United States Patent 7,250,496 (BIOINFORMATICALLY DETECTABLE GROUP OF NOVEL REGULATORY GENES AND USES THEREOF) - sequence listing, part 20

SEQ ID NO: 834180 - RNA, 23 nt, Human
uagcucuaaaauuuuucagagaa

SEQ ID NO: 834181 - RNA, 21 nt, Human
uauauacaaaacaaaguaucg

SEQ ID NO: 834182 - RNA, 24 nt, Human
uaugcagacucacacauguacgga

SEQ ID NO: 834183 - RNA, 22 nt, Human
ucaaaauaacauguagacacag

SEQ ID NO: 834184 - RNA, 26 nt, Human
ucaaaauaacauguagacacagaauc

SEQ ID NO: 834185 - RNA, 20 nt, Human
ucaaacaauuaaauacaaac

SEQ ID NO: 834186 - RNA, 18 nt, Human
ucacggucacuauaccua

SEQ ID NO: 834187 - RNA, 21 nt, Human
uccaaaaauguccaauaacca

SEQ ID NO: 834188 - RNA, 23 nt, Human
ugaacaugcaucacacauacaua

SEQ ID NO: 834189 - RNA, 24 nt, Human
ugaauccuagaucugaugacuccu

SEQ ID NO: 834190 - RNA, 21 nt, Human
ugaguauaaaguaagaagccu

SEQ ID NO: 834191 - RNA, 18 nt, Human
ugcacagaguuaugguca

SEQ ID NO: 834192 - RNA, 19 nt, Human
uggaaaaugaugaauccua

SEQ ID NO: 834193 - RNA, 20 nt, Human
uggcagaagggaaagauggg

SEQ ID NO: 834194 - RNA, 19 nt, Human
uggcuucacacagcagcag

SEQ ID NO: 834195 - RNA, 18 nt, Human
uguccaauaaccaagugc

SEQ ID NO: 834196 - RNA, 23 nt, Human
uuaugcagacucacacauguacg

SEQ ID NO: 834197 - RNA, 21 nt, Human
uucacggucacuauaccuagc

SEQ ID NO: 834198 - RNA, 18 nt, Human
uucgaaaguuaugcagac

SEQ ID NO: 834199 - RNA, 19 nt, Human
uuucauuuauuuuucccuc

SEQ ID NO: 834200 - RNA, 21 nt, Human
uuuuuuuuuuuuauagggauc

SEQ ID NO: 834201 - RNA, 25 nt, Human
uuuuuuuuuuuuuuuuuuauagggg

SEQ ID NO: 834202 - RNA, 24 nt, Human
auccaaguuacaaacaauuuaaaa

SEQ ID NO: 834203 - RNA, 22 nt, Human
auuagugauuauaauuuuuccu

SEQ ID NO: 834204 - RNA, 19 nt, Human
caaguuacaaacaauuuaa

SEQ ID NO: 834205 - RNA, 22 nt, Human
ccugcacaucacugugcauaua

SEQ ID NO: 834206 - RNA, 24 nt, Human
ccuuuccccaaaagaaaaaaaaaa

SEQ ID NO: 834207 - RNA, 22 nt, Human
cuuuagcaggcaagcaauuugu

SEQ ID NO: 834208 - RNA, 21 nt, Human
uaaaaagaaccaagauuagug

SEQ ID NO: 834209 - RNA, 19 nt, Human
uaaaacccuacaaacauug

SEQ ID NO: 834210 - RNA, 20 nt, Human
uaaaacccuacaaacauugg

SEQ ID NO: 834211 - RNA, 26 nt, Human
uauaauuuuuccuucccuuuccccaa

SEQ ID NO: 834212 - RNA, 21 nt, Human
uccccaaaagaaaaaaaaaaa

SEQ ID NO: 834213 - RNA, 26 nt, Human
ucccuuuccccaaaagaaaaaaaaaa

SEQ ID NO: 834214 - RNA, 19 nt, Human
uccugcacaucacugugca

SEQ ID NO: 834215 - RNA, 21 nt, Human
uccugcacaucacugugcaua

SEQ ID NO: 834216 - RNA, 20 nt, Human
ugcacaucacugugcauaua

SEQ ID NO: 834217 - RNA, 21 nt, Human
uuagugauuauaauuuuuccu

SEQ ID NO: 834218 - RNA, 22 nt, Human
aaaaacauuuaaaaaaugacug

SEQ ID NO: 834219 - RNA, 22 nt, Human
aauaugaaaguacacauaugug

SEQ ID NO: 834220 - RNA, 20 nt, Human
aaugaauuugauacaucauc

SEQ ID NO: 834221 - RNA, 21 nt, Human
acacugagacuuccugugcac

SEQ ID NO: 834222 - RNA, 18 nt, Human
acaggguuucaccauguu

SEQ ID NO: 834223 - RNA, 23 nt, Human
acaggguuucaccauguuggcca

SEQ ID NO: 834224 - RNA, 24 nt, Human
acaggguuucaccauguuggccag

SEQ ID NO: 834225 - RNA, 20 nt, Human
accacgcccggccaaaaaca

SEQ ID NO: 834226 - RNA, 18 nt, Human
accauguuggccaggcug

SEQ ID NO: 834227 - RNA, 24 nt, Human
accgcgccugccgccugccucagc

SEQ ID NO: 834228 - RNA, 18 nt, Human
acuuacauuggcagugga

SEQ ID NO: 834229 - RNA, 24 nt, Human
agaaaagaccccuucacacugaga

SEQ ID NO: 834230 - RNA, 19 nt, Human
agauuacaggcaugagcca

SEQ ID NO: 834231 - RNA, 22 nt, Human
agauuacaggcaugagccacca

SEQ ID NO: 834232 - RNA, 24 nt, Human
aggugauccaccugccuuggccuc

SEQ ID NO: 834233 - RNA, 18 nt, Human
aguggcugggauuacagg

SEQ ID NO: 834234 - RNA, 19 nt, Human
aguggcugggauuacaggc

SEQ ID NO: 834235 - RNA, 19 nt, Human
aguggcugggauuacaggc

SEQ ID NO: 834236 - RNA, 19 nt, Human
aucucuuacaaaguaaauu

SEQ ID NO: 834237 - RNA, 22 nt, Human
caagcgauucuccugccucagc

SEQ ID NO: 834238 - RNA, 24 nt, Human
caauguacugagauuacaggcaug

SEQ ID NO: 834239 - RNA, 24 nt, Human
caauuuuuuguauuuuuaguagag

SEQ ID NO: 834240 - RNA, 25 nt, Human
caauuuuuuguauuuuuaguagaga

SEQ ID NO: 834241 - RNA, 21 nt, Human
caccauguuggccaggcuggc

SEQ ID NO: 834242 - RNA, 24 nt, Human
caccauguuggccaggcuggccuc

SEQ ID NO: 834243 - RNA, 27 nt, Human
caccauguuggccaggcuggccucgaa

SEQ ID NO: 834244 - RNA, 18 nt, Human
cacugcaaucucugccuc

SEQ ID NO: 834245 - RNA, 20 nt, Human
cacugcaaucucugccucgc

SEQ ID NO: 834246 - RNA, 23 nt, Human
cagcccgccggggagcggccucg

SEQ ID NO: 834247 - RNA, 21 nt, Human
caggcgcccaccaucacgccc

SEQ ID NO: 834248 - RNA, 24 nt, Human
caggguuucaccauguuggccagg

SEQ ID NO: 834249 - RNA, 20 nt, Human
cauggaaaucuacaaguaac

SEQ ID NO: 834250 - RNA, 24 nt, Human
cauguuggccaggcuggccucgaa

SEQ ID NO: 834251 - RNA, 24 nt, Human
ccaauguacugagauuacaggcau

SEQ ID NO: 834252 - RNA, 18 nt, Human
ccaccaucacgcccggcc

SEQ ID NO: 834253 - RNA, 18 nt, Human
ccaggcuggaguacaaug

SEQ ID NO: 834254 - RNA, 24 nt, Human
cccacauuccuaucagccuaaggc

SEQ ID NO: 834255 - RNA, 25 nt, Human
ccccucgcgggccgggccagggggc

SEQ ID NO: 834256 - RNA, 22 nt, Human
cccggccaaaaacauuuaaaaa

SEQ ID NO: 834257 - RNA, 18 nt, Human
ccgccggggagcggccuc

SEQ ID NO: 834258 - RNA, 30 nt, Human
ccggccaaaaacauuuaaaaaaugacuguu

SEQ ID NO: 834259 - RNA, 21 nt, Human
ccucagccucuggaguggcug

SEQ ID NO: 834260 - RNA, 24 nt, Human
ccucgcagguucaagcgauucucc

SEQ ID NO: 834261 - RNA, 24 nt, Human
ccugccucagccucuggaguggcu

SEQ ID NO: 834262 - RNA, 21 nt, Human
ccugccuuggccucccaaugu

SEQ ID NO: 834263 - RNA, 23 nt, Human
ccugugcaccgcgccugccgccu

SEQ ID NO: 834264 - RNA, 18 nt, Human
cgccggggagcggccucg

SEQ ID NO: 834265 - RNA, 20 nt, Human
cgcuaagugaacgcucgcgc

SEQ ID NO: 834266 - RNA, 24 nt, Human
cgcucuuguuguccaggcuggagu

SEQ ID NO: 834267 - RNA, 26 nt, Human
cggccaaaaacauuuaaaaaaugacu

SEQ ID NO: 834268 - RNA, 18 nt, Human
cucacugcaaucucugcc

SEQ ID NO: 834269 - RNA, 19 nt, Human
cucacugcaaucucugccu

SEQ ID NO: 834270 - RNA, 24 nt, Human
cucaggugauccaccugccuuggc

SEQ ID NO: 834271 - RNA, 21 nt, Human
cucccaauguacugagauuac

SEQ ID NO: 834272 - RNA, 19 nt, Human
cucggcccgcuccacccgg

SEQ ID NO: 834273 - RNA, 19 nt, Human
cucuguccgcggagacgga

SEQ ID NO: 834274 - RNA, 21 nt, Human
cucuuguuguccaggcuggag

SEQ ID NO: 834275 - RNA, 24 nt, Human
cugcaaucucugccucgcagguuc

SEQ ID NO: 834276 - RNA, 21 nt, Human
cuggaguggcugggauuacag

SEQ ID NO: 834277 - RNA, 23 nt, Human
cuugaccucaggugauccaccug

SEQ ID NO: 834278 - RNA, 24 nt, Human
gaccucaggugauccaccugccuu

SEQ ID NO: 834279 - RNA, 18 nt, Human
gauuacaggcaugagcca

SEQ ID NO: 834280 - RNA, 22 nt, Human
gauuacaggcaugagccaccac

SEQ ID NO: 834281 - RNA, 20 nt, Human
gauucuccugccucagccuc

SEQ ID NO: 834282 - RNA, 21 nt, Human
gccaaaaacauuuaaaaaaug

SEQ ID NO: 834283 - RNA, 23 nt, Human
gcccggccaauuuuuuguauuuu

SEQ ID NO: 834284 - RNA, 20 nt, Human
gccucagccucuggaguggc

SEQ ID NO: 834285 - RNA, 21 nt, Human
gcucacugcaaucucugccuc

SEQ ID NO: 834286 - RNA, 19 nt, Human
gcuggaguacaauggcuug

SEQ ID NO: 834287 - RNA, 20 nt, Human
gggcucggcccgcuccaccc

SEQ ID NO: 834288 - RNA, 22 nt, Human
ggguuucaccauguuggccagg

SEQ ID NO: 834289 - RNA, 23 nt, Human
guacauuuuaaaaucaaauauga

SEQ ID NO: 834290 - RNA, 21 nt, Human
guacugagauuacaggcauga

SEQ ID NO: 834291 - RNA, 19 nt, Human
guccaggcuggaguacaau

SEQ ID NO: 834292 - RNA, 24 nt, Human
gugauccaccugccuuggccuccc

SEQ ID NO: 834293 - RNA, 18 nt, Human
guggcugggauuacaggc

SEQ ID NO: 834294 - RNA, 19 nt, Human
uaaagccccucaugcuuuc

SEQ ID NO: 834295 - RNA, 23 nt, Human
uacaggcaugagccaccacgccc

SEQ ID NO: 834296 - RNA, 22 nt, Human
uacaucaucagcaugaagugaa

SEQ ID NO: 834297 - RNA, 22 nt, Human
uagagacaggguuucaccaugu

SEQ ID NO: 834298 - RNA, 24 nt, Human
uaguagagacaggguuucaccaug

SEQ ID NO: 834299 - RNA, 25 nt, Human
uaguagagacaggguuucaccaugu

SEQ ID NO: 834300 - RNA, 23 nt, Human
uauauuuggucaagaaaacccac

SEQ ID NO: 834301 - RNA, 19 nt, Human
ucacugcaaucucugccuc

SEQ ID NO: 834302 - RNA, 20 nt, Human
ucacugcaaucucugccucg

SEQ ID NO: 834303 - RNA, 24 nt, Human
ucacugcaaucucugccucgcagg

SEQ ID NO: 834304 - RNA, 18 nt, Human
ucagccucuggaguggcu

SEQ ID NO: 834305 - RNA, 21 nt, Human
ucaggugauccaccugccuug

SEQ ID NO: 834306 - RNA, 24 nt, Human
ucccaauguacugagauuacaggc

SEQ ID NO: 834307 - RNA, 21 nt, Human
ucgcagguucaagcgauucuc

SEQ ID NO: 834308 - RNA, 24 nt, Human
ucgcagguucaagcgauucuccug

SEQ ID NO: 834309 - RNA, 23 nt, Human
ucgcucuuguuguccaggcugga

SEQ ID NO: 834310 - RNA, 23 nt, Human
ucuccugccucagccucuggagu

SEQ ID NO: 834311 - RNA, 24 nt, Human
ucuggaguggcugggauuacaggc

SEQ ID NO: 834312 - RNA, 19 nt, Human
ugaccucaggugauccacc

SEQ ID NO: 834313 - RNA, 24 nt, Human
ugaccucaggugauccaccugccu

SEQ ID NO: 834314 - RNA, 22 nt, Human
ugagauuacaggcaugagccac

SEQ ID NO: 834315 - RNA, 23 nt, Human
ugagauuacaggcaugagccacc

SEQ ID NO: 834316 - RNA, 24 nt, Human
ugagauuacaggcaugagccacca

SEQ ID NO: 834317 - RNA, 24 nt, Human
ugagauuacaggcaugagccacca

SEQ ID NO: 834318 - RNA, 24 nt, Human
ugccucagccucuggaguggcugg

SEQ ID NO: 834319 - RNA, 20 nt, Human
ugccuuggccucccaaugua

SEQ ID NO: 834320 - RNA, 18 nt, Human
uggcaguggagagaaaag

SEQ ID NO: 834321 - RNA, 20 nt, Human
uggcaguggagagaaaagga

SEQ ID NO: 834322 - RNA, 24 nt, Human
uggccaggcuggccucgaacucuu

SEQ ID NO: 834323 - RNA, 21 nt, Human
uggcucacugcaaucucugcc

SEQ ID NO: 834324 - RNA, 24 nt, Human
uggcucacugcaaucucugccucg

SEQ ID NO: 834325 - RNA, 21 nt, Human
ugggauuacaggcgcccacca

SEQ ID NO: 834326 - RNA, 22 nt, Human
ugggauuacaggcgcccaccau

SEQ ID NO: 834327 - RNA, 25 nt, Human
uguccaggcuggaguacaauggcuu

SEQ ID NO: 834328 - RNA, 18 nt, Human
uuaaagcaguagagcacc

SEQ ID NO: 834329 - RNA, 19 nt, Human
uuaaagcaguagagcaccu

SEQ ID NO: 834330 - RNA, 21 nt, Human
uuagaugcugauauauuuggu

SEQ ID NO: 834331 - RNA, 24 nt, Human
uuaguagagacaggguuucaccau

SEQ ID NO: 834332 - RNA, 21 nt, Human
uucaagcgauucuccugccuc

SEQ ID NO: 834333 - RNA, 23 nt, Human
uucaagcgauucuccugccucag

SEQ ID NO: 834334 - RNA, 24 nt, Human
uucaagcgauucuccugccucagc

SEQ ID NO: 834335 - RNA, 24 nt, Human
uucgcucuuguuguccaggcugga

SEQ ID NO: 834336 - RNA, 18 nt, Human
uuggcaguggagagaaaa

SEQ ID NO: 834337 - RNA, 21 nt, Human
uuucaccauguuggccaggcu

SEQ ID NO: 834338 - RNA, 22 nt, Human
uuucgcucuuguuguccaggcu

SEQ ID NO: 834339 - RNA, 24 nt, Human
uuucgcucuuguuguccaggcugg

SEQ ID NO: 834340 - RNA, 24 nt, Human
uuuuuaguagagacaggguuucac

SEQ ID NO: 834341 - RNA, 21 nt, Human
uuuuuguauuuuuaguagaga

SEQ ID NO: 834342 - RNA, 24 nt, Human
uuuuuuguauuuuuaguagagaca

SEQ ID NO: 834343 - RNA, 22 nt, Human
aaaaaauaaaaacagcauggac

SEQ ID NO: 834344 - RNA, 20 nt, Human
aaaaauaaaaacagcaugga

SEQ ID NO: 834345 - RNA, 21 nt, Human
aaaauacuuuacaagguacag

SEQ ID NO: 834346 - RNA, 19 nt, Human
aaacauagauuccccaccc

SEQ ID NO: 834347 - RNA, 19 nt, Human
aacuguguuuucagcccuu

SEQ ID NO: 834348 - RNA, 19 nt, Human
aacuguguuuucagcccuu

SEQ ID NO: 834349 - RNA, 19 nt, Human
acaauuacggagauaaaaa

SEQ ID NO: 834350 - RNA, 23 nt, Human
acuuuaggaguauuaggccugga

SEQ ID NO: 834351 - RNA, 25 nt, Human
agauaaaaaauaaaaacagcaugga

SEQ ID NO: 834352 - RNA, 18 nt, Human
aggccuccgagugcccag

SEQ ID NO: 834353 - RNA, 22 nt, Human
agugcccaguuacugaggcagc

SEQ ID NO: 834354 - RNA, 21 nt, Human
auaaaauacaaagguggcugg

SEQ ID NO: 834355 - RNA, 19 nt, Human
caaaacucaaaacaguacu

SEQ ID NO: 834356 - RNA, 18 nt, Human
cagugagcacucauagaa

SEQ ID NO: 834357 - RNA, 19 nt, Human
ccaaggccuccgagugccc

SEQ ID NO: 834358 - RNA, 21 nt, Human
ccaaucugccugcccugcccu

SEQ ID NO: 834359 - RNA, 25 nt, Human
cccaacucuuacuuuaggaguauua

SEQ ID NO: 834360 - RNA, 18 nt, Human
ccccaaggagcaucaccc

SEQ ID NO: 834361 - RNA, 21 nt, Human
ccccaaggagcaucacccagg

SEQ ID NO: 834362 - RNA, 21 nt, Human
ccccaugcaauaaagcaaguu

SEQ ID NO: 834363 - RNA, 21 nt, Human
cucuagguagggccccaagga

SEQ ID NO: 834364 - RNA, 23 nt, Human
cugucuguccuccagaacccgug

SEQ ID NO: 834365 - RNA, 22 nt, Human
cuuagugaugguagcucuccuu

SEQ ID NO: 834366 - RNA, 22 nt, Human
cuuagugaugguagcucuccuu

SEQ ID NO: 834367 - RNA, 19 nt, Human
gagaucacugaagucugaa

SEQ ID NO: 834368 - RNA, 19 nt, Human
gccaaggccuccgagugcc

SEQ ID NO: 834369 - RNA, 20 nt, Human
ggacaaaagucagucccucu

SEQ ID NO: 834370 - RNA, 20 nt, Human
guggagaaggcacuuguguu

SEQ ID NO: 834371 - RNA, 23 nt, Human
guggagaaggcacuuguguuuuc

SEQ ID NO: 834372 - RNA, 21 nt, Human
uaaaauacuuuacaagguaca

SEQ ID NO: 834373 - RNA, 26 nt, Human
uaagcagcagauaaaauacuuuacaa

SEQ ID NO: 834374 - RNA, 24 nt, Human
uacagcacaguuguauugaagaaa

SEQ ID NO: 834375 - RNA, 20 nt, Human
uagaauugcugucuguccuc

SEQ ID NO: 834376 - RNA, 21 nt, Human
uagggccccaaggagcaucac

SEQ ID NO: 834377 - RNA, 21 nt, Human
uaucucagugagcacucauag

SEQ ID NO: 834378 - RNA, 29 nt, Human
ucagcccuuagugaugguagcucuccuuu

SEQ ID NO: 834379 - RNA, 19 nt, Human
ucauuccacaaauaagcag

SEQ ID NO: 834380 - RNA, 19 nt, Human
ucccucuagguagggcccc

SEQ ID NO: 834381 - RNA, 21 nt, Human
ucccucuagguagggccccaa

SEQ ID NO: 834382 - RNA, 19 nt, Human
uccgagugcccaguuacug

SEQ ID NO: 834383 - RNA, 26 nt, Human
uccuccaaacauauaaaucugaguga

SEQ ID NO: 834384 - RNA, 19 nt, Human
uccuccagaacccgugcca

SEQ ID NO: 834385 - RNA, 21 nt, Human
ucugccugcccugcccuaccc

SEQ ID NO: 834386 - RNA, 18 nt, Human
ugaauugcaccguggaga

SEQ ID NO: 834387 - RNA, 18 nt, Human
ugccccaugcaauaaagc

SEQ ID NO: 834388 - RNA, 24 nt, Human
ugcccugcccuacccucccccuuu

SEQ ID NO: 834389 - RNA, 20 nt, Human
uggggaaaaacguugaguaa

SEQ ID NO: 834390 - RNA, 25 nt, Human
ugugucaauggacaaaagucagucg

SEQ ID NO: 834391 - RNA, 18 nt, Human
uucagcccuuagugaugg

SEQ ID NO: 834392 - RNA, 18 nt, Human
uucagcccuuagugaugg

SEQ ID NO: 834393 - RNA, 30 nt, Human
uucagcccuuagugaugguagcucuccuuu

SEQ ID NO: 834394 - RNA, 23 nt, Human
uuguauugaagaaaaaaaggacc

SEQ ID NO: 834395 - RNA, 22 nt, Human
uuuaacuguguuuucagcccuu

SEQ ID NO: 834396 - RNA, 22 nt, Human
uuuaacuguguuuucagcccuu

SEQ ID NO: 834397 - RNA, 21 nt, Human
uuuucagcccuuagugauggu

SEQ ID NO: 834398 - RNA, 21 nt, Human
uuuucagcccuuagugauggu

SEQ ID NO: 834399 - RNA, 21 nt, Human
uuuuuuuuuuuuuuuuugguu

SEQ ID NO: 834400 - RNA, 23 nt, Human
uuuuuuuuuuuuuuuuugguugg

SEQ ID NO: 834401 - RNA, 23 nt, Human
uuuuuuuuuuuuuuuuuuuuggg

SEQ ID NO: 834402 - RNA, 21 nt, Human
aaacaagacagaagcaauuga

SEQ ID NO: 834403 - RNA, 18 nt, Human
acaaaacaagacagaagc

SEQ ID NO: 834404 - RNA, 19 nt, Human
agaaacaaaacaagacaga

SEQ ID NO: 834405 - RNA, 19 nt, Human
agcagcaugaugcuugaaa

SEQ ID NO: 834406 - RNA, 22 nt, Human
aggaggcugcagccgggauucc

SEQ ID NO: 834407 - RNA, 22 nt, Human
aggcugcagccgggauuccuuc

SEQ ID NO: 834408 - RNA, 25 nt, Human
agguggaguauguauagauggucau

SEQ ID NO: 834409 - RNA, 21 nt, Human
aguagguuuccuuggugguuu

SEQ ID NO: 834410 - RNA, 24 nt, Human
aucucucuauuuuaaaauauaaag

SEQ ID NO: 834411 - RNA, 19 nt, Human
caaaacaagacagaagcaa

SEQ ID NO: 834412 - RNA, 22 nt, Human
caagacagaagcaauugauuuu

SEQ ID NO: 834413 - RNA, 22 nt, Human
cacauacucacugugucuacuc

SEQ ID NO: 834414 - RNA, 23 nt, Human
cacccgaucaguugucacacuga

SEQ ID NO: 834415 - RNA, 22 nt, Human
cacugugucuacucuacagaau

SEQ ID NO: 834416 - RNA, 21 nt, Human
caguucaacuacucuuauuua

SEQ ID NO: 834417 - RNA, 20 nt, Human
cauauuggagaagagaaggu

SEQ ID NO: 834418 - RNA, 18 nt, Human
ccauagaaccacaaaguu

SEQ ID NO: 834419 - RNA, 22 nt, Human
ccuggaacucuuuuucucaguc

SEQ ID NO: 834420 - RNA, 24 nt, Human
ccuucuuuuuccuggaacucuuuu

SEQ ID NO: 834421 - RNA, 22 nt, Human
ccuugcgugcuggauuccucag

SEQ ID NO: 834422 - RNA, 21 nt, Human
cugaggcucucaauccaguga

SEQ ID NO: 834423 - RNA, 21 nt, Human
cuuauaaaagagguccacaua

SEQ ID NO: 834424 - RNA, 18 nt, Human
gaagguggaguauguaua

SEQ ID NO: 834425 - RNA, 18 nt, Human
gagcagcauuggugaagc

SEQ ID NO: 834426 - RNA, 21 nt, Human
gagcagcauuggugaagcuua

SEQ ID NO: 834427 - RNA, 25 nt, Human
gauaugcacacaugcacgcaaucuu

SEQ ID NO: 834428 - RNA, 25 nt, Human
gauuccuucuuuuuccuggaacucu

SEQ ID NO: 834429 - RNA, 18 nt, Human
gccacaauugcauugucc

SEQ ID NO: 834430 - RNA, 21 nt, Human
gcuuucuucuucagaaauguu

SEQ ID NO: 834431 - RNA, 24 nt, Human
ggagcagcauuggugaagcuuaaa

SEQ ID NO: 834432 - RNA, 25 nt, Human
gugccacaauugcauuguccaaaaa

SEQ ID NO: 834433 - RNA, 18 nt, Human
guguaauacaacacagga

SEQ ID NO: 834434 - RNA, 20 nt, Human
uaaaggaaggcaggaggcug

SEQ ID NO: 834435 - RNA, 20 nt, Human
uacuuaaaaaaaauacagaa

SEQ ID NO: 834436 - RNA, 22 nt, Human
uauaaaggaaggcaggaggcug

SEQ ID NO: 834437 - RNA, 24 nt, Human
uauucuuuauuuagaaacaaaaca

SEQ ID NO: 834438 - RNA, 20 nt, Human
uauuugguugccacaguacc

SEQ ID NO: 834439 - RNA, 21 nt, Human
ucacaugguuguguucuugcc

SEQ ID NO: 834440 - RNA, 22 nt, Human
ucacugugucuacucuacagaa

SEQ ID NO: 834441 - RNA, 24 nt, Human
uccgauguccuugcgugcuggauu

SEQ ID NO: 834442 - RNA, 22 nt, Human
ucucuauuuuaaaauauaaagg

SEQ ID NO: 834443 - RNA, 21 nt, Human
ucuuucgcuuuuuuuuuuuuu

SEQ ID NO: 834444 - RNA, 26 nt, Human
ugaaaagcaguuucagugcuagccca

SEQ ID NO: 834445 - RNA, 21 nt, Human
ugaagcuuaaacuucucucuc

SEQ ID NO: 834446 - RNA, 24 nt, Human
ugaaguuguacauauuuccauugg

SEQ ID NO: 834447 - RNA, 20 nt, Human
ugaaugccauagaaccacaa

SEQ ID NO: 834448 - RNA, 20 nt, Human
ugauuuuaauccaaaaugua

SEQ ID NO: 834449 - RNA, 20 nt, Human
ugccauagaaccacaaaguu

SEQ ID NO: 834450 - RNA, 26 nt, Human
ugcuagcccaccuccgauguccuugc

SEQ ID NO: 834451 - RNA, 18 nt, Human
ugcuaguaaguucaauag

SEQ ID NO: 834452 - RNA, 24 nt, Human
uggcuaauauguguaauacaacac

SEQ ID NO: 834453 - RNA, 21 nt, Human
ugucaaaugaugaaugccaua

SEQ ID NO: 834454 - RNA, 22 nt, Human
ugucacacugacauggugcugc

SEQ ID NO: 834455 - RNA, 19 nt, Human
uguccaaaaaugucaugca

SEQ ID NO: 834456 - RNA, 30 nt, Human
uguuuguuuguuuuguuuuguuuuuaauuu

SEQ ID NO: 834457 - RNA, 22 nt, Human
uuacuuaaaaaaaauacagaaa

SEQ ID NO: 834458 - RNA, 21 nt, Human
uuagcacaacugcagucuuuc

SEQ ID NO: 834459 - RNA, 18 nt, Human
uucaauaggagcugauug

SEQ ID NO: 834460 - RNA, 22 nt, Human
uugccacaguaccccuugaagc

SEQ ID NO: 834461 - RNA, 23 nt, Human
uuggugaagcuuaaacuucucuc

SEQ ID NO: 834462 - RNA, 20 nt, Human
uuguuuguuuguuuuguuuu

SEQ ID NO: 834463 - RNA, 18 nt, Human
uuuguuuuguuuuguuuu

SEQ ID NO: 834464 - RNA, 24 nt, Human
uuuuuccuggaacucuuuuucuca

SEQ ID NO: 834465 - RNA, 22 nt, Human
uuuuuuguucauuuuuggagua

SEQ ID NO: 834466 - RNA, 19 nt, Human
uuuuuuuuuuuuuguucau

SEQ ID NO: 834467 - RNA, 21 nt, Human
aaaaaaaggcuccacuuggug

SEQ ID NO: 834468 - RNA, 20 nt, Human
aaacaguaguaaacaauuuc

SEQ ID NO: 834469 - RNA, 25 nt, Human
aaccaaaaaauaaauaguguguacu

SEQ ID NO: 834470 - RNA, 19 nt, Human
aagcugaccgggagcccuc

SEQ ID NO: 834471 - RNA, 20 nt, Human
aauaaaaauaacgggaggga

SEQ ID NO: 834472 - RNA, 22 nt, Human
acaagaaagagcuguaaacagc

SEQ ID NO: 834473 - RNA, 25 nt, Human
accagaggcgcgagcccuccuccuc

SEQ ID NO: 834474 - RNA, 18 nt, Human
accccacacccaggugcc

SEQ ID NO: 834475 - RNA, 18 nt, Human
acccggagaccgggcuuc

SEQ ID NO: 834476 - RNA, 21 nt, Human
acuggauggcaggacaagaaa

SEQ ID NO: 834477 - RNA, 18 nt, Human
agaaagggguggggagga

SEQ ID NO: 834478 - RNA, 18 nt, Human
agaacacaacgacagcag

SEQ ID NO: 834479 - RNA, 18 nt, Human
agagaugggucaggaagg

SEQ ID NO: 834480 - RNA, 21 nt, Human
agagucuggaggcgucuccuc

SEQ ID NO: 834481 - RNA, 18 nt, Human
agaucuggaggcuggacc

SEQ ID NO: 834482 - RNA, 22 nt, Human
agcagguuaggaaacuccacaa

SEQ ID NO: 834483 - RNA, 19 nt, Human
agccaggggcuggcagcag

SEQ ID NO: 834484 - RNA, 21 nt, Human
aggacaagaaagagcuguaaa

SEQ ID NO: 834485 - RNA, 19 nt, Human
aggcagcaggccccccagg

SEQ ID NO: 834486 - RNA, 20 nt, Human
agggacaggggaccagagaa

SEQ ID NO: 834487 - RNA, 21 nt, Human
auaaaaauaacgggagggaaa

SEQ ID NO: 834488 - RNA, 21 nt, Human
cacagagggaaggacgaggga

SEQ ID NO: 834489 - RNA, 19 nt, Human
cacagaucccgagugaccc

SEQ ID NO: 834490 - RNA, 24 nt, Human
cacccaggugcccaugccgagggc

SEQ ID NO: 834491 - RNA, 19 nt, Human
cacggcccccaggcagcag

SEQ ID NO: 834492 - RNA, 21 nt, Human
cacugaccgagguucuggaac

SEQ ID NO: 834493 - RNA, 24 nt, Human
cagacgcgugcucgcucugggccc

SEQ ID NO: 834494 - RNA, 19 nt, Human
cagagcacacagagggaag

SEQ ID NO: 834495 - RNA, 22 nt, Human
cagaggcgcgagcccuccuccu

SEQ ID NO: 834496 - RNA, 18 nt, Human
cagcacagcgagggucuc

SEQ ID NO: 834497 - RNA, 21 nt, Human
cagcacagcgagggucucugg

SEQ ID NO: 834498 - RNA, 21 nt, Human
cagcuccaaaauccugccugc

SEQ ID NO: 834499 - RNA, 19 nt, Human
caggggaccagagaaagcc

SEQ ID NO: 834500 - RNA, 19 nt, Human
ccagcuccaaaauccugcc

SEQ ID NO: 834501 - RNA, 23 nt, Human
cccaggccaccccggcccaggga

SEQ ID NO: 834502 - RNA, 23 nt, Human
ccccacacccaggugcccaugcc

SEQ ID NO: 834503 - RNA, 18 nt, Human
ccccuggucuuggcaucu

SEQ ID NO: 834504 - RNA, 22 nt, Human
cccgagugacccaguucagucc

SEQ ID NO: 834505 - RNA, 20 nt, Human
ccucauacucggcuugucuc

SEQ ID NO: 834506 - RNA, 27 nt, Human
ccucccacgaaccaggcugauagggau

SEQ ID NO: 834507 - RNA, 22 nt, Human
ccuuuaacaaaugagaaaagaa

SEQ ID NO: 834508 - RNA, 24 nt, Human
cgagggucucuggccacggccccc

SEQ ID NO: 834509 - RNA, 23 nt, Human
cggcccccaggcagcaggccccc

SEQ ID NO: 834510 - RNA, 22 nt, Human
cucuccacaacucccuuucaga

SEQ ID NO: 834511 - RNA, 23 nt, Human
cucuccacaacucccuuucagag

SEQ ID NO: 834512 - RNA, 23 nt, Human
cugcccagccaggggcuggcagc

SEQ ID NO: 834513 - RNA, 23 nt, Human
cuggacccagccacacccacugg

SEQ ID NO: 834514 - RNA, 20 nt, Human
cuggcagcagcacagcgagg

SEQ ID NO: 834515 - RNA, 24 nt, Human
cuguccauccugcaaggcaucgug

SEQ ID NO: 834516 - RNA, 22 nt, Human
cuuuuggacacugccuuuaaca

SEQ ID NO: 834517 - RNA, 21 nt, Human
gaacacaacgacagcagccgc

SEQ ID NO: 834518 - RNA, 19 nt, Human
gagcccuccuccuccaccc

SEQ ID NO: 834519 - RNA, 23 nt, Human
gagggggaccccaagcagguucc

SEQ ID NO: 834520 - RNA, 20 nt, Human
gaucugugagcccacacccc

SEQ ID NO: 834521 - RNA, 23 nt, Human
gcagcaggccccccaggguccug

SEQ ID NO: 834522 - RNA, 20 nt, Human
gccagacgcgugcucgcucu

SEQ ID NO: 834523 - RNA, 24 nt, Human
gcccccagacagggaaacacugac

SEQ ID NO: 834524 - RNA, 18 nt, Human
gccccgagaccagaggcg

SEQ ID NO: 834525 - RNA, 21 nt, Human
gccgagggcacuuucugccca

SEQ ID NO: 834526 - RNA, 19 nt, Human
gcucugggcccugccccca

SEQ ID NO: 834527 - RNA, 23 nt, Human
gcuggcagcagcacagcgagggu

SEQ ID NO: 834528 - RNA, 23 nt, Human
ggaaggacaaggacauauucaga

SEQ ID NO: 834529 - RNA, 19 nt, Human
gggacaggggaccagagaa

SEQ ID NO: 834530 - RNA, 20 nt, Human
gggcugguucagcccuuugg

SEQ ID NO: 834531 - RNA, 20 nt, Human
ggggaggauucgaacacagg

SEQ ID NO: 834532 - RNA, 21 nt, Human
gggguggggaggauucgaaca

SEQ ID NO: 834533 - RNA, 25 nt, Human
gucuccucuccacaacucccuuuca

SEQ ID NO: 834534 - RNA, 25 nt, Human
uaaaauuaaaauaagaaaaaaaaag

SEQ ID NO: 834535 - RNA, 19 nt, Human
uaagccccuggucuuggca

SEQ ID NO: 834536 - RNA, 20 nt, Human
uagaaauaagccccuggucu

SEQ ID NO: 834537 - RNA, 22 nt, Human
uagaaauaagccccuggucuug

SEQ ID NO: 834538 - RNA, 20 nt, Human
uagaacacaacgacagcagc

SEQ ID NO: 834539 - RNA, 18 nt, Human
uaggaagagcccucccac

SEQ ID NO: 834540 - RNA, 20 nt, Human
ucagagcacacagagggaag

SEQ ID NO: 834541 - RNA, 21 nt, Human
uccaaaauccugccugccucu

SEQ ID NO: 834542 - RNA, 24 nt, Human
uccaaaauccugccugccucugac

SEQ ID NO: 834543 - RNA, 19 nt, Human
uccaccuuguucauuaaaa

SEQ ID NO: 834544 - RNA, 22 nt, Human
uccaccuuguucauuaaaauua

SEQ ID NO: 834545 - RNA, 22 nt, Human
ucccacgaaccaggcugauagg

SEQ ID NO: 834546 - RNA, 23 nt, Human
ucccuagaaauaagccccugguc

SEQ ID NO: 834547 - RNA, 21 nt, Human
ucccugucugucauccugucc

SEQ ID NO: 834548 - RNA, 27 nt, Human
uccugguugaggggcuggggguucacc

SEQ ID NO: 834549 - RNA, 21 nt, Human
ucugugagcccacaccccaga

SEQ ID NO: 834550 - RNA, 24 nt, Human
ugaccgggagcccucuguucacag

SEQ ID NO: 834551 - RNA, 18 nt, Human
ugagaaaagaaagcacca

SEQ ID NO: 834552 - RNA, 19 nt, Human
ugagaaaagaaagcaccaa

SEQ ID NO: 834553 - RNA, 19 nt, Human
ugagcccacaccccagaca

SEQ ID NO: 834554 - RNA, 23 nt, Human
ugagcccacaccccagacacagg

SEQ ID NO: 834555 - RNA, 18 nt, Human
ugcccucugggcauaggg

SEQ ID NO: 834556 - RNA, 18 nt, Human
ugccucacuccucuccuc

SEQ ID NO: 834557 - RNA, 23 nt, Human
ugcuccccuccuccuggcaccca

SEQ ID NO: 834558 - RNA, 18 nt, Human
uggcacccaggccacccc

SEQ ID NO: 834559 - RNA, 19 nt, Human
uggcagcagcacagcgagg

SEQ ID NO: 834560 - RNA, 24 nt, Human
uggcaggacaagaaagagcuguaa

SEQ ID NO: 834561 - RNA, 21 nt, Human
ugggguaugcuccccuccucc

SEQ ID NO: 834562 - RNA, 18 nt, Human
uguugggucaguacgggg

SEQ ID NO: 834563 - RNA, 21 nt, Human
uuaggaaacuccacaaagaaa

SEQ ID NO: 834564 - RNA, 18 nt, Human
uucagagugacuuagaga

SEQ ID NO: 834565 - RNA, 21 nt, Human
uucccuagaaauaagccccug

SEQ ID NO: 834566 - RNA, 22 nt, Human
uucccuagaaauaagccccugg

SEQ ID NO: 834567 - RNA, 22 nt, Human
uuccuggccccgagaccagagg

SEQ ID NO: 834568 - RNA, 23 nt, Human
uuccuggccccgagaccagaggc

SEQ ID NO: 834569 - RNA, 22 nt, Human
uucugagagucuggaggcgucu

SEQ ID NO: 834570 - RNA, 22 nt, Human
uugccucacuccucuccucacg

SEQ ID NO: 834571 - RNA, 18 nt, Human
uuucugcccagccagggg

SEQ ID NO: 834572 - RNA, 21 nt, Human
aaaaccucuucccuccuaccg

SEQ ID NO: 834573 - RNA, 18 nt, Human
aaccucuucccuccuacc

SEQ ID NO: 834574 - RNA, 20 nt, Human
aagcccggaaucccgaccga

SEQ ID NO: 834575 - RNA, 21 nt, Human
augucacuuucacucagugac

SEQ ID NO: 834576 - RNA, 21 nt, Human
caagcccggaaucccgaccga

SEQ ID NO: 834577 - RNA, 21 nt, Human
ccccggcuuucagccgccggg

SEQ ID NO: 834578 - RNA, 18 nt, Human
ccccuacucuucaagagc

SEQ ID NO: 834579 - RNA, 19 nt, Human
cccuccuaccgcagucgcc

SEQ ID NO: 834580 - RNA, 19 nt, Human
ccugccggaagcuccucca

SEQ ID NO: 834581 - RNA, 19 nt, Human
cgccggggccugccggaag

SEQ ID NO: 834582 - RNA, 23 nt, Human
cgccggggccugccggaagcucc

SEQ ID NO: 834583 - RNA, 21 nt, Human
cuucaagagccaacagccucu

SEQ ID NO: 834584 - RNA, 22 nt, Human
cuucauguugcauauguaaaau

SEQ ID NO: 834585 - RNA, 20 nt, Human
gaagcuccuccauauuaccc

SEQ ID NO: 834586 - RNA, 21 nt, Human
gaccagcacuucugccccggc

SEQ ID NO: 834587 - RNA, 22 nt, Human
gaccagcacuucugccccggcu

SEQ ID NO: 834588 - RNA, 25 nt, Human
gagccaacagccucugggcaaaaga

SEQ ID NO: 834589 - RNA, 23 nt, Human
gcccggaaucccgaccgagacca

SEQ ID NO: 834590 - RNA, 22 nt, Human
gugacuuuucaaaacucuacag

SEQ ID NO: 834591 - RNA, 21 nt, Human
uaaaaaaaaaacccaccuaca

SEQ ID NO: 834592 - RNA, 22 nt, Human
uaaaaaaaaaacccaccuacac

SEQ ID NO: 834593 - RNA, 24 nt, Human
uaaaaaaaaaacccaccuacacga

SEQ ID NO: 834594 - RNA, 20 nt, Human
uccaaaaccucuucccuccu

SEQ ID NO: 834595 - RNA, 22 nt, Human
uccaaaaccucuucccuccuac

SEQ ID NO: 834596 - RNA, 23 nt, Human
uccaaaaccucuucccuccuacc

SEQ ID NO: 834597 - RNA, 19 nt, Human
ugaagaacaauauaaagaa

SEQ ID NO: 834598 - RNA, 21 nt, Human
ugaugugugaaggagucuaug

SEQ ID NO: 834599 - RNA, 20 nt, Human
ugccacagugaugugugaag

SEQ ID NO: 834600 - RNA, 24 nt, Human
ugugaucaaaugcgugagguggcc

SEQ ID NO: 834601 - RNA, 25 nt, Human
uucaagagccaacagccucugggca

SEQ ID NO: 834602 - RNA, 20 nt, Human
uuuuuuuuuuuuuuuuuugg

SEQ ID NO: 834603 - RNA, 22 nt, Human
aaccaugccggcgaccgggccg

SEQ ID NO: 834604 - RNA, 21 nt, Human
accagcugccugcuugcacgc

SEQ ID NO: 834605 - RNA, 21 nt, Human
aggcagcuuugacagguggug

SEQ ID NO: 834606 - RNA, 23 nt, Human
aggcagcuuugacaggugguguc

SEQ ID NO: 834607 - RNA, 20 nt, Human
cagacagggugugagggcag

SEQ ID NO: 834608 - RNA, 18 nt, Human
cagcaggacggagaaacc

SEQ ID NO: 834609 - RNA, 19 nt, Human
cagcuucuggccuggcccu

SEQ ID NO: 834610 - RNA, 23 nt, Human
cagcuucuggccuggcccugcuu

SEQ ID NO: 834611 - RNA, 20 nt, Human
ccagcuucuggccuggcccu

SEQ ID NO: 834612 - RNA, 24 nt, Human
cccagagugagucugggaggugga

SEQ ID NO: 834613 - RNA, 25 nt, Human
ccccaaggccacauauaggauucug

SEQ ID NO: 834614 - RNA, 20 nt, Human
cccgccggcugcagcaggac

SEQ ID NO: 834615 - RNA, 18 nt, Human
ccgcuuuccccgucuggg

SEQ ID NO: 834616 - RNA, 19 nt, Human
cggagaaaccaugccggcg

SEQ ID NO: 834617 - RNA, 22 nt, Human
ggagguggaacccugugaaagg

SEQ ID NO: 834618 - RNA, 22 nt, Human
gggccagggcuugcugagggcc

SEQ ID NO: 834619 - RNA, 20 nt, Human
gugagucugggagguggaac

SEQ ID NO: 834620 - RNA, 23 nt, Human
uaggauucugggucccagaguga

SEQ ID NO: 834621 - RNA, 24 nt, Human
uauccucacugggagaguugaaaa

SEQ ID NO: 834622 - RNA, 18 nt, Human
ugacagguggugucuguu

SEQ ID NO: 834623 - RNA, 22 nt, Human
ugacagguggugucuguuggac

SEQ ID NO: 834624 - RNA, 22 nt, Human
uggaacccugugaaaggcagcu

SEQ ID NO: 834625 - RNA, 21 nt, Human
uggaggacuccgaguuggggc

SEQ ID NO: 834626 - RNA, 20 nt, Human
uggccuggcccugcuuucuu

SEQ ID NO: 834627 - RNA, 23 nt, Human
uggccuggcccugcuuucuucuc

SEQ ID NO: 834628 - RNA, 20 nt, Human
uggcucaggcugagcauguu

SEQ ID NO: 834629 - RNA, 23 nt, Human
ugguggcucaggcugagcauguu

SEQ ID NO: 834630 - RNA, 21 nt, Human
ugucaccuaccccaaggccac

SEQ ID NO: 834631 - RNA, 20 nt, Human
uucagaucaucaaaaagggg

SEQ ID NO: 834632 - RNA, 21 nt, Human
uugcacgcgacauuccuuccu

SEQ ID NO: 834633 - RNA, 21 nt, Human
uuuuuuuuuuuugguggcuca

SEQ ID NO: 834634 - RNA, 18 nt, Human
uuuuuuuuuuuuuuuuug

SEQ ID NO: 834635 - RNA, 20 nt, Human
uuuuuuuuuuuuuuuuuggu

SEQ ID NO: 834636 - RNA, 22 nt, Human
uuuuuuuuuuuuuuuuuggugg

SEQ ID NO: 834637 - RNA, 21 nt, Human
aaagucucccguuuuccauac

SEQ ID NO: 834638 - RNA, 18 nt, Human
aguggaagaauccccgga

SEQ ID NO: 834639 - RNA, 24 nt, Human
cuuuuagagaggccacuguacaaa

SEQ ID NO: 834640 - RNA, 21 nt, Human
gaaaauaccauuuagcuuaag

SEQ ID NO: 834641 - RNA, 21 nt, Human
gaguggaagaauccccggaau

SEQ ID NO: 834642 - RNA, 22 nt, Human
guacaaagucucccguuuucca

SEQ ID NO: 834643 - RNA, 27 nt, Human
guuaucugcaaaucaacucauuucagg

SEQ ID NO: 834644 - RNA, 22 nt, Human
uaucaaaauguaugcagguuuc

SEQ ID NO: 834645 - RNA, 25 nt, Human
ucucccguuuuccauacaggacaaa

SEQ ID NO: 834646 - RNA, 18 nt, Human
ucucuuaugaauguuuug

SEQ ID NO: 834647 - RNA, 25 nt, Human
ugcaaaucaacucauuucaggagug

SEQ ID NO: 834648 - RNA, 22 nt, Human
uguuuuguacuuuuagagaggc

SEQ ID NO: 834649 - RNA, 18 nt, Human
uuggagagcuugagaaaa

SEQ ID NO: 834650 - RNA, 19 nt, Human
uuuuuuuuuuuuggugguc

SEQ ID NO: 834651 - RNA, 18 nt, Human
uuuuuuuuuuuuuuuuug

SEQ ID NO: 834652 - RNA, 20 nt, Human
uuuuuuuuuuuuuuuuuggu

SEQ ID NO: 834653 - RNA, 22 nt, Human
uuuuuuuuuuuuuuuuuggugg

SEQ ID NO: 834654 - RNA, 19 nt, Human
aaaaaggggcuucaccuaa

SEQ ID NO: 834655 - RNA, 21 nt, Human
aaaacaccaaguaacauuucu

SEQ ID NO: 834656 - RNA, 24 nt, Human
aaacacgaaggggguucccccugg

SEQ ID NO: 834657 - RNA, 24 nt, Human
aaacccugcaggcugucaguccca

SEQ ID NO: 834658 - RNA, 20 nt, Human
aaccaaaaaacaccaaguaa

SEQ ID NO: 834659 - RNA, 20 nt, Human
aagaaaaaggggcuucaccu

SEQ ID NO: 834660 - RNA, 23 nt, Human
aagaaaaaggggcuucaccuaaa

SEQ ID NO: 834661 - RNA, 19 nt, Human
aagggccagggcccgaggc

SEQ ID NO: 834662 - RNA, 19 nt, Human
aagggccagggcccgaggc

SEQ ID NO: 834663 - RNA, 23 nt, Human
aaugcaaaacaaacccgccugga

SEQ ID NO: 834664 - RNA, 23 nt, Human
acaaaacacgaaggggguucccc

SEQ ID NO: 834665 - RNA, 22 nt, Human
accgggcucgccggccacuucc

SEQ ID NO: 834666 - RNA, 23 nt, Human
agagaggaagcgaagggccaggg

SEQ ID NO: 834667 - RNA, 21 nt, Human
agcgaagggccagggcccgag

SEQ ID NO: 834668 - RNA, 19 nt, Human
aggaaacccugcaggcugu

SEQ ID NO: 834669 - RNA, 25 nt, Human
aggaaacccugcaggcugucagucc

SEQ ID NO: 834670 - RNA, 18 nt, Human
caaaaaacaccaaguaac

SEQ ID NO: 834671 - RNA, 20 nt, Human
cacuuccgccgccgccgcuu

SEQ ID NO: 834672 - RNA, 22 nt, Human
cagcuuaaaauaaaaaucuccc

SEQ ID NO: 834673 - RNA, 19 nt, Human
ccagagcgagggguugaaa

SEQ ID NO: 834674 - RNA, 23 nt, Human
ccgcgcccaaggaaacccugcag

SEQ ID NO: 834675 - RNA, 22 nt, Human
ccguccgagacuguggagcgga

SEQ ID NO: 834676 - RNA, 20 nt, Human
cgaaggggguucccccuggc

SEQ ID NO: 834677 - RNA, 23 nt, Human
cgccuggaaaaugcugcccugag

SEQ ID NO: 834678 - RNA, 21 nt, Human
cgggcucgccggccacuuccg

SEQ ID NO: 834679 - RNA, 24 nt, Human
gaaccagagcgagggguugaaaga

SEQ ID NO: 834680 - RNA, 18 nt, Human
gagcagauccguccgaga

SEQ ID NO: 834681 - RNA, 20 nt, Human
gcccugagaaccagagcgag

SEQ ID NO: 834682 - RNA, 25 nt, Human
gccuggaaaaugcugcccugagaac

SEQ ID NO: 834683 - RNA, 27 nt, Human
gcgcagcagccggucugggugggcgac

SEQ ID NO: 834684 - RNA, 18 nt, Human
ggagggggcgcagcagcc

SEQ ID NO: 834685 - RNA, 18 nt, Human
ggcucgccggccacuucc

SEQ ID NO: 834686 - RNA, 20 nt, Human
gguucccccuggcgccugcc

SEQ ID NO: 834687 - RNA, 22 nt, Human
guucgaaggcuuucaaccgucc

SEQ ID NO: 834688 - RNA, 19 nt, Human
uagcaagaaaaaggggcuu

SEQ ID NO: 834689 - RNA, 21 nt, Human
uccaagaaaugcaaaacaaac

SEQ ID NO: 834690 - RNA, 22 nt, Human
uccaagaaaugcaaaacaaacc

SEQ ID NO: 834691 - RNA, 21 nt, Human
uccccugcacgguucgaaggc

SEQ ID NO: 834692 - RNA, 23 nt, Human
ucgaaggcuuucaaccgucccgg

SEQ ID NO: 834693 - RNA, 25 nt, Human
ucgccggccacuuccgccgccgccg

SEQ ID NO: 834694 - RNA, 20 nt, Human
ugaaagaugccuucaacaca

SEQ ID NO: 834695 - RNA, 20 nt, Human
uggaaaaugcugcccugaga

SEQ ID NO: 834696 - RNA, 18 nt, Human
uggcaggagggggcgcag

SEQ ID NO: 834697 - RNA, 24 nt, Human
uggcaggagggggcgcagcagccg

SEQ ID NO: 834698 - RNA, 24 nt, Human
ugggacggccguuucacaaaacca

SEQ ID NO: 834699 - RNA, 23 nt, Human
uucacaaaaccaaaaaacaccaa

SEQ ID NO: 834700 - RNA, 20 nt, Human
uuuuuuuuuuuuuuuuuugg

SEQ ID NO: 834701 - RNA, 25 nt, Human
uuuuuuuuuuuuuuuuuuguaguuu

SEQ ID NO: 834702 - RNA, 22 nt, Human
aaacaaaaugacaguuaaccaa

SEQ ID NO: 834703 - RNA, 24 nt, Human
aaacaaaaugacaguuaaccaaaa

SEQ ID NO: 834704 - RNA, 24 nt, Human
aaauggucacguaaaugacaaaac

SEQ ID NO: 834705 - RNA, 20 nt, Human
acaaacuuuguuccacuggc

SEQ ID NO: 834706 - RNA, 25 nt, Human
acauuagaaagugggaaaaaaaauu

SEQ ID NO: 834707 - RNA, 20 nt, Human
agaaguucuuuucuucuuuu

SEQ ID NO: 834708 - RNA, 23 nt, Human
aguaaguggcaaaauaacuacaa

SEQ ID NO: 834709 - RNA, 23 nt, Human
aguaaguggcaaaauaacuacaa

SEQ ID NO: 834710 - RNA, 24 nt, Human
caaaaugacaguuaaccaaaaaca

SEQ ID NO: 834711 - RNA, 20 nt, Human
caaauaagcauauaaugaca

SEQ ID NO: 834712 - RNA, 20 nt, Human
cauauaaugacagaaaagua

SEQ ID NO: 834713 - RNA, 19 nt, Human
uaaccaaaaacaccuuuau

SEQ ID NO: 834714 - RNA, 26 nt, Human
uaacuuacaaaaauggguacacaucu

SEQ ID NO: 834715 - RNA, 19 nt, Human
uaagccaaaacaaaaucua

SEQ ID NO: 834716 - RNA, 20 nt, Human
uaagccaaaacaaaaucuag

SEQ ID NO: 834717 - RNA, 23 nt, Human
uauaaugacagaaaaguaagugg

SEQ ID NO: 834718 - RNA, 24 nt, Human
uauaaugacagaaaaguaaguggc

SEQ ID NO: 834719 - RNA, 18 nt, Human
ugucauuauaagccaaaa

SEQ ID NO: 834720 - RNA, 24 nt, Human
uuuuuuuuuuuuuuuuuuacaaaa

SEQ ID NO: 834721 - RNA, 27 nt, Human
aaaaagaggacaaauuguaucacaaaa

SEQ ID NO: 834722 - RNA, 22 nt, Human
acccucacuccaggcgccccac

SEQ ID NO: 834723 - RNA, 25 nt, Human
agaacccucacuccaggcgccccac

SEQ ID NO: 834724 - RNA, 25 nt, Human
auaaaaaaauauauccaacuaugaa

SEQ ID NO: 834725 - RNA, 24 nt, Human
aucacaaaagaagcaaaaauuaga

SEQ ID NO: 834726 - RNA, 28 nt, Human
auccacaauuguauacauuuaucuuacu

SEQ ID NO: 834727 - RNA, 23 nt, Human
cagaacccucacuccaggcgccc

SEQ ID NO: 834728 - RNA, 27 nt, Human
cauaaaaaaauauauccaacuaugaaa

SEQ ID NO: 834729 - RNA, 22 nt, Human
ccagaacccucacuccaggcgc

SEQ ID NO: 834730 - RNA, 19 nt, Human
ccaggcgccccacgagccc

SEQ ID NO: 834731 - RNA, 18 nt, Human
ccccacgagcccggccgc

SEQ ID NO: 834732 - RNA, 22 nt, Human
ccucacuccaggcgccccacga

SEQ ID NO: 834733 - RNA, 23 nt, Human
cucacaugucagugaaaaaucac

SEQ ID NO: 834734 - RNA, 19 nt, Human
uaaauccacaauuguauac

SEQ ID NO: 834735 - RNA, 18 nt, Human
uacauuuaucuuacucac

SEQ ID NO: 834736 - RNA, 23 nt, Human
uuuuuuuuuuuuauuuugucuuu

SEQ ID NO: 834737 - RNA, 23 nt, Human
uuuuuuuuuuuuuuuuuuauuuu

SEQ ID NO: 834738 - RNA, 19 nt, Human
aaagaauucuccugccuca

SEQ ID NO: 834739 - RNA, 19 nt, Human
aaagugcuggcauuacagg

SEQ ID NO: 834740 - RNA, 24 nt, Human
aaagugcuggcauuacaggcguga

SEQ ID NO: 834741 - RNA, 24 nt, Human
aagaauucuccugccucagccucc

SEQ ID NO: 834742 - RNA, 18 nt, Human
acaccaccacacccagcu

SEQ ID NO: 834743 - RNA, 23 nt, Human
acagagaccagaccaggugaaug

SEQ ID NO: 834744 - RNA, 19 nt, Human
acaggguuucgccaugucg

SEQ ID NO: 834745 - RNA, 20 nt, Human
acaggguuucgccaugucgg

SEQ ID NO: 834746 - RNA, 24 nt, Human
acaggguuucgccaugucggccag

SEQ ID NO: 834747 - RNA, 25 nt, Human
acccgccucggccucccaaagugcu

SEQ ID NO: 834748 - RNA, 18 nt, Human
agacaggguuucgccaug

SEQ ID NO: 834749 - RNA, 18 nt, Human
agacaggguuucgccaug

SEQ ID NO: 834750 - RNA, 20 nt, Human
aggcacacaccaccacaccc

SEQ ID NO: 834751 - RNA, 19 nt, Human
aggcgugaaccaccgugcc

SEQ ID NO: 834752 - RNA, 23 nt, Human
aggcgugaaccaccgugccuggc

SEQ ID NO: 834753 - RNA, 25 nt, Human
aggcuggagugcaguggugugaucu

SEQ ID NO: 834754 - RNA, 24 nt, Human
aggugguccacccgccucggccuc

SEQ ID NO: 834755 - RNA, 18 nt, Human
aguagcugggauuauagg

SEQ ID NO: 834756 - RNA, 23 nt, Human
agugcaguggugugaucuuggcu

SEQ ID NO: 834757 - RNA, 24 nt, Human
agugcaguggugugaucuuggcuc

SEQ ID NO: 834758 - RNA, 25 nt, Human
auucugucgcccaggcuggagugca

SEQ ID NO: 834759 - RNA, 24 nt, Human
caaagugcuggcauuacaggcgug

SEQ ID NO: 834760 - RNA, 23 nt, Human
cacacaccaccacacccagcuaa

SEQ ID NO: 834761 - RNA, 20 nt, Human
cacaccaccacacccagcua

SEQ ID NO: 834762 - RNA, 23 nt, Human
caccauccaaggaggcacagccg

SEQ ID NO: 834763 - RNA, 23 nt, Human
cacccgccucggccucccaaagu

SEQ ID NO: 834764 - RNA, 23 nt, Human
cacugcaaccuccgccuuuuggg

SEQ ID NO: 834765 - RNA, 20 nt, Human
cagccuccugaguagcuggg

SEQ ID NO: 834766 - RNA, 24 nt, Human
caggguuucgccaugucggccagg

SEQ ID NO: 834767 - RNA, 24 nt, Human
caugucggccaggcuggucuugaa

SEQ ID NO: 834768 - RNA, 24 nt, Human
cauuacaggcgugaaccaccgugc

SEQ ID NO: 834769 - RNA, 24 nt, Human
cauucugucgcccaggcuggagug

SEQ ID NO: 834770 - RNA, 20 nt, Human
ccaaagugcuggcauuacag

SEQ ID NO: 834771 - RNA, 22 nt, Human
ccaaagugcuggcauuacaggc

SEQ ID NO: 834772 - RNA, 24 nt, Human
ccaaagugcuggcauuacaggcgu

SEQ ID NO: 834773 - RNA, 18 nt, Human
ccagaccaggugaaugua

SEQ ID NO: 834774 - RNA, 19 nt, Human
ccaugucggccaggcuggu

SEQ ID NO: 834775 - RNA, 21 nt, Human
ccaugucggccaggcuggucu

SEQ ID NO: 834776 - RNA, 21 nt, Human
ccaugucggccaggcuggucu

SEQ ID NO: 834777 - RNA, 23 nt, Human
ccugaguagcugggauuauaggc

SEQ ID NO: 834778 - RNA, 24 nt, Human
ccugaguagcugggauuauaggca

SEQ ID NO: 834779 - RNA, 23 nt, Human
ccugccucagccuccugaguagc

SEQ ID NO: 834780 - RNA, 24 nt, Human
cgccaugucggccaggcuggucuu

SEQ ID NO: 834781 - RNA, 27 nt, Human
cgccaugucggccaggcuggucuugaa

SEQ ID NO: 834782 - RNA, 24 nt, Human
cgcccaggcuggagugcaguggug

SEQ ID NO: 834783 - RNA, 24 nt, Human
cggccaggcuggucuugaacuccu

SEQ ID NO: 834784 - RNA, 19 nt, Human
cucacugcaaccuccgccu

SEQ ID NO: 834785 - RNA, 24 nt, Human
cucacugcaaccuccgccuuuugg

SEQ ID NO: 834786 - RNA, 23 nt, Human
cucagccuccugaguagcuggga

SEQ ID NO: 834787 - RNA, 24 nt, Human
cucauucugucgcccaggcuggag

SEQ ID NO: 834788 - RNA, 25 nt, Human
cucccagcauccaucugcauucagc

SEQ ID NO: 834789 - RNA, 23 nt, Human
cugcaaccuccgccuuuuggguu

SEQ ID NO: 834790 - RNA, 18 nt, Human
cugcauuaucccgccaga

SEQ ID NO: 834791 - RNA, 23 nt, Human
cugccucagccuccugaguagcu

SEQ ID NO: 834792 - RNA, 26 nt, Human
cuuuuuguauuuuuuuuuaguagagg

SEQ ID NO: 834793 - RNA, 22 nt, Human
gaccaggugaauguaacugggg

SEQ ID NO: 834794 - RNA, 24 nt, Human
gaccucaggugguccacccgccuc

SEQ ID NO: 834795 - RNA, 24 nt, Human
gaguagcugggauuauaggcacac

SEQ ID NO: 834796 - RNA, 19 nt, Human
gagugcaguggugugaucu

SEQ ID NO: 834797 - RNA, 19 nt, Human
gcacacaccaccacaccca

SEQ ID NO: 834798 - RNA, 20 nt, Human
gcccaggcuggagugcagug

SEQ ID NO: 834799 - RNA, 23 nt, Human
gcccaggcuggagugcaguggug

SEQ ID NO: 834800 - RNA, 24 nt, Human
gcccaggcuggagugcaguggugu

SEQ ID NO: 834801 - RNA, 23 nt, Human
gccucggccucccaaagugcugg

SEQ ID NO: 834802 - RNA, 23 nt, Human
gcuggucuugaacuccugaccuc

SEQ ID NO: 834803 - RNA, 22 nt, Human
ggcuggagugcaguggugugau

SEQ ID NO: 834804 - RNA, 24 nt, Human
ggcuggucuugaacuccugaccuc

SEQ ID NO: 834805 - RNA, 20 nt, Human
ggucuccaccauccaaggag

SEQ ID NO: 834806 - RNA, 19 nt, Human
ggucuugaacuccugaccu

SEQ ID NO: 834807 - RNA, 18 nt, Human
guagcugggauuauaggc

SEQ ID NO: 834808 - RNA, 24 nt, Human
gugguccacccgccucggccuccc

SEQ ID NO: 834809 - RNA, 23 nt, Human
uaaaagaauucuccugccucagc

SEQ ID NO: 834810 - RNA, 22 nt, Human
uacaggcgugaaccaccgugcc

SEQ ID NO: 834811 - RNA, 22 nt, Human
uagagacaggguuucgccaugu

SEQ ID NO: 834812 - RNA, 22 nt, Human
uagcagaccauuucugaggucu

SEQ ID NO: 834813 - RNA, 21 nt, Human
uaggcacacaccaccacaccc

SEQ ID NO: 834814 - RNA, 24 nt, Human
uaguagagacaggguuucgccaug

SEQ ID NO: 834815 - RNA, 20 nt, Human
ucacagcuaagguacauacc

SEQ ID NO: 834816 - RNA, 18 nt, Human
ucacugcaaccuccgccu

SEQ ID NO: 834817 - RNA, 23 nt, Human
ucacugcaaccuccgccuuuugg

SEQ ID NO: 834818 - RNA, 23 nt, Human
ucacugcaaccuccgccuuuugg

SEQ ID NO: 834819 - RNA, 24 nt, Human
ucacugcaaccuccgccuuuuggg

SEQ ID NO: 834820 - RNA, 20 nt, Human
ucagccuccugaguagcugg

SEQ ID NO: 834821 - RNA, 24 nt, Human
ucauucugucgcccaggcuggagu

SEQ ID NO: 834822 - RNA, 27 nt, Human
uccaccauccaaggaggcacagccguc

SEQ ID NO: 834823 - RNA, 24 nt, Human
ucccaaagugcuggcauuacaggc

SEQ ID NO: 834824 - RNA, 24 nt, Human
uccugaguagcugggauuauaggc

SEQ ID NO: 834825 - RNA, 24 nt, Human
ucgcccaggcuggagugcaguggu

SEQ ID NO: 834826 - RNA, 18 nt, Human
ucggccucccaaagugcu

SEQ ID NO: 834827 - RNA, 23 nt, Human
ucucauucugucgcccaggcugg

SEQ ID NO: 834828 - RNA, 24 nt, Human
ucucauucugucgcccaggcugga

SEQ ID NO: 834829 - RNA, 24 nt, Human
ucuccugccucagccuccugagua

SEQ ID NO: 834830 - RNA, 18 nt, Human
ucuucuaagcuuacagag

SEQ ID NO: 834831 - RNA, 24 nt, Human
ucuugaacuccugaccucaggugg

SEQ ID NO: 834832 - RNA, 24 nt, Human
ugaccucaggugguccacccgccu

SEQ ID NO: 834833 - RNA, 18 nt, Human
ugagacagagucucauuc

SEQ ID NO: 834834 - RNA, 22 nt, Human
ugagacagagucucauucuguc

SEQ ID NO: 834835 - RNA, 22 nt, Human
ugcaguggugugaucuuggcuc

SEQ ID NO: 834836 - RNA, 24 nt, Human
ugccucagccuccugaguagcugg

SEQ ID NO: 834837 - RNA, 19 nt, Human
uggagugcaguggugugau

SEQ ID NO: 834838 - RNA, 24 nt, Human
uggagugcaguggugugaucuugg

SEQ ID NO: 834839 - RNA, 24 nt, Human
uggcauuacaggcgugaaccaccg

SEQ ID NO: 834840 - RNA, 25 nt, Human
uggcauuacaggcgugaaccaccgu

SEQ ID NO: 834841 - RNA, 21 nt, Human
ugggauuauaggcacacacca

SEQ ID NO: 834842 - RNA, 24 nt, Human
ugggauuauaggcacacaccacca

SEQ ID NO: 834843 - RNA, 26 nt, Human
uguagcagaccauuucugaggucucc

SEQ ID NO: 834844 - RNA, 22 nt, Human
uguccuccaugccuucagcagc

SEQ ID NO: 834845 - RNA, 21 nt, Human
ugucgcccaggcuggagugca

SEQ ID NO: 834846 - RNA, 24 nt, Human
uuaguagagacaggguuucgccau

SEQ ID NO: 834847 - RNA, 18 nt, Human
uucugucgcccaggcugg

SEQ ID NO: 834848 - RNA, 24 nt, Human
uuucgccaugucggccaggcuggu

SEQ ID NO: 834849 - RNA, 24 nt, Human
uuuuggguuaaaagaauucuccug

SEQ ID NO: 834850 - RNA, 26 nt, Human
uuuuguauuuuuuuuuaguagagaca

SEQ ID NO: 834851 - RNA, 24 nt, Human
uuuuuaguagagacaggguuucgc

SEQ ID NO: 834852 - RNA, 24 nt, Human
uuuuuuaguagagacaggguuucg

SEQ ID NO: 834853 - RNA, 20 nt, Human
uuuuuuuuuuugagacagag

SEQ ID NO: 834854 - RNA, 26 nt, Human
uuuuuuuuuuuugagacagagucuca

SEQ ID NO: 834855 - RNA, 27 nt, Human
uuuuuuuuuuuuuuuuuuuuuuugggg

SEQ ID NO: 834856 - RNA, 22 nt, Human
aaaacccaggaggaagggcugg

SEQ ID NO: 834857 - RNA, 20 nt, Human
accacugucaucuucuucag

SEQ ID NO: 834858 - RNA, 19 nt, Human
auccacgaacgucaacccu

SEQ ID NO: 834859 - RNA, 25 nt, Human
cacaaggcugacuuuucaaaaauca

SEQ ID NO: 834860 - RNA, 20 nt, Human
cacccugcuuuuuaaaaccc

SEQ ID NO: 834861 - RNA, 23 nt, Human
cacccugcuuuuuaaaacccagg

SEQ ID NO: 834862 - RNA, 18 nt, Human
caggaccuauuaugggcc

SEQ ID NO: 834863 - RNA, 21 nt, Human
caggucucuugcucaucccgg

SEQ ID NO: 834864 - RNA, 19 nt, Human
cauugaucaguauuaaaau

SEQ ID NO: 834865 - RNA, 22 nt, Human
ccaaaaacccgaucaucaucau

SEQ ID NO: 834866 - RNA, 21 nt, Human
cccuugucacuuuucugugua

SEQ ID NO: 834867 - RNA, 19 nt, Human
ccuugaagccgggggcagg

SEQ ID NO: 834868 - RNA, 19 nt, Human
cgaacgucaacccuauccc

SEQ ID NO: 834869 - RNA, 18 nt, Human
cgggccuugaagccgggg

SEQ ID NO: 834870 - RNA, 22 nt, Human
cucuucguccucgcuguuccgc

SEQ ID NO: 834871 - RNA, 22 nt, Human
cugggcccuuuuuucaaacucu

SEQ ID NO: 834872 - RNA, 18 nt, Human
gaacgucaacccuauccc

SEQ ID NO: 834873 - RNA, 20 nt, Human
gcagagcugguccugcaaca

SEQ ID NO: 834874 - RNA, 21 nt, Human
gcagagcugguccugcaacag

SEQ ID NO: 834875 - RNA, 20 nt, Human
ggccgguccgaucaggucuc

SEQ ID NO: 834876 - RNA, 25 nt, Human
gggcagggccgguccgaucaggucg

SEQ ID NO: 834877 - RNA, 21 nt, Human
gucacuuuucuguguagauuu

SEQ ID NO: 834878 - RNA, 24 nt, Human
gucaucauccugauuuuuccucug

SEQ ID NO: 834879 - RNA, 20 nt, Human
guuccgcgggccuugaagcc

SEQ ID NO: 834880 - RNA, 23 nt, Human
uaaaacccaggaggaagggcugg

SEQ ID NO: 834881 - RNA, 18 nt, Human
uaauauccucaucuucac

SEQ ID NO: 834882 - RNA, 21 nt, Human
uagauuuaaugaaaccaggug

SEQ ID NO: 834883 - RNA, 19 nt, Human
uauaauuagggggcagagc

SEQ ID NO: 834884 - RNA, 23 nt, Human
ucaucauccugauuuuuccucug

SEQ ID NO: 834885 - RNA, 23 nt, Human
uccgcgggccuugaagccggggg

SEQ ID NO: 834886 - RNA, 24 nt, Human
uccucuguuuucuugcaguuggac

SEQ ID NO: 834887 - RNA, 27 nt, Human
ugagggauuuuuccagucgacgcaagu

SEQ ID NO: 834888 - RNA, 18 nt, Human
ugggcccuuuuuucaaac

SEQ ID NO: 834889 - RNA, 22 nt, Human
uguccuggaucaucucugcccu

SEQ ID NO: 834890 - RNA, 23 nt, Human
uuagaaaaguucacauugaucag

SEQ ID NO: 834891 - RNA, 21 nt, Human
uucaucgcugucugaugaauc

SEQ ID NO: 834892 - RNA, 25 nt, Human
uugaagccgggggcagggccggucc

SEQ ID NO: 834893 - RNA, 26 nt, Human
uuuuccucuguuuucuugcaguugga

SEQ ID NO: 834894 - RNA, 20 nt, Human
uuuuuuuuuuuuuuuugcca

SEQ ID NO: 834895 - RNA, 23 nt, Human
uuuuuuuuuuuuuuuuugccauu

SEQ ID NO: 834896 - RNA, 27 nt, Human
uuuuuuuuuuuuuuuuuuuuuuugggg

SEQ ID NO: 834897 - RNA, 23 nt, Human
caucuaaauggccuccagauucc

SEQ ID NO: 834898 - RNA, 20 nt, Human
caugcuuucacuauugucuu

SEQ ID NO: 834899 - RNA, 20 nt, Human
gcuaaauggugaaaaacaaa

SEQ ID NO: 834900 - RNA, 22 nt, Human
uaaccaagcuuuccuauucccu

SEQ ID NO: 834901 - RNA, 18 nt, Human
uaucuccuuucagcauuc

SEQ ID NO: 834902 - RNA, 24 nt, Human
ucaucuaaauggccuccagauucc

SEQ ID NO: 834903 - RNA, 19 nt, Human
uccagauuccauguguccu

SEQ ID NO: 834904 - RNA, 20 nt, Human
ucccuccggcgcgcggcucc

SEQ ID NO: 834905 - RNA, 24 nt, Human
uggccuccagauuccauguguccu

SEQ ID NO: 834906 - RNA, 23 nt, Human
aggaugcgcggcaggggccccga

SEQ ID NO: 834907 - RNA, 21 nt, Human
aggcccgggaccacgacauca

SEQ ID NO: 834908 - RNA, 22 nt, Human
agguccaggcgggcggccccgu

SEQ ID NO: 834909 - RNA, 25 nt, Human
cagcuuccaggcguccguagguccc

SEQ ID NO: 834910 - RNA, 18 nt, Human
cagugggaggcgcuggug

SEQ ID NO: 834911 - RNA, 18 nt, Human
cccgugcacauacgcaua

SEQ ID NO: 834912 - RNA, 18 nt, Human
cgggagcagugcagggcg

SEQ ID NO: 834913 - RNA, 22 nt, Human
cgugcacauacgcauaagcggg

SEQ ID NO: 834914 - RNA, 19 nt, Human
gggccccugggccaggccc

SEQ ID NO: 834915 - RNA, 24 nt, Human
gggcugcaggaugcgcggcagggg

SEQ ID NO: 834916 - RNA, 23 nt, Human
gugcagggcgucgcagcuuccag

SEQ ID NO: 834917 - RNA, 22 nt, Human
uccaggcguccguaggucccuu

SEQ ID NO: 834918 - RNA, 19 nt, Human
uccagguccaggcgggcgg

SEQ ID NO: 834919 - RNA, 19 nt, Human
ucuccagguccaggcgggc

SEQ ID NO: 834920 - RNA, 24 nt, Human
uuuuuuuuuuuagaaaauaggugg

SEQ ID NO: 834921 - RNA, 21 nt, Human
aggcacccgccaacgaaaaca

SEQ ID NO: 834922 - RNA, 22 nt, Human
cagcccaggcacccgccaacga

SEQ ID NO: 834923 - RNA, 21 nt, Human
ccaccagcccaggcacccgcc

SEQ ID NO: 834924 - RNA, 19 nt, Human
cccaccagcccaggcaccc

SEQ ID NO: 834925 - RNA, 23 nt, Human
ccucggcccgcucucaggccgaa

SEQ ID NO: 834926 - RNA, 21 nt, Human
cgaaaacacgggcgacaccgu

SEQ ID NO: 834927 - RNA, 25 nt, Human
cgaaaacacgggcgacacuggagac

SEQ ID NO: 834928 - RNA, 18 nt, Human
uauugauucuggaaccuu

SEQ ID NO: 834929 - RNA, 20 nt, Human
ucagaggugggccgaaccag

SEQ ID NO: 834930 - RNA, 22 nt, Human
ucccaccagcccaggcacccgc

SEQ ID NO: 834931 - RNA, 22 nt, Human
uuccuucgggcggcuguuccca

SEQ ID NO: 834932 - RNA, 18 nt, Human
aaaaaccaaaacagaggu

SEQ ID NO: 834933 - RNA, 19 nt, Human
aaaacaaaaaccaaaacag

SEQ ID NO: 834934 - RNA, 21 nt, Human
aaaaccaaaacagagguaagc

SEQ ID NO: 834935 - RNA, 24 nt, Human
aaacaaaaaccaaaacagagguaa

SEQ ID NO: 834936 - RNA, 22 nt, Human
aaacagagguaagcagggccug

SEQ ID NO: 834937 - RNA, 24 nt, Human
aacaugacacuacguaaaaacaca

SEQ ID NO: 834938 - RNA, 24 nt, Human
acaaaaaccaaaacagcagggacu

SEQ ID NO: 834939 - RNA, 20 nt, Human
accagacacggcccucagca

SEQ ID NO: 834940 - RNA, 22 nt, Human
acccugggaacacagagaaggg

SEQ ID NO: 834941 - RNA, 22 nt, Human
accugagucccguucacgacuc

SEQ ID NO: 834942 - RNA, 18 nt, Human
aggacgcaggcaggggac

SEQ ID NO: 834943 - RNA, 24 nt, Human
auaucaaaaacaaaaaccaaaaca

SEQ ID NO: 834944 - RNA, 21 nt, Human
caacacuauaugcacagaaca

SEQ ID NO: 834945 - RNA, 19 nt, Human
cacggcccucagcagaccc

SEQ ID NO: 834946 - RNA, 18 nt, Human
caggacgcaggcagggga

SEQ ID NO: 834947 - RNA, 24 nt, Human
caggccccaggacgcaggcagggg

SEQ ID NO: 834948 - RNA, 19 nt, Human
cauccccaccagacacggc

SEQ ID NO: 834949 - RNA, 22 nt, Human
ccagacacggcccucagcagac

SEQ ID NO: 834950 - RNA, 26 nt, Human
cccacaccugagucccguucacgacu

SEQ ID NO: 834951 - RNA, 21 nt, Human
cccagccccauccccaccaga

SEQ ID NO: 834952 - RNA, 22 nt, Human
cccagccccauccccaccagac

SEQ ID NO: 834953 - RNA, 18 nt, Human
cccauccccaccagacac

SEQ ID NO: 834954 - RNA, 19 nt, Human
ccugugcagcccaucaccu

SEQ ID NO: 834955 - RNA, 21 nt, Human
cgacuccccagcccuacuccu

SEQ ID NO: 834956 - RNA, 24 nt, Human
cggcccucagcagacccugggaac

SEQ ID NO: 834957 - RNA, 20 nt, Human
gcccuacuccugagggugag

SEQ ID NO: 834958 - RNA, 25 nt, Human
ggaaaaaaaaauaucaaaaacaaaa

SEQ ID NO: 834959 - RNA, 19 nt, Human
ggacgcaggcaggggacag

SEQ ID NO: 834960 - RNA, 19 nt, Human
gggaacacagagaagggcc

SEQ ID NO: 834961 - RNA, 22 nt, Human
gucggccgcgacgacuucucuc

SEQ ID NO: 834962 - RNA, 23 nt, Human
uaacauaaacagugcaaaggaga

SEQ ID NO: 834963 - RNA, 18 nt, Human
uaagcagggccuggucag

SEQ ID NO: 834964 - RNA, 25 nt, Human
uaugcacagaacaugacacuacgua

SEQ ID NO: 834965 - RNA, 19 nt, Human
ugcgagcuccuccacagcc

SEQ ID NO: 834966 - RNA, 19 nt, Human
ugggaacacagagaagggc

SEQ ID NO: 834967 - RNA, 18 nt, Human
uuuuuuuuuuuuuuuuug

SEQ ID NO: 834968 - RNA, 24 nt, Human
uuuuuuuuuuuuuuuuugaccuuu

SEQ ID NO: 834969 - RNA, 22 nt, Human
aaagggccaaggcagacaagua

SEQ ID NO: 834970 - RNA, 23 nt, Human
aagcccuggcucaggaaggucaa

SEQ ID NO: 834971 - RNA, 21 nt, Human
aaggaggcugccuccgacucc

SEQ ID NO: 834972 - RNA, 21 nt, Human
aagggccaaggcagacaagua

SEQ ID NO: 834973 - RNA, 19 nt, Human
acagaccccagcacaugac

SEQ ID NO: 834974 - RNA, 19 nt, Human
acagaccccagcacaugac

SEQ ID NO: 834975 - RNA, 20 nt, Human
acggggugugggugggcggu

SEQ ID NO: 834976 - RNA, 24 nt, Human
agaaaauuacucauuuucugacac

SEQ ID NO: 834977 - RNA, 23 nt, Human
agccacgccacccuuuccacccu

SEQ ID NO: 834978 - RNA, 23 nt, Human
agccacgccacccuuuccacccu

SEQ ID NO: 834979 - RNA, 21 nt, Human
aggcacaacuacagcaaagcc

SEQ ID NO: 834980 - RNA, 21 nt, Human
aggcacaacuacagcaaagcc

SEQ ID NO: 834981 - RNA, 24 nt, Human
aggcaggaaggaggcugccuccga

SEQ ID NO: 834982 - RNA, 20 nt, Human
aggcuguagccacgccaccc

SEQ ID NO: 834983 - RNA, 20 nt, Human
aggcuguagccacgccaccc

SEQ ID NO: 834984 - RNA, 24 nt, Human
aggggcagacgggguguggguggg

SEQ ID NO: 834985 - RNA, 26 nt, Human
caaagcccuggcucaggaaggucaau

SEQ ID NO: 834986 - RNA, 23 nt, Human
caaggcagacaaguagcugcccc

SEQ ID NO: 834987 - RNA, 23 nt, Human
caaggcagacaaguagcugcccc

SEQ ID NO: 834988 - RNA, 21 nt, Human
cacccuguccuagccagaggc

SEQ ID NO: 834989 - RNA, 25 nt, Human
cagaaaauuacucauuuucugacac

SEQ ID NO: 834990 - RNA, 23 nt, Human
cagcaaugugcuccauacagauc

SEQ ID NO: 834991 - RNA, 23 nt, Human
cagcaaugugcuccauacagauc

SEQ ID NO: 834992 - RNA, 19 nt, Human
cagccccaugacaucauaa

SEQ ID NO: 834993 - RNA, 19 nt, Human
cagccccaugacaucauaa

SEQ ID NO: 834994 - RNA, 22 nt, Human
caugacugacacucggaagcac

SEQ ID NO: 834995 - RNA, 22 nt, Human
caugacugacacucggaagcac

SEQ ID NO: 834996 - RNA, 20 nt, Human
caugggcccacagaccccag

SEQ ID NO: 834997 - RNA, 20 nt, Human
caugggcccacagaccccag

SEQ ID NO: 834998 - RNA, 25 nt, Human
ccagcacaugacugacacucggaag

SEQ ID NO: 834999 - RNA, 25 nt, Human
ccagcacaugacugacacucggaag

SEQ ID NO: 835000 - RNA, 20 nt, Human
ccagcagcaccccuuggcag

SEQ ID NO: 835001 - RNA, 20 nt, Human
ccagcagcaccccuuggcag

SEQ ID NO: 835002 - RNA, 22 nt, Human
ccagcagcaccccuuggcaguc

SEQ ID NO: 835003 - RNA, 22 nt, Human
ccagcagcaccccuuggcaguc

SEQ ID NO: 835004 - RNA, 20 nt, Human
ccagccccaugacaucauaa

SEQ ID NO: 835005 - RNA, 20 nt, Human
ccagccccaugacaucauaa

SEQ ID NO: 835006 - RNA, 21 nt, Human
ccaggcacaacuacagcaaag

SEQ ID NO: 835007 - RNA, 21 nt, Human
ccaggcacaacuacagcaaag

SEQ ID NO: 835008 - RNA, 21 nt, Human
cccacacugucgguccccagc

SEQ ID NO: 835009 - RNA, 21 nt, Human
cccacacugucgguccccagc

SEQ ID NO: 835010 - RNA, 23 nt, Human
cccacagaccccagcacaugacu

SEQ ID NO: 835011 - RNA, 23 nt, Human
cccacagaccccagcacaugacu

SEQ ID NO: 835012 - RNA, 18 nt, Human
ccccuuaggcaaauggcu

SEQ ID NO: 835013 - RNA, 18 nt, Human
ccccuuaggcaaauggcu

SEQ ID NO: 835014 - RNA, 24 nt, Human
ccccuuguccuagagcuccugagc

SEQ ID NO: 835015 - RNA, 24 nt, Human
ccccuuguccuagagcuccugagc

SEQ ID NO: 835016 - RNA, 25 nt, Human
cccugccacaccguagaugcagacc

SEQ ID NO: 835017 - RNA, 25 nt, Human
cccugccacaccguagaugcagacc

SEQ ID NO: 835018 - RNA, 19 nt, Human
cccuguccuagccagaggc

SEQ ID NO: 835019 - RNA, 20 nt, Human
cgccgucgccaugcagucca

SEQ ID NO: 835020 - RNA, 20 nt, Human
cgccgucgccaugcagucca

SEQ ID NO: 835021 - RNA, 21 nt, Human
cgccgucgccaugcaguccag

SEQ ID NO: 835022 - RNA, 21 nt, Human
cgccgucgccaugcaguccag

SEQ ID NO: 835023 - RNA, 27 nt, Human
cuaacacacccacacugucggucccca

SEQ ID NO: 835024 - RNA, 27 nt, Human
cuaacacacccacacugucggucccca

SEQ ID NO: 835025 - RNA, 23 nt, Human
cugcaugugcacauucugguccu

SEQ ID NO: 835026 - RNA, 23 nt, Human
cugcaugugcacauucugguccu

SEQ ID NO: 835027 - RNA, 22 nt, Human
gaccccagcacaugacugacac

SEQ ID NO: 835028 - RNA, 22 nt, Human
gaccccagcacaugacugacac

SEQ ID NO: 835029 - RNA, 19 nt, Human
gacugccccaccacacgcc

SEQ ID NO: 835030 - RNA, 19 nt, Human
gacugccccaccacacgcc

SEQ ID NO: 835031 - RNA, 22 nt, Human
gagugccgaggggcccugccac

SEQ ID NO: 835032 - RNA, 22 nt, Human
gagugccgaggggcccugccac

SEQ ID NO: 835033 - RNA, 21 nt, Human
gaugcagaccuggagcggucc

SEQ ID NO: 835034 - RNA, 21 nt, Human
gaugcagaccuggagcggucc

SEQ ID NO: 835035 - RNA, 19 nt, Human
gccgucgccaugcagucca

SEQ ID NO: 835036 - RNA, 19 nt, Human
gccgucgccaugcagucca

SEQ ID NO: 835037 - RNA, 22 nt, Human
gcgguccccuuguccuagagcu

SEQ ID NO: 835038 - RNA, 22 nt, Human
gcgguccccuuguccuagagcu

SEQ ID NO: 835039 - RNA, 19 nt, Human
gcgugugguggggucaagg

SEQ ID NO: 835040 - RNA, 26 nt, Human
ggaagcacagaacaaaggguaggacg

SEQ ID NO: 835041 - RNA, 26 nt, Human
ggaagcacagaacaaaggguaggacg

SEQ ID NO: 835042 - RNA, 21 nt, Human
ggcagacgggguguggguggg

SEQ ID NO: 835043 - RNA, 19 nt, Human
gggccaaggcagacaagua

SEQ ID NO: 835044 - RNA, 22 nt, Human
ggucaaggggcagacggggugu

SEQ ID NO: 835045 - RNA, 22 nt, Human
gguccccagcacgcagaugccc

SEQ ID NO: 835046 - RNA, 22 nt, Human
gguccccagcacgcagaugccc

SEQ ID NO: 835047 - RNA, 21 nt, Human
guccccuuguccuagagcucc

SEQ ID NO: 835048 - RNA, 21 nt, Human
guccccuuguccuagagcucc

SEQ ID NO: 835049 - RNA, 21 nt, Human
gugggugggcggugccgcaag

SEQ ID NO: 835050 - RNA, 19 nt, Human
uacagauccuccuaacaca

SEQ ID NO: 835051 - RNA, 22 nt, Human
uacagauccuccuaacacaccu

SEQ ID NO: 835052 - RNA, 20 nt, Human
uccacccuguccuagccaga

SEQ ID NO: 835053 - RNA, 20 nt, Human
uccacccuguccuagccaga

SEQ ID NO: 835054 - RNA, 21 nt, Human
uccuccuaacacacccacacu

SEQ ID NO: 835055 - RNA, 23 nt, Human
ucugacacauuuauugaccagca

SEQ ID NO: 835056 - RNA, 19 nt, Human
ugacugacacucggaagca

SEQ ID NO: 835057 - RNA, 19 nt, Human
ugacugacacucggaagca

SEQ ID NO: 835058 - RNA, 19 nt, Human
ugcccaucugcaugugcac

SEQ ID NO: 835059 - RNA, 19 nt, Human
ugcccaucugcaugugcac

SEQ ID NO: 835060 - RNA, 20 nt, Human
ugggaaagaugacacuagug

SEQ ID NO: 835061 - RNA, 20 nt, Human
ugggaaagaugacacuagug

SEQ ID NO: 835062 - RNA, 19 nt, Human
ugguggggucaaggggcag

SEQ ID NO: 835063 - RNA, 22 nt, Human
ugguggggucaaggggcagacg

SEQ ID NO: 835064 - RNA, 26 nt, Human
uguccuagagcuccugagccaggcac

SEQ ID NO: 835065 - RNA, 26 nt, Human
uguccuagagcuccugagccaggcac

SEQ ID NO: 835066 - RNA, 19 nt, Human
ugugguggggucaaggggc

SEQ ID NO: 835067 - RNA, 21 nt, Human
uuccacccuguccuagccaga

SEQ ID NO: 835068 - RNA, 26 nt, Human
uuuuuuuuuuuuuuuuuuuuuuuggg

SEQ ID NO: 835069 - RNA, 23 nt, Human
cccaggcucccugcauccgagag

SEQ ID NO: 835070 - RNA, 18 nt, Human
cccugcauccgagagccc

SEQ ID NO: 835071 - RNA, 19 nt, Human
cccugcauccgagagcccu

SEQ ID NO: 835072 - RNA, 20 nt, Human
ccgcccguccugcuugcugc

SEQ ID NO: 835073 - RNA, 18 nt, Human
cucccugcauccgagagc

SEQ ID NO: 835074 - RNA, 24 nt, Human
cuccggaagcugcuguuugggccc

SEQ ID NO: 835075 - RNA, 21 nt, Human
cuucagucugucuucuuccuc

SEQ ID NO: 835076 - RNA, 18 nt, Human
ucaagacauuuauauaaa

SEQ ID NO: 835077 - RNA, 23 nt, Human
ucaauagacauguuuacacuucc

SEQ ID NO: 835078 - RNA, 20 nt, Human
ugcugcuggguccgguugcc

SEQ ID NO: 835079 - RNA, 22 nt, Human
uuccucagcuccuuccgacucc

SEQ ID NO: 835080 - RNA, 21 nt, Human
uugcugcuggguccgguugcc

SEQ ID NO: 835081 - RNA, 30 nt, Human
uugcugcuggguccgguugccgaggcggaa

SEQ ID NO: 835082 - RNA, 18 nt, Human
uuuuuuuuuuuuuuuuug

SEQ ID NO: 835083 - RNA, 21 nt, Human
uuuuuuuuuuuuuuuuuggcu

SEQ ID NO: 835084 - RNA, 22 nt, Human
uuuuuuuuuuuuuuuuuuuggc

SEQ ID NO: 835085 - RNA, 24 nt, Human
agagcagcgcgggagugugggggc

SEQ ID NO: 835086 - RNA, 19 nt, Human
aggcgaaaugaucaggggc

SEQ ID NO: 835087 - RNA, 22 nt, Human
agugugggggcccccuuggcug

SEQ ID NO: 835088 - RNA, 19 nt, Human
cagcaggugggcugcuccc

SEQ ID NO: 835089 - RNA, 22 nt, Human
cagcaggugggcugcucccuga

SEQ ID NO: 835090 - RNA, 21 nt, Human
ccagcaggugggcugcucccu

SEQ ID NO: 835091 - RNA, 19 nt, Human
cccugagccgcagagcagc

SEQ ID NO: 835092 - RNA, 25 nt, Human
cgcagagcagcgcgggagugugggg

SEQ ID NO: 835093 - RNA, 22 nt, Human
cgggagugugggggcccccuug

SEQ ID NO: 835094 - RNA, 18 nt, Human
cuaguccuugcucuuuua

SEQ ID NO: 835095 - RNA, 21 nt, Human
cucccugagccgcagagcagc

SEQ ID NO: 835096 - RNA, 24 nt, Human
gcagagcagcgcgggagugugggg

SEQ ID NO: 835097 - RNA, 22 nt, Human
gcuggaccacagggggacccug

SEQ ID NO: 835098 - RNA, 18 nt, Human
ggacuggccuggagguca

SEQ ID NO: 835099 - RNA, 24 nt, Human
gggcuggugacuugccucaaguuc

SEQ ID NO: 835100 - RNA, 20 nt, Human
guggagagcugcuucccaca

SEQ ID NO: 835101 - RNA, 19 nt, Human
gugggggcccccuuggcug

SEQ ID NO: 835102 - RNA, 18 nt, Human
uccacccgccuggguuga

SEQ ID NO: 835103 - RNA, 19 nt, Human
ucccacaggcagaugcugc

SEQ ID NO: 835104 - RNA, 19 nt, Human
ucccacaggcagaugcugc

SEQ ID NO: 835105 - RNA, 18 nt, Human
ugagaggacugagacaca

SEQ ID NO: 835106 - RNA, 20 nt, Human
ugagaggacugagacacaga

SEQ ID NO: 835107 - RNA, 22 nt, Human
ugccucaaguuccucauccagc

SEQ ID NO: 835108 - RNA, 21 nt, Human
uggccuggaggucaggaacuc

SEQ ID NO: 835109 - RNA, 18 nt, Human
uggguugaggaagguguc

SEQ ID NO: 835110 - RNA, 24 nt, Human
uggguugaggaaggugucuggggu

SEQ ID NO: 835111 - RNA, 21 nt, Human
uuaggcgaaaugaucaggggc

SEQ ID NO: 835112 - RNA, 23 nt, Human
uuuacuggcuggaccacaggggg

SEQ ID NO: 835113 - RNA, 21 nt, Human
aagcauccccauccuucugag

SEQ ID NO: 835114 - RNA, 18 nt, Human
accccuuccucccucccu

SEQ ID NO: 835115 - RNA, 21 nt, Human
acccugggccaguaggaagcc

SEQ ID NO: 835116 - RNA, 20 nt, Human
acuggggaggcagaaggagg

SEQ ID NO: 835117 - RNA, 18 nt, Human
agaaggagggauggaggc

SEQ ID NO: 835118 - RNA, 18 nt, Human
agggauggaggcacuggg

SEQ ID NO: 835119 - RNA, 21 nt, Human
augaccagcacaccuacaagc

SEQ ID NO: 835120 - RNA, 20 nt, Human
augagcagucucagcuccac

SEQ ID NO: 835121 - RNA, 18 nt, Human
auggaggcacugggucac

SEQ ID NO: 835122 - RNA, 19 nt, Human
auggccacgcuccaccccc

SEQ ID NO: 835123 - RNA, 20 nt, Human
cacaccuacaagcauaugga

SEQ ID NO: 835124 - RNA, 18 nt, Human
caccaugaccagcacacc

SEQ ID NO: 835125 - RNA, 20 nt, Human
cacccuuuaguuauacugac

SEQ ID NO: 835126 - RNA, 19 nt, Human
cagggugguuuugacaagg

SEQ ID NO: 835127 - RNA, 23 nt, Human
cauacccuccaaagaccuauucc

SEQ ID NO: 835128 - RNA, 22 nt, Human
caugaccagcacaccuacaagc

SEQ ID NO: 835129 - RNA, 21 nt, Human
cauggccacgcuccacccccu

SEQ ID NO: 835130 - RNA, 19 nt, Human
ccacccuuuaguuauacug

SEQ ID NO: 835131 - RNA, 18 nt, Human
ccccacuuacccuuuccu

SEQ ID NO: 835132 - RNA, 19 nt, Human
ccccacuuacccuuuccua

SEQ ID NO: 835133 - RNA, 22 nt, Human
ccccugggccccacuuacccuu

SEQ ID NO: 835134 - RNA, 19 nt, Human
cccugggccccacuuaccc

SEQ ID NO: 835135 - RNA, 19 nt, Human
cccugggccccacuuaccc

SEQ ID NO: 835136 - RNA, 23 nt, Human
cccuuuccuacugugaagcccac

SEQ ID NO: 835137 - RNA, 21 nt, Human
ccucccucccugccccugggc

SEQ ID NO: 835138 - RNA, 21 nt, Human
cgaggcagaaguggcacgucc

SEQ ID NO: 835139 - RNA, 23 nt, Human
cuccaaagaccuauucccucccu

SEQ ID NO: 835140 - RNA, 18 nt, Human
cuccaccagcggcaggca

SEQ ID NO: 835141 - RNA, 26 nt, Human
cuccaccagcggcaggcacacacaca

SEQ ID NO: 835142 - RNA, 18 nt, Human
cuccacccccuuccugga

SEQ ID NO: 835143 - RNA, 21 nt, Human
cucccugccccugggccccac

SEQ ID NO: 835144 - RNA, 21 nt, Human
cucccuuggaaaguccauggg

SEQ ID NO: 835145 - RNA, 22 nt, Human
cugccaccaugugcugucuucg

SEQ ID NO: 835146 - RNA, 24 nt, Human
cugccccugggccccacuuacccu

SEQ ID NO: 835147 - RNA, 19 nt, Human
cuggggaggcagaaggagg

SEQ ID NO: 835148 - RNA, 20 nt, Human
cuuugucuugcauacccucc

SEQ ID NO: 835149 - RNA, 23 nt, Human
gaccuugucccaccucguuccac

SEQ ID NO: 835150 - RNA, 21 nt, Human
gagcagucucagcuccaccag

SEQ ID NO: 835151 - RNA, 20 nt, Human
gaggcagaaggagggaugga

SEQ ID NO: 835152 - RNA, 19 nt, Human
gagggauggaggcacuggg

SEQ ID NO: 835153 - RNA, 22 nt, Human
gagggauggaggcacuggguca

SEQ ID NO: 835154 - RNA, 22 nt, Human
gaugguacacuucucugagccu

SEQ ID NO: 835155 - RNA, 24 nt, Human
gcacacacacaucacugagcagca

SEQ ID NO: 835156 - RNA, 24 nt, Human
gccaccaugugcugucuucgucau

SEQ ID NO: 835157 - RNA, 19 nt, Human
gccacgcuccacccccuuc

SEQ ID NO: 835158 - RNA, 22 nt, Human
gcccugaaaccccaccuuccuu

SEQ ID NO: 835159 - RNA, 23 nt, Human
gcuccacccccuuccuggacuca

SEQ ID NO: 835160 - RNA, 20 nt, Human
ggagaugggcaguuccugag

SEQ ID NO: 835161 - RNA, 20 nt, Human
ggaggcagaaggagggaugg

SEQ ID NO: 835162 - RNA, 21 nt, Human
gggugguuuugacaaggucug

SEQ ID NO: 835163 - RNA, 20 nt, Human
ggugguuuugacaaggucug

SEQ ID NO: 835164 - RNA, 21 nt, Human
guccggaugucgggaacagga

SEQ ID NO: 835165 - RNA, 21 nt, Human
uaucuaucucugccaccaugu

SEQ ID NO: 835166 - RNA, 23 nt, Human
uauucccucccuuggaaagucca

SEQ ID NO: 835167 - RNA, 23 nt, Human
uccaaagaccuauucccucccuu

SEQ ID NO: 835168 - RNA, 19 nt, Human
uccauggccacgcuccacc

SEQ ID NO: 835169 - RNA, 30 nt, Human
uccccauccuucugagaugagcagucucaa

SEQ ID NO: 835170 - RNA, 19 nt, Human
uccuucugagaugagcagu

SEQ ID NO: 835171 - RNA, 23 nt, Human
ucuacgaggcagaaguggcacgu

SEQ ID NO: 835172 - RNA, 19 nt, Human
ucucaaauacccugggcca

SEQ ID NO: 835173 - RNA, 20 nt, Human
ucuucuacgaggcagaaguu

SEQ ID NO: 835174 - RNA, 22 nt, Human
ugagaugagcagucucagcucc

SEQ ID NO: 835175 - RNA, 20 nt, Human
ugcagggugguuuugacaag

SEQ ID NO: 835176 - RNA, 18 nt, Human
uggccaggaaaucaagca

SEQ ID NO: 835177 - RNA, 22 nt, Human
ugggaaggaaguuauuacuugg

SEQ ID NO: 835178 - RNA, 24 nt, Human
uggggagaugggcaguuccugagg

SEQ ID NO: 835179 - RNA, 18 nt, Human
uggggaggcagaaggagg

SEQ ID NO: 835180 - RNA, 21 nt, Human
uuacuuggcaggagggacagc

SEQ ID NO: 835181 - RNA, 18 nt, Human
uuccucccucccugcccc

SEQ ID NO: 835182 - RNA, 21 nt, Human
uuccuggacucaguuaccccu

SEQ ID NO: 835183 - RNA, 21 nt, Human
aaacauccagggacuagggga

SEQ ID NO: 835184 - RNA, 20 nt, Human
aacaguuuacacacaaauuu

SEQ ID NO: 835185 - RNA, 21 nt, Human
aagcccagauagaagucagga

SEQ ID NO: 835186 - RNA, 20 nt, Human
aggcaaggagggcugguaug

SEQ ID NO: 835187 - RNA, 25 nt, Human
agggacuagaaguccuggccaagcc

SEQ ID NO: 835188 - RNA, 21 nt, Human
caagaggaagagccaaggcug

SEQ ID NO: 835189 - RNA, 23 nt, Human
caagcccagauagaagucaggaa

SEQ ID NO: 835190 - RNA, 22 nt, Human
cccagauagaagucaggaaggu

SEQ ID NO: 835191 - RNA, 20 nt, Human
cuggaaacugguggaauuuu

SEQ ID NO: 835192 - RNA, 23 nt, Human
cuggugggcaguagggcuggggg

SEQ ID NO: 835193 - RNA, 22 nt, Human
ggacuagaaguccuggccaagc

SEQ ID NO: 835194 - RNA, 24 nt, Human
gggguccaguggcuggagggaggc

SEQ ID NO: 835195 - RNA, 20 nt, Human
uagcaguaagugugcugaag

SEQ ID NO: 835196 - RNA, 19 nt, Human
uccaguggcuggagggagg

SEQ ID NO: 835197 - RNA, 22 nt, Human
uggagggaggcaaggagggcug

SEQ ID NO: 835198 - RNA, 22 nt, Human
uggccaagcccagauagaaguc

SEQ ID NO: 835199 - RNA, 20 nt, Human
uggcuggagggaggcaagga

SEQ ID NO: 835200 - RNA, 22 nt, Human
ugggcaguagggcuggggguac

SEQ ID NO: 835201 - RNA, 19 nt, Human
uggugggcaguagggcugg

SEQ ID NO: 835202 - RNA, 22 nt, Human
uugggagaaacauccagggacu

SEQ ID NO: 835203 - RNA, 20 nt, Human
aaaauggaaagaggugagua

SEQ ID NO: 835204 - RNA, 20 nt, Human
aaaugggagcuagggagagg

SEQ ID NO: 835205 - RNA, 23 nt, Human
acagaagccccauuucaggccca

SEQ ID NO: 835206 - RNA, 19 nt, Human
acagagacacagggagaga

SEQ ID NO: 835207 - RNA, 22 nt, Human
agaaaugggagcuagggagaga

SEQ ID NO: 835208 - RNA, 19 nt, Human
agaccacucggaacagugu

SEQ ID NO: 835209 - RNA, 21 nt, Human
agagugaagggugugaggugg

SEQ ID NO: 835210 - RNA, 22 nt, Human
agagugaagggugugagguggg

SEQ ID NO: 835211 - RNA, 19 nt, Human
aggaagcaaaguggggagc

SEQ ID NO: 835212 - RNA, 21 nt, Human
aggccaaggcaggugggagga

SEQ ID NO: 835213 - RNA, 19 nt, Human
agggagagaggcucaggcc

SEQ ID NO: 835214 - RNA, 23 nt, Human
agugaagggugugaggugggaag

SEQ ID NO: 835215 - RNA, 21 nt, Human
cacuggggacaacacagaagc

SEQ ID NO: 835216 - RNA, 24 nt, Human
cccagaucccaaucccuccucaag

SEQ ID NO: 835217 - RNA, 20 nt, Human
cuggaaggaagugggaaggg

SEQ ID NO: 835218 - RNA, 20 nt, Human
gaagggugugaggugggaag

SEQ ID NO: 835219 - RNA, 22 nt, Human
gaccacucggaacaguguuuaa

SEQ ID NO: 835220 - RNA, 24 nt, Human
gagacgauucuguaaagccagggg

SEQ ID NO: 835221 - RNA, 22 nt, Human
gccaauggagguccuggaagga

SEQ ID NO: 835222 - RNA, 20 nt, Human
ggagguccuggaaggaagug

SEQ ID NO: 835223 - RNA, 18 nt, Human
gggagcccuucuaggagc

SEQ ID NO: 835224 - RNA, 22 nt, Human
gggaugggguacauaugggagc

SEQ ID NO: 835225 - RNA, 24 nt, Human
ggggaugggguacauaugggagcc

SEQ ID NO: 835226 - RNA, 21 nt, Human
uauuacucaaaauggaaagag

SEQ ID NO: 835227 - RNA, 25 nt, Human
ucaaaauggaaagaggugaguaugg

SEQ ID NO: 835228 - RNA, 20 nt, Human
ucacuggggacaacacagaa

SEQ ID NO: 835229 - RNA, 22 nt, Human
ucagacucagacauuuauuacu

SEQ ID NO: 835230 - RNA, 21 nt, Human
ugaagggugugaggugggaag

SEQ ID NO: 835231 - RNA, 19 nt, Human
ugaggagaccacucggaac

SEQ ID NO: 835232 - RNA, 20 nt, Human
ugaggugggaaggacggaug

SEQ ID NO: 835233 - RNA, 19 nt, Human
ugaguaugggggauggggu

SEQ ID NO: 835234 - RNA, 19 nt, Human
uggaaggaagugggaaggg

SEQ ID NO: 835235 - RNA, 18 nt, Human
ugggaagggacccagaaa

SEQ ID NO: 835236 - RNA, 18 nt, Human
ugggagccuggauuuggg

SEQ ID NO: 835237 - RNA, 22 nt, Human
ugggaggaggggcagccaaugg

SEQ ID NO: 835238 - RNA, 23 nt, Human
ugggaggaggggcagccaaugga

SEQ ID NO: 835239 - RNA, 22 nt, Human
uggggacaacacagaagcccca

SEQ ID NO: 835240 - RNA, 21 nt, Human
ugggggaugggguacauaugg

SEQ ID NO: 835241 - RNA, 24 nt, Human
ugggggaugggguacauaugggag

SEQ ID NO: 835242 - RNA, 19 nt, Human
uguaaagccaggggauaca

SEQ ID NO: 835243 - RNA, 25 nt, Human
ugugaggugggaaggacggaugagg

SEQ ID NO: 835244 - RNA, 25 nt, Human
aaaaaauaaaaauuaaaaaguaagc

SEQ ID NO: 835245 - RNA, 21 nt, Human
aaaaaguaagcagaggccagg

SEQ ID NO: 835246 - RNA, 19 nt, Human
aaaaaguaagcaugucuua

SEQ ID NO: 835247 - RNA, 22 nt, Human
aaaagaaacagucauguaauac

SEQ ID NO: 835248 - RNA, 25 nt, Human
aaaauauacauauccuaguuaccaa

SEQ ID NO: 835249 - RNA, 21 nt, Human
aacacauguuaaaaaaguaaa

SEQ ID NO: 835250 - RNA, 19 nt, Human
aacauggugaaaccccauc

SEQ ID NO: 835251 - RNA, 20 nt, Human
aacauggugaaaccccaucu

SEQ ID NO: 835252 - RNA, 21 nt, Human
aacauggugaaaccccaucuc

SEQ ID NO: 835253 - RNA, 21 nt, Human
aacauggugaaaccccaucuc

SEQ ID NO: 835254 - RNA, 27 nt, Human
aagaaaucaggacaacuguagugggca

SEQ ID NO: 835255 - RNA, 18 nt, Human
aaucgcuugaaccuggga

SEQ ID NO: 835256 - RNA, 24 nt, Human
aaucgcuugaaccugggaggcgga

SEQ ID NO: 835257 - RNA, 25 nt, Human
aauuaaaaaguaagcaugucuuauu

SEQ ID NO: 835258 - RNA, 24 nt, Human
acagagagagacucagucucaaaa

SEQ ID NO: 835259 - RNA, 21 nt, Human
acaguucaauuuuuacuuuga

SEQ ID NO: 835260 - RNA, 20 nt, Human
acauauuacuguacaaacaa

SEQ ID NO: 835261 - RNA, 24 nt, Human
accccaucucuacuaaaaauacaa

SEQ ID NO: 835262 - RNA, 22 nt, Human
agaaucgcuugaaccugggagg

SEQ ID NO: 835263 - RNA, 23 nt, Human
agacucagucucaaaaaaauaaa

SEQ ID NO: 835264 - RNA, 24 nt, Human
agcacuuugggaggccgaggcggg

SEQ ID NO: 835265 - RNA, 20 nt, Human
agccgggcaugguggcaguu

SEQ ID NO: 835266 - RNA, 22 nt, Human
agccuggccaacauggugaaac

SEQ ID NO: 835267 - RNA, 24 nt, Human
agccuggccaacauggugaaaccc

SEQ ID NO: 835268 - RNA, 24 nt, Human
agccugggcaacagagagagacuc

SEQ ID NO: 835269 - RNA, 22 nt, Human
aggcaggagaaucgcuugaacc

SEQ ID NO: 835270 - RNA, 24 nt, Human
aggcaggagaaucgcuugaaccug

SEQ ID NO: 835271 - RNA, 22 nt, Human
aggccaggcgcgguggcucaug

SEQ ID NO: 835272 - RNA, 23 nt, Human
aggccgaggcgggaggaucacug

SEQ ID NO: 835273 - RNA, 24 nt, Human
aggcgcgguggcucaugccuguaa

SEQ ID NO: 835274 - RNA, 22 nt, Human
aggcggagauuugcagugagcc

SEQ ID NO: 835275 - RNA, 20 nt, Human
aggcugaggcaggagaaucg

SEQ ID NO: 835276 - RNA, 24 nt, Human
aggcugaggcaggagaaucgcuug

SEQ ID NO: 835277 - RNA, 18 nt, Human
agugacuaauuucuccau

SEQ ID NO: 835278 - RNA, 24 nt, Human
aucacgccauuguacuccagccug

SEQ ID NO: 835279 - RNA, 19 nt, Human
augccuguaaucccagcac

SEQ ID NO: 835280 - RNA, 24 nt, Human
auuguacuccagccugggcaacag

SEQ ID NO: 835281 - RNA, 21 nt, Human
caaaugcaacucauacacuuu

SEQ ID NO: 835282 - RNA, 24 nt, Human
caacauggugaaaccccaucucua

SEQ ID NO: 835283 - RNA, 20 nt, Human
caaugcugauagaguuuaca

SEQ ID NO: 835284 - RNA, 21 nt, Human
caauuauaaacagaaaaaaac

SEQ ID NO: 835285 - RNA, 23 nt, Human
caauuauaaacagaaaaaaacuc

SEQ ID NO: 835286 - RNA, 18 nt, Human
cacagaucacaagacaag

SEQ ID NO: 835287 - RNA, 24 nt, Human
cacaugccuaagaucuaaacaacu

SEQ ID NO: 835288 - RNA, 23 nt, Human
caccuaguaauaugccuauuuua

SEQ ID NO: 835289 - RNA, 24 nt, Human
cacugcuacaagguaccuacucaa

SEQ ID NO: 835290 - RNA, 18 nt, Human
cagaaaaugcaaagcaca

SEQ ID NO: 835291 - RNA, 19 nt, Human
cagaaaaugcaaagcacac

SEQ ID NO: 835292 - RNA, 19 nt, Human
cagagagagacucagucuc

SEQ ID NO: 835293 - RNA, 21 nt, Human
cagagagagacucagucucag

SEQ ID NO: 835294 - RNA, 24 nt, Human
cagcacuuugggaggccgaggcgg

SEQ ID NO: 835295 - RNA, 22 nt, Human
cagccugggcaacagagagaga

SEQ ID NO: 835296 - RNA, 24 nt, Human
cagcuacucaggaggcugaggcag

SEQ ID NO: 835297 - RNA, 18 nt, Human
cauaauaaugguaugaaa

SEQ ID NO: 835298 - RNA, 23 nt, Human
cauuaaacauauuacuguacaaa

SEQ ID NO: 835299 - RNA, 18 nt, Human
cauuguacuccagccugg

SEQ ID NO: 835300 - RNA, 19 nt, Human
cauuguacuccagccuggg

SEQ ID NO: 835301 - RNA, 21 nt, Human
cauuguacuccagccugggca

SEQ ID NO: 835302 - RNA, 24 nt, Human
cauuguacuccagccugggcaaca

SEQ ID NO: 835303 - RNA, 24 nt, Human
ccaaucacauucauacagagaaaa

SEQ ID NO: 835304 - RNA, 20 nt, Human
ccauuguacuccagccuggg

SEQ ID NO: 835305 - RNA, 21 nt, Human
ccauuguacuccagccugggc

SEQ ID NO: 835306 - RNA, 22 nt, Human
ccauuguacuccagccugggca

SEQ ID NO: 835307 - RNA, 23 nt, Human
ccauuguacuccagccugggcaa

SEQ ID NO: 835308 - RNA, 24 nt, Human
ccauuguacuccagccugggcaac

SEQ ID NO: 835309 - RNA, 19 nt, Human
cccagugcuaaaaaugacu

SEQ ID NO: 835310 - RNA, 19 nt, Human
ccugagcuggcgcaagccu

SEQ ID NO: 835311 - RNA, 23 nt, Human
ccuggccaacauggugaaacccc

SEQ ID NO: 835312 - RNA, 24 nt, Human
ccuggccaacauggugaaacccca

SEQ ID NO: 835313 - RNA, 20 nt, Human
ccuguaaucccagcacuuug

SEQ ID NO: 835314 - RNA, 21 nt, Human
ccuguaaucccagcuacucag

SEQ ID NO: 835315 - RNA, 22 nt, Human
ccuguaaucccagcuacucagg

SEQ ID NO: 835316 - RNA, 24 nt, Human
cgagaccagccuggccaacauggu

SEQ ID NO: 835317 - RNA, 24 nt, Human
cgagaucacgccauuguacuccag

SEQ ID NO: 835318 - RNA, 22 nt, Human
cuagucuaacaaauucaauaag

SEQ ID NO: 835319 - RNA, 24 nt, Human
cucaugccuguaaucccagcacuu

SEQ ID NO: 835320 - RNA, 23 nt, Human
cuggccaacauggugaaacccca

SEQ ID NO: 835321 - RNA, 19 nt, Human
cuugaaccugggaggcgga

SEQ ID NO: 835322 - RNA, 24 nt, Human
cuuuccuucauggacccuuucucu

SEQ ID NO: 835323 - RNA, 21 nt, Human
cuuuggaguccccuccauucu

SEQ ID NO: 835324 - RNA, 23 nt, Human
cuuuuccaguggaugcuauuacu

SEQ ID NO: 835325 - RNA, 19 nt, Human
gaggcggagauuugcagug

SEQ ID NO: 835326 - RNA, 24 nt, Human
gaggcgggaggaucacugcgguca

SEQ ID NO: 835327 - RNA, 24 nt, Human
gccaacauggugaaaccccaucuc

SEQ ID NO: 835328 - RNA, 22 nt, Human
gccauuguacuccagccugggc

SEQ ID NO: 835329 - RNA, 24 nt, Human
gccauuguacuccagccugggcaa

SEQ ID NO: 835330 - RNA, 21 nt, Human
ggcggagauuugcagugagcc

SEQ ID NO: 835331 - RNA, 24 nt, Human
ggcggagauuugcagugagccgag

SEQ ID NO: 835332 - RNA, 24 nt, Human
gggcaugguggcaguugccuguaa

SEQ ID NO: 835333 - RNA, 24 nt, Human
gguggcaguugccuguaaucccag

SEQ ID NO: 835334 - RNA, 23 nt, Human
gguggcucaugccuguaauccca

SEQ ID NO: 835335 - RNA, 24 nt, Human
gguggcucaugccuguaaucccag

SEQ ID NO: 835336 - RNA, 19 nt, Human
uaaaaaguaagcagaggcc

SEQ ID NO: 835337 - RNA, 20 nt, Human
uaaaaaguaagcagaggcca

SEQ ID NO: 835338 - RNA, 23 nt, Human
uaaacaauuauaaacagaaaaaa

SEQ ID NO: 835339 - RNA, 19 nt, Human
uacacagaucacaagacaa

SEQ ID NO: 835340 - RNA, 21 nt, Human
uacaucagaaaaugcaaagca

SEQ ID NO: 835341 - RNA, 19 nt, Human
uagggugauaaacauggca

SEQ ID NO: 835342 - RNA, 19 nt, Human
uaggugucaaaacuuaaag

SEQ ID NO: 835343 - RNA, 22 nt, Human
uauaaacagaaaaaaacucuuc

SEQ ID NO: 835344 - RNA, 23 nt, Human
uauuacuguacaaacaauuugga

SEQ ID NO: 835345 - RNA, 22 nt, Human
ucaaucuaaaaauaauguuccc

SEQ ID NO: 835346 - RNA, 23 nt, Human
ucacgccauuguacuccagccug

SEQ ID NO: 835347 - RNA, 22 nt, Human
ucaugccuguaaucccagcacu

SEQ ID NO: 835348 - RNA, 21 nt, Human
uccauaaccacauuagugcaa

SEQ ID NO: 835349 - RNA, 18 nt, Human
uccccuccauucuauuaa

SEQ ID NO: 835350 - RNA, 18 nt, Human
ucgcuugaaccugggagg

SEQ ID NO: 835351 - RNA, 23 nt, Human
ucuauuaaaauauacauauccua

SEQ ID NO: 835352 - RNA, 23 nt, Human
ucucuacuaaaaauacaaaaauu

SEQ ID NO: 835353 - RNA, 24 nt, Human
ucuuauuguuuauuuuuccccagu

SEQ ID NO: 835354 - RNA, 19 nt, Human
ugaaaccccaucucuacua

SEQ ID NO: 835355 - RNA, 22 nt, Human
ugagccgagaucacgccauugu

SEQ ID NO: 835356 - RNA, 20 nt, Human
ugaggcaggagaaucgcuug

SEQ ID NO: 835357 - RNA, 24 nt, Human
ugaggcaggagaaucgcuugaacc

SEQ ID NO: 835358 - RNA, 25 nt, Human
ugaggcaggagaaucgcuugaaccu

SEQ ID NO: 835359 - RNA, 22 nt, Human
ugccuaagaucuaaacaacuga

SEQ ID NO: 835360 - RNA, 23 nt, Human
ugccuguaaucccagcacuuugg

SEQ ID NO: 835361 - RNA, 23 nt, Human
ugccuguaaucccagcacuuugg

SEQ ID NO: 835362 - RNA, 24 nt, Human
ugccuguaaucccagcacuuuggg

SEQ ID NO: 835363 - RNA, 24 nt, Human
ugccuguaaucccagcuacucagg

SEQ ID NO: 835364 - RNA, 24 nt, Human
uggccaacauggugaaaccccauc

SEQ ID NO: 835365 - RNA, 24 nt, Human
uggcucaugccuguaaucccagca

SEQ ID NO: 835366 - RNA, 24 nt, Human
ugggaaaauguuaagcacuaaauc

SEQ ID NO: 835367 - RNA, 19 nt, Human
ugggaggccgaggcgggag

SEQ ID NO: 835368 - RNA, 24 nt, Human
ugggaggccgaggcgggaggauca

SEQ ID NO: 835369 - RNA, 25 nt, Human
ugggaggcggagauuugcagugagc

SEQ ID NO: 835370 - RNA, 24 nt, Human
ugguggcaguugccuguaauccca

SEQ ID NO: 835371 - RNA, 19 nt, Human
uguaaaauaaaucuaugga

SEQ ID NO: 835372 - RNA, 22 nt, Human
uguacuccagccugggcaacag

SEQ ID NO: 835373 - RNA, 22 nt, Human
uguacuccagccugggcaacag

SEQ ID NO: 835374 - RNA, 25 nt, Human
uuaaaugcugaauaaaacauuuuca

SEQ ID NO: 835375 - RNA, 18 nt, Human
uuacaacuuuaucauagu

SEQ ID NO: 835376 - RNA, 18 nt, Human
uuagccgggcaugguggc

SEQ ID NO: 835377 - RNA, 24 nt, Human
uucuauuaaaauauacauauccua

SEQ ID NO: 835378 - RNA, 25 nt, Human
uugaaccugggaggcggagauuugc

SEQ ID NO: 835379 - RNA, 20 nt, Human
uugcagugagccgagaucac

SEQ ID NO: 835380 - RNA, 21 nt, Human
uugcagugagccgagaucacg

SEQ ID NO: 835381 - RNA, 25 nt, Human
uugggaggccgaggcgggaggauca

SEQ ID NO: 835382 - RNA, 23 nt, Human
uuuauacaaaaauacucuaaagu

SEQ ID NO: 835383 - RNA, 25 nt, Human
uuucuccauaaccacauuagugcaa

SEQ ID NO: 835384 - RNA, 19 nt, Human
uuugcagugagccgagauc

SEQ ID NO: 835385 - RNA, 19 nt, Human
uuuggaguccccuccauuc

SEQ ID NO: 835386 - RNA, 19 nt, Human
uuuucacaucaaguuggcu

SEQ ID NO: 835387 - RNA, 25 nt, Human
uuuuuuuuuuuuuuuuuuuacuuaa

SEQ ID NO: 835388 - RNA, 20 nt, Human
agaggacguggggccggccc

SEQ ID NO: 835389 - RNA, 24 nt, Human
aggcaggagggcagcgugggagug

SEQ ID NO: 835390 - RNA, 22 nt, Human
agugcugcaaccguguucagcc

SEQ ID NO: 835391 - RNA, 20 nt, Human
agugggucugccucgggggc

SEQ ID NO: 835392 - RNA, 20 nt, Human
caacucaggguggugcgcag

SEQ ID NO: 835393 - RNA, 19 nt, Human
caacucagguggcgcacag

SEQ ID NO: 835394 - RNA, 21 nt, Human
caggcaggagggcagcguggg

SEQ ID NO: 835395 - RNA, 18 nt, Human
ccgcaggcuaucuucacc

SEQ ID NO: 835396 - RNA, 21 nt, Human
cucgagagcuuuguucuugag

SEQ ID NO: 835397 - RNA, 22 nt, Human
gaggacguggggccggcccugc

SEQ ID NO: 835398 - RNA, 19 nt, Human
gccggcccugccucccgga

SEQ ID NO: 835399 - RNA, 20 nt, Human
gcggcagcccagccuucccc

SEQ ID NO: 835400 - RNA, 20 nt, Human
ugagugggucugccucgggg

SEQ ID NO: 835401 - RNA, 18 nt, Human
ugcgcagaggacgugggg

SEQ ID NO: 835402 - RNA, 20 nt, Human
ugcgcagaggacguggggcc

SEQ ID NO: 835403 - RNA, 20 nt, Human
ugcugcaaccguguucagcc

SEQ ID NO: 835404 - RNA, 18 nt, Human
uggggccggcccugccuc

SEQ ID NO: 835405 - RNA, 22 nt, Human
aaaaacacccaaaaaccacaug

SEQ ID NO: 835406 - RNA, 18 nt, Human
aaaaaccacauggagaca

SEQ ID NO: 835407 - RNA, 19 nt, Human
aaaacacccaaaaaccaca

SEQ ID NO: 835408 - RNA, 22 nt, Human
aaacacccaaaaaccacaugga

SEQ ID NO: 835409 - RNA, 27 nt, Human
aaacacccaaaaaccacauggagacag

SEQ ID NO: 835410 - RNA, 24 nt, Human
aaagcagccugccccugcugcaga

SEQ ID NO: 835411 - RNA, 19 nt, Human
aacaagaaaaacacccaaa

SEQ ID NO: 835412 - RNA, 21 nt, Human
aacaagaaaaacacccaaaaa

SEQ ID NO: 835413 - RNA, 21 nt, Human
aacagcugagggaaggccccc

SEQ ID NO: 835414 - RNA, 20 nt, Human
aacuccucccccacugccuc

SEQ ID NO: 835415 - RNA, 24 nt, Human
aagaaaaacacccaaaaaccacau

SEQ ID NO: 835416 - RNA, 19 nt, Human
aagaaagcagccugccccu

SEQ ID NO: 835417 - RNA, 23 nt, Human
acaacuccucccccacugccucc

SEQ ID NO: 835418 - RNA, 19 nt, Human
acacaacaagaaaaacacc

SEQ ID NO: 835419 - RNA, 25 nt, Human
acacaacaagaaaaacacccaaaaa

SEQ ID NO: 835420 - RNA, 19 nt, Human
acacaacuccucccccacu

SEQ ID NO: 835421 - RNA, 25 nt, Human
acacaacuccucccccacugccucc

SEQ ID NO: 835422 - RNA, 23 nt, Human
acagagccagguggcuaaggcca

SEQ ID NO: 835423 - RNA, 23 nt, Human
acaggucaggaaggguggggaca

SEQ ID NO: 835424 - RNA, 20 nt, Human
acccugaggucacaggaggg

SEQ ID NO: 835425 - RNA, 22 nt, Human
agaaaaacacccaaaaaccaca

SEQ ID NO: 835426 - RNA, 21 nt, Human
agccagguggcuaaggccagg

SEQ ID NO: 835427 - RNA, 20 nt, Human
agccccccaguguggggaaa

SEQ ID NO: 835428 - RNA, 22 nt, Human
agcccuacaggcuccaggccug

SEQ ID NO: 835429 - RNA, 18 nt, Human
aggaaggcccggccaggc

SEQ ID NO: 835430 - RNA, 19 nt, Human
aggaaggguggggacaggg

SEQ ID NO: 835431 - RNA, 24 nt, Human
aggcagggcccagccccccagugg

SEQ ID NO: 835432 - RNA, 19 nt, Human
agggacagggagcccacag

SEQ ID NO: 835433 - RNA, 27 nt, Human
aguuggggcaggggccugggggggccc

SEQ ID NO: 835434 - RNA, 22 nt, Human
auggagacagaagacgagacac

SEQ ID NO: 835435 - RNA, 18 nt, Human
caaacccugaggucacag

SEQ ID NO: 835436 - RNA, 24 nt, Human
caacaagaaaaacacccaaaaacc

SEQ ID NO: 835437 - RNA, 19 nt, Human
caacuccucccccacugcc

SEQ ID NO: 835438 - RNA, 21 nt, Human
cacaacaagaaaaacacccaa

SEQ ID NO: 835439 - RNA, 22 nt, Human
cacaacaagaaaaacacccaaa

SEQ ID NO: 835440 - RNA, 23 nt, Human
cacacggcuccacggcgggggcc

SEQ ID NO: 835441 - RNA, 23 nt, Human
cacaggagggggcccaaagcggg

SEQ ID NO: 835442 - RNA, 22 nt, Human
cacuccugcccagggacaggga

SEQ ID NO: 835443 - RNA, 20 nt, Human
cagcaaggggaccccggggc

SEQ ID NO: 835444 - RNA, 21 nt, Human
cagcggcugggccccuuucuc

SEQ ID NO: 835445 - RNA, 22 nt, Human
cagcugagggaaggccccccuc

SEQ ID NO: 835446 - RNA, 19 nt, Human
caggagggggcccaaagcg

SEQ ID NO: 835447 - RNA, 18 nt, Human
cagggacagggagcccac

SEQ ID NO: 835448 - RNA, 22 nt, Human
caggggccugggggggccccau

SEQ ID NO: 835449 - RNA, 21 nt, Human
ccaccuccucaccagcacucc

SEQ ID NO: 835450 - RNA, 22 nt, Human
ccaccugcccccagaggccugu

SEQ ID NO: 835451 - RNA, 25 nt, Human
ccacugccucccugcucuagagugg

SEQ ID NO: 835452 - RNA, 22 nt, Human
ccagggacagggagcccacagc

SEQ ID NO: 835453 - RNA, 23 nt, Human
cccaaaaaccacauggagacaga

SEQ ID NO: 835454 - RNA, 21 nt, Human
ccccacugccucccugcucua

SEQ ID NO: 835455 - RNA, 22 nt, Human
ccccaugggccaaacccugagg

SEQ ID NO: 835456 - RNA, 22 nt, Human
cccccaguguggggaaacagcu

SEQ ID NO: 835457 - RNA, 26 nt, Human
ccccccucaaaaggcuccaccuccuc

SEQ ID NO: 835458 - RNA, 21 nt, Human
ccccucaaaaggcuccaccuc

SEQ ID NO: 835459 - RNA, 24 nt, Human
ccccucaaaaggcuccaccuccuc

SEQ ID NO: 835460 - RNA, 23 nt, Human
ccccugcugcagacagagccagg

SEQ ID NO: 835461 - RNA, 21 nt, Human
ccugcccccagaggccugugg

SEQ ID NO: 835462 - RNA, 18 nt, Human
ccugccccugcugcagac

SEQ ID NO: 835463 - RNA, 22 nt, Human
ccugcugcagacagagccaggu

SEQ ID NO: 835464 - RNA, 23 nt, Human
ccuguagccccuccaauacugcu

SEQ ID NO: 835465 - RNA, 22 nt, Human
ccuugccaccugcccccagagg

SEQ ID NO: 835466 - RNA, 22 nt, Human
ccuuucuccagcugccuguagc

SEQ ID NO: 835467 - RNA, 20 nt, Human
cgagacacaacuccuccccc

SEQ ID NO: 835468 - RNA, 23 nt, Human
cggggccauggccacauucauga

SEQ ID NO: 835469 - RNA, 25 nt, Human
cugggcagaaucaguuggggcaggg

SEQ ID NO: 835470 - RNA, 22 nt, Human
gaauccaggacacaacaagaaa

SEQ ID NO: 835471 - RNA, 23 nt, Human
gagacacaacuccucccccacug

SEQ ID NO: 835472 - RNA, 20 nt, Human
gagugagguccugagugagu

SEQ ID NO: 835473 - RNA, 20 nt, Human
gccccccucaaaaggcucca

SEQ ID NO: 835474 - RNA, 22 nt, Human
gcuccaccuccucaccagcacu

SEQ ID NO: 835475 - RNA, 19 nt, Human
gcucuagaguggggacaaa

SEQ ID NO: 835476 - RNA, 20 nt, Human
ggaaacagcugagggaaggc

SEQ ID NO: 835477 - RNA, 19 nt, Human
ggaaggcccggccaggccu

SEQ ID NO: 835478 - RNA, 23 nt, Human
ggacaggggcucgaccggcucag

SEQ ID NO: 835479 - RNA, 23 nt, Human
ggacaggucaggaagggugggga

SEQ ID NO: 835480 - RNA, 20 nt, Human
ggagggggcccaaagcgggg

SEQ ID NO: 835481 - RNA, 21 nt, Human
ggccugggggggccccauggg

SEQ ID NO: 835482 - RNA, 22 nt, Human
ggcugggccccuuucuccagcu

SEQ ID NO: 835483 - RNA, 21 nt, Human
gggaaacagcugagggaaggc

SEQ ID NO: 835484 - RNA, 21 nt, Human
gggagaccugaaccucagucc

SEQ ID NO: 835485 - RNA, 19 nt, Human
gggcaggggccuggggggg

SEQ ID NO: 835486 - RNA, 20 nt, Human
gggcaggggccugggggggc

SEQ ID NO: 835487 - RNA, 21 nt, Human
gggucagcggcugggccccuu

SEQ ID NO: 835488 - RNA, 22 nt, Human
uaagaaagcagccugccccugc

SEQ ID NO: 835489 - RNA, 23 nt, Human
ucaguuggggcaggggccugggg

SEQ ID NO: 835490 - RNA, 19 nt, Human
uccaccuccucaccagcac

SEQ ID NO: 835491 - RNA, 23 nt, Human
ucccccaugagcugggguacugc

SEQ ID NO: 835492 - RNA, 20 nt, Human
ucccugcucuagagugggga

SEQ ID NO: 835493 - RNA, 23 nt, Human
ucuagaguggggacaaagugggg

SEQ ID NO: 835494 - RNA, 20 nt, Human
ugacugagaagcagcugagu

SEQ ID NO: 835495 - RNA, 24 nt, Human
ugagcugggguacugcacuggggc

SEQ ID NO: 835496 - RNA, 23 nt, Human
ugcagacagagccagguggcuaa

SEQ ID NO: 835497 - RNA, 25 nt, Human
ugcagggaaggaggguaacggggag

SEQ ID NO: 835498 - RNA, 22 nt, Human
ugccaggggggcccgccuccag

SEQ ID NO: 835499 - RNA, 19 nt, Human
ugcccagggacagggagcc

SEQ ID NO: 835500 - RNA, 26 nt, Human
ugggcagaaucaguuggggcaggggc

SEQ ID NO: 835501 - RNA, 24 nt, Human
uggggaaacagcugagggaaggcc

SEQ ID NO: 835502 - RNA, 18 nt, Human
uggggggagaccugaacc

SEQ ID NO: 835503 - RNA, 19 nt, Human
uuuuuuuuuuuuuugagga

SEQ ID NO: 835504 - RNA, 21 nt, Human
uuuuuuuuuuuuuuuuugagg

SEQ ID NO: 835505 - RNA, 27 nt, Human
uuuuuuuuuuuuuuuuuuuuuuugggg

SEQ ID NO: 835506 - RNA, 23 nt, Human
aacaaacagcacuuccccauggc

SEQ ID NO: 835507 - RNA, 23 nt, Human
acagagaaaggauaacaaacagc

SEQ ID NO: 835508 - RNA, 22 nt, Human
accaucagcagcauucuugcca

SEQ ID NO: 835509 - RNA, 19 nt, Human
agaaggccauggcuccaac

SEQ ID NO: 835510 - RNA, 18 nt, Human
agacccuagggcagggug

SEQ ID NO: 835511 - RNA, 22 nt, Human
agagcagcucaguccagcguga

SEQ ID NO: 835512 - RNA, 23 nt, Human
agccacaggaguccuguggcaca

SEQ ID NO: 835513 - RNA, 24 nt, Human
agccaguccacccuguggagccag

SEQ ID NO: 835514 - RNA, 22 nt, Human
aggaaaucagggccccuggaac

SEQ ID NO: 835515 - RNA, 21 nt, Human
aggaacaaggggagacagaug

SEQ ID NO: 835516 - RNA, 22 nt, Human
aggaauaggggggacacauggc

SEQ ID NO: 835517 - RNA, 20 nt, Human
aggcagggacugggaccagg

SEQ ID NO: 835518 - RNA, 21 nt, Human
agggcccagccaguccacccu

SEQ ID NO: 835519 - RNA, 23 nt, Human
aggggggacacauggccccaggc

SEQ ID NO: 835520 - RNA, 30 nt, Human
agguaggaguggagugagaugucccagggg

SEQ ID NO: 835521 - RNA, 23 nt, Human
auacagccugcucagagccccau

SEQ ID NO: 835522 - RNA, 24 nt, Human
augcuucacaguccaagacucggg

SEQ ID NO: 835523 - RNA, 24 nt, Human
caaguuucugggcuagucccagca

SEQ ID NO: 835524 - RNA, 21 nt, Human
cacagagaaaggauaacaaac

SEQ ID NO: 835525 - RNA, 21 nt, Human
cacagcccaguaacaucccuc

SEQ ID NO: 835526 - RNA, 18 nt, Human
cacugccacagagaaagg

SEQ ID NO: 835527 - RNA, 24 nt, Human
cacuuagagccuacugccaugaag

SEQ ID NO: 835528 - RNA, 21 nt, Human
cagaugccaggcauguaugca

SEQ ID NO: 835529 - RNA, 23 nt, Human
cagcagcauucuugccauccagu

SEQ ID NO: 835530 - RNA, 20 nt, Human
cagcauucuugccauccagu

SEQ ID NO: 835531 - RNA, 21 nt, Human
cagcuaagccacagggaagcc

SEQ ID NO: 835532 - RNA, 21 nt, Human
cagcucagggaagcugcgagc

SEQ ID NO: 835533 - RNA, 21 nt, Human
cagggucccauucaaguuucu

SEQ ID NO: 835534 - RNA, 18 nt, Human
cauccagugucccuugag

SEQ ID NO: 835535 - RNA, 21 nt, Human
cauguaugcaacagagaaaau

SEQ ID NO: 835536 - RNA, 19 nt, Human
ccaucagcagcauucuugc

SEQ ID NO: 835537 - RNA, 22 nt, Human
cccagccaguccacccugugga

SEQ ID NO: 835538 - RNA, 23 nt, Human
cccauccucagcccugugcugac

SEQ ID NO: 835539 - RNA, 27 nt, Human
cccaugaccaguggcaggccggggucc

SEQ ID NO: 835540 - RNA, 23 nt, Human
ccccagaggccaacagcaggucc

SEQ ID NO: 835541 - RNA, 25 nt, Human
ccccauccucagcccugugcugacc

SEQ ID NO: 835542 - RNA, 23 nt, Human
ccccuggcucucucaggguccca

SEQ ID NO: 835543 - RNA, 24 nt, Human
cccuaggggggccucaggggaccc

SEQ ID NO: 835544 - RNA, 22 nt, Human
cccuggcucucucaggguccca

SEQ ID NO: 835545 - RNA, 22 nt, Human
cccugugcugacccacuuggua

SEQ ID NO: 835546 - RNA, 22 nt, Human
ccgaggaaaucagggccccugg

SEQ ID NO: 835547 - RNA, 18 nt, Human
ccgggaugcagguucagc

SEQ ID NO: 835548 - RNA, 18 nt, Human
ccucaggggaccccuggc

SEQ ID NO: 835549 - RNA, 21 nt, Human
ccugggaccucuggguacagg

SEQ ID NO: 835550 - RNA, 21 nt, Human
ccuggggcagacagaaagccc

SEQ ID NO: 835551 - RNA, 22 nt, Human
cgagcagccuuggcugcuuccu

SEQ ID NO: 835552 - RNA, 25 nt, Human
cgcaacaaacugccccugccugcag

SEQ ID NO: 835553 - RNA, 19 nt, Human
cgccgcagguccgggaugc

SEQ ID NO: 835554 - RNA, 24 nt, Human
cuacuaggcucgcccaggaagcca

SEQ ID NO: 835555 - RNA, 21 nt, Human
cuccaaccccugcucucaucc

SEQ ID NO: 835556 - RNA, 22 nt, Human
cuggccaccagcuaagccacag

SEQ ID NO: 835557 - RNA, 22 nt, Human
cuguggcuggugugugggaagg

SEQ ID NO: 835558 - RNA, 19 nt, Human
cuuggaaccacagucccag

SEQ ID NO: 835559 - RNA, 21 nt, Human
gaagccagucaggcuggccac

SEQ ID NO: 835560 - RNA, 25 nt, Human
gacagccccagaggccaacagcagg

SEQ ID NO: 835561 - RNA, 20 nt, Human
gagaugucccagggccuggg

SEQ ID NO: 835562 - RNA, 18 nt, Human
gcaacaaacugccccugc

SEQ ID NO: 835563 - RNA, 28 nt, Human
ggaacacagccugcgggacugggggcac

SEQ ID NO: 835564 - RNA, 24 nt, Human
ggaccagggcccagccaguccacc

SEQ ID NO: 835565 - RNA, 22 nt, Human
ggcccaguaggcaaguaugaaa

SEQ ID NO: 835566 - RNA, 21 nt, Human
gggaaccacgaagaacgcaac

SEQ ID NO: 835567 - RNA, 19 nt, Human
gggagagcagcucagucca

SEQ ID NO: 835568 - RNA, 22 nt, Human
gggaggcagcuucaguccuggg

SEQ ID NO: 835569 - RNA, 18 nt, Human
gggccccuggaacacagc

SEQ ID NO: 835570 - RNA, 21 nt, Human
gggggacacauggccccaggc

SEQ ID NO: 835571 - RNA, 18 nt, Human
gguacaggaccacagccc

SEQ ID NO: 835572 - RNA, 21 nt, Human
guggcuggugugugggaaggg

SEQ ID NO: 835573 - RNA, 18 nt, Human
uacuaggcucgcccagga

SEQ ID NO: 835574 - RNA, 18 nt, Human
uaggaaggcugcggggcc

SEQ ID NO: 835575 - RNA, 19 nt, Human
uaggcaaguaugaaaagcc

SEQ ID NO: 835576 - RNA, 22 nt, Human
uaggggggacacauggccccag

SEQ ID NO: 835577 - RNA, 21 nt, Human
uagucccagcacuaagcuggg

SEQ ID NO: 835578 - RNA, 19 nt, Human
ucacugccacagagaaagg

SEQ ID NO: 835579 - RNA, 24 nt, Human
ucacugccacagagaaaggauaac

SEQ ID NO: 835580 - RNA, 18 nt, Human
ucccagggccugggaacc

SEQ ID NO: 835581 - RNA, 19 nt, Human
ucccagggugaagggaggc

SEQ ID NO: 835582 - RNA, 25 nt, Human
uccccauggcagaugcuucacaguc

SEQ ID NO: 835583 - RNA, 24 nt, Human
ucccucauaggaaggcugcggggc

SEQ ID NO: 835584 - RNA, 22 nt, Human
ucccuuucuccauagguuccca

SEQ ID NO: 835585 - RNA, 19 nt, Human
uccuuggauucccuuucuc

SEQ ID NO: 835586 - RNA, 22 nt, Human
ugaaaagcccacaggaauaggg

SEQ ID NO: 835587 - RNA, 20 nt, Human
ugccacagagaaaggauaac

SEQ ID NO: 835588 - RNA, 20 nt, Human
ugccaugaaggcagcccuga

SEQ ID NO: 835589 - RNA, 21 nt, Human
ugcucagagccccaugugggg

SEQ ID NO: 835590 - RNA, 18 nt, Human
ugcugacccacuugguac

SEQ ID NO: 835591 - RNA, 23 nt, Human
ugcugcccaauccagagcuugaa

SEQ ID NO: 835592 - RNA, 22 nt, Human
uggaacacagccugcgggacug

SEQ ID NO: 835593 - RNA, 20 nt, Human
uggaaccacagucccagggu

SEQ ID NO: 835594 - RNA, 21 nt, Human
uggcagugugauggugggguu

SEQ ID NO: 835595 - RNA, 18 nt, Human
uggcuggugugugggaag

SEQ ID NO: 835596 - RNA, 19 nt, Human
ugggaccagggcccagcca

SEQ ID NO: 835597 - RNA, 19 nt, Human
uggugggguuagcaagagg

SEQ ID NO: 835598 - RNA, 25 nt, Human
uguggccagucacccacuuagagcc

SEQ ID NO: 835599 - RNA, 23 nt, Human
uguggcuggugugugggaagggu

SEQ ID NO: 835600 - RNA, 19 nt, Human
ugugggaagggucacccga

SEQ ID NO: 835601 - RNA, 27 nt, Human
uucucggccuguggccagucacccacu

SEQ ID NO: 835602 - RNA, 20 nt, Human
uuggaaccacagucccaggg

SEQ ID NO: 835603 - RNA, 23 nt, Human
uuuuuuuuuuuuuuuuuuuacag

SEQ ID NO: 835604 - RNA, 21 nt, Human
aaaacaaaaccacaggaaaau

SEQ ID NO: 835605 - RNA, 24 nt, Human
aaagugcugggauuacaggcguga

SEQ ID NO: 835606 - RNA, 22 nt, Human
aagaaaaaacaaaaccacagga

SEQ ID NO: 835607 - RNA, 19 nt, Human
aagugcugggauuacaggc

SEQ ID NO: 835608 - RNA, 19 nt, Human
aagugcugggauuacaggc

SEQ ID NO: 835609 - RNA, 26 nt, Human
aagugcugggauuacaggcgugagcc

SEQ ID NO: 835610 - RNA, 21 nt, Human
acccugaggcaaaaauggcuu

SEQ ID NO: 835611 - RNA, 23 nt, Human
acgggcgcccgccaccacaccca

SEQ ID NO: 835612 - RNA, 18 nt, Human
acgggguuucaccguguu

SEQ ID NO: 835613 - RNA, 19 nt, Human
acgggguuucaccguguua

SEQ ID NO: 835614 - RNA, 20 nt, Human
acgggguuucaccguguuag

SEQ ID NO: 835615 - RNA, 24 nt, Human
acgggguuucaccguguuagccag

SEQ ID NO: 835616 - RNA, 21 nt, Human
agaaaaaacaaaaccacagga

SEQ ID NO: 835617 - RNA, 19 nt, Human
agagacgggguuucaccgu

SEQ ID NO: 835618 - RNA, 19 nt, Human
aggaacaaaaaagggaaag

SEQ ID NO: 835619 - RNA, 23 nt, Human
aggaacaaaaaagggaaagaaaa

SEQ ID NO: 835620 - RNA, 21 nt, Human
aggcaaaaauggcuuuuccuu

SEQ ID NO: 835621 - RNA, 18 nt, Human
agugcugggauuacaggc

SEQ ID NO: 835622 - RNA, 24 nt, Human
augauccgcccgccucggccuccc

SEQ ID NO: 835623 - RNA, 24 nt, Human
caaaaaagggaaagaaaaaacaaa

SEQ ID NO: 835624 - RNA, 25 nt, Human
caaaaccacaggaaaauaaagagga

SEQ ID NO: 835625 - RNA, 24 nt, Human
caaagugcugggauuacaggcgug

SEQ ID NO: 835626 - RNA, 23 nt, Human
caccagugggcagcaucacggcc

SEQ ID NO: 835627 - RNA, 18 nt, Human
caccguguuagccaggau

SEQ ID NO: 835628 - RNA, 24 nt, Human
caccguguuagccaggauggucuc

SEQ ID NO: 835629 - RNA, 21 nt, Human
caguccuucucacaaacaauu

SEQ ID NO: 835630 - RNA, 21 nt, Human
cauuuuguuuuuguuuggagg

SEQ ID NO: 835631 - RNA, 20 nt, Human
ccaaagugcugggauuacag

SEQ ID NO: 835632 - RNA, 22 nt, Human
ccaaagugcugggauuacaggc

SEQ ID NO: 835633 - RNA, 22 nt, Human
ccaaagugcugggauuacaggc

SEQ ID NO: 835634 - RNA, 24 nt, Human
ccaaagugcugggauuacaggcgu

SEQ ID NO: 835635 - RNA, 21 nt, Human
cccgccaccacacccagcuaa

SEQ ID NO: 835636 - RNA, 19 nt, Human
ccggggaccccgggagcgg

SEQ ID NO: 835637 - RNA, 24 nt, Human
ccugaguaguuggacuaacgggcg

SEQ ID NO: 835638 - RNA, 20 nt, Human
ccugcuuggccggccgggga

SEQ ID NO: 835639 - RNA, 24 nt, Human
cgccucggccucccaaagugcugg

SEQ ID NO: 835640 - RNA, 21 nt, Human
cggaguuagagcccuccugcu

SEQ ID NO: 835641 - RNA, 24 nt, Human
cgggguuucaccguguuagccagg

SEQ ID NO: 835642 - RNA, 23 nt, Human
cuaauuuuuuguauuuuuaguag

SEQ ID NO: 835643 - RNA, 18 nt, Human
cucaugauccgcccgccu

SEQ ID NO: 835644 - RNA, 24 nt, Human
cuccugaccucaugauccgcccgc

SEQ ID NO: 835645 - RNA, 22 nt, Human
cuccugcuuggccggccgggga

SEQ ID NO: 835646 - RNA, 23 nt, Human
cugaggcaaaaauggcuuuuccu

SEQ ID NO: 835647 - RNA, 18 nt, Human
gaaaaaacaaaaccacag

SEQ ID NO: 835648 - RNA, 22 nt, Human
gaccucaugauccgcccgccuc

SEQ ID NO: 835649 - RNA, 24 nt, Human
gagacgggguuucaccguguuagc

SEQ ID NO: 835650 - RNA, 24 nt, Human
gagccaccgcgcucggccugcauu

SEQ ID NO: 835651 - RNA, 18 nt, Human
gaggagaaacccugaggc

SEQ ID NO: 835652 - RNA, 18 nt, Human
gauuacaggcgugagcca

SEQ ID NO: 835653 - RNA, 22 nt, Human
gauuacaggcgugagccaccgc

SEQ ID NO: 835654 - RNA, 22 nt, Human
gauuacaggcgugagccaccgc

SEQ ID NO: 835655 - RNA, 21 nt, Human
gccggggaccccgggagcggg

SEQ ID NO: 835656 - RNA, 24 nt, Human
ggauggucucgaucuccugaccuc

SEQ ID NO: 835657 - RNA, 18 nt, Human
gggaaagaaaaaacaaaa

SEQ ID NO: 835658 - RNA, 23 nt, Human
gggguuucaccguguuagccagg

SEQ ID NO: 835659 - RNA, 23 nt, Human
guagagacgggguuucaccgugu

SEQ ID NO: 835660 - RNA, 24 nt, Human
uaauuuuuuguauuuuuaguagag

SEQ ID NO: 835661 - RNA, 25 nt, Human
uaauuuuuuguauuuuuaguagaga

SEQ ID NO: 835662 - RNA, 22 nt, Human
uacaggcgugagccaccgcgcu

SEQ ID NO: 835663 - RNA, 21 nt, Human
uaguagagacgggguuucacc

SEQ ID NO: 835664 - RNA, 24 nt, Human
uaguagagacgggguuucaccgug

SEQ ID NO: 835665 - RNA, 26 nt, Human
uaguagagacgggguuucaccguguu

SEQ ID NO: 835666 - RNA, 26 nt, Human
uaguagagacgggguuucaccguugg

SEQ ID NO: 835667 - RNA, 24 nt, Human
ucaccguguuagccaggauggucu

SEQ ID NO: 835668 - RNA, 24 nt, Human
ucccaaagugcugggauuacaggc

SEQ ID NO: 835669 - RNA, 18 nt, Human
ucggccucccaaagugcu

SEQ ID NO: 835670 - RNA, 24 nt, Human
ugcugggauuacaggcgugagcca

SEQ ID NO: 835671 - RNA, 19 nt, Human
uggaggaacaaaaaaggga

SEQ ID NO: 835672 - RNA, 25 nt, Human
uggaggaacaaaaaagggaaaagac

SEQ ID NO: 835673 - RNA, 24 nt, Human
uggccggccggggaccccgggagc

SEQ ID NO: 835674 - RNA, 18 nt, Human
ugggauuacaggcgugag

SEQ ID NO: 835675 - RNA, 19 nt, Human
ugggauuacaggcgugagc

SEQ ID NO: 835676 - RNA, 21 nt, Human
ugggauuacaggcgugagcca

SEQ ID NO: 835677 - RNA, 22 nt, Human
ugggauuacaggcgugagccac

SEQ ID NO: 835678 - RNA, 23 nt, Human
ugggauuacaggcgugagccacc

SEQ ID NO: 835679 - RNA, 24 nt, Human
ugggauuacaggcgugagccaccg

SEQ ID NO: 835680 - RNA, 21 nt, Human
uguauuuuuaguagagacggg

SEQ ID NO: 835681 - RNA, 23 nt, Human
uuagagcccuccugcuuggccgg

SEQ ID NO: 835682 - RNA, 18 nt, Human
uuaguagagacgggguuu

SEQ ID NO: 835683 - RNA, 22 nt, Human
uuaguagagacgggguuucacc

SEQ ID NO: 835684 - RNA, 24 nt, Human
uuaguagagacgggguuucaccgu

SEQ ID NO: 835685 - RNA, 23 nt, Human
uuguauuuuuaguagagacgggg

SEQ ID NO: 835686 - RNA, 20 nt, Human
uuguuuggaggaacaaaaaa

SEQ ID NO: 835687 - RNA, 19 nt, Human
uuucaccguguuagccagg

SEQ ID NO: 835688 - RNA, 24 nt, Human
uuuuuaguagagacgggguuucac

SEQ ID NO: 835689 - RNA, 21 nt, Human
uuuuuguauuuuuaguagaga

SEQ ID NO: 835690 - RNA, 24 nt, Human
uuuuuuguauuuuuaguagagacg

SEQ ID NO: 835691 - RNA, 20 nt, Human
cccacggugacacucgcguc

SEQ ID NO: 835692 - RNA, 26 nt, Human
cccacggugacacucgcguccuccuc

SEQ ID NO: 835693 - RNA, 18 nt, Human
ccuguccccacggugaca

SEQ ID NO: 835694 - RNA, 21 nt, Human
cggcucagcggcggggcgcgg

SEQ ID NO: 835695 - RNA, 25 nt, Human
cguccugcuccucacccgaucuuca

SEQ ID NO: 835696 - RNA, 27 nt, Human
gaggcgcucauuuuuuuuuuuuuuuuu

SEQ ID NO: 835697 - RNA, 21 nt, Human
gagucucagcuucucuccugg

SEQ ID NO: 835698 - RNA, 24 nt, Human
ggcgcucauuuuuuuuuuuuuuuu

SEQ ID NO: 835699 - RNA, 19 nt, Human
ugacacucgcguccuccuc

SEQ ID NO: 835700 - RNA, 23 nt, Human
uuaaauccaauggaggugugucc

SEQ ID NO: 835701 - RNA, 23 nt, Human
uuccauagcugaaagucagugcu

SEQ ID NO: 835702 - RNA, 23 nt, Human
aaacagacaaaucauaacgaaca

SEQ ID NO: 835703 - RNA, 25 nt, Human
aaacagacaaaucauaacgaacaga

SEQ ID NO: 835704 - RNA, 22 nt, Human
aaccccagaagaaagacaccau

SEQ ID NO: 835705 - RNA, 23 nt, Human
aagcagguaaccgcacacaacgc

SEQ ID NO: 835706 - RNA, 22 nt, Human
aauaacugaaaaccccagaaga

SEQ ID NO: 835707 - RNA, 24 nt, Human
aauaacugaaaaccccagaagaaa

SEQ ID NO: 835708 - RNA, 23 nt, Human
acaaugaugaagagcauaaacac

SEQ ID NO: 835709 - RNA, 19 nt, Human
acuugaggaaaaugaaauu

SEQ ID NO: 835710 - RNA, 23 nt, Human
agccuuaauaaaaaucaagucca

SEQ ID NO: 835711 - RNA, 18 nt, Human
auaacugaaaaccccaga

SEQ ID NO: 835712 - RNA, 23 nt, Human
caaaaggcucaaaguucaaacca

SEQ ID NO: 835713 - RNA, 20 nt, Human
caacacuuaaaaacaaacag

SEQ ID NO: 835714 - RNA, 18 nt, Human
cacuaucaacacuuaaaa

SEQ ID NO: 835715 - RNA, 28 nt, Human
cagugagucccucugucgcaacaaguuc

SEQ ID NO: 835716 - RNA, 23 nt, Human
ccagaaucucuucauuucuuugc

SEQ ID NO: 835717 - RNA, 18 nt, Human
cccagaagaaagacacca

SEQ ID NO: 835718 - RNA, 20 nt, Human
cgaacagaguccagugaguc

SEQ ID NO: 835719 - RNA, 22 nt, Human
cucgggguggagaugcugacaa

SEQ ID NO: 835720 - RNA, 24 nt, Human
cuguucacuccaaugaguggggau

SEQ ID NO: 835721 - RNA, 23 nt, Human
gcacaaugaugaagagcauaaac

SEQ ID NO: 835722 - RNA, 19 nt, Human
gguaaccgcacacaacgca

SEQ ID NO: 835723 - RNA, 23 nt, Human
uaaguauauuuuuaugucgcuuu

SEQ ID NO: 835724 - RNA, 23 nt, Human
uaauaaaaaucaaguccacuuug

SEQ ID NO: 835725 - RNA, 22 nt, Human
uaaucucugucucuuaguacuc

SEQ ID NO: 835726 - RNA, 20 nt, Human
ugaaaaccccagaagaaaga

SEQ ID NO: 835727 - RNA, 25 nt, Human
ugcacaaaccuccaguucuugacgu

SEQ ID NO: 835728 - RNA, 23 nt, Human
ugccgaccggucucaaauugcac

SEQ ID NO: 835729 - RNA, 24 nt, Human
uuuuucuuagguuauugaugcauu

SEQ ID NO: 835730 - RNA, 20 nt, Human
aagaaagaacuaaugaggau

SEQ ID NO: 835731 - RNA, 21 nt, Human
aagaacuaaugaggauaccuc

SEQ ID NO: 835732 - RNA, 26 nt, Human
aggaagagaaacauuuaaugaaaaga

SEQ ID NO: 835733 - RNA, 18 nt, Human
caaaacaagaaagaauca

SEQ ID NO: 835734 - RNA, 18 nt, Human
caacauuacuuuuugcca

SEQ ID NO: 835735 - RNA, 21 nt, Human
caccgucaccaccuccuccca

SEQ ID NO: 835736 - RNA, 21 nt, Human
ccaaaacaagaaagaaucaca

SEQ ID NO: 835737 - RNA, 25 nt, Human
ccaaaacaagaaagaaucacauuga

SEQ ID NO: 835738 - RNA, 19 nt, Human
ccaccgucaccaccuccuc

SEQ ID NO: 835739 - RNA, 21 nt, Human
ccaccgucaccaccuccuccc

SEQ ID NO: 835740 - RNA, 21 nt, Human
cccaaaacaagaaagaaucac

SEQ ID NO: 835741 - RNA, 24 nt, Human
ccgacgcugccguugccaccguca

SEQ ID NO: 835742 - RNA, 22 nt, Human
cucccaaaacaagaaagaauca

SEQ ID NO: 835743 - RNA, 18 nt, Human
gaaagaacuaaugaggau

SEQ ID NO: 835744 - RNA, 18 nt, Human
gccugaagaaagaacuaa

SEQ ID NO: 835745 - RNA, 21 nt, Human
uaccuccaccgucucccaaaa

SEQ ID NO: 835746 - RNA, 19 nt, Human
ugccaccgucaccaccucc

SEQ ID NO: 835747 - RNA, 25 nt, Human
ugcgcagccacgcaacuaaagacac

SEQ ID NO: 835748 - RNA, 24 nt, Human
aagaggugguggaaacggaaacga

SEQ ID NO: 835749 - RNA, 21 nt, Human
aggcuaacacugacccggcac

SEQ ID NO: 835750 - RNA, 19 nt, Human
agggcuggaggcuaacacu

SEQ ID NO: 835751 - RNA, 19 nt, Human
ccgccacgcuuuccggcug

SEQ ID NO: 835752 - RNA, 23 nt, Human
ccggcugccacgugacuucuucc

SEQ ID NO: 835753 - RNA, 23 nt, Human
ccucaaggacgggaacaggaaga

SEQ ID NO: 835754 - RNA, 23 nt, Human
ccuugggugcgguaaagggaaag

SEQ ID NO: 835755 - RNA, 24 nt, Human
cuagcagcagccgccacgcuuucc

SEQ ID NO: 835756 - RNA, 20 nt, Human
gaaaggcucuagcagcagcc

SEQ ID NO: 835757 - RNA, 26 nt, Human
gccacgcuuuccggcugccacgugac

SEQ ID NO: 835758 - RNA, 22 nt, Human
gcuggaggcuaacacugacccg

SEQ ID NO: 835759 - RNA, 21 nt, Human
ucaaggacgggaacaggaaga

SEQ ID NO: 835760 - RNA, 18 nt, Human
ugcgguaaagggaaaggc

SEQ ID NO: 835761 - RNA, 20 nt, Human
ugucgcuccagcuccuuggg

SEQ ID NO: 835762 - RNA, 23 nt, Human
aaaacaaacaacguuucuccaaa

SEQ ID NO: 835763 - RNA, 23 nt, Human
aaaacaaacaacguuucuccaaa

SEQ ID NO: 835764 - RNA, 20 nt, Human
aaacaaccaauccguccccg

SEQ ID NO: 835765 - RNA, 20 nt, Human
aaacacagcccacuucaaua

SEQ ID NO: 835766 - RNA, 20 nt, Human
aaggguuggggguagaauga

SEQ ID NO: 835767 - RNA, 22 nt, Human
aaucacaaaaaacugacucagu

SEQ ID NO: 835768 - RNA, 26 nt, Human
acaaaacaaacaacguuucuccaaau

SEQ ID NO: 835769 - RNA, 21 nt, Human
acucuuuuuuuuuuuuuuuaa

SEQ ID NO: 835770 - RNA, 23 nt, Human
agaaaaucagagugcagugaaca

SEQ ID NO: 835771 - RNA, 21 nt, Human
agaaagauaguaaaagccaga

SEQ ID NO: 835772 - RNA, 23 nt, Human
auacaggaaaaaacaaccaaucc

SEQ ID NO: 835773 - RNA, 20 nt, Human
caaaaaacugacucaaugga

SEQ ID NO: 835774 - RNA, 19 nt, Human
caauacagccccucgccau

SEQ ID NO: 835775 - RNA, 25 nt, Human
caauauauuuuuuuacacuuugcuu

SEQ ID NO: 835776 - RNA, 19 nt, Human
caccggccucaaacacagc

SEQ ID NO: 835777 - RNA, 19 nt, Human
cacugcacuuuaugaaauc

SEQ ID NO: 835778 - RNA, 21 nt, Human
cagagugcagugaacauaaug

SEQ ID NO: 835779 - RNA, 21 nt, Human
cagcccacuucaauacagccc

SEQ ID NO: 835780 - RNA, 24 nt, Human
cagccccucgccauuuugguuucc

SEQ ID NO: 835781 - RNA, 23 nt, Human
cauacaggaaaaaacaaccaauc

SEQ ID NO: 835782 - RNA, 24 nt, Human
cauacaggaaaaaacaaccaaucc

SEQ ID NO: 835783 - RNA, 26 nt, Human
ccaaauacuugugcuaucuacaugau

SEQ ID NO: 835784 - RNA, 26 nt, Human
ccaaauacuugugcuaucuacaugau

SEQ ID NO: 835785 - RNA, 19 nt, Human
ccccgugggcgcuuccccu

SEQ ID NO: 835786 - RNA, 18 nt, Human
cccugcgaguccgagcac

SEQ ID NO: 835787 - RNA, 20 nt, Human
ccggccucaaacacagccca

SEQ ID NO: 835788 - RNA, 20 nt, Human
ccuuggagacaaggguuggg

SEQ ID NO: 835789 - RNA, 25 nt, Human
cgcacaaaccgagguccuuggagac

SEQ ID NO: 835790 - RNA, 20 nt, Human
cgcuucauacaggaaaaaac

SEQ ID NO: 835791 - RNA, 23 nt, Human
cggguacccggcacauaugcacg

SEQ ID NO: 835792 - RNA, 25 nt, Human
cuaaucaaaacaaacaacguuucuc

SEQ ID NO: 835793 - RNA, 23 nt, Human
cucaaacacagcccacuucaaua

SEQ ID NO: 835794 - RNA, 20 nt, Human
cuuacugggcacccgcccca

SEQ ID NO: 835795 - RNA, 24 nt, Human
cuucauacaggaaaaaacaaccaa

SEQ ID NO: 835796 - RNA, 19 nt, Human
gcauuauauacacugcacu

SEQ ID NO: 835797 - RNA, 22 nt, Human
gcuucauacaggaaaaaacaac

SEQ ID NO: 835798 - RNA, 24 nt, Human
gguuggggguagaaugagcguucu

SEQ ID NO: 835799 - RNA, 22 nt, Human
uaagaaagauaguaaaagccag

SEQ ID NO: 835800 - RNA, 18 nt, Human
uaaucaaaacaaacaacg

SEQ ID NO: 835801 - RNA, 19 nt, Human
uacuugugcuaucuacaug

SEQ ID NO: 835802 - RNA, 19 nt, Human
uacuugugcuaucuacaug

SEQ ID NO: 835803 - RNA, 22 nt, Human
uacuugugcuaucuacaugaug

SEQ ID NO: 835804 - RNA, 22 nt, Human
uacuugugcuaucuacaugaug

SEQ ID NO: 835805 - RNA, 23 nt, Human
ucuaacaccaugcauggguuuca

SEQ ID NO: 835806 - RNA, 20 nt, Human
ucuuuuuuuuuuuuuuuaag

SEQ ID NO: 835807 - RNA, 21 nt, Human
ugacaauauccauaacauuga

SEQ ID NO: 835808 - RNA, 21 nt, Human
ugacucuuuuuuuuuuuuuuu

SEQ ID NO: 835809 - RNA, 23 nt, Human
ugagcguucuuacaccggccuca

SEQ ID NO: 835810 - RNA, 19 nt, Human
ugcgaguccgagcacuuac

SEQ ID NO: 835811 - RNA, 21 nt, Human
ugguaacaaaacaaacaacgu

SEQ ID NO: 835812 - RNA, 23 nt, Human
ugguaacaaaacaaacaacguuu

SEQ ID NO: 835813 - RNA, 24 nt, Human
ugguaacaaaacaaacaacguuuc

SEQ ID NO: 835814 - RNA, 23 nt, Human
uuuuccaacauuuugguaacaaa

SEQ ID NO: 835815 - RNA, 25 nt, Human
uuuuugacucuuuuuuuuuuuuuuu

SEQ ID NO: 835816 - RNA, 23 nt, Human
acacugccgcaaacgucggggcc

SEQ ID NO: 835817 - RNA, 26 nt, Human
acgggacaaggaacacugccgcaaac

SEQ ID NO: 835818 - RNA, 18 nt, Human
aggcauggaggagcugug

SEQ ID NO: 835819 - RNA, 22 nt, Human
aucccugccaagcuggccccgg

SEQ ID NO: 835820 - RNA, 20 nt, Human
caaggaacacugccgcaaac

SEQ ID NO: 835821 - RNA, 19 nt, Human
caggauccacccacugccc

SEQ ID NO: 835822 - RNA, 21 nt, Human
cccggccccacgggacaagga

SEQ ID NO: 835823 - RNA, 20 nt, Human
ccucugggcggcccaggccu

SEQ ID NO: 835824 - RNA, 19 nt, Human
cucacagcuccccgggauc

SEQ ID NO: 835825 - RNA, 19 nt, Human
gaaaccaggauccacccac

SEQ ID NO: 835826 - RNA, 19 nt, Human
gagccucugggcggcccag

SEQ ID NO: 835827 - RNA, 18 nt, Human
gccuguuggucaggcaug

SEQ ID NO: 835828 - RNA, 26 nt, Human
gggacaaggaacacugccgcaaacgu

SEQ ID NO: 835829 - RNA, 18 nt, Human
guagaacucucgcucaaa

SEQ ID NO: 835830 - RNA, 19 nt, Human
guagaacucucgcucaaac

SEQ ID NO: 835831 - RNA, 21 nt, Human
guagaacucucgcucaaacag

SEQ ID NO: 835832 - RNA, 21 nt, Human
uauuuggcccaggauccagcc

SEQ ID NO: 835833 - RNA, 18 nt, Human
ucacagcuccccgggauc

SEQ ID NO: 835834 - RNA, 22 nt, Human
uccacacuuucuucagccucuu

SEQ ID NO: 835835 - RNA, 19 nt, Human
ugagaggagccucugggcg

SEQ ID NO: 835836 - RNA, 20 nt, Human
ugagaggagccucugggcgg

SEQ ID NO: 835837 - RNA, 19 nt, Human
ugccaagcuggccccgggc

SEQ ID NO: 835838 - RNA, 18 nt, Human
uggccccgggcuggaagg

SEQ ID NO: 835839 - RNA, 23 nt, Human
uggcuuccacacuuucuucagcc

SEQ ID NO: 835840 - RNA, 19 nt, Human
ugggcagcacacgaaacca

SEQ ID NO: 835841 - RNA, 21 nt, Human
ugggcagcacacgaaaccagg

SEQ ID NO: 835842 - RNA, 22 nt, Human
ugggcagcacacgaaaccagga

SEQ ID NO: 835843 - RNA, 19 nt, Human
ugggccuguuggucaggca

SEQ ID NO: 835844 - RNA, 18 nt, Human
uguuggucaggcauggag

SEQ ID NO: 835845 - RNA, 18 nt, Human
uuggcccaggauccagcc

SEQ ID NO: 835846 - RNA, 19 nt, Human
uuggcccaggauccagccc

SEQ ID NO: 835847 - RNA, 22 nt, Human
uuuggcccaggauccagcccuc

SEQ ID NO: 835848 - RNA, 18 nt, Human
aaccuuuuugcuuucucu

SEQ ID NO: 835849 - RNA, 19 nt, Human
aaccuuuuugcuuucucuu

SEQ ID NO: 835850 - RNA, 19 nt, Human
aaugagguuuuuuaagugc

SEQ ID NO: 835851 - RNA, 21 nt, Human
agccgagauuguccagaaauc

SEQ ID NO: 835852 - RNA, 18 nt, Human
aggaaggagaaggagagg

SEQ ID NO: 835853 - RNA, 20 nt, Human
aggauagggggaaagaagga

SEQ ID NO: 835854 - RNA, 20 nt, Human
aggggagaaaaggugauuuu

SEQ ID NO: 835855 - RNA, 19 nt, Human
agggggaaagaaggaaaag

SEQ ID NO: 835856 - RNA, 22 nt, Human
cagcguguuggucucgucucuu

SEQ ID NO: 835857 - RNA, 21 nt, Human
ccagagagcugcgaaguacaa

SEQ ID NO: 835858 - RNA, 21 nt, Human
ccuuuucccucuuucgaaacc

SEQ ID NO: 835859 - RNA, 24 nt, Human
cgcuuuucaagcaguccccagcac

SEQ ID NO: 835860 - RNA, 20 nt, Human
cggcugauaccguagccggc

SEQ ID NO: 835861 - RNA, 21 nt, Human
cuacuuucacucucguuuucc

SEQ ID NO: 835862 - RNA, 20 nt, Human
cucacccucccccaaaugga

SEQ ID NO: 835863 - RNA, 26 nt, Human
cucagggugaggguagagguucagga

SEQ ID NO: 835864 - RNA, 22 nt, Human
cuuccucacccucccccaaaug

SEQ ID NO: 835865 - RNA, 22 nt, Human
cuuggagguuugcugacgcccc

SEQ ID NO: 835866 - RNA, 26 nt, Human
cuuuucccucuuucgaaaccucuuuu

SEQ ID NO: 835867 - RNA, 20 nt, Human
cuuuuggcccucacaaaauc

SEQ ID NO: 835868 - RNA, 18 nt, Human
gaaagaaggaaaaggggg

SEQ ID NO: 835869 - RNA, 21 nt, Human
gaaguacaacucaguccgccg

SEQ ID NO: 835870 - RNA, 21 nt, Human
gagcacagucugacauuggcc

SEQ ID NO: 835871 - RNA, 19 nt, Human
gaucacuuuugugcaagaa

SEQ ID NO: 835872 - RNA, 18 nt, Human
gcaaccaaaagcaaaacg

SEQ ID NO: 835873 - RNA, 18 nt, Human
gcugaccggcugauaccg

SEQ ID NO: 835874 - RNA, 23 nt, Human
gcuuuucaagcaguccccagcac

SEQ ID NO: 835875 - RNA, 24 nt, Human
ggaaaaaacucaggauaccaaaag

SEQ ID NO: 835876 - RNA, 20 nt, Human
ggaaagaaggaaaagggggg

SEQ ID NO: 835877 - RNA, 24 nt, Human
ggaaguuguuugauaaucauuucu

SEQ ID NO: 835878 - RNA, 24 nt, Human
ggagagaaaaaggauagggggaaa

SEQ ID NO: 835879 - RNA, 24 nt, Human
ggaggcguuguuuggacuggguuu

SEQ ID NO: 835880 - RNA, 20 nt, Human
gggaaaaaacucaggauacc

SEQ ID NO: 835881 - RNA, 18 nt, Human
gggggggaugggguggag

SEQ ID NO: 835882 - RNA, 18 nt, Human
gguggagagaaaaaggau

SEQ ID NO: 835883 - RNA, 22 nt, Human
gugcaagaaugugauuuguuuu

SEQ ID NO: 835884 - RNA, 18 nt, Human
uaauguuuuuauuacugu

SEQ ID NO: 835885 - RNA, 20 nt, Human
uaauguuuuuauuacuguuu

SEQ ID NO: 835886 - RNA, 26 nt, Human
uacauaaaaguuuguguccagaguuu

SEQ ID NO: 835887 - RNA, 20 nt, Human
uagcugaguugugugucuga

SEQ ID NO: 835888 - RNA, 18 nt, Human
uaguggguucuccuugug

SEQ ID NO: 835889 - RNA, 19 nt, Human
ucacccucccccaaaugga

SEQ ID NO: 835890 - RNA, 20 nt, Human
ucacccucccccaaauggaa

SEQ ID NO: 835891 - RNA, 20 nt, Human
ucaggagagggaggagcaca

SEQ ID NO: 835892 - RNA, 24 nt, Human
ucugcagccgagauuguccagaaa

SEQ ID NO: 835893 - RNA, 18 nt, Human
ucuucucggggggucgug

SEQ ID NO: 835894 - RNA, 22 nt, Human
ugaggaaggagaaggagaggga

SEQ ID NO: 835895 - RNA, 28 nt, Human
ugagguuuuuuaagugccaaccacaggg

SEQ ID NO: 835896 - RNA, 24 nt, Human
ugccuucuuccucacccuccccca

SEQ ID NO: 835897 - RNA, 23 nt, Human
ugcgcuccccguuaagcccuacu

SEQ ID NO: 835898 - RNA, 23 nt, Human
uggaagaaaacgaucacuuuugu

SEQ ID NO: 835899 - RNA, 24 nt, Human
uggaaguuguuugauaaucauuuc

SEQ ID NO: 835900 - RNA, 24 nt, Human
uggagagaaaaaggauagggggaa

SEQ ID NO: 835901 - RNA, 22 nt, Human
ugguuggguugcucucuuuuug

SEQ ID NO: 835902 - RNA, 21 nt, Human
uguaggugagugccuucuucc

SEQ ID NO: 835903 - RNA, 19 nt, Human
uguccagaaaucuggaaau

SEQ ID NO: 835904 - RNA, 19 nt, Human
uguccagagagcugcgaag

SEQ ID NO: 835905 - RNA, 19 nt, Human
ugugucgcuuuucaagcag

SEQ ID NO: 835906 - RNA, 21 nt, Human
uguuuguaguggguucuccuu

SEQ ID NO: 835907 - RNA, 20 nt, Human
uucugcagaagaauuagggg

SEQ ID NO: 835908 - RNA, 21 nt, Human
uuuugugguggcggagcccga

SEQ ID NO: 835909 - RNA, 18 nt, Human
uuuuuuccuuuucccucu

SEQ ID NO: 835910 - RNA, 22 nt, Human
uuuuuuuuuuuuuuuuuuacaa

SEQ ID NO: 835911 - RNA, 22 nt, Human
aaacaaacaaaaaaaacuuucg

SEQ ID NO: 835912 - RNA, 20 nt, Human
aaacaagaugggaaugacgg

SEQ ID NO: 835913 - RNA, 23 nt, Human
aaacagaaaggacuuaaaccagg

SEQ ID NO: 835914 - RNA, 18 nt, Human
aaaccaggcugggggcuc

SEQ ID NO: 835915 - RNA, 18 nt, Human
aaagacuuagagaaagcu

SEQ ID NO: 835916 - RNA, 20 nt, Human
aaagcaaacaaacaaaaaaa

SEQ ID NO: 835917 - RNA, 23 nt, Human
aacagaaacaaaaacauuuucca

SEQ ID NO: 835918 - RNA, 24 nt, Human
aagcaaacaaacaaaaaaaacuuu

SEQ ID NO: 835919 - RNA, 21 nt, Human
aagcugauggaaugccaagca

SEQ ID NO: 835920 - RNA, 22 nt, Human
aauccucaaacagaaaugugga

SEQ ID NO: 835921 - RNA, 23 nt, Human
acuccacgcagcgccugguugcc

SEQ ID NO: 835922 - RNA, 20 nt, Human
agaaacaaaaacauuuucca

SEQ ID NO: 835923 - RNA, 22 nt, Human
agaaauaaacuaauuuaaaagc

SEQ ID NO: 835924 - RNA, 20 nt, Human
agacuuagagaaagcugaug

SEQ ID NO: 835925 - RNA, 23 nt, Human
agcaguuucuggucugguccugc

SEQ ID NO: 835926 - RNA, 19 nt, Human
aggguuuagucauaagcaa

SEQ ID NO: 835927 - RNA, 22 nt, Human
augaaaauuaaaaguaugaaug

SEQ ID NO: 835928 - RNA, 23 nt, Human
auuugacugaaagucauuguugg

SEQ ID NO: 835929 - RNA, 22 nt, Human
caaaaaaaacuuucgccuagga

SEQ ID NO: 835930 - RNA, 23 nt, Human
caacagaaacaaaaacauuuucc

SEQ ID NO: 835931 - RNA, 24 nt, Human
caacagaaacaaaaacauuuucca

SEQ ID NO: 835932 - RNA, 20 nt, Human
caagaugggaaugacggaac

SEQ ID NO: 835933 - RNA, 21 nt, Human
cacacaguuauuugguaccac

SEQ ID NO: 835934 - RNA, 24 nt, Human
cacacgugagucagacaguaccac

SEQ ID NO: 835935 - RNA, 18 nt, Human
cacucuugagaaucagga

SEQ ID NO: 835936 - RNA, 23 nt, Human
cagcgccugguugccggagcccc

SEQ ID NO: 835937 - RNA, 25 nt, Human
cauaguauguuuucucuuuuuuccu

SEQ ID NO: 835938 - RNA, 21 nt, Human
ccuggcuguagccaccuucuc

SEQ ID NO: 835939 - RNA, 20 nt, Human
ccuucccagacccacgcgcc

SEQ ID NO: 835940 - RNA, 21 nt, Human
cgcaaaacagaaaggacuuaa

SEQ ID NO: 835941 - RNA, 25 nt, Human
cucgcaaaacagaaaggacuuaaac

SEQ ID NO: 835942 - RNA, 21 nt, Human
cuguuuacaacagaaacaaaa

SEQ ID NO: 835943 - RNA, 19 nt, Human
cuucccagacccacgcgcc

SEQ ID NO: 835944 - RNA, 21 nt, Human
gaaacacaagcucgcaaaaca

SEQ ID NO: 835945 - RNA, 19 nt, Human
gaaaggcagcugaaacaca

SEQ ID NO: 835946 - RNA, 22 nt, Human
gcaaaacagaaaggacuuaaac

SEQ ID NO: 835947 - RNA, 23 nt, Human
gcaaaacagaaaggacuuaaacc

SEQ ID NO: 835948 - RNA, 18 nt, Human
gcaaugggaaagaaaggc

SEQ ID NO: 835949 - RNA, 27 nt, Human
gcagugggucuuugaacuccuuagcau

SEQ ID NO: 835950 - RNA, 22 nt, Human
gccuggacccgcugaugugaga

SEQ ID NO: 835951 - RNA, 23 nt, Human
gcugaaacacaagcucgcaaaac

SEQ ID NO: 835952 - RNA, 20 nt, Human
ggagaaauccucaaacagaa

SEQ ID NO: 835953 - RNA, 18 nt, Human
uaaguagggggcauagac

SEQ ID NO: 835954 - RNA, 20 nt, Human
uagagaaagcugauggaaug

SEQ ID NO: 835955 - RNA, 22 nt, Human
ucaaacaggccauguucuuuag

SEQ ID NO: 835956 - RNA, 22 nt, Human
uccacgcagcgccugguugccg

SEQ ID NO: 835957 - RNA, 25 nt, Human
ucucuucugaaaacaagaugggaau

SEQ ID NO: 835958 - RNA, 21 nt, Human
ugaaacacaagcucgcaaaac

SEQ ID NO: 835959 - RNA, 20 nt, Human
ugaacuccuuagcauaccac

SEQ ID NO: 835960 - RNA, 21 nt, Human
ugaugugagaagaggggccaa

SEQ ID NO: 835961 - RNA, 18 nt, Human
ugccggagcccccauagu

SEQ ID NO: 835962 - RNA, 21 nt, Human
uggcuugugagcaaaaugggu

SEQ ID NO: 835963 - RNA, 22 nt, Human
ugggaugaguaaguagggggca

SEQ ID NO: 835964 - RNA, 18 nt, Human
ugucauggugugaacaga

SEQ ID NO: 835965 - RNA, 25 nt, Human
uuaaaagcaaacaaacaaaaaaaac

SEQ ID NO: 835966 - RNA, 21 nt, Human
uuagaggugggaacaagaaaa

SEQ ID NO: 835967 - RNA, 23 nt, Human
uuccuuggguuagaggugggaac

SEQ ID NO: 835968 - RNA, 18 nt, Human
uucuuuagcaguuucugg

SEQ ID NO: 835969 - RNA, 24 nt, Human
uuuaaaagcaaacaaacaaaaaaa

SEQ ID NO: 835970 - RNA, 22 nt, Human
uuuccaguuuaauccauuugac

SEQ ID NO: 835971 - RNA, 22 nt, Human
aaaaagaaaaaaaauaaggcag

SEQ ID NO: 835972 - RNA, 21 nt, Human
aaaaagacgaaagcaaacagg

SEQ ID NO: 835973 - RNA, 20 nt, Human
aaaagaaaaaaaauaaggca

SEQ ID NO: 835974 - RNA, 23 nt, Human
aaacaauggaaaaagcccucccc

SEQ ID NO: 835975 - RNA, 20 nt, Human
aaacacccaguacugaaaca

SEQ ID NO: 835976 - RNA, 21 nt, Human
aaacacccaguacugaaacaa

SEQ ID NO: 835977 - RNA, 20 nt, Human
aaacaggagccccagacagc

SEQ ID NO: 835978 - RNA, 21 nt, Human
aaagauaaagcagguuuacaa

SEQ ID NO: 835979 - RNA, 24 nt, Human
aaagugcugggauuacagguguga

SEQ ID NO: 835980 - RNA, 22 nt, Human
aacacaauuauucuuuuacacu

SEQ ID NO: 835981 - RNA, 23 nt, Human
aacugcugagaauccccaaaccg

SEQ ID NO: 835982 - RNA, 20 nt, Human
aagauaaagcagguuuacaa

SEQ ID NO: 835983 - RNA, 18 nt, Human
aagugcugggauuacagg

SEQ ID NO: 835984 - RNA, 19 nt, Human
aagugcugggauuacaggu

SEQ ID NO: 835985 - RNA, 26 nt, Human
aagugcugggauuacaggugugagcu

SEQ ID NO: 835986 - RNA, 23 nt, Human
acaauauccaaagacaguauugc

SEQ ID NO: 835987 - RNA, 24 nt, Human
acaauggaaaaagcccuccccuca

SEQ ID NO: 835988 - RNA, 20 nt, Human
acaaugucaccaacgagccu

SEQ ID NO: 835989 - RNA, 19 nt, Human
acaggcacccgccaccacg

SEQ ID NO: 835990 - RNA, 18 nt, Human
acauggucggagcugaag

SEQ ID NO: 835991 - RNA, 24 nt, Human
accauguuggccaggcugguuuug

SEQ ID NO: 835992 - RNA, 18 nt, Human
acccaguacugaaacaau

SEQ ID NO: 835993 - RNA, 18 nt, Human
acgggguuucaccguguu

SEQ ID NO: 835994 - RNA, 19 nt, Human
acgggguuucaccguguua

SEQ ID NO: 835995 - RNA, 20 nt, Human
acgggguuucaccguguuag

SEQ ID NO: 835996 - RNA, 24 nt, Human
acgggguuucaccguguuagccag

SEQ ID NO: 835997 - RNA, 23 nt, Human
acguuuucugaacacuuacauuu

SEQ ID NO: 835998 - RNA, 24 nt, Human
acucugucuguugcccaggcugga

SEQ ID NO: 835999 - RNA, 24 nt, Human
acuucgugauccgccugccuuggc

SEQ ID NO: 836000 - RNA, 22 nt, Human
agaauaaauauacacccaaugu

SEQ ID NO: 836001 - RNA, 19 nt, Human
agagacgggguuucaccgu

SEQ ID NO: 836002 - RNA, 18 nt, Human
agcagcuaaaaaacagga

SEQ ID NO: 836003 - RNA, 23 nt, Human
agcuaaaaaacaggagccccaga

SEQ ID NO: 836004 - RNA, 18 nt, Human
aggcggggcugcugcagg

SEQ ID NO: 836005 - RNA, 21 nt, Human
agggccugggagcccagggag

SEQ ID NO: 836006 - RNA, 18 nt, Human
aggucagguugcagggga

SEQ ID NO: 836007 - RNA, 18 nt, Human
aguagcugggacuacagg

SEQ ID NO: 836008 - RNA, 19 nt, Human
aguagcugggacuacaggc

SEQ ID NO: 836009 - RNA, 18 nt, Human
aguagcugggacuauagg

SEQ ID NO: 836010 - RNA, 19 nt, Human
agugcaguggcgugaucuc

SEQ ID NO: 836011 - RNA, 20 nt, Human
agugcaguggcgugaucucg

SEQ ID NO: 836012 - RNA, 23 nt, Human
agugcaguggcgugaucucggcu

SEQ ID NO: 836013 - RNA, 24 nt, Human
agugcaguggcgugaucucggcuc

SEQ ID NO: 836014 - RNA, 24 nt, Human
auaaaacaaaucugaaauucacaa

SEQ ID NO: 836015 - RNA, 21 nt, Human
auaaagcagguuuacaacccu

SEQ ID NO: 836016 - RNA, 19 nt, Human
auccgccugccuuggccuc

SEQ ID NO: 836017 - RNA, 19 nt, Human
augcacugucguggcucaa

SEQ ID NO: 836018 - RNA, 18 nt, Human
augggguuucaccauguu

SEQ ID NO: 836019 - RNA, 22 nt, Human
augggguuucaccauguuggcc

SEQ ID NO: 836020 - RNA, 24 nt, Human
augggguuucaccauguuggccag

SEQ ID NO: 836021 - RNA, 20 nt, Human
caaaaaaagacgaaagcaaa

SEQ ID NO: 836022 - RNA, 24 nt, Human
caaagugcugggauuacaggugug

SEQ ID NO: 836023 - RNA, 18 nt, Human
caacauggucggagcuga

SEQ ID NO: 836024 - RNA, 23 nt, Human
caaugaacuccuuuugcuguauc

SEQ ID NO: 836025 - RNA, 26 nt, Human
caauggaaaaagcccuccccucaauu

SEQ ID NO: 836026 - RNA, 24 nt, Human
caauuuuuuguauuuuuaguagag

SEQ ID NO: 836027 - RNA, 20 nt, Human
cacaaaaaaagacgaaagca

SEQ ID NO: 836028 - RNA, 23 nt, Human
cacaaaaaaagacgaaagcaaac

SEQ ID NO: 836029 - RNA, 21 nt, Human
cacaaugucaccaacgagccu

SEQ ID NO: 836030 - RNA, 21 nt, Human
caccauguuggccaggcuggu

SEQ ID NO: 836031 - RNA, 24 nt, Human
caccauguuggccaggcugguuuu

SEQ ID NO: 836032 - RNA, 26 nt, Human
caccauguuggccaggcugguuuuga

SEQ ID NO: 836033 - RNA, 18 nt, Human
caccguguuagccaggau

SEQ ID NO: 836034 - RNA, 24 nt, Human
caccguguuagccaggauggucuc

SEQ ID NO: 836035 - RNA, 18 nt, Human
caccuaccagguucaagc

SEQ ID NO: 836036 - RNA, 19 nt, Human
caccuggccuaauuuuugu

SEQ ID NO: 836037 - RNA, 28 nt, Human
cacucugucuguugcccaggcuggagug

SEQ ID NO: 836038 - RNA, 20 nt, Human
cacuuguuuuucucaaauau

SEQ ID NO: 836039 - RNA, 22 nt, Human
cagaauaaauauacacccaaug

SEQ ID NO: 836040 - RNA, 24 nt, Human
cagccgcaacugcugagaaucccc

SEQ ID NO: 836041 - RNA, 25 nt, Human
cagcuaaaaaacaggagccccagga

SEQ ID NO: 836042 - RNA, 21 nt, Human
caggcacccgccaccacgccu

SEQ ID NO: 836043 - RNA, 22 nt, Human
caguacugaaacaauauccaaa

SEQ ID NO: 836044 - RNA, 20 nt, Human
caucuccaaaggccaaaagc

SEQ ID NO: 836045 - RNA, 23 nt, Human
cauguuggccaggcugguuuuga

SEQ ID NO: 836046 - RNA, 21 nt, Human
ccaaagugcugggauuacagg

SEQ ID NO: 836047 - RNA, 21 nt, Human
ccaaagugcugggauuacagg

SEQ ID NO: 836048 - RNA, 24 nt, Human
ccaaagugcugggauuacaggugu

SEQ ID NO: 836049 - RNA, 19 nt, Human
ccagguucaagcuauucuc

SEQ ID NO: 836050 - RNA, 18 nt, Human
ccauucuccugccucagc

SEQ ID NO: 836051 - RNA, 18 nt, Human
cccaaauguucugacguu

SEQ ID NO: 836052 - RNA, 22 nt, Human
cccaaguuggagugcaguggcg

SEQ ID NO: 836053 - RNA, 21 nt, Human
cccaguacugaaacaauaucc

SEQ ID NO: 836054 - RNA, 25 nt, Human
cccaucccauuuacacauucaaaaa

SEQ ID NO: 836055 - RNA, 23 nt, Human
cccgaguagcugggacuacaggc

SEQ ID NO: 836056 - RNA, 24 nt, Human
cccgaguagcugggacuacaggca

SEQ ID NO: 836057 - RNA, 19 nt, Human
cccgaguagcugggacuau

SEQ ID NO: 836058 - RNA, 24 nt, Human
cccgaguagcugggacuauaggug

SEQ ID NO: 836059 - RNA, 20 nt, Human
ccgccaccacgccuggccaa

SEQ ID NO: 836060 - RNA, 24 nt, Human
ccuaccagguucaagcuauucucc

SEQ ID NO: 836061 - RNA, 22 nt, Human
ccugccuuggccucccaaagug

SEQ ID NO: 836062 - RNA, 22 nt, Human
ccuuuaaacacccaguacugaa

SEQ ID NO: 836063 - RNA, 20 nt, Human
cgcaccauucuccugccuca

SEQ ID NO: 836064 - RNA, 24 nt, Human
cuaaaagauaaagcagguuuacaa

SEQ ID NO: 836065 - RNA, 23 nt, Human
cuaauuuuuguauuuuuaguaga

SEQ ID NO: 836066 - RNA, 27 nt, Human
cucacucugucuguugcccaggcugga

SEQ ID NO: 836067 - RNA, 24 nt, Human
cucagccucccgaguagcugggac

SEQ ID NO: 836068 - RNA, 24 nt, Human
cuccugacuucgugauccgccugc

SEQ ID NO: 836069 - RNA, 24 nt, Human
cucugucuguugcccaggcuggag

SEQ ID NO: 836070 - RNA, 19 nt, Human
cugaagaacagcagcuaaa

SEQ ID NO: 836071 - RNA, 23 nt, Human
cugagauagcaagucaaguuuau

SEQ ID NO: 836072 - RNA, 25 nt, Human
cugccgcaccuggccuaauuuuugu

SEQ ID NO: 836073 - RNA, 23 nt, Human
cugccucagccucccgaguagcu

SEQ ID NO: 836074 - RNA, 23 nt, Human
cugccuuggccucccaaagugcu

SEQ ID NO: 836075 - RNA, 23 nt, Human
cuguuucagacucccgaguagcu

SEQ ID NO: 836076 - RNA, 18 nt, Human
gaaacaauauccaaagac

SEQ ID NO: 836077 - RNA, 27 nt, Human
gacugcuuugggcaugcccuuuguuuu

SEQ ID NO: 836078 - RNA, 24 nt, Human
gacuucgugauccgccugccuugg

SEQ ID NO: 836079 - RNA, 24 nt, Human
gagacgggguuucaccguguuagc

SEQ ID NO: 836080 - RNA, 18 nt, Human
gagaugggguuucaccau

SEQ ID NO: 836081 - RNA, 24 nt, Human
gagaugggguuucaccauguuggc

SEQ ID NO: 836082 - RNA, 25 nt, Human
gaguagcugggacuacaggcacccg

SEQ ID NO: 836083 - RNA, 18 nt, Human
gauuacaggugugagcug

SEQ ID NO: 836084 - RNA, 23 nt, Human
gauuacaggugugagcugccgca

SEQ ID NO: 836085 - RNA, 19 nt, Human
gcacaaaaaaagacgaaag

SEQ ID NO: 836086 - RNA, 20 nt, Human
gccucagccucccgaguagc

SEQ ID NO: 836087 - RNA, 22 nt, Human
gccuuggccucccaaagugcug

SEQ ID NO: 836088 - RNA, 20 nt, Human
gcuaaaaaacaggagcccca

SEQ ID NO: 836089 - RNA, 18 nt, Human
ggaaaaagcccuccccuc

SEQ ID NO: 836090 - RNA, 23 nt, Human
ggagcaacaaaucaguuuaaaac

SEQ ID NO: 836091 - RNA, 18 nt, Human
ggauaguggcuugggggu

SEQ ID NO: 836092 - RNA, 24 nt, Human
ggauggucucaaucuccugacuuc

SEQ ID NO: 836093 - RNA, 19 nt, Human
ggccagugcccaaguuuaa

SEQ ID NO: 836094 - RNA, 18 nt, Human
ggccugggagcccaggga

SEQ ID NO: 836095 - RNA, 18 nt, Human
gggcugcugcaggagggc

SEQ ID NO: 836096 - RNA, 22 nt, Human
gggguuucaccauguuggccag

SEQ ID NO: 836097 - RNA, 23 nt, Human
gggguuucaccguguuagccagg

SEQ ID NO: 836098 - RNA, 18 nt, Human
ggguuucaccauguuggc

SEQ ID NO: 836099 - RNA, 22 nt, Human
ggguuucaccauguuggccagg

SEQ ID NO: 836100 - RNA, 22 nt, Human
ggguuucaccguguuagccagg

SEQ ID NO: 836101 - RNA, 23 nt, Human
guagagacgggguuucaccgugu

SEQ ID NO: 836102 - RNA, 23 nt, Human
guagagaugggguuucaccaugu

SEQ ID NO: 836103 - RNA, 21 nt, Human
gugaucucggcucacugcaag

SEQ ID NO: 836104 - RNA, 23 nt, Human
guggcuggccagugcccaaguuu

SEQ ID NO: 836105 - RNA, 26 nt, Human
guucagaauaaauauacacccaauua

SEQ ID NO: 836106 - RNA, 20 nt, Human
guuuaaaaccccaaauguuc

SEQ ID NO: 836107 - RNA, 19 nt, Human
uaaaaccccaaauguucug

SEQ ID NO: 836108 - RNA, 23 nt, Human
uaaaagauaaagcagguuuacaa

SEQ ID NO: 836109 - RNA, 23 nt, Human
uaaauaaauagcaaaaaaagugg

SEQ ID NO: 836110 - RNA, 23 nt, Human
uaaauagcaaaaaaaguggauaa

SEQ ID NO: 836111 - RNA, 19 nt, Human
uaauaggcuuuuuuuuuuu

SEQ ID NO: 836112 - RNA, 24 nt, Human
uaauuuuuguauuuuuaguagaga

SEQ ID NO: 836113 - RNA, 24 nt, Human
uacaaaaagaaaaaaaauaaggca

SEQ ID NO: 836114 - RNA, 25 nt, Human
uacaaaaagaaaaaaaauaaggcag

SEQ ID NO: 836115 - RNA, 19 nt, Human
uacaacccugcaccgcgca

SEQ ID NO: 836116 - RNA, 19 nt, Human
uacacuuuuaacaauauaa

SEQ ID NO: 836117 - RNA, 22 nt, Human
uacaggcacccgccaccacgcc

SEQ ID NO: 836118 - RNA, 21 nt, Human
uacauaaauauucacaugaaa

SEQ ID NO: 836119 - RNA, 24 nt, Human
uaccagguucaagcuauucuccug

SEQ ID NO: 836120 - RNA, 22 nt, Human
uagagaugggguuucaccaugu

SEQ ID NO: 836121 - RNA, 22 nt, Human
uagcaagucaaguuuauaaaga

SEQ ID NO: 836122 - RNA, 20 nt, Human
uagcagcuauuuguccuuua

SEQ ID NO: 836123 - RNA, 19 nt, Human
uaggcuuuuuuuuuuuuaa

SEQ ID NO: 836124 - RNA, 21 nt, Human
uaguagagacgggguuucacc

SEQ ID NO: 836125 - RNA, 24 nt, Human
uaguagagacgggguuucaccgug

SEQ ID NO: 836126 - RNA, 26 nt, Human
uaguagagacgggguuucaccguguu

SEQ ID NO: 836127 - RNA, 26 nt, Human
uaguagagacgggguuucaccguugg

SEQ ID NO: 836128 - RNA, 24 nt, Human
uaguagagaugggguuucaccaug

SEQ ID NO: 836129 - RNA, 25 nt, Human
uaguagagaugggguuucaccaugu

SEQ ID NO: 836130 - RNA, 26 nt, Human
uauucaguguucauuugauaguucua

SEQ ID NO: 836131 - RNA, 21 nt, Human
ucaccaacgagccuaucccuu

SEQ ID NO: 836132 - RNA, 24 nt, Human
ucaccguguuagccaggauggucu

SEQ ID NO: 836133 - RNA, 23 nt, Human
ucagccucccgaguagcugggac

SEQ ID NO: 836134 - RNA, 23 nt, Human
uccaaccuugauuuucacuuuaa

SEQ ID NO: 836135 - RNA, 23 nt, Human
ucccaaagugcugggauuacagg

SEQ ID NO: 836136 - RNA, 24 nt, Human
ucccgaguagcugggacuacaggc

SEQ ID NO: 836137 - RNA, 23 nt, Human
ucccgaguagcugggacuauagg

SEQ ID NO: 836138 - RNA, 24 nt, Human
ucccgaguagcugggacuauaggu

SEQ ID NO: 836139 - RNA, 21 nt, Human
ucggagcugaagaacagcagc

SEQ ID NO: 836140 - RNA, 21 nt, Human
ucuaagugggacaacuaguuc

SEQ ID NO: 836141 - RNA, 27 nt, Human
ucucacucugucuguugcccaggcugg

SEQ ID NO: 836142 - RNA, 28 nt, Human
ucucacucugucuguugcccaggcugga

SEQ ID NO: 836143 - RNA, 20 nt, Human
ucuccaaaggccaaaagcaa

SEQ ID NO: 836144 - RNA, 24 nt, Human
ucuccugccucagccucccgagua

SEQ ID NO: 836145 - RNA, 28 nt, Human
ucucgcucugucuguugcccaaguugga

SEQ ID NO: 836146 - RNA, 20 nt, Human
ucugucuguugcccaggcug

SEQ ID NO: 836147 - RNA, 21 nt, Human
ucugucuguugcccaggcugg

SEQ ID NO: 836148 - RNA, 24 nt, Human
ucugucuguugcccaggcuggagu

SEQ ID NO: 836149 - RNA, 24 nt, Human
ucuguugcccaaguuggagugcag

SEQ ID NO: 836150 - RNA, 18 nt, Human
ucuguugcccaggcugga

SEQ ID NO: 836151 - RNA, 24 nt, Human
ucuucugacuucguggcuggccag

SEQ ID NO: 836152 - RNA, 19 nt, Human
ugaaacaauauccaaagac

SEQ ID NO: 836153 - RNA, 25 nt, Human
ugaaacaauauccaaagacaguauu

SEQ ID NO: 836154 - RNA, 19 nt, Human
ugaaaccuccaccuaccag

SEQ ID NO: 836155 - RNA, 23 nt, Human
ugaagaacagcagcuaaaaaaca

SEQ ID NO: 836156 - RNA, 18 nt, Human
ugagacagagucucgcuc

SEQ ID NO: 836157 - RNA, 22 nt, Human
ugagacagagucucgcucuguc

SEQ ID NO: 836158 - RNA, 22 nt, Human
ugagauaaucacacagcaacau

SEQ ID NO: 836159 - RNA, 22 nt, Human
ugagauggagucucacucuguc

SEQ ID NO: 836160 - RNA, 22 nt, Human
ugcaguggcgugaucucggcuc

SEQ ID NO: 836161 - RNA, 19 nt, Human
ugccaagggucuggguccu

SEQ ID NO: 836162 - RNA, 21 nt, Human
ugcccaaguuggagugcagug

SEQ ID NO: 836163 - RNA, 18 nt, Human
ugcccaggcuggagugca

SEQ ID NO: 836164 - RNA, 18 nt, Human
ugcccaggcuggagugca

SEQ ID NO: 836165 - RNA, 20 nt, Human
ugcccaggcuggagugcaug

SEQ ID NO: 836166 - RNA, 21 nt, Human
ugcccaggcuggagugcaugc

SEQ ID NO: 836167 - RNA, 24 nt, Human
ugccucagccucccgaguagcugg

SEQ ID NO: 836168 - RNA, 20 nt, Human
ugcugggauuacagguguga

SEQ ID NO: 836169 - RNA, 23 nt, Human
ugcuuacccaucccauuuacaca

SEQ ID NO: 836170 - RNA, 19 nt, Human
uggagugcaguggcgugau

SEQ ID NO: 836171 - RNA, 23 nt, Human
uggagugcaguggcgugaucucg

SEQ ID NO: 836172 - RNA, 24 nt, Human
uggagugcaguggcgugaucucgg

SEQ ID NO: 836173 - RNA, 19 nt, Human
uggauaguggcuugggggu

SEQ ID NO: 836174 - RNA, 24 nt, Human
uggccaggcugguuuugaucuucu

SEQ ID NO: 836175 - RNA, 20 nt, Human
uggcgugaucucggcucacu

SEQ ID NO: 836176 - RNA, 21 nt, Human
ugggacuacaggcacccgcca

SEQ ID NO: 836177 - RNA, 22 nt, Human
ugggacuacaggcacccgccac

SEQ ID NO: 836178 - RNA, 24 nt, Human
ugggacuacaggcacccgccacca

SEQ ID NO: 836179 - RNA, 21 nt, Human
ugggacuauaggugcgugcca

SEQ ID NO: 836180 - RNA, 22 nt, Human
ugggacuauaggugcgugccac

SEQ ID NO: 836181 - RNA, 24 nt, Human
ugggacuauaggugcgugccacca

SEQ ID NO: 836182 - RNA, 25 nt, Human
ugggacuauaggugcgugccaccau

SEQ ID NO: 836183 - RNA, 18 nt, Human
ugggauuacaggugugag

SEQ ID NO: 836184 - RNA, 19 nt, Human
ugggauuacaggugugagc

SEQ ID NO: 836185 - RNA, 22 nt, Human
ugggauuacaggugugagcugc

SEQ ID NO: 836186 - RNA, 23 nt, Human
ugggauuacaggugugagcugcc

SEQ ID NO: 836187 - RNA, 24 nt, Human
ugggauuacaggugugagcugccg

SEQ ID NO: 836188 - RNA, 25 nt, Human
ugggauuacaggugugagcugccgc

SEQ ID NO: 836189 - RNA, 24 nt, Human
ugggguuucaccauguuggccagg

SEQ ID NO: 836190 - RNA, 21 nt, Human
uguauuuuuaguagagacggg

SEQ ID NO: 836191 - RNA, 21 nt, Human
uguauuuuuaguagagauggg

SEQ ID NO: 836192 - RNA, 23 nt, Human
ugucuguugcccaggcuggagug

SEQ ID NO: 836193 - RNA, 18 nt, Human
uuaguagagacgggguuu

SEQ ID NO: 836194 - RNA, 22 nt, Human
uuaguagagacgggguuucacc

SEQ ID NO: 836195 - RNA, 24 nt, Human
uuaguagagacgggguuucaccgu

SEQ ID NO: 836196 - RNA, 18 nt, Human
uuaguagagaugggguuu

SEQ ID NO: 836197 - RNA, 22 nt, Human
uuaguagagaugggguuucacc

SEQ ID NO: 836198 - RNA, 24 nt, Human
uuaguagagaugggguuucaccau

SEQ ID NO: 836199 - RNA, 18 nt, Human
uucaaaaaagggaaauuc

SEQ ID NO: 836200 - RNA, 23 nt, Human
uucacuuguuuuucucaaauauu

SEQ ID NO: 836201 - RNA, 21 nt, Human
uucucaagaugaaaaucucau

SEQ ID NO: 836202 - RNA, 21 nt, Human
uugcaggggaagacugcuuug

SEQ ID NO: 836203 - RNA, 18 nt, Human
uuggccucccaaagugcu

SEQ ID NO: 836204 - RNA, 23 nt, Human
uuguauuuuuaguagagacgggg

SEQ ID NO: 836205 - RNA, 23 nt, Human
uuguauuuuuaguagagaugggg

SEQ ID NO: 836206 - RNA, 25 nt, Human
uuuaauauaauuuaucuugcugaga

SEQ ID NO: 836207 - RNA, 24 nt, Human
uuucaccauguuggccaggcuggu

SEQ ID NO: 836208 - RNA, 19 nt, Human
uuucaccguguuagccagg

SEQ ID NO: 836209 - RNA, 19 nt, Human
uuucauggucacuugguca

SEQ ID NO: 836210 - RNA, 21 nt, Human
uuugcacauuugcacugagcc

SEQ ID NO: 836211 - RNA, 24 nt, Human
uuuucauauccaaccuugauuuuc

SEQ ID NO: 836212 - RNA, 20 nt, Human
uuuuguauuuuuaguagaga

SEQ ID NO: 836213 - RNA, 24 nt, Human
uuuuuaguagagacgggguuucac

SEQ ID NO: 836214 - RNA, 24 nt, Human
uuuuuaguagagaugggguuucac

SEQ ID NO: 836215 - RNA, 20 nt, Human
uuuuuguauuuuuaguagag

SEQ ID NO: 836216 - RNA, 21 nt, Human
uuuuuguauuuuuaguagaga

SEQ ID NO: 836217 - RNA, 24 nt, Human
uuuuuuguauuuuuaguagagacg

SEQ ID NO: 836218 - RNA, 20 nt, Human
uuuuuuuuuuugagacagag

SEQ ID NO: 836219 - RNA, 21 nt, Human
uuuuuuuuuuuucaggauucu

SEQ ID NO: 836220 - RNA, 25 nt, Human
uuuuuuuuuuuugagacagagucuc

SEQ ID NO: 836221 - RNA, 22 nt, Human
uuuuuuuuuuuuuuuuuucagg

SEQ ID NO: 836222 - RNA, 18 nt, Human
aaaaaaaacuaugucaca

SEQ ID NO: 836223 - RNA, 20 nt, Human
aaaagaaugggaagagaaga

SEQ ID NO: 836224 - RNA, 24 nt, Human
aaacaaaagcuuuuucacccagaa

SEQ ID NO: 836225 - RNA, 22 nt, Human
aaaguacuacuaaaaguaucau

SEQ ID NO: 836226 - RNA, 24 nt, Human
aaauuuucuuuuaaauaaaaaagc

SEQ ID NO: 836227 - RNA, 25 nt, Human
aagaacacaaacaaaagcuuuuuca

SEQ ID NO: 836228 - RNA, 22 nt, Human
acagagcauaugaaaacugccc

SEQ ID NO: 836229 - RNA, 20 nt, Human
agacaucaagagcuucugag

SEQ ID NO: 836230 - RNA, 23 nt, Human
aggagaaaagaaugggaagagaa

SEQ ID NO: 836231 - RNA, 21 nt, Human
aucuggacacauuucacagag

SEQ ID NO: 836232 - RNA, 20 nt, Human
caggaauacugugaaauuag

SEQ ID NO: 836233 - RNA, 19 nt, Human
caguacagaggcucaucuc

SEQ ID NO: 836234 - RNA, 21 nt, Human
caguacagaggcucaucucuu

SEQ ID NO: 836235 - RNA, 30 nt, Human
cauauuaaaaaaaaaaacuaugucacaucu

SEQ ID NO: 836236 - RNA, 18 nt, Human
caugaacaccguuugugc

SEQ ID NO: 836237 - RNA, 24 nt, Human
ccagcuaugacuuuuaaaauucca

SEQ ID NO: 836238 - RNA, 19 nt, Human
cccacaaacuaauuaagcc

SEQ ID NO: 836239 - RNA, 21 nt, Human
cccacaaacuaauuaagccuc

SEQ ID NO: 836240 - RNA, 21 nt, Human
cucagcaagaauuaugacaga

SEQ ID NO: 836241 - RNA, 18 nt, Human
gaaaacugcccacaaacu

SEQ ID NO: 836242 - RNA, 24 nt, Human
gagaaaagaaugggaagagaagac

SEQ ID NO: 836243 - RNA, 21 nt, Human
gagucauuuuuaaauacuugg

SEQ ID NO: 836244 - RNA, 18 nt, Human
ggaagagaagacauuucc

SEQ ID NO: 836245 - RNA, 23 nt, Human
ggagguaauagaggugagagagc

SEQ ID NO: 836246 - RNA, 24 nt, Human
gugauacagcaggaaaagguggaa

SEQ ID NO: 836247 - RNA, 21 nt, Human
uaaaaucccugggaauaguac

SEQ ID NO: 836248 - RNA, 25 nt, Human
uaacuggcagcuucugacaguccua

SEQ ID NO: 836249 - RNA, 28 nt, Human
uaagaacacaaacaaaagcuggagaccc

SEQ ID NO: 836250 - RNA, 24 nt, Human
uaagaacacaaacaaaagcuuuuu

SEQ ID NO: 836251 - RNA, 21 nt, Human
uacaguacagaggcucaucuc

SEQ ID NO: 836252 - RNA, 25 nt, Human
uagaaaaaggcauuuaauuacaaaa

SEQ ID NO: 836253 - RNA, 19 nt, Human
uaugacagaaguccacaug

SEQ ID NO: 836254 - RNA, 18 nt, Human
ucacaauaugguuugugc

SEQ ID NO: 836255 - RNA, 24 nt, Human
ugaacauaagucagaugaacugaa

SEQ ID NO: 836256 - RNA, 19 nt, Human
ugacaacacguaaagccag

SEQ ID NO: 836257 - RNA, 24 nt, Human
ugugaggagguaauagaggugaga

SEQ ID NO: 836258 - RNA, 24 nt, Human
uguuauccauaauccaauuauuau

SEQ ID NO: 836259 - RNA, 25 nt, Human
uuaacauuucucuacuucauuucuu

SEQ ID NO: 836260 - RNA, 22 nt, Human
uuaauaaauugacuccgauuau

SEQ ID NO: 836261 - RNA, 23 nt, Human
uuaaugugcugucuucacaacuu

SEQ ID NO: 836262 - RNA, 22 nt, Human
uuacuggauuauacuaucaugc

SEQ ID NO: 836263 - RNA, 19 nt, Human
uucacagagcauaugaaaa

SEQ ID NO: 836264 - RNA, 23 nt, Human
uucaggacuuaaaaaaaaaaauc

SEQ ID NO: 836265 - RNA, 24 nt, Human
aaaaaaaaaaaguacaaaucuggg

SEQ ID NO: 836266 - RNA, 21 nt, Human
aaaaaaaaaguacaaaucugg

SEQ ID NO: 836267 - RNA, 19 nt, Human
aaaaaaaguacaaaucugg

SEQ ID NO: 836268 - RNA, 23 nt, Human
aaaaaagagacacaguugauuca

SEQ ID NO: 836269 - RNA, 24 nt, Human
aaacaaaaccuacuuggaaaagaa

SEQ ID NO: 836270 - RNA, 19 nt, Human
aaaccuagacggggcagug

SEQ ID NO: 836271 - RNA, 19 nt, Human
aaagagacacaguugauuc

SEQ ID NO: 836272 - RNA, 23 nt, Human
aacugccuuaugcaggggugggg

SEQ ID NO: 836273 - RNA, 24 nt, Human
aagucaaaaaagagacacaguuga

SEQ ID NO: 836274 - RNA, 19 nt, Human
acagaccuccccccacccc

SEQ ID NO: 836275 - RNA, 23 nt, Human
acagaccuccccccaccccaaag

SEQ ID NO: 836276 - RNA, 21 nt, Human
agaaaaaaaaaaaaguacaaa

SEQ ID NO: 836277 - RNA, 22 nt, Human
agaauccacaggagggagagga

SEQ ID NO: 836278 - RNA, 21 nt, Human
agagaucacccaccugccccu

SEQ ID NO: 836279 - RNA, 24 nt, Human
agcaguuagaaaaaaaaaaaagua

SEQ ID NO: 836280 - RNA, 24 nt, Human
agcuguaagggaccaucuucaacu

SEQ ID NO: 836281 - RNA, 23 nt, Human
aggaggaaagggaacguggcugg

SEQ ID NO: 836282 - RNA, 21 nt, Human
aggagggagaggaggaaaggg

SEQ ID NO: 836283 - RNA, 19 nt, Human
aggcagccagggcaccagg

SEQ ID NO: 836284 - RNA, 22 nt, Human
agggaacguggcugggaggagg

SEQ ID NO: 836285 - RNA, 18 nt, Human
agggagaggaggaaaggg

SEQ ID NO: 836286 - RNA, 19 nt, Human
agggauuuggggaguaggg

SEQ ID NO: 836287 - RNA, 19 nt, Human
agggguggggacagggaag

SEQ ID NO: 836288 - RNA, 20 nt, Human
agggguggggacagggaagg

SEQ ID NO: 836289 - RNA, 23 nt, Human
aggugccacuaggcacagcacaa

SEQ ID NO: 836290 - RNA, 19 nt, Human
auuggggaagaaaaccaac

SEQ ID NO: 836291 - RNA, 20 nt, Human
caaaaaagagacacaguuga

SEQ ID NO: 836292 - RNA, 19 nt, Human
caagagacuaaaaacaaca

SEQ ID NO: 836293 - RNA, 25 nt, Human
caagucaaaaaagagacacaguuga

SEQ ID NO: 836294 - RNA, 22 nt, Human
cacauuacagaccuccccccac

SEQ ID NO: 836295 - RNA, 23 nt, Human
cacauuacagaccuccccccacc

SEQ ID NO: 836296 - RNA, 19 nt, Human
caccuccgcuccgcggccg

SEQ ID NO: 836297 - RNA, 25 nt, Human
cacuucuggcucagggauuugggga

SEQ ID NO: 836298 - RNA, 22 nt, Human
cagaccuccccccaccccaaag

SEQ ID NO: 836299 - RNA, 22 nt, Human
cagcacaagagacuaaaaacaa

SEQ ID NO: 836300 - RNA, 19 nt, Human
cagcacaguuuuugcagcu

SEQ ID NO: 836301 - RNA, 19 nt, Human
cagguggaagagaaugguu

SEQ ID NO: 836302 - RNA, 20 nt, Human
ccaagucaaaaaagagacac

SEQ ID NO: 836303 - RNA, 20 nt, Human
ccccaaagccuaauacuugc

SEQ ID NO: 836304 - RNA, 20 nt, Human
ccccaaagccuaauacuugc

SEQ ID NO: 836305 - RNA, 18 nt, Human
ccccccaccccaaagccu

SEQ ID NO: 836306 - RNA, 20 nt, Human
ccccuuccuuucugggcaca

SEQ ID NO: 836307 - RNA, 25 nt, Human
ccgcuagcugcgcccgccgccgcuc

SEQ ID NO: 836308 - RNA, 18 nt, Human
ccgcuccgcuccgcgccc

SEQ ID NO: 836309 - RNA, 19 nt, Human
ccuccccccaccccaaagc

SEQ ID NO: 836310 - RNA, 22 nt, Human
ccuccccccaccccaaagccua

SEQ ID NO: 836311 - RNA, 24 nt, Human
ccuuaagaggagaaccagauggcu

SEQ ID NO: 836312 - RNA, 22 nt, Human
cgcuuggagccgccccgggcuc

SEQ ID NO: 836313 - RNA, 19 nt, Human
cgggggaagccgagcugca

SEQ ID NO: 836314 - RNA, 19 nt, Human
cugcgcccgccgccgcucc

SEQ ID NO: 836315 - RNA, 18 nt, Human
cugggcacaggaaggcag

SEQ ID NO: 836316 - RNA, 24 nt, Human
gaaggcagccagggcaccaggucc

SEQ ID NO: 836317 - RNA, 20 nt, Human
gagaaaaaaagacaagaagu

SEQ ID NO: 836318 - RNA, 23 nt, Human
gagcauuucacaucacuaaccua

SEQ ID NO: 836319 - RNA, 24 nt, Human
gaggaggaaagggaacguggcugg

SEQ ID NO: 836320 - RNA, 21 nt, Human
gaggaggcaauagccccuucc

SEQ ID NO: 836321 - RNA, 20 nt, Human
gcacaagagacuaaaaacaa

SEQ ID NO: 836322 - RNA, 19 nt, Human
gcaguguccuccccagccc

SEQ ID NO: 836323 - RNA, 21 nt, Human
gcaguguccuccccagcccag

SEQ ID NO: 836324 - RNA, 20 nt, Human
gcccaggugccacuaggcac

SEQ ID NO: 836325 - RNA, 19 nt, Human
gccgacccgcuagcugcgc

SEQ ID NO: 836326 - RNA, 26 nt, Human
gcugaugggagaauccacaggaggga

SEQ ID NO: 836327 - RNA, 24 nt, Human
ggaaagggaacguggcugggagga

SEQ ID NO: 836328 - RNA, 20 nt, Human
ggaaggagguagggccaggg

SEQ ID NO: 836329 - RNA, 22 nt, Human
ggaaggagguagggccagggac

SEQ ID NO: 836330 - RNA, 21 nt, Human
ggacagggaaggagguagggc

SEQ ID NO: 836331 - RNA, 21 nt, Human
ggagaaaaaaagacaagaagu

SEQ ID NO: 836332 - RNA, 18 nt, Human
ggagguagggccagggac

SEQ ID NO: 836333 - RNA, 21 nt, Human
ggagguagggccagggacagg

SEQ ID NO: 836334 - RNA, 21 nt, Human
ggcaccagguccaggcaguga

SEQ ID NO: 836335 - RNA, 20 nt, Human
ggccgacccgcuagcugcgc

SEQ ID NO: 836336 - RNA, 21 nt, Human
gggaaggagguagggccaggg

SEQ ID NO: 836337 - RNA, 25 nt, Human
gggaguaggguaaacaaaaccuacu

SEQ ID NO: 836338 - RNA, 22 nt, Human
gggcacaggaaggcagccaggg

SEQ ID NO: 836339 - RNA, 21 nt, Human
gucaaaaaagagacacaguug

SEQ ID NO: 836340 - RNA, 21 nt, Human
gucggcccggccggcggaggg

SEQ ID NO: 836341 - RNA, 22 nt, Human
uaaaaacaacaggggaaggccg

SEQ ID NO: 836342 - RNA, 22 nt, Human
uacagaccuccccccaccccaa

SEQ ID NO: 836343 - RNA, 18 nt, Human
uacaguaaaaccaggugg

SEQ ID NO: 836344 - RNA, 20 nt, Human
uaccaagucaaaaaagagac

SEQ ID NO: 836345 - RNA, 22 nt, Human
uauaagcaccccacuucuggcu

SEQ ID NO: 836346 - RNA, 26 nt, Human
ucacaaggacagcacaguuuuugcag

SEQ ID NO: 836347 - RNA, 22 nt, Human
uccaggcagugaccucacaagg

SEQ ID NO: 836348 - RNA, 23 nt, Human
ugaccucacaaggacagcacagu

SEQ ID NO: 836349 - RNA, 21 nt, Human
ugccuuaugcaggggugggga

SEQ ID NO: 836350 - RNA, 24 nt, Human
ugggagaauccacaggagggagag

SEQ ID NO: 836351 - RNA, 30 nt, Human
uuacaacagugggagaaaaaaagacaagaa

SEQ ID NO: 836352 - RNA, 18 nt, Human
uuacagaccuccccccac

SEQ ID NO: 836353 - RNA, 22 nt, Human
uuagcaguuagaaaaaaaaaaa

SEQ ID NO: 836354 - RNA, 22 nt, Human
uuucugggcacaggaaggcagc

SEQ ID NO: 836355 - RNA, 24 nt, Human
uuugcagcuuagagaucacccacc

SEQ ID NO: 836356 - RNA, 18 nt, Human
uuugcagcuuagagaucc

SEQ ID NO: 836357 - RNA, 24 nt, Human
uuuugcagcuuagagaucacccac

SEQ ID NO: 836358 - RNA, 21 nt, Human
uuuuugcagcuuagagaucac

SEQ ID NO: 836359 - RNA, 21 nt, Human
uuuuuuuuuuuuuuaaaaagg

SEQ ID NO: 836360 - RNA, 25 nt, Human
uuuuuuuuuuuuuuuuuaaaaaggg

SEQ ID NO: 836361 - RNA, 21 nt, Human
aagcugccugcccugcagggg

SEQ ID NO: 836362 - RNA, 21 nt, Human
aagggaagaggcccaagaggc

SEQ ID NO: 836363 - RNA, 21 nt, Human
agaggcuuccuguccccuugg

SEQ ID NO: 836364 - RNA, 25 nt, Human
agcuggcggcgggccggccuagggu

SEQ ID NO: 836365 - RNA, 22 nt, Human
aggcuuggggagggcuccugcc

SEQ ID NO: 836366 - RNA, 21 nt, Human
agggcagaggcccgcccuggg

SEQ ID NO: 836367 - RNA, 18 nt, Human
aguagagggcagaggccc

SEQ ID NO: 836368 - RNA, 20 nt, Human
ccaggaagggaagaggccca

SEQ ID NO: 836369 - RNA, 18 nt, Human
cccugaaggcuuggggag

SEQ ID NO: 836370 - RNA, 19 nt, Human
ccugcagggguccagggag

SEQ ID NO: 836371 - RNA, 23 nt, Human
ccugcccugcagggguccaggga

SEQ ID NO: 836372 - RNA, 19 nt, Human
ccuggcaagugggccuggc

SEQ ID NO: 836373 - RNA, 19 nt, Human
cgggccggccuagggugcc

SEQ ID NO: 836374 - RNA, 22 nt, Human
cuccgagcagcccugaaggcuu

SEQ ID NO: 836375 - RNA, 21 nt, Human
cugccuggcaagugggccugg

SEQ ID NO: 836376 - RNA, 18 nt, Human
cuuccuguccccuugggg

SEQ ID NO: 836377 - RNA, 21 nt, Human
cuuccuguccccuugggggca

SEQ ID NO: 836378 - RNA, 18 nt, Human
gaagaggcccaagaggcu

SEQ ID NO: 836379 - RNA, 21 nt, Human
gggaagaggcccaagaggcuu

SEQ ID NO: 836380 - RNA, 24 nt, Human
gggcagcagagccaaaugcuuggg

SEQ ID NO: 836381 - RNA, 19 nt, Human
gugaggcaaaggcaggggg

SEQ ID NO: 836382 - RNA, 27 nt, Human
guuuaugugaggcaaaggcagggggcc

SEQ ID NO: 836383 - RNA, 22 nt, Human
uacaguuuaugugaggcaaagg

SEQ ID NO: 836384 - RNA, 21 nt, Human
uccaacaggugacuccgagca

SEQ ID NO: 836385 - RNA, 24 nt, Human
uccaggaagggaagaggcccaaga

SEQ ID NO: 836386 - RNA, 18 nt, Human
ucccacacaaggguccuu

SEQ ID NO: 836387 - RNA, 23 nt, Human
ucggcgacagcuggcggcgggcc

SEQ ID NO: 836388 - RNA, 23 nt, Human
ucggcgacagcuggcggcgggcc

SEQ ID NO: 836389 - RNA, 21 nt, Human
ugaaaauacuguacaguuuau

SEQ ID NO: 836390 - RNA, 24 nt, Human
ugaaagaggcuuuuaaugaaaaua

SEQ ID NO: 836391 - RNA, 18 nt, Human
ugaaggcuuggggagggc

SEQ ID NO: 836392 - RNA, 19 nt, Human
ugcagggguccagggaggu

SEQ ID NO: 836393 - RNA, 21 nt, Human
uggcggcgggccggccuaggg

SEQ ID NO: 836394 - RNA, 22 nt, Human
uuuuuuuuuuaugaaagaggcu

SEQ ID NO: 836395 - RNA, 29 nt, Human
uuuuuuuuuuuuuuuuuuuuuuaugaaaa

SEQ ID NO: 836396 - RNA, 21 nt, Human
aaacaaggacgcaacaacagc

SEQ ID NO: 836397 - RNA, 23 nt, Human
aaauagacacgaauuuuccccau

SEQ ID NO: 836398 - RNA, 20 nt, Human
aacccucgccuaggccagga

SEQ ID NO: 836399 - RNA, 22 nt, Human
aagcagggggcucgagucaggu

SEQ ID NO: 836400 - RNA, 20 nt, Human
aagcuccuuucugggcaccc

SEQ ID NO: 836401 - RNA, 18 nt, Human
acacacggcccgccuugc

SEQ ID NO: 836402 - RNA, 23 nt, Human
acacaggcccaagcaccgugcca

SEQ ID NO: 836403 - RNA, 20 nt, Human
acacgaauuuuccccaugau

SEQ ID NO: 836404 - RNA, 22 nt, Human
acagcccaggggcuguuugcca

SEQ ID NO: 836405 - RNA, 27 nt, Human
acagccuugccuuccuuccuuccucgg

SEQ ID NO: 836406 - RNA, 23 nt, Human
acaggcugagcugccgggagggu

SEQ ID NO: 836407 - RNA, 21 nt, Human
acagguggccgggggccccuu

SEQ ID NO: 836408 - RNA, 30 nt, Human
accagccuccaguucaccccagccccagcc

SEQ ID NO: 836409 - RNA, 21 nt, Human
acccggggacacaggcccaag

SEQ ID NO: 836410 - RNA, 21 nt, Human
accggcaagcgggcagugcca

SEQ ID NO: 836411 - RNA, 23 nt, Human
accuggaacccucgccuaggcca

SEQ ID NO: 836412 - RNA, 20 nt, Human
acgcagaggcucaggagccc

SEQ ID NO: 836413 - RNA, 21 nt, Human
acuggugugggcugggagggc

SEQ ID NO: 836414 - RNA, 20 nt, Human
agaccccuuguccacgccag

SEQ ID NO: 836415 - RNA, 19 nt, Human
agcagugggccuguggaga

SEQ ID NO: 836416 - RNA, 31 nt, Human
agcauguacaugagugggugugucuaggugg

SEQ ID NO: 836417 - RNA, 21 nt, Human
agccaggaagagaagccccuc

SEQ ID NO: 836418 - RNA, 19 nt, Human
agccuggggggacagacuc

SEQ ID NO: 836419 - RNA, 26 nt, Human
agcugggcaggccuggggcacccugg

SEQ ID NO: 836420 - RNA, 25 nt, Human
agcuuccagaauggcacagcagugg

SEQ ID NO: 836421 - RNA, 23 nt, Human
aggaaucugagaacagaccgugg

SEQ ID NO: 836422 - RNA, 18 nt, Human
aggcaaagccuugcugca

SEQ ID NO: 836423 - RNA, 24 nt, Human
aggcaguggggagggggucccagg

SEQ ID NO: 836424 - RNA, 21 nt, Human
aggccaaggagcagagggcac

SEQ ID NO: 836425 - RNA, 21 nt, Human
aggccuccucacaaccacccg

SEQ ID NO: 836426 - RNA, 21 nt, Human
aggcgggugcaagccuccugg

SEQ ID NO: 836427 - RNA, 18 nt, Human
agggcuccggauguggaa

SEQ ID NO: 836428 - RNA, 20 nt, Human
agggucaggguccucugugc

SEQ ID NO: 836429 - RNA, 19 nt, Human
aucugagaacagaccgugg

SEQ ID NO: 836430 - RNA, 24 nt, Human
caagcaccgugccacuaagauggg

SEQ ID NO: 836431 - RNA, 21 nt, Human
caagcgggcagugccaggcag

SEQ ID NO: 836432 - RNA, 20 nt, Human
cacagcacggcccacacggu

SEQ ID NO: 836433 - RNA, 22 nt, Human
caccaggcccucguguggcccc

SEQ ID NO: 836434 - RNA, 26 nt, Human
caccccucagcaaacaaggacgcaac

SEQ ID NO: 836435 - RNA, 21 nt, Human
cacccggggacacaggcccaa

SEQ ID NO: 836436 - RNA, 23 nt, Human
cacccugcuggccgagggucagg

SEQ ID NO: 836437 - RNA, 25 nt, Human
caccgugccacuaagauggggucug

SEQ ID NO: 836438 - RNA, 24 nt, Human
cacgaccaccucagggcccugcag

SEQ ID NO: 836439 - RNA, 21 nt, Human
cacgccaggagccuaugugga

SEQ ID NO: 836440 - RNA, 20 nt, Human
cacggcaggcacugcuaugg

SEQ ID NO: 836441 - RNA, 22 nt, Human
cacgggccggggcagacagagc

SEQ ID NO: 836442 - RNA, 20 nt, Human
cacuggggagggcaacacug

SEQ ID NO: 836443 - RNA, 19 nt, Human
cagaccgugggcggcuaug

SEQ ID NO: 836444 - RNA, 18 nt, Human
cagcacggcccacacggu

SEQ ID NO: 836445 - RNA, 21 nt, Human
cagcagagcucaugagaagcc

SEQ ID NO: 836446 - RNA, 21 nt, Human
cagcagugggccuguggagag

SEQ ID NO: 836447 - RNA, 22 nt, Human
cagccacuggggagggcaacac

SEQ ID NO: 836448 - RNA, 19 nt, Human
cagccccuccgugccaccc

SEQ ID NO: 836449 - RNA, 21 nt, Human
cagcccuagguucugacaccu

SEQ ID NO: 836450 - RNA, 19 nt, Human
cagccuccaguucacccca

SEQ ID NO: 836451 - RNA, 18 nt, Human
cagccuugccuuccuucc

SEQ ID NO: 836452 - RNA, 22 nt, Human
cagcuccaggcaccaugccccc

SEQ ID NO: 836453 - RNA, 19 nt, Human
cagcuggaaggggcaggca

SEQ ID NO: 836454 - RNA, 24 nt, Human
cagcuggagcuuccagaauggcac

SEQ ID NO: 836455 - RNA, 19 nt, Human
caggaaacagaggcggcac

SEQ ID NO: 836456 - RNA, 18 nt, Human
caggagccccgggcucug

SEQ ID NO: 836457 - RNA, 20 nt, Human
caggcaggacuacugggugg

SEQ ID NO: 836458 - RNA, 24 nt, Human
caggcaggacuacugggugggcgu

SEQ ID NO: 836459 - RNA, 21 nt, Human
cagggcagguucugugccaga

SEQ ID NO: 836460 - RNA, 18 nt, Human
caggguuccaccacccgg

SEQ ID NO: 836461 - RNA, 19 nt, Human
caggguuccaccacccggg

SEQ ID NO: 836462 - RNA, 19 nt, Human
caggugagaauccaucucu

SEQ ID NO: 836463 - RNA, 18 nt, Human
caugugaccucgggacgc

SEQ ID NO: 836464 - RNA, 22 nt, Human
ccaauaaggcuggggaacccaa

SEQ ID NO: 836465 - RNA, 22 nt, Human
ccacccgcaacgcguucggaug

SEQ ID NO: 836466 - RNA, 23 nt, Human
ccagcagcagcuggagcuuccag

SEQ ID NO: 836467 - RNA, 18 nt, Human
ccaggcccucguguggcc

SEQ ID NO: 836468 - RNA, 18 nt, Human
cccagcuggaaggggcag

SEQ ID NO: 836469 - RNA, 19 nt, Human
ccccagccaggaagagaag

SEQ ID NO: 836470 - RNA, 21 nt, Human
ccccaggugcucacccaguuc

SEQ ID NO: 836471 - RNA, 23 nt, Human
cccccuuccgccacagugggccc

SEQ ID NO: 836472 - RNA, 22 nt, Human
ccccucacacggcaccugccga

SEQ ID NO: 836473 - RNA, 24 nt, Human
ccccucuagcgcacgccccccuca

SEQ ID NO: 836474 - RNA, 23 nt, Human
cccgcaacgcguucggaugcccc

SEQ ID NO: 836475 - RNA, 19 nt, Human
cccgcgcccguccgccccg

SEQ ID NO: 836476 - RNA, 23 nt, Human
cccgcgcccguccgccccgggac

SEQ ID NO: 836477 - RNA, 18 nt, Human
cccugagccacgagggac

SEQ ID NO: 836478 - RNA, 20 nt, Human
cccuggaccccaguggggcc

SEQ ID NO: 836479 - RNA, 25 nt, Human
cccuggaccccaguggggccggagg

SEQ ID NO: 836480 - RNA, 18 nt, Human
ccgcccuucacagacccc

SEQ ID NO: 836481 - RNA, 18 nt, Human
ccuacagccugcagggca

SEQ ID NO: 836482 - RNA, 22 nt, Human
ccuaggccaggaagcagggggc

SEQ ID NO: 836483 - RNA, 21 nt, Human
ccuccaguucaccccagcccc

SEQ ID NO: 836484 - RNA, 19 nt, Human
ccucuagcgcacgcccccc

SEQ ID NO: 836485 - RNA, 18 nt, Human
ccugccccaggugcucac

SEQ ID NO: 836486 - RNA, 23 nt, Human
ccuggcugcaucgccuccaggaa

SEQ ID NO: 836487 - RNA, 23 nt, Human
ccuggugccaggccugcaccacc

SEQ ID NO: 836488 - RNA, 20 nt, Human
ccugugcagacaggcaggac

SEQ ID NO: 836489 - RNA, 22 nt, Human
ccuuccucgguccacuccuuuc

SEQ ID NO: 836490 - RNA, 21 nt, Human
ccuuccuuccuuccucggucc

SEQ ID NO: 836491 - RNA, 21 nt, Human
cgagagcacuggugugggcug

SEQ ID NO: 836492 - RNA, 21 nt, Human
cgaggacccagcggcugcaac

SEQ ID NO: 836493 - RNA, 24 nt, Human
cgccuaggccaggaagcagggggc

SEQ ID NO: 836494 - RNA, 23 nt, Human
cggaaccugcccuagugcccaac

SEQ ID NO: 836495 - RNA, 24 nt, Human
cggaugccccucagcuccaggcac

SEQ ID NO: 836496 - RNA, 20 nt, Human
cgggccggggcagacagagc

SEQ ID NO: 836497 - RNA, 21 nt, Human
cggggcagacagagcagggac

SEQ ID NO: 836498 - RNA, 26 nt, Human
cgucaggaaggaaaggcgggugcaag

SEQ ID NO: 836499 - RNA, 24 nt, Human
cuaggccaggaagcagggggcucg

SEQ ID NO: 836500 - RNA, 19 nt, Human
cuagugcccaacauggacc

SEQ ID NO: 836501 - RNA, 23 nt, Human
cucacaaccacccgcaacgcguu

SEQ ID NO: 836502 - RNA, 23 nt, Human
cucaugagaagcccuuuccuaag

SEQ ID NO: 836503 - RNA, 18 nt, Human
cuccugggauccaggguu

SEQ ID NO: 836504 - RNA, 24 nt, Human
cugaaaauagacacgaauuuuccc

SEQ ID NO: 836505 - RNA, 21 nt, Human
cugaaaccuggaacccucgcc

SEQ ID NO: 836506 - RNA, 24 nt, Human
cugaacagcaccccggguggcuga

SEQ ID NO: 836507 - RNA, 20 nt, Human
cugcagccuccagugauggc

SEQ ID NO: 836508 - RNA, 23 nt, Human
cugccgggaggggcugcccacag

SEQ ID NO: 836509 - RNA, 18 nt, Human
cugggcaccccuggaccc

SEQ ID NO: 836510 - RNA, 24 nt, Human
cuggucaccggguggauucugcug

SEQ ID NO: 836511 - RNA, 18 nt, Human
gaacagcaccccgggugg

SEQ ID NO: 836512 - RNA, 22 nt, Human
gaagcagggggcucgagucagg

SEQ ID NO: 836513 - RNA, 23 nt, Human
gaagcccuuuccuaagguggcuc

SEQ ID NO: 836514 - RNA, 19 nt, Human
gaagccuggggggacagac

SEQ ID NO: 836515 - RNA, 26 nt, Human
gagaugggaggacagcacuagcuggg

SEQ ID NO: 836516 - RNA, 19 nt, Human
gagcaagcaggccccugcc

SEQ ID NO: 836517 - RNA, 20 nt, Human
gagcugccgggagggugggc

SEQ ID NO: 836518 - RNA, 21 nt, Human
gaggcagggcacgggggagcc

SEQ ID NO: 836519 - RNA, 21 nt, Human
gaggggccaccacuggucacc

SEQ ID NO: 836520 - RNA, 21 nt, Human
gaggugccacgguguuugaaa

SEQ ID NO: 836521 - RNA, 22 nt, Human
gcaagcaggccccugccagcca

SEQ ID NO: 836522 - RNA, 20 nt, Human
gcacagcccaggggcuguuu

SEQ ID NO: 836523 - RNA, 20 nt, Human
gcacugcuaugggccagccc

SEQ ID NO: 836524 - RNA, 18 nt, Human
gcaggccuggggcacccu

SEQ ID NO: 836525 - RNA, 18 nt, Human
gcagggaggggcagcuga

SEQ ID NO: 836526 - RNA, 21 nt, Human
gcagugggccuguggagaggc

SEQ ID NO: 836527 - RNA, 22 nt, Human
gcauguacaugagugggugugu

SEQ ID NO: 836528 - RNA, 18 nt, Human
gccaggaagagaagcccc

SEQ ID NO: 836529 - RNA, 19 nt, Human
gccucuuggucccugcagc

SEQ ID NO: 836530 - RNA, 20 nt, Human
gccuugcugcagccucuccc

SEQ ID NO: 836531 - RNA, 24 nt, Human
gcgucaacugaaggagaacuggag

SEQ ID NO: 836532 - RNA, 21 nt, Human
gcguggcuggcgggcaggcag

SEQ ID NO: 836533 - RNA, 18 nt, Human
gcucccaccccucagcaa

SEQ ID NO: 836534 - RNA, 19 nt, Human
gcugcagccucucccacuc

SEQ ID NO: 836535 - RNA, 21 nt, Human
ggaaaauagaauacaaaaauc

SEQ ID NO: 836536 - RNA, 23 nt, Human
ggacaugcuggugggaagggcaa

SEQ ID NO: 836537 - RNA, 21 nt, Human
ggcacugcuaugggccagccc

SEQ ID NO: 836538 - RNA, 18 nt, Human
ggcaggcccugaccggca

SEQ ID NO: 836539 - RNA, 18 nt, Human
ggcugacacgcguggcug

SEQ ID NO: 836540 - RNA, 20 nt, Human
gggaaggaccuuaaccaccc

SEQ ID NO: 836541 - RNA, 23 nt, Human
gggaagggcaaggccugacacaa

SEQ ID NO: 836542 - RNA, 21 nt, Human
gggaauuggcuacagauguac

SEQ ID NO: 836543 - RNA, 22 nt, Human
gggaccaggucacagccccucc

SEQ ID NO: 836544 - RNA, 20 nt, Human
gggcaaccccucacccaccc

SEQ ID NO: 836545 - RNA, 25 nt, Human
gggcaaccccucacccaccugcuga

SEQ ID NO: 836546 - RNA, 18 nt, Human
gggcagggagcuggugcu

SEQ ID NO: 836547 - RNA, 18 nt, Human
gggccagccccaaggaca

SEQ ID NO: 836548 - RNA, 24 nt, Human
gggccggggcagacagagcaggga

SEQ ID NO: 836549 - RNA, 19 nt, Human
gggcgugggugagcaggag

SEQ ID NO: 836550 - RNA, 20 nt, Human
gugcgugcgcgugugcgucu

SEQ ID NO: 836551 - RNA, 19 nt, Human
uaagcccccgaggacccag

SEQ ID NO: 836552 - RNA, 19 nt, Human
uacaaugacauaaggacac

SEQ ID NO: 836553 - RNA, 23 nt, Human
uagagggggauccaggcacagcc

SEQ ID NO: 836554 - RNA, 21 nt, Human
uagcacgggcccccacccagu

SEQ ID NO: 836555 - RNA, 25 nt, Human
uauguggacugacagguagguggac

SEQ ID NO: 836556 - RNA, 22 nt, Human
ucaagaauugagggcagggaca

SEQ ID NO: 836557 - RNA, 20 nt, Human
uccaggagcccuaaccgggc

SEQ ID NO: 836558 - RNA, 21 nt, Human
ucccugacagagggaggcagg

SEQ ID NO: 836559 - RNA, 20 nt, Human
ucccugagacgcuggguggc

SEQ ID NO: 836560 - RNA, 20 nt, Human
uccgugccacccacaggggc

SEQ ID NO: 836561 - RNA, 24 nt, Human
uccucgguccacuccuuucuccug

SEQ ID NO: 836562 - RNA, 21 nt, Human
ucuccugggauccaggguugg

SEQ ID NO: 836563 - RNA, 23 nt, Human
ucuccugggauccaggguugggg

SEQ ID NO: 836564 - RNA, 20 nt, Human
ucugacaguccuaccagagc

SEQ ID NO: 836565 - RNA, 23 nt, Human
ucugggcaccccuggaccccagu

SEQ ID NO: 836566 - RNA, 25 nt, Human
ucugugccagaguuguuuccaggga

SEQ ID NO: 836567 - RNA, 18 nt, Human
ugacagagggaggcaggg

SEQ ID NO: 836568 - RNA, 23 nt, Human
ugacagggagcagugggagguug

SEQ ID NO: 836569 - RNA, 26 nt, Human
ugaccagggcuccggauguggaagcu

SEQ ID NO: 836570 - RNA, 18 nt, Human
ugaccucgggacgcccag

SEQ ID NO: 836571 - RNA, 23 nt, Human
ugaccucgggacgcccaggugug

SEQ ID NO: 836572 - RNA, 22 nt, Human
ugacuccuagcacgggcccccu

SEQ ID NO: 836573 - RNA, 18 nt, Human
ugaggggccaccacuggu

SEQ ID NO: 836574 - RNA, 19 nt, Human
ugauuaggaaucugagaac

SEQ ID NO: 836575 - RNA, 18 nt, Human
ugcaagccuccuggugcc

SEQ ID NO: 836576 - RNA, 26 nt, Human
ugcagacaggcaggacuacugggugg

SEQ ID NO: 836577 - RNA, 18 nt, Human
ugcagggcagguucugug

SEQ ID NO: 836578 - RNA, 23 nt, Human
ugcagugcuggcuggggaagcaa

SEQ ID NO: 836579 - RNA, 21 nt, Human
ugcaucgccuccaggaagccc

SEQ ID NO: 836580 - RNA, 21 nt, Human
ugcaugugugagcauguacau

SEQ ID NO: 836581 - RNA, 18 nt, Human
ugccacgguguuugaaau

SEQ ID NO: 836582 - RNA, 26 nt, Human
ugcccagcucggcgugggcuggggcc

SEQ ID NO: 836583 - RNA, 24 nt, Human
ugcugcagccucucccacucugcg

SEQ ID NO: 836584 - RNA, 23 nt, Human
ugcuuuuuguuuaaaaaagggag

SEQ ID NO: 836585 - RNA, 20 nt, Human
uggaaggggcaggcagcucg

SEQ ID NO: 836586 - RNA, 20 nt, Human
uggagcuuccagaauggcac

SEQ ID NO: 836587 - RNA, 19 nt, Human
uggaggguggggcagggag

SEQ ID NO: 836588 - RNA, 20 nt, Human
uggcagggaggggcagcuga

SEQ ID NO: 836589 - RNA, 24 nt, Human
uggcagggaggggcagcugaacag

SEQ ID NO: 836590 - RNA, 23 nt, Human
uggccgagagcacuggugugggc

SEQ ID NO: 836591 - RNA, 23 nt, Human
uggccucuuggucccugcagccu

SEQ ID NO: 836592 - RNA, 22 nt, Human
uggccugccuggccccgagagc

SEQ ID NO: 836593 - RNA, 19 nt, Human
uggcuacagauguaccaga

SEQ ID NO: 836594 - RNA, 19 nt, Human
uggcuccaggagcccuaac

SEQ ID NO: 836595 - RNA, 22 nt, Human
uggcuccaggagcccuaaccgg

SEQ ID NO: 836596 - RNA, 25 nt, Human
uggcuccaggagcccuaaccgggcu

SEQ ID NO: 836597 - RNA, 22 nt, Human
ugggaaccacggccucaagagc

SEQ ID NO: 836598 - RNA, 19 nt, Human
ugggagggcacacgcagag

SEQ ID NO: 836599 - RNA, 21 nt, Human
ugggcaaccccucacccaccu

SEQ ID NO: 836600 - RNA, 21 nt, Human
ugggcgugggugagcaggagc

SEQ ID NO: 836601 - RNA, 18 nt, Human
ugggcuggccugccuggc

SEQ ID NO: 836602 - RNA, 23 nt, Human
uggggcacccugagccacgaggg

SEQ ID NO: 836603 - RNA, 18 nt, Human
uggguggcucccaccccu

SEQ ID NO: 836604 - RNA, 20 nt, Human
ugggugugucuaggugcgug

SEQ ID NO: 836605 - RNA, 23 nt, Human
uguccacgccaggagccuaugug

SEQ ID NO: 836606 - RNA, 23 nt, Human
uucccgcccuucacagaccccuu

SEQ ID NO: 836607 - RNA, 21 nt, Human
uugcugcagccucucccacuc

SEQ ID NO: 836608 - RNA, 18 nt, Human
uuuuacuuuuuugcuuuu

SEQ ID NO: 836609 - RNA, 22 nt, Human
aacagagggaugacuuugagua

SEQ ID NO: 836610 - RNA, 24 nt, Human
acaguggccuucuuuugaguuucu

SEQ ID NO: 836611 - RNA, 20 nt, Human
agcuucuccaaagaggcaau

SEQ ID NO: 836612 - RNA, 18 nt, Human
caguggccuucuuuugag

SEQ ID NO: 836613 - RNA, 21 nt, Human
caguggccuucuuuugaguuu

SEQ ID NO: 836614 - RNA, 23 nt, Human
caguggccuucuuuugaguuucu

SEQ ID NO: 836615 - RNA, 18 nt, Human
ccaaagaggcaaucagaa

SEQ ID NO: 836616 - RNA, 21 nt, Human
ccaaagaggcaaucagaaaag

SEQ ID NO: 836617 - RNA, 22 nt, Human
ggggcccaggguggucagggca

SEQ ID NO: 836618 - RNA, 19 nt, Human
gugagacaaacaguggccu

SEQ ID NO: 836619 - RNA, 24 nt, Human
gugagacaaacaguggccuucuuu

SEQ ID NO: 836620 - RNA, 23 nt, Human
uaggugagacaaacaguggccuu

SEQ ID NO: 836621 - RNA, 20 nt, Human
ucagggaggggcuucagguu

SEQ ID NO: 836622 - RNA, 19 nt, Human
ucucugugaacagagggau

SEQ ID NO: 836623 - RNA, 20 nt, Human
ugacuuugaguagaauggga

SEQ ID NO: 836624 - RNA, 20 nt, Human
ugagacaaacaguggccuuc

SEQ ID NO: 836625 - RNA, 22 nt, Human
ugagcuucuccaaagaggcaau

SEQ ID NO: 836626 - RNA, 18 nt, Human
uggucagggcacagcuug

SEQ ID NO: 836627 - RNA, 22 nt, Human
ugguuccguccagaaagguggg

SEQ ID NO: 836628 - RNA, 23 nt, Human
ugguuccguccagaaaggugggg

SEQ ID NO: 836629 - RNA, 21 nt, Human
uugcccugaccaguucucaac

SEQ ID NO: 836630 - RNA, 20 nt, Human
uuggucuuacgcauuuuuag

SEQ ID NO: 836631 - RNA, 21 nt, Human
uuggucuuacgcauuuuuagg

SEQ ID NO: 836632 - RNA, 21 nt, Human
aaaaaugaagucuucucuguu

SEQ ID NO: 836633 - RNA, 19 nt, Human
aaaacaccucuguccaucu

SEQ ID NO: 836634 - RNA, 24 nt, Human
aaaacaccucuguccaucugauua

SEQ ID NO: 836635 - RNA, 18 nt, Human
aaacccccacucccaccc

SEQ ID NO: 836636 - RNA, 18 nt, Human
aaacccccacucccaccc

SEQ ID NO: 836637 - RNA, 19 nt, Human
aacaucgguccccccaacc

SEQ ID NO: 836638 - RNA, 19 nt, Human
aacaucgguccccccaacc

SEQ ID NO: 836639 - RNA, 21 nt, Human
aaccuuuuuccccuuacacac

SEQ ID NO: 836640 - RNA, 21 nt, Human
aaccuuuuuccccuuacacac

SEQ ID NO: 836641 - RNA, 21 nt, Human
aaggaacagacuucucggugc

SEQ ID NO: 836642 - RNA, 23 nt, Human
aaggaacagacuucucggugcuu

SEQ ID NO: 836643 - RNA, 23 nt, Human
aaggaacagacuucucggugcuu

SEQ ID NO: 836644 - RNA, 21 nt, Human
aaggcgcuguccagaucauuc

SEQ ID NO: 836645 - RNA, 22 nt, Human
acagaagcugcccagaucuucu

SEQ ID NO: 836646 - RNA, 22 nt, Human
acagaagcugcccagaucuucu

SEQ ID NO: 836647 - RNA, 22 nt, Human
accacuuaagagacuuguuuaa

SEQ ID NO: 836648 - RNA, 26 nt, Human
acccccacucccacccuauuccccac

SEQ ID NO: 836649 - RNA, 26 nt, Human
acccccacucccacccuauuccccac

SEQ ID NO: 836650 - RNA, 19 nt, Human
acccgucucccaaaccccc

SEQ ID NO: 836651 - RNA, 20 nt, Human
acugcagauucauucacacu

SEQ ID NO: 836652 - RNA, 21 nt, Human
acuuguuuaaaccuuuuuccc

SEQ ID NO: 836653 - RNA, 21 nt, Human
acuuguuuaaaccuuuuuccc

SEQ ID NO: 836654 - RNA, 23 nt, Human
agaaggugagcaacuuguaaaga

SEQ ID NO: 836655 - RNA, 20 nt, Human
agagagcaaggcaaaaagcu

SEQ ID NO: 836656 - RNA, 20 nt, Human
aggaacagaagcugcccaga

SEQ ID NO: 836657 - RNA, 20 nt, Human
aggaacagaagcugcccaga

SEQ ID NO: 836658 - RNA, 26 nt, Human
aggacagagagcaaggcaaaaagcuu

SEQ ID NO: 836659 - RNA, 20 nt, Human
aggggagcugaaugagccag

SEQ ID NO: 836660 - RNA, 21 nt, Human
caacggggcccucacuaagcu

SEQ ID NO: 836661 - RNA, 20 nt, Human
cacacuggccaaaguagggu

SEQ ID NO: 836662 - RNA, 23 nt, Human
caccacuuaagagacuuguuuaa

SEQ ID NO: 836663 - RNA, 21 nt, Human
cacccgucucccaaaccccca

SEQ ID NO: 836664 - RNA, 25 nt, Human
cacccuuucccacccgucucccaaa

SEQ ID NO: 836665 - RNA, 25 nt, Human
cacccuuucccacccgucucccaaa

SEQ ID NO: 836666 - RNA, 19 nt, Human
caccggcaccaaggcgcug

SEQ ID NO: 836667 - RNA, 19 nt, Human
caggaacagaagcugccca

SEQ ID NO: 836668 - RNA, 19 nt, Human
caggaacagaagcugccca

SEQ ID NO: 836669 - RNA, 19 nt, Human
caggggagcugaaugagcc

SEQ ID NO: 836670 - RNA, 18 nt, Human
cagugauccucuuccucu

SEQ ID NO: 836671 - RNA, 26 nt, Human
cauuccaucuuccuucagaaguuuca

SEQ ID NO: 836672 - RNA, 19 nt, Human
ccauuugcuuuauauucug

SEQ ID NO: 836673 - RNA, 18 nt, Human
cccaaacccccacuccca

SEQ ID NO: 836674 - RNA, 18 nt, Human
cccaaacccccacuccca

SEQ ID NO: 836675 - RNA, 27 nt, Human
cccaaacccccacucccacccuauucc

SEQ ID NO: 836676 - RNA, 22 nt, Human
cccacucccacccuauucccca

SEQ ID NO: 836677 - RNA, 22 nt, Human
cccacucccacccuauucccca

SEQ ID NO: 836678 - RNA, 18 nt, Human
ccccaaccacccuuuccc

SEQ ID NO: 836679 - RNA, 18 nt, Human
ccccaaccacccuuuccc

SEQ ID NO: 836680 - RNA, 22 nt, Human
ccccaaccacccuuucccaccc

SEQ ID NO: 836681 - RNA, 22 nt, Human
ccccaaccacccuuucccaccc

SEQ ID NO: 836682 - RNA, 24 nt, Human
ccccaaccacccuuucccacccgu

SEQ ID NO: 836683 - RNA, 25 nt, Human
cccccaaccacccuuucccacccgu

SEQ ID NO: 836684 - RNA, 25 nt, Human
cccccaaccacccuuucccacccgu

SEQ ID NO: 836685 - RNA, 21 nt, Human
cccccacucccacccuauucc

SEQ ID NO: 836686 - RNA, 21 nt, Human
cccccacucccacccuauucc

SEQ ID NO: 836687 - RNA, 28 nt, Human
cccccacucccacccuauuccccacccc

SEQ ID NO: 836688 - RNA, 28 nt, Human
cccccacucccacccuauuccccacccc

SEQ ID NO: 836689 - RNA, 26 nt, Human
ccccccaaccacccuuucccacccgu

SEQ ID NO: 836690 - RNA, 23 nt, Human
cccucccaucccacccuugguga

SEQ ID NO: 836691 - RNA, 24 nt, Human
ccucacuaagcuggcaggccccuc

SEQ ID NO: 836692 - RNA, 18 nt, Human
ccugcugauucaguaugc

SEQ ID NO: 836693 - RNA, 18 nt, Human
ccugcugauucaguaugc

SEQ ID NO: 836694 - RNA, 19 nt, Human
cggcaccaaggcgcugucc

SEQ ID NO: 836695 - RNA, 21 nt, Human
cucccaaacccccacucccac

SEQ ID NO: 836696 - RNA, 21 nt, Human
cucccaaacccccacucccac

SEQ ID NO: 836697 - RNA, 19 nt, Human
gaaacuguuucaucuucgu

SEQ ID NO: 836698 - RNA, 22 nt, Human
gcaacaagucugaacagaaaaa

SEQ ID NO: 836699 - RNA, 22 nt, Human
gcaaggcaaaaagcuuuggcaa

SEQ ID NO: 836700 - RNA, 22 nt, Human
gcagauucauucacacuggcca

SEQ ID NO: 836701 - RNA, 22 nt, Human
gcaggaacagaagcugcccaga

SEQ ID NO: 836702 - RNA, 19 nt, Human
gggaaaaaagucuucucau

SEQ ID NO: 836703 - RNA, 24 nt, Human
gggcuggccauugcucccugcuug

SEQ ID NO: 836704 - RNA, 22 nt, Human
guacugcgagggaaggggcugg

SEQ ID NO: 836705 - RNA, 19 nt, Human
uaacagaaggggauuagcu

SEQ ID NO: 836706 - RNA, 19 nt, Human
uaacagaaggggauuagcu

SEQ ID NO: 836707 - RNA, 18 nt, Human
uagaaacugcagauucau

SEQ ID NO: 836708 - RNA, 26 nt, Human
uauuuuauuuccccucugcccuccca

SEQ ID NO: 836709 - RNA, 25 nt, Human
ucaauaacuaugaaaucaaccuguu

SEQ ID NO: 836710 - RNA, 18 nt, Human
ucaggugaggacagagag

SEQ ID NO: 836711 - RNA, 19 nt, Human
uccagaauauaaaagauga

SEQ ID NO: 836712 - RNA, 23 nt, Human
ucccaaacccccacucccacccu

SEQ ID NO: 836713 - RNA, 23 nt, Human
ucccaaacccccacucccacccu

SEQ ID NO: 836714 - RNA, 28 nt, Human
ucccaaacccccacucccacccuauucc

SEQ ID NO: 836715 - RNA, 22 nt, Human
ucccacccuauuccccacccca

SEQ ID NO: 836716 - RNA, 22 nt, Human
ucccacccuauuccccacccca

SEQ ID NO: 836717 - RNA, 20 nt, Human
ucccagguuguaagcuucug

SEQ ID NO: 836718 - RNA, 25 nt, Human
uccccccaaccacccuuucccaccc

SEQ ID NO: 836719 - RNA, 25 nt, Human
uccccccaaccacccuuucccaccc

SEQ ID NO: 836720 - RNA, 18 nt, Human
ucccuuguuuugucucaa

SEQ ID NO: 836721 - RNA, 20 nt, Human
ucucccaaacccccacuccc

SEQ ID NO: 836722 - RNA, 20 nt, Human
ucucccaaacccccacuccc

SEQ ID NO: 836723 - RNA, 21 nt, Human
ucugcccucccaucccacccu

SEQ ID NO: 836724 - RNA, 26 nt, Human
ucuguggucaggggagcugaaugagc

SEQ ID NO: 836725 - RNA, 19 nt, Human
ucuuccucuguggucaggg

SEQ ID NO: 836726 - RNA, 23 nt, Human
ugagaagggggaucuagaaucuu

SEQ ID NO: 836727 - RNA, 24 nt, Human
ugagaagggggaucuagaaucuua

SEQ ID NO: 836728 - RNA, 23 nt, Human
ugcaacaagucugaacagaaaaa

SEQ ID NO: 836729 - RNA, 23 nt, Human
ugcaggaacagaagcugcccaga

SEQ ID NO: 836730 - RNA, 21 nt, Human
ugcuaagauacuuucaaaaca

SEQ ID NO: 836731 - RNA, 20 nt, Human
uggucauuccaucuuccuuc

SEQ ID NO: 836732 - RNA, 19 nt, Human
ugucuaaacaguaacagaa

SEQ ID NO: 836733 - RNA, 19 nt, Human
ugucuaaacaguaacagaa

SEQ ID NO: 836734 - RNA, 21 nt, Human
ugugcaggaacagaagcugcc

SEQ ID NO: 836735 - RNA, 23 nt, Human
uguugcaacaagucugaacagaa

SEQ ID NO: 836736 - RNA, 23 nt, Human
uguugcaacaagucugaacagaa

SEQ ID NO: 836737 - RNA, 20 nt, Human
uuagcacagugauccucuuc

SEQ ID NO: 836738 - RNA, 20 nt, Human
uuagcacagugauccucuuc

SEQ ID NO: 836739 - RNA, 21 nt, Human
uuccauuugcuuuauauucug

SEQ ID NO: 836740 - RNA, 20 nt, Human
uucccacccgucucccaaac

SEQ ID NO: 836741 - RNA, 21 nt, Human
uucccacccgucucccaaacc

SEQ ID NO: 836742 - RNA, 18 nt, Human
uuccuucagaaguuucag

SEQ ID NO: 836743 - RNA, 23 nt, Human
uuuuuuuuuuuuuuugaugcuuu

SEQ ID NO: 836744 - RNA, 18 nt, Human
uuuuuuuuuuuuuuuuug

SEQ ID NO: 836745 - RNA, 25 nt, Human
aaacaauauagaaauauacaaagca

SEQ ID NO: 836746 - RNA, 22 nt, Human
aaagauauauauggauuccccc

SEQ ID NO: 836747 - RNA, 20 nt, Human
aagaaauaugaugacaaaac

SEQ ID NO: 836748 - RNA, 22 nt, Human
acaaagacaauacauggaaaaa

SEQ ID NO: 836749 - RNA, 19 nt, Human
acaaagcagaaaauuaaag

SEQ ID NO: 836750 - RNA, 21 nt, Human
acaaagcagaaaauuaaaggc

SEQ ID NO: 836751 - RNA, 21 nt, Human
agccgcucgcagcggccuugg

SEQ ID NO: 836752 - RNA, 23 nt, Human
auauacccaccugcagacagaau

SEQ ID NO: 836753 - RNA, 21 nt, Human
caaaacacccauauuuaaaga

SEQ ID NO: 836754 - RNA, 20 nt, Human
caaagcagaaaauuaaaggc

SEQ ID NO: 836755 - RNA, 24 nt, Human
caagaaauaugaugacaaaacacc

SEQ ID NO: 836756 - RNA, 23 nt, Human
caccugcagacagaaugggaaga

SEQ ID NO: 836757 - RNA, 31 nt, Human
cagauaauagcagccacggugcuucuuccuu

SEQ ID NO: 836758 - RNA, 23 nt, Human
cagcggccuuggcaucacgaguc

SEQ ID NO: 836759 - RNA, 24 nt, Human
cauauacccaccugcagacagaau

SEQ ID NO: 836760 - RNA, 23 nt, Human
ccaccugcagacagaaugggaag

SEQ ID NO: 836761 - RNA, 21 nt, Human
ccgcucgcagcggccuuggca

SEQ ID NO: 836762 - RNA, 21 nt, Human
ccucauguaaacaaaucaggc

SEQ ID NO: 836763 - RNA, 20 nt, Human
ccuguguuugauuuuaagcc

SEQ ID NO: 836764 - RNA, 19 nt, Human
cuaggaaaaaacguaauca

SEQ ID NO: 836765 - RNA, 23 nt, Human
cucagcuggggcucaaccccgac

SEQ ID NO: 836766 - RNA, 19 nt, Human
cuguguuugauuuuaagcc

SEQ ID NO: 836767 - RNA, 25 nt, Human
gagcagauaauagcagccacggugc

SEQ ID NO: 836768 - RNA, 21 nt, Human
gagcccucggcucagcugggg

SEQ ID NO: 836769 - RNA, 18 nt, Human
gcuauggguagggcagac

SEQ ID NO: 836770 - RNA, 21 nt, Human
ggaauauugaggaagguagga

SEQ ID NO: 836771 - RNA, 21 nt, Human
ggguugggccugggagaccag

SEQ ID NO: 836772 - RNA, 26 nt, Human
gguugggccugggagaccagaagagu

SEQ ID NO: 836773 - RNA, 23 nt, Human
guaaacaaaucaggcaugaauaa

SEQ ID NO: 836774 - RNA, 18 nt, Human
guccugggaggggucagg

SEQ ID NO: 836775 - RNA, 22 nt, Human
uaaauacaaagacaauacaugg

SEQ ID NO: 836776 - RNA, 23 nt, Human
uacauggaaaaaaaauagacaau

SEQ ID NO: 836777 - RNA, 19 nt, Human
uacccaccugcagacagaa

SEQ ID NO: 836778 - RNA, 19 nt, Human
uacugugcuggggcaagau

SEQ ID NO: 836779 - RNA, 23 nt, Human
uaggaaaaaacguaaucauagca

SEQ ID NO: 836780 - RNA, 22 nt, Human
ucagaaguccucauguaaacaa

SEQ ID NO: 836781 - RNA, 23 nt, Human
ucccauuaccauauacccaccug

SEQ ID NO: 836782 - RNA, 24 nt, Human
uccucauguaaacaaaucaggcau

SEQ ID NO: 836783 - RNA, 23 nt, Human
ucuuacaaaguuaaacaauauag

SEQ ID NO: 836784 - RNA, 21 nt, Human
uuaaaggcucucuaaucccau

SEQ ID NO: 836785 - RNA, 23 nt, Human
uuaaaggcucucuaaucccauua

SEQ ID NO: 836786 - RNA, 18 nt, Human
uugaggaagguaggagaa

SEQ ID NO: 836787 - RNA, 23 nt, Human
uuuauagguauuuacaauuuauc

SEQ ID NO: 836788 - RNA, 18 nt, Human
uuucaaauaucuuuuuaa

SEQ ID NO: 836789 - RNA, 24 nt, Human
aagcaggaaguaaggcgcacacag

SEQ ID NO: 836790 - RNA, 20 nt, Human
aagccagcccccgacggugg

SEQ ID NO: 836791 - RNA, 24 nt, Human
aagugucccuccggugccgcugcc

SEQ ID NO: 836792 - RNA, 18 nt, Human
aaguugaaaguacuuuuc

SEQ ID NO: 836793 - RNA, 19 nt, Human
acguacgaacacagucccg

SEQ ID NO: 836794 - RNA, 24 nt, Human
acuaacuacaaaccucuuacgaua

SEQ ID NO: 836795 - RNA, 18 nt, Human
agaaggaaagaaacugaa

SEQ ID NO: 836796 - RNA, 18 nt, Human
aggcguuuuggcagcagc

SEQ ID NO: 836797 - RNA, 20 nt, Human
caacaggaaguggugaagga

SEQ ID NO: 836798 - RNA, 27 nt, Human
cacagaggguguguauacgaaacgacc

SEQ ID NO: 836799 - RNA, 22 nt, Human
cacagucccgcggacacgaccc

SEQ ID NO: 836800 - RNA, 19 nt, Human
cauccggcaaggccucugc

SEQ ID NO: 836801 - RNA, 24 nt, Human
ccagggccaacaggaaguggugaa

SEQ ID NO: 836802 - RNA, 20 nt, Human
cccuccggugccgcugccac

SEQ ID NO: 836803 - RNA, 19 nt, Human
ccgcugccaccuucccggc

SEQ ID NO: 836804 - RNA, 19 nt, Human
ccggccagccagggccaac

SEQ ID NO: 836805 - RNA, 23 nt, Human
ccuucccggccagccagggcccc

SEQ ID NO: 836806 - RNA, 18 nt, Human
cgacccgcgagcaggcgg

SEQ ID NO: 836807 - RNA, 21 nt, Human
cguucacagaaggaaagaaac

SEQ ID NO: 836808 - RNA, 22 nt, Human
gaaaacacagggaaaucacgga

SEQ ID NO: 836809 - RNA, 23 nt, Human
ggcgcacacagaggguguguaua

SEQ ID NO: 836810 - RNA, 19 nt, Human
uacaaaauccuaccaaucc

SEQ ID NO: 836811 - RNA, 22 nt, Human
uacgaaacgacgcagacuccga

SEQ ID NO: 836812 - RNA, 23 nt, Human
ucaacaucaacaugcaaaaauaa

SEQ ID NO: 836813 - RNA, 19 nt, Human
ucaacaugcaaaaauaagc

SEQ ID NO: 836814 - RNA, 26 nt, Human
ucaacaugcaaaaauaagcacuaacu

SEQ ID NO: 836815 - RNA, 19 nt, Human
ucccuccggugccgcugcc

SEQ ID NO: 836816 - RNA, 23 nt, Human
ucgaaugaagccauaaguguccc

SEQ ID NO: 836817 - RNA, 21 nt, Human
ugaaaacacagggaaaucacg

SEQ ID NO: 836818 - RNA, 22 nt, Human
ugguucauuuguuuugaaaagu

SEQ ID NO: 836819 - RNA, 18 nt, Human
uuaaagaagaguuuccuc

SEQ ID NO: 836820 - RNA, 24 nt, Human
aaaaaaaaaaguaauaauaaagaa

SEQ ID NO: 836821 - RNA, 25 nt, Human
aaaaaaaaguaauaauaaagaaaaa

SEQ ID NO: 836822 - RNA, 19 nt, Human
aaaagcagggaaagaaacg

SEQ ID NO: 836823 - RNA, 24 nt, Human
aaacaagaaaaugguacaaaauag

SEQ ID NO: 836824 - RNA, 22 nt, Human
aaacucaaaaaugcauccggcc

SEQ ID NO: 836825 - RNA, 25 nt, Human
aaccaaaaaacagaaaccagucuga

SEQ ID NO: 836826 - RNA, 22 nt, Human
aacuacuauacaacugaagaau

SEQ ID NO: 836827 - RNA, 22 nt, Human
aagcaaaauaggaaaccauuuu

SEQ ID NO: 836828 - RNA, 18 nt, Human
aagguccccugcccgccc

SEQ ID NO: 836829 - RNA, 22 nt, Human
aaguugcaaaauuacuugccaa

SEQ ID NO: 836830 - RNA, 18 nt, Human
aauaaacccaaacaaaga

SEQ ID NO: 836831 - RNA, 23 nt, Human
accaaaaaacagaaaccagucug

SEQ ID NO: 836832 - RNA, 19 nt, Human
accguaauaauaaacccaa

SEQ ID NO: 836833 - RNA, 18 nt, Human
acuauacaacugaagaau

SEQ ID NO: 836834 - RNA, 24 nt, Human
acuuuuucuuuuuuuuuuucuuuu

SEQ ID NO: 836835 - RNA, 26 nt, Human
agaaaaaaaaaaguaauaauaaagaa

SEQ ID NO: 836836 - RNA, 23 nt, Human
agaaagccaggagucuccagaug

SEQ ID NO: 836837 - RNA, 22 nt, Human
agacaaggcuguaguccagaac

SEQ ID NO: 836838 - RNA, 21 nt, Human
agagaggaaaaagaggaccga

SEQ ID NO: 836839 - RNA, 22 nt, Human
agcaggcaauaaaacugaugag

SEQ ID NO: 836840 - RNA, 21 nt, Human
agccgccggaguuuccaaacu

SEQ ID NO: 836841 - RNA, 18 nt, Human
aggaaaaagaggaccgaa

SEQ ID NO: 836842 - RNA, 18 nt, Human
aggaaagaaaacaugcaa

SEQ ID NO: 836843 - RNA, 19 nt, Human
aggacaaauauccacaaua

SEQ ID NO: 836844 - RNA, 18 nt, Human
aggcccagaggguucaga

SEQ ID NO: 836845 - RNA, 20 nt, Human
augcaggacaaauauccaca

SEQ ID NO: 836846 - RNA, 21 nt, Human
caaaaauaccguaauaauaaa

SEQ ID NO: 836847 - RNA, 21 nt, Human
caaaagcagggaaagaaacgc

SEQ ID NO: 836848 - RNA, 24 nt, Human
caaacaaaaauaccguaaucaacg

SEQ ID NO: 836849 - RNA, 18 nt, Human
caaagcagcugucccggc

SEQ ID NO: 836850 - RNA, 24 nt, Human
caaaguucagaaagccaggagucu

SEQ ID NO: 836851 - RNA, 21 nt, Human
caagccuacagcugggacuga

SEQ ID NO: 836852 - RNA, 22 nt, Human
caagguugaaaacuaaagcgag

SEQ ID NO: 836853 - RNA, 27 nt, Human
caccaagaacucuuccuacuaucucaa

SEQ ID NO: 836854 - RNA, 21 nt, Human
caccaugcgguucauacaauc

SEQ ID NO: 836855 - RNA, 20 nt, Human
cacccgcccgucgcccgcgg

SEQ ID NO: 836856 - RNA, 30 nt, Human
cagaaaaaaaaaaguaauaauaaagaaaaa

SEQ ID NO: 836857 - RNA, 21 nt, Human
cagcaaagcagcugucccggc

SEQ ID NO: 836858 - RNA, 22 nt, Human
cagccgccgcugccgcccggga

SEQ ID NO: 836859 - RNA, 24 nt, Human
caggcaauaaaacugaugagccuc

SEQ ID NO: 836860 - RNA, 24 nt, Human
caugcuaaaguuaaacaagaaaau

SEQ ID NO: 836861 - RNA, 20 nt, Human
ccaaaaaacagaaaccaguc

SEQ ID NO: 836862 - RNA, 20 nt, Human
ccagagucccucuccuuucc

SEQ ID NO: 836863 - RNA, 22 nt, Human
ccagcagcgccagcaauuucaa

SEQ ID NO: 836864 - RNA, 18 nt, Human
cccauaucuucccuauaa

SEQ ID NO: 836865 - RNA, 28 nt, Human
ccccgagcgucccuaacugagggccugu

SEQ ID NO: 836866 - RNA, 18 nt, Human
ccccgcacgcagccgccg

SEQ ID NO: 836867 - RNA, 24 nt, Human
ccccugcccgcccgcgcacccgcc

SEQ ID NO: 836868 - RNA, 26 nt, Human
cccgcacgcagccgccggaguuucca

SEQ ID NO: 836869 - RNA, 22 nt, Human
cccgcgcacccgcccgucgccc

SEQ ID NO: 836870 - RNA, 23 nt, Human
cccgcgcacccgcccgucgcccg

SEQ ID NO: 836871 - RNA, 25 nt, Human
cccgcgcacccgcccgucgcccgcg

SEQ ID NO: 836872 - RNA, 19 nt, Human
cccuuguacugggaccucc

SEQ ID NO: 836873 - RNA, 27 nt, Human
ccgggacgccagagucccucuccuuuc

SEQ ID NO: 836874 - RNA, 25 nt, Human
ccuacaauuagcgcaggccgggguc

SEQ ID NO: 836875 - RNA, 19 nt, Human
ccuacagcugggacugaaa

SEQ ID NO: 836876 - RNA, 18 nt, Human
ccucguugcucucuuccu

SEQ ID NO: 836877 - RNA, 19 nt, Human
ccuuguacugggaccucuc

SEQ ID NO: 836878 - RNA, 22 nt, Human
ccuuuccucguugcucucuucc

SEQ ID NO: 836879 - RNA, 28 nt, Human
cggaacuuuuucuuuuuuuuuuucuuuu

SEQ ID NO: 836880 - RNA, 24 nt, Human
cgggaccucccacccucucgucuc

SEQ ID NO: 836881 - RNA, 24 nt, Human
cuccuuuccucguugcucucuucc

SEQ ID NO: 836882 - RNA, 18 nt, Human
cugaaaccccgcacgcag

SEQ ID NO: 836883 - RNA, 22 nt, Human
cugaugcaaaaugcccggaacu

SEQ ID NO: 836884 - RNA, 22 nt, Human
gacaccaccaagaacucuuccu

SEQ ID NO: 836885 - RNA, 19 nt, Human
gaucuguuuuccuuuccuu

SEQ ID NO: 836886 - RNA, 19 nt, Human
gccaagguccccugcccgc

SEQ ID NO: 836887 - RNA, 22 nt, Human
gcgagagaggaaaaagaggacc

SEQ ID NO: 836888 - RNA, 26 nt, Human
gcgcaggcccagaggguucagaaggg

SEQ ID NO: 836889 - RNA, 22 nt, Human
gcgcccuuccucccucucgcuc

SEQ ID NO: 836890 - RNA, 19 nt, Human
gcggagcuuggcagcuucc

SEQ ID NO: 836891 - RNA, 26 nt, Human
gcuaaaguuaaacaagaaaaugguac

SEQ ID NO: 836892 - RNA, 22 nt, Human
ggcagcuucccugcccugcccu

SEQ ID NO: 836893 - RNA, 19 nt, Human
ggccggagcgcgccgagcc

SEQ ID NO: 836894 - RNA, 22 nt, Human
gggacuagggacgugggacagg

SEQ ID NO: 836895 - RNA, 18 nt, Human
gggauaagggaaggaaag

SEQ ID NO: 836896 - RNA, 19 nt, Human
gggccaggaccggccacga

SEQ ID NO: 836897 - RNA, 27 nt, Human
gggccgcggcagggacaggguccgggg

SEQ ID NO: 836898 - RNA, 25 nt, Human
gguccuuccuucuuucgcucagccu

SEQ ID NO: 836899 - RNA, 18 nt, Human
gguuucugguacauucug

SEQ ID NO: 836900 - RNA, 21 nt, Human
guaauaauaaagaaaaacacc

SEQ ID NO: 836901 - RNA, 18 nt, Human
gucagggauggcuaagcc

SEQ ID NO: 836902 - RNA, 23 nt, Human
guccuuccuucuuucgcucagcc

SEQ ID NO: 836903 - RNA, 22 nt, Human
gucugcuuaccagugcacugcc

SEQ ID NO: 836904 - RNA, 21 nt, Human
uaaaacugaugagccucgugc

SEQ ID NO: 836905 - RNA, 18 nt, Human
uaaacaagaaaaugguac

SEQ ID NO: 836906 - RNA, 19 nt, Human
uaaacccaaacaaagaccc

SEQ ID NO: 836907 - RNA, 23 nt, Human
uaaacccaaacaaagacccucag

SEQ ID NO: 836908 - RNA, 19 nt, Human
uaaccaaaaaacagaaacc

SEQ ID NO: 836909 - RNA, 27 nt, Human
uaaccaaaaaacagaaaccagucugaa

SEQ ID NO: 836910 - RNA, 25 nt, Human
uaauaagcaaaauaggaaaccauuu

SEQ ID NO: 836911 - RNA, 23 nt, Human
uaauaauaaagaaaaacacccau

SEQ ID NO: 836912 - RNA, 18 nt, Human
uaccagugcacugccagg

SEQ ID NO: 836913 - RNA, 21 nt, Human
uaccguaauaauaaacccaaa

SEQ ID NO: 836914 - RNA, 18 nt, Human
uacuauacaacugaagaa

SEQ ID NO: 836915 - RNA, 19 nt, Human
uagcgcaggcccagagggu

SEQ ID NO: 836916 - RNA, 24 nt, Human
uagucugggacuagggacguggga

SEQ ID NO: 836917 - RNA, 22 nt, Human
uaugauccaugaucaacaacau

SEQ ID NO: 836918 - RNA, 19 nt, Human
ucagcaccaacaagguuga

SEQ ID NO: 836919 - RNA, 18 nt, Human
uccagaacacuccucugg

SEQ ID NO: 836920 - RNA, 22 nt, Human
ucccuauaacuacuauacaacu

SEQ ID NO: 836921 - RNA, 19 nt, Human
ucccugcccugcccugccc

SEQ ID NO: 836922 - RNA, 25 nt, Human
uccgggccggggcaagggcgggggc

SEQ ID NO: 836923 - RNA, 18 nt, Human
ucucaaaagcagggaaag

SEQ ID NO: 836924 - RNA, 19 nt, Human
ucucagggcugaggagcca

SEQ ID NO: 836925 - RNA, 20 nt, Human
ucuccagauggccuugguga

SEQ ID NO: 836926 - RNA, 22 nt, Human
ucugggacuagggacgugggac

SEQ ID NO: 836927 - RNA, 22 nt, Human
ucugguuacaauaaaaagcaga

SEQ ID NO: 836928 - RNA, 19 nt, Human
ugaagcgaggcgcagccgc

SEQ ID NO: 836929 - RNA, 18 nt, Human
ugagggccugugucucag

SEQ ID NO: 836930 - RNA, 22 nt, Human
ugagggccugugucucagggcu

SEQ ID NO: 836931 - RNA, 20 nt, Human
ugauccaugaucaacaacau

SEQ ID NO: 836932 - RNA, 22 nt, Human
ugccgcccgggaaacuuugcgg

SEQ ID NO: 836933 - RNA, 19 nt, Human
ugccucgccgcccuucagc

SEQ ID NO: 836934 - RNA, 20 nt, Human
uggcuaagccucucacccuu

SEQ ID NO: 836935 - RNA, 20 nt, Human
ugggaccucucgguucucuc

SEQ ID NO: 836936 - RNA, 25 nt, Human
ugggacuagggacgugggacaggga

SEQ ID NO: 836937 - RNA, 21 nt, Human
ugguauuuuugucagugcaac

SEQ ID NO: 836938 - RNA, 21 nt, Human
uuaaaacugcaagcaccaugc

SEQ ID NO: 836939 - RNA, 20 nt, Human
uuacaaacaaaaauaccgua

SEQ ID NO: 836940 - RNA, 21 nt, Human
uucccuauaacuacuauacaa

SEQ ID NO: 836941 - RNA, 18 nt, Human
uugaccauaagacaaggc

SEQ ID NO: 836942 - RNA, 24 nt, Human
uuuuuuuuuuuuuuuuuuaauaag

SEQ ID NO: 836943 - RNA, 22 nt, Human
aaagcaaaggggauccuggccc

SEQ ID NO: 836944 - RNA, 18 nt, Human
aaagcacccggcacgcac

SEQ ID NO: 836945 - RNA, 19 nt, Human
aacuuauuugcccucuccu

SEQ ID NO: 836946 - RNA, 19 nt, Human
aagaagccgccuagggugc

SEQ ID NO: 836947 - RNA, 23 nt, Human
aagaagccgccuagggugcugug

SEQ ID NO: 836948 - RNA, 21 nt, Human
aagcacaaaaugaaagcagga

SEQ ID NO: 836949 - RNA, 22 nt, Human
aagcacccggcacgcaccucac

SEQ ID NO: 836950 - RNA, 21 nt, Human
aagcagcugcagggggagggg

SEQ ID NO: 836951 - RNA, 18 nt, Human
aagcaggaagagcaaaga

SEQ ID NO: 836952 - RNA, 19 nt, Human
aagcaggaagagcaaagag

SEQ ID NO: 836953 - RNA, 23 nt, Human
aagggucacguugcgggggggca

SEQ ID NO: 836954 - RNA, 18 nt, Human
aaucuccguccucauccc

SEQ ID NO: 836955 - RNA, 23 nt, Human
acaggaagaagccgccuagggug

SEQ ID NO: 836956 - RNA, 21 nt, Human
accaagaggagacucagccug

SEQ ID NO: 836957 - RNA, 23 nt, Human
acucagccugggaguguccuugg

SEQ ID NO: 836958 - RNA, 21 nt, Human
acucagguggguugcuguugg

SEQ ID NO: 836959 - RNA, 18 nt, Human
agagaggagagacccagg

SEQ ID NO: 836960 - RNA, 22 nt, Human
agagcaguaccagcagcggcug

SEQ ID NO: 836961 - RNA, 23 nt, Human
agcaguaccagcagcggcuggca

SEQ ID NO: 836962 - RNA, 25 nt, Human
aggaagagcaaagagagccgguacc

SEQ ID NO: 836963 - RNA, 23 nt, Human
agggagggugaagcagcugcagg

SEQ ID NO: 836964 - RNA, 25 nt, Human
agggugcugugucgagaaggaaucu

SEQ ID NO: 836965 - RNA, 21 nt, Human
aucgccaaaaucuccguccuc

SEQ ID NO: 836966 - RNA, 19 nt, Human
aucugugaugagcuuccuc

SEQ ID NO: 836967 - RNA, 19 nt, Human
aucuucucgggaacuccaa

SEQ ID NO: 836968 - RNA, 19 nt, Human
augaaaacacaaggaaaag

SEQ ID NO: 836969 - RNA, 18 nt, Human
augguggagcuggugcug

SEQ ID NO: 836970 - RNA, 23 nt, Human
augguggagcuggugcuggggcc

SEQ ID NO: 836971 - RNA, 23 nt, Human
auuuugcaacuuuaauguaacac

SEQ ID NO: 836972 - RNA, 21 nt, Human
cacaaggaaaagcacaaaaug

SEQ ID NO: 836973 - RNA, 20 nt, Human
caccaacuuauuugcccucu

SEQ ID NO: 836974 - RNA, 22 nt, Human
cacguggcccuccuguuggcac

SEQ ID NO: 836975 - RNA, 22 nt, Human
cagaggacagccucgcuggcac

SEQ ID NO: 836976 - RNA, 22 nt, Human
cagccuccaagaaaugagccuu

SEQ ID NO: 836977 - RNA, 21 nt, Human
cagcucuccacguggcccucc

SEQ ID NO: 836978 - RNA, 22 nt, Human
caggaagaagccgccuagggug

SEQ ID NO: 836979 - RNA, 25 nt, Human
caggaagaagccgccuagggugcug

SEQ ID NO: 836980 - RNA, 20 nt, Human
cagguggaucccaaacuucu

SEQ ID NO: 836981 - RNA, 22 nt, Human
caucugggcccucaucugggcc

SEQ ID NO: 836982 - RNA, 21 nt, Human
caucugggcccuggcauguuc

SEQ ID NO: 836983 - RNA, 21 nt, Human
caucugugaugagcuuccuca

SEQ ID NO: 836984 - RNA, 27 nt, Human
ccaaaacaugaaaacacaaggaaaagc

SEQ ID NO: 836985 - RNA, 20 nt, Human
ccagggagaugagagcucag

SEQ ID NO: 836986 - RNA, 18 nt, Human
ccccgugccaaagcaccc

SEQ ID NO: 836987 - RNA, 19 nt, Human
cccgugccaaagcacccgg

SEQ ID NO: 836988 - RNA, 19 nt, Human
ccucccagaggacagccuc

SEQ ID NO: 836989 - RNA, 23 nt, Human
ccucggccauauccacauccauu

SEQ ID NO: 836990 - RNA, 24 nt, Human
cggaugguggagcuggugcugggg

SEQ ID NO: 836991 - RNA, 21 nt, Human
cggggccaucgggggccgagg

SEQ ID NO: 836992 - RNA, 22 nt, Human
cguccucaucccaggucaggag

SEQ ID NO: 836993 - RNA, 21 nt, Human
cucgcaggccccagaggaauu

SEQ ID NO: 836994 - RNA, 22 nt, Human
cuggcccagaaagcaaagggga

SEQ ID NO: 836995 - RNA, 21 nt, Human
cuggcccaggcaucgccaaaa

SEQ ID NO: 836996 - RNA, 24 nt, Human
cugggcccuggcauguuccucggc

SEQ ID NO: 836997 - RNA, 19 nt, Human
cuugcaugccaccuccgac

SEQ ID NO: 836998 - RNA, 19 nt, Human
gaagaagccgccuagggug

SEQ ID NO: 836999 - RNA, 19 nt, Human
gaagcagcugcagggggag

SEQ ID NO: 837000 - RNA, 20 nt, Human
gaauguacugaugguaucug

SEQ ID NO: 837001 - RNA, 20 nt, Human
gacaggaagaagccgccuag

SEQ ID NO: 837002 - RNA, 18 nt, Human
gacccagggcuaccaggc

SEQ ID NO: 837003 - RNA, 21 nt, Human
gaucuccuucagguggauccc

SEQ ID NO: 837004 - RNA, 24 nt, Human
gcagaagggucacguugcgggggg

SEQ ID NO: 837005 - RNA, 23 nt, Human
gccagcucuccacguggcccucc

SEQ ID NO: 837006 - RNA, 18 nt, Human
ggagaagaagcuggcgcc

SEQ ID NO: 837007 - RNA, 19 nt, Human
ggagaagaagcuggcgcca

SEQ ID NO: 837008 - RNA, 21 nt, Human
ggagggugaagcagcugcagg

SEQ ID NO: 837009 - RNA, 24 nt, Human
ggaugguggagcuggugcuggggc

SEQ ID NO: 837010 - RNA, 19 nt, Human
ggcccuccuguuggcacgg

SEQ ID NO: 837011 - RNA, 23 nt, Human
ggcugugaugcucuccagguggg

SEQ ID NO: 837012 - RNA, 24 nt, Human
ggcugugaugcucuccaggugggu

SEQ ID NO: 837013 - RNA, 19 nt, Human
gggggagggggcgggaucc

SEQ ID NO: 837014 - RNA, 23 nt, Human
ggggggcaggcacaguacgugcc

SEQ ID NO: 837015 - RNA, 21 nt, Human
gguuuuuccaaggaggcgagc

SEQ ID NO: 837016 - RNA, 23 nt, Human
gucgaucuccuucagguggaucc

SEQ ID NO: 837017 - RNA, 18 nt, Human
uaacacugauacccaaaa

SEQ ID NO: 837018 - RNA, 21 nt, Human
uaacacugauacccaaaacau

SEQ ID NO: 837019 - RNA, 19 nt, Human
uaagugccaggcacugagc

SEQ ID NO: 837020 - RNA, 18 nt, Human
uaccaggcuccccgugcc

SEQ ID NO: 837021 - RNA, 18 nt, Human
uacccaaaacaugaaaac

SEQ ID NO: 837022 - RNA, 18 nt, Human
uacucagguggguugcug

SEQ ID NO: 837023 - RNA, 22 nt, Human
ucauccaggugcuuggacugua

SEQ ID NO: 837024 - RNA, 20 nt, Human
ucaucugggcccuggcaugu

SEQ ID NO: 837025 - RNA, 20 nt, Human
uccaaggaggcgagcugagg

SEQ ID NO: 837026 - RNA, 24 nt, Human
uccaaucagcgcuucauccccgau

SEQ ID NO: 837027 - RNA, 19 nt, Human
ucccgugugcagacaagaa

SEQ ID NO: 837028 - RNA, 24 nt, Human
uccucggccauauccacauccauu

SEQ ID NO: 837029 - RNA, 19 nt, Human
ucucccaccaguccugagg

SEQ ID NO: 837030 - RNA, 27 nt, Human
ucucccaccaguccugaggguagggac

SEQ ID NO: 837031 - RNA, 18 nt, Human
ucucgguucugauucugg

SEQ ID NO: 837032 - RNA, 23 nt, Human
ucucucuccuccucgcugcucuc

SEQ ID NO: 837033 - RNA, 20 nt, Human
ucugagaggaggcgcucugg

SEQ ID NO: 837034 - RNA, 21 nt, Human
ucugggcccucaucugggccc

SEQ ID NO: 837035 - RNA, 22 nt, Human
ugaaaacacaaggaaaagcaca

SEQ ID NO: 837036 - RNA, 19 nt, Human
ugaaagcaucauccacagc

SEQ ID NO: 837037 - RNA, 24 nt, Human
ugaagcagcugcagggggaggggg

SEQ ID NO: 837038 - RNA, 21 nt, Human
ugaaucucaggacccucaucu

SEQ ID NO: 837039 - RNA, 21 nt, Human
ugacgcccagaaucaccaaaa

SEQ ID NO: 837040 - RNA, 18 nt, Human
ugagagaggagagaccca

SEQ ID NO: 837041 - RNA, 23 nt, Human
ugagaggaggcgcucuggcuugg

SEQ ID NO: 837042 - RNA, 22 nt, Human
ugaggguagggacuacguggag

SEQ ID NO: 837043 - RNA, 23 nt, Human
ugcuggggccaucuaggacgcug

SEQ ID NO: 837044 - RNA, 18 nt, Human
ugcugugucgagaaggaa

SEQ ID NO: 837045 - RNA, 20 nt, Human
uggagcuggugcuggggcca

SEQ ID NO: 837046 - RNA, 19 nt, Human
uggccaguaagaucgcugc

SEQ ID NO: 837047 - RNA, 18 nt, Human
uggcccaggcaucgccaa

SEQ ID NO: 837048 - RNA, 21 nt, Human
uguaacacugauacccaaaac

SEQ ID NO: 837049 - RNA, 21 nt, Human
ugugcagacaagaauauacag

SEQ ID NO: 837050 - RNA, 19 nt, Human
uuauuugcccucuccugca

SEQ ID NO: 837051 - RNA, 22 nt, Human
uucacaaagucaucugugauga

SEQ ID NO: 837052 - RNA, 19 nt, Human
uucauccccgauauucauc

SEQ ID NO: 837053 - RNA, 21 nt, Human
uuccaaggaggcgagcugagg

SEQ ID NO: 837054 - RNA, 21 nt, Human
uucugauucugggcgaugaau

SEQ ID NO: 837055 - RNA, 22 nt, Human
uugagagaggagagacccaggg

SEQ ID NO: 837056 - RNA, 23 nt, Human
uugguuuuuccaaggaggcgagc

SEQ ID NO: 837057 - RNA, 19 nt, Human
aaaaccuugccuccucaca

SEQ ID NO: 837058 - RNA, 23 nt, Human
aaaaccuugccuccucacagagc

SEQ ID NO: 837059 - RNA, 25 nt, Human
aaccuugccuccucacagagccugg

SEQ ID NO: 837060 - RNA, 23 nt, Human
aagaagccaaggaaauccaggua

SEQ ID NO: 837061 - RNA, 21 nt, Human
aagccaaggaaauccagguau

SEQ ID NO: 837062 - RNA, 22 nt, Human
acauucucaaagaagccaagga

SEQ ID NO: 837063 - RNA, 21 nt, Human
aggaagaauucuuuauucaga

SEQ ID NO: 837064 - RNA, 22 nt, Human
aggcagaucuucuccuuggugc

SEQ ID NO: 837065 - RNA, 19 nt, Human
aggcaggagugugggcagg

SEQ ID NO: 837066 - RNA, 19 nt, Human
auuaucccaauucacaaaa

SEQ ID NO: 837067 - RNA, 24 nt, Human
caaagauaaaucuccaagucaccc

SEQ ID NO: 837068 - RNA, 26 nt, Human
caagucacccaauagaacagaaaccu

SEQ ID NO: 837069 - RNA, 22 nt, Human
cacaagacucuuacccuuaaac

SEQ ID NO: 837070 - RNA, 20 nt, Human
cagagccugggucagguucc

SEQ ID NO: 837071 - RNA, 25 nt, Human
caggcagaucuucuccuuggugcuc

SEQ ID NO: 837072 - RNA, 19 nt, Human
caggcaggagugugggcag

SEQ ID NO: 837073 - RNA, 18 nt, Human
cauucaaccaucccuuaa

SEQ ID NO: 837074 - RNA, 22 nt, Human
ccagucccccucccacuggccc

SEQ ID NO: 837075 - RNA, 21 nt, Human
ccucacagagccugggucagg

SEQ ID NO: 837076 - RNA, 21 nt, Human
cuccaagucacccaauagaac

SEQ ID NO: 837077 - RNA, 25 nt, Human
cuccucuguggccuccagggaaucc

SEQ ID NO: 837078 - RNA, 20 nt, Human
cugaauaaaacacaagacuc

SEQ ID NO: 837079 - RNA, 22 nt, Human
gcagcaggcaggagugugggca

SEQ ID NO: 837080 - RNA, 20 nt, Human
gcaggagugugggcaggagc

SEQ ID NO: 837081 - RNA, 18 nt, Human
gcucucuucagagugaag

SEQ ID NO: 837082 - RNA, 21 nt, Human
ggcaggagugugggcaggagc

SEQ ID NO: 837083 - RNA, 18 nt, Human
ggggaagcugcuggacgc

SEQ ID NO: 837084 - RNA, 23 nt, Human
gugcuccucuguggccuccaggg

SEQ ID NO: 837085 - RNA, 24 nt, Human
uaaagcaagaauugacuaucucuu

SEQ ID NO: 837086 - RNA, 20 nt, Human
uauauacacagaacugugug

SEQ ID NO: 837087 - RNA, 24 nt, Human
uaucucaucuauuuuacugcucau

SEQ ID NO: 837088 - RNA, 24 nt, Human
ucacccaauagaacagaaaccuac

SEQ ID NO: 837089 - RNA, 23 nt, Human
uccacugcuguuauuaucccaau

SEQ ID NO: 837090 - RNA, 23 nt, Human
ucccuuaaaaaaaaacauuugaa

SEQ ID NO: 837091 - RNA, 25 nt, Human
uccucuggguuggccuguccccuga

SEQ ID NO: 837092 - RNA, 23 nt, Human
uguccucuggguuggccuguccc

SEQ ID NO: 837093 - RNA, 25 nt, Human
uucaaccaucccuuaaaaaaaaaca

SEQ ID NO: 837094 - RNA, 19 nt, Human
uuuuuuuuuuuuaacagga

SEQ ID NO: 837095 - RNA, 26 nt, Human
uuuuuuuuuuuuuuuuuuuuaacagg

SEQ ID NO: 837096 - RNA, 19 nt, Human
aaacaaaaacuugacaugc

SEQ ID NO: 837097 - RNA, 19 nt, Human
aaaggagauauauaugaug

SEQ ID NO: 837098 - RNA, 19 nt, Human
acaaagugaacaaucugcc

SEQ ID NO: 837099 - RNA, 18 nt, Human
acuugaaagauacuaaug

SEQ ID NO: 837100 - RNA, 19 nt, Human
agaaaacaaaaacuugagg

SEQ ID NO: 837101 - RNA, 19 nt, Human
agcagaaaggcaggagaug

SEQ ID NO: 837102 - RNA, 20 nt, Human
aggagugggagacacugcug

SEQ ID NO: 837103 - RNA, 27 nt, Human
aggcaggaaagugagcagaagggaccc

SEQ ID NO: 837104 - RNA, 20 nt, Human
aggcaggaaagugagcagag

SEQ ID NO: 837105 - RNA, 22 nt, Human
auuuuacaaaaacaaaacugaa

SEQ ID NO: 837106 - RNA, 24 nt, Human
caaaaacaaagugaacaaucugcc

SEQ ID NO: 837107 - RNA, 22 nt, Human
caaaacaggcaggaaagugagc

SEQ ID NO: 837108 - RNA, 31 nt, Human
caaaacugaaugcagaaaacaaaaacuuggu

SEQ ID NO: 837109 - RNA, 18 nt, Human
caaagugaacaaucugcc

SEQ ID NO: 837110 - RNA, 23 nt, Human
caacccaaaaaagauucaaggau

SEQ ID NO: 837111 - RNA, 19 nt, Human
caccacgcugaaacaugcc

SEQ ID NO: 837112 - RNA, 22 nt, Human
caccuugacucccgaccagucc

SEQ ID NO: 837113 - RNA, 21 nt, Human
cagaaaggcaggagauguggc

SEQ ID NO: 837114 - RNA, 22 nt, Human
cagaaaggcaggagauguggca

SEQ ID NO: 837115 - RNA, 24 nt, Human
cagcaccaauaaaugugugaucca

SEQ ID NO: 837116 - RNA, 20 nt, Human
caguccugagaauucacccu

SEQ ID NO: 837117 - RNA, 21 nt, Human
ccacaaaaacaaagugaacaa

SEQ ID NO: 837118 - RNA, 26 nt, Human
cucagacuucacaaggagugggagac

SEQ ID NO: 837119 - RNA, 25 nt, Human
cucccgaccaguccugagaauucac

SEQ ID NO: 837120 - RNA, 19 nt, Human
cuccuggaugaucuucaua

SEQ ID NO: 837121 - RNA, 24 nt, Human
cucucuagccauaucuuggcugcu

SEQ ID NO: 837122 - RNA, 21 nt, Human
cugaaccugcuccucucacau

SEQ ID NO: 837123 - RNA, 18 nt, Human
cugaaugcagaaaacaaa

SEQ ID NO: 837124 - RNA, 23 nt, Human
gaaaaacacuugaaagauacuaa

SEQ ID NO: 837125 - RNA, 20 nt, Human
gaaaaggcuaaaaacaacca

SEQ ID NO: 837126 - RNA, 19 nt, Human
gaaaggcaggagauguggc

SEQ ID NO: 837127 - RNA, 20 nt, Human
gaaccugcuccucucacauc

SEQ ID NO: 837128 - RNA, 22 nt, Human
gagcagaaaggcaggagaugug

SEQ ID NO: 837129 - RNA, 27 nt, Human
gcaaaacaggcaggaaagugagcagaa

SEQ ID NO: 837130 - RNA, 24 nt, Human
gcagcaccaauaaaugugugaucc

SEQ ID NO: 837131 - RNA, 27 nt, Human
gcccuuuguuuaccugaaccugccgga

SEQ ID NO: 837132 - RNA, 21 nt, Human
gucaggcaaaacaggcaggaa

SEQ ID NO: 837133 - RNA, 21 nt, Human
guuuaccugaaccugcuccuc

SEQ ID NO: 837134 - RNA, 19 nt, Human
uaacaggaacacaaaggag

SEQ ID NO: 837135 - RNA, 23 nt, Human
uaacaggaacacaaaggagaaga

SEQ ID NO: 837136 - RNA, 20 nt, Human
uauagaauaucaaaacucuu

SEQ ID NO: 837137 - RNA, 22 nt, Human
ucaacccaaaaaagauucaagg

SEQ ID NO: 837138 - RNA, 21 nt, Human
ucacaaggagugggagacacu

SEQ ID NO: 837139 - RNA, 24 nt, Human
ucccgaccaguccugagaauucac

SEQ ID NO: 837140 - RNA, 22 nt, Human
uccugagaauucacccucggcu

SEQ ID NO: 837141 - RNA, 18 nt, Human
ucuuggcugcucacuacu

SEQ ID NO: 837142 - RNA, 19 nt, Human
ugaaaaggcuaaaaacaac

SEQ ID NO: 837143 - RNA, 18 nt, Human
ugacucccgaccaguccu

SEQ ID NO: 837144 - RNA, 21 nt, Human
ugccacaaaaacaaagugaac

SEQ ID NO: 837145 - RNA, 23 nt, Human
ugccacaaaaacaaagugaacaa

SEQ ID NO: 837146 - RNA, 20 nt, Human
ugcuuugcuuacucuuccuc

SEQ ID NO: 837147 - RNA, 21 nt, Human
ugcuuugcuuacucuuccucu

SEQ ID NO: 837148 - RNA, 22 nt, Human
uggauuuuacaaaaacaaaacu

SEQ ID NO: 837149 - RNA, 26 nt, Human
uggcagcaccaauaaaugugugaucc

SEQ ID NO: 837150 - RNA, 23 nt, Human
ugggagacacugcuggacaccac

SEQ ID NO: 837151 - RNA, 24 nt, Human
uucacacauuucugagaaaaucuc

SEQ ID NO: 837152 - RNA, 19 nt, Human
aaugccacauuuucuuguc

SEQ ID NO: 837153 - RNA, 23 nt, Human
acaaaacacuuucuacugucccu

SEQ ID NO: 837154 - RNA, 21 nt, Human
accucuggcuucugaucccaa

SEQ ID NO: 837155 - RNA, 21 nt, Human
acugccgaccaguccugagaa

SEQ ID NO: 837156 - RNA, 23 nt, Human
auaaguuguuucacucaaaaaac

SEQ ID NO: 837157 - RNA, 25 nt, Human
cacucaaaaaacaaaacacuuucua

SEQ ID NO: 837158 - RNA, 18 nt, Human
cagcaauaacagggugau

SEQ ID NO: 837159 - RNA, 23 nt, Human
cagcaauaacagggugaucuaua

SEQ ID NO: 837160 - RNA, 21 nt, Human
ccaaagauauuucuacucuaa

SEQ ID NO: 837161 - RNA, 22 nt, Human
ccuaagaccucauuggggguga

SEQ ID NO: 837162 - RNA, 26 nt, Human
cuacacucgcucggguccucgccucc

SEQ ID NO: 837163 - RNA, 23 nt, Human
cuaguugaaaaagagaaaaaaaa

SEQ ID NO: 837164 - RNA, 25 nt, Human
cugaaaaacagcaauaacaggguga

SEQ ID NO: 837165 - RNA, 22 nt, Human
gagaacagcagguaaacuuggc

SEQ ID NO: 837166 - RNA, 18 nt, Human
uaacaggccuuuugaauu

SEQ ID NO: 837167 - RNA, 18 nt, Human
uacaaaguaaagaaucug

SEQ ID NO: 837168 - RNA, 22 nt, Human
uccucgccuccaaagcggaagu

SEQ ID NO: 837169 - RNA, 22 nt, Human
uccugagaauucaccccuggcu

SEQ ID NO: 837170 - RNA, 20 nt, Human
ucuaaugccacauuuucuug

SEQ ID NO: 837171 - RNA, 21 nt, Human
ugaaaaacagcaauaacaggg

SEQ ID NO: 837172 - RNA, 20 nt, Human
uggcaguagugcaaggccug

SEQ ID NO: 837173 - RNA, 18 nt, Human
uggcuucugaucccaaau

SEQ ID NO: 837174 - RNA, 20 nt, Human
ugggagauugauuggcuaug

SEQ ID NO: 837175 - RNA, 21 nt, Human
ugggagauugauuggcuaugg

SEQ ID NO: 837176 - RNA, 22 nt, Human
uucaccccuggcugaccagacg

SEQ ID NO: 837177 - RNA, 24 nt, Human
uucaugcauaacaagaacaaaggu

SEQ ID NO: 837178 - RNA, 18 nt, Human
aguggcugccuagagugc

SEQ ID NO: 837179 - RNA, 21 nt, Human
cacucacuccaagccccuccg

SEQ ID NO: 837180 - RNA, 21 nt, Human
cucacuccaagccccuccgaa

SEQ ID NO: 837181 - RNA, 19 nt, Human
cuccaagccccuccgaaac

SEQ ID NO: 837182 - RNA, 18 nt, Human
cugaggaugcacccuggc

SEQ ID NO: 837183 - RNA, 20 nt, Human
cuguguugaguagguuucug

SEQ ID NO: 837184 - RNA, 18 nt, Human
gcguccacucacuccaag

SEQ ID NO: 837185 - RNA, 24 nt, Human
ugaagagaaagacuggcaggauua

SEQ ID NO: 837186 - RNA, 18 nt, Human
uggcaagagcugagccuc

SEQ ID NO: 837187 - RNA, 21 nt, Human
uggcuugaagagaaagacugg

SEQ ID NO: 837188 - RNA, 21 nt, Human
uguguugaguagguuucugag

SEQ ID NO: 837189 - RNA, 19 nt, Human
uuuuuuuuuuugaaauggc

SEQ ID NO: 837190 - RNA, 18 nt, Human
uuuuuuuuuuuuuuuuug

SEQ ID NO: 837191 - RNA, 24 nt, Human
aaaaacagguaaaucucuacauca

SEQ ID NO: 837192 - RNA, 20 nt, Human
aaacuacugaccacccuuca

SEQ ID NO: 837193 - RNA, 21 nt, Human
aacaagcuaagcaaagccagg

SEQ ID NO: 837194 - RNA, 21 nt, Human
aacagggauauggaugaugag

SEQ ID NO: 837195 - RNA, 19 nt, Human
aagacucuuccccccgcua

SEQ ID NO: 837196 - RNA, 30 nt, Human
aaggaaaagcauuuagaaaauacugaaaag

SEQ ID NO: 837197 - RNA, 24 nt, Human
acacccaguucgucaccaccuggu

SEQ ID NO: 837198 - RNA, 21 nt, Human
acagaaaugcaaagaacacua

SEQ ID NO: 837199 - RNA, 18 nt, Human
acuccuggcacugccugg

SEQ ID NO: 837200 - RNA, 23 nt, Human
acugcccuguucaaacacaaggg

SEQ ID NO: 837201 - RNA, 21 nt, Human
caacaagcuaagcaaagccag

SEQ ID NO: 837202 - RNA, 19 nt, Human
caccaccugguuccuggag

SEQ ID NO: 837203 - RNA, 24 nt, Human
cacuaccuagaaccuaaacugccc

SEQ ID NO: 837204 - RNA, 25 nt, Human
cauuuagaaaauacugaaaaacagg

SEQ ID NO: 837205 - RNA, 23 nt, Human
ccaacaggccuugacuccuggca

SEQ ID NO: 837206 - RNA, 22 nt, Human
cccucacccugaggacuggcca

SEQ ID NO: 837207 - RNA, 23 nt, Human
cccugaggacuggccaggucuaa

SEQ ID NO: 837208 - RNA, 18 nt, Human
ccuccacuaccuagaacc

SEQ ID NO: 837209 - RNA, 22 nt, Human
ccuccgauccgucagauuccca

SEQ ID NO: 837210 - RNA, 20 nt, Human
ccucgagccccaccuggccc

SEQ ID NO: 837211 - RNA, 21 nt, Human
ccucgagccccaccuggcccu

SEQ ID NO: 837212 - RNA, 22 nt, Human
cgcgccuccucacaaaugccuc

SEQ ID NO: 837213 - RNA, 20 nt, Human
cucacaaaugccuccgaucc

SEQ ID NO: 837214 - RNA, 22 nt, Human
cucacaaaugccuccgauccgu

SEQ ID NO: 837215 - RNA, 21 nt, Human
cugcuacuuucuucaacaagc

SEQ ID NO: 837216 - RNA, 23 nt, Human
cuggcacugccugggccuccucu

SEQ ID NO: 837217 - RNA, 20 nt, Human
cuuaaaccagauaaagagca

SEQ ID NO: 837218 - RNA, 24 nt, Human
gaccacccuucaauuuuguuccac

SEQ ID NO: 837219 - RNA, 19 nt, Human
ggggaagaaacuauccuag

SEQ ID NO: 837220 - RNA, 19 nt, Human
guaaaaaaaaaaaaaaauu

SEQ ID NO: 837221 - RNA, 23 nt, Human
uaagacucuuccccccgcuaacu

SEQ ID NO: 837222 - RNA, 18 nt, Human
uacagaucacaaaauaag

SEQ ID NO: 837223 - RNA, 18 nt, Human
uagaaaauacugaaaaac

SEQ ID NO: 837224 - RNA, 24 nt, Human
ucacacccaguucgucaccaccug

SEQ ID NO: 837225 - RNA, 25 nt, Human
uccacuaccuagaaccuaaacugcc

SEQ ID NO: 837226 - RNA, 23 nt, Human
ucgcgccuccucacaaaugccuc

SEQ ID NO: 837227 - RNA, 21 nt, Human
ucuacaucacccauaugggac

SEQ ID NO: 837228 - RNA, 24 nt, Human
ucucacggcagcgcaguacaggcc

SEQ ID NO: 837229 - RNA, 24 nt, Human
ucugcugugcugacuuuaggcugu

SEQ ID NO: 837230 - RNA, 18 nt, Human
ugacuccuggcacugccu

SEQ ID NO: 837231 - RNA, 21 nt, Human
ugcacauuguaaaaaaaaaaa

SEQ ID NO: 837232 - RNA, 20 nt, Human
ugcccuguucaaacacaagg

SEQ ID NO: 837233 - RNA, 21 nt, Human
ugccuccgauccgucagauuc

SEQ ID NO: 837234 - RNA, 24 nt, Human
uucaaaggaaaagcauuuagaaaa

SEQ ID NO: 837235 - RNA, 25 nt, Human
uucaagaacaaaagaauaagcagga

SEQ ID NO: 837236 - RNA, 21 nt, Human
uuccucagggcccucacccug

SEQ ID NO: 837237 - RNA, 23 nt, Human
uuuuuuuuuuuuuuuuuucuuuu

SEQ ID NO: 837238 - RNA, 18 nt, Human
aaaguucuuccauccauu

SEQ ID NO: 837239 - RNA, 19 nt, Human
aauccuuaaagucacacga

SEQ ID NO: 837240 - RNA, 22 nt, Human
acagcggcagugacggcgggag

SEQ ID NO: 837241 - RNA, 23 nt, Human
aggaaaaaguagaccaaucucau

SEQ ID NO: 837242 - RNA, 19 nt, Human
aucaucauacugcugaguu

SEQ ID NO: 837243 - RNA, 23 nt, Human
cacgggccgaggggugugggagc

SEQ ID NO: 837244 - RNA, 22 nt, Human
cagcauuuuaacaguaauuauu

SEQ ID NO: 837245 - RNA, 23 nt, Human
caggaaaaaguagaccaaucuca

SEQ ID NO: 837246 - RNA, 22 nt, Human
cauacugcugaguuccuucaaa

SEQ ID NO: 837247 - RNA, 20 nt, Human
ccagaucaucauacugcuga

SEQ ID NO: 837248 - RNA, 23 nt, Human
ccauccauuuuacaaaaccagca

SEQ ID NO: 837249 - RNA, 21 nt, Human
cccucgccccacccauauuac

SEQ ID NO: 837250 - RNA, 20 nt, Human
ccucgccccacccauauuac

SEQ ID NO: 837251 - RNA, 24 nt, Human
cggcagugacggcgggaguacaag

SEQ ID NO: 837252 - RNA, 24 nt, Human
cggcgggaguacaaggagcaaugg

SEQ ID NO: 837253 - RNA, 18 nt, Human
cuacaggaaaaaguagac

SEQ ID NO: 837254 - RNA, 18 nt, Human
cugaguuccuucaaacca

SEQ ID NO: 837255 - RNA, 19 nt, Human
cuggaaccagaucaucaua

SEQ ID NO: 837256 - RNA, 19 nt, Human
gccaacuuuucaccaaccc

SEQ ID NO: 837257 - RNA, 19 nt, Human
gcguacacgggccgagggg

SEQ ID NO: 837258 - RNA, 18 nt, Human
ggacaguaguucguccuc

SEQ ID NO: 837259 - RNA, 19 nt, Human
ggagggguuggacagcggc

SEQ ID NO: 837260 - RNA, 23 nt, Human
uaaauccuuaaagucacacgauu

SEQ ID NO: 837261 - RNA, 23 nt, Human
uacaaaaccagcaaaacucuaca

SEQ ID NO: 837262 - RNA, 27 nt, Human
uacaaaaccagcaaaacucuacaauaa

SEQ ID NO: 837263 - RNA, 25 nt, Human
uacacgggccgaggggugugggagc

SEQ ID NO: 837264 - RNA, 18 nt, Human
ucaaaccaucaaaguaca

SEQ ID NO: 837265 - RNA, 21 nt, Human
ucaggacaguaguucguccuc

SEQ ID NO: 837266 - RNA, 18 nt, Human
uccacaaauguuuaauuu

SEQ ID NO: 837267 - RNA, 19 nt, Human
ucuacaauaaaauccuaca

SEQ ID NO: 837268 - RNA, 19 nt, Human
ugaagguacaugccagucu

SEQ ID NO: 837269 - RNA, 21 nt, Human
ugcugaguuccuucaaaccau

SEQ ID NO: 837270 - RNA, 19 nt, Human
uggcagcgggagcuuugug

SEQ ID NO: 837271 - RNA, 19 nt, Human
aaagcaaacacucuauuuc

SEQ ID NO: 837272 - RNA, 22 nt, Human
aaugacaggaaacaaagaaaaa

SEQ ID NO: 837273 - RNA, 23 nt, Human
aaugacaggaaacaaagaaaaaa

SEQ ID NO: 837274 - RNA, 20 nt, Human
acaacagcagacacaaaggg

SEQ ID NO: 837275 - RNA, 20 nt, Human
acacaacagcagacacaaag

SEQ ID NO: 837276 - RNA, 22 nt, Human
acacaacagcagacacaaaggg

SEQ ID NO: 837277 - RNA, 20 nt, Human
accaaugucaauagagucuu

SEQ ID NO: 837278 - RNA, 23 nt, Human
agccgccgccagcacuugccgca

SEQ ID NO: 837279 - RNA, 20 nt, Human
aggcucaaagcuuacagcag

SEQ ID NO: 837280 - RNA, 20 nt, Human
aucaugguaaaugucaaucu

SEQ ID NO: 837281 - RNA, 19 nt, Human
augacaggaaacaaagaaa

SEQ ID NO: 837282 - RNA, 24 nt, Human
augacaggaaacaaagaaaaaaaa

SEQ ID NO: 837283 - RNA, 18 nt, Human
auuaucaaaagcaaacac

SEQ ID NO: 837284 - RNA, 18 nt, Human
caaaagaacagcuuauuu

SEQ ID NO: 837285 - RNA, 22 nt, Human
caaagcuuacagcaguccuagg

SEQ ID NO: 837286 - RNA, 24 nt, Human
caaauacagugucccccgccccca

SEQ ID NO: 837287 - RNA, 23 nt, Human
caaucuucacacaacagcagaca

SEQ ID NO: 837288 - RNA, 20 nt, Human
cacaacagcagacacaaagg

SEQ ID NO: 837289 - RNA, 23 nt, Human
cagcaaaauuggccccgccucuc

SEQ ID NO: 837290 - RNA, 19 nt, Human
cagccgccgccagcacuug

SEQ ID NO: 837291 - RNA, 19 nt, Human
caguccuagggaaggaugc

SEQ ID NO: 837292 - RNA, 20 nt, Human
cggaauuuuaaaacgaauac

SEQ ID NO: 837293 - RNA, 22 nt, Human
cugaagcuaccaaugucaauag

SEQ ID NO: 837294 - RNA, 22 nt, Human
gacacaaaggguuucagaaacg

SEQ ID NO: 837295 - RNA, 19 nt, Human
gacaggaaacaaagaaaaa

SEQ ID NO: 837296 - RNA, 18 nt, Human
gacucucuuuuacacccc

SEQ ID NO: 837297 - RNA, 19 nt, Human
ggaauuuuaaaacgaauac

SEQ ID NO: 837298 - RNA, 22 nt, Human
ggccccgccucuccugccacgc

SEQ ID NO: 837299 - RNA, 20 nt, Human
uacaagaucauagauuauga

SEQ ID NO: 837300 - RNA, 21 nt, Human
uacaagaucauagauuaugau

SEQ ID NO: 837301 - RNA, 24 nt, Human
uacaagaucauagauuaugaugga

SEQ ID NO: 837302 - RNA, 19 nt, Human
uacagugucccccgccccc

SEQ ID NO: 837303 - RNA, 21 nt, Human
uaccugugacucucuuuuaca

SEQ ID NO: 837304 - RNA, 20 nt, Human
uagccucuucaggaagcaac

SEQ ID NO: 837305 - RNA, 20 nt, Human
uaggacccuggcaucuacuc

SEQ ID NO: 837306 - RNA, 19 nt, Human
ucaaaagcaaacacucuau

SEQ ID NO: 837307 - RNA, 27 nt, Human
ucaaauacagugucccccgcccccaau

SEQ ID NO: 837308 - RNA, 18 nt, Human
ucaacuuaggacccuggc

SEQ ID NO: 837309 - RNA, 23 nt, Human
ucaaugacaggaaacaaagaaaa

SEQ ID NO: 837310 - RNA, 22 nt, Human
uccauuaucaaaagcaaacacu

SEQ ID NO: 837311 - RNA, 20 nt, Human
ugcaguaacuaaggaaaauc

SEQ ID NO: 837312 - RNA, 18 nt, Human
ugccgcagcugcaagccc

SEQ ID NO: 837313 - RNA, 21 nt, Human
ugcuagaggcucaaagcuuac

SEQ ID NO: 837314 - RNA, 23 nt, Human
uugggguaccugugacucucuuu

SEQ ID NO: 837315 - RNA, 21 nt, Human
uuuaaacauauuguuauucuc

SEQ ID NO: 837316 - RNA, 20 nt, Human
uuucagaaacgucagauaug

SEQ ID NO: 837317 - RNA, 20 nt, Human
cuccggggcucaaacucccc

SEQ ID NO: 837318 - RNA, 20 nt, Human
gcggggugggcggggggagc

SEQ ID NO: 837319 - RNA, 21 nt, Human
ggcagccgcucugcuccgggg

SEQ ID NO: 837320 - RNA, 22 nt, Human
uaccaagcuauaaauuagaggc

SEQ ID NO: 837321 - RNA, 20 nt, Human
uagaggcggcggggugggcg

SEQ ID NO: 837322 - RNA, 19 nt, Human
uccggggcucaaacucccc

SEQ ID NO: 837323 - RNA, 22 nt, Human
aaaaaaaaaaaaaagcaugcaa

SEQ ID NO: 837324 - RNA, 21 nt, Human
aaaaagcaucuuuacaauucg

SEQ ID NO: 837325 - RNA, 20 nt, Human
aaacaucauggcacauuauc

SEQ ID NO: 837326 - RNA, 23 nt, Human
aaagaucaaauucuaaccaugga

SEQ ID NO: 837327 - RNA, 18 nt, Human
aagcuacuguuaauugaa

SEQ ID NO: 837328 - RNA, 21 nt, Human
acaggaagauauguuucaaua

SEQ ID NO: 837329 - RNA, 21 nt, Human
acccacuauauaauagugaac

SEQ ID NO: 837330 - RNA, 19 nt, Human
acucagcugcaaagauaag

SEQ ID NO: 837331 - RNA, 19 nt, Human
acuccagccugggcgccag

SEQ ID NO: 837332 - RNA, 24 nt, Human
acuguacuccagccugggcgccag

SEQ ID NO: 837333 - RNA, 26 nt, Human
acuguacuccagccugggcgccagag

SEQ ID NO: 837334 - RNA, 24 nt, Human
agaaaaaaaaaaaaaagcaugcaa

SEQ ID NO: 837335 - RNA, 24 nt, Human
agacauacugggucaaacaaugug

SEQ ID NO: 837336 - RNA, 20 nt, Human
agcauuuugggagacuaagg

SEQ ID NO: 837337 - RNA, 22 nt, Human
agcauuuugggagacuaaggca

SEQ ID NO: 837338 - RNA, 18 nt, Human
agccaaauacauuccuca

SEQ ID NO: 837339 - RNA, 22 nt, Human
agccgggcaugguggcucacuc

SEQ ID NO: 837340 - RNA, 22 nt, Human
aggaagauauguuucaauacug

SEQ ID NO: 837341 - RNA, 22 nt, Human
aggaccccgacaccugcgccac

SEQ ID NO: 837342 - RNA, 23 nt, Human
aggaguucaagaccagccugggc

SEQ ID NO: 837343 - RNA, 21 nt, Human
aggaucacuugagcccaaguc

SEQ ID NO: 837344 - RNA, 26 nt, Human
aggcagauggcaugagcucaggaguu

SEQ ID NO: 837345 - RNA, 26 nt, Human
aggcaggcagauggcaugagcucagg

SEQ ID NO: 837346 - RNA, 24 nt, Human
aggcucagguaggaggaucacuug

SEQ ID NO: 837347 - RNA, 18 nt, Human
agguaggaggaucacuug

SEQ ID NO: 837348 - RNA, 23 nt, Human
agguaggaggaucacuugagccc

SEQ ID NO: 837349 - RNA, 21 nt, Human
agugcacaccuguagucccag

SEQ ID NO: 837350 - RNA, 24 nt, Human
aucaugccacuguacuccagccug

SEQ ID NO: 837351 - RNA, 20 nt, Human
augaaauaugcaaaucugcc

SEQ ID NO: 837352 - RNA, 22 nt, Human
augccacuguacuccagccugg

SEQ ID NO: 837353 - RNA, 21 nt, Human
auggacugguucauaucacac

SEQ ID NO: 837354 - RNA, 21 nt, Human
caaaucugccaagagaaauua

SEQ ID NO: 837355 - RNA, 24 nt, Human
caacagaacacauaaauuagaaaa

SEQ ID NO: 837356 - RNA, 22 nt, Human
caacuccguaacuccccaucug

SEQ ID NO: 837357 - RNA, 19 nt, Human
caagaccagccugggcaag

SEQ ID NO: 837358 - RNA, 20 nt, Human
caagucaaggcugaagugag

SEQ ID NO: 837359 - RNA, 19 nt, Human
cacaccuguagucccaguu

SEQ ID NO: 837360 - RNA, 19 nt, Human
caccuguagucccaguuac

SEQ ID NO: 837361 - RNA, 24 nt, Human
caccuguagucccaguuacucaga

SEQ ID NO: 837362 - RNA, 24 nt, Human
cacuccuguaaucccagcauuuug

SEQ ID NO: 837363 - RNA, 18 nt, Human
cacuguacuccagccugg

SEQ ID NO: 837364 - RNA, 19 nt, Human
cacuguacuccagccuggg

SEQ ID NO: 837365 - RNA, 20 nt, Human
cacuguacuccagccugggc

SEQ ID NO: 837366 - RNA, 20 nt, Human
cacuguacuccagccugggc

SEQ ID NO: 837367 - RNA, 24 nt, Human
cacuguacuccagccugggcgcca

SEQ ID NO: 837368 - RNA, 19 nt, Human
cagagcaagacccugucuc

SEQ ID NO: 837369 - RNA, 24 nt, Human
cagcauuuugggagacuaaggcag

SEQ ID NO: 837370 - RNA, 25 nt, Human
cagcauuuugggagacuaaggcagg

SEQ ID NO: 837371 - RNA, 27 nt, Human
caguaacucccagggacuaaggccaaa

SEQ ID NO: 837372 - RNA, 20 nt, Human
ccacuguacuccagccuggg

SEQ ID NO: 837373 - RNA, 20 nt, Human
ccacuguacuccagccuggg

SEQ ID NO: 837374 - RNA, 21 nt, Human
ccacuguacuccagccugggc

SEQ ID NO: 837375 - RNA, 22 nt, Human
ccacuguacuccagccugggcg

SEQ ID NO: 837376 - RNA, 22 nt, Human
ccacuguacuccagccugggcg

SEQ ID NO: 837377 - RNA, 23 nt, Human
ccacuguacuccagccugggcgc

SEQ ID NO: 837378 - RNA, 18 nt, Human
ccagauaccuggguauga

SEQ ID NO: 837379 - RNA, 21 nt, Human
ccgacaccugcgccaccggcu

SEQ ID NO: 837380 - RNA, 21 nt, Human
ccuguagucccaguuacucag

SEQ ID NO: 837381 - RNA, 19 nt, Human
cggcaagcaaaauaauguu

SEQ ID NO: 837382 - RNA, 19 nt, Human
cgggagaaaaaaaaaaaaa

SEQ ID NO: 837383 - RNA, 22 nt, Human
cgggagaaaaaaaaaaaaaagc

SEQ ID NO: 837384 - RNA, 21 nt, Human
cucacuccuguaaucccagca

SEQ ID NO: 837385 - RNA, 24 nt, Human
cucccaggcugggcgcucgaggac

SEQ ID NO: 837386 - RNA, 24 nt, Human
cuccuguaaucccagcauuuuggg

SEQ ID NO: 837387 - RNA, 20 nt, Human
cucuuccaugcaacugccag

SEQ ID NO: 837388 - RNA, 20 nt, Human
gacaacagaaaacaggaaga

SEQ ID NO: 837389 - RNA, 21 nt, Human
gagaaaaaaaaaaaaaagcau

SEQ ID NO: 837390 - RNA, 18 nt, Human
gagugcacaccuguaguc

SEQ ID NO: 837391 - RNA, 18 nt, Human
gauauuuuucuucuuuuc

SEQ ID NO: 837392 - RNA, 21 nt, Human
gaucacuugagcccaagucaa

SEQ ID NO: 837393 - RNA, 21 nt, Human
gcaagguggcaagauccugcc

SEQ ID NO: 837394 - RNA, 21 nt, Human
gcaggcagauggcaugagcuc

SEQ ID NO: 837395 - RNA, 24 nt, Human
gcaugagcucaggaguucaagacc

SEQ ID NO: 837396 - RNA, 20 nt, Human
gcaugccagcggcaagcaaa

SEQ ID NO: 837397 - RNA, 22 nt, Human
gcaugccagcggcaagcaaaau

SEQ ID NO: 837398 - RNA, 18 nt, Human
gcaugguggcucacuccu

SEQ ID NO: 837399 - RNA, 22 nt, Human
gccacuguacuccagccugggc

SEQ ID NO: 837400 - RNA, 23 nt, Human
gccacuguacuccagccugggcg

SEQ ID NO: 837401 - RNA, 21 nt, Human
gccagagcaagacccugucuc

SEQ ID NO: 837402 - RNA, 22 nt, Human
ggacaccuuucaucuaguccaa

SEQ ID NO: 837403 - RNA, 23 nt, Human
ggagugcacaccuguagucccag

SEQ ID NO: 837404 - RNA, 23 nt, Human
ggcaugccagcggcaagcaaaau

SEQ ID NO: 837405 - RNA, 23 nt, Human
ggcaugguggcucacuccuguaa

SEQ ID NO: 837406 - RNA, 19 nt, Human
gggagaaaaaaaaaaaaaa

SEQ ID NO: 837407 - RNA, 24 nt, Human
gguggcucacuccuguaaucccag

SEQ ID NO: 837408 - RNA, 26 nt, Human
guaaaaaaacaaaaauuucaacagaa

SEQ ID NO: 837409 - RNA, 18 nt, Human
guaaaggaacaacuccgu

SEQ ID NO: 837410 - RNA, 24 nt, Human
guacuccagccugggcgccagagc

SEQ ID NO: 837411 - RNA, 24 nt, Human
guuuauuuaaaaccaucaguuuuu

SEQ ID NO: 837412 - RNA, 22 nt, Human
uaaaggaacaacuccguaacuc

SEQ ID NO: 837413 - RNA, 24 nt, Human
uaacaaccaaguauguacaauauu

SEQ ID NO: 837414 - RNA, 23 nt, Human
uaacucccagggacuaaggccaa

SEQ ID NO: 837415 - RNA, 20 nt, Human
uaacugacagugaguguugg

SEQ ID NO: 837416 - RNA, 24 nt, Human
uaaggcaggcagauggcaugagcu

SEQ ID NO: 837417 - RNA, 21 nt, Human
uacaaaaacuuaguguguaau

SEQ ID NO: 837418 - RNA, 23 nt, Human
uacuccagccugggcgccagagc

SEQ ID NO: 837419 - RNA, 18 nt, Human
uagugaauuaguuuauuu

SEQ ID NO: 837420 - RNA, 21 nt, Human
uaguguguaaucaaagccaaa

SEQ ID NO: 837421 - RNA, 24 nt, Human
uauaauagugaacuaaauauguuu

SEQ ID NO: 837422 - RNA, 24 nt, Human
ucaaggcugaagugagccaagauc

SEQ ID NO: 837423 - RNA, 23 nt, Human
ucaugccacuguacuccagccug

SEQ ID NO: 837424 - RNA, 19 nt, Human
uccaugcaacugccagccg

SEQ ID NO: 837425 - RNA, 21 nt, Human
uccaugcaacugccagccggg

SEQ ID NO: 837426 - RNA, 22 nt, Human
uccaugcaacugccagccgggc

SEQ ID NO: 837427 - RNA, 19 nt, Human
ucccagggacuaaggccaa

SEQ ID NO: 837428 - RNA, 21 nt, Human
uccccaucugcuuuaucuaca

SEQ ID NO: 837429 - RNA, 20 nt, Human
ugaagccuguccaacgccag

SEQ ID NO: 837430 - RNA, 19 nt, Human
ugaauggacugguucauau

SEQ ID NO: 837431 - RNA, 18 nt, Human
ugccaagagaaauuagau

SEQ ID NO: 837432 - RNA, 25 nt, Human
ugcuguauuuaccuuuuuccuuuca

SEQ ID NO: 837433 - RNA, 21 nt, Human
ugcuuugaaacugucaauagc

SEQ ID NO: 837434 - RNA, 21 nt, Human
uggacaccuuucaucuagucc

SEQ ID NO: 837435 - RNA, 21 nt, Human
uggcucacuccuguaauccca

SEQ ID NO: 837436 - RNA, 22 nt, Human
uggcucacuccuguaaucccag

SEQ ID NO: 837437 - RNA, 24 nt, Human
uggcucacuccuguaaucccagca

SEQ ID NO: 837438 - RNA, 24 nt, Human
ugguggcucacuccuguaauccca

SEQ ID NO: 837439 - RNA, 21 nt, Human
ugucuacaagacauacugggu

SEQ ID NO: 837440 - RNA, 20 nt, Human
uuaguuuauuuaaaaccauc

SEQ ID NO: 837441 - RNA, 24 nt, Human
uuuuauuagugaauuaguuuauuu

SEQ ID NO: 837442 - RNA, 23 nt, Human
aaaaccaaccaacacuuucucau

SEQ ID NO: 837443 - RNA, 24 nt, Human
aaagaaaccaauuuaaugccacca

SEQ ID NO: 837444 - RNA, 22 nt, Human
aacaaaaaaucucacaccuaaa

SEQ ID NO: 837445 - RNA, 22 nt, Human
aacagauuuugucugucaccag

SEQ ID NO: 837446 - RNA, 21 nt, Human
aacauuacagaugucugggcu

SEQ ID NO: 837447 - RNA, 24 nt, Human
aagcuacaaaucuaaguauucaca

SEQ ID NO: 837448 - RNA, 19 nt, Human
aaguauucuccaaagguaa

SEQ ID NO: 837449 - RNA, 20 nt, Human
aaugcaaaauaauuagaagu

SEQ ID NO: 837450 - RNA, 18 nt, Human
acaaaagugccaccaaag

SEQ ID NO: 837451 - RNA, 23 nt, Human
acaaucuagaagcaaucuguuua

SEQ ID NO: 837452 - RNA, 23 nt, Human
accagauuuuaaaaccaaccaac

SEQ ID NO: 837453 - RNA, 20 nt, Human
acccagccuccccuuguuuu

SEQ ID NO: 837454 - RNA, 22 nt, Human
agaaaaggaggaaaauaaaggg

SEQ ID NO: 837455 - RNA, 19 nt, Human
agccagaaaguaaagggcu

SEQ ID NO: 837456 - RNA, 22 nt, Human
agccagaaauaguuuuugugcu

SEQ ID NO: 837457 - RNA, 23 nt, Human
aggaaaauaaagggggaaaggga

SEQ ID NO: 837458 - RNA, 25 nt, Human
aggggaugcuucagccagaaaguaa

SEQ ID NO: 837459 - RNA, 24 nt, Human
aguaguaggauauuauagaaaaga

SEQ ID NO: 837460 - RNA, 19 nt, Human
auauccacacacaaauaug

SEQ ID NO: 837461 - RNA, 20 nt, Human
aucucacaccuaaauucuag

SEQ ID NO: 837462 - RNA, 19 nt, Human
augguuguucuauguucca

SEQ ID NO: 837463 - RNA, 20 nt, Human
caaaaugguauccaaauuga

SEQ ID NO: 837464 - RNA, 22 nt, Human
caaaaugguauccaaauugauc

SEQ ID NO: 837465 - RNA, 22 nt, Human
caccaaacauaagccugcuaua

SEQ ID NO: 837466 - RNA, 25 nt, Human
caccagugguugacaaacuauggcc

SEQ ID NO: 837467 - RNA, 20 nt, Human
cagcaaccaaacaaaaggga

SEQ ID NO: 837468 - RNA, 23 nt, Human
cagcaaccaaacaaaagggauac

SEQ ID NO: 837469 - RNA, 23 nt, Human
caugcacagggcaaacaacugua

SEQ ID NO: 837470 - RNA, 18 nt, Human
cauggcacuccaagggga

SEQ ID NO: 837471 - RNA, 18 nt, Human
cauucaaaacaguuuggc

SEQ ID NO: 837472 - RNA, 22 nt, Human
ccaaacauaagccugcuauacc

SEQ ID NO: 837473 - RNA, 18 nt, Human
ccagaaaguaaagggcug

SEQ ID NO: 837474 - RNA, 18 nt, Human
ccgccgccgccucccgcc

SEQ ID NO: 837475 - RNA, 20 nt, Human
ccgccgccgccucccgccuc

SEQ ID NO: 837476 - RNA, 21 nt, Human
ccgccgccucccgccuccgcc

SEQ ID NO: 837477 - RNA, 22 nt, Human
ccgccgccucccgccuccgccu

SEQ ID NO: 837478 - RNA, 28 nt, Human
ccgccgccucccgccuccgccucccggg

SEQ ID NO: 837479 - RNA, 25 nt, Human
ccgccucccgccuccgccucccggg

SEQ ID NO: 837480 - RNA, 23 nt, Human
ccgccuccgccucccgggcuccu

SEQ ID NO: 837481 - RNA, 18 nt, Human
ccgcgcgccgccgccgcc

SEQ ID NO: 837482 - RNA, 23 nt, Human
ccucccgccuccgccucccgggc

SEQ ID NO: 837483 - RNA, 19 nt, Human
cgccucccgggcuccugcc

SEQ ID NO: 837484 - RNA, 19 nt, Human
cgccuccgccucccgggcu

SEQ ID NO: 837485 - RNA, 27 nt, Human
cgcgcgccgccgccgccucccgccucc

SEQ ID NO: 837486 - RNA, 20 nt, Human
cucauuuuuacagcuaagac

SEQ ID NO: 837487 - RNA, 23 nt, Human
cucccgccuccgccucccgggcu

SEQ ID NO: 837488 - RNA, 27 nt, Human
cucucuacuaaacacauuacuuuugga

SEQ ID NO: 837489 - RNA, 19 nt, Human
cuuugucauucaacucaca

SEQ ID NO: 837490 - RNA, 26 nt, Human
gaaauaaaccagaacuugagcuuaga

SEQ ID NO: 837491 - RNA, 19 nt, Human
gacaaacuauggcccacag

SEQ ID NO: 837492 - RNA, 22 nt, Human
gacucugccugagaaauuuuau

SEQ ID NO: 837493 - RNA, 18 nt, Human
gcuccugccgccgccgcc

SEQ ID NO: 837494 - RNA, 19 nt, Human
gcugccgcugccgcugcug

SEQ ID NO: 837495 - RNA, 18 nt, Human
ggaguuaccagauuuuaa

SEQ ID NO: 837496 - RNA, 22 nt, Human
ggcaaugugauuauugcauaau

SEQ ID NO: 837497 - RNA, 19 nt, Human
ggcuaaacccagccucccc

SEQ ID NO: 837498 - RNA, 18 nt, Human
gggaaagggaaaaagggg

SEQ ID NO: 837499 - RNA, 23 nt, Human
guagaacaauacaaaagcccucg

SEQ ID NO: 837500 - RNA, 19 nt, Human
guauggagcuaggaaaacc

SEQ ID NO: 837501 - RNA, 22 nt, Human
gugacucagcaaccaaacaaaa

SEQ ID NO: 837502 - RNA, 20 nt, Human
guggcuuuucuguuagguuu

SEQ ID NO: 837503 - RNA, 21 nt, Human
uaaaaccaaccaacacuuucu

SEQ ID NO: 837504 - RNA, 18 nt, Human
uaaagggggaaagggaaa

SEQ ID NO: 837505 - RNA, 20 nt, Human
uaacacuugaucauuaagca

SEQ ID NO: 837506 - RNA, 23 nt, Human
uaacuaagguuuuacaccagugg

SEQ ID NO: 837507 - RNA, 20 nt, Human
uaaguauaaagucauaugcc

SEQ ID NO: 837508 - RNA, 19 nt, Human
uacaaaagcccucgugugg

SEQ ID NO: 837509 - RNA, 23 nt, Human
uaccagauuuuaaaaccaaccaa

SEQ ID NO: 837510 - RNA, 23 nt, Human
uagaagcaaucuguuuacaaaag

SEQ ID NO: 837511 - RNA, 19 nt, Human
uagaauguacuguauaucc

SEQ ID NO: 837512 - RNA, 19 nt, Human
uagacuaucauuaguuuga

SEQ ID NO: 837513 - RNA, 24 nt, Human
uagaguuuagugggaagccuauuu

SEQ ID NO: 837514 - RNA, 18 nt, Human
uagcagaguaaacgauuc

SEQ ID NO: 837515 - RNA, 19 nt, Human
uaggugugugguauggagc

SEQ ID NO: 837516 - RNA, 18 nt, Human
uaguuuuugugcuggaua

SEQ ID NO: 837517 - RNA, 23 nt, Human
ucaaaacaguuuggcaccuuucc

SEQ ID NO: 837518 - RNA, 23 nt, Human
ucacagaugugucuuaggcuugg

SEQ ID NO: 837519 - RNA, 20 nt, Human
ucagccagaaauaguuuuug

SEQ ID NO: 837520 - RNA, 19 nt, Human
uccaaagguaaguauuuga

SEQ ID NO: 837521 - RNA, 20 nt, Human
uccacacacaaauaugggua

SEQ ID NO: 837522 - RNA, 19 nt, Human
uccaugaaauaaaccagaa

SEQ ID NO: 837523 - RNA, 20 nt, Human
ucccgccuccgccucccggg

SEQ ID NO: 837524 - RNA, 22 nt, Human
uccgcgcgccgccgccgccucc

SEQ ID NO: 837525 - RNA, 23 nt, Human
uccgcgcgccgccgccgccuccc

SEQ ID NO: 837526 - RNA, 24 nt, Human
uccgcgcgccgccgccgccucccg

SEQ ID NO: 837527 - RNA, 24 nt, Human
ucuagaaugugauuaagcuacaaa

SEQ ID NO: 837528 - RNA, 22 nt, Human
ucuccgcgcgccgccgccgccu

SEQ ID NO: 837529 - RNA, 18 nt, Human
ucucuggggaucccauuu

SEQ ID NO: 837530 - RNA, 21 nt, Human
ugaaguuuacuucauaaauua

SEQ ID NO: 837531 - RNA, 20 nt, Human
ugaauaguugugacagagac

SEQ ID NO: 837532 - RNA, 23 nt, Human
ugacacuaaauauuauguggcuu

SEQ ID NO: 837533 - RNA, 18 nt, Human
ugacgaggaucucuacag

SEQ ID NO: 837534 - RNA, 19 nt, Human
ugacucagcaaccaaacaa

SEQ ID NO: 837535 - RNA, 21 nt, Human
ugccugauuuccucaaaccuu

SEQ ID NO: 837536 - RNA, 23 nt, Human
uggccucacucuuacuuguccuu

SEQ ID NO: 837537 - RNA, 24 nt, Human
ugggaaacaaaaaaucucacaccu

SEQ ID NO: 837538 - RNA, 21 nt, Human
ugucugggcuaauacaaaaac

SEQ ID NO: 837539 - RNA, 20 nt, Human
ugucugucaccagugcaaaa

SEQ ID NO: 837540 - RNA, 23 nt, Human
ugugccaauuccugguuuacacu

SEQ ID NO: 837541 - RNA, 23 nt, Human
uuaaugccaccaaacauaagccu

SEQ ID NO: 837542 - RNA, 22 nt, Human
uucagccagaaaguaaagggcu

SEQ ID NO: 837543 - RNA, 19 nt, Human
uucauaauacagguuuagg

SEQ ID NO: 837544 - RNA, 28 nt, Human
uucaugcacagggcaaacaacuguauuc

SEQ ID NO: 837545 - RNA, 18 nt, Human
uuugcaucuggacaaaau

SEQ ID NO: 837546 - RNA, 18 nt, Human
uuuggcaccuuuccauga

SEQ ID NO: 837547 - RNA, 22 nt, Human
aaaaaggaagacaaaaagccaa

SEQ ID NO: 837548 - RNA, 18 nt, Human
aaaaauacaaccaccaca

SEQ ID NO: 837549 - RNA, 20 nt, Human
aaaagcacacagguaaggca

SEQ ID NO: 837550 - RNA, 21 nt, Human
aaaaggaaacugagcuuuaaa

SEQ ID NO: 837551 - RNA, 23 nt, Human
aaacaaaaaggaaacugagcuuu

SEQ ID NO: 837552 - RNA, 22 nt, Human
aaagcacacagguaaggcacaa

SEQ ID NO: 837553 - RNA, 20 nt, Human
aaauacacauuuugcugcaa

SEQ ID NO: 837554 - RNA, 22 nt, Human
aacaaauuaaauacugaggcac

SEQ ID NO: 837555 - RNA, 19 nt, Human
aacaggacaaguaacagau

SEQ ID NO: 837556 - RNA, 22 nt, Human
aagcaagaaaaagaugcaucug

SEQ ID NO: 837557 - RNA, 20 nt, Human
aagcauuuaaaaaggaagac

SEQ ID NO: 837558 - RNA, 20 nt, Human
aagccaauuguagauuacaa

SEQ ID NO: 837559 - RNA, 23 nt, Human
aaguaaaauuuacucagcaacua

SEQ ID NO: 837560 - RNA, 25 nt, Human
acacacauacauauauacacacaca

SEQ ID NO: 837561 - RNA, 19 nt, Human
agacaaaaagccaaacagg

SEQ ID NO: 837562 - RNA, 24 nt, Human
agacaaaaagccaaacaggaauug

SEQ ID NO: 837563 - RNA, 18 nt, Human
aggaagacaaaaagccaa

SEQ ID NO: 837564 - RNA, 18 nt, Human
auaaaaccuauaaaagau

SEQ ID NO: 837565 - RNA, 18 nt, Human
auaaaaccuauaaaagau

SEQ ID NO: 837566 - RNA, 22 nt, Human
auaacagaggcacuaacauauc

SEQ ID NO: 837567 - RNA, 22 nt, Human
auacacacauacauauauacac

SEQ ID NO: 837568 - RNA, 25 nt, Human
auacaucuauauauacacacacaua

SEQ ID NO: 837569 - RNA, 27 nt, Human
auauauauacaucuauauauacacaca

SEQ ID NO: 837570 - RNA, 19 nt, Human
auuuuuccaauaucugcca

SEQ ID NO: 837571 - RNA, 26 nt, Human
caacgcauacaauaaaacaaaaagga

SEQ ID NO: 837572 - RNA, 25 nt, Human
cacaaaagcacacagguaaggcaca

SEQ ID NO: 837573 - RNA, 28 nt, Human
cacacacauacacacauacauauauaca

SEQ ID NO: 837574 - RNA, 21 nt, Human
cacagguaaggcacaauaggg

SEQ ID NO: 837575 - RNA, 25 nt, Human
cacauacacacauacauauauacac

SEQ ID NO: 837576 - RNA, 25 nt, Human
cacauacauauauacacacacauua

SEQ ID NO: 837577 - RNA, 20 nt, Human
cagcauugcugccucacugc

SEQ ID NO: 837578 - RNA, 22 nt, Human
cagucuuagaaauggaagaaaa

SEQ ID NO: 837579 - RNA, 22 nt, Human
cauauacauccacuuacacaua

SEQ ID NO: 837580 - RNA, 24 nt, Human
caucaaacuucagaacuucucaaa

SEQ ID NO: 837581 - RNA, 18 nt, Human
caugacccaaaauugcaa

SEQ ID NO: 837582 - RNA, 20 nt, Human
cauucacucuugcaacaggu

SEQ ID NO: 837583 - RNA, 23 nt, Human
cgcauacaauaaaacaaaaagga

SEQ ID NO: 837584 - RNA, 20 nt, Human
cuaauacuuccagguguuug

SEQ ID NO: 837585 - RNA, 24 nt, Human
cucuguguguguauauauauacau

SEQ ID NO: 837586 - RNA, 18 nt, Human
cugagcuuuaaauacaag

SEQ ID NO: 837587 - RNA, 25 nt, Human
cuuaaccagaaaacgugcauuaucu

SEQ ID NO: 837588 - RNA, 21 nt, Human
cuuccagguguuuggcuguuu

SEQ ID NO: 837589 - RNA, 27 nt, Human
gaaaacgugcauuaucugugcaaguuc

SEQ ID NO: 837590 - RNA, 19 nt, Human
gugcccacaaaagcacaca

SEQ ID NO: 837591 - RNA, 20 nt, Human
uaaaacaaaaaggaaacuga

SEQ ID NO: 837592 - RNA, 22 nt, Human
uaaaacaaaaaggaaacugagc

SEQ ID NO: 837593 - RNA, 20 nt, Human
uaaaaugccacaacuauuuu

SEQ ID NO: 837594 - RNA, 21 nt, Human
uaaaaugccacaacuauuuuu

SEQ ID NO: 837595 - RNA, 22 nt, Human
uaaacaaggugcccacaaaagc

SEQ ID NO: 837596 - RNA, 22 nt, Human
uaacugagcuccaaaaacugaa

SEQ ID NO: 837597 - RNA, 22 nt, Human
uacacacacauacacacauaca

SEQ ID NO: 837598 - RNA, 19 nt, Human
uacacauucccaucugucu

SEQ ID NO: 837599 - RNA, 29 nt, Human
uacauauauacacacacauuagauuaugg

SEQ ID NO: 837600 - RNA, 22 nt, Human
uacuaugucauggcccuaguau

SEQ ID NO: 837601 - RNA, 18 nt, Human
uacuuucaccaccaccag

SEQ ID NO: 837602 - RNA, 20 nt, Human
uagccuguaggaacuaugca

SEQ ID NO: 837603 - RNA, 24 nt, Human
uauacacacacauacacacauaca

SEQ ID NO: 837604 - RNA, 28 nt, Human
uauacacacacauacacacauacauaua

SEQ ID NO: 837605 - RNA, 24 nt, Human
uauauacacacacauuagauuaug

SEQ ID NO: 837606 - RNA, 22 nt, Human
uauauacaucuauauauacaca

SEQ ID NO: 837607 - RNA, 19 nt, Human
uauauauacacacacauac

SEQ ID NO: 837608 - RNA, 21 nt, Human
uauauauauacaucuauauau

SEQ ID NO: 837609 - RNA, 23 nt, Human
uauauauauacaucuauauauac

SEQ ID NO: 837610 - RNA, 24 nt, Human
uauauaucucuguguguguauaua

SEQ ID NO: 837611 - RNA, 20 nt, Human
uaugcaaaaguacagccaua

SEQ ID NO: 837612 - RNA, 23 nt, Human
uauguauauaucucugugugugu

SEQ ID NO: 837613 - RNA, 24 nt, Human
uauguauauaucucugugugugua

SEQ ID NO: 837614 - RNA, 28 nt, Human
uauguauauaucucuguguguguauaua

SEQ ID NO: 837615 - RNA, 21 nt, Human
uauguuuuagaagcaagaaaa

SEQ ID NO: 837616 - RNA, 25 nt, Human
ucaaauaccuaguuauuauacacau

SEQ ID NO: 837617 - RNA, 23 nt, Human
ucacacaaaaucauacucagaca

SEQ ID NO: 837618 - RNA, 19 nt, Human
ucagaacuuucacacaaaa

SEQ ID NO: 837619 - RNA, 20 nt, Human
uccaaaaacugaaugaaaua

SEQ ID NO: 837620 - RNA, 22 nt, Human
ucggcuuaacaguuucagguaa

SEQ ID NO: 837621 - RNA, 22 nt, Human
ucuaugcaaaaguacagccaua

SEQ ID NO: 837622 - RNA, 20 nt, Human
ucugucuugcagggagggau

SEQ ID NO: 837623 - RNA, 24 nt, Human
ugaaacaaauuaaauacugaggca

SEQ ID NO: 837624 - RNA, 18 nt, Human
ugaaaucauaaacaguaa

SEQ ID NO: 837625 - RNA, 19 nt, Human
ugaggcacaaagcaacagu

SEQ ID NO: 837626 - RNA, 22 nt, Human
ugaggcacaaagcaacagucaa

SEQ ID NO: 837627 - RNA, 21 nt, Human
ugcaaacccaacgcauacaau

SEQ ID NO: 837628 - RNA, 26 nt, Human
ugcaaacccaacgcauacaauaaaac

SEQ ID NO: 837629 - RNA, 28 nt, Human
ugcaaacccaacgcauacagcgccggcg

SEQ ID NO: 837630 - RNA, 18 nt, Human
ugcaacaaugugcccugc

SEQ ID NO: 837631 - RNA, 19 nt, Human
ugcuuaauaaagucagugu

SEQ ID NO: 837632 - RNA, 22 nt, Human
uggaacguucagagauguauuc

SEQ ID NO: 837633 - RNA, 18 nt, Human
ugggggucacuaagcuca

SEQ ID NO: 837634 - RNA, 20 nt, Human
uguauauauauacaucuaua

SEQ ID NO: 837635 - RNA, 24 nt, Human
uguguauauauauacaucuauaua

SEQ ID NO: 837636 - RNA, 22 nt, Human
uuaugaauaaaauggaaagcuu

SEQ ID NO: 837637 - RNA, 18 nt, Human
uucaugcugcaaacccaa

SEQ ID NO: 837638 - RNA, 19 nt, Human
uuccucaugcaaaacuuua

SEQ ID NO: 837639 - RNA, 24 nt, Human
uugcucacauaaauuugacucuau

SEQ ID NO: 837640 - RNA, 20 nt, Human
uuuaaacuugacauauaaca

SEQ ID NO: 837641 - RNA, 25 nt, Human
uuuaaacuugacauauaacagaggc

SEQ ID NO: 837642 - RNA, 24 nt, Human
aaaaacaaaaaccaagaaaccaag

SEQ ID NO: 837643 - RNA, 23 nt, Human
aaaacaaaaaccaagaaaccaaa

SEQ ID NO: 837644 - RNA, 23 nt, Human
aaaaggaagcaaaucaaauacaa

SEQ ID NO: 837645 - RNA, 20 nt, Human
aaacaaaaaccaagaaacca

SEQ ID NO: 837646 - RNA, 26 nt, Human
aaacaaaaaccaagaaaccaaaagga

SEQ ID NO: 837647 - RNA, 22 nt, Human
aaaccaaaaggaagcaaaucaa

SEQ ID NO: 837648 - RNA, 21 nt, Human
aaagggaaaccccuccucaaa

SEQ ID NO: 837649 - RNA, 23 nt, Human
aagaaaccaaaaggaagcaaauc

SEQ ID NO: 837650 - RNA, 25 nt, Human
aagaaaccaaaaggaagcaguggga

SEQ ID NO: 837651 - RNA, 25 nt, Human
aagcaaaaacaaaaaccaagaaacc

SEQ ID NO: 837652 - RNA, 26 nt, Human
aagcaaaaacaaaaaccaagaaacca

SEQ ID NO: 837653 - RNA, 30 nt, Human
aagcaaaaacaaaaaccaagaaaccaaaag

SEQ ID NO: 837654 - RNA, 18 nt, Human
aaguugaacauaggguca

SEQ ID NO: 837655 - RNA, 23 nt, Human
aaucaagcaaaaacaaaaaccaa

SEQ ID NO: 837656 - RNA, 24 nt, Human
aaucaagcaaaaacaaaaaccaag

SEQ ID NO: 837657 - RNA, 23 nt, Human
acaaaaucaagcaaaaacaaaaa

SEQ ID NO: 837658 - RNA, 20 nt, Human
accaaaaggaagcaaaucaa

SEQ ID NO: 837659 - RNA, 21 nt, Human
accuccgguccuuuggcccug

SEQ ID NO: 837660 - RNA, 24 nt, Human
acggcuuggggcccgggcccgcag

SEQ ID NO: 837661 - RNA, 24 nt, Human
acuaaacuguagagaaaagacaaa

SEQ ID NO: 837662 - RNA, 18 nt, Human
agaaaagacaaaaucaag

SEQ ID NO: 837663 - RNA, 18 nt, Human
agcaaaaacaaaaaccaa

SEQ ID NO: 837664 - RNA, 22 nt, Human
agcacuaguaauuuguaacacu

SEQ ID NO: 837665 - RNA, 23 nt, Human
aggcgggggcgcagcggccucgg

SEQ ID NO: 837666 - RNA, 20 nt, Human
agugggcuucauagaaauuc

SEQ ID NO: 837667 - RNA, 27 nt, Human
caaaacuaaacuguagagaaaagacaa

SEQ ID NO: 837668 - RNA, 22 nt, Human
caaagggaaaccccuccucaau

SEQ ID NO: 837669 - RNA, 20 nt, Human
caagcaaaaacaaaaaccaa

SEQ ID NO: 837670 - RNA, 23 nt, Human
caaggcaucccugcggcggcccc

SEQ ID NO: 837671 - RNA, 26 nt, Human
cagccuccccuccggccgagcccucc

SEQ ID NO: 837672 - RNA, 20 nt, Human
cagcggccucggcugggccc

SEQ ID NO: 837673 - RNA, 20 nt, Human
caucgcugagucuccaaguc

SEQ ID NO: 837674 - RNA, 26 nt, Human
ccaagaaaccaaaaggaagcaaauca

SEQ ID NO: 837675 - RNA, 20 nt, Human
ccaggcacgugucugcgggg

SEQ ID NO: 837676 - RNA, 20 nt, Human
cccgccgcgccggggcccgc

SEQ ID NO: 837677 - RNA, 21 nt, Human
cccgccgcgccggggcccgcg

SEQ ID NO: 837678 - RNA, 22 nt, Human
cccuccggccgagcccuccccg

SEQ ID NO: 837679 - RNA, 25 nt, Human
cccuccggccgagcccuccccgccg

SEQ ID NO: 837680 - RNA, 20 nt, Human
cccuggccugacaucgcuga

SEQ ID NO: 837681 - RNA, 22 nt, Human
ccgcccgggaugggggucccug

SEQ ID NO: 837682 - RNA, 25 nt, Human
ccggccgcgcgccgcagccuccccu

SEQ ID NO: 837683 - RNA, 18 nt, Human
ccucggcugggcccgggc

SEQ ID NO: 837684 - RNA, 18 nt, Human
ccugcggcggccccaggg

SEQ ID NO: 837685 - RNA, 24 nt, Human
cgccgcagccuccccuccggccga

SEQ ID NO: 837686 - RNA, 21 nt, Human
cgccgcgccggggcccgcgcc

SEQ ID NO: 837687 - RNA, 20 nt, Human
cgggaugggggucccugggc

SEQ ID NO: 837688 - RNA, 21 nt, Human
cuccagaagcccucggagucc

SEQ ID NO: 837689 - RNA, 19 nt, Human
cuccggccgagcccucccc

SEQ ID NO: 837690 - RNA, 22 nt, Human
cugaggcccaaagggaaacccc

SEQ ID NO: 837691 - RNA, 21 nt, Human
gaaaagacaaaaucaagcaaa

SEQ ID NO: 837692 - RNA, 19 nt, Human
gagcggcacggcuuggggc

SEQ ID NO: 837693 - RNA, 24 nt, Human
gaggcgggggcgcagcggccucgg

SEQ ID NO: 837694 - RNA, 20 nt, Human
gcagccuccccuccggccga

SEQ ID NO: 837695 - RNA, 21 nt, Human
gcccgggcgagcggagcggca

SEQ ID NO: 837696 - RNA, 23 nt, Human
gcggcggccccagggcggcggca

SEQ ID NO: 837697 - RNA, 21 nt, Human
ggcaaaaagcauuuaaaauau

SEQ ID NO: 837698 - RNA, 24 nt, Human
ggcaagugagugggcuucauagaa

SEQ ID NO: 837699 - RNA, 20 nt, Human
ggccaguguggccauggccc

SEQ ID NO: 837700 - RNA, 20 nt, Human
ggccgagcccuccccgccgc

SEQ ID NO: 837701 - RNA, 19 nt, Human
gggcccgggcccgcagcga

SEQ ID NO: 837702 - RNA, 20 nt, Human
guccggagcgccgcccggga

SEQ ID NO: 837703 - RNA, 22 nt, Human
uaaaugacacaaaguugaacau

SEQ ID NO: 837704 - RNA, 24 nt, Human
uaagguaaaugacacaaaguugaa

SEQ ID NO: 837705 - RNA, 25 nt, Human
uaagguaaaugacacaaaguugaac

SEQ ID NO: 837706 - RNA, 23 nt, Human
uagcacuaguaauuuguaacacu

SEQ ID NO: 837707 - RNA, 18 nt, Human
ucaagcaaaaacaaaaac

SEQ ID NO: 837708 - RNA, 18 nt, Human
ucaauaaacucuuuuauu

SEQ ID NO: 837709 - RNA, 18 nt, Human
uccccgaaguucagggag

SEQ ID NO: 837710 - RNA, 23 nt, Human
ucccugggcaggguugccaaccc

SEQ ID NO: 837711 - RNA, 24 nt, Human
ugacaaaacuaaacuguagagaaa

SEQ ID NO: 837712 - RNA, 22 nt, Human
ugacacaaaguugaacauaggg

SEQ ID NO: 837713 - RNA, 18 nt, Human
ugagaacagucucaaauc

SEQ ID NO: 837714 - RNA, 21 nt, Human
ugagugggcuucauagaaauu

SEQ ID NO: 837715 - RNA, 21 nt, Human
uguugggcaaaaagcauuuaa

SEQ ID NO: 837716 - RNA, 21 nt, Human
uugagaacagucucaaauccu

SEQ ID NO: 837717 - RNA, 25 nt, Human
aaaccgucacagaagcagaaggaag

SEQ ID NO: 837718 - RNA, 18 nt, Human
aaagaauugaagggaugg

SEQ ID NO: 837719 - RNA, 18 nt, Human
aagacccucucccugccc

SEQ ID NO: 837720 - RNA, 23 nt, Human
acaaauaaugggagagggugugc

SEQ ID NO: 837721 - RNA, 20 nt, Human
acacgaguauugcuucccuu

SEQ ID NO: 837722 - RNA, 26 nt, Human
acagaagcagaaggaagaggaagucg

SEQ ID NO: 837723 - RNA, 23 nt, Human
acccugagugacggggugagaga

SEQ ID NO: 837724 - RNA, 19 nt, Human
agaagcaggcacugccuac

SEQ ID NO: 837725 - RNA, 24 nt, Human
agaggaagugguggauugcccagc

SEQ ID NO: 837726 - RNA, 22 nt, Human
agccaaauccccugcaccugau

SEQ ID NO: 837727 - RNA, 24 nt, Human
agcugggaggucuaggcugcagug

SEQ ID NO: 837728 - RNA, 23 nt, Human
aggcaggagaauugcuccagcug

SEQ ID NO: 837729 - RNA, 21 nt, Human
aggcauuuucugggccuggcu

SEQ ID NO: 837730 - RNA, 18 nt, Human
aggcugaggcaggagaau

SEQ ID NO: 837731 - RNA, 21 nt, Human
aggcugaggcaggagaauugc

SEQ ID NO: 837732 - RNA, 24 nt, Human
agggaaugaaagaauugaagggau

SEQ ID NO: 837733 - RNA, 19 nt, Human
agggugugcuugucagcau

SEQ ID NO: 837734 - RNA, 23 nt, Human
augggaauggccuucaaagcuug

SEQ ID NO: 837735 - RNA, 22 nt, Human
caaacaggugaggccuggcucu

SEQ ID NO: 837736 - RNA, 19 nt, Human
caacuguagucccagcuac

SEQ ID NO: 837737 - RNA, 24 nt, Human
caacuguagucccagcuacucaga

SEQ ID NO: 837738 - RNA, 20 nt, Human
caaugagucgugauugcgcc

SEQ ID NO: 837739 - RNA, 20 nt, Human
cacagcagcaacaaagguga

SEQ ID NO: 837740 - RNA, 21 nt, Human
cacccugagugacggggugag

SEQ ID NO: 837741 - RNA, 20 nt, Human
cacgccuucagccaaauccc

SEQ ID NO: 837742 - RNA, 21 nt, Human
cacuucagaaggucaugugcc

SEQ ID NO: 837743 - RNA, 25 nt, Human
cacuucagaaggucaugugccuggg

SEQ ID NO: 837744 - RNA, 19 nt, Human
cagaauccucagagcuggc

SEQ ID NO: 837745 - RNA, 18 nt, Human
cagcaacaaaggugacug

SEQ ID NO: 837746 - RNA, 24 nt, Human
cagcaacaaaggugacugaucagg

SEQ ID NO: 837747 - RNA, 24 nt, Human
cagcuacucagaaggcugaggcag

SEQ ID NO: 837748 - RNA, 26 nt, Human
cagcuagugggaucacuaacgcuuug

SEQ ID NO: 837749 - RNA, 19 nt, Human
caggagaucuguagugcac

SEQ ID NO: 837750 - RNA, 24 nt, Human
caggauggccacuuuucacaucuu

SEQ ID NO: 837751 - RNA, 21 nt, Human
caggugaggccuggcucuguc

SEQ ID NO: 837752 - RNA, 26 nt, Human
ccaaauccccugcaccugauggagca

SEQ ID NO: 837753 - RNA, 21 nt, Human
ccacaaggagggggcaacuca

SEQ ID NO: 837754 - RNA, 18 nt, Human
cccaggaaauaugcacgc

SEQ ID NO: 837755 - RNA, 18 nt, Human
ccccaagacccucucccu

SEQ ID NO: 837756 - RNA, 20 nt, Human
cccugcccgcccagcuccuc

SEQ ID NO: 837757 - RNA, 19 nt, Human
ccgcgccgccgcgccgccc

SEQ ID NO: 837758 - RNA, 21 nt, Human
ccgcgccgccgcgccgccccc

SEQ ID NO: 837759 - RNA, 27 nt, Human
ccucagacccugagccuggaaugcggg

SEQ ID NO: 837760 - RNA, 23 nt, Human
ccucccauuucagaggcucagga

SEQ ID NO: 837761 - RNA, 26 nt, Human
ccugcaccugauggagcagaagcagg

SEQ ID NO: 837762 - RNA, 22 nt, Human
cucccgcgccgccgcgccgccc

SEQ ID NO: 837763 - RNA, 20 nt, Human
cugggaggucuaggcugcag

SEQ ID NO: 837764 - RNA, 19 nt, Human
cugucuacacagcagcaac

SEQ ID NO: 837765 - RNA, 23 nt, Human
cugucuacacagcagcaacaaag

SEQ ID NO: 837766 - RNA, 24 nt, Human
cuuuagaaccaacuguagucccag

SEQ ID NO: 837767 - RNA, 19 nt, Human
gaaagaauugaagggaugg

SEQ ID NO: 837768 - RNA, 23 nt, Human
gaaauaugcacgccuucagccaa

SEQ ID NO: 837769 - RNA, 26 nt, Human
gaggcaggagaauugcuccagcuggg

SEQ ID NO: 837770 - RNA, 18 nt, Human
gaguauugcuucccuuuc

SEQ ID NO: 837771 - RNA, 23 nt, Human
gauucugugagcugacccggcuu

SEQ ID NO: 837772 - RNA, 19 nt, Human
gcagaucuucauccuccca

SEQ ID NO: 837773 - RNA, 24 nt, Human
gccacccugagugacggggugaga

SEQ ID NO: 837774 - RNA, 21 nt, Human
gcccagcuggagccuggggac

SEQ ID NO: 837775 - RNA, 28 nt, Human
ggaaauaugcacgccuucagccaaaucc

SEQ ID NO: 837776 - RNA, 22 nt, Human
gugaggccuggcucugucuaca

SEQ ID NO: 837777 - RNA, 27 nt, Human
uaaaaggcacaccuugaaccggggccc

SEQ ID NO: 837778 - RNA, 23 nt, Human
uaaacccacaaggagggggcaac

SEQ ID NO: 837779 - RNA, 25 nt, Human
uaagcaagaaaaugugauucuguga

SEQ ID NO: 837780 - RNA, 21 nt, Human
uagaucucugcggucauaggg

SEQ ID NO: 837781 - RNA, 18 nt, Human
uaggcugcagugagccaa

SEQ ID NO: 837782 - RNA, 24 nt, Human
ucagaaggucaugugccuggggca

SEQ ID NO: 837783 - RNA, 24 nt, Human
ucagacccugagccuggaaugcgg

SEQ ID NO: 837784 - RNA, 26 nt, Human
ucaguuuauucaccauacuuccccca

SEQ ID NO: 837785 - RNA, 23 nt, Human
uccauggcaucuuggccuaaaca

SEQ ID NO: 837786 - RNA, 22 nt, Human
ucccagccagaauccucagagc

SEQ ID NO: 837787 - RNA, 19 nt, Human
uccccaagacccucucccu

SEQ ID NO: 837788 - RNA, 23 nt, Human
uccccaagacccucucccugccc

SEQ ID NO: 837789 - RNA, 25 nt, Human
uccccaagacccucucccugcccgc

SEQ ID NO: 837790 - RNA, 22 nt, Human
ucccccaggaacccucucacug

SEQ ID NO: 837791 - RNA, 19 nt, Human
uccccugcaccugauggag

SEQ ID NO: 837792 - RNA, 26 nt, Human
uccccugcaccugauggagcagaagc

SEQ ID NO: 837793 - RNA, 23 nt, Human
ucuaugcucacaguguguuucag

SEQ ID NO: 837794 - RNA, 20 nt, Human
ucugugagcugacccggcuu

SEQ ID NO: 837795 - RNA, 18 nt, Human
ugacggggugagagauca

SEQ ID NO: 837796 - RNA, 19 nt, Human
ugacuucuggaaagagccc

SEQ ID NO: 837797 - RNA, 20 nt, Human
ugaggcaggagaauugcucc

SEQ ID NO: 837798 - RNA, 22 nt, Human
ugaggcaggagaauugcuccag

SEQ ID NO: 837799 - RNA, 27 nt, Human
ugaggcaggagaauugcuccagcucca

SEQ ID NO: 837800 - RNA, 19 nt, Human
ugagucgugauugcgccac

SEQ ID NO: 837801 - RNA, 22 nt, Human
ugcccagcuggagccuggggac

SEQ ID NO: 837802 - RNA, 22 nt, Human
ugcuaugauggguugaaaagag

SEQ ID NO: 837803 - RNA, 18 nt, Human
uggaaagagcccaacauc

SEQ ID NO: 837804 - RNA, 24 nt, Human
uggaaagagcccaacaucaucugg

SEQ ID NO: 837805 - RNA, 26 nt, Human
uggaaagagcccaacaucaucugguu

SEQ ID NO: 837806 - RNA, 22 nt, Human
uggaaugcgggggaacacaaug

SEQ ID NO: 837807 - RNA, 27 nt, Human
uggccuaaacaaacaggugaggccugg

SEQ ID NO: 837808 - RNA, 19 nt, Human
ugucacagcuagugggauc

SEQ ID NO: 837809 - RNA, 18 nt, Human
uucacaucagcucugucu

SEQ ID NO: 837810 - RNA, 22 nt, Human
uuuauucaccauacuuccccca

SEQ ID NO: 837811 - RNA, 18 nt, Human
uuuucugggccuggcugu

SEQ ID NO: 837812 - RNA, 27 nt, Human
uuuuuuuuuuuuuuuuuuuuuuugggg

SEQ ID NO: 837813 - RNA, 21 nt, Human
aaaaacguggaucauccacag

SEQ ID NO: 837814 - RNA, 22 nt, Human
aaaaacguggaucauccacagc

SEQ ID NO: 837815 - RNA, 22 nt, Human
aaaaggcggcggguucugugaa

SEQ ID NO: 837816 - RNA, 25 nt, Human
aaagauccucuuagggagaucucuc

SEQ ID NO: 837817 - RNA, 18 nt, Human
aacacaacuuccuaacac

SEQ ID NO: 837818 - RNA, 19 nt, Human
aacaccccuuuuuuuuccu

SEQ ID NO: 837819 - RNA, 20 nt, Human
aaucugguuuuccccguuac

SEQ ID NO: 837820 - RNA, 23 nt, Human
acaugggauauaggucaccccuc

SEQ ID NO: 837821 - RNA, 24 nt, Human
acauuuaacauuaaaaaaacaaaa

SEQ ID NO: 837822 - RNA, 22 nt, Human
accccuuuuuuuuccuugguaa

SEQ ID NO: 837823 - RNA, 24 nt, Human
acggcucuuuuugcuauguuuucu

SEQ ID NO: 837824 - RNA, 22 nt, Human
agaaaacuauaaauagugaacc

SEQ ID NO: 837825 - RNA, 20 nt, Human
agaaaugccacucuuucucc

SEQ ID NO: 837826 - RNA, 23 nt, Human
agaaaugucuaccccugcaagag

SEQ ID NO: 837827 - RNA, 22 nt, Human
agacaaaaccugaaacagaaga

SEQ ID NO: 837828 - RNA, 22 nt, Human
aggcagaagggagugugucuga

SEQ ID NO: 837829 - RNA, 20 nt, Human
agggucucucugaaagccuu

SEQ ID NO: 837830 - RNA, 22 nt, Human
auacacaucuaaacacacaagg

SEQ ID NO: 837831 - RNA, 26 nt, Human
caaaaccugaaacagaagaaaugcca

SEQ ID NO: 837832 - RNA, 27 nt, Human
caaaaccugaaacagaagaaaugccac

SEQ ID NO: 837833 - RNA, 25 nt, Human
caaacacaacuuccuaacacuccua

SEQ ID NO: 837834 - RNA, 19 nt, Human
caacuuagaaugcaaagua

SEQ ID NO: 837835 - RNA, 25 nt, Human
cacaacucaggccuaaagauccucu

SEQ ID NO: 837836 - RNA, 21 nt, Human
cacugcugcuuuccguaacaa

SEQ ID NO: 837837 - RNA, 21 nt, Human
ccccugcaagagugaggacuu

SEQ ID NO: 837838 - RNA, 20 nt, Human
cccgcuguacuccagaguga

SEQ ID NO: 837839 - RNA, 21 nt, Human
cgagggucccggcggcucccg

SEQ ID NO: 837840 - RNA, 24 nt, Human
cuaaagauccucuuagggagaucu

SEQ ID NO: 837841 - RNA, 19 nt, Human
cuacccaaaaaggcggcgg

SEQ ID NO: 837842 - RNA, 23 nt, Human
cuagagaacaaaccaaaccagaa

SEQ ID NO: 837843 - RNA, 25 nt, Human
cucccgcuguacuccagagugacac

SEQ ID NO: 837844 - RNA, 21 nt, Human
cugggcggcggcggcggcgac

SEQ ID NO: 837845 - RNA, 18 nt, Human
gaaaugucuaccccugca

SEQ ID NO: 837846 - RNA, 27 nt, Human
gcggcggcgacgacgcgagggucccuu

SEQ ID NO: 837847 - RNA, 20 nt, Human
gcggcggcugcugcggcggc

SEQ ID NO: 837848 - RNA, 28 nt, Human
gcggggguggggggagcaggugacagga

SEQ ID NO: 837849 - RNA, 22 nt, Human
ggaaggcagaagggaguguguc

SEQ ID NO: 837850 - RNA, 18 nt, Human
ggcggcggcggcggcgac

SEQ ID NO: 837851 - RNA, 18 nt, Human
ggcggcggcugcugcggc

SEQ ID NO: 837852 - RNA, 20 nt, Human
gggcggcggcggcggcgacg

SEQ ID NO: 837853 - RNA, 19 nt, Human
gggcggcggcugcugcggc

SEQ ID NO: 837854 - RNA, 23 nt, Human
ggggaucugggcggcggcggcgg

SEQ ID NO: 837855 - RNA, 23 nt, Human
gggggcggcggcugcugcggcgg

SEQ ID NO: 837856 - RNA, 20 nt, Human
gguucugugaaccugaagag

SEQ ID NO: 837857 - RNA, 24 nt, Human
guaauacugaguuacacauuuaac

SEQ ID NO: 837858 - RNA, 21 nt, Human
guagaaaacuucuacccaaaa

SEQ ID NO: 837859 - RNA, 24 nt, Human
uaacaccccuuuuuuuuccuuggu

SEQ ID NO: 837860 - RNA, 20 nt, Human
uaagaaacucgaucaaaauu

SEQ ID NO: 837861 - RNA, 23 nt, Human
uacacugcugcuuuccguaacaa

SEQ ID NO: 837862 - RNA, 21 nt, Human
uacuauuuuguguuucucccg

SEQ ID NO: 837863 - RNA, 21 nt, Human
uagagggcccagaugcaaaga

SEQ ID NO: 837864 - RNA, 22 nt, Human
uaucuagagaacaaaccaaacc

SEQ ID NO: 837865 - RNA, 20 nt, Human
uauuucauacacaucuaaac

SEQ ID NO: 837866 - RNA, 22 nt, Human
uccccguuacaguaaacagcuu

SEQ ID NO: 837867 - RNA, 19 nt, Human
ucuaaacacacaaggguaa

SEQ ID NO: 837868 - RNA, 18 nt, Human
ucuacccaaaaaggcggc

SEQ ID NO: 837869 - RNA, 19 nt, Human
ucuagagaacaaaccaaac

SEQ ID NO: 837870 - RNA, 22 nt, Human
ucuagagaacaaaccaaaccag

SEQ ID NO: 837871 - RNA, 20 nt, Human
ucucacacagcccguuuacc

SEQ ID NO: 837872 - RNA, 24 nt, Human
ucugaccuaagagugauaacuacu

SEQ ID NO: 837873 - RNA, 23 nt, Human
ugaaaacaagcuagccuacauua

SEQ ID NO: 837874 - RNA, 18 nt, Human
ugaaacacaaacacaacu

SEQ ID NO: 837875 - RNA, 28 nt, Human
ugaaacacaaacacaacuuccuaacacu

SEQ ID NO: 837876 - RNA, 19 nt, Human
ugaacucagacaaaaccug

SEQ ID NO: 837877 - RNA, 22 nt, Human
ugacacugguacacugcugcuu

SEQ ID NO: 837878 - RNA, 22 nt, Human
ugacaggaacuccuuuaacaau

SEQ ID NO: 837879 - RNA, 20 nt, Human
ugacaugcacuugguguggg

SEQ ID NO: 837880 - RNA, 19 nt, Human
ugaccugcuacacauaggg

SEQ ID NO: 837881 - RNA, 23 nt, Human
ugaucgaucucaguugguaacac

SEQ ID NO: 837882 - RNA, 21 nt, Human
ugcuggaauuacaaguuccua

SEQ ID NO: 837883 - RNA, 23 nt, Human
uggaucauccacagcuuuaagcc

SEQ ID NO: 837884 - RNA, 20 nt, Human
uggggggagcaggugacagg

SEQ ID NO: 837885 - RNA, 20 nt, Human
ugguacacugcugcuuuccg

SEQ ID NO: 837886 - RNA, 23 nt, Human
ugguacacugcugcuuuccguaa

SEQ ID NO: 837887 - RNA, 22 nt, Human
uuaaaaaaacaaaaacguggau

SEQ ID NO: 837888 - RNA, 25 nt, Human
uuaacauuaaaaaaacaaaaacgug

SEQ ID NO: 837889 - RNA, 18 nt, Human
uucugugaaccugaagag

SEQ ID NO: 837890 - RNA, 25 nt, Human
uuuaaaauuugaaaacaagcuagcc

SEQ ID NO: 837891 - RNA, 21 nt, Human
uuuaaauuacugcuggaauua

SEQ ID NO: 837892 - RNA, 21 nt, Human
uuuuuaaacuuuuaaaauuug

SEQ ID NO: 837893 - RNA, 22 nt, Human
uuuuuuuuuuuuuuuuugacag

SEQ ID NO: 837894 - RNA, 24 nt, Human
aacaacaacaacaaagauauucac

SEQ ID NO: 837895 - RNA, 22 nt, Human
aacauggucacaugugacaugc

SEQ ID NO: 837896 - RNA, 24 nt, Human
aacauggucacaugugacaugcua

SEQ ID NO: 837897 - RNA, 19 nt, Human
aacauggugaaaccccguc

SEQ ID NO: 837898 - RNA, 20 nt, Human
aacauggugaaaccccgucu

SEQ ID NO: 837899 - RNA, 21 nt, Human
aacauggugaaaccccgucuc

SEQ ID NO: 837900 - RNA, 26 nt, Human
aagcagguggaucacuugaggucagg

SEQ ID NO: 837901 - RNA, 24 nt, Human
aauuacaccuuuaggagacuuuaa

SEQ ID NO: 837902 - RNA, 22 nt, Human
acagagcgagacucugucucaa

SEQ ID NO: 837903 - RNA, 21 nt, Human
acccgcgccgcccgagcuccg

SEQ ID NO: 837904 - RNA, 24 nt, Human
accgaaauucaaaguaauccuccg

SEQ ID NO: 837905 - RNA, 23 nt, Human
accuccgcucaggaucuucauca

SEQ ID NO: 837906 - RNA, 18 nt, Human
acgccacugcacuccagc

SEQ ID NO: 837907 - RNA, 22 nt, Human
acgccacugcacuccagccugg

SEQ ID NO: 837908 - RNA, 24 nt, Human
acugcacuccagccugggugacag

SEQ ID NO: 837909 - RNA, 26 nt, Human
acugcacuccagccugggugacagag

SEQ ID NO: 837910 - RNA, 18 nt, Human
acuguucuaccuucaugc

SEQ ID NO: 837911 - RNA, 19 nt, Human
agaccacaggcgaccaccg

SEQ ID NO: 837912 - RNA, 22 nt, Human
agccuggccaacauggugaaac

SEQ ID NO: 837913 - RNA, 24 nt, Human
agccuggccaacauggugaaaccc

SEQ ID NO: 837914 - RNA, 24 nt, Human
agccugggugacagagcgagacuc

SEQ ID NO: 837915 - RNA, 23 nt, Human
agcugggcgugguggcacaugcc

SEQ ID NO: 837916 - RNA, 23 nt, Human
aggaguucgaaacuagccuggcc

SEQ ID NO: 837917 - RNA, 18 nt, Human
aggcacagaaacgacaaa

SEQ ID NO: 837918 - RNA, 22 nt, Human
aggcaggagaauagcuuaaacc

SEQ ID NO: 837919 - RNA, 24 nt, Human
aggcaggagaauagcuuaaaccug

SEQ ID NO: 837920 - RNA, 19 nt, Human
aggcggaggaugcagugag

SEQ ID NO: 837921 - RNA, 24 nt, Human
aggcggaggaugcagugagccaag

SEQ ID NO: 837922 - RNA, 20 nt, Human
aguaccaaacaagcugauac

SEQ ID NO: 837923 - RNA, 24 nt, Human
agugucucacgccuguaaucccag

SEQ ID NO: 837924 - RNA, 24 nt, Human
aucacgccacugcacuccagccug

SEQ ID NO: 837925 - RNA, 21 nt, Human
aucacuugaggucaggaguuc

SEQ ID NO: 837926 - RNA, 20 nt, Human
augacacauagcagaaaucu

SEQ ID NO: 837927 - RNA, 26 nt, Human
caacaacaacaacaaagauauucaca

SEQ ID NO: 837928 - RNA, 24 nt, Human
caacauggugaaaccccgucucua

SEQ ID NO: 837929 - RNA, 24 nt, Human
caagaucacgccacugcacuccag

SEQ ID NO: 837930 - RNA, 20 nt, Human
caaucgugaaaauguuacuc

SEQ ID NO: 837931 - RNA, 22 nt, Human
cacagaaucaauauaauucuga

SEQ ID NO: 837932 - RNA, 25 nt, Human
cacagauagugaaagaacuugugua

SEQ ID NO: 837933 - RNA, 23 nt, Human
cacgccuguaaucccagcacuuu

SEQ ID NO: 837934 - RNA, 22 nt, Human
cacuccagccugggugacagag

SEQ ID NO: 837935 - RNA, 23 nt, Human
cacuccagccugggugacagagc

SEQ ID NO: 837936 - RNA, 24 nt, Human
cacuccagccugggugacagagcg

SEQ ID NO: 837937 - RNA, 19 nt, Human
cacugcacuccagccuggg

SEQ ID NO: 837938 - RNA, 19 nt, Human
cacugcacuccagccuggg

SEQ ID NO: 837939 - RNA, 22 nt, Human
cacugcacuccagccuggguga

SEQ ID NO: 837940 - RNA, 23 nt, Human
cacugcacuccagccugggugac

SEQ ID NO: 837941 - RNA, 24 nt, Human
cacugcacuccagccugggugaca

SEQ ID NO: 837942 - RNA, 24 nt, Human
cacugcacuccagccugggugaca

SEQ ID NO: 837943 - RNA, 19 nt, Human
cagaggccgaagcaggugg

SEQ ID NO: 837944 - RNA, 24 nt, Human
cagguggaucacuugaggucagga

SEQ ID NO: 837945 - RNA, 21 nt, Human
cauugcaaacuuaaccaaucu

SEQ ID NO: 837946 - RNA, 20 nt, Human
ccacugcacuccagccuggg

SEQ ID NO: 837947 - RNA, 20 nt, Human
ccacugcacuccagccuggg

SEQ ID NO: 837948 - RNA, 20 nt, Human
ccacugcacuccagccuggg

SEQ ID NO: 837949 - RNA, 21 nt, Human
ccacugcacuccagccugggu

SEQ ID NO: 837950 - RNA, 21 nt, Human
ccacugcacuccagccugggu

SEQ ID NO: 837951 - RNA, 23 nt, Human
ccacugcacuccagccuggguga

SEQ ID NO: 837952 - RNA, 23 nt, Human
ccacugcacuccagccuggguga

SEQ ID NO: 837953 - RNA, 24 nt, Human
ccacugcacuccagccugggugac

SEQ ID NO: 837954 - RNA, 22 nt, Human
ccagaccacaggcgaccaccga

SEQ ID NO: 837955 - RNA, 19 nt, Human
cccgcgccgcccgagcucc

SEQ ID NO: 837956 - RNA, 20 nt, Human
ccgguacuccaggugccugu

SEQ ID NO: 837957 - RNA, 23 nt, Human
ccuggccaacauggugaaacccc

SEQ ID NO: 837958 - RNA, 24 nt, Human
ccuggccaacauggugaaaccccg

SEQ ID NO: 837959 - RNA, 22 nt, Human
ccugggugacagagcgagacuc

SEQ ID NO: 837960 - RNA, 21 nt, Human
ccuguagucccagcuacucgg

SEQ ID NO: 837961 - RNA, 24 nt, Human
cgaaacuagccuggccaacauggu

SEQ ID NO: 837962 - RNA, 24 nt, Human
cgaagcagguggaucacuugaggu

SEQ ID NO: 837963 - RNA, 26 nt, Human
cgaagcagguggaucacuugagguca

SEQ ID NO: 837964 - RNA, 24 nt, Human
cucacgccuguaaucccagcacuu

SEQ ID NO: 837965 - RNA, 25 nt, Human
cucacgccuguaaucccagcacuuu

SEQ ID NO: 837966 - RNA, 21 nt, Human
cucuacucauugccauauccc

SEQ ID NO: 837967 - RNA, 20 nt, Human
cuuccuagucaauuacaccu

SEQ ID NO: 837968 - RNA, 27 nt, Human
gaaggcggaggaugcagugacaacggu

SEQ ID NO: 837969 - RNA, 22 nt, Human
gacggacacucgggggccacag

SEQ ID NO: 837970 - RNA, 19 nt, Human
gaggaugcagugagccaag

SEQ ID NO: 837971 - RNA, 24 nt, Human
gaucacuugaggucaggaguucga

SEQ ID NO: 837972 - RNA, 24 nt, Human
gcacuccagccugggugacagagc

SEQ ID NO: 837973 - RNA, 22 nt, Human
gcagcacaagguagggauugua

SEQ ID NO: 837974 - RNA, 24 nt, Human
gccaacauggugaaaccccgucuc

SEQ ID NO: 837975 - RNA, 20 nt, Human
gccaagaucacgccacugca

SEQ ID NO: 837976 - RNA, 19 nt, Human
gccacugcacuccagccug

SEQ ID NO: 837977 - RNA, 24 nt, Human
gccacugcacuccagccuggguga

SEQ ID NO: 837978 - RNA, 19 nt, Human
gccccgacgaggcgcggga

SEQ ID NO: 837979 - RNA, 24 nt, Human
gccugugguacugucuggagggac

SEQ ID NO: 837980 - RNA, 20 nt, Human
ggaggaugcagugagccaag

SEQ ID NO: 837981 - RNA, 24 nt, Human
ggaggaugcagugagccaagauca

SEQ ID NO: 837982 - RNA, 22 nt, Human
ggaucacuugaggucaggaguu

SEQ ID NO: 837983 - RNA, 20 nt, Human
ggaugaggcugggcgcagug

SEQ ID NO: 837984 - RNA, 23 nt, Human
ggcgcagugucucacgccuguaa

SEQ ID NO: 837985 - RNA, 21 nt, Human
ggcggaggaugcagugagcca

SEQ ID NO: 837986 - RNA, 21 nt, Human
gugaaaccccgucucuacuga

SEQ ID NO: 837987 - RNA, 24 nt, Human
gugacagagcgagacucugucuca

SEQ ID NO: 837988 - RNA, 21 nt, Human
uaaauaggcacagaaacgacu

SEQ ID NO: 837989 - RNA, 20 nt, Human
uaacaaucgugaaaauguua

SEQ ID NO: 837990 - RNA, 22 nt, Human
uacugagaauugcacaaaaaug

SEQ ID NO: 837991 - RNA, 24 nt, Human
uagccuggccaacauggugaaacc

SEQ ID NO: 837992 - RNA, 22 nt, Human
uagcugggcgugguggcacaug

SEQ ID NO: 837993 - RNA, 18 nt, Human
uaggcacagaaacgacaa

SEQ ID NO: 837994 - RNA, 21 nt, Human
uagugcucgugcccgcguccg

SEQ ID NO: 837995 - RNA, 24 nt, Human
uaugccagaccacaggcgaccacc

SEQ ID NO: 837996 - RNA, 23 nt, Human
ucacgccacugcacuccagccug

SEQ ID NO: 837997 - RNA, 24 nt, Human
ucagaggccgaagcagguggauca

SEQ ID NO: 837998 - RNA, 22 nt, Human
ucauugcaaacuuaaccaaucu

SEQ ID NO: 837999 - RNA, 23 nt, Human
uccagccugggugacagagcgag

SEQ ID NO: 838000 - RNA, 24 nt, Human
uccagccugggugacagagcgaga

SEQ ID NO: 838001 - RNA, 21 nt, Human
ucccuucgugguucccugaga

SEQ ID NO: 838002 - RNA, 19 nt, Human
ucgggcaacugaggcagga

SEQ ID NO: 838003 - RNA, 21 nt, Human
ucucaacaacaacaacaaaga

SEQ ID NO: 838004 - RNA, 22 nt, Human
ugacacauagcagaaaucugug

SEQ ID NO: 838005 - RNA, 18 nt, Human
ugaggcaggagaauagcu

SEQ ID NO: 838006 - RNA, 24 nt, Human
ugaggcaggagaauagcuuaaacc

SEQ ID NO: 838007 - RNA, 20 nt, Human
ugaggcaggagaauagcuuc

SEQ ID NO: 838008 - RNA, 23 nt, Human
ugccuguagucccagcuacucgg

SEQ ID NO: 838009 - RNA, 24 nt, Human
ugccuguagucccagcuacucggg

SEQ ID NO: 838010 - RNA, 21 nt, Human
ugccugugguacugucuggag

SEQ ID NO: 838011 - RNA, 20 nt, Human
ugcucgugcccgcguccgug

SEQ ID NO: 838012 - RNA, 21 nt, Human
uggaaggcggaggaugcagug

SEQ ID NO: 838013 - RNA, 24 nt, Human
uggaucacuugaggucaggaguuc

SEQ ID NO: 838014 - RNA, 27 nt, Human
uggaucacuugaggucaggaguucgaa

SEQ ID NO: 838015 - RNA, 24 nt, Human
uggccaacauggugaaaccccguc

SEQ ID NO: 838016 - RNA, 24 nt, Human
ugguggcacaugccuguaguccca

SEQ ID NO: 838017 - RNA, 21 nt, Human
ugucucacgccuguaauccca

SEQ ID NO: 838018 - RNA, 22 nt, Human
ugucucacgccuguaaucccag

SEQ ID NO: 838019 - RNA, 24 nt, Human
ugucucacgccuguaaucccagca

SEQ ID NO: 838020 - RNA, 19 nt, Human
ugucuguccccucagagca

SEQ ID NO: 838021 - RNA, 21 nt, Human
ugugacaugcuacacuugcac

SEQ ID NO: 838022 - RNA, 22 nt, Human
ugugguucaagauggucauugc

SEQ ID NO: 838023 - RNA, 22 nt, Human
uguguacaauaagaaauucaca

SEQ ID NO: 838024 - RNA, 18 nt, Human
ugugucacaagaguauau

SEQ ID NO: 838025 - RNA, 18 nt, Human
uuagcugggcgugguggc

SEQ ID NO: 838026 - RNA, 20 nt, Human
uuagcugggcgugguggcac

SEQ ID NO: 838027 - RNA, 24 nt, Human
uuagcugggcgugguggcacaugc

SEQ ID NO: 838028 - RNA, 19 nt, Human
uucuaaauaugccagacca

SEQ ID NO: 838029 - RNA, 22 nt, Human
uucuaaauaugccagaccacag

SEQ ID NO: 838030 - RNA, 23 nt, Human
aaaaagaugaaccacacagcagg

SEQ ID NO: 838031 - RNA, 18 nt, Human
aggaaccaggagcucucu

SEQ ID NO: 838032 - RNA, 22 nt, Human
aguagguggguuggugcccucu

SEQ ID NO: 838033 - RNA, 23 nt, Human
cacccaggggcagaguagguggg

SEQ ID NO: 838034 - RNA, 19 nt, Human
cacccucccccaucccacc

SEQ ID NO: 838035 - RNA, 22 nt, Human
cacccucccccaucccaccagc

SEQ ID NO: 838036 - RNA, 19 nt, Human
cagcaggggugcugggagc

SEQ ID NO: 838037 - RNA, 22 nt, Human
caggagcucucugggcagggcc

SEQ ID NO: 838038 - RNA, 23 nt, Human
caggcaggggccuaaaaaaaaga

SEQ ID NO: 838039 - RNA, 21 nt, Human
caguucaggaaccaggagcuc

SEQ ID NO: 838040 - RNA, 26 nt, Human
ccaccagccagcacccagagggacaa

SEQ ID NO: 838041 - RNA, 18 nt, Human
ccacccucccccauccca

SEQ ID NO: 838042 - RNA, 22 nt, Human
ccagcacccagagggacaaccc

SEQ ID NO: 838043 - RNA, 23 nt, Human
cccaccagccagcacccagaggg

SEQ ID NO: 838044 - RNA, 27 nt, Human
cccaccagccagcacccagagggacaa

SEQ ID NO: 838045 - RNA, 20 nt, Human
cccaucccaccagccagcac

SEQ ID NO: 838046 - RNA, 21 nt, Human
ccuaacacgaccggcccagga

SEQ ID NO: 838047 - RNA, 22 nt, Human
ccucgcgcucaagggcucccuu

SEQ ID NO: 838048 - RNA, 21 nt, Human
cgacucccaggccgagccccc

SEQ ID NO: 838049 - RNA, 18 nt, Human
cgcaggccggggcucugg

SEQ ID NO: 838050 - RNA, 26 nt, Human
cucccccaucccaccagccagcaccc

SEQ ID NO: 838051 - RNA, 21 nt, Human
cucgggugggugaggggcaga

SEQ ID NO: 838052 - RNA, 23 nt, Human
cucuggggcgcggggaugugucu

SEQ ID NO: 838053 - RNA, 21 nt, Human
cugagcaaucuuuauucugca

SEQ ID NO: 838054 - RNA, 21 nt, Human
gagaccgaggggcggggagcc

SEQ ID NO: 838055 - RNA, 20 nt, Human
gcagagggacaaugaccaca

SEQ ID NO: 838056 - RNA, 20 nt, Human
gcagcucaguucaggaacca

SEQ ID NO: 838057 - RNA, 20 nt, Human
gcggugggcagagccucggg

SEQ ID NO: 838058 - RNA, 18 nt, Human
gcuccccacccuccccca

SEQ ID NO: 838059 - RNA, 23 nt, Human
gcucuggggcgcggggauguguc

SEQ ID NO: 838060 - RNA, 19 nt, Human
gggugaggggcagaugggc

SEQ ID NO: 838061 - RNA, 20 nt, Human
gugggcagagccucgggugg

SEQ ID NO: 838062 - RNA, 22 nt, Human
guucaggaaccaggagcucucu

SEQ ID NO: 838063 - RNA, 22 nt, Human
uccauacaccacguggagaccg

SEQ ID NO: 838064 - RNA, 23 nt, Human
ucccaccagccagcacccagagg

SEQ ID NO: 838065 - RNA, 19 nt, Human
uccccacccucccccaucc

SEQ ID NO: 838066 - RNA, 20 nt, Human
uccccacccucccccauccc

SEQ ID NO: 838067 - RNA, 23 nt, Human
ucucugggcagggccugaccggg

SEQ ID NO: 838068 - RNA, 18 nt, Human
ugaaccacacagcagggg

SEQ ID NO: 838069 - RNA, 18 nt, Human
ugcuccccacccuccccc

SEQ ID NO: 838070 - RNA, 23 nt, Human
ugcuccccacccucccccauccc

SEQ ID NO: 838071 - RNA, 20 nt, Human
ugcugggagcugcuccccac

SEQ ID NO: 838072 - RNA, 21 nt, Human
uucaggaaccaggagcucucu

SEQ ID NO: 838073 - RNA, 19 nt, Human
uuuuuuuuuuuuuugccag

SEQ ID NO: 838074 - RNA, 22 nt, Human
uuuuuuuuuuuuuuuugccagg

SEQ ID NO: 838075 - RNA, 22 nt, Human
uuuuuuuuuuuuuuuuugccag

SEQ ID NO: 838076 - RNA, 27 nt, Human
uuuuuuuuuuuuuuuuuuuuuuugggg

SEQ ID NO: 838077 - RNA, 27 nt, Human
aaagaaauaaaacauaaucugaagaaa

SEQ ID NO: 838078 - RNA, 27 nt, Human
aagaaauaaaacauaaucugaagaaaa

SEQ ID NO: 838079 - RNA, 24 nt, Human
aagcacuuucuaagccgccgucgc

SEQ ID NO: 838080 - RNA, 18 nt, Human
acagaauaacgaauugua

SEQ ID NO: 838081 - RNA, 19 nt, Human
acgccugggguuucugggc

SEQ ID NO: 838082 - RNA, 26 nt, Human
agaaauaaaacauaaucugaagaaaa

SEQ ID NO: 838083 - RNA, 22 nt, Human
agaacacacaaacauuaaaaca

SEQ ID NO: 838084 - RNA, 19 nt, Human
aguuugauucugauccacu

SEQ ID NO: 838085 - RNA, 20 nt, Human
aguuugauucugauccacug

SEQ ID NO: 838086 - RNA, 23 nt, Human
cauacuaacauuggaaacagaau

SEQ ID NO: 838087 - RNA, 20 nt, Human
cccccuucucucgcaggauc

SEQ ID NO: 838088 - RNA, 22 nt, Human
cccuacaccagaaaauauagca

SEQ ID NO: 838089 - RNA, 19 nt, Human
ccugggguuucugggcugc

SEQ ID NO: 838090 - RNA, 25 nt, Human
cgcugucacuucagggacagcuuua

SEQ ID NO: 838091 - RNA, 19 nt, Human
cggcggccgcgccccuccc

SEQ ID NO: 838092 - RNA, 19 nt, Human
cucauccauaucuggugac

SEQ ID NO: 838093 - RNA, 19 nt, Human
cuccucaagccaccgucac

SEQ ID NO: 838094 - RNA, 19 nt, Human
cucgcaggaucaaucucca

SEQ ID NO: 838095 - RNA, 23 nt, Human
cugcaagccugggcauauuguac

SEQ ID NO: 838096 - RNA, 20 nt, Human
gaagauaagguacacacuga

SEQ ID NO: 838097 - RNA, 24 nt, Human
gcaaagaaauaaaacauaaucuga

SEQ ID NO: 838098 - RNA, 22 nt, Human
ggaagcugcgagggcgcguccg

SEQ ID NO: 838099 - RNA, 24 nt, Human
ggguuucugggcugccugguucuc

SEQ ID NO: 838100 - RNA, 24 nt, Human
uaaaaaguuggcuuuauucugcaa

SEQ ID NO: 838101 - RNA, 20 nt, Human
uaaagagcagcacccucuga

SEQ ID NO: 838102 - RNA, 21 nt, Human
uaacuccaugggagcugugau

SEQ ID NO: 838103 - RNA, 23 nt, Human
uaagaaagacccuacaccagaaa

SEQ ID NO: 838104 - RNA, 23 nt, Human
uaaguuggaaaaaggggcccuuu

SEQ ID NO: 838105 - RNA, 20 nt, Human
uaaugaagauaagguacaca

SEQ ID NO: 838106 - RNA, 23 nt, Human
uauuacuuuuaccaagccauuuu

SEQ ID NO: 838107 - RNA, 18 nt, Human
uauuguacaauuggcagc

SEQ ID NO: 838108 - RNA, 21 nt, Human
uauuguagucuaaagauugcu

SEQ ID NO: 838109 - RNA, 20 nt, Human
ucacuaaauaagaaagaccc

SEQ ID NO: 838110 - RNA, 20 nt, Human
ucccuagaucucacuaaaua

SEQ ID NO: 838111 - RNA, 21 nt, Human
ucugagaauaaucaaacugau

SEQ ID NO: 838112 - RNA, 23 nt, Human
ugaagaacacacaaacauuaaaa

SEQ ID NO: 838113 - RNA, 19 nt, Human
ugauagacugaaccauuuc

SEQ ID NO: 838114 - RNA, 24 nt, Human
ugauugguuacagaaagcagaguu

SEQ ID NO: 838115 - RNA, 23 nt, Human
uggaaaaaggggcccuuucuuga

SEQ ID NO: 838116 - RNA, 23 nt, Human
uggcuuuauucugcaagccuggg

SEQ ID NO: 838117 - RNA, 22 nt, Human
uguuauaaugaagauaagguac

SEQ ID NO: 838118 - RNA, 20 nt, Human
uuaguaauauucaucuauac

SEQ ID NO: 838119 - RNA, 19 nt, Human
uucuaagccgccgucgccc

SEQ ID NO: 838120 - RNA, 19 nt, Human
uugcuggauugauauugug

SEQ ID NO: 838121 - RNA, 22 nt, Human
aaaaaaauauacaacuuggaug

SEQ ID NO: 838122 - RNA, 22 nt, Human
aaaaacacgaaaggugaaugac

SEQ ID NO: 838123 - RNA, 22 nt, Human
aaaagaaaaaaucaacagagga

SEQ ID NO: 838124 - RNA, 23 nt, Human
aaaagaaaaaaucaacagaggau

SEQ ID NO: 838125 - RNA, 22 nt, Human
aaacaagccaaacccauaaagc

SEQ ID NO: 838126 - RNA, 23 nt, Human
aaacaagccaaacccauaaagca

SEQ ID NO: 838127 - RNA, 24 nt, Human
aaagcaaaagaaaaaaucaacaga

SEQ ID NO: 838128 - RNA, 20 nt, Human
aaauggcucgccacagagcc

SEQ ID NO: 838129 - RNA, 21 nt, Human
aacaagccaaacccauaaagc

SEQ ID NO: 838130 - RNA, 24 nt, Human
aacucauccccucuuguguacccc

SEQ ID NO: 838131 - RNA, 19 nt, Human
aagcaaaagaaaaaaucaa

SEQ ID NO: 838132 - RNA, 24 nt, Human
aagcaaaagaaaaaaucaacagag

SEQ ID NO: 838133 - RNA, 24 nt, Human
aagccaaacccauaaagcaaaaga

SEQ ID NO: 838134 - RNA, 26 nt, Human
aauggcucgccacagagccagguggg

SEQ ID NO: 838135 - RNA, 19 nt, Human
accaugcaagaaaaacaag

SEQ ID NO: 838136 - RNA, 20 nt, Human
acccauaaagcaaaagaaaa

SEQ ID NO: 838137 - RNA, 21 nt, Human
accccgcaccaaagccgggau

SEQ ID NO: 838138 - RNA, 22 nt, Human
acugcggcgaggacugcggcgg

SEQ ID NO: 838139 - RNA, 24 nt, Human
acugguggggccgacaagggccug

SEQ ID NO: 838140 - RNA, 20 nt, Human
agagguguggccacccuggg

SEQ ID NO: 838141 - RNA, 23 nt, Human
agcaaaagaaaaaaucaacagag

SEQ ID NO: 838142 - RNA, 19 nt, Human
agcagcauccacagggggc

SEQ ID NO: 838143 - RNA, 19 nt, Human
agcagggagaggcacuggu

SEQ ID NO: 838144 - RNA, 19 nt, Human
agccaggugggagcagccc

SEQ ID NO: 838145 - RNA, 23 nt, Human
agcggcggcggcggcggcggcgg

SEQ ID NO: 838146 - RNA, 27 nt, Human
aggagcagcagggagaggccgguaccc

SEQ ID NO: 838147 - RNA, 23 nt, Human
aggagcagcggcggcggcggcgg

SEQ ID NO: 838148 - RNA, 22 nt, Human
agggagaggcacugguggggcc

SEQ ID NO: 838149 - RNA, 21 nt, Human
agguguggccacccugggcca

SEQ ID NO: 838150 - RNA, 20 nt, Human
auaaagcaaaagaaaaaauc

SEQ ID NO: 838151 - RNA, 26 nt, Human
auaaagcaaaagaaaaaaucaacaga

SEQ ID NO: 838152 - RNA, 27 nt, Human
auaaagcaaaagaaaaaaucaacagag

SEQ ID NO: 838153 - RNA, 18 nt, Human
aucagcuccaaaccaugc

SEQ ID NO: 838154 - RNA, 21 nt, Human
auccguagauccuucuuccuc

SEQ ID NO: 838155 - RNA, 24 nt, Human
augcaagaaaaacaagccaaaccc

SEQ ID NO: 838156 - RNA, 22 nt, Human
caaaagaaaaaaucaacagagg

SEQ ID NO: 838157 - RNA, 22 nt, Human
caaaccaugcaagaaaaacaag

SEQ ID NO: 838158 - RNA, 23 nt, Human
caaacccauaaagcaaaagaaaa

SEQ ID NO: 838159 - RNA, 22 nt, Human
caaauggcucgccacagagcca

SEQ ID NO: 838160 - RNA, 21 nt, Human
caagaaaaacaagccaaaccc

SEQ ID NO: 838161 - RNA, 21 nt, Human
caagccaaacccauaaagcaa

SEQ ID NO: 838162 - RNA, 21 nt, Human
caaggcgguggcccauccacc

SEQ ID NO: 838163 - RNA, 18 nt, Human
cacccaggcacuggcagc

SEQ ID NO: 838164 - RNA, 20 nt, Human
cacccugggccaaagugugc

SEQ ID NO: 838165 - RNA, 24 nt, Human
cagcuggagacggguccuaggagc

SEQ ID NO: 838166 - RNA, 18 nt, Human
caggcacuggcagccugc

SEQ ID NO: 838167 - RNA, 18 nt, Human
cauccaccggccuugcac

SEQ ID NO: 838168 - RNA, 19 nt, Human
cauccaggcccccucaguc

SEQ ID NO: 838169 - RNA, 23 nt, Human
caucucccucaugggagucuugg

SEQ ID NO: 838170 - RNA, 24 nt, Human
caugcaagaaaaacaagccaaacc

SEQ ID NO: 838171 - RNA, 25 nt, Human
caugcaagaaaaacaagccaaaccc

SEQ ID NO: 838172 - RNA, 18 nt, Human
ccaaaccaugcaagaaaa

SEQ ID NO: 838173 - RNA, 21 nt, Human
ccaaacccauaaagcaaaaga

SEQ ID NO: 838174 - RNA, 22 nt, Human
ccaaacccauaaagcaaaagaa

SEQ ID NO: 838175 - RNA, 24 nt, Human
ccaaagguccccacgugggcccgg

SEQ ID NO: 838176 - RNA, 20 nt, Human
ccaggcacuggcagccugcu

SEQ ID NO: 838177 - RNA, 23 nt, Human
ccaugcaagaaaaacaagccaaa

SEQ ID NO: 838178 - RNA, 24 nt, Human
ccaugcaagaaaaacaagccaaac

SEQ ID NO: 838179 - RNA, 19 nt, Human
ccccacgugggcccggcuc

SEQ ID NO: 838180 - RNA, 27 nt, Human
ccguagauccuucuuccucuuggauuu

SEQ ID NO: 838181 - RNA, 19 nt, Human
cgccacagagccagguggg

SEQ ID NO: 838182 - RNA, 19 nt, Human
cgcgacgggcggcgccgga

SEQ ID NO: 838183 - RNA, 24 nt, Human
cggagugggguccgaggcccagcc

SEQ ID NO: 838184 - RNA, 22 nt, Human
cggcgacugcagcaaggacgag

SEQ ID NO: 838185 - RNA, 19 nt, Human
cggcggcggcgacugcggc

SEQ ID NO: 838186 - RNA, 20 nt, Human
cggcucauggcaucucccuc

SEQ ID NO: 838187 - RNA, 19 nt, Human
cggguccuaggagcagcag

SEQ ID NO: 838188 - RNA, 19 nt, Human
cuccaaaccaugcaagaaa

SEQ ID NO: 838189 - RNA, 20 nt, Human
cuccaaaccaugcaagaaaa

SEQ ID NO: 838190 - RNA, 20 nt, Human
cugcccccgcagauggggcu

SEQ ID NO: 838191 - RNA, 18 nt, Human
gaaaaacaagccaaaccc

SEQ ID NO: 838192 - RNA, 26 nt, Human
gagagauuaaaaaaauauacaacuug

SEQ ID NO: 838193 - RNA, 22 nt, Human
gagcagcagggagaggcacugg

SEQ ID NO: 838194 - RNA, 23 nt, Human
gcaagaaaaacaagccaaaccca

SEQ ID NO: 838195 - RNA, 20 nt, Human
gcacuggcagccugcugugc

SEQ ID NO: 838196 - RNA, 24 nt, Human
gcagaggcccuguuugccagugcc

SEQ ID NO: 838197 - RNA, 19 nt, Human
gcagcagggagaggcacug

SEQ ID NO: 838198 - RNA, 20 nt, Human
gcagcagggagaggcacugg

SEQ ID NO: 838199 - RNA, 22 nt, Human
gcagcggcggcggcggcggcuu

SEQ ID NO: 838200 - RNA, 21 nt, Human
gcaggggcagcagcauccaca

SEQ ID NO: 838201 - RNA, 20 nt, Human
gccaggcggaggagcagcgg

SEQ ID NO: 838202 - RNA, 22 nt, Human
gccccgcacagugcugcaggac

SEQ ID NO: 838203 - RNA, 18 nt, Human
gcggcgccggagacagac

SEQ ID NO: 838204 - RNA, 23 nt, Human
gcggcggcggcggcgacugcggc

SEQ ID NO: 838205 - RNA, 20 nt, Human
gcggcggcggcggcggcggc

SEQ ID NO: 838206 - RNA, 24 nt, Human
gcggcggcggcggcggcggcgacu

SEQ ID NO: 838207 - RNA, 23 nt, Human
gcggcggcggcggcggcggcggc

SEQ ID NO: 838208 - RNA, 24 nt, Human
gcggcggcggcggcggcggcggcg

SEQ ID NO: 838209 - RNA, 22 nt, Human
gcucuggagggccggagugggg

SEQ ID NO: 838210 - RNA, 27 nt, Human
ggagcagcggcggcggcggcggcggcg

SEQ ID NO: 838211 - RNA, 20 nt, Human
ggcagacggcccaggccagg

SEQ ID NO: 838212 - RNA, 18 nt, Human
ggcaggacugggugagcc

SEQ ID NO: 838213 - RNA, 19 nt, Human
ggcccuguuugccagugcc

SEQ ID NO: 838214 - RNA, 23 nt, Human
ggcggcggcggcggcggcgacug

SEQ ID NO: 838215 - RNA, 23 nt, Human
ggcggcggcggcggcggcggcgg

SEQ ID NO: 838216 - RNA, 21 nt, Human
gggagaggcacugguggggcc

SEQ ID NO: 838217 - RNA, 24 nt, Human
gggccggagugggguccgaggccc

SEQ ID NO: 838218 - RNA, 23 nt, Human
ggggccgacaagggccuggcugg

SEQ ID NO: 838219 - RNA, 20 nt, Human
ggguccuggacggcggugga

SEQ ID NO: 838220 - RNA, 19 nt, Human
gugggcccggcucgagguc

SEQ ID NO: 838221 - RNA, 18 nt, Human
uaaaaaaaacacgaaagg

SEQ ID NO: 838222 - RNA, 23 nt, Human
uaaaaaaauauacaacuuggaug

SEQ ID NO: 838223 - RNA, 20 nt, Human
uagauccuucuuccucuugg

SEQ ID NO: 838224 - RNA, 21 nt, Human
uauggacuggccucugcaucc

SEQ ID NO: 838225 - RNA, 19 nt, Human
uccccacgugggcccggcu

SEQ ID NO: 838226 - RNA, 22 nt, Human
ucccucaugggagucuuggggu

SEQ ID NO: 838227 - RNA, 23 nt, Human
uccgcagaggcccuguuugccag

SEQ ID NO: 838228 - RNA, 20 nt, Human
uccguagauccuucuuccuc

SEQ ID NO: 838229 - RNA, 22 nt, Human
uccuaggagcagcagggagagg

SEQ ID NO: 838230 - RNA, 21 nt, Human
ucuggagggccggaguggggu

SEQ ID NO: 838231 - RNA, 23 nt, Human
ugcaagaaaaacaagccaaaccc

SEQ ID NO: 838232 - RNA, 21 nt, Human
ugccaggggaaggccuugggc

SEQ ID NO: 838233 - RNA, 23 nt, Human
ugccagugccaggggaaggccuu

SEQ ID NO: 838234 - RNA, 19 nt, Human
uggacuggccucugcaucc

SEQ ID NO: 838235 - RNA, 24 nt, Human
uggagacuaaucuagaggacugcg

SEQ ID NO: 838236 - RNA, 21 nt, Human
uggcaguagcuuauggugugg

SEQ ID NO: 838237 - RNA, 22 nt, Human
uggcaguagcuuaugguguggg

SEQ ID NO: 838238 - RNA, 22 nt, Human
uggccucugcauccaccggccu

SEQ ID NO: 838239 - RNA, 19 nt, Human
ugggguauucacacaacuc

SEQ ID NO: 838240 - RNA, 18 nt, Human
ugguauauggacuggccu

SEQ ID NO: 838241 - RNA, 19 nt, Human
ugguggggccgacaagggc

SEQ ID NO: 838242 - RNA, 19 nt, Human
uguggggcucuggagggcc

SEQ ID NO: 838243 - RNA, 20 nt, Human
uguguaccccgcaccaaagc

SEQ ID NO: 838244 - RNA, 23 nt, Human
uugggacaaauggcucgccacag

SEQ ID NO: 838245 - RNA, 23 nt, Human
aaaaccuaaugagaaccuggcua

SEQ ID NO: 838246 - RNA, 21 nt, Human
aaaauucuuuacgucuugcuu

SEQ ID NO: 838247 - RNA, 21 nt, Human
aaacaggaaauuuggcugagc

SEQ ID NO: 838248 - RNA, 22 nt, Human
aaauaaggcaauaucccugcac

SEQ ID NO: 838249 - RNA, 19 nt, Human
aacuguaaagcaacagaau

SEQ ID NO: 838250 - RNA, 24 nt, Human
aagaauacaggauaaaauauucca

SEQ ID NO: 838251 - RNA, 18 nt, Human
aagugacccuaugcugag

SEQ ID NO: 838252 - RNA, 19 nt, Human
aaucacagucaacaacuug

SEQ ID NO: 838253 - RNA, 18 nt, Human
aauuccaaugccaagaaa

SEQ ID NO: 838254 - RNA, 23 nt, Human
aauuccuccuuugucucccagcu

SEQ ID NO: 838255 - RNA, 26 nt, Human
aauugccuucuuauguggucauccac

SEQ ID NO: 838256 - RNA, 19 nt, Human
acacaauagaacggucaga

SEQ ID NO: 838257 - RNA, 19 nt, Human
acaugauggaaacgaacac

SEQ ID NO: 838258 - RNA, 21 nt, Human
agaaaaauaaccagagcucac

SEQ ID NO: 838259 - RNA, 22 nt, Human
agaaaucuuuaucuaaucaauc

SEQ ID NO: 838260 - RNA, 22 nt, Human
agcaaaaccuaaugagaaccug

SEQ ID NO: 838261 - RNA, 22 nt, Human
agcaccuucuuugacaaguggc

SEQ ID NO: 838262 - RNA, 23 nt, Human
agcaccuucuuugacaaguggca

SEQ ID NO: 838263 - RNA, 27 nt, Human
agcgacaauagaccacaggggaaggga

SEQ ID NO: 838264 - RNA, 20 nt, Human
aggcaaguagaucaaagaga

SEQ ID NO: 838265 - RNA, 18 nt, Human
auagagcaaugucuccuu

SEQ ID NO: 838266 - RNA, 21 nt, Human
auggacuacgagagguucuag

SEQ ID NO: 838267 - RNA, 19 nt, Human
auuccaguagcugcaucuc

SEQ ID NO: 838268 - RNA, 21 nt, Human
auuccucuugaguccccggga

SEQ ID NO: 838269 - RNA, 18 nt, Human
auugcacauggugucugg

SEQ ID NO: 838270 - RNA, 19 nt, Human
caaguuguuccagauaaaa

SEQ ID NO: 838271 - RNA, 25 nt, Human
cacuaacacugugugaucaaucagg

SEQ ID NO: 838272 - RNA, 21 nt, Human
cacugucauacaaagccuaag

SEQ ID NO: 838273 - RNA, 19 nt, Human
cacuguguccuuccaggau

SEQ ID NO: 838274 - RNA, 19 nt, Human
cacugugugaucaaucagg

SEQ ID NO: 838275 - RNA, 20 nt, Human
cacugugugaucaaucaggu

SEQ ID NO: 838276 - RNA, 19 nt, Human
cagacuccugagucuuccc

SEQ ID NO: 838277 - RNA, 24 nt, Human
cagauuagcuccuggacagccaga

SEQ ID NO: 838278 - RNA, 19 nt, Human
cagcccuuuuuucuagagu

SEQ ID NO: 838279 - RNA, 19 nt, Human
caucacaaaagagcaggau

SEQ ID NO: 838280 - RNA, 20 nt, Human
ccacacaauagaacggucag

SEQ ID NO: 838281 - RNA, 24 nt, Human
ccaguagcugcaucuccagguuuu

SEQ ID NO: 838282 - RNA, 21 nt, Human
ccagugauggcaagaagcaaa

SEQ ID NO: 838283 - RNA, 23 nt, Human
cccacuauucuuagccuuuuaaa

SEQ ID NO: 838284 - RNA, 19 nt, Human
ccucuugaguccccgggag

SEQ ID NO: 838285 - RNA, 20 nt, Human
ccuucuguacuguuuucuuc

SEQ ID NO: 838286 - RNA, 19 nt, Human
cgaaggcagacauagagca

SEQ ID NO: 838287 - RNA, 18 nt, Human
cuaugauuaauacacuaa

SEQ ID NO: 838288 - RNA, 20 nt, Human
cuccugagucuucccauuga

SEQ ID NO: 838289 - RNA, 19 nt, Human
cuugaaccacucacagugc

SEQ ID NO: 838290 - RNA, 21 nt, Human
cuugaguccccgggagcaaug

SEQ ID NO: 838291 - RNA, 22 nt, Human
gaagaagcacaagauacuuaaa

SEQ ID NO: 838292 - RNA, 21 nt, Human
gaccacaggggaagggaaaga

SEQ ID NO: 838293 - RNA, 20 nt, Human
gagaaaagaacacauucugu

SEQ ID NO: 838294 - RNA, 18 nt, Human
gcugagcacaucgauccc

SEQ ID NO: 838295 - RNA, 18 nt, Human
ggcaaagugacccuaugc

SEQ ID NO: 838296 - RNA, 20 nt, Human
gucucguuggcugugcaagc

SEQ ID NO: 838297 - RNA, 25 nt, Human
uaacacugugugaucaaucagguau

SEQ ID NO: 838298 - RNA, 22 nt, Human
uaacuguaaagcaacagaauau

SEQ ID NO: 838299 - RNA, 23 nt, Human
uaagaugugaucuaaucacaguc

SEQ ID NO: 838300 - RNA, 28 nt, Human
uaaggaacaucccugcuaaccggggccc

SEQ ID NO: 838301 - RNA, 18 nt, Human
uacagacaaauaaggcaa

SEQ ID NO: 838302 - RNA, 23 nt, Human
uacuagaauuaaaaacaucugua

SEQ ID NO: 838303 - RNA, 18 nt, Human
uacuguuuucuucuuuca

SEQ ID NO: 838304 - RNA, 27 nt, Human
uagaacggucagauuagcuccuggaca

SEQ ID NO: 838305 - RNA, 20 nt, Human
uagaauuaaaaacaucugua

SEQ ID NO: 838306 - RNA, 19 nt, Human
uagaccacaggggaaggga

SEQ ID NO: 838307 - RNA, 23 nt, Human
uagcuccuggacagccagaauug

SEQ ID NO: 838308 - RNA, 24 nt, Human
uaguacauucaucacuguguccuu

SEQ ID NO: 838309 - RNA, 24 nt, Human
uaugguacaagagaaaaauaacca

SEQ ID NO: 838310 - RNA, 23 nt, Human
uauugcacuuggugaagaaagua

SEQ ID NO: 838311 - RNA, 19 nt, Human
ucagcaccuucuuugacaa

SEQ ID NO: 838312 - RNA, 21 nt, Human
ucaggcuugggaccaagggga

SEQ ID NO: 838313 - RNA, 20 nt, Human
uccaaugccaagaaauggug

SEQ ID NO: 838314 - RNA, 23 nt, Human
uccacacaauagaacggucagau

SEQ ID NO: 838315 - RNA, 18 nt, Human
ucccauugaaaaauagga

SEQ ID NO: 838316 - RNA, 24 nt, Human
uccuccuuugucucccagcuccag

SEQ ID NO: 838317 - RNA, 19 nt, Human
uccuggacagccagaauug

SEQ ID NO: 838318 - RNA, 23 nt, Human
ucuugaguccccgggagcaaugg

SEQ ID NO: 838319 - RNA, 20 nt, Human
ugaaaaauaggacugguaga

SEQ ID NO: 838320 - RNA, 19 nt, Human
ugacagcagagaaacagau

SEQ ID NO: 838321 - RNA, 21 nt, Human
ugacagcagagaaacagauuc

SEQ ID NO: 838322 - RNA, 22 nt, Human
ugacagcagagaaacagauucc

SEQ ID NO: 838323 - RNA, 19 nt, Human
ugacaguauuuaugacugu

SEQ ID NO: 838324 - RNA, 19 nt, Human
ugagaggagacacagcaau

SEQ ID NO: 838325 - RNA, 20 nt, Human
ugagaggagacacagcaaua

SEQ ID NO: 838326 - RNA, 25 nt, Human
ugaggcaaguagaucaaagagauaa

SEQ ID NO: 838327 - RNA, 21 nt, Human
ugauuaauacacuaaaauugc

SEQ ID NO: 838328 - RNA, 18 nt, Human
ugcauaauggcaaaguga

SEQ ID NO: 838329 - RNA, 25 nt, Human
ugcauaauggcaaagugacccuaug

SEQ ID NO: 838330 - RNA, 22 nt, Human
ugccagggaggcccaagcaaaa

SEQ ID NO: 838331 - RNA, 23 nt, Human
ugccagggaggcccaagcaaaac

SEQ ID NO: 838332 - RNA, 24 nt, Human
ugccuucuguacuguuuucuucuu

SEQ ID NO: 838333 - RNA, 22 nt, Human
uggcaagaagcaaacaacugag

SEQ ID NO: 838334 - RNA, 20 nt, Human
uggcagacuccugagucuuc

SEQ ID NO: 838335 - RNA, 21 nt, Human
uggcugugcaagcucuucuca

SEQ ID NO: 838336 - RNA, 21 nt, Human
uggggguuaaaaauccucggu

SEQ ID NO: 838337 - RNA, 18 nt, Human
uguaaacuuugccuucug

SEQ ID NO: 838338 - RNA, 21 nt, Human
uguaacagugcugaggguuuu

SEQ ID NO: 838339 - RNA, 24 nt, Human
ugugauacgggaugaaaauucuuu

SEQ ID NO: 838340 - RNA, 18 nt, Human
ugugucucuagaaaagau

SEQ ID NO: 838341 - RNA, 21 nt, Human
uguuuuauauuccagugugcu

SEQ ID NO: 838342 - RNA, 21 nt, Human
uucuuagccuuuuaaacacua

SEQ ID NO: 838343 - RNA, 22 nt, Human
uucuuaggaucagcaccuucuu

SEQ ID NO: 838344 - RNA, 18 nt, Human
uugcacuuggugaagaaa

SEQ ID NO: 838345 - RNA, 22 nt, Human
uugcuuccucucagcccuuuuu

SEQ ID NO: 838346 - RNA, 19 nt, Human
uuggauuaagcgcaaguca

SEQ ID NO: 838347 - RNA, 25 nt, Human
uugggccccacuauucuuagccuuu

SEQ ID NO: 838348 - RNA, 22 nt, Human
uuugugaacacuauacacccuu

SEQ ID NO: 838349 - RNA, 25 nt, Human
uuugugaacacuauacacccuuuug

SEQ ID NO: 838350 - RNA, 21 nt, Human
uuuuugguaaagauaaauuca

SEQ ID NO: 838351 - RNA, 24 nt, Human
aaccagaagguauggggauggccu

SEQ ID NO: 838352 - RNA, 18 nt, Human
aagccagggcccagcaaa

SEQ ID NO: 838353 - RNA, 18 nt, Human
aauggaggaugaggggga

SEQ ID NO: 838354 - RNA, 19 nt, Human
acuuuuauucccaucagug

SEQ ID NO: 838355 - RNA, 25 nt, Human
agagaaaaacauuaggaaaacagaa

SEQ ID NO: 838356 - RNA, 20 nt, Human
agagggugaaaacaagggaa

SEQ ID NO: 838357 - RNA, 19 nt, Human
aggaaaacagaagugggca

SEQ ID NO: 838358 - RNA, 19 nt, Human
aggcaccgagccugcccag

SEQ ID NO: 838359 - RNA, 18 nt, Human
aggcgagggcagggaagc

SEQ ID NO: 838360 - RNA, 21 nt, Human
agggaauggaggaugaggggg

SEQ ID NO: 838361 - RNA, 23 nt, Human
agggcaaggacucgguuuggggg

SEQ ID NO: 838362 - RNA, 20 nt, Human
aggggacucaguccggggcu

SEQ ID NO: 838363 - RNA, 18 nt, Human
cacccuuuaccucucugc

SEQ ID NO: 838364 - RNA, 20 nt, Human
cagaggacagagggugaaaa

SEQ ID NO: 838365 - RNA, 24 nt, Human
cagggcaaggacucgguuuggggg

SEQ ID NO: 838366 - RNA, 18 nt, Human
ccacccgaggccgcgcgg

SEQ ID NO: 838367 - RNA, 21 nt, Human
ccacccggagacacagggcgc

SEQ ID NO: 838368 - RNA, 24 nt, Human
ccaccugcugacagaggugaaggc

SEQ ID NO: 838369 - RNA, 18 nt, Human
ccccagggccgccacacc

SEQ ID NO: 838370 - RNA, 19 nt, Human
ccguguggguaugaggagg

SEQ ID NO: 838371 - RNA, 24 nt, Human
cgacggguggguuguucuccuugg

SEQ ID NO: 838372 - RNA, 21 nt, Human
cgagaggaggaggaggaaggc

SEQ ID NO: 838373 - RNA, 22 nt, Human
cgccacaccacggagagucccc

SEQ ID NO: 838374 - RNA, 18 nt, Human
cgccguguggguaugagg

SEQ ID NO: 838375 - RNA, 21 nt, Human
cggcgguagcggcgagaggag

SEQ ID NO: 838376 - RNA, 20 nt, Human
cuccaagaggugacaagggg

SEQ ID NO: 838377 - RNA, 28 nt, Human
cugguccugggcuuucagugcccugcgg

SEQ ID NO: 838378 - RNA, 22 nt, Human
gagggugcaccgggaagcgggc

SEQ ID NO: 838379 - RNA, 24 nt, Human
gaguugagcgaacgcuauggugaa

SEQ ID NO: 838380 - RNA, 19 nt, Human
gaugagggggagggaagag

SEQ ID NO: 838381 - RNA, 18 nt, Human
gcagcagggcaaggacuc

SEQ ID NO: 838382 - RNA, 19 nt, Human
gcagggaagccagggccca

SEQ ID NO: 838383 - RNA, 22 nt, Human
gccacaccacggagaguccccg

SEQ ID NO: 838384 - RNA, 18 nt, Human
gccccagggccgccacac

SEQ ID NO: 838385 - RNA, 21 nt, Human
gcggcggcggcgacggcggua

SEQ ID NO: 838386 - RNA, 23 nt, Human
gcggcggcggcgacggcgguagc

SEQ ID NO: 838387 - RNA, 20 nt, Human
gcggcggcugcggcggcggc

SEQ ID NO: 838388 - RNA, 19 nt, Human
gcgguagcggcgagaggag

SEQ ID NO: 838389 - RNA, 21 nt, Human
gcucacauccugggguauggg

SEQ ID NO: 838390 - RNA, 18 nt, Human
ggagggaagaggggaggg

SEQ ID NO: 838391 - RNA, 22 nt, Human
ggcagggacccugggagccucc

SEQ ID NO: 838392 - RNA, 19 nt, Human
ggcuccaagaggugacaag

SEQ ID NO: 838393 - RNA, 18 nt, Human
gggaagccagggcccagc

SEQ ID NO: 838394 - RNA, 18 nt, Human
gggacucaguccggggcu

SEQ ID NO: 838395 - RNA, 19 nt, Human
gggauggccugguggggug

SEQ ID NO: 838396 - RNA, 21 nt, Human
gggcaaggacucgguuugggg

SEQ ID NO: 838397 - RNA, 19 nt, Human
gggcagggacccugggagc

SEQ ID NO: 838398 - RNA, 23 nt, Human
gggcagggacccugggagccucc

SEQ ID NO: 838399 - RNA, 21 nt, Human
gggcccagcaaagcucuucug

SEQ ID NO: 838400 - RNA, 23 nt, Human
gggcuauuaagaaagagccccag

SEQ ID NO: 838401 - RNA, 20 nt, Human
ggggagggaagaggggaggg

SEQ ID NO: 838402 - RNA, 24 nt, Human
ggggauggccugguggggugggcc

SEQ ID NO: 838403 - RNA, 18 nt, Human
gggggagggaagagggga

SEQ ID NO: 838404 - RNA, 23 nt, Human
ggucugaggugucucccggggag

SEQ ID NO: 838405 - RNA, 19 nt, Human
ggugacaaggggagugacg

SEQ ID NO: 838406 - RNA, 19 nt, Human
ggugcaccgggaagcgggc

SEQ ID NO: 838407 - RNA, 19 nt, Human
gugaugcugacgggccuga

SEQ ID NO: 838408 - RNA, 24 nt, Human
guuugggggagauacagcggcagg

SEQ ID NO: 838409 - RNA, 19 nt, Human
uaagaaagagccccagggc

SEQ ID NO: 838410 - RNA, 27 nt, Human
uaagaaagagccccagggccgccacac

SEQ ID NO: 838411 - RNA, 22 nt, Human
uacugguccugggcuuucagug

SEQ ID NO: 838412 - RNA, 27 nt, Human
uauggggauggccugguggggugggcc

SEQ ID NO: 838413 - RNA, 20 nt, Human
uauuaagaaagagccccagg

SEQ ID NO: 838414 - RNA, 23 nt, Human
ucaguggacuaggagaggguccu

SEQ ID NO: 838415 - RNA, 19 nt, Human
uccaagaggugacaagggg

SEQ ID NO: 838416 - RNA, 20 nt, Human
uccccaggcaaggccaccug

SEQ ID NO: 838417 - RNA, 18 nt, Human
ucccggggagggugcacc

SEQ ID NO: 838418 - RNA, 28 nt, Human
ucucaaugccccacccuuuaccucucug

SEQ ID NO: 838419 - RNA, 20 nt, Human
ugaggugucucccggggagg

SEQ ID NO: 838420 - RNA, 19 nt, Human
ugccccacccuuuaccucu

SEQ ID NO: 838421 - RNA, 20 nt, Human
uggaggggacucaguccggg

SEQ ID NO: 838422 - RNA, 18 nt, Human
ugggagccuccauucuca

SEQ ID NO: 838423 - RNA, 19 nt, Human
ugggguaugggaaacccac

SEQ ID NO: 838424 - RNA, 21 nt, Human
uuacugguccugggcuuucag

SEQ ID NO: 838425 - RNA, 18 nt, Human
uugguuacugguccuggg

SEQ ID NO: 838426 - RNA, 25 nt, Human
uuuauagagaaaaacauuaggaaaa

SEQ ID NO: 838427 - RNA, 20 nt, Human
aaaacaaacaaacaaagcca

SEQ ID NO: 838428 - RNA, 21 nt, Human
aaacaaacaaacaaagccaaa

SEQ ID NO: 838429 - RNA, 24 nt, Human
aaacaaacaaagccaaagaguaca

SEQ ID NO: 838430 - RNA, 30 nt, Human
aaacagacuggaaagugauuuuucccccag

SEQ ID NO: 838431 - RNA, 19 nt, Human
aaacugacaauuguccucc

SEQ ID NO: 838432 - RNA, 21 nt, Human
aaauaauaaaugggacaaacu

SEQ ID NO: 838433 - RNA, 22 nt, Human
aaaucacaagcacacacagcaa

SEQ ID NO: 838434 - RNA, 18 nt, Human
aacaaagaugcaagcugc

SEQ ID NO: 838435 - RNA, 24 nt, Human
aacaagaaaaaaaaauagauccag

SEQ ID NO: 838436 - RNA, 27 nt, Human
aacaagaaaaaaaaauagauccaggag

SEQ ID NO: 838437 - RNA, 23 nt, Human
aagaaaaaaaaauagauccagga

SEQ ID NO: 838438 - RNA, 24 nt, Human
aagaaaacaaacaaacaaagccaa

SEQ ID NO: 838439 - RNA, 25 nt, Human
aagaaaacaaacaaacaaagccaaa

SEQ ID NO: 838440 - RNA, 23 nt, Human
aagaaaccuagagcuacaaauca

SEQ ID NO: 838441 - RNA, 18 nt, Human
aagaagaaaacaaacaaa

SEQ ID NO: 838442 - RNA, 19 nt, Human
aagaagaaaacaaacaaac

SEQ ID NO: 838443 - RNA, 22 nt, Human
aagaagaaaacaaacaaacaaa

SEQ ID NO: 838444 - RNA, 21 nt, Human
aagaagagcuccuuuuugaua

SEQ ID NO: 838445 - RNA, 19 nt, Human
aagagggggaguaaaaaga

SEQ ID NO: 838446 - RNA, 21 nt, Human
aagcucaucuccuauagagga

SEQ ID NO: 838447 - RNA, 20 nt, Human
aauaauaaaugggacaaacu

SEQ ID NO: 838448 - RNA, 23 nt, Human
aaucuuuucaaccaagcacuuaa

SEQ ID NO: 838449 - RNA, 22 nt, Human
acaaacgcagaagaaggcacca

SEQ ID NO: 838450 - RNA, 24 nt, Human
acaaaucacaagcacacacagcaa

SEQ ID NO: 838451 - RNA, 20 nt, Human
acaguucauucuauacuaua

SEQ ID NO: 838452 - RNA, 23 nt, Human
accccgaaacccaccaauccaca

SEQ ID NO: 838453 - RNA, 20 nt, Human
acuuugccuugcuucucuuc

SEQ ID NO: 838454 - RNA, 18 nt, Human
agaaaauacucugccuuc

SEQ ID NO: 838455 - RNA, 22 nt, Human
agagaagucugagaagcuugag

SEQ ID NO: 838456 - RNA, 23 nt, Human
agagcuacaaaucauagaaccug

SEQ ID NO: 838457 - RNA, 21 nt, Human
aggaagagaggauucagggaa

SEQ ID NO: 838458 - RNA, 19 nt, Human
aggcuccaggucaucugcc

SEQ ID NO: 838459 - RNA, 25 nt, Human
agggggaguaaaaagaaaauuggga

SEQ ID NO: 838460 - RNA, 23 nt, Human
aguaaaaagaaaauugggagaga

SEQ ID NO: 838461 - RNA, 23 nt, Human
auaaaauacaaaucacaagcaca

SEQ ID NO: 838462 - RNA, 27 nt, Human
auaagguuuuuuuuucuucuuuuuaaa

SEQ ID NO: 838463 - RNA, 18 nt, Human
auauaaaaucauauuaca

SEQ ID NO: 838464 - RNA, 18 nt, Human
caaacaaacaaagccaaa

SEQ ID NO: 838465 - RNA, 24 nt, Human
caaacacacacauacacacaggua

SEQ ID NO: 838466 - RNA, 19 nt, Human
caaauagacacacaaacac

SEQ ID NO: 838467 - RNA, 22 nt, Human
caaauagacacacaaacacaca

SEQ ID NO: 838468 - RNA, 21 nt, Human
caacuugcuaggaacucccaa

SEQ ID NO: 838469 - RNA, 24 nt, Human
caagaaaccuagagcuacaaauca

SEQ ID NO: 838470 - RNA, 22 nt, Human
caagaagagcuccuuuuugaua

SEQ ID NO: 838471 - RNA, 20 nt, Human
caagauggaaaugcacaccc

SEQ ID NO: 838472 - RNA, 20 nt, Human
caauagaaaugcaagccuug

SEQ ID NO: 838473 - RNA, 21 nt, Human
cacaacagcuggaacagacau

SEQ ID NO: 838474 - RNA, 24 nt, Human
cacacacauacacacagguagaug

SEQ ID NO: 838475 - RNA, 20 nt, Human
caccccgaaacccaccaauc

SEQ ID NO: 838476 - RNA, 18 nt, Human
caccucaaaguucugauu

SEQ ID NO: 838477 - RNA, 18 nt, Human
cagcagucacaacagcug

SEQ ID NO: 838478 - RNA, 19 nt, Human
caggagggacaaacgcaga

SEQ ID NO: 838479 - RNA, 20 nt, Human
cagggaagcaauccucucca

SEQ ID NO: 838480 - RNA, 21 nt, Human
caguucauucuauacuauaga

SEQ ID NO: 838481 - RNA, 22 nt, Human
cauuuuguaaagaauaagagaa

SEQ ID NO: 838482 - RNA, 20 nt, Human
cccaggauugggcagauguu

SEQ ID NO: 838483 - RNA, 18 nt, Human
cccauuauuuccucaucu

SEQ ID NO: 838484 - RNA, 27 nt, Human
ccccucaaaacugacaauuguccuccu

SEQ ID NO: 838485 - RNA, 23 nt, Human
cccuaaaagauguggugaucacc

SEQ ID NO: 838486 - RNA, 20 nt, Human
cccucuguucuuccuugucc

SEQ ID NO: 838487 - RNA, 21 nt, Human
cccucuguucuuccuugucca

SEQ ID NO: 838488 - RNA, 20 nt, Human
ccucagaacaacaagaaaaa

SEQ ID NO: 838489 - RNA, 20 nt, Human
ccuccuuaccaaacagagau

SEQ ID NO: 838490 - RNA, 21 nt, Human
ccuccuuaccaaacagagauu

SEQ ID NO: 838491 - RNA, 23 nt, Human
ccuucagaggugggccgaaccag

SEQ ID NO: 838492 - RNA, 21 nt, Human
ccuuuugaaguccuaagccuu

SEQ ID NO: 838493 - RNA, 23 nt, Human
cuaaaagauguggugaucaccca

SEQ ID NO: 838494 - RNA, 25 nt, Human
cuagagcuacaaaucauagaaccug

SEQ ID NO: 838495 - RNA, 25 nt, Human
cuauaccacaagugucagaagaacc

SEQ ID NO: 838496 - RNA, 23 nt, Human
cucagaacaacaagaaaaaaaaa

SEQ ID NO: 838497 - RNA, 24 nt, Human
cuccaggucaucugccuucaccgu

SEQ ID NO: 838498 - RNA, 23 nt, Human
cucuucuguagcuaguuuugcaa

SEQ ID NO: 838499 - RNA, 25 nt, Human
cugcuucacugaagaagaaaacaaa

SEQ ID NO: 838500 - RNA, 18 nt, Human
cuggaaagugauuuuucc

SEQ ID NO: 838501 - RNA, 22 nt, Human
cuugcuucaccccgaaacccac

SEQ ID NO: 838502 - RNA, 21 nt, Human
cuuuccacuaauacuauacca

SEQ ID NO: 838503 - RNA, 19 nt, Human
cuuuuugucagggccaaug

SEQ ID NO: 838504 - RNA, 21 nt, Human
gaaaacaaacaaacaaagcca

SEQ ID NO: 838505 - RNA, 21 nt, Human
gaacuuaaaaaauaaaagccc

SEQ ID NO: 838506 - RNA, 23 nt, Human
gaacuugcuucaccccgaaaccc

SEQ ID NO: 838507 - RNA, 24 nt, Human
gacacaaaaccuaguugaauuaca

SEQ ID NO: 838508 - RNA, 19 nt, Human
gcugcuucacugaagaaga

SEQ ID NO: 838509 - RNA, 22 nt, Human
gcuucacugaagaagaaaacaa

SEQ ID NO: 838510 - RNA, 20 nt, Human
gguguggaacuggucugagg

SEQ ID NO: 838511 - RNA, 24 nt, Human
gugaacuugcuucaccccgaaacc

SEQ ID NO: 838512 - RNA, 23 nt, Human
uaaaauacaaaucacaagcacac

SEQ ID NO: 838513 - RNA, 22 nt, Human
uaaaucucgaggugguguggaa

SEQ ID NO: 838514 - RNA, 20 nt, Human
uaacacaugucccccucaaa

SEQ ID NO: 838515 - RNA, 23 nt, Human
uaagagaagucugagaagcuuga

SEQ ID NO: 838516 - RNA, 20 nt, Human
uaauuucaucacuaccguag

SEQ ID NO: 838517 - RNA, 22 nt, Human
uacaaaucacuuuccacuaaua

SEQ ID NO: 838518 - RNA, 22 nt, Human
uacaaaucauagaaccuguggg

SEQ ID NO: 838519 - RNA, 20 nt, Human
uaccaaacagagaugcucau

SEQ ID NO: 838520 - RNA, 24 nt, Human
uaccaaacagagaugcucauagaa

SEQ ID NO: 838521 - RNA, 19 nt, Human
uagaggagccagcuauugc

SEQ ID NO: 838522 - RNA, 22 nt, Human
uagaugaauagguagguggaua

SEQ ID NO: 838523 - RNA, 20 nt, Human
uagggucaaccgauuaaguc

SEQ ID NO: 838524 - RNA, 22 nt, Human
uagguagguggauauaaaauca

SEQ ID NO: 838525 - RNA, 24 nt, Human
uagguagguggauauaaaaucaua

SEQ ID NO: 838526 - RNA, 19 nt, Human
uagucaacuugcuaggaac

SEQ ID NO: 838527 - RNA, 22 nt, Human
uaguugaauuacaguguuagaa

SEQ ID NO: 838528 - RNA, 18 nt, Human
uauuacaaaucacuuucc

SEQ ID NO: 838529 - RNA, 19 nt, Human
uauuacaaaucacuuucca

SEQ ID NO: 838530 - RNA, 20 nt, Human
uauuacaaaucacuuuccac

SEQ ID NO: 838531 - RNA, 22 nt, Human
ucaaagaugacuuucuauugau

SEQ ID NO: 838532 - RNA, 19 nt, Human
ucagaacaacaagaaaaaa

SEQ ID NO: 838533 - RNA, 21 nt, Human
ucagaacaacaagaaaaaaaa

SEQ ID NO: 838534 - RNA, 23 nt, Human
ucagaacaacaagaaaaaaaaau

SEQ ID NO: 838535 - RNA, 19 nt, Human
ucagcuccucagaacaaca

SEQ ID NO: 838536 - RNA, 21 nt, Human
ucagggaagcaauccucucca

SEQ ID NO: 838537 - RNA, 20 nt, Human
ucauaugacacaucauuaaa

SEQ ID NO: 838538 - RNA, 21 nt, Human
uccaaaaauggcagcagucac

SEQ ID NO: 838539 - RNA, 18 nt, Human
uccaauagaaaugcaagc

SEQ ID NO: 838540 - RNA, 22 nt, Human
uccaugcccaggaauuaauuca

SEQ ID NO: 838541 - RNA, 24 nt, Human
ucccuucuuguauaaaauggaauc

SEQ ID NO: 838542 - RNA, 19 nt, Human
uccuauagaggagccagcu

SEQ ID NO: 838543 - RNA, 21 nt, Human
ucgcuucuugccugaccugcc

SEQ ID NO: 838544 - RNA, 20 nt, Human
ucuggaccacagacacaauu

SEQ ID NO: 838545 - RNA, 22 nt, Human
ucugguaguccaugcccaggaa

SEQ ID NO: 838546 - RNA, 22 nt, Human
ucugguaguccaugcccaggaa

SEQ ID NO: 838547 - RNA, 22 nt, Human
ucuguucuuccuuguccaaaag

SEQ ID NO: 838548 - RNA, 24 nt, Human
ugaaauugccagccuccugucucc

SEQ ID NO: 838549 - RNA, 19 nt, Human
ugaacuuaaaaaauaaaag

SEQ ID NO: 838550 - RNA, 21 nt, Human
ugaccgaugcagcagauggac

SEQ ID NO: 838551 - RNA, 22 nt, Human
ugagugauuuuuauguuuucca

SEQ ID NO: 838552 - RNA, 18 nt, Human
ugcaacguuagggaaggc

SEQ ID NO: 838553 - RNA, 23 nt, Human
ugcaacguuagggaaggcugugc

SEQ ID NO: 838554 - RNA, 19 nt, Human
ugcacgcugcugaagaaag

SEQ ID NO: 838555 - RNA, 21 nt, Human
ugccaaauagacacacaaaca

SEQ ID NO: 838556 - RNA, 20 nt, Human
ugcccaggaauuaauucaac

SEQ ID NO: 838557 - RNA, 25 nt, Human
ugccuucaccucaaaguucugauuu

SEQ ID NO: 838558 - RNA, 18 nt, Human
ugccuugcuucucuucug

SEQ ID NO: 838559 - RNA, 21 nt, Human
ugcuaggaacucccaaugaag

SEQ ID NO: 838560 - RNA, 18 nt, Human
ugcugaagaaagaugcgg

SEQ ID NO: 838561 - RNA, 20 nt, Human
ugcuucaccccgaaacccac

SEQ ID NO: 838562 - RNA, 23 nt, Human
ugcuucaccccgaaacccaccaa

SEQ ID NO: 838563 - RNA, 23 nt, Human
uggaaaugcacaccuugcaaaac

SEQ ID NO: 838564 - RNA, 21 nt, Human
uggaauuuuaaggccaggguu

SEQ ID NO: 838565 - RNA, 21 nt, Human
uggaccacagacacaauugaa

SEQ ID NO: 838566 - RNA, 21 nt, Human
uggauauaaaaucauauuaca

SEQ ID NO: 838567 - RNA, 22 nt, Human
uggcagcagucacaacagcugg

SEQ ID NO: 838568 - RNA, 24 nt, Human
uggcagcagucacaacagcuggaa

SEQ ID NO: 838569 - RNA, 18 nt, Human
uguagcuaguuuugcaac

SEQ ID NO: 838570 - RNA, 19 nt, Human
uguggaacuggucugaggu

SEQ ID NO: 838571 - RNA, 22 nt, Human
uguuuuacucuuugagcuguua

SEQ ID NO: 838572 - RNA, 19 nt, Human
uugaacuugaggccaagaa

SEQ ID NO: 838573 - RNA, 23 nt, Human
uugaucaucaagaaaccuagagc

SEQ ID NO: 838574 - RNA, 19 nt, Human
uuucacaagaagagcuccu

SEQ ID NO: 838575 - RNA, 23 nt, Human
uuuccacuaauacuauaccacaa

SEQ ID NO: 838576 - RNA, 21 nt, Human
uuuccuuugaugggggagggg

SEQ ID NO: 838577 - RNA, 23 nt, Human
caggcagcuggguggccaagugg

SEQ ID NO: 838578 - RNA, 19 nt, Human
ccccgccgccaccgccgcc

SEQ ID NO: 838579 - RNA, 19 nt, Human
ccccuggcaggcagcuggg

SEQ ID NO: 838580 - RNA, 19 nt, Human
ccccuguggggcuggccgc

SEQ ID NO: 838581 - RNA, 18 nt, Human
ccgccgccaccgccgccg

SEQ ID NO: 838582 - RNA, 19 nt, Human
ccgccgccaccgccgccgc

SEQ ID NO: 838583 - RNA, 31 nt, Human
ccgccgccaccgccgccgcgcaccgcccggg

SEQ ID NO: 838584 - RNA, 24 nt, Human
ccgccgcgcaccgcccggccgccc

SEQ ID NO: 838585 - RNA, 22 nt, Human
uggcaggcagcuggguggccaa

SEQ ID NO: 838586 - RNA, 20 nt, Human
uggccaugccccuggccccc

SEQ ID NO: 838587 - RNA, 25 nt, Human
uggccguccaggucccaggucuccc

SEQ ID NO: 838588 - RNA, 21 nt, Human
uggggaggggggccuguggcc

SEQ ID NO: 838589 - RNA, 18 nt, Human
uuccccgccgccaccgcc

SEQ ID NO: 838590 - RNA, 26 nt, Human
uuccccgccgccaccgccgccgcgca

SEQ ID NO: 838591 - RNA, 25 nt, Human
aaaaaagaaaagugcagucagagag

SEQ ID NO: 838592 - RNA, 21 nt, Human
aaacaaauuuaaccaagaauc

SEQ ID NO: 838593 - RNA, 18 nt, Human
aaagaauacagauauaag

SEQ ID NO: 838594 - RNA, 23 nt, Human
aaaguuuagggcucaaccccaca

SEQ ID NO: 838595 - RNA, 19 nt, Human
aaaugaggauauauuuuaa

SEQ ID NO: 838596 - RNA, 19 nt, Human
aacaucccuggccucuacc

SEQ ID NO: 838597 - RNA, 19 nt, Human
aacuguuuaaaauacacua

SEQ ID NO: 838598 - RNA, 19 nt, Human
aagcagaaagcuaucccuc

SEQ ID NO: 838599 - RNA, 21 nt, Human
aauuuaaccaagaaucaagag

SEQ ID NO: 838600 - RNA, 20 nt, Human
agaaaccuauauucuuuaag

SEQ ID NO: 838601 - RNA, 18 nt, Human
agcaacaucccuggccuc

SEQ ID NO: 838602 - RNA, 21 nt, Human
agguagaggcacaggagaggu

SEQ ID NO: 838603 - RNA, 31 nt, Human
agguuuuccgugugugugugugugugugugg

SEQ ID NO: 838604 - RNA, 19 nt, Human
auacaugauuuugauuauu

SEQ ID NO: 838605 - RNA, 22 nt, Human
auccuaagaacaaggguuucau

SEQ ID NO: 838606 - RNA, 24 nt, Human
aucuaaagaauacagauauaagag

SEQ ID NO: 838607 - RNA, 23 nt, Human
aucuucuaucaagacuccuacug

SEQ ID NO: 838608 - RNA, 19 nt, Human
auggggaaucaggagcugg

SEQ ID NO: 838609 - RNA, 23 nt, Human
auguuaccuauggggaaucagga

SEQ ID NO: 838610 - RNA, 19 nt, Human
auuuagcaacaucccuggc

SEQ ID NO: 838611 - RNA, 23 nt, Human
auuuugggagggguaauucuuug

SEQ ID NO: 838612 - RNA, 18 nt, Human
caaauaaacauaccucuc

SEQ ID NO: 838613 - RNA, 24 nt, Human
caaaugaggauauauuuuaaauac

SEQ ID NO: 838614 - RNA, 20 nt, Human
caaguaaaacaaaacaaaac

SEQ ID NO: 838615 - RNA, 22 nt, Human
cacuaaaaacuacaaauuauac

SEQ ID NO: 838616 - RNA, 23 nt, Human
cagcucaacaauuugaaaauuag

SEQ ID NO: 838617 - RNA, 23 nt, Human
caucccuggccucuacccaauuc

SEQ ID NO: 838618 - RNA, 23 nt, Human
ccucuugucuuuuuucuccccca

SEQ ID NO: 838619 - RNA, 18 nt, Human
ccuguuuuuuugaggugc

SEQ ID NO: 838620 - RNA, 21 nt, Human
cgugugugugugugugugugu

SEQ ID NO: 838621 - RNA, 22 nt, Human
cuaaaguuuagggccggggucc

SEQ ID NO: 838622 - RNA, 23 nt, Human
cuggccucuacccaauucaugcu

SEQ ID NO: 838623 - RNA, 19 nt, Human
cuuucccucuugucuuuuu

SEQ ID NO: 838624 - RNA, 22 nt, Human
cuuucccucuugucuuuuuucu

SEQ ID NO: 838625 - RNA, 24 nt, Human
gaaugaauagaugggagcuaggua

SEQ ID NO: 838626 - RNA, 23 nt, Human
gguauacaugauuuugauuauuu

SEQ ID NO: 838627 - RNA, 19 nt, Human
gguugguagacagagguua

SEQ ID NO: 838628 - RNA, 19 nt, Human
guaaaacaaaacaaaacug

SEQ ID NO: 838629 - RNA, 23 nt, Human
guaucccuccaauugugacaacc

SEQ ID NO: 838630 - RNA, 18 nt, Human
gugugugugugugugugu

SEQ ID NO: 838631 - RNA, 18 nt, Human
uaaaauacacuaaacacc

SEQ ID NO: 838632 - RNA, 23 nt, Human
uacccuaaacuaaaguuuagggc

SEQ ID NO: 838633 - RNA, 18 nt, Human
uagcaacaucccuggccu

SEQ ID NO: 838634 - RNA, 22 nt, Human
uagcuguuuucaguuuauaacu

SEQ ID NO: 838635 - RNA, 25 nt, Human
uaggauuaacaaauaaacauaccuc

SEQ ID NO: 838636 - RNA, 18 nt, Human
uauaaaaaagaaaagugc

SEQ ID NO: 838637 - RNA, 19 nt, Human
uauaagaagaaaccuauau

SEQ ID NO: 838638 - RNA, 21 nt, Human
uauaaucuauuuagcaacauc

SEQ ID NO: 838639 - RNA, 18 nt, Human
uaucuucuaucaagacuc

SEQ ID NO: 838640 - RNA, 25 nt, Human
uauggccgugagaagauaaaacaga

SEQ ID NO: 838641 - RNA, 25 nt, Human
uauuucuccauuccuuuaauuuugg

SEQ ID NO: 838642 - RNA, 21 nt, Human
ucaagguuuacagauuccagu

SEQ ID NO: 838643 - RNA, 23 nt, Human
ucccccaucucucuuuuuuuaua

SEQ ID NO: 838644 - RNA, 21 nt, Human
ucccuggccucuacccaauuc

SEQ ID NO: 838645 - RNA, 18 nt, Human
ucuaaagaauacagauau

SEQ ID NO: 838646 - RNA, 20 nt, Human
ucugugauccuaagaacaag

SEQ ID NO: 838647 - RNA, 21 nt, Human
ucuugucuuuuuucuccccca

SEQ ID NO: 838648 - RNA, 20 nt, Human
ucuuuuuucucccccaucuc

SEQ ID NO: 838649 - RNA, 18 nt, Human
ugaaaucauccucgcucc

SEQ ID NO: 838650 - RNA, 23 nt, Human
ugaauagaugggagcuagguaga

SEQ ID NO: 838651 - RNA, 20 nt, Human
ugagaagauaaaacagaucg

SEQ ID NO: 838652 - RNA, 21 nt, Human
ugagcaaaaagguugguagac

SEQ ID NO: 838653 - RNA, 18 nt, Human
ugauccuaagaacaaggg

SEQ ID NO: 838654 - RNA, 19 nt, Human
ugauccuaagaacaagggu

SEQ ID NO: 838655 - RNA, 26 nt, Human
ugccaaaugccuagugaaaucauccu

SEQ ID NO: 838656 - RNA, 19 nt, Human
ugcuacuaguaucccucca

SEQ ID NO: 838657 - RNA, 22 nt, Human
uguacuaaagugcuuuaucucu

SEQ ID NO: 838658 - RNA, 18 nt, Human
ugugugugugugugugug

SEQ ID NO: 838659 - RNA, 18 nt, Human
ugugugugugugugugug

SEQ ID NO: 838660 - RNA, 18 nt, Human
ugugugugugugugugug

SEQ ID NO: 838661 - RNA, 21 nt, Human
ugugugugugugugugugugu

SEQ ID NO: 838662 - RNA, 21 nt, Human
ugugugugugugugugugugu

SEQ ID NO: 838663 - RNA, 21 nt, Human
ugugugugugugugugugugu

SEQ ID NO: 838664 - RNA, 22 nt, Human
ugugugugugugugugugugug

SEQ ID NO: 838665 - RNA, 24 nt, Human
uuaggauuaacaaauaaacauacc

SEQ ID NO: 838666 - RNA, 21 nt, Human
uugucuuuuuucucccccauc

SEQ ID NO: 838667 - RNA, 20 nt, Human
uuugauaagagugauguccu

SEQ ID NO: 838668 - RNA, 19 nt, Human
uuugggacgucccccucaa

SEQ ID NO: 838669 - RNA, 23 nt, Human
aaagcagggguacucagagccca

SEQ ID NO: 838670 - RNA, 23 nt, Human
aagcagcaacuucacugagccca

SEQ ID NO: 838671 - RNA, 23 nt, Human
agcagcccccugccaugcagcaa

SEQ ID NO: 838672 - RNA, 20 nt, Human
agcuggcgguuuuggacaca

SEQ ID NO: 838673 - RNA, 24 nt, Human
aggaaaaacaaaauaacacuuuga

SEQ ID NO: 838674 - RNA, 23 nt, Human
aggcagccugagacaccuccucg

SEQ ID NO: 838675 - RNA, 20 nt, Human
agggguacucagagcccaga

SEQ ID NO: 838676 - RNA, 22 nt, Human
auggcggcggcgguggcuaagg

SEQ ID NO: 838677 - RNA, 25 nt, Human
auggcggcggcgguggcuaaggucc

SEQ ID NO: 838678 - RNA, 19 nt, Human
caaaggcugggccaggagc

SEQ ID NO: 838679 - RNA, 19 nt, Human
cacacagucuccaguuuag

SEQ ID NO: 838680 - RNA, 23 nt, Human
cacaggcaggacaggcuccuccu

SEQ ID NO: 838681 - RNA, 23 nt, Human
cacuggagcuccuggaucugaca

SEQ ID NO: 838682 - RNA, 23 nt, Human
cagagcccagagggcacacacag

SEQ ID NO: 838683 - RNA, 23 nt, Human
cagaugcccccaccgugucgucc

SEQ ID NO: 838684 - RNA, 19 nt, Human
cagcauaagagugacucca

SEQ ID NO: 838685 - RNA, 21 nt, Human
cagccaccccaccccggcucu

SEQ ID NO: 838686 - RNA, 21 nt, Human
cagccuaggcccaagcccaaa

SEQ ID NO: 838687 - RNA, 21 nt, Human
cagcuguguggccgugagagc

SEQ ID NO: 838688 - RNA, 23 nt, Human
caggagcgcaaaggccacaaccu

SEQ ID NO: 838689 - RNA, 21 nt, Human
caggcaggacaggcuccuccu

SEQ ID NO: 838690 - RNA, 21 nt, Human
cauggccacaggcaggacagg

SEQ ID NO: 838691 - RNA, 23 nt, Human
ccaagcccaaagcagggguacuc

SEQ ID NO: 838692 - RNA, 21 nt, Human
ccacaucgcgggccccugccu

SEQ ID NO: 838693 - RNA, 20 nt, Human
ccaccccggcucugagcccc

SEQ ID NO: 838694 - RNA, 22 nt, Human
ccagcgcccaggcugagguaaa

SEQ ID NO: 838695 - RNA, 20 nt, Human
ccaggagcgcaaaggccaca

SEQ ID NO: 838696 - RNA, 22 nt, Human
ccccaaccccugcugccauucc

SEQ ID NO: 838697 - RNA, 21 nt, Human
ccccaccgugucguccaucuc

SEQ ID NO: 838698 - RNA, 18 nt, Human
cccccugccaugcagcaa

SEQ ID NO: 838699 - RNA, 21 nt, Human
cccuaccccuccacgcugagc

SEQ ID NO: 838700 - RNA, 22 nt, Human
cccugcugccauucccccucca

SEQ ID NO: 838701 - RNA, 21 nt, Human
ccugcugccauucccccucca

SEQ ID NO: 838702 - RNA, 19 nt, Human
ccuggaucugacaggcugg

SEQ ID NO: 838703 - RNA, 20 nt, Human
cgacucaggcagccugagac

SEQ ID NO: 838704 - RNA, 26 nt, Human
cgcagccggggcugcaugccgggggc

SEQ ID NO: 838705 - RNA, 20 nt, Human
cggcagccugggccucugcc

SEQ ID NO: 838706 - RNA, 22 nt, Human
cguccaucuccccuucugcucc

SEQ ID NO: 838707 - RNA, 22 nt, Human
cuccaugguccacagccuugcc

SEQ ID NO: 838708 - RNA, 18 nt, Human
cuccucgggcucucuggg

SEQ ID NO: 838709 - RNA, 19 nt, Human
cugagcccagcagcagccc

SEQ ID NO: 838710 - RNA, 19 nt, Human
cugaggcugcagccacccc

SEQ ID NO: 838711 - RNA, 18 nt, Human
gaaaggaccagcgcccag

SEQ ID NO: 838712 - RNA, 22 nt, Human
gaggguggggcccacggcugcc

SEQ ID NO: 838713 - RNA, 18 nt, Human
gaucagggcacuggccag

SEQ ID NO: 838714 - RNA, 24 nt, Human
gaugcuguuuccccaaccccugcu

SEQ ID NO: 838715 - RNA, 18 nt, Human
gcagccggggcugcaugc

SEQ ID NO: 838716 - RNA, 19 nt, Human
gcaggacaggcuccuccuu

SEQ ID NO: 838717 - RNA, 21 nt, Human
gccaggagcgcaaaggccaca

SEQ ID NO: 838718 - RNA, 23 nt, Human
gcccagcagcagcccccugccau

SEQ ID NO: 838719 - RNA, 20 nt, Human
gcgucagucuugugccccca

SEQ ID NO: 838720 - RNA, 19 nt, Human
gcugcagccaccccacccc

SEQ ID NO: 838721 - RNA, 20 nt, Human
ggacuggcagagccaaccug

SEQ ID NO: 838722 - RNA, 20 nt, Human
ggagcgcaaaggccacaacc

SEQ ID NO: 838723 - RNA, 18 nt, Human
ggcacacacagucuccag

SEQ ID NO: 838724 - RNA, 20 nt, Human
ggccacaggcaggacaggcc

SEQ ID NO: 838725 - RNA, 24 nt, Human
ggcugcagccaccccaccccggcu

SEQ ID NO: 838726 - RNA, 20 nt, Human
gggcacagaccgacgcuggc

SEQ ID NO: 838727 - RNA, 22 nt, Human
gguggcgauggcggcggcggug

SEQ ID NO: 838728 - RNA, 23 nt, Human
gguggcgauggcggcggcggugg

SEQ ID NO: 838729 - RNA, 27 nt, Human
guggcgauggcggcggcgguggcuuuu

SEQ ID NO: 838730 - RNA, 22 nt, Human
gugucguccaucuccccuucug

SEQ ID NO: 838731 - RNA, 27 nt, Human
uaaaacagagacaacugcauugacaaa

SEQ ID NO: 838732 - RNA, 23 nt, Human
uacagcauaagagugacuccaac

SEQ ID NO: 838733 - RNA, 18 nt, Human
uccacaucgcgggccccu

SEQ ID NO: 838734 - RNA, 20 nt, Human
uccaguuuagaaacugggua

SEQ ID NO: 838735 - RNA, 30 nt, Human
ucccagccccuaccccuccacgcugagcuu

SEQ ID NO: 838736 - RNA, 19 nt, Human
ucccucaggcuugugggag

SEQ ID NO: 838737 - RNA, 22 nt, Human
ucccucaggcuugugggagcuc

SEQ ID NO: 838738 - RNA, 28 nt, Human
uccgcagccggggcugcaugccgggggc

SEQ ID NO: 838739 - RNA, 23 nt, Human
ucuaccagauggagugggcucug

SEQ ID NO: 838740 - RNA, 25 nt, Human
ucugggaucagggcacuggccaggc

SEQ ID NO: 838741 - RNA, 24 nt, Human
ugacaaaacuggauccccccucag

SEQ ID NO: 838742 - RNA, 22 nt, Human
ugcagccuaggcccaagcccaa

SEQ ID NO: 838743 - RNA, 18 nt, Human
ugcaugccgggggcccgg

SEQ ID NO: 838744 - RNA, 22 nt, Human
ugccaugcagcaaagggcgacc

SEQ ID NO: 838745 - RNA, 21 nt, Human
ugcccccaccgugucguccau

SEQ ID NO: 838746 - RNA, 18 nt, Human
ugccgggggcccgggcgg

SEQ ID NO: 838747 - RNA, 22 nt, Human
ugccuugcacacuguucccagc

SEQ ID NO: 838748 - RNA, 23 nt, Human
uggaaggaaaaacaaaauaacac

SEQ ID NO: 838749 - RNA, 22 nt, Human
uggcagagccaaccugggacuc

SEQ ID NO: 838750 - RNA, 21 nt, Human
uggcagcaguuccacaucgcg

SEQ ID NO: 838751 - RNA, 20 nt, Human
uggccacaggcaggacaggc

SEQ ID NO: 838752 - RNA, 23 nt, Human
uggcgauggcggcggcgguggcu

SEQ ID NO: 838753 - RNA, 21 nt, Human
uggcggcggcgguggcuaagg

SEQ ID NO: 838754 - RNA, 20 nt, Human
uggcugaggaagaacagagc

SEQ ID NO: 838755 - RNA, 19 nt, Human
ugggagaggcagggucaug

SEQ ID NO: 838756 - RNA, 24 nt, Human
ugggagcucauccagcccagagau

SEQ ID NO: 838757 - RNA, 19 nt, Human
ugggcgaggcuggcugagg

SEQ ID NO: 838758 - RNA, 18 nt, Human
uguaaaacagagacaacu

SEQ ID NO: 838759 - RNA, 25 nt, Human
uguaaaacagagacaacugcauuga

SEQ ID NO: 838760 - RNA, 19 nt, Human
uucccuucuaccagaugga

SEQ ID NO: 838761 - RNA, 21 nt, Human
uugcacacuguucccagcccc

SEQ ID NO: 838762 - RNA, 22 nt, Human
uuuuuuuuuuuuuuuccuuuaa

SEQ ID NO: 838763 - RNA, 22 nt, Human
uuuuuuuuuuuuuuuuuccuuu

SEQ ID NO: 838764 - RNA, 23 nt, Human
uuuuuuuuuuuuuuuuuuccuuu

SEQ ID NO: 838765 - RNA, 19 nt, Human
aaauagccacaagagucug

SEQ ID NO: 838766 - RNA, 21 nt, Human
aagcugccuuuguccucucca

SEQ ID NO: 838767 - RNA, 24 nt, Human
aagcugccuuuguccucuccauuc

SEQ ID NO: 838768 - RNA, 19 nt, Human
cacugaaccgcucccgcgc

SEQ ID NO: 838769 - RNA, 21 nt, Human
cacugaaccgcucccgcgccu

SEQ ID NO: 838770 - RNA, 18 nt, Human
caguccugggccccacuc

SEQ ID NO: 838771 - RNA, 22 nt, Human
caguccugggccccacucgccu

SEQ ID NO: 838772 - RNA, 23 nt, Human
cauccauccuugggccugucugg

SEQ ID NO: 838773 - RNA, 21 nt, Human
ccacgcuguccagucuccgcu

SEQ ID NO: 838774 - RNA, 22 nt, Human
ccccacucgccuggcuuccucc

SEQ ID NO: 838775 - RNA, 21 nt, Human
cccgcgccugccggauguccc

SEQ ID NO: 838776 - RNA, 19 nt, Human
ccucgguccccacuccagc

SEQ ID NO: 838777 - RNA, 26 nt, Human
ccugggccccacucgccuggcuuccu

SEQ ID NO: 838778 - RNA, 19 nt, Human
cggggcucagcagcuccac

SEQ ID NO: 838779 - RNA, 24 nt, Human
cuccagccccaugguacccggauc

SEQ ID NO: 838780 - RNA, 19 nt, Human
cugcaggcgagccagcucc

SEQ ID NO: 838781 - RNA, 18 nt, Human
gccccagguccuggggcu

SEQ ID NO: 838782 - RNA, 20 nt, Human
gccccagguccuggggcugg

SEQ ID NO: 838783 - RNA, 18 nt, Human
guggguguggccuccagc

SEQ ID NO: 838784 - RNA, 18 nt, Human
uccugccgcagcuguggc

SEQ ID NO: 838785 - RNA, 22 nt, Human
ucgccuggcuuccuccagucgc

SEQ ID NO: 838786 - RNA, 25 nt, Human
ucgguccccacuccagccccauggu

SEQ ID NO: 838787 - RNA, 23 nt, Human
ucucccggaaauagccacaagag

SEQ ID NO: 838788 - RNA, 24 nt, Human
ucucccggaaauagccacaagagu

SEQ ID NO: 838789 - RNA, 20 nt, Human
ucuccgcugcaggcgagcca

SEQ ID NO: 838790 - RNA, 22 nt, Human
ugaaccgcucccgcgccugccg

SEQ ID NO: 838791 - RNA, 18 nt, Human
uggugugucagaagcugc

SEQ ID NO: 838792 - RNA, 27 nt, Human
uugggugccugugguugguuucucuca

SEQ ID NO: 838793 - RNA, 22 nt, Human
acuaguuccugacaccccccua

SEQ ID NO: 838794 - RNA, 20 nt, Human
ccccuagggacucauuccug

SEQ ID NO: 838795 - RNA, 19 nt, Human
ggagaugaggacaugccau

SEQ ID NO: 838796 - RNA, 18 nt, Human
ugaggacaugccaugacc

SEQ ID NO: 838797 - RNA, 20 nt, Human
ugggagaugaggacaugcca

SEQ ID NO: 838798 - RNA, 23 nt, Human
ugggagcaguaggaucauccacu

SEQ ID NO: 838799 - RNA, 18 nt, Human
uuccugacaccccccuag

SEQ ID NO: 838800 - RNA, 19 nt, Human
aaagagccaaaagugugca

SEQ ID NO: 838801 - RNA, 22 nt, Human
aaauauaaagaacauauaccaa

SEQ ID NO: 838802 - RNA, 20 nt, Human
aacaaaauuuuccccaucuu

SEQ ID NO: 838803 - RNA, 24 nt, Human
aaucaaaaaugacuuaaaccaaaa

SEQ ID NO: 838804 - RNA, 29 nt, Human
aaucaaaaaugacuuaaaccaaaacuaag

SEQ ID NO: 838805 - RNA, 18 nt, Human
accacuuaaaacaaaauu

SEQ ID NO: 838806 - RNA, 20 nt, Human
auaaaaguacauuaucuaca

SEQ ID NO: 838807 - RNA, 21 nt, Human
auaaggccaacaaaaguaaaa

SEQ ID NO: 838808 - RNA, 18 nt, Human
auaccaaaaagagccaaa

SEQ ID NO: 838809 - RNA, 19 nt, Human
auaccacuuaaaacaaaau

SEQ ID NO: 838810 - RNA, 25 nt, Human
augaagaucauaaaucacaauuuag

SEQ ID NO: 838811 - RNA, 22 nt, Human
caaaaagagccaaaagugugca

SEQ ID NO: 838812 - RNA, 20 nt, Human
caaaaguaaaaauuccaaga

SEQ ID NO: 838813 - RNA, 21 nt, Human
caaauauaaacaccaguguac

SEQ ID NO: 838814 - RNA, 20 nt, Human
caagcauccauuaauguugc

SEQ ID NO: 838815 - RNA, 22 nt, Human
caaucaggaacauauuuuaaaa

SEQ ID NO: 838816 - RNA, 22 nt, Human
cacuuaaaacaaaauuuucccc

SEQ ID NO: 838817 - RNA, 18 nt, Human
caggugccccccgccucc

SEQ ID NO: 838818 - RNA, 22 nt, Human
cauaccacuuaaaacaaaauuu

SEQ ID NO: 838819 - RNA, 21 nt, Human
cauugccagcaucccauuuug

SEQ ID NO: 838820 - RNA, 23 nt, Human
ccccaggugccccccgccucccu

SEQ ID NO: 838821 - RNA, 22 nt, Human
ccccccgccucccucccgggca

SEQ ID NO: 838822 - RNA, 18 nt, Human
cccgccucccucccgggc

SEQ ID NO: 838823 - RNA, 20 nt, Human
cggagagagggcgccgcggc

SEQ ID NO: 838824 - RNA, 20 nt, Human
cucaugccacaauaaauuac

SEQ ID NO: 838825 - RNA, 24 nt, Human
cucccucccgggcaggggaggggg

SEQ ID NO: 838826 - RNA, 24 nt, Human
cuucaagcauccauuaauguugca

SEQ ID NO: 838827 - RNA, 23 nt, Human
gcaaagacaagcaaucuuacagg

SEQ ID NO: 838828 - RNA, 25 nt, Human
gcagcuuuuguacagcuucaagcau

SEQ ID NO: 838829 - RNA, 22 nt, Human
ggccccaggugccccccgccuc

SEQ ID NO: 838830 - RNA, 22 nt, Human
gggccccaggugccccccgccu

SEQ ID NO: 838831 - RNA, 25 nt, Human
uaaaauaaaugaagaucauaaauca

SEQ ID NO: 838832 - RNA, 27 nt, Human
uaaagaacauauaccaaaaagagccaa

SEQ ID NO: 838833 - RNA, 18 nt, Human
uaacuaaauuauuuuggc

SEQ ID NO: 838834 - RNA, 19 nt, Human
uaagucaaaagaaauauga

SEQ ID NO: 838835 - RNA, 18 nt, Human
uagccacacccaagaaua

SEQ ID NO: 838836 - RNA, 22 nt, Human
uauaaaaugauuacagccucca

SEQ ID NO: 838837 - RNA, 22 nt, Human
uauaaagaacauauaccaaaaa

SEQ ID NO: 838838 - RNA, 23 nt, Human
uaugcuaaauauauccauaccac

SEQ ID NO: 838839 - RNA, 22 nt, Human
ucaaaaaugacuuaaaccaaaa

SEQ ID NO: 838840 - RNA, 19 nt, Human
ucaacauuuacaucuguac

SEQ ID NO: 838841 - RNA, 18 nt, Human
ucauugccagcaucccau

SEQ ID NO: 838842 - RNA, 22 nt, Human
uccauaccacuuaaaacaaaau

SEQ ID NO: 838843 - RNA, 24 nt, Human
ucccucccgggcaggggagggggg

SEQ ID NO: 838844 - RNA, 20 nt, Human
ugaauuaagcacuugugugg

SEQ ID NO: 838845 - RNA, 22 nt, Human
ugacuuaaaccaaaacuaaguu

SEQ ID NO: 838846 - RNA, 23 nt, Human
ugacuuaauacaucacauaucaa

SEQ ID NO: 838847 - RNA, 24 nt, Human
ugccacaauaaauuacaaaguaac

SEQ ID NO: 838848 - RNA, 20 nt, Human
ugccagcaucccauuuugua

SEQ ID NO: 838849 - RNA, 22 nt, Human
uggaaaaaagcaaucaaaaaug

SEQ ID NO: 838850 - RNA, 24 nt, Human
uuaaaaaacauguuuauuuuacaa

SEQ ID NO: 838851 - RNA, 20 nt, Human
uuaaaacaaaauuuucccca

SEQ ID NO: 838852 - RNA, 25 nt, Human
uuaaaauaaaugaagaucauaaauc

SEQ ID NO: 838853 - RNA, 24 nt, Human
uuaaaauauuaaccccaauugcau

SEQ ID NO: 838854 - RNA, 22 nt, Human
uuacugcagcuuuuguacagcu

SEQ ID NO: 838855 - RNA, 22 nt, Human
uuacugcagcuuuuguacagcu

SEQ ID NO: 838856 - RNA, 22 nt, Human
uucaagcauccauuaauguugc

SEQ ID NO: 838857 - RNA, 24 nt, Human
uucauugccagcaucccauuuugu

SEQ ID NO: 838858 - RNA, 25 nt, Human
uucauugccagcaucccauuuugua

SEQ ID NO: 838859 - RNA, 20 nt, Human
uuugugcaaauauaaacacc

SEQ ID NO: 838860 - RNA, 18 nt, Human
uuuuuuuuuuuuuuuuug

SEQ ID NO: 838861 - RNA, 20 nt, Human
uuuuuuuuuuuuuuuuuguu

SEQ ID NO: 838862 - RNA, 23 nt, Human
accaaaaaacaaauaacaauaaa

SEQ ID NO: 838863 - RNA, 18 nt, Human
agacucuggaggccagua

SEQ ID NO: 838864 - RNA, 18 nt, Human
aggaacaggaaggagggg

SEQ ID NO: 838865 - RNA, 22 nt, Human
aggggagagaacccaacacaug

SEQ ID NO: 838866 - RNA, 20 nt, Human
caccaaaaaacaaauaacaa

SEQ ID NO: 838867 - RNA, 24 nt, Human
ccagcugcauugcagccuugauuu

SEQ ID NO: 838868 - RNA, 24 nt, Human
gaagacucuggaggccaguaaucc

SEQ ID NO: 838869 - RNA, 23 nt, Human
gaggggagagaacccaacacaug

SEQ ID NO: 838870 - RNA, 22 nt, Human
gccaccaaaaaacaaauaacaa

SEQ ID NO: 838871 - RNA, 24 nt, Human
gguauauaagaggaacaggaagga

SEQ ID NO: 838872 - RNA, 21 nt, Human
aacagcacacccaccccggcu

SEQ ID NO: 838873 - RNA, 19 nt, Human
aagacagcccccuaccucc

SEQ ID NO: 838874 - RNA, 24 nt, Human
acacacccacgggugaacacaaga

SEQ ID NO: 838875 - RNA, 33 nt, Human
acacauguuugugcaugcauacaugcguguagu

SEQ ID NO: 838876 - RNA, 18 nt, Human
acacccaggcuucccugg

SEQ ID NO: 838877 - RNA, 18 nt, Human
acacccaggcuucccugg

SEQ ID NO: 838878 - RNA, 23 nt, Human
acagcccccuaccuccaggcuga

SEQ ID NO: 838879 - RNA, 23 nt, Human
acauguacacacauguuugugca

SEQ ID NO: 838880 - RNA, 21 nt, Human
accucucccuuugagucuccc

SEQ ID NO: 838881 - RNA, 25 nt, Human
acgcucauccacacgugcccacaca

SEQ ID NO: 838882 - RNA, 21 nt, Human
agagccacacccccaacucag

SEQ ID NO: 838883 - RNA, 21 nt, Human
agagccacacccccaacucag

SEQ ID NO: 838884 - RNA, 19 nt, Human
agccugguggcacacuggc

SEQ ID NO: 838885 - RNA, 21 nt, Human
aggcacuugacacccaggcuu

SEQ ID NO: 838886 - RNA, 21 nt, Human
aggcacuugacacccaggcuu

SEQ ID NO: 838887 - RNA, 23 nt, Human
aggccagcuguggaagggugcag

SEQ ID NO: 838888 - RNA, 23 nt, Human
aggugccucucgaggaaaccagg

SEQ ID NO: 838889 - RNA, 24 nt, Human
aguagccagaagaggacaggagga

SEQ ID NO: 838890 - RNA, 25 nt, Human
auguacacacauguuugugcaugca

SEQ ID NO: 838891 - RNA, 20 nt, Human
auucacacgcaccacaucac

SEQ ID NO: 838892 - RNA, 25 nt, Human
caagaggucacccccuuuccagggc

SEQ ID NO: 838893 - RNA, 25 nt, Human
caagaggucacccccuuuccagggc

SEQ ID NO: 838894 - RNA, 19 nt, Human
caagccccuccacaggcuc

SEQ ID NO: 838895 - RNA, 23 nt, Human
cacacacacccacgggugaacac

SEQ ID NO: 838896 - RNA, 21 nt, Human
cacacacccacgggugaacac

SEQ ID NO: 838897 - RNA, 22 nt, Human
cacacgcaccacaucacaugug

SEQ ID NO: 838898 - RNA, 19 nt, Human
cacacgugcccacacacac

SEQ ID NO: 838899 - RNA, 21 nt, Human
cacacgugcccacacacaccc

SEQ ID NO: 838900 - RNA, 22 nt, Human
cacacgugcccacacacaccca

SEQ ID NO: 838901 - RNA, 22 nt, Human
cacacuggcucugccucuccuc

SEQ ID NO: 838902 - RNA, 28 nt, Human
cacauguacacacauguuugugcaugca

SEQ ID NO: 838903 - RNA, 22 nt, Human
caccacaucacaugugcccuga

SEQ ID NO: 838904 - RNA, 19 nt, Human
cacccaccccggcuccagc

SEQ ID NO: 838905 - RNA, 18 nt, Human
cacccccuuuccagggca

SEQ ID NO: 838906 - RNA, 18 nt, Human
cacccccuuuccagggca

SEQ ID NO: 838907 - RNA, 19 nt, Human
caccucagaucuccggcug

SEQ ID NO: 838908 - RNA, 22 nt, Human
cacgugcccacacacacccacg

SEQ ID NO: 838909 - RNA, 21 nt, Human
cacugagaccucucccuuuga

SEQ ID NO: 838910 - RNA, 22 nt, Human
cagaaagcccugggacagaaga

SEQ ID NO: 838911 - RNA, 22 nt, Human
cagagcaccucagaucuccggc

SEQ ID NO: 838912 - RNA, 18 nt, Human
cagccgccgcuccgcccg

SEQ ID NO: 838913 - RNA, 23 nt, Human
cagcgcguccuccagaaagcccu

SEQ ID NO: 838914 - RNA, 22 nt, Human
caggaggaccaagguaggccca

SEQ ID NO: 838915 - RNA, 25 nt, Human
caucuaggaccccacagucaggucc

SEQ ID NO: 838916 - RNA, 27 nt, Human
cccagccccgcgccccgcgccgguucc

SEQ ID NO: 838917 - RNA, 21 nt, Human
cccccuaccuccaggcugagc

SEQ ID NO: 838918 - RNA, 24 nt, Human
ccccgcgccccgcgcccgcgcccg

SEQ ID NO: 838919 - RNA, 18 nt, Human
ccccucgaggcaagaggu

SEQ ID NO: 838920 - RNA, 18 nt, Human
ccccucgaggcaagaggu

SEQ ID NO: 838921 - RNA, 18 nt, Human
cccgggcccagccccgcg

SEQ ID NO: 838922 - RNA, 21 nt, Human
cccugggacagaagagagccc

SEQ ID NO: 838923 - RNA, 21 nt, Human
ccuacacauggcaagcacaug

SEQ ID NO: 838924 - RNA, 21 nt, Human
ccuccacaggcucucaggggc

SEQ ID NO: 838925 - RNA, 18 nt, Human
ccuccagaaagcccuggg

SEQ ID NO: 838926 - RNA, 20 nt, Human
ccucucgaggaaaccaggcc

SEQ ID NO: 838927 - RNA, 22 nt, Human
ccugaaggcgagggguccuagg

SEQ ID NO: 838928 - RNA, 22 nt, Human
ccuuugagucucccgggguccc

SEQ ID NO: 838929 - RNA, 18 nt, Human
cgagggguccuaggccag

SEQ ID NO: 838930 - RNA, 20 nt, Human
cgcccgagccgagcccgagc

SEQ ID NO: 838931 - RNA, 23 nt, Human
cgcucauccacacgugcccacac

SEQ ID NO: 838932 - RNA, 21 nt, Human
cgcuccgcccgggcccagccc

SEQ ID NO: 838933 - RNA, 23 nt, Human
cucaaggcaucaggaaccgagga

SEQ ID NO: 838934 - RNA, 20 nt, Human
cuccgcccgggcccagcccc

SEQ ID NO: 838935 - RNA, 18 nt, Human
cucucgaggaaaccaggc

SEQ ID NO: 838936 - RNA, 22 nt, Human
cugacccacagaccagagcacc

SEQ ID NO: 838937 - RNA, 23 nt, Human
cugggccccucgaggcaagaggu

SEQ ID NO: 838938 - RNA, 23 nt, Human
cugggccccucgaggcaagaggu

SEQ ID NO: 838939 - RNA, 20 nt, Human
gaagagagcccaaggcugac

SEQ ID NO: 838940 - RNA, 22 nt, Human
gacagaagagagcccaaggcug

SEQ ID NO: 838941 - RNA, 18 nt, Human
gagcagcucuaaccacug

SEQ ID NO: 838942 - RNA, 18 nt, Human
gagccacacccccaacuc

SEQ ID NO: 838943 - RNA, 18 nt, Human
gagccacacccccaacuc

SEQ ID NO: 838944 - RNA, 25 nt, Human
gagcccaaggcugacacucccuugg

SEQ ID NO: 838945 - RNA, 23 nt, Human
gagcccgagccgagcggagcgga

SEQ ID NO: 838946 - RNA, 20 nt, Human
gaggaccaagguaggcccag

SEQ ID NO: 838947 - RNA, 19 nt, Human
gccagucugaaacaccccu

SEQ ID NO: 838948 - RNA, 23 nt, Human
gcucauccacacgugcccacaca

SEQ ID NO: 838949 - RNA, 22 nt, Human
ggaaagaggacugacccacaga

SEQ ID NO: 838950 - RNA, 24 nt, Human
ggcaucaggaaccgaggagaggga

SEQ ID NO: 838951 - RNA, 21 nt, Human
gggacagacaggggaacuccg

SEQ ID NO: 838952 - RNA, 19 nt, Human
gggccccucgaggcaagag

SEQ ID NO: 838953 - RNA, 19 nt, Human
gggccccucgaggcaagag

SEQ ID NO: 838954 - RNA, 20 nt, Human
guagccagaagaggacagga

SEQ ID NO: 838955 - RNA, 25 nt, Human
guaggcccagggacacuugugccca

SEQ ID NO: 838956 - RNA, 19 nt, Human
uaccuccaggcugagcagc

SEQ ID NO: 838957 - RNA, 22 nt, Human
uacuggaucagcuccauccugg

SEQ ID NO: 838958 - RNA, 21 nt, Human
uaggaccccacagucaggucc

SEQ ID NO: 838959 - RNA, 19 nt, Human
ucacacgcaccacaucaca

SEQ ID NO: 838960 - RNA, 26 nt, Human
ucagaucuccggcugcagggccacaa

SEQ ID NO: 838961 - RNA, 21 nt, Human
uccagggcagagccacacccc

SEQ ID NO: 838962 - RNA, 21 nt, Human
uccagggcagagccacacccc

SEQ ID NO: 838963 - RNA, 24 nt, Human
uccagggcagagccacacccccaa

SEQ ID NO: 838964 - RNA, 24 nt, Human
uccagggcagagccacacccccaa

SEQ ID NO: 838965 - RNA, 24 nt, Human
ucucaggggcugcugggcagcacc

SEQ ID NO: 838966 - RNA, 19 nt, Human
ucuccugaaggcgaggggu

SEQ ID NO: 838967 - RNA, 20 nt, Human
ucuccugaaggcgagggguu

SEQ ID NO: 838968 - RNA, 19 nt, Human
ucucgaggaaaccaggcca

SEQ ID NO: 838969 - RNA, 20 nt, Human
ucugccucuccucuuagacc

SEQ ID NO: 838970 - RNA, 20 nt, Human
ugacacccaggcuucccugg

SEQ ID NO: 838971 - RNA, 20 nt, Human
ugacacccaggcuucccugg

SEQ ID NO: 838972 - RNA, 19 nt, Human
ugaccauaggaguguggga

SEQ ID NO: 838973 - RNA, 21 nt, Human
ugcacgcucauccacacgugg

SEQ ID NO: 838974 - RNA, 20 nt, Human
ugcaguagccagaagaggac

SEQ ID NO: 838975 - RNA, 27 nt, Human
ugcaugcauacaugcguguagauucuc

SEQ ID NO: 838976 - RNA, 18 nt, Human
uggagagugcaguagcca

SEQ ID NO: 838977 - RNA, 19 nt, Human
uggcacacuggcucugccu

SEQ ID NO: 838978 - RNA, 18 nt, Human
uuacuggaucagcuccau

SEQ ID NO: 838979 - RNA, 23 nt, Human
uuacuggaucagcuccaucaugc

SEQ ID NO: 838980 - RNA, 20 nt, Human
uucccugggccccucgaggc

SEQ ID NO: 838981 - RNA, 19 nt, Human
uugagucucccgggguccc

SEQ ID NO: 838982 - RNA, 19 nt, Human
uuucucauuugacaccugg

SEQ ID NO: 838983 - RNA, 23 nt, Human
uuuuuuuagagagaacccccuuu

SEQ ID NO: 838984 - RNA, 25 nt, Human
aacgggcucccagcgccccgacccc

SEQ ID NO: 838985 - RNA, 21 nt, Human
aagaagggcugaguuugguag

SEQ ID NO: 838986 - RNA, 22 nt, Human
aaggaaagggccccaccugcag

SEQ ID NO: 838987 - RNA, 23 nt, Human
aagggaccacagcccugccaaca

SEQ ID NO: 838988 - RNA, 18 nt, Human
accacagcccugccaaca

SEQ ID NO: 838989 - RNA, 18 nt, Human
acccuucuguccucugcu

SEQ ID NO: 838990 - RNA, 20 nt, Human
acucagccccacucuggcgg

SEQ ID NO: 838991 - RNA, 18 nt, Human
acugguccuugggcagug

SEQ ID NO: 838992 - RNA, 20 nt, Human
agcgcccacucagccccacu

SEQ ID NO: 838993 - RNA, 25 nt, Human
agcgcccacucagccccacucuggc

SEQ ID NO: 838994 - RNA, 19 nt, Human
cacagcaucacugccauag

SEQ ID NO: 838995 - RNA, 21 nt, Human
cacagcccugccaacaccucc

SEQ ID NO: 838996 - RNA, 19 nt, Human
cacaggauuagggugggcc

SEQ ID NO: 838997 - RNA, 21 nt, Human
caccuccaucccagauuucca

SEQ ID NO: 838998 - RNA, 22 nt, Human
cagcgcccacucagccccacuc

SEQ ID NO: 838999 - RNA, 18 nt, Human
cagcgccccgacccccgc

SEQ ID NO: 839000 - RNA, 23 nt, Human
ccaacacagcaucacugccauag

SEQ ID NO: 839001 - RNA, 19 nt, Human
ccacagcccugccaacacc

SEQ ID NO: 839002 - RNA, 19 nt, Human
cccacauaaggagaaggac

SEQ ID NO: 839003 - RNA, 18 nt, Human
cccagauuuccagccucc

SEQ ID NO: 839004 - RNA, 21 nt, Human
ccccaccugcaggcgauucuc

SEQ ID NO: 839005 - RNA, 19 nt, Human
ccccacucuggcgggaagg

SEQ ID NO: 839006 - RNA, 23 nt, Human
ccccagagccuucaaagggaccc

SEQ ID NO: 839007 - RNA, 18 nt, Human
ccccgcugcgcccgcccc

SEQ ID NO: 839008 - RNA, 24 nt, Human
ccgccacaagcuaaaaagagccaa

SEQ ID NO: 839009 - RNA, 26 nt, Human
ccgccacaagcuaaaaagagccaagg

SEQ ID NO: 839010 - RNA, 20 nt, Human
ccuccagaacuguaagggaa

SEQ ID NO: 839011 - RNA, 26 nt, Human
ccugagaaugugacuuuauuuggaac

SEQ ID NO: 839012 - RNA, 22 nt, Human
ccugccaacaccuccaucccag

SEQ ID NO: 839013 - RNA, 24 nt, Human
ccuugggcagugucuggccggugg

SEQ ID NO: 839014 - RNA, 25 nt, Human
cgcggcccaacgggcucccagcgcc

SEQ ID NO: 839015 - RNA, 19 nt, Human
cgcugcgcccgccccgcgc

SEQ ID NO: 839016 - RNA, 18 nt, Human
cucccaaccgacaucuuu

SEQ ID NO: 839017 - RNA, 23 nt, Human
cucccagcgccccgacccccgcu

SEQ ID NO: 839018 - RNA, 20 nt, Human
cugccaacaccuccauccca

SEQ ID NO: 839019 - RNA, 22 nt, Human
cugcuugaaaggcuguauucca

SEQ ID NO: 839020 - RNA, 21 nt, Human
gagaacagaagagacagagac

SEQ ID NO: 839021 - RNA, 23 nt, Human
gcggccccggcguggcggcugcg

SEQ ID NO: 839022 - RNA, 23 nt, Human
ggcagugucuggccgguggugcc

SEQ ID NO: 839023 - RNA, 19 nt, Human
gggaaggaaagggccccac

SEQ ID NO: 839024 - RNA, 19 nt, Human
gggaaucaaguucugcugu

SEQ ID NO: 839025 - RNA, 21 nt, Human
ggugggcccuaaauccaauga

SEQ ID NO: 839026 - RNA, 20 nt, Human
uaauucguuagagcaucccu

SEQ ID NO: 839027 - RNA, 21 nt, Human
uaggaaaccaacacagcauca

SEQ ID NO: 839028 - RNA, 21 nt, Human
uaggcccccggccuggcucag

SEQ ID NO: 839029 - RNA, 22 nt, Human
ucccacauaaggagaaggaccc

SEQ ID NO: 839030 - RNA, 21 nt, Human
uccccagagccuucaaaggga

SEQ ID NO: 839031 - RNA, 25 nt, Human
uccccagagccuucaaagggaccac

SEQ ID NO: 839032 - RNA, 20 nt, Human
ucuacuaggcccauuuccca

SEQ ID NO: 839033 - RNA, 20 nt, Human
ucuguccucugcuugaaagg

SEQ ID NO: 839034 - RNA, 22 nt, Human
ugccgccacaagcuaaaaagag

SEQ ID NO: 839035 - RNA, 23 nt, Human
uggaaccugagaaugugacuuua

SEQ ID NO: 839036 - RNA, 18 nt, Human
uggcgggaaggaaagggc

SEQ ID NO: 839037 - RNA, 25 nt, Human
ugucuggccgguggugccaugccgg

SEQ ID NO: 839038 - RNA, 22 nt, Human
uguuucaauccaccagguuugu

SEQ ID NO: 839039 - RNA, 18 nt, Human
uuauuuggaacuagagua

SEQ ID NO: 839040 - RNA, 20 nt, Human
uucucccaaccgacaucuuu

SEQ ID NO: 839041 - RNA, 18 nt, Human
uucuuccccagagccuuc

SEQ ID NO: 839042 - RNA, 18 nt, Human
aaaaagaaagucuggauu

SEQ ID NO: 839043 - RNA, 24 nt, Human
aaaaagacaaaacacauuucauga

SEQ ID NO: 839044 - RNA, 23 nt, Human
aaaauccuuacuaaaugacacca

SEQ ID NO: 839045 - RNA, 20 nt, Human
aaacuggcaucaaaaggaaa

SEQ ID NO: 839046 - RNA, 24 nt, Human
aagaaacucaaacggaaugaaaug

SEQ ID NO: 839047 - RNA, 26 nt, Human
aagaaugcauaccagaaccggggccc

SEQ ID NO: 839048 - RNA, 19 nt, Human
aagcaccuccaaaauacaa

SEQ ID NO: 839049 - RNA, 21 nt, Human
aauaaacacaauuaagacuuc

SEQ ID NO: 839050 - RNA, 20 nt, Human
acgaaaacaagaaacucaaa

SEQ ID NO: 839051 - RNA, 20 nt, Human
acuacaauaaugauguaccc

SEQ ID NO: 839052 - RNA, 20 nt, Human
acuauugccuuuuccuuuca

SEQ ID NO: 839053 - RNA, 23 nt, Human
agaaaaagaaagucuggauuuua

SEQ ID NO: 839054 - RNA, 25 nt, Human
aggaagaaaacuggcaucaaaagga

SEQ ID NO: 839055 - RNA, 23 nt, Human
aggcaacaaaccauagugccaaa

SEQ ID NO: 839056 - RNA, 23 nt, Human
augaaaaaugucuuaggaaaaaa

SEQ ID NO: 839057 - RNA, 26 nt, Human
caaaaagugaauaaauaugcacacaa

SEQ ID NO: 839058 - RNA, 18 nt, Human
caaauggaaaaaguauau

SEQ ID NO: 839059 - RNA, 23 nt, Human
caacaggcuucuaugaacauucu

SEQ ID NO: 839060 - RNA, 24 nt, Human
cacaagucuaacauuuguuuuuuu

SEQ ID NO: 839061 - RNA, 20 nt, Human
cacagugcagauacauucag

SEQ ID NO: 839062 - RNA, 19 nt, Human
cacuaguaauaaaaaaaga

SEQ ID NO: 839063 - RNA, 24 nt, Human
cacuaguaauaaaaaaagacaaaa

SEQ ID NO: 839064 - RNA, 26 nt, Human
cacuguguaaauuucaaggcaagguu

SEQ ID NO: 839065 - RNA, 26 nt, Human
caguaaaaacaaaaugucuuaucaug

SEQ ID NO: 839066 - RNA, 22 nt, Human
caguaugaaaaacuugaaaaua

SEQ ID NO: 839067 - RNA, 22 nt, Human
caugcuugccuugggaugggga

SEQ ID NO: 839068 - RNA, 25 nt, Human
cauguagaaaaagaaagucuggauu

SEQ ID NO: 839069 - RNA, 18 nt, Human
cauuuucaguugcugcug

SEQ ID NO: 839070 - RNA, 23 nt, Human
ccaaaauacaaauuccuauacac

SEQ ID NO: 839071 - RNA, 23 nt, Human
cggcauucauuuucaguugcugc

SEQ ID NO: 839072 - RNA, 19 nt, Human
cucacauguagaaaaagaa

SEQ ID NO: 839073 - RNA, 21 nt, Human
cucacauguagaaaaagaaag

SEQ ID NO: 839074 - RNA, 24 nt, Human
cugguccugagcagcaucauucua

SEQ ID NO: 839075 - RNA, 23 nt, Human
cuuaaaaugaacacuuaaguaaa

SEQ ID NO: 839076 - RNA, 28 nt, Human
cuuaaacacuaguaauaaaaaaagacaa

SEQ ID NO: 839077 - RNA, 25 nt, Human
cuuacuauugccuuuuccuuucaaa

SEQ ID NO: 839078 - RNA, 23 nt, Human
cuuagauuuaaagcucaaaaagc

SEQ ID NO: 839079 - RNA, 21 nt, Human
cuuccaugcacacaagucuaa

SEQ ID NO: 839080 - RNA, 21 nt, Human
gaauagaucauucaguaaaaa

SEQ ID NO: 839081 - RNA, 22 nt, Human
gcuggcggcagcggcgucuccg

SEQ ID NO: 839082 - RNA, 21 nt, Human
ggaaagaucuuucaaaaaggg

SEQ ID NO: 839083 - RNA, 23 nt, Human
ggcggcagcggcgucuccgaggc

SEQ ID NO: 839084 - RNA, 24 nt, Human
gucgaguuccccuuagauuuaaag

SEQ ID NO: 839085 - RNA, 18 nt, Human
gugaagcacuaugggugg

SEQ ID NO: 839086 - RNA, 20 nt, Human
gugcauuucuuuucuccucc

SEQ ID NO: 839087 - RNA, 19 nt, Human
uaaccaaagauacagacag

SEQ ID NO: 839088 - RNA, 22 nt, Human
uaaccaaagauacagacaguau

SEQ ID NO: 839089 - RNA, 21 nt, Human
uaacgaaaacaagaaacucaa

SEQ ID NO: 839090 - RNA, 20 nt, Human
uaagagacugcgaugccaca

SEQ ID NO: 839091 - RNA, 21 nt, Human
uaaguaaauuaaguacgugga

SEQ ID NO: 839092 - RNA, 24 nt, Human
uaaguaaauuaaguacguggacag

SEQ ID NO: 839093 - RNA, 21 nt, Human
uacaguaugaaaaacuugaaa

SEQ ID NO: 839094 - RNA, 20 nt, Human
uagauaacacauguguacca

SEQ ID NO: 839095 - RNA, 24 nt, Human
uagaugcagcuagguaggcaacaa

SEQ ID NO: 839096 - RNA, 23 nt, Human
uaggaaaaaaauagcuauuuuca

SEQ ID NO: 839097 - RNA, 18 nt, Human
uagguaggcaacaaacca

SEQ ID NO: 839098 - RNA, 19 nt, Human
uaugaaaaacuugaaaaua

SEQ ID NO: 839099 - RNA, 23 nt, Human
uaugcacacaacaggcuucuaug

SEQ ID NO: 839100 - RNA, 20 nt, Human
uauuaacacuucacuauaaa

SEQ ID NO: 839101 - RNA, 21 nt, Human
ucaaaaagggagaagaaaaau

SEQ ID NO: 839102 - RNA, 26 nt, Human
uccuuuguugcuauauauuuauuuca

SEQ ID NO: 839103 - RNA, 19 nt, Human
uccuuuuucuucaaacagg

SEQ ID NO: 839104 - RNA, 18 nt, Human
ucuaugaacauucuccuc

SEQ ID NO: 839105 - RNA, 18 nt, Human
ucuauucauauugagaau

SEQ ID NO: 839106 - RNA, 19 nt, Human
ugaacauucuccucacagu

SEQ ID NO: 839107 - RNA, 20 nt, Human
ugacauuauagaugcagcua

SEQ ID NO: 839108 - RNA, 23 nt, Human
ugagguagauaacacauguguac

SEQ ID NO: 839109 - RNA, 24 nt, Human
ugccaaacaggccugucgaguucc

SEQ ID NO: 839110 - RNA, 21 nt, Human
ugcugcugguaucauguguuu

SEQ ID NO: 839111 - RNA, 22 nt, Human
ugcuuccacagcaagaugguuu

SEQ ID NO: 839112 - RNA, 22 nt, Human
uggcaucaaaaggaaagaucuu

SEQ ID NO: 839113 - RNA, 22 nt, Human
ugguuaacagaagaugucuuuu

SEQ ID NO: 839114 - RNA, 24 nt, Human
uguaaacaaggaagaaaacuggca

SEQ ID NO: 839115 - RNA, 24 nt, Human
uguagauagaucaagcaccuccaa

SEQ ID NO: 839116 - RNA, 21 nt, Human
uguuuuaagaaauguguacag

SEQ ID NO: 839117 - RNA, 24 nt, Human
uguuuuauuuguccuuuuucuuca

SEQ ID NO: 839118 - RNA, 20 nt, Human
uucaagaaaggggcagcaac

SEQ ID NO: 839119 - RNA, 22 nt, Human
uucaagaaaggggcagcaacuc

SEQ ID NO: 839120 - RNA, 22 nt, Human
uucuaggagcauuuuauaauaa

SEQ ID NO: 839121 - RNA, 20 nt, Human
uuguauuugcuggccauguu

SEQ ID NO: 839122 - RNA, 21 nt, Human
uuuauuaagaauaguuuacua

SEQ ID NO: 839123 - RNA, 22 nt, Human
uuugccacauacucuuguuacc

SEQ ID NO: 839124 - RNA, 22 nt, Human
aaccgacuccccaucccuccca

SEQ ID NO: 839125 - RNA, 22 nt, Human
aaccgacuccccaucccuccca

SEQ ID NO: 839126 - RNA, 23 nt, Human
aaguagucaucuacagcagccca

SEQ ID NO: 839127 - RNA, 25 nt, Human
aaguagucaucuacagcagcccaga

SEQ ID NO: 839128 - RNA, 20 nt, Human
aaugacuaaccgacucccca

SEQ ID NO: 839129 - RNA, 20 nt, Human
aaugacuaaccgacucccca

SEQ ID NO: 839130 - RNA, 20 nt, Human
acagcagcccagaggcccag

SEQ ID NO: 839131 - RNA, 21 nt, Human
accgacuccccaucccuccca

SEQ ID NO: 839132 - RNA, 21 nt, Human
accgacuccccaucccuccca

SEQ ID NO: 839133 - RNA, 19 nt, Human
caaagucggaucuguugac

SEQ ID NO: 839134 - RNA, 24 nt, Human
caaguagucaucuacagcagccca

SEQ ID NO: 839135 - RNA, 21 nt, Human
caaugacuaaccgacuccccc

SEQ ID NO: 839136 - RNA, 21 nt, Human
caaugacuaaccgacuccccc

SEQ ID NO: 839137 - RNA, 19 nt, Human
caccccccgauggcccaag

SEQ ID NO: 839138 - RNA, 19 nt, Human
caccccccgauggcccaag

SEQ ID NO: 839139 - RNA, 20 nt, Human
ccaaagucggaucuguugac

SEQ ID NO: 839140 - RNA, 22 nt, Human
cccaccccccgauggcccaagu

SEQ ID NO: 839141 - RNA, 22 nt, Human
cccaccccccgauggcccaagu

SEQ ID NO: 839142 - RNA, 23 nt, Human
cccucccaccccccgauggccca

SEQ ID NO: 839143 - RNA, 23 nt, Human
cccucccaccccccgauggccca

SEQ ID NO: 839144 - RNA, 25 nt, Human
ccucccaccccccgauggcccaagu

SEQ ID NO: 839145 - RNA, 25 nt, Human
ccucccaccccccgauggcccaagu

SEQ ID NO: 839146 - RNA, 21 nt, Human
cgacuccccaucccucccacc

SEQ ID NO: 839147 - RNA, 21 nt, Human
cgacuccccaucccucccacc

SEQ ID NO: 839148 - RNA, 22 nt, Human
cgacuccccaucccucccaccc

SEQ ID NO: 839149 - RNA, 22 nt, Human
cgacuccccaucccucccaccc

SEQ ID NO: 839150 - RNA, 24 nt, Human
cgacuccccaucccucccaccccc

SEQ ID NO: 839151 - RNA, 24 nt, Human
cgacuccccaucccucccaccccc

SEQ ID NO: 839152 - RNA, 23 nt, Human
cuacagcagcccagaggcccagc

SEQ ID NO: 839153 - RNA, 19 nt, Human
cucccaccccccgauggcc

SEQ ID NO: 839154 - RNA, 19 nt, Human
cucccaccccccgauggcc

SEQ ID NO: 839155 - RNA, 20 nt, Human
gacuccccaucccucccacc

SEQ ID NO: 839156 - RNA, 22 nt, Human
gacuccccaucccucccacccc

SEQ ID NO: 839157 - RNA, 22 nt, Human
gacuccccaucccucccacccc

SEQ ID NO: 839158 - RNA, 24 nt, Human
gacuccccaucccucccacccccc

SEQ ID NO: 839159 - RNA, 24 nt, Human
gacuccccaucccucccacccccc

SEQ ID NO: 839160 - RNA, 22 nt, Human
gcugcugcuucuagacugcugu

SEQ ID NO: 839161 - RNA, 23 nt, Human
guagucaucuacagcagcccaga

SEQ ID NO: 839162 - RNA, 23 nt, Human
uaaccgacuccccaucccuccca

SEQ ID NO: 839163 - RNA, 23 nt, Human
uaaccgacuccccaucccuccca

SEQ ID NO: 839164 - RNA, 22 nt, Human
ucaucuacagcagcccagaggc

SEQ ID NO: 839165 - RNA, 23 nt, Human
ucccucccaccccccgauggccc

SEQ ID NO: 839166 - RNA, 23 nt, Human
ucccucccaccccccgauggccc

SEQ ID NO: 839167 - RNA, 23 nt, Human
ugaaaaaucacccaaaaauaaga

SEQ ID NO: 839168 - RNA, 23 nt, Human
ugaaaaaucacccaaaaauaaga

SEQ ID NO: 839169 - RNA, 22 nt, Human
ugacuaaccgacuccccauccc

SEQ ID NO: 839170 - RNA, 22 nt, Human
ugacuaaccgacuccccauccc

SEQ ID NO: 839171 - RNA, 18 nt, Human
uguuuucaaaguaguucu

SEQ ID NO: 839172 - RNA, 18 nt, Human
uguuuucaaaguaguucu

SEQ ID NO: 839173 - RNA, 21 nt, Human
aaauucccuuauaaaucgcag

SEQ ID NO: 839174 - RNA, 20 nt, Human
aagaaccacuccuagccucc

SEQ ID NO: 839175 - RNA, 21 nt, Human
aagcggagggguauugggggc

SEQ ID NO: 839176 - RNA, 24 nt, Human
acccccacaagcguaaggucccau

SEQ ID NO: 839177 - RNA, 21 nt, Human
accccucccugcuucccccug

SEQ ID NO: 839178 - RNA, 25 nt, Human
accuccuccacacccccgaaguucu

SEQ ID NO: 839179 - RNA, 22 nt, Human
agaaagaacggaucugaggaaa

SEQ ID NO: 839180 - RNA, 23 nt, Human
agaaagaacggaucugaggaaaa

SEQ ID NO: 839181 - RNA, 23 nt, Human
agagagaaaagggagacugggaa

SEQ ID NO: 839182 - RNA, 28 nt, Human
agagaguuuauugaggccaugggcaggg

SEQ ID NO: 839183 - RNA, 19 nt, Human
agaggggcagagacaccag

SEQ ID NO: 839184 - RNA, 19 nt, Human
aggggaguggcaggagggc

SEQ ID NO: 839185 - RNA, 23 nt, Human
aguuuauugaggccaugggcagg

SEQ ID NO: 839186 - RNA, 21 nt, Human
aucgcaggggaguggcaggag

SEQ ID NO: 839187 - RNA, 21 nt, Human
augaucccuugagauucacua

SEQ ID NO: 839188 - RNA, 21 nt, Human
caagaaccacuccuagccucc

SEQ ID NO: 839189 - RNA, 22 nt, Human
cacacccccgaaguucugaccc

SEQ ID NO: 839190 - RNA, 19 nt, Human
cacagagaggggcagagac

SEQ ID NO: 839191 - RNA, 22 nt, Human
cagcccgcagacccccacaagc

SEQ ID NO: 839192 - RNA, 19 nt, Human
cagcugcgccuggagcaga

SEQ ID NO: 839193 - RNA, 23 nt, Human
caggaacacagcacggggcgugc

SEQ ID NO: 839194 - RNA, 26 nt, Human
caggaacacagcacggggcgugcgug

SEQ ID NO: 839195 - RNA, 22 nt, Human
ccaaagccaugguggccucuug

SEQ ID NO: 839196 - RNA, 20 nt, Human
ccaaagugaagaauagagga

SEQ ID NO: 839197 - RNA, 24 nt, Human
ccaauccaguccuugccaaagcca

SEQ ID NO: 839198 - RNA, 19 nt, Human
ccagcccgcagacccccac

SEQ ID NO: 839199 - RNA, 18 nt, Human
ccauguccccccaaucca

SEQ ID NO: 839200 - RNA, 21 nt, Human
ccauguccccccaauccaguc

SEQ ID NO: 839201 - RNA, 22 nt, Human
cccagcccgcagacccccacaa

SEQ ID NO: 839202 - RNA, 23 nt, Human
cccagcccgcagacccccacaag

SEQ ID NO: 839203 - RNA, 23 nt, Human
cccccacaagcguaaggucccau

SEQ ID NO: 839204 - RNA, 19 nt, Human
cccccgaaguucugacccc

SEQ ID NO: 839205 - RNA, 28 nt, Human
cccccgaaguucugaccccaaagugaag

SEQ ID NO: 839206 - RNA, 18 nt, Human
ccccgcagccccaacagc

SEQ ID NO: 839207 - RNA, 21 nt, Human
ccccgcgccggcgcucggccc

SEQ ID NO: 839208 - RNA, 24 nt, Human
ccccugagcuccaugugggguggg

SEQ ID NO: 839209 - RNA, 24 nt, Human
cccucuugucccuguggucaagga

SEQ ID NO: 839210 - RNA, 22 nt, Human
ccgcagccccaacagcugcgcc

SEQ ID NO: 839211 - RNA, 19 nt, Human
ccgcagggcucuuuuggga

SEQ ID NO: 839212 - RNA, 21 nt, Human
ccucccugcuucccccugagc

SEQ ID NO: 839213 - RNA, 21 nt, Human
cgcaccuccuccacacccccg

SEQ ID NO: 839214 - RNA, 21 nt, Human
cgccgcgccccgcgccggcgc

SEQ ID NO: 839215 - RNA, 21 nt, Human
cgccgcgccccgcgccggcgc

SEQ ID NO: 839216 - RNA, 21 nt, Human
cgccggcgcucggcccgcccc

SEQ ID NO: 839217 - RNA, 24 nt, Human
cgggagaggcccgcgacugcggcg

SEQ ID NO: 839218 - RNA, 18 nt, Human
cuagccuccgcagggcuc

SEQ ID NO: 839219 - RNA, 18 nt, Human
cuccuccacacccccgaa

SEQ ID NO: 839220 - RNA, 22 nt, Human
cucuugucccuguggucaagga

SEQ ID NO: 839221 - RNA, 25 nt, Human
cugaccccaaagugaagaauagagg

SEQ ID NO: 839222 - RNA, 23 nt, Human
cugcgcccuggggaccgaggacg

SEQ ID NO: 839223 - RNA, 18 nt, Human
cugcgccuggagcagacg

SEQ ID NO: 839224 - RNA, 18 nt, Human
cuggagcagacggccagg

SEQ ID NO: 839225 - RNA, 19 nt, Human
gaacacagcacggggcgug

SEQ ID NO: 839226 - RNA, 20 nt, Human
gacugcaggggugcgcuagc

SEQ ID NO: 839227 - RNA, 21 nt, Human
gagccgcaccuccuccacacc

SEQ ID NO: 839228 - RNA, 19 nt, Human
gcaccuccuccacaccccc

SEQ ID NO: 839229 - RNA, 19 nt, Human
gcagccccaacagcugcgc

SEQ ID NO: 839230 - RNA, 20 nt, Human
gccaggagacagagcggugg

SEQ ID NO: 839231 - RNA, 18 nt, Human
gccaugguggccucuuga

SEQ ID NO: 839232 - RNA, 21 nt, Human
gcccaggaacacagcacgggg

SEQ ID NO: 839233 - RNA, 20 nt, Human
gccggcgcucggcccgcccc

SEQ ID NO: 839234 - RNA, 21 nt, Human
gccuggagcagacggccagga

SEQ ID NO: 839235 - RNA, 21 nt, Human
ggaaccccucccugcuucccc

SEQ ID NO: 839236 - RNA, 18 nt, Human
ggaagggaaggaggagga

SEQ ID NO: 839237 - RNA, 19 nt, Human
ggacugcaggggugcgcua

SEQ ID NO: 839238 - RNA, 22 nt, Human
ggcacagagaggggcagagaca

SEQ ID NO: 839239 - RNA, 19 nt, Human
ggcagggcccaggaacaca

SEQ ID NO: 839240 - RNA, 18 nt, Human
ggccaggagacagagcgg

SEQ ID NO: 839241 - RNA, 19 nt, Human
gggagccucgccgcgcccc

SEQ ID NO: 839242 - RNA, 21 nt, Human
gggcacgggggcuccacuccc

SEQ ID NO: 839243 - RNA, 20 nt, Human
gggcagggcccaggaacaca

SEQ ID NO: 839244 - RNA, 24 nt, Human
gggguggggcuggggcgagggggc

SEQ ID NO: 839245 - RNA, 25 nt, Human
guggccucuugagacauccucagcc

SEQ ID NO: 839246 - RNA, 26 nt, Human
uagagccgcaccuccuccacaccccc

SEQ ID NO: 839247 - RNA, 22 nt, Human
ucaagaaccacuccuagccucc

SEQ ID NO: 839248 - RNA, 19 nt, Human
ucccagcccgcagaccccc

SEQ ID NO: 839249 - RNA, 20 nt, Human
ucccagcccgcagaccccca

SEQ ID NO: 839250 - RNA, 20 nt, Human
ucccccgcagccccaacagc

SEQ ID NO: 839251 - RNA, 22 nt, Human
ucccugcuucccccugagcucc

SEQ ID NO: 839252 - RNA, 20 nt, Human
ucccuguggucaaggauggg

SEQ ID NO: 839253 - RNA, 18 nt, Human
ucccuuauaaaucgcagg

SEQ ID NO: 839254 - RNA, 24 nt, Human
ucgccgcgccccgcgccggcgcuc

SEQ ID NO: 839255 - RNA, 24 nt, Human
ucugaccccaaagugaagaauaga

SEQ ID NO: 839256 - RNA, 22 nt, Human
ugaccccaaagugaagaauaga

SEQ ID NO: 839257 - RNA, 20 nt, Human
ugaggaaaagcaggggcacg

SEQ ID NO: 839258 - RNA, 23 nt, Human
ugaggaaaagcaggggcacgggg

SEQ ID NO: 839259 - RNA, 19 nt, Human
uggccucuugagacauccu

SEQ ID NO: 839260 - RNA, 20 nt, Human
ugggaagggaaggaggagga

SEQ ID NO: 839261 - RNA, 20 nt, Human
ugggcagggcccaggaacac

SEQ ID NO: 839262 - RNA, 27 nt, Human
ugguggccucuugagacauccucagcc

SEQ ID NO: 839263 - RNA, 18 nt, Human
uucaggugagcaucaaga

SEQ ID NO: 839264 - RNA, 21 nt, Human
uucccagcccgcagaccccca

SEQ ID NO: 839265 - RNA, 25 nt, Human
uuugggaaccccucccugcuucccc

SEQ ID NO: 839266 - RNA, 21 nt, Human
aaaacaaaacaaaacaaaaaa

SEQ ID NO: 839267 - RNA, 33 nt, Human
aaaacaaaacaaaacaaaaaacaacaaaaaaga

SEQ ID NO: 839268 - RNA, 25 nt, Human
aaacaaaaacaaaacaaaacaaaaa

SEQ ID NO: 839269 - RNA, 19 nt, Human
aaacaaaacaaaacaaaaa

SEQ ID NO: 839270 - RNA, 18 nt, Human
aaacaaacauucuuucca

SEQ ID NO: 839271 - RNA, 19 nt, Human
aaacagggaaccccaugug

SEQ ID NO: 839272 - RNA, 24 nt, Human
aagaaccugucuacccaauguguc

SEQ ID NO: 839273 - RNA, 23 nt, Human
aagccagggaugcugcuccacag

SEQ ID NO: 839274 - RNA, 20 nt, Human
aagggcugccugcagacgag

SEQ ID NO: 839275 - RNA, 22 nt, Human
aagggcuggcugugccgccacc

SEQ ID NO: 839276 - RNA, 20 nt, Human
aaguccagagacauuuuugu

SEQ ID NO: 839277 - RNA, 18 nt, Human
aagugaccagggcagacg

SEQ ID NO: 839278 - RNA, 26 nt, Human
aauacaguacauaaaaacaaaaacaa

SEQ ID NO: 839279 - RNA, 26 nt, Human
acaaaaaaauuaagaaauuagaaaaa

SEQ ID NO: 839280 - RNA, 24 nt, Human
acaaaacaaaacaaaaaacaacaa

SEQ ID NO: 839281 - RNA, 23 nt, Human
acaccagcaacagggaggagccu

SEQ ID NO: 839282 - RNA, 18 nt, Human
acaggcacuguacacccc

SEQ ID NO: 839283 - RNA, 22 nt, Human
accaaugcuuugcacuuugccu

SEQ ID NO: 839284 - RNA, 21 nt, Human
accagagcucaccccugaaca

SEQ ID NO: 839285 - RNA, 24 nt, Human
acccagcccacaggccccaagggc

SEQ ID NO: 839286 - RNA, 20 nt, Human
acccaugggacacucccccu

SEQ ID NO: 839287 - RNA, 22 nt, Human
acccgcgccugccccacguucc

SEQ ID NO: 839288 - RNA, 23 nt, Human
acccucucuccagcccugagcac

SEQ ID NO: 839289 - RNA, 28 nt, Human
acgcaggaggugaaaggaaaggggaccc

SEQ ID NO: 839290 - RNA, 21 nt, Human
acuguacaccccuggcuacag

SEQ ID NO: 839291 - RNA, 21 nt, Human
agaaaaacuucaaaaccuaga

SEQ ID NO: 839292 - RNA, 19 nt, Human
agaaaaagagccccaaacg

SEQ ID NO: 839293 - RNA, 20 nt, Human
agaaauuagaaaaacuucaa

SEQ ID NO: 839294 - RNA, 21 nt, Human
agaagaagagcgggcccagag

SEQ ID NO: 839295 - RNA, 19 nt, Human
agacaucaugagaagaaga

SEQ ID NO: 839296 - RNA, 23 nt, Human
agagaagaggagcuuucuccuca

SEQ ID NO: 839297 - RNA, 23 nt, Human
agagacauuuuuguggucacaaa

SEQ ID NO: 839298 - RNA, 22 nt, Human
agagagcgacgaugucagacaa

SEQ ID NO: 839299 - RNA, 22 nt, Human
agcaagcgcaaagaaaccacaa

SEQ ID NO: 839300 - RNA, 19 nt, Human
agcacagggaggacaggag

SEQ ID NO: 839301 - RNA, 22 nt, Human
agcagcaggugggcugacggag

SEQ ID NO: 839302 - RNA, 22 nt, Human
agcaggagccugcagcagcccc

SEQ ID NO: 839303 - RNA, 20 nt, Human
agcagugccgagggagagcc

SEQ ID NO: 839304 - RNA, 21 nt, Human
agcccgcagccccgccacccu

SEQ ID NO: 839305 - RNA, 21 nt, Human
agcccgggugagcaugaggcu

SEQ ID NO: 839306 - RNA, 19 nt, Human
agcuccaggcccgggaagc

SEQ ID NO: 839307 - RNA, 22 nt, Human
aggaaguaagcuucuggagaag

SEQ ID NO: 839308 - RNA, 20 nt, Human
aggaucacuaagcucaaccc

SEQ ID NO: 839309 - RNA, 22 nt, Human
aggcagcccggaggccagagag

SEQ ID NO: 839310 - RNA, 19 nt, Human
aggcagccgcugggugggu

SEQ ID NO: 839311 - RNA, 23 nt, Human
agggacaggcagggaggggccca

SEQ ID NO: 839312 - RNA, 24 nt, Human
agggagagggcgaguggcccagag

SEQ ID NO: 839313 - RNA, 24 nt, Human
agggaggacaggagagcguuccag

SEQ ID NO: 839314 - RNA, 24 nt, Human
agggcagagggcucugacugggga

SEQ ID NO: 839315 - RNA, 20 nt, Human
aggggcaggaugugucuggc

SEQ ID NO: 839316 - RNA, 21 nt, Human
agguuccgcaggccgcagccc

SEQ ID NO: 839317 - RNA, 21 nt, Human
aguaagcuucuggagaagucc

SEQ ID NO: 839318 - RNA, 24 nt, Human
auaguagcuauucucaguugggcc

SEQ ID NO: 839319 - RNA, 20 nt, Human
aucacuaagcucaacccuga

SEQ ID NO: 839320 - RNA, 21 nt, Human
caaaccucucaaccuccuaaa

SEQ ID NO: 839321 - RNA, 21 nt, Human
caaagaaaccacaaucccugc

SEQ ID NO: 839322 - RNA, 20 nt, Human
caacccagcccacaggcccc

SEQ ID NO: 839323 - RNA, 20 nt, Human
cacagggaggacaggagagc

SEQ ID NO: 839324 - RNA, 18 nt, Human
cacagggccugcugggca

SEQ ID NO: 839325 - RNA, 24 nt, Human
cacccaccgcgucccagcggccca

SEQ ID NO: 839326 - RNA, 18 nt, Human
cacccgcuauggcagagc

SEQ ID NO: 839327 - RNA, 19 nt, Human
cacccggcagagagaaaac

SEQ ID NO: 839328 - RNA, 21 nt, Human
caccuuccuccacgcuggguc

SEQ ID NO: 839329 - RNA, 26 nt, Human
cacuguacaccccuggcuacagagcu

SEQ ID NO: 839330 - RNA, 19 nt, Human
cagcaagcgaccuggggcc

SEQ ID NO: 839331 - RNA, 20 nt, Human
cagcaggugggcugacggag

SEQ ID NO: 839332 - RNA, 23 nt, Human
cagccacagccacacagggccug

SEQ ID NO: 839333 - RNA, 24 nt, Human
cagcccagguagggcagagggcuc

SEQ ID NO: 839334 - RNA, 22 nt, Human
cagcccccuguagcuuguggcu

SEQ ID NO: 839335 - RNA, 24 nt, Human
cagccgcuggguggguucccgugg

SEQ ID NO: 839336 - RNA, 19 nt, Human
cagcugccucagguuccgc

SEQ ID NO: 839337 - RNA, 23 nt, Human
cagcuggagaaaaagagccccaa

SEQ ID NO: 839338 - RNA, 20 nt, Human
caggacccaggaggcguuac

SEQ ID NO: 839339 - RNA, 20 nt, Human
caggacccaggaggcguuac

SEQ ID NO: 839340 - RNA, 22 nt, Human
caggagccugcagcagccccca

SEQ ID NO: 839341 - RNA, 21 nt, Human
caggcacgauggacacuuaga

SEQ ID NO: 839342 - RNA, 23 nt, Human
caggccaaaacuggcagcaagcg

SEQ ID NO: 839343 - RNA, 21 nt, Human
cagggaggggcccagagaaga

SEQ ID NO: 839344 - RNA, 21 nt, Human
cagggccugcugggcagccug

SEQ ID NO: 839345 - RNA, 24 nt, Human
caggucccagcuccaggcccggga

SEQ ID NO: 839346 - RNA, 26 nt, Human
caguacauaaaaacaaaaacaaaaca

SEQ ID NO: 839347 - RNA, 28 nt, Human
cauaaaaacaaaaacaaaacaaaacaaa

SEQ ID NO: 839348 - RNA, 23 nt, Human
caugaggcuuuaugugggggugu

SEQ ID NO: 839349 - RNA, 21 nt, Human
caugcauguccagccccaaaa

SEQ ID NO: 839350 - RNA, 21 nt, Human
ccaaaagaugagcagugccga

SEQ ID NO: 839351 - RNA, 21 nt, Human
ccacacacgaagggagagggc

SEQ ID NO: 839352 - RNA, 21 nt, Human
ccacacccaccgcgucccagc

SEQ ID NO: 839353 - RNA, 20 nt, Human
ccacagccacacagggccug

SEQ ID NO: 839354 - RNA, 19 nt, Human
ccacaggcacgauggacac

SEQ ID NO: 839355 - RNA, 21 nt, Human
ccaccgccgccgccagcgcgg

SEQ ID NO: 839356 - RNA, 19 nt, Human
ccagcccaacccagcccac

SEQ ID NO: 839357 - RNA, 18 nt, Human
ccagcccagguagggcag

SEQ ID NO: 839358 - RNA, 24 nt, Human
ccaggcaggguguagcugugcaca

SEQ ID NO: 839359 - RNA, 24 nt, Human
cccaacccagcccacaggccccaa

SEQ ID NO: 839360 - RNA, 23 nt, Human
cccacauccaccagcccaaccca

SEQ ID NO: 839361 - RNA, 26 nt, Human
cccaccgcgucccagcggcccaggcc

SEQ ID NO: 839362 - RNA, 21 nt, Human
cccagaaggcccggggagccc

SEQ ID NO: 839363 - RNA, 21 nt, Human
ccccaaaagaugagcagugcc

SEQ ID NO: 839364 - RNA, 19 nt, Human
ccccaagggcucugccucu

SEQ ID NO: 839365 - RNA, 18 nt, Human
ccccagacgauugcuugu

SEQ ID NO: 839366 - RNA, 22 nt, Human
ccccagcugccucagguuccgc

SEQ ID NO: 839367 - RNA, 21 nt, Human
ccccauguggccaggcagggu

SEQ ID NO: 839368 - RNA, 18 nt, Human
ccccgggcucaggucagg

SEQ ID NO: 839369 - RNA, 19 nt, Human
ccccuggccacaacuuacc

SEQ ID NO: 839370 - RNA, 18 nt, Human
cccugagcacagggagga

SEQ ID NO: 839371 - RNA, 18 nt, Human
ccgacucugccaccaccc

SEQ ID NO: 839372 - RNA, 21 nt, Human
ccgacucugccaccacccggc

SEQ ID NO: 839373 - RNA, 21 nt, Human
ccggcgcgcccggcccucccc

SEQ ID NO: 839374 - RNA, 23 nt, Human
ccuacagggccaccacuuaccca

SEQ ID NO: 839375 - RNA, 22 nt, Human
ccuaugggcaggucccagcucu

SEQ ID NO: 839376 - RNA, 18 nt, Human
ccucgcccgacacccugc

SEQ ID NO: 839377 - RNA, 19 nt, Human
ccucgcccgacacccugcg

SEQ ID NO: 839378 - RNA, 21 nt, Human
ccucucaaccuccuaaacauc

SEQ ID NO: 839379 - RNA, 22 nt, Human
ccugaaauggcuuggaacgggg

SEQ ID NO: 839380 - RNA, 18 nt, Human
ccuguggacacuaaggcc

SEQ ID NO: 839381 - RNA, 24 nt, Human
ccuguggcuugacuggaccagagc

SEQ ID NO: 839382 - RNA, 22 nt, Human
cgacucugccaccacccggcag

SEQ ID NO: 839383 - RNA, 20 nt, Human
cgcagccccgccacccucuc

SEQ ID NO: 839384 - RNA, 23 nt, Human
cgcgcccggcccuccccagcugc

SEQ ID NO: 839385 - RNA, 20 nt, Human
cgcuucugggccaccuuccu

SEQ ID NO: 839386 - RNA, 18 nt, Human
cggauuacgagaaaccgc

SEQ ID NO: 839387 - RNA, 19 nt, Human
cggcagagagaaaacaggg

SEQ ID NO: 839388 - RNA, 23 nt, Human
cggcagagagaaaacagggaacc

SEQ ID NO: 839389 - RNA, 24 nt, Human
cgucacccuacagggccaccacuu

SEQ ID NO: 839390 - RNA, 18 nt, Human
cguggcccccggcccucc

SEQ ID NO: 839391 - RNA, 18 nt, Human
cguguagcagugaccucc

SEQ ID NO: 839392 - RNA, 20 nt, Human
cuaaaggcaaaccucucaac

SEQ ID NO: 839393 - RNA, 23 nt, Human
cucaaacucaggacccaggaggc

SEQ ID NO: 839394 - RNA, 21 nt, Human
cucacaggccaaaacuggcag

SEQ ID NO: 839395 - RNA, 23 nt, Human
cuccucggaagcagggccacccu

SEQ ID NO: 839396 - RNA, 21 nt, Human
cucuaaugcuaaggaucucac

SEQ ID NO: 839397 - RNA, 19 nt, Human
cucugccucugcccagccu

SEQ ID NO: 839398 - RNA, 19 nt, Human
cugcagcagcccccacagg

SEQ ID NO: 839399 - RNA, 24 nt, Human
cuggcugugccgccaccgcugccc

SEQ ID NO: 839400 - RNA, 18 nt, Human
cuggggacccaagaaggg

SEQ ID NO: 839401 - RNA, 23 nt, Human
cuggggcccccgcacucuggcug

SEQ ID NO: 839402 - RNA, 20 nt, Human
cugucgaggggguauccagc

SEQ ID NO: 839403 - RNA, 22 nt, Human
cugugagaaccugcuggggccc

SEQ ID NO: 839404 - RNA, 23 nt, Human
cuucaugucacuccccacgcugg

SEQ ID NO: 839405 - RNA, 18 nt, Human
cuuccgggccucaccacu

SEQ ID NO: 839406 - RNA, 19 nt, Human
cuucuucccaggaaggugg

SEQ ID NO: 839407 - RNA, 21 nt, Human
gaaggugcugacccuguggcu

SEQ ID NO: 839408 - RNA, 19 nt, Human
gaccucugccucugcccag

SEQ ID NO: 839409 - RNA, 25 nt, Human
gagaaaccgcaaccagccgucuacc

SEQ ID NO: 839410 - RNA, 21 nt, Human
gagaagaagagcgggcccaga

SEQ ID NO: 839411 - RNA, 21 nt, Human
gagagaaaacagggaacccca

SEQ ID NO: 839412 - RNA, 21 nt, Human
gagcagugccgagggagagcc

SEQ ID NO: 839413 - RNA, 23 nt, Human
gagcaugaggcuuuauguggggg

SEQ ID NO: 839414 - RNA, 21 nt, Human
gagcucacaggccaaaacugg

SEQ ID NO: 839415 - RNA, 22 nt, Human
gaggacaggagagcguuccaga

SEQ ID NO: 839416 - RNA, 18 nt, Human
gaggagccucucacucca

SEQ ID NO: 839417 - RNA, 23 nt, Human
gaggccgcguggaacagccacag

SEQ ID NO: 839418 - RNA, 19 nt, Human
gaguggccuggcucugggc

SEQ ID NO: 839419 - RNA, 23 nt, Human
gcaaaccccacacucuagacacu

SEQ ID NO: 839420 - RNA, 23 nt, Human
gcaccaaugcuuugcacuuugcc

SEQ ID NO: 839421 - RNA, 26 nt, Human
gcagcaagcgaccuggggcccugaag

SEQ ID NO: 839422 - RNA, 18 nt, Human
gcagccgcuggguggguu

SEQ ID NO: 839423 - RNA, 26 nt, Human
gcagugccgagggagagcccucacac

SEQ ID NO: 839424 - RNA, 21 nt, Human
gccacagccacacagggccug

SEQ ID NO: 839425 - RNA, 23 nt, Human
gccacagccacacagggccugcu

SEQ ID NO: 839426 - RNA, 19 nt, Human
gcccaacccagcccacagg

SEQ ID NO: 839427 - RNA, 21 nt, Human
gcccagaaggcccggggagcc

SEQ ID NO: 839428 - RNA, 23 nt, Human
gcccagccucucuggucaccgcc

SEQ ID NO: 839429 - RNA, 27 nt, Human
gcccgacacccugcgggccagagcucc

SEQ ID NO: 839430 - RNA, 24 nt, Human
gcccggcccuccccagcugccuca

SEQ ID NO: 839431 - RNA, 18 nt, Human
gccgccaccgcugccccg

SEQ ID NO: 839432 - RNA, 21 nt, Human
gccucaccacucccgaguggc

SEQ ID NO: 839433 - RNA, 19 nt, Human
gccuuuaagugaccagggc

SEQ ID NO: 839434 - RNA, 24 nt, Human
gcgccuccccuagcucuccgucac

SEQ ID NO: 839435 - RNA, 18 nt, Human
gcgggcccagagcgggcg

SEQ ID NO: 839436 - RNA, 23 nt, Human
gcugccugcagacgaggcucccg

SEQ ID NO: 839437 - RNA, 22 nt, Human
gcuggguuucuccauccugcca

SEQ ID NO: 839438 - RNA, 21 nt, Human
gcugugccgccaccgcugccc

SEQ ID NO: 839439 - RNA, 19 nt, Human
ggaaagacaucaugagaag

SEQ ID NO: 839440 - RNA, 18 nt, Human
ggaagcagggccacccuc

SEQ ID NO: 839441 - RNA, 21 nt, Human
ggaggugggcccagguggcag

SEQ ID NO: 839442 - RNA, 18 nt, Human
ggcagccgcugggugggu

SEQ ID NO: 839443 - RNA, 19 nt, Human
ggccaggcaggguguagcu

SEQ ID NO: 839444 - RNA, 18 nt, Human
ggcccagagcgggcgcga

SEQ ID NO: 839445 - RNA, 23 nt, Human
ggccgcguggaacagccacagcc

SEQ ID NO: 839446 - RNA, 23 nt, Human
ggcucugccucuguggacauccu

SEQ ID NO: 839447 - RNA, 19 nt, Human
gggacaggcagggaggggc

SEQ ID NO: 839448 - RNA, 22 nt, Human
gggagagcgagucacugcaggu

SEQ ID NO: 839449 - RNA, 19 nt, Human
ggucauuccucaccaugaa

SEQ ID NO: 839450 - RNA, 18 nt, Human
ggugggggcagcccggau

SEQ ID NO: 839451 - RNA, 24 nt, Human
gucccaggccccacauccaccagc

SEQ ID NO: 839452 - RNA, 21 nt, Human
guggcuccugugccuguccca

SEQ ID NO: 839453 - RNA, 20 nt, Human
guggcucugcagcuaugccc

SEQ ID NO: 839454 - RNA, 20 nt, Human
guggcugccugaggccccgc

SEQ ID NO: 839455 - RNA, 20 nt, Human
gugggggcagcccggauuac

SEQ ID NO: 839456 - RNA, 21 nt, Human
gugggggcagcccggauuacg

SEQ ID NO: 839457 - RNA, 24 nt, Human
uaaaggcaaaccucucaaccuccu

SEQ ID NO: 839458 - RNA, 20 nt, Human
uaauuuaaaauaaagaaaaa

SEQ ID NO: 839459 - RNA, 25 nt, Human
uacaguacauaaaaacaaaaacaaa

SEQ ID NO: 839460 - RNA, 23 nt, Human
uagacacugacguuccuccgaga

SEQ ID NO: 839461 - RNA, 19 nt, Human
uagcugugcacaucagaca

SEQ ID NO: 839462 - RNA, 26 nt, Human
uaugaacgaaaacauaaaacgcuaca

SEQ ID NO: 839463 - RNA, 22 nt, Human
ucaaauaaaacacuccuaugaa

SEQ ID NO: 839464 - RNA, 23 nt, Human
ucaaauaaaacacuccuaugaac

SEQ ID NO: 839465 - RNA, 24 nt, Human
ucacacgggcgcagcccgccuccc

SEQ ID NO: 839466 - RNA, 26 nt, Human
ucacuaagcucaacccugacaggcac

SEQ ID NO: 839467 - RNA, 22 nt, Human
ucagggccagggagugaccaga

SEQ ID NO: 839468 - RNA, 25 nt, Human
uccacacccaccgcgucccagcggc

SEQ ID NO: 839469 - RNA, 19 nt, Human
uccacuggugcccucccca

SEQ ID NO: 839470 - RNA, 21 nt, Human
ucccagagcagcgcagcagca

SEQ ID NO: 839471 - RNA, 21 nt, Human
ucccaggaagguggcuguccu

SEQ ID NO: 839472 - RNA, 23 nt, Human
ucccaggcagccgcugggugggu

SEQ ID NO: 839473 - RNA, 25 nt, Human
ucccaggccccacauccaccagccc

SEQ ID NO: 839474 - RNA, 19 nt, Human
uccgccguggcugccugag

SEQ ID NO: 839475 - RNA, 18 nt, Human
ucuaugugacuaaugcgg

SEQ ID NO: 839476 - RNA, 19 nt, Human
ucucaaccuccuaaacauc

SEQ ID NO: 839477 - RNA, 19 nt, Human
ucucacccagggaggagcu

SEQ ID NO: 839478 - RNA, 19 nt, Human
ucucuggucaccgccagac

SEQ ID NO: 839479 - RNA, 19 nt, Human
ucugacuggggacccaaga

SEQ ID NO: 839480 - RNA, 18 nt, Human
ucugcagcuaugcccagu

SEQ ID NO: 839481 - RNA, 22 nt, Human
ucugcagucugauugcgccucc

SEQ ID NO: 839482 - RNA, 20 nt, Human
ucugccucuguggacauccu

SEQ ID NO: 839483 - RNA, 20 nt, Human
ucuucuucccaggaaggugg

SEQ ID NO: 839484 - RNA, 23 nt, Human
ugaaaauacaguacauaaaaaca

SEQ ID NO: 839485 - RNA, 22 nt, Human
ugaaaggaaaacccuugcucuu

SEQ ID NO: 839486 - RNA, 18 nt, Human
ugaaaggaaagacaucau

SEQ ID NO: 839487 - RNA, 18 nt, Human
ugaaggaguggccuggcu

SEQ ID NO: 839488 - RNA, 24 nt, Human
ugaccucugccucugcccagccuc

SEQ ID NO: 839489 - RNA, 19 nt, Human
ugacugccccgaggggaug

SEQ ID NO: 839490 - RNA, 19 nt, Human
ugagaggaggugggcccag

SEQ ID NO: 839491 - RNA, 23 nt, Human
ugagcaagcgcaaagaaaccaca

SEQ ID NO: 839492 - RNA, 18 nt, Human
ugagccagagacagugag

SEQ ID NO: 839493 - RNA, 25 nt, Human
ugagccagagacagugagaggaggu

SEQ ID NO: 839494 - RNA, 21 nt, Human
ugaggcugacgugucuucaga

SEQ ID NO: 839495 - RNA, 18 nt, Human
ugccccgucaccaucacu

SEQ ID NO: 839496 - RNA, 21 nt, Human
ugccucugcccagccucucug

SEQ ID NO: 839497 - RNA, 19 nt, Human
ugccugaggccccgcgcac

SEQ ID NO: 839498 - RNA, 22 nt, Human
ugcugggcagccugagccccug

SEQ ID NO: 839499 - RNA, 18 nt, Human
uggaacagccacagccac

SEQ ID NO: 839500 - RNA, 21 nt, Human
uggagggugggggcagcccgg

SEQ ID NO: 839501 - RNA, 19 nt, Human
uggcuccugugccuguccc

SEQ ID NO: 839502 - RNA, 18 nt, Human
uggcugugccgccaccgc

SEQ ID NO: 839503 - RNA, 21 nt, Human
uggcuugacuggaccagagcu

SEQ ID NO: 839504 - RNA, 21 nt, Human
ugggcccagguggcagggcug

SEQ ID NO: 839505 - RNA, 20 nt, Human
uggggacccaagaagggcug

SEQ ID NO: 839506 - RNA, 22 nt, Human
uggggacccaagaaggggggag

SEQ ID NO: 839507 - RNA, 22 nt, Human
uggggcccugaaggaguggccu

SEQ ID NO: 839508 - RNA, 23 nt, Human
uggggcccugaaggaguggccug

SEQ ID NO: 839509 - RNA, 22 nt, Human
uguacaccccuggcuacagagc

SEQ ID NO: 839510 - RNA, 20 nt, Human
ugucacaggcaccugguguc

SEQ ID NO: 839511 - RNA, 22 nt, Human
ugucccaggcagccgcugggug

SEQ ID NO: 839512 - RNA, 18 nt, Human
uguccuuaccuggcacug

SEQ ID NO: 839513 - RNA, 21 nt, Human
ugucuggcuggagcccgggug

SEQ ID NO: 839514 - RNA, 23 nt, Human
ugugucacaggcaccuggugucu

SEQ ID NO: 839515 - RNA, 23 nt, Human
uucauccuguggacacuaaggcc

SEQ ID NO: 839516 - RNA, 23 nt, Human
uuccucaccaugaguagccacaa

SEQ ID NO: 839517 - RNA, 21 nt, Human
uugaggugugggaaagugcaa

SEQ ID NO: 839518 - RNA, 21 nt, Human
uugcgccuccccuagcucucc

SEQ ID NO: 839519 - RNA, 21 nt, Human
uugcuuguaaugggccagugc

SEQ ID NO: 839520 - RNA, 20 nt, Human
uuugaaaggaaaacccuugc

SEQ ID NO: 839521 - RNA, 20 nt, Human
aggggguggucugaccccca

SEQ ID NO: 839522 - RNA, 18 nt, Human
caagcaucgcuuaucaaa

SEQ ID NO: 839523 - RNA, 23 nt, Human
caagcaucgcuuaucaaagccac

SEQ ID NO: 839524 - RNA, 19 nt, Human
cacucucgggauccacggg

SEQ ID NO: 839525 - RNA, 21 nt, Human
ccacugccaagcagacuuccg

SEQ ID NO: 839526 - RNA, 24 nt, Human
cccccgacaccuuccccgagagcc

SEQ ID NO: 839527 - RNA, 27 nt, Human
cccccgacaccuuccccgagagcccac

SEQ ID NO: 839528 - RNA, 26 nt, Human
cccggccccugccccgagccgguucc

SEQ ID NO: 839529 - RNA, 23 nt, Human
cccggccccugccccgagcucuc

SEQ ID NO: 839530 - RNA, 22 nt, Human
cccggguuagcccucaugcccc

SEQ ID NO: 839531 - RNA, 25 nt, Human
cccuccuagggggcccccgacaccu

SEQ ID NO: 839532 - RNA, 21 nt, Human
ccgccggccggccgagcagca

SEQ ID NO: 839533 - RNA, 19 nt, Human
ccggccggccgagcagcag

SEQ ID NO: 839534 - RNA, 19 nt, Human
ccggcucccccacgccucc

SEQ ID NO: 839535 - RNA, 23 nt, Human
ccgggucggccccuggacaccac

SEQ ID NO: 839536 - RNA, 22 nt, Human
ccgggucggccccuggacacgu

SEQ ID NO: 839537 - RNA, 24 nt, Human
ccgggucggccccuggacacguua

SEQ ID NO: 839538 - RNA, 25 nt, Human
ccgggucggccccuggacacguuuu

SEQ ID NO: 839539 - RNA, 18 nt, Human
ccucaugccccugcugcu

SEQ ID NO: 839540 - RNA, 22 nt, Human
ccucccggccccugccccgagc

SEQ ID NO: 839541 - RNA, 19 nt, Human
ccugaagcugcuuccacac

SEQ ID NO: 839542 - RNA, 21 nt, Human
ccugugccagugagccagggg

SEQ ID NO: 839543 - RNA, 23 nt, Human
cggccgagcagcagcccuauuac

SEQ ID NO: 839544 - RNA, 23 nt, Human
cucccccacgccucccggccccc

SEQ ID NO: 839545 - RNA, 19 nt, Human
cucugagcuacggaacaga

SEQ ID NO: 839546 - RNA, 23 nt, Human
gaaauguacauuuuuguuguuug

SEQ ID NO: 839547 - RNA, 19 nt, Human
ggcacuuggcccuggcagg

SEQ ID NO: 839548 - RNA, 23 nt, Human
ggcaggguggcaggcauugaagg

SEQ ID NO: 839549 - RNA, 21 nt, Human
ggcgcuccucccggcccgcuc

SEQ ID NO: 839550 - RNA, 20 nt, Human
uacgggccgggucggccccu

SEQ ID NO: 839551 - RNA, 20 nt, Human
uaucaaagccacugccaagc

SEQ ID NO: 839552 - RNA, 20 nt, Human
ucccauggcaauguccccag

SEQ ID NO: 839553 - RNA, 21 nt, Human
ucccauggcaauguccccagc

SEQ ID NO: 839554 - RNA, 21 nt, Human
ucccggccccugccccgagcu

SEQ ID NO: 839555 - RNA, 20 nt, Human
ugccccgagcucugcacucu

SEQ ID NO: 839556 - RNA, 22 nt, Human
ugccccgagcucugcacucucg

SEQ ID NO: 839557 - RNA, 19 nt, Human
uuaaaaggaaaaacagaaa

SEQ ID NO: 839558 - RNA, 19 nt, Human
uucauauuguuucacgagc

SEQ ID NO: 839559 - RNA, 26 nt, Human
uucccggguuagcccucaugccccug

SEQ ID NO: 839560 - RNA, 21 nt, Human
uuuuuuuuuuuuuaaagagua

SEQ ID NO: 839561 - RNA, 19 nt, Human
uuuuuuuuuuuuuuuuuaa

SEQ ID NO: 839562 - RNA, 20 nt, Human
aaaaggauucuaagaaacaa

SEQ ID NO: 839563 - RNA, 25 nt, Human
aagcggccgcuuuuuuuuuuuuuuu

SEQ ID NO: 839564 - RNA, 19 nt, Human
acaacaagggcagggugag

SEQ ID NO: 839565 - RNA, 23 nt, Human
acgccggggcacaggcgggggug

SEQ ID NO: 839566 - RNA, 21 nt, Human
agaagacagguaggagagaca

SEQ ID NO: 839567 - RNA, 19 nt, Human
agagacaacaagggcaggg

SEQ ID NO: 839568 - RNA, 18 nt, Human
agagagaagacgggcugg

SEQ ID NO: 839569 - RNA, 21 nt, Human
agagagagaagacgggcuggu

SEQ ID NO: 839570 - RNA, 18 nt, Human
agagccagaagacaggua

SEQ ID NO: 839571 - RNA, 18 nt, Human
agagccccccagugaucc

SEQ ID NO: 839572 - RNA, 20 nt, Human
agcggccgcuuuuuuuuuuu

SEQ ID NO: 839573 - RNA, 19 nt, Human
agcugcgugaccuugagca

SEQ ID NO: 839574 - RNA, 23 nt, Human
aggaaaccuggguccggucugcc

SEQ ID NO: 839575 - RNA, 20 nt, Human
aggaagagacuugggccagg

SEQ ID NO: 839576 - RNA, 21 nt, Human
aggaggaagagacuugggcca

SEQ ID NO: 839577 - RNA, 30 nt, Human
aggcacuggucaucuccuccuggggggaag

SEQ ID NO: 839578 - RNA, 23 nt, Human
aggggugggagcagagagagaag

SEQ ID NO: 839579 - RNA, 19 nt, Human
agucaggaaaccugggucc

SEQ ID NO: 839580 - RNA, 19 nt, Human
aguuuggacaggaacacag

SEQ ID NO: 839581 - RNA, 18 nt, Human
caacgcgcauuguggcca

SEQ ID NO: 839582 - RNA, 19 nt, Human
cagacugcccuccgccucu

SEQ ID NO: 839583 - RNA, 20 nt, Human
caggauaggaggaagagacu

SEQ ID NO: 839584 - RNA, 19 nt, Human
cagggugagggcggcaggg

SEQ ID NO: 839585 - RNA, 25 nt, Human
cccaccgcgcgccgcuggcucccac

SEQ ID NO: 839586 - RNA, 19 nt, Human
cccccgggggccuggcgcu

SEQ ID NO: 839587 - RNA, 18 nt, Human
cccccuccuccggcuccg

SEQ ID NO: 839588 - RNA, 23 nt, Human
ccccgccgccccccgacgggcug

SEQ ID NO: 839589 - RNA, 21 nt, Human
ccccuccccgccgccccccga

SEQ ID NO: 839590 - RNA, 18 nt, Human
cccgcggccgcccccucc

SEQ ID NO: 839591 - RNA, 18 nt, Human
cccucccucccucccccc

SEQ ID NO: 839592 - RNA, 23 nt, Human
ccgcagccuccagggcccgagcu

SEQ ID NO: 839593 - RNA, 20 nt, Human
ccgcgcgccgcuggcucccc

SEQ ID NO: 839594 - RNA, 24 nt, Human
ccuccccgccgccccccgacgggc

SEQ ID NO: 839595 - RNA, 25 nt, Human
ccucccgugggcaggagggcgcggu

SEQ ID NO: 839596 - RNA, 25 nt, Human
ccucccgugggcaggagggcgcggu

SEQ ID NO: 839597 - RNA, 20 nt, Human
ccuugagcagacugcccucc

SEQ ID NO: 839598 - RNA, 22 nt, Human
cgccgcuggcucccaccggccc

SEQ ID NO: 839599 - RNA, 20 nt, Human
cgcugggcagcagagagccu

SEQ ID NO: 839600 - RNA, 24 nt, Human
cgcuuuuuuuuuuuuuuucaccag

SEQ ID NO: 839601 - RNA, 23 nt, Human
cggccgcccccuccuccggcucc

SEQ ID NO: 839602 - RNA, 23 nt, Human
cggcgcccucccucccucccccc

SEQ ID NO: 839603 - RNA, 24 nt, Human
cgggcccccuccccgccgcccccc

SEQ ID NO: 839604 - RNA, 19 nt, Human
cuccgggcccccuccccgc

SEQ ID NO: 839605 - RNA, 23 nt, Human
cuuccccgagccggcccggcucc

SEQ ID NO: 839606 - RNA, 23 nt, Human
gaccgcggggcggcgggggcccg

SEQ ID NO: 839607 - RNA, 20 nt, Human
gagaagaugauaccagaugg

SEQ ID NO: 839608 - RNA, 19 nt, Human
gagagccuggcuauggcac

SEQ ID NO: 839609 - RNA, 21 nt, Human
gagccggcuuccccgagccgg

SEQ ID NO: 839610 - RNA, 20 nt, Human
gagccuggcuauggcacugc

SEQ ID NO: 839611 - RNA, 22 nt, Human
gaggaagagacuugggccagga

SEQ ID NO: 839612 - RNA, 22 nt, Human
gaggagaggaggcagaugugga

SEQ ID NO: 839613 - RNA, 22 nt, Human
gaggagaggaggcagaugugga

SEQ ID NO: 839614 - RNA, 22 nt, Human
gagggcggcaggggugggagca

SEQ ID NO: 839615 - RNA, 18 nt, Human
gcacuggucaucuccucc

SEQ ID NO: 839616 - RNA, 21 nt, Human
gcacuggucaucuccuccugg

SEQ ID NO: 839617 - RNA, 18 nt, Human
gcagggugagggcggcag

SEQ ID NO: 839618 - RNA, 21 nt, Human
gccgcuggcucccaccggccc

SEQ ID NO: 839619 - RNA, 24 nt, Human
gccuccagggcccgagcuuucuuc

SEQ ID NO: 839620 - RNA, 19 nt, Human
gcggcaggggugggagcag

SEQ ID NO: 839621 - RNA, 18 nt, Human
gcgguggcucagugggcc

SEQ ID NO: 839622 - RNA, 19 nt, Human
ggaggagaggaggcagaug

SEQ ID NO: 839623 - RNA, 19 nt, Human
ggaggagaggaggcagaug

SEQ ID NO: 839624 - RNA, 20 nt, Human
ggcagggugagggcggcagg

SEQ ID NO: 839625 - RNA, 22 nt, Human
ggcccccuccccgccgcccccc

SEQ ID NO: 839626 - RNA, 22 nt, Human
ggccgcccccuccuccggcucc

SEQ ID NO: 839627 - RNA, 21 nt, Human
ggccgcuuuuuuuuuuuuuuu

SEQ ID NO: 839628 - RNA, 22 nt, Human
gggcagggugagggcggcaggg

SEQ ID NO: 839629 - RNA, 23 nt, Human
gggcagggugagggcggcagggg

SEQ ID NO: 839630 - RNA, 24 nt, Human
gggcagggugagggcggcaggggu

SEQ ID NO: 839631 - RNA, 21 nt, Human
gggcggcaggggugggagcag

SEQ ID NO: 839632 - RNA, 21 nt, Human
gguccggucugccccaaccag

SEQ ID NO: 839633 - RNA, 21 nt, Human
gucgcggggcuccgugggucc

SEQ ID NO: 839634 - RNA, 21 nt, Human
uaaaaaauauauuccuguaga

SEQ ID NO: 839635 - RNA, 21 nt, Human
uaaaaaauauauuccuguaga

SEQ ID NO: 839636 - RNA, 21 nt, Human
uagcauuucaauguugcugug

SEQ ID NO: 839637 - RNA, 19 nt, Human
ucaacgcgcauuguggcca

SEQ ID NO: 839638 - RNA, 21 nt, Human
ucaacgcgcauuguggccaag

SEQ ID NO: 839639 - RNA, 23 nt, Human
ucccaccggcccggcgcccuccc

SEQ ID NO: 839640 - RNA, 20 nt, Human
uccccgagccggcccggcuc

SEQ ID NO: 839641 - RNA, 19 nt, Human
uccccgccgccccccgacg

SEQ ID NO: 839642 - RNA, 21 nt, Human
uccgggcuggagccggcuucc

SEQ ID NO: 839643 - RNA, 21 nt, Human
uccucccgugggcaggagggc

SEQ ID NO: 839644 - RNA, 21 nt, Human
uccucccgugggcaggagggc

SEQ ID NO: 839645 - RNA, 21 nt, Human
uccuguagagaguuauugcuu

SEQ ID NO: 839646 - RNA, 21 nt, Human
uccuguagagaguuauugcuu

SEQ ID NO: 839647 - RNA, 23 nt, Human
ugaggaggagaggaggcagaugu

SEQ ID NO: 839648 - RNA, 23 nt, Human
ugaggaggagaggaggcagaugu

SEQ ID NO: 839649 - RNA, 25 nt, Human
ugaggaggagaggaggcagaugugg

SEQ ID NO: 839650 - RNA, 25 nt, Human
ugaggaggagaggaggcagaugugg

SEQ ID NO: 839651 - RNA, 18 nt, Human
ugagggcggcaggggugg

SEQ ID NO: 839652 - RNA, 21 nt, Human
uggcacugcugcuguucccug

SEQ ID NO: 839653 - RNA, 21 nt, Human
ugggagcagagagagaagacg

SEQ ID NO: 839654 - RNA, 25 nt, Human
ugggccaggagucaggaaaccuggg

SEQ ID NO: 839655 - RNA, 21 nt, Human
uggguccggucugccccaacc

SEQ ID NO: 839656 - RNA, 21 nt, Human
aaagauagccccugacuucaa

SEQ ID NO: 839657 - RNA, 18 nt, Human
aacccucaaucgccccuc

SEQ ID NO: 839658 - RNA, 21 nt, Human
aaguucagaugaaaagucacc

SEQ ID NO: 839659 - RNA, 22 nt, Human
aaugacccugggcccuccuggc

SEQ ID NO: 839660 - RNA, 21 nt, Human
acagaggccucacucgggcca

SEQ ID NO: 839661 - RNA, 19 nt, Human
acccugggcccuccuggcc

SEQ ID NO: 839662 - RNA, 22 nt, Human
agaggggcuuuccugccugaga

SEQ ID NO: 839663 - RNA, 21 nt, Human
agcaacguggucccuggucac

SEQ ID NO: 839664 - RNA, 24 nt, Human
agccccuaggcccugcccaucucu

SEQ ID NO: 839665 - RNA, 24 nt, Human
aggaaggaacuaggcugcguguca

SEQ ID NO: 839666 - RNA, 25 nt, Human
aggaaggaacuaggcugcgugucag

SEQ ID NO: 839667 - RNA, 21 nt, Human
aggcagaggugaacccucaau

SEQ ID NO: 839668 - RNA, 19 nt, Human
aggcaggcagaccggaucc

SEQ ID NO: 839669 - RNA, 23 nt, Human
agggaggcaggcagaccggaucc

SEQ ID NO: 839670 - RNA, 23 nt, Human
agugagagaggggccaggaagga

SEQ ID NO: 839671 - RNA, 18 nt, Human
aucugggcuggggcugca

SEQ ID NO: 839672 - RNA, 21 nt, Human
caacagagaggggcuuuccug

SEQ ID NO: 839673 - RNA, 23 nt, Human
caagccaggaccagacauucuga

SEQ ID NO: 839674 - RNA, 22 nt, Human
caaggccaggcccaucugcccc

SEQ ID NO: 839675 - RNA, 18 nt, Human
cacagaggccucacucgg

SEQ ID NO: 839676 - RNA, 24 nt, Human
cacagugacauuuuccaaagugga

SEQ ID NO: 839677 - RNA, 19 nt, Human
caccagggcaggacagcac

SEQ ID NO: 839678 - RNA, 20 nt, Human
caccagggcaggacagcaca

SEQ ID NO: 839679 - RNA, 19 nt, Human
caccauggcaaccaauggc

SEQ ID NO: 839680 - RNA, 20 nt, Human
cacucagcauucacaggcag

SEQ ID NO: 839681 - RNA, 19 nt, Human
cagcagccucagggcccaa

SEQ ID NO: 839682 - RNA, 22 nt, Human
cagcaggcagcucccagccccu

SEQ ID NO: 839683 - RNA, 18 nt, Human
cagccccuaggcccugcc

SEQ ID NO: 839684 - RNA, 20 nt, Human
caggaaggaacuaggcugcg

SEQ ID NO: 839685 - RNA, 18 nt, Human
caggacagcacagaggcc

SEQ ID NO: 839686 - RNA, 22 nt, Human
caggacagcacagaggccucac

SEQ ID NO: 839687 - RNA, 21 nt, Human
caggcccaagccaggaccaga

SEQ ID NO: 839688 - RNA, 24 nt, Human
caggcccaucugcccaucccacag

SEQ ID NO: 839689 - RNA, 18 nt, Human
caggcugagaggccaggc

SEQ ID NO: 839690 - RNA, 19 nt, Human
cagggcccaaggaggagug

SEQ ID NO: 839691 - RNA, 24 nt, Human
caggguccuccauccugaaguucc

SEQ ID NO: 839692 - RNA, 24 nt, Human
ccaaccagccacuuucacacaagu

SEQ ID NO: 839693 - RNA, 20 nt, Human
ccagccccuaggcccugccc

SEQ ID NO: 839694 - RNA, 21 nt, Human
ccagccuggcgcuucuagugg

SEQ ID NO: 839695 - RNA, 21 nt, Human
cccagaguaaagaaagagacc

SEQ ID NO: 839696 - RNA, 21 nt, Human
ccccaaccucaggucugaccu

SEQ ID NO: 839697 - RNA, 20 nt, Human
ccccaaggcagaggugaacc

SEQ ID NO: 839698 - RNA, 22 nt, Human
cccugcccaucucuagggcuug

SEQ ID NO: 839699 - RNA, 25 nt, Human
ccgagugacaaauuaaaacacaaca

SEQ ID NO: 839700 - RNA, 21 nt, Human
ccucagggcccaaggaggagu

SEQ ID NO: 839701 - RNA, 18 nt, Human
ccuccccaaggcagaggu

SEQ ID NO: 839702 - RNA, 19 nt, Human
ccuuaaguucagaugaaaa

SEQ ID NO: 839703 - RNA, 23 nt, Human
cgcucagaggcggccccagccug

SEQ ID NO: 839704 - RNA, 18 nt, Human
cgcugagugccaucuggg

SEQ ID NO: 839705 - RNA, 20 nt, Human
cuccccaaggcagaggugaa

SEQ ID NO: 839706 - RNA, 23 nt, Human
cugagguaccggcgaggggcagg

SEQ ID NO: 839707 - RNA, 19 nt, Human
cugggcccuccuggccagg

SEQ ID NO: 839708 - RNA, 19 nt, Human
gaagccacuuagcucugcu

SEQ ID NO: 839709 - RNA, 25 nt, Human
gagccugggccagagaucugaagga

SEQ ID NO: 839710 - RNA, 21 nt, Human
gagugacaaauuaaaacacaa

SEQ ID NO: 839711 - RNA, 20 nt, Human
gcacagaggccucacucggg

SEQ ID NO: 839712 - RNA, 20 nt, Human
gcaggcugagaggccaggcu

SEQ ID NO: 839713 - RNA, 19 nt, Human
gcagggaaaguaugcuggc

SEQ ID NO: 839714 - RNA, 23 nt, Human
gccacuuucacacaaguauacca

SEQ ID NO: 839715 - RNA, 20 nt, Human
gccagagaucugaaggaggc

SEQ ID NO: 839716 - RNA, 21 nt, Human
gccaugcaccagggcaggaca

SEQ ID NO: 839717 - RNA, 23 nt, Human
ggagaggcggucgcgggagcugg

SEQ ID NO: 839718 - RNA, 22 nt, Human
ggccagggccugagcacauuuc

SEQ ID NO: 839719 - RNA, 21 nt, Human
ggccuagaaagcuaaggccau

SEQ ID NO: 839720 - RNA, 21 nt, Human
gggaagcccagccacaacucc

SEQ ID NO: 839721 - RNA, 23 nt, Human
ggucgggaauagugaggggaugg

SEQ ID NO: 839722 - RNA, 22 nt, Human
gugaacccucaaucgccccucc

SEQ ID NO: 839723 - RNA, 19 nt, Human
guucagaugaaaagucacc

SEQ ID NO: 839724 - RNA, 18 nt, Human
uaaaacccagcaguguug

SEQ ID NO: 839725 - RNA, 19 nt, Human
uaaagaaagagaccucagg

SEQ ID NO: 839726 - RNA, 22 nt, Human
uaccauggugggguggggcugg

SEQ ID NO: 839727 - RNA, 23 nt, Human
uagaaagcuaaggccaugcacca

SEQ ID NO: 839728 - RNA, 21 nt, Human
uaggcccugcccaucucuagg

SEQ ID NO: 839729 - RNA, 19 nt, Human
uaugcaggcugagaggcca

SEQ ID NO: 839730 - RNA, 26 nt, Human
ucccaaccagccacuuucacacaagu

SEQ ID NO: 839731 - RNA, 18 nt, Human
uccuggccagggccugag

SEQ ID NO: 839732 - RNA, 18 nt, Human
ucugacauggucuagggu

SEQ ID NO: 839733 - RNA, 24 nt, Human
ucugggcuggggcugcagcaaggc

SEQ ID NO: 839734 - RNA, 21 nt, Human
ugaacccucaaucgccccucc

SEQ ID NO: 839735 - RNA, 24 nt, Human
ugacauuuuccaaaguggaaaaaa

SEQ ID NO: 839736 - RNA, 26 nt, Human
ugagagaggggccaggaaggaacuag

SEQ ID NO: 839737 - RNA, 23 nt, Human
ugagaucuggugagcagaugggu

SEQ ID NO: 839738 - RNA, 23 nt, Human
ugagcagaugggugcagggaaag

SEQ ID NO: 839739 - RNA, 18 nt, Human
ugagguaccggcgagggg

SEQ ID NO: 839740 - RNA, 19 nt, Human
ugagugccaucugggcugg

SEQ ID NO: 839741 - RNA, 25 nt, Human
uggauguaaaacccagcaguguugu

SEQ ID NO: 839742 - RNA, 21 nt, Human
uggcaaccaauggccaaugcc

SEQ ID NO: 839743 - RNA, 18 nt, Human
uggccaaugccuuucuca

SEQ ID NO: 839744 - RNA, 23 nt, Human
uggcuaggcccagggacucccuc

SEQ ID NO: 839745 - RNA, 21 nt, Human
ugggaagcccagccacaacuc

SEQ ID NO: 839746 - RNA, 22 nt, Human
ugggcuggggcugcagcaaggc

SEQ ID NO: 839747 - RNA, 23 nt, Human
ugggugcagggaaaguaugcugg

SEQ ID NO: 839748 - RNA, 18 nt, Human
uggugagcagaugggugc

SEQ ID NO: 839749 - RNA, 18 nt, Human
uucagaugaaaagucacc

SEQ ID NO: 839750 - RNA, 24 nt, Human
uuucagucuguuaugcaggcugag

SEQ ID NO: 839751 - RNA, 23 nt, Human
aaguaauaguaugucucuagaac

SEQ ID NO: 839752 - RNA, 20 nt, Human
aaucaauguggaaaugaaau

SEQ ID NO: 839753 - RNA, 21 nt, Human
acccuaaaucuauacagcagc

SEQ ID NO: 839754 - RNA, 22 nt, Human
acuuuauacauuaaagaauaau

SEQ ID NO: 839755 - RNA, 18 nt, Human
agcccuguccccgcgcgg

SEQ ID NO: 839756 - RNA, 21 nt, Human
aggcugcucagcagcccuguc

SEQ ID NO: 839757 - RNA, 19 nt, Human
cacaguccuaaaguaauag

SEQ ID NO: 839758 - RNA, 19 nt, Human
cagcagcagcggcggaggc

SEQ ID NO: 839759 - RNA, 21 nt, Human
cagcagcggcggaggcggcgg

SEQ ID NO: 839760 - RNA, 26 nt, Human
cagcccuguccccgcgcggccgaggg

SEQ ID NO: 839761 - RNA, 24 nt, Human
cccacagccgggagaggcggaggc

SEQ ID NO: 839762 - RNA, 25 nt, Human
ccccacagccgggagaggcggaggc

SEQ ID NO: 839763 - RNA, 18 nt, Human
ccccgcgcggccgaggga

SEQ ID NO: 839764 - RNA, 22 nt, Human
ccccgcgcggccgagggagcaa

SEQ ID NO: 839765 - RNA, 18 nt, Human
ccccggcgccggcucugc

SEQ ID NO: 839766 - RNA, 23 nt, Human
ccccucgggaccgguggggauga

SEQ ID NO: 839767 - RNA, 20 nt, Human
cgggccccugggccucgugg

SEQ ID NO: 839768 - RNA, 22 nt, Human
cucgggccccugggccucgugg

SEQ ID NO: 839769 - RNA, 20 nt, Human
cucugcuucggcgggcggcu

SEQ ID NO: 839770 - RNA, 24 nt, Human
cuggcggcagcagcagcggcggag

SEQ ID NO: 839771 - RNA, 24 nt, Human
cuuugugcugggccccacgcggcc

SEQ ID NO: 839772 - RNA, 18 nt, Human
gaggaccccggcgccggc

SEQ ID NO: 839773 - RNA, 21 nt, Human
gaggaccccggcgccggcucu

SEQ ID NO: 839774 - RNA, 23 nt, Human
gcacccuaaaucuauacagcagc

SEQ ID NO: 839775 - RNA, 19 nt, Human
gcagcagcagcggcggagg

SEQ ID NO: 839776 - RNA, 27 nt, Human
gcccccacagccgggagaggcggaggc

SEQ ID NO: 839777 - RNA, 18 nt, Human
gccccuggggacaggucu

SEQ ID NO: 839778 - RNA, 19 nt, Human
gcgggcggcucuaggcugg

SEQ ID NO: 839779 - RNA, 19 nt, Human
ggaggcggcggccccuggg

SEQ ID NO: 839780 - RNA, 18 nt, Human
ggccccugggccucgugg

SEQ ID NO: 839781 - RNA, 28 nt, Human
ggcgacgggcagcagccgccccucggga

SEQ ID NO: 839782 - RNA, 19 nt, Human
gugcugggccccacgcggc

SEQ ID NO: 839783 - RNA, 22 nt, Human
uaacuauacuauuauuaagucc

SEQ ID NO: 839784 - RNA, 18 nt, Human
uacuuuauacauuaaaga

SEQ ID NO: 839785 - RNA, 20 nt, Human
uagucgguccuuuuucuacu

SEQ ID NO: 839786 - RNA, 23 nt, Human
uggcggcagcagcagcggcggag

SEQ ID NO: 839787 - RNA, 24 nt, Human
uuacuuuauacauuaaagaauaau

SEQ ID NO: 839788 - RNA, 23 nt, Human
uucuuaaaaacaaacaauaacua

SEQ ID NO: 839789 - RNA, 21 nt, Human
uuuuuuuuuuuuuuuuccaga

SEQ ID NO: 839790 - RNA, 24 nt, Human
uuuuuuuuuuuuuuuuuuuuccag

SEQ ID NO: 839791 - RNA, 20 nt, Human
aaaaaaaaaaaaaaagacag

SEQ ID NO: 839792 - RNA, 21 nt, Human
aaaaaaaaaaaaaaagacagc

SEQ ID NO: 839793 - RNA, 19 nt, Human
aaaaaaaaaaagacagccc

SEQ ID NO: 839794 - RNA, 23 nt, Human
aaaaaaaagaaguaauaaaaaaa

SEQ ID NO: 839795 - RNA, 23 nt, Human
aaaaaacaacaaaauuuggugcu

SEQ ID NO: 839796 - RNA, 22 nt, Human
aaaaacaacaaaauuuggugcu

SEQ ID NO: 839797 - RNA, 22 nt, Human
aaaaauaaaagagaaacaaggc

SEQ ID NO: 839798 - RNA, 22 nt, Human
aaaagagaaacaaggcagagga

SEQ ID NO: 839799 - RNA, 25 nt, Human
aaacaguaccuggcaccacuccaac

SEQ ID NO: 839800 - RNA, 24 nt, Human
aaaucuggguauugguguuuuuuc

SEQ ID NO: 839801 - RNA, 23 nt, Human
aacaaagaaacucaacagaucca

SEQ ID NO: 839802 - RNA, 26 nt, Human
aacaaagaaacucaacagauccaaga

SEQ ID NO: 839803 - RNA, 20 nt, Human
aacaaggcagaggaagaagg

SEQ ID NO: 839804 - RNA, 18 nt, Human
aagaaaguuuacacuuuu

SEQ ID NO: 839805 - RNA, 23 nt, Human
aagagaucaaaaagcagcagcac

SEQ ID NO: 839806 - RNA, 18 nt, Human
aagcagcagcacaggagg

SEQ ID NO: 839807 - RNA, 23 nt, Human
aauaaacaauaaagccuauacaa

SEQ ID NO: 839808 - RNA, 19 nt, Human
acaaaaaaaggagcccaag

SEQ ID NO: 839809 - RNA, 18 nt, Human
acaaggcagaggaagaag

SEQ ID NO: 839810 - RNA, 18 nt, Human
acaaggcagaggaagaag

SEQ ID NO: 839811 - RNA, 18 nt, Human
acaaggcagaggaagaag

SEQ ID NO: 839812 - RNA, 19 nt, Human
acaaggcagaggaagaagg

SEQ ID NO: 839813 - RNA, 23 nt, Human
agaaaaaaaaaaacaacaaaauu

SEQ ID NO: 839814 - RNA, 18 nt, Human
agacaagaggaaaaugga

SEQ ID NO: 839815 - RNA, 29 nt, Human
agacaagaggaaaauggagaagggacccc

SEQ ID NO: 839816 - RNA, 22 nt, Human
agacaagaugcuacacaaaacc

SEQ ID NO: 839817 - RNA, 24 nt, Human
agagaaacaaggcagaggaagaag

SEQ ID NO: 839818 - RNA, 19 nt, Human
agaugggaucuguggggag

SEQ ID NO: 839819 - RNA, 23 nt, Human
augauagacaagaugcuacacaa

SEQ ID NO: 839820 - RNA, 18 nt, Human
auuuauuuuucgcuuuua

SEQ ID NO: 839821 - RNA, 23 nt, Human
caaauuggucaaagcuucuccag

SEQ ID NO: 839822 - RNA, 21 nt, Human
caacagauccaagaggggaaa

SEQ ID NO: 839823 - RNA, 24 nt, Human
caauaaacaauaaagccuauacaa

SEQ ID NO: 839824 - RNA, 20 nt, Human
cacauuuauuuuucgcuuuu

SEQ ID NO: 839825 - RNA, 20 nt, Human
caccacuccaacaaacaaac

SEQ ID NO: 839826 - RNA, 18 nt, Human
cagcacaggagggaggga

SEQ ID NO: 839827 - RNA, 23 nt, Human
cagcagcagcagcggcggcggca

SEQ ID NO: 839828 - RNA, 23 nt, Human
cagcagcagcggcggcggcaaca

SEQ ID NO: 839829 - RNA, 21 nt, Human
cagcagcggcggcggcaacag

SEQ ID NO: 839830 - RNA, 26 nt, Human
cagcggcagcggcacacacaccggag

SEQ ID NO: 839831 - RNA, 24 nt, Human
ccagcaauaaacaauaaagccuau

SEQ ID NO: 839832 - RNA, 27 nt, Human
ccuaugguuuaaaugaacuccuaagac

SEQ ID NO: 839833 - RNA, 18 nt, Human
ccucuuuccuucuuaacu

SEQ ID NO: 839834 - RNA, 19 nt, Human
ccucuuuccuucuuaacuc

SEQ ID NO: 839835 - RNA, 21 nt, Human
ccuuuuugacccacccaucuc

SEQ ID NO: 839836 - RNA, 26 nt, Human
cgaaaaaauaaaaaauaaaagagaaa

SEQ ID NO: 839837 - RNA, 26 nt, Human
cgacuggaaaagaaagcauuaucugc

SEQ ID NO: 839838 - RNA, 22 nt, Human
cggcaacagcggcagcggcaca

SEQ ID NO: 839839 - RNA, 21 nt, Human
cggcggcaacagcggcagcgg

SEQ ID NO: 839840 - RNA, 23 nt, Human
cggcggcaacagcggcagcggca

SEQ ID NO: 839841 - RNA, 21 nt, Human
cucaaagacgacuggaaaaga

SEQ ID NO: 839842 - RNA, 28 nt, Human
cuccggauaaaaaaauuuuagucgaaga

SEQ ID NO: 839843 - RNA, 20 nt, Human
cuucauauaugggcauguca

SEQ ID NO: 839844 - RNA, 24 nt, Human
gaaaaaaaaagaaguaauaaaaaa

SEQ ID NO: 839845 - RNA, 21 nt, Human
gacaagaggaaaauggagaaa

SEQ ID NO: 839846 - RNA, 21 nt, Human
gacaagaugcuacacaaaacc

SEQ ID NO: 839847 - RNA, 22 nt, Human
gagaaaaaaaaaaacaacaaaa

SEQ ID NO: 839848 - RNA, 23 nt, Human
gaggacagaacagaaccgauuaa

SEQ ID NO: 839849 - RNA, 21 nt, Human
gauaucccuuuuugacccacc

SEQ ID NO: 839850 - RNA, 19 nt, Human
gcagcagcagcggcggcgg

SEQ ID NO: 839851 - RNA, 19 nt, Human
gcggcaacagcggcagcgg

SEQ ID NO: 839852 - RNA, 24 nt, Human
gcggcggcggcaacagcggcagcg

SEQ ID NO: 839853 - RNA, 20 nt, Human
ggagggggguggggguggug

SEQ ID NO: 839854 - RNA, 23 nt, Human
ggcaggguggaaaguugcaaacu

SEQ ID NO: 839855 - RNA, 25 nt, Human
gggcaggguggaaaguugcaaacuu

SEQ ID NO: 839856 - RNA, 18 nt, Human
ggggugggggugguggag

SEQ ID NO: 839857 - RNA, 20 nt, Human
gguugguguaacgacggggc

SEQ ID NO: 839858 - RNA, 18 nt, Human
guaguucgaaaaaaaaag

SEQ ID NO: 839859 - RNA, 24 nt, Human
guguaacgacggggcgagcagcag

SEQ ID NO: 839860 - RNA, 21 nt, Human
uaaagccuauacaacuuguag

SEQ ID NO: 839861 - RNA, 20 nt, Human
uaaggucauaaaccagcaau

SEQ ID NO: 839862 - RNA, 21 nt, Human
uacaaaacaugauagacaaga

SEQ ID NO: 839863 - RNA, 24 nt, Human
uaccuggcaccacuccaacaaaca

SEQ ID NO: 839864 - RNA, 24 nt, Human
uagacaagaugcuacacaaaacca

SEQ ID NO: 839865 - RNA, 23 nt, Human
uccaaaacaguaccuggcaccac

SEQ ID NO: 839866 - RNA, 25 nt, Human
uccaaaacaguaccuggcaccacuc

SEQ ID NO: 839867 - RNA, 20 nt, Human
uccaagaggggaaacaaaga

SEQ ID NO: 839868 - RNA, 25 nt, Human
uccaagaugacugcaguuuuacaaa

SEQ ID NO: 839869 - RNA, 24 nt, Human
uccccauugugaccccuaucacuu

SEQ ID NO: 839870 - RNA, 25 nt, Human
ucuccaaaacaguaccuggcaccac

SEQ ID NO: 839871 - RNA, 23 nt, Human
ucugaagauuuuuuuuccuuuau

SEQ ID NO: 839872 - RNA, 23 nt, Human
ucugcuguaaucaaaaacauacc

SEQ ID NO: 839873 - RNA, 20 nt, Human
ucuuuaaaaaaaaaaaaaaa

SEQ ID NO: 839874 - RNA, 19 nt, Human
ugacccacccaucuccuuc

SEQ ID NO: 839875 - RNA, 18 nt, Human
uggaauggugguuaacag

SEQ ID NO: 839876 - RNA, 20 nt, Human
uggcaccacuccaacaaaca

SEQ ID NO: 839877 - RNA, 21 nt, Human
ugguuaacagaaugauuugag

SEQ ID NO: 839878 - RNA, 22 nt, Human
ugguuguagacaaguucuccaa

SEQ ID NO: 839879 - RNA, 21 nt, Human
uguaaaccugccucacaaaau

SEQ ID NO: 839880 - RNA, 21 nt, Human
uguaaucaaaaacauaccaca

SEQ ID NO: 839881 - RNA, 23 nt, Human
uguagacaaguucuccaaaacag

SEQ ID NO: 839882 - RNA, 24 nt, Human
uguggggaggggagaaaaaaaaaa

SEQ ID NO: 839883 - RNA, 19 nt, Human
uguguuuuaaaagguccaa

SEQ ID NO: 839884 - RNA, 24 nt, Human
uuaugcaccacuucaauuucccca

SEQ ID NO: 839885 - RNA, 23 nt, Human
uucaacaaagaaacucaacagau

SEQ ID NO: 839886 - RNA, 21 nt, Human
uugcaaacuucaugugcuucu

SEQ ID NO: 839887 - RNA, 21 nt, Human
uuggugcuuaaaaaaaaguaa

SEQ ID NO: 839888 - RNA, 22 nt, Human
uuguaaaccugccucacaaaau

SEQ ID NO: 839889 - RNA, 20 nt, Human
uuuaaaaaaaaaaaaaaaga

SEQ ID NO: 839890 - RNA, 24 nt, Human
uuuauacaauagucacaguuaaaa

SEQ ID NO: 839891 - RNA, 28 nt, Human
uuucuuuuuuccucuuuccuucuuaacu

SEQ ID NO: 839892 - RNA, 24 nt, Human
uuugauaucccuuuuugacccacc

SEQ ID NO: 839893 - RNA, 18 nt, Human
uuuuuucuuuuuuccucu

SEQ ID NO: 839894 - RNA, 21 nt, Human
aaagauccuucccaucgaacc

SEQ ID NO: 839895 - RNA, 23 nt, Human
aaccucgcagcacuucccuuugg

SEQ ID NO: 839896 - RNA, 22 nt, Human
acauaugagcccgaggacaccu

SEQ ID NO: 839897 - RNA, 20 nt, Human
agagaagugaaaggguuucc

SEQ ID NO: 839898 - RNA, 21 nt, Human
agauggccaaaguccuggagc

SEQ ID NO: 839899 - RNA, 22 nt, Human
agcccgaggacaccucgggagc

SEQ ID NO: 839900 - RNA, 24 nt, Human
agcuuuauagauggccaaaguccu

SEQ ID NO: 839901 - RNA, 21 nt, Human
cagggaacuccucagagaucc

SEQ ID NO: 839902 - RNA, 21 nt, Human
cccacauaugagcccgaggac

SEQ ID NO: 839903 - RNA, 27 nt, Human
ccucaagaggaaccacuuggagaaaga

SEQ ID NO: 839904 - RNA, 24 nt, Human
cucaagaggaaccacuuggagaaa

SEQ ID NO: 839905 - RNA, 25 nt, Human
cuccagaggcugcucaguugucccc

SEQ ID NO: 839906 - RNA, 23 nt, Human
cuggagccagcagaaaugcuccc

SEQ ID NO: 839907 - RNA, 22 nt, Human
gagaaagauccuucccaucgaa

SEQ ID NO: 839908 - RNA, 25 nt, Human
ggaacuccucagagauccucugccu

SEQ ID NO: 839909 - RNA, 19 nt, Human
ucagagauccucugccuuc

SEQ ID NO: 839910 - RNA, 22 nt, Human
ucagagauccucugccuuccca

SEQ ID NO: 839911 - RNA, 21 nt, Human
ucccaucgaaccacugcagcu

SEQ ID NO: 839912 - RNA, 20 nt, Human
ucuccagaggcugcucaguu

SEQ ID NO: 839913 - RNA, 22 nt, Human
ucuccagaggcugcucaguugu

SEQ ID NO: 839914 - RNA, 23 nt, Human
ucuccagaggcugcucaguuguc

SEQ ID NO: 839915 - RNA, 24 nt, Human
ugagcuuuauuaauggccccucuc

SEQ ID NO: 839916 - RNA, 18 nt, Human
uuuucuuuuuuuuuuuug

SEQ ID NO: 839917 - RNA, 19 nt, Human
uuuuucuuuuuuuuuuuug

SEQ ID NO: 839918 - RNA, 25 nt, Human
uuuuucuuuuuuuuuuuugauguug

SEQ ID NO: 839919 - RNA, 23 nt, Human
uuuuuuuuuuuuuuuuucuuuuu

SEQ ID NO: 839920 - RNA, 23 nt, Human
aaguacagaggccgggaagagcc

SEQ ID NO: 839921 - RNA, 23 nt, Human
acucagccagagcaggcgacacc

SEQ ID NO: 839922 - RNA, 19 nt, Human
acuggguuuggcaaggaga

SEQ ID NO: 839923 - RNA, 20 nt, Human
agacuggguuuggcaaggag

SEQ ID NO: 839924 - RNA, 21 nt, Human
agagcaggcgacaccuuccac

SEQ ID NO: 839925 - RNA, 18 nt, Human
agcccacagcagaaccug

SEQ ID NO: 839926 - RNA, 25 nt, Human
agcccggggaugcgccgcucgggcu

SEQ ID NO: 839927 - RNA, 26 nt, Human
agcggcacugcuccgcgcccggcaca

SEQ ID NO: 839928 - RNA, 18 nt, Human
aggaagggagggaaggga

SEQ ID NO: 839929 - RNA, 26 nt, Human
aggagaagggggaaucucugggcagg

SEQ ID NO: 839930 - RNA, 26 nt, Human
aggagaagggggaaucucugggcagg

SEQ ID NO: 839931 - RNA, 22 nt, Human
aggcgaaauacucugugcaacc

SEQ ID NO: 839932 - RNA, 22 nt, Human
aggcgaaauacucugugcaacc

SEQ ID NO: 839933 - RNA, 23 nt, Human
agugaaaaguagcuaagcagccc

SEQ ID NO: 839934 - RNA, 22 nt, Human
aucgcugcagucucgcccaggu

SEQ ID NO: 839935 - RNA, 22 nt, Human
aucgcugcagucucgcccaggu

SEQ ID NO: 839936 - RNA, 20 nt, Human
caaagccccgcuggcuucuc

SEQ ID NO: 839937 - RNA, 22 nt, Human
caacagggacaaagccccgcug

SEQ ID NO: 839938 - RNA, 19 nt, Human
caaccgaaaccaccacuag

SEQ ID NO: 839939 - RNA, 21 nt, Human
caaggugucccaaggugggcc

SEQ ID NO: 839940 - RNA, 19 nt, Human
cacccccccgacccccggc

SEQ ID NO: 839941 - RNA, 18 nt, Human
cagaaccugucaggcagc

SEQ ID NO: 839942 - RNA, 20 nt, Human
cagagagacuggguuuggca

SEQ ID NO: 839943 - RNA, 20 nt, Human
cagagcaggcgacaccuucc

SEQ ID NO: 839944 - RNA, 18 nt, Human
cagcagaaccugucaggc

SEQ ID NO: 839945 - RNA, 19 nt, Human
cagcagagcccacagcaga

SEQ ID NO: 839946 - RNA, 22 nt, Human
cagcagggagacacaccaaucc

SEQ ID NO: 839947 - RNA, 19 nt, Human
cagccacccuuacucagcc

SEQ ID NO: 839948 - RNA, 23 nt, Human
caggggagacacaccaauccauc

SEQ ID NO: 839949 - RNA, 21 nt, Human
ccagccacccuuacucagcca

SEQ ID NO: 839950 - RNA, 18 nt, Human
ccauucagcagagcccac

SEQ ID NO: 839951 - RNA, 21 nt, Human
cccacagcagaaccugucagg

SEQ ID NO: 839952 - RNA, 22 nt, Human
cccacagcagaaccugucaggc

SEQ ID NO: 839953 - RNA, 21 nt, Human
cccauccacccuccccuuccu

SEQ ID NO: 839954 - RNA, 21 nt, Human
cccauccacccuccccuuccu

SEQ ID NO: 839955 - RNA, 21 nt, Human
ccccauccacccuccccuucc

SEQ ID NO: 839956 - RNA, 21 nt, Human
ccccauccacccuccccuucc

SEQ ID NO: 839957 - RNA, 18 nt, Human
ccccccauccacccuccc

SEQ ID NO: 839958 - RNA, 18 nt, Human
ccccccauccacccuccc

SEQ ID NO: 839959 - RNA, 22 nt, Human
ccccccgccgcccccgcuccug

SEQ ID NO: 839960 - RNA, 23 nt, Human
ccccccgccgcccccgcuccugg

SEQ ID NO: 839961 - RNA, 19 nt, Human
cccccgccgcccccgcucc

SEQ ID NO: 839962 - RNA, 21 nt, Human
cccccgccgcccccgcuccug

SEQ ID NO: 839963 - RNA, 22 nt, Human
cccccgccgcccccgcuccugg

SEQ ID NO: 839964 - RNA, 22 nt, Human
cccccggcugggcugugccgcc

SEQ ID NO: 839965 - RNA, 28 nt, Human
ccccgccgcccccgcuccuggcagccug

SEQ ID NO: 839966 - RNA, 23 nt, Human
ccccggcugggcugugccgccuu

SEQ ID NO: 839967 - RNA, 18 nt, Human
cccgacccccggcugggc

SEQ ID NO: 839968 - RNA, 25 nt, Human
cccgcccccgccgcccccgcuccug

SEQ ID NO: 839969 - RNA, 21 nt, Human
cccggccgggcggggcuucuc

SEQ ID NO: 839970 - RNA, 18 nt, Human
cccugcccccccauccac

SEQ ID NO: 839971 - RNA, 19 nt, Human
cccugcccccccauccacc

SEQ ID NO: 839972 - RNA, 23 nt, Human
cccugcccccccauccacccucc

SEQ ID NO: 839973 - RNA, 23 nt, Human
cccugcccccccauccacccucc

SEQ ID NO: 839974 - RNA, 27 nt, Human
cccugcccccccauccacccuccccuu

SEQ ID NO: 839975 - RNA, 27 nt, Human
cccugcccccccauccacccuccccuu

SEQ ID NO: 839976 - RNA, 23 nt, Human
ccgcagccggccgccugccucgg

SEQ ID NO: 839977 - RNA, 23 nt, Human
ccgcccccgccgcccccgcuccu

SEQ ID NO: 839978 - RNA, 18 nt, Human
ccgccgcagccggccgcc

SEQ ID NO: 839979 - RNA, 19 nt, Human
ccgccgcagccggccgccu

SEQ ID NO: 839980 - RNA, 21 nt, Human
ccgccgccggaccugcugcuc

SEQ ID NO: 839981 - RNA, 22 nt, Human
ccgccgccggaccugcugcucc

SEQ ID NO: 839982 - RNA, 23 nt, Human
ccgccggaccugcugcucccaac

SEQ ID NO: 839983 - RNA, 21 nt, Human
ccuagggcgggggcugccggc

SEQ ID NO: 839984 - RNA, 18 nt, Human
ccugcccccccauccacc

SEQ ID NO: 839985 - RNA, 23 nt, Human
ccuuucggccgggccgcgccgcu

SEQ ID NO: 839986 - RNA, 21 nt, Human
cgcaaccgaaaccaccacuag

SEQ ID NO: 839987 - RNA, 24 nt, Human
cgcagccggccgccugccucgcuc

SEQ ID NO: 839988 - RNA, 19 nt, Human
cgccccccgccgcccccgc

SEQ ID NO: 839989 - RNA, 21 nt, Human
cgcccccgcuccuggcagccu

SEQ ID NO: 839990 - RNA, 22 nt, Human
cgcccccgcuccuggcagccug

SEQ ID NO: 839991 - RNA, 19 nt, Human
cggcuccgagcggcuccgg

SEQ ID NO: 839992 - RNA, 20 nt, Human
cggcuccggaccgcaccccc

SEQ ID NO: 839993 - RNA, 18 nt, Human
cggcugggcugugccgcc

SEQ ID NO: 839994 - RNA, 19 nt, Human
cggcugggcugugccgccu

SEQ ID NO: 839995 - RNA, 19 nt, Human
cggggaggccgggcagccg

SEQ ID NO: 839996 - RNA, 19 nt, Human
cgggggugcggggaggccg

SEQ ID NO: 839997 - RNA, 21 nt, Human
cguccagcuggcccgcccccc

SEQ ID NO: 839998 - RNA, 19 nt, Human
cuaagcagccaggccgagc

SEQ ID NO: 839999 - RNA, 18 nt, Human
cucucugccgccgcagcc

SEQ ID NO: 840000 - RNA, 22 nt, Human
cugccucgcuccuccccugccc

SEQ ID NO: 840001 - RNA, 18 nt, Human
gaagggagggaagggaag

SEQ ID NO: 840002 - RNA, 21 nt, Human
gacuuacugcugggcuuggag

SEQ ID NO: 840003 - RNA, 20 nt, Human
gagaagcuuggaggaaggga

SEQ ID NO: 840004 - RNA, 21 nt, Human
gagaagcuuggaggaagggag

SEQ ID NO: 840005 - RNA, 21 nt, Human
gagcccugcccccccauccac

SEQ ID NO: 840006 - RNA, 20 nt, Human
gaggaagggagggaagggaa

SEQ ID NO: 840007 - RNA, 20 nt, Human
gagggcaaaguacagaggcc

SEQ ID NO: 840008 - RNA, 24 nt, Human
gcccacagcagaaccugucaggac

SEQ ID NO: 840009 - RNA, 18 nt, Human
gcccccccauccacccuc

SEQ ID NO: 840010 - RNA, 18 nt, Human
gcccccccauccacccuc

SEQ ID NO: 840011 - RNA, 18 nt, Human
gccgccgcagccggccgc

SEQ ID NO: 840012 - RNA, 20 nt, Human
gccucgcuccuccccugccc

SEQ ID NO: 840013 - RNA, 21 nt, Human
gccucgcuccuccccugcccu

SEQ ID NO: 840014 - RNA, 20 nt, Human
gcgaaauacucugugcaacc

SEQ ID NO: 840015 - RNA, 20 nt, Human
gcgaaauacucugugcaacc

SEQ ID NO: 840016 - RNA, 20 nt, Human
gcgcggagcccggccgggcg

SEQ ID NO: 840017 - RNA, 20 nt, Human
gcugugccgccuuucggccg

SEQ ID NO: 840018 - RNA, 25 nt, Human
ggaaccuggacggugucgcaaccga

SEQ ID NO: 840019 - RNA, 19 nt, Human
ggaagagccaggccuaggg

SEQ ID NO: 840020 - RNA, 18 nt, Human
ggcaaaguacagaggccg

SEQ ID NO: 840021 - RNA, 20 nt, Human
ggcaaggagagcaacaggga

SEQ ID NO: 840022 - RNA, 19 nt, Human
ggccgggaagagccaggcc

SEQ ID NO: 840023 - RNA, 18 nt, Human
ggcgcagcggccggcagc

SEQ ID NO: 840024 - RNA, 20 nt, Human
gggaagagccaggccuaggg

SEQ ID NO: 840025 - RNA, 19 nt, Human
gggccagggaggggagaag

SEQ ID NO: 840026 - RNA, 19 nt, Human
gggccagggaggggagaag

SEQ ID NO: 840027 - RNA, 20 nt, Human
gggccagggaggggagaagu

SEQ ID NO: 840028 - RNA, 20 nt, Human
gggccagggaggggagaagu

SEQ ID NO: 840029 - RNA, 22 nt, Human
gggcugugccgccuuucggccg

SEQ ID NO: 840030 - RNA, 18 nt, Human
gugggagaaaacugagaa

SEQ ID NO: 840031 - RNA, 18 nt, Human
gugggagaaaacugagaa

SEQ ID NO: 840032 - RNA, 21 nt, Human
uaccagcgacuuccauucagc

SEQ ID NO: 840033 - RNA, 19 nt, Human
uccaccaccuccucaguga

SEQ ID NO: 840034 - RNA, 19 nt, Human
uccgcgcccggcacacagg

SEQ ID NO: 840035 - RNA, 19 nt, Human
ucgcaaccgaaaccaccac

SEQ ID NO: 840036 - RNA, 24 nt, Human
ucucugggcaggggugaauguggg

SEQ ID NO: 840037 - RNA, 24 nt, Human
ucucugggcaggggugaauguggg

SEQ ID NO: 840038 - RNA, 18 nt, Human
ugagaagggccagggagg

SEQ ID NO: 840039 - RNA, 18 nt, Human
ugagaagggccagggagg

SEQ ID NO: 840040 - RNA, 21 nt, Human
ugagaagggccagggagggga

SEQ ID NO: 840041 - RNA, 21 nt, Human
ugagaagggccagggagggga

SEQ ID NO: 840042 - RNA, 23 nt, Human
ugccucgcuccuccccugcccuc

SEQ ID NO: 840043 - RNA, 24 nt, Human
ugccucgcuccuccccugcccuca

SEQ ID NO: 840044 - RNA, 26 nt, Human
ugccucgcuccuccccugcccucagc

SEQ ID NO: 840045 - RNA, 26 nt, Human
uggaggaagggagggaagggaaggcg

SEQ ID NO: 840046 - RNA, 25 nt, Human
uggguuuggcaaggagagcaacagg

SEQ ID NO: 840047 - RNA, 21 nt, Human
ugucgcaaccgaaaccaccac

SEQ ID NO: 840048 - RNA, 20 nt, Human
uuccuuugccuccaguaggg

SEQ ID NO: 840049 - RNA, 20 nt, Human
uuccuuugccuccaguaggg

SEQ ID NO: 840050 - RNA, 21 nt, Human
uucuugguuuaggcgaaauac

SEQ ID NO: 840051 - RNA, 21 nt, Human
uucuugguuuaggcgaaauac

SEQ ID NO: 840052 - RNA, 18 nt, Human
uuucuugguuuaggcgaa

SEQ ID NO: 840053 - RNA, 18 nt, Human
uuucuugguuuaggcgaa

SEQ ID NO: 840054 - RNA, 20 nt, Human
aagcggcggcggagggaggc

SEQ ID NO: 840055 - RNA, 18 nt, Human
agagggggcagggcgggg

SEQ ID NO: 840056 - RNA, 18 nt, Human
agccggcccaagcggcgg

SEQ ID NO: 840057 - RNA, 23 nt, Human
agggcgggggaggggaagggacg

SEQ ID NO: 840058 - RNA, 25 nt, Human
agggcgggggaggggaagggacgcc

SEQ ID NO: 840059 - RNA, 22 nt, Human
caggggcggccggguggggggg

SEQ ID NO: 840060 - RNA, 20 nt, Human
ccccccgccggccuggggac

SEQ ID NO: 840061 - RNA, 19 nt, Human
ccccucucuuccccucccc

SEQ ID NO: 840062 - RNA, 27 nt, Human
ccccucucuuccccuccccccccgccg

SEQ ID NO: 840063 - RNA, 23 nt, Human
cgcggagccggcccaagcggcgg

SEQ ID NO: 840064 - RNA, 19 nt, Human
cgugcagcggggaccccgg

SEQ ID NO: 840065 - RNA, 20 nt, Human
gcaggggcggccgggugggg

SEQ ID NO: 840066 - RNA, 20 nt, Human
gccgcggagggggcgcggag

SEQ ID NO: 840067 - RNA, 21 nt, Human
gcgcggcgggagagggggcag

SEQ ID NO: 840068 - RNA, 18 nt, Human
ggcaggcgggcgggcggg

SEQ ID NO: 840069 - RNA, 20 nt, Human
ggcaggggcggccggguggg

SEQ ID NO: 840070 - RNA, 23 nt, Human
ggccggguggggggggcgggggu

SEQ ID NO: 840071 - RNA, 19 nt, Human
ggccuggggacgcgagcuc

SEQ ID NO: 840072 - RNA, 21 nt, Human
ggcggccggguggggggggcg

SEQ ID NO: 840073 - RNA, 18 nt, Human
gggcagggcgggggaggg

SEQ ID NO: 840074 - RNA, 22 nt, Human
gggcaggggcggccgggugggg

SEQ ID NO: 840075 - RNA, 26 nt, Human
gggcggcgggcaggcgggcgggcggg

SEQ ID NO: 840076 - RNA, 19 nt, Human
gggcgggggaggggaaggg

SEQ ID NO: 840077 - RNA, 20 nt, Human
ggggcagggcgggggagggg

SEQ ID NO: 840078 - RNA, 19 nt, Human
ggggcggccgggugggggg

SEQ ID NO: 840079 - RNA, 18 nt, Human
ggguggggggggcggggg

SEQ ID NO: 840080 - RNA, 18 nt, Human
ucccaggguccccucucu

SEQ ID NO: 840081 - RNA, 24 nt, Human
ucccaggguccccucucuuccccu

SEQ ID NO: 840082 - RNA, 20 nt, Human
uccccccccgccggccuggg

SEQ ID NO: 840083 - RNA, 23 nt, Human
ucuuccccuccccccccgccggc

SEQ ID NO: 840084 - RNA, 19 nt, Human
uggggacgcgagcucaaaa

SEQ ID NO: 840085 - RNA, 18 nt, Human
aaacaauuucuacauaua

SEQ ID NO: 840086 - RNA, 19 nt, Human
aacuggaaaaggcggccgc

SEQ ID NO: 840087 - RNA, 21 nt, Human
aagcagaaggaaauaccuugg

SEQ ID NO: 840088 - RNA, 20 nt, Human
aauuuuguucuuuugaagca

SEQ ID NO: 840089 - RNA, 22 nt, Human
acagggacaacucuggggaaca

SEQ ID NO: 840090 - RNA, 26 nt, Human
acauacuugcauacauauguguacau

SEQ ID NO: 840091 - RNA, 23 nt, Human
accucagugcaccuuuuucacug

SEQ ID NO: 840092 - RNA, 18 nt, Human
acuacacuuugcccucac

SEQ ID NO: 840093 - RNA, 22 nt, Human
agugaguuuucuuucccaauuu

SEQ ID NO: 840094 - RNA, 24 nt, Human
auaauuucucaaaacuagcuuucc

SEQ ID NO: 840095 - RNA, 20 nt, Human
caacaugaaauuaacaugac

SEQ ID NO: 840096 - RNA, 23 nt, Human
caauuucuucuaccaacuacacu

SEQ ID NO: 840097 - RNA, 20 nt, Human
caccuggaacuggaaaaggc

SEQ ID NO: 840098 - RNA, 26 nt, Human
cacuucugcacaccuggaacuggaaa

SEQ ID NO: 840099 - RNA, 20 nt, Human
cccgcgcgaucucggagcca

SEQ ID NO: 840100 - RNA, 22 nt, Human
ccggcggccccgcgcgaucucg

SEQ ID NO: 840101 - RNA, 22 nt, Human
cuagacacuacagggacaacuc

SEQ ID NO: 840102 - RNA, 20 nt, Human
cuuccggcggccccgcgcga

SEQ ID NO: 840103 - RNA, 20 nt, Human
gacacuucugcacaccugga

SEQ ID NO: 840104 - RNA, 19 nt, Human
gcggagggcggcgccggcu

SEQ ID NO: 840105 - RNA, 22 nt, Human
gcggagggcggcgccggcugcg

SEQ ID NO: 840106 - RNA, 20 nt, Human
gcggcgccggcugcggcugc

SEQ ID NO: 840107 - RNA, 18 nt, Human
gggcaaugaauuauucau

SEQ ID NO: 840108 - RNA, 21 nt, Human
uaaacauagcacauuagauag

SEQ ID NO: 840109 - RNA, 18 nt, Human
uaccucagugcaccuuuu

SEQ ID NO: 840110 - RNA, 20 nt, Human
uacuugcauacauaugugua

SEQ ID NO: 840111 - RNA, 19 nt, Human
uaguaaauagcaauuaacg

SEQ ID NO: 840112 - RNA, 24 nt, Human
uauauacauacuugcauacauaug

SEQ ID NO: 840113 - RNA, 29 nt, Human
uauauacauacuugcauacauauguguag

SEQ ID NO: 840114 - RNA, 24 nt, Human
ucacauccauuccagaggaaaauc

SEQ ID NO: 840115 - RNA, 21 nt, Human
ucuaccaacuacacuuugccc

SEQ ID NO: 840116 - RNA, 21 nt, Human
ucuugggcuuccggcggcccc

SEQ ID NO: 840117 - RNA, 19 nt, Human
ucuuucccaauuuuguucu

SEQ ID NO: 840118 - RNA, 23 nt, Human
ugcuugcugugggugccacaaug

SEQ ID NO: 840119 - RNA, 19 nt, Human
uggggagggcggagggcgg

SEQ ID NO: 840120 - RNA, 21 nt, Human
uguuaccucagugcaccuuuu

SEQ ID NO: 840121 - RNA, 19 nt, Human
uguuauggacugauuucag

SEQ ID NO: 840122 - RNA, 23 nt, Human
uguuugaucaagacucaagugag

SEQ ID NO: 840123 - RNA, 22 nt, Human
uucuaccaacuacacuuugccc

SEQ ID NO: 840124 - RNA, 23 nt, Human
uugcauacauauguguacauuac

SEQ ID NO: 840125 - RNA, 18 nt, Human
uuggggagggcggagggc

SEQ ID NO: 840126 - RNA, 20 nt, Human
uuucucaaaacuagcuuucc

SEQ ID NO: 840127 - RNA, 22 nt, Human
uuugaagcagaaggaaauaccu

SEQ ID NO: 840128 - RNA, 24 nt, Human
uuuguguucacugaacugagacuu

SEQ ID NO: 840129 - RNA, 25 nt, Human
uuuugaagcagaaggaaauaccuug

SEQ ID NO: 840130 - RNA, 19 nt, Human
aaaagcucaucuggaacca

SEQ ID NO: 840131 - RNA, 26 nt, Human
accaaugccaaaucccgaugcuuuug

SEQ ID NO: 840132 - RNA, 21 nt, Human
accaccacccgcggccaccau

SEQ ID NO: 840133 - RNA, 18 nt, Human
caaccaccacccgcggcc

SEQ ID NO: 840134 - RNA, 19 nt, Human
cacccgcggccaccauggc

SEQ ID NO: 840135 - RNA, 20 nt, Human
cacccgcggccaccauggcc

SEQ ID NO: 840136 - RNA, 19 nt, Human
caccgaccccagcccgcgg

SEQ ID NO: 840137 - RNA, 18 nt, Human
cagcccgcggcgccuucg

SEQ ID NO: 840138 - RNA, 25 nt, Human
cagcgcagccgcgccaaccccuugg

SEQ ID NO: 840139 - RNA, 22 nt, Human
ccagcacacguugggcaggcca

SEQ ID NO: 840140 - RNA, 19 nt, Human
ccagcccgcggcgccuucg

SEQ ID NO: 840141 - RNA, 19 nt, Human
cccccugguucuuggcccc

SEQ ID NO: 840142 - RNA, 24 nt, Human
ccccgggccgcagcgcagccgcgc

SEQ ID NO: 840143 - RNA, 23 nt, Human
ccccugguucuuggccccuccug

SEQ ID NO: 840144 - RNA, 23 nt, Human
cccuaagccaccgaccccagccc

SEQ ID NO: 840145 - RNA, 20 nt, Human
cccugguucuuggccccucc

SEQ ID NO: 840146 - RNA, 24 nt, Human
ccuaagccaccgaccccagcccgc

SEQ ID NO: 840147 - RNA, 18 nt, Human
ccuaagccaccgaccccg

SEQ ID NO: 840148 - RNA, 23 nt, Human
ccugaggcugggcucaggguacc

SEQ ID NO: 840149 - RNA, 19 nt, Human
cgcacugccccgggccgca

SEQ ID NO: 840150 - RNA, 24 nt, Human
cgcagccgcgccaaccaccacccg

SEQ ID NO: 840151 - RNA, 19 nt, Human
gccucgccuucucccaccc

SEQ ID NO: 840152 - RNA, 22 nt, Human
gccucgccuucucccacccagc

SEQ ID NO: 840153 - RNA, 19 nt, Human
gcgaccuccucugcgcucc

SEQ ID NO: 840154 - RNA, 21 nt, Human
gcggcgccuucgagccuucug

SEQ ID NO: 840155 - RNA, 19 nt, Human
gcugccgccucgccuucuc

SEQ ID NO: 840156 - RNA, 21 nt, Human
ggcaggccacccgccgccggc

SEQ ID NO: 840157 - RNA, 24 nt, Human
gggcaggccacccgccgccggcuc

SEQ ID NO: 840158 - RNA, 19 nt, Human
ggugagggggcagccucgg

SEQ ID NO: 840159 - RNA, 22 nt, Human
guuugcuuuaaaagcucaucug

SEQ ID NO: 840160 - RNA, 23 nt, Human
uaaaagcucaucuggaaccaaug

SEQ ID NO: 840161 - RNA, 19 nt, Human
ucccggcuccgcacugccc

SEQ ID NO: 840162 - RNA, 20 nt, Human
ucccuaagccaccgacccca

SEQ ID NO: 840163 - RNA, 24 nt, Human
ucccuaagccaccgaccccagccc

SEQ ID NO: 840164 - RNA, 21 nt, Human
uccggcgccgcgaccuccucu

SEQ ID NO: 840165 - RNA, 22 nt, Human
ucugcagcuggggcccgcgggc

SEQ ID NO: 840166 - RNA, 18 nt, Human
ugaugcucagggcuggau

SEQ ID NO: 840167 - RNA, 18 nt, Human
ugauggcccccugguucu

SEQ ID NO: 840168 - RNA, 18 nt, Human
ugcaagaaauggcaaaca

SEQ ID NO: 840169 - RNA, 20 nt, Human
ugcaagaaauggcaaacaac

SEQ ID NO: 840170 - RNA, 22 nt, Human
ugcaagaaauggcaaacaacug

SEQ ID NO: 840171 - RNA, 22 nt, Human
ugccaaaucccgaugcuuuuga

SEQ ID NO: 840172 - RNA, 21 nt, Human
ugccccgggccgcagcgcagc

SEQ ID NO: 840173 - RNA, 22 nt, Human
uggaaccaaugccaaaucccga

SEQ ID NO: 840174 - RNA, 23 nt, Human
uggcccccugguucuuggccccu

SEQ ID NO: 840175 - RNA, 22 nt, Human
ugggugaugcucagggcuggau

SEQ ID NO: 840176 - RNA, 22 nt, Human
uuaaaagcucaucuggaaccaa

SEQ ID NO: 840177 - RNA, 18 nt, Human
uucugggugagggggcag

SEQ ID NO: 840178 - RNA, 20 nt, Human
uuggccccuccugaggcugg

SEQ ID NO: 840179 - RNA, 24 nt, Human
aaaaaagaaguaaauacaagaaaa

SEQ ID NO: 840180 - RNA, 22 nt, Human
aaaaagaaaaauuacugcaaac

SEQ ID NO: 840181 - RNA, 23 nt, Human
aaaagcaggaggcaucaagcugu

SEQ ID NO: 840182 - RNA, 21 nt, Human
aaaaggacaguuauauauuua

SEQ ID NO: 840183 - RNA, 18 nt, Human
aaacuccaaguuuagcca

SEQ ID NO: 840184 - RNA, 25 nt, Human
aaauaaucaacaugaaauggucaac

SEQ ID NO: 840185 - RNA, 20 nt, Human
aagaaguaaauacaagaaaa

SEQ ID NO: 840186 - RNA, 21 nt, Human
accuccuccaacccaggaucg

SEQ ID NO: 840187 - RNA, 25 nt, Human
acuccaaguuuagccaggacaaacc

SEQ ID NO: 840188 - RNA, 18 nt, Human
agaaaaaaaauacaugua

SEQ ID NO: 840189 - RNA, 20 nt, Human
agaaaaaaaauacauguaca

SEQ ID NO: 840190 - RNA, 20 nt, Human
agagcaucauuuaccugaaa

SEQ ID NO: 840191 - RNA, 22 nt, Human
agcuucaaaaauccugaaaaua

SEQ ID NO: 840192 - RNA, 23 nt, Human
auaaugauaaaaagaaaaauuac

SEQ ID NO: 840193 - RNA, 20 nt, Human
auguugaaauaucucaagca

SEQ ID NO: 840194 - RNA, 22 nt, Human
caaaaauaaaguuccuuucuuc

SEQ ID NO: 840195 - RNA, 19 nt, Human
caacccaggaucgacgcgg

SEQ ID NO: 840196 - RNA, 21 nt, Human
cacgcucuuucaagugcuccc

SEQ ID NO: 840197 - RNA, 19 nt, Human
cacuuagcggcaacauggg

SEQ ID NO: 840198 - RNA, 25 nt, Human
cagcagaucugcuucauccugaccc

SEQ ID NO: 840199 - RNA, 24 nt, Human
cagcuucaaaaauccugaaaauau

SEQ ID NO: 840200 - RNA, 19 nt, Human
cauaaacugcuauaaaagc

SEQ ID NO: 840201 - RNA, 22 nt, Human
caucugaaaagucuacagcaga

SEQ ID NO: 840202 - RNA, 22 nt, Human
cauuacaugccagcaguacaua

SEQ ID NO: 840203 - RNA, 18 nt, Human
ccaggacaaacauaauga

SEQ ID NO: 840204 - RNA, 23 nt, Human
ccucagcggccgccaccuccucc

SEQ ID NO: 840205 - RNA, 23 nt, Human
cuccaaguuuagccaggacaaac

SEQ ID NO: 840206 - RNA, 24 nt, Human
cuccccauaaacugcuauaaaagc

SEQ ID NO: 840207 - RNA, 20 nt, Human
cuuacauuuaaaaaaaagaa

SEQ ID NO: 840208 - RNA, 24 nt, Human
cuucacgccgcagccucagcggcc

SEQ ID NO: 840209 - RNA, 18 nt, Human
cuugcaaaaauaaaguuc

SEQ ID NO: 840210 - RNA, 24 nt, Human
gagucacaauuaaaguacucauac

SEQ ID NO: 840211 - RNA, 25 nt, Human
gcaacaaaagaacaauuaguuuaga

SEQ ID NO: 840212 - RNA, 19 nt, Human
gcccgccgucuucacgccg

SEQ ID NO: 840213 - RNA, 19 nt, Human
gccuagaaaaaaaauacau

SEQ ID NO: 840214 - RNA, 21 nt, Human
uaaaaagggccacauacuaua

SEQ ID NO: 840215 - RNA, 25 nt, Human
uaaauacaagaaaacuaagcauuac

SEQ ID NO: 840216 - RNA, 18 nt, Human
uagccaggacaaacauaa

SEQ ID NO: 840217 - RNA, 21 nt, Human
ucagcggccgccaccuccucc

SEQ ID NO: 840218 - RNA, 22 nt, Human
ucaggcaaagcaaauaaugaac

SEQ ID NO: 840219 - RNA, 25 nt, Human
uccacacaauuuaaaauaaucaaca

SEQ ID NO: 840220 - RNA, 21 nt, Human
ugaaauaucucaagcauaaaa

SEQ ID NO: 840221 - RNA, 22 nt, Human
ugaguauaaccacacauaugaa

SEQ ID NO: 840222 - RNA, 23 nt, Human
uucaagugcuccccauaaacugc

SEQ ID NO: 840223 - RNA, 23 nt, Human
uucauuuaaaaaaaaaaagaacc

SEQ ID NO: 840224 - RNA, 22 nt, Human
uuuagccaggacaaacauaaug

SEQ ID NO: 840225 - RNA, 24 nt, Human
uuuuuuuuuuuuuuuuuuaauuuu

SEQ ID NO: 840226 - RNA, 25 nt, Human
aaaaagaaagcucaaacuagaaagc

SEQ ID NO: 840227 - RNA, 26 nt, Human
aaaauacauugacuacuagaauacga

SEQ ID NO: 840228 - RNA, 21 nt, Human
aaacaacagcaugacauuaac

SEQ ID NO: 840229 - RNA, 24 nt, Human
aaaugaaagucugcaaggcucaga

SEQ ID NO: 840230 - RNA, 22 nt, Human
aaauuacaaaaucuaaagccaa

SEQ ID NO: 840231 - RNA, 19 nt, Human
aacacuuaacacaugaaca

SEQ ID NO: 840232 - RNA, 19 nt, Human
aacagcaugacauuaacag

SEQ ID NO: 840233 - RNA, 19 nt, Human
aagcaguaagaucucaaaa

SEQ ID NO: 840234 - RNA, 18 nt, Human
aaggaucaauaaggacug

SEQ ID NO: 840235 - RNA, 24 nt, Human
aaggucacaugugcagguacauga

SEQ ID NO: 840236 - RNA, 20 nt, Human
aaugguaacgccaagaaaaa

SEQ ID NO: 840237 - RNA, 23 nt, Human
acucuuagggaaagggagaggga

SEQ ID NO: 840238 - RNA, 21 nt, Human
acuguuuuaaaaaugcagaaa

SEQ ID NO: 840239 - RNA, 21 nt, Human
agauauaagcaguauauaacc

SEQ ID NO: 840240 - RNA, 22 nt, Human
aggaucaauaaggacugcagaa

SEQ ID NO: 840241 - RNA, 24 nt, Human
augcaaccaaaacggguucaaacu

SEQ ID NO: 840242 - RNA, 21 nt, Human
auucugauaaaacaaaaacua

SEQ ID NO: 840243 - RNA, 22 nt, Human
caacagcaugacauuaacagaa

SEQ ID NO: 840244 - RNA, 22 nt, Human
caaguaaacacaaauuauacaa

SEQ ID NO: 840245 - RNA, 22 nt, Human
caauugccaaucucacguuaau

SEQ ID NO: 840246 - RNA, 19 nt, Human
cacuaaaacaaaagaguac

SEQ ID NO: 840247 - RNA, 21 nt, Human
cagaaaguuacaaguaaacac

SEQ ID NO: 840248 - RNA, 18 nt, Human
caugacauuaacagaaaa

SEQ ID NO: 840249 - RNA, 27 nt, Human
ccagcagacaacucuuagggaaaggga

SEQ ID NO: 840250 - RNA, 22 nt, Human
cucagggaaaaaaauuacaaaa

SEQ ID NO: 840251 - RNA, 22 nt, Human
cuuagggaaagggagagggaaa

SEQ ID NO: 840252 - RNA, 19 nt, Human
gcagaaucuucuucaagcu

SEQ ID NO: 840253 - RNA, 23 nt, Human
gcagaaucuucuucaagcugaga

SEQ ID NO: 840254 - RNA, 24 nt, Human
gcagaaucuucuucaagcugagaa

SEQ ID NO: 840255 - RNA, 18 nt, Human
gcauuucaauugccaauc

SEQ ID NO: 840256 - RNA, 20 nt, Human
uaacauuaaaaacaaagaac

SEQ ID NO: 840257 - RNA, 24 nt, Human
uaacauuccaaacauguauaacca

SEQ ID NO: 840258 - RNA, 21 nt, Human
uaacuugaauccacagauaua

SEQ ID NO: 840259 - RNA, 18 nt, Human
uacaaaaucuaaagccaa

SEQ ID NO: 840260 - RNA, 24 nt, Human
uacaaguaaacacaaauuauacau

SEQ ID NO: 840261 - RNA, 21 nt, Human
ucacugaaaauacauugacua

SEQ ID NO: 840262 - RNA, 24 nt, Human
ucaguauuguauuuaaaaaagguu

SEQ ID NO: 840263 - RNA, 22 nt, Human
uccacagauauaagcaguauau

SEQ ID NO: 840264 - RNA, 22 nt, Human
uccacuaaaacaaaagaguaca

SEQ ID NO: 840265 - RNA, 21 nt, Human
ucuagcaggaacucagggaaa

SEQ ID NO: 840266 - RNA, 23 nt, Human
ugaauccacagauauaagcagua

SEQ ID NO: 840267 - RNA, 19 nt, Human
ugacuacuagaauacgaaa

SEQ ID NO: 840268 - RNA, 22 nt, Human
uucacaaaggucacaugugcag

SEQ ID NO: 840269 - RNA, 23 nt, Human
uucacaaaggucacaugugcagg

SEQ ID NO: 840270 - RNA, 23 nt, Human
uuccaaacauguauaaccaauua

SEQ ID NO: 840271 - RNA, 18 nt, Human
uugcuauaacacuuaaca

SEQ ID NO: 840272 - RNA, 24 nt, Human
uugcuauaacacuuaacacaugaa

SEQ ID NO: 840273 - RNA, 18 nt, Human
uugucuuaaguagcuuag

SEQ ID NO: 840274 - RNA, 19 nt, Human
aaaaaucaguaaaaauaga

SEQ ID NO: 840275 - RNA, 21 nt, Human
aaaaggaaauaauuaccaagg

SEQ ID NO: 840276 - RNA, 19 nt, Human
aaaaucaguaaaaauagaa

SEQ ID NO: 840277 - RNA, 21 nt, Human
aaaggaaauaauuaccaagga

SEQ ID NO: 840278 - RNA, 24 nt, Human
aaagugcuacgauuacaggcauga

SEQ ID NO: 840279 - RNA, 24 nt, Human
aaagugcugggauuacaggcauga

SEQ ID NO: 840280 - RNA, 24 nt, Human
aacacuuuauggccuacuguccuc

SEQ ID NO: 840281 - RNA, 22 nt, Human
aaccccugaccucaggugaucc

SEQ ID NO: 840282 - RNA, 19 nt, Human
aacuaccauuaacuuaaaa

SEQ ID NO: 840283 - RNA, 24 nt, Human
aaguagcuggaauuacaggcaugu

SEQ ID NO: 840284 - RNA, 27 nt, Human
aaguagcuggaauuacaggcauguggc

SEQ ID NO: 840285 - RNA, 19 nt, Human
aagugcugggauuacaggc

SEQ ID NO: 840286 - RNA, 21 nt, Human
aagugcugggauuacaggcau

SEQ ID NO: 840287 - RNA, 26 nt, Human
aagugcugggauuacaggcaugagcc

SEQ ID NO: 840288 - RNA, 20 nt, Human
aaucaguaaaaauagaaaac

SEQ ID NO: 840289 - RNA, 25 nt, Human
aauuacuucuaaacuugccccccac

SEQ ID NO: 840290 - RNA, 21 nt, Human
acagcagcgucacagcauaac

SEQ ID NO: 840291 - RNA, 23 nt, Human
acauuaucauucucaagccauau

SEQ ID NO: 840292 - RNA, 22 nt, Human
acauuccuuuuuuuuuuuuuuu

SEQ ID NO: 840293 - RNA, 24 nt, Human
accauguuggccaggcuggugucg

SEQ ID NO: 840294 - RNA, 18 nt, Human
acgagguuucaccauguu

SEQ ID NO: 840295 - RNA, 20 nt, Human
acgagguuucaccauguugg

SEQ ID NO: 840296 - RNA, 24 nt, Human
acgagguuucaccauguuggccag

SEQ ID NO: 840297 - RNA, 25 nt, Human
acucuguugcccaggcuggagugca

SEQ ID NO: 840298 - RNA, 25 nt, Human
agacgaucauugagguuucaaaaac

SEQ ID NO: 840299 - RNA, 19 nt, Human
agcauaacacugcuaacac

SEQ ID NO: 840300 - RNA, 22 nt, Human
aggagaaacacaagauuacugc

SEQ ID NO: 840301 - RNA, 25 nt, Human
aggcuggagugcaguggugugaucu

SEQ ID NO: 840302 - RNA, 24 nt, Human
aggugauccacccaccuuggccuc

SEQ ID NO: 840303 - RNA, 21 nt, Human
agguucaagugauccuccugc

SEQ ID NO: 840304 - RNA, 22 nt, Human
aguaaaaauagaaaacauggua

SEQ ID NO: 840305 - RNA, 18 nt, Human
agugcaguggugugaucu

SEQ ID NO: 840306 - RNA, 19 nt, Human
agugcaguggugugaucuc

SEQ ID NO: 840307 - RNA, 21 nt, Human
agugcaguggugugaucucug

SEQ ID NO: 840308 - RNA, 24 nt, Human
agugcaguggugugaucucugcuc

SEQ ID NO: 840309 - RNA, 18 nt, Human
agugcugggauuacaggc

SEQ ID NO: 840310 - RNA, 23 nt, Human
aucaccuuaaacaaacacucuua

SEQ ID NO: 840311 - RNA, 22 nt, Human
augccucagccucccaaguagc

SEQ ID NO: 840312 - RNA, 23 nt, Human
caaagugcuacgauuacaggcau

SEQ ID NO: 840313 - RNA, 24 nt, Human
caaagugcuacgauuacaggcaug

SEQ ID NO: 840314 - RNA, 24 nt, Human
caaagugcugggauuacaggcaug

SEQ ID NO: 840315 - RNA, 29 nt, Human
caagcgauucuccaugccucagccuccca

SEQ ID NO: 840316 - RNA, 24 nt, Human
caaguucucgcuguguugcccagg

SEQ ID NO: 840317 - RNA, 24 nt, Human
caccacacccagcuaauuuuugua

SEQ ID NO: 840318 - RNA, 18 nt, Human
caccauguuggccaggcu

SEQ ID NO: 840319 - RNA, 21 nt, Human
caccauguuggccaggcuggu

SEQ ID NO: 840320 - RNA, 24 nt, Human
caccauguuggccaggcugguguc

SEQ ID NO: 840321 - RNA, 27 nt, Human
caccauguuggccaggcuggugucgaa

SEQ ID NO: 840322 - RNA, 22 nt, Human
cacccaccuuggccucucaaag

SEQ ID NO: 840323 - RNA, 23 nt, Human
cacccaccuuggccucucaaagu

SEQ ID NO: 840324 - RNA, 21 nt, Human
cacugcaacuucugccuccug

SEQ ID NO: 840325 - RNA, 23 nt, Human
cacugcaacuucugccuccuggg

SEQ ID NO: 840326 - RNA, 24 nt, Human
cauguuggccaggcuggugucgaa

SEQ ID NO: 840327 - RNA, 22 nt, Human
ccaaagugcugggauuacaggc

SEQ ID NO: 840328 - RNA, 23 nt, Human
ccaaagugcugggauuacaggca

SEQ ID NO: 840329 - RNA, 24 nt, Human
ccaaagugcugggauuacaggcau

SEQ ID NO: 840330 - RNA, 24 nt, Human
ccaaguagcuggaauuacaggcau

SEQ ID NO: 840331 - RNA, 21 nt, Human
ccacgcccagcugagauuaca

SEQ ID NO: 840332 - RNA, 23 nt, Human
cccaaguagcuggaauuacaggc

SEQ ID NO: 840333 - RNA, 19 nt, Human
cccaggcuggagugcagug

SEQ ID NO: 840334 - RNA, 21 nt, Human
ccccacacaugaacuguuuuc

SEQ ID NO: 840335 - RNA, 22 nt, Human
ccuagguucaagugauccuccu

SEQ ID NO: 840336 - RNA, 23 nt, Human
ccuagguucaagugauccuccug

SEQ ID NO: 840337 - RNA, 20 nt, Human
ccuccugccuuguccugcca

SEQ ID NO: 840338 - RNA, 24 nt, Human
ccuccuggguucaagcgauucucc

SEQ ID NO: 840339 - RNA, 24 nt, Human
ccugaccucaggugauccacccac

SEQ ID NO: 840340 - RNA, 25 nt, Human
cgaacuccuagguucaagugauccu

SEQ ID NO: 840341 - RNA, 24 nt, Human
cgagguuucaccauguuggccagg

SEQ ID NO: 840342 - RNA, 22 nt, Human
cgauuacaggcaugagccacug

SEQ ID NO: 840343 - RNA, 24 nt, Human
cucacugcaacuucugccuccugg

SEQ ID NO: 840344 - RNA, 24 nt, Human
cucaggugauccacccaccuuggc

SEQ ID NO: 840345 - RNA, 21 nt, Human
cuccuggguucaagcgauucu

SEQ ID NO: 840346 - RNA, 23 nt, Human
cugcaacuucugccuccuggguu

SEQ ID NO: 840347 - RNA, 24 nt, Human
cugcaacuucugccuccuggguuc

SEQ ID NO: 840348 - RNA, 19 nt, Human
cuguugcccaggcuggagu

SEQ ID NO: 840349 - RNA, 24 nt, Human
gaccucaggugauccacccaccuu

SEQ ID NO: 840350 - RNA, 23 nt, Human
gagguuucaccauguuggccagg

SEQ ID NO: 840351 - RNA, 18 nt, Human
gauuacaggcaugagcca

SEQ ID NO: 840352 - RNA, 19 nt, Human
gauuacaggcaugagccac

SEQ ID NO: 840353 - RNA, 19 nt, Human
gauuacaggcaugagccac

SEQ ID NO: 840354 - RNA, 21 nt, Human
gauuacaggcaugagccacug

SEQ ID NO: 840355 - RNA, 22 nt, Human
gauuacaggcaugagccacugc

SEQ ID NO: 840356 - RNA, 18 nt, Human
gauuacaggcaugagccg

SEQ ID NO: 840357 - RNA, 21 nt, Human
gauuacaggcaugagccgcca

SEQ ID NO: 840358 - RNA, 22 nt, Human
gauuacaggcaugagccgccac

SEQ ID NO: 840359 - RNA, 24 nt, Human
gccaaagugcugggauuacaggca

SEQ ID NO: 840360 - RNA, 24 nt, Human
gcccaggcuggagugcaguggugu

SEQ ID NO: 840361 - RNA, 22 nt, Human
gccuuguccugccaaagugcug

SEQ ID NO: 840362 - RNA, 20 nt, Human
gcuaaaggcagccccuuaca

SEQ ID NO: 840363 - RNA, 23 nt, Human
gcuggugucgaaccccugaccuc

SEQ ID NO: 840364 - RNA, 24 nt, Human
gcuguguugcccaggcuggucucg

SEQ ID NO: 840365 - RNA, 23 nt, Human
ggagucuuacucuguugcccagg

SEQ ID NO: 840366 - RNA, 22 nt, Human
ggagugcaguggugugaucucu

SEQ ID NO: 840367 - RNA, 19 nt, Human
ggauuacaggcaugagccg

SEQ ID NO: 840368 - RNA, 20 nt, Human
ggccaggcuggugucgaacc

SEQ ID NO: 840369 - RNA, 22 nt, Human
ggcuggagugcaguggugugau

SEQ ID NO: 840370 - RNA, 19 nt, Human
guaaaaauagaaaacaugg

SEQ ID NO: 840371 - RNA, 24 nt, Human
guaguagagacgagguuucaccau

SEQ ID NO: 840372 - RNA, 22 nt, Human
gugauccacccaccuuggccuc

SEQ ID NO: 840373 - RNA, 22 nt, Human
uaaagugaaaaaauugggguca

SEQ ID NO: 840374 - RNA, 18 nt, Human
uaauagagacaaguucuc

SEQ ID NO: 840375 - RNA, 18 nt, Human
uaaugacuugaaaaaguc

SEQ ID NO: 840376 - RNA, 24 nt, Human
uaauuuuuguauuuguaguagaga

SEQ ID NO: 840377 - RNA, 22 nt, Human
uacaggcaugagccacugcgcc

SEQ ID NO: 840378 - RNA, 24 nt, Human
uacaggcaugagccgccacgccca

SEQ ID NO: 840379 - RNA, 24 nt, Human
uacaggcauguggcaccacaccca

SEQ ID NO: 840380 - RNA, 18 nt, Human
uaccaaggaauucaaggc

SEQ ID NO: 840381 - RNA, 24 nt, Human
uacgauuacaggcaugagccacug

SEQ ID NO: 840382 - RNA, 25 nt, Human
uacgauuacaggcaugagccacugc

SEQ ID NO: 840383 - RNA, 24 nt, Human
uacucuguugcccaggcuggagug

SEQ ID NO: 840384 - RNA, 19 nt, Human
uacuuggugguuagagaca

SEQ ID NO: 840385 - RNA, 22 nt, Human
uagagacgagguuucaccaugu

SEQ ID NO: 840386 - RNA, 23 nt, Human
uagguucaagugauccuccugcc

SEQ ID NO: 840387 - RNA, 23 nt, Human
uaguagagacgagguuucaccau

SEQ ID NO: 840388 - RNA, 24 nt, Human
uaguagagacgagguuucaccaug

SEQ ID NO: 840389 - RNA, 26 nt, Human
uaguagagacgagguuucaccauguu

SEQ ID NO: 840390 - RNA, 19 nt, Human
uagucauaaucaaaugaag

SEQ ID NO: 840391 - RNA, 18 nt, Human
uaucaagaaaaagauuga

SEQ ID NO: 840392 - RNA, 21 nt, Human
uaucauucucaagccauauau

SEQ ID NO: 840393 - RNA, 23 nt, Human
ucaaagugcuacgauuacaggca

SEQ ID NO: 840394 - RNA, 24 nt, Human
ucaaagugcuacgauuacaggcau

SEQ ID NO: 840395 - RNA, 19 nt, Human
ucaagugauccuccugccu

SEQ ID NO: 840396 - RNA, 24 nt, Human
ucacugcaacuucugccuccuggg

SEQ ID NO: 840397 - RNA, 25 nt, Human
ucacugcaacuucugccuccugggu

SEQ ID NO: 840398 - RNA, 20 nt, Human
ucagccucccaaguagcugg

SEQ ID NO: 840399 - RNA, 21 nt, Human
ucaguaaaaauagaaaacaug

SEQ ID NO: 840400 - RNA, 22 nt, Human
ucaugaguggagccaaaacucc

SEQ ID NO: 840401 - RNA, 21 nt, Human
ucauuagucuggaaagcacua

SEQ ID NO: 840402 - RNA, 24 nt, Human
ucccaaguagcuggaauuacaggc

SEQ ID NO: 840403 - RNA, 18 nt, Human
uccuagguucaagugauc

SEQ ID NO: 840404 - RNA, 21 nt, Human
uccuagguucaagugauccuc

SEQ ID NO: 840405 - RNA, 24 nt, Human
uccuagguucaagugauccuccug

SEQ ID NO: 840406 - RNA, 20 nt, Human
uccugccuuguccugccaaa

SEQ ID NO: 840407 - RNA, 21 nt, Human
uccuggguucaagcgauucuc

SEQ ID NO: 840408 - RNA, 25 nt, Human
uccuggguucaagcgauucuccaug

SEQ ID NO: 840409 - RNA, 24 nt, Human
ucucaaagugcuacgauuacaggc

SEQ ID NO: 840410 - RNA, 23 nt, Human
ucucgaacuccuagguucaagug

SEQ ID NO: 840411 - RNA, 19 nt, Human
ucucgcuguguugcccagg

SEQ ID NO: 840412 - RNA, 23 nt, Human
ucucgcuguguugcccaggcugg

SEQ ID NO: 840413 - RNA, 24 nt, Human
ucucgcuguguugcccaggcuggu

SEQ ID NO: 840414 - RNA, 26 nt, Human
ucucgcuguguugcccaggcuggucu

SEQ ID NO: 840415 - RNA, 18 nt, Human
ucuguugcccaggcugga

SEQ ID NO: 840416 - RNA, 22 nt, Human
ucuuacucuguugcccaggcug

SEQ ID NO: 840417 - RNA, 23 nt, Human
ucuuacucuguugcccaggcugg

SEQ ID NO: 840418 - RNA, 24 nt, Human
ucuuacucuguugcccaggcugga

SEQ ID NO: 840419 - RNA, 22 nt, Human
ugacaggaaguagccuaauaca

SEQ ID NO: 840420 - RNA, 21 nt, Human
ugaccucaggugauccaccca

SEQ ID NO: 840421 - RNA, 24 nt, Human
ugaccucaggugauccacccaccu

SEQ ID NO: 840422 - RNA, 24 nt, Human
ugagaucaccuuaaacaaacacuc

SEQ ID NO: 840423 - RNA, 24 nt, Human
ugauccacccaccuuggccucuca

SEQ ID NO: 840424 - RNA, 18 nt, Human
ugcccaggcuggagugca

SEQ ID NO: 840425 - RNA, 21 nt, Human
ugcccaggcuggagugcagug

SEQ ID NO: 840426 - RNA, 24 nt, Human
ugcccaggcuggagugcaguggug

SEQ ID NO: 840427 - RNA, 24 nt, Human
ugcccaggcuggucucgaacuccu

SEQ ID NO: 840428 - RNA, 22 nt, Human
ugccucagccucccaaguagcu

SEQ ID NO: 840429 - RNA, 24 nt, Human
ugccucagccucccaaguagcugg

SEQ ID NO: 840430 - RNA, 24 nt, Human
ugcgccuggcccauuuuucgauuu

SEQ ID NO: 840431 - RNA, 20 nt, Human
ugcugggauuacaggcauga

SEQ ID NO: 840432 - RNA, 18 nt, Human
uggaauuacaggcaugug

SEQ ID NO: 840433 - RNA, 24 nt, Human
uggaauuacaggcauguggcacca

SEQ ID NO: 840434 - RNA, 24 nt, Human
uggacaacaacuaccauuaacuua

SEQ ID NO: 840435 - RNA, 24 nt, Human
uggagucuuacucuguugcccagg

SEQ ID NO: 840436 - RNA, 19 nt, Human
uggagugcaguggugugau

SEQ ID NO: 840437 - RNA, 22 nt, Human
uggagugcaguggugugaucuc

SEQ ID NO: 840438 - RNA, 23 nt, Human
uggagugcaguggugugaucucu

SEQ ID NO: 840439 - RNA, 24 nt, Human
uggagugcaguggugugaucucug

SEQ ID NO: 840440 - RNA, 24 nt, Human
uggccaggcuggugucgaaccccu

SEQ ID NO: 840441 - RNA, 18 nt, Human
uggcugcaaaaucaggua

SEQ ID NO: 840442 - RNA, 18 nt, Human
ugggauuacaggcaugag

SEQ ID NO: 840443 - RNA, 19 nt, Human
ugggauuacaggcaugagc

SEQ ID NO: 840444 - RNA, 21 nt, Human
ugggauuacaggcaugagccg

SEQ ID NO: 840445 - RNA, 22 nt, Human
ugggauuacaggcaugagccgc

SEQ ID NO: 840446 - RNA, 23 nt, Human
ugggauuacaggcaugagccgcc

SEQ ID NO: 840447 - RNA, 24 nt, Human
ugggauuacaggcaugagccgcca

SEQ ID NO: 840448 - RNA, 18 nt, Human
uguauuccuccuucucuu

SEQ ID NO: 840449 - RNA, 19 nt, Human
uguguguguguguguggau

SEQ ID NO: 840450 - RNA, 18 nt, Human
ugugugugugugugugug

SEQ ID NO: 840451 - RNA, 18 nt, Human
ugugugugugugugugug

SEQ ID NO: 840452 - RNA, 20 nt, Human
ugugugugugugugugugug

SEQ ID NO: 840453 - RNA, 22 nt, Human
ugugugugugugugugugugag

SEQ ID NO: 840454 - RNA, 21 nt, Human
ugugugugugugugugugugu

SEQ ID NO: 840455 - RNA, 21 nt, Human
ugugugugugugugugugugu

SEQ ID NO: 840456 - RNA, 24 nt, Human
uguguugcccaggcuggucucgaa

SEQ ID NO: 840457 - RNA, 21 nt, Human
uguugcccaggcuggagugca

SEQ ID NO: 840458 - RNA, 19 nt, Human
uguugcccaggcuggucuc

SEQ ID NO: 840459 - RNA, 22 nt, Human
uguugcccaggcuggucucgaa

SEQ ID NO: 840460 - RNA, 22 nt, Human
uuaacugaauuuaaaguuaugu

SEQ ID NO: 840461 - RNA, 20 nt, Human
uuacaggcauguggcaccac

SEQ ID NO: 840462 - RNA, 21 nt, Human
uuacuucuaaacuugcccccc

SEQ ID NO: 840463 - RNA, 25 nt, Human
uuagcaauaauaagaguuacacgcu

SEQ ID NO: 840464 - RNA, 24 nt, Human
uucaagcgauucuccaugccucag

SEQ ID NO: 840465 - RNA, 28 nt, Human
uucaagugauccuccugccuuguccugc

SEQ ID NO: 840466 - RNA, 28 nt, Human
uucaauuuugugugugugugugugugug

SEQ ID NO: 840467 - RNA, 24 nt, Human
uucucgcuguguugcccaggcugg

SEQ ID NO: 840468 - RNA, 24 nt, Human
uugcccaggcuggagugcaguggu

SEQ ID NO: 840469 - RNA, 24 nt, Human
uuucaccauguuggccaggcuggu

SEQ ID NO: 840470 - RNA, 24 nt, Human
uuuguaguagagacgagguuucac

SEQ ID NO: 840471 - RNA, 26 nt, Human
uuuguaguagagacgagguuucacca

SEQ ID NO: 840472 - RNA, 24 nt, Human
uuugugugugugugugugugugug

SEQ ID NO: 840473 - RNA, 23 nt, Human
uuuuaauggcugcaaaaucaggu

SEQ ID NO: 840474 - RNA, 21 nt, Human
uuuuguauuuguaguagagac

SEQ ID NO: 840475 - RNA, 20 nt, Human
uuuuuguauuuguaguagag

SEQ ID NO: 840476 - RNA, 18 nt, Human
uuuuuuuuuuuuuuuuug

SEQ ID NO: 840477 - RNA, 22 nt, Human
uuuuuuuuuuuuuuuuugcugg

SEQ ID NO: 840478 - RNA, 23 nt, Human
uuuuuuuuuuuuuuuuuugcugg

SEQ ID NO: 840479 - RNA, 21 nt, Human
aaagccccgaggaaacccuaa

SEQ ID NO: 840480 - RNA, 21 nt, Human
aaagccccgaggaaacgccaa

SEQ ID NO: 840481 - RNA, 24 nt, Human
aagaagcauuuauuagcaugcagg

SEQ ID NO: 840482 - RNA, 22 nt, Human
aagaucccgaaagccccgagga

SEQ ID NO: 840483 - RNA, 19 nt, Human
acaccgaucccaccaaagc

SEQ ID NO: 840484 - RNA, 25 nt, Human
caccaaagccccgaggaaacgccaa

SEQ ID NO: 840485 - RNA, 21 nt, Human
cacccggauuccgagaacaga

SEQ ID NO: 840486 - RNA, 27 nt, Human
cacccggauuccgagaaccggggguuc

SEQ ID NO: 840487 - RNA, 22 nt, Human
cccaccaaagccccgaggaaag

SEQ ID NO: 840488 - RNA, 18 nt, Human
cccgaaagccccgaggaa

SEQ ID NO: 840489 - RNA, 22 nt, Human
cccuaaaucucauccugaggac

SEQ ID NO: 840490 - RNA, 21 nt, Human
cgaaagccccgaggaaacccu

SEQ ID NO: 840491 - RNA, 19 nt, Human
cgaggaaacgccaaaucuc

SEQ ID NO: 840492 - RNA, 19 nt, Human
cgaggacaccgaucccacc

SEQ ID NO: 840493 - RNA, 22 nt, Human
cgccaaaucucaucccgaggac

SEQ ID NO: 840494 - RNA, 23 nt, Human
uuaggaaccgggaccucaauccg

SEQ ID NO: 840495 - RNA, 20 nt, Human
uuuuuuuuuucugaagaagc

SEQ ID NO: 840496 - RNA, 18 nt, Human
uuuuuuuuuuuuuuucug

SEQ ID NO: 840497 - RNA, 21 nt, Human
aaaagcucagcuucaucuuag

SEQ ID NO: 840498 - RNA, 19 nt, Human
aaaaguccaagucacaggc

SEQ ID NO: 840499 - RNA, 20 nt, Human
aagaauguacaggugucccc

SEQ ID NO: 840500 - RNA, 20 nt, Human
aagcaacucugccuagaagc

SEQ ID NO: 840501 - RNA, 23 nt, Human
aagcugccucucacuguagccaa

SEQ ID NO: 840502 - RNA, 27 nt, Human
aauauccaucucuucuguaucagcagc

SEQ ID NO: 840503 - RNA, 22 nt, Human
acagguaaugguuuguaaagua

SEQ ID NO: 840504 - RNA, 20 nt, Human
acagugaugauggaagaaug

SEQ ID NO: 840505 - RNA, 21 nt, Human
accugauaacucaguaagcua

SEQ ID NO: 840506 - RNA, 22 nt, Human
acuaggaugauuugugacuuug

SEQ ID NO: 840507 - RNA, 20 nt, Human
agaggaaggcuaacgagggg

SEQ ID NO: 840508 - RNA, 21 nt, Human
agcacaauucucacaacgucc

SEQ ID NO: 840509 - RNA, 23 nt, Human
auacaucuaaaaaggcauugguu

SEQ ID NO: 840510 - RNA, 22 nt, Human
auugugugugcuuuucaacaga

SEQ ID NO: 840511 - RNA, 19 nt, Human
caacguccagaggcaauag

SEQ ID NO: 840512 - RNA, 19 nt, Human
caauaaacauggacgccuu

SEQ ID NO: 840513 - RNA, 25 nt, Human
cagagggguugagauguguuaagcc

SEQ ID NO: 840514 - RNA, 19 nt, Human
cagcggagacuugcccugu

SEQ ID NO: 840515 - RNA, 23 nt, Human
cauuuuuguucaauuucuaggaa

SEQ ID NO: 840516 - RNA, 18 nt, Human
ccaagggaagaaaaagcc

SEQ ID NO: 840517 - RNA, 23 nt, Human
ccagccggcgcugcgcuucuucc

SEQ ID NO: 840518 - RNA, 19 nt, Human
ccaggccagguacagguaa

SEQ ID NO: 840519 - RNA, 19 nt, Human
cccaagggaagaaaaagcc

SEQ ID NO: 840520 - RNA, 21 nt, Human
cccuuggaaucccggagaccc

SEQ ID NO: 840521 - RNA, 18 nt, Human
ccuagaagcugccucuca

SEQ ID NO: 840522 - RNA, 23 nt, Human
ccuugaagaccuuuggguaguuc

SEQ ID NO: 840523 - RNA, 20 nt, Human
ccuuuggguaguuccauggu

SEQ ID NO: 840524 - RNA, 21 nt, Human
cgcgacaagaugucugccauc

SEQ ID NO: 840525 - RNA, 23 nt, Human
cgcgaguuucaacagaaaaagaa

SEQ ID NO: 840526 - RNA, 22 nt, Human
cggccaccgccucuuagguccu

SEQ ID NO: 840527 - RNA, 22 nt, Human
cguaaccgagcccuuggaaucc

SEQ ID NO: 840528 - RNA, 23 nt, Human
cguggccccggccaccgccucuu

SEQ ID NO: 840529 - RNA, 21 nt, Human
cuccacuguccauuucaauau

SEQ ID NO: 840530 - RNA, 24 nt, Human
cuccacuguccauuucaauaucca

SEQ ID NO: 840531 - RNA, 22 nt, Human
cuccaugucaaaccuaaggccc

SEQ ID NO: 840532 - RNA, 22 nt, Human
cucuuagguccuccaagcgcua

SEQ ID NO: 840533 - RNA, 24 nt, Human
cugugaauauaaucauuuauuugu

SEQ ID NO: 840534 - RNA, 22 nt, Human
cuuccuguuuccugaugucuuc

SEQ ID NO: 840535 - RNA, 22 nt, Human
cuugcuguacucgcucuuccug

SEQ ID NO: 840536 - RNA, 23 nt, Human
cuuuucaacagaaagaauuccaa

SEQ ID NO: 840537 - RNA, 21 nt, Human
gaagaauguacaggugucccc

SEQ ID NO: 840538 - RNA, 21 nt, Human
gauauauacaucaaaaauaca

SEQ ID NO: 840539 - RNA, 20 nt, Human
gcaaagcacuggcaacagca

SEQ ID NO: 840540 - RNA, 23 nt, Human
gcccugugauuggcgcagagcuu

SEQ ID NO: 840541 - RNA, 18 nt, Human
gcgacaagaugucugcca

SEQ ID NO: 840542 - RNA, 23 nt, Human
gcuauuaaaaagcucuaugugcu

SEQ ID NO: 840543 - RNA, 23 nt, Human
ggcaacagcagauaaaagggucu

SEQ ID NO: 840544 - RNA, 18 nt, Human
ggccccggccaccgccuc

SEQ ID NO: 840545 - RNA, 21 nt, Human
ggcuucaucuccacuguccau

SEQ ID NO: 840546 - RNA, 20 nt, Human
ggggcguggccccggccacc

SEQ ID NO: 840547 - RNA, 22 nt, Human
gguucuuuauugugugugcuuu

SEQ ID NO: 840548 - RNA, 18 nt, Human
guaaaguauuacaaaccc

SEQ ID NO: 840549 - RNA, 27 nt, Human
uaaccgagcccuuggaaucccggagac

SEQ ID NO: 840550 - RNA, 19 nt, Human
uaacucaguaagcuagugg

SEQ ID NO: 840551 - RNA, 23 nt, Human
uaacugggaaauuuauuuagaau

SEQ ID NO: 840552 - RNA, 24 nt, Human
uaccuggaccaacuccuugaagac

SEQ ID NO: 840553 - RNA, 19 nt, Human
uacuaggaugauuugugac

SEQ ID NO: 840554 - RNA, 23 nt, Human
uagccaagagucugaccugcacc

SEQ ID NO: 840555 - RNA, 22 nt, Human
uagguccuccaagcgcuauggg

SEQ ID NO: 840556 - RNA, 23 nt, Human
uagugcuauuaaaaagcucuaug

SEQ ID NO: 840557 - RNA, 23 nt, Human
ucaauaaauucaagugguaugaa

SEQ ID NO: 840558 - RNA, 22 nt, Human
uccaagucacaggcaaggaaaa

SEQ ID NO: 840559 - RNA, 23 nt, Human
uccacagcagcggagacuugccc

SEQ ID NO: 840560 - RNA, 18 nt, Human
uccaugucaaaccuaagg

SEQ ID NO: 840561 - RNA, 22 nt, Human
ucccagaaaagcugacguggcu

SEQ ID NO: 840562 - RNA, 22 nt, Human
ucugaccugcaccugauaacuc

SEQ ID NO: 840563 - RNA, 24 nt, Human
ucugaccugcaccugauaacucag

SEQ ID NO: 840564 - RNA, 19 nt, Human
ucugugacaauaaaagcuu

SEQ ID NO: 840565 - RNA, 20 nt, Human
ugaaaguuacacucgcgagu

SEQ ID NO: 840566 - RNA, 22 nt, Human
ugaagaccuuuggguaguucca

SEQ ID NO: 840567 - RNA, 18 nt, Human
ugauggaagaauguacag

SEQ ID NO: 840568 - RNA, 19 nt, Human
ugcacuaaguccuuguagc

SEQ ID NO: 840569 - RNA, 18 nt, Human
ugccucucacuguagcca

SEQ ID NO: 840570 - RNA, 21 nt, Human
ugcuacauuuccaguagauug

SEQ ID NO: 840571 - RNA, 20 nt, Human
uggaaucccggagacccgcc

SEQ ID NO: 840572 - RNA, 18 nt, Human
ugguuaccgguuguuuga

SEQ ID NO: 840573 - RNA, 22 nt, Human
uguaaaucagaggaaggcuaac

SEQ ID NO: 840574 - RNA, 25 nt, Human
uguagccaagagucugaccugcacc

SEQ ID NO: 840575 - RNA, 24 nt, Human
ugugauuggcgcagagcuugugug

SEQ ID NO: 840576 - RNA, 21 nt, Human
uguuugaaaauugaugcuguu

SEQ ID NO: 840577 - RNA, 20 nt, Human
uucacuuuauuacuaggaug

SEQ ID NO: 840578 - RNA, 19 nt, Human
uuuccacagcagcggagac

SEQ ID NO: 840579 - RNA, 25 nt, Human
cacuaucuucccuuuuuccucugaa

SEQ ID NO: 840580 - RNA, 22 nt, Human
aaagggaccgaaagcccaggac

SEQ ID NO: 840581 - RNA, 22 nt, Human
agaguuccuccugcugacccca

SEQ ID NO: 840582 - RNA, 25 nt, Human
agaguuccuccugcugaccccacuc

SEQ ID NO: 840583 - RNA, 22 nt, Human
gaugggcauuaaaagaaaggga

SEQ ID NO: 840584 - RNA, 20 nt, Human
gggaagggaaaagugugaca

SEQ ID NO: 840585 - RNA, 19 nt, Human
uagaguuccuccugcugac

SEQ ID NO: 840586 - RNA, 19 nt, Human
ugggcauuaaaagaaaggg

SEQ ID NO: 840587 - RNA, 24 nt, Human
ugggcauuaaaagaaagggaccga

SEQ ID NO: 840588 - RNA, 21 nt, Human
aaacagaagggaauaaauucc

SEQ ID NO: 840589 - RNA, 23 nt, Human
aaacagaagggaauaaauuccaa

SEQ ID NO: 840590 - RNA, 19 nt, Human
aaguuuuucaauuuccaaa

SEQ ID NO: 840591 - RNA, 24 nt, Human
aauaaaucuuccuuccgguggucc

SEQ ID NO: 840592 - RNA, 22 nt, Human
aaucuuccuuccggugguccac

SEQ ID NO: 840593 - RNA, 21 nt, Human
acaaaagaaaaaagauguacc

SEQ ID NO: 840594 - RNA, 24 nt, Human
agaagggaauaaauuccaacaaug

SEQ ID NO: 840595 - RNA, 21 nt, Human
auaaaccuugacuucacagag

SEQ ID NO: 840596 - RNA, 22 nt, Human
aucuucucaggccgccccacca

SEQ ID NO: 840597 - RNA, 20 nt, Human
caaaacuuacuggaauauuu

SEQ ID NO: 840598 - RNA, 23 nt, Human
cacaugcauuuaaaauucauuuc

SEQ ID NO: 840599 - RNA, 21 nt, Human
caccaccaccaccaccaagau

SEQ ID NO: 840600 - RNA, 22 nt, Human
caccaccaccaccaccaagauu

SEQ ID NO: 840601 - RNA, 24 nt, Human
caccaccaccaccaccaagauuug

SEQ ID NO: 840602 - RNA, 22 nt, Human
caguguaaguuacacauaugua

SEQ ID NO: 840603 - RNA, 24 nt, Human
caguguaaguuacacauauguaua

SEQ ID NO: 840604 - RNA, 18 nt, Human
cccaccaccaccaccacc

SEQ ID NO: 840605 - RNA, 20 nt, Human
cccaccaccaccaccaccaa

SEQ ID NO: 840606 - RNA, 22 nt, Human
ccccaccaccaccaccaccaag

SEQ ID NO: 840607 - RNA, 24 nt, Human
ccgccccaccaccaccaccaccaa

SEQ ID NO: 840608 - RNA, 21 nt, Human
ccuuccggugguccacaaaag

SEQ ID NO: 840609 - RNA, 23 nt, Human
ccuuuaaaacagaagggaauaaa

SEQ ID NO: 840610 - RNA, 20 nt, Human
ggaauaaauuccaacaaugc

SEQ ID NO: 840611 - RNA, 23 nt, Human
uaaacugguuaacaucaauguua

SEQ ID NO: 840612 - RNA, 23 nt, Human
uccaaaauaccuccuuuaaaaca

SEQ ID NO: 840613 - RNA, 20 nt, Human
ugaaaauaaaccuugacuuc

SEQ ID NO: 840614 - RNA, 20 nt, Human
ugaagauuacuugcugcaag

SEQ ID NO: 840615 - RNA, 19 nt, Human
ugacuucacagagaagucu

SEQ ID NO: 840616 - RNA, 20 nt, Human
uugaaugcuuauuauaugcc

SEQ ID NO: 840617 - RNA, 22 nt, Human
uuuucaauuuccaaaauaccuc

SEQ ID NO: 840618 - RNA, 27 nt, Human
aaaaagaaaacaaguuugaauguuuua

SEQ ID NO: 840619 - RNA, 22 nt, Human
aaaacaaacuuucugaacaaaa

SEQ ID NO: 840620 - RNA, 26 nt, Human
aaacaaaagaaaaaaaagaaagacaa

SEQ ID NO: 840621 - RNA, 23 nt, Human
aaacaaaugcaacgauacaagca

SEQ ID NO: 840622 - RNA, 19 nt, Human
aaacagaaaaaagaaaaca

SEQ ID NO: 840623 - RNA, 21 nt, Human
aaacagaaaaaagaaaacaag

SEQ ID NO: 840624 - RNA, 19 nt, Human
aaacucaaacuuacuuaaa

SEQ ID NO: 840625 - RNA, 22 nt, Human
aaagaaaaaaacagaaaaaaga

SEQ ID NO: 840626 - RNA, 21 nt, Human
aaagaaagcucccaagcugca

SEQ ID NO: 840627 - RNA, 21 nt, Human
aaagaaagcucccaagcugca

SEQ ID NO: 840628 - RNA, 19 nt, Human
aacaaagaaaaaaacagaa

SEQ ID NO: 840629 - RNA, 20 nt, Human
aagaaaaaaaagaaagacaa

SEQ ID NO: 840630 - RNA, 24 nt, Human
aagaaaaaaacagaaaaaagaaaa

SEQ ID NO: 840631 - RNA, 25 nt, Human
aagaaaacaaguuugaauguuuuag

SEQ ID NO: 840632 - RNA, 24 nt, Human
aagcaaaaucuguuguacauauag

SEQ ID NO: 840633 - RNA, 19 nt, Human
aagcaauuggcaaagucag

SEQ ID NO: 840634 - RNA, 19 nt, Human
aagcaauuggcaaagucag

SEQ ID NO: 840635 - RNA, 20 nt, Human
aagcucccaagcugcaguuu

SEQ ID NO: 840636 - RNA, 20 nt, Human
aagcucccaagcugcaguuu

SEQ ID NO: 840637 - RNA, 23 nt, Human
aagcugcaguuuuccagcaaaag

SEQ ID NO: 840638 - RNA, 23 nt, Human
aagcugcaguuuuccagcaaaag

SEQ ID NO: 840639 - RNA, 18 nt, Human
aauauacuaagcauacca

SEQ ID NO: 840640 - RNA, 18 nt, Human
aauauacuaagcauacca

SEQ ID NO: 840641 - RNA, 19 nt, Human
acaaaagaaaaaaaagaaa

SEQ ID NO: 840642 - RNA, 25 nt, Human
acaauacugguagcgggugucaugc

SEQ ID NO: 840643 - RNA, 23 nt, Human
acaccacacuuugaugugucccc

SEQ ID NO: 840644 - RNA, 23 nt, Human
acaccacacuuugaugugucccc

SEQ ID NO: 840645 - RNA, 22 nt, Human
accccaggaacaucuggcagaa

SEQ ID NO: 840646 - RNA, 22 nt, Human
accccaggaacaucuggcagaa

SEQ ID NO: 840647 - RNA, 21 nt, Human
acguccgagucucuugacugu

SEQ ID NO: 840648 - RNA, 25 nt, Human
agaaaaaaaagaaagacaauguuac

SEQ ID NO: 840649 - RNA, 18 nt, Human
agaagugaaacauacccu

SEQ ID NO: 840650 - RNA, 18 nt, Human
agaagugaaacauacccu

SEQ ID NO: 840651 - RNA, 25 nt, Human
agcaaaagugacuucacacaggcac

SEQ ID NO: 840652 - RNA, 25 nt, Human
agcaaaagugacuucacacaggcac

SEQ ID NO: 840653 - RNA, 22 nt, Human
agcaauuggcaaagucagacaa

SEQ ID NO: 840654 - RNA, 22 nt, Human
agcaauuggcaaagucagacaa

SEQ ID NO: 840655 - RNA, 23 nt, Human
agcauaccauauuuaauacucau

SEQ ID NO: 840656 - RNA, 23 nt, Human
agcauaccauauuuaauacucau

SEQ ID NO: 840657 - RNA, 20 nt, Human
aguaaccccaggaacaucug

SEQ ID NO: 840658 - RNA, 20 nt, Human
aguaaccccaggaacaucug

SEQ ID NO: 840659 - RNA, 21 nt, Human
auacagaucuccucaccuaca

SEQ ID NO: 840660 - RNA, 24 nt, Human
auauauaguauauauauguaugug

SEQ ID NO: 840661 - RNA, 21 nt, Human
auaucauggcacuccuuggga

SEQ ID NO: 840662 - RNA, 21 nt, Human
auaucauggcacuccuuggga

SEQ ID NO: 840663 - RNA, 22 nt, Human
augcucagugucaucucuggcu

SEQ ID NO: 840664 - RNA, 22 nt, Human
augcucagugucaucucuggcu

SEQ ID NO: 840665 - RNA, 23 nt, Human
caaaaauauuucagugauuccca

SEQ ID NO: 840666 - RNA, 21 nt, Human
caaaaucaugaaacaaaagaa

SEQ ID NO: 840667 - RNA, 26 nt, Human
caaauuaaaacaaaugcaacgauaca

SEQ ID NO: 840668 - RNA, 22 nt, Human
caaauuuuagaccugcaggaca

SEQ ID NO: 840669 - RNA, 22 nt, Human
caaauuuuagaccugcaggaca

SEQ ID NO: 840670 - RNA, 24 nt, Human
caacauuaaaauauguuucaucca

SEQ ID NO: 840671 - RNA, 26 nt, Human
caauucuauugaggaggaaacaggau

SEQ ID NO: 840672 - RNA, 25 nt, Human
cacauaauauucauuuauaacagcu

SEQ ID NO: 840673 - RNA, 22 nt, Human
cagcuguuauuaauaaagugac

SEQ ID NO: 840674 - RNA, 22 nt, Human
cagcuguuauuaauaaagugac

SEQ ID NO: 840675 - RNA, 22 nt, Human
caggaacaucuggcagaaccaa

SEQ ID NO: 840676 - RNA, 22 nt, Human
caggaacaucuggcagaaccaa

SEQ ID NO: 840677 - RNA, 21 nt, Human
caggaguuguugcugcagaga

SEQ ID NO: 840678 - RNA, 20 nt, Human
caggcaaaccaaacaccaca

SEQ ID NO: 840679 - RNA, 21 nt, Human
caggcaaaccaaacaccacac

SEQ ID NO: 840680 - RNA, 21 nt, Human
caggcaaaccaaacaccacac

SEQ ID NO: 840681 - RNA, 19 nt, Human
cauaaagaugaaacuacca

SEQ ID NO: 840682 - RNA, 18 nt, Human
cauauauaguauauauau

SEQ ID NO: 840683 - RNA, 23 nt, Human
cauccacucauaaggucagggua

SEQ ID NO: 840684 - RNA, 23 nt, Human
cauccacucauaaggucagggua

SEQ ID NO: 840685 - RNA, 19 nt, Human
caugagaaagaaacuucca

SEQ ID NO: 840686 - RNA, 19 nt, Human
caugagaaagaaacuucca

SEQ ID NO: 840687 - RNA, 23 nt, Human
ccacacuuugauguguccccagu

SEQ ID NO: 840688 - RNA, 23 nt, Human
ccacacuuugauguguccccagu

SEQ ID NO: 840689 - RNA, 19 nt, Human
ccaggaacaucuggcagaa

SEQ ID NO: 840690 - RNA, 19 nt, Human
ccaggaacaucuggcagaa

SEQ ID NO: 840691 - RNA, 21 nt, Human
ccaggcaaaccaaacaccaca

SEQ ID NO: 840692 - RNA, 20 nt, Human
ccauucaaauuuuagaccug

SEQ ID NO: 840693 - RNA, 20 nt, Human
ccauucaaauuuuagaccug

SEQ ID NO: 840694 - RNA, 21 nt, Human
cccacauguaagucugaaggu

SEQ ID NO: 840695 - RNA, 21 nt, Human
cccacauguaagucugaaggu

SEQ ID NO: 840696 - RNA, 25 nt, Human
ccccaggaacaucuggcagaaccaa

SEQ ID NO: 840697 - RNA, 25 nt, Human
ccccaggaacaucuggcagaaccaa

SEQ ID NO: 840698 - RNA, 25 nt, Human
ccccaguacuugugcuugaauuucc

SEQ ID NO: 840699 - RNA, 25 nt, Human
ccccaguacuugugcuugaauuucc

SEQ ID NO: 840700 - RNA, 18 nt, Human
cgcucacagcuauugacg

SEQ ID NO: 840701 - RNA, 18 nt, Human
cgcucacagcuauugacg

SEQ ID NO: 840702 - RNA, 23 nt, Human
cgcuucauugcuuuggcagucga

SEQ ID NO: 840703 - RNA, 20 nt, Human
cguccgagucucuugacugu

SEQ ID NO: 840704 - RNA, 19 nt, Human
cuaagcauaccauauuuaa

SEQ ID NO: 840705 - RNA, 19 nt, Human
cuaagcauaccauauuuaa

SEQ ID NO: 840706 - RNA, 22 nt, Human
cuaugcauuugccuugccuccu

SEQ ID NO: 840707 - RNA, 23 nt, Human
cucccaagcugcaguuuuccagc

SEQ ID NO: 840708 - RNA, 23 nt, Human
cucccaagcugcaguuuuccagc

SEQ ID NO: 840709 - RNA, 22 nt, Human
cucugccuguccuucccauuua

SEQ ID NO: 840710 - RNA, 24 nt, Human
cugaaagccgucugccguaucugg

SEQ ID NO: 840711 - RNA, 24 nt, Human
cugaaagccgucugccguaucugg

SEQ ID NO: 840712 - RNA, 20 nt, Human
cugccuguccuucccauuua

SEQ ID NO: 840713 - RNA, 23 nt, Human
cuuagguuggaauauacuaagca

SEQ ID NO: 840714 - RNA, 20 nt, Human
cuuccauguaaauaguucuc

SEQ ID NO: 840715 - RNA, 31 nt, Human
cuuugauccaguggguaaaugacaugacagg

SEQ ID NO: 840716 - RNA, 31 nt, Human; identical to SEQ ID NO: 840715

SEQ ID NO: 840717 - RNA, 21 nt, Human
cuuuuccacaaauuaaaacaa

SEQ ID NO: 840718 - RNA, 22 nt, Human
gaacugauaucuucaugucuug

SEQ ID NO: 840719 - RNA, 22 nt, Human
gaagagcaccagggggaaaggc

SEQ ID NO: 840720 - RNA, 18 nt, Human
gacgauguuggaaaauaa

SEQ ID NO: 840721 - RNA, 18 nt, Human
gacgauguuggaaaauaa

SEQ ID NO: 840722 - RNA, 22 nt, Human
gagcaccagggggaaaggccag

SEQ ID NO: 840723 - RNA, 21 nt, Human
gaguuguugcugcagagacag

SEQ ID NO: 840724 - RNA, 18 nt, Human
gcagaaccaaguggccga

SEQ ID NO: 840725 - RNA, 18 nt, Human
gcagaaccaaguggccga

SEQ ID NO: 840726 - RNA, 22 nt, Human
gcaggaguuguugcugcagaga

SEQ ID NO: 840727 - RNA, 18 nt, Human
gcugcagcauuuauauug

SEQ ID NO: 840728 - RNA, 18 nt, Human
gcugcagcauuuauauug

SEQ ID NO: 840729 - RNA, 22 nt, Human
ggaaaauaagacacucagaugu

SEQ ID NO: 840730 - RNA, 22 nt, Human
ggaaaauaagacacucagaugu

SEQ ID NO: 840731 - RNA, 18 nt, Human
ggaaaggccaggucuaca

SEQ ID NO: 840732 - RNA, 18 nt, Human
ggacagguaucgguuuua

SEQ ID NO: 840733 - RNA, 18 nt, Human
ggacagguaucgguuuua

SEQ ID NO: 840734 - RNA, 23 nt, Human
ggaguuguugcugcagagacagu

SEQ ID NO: 840735 - RNA, 24 nt, Human
ggauauuggugauuuuuguuuuuu

SEQ ID NO: 840736 - RNA, 22 nt, Human
ggcugaaagaauauuucgguga

SEQ ID NO: 840737 - RNA, 18 nt, Human
gggaauucuuuaaguguu

SEQ ID NO: 840738 - RNA, 18 nt, Human
guacuugacagaagagug

SEQ ID NO: 840739 - RNA, 18 nt, Human
guacuugacagaagagug

SEQ ID NO: 840740 - RNA, 20 nt, Human
guagcguaacuacauuguua

SEQ ID NO: 840741 - RNA, 20 nt, Human
uaaacuuuauccuuuauguc

SEQ ID NO: 840742 - RNA, 20 nt, Human
uaaacuuuauccuuuauguc

SEQ ID NO: 840743 - RNA, 23 nt, Human
uaaauaguucucauucccuguuu

SEQ ID NO: 840744 - RNA, 24 nt, Human
uaaauaguucucauucccuguuua

SEQ ID NO: 840745 - RNA, 24 nt, Human
uaacaaagaaaaaaacagaaaaaa

SEQ ID NO: 840746 - RNA, 25 nt, Human
uaacaaagaaaaaaacagaaaaaag

SEQ ID NO: 840747 - RNA, 21 nt, Human
uaacagcuguuuuguuuuuua

SEQ ID NO: 840748 - RNA, 27 nt, Human
uaacagcuguuuuguuuuuuaaacaau

SEQ ID NO: 840749 - RNA, 27 nt, Human
uaagacacucagauguucauauuuuag

SEQ ID NO: 840750 - RNA, 27 nt, Human
uaagacacucagauguucauauuuuag

SEQ ID NO: 840751 - RNA, 21 nt, Human
uaaggucaggguaaaguguac

SEQ ID NO: 840752 - RNA, 21 nt, Human
uaaggucaggguaaaguguac

SEQ ID NO: 840753 - RNA, 18 nt, Human
uaaggugaaagaauuaaa

SEQ ID NO: 840754 - RNA, 19 nt, Human
uaauacaaguuagauacaa

SEQ ID NO: 840755 - RNA, 21 nt, Human
uacaacaauuaaucuacaaaa

SEQ ID NO: 840756 - RNA, 21 nt, Human
uacagucuucuauauuugcuu

SEQ ID NO: 840757 - RNA, 19 nt, Human
uaccauauuuaauacucau

SEQ ID NO: 840758 - RNA, 19 nt, Human
uaccauauuuaauacucau

SEQ ID NO: 840759 - RNA, 21 nt, Human
uacuaagcauaccauauuuaa

SEQ ID NO: 840760 - RNA, 21 nt, Human
uacuaagcauaccauauuuaa

SEQ ID NO: 840761 - RNA, 23 nt, Human
uagaauauuauacagaucuccuc

SEQ ID NO: 840762 - RNA, 21 nt, Human
uaggcacuucuacaaagucuc

SEQ ID NO: 840763 - RNA, 18 nt, Human
uagguuuuuaguuaagaa

SEQ ID NO: 840764 - RNA, 18 nt, Human
uaguuaacuaucuuaggu

SEQ ID NO: 840765 - RNA, 18 nt, Human
uaguuaacuaucuuaggu

SEQ ID NO: 840766 - RNA, 20 nt, Human
uaguuaacuaucuuagguug

SEQ ID NO: 840767 - RNA, 20 nt, Human
uaguuaacuaucuuagguug

SEQ ID NO: 840768 - RNA, 25 nt, Human
uauacagaaaaauaguuuuagaucc

SEQ ID NO: 840769 - RNA, 18 nt, Human
uauaguuauggagauaag

SEQ ID NO: 840770 - RNA, 24 nt, Human
uauauaguauauauauguaugugu

SEQ ID NO: 840771 - RNA, 22 nt, Human
uauauauauguauguguauaua

SEQ ID NO: 840772 - RNA, 19 nt, Human
uaucauggcacuccuuggg

SEQ ID NO: 840773 - RNA, 19 nt, Human
uaucauggcacuccuuggg

SEQ ID NO: 840774 - RNA, 19 nt, Human
uaugucccacuuaaagaug

SEQ ID NO: 840775 - RNA, 19 nt, Human
uaugucccacuuaaagaug

SEQ ID NO: 840776 - RNA, 22 nt, Human
uaugucuuuaaacaucacagcu

SEQ ID NO: 840777 - RNA, 22 nt, Human
uaugucuuuaaacaucacagcu

SEQ ID NO: 840778 - RNA, 18 nt, Human
uauguguauauauaauau

SEQ ID NO: 840779 - RNA, 18 nt, Human
uauguguauauauaauau

SEQ ID NO: 840780 - RNA, 21 nt, Human
uauuucagaauuaucugauug

SEQ ID NO: 840781 - RNA, 22 nt, Human
ucaacguccgagucucuugacu

SEQ ID NO: 840782 - RNA, 22 nt, Human
ucaacguccgagucucuugacu

SEQ ID NO: 840783 - RNA, 18 nt, Human
ucaugaaacaaaagaaaa

SEQ ID NO: 840784 - RNA, 25 nt, Human
ucaugaaacaaaagaaaaaaaagaa

SEQ ID NO: 840785 - RNA, 26 nt, Human
uccacaaauuaaaacaaaugcaacga

SEQ ID NO: 840786 - RNA, 24 nt, Human
uccauucaaauuuuagaccugcag

SEQ ID NO: 840787 - RNA, 24 nt, Human
uccauucaaauuuuagaccugcag

SEQ ID NO: 840788 - RNA, 22 nt, Human
uccccaguacuugugcuugaau

SEQ ID NO: 840789 - RNA, 22 nt, Human
uccccaguacuugugcuugaau

SEQ ID NO: 840790 - RNA, 23 nt, Human
ucgaaccugcccuuggaauaugu

SEQ ID NO: 840791 - RNA, 23 nt, Human
ucgaaccugcccuuggaauaugu

SEQ ID NO: 840792 - RNA, 18 nt, Human
ucucaaaagucaaaauac

SEQ ID NO: 840793 - RNA, 21 nt, Human
ucucaaucuugucaagcugga

SEQ ID NO: 840794 - RNA, 21 nt, Human
ucuccaggcaaaccaaacacc

SEQ ID NO: 840795 - RNA, 21 nt, Human
ucuccaggcaaaccaaacacc

SEQ ID NO: 840796 - RNA, 18 nt, Human
ucugauuggcuguggcug

SEQ ID NO: 840797 - RNA, 18 nt, Human
ucuggcagaaccaagugg

SEQ ID NO: 840798 - RNA, 18 nt, Human
ucuggcagaaccaagugg

SEQ ID NO: 840799 - RNA, 25 nt, Human
ucuuagguuggaauauacuaagcau

SEQ ID NO: 840800 - RNA, 19 nt, Human
ugaagcucauaccgugcaa

SEQ ID NO: 840801 - RNA, 20 nt, Human
ugaagugcuguuauauccug

SEQ ID NO: 840802 - RNA, 21 nt, Human
ugaauuaacaaagaaaaaaac

SEQ ID NO: 840803 - RNA, 27 nt, Human
ugaauuaacaaagaaaaaaacagaaaa

SEQ ID NO: 840804 - RNA, 19 nt, Human
ugacuucaauaucauggca

SEQ ID NO: 840805 - RNA, 19 nt, Human
ugacuucaauaucauggca

SEQ ID NO: 840806 - RNA, 18 nt, Human
ugacuucacacaggcacu

SEQ ID NO: 840807 - RNA, 19 nt, Human
ugcuucuuuuauuucauug

SEQ ID NO: 840808 - RNA, 18 nt, Human
uggaaaauaagacacuca

SEQ ID NO: 840809 - RNA, 18 nt, Human
uggaaaauaagacacuca

SEQ ID NO: 840810 - RNA, 20 nt, Human
uggaauauacuaagcauacc

SEQ ID NO: 840811 - RNA, 24 nt, Human
ugguaccauugcuuuuuucaagug

SEQ ID NO: 840812 - RNA, 21 nt, Human
uguacaguaacaauguuuagu

SEQ ID NO: 840813 - RNA, 21 nt, Human
uguacaguaacaauguuuagu

SEQ ID NO: 840814 - RNA, 31 nt, Human
uguacauauauuuguacaucuaugcauuuca

SEQ ID NO: 840815 - RNA, 19 nt, Human
uguacaucuaugcauuugc

SEQ ID NO: 840816 - RNA, 21 nt, Human
uguacuugacagaagaguggg

SEQ ID NO: 840817 - RNA, 21 nt, Human
uguacuugacagaagaguggg

SEQ ID NO: 840818 - RNA, 22 nt, Human
ugucaagaagugaaacauaccc

SEQ ID NO: 840819 - RNA, 22 nt, Human
ugucaagaagugaaacauaccc

SEQ ID NO: 840820 - RNA, 24 nt, Human
ugugaauacaaagaaagcucccaa

SEQ ID NO: 840821 - RNA, 24 nt, Human
ugugaauacaaagaaagcucccaa

SEQ ID NO: 840822 - RNA, 23 nt, Human
uguguauauauaauauguaugua

SEQ ID NO: 840823 - RNA, 20 nt, Human
uguugcugcgaaggggacac

SEQ ID NO: 840824 - RNA, 24 nt, Human
uuaacaaagaaaaaaacagaaaaa

SEQ ID NO: 840825 - RNA, 19 nt, Human
uuaaggugaaagaauuaaa

SEQ ID NO: 840826 - RNA, 18 nt, Human
uuccauguaaauaguucu

SEQ ID NO: 840827 - RNA, 19 nt, Human
uuccucaaacaaauaauga

SEQ ID NO: 840828 - RNA, 22 nt, Human
uugcauauuguaaucacaauuc

SEQ ID NO: 840829 - RNA, 21 nt, Human
uuggaauauacuaagcauacc

SEQ ID NO: 840830 - RNA, 21 nt, Human
uuggcaaagucagacaacuga

SEQ ID NO: 840831 - RNA, 21 nt, Human
uuggcaaagucagacaacuga

SEQ ID NO: 840832 - RNA, 24 nt, Human
uuggcaugggccucucaaucuugu

SEQ ID NO: 840833 - RNA, 18 nt, Human
uugggguuacaggugaug

SEQ ID NO: 840834 - RNA, 20 nt, Human
uugggugagugaacugaaua

SEQ ID NO: 840835 - RNA, 23 nt, Human
uuguugaacugauaucuucaugu

SEQ ID NO: 840836 - RNA, 20 nt, Human
uuuguugaacugauaucuuc

SEQ ID NO: 840837 - RNA, 23 nt, Human
aaacugacuuacuaagaaaacaa

SEQ ID NO: 840838 - RNA, 20 nt, Human
aaagaugacugcccaacuga

SEQ ID NO: 840839 - RNA, 24 nt, Human
aaauggcugaacaaagaaaacuaa

SEQ ID NO: 840840 - RNA, 19 nt, Human
aacagcaaagugguagcaa

SEQ ID NO: 840841 - RNA, 20 nt, Human
aacuucuccuuuguaguguu

SEQ ID NO: 840842 - RNA, 26 nt, Human
aauaaacauuaaacugacuuacuaag

SEQ ID NO: 840843 - RNA, 24 nt, Human
acaaugaauaaguaauucucuaaa

SEQ ID NO: 840844 - RNA, 21 nt, Human
acccuuauucuuuauugcagu

SEQ ID NO: 840845 - RNA, 22 nt, Human
agagagcagauaucccaaccac

SEQ ID NO: 840846 - RNA, 18 nt, Human
aggcgaggcgaggcggcg

SEQ ID NO: 840847 - RNA, 23 nt, Human
aggcgaggcgaggcggcgggaga

SEQ ID NO: 840848 - RNA, 26 nt, Human
agguaucaacaaccacacuauguacc

SEQ ID NO: 840849 - RNA, 26 nt, Human
auaaaaauacugucacaaagaagcac

SEQ ID NO: 840850 - RNA, 19 nt, Human
auugaagaagucuuauuac

SEQ ID NO: 840851 - RNA, 19 nt, Human
caaccacacuauguaccca

SEQ ID NO: 840852 - RNA, 29 nt, Human
caagguaucaacaaccacacuauguaccu

SEQ ID NO: 840853 - RNA, 19 nt, Human
cacagaucauaaacucaga

SEQ ID NO: 840854 - RNA, 24 nt, Human
cacccugcaguuuaacaaagacug

SEQ ID NO: 840855 - RNA, 23 nt, Human
cagugaugaaauaaugagaaaaa

SEQ ID NO: 840856 - RNA, 25 nt, Human
ccaaccaccaacuugaaauggcuga

SEQ ID NO: 840857 - RNA, 21 nt, Human
ccaggcgaggcgaggcggcgg

SEQ ID NO: 840858 - RNA, 21 nt, Human
ccugcagaagccuccuuuguu

SEQ ID NO: 840859 - RNA, 22 nt, Human
gaaauaaaaauacugucacaaa

SEQ ID NO: 840860 - RNA, 22 nt, Human
guguugcuaguauaaaaaaagg

SEQ ID NO: 840861 - RNA, 23 nt, Human
uaaaaaaagguacaaguucaaaa

SEQ ID NO: 840862 - RNA, 23 nt, Human
uaaaauacauuuuuauuaaaugu

SEQ ID NO: 840863 - RNA, 23 nt, Human
uaaaaugaaugucagaaauaaaa

SEQ ID NO: 840864 - RNA, 18 nt, Human
uacagucucuaguaacag

SEQ ID NO: 840865 - RNA, 24 nt, Human
uaggcaaauaauguuuuaaaacug

SEQ ID NO: 840866 - RNA, 20 nt, Human
uauguacccaaauaaaauga

SEQ ID NO: 840867 - RNA, 22 nt, Human
ucaaaagcacacuucucuucca

SEQ ID NO: 840868 - RNA, 24 nt, Human
ucuugaacagcaaagugguagcaa

SEQ ID NO: 840869 - RNA, 27 nt, Human
ugaaauaaugagaaaaauaaacauuaa

SEQ ID NO: 840870 - RNA, 19 nt, Human
ugaugccaucccagagagc

SEQ ID NO: 840871 - RNA, 23 nt, Human
uggaagauguauugaagaagucu

SEQ ID NO: 840872 - RNA, 21 nt, Human
uggcaacauacaaaaguggcc

SEQ ID NO: 840873 - RNA, 18 nt, Human
ugggaagcaaaaucaaug

SEQ ID NO: 840874 - RNA, 19 nt, Human
uuaaaacugaagucuuugc

SEQ ID NO: 840875 - RNA, 18 nt, Human
uucacaaauucuuuacaa

SEQ ID NO: 840876 - RNA, 21 nt, Human
uuucccuccucauaaugugcc

SEQ ID NO: 840877 - RNA, 22 nt, Human
uuuuuuuuuuuuuuuuuuuagg

SEQ ID NO: 840878 - RNA, 20 nt, Human
aaacagcgcccagcuuccuc

SEQ ID NO: 840879 - RNA, 20 nt, Human
aaacagcgcccagcuuccuc

SEQ ID NO: 840880 - RNA, 25 nt, Human
aaagaaaaaacacguucugcaagaa

SEQ ID NO: 840881 - RNA, 24 nt, Human
aaagugcugggauuacaggcguga

SEQ ID NO: 840882 - RNA, 25 nt, Human
aaccauauauacacacauauguaug

SEQ ID NO: 840883 - RNA, 24 nt, Human
aagaaaaaacacguucugcaagaa

SEQ ID NO: 840884 - RNA, 21 nt, Human
aagccagccuuuggggcagga

SEQ ID NO: 840885 - RNA, 19 nt, Human
aagugcugggauuacaggc

SEQ ID NO: 840886 - RNA, 19 nt, Human
aagugcugggauuacaggc

SEQ ID NO: 840887 - RNA, 26 nt, Human
aagugcugggauuacaggcgugagcc

SEQ ID NO: 840888 - RNA, 23 nt, Human
aaguggacggaaacgauaggaag

SEQ ID NO: 840889 - RNA, 21 nt, Human
acacacagacagacacacaca

SEQ ID NO: 840890 - RNA, 23 nt, Human
acagacagacacacacacccgaa

SEQ ID NO: 840891 - RNA, 24 nt, Human
acagacagacacacacacccgaag

SEQ ID NO: 840892 - RNA, 25 nt, Human
acagacagacacacacacccgaagc

SEQ ID NO: 840893 - RNA, 21 nt, Human
acagcgcccagcuuccucacc

SEQ ID NO: 840894 - RNA, 23 nt, Human
acaggcccccagguuccuguggu

SEQ ID NO: 840895 - RNA, 18 nt, Human
acaggguuucaccguguu

SEQ ID NO: 840896 - RNA, 19 nt, Human
acaggguuucaccguguua

SEQ ID NO: 840897 - RNA, 20 nt, Human
acaggguuucaccguguuag

SEQ ID NO: 840898 - RNA, 24 nt, Human
acaggguuucaccguguuagccag

SEQ ID NO: 840899 - RNA, 22 nt, Human
acauagcuccugcuaacagccu

SEQ ID NO: 840900 - RNA, 18 nt, Human
accacaccuggccccggc

SEQ ID NO: 840901 - RNA, 19 nt, Human
accauauauacacacauau

SEQ ID NO: 840902 - RNA, 19 nt, Human
accuggccccggcacguau

SEQ ID NO: 840903 - RNA, 24 nt, Human
acggagucucgcuguguugcccag

SEQ ID NO: 840904 - RNA, 24 nt, Human
acuuugugauccgcccgccucggc

SEQ ID NO: 840905 - RNA, 18 nt, Human
agacagacacacacaccc

SEQ ID NO: 840906 - RNA, 18 nt, Human
agacaggguuucaccgug

SEQ ID NO: 840907 - RNA, 20 nt, Human
agccaccacaccuggccccg

SEQ ID NO: 840908 - RNA, 25 nt, Human
aggcuggagugcaguggcacggucu

SEQ ID NO: 840909 - RNA, 20 nt, Human
aguagagacaggguuucacc

SEQ ID NO: 840910 - RNA, 18 nt, Human
aguagcugggacuauagg

SEQ ID NO: 840911 - RNA, 20 nt, Human
agugcaguggcacggucucg

SEQ ID NO: 840912 - RNA, 23 nt, Human
agugcaguggcacggucucggcu

SEQ ID NO: 840913 - RNA, 24 nt, Human
agugcaguggcacggucucggcuc

SEQ ID NO: 840914 - RNA, 18 nt, Human
agugcugggauuacaggc

SEQ ID NO: 840915 - RNA, 24 nt, Human
caaagugcugggauuacaggcgug

SEQ ID NO: 840916 - RNA, 19 nt, Human
cacacagacagacacacac

SEQ ID NO: 840917 - RNA, 19 nt, Human
cacacagacagacacacac

SEQ ID NO: 840918 - RNA, 18 nt, Human
caccguguuagccaggau

SEQ ID NO: 840919 - RNA, 24 nt, Human
caccguguuagccaggauggucuc

SEQ ID NO: 840920 - RNA, 18 nt, Human
cacugcagcugcuucugg

SEQ ID NO: 840921 - RNA, 21 nt, Human
cagacagacacacacacccga

SEQ ID NO: 840922 - RNA, 23 nt, Human
cagacagacacacacacccgaag

SEQ ID NO: 840923 - RNA, 21 nt, Human
cagcaacacugcagcugcuuc

SEQ ID NO: 840924 - RNA, 20 nt, Human
cagcugcuggcaggagccag

SEQ ID NO: 840925 - RNA, 22 nt, Human
cagcugcuggcaggagccaggu

SEQ ID NO: 840926 - RNA, 24 nt, Human
caggguuucaccguguuagccagg

SEQ ID NO: 840927 - RNA, 22 nt, Human
cauaccauucuccugcuucagc

SEQ ID NO: 840928 - RNA, 21 nt, Human
cauauauacacacauauguau

SEQ ID NO: 840929 - RNA, 30 nt, Human
cauauguaugcauacacacagacagacaca

SEQ ID NO: 840930 - RNA, 21 nt, Human
caugagcaggcgccuggcucc

SEQ ID NO: 840931 - RNA, 18 nt, Human
cauguagaauaaaaaagc

SEQ ID NO: 840932 - RNA, 22 nt, Human
ccaaagugcugggauuacaggc

SEQ ID NO: 840933 - RNA, 22 nt, Human
ccaaagugcugggauuacaggc

SEQ ID NO: 840934 - RNA, 24 nt, Human
ccaaagugcugggauuacaggcgu

SEQ ID NO: 840935 - RNA, 18 nt, Human
ccaccacaccuggccccg

SEQ ID NO: 840936 - RNA, 19 nt, Human
ccagcucagagaggcuacc

SEQ ID NO: 840937 - RNA, 18 nt, Human
ccagcucagcugcuggca

SEQ ID NO: 840938 - RNA, 23 nt, Human
ccaguuccuggcuucugaccaaa

SEQ ID NO: 840939 - RNA, 20 nt, Human
ccaugaaggacaguguagac

SEQ ID NO: 840940 - RNA, 21 nt, Human
cccagguuccugugguaccca

SEQ ID NO: 840941 - RNA, 21 nt, Human
cccccagguuccugugguacc

SEQ ID NO: 840942 - RNA, 20 nt, Human
cccguuuuccaucccuaagu

SEQ ID NO: 840943 - RNA, 21 nt, Human
ccgaagcucuagccaggcccc

SEQ ID NO: 840944 - RNA, 22 nt, Human
ccgcagguacgcgucuuuucuu

SEQ ID NO: 840945 - RNA, 24 nt, Human
ccuccuggauucauaccauucucc

SEQ ID NO: 840946 - RNA, 18 nt, Human
ccugaacucgaaaacagc

SEQ ID NO: 840947 - RNA, 24 nt, Human
ccugcuucagccuuccgaguagcu

SEQ ID NO: 840948 - RNA, 21 nt, Human
cgaaaacagcgcccagcuucc

SEQ ID NO: 840949 - RNA, 19 nt, Human
cgagcaggagggugguggc

SEQ ID NO: 840950 - RNA, 27 nt, Human
cgagcaggagggugguggcagcaacac

SEQ ID NO: 840951 - RNA, 24 nt, Human
cgccucggccucccaaagugcugg

SEQ ID NO: 840952 - RNA, 22 nt, Human
cgcucgggagacuggggcuccu

SEQ ID NO: 840953 - RNA, 24 nt, Human
cgcuguguugcccaggcuggagug

SEQ ID NO: 840954 - RNA, 24 nt, Human
cggagucucgcuguguugcccagg

SEQ ID NO: 840955 - RNA, 22 nt, Human
cucaucuuugucugcuccccgc

SEQ ID NO: 840956 - RNA, 21 nt, Human
cuccuggauucauaccauucu

SEQ ID NO: 840957 - RNA, 22 nt, Human
cucuccggagcgggugugaaca

SEQ ID NO: 840958 - RNA, 19 nt, Human
gaacagcgcacuucaacau

SEQ ID NO: 840959 - RNA, 24 nt, Human
gaccaaagaaaaaaugucacagga

SEQ ID NO: 840960 - RNA, 22 nt, Human
gacuuugugauccgcccgccuc

SEQ ID NO: 840961 - RNA, 24 nt, Human
gacuuugugauccgcccgccucgg

SEQ ID NO: 840962 - RNA, 18 nt, Human
gagcaagugaacacgggg

SEQ ID NO: 840963 - RNA, 18 nt, Human
gagcaggcgccuggcucc

SEQ ID NO: 840964 - RNA, 22 nt, Human
gagccaccacaccuggccccgg

SEQ ID NO: 840965 - RNA, 18 nt, Human
gauuacaggcgugagcca

SEQ ID NO: 840966 - RNA, 21 nt, Human
gauuacaggcgugagccacca

SEQ ID NO: 840967 - RNA, 22 nt, Human
gauuacaggcgugagccaccac

SEQ ID NO: 840968 - RNA, 25 nt, Human
gccuagcuaauuuuuuuuuguauuu

SEQ ID NO: 840969 - RNA, 19 nt, Human
gcuggagugcaguggcacg

SEQ ID NO: 840970 - RNA, 24 nt, Human
ggaaacgauaggaagggacauagc

SEQ ID NO: 840971 - RNA, 23 nt, Human
ggagucucgcuguguugcccagg

SEQ ID NO: 840972 - RNA, 19 nt, Human
ggauuacaggcgugagcca

SEQ ID NO: 840973 - RNA, 20 nt, Human
gggagcaagugaacacgggg

SEQ ID NO: 840974 - RNA, 21 nt, Human
gggagcugggaaugguccagg

SEQ ID NO: 840975 - RNA, 19 nt, Human
guaaagaaaaaacacguuc

SEQ ID NO: 840976 - RNA, 20 nt, Human
gucccuuuggaggcuuuggc

SEQ ID NO: 840977 - RNA, 19 nt, Human
gucuuuucuuuuuuuuucc

SEQ ID NO: 840978 - RNA, 24 nt, Human
gugauccgcccgccucggccuccc

SEQ ID NO: 840979 - RNA, 23 nt, Human
gugguggcagcaacacugcagcu

SEQ ID NO: 840980 - RNA, 27 nt, Human
guuucacaggcccccagguuccugugg

SEQ ID NO: 840981 - RNA, 25 nt, Human
uaaagaaaaaacacguucugcaaga

SEQ ID NO: 840982 - RNA, 28 nt, Human
uaauuuuuuuuuguauuuuuaguagaga

SEQ ID NO: 840983 - RNA, 25 nt, Human
uacacaccugacaaaaccauauaua

SEQ ID NO: 840984 - RNA, 22 nt, Human
uacaggcgugagccaccacacc

SEQ ID NO: 840985 - RNA, 22 nt, Human
uacaggcgugagccaccacacc

SEQ ID NO: 840986 - RNA, 23 nt, Human
uacaggcgugagccaccacaccu

SEQ ID NO: 840987 - RNA, 21 nt, Human
uacccagcucagcugcuggca

SEQ ID NO: 840988 - RNA, 22 nt, Human
uagagacaggguuucaccgugu

SEQ ID NO: 840989 - RNA, 19 nt, Human
uaggugccaaccacuacgc

SEQ ID NO: 840990 - RNA, 21 nt, Human
uaguagagacaggguuucacc

SEQ ID NO: 840991 - RNA, 24 nt, Human
uaguagagacaggguuucaccgug

SEQ ID NO: 840992 - RNA, 26 nt, Human
uaguagagacaggguuucaccguguu

SEQ ID NO: 840993 - RNA, 26 nt, Human
uauauacacacauauguaugcauaca

SEQ ID NO: 840994 - RNA, 21 nt, Human
uauauacauacauauauaaag

SEQ ID NO: 840995 - RNA, 19 nt, Human
uauauauacauacauauau

SEQ ID NO: 840996 - RNA, 21 nt, Human
uauauauauacauacauauag

SEQ ID NO: 840997 - RNA, 23 nt, Human
uauauauauacauacauauauaa

SEQ ID NO: 840998 - RNA, 20 nt, Human
uauauauauauauuuucaua

SEQ ID NO: 840999 - RNA, 26 nt, Human
uauauauuuucauauauauauauaca

SEQ ID NO: 841000 - RNA, 24 nt, Human
ucaccguguuagccaggauggucu

SEQ ID NO: 841001 - RNA, 19 nt, Human
ucacugcaagcuccaccuc

SEQ ID NO: 841002 - RNA, 23 nt, Human
ucacugcaagcuccaccuccugg

SEQ ID NO: 841003 - RNA, 24 nt, Human
ucacugcaagcuccaccuccugga

SEQ ID NO: 841004 - RNA, 23 nt, Human
ucagccuuccgaguagcugggac

SEQ ID NO: 841005 - RNA, 21 nt, Human
ucauaccauucuccugcuuca

SEQ ID NO: 841006 - RNA, 24 nt, Human
ucccaaagugcugggauuacaggc

SEQ ID NO: 841007 - RNA, 21 nt, Human
ucccugaaaagcggcuugcag

SEQ ID NO: 841008 - RNA, 19 nt, Human
uccgaguagcugggacuau

SEQ ID NO: 841009 - RNA, 22 nt, Human
uccgaguagcugggacuauagg

SEQ ID NO: 841010 - RNA, 24 nt, Human
uccgaguagcugggacuauaggug

SEQ ID NO: 841011 - RNA, 23 nt, Human
uccugacuuugugauccgcccgc

SEQ ID NO: 841012 - RNA, 24 nt, Human
uccuggauucauaccauucuccug

SEQ ID NO: 841013 - RNA, 18 nt, Human
ucgaaaacagcgcccagc

SEQ ID NO: 841014 - RNA, 24 nt, Human
ucgcuguguugcccaggcuggagu

SEQ ID NO: 841015 - RNA, 18 nt, Human
ucggccucccaaagugcu

SEQ ID NO: 841016 - RNA, 21 nt, Human
ucuaggguuggggcccugagc

SEQ ID NO: 841017 - RNA, 19 nt, Human
ucuagucccuuuggaggcu

SEQ ID NO: 841018 - RNA, 22 nt, Human
ucucgcuguguugcccaggcug

SEQ ID NO: 841019 - RNA, 23 nt, Human
ucucgcuguguugcccaggcugg

SEQ ID NO: 841020 - RNA, 24 nt, Human
ucucgcuguguugcccaggcugga

SEQ ID NO: 841021 - RNA, 18 nt, Human
ucucugcugccaacugga

SEQ ID NO: 841022 - RNA, 19 nt, Human
ugaaagggggugugcaggu

SEQ ID NO: 841023 - RNA, 20 nt, Human
ugaaagggggugugcaggug

SEQ ID NO: 841024 - RNA, 21 nt, Human
ugaccaaagaaaaaaugucac

SEQ ID NO: 841025 - RNA, 23 nt, Human
ugcaccuggaugguggaagccag

SEQ ID NO: 841026 - RNA, 22 nt, Human
ugcaguggcacggucucggcuc

SEQ ID NO: 841027 - RNA, 24 nt, Human
ugcauacacacagacagacacaca

SEQ ID NO: 841028 - RNA, 30 nt, Human
ugcauacacacagacagacacacacacccu

SEQ ID NO: 841029 - RNA, 18 nt, Human
ugccaggcccuucgugcu

SEQ ID NO: 841030 - RNA, 18 nt, Human
ugcccaggcuggagugca

SEQ ID NO: 841031 - RNA, 21 nt, Human
ugcccaggcuggagugcagug

SEQ ID NO: 841032 - RNA, 22 nt, Human
ugcccaggcuggagugcagugg

SEQ ID NO: 841033 - RNA, 24 nt, Human
ugcccaggcuggagugcaguggca

SEQ ID NO: 841034 - RNA, 22 nt, Human
ugccuuuugguuguaguuucac

SEQ ID NO: 841035 - RNA, 22 nt, Human
ugcugccaacuggaaacgguuu

SEQ ID NO: 841036 - RNA, 24 nt, Human
ugcugggauuacaggcgugagcca

SEQ ID NO: 841037 - RNA, 18 nt, Human
uggagugcaguggcacgg

SEQ ID NO: 841038 - RNA, 23 nt, Human
uggagugcaguggcacggucucg

SEQ ID NO: 841039 - RNA, 24 nt, Human
uggagugcaguggcacggucucgg

SEQ ID NO: 841040 - RNA, 22 nt, Human
ugggacuauaggugccaaccac

SEQ ID NO: 841041 - RNA, 22 nt, Human
ugggacuauaggugccaaccac

SEQ ID NO: 841042 - RNA, 18 nt, Human
ugggauuacaggcgugag

SEQ ID NO: 841043 - RNA, 19 nt, Human
ugggauuacaggcgugagc

SEQ ID NO: 841044 - RNA, 22 nt, Human
ugggauuacaggcgugagccac

SEQ ID NO: 841045 - RNA, 23 nt, Human
ugggauuacaggcgugagccacc

SEQ ID NO: 841046 - RNA, 24 nt, Human
ugggauuacaggcgugagccacca

SEQ ID NO: 841047 - RNA, 20 nt, Human
ugguggaagccagccuuugg

SEQ ID NO: 841048 - RNA, 18 nt, Human
ugucacaggagacuuuga

SEQ ID NO: 841049 - RNA, 18 nt, Human
uguguugcccaggcugga

SEQ ID NO: 841050 - RNA, 22 nt, Human
uguguugcccaggcuggagugc

SEQ ID NO: 841051 - RNA, 21 nt, Human
uguugcccaggcuggagugca

SEQ ID NO: 841052 - RNA, 19 nt, Human
uuacacaccugacaaaacc

SEQ ID NO: 841053 - RNA, 22 nt, Human
uuaguagagacaggguuucacc

SEQ ID NO: 841054 - RNA, 24 nt, Human
uuaguagagacaggguuucaccgu

SEQ ID NO: 841055 - RNA, 19 nt, Human
uucacaggcccccagguuc

SEQ ID NO: 841056 - RNA, 22 nt, Human
uucacaggcccccagguuccug

SEQ ID NO: 841057 - RNA, 24 nt, Human
uucagccuuccgaguagcugggac

SEQ ID NO: 841058 - RNA, 24 nt, Human
uugcccaggcuggagugcaguggc

SEQ ID NO: 841059 - RNA, 19 nt, Human
uuucaccguguuagccagg

SEQ ID NO: 841060 - RNA, 18 nt, Human
uuucauauauauauauau

SEQ ID NO: 841061 - RNA, 19 nt, Human
uuugcugcugaaaaguagg

SEQ ID NO: 841062 - RNA, 24 nt, Human
uuuuuaguagagacaggguuucac

SEQ ID NO: 841063 - RNA, 21 nt, Human
uuuuuguauuuuuaguagaga

SEQ ID NO: 841064 - RNA, 21 nt, Human
uuuuuuguauuuuuaguagag

SEQ ID NO: 841065 - RNA, 24 nt, Human
uuuuuuguauuuuuaguagagaca

SEQ ID NO: 841066 - RNA, 19 nt, Human
aaccccucucugauccucu

SEQ ID NO: 841067 - RNA, 20 nt, Human
aaugugccccaacaugccaa

SEQ ID NO: 841068 - RNA, 26 nt, Human
accugagucuuucuucauugccuggc

SEQ ID NO: 841069 - RNA, 24 nt, Human
cacccaugugcaccagcuucccuc

SEQ ID NO: 841070 - RNA, 22 nt, Human
cagugcccucugaaugcuucuc

SEQ ID NO: 841071 - RNA, 22 nt, Human
ccacaccccaucaggcccugga

SEQ ID NO: 841072 - RNA, 23 nt, Human
ccucacgccaaaugugccccaac

SEQ ID NO: 841073 - RNA, 19 nt, Human
ccugagucccgggacacuc

SEQ ID NO: 841074 - RNA, 22 nt, Human
cugagucccgggacacucuguu

SEQ ID NO: 841075 - RNA, 19 nt, Human
cuggacacccaugugcacc

SEQ ID NO: 841076 - RNA, 20 nt, Human
gacacccaugugcaccagcu

SEQ ID NO: 841077 - RNA, 24 nt, Human
ucaaccccucucugauccucuggg

SEQ ID NO: 841078 - RNA, 20 nt, Human
uccagaagccagugcccucu

SEQ ID NO: 841079 - RNA, 20 nt, Human
ucccgggacacucuguuggg

SEQ ID NO: 841080 - RNA, 18 nt, Human
ucucugauccucuggggg

SEQ ID NO: 841081 - RNA, 19 nt, Human
ucuggcauguccagacaug

SEQ ID NO: 841082 - RNA, 20 nt, Human
ugacaugccacagcugucug

SEQ ID NO: 841083 - RNA, 20 nt, Human
ugagucccgggacacucugu

SEQ ID NO: 841084 - RNA, 23 nt, Human
ugcaccagcuucccucacgccaa

SEQ ID NO: 841085 - RNA, 21 nt, Human
ugcccucugaaugcuucuccu

SEQ ID NO: 841086 - RNA, 24 nt, Human
ugccuggccacaccccaucaggcc

SEQ ID NO: 841087 - RNA, 20 nt, Human
augauggaagcagugaagga

SEQ ID NO: 841088 - RNA, 21 nt, Human
cuuuaacugugaacuuuuaca

SEQ ID NO: 841089 - RNA, 24 nt, Human
uaggcuuuuucaggucaauuaauu

SEQ ID NO: 841090 - RNA, 22 nt, Human
uauguauuuauauauguauaua

SEQ ID NO: 841091 - RNA, 23 nt, Human
ucuguaauucagucuuuaacugu

SEQ ID NO: 841092 - RNA, 23 nt, Human
uggaagcagugaaggacucaaug

SEQ ID NO: 841093 - RNA, 22 nt, Human
uuuuuuuuuuuuuugaagagga

SEQ ID NO: 841094 - RNA, 18 nt, Human
uuuuuuuuuuuuuuuuug

SEQ ID NO: 841095 - RNA, 24 nt, Human
aaaaaauccuaaaacuuguaaaag

SEQ ID NO: 841096 - RNA, 23 nt, Human
aaacagaagaguuuuuuuccagu

SEQ ID NO: 841097 - RNA, 27 nt, Human
aaacgucauccauacaauaaagaacuc

SEQ ID NO: 841098 - RNA, 18 nt, Human
aaagagaccccgugcccc

SEQ ID NO: 841099 - RNA, 18 nt, Human
aaguaccacaaaaaaugg

SEQ ID NO: 841100 - RNA, 20 nt, Human
aagugccuuuauggggaggg

SEQ ID NO: 841101 - RNA, 22 nt, Human
acccagcccuccuugccagugg

SEQ ID NO: 841102 - RNA, 19 nt, Human
acgccaccgcagccccaga

SEQ ID NO: 841103 - RNA, 22 nt, Human
acucaagguggucaccaggugg

SEQ ID NO: 841104 - RNA, 27 nt, Human
agagcccccccaaagucacuuaguggu

SEQ ID NO: 841105 - RNA, 22 nt, Human
agagcccccccaaagucacuuu

SEQ ID NO: 841106 - RNA, 21 nt, Human
aggcaggggcagggcucucug

SEQ ID NO: 841107 - RNA, 19 nt, Human
aggcggcccucccagcagc

SEQ ID NO: 841108 - RNA, 19 nt, Human
aggcggggacgggcuucgg

SEQ ID NO: 841109 - RNA, 26 nt, Human
agggcuucaaaaguuuugaacagaau

SEQ ID NO: 841110 - RNA, 19 nt, Human
caaaguaccacaaaaaaug

SEQ ID NO: 841111 - RNA, 21 nt, Human
caagaaguugguaaaacagaa

SEQ ID NO: 841112 - RNA, 19 nt, Human
cacacccugcagaaacugc

SEQ ID NO: 841113 - RNA, 21 nt, Human
cacccugcagaaacugcaucu

SEQ ID NO: 841114 - RNA, 20 nt, Human
cacgccacacccugcagaaa

SEQ ID NO: 841115 - RNA, 18 nt, Human
cacggccaggcgcucugg

SEQ ID NO: 841116 - RNA, 19 nt, Human
cacugugcuggggcuggga

SEQ ID NO: 841117 - RNA, 18 nt, Human
caucagggacaucgcggg

SEQ ID NO: 841118 - RNA, 31 nt, Human
ccacaaaaaauggccacgggauugauccccc

SEQ ID NO: 841119 - RNA, 19 nt, Human
ccaccugugaccagggagc

SEQ ID NO: 841120 - RNA, 23 nt, Human
ccacgccaccgcagccccagaca

SEQ ID NO: 841121 - RNA, 24 nt, Human
cccacgccaccgcagccccagaca

SEQ ID NO: 841122 - RNA, 21 nt, Human
ccccgugccccgcucuccuca

SEQ ID NO: 841123 - RNA, 24 nt, Human
ccgcgcccuccccacgccaccgca

SEQ ID NO: 841124 - RNA, 23 nt, Human
ccgcugcccggcgccugccgccc

SEQ ID NO: 841125 - RNA, 25 nt, Human
ccgcugcccggcgccugccgcccgg

SEQ ID NO: 841126 - RNA, 19 nt, Human
ccggcacccagcccuccuu

SEQ ID NO: 841127 - RNA, 23 nt, Human
ccuccacuucuccggaagcagcu

SEQ ID NO: 841128 - RNA, 21 nt, Human
ccucgcccgggcccuuggcag

SEQ ID NO: 841129 - RNA, 20 nt, Human
ccucgcccgggcccuuggcc

SEQ ID NO: 841130 - RNA, 18 nt, Human
ccugccgcccggggcugu

SEQ ID NO: 841131 - RNA, 18 nt, Human
ccugccgcccggggcugu

SEQ ID NO: 841132 - RNA, 23 nt, Human
cgacgagacggaggcaccgcgcc

SEQ ID NO: 841133 - RNA, 20 nt, Human
cgagccggacggacaggcug

SEQ ID NO: 841134 - RNA, 26 nt, Human
cgagccggacggacaggcugcuggcc

SEQ ID NO: 841135 - RNA, 22 nt, Human
cgagccggacgggccgagccgg

SEQ ID NO: 841136 - RNA, 20 nt, Human
cgaggccgcgcuaccccugc

SEQ ID NO: 841137 - RNA, 19 nt, Human
cgcccgggcccuuggcagc

SEQ ID NO: 841138 - RNA, 21 nt, Human
cggccccuccucugugggcuc

SEQ ID NO: 841139 - RNA, 18 nt, Human
cggggcguccgggggccg

SEQ ID NO: 841140 - RNA, 18 nt, Human
cgucacgggugggcucgg

SEQ ID NO: 841141 - RNA, 23 nt, Human
cgugcggggcaguccggggcuga

SEQ ID NO: 841142 - RNA, 21 nt, Human
cuaaagagaccccgugccccg

SEQ ID NO: 841143 - RNA, 24 nt, Human
cuccccacgccaccgcagccccag

SEQ ID NO: 841144 - RNA, 26 nt, Human
cucuccccacuuucacuucuguacuc

SEQ ID NO: 841145 - RNA, 21 nt, Human
cucugccccggagggguccuc

SEQ ID NO: 841146 - RNA, 21 nt, Human
cugaaagcaccguccagaggc

SEQ ID NO: 841147 - RNA, 21 nt, Human
cugcagcuggacgaguugcuc

SEQ ID NO: 841148 - RNA, 23 nt, Human
cuuggcuucuaacugcuuuuggu

SEQ ID NO: 841149 - RNA, 23 nt, Human
gaaaaaauccuaaaacuuguaaa

SEQ ID NO: 841150 - RNA, 19 nt, Human
gaccccgugccccgcucuc

SEQ ID NO: 841151 - RNA, 21 nt, Human
gagacaccaccugaugucacc

SEQ ID NO: 841152 - RNA, 22 nt, Human
gagacaccaccugaugucaccc

SEQ ID NO: 841153 - RNA, 20 nt, Human
gagggguccucugcagcccg

SEQ ID NO: 841154 - RNA, 18 nt, Human
gcacaguacaucagggac

SEQ ID NO: 841155 - RNA, 22 nt, Human
gcaggggcagggcucucugagc

SEQ ID NO: 841156 - RNA, 24 nt, Human
gcaggggcagggcucucugagcua

SEQ ID NO: 841157 - RNA, 25 nt, Human
gccccagacagcgcgcgggucuccg

SEQ ID NO: 841158 - RNA, 22 nt, Human
gcggggagaucaggcggggacg

SEQ ID NO: 841159 - RNA, 18 nt, Human
gcuguucccugcggcccc

SEQ ID NO: 841160 - RNA, 21 nt, Human
ggccagugacggcuacaagcc

SEQ ID NO: 841161 - RNA, 23 nt, Human
ggccguuggccagaggauccucc

SEQ ID NO: 841162 - RNA, 21 nt, Human
gggaaccgugaggcugugagg

SEQ ID NO: 841163 - RNA, 18 nt, Human
gggcagggcucucugagc

SEQ ID NO: 841164 - RNA, 19 nt, Human
gggcagggcucucugagcu

SEQ ID NO: 841165 - RNA, 19 nt, Human
gggcaguccggggcugagc

SEQ ID NO: 841166 - RNA, 21 nt, Human
gggccgagccggacgggccga

SEQ ID NO: 841167 - RNA, 23 nt, Human
ggggagaucaggcggggacgggc

SEQ ID NO: 841168 - RNA, 21 nt, Human
ggggcggugaggugccccuuc

SEQ ID NO: 841169 - RNA, 26 nt, Human
gggugggaggcagggggcgcgugggg

SEQ ID NO: 841170 - RNA, 21 nt, Human
ggugcggccuccgaggaggcu

SEQ ID NO: 841171 - RNA, 23 nt, Human
ggugcggccuccgaggaggcugc

SEQ ID NO: 841172 - RNA, 24 nt, Human
guaaagugccuuuauggggagggu

SEQ ID NO: 841173 - RNA, 24 nt, Human
guggaccugggugggaggcagggg

SEQ ID NO: 841174 - RNA, 23 nt, Human
guggcagguggaccuggguggga

SEQ ID NO: 841175 - RNA, 22 nt, Human
uaaaagcaauaaaaauauccua

SEQ ID NO: 841176 - RNA, 23 nt, Human
uaaauuuucuuuugaaaaugaac

SEQ ID NO: 841177 - RNA, 22 nt, Human
uacacacauggucagaggugca

SEQ ID NO: 841178 - RNA, 21 nt, Human
uacaucagcaguuaaaaaaaa

SEQ ID NO: 841179 - RNA, 22 nt, Human
uaccacaaaaaauggccacggg

SEQ ID NO: 841180 - RNA, 23 nt, Human
uaccacaaaaaauggccacggga

SEQ ID NO: 841181 - RNA, 21 nt, Human
uauggggagggucacacaagg

SEQ ID NO: 841182 - RNA, 23 nt, Human
uauggggagggucacacaagggc

SEQ ID NO: 841183 - RNA, 30 nt, Human
uauguacacacauggucagaggugcacaca

SEQ ID NO: 841184 - RNA, 19 nt, Human
ucaccagguggcaggugga

SEQ ID NO: 841185 - RNA, 21 nt, Human
ucacuucuguacucaaggugg

SEQ ID NO: 841186 - RNA, 22 nt, Human
uccagaggcagaagcagcacgg

SEQ ID NO: 841187 - RNA, 23 nt, Human
uccccacgccaccgcagccccag

SEQ ID NO: 841188 - RNA, 26 nt, Human
uccguggaaccugccucugccccgga

SEQ ID NO: 841189 - RNA, 23 nt, Human
uccuaaaacuuguaaaagcuaaa

SEQ ID NO: 841190 - RNA, 21 nt, Human
ucggcucugccgggcacacac

SEQ ID NO: 841191 - RNA, 24 nt, Human
ucuccccacuuucacuucuguacu

SEQ ID NO: 841192 - RNA, 22 nt, Human
ucugagcuauggucggcagcac

SEQ ID NO: 841193 - RNA, 21 nt, Human
ucuuuugaaaaugaacccuag

SEQ ID NO: 841194 - RNA, 18 nt, Human
ugaaacacaagaaguugg

SEQ ID NO: 841195 - RNA, 18 nt, Human
ugaaacaugaagcuguaa

SEQ ID NO: 841196 - RNA, 20 nt, Human
ugacggcuacaagccgcugg

SEQ ID NO: 841197 - RNA, 19 nt, Human
ugaggccaaaguaccacaa

SEQ ID NO: 841198 - RNA, 23 nt, Human
ugaggccaaaguaccacaaaaaa

SEQ ID NO: 841199 - RNA, 22 nt, Human
ugaucccugcuugaaaaaaucc

SEQ ID NO: 841200 - RNA, 21 nt, Human
ugcacacauacaaaaacaucu

SEQ ID NO: 841201 - RNA, 24 nt, Human
ugcacacauacaaaaacaucugca

SEQ ID NO: 841202 - RNA, 18 nt, Human
ugccccgcucuccucagg

SEQ ID NO: 841203 - RNA, 21 nt, Human
ugccgggcacacacggggcag

SEQ ID NO: 841204 - RNA, 18 nt, Human
uggacgaguugcucagca

SEQ ID NO: 841205 - RNA, 21 nt, Human
ugggaggcagggggcgcgugg

SEQ ID NO: 841206 - RNA, 21 nt, Human
ugggccuuaccugagcugcuc

SEQ ID NO: 841207 - RNA, 25 nt, Human
uggggcugggaaccgugaggcugug

SEQ ID NO: 841208 - RNA, 22 nt, Human
uuaaaaaaaagugacaguggau

SEQ ID NO: 841209 - RNA, 23 nt, Human
uuaccugagcugcucaggcacug

SEQ ID NO: 841210 - RNA, 24 nt, Human
uuuaaaauuccauuuacaucagca

SEQ ID NO: 841211 - RNA, 23 nt, Human
uuuauggggagggucacacaagg

SEQ ID NO: 841212 - RNA, 21 nt, Human
uuuuccaguucugcugugacu

SEQ ID NO: 841213 - RNA, 28 nt, Human
aacacagagccgcgccaacucucugacg

SEQ ID NO: 841214 - RNA, 23 nt, Human
agaccugaagcggcggaccgaga

SEQ ID NO: 841215 - RNA, 18 nt, Human
agagaauaauggugaaaa

SEQ ID NO: 841216 - RNA, 24 nt, Human
agaggcgggaacacaaccugcagg

SEQ ID NO: 841217 - RNA, 23 nt, Human
aucauuggagagaauaaugguga

SEQ ID NO: 841218 - RNA, 23 nt, Human
cacuagguuuggucaacacagag

SEQ ID NO: 841219 - RNA, 23 nt, Human
cccgggucugagacugagagagc

SEQ ID NO: 841220 - RNA, 23 nt, Human
gaauggaggcgggguagaggcgg

SEQ ID NO: 841221 - RNA, 21 nt, Human
gacggcgccaagaccugaagc

SEQ ID NO: 841222 - RNA, 23 nt, Human
gagaauaauggugaaaaccauuc

SEQ ID NO: 841223 - RNA, 21 nt, Human
gcgccaagaccugaagcggcg

SEQ ID NO: 841224 - RNA, 21 nt, Human
gggcagaaggcagcugcaggg

SEQ ID NO: 841225 - RNA, 22 nt, Human
guguuguuccaaguugaaccag

SEQ ID NO: 841226 - RNA, 19 nt, Human
uaacaucaguagccaaaaa

SEQ ID NO: 841227 - RNA, 22 nt, Human
ucaguagccaaaaaccuggggc

SEQ ID NO: 841228 - RNA, 19 nt, Human
ucauuggagagaauaaugg

SEQ ID NO: 841229 - RNA, 20 nt, Human
ugcuccaauauuuuauuguu

SEQ ID NO: 841230 - RNA, 23 nt, Human
ugcuccaauauuuuauuguuugu

SEQ ID NO: 841231 - RNA, 18 nt, Human
uggaggcgggguagaggc

SEQ ID NO: 841232 - RNA, 18 nt, Human
uggggcagaaggcagcug

SEQ ID NO: 841233 - RNA, 23 nt, Human
uuaagagucuccaucuucuuggg

SEQ ID NO: 841234 - RNA, 19 nt, Human
uucaacucuaugcuccaau

SEQ ID NO: 841235 - RNA, 21 nt, Human
uucuuugcuuaagagucucca

SEQ ID NO: 841236 - RNA, 21 nt, Human
uuuuuuuuuuuuuuuuuuaag

SEQ ID NO: 841237 - RNA, 19 nt, Human
acucaaggcgccgcggcag

SEQ ID NO: 841238 - RNA, 20 nt, Human
acuccgaaaggagccaaggg

SEQ ID NO: 841239 - RNA, 21 nt, Human
agacucaaggcgccgcggcag

SEQ ID NO: 841240 - RNA, 20 nt, Human
agauaauaaaaagcaagacu

SEQ ID NO: 841241 - RNA, 21 nt, Human
agcuguaaugccugagggugg

SEQ ID NO: 841242 - RNA, 18 nt, Human
aucacacucacaggcgca

SEQ ID NO: 841243 - RNA, 18 nt, Human
aucagaugacugcccagu

SEQ ID NO: 841244 - RNA, 19 nt, Human
cacuccgaaaggagccaag

SEQ ID NO: 841245 - RNA, 19 nt, Human
ccguagggacaaacuaguu

SEQ ID NO: 841246 - RNA, 18 nt, Human
cugcccaguaagcucgga

SEQ ID NO: 841247 - RNA, 20 nt, Human
cuuuaaaagauaauaaaaag

SEQ ID NO: 841248 - RNA, 22 nt, Human
cuuuuuuuuuuuucgaaguccc

SEQ ID NO: 841249 - RNA, 21 nt, Human
ggcccggagacucaaggcgcc

SEQ ID NO: 841250 - RNA, 24 nt, Human
uacccuucucacccgagcugggua

SEQ ID NO: 841251 - RNA, 25 nt, Human
uagcgcgguuucuucucgcagaucc

SEQ ID NO: 841252 - RNA, 19 nt, Human
uccauauagaaaauuaaga

SEQ ID NO: 841253 - RNA, 22 nt, Human
uccauauagaaaauuaagaaga

SEQ ID NO: 841254 - RNA, 23 nt, Human
ucccggaagauacccuucucacc

SEQ ID NO: 841255 - RNA, 20 nt, Human
ucccgugcaagcacgggguu

SEQ ID NO: 841256 - RNA, 20 nt, Human
uccgaaaggagccaagggca

SEQ ID NO: 841257 - RNA, 19 nt, Human
ugagggugggcuugccuga

SEQ ID NO: 841258 - RNA, 24 nt, Human
ugagggugggcuugccugagcuuu

SEQ ID NO: 841259 - RNA, 22 nt, Human
uuaaaggcgagguucccggaaa

SEQ ID NO: 841260 - RNA, 20 nt, Human
uucgaaguccccucuuuuuu

SEQ ID NO: 841261 - RNA, 20 nt, Human
aaaaaaguaaaauuucaaaa

SEQ ID NO: 841262 - RNA, 22 nt, Human
aaacaagucuuaucucaucuca

SEQ ID NO: 841263 - RNA, 22 nt, Human
aaacacccgauguguucaauuu

SEQ ID NO: 841264 - RNA, 22 nt, Human
aaaccccaucucuacuaaaaaa

SEQ ID NO: 841265 - RNA, 19 nt, Human
aacauggugaaaccccauc

SEQ ID NO: 841266 - RNA, 20 nt, Human
aacauggugaaaccccaucu

SEQ ID NO: 841267 - RNA, 21 nt, Human
aacauggugaaaccccaucuc

SEQ ID NO: 841268 - RNA, 21 nt, Human
aacauggugaaaccccaucuc

SEQ ID NO: 841269 - RNA, 24 nt, Human
aaucucuugaaccugggaggugga

SEQ ID NO: 841270 - RNA, 23 nt, Human
aauggcucaugccuguaauccca

SEQ ID NO: 841271 - RNA, 24 nt, Human
aauggcucaugccuguaaucccag

SEQ ID NO: 841272 - RNA, 24 nt, Human
accaacauggugaaaccccaucuc

SEQ ID NO: 841273 - RNA, 25 nt, Human
accccaucucuacuaaaaaauacaa

SEQ ID NO: 841274 - RNA, 18 nt, Human
accucacuccagccuggg

SEQ ID NO: 841275 - RNA, 24 nt, Human
accucacuccagccugggugacag

SEQ ID NO: 841276 - RNA, 24 nt, Human
acuugaggucaggaguucgagacc

SEQ ID NO: 841277 - RNA, 24 nt, Human
agacugaggcaggagaaucucuug

SEQ ID NO: 841278 - RNA, 24 nt, Human
agcacuuugggaggccgacaaggg

SEQ ID NO: 841279 - RNA, 18 nt, Human
agccaggcauggugaugc

SEQ ID NO: 841280 - RNA, 24 nt, Human
agccugaccaacauggugaaaccc

SEQ ID NO: 841281 - RNA, 22 nt, Human
agccugggugacagagcaaaac

SEQ ID NO: 841282 - RNA, 24 nt, Human
agccugggugacagagcaaaacuc

SEQ ID NO: 841283 - RNA, 22 nt, Human
aggcaggagaaucucuugaacc

SEQ ID NO: 841284 - RNA, 24 nt, Human
aggcaggagaaucucuugaaccug

SEQ ID NO: 841285 - RNA, 22 nt, Human
aggcugggcacaauggcucaug

SEQ ID NO: 841286 - RNA, 21 nt, Human
aggguccgggauccccugccu

SEQ ID NO: 841287 - RNA, 24 nt, Human
agguggagguugcagugagccgag

SEQ ID NO: 841288 - RNA, 21 nt, Human
aguugcaugucgccuugcuag

SEQ ID NO: 841289 - RNA, 24 nt, Human
aucucaucucuuuucugauaacaa

SEQ ID NO: 841290 - RNA, 19 nt, Human
augccuguaaucccagcac

SEQ ID NO: 841291 - RNA, 24 nt, Human
auuguaccaccucacuccagccug

SEQ ID NO: 841292 - RNA, 21 nt, Human
caaaaaagcuucacaauauaa

SEQ ID NO: 841293 - RNA, 27 nt, Human
caaaacucucaaaaaaaaguaaaauuu

SEQ ID NO: 841294 - RNA, 24 nt, Human
caacauggugaaaccccaucucua

SEQ ID NO: 841295 - RNA, 19 nt, Human
cacaucuguaauccuagcu

SEQ ID NO: 841296 - RNA, 24 nt, Human
caccucacuccagccugggugaca

SEQ ID NO: 841297 - RNA, 22 nt, Human
cacuccagccugggugacagag

SEQ ID NO: 841298 - RNA, 23 nt, Human
cacuccagccugggugacagagc

SEQ ID NO: 841299 - RNA, 23 nt, Human
cacuugaggucaggaguucgaga

SEQ ID NO: 841300 - RNA, 28 nt, Human
cagcacuuugggaggccgacaagggcgg

SEQ ID NO: 841301 - RNA, 24 nt, Human
caucuguaauccuagcuacucggg

SEQ ID NO: 841302 - RNA, 20 nt, Human
caugccuguaaucccagcac

SEQ ID NO: 841303 - RNA, 24 nt, Human
caugccuguaaucccagcacuuug

SEQ ID NO: 841304 - RNA, 21 nt, Human
ccaccucacuccagccugggu

SEQ ID NO: 841305 - RNA, 23 nt, Human
ccaccucacuccagccuggguga

SEQ ID NO: 841306 - RNA, 24 nt, Human
ccaccucacuccagccugggugac

SEQ ID NO: 841307 - RNA, 18 nt, Human
cccaggccggccgcagaa

SEQ ID NO: 841308 - RNA, 19 nt, Human
ccccaaauggauauaaagc

SEQ ID NO: 841309 - RNA, 21 nt, Human
ccccaaauggauauaaagcuc

SEQ ID NO: 841310 - RNA, 24 nt, Human
ccugaccaacauggugaaacccca

SEQ ID NO: 841311 - RNA, 21 nt, Human
ccugggagguggagguugcag

SEQ ID NO: 841312 - RNA, 22 nt, Human
ccugggugacagagcaaaacuc

SEQ ID NO: 841313 - RNA, 24 nt, Human
cgacaagggcgggucacuugaggu

SEQ ID NO: 841314 - RNA, 24 nt, Human
cgagaccagccugaccaacauggu

SEQ ID NO: 841315 - RNA, 21 nt, Human
cgauguguucaauuugcuuuc

SEQ ID NO: 841316 - RNA, 20 nt, Human
cgcacagcuugccgccgccc

SEQ ID NO: 841317 - RNA, 21 nt, Human
cgggauccccugccugccucu

SEQ ID NO: 841318 - RNA, 22 nt, Human
cgggauccccugccugccucuc

SEQ ID NO: 841319 - RNA, 24 nt, Human
cgggucacuugaggucaggaguuc

SEQ ID NO: 841320 - RNA, 19 nt, Human
cuacuaaaaaauacaaaaa

SEQ ID NO: 841321 - RNA, 24 nt, Human
cucaugccuguaaucccagcacuu

SEQ ID NO: 841322 - RNA, 21 nt, Human
cucuacuaaaaaauacaaaaa

SEQ ID NO: 841323 - RNA, 23 nt, Human
cucucaaaaaaaaguaaaauuuc

SEQ ID NO: 841324 - RNA, 21 nt, Human
cugcccaggccggccgcagaa

SEQ ID NO: 841325 - RNA, 18 nt, Human
cuguaauccuagcuacuc

SEQ ID NO: 841326 - RNA, 21 nt, Human
cuguaauccuagcuacucggg

SEQ ID NO: 841327 - RNA, 23 nt, Human
cuucacaauauaaaccuuaauuu

SEQ ID NO: 841328 - RNA, 21 nt, Human
cuugaaccugggagguggagg

SEQ ID NO: 841329 - RNA, 21 nt, Human
gagguugcagugagccgagau

SEQ ID NO: 841330 - RNA, 23 nt, Human
gagguugcagugagccgagauug

SEQ ID NO: 841331 - RNA, 22 nt, Human
ggagguugcagugagccgagau

SEQ ID NO: 841332 - RNA, 24 nt, Human
ggagguugcagugagccgagauug

SEQ ID NO: 841333 - RNA, 23 nt, Human
ggcacaauggcucaugccuguaa

SEQ ID NO: 841334 - RNA, 23 nt, Human
ggcugggcacaauggcucaugcc

SEQ ID NO: 841335 - RNA, 22 nt, Human
gggucacuugaggucaggaguu

SEQ ID NO: 841336 - RNA, 23 nt, Human
gggucacuugaggucaggaguuc

SEQ ID NO: 841337 - RNA, 24 nt, Human
ggucacuugaggucaggaguucga

SEQ ID NO: 841338 - RNA, 24 nt, Human
ggugaugcacaucuguaauccuag

SEQ ID NO: 841339 - RNA, 24 nt, Human
gucacuugaggucaggaguucgag

SEQ ID NO: 841340 - RNA, 22 nt, Human
gucgcacagcuugccgccgccc

SEQ ID NO: 841341 - RNA, 19 nt, Human
guugcagugagccgagauu

SEQ ID NO: 841342 - RNA, 18 nt, Human
uauaaagcucgaaggaga

SEQ ID NO: 841343 - RNA, 24 nt, Human
ucaaaguagacuucauccccaaau

SEQ ID NO: 841344 - RNA, 22 nt, Human
ucacuugaggucaggaguucga

SEQ ID NO: 841345 - RNA, 22 nt, Human
ucaucauucaacaacaguugca

SEQ ID NO: 841346 - RNA, 27 nt, Human
ucaucucaucucuuuucugauaacaaa

SEQ ID NO: 841347 - RNA, 22 nt, Human
ucaugccuguaaucccagcacu

SEQ ID NO: 841348 - RNA, 18 nt, Human
uccagccugggugacaga

SEQ ID NO: 841349 - RNA, 22 nt, Human
ucucuacuaaaaaauacaaaaa

SEQ ID NO: 841350 - RNA, 22 nt, Human
ucucuugaaccugggaggugga

SEQ ID NO: 841351 - RNA, 24 nt, Human
ucucuugaaccugggagguggagg

SEQ ID NO: 841352 - RNA, 19 nt, Human
ugaaaccccaucucuacua

SEQ ID NO: 841353 - RNA, 24 nt, Human
ugaaccugggagguggagguugca

SEQ ID NO: 841354 - RNA, 26 nt, Human
ugacagagcaaaacucucaaaaaaaa

SEQ ID NO: 841355 - RNA, 24 nt, Human
ugaccaacauggugaaaccccauc

SEQ ID NO: 841356 - RNA, 19 nt, Human
ugagccgagauuguaccac

SEQ ID NO: 841357 - RNA, 20 nt, Human
ugaggcaggagaaucucuug

SEQ ID NO: 841358 - RNA, 24 nt, Human
ugaggcaggagaaucucuugaacc

SEQ ID NO: 841359 - RNA, 25 nt, Human
ugaggcaggagaaucucuugaaccu

SEQ ID NO: 841360 - RNA, 19 nt, Human
ugaugcacaucuguaaucc

SEQ ID NO: 841361 - RNA, 23 nt, Human
ugccuguaaucccagcacuuugg

SEQ ID NO: 841362 - RNA, 24 nt, Human
ugccuguaaucccagcacuuuggg

SEQ ID NO: 841363 - RNA, 24 nt, Human
uggcucaugccuguaaucccagca

SEQ ID NO: 841364 - RNA, 26 nt, Human
ugggaggccgacaagggcgggucacc

SEQ ID NO: 841365 - RNA, 18 nt, Human
ugggagguggagguugca

SEQ ID NO: 841366 - RNA, 29 nt, Human
ugggagguggagguugcagugacaacggu

SEQ ID NO: 841367 - RNA, 24 nt, Human
ugggagguggagguugcagugagc

SEQ ID NO: 841368 - RNA, 22 nt, Human
uggugaugcacaucuguaaucc

SEQ ID NO: 841369 - RNA, 18 nt, Human
uguguucaauuugcuuuc

SEQ ID NO: 841370 - RNA, 20 nt, Human
uuagccaggcauggugaugc

SEQ ID NO: 841371 - RNA, 24 nt, Human
uugaaccugggagguggagguugc

SEQ ID NO: 841372 - RNA, 18 nt, Human
uugcagugagccgagauu

SEQ ID NO: 841373 - RNA, 19 nt, Human
uugcagugagccgagauug

SEQ ID NO: 841374 - RNA, 22 nt, Human
uugcagugagccgagauuguac

SEQ ID NO: 841375 - RNA, 21 nt, Human
uuuuuuuuuuugaugagagcu

SEQ ID NO: 841376 - RNA, 23 nt, Human
uuuuuuuuuuuuuuuuugaugag

SEQ ID NO: 841377 - RNA, 27 nt, Human
uuuuuuuuuuuuuuuuuuuuuuugggg

SEQ ID NO: 841378 - RNA, 20 nt, Human
aaaaaauacauuucaggauc

SEQ ID NO: 841379 - RNA, 22 nt, Human
aaacugaaaugcaaagugauuc

SEQ ID NO: 841380 - RNA, 19 nt, Human
aacauggcaaaaccccauc

SEQ ID NO: 841381 - RNA, 21 nt, Human
aacauggcaaaaccccaucuc

SEQ ID NO: 841382 - RNA, 21 nt, Human
aacauggcaaaaccccaucuc

SEQ ID NO: 841383 - RNA, 18 nt, Human
aagcaaccuucuauaaag

SEQ ID NO: 841384 - RNA, 22 nt, Human
aaguuagauacagcaccuucca

SEQ ID NO: 841385 - RNA, 22 nt, Human
aaucauccacacugagcuuaga

SEQ ID NO: 841386 - RNA, 19 nt, Human
aauccuuugcuuuccagag

SEQ ID NO: 841387 - RNA, 18 nt, Human
acaauacacagccaaucc

SEQ ID NO: 841388 - RNA, 18 nt, Human
acauagugagacccuguc

SEQ ID NO: 841389 - RNA, 24 nt, Human
accaucucccacaacaaccuccca

SEQ ID NO: 841390 - RNA, 23 nt, Human
accuaaaucaaccaucucccacc

SEQ ID NO: 841391 - RNA, 18 nt, Human
acugcacuccagccaggg

SEQ ID NO: 841392 - RNA, 18 nt, Human
acugcacuccagccaggg

SEQ ID NO: 841393 - RNA, 18 nt, Human
acugcacuccagccaggg

SEQ ID NO: 841394 - RNA, 19 nt, Human
acugcacuccagccagggu

SEQ ID NO: 841395 - RNA, 21 nt, Human
acugcacuccagccaggguga

SEQ ID NO: 841396 - RNA, 22 nt, Human
acugcacuccagccagggugac

SEQ ID NO: 841397 - RNA, 23 nt, Human
acugcacuccagccagggugaca

SEQ ID NO: 841398 - RNA, 19 nt, Human
acuucgaaggaggcucaga

SEQ ID NO: 841399 - RNA, 19 nt, Human
acuuuauucuuuucuuugu

SEQ ID NO: 841400 - RNA, 24 nt, Human
agacugaggugggaggacugcuug

SEQ ID NO: 841401 - RNA, 19 nt, Human
agcaccuuccacccaauua

SEQ ID NO: 841402 - RNA, 22 nt, Human
agccagggugacauagugagac

SEQ ID NO: 841403 - RNA, 24 nt, Human
agccauuaaaaacaucaguuucaa

SEQ ID NO: 841404 - RNA, 19 nt, Human
agcucucuguuuaccuucc

SEQ ID NO: 841405 - RNA, 19 nt, Human
aggaagucugugggaaaau

SEQ ID NO: 841406 - RNA, 20 nt, Human
aggaguuugagaccagccug

SEQ ID NO: 841407 - RNA, 21 nt, Human
agugcucaggaguuugagacc

SEQ ID NO: 841408 - RNA, 22 nt, Human
aucaaccaucucccacaacaac

SEQ ID NO: 841409 - RNA, 20 nt, Human
aucgcacuacugcacuccag

SEQ ID NO: 841410 - RNA, 23 nt, Human
aucucccacaacaaccucccaaa

SEQ ID NO: 841411 - RNA, 19 nt, Human
auuuuuuuuuuuuuuuugg

SEQ ID NO: 841412 - RNA, 18 nt, Human
cacaaguuagauacagca

SEQ ID NO: 841413 - RNA, 18 nt, Human
cacagccaauccuuugcu

SEQ ID NO: 841414 - RNA, 18 nt, Human
cacgccuguaguccuagc

SEQ ID NO: 841415 - RNA, 25 nt, Human
cagugcuaaaaaauacauuucagga

SEQ ID NO: 841416 - RNA, 23 nt, Human
caucucccacaacaaccucccaa

SEQ ID NO: 841417 - RNA, 22 nt, Human
cauuucaggaucacuuagucca

SEQ ID NO: 841418 - RNA, 19 nt, Human
ccaaaaguguuaugucccu

SEQ ID NO: 841419 - RNA, 19 nt, Human
ccagggaagccaaggcugc

SEQ ID NO: 841420 - RNA, 21 nt, Human
cccacaacaaccucccaaaag

SEQ ID NO: 841421 - RNA, 20 nt, Human
cccucuguucaaacaagaac

SEQ ID NO: 841422 - RNA, 26 nt, Human
ccuaaaugagccauuaaaaacaucag

SEQ ID NO: 841423 - RNA, 24 nt, Human
cgccuguaguccuagcuauuuggg

SEQ ID NO: 841424 - RNA, 27 nt, Human
cguauaaacacuagaauuuuguuauga

SEQ ID NO: 841425 - RNA, 19 nt, Human
cuaaaucaaccaucuccca

SEQ ID NO: 841426 - RNA, 21 nt, Human
cuacugcacuccagccagggu

SEQ ID NO: 841427 - RNA, 24 nt, Human
cuacugcacuccagccagggugac

SEQ ID NO: 841428 - RNA, 19 nt, Human
cuagugcucaggaguuuga

SEQ ID NO: 841429 - RNA, 22 nt, Human
cuauaaccaaaagauacagaaa

SEQ ID NO: 841430 - RNA, 25 nt, Human
cugcuugagcccagggaagccaagg

SEQ ID NO: 841431 - RNA, 21 nt, Human
cugugggaaaaugucugaagu

SEQ ID NO: 841432 - RNA, 20 nt, Human
gaccuuucauuuuuuuuuuu

SEQ ID NO: 841433 - RNA, 19 nt, Human
gagaaaacugaagcccaga

SEQ ID NO: 841434 - RNA, 23 nt, Human
gagauaacagaauugaaugaaga

SEQ ID NO: 841435 - RNA, 18 nt, Human
gagguggguggauugcua

SEQ ID NO: 841436 - RNA, 19 nt, Human
gaucaucauuaucuagaug

SEQ ID NO: 841437 - RNA, 24 nt, Human
gauugcuagugcucaggaguuuga

SEQ ID NO: 841438 - RNA, 22 nt, Human
ggaaacagagguggguggauug

SEQ ID NO: 841439 - RNA, 22 nt, Human
ggacaauacacagccaauccuu

SEQ ID NO: 841440 - RNA, 22 nt, Human
ggcuuggucacgcacgccugua

SEQ ID NO: 841441 - RNA, 24 nt, Human
ggucacgcacgccuguaguccuag

SEQ ID NO: 841442 - RNA, 22 nt, Human
uaaaaagaaaagcaaccuucua

SEQ ID NO: 841443 - RNA, 22 nt, Human
uaaaugugguaucaaaccaacc

SEQ ID NO: 841444 - RNA, 22 nt, Human
uaagagcagacagccuucuuuc

SEQ ID NO: 841445 - RNA, 21 nt, Human
uacagcucacccucagccuuu

SEQ ID NO: 841446 - RNA, 21 nt, Human
uaccuggagugagaauuaagc

SEQ ID NO: 841447 - RNA, 23 nt, Human
uacugcacuccagccagggugac

SEQ ID NO: 841448 - RNA, 24 nt, Human
uacugcacuccagccagggugaca

SEQ ID NO: 841449 - RNA, 19 nt, Human
uagaaucuuggccgaugcc

SEQ ID NO: 841450 - RNA, 19 nt, Human
uagcauguucuucuccucu

SEQ ID NO: 841451 - RNA, 23 nt, Human
uaguaucaacauucacuuagguc

SEQ ID NO: 841452 - RNA, 24 nt, Human
uauaaaguagaaguauacuccuaa

SEQ ID NO: 841453 - RNA, 21 nt, Human
uauuauacaacuuauauaaca

SEQ ID NO: 841454 - RNA, 25 nt, Human
ucaaccaauuuacccaaucuuuagc

SEQ ID NO: 841455 - RNA, 21 nt, Human
uccacacugagcuuagaaaag

SEQ ID NO: 841456 - RNA, 19 nt, Human
ucccacaacaaccucccaa

SEQ ID NO: 841457 - RNA, 20 nt, Human
ucccacaacaaccucccaaa

SEQ ID NO: 841458 - RNA, 21 nt, Human
ucccacaacaaccucccaaaa

SEQ ID NO: 841459 - RNA, 20 nt, Human
ucccacaacaaccucccaag

SEQ ID NO: 841460 - RNA, 21 nt, Human
ucccauaagaaagggauugcu

SEQ ID NO: 841461 - RNA, 18 nt, Human
ucccuaacauaauaacau

SEQ ID NO: 841462 - RNA, 19 nt, Human
ucuauaaccaaaagauaca

SEQ ID NO: 841463 - RNA, 23 nt, Human
ucucucucuauauauaaacugaa

SEQ ID NO: 841464 - RNA, 23 nt, Human
ugaaugaaaccuuugcuguggua

SEQ ID NO: 841465 - RNA, 19 nt, Human
ugacauagugagacccugu

SEQ ID NO: 841466 - RNA, 20 nt, Human
ugacauagugagacccuguc

SEQ ID NO: 841467 - RNA, 22 nt, Human
ugagaaaacugaagcccagaag

SEQ ID NO: 841468 - RNA, 23 nt, Human
ugagaaaacugaagcccagaagu

SEQ ID NO: 841469 - RNA, 31 nt, Human
ugagaaaacugaagcccagaaguuaagcuag

SEQ ID NO: 841470 - RNA, 22 nt, Human
ugagauaaauaaaucuacccua

SEQ ID NO: 841471 - RNA, 26 nt, Human
ugagauaaauaaaucuacccuaaaug

SEQ ID NO: 841472 - RNA, 22 nt, Human
ugagcaacauggcaaaacccca

SEQ ID NO: 841473 - RNA, 23 nt, Human
ugaggugggaggacugcuugagc

SEQ ID NO: 841474 - RNA, 24 nt, Human
ugaggugggaggacugcuugagcc

SEQ ID NO: 841475 - RNA, 22 nt, Human
ugcccagaugagcaauguagaa

SEQ ID NO: 841476 - RNA, 21 nt, Human
uggaaacagagguggguggau

SEQ ID NO: 841477 - RNA, 18 nt, Human
uggaagaaucuccugaau

SEQ ID NO: 841478 - RNA, 20 nt, Human
uggaagaaucuccugaaugg

SEQ ID NO: 841479 - RNA, 23 nt, Human
uggauugcuagugcucaggaguu

SEQ ID NO: 841480 - RNA, 24 nt, Human
uggauugcuagugcucaggaguuu

SEQ ID NO: 841481 - RNA, 19 nt, Human
ugggagacugaggugggag

SEQ ID NO: 841482 - RNA, 24 nt, Human
ugggaggacugcuugagcccaggg

SEQ ID NO: 841483 - RNA, 20 nt, Human
uggguguucguauaaacacu

SEQ ID NO: 841484 - RNA, 20 nt, Human
ugguguucaaguucuguugu

SEQ ID NO: 841485 - RNA, 18 nt, Human
ugucaagaggacaguugu

SEQ ID NO: 841486 - RNA, 19 nt, Human
ugucaagaggacaguugug

SEQ ID NO: 841487 - RNA, 18 nt, Human
ugugggaaaaugucugaa

SEQ ID NO: 841488 - RNA, 20 nt, Human
uuaauaggagaugguuccac

SEQ ID NO: 841489 - RNA, 19 nt, Human
uuagcugggcuuggucacg

SEQ ID NO: 841490 - RNA, 24 nt, Human
uuccaauuuuugggcaaaaacuuc

SEQ ID NO: 841491 - RNA, 24 nt, Human
uuccuagaaaaaugaaaauauuuu

SEQ ID NO: 841492 - RNA, 19 nt, Human
uuggaaacagaggugggug

SEQ ID NO: 841493 - RNA, 24 nt, Human
uuuacagaugagaaaacugaagcc

SEQ ID NO: 841494 - RNA, 21 nt, Human
uuuuuuuuuuggaaacagagg

SEQ ID NO: 841495 - RNA, 25 nt, Human
uuuuuuuuuuuggaaacagaggugg

SEQ ID NO: 841496 - RNA, 25 nt, Human
aaaaacagaaacucuucgggagaga

SEQ ID NO: 841497 - RNA, 22 nt, Human
caacagugcaucaagcaucuga

SEQ ID NO: 841498 - RNA, 19 nt, Human
ccaacagugcaucaagcau

SEQ ID NO: 841499 - RNA, 19 nt, Human
cgggagagacccccucccc

SEQ ID NO: 841500 - RNA, 18 nt, Human
uaaaaacagaaacucuuc

SEQ ID NO: 841501 - RNA, 22 nt, Human
uucgggagagacccccucccca

SEQ ID NO: 841502 - RNA, 20 nt, Human
aggucucaauuagcucaaaa

SEQ ID NO: 841503 - RNA, 22 nt, Human
auaggucucaauuagcucaaaa

SEQ ID NO: 841504 - RNA, 22 nt, Human
auccacaguguuccaacucagc

SEQ ID NO: 841505 - RNA, 20 nt, Human
caaaauaacagucuccaaac

SEQ ID NO: 841506 - RNA, 23 nt, Human
caaucccagcauaaaguugcaaa

SEQ ID NO: 841507 - RNA, 24 nt, Human
cagaauauccacaguguuccaacu

SEQ ID NO: 841508 - RNA, 22 nt, Human
cagcauaaaguugcaaagacau

SEQ ID NO: 841509 - RNA, 22 nt, Human
cucaaaauaacagucuccaaac

SEQ ID NO: 841510 - RNA, 22 nt, Human
cuccgguguccgcggcgagggc

SEQ ID NO: 841511 - RNA, 20 nt, Human
gagcggccgcagcuccggug

SEQ ID NO: 841512 - RNA, 22 nt, Human
gagcggccgcagcuccgguguc

SEQ ID NO: 841513 - RNA, 19 nt, Human
uagcucaaaauaacagucu

SEQ ID NO: 841514 - RNA, 22 nt, Human
uccacaguguuccaacucagcu

SEQ ID NO: 841515 - RNA, 21 nt, Human
uccgguguccgcggcgagggc

SEQ ID NO: 841516 - RNA, 21 nt, Human
ucuaaaguacagauaaaccug

SEQ ID NO: 841517 - RNA, 18 nt, Human
aaugaugacagcaacaga

SEQ ID NO: 841518 - RNA, 19 nt, Human
aggaagaacgggcaacagc

SEQ ID NO: 841519 - RNA, 20 nt, Human
aggcccgagggcagcggcgg

SEQ ID NO: 841520 - RNA, 20 nt, Human
cccucucccucccguauucc

SEQ ID NO: 841521 - RNA, 20 nt, Human
ccgcagcagcuuaucauucc

SEQ ID NO: 841522 - RNA, 24 nt, Human
ccgcagcagcuuaucauucccucu

SEQ ID NO: 841523 - RNA, 18 nt, Human
cgagccccggcugcuccc

SEQ ID NO: 841524 - RNA, 18 nt, Human
cugcuccccggaggcgca

SEQ ID NO: 841525 - RNA, 20 nt, Human
ggaagaacgggcaacagcag

SEQ ID NO: 841526 - RNA, 24 nt, Human
uaacucgggacgcgucaggcgcgg

SEQ ID NO: 841527 - RNA, 22 nt, Human
uagcuuugauguuuggucacgu

SEQ ID NO: 841528 - RNA, 23 nt, Human
uaucauucccucucccucccgua

SEQ ID NO: 841529 - RNA, 21 nt, Human
uccuucacagugacucuuggg

SEQ ID NO: 841530 - RNA, 23 nt, Human
ugacucuugggccgcagcagcuu

SEQ ID NO: 841531 - RNA, 23 nt, Human
uucaggguagguucaccgccaga

SEQ ID NO: 841532 - RNA, 23 nt, Human
aaaagaaaaacaauaaaagaaga

SEQ ID NO: 841533 - RNA, 24 nt, Human
acaaaggccagcccuauccucccu

SEQ ID NO: 841534 - RNA, 21 nt, Human
agagaggaagauggggagggg

SEQ ID NO: 841535 - RNA, 20 nt, Human
agaggaagauggggaggggc

SEQ ID NO: 841536 - RNA, 22 nt, Human
aggaagauggggaggggcucug

SEQ ID NO: 841537 - RNA, 23 nt, Human
aggccagcccuauccucccucaa

SEQ ID NO: 841538 - RNA, 20 nt, Human
agggggcuggaguggcaggg

SEQ ID NO: 841539 - RNA, 21 nt, Human
agggggcuggaguggcagggg

SEQ ID NO: 841540 - RNA, 22 nt, Human
agguucucagccucugcuggcu

SEQ ID NO: 841541 - RNA, 20 nt, Human
auggggaggggcucuggauc

SEQ ID NO: 841542 - RNA, 19 nt, Human
caaaucaauggcccgcagc

SEQ ID NO: 841543 - RNA, 24 nt, Human
caaaucaauggcccgcagcugagc

SEQ ID NO: 841544 - RNA, 22 nt, Human
cagcugagccucccacugccca

SEQ ID NO: 841545 - RNA, 20 nt, Human
caggccggagagggcccacg

SEQ ID NO: 841546 - RNA, 19 nt, Human
ccagguuuuuccaggagcc

SEQ ID NO: 841547 - RNA, 18 nt, Human
ccucccucaaaggcucaa

SEQ ID NO: 841548 - RNA, 24 nt, Human
cggagagggcccacgaguccugcc

SEQ ID NO: 841549 - RNA, 21 nt, Human
cucaaaucaauggcccgcagc

SEQ ID NO: 841550 - RNA, 24 nt, Human
cugagccucccacugcccagguuu

SEQ ID NO: 841551 - RNA, 23 nt, Human
cuggagacacaggagugaaggug

SEQ ID NO: 841552 - RNA, 18 nt, Human
gagagaggaagaugggga

SEQ ID NO: 841553 - RNA, 22 nt, Human
gaggcuaaucagcuggagacac

SEQ ID NO: 841554 - RNA, 18 nt, Human
ggcuggaguggcagggga

SEQ ID NO: 841555 - RNA, 21 nt, Human
gggaaacaggccggagagggc

SEQ ID NO: 841556 - RNA, 18 nt, Human
gggcuggaguggcagggg

SEQ ID NO: 841557 - RNA, 18 nt, Human
ggggaggggcucuggauc

SEQ ID NO: 841558 - RNA, 21 nt, Human
gguucucagccucugcuggcu

SEQ ID NO: 841559 - RNA, 23 nt, Human
uaaaagaagagucugaggcuaau

SEQ ID NO: 841560 - RNA, 25 nt, Human
ucaauggcccgcagcugagccuccc

SEQ ID NO: 841561 - RNA, 18 nt, Human
ucagcuggagacacagga

SEQ ID NO: 841562 - RNA, 19 nt, Human
ugagccucccacugcccag

SEQ ID NO: 841563 - RNA, 21 nt, Human
ugcccagguuuuuccaggagc

SEQ ID NO: 841564 - RNA, 18 nt, Human
uggcaaugggggguaggg

SEQ ID NO: 841565 - RNA, 24 nt, Human
uuuuuuuuuuuugaaccuggugcu

SEQ ID NO: 841566 - RNA, 22 nt, Human
aagggggcgacgauagggaagg

SEQ ID NO: 841567 - RNA, 24 nt, Human
acagacacaaacacagauacagca

SEQ ID NO: 841568 - RNA, 20 nt, Human
acaggcauuaucuucaugcu

SEQ ID NO: 841569 - RNA, 23 nt, Human
accacaggcauuaucuucaugcu

SEQ ID NO: 841570 - RNA, 22 nt, Human
augcugucacacacagacacaa

SEQ ID NO: 841571 - RNA, 24 nt, Human
caaacacagauacagcacaauauc

SEQ ID NO: 841572 - RNA, 19 nt, Human
cagcauaaccacaggcauu

SEQ ID NO: 841573 - RNA, 20 nt, Human
cagcauaaccacaggcauuu

SEQ ID NO: 841574 - RNA, 22 nt, Human
cccaagugcauuccuucugagg

SEQ ID NO: 841575 - RNA, 22 nt, Human
ccggaaugggaaagaaauugaa

SEQ ID NO: 841576 - RNA, 19 nt, Human
ccucuggacuccacguagg

SEQ ID NO: 841577 - RNA, 22 nt, Human
gacgauagggaagggcccggaa

SEQ ID NO: 841578 - RNA, 18 nt, Human
gcgacgauagggaagggc

SEQ ID NO: 841579 - RNA, 24 nt, Human
uaucuucaugcugucacacacaga

SEQ ID NO: 841580 - RNA, 22 nt, Human
uuugcagggguccggcagaucc

SEQ ID NO: 841581 - RNA, 23 nt, Human
uuuuuuuuuuuagcaucugguga

SEQ ID NO: 841582 - RNA, 20 nt, Human
acuccuaaaaaguugaaaag

SEQ ID NO: 841583 - RNA, 21 nt, Human
acuccuaaaaaguugaaaagc

SEQ ID NO: 841584 - RNA, 20 nt, Human
agaggagcuuggagguccca

SEQ ID NO: 841585 - RNA, 23 nt, Human
aggcgaccaauuagagaaaaagg

SEQ ID NO: 841586 - RNA, 22 nt, Human
caucagacugcuucuccuccca

SEQ ID NO: 841587 - RNA, 25 nt, Human
cuuaaggacugccaagaggcuccuc

SEQ ID NO: 841588 - RNA, 21 nt, Human
gcacuccuaaaaaguugaaaa

SEQ ID NO: 841589 - RNA, 22 nt, Human
gggacuucauuacaucugugga

SEQ ID NO: 841590 - RNA, 20 nt, Human
ggggaugucugguccuggga

SEQ ID NO: 841591 - RNA, 21 nt, Human
guugaaaagcaggugagucug

SEQ ID NO: 841592 - RNA, 19 nt, Human
uccucccacguagguucag

SEQ ID NO: 841593 - RNA, 22 nt, Human
ugccaagaggcuccuuagaaac

SEQ ID NO: 841594 - RNA, 24 nt, Human
uguggagucuggggaugucugguc

SEQ ID NO: 841595 - RNA, 20 nt, Human
aagcagaaaagauuuaccuc

SEQ ID NO: 841596 - RNA, 18 nt, Human
ccaaagcuuuacaaaugc

SEQ ID NO: 841597 - RNA, 22 nt, Human
ccccucgugccgaagugggagc

SEQ ID NO: 841598 - RNA, 19 nt, Human
cgaagugggagcggcccgc

SEQ ID NO: 841599 - RNA, 20 nt, Human
uaaucaucagacucuuccuu

SEQ ID NO: 841600 - RNA, 24 nt, Human
uucaguaagcagaaaagauuuacc

SEQ ID NO: 841601 - RNA, 19 nt, Human
aagaaucuucaaucaagug

SEQ ID NO: 841602 - RNA, 20 nt, Human
cccacuuagagaagcagggu

SEQ ID NO: 841603 - RNA, 18 nt, Human
cgugccgcuguccgcugc

SEQ ID NO: 841604 - RNA, 19 nt, Human
gagaagggagaggguucuc

SEQ ID NO: 841605 - RNA, 23 nt, Human
gcagggucuaccgcucugugccu

SEQ ID NO: 841606 - RNA, 20 nt, Human
gugaaaugugcgugccgcug

SEQ ID NO: 841607 - RNA, 18 nt, Human
gugccugacaaugacgag

SEQ ID NO: 841608 - RNA, 21 nt, Human
ucagagaagggagaggguucu

SEQ ID NO: 841609 - RNA, 24 nt, Human
ucagaguaaaacaaucauuuuauu

SEQ ID NO: 841610 - RNA, 20 nt, Human
ugcgugccgcuguccgcugc

SEQ ID NO: 841611 - RNA, 21 nt, Human
gagcagucccccggggacucc

SEQ ID NO: 841612 - RNA, 21 nt, Human
aaaaaaaaaaaugaacuaaac

SEQ ID NO: 841613 - RNA, 23 nt, Human
aaaaaccucagcccaggcaaagc

SEQ ID NO: 841614 - RNA, 22 nt, Human
aaaaccucagcccaggcaaagc

SEQ ID NO: 841615 - RNA, 20 nt, Human
acauuaaguagaacagagca

SEQ ID NO: 841616 - RNA, 23 nt, Human
acccucauacucuccagaaacga

SEQ ID NO: 841617 - RNA, 21 nt, Human
acgagcugucuuggccacuug

SEQ ID NO: 841618 - RNA, 22 nt, Human
acuacaacaacagggaccaugg

SEQ ID NO: 841619 - RNA, 20 nt, Human
acucccguucuuccuccucc

SEQ ID NO: 841620 - RNA, 18 nt, Human
acuggaaaaaauagaugg

SEQ ID NO: 841621 - RNA, 24 nt, Human
agaaaacacacccucauacucucc

SEQ ID NO: 841622 - RNA, 21 nt, Human
agaggauacugaaaagccagu

SEQ ID NO: 841623 - RNA, 23 nt, Human
agauggagcugcugaguucugga

SEQ ID NO: 841624 - RNA, 18 nt, Human
agcuggguuugugccugc

SEQ ID NO: 841625 - RNA, 22 nt, Human
aggcaaagccgggagccagaga

SEQ ID NO: 841626 - RNA, 25 nt, Human
aggccagggcuuccaaggcagggaa

SEQ ID NO: 841627 - RNA, 25 nt, Human
aguagaacagagcacacaguuucaa

SEQ ID NO: 841628 - RNA, 27 nt, Human
aguccccuagcauaccuuuuacaaucc

SEQ ID NO: 841629 - RNA, 18 nt, Human
aguuucaaguauucagca

SEQ ID NO: 841630 - RNA, 18 nt, Human
aucauguuagcacagcau

SEQ ID NO: 841631 - RNA, 21 nt, Human
augauauaacuucagguacau

SEQ ID NO: 841632 - RNA, 18 nt, Human
auggagcugcugaguucu

SEQ ID NO: 841633 - RNA, 21 nt, Human
caaaauaucugcaaaguccuu

SEQ ID NO: 841634 - RNA, 25 nt, Human
caacaacagggaccauggcacugaa

SEQ ID NO: 841635 - RNA, 18 nt, Human
caacggugggguaugacc

SEQ ID NO: 841636 - RNA, 19 nt, Human
caauaagaaaacacacccu

SEQ ID NO: 841637 - RNA, 23 nt, Human
cacaauaagaaaacacacccuca

SEQ ID NO: 841638 - RNA, 23 nt, Human
cacacaccacauucuuccuaccc

SEQ ID NO: 841639 - RNA, 21 nt, Human
cacacaguuucaaguauucag

SEQ ID NO: 841640 - RNA, 22 nt, Human
cacagcguuucuuucccagaau

SEQ ID NO: 841641 - RNA, 25 nt, Human
caccacauucuuccuacccucuaag

SEQ ID NO: 841642 - RNA, 20 nt, Human
cacuaugggcuuggcaaggc

SEQ ID NO: 841643 - RNA, 19 nt, Human
cacugcuuucuggccaagu

SEQ ID NO: 841644 - RNA, 18 nt, Human
cagcccaggcaaagccgg

SEQ ID NO: 841645 - RNA, 20 nt, Human
caucugaaguuccuuuguuc

SEQ ID NO: 841646 - RNA, 23 nt, Human
ccaacguuggcugcaccaaaaua

SEQ ID NO: 841647 - RNA, 26 nt, Human
ccacauucuuccuacccucuaagaga

SEQ ID NO: 841648 - RNA, 21 nt, Human
cccaaggaucguuuuuauaga

SEQ ID NO: 841649 - RNA, 18 nt, Human
cccagauccccugcaaaa

SEQ ID NO: 841650 - RNA, 22 nt, Human
cccaggccagggcuuccaaggc

SEQ ID NO: 841651 - RNA, 22 nt, Human
cccaucugaaguuccuuuguuc

SEQ ID NO: 841652 - RNA, 21 nt, Human
cccguucuuccuccuccucuu

SEQ ID NO: 841653 - RNA, 21 nt, Human
cccguucuuccuccuccucuu

SEQ ID NO: 841654 - RNA, 18 nt, Human
cccucauacucuccagaa

SEQ ID NO: 841655 - RNA, 21 nt, Human
ccucccaggccagggcuucca

SEQ ID NO: 841656 - RNA, 20 nt, Human
ccuccuccucuucacucagg

SEQ ID NO: 841657 - RNA, 21 nt, Human
ccucuucacucagggcugucc

SEQ ID NO: 841658 - RNA, 23 nt, Human
ccugcaaaagaaaacaggcagcu

SEQ ID NO: 841659 - RNA, 21 nt, Human
ccuguaucuauacaggccgcu

SEQ ID NO: 841660 - RNA, 24 nt, Human
cggugggguaugaccuccucccag

SEQ ID NO: 841661 - RNA, 21 nt, Human
cuccaacggugggguaugacc

SEQ ID NO: 841662 - RNA, 24 nt, Human
cuccucuucacucagggcuguccu

SEQ ID NO: 841663 - RNA, 21 nt, Human
cuccuggcagcaucuccucaa

SEQ ID NO: 841664 - RNA, 21 nt, Human
cuccuguaucuauacaggccg

SEQ ID NO: 841665 - RNA, 23 nt, Human
cugcugcugcuuccagguuuggu

SEQ ID NO: 841666 - RNA, 21 nt, Human
cuuggcaaggcagagcuuaga

SEQ ID NO: 841667 - RNA, 18 nt, Human
cuuggccacuugacagcu

SEQ ID NO: 841668 - RNA, 18 nt, Human
gaaagaggauacugaaaa

SEQ ID NO: 841669 - RNA, 23 nt, Human
gaacacacacacaccacauucuu

SEQ ID NO: 841670 - RNA, 21 nt, Human
gaagaucaguccccuagcaua

SEQ ID NO: 841671 - RNA, 19 nt, Human
gacacagcguuucuuuccc

SEQ ID NO: 841672 - RNA, 18 nt, Human
gcagcaucuccucaaggc

SEQ ID NO: 841673 - RNA, 19 nt, Human
gcuuuaugagaacacacac

SEQ ID NO: 841674 - RNA, 18 nt, Human
ggagcaccuggguaagca

SEQ ID NO: 841675 - RNA, 19 nt, Human
ggcaaucaccuucccauca

SEQ ID NO: 841676 - RNA, 21 nt, Human
ggcucaguccagcuugaaagc

SEQ ID NO: 841677 - RNA, 24 nt, Human
gucgcagacuucacaguguaacuu

SEQ ID NO: 841678 - RNA, 18 nt, Human
uaagaaaacacacccuca

SEQ ID NO: 841679 - RNA, 20 nt, Human
uaagaaaacacacccucaua

SEQ ID NO: 841680 - RNA, 20 nt, Human
uaagagaagguaguuccuuu

SEQ ID NO: 841681 - RNA, 22 nt, Human
uaagccuccuuauaaggcuaca

SEQ ID NO: 841682 - RNA, 18 nt, Human
uacaauccugucaucuuc

SEQ ID NO: 841683 - RNA, 19 nt, Human
uaccauggacauaaaugca

SEQ ID NO: 841684 - RNA, 24 nt, Human
uagcuuuuuagaauaaaaaaugau

SEQ ID NO: 841685 - RNA, 21 nt, Human
uaggaggggaucauguuagca

SEQ ID NO: 841686 - RNA, 19 nt, Human
ucaaguauucagcacugcu

SEQ ID NO: 841687 - RNA, 22 nt, Human
ucagcacugcuuucuggccaag

SEQ ID NO: 841688 - RNA, 18 nt, Human
ucagcccaggcaaagccg

SEQ ID NO: 841689 - RNA, 22 nt, Human
ucagcccaggcaaagccgggag

SEQ ID NO: 841690 - RNA, 23 nt, Human
ucaguccagcuugaaagcagugu

SEQ ID NO: 841691 - RNA, 22 nt, Human
uccccugcaaaagaaaacaggc

SEQ ID NO: 841692 - RNA, 27 nt, Human
ucuccagaaacgagcugucuuggccac

SEQ ID NO: 841693 - RNA, 18 nt, Human
ucugaaguuccuuuguuc

SEQ ID NO: 841694 - RNA, 20 nt, Human
ucuguaggcuguaagaucac

SEQ ID NO: 841695 - RNA, 21 nt, Human
ucuuccuccuccucuucacuc

SEQ ID NO: 841696 - RNA, 20 nt, Human
ugacagaacauuaaguagaa

SEQ ID NO: 841697 - RNA, 21 nt, Human
ugacugauccagcagagaaga

SEQ ID NO: 841698 - RNA, 19 nt, Human
ugagaacacacacacacca

SEQ ID NO: 841699 - RNA, 20 nt, Human
ugagaacacacacacaccac

SEQ ID NO: 841700 - RNA, 21 nt, Human
ugaguucuggacacagcguuu

SEQ ID NO: 841701 - RNA, 23 nt, Human
ugcagggggaacuguuuucugaa

SEQ ID NO: 841702 - RNA, 19 nt, Human
uggaaaaaauagauggagc

SEQ ID NO: 841703 - RNA, 24 nt, Human
uggaaacagacaaggagauagaug

SEQ ID NO: 841704 - RNA, 21 nt, Human
uggaaguaggaggggaucaug

SEQ ID NO: 841705 - RNA, 18 nt, Human
uggagcugcugaguucug

SEQ ID NO: 841706 - RNA, 23 nt, Human
uggcaaggcagagcuuagaacag

SEQ ID NO: 841707 - RNA, 20 nt, Human
uggcagcaucuccucaaggc

SEQ ID NO: 841708 - RNA, 18 nt, Human
ugggagaggagagcuggg

SEQ ID NO: 841709 - RNA, 18 nt, Human
uggguaagcaaugugacc

SEQ ID NO: 841710 - RNA, 19 nt, Human
uguccuagaguuccugcuc

SEQ ID NO: 841711 - RNA, 20 nt, Human
uuccuuucacaauaagaaaa

SEQ ID NO: 841712 - RNA, 20 nt, Human
uucuuccuccuccucuucac

SEQ ID NO: 841713 - RNA, 19 nt, Human
uuuauacaaaggacuguca

SEQ ID NO: 841714 - RNA, 19 nt, Human
uuuauacaaaggacuguca

SEQ ID NO: 841715 - RNA, 23 nt, Human
uuuauacaaaggacugucagagu

SEQ ID NO: 841716 - RNA, 19 nt, Human
uuucccagaaugagacugg

SEQ ID NO: 841717 - RNA, 25 nt, Human
uuuucagaauauaagcugcauagcu

SEQ ID NO: 841718 - RNA, 22 nt, Human
aauucauaauucuaucuggaac

SEQ ID NO: 841719 - RNA, 23 nt, Human
accaccuuuucuugguuuguguc

SEQ ID NO: 841720 - RNA, 24 nt, Human
accaccuuuucuugguuuguguca

SEQ ID NO: 841721 - RNA, 18 nt, Human
acgugguauacaccaaaa

SEQ ID NO: 841722 - RNA, 23 nt, Human
auuuuuauuuuuuuguuuaggag

SEQ ID NO: 841723 - RNA, 26 nt, Human
cacaccacacacucaugagaccaaau

SEQ ID NO: 841724 - RNA, 19 nt, Human
caccacacacucaugagac

SEQ ID NO: 841725 - RNA, 19 nt, Human
cagcaaagaaacacaccac

SEQ ID NO: 841726 - RNA, 22 nt, Human
cagcaaagaaacacaccacaca

SEQ ID NO: 841727 - RNA, 23 nt, Human
cauuaaacuggacaaacuggggc

SEQ ID NO: 841728 - RNA, 20 nt, Human
cucagaguagccaccaucau

SEQ ID NO: 841729 - RNA, 20 nt, Human
cuucuagguugacgugguau

SEQ ID NO: 841730 - RNA, 21 nt, Human
gacaugaacugugccaaaggc

SEQ ID NO: 841731 - RNA, 18 nt, Human
ggacaaacuggggcucag

SEQ ID NO: 841732 - RNA, 23 nt, Human
uaaacuggacaaacuggggcuca

SEQ ID NO: 841733 - RNA, 21 nt, Human
uaggagggacaaacacaaagc

SEQ ID NO: 841734 - RNA, 21 nt, Human
uagguugacgugguauacacc

SEQ ID NO: 841735 - RNA, 19 nt, Human
uccucagaguagccaccau

SEQ ID NO: 841736 - RNA, 26 nt, Human
ucuaucaaguuaaaauaaauuagacu

SEQ ID NO: 841737 - RNA, 18 nt, Human
ucuguaguuccaggccag

SEQ ID NO: 841738 - RNA, 19 nt, Human
ucuuccugcugaauaaaag

SEQ ID NO: 841739 - RNA, 21 nt, Human
ucuugguuugugucagagaau

SEQ ID NO: 841740 - RNA, 21 nt, Human
ugaccagcaaagaaacacacc

SEQ ID NO: 841741 - RNA, 19 nt, Human
ugagaccaaaugacugcca

SEQ ID NO: 841742 - RNA, 18 nt, Human
ugccaaaggcuuggcugu

SEQ ID NO: 841743 - RNA, 20 nt, Human
ugccaaaggcuuggcugucu

SEQ ID NO: 841744 - RNA, 20 nt, Human
uggcugaauccuccauuaaa

SEQ ID NO: 841745 - RNA, 19 nt, Human
ugugucagagaauguuagc

SEQ ID NO: 841746 - RNA, 21 nt, Human
uuaaaauaaauuagacuaaca

SEQ ID NO: 841747 - RNA, 22 nt, Human
uuucuuguaauucauaauucua

SEQ ID NO: 841748 - RNA, 23 nt, Human
uuuuuuuuuuuuuuuuugaugag

SEQ ID NO: 841749 - RNA, 27 nt, Human
uuuuuuuuuuuuuuuuuuuuuuugggg

SEQ ID NO: 841750 - RNA, 21 nt, Human
aaaaaacaaagcacaaauaua

SEQ ID NO: 841751 - RNA, 19 nt, Human
aagcaaguuuuucuuguuu

SEQ ID NO: 841752 - RNA, 20 nt, Human
auggcgccaaaagcaaguuu

SEQ ID NO: 841753 - RNA, 19 nt, Human
cacgucuccagcuccgccc

SEQ ID NO: 841754 - RNA, 18 nt, Human
cacugcacacccgcgagu

SEQ ID NO: 841755 - RNA, 25 nt, Human
cacugcacacccgcgaguccucgaa

SEQ ID NO: 841756 - RNA, 27 nt, Human
cauucaaaaucaccagaacucuuguuc

SEQ ID NO: 841757 - RNA, 19 nt, Human
ccagagcauuuggcauucu

SEQ ID NO: 841758 - RNA, 21 nt, Human
cccgagcccgagccacgcgcc

SEQ ID NO: 841759 - RNA, 18 nt, Human
cuccagcuccgcccgagc

SEQ ID NO: 841760 - RNA, 19 nt, Human
cuccgcccgagcccgagcc

SEQ ID NO: 841761 - RNA, 18 nt, Human
cuugaagucgcucaucag

SEQ ID NO: 841762 - RNA, 18 nt, Human
guaaguuuuccuguuucc

SEQ ID NO: 841763 - RNA, 18 nt, Human
guuuguuugguucccagg

SEQ ID NO: 841764 - RNA, 20 nt, Human
uaaaaaacaaagcacaaaua

SEQ ID NO: 841765 - RNA, 23 nt, Human
uaccagaaaguaguaaauggcuu

SEQ ID NO: 841766 - RNA, 22 nt, Human
uagacugagguccaggaaaaau

SEQ ID NO: 841767 - RNA, 21 nt, Human
uagcaaaauaaaaagacauaa

SEQ ID NO: 841768 - RNA, 20 nt, Human
uaugguagucuaccagaaag

SEQ ID NO: 841769 - RNA, 23 nt, Human
ucaacucaacuuguaacaacccu

SEQ ID NO: 841770 - RNA, 21 nt, Human
ucuccagcuccgcccgagccc

SEQ ID NO: 841771 - RNA, 26 nt, Human
ugccucuaacauuauuuugaauccuu

SEQ ID NO: 841772 - RNA, 26 nt, Human
uuagcaaaauaaaaagacauaagugg

SEQ ID NO: 841773 - RNA, 20 nt, Human
uuccuguuuccuuaucucca

SEQ ID NO: 841774 - RNA, 28 nt, Human
uugauggcgccaaaagcaaguuuuucuu

SEQ ID NO: 841775 - RNA, 21 nt, Human
uuuuguuuguuugguucccag

SEQ ID NO: 841776 - RNA, 23 nt, Human
uuuuuugcagaugaaaagaaaua

SEQ ID NO: 841777 - RNA, 19 nt, Human
aaccaagaagcaggcaaga

SEQ ID NO: 841778 - RNA, 26 nt, Human
aagcaggcaagaggccugggacccag

SEQ ID NO: 841779 - RNA, 25 nt, Human
aagccagccucagccucagcuccaa

SEQ ID NO: 841780 - RNA, 18 nt, Human
accacagcuggguuguag

SEQ ID NO: 841781 - RNA, 19 nt, Human
accacagcuggguuguagg

SEQ ID NO: 841782 - RNA, 20 nt, Human
agaagcaggcaagaggccug

SEQ ID NO: 841783 - RNA, 21 nt, Human
agacacccaggccccugccuc

SEQ ID NO: 841784 - RNA, 25 nt, Human
agagcugggauuggaacuaggggcc

SEQ ID NO: 841785 - RNA, 21 nt, Human
agccugccaggccugggcucu

SEQ ID NO: 841786 - RNA, 19 nt, Human
agcuggguagcagaggguu

SEQ ID NO: 841787 - RNA, 23 nt, Human
aggaaaccucagaguccugccaa

SEQ ID NO: 841788 - RNA, 19 nt, Human
aggaagccagccucagccu

SEQ ID NO: 841789 - RNA, 22 nt, Human
aggaaggcuaaguccugaacca

SEQ ID NO: 841790 - RNA, 19 nt, Human
aggcaagaggccugggacc

SEQ ID NO: 841791 - RNA, 21 nt, Human
aggcaagaggccugggaccca

SEQ ID NO: 841792 - RNA, 20 nt, Human
agguaagugaaggucaggaa

SEQ ID NO: 841793 - RNA, 22 nt, Human
agguggggaggggcucuaggca

SEQ ID NO: 841794 - RNA, 20 nt, Human
auccgcgccaggcgcgucuc

SEQ ID NO: 841795 - RNA, 23 nt, Human
caaagagcugaaacucccaaggc

SEQ ID NO: 841796 - RNA, 21 nt, Human
caaauggcaauuaagucaaaa

SEQ ID NO: 841797 - RNA, 23 nt, Human
caacucccugaggguaggauaac

SEQ ID NO: 841798 - RNA, 25 nt, Human
caagaagcaggcaagaggccuggga

SEQ ID NO: 841799 - RNA, 22 nt, Human
caagaggccugggacccagggc

SEQ ID NO: 841800 - RNA, 24 nt, Human
caaucucauggcauggucugcagg

SEQ ID NO: 841801 - RNA, 18 nt, Human
cacaccuggcaacacccc

SEQ ID NO: 841802 - RNA, 25 nt, Human
caccuucaaucucauggcauggucu

SEQ ID NO: 841803 - RNA, 18 nt, Human
cacugauuccagccagua

SEQ ID NO: 841804 - RNA, 25 nt, Human
cagagggacacccaugacagaaauc

SEQ ID NO: 841805 - RNA, 19 nt, Human
cagccucagccucagcucc

SEQ ID NO: 841806 - RNA, 23 nt, Human
cagcugugguguuucuaaaagcc

SEQ ID NO: 841807 - RNA, 25 nt, Human
cagcugugguguuucuaaaagccgu

SEQ ID NO: 841808 - RNA, 18 nt, Human
caggcucagagcaggucc

SEQ ID NO: 841809 - RNA, 21 nt, Human
caguaggcuuccugguccccc

SEQ ID NO: 841810 - RNA, 22 nt, Human
cagugcucucagagcccacaug

SEQ ID NO: 841811 - RNA, 18 nt, Human
ccaaauacgcagacaagc

SEQ ID NO: 841812 - RNA, 22 nt, Human
ccaacauccaucuucaccgacu

SEQ ID NO: 841813 - RNA, 24 nt, Human
ccaaggcucagccaggacucucca

SEQ ID NO: 841814 - RNA, 22 nt, Human
ccacaccuggcaacacccccug

SEQ ID NO: 841815 - RNA, 19 nt, Human
ccagcaaagcugaaaggau

SEQ ID NO: 841816 - RNA, 23 nt, Human
cccagggcagggucaacccuccu

SEQ ID NO: 841817 - RNA, 18 nt, Human
ccccgcugcagccacacc

SEQ ID NO: 841818 - RNA, 24 nt, Human
ccuccuauuuugccaacauccauc

SEQ ID NO: 841819 - RNA, 25 nt, Human
ccuccuggcugcuuaccugucacuu

SEQ ID NO: 841820 - RNA, 22 nt, Human
ccugaacccauucugaguacag

SEQ ID NO: 841821 - RNA, 18 nt, Human
ccuggccccugggcaggc

SEQ ID NO: 841822 - RNA, 21 nt, Human
ccuggccccugggcaggcuca

SEQ ID NO: 841823 - RNA, 21 nt, Human
cgccaaagagcugaaacuccc

SEQ ID NO: 841824 - RNA, 27 nt, Human
cgccaaagagcugaaacucccaaggcu

SEQ ID NO: 841825 - RNA, 18 nt, Human
cuaggcagcggccucucc

SEQ ID NO: 841826 - RNA, 20 nt, Human
cuaguaagcggcagagcugg

SEQ ID NO: 841827 - RNA, 23 nt, Human
cuccaaauacgcagacaagcccu

SEQ ID NO: 841828 - RNA, 25 nt, Human
cucucuggcauauaugcaugccuag

SEQ ID NO: 841829 - RNA, 19 nt, Human
cuggagcaggccuggcccc

SEQ ID NO: 841830 - RNA, 20 nt, Human
cuggagcaggccuggccccu

SEQ ID NO: 841831 - RNA, 27 nt, Human
cuuccccagccacaccuggcaacaccc

SEQ ID NO: 841832 - RNA, 20 nt, Human
gaccacagcuggguuguagg

SEQ ID NO: 841833 - RNA, 25 nt, Human
gaggcacagacacccaggccccugc

SEQ ID NO: 841834 - RNA, 23 nt, Human
gccccugccucagguccagcaaa

SEQ ID NO: 841835 - RNA, 20 nt, Human
gcggccucuccugguugaaa

SEQ ID NO: 841836 - RNA, 25 nt, Human
ggaccacagcuggguuguagggaaa

SEQ ID NO: 841837 - RNA, 19 nt, Human
ggacccagggcagggucaa

SEQ ID NO: 841838 - RNA, 18 nt, Human
ggauuggaacuaggggcu

SEQ ID NO: 841839 - RNA, 22 nt, Human
ggcaagaggccugggacccagg

SEQ ID NO: 841840 - RNA, 20 nt, Human
gguagggaggcacagacacc

SEQ ID NO: 841841 - RNA, 19 nt, Human
gucugguggcuucaaguuc

SEQ ID NO: 841842 - RNA, 27 nt, Human
guuccaggcacucaguggcauggguau

SEQ ID NO: 841843 - RNA, 20 nt, Human
uagcagaggguuucugggcc

SEQ ID NO: 841844 - RNA, 25 nt, Human
uauuucauacccuaaggcaauuuua

SEQ ID NO: 841845 - RNA, 21 nt, Human
ucacccauccaggaaaaggug

SEQ ID NO: 841846 - RNA, 22 nt, Human
ucagccaggacucuccagcugu

SEQ ID NO: 841847 - RNA, 19 nt, Human
ucagccucagcuccaaaua

SEQ ID NO: 841848 - RNA, 20 nt, Human
ucccaaagggucaccuggug

SEQ ID NO: 841849 - RNA, 23 nt, Human
ucccaaagggucaccuggugaag

SEQ ID NO: 841850 - RNA, 19 nt, Human
uccccgcaccuucaaucuc

SEQ ID NO: 841851 - RNA, 21 nt, Human
uccccgcugcagccacaccaa

SEQ ID NO: 841852 - RNA, 23 nt, Human
uccgcgccaggcgcgucucgggg

SEQ ID NO: 841853 - RNA, 23 nt, Human
uccugguugaaagaaacugagac

SEQ ID NO: 841854 - RNA, 22 nt, Human
ucgcucaguccuccuuccucgg

SEQ ID NO: 841855 - RNA, 23 nt, Human
ucuccuggcuugccucacccauc

SEQ ID NO: 841856 - RNA, 19 nt, Human
ucucuggaucuacuucccc

SEQ ID NO: 841857 - RNA, 20 nt, Human
ucucugggaccacagcuggg

SEQ ID NO: 841858 - RNA, 22 nt, Human
ucucugggaccacagcuggguu

SEQ ID NO: 841859 - RNA, 22 nt, Human
ucugcaggaaaccucagagucc

SEQ ID NO: 841860 - RNA, 23 nt, Human
ucugggagccugccaggccuggg

SEQ ID NO: 841861 - RNA, 18 nt, Human
ucugggugagauguagag

SEQ ID NO: 841862 - RNA, 18 nt, Human
ucugguggcuucaaguuc

SEQ ID NO: 841863 - RNA, 24 nt, Human
ugaaacucccaaggcucagccagg

SEQ ID NO: 841864 - RNA, 19 nt, Human
ugaaaggaugagaacagag

SEQ ID NO: 841865 - RNA, 21 nt, Human
ugaaccaaacugccacugcua

SEQ ID NO: 841866 - RNA, 21 nt, Human
ugaacccauucugaguacaga

SEQ ID NO: 841867 - RNA, 19 nt, Human
ugaagucaagugcuguuga

SEQ ID NO: 841868 - RNA, 28 nt, Human
ugaguugugaacccagacccuuccccuu

SEQ ID NO: 841869 - RNA, 18 nt, Human
ugcucucagagcccacau

SEQ ID NO: 841870 - RNA, 24 nt, Human
ugcuugcucuccuggcuugccuca

SEQ ID NO: 841871 - RNA, 21 nt, Human
uggagcacugauuccagccag

SEQ ID NO: 841872 - RNA, 19 nt, Human
uggagcaggccuggccccu

SEQ ID NO: 841873 - RNA, 18 nt, Human
uggcauggguauucugca

SEQ ID NO: 841874 - RNA, 23 nt, Human
ugggcaggcucagagcagguccc

SEQ ID NO: 841875 - RNA, 21 nt, Human
uggggaggggcucuaggcagc

SEQ ID NO: 841876 - RNA, 24 nt, Human
uggguagcagaggguuucugggcc

SEQ ID NO: 841877 - RNA, 24 nt, Human
uggguauucugcacacaaaauuuc

SEQ ID NO: 841878 - RNA, 18 nt, Human
uguagggaaagaauggag

SEQ ID NO: 841879 - RNA, 20 nt, Human
uucacugaauccucucaaca

SEQ ID NO: 841880 - RNA, 19 nt, Human
uugaaagaaacugagaccu

SEQ ID NO: 841881 - RNA, 23 nt, Human
aaaauagauuuacuauucaugaa

SEQ ID NO: 841882 - RNA, 21 nt, Human
aaccaaauaaacauaucuacc

SEQ ID NO: 841883 - RNA, 25 nt, Human
aaccaggacaucaagguaauacuuc

SEQ ID NO: 841884 - RNA, 23 nt, Human
aaccauauugacgaagauuggcc

SEQ ID NO: 841885 - RNA, 23 nt, Human
aaucgaugacaaccaaaaaccaa

SEQ ID NO: 841886 - RNA, 24 nt, Human
acaaaaaagucuauaaaacaaaga

SEQ ID NO: 841887 - RNA, 22 nt, Human
accauauugacgaagauuggcc

SEQ ID NO: 841888 - RNA, 21 nt, Human
acuggaaagcuucugcucgca

SEQ ID NO: 841889 - RNA, 19 nt, Human
acuucucuaaaccauauug

SEQ ID NO: 841890 - RNA, 21 nt, Human
agauucucugauaccauaugg

SEQ ID NO: 841891 - RNA, 19 nt, Human
augaaaguucacauccaga

SEQ ID NO: 841892 - RNA, 21 nt, Human
augugcccuuccuccaggaag

SEQ ID NO: 841893 - RNA, 20 nt, Human
augugugacuggaaagcuuc

SEQ ID NO: 841894 - RNA, 21 nt, Human
caaccaaaaaccaaauaaacu

SEQ ID NO: 841895 - RNA, 24 nt, Human
caaggaaacaggaacauggcuuuc

SEQ ID NO: 841896 - RNA, 18 nt, Human
caccgguaaccaauagac

SEQ ID NO: 841897 - RNA, 23 nt, Human
caccgugcgccgcuggcccgcgc

SEQ ID NO: 841898 - RNA, 19 nt, Human
cagcugcgaaguuuaacag

SEQ ID NO: 841899 - RNA, 26 nt, Human
caguaaaaauagauuuacuauucaug

SEQ ID NO: 841900 - RNA, 26 nt, Human
ccaaauaaacauaucuaccaaaugaa

SEQ ID NO: 841901 - RNA, 26 nt, Human
ccaccuaaaacgagggucucagcugc

SEQ ID NO: 841902 - RNA, 23 nt, Human
ccagaugucuuuuuaaaucaaau

SEQ ID NO: 841903 - RNA, 18 nt, Human
ccaucucuucaguguauu

SEQ ID NO: 841904 - RNA, 24 nt, Human
cccucuuucucccucccaaagccc

SEQ ID NO: 841905 - RNA, 22 nt, Human
cuaggucccucuuucucccucc

SEQ ID NO: 841906 - RNA, 25 nt, Human
cucaaauuucuucaccuuuuccauu

SEQ ID NO: 841907 - RNA, 19 nt, Human
cucuucaguguauucuggc

SEQ ID NO: 841908 - RNA, 18 nt, Human
cucuuucucccucccaaa

SEQ ID NO: 841909 - RNA, 19 nt, Human
gacauuuuucccauuuuuc

SEQ ID NO: 841910 - RNA, 25 nt, Human
gaugcaucugaaaccaggacaucaa

SEQ ID NO: 841911 - RNA, 18 nt, Human
gcccgcgcuaggucccuc

SEQ ID NO: 841912 - RNA, 21 nt, Human
ggaaggaauuaugaccuuggu

SEQ ID NO: 841913 - RNA, 22 nt, Human
ggaaggaauuaugaccuuggua

SEQ ID NO: 841914 - RNA, 22 nt, Human
guuuucaucugguccucuccac

SEQ ID NO: 841915 - RNA, 18 nt, Human
uaauuguaaaaaaauaac

SEQ ID NO: 841916 - RNA, 19 nt, Human
uaauuguaaaaaaauaacu

SEQ ID NO: 841917 - RNA, 25 nt, Human
uacauacaacaaaaaagucuauaaa

SEQ ID NO: 841918 - RNA, 18 nt, Human
uacaugaaaguucacauc

SEQ ID NO: 841919 - RNA, 20 nt, Human
uaccauauggaggaucagua

SEQ ID NO: 841920 - RNA, 24 nt, Human
uaccuauuuucuggaucauacaug

SEQ ID NO: 841921 - RNA, 23 nt, Human
uagauuaauuguaaaaaaauaac

SEQ ID NO: 841922 - RNA, 18 nt, Human
uaucuccuucugugaacc

SEQ ID NO: 841923 - RNA, 22 nt, Human
ucaaaauaugugcccuuccucc

SEQ ID NO: 841924 - RNA, 22 nt, Human
ucaauuccauccaaucacacau

SEQ ID NO: 841925 - RNA, 22 nt, Human
ucccauuuuucuauccccuuug

SEQ ID NO: 841926 - RNA, 19 nt, Human
ucccucuuucucccuccca

SEQ ID NO: 841927 - RNA, 24 nt, Human
uccuggguggauuuuucuuccuug

SEQ ID NO: 841928 - RNA, 19 nt, Human
uccuuggcaauucuuuuug

SEQ ID NO: 841929 - RNA, 24 nt, Human
ugaaaccaggacaucaagguaaua

SEQ ID NO: 841930 - RNA, 19 nt, Human
ugccaaggcaccaucucuu

SEQ ID NO: 841931 - RNA, 25 nt, Human
uggcaauguaaaucgaugacaacca

SEQ ID NO: 841932 - RNA, 22 nt, Human
uggguggauuuuucuuccuugg

SEQ ID NO: 841933 - RNA, 19 nt, Human
ugugcccuuccuccaggaa

SEQ ID NO: 841934 - RNA, 20 nt, Human
uuaaaagucaacaauauuaa

SEQ ID NO: 841935 - RNA, 22 nt, Human
uuagaugcaucugaaaccagga

SEQ ID NO: 841936 - RNA, 24 nt, Human
uucaauuccauccaaucacacauc

SEQ ID NO: 841937 - RNA, 23 nt, Human
uucaccuuuuccauugugaucaa

SEQ ID NO: 841938 - RNA, 21 nt, Human
uucaucugguccucuccacuu

SEQ ID NO: 841939 - RNA, 18 nt, Human
uucugugaaccuguucuu

SEQ ID NO: 841940 - RNA, 19 nt, Human
uucuucaccuuuuccauug

SEQ ID NO: 841941 - RNA, 18 nt, Human
uucuuccuuggcaauucu

SEQ ID NO: 841942 - RNA, 18 nt, Human
uuucccauuuuucuaucc

SEQ ID NO: 841943 - RNA, 21 nt, Human
uuuucuggaucauacaugaaa

SEQ ID NO: 841944 - RNA, 23 nt, Human
uuuuuuuuuuuuagaaauucuca

SEQ ID NO: 841945 - RNA, 20 nt, Human
aacagcuggcucccccaaga

SEQ ID NO: 841946 - RNA, 18 nt, Human
aaccaauacccacaaaau

SEQ ID NO: 841947 - RNA, 22 nt, Human
aaccaauacccacaaaauccug

SEQ ID NO: 841948 - RNA, 24 nt, Human
aagaagccaacagccacagcagga

SEQ ID NO: 841949 - RNA, 21 nt, Human
acacaauaaagacacaguauc

SEQ ID NO: 841950 - RNA, 25 nt, Human
acacaccugcacucacacacacaca

SEQ ID NO: 841951 - RNA, 22 nt, Human
aggcuuucgggcaagguaguuc

SEQ ID NO: 841952 - RNA, 22 nt, Human
agguaguucuggcaccacagga

SEQ ID NO: 841953 - RNA, 22 nt, Human
auuaugcaaugguuaucaggaa

SEQ ID NO: 841954 - RNA, 24 nt, Human
caauacccacaaaauccuguauga

SEQ ID NO: 841955 - RNA, 19 nt, Human
ccaauacccacaaaauccu

SEQ ID NO: 841956 - RNA, 19 nt, Human
cccaagauagccagcggcc

SEQ ID NO: 841957 - RNA, 18 nt, Human
cccgcuucucccagcgcc

SEQ ID NO: 841958 - RNA, 21 nt, Human
cgagaucuugucagagaaccu

SEQ ID NO: 841959 - RNA, 18 nt, Human
cgcccuaggaaagcgaga

SEQ ID NO: 841960 - RNA, 22 nt, Human
cgcucugucacaagcucaccuc

SEQ ID NO: 841961 - RNA, 26 nt, Human
cguggucccacgaaacugggucucuu

SEQ ID NO: 841962 - RNA, 20 nt, Human
cuggcaguggggcauagucc

SEQ ID NO: 841963 - RNA, 23 nt, Human
gaccuuugaacgccuucaccgcc

SEQ ID NO: 841964 - RNA, 19 nt, Human
gagcauggcucagcgcugc

SEQ ID NO: 841965 - RNA, 19 nt, Human
gccuguuuccuggcagugg

SEQ ID NO: 841966 - RNA, 18 nt, Human
ggaagacgggguaaaucu

SEQ ID NO: 841967 - RNA, 19 nt, Human
uaagaagccaacagccaca

SEQ ID NO: 841968 - RNA, 20 nt, Human
uaagaagccaacagccacag

SEQ ID NO: 841969 - RNA, 22 nt, Human
uaagaagccaacagccacagca

SEQ ID NO: 841970 - RNA, 19 nt, Human
uauaauaaagacacacacc

SEQ ID NO: 841971 - RNA, 21 nt, Human
ucaaaccaggucugagugaca

SEQ ID NO: 841972 - RNA, 22 nt, Human
uccggugggagggaggcggaag

SEQ ID NO: 841973 - RNA, 20 nt, Human
ucgcucugucacaagcucac

SEQ ID NO: 841974 - RNA, 18 nt, Human
ucucccagcgccccuucc

SEQ ID NO: 841975 - RNA, 20 nt, Human
ucucccagcgccccuucccg

SEQ ID NO: 841976 - RNA, 24 nt, Human
uggcaguggggcauaguccaacag

SEQ ID NO: 841977 - RNA, 18 nt, Human
uggucccacgaaacuggg

SEQ ID NO: 841978 - RNA, 24 nt, Human
uuaacuaucaaaaggacaaaaugc

SEQ ID NO: 841979 - RNA, 23 nt, Human
uuggaauaaucuuucauuuuaua

SEQ ID NO: 841980 - RNA, 19 nt, Human
uuuacacaacuguucaagc

SEQ ID NO: 841981 - RNA, 22 nt, Human
acaccgggccuccagcggaggc

SEQ ID NO: 841982 - RNA, 19 nt, Human
accacaccgggccuccagc

SEQ ID NO: 841983 - RNA, 22 nt, Human
agccacggcaaugacauugucc

SEQ ID NO: 841984 - RNA, 18 nt, Human
agcgucuccacgugagcg

SEQ ID NO: 841985 - RNA, 19 nt, Human
aguccagacuguccacacu

SEQ ID NO: 841986 - RNA, 20 nt, Human
caaugaugccuuuucucuga

SEQ ID NO: 841987 - RNA, 23 nt, Human
caccgggccuccagcggaggcgg

SEQ ID NO: 841988 - RNA, 21 nt, Human
cagacuguccacacugaucuc

SEQ ID NO: 841989 - RNA, 18 nt, Human
cagcagcgccugucucgc

SEQ ID NO: 841990 - RNA, 21 nt, Human
cggaaccacaccgggccucca

SEQ ID NO: 841991 - RNA, 20 nt, Human
cggacaaugaugccuuuucu

SEQ ID NO: 841992 - RNA, 23 nt, Human
gaucucgucuuuccuccgcuuac

SEQ ID NO: 841993 - RNA, 21 nt, Human
gcagcagcgccugucucgcgc

SEQ ID NO: 841994 - RNA, 23 nt, Human
gcaggugcgucacuguucuuaau

SEQ ID NO: 841995 - RNA, 28 nt, Human
gccgugauccuaaauggguccggcgccg

SEQ ID NO: 841996 - RNA, 21 nt, Human
gguuugaggcuggcgcgcggu

SEQ ID NO: 841997 - RNA, 24 nt, Human
uccacggggugccaggcugugugc

SEQ ID NO: 841998 - RNA, 22 nt, Human
uccagcggaggcggcuuucucc

SEQ ID NO: 841999 - RNA, 19 nt, Human
uccugugucugugaaggga

SEQ ID NO: 842000 - RNA, 18 nt, Human
ucucucgaggccuccagg

SEQ ID NO: 842001 - RNA, 26 nt, Human
ugaaauaaauacauuuauucugagua

SEQ ID NO: 842002 - RNA, 24 nt, Human
ugauguccacgauguuaaagcuuc

SEQ ID NO: 842003 - RNA, 22 nt, Human
uuaauggagcggacaaugaugc

SEQ ID NO: 842004 - RNA, 28 nt, Human
aaacaaaacaguuugccauuccuuuaac

SEQ ID NO: 842005 - RNA, 24 nt, Human
acccugcuggcaugaugggugagg

SEQ ID NO: 842006 - RNA, 18 nt, Human
agcagggcuucugaagcu

SEQ ID NO: 842007 - RNA, 18 nt, Human
agcuaugaggcaaguaca

SEQ ID NO: 842008 - RNA, 21 nt, Human
aggaaaugggcagagggucaa

SEQ ID NO: 842009 - RNA, 21 nt, Human
caacacagugacaguggggag

SEQ ID NO: 842010 - RNA, 18 nt, Human
cacacaaacaagucucug

SEQ ID NO: 842011 - RNA, 21 nt, Human
cagugacaguggggagugggu

SEQ ID NO: 842012 - RNA, 24 nt, Human
cauauucccuauccugccaauacc

SEQ ID NO: 842013 - RNA, 23 nt, Human
ccaauaccacagauaccuuuagg

SEQ ID NO: 842014 - RNA, 18 nt, Human
ccaguaaauauucccuga

SEQ ID NO: 842015 - RNA, 23 nt, Human
ccccugggccuaaagccugguuu

SEQ ID NO: 842016 - RNA, 23 nt, Human
ccuccaagagcagagggagcgga

SEQ ID NO: 842017 - RNA, 23 nt, Human
cggcaacgugagaaggcacugac

SEQ ID NO: 842018 - RNA, 20 nt, Human
cuaacgucaagaacuuggaa

SEQ ID NO: 842019 - RNA, 19 nt, Human
cugcugccaucuuucaugc

SEQ ID NO: 842020 - RNA, 23 nt, Human
cuguaaugcauauucccuauccu

SEQ ID NO: 842021 - RNA, 20 nt, Human
cuugucucuucuuucaccga

SEQ ID NO: 842022 - RNA, 20 nt, Human
gaaaagacugcgaggucuau

SEQ ID NO: 842023 - RNA, 19 nt, Human
gacccugcuggcaugaugg

SEQ ID NO: 842024 - RNA, 20 nt, Human
uaccugaagaauacggcaac

SEQ ID NO: 842025 - RNA, 22 nt, Human
uauucccugaacccccgucgcg

SEQ ID NO: 842026 - RNA, 24 nt, Human
ucacccuagggcugcugccaucuu

SEQ ID NO: 842027 - RNA, 24 nt, Human
ucaggguugcuaggaacaugggua

SEQ ID NO: 842028 - RNA, 19 nt, Human
uccccugggccuaaagccu

SEQ ID NO: 842029 - RNA, 19 nt, Human
uccuucaccagcuaugagg

SEQ ID NO: 842030 - RNA, 24 nt, Human
ucucaggguugcuaggaacauggg

SEQ ID NO: 842031 - RNA, 22 nt, Human
ugagaaggcacugacccggcug

SEQ ID NO: 842032 - RNA, 23 nt, Human
uggaagaaaaucaucucaggguu

SEQ ID NO: 842033 - RNA, 22 nt, Human
uggggccacacaaacaagucuc

SEQ ID NO: 842034 - RNA, 24 nt, Human
ugggguggagcccuuaccuccacu

SEQ ID NO: 842035 - RNA, 19 nt, Human
uggguaagaccagacugua

SEQ ID NO: 842036 - RNA, 19 nt, Human
uggguggguggaaaaaugg

SEQ ID NO: 842037 - RNA, 23 nt, Human
uggguggguggaaaaaugggagg

SEQ ID NO: 842038 - RNA, 20 nt, Human
ugugccacggaagacagagc

SEQ ID NO: 842039 - RNA, 20 nt, Human
uucaugcccagagucaaauc

SEQ ID NO: 842040 - RNA, 21 nt, Human
uugugccacggaagacagagc

SEQ ID NO: 842041 - RNA, 19 nt, Human
aaacaaaugugcaccacga

SEQ ID NO: 842042 - RNA, 18 nt, Human
aaaugugaaagcugcagu

SEQ ID NO: 842043 - RNA, 20 nt, Human
aagacaaaugccauaaaugu

SEQ ID NO: 842044 - RNA, 19 nt, Human
accacauuuagaauccagc

SEQ ID NO: 842045 - RNA, 23 nt, Human
aggugccagcggcguacuaaagc

SEQ ID NO: 842046 - RNA, 19 nt, Human
cgcuugcaaaggcgugugc

SEQ ID NO: 842047 - RNA, 18 nt, Human
guacuaaagcaccgacuc

SEQ ID NO: 842048 - RNA, 18 nt, Human
ugcaguuugcaauauacc

SEQ ID NO: 842049 - RNA, 19 nt, Human
ugccagcggcguacuaaag

SEQ ID NO: 842050 - RNA, 20 nt, Human
uuuuuuuuuuuuuuuuguuu

SEQ ID NO: 842051 - RNA, 21 nt, Human
aaaccuccaggccccggcucc

SEQ ID NO: 842052 - RNA, 22 nt, Human
aaaccuccaggccccggcuccu

SEQ ID NO: 842053 - RNA, 24 nt, Human
aaauagcucaaaacuaucuugcau

SEQ ID NO: 842054 - RNA, 21 nt, Human
aagcaggaagaagagcuuccu

SEQ ID NO: 842055 - RNA, 20 nt, Human
acagagagaggaaaucuaaa

SEQ ID NO: 842056 - RNA, 18 nt, Human
aggguuaaagguggaagc

SEQ ID NO: 842057 - RNA, 19 nt, Human
cggcuccuuucgcccgcug

SEQ ID NO: 842058 - RNA, 21 nt, Human
cgggaccaggcgaccgguacg

SEQ ID NO: 842059 - RNA, 18 nt, Human
cuccugggucuggacuug

SEQ ID NO: 842060 - RNA, 26 nt, Human
cuugcucuccugggucuggacuugua

SEQ ID NO: 842061 - RNA, 21 nt, Human
gaagccaagcaggaagaagag

SEQ ID NO: 842062 - RNA, 19 nt, Human
gcuuugagauuugauuggu

SEQ ID NO: 842063 - RNA, 21 nt, Human
ggaagaagagcuuccuuaugg

SEQ ID NO: 842064 - RNA, 20 nt, Human
ggugccgggaccaggcgaca

SEQ ID NO: 842065 - RNA, 19 nt, Human
gugccgggaccaggcgacc

SEQ ID NO: 842066 - RNA, 23 nt, Human
uccaggccccggcuccuuucgcc

SEQ ID NO: 842067 - RNA, 19 nt, Human
uccugggucuggacuugua

SEQ ID NO: 842068 - RNA, 23 nt, Human
ucugggccuugcucuccuggguc

SEQ ID NO: 842069 - RNA, 20 nt, Human
uggaagccaagcaggaagaa

SEQ ID NO: 842070 - RNA, 21 nt, Human
ugggaaaccacacugggcggc

SEQ ID NO: 842071 - RNA, 22 nt, Human
uuccuuaugggaaaccacacug

SEQ ID NO: 842072 - RNA, 20 nt, Human
uucugugcuuugagauuuga

SEQ ID NO: 842073 - RNA, 18 nt, Human
uuuaaaaaacuguaaaaa

SEQ ID NO: 842074 - RNA, 22 nt, Human
aaguacaagagaucaacuaacu

SEQ ID NO: 842075 - RNA, 23 nt, Human
acauagguugaauuuggggguug

SEQ ID NO: 842076 - RNA, 19 nt, Human
accacugugagaggagauc

SEQ ID NO: 842077 - RNA, 23 nt, Human
acucuguucuuuaggaaaaaagu

SEQ ID NO: 842078 - RNA, 21 nt, Human
acugcaauuaggauuuggacc

SEQ ID NO: 842079 - RNA, 23 nt, Human
acuuuguauguuuuagaaaaaaa

SEQ ID NO: 842080 - RNA, 20 nt, Human
aguccuuuuugauuauucuu

SEQ ID NO: 842081 - RNA, 24 nt, Human
auauauccacuccacucuguucuu

SEQ ID NO: 842082 - RNA, 24 nt, Human
caaugcaaaugugcacaacauaaa

SEQ ID NO: 842083 - RNA, 23 nt, Human
cauuaccacugugagaggagauc

SEQ ID NO: 842084 - RNA, 23 nt, Human
ccaaugcaaaugugcacaacaua

SEQ ID NO: 842085 - RNA, 23 nt, Human
cuacauacugaagauuagaaaaa

SEQ ID NO: 842086 - RNA, 20 nt, Human
gagcauaauccaucauuuuu

SEQ ID NO: 842087 - RNA, 19 nt, Human
ggaaaaaaguagcuuuucc

SEQ ID NO: 842088 - RNA, 18 nt, Human
gugaauauauccacucca

SEQ ID NO: 842089 - RNA, 19 nt, Human
uaauuugauuuaaucacau

SEQ ID NO: 842090 - RNA, 22 nt, Human
uacauaaaaguuguuacuguuu

SEQ ID NO: 842091 - RNA, 25 nt, Human
uaguaaguccuauugguauaagucc

SEQ ID NO: 842092 - RNA, 20 nt, Human
ugaagauuagaaaaaaaucu

SEQ ID NO: 842093 - RNA, 23 nt, Human
uugauuauucuucucaaaccagu

SEQ ID NO: 842094 - RNA, 23 nt, Human
uuucauuuuuuuauucuaaggag

SEQ ID NO: 842095 - RNA, 25 nt, Human
uuuuuuuuuuuuuuuuucagccauu

SEQ ID NO: 842096 - RNA, 24 nt, Human
uuuuuuuuuuuuuuuuuuuuucag

SEQ ID NO: 842097 - RNA, 21 nt, Human
cccggcccuacccaccccuuc

SEQ ID NO: 842098 - RNA, 18 nt, Human
cccuacccaccccuuccg

SEQ ID NO: 842099 - RNA, 20 nt, Human
ucgcccggcccuacccaccc

SEQ ID NO: 842100 - RNA, 20 nt, Human
aagcagggccccaguaugug

SEQ ID NO: 842101 - RNA, 25 nt, Human
acccuaaguaacagaugcaaggagg

SEQ ID NO: 842102 - RNA, 18 nt, Human
caaccacgccccaggaga

SEQ ID NO: 842103 - RNA, 20 nt, Human
caagacccaagccuugaccc

SEQ ID NO: 842104 - RNA, 21 nt, Human
caagacccaagccuugacccu

SEQ ID NO: 842105 - RNA, 23 nt, Human
caagucuuaggaguuugagaagg

SEQ ID NO: 842106 - RNA, 19 nt, Human
ccacgccccaggagagcuc

SEQ ID NO: 842107 - RNA, 19 nt, Human
cccaagccuugacccuaag

SEQ ID NO: 842108 - RNA, 18 nt, Human
cgcuggggccgggucguc

SEQ ID NO: 842109 - RNA, 19 nt, Human
cuugacccuaaguaacaga

SEQ ID NO: 842110 - RNA, 21 nt, Human
gccuuagcuacuuucaguuau

SEQ ID NO: 842111 - RNA, 19 nt, Human
gggcucccaggacaggcuc

SEQ ID NO: 842112 - RNA, 22 nt, Human
uaacagaugcaaggaucacgaa

SEQ ID NO: 842113 - RNA, 19 nt, Human
uccuccggcuggggugccu

SEQ ID NO: 842114 - RNA, 19 nt, Human
ugccuuagcuacuuucagu

SEQ ID NO: 842115 - RNA, 18 nt, Human
ugcgcuggggccgggucg

SEQ ID NO: 842116 - RNA, 24 nt, Human
uggaaaguuaggguccuuuauugg

SEQ ID NO: 842117 - RNA, 22 nt, Human
ugggagaauaagcagggcccca

SEQ ID NO: 842118 - RNA, 19 nt, Human
uuccuccggcuggggugcc

SEQ ID NO: 842119 - RNA, 24 nt, Human
uugacccuaaguaacagaugcaaa

SEQ ID NO: 842120 - RNA, 22 nt, Human
aacccauuuauauugugggugu

SEQ ID NO: 842121 - RNA, 24 nt, Human
cacuugggccauuuuggaacccau

SEQ ID NO: 842122 - RNA, 21 nt, Human
cauacuagccucugagacugc

SEQ ID NO: 842123 - RNA, 21 nt, Human
ccccauacuagccucugagac

SEQ ID NO: 842124 - RNA, 21 nt, Human
cuuggcagaccucgguccucu

SEQ ID NO: 842125 - RNA, 23 nt, Human
cuuggcagaccucgguccucucc

SEQ ID NO: 842126 - RNA, 24 nt, Human
aaagccaucaucccaugaaaaagu

SEQ ID NO: 842127 - RNA, 19 nt, Human
aaagugccgggauuacagg

SEQ ID NO: 842128 - RNA, 24 nt, Human
aaagugccgggauuacaggaguga

SEQ ID NO: 842129 - RNA, 21 nt, Human
aacaaagccaucaucccauga

SEQ ID NO: 842130 - RNA, 26 nt, Human
aagugccgggauuacaggagugagcc

SEQ ID NO: 842131 - RNA, 25 nt, Human
acuauguugcccaggcugaucuuga

SEQ ID NO: 842132 - RNA, 20 nt, Human
agaaaacagcuucauucuca

SEQ ID NO: 842133 - RNA, 20 nt, Human
agagugaacuugcaucuguu

SEQ ID NO: 842134 - RNA, 20 nt, Human
agccaccacaccuggcccca

SEQ ID NO: 842135 - RNA, 20 nt, Human
agccaccacaccuggcccca

SEQ ID NO: 842136 - RNA, 21 nt, Human
agccaccacaccuggccccaa

SEQ ID NO: 842137 - RNA, 25 nt, Human
aggugauccaccugccuuggcauuc

SEQ ID NO: 842138 - RNA, 24 nt, Human
aguuaacuaacagagugaacuugg

SEQ ID NO: 842139 - RNA, 22 nt, Human
aguuacaugaaucucagcugca

SEQ ID NO: 842140 - RNA, 20 nt, Human
aucccaugaaaaagugaaac

SEQ ID NO: 842141 - RNA, 22 nt, Human
augaaucucagcugcaacaaag

SEQ ID NO: 842142 - RNA, 21 nt, Human
augugaaacuauuauuaccac

SEQ ID NO: 842143 - RNA, 24 nt, Human
caaagugccgggauuacaggagug

SEQ ID NO: 842144 - RNA, 18 nt, Human
caacaaagccaucauccc

SEQ ID NO: 842145 - RNA, 23 nt, Human
caccugccuuggcauuccaaagu

SEQ ID NO: 842146 - RNA, 24 nt, Human
caccugccuuggcauuccaaagug

SEQ ID NO: 842147 - RNA, 19 nt, Human
cacuauguugcccaggcug

SEQ ID NO: 842148 - RNA, 24 nt, Human
cacuauguugcccaggcugaucuu

SEQ ID NO: 842149 - RNA, 27 nt, Human
cacuauguugcccaggcugaucuugaa

SEQ ID NO: 842150 - RNA, 23 nt, Human
cagguuucacuauguugcccagg

SEQ ID NO: 842151 - RNA, 20 nt, Human
ccaaagugccgggauuacag

SEQ ID NO: 842152 - RNA, 21 nt, Human
ccaaagugccgggauuacagg

SEQ ID NO: 842153 - RNA, 21 nt, Human
ccaaagugccgggauuacagg

SEQ ID NO: 842154 - RNA, 24 nt, Human
ccaaagugccgggauuacaggagu

SEQ ID NO: 842155 - RNA, 18 nt, Human
ccacaccuggccccaaau

SEQ ID NO: 842156 - RNA, 18 nt, Human
ccaccacaccuggcccca

SEQ ID NO: 842157 - RNA, 21 nt, Human
ccaccacaccuggccccaaau

SEQ ID NO: 842158 - RNA, 19 nt, Human
ccuaaagaaaacagcuuca

SEQ ID NO: 842159 - RNA, 18 nt, Human
ccuaggcucaggugaucc

SEQ ID NO: 842160 - RNA, 24 nt, Human
ccuaggcucaggugauccaccugc

SEQ ID NO: 842161 - RNA, 20 nt, Human
ccuuggcauuccaaagugcc

SEQ ID NO: 842162 - RNA, 22 nt, Human
cgggauuacaggagugagccac

SEQ ID NO: 842163 - RNA, 24 nt, Human
cgggauuacaggagugagccacca

SEQ ID NO: 842164 - RNA, 20 nt, Human
cucaggugauccaccugccu

SEQ ID NO: 842165 - RNA, 20 nt, Human
cucaggugauccaccugccu

SEQ ID NO: 842166 - RNA, 24 nt, Human
cucaggugauccaccugccuuggc

SEQ ID NO: 842167 - RNA, 21 nt, Human
cucgugccgaauucuuggccu

SEQ ID NO: 842168 - RNA, 20 nt, Human
cuugaacuccuaggcucagg

SEQ ID NO: 842169 - RNA, 18 nt, Human
gauuacaggagugagcca

SEQ ID NO: 842170 - RNA, 24 nt, Human
gcucaggugauccaccugccuugg

SEQ ID NO: 842171 - RNA, 23 nt, Human
gggauuacaggagugagccacca

SEQ ID NO: 842172 - RNA, 24 nt, Human
gugauccaccugccuuggcauucc

SEQ ID NO: 842173 - RNA, 24 nt, Human
guuucacuauguugcccaggcuga

SEQ ID NO: 842174 - RNA, 25 nt, Human
uaacaaagacuaccaguuaacuaac

SEQ ID NO: 842175 - RNA, 22 nt, Human
uacaggagugagccaccacacc

SEQ ID NO: 842176 - RNA, 23 nt, Human
uacaggagugagccaccacaccu

SEQ ID NO: 842177 - RNA, 23 nt, Human
uacaggagugagccaccacaccu

SEQ ID NO: 842178 - RNA, 20 nt, Human
uauguugcccaggcugaucu

SEQ ID NO: 842179 - RNA, 24 nt, Human
uauguugcccaggcugaucuugaa

SEQ ID NO: 842180 - RNA, 20 nt, Human
ucuugaacuccuaggcucag

SEQ ID NO: 842181 - RNA, 19 nt, Human
ugaaacacacuuagaaaag

SEQ ID NO: 842182 - RNA, 24 nt, Human
ugaucuugaacuccuaggcucagg

SEQ ID NO: 842183 - RNA, 24 nt, Human
ugcccaggcugaucuugaacuccu

SEQ ID NO: 842184 - RNA, 24 nt, Human
ugccuuggcauuccaaagugccgg

SEQ ID NO: 842185 - RNA, 25 nt, Human
uuaaaaccuugaaucaccuuaacaa

SEQ ID NO: 842186 - RNA, 25 nt, Human
uuacagguucccucgugccgaauuc

SEQ ID NO: 842187 - RNA, 19 nt, Human
uuucacuauguugcccagg

SEQ ID NO: 842188 - RNA, 19 nt, Human
aaaagcaggcaaagcuacu

SEQ ID NO: 842189 - RNA, 18 nt, Human
aaaauaagaaacaugaau

SEQ ID NO: 842190 - RNA, 21 nt, Human
aaacaugaauccaggggaagg

SEQ ID NO: 842191 - RNA, 19 nt, Human
aaagcuacuggggguugcc

SEQ ID NO: 842192 - RNA, 20 nt, Human
aacaaaggaguacuaagaaa

SEQ ID NO: 842193 - RNA, 19 nt, Human
aagugcaauucccuucucc

SEQ ID NO: 842194 - RNA, 21 nt, Human
accccugcccaugccaacaaa

SEQ ID NO: 842195 - RNA, 23 nt, Human
acuugcaaaugaaacuccccaga

SEQ ID NO: 842196 - RNA, 23 nt, Human
agaaagcaaggcaaagcugucca

SEQ ID NO: 842197 - RNA, 21 nt, Human
aggaauccuuugguccacuuc

SEQ ID NO: 842198 - RNA, 18 nt, Human
aggacagauggccagguc

SEQ ID NO: 842199 - RNA, 18 nt, Human
agucgagaaagugggcac

SEQ ID NO: 842200 - RNA, 22 nt, Human
aucucggucuggagacaacacc

SEQ ID NO: 842201 - RNA, 20 nt, Human
caacuugcaaaugaaacucc

SEQ ID NO: 842202 - RNA, 27 nt, Human
caauucccuucucccuccaaaauaaga

SEQ ID NO: 842203 - RNA, 19 nt, Human
caccagaggaaugaugacc

SEQ ID NO: 842204 - RNA, 26 nt, Human
cagcagugcaucuaaugaugccucaa

SEQ ID NO: 842205 - RNA, 24 nt, Human
ccaugccaacaaaggaguacuaag

SEQ ID NO: 842206 - RNA, 25 nt, Human
cccccucccaccaucauucuggucc

SEQ ID NO: 842207 - RNA, 18 nt, Human
cccuccaaaauaagaaaa

SEQ ID NO: 842208 - RNA, 18 nt, Human
ccucccaccaucauucug

SEQ ID NO: 842209 - RNA, 19 nt, Human
cucaaccccugcccaugcc

SEQ ID NO: 842210 - RNA, 20 nt, Human
cugacucaaccccugcccau

SEQ ID NO: 842211 - RNA, 32 nt, Human
cugauggcagugugaagugcaauucccuucuu

SEQ ID NO: 842212 - RNA, 25 nt, Human
cugcugacucaaccccugcccaugc

SEQ ID NO: 842213 - RNA, 24 nt, Human
gaaaaacccuuucccacauagucc

SEQ ID NO: 842214 - RNA, 23 nt, Human
gaaauccuggccaaagucgagaa

SEQ ID NO: 842215 - RNA, 24 nt, Human
gcaaggcaaagcuguccaggacag

SEQ ID NO: 842216 - RNA, 21 nt, Human
gugcaauucccuucucccucc

SEQ ID NO: 842217 - RNA, 18 nt, Human
guucagaguguucagcug

SEQ ID NO: 842218 - RNA, 23 nt, Human
uaaggaaaaacccuuucccacau

SEQ ID NO: 842219 - RNA, 20 nt, Human
uauaaaagcaggcaaagcua

SEQ ID NO: 842220 - RNA, 22 nt, Human
uccaaaauaagaaacaugaauc

SEQ ID NO: 842221 - RNA, 23 nt, Human
uccaggacagauggccaggucag

SEQ ID NO: 842222 - RNA, 23 nt, Human
ucuucagaucagccacuugacuc

SEQ ID NO: 842223 - RNA, 21 nt, Human
ugaauccaggggaaggggcuu

SEQ ID NO: 842224 - RNA, 22 nt, Human
ugaccugguuacggaacagcgg

SEQ ID NO: 842225 - RNA, 23 nt, Human
ugcccccucccaccaucauucug

SEQ ID NO: 842226 - RNA, 22 nt, Human
uguccaggacagauggccaggu

SEQ ID NO: 842227 - RNA, 20 nt, Human
uguguauaaggugggguaaa

SEQ ID NO: 842228 - RNA, 20 nt, Human
uucuuugaaggaaauccugg

SEQ ID NO: 842229 - RNA, 19 nt, Human
uuucccacauaguccugcc

SEQ ID NO: 842230 - RNA, 24 nt, Human
uuucuuugaaggaaauccuggcca

SEQ ID NO: 842231 - RNA, 24 nt, Human
aaaaaaaaaguuuacuuccucagu

SEQ ID NO: 842232 - RNA, 24 nt, Human
aaaaacuggagaaacuagaacaaa

SEQ ID NO: 842233 - RNA, 18 nt, Human
aaaagcuggugggaguuu

SEQ ID NO: 842234 - RNA, 24 nt, Human
aaacagauguaggaauguuccaac

SEQ ID NO: 842235 - RNA, 21 nt, Human
aaacagcagaggacuaacuua

SEQ ID NO: 842236 - RNA, 24 nt, Human
aaacuagaacaaacaaauccaacu

SEQ ID NO: 842237 - RNA, 20 nt, Human
aacauggugaaacccagucu

SEQ ID NO: 842238 - RNA, 21 nt, Human
aacauggugaaacccagucuc

SEQ ID NO: 842239 - RNA, 21 nt, Human
aagaaaaaaaaagagaaagaa

SEQ ID NO: 842240 - RNA, 22 nt, Human
aagauagcuauaauuaauuugc

SEQ ID NO: 842241 - RNA, 22 nt, Human
aagugacuccagaggaaaaguu

SEQ ID NO: 842242 - RNA, 23 nt, Human
aagugacuccagaggaaaaguuu

SEQ ID NO: 842243 - RNA, 24 nt, Human
aauaguaauuaaccauuaaccaug

SEQ ID NO: 842244 - RNA, 28 nt, Human
aauucuaaaugugccuauuuuauuuuug

SEQ ID NO: 842245 - RNA, 20 nt, Human
aauuguuugaauccaggagg

SEQ ID NO: 842246 - RNA, 24 nt, Human
aauuguuugaauccaggaggcgga

SEQ ID NO: 842247 - RNA, 24 nt, Human
acagagcgagacugugucucaaaa

SEQ ID NO: 842248 - RNA, 20 nt, Human
acauaaccaucucucucaac

SEQ ID NO: 842249 - RNA, 24 nt, Human
accaacauggugaaacccagucuc

SEQ ID NO: 842250 - RNA, 24 nt, Human
acccagucucuacuaaaaauacaa

SEQ ID NO: 842251 - RNA, 27 nt, Human
acggcacuccagcagccugggcaacag

SEQ ID NO: 842252 - RNA, 19 nt, Human
acguucccccucccccgcc

SEQ ID NO: 842253 - RNA, 20 nt, Human
acuuggaauuauuggaaaua

SEQ ID NO: 842254 - RNA, 22 nt, Human
agaaaaaaaaagagaaagaaaa

SEQ ID NO: 842255 - RNA, 26 nt, Human
agaaacuagaacaaacaaauccaacu

SEQ ID NO: 842256 - RNA, 21 nt, Human
agacagaaaguugggaauagu

SEQ ID NO: 842257 - RNA, 23 nt, Human
agagagaaaaauccauuucuuca

SEQ ID NO: 842258 - RNA, 19 nt, Human
agcagguuaauuucacuca

SEQ ID NO: 842259 - RNA, 23 nt, Human
agccgggcgugguggcaugugcc

SEQ ID NO: 842260 - RNA, 18 nt, Human
agccgggugugguggcuc

SEQ ID NO: 842261 - RNA, 24 nt, Human
agccugaccaacauggugaaaccc

SEQ ID NO: 842262 - RNA, 20 nt, Human
aggaguuugagaccagccug

SEQ ID NO: 842263 - RNA, 23 nt, Human
aggcaggagaauuguuugaaucc

SEQ ID NO: 842264 - RNA, 21 nt, Human
aggccgaggcggguggaucac

SEQ ID NO: 842265 - RNA, 21 nt, Human
aggcggagguugcagugagcc

SEQ ID NO: 842266 - RNA, 24 nt, Human
aggcggagguugcagugagccgag

SEQ ID NO: 842267 - RNA, 24 nt, Human
aggcggguggaucacgaggucagg

SEQ ID NO: 842268 - RNA, 21 nt, Human
aggcuagaaugaguaaaagua

SEQ ID NO: 842269 - RNA, 21 nt, Human
aggcugaggcaggagaauugu

SEQ ID NO: 842270 - RNA, 24 nt, Human
aggcugaggcaggagaauuguuug

SEQ ID NO: 842271 - RNA, 23 nt, Human
aggggcagagagaaaaauccauu

SEQ ID NO: 842272 - RNA, 23 nt, Human
aguacugaaaacaacaagaaaau

SEQ ID NO: 842273 - RNA, 24 nt, Human
auccaggaggcggagguugcagug

SEQ ID NO: 842274 - RNA, 23 nt, Human
auguugugccuugguauuccaug

SEQ ID NO: 842275 - RNA, 23 nt, Human
auugcgccacggcacuccagcag

SEQ ID NO: 842276 - RNA, 18 nt, Human
auuggcucugaauucuaa

SEQ ID NO: 842277 - RNA, 23 nt, Human
auuuguaacuugaaauaucuguu

SEQ ID NO: 842278 - RNA, 24 nt, Human
caaaaacuggagaaacuagaacaa

SEQ ID NO: 842279 - RNA, 24 nt, Human
caacauggugaaacccagucucua

SEQ ID NO: 842280 - RNA, 23 nt, Human
caacauuaaaggaacaguuacau

SEQ ID NO: 842281 - RNA, 19 nt, Human
caagaaaagguaagaacua

SEQ ID NO: 842282 - RNA, 20 nt, Human
caagaaaauggcuuauuuca

SEQ ID NO: 842283 - RNA, 22 nt, Human
caaguagaaaacagguuuuguu

SEQ ID NO: 842284 - RNA, 19 nt, Human
caauaaauaagcuacuuuc

SEQ ID NO: 842285 - RNA, 20 nt, Human
cacaauugcaaguguguugg

SEQ ID NO: 842286 - RNA, 24 nt, Human
cacgaggucaggaguuugagacca

SEQ ID NO: 842287 - RNA, 22 nt, Human
cacggcacuccagcagccuggg

SEQ ID NO: 842288 - RNA, 27 nt, Human
cacggcacuccagcagccugggcaaca

SEQ ID NO: 842289 - RNA, 22 nt, Human
cagcaggaacaagcauaccaga

SEQ ID NO: 842290 - RNA, 19 nt, Human
cagccgggugugguggcuc

SEQ ID NO: 842291 - RNA, 24 nt, Human
cagccgggugugguggcucgcgcc

SEQ ID NO: 842292 - RNA, 24 nt, Human
cagcuacucaggaggcugaggcag

SEQ ID NO: 842293 - RNA, 24 nt, Human
caggauuuugggaggccgaggcgg

SEQ ID NO: 842294 - RNA, 24 nt, Human
cauuaucaaauauucagcacagcc

SEQ ID NO: 842295 - RNA, 23 nt, Human
ccaaacuugagauuaacaaaaau

SEQ ID NO: 842296 - RNA, 24 nt, Human
ccacggcacuccagcagccugggc

SEQ ID NO: 842297 - RNA, 27 nt, Human
ccacggcacuccagcagccugggcaac

SEQ ID NO: 842298 - RNA, 24 nt, Human
ccacggcacuccagcagccugggg

SEQ ID NO: 842299 - RNA, 22 nt, Human
cccaagaaaaauuuaaaaauac

SEQ ID NO: 842300 - RNA, 22 nt, Human
cccccgcccugccaaagcccac

SEQ ID NO: 842301 - RNA, 22 nt, Human
cccccucccccgcccugccaaa

SEQ ID NO: 842302 - RNA, 25 nt, Human
ccccgcccugccaaagcccacuaaa

SEQ ID NO: 842303 - RNA, 22 nt, Human
cccgccgccgcugccuccgccu

SEQ ID NO: 842304 - RNA, 18 nt, Human
ccgccgccgcugccuccg

SEQ ID NO: 842305 - RNA, 19 nt, Human
ccgccgcugccuccgccuc

SEQ ID NO: 842306 - RNA, 20 nt, Human
ccgccgcugccuccgccucg

SEQ ID NO: 842307 - RNA, 28 nt, Human
ccgccgcugccuccgccucggccgccug

SEQ ID NO: 842308 - RNA, 18 nt, Human
ccgccugagcugaggggc

SEQ ID NO: 842309 - RNA, 25 nt, Human
ccuauuaucauacuuggggcuugcu

SEQ ID NO: 842310 - RNA, 19 nt, Human
ccuccgccucggccgccug

SEQ ID NO: 842311 - RNA, 22 nt, Human
ccugaccaacauggugaaaccc

SEQ ID NO: 842312 - RNA, 23 nt, Human
ccugaccaacauggugaaaccca

SEQ ID NO: 842313 - RNA, 21 nt, Human
ccuguaaucccagcuacucag

SEQ ID NO: 842314 - RNA, 24 nt, Human
cgaggcggguggaucacgagguca

SEQ ID NO: 842315 - RNA, 18 nt, Human
cgccucggccgccugagc

SEQ ID NO: 842316 - RNA, 24 nt, Human
cgccuguaaucccaggauuuuggg

SEQ ID NO: 842317 - RNA, 24 nt, Human
cgcgccuguaaucccaggauuuug

SEQ ID NO: 842318 - RNA, 20 nt, Human
cuagaacaaacaaauccaac

SEQ ID NO: 842319 - RNA, 24 nt, Human
cucacuggcagaauuuuagcuguu

SEQ ID NO: 842320 - RNA, 25 nt, Human
cucacuggcagaauuuuagcuguua

SEQ ID NO: 842321 - RNA, 24 nt, Human
cucgcgccuguaaucccaggauuu

SEQ ID NO: 842322 - RNA, 22 nt, Human
cucuaacaacaauuuuucaaaa

SEQ ID NO: 842323 - RNA, 23 nt, Human
gaacaagcauaccagacacaauu

SEQ ID NO: 842324 - RNA, 22 nt, Human
gacaaaaacuggagaaacuaga

SEQ ID NO: 842325 - RNA, 23 nt, Human
gagaauuguuugaauccaggagg

SEQ ID NO: 842326 - RNA, 23 nt, Human
gagauugcgccacggcacuccag

SEQ ID NO: 842327 - RNA, 21 nt, Human
gagguugcagugagccgagau

SEQ ID NO: 842328 - RNA, 23 nt, Human
gagguugcagugagccgagauug

SEQ ID NO: 842329 - RNA, 21 nt, Human
gaguaaaaguagcuuuaaaaa

SEQ ID NO: 842330 - RNA, 24 nt, Human
gaguaaaaguagcuuuaaaaaugu

SEQ ID NO: 842331 - RNA, 21 nt, Human
gaucacgaggucaggaguuug

SEQ ID NO: 842332 - RNA, 22 nt, Human
gaucacgaggucaggaguuuga

SEQ ID NO: 842333 - RNA, 24 nt, Human
gaucacgaggucaggaguuugaga

SEQ ID NO: 842334 - RNA, 20 nt, Human
gauuaaugaacguucccccu

SEQ ID NO: 842335 - RNA, 25 nt, Human
gcagaaguaaacagcagaggacuaa

SEQ ID NO: 842336 - RNA, 22 nt, Human
gcaugugccuguaaucccagcu

SEQ ID NO: 842337 - RNA, 23 nt, Human
gccucggccgccugagcugaggg

SEQ ID NO: 842338 - RNA, 19 nt, Human
gcgccuguaaucccaggau

SEQ ID NO: 842339 - RNA, 24 nt, Human
gcugccuccgccucggccgccuga

SEQ ID NO: 842340 - RNA, 22 nt, Human
ggaggcggagguugcagugagc

SEQ ID NO: 842341 - RNA, 22 nt, Human
ggagguugcagugagccgagau

SEQ ID NO: 842342 - RNA, 24 nt, Human
ggagguugcagugagccgagauug

SEQ ID NO: 842343 - RNA, 21 nt, Human
ggcaugugccuguaaucccag

SEQ ID NO: 842344 - RNA, 21 nt, Human
ggcucgcgccuguaaucccag

SEQ ID NO: 842345 - RNA, 24 nt, Human
gggcgugguggcaugugccuguaa

SEQ ID NO: 842346 - RNA, 23 nt, Human
ggggaaaaaaucuauguuuuacc

SEQ ID NO: 842347 - RNA, 24 nt, Human
gggugugguggcucgcgccuguaa

SEQ ID NO: 842348 - RNA, 23 nt, Human
gguggaucacgaggucaggaguu

SEQ ID NO: 842349 - RNA, 24 nt, Human
gguggcaugugccuguaaucccag

SEQ ID NO: 842350 - RNA, 23 nt, Human
guggaucacgaggucaggaguuu

SEQ ID NO: 842351 - RNA, 23 nt, Human
guggcucgcgccuguaaucccag

SEQ ID NO: 842352 - RNA, 20 nt, Human
gugucucaaaaaacaaaaac

SEQ ID NO: 842353 - RNA, 24 nt, Human
guuaacacauuuauagcuuaaaga

SEQ ID NO: 842354 - RNA, 18 nt, Human
guucccccucccccgccc

SEQ ID NO: 842355 - RNA, 19 nt, Human
guugcagugagccgagauu

SEQ ID NO: 842356 - RNA, 21 nt, Human
guugcagugagccgagauugc

SEQ ID NO: 842357 - RNA, 22 nt, Human
guuuauuacaggggaaacacua

SEQ ID NO: 842358 - RNA, 21 nt, Human
uaaaacacaguauugguaagc

SEQ ID NO: 842359 - RNA, 25 nt, Human
uaaaaguagcuuuaaaaauguuuac

SEQ ID NO: 842360 - RNA, 19 nt, Human
uaaaaguucauuuuuacag

SEQ ID NO: 842361 - RNA, 24 nt, Human
uaaacagcagaggacuaacuuaca

SEQ ID NO: 842362 - RNA, 21 nt, Human
uaaacugaaugaccagacuug

SEQ ID NO: 842363 - RNA, 23 nt, Human
uaaauggaucagcuccugcagaa

SEQ ID NO: 842364 - RNA, 19 nt, Human
uaacaaccaauuccaauuc

SEQ ID NO: 842365 - RNA, 18 nt, Human
uaacagaaauuaacaacc

SEQ ID NO: 842366 - RNA, 20 nt, Human
uaauaaaugguauauauaca

SEQ ID NO: 842367 - RNA, 20 nt, Human
uacaauauuacuuuaaaaaa

SEQ ID NO: 842368 - RNA, 20 nt, Human
uacccgaauuaccagccuga

SEQ ID NO: 842369 - RNA, 22 nt, Human
uacuuuauuagcagcaggaaca

SEQ ID NO: 842370 - RNA, 22 nt, Human
uacuuugaagggggaaaaaagu

SEQ ID NO: 842371 - RNA, 23 nt, Human
uagcaaagccaguaacagaaauu

SEQ ID NO: 842372 - RNA, 24 nt, Human
uagcagcaggaacaagcauaccag

SEQ ID NO: 842373 - RNA, 22 nt, Human
uagccgggcgugguggcaugug

SEQ ID NO: 842374 - RNA, 23 nt, Human
uagcuaaaaaacuaauaagcaag

SEQ ID NO: 842375 - RNA, 18 nt, Human
uagggaaaggagauaugg

SEQ ID NO: 842376 - RNA, 20 nt, Human
uauauacauguuaacacauu

SEQ ID NO: 842377 - RNA, 24 nt, Human
uauaugaacuuggaauuauuggaa

SEQ ID NO: 842378 - RNA, 20 nt, Human
uaugcagaaaauaugaaugg

SEQ ID NO: 842379 - RNA, 21 nt, Human
uaugcagaaaauaugaauggc

SEQ ID NO: 842380 - RNA, 24 nt, Human
ucacgaggucaggaguuugagacc

SEQ ID NO: 842381 - RNA, 20 nt, Human
ucacucaaucuaauccccca

SEQ ID NO: 842382 - RNA, 24 nt, Human
ucacucaaucuaaucccccaaaua

SEQ ID NO: 842383 - RNA, 18 nt, Human
uccaaaauaacugcaaag

SEQ ID NO: 842384 - RNA, 20 nt, Human
uccaaaauaacugcaaagga

SEQ ID NO: 842385 - RNA, 21 nt, Human
uccaauaucaauguauaagca

SEQ ID NO: 842386 - RNA, 26 nt, Human
uccagccgggugugguggcucgcgcc

SEQ ID NO: 842387 - RNA, 22 nt, Human
ucccgauacaguaaugggccuu

SEQ ID NO: 842388 - RNA, 24 nt, Human
ucccgauacaguaaugggccuuac

SEQ ID NO: 842389 - RNA, 21 nt, Human
ucuagcaaagccaguaacaga

SEQ ID NO: 842390 - RNA, 26 nt, Human
ucucaaaaaacaaaaaccaaaaaaaa

SEQ ID NO: 842391 - RNA, 21 nt, Human
ucucuacuaaaaauacaaaaa

SEQ ID NO: 842392 - RNA, 20 nt, Human
ugaaaagcaacaaauaagcu

SEQ ID NO: 842393 - RNA, 23 nt, Human
ugaagauuauuaauaaaacacag

SEQ ID NO: 842394 - RNA, 21 nt, Human
ugacaaaaacuggagaaacua

SEQ ID NO: 842395 - RNA, 23 nt, Human
ugacaaaaacuggagaaacuaga

SEQ ID NO: 842396 - RNA, 24 nt, Human
ugaccaacauggugaaacccaguc

SEQ ID NO: 842397 - RNA, 19 nt, Human
ugagaauaaauacauuucu

SEQ ID NO: 842398 - RNA, 23 nt, Human
ugagaccagccugaccaacaugg

SEQ ID NO: 842399 - RNA, 24 nt, Human
ugagaccagccugaccaacauggu

SEQ ID NO: 842400 - RNA, 22 nt, Human
ugagccgagauugcgccacggc

SEQ ID NO: 842401 - RNA, 24 nt, Human
ugaggcaggagaauuguuugaauc

SEQ ID NO: 842402 - RNA, 25 nt, Human
ugaggcaggagaauuguuugaaucc

SEQ ID NO: 842403 - RNA, 19 nt, Human
ugcaauggucauucuacaa

SEQ ID NO: 842404 - RNA, 24 nt, Human
ugcacauaugaauucuagcaaagc

SEQ ID NO: 842405 - RNA, 24 nt, Human
ugccuguaaucccagcuacucagg

SEQ ID NO: 842406 - RNA, 22 nt, Human
ugcgccacggcacuccagcagc

SEQ ID NO: 842407 - RNA, 21 nt, Human
uggaucacgaggucaggaguu

SEQ ID NO: 842408 - RNA, 24 nt, Human
uggaucacgaggucaggaguuuga

SEQ ID NO: 842409 - RNA, 21 nt, Human
uggcaugugccuguaauccca

SEQ ID NO: 842410 - RNA, 21 nt, Human
uggcucgcgccuguaauccca

SEQ ID NO: 842411 - RNA, 22 nt, Human
uggcucgcgccuguaaucccag

SEQ ID NO: 842412 - RNA, 24 nt, Human
ugggaccauauguuagacucaagu

SEQ ID NO: 842413 - RNA, 23 nt, Human
ugggaggccgaggcggguggauc

SEQ ID NO: 842414 - RNA, 24 nt, Human
ugggaggccgaggcggguggauca

SEQ ID NO: 842415 - RNA, 24 nt, Human
ugguggcaugugccuguaauccca

SEQ ID NO: 842416 - RNA, 24 nt, Human
ugguggcucgcgccuguaauccca

SEQ ID NO: 842417 - RNA, 19 nt, Human
uguagggaaaggagauaug

SEQ ID NO: 842418 - RNA, 22 nt, Human
uguagggaaaggagauauggcc

SEQ ID NO: 842419 - RNA, 22 nt, Human
ugucucaaaaaacaaaaaccaa

SEQ ID NO: 842420 - RNA, 20 nt, Human
uguuugauauguugugccuu

SEQ ID NO: 842421 - RNA, 20 nt, Human
uuaaaaccaaccaaaaucac

SEQ ID NO: 842422 - RNA, 24 nt, Human
uuaaaaccaaccaaaaucacaucc

SEQ ID NO: 842423 - RNA, 23 nt, Human
uuaccagccugauucaaauaugu

SEQ ID NO: 842424 - RNA, 19 nt, Human
uuagccgggcgugguggca

SEQ ID NO: 842425 - RNA, 20 nt, Human
uuagccgggcgugguggcau

SEQ ID NO: 842426 - RNA, 24 nt, Human
uuagccgggcgugguggcaugugc

SEQ ID NO: 842427 - RNA, 21 nt, Human
uucaaauauguugcuagcuaa

SEQ ID NO: 842428 - RNA, 22 nt, Human
uucagcaaaacagauguaggaa

SEQ ID NO: 842429 - RNA, 24 nt, Human
uucuaaaugugccuauuuuauuuu

SEQ ID NO: 842430 - RNA, 24 nt, Human
uugaauccaggaggcggagguugc

SEQ ID NO: 842431 - RNA, 24 nt, Human
uugcaagaaaagguaagaacuagg

SEQ ID NO: 842432 - RNA, 19 nt, Human
uugcagugagccgagauug

SEQ ID NO: 842433 - RNA, 22 nt, Human
uugcagugagccgagauugcgc

SEQ ID NO: 842434 - RNA, 26 nt, Human
uugcgccacggcacuccagcagccug

SEQ ID NO: 842435 - RNA, 25 nt, Human
uugggaggccgaggcggguggauca

SEQ ID NO: 842436 - RNA, 24 nt, Human
uuguuugaauccaggaggcggagg

SEQ ID NO: 842437 - RNA, 20 nt, Human
uuugaagggggaaaaaagug

SEQ ID NO: 842438 - RNA, 18 nt, Human
uuuucuuuuuuuagcagu

SEQ ID NO: 842439 - RNA, 20 nt, Human
aaaaugaacagccaccagug

SEQ ID NO: 842440 - RNA, 21 nt, Human
aaacaagcaaccauccauacc

SEQ ID NO: 842441 - RNA, 22 nt, Human
aacaagaccucuccaaauguaa

SEQ ID NO: 842442 - RNA, 21 nt, Human
aaccaaacagcaguucuggaa

SEQ ID NO: 842443 - RNA, 22 nt, Human
aagcgucaucuugcauuuaaaa

SEQ ID NO: 842444 - RNA, 19 nt, Human
aaggaauaacgaacauaua

SEQ ID NO: 842445 - RNA, 20 nt, Human
aaguagaucaacaaaaggga

SEQ ID NO: 842446 - RNA, 23 nt, Human
aauggcauuugcuaaguaucucu

SEQ ID NO: 842447 - RNA, 20 nt, Human
acaaaacauagaauaugcaa

SEQ ID NO: 842448 - RNA, 21 nt, Human
acaaaaucuaagauuuucgua

SEQ ID NO: 842449 - RNA, 22 nt, Human
acaauccaaacacuacaaaaca

SEQ ID NO: 842450 - RNA, 23 nt, Human
agaauagauucacuugguaugaa

SEQ ID NO: 842451 - RNA, 21 nt, Human
agacacaaaaucuguuccaau

SEQ ID NO: 842452 - RNA, 20 nt, Human
agaccagcuuaagcauaguu

SEQ ID NO: 842453 - RNA, 20 nt, Human
agaguugggagccagccagu

SEQ ID NO: 842454 - RNA, 25 nt, Human
agccaagacacaaaaucuguuccaa

SEQ ID NO: 842455 - RNA, 19 nt, Human
aggaagggauggcaguggc

SEQ ID NO: 842456 - RNA, 25 nt, Human
aggaagggauggcaguggccccuug

SEQ ID NO: 842457 - RNA, 19 nt, Human
aggacaucagcuaacugga

SEQ ID NO: 842458 - RNA, 24 nt, Human
aggcucagcaccaacagaucaaaa

SEQ ID NO: 842459 - RNA, 21 nt, Human
aucaaugucaaauuaaauucg

SEQ ID NO: 842460 - RNA, 19 nt, Human
augcacaaaaauauuucag

SEQ ID NO: 842461 - RNA, 18 nt, Human
caaaaagcaccuacaguc

SEQ ID NO: 842462 - RNA, 22 nt, Human
caaaagaaaaaagaacaacgca

SEQ ID NO: 842463 - RNA, 18 nt, Human
caaaaggaacucuauuuu

SEQ ID NO: 842464 - RNA, 20 nt, Human
caaaaucuaagauuuucgua

SEQ ID NO: 842465 - RNA, 22 nt, Human
caaaaugaacagccaccagugc

SEQ ID NO: 842466 - RNA, 20 nt, Human
caaagccagccaagacacaa

SEQ ID NO: 842467 - RNA, 19 nt, Human
caaaguucaugagaauaga

SEQ ID NO: 842468 - RNA, 23 nt, Human
caaauguaacacguaguuuuaca

SEQ ID NO: 842469 - RNA, 21 nt, Human
caagacacaaaaucuguucca

SEQ ID NO: 842470 - RNA, 19 nt, Human
caagcaaccauccauacca

SEQ ID NO: 842471 - RNA, 19 nt, Human
caccaaaaaggaccccgau

SEQ ID NO: 842472 - RNA, 20 nt, Human
cacguaguuuuacaacaucc

SEQ ID NO: 842473 - RNA, 25 nt, Human
cagcgcaaccuuuucuccccggucu

SEQ ID NO: 842474 - RNA, 18 nt, Human
cagcgucccagaagaaag

SEQ ID NO: 842475 - RNA, 22 nt, Human
cagcgucccagaagaaagcaau

SEQ ID NO: 842476 - RNA, 18 nt, Human
caggacucuaaacgggca

SEQ ID NO: 842477 - RNA, 22 nt, Human
caggaguuaacaauauguuccu

SEQ ID NO: 842478 - RNA, 21 nt, Human
cauaagcagacccaguguuag

SEQ ID NO: 842479 - RNA, 19 nt, Human
caucuggaaaaguuccuaa

SEQ ID NO: 842480 - RNA, 24 nt, Human
caugagaauagauucacuugguau

SEQ ID NO: 842481 - RNA, 20 nt, Human
ccaaagccagccaagacacc

SEQ ID NO: 842482 - RNA, 25 nt, Human
ccaccgaauugacuaacauucacau

SEQ ID NO: 842483 - RNA, 23 nt, Human
ccacugcaaccugcgucuccgag

SEQ ID NO: 842484 - RNA, 20 nt, Human
ccccgauggcuauugacuca

SEQ ID NO: 842485 - RNA, 19 nt, Human
ccuuauucaguuuuucagc

SEQ ID NO: 842486 - RNA, 24 nt, Human
cgaauugacuaacauucacaugaa

SEQ ID NO: 842487 - RNA, 24 nt, Human
cgagggaguucugcaaguucaugc

SEQ ID NO: 842488 - RNA, 23 nt, Human
cuaacauucacaugaaaguggca

SEQ ID NO: 842489 - RNA, 20 nt, Human
cuauguguguccugauguuu

SEQ ID NO: 842490 - RNA, 19 nt, Human
cucaaaaugaacagccacc

SEQ ID NO: 842491 - RNA, 27 nt, Human
cuccccuucucccugguuuaaccaagg

SEQ ID NO: 842492 - RNA, 21 nt, Human
cuccuuuacugcuuugaccac

SEQ ID NO: 842493 - RNA, 24 nt, Human
cuguauuauccaucugaccaaacc

SEQ ID NO: 842494 - RNA, 18 nt, Human
gaaauccgcuugcuucuc

SEQ ID NO: 842495 - RNA, 19 nt, Human
gaacaaccucucugaaauc

SEQ ID NO: 842496 - RNA, 20 nt, Human
gaccaaauacugaacuagca

SEQ ID NO: 842497 - RNA, 19 nt, Human
gaggauggagaagaaccaa

SEQ ID NO: 842498 - RNA, 21 nt, Human
gauggagccagugaucagaau

SEQ ID NO: 842499 - RNA, 21 nt, Human
gcaaaauugaggauggagaag

SEQ ID NO: 842500 - RNA, 18 nt, Human
gccacaaccaaguaaacc

SEQ ID NO: 842501 - RNA, 18 nt, Human
gcgcaaccuuuucucccc

SEQ ID NO: 842502 - RNA, 18 nt, Human
gcuugcuucuccuucuuu

SEQ ID NO: 842503 - RNA, 21 nt, Human
gugcagugaguguucuaagug

SEQ ID NO: 842504 - RNA, 20 nt, Human
uaaaaaucucaauaauugac

SEQ ID NO: 842505 - RNA, 22 nt, Human
uaaaacuaacagcaauggcaaa

SEQ ID NO: 842506 - RNA, 22 nt, Human
uaaacaagcaaccauccauacc

SEQ ID NO: 842507 - RNA, 21 nt, Human
uaacagcaauggcaaaucaca

SEQ ID NO: 842508 - RNA, 23 nt, Human
uaagaccaaaaucucucuuaaac

SEQ ID NO: 842509 - RNA, 22 nt, Human
uaagaugagucugugguacuca

SEQ ID NO: 842510 - RNA, 22 nt, Human
uaauaagaauugccucagguac

SEQ ID NO: 842511 - RNA, 22 nt, Human
uacaaaacauagaauaugcaau

SEQ ID NO: 842512 - RNA, 18 nt, Human
uauaaauuccauaaagau

SEQ ID NO: 842513 - RNA, 23 nt, Human
uauuuucaucuugucccuccaaa

SEQ ID NO: 842514 - RNA, 22 nt, Human
ucagcuuucagcuuucugguuc

SEQ ID NO: 842515 - RNA, 25 nt, Human
ucagucauaucaaaaugaagccuag

SEQ ID NO: 842516 - RNA, 22 nt, Human
ucauauaauuaaccucaaauaa

SEQ ID NO: 842517 - RNA, 24 nt, Human
uccaaaauuaacauggguucaaag

SEQ ID NO: 842518 - RNA, 19 nt, Human
uccagagaucuugagaauc

SEQ ID NO: 842519 - RNA, 19 nt, Human
uccccggucuucacccaaa

SEQ ID NO: 842520 - RNA, 21 nt, Human
uccccggucuucacccaaagc

SEQ ID NO: 842521 - RNA, 18 nt, Human
ucccuccaaaagaaaaaa

SEQ ID NO: 842522 - RNA, 19 nt, Human
ucccuccaaaagaaaaaag

SEQ ID NO: 842523 - RNA, 21 nt, Human
uccuuauuuccuugaauugac

SEQ ID NO: 842524 - RNA, 19 nt, Human
ucgaauccaccugaacaaa

SEQ ID NO: 842525 - RNA, 20 nt, Human
ucucuaaacuccuuuacugc

SEQ ID NO: 842526 - RNA, 22 nt, Human
ugaaaguggcaaaauugaggau

SEQ ID NO: 842527 - RNA, 20 nt, Human
ugaaaguuuaucaucuuugg

SEQ ID NO: 842528 - RNA, 24 nt, Human
ugaccaaaccaccaucauacgugc

SEQ ID NO: 842529 - RNA, 20 nt, Human
ugacuucugcaauacuuccu

SEQ ID NO: 842530 - RNA, 22 nt, Human
ugagacagaaugccauauagga

SEQ ID NO: 842531 - RNA, 21 nt, Human
ugaucaccauaaugagaguuu

SEQ ID NO: 842532 - RNA, 18 nt, Human
ugcauuaaucuauaaacu

SEQ ID NO: 842533 - RNA, 24 nt, Human
ugccuuuguacagcaagcuuucaa

SEQ ID NO: 842534 - RNA, 22 nt, Human
uggaauaagaaaagaaacaguu

SEQ ID NO: 842535 - RNA, 23 nt, Human
uggaauaagaaaagaaacaguug

SEQ ID NO: 842536 - RNA, 22 nt, Human
uggcaaaucacaucucuaacug

SEQ ID NO: 842537 - RNA, 18 nt, Human
ugggagccagccaguggu

SEQ ID NO: 842538 - RNA, 19 nt, Human
ugguucauguccaaaaauu

SEQ ID NO: 842539 - RNA, 23 nt, Human
ugguugguuuuccugaaauuggu

SEQ ID NO: 842540 - RNA, 23 nt, Human
uguccagauuuucuuuuuuaagu

SEQ ID NO: 842541 - RNA, 18 nt, Human
uuauaaaguucuaugguu

SEQ ID NO: 842542 - RNA, 23 nt, Human
uucauguccaaaaauugcccacc

SEQ ID NO: 842543 - RNA, 24 nt, Human
uuccaguggcuaccaagcgguccu

SEQ ID NO: 842544 - RNA, 24 nt, Human
uuucuaaaauaauucuaauuguau

SEQ ID NO: 842545 - RNA, 21 nt, Human
uuugccacaaccaaguaaacc

SEQ ID NO: 842546 - RNA, 18 nt, Human
aaaaaaagggagcccaga

SEQ ID NO: 842547 - RNA, 27 nt, Human
aaaaaaagggagcccagagagggcgac

SEQ ID NO: 842548 - RNA, 21 nt, Human
aaggaucaucuuagagcucug

SEQ ID NO: 842549 - RNA, 19 nt, Human
aaguacucuugagucaagg

SEQ ID NO: 842550 - RNA, 22 nt, Human
aaguagauaugacaaagccagg

SEQ ID NO: 842551 - RNA, 18 nt, Human
aauaccucuguacaauaa

SEQ ID NO: 842552 - RNA, 18 nt, Human
acacugcugcacuuugga

SEQ ID NO: 842553 - RNA, 19 nt, Human
acauuuguccaauuuccug

SEQ ID NO: 842554 - RNA, 21 nt, Human
accauaaucacacccucugcc

SEQ ID NO: 842555 - RNA, 22 nt, Human
acugcuagagcugaaggguuag

SEQ ID NO: 842556 - RNA, 21 nt, Human
acugcuugcuuaaaggaucau

SEQ ID NO: 842557 - RNA, 21 nt, Human
agaaaaaaagggagcccagag

SEQ ID NO: 842558 - RNA, 18 nt, Human
aggauaagggaagaagag

SEQ ID NO: 842559 - RNA, 19 nt, Human
agggcauuuggggcugagu

SEQ ID NO: 842560 - RNA, 19 nt, Human
agugaacauauauuacaaa

SEQ ID NO: 842561 - RNA, 25 nt, Human
aguggaagguauagacacaucugaa

SEQ ID NO: 842562 - RNA, 21 nt, Human
agugggugauaggauuugccu

SEQ ID NO: 842563 - RNA, 22 nt, Human
aguugauuucauuucauuugga

SEQ ID NO: 842564 - RNA, 18 nt, Human
aucaucuuagagcucugu

SEQ ID NO: 842565 - RNA, 21 nt, Human
auccucuucccuccccagucu

SEQ ID NO: 842566 - RNA, 24 nt, Human
augcacacaugcaacauucaugua

SEQ ID NO: 842567 - RNA, 20 nt, Human
auugcccaaaguauuguguu

SEQ ID NO: 842568 - RNA, 18 nt, Human
cagaacucucauacuucc

SEQ ID NO: 842569 - RNA, 19 nt, Human
cagccgggagccgggcggc

SEQ ID NO: 842570 - RNA, 21 nt, Human
cagccgggagccgggcggcgg

SEQ ID NO: 842571 - RNA, 23 nt, Human
cagggcauuuggggcugaguggg

SEQ ID NO: 842572 - RNA, 18 nt, Human
caguuugccaggcagcag

SEQ ID NO: 842573 - RNA, 27 nt, Human
caucuuagagcucuguuuuacauggaa

SEQ ID NO: 842574 - RNA, 25 nt, Human
caugcacacaugcaacauucaugua

SEQ ID NO: 842575 - RNA, 18 nt, Human
caugcuguuuacaguaac

SEQ ID NO: 842576 - RNA, 19 nt, Human
cauucauguaaguauuaca

SEQ ID NO: 842577 - RNA, 23 nt, Human
ccagggcauuuggggcugagugg

SEQ ID NO: 842578 - RNA, 18 nt, Human
cccaugcacacaugcaac

SEQ ID NO: 842579 - RNA, 18 nt, Human
cccgcggccggcccaggg

SEQ ID NO: 842580 - RNA, 19 nt, Human
ccggagcccgagccuggcc

SEQ ID NO: 842581 - RNA, 18 nt, Human
ccucuucccuccccaguc

SEQ ID NO: 842582 - RNA, 20 nt, Human
ccucuucccuccccagucuc

SEQ ID NO: 842583 - RNA, 24 nt, Human
cgacuaacuugaccagaguaacac

SEQ ID NO: 842584 - RNA, 22 nt, Human
cuaaguagauaugacaaagcca

SEQ ID NO: 842585 - RNA, 21 nt, Human
cuugcugaauaccuuugccca

SEQ ID NO: 842586 - RNA, 19 nt, Human
gaaaaccugggauugaguu

SEQ ID NO: 842587 - RNA, 20 nt, Human
gaaacuucaaacuugaguga

SEQ ID NO: 842588 - RNA, 19 nt, Human
gacaucuucaugcugcuca

SEQ ID NO: 842589 - RNA, 23 nt, Human
gacuaacuugaccagaguaacac

SEQ ID NO: 842590 - RNA, 19 nt, Human
gagccuggccagagcgccg

SEQ ID NO: 842591 - RNA, 20 nt, Human
gaggaggccaacuagccguc

SEQ ID NO: 842592 - RNA, 22 nt, Human
gaucuuucaaagucacccauaa

SEQ ID NO: 842593 - RNA, 19 nt, Human
gaugcugcuuguuugcagu

SEQ ID NO: 842594 - RNA, 19 nt, Human
gaugguaacagcaaccaaa

SEQ ID NO: 842595 - RNA, 21 nt, Human
gcagcaguuauuguacaugca

SEQ ID NO: 842596 - RNA, 18 nt, Human
ggccagagcgccaggcag

SEQ ID NO: 842597 - RNA, 22 nt, Human
gggaagaagagaaaaccuggga

SEQ ID NO: 842598 - RNA, 21 nt, Human
gggagccgggcggcgggcagc

SEQ ID NO: 842599 - RNA, 26 nt, Human
guaacacugaaaucucuugauucagu

SEQ ID NO: 842600 - RNA, 20 nt, Human
guaauccucuucccucccca

SEQ ID NO: 842601 - RNA, 23 nt, Human
guccauucuuuuuuugaucauuu

SEQ ID NO: 842602 - RNA, 21 nt, Human
gugugugugugucucugugug

SEQ ID NO: 842603 - RNA, 22 nt, Human
uaaaauagaaguugucagcauu

SEQ ID NO: 842604 - RNA, 27 nt, Human
uaacuuguaauguccuugaacuuugaa

SEQ ID NO: 842605 - RNA, 24 nt, Human
uaaguagauaugacaaagccagga

SEQ ID NO: 842606 - RNA, 18 nt, Human
uaaguaguaguuuuaaga

SEQ ID NO: 842607 - RNA, 23 nt, Human
uaauuuucuaauauuuauauuuu

SEQ ID NO: 842608 - RNA, 19 nt, Human
uacaggaguagccguuagc

SEQ ID NO: 842609 - RNA, 25 nt, Human
uacaggaguagccguuagcuuccua

SEQ ID NO: 842610 - RNA, 23 nt, Human
uaccucuguacaauaaugguuuu

SEQ ID NO: 842611 - RNA, 18 nt, Human
uagaagguggaaggacuu

SEQ ID NO: 842612 - RNA, 21 nt, Human
uagagcugucuucccacucuc

SEQ ID NO: 842613 - RNA, 21 nt, Human
uagcugauguugaugaguagc

SEQ ID NO: 842614 - RNA, 20 nt, Human
uagcuuccuagguuugcccu

SEQ ID NO: 842615 - RNA, 18 nt, Human
ucacuuagggggcagaag

SEQ ID NO: 842616 - RNA, 24 nt, Human
ucauuuggacuuaucugagccuca

SEQ ID NO: 842617 - RNA, 25 nt, Human
ucccgaccagucuaugacugcuugc

SEQ ID NO: 842618 - RNA, 26 nt, Human
ucucuguguguuuaaaccuaucacuu

SEQ ID NO: 842619 - RNA, 18 nt, Human
ucugccuuucccuucucc

SEQ ID NO: 842620 - RNA, 18 nt, Human
ucuugauucagugucuag

SEQ ID NO: 842621 - RNA, 21 nt, Human
ucuugauucagugucuagcca

SEQ ID NO: 842622 - RNA, 18 nt, Human
ugaaagagacacugcugc

SEQ ID NO: 842623 - RNA, 19 nt, Human
ugaaauacugagguaagcu

SEQ ID NO: 842624 - RNA, 21 nt, Human
ugaacagaucuuucaaaguca

SEQ ID NO: 842625 - RNA, 18 nt, Human
ugaagaacuugaaagcaa

SEQ ID NO: 842626 - RNA, 18 nt, Human
ugaauacugggaucugga

SEQ ID NO: 842627 - RNA, 22 nt, Human
ugaauagagugguacaggagua

SEQ ID NO: 842628 - RNA, 24 nt, Human
ugacaaaagcggcgaaacuucaaa

SEQ ID NO: 842629 - RNA, 21 nt, Human
ugacuuguauuacauuuccuu

SEQ ID NO: 842630 - RNA, 22 nt, Human
ugagaacacaauuccuugaaca

SEQ ID NO: 842631 - RNA, 19 nt, Human
ugauguugaugaguagcug

SEQ ID NO: 842632 - RNA, 20 nt, Human
ugcaggauaagggaagaaga

SEQ ID NO: 842633 - RNA, 18 nt, Human
ugcccagaggauaguuga

SEQ ID NO: 842634 - RNA, 20 nt, Human
ugcucccaugcacacaugca

SEQ ID NO: 842635 - RNA, 20 nt, Human
ugcugcucauccuugcuuca

SEQ ID NO: 842636 - RNA, 26 nt, Human
ugcuuaccuauauuucuuucuacaua

SEQ ID NO: 842637 - RNA, 19 nt, Human
uggagcauuagcucauugu

SEQ ID NO: 842638 - RNA, 19 nt, Human
uggccagagcgccaggcag

SEQ ID NO: 842639 - RNA, 21 nt, Human
ugugagaagguucucuuuagg

SEQ ID NO: 842640 - RNA, 19 nt, Human
ugugugugucucugugugu

SEQ ID NO: 842641 - RNA, 20 nt, Human
ugugugugugucucugugug

SEQ ID NO: 842642 - RNA, 18 nt, Human
uguuagacagaaguuucu

SEQ ID NO: 842643 - RNA, 26 nt, Human
uuaaucccgaccagucuaugacugcu

SEQ ID NO: 842644 - RNA, 24 nt, Human
uucaaagucacccauaaaaugcac

SEQ ID NO: 842645 - RNA, 24 nt, Human
uucacaaacacuugcugcccugaa

SEQ ID NO: 842646 - RNA, 25 nt, Human
uucagauaaauauauauauauauau

SEQ ID NO: 842647 - RNA, 19 nt, Human
uucagugucuagccauucc

SEQ ID NO: 842648 - RNA, 24 nt, Human
uuccuguauacuuuuagguuucau

SEQ ID NO: 842649 - RNA, 20 nt, Human
uuggcaaaauuugauaaagc

SEQ ID NO: 842650 - RNA, 27 nt, Human
uuggggcugagugggugauaggauuug

SEQ ID NO: 842651 - RNA, 28 nt, Human
uuucagaacucucauacuucucauuuga

SEQ ID NO: 842652 - RNA, 23 nt, Human
uuuuaugcauagaaaaaaaggga

SEQ ID NO: 842653 - RNA, 25 nt, Human
uuuuuacaucauguuacagcaacug

SEQ ID NO: 842654 - RNA, 21 nt, Human
uuuuuuugcuuuuucugauua

SEQ ID NO: 842655 - RNA, 20 nt, Human
aaaaaaagaagaaauuagag

SEQ ID NO: 842656 - RNA, 22 nt, Human
aaaaaaagaagaaauuagagaa

SEQ ID NO: 842657 - RNA, 19 nt, Human
aaaaagaagaaauuagaga

SEQ ID NO: 842658 - RNA, 24 nt, Human
aagaagaaauuagagaagggaggu

SEQ ID NO: 842659 - RNA, 19 nt, Human
aagggaggugggggggaca

SEQ ID NO: 842660 - RNA, 21 nt, Human
acgucuuuuuaguuugcuuca

SEQ ID NO: 842661 - RNA, 22 nt, Human
agaagggaggugggggggacag

SEQ ID NO: 842662 - RNA, 22 nt, Human
agagaagggaggugggggggac

SEQ ID NO: 842663 - RNA, 22 nt, Human
agaggaccaggcgggaaccaga

SEQ ID NO: 842664 - RNA, 22 nt, Human
agcagggcccuagggagguagg

SEQ ID NO: 842665 - RNA, 24 nt, Human
aggagcccagcucgggucccaggc

SEQ ID NO: 842666 - RNA, 21 nt, Human
aggcagaagcggggcucagag

SEQ ID NO: 842667 - RNA, 20 nt, Human
aggcccccaugucccagcag

SEQ ID NO: 842668 - RNA, 21 nt, Human
aggcgggaaccagagccaggu

SEQ ID NO: 842669 - RNA, 18 nt, Human
agggaggugggggggaca

SEQ ID NO: 842670 - RNA, 20 nt, Human
agggaggugggggggacagg

SEQ ID NO: 842671 - RNA, 23 nt, Human
agggaggugggggggacaggagg

SEQ ID NO: 842672 - RNA, 21 nt, Human
auagcaguagucaaacacuaa

SEQ ID NO: 842673 - RNA, 20 nt, Human
cacucaggcccccauguccc

SEQ ID NO: 842674 - RNA, 21 nt, Human
cacucugucaccuuagaaacu

SEQ ID NO: 842675 - RNA, 23 nt, Human
caguagucaaacacuaauaaugc

SEQ ID NO: 842676 - RNA, 27 nt, Human
ccacccugucccuucucuguccucgcg

SEQ ID NO: 842677 - RNA, 22 nt, Human
ccaucucuuuauuaagugucuc

SEQ ID NO: 842678 - RNA, 18 nt, Human
cccaugucccagcagggc

SEQ ID NO: 842679 - RNA, 18 nt, Human
ccccaugucccagcaggg

SEQ ID NO: 842680 - RNA, 21 nt, Human
ccccaugucccagcagggccc

SEQ ID NO: 842681 - RNA, 21 nt, Human
ccugucccuucucuguccucg

SEQ ID NO: 842682 - RNA, 23 nt, Human
ccuugccgguguccuugagagcc

SEQ ID NO: 842683 - RNA, 21 nt, Human
cuucuggggaccaaggcccag

SEQ ID NO: 842684 - RNA, 19 nt, Human
gauccgggcgacccuccuu

SEQ ID NO: 842685 - RNA, 27 nt, Human
gcucgggucccaggcagaggugaaggc

SEQ ID NO: 842686 - RNA, 22 nt, Human
ggaggugggggggacaggaggg

SEQ ID NO: 842687 - RNA, 18 nt, Human
ggcagaagcggggcucag

SEQ ID NO: 842688 - RNA, 18 nt, Human
gggaggugggggggacag

SEQ ID NO: 842689 - RNA, 23 nt, Human
gggaggugggggggacaggaggg

SEQ ID NO: 842690 - RNA, 24 nt, Human
gucuuuuuuuuuucuguguuuuaa

SEQ ID NO: 842691 - RNA, 24 nt, Human
uaaaaaaagaagaaauuagagaag

SEQ ID NO: 842692 - RNA, 23 nt, Human
uaaauauggcauaaaaaccuguu

SEQ ID NO: 842693 - RNA, 24 nt, Human
uaaggauauuugcuaagaucaaga

SEQ ID NO: 842694 - RNA, 20 nt, Human
uaaguacacuaguggcuuua

SEQ ID NO: 842695 - RNA, 18 nt, Human
uacacccuaccucagaac

SEQ ID NO: 842696 - RNA, 18 nt, Human
ucauuaaaaaaagaagaa

SEQ ID NO: 842697 - RNA, 25 nt, Human
uccuaaaucacaauguagaacuaag

SEQ ID NO: 842698 - RNA, 23 nt, Human
uccuuugaauucacuugauagca

SEQ ID NO: 842699 - RNA, 20 nt, Human
ucucacucugucaccuuaga

SEQ ID NO: 842700 - RNA, 21 nt, Human
ucucacucugucaccuuagaa

SEQ ID NO: 842701 - RNA, 19 nt, Human
ugagcggagaggccuuugg

SEQ ID NO: 842702 - RNA, 21 nt, Human
uggaggugggauccugaagcc

SEQ ID NO: 842703 - RNA, 22 nt, Human
uggggaccaaggcccaggagcc

SEQ ID NO: 842704 - RNA, 18 nt, Human
ugggugggcacucaggcc

SEQ ID NO: 842705 - RNA, 18 nt, Human
ugguuaggugacagcaua

SEQ ID NO: 842706 - RNA, 21 nt, Human
aaaaaagacaggccaacaaug

SEQ ID NO: 842707 - RNA, 24 nt, Human
aaaagacaggccaacaaugccuaa

SEQ ID NO: 842708 - RNA, 25 nt, Human
aacccuuucgucaacuuguuuuggg

SEQ ID NO: 842709 - RNA, 23 nt, Human
aagacaggccaacaaugccuaaa

SEQ ID NO: 842710 - RNA, 24 nt, Human
aagagaaaggggaccagggcagaa

SEQ ID NO: 842711 - RNA, 22 nt, Human
accaacaccaugaugacucaca

SEQ ID NO: 842712 - RNA, 24 nt, Human
acccagacacggccaauuccucau

SEQ ID NO: 842713 - RNA, 21 nt, Human
acggcacagaucuagcauauc

SEQ ID NO: 842714 - RNA, 20 nt, Human
agaaaaacacuucucucuca

SEQ ID NO: 842715 - RNA, 21 nt, Human
agaauccagccucccucaggc

SEQ ID NO: 842716 - RNA, 18 nt, Human
agacacggccaauuccuc

SEQ ID NO: 842717 - RNA, 23 nt, Human
agcauggaagcuuuacugagaaa

SEQ ID NO: 842718 - RNA, 20 nt, Human
agccagaaaauggauuucug

SEQ ID NO: 842719 - RNA, 19 nt, Human
aggaacccagaauccagcc

SEQ ID NO: 842720 - RNA, 21 nt, Human
agggagugggcauuacacagg

SEQ ID NO: 842721 - RNA, 21 nt, Human
agggcaaagaaguggacacuc

SEQ ID NO: 842722 - RNA, 21 nt, Human
agggcagggcaaagaagugga

SEQ ID NO: 842723 - RNA, 18 nt, Human
agugagcugggcugcauu

SEQ ID NO: 842724 - RNA, 20 nt, Human
caaaaaagacaggccaacag

SEQ ID NO: 842725 - RNA, 19 nt, Human
caacagccugugucaguuu

SEQ ID NO: 842726 - RNA, 25 nt, Human
caagaccaacaccaugaugacuccu

SEQ ID NO: 842727 - RNA, 22 nt, Human
caccaugaugacucacauaagu

SEQ ID NO: 842728 - RNA, 20 nt, Human
cagaagaugucaggccccau

SEQ ID NO: 842729 - RNA, 23 nt, Human
caucccauaacccacccagacac

SEQ ID NO: 842730 - RNA, 20 nt, Human
caugaugacucacauaagug

SEQ ID NO: 842731 - RNA, 19 nt, Human
ccaaccuagacucaaacug

SEQ ID NO: 842732 - RNA, 19 nt, Human
cccaagaauaaauauuuac

SEQ ID NO: 842733 - RNA, 18 nt, Human
cccaucucuaugaguagc

SEQ ID NO: 842734 - RNA, 23 nt, Human
cuaacuacacauaacacacaugc

SEQ ID NO: 842735 - RNA, 21 nt, Human
cuccaccaacccaagaauaaa

SEQ ID NO: 842736 - RNA, 21 nt, Human
ggaacccagaauccagccucc

SEQ ID NO: 842737 - RNA, 19 nt, Human
ggaagauguaggauggauu

SEQ ID NO: 842738 - RNA, 21 nt, Human
ggaagcacaggaaaaauaaug

SEQ ID NO: 842739 - RNA, 21 nt, Human
ggaugcccacaucccauaacc

SEQ ID NO: 842740 - RNA, 19 nt, Human
ggccaauuccucauagaca

SEQ ID NO: 842741 - RNA, 18 nt, Human
guaaaaccguaccaaguc

SEQ ID NO: 842742 - RNA, 19 nt, Human
gucccaucacuagggagcc

SEQ ID NO: 842743 - RNA, 22 nt, Human
uaacacacaugcuucaaaaaag

SEQ ID NO: 842744 - RNA, 23 nt, Human
uaacacacaugcuucaaaaaaga

SEQ ID NO: 842745 - RNA, 21 nt, Human
uaacccacccagacacggcca

SEQ ID NO: 842746 - RNA, 19 nt, Human
uaagagcugcuuccaagaa

SEQ ID NO: 842747 - RNA, 23 nt, Human
uaagcucuccuucauccccaaac

SEQ ID NO: 842748 - RNA, 21 nt, Human
uacacacacacucacacgcac

SEQ ID NO: 842749 - RNA, 23 nt, Human
uacacacacacucacacgcacau

SEQ ID NO: 842750 - RNA, 29 nt, Human
uacacacacacucacacgcacauacaugg

SEQ ID NO: 842751 - RNA, 19 nt, Human
uacuggauuuuaaaaccuu

SEQ ID NO: 842752 - RNA, 23 nt, Human
uacuggauuuuaaaaccuuagaa

SEQ ID NO: 842753 - RNA, 26 nt, Human
uauucagccagaaaauggauuucuga

SEQ ID NO: 842754 - RNA, 21 nt, Human
uauuuugcccauauuccuuca

SEQ ID NO: 842755 - RNA, 23 nt, Human
ucaacagccugugucaguuuucu

SEQ ID NO: 842756 - RNA, 19 nt, Human
uccaccaacccaagaauaa

SEQ ID NO: 842757 - RNA, 18 nt, Human
ucccauaacccacccaga

SEQ ID NO: 842758 - RNA, 18 nt, Human
ucccucaggcugagagac

SEQ ID NO: 842759 - RNA, 19 nt, Human
ucccugugacuacaggaac

SEQ ID NO: 842760 - RNA, 21 nt, Human
ucccugugacuacaggaaccc

SEQ ID NO: 842761 - RNA, 22 nt, Human
ucucuaugaguagcauaagagc

SEQ ID NO: 842762 - RNA, 23 nt, Human
ugagagagaggcagugcuuaggg

SEQ ID NO: 842763 - RNA, 20 nt, Human
ugauagaaaaacacuucucu

SEQ ID NO: 842764 - RNA, 24 nt, Human
ugauagaaaaacacuucucucuca

SEQ ID NO: 842765 - RNA, 23 nt, Human
ugcaaagcucaaaaguacauaau

SEQ ID NO: 842766 - RNA, 25 nt, Human
ugcccauauuccuucagacuuuccc

SEQ ID NO: 842767 - RNA, 21 nt, Human
uggaagcauuucucauaaugg

SEQ ID NO: 842768 - RNA, 18 nt, Human
uggcaauauccacuccac

SEQ ID NO: 842769 - RNA, 22 nt, Human
uguaaaaccguaccaaguccug

SEQ ID NO: 842770 - RNA, 23 nt, Human
ugucaagggugaagcauggaagc

SEQ ID NO: 842771 - RNA, 20 nt, Human
ugucucacaagcugagaggg

SEQ ID NO: 842772 - RNA, 18 nt, Human
uguguaaaaccguaccaa

SEQ ID NO: 842773 - RNA, 21 nt, Human
uucaaaaaagacaggccaaca

SEQ ID NO: 842774 - RNA, 18 nt, Human
uuccaacuccaaccuaga

SEQ ID NO: 842775 - RNA, 20 nt, Human
uucugauuuucuucuugaua

SEQ ID NO: 842776 - RNA, 26 nt, Human
uuucucauaauggugaauuaaccuug

SEQ ID NO: 842777 - RNA, 24 nt, Human
aaaaaaaaaaagacauacaaaaaa

SEQ ID NO: 842778 - RNA, 23 nt, Human
aaaaaaaaaagacauacaaaaaa

SEQ ID NO: 842779 - RNA, 25 nt, Human
aaaaaaaaagacauacaaaaaaagg

SEQ ID NO: 842780 - RNA, 25 nt, Human
aaaaaaaagacauacaaaaaaaggu

SEQ ID NO: 842781 - RNA, 26 nt, Human
aaaaaaaagacauacaaaaaaaggua

SEQ ID NO: 842782 - RNA, 28 nt, Human
aaaaacaaaaaugaaaugaacccaugac

SEQ ID NO: 842783 - RNA, 22 nt, Human
aaaaacacaaaaaacaaaaaug

SEQ ID NO: 842784 - RNA, 22 nt, Human
aaacaaaaaugaaaugaaccca

SEQ ID NO: 842785 - RNA, 23 nt, Human
aaacaaaaaugaaaugaacccau

SEQ ID NO: 842786 - RNA, 27 nt, Human
aaacaaaaaugaaaugaacccaugacc

SEQ ID NO: 842787 - RNA, 25 nt, Human
aacacaaaaaacaaaaaugaaauga

SEQ ID NO: 842788 - RNA, 18 nt, Human
aaggccgcggugccuucc

SEQ ID NO: 842789 - RNA, 25 nt, Human
acauacaaaaaaagguagcuacauc

SEQ ID NO: 842790 - RNA, 20 nt, Human
accaugaaccggggcagagc

SEQ ID NO: 842791 - RNA, 20 nt, Human
acuccaguacaugcaaggua

SEQ ID NO: 842792 - RNA, 21 nt, Human
acuccaguacaugcaagguaa

SEQ ID NO: 842793 - RNA, 21 nt, Human
acuguccgcgcuccucgucgc

SEQ ID NO: 842794 - RNA, 22 nt, Human
aggcagcucaggcgggcugugc

SEQ ID NO: 842795 - RNA, 21 nt, Human
agggcgggacggggaagcugg

SEQ ID NO: 842796 - RNA, 21 nt, Human
caaaaaugaaaugaacccaug

SEQ ID NO: 842797 - RNA, 18 nt, Human
cacaaaaaacaaaaauga

SEQ ID NO: 842798 - RNA, 20 nt, Human
caccgccgcugccgcggccc

SEQ ID NO: 842799 - RNA, 22 nt, Human
cagaugacauaucuuccagucc

SEQ ID NO: 842800 - RNA, 22 nt, Human
cagcuuucggccuccuagaggg

SEQ ID NO: 842801 - RNA, 24 nt, Human
caggaaccaugaaccggggcagag

SEQ ID NO: 842802 - RNA, 23 nt, Human
ccaaggccgcggugccuuccccg

SEQ ID NO: 842803 - RNA, 19 nt, Human
cccgcgacggcggccgggg

SEQ ID NO: 842804 - RNA, 21 nt, Human
ccgagggcgagagaacgcgga

SEQ ID NO: 842805 - RNA, 27 nt, Human
ccgccgcugccgcggccacugccgccg

SEQ ID NO: 842806 - RNA, 23 nt, Human
ccgcgggcagagggcacugggcu

SEQ ID NO: 842807 - RNA, 21 nt, Human
ccgggcggcgcggggugggcc

SEQ ID NO: 842808 - RNA, 21 nt, Human
ccuccaagugcgugugcaggu

SEQ ID NO: 842809 - RNA, 23 nt, Human
ccuccuagagggcuugcaggaac

SEQ ID NO: 842810 - RNA, 21 nt, Human
ccucggagcggggagggcggg

SEQ ID NO: 842811 - RNA, 23 nt, Human
ccugccuuguggaagauuccucu

SEQ ID NO: 842812 - RNA, 21 nt, Human
ccuuccugcccaauaaugaaa

SEQ ID NO: 842813 - RNA, 20 nt, Human
ccuuccuuccuuccuuucuc

SEQ ID NO: 842814 - RNA, 23 nt, Human
ccuuccuuccuuucuuugaaauc

SEQ ID NO: 842815 - RNA, 23 nt, Human
cgccacgagguuuuuuucugaga

SEQ ID NO: 842816 - RNA, 24 nt, Human
cgccgccuucuugggcauggccug

SEQ ID NO: 842817 - RNA, 22 nt, Human
cgcucgaggccaccucgggcuc

SEQ ID NO: 842818 - RNA, 18 nt, Human
cggcgggagcccgggcgg

SEQ ID NO: 842819 - RNA, 18 nt, Human
cgggagcccgggcggcgc

SEQ ID NO: 842820 - RNA, 18 nt, Human
cgggcugggguagggggu

SEQ ID NO: 842821 - RNA, 23 nt, Human
cggggaggagcgcgggaggcagc

SEQ ID NO: 842822 - RNA, 21 nt, Human
cgugugcagguugcgugcaug

SEQ ID NO: 842823 - RNA, 20 nt, Human
cucacaguagcuucccccca

SEQ ID NO: 842824 - RNA, 20 nt, Human
cuccaagugcgugugcaggu

SEQ ID NO: 842825 - RNA, 19 nt, Human
cugccgccgccccggcggc

SEQ ID NO: 842826 - RNA, 19 nt, Human
cugcggcggcgggagcccg

SEQ ID NO: 842827 - RNA, 26 nt, Human
cugcugguucgccgccgccgccgccu

SEQ ID NO: 842828 - RNA, 22 nt, Human
cuuccuuuagucugggggugga

SEQ ID NO: 842829 - RNA, 18 nt, Human
gaaccggggcagagcaaa

SEQ ID NO: 842830 - RNA, 18 nt, Human
gaccuccuuccugcccaa

SEQ ID NO: 842831 - RNA, 21 nt, Human
gacgggcugggguagggggug

SEQ ID NO: 842832 - RNA, 19 nt, Human
gagagaacgcggaaggcuc

SEQ ID NO: 842833 - RNA, 22 nt, Human
gccgcggccacugccgccgccc

SEQ ID NO: 842834 - RNA, 18 nt, Human
gccgcuggggagcccgcu

SEQ ID NO: 842835 - RNA, 21 nt, Human
gccgugaccccaccaggcggc

SEQ ID NO: 842836 - RNA, 19 nt, Human
gcucgaggccaccucgggc

SEQ ID NO: 842837 - RNA, 20 nt, Human
gcugcggcggcgggagcccg

SEQ ID NO: 842838 - RNA, 21 nt, Human
gcugguucgccgccgccgccg

SEQ ID NO: 842839 - RNA, 23 nt, Human
gcugguucgccgccgccgccgcc

SEQ ID NO: 842840 - RNA, 23 nt, Human
gcugguucgccgccgccgccgcc

SEQ ID NO: 842841 - RNA, 21 nt, Human
ggccggggcuggcucucuggg

SEQ ID NO: 842842 - RNA, 22 nt, Human
ggcggcgcggggugggcccgag

SEQ ID NO: 842843 - RNA, 18 nt, Human
ggcugggguagggggugg

SEQ ID NO: 842844 - RNA, 22 nt, Human
ggcugugcugucagccgccgcg

SEQ ID NO: 842845 - RNA, 24 nt, Human
gggcaaggggaggggcugcagcuu

SEQ ID NO: 842846 - RNA, 19 nt, Human
gggcauggccuggcgcggc

SEQ ID NO: 842847 - RNA, 24 nt, Human
gggcgagagaacgcggaaggcucu

SEQ ID NO: 842848 - RNA, 19 nt, Human
gggcggcgcggggugggcc

SEQ ID NO: 842849 - RNA, 22 nt, Human
gggcugcagcuuucggccuccu

SEQ ID NO: 842850 - RNA, 20 nt, Human
gggcugggguaggggguggg

SEQ ID NO: 842851 - RNA, 18 nt, Human
ggguauggggguggggug

SEQ ID NO: 842852 - RNA, 20 nt, Human
gugugcagguugcgugcaug

SEQ ID NO: 842853 - RNA, 19 nt, Human
guuguccuuccuuccuucc

SEQ ID NO: 842854 - RNA, 21 nt, Human
uaaaaaaaaaaagacauacaa

SEQ ID NO: 842855 - RNA, 19 nt, Human
uaaaaaaacacacgcucac

SEQ ID NO: 842856 - RNA, 18 nt, Human
uaaauggagaggggcaga

SEQ ID NO: 842857 - RNA, 19 nt, Human
uaaauuaaaaaaacacacg

SEQ ID NO: 842858 - RNA, 23 nt, Human
uaaauuaaaaaaacacacgcuca

SEQ ID NO: 842859 - RNA, 22 nt, Human
uaacacaaccagcagaugacau

SEQ ID NO: 842860 - RNA, 23 nt, Human
uaacacaaccagcagaugacaua

SEQ ID NO: 842861 - RNA, 27 nt, Human
uaacacaaccagcagaugacauaucuu

SEQ ID NO: 842862 - RNA, 20 nt, Human
uaaguaucuuccuuuagucu

SEQ ID NO: 842863 - RNA, 23 nt, Human
uaccaccgccgcugccgcggcca

SEQ ID NO: 842864 - RNA, 23 nt, Human
uagucuggggguggaagaagggg

SEQ ID NO: 842865 - RNA, 22 nt, Human
ucaccaaguauacuccuaauuc

SEQ ID NO: 842866 - RNA, 20 nt, Human
ucaggcgccgugaccccacc

SEQ ID NO: 842867 - RNA, 22 nt, Human
ucccuucugcugguucgccgcc

SEQ ID NO: 842868 - RNA, 23 nt, Human
uccuagagggcuugcaggaaccc

SEQ ID NO: 842869 - RNA, 26 nt, Human
uccuuccuuccuuccuuucuuugaaa

SEQ ID NO: 842870 - RNA, 18 nt, Human
ucgccgggcugccaggaa

SEQ ID NO: 842871 - RNA, 20 nt, Human
ugaaauaaauacuccaguac

SEQ ID NO: 842872 - RNA, 21 nt, Human
ugaaaucaaaauccuuuccuc

SEQ ID NO: 842873 - RNA, 18 nt, Human
ugaaccggggcagagcaa

SEQ ID NO: 842874 - RNA, 22 nt, Human
ugagaaacauaacauuuuaaua

SEQ ID NO: 842875 - RNA, 25 nt, Human
ugagaaacauaacauuuuaauagau

SEQ ID NO: 842876 - RNA, 21 nt, Human
ugcagcuuucggccuccuaga

SEQ ID NO: 842877 - RNA, 24 nt, Human
ugcccaauaaugaaauuuaguuga

SEQ ID NO: 842878 - RNA, 23 nt, Human
ugccgcggccacugccgccgccc

SEQ ID NO: 842879 - RNA, 20 nt, Human
ugccuuguggaagauuccuc

SEQ ID NO: 842880 - RNA, 18 nt, Human
ugcgugcauggcccugcc

SEQ ID NO: 842881 - RNA, 23 nt, Human
ugggggaaaaaaaaucacucuau

SEQ ID NO: 842882 - RNA, 21 nt, Human
uggggguggaagaagggguau

SEQ ID NO: 842883 - RNA, 20 nt, Human
uuagucuggggguggaagaa

SEQ ID NO: 842884 - RNA, 20 nt, Human
uucgccgccgccgccgccuu

SEQ ID NO: 842885 - RNA, 19 nt, Human
uugcgugcauggcccugcc

SEQ ID NO: 842886 - RNA, 23 nt, Human
uuggcccucgaggccaagaauuc

SEQ ID NO: 842887 - RNA, 18 nt, Human
uuggggaggguagggggu

SEQ ID NO: 842888 - RNA, 20 nt, Human
aaaaacaaaaacaaaugaca

SEQ ID NO: 842889 - RNA, 22 nt, Human
aaaaacaaaaacaaaugacauu

SEQ ID NO: 842890 - RNA, 21 nt, Human
aaaaaucugaacacucaagug

SEQ ID NO: 842891 - RNA, 25 nt, Human
aaaacaaacaagacaaaaaggaaga

SEQ ID NO: 842892 - RNA, 23 nt, Human
aaacaagacaaaaaggaagacaa

SEQ ID NO: 842893 - RNA, 24 nt, Human
aaacaagacaaaaaggaagacaaa

SEQ ID NO: 842894 - RNA, 24 nt, Human
aaacagaugcugugaggccaaaac

SEQ ID NO: 842895 - RNA, 20 nt, Human
aaaccugacagacaccaaga

SEQ ID NO: 842896 - RNA, 24 nt, Human
aaaguacugggauuacaggcguga

SEQ ID NO: 842897 - RNA, 20 nt, Human
aacagacacacagaaacuac

SEQ ID NO: 842898 - RNA, 24 nt, Human
aacagagugagacccugucucaaa

SEQ ID NO: 842899 - RNA, 22 nt, Human
aacuacugggugaagugggggc

SEQ ID NO: 842900 - RNA, 21 nt, Human
aagcccacagacagggcuugg

SEQ ID NO: 842901 - RNA, 23 nt, Human
aaggaaacaaaacagaaccccua

SEQ ID NO: 842902 - RNA, 19 nt, Human
aaguacugggauuacaggc

SEQ ID NO: 842903 - RNA, 20 nt, Human
aagucaaagaaauucaaaac

SEQ ID NO: 842904 - RNA, 18 nt, Human
aaugucauccggugugca

SEQ ID NO: 842905 - RNA, 20 nt, Human
acaacagaaaaagcccacag

SEQ ID NO: 842906 - RNA, 21 nt, Human
acaauuaagauccaccagggc

SEQ ID NO: 842907 - RNA, 23 nt, Human
acacugacauuuucuaaccaugu

SEQ ID NO: 842908 - RNA, 24 nt, Human
acagagugagacccugucucaaaa

SEQ ID NO: 842909 - RNA, 23 nt, Human
acaggcccgcaccaccacacucg

SEQ ID NO: 842910 - RNA, 24 nt, Human
acagggcuucaccauguuggccag

SEQ ID NO: 842911 - RNA, 19 nt, Human
acauaacagacacacagaa

SEQ ID NO: 842912 - RNA, 21 nt, Human
acaugucugugccugggcugg

SEQ ID NO: 842913 - RNA, 18 nt, Human
accauguuggccaggcug

SEQ ID NO: 842914 - RNA, 21 nt, Human
accccaucacaauuaagaucc

SEQ ID NO: 842915 - RNA, 23 nt, Human
acccugucucaaaaacaaaaaca

SEQ ID NO: 842916 - RNA, 24 nt, Human
accugaguagcugggauuacaggc

SEQ ID NO: 842917 - RNA, 19 nt, Human
acguccaccugucccccca

SEQ ID NO: 842918 - RNA, 22 nt, Human
acucccaccccaggagcugggc

SEQ ID NO: 842919 - RNA, 20 nt, Human
acucggcuaauuuuuaguag

SEQ ID NO: 842920 - RNA, 19 nt, Human
acugcacucuagugagggc

SEQ ID NO: 842921 - RNA, 24 nt, Human
acugcacucuagugagggcaacag

SEQ ID NO: 842922 - RNA, 19 nt, Human
agagcucuccacguccacc

SEQ ID NO: 842923 - RNA, 26 nt, Human
agaggcuguaucuacaccguccuggg

SEQ ID NO: 842924 - RNA, 19 nt, Human
agagggcauggccuggagg

SEQ ID NO: 842925 - RNA, 21 nt, Human
agauauaaacaaaaguguacc

SEQ ID NO: 842926 - RNA, 20 nt, Human
agaucaauugagccgguagg

SEQ ID NO: 842927 - RNA, 20 nt, Human
agcaaaaaaucugaacacuc

SEQ ID NO: 842928 - RNA, 22 nt, Human
agcugggguuggagcagguggg

SEQ ID NO: 842929 - RNA, 18 nt, Human
aggaaacaaaacagaacc

SEQ ID NO: 842930 - RNA, 18 nt, Human
aggccucugguuuucuua

SEQ ID NO: 842931 - RNA, 25 nt, Human
aggcuggagugcaguggccugaucu

SEQ ID NO: 842932 - RNA, 27 nt, Human
agggaagauucuaccucccccuacccu

SEQ ID NO: 842933 - RNA, 19 nt, Human
agggauacacuuuucacuu

SEQ ID NO: 842934 - RNA, 19 nt, Human
aggguggggggacugcagg

SEQ ID NO: 842935 - RNA, 21 nt, Human
agguagagacuucagugagcc

SEQ ID NO: 842936 - RNA, 22 nt, Human
aguagagacagggcuucaccau

SEQ ID NO: 842937 - RNA, 18 nt, Human
aguagcugggauuacagg

SEQ ID NO: 842938 - RNA, 18 nt, Human
agugcaaccuggacugcc

SEQ ID NO: 842939 - RNA, 20 nt, Human
agugcaguggccugaucuug

SEQ ID NO: 842940 - RNA, 24 nt, Human
agugcaguggccugaucuuggcuc

SEQ ID NO: 842941 - RNA, 19 nt, Human
auaaaaccugacagacacc

SEQ ID NO: 842942 - RNA, 19 nt, Human
auaaaaccugacagacacc

SEQ ID NO: 842943 - RNA, 22 nt, Human
aucccgucauccaggcuggagu

SEQ ID NO: 842944 - RNA, 19 nt, Human
caaaaaaucugaacacuca

SEQ ID NO: 842945 - RNA, 21 nt, Human
caaaaaaucugaacacucaag

SEQ ID NO: 842946 - RNA, 22 nt, Human
caaacaagacaaaaaggaagac

SEQ ID NO: 842947 - RNA, 24 nt, Human
caaacauacaucaccauaaguaca

SEQ ID NO: 842948 - RNA, 22 nt, Human
caaagagcucuccacguccacc

SEQ ID NO: 842949 - RNA, 24 nt, Human
caaaguacugggauuacaggcgug

SEQ ID NO: 842950 - RNA, 22 nt, Human
caaauucauuaaaaacaggaca

SEQ ID NO: 842951 - RNA, 22 nt, Human
caacagagugagacccugucuc

SEQ ID NO: 842952 - RNA, 24 nt, Human
caacaguagcacaucauguuacuc

SEQ ID NO: 842953 - RNA, 25 nt, Human
caaccuggacugccuuucacaccca

SEQ ID NO: 842954 - RNA, 19 nt, Human
caacugauccacccaccuc

SEQ ID NO: 842955 - RNA, 22 nt, Human
caagccauucuccugccucagc

SEQ ID NO: 842956 - RNA, 18 nt, Human
caaguguaaaugggaaaa

SEQ ID NO: 842957 - RNA, 21 nt, Human
cacauaaaaccugacagacac

SEQ ID NO: 842958 - RNA, 21 nt, Human
caccauguuggccaggcuggu

SEQ ID NO: 842959 - RNA, 24 nt, Human
caccauguuggccaggcuggucuc

SEQ ID NO: 842960 - RNA, 27 nt, Human
caccauguuggccaggcuggucucaaa

SEQ ID NO: 842961 - RNA, 24 nt, Human
cacccaaucacagcaggugcuugg

SEQ ID NO: 842962 - RNA, 22 nt, Human
cacccaccucggccucccaaag

SEQ ID NO: 842963 - RNA, 23 nt, Human
cacccaccucggccucccaaagu

SEQ ID NO: 842964 - RNA, 20 nt, Human
caccccaucacaauuaagau

SEQ ID NO: 842965 - RNA, 25 nt, Human
cacccuggagagggcauggccugga

SEQ ID NO: 842966 - RNA, 24 nt, Human
caccucggccucccaaaguacugg

SEQ ID NO: 842967 - RNA, 21 nt, Human
cacugcaaccuccgccucccg

SEQ ID NO: 842968 - RNA, 23 nt, Human
cacugcaaccuccgccucccggg

SEQ ID NO: 842969 - RNA, 22 nt, Human
cacugggacaagcuaccaccgg

SEQ ID NO: 842970 - RNA, 20 nt, Human
cagccacggcaugauucagg

SEQ ID NO: 842971 - RNA, 20 nt, Human
cagcuuauguuggcuccccu

SEQ ID NO: 842972 - RNA, 22 nt, Human
cagggaagauucuaccuccccc

SEQ ID NO: 842973 - RNA, 24 nt, Human
cagggcuucaccauguuggccagg

SEQ ID NO: 842974 - RNA, 25 nt, Human
caguaaccccaucaaacugcccuga

SEQ ID NO: 842975 - RNA, 22 nt, Human
caucccgucauccaggcuggag

SEQ ID NO: 842976 - RNA, 20 nt, Human
caugaacggcaaaaucagac

SEQ ID NO: 842977 - RNA, 21 nt, Human
cauguaaugugcuacuuuuaa

SEQ ID NO: 842978 - RNA, 24 nt, Human
cauguuggccaggcuggucucaaa

SEQ ID NO: 842979 - RNA, 22 nt, Human
ccaaaacaaacauacaucacca

SEQ ID NO: 842980 - RNA, 20 nt, Human
ccaaaguacugggauuacag

SEQ ID NO: 842981 - RNA, 22 nt, Human
ccaaaguacugggauuacaggc

SEQ ID NO: 842982 - RNA, 24 nt, Human
ccaaaguacugggauuacaggcgu

SEQ ID NO: 842983 - RNA, 19 nt, Human
ccacaugucugugccuggg

SEQ ID NO: 842984 - RNA, 18 nt, Human
ccacuguacccagcccaa

SEQ ID NO: 842985 - RNA, 19 nt, Human
ccacuguacccagcccaac

SEQ ID NO: 842986 - RNA, 22 nt, Human
ccagguucaagaugcaggagga

SEQ ID NO: 842987 - RNA, 22 nt, Human
cccaucacaauuaagauccacc

SEQ ID NO: 842988 - RNA, 19 nt, Human
cccccuacccugccccuuu

SEQ ID NO: 842989 - RNA, 23 nt, Human
cccggguucaagccauucuccug

SEQ ID NO: 842990 - RNA, 18 nt, Human
cccgucauccaggcugga

SEQ ID NO: 842991 - RNA, 24 nt, Human
cccgucauccaggcuggagugcag

SEQ ID NO: 842992 - RNA, 24 nt, Human
cccugaguacaacagaaaaagccc

SEQ ID NO: 842993 - RNA, 19 nt, Human
ccgcaccaccacacucggc

SEQ ID NO: 842994 - RNA, 19 nt, Human
ccgcgcagcgcccuagacg

SEQ ID NO: 842995 - RNA, 22 nt, Human
ccuaccaaacuccaugugcuac

SEQ ID NO: 842996 - RNA, 21 nt, Human
ccuacccugccccuuucauac

SEQ ID NO: 842997 - RNA, 18 nt, Human
ccucccagcucacggcuc

SEQ ID NO: 842998 - RNA, 19 nt, Human
ccucucccucugccacuuc

SEQ ID NO: 842999 - RNA, 22 nt, Human
ccucugccacuucuagccacag

SEQ ID NO: 843000 - RNA, 24 nt, Human
ccugaccucaacugauccacccac

SEQ ID NO: 843001 - RNA, 23 nt, Human
ccugagaccacucccaccccagg

SEQ ID NO: 843002 - RNA, 23 nt, Human
ccugaguagcugggauuacaggc

SEQ ID NO: 843003 - RNA, 24 nt, Human
ccugcacugggccccagccucccc

SEQ ID NO: 843004 - RNA, 18 nt, Human
ccugccccuuucauacuu

SEQ ID NO: 843005 - RNA, 20 nt, Human
ccugucucaaaaacaaaaac

SEQ ID NO: 843006 - RNA, 19 nt, Human
cgcagcgcccuagacgcgc

SEQ ID NO: 843007 - RNA, 19 nt, Human
cgccucccggguucaagcc

SEQ ID NO: 843008 - RNA, 23 nt, Human
cgucugucacacucugcaaagga

SEQ ID NO: 843009 - RNA, 25 nt, Human
cuaccaaacuccaugugcuacgcuc

SEQ ID NO: 843010 - RNA, 18 nt, Human
cuacugcacucuagugag

SEQ ID NO: 843011 - RNA, 24 nt, Human
cuacugcacucuagugagggcaac

SEQ ID NO: 843012 - RNA, 18 nt, Human
cucaaaaacaaaaacaaa

SEQ ID NO: 843013 - RNA, 18 nt, Human
cucacggcucacaccugc

SEQ ID NO: 843014 - RNA, 24 nt, Human
cucacugcaaccuccgccucccgg

SEQ ID NO: 843015 - RNA, 23 nt, Human
cucagccaccugaguagcuggga

SEQ ID NO: 843016 - RNA, 19 nt, Human
cucaucccgucauccaggc

SEQ ID NO: 843017 - RNA, 22 nt, Human
cuccagguucaagaugcaggag

SEQ ID NO: 843018 - RNA, 23 nt, Human
cucccccuacccugccccuuuca

SEQ ID NO: 843019 - RNA, 18 nt, Human
cucuccccacugucagac

SEQ ID NO: 843020 - RNA, 21 nt, Human
cugaacacucaaguguccauc

SEQ ID NO: 843021 - RNA, 24 nt, Human
cugauccacccaccucggccuccc

SEQ ID NO: 843022 - RNA, 23 nt, Human
cugcaaccuccgccucccggguu

SEQ ID NO: 843023 - RNA, 24 nt, Human
cugcaaccuccgccucccggguuc

SEQ ID NO: 843024 - RNA, 23 nt, Human
cugccucagccaccugaguagcu

SEQ ID NO: 843025 - RNA, 22 nt, Human
cugcugggguccucuucugauc

SEQ ID NO: 843026 - RNA, 21 nt, Human
cugggccccagccuccccgcu

SEQ ID NO: 843027 - RNA, 24 nt, Human
cugggccccagccuccccgcuggc

SEQ ID NO: 843028 - RNA, 23 nt, Human
cugggccugcacugggccccagc

SEQ ID NO: 843029 - RNA, 19 nt, Human
cuguuuccucugccugccu

SEQ ID NO: 843030 - RNA, 21 nt, Human
cuucaccauguuggccaggcu

SEQ ID NO: 843031 - RNA, 24 nt, Human
cuugguucagccacggcaugauuc

SEQ ID NO: 843032 - RNA, 19 nt, Human
cuuucauacuucuaacagc

SEQ ID NO: 843033 - RNA, 19 nt, Human
gaaaauguccacugcagca

SEQ ID NO: 843034 - RNA, 23 nt, Human
gaaacagaugcugugaggccaaa

SEQ ID NO: 843035 - RNA, 24 nt, Human
gaaacagaugcugugaggccaaaa

SEQ ID NO: 843036 - RNA, 21 nt, Human
gaccucaacugauccacccac

SEQ ID NO: 843037 - RNA, 24 nt, Human
gaccucaacugauccacccaccuc

SEQ ID NO: 843038 - RNA, 19 nt, Human
gagaaggccucugguuuuc

SEQ ID NO: 843039 - RNA, 19 nt, Human
gagaccacucccaccccag

SEQ ID NO: 843040 - RNA, 23 nt, Human
gagcugggcaaagagcucuccac

SEQ ID NO: 843041 - RNA, 24 nt, Human
gaguagcugggauuacaggcccgc

SEQ ID NO: 843042 - RNA, 18 nt, Human
gauuacaggcgugagcca

SEQ ID NO: 843043 - RNA, 21 nt, Human
gauuacaggcgugagccacug

SEQ ID NO: 843044 - RNA, 24 nt, Human
gauuacaggcgugagccacuguac

SEQ ID NO: 843045 - RNA, 18 nt, Human
gcagaggcuguaucuaca

SEQ ID NO: 843046 - RNA, 19 nt, Human
gcuggagugcaguggccug

SEQ ID NO: 843047 - RNA, 23 nt, Human
gcuggucucaaacuccugaccuc

SEQ ID NO: 843048 - RNA, 25 nt, Human
ggaacauauaaccccucgacaccag

SEQ ID NO: 843049 - RNA, 18 nt, Human
ggaagacucaugcagcug

SEQ ID NO: 843050 - RNA, 22 nt, Human
ggaggcuguggugggaagauca

SEQ ID NO: 843051 - RNA, 23 nt, Human
ggcagggagggggaugugggggc

SEQ ID NO: 843052 - RNA, 19 nt, Human
ggcauggccuggagggugg

SEQ ID NO: 843053 - RNA, 19 nt, Human
ggccccagccuccccgcug

SEQ ID NO: 843054 - RNA, 24 nt, Human
ggcuggucucaaacuccugaccuc

SEQ ID NO: 843055 - RNA, 20 nt, Human
gggcaacagagugagacccu

SEQ ID NO: 843056 - RNA, 21 nt, Human
gggcagggagggggauguggg

SEQ ID NO: 843057 - RNA, 22 nt, Human
gggcagggagggggaugugggg

SEQ ID NO: 843058 - RNA, 18 nt, Human
gggccccagccuccccgc

SEQ ID NO: 843059 - RNA, 22 nt, Human
gggcuucaccauguuggccagg

SEQ ID NO: 843060 - RNA, 20 nt, Human
gguaaaugugaugcccaagg

SEQ ID NO: 843061 - RNA, 18 nt, Human
guagcugggauuacaggc

SEQ ID NO: 843062 - RNA, 22 nt, Human
gugaaacacuguacgcagccuc

SEQ ID NO: 843063 - RNA, 22 nt, Human
gugagccacuguacccagccca

SEQ ID NO: 843064 - RNA, 19 nt, Human
gugcaaccuggacugccuu

SEQ ID NO: 843065 - RNA, 20 nt, Human
gugcaaccuggacugccuuu

SEQ ID NO: 843066 - RNA, 23 nt, Human
guguccaucagcagggacuaugc

SEQ ID NO: 843067 - RNA, 18 nt, Human
guucaaaccucaccauca

SEQ ID NO: 843068 - RNA, 21 nt, Human
uaaaaccugacagacaccaag

SEQ ID NO: 843069 - RNA, 20 nt, Human
uaaaccacuugggagggcaa

SEQ ID NO: 843070 - RNA, 20 nt, Human
uaaauaaggaaacaaaacag

SEQ ID NO: 843071 - RNA, 25 nt, Human
uaacagcagcuuccacugggacaag

SEQ ID NO: 843072 - RNA, 19 nt, Human
uaacaugaacggcaaaauc

SEQ ID NO: 843073 - RNA, 22 nt, Human
uaaguacauuuacauaaguaaa

SEQ ID NO: 843074 - RNA, 24 nt, Human
uacaacagaaaaagcccacagacc

SEQ ID NO: 843075 - RNA, 19 nt, Human
uacaggcgugagccacugu

SEQ ID NO: 843076 - RNA, 24 nt, Human
uacaggcgugagccacuguaccca

SEQ ID NO: 843077 - RNA, 22 nt, Human
uaccucccccuacccugcccug

SEQ ID NO: 843078 - RNA, 21 nt, Human
uacugcacucuagugagggca

SEQ ID NO: 843079 - RNA, 23 nt, Human
uacugcacucuagugagggcaac

SEQ ID NO: 843080 - RNA, 24 nt, Human
uacugcacucuagugagggcaaca

SEQ ID NO: 843081 - RNA, 24 nt, Human
uacugcuaggaauuuaccuuucag

SEQ ID NO: 843082 - RNA, 24 nt, Human
uacugggauuacaggcgugagcca

SEQ ID NO: 843083 - RNA, 21 nt, Human
uagaagacacuagaaugucau

SEQ ID NO: 843084 - RNA, 22 nt, Human
uagaagacacuagaaugucauc

SEQ ID NO: 843085 - RNA, 21 nt, Human
uagaaugucauccggugugca

SEQ ID NO: 843086 - RNA, 22 nt, Human
uagagacagggcuucaccaugu

SEQ ID NO: 843087 - RNA, 24 nt, Human
uaguagagacagggcuucaccaug

SEQ ID NO: 843088 - RNA, 19 nt, Human
uauacugggccauuauggc

SEQ ID NO: 843089 - RNA, 22 nt, Human
uauuaagcaguaauucuuugac

SEQ ID NO: 843090 - RNA, 24 nt, Human
uauugagucgucugucacacucug

SEQ ID NO: 843091 - RNA, 22 nt, Human
ucacaaagcauauuuuaccuuu

SEQ ID NO: 843092 - RNA, 21 nt, Human
ucacacaggccucacccugga

SEQ ID NO: 843093 - RNA, 20 nt, Human
ucacacccaccccaucacaa

SEQ ID NO: 843094 - RNA, 23 nt, Human
ucacugcaaccuccgccucccgg

SEQ ID NO: 843095 - RNA, 24 nt, Human
ucacugcaaccuccgccucccggg

SEQ ID NO: 843096 - RNA, 25 nt, Human
ucacugcaaccuccgccucccgggu

SEQ ID NO: 843097 - RNA, 26 nt, Human
ucacugcaaccuccgccucccggguu

SEQ ID NO: 843098 - RNA, 23 nt, Human
ucagauauaaacaaaaguguacc

SEQ ID NO: 843099 - RNA, 24 nt, Human
ucauccaggcuggagugcaguggc

SEQ ID NO: 843100 - RNA, 22 nt, Human
ucaucccgucauccaggcugga

SEQ ID NO: 843101 - RNA, 21 nt, Human
ucaugcagcugggguuggagc

SEQ ID NO: 843102 - RNA, 18 nt, Human
ucccaaagaauuuuaguu

SEQ ID NO: 843103 - RNA, 24 nt, Human
ucccaaaguacugggauuacaggc

SEQ ID NO: 843104 - RNA, 21 nt, Human
ucccggguucaagccauucuc

SEQ ID NO: 843105 - RNA, 24 nt, Human
ucccggguucaagccauucuccug

SEQ ID NO: 843106 - RNA, 22 nt, Human
uccuggguaucccucucucuac

SEQ ID NO: 843107 - RNA, 23 nt, Human
ucggcuaauuuuuaguagagaca

SEQ ID NO: 843108 - RNA, 19 nt, Human
ucguuuuuuugagacagag

SEQ ID NO: 843109 - RNA, 19 nt, Human
ucuacugcuaggaauuuac

SEQ ID NO: 843110 - RNA, 24 nt, Human
ucucaucccgucauccaggcugga

SEQ ID NO: 843111 - RNA, 19 nt, Human
ucugaucagagcaggccac

SEQ ID NO: 843112 - RNA, 20 nt, Human
ugaaaaugauguauauggca

SEQ ID NO: 843113 - RNA, 23 nt, Human
ugaaagcuuugcuaccuuuugcu

SEQ ID NO: 843114 - RNA, 18 nt, Human
ugaagcaccucccagcuc

SEQ ID NO: 843115 - RNA, 21 nt, Human
ugaaggcuggggcuggaaaug

SEQ ID NO: 843116 - RNA, 22 nt, Human
ugaccucaacugauccacccac

SEQ ID NO: 843117 - RNA, 20 nt, Human
ugagaaugcagagggugugg

SEQ ID NO: 843118 - RNA, 22 nt, Human
ugcaguggccugaucuuggcuc

SEQ ID NO: 843119 - RNA, 19 nt, Human
ugcccugaguacaacagaa

SEQ ID NO: 843120 - RNA, 21 nt, Human
ugccucagccaccugaguagc

SEQ ID NO: 843121 - RNA, 24 nt, Human
ugccucagccaccugaguagcugg

SEQ ID NO: 843122 - RNA, 28 nt, Human
ugccugagaccacucccaccccaggagc

SEQ ID NO: 843123 - RNA, 18 nt, Human
ugccugggcugggaagac

SEQ ID NO: 843124 - RNA, 19 nt, Human
ugccugggcugggaagacu

SEQ ID NO: 843125 - RNA, 20 nt, Human
ugccugggcugggaagacuc

SEQ ID NO: 843126 - RNA, 19 nt, Human
uggagcaggugggccuccu

SEQ ID NO: 843127 - RNA, 19 nt, Human
uggaggguggggggacugc

SEQ ID NO: 843128 - RNA, 19 nt, Human
uggagugcaguggccugau

SEQ ID NO: 843129 - RNA, 23 nt, Human
uggagugcaguggccugaucuug

SEQ ID NO: 843130 - RNA, 24 nt, Human
uggagugcaguggccugaucuugg

SEQ ID NO: 843131 - RNA, 22 nt, Human
uggcaaggguaagcugacuaaa

SEQ ID NO: 843132 - RNA, 24 nt, Human
uggccaggcuggucucaaacuccu

SEQ ID NO: 843133 - RNA, 18 nt, Human
uggccuggaggguggggg

SEQ ID NO: 843134 - RNA, 19 nt, Human
uggccuggagggugggggg

SEQ ID NO: 843135 - RNA, 20 nt, Human
ugggaagaucaauugagccg

SEQ ID NO: 843136 - RNA, 20 nt, Human
ugggaggcuguggugggaag

SEQ ID NO: 843137 - RNA, 21 nt, Human
ugggauuacaggcccgcacca

SEQ ID NO: 843138 - RNA, 24 nt, Human
ugggauuacaggcccgcaccacca

SEQ ID NO: 843139 - RNA, 21 nt, Human
ugggauuacaggcgugagcca

SEQ ID NO: 843140 - RNA, 22 nt, Human
ugggauuacaggcgugagccac

SEQ ID NO: 843141 - RNA, 22 nt, Human
ugggauuacaggcgugagccac

SEQ ID NO: 843142 - RNA, 22 nt, Human
ugggauuacaggcgugagccac

SEQ ID NO: 843143 - RNA, 24 nt, Human
ugggauuacaggcgugagccacug

SEQ ID NO: 843144 - RNA, 26 nt, Human
ugggauuacaggcgugagccacugua

SEQ ID NO: 843145 - RNA, 19 nt, Human
ugggcagggagggggaugu

SEQ ID NO: 843146 - RNA, 23 nt, Human
uguaaaugggaaaaagcaacaca

SEQ ID NO: 843147 - RNA, 22 nt, Human
uuagaaaacaucugucuucuua

SEQ ID NO: 843148 - RNA, 24 nt, Human
uuaguagagacagggcuucaccau

SEQ ID NO: 843149 - RNA, 18 nt, Human
uucaagccauucuccugc

SEQ ID NO: 843150 - RNA, 21 nt, Human
uucaagccauucuccugccuc

SEQ ID NO: 843151 - RNA, 18 nt, Human
uucaagucaaagaaauuc

SEQ ID NO: 843152 - RNA, 22 nt, Human
uucccaaagaauuuuaguucuu

SEQ ID NO: 843153 - RNA, 26 nt, Human
uucuccaagggcggggccuacaacag

SEQ ID NO: 843154 - RNA, 20 nt, Human
uugcuugaaggcuggggcug

SEQ ID NO: 843155 - RNA, 20 nt, Human
uuggagcaggugggccuccu

SEQ ID NO: 843156 - RNA, 20 nt, Human
uuucagggccuaguacccua

SEQ ID NO: 843157 - RNA, 22 nt, Human
uuuccauguaaggagauuuuau

SEQ ID NO: 843158 - RNA, 26 nt, Human
aaacagaaaagggaagaaaggggacc

SEQ ID NO: 843159 - RNA, 20 nt, Human
aaacagaggucugaaauagc

SEQ ID NO: 843160 - RNA, 21 nt, Human
aaacagaggucugaaauagca

SEQ ID NO: 843161 - RNA, 21 nt, Human
aaagccugauaaccuuccaaa

SEQ ID NO: 843162 - RNA, 19 nt, Human
aacaggugugcagggggag

SEQ ID NO: 843163 - RNA, 19 nt, Human
aacucuuuccccauccucc

SEQ ID NO: 843164 - RNA, 23 nt, Human
aacucuuuccccauccuccacca

SEQ ID NO: 843165 - RNA, 23 nt, Human
aacuucacacacauacucccaaa

SEQ ID NO: 843166 - RNA, 20 nt, Human
aaguaaaacagaaaagggaa

SEQ ID NO: 843167 - RNA, 26 nt, Human
aaguaaaacagaaaagggaagaaagg

SEQ ID NO: 843168 - RNA, 19 nt, Human
aaguacacucuaaugacaa

SEQ ID NO: 843169 - RNA, 22 nt, Human
aauguuuccuuuauucuucuca

SEQ ID NO: 843170 - RNA, 20 nt, Human
acaaacuccaggucacauag

SEQ ID NO: 843171 - RNA, 23 nt, Human
acaacacaaacuccaggucacaa

SEQ ID NO: 843172 - RNA, 19 nt, Human
acacauacucccaaagucu

SEQ ID NO: 843173 - RNA, 22 nt, Human
acagcuggagacacuuuagaac

SEQ ID NO: 843174 - RNA, 18 nt, Human
acucccaaagucuauacc

SEQ ID NO: 843175 - RNA, 21 nt, Human
auacucccaaagucuauacca

SEQ ID NO: 843176 - RNA, 23 nt, Human
auggggcagcugaggucauuucu

SEQ ID NO: 843177 - RNA, 20 nt, Human
auuugauaugucuucacugg

SEQ ID NO: 843178 - RNA, 22 nt, Human
caaccaggaauuaaaucacugc

SEQ ID NO: 843179 - RNA, 21 nt, Human
cacacagaguccacauuggag

SEQ ID NO: 843180 - RNA, 22 nt, Human
cacgcuucucugagcaccucca

SEQ ID NO: 843181 - RNA, 22 nt, Human
cacuccuacuuggacaacugcu

SEQ ID NO: 843182 - RNA, 22 nt, Human
cccaaccaggaauuaaaucacu

SEQ ID NO: 843183 - RNA, 24 nt, Human
ccccauccuccaccauagugcaaa

SEQ ID NO: 843184 - RNA, 21 nt, Human
cccugcaacagucagccacca

SEQ ID NO: 843185 - RNA, 19 nt, Human
ccuccuggguucacagcug

SEQ ID NO: 843186 - RNA, 21 nt, Human
ccugcaacagucagccaccac

SEQ ID NO: 843187 - RNA, 23 nt, Human
cgaaggacagcugcaucucuacu

SEQ ID NO: 843188 - RNA, 21 nt, Human
cucaaagggcaaaugagaaaa

SEQ ID NO: 843189 - RNA, 18 nt, Human
cuccuggguucacagcug

SEQ ID NO: 843190 - RNA, 18 nt, Human
cugcaaacuauggaucca

SEQ ID NO: 843191 - RNA, 19 nt, Human
gaaaacauuauuauauuuu

SEQ ID NO: 843192 - RNA, 20 nt, Human
gaaaggaacguagauauggg

SEQ ID NO: 843193 - RNA, 19 nt, Human
gaccuccuggguucacagc

SEQ ID NO: 843194 - RNA, 18 nt, Human
gagaaaacaggugugcag

SEQ ID NO: 843195 - RNA, 18 nt, Human
gcaaacuucacgcuucuc

SEQ ID NO: 843196 - RNA, 18 nt, Human
gcagugauaaaagcaacu

SEQ ID NO: 843197 - RNA, 21 nt, Human
uaaaaaaucuggugcaacaca

SEQ ID NO: 843198 - RNA, 25 nt, Human
uaaaaacuucacacacauacuccca

SEQ ID NO: 843199 - RNA, 19 nt, Human
uaaaccugucagagcagaa

SEQ ID NO: 843200 - RNA, 18 nt, Human
uaagaagguacugagaug

SEQ ID NO: 843201 - RNA, 24 nt, Human
uacaagcaaguuuaaguaaaagug

SEQ ID NO: 843202 - RNA, 22 nt, Human
uagaacucuuuccccauccucc

SEQ ID NO: 843203 - RNA, 19 nt, Human
uauaaaccugucagagcag

SEQ ID NO: 843204 - RNA, 25 nt, Human
ucaaagauucucauuuccaauguuu

SEQ ID NO: 843205 - RNA, 20 nt, Human
ucacacacauacucccaaag

SEQ ID NO: 843206 - RNA, 22 nt, Human
uccacauuggagaaagucucau

SEQ ID NO: 843207 - RNA, 22 nt, Human
ucccugcaacagucagccacca

SEQ ID NO: 843208 - RNA, 19 nt, Human
uccuacuuggacaacugcu

SEQ ID NO: 843209 - RNA, 27 nt, Human
ucuauagucaaaacaaaaccggggucc

SEQ ID NO: 843210 - RNA, 19 nt, Human
ucucuacugcaagguuaca

SEQ ID NO: 843211 - RNA, 20 nt, Human
ucucugagcaccuccaaggu

SEQ ID NO: 843212 - RNA, 21 nt, Human
ugaaaggaacguagauauggg

SEQ ID NO: 843213 - RNA, 20 nt, Human
ugaccaaacagaggucugaa

SEQ ID NO: 843214 - RNA, 21 nt, Human
ugaccuccuggguucacagcu

SEQ ID NO: 843215 - RNA, 23 nt, Human
ugaggacacacaucaaaugcugu

SEQ ID NO: 843216 - RNA, 24 nt, Human
ugauaaaaacuucacacacauacu

SEQ ID NO: 843217 - RNA, 21 nt, Human
ugcaacagucagccaccacuu

SEQ ID NO: 843218 - RNA, 21 nt, Human
ugcaagguuacaguacacaaa

SEQ ID NO: 843219 - RNA, 21 nt, Human
ugcagggggagggggcugaag

SEQ ID NO: 843220 - RNA, 20 nt, Human
ugcccaguaaucaaguacaa

SEQ ID NO: 843221 - RNA, 23 nt, Human
uguauacauauauauuuccauau

SEQ ID NO: 843222 - RNA, 24 nt, Human
uguauacauauauauuuccauaua

SEQ ID NO: 843223 - RNA, 28 nt, Human
uguauacauauauauuuccauauauaua

SEQ ID NO: 843224 - RNA, 26 nt, Human
uuaaaagccugauaaccuuccaaagu

SEQ ID NO: 843225 - RNA, 20 nt, Human
uucaaauaauaaaaguaaug

SEQ ID NO: 843226 - RNA, 20 nt, Human
uucucauucccugcaacagu

SEQ ID NO: 843227 - RNA, 21 nt, Human
uuuagaacucuuuccccaucc

SEQ ID NO: 843228 - RNA, 24 nt, Human
uuuucagacccaagacaaguucuu

SEQ ID NO: 843229 - RNA, 18 nt, Human
aaaaagcaacaccagagg

SEQ ID NO: 843230 - RNA, 22 nt, Human
aaaaagcaacaccagaggguau

SEQ ID NO: 843231 - RNA, 19 nt, Human
agacaggaaggggaaaaac

SEQ ID NO: 843232 - RNA, 23 nt, Human
agacaggaaggggaaaaagggac

SEQ ID NO: 843233 - RNA, 21 nt, Human
uaaaacagacaacauguggca

SEQ ID NO: 843234 - RNA, 23 nt, Human
uaaaacagacaacauguggcaaa

SEQ ID NO: 843235 - RNA, 24 nt, Human
uaucauguuuuccaacaaagcuca

SEQ ID NO: 843236 - RNA, 25 nt, Human
uauccaaaaaguaucucuuagguau

SEQ ID NO: 843237 - RNA, 22 nt, Human
uccaaauuccuucuuuuuuaaa

SEQ ID NO: 843238 - RNA, 23 nt, Human
uccaaauuccuucuuuuuuaaac

SEQ ID NO: 843239 - RNA, 19 nt, Human
uccuucuuuuuuaaacaug

SEQ ID NO: 843240 - RNA, 19 nt, Human
ugcccgagagagcgcgagg

SEQ ID NO: 843241 - RNA, 20 nt, Human
uggcaauauaaauauccaaa

SEQ ID NO: 843242 - RNA, 19 nt, Human
uuaaaaagcaacaccagag

SEQ ID NO: 843243 - RNA, 22 nt, Human
aaaaacacuugucauauauaac

SEQ ID NO: 843244 - RNA, 19 nt, Human
aaaaagcucggaaacacaa

SEQ ID NO: 843245 - RNA, 18 nt, Human
acagauugaggucucaaa

SEQ ID NO: 843246 - RNA, 19 nt, Human
agguucaagucugaauucu

SEQ ID NO: 843247 - RNA, 21 nt, Human
aguggcugggauuacaggcau

SEQ ID NO: 843248 - RNA, 21 nt, Human
caaauuuuuuuuuaaaaaaag

SEQ ID NO: 843249 - RNA, 22 nt, Human
cacuugucauauauaacacuuu

SEQ ID NO: 843250 - RNA, 20 nt, Human
cagccuccugaguggcuggg

SEQ ID NO: 843251 - RNA, 19 nt, Human
caugcaccaugcccggugc

SEQ ID NO: 843252 - RNA, 20 nt, Human
ccagcuugcuuccccuacaa

SEQ ID NO: 843253 - RNA, 22 nt, Human
cccgcgccggaucgcucaggaa

SEQ ID NO: 843254 - RNA, 24 nt, Human
cccugccucagccuccugaguggc

SEQ ID NO: 843255 - RNA, 21 nt, Human
ccggugcuacaaauuuuuuuu

SEQ ID NO: 843256 - RNA, 18 nt, Human
ccuacaacuuaauaagcc

SEQ ID NO: 843257 - RNA, 25 nt, Human
ccucccugccucagccuccugagug

SEQ ID NO: 843258 - RNA, 23 nt, Human
ccugaguggcugggauuacaggc

SEQ ID NO: 843259 - RNA, 24 nt, Human
ccugaguggcugggauuacaggca

SEQ ID NO: 843260 - RNA, 20 nt, Human
ccugggcucaauggauccuc

SEQ ID NO: 843261 - RNA, 24 nt, Human
cgcuauuuugcccaggcuggacuc

SEQ ID NO: 843262 - RNA, 20 nt, Human
cggcuuccgaacugcugccu

SEQ ID NO: 843263 - RNA, 21 nt, Human
cucaaagaaagaacuugagaa

SEQ ID NO: 843264 - RNA, 23 nt, Human
cuccugggcucaauggauccucc

SEQ ID NO: 843265 - RNA, 23 nt, Human
cugaguggcugggauuacaggca

SEQ ID NO: 843266 - RNA, 24 nt, Human
cugaguggcugggauuacaggcau

SEQ ID NO: 843267 - RNA, 23 nt, Human
cugccucagccuccugaguggcu

SEQ ID NO: 843268 - RNA, 22 nt, Human
cuggacuccugggcucaaugga

SEQ ID NO: 843269 - RNA, 19 nt, Human
gacuccugggcucaaugga

SEQ ID NO: 843270 - RNA, 22 nt, Human
gaguggcugggauuacaggcau

SEQ ID NO: 843271 - RNA, 24 nt, Human
gaguggcugggauuacaggcaugc

SEQ ID NO: 843272 - RNA, 22 nt, Human
gauccucccugccucagccucc

SEQ ID NO: 843273 - RNA, 19 nt, Human
gauuacaggcaugcaccau

SEQ ID NO: 843274 - RNA, 24 nt, Human
gccucagccuccugaguggcuggg

SEQ ID NO: 843275 - RNA, 21 nt, Human
gcgccggaucgcucaggaacc

SEQ ID NO: 843276 - RNA, 21 nt, Human
ggauuacaggcaugcaccaug

SEQ ID NO: 843277 - RNA, 19 nt, Human
ggguaggagccggccauga

SEQ ID NO: 843278 - RNA, 18 nt, Human
guggcugggauuacaggc

SEQ ID NO: 843279 - RNA, 20 nt, Human
guggcugggauuacaggcau

SEQ ID NO: 843280 - RNA, 19 nt, Human
uaaaaaaagcucggaaaca

SEQ ID NO: 843281 - RNA, 20 nt, Human
uacaacuuaauaagcccuuc

SEQ ID NO: 843282 - RNA, 18 nt, Human
uauuuugcccaggcugga

SEQ ID NO: 843283 - RNA, 26 nt, Human
ucaauggauccucccugccucagccu

SEQ ID NO: 843284 - RNA, 20 nt, Human
ucagccuccugaguggcugg

SEQ ID NO: 843285 - RNA, 24 nt, Human
uccugaguggcugggauuacaggc

SEQ ID NO: 843286 - RNA, 18 nt, Human
ucucaaagaaagaacuug

SEQ ID NO: 843287 - RNA, 23 nt, Human
ucucgcuauuuugcccaggcugg

SEQ ID NO: 843288 - RNA, 24 nt, Human
ucucgcuauuuugcccaggcugga

SEQ ID NO: 843289 - RNA, 23 nt, Human
ucugauucuucccagcuugcuuc

SEQ ID NO: 843290 - RNA, 22 nt, Human
ugcccaggcuggacuccugggc

SEQ ID NO: 843291 - RNA, 25 nt, Human
ugcccaggcuggacuccugggcuca

SEQ ID NO: 843292 - RNA, 24 nt, Human
ugccucagccuccugaguggcugg

SEQ ID NO: 843293 - RNA, 25 nt, Human
uggacuccugggcucaauggauccu

SEQ ID NO: 843294 - RNA, 21 nt, Human
ugggauuacaggcaugcacca

SEQ ID NO: 843295 - RNA, 21 nt, Human
ugggauuacaggcaugcacca

SEQ ID NO: 843296 - RNA, 23 nt, Human
ugggauuacaggcaugcaccaug

SEQ ID NO: 843297 - RNA, 27 nt, Human
ugggauuacaggcaugcaccaugcccg

SEQ ID NO: 843298 - RNA, 24 nt, Human
uguccagcaucaacgagaccucau

SEQ ID NO: 843299 - RNA, 23 nt, Human
uugcaggugcaccuucaggguag

SEQ ID NO: 843300 - RNA, 25 nt, Human
uuuaagguucaagucugaauucuug

SEQ ID NO: 843301 - RNA, 24 nt, Human
uuuugcccaggcuggacuccuggg

SEQ ID NO: 843302 - RNA, 23 nt, Human
aaaacagacagucgacaaauuuc

SEQ ID NO: 843303 - RNA, 21 nt, Human
aaaacgaaauacaauauccuc

SEQ ID NO: 843304 - RNA, 21 nt, Human
aaagauauuugaacccaaaau

SEQ ID NO: 843305 - RNA, 21 nt, Human
aaagauauuugaacccaaaau

SEQ ID NO: 843306 - RNA, 22 nt, Human
aacaaaauucaucaaccaaaac

SEQ ID NO: 843307 - RNA, 24 nt, Human
aagagcucacagccccaccccuca

SEQ ID NO: 843308 - RNA, 24 nt, Human
aagagcucacagccccaccccuca

SEQ ID NO: 843309 - RNA, 23 nt, Human
aagccuccaaugggguauaaucc

SEQ ID NO: 843310 - RNA, 23 nt, Human
aagccuccaaugggguauaaucc

SEQ ID NO: 843311 - RNA, 24 nt, Human
accaaaacagacagucgacaaauu

SEQ ID NO: 843312 - RNA, 21 nt, Human
acgucuccuaucuuuggcuau

SEQ ID NO: 843313 - RNA, 21 nt, Human
acgucuccuaucuuuggcuau

SEQ ID NO: 843314 - RNA, 23 nt, Human
acucaaggacauuccacacuccu

SEQ ID NO: 843315 - RNA, 24 nt, Human
acucaaggacauuccacacuccuu

SEQ ID NO: 843316 - RNA, 22 nt, Human
acugccucaucuucccgagaag

SEQ ID NO: 843317 - RNA, 24 nt, Human
acugccucaucuucccgagaaguu

SEQ ID NO: 843318 - RNA, 23 nt, Human
agaagcuaaagaucuagggagcu

SEQ ID NO: 843319 - RNA, 18 nt, Human
aggaagcagaguuuuuca

SEQ ID NO: 843320 - RNA, 18 nt, Human
aggaagcagaguuuuuca

SEQ ID NO: 843321 - RNA, 20 nt, Human
aggacauuccacacuccuug

SEQ ID NO: 843322 - RNA, 20 nt, Human
aggacauuccacacuccuug

SEQ ID NO: 843323 - RNA, 21 nt, Human
aggaugaaacucugaacaaaa

SEQ ID NO: 843324 - RNA, 22 nt, Human
aggauucuucauugcuugaagg

SEQ ID NO: 843325 - RNA, 18 nt, Human
agguaaaaaauacaauaa

SEQ ID NO: 843326 - RNA, 21 nt, Human
agguaaaaaauacaauaauaa

SEQ ID NO: 843327 - RNA, 21 nt, Human
agguaaaaaauacaauaauaa

SEQ ID NO: 843328 - RNA, 19 nt, Human
agugguaggagcaguggga

SEQ ID NO: 843329 - RNA, 24 nt, Human
aguuaguacaauucauauuuaaag

SEQ ID NO: 843330 - RNA, 24 nt, Human
aguuaguacaauucauauuuaaag

SEQ ID NO: 843331 - RNA, 19 nt, Human
auaaagauacaaagcucca

SEQ ID NO: 843332 - RNA, 24 nt, Human
auacaauaauaauuuuuaaugaaa

SEQ ID NO: 843333 - RNA, 24 nt, Human
auacaauaauaauuuuuaaugaaa

SEQ ID NO: 843334 - RNA, 23 nt, Human
aucgauguacaagggaagaccag

SEQ ID NO: 843335 - RNA, 19 nt, Human
auguacaagggaagaccag

SEQ ID NO: 843336 - RNA, 22 nt, Human
caaaaauacacauacccugaga

SEQ ID NO: 843337 - RNA, 22 nt, Human
caaaaauacacauacccugaga

SEQ ID NO: 843338 - RNA, 19 nt, Human
caaaucacuccuccaacaa

SEQ ID NO: 843339 - RNA, 22 nt, Human
caaccaaaacagacagucgaca

SEQ ID NO: 843340 - RNA, 27 nt, Human
cacccuuugagcauuucuagggcccaa

SEQ ID NO: 843341 - RNA, 23 nt, Human
cacuguuuaucauucaaaauuca

SEQ ID NO: 843342 - RNA, 23 nt, Human
cacuguuuaucauucaaaauuca

SEQ ID NO: 843343 - RNA, 25 nt, Human
caggaagcagaguuuuucagaauca

SEQ ID NO: 843344 - RNA, 25 nt, Human
caggaagcagaguuuuucagaauca

SEQ ID NO: 843345 - RNA, 18 nt, Human
cagggcuuugcuauuuag

SEQ ID NO: 843346 - RNA, 18 nt, Human
cagggcuuugcuauuuag

SEQ ID NO: 843347 - RNA, 22 nt, Human
cauaaugggagcaaagcugaaa

SEQ ID NO: 843348 - RNA, 22 nt, Human
cauaaugggagcaaagcugaaa

SEQ ID NO: 843349 - RNA, 25 nt, Human
cauuccacacuccuuggugguucca

SEQ ID NO: 843350 - RNA, 22 nt, Human
ccaaaacagacagucgacaaau

SEQ ID NO: 843351 - RNA, 21 nt, Human
ccaacaauaaugaugcccaua

SEQ ID NO: 843352 - RNA, 28 nt, Human
ccagcaauauccuaggcaaaugccuccu

SEQ ID NO: 843353 - RNA, 28 nt, Human
ccagcaauauccuaggcaaaugccuccu

SEQ ID NO: 843354 - RNA, 21 nt, Human
ccgcuccaacuaucacccggc

SEQ ID NO: 843355 - RNA, 24 nt, Human
ccggcaacagcaacucggccacag

SEQ ID NO: 843356 - RNA, 22 nt, Human
ccuaggcaaaugccuccugaag

SEQ ID NO: 843357 - RNA, 22 nt, Human
ccuaggcaaaugccuccugaag

SEQ ID NO: 843358 - RNA, 20 nt, Human
cgcuccaacuaucacccggc

SEQ ID NO: 843359 - RNA, 20 nt, Human
cucaaaauuaaaacuaagga

SEQ ID NO: 843360 - RNA, 24 nt, Human
cuccaacaauaaugaugcccauag

SEQ ID NO: 843361 - RNA, 22 nt, Human
cuccuuggcaugggugguccag

SEQ ID NO: 843362 - RNA, 22 nt, Human
cugaacaaaauucaucaaccaa

SEQ ID NO: 843363 - RNA, 23 nt, Human
cugaagaacaacagcuuuuuuaa

SEQ ID NO: 843364 - RNA, 23 nt, Human
cugaagaacaacagcuuuuuuaa

SEQ ID NO: 843365 - RNA, 20 nt, Human
cuuggugacugcaguuugca

SEQ ID NO: 843366 - RNA, 24 nt, Human
cuuuacucaaaauuaaaacuaagg

SEQ ID NO: 843367 - RNA, 24 nt, Human
cuuuacucaaaauuaaaacuaagg

SEQ ID NO: 843368 - RNA, 22 nt, Human
cuuugagcauuucuagggccca

SEQ ID NO: 843369 - RNA, 26 nt, Human
gaccagcccagggaaaaacgaaauac

SEQ ID NO: 843370 - RNA, 20 nt, Human
gagcucacagccccaccccu

SEQ ID NO: 843371 - RNA, 20 nt, Human
gagcucacagccccaccccu

SEQ ID NO: 843372 - RNA, 23 nt, Human
gagcucacagccccaccccucag

SEQ ID NO: 843373 - RNA, 23 nt, Human
gagcucacagccccaccccucag

SEQ ID NO: 843374 - RNA, 22 nt, Human
gcagaguuuuucagaaucaaaa

SEQ ID NO: 843375 - RNA, 22 nt, Human
gcagaguuuuucagaaucaaaa

SEQ ID NO: 843376 - RNA, 18 nt, Human
gcucauuuucaaguugaa

SEQ ID NO: 843377 - RNA, 20 nt, Human
ggcuuugcuauuuagguaca

SEQ ID NO: 843378 - RNA, 20 nt, Human
ggcuuugcuauuuagguaca

SEQ ID NO: 843379 - RNA, 20 nt, Human
gggaaaaacgaaauacaaua

SEQ ID NO: 843380 - RNA, 19 nt, Human
ggguauaauccagcaauau

SEQ ID NO: 843381 - RNA, 19 nt, Human
ggguauaauccagcaauau

SEQ ID NO: 843382 - RNA, 22 nt, Human
uaaaauucuccagcucauuuuc

SEQ ID NO: 843383 - RNA, 18 nt, Human
uaaagauacaaagcucca

SEQ ID NO: 843384 - RNA, 25 nt, Human
uaaauaauacacucaaggacauucc

SEQ ID NO: 843385 - RNA, 25 nt, Human
uaaauaauacacucaaggacauucc

SEQ ID NO: 843386 - RNA, 21 nt, Human
uaacaagccuuuauccuguuu

SEQ ID NO: 843387 - RNA, 20 nt, Human
uaacgggaauaaaaaguaaa

SEQ ID NO: 843388 - RNA, 22 nt, Human
uaacuccuggaugccaggaagc

SEQ ID NO: 843389 - RNA, 22 nt, Human
uaacuccuggaugccaggaagc

SEQ ID NO: 843390 - RNA, 19 nt, Human
uacacauacccugagacag

SEQ ID NO: 843391 - RNA, 19 nt, Human
uacacauacccugagacag

SEQ ID NO: 843392 - RNA, 18 nt, Human
uaucauggucaccaaagc

SEQ ID NO: 843393 - RNA, 18 nt, Human
uaucauggucaccaaagc

SEQ ID NO: 843394 - RNA, 23 nt, Human
uauucccaugaaagaaagcauca

SEQ ID NO: 843395 - RNA, 23 nt, Human
ucaaaaacaaauuaagagcucac

SEQ ID NO: 843396 - RNA, 26 nt, Human
ucacccggcaacagcaacucggccac

SEQ ID NO: 843397 - RNA, 19 nt, Human
uccaaaucacuccuccaac

SEQ ID NO: 843398 - RNA, 18 nt, Human
uccagcaauauccuaggc

SEQ ID NO: 843399 - RNA, 18 nt, Human
uccagcaauauccuaggc

SEQ ID NO: 843400 - RNA, 18 nt, Human
uccuggaugccaggaagc

SEQ ID NO: 843401 - RNA, 18 nt, Human
uccuggaugccaggaagc

SEQ ID NO: 843402 - RNA, 19 nt, Human
uccuuggugguuccagcaa

SEQ ID NO: 843403 - RNA, 19 nt, Human
uccuuggugguuccagcaa

SEQ ID NO: 843404 - RNA, 20 nt, Human
ucggccacagaugccaaacu

SEQ ID NO: 843405 - RNA, 20 nt, Human
ucuccgcuccaacuaucacc

SEQ ID NO: 843406 - RNA, 19 nt, Human
ucuuucauaaagauacaaa

SEQ ID NO: 843407 - RNA, 22 nt, Human
ugaacaaaauucaucaaccaaa

SEQ ID NO: 843408 - RNA, 21 nt, Human
ugacugcaguuugcacucgug

SEQ ID NO: 843409 - RNA, 21 nt, Human
ugagaaagaagaugaaaggcu

SEQ ID NO: 843410 - RNA, 21 nt, Human
ugagaaagaagaugaaaggcu

SEQ ID NO: 843411 - RNA, 21 nt, Human
ugagacagaucauuaccagaa

SEQ ID NO: 843412 - RNA, 21 nt, Human
ugagacagaucauuaccagaa

SEQ ID NO: 843413 - RNA, 21 nt, Human
ugcauaguuuacaaacugcug

SEQ ID NO: 843414 - RNA, 18 nt, Human
ugccucaucuucccgaga

SEQ ID NO: 843415 - RNA, 19 nt, Human
uggaugccaggaagcagag

SEQ ID NO: 843416 - RNA, 19 nt, Human
uggaugccaggaagcagag

SEQ ID NO: 843417 - RNA, 20 nt, Human
ugggagcaaagcugaaaaug

SEQ ID NO: 843418 - RNA, 20 nt, Human
ugggagcaaagcugaaaaug

SEQ ID NO: 843419 - RNA, 19 nt, Human
ugggguauaauccagcaau

SEQ ID NO: 843420 - RNA, 22 nt, Human
ugggguauaauccagcaauauc

SEQ ID NO: 843421 - RNA, 22 nt, Human
uguuucuuuagaaacaucuaag

SEQ ID NO: 843422 - RNA, 22 nt, Human
uguuucuuuagaaacaucuaag

SEQ ID NO: 843423 - RNA, 18 nt, Human
uucagaaucaaaaacaaa

SEQ ID NO: 843424 - RNA, 18 nt, Human
uucagaaucaaaaacaaa

SEQ ID NO: 843425 - RNA, 21 nt, Human
uucaguugcauaguuuacaaa

SEQ ID NO: 843426 - RNA, 21 nt, Human
uucuuuggguaaucuagcaau

SEQ ID NO: 843427 - RNA, 21 nt, Human
uuugagcauuucuagggccca

SEQ ID NO: 843428 - RNA, 19 nt, Human
aaacaggccugcacaaguc

SEQ ID NO: 843429 - RNA, 19 nt, Human
aacagggaugcaaucaagc

SEQ ID NO: 843430 - RNA, 22 nt, Human
aacagggaugcaaucaagccua

SEQ ID NO: 843431 - RNA, 20 nt, Human
aacaucagcauaaagacaag

SEQ ID NO: 843432 - RNA, 18 nt, Human
aacauccacccacagcau

SEQ ID NO: 843433 - RNA, 24 nt, Human
aaccaguaacaaucccaaaacuca

SEQ ID NO: 843434 - RNA, 23 nt, Human
aagcaaucaaaugaaccagagaa

SEQ ID NO: 843435 - RNA, 19 nt, Human
acccccagcacagggcccg

SEQ ID NO: 843436 - RNA, 20 nt, Human
acccugagcccagccggcuc

SEQ ID NO: 843437 - RNA, 18 nt, Human
accucagccagccaccaa

SEQ ID NO: 843438 - RNA, 20 nt, Human
acguauugaagaagcucaaa

SEQ ID NO: 843439 - RNA, 18 nt, Human
acuaaagcaaaggacaca

SEQ ID NO: 843440 - RNA, 18 nt, Human
agaaagggucucucccuc

SEQ ID NO: 843441 - RNA, 19 nt, Human
agcagguaugugaacagga

SEQ ID NO: 843442 - RNA, 20 nt, Human
agccagccaccaacgucccc

SEQ ID NO: 843443 - RNA, 18 nt, Human
aggagccacacgugcccc

SEQ ID NO: 843444 - RNA, 18 nt, Human
aggcaucauggacauggc

SEQ ID NO: 843445 - RNA, 19 nt, Human
aggcccggcacacgccggg

SEQ ID NO: 843446 - RNA, 26 nt, Human
aggcgggaggagggaagugggggacc

SEQ ID NO: 843447 - RNA, 27 nt, Human
aggcgggaggagggaagugggggaccc

SEQ ID NO: 843448 - RNA, 22 nt, Human
aggcuaccaacucauuuccuca

SEQ ID NO: 843449 - RNA, 18 nt, Human
agucaacaccuuggugac

SEQ ID NO: 843450 - RNA, 23 nt, Human
agugauggcugggcugcugggcc

SEQ ID NO: 843451 - RNA, 19 nt, Human
aucauggacauggcugaag

SEQ ID NO: 843452 - RNA, 20 nt, Human
aucauggacauggcugaagu

SEQ ID NO: 843453 - RNA, 26 nt, Human
augaggcauugugcaaugcugagauc

SEQ ID NO: 843454 - RNA, 23 nt, Human
augauacaggaguaacucaagca

SEQ ID NO: 843455 - RNA, 18 nt, Human
caaaacagaucuacacaa

SEQ ID NO: 843456 - RNA, 22 nt, Human
caacaggacagacugagggcuu

SEQ ID NO: 843457 - RNA, 26 nt, Human
caaccaguaacaaucccaaaacucaa

SEQ ID NO: 843458 - RNA, 23 nt, Human
caaucccaaaacucaacaucagc

SEQ ID NO: 843459 - RNA, 19 nt, Human
cacuacgucaccagcgagc

SEQ ID NO: 843460 - RNA, 22 nt, Human
cagcacgucuugcgcuccagca

SEQ ID NO: 843461 - RNA, 23 nt, Human
cagcauuaaagugcuuuuggcca

SEQ ID NO: 843462 - RNA, 21 nt, Human
cagccuaagcccagggguaac

SEQ ID NO: 843463 - RNA, 23 nt, Human
caucacuucgccccacacaacag

SEQ ID NO: 843464 - RNA, 24 nt, Human
cauggcugaaguccaaaagacaaa

SEQ ID NO: 843465 - RNA, 18 nt, Human
cauguccaccuggcagag

SEQ ID NO: 843466 - RNA, 19 nt, Human
cauguuuacgcuaaagaau

SEQ ID NO: 843467 - RNA, 23 nt, Human
ccaccaacguccccaccuuccac

SEQ ID NO: 843468 - RNA, 18 nt, Human
ccagcaacagcaggcaaa

SEQ ID NO: 843469 - RNA, 19 nt, Human
ccauacauccaacagcccu

SEQ ID NO: 843470 - RNA, 21 nt, Human
cccaaaacucaacaucagcau

SEQ ID NO: 843471 - RNA, 19 nt, Human
cccacacggcacuuagggc

SEQ ID NO: 843472 - RNA, 18 nt, Human
cccagcacagggcccgcc

SEQ ID NO: 843473 - RNA, 18 nt, Human
cccagugacugccaccug

SEQ ID NO: 843474 - RNA, 21 nt, Human
cccaugcaccucagccagcca

SEQ ID NO: 843475 - RNA, 22 nt, Human
cccggggggaggcgggaggagg

SEQ ID NO: 843476 - RNA, 19 nt, Human
cccugagcccagccggcuc

SEQ ID NO: 843477 - RNA, 22 nt, Human
cccugagcccagccggcucgcc

SEQ ID NO: 843478 - RNA, 20 nt, Human
ccggccucgcggcggccauc

SEQ ID NO: 843479 - RNA, 22 nt, Human
ccucaccaccaagacgugucug

SEQ ID NO: 843480 - RNA, 20 nt, Human
ccuuccaccauccauccuuc

SEQ ID NO: 843481 - RNA, 22 nt, Human
ccuucuacuacauccuucaacc

SEQ ID NO: 843482 - RNA, 19 nt, Human
ccuuggccaacugcaguca

SEQ ID NO: 843483 - RNA, 28 nt, Human
cgagauggacacacacaagccacagucc

SEQ ID NO: 843484 - RNA, 20 nt, Human
cgccccacacaacaggacag

SEQ ID NO: 843485 - RNA, 21 nt, Human
cgccgggaacauccacccaca

SEQ ID NO: 843486 - RNA, 21 nt, Human
cgucaccagcgagcgccaccc

SEQ ID NO: 843487 - RNA, 24 nt, Human
cucagccuaagcccagggguaacu

SEQ ID NO: 843488 - RNA, 20 nt, Human
cuccaaucgucccuuacacc

SEQ ID NO: 843489 - RNA, 20 nt, Human
cuccacgcagacuccgccuc

SEQ ID NO: 843490 - RNA, 26 nt, Human
cuccagcaaaugaacauaagguaccc

SEQ ID NO: 843491 - RNA, 22 nt, Human
cuccagcugccucagcagcauc

SEQ ID NO: 843492 - RNA, 19 nt, Human
cucucagacccaugagccc

SEQ ID NO: 843493 - RNA, 21 nt, Human
cucucugggaagaaacuccaa

SEQ ID NO: 843494 - RNA, 22 nt, Human
cucugagcuacucccacuccuc

SEQ ID NO: 843495 - RNA, 23 nt, Human
cugggcugcugggccccugccuu

SEQ ID NO: 843496 - RNA, 26 nt, Human
gaagguucuggagaucagggagggug

SEQ ID NO: 843497 - RNA, 20 nt, Human
gaggaaggugggggugucug

SEQ ID NO: 843498 - RNA, 22 nt, Human
gaggcgggaggagggaagugga

SEQ ID NO: 843499 - RNA, 20 nt, Human
gauacaggaguaacucaagc

SEQ ID NO: 843500 - RNA, 19 nt, Human
gccauacuucuuucagaaa

SEQ ID NO: 843501 - RNA, 22 nt, Human
gcccagggguaacugagccuca

SEQ ID NO: 843502 - RNA, 19 nt, Human
gccccucuccacgcagacu

SEQ ID NO: 843503 - RNA, 23 nt, Human
gccuugugggcugcuuuuuuggg

SEQ ID NO: 843504 - RNA, 18 nt, Human
gcugcugggccccugccu

SEQ ID NO: 843505 - RNA, 20 nt, Human
ggccccugccuugugggcug

SEQ ID NO: 843506 - RNA, 20 nt, Human
ggcugcaaggagggcaggug

SEQ ID NO: 843507 - RNA, 18 nt, Human
ggcugcuuuuuugggaga

SEQ ID NO: 843508 - RNA, 18 nt, Human
gggaacauccacccacag

SEQ ID NO: 843509 - RNA, 19 nt, Human
gggcugcuuuuuugggaga

SEQ ID NO: 843510 - RNA, 20 nt, Human
gguucuggagaucagggagg

SEQ ID NO: 843511 - RNA, 21 nt, Human
gugcaaugcugagauccugag

SEQ ID NO: 843512 - RNA, 22 nt, Human
uaaaaacaacaaugucagcagc

SEQ ID NO: 843513 - RNA, 22 nt, Human
uaaagggcacaacagggaugca

SEQ ID NO: 843514 - RNA, 20 nt, Human
uaacaaucccaaaacucaac

SEQ ID NO: 843515 - RNA, 21 nt, Human
uauuaugagcaaugauacagg

SEQ ID NO: 843516 - RNA, 22 nt, Human
ucaccagucgccucagauugcc

SEQ ID NO: 843517 - RNA, 21 nt, Human
ucacccaaacugcuuuucuca

SEQ ID NO: 843518 - RNA, 26 nt, Human
ucagccagccaccaacguccccaccu

SEQ ID NO: 843519 - RNA, 21 nt, Human
ucagccuaagcccagggguaa

SEQ ID NO: 843520 - RNA, 25 nt, Human
uccaaaacagaucuacacaaaacag

SEQ ID NO: 843521 - RNA, 20 nt, Human
uccaaaagacaaaaagauuc

SEQ ID NO: 843522 - RNA, 27 nt, Human
uccacccacagcauguccaccuggcag

SEQ ID NO: 843523 - RNA, 22 nt, Human
uccauuggaauugugugacagu

SEQ ID NO: 843524 - RNA, 21 nt, Human
ucccaaaacucaacaucagca

SEQ ID NO: 843525 - RNA, 22 nt, Human
uccccaccuuccaccauccauc

SEQ ID NO: 843526 - RNA, 19 nt, Human
uccuucugggacagacucu

SEQ ID NO: 843527 - RNA, 21 nt, Human
ucgccccacacaacaggacag

SEQ ID NO: 843528 - RNA, 18 nt, Human
ucucacacagucaacacc

SEQ ID NO: 843529 - RNA, 21 nt, Human
ucucagacccaugagccccuc

SEQ ID NO: 843530 - RNA, 20 nt, Human
ucucuuggcaguggccaggg

SEQ ID NO: 843531 - RNA, 20 nt, Human
ugaaaguguccuuugggggu

SEQ ID NO: 843532 - RNA, 18 nt, Human
ugaacaggacaucaccug

SEQ ID NO: 843533 - RNA, 28 nt, Human
ugaaccagagaaagcuggaaaaagccuu

SEQ ID NO: 843534 - RNA, 21 nt, Human
ugacacuaaagcaaaggacac

SEQ ID NO: 843535 - RNA, 18 nt, Human
ugagcuacucccacuccu

SEQ ID NO: 843536 - RNA, 27 nt, Human
ugcccccacuucaaccaguaacaaucc

SEQ ID NO: 843537 - RNA, 21 nt, Human
ugccccugggggagcccacac

SEQ ID NO: 843538 - RNA, 21 nt, Human
ugcugggcugcaaggagggca

SEQ ID NO: 843539 - RNA, 20 nt, Human
uggaaaaagccucaacuuaa

SEQ ID NO: 843540 - RNA, 20 nt, Human
uggacacacacaagccacag

SEQ ID NO: 843541 - RNA, 18 nt, Human
uggacccugagcccagcc

SEQ ID NO: 843542 - RNA, 19 nt, Human
uggcaguggccagggggca

SEQ ID NO: 843543 - RNA, 21 nt, Human
uggcuauugauugacuguguu

SEQ ID NO: 843544 - RNA, 22 nt, Human
uggcugggcugcugggccccug

SEQ ID NO: 843545 - RNA, 19 nt, Human
ugggcugcaaggagggcag

SEQ ID NO: 843546 - RNA, 19 nt, Human
ugggggagcccacacggca

SEQ ID NO: 843547 - RNA, 23 nt, Human
uguccugucucagguugagguug

SEQ ID NO: 843548 - RNA, 22 nt, Human
ugugcugggcugcaaggagggc

SEQ ID NO: 843549 - RNA, 21 nt, Human
uucaaccaccuagaccaugcc

SEQ ID NO: 843550 - RNA, 22 nt, Human
uucauguuuacgcuaaagaauu

SEQ ID NO: 843551 - RNA, 23 nt, Human
uugcgcuccagcaaaugaacaua

SEQ ID NO: 843552 - RNA, 18 nt, Human
uuggauggugagagaucu

SEQ ID NO: 843553 - RNA, 24 nt, Human
uuucagaaagggucucucccucag

SEQ ID NO: 843554 - RNA, 24 nt, Human
uuucucacacagucaacaccuugg

SEQ ID NO: 843555 - RNA, 27 nt, Human
uuuuugggagagguguugcuuauuucu

SEQ ID NO: 843556 - RNA, 18 nt, Human
uuuuuugggagagguguu

SEQ ID NO: 843557 - RNA, 21 nt, Human
uuuuuuuuuuucaaaaagagc

SEQ ID NO: 843558 - RNA, 23 nt, Human
aaaggaagaaggaaggcggggag

SEQ ID NO: 843559 - RNA, 23 nt, Human
aagcaucccccucuaggccccag

SEQ ID NO: 843560 - RNA, 23 nt, Human
acccugagaggggucuuaagagg

SEQ ID NO: 843561 - RNA, 19 nt, Human
agaaggaaggcggggaggc

SEQ ID NO: 843562 - RNA, 22 nt, Human
agcaggcaccacccccuuccug

SEQ ID NO: 843563 - RNA, 20 nt, Human
aggcggggaggcccuggauc

SEQ ID NO: 843564 - RNA, 24 nt, Human
aucuccccuucucuguuuccccaa

SEQ ID NO: 843565 - RNA, 18 nt, Human
cagcaggcaccacccccu

SEQ ID NO: 843566 - RNA, 18 nt, Human
cccaagcaucccccucua

SEQ ID NO: 843567 - RNA, 18 nt, Human
ccccaagcaucccccucu

SEQ ID NO: 843568 - RNA, 22 nt, Human
ccccagcaggcaccacccccuu

SEQ ID NO: 843569 - RNA, 18 nt, Human
ccucuaggccccagcagg

SEQ ID NO: 843570 - RNA, 25 nt, Human
ccucuaggccccagcaggcaccacc

SEQ ID NO: 843571 - RNA, 19 nt, Human
cuaggccccagcaggcacc

SEQ ID NO: 843572 - RNA, 23 nt, Human
cuccccuucucuguuuccccaag

SEQ ID NO: 843573 - RNA, 22 nt, Human
gaagaaggaaggcggggaggcc

SEQ ID NO: 843574 - RNA, 19 nt, Human
gcccuggaucuccccuucu

SEQ ID NO: 843575 - RNA, 18 nt, Human
gccuucccucauccccca

SEQ ID NO: 843576 - RNA, 22 nt, Human
ggcggggaggcccuggaucucc

SEQ ID NO: 843577 - RNA, 19 nt, Human
ggggaggcccuggaucucc

SEQ ID NO: 843578 - RNA, 19 nt, Human
gucaaggauggaggggguc

SEQ ID NO: 843579 - RNA, 30 nt, Human
gugugauuuugugugugugugugugugugg

SEQ ID NO: 843580 - RNA, 19 nt, Human
uaaaaaggaagaaggaagg

SEQ ID NO: 843581 - RNA, 24 nt, Human
uaggccccagcaggcaccaccccc

SEQ ID NO: 843582 - RNA, 23 nt, Human
ucaaggauggagggggucaagga

SEQ ID NO: 843583 - RNA, 19 nt, Human
ugagaggggucuuaagagg

SEQ ID NO: 843584 - RNA, 19 nt, Human
ugccuuguggugggguggg

SEQ ID NO: 843585 - RNA, 22 nt, Human
ugccuuguggugggguggggau

SEQ ID NO: 843586 - RNA, 22 nt, Human
ugggguggggauugacaggcau

SEQ ID NO: 843587 - RNA, 24 nt, Human
uggugugauuuugugugugugugu

SEQ ID NO: 843588 - RNA, 29 nt, Human
uggugugauuuugugugugugugugugug

SEQ ID NO: 843589 - RNA, 22 nt, Human
uguggugggguggggauugaca

SEQ ID NO: 843590 - RNA, 23 nt, Human
uguggugggguggggauugacag

SEQ ID NO: 843591 - RNA, 18 nt, Human
ugugugugugugugugug

SEQ ID NO: 843592 - RNA, 18 nt, Human
ugugugugugugugugug

SEQ ID NO: 843593 - RNA, 18 nt, Human
ugugugugugugugugug

SEQ ID NO: 843594 - RNA, 18 nt, Human
ugugugugugugugugug

SEQ ID NO: 843595 - RNA, 21 nt, Human
ugugugugugugugugugugu

SEQ ID NO: 843596 - RNA, 21 nt, Human
ugugugugugugugugugugu

SEQ ID NO: 843597 - RNA, 21 nt, Human
ugugugugugugugugugugu

SEQ ID NO: 843598 - RNA, 21 nt, Human
ugugugugugugugugugugu

SEQ ID NO: 843599 - RNA, 21 nt, Human
ugugugugugugugugugugu

SEQ ID NO: 843600 - RNA, 21 nt, Human
ugugugugugugugugugugu

SEQ ID NO: 843601 - RNA, 22 nt, Human
ugugugugugugugugugugug

SEQ ID NO: 843602 - RNA, 21 nt, Human
uguguguguguguguguugag

SEQ ID NO: 843603 - RNA, 22 nt, Human
uguguguguguguguugaggug

SEQ ID NO: 843604 - RNA, 21 nt, Human
uugggggucaaggauggaggg

SEQ ID NO: 843605 - RNA, 24 nt, Human
uuugugugugugugugugugugug

SEQ ID NO: 843606 - RNA, 22 nt, Human
aacacuaugagcuacuaaaaaa

SEQ ID NO: 843607 - RNA, 21 nt, Human
agaaauaugaaaaguuccagc

SEQ ID NO: 843608 - RNA, 26 nt, Human
agcuacuaaaaaaguuguggaacuca

SEQ ID NO: 843609 - RNA, 18 nt, Human
aggagaacuugaggucag

SEQ ID NO: 843610 - RNA, 26 nt, Human
aggggacugguucugagaaggggcag

SEQ ID NO: 843611 - RNA, 21 nt, Human
augguccugguuuagaagaug

SEQ ID NO: 843612 - RNA, 24 nt, Human
caacuugccccaccaauucucacu

SEQ ID NO: 843613 - RNA, 20 nt, Human
cacucuggaaacccaccaac

SEQ ID NO: 843614 - RNA, 22 nt, Human
cagaaagaacaggauuuccagc

SEQ ID NO: 843615 - RNA, 19 nt, Human
cagccuuucucaggacaac

SEQ ID NO: 843616 - RNA, 20 nt, Human
caggacaacuugccccacca

SEQ ID NO: 843617 - RNA, 24 nt, Human
cagguccugcuugaagcccaagga

SEQ ID NO: 843618 - RNA, 24 nt, Human
cauuauaccacccguucagaaaga

SEQ ID NO: 843619 - RNA, 22 nt, Human
ccccguggcagcauacgcugcc

SEQ ID NO: 843620 - RNA, 22 nt, Human
cgcggcgccaucuucagucccc

SEQ ID NO: 843621 - RNA, 20 nt, Human
cggugaucaaggaggagaac

SEQ ID NO: 843622 - RNA, 22 nt, Human
cguucagaaagaacaggauuuc

SEQ ID NO: 843623 - RNA, 18 nt, Human
cugcuggcugaaauucug

SEQ ID NO: 843624 - RNA, 20 nt, Human
cuguuggauaugguagcagg

SEQ ID NO: 843625 - RNA, 19 nt, Human
cuugccccucccuauacuu

SEQ ID NO: 843626 - RNA, 19 nt, Human
gaggucagcaggggacugg

SEQ ID NO: 843627 - RNA, 21 nt, Human
gaucaaggaggagaacuugag

SEQ ID NO: 843628 - RNA, 21 nt, Human
gcuaaaguaccagaagcaaua

SEQ ID NO: 843629 - RNA, 24 nt, Human
ggauuggggugagaggcuuucaca

SEQ ID NO: 843630 - RNA, 21 nt, Human
ggcaggaugggaauaaccuug

SEQ ID NO: 843631 - RNA, 20 nt, Human
ggugaucaaggaggagaacu

SEQ ID NO: 843632 - RNA, 21 nt, Human
uaaaguaccagaagcaauaug

SEQ ID NO: 843633 - RNA, 23 nt, Human
uagcaggacaccuuuauacagaa

SEQ ID NO: 843634 - RNA, 24 nt, Human
uaugguagcaggacaccuuuauac

SEQ ID NO: 843635 - RNA, 19 nt, Human
ucacugguguggcuaaagu

SEQ ID NO: 843636 - RNA, 23 nt, Human
ucagccugaugggcugcuggcug

SEQ ID NO: 843637 - RNA, 20 nt, Human
uccccguggcagcauacgcu

SEQ ID NO: 843638 - RNA, 20 nt, Human
ucuccgaggauuggggugag

SEQ ID NO: 843639 - RNA, 22 nt, Human
ucucuugggcugaugguccugg

SEQ ID NO: 843640 - RNA, 21 nt, Human
ucuggccacggugaucaagga

SEQ ID NO: 843641 - RNA, 20 nt, Human
ucuugggcugaugguccugg

SEQ ID NO: 843642 - RNA, 21 nt, Human
ugaguguagaagagucucuug

SEQ ID NO: 843643 - RNA, 19 nt, Human
uggaaacccaccaacauga

SEQ ID NO: 843644 - RNA, 19 nt, Human
uggcucagguccugcuuga

SEQ ID NO: 843645 - RNA, 24 nt, Human
ugggaauaaccuugccccucccua

SEQ ID NO: 843646 - RNA, 22 nt, Human
uguagaagagucucuugggcug

SEQ ID NO: 843647 - RNA, 19 nt, Human
ugucagccugaugggcugc

SEQ ID NO: 843648 - RNA, 21 nt, Human
uguggaacucagucuccgagg

SEQ ID NO: 843649 - RNA, 22 nt, Human
uucucaggacaacuugccccac

SEQ ID NO: 843650 - RNA, 24 nt, Human
uugcuugcccaaaugucugugcug

SEQ ID NO: 843651 - RNA, 21 nt, Human
uuucucaggacaacuugcccc

SEQ ID NO: 843652 - RNA, 24 nt, Human
uuuuuuucuuuuuuuuuuuuccag

SEQ ID NO: 843653 - RNA, 22 nt, Human
uuuuuuuuuuuuuuuucuuuuu

SEQ ID NO: 843654 - RNA, 22 nt, Human
agcgcccccccagcuaccgccc

SEQ ID NO: 843655 - RNA, 18 nt, Human
augcagccccuggguggg

SEQ ID NO: 843656 - RNA, 27 nt, Human
caagccgagccccagggagccucgcaa

SEQ ID NO: 843657 - RNA, 21 nt, Human
caccggggcccccgccaacaa

SEQ ID NO: 843658 - RNA, 18 nt, Human
ccacaugcagccccuggg

SEQ ID NO: 843659 - RNA, 19 nt, Human
ccaccccggcccgcgcccc

SEQ ID NO: 843660 - RNA, 18 nt, Human
ccagggccgcgcuccaug

SEQ ID NO: 843661 - RNA, 20 nt, Human
cccccagcuaccgccccaga

SEQ ID NO: 843662 - RNA, 22 nt, Human
ccccccagcuaccgccccagac

SEQ ID NO: 843663 - RNA, 18 nt, Human
ccccggggccccagggcc

SEQ ID NO: 843664 - RNA, 24 nt, Human
ccccggggccccagggccgcgcuc

SEQ ID NO: 843665 - RNA, 23 nt, Human
ccccugggccgcccggggggucc

SEQ ID NO: 843666 - RNA, 18 nt, Human
cccgccaacaacgccgcc

SEQ ID NO: 843667 - RNA, 20 nt, Human
cccggcccgcgccccggggc

SEQ ID NO: 843668 - RNA, 24 nt, Human
cccggccgcccgcccgugcguccg

SEQ ID NO: 843669 - RNA, 23 nt, Human
cccggggccccagggccgcgcuc

SEQ ID NO: 843670 - RNA, 19 nt, Human
cccugggucggggcggggu

SEQ ID NO: 843671 - RNA, 20 nt, Human
ccgcccaggccgggccucca

SEQ ID NO: 843672 - RNA, 18 nt, Human
ccgcgccccggggcccca

SEQ ID NO: 843673 - RNA, 20 nt, Human
ccgcgccccggggccccagg

SEQ ID NO: 843674 - RNA, 19 nt, Human
ccggcccgcgccccggggc

SEQ ID NO: 843675 - RNA, 21 nt, Human
ccuggcccggcaggggagggg

SEQ ID NO: 843676 - RNA, 21 nt, Human
cgccaacaacgccgcccggcc

SEQ ID NO: 843677 - RNA, 21 nt, Human
cggcaggggaggggugggggu

SEQ ID NO: 843678 - RNA, 24 nt, Human
cggggcgggguccccugggccgcc

SEQ ID NO: 843679 - RNA, 20 nt, Human
cgggggccgccuuauugcug

SEQ ID NO: 843680 - RNA, 23 nt, Human
cgggggccgccuuauugcugagg

SEQ ID NO: 843681 - RNA, 23 nt, Human
cggggugagguccgggggccgcc

SEQ ID NO: 843682 - RNA, 19 nt, Human
cuccauggcucccggccgc

SEQ ID NO: 843683 - RNA, 22 nt, Human
cugagguccggccgguuggggc

SEQ ID NO: 843684 - RNA, 21 nt, Human
gacagcagccccguuaggagg

SEQ ID NO: 843685 - RNA, 18 nt, Human
gaggccagggcccagccc

SEQ ID NO: 843686 - RNA, 21 nt, Human
gaggggugggggugcuccgag

SEQ ID NO: 843687 - RNA, 18 nt, Human
gagguccggccgguuggg

SEQ ID NO: 843688 - RNA, 25 nt, Human
gcccaggccgggccuccaccggggc

SEQ ID NO: 843689 - RNA, 18 nt, Human
gccgagccccagggagcc

SEQ ID NO: 843690 - RNA, 24 nt, Human
gggaagcccaccccggcccgcgcc

SEQ ID NO: 843691 - RNA, 18 nt, Human
ggucggggcggggucccc

SEQ ID NO: 843692 - RNA, 22 nt, Human
gugggggccggcgcggggugag

SEQ ID NO: 843693 - RNA, 18 nt, Human
uccccugggccgcccggg

SEQ ID NO: 843694 - RNA, 18 nt, Human
ugagguccgggggccgcc

SEQ ID NO: 843695 - RNA, 20 nt, Human
uucacguauuuucuucuugc

SEQ ID NO: 843696 - RNA, 23 nt, Human
aaaaacuggaagaccaaguauaa

SEQ ID NO: 843697 - RNA, 21 nt, Human
aaaaguacuaguuucaacaug

SEQ ID NO: 843698 - RNA, 21 nt, Human
aaaguacuaguuucaacaugg

SEQ ID NO: 843699 - RNA, 23 nt, Human
aaauacaagaacuguauaaagca

SEQ ID NO: 843700 - RNA, 20 nt, Human
aacacaaugagacaaaaaca

SEQ ID NO: 843701 - RNA, 22 nt, Human
aagauauagcuggaacagaaca

SEQ ID NO: 843702 - RNA, 23 nt, Human
aaggaucaauuccuuucaaauac

SEQ ID NO: 843703 - RNA, 23 nt, Human
acauguacacacauacaggccua

SEQ ID NO: 843704 - RNA, 26 nt, Human
agacaaaaacacaaaacauaacuugu

SEQ ID NO: 843705 - RNA, 24 nt, Human
agacaagauauagcuggaacagaa

SEQ ID NO: 843706 - RNA, 21 nt, Human
caaaaacuuuuuguucaugcu

SEQ ID NO: 843707 - RNA, 24 nt, Human
caaaacauaacuuguuuccaaagu

SEQ ID NO: 843708 - RNA, 23 nt, Human
caaugagacaaaaacacaaaaca

SEQ ID NO: 843709 - RNA, 24 nt, Human
cacaaugagacaaaaacacaaaac

SEQ ID NO: 843710 - RNA, 18 nt, Human
cacuuugugugugugugu

SEQ ID NO: 843711 - RNA, 20 nt, Human
cauucuuguuccuuaguuuu

SEQ ID NO: 843712 - RNA, 21 nt, Human
ccaaagucacaaaaugacauu

SEQ ID NO: 843713 - RNA, 23 nt, Human
ccacugaaauuaguccuguaagg

SEQ ID NO: 843714 - RNA, 19 nt, Human
cguaucugcaggcuuaagc

SEQ ID NO: 843715 - RNA, 18 nt, Human
cuacuuagccaccaaaaa

SEQ ID NO: 843716 - RNA, 28 nt, Human
cuccacuuugugugugugugugugugug

SEQ ID NO: 843717 - RNA, 25 nt, Human
cuggaacagaacaaaaacuuuuugu

SEQ ID NO: 843718 - RNA, 23 nt, Human
gaacaauauacaccauguuucuu

SEQ ID NO: 843719 - RNA, 19 nt, Human
gcuagauauuuucacugaa

SEQ ID NO: 843720 - RNA, 18 nt, Human
guggucaguaaccaacgc

SEQ ID NO: 843721 - RNA, 18 nt, Human
guguggugggaggguggg

SEQ ID NO: 843722 - RNA, 21 nt, Human
gugugugugugugugugugug

SEQ ID NO: 843723 - RNA, 20 nt, Human
uacaaaaaacuggaagacca

SEQ ID NO: 843724 - RNA, 23 nt, Human
ucuuauggcuagauauuuucacu

SEQ ID NO: 843725 - RNA, 24 nt, Human
ugaaacaguguuagcacuuagaca

SEQ ID NO: 843726 - RNA, 18 nt, Human
ugacaaagaaauaaaaaa

SEQ ID NO: 843727 - RNA, 19 nt, Human
ugagacaaaaacacaaaac

SEQ ID NO: 843728 - RNA, 23 nt, Human
ugcuaucaucuucaaaaaauaua

SEQ ID NO: 843729 - RNA, 23 nt, Human
uggacauguacacacauacagug

SEQ ID NO: 843730 - RNA, 18 nt, Human
uggugggaggguggggug

SEQ ID NO: 843731 - RNA, 19 nt, Human
uggugggaggguggggugg

SEQ ID NO: 843732 - RNA, 22 nt, Human
uguguguguguggugggagggu

SEQ ID NO: 843733 - RNA, 18 nt, Human
ugugugugugugugugug

SEQ ID NO: 843734 - RNA, 18 nt, Human
ugugugugugugugugug

SEQ ID NO: 843735 - RNA, 18 nt, Human
ugugugugugugugugug

SEQ ID NO: 843736 - RNA, 18 nt, Human
ugugugugugugugugug

SEQ ID NO: 843737 - RNA, 18 nt, Human
ugugugugugugugugug

SEQ ID NO: 843738 - RNA, 18 nt, Human
ugugugugugugugugug

SEQ ID NO: 843739 - RNA, 18 nt, Human
ugugugugugugugugug

SEQ ID NO: 843740 - RNA, 18 nt, Human
ugugugugugugugugug

SEQ ID NO: 843741 - RNA, 18 nt, Human
ugugugugugugugugug

SEQ ID NO: 843742 - RNA, 18 nt, Human
ugugugugugugugugug

SEQ ID NO: 843743 - RNA, 18 nt, Human
ugugugugugugugugug

SEQ ID NO: 843744 - RNA, 18 nt, Human
ugugugugugugugugug

SEQ ID NO: 843745 - RNA, 18 nt, Human
ugugugugugugugugug

SEQ ID NO: 843746 - RNA, 18 nt, Human
ugugugugugugugugug

SEQ ID NO: 843747 - RNA, 18 nt, Human
ugugugugugugugugug

SEQ ID NO: 843748 - RNA, 18 nt, Human
ugugugugugugugugug

SEQ ID NO: 843749 - RNA, 20 nt, Human
ugugugugugugugugugug

SEQ ID NO: 843750 - RNA, 22 nt, Human
ugugugugugugugugugugag

SEQ ID NO: 843751 - RNA, 21 nt, Human
ugugugugugugugugugugu

SEQ ID NO: 843752 - RNA, 21 nt, Human
ugugugugugugugugugugu

SEQ ID NO: 843753 - RNA, 21 nt, Human
ugugugugugugugugugugu

SEQ ID NO: 843754 - RNA, 21 nt, Human
ugugugugugugugugugugu

SEQ ID NO: 843755 - RNA, 21 nt, Human
ugugugugugugugugugugu

SEQ ID NO: 843756 - RNA, 21 nt, Human
ugugugugugugugugugugu

SEQ ID NO: 843757 - RNA, 21 nt, Human
ugugugugugugugugugugu

SEQ ID NO: 843758 - RNA, 21 nt, Human
ugugugugugugugugugugu

SEQ ID NO: 843759 - RNA, 21 nt, Human
ugugugugugugugugugugu

SEQ ID NO: 843760 - RNA, 21 nt, Human
ugugugugugugugugugugu

SEQ ID NO: 843761 - RNA, 21 nt, Human
ugugugugugugugugugugu

SEQ ID NO: 843762 - RNA, 21 nt, Human
ugugugugugugugugugugu

SEQ ID NO: 843763 - RNA, 21 nt, Human
ugugugugugugugugugugu

SEQ ID NO: 843764 - RNA, 21 nt, Human
ugugugugugugugugugugu

SEQ ID NO: 843765 - RNA, 21 nt, Human
ugugugugugugugugugugu

SEQ ID NO: 843766 - RNA, 21 nt, Human
ugugugugugugugugugugu

SEQ ID NO: 843767 - RNA, 21 nt, Human
ugugugugugugugugugugu

SEQ ID NO: 843768 - RNA, 21 nt, Human
ugugugugugugugugugugu

SEQ ID NO: 843769 - RNA, 21 nt, Human
ugugugugugugugugugugu

SEQ ID NO: 843770 - RNA, 21 nt, Human
ugugugugugugugugugugu

SEQ ID NO: 843771 - RNA, 21 nt, Human
ugugugugugugugugugugu

SEQ ID NO: 843772 - RNA, 21 nt, Human
ugugugugugugugugugugu

SEQ ID NO: 843773 - RNA, 21 nt, Human
ugugugugugugugugugugu

SEQ ID NO: 843774 - RNA, 21 nt, Human
ugugugugugugugugugugu

SEQ ID NO: 843775 - RNA, 21 nt, Human
ugugugugugugugugugugu

SEQ ID NO: 843776 - RNA, 21 nt, Human
ugugugugugugugugugugu

SEQ ID NO: 843777 - RNA, 21 nt, Human
ugugugugugugugugugugu

SEQ ID NO: 843778 - RNA, 21 nt, Human
ugugugugugugugugugugu

SEQ ID NO: 843779 - RNA, 21 nt, Human
ugugugugugugugugugugu

SEQ ID NO: 843780 - RNA, 21 nt, Human
ugugugugugugugugugugu

SEQ ID NO: 843781 - RNA, 22 nt, Human
ugugugugugugugugugugug

SEQ ID NO: 843782 - RNA, 22 nt, Human
ugugugugugugugugugugug

SEQ ID NO: 843783 - RNA, 22 nt, Human
ugugugugugugugugugugug

SEQ ID NO: 843784 - RNA, 22 nt, Human
ugugugugugugugugugugug

SEQ ID NO: 843785 - RNA, 22 nt, Human
ugugugugugugugugugugug

SEQ ID NO: 843786 - RNA, 22 nt, Human
ugugugugugugugugugugug

SEQ ID NO: 843787 - RNA, 22 nt, Human
ugugugugugugugugugugug

SEQ ID NO: 843788 - RNA, 22 nt, Human
ugugugugugugugugugugug

SEQ ID NO: 843789 - RNA, 22 nt, Human
ugugugugugugugugugugug

SEQ ID NO: 843790 - RNA, 22 nt, Human
ugugugugugugugugugugug

SEQ ID NO: 843791 - RNA, 22 nt, Human
ugugugugugugugugugugug

SEQ ID NO: 843792 - RNA, 22 nt, Human
ugugugugugugugugugugug

SEQ ID NO: 843793 - RNA, 22 nt, Human
ugugugugugugugugugugug

SEQ ID NO: 843794 - RNA, 22 nt, Human
uucagaaaaaaaaauaccugga

SEQ ID NO: 843795 - RNA, 24 nt, Human
uuugugugugugugugugugugug

SEQ ID NO: 843796 - RNA, 21 nt, Human
uuuuaagcauagcaaacuagg

SEQ ID NO: 843797 - RNA, 21 nt, Human
uuuuccagcuuuacuuggaca

SEQ ID NO: 843798 - RNA, 30 nt, Human
uuuuuguuuuuuuuuuuugguuuguuuuuu

SEQ ID NO: 843799 - RNA, 25 nt, Human
aaaaaaaaaaaaaggaaacaaaaaa

SEQ ID NO: 843800 - RNA, 18 nt, Human
aaaaaaaaaaaggaaaca

SEQ ID NO: 843801 - RNA, 21 nt, Human
aaaaaaaaaaaggaaacaaaa

SEQ ID NO: 843802 - RNA, 20 nt, Human
aaaaauucuccuaucacugg

SEQ ID NO: 843803 - RNA, 24 nt, Human
aaaagaaaaagaaaaaaacaagaa

SEQ ID NO: 843804 - RNA, 24 nt, Human
aaacaagaaauaagcuuuauccaa

SEQ ID NO: 843805 - RNA, 26 nt, Human
aaacaagaaauaagcuuuauccaaaa

SEQ ID NO: 843806 - RNA, 21 nt, Human
aaagaaaaaaacaagaaauaa

SEQ ID NO: 843807 - RNA, 23 nt, Human
aaagaaaaaaacaagaaauaagc

SEQ ID NO: 843808 - RNA, 19 nt, Human
aacauggugaaaccccauc

SEQ ID NO: 843809 - RNA, 20 nt, Human
aacauggugaaaccccaucu

SEQ ID NO: 843810 - RNA, 20 nt, Human
aacauggugaaaccccaucu

SEQ ID NO: 843811 - RNA, 21 nt, Human
aacauggugaaaccccaucuc

SEQ ID NO: 843812 - RNA, 24 nt, Human
aagaaacaagaauaggucaggugu

SEQ ID NO: 843813 - RNA, 22 nt, Human
aagcaauucuccugaguagcug

SEQ ID NO: 843814 - RNA, 18 nt, Human
aagcauccugagcacagg

SEQ ID NO: 843815 - RNA, 19 nt, Human
aaggguuuuaggagcucug

SEQ ID NO: 843816 - RNA, 18 nt, Human
aaguccaaagggccuggg

SEQ ID NO: 843817 - RNA, 18 nt, Human
aauuagccaggcauggug

SEQ ID NO: 843818 - RNA, 24 nt, Human
acaaagcaagauccugucucaaaa

SEQ ID NO: 843819 - RNA, 25 nt, Human
acaaggguuuuaggagcucugaaca

SEQ ID NO: 843820 - RNA, 19 nt, Human
acccugaagcucccugaac

SEQ ID NO: 843821 - RNA, 20 nt, Human
acccugaagcucccugaacu

SEQ ID NO: 843822 - RNA, 18 nt, Human
acugcacucuagccugcg

SEQ ID NO: 843823 - RNA, 19 nt, Human
acuggagugcaguggcacg

SEQ ID NO: 843824 - RNA, 23 nt, Human
agaccaaauacuagaacaaaaga

SEQ ID NO: 843825 - RNA, 25 nt, Human
agacugaaaguuugaaacuuccaau

SEQ ID NO: 843826 - RNA, 20 nt, Human
agagcgagacugucucaaaa

SEQ ID NO: 843827 - RNA, 22 nt, Human
agcaaaauucaaaccgcccgcc

SEQ ID NO: 843828 - RNA, 23 nt, Human
agcaaaauucaaaccgcccgccg

SEQ ID NO: 843829 - RNA, 24 nt, Human
agcacuuugggaggcugaggaggg

SEQ ID NO: 843830 - RNA, 22 nt, Human
agccaggcaugguggcgcacgc

SEQ ID NO: 843831 - RNA, 24 nt, Human
agccauucagggggcugagguggg

SEQ ID NO: 843832 - RNA, 22 nt, Human
agccuaggcaacauggugaaac

SEQ ID NO: 843833 - RNA, 24 nt, Human
agccuaggcaacauggugaaaccc

SEQ ID NO: 843834 - RNA, 23 nt, Human
agccuguaaucccagcacuuugg

SEQ ID NO: 843835 - RNA, 24 nt, Human
agccuguaaucccagcacuuuggg

SEQ ID NO: 843836 - RNA, 21 nt, Human
agcugcucccuaaggaccuau

SEQ ID NO: 843837 - RNA, 25 nt, Human
aggaagaucaaauauauauuucuua

SEQ ID NO: 843838 - RNA, 23 nt, Human
aggagcucaagaccagccuaggc

SEQ ID NO: 843839 - RNA, 21 nt, Human
aggcagaguuugcagcgagcc

SEQ ID NO: 843840 - RNA, 24 nt, Human
aggcagaguuugcagcgagccgag

SEQ ID NO: 843841 - RNA, 22 nt, Human
aggcaggaggauggcgugaacc

SEQ ID NO: 843842 - RNA, 24 nt, Human
aggcaggaggauggcgugaaccug

SEQ ID NO: 843843 - RNA, 18 nt, Human
aggcugaggaggguggau

SEQ ID NO: 843844 - RNA, 20 nt, Human
aggcugaggaggguggauug

SEQ ID NO: 843845 - RNA, 19 nt, Human
aggcugcagugagccaugu

SEQ ID NO: 843846 - RNA, 24 nt, Human
aggugggaggaucacuugagccug

SEQ ID NO: 843847 - RNA, 24 nt, Human
aggugugguggcucaagccuguaa

SEQ ID NO: 843848 - RNA, 24 nt, Human
agguugaggcugcagugagccaug

SEQ ID NO: 843849 - RNA, 20 nt, Human
agucuuuuuuucuuuuuuuc

SEQ ID NO: 843850 - RNA, 20 nt, Human
agugcaguggcacgaucucg

SEQ ID NO: 843851 - RNA, 23 nt, Human
agugcaguggcacgaucucggcu

SEQ ID NO: 843852 - RNA, 24 nt, Human
agugcaguggcacgaucucggcuc

SEQ ID NO: 843853 - RNA, 23 nt, Human
auaccgcagucuccguuggaagc

SEQ ID NO: 843854 - RNA, 20 nt, Human
caaaauguuugccaacccug

SEQ ID NO: 843855 - RNA, 18 nt, Human
caacauggugaaacccca

SEQ ID NO: 843856 - RNA, 22 nt, Human
caacauggugaaaccccaucuc

SEQ ID NO: 843857 - RNA, 24 nt, Human
caacauggugaaaccccaucucuc

SEQ ID NO: 843858 - RNA, 23 nt, Human
caaccuccaccucccagguucaa

SEQ ID NO: 843859 - RNA, 26 nt, Human
cacaaaucuccagccccucuccccuc

SEQ ID NO: 843860 - RNA, 20 nt, Human
cacaggacuugcugacuuca

SEQ ID NO: 843861 - RNA, 18 nt, Human
cacauuaucacaucaacu

SEQ ID NO: 843862 - RNA, 23 nt, Human
cacucuagccugcgugacaaagc

SEQ ID NO: 843863 - RNA, 21 nt, Human
cacugcaaccuccaccuccca

SEQ ID NO: 843864 - RNA, 22 nt, Human
cacugcacucuagccugcguga

SEQ ID NO: 843865 - RNA, 24 nt, Human
cacugcacucuagccugcgugaca

SEQ ID NO: 843866 - RNA, 25 nt, Human
cacugcacucuagccugcgugacaa

SEQ ID NO: 843867 - RNA, 18 nt, Human
cagaagcauccugagcac

SEQ ID NO: 843868 - RNA, 25 nt, Human
cagaugauaaacugucuccaaaucc

SEQ ID NO: 843869 - RNA, 23 nt, Human
cagcacuuugggaggcugaggag

SEQ ID NO: 843870 - RNA, 26 nt, Human
cagcacuuugggaggcugaggagggu

SEQ ID NO: 843871 - RNA, 24 nt, Human
cagccccucuccccucucuggagg

SEQ ID NO: 843872 - RNA, 24 nt, Human
caggugcccaucaagagugaccuc

SEQ ID NO: 843873 - RNA, 21 nt, Human
cagugagccauguuugcgcca

SEQ ID NO: 843874 - RNA, 23 nt, Human
cauccugaguuauccaggugccc

SEQ ID NO: 843875 - RNA, 24 nt, Human
caugauguggucuuuguggcguac

SEQ ID NO: 843876 - RNA, 24 nt, Human
ccaaauacuagaacaaaagaugua

SEQ ID NO: 843877 - RNA, 27 nt, Human
ccaccucccagguucaagcaauucuuu

SEQ ID NO: 843878 - RNA, 18 nt, Human
ccacugcacucuagccug

SEQ ID NO: 843879 - RNA, 18 nt, Human
ccacugcacucuagccug

SEQ ID NO: 843880 - RNA, 19 nt, Human
ccacugcacucuagccugc

SEQ ID NO: 843881 - RNA, 24 nt, Human
ccacugcacucuagccugcgugac

SEQ ID NO: 843882 - RNA, 23 nt, Human
cccagguucaagcaauucuccug

SEQ ID NO: 843883 - RNA, 25 nt, Human
cccagucuuuuuuucuuuuuuucug

SEQ ID NO: 843884 - RNA, 24 nt, Human
ccccugggugacaaagcaagaucc

SEQ ID NO: 843885 - RNA, 18 nt, Human
cccgccgcgcccuagcgc

SEQ ID NO: 843886 - RNA, 21 nt, Human
ccgcugcaguccggccugggu

SEQ ID NO: 843887 - RNA, 24 nt, Human
ccuaggcaacauggugaaacccca

SEQ ID NO: 843888 - RNA, 24 nt, Human
ccucccagguucaagcaauucucc

SEQ ID NO: 843889 - RNA, 21 nt, Human
ccugggaggcagaguuugcag

SEQ ID NO: 843890 - RNA, 20 nt, Human
ccuguaaucccagcacuuug

SEQ ID NO: 843891 - RNA, 21 nt, Human
ccugucucaaaaaaaaaaaaa

SEQ ID NO: 843892 - RNA, 22 nt, Human
ccugucucaaaaaaaaaaaaag

SEQ ID NO: 843893 - RNA, 24 nt, Human
cgcucuguugcccagacuggagug

SEQ ID NO: 843894 - RNA, 24 nt, Human
cgcuuguagucccagccauucagg

SEQ ID NO: 843895 - RNA, 24 nt, Human
cucaaaaaaaaaaaaagaaaaaga

SEQ ID NO: 843896 - RNA, 25 nt, Human
cucaaaaaaaaaaaaaggaaacaaa

SEQ ID NO: 843897 - RNA, 22 nt, Human
cucaagaccagccuaggcaaca

SEQ ID NO: 843898 - RNA, 24 nt, Human
cucaagccuguaaucccagcacuu

SEQ ID NO: 843899 - RNA, 24 nt, Human
cucacugcaaccuccaccucccag

SEQ ID NO: 843900 - RNA, 23 nt, Human
cucuguugcccagacuggagugc

SEQ ID NO: 843901 - RNA, 23 nt, Human
cugcaaccuccaccucccagguu

SEQ ID NO: 843902 - RNA, 24 nt, Human
cugcaaccuccaccucccagguuc

SEQ ID NO: 843903 - RNA, 22 nt, Human
cugcaguccggccugggugaaa

SEQ ID NO: 843904 - RNA, 22 nt, Human
cugcagugagccauguuugcgc

SEQ ID NO: 843905 - RNA, 20 nt, Human
cugucucaaaaaaaaaaaaa

SEQ ID NO: 843906 - RNA, 20 nt, Human
cugucucaaaaaaaaaaaaa

SEQ ID NO: 843907 - RNA, 23 nt, Human
cuugagccugggagguugaggcu

SEQ ID NO: 843908 - RNA, 20 nt, Human
gaaccugggaggcagaguuu

SEQ ID NO: 843909 - RNA, 24 nt, Human
gacacaaaucuccagccccucucc

SEQ ID NO: 843910 - RNA, 19 nt, Human
gagcagcccccauccugag

SEQ ID NO: 843911 - RNA, 22 nt, Human
gcaaccuccaccucccagguuc

SEQ ID NO: 843912 - RNA, 23 nt, Human
gcagcgcaggcgcacauccaugc

SEQ ID NO: 843913 - RNA, 24 nt, Human
gccacugcacucuagccugcguga

SEQ ID NO: 843914 - RNA, 20 nt, Human
gcccagacuggagugcagug

SEQ ID NO: 843915 - RNA, 24 nt, Human
gccugggagguugaggcugcagug

SEQ ID NO: 843916 - RNA, 21 nt, Human
ggcucaagccuguaaucccag

SEQ ID NO: 843917 - RNA, 23 nt, Human
ggcugaggugggaggaucacuug

SEQ ID NO: 843918 - RNA, 18 nt, Human
gggaggcugaggagggug

SEQ ID NO: 843919 - RNA, 19 nt, Human
gucucaaaaaaaaaaaaag

SEQ ID NO: 843920 - RNA, 19 nt, Human
gucucaaaaaaaaaaaaag

SEQ ID NO: 843921 - RNA, 19 nt, Human
guggcgcacgcuuguaguc

SEQ ID NO: 843922 - RNA, 23 nt, Human
guggcucaagccuguaaucccag

SEQ ID NO: 843923 - RNA, 21 nt, Human
uaaaugcauuucagguaagcu

SEQ ID NO: 843924 - RNA, 19 nt, Human
uaccuggggcaagguccag

SEQ ID NO: 843925 - RNA, 23 nt, Human
uaccuggggcaagguccagaagc

SEQ ID NO: 843926 - RNA, 24 nt, Human
uacuacaaaggauacagaugaaca

SEQ ID NO: 843927 - RNA, 22 nt, Human
uagccucuauacucuauacccu

SEQ ID NO: 843928 - RNA, 24 nt, Human
uagcugaggcaggaggauggcgug

SEQ ID NO: 843929 - RNA, 20 nt, Human
uaggcaacauggugaaaccc

SEQ ID NO: 843930 - RNA, 22 nt, Human
uaggcaacauggugaaacccca

SEQ ID NO: 843931 - RNA, 21 nt, Human
uaggucaggugugguggcuca

SEQ ID NO: 843932 - RNA, 24 nt, Human
uaggucaggugugguggcucaagc

SEQ ID NO: 843933 - RNA, 21 nt, Human
uaucacugggaaauuuaaagg

SEQ ID NO: 843934 - RNA, 23 nt, Human
uauguucaaaaguucacaaggga

SEQ ID NO: 843935 - RNA, 21 nt, Human
ucaaaaaaaaaaaaagaaaaa

SEQ ID NO: 843936 - RNA, 24 nt, Human
ucaaaaaaaaaaaaagaaaaagaa

SEQ ID NO: 843937 - RNA, 22 nt, Human
ucaaaaaaaaaaaaaggaaaca

SEQ ID NO: 843938 - RNA, 23 nt, Human
ucaaaaaaaaaaaaaggaaacaa

SEQ ID NO: 843939 - RNA, 22 nt, Human
ucaaagaccaaauacuagaaca

SEQ ID NO: 843940 - RNA, 24 nt, Human
ucacugcaaccuccaccucccagg

SEQ ID NO: 843941 - RNA, 25 nt, Human
ucacugcaaccuccaccucccaggu

SEQ ID NO: 843942 - RNA, 27 nt, Human
ucacugcaaccuccaccucccagguuc

SEQ ID NO: 843943 - RNA, 23 nt, Human
ucacuugagccugggagguugag

SEQ ID NO: 843944 - RNA, 23 nt, Human
uccaaagggccuggguauccuaa

SEQ ID NO: 843945 - RNA, 20 nt, Human
uccaauaucacaucuguacc

SEQ ID NO: 843946 - RNA, 21 nt, Human
ucccagguucaagcaauucuc

SEQ ID NO: 843947 - RNA, 24 nt, Human
ucccagguucaagcaauucuccug

SEQ ID NO: 843948 - RNA, 18 nt, Human
ucccugaacuccauaguu

SEQ ID NO: 843949 - RNA, 23 nt, Human
uccggccugggugaaagagcgag

SEQ ID NO: 843950 - RNA, 24 nt, Human
uccggccugggugaaagagcgaga

SEQ ID NO: 843951 - RNA, 22 nt, Human
ucgccgcugggucuccagccgc

SEQ ID NO: 843952 - RNA, 20 nt, Human
ucuccaaaaaauacaaaaau

SEQ ID NO: 843953 - RNA, 22 nt, Human
ucucgcucuguugcccagacug

SEQ ID NO: 843954 - RNA, 24 nt, Human
ucucgcucuguugcccagacugga

SEQ ID NO: 843955 - RNA, 26 nt, Human
ucucgcucuguugcccagacuggagu

SEQ ID NO: 843956 - RNA, 27 nt, Human
ucucgcucuguugcccagacuggagug

SEQ ID NO: 843957 - RNA, 18 nt, Human
ucucuggaggugggagac

SEQ ID NO: 843958 - RNA, 24 nt, Human
ucuguugcccagacuggagugcag

SEQ ID NO: 843959 - RNA, 20 nt, Human
ugacaaagcaagauccuguc

SEQ ID NO: 843960 - RNA, 22 nt, Human
ugacaaagcaagauccugucuc

SEQ ID NO: 843961 - RNA, 20 nt, Human
ugacacaaaucuccagcccc

SEQ ID NO: 843962 - RNA, 22 nt, Human
ugagauggagucucgcucuguu

SEQ ID NO: 843963 - RNA, 22 nt, Human
ugagcagcccccauccugaguu

SEQ ID NO: 843964 - RNA, 24 nt, Human
ugagccugggagguugaggcugca

SEQ ID NO: 843965 - RNA, 22 nt, Human
ugaggaggguggauuguuugag

SEQ ID NO: 843966 - RNA, 24 nt, Human
ugaggcaggaggauggcgugaacc

SEQ ID NO: 843967 - RNA, 25 nt, Human
ugaggcaggaggauggcgugaaccu

SEQ ID NO: 843968 - RNA, 19 nt, Human
ugaggugggaggaucacuu

SEQ ID NO: 843969 - RNA, 20 nt, Human
ugaggugggaggaucacuug

SEQ ID NO: 843970 - RNA, 22 nt, Human
ugaggugggaggaucacuugag

SEQ ID NO: 843971 - RNA, 23 nt, Human
ugaggugggaggaucacuugagc

SEQ ID NO: 843972 - RNA, 24 nt, Human
ugaggugggaggaucacuugagcc

SEQ ID NO: 843973 - RNA, 22 nt, Human
ugcaguggcacgaucucggcuc

SEQ ID NO: 843974 - RNA, 24 nt, Human
ugcccagacuggagugcaguggca

SEQ ID NO: 843975 - RNA, 23 nt, Human
uggagugcaguggcacgaucucg

SEQ ID NO: 843976 - RNA, 24 nt, Human
uggagugcaguggcacgaucucgg

SEQ ID NO: 843977 - RNA, 27 nt, Human
uggauuauugacacaaaucuccagccc

SEQ ID NO: 843978 - RNA, 24 nt, Human
uggauuguuugagcucaggagcuc

SEQ ID NO: 843979 - RNA, 22 nt, Human
uggcucaagccuguaaucccag

SEQ ID NO: 843980 - RNA, 24 nt, Human
uggcucaagccuguaaucccagca

SEQ ID NO: 843981 - RNA, 22 nt, Human
ugggaggcugaggaggguggau

SEQ ID NO: 843982 - RNA, 24 nt, Human
ugggaggcugaggaggguggauug

SEQ ID NO: 843983 - RNA, 24 nt, Human
ugggagguugaggcugcagugagc

SEQ ID NO: 843984 - RNA, 22 nt, Human
uggggcaagguccagaagcauc

SEQ ID NO: 843985 - RNA, 24 nt, Human
ugguggcgcacgcuuguaguccca

SEQ ID NO: 843986 - RNA, 24 nt, Human
ugguggcucaagccuguaauccca

SEQ ID NO: 843987 - RNA, 20 nt, Human
uguagucccagccauucagg

SEQ ID NO: 843988 - RNA, 22 nt, Human
uuacacuuucauuacagguuga

SEQ ID NO: 843989 - RNA, 18 nt, Human
uucagggggcugaggugg

SEQ ID NO: 843990 - RNA, 22 nt, Human
uugcagcgagccgagauagcgc

SEQ ID NO: 843991 - RNA, 22 nt, Human
uugggaggcugaggagggugga

SEQ ID NO: 843992 - RNA, 20 nt, Human
uuucuuuuuuucugagaugg

SEQ ID NO: 843993 - RNA, 24 nt, Human
uuugcagcgagccgagauagcgcc

SEQ ID NO: 843994 - RNA, 24 nt, Human
uuugcgccacugcacucuagccug

SEQ ID NO: 843995 - RNA, 20 nt, Human
uuuuuuuuuuuuuuuguguu

SEQ ID NO: 843996 - RNA, 22 nt, Human
accccgggaccugugacuucac

SEQ ID NO: 843997 - RNA, 22 nt, Human
accgcagcccagaucugcagca

SEQ ID NO: 843998 - RNA, 21 nt, Human
agcccagaucugcagcaggaa

SEQ ID NO: 843999 - RNA, 24 nt, Human
auaggccgagggggagccguggcu

SEQ ID NO: 844000 - RNA, 18 nt, Human
caccccugccugcucugc

SEQ ID NO: 844001 - RNA, 22 nt, Human
caccgcacccuggcgaggccug

SEQ ID NO: 844002 - RNA, 25 nt, Human
cacgggacucacggcccuggccacc

SEQ ID NO: 844003 - RNA, 18 nt, Human
cagaggaucuccuguucc

SEQ ID NO: 844004 - RNA, 19 nt, Human
cagcccagaucugcagcag

SEQ ID NO: 844005 - RNA, 19 nt, Human
cagcucacaggggcgacag

SEQ ID NO: 844006 - RNA, 20 nt, Human
ccagcucagcucacaggggc

SEQ ID NO: 844007 - RNA, 18 nt, Human
cccacguucauggccucc

SEQ ID NO: 844008 - RNA, 19 nt, Human
cccgcagcgcccagaaggc

SEQ ID NO: 844009 - RNA, 22 nt, Human
cccuggcgaggccuggcugcgc

SEQ ID NO: 844010 - RNA, 21 nt, Human
ccguggcugaggcgucuuguu

SEQ ID NO: 844011 - RNA, 19 nt, Human
ccuaaccagcucagcucac

SEQ ID NO: 844012 - RNA, 18 nt, Human
ccugugacuucacccugg

SEQ ID NO: 844013 - RNA, 23 nt, Human
ccuguucccgcagcgcccagaag

SEQ ID NO: 844014 - RNA, 24 nt, Human
cgccaccuucucugucacagucug

SEQ ID NO: 844015 - RNA, 20 nt, Human
cgcccagaaggcucugccac

SEQ ID NO: 844016 - RNA, 20 nt, Human
cgggcccggcccccaccccu

SEQ ID NO: 844017 - RNA, 23 nt, Human
cuccacaccccgggaccugugac

SEQ ID NO: 844018 - RNA, 24 nt, Human
cucugucacagucugugguuccua

SEQ ID NO: 844019 - RNA, 19 nt, Human
cugcacggccugcuccggg

SEQ ID NO: 844020 - RNA, 24 nt, Human
cugccugcucugcucugcaccgca

SEQ ID NO: 844021 - RNA, 24 nt, Human
cugcucugcucugcaccgcacccu

SEQ ID NO: 844022 - RNA, 23 nt, Human
gagugcucggcguagagcuucug

SEQ ID NO: 844023 - RNA, 22 nt, Human
gcaggaaagccggugcggcccu

SEQ ID NO: 844024 - RNA, 18 nt, Human
gcagggagugcucggcgu

SEQ ID NO: 844025 - RNA, 24 nt, Human
gcccagaaggcucugccacgggag

SEQ ID NO: 844026 - RNA, 26 nt, Human
gcccccaccccugccugcucugcucu

SEQ ID NO: 844027 - RNA, 18 nt, Human
ggcccuggccaccgcagc

SEQ ID NO: 844028 - RNA, 21 nt, Human
ggccuggcugcgcacgcgugu

SEQ ID NO: 844029 - RNA, 24 nt, Human
ggggcgacagaggaucuccuguuc

SEQ ID NO: 844030 - RNA, 23 nt, Human
gucacagucugugguuccuaacc

SEQ ID NO: 844031 - RNA, 20 nt, Human
gugggcagcgugcagaaggc

SEQ ID NO: 844032 - RNA, 20 nt, Human
gugggccucuucugggcugg

SEQ ID NO: 844033 - RNA, 18 nt, Human
uagcaucugcacggccug

SEQ ID NO: 844034 - RNA, 19 nt, Human
ucacggcccuggccaccgc

SEQ ID NO: 844035 - RNA, 18 nt, Human
ucugcaccgcacccuggc

SEQ ID NO: 844036 - RNA, 20 nt, Human
ucugcacggccugcuccggg

SEQ ID NO: 844037 - RNA, 20 nt, Human
ucugcucugcaccgcacccu

SEQ ID NO: 844038 - RNA, 20 nt, Human
ugcaccccagcgucucccuc

SEQ ID NO: 844039 - RNA, 18 nt, Human
ugccugcucugcucugca

SEQ ID NO: 844040 - RNA, 23 nt, Human
ugcucugcaccgcacccuggcga

SEQ ID NO: 844041 - RNA, 18 nt, Human
uggcagaaaggagaaagg

SEQ ID NO: 844042 - RNA, 22 nt, Human
uggcagaaaggagaaaggaugg

SEQ ID NO: 844043 - RNA, 25 nt, Human
uggcagaaaggagaaaggauggagc

SEQ ID NO: 844044 - RNA, 23 nt, Human
uucacccugguucgcagaugcac

SEQ ID NO: 844045 - RNA, 21 nt, Human
uuccuaaccagcucagcucac

SEQ ID NO: 844046 - RNA, 28 nt, Human
uucucugucacagucugugguuccuaac

SEQ ID NO: 844047 - RNA, 24 nt, Human
aggggauggguggacagcuggggg

SEQ ID NO: 844048 - RNA, 25 nt, Human
caaagagaacugagggaggagccag

SEQ ID NO: 844049 - RNA, 21 nt, Human
cagcuggggguuuuccaaaga

SEQ ID NO: 844050 - RNA, 23 nt, Human
ccgccgcugguucugcugucuac

SEQ ID NO: 844051 - RNA, 26 nt, Human
cuacuacagucucugcuuaggggccu

SEQ ID NO: 844052 - RNA, 22 nt, Human
cugccgucgucgcugucgccgc

SEQ ID NO: 844053 - RNA, 25 nt, Human
cuggggguuuuccaaagagaacuga

SEQ ID NO: 844054 - RNA, 20 nt, Human
gcaggggauggguggacagc

SEQ ID NO: 844055 - RNA, 27 nt, Human
gccgccgccgcugguucugcugucuac

SEQ ID NO: 844056 - RNA, 19 nt, Human
ggggauggguggacagcug

SEQ ID NO: 844057 - RNA, 21 nt, Human
ggggauggguggacagcuggg

SEQ ID NO: 844058 - RNA, 24 nt, Human
gguuuuggggcaggggaugggugg

SEQ ID NO: 844059 - RNA, 24 nt, Human
guaaauuuauugaaacugguuuug

SEQ ID NO: 844060 - RNA, 23 nt, Human
uagccgccgccgcugguucugcu

SEQ ID NO: 844061 - RNA, 20 nt, Human
ucgucgcugucgccgcuacc

SEQ ID NO: 844062 - RNA, 20 nt, Human
ugcuuagccgccgccgcugg

SEQ ID NO: 844063 - RNA, 21 nt, Human
uggggcaggggauggguggac

SEQ ID NO: 844064 - RNA, 20 nt, Human
uuuuuuggaaaugaacguaa

SEQ ID NO: 844065 - RNA, 23 nt, Human
uuuuuuuuuuuuuuuuuggaaau

SEQ ID NO: 844066 - RNA, 23 nt, Human
uuuuuuuuuuuuuuuuuuuuggg

SEQ ID NO: 844067 - RNA, 23 nt, Human
aaggcgcggucuggggaggaugc

SEQ ID NO: 844068 - RNA, 20 nt, Human
acaaacacccucaccaggac

SEQ ID NO: 844069 - RNA, 22 nt, Human
acaaacacccucaccaggacca

SEQ ID NO: 844070 - RNA, 21 nt, Human
acaaggcacaaacacccucac

SEQ ID NO: 844071 - RNA, 23 nt, Human
caaacacccucaccaggaccaaa

SEQ ID NO: 844072 - RNA, 23 nt, Human
caaauaaauaacuccacgguugc

SEQ ID NO: 844073 - RNA, 24 nt, Human
cacaaacacccucaccaggaccaa

SEQ ID NO: 844074 - RNA, 22 nt, Human
caccaggaccaaauaaauaacu

SEQ ID NO: 844075 - RNA, 27 nt, Human
cacccucaccaggaccaaauaaauaac

SEQ ID NO: 844076 - RNA, 21 nt, Human
cacugcacuguccugaccucu

SEQ ID NO: 844077 - RNA, 21 nt, Human
cccucaccaggaccaaauaaa

SEQ ID NO: 844078 - RNA, 24 nt, Human
cgccaggcauaggaggcauccaaa

SEQ ID NO: 844079 - RNA, 19 nt, Human
cugugaggggccuccuggg

SEQ ID NO: 844080 - RNA, 19 nt, Human
gaagaugucgugggccgug

SEQ ID NO: 844081 - RNA, 23 nt, Human
gcacaaacacccucaccaggacc

SEQ ID NO: 844082 - RNA, 19 nt, Human
gcccuccucccgacccucg

SEQ ID NO: 844083 - RNA, 23 nt, Human
gccucuagagcggguccagucuc

SEQ ID NO: 844084 - RNA, 23 nt, Human
gguugcaggaaggcgcggucugg

SEQ ID NO: 844085 - RNA, 21 nt, Human
gucucacaaggcacaaacacc

SEQ ID NO: 844086 - RNA, 22 nt, Human
guggagccuggcagagggucca

SEQ ID NO: 844087 - RNA, 22 nt, Human
gugggccgugugguggugccag

SEQ ID NO: 844088 - RNA, 21 nt, Human
uccacaggcuucccugcgaag

SEQ ID NO: 844089 - RNA, 18 nt, Human
uccacgguugcaggaagg

SEQ ID NO: 844090 - RNA, 18 nt, Human
ucccagggcuggugggcg

SEQ ID NO: 844091 - RNA, 21 nt, Human
ucccagggcuggugggcgagc

SEQ ID NO: 844092 - RNA, 21 nt, Human
uccuggguguguccgggccuc

SEQ ID NO: 844093 - RNA, 23 nt, Human
uccuggguguguccgggccucua

SEQ ID NO: 844094 - RNA, 22 nt, Human
ucucacaaggcacaaacacccu

SEQ ID NO: 844095 - RNA, 21 nt, Human
ucugcagucugugaggggccu

SEQ ID NO: 844096 - RNA, 22 nt, Human
ucugcagucugugaggggccuc

SEQ ID NO: 844097 - RNA, 20 nt, Human
ugcgaagaugucgugggccg

SEQ ID NO: 844098 - RNA, 22 nt, Human
ugcgaagaugucgugggccgug

SEQ ID NO: 844099 - RNA, 19 nt, Human
uggcagaggguccacaggc

SEQ ID NO: 844100 - RNA, 18 nt, Human
uggugccagcucagacaa

SEQ ID NO: 844101 - RNA, 18 nt, Human
uguacggagucucacaag

SEQ ID NO: 844102 - RNA, 18 nt, Human
ugugaggggccuccuggg

SEQ ID NO: 844103 - RNA, 23 nt, Human
uuuuuuuuuuuugaagaagagac

SEQ ID NO: 844104 - RNA, 18 nt, Human
uuuuuuuuuuuuuuuuug

SEQ ID NO: 844105 - RNA, 18 nt, Human
aacugagccucacaaggu

SEQ ID NO: 844106 - RNA, 19 nt, Human
aagguccgcccccgccccc

SEQ ID NO: 844107 - RNA, 18 nt, Human
aggagcagugcccucggc

SEQ ID NO: 844108 - RNA, 18 nt, Human
cacagagccggguguggg

SEQ ID NO: 844109 - RNA, 21 nt, Human
cccgcggccgguggcaguggg

SEQ ID NO: 844110 - RNA, 21 nt, Human
ccggcggugcaacgcaccgag

SEQ ID NO: 844111 - RNA, 18 nt, Human
ccucggccgagccagucc

SEQ ID NO: 844112 - RNA, 18 nt, Human
ccugcgccugccgggugg

SEQ ID NO: 844113 - RNA, 19 nt, Human
cgcucggccgccgcggggc

SEQ ID NO: 844114 - RNA, 24 nt, Human
cggugcaacgcaccgaggcgcuuc

SEQ ID NO: 844115 - RNA, 20 nt, Human
cucacaagguccgcccccgc

SEQ ID NO: 844116 - RNA, 21 nt, Human
cuggcggcugcgggcugcggc

SEQ ID NO: 844117 - RNA, 23 nt, Human
gagccagucccagccagucccgc

SEQ ID NO: 844118 - RNA, 24 nt, Human
gagcgcgcucggccgccgcggggc

SEQ ID NO: 844119 - RNA, 18 nt, Human
gcgagcgcgcucggccgc

SEQ ID NO: 844120 - RNA, 19 nt, Human
gcgggcgagggucggccgu

SEQ ID NO: 844121 - RNA, 20 nt, Human
ggaggcuggcggcugcgggc

SEQ ID NO: 844122 - RNA, 21 nt, Human
guaaagaaggccagagggccc

SEQ ID NO: 844123 - RNA, 19 nt, Human
gugggcgccgacggacagc

SEQ ID NO: 844124 - RNA, 23 nt, Human
guuuucagguugcaaguaacggg

SEQ ID NO: 844125 - RNA, 24 nt, Human
uaacgggucaacugagccucacaa

SEQ ID NO: 844126 - RNA, 19 nt, Human
ucagguugcaaguaacggg

SEQ ID NO: 844127 - RNA, 19 nt, Human
uccagcgccgagcagcgcu

SEQ ID NO: 844128 - RNA, 22 nt, Human
ugcaaugcugcggggggcagcc

SEQ ID NO: 844129 - RNA, 21 nt, Human
ugccgccgggcagugggcgcc

SEQ ID NO: 844130 - RNA, 18 nt, Human
ugggcgccgacggacagc

SEQ ID NO: 844131 - RNA, 21 nt, Human
ugguagaugggggugcugggg

SEQ ID NO: 844132 - RNA, 19 nt, Human
uuuuuuuuuuuuuuuuuaa

SEQ ID NO: 844133 - RNA, 19 nt, Human
acagugcaugcaauaaaau

SEQ ID NO: 844134 - RNA, 18 nt, Human
acgagauccaagccagcc

SEQ ID NO: 844135 - RNA, 25 nt, Human
acgcuacagaacgagggggacagac

SEQ ID NO: 844136 - RNA, 22 nt, Human
aggggcucugaggguccagagc

SEQ ID NO: 844137 - RNA, 26 nt, Human
agggggacagacacgcgugggguaag

SEQ ID NO: 844138 - RNA, 27 nt, Human
cacagugcaugcaauaaaauauauaua

SEQ ID NO: 844139 - RNA, 23 nt, Human
cacugggaccaggagagcagaac

SEQ ID NO: 844140 - RNA, 20 nt, Human
ccacggggagcagagggagc

SEQ ID NO: 844141 - RNA, 20 nt, Human
ccagaucgcaggaggugcgg

SEQ ID NO: 844142 - RNA, 19 nt, Human
ccaguggcgcucccuggcg

SEQ ID NO: 844143 - RNA, 18 nt, Human
cccacggggagcagaggg

SEQ ID NO: 844144 - RNA, 24 nt, Human
cccuucggguggcgggaagccagu

SEQ ID NO: 844145 - RNA, 24 nt, Human
ccgccggggugggcuggccuggga

SEQ ID NO: 844146 - RNA, 21 nt, Human
ccugggaguggggggcgcucc

SEQ ID NO: 844147 - RNA, 23 nt, Human
ccugggcgcgcggggcccggucc

SEQ ID NO: 844148 - RNA, 24 nt, Human
cgcgugggguaagaagggccuggu

SEQ ID NO: 844149 - RNA, 19 nt, Human
cgucccccuucuguucucc

SEQ ID NO: 844150 - RNA, 22 nt, Human
cgucccccuucuguucuccccc

SEQ ID NO: 844151 - RNA, 19 nt, Human
gagcggcccacggggagca

SEQ ID NO: 844152 - RNA, 23 nt, Human
gccucgccugggcgcgcggggcc

SEQ ID NO: 844153 - RNA, 19 nt, Human
gcggccaggccgggcugga

SEQ ID NO: 844154 - RNA, 22 nt, Human
gcgugggguaagaagggccugg

SEQ ID NO: 844155 - RNA, 25 nt, Human
gggaagccaguggcgcucccuggcg

SEQ ID NO: 844156 - RNA, 21 nt, Human
gggcuggagccacaugcgucg

SEQ ID NO: 844157 - RNA, 23 nt, Human
uaaaaacgagauccaagccagcc

SEQ ID NO: 844158 - RNA, 24 nt, Human
ugaggguccagagcucccuucggg

SEQ ID NO: 844159 - RNA, 18 nt, Human
uggccugggagugggggg

SEQ ID NO: 844160 - RNA, 20 nt, Human
uggcggccaggccgggcugg

SEQ ID NO: 844161 - RNA, 21 nt, Human
uggcggccaggccgggcugga

SEQ ID NO: 844162 - RNA, 21 nt, Human
uguacaaacgcuacagaacga

SEQ ID NO: 844163 - RNA, 24 nt, Human
uuauuauguacaaacgcuacagaa

SEQ ID NO: 844164 - RNA, 19 nt, Human
uuuuuuuuuuuuuuugucu

SEQ ID NO: 844165 - RNA, 18 nt, Human
uuuuuuuuuuuuuuuuug

SEQ ID NO: 844166 - RNA, 19 nt, Human
uuuuuuuuuuuuuuuuugu

SEQ ID NO: 844167 - RNA, 24 nt, Human
agggcagagucaggugccgggggc

SEQ ID NO: 844168 - RNA, 22 nt, Human
augugaugcaacuauuuggccu

SEQ ID NO: 844169 - RNA, 21 nt, Human
caggaagugcucagcuggacu

SEQ ID NO: 844170 - RNA, 19 nt, Human
gaaaacaucguguggauaa

SEQ ID NO: 844171 - RNA, 20 nt, Human
gagggcagugagcaggagcu

SEQ ID NO: 844172 - RNA, 20 nt, Human
gcaggaagugcucagcugga

SEQ ID NO: 844173 - RNA, 21 nt, Human
gcaggaagugcucagcuggac

SEQ ID NO: 844174 - RNA, 22 nt, Human
ugagggcagugagcaggagcug

SEQ ID NO: 844175 - RNA, 24 nt, Human
uucugagggcagugagcaggagcu

SEQ ID NO: 844176 - RNA, 21 nt, Human
uuuuuuuuuuuuuuuuuuaag

SEQ ID NO: 844177 - RNA, 24 nt, Human
auuuuucucggcaccgcucccgau

SEQ ID NO: 844178 - RNA, 19 nt, Human
ccuggucugguuccgcggg

SEQ ID NO: 844179 - RNA, 20 nt, Human
gcagucgggcggcccucgug

SEQ ID NO: 844180 - RNA, 22 nt, Human
uggcagucgggcggcccucgug

SEQ ID NO: 844181 - RNA, 22 nt, Human
uuccgcgggcgcggccgggccg

SEQ ID NO: 844182 - RNA, 20 nt, Human
uuucucggcaccgcucccga

SEQ ID NO: 844183 - RNA, 19 nt, Human
aacccggaagcuaccggcu

SEQ ID NO: 844184 - RNA, 21 nt, Human
acacugggucugucuccuuuu

SEQ ID NO: 844185 - RNA, 19 nt, Human
acccggaagcuaccggcua

SEQ ID NO: 844186 - RNA, 18 nt, Human
aggaaacccggaagcuac

SEQ ID NO: 844187 - RNA, 21 nt, Human
auggggugugagaaacccauc

SEQ ID NO: 844188 - RNA, 18 nt, Human
cacugccaggcccguggg

SEQ ID NO: 844189 - RNA, 22 nt, Human
cagcaccagccugagaagggag

SEQ ID NO: 844190 - RNA, 20 nt, Human
ccacaccucucacugccagg

SEQ ID NO: 844191 - RNA, 22 nt, Human
ccagccuucaggacuggagucc

SEQ ID NO: 844192 - RNA, 21 nt, Human
ccagggcuucccccauccccu

SEQ ID NO: 844193 - RNA, 20 nt, Human
cuaggaugggaaaggaggua

SEQ ID NO: 844194 - RNA, 19 nt, Human
cuuugggggacacuggguc

SEQ ID NO: 844195 - RNA, 23 nt, Human
gaggaggagacagaagcaugugc

SEQ ID NO: 844196 - RNA, 20 nt, Human
gaggaggaggagacagaagc

SEQ ID NO: 844197 - RNA, 22 nt, Human
gagucacagauccagucuuugg

SEQ ID NO: 844198 - RNA, 25 nt, Human
gcaugugcugcaggcgcaugugugu

SEQ ID NO: 844199 - RNA, 18 nt, Human
gcugccugcagccagggc

SEQ ID NO: 844200 - RNA, 20 nt, Human
gcuucagccucacccuaucc

SEQ ID NO: 844201 - RNA, 18 nt, Human
ggaaggcugccugcagcc

SEQ ID NO: 844202 - RNA, 18 nt, Human
ggaggagacagaagcaug

SEQ ID NO: 844203 - RNA, 25 nt, Human
ggagucacagauccagucuuugggg

SEQ ID NO: 844204 - RNA, 20 nt, Human
gggaggaggaggagacagaa

SEQ ID NO: 844205 - RNA, 25 nt, Human
gggggacacugggucugucuccuuu

SEQ ID NO: 844206 - RNA, 22 nt, Human
uagcccaggaaacccggaagcu

SEQ ID NO: 844207 - RNA, 18 nt, Human
uaggaaggauccagcacc

SEQ ID NO: 844208 - RNA, 24 nt, Human
uaggaaggauccagcaccagccug

SEQ ID NO: 844209 - RNA, 21 nt, Human
uaucauaaaucgguguggggc

SEQ ID NO: 844210 - RNA, 18 nt, Human
uauguacuuacaugugug

SEQ ID NO: 844211 - RNA, 26 nt, Human
uauguacuuacaugugugaacacaua

SEQ ID NO: 844212 - RNA, 18 nt, Human
ucaaggacagucuaggau

SEQ ID NO: 844213 - RNA, 18 nt, Human
uccaagggacagacauau

SEQ ID NO: 844214 - RNA, 25 nt, Human
uccuuuugaaagcccuggaaaggug

SEQ ID NO: 844215 - RNA, 18 nt, Human
ugaaagcccuggaaaggu

SEQ ID NO: 844216 - RNA, 24 nt, Human
uggggccacaccucucacugccag

SEQ ID NO: 844217 - RNA, 21 nt, Human
ugguggagucacagauccagu

SEQ ID NO: 844218 - RNA, 18 nt, Human
ugugagaaacccaucccc

SEQ ID NO: 844219 - RNA, 22 nt, Human
uguguauguacuuacaugugug

SEQ ID NO: 844220 - RNA, 18 nt, Human
uguguguauguacuuaca

SEQ ID NO: 844221 - RNA, 18 nt, Human
uuuuuuuuuuuuuuuuug

SEQ ID NO: 844222 - RNA, 25 nt, Human
uuuuuuuuuuuuuuuuuuuuuuggg

SEQ ID NO: 844223 - RNA, 22 nt, Human
aagccacacccgggacugaggc

SEQ ID NO: 844224 - RNA, 20 nt, Human
acacugccucugcccuccuc

SEQ ID NO: 844225 - RNA, 22 nt, Human
acugccucugcccuccuccaag

SEQ ID NO: 844226 - RNA, 22 nt, Human
agaaggccaaagcacaucauca

SEQ ID NO: 844227 - RNA, 19 nt, Human
aggcccuccucccccaucc

SEQ ID NO: 844228 - RNA, 18 nt, Human
auccagccggcaauccua

SEQ ID NO: 844229 - RNA, 24 nt, Human
caaaucuuaggcuuuugagucaca

SEQ ID NO: 844230 - RNA, 24 nt, Human
caggacagucccgagaaggccaaa

SEQ ID NO: 844231 - RNA, 21 nt, Human
cagggacagugcccggaggag

SEQ ID NO: 844232 - RNA, 25 nt, Human
cccacacugccucugcccuccucca

SEQ ID NO: 844233 - RNA, 18 nt, Human
cccgggacugaggccagg

SEQ ID NO: 844234 - RNA, 22 nt, Human
cccgggacugaggccaggcccu

SEQ ID NO: 844235 - RNA, 21 nt, Human
cccuaccacggaccccagggg

SEQ ID NO: 844236 - RNA, 22 nt, Human
cccuaccacggaccccaggggc

SEQ ID NO: 844237 - RNA, 21 nt, Human
cccuccucccccauccugucc

SEQ ID NO: 844238 - RNA, 23 nt, Human
ccuaccacggaccccaggggcug

SEQ ID NO: 844239 - RNA, 18 nt, Human
ccucaggggagggagggg

SEQ ID NO: 844240 - RNA, 18 nt, Human
ccuccuggcacccccugg

SEQ ID NO: 844241 - RNA, 22 nt, Human
ccuccuggcacccccuggcuau

SEQ ID NO: 844242 - RNA, 23 nt, Human
ccuggcuauucagucagcccugc

SEQ ID NO: 844243 - RNA, 23 nt, Human
cggggugagcccaucacuguagc

SEQ ID NO: 844244 - RNA, 19 nt, Human
cugccucugcccuccucca

SEQ ID NO: 844245 - RNA, 18 nt, Human
cuguccugccucaccugu

SEQ ID NO: 844246 - RNA, 23 nt, Human
gagaaggccaaagcacaucauca

SEQ ID NO: 844247 - RNA, 22 nt, Human
gccaaagcacaucaucagccca

SEQ ID NO: 844248 - RNA, 22 nt, Human
gcccacacugccucugcccucc

SEQ ID NO: 844249 - RNA, 21 nt, Human
gcccuccuccaaggccccucc

SEQ ID NO: 844250 - RNA, 19 nt, Human
ggcccggaguagcccccaa

SEQ ID NO: 844251 - RNA, 20 nt, Human
gggagggaggggcccuacca

SEQ ID NO: 844252 - RNA, 21 nt, Human
ggugacaggacagucccgaga

SEQ ID NO: 844253 - RNA, 25 nt, Human
ucaaagccacacccgggacugaggc

SEQ ID NO: 844254 - RNA, 23 nt, Human
ucaccuguccucaggggagggag

SEQ ID NO: 844255 - RNA, 20 nt, Human
uccugccucaccuguccuca

SEQ ID NO: 844256 - RNA, 21 nt, Human
ucuuaggcuuuugagucacau

SEQ ID NO: 844257 - RNA, 18 nt, Human
ucuuuuuuuuuuuuuuuu

SEQ ID NO: 844258 - RNA, 23 nt, Human
uggcggggugagcccaucacugu

SEQ ID NO: 844259 - RNA, 23 nt, Human
uggcuauucagucagcccugccu

SEQ ID NO: 844260 - RNA, 21 nt, Human
uguccugccucaccuguccuc

SEQ ID NO: 844261 - RNA, 18 nt, Human
uuuuuuuuuuuuuuuuug

SEQ ID NO: 844262 - RNA, 19 nt, Human
uuuuuuuuuuuuuuuuugu

SEQ ID NO: 844263 - RNA, 27 nt, Human
uuuuuuuuuuuuuuuuuuguaucaggg

SEQ ID NO: 844264 - RNA, 25 nt, Human
uuuuuuuuuuuuuuuuuuucuuuuu

SEQ ID NO: 844265 - RNA, 19 nt, Human
aaucuguauauucuucccu

SEQ ID NO: 844266 - RNA, 21 nt, Human
accgacaggcaccgcgcgagc

SEQ ID NO: 844267 - RNA, 28 nt, Human
agaaacaaggaaggggaagccgguaccc

SEQ ID NO: 844268 - RNA, 19 nt, Human
aggaagaaaaaagccucuu

SEQ ID NO: 844269 - RNA, 18 nt, Human
aggcgcuggcgacccgcc

SEQ ID NO: 844270 - RNA, 20 nt, Human
aguguaggugacgcgggcug

SEQ ID NO: 844271 - RNA, 19 nt, Human
aucccauuuuccuucucac

SEQ ID NO: 844272 - RNA, 19 nt, Human
cagaguagaggccacacag

SEQ ID NO: 844273 - RNA, 21 nt, Human
cauuuuccuucucacuggggg

SEQ ID NO: 844274 - RNA, 23 nt, Human
ccccgccgccccgcacgcgacua

SEQ ID NO: 844275 - RNA, 20 nt, Human
ccccgccgccccgccgcccc

SEQ ID NO: 844276 - RNA, 27 nt, Human
cccgcacgcgacuaccgacaggcaccg

SEQ ID NO: 844277 - RNA, 30 nt, Human
cccgcacgcgacuaccgacaggcaccgcgg

SEQ ID NO: 844278 - RNA, 20 nt, Human
cccucugacuguguggcucc

SEQ ID NO: 844279 - RNA, 21 nt, Human
cccucuguuuuaaaaagaagg

SEQ ID NO: 844280 - RNA, 22 nt, Human
ccgccccgccgccccgccgccc

SEQ ID NO: 844281 - RNA, 18 nt, Human
ccgccgccggccgccccg

SEQ ID NO: 844282 - RNA, 21 nt, Human
ccgccggccgccccgccgccc

SEQ ID NO: 844283 - RNA, 18 nt, Human
cucugcuuuagaauaacc

SEQ ID NO: 844284 - RNA, 22 nt, Human
cucugcuuuagaauaaccuggg

SEQ ID NO: 844285 - RNA, 23 nt, Human
cugaaacagugucccagacuuau

SEQ ID NO: 844286 - RNA, 19 nt, Human
cugcuuuagaauaaccugg

SEQ ID NO: 844287 - RNA, 20 nt, Human
cuuacaucccccucugacug

SEQ ID NO: 844288 - RNA, 19 nt, Human
gacuuaucccauuuuccuu

SEQ ID NO: 844289 - RNA, 21 nt, Human
ggccuggggcacaaugggugg

SEQ ID NO: 844290 - RNA, 19 nt, Human
gguggagcugcgcaauggg

SEQ ID NO: 844291 - RNA, 21 nt, Human
gucugugcaucugggcugagc

SEQ ID NO: 844292 - RNA, 20 nt, Human
uagaacacacucaauucucc

SEQ ID NO: 844293 - RNA, 18 nt, Human
uaucccauuuuccuucuc

SEQ ID NO: 844294 - RNA, 23 nt, Human
uaucccauuuuccuucucacugg

SEQ ID NO: 844295 - RNA, 25 nt, Human
uaucccauuuuccuucucacugggg

SEQ ID NO: 844296 - RNA, 22 nt, Human
ucccagacuuaucccauuuucc

SEQ ID NO: 844297 - RNA, 18 nt, Human
ucccaggcacagcugccc

SEQ ID NO: 844298 - RNA, 21 nt, Human
uccugucccaggcacagcugc

SEQ ID NO: 844299 - RNA, 24 nt, Human
ucugcuuuagaauaaccugggggu

SEQ ID NO: 844300 - RNA, 25 nt, Human
ucuguagauggcuuaaauaacucuu

SEQ ID NO: 844301 - RNA, 21 nt, Human
ugacuguguggcuccuguccc

SEQ ID NO: 844302 - RNA, 21 nt, Human
ugccuucacuuagaacacacu

SEQ ID NO: 844303 - RNA, 19 nt, Human
uggcagggcacagaaggaa

SEQ ID NO: 844304 - RNA, 20 nt, Human
uguauauucuucccucuguu

SEQ ID NO: 844305 - RNA, 23 nt, Human
ugugaugacagaggagggucaac

SEQ ID NO: 844306 - RNA, 18 nt, Human
uguucagaguagaggcca

SEQ ID NO: 844307 - RNA, 19 nt, Human
uguuuuaaaaagaaggaga

SEQ ID NO: 844308 - RNA, 26 nt, Human
uucccucuguuuuaaaaagaaggagc

SEQ ID NO: 844309 - RNA, 22 nt, Human
uuccucagcucuguagauggcu

SEQ ID NO: 844310 - RNA, 18 nt, Human
uuugucagagaagguggc

SEQ ID NO: 844311 - RNA, 23 nt, Human
uuuuuuuuuuuuuuuuuuuaagg

SEQ ID NO: 844312 - RNA, 23 nt, Human
aaaaaacaaaaacaaaaacugaa

SEQ ID NO: 844313 - RNA, 21 nt, Human
aaaacaaaaacaaaaacugaa

SEQ ID NO: 844314 - RNA, 28 nt, Human
aaaacaaaaacaaaaacugaaagcugga

SEQ ID NO: 844315 - RNA, 19 nt, Human
aaacaaaaacaaaaacuga

SEQ ID NO: 844316 - RNA, 25 nt, Human
aaacaaaaacaaaaacugaaagcug

SEQ ID NO: 844317 - RNA, 27 nt, Human
aaacaaaaacaaaaacugaaagcugga

SEQ ID NO: 844318 - RNA, 26 nt, Human
aaauaaugguuaaaaaacaaaaacaa

SEQ ID NO: 844319 - RNA, 18 nt, Human
aacugaauacuucuucca

SEQ ID NO: 844320 - RNA, 23 nt, Human
aaggaaacugaauacuucuucca

SEQ ID NO: 844321 - RNA, 22 nt, Human
agaaaaacuugcaggauaacca

SEQ ID NO: 844322 - RNA, 20 nt, Human
agaaaggaaaaggaaacuga

SEQ ID NO: 844323 - RNA, 22 nt, Human
agagcagacagacuaagccagg

SEQ ID NO: 844324 - RNA, 19 nt, Human
aggaaagaggaggaagagg

SEQ ID NO: 844325 - RNA, 20 nt, Human
aggaaagaggaggaagaggg

SEQ ID NO: 844326 - RNA, 25 nt, Human
aggaggaagagggcaugaggucuga

SEQ ID NO: 844327 - RNA, 21 nt, Human
aggauaaccacacccaacaga

SEQ ID NO: 844328 - RNA, 18 nt, Human
agggaaccgguuggacug

SEQ ID NO: 844329 - RNA, 18 nt, Human
agggaggggggaauagua

SEQ ID NO: 844330 - RNA, 23 nt, Human
agggaggggggaauaguauaaag

SEQ ID NO: 844331 - RNA, 24 nt, Human
agggaggggggaauaguauaaagg

SEQ ID NO: 844332 - RNA, 21 nt, Human
cagaggacuacuacaaacaga

SEQ ID NO: 844333 - RNA, 22 nt, Human
cagcagaugcugcagagcagac

SEQ ID NO: 844334 - RNA, 27 nt, Human
cagcguagugugaguaggagggccccc

SEQ ID NO: 844335 - RNA, 18 nt, Human
caguggcucuugugucca

SEQ ID NO: 844336 - RNA, 24 nt, Human
ccagguauuccuucaugaucccag

SEQ ID NO: 844337 - RNA, 22 nt, Human
cccacagcagaugcugcagagc

SEQ ID NO: 844338 - RNA, 20 nt, Human
cccuccuccucaaaaaaaag

SEQ ID NO: 844339 - RNA, 22 nt, Human
cgaccuuaaggggcacuguuug

SEQ ID NO: 844340 - RNA, 20 nt, Human
cgccgaccuuaaggggcacu

SEQ ID NO: 844341 - RNA, 18 nt, Human
cuuaaaaucuccaaguuc

SEQ ID NO: 844342 - RNA, 24 nt, Human
cuuggcuguugugcaguggcucuu

SEQ ID NO: 844343 - RNA, 21 nt, Human
gaaggugaugcccuccuccuc

SEQ ID NO: 844344 - RNA, 18 nt, Human
gaggaagagggcaugagg

SEQ ID NO: 844345 - RNA, 18 nt, Human
gcaggucucaaaguuccu

SEQ ID NO: 844346 - RNA, 22 nt, Human
gcugcagagcagacagacuaag

SEQ ID NO: 844347 - RNA, 23 nt, Human
ggaggggggaauaguauaaagga

SEQ ID NO: 844348 - RNA, 26 nt, Human
gggaggggggaauaguauaaaggagg

SEQ ID NO: 844349 - RNA, 19 nt, Human
gggggaauaguauaaagga

SEQ ID NO: 844350 - RNA, 20 nt, Human
ggggggaauaguauaaagga

SEQ ID NO: 844351 - RNA, 24 nt, Human
guaaauaaugguuaaaaaacaaaa

SEQ ID NO: 844352 - RNA, 22 nt, Human
guuaccagagaaaggaaaagga

SEQ ID NO: 844353 - RNA, 23 nt, Human
uaaaaaacaaaaacaaaaacuga

SEQ ID NO: 844354 - RNA, 22 nt, Human
uccucaaaaaaaagggaggggg

SEQ ID NO: 844355 - RNA, 19 nt, Human
uccucaaggaugaaaacuc

SEQ ID NO: 844356 - RNA, 20 nt, Human
ugagacaugaggaccugaaa

SEQ ID NO: 844357 - RNA, 21 nt, Human
ugccucaggaaucgaguccag

SEQ ID NO: 844358 - RNA, 20 nt, Human
uggcuguugugcaguggcuc

SEQ ID NO: 844359 - RNA, 21 nt, Human
uguccuuuucuuaaaaucucc

SEQ ID NO: 844360 - RNA, 23 nt, Human
uucaugguccugacuacuucacc

SEQ ID NO: 844361 - RNA, 22 nt, Human
uuuuuuuuuuuuagagauucca

SEQ ID NO: 844362 - RNA, 21 nt, Human
aaacaaaggcugcaggcucca

SEQ ID NO: 844363 - RNA, 24 nt, Human
aaugagccccuaccccagccaccc

SEQ ID NO: 844364 - RNA, 20 nt, Human
agccccuaccccagccaccc

SEQ ID NO: 844365 - RNA, 24 nt, Human
agcggugaccgauccagaccaggu

SEQ ID NO: 844366 - RNA, 22 nt, Human
auaguuggucuggaacaaguac

SEQ ID NO: 844367 - RNA, 21 nt, Human
caaugagccccuaccccagcc

SEQ ID NO: 844368 - RNA, 24 nt, Human
caaugagccccuaccccagccacc

SEQ ID NO: 844369 - RNA, 19 nt, Human
caccacaauuuccgccuca

SEQ ID NO: 844370 - RNA, 23 nt, Human
cccagcggugaccgauccagacc

SEQ ID NO: 844371 - RNA, 26 nt, Human
ccccagccacccgcugcguuugcgcc

SEQ ID NO: 844372 - RNA, 21 nt, Human
ccccgagccgccgccgcgcuc

SEQ ID NO: 844373 - RNA, 19 nt, Human
cccggaagcccggccugcc

SEQ ID NO: 844374 - RNA, 21 nt, Human
cccggaagcccggccugcccg

SEQ ID NO: 844375 - RNA, 23 nt, Human
ccgccgcgcuccgugggcuccca

SEQ ID NO: 844376 - RNA, 19 nt, Human
cggcccccgagccgccgcc

SEQ ID NO: 844377 - RNA, 28 nt, Human
cuucccguucuucuggaugggcauccua

SEQ ID NO: 844378 - RNA, 18 nt, Human
ucccaaugagccccuacc

SEQ ID NO: 844379 - RNA, 19 nt, Human
ucccggaagcccggccugc

SEQ ID NO: 844380 - RNA, 23 nt, Human
uccgugggcucccaaugagcccc

SEQ ID NO: 844381 - RNA, 25 nt, Human
uccgugggcucccaaugagccccua

SEQ ID NO: 844382 - RNA, 19 nt, Human
ucuggaacaaguacaccac

SEQ ID NO: 844383 - RNA, 22 nt, Human
ucuuuauaaguuaaacaaaggc

SEQ ID NO: 844384 - RNA, 24 nt, Human
ucuuuauaaguuaaacaaaggcug

SEQ ID NO: 844385 - RNA, 22 nt, Human
ugagccccuaccccagccaccc

SEQ ID NO: 844386 - RNA, 24 nt, Human
uuauaaguuaaacaaaggcugcag

SEQ ID NO: 844387 - RNA, 18 nt, Human
uuugcgccagccuccccc

SEQ ID NO: 844388 - RNA, 25 nt, Human
uuuuuuuucuuuuuuuuuuuguuuu

SEQ ID NO: 844389 - RNA, 27 nt, Human
uuuuuuuuuuucuuuuuuuuuuugggg

SEQ ID NO: 844390 - RNA, 24 nt, Human
uuuuuuuuuuuuuuuuuucuuuuu

SEQ ID NO: 844391 - RNA, 20 nt, Human
aaaaagacacuccggacaua

SEQ ID NO: 844392 - RNA, 23 nt, Human
aacagaaccaccuacacacauga

SEQ ID NO: 844393 - RNA, 23 nt, Human
aacaggacuguucagggagccug

SEQ ID NO: 844394 - RNA, 23 nt, Human
aauuguugccuuuaauaauuuca

SEQ ID NO: 844395 - RNA, 20 nt, Human
agacaaagguaccuccccuc

SEQ ID NO: 844396 - RNA, 21 nt, Human
aggcuggaaggcucuaguggg

SEQ ID NO: 844397 - RNA, 19 nt, Human
caaagguaccuccccucug

SEQ ID NO: 844398 - RNA, 24 nt, Human
caccuaacauuacaauaugaaaac

SEQ ID NO: 844399 - RNA, 19 nt, Human
cagccgcaccggaggccug

SEQ ID NO: 844400 - RNA, 24 nt, Human
cauugcagccgcaccggaggccug

SEQ ID NO: 844401 - RNA, 18 nt, Human
ccccucugagaacaccua

SEQ ID NO: 844402 - RNA, 18 nt, Human
ccgccgccgccgccgccg

SEQ ID NO: 844403 - RNA, 24 nt, Human
ccgccgccgccgccgccgccgccg

SEQ ID NO: 844404 - RNA, 25 nt, Human
ccgccgccgccgccgccgccgccgg

SEQ ID NO: 844405 - RNA, 23 nt, Human
ccgccgccgccgccgccgccgga

SEQ ID NO: 844406 - RNA, 24 nt, Human
ccgccgccgccgccgccggaccga

SEQ ID NO: 844407 - RNA, 19 nt, Human
ccggaccgagggauacgac

SEQ ID NO: 844408 - RNA, 25 nt, Human
ccuccgcuaccgccgccgccgccgg

SEQ ID NO: 844409 - RNA, 22 nt, Human
cggaggccugaaaccgucuccu

SEQ ID NO: 844410 - RNA, 19 nt, Human
cuaccgccgccgccgccgc

SEQ ID NO: 844411 - RNA, 22 nt, Human
cugcucuuagaacacaccagaa

SEQ ID NO: 844412 - RNA, 28 nt, Human
gaacaccuaacauuacaauaugaaaacg

SEQ ID NO: 844413 - RNA, 19 nt, Human
gggccugcuuauuaaaaau

SEQ ID NO: 844414 - RNA, 21 nt, Human
gggcuggcucccagguggagc

SEQ ID NO: 844415 - RNA, 24 nt, Human
gggcuggcucccagguggagccug

SEQ ID NO: 844416 - RNA, 22 nt, Human
gucuccuccgcuaccgccgccg

SEQ ID NO: 844417 - RNA, 23 nt, Human
uaacacaacagaaccaccuacac

SEQ ID NO: 844418 - RNA, 20 nt, Human
uaccgccgccgccgccgccc

SEQ ID NO: 844419 - RNA, 19 nt, Human
uagaacacaccagaaggcu

SEQ ID NO: 844420 - RNA, 25 nt, Human
uagaacacaccagaaggcuggaagg

SEQ ID NO: 844421 - RNA, 20 nt, Human
ucccagguggagccugcucu

SEQ ID NO: 844422 - RNA, 18 nt, Human
uccuccgcuaccgccgcc

SEQ ID NO: 844423 - RNA, 23 nt, Human
uccuccgcuaccgccgccgccgc

SEQ ID NO: 844424 - RNA, 18 nt, Human
ugaguaaaaagacacucc

SEQ ID NO: 844425 - RNA, 24 nt, Human
uggaaacguugauuagacaaaggu

SEQ ID NO: 844426 - RNA, 24 nt, Human
uggagccugcucuuagaacacacc

SEQ ID NO: 844427 - RNA, 21 nt, Human
uuagaacacaccagaaggcug

SEQ ID NO: 844428 - RNA, 24 nt, Human
uucuucuaaauuguugccuuuaau

SEQ ID NO: 844429 - RNA, 23 nt, Human
uuuccuggacagugcagacagug

SEQ ID NO: 844430 - RNA, 24 nt, Human
uuuuuuuuuuuuuucuucuaaauu

SEQ ID NO: 844431 - RNA, 18 nt, Human
aaacaaagaccuccuucc

SEQ ID NO: 844432 - RNA, 22 nt, Human
aauguauagcaagccaccauca

SEQ ID NO: 844433 - RNA, 23 nt, Human
acaagcccugcccacagaggucu

SEQ ID NO: 844434 - RNA, 18 nt, Human
accccugaaaaggucauc

SEQ ID NO: 844435 - RNA, 19 nt, Human
accuacaaacaaccaguaa

SEQ ID NO: 844436 - RNA, 20 nt, Human
agaagguaccccugcaaagg

SEQ ID NO: 844437 - RNA, 22 nt, Human
agcuggugacccuggagagccu

SEQ ID NO: 844438 - RNA, 22 nt, Human
aggaagaagcugaccugcaaug

SEQ ID NO: 844439 - RNA, 21 nt, Human
agggcaggacugggcagagga

SEQ ID NO: 844440 - RNA, 20 nt, Human
aggguuggggccagaaggua

SEQ ID NO: 844441 - RNA, 19 nt, Human
auacauccuacaaacaaag

SEQ ID NO: 844442 - RNA, 19 nt, Human
aucacagucacaucccuga

SEQ ID NO: 844443 - RNA, 21 nt, Human
auggcugaagccuuaucuaca

SEQ ID NO: 844444 - RNA, 19 nt, Human
caacacuccccagacaagg

SEQ ID NO: 844445 - RNA, 18 nt, Human
caagaaguagaaaagaaa

SEQ ID NO: 844446 - RNA, 22 nt, Human
caauuaucuggacagacaacga

SEQ ID NO: 844447 - RNA, 21 nt, Human
cacauuuucccuccccaccca

SEQ ID NO: 844448 - RNA, 19 nt, Human
cacccacaagcccugccca

SEQ ID NO: 844449 - RNA, 25 nt, Human
cacccauguaaagcuugucccaaaa

SEQ ID NO: 844450 - RNA, 19 nt, Human
cagagcuccacaguguccc

SEQ ID NO: 844451 - RNA, 18 nt, Human
cagaggucuucucccuga

SEQ ID NO: 844452 - RNA, 18 nt, Human
cagaggugagugagguag

SEQ ID NO: 844453 - RNA, 22 nt, Human
ccaaaaaagcuguucuuugaug

SEQ ID NO: 844454 - RNA, 18 nt, Human
ccagagcggagugcaucu

SEQ ID NO: 844455 - RNA, 19 nt, Human
cccaaaaaagcuguucuuu

SEQ ID NO: 844456 - RNA, 22 nt, Human
ccccacaugcagauucucccug

SEQ ID NO: 844457 - RNA, 22 nt, Human
ccccugcaaaggugcauugccc

SEQ ID NO: 844458 - RNA, 22 nt, Human
cccuacacauaaacuucucucc

SEQ ID NO: 844459 - RNA, 21 nt, Human
cccuccccacccauguaaagc

SEQ ID NO: 844460 - RNA, 27 nt, Human
ccuguggcugagagugaguuccagagc

SEQ ID NO: 844461 - RNA, 21 nt, Human
cgcucacauacagaguacaug

SEQ ID NO: 844462 - RNA, 18 nt, Human
cucaaggccgacugaugg

SEQ ID NO: 844463 - RNA, 21 nt, Human
cucccuguggcugagagugag

SEQ ID NO: 844464 - RNA, 22 nt, Human
cucuauacucauaaggcuccuc

SEQ ID NO: 844465 - RNA, 18 nt, Human
cucuggacucagucucuu

SEQ ID NO: 844466 - RNA, 24 nt, Human
cuucccacagucccuacacauaaa

SEQ ID NO: 844467 - RNA, 21 nt, Human
cuugggguagcaagacugucc

SEQ ID NO: 844468 - RNA, 21 nt, Human
gaaaauugaggauucacuggg

SEQ ID NO: 844469 - RNA, 25 nt, Human
gaagcuccacccacaagcccugccc

SEQ ID NO: 844470 - RNA, 22 nt, Human
gaccugcaaugugucugcaacc

SEQ ID NO: 844471 - RNA, 26 nt, Human
gacugggcagaggaagaagcugaccu

SEQ ID NO: 844472 - RNA, 20 nt, Human
gaucacagucacaucccugg

SEQ ID NO: 844473 - RNA, 22 nt, Human
gauuccucugcucuggacucag

SEQ ID NO: 844474 - RNA, 21 nt, Human
gcagagcuccacagugucccc

SEQ ID NO: 844475 - RNA, 19 nt, Human
gcaugcagcucccuguggc

SEQ ID NO: 844476 - RNA, 20 nt, Human
gcccauacauccuacaaaca

SEQ ID NO: 844477 - RNA, 19 nt, Human
ggagcacagcuggugaccc

SEQ ID NO: 844478 - RNA, 19 nt, Human
ggaugaagcuccacccaca

SEQ ID NO: 844479 - RNA, 24 nt, Human
ggaugaagcuccacccacaagccc

SEQ ID NO: 844480 - RNA, 21 nt, Human
ggccagaagguaccccugcaa

SEQ ID NO: 844481 - RNA, 20 nt, Human
guggagcacagcuggugacc

SEQ ID NO: 844482 - RNA, 21 nt, Human
guggagcacagcuggugaccc

SEQ ID NO: 844483 - RNA, 22 nt, Human
guuucacauuuucccuccccac

SEQ ID NO: 844484 - RNA, 24 nt, Human
uaacugguaccuacaaacaaccag

SEQ ID NO: 844485 - RNA, 25 nt, Human
uaaguccuuguccauucuccccaca

SEQ ID NO: 844486 - RNA, 22 nt, Human
uaauguguuucacauuuucccu

SEQ ID NO: 844487 - RNA, 22 nt, Human
uagcaagccaccaucaaucuuc

SEQ ID NO: 844488 - RNA, 19 nt, Human
uauagcaagccaccaucaa

SEQ ID NO: 844489 - RNA, 20 nt, Human
uaucuggacagacaacgaga

SEQ ID NO: 844490 - RNA, 23 nt, Human
ucacaaucuguguacacaggguc

SEQ ID NO: 844491 - RNA, 23 nt, Human
ucacauuuucccuccccacccau

SEQ ID NO: 844492 - RNA, 18 nt, Human
ucacuggggagugagggc

SEQ ID NO: 844493 - RNA, 19 nt, Human
uccacccacaagcccugcc

SEQ ID NO: 844494 - RNA, 19 nt, Human
uccauucuccccacacaug

SEQ ID NO: 844495 - RNA, 21 nt, Human
uccccaacacuccccagacaa

SEQ ID NO: 844496 - RNA, 27 nt, Human
uccccaacacuccccagacaaggguug

SEQ ID NO: 844497 - RNA, 23 nt, Human
uccccacacaugcagaauuucua

SEQ ID NO: 844498 - RNA, 23 nt, Human
ucccucccaugccugauaagggc

SEQ ID NO: 844499 - RNA, 21 nt, Human
ucccuccccacccauguaaag

SEQ ID NO: 844500 - RNA, 21 nt, Human
ucccuguguguggagcacagc

SEQ ID NO: 844501 - RNA, 21 nt, Human
uccuuguccauucuccccaca

SEQ ID NO: 844502 - RNA, 19 nt, Human
ucucaagcagcuggggugu

SEQ ID NO: 844503 - RNA, 21 nt, Human
ugaauguaacugguaccuaca

SEQ ID NO: 844504 - RNA, 21 nt, Human
ugacuugggguagcaagacug

SEQ ID NO: 844505 - RNA, 21 nt, Human
ugagguagugacuugggguag

SEQ ID NO: 844506 - RNA, 23 nt, Human
ugagucaaggguuggggccagaa

SEQ ID NO: 844507 - RNA, 19 nt, Human
ugcaaaggugcauugcccc

SEQ ID NO: 844508 - RNA, 19 nt, Human
ugcaacccagugauccuuc

SEQ ID NO: 844509 - RNA, 21 nt, Human
ugcaucucuggaaugcaucuc

SEQ ID NO: 844510 - RNA, 22 nt, Human
uggcugaagccuuaucuacacu

SEQ ID NO: 844511 - RNA, 19 nt, Human
ugggcagagcuccacagug

SEQ ID NO: 844512 - RNA, 19 nt, Human
ugggguguuaccccugaaa

SEQ ID NO: 844513 - RNA, 20 nt, Human
uguccauucuuuuacugaug

SEQ ID NO: 844514 - RNA, 20 nt, Human
ugucccaaaaaagcuguucu

SEQ ID NO: 844515 - RNA, 22 nt, Human
uuccugagggccacucugugcc

SEQ ID NO: 844516 - RNA, 22 nt, Human
uuguccauucuccccacacaug

SEQ ID NO: 844517 - RNA, 26 nt, Human
uuuacugaugcuccccaacacucccc

SEQ ID NO: 844518 - RNA, 18 nt, Human
aggccuucgccacgcgac

SEQ ID NO: 844519 - RNA, 18 nt, Human
aggcgcgaccuggaggag

SEQ ID NO: 844520 - RNA, 21 nt, Human
cccaacuuugugccgcggccg

SEQ ID NO: 844521 - RNA, 23 nt, Human
cccaacuuugugccgcggccgca

SEQ ID NO: 844522 - RNA, 24 nt, Human
ccccaacuuugugccgcggccgca

SEQ ID NO: 844523 - RNA, 25 nt, Human
cuuugugccgcggccgcaggccuuc

SEQ ID NO: 844524 - RNA, 19 nt, Human
gcgcggcggagagagggag

SEQ ID NO: 844525 - RNA, 18 nt, Human
gcggcggagagagggagc

SEQ ID NO: 844526 - RNA, 18 nt, Human
ggcggccgcggagcugcg

SEQ ID NO: 844527 - RNA, 19 nt, Human
ggcuuggcggccgcggagc

SEQ ID NO: 844528 - RNA, 25 nt, Human
uaccuuuauuuuuccuuauaacauu

SEQ ID NO: 844529 - RNA, 18 nt, Human
uauuaccuuuauuuuucc

SEQ ID NO: 844530 - RNA, 21 nt, Human
uggcggccgcggagcugcgcc

SEQ ID NO: 844531 - RNA, 22 nt, Human
uuggcggccgcggagcugcgcc

SEQ ID NO: 844532 - RNA, 22 nt, Human
aagugcagucccucagccgccu

SEQ ID NO: 844533 - RNA, 21 nt, Human
agaaugcugagagcagggagu

SEQ ID NO: 844534 - RNA, 20 nt, Human
agagcagggagugggaaggg

SEQ ID NO: 844535 - RNA, 20 nt, Human
aucuguuacaacagauggug

SEQ ID NO: 844536 - RNA, 22 nt, Human
caaccaauacagguucuugauu

SEQ ID NO: 844537 - RNA, 18 nt, Human
cacccccucucccaguca

SEQ ID NO: 844538 - RNA, 24 nt, Human
cacccccucucccagucauccucc

SEQ ID NO: 844539 - RNA, 27 nt, Human
cagccuccagcccuaugucgagaccuu

SEQ ID NO: 844540 - RNA, 23 nt, Human
cagggccuugguccccaccuccc

SEQ ID NO: 844541 - RNA, 20 nt, Human
caucggugcugccaaagggg

SEQ ID NO: 844542 - RNA, 21 nt, Human
ccaccucccugccaugaauuc

SEQ ID NO: 844543 - RNA, 24 nt, Human
ccagauaggauccauguuccugcc

SEQ ID NO: 844544 - RNA, 25 nt, Human
cccagccuccagcccuaugucgaga

SEQ ID NO: 844545 - RNA, 28 nt, Human
ccccagccuccagcccuaugucgagacc

SEQ ID NO: 844546 - RNA, 19 nt, Human
cccucugacucucccgggg

SEQ ID NO: 844547 - RNA, 26 nt, Human
ccugugaucccucuuaacugcccucu

SEQ ID NO: 844548 - RNA, 23 nt, Human
cucagggccuugguccccaccuc

SEQ ID NO: 844549 - RNA, 21 nt, Human
cuccuucgcaaugcucccugg

SEQ ID NO: 844550 - RNA, 24 nt, Human
cucgcgggugggccuucucuggcc

SEQ ID NO: 844551 - RNA, 21 nt, Human
cuugagaggcacccccucucc

SEQ ID NO: 844552 - RNA, 20 nt, Human
gggaaaggccacgggagaug

SEQ ID NO: 844553 - RNA, 22 nt, Human
gggagauguucgagcucaggga

SEQ ID NO: 844554 - RNA, 21 nt, Human
ggggaaaggccacgggagaug

SEQ ID NO: 844555 - RNA, 19 nt, Human
uacagguucuugauugaag

SEQ ID NO: 844556 - RNA, 28 nt, Human
uaggauccauguuccugccccagccucc

SEQ ID NO: 844557 - RNA, 18 nt, Human
ucccucagccgccucucu

SEQ ID NO: 844558 - RNA, 18 nt, Human
uccuccaucggugcugcc

SEQ ID NO: 844559 - RNA, 18 nt, Human
ugacagaaugcugagagc

SEQ ID NO: 844560 - RNA, 21 nt, Human
ugacaguaccaagccgggccu

SEQ ID NO: 844561 - RNA, 26 nt, Human
ugggaaggggagugacagucgaccuc

SEQ ID NO: 844562 - RNA, 18 nt, Human
ugggaucacaggcaacca

SEQ ID NO: 844563 - RNA, 18 nt, Human
ugggaucacaggcaacca

SEQ ID NO: 844564 - RNA, 20 nt, Human
ugggauuucgggguuuaucu

SEQ ID NO: 844565 - RNA, 23 nt, Human
uggggauagucaucccauuacug

SEQ ID NO: 844566 - RNA, 18 nt, Human
uguuccugccccagccuc

SEQ ID NO: 844567 - RNA, 24 nt, Human
uuuugggauuucgggguuuaucug

SEQ ID NO: 844568 - RNA, 26 nt, Human
uuuugggauuucgggguuuaucuguu

SEQ ID NO: 844569 - RNA, 20 nt, Human
uuuuuuuuuuuugggauuuc

SEQ ID NO: 844570 - RNA, 23 nt, Human
uuuuuuuuuuuuugggauuucgg

SEQ ID NO: 844571 - RNA, 23 nt, Human
uuuuuuuuuuuuuuuuugggauu

SEQ ID NO: 844572 - RNA, 22 nt, Human
uuuuuuuuuuuuuuuuuuuggg

SEQ ID NO: 844573 - RNA, 24 nt, Human
aaaacuccugccaaauguccacaa

SEQ ID NO: 844574 - RNA, 23 nt, Human
aaaagacauuuuguugcaagacu

SEQ ID NO: 844575 - RNA, 25 nt, Human
aaaaggccaaguauacucauaagug

SEQ ID NO: 844576 - RNA, 23 nt, Human
aaacuuaaaagacauuuuguugc

SEQ ID NO: 844577 - RNA, 24 nt, Human
aaagugcugggauuacaggcauga

SEQ ID NO: 844578 - RNA, 21 nt, Human
aagguuguguuuuucaaccug

SEQ ID NO: 844579 - RNA, 19 nt, Human
aagugcugggauuacaggc

SEQ ID NO: 844580 - RNA, 21 nt, Human
aagugcugggauuacaggcau

SEQ ID NO: 844581 - RNA, 26 nt, Human
aagugcugggauuacaggcaugagcc

SEQ ID NO: 844582 - RNA, 23 nt, Human
acaauaaaaucccucucaccaug

SEQ ID NO: 844583 - RNA, 21 nt, Human
accaaaaucaacaaacacaaa

SEQ ID NO: 844584 - RNA, 24 nt, Human
accauguuggucaggcuggucucg

SEQ ID NO: 844585 - RNA, 22 nt, Human
accccuaccucuuuacucuuga

SEQ ID NO: 844586 - RNA, 23 nt, Human
acccuaauacuguuaacacauca

SEQ ID NO: 844587 - RNA, 20 nt, Human
acccucugccucccggguuc

SEQ ID NO: 844588 - RNA, 23 nt, Human
accucggccucccaaagugcugg

SEQ ID NO: 844589 - RNA, 24 nt, Human
accuugugauccacccaccucggc

SEQ ID NO: 844590 - RNA, 21 nt, Human
acugcacccucugccucccgg

SEQ ID NO: 844591 - RNA, 21 nt, Human
acugcacccucugccucccgg

SEQ ID NO: 844592 - RNA, 22 nt, Human
acugcacccucugccucccggg

SEQ ID NO: 844593 - RNA, 23 nt, Human
acuuggagaugccuguaugaugc

SEQ ID NO: 844594 - RNA, 22 nt, Human
agaaauagagagugaggaagga

SEQ ID NO: 844595 - RNA, 22 nt, Human
agaaccaggaucuugacccaaa

SEQ ID NO: 844596 - RNA, 18 nt, Human
agagagugaggaaggaag

SEQ ID NO: 844597 - RNA, 18 nt, Human
agagggaaagagaaauag

SEQ ID NO: 844598 - RNA, 18 nt, Human
agcugacuacuguacuua

SEQ ID NO: 844599 - RNA, 25 nt, Human
aggcuggagugcaguggugcaaucu

SEQ ID NO: 844600 - RNA, 23 nt, Human
agggaaagagaaauagagaguga

SEQ ID NO: 844601 - RNA, 22 nt, Human
aguagagauggcguuucaccau

SEQ ID NO: 844602 - RNA, 20 nt, Human
agugcaguggugcaaucucg

SEQ ID NO: 844603 - RNA, 24 nt, Human
agugcaguggugcaaucucggcuu

SEQ ID NO: 844604 - RNA, 18 nt, Human
agugcugggauuacaggc

SEQ ID NO: 844605 - RNA, 19 nt, Human
auaacaaaacacaaaggca

SEQ ID NO: 844606 - RNA, 23 nt, Human
auaacaguaacuuuaaaaggcca

SEQ ID NO: 844607 - RNA, 21 nt, Human
auggcguuucaccauguuggu

SEQ ID NO: 844608 - RNA, 24 nt, Human
auggcguuucaccauguuggucag

SEQ ID NO: 844609 - RNA, 22 nt, Human
auugacaccaaaaucaacaaac

SEQ ID NO: 844610 - RNA, 24 nt, Human
auuuuuguauuuuuaguagagaug

SEQ ID NO: 844611 - RNA, 18 nt, Human
caaaacacaaaggcaagu

SEQ ID NO: 844612 - RNA, 19 nt, Human
caaaauaucaaguaaggau

SEQ ID NO: 844613 - RNA, 24 nt, Human
caaagugcugggauuacaggcaug

SEQ ID NO: 844614 - RNA, 22 nt, Human
caaccaauaugccaauauccaa

SEQ ID NO: 844615 - RNA, 20 nt, Human
caagugauucucuugccuca

SEQ ID NO: 844616 - RNA, 22 nt, Human
caagugauucucuugccucagc

SEQ ID NO: 844617 - RNA, 24 nt, Human
caccaaaaucaacaaacacaaaga

SEQ ID NO: 844618 - RNA, 24 nt, Human
caccacgcccggcuaauuuuugua

SEQ ID NO: 844619 - RNA, 21 nt, Human
caccauguuggucaggcuggu

SEQ ID NO: 844620 - RNA, 24 nt, Human
caccauguuggucaggcuggucuc

SEQ ID NO: 844621 - RNA, 22 nt, Human
cacccaccucggccucccaaag

SEQ ID NO: 844622 - RNA, 23 nt, Human
cacccaccucggccucccaaagu

SEQ ID NO: 844623 - RNA, 21 nt, Human
cagcaggagcagaggaaugcu

SEQ ID NO: 844624 - RNA, 20 nt, Human
cagccuccuggguagcuggg

SEQ ID NO: 844625 - RNA, 24 nt, Human
cauaagaaccaggaucuugaccca

SEQ ID NO: 844626 - RNA, 23 nt, Human
ccaaagugcugggauuacaggca

SEQ ID NO: 844627 - RNA, 24 nt, Human
ccaaagugcugggauuacaggcau

SEQ ID NO: 844628 - RNA, 27 nt, Human
cccaaacuuauaagaucuucuaaaaag

SEQ ID NO: 844629 - RNA, 24 nt, Human
cccaaagugcugggauuacaggca

SEQ ID NO: 844630 - RNA, 21 nt, Human
cccggguucaagugauucucu

SEQ ID NO: 844631 - RNA, 18 nt, Human
cccucucaccaugaaaau

SEQ ID NO: 844632 - RNA, 19 nt, Human
ccuaggcuggagugcagug

SEQ ID NO: 844633 - RNA, 26 nt, Human
ccucuuuacucuugauuccucuucca

SEQ ID NO: 844634 - RNA, 22 nt, Human
ccugaccuugugauccacccac

SEQ ID NO: 844635 - RNA, 23 nt, Human
ccuggguagcugggauuacaggu

SEQ ID NO: 844636 - RNA, 24 nt, Human
ccuggguagcugggauuacaggug

SEQ ID NO: 844637 - RNA, 24 nt, Human
cgcucugucgccuaggcuggagug

SEQ ID NO: 844638 - RNA, 20 nt, Human
cggguucaagugauucucuu

SEQ ID NO: 844639 - RNA, 20 nt, Human
cuaaagagaaugcaaccuaa

SEQ ID NO: 844640 - RNA, 24 nt, Human
cucagccuccuggguagcugggau

SEQ ID NO: 844641 - RNA, 19 nt, Human
cucauucugucuccuuucc

SEQ ID NO: 844642 - RNA, 20 nt, Human
cucccggguucaagugauuc

SEQ ID NO: 844643 - RNA, 18 nt, Human
cuccugaccuugugaucc

SEQ ID NO: 844644 - RNA, 25 nt, Human
cuccugaccuugugauccacccacc

SEQ ID NO: 844645 - RNA, 19 nt, Human
cuccugccaaauguccaca

SEQ ID NO: 844646 - RNA, 21 nt, Human
cucgcucugucgccuaggcug

SEQ ID NO: 844647 - RNA, 24 nt, Human
cucgcucugucgccuaggcuggag

SEQ ID NO: 844648 - RNA, 22 nt, Human
cucuauggccagauauuauacu

SEQ ID NO: 844649 - RNA, 23 nt, Human
cucugucgccuaggcuggagugc

SEQ ID NO: 844650 - RNA, 21 nt, Human
cugcacccucugccucccggg

SEQ ID NO: 844651 - RNA, 23 nt, Human
cugccucccggguucaagugauu

SEQ ID NO: 844652 - RNA, 22 nt, Human
gaauggugacagaguuggcuug

SEQ ID NO: 844653 - RNA, 22 nt, Human
gacaccaaaaucaacaaacaca

SEQ ID NO: 844654 - RNA, 22 nt, Human
gaccuugugauccacccaccuc

SEQ ID NO: 844655 - RNA, 22 nt, Human
gaccuugugauccacccaccuc

SEQ ID NO: 844656 - RNA, 24 nt, Human
gaccuugugauccacccaccucgg

SEQ ID NO: 844657 - RNA, 24 nt, Human
gagauggcguuucaccauguuggu

SEQ ID NO: 844658 - RNA, 22 nt, Human
gagcaccaccacgcccggcuaa

SEQ ID NO: 844659 - RNA, 19 nt, Human
gaugcuggaugaccaagua

SEQ ID NO: 844660 - RNA, 18 nt, Human
gauuacaggcaugagcca

SEQ ID NO: 844661 - RNA, 22 nt, Human
gauuacaggcaugagccacugc

SEQ ID NO: 844662 - RNA, 22 nt, Human
gauuacaggcaugagccacugc

SEQ ID NO: 844663 - RNA, 21 nt, Human
gauucucuugccucagccucc

SEQ ID NO: 844664 - RNA, 21 nt, Human
gccaauauccaacuucuaggu

SEQ ID NO: 844665 - RNA, 22 nt, Human
gcccggcuaauuuuuguauuuu

SEQ ID NO: 844666 - RNA, 20 nt, Human
gccuaggcuggagugcagug

SEQ ID NO: 844667 - RNA, 23 nt, Human
gccuaggcuggagugcaguggug

SEQ ID NO: 844668 - RNA, 19 nt, Human
gcugaaucagaaucucaua

SEQ ID NO: 844669 - RNA, 23 nt, Human
gcuugucacaccuggcucaggga

SEQ ID NO: 844670 - RNA, 22 nt, Human
ggauuacaggcaugagccacug

SEQ ID NO: 844671 - RNA, 22 nt, Human
ggcguuucaccauguuggucag

SEQ ID NO: 844672 - RNA, 24 nt, Human
ggcguuucaccauguuggucaggc

SEQ ID NO: 844673 - RNA, 23 nt, Human
ggcuggucucgaacuccugaccu

SEQ ID NO: 844674 - RNA, 22 nt, Human
ggguucaagugauucucuugcc

SEQ ID NO: 844675 - RNA, 23 nt, Human
ggguucaagugauucucuugccu

SEQ ID NO: 844676 - RNA, 20 nt, Human
ggucucgaacuccugaccuu

SEQ ID NO: 844677 - RNA, 24 nt, Human
gugauccacccaccucggccuccc

SEQ ID NO: 844678 - RNA, 23 nt, Human
gugauucucuugccucagccucc

SEQ ID NO: 844679 - RNA, 18 nt, Human
guuguguuuuucaaccug

SEQ ID NO: 844680 - RNA, 19 nt, Human
uaaauugaagcaauuccua

SEQ ID NO: 844681 - RNA, 19 nt, Human
uaacaggaaacuuaaaaga

SEQ ID NO: 844682 - RNA, 22 nt, Human
uaagaauaaugccauuaucugu

SEQ ID NO: 844683 - RNA, 25 nt, Human
uaaucuaauuuuaaaaauccuuuuc

SEQ ID NO: 844684 - RNA, 24 nt, Human
uaauuuuuguauuuuuaguagaga

SEQ ID NO: 844685 - RNA, 22 nt, Human
uacaggcaugagccacugcgcc

SEQ ID NO: 844686 - RNA, 23 nt, Human
uacaggugagcaccaccacgccc

SEQ ID NO: 844687 - RNA, 23 nt, Human
uacuaaggucacaaguguguuca

SEQ ID NO: 844688 - RNA, 23 nt, Human
uacugcacccucugccucccggg

SEQ ID NO: 844689 - RNA, 24 nt, Human
uagaauuucacaauaaaaucccuc

SEQ ID NO: 844690 - RNA, 22 nt, Human
uagagauggcguuucaccaugu

SEQ ID NO: 844691 - RNA, 18 nt, Human
uagauaaacauaacagua

SEQ ID NO: 844692 - RNA, 24 nt, Human
uaguagagauggcguuucaccaug

SEQ ID NO: 844693 - RNA, 23 nt, Human
uauggccagauauuauacuaauc

SEQ ID NO: 844694 - RNA, 22 nt, Human
ucaacaaacacaaagaaagaga

SEQ ID NO: 844695 - RNA, 19 nt, Human
ucaagugauucucuugccu

SEQ ID NO: 844696 - RNA, 20 nt, Human
ucagccuccuggguagcugg

SEQ ID NO: 844697 - RNA, 23 nt, Human
ucauauuguucuuaucacucuau

SEQ ID NO: 844698 - RNA, 24 nt, Human
ucccaaagugcugggauuacaggc

SEQ ID NO: 844699 - RNA, 21 nt, Human
ucccggguucaagugauucuc

SEQ ID NO: 844700 - RNA, 21 nt, Human
ucccggguucaagugauucuc

SEQ ID NO: 844701 - RNA, 24 nt, Human
ucccggguucaagugauucucuug

SEQ ID NO: 844702 - RNA, 24 nt, Human
uccuggguagcugggauuacaggu

SEQ ID NO: 844703 - RNA, 24 nt, Human
ucgccuaggcuggagugcaguggu

SEQ ID NO: 844704 - RNA, 24 nt, Human
ucgcucugucgccuaggcuggagu

SEQ ID NO: 844705 - RNA, 18 nt, Human
ucggccucccaaagugcu

SEQ ID NO: 844706 - RNA, 19 nt, Human
ucucgaacuccugaccuug

SEQ ID NO: 844707 - RNA, 19 nt, Human
ucucgcucugucgccuagg

SEQ ID NO: 844708 - RNA, 20 nt, Human
ucucgcucugucgccuaggc

SEQ ID NO: 844709 - RNA, 23 nt, Human
ucucgcucugucgccuaggcugg

SEQ ID NO: 844710 - RNA, 24 nt, Human
ucucgcucugucgccuaggcugga

SEQ ID NO: 844711 - RNA, 18 nt, Human
ucugucuccuuuccuuuc

SEQ ID NO: 844712 - RNA, 23 nt, Human
ucugugcaauagaaauaaccaaa

SEQ ID NO: 844713 - RNA, 21 nt, Human
ucugugcucaauauagauaaa

SEQ ID NO: 844714 - RNA, 23 nt, Human
ugaccuugugauccacccaccuc

SEQ ID NO: 844715 - RNA, 21 nt, Human
ugagaaccaguggccuaaaga

SEQ ID NO: 844716 - RNA, 18 nt, Human
ugagacagagucucgcuc

SEQ ID NO: 844717 - RNA, 22 nt, Human
ugagacagagucucgcucuguc

SEQ ID NO: 844718 - RNA, 18 nt, Human
ugagcaccaccacgcccg

SEQ ID NO: 844719 - RNA, 24 nt, Human
ugaguaaaccccuaccucuuuacu

SEQ ID NO: 844720 - RNA, 20 nt, Human
ugauaggaacaaaauaucaa

SEQ ID NO: 844721 - RNA, 24 nt, Human
ugauccacccaccucggccuccca

SEQ ID NO: 844722 - RNA, 20 nt, Human
ugcaauagaaauaaccaaag

SEQ ID NO: 844723 - RNA, 21 nt, Human
ugcauagagucuaacuuggag

SEQ ID NO: 844724 - RNA, 21 nt, Human
ugccucagccuccuggguagc

SEQ ID NO: 844725 - RNA, 22 nt, Human
ugccucagccuccuggguagcu

SEQ ID NO: 844726 - RNA, 24 nt, Human
ugccucagccuccuggguagcugg

SEQ ID NO: 844727 - RNA, 22 nt, Human
ugccucccggguucaagugauu

SEQ ID NO: 844728 - RNA, 24 nt, Human
ugcguguuucauaacaaaacacaa

SEQ ID NO: 844729 - RNA, 23 nt, Human
uggagugcaguggugcaaucucg

SEQ ID NO: 844730 - RNA, 24 nt, Human
uggagugcaguggugcaaucucgg

SEQ ID NO: 844731 - RNA, 24 nt, Human
uggcguuucaccauguuggucagg

SEQ ID NO: 844732 - RNA, 18 nt, Human
ugggauuacaggcaugag

SEQ ID NO: 844733 - RNA, 19 nt, Human
ugggauuacaggcaugagc

SEQ ID NO: 844734 - RNA, 21 nt, Human
ugggauuacaggcaugagcca

SEQ ID NO: 844735 - RNA, 22 nt, Human
ugggauuacaggcaugagccac

SEQ ID NO: 844736 - RNA, 22 nt, Human
ugggauuacaggcaugagccac

SEQ ID NO: 844737 - RNA, 23 nt, Human
ugggauuacaggcaugagccacu

SEQ ID NO: 844738 - RNA, 24 nt, Human
ugggauuacaggcaugagccacug

SEQ ID NO: 844739 - RNA, 24 nt, Human
ugggauuacaggcaugagccacug

SEQ ID NO: 844740 - RNA, 19 nt, Human
ugggauuacaggugagcac

SEQ ID NO: 844741 - RNA, 21 nt, Human
ugggauuacaggugagcacca

SEQ ID NO: 844742 - RNA, 24 nt, Human
ugggauuacaggugagcaccacca

SEQ ID NO: 844743 - RNA, 24 nt, Human
uggucaggcuggucucgaacuccu

SEQ ID NO: 844744 - RNA, 21 nt, Human
ugucgccuaggcuggagugca

SEQ ID NO: 844745 - RNA, 18 nt, Human
ugugcaauagaaauaacc

SEQ ID NO: 844746 - RNA, 21 nt, Human
uguugcaagacuaucuuaaca

SEQ ID NO: 844747 - RNA, 21 nt, Human
uuaaaagacauuuuguugcaa

SEQ ID NO: 844748 - RNA, 24 nt, Human
uuacugcacccucugccucccggg

SEQ ID NO: 844749 - RNA, 18 nt, Human
uuaguagagauggcguuu

SEQ ID NO: 844750 - RNA, 24 nt, Human
uuaguagagauggcguuucaccau

SEQ ID NO: 844751 - RNA, 23 nt, Human
uucaagugauucucuugccucag

SEQ ID NO: 844752 - RNA, 21 nt, Human
uugacaccaaaaucaacaaac

SEQ ID NO: 844753 - RNA, 23 nt, Human
uugacaccaaaaucaacaaacac

SEQ ID NO: 844754 - RNA, 19 nt, Human
uugucacaccuggcucagg

SEQ ID NO: 844755 - RNA, 24 nt, Human
uuucaccauguuggucaggcuggu

SEQ ID NO: 844756 - RNA, 24 nt, Human
uuuuuaguagagauggcguuucac

SEQ ID NO: 844757 - RNA, 20 nt, Human
uuuuuguauuuuuaguagag

SEQ ID NO: 844758 - RNA, 20 nt, Human
uuuuuuuuuuugagacagag

SEQ ID NO: 844759 - RNA, 25 nt, Human
uuuuuuuuuuuugagacagagucuc

SEQ ID NO: 844760 - RNA, 18 nt, Human
uuuuuuuuuuuuuuuuug

SEQ ID NO: 844761 - RNA, 24 nt, Human
aaagugcugggauuacaggcauga

SEQ ID NO: 844762 - RNA, 22 nt, Human
aaccuccacucacugcaaccuc

SEQ ID NO: 844763 - RNA, 19 nt, Human
aaguagcugggauuagagg

SEQ ID NO: 844764 - RNA, 19 nt, Human
aagugcugggauuacaggc

SEQ ID NO: 844765 - RNA, 21 nt, Human
aagugcugggauuacaggcau

SEQ ID NO: 844766 - RNA, 26 nt, Human
aagugcugggauuacaggcaugagcc

SEQ ID NO: 844767 - RNA, 22 nt, Human
accauguuggccaggcuggucu

SEQ ID NO: 844768 - RNA, 25 nt, Human
acccgucucagccucccaaagugcu

SEQ ID NO: 844769 - RNA, 18 nt, Human
acgggguuucaccauguu

SEQ ID NO: 844770 - RNA, 23 nt, Human
acgggguuucaccauguuggcca

SEQ ID NO: 844771 - RNA, 24 nt, Human
acgggguuucaccauguuggccag

SEQ ID NO: 844772 - RNA, 25 nt, Human
acugcaaccucugccuccuggauuc

SEQ ID NO: 844773 - RNA, 24 nt, Human
agguaauccacccgucucagccuc

SEQ ID NO: 844774 - RNA, 18 nt, Human
aggugcccaccaucacgc

SEQ ID NO: 844775 - RNA, 18 nt, Human
agugcugggauuacaggc

SEQ ID NO: 844776 - RNA, 24 nt, Human
auuuuuguauuuuuaguggagacg

SEQ ID NO: 844777 - RNA, 24 nt, Human
caaagugcugggauuacaggcaug

SEQ ID NO: 844778 - RNA, 21 nt, Human
caccauguuggccaggcuggu

SEQ ID NO: 844779 - RNA, 22 nt, Human
caccauguuggccaggcugguc

SEQ ID NO: 844780 - RNA, 23 nt, Human
caccauguuggccaggcuggucu

SEQ ID NO: 844781 - RNA, 24 nt, Human
caccauguuggccaggcuggucuu

SEQ ID NO: 844782 - RNA, 23 nt, Human
cacccgucucagccucccaaagu

SEQ ID NO: 844783 - RNA, 21 nt, Human
cacgcccggcuaauuuuugua

SEQ ID NO: 844784 - RNA, 18 nt, Human
cacugcaaccucugccuc

SEQ ID NO: 844785 - RNA, 21 nt, Human
cacugcaaccucugccuccug

SEQ ID NO: 844786 - RNA, 24 nt, Human
cauguuggccaggcuggucuugaa

SEQ ID NO: 844787 - RNA, 23 nt, Human
ccaaagugcugggauuacaggca

SEQ ID NO: 844788 - RNA, 24 nt, Human
ccaaagugcugggauuacaggcau

SEQ ID NO: 844789 - RNA, 19 nt, Human
ccaccaugccuggccuacc

SEQ ID NO: 844790 - RNA, 26 nt, Human
ccacccgucucagccucccaaagugc

SEQ ID NO: 844791 - RNA, 24 nt, Human
cccaaagugcugggauuacaggca

SEQ ID NO: 844792 - RNA, 19 nt, Human
cccaaguagcugggauuag

SEQ ID NO: 844793 - RNA, 23 nt, Human
ccgucucagccucccaaagugcu

SEQ ID NO: 844794 - RNA, 22 nt, Human
ccucagccucccaaguagcugg

SEQ ID NO: 844795 - RNA, 24 nt, Human
ccuccuggauucaagcaauucucc

SEQ ID NO: 844796 - RNA, 22 nt, Human
ccugaccucagguaauccaccc

SEQ ID NO: 844797 - RNA, 24 nt, Human
ccugaccucagguaauccacccgu

SEQ ID NO: 844798 - RNA, 24 nt, Human
ccugcccucagccucccaaguagc

SEQ ID NO: 844799 - RNA, 23 nt, Human
ccuggauucaagcaauucuccug

SEQ ID NO: 844800 - RNA, 24 nt, Human
cgggguuucaccauguuggccagg

SEQ ID NO: 844801 - RNA, 24 nt, Human
cgucucagccucccaaagugcugg

SEQ ID NO: 844802 - RNA, 20 nt, Human
cucacugcaaccucugccuc

SEQ ID NO: 844803 - RNA, 24 nt, Human
cucacugcaaccucugccuccugg

SEQ ID NO: 844804 - RNA, 25 nt, Human
cucacugcaaccucugccuccuggg

SEQ ID NO: 844805 - RNA, 24 nt, Human
cucagccucccaaguagcugggau

SEQ ID NO: 844806 - RNA, 19 nt, Human
cugcaaccucugccuccug

SEQ ID NO: 844807 - RNA, 23 nt, Human
cugcaaccucugccuccuggauu

SEQ ID NO: 844808 - RNA, 22 nt, Human
cugccucauucagaaaggcaau

SEQ ID NO: 844809 - RNA, 23 nt, Human
cugucagccaggcuggagugcag

SEQ ID NO: 844810 - RNA, 19 nt, Human
cuuuuuuuuuuuuuuuuug

SEQ ID NO: 844811 - RNA, 20 nt, Human
cuuuuuuuuuuuuuuuuugg

SEQ ID NO: 844812 - RNA, 24 nt, Human
gaccucagguaauccacccgucuc

SEQ ID NO: 844813 - RNA, 24 nt, Human
gagacgggguuucaccauguuggc

SEQ ID NO: 844814 - RNA, 21 nt, Human
gaggugcccaccaucacgccc

SEQ ID NO: 844815 - RNA, 18 nt, Human
gauuacaggcaugagcca

SEQ ID NO: 844816 - RNA, 21 nt, Human
gauuacaggcaugagccacca

SEQ ID NO: 844817 - RNA, 24 nt, Human
gauuacaggcaugagccaccaugc

SEQ ID NO: 844818 - RNA, 22 nt, Human
gcccggcuaauuuuuguauuuu

SEQ ID NO: 844819 - RNA, 24 nt, Human
ggauuacaggcaugagccaccaug

SEQ ID NO: 844820 - RNA, 24 nt, Human
ggcuggucuugaaguccugaccuc

SEQ ID NO: 844821 - RNA, 23 nt, Human
gggguuucaccauguuggccagg

SEQ ID NO: 844822 - RNA, 24 nt, Human
guaauccacccgucucagccuccc

SEQ ID NO: 844823 - RNA, 19 nt, Human
gucagccaggcuggagugc

SEQ ID NO: 844824 - RNA, 23 nt, Human
guggagacgggguuucaccaugu

SEQ ID NO: 844825 - RNA, 24 nt, Human
uaauuuuuguauuuuuaguggaga

SEQ ID NO: 844826 - RNA, 22 nt, Human
uacaggcaugagccaccaugcc

SEQ ID NO: 844827 - RNA, 24 nt, Human
uaguggagacgggguuucaccaug

SEQ ID NO: 844828 - RNA, 18 nt, Human
ucacugcaaccucugccu

SEQ ID NO: 844829 - RNA, 19 nt, Human
ucacugcaaccucugccuc

SEQ ID NO: 844830 - RNA, 23 nt, Human
ucacugcaaccucugccuccugg

SEQ ID NO: 844831 - RNA, 27 nt, Human
ucacugcaaccucugccuccuggauuc

SEQ ID NO: 844832 - RNA, 20 nt, Human
ucagccucccaaguagcugg

SEQ ID NO: 844833 - RNA, 24 nt, Human
ucccaaagugcugggauuacaggc

SEQ ID NO: 844834 - RNA, 24 nt, Human
ucccaaguagcugggauuagaggu

SEQ ID NO: 844835 - RNA, 21 nt, Human
uccuggauucaagcaauucuc

SEQ ID NO: 844836 - RNA, 24 nt, Human
uccuggauucaagcaauucuccug

SEQ ID NO: 844837 - RNA, 22 nt, Human
ucucacugucagccaggcugga

SEQ ID NO: 844838 - RNA, 24 nt, Human
ucucacugucagccaggcuggagu

SEQ ID NO: 844839 - RNA, 24 nt, Human
ucugccuccuggauucaagcaauu

SEQ ID NO: 844840 - RNA, 21 nt, Human
ucuugaaguccugaccucagg

SEQ ID NO: 844841 - RNA, 21 nt, Human
ugaccucagguaauccacccg

SEQ ID NO: 844842 - RNA, 24 nt, Human
ugaccucagguaauccacccgucu

SEQ ID NO: 844843 - RNA, 18 nt, Human
uggagugcagugguacaa

SEQ ID NO: 844844 - RNA, 19 nt, Human
uggagugcagugguacaac

SEQ ID NO: 844845 - RNA, 21 nt, Human
uggauucaagcaauucuccug

SEQ ID NO: 844846 - RNA, 24 nt, Human
uggccaggcuggucuugaaguccu

SEQ ID NO: 844847 - RNA, 18 nt, Human
ugggauuacaggcaugag

SEQ ID NO: 844848 - RNA, 22 nt, Human
ugggauuacaggcaugagccac

SEQ ID NO: 844849 - RNA, 23 nt, Human
ugggauuacaggcaugagccacc

SEQ ID NO: 844850 - RNA, 24 nt, Human
ugggauuacaggcaugagccacca

SEQ ID NO: 844851 - RNA, 25 nt, Human
ugggauuacaggcaugagccaccau

SEQ ID NO: 844852 - RNA, 21 nt, Human
ugggauuagaggugcccacca

SEQ ID NO: 844853 - RNA, 22 nt, Human
ugggauuagaggugcccaccau

SEQ ID NO: 844854 - RNA, 24 nt, Human
ugguacaaccuccacucacugcaa

SEQ ID NO: 844855 - RNA, 18 nt, Human
uuaguggagacgggguuu

SEQ ID NO: 844856 - RNA, 22 nt, Human
uuaguggagacgggguuucacc

SEQ ID NO: 844857 - RNA, 24 nt, Human
uuaguggagacgggguuucaccau

SEQ ID NO: 844858 - RNA, 25 nt, Human
uucaagcaauucuccugcccucagc

SEQ ID NO: 844859 - RNA, 23 nt, Human
uuguauuuuuaguggagacgggg

SEQ ID NO: 844860 - RNA, 24 nt, Human
uuucaccauguuggccaggcuggu

SEQ ID NO: 844861 - RNA, 24 nt, Human
uuuuuaguggagacgggguuucac

SEQ ID NO: 844862 - RNA, 20 nt, Human
uuuuuguauuuuuaguggag

SEQ ID NO: 844863 - RNA, 27 nt, Human
uuuuuuuuuuugagauggagugucuca

SEQ ID NO: 844864 - RNA, 22 nt, Human
uuuuuuuuuuuuuugagaugga

SEQ ID NO: 844865 - RNA, 25 nt, Human
aaccagaucacacaccuuuauuauc

SEQ ID NO: 844866 - RNA, 22 nt, Human
aagccccgcagucaggccagga

SEQ ID NO: 844867 - RNA, 21 nt, Human
acacugggcuccgcugcgugg

SEQ ID NO: 844868 - RNA, 24 nt, Human
acagcagcggcgcccgcuccuucc

SEQ ID NO: 844869 - RNA, 18 nt, Human
accugguccugcacucac

SEQ ID NO: 844870 - RNA, 21 nt, Human
accugguccugcacucacucc

SEQ ID NO: 844871 - RNA, 23 nt, Human
agaaaucccucccuccccccgcc

SEQ ID NO: 844872 - RNA, 24 nt, Human
agaaaucccucccuccccccgccc

SEQ ID NO: 844873 - RNA, 25 nt, Human
agaaaucccucccuccccccgcccc

SEQ ID NO: 844874 - RNA, 22 nt, Human
auaagaaaucccucccuccccc

SEQ ID NO: 844875 - RNA, 20 nt, Human
caaaccagaucacacaccuu

SEQ ID NO: 844876 - RNA, 22 nt, Human
cacaccuuuauuauccucaaaa

SEQ ID NO: 844877 - RNA, 19 nt, Human
cacccggggccgcgcggga

SEQ ID NO: 844878 - RNA, 28 nt, Human
cagacaguggcagcgaaagcggcuccuu

SEQ ID NO: 844879 - RNA, 22 nt, Human
cagcagcggcgcccgcuccuuc

SEQ ID NO: 844880 - RNA, 26 nt, Human
cagcagcggcgcccgcuccuucccau

SEQ ID NO: 844881 - RNA, 22 nt, Human
caggcauccuccucgagcucgu

SEQ ID NO: 844882 - RNA, 21 nt, Human
caggugccgccagcgucacuc

SEQ ID NO: 844883 - RNA, 19 nt, Human
ccccccgccccuccccgca

SEQ ID NO: 844884 - RNA, 23 nt, Human
cccccgccccuccccgcaguccc

SEQ ID NO: 844885 - RNA, 21 nt, Human
ccccgccccuccccgcagucc

SEQ ID NO: 844886 - RNA, 21 nt, Human
ccccgggcccgcgccacacuc

SEQ ID NO: 844887 - RNA, 24 nt, Human
cccgcagucaggccaggaguccgc

SEQ ID NO: 844888 - RNA, 19 nt, Human
cccguggcaggucucaagu

SEQ ID NO: 844889 - RNA, 25 nt, Human
ccgccagcgucacucggggacccgc

SEQ ID NO: 844890 - RNA, 19 nt, Human
ccgccccuccccgcagucc

SEQ ID NO: 844891 - RNA, 18 nt, Human
ccgggggcugcccguggc

SEQ ID NO: 844892 - RNA, 21 nt, Human
ccuccccccgccccuccccgc

SEQ ID NO: 844893 - RNA, 20 nt, Human
ccucccuccccccgccccuc

SEQ ID NO: 844894 - RNA, 28 nt, Human
ccuugcaccgggcccaggcauccuccuc

SEQ ID NO: 844895 - RNA, 20 nt, Human
cggcccgggggagcagacag

SEQ ID NO: 844896 - RNA, 18 nt, Human
cgggauaagaaaucccuc

SEQ ID NO: 844897 - RNA, 21 nt, Human
cggggacccgcggccgggggc

SEQ ID NO: 844898 - RNA, 21 nt, Human
cgguggggcccggggcgccgg

SEQ ID NO: 844899 - RNA, 25 nt, Human
cuccccccgccccuccccgcagucc

SEQ ID NO: 844900 - RNA, 19 nt, Human
cuccgagcgcugggcugga

SEQ ID NO: 844901 - RNA, 21 nt, Human
cuccuucccauggcgccggcg

SEQ ID NO: 844902 - RNA, 23 nt, Human
cuugcaccgggcccaggcauccu

SEQ ID NO: 844903 - RNA, 19 nt, Human
gagagggggaaccuugcac

SEQ ID NO: 844904 - RNA, 19 nt, Human
gcagcgaaagcggcuccga

SEQ ID NO: 844905 - RNA, 20 nt, Human
gcggcggcacgggcggcggg

SEQ ID NO: 844906 - RNA, 23 nt, Human
ggcggcggcacgggcggcggguc

SEQ ID NO: 844907 - RNA, 20 nt, Human
ggcggcggguccucagacgc

SEQ ID NO: 844908 - RNA, 18 nt, Human
gggcccggggcgccgggc

SEQ ID NO: 844909 - RNA, 19 nt, Human
gggcuccgcugcguggccc

SEQ ID NO: 844910 - RNA, 18 nt, Human
ggggagcagacaguggca

SEQ ID NO: 844911 - RNA, 22 nt, Human
gggggaggcggcggcggcccgg

SEQ ID NO: 844912 - RNA, 21 nt, Human
uaaaaagccccgcagucaggc

SEQ ID NO: 844913 - RNA, 20 nt, Human
uauccucaaaauguaacaaa

SEQ ID NO: 844914 - RNA, 18 nt, Human
ucacccggggccgcgcgg

SEQ ID NO: 844915 - RNA, 23 nt, Human
ucacccggggccgcgcgggaccu

SEQ ID NO: 844916 - RNA, 22 nt, Human
ucaggccaggaguccgccggug

SEQ ID NO: 844917 - RNA, 24 nt, Human
ucaggccaggaguccgccgguggg

SEQ ID NO: 844918 - RNA, 22 nt, Human
uccacagcugcgggugagaggg

SEQ ID NO: 844919 - RNA, 20 nt, Human
ucccucccuccccccgcccc

SEQ ID NO: 844920 - RNA, 23 nt, Human
uccgcuuccuccucuccacagcu

SEQ ID NO: 844921 - RNA, 19 nt, Human
uccuccucuccacagcugc

SEQ ID NO: 844922 - RNA, 20 nt, Human
ucucaagucgugcgcgcgcc

SEQ ID NO: 844923 - RNA, 18 nt, Human
uggccccgggcccgcgcc

SEQ ID NO: 844924 - RNA, 21 nt, Human
uggcccggggcgagcagcgcg

SEQ ID NO: 844925 - RNA, 20 nt, Human
uucccauggcgccggcgggc

SEQ ID NO: 844926 - RNA, 19 nt, Human
uuccgcuuccuccucucca

SEQ ID NO: 844927 - RNA, 23 nt, Human
uuuuuuuuuuuuuuuuucaccaa

SEQ ID NO: 844928 - RNA, 18 nt, Human
aaaaguucuagggcgggg

SEQ ID NO: 844929 - RNA, 22 nt, Human
aaacccccaggccccagacccc

SEQ ID NO: 844930 - RNA, 19 nt, Human
aacacagucaccuuuggca

SEQ ID NO: 844931 - RNA, 19 nt, Human
aaccagcagccccgggccc

SEQ ID NO: 844932 - RNA, 18 nt, Human
aaccccagcccucggccg

SEQ ID NO: 844933 - RNA, 18 nt, Human
acagcggggagaaagagc

SEQ ID NO: 844934 - RNA, 18 nt, Human
acuugugcccagggaagg

SEQ ID NO: 844935 - RNA, 25 nt, Human
agaaagggaauuugggggaggggga

SEQ ID NO: 844936 - RNA, 18 nt, Human
agacaagauaaaaaccug

SEQ ID NO: 844937 - RNA, 23 nt, Human
agaggagcccccagaaccaagcc

SEQ ID NO: 844938 - RNA, 19 nt, Human
agccacggccacuacccag

SEQ ID NO: 844939 - RNA, 18 nt, Human
aggagaaagggaauuugg

SEQ ID NO: 844940 - RNA, 22 nt, Human
aggagaaagggaauuuggggga

SEQ ID NO: 844941 - RNA, 19 nt, Human
aggcagaauccggcauauc

SEQ ID NO: 844942 - RNA, 19 nt, Human
aggcaggcacuucuguggg

SEQ ID NO: 844943 - RNA, 21 nt, Human
agggagaagccacacugagcc

SEQ ID NO: 844944 - RNA, 23 nt, Human
agggagaagccacacugagccug

SEQ ID NO: 844945 - RNA, 23 nt, Human
caaaacccccaggccccagaccc

SEQ ID NO: 844946 - RNA, 20 nt, Human
caaagugucacgacacaaaa

SEQ ID NO: 844947 - RNA, 24 nt, Human
caaagugucacgacacaaaacccc

SEQ ID NO: 844948 - RNA, 19 nt, Human
caaguccugggaguccccc

SEQ ID NO: 844949 - RNA, 19 nt, Human
cacaaaacccccaggcccc

SEQ ID NO: 844950 - RNA, 26 nt, Human
cacaaaacccccaggccccagacccc

SEQ ID NO: 844951 - RNA, 22 nt, Human
cacuucuguggguaacuggggg

SEQ ID NO: 844952 - RNA, 22 nt, Human
cagaaccaagccggugcucccc

SEQ ID NO: 844953 - RNA, 21 nt, Human
cagcagccccgggcccucaug

SEQ ID NO: 844954 - RNA, 20 nt, Human
cagcuugugacaacuguccu

SEQ ID NO: 844955 - RNA, 18 nt, Human
ccaggccccagaccccac

SEQ ID NO: 844956 - RNA, 19 nt, Human
ccaggccccagaccccacc

SEQ ID NO: 844957 - RNA, 19 nt, Human
ccagggaagggaaauuuaa

SEQ ID NO: 844958 - RNA, 22 nt, Human
cccaggccccagaccccaccuc

SEQ ID NO: 844959 - RNA, 21 nt, Human
cccccaggccccagaccccac

SEQ ID NO: 844960 - RNA, 22 nt, Human
cccccaggccccagaccccacc

SEQ ID NO: 844961 - RNA, 20 nt, Human
ccgggcccuccuucggcggc

SEQ ID NO: 844962 - RNA, 18 nt, Human
ccucacugcaaaaacggg

SEQ ID NO: 844963 - RNA, 23 nt, Human
ccucccaaccagcagccccgggc

SEQ ID NO: 844964 - RNA, 21 nt, Human
ccugggaguccccccccacuc

SEQ ID NO: 844965 - RNA, 21 nt, Human
cgggcccucaugaggcacuug

SEQ ID NO: 844966 - RNA, 19 nt, Human
cuaaguggaaccccagccc

SEQ ID NO: 844967 - RNA, 19 nt, Human
cuagagcccagccccaggc

SEQ ID NO: 844968 - RNA, 21 nt, Human
cuagggcgggggucagggaga

SEQ ID NO: 844969 - RNA, 18 nt, Human
cuccuagagcccagcccc

SEQ ID NO: 844970 - RNA, 21 nt, Human
gacacaaaacccccaggcccc

SEQ ID NO: 844971 - RNA, 20 nt, Human
gagcaggaggagaaagggaa

SEQ ID NO: 844972 - RNA, 20 nt, Human
gagccacggccacuacccag

SEQ ID NO: 844973 - RNA, 20 nt, Human
gagggaccgggcccuccuuc

SEQ ID NO: 844974 - RNA, 23 nt, Human
gaguccccccccacucagggcac

SEQ ID NO: 844975 - RNA, 20 nt, Human
gcacagcggggagaaagagc

SEQ ID NO: 844976 - RNA, 23 nt, Human
gccacacugagccuggagggacc

SEQ ID NO: 844977 - RNA, 20 nt, Human
gcccggcccucagccaggcu

SEQ ID NO: 844978 - RNA, 18 nt, Human
gccuccucacugcaaaaa

SEQ ID NO: 844979 - RNA, 25 nt, Human
gccuccucacugcaaaaacggggau

SEQ ID NO: 844980 - RNA, 21 nt, Human
gccuggggggcccgggacaca

SEQ ID NO: 844981 - RNA, 30 nt, Human
ggaccgggcccuccuucggcggcagaaaaa

SEQ ID NO: 844982 - RNA, 23 nt, Human
ggagaagccacacugagccugga

SEQ ID NO: 844983 - RNA, 27 nt, Human
ggaggagaaagggaauuugggggaggg

SEQ ID NO: 844984 - RNA, 22 nt, Human
ggaggcuugcccggcccucagc

SEQ ID NO: 844985 - RNA, 22 nt, Human
ggaguccccccccacucagcuu

SEQ ID NO: 844986 - RNA, 24 nt, Human
gggagggggagcaguuuggggugg

SEQ ID NO: 844987 - RNA, 21 nt, Human
gggcgggggucagggagaagc

SEQ ID NO: 844988 - RNA, 22 nt, Human
ggggagggggagcaguuugggg

SEQ ID NO: 844989 - RNA, 20 nt, Human
gggggaggcacagcggggag

SEQ ID NO: 844990 - RNA, 26 nt, Human
ggggggcccgggacacaggaguuuca

SEQ ID NO: 844991 - RNA, 22 nt, Human
guggaaucuccuugagacaaag

SEQ ID NO: 844992 - RNA, 20 nt, Human
uaacugggggaggcacagcg

SEQ ID NO: 844993 - RNA, 18 nt, Human
uaagacaagauaaaaacc

SEQ ID NO: 844994 - RNA, 20 nt, Human
uaagacaagauaaaaaccug

SEQ ID NO: 844995 - RNA, 21 nt, Human
uaaguggaaccccagcccucg

SEQ ID NO: 844996 - RNA, 18 nt, Human
ucagaaaaggcacuggca

SEQ ID NO: 844997 - RNA, 21 nt, Human
ucaggggaggcuugcccggcc

SEQ ID NO: 844998 - RNA, 22 nt, Human
uccgccuggggggcccgggaca

SEQ ID NO: 844999 - RNA, 22 nt, Human
uccuucggcggcagaaaacaca

SEQ ID NO: 845000 - RNA, 21 nt, Human
ucuccuagagcccagccccag

SEQ ID NO: 845001 - RNA, 18 nt, Human
ugagccuggagggaccgg

SEQ ID NO: 845002 - RNA, 18 nt, Human
ugaggcacuugugcccag

SEQ ID NO: 845003 - RNA, 26 nt, Human
uggaaccccagcccucggccggccuc

SEQ ID NO: 845004 - RNA, 21 nt, Human
uggcagggaaggguuuuuucc

SEQ ID NO: 845005 - RNA, 21 nt, Human
ugggcaggcagagagugaacu

SEQ ID NO: 845006 - RNA, 19 nt, Human
uggggugggacuggguccc

SEQ ID NO: 845007 - RNA, 19 nt, Human
uggggugggacuggguccc

SEQ ID NO: 845008 - RNA, 21 nt, Human
ugucacgacacaaaaccccca

SEQ ID NO: 845009 - RNA, 22 nt, Human
uguuagaggagcccccagaacc

SEQ ID NO: 845010 - RNA, 24 nt, Human
uucuguggguaacugggggaggca

SEQ ID NO: 845011 - RNA, 19 nt, Human
uugagacaaagugucacga

SEQ ID NO: 845012 - RNA, 20 nt, Human
uuggggucuccuagagccca

SEQ ID NO: 845013 - RNA, 19 nt, Human
uuuuuuuuuuuuuuuugcg

SEQ ID NO: 845014 - RNA, 19 nt, Human
uuuuuuuuuuuuuuuuugc

SEQ ID NO: 845015 - RNA, 20 nt, Human
uuuuuuuuuuuuuuuuuugg

SEQ ID NO: 845016 - RNA, 24 nt, Human
aaagugcugggauuacaggcauga

SEQ ID NO: 845017 - RNA, 25 nt, Human
aagcgauucucccaccucagccucu

SEQ ID NO: 845018 - RNA, 24 nt, Human
aaguagcuggcauuacagguaugu

SEQ ID NO: 845019 - RNA, 18 nt, Human
aagugcugggauuacagg

SEQ ID NO: 845020 - RNA, 19 nt, Human
aagugcugggauuacaggc

SEQ ID NO: 845021 - RNA, 21 nt, Human
aagugcugggauuacaggcau

SEQ ID NO: 845022 - RNA, 26 nt, Human
aagugcugggauuacaggcaugagcc

SEQ ID NO: 845023 - RNA, 19 nt, Human
aagugcugggauuacaggu

SEQ ID NO: 845024 - RNA, 23 nt, Human
aagugcugggauuacagguguga

SEQ ID NO: 845025 - RNA, 26 nt, Human
aagugcugggauuacaggugugagcc

SEQ ID NO: 845026 - RNA, 24 nt, Human
aauuuuguauuuuuaguagagacg

SEQ ID NO: 845027 - RNA, 22 nt, Human
acaccuaacaccugcagccaca

SEQ ID NO: 845028 - RNA, 21 nt, Human
acaggcacucaucaccaugcc

SEQ ID NO: 845029 - RNA, 18 nt, Human
acaggguuucaccauguu

SEQ ID NO: 845030 - RNA, 23 nt, Human
acaggguuucaccauguuggcca

SEQ ID NO: 845031 - RNA, 24 nt, Human
acaggguuucaccauguuggccag

SEQ ID NO: 845032 - RNA, 18 nt, Human
accauguuggccaggcug

SEQ ID NO: 845033 - RNA, 25 nt, Human
acccgccuuggccucccgaagugcu

SEQ ID NO: 845034 - RNA, 19 nt, Human
accucagccucuugaguag

SEQ ID NO: 845035 - RNA, 23 nt, Human
accucggccucccaaagugcugg

SEQ ID NO: 845036 - RNA, 20 nt, Human
acgggguuucaccauguugg

SEQ ID NO: 845037 - RNA, 21 nt, Human
acgggguuucaccauguuggu

SEQ ID NO: 845038 - RNA, 23 nt, Human
acgggguuucaccauguuggucc

SEQ ID NO: 845039 - RNA, 25 nt, Human
acgggguuucaccauguuggucccg

SEQ ID NO: 845040 - RNA, 27 nt, Human
acucuguugcccaggcuggaaugccuc

SEQ ID NO: 845041 - RNA, 24 nt, Human
agcgauucucccaccucagccucu

SEQ ID NO: 845042 - RNA, 24 nt, Human
aggugauccacccaccucggccuc

SEQ ID NO: 845043 - RNA, 19 nt, Human
auuacagguaugugccacc

SEQ ID NO: 845044 - RNA, 24 nt, Human
caaagugcugggauuacaggcaug

SEQ ID NO: 845045 - RNA, 23 nt, Human
caaccuccaccucccggguucaa

SEQ ID NO: 845046 - RNA, 22 nt, Human
caagcaauucuccugccucagc

SEQ ID NO: 845047 - RNA, 19 nt, Human
cacagccaccucugccucc

SEQ ID NO: 845048 - RNA, 23 nt, Human
cacagccaccucugccucccggg

SEQ ID NO: 845049 - RNA, 18 nt, Human
caccauguuggccaggcu

SEQ ID NO: 845050 - RNA, 22 nt, Human
caccauguuggccaggcuguuc

SEQ ID NO: 845051 - RNA, 24 nt, Human
caccauguuggccaggcuguucuc

SEQ ID NO: 845052 - RNA, 27 nt, Human
caccauguuggccaggcuguucucaaa

SEQ ID NO: 845053 - RNA, 22 nt, Human
cacccaccucggccucccaaag

SEQ ID NO: 845054 - RNA, 23 nt, Human
cacccaccucggccucccaaagu

SEQ ID NO: 845055 - RNA, 24 nt, Human
cacccgccuuggccucccgaagug

SEQ ID NO: 845056 - RNA, 21 nt, Human
caccgcaaccuccaccucccg

SEQ ID NO: 845057 - RNA, 23 nt, Human
caccgcaaccuccaccucccggg

SEQ ID NO: 845058 - RNA, 23 nt, Human
caccucagccucuugaguagcuu

SEQ ID NO: 845059 - RNA, 24 nt, Human
caccucccuucacuccuuucaguc

SEQ ID NO: 845060 - RNA, 19 nt, Human
caccucugccucccggguu

SEQ ID NO: 845061 - RNA, 22 nt, Human
cacucuguugcccaggcuggaa

SEQ ID NO: 845062 - RNA, 24 nt, Human
caggguuucaccauguuggccagg

SEQ ID NO: 845063 - RNA, 24 nt, Human
caggugugagccaccgugcccggc

SEQ ID NO: 845064 - RNA, 24 nt, Human
cauguuggccaggcuguucucaaa

SEQ ID NO: 845065 - RNA, 19 nt, Human
cauuacagguaugugccac

SEQ ID NO: 845066 - RNA, 23 nt, Human
ccaaagugcugggauuacaggca

SEQ ID NO: 845067 - RNA, 24 nt, Human
ccaaagugcugggauuacaggcau

SEQ ID NO: 845068 - RNA, 21 nt, Human
ccacagagucuccaucugaca

SEQ ID NO: 845069 - RNA, 23 nt, Human
ccacagagucuccaucugacaga

SEQ ID NO: 845070 - RNA, 20 nt, Human
ccaccacgcccaguuaauuu

SEQ ID NO: 845071 - RNA, 23 nt, Human
ccaccucagccucuugaguagcu

SEQ ID NO: 845072 - RNA, 26 nt, Human
ccaccucccggguucaagcaauucuu

SEQ ID NO: 845073 - RNA, 19 nt, Human
ccaucugacagaugagcug

SEQ ID NO: 845074 - RNA, 24 nt, Human
cccaaagugcugggauuacaggca

SEQ ID NO: 845075 - RNA, 23 nt, Human
cccaaguagcuggcauuacaggu

SEQ ID NO: 845076 - RNA, 24 nt, Human
cccagaccaacuaacaccuaacac

SEQ ID NO: 845077 - RNA, 22 nt, Human
cccaguuaauuuuguauuuuua

SEQ ID NO: 845078 - RNA, 23 nt, Human
cccccagaccaacuaacaccuaa

SEQ ID NO: 845079 - RNA, 24 nt, Human
cccgaagugcugggauuacaggug

SEQ ID NO: 845080 - RNA, 21 nt, Human
cccgcugaucucgaauuccca

SEQ ID NO: 845081 - RNA, 23 nt, Human
cccggguucaagcaauucuccug

SEQ ID NO: 845082 - RNA, 20 nt, Human
cccggguucaagcgauucuc

SEQ ID NO: 845083 - RNA, 23 nt, Human
cccuguccuuccacagagucucc

SEQ ID NO: 845084 - RNA, 23 nt, Human
ccgaagugcugggauuacaggug

SEQ ID NO: 845085 - RNA, 24 nt, Human
ccgaagugcugggauuacaggugu

SEQ ID NO: 845086 - RNA, 18 nt, Human
ccgcaaccuccaccuccc

SEQ ID NO: 845087 - RNA, 23 nt, Human
ccgcaaccuccaccucccggguu

SEQ ID NO: 845088 - RNA, 24 nt, Human
ccgcaaccuccaccucccggguuc

SEQ ID NO: 845089 - RNA, 22 nt, Human
ccucacucuguugcccaggcug

SEQ ID NO: 845090 - RNA, 24 nt, Human
ccucacucuguugcccaggcugga

SEQ ID NO: 845091 - RNA, 24 nt, Human
ccucccggguucaagcaauucucc

SEQ ID NO: 845092 - RNA, 24 nt, Human
ccucccggguucaagcgauucucc

SEQ ID NO: 845093 - RNA, 22 nt, Human
ccucccuucacuccuuucaguc

SEQ ID NO: 845094 - RNA, 24 nt, Human
ccugaccucaggugauccacccac

SEQ ID NO: 845095 - RNA, 24 nt, Human
ccugccucagccuucccaaguagc

SEQ ID NO: 845096 - RNA, 24 nt, Human
cgaagugcugggauuacaggugug

SEQ ID NO: 845097 - RNA, 24 nt, Human
cgggguuucaccauguuggucccg

SEQ ID NO: 845098 - RNA, 24 nt, Human
cucacagccaccucugccucccgg

SEQ ID NO: 845099 - RNA, 24 nt, Human
cucaccgcaaccuccaccucccgg

SEQ ID NO: 845100 - RNA, 19 nt, Human
cucaucugucacccccaga

SEQ ID NO: 845101 - RNA, 23 nt, Human
cucuuguugcccaggcuggagcg

SEQ ID NO: 845102 - RNA, 24 nt, Human
cugccucagccuucccaaguagcu

SEQ ID NO: 845103 - RNA, 24 nt, Human
cuugaguagcuuggacuacaggca

SEQ ID NO: 845104 - RNA, 24 nt, Human
cuugcucuuguugcccaggcugga

SEQ ID NO: 845105 - RNA, 20 nt, Human
gacccacccgccuuggccuc

SEQ ID NO: 845106 - RNA, 24 nt, Human
gaccucaggugauccacccaccuc

SEQ ID NO: 845107 - RNA, 24 nt, Human
gacuacaggcacucaucaccaugc

SEQ ID NO: 845108 - RNA, 23 nt, Human
gagacgggguuucaccauguugg

SEQ ID NO: 845109 - RNA, 24 nt, Human
gagacgggguuucaccauguuggu

SEQ ID NO: 845110 - RNA, 21 nt, Human
gagcugcccgaggguccugga

SEQ ID NO: 845111 - RNA, 18 nt, Human
gauuacaggcaugagcca

SEQ ID NO: 845112 - RNA, 22 nt, Human
gauuacaggcaugagccacugc

SEQ ID NO: 845113 - RNA, 23 nt, Human
gauuacaggcaugagccacugca

SEQ ID NO: 845114 - RNA, 18 nt, Human
gauuacaggugugagcca

SEQ ID NO: 845115 - RNA, 21 nt, Human
gauuacaggugugagccaccg

SEQ ID NO: 845116 - RNA, 24 nt, Human
gauuacaggugugagccaccgugc

SEQ ID NO: 845117 - RNA, 26 nt, Human
gcaauucuccugccucagccuuccca

SEQ ID NO: 845118 - RNA, 22 nt, Human
gccuuggccucccgaagugcug

SEQ ID NO: 845119 - RNA, 21 nt, Human
gcucuuguugcccaggcugga

SEQ ID NO: 845120 - RNA, 19 nt, Human
gcuggagcgcaauggcacg

SEQ ID NO: 845121 - RNA, 22 nt, Human
ggacuacaggcacucaucacca

SEQ ID NO: 845122 - RNA, 22 nt, Human
ggauuacaggcaugagccacug

SEQ ID NO: 845123 - RNA, 21 nt, Human
gggguuucaccauguuggucc

SEQ ID NO: 845124 - RNA, 22 nt, Human
ggguuucaccauguuggccagg

SEQ ID NO: 845125 - RNA, 23 nt, Human
guagagacgggguuucaccaugu

SEQ ID NO: 845126 - RNA, 24 nt, Human
gugacccacccgccuuggccuccc

SEQ ID NO: 845127 - RNA, 24 nt, Human
gugauccacccaccucggccuccc

SEQ ID NO: 845128 - RNA, 22 nt, Human
uaauuuuuuuauuuuuagcaga

SEQ ID NO: 845129 - RNA, 22 nt, Human
uacaggcaugagccacugcacc

SEQ ID NO: 845130 - RNA, 24 nt, Human
uacagguaugugccaccacgccca

SEQ ID NO: 845131 - RNA, 23 nt, Human
uacaggugugagccaccgugccc

SEQ ID NO: 845132 - RNA, 22 nt, Human
uagagacgggguuucaccaugu

SEQ ID NO: 845133 - RNA, 24 nt, Human
uagcagacacaggguuucaccaug

SEQ ID NO: 845134 - RNA, 24 nt, Human
uaguagagacgggguuucaccaug

SEQ ID NO: 845135 - RNA, 26 nt, Human
uaguagagacgggguuucaccauguu

SEQ ID NO: 845136 - RNA, 19 nt, Human
uaugugccaccacgcccag

SEQ ID NO: 845137 - RNA, 21 nt, Human
uaugugccaccacgcccaguu

SEQ ID NO: 845138 - RNA, 24 nt, Human
ucacagccaccucugccucccggg

SEQ ID NO: 845139 - RNA, 24 nt, Human
ucaccgcaaccuccaccucccggg

SEQ ID NO: 845140 - RNA, 27 nt, Human
ucaccgcaaccuccaccucccggguuc

SEQ ID NO: 845141 - RNA, 21 nt, Human
ucagcaccucccuucacuccu

SEQ ID NO: 845142 - RNA, 20 nt, Human
ucaggugauccacccaccuc

SEQ ID NO: 845143 - RNA, 23 nt, Human
ucaugugacccacccgccuuggc

SEQ ID NO: 845144 - RNA, 24 nt, Human
ucccaaagugcugggauuacaggc

SEQ ID NO: 845145 - RNA, 26 nt, Human
ucccaaccucaugugacccacccgcc

SEQ ID NO: 845146 - RNA, 24 nt, Human
ucccaaguagcuggcauuacaggu

SEQ ID NO: 845147 - RNA, 18 nt, Human
uccccuguccuuccacaa

SEQ ID NO: 845148 - RNA, 19 nt, Human
ucccgaagugcugggauua

SEQ ID NO: 845149 - RNA, 23 nt, Human
ucccgaagugcugggauuacagg

SEQ ID NO: 845150 - RNA, 24 nt, Human
ucccgaagugcugggauuacaggu

SEQ ID NO: 845151 - RNA, 21 nt, Human
ucccggguucaagcaauucuc

SEQ ID NO: 845152 - RNA, 24 nt, Human
ucccggguucaagcaauucuccug

SEQ ID NO: 845153 - RNA, 21 nt, Human
ucccggguucaagcgauucuc

SEQ ID NO: 845154 - RNA, 23 nt, Human
ucccggguucaagcgauucuccc

SEQ ID NO: 845155 - RNA, 18 nt, Human
ucggccucccaaagugcu

SEQ ID NO: 845156 - RNA, 24 nt, Human
ucucccaccucagccucuugagua

SEQ ID NO: 845157 - RNA, 26 nt, Human
ucuccugccucagccuucccaaguag

SEQ ID NO: 845158 - RNA, 21 nt, Human
ucugcucaucugucaccccca

SEQ ID NO: 845159 - RNA, 18 nt, Human
ucuguugcccaggcugga

SEQ ID NO: 845160 - RNA, 24 nt, Human
ucuugaguagcuuggacuacaggc

SEQ ID NO: 845161 - RNA, 24 nt, Human
ucuugcucuuguugcccaggcugg

SEQ ID NO: 845162 - RNA, 25 nt, Human
ucuugcucuuguugcccaggcugga

SEQ ID NO: 845163 - RNA, 21 nt, Human
ugaccucaggugauccaccca

SEQ ID NO: 845164 - RNA, 24 nt, Human
ugaccucaggugauccacccaccu

SEQ ID NO: 845165 - RNA, 18 nt, Human
ugagacagagucuugcuc

SEQ ID NO: 845166 - RNA, 23 nt, Human
ugagacagagucuugcucuuguu

SEQ ID NO: 845167 - RNA, 24 nt, Human
ugauccacccaccucggccuccca

SEQ ID NO: 845168 - RNA, 26 nt, Human
ugcaccuggccuuuucuccauaauuc

SEQ ID NO: 845169 - RNA, 24 nt, Human
ugcccaggcuggagcgcaauggca

SEQ ID NO: 845170 - RNA, 25 nt, Human
ugccucagccuucccaaguagcugg

SEQ ID NO: 845171 - RNA, 24 nt, Human
ugcugggauuacaggugugagcca

SEQ ID NO: 845172 - RNA, 23 nt, Human
uggacuacaggcacucaucacca

SEQ ID NO: 845173 - RNA, 24 nt, Human
uggcacgaucucagcucaccgcaa

SEQ ID NO: 845174 - RNA, 22 nt, Human
uggcauuacagguaugugccac

SEQ ID NO: 845175 - RNA, 24 nt, Human
uggcauuacagguaugugccacca

SEQ ID NO: 845176 - RNA, 24 nt, Human
uggccaggcuguucucaaacuccu

SEQ ID NO: 845177 - RNA, 18 nt, Human
ugggauuacaggcaugag

SEQ ID NO: 845178 - RNA, 19 nt, Human
ugggauuacaggcaugagc

SEQ ID NO: 845179 - RNA, 21 nt, Human
ugggauuacaggcaugagcca

SEQ ID NO: 845180 - RNA, 22 nt, Human
ugggauuacaggcaugagccac

SEQ ID NO: 845181 - RNA, 22 nt, Human
ugggauuacaggcaugagccac

SEQ ID NO: 845182 - RNA, 24 nt, Human
ugggauuacaggcaugagccacug

SEQ ID NO: 845183 - RNA, 24 nt, Human
ugggauuacaggcaugagccacug

SEQ ID NO: 845184 - RNA, 18 nt, Human
ugggauuacaggugugag

SEQ ID NO: 845185 - RNA, 21 nt, Human
ugggauuacaggugugagcca

SEQ ID NO: 845186 - RNA, 22 nt, Human
ugggauuacaggugugagccac

SEQ ID NO: 845187 - RNA, 23 nt, Human
ugggauuacaggugugagccacc

SEQ ID NO: 845188 - RNA, 23 nt, Human
ugggauuacaggugugagccacc

SEQ ID NO: 845189 - RNA, 24 nt, Human
ugggauuacaggugugagccaccg

SEQ ID NO: 845190 - RNA, 25 nt, Human
ugugagccaccgugcccggccccau

SEQ ID NO: 845191 - RNA, 24 nt, Human
uuagcagacacaggguuucaccau

SEQ ID NO: 845192 - RNA, 18 nt, Human
uuaguagagacgggguuu

SEQ ID NO: 845193 - RNA, 22 nt, Human
uuaguagagacgggguuucacc

SEQ ID NO: 845194 - RNA, 24 nt, Human
uuaguagagacgggguuucaccau

SEQ ID NO: 845195 - RNA, 21 nt, Human
uucaagcaauucuccugccuc

SEQ ID NO: 845196 - RNA, 24 nt, Human
uucaagcaauucuccugccucagc

SEQ ID NO: 845197 - RNA, 23 nt, Human
uucaagcgauucucccaccucag

SEQ ID NO: 845198 - RNA, 24 nt, Human
uucaagcgauucucccaccucagc

SEQ ID NO: 845199 - RNA, 18 nt, Human
uuccacagagucuccauc

SEQ ID NO: 845200 - RNA, 21 nt, Human
uugcccaggcuggaaugccuc

SEQ ID NO: 845201 - RNA, 18 nt, Human
uugcccaggcuggagcgc

SEQ ID NO: 845202 - RNA, 23 nt, Human
uugcucuuguugcccaggcugga

SEQ ID NO: 845203 - RNA, 18 nt, Human
uuggccucccgaagugcu

SEQ ID NO: 845204 - RNA, 23 nt, Human
uuguauuuuuaguagagacgggg

SEQ ID NO: 845205 - RNA, 21 nt, Human
uuucaccauguuggccaggcu

SEQ ID NO: 845206 - RNA, 19 nt, Human
uuuuguauuuuuaguagag

SEQ ID NO: 845207 - RNA, 20 nt, Human
uuuuguauuuuuaguagaga

SEQ ID NO: 845208 - RNA, 24 nt, Human
uuuuuagcagacacaggguuucac

SEQ ID NO: 845209 - RNA, 24 nt, Human
uuuuuaguagagacgggguuucac

SEQ ID NO: 845210 - RNA, 20 nt, Human
uuuuuuuuuuugagacagag

SEQ ID NO: 845211 - RNA, 24 nt, Human
uuuuuuuuuuuugagacagagucu

SEQ ID NO: 845212 - RNA, 18 nt, Human
uuuuuuuuuuuuuuuuug

SEQ ID NO: 845213 - RNA, 20 nt, Human
aauugcuugaacccagaagg

SEQ ID NO: 845214 - RNA, 24 nt, Human
aauugcuugaacccagaaggcaga

SEQ ID NO: 845215 - RNA, 23 nt, Human
acacgcaacucacugacucaacc

SEQ ID NO: 845216 - RNA, 22 nt, Human
acagaguaagacuccaucaaaa

SEQ ID NO: 845217 - RNA, 19 nt, Human
accauuggaucaugaaagu

SEQ ID NO: 845218 - RNA, 22 nt, Human
accauuguacuccagccugggc

SEQ ID NO: 845219 - RNA, 24 nt, Human
accauuguacuccagccugggcga

SEQ ID NO: 845220 - RNA, 18 nt, Human
accuccugggccgcgcac

SEQ ID NO: 845221 - RNA, 18 nt, Human
acucaggagacuucccuc

SEQ ID NO: 845222 - RNA, 21 nt, Human
acuccagccugggcgacagag

SEQ ID NO: 845223 - RNA, 18 nt, Human
agacaaggaugaaggagg

SEQ ID NO: 845224 - RNA, 24 nt, Human
agacuccaucaaaagcgaagccaa

SEQ ID NO: 845225 - RNA, 22 nt, Human
agcauaagaggcgagaggaggg

SEQ ID NO: 845226 - RNA, 24 nt, Human
agccugggcgacagaguaagacuc

SEQ ID NO: 845227 - RNA, 19 nt, Human
aggaaugaaggaggugagg

SEQ ID NO: 845228 - RNA, 18 nt, Human
aggaggcugaggcagaga

SEQ ID NO: 845229 - RNA, 22 nt, Human
aggaugaaggaggggauguggg

SEQ ID NO: 845230 - RNA, 23 nt, Human
aggcagagaauugcuugaaccca

SEQ ID NO: 845231 - RNA, 24 nt, Human
aggcagagguagcagguggcugag

SEQ ID NO: 845232 - RNA, 23 nt, Human
aggcugaggcagagaauugcuug

SEQ ID NO: 845233 - RNA, 22 nt, Human
agggcggcggcggcggcggcgg

SEQ ID NO: 845234 - RNA, 18 nt, Human
agguccccgccacaaguu

SEQ ID NO: 845235 - RNA, 24 nt, Human
auuguacuccagccugggcgacag

SEQ ID NO: 845236 - RNA, 19 nt, Human
caacucacugacucaacca

SEQ ID NO: 845237 - RNA, 20 nt, Human
cacucaggagacuucccuca

SEQ ID NO: 845238 - RNA, 21 nt, Human
cagcccuuggggaguggggag

SEQ ID NO: 845239 - RNA, 19 nt, Human
cagcggcugcaggccuggc

SEQ ID NO: 845240 - RNA, 18 nt, Human
caggaggcugaggcagag

SEQ ID NO: 845241 - RNA, 21 nt, Human
caggcacgugccuagaaggcc

SEQ ID NO: 845242 - RNA, 18 nt, Human
caggccuggccgauugug

SEQ ID NO: 845243 - RNA, 24 nt, Human
caguuacucaggaggcugaggcag

SEQ ID NO: 845244 - RNA, 20 nt, Human
caugcccugugagcauaaga

SEQ ID NO: 845245 - RNA, 19 nt, Human
cauuguacuccagccuggg

SEQ ID NO: 845246 - RNA, 21 nt, Human
cauuguacuccagccugggcg

SEQ ID NO: 845247 - RNA, 22 nt, Human
cauuguacuccagccugggcga

SEQ ID NO: 845248 - RNA, 24 nt, Human
cauuguacuccagccugggcgaca

SEQ ID NO: 845249 - RNA, 20 nt, Human
ccauuguacuccagccuggg

SEQ ID NO: 845250 - RNA, 21 nt, Human
ccauuguacuccagccugggc

SEQ ID NO: 845251 - RNA, 22 nt, Human
ccauuguacuccagccugggcg

SEQ ID NO: 845252 - RNA, 23 nt, Human
ccauuguacuccagccugggcga

SEQ ID NO: 845253 - RNA, 24 nt, Human
ccauuguacuccagccugggcgac

SEQ ID NO: 845254 - RNA, 20 nt, Human
cccaggcuucucugucccuu

SEQ ID NO: 845255 - RNA, 18 nt, Human
cccauggccaugcucugc

SEQ ID NO: 845256 - RNA, 20 nt, Human
cccggcucgcgccgcggccg

SEQ ID NO: 845257 - RNA, 22 nt, Human
cccggcucgcgccgcggccgcg

SEQ ID NO: 845258 - RNA, 20 nt, Human
ccuccugguccucuuccaug

SEQ ID NO: 845259 - RNA, 22 nt, Human
ccugggcgacagaguaagacuc

SEQ ID NO: 845260 - RNA, 21 nt, Human
ccugugagcauaagaggcgag

SEQ ID NO: 845261 - RNA, 21 nt, Human
cgcaccauuguacuccagccu

SEQ ID NO: 845262 - RNA, 19 nt, Human
cggcggcagcggcugcagg

SEQ ID NO: 845263 - RNA, 22 nt, Human
cuaaccgaguucgagaccacag

SEQ ID NO: 845264 - RNA, 21 nt, Human
cugcaauuccaguuacucagg

SEQ ID NO: 845265 - RNA, 22 nt, Human
gaacccagaaggcagagguagc

SEQ ID NO: 845266 - RNA, 20 nt, Human
gaaccgaugugugacugaug

SEQ ID NO: 845267 - RNA, 18 nt, Human
gaaugaaggaggugaggg

SEQ ID NO: 845268 - RNA, 21 nt, Human
gacugaugaagguaggaaaga

SEQ ID NO: 845269 - RNA, 23 nt, Human
gagcauaagaggcgagaggaggg

SEQ ID NO: 845270 - RNA, 20 nt, Human
gcaccauuguacuccagccu

SEQ ID NO: 845271 - RNA, 23 nt, Human
gcggcagcggcugcaggccuggc

SEQ ID NO: 845272 - RNA, 21 nt, Human
gcggcggcagcggcugcaggc

SEQ ID NO: 845273 - RNA, 20 nt, Human
gcggcggcggcggcggcggc

SEQ ID NO: 845274 - RNA, 20 nt, Human
gcggcggcggcggcggcggc

SEQ ID NO: 845275 - RNA, 23 nt, Human
gcggcggcggcggcggcggcagc

SEQ ID NO: 845276 - RNA, 24 nt, Human
gcggcggcggcggcggcggcggca

SEQ ID NO: 845277 - RNA, 21 nt, Human
ggcagcggcugcaggccuggc

SEQ ID NO: 845278 - RNA, 20 nt, Human
ggcggcagcggcugcaggcc

SEQ ID NO: 845279 - RNA, 23 nt, Human
ggcggcggcggcggcagcggcug

SEQ ID NO: 845280 - RNA, 27 nt, Human
gggaguggggagguagccuugggggaa

SEQ ID NO: 845281 - RNA, 24 nt, Human
gggcggcggcggcggcggcggcgg

SEQ ID NO: 845282 - RNA, 18 nt, Human
gguccccgccacaaguuc

SEQ ID NO: 845283 - RNA, 22 nt, Human
ggucuaucaagcaccagcccuu

SEQ ID NO: 845284 - RNA, 24 nt, Human
guacuccagccugggcgacagagu

SEQ ID NO: 845285 - RNA, 24 nt, Human
guggcacacuaauggaggcgacca

SEQ ID NO: 845286 - RNA, 18 nt, Human
uaagaggcgagaggaggg

SEQ ID NO: 845287 - RNA, 21 nt, Human
uaccuccugggccgcgcaccc

SEQ ID NO: 845288 - RNA, 23 nt, Human
uacgaauagagugaacucaaaua

SEQ ID NO: 845289 - RNA, 21 nt, Human
uacgguggcacacuaauggag

SEQ ID NO: 845290 - RNA, 22 nt, Human
uacuccagccugggcgacagag

SEQ ID NO: 845291 - RNA, 21 nt, Human
uauccuggaggccaaagacag

SEQ ID NO: 845292 - RNA, 24 nt, Human
uccagccugggcgacagaguaaga

SEQ ID NO: 845293 - RNA, 19 nt, Human
ucccauggccaugcucugc

SEQ ID NO: 845294 - RNA, 23 nt, Human
ucccggcucgcgccgcggccgcg

SEQ ID NO: 845295 - RNA, 24 nt, Human
ucccugaguagggcggcggcggcg

SEQ ID NO: 845296 - RNA, 22 nt, Human
uccugggccgcgcacccgaccc

SEQ ID NO: 845297 - RNA, 23 nt, Human
uccugggccgcgcacccgacccu

SEQ ID NO: 845298 - RNA, 23 nt, Human
ucgcaccauuguacuccagccug

SEQ ID NO: 845299 - RNA, 18 nt, Human
ucucaccaaaagugaagc

SEQ ID NO: 845300 - RNA, 18 nt, Human
ucucauccccucuuccca

SEQ ID NO: 845301 - RNA, 22 nt, Human
ucucugucccuucaccggacua

SEQ ID NO: 845302 - RNA, 23 nt, Human
ugaaacaccauuggaucaugaaa

SEQ ID NO: 845303 - RNA, 19 nt, Human
ugaaggaggugaggguggc

SEQ ID NO: 845304 - RNA, 21 nt, Human
ugaagguaggaaagaagggaa

SEQ ID NO: 845305 - RNA, 18 nt, Human
ugagagggacaggucccc

SEQ ID NO: 845306 - RNA, 23 nt, Human
ugagcuccuccugguccucuucc

SEQ ID NO: 845307 - RNA, 23 nt, Human
ugaggcagagaauugcuugaacc

SEQ ID NO: 845308 - RNA, 23 nt, Human
ugaggcagagaauugcuugaacc

SEQ ID NO: 845309 - RNA, 24 nt, Human
ugaggcagagaauugcuugaaccc

SEQ ID NO: 845310 - RNA, 18 nt, Human
ugcccugugagcauaaga

SEQ ID NO: 845311 - RNA, 21 nt, Human
ugcccugugagcauaagaggc

SEQ ID NO: 845312 - RNA, 25 nt, Human
ugcucugcucugaccugcaauucca

SEQ ID NO: 845313 - RNA, 22 nt, Human
ugggcaaaggccacucaccaaa

SEQ ID NO: 845314 - RNA, 25 nt, Human
ugguuggucaggggcugugcaccuc

SEQ ID NO: 845315 - RNA, 22 nt, Human
uguacuccagccugggcgacag

SEQ ID NO: 845316 - RNA, 24 nt, Human
uguacuccagccugggcgacagag

SEQ ID NO: 845317 - RNA, 18 nt, Human
ugugucaccaugcccugu

SEQ ID NO: 845318 - RNA, 24 nt, Human
uucgcaccauuguacuccagccug

SEQ ID NO: 845319 - RNA, 19 nt, Human
acccaccccuacccuucgc

SEQ ID NO: 845320 - RNA, 22 nt, Human
agaggcaggaagaggcaguaga

SEQ ID NO: 845321 - RNA, 22 nt, Human
agcuaugacccuucucuccccu

SEQ ID NO: 845322 - RNA, 21 nt, Human
aggagcugaggcguguacaag

SEQ ID NO: 845323 - RNA, 21 nt, Human
aggcaggaagaggcaguaggg

SEQ ID NO: 845324 - RNA, 21 nt, Human
aguagagggaaaugacauuug

SEQ ID NO: 845325 - RNA, 20 nt, Human
aucacuguccuucaugcacu

SEQ ID NO: 845326 - RNA, 25 nt, Human
cagaacagaaaagcagguugggaca

SEQ ID NO: 845327 - RNA, 23 nt, Human
ccagaaaggcuuacuuuaugaua

SEQ ID NO: 845328 - RNA, 21 nt, Human
cccaccccuacccuucgccca

SEQ ID NO: 845329 - RNA, 25 nt, Human
cccaccccuacccuucgcccagaca

SEQ ID NO: 845330 - RNA, 22 nt, Human
cccagacagacgucggaucuau

SEQ ID NO: 845331 - RNA, 23 nt, Human
ccccacggccuccccacaucacu

SEQ ID NO: 845332 - RNA, 19 nt, Human
ccccuacccaccccuaccc

SEQ ID NO: 845333 - RNA, 21 nt, Human
cccuacccaccccuacccuuc

SEQ ID NO: 845334 - RNA, 24 nt, Human
ccuacccaccccuacccuucgccc

SEQ ID NO: 845335 - RNA, 20 nt, Human
ccucuguggaugugggcagg

SEQ ID NO: 845336 - RNA, 25 nt, Human
cgccccuacccaccccuacccuucg

SEQ ID NO: 845337 - RNA, 19 nt, Human
cuguggaugugggcagggu

SEQ ID NO: 845338 - RNA, 20 nt, Human
gaggcguguacaagccauga

SEQ ID NO: 845339 - RNA, 23 nt, Human
gccccacggccuccccacaucac

SEQ ID NO: 845340 - RNA, 20 nt, Human
ggggugggucauggagucca

SEQ ID NO: 845341 - RNA, 26 nt, Human
uaacagaacagaaaagcagguuggga

SEQ ID NO: 845342 - RNA, 23 nt, Human
uaugcuaacagaacagaaaagca

SEQ ID NO: 845343 - RNA, 20 nt, Human
uaugcugcaccagggguggg

SEQ ID NO: 845344 - RNA, 20 nt, Human
uccccacaucacuguccuuc

SEQ ID NO: 845345 - RNA, 21 nt, Human
ucccgccccuacccaccccua

SEQ ID NO: 845346 - RNA, 21 nt, Human
ugggacaagauacagacuuug

SEQ ID NO: 845347 - RNA, 23 nt, Human
ugggacaagauacagacuuuguu

SEQ ID NO: 845348 - RNA, 18 nt, Human
uggggagaggcaggaaga

SEQ ID NO: 845349 - RNA, 18 nt, Human
ugggucauggaguccagc

SEQ ID NO: 845350 - RNA, 24 nt, Human
uuugcacucaggcuucccgccccu

SEQ ID NO: 845351 - RNA, 22 nt, Human
uuuguugcauuuagcuaugacc

SEQ ID NO: 845352 - RNA, 23 nt, Human
aacagagcccuguaaaacugccu

SEQ ID NO: 845353 - RNA, 22 nt, Human
aaugaugaaccugagcaggcac

SEQ ID NO: 845354 - RNA, 21 nt, Human
acagagcccuguaaaacugcc

SEQ ID NO: 845355 - RNA, 23 nt, Human
agagucccccggcccgacuuccc

SEQ ID NO: 845356 - RNA, 22 nt, Human
agucccccgguguaauucccag

SEQ ID NO: 845357 - RNA, 19 nt, Human
caacaggaaaccacacgcc

SEQ ID NO: 845358 - RNA, 21 nt, Human
caaugaugaaccugagguacc

SEQ ID NO: 845359 - RNA, 22 nt, Human
cagcgcuguaaacacgugccca

SEQ ID NO: 845360 - RNA, 24 nt, Human
cccagacgcgcuacagcaacgccg

SEQ ID NO: 845361 - RNA, 21 nt, Human
cccgcaggcacgaagcgggcc

SEQ ID NO: 845362 - RNA, 19 nt, Human
ccggcuguuuccucccugu

SEQ ID NO: 845363 - RNA, 20 nt, Human
cggcuguuuccucccuguuu

SEQ ID NO: 845364 - RNA, 26 nt, Human
cuacagcaacgccggcuguuuccucc

SEQ ID NO: 845365 - RNA, 19 nt, Human
cugacagugccccgggcac

SEQ ID NO: 845366 - RNA, 22 nt, Human
cugcugagccaucugacagugc

SEQ ID NO: 845367 - RNA, 22 nt, Human
gaccuucaguugaugugacugu

SEQ ID NO: 845368 - RNA, 21 nt, Human
gacuucccgcaggcacgaagc

SEQ ID NO: 845369 - RNA, 20 nt, Human
gaggcucggaguuuccgaag

SEQ ID NO: 845370 - RNA, 18 nt, Human
gcagcgcuguaaacacgu

SEQ ID NO: 845371 - RNA, 20 nt, Human
ggaaaccacacgccccauca

SEQ ID NO: 845372 - RNA, 22 nt, Human
gguaagaaaggcaugaaaggga

SEQ ID NO: 845373 - RNA, 21 nt, Human
gugagacaacaggaaaccaca

SEQ ID NO: 845374 - RNA, 20 nt, Human
uaagaaaggcaugaaaggga

SEQ ID NO: 845375 - RNA, 18 nt, Human
uacaagacuaugcagcag

SEQ ID NO: 845376 - RNA, 20 nt, Human
uccgaagagucccccggccc

SEQ ID NO: 845377 - RNA, 22 nt, Human
ucucugaggcucggaguuuccg

SEQ ID NO: 845378 - RNA, 23 nt, Human
ugaccuucaguugaugugacugu

SEQ ID NO: 845379 - RNA, 21 nt, Human
ugagcaggcacugcugagcca

SEQ ID NO: 845380 - RNA, 19 nt, Human
uucccgcaggcacgaagcg

SEQ ID NO: 845381 - RNA, 28 nt, Human
uuuuuuuuuuuuucuagguuuguuuuuu

SEQ ID NO: 845382 - RNA, 25 nt, Human
uuuuuuuuuuuuuuuuucuagguuu

SEQ ID NO: 845383 - RNA, 23 nt, Human
uuuuuuuuuuuuuuuuuucuagg

SEQ ID NO: 845384 - RNA, 23 nt, Human
aaaccagggcccaagagugggaa

SEQ ID NO: 845385 - RNA, 23 nt, Human
aagaacagaggaggaagcccagc

SEQ ID NO: 845386 - RNA, 20 nt, Human
aagcggcccccugggugggc

SEQ ID NO: 845387 - RNA, 21 nt, Human
aagcggcccccugggugggcc

SEQ ID NO: 845388 - RNA, 22 nt, Human
acaaaaccagggcccaagagug

SEQ ID NO: 845389 - RNA, 22 nt, Human
acauccacgcccaccugcucag

SEQ ID NO: 845390 - RNA, 25 nt, Human
acccgaauguggcugggacuccuug

SEQ ID NO: 845391 - RNA, 18 nt, Human
acgcggugguccugcgcu

SEQ ID NO: 845392 - RNA, 20 nt, Human
agcgcccauccucugcccag

SEQ ID NO: 845393 - RNA, 19 nt, Human
aggcagaaguauucgaccc

SEQ ID NO: 845394 - RNA, 21 nt, Human
aggcagcaccaacauugggga

SEQ ID NO: 845395 - RNA, 27 nt, Human
aggcagcaccaacauuggggauggucc

SEQ ID NO: 845396 - RNA, 21 nt, Human
aggggaagcuccauugcgacc

SEQ ID NO: 845397 - RNA, 21 nt, Human
agugacccacccuggagcagc

SEQ ID NO: 845398 - RNA, 19 nt, Human
caagaacagaggaggaagc

SEQ ID NO: 845399 - RNA, 24 nt, Human
cacauccacgcccaccugcucagg

SEQ ID NO: 845400 - RNA, 21 nt, Human
caccaggaugucaggcaggua

SEQ ID NO: 845401 - RNA, 22 nt, Human
caccgcccuaggggaagcucca

SEQ ID NO: 845402 - RNA, 22 nt, Human
caccuucuugucauaggugcca

SEQ ID NO: 845403 - RNA, 19 nt, Human
cagcgcaaugcaggcugcc

SEQ ID NO: 845404 - RNA, 19 nt, Human
cagcugccgcaggucccac

SEQ ID NO: 845405 - RNA, 22 nt, Human
cagcugccgcaggucccacaag

SEQ ID NO: 845406 - RNA, 21 nt, Human
caggccaggacgcucacccga

SEQ ID NO: 845407 - RNA, 19 nt, Human
ccacgcccaccugcucagg

SEQ ID NO: 845408 - RNA, 22 nt, Human
ccaggacgcucacccgaaugug

SEQ ID NO: 845409 - RNA, 21 nt, Human
cccaagagugggaagcggccc

SEQ ID NO: 845410 - RNA, 22 nt, Human
ccccaagaacagaggaggaagc

SEQ ID NO: 845411 - RNA, 21 nt, Human
ccccaauuucacccuuccccc

SEQ ID NO: 845412 - RNA, 20 nt, Human
ccccagcugccgcagguccc

SEQ ID NO: 845413 - RNA, 27 nt, Human
cccccaagaacagaggaggaagcccag

SEQ ID NO: 845414 - RNA, 27 nt, Human
ccccugggugggccugaaccccaauuu

SEQ ID NO: 845415 - RNA, 19 nt, Human
cccgcgacaggacguggag

SEQ ID NO: 845416 - RNA, 21 nt, Human
ccgccagcagggucagcacgg

SEQ ID NO: 845417 - RNA, 18 nt, Human
ccuggacgcggcccgagg

SEQ ID NO: 845418 - RNA, 25 nt, Human
cgcgcguacgcggcguagcgcgcgu

SEQ ID NO: 845419 - RNA, 20 nt, Human
cgcucucaacugagagcggg

SEQ ID NO: 845420 - RNA, 20 nt, Human
cggccagucaaaguucuucu

SEQ ID NO: 845421 - RNA, 22 nt, Human
cggccgaaacccuggacgcggc

SEQ ID NO: 845422 - RNA, 21 nt, Human
cuccuugugcccuaggcccac

SEQ ID NO: 845423 - RNA, 19 nt, Human
cugccagugaccacaccca

SEQ ID NO: 845424 - RNA, 23 nt, Human
cugccagugaccacacccagccc

SEQ ID NO: 845425 - RNA, 22 nt, Human
cugccaugucccagagcuucac

SEQ ID NO: 845426 - RNA, 20 nt, Human
cugggccggcucuggggucg

SEQ ID NO: 845427 - RNA, 20 nt, Human
gacccacccuggagcagcag

SEQ ID NO: 845428 - RNA, 18 nt, Human
gacguggagcacgaggcg

SEQ ID NO: 845429 - RNA, 21 nt, Human
gcacugagucaacggaagcca

SEQ ID NO: 845430 - RNA, 24 nt, Human
gcacugagucaacggaagccacgu

SEQ ID NO: 845431 - RNA, 25 nt, Human
gcagcaccaacauuggggauggucc

SEQ ID NO: 845432 - RNA, 25 nt, Human
gccgaaacccuggacgcggcccgag

SEQ ID NO: 845433 - RNA, 19 nt, Human
gcguagccuccaggugaca

SEQ ID NO: 845434 - RNA, 19 nt, Human
ggacaggugcugcuccagc

SEQ ID NO: 845435 - RNA, 18 nt, Human
ggagcccgacagacagag

SEQ ID NO: 845436 - RNA, 24 nt, Human
gggaagcggcccccugggugggcc

SEQ ID NO: 845437 - RNA, 22 nt, Human
gggcauagggcccaggccagga

SEQ ID NO: 845438 - RNA, 22 nt, Human
gggcgcugccggccucgcgucu

SEQ ID NO: 845439 - RNA, 21 nt, Human
ggugcuucaacagggcugggc

SEQ ID NO: 845440 - RNA, 18 nt, Human
guaggagaggcacagcac

SEQ ID NO: 845441 - RNA, 24 nt, Human
gucaccuucuugucauaggugcca

SEQ ID NO: 845442 - RNA, 22 nt, Human
uacgcggcguagcgcgcguagc

SEQ ID NO: 845443 - RNA, 21 nt, Human
uaggugccagucaccaggaug

SEQ ID NO: 845444 - RNA, 25 nt, Human
ucagaaccugguuggacuccguccc

SEQ ID NO: 845445 - RNA, 24 nt, Human
uccacauccacgcccaccugcuca

SEQ ID NO: 845446 - RNA, 21 nt, Human
ucccaggagccggagcacacg

SEQ ID NO: 845447 - RNA, 24 nt, Human
ucccccaagaacagaggaggaagc

SEQ ID NO: 845448 - RNA, 21 nt, Human
uccgcugccaugucccagagc

SEQ ID NO: 845449 - RNA, 27 nt, Human
uggagcagcagcacugagucaacggaa

SEQ ID NO: 845450 - RNA, 23 nt, Human
ugggaagcggcccccuggguggg

SEQ ID NO: 845451 - RNA, 19 nt, Human
ugggccugaaccccaauuu

SEQ ID NO: 845452 - RNA, 18 nt, Human
uggguagggcgcgcguac

SEQ ID NO: 845453 - RNA, 21 nt, Human
uggugcuucaacagggcuggg

SEQ ID NO: 845454 - RNA, 22 nt, Human
ugucccaggagccggagcacac

SEQ ID NO: 845455 - RNA, 24 nt, Human
uuuuuuuuuuuuuuuuuuuccaag

SEQ ID NO: 845456 - RNA, 18 nt, Human
aaaaagggaggaguggag

SEQ ID NO: 845457 - RNA, 24 nt, Human
aaaacaaacaaaacaacaaaaccc

SEQ ID NO: 845458 - RNA, 21 nt, Human
aaaacaacaaaacccccaaug

SEQ ID NO: 845459 - RNA, 22 nt, Human
aaaacaacaaaacccccaaugg

SEQ ID NO: 845460 - RNA, 23 nt, Human
aaaaggggaugccagcauaaucc

SEQ ID NO: 845461 - RNA, 19 nt, Human
aaacaaaacaacaaaaccc

SEQ ID NO: 845462 - RNA, 21 nt, Human
aaacaaaacaacaaaaccccc

SEQ ID NO: 845463 - RNA, 23 nt, Human
aaacaaaacaacaaaacccccaa

SEQ ID NO: 845464 - RNA, 24 nt, Human
aaacaaaacaacaaaacccccaau

SEQ ID NO: 845465 - RNA, 26 nt, Human
aaacaaacaaaacaacaaaaccccca

SEQ ID NO: 845466 - RNA, 20 nt, Human
aacaaaacaacaaaaccccc

SEQ ID NO: 845467 - RNA, 19 nt, Human
aagaguccagagcuaacag

SEQ ID NO: 845468 - RNA, 20 nt, Human
aaguguuaagaguccagagc

SEQ ID NO: 845469 - RNA, 21 nt, Human
aaguguuaagaguccagagcu

SEQ ID NO: 845470 - RNA, 22 nt, Human
aauuuuuuuaaaaaagggagga

SEQ ID NO: 845471 - RNA, 21 nt, Human
acaaaacaacaaaacccccaa

SEQ ID NO: 845472 - RNA, 21 nt, Human
acauggucauuuuaaagggaa

SEQ ID NO: 845473 - RNA, 23 nt, Human
acuuagaagaauuaagaaagaaa

SEQ ID NO: 845474 - RNA, 25 nt, Human
agaaagaaaacauaguuggucacaa

SEQ ID NO: 845475 - RNA, 23 nt, Human
agcaauggaaacaucccggcaaa

SEQ ID NO: 845476 - RNA, 18 nt, Human
aggaaagaaaagucaacu

SEQ ID NO: 845477 - RNA, 25 nt, Human
aggaaagaaaagucaacuuagaaga

SEQ ID NO: 845478 - RNA, 22 nt, Human
aggcugagaauauaaggaacag

SEQ ID NO: 845479 - RNA, 20 nt, Human
caaaacccccaaugguccua

SEQ ID NO: 845480 - RNA, 23 nt, Human
caaacaaaacaacaaaaccccca

SEQ ID NO: 845481 - RNA, 18 nt, Human
cacugcacaggaaaaagg

SEQ ID NO: 845482 - RNA, 23 nt, Human
ccuuaccuagggcugcucagagg

SEQ ID NO: 845483 - RNA, 20 nt, Human
cgagccuggacgcgaccggg

SEQ ID NO: 845484 - RNA, 25 nt, Human
cgcgaccgggcccuuucucgcgcgc

SEQ ID NO: 845485 - RNA, 24 nt, Human
cgcgcgccagcucacgcacgcgcg

SEQ ID NO: 845486 - RNA, 24 nt, Human
cggacauaaaaaacaaacaaaaca

SEQ ID NO: 845487 - RNA, 21 nt, Human
cuagcaauuucagaagaguaa

SEQ ID NO: 845488 - RNA, 20 nt, Human
cucacgcacgcgcgagugcg

SEQ ID NO: 845489 - RNA, 23 nt, Human
cucacgcacgcgcgagugcgcgc

SEQ ID NO: 845490 - RNA, 24 nt, Human
cucccacgucagagagaaccuuac

SEQ ID NO: 845491 - RNA, 20 nt, Human
gacauaaaaaacaaacaaaa

SEQ ID NO: 845492 - RNA, 25 nt, Human
gagcaaguucucauauaugaccgca

SEQ ID NO: 845493 - RNA, 21 nt, Human
gaguccagagcuaacagaaga

SEQ ID NO: 845494 - RNA, 20 nt, Human
gcgagugcgcgcugcuuccc

SEQ ID NO: 845495 - RNA, 25 nt, Human
gcggcagcgacggcggcucccacgu

SEQ ID NO: 845496 - RNA, 18 nt, Human
gcugagaauauaaggaac

SEQ ID NO: 845497 - RNA, 18 nt, Human
ggaaagaaaagucaacuu

SEQ ID NO: 845498 - RNA, 19 nt, Human
ggaguggaguaaaacaagg

SEQ ID NO: 845499 - RNA, 27 nt, Human
ggcuacagagacuaguuucaggaggaa

SEQ ID NO: 845500 - RNA, 23 nt, Human
guaaaaggcugcuugccacuaca

SEQ ID NO: 845501 - RNA, 24 nt, Human
guuaagaguccagagcuaacagaa

SEQ ID NO: 845502 - RNA, 23 nt, Human
uaaaaaacaaacaaaacaacaaa

SEQ ID NO: 845503 - RNA, 24 nt, Human
uaaaaaacaaacaaaacaacaaaa

SEQ ID NO: 845504 - RNA, 24 nt, Human
uacagagacuaguuucaggaggaa

SEQ ID NO: 845505 - RNA, 21 nt, Human
uaccuagggcugcucagaggc

SEQ ID NO: 845506 - RNA, 21 nt, Human
ucaacuuagaagaauuaagaa

SEQ ID NO: 845507 - RNA, 19 nt, Human
ucagaagaguaacuuaagu

SEQ ID NO: 845508 - RNA, 21 nt, Human
ucaguccgcaauuauccuacc

SEQ ID NO: 845509 - RNA, 20 nt, Human
ugacaagagccuccgggugg

SEQ ID NO: 845510 - RNA, 22 nt, Human
uggcggcagcgacggcggcucc

SEQ ID NO: 845511 - RNA, 18 nt, Human
uucaggaggaaagaaaag

SEQ ID NO: 845512 - RNA, 21 nt, Human
agggaaggggagugggauggg

SEQ ID NO: 845513 - RNA, 20 nt, Human
ggagggaaggggagugggau

SEQ ID NO: 845514 - RNA, 24 nt, Human
ggagggaaggggagugggaugggg

SEQ ID NO: 845515 - RNA, 21 nt, Human
ggagugggauggggugggggc

SEQ ID NO: 845516 - RNA, 19 nt, Human
gggaaggggagugggaugg

SEQ ID NO: 845517 - RNA, 19 nt, Human
gggagggaaggggaguggg

SEQ ID NO: 845518 - RNA, 20 nt, Human
uggggagggaaggggagugg

SEQ ID NO: 845519 - RNA, 21 nt, Human
uggggagggaaggggaguggg

SEQ ID NO: 845520 - RNA, 18 nt, Human
uuuuuuuuuuuuuuuuug

SEQ ID NO: 845521 - RNA, 24 nt, Human
uuuuuuuuuuuuuuuuuugcuuuu

SEQ ID NO: 845522 - RNA, 29 nt, Human
uuuuuuuuuuuuuuuuuuuugcuuuuuaa

SEQ ID NO: 845523 - RNA, 21 nt, Human
aaacaaccagaucccaugagc

SEQ ID NO: 845524 - RNA, 22 nt, Human
aaacaaccagaucccaugagca

SEQ ID NO: 845525 - RNA, 18 nt, Human
aaggagcccugagggggc

SEQ ID NO: 845526 - RNA, 20 nt, Human
aaggagcccugagggggccu

SEQ ID NO: 845527 - RNA, 18 nt, Human
acgagaccagccugccca

SEQ ID NO: 845528 - RNA, 20 nt, Human
acucacaguuuugcaggcuu

SEQ ID NO: 845529 - RNA, 23 nt, Human
acucacuaucacgagaccagccu

SEQ ID NO: 845530 - RNA, 22 nt, Human
agaaaggcagaggagaggcagg

SEQ ID NO: 845531 - RNA, 23 nt, Human
agaggagaggcaggggggcuggu

SEQ ID NO: 845532 - RNA, 22 nt, Human
agaggcaggggggcuggugcug

SEQ ID NO: 845533 - RNA, 20 nt, Human
aggaagcauggcuggggagc

SEQ ID NO: 845534 - RNA, 22 nt, Human
aggcaaggagcccugagggggc

SEQ ID NO: 845535 - RNA, 19 nt, Human
aggcagaggagaggcaggg

SEQ ID NO: 845536 - RNA, 23 nt, Human
aggcagaggagaggcaggggggc

SEQ ID NO: 845537 - RNA, 19 nt, Human
aggcaggguacggggugug

SEQ ID NO: 845538 - RNA, 27 nt, Human
agggggccugugggugcaggagcuggg

SEQ ID NO: 845539 - RNA, 24 nt, Human
auuccaggcaggguacggggugug

SEQ ID NO: 845540 - RNA, 18 nt, Human
cacgagaccagccugccc

SEQ ID NO: 845541 - RNA, 18 nt, Human
cacgagaccagccugccc

SEQ ID NO: 845542 - RNA, 20 nt, Human
cacggcagaaggcgaagggg

SEQ ID NO: 845543 - RNA, 24 nt, Human
cacucacuaucacgagaccagccu

SEQ ID NO: 845544 - RNA, 21 nt, Human
cagaaaggcagaggagaggca

SEQ ID NO: 845545 - RNA, 21 nt, Human
cagaaggcgaaggggaagcag

SEQ ID NO: 845546 - RNA, 25 nt, Human
cagaaggcgaaggggaagcaggcac

SEQ ID NO: 845547 - RNA, 23 nt, Human
cagccugcccauggcccuccccu

SEQ ID NO: 845548 - RNA, 22 nt, Human
caggggcuggucuggcuccccc

SEQ ID NO: 845549 - RNA, 25 nt, Human
cccauggcccuccccuaaacccucc

SEQ ID NO: 845550 - RNA, 21 nt, Human
ccuaaacccuccugagugcaa

SEQ ID NO: 845551 - RNA, 21 nt, Human
ccuccccuaaacccuccugag

SEQ ID NO: 845552 - RNA, 22 nt, Human
ccuccccuaaacccuccugagu

SEQ ID NO: 845553 - RNA, 24 nt, Human
cucaagaaacugacaaucacggca

SEQ ID NO: 845554 - RNA, 25 nt, Human
cuccccuaaacccuccugagugcaa

SEQ ID NO: 845555 - RNA, 21 nt, Human
cuucuaaacaaccagauccca

SEQ ID NO: 845556 - RNA, 18 nt, Human
gaaaccagaaaggcagag

SEQ ID NO: 845557 - RNA, 19 nt, Human
gaaaccagaaaggcagagg

SEQ ID NO: 845558 - RNA, 19 nt, Human
gagaccagccugcccaugg

SEQ ID NO: 845559 - RNA, 23 nt, Human
gagcccugagggggccugugggu

SEQ ID NO: 845560 - RNA, 21 nt, Human
gaggcaggggggcuggugcug

SEQ ID NO: 845561 - RNA, 20 nt, Human
gcccugagggggccuguggg

SEQ ID NO: 845562 - RNA, 24 nt, Human
gcuggugcugggauuccaggcagg

SEQ ID NO: 845563 - RNA, 20 nt, Human
ggagagaaaccagaaaggca

SEQ ID NO: 845564 - RNA, 18 nt, Human
ggagaggcaggggggcug

SEQ ID NO: 845565 - RNA, 20 nt, Human
ggcccuccccuaaacccucc

SEQ ID NO: 845566 - RNA, 23 nt, Human
ggguacggggugugcuggugggg

SEQ ID NO: 845567 - RNA, 19 nt, Human
guggagcaggagagacaga

SEQ ID NO: 845568 - RNA, 23 nt, Human
gugugcuggugggggggaaaggc

SEQ ID NO: 845569 - RNA, 18 nt, Human
uaaacaaccagaucccau

SEQ ID NO: 845570 - RNA, 23 nt, Human
uacaggaagcauggcuggggagc

SEQ ID NO: 845571 - RNA, 18 nt, Human
uccaggcaggguacgggg

SEQ ID NO: 845572 - RNA, 18 nt, Human
ugagggggccugugggug

SEQ ID NO: 845573 - RNA, 23 nt, Human
ugcuucuaaacaaccagaucccu

SEQ ID NO: 845574 - RNA, 18 nt, Human
ugcuuggagagggagaga

SEQ ID NO: 845575 - RNA, 21 nt, Human
ugcuuggagagggagagaaac

SEQ ID NO: 845576 - RNA, 21 nt, Human
uggcccuccccuaaacccucc

SEQ ID NO: 845577 - RNA, 22 nt, Human
uggucuggcugcuucgggcugc

SEQ ID NO: 845578 - RNA, 24 nt, Human
uggugcugggauuccaggcagggu

SEQ ID NO: 845579 - RNA, 20 nt, Human
uggugggggggaaaggcaag

SEQ ID NO: 845580 - RNA, 22 nt, Human
ugugcuggugggggggaaaggc

SEQ ID NO: 845581 - RNA, 24 nt, Human
uuacagaugcuuggagagggagag

SEQ ID NO: 845582 - RNA, 21 nt, Human
aaacggaaacgcaaggaggcc

SEQ ID NO: 845583 - RNA, 21 nt, Human
aagaaggggccaggcgcggug

SEQ ID NO: 845584 - RNA, 22 nt, Human
accuguuccacccuccccguca

SEQ ID NO: 845585 - RNA, 22 nt, Human
acggaaacgcaaggaggcccag

SEQ ID NO: 845586 - RNA, 18 nt, Human
agaaaggggaaaaaaagg

SEQ ID NO: 845587 - RNA, 20 nt, Human
agagucugccugagacacga

SEQ ID NO: 845588 - RNA, 24 nt, Human
aggccgagacaggacgaucguuga

SEQ ID NO: 845589 - RNA, 24 nt, Human
aggcgcgguggcucaugccuguca

SEQ ID NO: 845590 - RNA, 24 nt, Human
aggggccaggcgcgguggcucaug

SEQ ID NO: 845591 - RNA, 27 nt, Human
caauucucaaacacaagcaacgauuca

SEQ ID NO: 845592 - RNA, 21 nt, Human
cacccuccccgucaugcacag

SEQ ID NO: 845593 - RNA, 22 nt, Human
cacgagucuuuuuuccuggcuc

SEQ ID NO: 845594 - RNA, 18 nt, Human
cagcgcggggcggcugcc

SEQ ID NO: 845595 - RNA, 24 nt, Human
caugccugucaucccggcacuuug

SEQ ID NO: 845596 - RNA, 20 nt, Human
ccaaaguuccucccuccacc

SEQ ID NO: 845597 - RNA, 20 nt, Human
ccuccgggaccuguuccacc

SEQ ID NO: 845598 - RNA, 21 nt, Human
ccuuggggcucccaaaaaagu

SEQ ID NO: 845599 - RNA, 24 nt, Human
cgagacaggacgaucguugaggcc

SEQ ID NO: 845600 - RNA, 21 nt, Human
cgagucuuuuuuccuggcucc

SEQ ID NO: 845601 - RNA, 18 nt, Human
cggcacuuugggaggccg

SEQ ID NO: 845602 - RNA, 21 nt, Human
cgggaccuguuccacccuccc

SEQ ID NO: 845603 - RNA, 19 nt, Human
cucccaaaaaaguagcacg

SEQ ID NO: 845604 - RNA, 21 nt, Human
cugcugagcagcgcggggcgg

SEQ ID NO: 845605 - RNA, 22 nt, Human
cugcugagcagcgcggggcggc

SEQ ID NO: 845606 - RNA, 23 nt, Human
cuuuaauuuagguuaaaaagaaa

SEQ ID NO: 845607 - RNA, 20 nt, Human
cuuuuuuccuggcuccaagg

SEQ ID NO: 845608 - RNA, 19 nt, Human
gaccuguuccacccucccc

SEQ ID NO: 845609 - RNA, 21 nt, Human
gacgaucguugaggccaggaa

SEQ ID NO: 845610 - RNA, 24 nt, Human
gacgaucguugaggccaggaauuc

SEQ ID NO: 845611 - RNA, 18 nt, Human
gcacuuugggaggccgag

SEQ ID NO: 845612 - RNA, 22 nt, Human
gcacuuugggaggccgagacag

SEQ ID NO: 845613 - RNA, 22 nt, Human
ggaaacgcaaggaggcccauuc

SEQ ID NO: 845614 - RNA, 22 nt, Human
ggacgaucguugaggccaggaa

SEQ ID NO: 845615 - RNA, 19 nt, Human
ggcucaugccugucauccc

SEQ ID NO: 845616 - RNA, 21 nt, Human
ggcucugcaguggcagcuuua

SEQ ID NO: 845617 - RNA, 22 nt, Human
gguggcucaugccugucauccc

SEQ ID NO: 845618 - RNA, 18 nt, Human
guccugcugagcagcgcg

SEQ ID NO: 845619 - RNA, 21 nt, Human
guggcucaugccugucauccc

SEQ ID NO: 845620 - RNA, 26 nt, Human
uaauaaaaaagaaauuuccuccuaca

SEQ ID NO: 845621 - RNA, 22 nt, Human
uccccgucaugcacagaugauc

SEQ ID NO: 845622 - RNA, 22 nt, Human
ucccugagugggugucugggug

SEQ ID NO: 845623 - RNA, 23 nt, Human
uccucccuccaccggggagggag

SEQ ID NO: 845624 - RNA, 19 nt, Human
uccuccgggaccuguucca

SEQ ID NO: 845625 - RNA, 24 nt, Human
ucuggguguucacguguccugcug

SEQ ID NO: 845626 - RNA, 24 nt, Human
ugaaacggaaacgcaaggaggccc

SEQ ID NO: 845627 - RNA, 19 nt, Human
ugacucauuccuccaauuc

SEQ ID NO: 845628 - RNA, 21 nt, Human
ugacucauuccuccaauucuc

SEQ ID NO: 845629 - RNA, 18 nt, Human
ugagcagcgcggggcggc

SEQ ID NO: 845630 - RNA, 19 nt, Human
ugagcagcgcggggcggcu

SEQ ID NO: 845631 - RNA, 19 nt, Human
ugccugagacacgagucuu

SEQ ID NO: 845632 - RNA, 24 nt, Human
uggcucaugccugucaucccggca

SEQ ID NO: 845633 - RNA, 23 nt, Human
ugggaggccgagacaggacgauc

SEQ ID NO: 845634 - RNA, 27 nt, Human
uggggcucccaaaaaaguaggggaguc

SEQ ID NO: 845635 - RNA, 18 nt, Human
uguuccacccuccccguc

SEQ ID NO: 845636 - RNA, 21 nt, Human
uguuccacccuccccgucaug

SEQ ID NO: 845637 - RNA, 18 nt, Human
uuuuuuuuuuuuuuuuug

SEQ ID NO: 845638 - RNA, 24 nt, Human
uuuuuuuuuuuuuuuuuuuuuggg

SEQ ID NO: 845639 - RNA, 23 nt, Human
aaaaacacagucauaacaaaagu

SEQ ID NO: 845640 - RNA, 24 nt, Human
aaacacagucauaacaaaaguuua

SEQ ID NO: 845641 - RNA, 22 nt, Human
aaaccaagaugaauuaccacuu

SEQ ID NO: 845642 - RNA, 18 nt, Human
aagagcuuuuucaaacau

SEQ ID NO: 845643 - RNA, 24 nt, Human
aagcuacuucuuucuuugcuccua

SEQ ID NO: 845644 - RNA, 21 nt, Human
aaucaccaggagacaaaagga

SEQ ID NO: 845645 - RNA, 22 nt, Human
aauccucuccuuacucccagac

SEQ ID NO: 845646 - RNA, 18 nt, Human
agacaaaaggaaaauaag

SEQ ID NO: 845647 - RNA, 25 nt, Human
agacaaaaggaaaauaagggggacc

SEQ ID NO: 845648 - RNA, 24 nt, Human
agagcuuuuucaaacauuaaccac

SEQ ID NO: 845649 - RNA, 22 nt, Human
agcgcugggaggccgaggggga

SEQ ID NO: 845650 - RNA, 18 nt, Human
auaaagcaagacugcccc

SEQ ID NO: 845651 - RNA, 18 nt, Human
auaaagcaagacugcccc

SEQ ID NO: 845652 - RNA, 20 nt, Human
auaaagcaagacugcccccu

SEQ ID NO: 845653 - RNA, 19 nt, Human
caaaaggaaaauaaggggg

SEQ ID NO: 845654 - RNA, 22 nt, Human
caacaguacuuuauuuuuuuaa

SEQ ID NO: 845655 - RNA, 19 nt, Human
caagacugcccccuaccga

SEQ ID NO: 845656 - RNA, 19 nt, Human
caagaugaauuaccacuug

SEQ ID NO: 845657 - RNA, 23 nt, Human
caagaugaauuaccacuugggca

SEQ ID NO: 845658 - RNA, 19 nt, Human
caccaggagacaaaaggaa

SEQ ID NO: 845659 - RNA, 21 nt, Human
caggaaggccuuugccagaaa

SEQ ID NO: 845660 - RNA, 22 nt, Human
cauuauaacccacugguuucug

SEQ ID NO: 845661 - RNA, 19 nt, Human
ccaagcuacuucuuucuuu

SEQ ID NO: 845662 - RNA, 19 nt, Human
cccccuaccgacuacaggg

SEQ ID NO: 845663 - RNA, 24 nt, Human
cuaaucaccaggagacaaaaggaa

SEQ ID NO: 845664 - RNA, 21 nt, Human
cuaggaacaaauagagagaaa

SEQ ID NO: 845665 - RNA, 18 nt, Human
cuuccagguguucauaca

SEQ ID NO: 845666 - RNA, 20 nt, Human
gacugcccccuaccgacuac

SEQ ID NO: 845667 - RNA, 19 nt, Human
gcaagagcuuuuucaaaca

SEQ ID NO: 845668 - RNA, 18 nt, Human
ggaaggccuuugccagaa

SEQ ID NO: 845669 - RNA, 19 nt, Human
gggaagcagagcgagcgag

SEQ ID NO: 845670 - RNA, 18 nt, Human
gggggguggggguggggg

SEQ ID NO: 845671 - RNA, 20 nt, Human
gggggugggggugggggugg

SEQ ID NO: 845672 - RNA, 20 nt, Human
gggugggggugaagaacgcu

SEQ ID NO: 845673 - RNA, 19 nt, Human
guggggguggggguggggg

SEQ ID NO: 845674 - RNA, 24 nt, Human
guuccaagcuacuucuuucuuugc

SEQ ID NO: 845675 - RNA, 18 nt, Human
uaacacauuguaaaagca

SEQ ID NO: 845676 - RNA, 23 nt, Human
uaaccacuaaugauucaaugauu

SEQ ID NO: 845677 - RNA, 23 nt, Human
uaauuccaaguucauuuugagau

SEQ ID NO: 845678 - RNA, 19 nt, Human
uacaaacaauauauaaggc

SEQ ID NO: 845679 - RNA, 26 nt, Human
uacagugacaacaccuuuagaauccc

SEQ ID NO: 845680 - RNA, 26 nt, Human
uagaaucccuuagguacaauaaggua

SEQ ID NO: 845681 - RNA, 22 nt, Human
uagguacaauaagguaccgcag

SEQ ID NO: 845682 - RNA, 24 nt, Human
uauuuaccaauuaaagacuuauuu

SEQ ID NO: 845683 - RNA, 18 nt, Human
ucaccaggagacaaaagg

SEQ ID NO: 845684 - RNA, 24 nt, Human
ucaccaggagacaaaaggaaaaua

SEQ ID NO: 845685 - RNA, 19 nt, Human
uccaaguucauuuugagau

SEQ ID NO: 845686 - RNA, 20 nt, Human
ucuagauuaacuugaacagc

SEQ ID NO: 845687 - RNA, 22 nt, Human
ugaagaacgcuaauuauagaaa

SEQ ID NO: 845688 - RNA, 25 nt, Human
ugagaaaaccccuuuaaaauggcca

SEQ ID NO: 845689 - RNA, 21 nt, Human
ugcuacacaagagauauuuau

SEQ ID NO: 845690 - RNA, 19 nt, Human
ugggagcgcugggaggccg

SEQ ID NO: 845691 - RNA, 18 nt, Human
ugggaggccgagggggac

SEQ ID NO: 845692 - RNA, 18 nt, Human
uggggguggggguggggg

SEQ ID NO: 845693 - RNA, 20 nt, Human
ugggggugggggugggggug

SEQ ID NO: 845694 - RNA, 24 nt, Human
uguucuguuguauuuacaguuuua

SEQ ID NO: 845695 - RNA, 19 nt, Human
uucaaacauuaaccacuaa

SEQ ID NO: 845696 - RNA, 21 nt, Human
uucugcaucuugauucacuuc

SEQ ID NO: 845697 - RNA, 20 nt, Human
uuuuuuuuuuuuuuuugcua

SEQ ID NO: 845698 - RNA, 18 nt, Human
uuuuuuuuuuuuuuuuug

SEQ ID NO: 845699 - RNA, 20 nt, Human
uuuuuuuuuuuuuuuuugcu

SEQ ID NO: 845700 - RNA, 23 nt, Human
aaaauaaaacagaagcccugcca

SEQ ID NO: 845701 - RNA, 20 nt, Human
aacuaaaaauuuuaaaacag

SEQ ID NO: 845702 - RNA, 25 nt, Human
aagcaauccuccugcgucggccucc

SEQ ID NO: 845703 - RNA, 20 nt, Human
aagucaccucuuuaaaggcc

SEQ ID NO: 845704 - RNA, 24 nt, Human
acaaauucuaucuuuuccagaaca

SEQ ID NO: 845705 - RNA, 21 nt, Human
acaagaagauuugaaagagcu

SEQ ID NO: 845706 - RNA, 18 nt, Human
acccucccagccucucaa

SEQ ID NO: 845707 - RNA, 22 nt, Human
acuauguuguccaggcuggccu

SEQ ID NO: 845708 - RNA, 21 nt, Human
agaacaaacgugcauauccuu

SEQ ID NO: 845709 - RNA, 19 nt, Human
agacuagcuucauuuuaca

SEQ ID NO: 845710 - RNA, 19 nt, Human
agagcuaaagcuggaccgu

SEQ ID NO: 845711 - RNA, 25 nt, Human
agcaauccuccugcgucggccuccc

SEQ ID NO: 845712 - RNA, 24 nt, Human
agcggcggcggcgagcagagagcu

SEQ ID NO: 845713 - RNA, 23 nt, Human
aggacaauuuaaacauauuuuua

SEQ ID NO: 845714 - RNA, 23 nt, Human
agggucuuacuauguuguccagg

SEQ ID NO: 845715 - RNA, 24 nt, Human
agguggcggcgacagcggcggcgg

SEQ ID NO: 845716 - RNA, 22 nt, Human
auagaauggucugcauuuguaa

SEQ ID NO: 845717 - RNA, 19 nt, Human
aucauaaucacgcuugcuu

SEQ ID NO: 845718 - RNA, 22 nt, Human
caaaacacuguagccaaaugca

SEQ ID NO: 845719 - RNA, 23 nt, Human
caaggaaacagcauaguagacac

SEQ ID NO: 845720 - RNA, 19 nt, Human
caccauguuggauuagacu

SEQ ID NO: 845721 - RNA, 22 nt, Human
cacuguauuagcuugcuagggc

SEQ ID NO: 845722 - RNA, 19 nt, Human
cagcauaguagacacagca

SEQ ID NO: 845723 - RNA, 19 nt, Human
cauuuuacaugacaagaag

SEQ ID NO: 845724 - RNA, 22 nt, Human
cauuuuacaugacaagaagauu

SEQ ID NO: 845725 - RNA, 24 nt, Human
ccaaugaccuauucuaagguuucu

SEQ ID NO: 845726 - RNA, 20 nt, Human
ccaccuggaaagcuaguuau

SEQ ID NO: 845727 - RNA, 22 nt, Human
ccuaacauuaugaaucuaagaa

SEQ ID NO: 845728 - RNA, 21 nt, Human
ccucaacccucccagccucuc

SEQ ID NO: 845729 - RNA, 18 nt, Human
ccuggccucaagcaaucc

SEQ ID NO: 845730 - RNA, 22 nt, Human
cggcggcggcgagcagagagcu

SEQ ID NO: 845731 - RNA, 24 nt, Human
cucaagcaauccuccugcgucggc

SEQ ID NO: 845732 - RNA, 18 nt, Human
cucacuguguccucuccu

SEQ ID NO: 845733 - RNA, 18 nt, Human
cuggaccgucccuccgca

SEQ ID NO: 845734 - RNA, 25 nt, Human
cuggauggagaggugagaucuugga

SEQ ID NO: 845735 - RNA, 18 nt, Human
cuggccucaagcaauccu

SEQ ID NO: 845736 - RNA, 20 nt, Human
gaacaaacgugcauauccuu

SEQ ID NO: 845737 - RNA, 18 nt, Human
gaaucuaagaaaugucag

SEQ ID NO: 845738 - RNA, 22 nt, Human
gagguggcggcgacagcgggac

SEQ ID NO: 845739 - RNA, 26 nt, Human
gcggcgacagcggcggcggcgagcag

SEQ ID NO: 845740 - RNA, 24 nt, Human
gcugccauaauaaaauaccacaga

SEQ ID NO: 845741 - RNA, 19 nt, Human
gcuggccuugaacuccugg

SEQ ID NO: 845742 - RNA, 23 nt, Human
gcuggccuugaacuccuggccuc

SEQ ID NO: 845743 - RNA, 23 nt, Human
ggaaacagcauaguagacacagc

SEQ ID NO: 845744 - RNA, 24 nt, Human
ggcuggccuugaacuccuggccuc

SEQ ID NO: 845745 - RNA, 24 nt, Human
ggucuuacuauguuguccaggcug

SEQ ID NO: 845746 - RNA, 23 nt, Human
guaaggcucaaaggguuaaaccc

SEQ ID NO: 845747 - RNA, 23 nt, Human
guggcggcgacagcggcggcggc

SEQ ID NO: 845748 - RNA, 26 nt, Human
guuacacugagcaaguauuuuuaacu

SEQ ID NO: 845749 - RNA, 18 nt, Human
uaaaauaccacagauugg

SEQ ID NO: 845750 - RNA, 21 nt, Human
uaaagcagcacuagcaggaac

SEQ ID NO: 845751 - RNA, 24 nt, Human
uaacaggaaagaaaacaaacauua

SEQ ID NO: 845752 - RNA, 22 nt, Human
uaaggcucaaaggguuaaaccc

SEQ ID NO: 845753 - RNA, 20 nt, Human
uaagguuucuguuucaaaac

SEQ ID NO: 845754 - RNA, 22 nt, Human
uagagauagggucuuacuaugu

SEQ ID NO: 845755 - RNA, 24 nt, Human
uagaguggaagcugagaagcaaaa

SEQ ID NO: 845756 - RNA, 22 nt, Human
uagcaggaacaaggaaacagca

SEQ ID NO: 845757 - RNA, 22 nt, Human
uagcuaaauugcuuaauggcac

SEQ ID NO: 845758 - RNA, 24 nt, Human
uagggucuuacuauguuguccagg

SEQ ID NO: 845759 - RNA, 18 nt, Human
uaguagacacagcagauu

SEQ ID NO: 845760 - RNA, 24 nt, Human
uauaaaaacacagacugucuuaga

SEQ ID NO: 845761 - RNA, 25 nt, Human
uaucaaaaugaaaaauuauuguuuc

SEQ ID NO: 845762 - RNA, 23 nt, Human
uauguuguccaggcuggccuuga

SEQ ID NO: 845763 - RNA, 24 nt, Human
uauguuguccaggcuggccuugaa

SEQ ID NO: 845764 - RNA, 24 nt, Human
ucaacccucccagccucucaaacc

SEQ ID NO: 845765 - RNA, 21 nt, Human
ucaaggugcuggugauuuugu

SEQ ID NO: 845766 - RNA, 21 nt, Human
uccccucaacccucccagccu

SEQ ID NO: 845767 - RNA, 22 nt, Human
uccccucaacccucccagccuc

SEQ ID NO: 845768 - RNA, 21 nt, Human
uccgaacagucacauucaaaa

SEQ ID NO: 845769 - RNA, 18 nt, Human
uccuggauggagagguga

SEQ ID NO: 845770 - RNA, 21 nt, Human
ucgccaguacuaauucauuuu

SEQ ID NO: 845771 - RNA, 23 nt, Human
ucuaagguuucuguuucaaaaca

SEQ ID NO: 845772 - RNA, 20 nt, Human
ucugaagccucucucuuugc

SEQ ID NO: 845773 - RNA, 23 nt, Human
ucuuacuauguuguccaggcugg

SEQ ID NO: 845774 - RNA, 24 nt, Human
ugacuggacucccuuugaucaguu

SEQ ID NO: 845775 - RNA, 24 nt, Human
ugagaagcaaaauuguuacacuga

SEQ ID NO: 845776 - RNA, 22 nt, Human
ugauagaauggucugcauuugu

SEQ ID NO: 845777 - RNA, 18 nt, Human
ugcagauaacugccuucu

SEQ ID NO: 845778 - RNA, 21 nt, Human
ugcuggugauuuuguuucuuc

SEQ ID NO: 845779 - RNA, 22 nt, Human
uggaaagcuaguuaucaaaaug

SEQ ID NO: 845780 - RNA, 20 nt, Human
uggaauacaugcagcaauuu

SEQ ID NO: 845781 - RNA, 20 nt, Human
uggccucaagcaauccuccu

SEQ ID NO: 845782 - RNA, 21 nt, Human
uggccucaagcaauccuccug

SEQ ID NO: 845783 - RNA, 20 nt, Human
uggccuugaacuccuggccu

SEQ ID NO: 845784 - RNA, 18 nt, Human
uggcggcgacagcggcgg

SEQ ID NO: 845785 - RNA, 21 nt, Human
uggcuaaguccaccuggaaag

SEQ ID NO: 845786 - RNA, 27 nt, Human
uguaaaauacagauuaaaugcuccuaa

SEQ ID NO: 845787 - RNA, 18 nt, Human
uguagccaaaugcauacu

SEQ ID NO: 845788 - RNA, 24 nt, Human
uguccaggcuggccuugaacuccu

SEQ ID NO: 845789 - RNA, 25 nt, Human
ugucuuagaaucccacuuaaugaag

SEQ ID NO: 845790 - RNA, 22 nt, Human
uuaaaauaaguauauaaaaauc

SEQ ID NO: 845791 - RNA, 21 nt, Human
uuaaagcagagggggcuuccu

SEQ ID NO: 845792 - RNA, 19 nt, Human
uuagauuuuaacuguugag

SEQ ID NO: 845793 - RNA, 21 nt, Human
uucauuuuacaugacaagaag

SEQ ID NO: 845794 - RNA, 18 nt, Human
uuggauuagacuaacagc

SEQ ID NO: 845795 - RNA, 20 nt, Human
uuuuuuuuuuuuaaagaucu

SEQ ID NO: 845796 - RNA, 19 nt, Human
uuuuuuuuuuuuuuuuuaa

SEQ ID NO: 845797 - RNA, 24 nt, Human
cuggaguagaguuugggaguccac

SEQ ID NO: 845798 - RNA, 21 nt, Human
ggaguccacagggacaucuug

SEQ ID NO: 845799 - RNA, 20 nt, Human
uaaaaaggguccaaagguuu

SEQ ID NO: 845800 - RNA, 19 nt, Human
uccccaucuggaguagagu

SEQ ID NO: 845801 - RNA, 18 nt, Human
ugaguuuucgacucuugc

SEQ ID NO: 845802 - RNA, 18 nt, Human
uggaguagaguuugggag

SEQ ID NO: 845803 - RNA, 22 nt, Human
uuuuuuuuuuuuaaaaaggguc

SEQ ID NO: 845804 - RNA, 21 nt, Human
uuuuuuuuuuuuuuaaaaagg

SEQ ID NO: 845805 - RNA, 25 nt, Human
uuuuuuuuuuuuuuuuuaaaaaggg

SEQ ID NO: 845806 - RNA, 25 nt, Human
aaaaggcuuacuuucccugccuccu

SEQ ID NO: 845807 - RNA, 18 nt, Human
acuauugcuguucuuuuc

SEQ ID NO: 845808 - RNA, 23 nt, Human
agacaguucuguccugcuacaga

SEQ ID NO: 845809 - RNA, 21 nt, Human
agcugaggcacaggcagacau

SEQ ID NO: 845810 - RNA, 20 nt, Human
aggcagagcccaccucccac

SEQ ID NO: 845811 - RNA, 22 nt, Human
auccauuccugcugcagccaug

SEQ ID NO: 845812 - RNA, 23 nt, Human
auccuuuacuauugcuguucuuu

SEQ ID NO: 845813 - RNA, 18 nt, Human
auggcagugggagguuga

SEQ ID NO: 845814 - RNA, 21 nt, Human
cacuaaauuauuuucugcucc

SEQ ID NO: 845815 - RNA, 23 nt, Human
cacuccucucucacacuccuuug

SEQ ID NO: 845816 - RNA, 23 nt, Human
ccaaucagauggaccugcccuga

SEQ ID NO: 845817 - RNA, 18 nt, Human
ccacgacagaagcugaaa

SEQ ID NO: 845818 - RNA, 18 nt, Human
ccauggcuacaacaucug

SEQ ID NO: 845819 - RNA, 23 nt, Human
cccacgacagaagcugaaaaggc

SEQ ID NO: 845820 - RNA, 19 nt, Human
cccugaacuugggagcaag

SEQ ID NO: 845821 - RNA, 26 nt, Human
ccucccacgacagaagcugaaaaggc

SEQ ID NO: 845822 - RNA, 21 nt, Human
ccucuaaacuucuuacaugaa

SEQ ID NO: 845823 - RNA, 18 nt, Human
ccugcccugaacuuggga

SEQ ID NO: 845824 - RNA, 19 nt, Human
cgagguuuuuuuuuuuuuu

SEQ ID NO: 845825 - RNA, 21 nt, Human
cgagguuuuuuuuuuuuuuuu

SEQ ID NO: 845826 - RNA, 20 nt, Human
cugcagccauggcuacaacc

SEQ ID NO: 845827 - RNA, 22 nt, Human
cuuacuuucccugccucccuca

SEQ ID NO: 845828 - RNA, 22 nt, Human
gacagaagcugaaaaggcuuac

SEQ ID NO: 845829 - RNA, 19 nt, Human
gcagugccagcuuuuuguc

SEQ ID NO: 845830 - RNA, 18 nt, Human
gccauggcuacaacaucu

SEQ ID NO: 845831 - RNA, 21 nt, Human
ggcagcugauugaguacuaua

SEQ ID NO: 845832 - RNA, 24 nt, Human
gguaggaggcagagcccaccuccc

SEQ ID NO: 845833 - RNA, 19 nt, Human
guuugaagauccuccaccc

SEQ ID NO: 845834 - RNA, 20 nt, Human
uacagagagagaaugcagug

SEQ ID NO: 845835 - RNA, 23 nt, Human
ucacagcugaggcacaggcagac

SEQ ID NO: 845836 - RNA, 26 nt, Human
ucacagcugaggcacaggcagacauu

SEQ ID NO: 845837 - RNA, 19 nt, Human
uccauuccugcugcagcca

SEQ ID NO: 845838 - RNA, 21 nt, Human
uccauuccugcugcagccaug

SEQ ID NO: 845839 - RNA, 18 nt, Human
uccuguuucuuccccucc

SEQ ID NO: 845840 - RNA, 27 nt, Human
uccuuuacuauugcuguucuuuucguu

SEQ ID NO: 845841 - RNA, 19 nt, Human
ucucucacacuccuuugcc

SEQ ID NO: 845842 - RNA, 21 nt, Human
ucuugguaggaggcagagccc

SEQ ID NO: 845843 - RNA, 25 nt, Human
ugaaaauuugggggugccaggaucc

SEQ ID NO: 845844 - RNA, 26 nt, Human
ugaacuugggagcaagucacaccgag

SEQ ID NO: 845845 - RNA, 25 nt, Human
ugaagauccuccacccuuugauucu

SEQ ID NO: 845846 - RNA, 18 nt, Human
ugccaggauccggguucu

SEQ ID NO: 845847 - RNA, 21 nt, Human
ugcucccaucagccagcacug

SEQ ID NO: 845848 - RNA, 22 nt, Human
ugcugcagccauggcuacaaca

SEQ ID NO: 845849 - RNA, 18 nt, Human
uggaguccaugguggugg

SEQ ID NO: 845850 - RNA, 21 nt, Human
uggccaaaggggucuugucuu

SEQ ID NO: 845851 - RNA, 24 nt, Human
uuccugcugcagccauggcuacaa

SEQ ID NO: 845852 - RNA, 21 nt, Human
uuccuuuauuuuggccaaagg

SEQ ID NO: 845853 - RNA, 23 nt, Human
uuccuuuauuuuggccaaagggg

SEQ ID NO: 845854 - RNA, 20 nt, Human
uucuggauggugguaguggc

SEQ ID NO: 845855 - RNA, 21 nt, Human
uuuccuguuucuuccccucca

SEQ ID NO: 845856 - RNA, 18 nt, Human
uuuuggccaaaggggucu

SEQ ID NO: 845857 - RNA, 25 nt, Human
uuuuggccaaaggggucuugucuuu

SEQ ID NO: 845858 - RNA, 22 nt, Human
uuuuuuuuuuuuuuuaauguuu

SEQ ID NO: 845859 - RNA, 24 nt, Human
uuuuuuuuuuuuuuuuuuuuaaug

SEQ ID NO: 845860 - RNA, 22 nt, Human
aaagagccugaucucagcaggc

SEQ ID NO: 845861 - RNA, 23 nt, Human
aaaggagacaguaaacaacagaa

SEQ ID NO: 845862 - RNA, 21 nt, Human
aagacuucugcagugacagcc

SEQ ID NO: 845863 - RNA, 19 nt, Human
aagcagccuccauucuggg

SEQ ID NO: 845864 - RNA, 18 nt, Human
aagggaaaacgugggaaa

SEQ ID NO: 845865 - RNA, 19 nt, Human
acagugggagcccagcugg

SEQ ID NO: 845866 - RNA, 21 nt, Human
acagugggagcccagcuggau

SEQ ID NO: 845867 - RNA, 24 nt, Human
acguaucucuuuaagaaugugucc

SEQ ID NO: 845868 - RNA, 19 nt, Human
agaaaaaggacaaguugaa

SEQ ID NO: 845869 - RNA, 21 nt, Human
agaaauacacacaacguccuc

SEQ ID NO: 845870 - RNA, 19 nt, Human
agacagaaaucugagcaca

SEQ ID NO: 845871 - RNA, 21 nt, Human
agacagaaaucugagcacacg

SEQ ID NO: 845872 - RNA, 18 nt, Human
agacagucacagggucau

SEQ ID NO: 845873 - RNA, 19 nt, Human
agaccacaguuugaaaucc

SEQ ID NO: 845874 - RNA, 18 nt, Human
agauggagggaagcacca

SEQ ID NO: 845875 - RNA, 18 nt, Human
agcagcagagggucccgg

SEQ ID NO: 845876 - RNA, 19 nt, Human
agccauggaauaggaaggg

SEQ ID NO: 845877 - RNA, 23 nt, Human
agcuggauuccuacacucaagcc

SEQ ID NO: 845878 - RNA, 18 nt, Human
aggcauuggcaggaccag

SEQ ID NO: 845879 - RNA, 19 nt, Human
aggcgaccacaggauuccu

SEQ ID NO: 845880 - RNA, 21 nt, Human
aggggaauguucccagugcca

SEQ ID NO: 845881 - RNA, 20 nt, Human
agugaacaggggauggaugg

SEQ ID NO: 845882 - RNA, 18 nt, Human
aucagguuuauuuuccag

SEQ ID NO: 845883 - RNA, 22 nt, Human
auccgcucucugcugcucugga

SEQ ID NO: 845884 - RNA, 20 nt, Human
auggagggaagcaccauggg

SEQ ID NO: 845885 - RNA, 20 nt, Human
auguccuggccccaggcgac

SEQ ID NO: 845886 - RNA, 25 nt, Human
caaagagccugaucucagcaggcac

SEQ ID NO: 845887 - RNA, 23 nt, Human
caacagcugggaacgccaugucc

SEQ ID NO: 845888 - RNA, 21 nt, Human
cacaaaggagacaguaaacac

SEQ ID NO: 845889 - RNA, 20 nt, Human
cacacaaggacuauagucaa

SEQ ID NO: 845890 - RNA, 24 nt, Human
cacaguuugaaauccacuuaaucu

SEQ ID NO: 845891 - RNA, 19 nt, Human
caccucagcgaaggccugu

SEQ ID NO: 845892 - RNA, 18 nt, Human
caccugaagccauggaau

SEQ ID NO: 845893 - RNA, 21 nt, Human
cagcagacaccccauggagcc

SEQ ID NO: 845894 - RNA, 24 nt, Human
caguaaacaacagaacagaggugg

SEQ ID NO: 845895 - RNA, 24 nt, Human
caguucccagaaggcucaagacca

SEQ ID NO: 845896 - RNA, 20 nt, Human
ccaaggggaauguucccagu

SEQ ID NO: 845897 - RNA, 22 nt, Human
ccaagucagggagagcgucaca

SEQ ID NO: 845898 - RNA, 24 nt, Human
ccacaccaacccgcaccucagcga

SEQ ID NO: 845899 - RNA, 19 nt, Human
ccacagucucagcacagca

SEQ ID NO: 845900 - RNA, 18 nt, Human
ccaccgcggcccagggag

SEQ ID NO: 845901 - RNA, 19 nt, Human
ccagcacacccgugcgcag

SEQ ID NO: 845902 - RNA, 24 nt, Human
ccagcagacaccccauggagccga

SEQ ID NO: 845903 - RNA, 21 nt, Human
ccagcuggauuccuacacuca

SEQ ID NO: 845904 - RNA, 20 nt, Human
ccauguccuggccccaggcg

SEQ ID NO: 845905 - RNA, 20 nt, Human
cccacagagucaugagcagg

SEQ ID NO: 845906 - RNA, 19 nt, Human
ccccacaccaacccgcacc

SEQ ID NO: 845907 - RNA, 21 nt, Human
ccccacaccaacccgcaccuc

SEQ ID NO: 845908 - RNA, 23 nt, Human
ccccuccuuucgggcaguuccca

SEQ ID NO: 845909 - RNA, 18 nt, Human
ccuacacucaagcccucc

SEQ ID NO: 845910 - RNA, 20 nt, Human
ccuaggacaccaggaccaag

SEQ ID NO: 845911 - RNA, 21 nt, Human
ccucaggcgaccacaggauuc

SEQ ID NO: 845912 - RNA, 20 nt, Human
ccucugagguuugggguggc

SEQ ID NO: 845913 - RNA, 22 nt, Human
ccuggccaccgcggcccaggga

SEQ ID NO: 845914 - RNA, 22 nt, Human
ccuuccccugaccuguccggga

SEQ ID NO: 845915 - RNA, 22 nt, Human
cggagucucaguguugcccggg

SEQ ID NO: 845916 - RNA, 23 nt, Human
cuaggacaccaggaccaagacca

SEQ ID NO: 845917 - RNA, 21 nt, Human
cuggggcagacagugggagcc

SEQ ID NO: 845918 - RNA, 25 nt, Human
cuguggagacccagggccccccucc

SEQ ID NO: 845919 - RNA, 24 nt, Human
cuuaccgcauaccaggcucccaaa

SEQ ID NO: 845920 - RNA, 18 nt, Human
gaagccauggaauaggaa

SEQ ID NO: 845921 - RNA, 23 nt, Human
gacggagcccagccaccacggga

SEQ ID NO: 845922 - RNA, 21 nt, Human
gagacagucacagggucaugc

SEQ ID NO: 845923 - RNA, 21 nt, Human
gaggcccggccagccugcggu

SEQ ID NO: 845924 - RNA, 20 nt, Human
gaucccaccguucuagccac

SEQ ID NO: 845925 - RNA, 21 nt, Human
gcacacaaggacuauagucaa

SEQ ID NO: 845926 - RNA, 24 nt, Human
gccacagucucagcacagcagguu

SEQ ID NO: 845927 - RNA, 21 nt, Human
gccaggaaguggaugguggcu

SEQ ID NO: 845928 - RNA, 21 nt, Human
gccccggccaucucacccucc

SEQ ID NO: 845929 - RNA, 23 nt, Human
gcgaccacaggauuccuucucaa

SEQ ID NO: 845930 - RNA, 24 nt, Human
ggaagacuucugcagugacagccc

SEQ ID NO: 845931 - RNA, 25 nt, Human
ggaccaagaccaggccacagucuca

SEQ ID NO: 845932 - RNA, 19 nt, Human
ggagauggagggaagcacc

SEQ ID NO: 845933 - RNA, 19 nt, Human
ggagugcuuaccgcauacc

SEQ ID NO: 845934 - RNA, 21 nt, Human
ggagugcuuaccgcauaccag

SEQ ID NO: 845935 - RNA, 21 nt, Human
ggagugcuuaccgcauaccag

SEQ ID NO: 845936 - RNA, 20 nt, Human
ggcaugacaggaaggggguu

SEQ ID NO: 845937 - RNA, 22 nt, Human
ggcccagcagacaccccaugga

SEQ ID NO: 845938 - RNA, 23 nt, Human
gggaaaacgugggaaauggauuu

SEQ ID NO: 845939 - RNA, 19 nt, Human
gggagcagcagaggguccc

SEQ ID NO: 845940 - RNA, 22 nt, Human
gggagcagcagagggucccggc

SEQ ID NO: 845941 - RNA, 20 nt, Human
gggaggcccggccagccugc

SEQ ID NO: 845942 - RNA, 19 nt, Human
gggcacggaaggccaggaa

SEQ ID NO: 845943 - RNA, 21 nt, Human
gggccccccuccaggagcccc

SEQ ID NO: 845944 - RNA, 20 nt, Human
gggcuggcggcugacaccug

SEQ ID NO: 845945 - RNA, 21 nt, Human
guggagaggauggcaccugaa

SEQ ID NO: 845946 - RNA, 22 nt, Human
guggagcgggcacggaaggcca

SEQ ID NO: 845947 - RNA, 20 nt, Human
guggaugguggcugccagca

SEQ ID NO: 845948 - RNA, 22 nt, Human
gugggaaauggauuuuuggugc

SEQ ID NO: 845949 - RNA, 19 nt, Human
uacacucaagcccuccagc

SEQ ID NO: 845950 - RNA, 19 nt, Human
uaggacaccaggaccaaga

SEQ ID NO: 845951 - RNA, 18 nt, Human
uaggcuucaaaagcacaa

SEQ ID NO: 845952 - RNA, 21 nt, Human
uauccuguaggcauuggcagg

SEQ ID NO: 845953 - RNA, 18 nt, Human
ucacagaucaguggcauu

SEQ ID NO: 845954 - RNA, 21 nt, Human
ucacagaucaguggcauuuac

SEQ ID NO: 845955 - RNA, 21 nt, Human
ucagaggcugcuggcuggucc

SEQ ID NO: 845956 - RNA, 21 nt, Human
uccacagugaacaggggaugg

SEQ ID NO: 845957 - RNA, 21 nt, Human
uccacucaggccccggccauc

SEQ ID NO: 845958 - RNA, 20 nt, Human
ucccaccguucuagccacag

SEQ ID NO: 845959 - RNA, 19 nt, Human
ucccagaaggcucaagacc

SEQ ID NO: 845960 - RNA, 22 nt, Human
uccuacacucaagcccuccagc

SEQ ID NO: 845961 - RNA, 19 nt, Human
uccuucucaaagagccuga

SEQ ID NO: 845962 - RNA, 21 nt, Human
ucucaaagagccugaucucag

SEQ ID NO: 845963 - RNA, 19 nt, Human
ucucaguguugcccgggcc

SEQ ID NO: 845964 - RNA, 22 nt, Human
ucuguggagacccagggccccc

SEQ ID NO: 845965 - RNA, 24 nt, Human
ucuguggagaggauggcaccugaa

SEQ ID NO: 845966 - RNA, 23 nt, Human
ugaacaggccgggcagcuggacc

SEQ ID NO: 845967 - RNA, 18 nt, Human
ugaagggaaaacguggga

SEQ ID NO: 845968 - RNA, 19 nt, Human
ugacaggaaggggguucac

SEQ ID NO: 845969 - RNA, 24 nt, Human
ugagcacacggauugcccugugug

SEQ ID NO: 845970 - RNA, 20 nt, Human
ugcccgggccagagcgcagc

SEQ ID NO: 845971 - RNA, 19 nt, Human
ugcccggggcgccugccug

SEQ ID NO: 845972 - RNA, 20 nt, Human
ugcucuacaacagcugggaa

SEQ ID NO: 845973 - RNA, 21 nt, Human
ugcucuggagggagaaaaagg

SEQ ID NO: 845974 - RNA, 22 nt, Human
ugcuggcugguccugcagagcc

SEQ ID NO: 845975 - RNA, 24 nt, Human
uggaaaucauuuugugccaccgua

SEQ ID NO: 845976 - RNA, 24 nt, Human
uggaccacuccgaggcuggcgccu

SEQ ID NO: 845977 - RNA, 21 nt, Human
uggcugagauguccucgaaau

SEQ ID NO: 845978 - RNA, 18 nt, Human
uggcuggaaagggaaagg

SEQ ID NO: 845979 - RNA, 18 nt, Human
ugggaacgccauguccug

SEQ ID NO: 845980 - RNA, 21 nt, Human
ugguggcugccagcacuucug

SEQ ID NO: 845981 - RNA, 22 nt, Human
uguccuggccaccgcggcccag

SEQ ID NO: 845982 - RNA, 20 nt, Human
ugugaacaggccgggcagcu

SEQ ID NO: 845983 - RNA, 23 nt, Human
uucccacaaaggagacaguaaac

SEQ ID NO: 845984 - RNA, 21 nt, Human
uuccccacaccaacccgcacc

SEQ ID NO: 845985 - RNA, 21 nt, Human
uuccccuccuuucgggcaguu

SEQ ID NO: 845986 - RNA, 19 nt, Human
uucccuuguauuccccaca

SEQ ID NO: 845987 - RNA, 18 nt, Human
uuguuguuuuccagaguc

SEQ ID NO: 845988 - RNA, 24 nt, Human
uuuccagagucggagucucagugu

SEQ ID NO: 845989 - RNA, 24 nt, Human
uuuuuuuuuuuuuuuuuuuuaaag

SEQ ID NO: 845990 - RNA, 19 nt, Human
caaggggcucuggccuguc

SEQ ID NO: 845991 - RNA, 18 nt, Human
cagccccucggucagucc

SEQ ID NO: 845992 - RNA, 19 nt, Human
cagccgccgcuccucccca

SEQ ID NO: 845993 - RNA, 20 nt, Human
ccccaaccccgucccagccu

SEQ ID NO: 845994 - RNA, 21 nt, Human
cccccccggcccguugucgcc

SEQ ID NO: 845995 - RNA, 22 nt, Human
cccccccggcccguugucgccc

SEQ ID NO: 845996 - RNA, 21 nt, Human
ccccucggucaguccagcagc

SEQ ID NO: 845997 - RNA, 23 nt, Human
ccucgcgccuccagccgccgcuc

SEQ ID NO: 845998 - RNA, 23 nt, Human
cgccccaaccccgucccagccga

SEQ ID NO: 845999 - RNA, 23 nt, Human
cggcccguugucgccccaacccc

SEQ ID NO: 846000 - RNA, 26 nt, Human
gaagaggcugcagucuugcugggcag

SEQ ID NO: 846001 - RNA, 20 nt, Human
ugagggaggaagaggcugca

SEQ ID NO: 846002 - RNA, 20 nt, Human
uggccugucggguccccccc

SEQ ID NO: 846003 - RNA, 22 nt, Human
uggugggaucugagggaggaag

SEQ ID NO: 846004 - RNA, 18 nt, Human
uuuucuccgucuagaauc

SEQ ID NO: 846005 - RNA, 18 nt, Human
uuuuuuuuuuuuucuccg

SEQ ID NO: 846006 - RNA, 21 nt, Human
uuuuuuuuuuuuuuucuccgu

SEQ ID NO: 846007 - RNA, 24 nt, Human
uuuuuuuuuuuuuuuuuucuccgu

SEQ ID NO: 846008 - RNA, 24 nt, Human
uuuuuuuuuuuuuuuuuuucuccu

SEQ ID NO: 846009 - RNA, 24 nt, Human
uuuuuuuuuuuuuuuuuuuuucuu

SEQ ID NO: 846010 - RNA, 18 nt, Human
aaacaccaucaucuccuc

SEQ ID NO: 846011 - RNA, 21 nt, Human
acaccccugugggccgugggc

SEQ ID NO: 846012 - RNA, 21 nt, Human
acccccacccccaucccuggc

SEQ ID NO: 846013 - RNA, 21 nt, Human
accuccccgcucugggacagc

SEQ ID NO: 846014 - RNA, 19 nt, Human
agacaccgcgacgagucca

SEQ ID NO: 846015 - RNA, 20 nt, Human
agccggcucccccaccuccc

SEQ ID NO: 846016 - RNA, 27 nt, Human
agccuggaagaggggcugggagaagcu

SEQ ID NO: 846017 - RNA, 21 nt, Human
aggagggggucggguggcggc

SEQ ID NO: 846018 - RNA, 22 nt, Human
agggcaggggcaaucagacagc

SEQ ID NO: 846019 - RNA, 20 nt, Human
agguugagcugcugaauggg

SEQ ID NO: 846020 - RNA, 19 nt, Human
agugcaggugccacgcccc

SEQ ID NO: 846021 - RNA, 19 nt, Human
caaacaccaucaucuccuc

SEQ ID NO: 846022 - RNA, 19 nt, Human
caaaucgaagaagcuguag

SEQ ID NO: 846023 - RNA, 21 nt, Human
caccacaugagcucagggacc

SEQ ID NO: 846024 - RNA, 18 nt, Human
caccgcgacgaguccagc

SEQ ID NO: 846025 - RNA, 21 nt, Human
cacggaggcgcagugcgcggc

SEQ ID NO: 846026 - RNA, 21 nt, Human
cacugccucuucuguucccac

SEQ ID NO: 846027 - RNA, 21 nt, Human
cagcagccacugccucuucug

SEQ ID NO: 846028 - RNA, 21 nt, Human
cagccaccugcuguggagcug

SEQ ID NO: 846029 - RNA, 18 nt, Human
caggagcccggagcaggg

SEQ ID NO: 846030 - RNA, 22 nt, Human
caggaucccguacuuguccagu

SEQ ID NO: 846031 - RNA, 21 nt, Human
caggggccucguccuggcucu

SEQ ID NO: 846032 - RNA, 19 nt, Human
cagggucagcuuccggggc

SEQ ID NO: 846033 - RNA, 19 nt, Human
cagugcgcggcgguugggc

SEQ ID NO: 846034 - RNA, 18 nt, Human
caucccuggccuggguga

SEQ ID NO: 846035 - RNA, 21 nt, Human
caucuccuccucggugcaguc

SEQ ID NO: 846036 - RNA, 21 nt, Human
ccagccuugaugcccugcugc

SEQ ID NO: 846037 - RNA, 21 nt, Human
cccacaaacacccgcagcucc

SEQ ID NO: 846038 - RNA, 25 nt, Human
cccacaaacacccgcagcucccaug

SEQ ID NO: 846039 - RNA, 21 nt, Human
ccccagugacccgcaggguga

SEQ ID NO: 846040 - RNA, 21 nt, Human
ccccaucccuggccuggguga

SEQ ID NO: 846041 - RNA, 22 nt, Human
cccccagccaagacaaccuugc

SEQ ID NO: 846042 - RNA, 19 nt, Human
ccccuccagcuucaccucc

SEQ ID NO: 846043 - RNA, 24 nt, Human
ccgccauggcugcggcugcugcuu

SEQ ID NO: 846044 - RNA, 20 nt, Human
ccucaggggagggcacuagg

SEQ ID NO: 846045 - RNA, 21 nt, Human
ccuccagcuucaccuccaggu

SEQ ID NO: 846046 - RNA, 26 nt, Human
ccucuggcuccuucucuuugggccgc

SEQ ID NO: 846047 - RNA, 18 nt, Human
ccuggagcgggugugggg

SEQ ID NO: 846048 - RNA, 20 nt, Human
ccugggugaugguacagcgu

SEQ ID NO: 846049 - RNA, 24 nt, Human
ccuugagcucugggauggugguga

SEQ ID NO: 846050 - RNA, 22 nt, Human
cgccauggcugcggcugcugcu

SEQ ID NO: 846051 - RNA, 23 nt, Human
cggccaggaucccguacuugucc

SEQ ID NO: 846052 - RNA, 19 nt, Human
cggccucuggguccuccuc

SEQ ID NO: 846053 - RNA, 23 nt, Human
cggccucuggguccuccucuccc

SEQ ID NO: 846054 - RNA, 21 nt, Human
cggggugccggaugcugagga

SEQ ID NO: 846055 - RNA, 19 nt, Human
cucucccacaaacacccgc

SEQ ID NO: 846056 - RNA, 21 nt, Human
cugcagcagccacugccucuu

SEQ ID NO: 846057 - RNA, 20 nt, Human
cugccuggagcggguguggg

SEQ ID NO: 846058 - RNA, 22 nt, Human
cugcugcaugagacaccgcgac

SEQ ID NO: 846059 - RNA, 24 nt, Human
cuguagcuacaucuggucuuccuu

SEQ ID NO: 846060 - RNA, 22 nt, Human
cugugggugugggcuugggagu

SEQ ID NO: 846061 - RNA, 21 nt, Human
cuuucuucuucuucuccuucu

SEQ ID NO: 846062 - RNA, 20 nt, Human
gaaccaccucacagcccuug

SEQ ID NO: 846063 - RNA, 18 nt, Human
gacagcaggugaaaugcc

SEQ ID NO: 846064 - RNA, 20 nt, Human
gaccccuccagcuucaccuc

SEQ ID NO: 846065 - RNA, 19 nt, Human
gagcccggagcagggacag

SEQ ID NO: 846066 - RNA, 24 nt, Human
gagcugggccguggcagacgcugg

SEQ ID NO: 846067 - RNA, 26 nt, Human
gcaggugaaaugcccagcugggugcc

SEQ ID NO: 846068 - RNA, 20 nt, Human
gcccccagccaagacaaccu

SEQ ID NO: 846069 - RNA, 19 nt, Human
gccggaugcugaggaggcg

SEQ ID NO: 846070 - RNA, 25 nt, Human
gccggcucccccaccuccccgcucu

SEQ ID NO: 846071 - RNA, 22 nt, Human
gccgugggcuuccugcccuccu

SEQ ID NO: 846072 - RNA, 22 nt, Human
gccucuggguccuccucuccca

SEQ ID NO: 846073 - RNA, 23 nt, Human
gcgguagcccuucagggucagcu

SEQ ID NO: 846074 - RNA, 20 nt, Human
ggaguggcugugacaggugg

SEQ ID NO: 846075 - RNA, 20 nt, Human
ggcaucccccggaacagugc

SEQ ID NO: 846076 - RNA, 23 nt, Human
ggccgugggcuuccugcccuccu

SEQ ID NO: 846077 - RNA, 20 nt, Human
ggcugggggcugcagguggg

SEQ ID NO: 846078 - RNA, 21 nt, Human
gggaguggcugugacaggugg

SEQ ID NO: 846079 - RNA, 22 nt, Human
gggcggcaaacaccaucaucuc

SEQ ID NO: 846080 - RNA, 21 nt, Human
gggucggguggcggcuggggc

SEQ ID NO: 846081 - RNA, 22 nt, Human
gucagcuuccggggccgaaaga

SEQ ID NO: 846082 - RNA, 18 nt, Human
guccagccaccugcugug

SEQ ID NO: 846083 - RNA, 21 nt, Human
gucugugccagccggcucccc

SEQ ID NO: 846084 - RNA, 18 nt, Human
uagagcucuuccucuggc

SEQ ID NO: 846085 - RNA, 19 nt, Human
uagagcucuuccucuggcu

SEQ ID NO: 846086 - RNA, 20 nt, Human
uagcaggccucagucugggc

SEQ ID NO: 846087 - RNA, 22 nt, Human
uagcaggccucagucugggcgc

SEQ ID NO: 846088 - RNA, 24 nt, Human
uagcauggucugaccaguccugcu

SEQ ID NO: 846089 - RNA, 18 nt, Human
ucagacaaggaaaggggg

SEQ ID NO: 846090 - RNA, 18 nt, Human
ucagggccacauccaggu

SEQ ID NO: 846091 - RNA, 24 nt, Human
ucccacaaacacccgcagcuccca

SEQ ID NO: 846092 - RNA, 24 nt, Human
uccccaggggccucguccuggcuc

SEQ ID NO: 846093 - RNA, 19 nt, Human
ucucccacaaacacccgca

SEQ ID NO: 846094 - RNA, 20 nt, Human
ucucuuucuucuucuucucc

SEQ ID NO: 846095 - RNA, 20 nt, Human
ucuuucuucuucuucuccuu

SEQ ID NO: 846096 - RNA, 18 nt, Human
ugacagguggugagcagg

SEQ ID NO: 846097 - RNA, 18 nt, Human
ugaccgacucggccucug

SEQ ID NO: 846098 - RNA, 19 nt, Human
ugaggaggcggcagauggc

SEQ ID NO: 846099 - RNA, 18 nt, Human
ugaugugguacugcaggc

SEQ ID NO: 846100 - RNA, 21 nt, Human
ugccacgcccccagccaagac

SEQ ID NO: 846101 - RNA, 18 nt, Human
ugcccugcugcaugagac

SEQ ID NO: 846102 - RNA, 20 nt, Human
ugccuggagcgggugugggg

SEQ ID NO: 846103 - RNA, 22 nt, Human
uggaagaggggcugggagaagc

SEQ ID NO: 846104 - RNA, 23 nt, Human
uggccggagacguuaacaucggg

SEQ ID NO: 846105 - RNA, 21 nt, Human
uggcgguagcccuucaggguc

SEQ ID NO: 846106 - RNA, 22 nt, Human
uggcugugacagguggugagca

SEQ ID NO: 846107 - RNA, 21 nt, Human
ugggagaagcuggcacggagg

SEQ ID NO: 846108 - RNA, 20 nt, Human
ugggaugguggugaggcugu

SEQ ID NO: 846109 - RNA, 19 nt, Human
ugguacagcgucuggcccu

SEQ ID NO: 846110 - RNA, 21 nt, Human
ugguccuugagcucugggaug

SEQ ID NO: 846111 - RNA, 23 nt, Human
ugugccagccggcucccccaccu

SEQ ID NO: 846112 - RNA, 20 nt, Human
ugugguagcaggccucaguc

SEQ ID NO: 846113 - RNA, 19 nt, Human
ugugugcugggggacugca

SEQ ID NO: 846114 - RNA, 20 nt, Human
ugugugcugggggacugcag

SEQ ID NO: 846115 - RNA, 21 nt, Human
uguuucaucauccuguagcua

SEQ ID NO: 846116 - RNA, 21 nt, Human
uuuaaaaaguaacaagaaaga

SEQ ID NO: 846117 - RNA, 18 nt, Human
uuuccuggcaagggcugg

SEQ ID NO: 846118 - RNA, 24 nt, Human
uuuccuggcaagggcugggggcug

SEQ ID NO: 846119 - RNA, 18 nt, Human
gagggcaggguuggggaa

SEQ ID NO: 846120 - RNA, 23 nt, Human
uuuuuuuuuuuuuuuuuuuuagg

SEQ ID NO: 846121 - RNA, 24 nt, Human
aaacagccacgaauugaagcacaa

SEQ ID NO: 846122 - RNA, 18 nt, Human
accauauuuaauagaaac

SEQ ID NO: 846123 - RNA, 22 nt, Human
augagagacaaauuaacccaca

SEQ ID NO: 846124 - RNA, 22 nt, Human
caaaacagccacgaauugaagc

SEQ ID NO: 846125 - RNA, 20 nt, Human
cagauuucugagauuuucac

SEQ ID NO: 846126 - RNA, 26 nt, Human
ccaaaaugagagacaaauuaacccac

SEQ ID NO: 846127 - RNA, 19 nt, Human
ccuccugcaaaacagccac

SEQ ID NO: 846128 - RNA, 23 nt, Human
ccuccugcaaaacagccacgaau

SEQ ID NO: 846129 - RNA, 20 nt, Human
gaagcacaagugaggacaau

SEQ ID NO: 846130 - RNA, 19 nt, Human
gaguuugcuuuguuucucc

SEQ ID NO: 846131 - RNA, 27 nt, Human
gcgaaaaagagggcuuucugggauaaa

SEQ ID NO: 846132 - RNA, 25 nt, Human
gcuuuguuucuccucauguuuguca

SEQ ID NO: 846133 - RNA, 30 nt, Human
ggugcgaaaaagagggcuuucugggauaaa

SEQ ID NO: 846134 - RNA, 18 nt, Human
uacgaaggacccaaaaug

SEQ ID NO: 846135 - RNA, 30 nt, Human
uauacgaaggacccaaaaugagagacaaag

SEQ ID NO: 846136 - RNA, 18 nt, Human
ugagagacaaauuaaccc

SEQ ID NO: 846137 - RNA, 23 nt, Human
uuaauguuuucaccauauuuaau

SEQ ID NO: 846138 - RNA, 19 nt, Human
uugaugaggugcgaaaaag

SEQ ID NO: 846139 - RNA, 22 nt, Human
uuuuuaauguuuucaccauauu

SEQ ID NO: 846140 - RNA, 25 nt, Human
uuuuuuuuuuuuuuuuuaauguuuu

SEQ ID NO: 846141 - RNA, 24 nt, Human
uuuuuuuuuuuuuuuuuuuuaaug

SEQ ID NO: 846142 - RNA, 18 nt, Human
aauccucccuccuaccac

SEQ ID NO: 846143 - RNA, 19 nt, Human
accccaucauagaaaugag

SEQ ID NO: 846144 - RNA, 22 nt, Human
agcaaguggcagggcugcagug

SEQ ID NO: 846145 - RNA, 24 nt, Human
agucagccaaagaaagcggauccc

SEQ ID NO: 846146 - RNA, 21 nt, Human
augcagacaagcaaguggcag

SEQ ID NO: 846147 - RNA, 21 nt, Human
cacagcaagccauucuuaucc

SEQ ID NO: 846148 - RNA, 23 nt, Human
cacagcaagccauucuuauccca

SEQ ID NO: 846149 - RNA, 24 nt, Human
cacagcaagccauucuuaucccau

SEQ ID NO: 846150 - RNA, 18 nt, Human
caccugugggaucgacuc

SEQ ID NO: 846151 - RNA, 21 nt, Human
cagaacugguuugccaccugu

SEQ ID NO: 846152 - RNA, 22 nt, Human
caggugaugggcuccugagucc

SEQ ID NO: 846153 - RNA, 20 nt, Human
cauccagccggaaauagauu

SEQ ID NO: 846154 - RNA, 23 nt, Human
cauuaagacaugagacacucagc

SEQ ID NO: 846155 - RNA, 21 nt, Human
ccagcacccucuucccuuccc

SEQ ID NO: 846156 - RNA, 24 nt, Human
cccaacauacguguugaccagaua

SEQ ID NO: 846157 - RNA, 19 nt, Human
cccacacaugcagacaagc

SEQ ID NO: 846158 - RNA, 19 nt, Human
cccagcacccucuucccuu

SEQ ID NO: 846159 - RNA, 24 nt, Human
cccaucauagaaaugagaaaagaa

SEQ ID NO: 846160 - RNA, 22 nt, Human
ccccaucauagaaaugagaaaa

SEQ ID NO: 846161 - RNA, 22 nt, Human
ccgucauccuuccucaucagcc

SEQ ID NO: 846162 - RNA, 20 nt, Human
ccuccaagcacuagagcagu

SEQ ID NO: 846163 - RNA, 24 nt, Human
ccugagauuuucaaaucugaaucu

SEQ ID NO: 846164 - RNA, 24 nt, Human
ccugaucuaggcuuuucuccaccu

SEQ ID NO: 846165 - RNA, 23 nt, Human
ccuguaguagauccagcuagggc

SEQ ID NO: 846166 - RNA, 21 nt, Human
ccuucagacuccacauccagc

SEQ ID NO: 846167 - RNA, 23 nt, Human
cggaugucuugcauuccggcuuc

SEQ ID NO: 846168 - RNA, 18 nt, Human
cucagcaucuuuaucugu

SEQ ID NO: 846169 - RNA, 20 nt, Human
cuccggguggcccugggcuc

SEQ ID NO: 846170 - RNA, 19 nt, Human
cuguucuacccaacauacg

SEQ ID NO: 846171 - RNA, 23 nt, Human
gagccugcccacccgugagugcc

SEQ ID NO: 846172 - RNA, 18 nt, Human
gagcggugggcaccguca

SEQ ID NO: 846173 - RNA, 19 nt, Human
gagcggugggcaccgucau

SEQ ID NO: 846174 - RNA, 21 nt, Human
gcagcuccggguggcccuggg

SEQ ID NO: 846175 - RNA, 22 nt, Human
gccaaauccucccuccuaccac

SEQ ID NO: 846176 - RNA, 19 nt, Human
gcucccccaaggcucacag

SEQ ID NO: 846177 - RNA, 21 nt, Human
ggaaaagggaagacucugagc

SEQ ID NO: 846178 - RNA, 22 nt, Human
ggaagacucugagcagucagcc

SEQ ID NO: 846179 - RNA, 21 nt, Human
ggaguuaggugcagauguuga

SEQ ID NO: 846180 - RNA, 21 nt, Human
ggcagggcugcagugugggga

SEQ ID NO: 846181 - RNA, 23 nt, Human
ggcuccugaguccaucugggcau

SEQ ID NO: 846182 - RNA, 24 nt, Human
ggcuugaaaucgcuccgcagggcc

SEQ ID NO: 846183 - RNA, 19 nt, Human
ggugaugggcuccugaguc

SEQ ID NO: 846184 - RNA, 20 nt, Human
guggggauuuacaggugaug

SEQ ID NO: 846185 - RNA, 18 nt, Human
uaaaaagccccccauggc

SEQ ID NO: 846186 - RNA, 19 nt, Human
uaagacaugagacacucag

SEQ ID NO: 846187 - RNA, 18 nt, Human
uauccugcggugccugug

SEQ ID NO: 846188 - RNA, 21 nt, Human
uauccugcggugccugugguc

SEQ ID NO: 846189 - RNA, 22 nt, Human
ucaaaucugaaucugugcaacu

SEQ ID NO: 846190 - RNA, 23 nt, Human
ucacagagccagagugggugcca

SEQ ID NO: 846191 - RNA, 21 nt, Human
ucacaggaaaagggaagacuc

SEQ ID NO: 846192 - RNA, 18 nt, Human
ucagcuggagagauggag

SEQ ID NO: 846193 - RNA, 20 nt, Human
ucagggagccagccaggcag

SEQ ID NO: 846194 - RNA, 23 nt, Human
uccaggaagauuucccagagaaa

SEQ ID NO: 846195 - RNA, 19 nt, Human
ucccuguaguagauccagc

SEQ ID NO: 846196 - RNA, 20 nt, Human
ucuaccccaucauagaaaug

SEQ ID NO: 846197 - RNA, 22 nt, Human
ugagaaaagaaucaccaagaga

SEQ ID NO: 846198 - RNA, 19 nt, Human
uggcagggcugcagugugg

SEQ ID NO: 846199 - RNA, 22 nt, Human
uggcagggcugcagugugggga

SEQ ID NO: 846200 - RNA, 18 nt, Human
uggcccugggcuccaggu

SEQ ID NO: 846201 - RNA, 21 nt, Human
ugggaucgacucagcauuuua

SEQ ID NO: 846202 - RNA, 18 nt, Human
ugggauuugcaccugaga

SEQ ID NO: 846203 - RNA, 19 nt, Human
ugggcuccugaguccaucu

SEQ ID NO: 846204 - RNA, 19 nt, Human
uguaguagauccagcuagg

SEQ ID NO: 846205 - RNA, 23 nt, Human
uguccaggaagauuucccagaag

SEQ ID NO: 846206 - RNA, 19 nt, Human
ugucugagccugcccaccc

SEQ ID NO: 846207 - RNA, 18 nt, Human
ugugguccacagcaagcc

SEQ ID NO: 846208 - RNA, 21 nt, Human
uguuuauuucaacagcucaag

SEQ ID NO: 846209 - RNA, 24 nt, Human
uuuguauugguguuaguccucauu

SEQ ID NO: 846210 - RNA, 20 nt, Human
uuuuaaaauaggaggcaguu

SEQ ID NO: 846211 - RNA, 20 nt, Human
uuuuuuuuuuuuuuuuuugg

SEQ ID NO: 846212 - RNA, 22 nt, Human
uuuuuuuuuuuuuuuuuuguuu

SEQ ID NO: 846213 - RNA, 22 nt, Human
aagaaggaaggaguccuggagc

SEQ ID NO: 846214 - RNA, 21 nt, Human
aagcaggaagcaggguggugg

SEQ ID NO: 846215 - RNA, 22 nt, Human
aaggaagaaggaaggaguccug

SEQ ID NO: 846216 - RNA, 23 nt, Human
aaggaagaaggaaggaguccugg

SEQ ID NO: 846217 - RNA, 19 nt, Human
aaggaguccuggagcagag

SEQ ID NO: 846218 - RNA, 20 nt, Human
aaggaguccuggagcagagc

SEQ ID NO: 846219 - RNA, 26 nt, Human
accuccuucccaccuucccccugccg

SEQ ID NO: 846220 - RNA, 22 nt, Human
acuuccccaucuccucccccau

SEQ ID NO: 846221 - RNA, 18 nt, Human
agaaggaagaaggaagga

SEQ ID NO: 846222 - RNA, 22 nt, Human
agaccccaauccugguuuccaa

SEQ ID NO: 846223 - RNA, 22 nt, Human
agcgggggaggggaguggggcc

SEQ ID NO: 846224 - RNA, 18 nt, Human
aggggguggaagguuaca

SEQ ID NO: 846225 - RNA, 22 nt, Human
auaggggagcugggcuuggggg

SEQ ID NO: 846226 - RNA, 21 nt, Human
caacaggaugggcacaaaugg

SEQ ID NO: 846227 - RNA, 18 nt, Human
caagccccacuggggcag

SEQ ID NO: 846228 - RNA, 21 nt, Human
cagagcccugcccuggucccc

SEQ ID NO: 846229 - RNA, 20 nt, Human
cagccccugccagugccugg

SEQ ID NO: 846230 - RNA, 22 nt, Human
caggcccugccuugcccugcag

SEQ ID NO: 846231 - RNA, 19 nt, Human
cauccccuucccaccuggc

SEQ ID NO: 846232 - RNA, 21 nt, Human
ccaagccccacuggggcaggc

SEQ ID NO: 846233 - RNA, 20 nt, Human
ccacgcaagcccagcucgac

SEQ ID NO: 846234 - RNA, 20 nt, Human
ccacuuccccaucuccuccc

SEQ ID NO: 846235 - RNA, 24 nt, Human
ccccacgcaagcccagcucgaccu

SEQ ID NO: 846236 - RNA, 21 nt, Human
cccuacgccugagcaagccuc

SEQ ID NO: 846237 - RNA, 19 nt, Human
ccgcggggcgggaucgguc

SEQ ID NO: 846238 - RNA, 22 nt, Human
ccgcuggguucaggcccggccu

SEQ ID NO: 846239 - RNA, 21 nt, Human
ccggccugggccgcggggcgg

SEQ ID NO: 846240 - RNA, 21 nt, Human
ccugccuugcccugcagaggc

SEQ ID NO: 846241 - RNA, 23 nt, Human
ccuggagcagagcccugcccugg

SEQ ID NO: 846242 - RNA, 18 nt, Human
ccuugcuggagaaaaggc

SEQ ID NO: 846243 - RNA, 21 nt, Human
cgaccuccuucccaccuuccc

SEQ ID NO: 846244 - RNA, 25 nt, Human
cgguggcagugagggagcuugggac

SEQ ID NO: 846245 - RNA, 22 nt, Human
cucccccaugggcugcaggggc

SEQ ID NO: 846246 - RNA, 19 nt, Human
cuccuucccaccuuccccc

SEQ ID NO: 846247 - RNA, 19 nt, Human
cuccuuccucccugucucc

SEQ ID NO: 846248 - RNA, 19 nt, Human
cuggggcaggcccugccuu

SEQ ID NO: 846249 - RNA, 20 nt, Human
cuggggugagguggggaggg

SEQ ID NO: 846250 - RNA, 18 nt, Human
gaagcaggaagcagggug

SEQ ID NO: 846251 - RNA, 20 nt, Human
gaccuccuucccaccuuccc

SEQ ID NO: 846252 - RNA, 26 nt, Human
gagaaggaagaaggaaggaguccugg

SEQ ID NO: 846253 - RNA, 22 nt, Human
gagguagauggggagacguggg

SEQ ID NO: 846254 - RNA, 22 nt, Human
gcacugucgcgcuccuuccucc

SEQ ID NO: 846255 - RNA, 19 nt, Human
gccggcuccaggccuuccg

SEQ ID NO: 846256 - RNA, 20 nt, Human
gccucccaggggguccuggg

SEQ ID NO: 846257 - RNA, 20 nt, Human
gccugggccgcggggcggga

SEQ ID NO: 846258 - RNA, 24 nt, Human
gcuccacuuccccaucuccucccc

SEQ ID NO: 846259 - RNA, 18 nt, Human
ggagaagcggcacccgcu

SEQ ID NO: 846260 - RNA, 23 nt, Human
ggagcgggggaggggaguggggc

SEQ ID NO: 846261 - RNA, 19 nt, Human
ggcccccacgcaagcccag

SEQ ID NO: 846262 - RNA, 24 nt, Human
gggagggaggcugaacgaagcagg

SEQ ID NO: 846263 - RNA, 21 nt, Human
gggaguggggccgcaccagcc

SEQ ID NO: 846264 - RNA, 20 nt, Human
ggggagggaggcugaacgaa

SEQ ID NO: 846265 - RNA, 21 nt, Human
ggguacgaggagggcgcgggc

SEQ ID NO: 846266 - RNA, 19 nt, Human
ucaggcccggccugggccg

SEQ ID NO: 846267 - RNA, 23 nt, Human
uccacuuccccaucuccuccccc

SEQ ID NO: 846268 - RNA, 18 nt, Human
uccccaucuccuccccca

SEQ ID NO: 846269 - RNA, 18 nt, Human
uccccaucuccuccccca

SEQ ID NO: 846270 - RNA, 18 nt, Human
ucccccaugggcugcagg

SEQ ID NO: 846271 - RNA, 19 nt, Human
uccuucccaccuucccccu

SEQ ID NO: 846272 - RNA, 23 nt, Human
ugagggagcuugggacccugagg

SEQ ID NO: 846273 - RNA, 23 nt, Human
ugagguggggagggaggcugaac

SEQ ID NO: 846274 - RNA, 27 nt, Human
uggcacugucgcgcuccuuccucccug

SEQ ID NO: 846275 - RNA, 20 nt, Human
uggggccgcaccagccccug

SEQ ID NO: 846276 - RNA, 24 nt, Human
uggggccgcaccagccccugccag

SEQ ID NO: 846277 - RNA, 24 nt, Human
uggggugagguggggagggaggcu

SEQ ID NO: 846278 - RNA, 21 nt, Human
uggucccaagccccacugggg

SEQ ID NO: 846279 - RNA, 21 nt, Human
uggugggcagaccccaauccu

SEQ ID NO: 846280 - RNA, 23 nt, Human
uuaaggguagagguagaugggga

SEQ ID NO: 846281 - RNA, 27 nt, Human
uucccaccuucccccugccggcuccag

SEQ ID NO: 846282 - RNA, 20 nt, Human
uugcuucugcuucuccacgc

SEQ ID NO: 846283 - RNA, 22 nt, Human
uuggagguggaagccucgggug

SEQ ID NO: 846284 - RNA, 21 nt, Human
uuuuuuuuuuagagaaucugg

SEQ ID NO: 846285 - RNA, 21 nt, Human
uuuuuuuuuuuuagagaaucu

SEQ ID NO: 846286 - RNA, 24 nt, Human
aacaacugcccccaacaugcccag

SEQ ID NO: 846287 - RNA, 22 nt, Human
acauuccugagcucugguucag

SEQ ID NO: 846288 - RNA, 24 nt, Human
acucgcggucgggcucaggggcgg

SEQ ID NO: 846289 - RNA, 26 nt, Human
agcccugcaugaaguccugggugggu

SEQ ID NO: 846290 - RNA, 19 nt, Human
auaaaacauaggcuuccuu

SEQ ID NO: 846291 - RNA, 20 nt, Human
aucuggacugggccuuggag

SEQ ID NO: 846292 - RNA, 21 nt, Human
auggguccaaagacuucuggg

SEQ ID NO: 846293 - RNA, 21 nt, Human
caacccccgcccacaucugcc

SEQ ID NO: 846294 - RNA, 18 nt, Human
cacaacccccgcccacau

SEQ ID NO: 846295 - RNA, 24 nt, Human
caggguggggcuccaacaacugcc

SEQ ID NO: 846296 - RNA, 19 nt, Human
caugaugacgccgugcccc

SEQ ID NO: 846297 - RNA, 19 nt, Human
cccaagaacuugaacuuca

SEQ ID NO: 846298 - RNA, 22 nt, Human
cccacaacccccgcccacaucu

SEQ ID NO: 846299 - RNA, 23 nt, Human
cccacaacccccgcccacaucug

SEQ ID NO: 846300 - RNA, 23 nt, Human
cccauccugcccagccacaggaa

SEQ ID NO: 846301 - RNA, 19 nt, Human
ccccaagaacuugaacuuc

SEQ ID NO: 846302 - RNA, 24 nt, Human
ccccacaacccccgcccacaucug

SEQ ID NO: 846303 - RNA, 22 nt, Human
cccccaacaugcccagcccugc

SEQ ID NO: 846304 - RNA, 18 nt, Human
cccccacaacccccgccc

SEQ ID NO: 846305 - RNA, 21 nt, Human
ccccgcuucccucugggccac

SEQ ID NO: 846306 - RNA, 18 nt, Human
cccgcccacaucugccau

SEQ ID NO: 846307 - RNA, 18 nt, Human
ccgugccccgcuucccuc

SEQ ID NO: 846308 - RNA, 18 nt, Human
ccucugggccaccgggcg

SEQ ID NO: 846309 - RNA, 19 nt, Human
cgccuccucggaccucggg

SEQ ID NO: 846310 - RNA, 22 nt, Human
cggcuccggggacgcgcggcgg

SEQ ID NO: 846311 - RNA, 19 nt, Human
cgggcccugagcucgaacu

SEQ ID NO: 846312 - RNA, 25 nt, Human
cgucccccacaacccccgcccacau

SEQ ID NO: 846313 - RNA, 27 nt, Human
cuccggggacgcgcggcggggcaaauc

SEQ ID NO: 846314 - RNA, 19 nt, Human
cugggccaccgggcggagg

SEQ ID NO: 846315 - RNA, 20 nt, Human
cugggccuuggagcuguccu

SEQ ID NO: 846316 - RNA, 24 nt, Human
gcgauacaacugugcaugaugacg

SEQ ID NO: 846317 - RNA, 23 nt, Human
gcgcgcgcgcgcgcgugugugua

SEQ ID NO: 846318 - RNA, 24 nt, Human
gcgcgcguguguguauauauauau

SEQ ID NO: 846319 - RNA, 30 nt, Human
gcguguguguauauauauauauaaaaaauc

SEQ ID NO: 846320 - RNA, 24 nt, Human
gcugcggcgggguagagcgggcac

SEQ ID NO: 846321 - RNA, 22 nt, Human
ggacccugggcagguauggggc

SEQ ID NO: 846322 - RNA, 20 nt, Human
ggccgggacuugcgggcucc

SEQ ID NO: 846323 - RNA, 22 nt, Human
ggguccaaagacuucugggugu

SEQ ID NO: 846324 - RNA, 19 nt, Human
ggguggggcuccaacaacu

SEQ ID NO: 846325 - RNA, 20 nt, Human
guauauauauauauaaaaca

SEQ ID NO: 846326 - RNA, 24 nt, Human
guccugggugggugaggucaucug

SEQ ID NO: 846327 - RNA, 21 nt, Human
gugugcgcgcgcgcgcgcgcg

SEQ ID NO: 846328 - RNA, 23 nt, Human
ucugccauacuuucagaugcccc

SEQ ID NO: 846329 - RNA, 24 nt, Human
ugaugacgccgugccccgcuuccc

SEQ ID NO: 846330 - RNA, 21 nt, Human
ugcccccaacaugcccagccc

SEQ ID NO: 846331 - RNA, 26 nt, Human
ugcccccaacaugcccagcccugcau

SEQ ID NO: 846332 - RNA, 24 nt, Human
ugcgcgcgcgcgcgcgcgugugug

SEQ ID NO: 846333 - RNA, 19 nt, Human
uggcaggaacuggucccag

SEQ ID NO: 846334 - RNA, 23 nt, Human
uguauuuauaaaaccaaaugggu

SEQ ID NO: 846335 - RNA, 24 nt, Human
uguauuuauaaaaccaaauggguc

SEQ ID NO: 846336 - RNA, 19 nt, Human
ugugcgcgcgcgcgcgcgc

SEQ ID NO: 846337 - RNA, 24 nt, Human
ugugcgcgcgcgcgcgcgcgugug

SEQ ID NO: 846338 - RNA, 18 nt, Human
uguguauauauauauaua

SEQ ID NO: 846339 - RNA, 23 nt, Human
uguguauauauauauauaaaaca

SEQ ID NO: 846340 - RNA, 24 nt, Human
uguguguauauauauauauaaaac

SEQ ID NO: 846341 - RNA, 19 nt, Human
uuacuugacauuccugagc

SEQ ID NO: 846342 - RNA, 19 nt, Human
uucacugcauuguaugaug

SEQ ID NO: 846343 - RNA, 23 nt, Human
uuuuuuuuuuuuuucuucacauu

SEQ ID NO: 846344 - RNA, 18 nt, Human
aaguguccuugugaugag

SEQ ID NO: 846345 - RNA, 22 nt, Human
caacucuacaaucuugcaaggc

SEQ ID NO: 846346 - RNA, 20 nt, Human
cacccuuugugccaggcccu

SEQ ID NO: 846347 - RNA, 19 nt, Human
cauaaguagugguuauagu

SEQ ID NO: 846348 - RNA, 23 nt, Human
caucuccacuuuacaguucaaga

SEQ ID NO: 846349 - RNA, 19 nt, Human
caugugcgcgcggcagggc

SEQ ID NO: 846350 - RNA, 24 nt, Human
ccccugaauagucccucauagucc

SEQ ID NO: 846351 - RNA, 19 nt, Human
ccgccgccgcucggaacgc

SEQ ID NO: 846352 - RNA, 26 nt, Human
ccgugcgcucaccuccgccgccgcuc

SEQ ID NO: 846353 - RNA, 18 nt, Human
cgccuacaugugcgcgcg

SEQ ID NO: 846354 - RNA, 23 nt, Human
cugaauagucccucauagucccu

SEQ ID NO: 846355 - RNA, 24 nt, Human
gagcuauagguccaaaggcuccaa

SEQ ID NO: 846356 - RNA, 20 nt, Human
uagccccugaauagucccuc

SEQ ID NO: 846357 - RNA, 21 nt, Human
uagccccugaauagucccuca

SEQ ID NO: 846358 - RNA, 21 nt, Human
uccgugcgcucaccuccgccg

SEQ ID NO: 846359 - RNA, 23 nt, Human
ucugcacaagcuggaaguguccu

SEQ ID NO: 846360 - RNA, 24 nt, Human
ucugcacaagcuggaaguguccuu

SEQ ID NO: 846361 - RNA, 24 nt, Human
ugaguucauaaguagugguuauag

SEQ ID NO: 846362 - RNA, 22 nt, Human
ugccaggcccuuauguucauga

SEQ ID NO: 846363 - RNA, 24 nt, Human
uuuuuuuuuuuuuuuuaaggaggg

SEQ ID NO: 846364 - RNA, 23 nt, Human
uuuuuuuuuuuuuuuuuuuaagg

SEQ ID NO: 846365 - RNA, 24 nt, Human
aaagugcuaagauuauacauauga

SEQ ID NO: 846366 - RNA, 19 nt, Human
aaccgcgcgaucacagggc

SEQ ID NO: 846367 - RNA, 24 nt, Human
aagcaauccuccugccuuggccuc

SEQ ID NO: 846368 - RNA, 25 nt, Human
aagcaauccuccugccuuggccucc

SEQ ID NO: 846369 - RNA, 20 nt, Human
aagggcuuuccaccccucca

SEQ ID NO: 846370 - RNA, 24 nt, Human
aaguaacugggauuacaggcacgu

SEQ ID NO: 846371 - RNA, 25 nt, Human
aaguaacugggauuacaggcacgug

SEQ ID NO: 846372 - RNA, 26 nt, Human
aagugcuaagauuauacauaugagcc

SEQ ID NO: 846373 - RNA, 25 nt, Human
aaucucgccucacugcaaccuccac

SEQ ID NO: 846374 - RNA, 23 nt, Human
aaugcaguggcgugacuguggcu

SEQ ID NO: 846375 - RNA, 24 nt, Human
aaugcaguggcgugacuguggcuc

SEQ ID NO: 846376 - RNA, 24 nt, Human
aauuuuguauuuuuaguagagaug

SEQ ID NO: 846377 - RNA, 23 nt, Human
acagugcugggauuacaggcaua

SEQ ID NO: 846378 - RNA, 25 nt, Human
acccgccucagccucccacagugcu

SEQ ID NO: 846379 - RNA, 21 nt, Human
acccuccguacgccuccgcug

SEQ ID NO: 846380 - RNA, 19 nt, Human
acuguuuucugcaaugaau

SEQ ID NO: 846381 - RNA, 18 nt, Human
agaugauccacccgccuc

SEQ ID NO: 846382 - RNA, 22 nt, Human
agauuauacauaugagccacca

SEQ ID NO: 846383 - RNA, 21 nt, Human
agcaauccuccugccuuggcc

SEQ ID NO: 846384 - RNA, 24 nt, Human
agcgauucucuugccucagccucc

SEQ ID NO: 846385 - RNA, 19 nt, Human
aggcauaaaccacugugcc

SEQ ID NO: 846386 - RNA, 23 nt, Human
aggcauaaaccacugugcccggc

SEQ ID NO: 846387 - RNA, 24 nt, Human
agguggucucaaacuccugaccuc

SEQ ID NO: 846388 - RNA, 18 nt, Human
agugcugggauuacaggc

SEQ ID NO: 846389 - RNA, 21 nt, Human
agugcugggauuacaggcaua

SEQ ID NO: 846390 - RNA, 25 nt, Human
aguugagaaaagagccuccaaacuu

SEQ ID NO: 846391 - RNA, 24 nt, Human
augauccacccgccucagccuccc

SEQ ID NO: 846392 - RNA, 22 nt, Human
augggguuucaccauguuggcc

SEQ ID NO: 846393 - RNA, 24 nt, Human
augggguuucaccauguuggccag

SEQ ID NO: 846394 - RNA, 22 nt, Human
caaagugcuaagauuauacaua

SEQ ID NO: 846395 - RNA, 22 nt, Human
caagcaauccuccugccuuggc

SEQ ID NO: 846396 - RNA, 27 nt, Human
caagcaauccuccugccuuggccuccc

SEQ ID NO: 846397 - RNA, 27 nt, Human
caagcaauccuccugccuuggccuccc

SEQ ID NO: 846398 - RNA, 22 nt, Human
caagcgauucucuugccucagc

SEQ ID NO: 846399 - RNA, 27 nt, Human
caagcgauucucuugccucagccuccc

SEQ ID NO: 846400 - RNA, 24 nt, Human
caaggucuccaucuguugcccagg

SEQ ID NO: 846401 - RNA, 20 nt, Human
caauccacccuccucagccu

SEQ ID NO: 846402 - RNA, 24 nt, Human
cacagugcugggauuacaggcaua

SEQ ID NO: 846403 - RNA, 23 nt, Human
caccacacacuugugcucguccu

SEQ ID NO: 846404 - RNA, 20 nt, Human
caccauguuggccagguggu

SEQ ID NO: 846405 - RNA, 23 nt, Human
caccauguuggccagguggucuc

SEQ ID NO: 846406 - RNA, 26 nt, Human
caccauguuggccagguggucucaaa

SEQ ID NO: 846407 - RNA, 23 nt, Human
cacccaguugaccgcggccucgu

SEQ ID NO: 846408 - RNA, 20 nt, Human
cacccuccucagccucagcc

SEQ ID NO: 846409 - RNA, 21 nt, Human
cacgugccaccacgcccagcu

SEQ ID NO: 846410 - RNA, 19 nt, Human
cagcagaauuuucccgguu

SEQ ID NO: 846411 - RNA, 23 nt, Human
cagcagcagcucugccacccucc

SEQ ID NO: 846412 - RNA, 20 nt, Human
cagcagcucugccacccucc

SEQ ID NO: 846413 - RNA, 24 nt, Human
cagccucaaaccccugggcucaag

SEQ ID NO: 846414 - RNA, 23 nt, Human
cagccucccaaguaacugggauu

SEQ ID NO: 846415 - RNA, 25 nt, Human
caggggguuuucuuuggaucaguuu

SEQ ID NO: 846416 - RNA, 25 nt, Human
cagugcugggauuacaggcauaaac

SEQ ID NO: 846417 - RNA, 23 nt, Human
ccaaguaacugggauuacaggca

SEQ ID NO: 846418 - RNA, 23 nt, Human
ccacagugcugggauuacaggca

SEQ ID NO: 846419 - RNA, 24 nt, Human
ccacagugcugggauuacaggcau

SEQ ID NO: 846420 - RNA, 20 nt, Human
ccaccacgcccagcuaauuu

SEQ ID NO: 846421 - RNA, 21 nt, Human
ccacccgccucagccucccac

SEQ ID NO: 846422 - RNA, 22 nt, Human
ccacccuccguacgccuccgcu

SEQ ID NO: 846423 - RNA, 24 nt, Human
ccaccuucugaguucaagcgauuc

SEQ ID NO: 846424 - RNA, 21 nt, Human
ccacgcgcagcucuggccccu

SEQ ID NO: 846425 - RNA, 19 nt, Human
ccagagagaccccggggca

SEQ ID NO: 846426 - RNA, 19 nt, Human
cccaaguaacugggauuac

SEQ ID NO: 846427 - RNA, 24 nt, Human
cccaaguaacugggauuacaggca

SEQ ID NO: 846428 - RNA, 20 nt, Human
ccccugggcucaagcaaucc

SEQ ID NO: 846429 - RNA, 21 nt, Human
cccgacuguuuucugcaauga

SEQ ID NO: 846430 - RNA, 20 nt, Human
ccgacuguuuucugcaauga

SEQ ID NO: 846431 - RNA, 21 nt, Human
ccgccuuggccagcagcagcu

SEQ ID NO: 846432 - RNA, 24 nt, Human
ccguacgccuccgcugucaauaaa

SEQ ID NO: 846433 - RNA, 24 nt, Human
ccguccauucugcccuuugggacc

SEQ ID NO: 846434 - RNA, 24 nt, Human
ccuauaaccucgaucauguucucu

SEQ ID NO: 846435 - RNA, 22 nt, Human
ccuauguugccuaggcuggucu

SEQ ID NO: 846436 - RNA, 22 nt, Human
ccuauguugccuaggcuggucu

SEQ ID NO: 846437 - RNA, 31 nt, Human
ccuccacgcgcagcucuggccccgccgccuu

SEQ ID NO: 846438 - RNA, 26 nt, Human
ccuccugccuuggccucccaaagugc

SEQ ID NO: 846439 - RNA, 20 nt, Human
ccucgccucaagcaauccuc

SEQ ID NO: 846440 - RNA, 22 nt, Human
ccugaccucagaugauccaccc

SEQ ID NO: 846441 - RNA, 23 nt, Human
ccugaccucagaugauccacccg

SEQ ID NO: 846442 - RNA, 24 nt, Human
ccugggcucaagcaauccacccuc

SEQ ID NO: 846443 - RNA, 24 nt, Human
ccuucugaguucaagcgauucucu

SEQ ID NO: 846444 - RNA, 23 nt, Human
cgccucaagcaauccuccugccu

SEQ ID NO: 846445 - RNA, 24 nt, Human
cgccucagccucccacagugcugg

SEQ ID NO: 846446 - RNA, 19 nt, Human
cgccuuggccagcagcagc

SEQ ID NO: 846447 - RNA, 21 nt, Human
cgggucaagguccacucugcg

SEQ ID NO: 846448 - RNA, 22 nt, Human
cuaaacaaggucccgcccugcc

SEQ ID NO: 846449 - RNA, 24 nt, Human
cuaauuuuguauuuuuaguagaga

SEQ ID NO: 846450 - RNA, 24 nt, Human
cucaagcaauccuccugccuuggc

SEQ ID NO: 846451 - RNA, 23 nt, Human
cucacugcaaccuccaccuucug

SEQ ID NO: 846452 - RNA, 19 nt, Human
cucacugcagccucaaacc

SEQ ID NO: 846453 - RNA, 24 nt, Human
cucacugcagccucaaaccccugg

SEQ ID NO: 846454 - RNA, 22 nt, Human
cucaugaagggcuuuccacccc

SEQ ID NO: 846455 - RNA, 22 nt, Human
cucguccugcuccgaccaaaag

SEQ ID NO: 846456 - RNA, 22 nt, Human
cucuuguugcugaggcuggagu

SEQ ID NO: 846457 - RNA, 24 nt, Human
cugcaaccuccaccuucugaguuc

SEQ ID NO: 846458 - RNA, 23 nt, Human
cugcagccucaaaccccugggcu

SEQ ID NO: 846459 - RNA, 23 nt, Human
cugccuuggccucccaaagugcu

SEQ ID NO: 846460 - RNA, 18 nt, Human
gaaaccagagagaccccg

SEQ ID NO: 846461 - RNA, 18 nt, Human
gacaaaguuucacucuug

SEQ ID NO: 846462 - RNA, 24 nt, Human
gaccucagaugauccacccgccuc

SEQ ID NO: 846463 - RNA, 18 nt, Human
gagaauccgaugccucuc

SEQ ID NO: 846464 - RNA, 18 nt, Human
gagaugggguuucaccau

SEQ ID NO: 846465 - RNA, 24 nt, Human
gagaugggguuucaccauguuggc

SEQ ID NO: 846466 - RNA, 18 nt, Human
gaguucaagcgauucucu

SEQ ID NO: 846467 - RNA, 23 nt, Human
gauuacagagcgugccaccaugc

SEQ ID NO: 846468 - RNA, 18 nt, Human
gauuacaggcacgugcca

SEQ ID NO: 846469 - RNA, 21 nt, Human
gauuacaggcauaaaccacug

SEQ ID NO: 846470 - RNA, 24 nt, Human
gauuacaggcauaaaccacugugc

SEQ ID NO: 846471 - RNA, 18 nt, Human
gauuauacauaugagcca

SEQ ID NO: 846472 - RNA, 19 nt, Human
gccgcccugggguucagcu

SEQ ID NO: 846473 - RNA, 23 nt, Human
gccuaggcuggucuugaacuccu

SEQ ID NO: 846474 - RNA, 24 nt, Human
gcgauucucuugccucagccuccc

SEQ ID NO: 846475 - RNA, 19 nt, Human
gcuggagugcaauggccua

SEQ ID NO: 846476 - RNA, 23 nt, Human
ggauuacagagcgugccaccaug

SEQ ID NO: 846477 - RNA, 24 nt, Human
ggauuacaggcauaaaccacugug

SEQ ID NO: 846478 - RNA, 22 nt, Human
ggcucuguugacggcggcgccg

SEQ ID NO: 846479 - RNA, 24 nt, Human
ggcuggucuugaacuccucgccuc

SEQ ID NO: 846480 - RNA, 24 nt, Human
gggggucucccuauguugccuagg

SEQ ID NO: 846481 - RNA, 19 nt, Human
gggguuucaccauguuggc

SEQ ID NO: 846482 - RNA, 22 nt, Human
gggguuucaccauguuggccag

SEQ ID NO: 846483 - RNA, 22 nt, Human
gggucucccuauguugccuagg

SEQ ID NO: 846484 - RNA, 18 nt, Human
ggguuucaccauguuggc

SEQ ID NO: 846485 - RNA, 22 nt, Human
ggguuucaccauguuggccagg

SEQ ID NO: 846486 - RNA, 23 nt, Human
guagagaugggguuucaccaugu

SEQ ID NO: 846487 - RNA, 21 nt, Human
uaacuucugcgcacuauucuc

SEQ ID NO: 846488 - RNA, 24 nt, Human
uaagauuauacauaugagccacca

SEQ ID NO: 846489 - RNA, 24 nt, Human
uacaggcacgugccaccacgccca

SEQ ID NO: 846490 - RNA, 18 nt, Human
uacauaugagccaccaca

SEQ ID NO: 846491 - RNA, 20 nt, Human
uacgaggcacuaguuauugg

SEQ ID NO: 846492 - RNA, 24 nt, Human
uagaaugcaguggcgugacugugg

SEQ ID NO: 846493 - RNA, 22 nt, Human
uagagaugggguuucaccaugu

SEQ ID NO: 846494 - RNA, 19 nt, Human
uagaggauucccugggauu

SEQ ID NO: 846495 - RNA, 22 nt, Human
uaggaaaccagagagaccccgg

SEQ ID NO: 846496 - RNA, 24 nt, Human
uaguagagaugggguuucaccaug

SEQ ID NO: 846497 - RNA, 26 nt, Human
uaguagagaugggguuucaccauguu

SEQ ID NO: 846498 - RNA, 19 nt, Human
uauguugccuaggcugguc

SEQ ID NO: 846499 - RNA, 24 nt, Human
uauguugccuaggcuggucuugaa

SEQ ID NO: 846500 - RNA, 21 nt, Human
ucaauuuccuauaaccucgau

SEQ ID NO: 846501 - RNA, 18 nt, Human
ucacugcaaccuccaccu

SEQ ID NO: 846502 - RNA, 18 nt, Human
ucacugcaaccuccaccu

SEQ ID NO: 846503 - RNA, 22 nt, Human
ucacugcaaccuccaccuucug

SEQ ID NO: 846504 - RNA, 25 nt, Human
ucacugcaaccuccaccuucugagu

SEQ ID NO: 846505 - RNA, 27 nt, Human
ucacugcaaccuccaccuucugaguuc

SEQ ID NO: 846506 - RNA, 24 nt, Human
ucacugcagccucaaaccccuggg

SEQ ID NO: 846507 - RNA, 21 nt, Human
uccacccgccucagccuccca

SEQ ID NO: 846508 - RNA, 21 nt, Human
uccagcagaauuuucccgguu

SEQ ID NO: 846509 - RNA, 24 nt, Human
ucccaaguaacugggauuacaggc

SEQ ID NO: 846510 - RNA, 24 nt, Human
ucccacagugcugggauuacaggc

SEQ ID NO: 846511 - RNA, 23 nt, Human
ucccuauguugccuaggcugguc

SEQ ID NO: 846512 - RNA, 20 nt, Human
uccgaaccugauccagggca

SEQ ID NO: 846513 - RNA, 23 nt, Human
ucucccuauguugccuaggcugg

SEQ ID NO: 846514 - RNA, 24 nt, Human
ucucccuauguugccuaggcuggu

SEQ ID NO: 846515 - RNA, 20 nt, Human
ucugaguucaagcgauucuc

SEQ ID NO: 846516 - RNA, 20 nt, Human
ucugaguucaagcgauucuc

SEQ ID NO: 846517 - RNA, 18 nt, Human
ucuuguugcugaggcugg

SEQ ID NO: 846518 - RNA, 24 nt, Human
ugaacuccucgccucaagcaaucc

SEQ ID NO: 846519 - RNA, 24 nt, Human
ugaccgcggccucgucggccgccc

SEQ ID NO: 846520 - RNA, 24 nt, Human
ugaccucagaugauccacccgccu

SEQ ID NO: 846521 - RNA, 18 nt, Human
ugagaaaagagccuccaa

SEQ ID NO: 846522 - RNA, 24 nt, Human
ugagaaaagagccuccaaacuucc

SEQ ID NO: 846523 - RNA, 23 nt, Human
ugagacaaaguuucacucuuguu

SEQ ID NO: 846524 - RNA, 22 nt, Human
ugagacaaggucuccaucuguu

SEQ ID NO: 846525 - RNA, 24 nt, Human
ugaguucaagcgauucucuugccu

SEQ ID NO: 846526 - RNA, 22 nt, Human
ugcccaggauagaaugcagugg

SEQ ID NO: 846527 - RNA, 24 nt, Human
ugccucagccucccaaguaacugg

SEQ ID NO: 846528 - RNA, 23 nt, Human
ugccuuggccucccaaagugcua

SEQ ID NO: 846529 - RNA, 21 nt, Human
ugcugaggcuggagugcaaug

SEQ ID NO: 846530 - RNA, 24 nt, Human
ugcugggauuacaggcauaaacca

SEQ ID NO: 846531 - RNA, 23 nt, Human
uggagugcaauggccuaaucucg

SEQ ID NO: 846532 - RNA, 23 nt, Human
uggccagguggucucaaacuccu

SEQ ID NO: 846533 - RNA, 23 nt, Human
uggcgugacuguggcucacugca

SEQ ID NO: 846534 - RNA, 24 nt, Human
uggcgugacuguggcucacugcag

SEQ ID NO: 846535 - RNA, 21 nt, Human
ugggauuacagagcgugccac

SEQ ID NO: 846536 - RNA, 23 nt, Human
ugggauuacagagcgugccacca

SEQ ID NO: 846537 - RNA, 24 nt, Human
ugggauuacagagcgugccaccau

SEQ ID NO: 846538 - RNA, 21 nt, Human
ugggauuacaggcacgugcca

SEQ ID NO: 846539 - RNA, 22 nt, Human
ugggauuacaggcacgugccac

SEQ ID NO: 846540 - RNA, 24 nt, Human
ugggauuacaggcacgugccacca

SEQ ID NO: 846541 - RNA, 21 nt, Human
ugggauuacaggcauaaacca

SEQ ID NO: 846542 - RNA, 22 nt, Human
ugggauuacaggcauaaaccac

SEQ ID NO: 846543 - RNA, 23 nt, Human
ugggauuacaggcauaaaccacu

SEQ ID NO: 846544 - RNA, 24 nt, Human
ugggauuacaggcauaaaccacug

SEQ ID NO: 846545 - RNA, 26 nt, Human
ugggauuacaggcauaaaccacugug

SEQ ID NO: 846546 - RNA, 24 nt, Human
ugggcaaucaauuuccuauaaccu

SEQ ID NO: 846547 - RNA, 24 nt, Human
ugggguuucaccauguuggccagg

SEQ ID NO: 846548 - RNA, 25 nt, Human
uguagagaugggggucucccuaugu

SEQ ID NO: 846549 - RNA, 21 nt, Human
uguauuuuuaguagagauggg

SEQ ID NO: 846550 - RNA, 21 nt, Human
ugucagaacgaaguauauucc

SEQ ID NO: 846551 - RNA, 22 nt, Human
uguugcugaggcuggagugcaa

SEQ ID NO: 846552 - RNA, 21 nt, Human
uuaaauuuuuguagagauggg

SEQ ID NO: 846553 - RNA, 18 nt, Human
uuaguagagaugggguuu

SEQ ID NO: 846554 - RNA, 22 nt, Human
uuaguagagaugggguuucacc

SEQ ID NO: 846555 - RNA, 24 nt, Human
uuaguagagaugggguuucaccau

SEQ ID NO: 846556 - RNA, 20 nt, Human
uuagugcagccaagguaaag

SEQ ID NO: 846557 - RNA, 23 nt, Human
uucaagcgauucucuugccucag

SEQ ID NO: 846558 - RNA, 22 nt, Human
uucuccagcagaauuuucccgg

SEQ ID NO: 846559 - RNA, 18 nt, Human
uucugcaaugaauuuaga

SEQ ID NO: 846560 - RNA, 23 nt, Human
uugcugaggcuggagugcaaugg

SEQ ID NO: 846561 - RNA, 18 nt, Human
uuggccucccaaagugcu

SEQ ID NO: 846562 - RNA, 24 nt, Human
uugggauuacagagcgugccacca

SEQ ID NO: 846563 - RNA, 19 nt, Human
uuucaccauguuggccagg

SEQ ID NO: 846564 - RNA, 20 nt, Human
uuucaccauguuggccaggu

SEQ ID NO: 846565 - RNA, 24 nt, Human
uuuccaccccuccacgcgcagcuc

SEQ ID NO: 846566 - RNA, 19 nt, Human
uuuucugcaaugaauuuag

SEQ ID NO: 846567 - RNA, 25 nt, Human
uuuugagacaaggucuccaucuguu

SEQ ID NO: 846568 - RNA, 19 nt, Human
uuuuguauuuuuaguagag

SEQ ID NO: 846569 - RNA, 20 nt, Human
uuuuguauuuuuaguagaga

SEQ ID NO: 846570 - RNA, 21 nt, Human
uuuuguuguuguuguuguugu

SEQ ID NO: 846571 - RNA, 24 nt, Human
uuuuuaguagagaugggguuucac

SEQ ID NO: 846572 - RNA, 18 nt, Human
uuuuuuuuugagacaagg

SEQ ID NO: 846573 - RNA, 20 nt, Human
uuuuuuuuuuuuuuuuuugg

SEQ ID NO: 846574 - RNA, 19 nt, Human
aaaaacaaaacugaacaga

SEQ ID NO: 846575 - RNA, 23 nt, Human
aaaccaaauccuacugcaaguca

SEQ ID NO: 846576 - RNA, 23 nt, Human
aaaccaaauuacuguagagcaac

SEQ ID NO: 846577 - RNA, 22 nt, Human
aaagagcuucucugccuauaca

SEQ ID NO: 846578 - RNA, 21 nt, Human
aacagcaucgcuaguccacag

SEQ ID NO: 846579 - RNA, 24 nt, Human
aaccugggcucuucuccuagcccu

SEQ ID NO: 846580 - RNA, 23 nt, Human
aacuuuuuuuuuuuucagggggg

SEQ ID NO: 846581 - RNA, 19 nt, Human
aagcacaaaacugcucaga

SEQ ID NO: 846582 - RNA, 23 nt, Human
aaggaaugaaaauaaaaucaaga

SEQ ID NO: 846583 - RNA, 21 nt, Human
aagugccaacaaggguagugg

SEQ ID NO: 846584 - RNA, 25 nt, Human
aaugacuggcugaacugucucuacg

SEQ ID NO: 846585 - RNA, 22 nt, Human
acaaacagcaucgcuaguccac

SEQ ID NO: 846586 - RNA, 22 nt, Human
acccagaucguaggaaaaucaa

SEQ ID NO: 846587 - RNA, 23 nt, Human
acuaguuccacucucuaagggac

SEQ ID NO: 846588 - RNA, 21 nt, Human
agaauugauuccaguguccuc

SEQ ID NO: 846589 - RNA, 21 nt, Human
agacaguggugaaagucuuuc

SEQ ID NO: 846590 - RNA, 24 nt, Human
agacaguggugaaagucuuucuuc

SEQ ID NO: 846591 - RNA, 20 nt, Human
agauacacaugggaagaagg

SEQ ID NO: 846592 - RNA, 18 nt, Human
agcuggaagcgcagggcu

SEQ ID NO: 846593 - RNA, 24 nt, Human
agcuggaagcgcagggcuccucug

SEQ ID NO: 846594 - RNA, 25 nt, Human
agguuauuccaucugaaagaacuag

SEQ ID NO: 846595 - RNA, 20 nt, Human
aucaaguggcagaauugcuu

SEQ ID NO: 846596 - RNA, 22 nt, Human
aucacccaggcaaaagguaccg

SEQ ID NO: 846597 - RNA, 24 nt, Human
augagauaaauaauccauuucagg

SEQ ID NO: 846598 - RNA, 23 nt, Human
augcuggaguuggcccagggcug

SEQ ID NO: 846599 - RNA, 23 nt, Human
caaagcacaaaacugcucagaug

SEQ ID NO: 846600 - RNA, 22 nt, Human
caacagcaucaucacucagaca

SEQ ID NO: 846601 - RNA, 22 nt, Human
caagacaauucuggguccucaa

SEQ ID NO: 846602 - RNA, 19 nt, Human
caaggaaaaacaaagauaa

SEQ ID NO: 846603 - RNA, 21 nt, Human
caagucaaaauucucugcugg

SEQ ID NO: 846604 - RNA, 19 nt, Human
cacaaggaaaaacaaagau

SEQ ID NO: 846605 - RNA, 20 nt, Human
cacaaggaaaaacaaagaua

SEQ ID NO: 846606 - RNA, 23 nt, Human
cagaaaugggcuuuucaagauca

SEQ ID NO: 846607 - RNA, 19 nt, Human
cagaauugcuucgagaaua

SEQ ID NO: 846608 - RNA, 23 nt, Human
cagauguucaagaguccuaggag

SEQ ID NO: 846609 - RNA, 19 nt, Human
cagccccucccuucccauc

SEQ ID NO: 846610 - RNA, 23 nt, Human
cagucuacacuuauuucacauua

SEQ ID NO: 846611 - RNA, 21 nt, Human
caucacacuuccuucucucaa

SEQ ID NO: 846612 - RNA, 23 nt, Human
caucacacuuccuucucucaaaa

SEQ ID NO: 846613 - RNA, 22 nt, Human
caugagcauuaaucagaaauuu

SEQ ID NO: 846614 - RNA, 22 nt, Human
cauguggugauuuuuauuaaga

SEQ ID NO: 846615 - RNA, 18 nt, Human
ccaaugcagaaaugacug

SEQ ID NO: 846616 - RNA, 22 nt, Human
ccaguguccucuuccuuuuucc

SEQ ID NO: 846617 - RNA, 22 nt, Human
ccaguguccucuuccuuuuucc

SEQ ID NO: 846618 - RNA, 20 nt, Human
ccuagcccugccucagcugc

SEQ ID NO: 846619 - RNA, 23 nt, Human
ccucccuucccaucagcuguucc

SEQ ID NO: 846620 - RNA, 18 nt, Human
ccucuuccuuuuuccugu

SEQ ID NO: 846621 - RNA, 21 nt, Human
cgacaucauccuuaucaacag

SEQ ID NO: 846622 - RNA, 24 nt, Human
cuaaaggagccuaccagggccccu

SEQ ID NO: 846623 - RNA, 21 nt, Human
cucuaggaacagaaauggucc

SEQ ID NO: 846624 - RNA, 21 nt, Human
cugcaaguagcuggaagcgca

SEQ ID NO: 846625 - RNA, 20 nt, Human
cugcuauuauuacacagaga

SEQ ID NO: 846626 - RNA, 28 nt, Human
cuggaagguuauuccaucucccaauugg

SEQ ID NO: 846627 - RNA, 20 nt, Human
cugucuggcugcaaguagcu

SEQ ID NO: 846628 - RNA, 23 nt, Human
gaaagaacuagaucagcaagaca

SEQ ID NO: 846629 - RNA, 20 nt, Human
gaacacagguccaucauucc

SEQ ID NO: 846630 - RNA, 22 nt, Human
gaaccaaaaggaaugaaaauaa

SEQ ID NO: 846631 - RNA, 21 nt, Human
gacaggauguaccuucuugga

SEQ ID NO: 846632 - RNA, 22 nt, Human
gcaaaagguaccgaugcccaca

SEQ ID NO: 846633 - RNA, 20 nt, Human
gcccagggcugcuucaucgc

SEQ ID NO: 846634 - RNA, 23 nt, Human
gccuagagaaauccugacugccc

SEQ ID NO: 846635 - RNA, 21 nt, Human
gcucaaagcacaaaacugcuc

SEQ ID NO: 846636 - RNA, 22 nt, Human
gcugcuucaucgcuuggaggug

SEQ ID NO: 846637 - RNA, 23 nt, Human
gcugcuucaucgcuuggaggugg

SEQ ID NO: 846638 - RNA, 21 nt, Human
ggaaugaaaauaaaaucaaga

SEQ ID NO: 846639 - RNA, 25 nt, Human
ggacaggauguaccuucuuggaaaa

SEQ ID NO: 846640 - RNA, 22 nt, Human
ggagccuaccagggccccugug

SEQ ID NO: 846641 - RNA, 23 nt, Human
guccucuuccuuuuuccuguucu

SEQ ID NO: 846642 - RNA, 21 nt, Human
uaaaaacaaaacugaacagaa

SEQ ID NO: 846643 - RNA, 23 nt, Human
uaaaaacaaaacugaacagaaac

SEQ ID NO: 846644 - RNA, 19 nt, Human
uaaaggagccuaccagggc

SEQ ID NO: 846645 - RNA, 27 nt, Human
uaaauuaaacaagacaauucugggucc

SEQ ID NO: 846646 - RNA, 21 nt, Human
uaacugcaacaggggugaaag

SEQ ID NO: 846647 - RNA, 22 nt, Human
uaagaaaaccacgcuguggaaa

SEQ ID NO: 846648 - RNA, 21 nt, Human
uaagacaccacuuuacgcuau

SEQ ID NO: 846649 - RNA, 21 nt, Human
uaagugccaacaaggguagug

SEQ ID NO: 846650 - RNA, 18 nt, Human
uagcuagaacaagggaac

SEQ ID NO: 846651 - RNA, 18 nt, Human
uagcuggaagcgcagggc

SEQ ID NO: 846652 - RNA, 19 nt, Human
uauacaagagcaaauacaa

SEQ ID NO: 846653 - RNA, 22 nt, Human
uauuauauacacucaaacaagu

SEQ ID NO: 846654 - RNA, 20 nt, Human
ucaaaugcuauacaucuucu

SEQ ID NO: 846655 - RNA, 22 nt, Human
ucaagauuuuucagaguagaag

SEQ ID NO: 846656 - RNA, 18 nt, Human
ucacaaggaaaaacaaag

SEQ ID NO: 846657 - RNA, 26 nt, Human
uccacagacacaaagaaagaauucca

SEQ ID NO: 846658 - RNA, 25 nt, Human
uccaccguuuagcauaagacaccac

SEQ ID NO: 846659 - RNA, 22 nt, Human
uccucugcaguucacacgagaa

SEQ ID NO: 846660 - RNA, 21 nt, Human
uccuucucugguguuaacugc

SEQ ID NO: 846661 - RNA, 26 nt, Human
ucuucauuuuacaaacagcaucgcua

SEQ ID NO: 846662 - RNA, 21 nt, Human
ugagaggagaccgacagccug

SEQ ID NO: 846663 - RNA, 21 nt, Human
ugagauaaauaauccauuuca

SEQ ID NO: 846664 - RNA, 19 nt, Human
ugagauuaggaaagaaaug

SEQ ID NO: 846665 - RNA, 21 nt, Human
ugagauugagaaggcacccac

SEQ ID NO: 846666 - RNA, 21 nt, Human
ugauaugcauuaucauuagac

SEQ ID NO: 846667 - RNA, 20 nt, Human
ugcaugagaaugcggcugcu

SEQ ID NO: 846668 - RNA, 20 nt, Human
ugcaugguccaagcaugugg

SEQ ID NO: 846669 - RNA, 21 nt, Human
ugcaugguccaagcauguggu

SEQ ID NO: 846670 - RNA, 21 nt, Human
ugcccagcuggucaugggaac

SEQ ID NO: 846671 - RNA, 20 nt, Human
ugccccagauacacauggga

SEQ ID NO: 846672 - RNA, 23 nt, Human
uggaacuggaaugucacuaugua

SEQ ID NO: 846673 - RNA, 23 nt, Human
uggaauggaagaaaaaccaagua

SEQ ID NO: 846674 - RNA, 30 nt, Human
uggcagaauugcuucgagaauacagauuuc

SEQ ID NO: 846675 - RNA, 19 nt, Human
uggucaugggaaccuuccc

SEQ ID NO: 846676 - RNA, 21 nt, Human
uguagccugcuauuauuacac

SEQ ID NO: 846677 - RNA, 22 nt, Human
ugucaaaaaguggcucaaagca

SEQ ID NO: 846678 - RNA, 20 nt, Human
uguucccauucagauugaau

SEQ ID NO: 846679 - RNA, 23 nt, Human
uuaaaaacaauuauacaagagca

SEQ ID NO: 846680 - RNA, 23 nt, Human
uuccuguucucacuuguuuugcu

SEQ ID NO: 846681 - RNA, 19 nt, Human
uucuccuagcccugccuca

SEQ ID NO: 846682 - RNA, 19 nt, Human
uucuggguccucaaaauuu

SEQ ID NO: 846683 - RNA, 22 nt, Human
uugaauaugggccuaauuguca

SEQ ID NO: 846684 - RNA, 19 nt, Human
uugacagcagucuacacuu

SEQ ID NO: 846685 - RNA, 24 nt, Human
uugacagcagucuacacuuauuuc

SEQ ID NO: 846686 - RNA, 20 nt, Human
uugugagcccagcucaucug

SEQ ID NO: 846687 - RNA, 25 nt, Human
uuuuucagugaagaaugaauucuag

SEQ ID NO: 846688 - RNA, 18 nt, Human
aaaaauuguuuuaaaaag

SEQ ID NO: 846689 - RNA, 24 nt, Human
aaacaaaccaaauauauaucagca

SEQ ID NO: 846690 - RNA, 22 nt, Human
aaacagaaacuuuaaaucagau

SEQ ID NO: 846691 - RNA, 21 nt, Human
aaacauuuugaagaaaaaaau

SEQ ID NO: 846692 - RNA, 21 nt, Human
aagaauucccagccuacacac

SEQ ID NO: 846693 - RNA, 19 nt, Human
accaaauauauaucagcaa

SEQ ID NO: 846694 - RNA, 25 nt, Human
agauaaacagaaacuuuaaaucaga

SEQ ID NO: 846695 - RNA, 19 nt, Human
aguauuuuauuuuuucuac

SEQ ID NO: 846696 - RNA, 21 nt, Human
auaaauauauauguauaaaua

SEQ ID NO: 846697 - RNA, 19 nt, Human
augauuuagaaguaccacu

SEQ ID NO: 846698 - RNA, 21 nt, Human
augcuguaaauauuacuguuu

SEQ ID NO: 846699 - RNA, 22 nt, Human
auuuuauucacuggaauaugga

SEQ ID NO: 846700 - RNA, 19 nt, Human
caaaaaugguuuugaaaag

SEQ ID NO: 846701 - RNA, 22 nt, Human
caagcugcgagcgaggccagaa

SEQ ID NO: 846702 - RNA, 20 nt, Human
caaggaaguaucgaagcaug

SEQ ID NO: 846703 - RNA, 25 nt, Human
cagaaacuuuaaaucagauguuugg

SEQ ID NO: 846704 - RNA, 24 nt, Human
ccaaaaaucccagauaacugcaau

SEQ ID NO: 846705 - RNA, 27 nt, Human
ccacuuaaaaauauuuacugaugcugu

SEQ ID NO: 846706 - RNA, 20 nt, Human
ccccaccaaagucuucuccu

SEQ ID NO: 846707 - RNA, 20 nt, Human
ccccgagacuaccccaccaa

SEQ ID NO: 846708 - RNA, 19 nt, Human
cccgcacgcucgcccuacg

SEQ ID NO: 846709 - RNA, 20 nt, Human
cccgcacgcucgcccuacgg

SEQ ID NO: 846710 - RNA, 19 nt, Human
ccgagacuaccccaccaaa

SEQ ID NO: 846711 - RNA, 19 nt, Human
ccucuugcuccuuugguca

SEQ ID NO: 846712 - RNA, 19 nt, Human
cugugaugcuggagaaaac

SEQ ID NO: 846713 - RNA, 21 nt, Human
gacacaaucuuaaaaacacaa

SEQ ID NO: 846714 - RNA, 20 nt, Human
gaggcugcggcugggcccag

SEQ ID NO: 846715 - RNA, 21 nt, Human
gcugagcugccccgagacuac

SEQ ID NO: 846716 - RNA, 19 nt, Human
gggcacagcgggccgcuga

SEQ ID NO: 846717 - RNA, 20 nt, Human
gugcuuuuggcacaaguuuu

SEQ ID NO: 846718 - RNA, 22 nt, Human
uaaaaauauuuacugaugcugu

SEQ ID NO: 846719 - RNA, 24 nt, Human
uaaaauucugacccaaaaauccca

SEQ ID NO: 846720 - RNA, 22 nt, Human
uaaacagaaacuuuaaaucaga

SEQ ID NO: 846721 - RNA, 26 nt, Human
uaaacagaaacuuuaaaucagauguu

SEQ ID NO: 846722 - RNA, 22 nt, Human
uaaaggucucuuuccccaacuu

SEQ ID NO: 846723 - RNA, 19 nt, Human
uaucgaagcaugugugaga

SEQ ID NO: 846724 - RNA, 21 nt, Human
uauuaagaauucuuaacaagg

SEQ ID NO: 846725 - RNA, 25 nt, Human
ucccagauaacugcaauugcuuaau

SEQ ID NO: 846726 - RNA, 20 nt, Human
ucccagccuacacacaaauu

SEQ ID NO: 846727 - RNA, 23 nt, Human
uccuuuggucagaaagauaaaca

SEQ ID NO: 846728 - RNA, 23 nt, Human
ucuccaauuccuucagcaagaau

SEQ ID NO: 846729 - RNA, 21 nt, Human
ucugcaggaucugugaugcug

SEQ ID NO: 846730 - RNA, 20 nt, Human
ugacccaaaaaucccagaua

SEQ ID NO: 846731 - RNA, 20 nt, Human
ugcagcaacagguuuucucc

SEQ ID NO: 846732 - RNA, 21 nt, Human
ugcggcugggcccagaccccg

SEQ ID NO: 846733 - RNA, 19 nt, Human
uggagaaaacauuuugaag

SEQ ID NO: 846734 - RNA, 19 nt, Human
ugugaugcuggagaaaaca

SEQ ID NO: 846735 - RNA, 22 nt, Human
uuccuucagcaagaauucccag

SEQ ID NO: 846736 - RNA, 20 nt, Human
uucuauucauguauaacuug

SEQ ID NO: 846737 - RNA, 24 nt, Human
uuuaaaggucucuuuccccaacuu

SEQ ID NO: 846738 - RNA, 24 nt, Human
uuucauaaauauauauguauaaau

SEQ ID NO: 846739 - RNA, 23 nt, Human
uuuuaugauuuagaaguaccacu

SEQ ID NO: 846740 - RNA, 21 nt, Human
uuuuuuuuuuuucacaacugg

SEQ ID NO: 846741 - RNA, 24 nt, Human
uuuuuuuuuuuuuuuuucacaacu

SEQ ID NO: 846742 - RNA, 19 nt, Human
aaaagaagaagggaaaugg

SEQ ID NO: 846743 - RNA, 23 nt, Human
aagaagggaaucaguggggagga

SEQ ID NO: 846744 - RNA, 21 nt, Human
aagcccuuuuccuuucucucu

SEQ ID NO: 846745 - RNA, 25 nt, Human
acuagcucuaguuucugcaaguucu

SEQ ID NO: 846746 - RNA, 24 nt, Human
agaaagacaaacacaauuuccugg

SEQ ID NO: 846747 - RNA, 18 nt, Human
agaagaagggaaauggca

SEQ ID NO: 846748 - RNA, 19 nt, Human
agaagaagggaaauggcag

SEQ ID NO: 846749 - RNA, 21 nt, Human
agaagaagggaaauggcagaa

SEQ ID NO: 846750 - RNA, 18 nt, Human
agaagggaaucagugggg

SEQ ID NO: 846751 - RNA, 20 nt, Human
aggaaggagugggcucuagc

SEQ ID NO: 846752 - RNA, 19 nt, Human
aucacgugggccugaucug

SEQ ID NO: 846753 - RNA, 21 nt, Human
caaacacaauuuccugccuua

SEQ ID NO: 846754 - RNA, 19 nt, Human
caauccuguuaacccaggg

SEQ ID NO: 846755 - RNA, 23 nt, Human
ccacuuggaaaggacaggcaaga

SEQ ID NO: 846756 - RNA, 18 nt, Human
cccgagggaacagacagc

SEQ ID NO: 846757 - RNA, 19 nt, Human
cccuuuuccuuucucucuc

SEQ ID NO: 846758 - RNA, 21 nt, Human
cccuuuuccuuucucucuccc

SEQ ID NO: 846759 - RNA, 18 nt, Human
ccgcauuccuacaccuua

SEQ ID NO: 846760 - RNA, 23 nt, Human
ccuuuuccuuucucucucccucc

SEQ ID NO: 846761 - RNA, 20 nt, Human
ccuuuuuuuuuguaaaggac

SEQ ID NO: 846762 - RNA, 18 nt, Human
cgcagccaggugccugag

SEQ ID NO: 846763 - RNA, 21 nt, Human
cguuuuauuacuucgcagcca

SEQ ID NO: 846764 - RNA, 18 nt, Human
cucucccuccgccuuuuu

SEQ ID NO: 846765 - RNA, 18 nt, Human
cucucccuccgccuuuuu

SEQ ID NO: 846766 - RNA, 18 nt, Human
cuuuagaugauaaggcaa

SEQ ID NO: 846767 - RNA, 20 nt, Human
cuuucucucucccuccgccu

SEQ ID NO: 846768 - RNA, 18 nt, Human
cuuuuugcuguuuugcuc

SEQ ID NO: 846769 - RNA, 22 nt, Human
gaaaggacaggcaagauucaaa

SEQ ID NO: 846770 - RNA, 25 nt, Human
gaacagacagcccauaucagacuca

SEQ ID NO: 846771 - RNA, 21 nt, Human
gaccaucaaaacgcuucccuc

SEQ ID NO: 846772 - RNA, 20 nt, Human
gacucacuccaccuuuagau

SEQ ID NO: 846773 - RNA, 21 nt, Human
gaugauaaggcaaccguuuua

SEQ ID NO: 846774 - RNA, 21 nt, Human
gcugaaccucggagcagggac

SEQ ID NO: 846775 - RNA, 18 nt, Human
gcuguuuugcucguuucu

SEQ ID NO: 846776 - RNA, 23 nt, Human
ggaaauggcagaaauggaaagaa

SEQ ID NO: 846777 - RNA, 21 nt, Human
ggugccugagggugacaagac

SEQ ID NO: 846778 - RNA, 18 nt, Human
gugggccugaucugucgg

SEQ ID NO: 846779 - RNA, 22 nt, Human
guggggaggaaggagugggcuc

SEQ ID NO: 846780 - RNA, 24 nt, Human
guuggcaucaaauuuggaauucac

SEQ ID NO: 846781 - RNA, 22 nt, Human
uaacagcaaugaaugagucacu

SEQ ID NO: 846782 - RNA, 19 nt, Human
uacacauaaaguuggcauc

SEQ ID NO: 846783 - RNA, 21 nt, Human
uacaccuuagcucuguccucu

SEQ ID NO: 846784 - RNA, 21 nt, Human
uacccugggcugagguuugac

SEQ ID NO: 846785 - RNA, 23 nt, Human
uagcacuuaggcacaagacucca

SEQ ID NO: 846786 - RNA, 18 nt, Human
ucacugcagcugccaugg

SEQ ID NO: 846787 - RNA, 18 nt, Human
uccaaggagaaagacaaa

SEQ ID NO: 846788 - RNA, 19 nt, Human
uccaaggagaaagacaaac

SEQ ID NO: 846789 - RNA, 19 nt, Human
uccagaaaauguccaaguu

SEQ ID NO: 846790 - RNA, 26 nt, Human
ucccuggaaaacuuuuugcuguuuug

SEQ ID NO: 846791 - RNA, 23 nt, Human
uccuuucucucucccuccgccuu

SEQ ID NO: 846792 - RNA, 21 nt, Human
ucuguccucuuguguucuccc

SEQ ID NO: 846793 - RNA, 18 nt, Human
ugagguuugacucacucc

SEQ ID NO: 846794 - RNA, 19 nt, Human
ugagucacuuggugugauu

SEQ ID NO: 846795 - RNA, 20 nt, Human
ugauuguaacuuccuucccu

SEQ ID NO: 846796 - RNA, 24 nt, Human
ugccauggggcuuuuauaagcugg

SEQ ID NO: 846797 - RNA, 22 nt, Human
uggaaaggacaggcaagauuca

SEQ ID NO: 846798 - RNA, 23 nt, Human
uggauuuucaucagcuugagccu

SEQ ID NO: 846799 - RNA, 22 nt, Human
uggcagaaauggaaagaaggga

SEQ ID NO: 846800 - RNA, 23 nt, Human
uggcagaaauggaaagaagggaa

SEQ ID NO: 846801 - RNA, 23 nt, Human
uggcaucaaauuuggaauucaca

SEQ ID NO: 846802 - RNA, 22 nt, Human
uucacaaucacuaguucacgaa

SEQ ID NO: 846803 - RNA, 22 nt, Human
uugacucacuccaccuuuagau

SEQ ID NO: 846804 - RNA, 21 nt, Human
uuggcaggaguuagcuucuuu

SEQ ID NO: 846805 - RNA, 21 nt, Human
uuugcuaaaacuuuucaucca

SEQ ID NO: 846806 - RNA, 21 nt, Human
uuuuuuuuuuuuuuuuccaga

SEQ ID NO: 846807 - RNA, 23 nt, Human
uuuuuuuuuuuuuuuuuuuccag

SEQ ID NO: 846808 - RNA, 18 nt, Human
acccugggaauguccaag

SEQ ID NO: 846809 - RNA, 22 nt, Human
agagacugucaacuccuccucc

SEQ ID NO: 846810 - RNA, 21 nt, Human
aguggagaauuggguccugga

SEQ ID NO: 846811 - RNA, 25 nt, Human
caagcccagaagagccaggggccag

SEQ ID NO: 846812 - RNA, 25 nt, Human
cacccugggaauguccaagcccaga

SEQ ID NO: 846813 - RNA, 18 nt, Human
cagagaggagcccugcuu

SEQ ID NO: 846814 - RNA, 19 nt, Human
caggggccagucccugagc

SEQ ID NO: 846815 - RNA, 18 nt, Human
caguccaacugcgaggag

SEQ ID NO: 846816 - RNA, 22 nt, Human
ccaagcccagaagagccagggg

SEQ ID NO: 846817 - RNA, 18 nt, Human
ccagucccugagcaagug

SEQ ID NO: 846818 - RNA, 22 nt, Human
cccaccaguccaacugcgagga

SEQ ID NO: 846819 - RNA, 20 nt, Human
ccucaugcaggggugaagau

SEQ ID NO: 846820 - RNA, 18 nt, Human
ccugaguuccuuggaugg

SEQ ID NO: 846821 - RNA, 21 nt, Human
gaacccaggacuguucggcgg

SEQ ID NO: 846822 - RNA, 19 nt, Human
gaagagccaggggccaguc

SEQ ID NO: 846823 - RNA, 21 nt, Human
gcucagaacccaggacuguuc

SEQ ID NO: 846824 - RNA, 19 nt, Human
uagaaaucaggucuccagu

SEQ ID NO: 846825 - RNA, 26 nt, Human
uccaguguucccaguucccaccaguc

SEQ ID NO: 846826 - RNA, 22 nt, Human
ucccugagcaaguggagaauug

SEQ ID NO: 846827 - RNA, 20 nt, Human
uccugaguuccuuggaugga

SEQ ID NO: 846828 - RNA, 26 nt, Human
ugcaggggugaagaugugcagagcac

SEQ ID NO: 846829 - RNA, 22 nt, Human
ugguuaggaacgaagagacugu

SEQ ID NO: 846830 - RNA, 19 nt, Human
uguucccaguucccaccag

SEQ ID NO: 846831 - RNA, 19 nt, Human
uuagaaaucaggucuccag

SEQ ID NO: 846832 - RNA, 23 nt, Human
uuggauggcaggcucagaaccca

SEQ ID NO: 846833 - RNA, 19 nt, Human
uuuuuuuuuucaccaaccc

SEQ ID NO: 846834 - RNA, 23 nt, Human
uuuuuuuuuuuuuuuuucaccaa

SEQ ID NO: 846835 - RNA, 20 nt, Human
aaccaggcuguggcaccuga

SEQ ID NO: 846836 - RNA, 24 nt, Human
aagcagcaguccccuuggcgggcc

SEQ ID NO: 846837 - RNA, 25 nt, Human
acagagcauaguuagucaacgggca

SEQ ID NO: 846838 - RNA, 23 nt, Human
acaggcgagaaaccgaggacgcg

SEQ ID NO: 846839 - RNA, 23 nt, Human
accugcagggcugggccuccccu

SEQ ID NO: 846840 - RNA, 24 nt, Human
acgcgccgggucccuggcaggccc

SEQ ID NO: 846841 - RNA, 18 nt, Human
agaaggugcucuaccucc

SEQ ID NO: 846842 - RNA, 21 nt, Human
agaaggugcucuaccuccagu

SEQ ID NO: 846843 - RNA, 18 nt, Human
agagagagggaggggcag

SEQ ID NO: 846844 - RNA, 18 nt, Human
agcucugugggcccaggc

SEQ ID NO: 846845 - RNA, 21 nt, Human
aggcacccgggagccacagaa

SEQ ID NO: 846846 - RNA, 20 nt, Human
aggcccaggccagccaggaa

SEQ ID NO: 846847 - RNA, 25 nt, Human
aggcccuggguccagggucugucag

SEQ ID NO: 846848 - RNA, 22 nt, Human
aggcggagauggagcccugggg

SEQ ID NO: 846849 - RNA, 23 nt, Human
aggcggagauggagcccugggga

SEQ ID NO: 846850 - RNA, 18 nt, Human
aggggagugggggugcca

SEQ ID NO: 846851 - RNA, 22 nt, Human
aggguaaagagagagggagaga

SEQ ID NO: 846852 - RNA, 18 nt, Human
aguagccccuccuccagg

SEQ ID NO: 846853 - RNA, 20 nt, Human
caacgggcagggccggaggg

SEQ ID NO: 846854 - RNA, 23 nt, Human
caacuugauaugccccccacauc

SEQ ID NO: 846855 - RNA, 22 nt, Human
caaggcccaggccagccaggaa

SEQ ID NO: 846856 - RNA, 18 nt, Human
cacagcaaggcccaggcc

SEQ ID NO: 846857 - RNA, 22 nt, Human
cacagcgccgcccgcagucccc

SEQ ID NO: 846858 - RNA, 21 nt, Human
cacaugacucccagggccuga

SEQ ID NO: 846859 - RNA, 19 nt, Human
caccccgcaggaagcccaa

SEQ ID NO: 846860 - RNA, 24 nt, Human
cacccgggagccacagaaggugcu

SEQ ID NO: 846861 - RNA, 21 nt, Human
cagcgugaacagggcuccccu

SEQ ID NO: 846862 - RNA, 21 nt, Human
caggaaggccagcagguagcg

SEQ ID NO: 846863 - RNA, 21 nt, Human
caggccagccaggaagcucau

SEQ ID NO: 846864 - RNA, 18 nt, Human
caguccccagcggucugc

SEQ ID NO: 846865 - RNA, 24 nt, Human
cauccacaugacucccagggccug

SEQ ID NO: 846866 - RNA, 23 nt, Human
cauuuagaaaaagaagcagcagu

SEQ ID NO: 846867 - RNA, 22 nt, Human
ccacagcccagcagccugggac

SEQ ID NO: 846868 - RNA, 20 nt, Human
ccagccaggaagcucauggg

SEQ ID NO: 846869 - RNA, 23 nt, Human
ccagccaggaagcucaugggucc

SEQ ID NO: 846870 - RNA, 23 nt, Human
ccaggccagccaggaagcucaug

SEQ ID NO: 846871 - RNA, 20 nt, Human
cccagucccucuggucucug

SEQ ID NO: 846872 - RNA, 20 nt, Human
ccccccuaggucaucugcca

SEQ ID NO: 846873 - RNA, 19 nt, Human
ccccgcaggaagcccaagg

SEQ ID NO: 846874 - RNA, 22 nt, Human
ccccgccgcgcguccgccccuc

SEQ ID NO: 846875 - RNA, 19 nt, Human
ccccucgagcucuccccgc

SEQ ID NO: 846876 - RNA, 23 nt, Human
ccccucggucagccgcccggucc

SEQ ID NO: 846877 - RNA, 19 nt, Human
ccccugaggcggagaugga

SEQ ID NO: 846878 - RNA, 22 nt, Human
ccccugaggcggagauggaaag

SEQ ID NO: 846879 - RNA, 24 nt, Human
ccccugggccucagaggggugggg

SEQ ID NO: 846880 - RNA, 22 nt, Human
ccccuguggcauacucguggcu

SEQ ID NO: 846881 - RNA, 24 nt, Human
ccccuguuacucagcucgccgcuc

SEQ ID NO: 846882 - RNA, 23 nt, Human
cccgcaguccccagcggucugcc

SEQ ID NO: 846883 - RNA, 18 nt, Human
cccucgagcucuccccgc

SEQ ID NO: 846884 - RNA, 24 nt, Human
cccucggucagccgcccgguccac

SEQ ID NO: 846885 - RNA, 28 nt, Human
cccuggguccagggucugucagagcccc

SEQ ID NO: 846886 - RNA, 24 nt, Human
ccgcaggaagcccaagguugcugc

SEQ ID NO: 846887 - RNA, 22 nt, Human
ccgccaggccgaaccaggcugu

SEQ ID NO: 846888 - RNA, 22 nt, Human
ccgcccgguccaccagcuccag

SEQ ID NO: 846889 - RNA, 18 nt, Human
ccgccgcgcguccgcccc

SEQ ID NO: 846890 - RNA, 22 nt, Human
ccgugcucgcccgccccuuuuu

SEQ ID NO: 846891 - RNA, 19 nt, Human
ccuaggucaucugccagga

SEQ ID NO: 846892 - RNA, 23 nt, Human
ccucuggucucuguccuguuguc

SEQ ID NO: 846893 - RNA, 18 nt, Human
ccugaggacaggagccuc

SEQ ID NO: 846894 - RNA, 22 nt, Human
ccugaggcuagcccuccucagg

SEQ ID NO: 846895 - RNA, 19 nt, Human
ccugccugguuuugaaagc

SEQ ID NO: 846896 - RNA, 18 nt, Human
ccuguuacucagcucgcc

SEQ ID NO: 846897 - RNA, 23 nt, Human
cgcccgcaguccccagcggucug

SEQ ID NO: 846898 - RNA, 21 nt, Human
cgccgggucccuggcaggccc

SEQ ID NO: 846899 - RNA, 18 nt, Human
cgcgggccgugcucgccc

SEQ ID NO: 846900 - RNA, 25 nt, Human
cgcgggccgugcucgcccgccccuu

SEQ ID NO: 846901 - RNA, 20 nt, Human
cguggcuggggagggagagc

SEQ ID NO: 846902 - RNA, 24 nt, Human
cucuguccuguugucuaagggcca

SEQ ID NO: 846903 - RNA, 24 nt, Human
cugaguucucuggaaacaaaacca

SEQ ID NO: 846904 - RNA, 18 nt, Human
cuguugucuaagggccaa

SEQ ID NO: 846905 - RNA, 19 nt, Human
cuuggcccugccugguuuu

SEQ ID NO: 846906 - RNA, 20 nt, Human
gaagguguguuuuuuacaca

SEQ ID NO: 846907 - RNA, 22 nt, Human
gagagagagggagagagaggga

SEQ ID NO: 846908 - RNA, 19 nt, Human
gaggguaaagagagaggga

SEQ ID NO: 846909 - RNA, 22 nt, Human
gaguggcaggugaggcccuggg

SEQ ID NO: 846910 - RNA, 19 nt, Human
gaugaugacaggcgagaaa

SEQ ID NO: 846911 - RNA, 19 nt, Human
gcagggcugggccuccccu

SEQ ID NO: 846912 - RNA, 22 nt, Human
gcaggugaggcccuggguccag

SEQ ID NO: 846913 - RNA, 22 nt, Human
gccaagggacaguagccccucc

SEQ ID NO: 846914 - RNA, 18 nt, Human
gcccccaaacgagcaccu

SEQ ID NO: 846915 - RNA, 21 nt, Human
gccccgccgcgcguccgcccc

SEQ ID NO: 846916 - RNA, 18 nt, Human
gcccuggguccagggucc

SEQ ID NO: 846917 - RNA, 21 nt, Human
gcggagauggagcccugggga

SEQ ID NO: 846918 - RNA, 23 nt, Human
ggaauggagccagacuuggggug

SEQ ID NO: 846919 - RNA, 21 nt, Human
ggagaaaccagcgugaacagg

SEQ ID NO: 846920 - RNA, 20 nt, Human
ggagauggagcccuggggag

SEQ ID NO: 846921 - RNA, 19 nt, Human
ggagugggggugccaggcu

SEQ ID NO: 846922 - RNA, 23 nt, Human
ggccagccaggaagcucaugggu

SEQ ID NO: 846923 - RNA, 23 nt, Human
ggccugggggcugugcaggggag

SEQ ID NO: 846924 - RNA, 18 nt, Human
gggagugggggugccagg

SEQ ID NO: 846925 - RNA, 18 nt, Human
gggccgccaggccgaacc

SEQ ID NO: 846926 - RNA, 21 nt, Human
gggcugggccuccccucgagc

SEQ ID NO: 846927 - RNA, 19 nt, Human
ggguccgucaugggguugg

SEQ ID NO: 846928 - RNA, 19 nt, Human
gguaaagagagagggagag

SEQ ID NO: 846929 - RNA, 26 nt, Human
gguaaagagagagggagagagaggga

SEQ ID NO: 846930 - RNA, 18 nt, Human
guccccuuggcgggccgg

SEQ ID NO: 846931 - RNA, 23 nt, Human
gugccaggcugaggugcugccug

SEQ ID NO: 846932 - RNA, 22 nt, Human
guggggaggccuccaggggguc

SEQ ID NO: 846933 - RNA, 20 nt, Human
uaccuccaguggggccaagg

SEQ ID NO: 846934 - RNA, 19 nt, Human
ucagcaccuuguaagguga

SEQ ID NO: 846935 - RNA, 19 nt, Human
ucccacagcaaggcccagg

SEQ ID NO: 846936 - RNA, 24 nt, Human
ucccagggccugaguccacacugc

SEQ ID NO: 846937 - RNA, 24 nt, Human
uccccagcggucugccccgccgcg

SEQ ID NO: 846938 - RNA, 18 nt, Human
ucccucuggucucugucc

SEQ ID NO: 846939 - RNA, 26 nt, Human
ucgaugaugacaggcgagaaaccgag

SEQ ID NO: 846940 - RNA, 21 nt, Human
ugaaaggguccgucauggggu

SEQ ID NO: 846941 - RNA, 23 nt, Human
ugaagagcccccaaacgagcacc

SEQ ID NO: 846942 - RNA, 21 nt, Human
ugacucccagggccugagucc

SEQ ID NO: 846943 - RNA, 20 nt, Human
ugauaugccccccacauccc

SEQ ID NO: 846944 - RNA, 23 nt, Human
ugcaggggagugggggugccagg

SEQ ID NO: 846945 - RNA, 19 nt, Human
uggagaagccccugaggcg

SEQ ID NO: 846946 - RNA, 19 nt, Human
uggcaggcccuuggggucu

SEQ ID NO: 846947 - RNA, 22 nt, Human
uggcaggcccuuggggucuggc

SEQ ID NO: 846948 - RNA, 19 nt, Human
uggcauccacaugacuccc

SEQ ID NO: 846949 - RNA, 21 nt, Human
uggcuggggagggagagccag

SEQ ID NO: 846950 - RNA, 20 nt, Human
uggggagggagagccagucc

SEQ ID NO: 846951 - RNA, 20 nt, Human
uggggaggguaaagagagag

SEQ ID NO: 846952 - RNA, 20 nt, Human
ugggggcugugcaggggagu

SEQ ID NO: 846953 - RNA, 19 nt, Human
ugggguggagaagccccug

SEQ ID NO: 846954 - RNA, 23 nt, Human
ugggguggagaagccccugaggc

SEQ ID NO: 846955 - RNA, 20 nt, Human
uggguccagggucugucaga

SEQ ID NO: 846956 - RNA, 18 nt, Human
uugguugaguggcaggug

SEQ ID NO: 846957 - RNA, 20 nt, Human
aggccccauggcgcagggca

SEQ ID NO: 846958 - RNA, 21 nt, Human
cccaaggucacaccgucagcc

SEQ ID NO: 846959 - RNA, 19 nt, Human
ccccagcuucaaggcccca

SEQ ID NO: 846960 - RNA, 22 nt, Human
gcagggcauaggacagagccuu

SEQ ID NO: 846961 - RNA, 21 nt, Human
gggcauaggacagagccuugg

SEQ ID NO: 846962 - RNA, 23 nt, Human
gggugguccgggaggcagggccg

SEQ ID NO: 846963 - RNA, 18 nt, Human
ggugguccgggaggcagg

SEQ ID NO: 846964 - RNA, 22 nt, Human
ucaaggccccauggcgcagggc

SEQ ID NO: 846965 - RNA, 21 nt, Human
ucacaccgucagccaggagcg

SEQ ID NO: 846966 - RNA, 20 nt, Human
ugcgccccgcaggguggucc

SEQ ID NO: 846967 - RNA, 29 nt, Human
uuuuacaggaugaugaaacaugguuucaa

SEQ ID NO: 846968 - RNA, 22 nt, Human
uuuuuuuuuuuuuuuuacagga

SEQ ID NO: 846969 - RNA, 24 nt, Human
uuuuuuuuuuuuuuuuuuuacagg

SEQ ID NO: 846970 - RNA, 21 nt, Human
aaaauuccccacccacucccc

SEQ ID NO: 846971 - RNA, 23 nt, Human
aaacaggaacuaacaggccaaac

SEQ ID NO: 846972 - RNA, 19 nt, Human
aaagagguucucggccuuu

SEQ ID NO: 846973 - RNA, 24 nt, Human
aaauacaaaccuaaaaaacagcca

SEQ ID NO: 846974 - RNA, 19 nt, Human
aacauaaaggcaugagaaa

SEQ ID NO: 846975 - RNA, 19 nt, Human
aacuaacaggccaaacuac

SEQ ID NO: 846976 - RNA, 19 nt, Human
agagugccaggguccucug

SEQ ID NO: 846977 - RNA, 21 nt, Human
agcugccugggagggugagac

SEQ ID NO: 846978 - RNA, 25 nt, Human
aggaaguuuacugccgguguuagga

SEQ ID NO: 846979 - RNA, 19 nt, Human
aggacccugggaucuccca

SEQ ID NO: 846980 - RNA, 18 nt, Human
aggcaugagaaacaguca

SEQ ID NO: 846981 - RNA, 23 nt, Human
aguaaagggagcagcaauugaaa

SEQ ID NO: 846982 - RNA, 20 nt, Human
aguaggaaagggagaggaga

SEQ ID NO: 846983 - RNA, 24 nt, Human
agucauggccaaaacaggaacuaa

SEQ ID NO: 846984 - RNA, 18 nt, Human
aguggcggcacauaaaua

SEQ ID NO: 846985 - RNA, 26 nt, Human
caaaacaggaacuaacaggccaaacc

SEQ ID NO: 846986 - RNA, 21 nt, Human
cagcuucagcuauggccaaag

SEQ ID NO: 846987 - RNA, 18 nt, Human
caggguccucuguccccu

SEQ ID NO: 846988 - RNA, 22 nt, Human
cauucccugccaugcccaccuc

SEQ ID NO: 846989 - RNA, 20 nt, Human
ccaaagaggccagcguggca

SEQ ID NO: 846990 - RNA, 21 nt, Human
ccaaggauggggcuuucugua

SEQ ID NO: 846991 - RNA, 21 nt, Human
ccagcguggcaagguccuguc

SEQ ID NO: 846992 - RNA, 19 nt, Human
ccagggaguagucacaggu

SEQ ID NO: 846993 - RNA, 18 nt, Human
ccaggguccucugucccc

SEQ ID NO: 846994 - RNA, 22 nt, Human
ccaggguccucuguccccuccg

SEQ ID NO: 846995 - RNA, 18 nt, Human
ccuaagccaaggaugggg

SEQ ID NO: 846996 - RNA, 20 nt, Human
ccuccgcaccugagggcaaa

SEQ ID NO: 846997 - RNA, 20 nt, Human
cggcacauaaauacaaaccc

SEQ ID NO: 846998 - RNA, 21 nt, Human
cggcacauaaauacaaaccua

SEQ ID NO: 846999 - RNA, 24 nt, Human
cucccaggccuuacaaaaguggcg

SEQ ID NO: 847000 - RNA, 20 nt, Human
cucccuaagccaaggauggg

SEQ ID NO: 847001 - RNA, 27 nt, Human
cugagggcaaaguuccaggaaguuuac

SEQ ID NO: 847002 - RNA, 19 nt, Human
cuggaggugagaccuuucc

SEQ ID NO: 847003 - RNA, 19 nt, Human
cuguaaucccgacugcucc

SEQ ID NO: 847004 - RNA, 29 nt, Human
gaaaaugugcccuccucaggauugguccc

SEQ ID NO: 847005 - RNA, 23 nt, Human
gaaggaacauaaaggcaugagaa

SEQ ID NO: 847006 - RNA, 19 nt, Human
gagaaaguaaagggagcag

SEQ ID NO: 847007 - RNA, 26 nt, Human
gcagcaauugaaacucgcccuugacc

SEQ ID NO: 847008 - RNA, 24 nt, Human
gccagcguggcaagguccugucuc

SEQ ID NO: 847009 - RNA, 21 nt, Human
gcccugccauugcuucaagga

SEQ ID NO: 847010 - RNA, 18 nt, Human
gccugggagggugagacu

SEQ ID NO: 847011 - RNA, 19 nt, Human
gcuccaggcuggaggugag

SEQ ID NO: 847012 - RNA, 19 nt, Human
gucagggggaggguggagg

SEQ ID NO: 847013 - RNA, 19 nt, Human
uaaaaaacagccauuuccu

SEQ ID NO: 847014 - RNA, 23 nt, Human
uaaaaaacagccauuuccugcca

SEQ ID NO: 847015 - RNA, 23 nt, Human
uaaaugcaagacaugagcauaaa

SEQ ID NO: 847016 - RNA, 20 nt, Human
uagagugccuuuguaugugg

SEQ ID NO: 847017 - RNA, 24 nt, Human
uagcuucccuuugaggguguguga

SEQ ID NO: 847018 - RNA, 26 nt, Human
uagucacagguagagaaaguaaaggg

SEQ ID NO: 847019 - RNA, 19 nt, Human
ucaacuggccccacagcuu

SEQ ID NO: 847020 - RNA, 25 nt, Human
ucaacuggccccacagcuucagcua

SEQ ID NO: 847021 - RNA, 21 nt, Human
ucagugucucugccucuggcu

SEQ ID NO: 847022 - RNA, 22 nt, Human
ucagugucucugccucuggcuc

SEQ ID NO: 847023 - RNA, 18 nt, Human
uccacagaaaccagcccc

SEQ ID NO: 847024 - RNA, 18 nt, Human
uccaggcuggaggugaga

SEQ ID NO: 847025 - RNA, 21 nt, Human
ucccuaagccaaggauggggc

SEQ ID NO: 847026 - RNA, 24 nt, Human
ucccugcuggcccugccauugcuu

SEQ ID NO: 847027 - RNA, 21 nt, Human
ucucccaggccuuacaaaagu

SEQ ID NO: 847028 - RNA, 18 nt, Human
ucuggcucacucucucca

SEQ ID NO: 847029 - RNA, 24 nt, Human
ugagaaacagucaucucaauaaau

SEQ ID NO: 847030 - RNA, 19 nt, Human
ugagaccuuuccuagagaa

SEQ ID NO: 847031 - RNA, 19 nt, Human
ugagcucaaguucaguguc

SEQ ID NO: 847032 - RNA, 24 nt, Human
ugauggcagggagccaagaggugc

SEQ ID NO: 847033 - RNA, 23 nt, Human
ugcaaaagucauggccaaaacag

SEQ ID NO: 847034 - RNA, 19 nt, Human
ugccaugcccaccucccug

SEQ ID NO: 847035 - RNA, 20 nt, Human
ugccgguguuaggaggugag

SEQ ID NO: 847036 - RNA, 27 nt, Human
ugccucuggcuccacagaaaccagccc

SEQ ID NO: 847037 - RNA, 21 nt, Human
uggcaagguccugucucagau

SEQ ID NO: 847038 - RNA, 18 nt, Human
uggccaaaacaggaacua

SEQ ID NO: 847039 - RNA, 20 nt, Human
uggcccguguagcuucccuu

SEQ ID NO: 847040 - RNA, 21 nt, Human
uggcccguguagcuucccuuu

SEQ ID NO: 847041 - RNA, 22 nt, Human
uggcuucuggaaaaugugcccu

SEQ ID NO: 847042 - RNA, 19 nt, Human
uggggcuuucuguaauccc

SEQ ID NO: 847043 - RNA, 23 nt, Human
uguguccaguaaggaggugaagu

SEQ ID NO: 847044 - RNA, 21 nt, Human
uguuaaacaaaauucaaggcu

SEQ ID NO: 847045 - RNA, 24 nt, Human
uucccugccaugcccaccucccug

SEQ ID NO: 847046 - RNA, 20 nt, Human
uugagggugugugacuugcc

SEQ ID NO: 847047 - RNA, 20 nt, Human
uuuguauguggucaggggga

SEQ ID NO: 847048 - RNA, 22 nt, Human
uuuuuuuuuuugagcacaaagg

SEQ ID NO: 847049 - RNA, 18 nt, Human
uuuuuuuuuuuuuuuuug

SEQ ID NO: 847050 - RNA, 23 nt, Human
aaacaggccacagccaggccccu

SEQ ID NO: 847051 - RNA, 21 nt, Human
acaggccacagccaggccccu

SEQ ID NO: 847052 - RNA, 26 nt, Human
acgucgcccaccuaagcgugaacagc

SEQ ID NO: 847053 - RNA, 18 nt, Human
acuccacaagcucccacc

SEQ ID NO: 847054 - RNA, 20 nt, Human
aggccccucgauggacgcag

SEQ ID NO: 847055 - RNA, 23 nt, Human
aggcucuggugcuggugaucccg

SEQ ID NO: 847056 - RNA, 19 nt, Human
aggugcagguuugcagcug

SEQ ID NO: 847057 - RNA, 21 nt, Human
caccggaggagcugaaagccc

SEQ ID NO: 847058 - RNA, 22 nt, Human
cauccacgcucugcgcugaagg

SEQ ID NO: 847059 - RNA, 24 nt, Human
ccaccuaagcgugaacagcugcgu

SEQ ID NO: 847060 - RNA, 23 nt, Human
ccagagcauccacgcucugcgcu

SEQ ID NO: 847061 - RNA, 25 nt, Human
cccaccaccggaggagcugaaagcc

SEQ ID NO: 847062 - RNA, 20 nt, Human
cccuccaaagcagauuccug

SEQ ID NO: 847063 - RNA, 22 nt, Human
cccugcacugggcagcggcccc

SEQ ID NO: 847064 - RNA, 18 nt, Human
cccuguguggucugaggc

SEQ ID NO: 847065 - RNA, 18 nt, Human
ccgccccgcgcugaaccc

SEQ ID NO: 847066 - RNA, 20 nt, Human
ccgccggaggagcugcaccc

SEQ ID NO: 847067 - RNA, 23 nt, Human
ccgcugcccugcuggugaacccg

SEQ ID NO: 847068 - RNA, 21 nt, Human
ccggcccccaccaccggagga

SEQ ID NO: 847069 - RNA, 21 nt, Human
ccggcccccaccgccggagga

SEQ ID NO: 847070 - RNA, 20 nt, Human
cgacuccacaagcucccacc

SEQ ID NO: 847071 - RNA, 22 nt, Human
cgcccaccugcgcccacgucgc

SEQ ID NO: 847072 - RNA, 22 nt, Human
cgggaggagccagcaugcccca

SEQ ID NO: 847073 - RNA, 18 nt, Human
cuccaaggccaggggucc

SEQ ID NO: 847074 - RNA, 22 nt, Human
cugcgcccacgucgcccaccua

SEQ ID NO: 847075 - RNA, 24 nt, Human
cuggugcuggugaucccggccccc

SEQ ID NO: 847076 - RNA, 20 nt, Human
gaaaaauagacauuucccuc

SEQ ID NO: 847077 - RNA, 23 nt, Human
gaaaacaggccacagccaggccc

SEQ ID NO: 847078 - RNA, 20 nt, Human
gcagcggccccgccccgcgc

SEQ ID NO: 847079 - RNA, 18 nt, Human
gcccacgucgcccaccua

SEQ ID NO: 847080 - RNA, 22 nt, Human
gcucccaccaggggcuccccau

SEQ ID NO: 847081 - RNA, 24 nt, Human
ggagggucuggaggagggaagggg

SEQ ID NO: 847082 - RNA, 21 nt, Human
ggcagcggccccgccccgcgc

SEQ ID NO: 847083 - RNA, 18 nt, Human
uccaaagcagauuccugg

SEQ ID NO: 847084 - RNA, 24 nt, Human
ucccuccaaagcagauuccugggg

SEQ ID NO: 847085 - RNA, 22 nt, Human
uccgacuccacaagcucccacc

SEQ ID NO: 847086 - RNA, 19 nt, Human
ugaaggcacugaaccugcc

SEQ ID NO: 847087 - RNA, 18 nt, Human
ugauccgacuccacaagc

SEQ ID NO: 847088 - RNA, 18 nt, Human
uggaggagggaaggggcc

SEQ ID NO: 847089 - RNA, 20 nt, Human
uggaggagggaaggggcccu

SEQ ID NO: 847090 - RNA, 19 nt, Human
uggcgggaggagccagcau

SEQ ID NO: 847091 - RNA, 20 nt, Human
uggggcuggagggucccucc

SEQ ID NO: 847092 - RNA, 24 nt, Human
uuccuggggcuggagggucccucc

SEQ ID NO: 847093 - RNA, 24 nt, Human
uucugcacagguacgugauccgac

SEQ ID NO: 847094 - RNA, 25 nt, Human
uuuuuuuuuuuugcugcugggucgg

SEQ ID NO: 847095 - RNA, 25 nt, Human
uuuuuuuuuuuuuuuugcugcuggg

SEQ ID NO: 847096 - RNA, 18 nt, Human
uuuuuuuuuuuuuuuuug

SEQ ID NO: 847097 - RNA, 20 nt, Human
uuuuuuuuuuuuuuuuugcu

SEQ ID NO: 847098 - RNA, 25 nt, Human
uuuuuuuuuuuuuuuuugcugcugg

SEQ ID NO: 847099 - RNA, 21 nt, Human
aacaguccaaaccggaaggga

SEQ ID NO: 847100 - RNA, 20 nt, Human
aacaguccuuccagagcccu

SEQ ID NO: 847101 - RNA, 24 nt, Human
aaccggaagggagaauuuauuuuu

SEQ ID NO: 847102 - RNA, 19 nt, Human
aacuccuguccccuuaguc

SEQ ID NO: 847103 - RNA, 21 nt, Human
aagcugccuuugccgcugggc

SEQ ID NO: 847104 - RNA, 18 nt, Human
agaaaccuccucagccuu

SEQ ID NO: 847105 - RNA, 18 nt, Human
agacagggcuuggugggg

SEQ ID NO: 847106 - RNA, 18 nt, Human
agcaggaggguggcagag

SEQ ID NO: 847107 - RNA, 19 nt, Human
aggggcccugaccacugug

SEQ ID NO: 847108 - RNA, 21 nt, Human
auggcucccauuuugaaggga

SEQ ID NO: 847109 - RNA, 22 nt, Human
cagagcugggacaaagcugccu

SEQ ID NO: 847110 - RNA, 20 nt, Human
ccaaucccugccguccuugc

SEQ ID NO: 847111 - RNA, 18 nt, Human
ccacugugagcaggaggg

SEQ ID NO: 847112 - RNA, 19 nt, Human
ccauccacgucuuccucgu

SEQ ID NO: 847113 - RNA, 19 nt, Human
cccaagggccuucccauga

SEQ ID NO: 847114 - RNA, 21 nt, Human
ccccuuagucaugagaacaga

SEQ ID NO: 847115 - RNA, 22 nt, Human
cccucguccugguguuccugau

SEQ ID NO: 847116 - RNA, 23 nt, Human
ccuucuagcucacccaggccaga

SEQ ID NO: 847117 - RNA, 23 nt, Human
ccuugccccugaggggcccugac

SEQ ID NO: 847118 - RNA, 24 nt, Human
ccuuucaccuggcaggggaggggg

SEQ ID NO: 847119 - RNA, 18 nt, Human
cuccuguccccuuaguca

SEQ ID NO: 847120 - RNA, 18 nt, Human
gagcacaggcggggaagc

SEQ ID NO: 847121 - RNA, 24 nt, Human
gagcaggaggguggcagagcuggg

SEQ ID NO: 847122 - RNA, 18 nt, Human
gaggggcccugaccacug

SEQ ID NO: 847123 - RNA, 23 nt, Human
gaggggcccugaccacugugagc

SEQ ID NO: 847124 - RNA, 18 nt, Human
gaggguggcagagcuggg

SEQ ID NO: 847125 - RNA, 19 nt, Human
gcucccauuuugaagggag

SEQ ID NO: 847126 - RNA, 18 nt, Human
gggacuccaauguccuug

SEQ ID NO: 847127 - RNA, 20 nt, Human
gggcccugaccacugugagc

SEQ ID NO: 847128 - RNA, 20 nt, Human
uaguguccccagcauagggg

SEQ ID NO: 847129 - RNA, 23 nt, Human
ucacccaggccagaagcgagaau

SEQ ID NO: 847130 - RNA, 18 nt, Human
ucaccuggcaggggaggg

SEQ ID NO: 847131 - RNA, 23 nt, Human
ucagauucccaagggccuuccca

SEQ ID NO: 847132 - RNA, 24 nt, Human
ucagccuucauuuguucguggaug

SEQ ID NO: 847133 - RNA, 22 nt, Human
uccaugugguccgagugaggug

SEQ ID NO: 847134 - RNA, 19 nt, Human
ucccaugaaguugucuagg

SEQ ID NO: 847135 - RNA, 22 nt, Human
ucguccugguguuccugaucau

SEQ ID NO: 847136 - RNA, 20 nt, Human
ucuagcucacccaggccaga

SEQ ID NO: 847137 - RNA, 22 nt, Human
ucuagcucacccaggccagaag

SEQ ID NO: 847138 - RNA, 20 nt, Human
ugcacacucauggacuuuag

SEQ ID NO: 847139 - RNA, 20 nt, Human
ugccuguaguguccccagca

SEQ ID NO: 847140 - RNA, 19 nt, Human
ugccuuugccgcugggcuu

SEQ ID NO: 847141 - RNA, 18 nt, Human
uggagggagcacaggcgg

SEQ ID NO: 847142 - RNA, 20 nt, Human
uuuuuuuuuuuuaacagucc

SEQ ID NO: 847143 - RNA, 23 nt, Human
uuuuuuuuuuuuuuuuuuaacag

SEQ ID NO: 847144 - RNA, 22 nt, Human
aaauagauuauacccaaggcuc

SEQ ID NO: 847145 - RNA, 20 nt, Human
aagcagugggaagagccuuu

SEQ ID NO: 847146 - RNA, 18 nt, Human
aagcugcaagugacaagg

SEQ ID NO: 847147 - RNA, 24 nt, Human
agaaaagccagcuccacugaaggg

SEQ ID NO: 847148 - RNA, 18 nt, Human
agagggagaagcaggggc

SEQ ID NO: 847149 - RNA, 21 nt, Human
agagggagaagcaggggccug

SEQ ID NO: 847150 - RNA, 19 nt, Human
agccaucaaagcagagggc

SEQ ID NO: 847151 - RNA, 25 nt, Human
agccugccuccccaaauggcuucca

SEQ ID NO: 847152 - RNA, 25 nt, Human
aggcagacugggagagaagaccagg

SEQ ID NO: 847153 - RNA, 20 nt, Human
aggcauggaaaggggcuggg

SEQ ID NO: 847154 - RNA, 18 nt, Human
aggggccuggggucaagg

SEQ ID NO: 847155 - RNA, 19 nt, Human
agggguggggaaaaggaag

SEQ ID NO: 847156 - RNA, 19 nt, Human
aucugggaggggugugggg

SEQ ID NO: 847157 - RNA, 21 nt, Human
caaacuuacgggccacccucc

SEQ ID NO: 847158 - RNA, 23 nt, Human
caacacaguaacaagcaguggga

SEQ ID NO: 847159 - RNA, 22 nt, Human
caccacccaccccccaagugcu

SEQ ID NO: 847160 - RNA, 22 nt, Human
caccacccaccccccaagugcu

SEQ ID NO: 847161 - RNA, 18 nt, Human
cacccuccaccacccacc

SEQ ID NO: 847162 - RNA, 21 nt, Human
cacccuccaccacccaccccc

SEQ ID NO: 847163 - RNA, 22 nt, Human
cagagcuugccaaauggaguga

SEQ ID NO: 847164 - RNA, 22 nt, Human
cagcuccacugaacaaagggga

SEQ ID NO: 847165 - RNA, 20 nt, Human
ccaaagaacaugaguucacc

SEQ ID NO: 847166 - RNA, 18 nt, Human
ccacagcacgccuucccu

SEQ ID NO: 847167 - RNA, 18 nt, Human
ccaccacccaccccccaa

SEQ ID NO: 847168 - RNA, 19 nt, Human
ccaccacccaccccccaag

SEQ ID NO: 847169 - RNA, 21 nt, Human
ccaccacccaccccccaagug

SEQ ID NO: 847170 - RNA, 20 nt, Human
ccacccuccaccacccaccc

SEQ ID NO: 847171 - RNA, 23 nt, Human
ccagcuccacugaacaaagggga

SEQ ID NO: 847172 - RNA, 21 nt, Human
cccaaagaacaugaguucacc

SEQ ID NO: 847173 - RNA, 18 nt, Human
cccaggcucccccucaga

SEQ ID NO: 847174 - RNA, 23 nt, Human
cccagggcugggcuaggcagacu

SEQ ID NO: 847175 - RNA, 25 nt, Human
ccccaaauggcuuccaaaucccuca

SEQ ID NO: 847176 - RNA, 20 nt, Human
ccccucauccccuacucaaa

SEQ ID NO: 847177 - RNA, 20 nt, Human
cccuccaccacccacccccc

SEQ ID NO: 847178 - RNA, 22 nt, Human
ccuccaccacccaccccccaag

SEQ ID NO: 847179 - RNA, 21 nt, Human
ccuugcccaaacccuccagcc

SEQ ID NO: 847180 - RNA, 23 nt, Human
ccuugcccaaacccuccagccuc

SEQ ID NO: 847181 - RNA, 19 nt, Human
cucagaacugauaaagagg

SEQ ID NO: 847182 - RNA, 18 nt, Human
cugcaagugacaaggcag

SEQ ID NO: 847183 - RNA, 22 nt, Human
cugggaggggugugggguggga

SEQ ID NO: 847184 - RNA, 19 nt, Human
cuugcccaaacccuccagc

SEQ ID NO: 847185 - RNA, 22 nt, Human
cuugcccaaacccuccagccuc

SEQ ID NO: 847186 - RNA, 20 nt, Human
cuugguugagugcuggaaaa

SEQ ID NO: 847187 - RNA, 23 nt, Human
gaagagcagggguggggaaaagg

SEQ ID NO: 847188 - RNA, 18 nt, Human
gagaagcaggggccuggg

SEQ ID NO: 847189 - RNA, 23 nt, Human
gagcuggaggccaggaggguucu

SEQ ID NO: 847190 - RNA, 21 nt, Human
gccagcuccacugaacaaagg

SEQ ID NO: 847191 - RNA, 19 nt, Human
gcccaaacccuccagccuc

SEQ ID NO: 847192 - RNA, 18 nt, Human
ggagaagcaggggccugg

SEQ ID NO: 847193 - RNA, 19 nt, Human
ggccuggggucaaggggga

SEQ ID NO: 847194 - RNA, 24 nt, Human
gggguguggggugggaugagcuuu

SEQ ID NO: 847195 - RNA, 20 nt, Human
gucccagggcugggcuaggc

SEQ ID NO: 847196 - RNA, 18 nt, Human
uaacaagcagugggaaga

SEQ ID NO: 847197 - RNA, 23 nt, Human
uacccaaggcucuccuccugggg

SEQ ID NO: 847198 - RNA, 25 nt, Human
uacccaaggcucuccuccuggggac

SEQ ID NO: 847199 - RNA, 20 nt, Human
ucaagugaagcuaaauucug

SEQ ID NO: 847200 - RNA, 19 nt, Human
ucaaucauggcgaccauuc

SEQ ID NO: 847201 - RNA, 20 nt, Human
ucauccccuacucaaauucc

SEQ ID NO: 847202 - RNA, 22 nt, Human
uccaaaucccucagcuaaaauc

SEQ ID NO: 847203 - RNA, 23 nt, Human
uccccaaauggcuuccaaauccc

SEQ ID NO: 847204 - RNA, 21 nt, Human
ugagcuggaggccaggagggu

SEQ ID NO: 847205 - RNA, 23 nt, Human
ugccuccccaaauggcuuccaaa

SEQ ID NO: 847206 - RNA, 19 nt, Human
ugccuugcccaaacccucc

SEQ ID NO: 847207 - RNA, 20 nt, Human
uggaaaggggcugggagaaa

SEQ ID NO: 847208 - RNA, 20 nt, Human
uggaggccaggaggguucuu

SEQ ID NO: 847209 - RNA, 24 nt, Human
uggagugaaaggcauggaaagggg

SEQ ID NO: 847210 - RNA, 28 nt, Human
uggagugaaaggcauggaaaggggcugg

SEQ ID NO: 847211 - RNA, 23 nt, Human
uggcagugagcagaucugggagg

SEQ ID NO: 847212 - RNA, 21 nt, Human
ugggagaaaagccagcuccac

SEQ ID NO: 847213 - RNA, 18 nt, Human
ugggagggguguggggug

SEQ ID NO: 847214 - RNA, 18 nt, Human
ugggagggguguggggug

SEQ ID NO: 847215 - RNA, 22 nt, Human
ugggaugagcuuugcuccuugg

SEQ ID NO: 847216 - RNA, 21 nt, Human
uggggacccaaacccgucccc

SEQ ID NO: 847217 - RNA, 18 nt, Human
uucaccucagccaucaaa

SEQ ID NO: 847218 - RNA, 21 nt, Human
uuccagucccagggcugggcu

SEQ ID NO: 847219 - RNA, 19 nt, Human
uugguugagugcuggaaaa

SEQ ID NO: 847220 - RNA, 20 nt, Human
uuuagaaucccuccucccca

SEQ ID NO: 847221 - RNA, 20 nt, Human
uuuuuuuuuuuuagagaagc

SEQ ID NO: 847222 - RNA, 24 nt, Human
aagaaaacaaagggagccgguacc

SEQ ID NO: 847223 - RNA, 18 nt, Human
aaggguggcaaaugaccu

SEQ ID NO: 847224 - RNA, 23 nt, Human
acacaguuucccucccugaagcc

SEQ ID NO: 847225 - RNA, 23 nt, Human
acccugucugucucaggcuugcu

SEQ ID NO: 847226 - RNA, 18 nt, Human
agaaauaaaauggaaaug

SEQ ID NO: 847227 - RNA, 21 nt, Human
agcuccguggccuccuggagg

SEQ ID NO: 847228 - RNA, 22 nt, Human
agcuggcauccuggacucuggg

SEQ ID NO: 847229 - RNA, 18 nt, Human
aggaaacacagaccucaa

SEQ ID NO: 847230 - RNA, 19 nt, Human
aggaaacacagaccucaaa

SEQ ID NO: 847231 - RNA, 21 nt, Human
aggaaagaaacaaauucugaa

SEQ ID NO: 847232 - RNA, 22 nt, Human
aggaaagaaacaaauucugaaa

SEQ ID NO: 847233 - RNA, 19 nt, Human
aggcugcuaugagucccuu

SEQ ID NO: 847234 - RNA, 18 nt, Human
agggaggagcaucccagg

SEQ ID NO: 847235 - RNA, 21 nt, Human
agguggccagcuuccuggagc

SEQ ID NO: 847236 - RNA, 20 nt, Human
auggaaauggggagaaagaa

SEQ ID NO: 847237 - RNA, 22 nt, Human
caaccccgucccccugucugga

SEQ ID NO: 847238 - RNA, 24 nt, Human
caaccccgucccccugucuggagg

SEQ ID NO: 847239 - RNA, 21 nt, Human
cagaagaaauaaaauggaaau

SEQ ID NO: 847240 - RNA, 21 nt, Human
caggacccuaaaauuugcaaa

SEQ ID NO: 847241 - RNA, 21 nt, Human
caggcuaaaggccccacuccc

SEQ ID NO: 847242 - RNA, 19 nt, Human
ccacugccgggcaccgccu

SEQ ID NO: 847243 - RNA, 20 nt, Human
ccagaagaaauaaaauggaa

SEQ ID NO: 847244 - RNA, 19 nt, Human
ccagccccugcuguccuuu

SEQ ID NO: 847245 - RNA, 18 nt, Human
ccagcuccguggccuccu

SEQ ID NO: 847246 - RNA, 23 nt, Human
ccauccauacuuggcucaggacc

SEQ ID NO: 847247 - RNA, 19 nt, Human
cccagaagaaauaaaaugg

SEQ ID NO: 847248 - RNA, 19 nt, Human
ccccagggucuccacuagc

SEQ ID NO: 847249 - RNA, 22 nt, Human
cccggguuccaggcaccaagag

SEQ ID NO: 847250 - RNA, 21 nt, Human
cccucuaggcaggccagcccc

SEQ ID NO: 847251 - RNA, 23 nt, Human
cccucuaggcaggccagccccug

SEQ ID NO: 847252 - RNA, 23 nt, Human
cccuggccaggugaggcuaggac

SEQ ID NO: 847253 - RNA, 24 nt, Human
ccgccugcacagggcucuggcugc

SEQ ID NO: 847254 - RNA, 19 nt, Human
ccucuaggcaggccagccc

SEQ ID NO: 847255 - RNA, 21 nt, Human
ccugcacagggcucuggcugc

SEQ ID NO: 847256 - RNA, 23 nt, Human
ccuggaacccugucugucucagg

SEQ ID NO: 847257 - RNA, 19 nt, Human
ccuggagcccaggcccgcu

SEQ ID NO: 847258 - RNA, 19 nt, Human
ccuggagcccaggcccgcu

SEQ ID NO: 847259 - RNA, 18 nt, Human
ccuggagggggaccccca

SEQ ID NO: 847260 - RNA, 22 nt, Human
cuaugagucccuuccccuuccc

SEQ ID NO: 847261 - RNA, 20 nt, Human
cuccguggccuccuggaggg

SEQ ID NO: 847262 - RNA, 21 nt, Human
cuccuggagggggacccccag

SEQ ID NO: 847263 - RNA, 23 nt, Human
cucugucuggcuucuccccuuca

SEQ ID NO: 847264 - RNA, 24 nt, Human
cugaagccaaggguggcaaaugac

SEQ ID NO: 847265 - RNA, 26 nt, Human
cugcuguccuuugggccccucccucc

SEQ ID NO: 847266 - RNA, 24 nt, Human
cuucccuacccauccugcuggggg

SEQ ID NO: 847267 - RNA, 24 nt, Human
cuuguucugacagguggucuuggc

SEQ ID NO: 847268 - RNA, 18 nt, Human
cuuuguguuguccaugga

SEQ ID NO: 847269 - RNA, 21 nt, Human
cuuuuggccaccgucaccugg

SEQ ID NO: 847270 - RNA, 18 nt, Human
gaaagaaacaaauucuga

SEQ ID NO: 847271 - RNA, 19 nt, Human
gacucugggcgcuggacuc

SEQ ID NO: 847272 - RNA, 19 nt, Human
gagcagggccugagguagg

SEQ ID NO: 847273 - RNA, 21 nt, Human
gagcaucuuggaggaggucug

SEQ ID NO: 847274 - RNA, 19 nt, Human
gaggcagggcccaguccug

SEQ ID NO: 847275 - RNA, 19 nt, Human
gagggggacccccaggguc

SEQ ID NO: 847276 - RNA, 23 nt, Human
gcaaaugaccuugacccuggccg

SEQ ID NO: 847277 - RNA, 23 nt, Human
gcacugucugccugcgucguagc

SEQ ID NO: 847278 - RNA, 18 nt, Human
gccagccccugcuguccu

SEQ ID NO: 847279 - RNA, 20 nt, Human
gcugggguacaggggacacc

SEQ ID NO: 847280 - RNA, 18 nt, Human
ggagaaagaaaacaaagg

SEQ ID NO: 847281 - RNA, 18 nt, Human
ggcagggcccaguccugg

SEQ ID NO: 847282 - RNA, 22 nt, Human
ggcccaguccuggagcagggcc

SEQ ID NO: 847283 - RNA, 23 nt, Human
gggggucaggggagcccugggcc

SEQ ID NO: 847284 - RNA, 21 nt, Human
ggggucaggggagcccugggc

SEQ ID NO: 847285 - RNA, 21 nt, Human
gucccuuccccuucccuaccc

SEQ ID NO: 847286 - RNA, 19 nt, Human
uaugagucccuuccccuuc

SEQ ID NO: 847287 - RNA, 23 nt, Human
ucacggccuccuuuguguugucc

SEQ ID NO: 847288 - RNA, 22 nt, Human
ucaggggagcccugggccacag

SEQ ID NO: 847289 - RNA, 23 nt, Human
ucccagaagaaauaaaauggaaa

SEQ ID NO: 847290 - RNA, 22 nt, Human
ucccaggcugcuaugagucccu

SEQ ID NO: 847291 - RNA, 23 nt, Human
ucccaggcugcuaugagucccuu

SEQ ID NO: 847292 - RNA, 22 nt, Human
ucccccagcuccguggccuccu

SEQ ID NO: 847293 - RNA, 20 nt, Human
ucccugaagccaaggguggc

SEQ ID NO: 847294 - RNA, 18 nt, Human
uccggacaggaugggccc

SEQ ID NO: 847295 - RNA, 19 nt, Human
uccuggagcccaggcccgc

SEQ ID NO: 847296 - RNA, 19 nt, Human
uccuggggggcuccucugu

SEQ ID NO: 847297 - RNA, 23 nt, Human
ucugaaccauccauacuuggcuc

SEQ ID NO: 847298 - RNA, 21 nt, Human
ucugggcgcuggacucugcga

SEQ ID NO: 847299 - RNA, 18 nt, Human
ugaagucacuggggcugu

SEQ ID NO: 847300 - RNA, 21 nt, Human
ugaagucacuggggcuguggg

SEQ ID NO: 847301 - RNA, 23 nt, Human
ugaagucacuggggcugugggag

SEQ ID NO: 847302 - RNA, 19 nt, Human
ugaggcggacaaccccguc

SEQ ID NO: 847303 - RNA, 19 nt, Human
ugagguaggagcugaugcu

SEQ ID NO: 847304 - RNA, 18 nt, Human
ugcguugggucccccagc

SEQ ID NO: 847305 - RNA, 24 nt, Human
ugcugggggucugcugggggucag

SEQ ID NO: 847306 - RNA, 22 nt, Human
ugcugggguacaggggacaccg

SEQ ID NO: 847307 - RNA, 25 nt, Human
uggaacccugucugucucaggcuug

SEQ ID NO: 847308 - RNA, 22 nt, Human
uggacucugcgauuguuuccag

SEQ ID NO: 847309 - RNA, 23 nt, Human
uggagggggacccccagggucuc

SEQ ID NO: 847310 - RNA, 19 nt, Human
uggagggucaucaggcuga

SEQ ID NO: 847311 - RNA, 19 nt, Human
uggcaaaugaccuugaccc

SEQ ID NO: 847312 - RNA, 23 nt, Human
uggcaaaugaccuugacccuggc

SEQ ID NO: 847313 - RNA, 19 nt, Human
uggcugcucugcucagggc

SEQ ID NO: 847314 - RNA, 20 nt, Human
uggcuggcccucugugaggc

SEQ ID NO: 847315 - RNA, 21 nt, Human
ugggagacacaguuucccucc

SEQ ID NO: 847316 - RNA, 23 nt, Human
ugggcgcuggacucugcgauugu

SEQ ID NO: 847317 - RNA, 21 nt, Human
uggguggcaaaggaaacacag

SEQ ID NO: 847318 - RNA, 22 nt, Human
uggucuuggcuggcccucugug

SEQ ID NO: 847319 - RNA, 23 nt, Human
ugucucaggcuugcugucaucgg

SEQ ID NO: 847320 - RNA, 22 nt, Human
ugucuggagggucaucaggcug

SEQ ID NO: 847321 - RNA, 20 nt, Human
uucccagaagaaauaaaauc

SEQ ID NO: 847322 - RNA, 23 nt, Human
uucccagaagaaauaaaauggaa

SEQ ID NO: 847323 - RNA, 21 nt, Human
uuccuggagcccaggcccgcu

SEQ ID NO: 847324 - RNA, 24 nt, Human
uuggcuggcccucugugaggcgga

SEQ ID NO: 847325 - RNA, 19 nt, Human
aacccgccuccuaggucug

SEQ ID NO: 847326 - RNA, 25 nt, Human
acccgccuccuaggucugucucuac

SEQ ID NO: 847327 - RNA, 20 nt, Human
aggccccagccacacagucc

SEQ ID NO: 847328 - RNA, 19 nt, Human
cacacaguccagcugugcu

SEQ ID NO: 847329 - RNA, 18 nt, Human
caccaaacccccucgugc

SEQ ID NO: 847330 - RNA, 18 nt, Human
caccaaacccgccuccua

SEQ ID NO: 847331 - RNA, 20 nt, Human
caggccaaggaggcggcuuu

SEQ ID NO: 847332 - RNA, 25 nt, Human
caguaagauuuucucgcuuuggccu

SEQ ID NO: 847333 - RNA, 19 nt, Human
cccagccacacaguccagc

SEQ ID NO: 847334 - RNA, 18 nt, Human
cgcaccaaacccgccucc

SEQ ID NO: 847335 - RNA, 19 nt, Human
gcaccaaacccccucgugc

SEQ ID NO: 847336 - RNA, 22 nt, Human
gcagggcacuggccucucacca

SEQ ID NO: 847337 - RNA, 24 nt, Human
uaaaaagcucuuuauuugaagcuc

SEQ ID NO: 847338 - RNA, 22 nt, Human
uauuugaagcuccagggugggg

SEQ ID NO: 847339 - RNA, 22 nt, Human
uccagcugugcuccgauuggca

SEQ ID NO: 847340 - RNA, 22 nt, Human
ucuacaggccaaggaggcggcu

SEQ ID NO: 847341 - RNA, 18 nt, Human
ugucaggccccagccaca

SEQ ID NO: 847342 - RNA, 25 nt, Human
ugucucuacaggccaaggaggcggc

SEQ ID NO: 847343 - RNA, 22 nt, Human
uuauuugaagcuccaggguggg

SEQ ID NO: 847344 - RNA, 22 nt, Human
uuuuggggguaaaaagcucuuu

SEQ ID NO: 847345 - RNA, 26 nt, Human
uuuuggggguaaaaagcucuuuauuu

SEQ ID NO: 847346 - RNA, 19 nt, Human
uuuuuuuuuuuuugggggu

SEQ ID NO: 847347 - RNA, 20 nt, Human
uuuuuuuuuuuuuuuggggg

SEQ ID NO: 847348 - RNA, 22 nt, Human
uuuuuuuuuuuuuuuuuggggg

SEQ ID NO: 847349 - RNA, 23 nt, Human
uuuuuuuuuuuuuuuuugggggu

SEQ ID NO: 847350 - RNA, 24 nt, Human
aagugauccgucugccucggccuc

SEQ ID NO: 847351 - RNA, 20 nt, Human
accacagagagucauguaca

SEQ ID NO: 847352 - RNA, 21 nt, Human
accagaggcaagacauuucug

SEQ ID NO: 847353 - RNA, 20 nt, Human
accauguuggccaggcuggu

SEQ ID NO: 847354 - RNA, 22 nt, Human
accauguuggccaggcuggucu

SEQ ID NO: 847355 - RNA, 22 nt, Human
accauguuggccaggcuggucu

SEQ ID NO: 847356 - RNA, 19 nt, Human
accugguggugacugggau

SEQ ID NO: 847357 - RNA, 22 nt, Human
aggcaggacguggaccacagag

SEQ ID NO: 847358 - RNA, 21 nt, Human
agugcugggauuauagacgug

SEQ ID NO: 847359 - RNA, 22 nt, Human
agugcugggauuauagacguga

SEQ ID NO: 847360 - RNA, 24 nt, Human
agugcugggauuauagacgugagc

SEQ ID NO: 847361 - RNA, 24 nt, Human
aucaaauucaguucagcaaacauu

SEQ ID NO: 847362 - RNA, 19 nt, Human
auggcaucccugcuucugg

SEQ ID NO: 847363 - RNA, 26 nt, Human
caaaacucuaguggaaauuucccagg

SEQ ID NO: 847364 - RNA, 22 nt, Human
caagugauccgucugccucggc

SEQ ID NO: 847365 - RNA, 19 nt, Human
caccccagcuuuucagaga

SEQ ID NO: 847366 - RNA, 19 nt, Human
caccgcgcaggccuggggc

SEQ ID NO: 847367 - RNA, 22 nt, Human
caccugguggugacugggaugc

SEQ ID NO: 847368 - RNA, 21 nt, Human
cacguggaccgugucagaagc

SEQ ID NO: 847369 - RNA, 19 nt, Human
cagcugggaccauguuggc

SEQ ID NO: 847370 - RNA, 28 nt, Human
caucccucccugcacaacagauggcauc

SEQ ID NO: 847371 - RNA, 20 nt, Human
caucugguacuguguugagc

SEQ ID NO: 847372 - RNA, 24 nt, Human
cauguuggccaggcuggucuugaa

SEQ ID NO: 847373 - RNA, 18 nt, Human
ccacagugcugggauuau

SEQ ID NO: 847374 - RNA, 24 nt, Human
ccacagugcugggauuauagacgu

SEQ ID NO: 847375 - RNA, 24 nt, Human
ccaggucggucccacgccccggug

SEQ ID NO: 847376 - RNA, 20 nt, Human
cccacgccccggugacaggg

SEQ ID NO: 847377 - RNA, 21 nt, Human
cccccaaacuggaggcaauug

SEQ ID NO: 847378 - RNA, 23 nt, Human
cccugcacaacagauggcauccc

SEQ ID NO: 847379 - RNA, 18 nt, Human
ccugaccucaagugaucc

SEQ ID NO: 847380 - RNA, 18 nt, Human
ccugaccucaagugaucc

SEQ ID NO: 847381 - RNA, 23 nt, Human
ccugaccucaagugauccgucug

SEQ ID NO: 847382 - RNA, 23 nt, Human
ccugcagcugggaccauguuggc

SEQ ID NO: 847383 - RNA, 24 nt, Human
ccugcagcugggaccauguuggcc

SEQ ID NO: 847384 - RNA, 26 nt, Human
cuccugaccucaagugauccgucugc

SEQ ID NO: 847385 - RNA, 23 nt, Human
cucugucucagucuccugaagag

SEQ ID NO: 847386 - RNA, 23 nt, Human
cugccucggccucccacagugcu

SEQ ID NO: 847387 - RNA, 20 nt, Human
cuggcagggaggagcugagg

SEQ ID NO: 847388 - RNA, 23 nt, Human
cuucugggccuccccagcugcac

SEQ ID NO: 847389 - RNA, 24 nt, Human
gaccucaagugauccgucugccuc

SEQ ID NO: 847390 - RNA, 24 nt, Human
gagaggagcccccaaacuggaggc

SEQ ID NO: 847391 - RNA, 22 nt, Human
gagcucuggagagagcugagga

SEQ ID NO: 847392 - RNA, 18 nt, Human
gauuauagacgugagcca

SEQ ID NO: 847393 - RNA, 22 nt, Human
gauuauagacgugagccaccgc

SEQ ID NO: 847394 - RNA, 25 nt, Human
gcaaaacucuaguggaaauuuccca

SEQ ID NO: 847395 - RNA, 23 nt, Human
gcagcugggaccauguuggccag

SEQ ID NO: 847396 - RNA, 24 nt, Human
gcagcugggaccauguuggccagg

SEQ ID NO: 847397 - RNA, 19 nt, Human
gcccugcagcugggaccau

SEQ ID NO: 847398 - RNA, 18 nt, Human
gccuucagagccaggcac

SEQ ID NO: 847399 - RNA, 23 nt, Human
gcuggucuugaacuccugaccuc

SEQ ID NO: 847400 - RNA, 21 nt, Human
ggcucuguuuuccuuuccaau

SEQ ID NO: 847401 - RNA, 24 nt, Human
ggcuggucuugaacuccugaccuc

SEQ ID NO: 847402 - RNA, 21 nt, Human
gguaaacagccagggccugag

SEQ ID NO: 847403 - RNA, 19 nt, Human
ggucuugaacuccugaccu

SEQ ID NO: 847404 - RNA, 22 nt, Human
gucaagucuccccaccaugagu

SEQ ID NO: 847405 - RNA, 19 nt, Human
gucucagucuccugaagag

SEQ ID NO: 847406 - RNA, 23 nt, Human
guugggccuucagagccaggcac

SEQ ID NO: 847407 - RNA, 20 nt, Human
uaaccacucaccccagcuuu

SEQ ID NO: 847408 - RNA, 22 nt, Human
uacuguguugagcucuggagag

SEQ ID NO: 847409 - RNA, 18 nt, Human
ucacaguaggcagugaca

SEQ ID NO: 847410 - RNA, 21 nt, Human
ucacuugucuucucugucuca

SEQ ID NO: 847411 - RNA, 18 nt, Human
ucccacagugcugggauu

SEQ ID NO: 847412 - RNA, 24 nt, Human
ucccacagugcugggauuauagac

SEQ ID NO: 847413 - RNA, 18 nt, Human
uccucaucccucccugca

SEQ ID NO: 847414 - RNA, 23 nt, Human
uccugaagagcccgaggaaguca

SEQ ID NO: 847415 - RNA, 21 nt, Human
ucuugaacuccugaccucaag

SEQ ID NO: 847416 - RNA, 19 nt, Human
ugaccucaagugauccguc

SEQ ID NO: 847417 - RNA, 24 nt, Human
ugaccucaagugauccgucugccu

SEQ ID NO: 847418 - RNA, 23 nt, Human
ugacugggaugcuggcagggagg

SEQ ID NO: 847419 - RNA, 22 nt, Human
ugagcucuggagagagcugagg

SEQ ID NO: 847420 - RNA, 21 nt, Human
ugccucggccucccacagugc

SEQ ID NO: 847421 - RNA, 24 nt, Human
ugccucggccucccacagugcugg

SEQ ID NO: 847422 - RNA, 21 nt, Human
uggaccgugucagaagcgcca

SEQ ID NO: 847423 - RNA, 24 nt, Human
uggccaggcuggucuugaacuccu

SEQ ID NO: 847424 - RNA, 18 nt, Human
ugggauuauagacgugag

SEQ ID NO: 847425 - RNA, 19 nt, Human
ugggauuauagacgugagc

SEQ ID NO: 847426 - RNA, 21 nt, Human
ugggauuauagacgugagcca

SEQ ID NO: 847427 - RNA, 22 nt, Human
ugggauuauagacgugagccac

SEQ ID NO: 847428 - RNA, 23 nt, Human
ugggauuauagacgugagccacc

SEQ ID NO: 847429 - RNA, 24 nt, Human
ugggauuauagacgugagccaccg

SEQ ID NO: 847430 - RNA, 23 nt, Human
uggucugacaguugggccuucag

SEQ ID NO: 847431 - RNA, 19 nt, Human
ugucucagucuccugaaga

SEQ ID NO: 847432 - RNA, 23 nt, Human
uuucacuugucuucucugucuca

SEQ ID NO: 847433 - RNA, 22 nt, Human
uuuuuuuuuuuuuuuuuuuagg

SEQ ID NO: 847434 - RNA, 21 nt, Human
acuggcauuuuccagccgcgc

SEQ ID NO: 847435 - RNA, 24 nt, Human
auuuuuauuacuguuucuuuuaau

SEQ ID NO: 847436 - RNA, 20 nt, Human
cagcccggccaccgccgcuu

SEQ ID NO: 847437 - RNA, 18 nt, Human
ccccaacccacccagcca

SEQ ID NO: 847438 - RNA, 18 nt, Human
ccgagcuugcuccucgug

SEQ ID NO: 847439 - RNA, 19 nt, Human
ccgcuucaaugaagggcgc

SEQ ID NO: 847440 - RNA, 24 nt, Human
cgccccaacccacccagccaccga

SEQ ID NO: 847441 - RNA, 18 nt, Human
gccccaacccacccagcc

SEQ ID NO: 847442 - RNA, 18 nt, Human
gcggaacgccccaaccca

SEQ ID NO: 847443 - RNA, 22 nt, Human
guccaccuccaucucaucguga

SEQ ID NO: 847444 - RNA, 19 nt, Human
ucggagcugcuccccucau

SEQ ID NO: 847445 - RNA, 22 nt, Human
ucucucaugauucagugagaau

SEQ ID NO: 847446 - RNA, 22 nt, Human
uugguaacacuaauaagguaaa

SEQ ID NO: 847447 - RNA, 18 nt, Human
uuuuuuuuuuuuuuuucg

SEQ ID NO: 847448 - RNA, 20 nt, Human
uuuuuuuuuuuuuuuuucgu

SEQ ID NO: 847449 - RNA, 20 nt, Human
aaaguccuggcugggccugg

SEQ ID NO: 847450 - RNA, 18 nt, Human
acccaccugccccgaggg

SEQ ID NO: 847451 - RNA, 22 nt, Human
acccaccugccccgagggcccc

SEQ ID NO: 847452 - RNA, 23 nt, Human
agcugggguaggcaaaguccugg

SEQ ID NO: 847453 - RNA, 23 nt, Human
aggcaaaguccuggcugggccug

SEQ ID NO: 847454 - RNA, 23 nt, Human
caccugccccgagggccccgcga

SEQ ID NO: 847455 - RNA, 19 nt, Human
cagccaccugcagguccug

SEQ ID NO: 847456 - RNA, 19 nt, Human
cagccgcgcagccgccccg

SEQ ID NO: 847457 - RNA, 24 nt, Human
ccaccugcagguccuguucaugcc

SEQ ID NO: 847458 - RNA, 20 nt, Human
ccccugagcucccccggcuc

SEQ ID NO: 847459 - RNA, 19 nt, Human
cccugagcucccccggcuc

SEQ ID NO: 847460 - RNA, 23 nt, Human
ccgcgccgagucccggcagccgc

SEQ ID NO: 847461 - RNA, 18 nt, Human
ccgcgugccaagcgcucc

SEQ ID NO: 847462 - RNA, 22 nt, Human
ccggcagccgcgcagccgcccc

SEQ ID NO: 847463 - RNA, 21 nt, Human
ccuguucaugccccaguuggu

SEQ ID NO: 847464 - RNA, 22 nt, Human
cgccgagucccggcagccgcgc

SEQ ID NO: 847465 - RNA, 24 nt, Human
cgcgcagccgccccgccgagugcg

SEQ ID NO: 847466 - RNA, 19 nt, Human
cgcgccgagucccggcagc

SEQ ID NO: 847467 - RNA, 25 nt, Human
cggcuccugcggccccugagcuccc

SEQ ID NO: 847468 - RNA, 21 nt, Human
cuggaguggggcagaggucag

SEQ ID NO: 847469 - RNA, 24 nt, Human
cuuuauacccgcugagucccccuu

SEQ ID NO: 847470 - RNA, 21 nt, Human
gccgagucccggcagccgcgc

SEQ ID NO: 847471 - RNA, 27 nt, Human
gcggccccugagcucccccggcucccu

SEQ ID NO: 847472 - RNA, 23 nt, Human
ggggaccugguuuauaacacagc

SEQ ID NO: 847473 - RNA, 21 nt, Human
gggggacacucaguccagcca

SEQ ID NO: 847474 - RNA, 18 nt, Human
ggucaggagggggaccug

SEQ ID NO: 847475 - RNA, 19 nt, Human
ucaggagggggaccugguu

SEQ ID NO: 847476 - RNA, 21 nt, Human
ucccgcugcggcugcagcucc

SEQ ID NO: 847477 - RNA, 22 nt, Human
ugccaagcgcucccgugucucc

SEQ ID NO: 847478 - RNA, 22 nt, Human
ugggaagagcuccauuccugga

SEQ ID NO: 847479 - RNA, 19 nt, Human
ugggguaggcaaaguccug

SEQ ID NO: 847480 - RNA, 20 nt, Human
uuuuuuuuuuuugcaggguc

SEQ ID NO: 847481 - RNA, 19 nt, Human
uuuuuuuuuuuuuuuuugc

SEQ ID NO: 847482 - RNA, 24 nt, Human
uuuuuuuuuuuuuuuuugcagggg

SEQ ID NO: 847483 - RNA, 24 nt, Human
aagaaagugggaggagccgguacc

SEQ ID NO: 847484 - RNA, 18 nt, Human
aaguggggcccgcagcug

SEQ ID NO: 847485 - RNA, 20 nt, Human
aauggcacucuggucugagc

SEQ ID NO: 847486 - RNA, 24 nt, Human
acagagucagaggccaucuaacaa

SEQ ID NO: 847487 - RNA, 18 nt, Human
acaguacagcuccccggg

SEQ ID NO: 847488 - RNA, 18 nt, Human
accucuuccuucugccca

SEQ ID NO: 847489 - RNA, 25 nt, Human
agacagagccuccuggggcaaaaaa

SEQ ID NO: 847490 - RNA, 21 nt, Human
aggaagggcugggcagguguu

SEQ ID NO: 847491 - RNA, 18 nt, Human
agggagcccacagcugug

SEQ ID NO: 847492 - RNA, 18 nt, Human
aguugguauuuaauggca

SEQ ID NO: 847493 - RNA, 23 nt, Human
caaugcaccguccgcuccgugac

SEQ ID NO: 847494 - RNA, 19 nt, Human
caccaacagccuguuccuu

SEQ ID NO: 847495 - RNA, 23 nt, Human
caccucuuccuucugcccaagug

SEQ ID NO: 847496 - RNA, 23 nt, Human
caccucuuccuucugcccaagug

SEQ ID NO: 847497 - RNA, 22 nt, Human
cacuguccccucccuggggccc

SEQ ID NO: 847498 - RNA, 22 nt, Human
cagaggccaucuaacaaacccu

SEQ ID NO: 847499 - RNA, 21 nt, Human
cagccucagggccucaccccc

SEQ ID NO: 847500 - RNA, 18 nt, Human
cagcuagcaccucuuccc

SEQ ID NO: 847501 - RNA, 20 nt, Human
caucacuaacaaugcaggga

SEQ ID NO: 847502 - RNA, 18 nt, Human
ccacuguccccucccugg

SEQ ID NO: 847503 - RNA, 21 nt, Human
cccacagagucagaggccauc

SEQ ID NO: 847504 - RNA, 26 nt, Human
cccccacuguccccucccuggggccc

SEQ ID NO: 847505 - RNA, 28 nt, Human
cccccacuguccccucccuggggcccac

SEQ ID NO: 847506 - RNA, 21 nt, Human
cccuggacagccucagggccu

SEQ ID NO: 847507 - RNA, 22 nt, Human
cccuggacagccucagggccuc

SEQ ID NO: 847508 - RNA, 21 nt, Human
ccucacccccacuguccccuc

SEQ ID NO: 847509 - RNA, 18 nt, Human
ccucagaagacccagcca

SEQ ID NO: 847510 - RNA, 24 nt, Human
ccuccuggggcaaaaaagucaagu

SEQ ID NO: 847511 - RNA, 20 nt, Human
ccuggacagccucagggccu

SEQ ID NO: 847512 - RNA, 21 nt, Human
ccuggacagccucagggccuc

SEQ ID NO: 847513 - RNA, 20 nt, Human
ccuuuuggggcagaagcagg

SEQ ID NO: 847514 - RNA, 24 nt, Human
cuagcaccucuuccuucugcccaa

SEQ ID NO: 847515 - RNA, 23 nt, Human
cucagacccuggacagccucagg

SEQ ID NO: 847516 - RNA, 23 nt, Human
cugccaccaacagccuguuccuu

SEQ ID NO: 847517 - RNA, 21 nt, Human
gaagggcugggcagguguuca

SEQ ID NO: 847518 - RNA, 21 nt, Human
gagcaccucagcagacaagga

SEQ ID NO: 847519 - RNA, 24 nt, Human
gagcccacagcugugaguccuugg

SEQ ID NO: 847520 - RNA, 25 nt, Human
gaggagcuggaagggagcccacagc

SEQ ID NO: 847521 - RNA, 20 nt, Human
gccccagguuaaagagugau

SEQ ID NO: 847522 - RNA, 19 nt, Human
gcuggaagggagcccacag

SEQ ID NO: 847523 - RNA, 19 nt, Human
ggaaagcucugugggagaa

SEQ ID NO: 847524 - RNA, 21 nt, Human
ggaggagcuggaagggagccc

SEQ ID NO: 847525 - RNA, 20 nt, Human
ggcaaaaaagucaaguugaa

SEQ ID NO: 847526 - RNA, 19 nt, Human
gggaggagcuggaagggag

SEQ ID NO: 847527 - RNA, 22 nt, Human
guaguucauuccacguaggccu

SEQ ID NO: 847528 - RNA, 21 nt, Human
uaacaaugcagggaaagcucu

SEQ ID NO: 847529 - RNA, 22 nt, Human
uacaccuuggucuguacaguac

SEQ ID NO: 847530 - RNA, 18 nt, Human
uagaagagcaaacuguuu

SEQ ID NO: 847531 - RNA, 19 nt, Human
uaggccucagaagacccag

SEQ ID NO: 847532 - RNA, 21 nt, Human
uaguucauuccacguaggccu

SEQ ID NO: 847533 - RNA, 18 nt, Human
ucacagcaggcaggggca

SEQ ID NO: 847534 - RNA, 19 nt, Human
ucacuaacaaugcagggaa

SEQ ID NO: 847535 - RNA, 19 nt, Human
ucauuccacguaggccuca

SEQ ID NO: 847536 - RNA, 26 nt, Human
ucccaccccagcacuaaaaggucggc

SEQ ID NO: 847537 - RNA, 19 nt, Human
uccccgggaggagccugcc

SEQ ID NO: 847538 - RNA, 20 nt, Human
ucccugcuggggccaaugcc

SEQ ID NO: 847539 - RNA, 18 nt, Human
ucugagcaccucagcaga

SEQ ID NO: 847540 - RNA, 21 nt, Human
ugaaucccacagagucagagg

SEQ ID NO: 847541 - RNA, 27 nt, Human
ugacaucaguugguauuuaauggcacu

SEQ ID NO: 847542 - RNA, 24 nt, Human
ugaguccuuggcaaugcaccgucc

SEQ ID NO: 847543 - RNA, 19 nt, Human
ugcuuugcccgacaucacu

SEQ ID NO: 847544 - RNA, 21 nt, Human
ugggaggagcuggaagggagc

SEQ ID NO: 847545 - RNA, 22 nt, Human
ugggaggagcuggaagggagcc

SEQ ID NO: 847546 - RNA, 21 nt, Human
uggggcccacagggcaggucc

SEQ ID NO: 847547 - RNA, 21 nt, Human
uguguaguucauuccacguag

SEQ ID NO: 847548 - RNA, 22 nt, Human
uucacagcaggcaggggcagca

SEQ ID NO: 847549 - RNA, 20 nt, Human
uuuuuuuuuuuuagaagagc

SEQ ID NO: 847550 - RNA, 23 nt, Human
aaaaaagccauuccauuucuaag

SEQ ID NO: 847551 - RNA, 18 nt, Human
aaaacaaaacaaaaaaag

SEQ ID NO: 847552 - RNA, 28 nt, Human
aaaacaaaacaaaacaaaaaaagccauu

SEQ ID NO: 847553 - RNA, 19 nt, Human
aaacaaaacaaaacaaaaa

SEQ ID NO: 847554 - RNA, 19 nt, Human
aaacaaacaaaucaguaga

SEQ ID NO: 847555 - RNA, 18 nt, Human
aaacaaggaaaacuaagc

SEQ ID NO: 847556 - RNA, 19 nt, Human
aaacaauaaaacaaaacaa

SEQ ID NO: 847557 - RNA, 24 nt, Human
aaaccaccuuacaauccauggggc

SEQ ID NO: 847558 - RNA, 20 nt, Human
aacaaaacaauaaaacaaaa

SEQ ID NO: 847559 - RNA, 19 nt, Human
aacaacaaaagccaaaaag

SEQ ID NO: 847560 - RNA, 18 nt, Human
acaaaacaaaaaaagcca

SEQ ID NO: 847561 - RNA, 23 nt, Human
acaaaacaaaaaaagccauucca

SEQ ID NO: 847562 - RNA, 23 nt, Human
acaaaacaaaacaaaaaaagcca

SEQ ID NO: 847563 - RNA, 23 nt, Human
acaaaacaauaaaacaaaacaaa

SEQ ID NO: 847564 - RNA, 27 nt, Human
acaaaacaauaaaacaaaacaaaacaa

SEQ ID NO: 847565 - RNA, 22 nt, Human
acaaaagccaaaaagggcaccu

SEQ ID NO: 847566 - RNA, 27 nt, Human
acaacaacaaaagccaaaaagggcacc

SEQ ID NO: 847567 - RNA, 28 nt, Human
acaacaacaaaagccaaaaagggcaccu

SEQ ID NO: 847568 - RNA, 19 nt, Human
acaacaacaacaaaagcca

SEQ ID NO: 847569 - RNA, 24 nt, Human
acaacaacaacaaaagccaaaaag

SEQ ID NO: 847570 - RNA, 21 nt, Human
accauaaccauaauggucauc

SEQ ID NO: 847571 - RNA, 21 nt, Human
accuuacaauccauggggcua

SEQ ID NO: 847572 - RNA, 20 nt, Human
caaaacaaaacaaaaaaagc

SEQ ID NO: 847573 - RNA, 26 nt, Human
caaaacaauaaaacaaaacaaaacaa

SEQ ID NO: 847574 - RNA, 23 nt, Human
caaaagccaaaaagggcaccugu

SEQ ID NO: 847575 - RNA, 20 nt, Human
cacugauguguaaucucacc

SEQ ID NO: 847576 - RNA, 25 nt, Human
caucuugcacugauguguaaucuca

SEQ ID NO: 847577 - RNA, 19 nt, Human
ccggcggagcuggcaccgg

SEQ ID NO: 847578 - RNA, 21 nt, Human
ccgggccgcgggcugugcugg

SEQ ID NO: 847579 - RNA, 21 nt, Human
ccucuggcauaaagagguaga

SEQ ID NO: 847580 - RNA, 23 nt, Human
ccucuggcauaaagagguagaga

SEQ ID NO: 847581 - RNA, 21 nt, Human
cgagccagguucccugcggga

SEQ ID NO: 847582 - RNA, 22 nt, Human
cgaugaguuccaaacacacuuu

SEQ ID NO: 847583 - RNA, 24 nt, Human
cuaucugaaaauguguuugguuac

SEQ ID NO: 847584 - RNA, 23 nt, Human
cucaguaaaccaccuuacaaucc

SEQ ID NO: 847585 - RNA, 20 nt, Human
cuggaggcccuccccgagcc

SEQ ID NO: 847586 - RNA, 21 nt, Human
gcaccgggccgcgggcugugc

SEQ ID NO: 847587 - RNA, 21 nt, Human
gcacugauguguaaucucacc

SEQ ID NO: 847588 - RNA, 18 nt, Human
gcugguuaaaaugugguc

SEQ ID NO: 847589 - RNA, 24 nt, Human
uaaaacaaaacaaaacaaaaaaag

SEQ ID NO: 847590 - RNA, 23 nt, Human
uaacucaguaaaccaccuuacaa

SEQ ID NO: 847591 - RNA, 31 nt, Human
uaauaaaaacaaaacaauaaaacaaaacaaa

SEQ ID NO: 847592 - RNA, 25 nt, Human
uacaaaaacaaacaaaucaguagau

SEQ ID NO: 847593 - RNA, 23 nt, Human
uacaacaacaacaaaagccaaaa

SEQ ID NO: 847594 - RNA, 31 nt, Human
uacaacaacaacaaaagccaaaaagggcacc

SEQ ID NO: 847595 - RNA, 23 nt, Human
uacaauccuccauuuuuccuuuc

SEQ ID NO: 847596 - RNA, 19 nt, Human
uagaaaagauuaacaauaa

SEQ ID NO: 847597 - RNA, 21 nt, Human
uagaugggagggguacuaggu

SEQ ID NO: 847598 - RNA, 22 nt, Human
uaguauuucucuuccaacacac

SEQ ID NO: 847599 - RNA, 18 nt, Human
uauacaaauauuucauuc

SEQ ID NO: 847600 - RNA, 20 nt, Human
ucaaacaaggaaaacuaagc

SEQ ID NO: 847601 - RNA, 18 nt, Human
ucagagcagguggccaca

SEQ ID NO: 847602 - RNA, 25 nt, Human
uccccaggcagucccgcgggagcuc

SEQ ID NO: 847603 - RNA, 18 nt, Human
uccccgagccagguuccc

SEQ ID NO: 847604 - RNA, 21 nt, Human
uccccgagccagguucccugc

SEQ ID NO: 847605 - RNA, 18 nt, Human
ucccugcgggagcaccgc

SEQ ID NO: 847606 - RNA, 22 nt, Human
ucccugcgggagcaccgcacuu

SEQ ID NO: 847607 - RNA, 25 nt, Human
ucccugcgggagcaccgcacuuugg

SEQ ID NO: 847608 - RNA, 21 nt, Human
ucccuguccccaggcaguccc

SEQ ID NO: 847609 - RNA, 26 nt, Human
ugccuacauauaaaugcgcacacaca

SEQ ID NO: 847610 - RNA, 19 nt, Human
ugcgcacacacauuaacuu

SEQ ID NO: 847611 - RNA, 25 nt, Human
uggcaaggcuaauuacagaaaaaga

SEQ ID NO: 847612 - RNA, 18 nt, Human
ugggagggguacuaggua

SEQ ID NO: 847613 - RNA, 19 nt, Human
uguuugguuacaaaaacaa

SEQ ID NO: 847614 - RNA, 23 nt, Human
uuacaacaacaacaaaagccaaa

SEQ ID NO: 847615 - RNA, 19 nt, Human
uucaaacaaggaaaacuaa

SEQ ID NO: 847616 - RNA, 22 nt, Human
uucagagcagguggccacaaag

SEQ ID NO: 847617 - RNA, 19 nt, Human
uucccugcgggagcaccgc

SEQ ID NO: 847618 - RNA, 20 nt, Human
uugguuacaaaaacaaacaa

SEQ ID NO: 847619 - RNA, 22 nt, Human
cagcagcagccgcggaccuacc

SEQ ID NO: 847620 - RNA, 24 nt, Human
gcagcagccgcggaccuaccccuc

SEQ ID NO: 847621 - RNA, 21 nt, Human
gcagccgcggaccuaccccuc

SEQ ID NO: 847622 - RNA, 21 nt, Human
uuuuuuuuuuuuuuuuuuguu

SEQ ID NO: 847623 - RNA, 27 nt, Human
uuuuuuuuuuuuuuuuuuuuuuugggg

SEQ ID NO: 847624 - RNA, 20 nt, Human
aaagcccucccuugccuccu

SEQ ID NO: 847625 - RNA, 18 nt, Human
aaccagggcccucugucc

SEQ ID NO: 847626 - RNA, 26 nt, Human
aacucaucuccccacaagagccucug

SEQ ID NO: 847627 - RNA, 18 nt, Human
aagcaagccccagucccc

SEQ ID NO: 847628 - RNA, 22 nt, Human
aagucccugucaugucuggcuc

SEQ ID NO: 847629 - RNA, 23 nt, Human
accaacucaucuccccacaagag

SEQ ID NO: 847630 - RNA, 19 nt, Human
acccugcaagucugaggag

SEQ ID NO: 847631 - RNA, 20 nt, Human
agccaccucuggcuucaccc

SEQ ID NO: 847632 - RNA, 21 nt, Human
aggagcaggugagccacugga

SEQ ID NO: 847633 - RNA, 21 nt, Human
aggcugaagggcuccccaggg

SEQ ID NO: 847634 - RNA, 19 nt, Human
caaaagcccaagagcucac

SEQ ID NO: 847635 - RNA, 24 nt, Human
caacucaucuccccacaagagccu

SEQ ID NO: 847636 - RNA, 18 nt, Human
caagaacgaaacaaaacu

SEQ ID NO: 847637 - RNA, 23 nt, Human
caccucuggcuucacccagacuc

SEQ ID NO: 847638 - RNA, 24 nt, Human
caccucuggcuucacccagacuca

SEQ ID NO: 847639 - RNA, 21 nt, Human
caccugggaagggccugguca

SEQ ID NO: 847640 - RNA, 23 nt, Human
caggaacauuugccacccugcaa

SEQ ID NO: 847641 - RNA, 22 nt, Human
caucuccccacaagagccucug

SEQ ID NO: 847642 - RNA, 23 nt, Human
ccaccugggaagggccuggucac

SEQ ID NO: 847643 - RNA, 22 nt, Human
ccagggcccucuguccuacuuc

SEQ ID NO: 847644 - RNA, 21 nt, Human
ccccucccuggucccucugcc

SEQ ID NO: 847645 - RNA, 24 nt, Human
cccucccuugccuccucucugcca

SEQ ID NO: 847646 - RNA, 25 nt, Human
ccgccaccgggaacgcgccgccugg

SEQ ID NO: 847647 - RNA, 24 nt, Human
ccucagccgagcuggccccucuug

SEQ ID NO: 847648 - RNA, 24 nt, Human
ccucuggcuucacccagacucauc

SEQ ID NO: 847649 - RNA, 23 nt, Human
ccuggcacgcuggcaccgcccac

SEQ ID NO: 847650 - RNA, 22 nt, Human
ccugggaagggccuggucacau

SEQ ID NO: 847651 - RNA, 20 nt, Human
ccuggucagacauggcuccu

SEQ ID NO: 847652 - RNA, 18 nt, Human
ccugugcacaccguggua

SEQ ID NO: 847653 - RNA, 22 nt, Human
cuaaagcccucccuugccuccu

SEQ ID NO: 847654 - RNA, 22 nt, Human
cucaggccucagccgagcuggc

SEQ ID NO: 847655 - RNA, 22 nt, Human
cuccuggcacgcuggcaccgcc

SEQ ID NO: 847656 - RNA, 23 nt, Human
cucucugccaaaccagggcccuc

SEQ ID NO: 847657 - RNA, 20 nt, Human
cuggcaccgcccacuccgcg

SEQ ID NO: 847658 - RNA, 19 nt, Human
cuggucccucugcccugug

SEQ ID NO: 847659 - RNA, 22 nt, Human
cuguggcaaggagcccaggugc

SEQ ID NO: 847660 - RNA, 18 nt, Human
cuguuccugagaugcccc

SEQ ID NO: 847661 - RNA, 24 nt, Human
cuuuaccaacucaucuccccacaa

SEQ ID NO: 847662 - RNA, 19 nt, Human
gcccucccuugccuccucu

SEQ ID NO: 847663 - RNA, 24 nt, Human
gcccucuguccuacuucaaaagcc

SEQ ID NO: 847664 - RNA, 21 nt, Human
gcucugcccugugcacaccgu

SEQ ID NO: 847665 - RNA, 19 nt, Human
gcugaagggcuccccaggg

SEQ ID NO: 847666 - RNA, 19 nt, Human
ggcuccuggcacgcuggca

SEQ ID NO: 847667 - RNA, 20 nt, Human
gggucccugagggacagcuu

SEQ ID NO: 847668 - RNA, 21 nt, Human
gucaugucuggcuccuguucc

SEQ ID NO: 847669 - RNA, 23 nt, Human
uaaagcaagccccaguccccacc

SEQ ID NO: 847670 - RNA, 20 nt, Human
uaaagcccucccuugccucc

SEQ ID NO: 847671 - RNA, 18 nt, Human
uaaccuggcaacaggaac

SEQ ID NO: 847672 - RNA, 24 nt, Human
uccccaccugggaagggccugguc

SEQ ID NO: 847673 - RNA, 24 nt, Human
ucccugagggacagcuuguugccc

SEQ ID NO: 847674 - RNA, 21 nt, Human
ucccuugccuccucucugcca

SEQ ID NO: 847675 - RNA, 21 nt, Human
uccgcgcugcacuggaaacca

SEQ ID NO: 847676 - RNA, 23 nt, Human
uccgcgcugcacuggaaaccaug

SEQ ID NO: 847677 - RNA, 22 nt, Human
ugagaugccccagcccaagaac

SEQ ID NO: 847678 - RNA, 21 nt, Human
ugcacuggaaaccaugggucc

SEQ ID NO: 847679 - RNA, 24 nt, Human
ugccccagcccaagaacgaaacaa

SEQ ID NO: 847680 - RNA, 19 nt, Human
ugcggaucaggcugaaggg

SEQ ID NO: 847681 - RNA, 20 nt, Human
uggcaaggagcccaggugca

SEQ ID NO: 847682 - RNA, 23 nt, Human
uggcaucaccaugaggaggccug

SEQ ID NO: 847683 - RNA, 22 nt, Human
uggcggcagcucugcccugugc

SEQ ID NO: 847684 - RNA, 22 nt, Human
ugggagggcaggugaggguccc

SEQ ID NO: 847685 - RNA, 20 nt, Human
uggucacaugggagggcagg

SEQ ID NO: 847686 - RNA, 19 nt, Human
uucucagauguucuaaagc

SEQ ID NO: 847687 - RNA, 20 nt, Human
uuuaccaacucaucucccca

SEQ ID NO: 847688 - RNA, 24 nt, Human
uuuuuuuuuuuuuuuuuuuauuuu

SEQ ID NO: 847689 - RNA, 26 nt, Human
aaaccaaaugaggucuccccaggcuc

SEQ ID NO: 847690 - RNA, 20 nt, Human
acaaaccccaucccaggugc

SEQ ID NO: 847691 - RNA, 24 nt, Human
caaaaucaacuugcccacaaaccc

SEQ ID NO: 847692 - RNA, 18 nt, Human
caaagaguauagcccgaa

SEQ ID NO: 847693 - RNA, 21 nt, Human
cacacugaagcugaaagacca

SEQ ID NO: 847694 - RNA, 22 nt, Human
cacacugaagcugaaagaccac

SEQ ID NO: 847695 - RNA, 21 nt, Human
cacagcccucgacagggcagg

SEQ ID NO: 847696 - RNA, 22 nt, Human
cacagcucagauccaacgggac

SEQ ID NO: 847697 - RNA, 19 nt, Human
cacaggacacucgaacggc

SEQ ID NO: 847698 - RNA, 22 nt, Human
caccacaucauccucccccgaa

SEQ ID NO: 847699 - RNA, 20 nt, Human
cacugaagcugaaagaccac

SEQ ID NO: 847700 - RNA, 23 nt, Human
cacuuuauaaacuguugccaaau

SEQ ID NO: 847701 - RNA, 23 nt, Human
cagggcagguaaaccuccgguca

SEQ ID NO: 847702 - RNA, 20 nt, Human
caucgucauguuuccuucug

SEQ ID NO: 847703 - RNA, 19 nt, Human
cauguuuccuucugugccu

SEQ ID NO: 847704 - RNA, 21 nt, Human
cccaggugcugggaugcuaac

SEQ ID NO: 847705 - RNA, 19 nt, Human
ccccccgagcucucggcua

SEQ ID NO: 847706 - RNA, 22 nt, Human
cccccgagcucucggcuaugaa

SEQ ID NO: 847707 - RNA, 18 nt, Human
ccccgaaaacuagcugcc

SEQ ID NO: 847708 - RNA, 20 nt, Human
cgaacggcuuugugccuagg

SEQ ID NO: 847709 - RNA, 21 nt, Human
cuagguggguuaugcuguggc

SEQ ID NO: 847710 - RNA, 21 nt, Human
cuguugccaaauuaccacuua

SEQ ID NO: 847711 - RNA, 21 nt, Human
cuucacgguggcaaugggacc

SEQ ID NO: 847712 - RNA, 22 nt, Human
gagguccucugucccaccacau

SEQ ID NO: 847713 - RNA, 26 nt, Human
gcacuuugcucacaaaggcaguuuca

SEQ ID NO: 847714 - RNA, 19 nt, Human
gcccacaaaccccauccca

SEQ ID NO: 847715 - RNA, 20 nt, Human
gcucaugucaugagucucag

SEQ ID NO: 847716 - RNA, 26 nt, Human
gcuuugugccuagguggguuaugcug

SEQ ID NO: 847717 - RNA, 21 nt, Human
ggccugcccaggccgaggcug

SEQ ID NO: 847718 - RNA, 18 nt, Human
ggccuugggccugcccag

SEQ ID NO: 847719 - RNA, 19 nt, Human
gguccagccacagcuguca

SEQ ID NO: 847720 - RNA, 24 nt, Human
gguggcaaugggaccaccugggcc

SEQ ID NO: 847721 - RNA, 18 nt, Human
gugcugggaugcuaacac

SEQ ID NO: 847722 - RNA, 22 nt, Human
uaaaacaaaaggaaaacauuuu

SEQ ID NO: 847723 - RNA, 24 nt, Human
uaaaacaaaaggaaaacauuuuug

SEQ ID NO: 847724 - RNA, 23 nt, Human
uaaaccuccggucaucggacccu

SEQ ID NO: 847725 - RNA, 21 nt, Human
uaaauguacccaaaagucuca

SEQ ID NO: 847726 - RNA, 24 nt, Human
uaacuaccauccccccgagcucuc

SEQ ID NO: 847727 - RNA, 18 nt, Human
uaauaggccacugagguc

SEQ ID NO: 847728 - RNA, 22 nt, Human
uaauauccaaauacagaauuua

SEQ ID NO: 847729 - RNA, 18 nt, Human
uagaaacugggcaacggc

SEQ ID NO: 847730 - RNA, 19 nt, Human
uagaauuuggcuucacggu

SEQ ID NO: 847731 - RNA, 22 nt, Human
uagagugaauguacagacugcu

SEQ ID NO: 847732 - RNA, 20 nt, Human
uauucagaacaucacuuuau

SEQ ID NO: 847733 - RNA, 22 nt, Human
ucaaaagggcuacgcuggucuu

SEQ ID NO: 847734 - RNA, 18 nt, Human
ucagaacaucacuuuaua

SEQ ID NO: 847735 - RNA, 18 nt, Human
ucauccucccccgaaaac

SEQ ID NO: 847736 - RNA, 19 nt, Human
uccaacgggacacggggaa

SEQ ID NO: 847737 - RNA, 20 nt, Human
ucccaccacaucauccuccc

SEQ ID NO: 847738 - RNA, 21 nt, Human
ucccaggugcugggaugcuaa

SEQ ID NO: 847739 - RNA, 20 nt, Human
ucccaggugcugggaugcuc

SEQ ID NO: 847740 - RNA, 23 nt, Human
uccccaggcucaugucaugaguc

SEQ ID NO: 847741 - RNA, 26 nt, Human
uccccaggcucaugucaugagucuca

SEQ ID NO: 847742 - RNA, 21 nt, Human
ucccccgaaaacuagcugccc

SEQ ID NO: 847743 - RNA, 20 nt, Human
ugaagagucuguugcaggua

SEQ ID NO: 847744 - RNA, 21 nt, Human
ugaggucuccccaggcucaug

SEQ ID NO: 847745 - RNA, 21 nt, Human
ugcagaagucuuuuucuuugu

SEQ ID NO: 847746 - RNA, 23 nt, Human
ugccaaagcacuuugcucacaaa

SEQ ID NO: 847747 - RNA, 23 nt, Human
ugcuacacagcucagauccaacg

SEQ ID NO: 847748 - RNA, 22 nt, Human
ugcucuggugaaugauuuccca

SEQ ID NO: 847749 - RNA, 22 nt, Human
ugcuguggccuuucagaugcuc

SEQ ID NO: 847750 - RNA, 21 nt, Human
ugcuuggaggugaagagucug

SEQ ID NO: 847751 - RNA, 22 nt, Human
uggcaaugggaccaccugggcc

SEQ ID NO: 847752 - RNA, 24 nt, Human
uggcaaugggaccaccugggcccu

SEQ ID NO: 847753 - RNA, 21 nt, Human
ugggaagagggcuccguaaua

SEQ ID NO: 847754 - RNA, 18 nt, Human
ugggcuagaauuuggcuu

SEQ ID NO: 847755 - RNA, 23 nt, Human
uggugaagguccagccacagcug

SEQ ID NO: 847756 - RNA, 18 nt, Human
uguaaugcaacaagugcu

SEQ ID NO: 847757 - RNA, 22 nt, Human
uguagugcaccuagcccugcug

SEQ ID NO: 847758 - RNA, 26 nt, Human
uuagagugaauguacagacuucaaag

SEQ ID NO: 847759 - RNA, 22 nt, Human
uugcagguagaaacugggcaac

SEQ ID NO: 847760 - RNA, 24 nt, Human
uugcagguagaaacugggcaacgg

SEQ ID NO: 847761 - RNA, 23 nt, Human
uuucagaugcucugcucugguga

SEQ ID NO: 847762 - RNA, 19 nt, Human
uuucccacagcccucgaca

SEQ ID NO: 847763 - RNA, 23 nt, Human
aaaaaaaucaucaucaacagcca

SEQ ID NO: 847764 - RNA, 18 nt, Human
aaacaaaaugccuggagc

SEQ ID NO: 847765 - RNA, 19 nt, Human
aacaaaaaugaccaaaaca

SEQ ID NO: 847766 - RNA, 23 nt, Human
aacuggcgagccugggccucuga

SEQ ID NO: 847767 - RNA, 25 nt, Human
aagcagacauaugggagaggucaga

SEQ ID NO: 847768 - RNA, 20 nt, Human
aagggguuucaccguauuag

SEQ ID NO: 847769 - RNA, 21 nt, Human
aagugucucuaccaagauccc

SEQ ID NO: 847770 - RNA, 23 nt, Human
aaguguuagaaaguagcccagcu

SEQ ID NO: 847771 - RNA, 19 nt, Human
acaagccaacuugugcggc

SEQ ID NO: 847772 - RNA, 25 nt, Human
acaauguuuccucuagaccuaugga

SEQ ID NO: 847773 - RNA, 20 nt, Human
acacaaccuaaaaaccgugg

SEQ ID NO: 847774 - RNA, 19 nt, Human
acagcucaugcagcagcag

SEQ ID NO: 847775 - RNA, 24 nt, Human
accaacccccuucacagaaaggcc

SEQ ID NO: 847776 - RNA, 26 nt, Human
accacacuagaauguacacuccggca

SEQ ID NO: 847777 - RNA, 18 nt, Human
accccaaacaaaaaugac

SEQ ID NO: 847778 - RNA, 25 nt, Human
accccaaacaaaaaugaccaaaaca

SEQ ID NO: 847779 - RNA, 19 nt, Human
acccgccaccaagcccggc

SEQ ID NO: 847780 - RNA, 21 nt, Human
acccuagagcuggaaaggccc

SEQ ID NO: 847781 - RNA, 22 nt, Human
acccuaucccuugguuccucug

SEQ ID NO: 847782 - RNA, 21 nt, Human
accgacacccguaagacccua

SEQ ID NO: 847783 - RNA, 22 nt, Human
acuacaggcacccgccaccaag

SEQ ID NO: 847784 - RNA, 24 nt, Human
acucaguguccccaagcucuucug

SEQ ID NO: 847785 - RNA, 18 nt, Human
acugcaagcuccgccucc

SEQ ID NO: 847786 - RNA, 20 nt, Human
acugcagccaccuacaguca

SEQ ID NO: 847787 - RNA, 23 nt, Human
agacaaaugccccagcuaucccc

SEQ ID NO: 847788 - RNA, 19 nt, Human
agacugccacgugaccggc

SEQ ID NO: 847789 - RNA, 21 nt, Human
agagcagccccagaaaagccc

SEQ ID NO: 847790 - RNA, 18 nt, Human
agaggcuguugugggcug

SEQ ID NO: 847791 - RNA, 19 nt, Human
agaggcuguugugggcugg

SEQ ID NO: 847792 - RNA, 18 nt, Human
agagggaagugucucuac

SEQ ID NO: 847793 - RNA, 23 nt, Human
agaggucagagaacuggcgagcc

SEQ ID NO: 847794 - RNA, 18 nt, Human
agccaccaguauacacca

SEQ ID NO: 847795 - RNA, 21 nt, Human
agccaggauggugaacaugcc

SEQ ID NO: 847796 - RNA, 24 nt, Human
agcccaggcuggagugcaguggug

SEQ ID NO: 847797 - RNA, 20 nt, Human
agccccagaaaagcccugac

SEQ ID NO: 847798 - RNA, 18 nt, Human
agcuccgccuccuggguu

SEQ ID NO: 847799 - RNA, 23 nt, Human
agcugcagcagaguccuaagcag

SEQ ID NO: 847800 - RNA, 19 nt, Human
aggagcccuggccaacagu

SEQ ID NO: 847801 - RNA, 22 nt, Human
aggagcccuggccaacaguuuc

SEQ ID NO: 847802 - RNA, 19 nt, Human
aggauggugaacaugccuu

SEQ ID NO: 847803 - RNA, 20 nt, Human
aggccagugcuaggugggga

SEQ ID NO: 847804 - RNA, 25 nt, Human
aggcuggagugcaguggugugaucu

SEQ ID NO: 847805 - RNA, 24 nt, Human
aggcuggccaucuugggcuggggc

SEQ ID NO: 847806 - RNA, 24 nt, Human
agggguuucaccguauuagccagg

SEQ ID NO: 847807 - RNA, 19 nt, Human
aggugcugggaccacugcu

SEQ ID NO: 847808 - RNA, 18 nt, Human
aguagcugggacuacagg

SEQ ID NO: 847809 - RNA, 19 nt, Human
aguagcugggacuacaggc

SEQ ID NO: 847810 - RNA, 19 nt, Human
agugcaguggugugaucuc

SEQ ID NO: 847811 - RNA, 20 nt, Human
agugcaguggugugaucucg

SEQ ID NO: 847812 - RNA, 23 nt, Human
agugcaguggugugaucucggcu

SEQ ID NO: 847813 - RNA, 24 nt, Human
agugcaguggugugaucucggcuc

SEQ ID NO: 847814 - RNA, 18 nt, Human
aguguccccaagcucuuc

SEQ ID NO: 847815 - RNA, 21 nt, Human
aucacacuuccgaaaaacaca

SEQ ID NO: 847816 - RNA, 25 nt, Human
aucaucaacagccaccaguauacac

SEQ ID NO: 847817 - RNA, 26 nt, Human
auccauccuucuguaaggucuacaua

SEQ ID NO: 847818 - RNA, 18 nt, Human
augcagcagcagugccca

SEQ ID NO: 847819 - RNA, 24 nt, Human
auucaaauucugggugacaauuuc

SEQ ID NO: 847820 - RNA, 24 nt, Human
caaaacagcauuaauauaaagaua

SEQ ID NO: 847821 - RNA, 21 nt, Human
caaacaaaaaugaccaaaaca

SEQ ID NO: 847822 - RNA, 20 nt, Human
caaaugccccagcuaucccc

SEQ ID NO: 847823 - RNA, 20 nt, Human
caacuugugcggcuguggcc

SEQ ID NO: 847824 - RNA, 23 nt, Human
caagagcagccccagaaaagccc

SEQ ID NO: 847825 - RNA, 21 nt, Human
caagggcaacugaaagugcug

SEQ ID NO: 847826 - RNA, 21 nt, Human
cacaugcaugccugccaccuc

SEQ ID NO: 847827 - RNA, 21 nt, Human
caccaagcccggcuaauuuuu

SEQ ID NO: 847828 - RNA, 27 nt, Human
caccagaaacaaaaugccuggagcuuc

SEQ ID NO: 847829 - RNA, 18 nt, Human
caccguauuagccaggau

SEQ ID NO: 847830 - RNA, 24 nt, Human
caccguauuagccaggauggugaa

SEQ ID NO: 847831 - RNA, 18 nt, Human
cacguuccaggaagguug

SEQ ID NO: 847832 - RNA, 18 nt, Human
cacuccaccacccacccc

SEQ ID NO: 847833 - RNA, 23 nt, Human
cacuccaccacccacccccuacc

SEQ ID NO: 847834 - RNA, 23 nt, Human
cacugccaccaacccccuucaca

SEQ ID NO: 847835 - RNA, 20 nt, Human
cacuuccgaaaaacacaagg

SEQ ID NO: 847836 - RNA, 19 nt, Human
cagaagacagugaggccac

SEQ ID NO: 847837 - RNA, 22 nt, Human
cagcacuccaccacccaccccc

SEQ ID NO: 847838 - RNA, 24 nt, Human
cagccaccaguauacaccacacua

SEQ ID NO: 847839 - RNA, 31 nt, Human
cagcuagacaaaugccccagcuauccccagg

SEQ ID NO: 847840 - RNA, 20 nt, Human
cagcugaaagcucuggacca

SEQ ID NO: 847841 - RNA, 23 nt, Human
cagcugcagccugggguuguggc

SEQ ID NO: 847842 - RNA, 21 nt, Human
caggagccuuccaggagcucu

SEQ ID NO: 847843 - RNA, 26 nt, Human
caggagccuuccaggagcucuggccg

SEQ ID NO: 847844 - RNA, 19 nt, Human
caggccagccagcccuggg

SEQ ID NO: 847845 - RNA, 22 nt, Human
caggccagccagcccuggguac

SEQ ID NO: 847846 - RNA, 23 nt, Human
caggggaggcugggucagaggca

SEQ ID NO: 847847 - RNA, 18 nt, Human
caguagcaccaagaccag

SEQ ID NO: 847848 - RNA, 21 nt, Human
caguauacaccacacuagaau

SEQ ID NO: 847849 - RNA, 25 nt, Human
caguguccccaagcucuucugcuug

SEQ ID NO: 847850 - RNA, 25 nt, Human
cauacagaaucuuaaaaaaaaaaaa

SEQ ID NO: 847851 - RNA, 20 nt, Human
cauggggaaacccagugcca

SEQ ID NO: 847852 - RNA, 27 nt, Human
ccaaacaaaaaugaccaaaacagcauu

SEQ ID NO: 847853 - RNA, 22 nt, Human
ccaaacaaaaaugaccaaaacc

SEQ ID NO: 847854 - RNA, 19 nt, Human
ccaacucugcaaaaaucgc

SEQ ID NO: 847855 - RNA, 19 nt, Human
ccaccacccacccccuacc

SEQ ID NO: 847856 - RNA, 19 nt, Human
ccaccaguauacaccacac

SEQ ID NO: 847857 - RNA, 20 nt, Human
ccagaagacagugaggccac

SEQ ID NO: 847858 - RNA, 18 nt, Human
ccagcuagacaaaugccc

SEQ ID NO: 847859 - RNA, 22 nt, Human
ccagcuauccccaggggaguua

SEQ ID NO: 847860 - RNA, 22 nt, Human
ccaggacacacagcucaugcag

SEQ ID NO: 847861 - RNA, 23 nt, Human
cccacccccuaccaguacagcug

SEQ ID NO: 847862 - RNA, 23 nt, Human
cccacuucgacucagugucccca

SEQ ID NO: 847863 - RNA, 20 nt, Human
cccaggcuggagugcagugg

SEQ ID NO: 847864 - RNA, 18 nt, Human
ccccagaaaagcccugac

SEQ ID NO: 847865 - RNA, 19 nt, Human
cccccuaccaguacagcug

SEQ ID NO: 847866 - RNA, 22 nt, Human
cccguaagacccuagagcugga

SEQ ID NO: 847867 - RNA, 24 nt, Human
cccugccucagccuccggaguagc

SEQ ID NO: 847868 - RNA, 19 nt, Human
ccggacacacaaccuaaaa

SEQ ID NO: 847869 - RNA, 24 nt, Human
ccggaguagcugggacuacaggca

SEQ ID NO: 847870 - RNA, 24 nt, Human
ccuacagucacaugcaugccugcc

SEQ ID NO: 847871 - RNA, 22 nt, Human
ccuccuggguucacaccauucc

SEQ ID NO: 847872 - RNA, 21 nt, Human
ccucugaagcagagaagcaga

SEQ ID NO: 847873 - RNA, 21 nt, Human
ccucugagacugcuggcugag

SEQ ID NO: 847874 - RNA, 19 nt, Human
cgccuccuggguucacacc

SEQ ID NO: 847875 - RNA, 22 nt, Human
cgcuggggagugggggagugcu

SEQ ID NO: 847876 - RNA, 21 nt, Human
cggggauucaggacaggccag

SEQ ID NO: 847877 - RNA, 18 nt, Human
cgucuauguuccucugag

SEQ ID NO: 847878 - RNA, 28 nt, Human
cuacagagaauuguguaaaaaaaaaaaa

SEQ ID NO: 847879 - RNA, 24 nt, Human
cucagccuccggaguagcugggac

SEQ ID NO: 847880 - RNA, 22 nt, Human
cucaggugcugggaccacugcu

SEQ ID NO: 847881 - RNA, 24 nt, Human
cugagaacagccagaagggucuau

SEQ ID NO: 847882 - RNA, 21 nt, Human
cugcagcauccuccugggcac

SEQ ID NO: 847883 - RNA, 19 nt, Human
cugccaccaacccccuuca

SEQ ID NO: 847884 - RNA, 23 nt, Human
cugccucagccuccggaguagcu

SEQ ID NO: 847885 - RNA, 23 nt, Human
cugccucccuccuuucucagcag

SEQ ID NO: 847886 - RNA, 19 nt, Human
cuggguucacaccauuccc

SEQ ID NO: 847887 - RNA, 18 nt, Human
gaagcagagaagcagagg

SEQ ID NO: 847888 - RNA, 20 nt, Human
gaagcaucacacuuccgaaa

SEQ ID NO: 847889 - RNA, 21 nt, Human
gaauuguguaaaaaaaaaaaa

SEQ ID NO: 847890 - RNA, 18 nt, Human
gagaaagagaggcuguug

SEQ ID NO: 847891 - RNA, 19 nt, Human
gagcaaaaaaggcucuaaa

SEQ ID NO: 847892 - RNA, 18 nt, Human
gaggagaaagagaggcug

SEQ ID NO: 847893 - RNA, 20 nt, Human
gaggagcccuggccaacagu

SEQ ID NO: 847894 - RNA, 23 nt, Human
gaggcuguugugggcugguucuu

SEQ ID NO: 847895 - RNA, 25 nt, Human
gaguagcugggacuacaggcacccg

SEQ ID NO: 847896 - RNA, 18 nt, Human
gagugcuuguauguggga

SEQ ID NO: 847897 - RNA, 18 nt, Human
gcagaguccuaagcagac

SEQ ID NO: 847898 - RNA, 26 nt, Human
gcauggaaucucccagagaaauucca

SEQ ID NO: 847899 - RNA, 21 nt, Human
gccaggcuucuuguggaccau

SEQ ID NO: 847900 - RNA, 20 nt, Human
gcccaggcuggagugcagug

SEQ ID NO: 847901 - RNA, 23 nt, Human
gcccaggcuggagugcaguggug

SEQ ID NO: 847902 - RNA, 18 nt, Human
gccccagaaaagcccuga

SEQ ID NO: 847903 - RNA, 25 nt, Human
gccccagaaaagcccugacaggaag

SEQ ID NO: 847904 - RNA, 24 nt, Human
gcccggcuaauuuuuuuguauuuu

SEQ ID NO: 847905 - RNA, 18 nt, Human
gcccugacaggaagggug

SEQ ID NO: 847906 - RNA, 21 nt, Human
gccggcacacaagggcaacug

SEQ ID NO: 847907 - RNA, 18 nt, Human
gccucccuccuuucucag

SEQ ID NO: 847908 - RNA, 19 nt, Human
gccucccuccuuucucagc

SEQ ID NO: 847909 - RNA, 20 nt, Human
gcuggccaucuugggcuggg

SEQ ID NO: 847910 - RNA, 24 nt, Human
gcuucaaucccauguccccacuuc

SEQ ID NO: 847911 - RNA, 18 nt, Human
ggaaaggcccaccuguga

SEQ ID NO: 847912 - RNA, 23 nt, Human
ggacagaaauaaccuaaaacaau

SEQ ID NO: 847913 - RNA, 19 nt, Human
ggagugcuuguauguggga

SEQ ID NO: 847914 - RNA, 18 nt, Human
ggaugccucaggugcugg

SEQ ID NO: 847915 - RNA, 18 nt, Human
ggaugccucaggugcugg

SEQ ID NO: 847916 - RNA, 19 nt, Human
ggcaaaguguuagaaagua

SEQ ID NO: 847917 - RNA, 20 nt, Human
ggcacgaugacagagggaag

SEQ ID NO: 847918 - RNA, 22 nt, Human
ggcuggagugcaguggugugau

SEQ ID NO: 847919 - RNA, 21 nt, Human
gggaggcugcaguauguggag

SEQ ID NO: 847920 - RNA, 18 nt, Human
gggguuucaccguauuag

SEQ ID NO: 847921 - RNA, 23 nt, Human
gggguuucaccguauuagccagg

SEQ ID NO: 847922 - RNA, 21 nt, Human
gguucacaccauuccccugcc

SEQ ID NO: 847923 - RNA, 21 nt, Human
gucuguggccacccacucccc

SEQ ID NO: 847924 - RNA, 26 nt, Human
gugaccccaaacaaaaaugaccaaaa

SEQ ID NO: 847925 - RNA, 21 nt, Human
gugaucucggcucacugcaag

SEQ ID NO: 847926 - RNA, 18 nt, Human
gugcugggaccacugcug

SEQ ID NO: 847927 - RNA, 26 nt, Human
uaauuuuuuuguauuuuuaguagaga

SEQ ID NO: 847928 - RNA, 21 nt, Human
uacauggccacaagaggagcc

SEQ ID NO: 847929 - RNA, 25 nt, Human
uagacaaaugccccagcuaucccca

SEQ ID NO: 847930 - RNA, 24 nt, Human
uagcaauaucucaauagugacccc

SEQ ID NO: 847931 - RNA, 23 nt, Human
uagcaauaucucaauagugacug

SEQ ID NO: 847932 - RNA, 24 nt, Human
uagcgggggauaaaccacaagccu

SEQ ID NO: 847933 - RNA, 21 nt, Human
uaguagagaagggguuucacc

SEQ ID NO: 847934 - RNA, 22 nt, Human
uaguagagaagggguuucaccg

SEQ ID NO: 847935 - RNA, 24 nt, Human
uaguagagaagggguuucaccgua

SEQ ID NO: 847936 - RNA, 21 nt, Human
uagucaccugcagcauccucc

SEQ ID NO: 847937 - RNA, 20 nt, Human
uagugaccccaaacaaaaau

SEQ ID NO: 847938 - RNA, 21 nt, Human
uauacaccacacuagaaugua

SEQ ID NO: 847939 - RNA, 26 nt, Human
uauacaccacacuagaauguacacuc

SEQ ID NO: 847940 - RNA, 24 nt, Human
uauuagccaggauggugaacaugc

SEQ ID NO: 847941 - RNA, 21 nt, Human
ucacaccauuccccugccuca

SEQ ID NO: 847942 - RNA, 18 nt, Human
ucaccugcagcauccucc

SEQ ID NO: 847943 - RNA, 22 nt, Human
ucaccugcagcauccuccuggg

SEQ ID NO: 847944 - RNA, 18 nt, Human
ucacugcaagcuccgccu

SEQ ID NO: 847945 - RNA, 23 nt, Human
ucacugcaagcuccgccuccugg

SEQ ID NO: 847946 - RNA, 24 nt, Human
ucacugcaagcuccgccuccuggg

SEQ ID NO: 847947 - RNA, 22 nt, Human
ucagcagucgucuauguuccuc

SEQ ID NO: 847948 - RNA, 23 nt, Human
ucagcagucgucuauguuccucu

SEQ ID NO: 847949 - RNA, 22 nt, Human
ucauucagcacuccaccaccca

SEQ ID NO: 847950 - RNA, 24 nt, Human
ucauucagcacuccaccacccacc

SEQ ID NO: 847951 - RNA, 21 nt, Human
uccauuccucauccaacuauu

SEQ ID NO: 847952 - RNA, 21 nt, Human
ucccaugacagcaggaugccu

SEQ ID NO: 847953 - RNA, 24 nt, Human
uccccugccucagccuccggagua

SEQ ID NO: 847954 - RNA, 24 nt, Human
uccggaguagcugggacuacaggc

SEQ ID NO: 847955 - RNA, 22 nt, Human
uccuggguucacaccauucccc

SEQ ID NO: 847956 - RNA, 22 nt, Human
ucuagugaggugggcacugcca

SEQ ID NO: 847957 - RNA, 28 nt, Human
ucuauaguugaaagauaaaccggggucc

SEQ ID NO: 847958 - RNA, 21 nt, Human
ucuauguuccucugagacugc

SEQ ID NO: 847959 - RNA, 23 nt, Human
ucuauguuccucugagacugcug

SEQ ID NO: 847960 - RNA, 21 nt, Human
ucugaagcagagaagcagagg

SEQ ID NO: 847961 - RNA, 21 nt, Human
ucugcugggagccuuccaaca

SEQ ID NO: 847962 - RNA, 24 nt, Human
ucugugcggacagccgaugcuggg

SEQ ID NO: 847963 - RNA, 21 nt, Human
ucuuuuuugagcccaggcugg

SEQ ID NO: 847964 - RNA, 22 nt, Human
ucuuuuuugagcccaggcugga

SEQ ID NO: 847965 - RNA, 24 nt, Human
ucuuuuuugagcccaggcuggagu

SEQ ID NO: 847966 - RNA, 21 nt, Human
ugaaagauaaacccaacucuu

SEQ ID NO: 847967 - RNA, 24 nt, Human
ugaacaggaauuggccaagccuug

SEQ ID NO: 847968 - RNA, 18 nt, Human
ugaccaaaacagcauuaa

SEQ ID NO: 847969 - RNA, 23 nt, Human
ugaccccaaacaaaaaugaccaa

SEQ ID NO: 847970 - RNA, 21 nt, Human
ugaccggcucucauccuugcu

SEQ ID NO: 847971 - RNA, 20 nt, Human
ugagaagccaucaggugggu

SEQ ID NO: 847972 - RNA, 18 nt, Human
ugagacugcuggcugaga

SEQ ID NO: 847973 - RNA, 19 nt, Human
ugaggacagcugcagcaga

SEQ ID NO: 847974 - RNA, 24 nt, Human
ugaggugggcacugccaccaaccc

SEQ ID NO: 847975 - RNA, 22 nt, Human
ugcaguggugugaucucggcuc

SEQ ID NO: 847976 - RNA, 20 nt, Human
ugcaugccugccaccucccu

SEQ ID NO: 847977 - RNA, 19 nt, Human
ugcauggaaucucccagag

SEQ ID NO: 847978 - RNA, 19 nt, Human
ugccaggcuucuuguggac

SEQ ID NO: 847979 - RNA, 20 nt, Human
ugcccuguggguagugggau

SEQ ID NO: 847980 - RNA, 24 nt, Human
ugccucagccuccggaguagcugg

SEQ ID NO: 847981 - RNA, 18 nt, Human
ugccuggagcuucugagc

SEQ ID NO: 847982 - RNA, 20 nt, Human
ugccuggagcuucugagcag

SEQ ID NO: 847983 - RNA, 18 nt, Human
uggaaaggcccaccugug

SEQ ID NO: 847984 - RNA, 19 nt, Human
uggagugcaguggugugau

SEQ ID NO: 847985 - RNA, 23 nt, Human
uggagugcaguggugugaucucg

SEQ ID NO: 847986 - RNA, 24 nt, Human
uggagugcaguggugugaucucgg

SEQ ID NO: 847987 - RNA, 22 nt, Human
uggcagccgcguuuaccacuga

SEQ ID NO: 847988 - RNA, 23 nt, Human
uggcaggccagccagcccugggu

SEQ ID NO: 847989 - RNA, 20 nt, Human
uggcagggagggucuguggc

SEQ ID NO: 847990 - RNA, 23 nt, Human
uggccaagccuugccaacuugau

SEQ ID NO: 847991 - RNA, 18 nt, Human
uggccggcacacaagggc

SEQ ID NO: 847992 - RNA, 19 nt, Human
uggccggcacacaagggca

SEQ ID NO: 847993 - RNA, 22 nt, Human
uggccucugcauggaaucuccc

SEQ ID NO: 847994 - RNA, 25 nt, Human
uggcugagaagccaucagguggguu

SEQ ID NO: 847995 - RNA, 27 nt, Human
uggcugagaagccaucagguggguucc

SEQ ID NO: 847996 - RNA, 21 nt, Human
ugggacuacaggcacccgcca

SEQ ID NO: 847997 - RNA, 22 nt, Human
ugggacuacaggcacccgccac

SEQ ID NO: 847998 - RNA, 24 nt, Human
ugggacuacaggcacccgccacca

SEQ ID NO: 847999 - RNA, 23 nt, Human
ugggagaggucagagaacuggcg

SEQ ID NO: 848000 - RNA, 22 nt, Human
ugggcuggggcucccugggcuu

SEQ ID NO: 848001 - RNA, 18 nt, Human
ugggcuugcaguggggag

SEQ ID NO: 848002 - RNA, 21 nt, Human
ugggcuugcaguggggagggu

SEQ ID NO: 848003 - RNA, 24 nt, Human
ugggcuugcaguggggagggucag

SEQ ID NO: 848004 - RNA, 20 nt, Human
uggucugagcuauggcaaag

SEQ ID NO: 848005 - RNA, 22 nt, Human
uguggaggagaaagagaggcug

SEQ ID NO: 848006 - RNA, 18 nt, Human
uguguaaaaaaaaaaaaa

SEQ ID NO: 848007 - RNA, 18 nt, Human
uuaguagagaagggguuu

SEQ ID NO: 848008 - RNA, 22 nt, Human
uuaguagagaagggguuucacc

SEQ ID NO: 848009 - RNA, 24 nt, Human
uuaguagagaagggguuucaccgu

SEQ ID NO: 848010 - RNA, 23 nt, Human
uucagcacuccaccacccacccc

SEQ ID NO: 848011 - RNA, 21 nt, Human
uucagcccagcccacagcccu

SEQ ID NO: 848012 - RNA, 19 nt, Human
uuccauuccucauccaacu

SEQ ID NO: 848013 - RNA, 19 nt, Human
uuccccugccucagccucc

SEQ ID NO: 848014 - RNA, 18 nt, Human
uucuuguggaccaugcag

SEQ ID NO: 848015 - RNA, 18 nt, Human
uugcaguggggaggguca

SEQ ID NO: 848016 - RNA, 22 nt, Human
uuggcagucaaagagaagcauc

SEQ ID NO: 848017 - RNA, 21 nt, Human
uugggcuggggcucccugggc

SEQ ID NO: 848018 - RNA, 19 nt, Human
uuguguaaaaaaaaaaaaa

SEQ ID NO: 848019 - RNA, 24 nt, Human
uuguguaaaaaaaaaaaaaucauc

SEQ ID NO: 848020 - RNA, 24 nt, Human
uuucuuuuuugagcccaggcugga

SEQ ID NO: 848021 - RNA, 24 nt, Human
uuuucuuuuuugagcccaggcugg

SEQ ID NO: 848022 - RNA, 24 nt, Human
uuuugagcccaggcuggagugcag

SEQ ID NO: 848023 - RNA, 24 nt, Human
uuuuuaguagagaagggguuucac

SEQ ID NO: 848024 - RNA, 21 nt, Human
uuuuuguauuuuuaguagaga

SEQ ID NO: 848025 - RNA, 18 nt, Human
uuuuuuguauuuuuagua

SEQ ID NO: 848026 - RNA, 21 nt, Human
uuuuuuguauuuuuaguagag

SEQ ID NO: 848027 - RNA, 18 nt, Human
uuuuuuuuuucuuuuuug

SEQ ID NO: 848028 - RNA, 25 nt, Human
uuuuuuuuuuuuuuuuuuucuuuuu

SEQ ID NO: 848029 - RNA, 23 nt, Human
aaccucacuccccguccccuccc

SEQ ID NO: 848030 - RNA, 25 nt, Human
aaccucacuccccguccccucccac

SEQ ID NO: 848031 - RNA, 19 nt, Human
aagcagcagccgugggccu

SEQ ID NO: 848032 - RNA, 22 nt, Human
aagcaggguucaaaucagcgug

SEQ ID NO: 848033 - RNA, 26 nt, Human
accucacuccccguccccucccacaa

SEQ ID NO: 848034 - RNA, 19 nt, Human
acugccagccaugcaccuc

SEQ ID NO: 848035 - RNA, 18 nt, Human
agcugccuccuucccugg

SEQ ID NO: 848036 - RNA, 19 nt, Human
aggaguggcuguggugaug

SEQ ID NO: 848037 - RNA, 23 nt, Human
agguggcagaaaccguggcagcu

SEQ ID NO: 848038 - RNA, 18 nt, Human
auaaagggacucggucuc

SEQ ID NO: 848039 - RNA, 18 nt, Human
auggcccuuuuguuuugg

SEQ ID NO: 848040 - RNA, 22 nt, Human
caaccucacuccccguccccuu

SEQ ID NO: 848041 - RNA, 20 nt, Human
cacacacgucgaagcagggu

SEQ ID NO: 848042 - RNA, 23 nt, Human
caccacacugcccaaccucacuc

SEQ ID NO: 848043 - RNA, 22 nt, Human
cacgcuagcuaccuccuccugu

SEQ ID NO: 848044 - RNA, 21 nt, Human
cagggagcacccuggccagau

SEQ ID NO: 848045 - RNA, 23 nt, Human
caguggccuggggcucggccucu

SEQ ID NO: 848046 - RNA, 24 nt, Human
ccaaccucacuccccguccccucc

SEQ ID NO: 848047 - RNA, 21 nt, Human
ccaccacacugcccaaccuca

SEQ ID NO: 848048 - RNA, 21 nt, Human
ccagcugggagccagggaccu

SEQ ID NO: 848049 - RNA, 18 nt, Human
ccaucuacagccuagcug

SEQ ID NO: 848050 - RNA, 22 nt, Human
ccaucucuucgcugucugucuc

SEQ ID NO: 848051 - RNA, 21 nt, Human
cccacgggccuggccugaccu

SEQ ID NO: 848052 - RNA, 19 nt, Human
ccccguccccucccacaaa

SEQ ID NO: 848053 - RNA, 24 nt, Human
cccucacacgcuagcuaccuccuc

SEQ ID NO: 848054 - RNA, 19 nt, Human
cccuuuuguuuuggugagg

SEQ ID NO: 848055 - RNA, 19 nt, Human
ccuagcugccuccuucccu

SEQ ID NO: 848056 - RNA, 23 nt, Human
ccuaucuccagcugggagccagg

SEQ ID NO: 848057 - RNA, 22 nt, Human
ccucacuccccguccccuccca

SEQ ID NO: 848058 - RNA, 19 nt, Human
ccuccuaucuccagcuggg

SEQ ID NO: 848059 - RNA, 21 nt, Human
ccuccuaucuccagcugggag

SEQ ID NO: 848060 - RNA, 19 nt, Human
ccuccugcuaccugccacc

SEQ ID NO: 848061 - RNA, 20 nt, Human
ccugaccucucucccccucc

SEQ ID NO: 848062 - RNA, 21 nt, Human
cgcuccugcugcugucgccgc

SEQ ID NO: 848063 - RNA, 21 nt, Human
cuagcuaccuccuccugugcu

SEQ ID NO: 848064 - RNA, 22 nt, Human
cucacacgcuagcuaccuccuc

SEQ ID NO: 848065 - RNA, 22 nt, Human
cucacuccccguccccucccac

SEQ ID NO: 848066 - RNA, 19 nt, Human
cucuaugcuagggguuuca

SEQ ID NO: 848067 - RNA, 18 nt, Human
cugcaggaguggcugugg

SEQ ID NO: 848068 - RNA, 19 nt, Human
cugcccaaccucacucccc

SEQ ID NO: 848069 - RNA, 21 nt, Human
cugcccaagacagguugacag

SEQ ID NO: 848070 - RNA, 19 nt, Human
cuuggaguggaaagucugu

SEQ ID NO: 848071 - RNA, 21 nt, Human
gaaacacuugggcacaaagag

SEQ ID NO: 848072 - RNA, 23 nt, Human
gcagacagcgccacggccaugac

SEQ ID NO: 848073 - RNA, 21 nt, Human
gcagggcagagauggcccuuu

SEQ ID NO: 848074 - RNA, 23 nt, Human
gccacggccaugacgcuccugcu

SEQ ID NO: 848075 - RNA, 23 nt, Human
gccggcgcagacagcgccacggc

SEQ ID NO: 848076 - RNA, 18 nt, Human
ggauccaguaagcgagug

SEQ ID NO: 848077 - RNA, 20 nt, Human
ggaugggugaucugggccuc

SEQ ID NO: 848078 - RNA, 21 nt, Human
ggggaggaugggugaucuggg

SEQ ID NO: 848079 - RNA, 20 nt, Human
ggugcccauccaccacacug

SEQ ID NO: 848080 - RNA, 18 nt, Human
guggcuguggugaugaug

SEQ ID NO: 848081 - RNA, 21 nt, Human
uacagccuagcugccuccuuc

SEQ ID NO: 848082 - RNA, 22 nt, Human
uacccacgggccuggccugacc

SEQ ID NO: 848083 - RNA, 19 nt, Human
uagcugccuccuucccugg

SEQ ID NO: 848084 - RNA, 20 nt, Human
uagcugccuccuucccuggu

SEQ ID NO: 848085 - RNA, 23 nt, Human
uagugccaacccucacacgcuag

SEQ ID NO: 848086 - RNA, 19 nt, Human
ucagcgugugcgcugguga

SEQ ID NO: 848087 - RNA, 19 nt, Human
uccaccacacugcccaacc

SEQ ID NO: 848088 - RNA, 20 nt, Human
uccccguccccucccacaaa

SEQ ID NO: 848089 - RNA, 21 nt, Human
uccugcugcugucgccgccgc

SEQ ID NO: 848090 - RNA, 25 nt, Human
uccugcugcugucgccgccgcuguu

SEQ ID NO: 848091 - RNA, 22 nt, Human
ucuccagcugggagccagggac

SEQ ID NO: 848092 - RNA, 19 nt, Human
ucugggccuccugcuaccu

SEQ ID NO: 848093 - RNA, 19 nt, Human
ugaccucucucccccuccc

SEQ ID NO: 848094 - RNA, 20 nt, Human
ugaccucucucccccucccc

SEQ ID NO: 848095 - RNA, 20 nt, Human
ugagggagagagggaaacac

SEQ ID NO: 848096 - RNA, 19 nt, Human
ugcaggaguggcuguggug

SEQ ID NO: 848097 - RNA, 18 nt, Human
ugcccaagacagguugac

SEQ ID NO: 848098 - RNA, 22 nt, Human
ugcucuuugcaagcgcugcgcu

SEQ ID NO: 848099 - RNA, 21 nt, Human
ugcuuggaguggaaagucugu

SEQ ID NO: 848100 - RNA, 21 nt, Human
uggcagcugcaggaguggcug

SEQ ID NO: 848101 - RNA, 25 nt, Human
uggcagcugcaggaguggcuguggu

SEQ ID NO: 848102 - RNA, 18 nt, Human
ugggccuccuaucuccag

SEQ ID NO: 848103 - RNA, 19 nt, Human
ugggugaucugggccuccu

SEQ ID NO: 848104 - RNA, 22 nt, Human
uucccuggucaacccuuccugg

SEQ ID NO: 848105 - RNA, 21 nt, Human
uucucugucugguucugcaag

SEQ ID NO: 848106 - RNA, 19 nt, Human
uuucacacaacucuacacc

SEQ ID NO: 848107 - RNA, 18 nt, Human
uuuuguuuuggugaggga

SEQ ID NO: 848108 - RNA, 20 nt, Human
aaaaagaaaaaagaaguuca

SEQ ID NO: 848109 - RNA, 24 nt, Human
aaaggccgggugcaguggcucaug

SEQ ID NO: 848110 - RNA, 24 nt, Human
aaagugcugggauuauaggcguga

SEQ ID NO: 848111 - RNA, 19 nt, Human
aaauccuguacuuccuguu

SEQ ID NO: 848112 - RNA, 20 nt, Human
aacacagugagauccccauc

SEQ ID NO: 848113 - RNA, 21 nt, Human
aacacagugagauccccaucu

SEQ ID NO: 848114 - RNA, 22 nt, Human
aacacagugagauccccaucuc

SEQ ID NO: 848115 - RNA, 22 nt, Human
aagccagcaugacagcaaagaa

SEQ ID NO: 848116 - RNA, 19 nt, Human
aaguagcugggacuacagg

SEQ ID NO: 848117 - RNA, 20 nt, Human
aaguagcugggacuacaggc

SEQ ID NO: 848118 - RNA, 24 nt, Human
aaguagcugggacuacaggcacac

SEQ ID NO: 848119 - RNA, 19 nt, Human
aagugcugggauuauaggc

SEQ ID NO: 848120 - RNA, 19 nt, Human
aagugcugggauuauaggc

SEQ ID NO: 848121 - RNA, 26 nt, Human
aagugcugggauuauaggcgugagcc

SEQ ID NO: 848122 - RNA, 18 nt, Human
aaugaaacaaaacauaca

SEQ ID NO: 848123 - RNA, 21 nt, Human
acaccagggccugucagggga

SEQ ID NO: 848124 - RNA, 21 nt, Human
acaggguuucaccauguuggc

SEQ ID NO: 848125 - RNA, 24 nt, Human
acaggguuucaccauguuggccag

SEQ ID NO: 848126 - RNA, 25 nt, Human
acaggguuucaccauguuggccagg

SEQ ID NO: 848127 - RNA, 24 nt, Human
accacugugcuucagccuaggcga

SEQ ID NO: 848128 - RNA, 24 nt, Human
acugugcuucagccuaggcgauag

SEQ ID NO: 848129 - RNA, 26 nt, Human
acugugcuucagccuaggcgauagag

SEQ ID NO: 848130 - RNA, 21 nt, Human
agaaaaaaugagacgggucug

SEQ ID NO: 848131 - RNA, 21 nt, Human
agcaugacagcaaagaaagga

SEQ ID NO: 848132 - RNA, 24 nt, Human
agccuaggcgauagagcgaggccu

SEQ ID NO: 848133 - RNA, 22 nt, Human
agccucaccacaaaaaugacaa

SEQ ID NO: 848134 - RNA, 24 nt, Human
agccuggccaacacagugagaucc

SEQ ID NO: 848135 - RNA, 19 nt, Human
aggaggucaaggcugcagc

SEQ ID NO: 848136 - RNA, 20 nt, Human
aggaguuugagaccagccug

SEQ ID NO: 848137 - RNA, 24 nt, Human
aggauugcuugagcccaggaguuu

SEQ ID NO: 848138 - RNA, 26 nt, Human
aggcaggaaauaaauaguaacaccaa

SEQ ID NO: 848139 - RNA, 27 nt, Human
aggcaggaaauaaauaguaagggaccc

SEQ ID NO: 848140 - RNA, 18 nt, Human
aggcaggaggauggcuug

SEQ ID NO: 848141 - RNA, 21 nt, Human
aggccaaggugggaggauugc

SEQ ID NO: 848142 - RNA, 24 nt, Human
aggccaaggugggaggauugcuug

SEQ ID NO: 848143 - RNA, 19 nt, Human
aggcgugagccacugcgcc

SEQ ID NO: 848144 - RNA, 18 nt, Human
aggcuggagugcaguggc

SEQ ID NO: 848145 - RNA, 24 nt, Human
aggugaucugcuuacuucggccuc

SEQ ID NO: 848146 - RNA, 23 nt, Human
aggugggaggauugcuugagccc

SEQ ID NO: 848147 - RNA, 22 nt, Human
aguagagacaggguuucaccau

SEQ ID NO: 848148 - RNA, 22 nt, Human
agugagauccccaucucuaaaa

SEQ ID NO: 848149 - RNA, 23 nt, Human
agugcaguggcguaauuuuggcu

SEQ ID NO: 848150 - RNA, 24 nt, Human
agugcaguggcguaauuuuggcuc

SEQ ID NO: 848151 - RNA, 23 nt, Human
aguggcucaugccuguaaucuca

SEQ ID NO: 848152 - RNA, 24 nt, Human
auaauaaaaauagaaaaaaugaga

SEQ ID NO: 848153 - RNA, 23 nt, Human
aucgcaccacugugcuucagccu

SEQ ID NO: 848154 - RNA, 23 nt, Human
augaaaaaaaaaaaagacaacca

SEQ ID NO: 848155 - RNA, 27 nt, Human
augaaacaaaacauacaaccaagccuc

SEQ ID NO: 848156 - RNA, 19 nt, Human
augccuguaaucucaauac

SEQ ID NO: 848157 - RNA, 24 nt, Human
augcugaggcaggaggauggcuug

SEQ ID NO: 848158 - RNA, 18 nt, Human
auguguaugugugugugu

SEQ ID NO: 848159 - RNA, 25 nt, Human
auucugcacguguaccccagaacuu

SEQ ID NO: 848160 - RNA, 24 nt, Human
caaaggcaaggaauaggguuuuug

SEQ ID NO: 848161 - RNA, 24 nt, Human
caaagugcugggauuauaggcgug

SEQ ID NO: 848162 - RNA, 24 nt, Human
caaccgugugagguaaugcauuug

SEQ ID NO: 848163 - RNA, 22 nt, Human
caauacuuugaggccaaggugg

SEQ ID NO: 848164 - RNA, 23 nt, Human
caauacuuugaggccaagguggg

SEQ ID NO: 848165 - RNA, 23 nt, Human
cacacaacaccacaucaggcuaa

SEQ ID NO: 848166 - RNA, 22 nt, Human
caccauguuggccagguuuguc

SEQ ID NO: 848167 - RNA, 24 nt, Human
caccauguuggccagguuugucuu

SEQ ID NO: 848168 - RNA, 18 nt, Human
cacgugcauaccuaugua

SEQ ID NO: 848169 - RNA, 21 nt, Human
cacuaccuugcacugaaagca

SEQ ID NO: 848170 - RNA, 21 nt, Human
cacugcaaccuccgccuccca

SEQ ID NO: 848171 - RNA, 19 nt, Human
cacugugcuucagccuagg

SEQ ID NO: 848172 - RNA, 20 nt, Human
cacugugcuucagccuaggc

SEQ ID NO: 848173 - RNA, 22 nt, Human
cacugugcuucagccuaggcga

SEQ ID NO: 848174 - RNA, 23 nt, Human
cacugugcuucagccuaggcgau

SEQ ID NO: 848175 - RNA, 23 nt, Human
cagagccccggaacagcgguguu

SEQ ID NO: 848176 - RNA, 19 nt, Human
cagcaaagaaaggacggac

SEQ ID NO: 848177 - RNA, 21 nt, Human
cagcaugacagcaaagaaagg

SEQ ID NO: 848178 - RNA, 22 nt, Human
cagcaugacagcaaagaaagga

SEQ ID NO: 848179 - RNA, 21 nt, Human
cagccuaggcgauagagcgag

SEQ ID NO: 848180 - RNA, 23 nt, Human
cagcuacucgggaggccccagcc

SEQ ID NO: 848181 - RNA, 19 nt, Human
cagcuuaaccugagggugg

SEQ ID NO: 848182 - RNA, 24 nt, Human
caggguuucaccauguuggccagg

SEQ ID NO: 848183 - RNA, 20 nt, Human
cagucgaggcgagcagagcc

SEQ ID NO: 848184 - RNA, 20 nt, Human
cauacaaccaagccucacca

SEQ ID NO: 848185 - RNA, 22 nt, Human
cauacaaccaagccucaccaca

SEQ ID NO: 848186 - RNA, 20 nt, Human
caugccuguaaucucaauac

SEQ ID NO: 848187 - RNA, 24 nt, Human
caugccuguaaucucaauacuuug

SEQ ID NO: 848188 - RNA, 22 nt, Human
ccaaagugcugggauuauaggc

SEQ ID NO: 848189 - RNA, 24 nt, Human
ccaaagugcugggauuauaggcgu

SEQ ID NO: 848190 - RNA, 19 nt, Human
ccacugugcuucagccuag

SEQ ID NO: 848191 - RNA, 20 nt, Human
ccacugugcuucagccuagg

SEQ ID NO: 848192 - RNA, 20 nt, Human
ccacugugcuucagccuagg

SEQ ID NO: 848193 - RNA, 21 nt, Human
ccacugugcuucagccuaggc

SEQ ID NO: 848194 - RNA, 22 nt, Human
ccagcccaugaaauccuguacu

SEQ ID NO: 848195 - RNA, 18 nt, Human
ccauggcacgugcauacc

SEQ ID NO: 848196 - RNA, 18 nt, Human
ccccuuaggcccacuacc

SEQ ID NO: 848197 - RNA, 26 nt, Human
ccgccucccagguucaagcaauucuu

SEQ ID NO: 848198 - RNA, 23 nt, Human
ccuaaguagcugggacuacaggc

SEQ ID NO: 848199 - RNA, 24 nt, Human
ccuaaguagcugggacuacaggca

SEQ ID NO: 848200 - RNA, 23 nt, Human
ccuaccucagccuccuaaguagc

SEQ ID NO: 848201 - RNA, 21 nt, Human
ccucauggucugccucgugcc

SEQ ID NO: 848202 - RNA, 24 nt, Human
ccucccagguucaagcaauucucc

SEQ ID NO: 848203 - RNA, 24 nt, Human
cgaccucaggugaucugcuuacuu

SEQ ID NO: 848204 - RNA, 21 nt, Human
cgagcagagccagcccaugaa

SEQ ID NO: 848205 - RNA, 19 nt, Human
cgcuccucugcagugaccu

SEQ ID NO: 848206 - RNA, 24 nt, Human
cucacugcaaccuccgccucccag

SEQ ID NO: 848207 - RNA, 24 nt, Human
cucagccuccuaaguagcugggac

SEQ ID NO: 848208 - RNA, 24 nt, Human
cucaugccuguaaucucaauacuu

SEQ ID NO: 848209 - RNA, 19 nt, Human
cucauggucugccucgugc

SEQ ID NO: 848210 - RNA, 24 nt, Human
cucgcucuguugcccaggcuggag

SEQ ID NO: 848211 - RNA, 20 nt, Human
cucuguugcccaggcuggag

SEQ ID NO: 848212 - RNA, 23 nt, Human
cugcaaccuccgccucccagguu

SEQ ID NO: 848213 - RNA, 24 nt, Human
cugcaaccuccgccucccagguuc

SEQ ID NO: 848214 - RNA, 22 nt, Human
cugucaauuuaaaaauaaaaau

SEQ ID NO: 848215 - RNA, 18 nt, Human
gaaaggacggacccagag

SEQ ID NO: 848216 - RNA, 23 nt, Human
gaccgcuccucugcagugaccug

SEQ ID NO: 848217 - RNA, 21 nt, Human
gacuacaggcacacaacacca

SEQ ID NO: 848218 - RNA, 20 nt, Human
gagaaaggccgggugcagug

SEQ ID NO: 848219 - RNA, 23 nt, Human
gagaccagccuggccaacacagu

SEQ ID NO: 848220 - RNA, 18 nt, Human
gaggagacuccaaggaug

SEQ ID NO: 848221 - RNA, 20 nt, Human
gaggcgagcagagccagccc

SEQ ID NO: 848222 - RNA, 21 nt, Human
gaggcgagcagagccagccca

SEQ ID NO: 848223 - RNA, 21 nt, Human
gauaucagggaaugaaaggga

SEQ ID NO: 848224 - RNA, 24 nt, Human
gauguaaaaacaugaaugaaacaa

SEQ ID NO: 848225 - RNA, 18 nt, Human
gauuauaggcgugagcca

SEQ ID NO: 848226 - RNA, 22 nt, Human
gauuauaggcgugagccacugc

SEQ ID NO: 848227 - RNA, 22 nt, Human
gauuauaggcgugagccacugc

SEQ ID NO: 848228 - RNA, 22 nt, Human
gauugcuugagcccaggaguuu

SEQ ID NO: 848229 - RNA, 24 nt, Human
gauugcuugagcccaggaguuuga

SEQ ID NO: 848230 - RNA, 22 nt, Human
gcaaagaaaggacggacccaga

SEQ ID NO: 848231 - RNA, 19 nt, Human
gcaagccagcaugacagca

SEQ ID NO: 848232 - RNA, 18 nt, Human
gcaugacagcaaagaaag

SEQ ID NO: 848233 - RNA, 22 nt, Human
gcccaggaguuugagaccagcc

SEQ ID NO: 848234 - RNA, 20 nt, Human
gcccaggcuggagugcagug

SEQ ID NO: 848235 - RNA, 24 nt, Human
gcccaggcuggagugcaguggcgu

SEQ ID NO: 848236 - RNA, 18 nt, Human
gcuacuguggaugcugag

SEQ ID NO: 848237 - RNA, 19 nt, Human
gcuacuguggaugcugagg

SEQ ID NO: 848238 - RNA, 20 nt, Human
gcuacuguggaugcugaggc

SEQ ID NO: 848239 - RNA, 25 nt, Human
gcucuguugcccaggcuggagugca

SEQ ID NO: 848240 - RNA, 19 nt, Human
gcuggagugcaguggcgua

SEQ ID NO: 848241 - RNA, 23 nt, Human
ggaaauaccuaauguaggugaca

SEQ ID NO: 848242 - RNA, 19 nt, Human
ggaucgcaucaaacagcaa

SEQ ID NO: 848243 - RNA, 22 nt, Human
ggaugcugaggcaggaggaugg

SEQ ID NO: 848244 - RNA, 22 nt, Human
ggauugcuugagcccaggaguu

SEQ ID NO: 848245 - RNA, 23 nt, Human
ggccgggugcaguggcucaugcc

SEQ ID NO: 848246 - RNA, 18 nt, Human
ggccugucaggggaugga

SEQ ID NO: 848247 - RNA, 24 nt, Human
ggcgagcagagccagcccaugaaa

SEQ ID NO: 848248 - RNA, 24 nt, Human
gggaggccccagcccagcaggagc

SEQ ID NO: 848249 - RNA, 23 nt, Human
gggauggagggcuaggggaggga

SEQ ID NO: 848250 - RNA, 24 nt, Human
ggggaacaucacacaccagggccu

SEQ ID NO: 848251 - RNA, 24 nt, Human
gggugcaguggcucaugccuguaa

SEQ ID NO: 848252 - RNA, 22 nt, Human
ggguuucaccauguuggccagg

SEQ ID NO: 848253 - RNA, 19 nt, Human
gugcauaccuauguaacaa

SEQ ID NO: 848254 - RNA, 24 nt, Human
guuuuaguagagacaggguuucac

SEQ ID NO: 848255 - RNA, 18 nt, Human
uaaauguguaugugugug

SEQ ID NO: 848256 - RNA, 20 nt, Human
uaaugcauuugugagcuaga

SEQ ID NO: 848257 - RNA, 26 nt, Human
uaauuuuuuuguaguuuuaguagaga

SEQ ID NO: 848258 - RNA, 24 nt, Human
uaccucagccuccuaaguagcugg

SEQ ID NO: 848259 - RNA, 18 nt, Human
uacuuugaggccaaggug

SEQ ID NO: 848260 - RNA, 22 nt, Human
uagagacaggguuucaccaugu

SEQ ID NO: 848261 - RNA, 24 nt, Human
uagagcgaggccuugucucuaaaa

SEQ ID NO: 848262 - RNA, 24 nt, Human
uaguagagacaggguuucaccaug

SEQ ID NO: 848263 - RNA, 26 nt, Human
uaguagagacaggguuucaccauguu

SEQ ID NO: 848264 - RNA, 23 nt, Human
uauaggcgugagccacugcgccu

SEQ ID NO: 848265 - RNA, 23 nt, Human
uaucuguacuuccagcuacucgg

SEQ ID NO: 848266 - RNA, 24 nt, Human
uaucuguacuuccagcuacucggg

SEQ ID NO: 848267 - RNA, 18 nt, Human
uauguguguguguauaca

SEQ ID NO: 848268 - RNA, 24 nt, Human
uauuuuuuuuuuuuuuuugcccag

SEQ ID NO: 848269 - RNA, 26 nt, Human
uauuuuuuuuuuuuuuuugcccaggg

SEQ ID NO: 848270 - RNA, 22 nt, Human
ucaaacagcaauauugauaagc

SEQ ID NO: 848271 - RNA, 19 nt, Human
ucacugcaaccuccgccuc

SEQ ID NO: 848272 - RNA, 23 nt, Human
ucacugcaaccuccgccucccag

SEQ ID NO: 848273 - RNA, 24 nt, Human
ucacugcaaccuccgccucccagg

SEQ ID NO: 848274 - RNA, 27 nt, Human
ucacugcaaccuccgccucccagguuc

SEQ ID NO: 848275 - RNA, 24 nt, Human
ucccaaagugcugggauuauaggc

SEQ ID NO: 848276 - RNA, 21 nt, Human
ucccagguucaagcaauucuc

SEQ ID NO: 848277 - RNA, 23 nt, Human
ucccagguucaagcaauucuccu

SEQ ID NO: 848278 - RNA, 24 nt, Human
uccuaaguagcugggacuacaggc

SEQ ID NO: 848279 - RNA, 19 nt, Human
ucgcaccacugugcuucag

SEQ ID NO: 848280 - RNA, 24 nt, Human
ucgcucuguugcccaggcuggagu

SEQ ID NO: 848281 - RNA, 24 nt, Human
ucuccuaccucagccuccuaagua

SEQ ID NO: 848282 - RNA, 19 nt, Human
ucucgcucuguugcccagg

SEQ ID NO: 848283 - RNA, 23 nt, Human
ucucgcucuguugcccaggcugg

SEQ ID NO: 848284 - RNA, 24 nt, Human
ucucgcucuguugcccaggcugga

SEQ ID NO: 848285 - RNA, 26 nt, Human
ucucgcucuguugcccaggcuggagu

SEQ ID NO: 848286 - RNA, 27 nt, Human
ucucgcucuguugcccaggcuggagug

SEQ ID NO: 848287 - RNA, 21 nt, Human
ucucuaaaauaauaaaaauag

SEQ ID NO: 848288 - RNA, 23 nt, Human
ucugcagugaccugcagaccccc

SEQ ID NO: 848289 - RNA, 18 nt, Human
ucuguugcccaggcugga

SEQ ID NO: 848290 - RNA, 24 nt, Human
ucuguugcccaggcuggagugcag

SEQ ID NO: 848291 - RNA, 24 nt, Human
ugaaaaaaaaaaaagacaaccaaa

SEQ ID NO: 848292 - RNA, 20 nt, Human
ugaaagggauuaaaagcuuu

SEQ ID NO: 848293 - RNA, 25 nt, Human
ugaaaucucugagauaucagggaau

SEQ ID NO: 848294 - RNA, 24 nt, Human
ugaaugaaacaaaacauacaaccc

SEQ ID NO: 848295 - RNA, 22 nt, Human
ugacaaccgugugagguaaugc

SEQ ID NO: 848296 - RNA, 22 nt, Human
ugacagcaaagaaaggacggac

SEQ ID NO: 848297 - RNA, 18 nt, Human
ugagaccagccuggccaa

SEQ ID NO: 848298 - RNA, 23 nt, Human
ugagcccaggaguuugagaccag

SEQ ID NO: 848299 - RNA, 23 nt, Human
ugagcuagauuuaaccauuccca

SEQ ID NO: 848300 - RNA, 18 nt, Human
ugaggcaggaggauggcu

SEQ ID NO: 848301 - RNA, 19 nt, Human
ugaggcaggaggauggcuu

SEQ ID NO: 848302 - RNA, 19 nt, Human
ugcacauucugcacgugua

SEQ ID NO: 848303 - RNA, 22 nt, Human
ugcaguggcguaauuuuggcuc

SEQ ID NO: 848304 - RNA, 18 nt, Human
ugcccaggcuggagugca

SEQ ID NO: 848305 - RNA, 21 nt, Human
ugcccaggcuggagugcagug

SEQ ID NO: 848306 - RNA, 22 nt, Human
ugcccaggcuggagugcagugg

SEQ ID NO: 848307 - RNA, 24 nt, Human
ugcccaggcuggagugcaguggcg

SEQ ID NO: 848308 - RNA, 23 nt, Human
ugcuucagccuaggcgauagagc

SEQ ID NO: 848309 - RNA, 18 nt, Human
ugcuugagcccaggaguu

SEQ ID NO: 848310 - RNA, 19 nt, Human
uggagugcaguggcguaau

SEQ ID NO: 848311 - RNA, 23 nt, Human
uggagugcaguggcguaauuuug

SEQ ID NO: 848312 - RNA, 24 nt, Human
uggagugcaguggcguaauuuugg

SEQ ID NO: 848313 - RNA, 21 nt, Human
uggccagguuugucuugaacu

SEQ ID NO: 848314 - RNA, 19 nt, Human
uggcguaauuuuggcucac

SEQ ID NO: 848315 - RNA, 21 nt, Human
uggcucaugccuguaaucuca

SEQ ID NO: 848316 - RNA, 22 nt, Human
uggcucaugccuguaaucucaa

SEQ ID NO: 848317 - RNA, 24 nt, Human
uggcucaugccuguaaucucaaua

SEQ ID NO: 848318 - RNA, 24 nt, Human
ugggacuacaggcacacaacacca

SEQ ID NO: 848319 - RNA, 18 nt, Human
ugggauuauaggcgugag

SEQ ID NO: 848320 - RNA, 19 nt, Human
ugggauuauaggcgugagc

SEQ ID NO: 848321 - RNA, 21 nt, Human
ugggauuauaggcgugagcca

SEQ ID NO: 848322 - RNA, 22 nt, Human
ugggauuauaggcgugagccac

SEQ ID NO: 848323 - RNA, 22 nt, Human
ugggauuauaggcgugagccac

SEQ ID NO: 848324 - RNA, 24 nt, Human
ugggauuauaggcgugagccacug

SEQ ID NO: 848325 - RNA, 19 nt, Human
uguaacagaccgcuccucu

SEQ ID NO: 848326 - RNA, 18 nt, Human
uguauguguguguguaua

SEQ ID NO: 848327 - RNA, 21 nt, Human
uguauguguguguguauacau

SEQ ID NO: 848328 - RNA, 23 nt, Human
uguauguguguguguauacauau

SEQ ID NO: 848329 - RNA, 20 nt, Human
ugugaucgcaccacugugcu

SEQ ID NO: 848330 - RNA, 20 nt, Human
uguguauguguguguguaua

SEQ ID NO: 848331 - RNA, 18 nt, Human
uguguguguauacauaua

SEQ ID NO: 848332 - RNA, 19 nt, Human
uguguguguauacauauac

SEQ ID NO: 848333 - RNA, 23 nt, Human
uuaggcccacuaccuugcacuga

SEQ ID NO: 848334 - RNA, 24 nt, Human
uuaguagagacaggguuucaccau

SEQ ID NO: 848335 - RNA, 24 nt, Human
uucaagcaauucuccuaccucagc

SEQ ID NO: 848336 - RNA, 24 nt, Human
uucagccuaggcgauagagcgagg

SEQ ID NO: 848337 - RNA, 19 nt, Human
uucggccucccaaagugcu

SEQ ID NO: 848338 - RNA, 20 nt, Human
uugaagcaccagggccucgg

SEQ ID NO: 848339 - RNA, 23 nt, Human
uugacuccuacaaaggcaaggaa

SEQ ID NO: 848340 - RNA, 22 nt, Human
uugagcccaggaguuugagacc

SEQ ID NO: 848341 - RNA, 21 nt, Human
uugcuugagcccaggaguuug

SEQ ID NO: 848342 - RNA, 18 nt, Human
uuguuguuguuguuuuug

SEQ ID NO: 848343 - RNA, 19 nt, Human
uuucaccauguuggccagg

SEQ ID NO: 848344 - RNA, 20 nt, Human
uuucaccauguuggccaggu

SEQ ID NO: 848345 - RNA, 21 nt, Human
uuugucuugaacucccgaccu

SEQ ID NO: 848346 - RNA, 24 nt, Human
uuuuaaaaaugaaaaaaaaaaaag

SEQ ID NO: 848347 - RNA, 18 nt, Human
uuuuguaguuuuaguaga

SEQ ID NO: 848348 - RNA, 21 nt, Human
uuuuuguaguuuuaguagaga

SEQ ID NO: 848349 - RNA, 21 nt, Human
uuuuuuguaguuuuaguagag

SEQ ID NO: 848350 - RNA, 24 nt, Human
uuuuuuguaguuuuaguagagaca

SEQ ID NO: 848351 - RNA, 20 nt, Human
uuuuuuuuuuuuuugcccag

SEQ ID NO: 848352 - RNA, 18 nt, Human
uuuuuuuuuuuuuuuuug

SEQ ID NO: 848353 - RNA, 18 nt, Human
aaguucccuccgcccucc

SEQ ID NO: 848354 - RNA, 21 nt, Human
aaguucccuccgcccuccgcc

SEQ ID NO: 848355 - RNA, 19 nt, Human
acacacuggggugugugcg

SEQ ID NO: 848356 - RNA, 22 nt, Human
agaaugagaggggcaguguggg

SEQ ID NO: 848357 - RNA, 21 nt, Human
aucaguaguaaaacauccccu

SEQ ID NO: 848358 - RNA, 26 nt, Human
auuccauucaacgccccccuccccca

SEQ ID NO: 848359 - RNA, 18 nt, Human
caaggaucguggcgcuuu

SEQ ID NO: 848360 - RNA, 18 nt, Human
caaguucccuccgcccuc

SEQ ID NO: 848361 - RNA, 22 nt, Human
caaugcugaaaggauaggagga

SEQ ID NO: 848362 - RNA, 21 nt, Human
cacagguuuaguucccucacc

SEQ ID NO: 848363 - RNA, 21 nt, Human
cacccccucucucuucaucca

SEQ ID NO: 848364 - RNA, 24 nt, Human
cagaucgugcaggucagacacacu

SEQ ID NO: 848365 - RNA, 22 nt, Human
cagcggacugcuccucaggcuc

SEQ ID NO: 848366 - RNA, 20 nt, Human
cccauagcaccuggggggcc

SEQ ID NO: 848367 - RNA, 21 nt, Human
ccccauagcaccuggggggcc

SEQ ID NO: 848368 - RNA, 18 nt, Human
ccccgccugcccucucuc

SEQ ID NO: 848369 - RNA, 21 nt, Human
ccccucucucuucauccagau

SEQ ID NO: 848370 - RNA, 19 nt, Human
cccuccgcccucuccuccc

SEQ ID NO: 848371 - RNA, 19 nt, Human
ccucccgggaacaccaccc

SEQ ID NO: 848372 - RNA, 18 nt, Human
ccuccgcccucuccuccc

SEQ ID NO: 848373 - RNA, 21 nt, Human
cgccccccucccccauagcac

SEQ ID NO: 848374 - RNA, 21 nt, Human
cucggccaggugcagcuucug

SEQ ID NO: 848375 - RNA, 19 nt, Human
gacaagcuuugcuaugauu

SEQ ID NO: 848376 - RNA, 22 nt, Human
gaggacaucggacaagcuuugc

SEQ ID NO: 848377 - RNA, 21 nt, Human
gcagcggacugcuccucaggc

SEQ ID NO: 848378 - RNA, 19 nt, Human
gcccucucucacccccucu

SEQ ID NO: 848379 - RNA, 23 nt, Human
gcgcacucgcgcuguuucugacu

SEQ ID NO: 848380 - RNA, 24 nt, Human
ggccuggagguuuggggucucgag

SEQ ID NO: 848381 - RNA, 25 nt, Human
uaaaacauccccuacaaccacuuuu

SEQ ID NO: 848382 - RNA, 21 nt, Human
ucccaccccggucucccaucu

SEQ ID NO: 848383 - RNA, 21 nt, Human
ucccccauagcaccugggggg

SEQ ID NO: 848384 - RNA, 24 nt, Human
uccccgccugcccucucucacccc

SEQ ID NO: 848385 - RNA, 19 nt, Human
ucccucaccugugcaaagg

SEQ ID NO: 848386 - RNA, 22 nt, Human
ucccuccgcccuccgcccucuc

SEQ ID NO: 848387 - RNA, 22 nt, Human
ucggcguucucggccaggugca

SEQ ID NO: 848388 - RNA, 22 nt, Human
ucucucacccccucucucuuca

SEQ ID NO: 848389 - RNA, 23 nt, Human
ugaaaggauaggaggacaucgga

SEQ ID NO: 848390 - RNA, 25 nt, Human
ugaagagaaugagaggggcagugug

SEQ ID NO: 848391 - RNA, 20 nt, Human
uggagguuuggggucucgag

SEQ ID NO: 848392 - RNA, 19 nt, Human
ugggccucaggccuggagg

SEQ ID NO: 848393 - RNA, 18 nt, Human
ugggccugcgugggacgc

SEQ ID NO: 848394 - RNA, 22 nt, Human
uugcaguccccgccugcccucu

SEQ ID NO: 848395 - RNA, 20 nt, Human
uuugaagagaaugagagggg

SEQ ID NO: 848396 - RNA, 25 nt, Human
uuuggaccaguccuuccucccaccc

SEQ ID NO: 848397 - RNA, 23 nt, Human
uuuuuuuuuuuuuuuuuugcuuu

SEQ ID NO: 848398 - RNA, 27 nt, Human
uuuuuuuuuuuuuuuuuuuuuuugggg

SEQ ID NO: 848399 - RNA, 20 nt, Human
aaaaaagaaaaaaaaaagga

SEQ ID NO: 848400 - RNA, 20 nt, Human
aaaaaagaaaaaaaaaagga

SEQ ID NO: 848401 - RNA, 21 nt, Human
aaaaaagaaaagaaaagcaaa

SEQ ID NO: 848402 - RNA, 18 nt, Human
aaaagaaaaaaaaaaggg

SEQ ID NO: 848403 - RNA, 20 nt, Human
aaagaaaagcaaaaaagaaa

SEQ ID NO: 848404 - RNA, 23 nt, Human
aaagauucuaaaacaauugaaca

SEQ ID NO: 848405 - RNA, 22 nt, Human
aagcaacuaaaaaaaggcauac

SEQ ID NO: 848406 - RNA, 31 nt, Human
acaaaguuuucucccuaaaguggcucaaaag

SEQ ID NO: 848407 - RNA, 22 nt, Human
acacugcuucauagcaaggccu

SEQ ID NO: 848408 - RNA, 19 nt, Human
acagccuagccugcacucu

SEQ ID NO: 848409 - RNA, 21 nt, Human
acaggcugcagaguaaaccaa

SEQ ID NO: 848410 - RNA, 18 nt, Human
accuggcucuccaucacu

SEQ ID NO: 848411 - RNA, 20 nt, Human
agaaaagaaaagcaaaaaag

SEQ ID NO: 848412 - RNA, 22 nt, Human
agaaaagaaaagcaaaaaagaa

SEQ ID NO: 848413 - RNA, 18 nt, Human
agaaaagcaaaaaagaaa

SEQ ID NO: 848414 - RNA, 21 nt, Human
agaguaaaccaaugucugcug

SEQ ID NO: 848415 - RNA, 23 nt, Human
agcaaaaaagaaaaaaaaaagga

SEQ ID NO: 848416 - RNA, 24 nt, Human
aggacucaacaaaaucuaaaaaug

SEQ ID NO: 848417 - RNA, 23 nt, Human
aggauuggguggggggaaggagg

SEQ ID NO: 848418 - RNA, 24 nt, Human
aggcugcagaguaaaccaaugucu

SEQ ID NO: 848419 - RNA, 22 nt, Human
aucuacucaaaccucuucaucg

SEQ ID NO: 848420 - RNA, 20 nt, Human
auuuugaugauuuacuaggu

SEQ ID NO: 848421 - RNA, 21 nt, Human
caaaaaagaaaaaaaaaagga

SEQ ID NO: 848422 - RNA, 21 nt, Human
caaagaugaaccuggcucucc

SEQ ID NO: 848423 - RNA, 30 nt, Human
caaaguuuucucccuaaaguggcucaaaag

SEQ ID NO: 848424 - RNA, 23 nt, Human
cacacugcuucauagcaaggccu

SEQ ID NO: 848425 - RNA, 24 nt, Human
cacugagccagacauucauucaac

SEQ ID NO: 848426 - RNA, 24 nt, Human
cagcacgguauucuaccacaacug

SEQ ID NO: 848427 - RNA, 21 nt, Human
caucaaacauucaucuggugc

SEQ ID NO: 848428 - RNA, 23 nt, Human
cauucaacauuguccauucacac

SEQ ID NO: 848429 - RNA, 24 nt, Human
cauucauguaaaguuuucauuaca

SEQ ID NO: 848430 - RNA, 25 nt, Human
ccuacaaugagccaccuuauaaaga

SEQ ID NO: 848431 - RNA, 23 nt, Human
cuccaucacugagccagacauuc

SEQ ID NO: 848432 - RNA, 22 nt, Human
cuuauagcaaacuguuguucau

SEQ ID NO: 848433 - RNA, 18 nt, Human
cuugauuuguacaucuac

SEQ ID NO: 848434 - RNA, 20 nt, Human
gagccagacauucauucaac

SEQ ID NO: 848435 - RNA, 21 nt, Human
gaucugugaccuguagcccuu

SEQ ID NO: 848436 - RNA, 22 nt, Human
gcaaaugcacagggaaaccuuc

SEQ ID NO: 848437 - RNA, 20 nt, Human
ggaaaccuuccugaaaaguu

SEQ ID NO: 848438 - RNA, 21 nt, Human
ggaaagggggaaacagaaaac

SEQ ID NO: 848439 - RNA, 18 nt, Human
ggaaggaggugggaaagg

SEQ ID NO: 848440 - RNA, 18 nt, Human
ggaaggaggugggaaagg

SEQ ID NO: 848441 - RNA, 18 nt, Human
ggaaggaggugggaaagg

SEQ ID NO: 848442 - RNA, 21 nt, Human
ggauuggguggggggaaggag

SEQ ID NO: 848443 - RNA, 21 nt, Human
ggccugggcucauuuuccuuu

SEQ ID NO: 848444 - RNA, 20 nt, Human
gggaaggcacaggauuuccu

SEQ ID NO: 848445 - RNA, 21 nt, Human
ggggaaggaggugggaaaggg

SEQ ID NO: 848446 - RNA, 20 nt, Human
ggguggggggaaggaggugg

SEQ ID NO: 848447 - RNA, 21 nt, Human
ggguggggggaaggagguggg

SEQ ID NO: 848448 - RNA, 21 nt, Human
ggugggaaagggggaaacaga

SEQ ID NO: 848449 - RNA, 20 nt, Human
guggcuaaucugguauguuu

SEQ ID NO: 848450 - RNA, 28 nt, Human
uaaaaaaaaagaaaagaaaagcaaaaaa

SEQ ID NO: 848451 - RNA, 22 nt, Human
uaaaaauacaaaguuuucuccc

SEQ ID NO: 848452 - RNA, 23 nt, Human
uacaaaguuuucucccuaaagug

SEQ ID NO: 848453 - RNA, 23 nt, Human
uacaggacucaacaaaaggacau

SEQ ID NO: 848454 - RNA, 24 nt, Human
uacucuaguucaacaaagaguuau

SEQ ID NO: 848455 - RNA, 23 nt, Human
ucaauguucuuucucaggcacug

SEQ ID NO: 848456 - RNA, 22 nt, Human
uccauucuacaguguuucagaa

SEQ ID NO: 848457 - RNA, 20 nt, Human
uccccaagacagccuagccu

SEQ ID NO: 848458 - RNA, 22 nt, Human
ucugugaccuguagcccuuuuu

SEQ ID NO: 848459 - RNA, 24 nt, Human
ugaaaacaaguaacauuuaaacac

SEQ ID NO: 848460 - RNA, 18 nt, Human
ugaaaaugaaaaggaugg

SEQ ID NO: 848461 - RNA, 21 nt, Human
ugacaaggaaugcugcaaaaa

SEQ ID NO: 848462 - RNA, 19 nt, Human
ugagaagcaacuaaaaaaa

SEQ ID NO: 848463 - RNA, 23 nt, Human
ugcuaaugguggcuaaucuggua

SEQ ID NO: 848464 - RNA, 26 nt, Human
ugcuaaugguggcuaaucugguauga

SEQ ID NO: 848465 - RNA, 19 nt, Human
ugcuucauagcaaggccug

SEQ ID NO: 848466 - RNA, 21 nt, Human
ugggcucauuuuccuuugacu

SEQ ID NO: 848467 - RNA, 18 nt, Human
uggggggaaggagguggg

SEQ ID NO: 848468 - RNA, 21 nt, Human
uggguggggggaaggaggugg

SEQ ID NO: 848469 - RNA, 19 nt, Human
ugguggcuaaucugguaug

SEQ ID NO: 848470 - RNA, 21 nt, Human
uguucaaaccauuacuugauu

SEQ ID NO: 848471 - RNA, 24 nt, Human
uguuucuuauagcaaacuguuguu

SEQ ID NO: 848472 - RNA, 21 nt, Human
uuacaagcuaguuuucugcug

SEQ ID NO: 848473 - RNA, 28 nt, Human
uugaagaugacgguacugcacuuucccc

SEQ ID NO: 848474 - RNA, 24 nt, Human
uuucauagaaaacaaaguuugaaa

SEQ ID NO: 848475 - RNA, 25 nt, Human
uuucucaggcacugacgaucuguga

SEQ ID NO: 848476 - RNA, 21 nt, Human
uuuguacaucuacucaaaccu

SEQ ID NO: 848477 - RNA, 25 nt, Human
uuuuuucuuuuuuuuuuuaaaacau

SEQ ID NO: 848478 - RNA, 25 nt, Human
uuuuuuuuuuuuuuuuuuucuuuuu

SEQ ID NO: 848479 - RNA, 24 nt, Human
aaaaugcugcacuuauuucucuua

SEQ ID NO: 848480 - RNA, 23 nt, Human
aaaugcugcacuuauuucucuua

SEQ ID NO: 848481 - RNA, 22 nt, Human
aacaacugauuuuccaccccuc

SEQ ID NO: 848482 - RNA, 20 nt, Human
acaacugauuuuccaccccu

SEQ ID NO: 848483 - RNA, 21 nt, Human
acagaaagagauaaaaucaau

SEQ ID NO: 848484 - RNA, 18 nt, Human
agaaagagauaaaaucaa

SEQ ID NO: 848485 - RNA, 19 nt, Human
agccgcgggacacagcagc

SEQ ID NO: 848486 - RNA, 21 nt, Human
aggguucucaaugucaacacc

SEQ ID NO: 848487 - RNA, 19 nt, Human
augcugcacuuauuucucu

SEQ ID NO: 848488 - RNA, 24 nt, Human
caacugauuuuccaccccuccgcc

SEQ ID NO: 848489 - RNA, 23 nt, Human
caagccgcgggacacagcagcca

SEQ ID NO: 848490 - RNA, 22 nt, Human
cagaaaggagacuaccccaggc

SEQ ID NO: 848491 - RNA, 19 nt, Human
ccucugagcagggaauggg

SEQ ID NO: 848492 - RNA, 24 nt, Human
cucaaugucaacaccuaacauuuu

SEQ ID NO: 848493 - RNA, 20 nt, Human
cuccgccaaauuuggugucu

SEQ ID NO: 848494 - RNA, 23 nt, Human
cuucaugaguccaagcuggaaca

SEQ ID NO: 848495 - RNA, 25 nt, Human
gaaaauaguggaagaugccgguacc

SEQ ID NO: 848496 - RNA, 18 nt, Human
gaagaugcagauuuuuaa

SEQ ID NO: 848497 - RNA, 20 nt, Human
ggagcgcaagccgcgggaca

SEQ ID NO: 848498 - RNA, 23 nt, Human
uaggguuauaaugguaacaacug

SEQ ID NO: 848499 - RNA, 23 nt, Human
uauagauacagaaagagauaaaa

SEQ ID NO: 848500 - RNA, 20 nt, Human
ucacacuguuccucugagca

SEQ ID NO: 848501 - RNA, 18 nt, Human
uccaagcuggaacaugac

SEQ ID NO: 848502 - RNA, 25 nt, Human
uccaagcuggaacaugaccgggguc

SEQ ID NO: 848503 - RNA, 21 nt, Human
ugggguuucaggguucucaau

SEQ ID NO: 848504 - RNA, 18 nt, Human
ugucuuuuuuuuuuuuag

SEQ ID NO: 848505 - RNA, 25 nt, Human
uuauaaugguaacaacugauuuucc

SEQ ID NO: 848506 - RNA, 24 nt, Human
uucucaaugucaacaccuaacauu

SEQ ID NO: 848507 - RNA, 21 nt, Human
aaaaaaaaaaaaauggcccag

SEQ ID NO: 848508 - RNA, 21 nt, Human
aaaaaccaagaguucucaagu

SEQ ID NO: 848509 - RNA, 25 nt, Human
aaguaacccuuuugccuuuugcagg

SEQ ID NO: 848510 - RNA, 19 nt, Human
agaccauccuccacgaagg

SEQ ID NO: 848511 - RNA, 20 nt, Human
caaccuuucaaaaaaccaag

SEQ ID NO: 848512 - RNA, 20 nt, Human
cacucucugucccuccuacu

SEQ ID NO: 848513 - RNA, 18 nt, Human
cagacaacuucaguagua

SEQ ID NO: 848514 - RNA, 18 nt, Human
cauccuccacgaagguca

SEQ ID NO: 848515 - RNA, 18 nt, Human
cauugccuugguucugac

SEQ ID NO: 848516 - RNA, 23 nt, Human
ccaccaccucccuccaccagaaa

SEQ ID NO: 848517 - RNA, 20 nt, Human
ccagaaaaaaaaaaaaaaaa

SEQ ID NO: 848518 - RNA, 20 nt, Human
ccuccacgaaggucaaagau

SEQ ID NO: 848519 - RNA, 19 nt, Human
cuaaguuccucucucucuc

SEQ ID NO: 848520 - RNA, 19 nt, Human
cuagauguucucuaacaca

SEQ ID NO: 848521 - RNA, 18 nt, Human
cuauaccauuuauuugau

SEQ ID NO: 848522 - RNA, 20 nt, Human
cuccaccaccucccuccacc

SEQ ID NO: 848523 - RNA, 23 nt, Human
cuccaccagaaaaaaaaaaaaaa

SEQ ID NO: 848524 - RNA, 22 nt, Human
cucccuccaccagaaaaaaaaa

SEQ ID NO: 848525 - RNA, 21 nt, Human
gagaucugggagagagaaguc

SEQ ID NO: 848526 - RNA, 23 nt, Human
gcagucaaccuuucaaaaaacca

SEQ ID NO: 848527 - RNA, 23 nt, Human
ggaugagcaacccaugaaaauaa

SEQ ID NO: 848528 - RNA, 24 nt, Human
ggcccaggaccaguagcuaggaga

SEQ ID NO: 848529 - RNA, 22 nt, Human
gugaguuucuuuggucagauuu

SEQ ID NO: 848530 - RNA, 21 nt, Human
guuuucuucuuucuugguucu

SEQ ID NO: 848531 - RNA, 20 nt, Human
uaacuuacuuucccauuguc

SEQ ID NO: 848532 - RNA, 20 nt, Human
uaaguaacccuuuugccuuu

SEQ ID NO: 848533 - RNA, 24 nt, Human
uaaguaacccuuuugccuuuugca

SEQ ID NO: 848534 - RNA, 22 nt, Human
ucaaccuuucaaaaaaccaaga

SEQ ID NO: 848535 - RNA, 25 nt, Human
ucccuccaccagaaaaaaaaaaaaa

SEQ ID NO: 848536 - RNA, 19 nt, Human
uccucagcauccuucucug

SEQ ID NO: 848537 - RNA, 21 nt, Human
uccuccacgaaggucaaagau

SEQ ID NO: 848538 - RNA, 20 nt, Human
ucucuguaaacugaagaguu

SEQ ID NO: 848539 - RNA, 20 nt, Human
uggaagagguuuugacaaug

SEQ ID NO: 848540 - RNA, 22 nt, Human
uggcccaggaccaguagcuagg

SEQ ID NO: 848541 - RNA, 24 nt, Human
ugggauuauuuaaaaaaaaaaaaa

SEQ ID NO: 848542 - RNA, 23 nt, Human
uguuccuccaccaccucccucca

SEQ ID NO: 848543 - RNA, 19 nt, Human
uugcucagaagagaaacag

SEQ ID NO: 848544 - RNA, 19 nt, Human
uuguguuuucuucuuucuu

SEQ ID NO: 848545 - RNA, 22 nt, Human
uuuaaaaaaaaaaaaauggccc

SEQ ID NO: 848546 - RNA, 21 nt, Human
uuugcagguaacuucucaucu

SEQ ID NO: 848547 - RNA, 18 nt, Human
uuuuuuuuuuuuuuuuug

SEQ ID NO: 848548 - RNA, 21 nt, Human
uuuuuuuuuuuuuuuuuuguu

SEQ ID NO: 848549 - RNA, 19 nt, Human
aagaaacuuuugucccaua

SEQ ID NO: 848550 - RNA, 18 nt, Human
agacaaaaaucgaaaauu

SEQ ID NO: 848551 - RNA, 20 nt, Human
caccaugcugccuucugagc

SEQ ID NO: 848552 - RNA, 20 nt, Human
cccaucucgcuaaggcuucu

SEQ ID NO: 848553 - RNA, 21 nt, Human
ccuaaaaaaaaaugaacaaac

SEQ ID NO: 848554 - RNA, 18 nt, Human
cucugguugcuagggccc

SEQ ID NO: 848555 - RNA, 25 nt, Human
cugaagacaaaaaucgaaaauuugu

SEQ ID NO: 848556 - RNA, 23 nt, Human
cugaauaaguuaaaggaaaaaaa

SEQ ID NO: 848557 - RNA, 20 nt, Human
gaacaaacugaaaaaaacau

SEQ ID NO: 848558 - RNA, 18 nt, Human
gccaguuuucucuuccca

SEQ ID NO: 848559 - RNA, 27 nt, Human
ggaacucuucccaucaccaugcugccu

SEQ ID NO: 848560 - RNA, 18 nt, Human
ggcuucagauggccucug

SEQ ID NO: 848561 - RNA, 22 nt, Human
gucuacaaagguuuuguuuuag

SEQ ID NO: 848562 - RNA, 24 nt, Human
uaaccuaaaaaaaaaugaacaaac

SEQ ID NO: 848563 - RNA, 19 nt, Human
uagauggggcuacacagua

SEQ ID NO: 848564 - RNA, 23 nt, Human
uauagggggaaucugggcauaaa

SEQ ID NO: 848565 - RNA, 22 nt, Human
ucgcuaaggcuucuuugauugu

SEQ ID NO: 848566 - RNA, 23 nt, Human
ucuaaccuaaaaaaaaaugaaca

SEQ ID NO: 848567 - RNA, 20 nt, Human
ugcugccuucugagcuaaag

SEQ ID NO: 848568 - RNA, 20 nt, Human
uggggagaaacacugaauaa

SEQ ID NO: 848569 - RNA, 21 nt, Human
uuaagaaacuuuugucccaua

SEQ ID NO: 848570 - RNA, 27 nt, Human
uucuuugauuguuguugcuuucgccau

SEQ ID NO: 848571 - RNA, 22 nt, Human
uuuuuuuuuuccuuuuuucacc

SEQ ID NO: 848572 - RNA, 23 nt, Human
uuuuuuuuuuuuuuuuuuccuuu

SEQ ID NO: 848573 - RNA, 25 nt, Human
uuuuuuuuuuuuuuuuuuccuuuuu

SEQ ID NO: 848574 - RNA, 18 nt, Human
aagaagccuucauuacac

SEQ ID NO: 848575 - RNA, 27 nt, Human
cacccucuuaagaucuuuacaugccaa

SEQ ID NO: 848576 - RNA, 24 nt, Human
cagcuuaauuaauucgaaggugac

SEQ ID NO: 848577 - RNA, 18 nt, Human
gaaauuaacaagaacaag

SEQ ID NO: 848578 - RNA, 20 nt, Human
gguauaaaauaucacauaua

SEQ ID NO: 848579 - RNA, 23 nt, Human
uaaaaaagaagccuucauuacac

SEQ ID NO: 848580 - RNA, 21 nt, Human
uaacaagaacaagcaauuucu

SEQ ID NO: 848581 - RNA, 21 nt, Human
uauaggaauccuaagauaaga

SEQ ID NO: 848582 - RNA, 18 nt, Human
uuaacaagaacaagcaau

SEQ ID NO: 848583 - RNA, 22 nt, Human
uucgagugguucguucugcacc

SEQ ID NO: 848584 - RNA, 18 nt, Human
uuuuuuuuuuuuuuuucg

SEQ ID NO: 848585 - RNA, 22 nt, Human
uuuuuuuuuuuuuuuuucgauu

SEQ ID NO: 848586 - RNA, 23 nt, Human
aaaaaacacaagaaaacuuccug

SEQ ID NO: 848587 - RNA, 19 nt, Human
aaaacacaagaaaacuucc

SEQ ID NO: 848588 - RNA, 19 nt, Human
aacacagccuauuaagcuc

SEQ ID NO: 848589 - RNA, 19 nt, Human
aacacagccuauuaagcuc

SEQ ID NO: 848590 - RNA, 24 nt, Human
aacauguagacaggcugaggcagg

SEQ ID NO: 848591 - RNA, 19 nt, Human
aaggcuuuaccacauuguu

SEQ ID NO: 848592 - RNA, 30 nt, Human
aagguagaauacacacacacacacacacag

SEQ ID NO: 848593 - RNA, 24 nt, Human
aaucacuugagcccaggaauuuga

SEQ ID NO: 848594 - RNA, 24 nt, Human
aauuugaggcugcagugagcuaag

SEQ ID NO: 848595 - RNA, 26 nt, Human
acaaauuuuuaaaugaauagacaaaa

SEQ ID NO: 848596 - RNA, 26 nt, Human
acaaauuuuuaaaugaauagacaaaa

SEQ ID NO: 848597 - RNA, 23 nt, Human
acaauaaauaaaaaacacaagaa

SEQ ID NO: 848598 - RNA, 23 nt, Human
acacacacacacacacacacaca

SEQ ID NO: 848599 - RNA, 23 nt, Human
acacacacacacacacacacaca

SEQ ID NO: 848600 - RNA, 23 nt, Human
acacacacacacacacacacaca

SEQ ID NO: 848601 - RNA, 23 nt, Human
acacacacacacacacacacaca

SEQ ID NO: 848602 - RNA, 23 nt, Human
acacacacacacacacacacaca

SEQ ID NO: 848603 - RNA, 23 nt, Human
acacacacacacacacacacaca

SEQ ID NO: 848604 - RNA, 28 nt, Human
acacacacacacacacacacaugaacuc

SEQ ID NO: 848605 - RNA, 25 nt, Human
acacacacacacacacacaugaacu

SEQ ID NO: 848606 - RNA, 18 nt, Human
acagcgagaucccaucuc

SEQ ID NO: 848607 - RNA, 18 nt, Human
acgcagauuagacaagca

SEQ ID NO: 848608 - RNA, 20 nt, Human
acuacacuucagccuagcug

SEQ ID NO: 848609 - RNA, 20 nt, Human
acuauuauuaccacuacacu

SEQ ID NO: 848610 - RNA, 18 nt, Human
acuccuuuaccaugaaac

SEQ ID NO: 848611 - RNA, 18 nt, Human
acuugauggugagacuga

SEQ ID NO: 848612 - RNA, 26 nt, Human
agaagaaaaucuuuacaacaaaaaag

SEQ ID NO: 848613 - RNA, 26 nt, Human
agaagaaaaucuuuacaacaaaaaag

SEQ ID NO: 848614 - RNA, 19 nt, Human
agaaugccaaaaaccacaa

SEQ ID NO: 848615 - RNA, 20 nt, Human
agcaaagaaaacagaagaaa

SEQ ID NO: 848616 - RNA, 20 nt, Human
agcaaagaaaacagaagaaa

SEQ ID NO: 848617 - RNA, 21 nt, Human
agcaaagaaaacagaagaaaa

SEQ ID NO: 848618 - RNA, 21 nt, Human
agcaaagaaaacagaagaaaa

SEQ ID NO: 848619 - RNA, 24 nt, Human
agcaaagaaaacagaagaaaaucu

SEQ ID NO: 848620 - RNA, 24 nt, Human
agcaaagaaaacagaagaaaaucu

SEQ ID NO: 848621 - RNA, 22 nt, Human
agcaacagaagcugccgcggga

SEQ ID NO: 848622 - RNA, 23 nt, Human
agcugagcaugguggcauguguc

SEQ ID NO: 848623 - RNA, 28 nt, Human
agcuugaggccaggaauucaaccuucgg

SEQ ID NO: 848624 - RNA, 23 nt, Human
aggaauucaauaccagccuagac

SEQ ID NO: 848625 - RNA, 19 nt, Human
aggauagcuugaggccagg

SEQ ID NO: 848626 - RNA, 24 nt, Human
aggauagcuugaggccaggaauuc

SEQ ID NO: 848627 - RNA, 18 nt, Human
aggcaggaggauagcuug

SEQ ID NO: 848628 - RNA, 26 nt, Human
aggcaggaggauagcuugaggccagg

SEQ ID NO: 848629 - RNA, 24 nt, Human
aggcuaaggugggagaaucacuug

SEQ ID NO: 848630 - RNA, 24 nt, Human
aggcugaggcaggaggauagcuug

SEQ ID NO: 848631 - RNA, 18 nt, Human
agggcacaccaauuugac

SEQ ID NO: 848632 - RNA, 18 nt, Human
aggugggagaaucacuug

SEQ ID NO: 848633 - RNA, 23 nt, Human
aggugggagaaucacuugagccc

SEQ ID NO: 848634 - RNA, 24 nt, Human
aggugugguagcucaugucaguaa

SEQ ID NO: 848635 - RNA, 22 nt, Human
auacacacacacacacacacag

SEQ ID NO: 848636 - RNA, 19 nt, Human
auacagaugaugcuauacu

SEQ ID NO: 848637 - RNA, 20 nt, Human
augaaccacugauaaaaaua

SEQ ID NO: 848638 - RNA, 20 nt, Human
augaaccacugauaaaaaua

SEQ ID NO: 848639 - RNA, 20 nt, Human
augacagaauaaaggaaaga

SEQ ID NO: 848640 - RNA, 18 nt, Human
auguagacaggcugaggc

SEQ ID NO: 848641 - RNA, 20 nt, Human
auguagacaugcuauauaua

SEQ ID NO: 848642 - RNA, 18 nt, Human
auuucagacuuuuaacau

SEQ ID NO: 848643 - RNA, 21 nt, Human
caaaaaacugaaaaucuaaag

SEQ ID NO: 848644 - RNA, 21 nt, Human
caaaaaacugaaaaucuaaag

SEQ ID NO: 848645 - RNA, 20 nt, Human
caaccuguagauaaaauacu

SEQ ID NO: 848646 - RNA, 19 nt, Human
caagaaaacuuccugagcc

SEQ ID NO: 848647 - RNA, 23 nt, Human
caaguaacagccaaaacucauga

SEQ ID NO: 848648 - RNA, 18 nt, Human
cacacacacacacacaca

SEQ ID NO: 848649 - RNA, 20 nt, Human
cacacacacacacacacaca

SEQ ID NO: 848650 - RNA, 20 nt, Human
cacacacacacacacacaca

SEQ ID NO: 848651 - RNA, 20 nt, Human
cacacacacacacacacaca

SEQ ID NO: 848652 - RNA, 20 nt, Human
cacacacacacacacacaca

SEQ ID NO: 848653 - RNA, 20 nt, Human
cacacacacacacacacaca

SEQ ID NO: 848654 - RNA, 20 nt, Human
cacacacacacacacacaca

SEQ ID NO: 848655 - RNA, 20 nt, Human
cacacacacacacacacaca

SEQ ID NO: 848656 - RNA, 20 nt, Human
cacacacacacacacacaca

SEQ ID NO: 848657 - RNA, 20 nt, Human
cacacacacacacacacaca

SEQ ID NO: 848658 - RNA, 20 nt, Human
cacacacacacacacacaca

SEQ ID NO: 848659 - RNA, 20 nt, Human
cacacacacacacacacaca

SEQ ID NO: 848660 - RNA, 20 nt, Human
cacacacacacacacacaca

SEQ ID NO: 848661 - RNA, 20 nt, Human
cacacacacacacacacaca

SEQ ID NO: 848662 - RNA, 20 nt, Human
cacacacacacacacacaca

SEQ ID NO: 848663 - RNA, 20 nt, Human
cacacacacacacacacaca

SEQ ID NO: 848664 - RNA, 20 nt, Human
cacacacacacacacacaca

SEQ ID NO: 848665 - RNA, 20 nt, Human
cacacacacacacacacaca

SEQ ID NO: 848666 - RNA, 20 nt, Human
cacacacacacacacacaca

SEQ ID NO: 848667 - RNA, 22 nt, Human
cacacacacacacacacacaca

SEQ ID NO: 848668 - RNA, 22 nt, Human
cacacacacacacacacacaca

SEQ ID NO: 848669 - RNA, 22 nt, Human
cacacacacacacacacacaca

SEQ ID NO: 848670 - RNA, 22 nt, Human
cacacacacacacacacacaca

SEQ ID NO: 848671 - RNA, 22 nt, Human
cacacacacacacacacacaca

SEQ ID NO: 848672 - RNA, 22 nt, Human
cacacacacacacacacacaca

SEQ ID NO: 848673 - RNA, 22 nt, Human
cacacacacacacacacacaca

SEQ ID NO: 848674 - RNA, 22 nt, Human
cacacacacacacacacacaca

SEQ ID NO: 848675 - RNA, 22 nt, Human
cacacacacacacacacacaca

SEQ ID NO: 848676 - RNA, 22 nt, Human
cacacacacacacacacacaca

SEQ ID NO: 848677 - RNA, 22 nt, Human
cacacacacacacacacacaca

SEQ ID NO: 848678 - RNA, 26 nt, Human
cacacacacacacacacacacacaca

SEQ ID NO: 848679 - RNA, 26 nt, Human
cacacacacacacacacacacacaca

SEQ ID NO: 848680 - RNA, 26 nt, Human
cacacacacacacacacacacacaca

SEQ ID NO: 848681 - RNA, 26 nt, Human
cacacacacacacacacacacacaca

SEQ ID NO: 848682 - RNA, 26 nt, Human
cacacacacacacacacacacacaca

SEQ ID NO: 848683 - RNA, 26 nt, Human
cacacacacacacacacacacacaca

SEQ ID NO: 848684 - RNA, 26 nt, Human
cacacacacacacacacacacacaca

SEQ ID NO: 848685 - RNA, 26 nt, Human
cacacacacacacacacacacacaca

SEQ ID NO: 848686 - RNA, 26 nt, Human
cacacacacacacacacacacacaca

SEQ ID NO: 848687 - RNA, 26 nt, Human
cacacacacacacacacacacacaug

SEQ ID NO: 848688 - RNA, 26 nt, Human
cacacacacacacacacacacacaug

SEQ ID NO: 848689 - RNA, 24 nt, Human
cacuacacuucagccuagcugaca

SEQ ID NO: 848690 - RNA, 24 nt, Human
cagcuacauaggaggcuaaggugg

SEQ ID NO: 848691 - RNA, 21 nt, Human
caggucccagagcaacagaag

SEQ ID NO: 848692 - RNA, 23 nt, Human
cauguagacaugcuauauauaca

SEQ ID NO: 848693 - RNA, 23 nt, Human
ccacauucgcgcugcccaacaca

SEQ ID NO: 848694 - RNA, 19 nt, Human
ccacuacacuucagccuag

SEQ ID NO: 848695 - RNA, 20 nt, Human
ccacuacacuucagccuagc

SEQ ID NO: 848696 - RNA, 24 nt, Human
ccacuacacuucagccuagcugac

SEQ ID NO: 848697 - RNA, 18 nt, Human
ccagagcaacagaagcug

SEQ ID NO: 848698 - RNA, 19 nt, Human
ccggugucugggguccucc

SEQ ID NO: 848699 - RNA, 21 nt, Human
ccggugucugggguccucccu

SEQ ID NO: 848700 - RNA, 23 nt, Human
ccuaaggaccuuccgggaccuuu

SEQ ID NO: 848701 - RNA, 23 nt, Human
cgccacauucgcgcugcccaaca

SEQ ID NO: 848702 - RNA, 27 nt, Human
cguaauagacuaucaguagaaugccaa

SEQ ID NO: 848703 - RNA, 25 nt, Human
cuccaugauucccugcaaaaaacug

SEQ ID NO: 848704 - RNA, 26 nt, Human
cugaggcaggaggauagcuugaggcc

SEQ ID NO: 848705 - RNA, 19 nt, Human
cugaugagaaacaaaacac

SEQ ID NO: 848706 - RNA, 19 nt, Human
cugaugagaaacaaaacac

SEQ ID NO: 848707 - RNA, 21 nt, Human
cuguagcuccagcuacauagg

SEQ ID NO: 848708 - RNA, 22 nt, Human
cugugaguccuuucauggacuc

SEQ ID NO: 848709 - RNA, 24 nt, Human
cuuauacacauauaaguauacaug

SEQ ID NO: 848710 - RNA, 19 nt, Human
cuuccgggaccugcagguc

SEQ ID NO: 848711 - RNA, 23 nt, Human
cuuccgggaccugcaggucccag

SEQ ID NO: 848712 - RNA, 18 nt, Human
gaaaaucuaaaguauaga

SEQ ID NO: 848713 - RNA, 18 nt, Human
gaaaaucuaaaguauaga

SEQ ID NO: 848714 - RNA, 23 nt, Human
gaaucacuugagcccaggaauuu

SEQ ID NO: 848715 - RNA, 21 nt, Human
gacaccuucuuuaacaaugaa

SEQ ID NO: 848716 - RNA, 21 nt, Human
gacaccuucuuuaacaaugaa

SEQ ID NO: 848717 - RNA, 27 nt, Human
gagcaucccuaauccaaauaucaaaaa

SEQ ID NO: 848718 - RNA, 26 nt, Human
gagcauuucuguugagcauaagacuc

SEQ ID NO: 848719 - RNA, 23 nt, Human
gagcucgccacauucgcgcugcc

SEQ ID NO: 848720 - RNA, 18 nt, Human
gaggcugcagugagcuaa

SEQ ID NO: 848721 - RNA, 19 nt, Human
gaugagaaacaaaacacag

SEQ ID NO: 848722 - RNA, 19 nt, Human
gaugagaaacaaaacacag

SEQ ID NO: 848723 - RNA, 22 nt, Human
gcagaaaaaaacaugucauaag

SEQ ID NO: 848724 - RNA, 24 nt, Human
gcccaggaauuugaggcugcagug

SEQ ID NO: 848725 - RNA, 20 nt, Human
gccuagacaauacagcgaga

SEQ ID NO: 848726 - RNA, 26 nt, Human
gcuccaugauucccugcaaaaaacug

SEQ ID NO: 848727 - RNA, 25 nt, Human
ggaaagaaaaugaaaauaacaaugu

SEQ ID NO: 848728 - RNA, 21 nt, Human
ggaacaucuaaaggcuuugcc

SEQ ID NO: 848729 - RNA, 21 nt, Human
ggccaggugugguagcucaug

SEQ ID NO: 848730 - RNA, 24 nt, Human
gggccaggugugguagcucauguc

SEQ ID NO: 848731 - RNA, 30 nt, Human
gguagaauacacacacacacacacacacag

SEQ ID NO: 848732 - RNA, 30 nt, Human; identical to SEQ ID NO: 848731

SEQ ID NO: 848733 - RNA, 22 nt, Human
gguguuuuguuguuguuguuuu

SEQ ID NO: 848734 - RNA, 31 nt, Human
guagaauacacacacacacacacacacacag

SEQ ID NO: 848735 - RNA, 20 nt, Human
uaacagccaaaacucaugac

SEQ ID NO: 848736 - RNA, 20 nt, Human
uaaggugggagaaucacuug

SEQ ID NO: 848737 - RNA, 21 nt, Human
uacaaaacuguacuauaccac

SEQ ID NO: 848738 - RNA, 20 nt, Human
uacacacacacacacacaca

SEQ ID NO: 848739 - RNA, 25 nt, Human
uacacacacacacacacacacacac

SEQ ID NO: 848740 - RNA, 25 nt, Human
uacacacacacacacacacacacac

SEQ ID NO: 848741 - RNA, 25 nt, Human
uacacacacacacacacacacacag

SEQ ID NO: 848742 - RNA, 25 nt, Human
uacagcgagaucccaucucuauaaa

SEQ ID NO: 848743 - RNA, 21 nt, Human
uacauaggaggcuaagguggg

SEQ ID NO: 848744 - RNA, 21 nt, Human
uacauguguuggguuucucuc

SEQ ID NO: 848745 - RNA, 21 nt, Human
uacuauaugguauacuagggc

SEQ ID NO: 848746 - RNA, 24 nt, Human
uagaaugccaaaaaccacaaauca

SEQ ID NO: 848747 - RNA, 21 nt, Human
uagcaaagaaaacagaagaaa

SEQ ID NO: 848748 - RNA, 22 nt, Human
uagcaaagaaaacagaagaaaa

SEQ ID NO: 848749 - RNA, 22 nt, Human
uagcaaagaaaacagaagaaaa

SEQ ID NO: 848750 - RNA, 24 nt, Human
uaggaggcuaaggugggagaauca

SEQ ID NO: 848751 - RNA, 18 nt, Human
uagggcacaccaauuuga

SEQ ID NO: 848752 - RNA, 20 nt, Human
uauacagaugaugcuauacu

SEQ ID NO: 848753 - RNA, 22 nt, Human
uauauaauuagcugagcauggu

SEQ ID NO: 848754 - RNA, 23 nt, Human
uauguuaacugaugagaaacaaa

SEQ ID NO: 848755 - RNA, 23 nt, Human
uauguuaacugaugagaaacaaa

SEQ ID NO: 848756 - RNA, 24 nt, Human
uauuagaaauacauuucaacuuag

SEQ ID NO: 848757 - RNA, 24 nt, Human
uauuagaaauacauuucaacuuag

SEQ ID NO: 848758 - RNA, 24 nt, Human
uauuagcaaagaaaacagaagaaa

SEQ ID NO: 848759 - RNA, 27 nt, Human
uauuagcaaagaaaacagaagaaaauc

SEQ ID NO: 848760 - RNA, 27 nt, Human
uauuagcaaagaaaacagaagaaaauc

SEQ ID NO: 848761 - RNA, 30 nt, Human
uccaaauaucaaaaauccucuaaugagcaa

SEQ ID NO: 848762 - RNA, 24 nt, Human
uccacaauauacuugauggugaga

SEQ ID NO: 848763 - RNA, 19 nt, Human
ucccugcaaaaaacugaaa

SEQ ID NO: 848764 - RNA, 19 nt, Human
ucccugcaaaaaacugaaa

SEQ ID NO: 848765 - RNA, 20 nt, Human
ucccugcaaaaaacugaaaa

SEQ ID NO: 848766 - RNA, 20 nt, Human
ucccugcaaaaaacugaaaa

SEQ ID NO: 848767 - RNA, 19 nt, Human
ucugggguccucccuaagg

SEQ ID NO: 848768 - RNA, 21 nt, Human
ucuguagcuccagcuacauag

SEQ ID NO: 848769 - RNA, 20 nt, Human
ucuguugagcauaagacugg

SEQ ID NO: 848770 - RNA, 19 nt, Human
ugaaaaauccacaauauac

SEQ ID NO: 848771 - RNA, 19 nt, Human
ugaaauacuugggaacgga

SEQ ID NO: 848772 - RNA, 23 nt, Human
ugaagacaaauuucacccagaua

SEQ ID NO: 848773 - RNA, 21 nt, Human
ugacagaauaaaggaaagaaa

SEQ ID NO: 848774 - RNA, 23 nt, Human
ugacuauaaaugcaaaaggcccc

SEQ ID NO: 848775 - RNA, 21 nt, Human
ugagaaacaaaacacagccua

SEQ ID NO: 848776 - RNA, 21 nt, Human
ugagaaacaaaacacagccua

SEQ ID NO: 848777 - RNA, 23 nt, Human
ugagcaucccuaauccaaauauc

SEQ ID NO: 848778 - RNA, 22 nt, Human
ugagcccaggaauuugaggcug

SEQ ID NO: 848779 - RNA, 24 nt, Human
ugagcuaagacuauuauuaccacu

SEQ ID NO: 848780 - RNA, 18 nt, Human
ugaggcaggaggauagcu

SEQ ID NO: 848781 - RNA, 20 nt, Human
ugaggcaggaggauagcuuc

SEQ ID NO: 848782 - RNA, 26 nt, Human
ugaggcaggaggauagcuugaggcca

SEQ ID NO: 848783 - RNA, 19 nt, Human
ugaguccuuucauggacuc

SEQ ID NO: 848784 - RNA, 20 nt, Human
ugcaaaaaacugaaaaucua

SEQ ID NO: 848785 - RNA, 20 nt, Human
ugcaaaaaacugaaaaucua

SEQ ID NO: 848786 - RNA, 25 nt, Human
ugcauacauucuaaucuuccuuaca

SEQ ID NO: 848787 - RNA, 18 nt, Human
uggaacaucuaaaggcuu

SEQ ID NO: 848788 - RNA, 22 nt, Human
uggaauauuugcagaaaacuua

SEQ ID NO: 848789 - RNA, 23 nt, Human
uggaaucugggguuuacagaugu

SEQ ID NO: 848790 - RNA, 25 nt, Human
uggaaucugggguuuacagauguuu

SEQ ID NO: 848791 - RNA, 21 nt, Human
ugggaaaauaaaguguucuaa

SEQ ID NO: 848792 - RNA, 21 nt, Human
ugggaaaauaaaguguucuaa

SEQ ID NO: 848793 - RNA, 19 nt, Human
ugguauuggaaucuggggu

SEQ ID NO: 848794 - RNA, 21 nt, Human
ugucauaagaguucaacacuc

SEQ ID NO: 848795 - RNA, 23 nt, Human
ugucugggguccucccuaaggac

SEQ ID NO: 848796 - RNA, 24 nt, Human
ugucuguagcuccagcuacauagg

SEQ ID NO: 848797 - RNA, 23 nt, Human
uguuggguuucucucuaauuuga

SEQ ID NO: 848798 - RNA, 20 nt, Human
uguuuuguuguuguuguuuu

SEQ ID NO: 848799 - RNA, 21 nt, Human
uuacuagaauauuugaaggcu

SEQ ID NO: 848800 - RNA, 24 nt, Human
uuacuggaugagcaucccuaaucc

SEQ ID NO: 848801 - RNA, 24 nt, Human
uuagcugagcaugguggcaugugu

SEQ ID NO: 848802 - RNA, 19 nt, Human
uuauuguagugcuaauuac

SEQ ID NO: 848803 - RNA, 21 nt, Human
uucuaaucuuccuuacaugug

SEQ ID NO: 848804 - RNA, 22 nt, Human
uucuuuaacaaugaaccacuga

SEQ ID NO: 848805 - RNA, 22 nt, Human
uucuuuaacaaugaaccacuga

SEQ ID NO: 848806 - RNA, 21 nt, Human
uuuagaagggaacuaggaaaa

SEQ ID NO: 848807 - RNA, 21 nt, Human
uuuagaagggaacuaggaaaa

SEQ ID NO: 848808 - RNA, 18 nt, Human
uuuuuuuuuuuuuuuuug

SEQ ID NO: 848809 - RNA, 24 nt, Human
uuuuuuuuuuuuuuuuuggcaaau

SEQ ID NO: 848810 - RNA, 22 nt, Human
uuuuuuuuuuuuuuuuuuuggc

SEQ ID NO: 848811 - RNA, 23 nt, Human
aaaaaggagacuaguaaaauaga

SEQ ID NO: 848812 - RNA, 20 nt, Human
aacauggugaaacccucacu

SEQ ID NO: 848813 - RNA, 21 nt, Human
aacauggugaaacccucacuc

SEQ ID NO: 848814 - RNA, 22 nt, Human
aacauggugaaacccucacucu

SEQ ID NO: 848815 - RNA, 21 nt, Human
aagacauaaaaacagcaaccc

SEQ ID NO: 848816 - RNA, 25 nt, Human
aaucacuugaaucccgaggggcaga

SEQ ID NO: 848817 - RNA, 24 nt, Human
acacgaggucaggcguucgagacc

SEQ ID NO: 848818 - RNA, 21 nt, Human
acauauguggucauaugaaga

SEQ ID NO: 848819 - RNA, 20 nt, Human
accccuaaaguauauggaau

SEQ ID NO: 848820 - RNA, 26 nt, Human
agaggaccugaaggcaguauaaaaca

SEQ ID NO: 848821 - RNA, 21 nt, Human
agauacacacccuuaucaaua

SEQ ID NO: 848822 - RNA, 24 nt, Human
agcacuuugggaggcugaggaggg

SEQ ID NO: 848823 - RNA, 23 nt, Human
agccgggcaugauggcacucgcc

SEQ ID NO: 848824 - RNA, 22 nt, Human
agccuggccaacauggugaaac

SEQ ID NO: 848825 - RNA, 24 nt, Human
agccuggccaacauggugaaaccc

SEQ ID NO: 848826 - RNA, 25 nt, Human
aggagcagaggacauagagcaguga

SEQ ID NO: 848827 - RNA, 18 nt, Human
aggcaguagaaucacuug

SEQ ID NO: 848828 - RNA, 25 nt, Human
aggcaguagaaucacuugaaucccg

SEQ ID NO: 848829 - RNA, 24 nt, Human
aggcugaggcaguagaaucacuug

SEQ ID NO: 848830 - RNA, 21 nt, Human
auaaaacaaauauuccuaaca

SEQ ID NO: 848831 - RNA, 23 nt, Human
auauauauacuuucacauaugug

SEQ ID NO: 848832 - RNA, 19 nt, Human
augccuguaaucccagcac

SEQ ID NO: 848833 - RNA, 24 nt, Human
caacauggugaaacccucacucua

SEQ ID NO: 848834 - RNA, 24 nt, Human
caagagacaauaaaguaccuaaca

SEQ ID NO: 848835 - RNA, 23 nt, Human
caaucuucaaaaaaaggaacaau

SEQ ID NO: 848836 - RNA, 21 nt, Human
cacacccuuaucaauagcuua

SEQ ID NO: 848837 - RNA, 20 nt, Human
cacauauauauacuuucaca

SEQ ID NO: 848838 - RNA, 22 nt, Human
cacucuacuaaaaauacaaaaa

SEQ ID NO: 848839 - RNA, 23 nt, Human
cagaccaccaaauaagucaaaag

SEQ ID NO: 848840 - RNA, 23 nt, Human
cagcacuuugggaggcugaggag

SEQ ID NO: 848841 - RNA, 28 nt, Human
cagcacuuugggaggcugaggagggcgg

SEQ ID NO: 848842 - RNA, 20 nt, Human
cagcgagagacaaaggcccc

SEQ ID NO: 848843 - RNA, 24 nt, Human
cagcuacucgggaggcugaggcag

SEQ ID NO: 848844 - RNA, 21 nt, Human
cauagagcagugaagacgaga

SEQ ID NO: 848845 - RNA, 24 nt, Human
caugccuguaaucccagcacuuug

SEQ ID NO: 848846 - RNA, 25 nt, Human
ccaaauaagucaaaagagucuuaaa

SEQ ID NO: 848847 - RNA, 19 nt, Human
ccaauagguaaaagcaaug

SEQ ID NO: 848848 - RNA, 21 nt, Human
ccuauaaucccagcuacucgg

SEQ ID NO: 848849 - RNA, 22 nt, Human
ccuauaaucccagcuacucggg

SEQ ID NO: 848850 - RNA, 19 nt, Human
ccugaaggcaguauaaaac

SEQ ID NO: 848851 - RNA, 23 nt, Human
ccuggccaacauggugaaacccu

SEQ ID NO: 848852 - RNA, 25 nt, Human
ccuggccaacauggugaaacccuca

SEQ ID NO: 848853 - RNA, 21 nt, Human
cgacugcagcgagagacaaag

SEQ ID NO: 848854 - RNA, 24 nt, Human
cgagaccagccuggccaacauggu

SEQ ID NO: 848855 - RNA, 23 nt, Human
cgccuauaaucccagcuacucgg

SEQ ID NO: 848856 - RNA, 24 nt, Human
cggaucacacgaggucaggcguuc

SEQ ID NO: 848857 - RNA, 21 nt, Human
cucaagagacaauaaaguacc

SEQ ID NO: 848858 - RNA, 24 nt, Human
cucaugccuguaaucccagcacuu

SEQ ID NO: 848859 - RNA, 22 nt, Human
cugucaccaaaucauucaguag

SEQ ID NO: 848860 - RNA, 21 nt, Human
gacaauaaaguaccuaacaau

SEQ ID NO: 848861 - RNA, 24 nt, Human
gaucacacgaggucaggcguucga

SEQ ID NO: 848862 - RNA, 24 nt, Human
gauggcacucgccuauaaucccag

SEQ ID NO: 848863 - RNA, 24 nt, Human
gccaacauggugaaacccucacuc

SEQ ID NO: 848864 - RNA, 23 nt, Human
gccuauaaucccagcuacucggg

SEQ ID NO: 848865 - RNA, 26 nt, Human
gcuuuuguucaaaaguugaaauauug

SEQ ID NO: 848866 - RNA, 23 nt, Human
ggcagagguugcaguaacccaag

SEQ ID NO: 848867 - RNA, 23 nt, Human
gggaggcugaggcaguagaauca

SEQ ID NO: 848868 - RNA, 24 nt, Human
gggcacuguggcucaugccuguaa

SEQ ID NO: 848869 - RNA, 21 nt, Human
ggucauaugaagagucauuuu

SEQ ID NO: 848870 - RNA, 20 nt, Human
guaaaaaaaaaaaggagacu

SEQ ID NO: 848871 - RNA, 22 nt, Human
guggcucaugccuguaauccca

SEQ ID NO: 848872 - RNA, 21 nt, Human
uaaaaacagcaaccccuaaag

SEQ ID NO: 848873 - RNA, 21 nt, Human
uaaagguaaaaaaaaaaagga

SEQ ID NO: 848874 - RNA, 20 nt, Human
uaacaaaaauggaaugacaa

SEQ ID NO: 848875 - RNA, 25 nt, Human
uaacaaaaauggaaugacaauauaa

SEQ ID NO: 848876 - RNA, 23 nt, Human
uaacaaguuuacaaauauauagu

SEQ ID NO: 848877 - RNA, 23 nt, Human
uaagagaacagaggaccugaagg

SEQ ID NO: 848878 - RNA, 24 nt, Human
uaagauacacacccuuaucaauag

SEQ ID NO: 848879 - RNA, 22 nt, Human
uacaaagcuacagaauuaaaac

SEQ ID NO: 848880 - RNA, 21 nt, Human
uacacacccuuaucaauagcu

SEQ ID NO: 848881 - RNA, 27 nt, Human
uacagaauuaaaacaauuugcuacaag

SEQ ID NO: 848882 - RNA, 22 nt, Human
uaguaagaauaaaacaagacag

SEQ ID NO: 848883 - RNA, 22 nt, Human
uauauauacuuucacauaugug

SEQ ID NO: 848884 - RNA, 24 nt, Human
uauuacaaagcuacagaauuaaaa

SEQ ID NO: 848885 - RNA, 22 nt, Human
ucaugccuguaaucccagcacu

SEQ ID NO: 848886 - RNA, 25 nt, Human
ucgggaggcugaggcaguagaauca

SEQ ID NO: 848887 - RNA, 21 nt, Human
ucuauaacaaaaauggaauga

SEQ ID NO: 848888 - RNA, 19 nt, Human
ucucccaauaccugcaggu

SEQ ID NO: 848889 - RNA, 24 nt, Human
ucugaaauauaaaaauacuuggcc

SEQ ID NO: 848890 - RNA, 18 nt, Human
ucuucaaaaaaaggaaca

SEQ ID NO: 848891 - RNA, 25 nt, Human
ugacagaccaccaaauaagucaaaa

SEQ ID NO: 848892 - RNA, 24 nt, Human
ugaggagggcggaucacacgaggu

SEQ ID NO: 848893 - RNA, 26 nt, Human
ugaggagggcggaucacacgagguca

SEQ ID NO: 848894 - RNA, 20 nt, Human
ugaggcaguagaaucacuug

SEQ ID NO: 848895 - RNA, 25 nt, Human
ugaggcaguagaaucacuugaaucc

SEQ ID NO: 848896 - RNA, 23 nt, Human
ugccuguaaucccagcacuuugg

SEQ ID NO: 848897 - RNA, 23 nt, Human
ugccuguaaucccagcacuuugg

SEQ ID NO: 848898 - RNA, 24 nt, Human
ugccuguaaucccagcacuuuggg

SEQ ID NO: 848899 - RNA, 22 nt, Human
ugcgacugcagcgagagacaaa

SEQ ID NO: 848900 - RNA, 22 nt, Human
uggccaacauggugaaacccuc

SEQ ID NO: 848901 - RNA, 24 nt, Human
uggccgggcacuguggcucaugcc

SEQ ID NO: 848902 - RNA, 24 nt, Human
uggcucaugccuguaaucccagca

SEQ ID NO: 848903 - RNA, 19 nt, Human
ugggaggcugaggagggcg

SEQ ID NO: 848904 - RNA, 24 nt, Human
ugggaggcugaggagggcggauca

SEQ ID NO: 848905 - RNA, 24 nt, Human
uguggcucaugccuguaaucccag

SEQ ID NO: 848906 - RNA, 20 nt, Human
uguucaaaaguugaaauauu

SEQ ID NO: 848907 - RNA, 18 nt, Human
uucgagaccagccuggcc

SEQ ID NO: 848908 - RNA, 25 nt, Human
uugggaggcugaggagggcggauca

SEQ ID NO: 848909 - RNA, 19 nt, Human
aguugauuccauuuuucuu

SEQ ID NO: 848910 - RNA, 22 nt, Human
aguugcugagaaagaaucagaa

SEQ ID NO: 848911 - RNA, 22 nt, Human
aucauccaguugcuguugaagc

SEQ ID NO: 848912 - RNA, 20 nt, Human
cauggaccuguccauggccu

SEQ ID NO: 848913 - RNA, 19 nt, Human
ccuagcccccacccccgga

SEQ ID NO: 848914 - RNA, 20 nt, Human
ccucuuguucuucuagcaaa

SEQ ID NO: 848915 - RNA, 22 nt, Human
ccuucauuugacaccguuuggu

SEQ ID NO: 848916 - RNA, 19 nt, Human
cuagaauuuucuauuucaa

SEQ ID NO: 848917 - RNA, 18 nt, Human
cuccuuaguacauuuuau

SEQ ID NO: 848918 - RNA, 19 nt, Human
cuucucuuucugcuuucuc

SEQ ID NO: 848919 - RNA, 18 nt, Human
gaucauccucuuguucuu

SEQ ID NO: 848920 - RNA, 22 nt, Human
gcuugaagauuuugugcuguag

SEQ ID NO: 848921 - RNA, 28 nt, Human
uaauuucuuccuugaauccuacaucucc

SEQ ID NO: 848922 - RNA, 23 nt, Human
uaauuuucuuuuuuuauaugaga

SEQ ID NO: 848923 - RNA, 23 nt, Human
uacguggccuugcgucuccuuag

SEQ ID NO: 848924 - RNA, 21 nt, Human
uacucucagcuuuagaaaguu

SEQ ID NO: 848925 - RNA, 20 nt, Human
uagaagauccacaguaacuc

SEQ ID NO: 848926 - RNA, 20 nt, Human
uaugagauucuggaaauacu

SEQ ID NO: 848927 - RNA, 22 nt, Human
ucaauguccuucauuugacacc

SEQ ID NO: 848928 - RNA, 18 nt, Human
ucccuccccuagccccca

SEQ ID NO: 848929 - RNA, 25 nt, Human
ugacgcaaugaagcauccagcaaag

SEQ ID NO: 848930 - RNA, 23 nt, Human
ugagaaagaaucagaacaugaga

SEQ ID NO: 848931 - RNA, 18 nt, Human
uggacgcagugacgcaau

SEQ ID NO: 848932 - RNA, 20 nt, Human
uguaaaugacgcaauuuauc

SEQ ID NO: 848933 - RNA, 24 nt, Human
uguagguugggaaccucugcuaca

SEQ ID NO: 848934 - RNA, 20 nt, Human
ugugaacaucauccaguugc

SEQ ID NO: 848935 - RNA, 23 nt, Human
uguuauggagcucaguuuugagg

SEQ ID NO: 848936 - RNA, 21 nt, Human
uuacauaaauaaacugcauuu

SEQ ID NO: 848937 - RNA, 19 nt, Human
uuagaaaguugcugagaaa

SEQ ID NO: 848938 - RNA, 20 nt, Human
uuagaaaguugcugagaaag

SEQ ID NO: 848939 - RNA, 24 nt, Human
uucaaaaaccaaagcguuuucuuu

SEQ ID NO: 848940 - RNA, 20 nt, Human
uuguugugaacaucauccag

SEQ ID NO: 848941 - RNA, 21 nt, Human
uuuacauaaauaaacugcauu

SEQ ID NO: 848942 - RNA, 23 nt, Human
uuuguaguacacuagucuuuuuc

SEQ ID NO: 848943 - RNA, 18 nt, Human
uuuuuuuuuuuuuuuuug

SEQ ID NO: 848944 - RNA, 19 nt, Human
uuuuuuuuuuuuuuuuugu

SEQ ID NO: 848945 - RNA, 21 nt, Human
aaaugggccggaccgagaucc

SEQ ID NO: 848946 - RNA, 22 nt, Human
aacaaaaacgacugcaguagau

SEQ ID NO: 848947 - RNA, 25 nt, Human
aacccaaucugauccaacaauaacc

SEQ ID NO: 848948 - RNA, 23 nt, Human
aagccgcacccucgcggccccag

SEQ ID NO: 848949 - RNA, 19 nt, Human
aaggcucccccucccccac

SEQ ID NO: 848950 - RNA, 21 nt, Human
accaacagcagcagcaacugg

SEQ ID NO: 848951 - RNA, 24 nt, Human
acccacccucaggccucuccaccg

SEQ ID NO: 848952 - RNA, 20 nt, Human
agaagcgcagucuuaggccc

SEQ ID NO: 848953 - RNA, 18 nt, Human
agcaccaacagcagcagc

SEQ ID NO: 848954 - RNA, 22 nt, Human
aggagcggcugcgccgcccggc

SEQ ID NO: 848955 - RNA, 18 nt, Human
aggcucccccucccccac

SEQ ID NO: 848956 - RNA, 20 nt, Human
aggcucccccucccccaccc

SEQ ID NO: 848957 - RNA, 22 nt, Human
agugccuacuaucaccaggcac

SEQ ID NO: 848958 - RNA, 25 nt, Human
agugguucucauaauguggucccgg

SEQ ID NO: 848959 - RNA, 21 nt, Human
auucaauauuuauugagugcc

SEQ ID NO: 848960 - RNA, 28 nt, Human
caacaauaaccagccuuaauucaauaau

SEQ ID NO: 848961 - RNA, 24 nt, Human
caauauuuauugagugccuacuau

SEQ ID NO: 848962 - RNA, 23 nt, Human
cacagcacccggguuuaaacagg

SEQ ID NO: 848963 - RNA, 22 nt, Human
cacccuacacucuagggauggg

SEQ ID NO: 848964 - RNA, 19 nt, Human
cagaaaugaacucccggau

SEQ ID NO: 848965 - RNA, 19 nt, Human
cagcagcagcaacugggag

SEQ ID NO: 848966 - RNA, 23 nt, Human
caucuggcuucuaaacccacccu

SEQ ID NO: 848967 - RNA, 23 nt, Human
ccaacagcagcagcaacugggag

SEQ ID NO: 848968 - RNA, 19 nt, Human
ccacgcggccgcagcccca

SEQ ID NO: 848969 - RNA, 21 nt, Human
ccccucccccaccccgagucc

SEQ ID NO: 848970 - RNA, 19 nt, Human
ccgcacccucgcggcccca

SEQ ID NO: 848971 - RNA, 26 nt, Human
ccgcagccccagccgagacgcgagcu

SEQ ID NO: 848972 - RNA, 21 nt, Human
ccgggggggccggcuagggcc

SEQ ID NO: 848973 - RNA, 23 nt, Human
cgaggaggucagaaaugaacucc

SEQ ID NO: 848974 - RNA, 21 nt, Human
cgccgcccggccgggucaacg

SEQ ID NO: 848975 - RNA, 21 nt, Human
cgcggaggugauuccacacug

SEQ ID NO: 848976 - RNA, 22 nt, Human
cggauaucccccaccucugccu

SEQ ID NO: 848977 - RNA, 24 nt, Human
cggauaucccccaccucugccugg

SEQ ID NO: 848978 - RNA, 19 nt, Human
cggccgcagccccagccga

SEQ ID NO: 848979 - RNA, 19 nt, Human
cggccgggucaacgucgug

SEQ ID NO: 848980 - RNA, 19 nt, Human
cgggaagggccgggggggc

SEQ ID NO: 848981 - RNA, 19 nt, Human
cgggggggccggcuagggc

SEQ ID NO: 848982 - RNA, 20 nt, Human
cuaaacccacccucaggccu

SEQ ID NO: 848983 - RNA, 20 nt, Human
cuagggccggccagcuugga

SEQ ID NO: 848984 - RNA, 20 nt, Human
cucccccucccccaccccga

SEQ ID NO: 848985 - RNA, 20 nt, Human
cugaaggguacuguaauugu

SEQ ID NO: 848986 - RNA, 21 nt, Human
cugaaggguacuguaauuguu

SEQ ID NO: 848987 - RNA, 19 nt, Human
cugauccaacaauaaccag

SEQ ID NO: 848988 - RNA, 22 nt, Human
cuucuaaacccacccucaggcc

SEQ ID NO: 848989 - RNA, 23 nt, Human
gaacucccggauaucccccaccu

SEQ ID NO: 848990 - RNA, 21 nt, Human
gacccggcgccauuuuggugg

SEQ ID NO: 848991 - RNA, 23 nt, Human
gaggcgagcgcggcggccggggu

SEQ ID NO: 848992 - RNA, 22 nt, Human
gaguaccugucucaaacccaau

SEQ ID NO: 848993 - RNA, 19 nt, Human
gagugcggcgucggaaacc

SEQ ID NO: 848994 - RNA, 26 nt, Human
gcccgaaccuucggucagaggccagc

SEQ ID NO: 848995 - RNA, 24 nt, Human
gccgcacccucgcggccccagacg

SEQ ID NO: 848996 - RNA, 24 nt, Human
gcgcccgaaccuucggucagaggc

SEQ ID NO: 848997 - RNA, 22 nt, Human
gcgcggcggccggggugguagu

SEQ ID NO: 848998 - RNA, 19 nt, Human
gcggcggccggggugguag

SEQ ID NO: 848999 - RNA, 21 nt, Human
ggauaucccccaccucugccu

SEQ ID NO: 849000 - RNA, 23 nt, Human
gggccggaccgagauccgggaga

SEQ ID NO: 849001 - RNA, 23 nt, Human
guacuguaauuguuuccauuucu

SEQ ID NO: 849002 - RNA, 20 nt, Human
gugugugugugugugugugu

SEQ ID NO: 849003 - RNA, 20 nt, Human
uagauuuucuggggcuacac

SEQ ID NO: 849004 - RNA, 31 nt, Human
uaggagugagugugugugugugugugugugg

SEQ ID NO: 849005 - RNA, 18 nt, Human
ucagccuccggguuccgg

SEQ ID NO: 849006 - RNA, 23 nt, Human
uccaccgaguaccugucucaaac

SEQ ID NO: 849007 - RNA, 20 nt, Human
uccagccgagugcggcgucg

SEQ ID NO: 849008 - RNA, 23 nt, Human
ucccggaaccagcaccaacagca

SEQ ID NO: 849009 - RNA, 20 nt, Human
ucgugcgcaugcgccgaccc

SEQ ID NO: 849010 - RNA, 20 nt, Human
ugaacucccggauauccccc

SEQ ID NO: 849011 - RNA, 27 nt, Human
ugaauuuucacaugcuucauucaguuc

SEQ ID NO: 849012 - RNA, 20 nt, Human
ugagaugaugggaauaaucg

SEQ ID NO: 849013 - RNA, 18 nt, Human
ugcagaacaaaaacgacu

SEQ ID NO: 849014 - RNA, 22 nt, Human
ugccuacuaucaccaggcaccu

SEQ ID NO: 849015 - RNA, 22 nt, Human
uggcuucuaaacccacccucag

SEQ ID NO: 849016 - RNA, 19 nt, Human
uggggcgggaggguccucc

SEQ ID NO: 849017 - RNA, 18 nt, Human
ugugugugugugugugug

SEQ ID NO: 849018 - RNA, 18 nt, Human
ugugugugugugugugug

SEQ ID NO: 849019 - RNA, 18 nt, Human
ugugugugugugugugug

SEQ ID NO: 849020 - RNA, 21 nt, Human
ugugugugugugugugugugu

SEQ ID NO: 849021 - RNA, 21 nt, Human
ugugugugugugugugugugu

SEQ ID NO: 849022 - RNA, 21 nt, Human
ugugugugugugugugugugu

SEQ ID NO: 849023 - RNA, 21 nt, Human
ugugugugugugugugugugu

SEQ ID NO: 849024 - RNA, 22 nt, Human
ugugugugugugugugugugug

SEQ ID NO: 849025 - RNA, 22 nt, Human
ugugugugugugugugugugug

SEQ ID NO: 849026 - RNA, 19 nt, Human
uuacagaaauaaggcuccc

SEQ ID NO: 849027 - RNA, 18 nt, Human
uucaaggaggugcugaag

SEQ ID NO: 849028 - RNA, 18 nt, Human
uuccacacugaggcgagc

SEQ ID NO: 849029 - RNA, 19 nt, Human
uuuuuuuuuuuuuuuuugu

SEQ ID NO: 849030 - RNA, 27 nt, Human
uuuuuuuuuuuuuuuuuuuuuuugggg

SEQ ID NO: 849031 - RNA, 24 nt, Human
aaaagacaaagacaacagaggaca

SEQ ID NO: 849032 - RNA, 21 nt, Human
aaacaucagggcagcaagagc

SEQ ID NO: 849033 - RNA, 22 nt, Human
aaacaucagggcagcaagagcc

SEQ ID NO: 849034 - RNA, 21 nt, Human
aaagacaaagacaacagagga

SEQ ID NO: 849035 - RNA, 27 nt, Human
aaagacaacagaggacagccgguaccc

SEQ ID NO: 849036 - RNA, 22 nt, Human
aaccugcagcuucucccgcucc

SEQ ID NO: 849037 - RNA, 19 nt, Human
aagacaaagacaacagagg

SEQ ID NO: 849038 - RNA, 22 nt, Human
aaggagcagcagugggcuggcc

SEQ ID NO: 849039 - RNA, 21 nt, Human
accugcagcuucucccgcucc

SEQ ID NO: 849040 - RNA, 30 nt, Human
agacaaagacaacagaggacagcagagaaa

SEQ ID NO: 849041 - RNA, 23 nt, Human
agacaacagaggacagcagagaa

SEQ ID NO: 849042 - RNA, 20 nt, Human
agagaggaagaggaguccgc

SEQ ID NO: 849043 - RNA, 22 nt, Human
agcaagagccaucuggccccca

SEQ ID NO: 849044 - RNA, 23 nt, Human
agcagcagugggcuggccugggg

SEQ ID NO: 849045 - RNA, 18 nt, Human
agcagugggcuggccugg

SEQ ID NO: 849046 - RNA, 24 nt, Human
agccuuccgccgggccagcagcuc

SEQ ID NO: 849047 - RNA, 18 nt, Human
agcuccuccugggcaacc

SEQ ID NO: 849048 - RNA, 22 nt, Human
aggagaagagagaggaagagga

SEQ ID NO: 849049 - RNA, 24 nt, Human
aggcauuaccuuauuuaaaguuca

SEQ ID NO: 849050 - RNA, 18 nt, Human
agggacugauaaggacua

SEQ ID NO: 849051 - RNA, 18 nt, Human
augcagcuguuaaaagca

SEQ ID NO: 849052 - RNA, 19 nt, Human
caaaaaugcucucugcagc

SEQ ID NO: 849053 - RNA, 24 nt, Human
caaagacaacagaggacagcagag

SEQ ID NO: 849054 - RNA, 18 nt, Human
caccaggaggggcccagg

SEQ ID NO: 849055 - RNA, 23 nt, Human
caccaggaggggcccaggcagac

SEQ ID NO: 849056 - RNA, 18 nt, Human
cagcuccucggccugcug

SEQ ID NO: 849057 - RNA, 21 nt, Human
caggaggggcccaggcagacc

SEQ ID NO: 849058 - RNA, 18 nt, Human
cagggccgugaaagugcc

SEQ ID NO: 849059 - RNA, 18 nt, Human
cagggcggagagaaucag

SEQ ID NO: 849060 - RNA, 22 nt, Human
cagugggcuggccugggggucc

SEQ ID NO: 849061 - RNA, 20 nt, Human
cccaggcagaccccccaaaa

SEQ ID NO: 849062 - RNA, 22 nt, Human
cccccaaaacaucagggcagca

SEQ ID NO: 849063 - RNA, 22 nt, Human
cccccauacccucagagaugga

SEQ ID NO: 849064 - RNA, 24 nt, Human
cccccauacccucagagauggagg

SEQ ID NO: 849065 - RNA, 21 nt, Human
cccgugcgccauucugcaccg

SEQ ID NO: 849066 - RNA, 19 nt, Human
ccucacucagcuguuccuu

SEQ ID NO: 849067 - RNA, 21 nt, Human
ccucuuccugcucuuccucca

SEQ ID NO: 849068 - RNA, 19 nt, Human
ccugcggcagcuccucggc

SEQ ID NO: 849069 - RNA, 19 nt, Human
ccugcuccugccggcucug

SEQ ID NO: 849070 - RNA, 25 nt, Human
ccuuccgccgggccagcagcuccuc

SEQ ID NO: 849071 - RNA, 20 nt, Human
cgcgugugacacaccaggag

SEQ ID NO: 849072 - RNA, 22 nt, Human
cgcuggcgcugcagcuccuccu

SEQ ID NO: 849073 - RNA, 20 nt, Human
cucagagauggagggugacc

SEQ ID NO: 849074 - RNA, 22 nt, Human
cuccugcggcagcuccucggcc

SEQ ID NO: 849075 - RNA, 18 nt, Human
cuccugcugcagggcagc

SEQ ID NO: 849076 - RNA, 18 nt, Human
cuccugggccugcuccgc

SEQ ID NO: 849077 - RNA, 21 nt, Human
cucuaguugucuauggcugcg

SEQ ID NO: 849078 - RNA, 20 nt, Human
cucugcagcugggcccgcuc

SEQ ID NO: 849079 - RNA, 19 nt, Human
cugcaccgccucuuccugc

SEQ ID NO: 849080 - RNA, 19 nt, Human
cugcaccgccucuuccugc

SEQ ID NO: 849081 - RNA, 21 nt, Human
cugcagcuccuccugggcaac

SEQ ID NO: 849082 - RNA, 21 nt, Human
cugcagcugggcccgcucggc

SEQ ID NO: 849083 - RNA, 19 nt, Human
cugcggcagcuccucggcc

SEQ ID NO: 849084 - RNA, 20 nt, Human
cuggacgcgugugacacacc

SEQ ID NO: 849085 - RNA, 18 nt, Human
cuggcgcugcagcuccuc

SEQ ID NO: 849086 - RNA, 20 nt, Human
cugggccaccugcaggcugu

SEQ ID NO: 849087 - RNA, 23 nt, Human
cugggcccgcucggccuccagcu

SEQ ID NO: 849088 - RNA, 23 nt, Human
cuguugcuccagcgccuccuggg

SEQ ID NO: 849089 - RNA, 19 nt, Human
cuucucagccuuccgccgg

SEQ ID NO: 849090 - RNA, 21 nt, Human
cuucucgcucucggccaggag

SEQ ID NO: 849091 - RNA, 27 nt, Human
gaaaauaauaacagaugaccgguaccc

SEQ ID NO: 849092 - RNA, 22 nt, Human
gaacgaauuuauuauucaauaa

SEQ ID NO: 849093 - RNA, 23 nt, Human
gaacuaccaaggaaaagaguaac

SEQ ID NO: 849094 - RNA, 19 nt, Human
gaagagccucuggccuaca

SEQ ID NO: 849095 - RNA, 21 nt, Human
gacaacagaggacagcagaga

SEQ ID NO: 849096 - RNA, 18 nt, Human
gagcagcagugggcuggc

SEQ ID NO: 849097 - RNA, 21 nt, Human
gagcagcagugggcuggccug

SEQ ID NO: 849098 - RNA, 23 nt, Human
gagcagcagugggcuggccuggg

SEQ ID NO: 849099 - RNA, 18 nt, Human
gcagcagugggcuggccu

SEQ ID NO: 849100 - RNA, 19 nt, Human
gcagcugggcccgcucggc

SEQ ID NO: 849101 - RNA, 21 nt, Human
gccuacccgguccugcuccug

SEQ ID NO: 849102 - RNA, 18 nt, Human
gccucccucaccuccacc

SEQ ID NO: 849103 - RNA, 19 nt, Human
gcgcugcagcuccuccugg

SEQ ID NO: 849104 - RNA, 29 nt, Human
gcuccuuggccaggacugagcgcuucccc

SEQ ID NO: 849105 - RNA, 24 nt, Human
gcugcagcuccuccugggcaaccu

SEQ ID NO: 849106 - RNA, 21 nt, Human
ggaaaagaguaacuuguggca

SEQ ID NO: 849107 - RNA, 21 nt, Human
ggaacaccaggauagaagacc

SEQ ID NO: 849108 - RNA, 20 nt, Human
ggagaugguggccaggcugu

SEQ ID NO: 849109 - RNA, 25 nt, Human
ggaugcuggaaaccgcgggauagcu

SEQ ID NO: 849110 - RNA, 25 nt, Human
ggcauuaccuuauuuaaaguucaga

SEQ ID NO: 849111 - RNA, 24 nt, Human
ggccugcugcugggccaccugcag

SEQ ID NO: 849112 - RNA, 22 nt, Human
ggcgcugcagcuccuccugggc

SEQ ID NO: 849113 - RNA, 18 nt, Human
ggcuggccuggggguccg

SEQ ID NO: 849114 - RNA, 24 nt, Human
gggcggagagaaucagggcaagcg

SEQ ID NO: 849115 - RNA, 24 nt, Human
gugaaaagacaaagacaacagagg

SEQ ID NO: 849116 - RNA, 19 nt, Human
uaccaaggaaaagaguaac

SEQ ID NO: 849117 - RNA, 22 nt, Human
uagaagacccagaguaggagaa

SEQ ID NO: 849118 - RNA, 22 nt, Human
uauccagaguccuugaucugau

SEQ ID NO: 849119 - RNA, 20 nt, Human
ucaauaauuauaaaaugguc

SEQ ID NO: 849120 - RNA, 23 nt, Human
ucacucagcuguuccuuccucgg

SEQ ID NO: 849121 - RNA, 22 nt, Human
ucagggcagcaagagccaucug

SEQ ID NO: 849122 - RNA, 21 nt, Human
ucccgcuggcgcugcagcucc

SEQ ID NO: 849123 - RNA, 19 nt, Human
ucccugaaggcuuugauug

SEQ ID NO: 849124 - RNA, 20 nt, Human
ucuaguugucuauggcugcg

SEQ ID NO: 849125 - RNA, 18 nt, Human
ucucugacagcgccaucu

SEQ ID NO: 849126 - RNA, 25 nt, Human
ucugcaccgccucuuccugcucuuc

SEQ ID NO: 849127 - RNA, 23 nt, Human
ucugcagcugggcccgcucggcc

SEQ ID NO: 849128 - RNA, 22 nt, Human
ugaccagguaaauacaagggac

SEQ ID NO: 849129 - RNA, 23 nt, Human
ugauaaggacuaugacggggaca

SEQ ID NO: 849130 - RNA, 21 nt, Human
ugcaccgccucuuccugcucu

SEQ ID NO: 849131 - RNA, 18 nt, Human
ugcagcuucucccgcucc

SEQ ID NO: 849132 - RNA, 18 nt, Human
ugcagggcggagagaauc

SEQ ID NO: 849133 - RNA, 18 nt, Human
ugccgcuccaucuccagg

SEQ ID NO: 849134 - RNA, 18 nt, Human
ugcuccagcgccuccugg

SEQ ID NO: 849135 - RNA, 20 nt, Human
ugggaugcuggaaaccgcgg

SEQ ID NO: 849136 - RNA, 21 nt, Human
ugguuucugccgcuccaucuc

SEQ ID NO: 849137 - RNA, 18 nt, Human
uguaaaauagcagaacga

SEQ ID NO: 849138 - RNA, 19 nt, Human
uugcuccagcgccuccugg

SEQ ID NO: 849139 - RNA, 19 nt, Human
aaaggaaaagggcaggaaa

SEQ ID NO: 849140 - RNA, 20 nt, Human
aagagaaaaaagguggaaaa

SEQ ID NO: 849141 - RNA, 22 nt, Human
aagaggaagaagggaacuccag

SEQ ID NO: 849142 - RNA, 20 nt, Human
aagauaccaaaggcuuauga

SEQ ID NO: 849143 - RNA, 18 nt, Human
acaaaggaagggaagaaa

SEQ ID NO: 849144 - RNA, 22 nt, Human
acaaaggaagggaagaaaagag

SEQ ID NO: 849145 - RNA, 23 nt, Human
acaaaggaagggaagaaaagaga

SEQ ID NO: 849146 - RNA, 22 nt, Human
agaaaaaagguggaaaaucagg

SEQ ID NO: 849147 - RNA, 22 nt, Human
agagcagaauagcaguccugug

SEQ ID NO: 849148 - RNA, 19 nt, Human
aggaagggaagaaaagaga

SEQ ID NO: 849149 - RNA, 23 nt, Human
aguccagugggggacuuugagug

SEQ ID NO: 849150 - RNA, 24 nt, Human
aguuggggauggaggggaugaugc

SEQ ID NO: 849151 - RNA, 19 nt, Human
auagcaguccuguguuucc

SEQ ID NO: 849152 - RNA, 20 nt, Human
caaagcuugauuuucaccac

SEQ ID NO: 849153 - RNA, 25 nt, Human
cacccacuguuccaccagcuggcac

SEQ ID NO: 849154 - RNA, 24 nt, Human
caggaaagauaccaaaggcuuagu

SEQ ID NO: 849155 - RNA, 21 nt, Human
caggaagcccagccuggcucc

SEQ ID NO: 849156 - RNA, 26 nt, Human
cauuuguucucucgagcauccuucca

SEQ ID NO: 849157 - RNA, 21 nt, Human
ccaccagcuggcaccagauca

SEQ ID NO: 849158 - RNA, 21 nt, Human
ccucugaauuucuaguugcaa

SEQ ID NO: 849159 - RNA, 21 nt, Human
ccuggcuccuuuucucuuuug

SEQ ID NO: 849160 - RNA, 22 nt, Human
ccuugauuuauccuucccuugg

SEQ ID NO: 849161 - RNA, 22 nt, Human
ccuugcacuggcuuguuuccuc

SEQ ID NO: 849162 - RNA, 25 nt, Human
ccuuggcuuugggcuuugaggaagu

SEQ ID NO: 849163 - RNA, 19 nt, Human
ccuuuucucuuuugcuccc

SEQ ID NO: 849164 - RNA, 21 nt, Human
cuaaagccagcauaccaaccc

SEQ ID NO: 849165 - RNA, 18 nt, Human
cucuauuccaagccccuc

SEQ ID NO: 849166 - RNA, 18 nt, Human
cuggggucaagucucuuu

SEQ ID NO: 849167 - RNA, 18 nt, Human
gaagaaaagagaaaaaag

SEQ ID NO: 849168 - RNA, 19 nt, Human
gaagaagggaacuccagua

SEQ ID NO: 849169 - RNA, 21 nt, Human
gaaguuggggauggaggggau

SEQ ID NO: 849170 - RNA, 21 nt, Human
gagcauccuuccagauguuuc

SEQ ID NO: 849171 - RNA, 24 nt, Human
gagcauccuuccagauguuucucc

SEQ ID NO: 849172 - RNA, 20 nt, Human
gagucguaguacaguccugg

SEQ ID NO: 849173 - RNA, 24 nt, Human
gcaggagagcagaauagcaguccu

SEQ ID NO: 849174 - RNA, 25 nt, Human
ggaggaagcaguccagugggggacu

SEQ ID NO: 849175 - RNA, 18 nt, Human
ggaggggaugaugcuucu

SEQ ID NO: 849176 - RNA, 19 nt, Human
ggauggaggggaugaugcu

SEQ ID NO: 849177 - RNA, 21 nt, Human
ggauugagccuacagcaagag

SEQ ID NO: 849178 - RNA, 22 nt, Human
ggcuuaugaaaacaaaggaagg

SEQ ID NO: 849179 - RNA, 22 nt, Human
gggaagaaaagagaaaaaaggu

SEQ ID NO: 849180 - RNA, 19 nt, Human
uaaagccagcauaccaacc

SEQ ID NO: 849181 - RNA, 27 nt, Human
uagcaguccuguguuuccugugucugu

SEQ ID NO: 849182 - RNA, 21 nt, Human
uauagaguacacaaaggaaaa

SEQ ID NO: 849183 - RNA, 19 nt, Human
ucaggaagcccagccuggc

SEQ ID NO: 849184 - RNA, 23 nt, Human
uccaccagcuggcaccagaucac

SEQ ID NO: 849185 - RNA, 20 nt, Human
ucccgagcucugcgaugcug

SEQ ID NO: 849186 - RNA, 19 nt, Human
uccuucccuuggcuuuggg

SEQ ID NO: 849187 - RNA, 26 nt, Human
uccuuuucucuuuugcuccccuugca

SEQ ID NO: 849188 - RNA, 21 nt, Human
ucuaaagccagcauaccaacc

SEQ ID NO: 849189 - RNA, 22 nt, Human
ucuaaagccagcauaccaaccc

SEQ ID NO: 849190 - RNA, 18 nt, Human
ugaauuucuaguugcaac

SEQ ID NO: 849191 - RNA, 22 nt, Human
ugcacuggcuuguuuccucccc

SEQ ID NO: 849192 - RNA, 18 nt, Human
ugccucccgagcucugcg

SEQ ID NO: 849193 - RNA, 22 nt, Human
uggcaccagaucaccgugggca

SEQ ID NO: 849194 - RNA, 26 nt, Human
uggcuuugggcuuugaggaaguuggg

SEQ ID NO: 849195 - RNA, 22 nt, Human
ugggaaagauuaguuguagaug

SEQ ID NO: 849196 - RNA, 20 nt, Human
ugugggaucaggaagcccag

SEQ ID NO: 849197 - RNA, 21 nt, Human
uuauaccaguggggcuaagga

SEQ ID NO: 849198 - RNA, 18 nt, Human
uuauccuucccuuggcuu

SEQ ID NO: 849199 - RNA, 28 nt, Human
uugcuccccuugcacuggcuuguuuccc

SEQ ID NO: 849200 - RNA, 20 nt, Human
uuuuuuuuuuuuuugccaaa

SEQ ID NO: 849201 - RNA, 18 nt, Human
uuuuuuuuuuuuuuuuug

SEQ ID NO: 849202 - RNA, 22 nt, Human
uuuuuuuuuuuuuuuuugccaa

SEQ ID NO: 849203 - RNA, 24 nt, Human
uuuuuuuuuuuuuuuuugccaaau

SEQ ID NO: 849204 - RNA, 19 nt, Human
agagcucagcacucacugc

SEQ ID NO: 849205 - RNA, 21 nt, Human
agagggggaaagguccagagc

SEQ ID NO: 849206 - RNA, 18 nt, Human
agccacuucccucacugg

SEQ ID NO: 849207 - RNA, 24 nt, Human
agggagagggggaaagguccagag

SEQ ID NO: 849208 - RNA, 23 nt, Human
aggguuuguuuaagguuuucucc

SEQ ID NO: 849209 - RNA, 19 nt, Human
auaagaccaccucugcgca

SEQ ID NO: 849210 - RNA, 25 nt, Human
caaccuaacaaucaccucuuuccag

SEQ ID NO: 849211 - RNA, 20 nt, Human
caaucaccucuuuccaggcc

SEQ ID NO: 849212 - RNA, 21 nt, Human
caggggaagcugagcuggaua

SEQ ID NO: 849213 - RNA, 25 nt, Human
caggucccacggugggucccagggg

SEQ ID NO: 849214 - RNA, 20 nt, Human
ccaaggucacagugagucag

SEQ ID NO: 849215 - RNA, 24 nt, Human
ccagagcuguggagaaagaagggg

SEQ ID NO: 849216 - RNA, 25 nt, Human
ccucugcgcaaccuaacaaucaccu

SEQ ID NO: 849217 - RNA, 26 nt, Human
ccugucuccaggguuuguuuaagguu

SEQ ID NO: 849218 - RNA, 19 nt, Human
gagcuguggagaaagaagg

SEQ ID NO: 849219 - RNA, 20 nt, Human
gccgcagggagagggggaaa

SEQ ID NO: 849220 - RNA, 19 nt, Human
ggagagggggaaaggucca

SEQ ID NO: 849221 - RNA, 21 nt, Human
gggagagggggaaagguccag

SEQ ID NO: 849222 - RNA, 20 nt, Human
ggugacaaaggccgcaggga

SEQ ID NO: 849223 - RNA, 24 nt, Human
guuuguuuaagguuuucuccaugg

SEQ ID NO: 849224 - RNA, 24 nt, Human
uaacaaucaccucuuuccaggccu

SEQ ID NO: 849225 - RNA, 24 nt, Human
uccauggccuagggcccagccacu

SEQ ID NO: 849226 - RNA, 22 nt, Human
ucugcgcaaccuaacaaucacc

SEQ ID NO: 849227 - RNA, 24 nt, Human
ugacaaaggccgcagggagagggg

SEQ ID NO: 849228 - RNA, 25 nt, Human
ugacaaaggccgcagggagaggggg

SEQ ID NO: 849229 - RNA, 19 nt, Human
ugcgcaaccuaacaaucac

SEQ ID NO: 849230 - RNA, 19 nt, Human
ugcgcaaccuaacaaucac

SEQ ID NO: 849231 - RNA, 21 nt, Human
ugggggaagggugagagcuca

SEQ ID NO: 849232 - RNA, 19 nt, Human
uuccaggccuuguggguca

SEQ ID NO: 849233 - RNA, 19 nt, Human
uuuuuuuuuuuuagugggg

SEQ ID NO: 849234 - RNA, 19 nt, Human
uuuuuuuuuuuuuuagugg

SEQ ID NO: 849235 - RNA, 23 nt, Human
uuuuuuuuuuuuuuuuuaguggg

SEQ ID NO: 849236 - RNA, 23 nt, Human
aacagcuucugaagcugaagcua

SEQ ID NO: 849237 - RNA, 18 nt, Human
agaggaaacacagugaca

SEQ ID NO: 849238 - RNA, 20 nt, Human
agaggaugaggaaguggaag

SEQ ID NO: 849239 - RNA, 18 nt, Human
aggggggaagaggaggga

SEQ ID NO: 849240 - RNA, 25 nt, Human
cugaagcuaugacaaugaacuucca

SEQ ID NO: 849241 - RNA, 18 nt, Human
cugaagcugaagcuauga

SEQ ID NO: 849242 - RNA, 22 nt, Human
gaggaugaggaaguggaaggga

SEQ ID NO: 849243 - RNA, 21 nt, Human
gcuaugacaaugaacuuccau

SEQ ID NO: 849244 - RNA, 28 nt, Human
gggaacagugcagaggaaaccgguaccc

SEQ ID NO: 849245 - RNA, 18 nt, Human
uaaaaaaaggggggaaga

SEQ ID NO: 849246 - RNA, 21 nt, Human
uaugacaaugaacuuccaugu

SEQ ID NO: 849247 - RNA, 25 nt, Human
uggaguagagucuaggaaaugauau

SEQ ID NO: 849248 - RNA, 23 nt, Human
uuuuuuuuuuuuuuuuuuauuuu

SEQ ID NO: 849249 - RNA, 19 nt, Human
aagaagguuuagcaagaag

SEQ ID NO: 849250 - RNA, 20 nt, Human
aaggacaagacaagacucgg

SEQ ID NO: 849251 - RNA, 23 nt, Human
aaugcacauccaaaacgggugac

SEQ ID NO: 849252 - RNA, 23 nt, Human
aaugcggggccugcaccagcaga

SEQ ID NO: 849253 - RNA, 23 nt, Human
acaagacucggccccucccacca

SEQ ID NO: 849254 - RNA, 21 nt, Human
accacaaaaccccuuuccccc

SEQ ID NO: 849255 - RNA, 22 nt, Human
accccgagaaggccgaugccag

SEQ ID NO: 849256 - RNA, 20 nt, Human
acucggccccucccaccauc

SEQ ID NO: 849257 - RNA, 21 nt, Human
agacaagagcugcccccagag

SEQ ID NO: 849258 - RNA, 21 nt, Human
agcaggugggggcugugcuga

SEQ ID NO: 849259 - RNA, 22 nt, Human
agccgggcagccaaucgagccc

SEQ ID NO: 849260 - RNA, 21 nt, Human
aggaacucagcccgguugagg

SEQ ID NO: 849261 - RNA, 21 nt, Human
aggagacuuggaguccaagca

SEQ ID NO: 849262 - RNA, 20 nt, Human
agggccagcccugcccccag

SEQ ID NO: 849263 - RNA, 18 nt, Human
auagggcuguccccaugg

SEQ ID NO: 849264 - RNA, 18 nt, Human
auaguguggagaguugca

SEQ ID NO: 849265 - RNA, 22 nt, Human
auccaaaacgggugacuuggaa

SEQ ID NO: 849266 - RNA, 18 nt, Human
augaaaugcacauccaaa

SEQ ID NO: 849267 - RNA, 21 nt, Human
augaugaugaaaggacaagac

SEQ ID NO: 849268 - RNA, 24 nt, Human
augcacauccaaaacgggugaccc

SEQ ID NO: 849269 - RNA, 19 nt, Human
auggcaauggcaccugcau

SEQ ID NO: 849270 - RNA, 24 nt, Human
augucaucuguauugucacaugaa

SEQ ID NO: 849271 - RNA, 22 nt, Human
caaaacgcacuugaggaaccaa

SEQ ID NO: 849272 - RNA, 22 nt, Human
caaaagcaucucgcaggcuggu

SEQ ID NO: 849273 - RNA, 21 nt, Human
caagacaagacucggccccuc

SEQ ID NO: 849274 - RNA, 22 nt, Human
caagacaagacucggccccucc

SEQ ID NO: 849275 - RNA, 19 nt, Human
caagcaaaggggcaagagg

SEQ ID NO: 849276 - RNA, 22 nt, Human
caagggccuucuccccgaagac

SEQ ID NO: 849277 - RNA, 19 nt, Human
cacaaaaccccuuuccccc

SEQ ID NO: 849278 - RNA, 22 nt, Human
cacaaaaccccuuucccccaaa

SEQ ID NO: 849279 - RNA, 18 nt, Human
cacacggaguccggcccc

SEQ ID NO: 849280 - RNA, 19 nt, Human
cacauggcuguuuaucucc

SEQ ID NO: 849281 - RNA, 25 nt, Human
cacccccugccccuucucuagggcc

SEQ ID NO: 849282 - RNA, 19 nt, Human
caccucgccacccccugcc

SEQ ID NO: 849283 - RNA, 19 nt, Human
cagagcagaagcuaaauag

SEQ ID NO: 849284 - RNA, 19 nt, Human
cagcacuuccgaaaguuau

SEQ ID NO: 849285 - RNA, 24 nt, Human
cagcucccaaaacgcacuugagga

SEQ ID NO: 849286 - RNA, 22 nt, Human
cauccugauuuuugcuguuccc

SEQ ID NO: 849287 - RNA, 21 nt, Human
ccaaagccucaucgaugccca

SEQ ID NO: 849288 - RNA, 18 nt, Human
ccaacuuggggacagagu

SEQ ID NO: 849289 - RNA, 23 nt, Human
ccacaaaaccccuuucccccaaa

SEQ ID NO: 849290 - RNA, 23 nt, Human
ccaccauccugauuuuugcuguu

SEQ ID NO: 849291 - RNA, 22 nt, Human
ccacccagcuccaaggggacgu

SEQ ID NO: 849292 - RNA, 20 nt, Human
ccacccagcuccaaggggag

SEQ ID NO: 849293 - RNA, 22 nt, Human
ccacgcccgccaccucgccacc

SEQ ID NO: 849294 - RNA, 24 nt, Human
ccagaggcuugugugggccggcgg

SEQ ID NO: 849295 - RNA, 18 nt, Human
cccaugggcacccguugg

SEQ ID NO: 849296 - RNA, 18 nt, Human
ccccagagccgccaccgu

SEQ ID NO: 849297 - RNA, 23 nt, Human
ccccgucaccagcaggugggggc

SEQ ID NO: 849298 - RNA, 21 nt, Human
ccccucccaccauccugauuu

SEQ ID NO: 849299 - RNA, 19 nt, Human
ccccugggggccaaagccu

SEQ ID NO: 849300 - RNA, 20 nt, Human
cccgggcacgggcccggcuc

SEQ ID NO: 849301 - RNA, 21 nt, Human
ccguggcugccucccugccuu

SEQ ID NO: 849302 - RNA, 22 nt, Human
ccucccugccuucuccgccgca

SEQ ID NO: 849303 - RNA, 23 nt, Human
ccucgcucaccccgagaaggccg

SEQ ID NO: 849304 - RNA, 23 nt, Human
ccucugccacccagcuccaaggg

SEQ ID NO: 849305 - RNA, 18 nt, Human
ccucuggcagcugcugug

SEQ ID NO: 849306 - RNA, 23 nt, Human
ccuggccgcucuguuccacccac

SEQ ID NO: 849307 - RNA, 19 nt, Human
ccuucuccccgaagacaag

SEQ ID NO: 849308 - RNA, 19 nt, Human
ccuuggggguuaauagcug

SEQ ID NO: 849309 - RNA, 21 nt, Human
cgaggccuuucugcccgagcu

SEQ ID NO: 849310 - RNA, 18 nt, Human
cggccccucccaccaucc

SEQ ID NO: 849311 - RNA, 23 nt, Human
cgggcccggcucugggaagcugg

SEQ ID NO: 849312 - RNA, 25 nt, Human
cggggcuccgggccccccuuggggg

SEQ ID NO: 849313 - RNA, 23 nt, Human
cucccaaaacgcacuugaggaac

SEQ ID NO: 849314 - RNA, 20 nt, Human
cuccucugccacccagcucc

SEQ ID NO: 849315 - RNA, 22 nt, Human
cuccucugccacccagcuccaa

SEQ ID NO: 849316 - RNA, 18 nt, Human
cuccuggccgcucuguuc

SEQ ID NO: 849317 - RNA, 21 nt, Human
cucucuggcagcagcucccaa

SEQ ID NO: 849318 - RNA, 19 nt, Human
cugccccuucucuagggcc

SEQ ID NO: 849319 - RNA, 24 nt, Human
cuguggcgugugcacccggccucc

SEQ ID NO: 849320 - RNA, 22 nt, Human
gagucagcucacaccccaggcc

SEQ ID NO: 849321 - RNA, 20 nt, Human
gaugaaaggacaagacaaga

SEQ ID NO: 849322 - RNA, 19 nt, Human
gcccgaggccuuucugccc

SEQ ID NO: 849323 - RNA, 21 nt, Human
gcggggcuccgggccccccuu

SEQ ID NO: 849324 - RNA, 19 nt, Human
gcugaugggcccgaggccu

SEQ ID NO: 849325 - RNA, 28 nt, Human
ggcccuuuagcucucuggcagcagcucu

SEQ ID NO: 849326 - RNA, 18 nt, Human
ggcugugcugaugggccc

SEQ ID NO: 849327 - RNA, 21 nt, Human
gguccuggcugccuagagagg

SEQ ID NO: 849328 - RNA, 22 nt, Human
guccaacuuggggacagagugu

SEQ ID NO: 849329 - RNA, 24 nt, Human
gugcugaugggcccgaggccuuuc

SEQ ID NO: 849330 - RNA, 19 nt, Human
uagggccagcccugccccc

SEQ ID NO: 849331 - RNA, 23 nt, Human
uagguugggggcauuuuggcagg

SEQ ID NO: 849332 - RNA, 19 nt, Human
ucagcucacaccccaggcc

SEQ ID NO: 849333 - RNA, 18 nt, Human
ucagggacaggaacucag

SEQ ID NO: 849334 - RNA, 18 nt, Human
uccaacuuggggacagag

SEQ ID NO: 849335 - RNA, 20 nt, Human
uccacccacgcccgccaccu

SEQ ID NO: 849336 - RNA, 22 nt, Human
uccccaagaaaaggguucugug

SEQ ID NO: 849337 - RNA, 20 nt, Human
uccccagaggagagucagcu

SEQ ID NO: 849338 - RNA, 19 nt, Human
uccccgaagacaagagcug

SEQ ID NO: 849339 - RNA, 24 nt, Human
uccccgaagacaagagcugccccc

SEQ ID NO: 849340 - RNA, 19 nt, Human
ucuagggccagcccugccc

SEQ ID NO: 849341 - RNA, 20 nt, Human
ucuccccgaagacaagagcu

SEQ ID NO: 849342 - RNA, 23 nt, Human
ucuccucugccacccagcuccaa

SEQ ID NO: 849343 - RNA, 20 nt, Human
ucucuggcagcagcucccaa

SEQ ID NO: 849344 - RNA, 20 nt, Human
ucucuggccccgucaccagc

SEQ ID NO: 849345 - RNA, 21 nt, Human
ugacuuggaaacgaccuauua

SEQ ID NO: 849346 - RNA, 19 nt, Human
ugagguggggguggccgcu

SEQ ID NO: 849347 - RNA, 21 nt, Human
ugccagcccggcuccaagggc

SEQ ID NO: 849348 - RNA, 19 nt, Human
ugcuguggcgugaugggca

SEQ ID NO: 849349 - RNA, 23 nt, Human
uggcagcagcucccaaaacgcac

SEQ ID NO: 849350 - RNA, 21 nt, Human
uggccgcucuguuccacccac

SEQ ID NO: 849351 - RNA, 22 nt, Human
uggggacagagugugcagcacu

SEQ ID NO: 849352 - RNA, 21 nt, Human
ugugcugaugggcccgaggcc

SEQ ID NO: 849353 - RNA, 19 nt, Human
uguuaaauauaguguggag

SEQ ID NO: 849354 - RNA, 26 nt, Human
uguuccacccacgcccgccaccucgc

SEQ ID NO: 849355 - RNA, 19 nt, Human
uucagggacaggaacucag

SEQ ID NO: 849356 - RNA, 18 nt, Human
uucuccgccgcagcuguu

SEQ ID NO: 849357 - RNA, 19 nt, Human
aaacacucugcacuaguca

SEQ ID NO: 849358 - RNA, 23 nt, Human
aacaucgcauccuucaaaggcuc

SEQ ID NO: 849359 - RNA, 21 nt, Human
aacugagugaucucuaaacac

SEQ ID NO: 849360 - RNA, 23 nt, Human
acuucaaagaaauuagugagaga

SEQ ID NO: 849361 - RNA, 22 nt, Human
aucaacucugcuuauccuugaa

SEQ ID NO: 849362 - RNA, 18 nt, Human
auccuugaagacuucaaa

SEQ ID NO: 849363 - RNA, 25 nt, Human
cagucaccaucaccagagucagcac

SEQ ID NO: 849364 - RNA, 19 nt, Human
ccuucaaaggcucugccuc

SEQ ID NO: 849365 - RNA, 22 nt, Human
cuaguucaugaucccuuucuca

SEQ ID NO: 849366 - RNA, 24 nt, Human
cucugcuuauccuugaagacuuca

SEQ ID NO: 849367 - RNA, 19 nt, Human
gccagucuuuaaaaacuga

SEQ ID NO: 849368 - RNA, 18 nt, Human
gcugcacugagacacgau

SEQ ID NO: 849369 - RNA, 23 nt, Human
uaagaaugacaacaucgcauccu

SEQ ID NO: 849370 - RNA, 25 nt, Human
ucccggagacuuuugaaauucuacc

SEQ ID NO: 849371 - RNA, 20 nt, Human
uccuucaaaggcucugccuc

SEQ ID NO: 849372 - RNA, 28 nt, Human
ugacaacaucgcauccuucaaaggcucu

SEQ ID NO: 849373 - RNA, 20 nt, Human
ugagacacgauaaaggccag

SEQ ID NO: 849374 - RNA, 19 nt, Human
ugagugaucucuaaacacu

SEQ ID NO: 849375 - RNA, 18 nt, Human
ugccucggcugcacugag

SEQ ID NO: 849376 - RNA, 21 nt, Human
uucaagagucugugccucuaa

SEQ ID NO: 849377 - RNA, 21 nt, Human
uucaugaucccuuucucagau

SEQ ID NO: 849378 - RNA, 20 nt, Human
uuucugaaguuggacuugau

SEQ ID NO: 849379 - RNA, 19 nt, Human
aaaaggccccacgcaaaga

SEQ ID NO: 849380 - RNA, 21 nt, Human
aaggccccacgcaaagaauuc

SEQ ID NO: 849381 - RNA, 22 nt, Human
acgcucaugccgcggccaugcc

SEQ ID NO: 849382 - RNA, 20 nt, Human
agcucggggcgcuccgggac

SEQ ID NO: 849383 - RNA, 22 nt, Human
agcucggggcgcuccgggacga

SEQ ID NO: 849384 - RNA, 19 nt, Human
aggcggcggcgccgagggc

SEQ ID NO: 849385 - RNA, 23 nt, Human
agugcaauggugugaucuuggcu

SEQ ID NO: 849386 - RNA, 24 nt, Human
agugcaauggugugaucuuggcuc

SEQ ID NO: 849387 - RNA, 18 nt, Human
augccuaggcuggagugc

SEQ ID NO: 849388 - RNA, 18 nt, Human
auggagucucaccaugcc

SEQ ID NO: 849389 - RNA, 21 nt, Human
augguacacacuuggugggcc

SEQ ID NO: 849390 - RNA, 22 nt, Human
caccaugccuaggcuggagugc

SEQ ID NO: 849391 - RNA, 24 nt, Human
caccaugccuaggcuggagugcaa

SEQ ID NO: 849392 - RNA, 23 nt, Human
cacugcaaccuccgcuuccuggg

SEQ ID NO: 849393 - RNA, 18 nt, Human
ccaaagccuuguagccag

SEQ ID NO: 849394 - RNA, 20 nt, Human
ccaggaaccgaccacuuagc

SEQ ID NO: 849395 - RNA, 20 nt, Human
ccccgcggccugcgcgcccg

SEQ ID NO: 849396 - RNA, 21 nt, Human
ccccgcggccugcgcgcccgc

SEQ ID NO: 849397 - RNA, 20 nt, Human
cccgcgccagcucggggcgc

SEQ ID NO: 849398 - RNA, 24 nt, Human
cccgcgcccucaugggcucugcgg

SEQ ID NO: 849399 - RNA, 19 nt, Human
ccuaggcuggagugcaaug

SEQ ID NO: 849400 - RNA, 19 nt, Human
ccuccagcuccggcggcgg

SEQ ID NO: 849401 - RNA, 20 nt, Human
ccuccagcuccggcggcggc

SEQ ID NO: 849402 - RNA, 22 nt, Human
ccucgggcuccgacgccgccuu

SEQ ID NO: 849403 - RNA, 21 nt, Human
ccuuguagccaggugcucccc

SEQ ID NO: 849404 - RNA, 20 nt, Human
cgccgagggcugaggaggcg

SEQ ID NO: 849405 - RNA, 19 nt, Human
cgccgccuucuccuccagc

SEQ ID NO: 849406 - RNA, 23 nt, Human
cgccucgggcuccgacgccgccu

SEQ ID NO: 849407 - RNA, 19 nt, Human
cgcggccugcgcgcccgcg

SEQ ID NO: 849408 - RNA, 22 nt, Human
cggaggcugaagcugcggauca

SEQ ID NO: 849409 - RNA, 24 nt, Human
cucacugcaaccuccgcuuccugg

SEQ ID NO: 849410 - RNA, 24 nt, Human
cuccacgcucaugccgcggccaug

SEQ ID NO: 849411 - RNA, 21 nt, Human
cuccaggaaccgaccacuuag

SEQ ID NO: 849412 - RNA, 22 nt, Human
cuccaggaaccgaccacuuagc

SEQ ID NO: 849413 - RNA, 24 nt, Human
cuccuccagcuccggcggcggcuc

SEQ ID NO: 849414 - RNA, 22 nt, Human
cugcaaccuccgcuuccugggu

SEQ ID NO: 849415 - RNA, 19 nt, Human
gcagcuccaggaaccgacc

SEQ ID NO: 849416 - RNA, 24 nt, Human
gccuaggcuggagugcaauggugu

SEQ ID NO: 849417 - RNA, 30 nt, Human; identical to SEQ ID NO: 340167

SEQ ID NO: 849418 - RNA, 20 nt, Human
ggaggcggcggaggcugaag

SEQ ID NO: 849419 - RNA, 20 nt, Human
ggagucucaccaugccuagg

SEQ ID NO: 849420 - RNA, 18 nt, Human
ggcggcggcggugcccgc

SEQ ID NO: 849421 - RNA, 22 nt, Human
ggcuggagugcaauggugugau

SEQ ID NO: 849422 - RNA, 21 nt, Human
gucucaccaugccuaggcugg

SEQ ID NO: 849423 - RNA, 22 nt, Human
uaauuuuuuuuuuuuuuugaga

SEQ ID NO: 849424 - RNA, 24 nt, Human
ucacugcaaccuccgcuuccuggg

SEQ ID NO: 849425 - RNA, 25 nt, Human
ucacugcaaccuccgcuuccugggu

SEQ ID NO: 849426 - RNA, 21 nt, Human
uccacgcucaugccgcggcca

SEQ ID NO: 849427 - RNA, 23 nt, Human
uccacgcucaugccgcggccaug

SEQ ID NO: 849428 - RNA, 21 nt, Human
ucucaccaugccuaggcugga

SEQ ID NO: 849429 - RNA, 23 nt, Human
ucucaccaugccuaggcuggagu

SEQ ID NO: 849430 - RNA, 23 nt, Human
ugaaaagagaaaaucaauacaau

SEQ ID NO: 849431 - RNA, 23 nt, Human
ugaagcugcggaucaggcuagca

SEQ ID NO: 849432 - RNA, 20 nt, Human
ugccuaggcuggagugcaau

SEQ ID NO: 849433 - RNA, 24 nt, Human
ugccuaggcuggagugcaauggug

SEQ ID NO: 849434 - RNA, 19 nt, Human
uggagugcaauggugugau

SEQ ID NO: 849435 - RNA, 23 nt, Human
uggagugcaauggugugaucuug

SEQ ID NO: 849436 - RNA, 24 nt, Human
uggagugcaauggugugaucuugg

SEQ ID NO: 849437 - RNA, 22 nt, Human
ugggccaaagccuuguagccag

SEQ ID NO: 849438 - RNA, 20 nt, Human
ugguacacacuuggugggcc

SEQ ID NO: 849439 - RNA, 24 nt, Human
uguagccaggugcuccccgcggcc

SEQ ID NO: 849440 - RNA, 24 nt, Human
uuuuugagauggagucucaccaug

SEQ ID NO: 849441 - RNA, 26 nt, Human
uuuuuuuuuuuugaaaagagaaaauc

SEQ ID NO: 849442 - RNA, 26 nt, Human
uuuuuuuuuuuugagauggagucuca

SEQ ID NO: 849443 - RNA, 22 nt, Human
uuuuuuuuuuuuuugagaugga

SEQ ID NO: 849444 - RNA, 20 nt, Human
uuuuuuuuuuuuuuuuuugg

SEQ ID NO: 849445 - RNA, 25 nt, Human
aaaaggacacacaggauuugggaca

SEQ ID NO: 849446 - RNA, 19 nt, Human
aaacccacggcugugcucg

SEQ ID NO: 849447 - RNA, 18 nt, Human
aaacuacagcaggaaccu

SEQ ID NO: 849448 - RNA, 24 nt, Human
aaagcacaauuuaacacaugccaa

SEQ ID NO: 849449 - RNA, 19 nt, Human
aaccacaggcuuauucauc

SEQ ID NO: 849450 - RNA, 22 nt, Human
aacuucccauuuccggcacuuu

SEQ ID NO: 849451 - RNA, 19 nt, Human
aagcacaauuuaacacaug

SEQ ID NO: 849452 - RNA, 21 nt, Human
aagccagaggccagccccgcu

SEQ ID NO: 849453 - RNA, 22 nt, Human
aagccagaggccagccccgcuc

SEQ ID NO: 849454 - RNA, 23 nt, Human
aaggacacacaggauuugggaca

SEQ ID NO: 849455 - RNA, 20 nt, Human
acauauggaagcacugggcc

SEQ ID NO: 849456 - RNA, 18 nt, Human
acugcaauucuuagaauc

SEQ ID NO: 849457 - RNA, 22 nt, Human
acuguccucuguggccgucagu

SEQ ID NO: 849458 - RNA, 20 nt, Human
agaccaaaaucauucuacaa

SEQ ID NO: 849459 - RNA, 22 nt, Human
agacgacaacaggagucaccuu

SEQ ID NO: 849460 - RNA, 19 nt, Human
agcuacuuuuuucucgagc

SEQ ID NO: 849461 - RNA, 24 nt, Human
aggaggcggcggcuagaccggcgg

SEQ ID NO: 849462 - RNA, 21 nt, Human
augguaacagcuuaccacgaa

SEQ ID NO: 849463 - RNA, 18 nt, Human
auuuccagugauaaugcc

SEQ ID NO: 849464 - RNA, 19 nt, Human
caaaacuacagcaggaacu

SEQ ID NO: 849465 - RNA, 21 nt, Human
caaaagguugcagagccagua

SEQ ID NO: 849466 - RNA, 23 nt, Human
cacagcccccccgcccgcccucu

SEQ ID NO: 849467 - RNA, 23 nt, Human
caccacugcaggacacccgagca

SEQ ID NO: 849468 - RNA, 24 nt, Human
cacgugcagcguugcagacaggau

SEQ ID NO: 849469 - RNA, 26 nt, Human
cagacccuugggaaaagcacuuggug

SEQ ID NO: 849470 - RNA, 20 nt, Human
cagagcuucaacaccacugc

SEQ ID NO: 849471 - RNA, 22 nt, Human
cagcacacagcauaaacugaua

SEQ ID NO: 849472 - RNA, 18 nt, Human
cagcccccccgcccgccc

SEQ ID NO: 849473 - RNA, 20 nt, Human
cagccgccuguaccagccug

SEQ ID NO: 849474 - RNA, 23 nt, Human
caguaaccccaguguuaucugca

SEQ ID NO: 849475 - RNA, 18 nt, Human
cauuuccagugauaaugc

SEQ ID NO: 849476 - RNA, 21 nt, Human
ccacugcaggacacccgagca

SEQ ID NO: 849477 - RNA, 21 nt, Human
ccagagcuucaacaccacugc

SEQ ID NO: 849478 - RNA, 25 nt, Human
cccacagcccccccgcccgcccucu

SEQ ID NO: 849479 - RNA, 19 nt, Human
ccccaaacacuaaaauagc

SEQ ID NO: 849480 - RNA, 22 nt, Human
cccccccgcccgcccucuccgc

SEQ ID NO: 849481 - RNA, 18 nt, Human
cccccgcccgcccucucc

SEQ ID NO: 849482 - RNA, 21 nt, Human
ccccgcucggauccuuucuca

SEQ ID NO: 849483 - RNA, 21 nt, Human
cccggcagcugacccucgccu

SEQ ID NO: 849484 - RNA, 22 nt, Human
ccggcacuuuuugauggcgugg

SEQ ID NO: 849485 - RNA, 22 nt, Human
ccggcgcucccacagccccccc

SEQ ID NO: 849486 - RNA, 23 nt, Human
ccucccagccagucucgccgccc

SEQ ID NO: 849487 - RNA, 19 nt, Human
ccuccgcgagcagccgccu

SEQ ID NO: 849488 - RNA, 20 nt, Human
ccugaaaacuucccauuucc

SEQ ID NO: 849489 - RNA, 27 nt, Human
cgaggcucuccuuugggggaggucccc

SEQ ID NO: 849490 - RNA, 22 nt, Human
cgccccagagcuucaacaccac

SEQ ID NO: 849491 - RNA, 22 nt, Human
cgcccgcccucuccgcgccgcg

SEQ ID NO: 849492 - RNA, 24 nt, Human
cgcucccacagcccccccgcccgc

SEQ ID NO: 849493 - RNA, 19 nt, Human
cggcgcucccacagccccc

SEQ ID NO: 849494 - RNA, 25 nt, Human
cgugcagcguugcagacaggaugga

SEQ ID NO: 849495 - RNA, 24 nt, Human
cuaaaauagcacauggcauaguaa

SEQ ID NO: 849496 - RNA, 18 nt, Human
cuaauucaaaagguugca

SEQ ID NO: 849497 - RNA, 20 nt, Human
cucccagccagucucgccgc

SEQ ID NO: 849498 - RNA, 19 nt, Human
cuccgcgccgcgucgcccc

SEQ ID NO: 849499 - RNA, 19 nt, Human
cugaggugcuuuuaagcau

SEQ ID NO: 849500 - RNA, 20 nt, Human
gaagccagaggccagccccg

SEQ ID NO: 849501 - RNA, 24 nt, Human
gacaacaggagucaccuugaaaaa

SEQ ID NO: 849502 - RNA, 21 nt, Human
gaccaucugaggugcuuuuaa

SEQ ID NO: 849503 - RNA, 21 nt, Human
gcagccgccuguaccagccug

SEQ ID NO: 849504 - RNA, 28 nt, Human
gcccugggcccuccucccagccagucuc

SEQ ID NO: 849505 - RNA, 25 nt, Human
gcggcuagaccggcgggcgggcggg

SEQ ID NO: 849506 - RNA, 18 nt, Human
gcggugggccugagguca

SEQ ID NO: 849507 - RNA, 19 nt, Human
gcucccacagcccccccgc

SEQ ID NO: 849508 - RNA, 24 nt, Human
ggcgcucccacagcccccccgccc

SEQ ID NO: 849509 - RNA, 19 nt, Human
ggcugcaugauaguuuguc

SEQ ID NO: 849510 - RNA, 27 nt, Human
uaaagcacaauuuaacacaugccaaaa

SEQ ID NO: 849511 - RNA, 22 nt, Human
uaacacaugccaaaaaaguucc

SEQ ID NO: 849512 - RNA, 24 nt, Human
uaagggcugcacaguuugcaucca

SEQ ID NO: 849513 - RNA, 18 nt, Human
uacuuuaagucugccagg

SEQ ID NO: 849514 - RNA, 23 nt, Human
uauugguauuguucugcuuguac

SEQ ID NO: 849515 - RNA, 25 nt, Human
uauuguuugcuuugaaaacaugggc

SEQ ID NO: 849516 - RNA, 19 nt, Human
ucaacaccacugcaggaca

SEQ ID NO: 849517 - RNA, 24 nt, Human
ucacuuugugaauuuccaucaacc

SEQ ID NO: 849518 - RNA, 19 nt, Human
ucaguggcccugggcccuc

SEQ ID NO: 849519 - RNA, 21 nt, Human
uccagacuuaaugcgaaagaa

SEQ ID NO: 849520 - RNA, 19 nt, Human
uccgcgccgcgucgccccg

SEQ ID NO: 849521 - RNA, 21 nt, Human
uccgcgccgcgucgccccggc

SEQ ID NO: 849522 - RNA, 22 nt, Human
uccgcgccgcgucgccccggca

SEQ ID NO: 849523 - RNA, 19 nt, Human
ucucuguaacugagcuacu

SEQ ID NO: 849524 - RNA, 19 nt, Human
ugaaaaauuuuaggguaca

SEQ ID NO: 849525 - RNA, 24 nt, Human
ugaaaacuucccauuuccggcacu

SEQ ID NO: 849526 - RNA, 22 nt, Human
ugaaaucgaauuuugcugcaga

SEQ ID NO: 849527 - RNA, 22 nt, Human
ugcgaaagaaaucauucuaaga

SEQ ID NO: 849528 - RNA, 19 nt, Human
ugcugcagaccaaaaucaa

SEQ ID NO: 849529 - RNA, 27 nt, Human
ugcugcagaccaaaaucauucuacaag

SEQ ID NO: 849530 - RNA, 18 nt, Human
uggagugcaggcaagcgg

SEQ ID NO: 849531 - RNA, 23 nt, Human
uggauuucuucuuacugauucuc

SEQ ID NO: 849532 - RNA, 23 nt, Human
uggcauaguaauucagcacacag

SEQ ID NO: 849533 - RNA, 20 nt, Human
uggcccugggcccuccuccc

SEQ ID NO: 849534 - RNA, 19 nt, Human
ugggaaauaacucgauuug

SEQ ID NO: 849535 - RNA, 24 nt, Human
uguaacugagcuacuuuuuucucg

SEQ ID NO: 849536 - RNA, 23 nt, Human
uguccgagucaccuccuccggcc

SEQ ID NO: 849537 - RNA, 18 nt, Human
ugugaagccagaggccag

SEQ ID NO: 849538 - RNA, 28 nt, Human
uuaaagcacaauuuaacaccaccuaggu

SEQ ID NO: 849539 - RNA, 24 nt, Human
uuaaggcugcaugauaguuugucc

SEQ ID NO: 849540 - RNA, 24 nt, Human
uuacugauucucucacauauggaa

SEQ ID NO: 849541 - RNA, 23 nt, Human
uucaacaccacugcaggacaccc

SEQ ID NO: 849542 - RNA, 21 nt, Human
uuccaacucagagcccagacc

SEQ ID NO: 849543 - RNA, 19 nt, Human
uuuuuuuuuuuuuuuuuaa

SEQ ID NO: 849544 - RNA, 18 nt, Human
agacagggucuugcuaug

SEQ ID NO: 849545 - RNA, 23 nt, Human
agacagggucuugcuauguugcc

SEQ ID NO: 849546 - RNA, 23 nt, Human
agauuacaggugggagccacugc

SEQ ID NO: 849547 - RNA, 20 nt, Human
aggagacagucuugcaucug

SEQ ID NO: 849548 - RNA, 24 nt, Human
aggagcccauuccccuucugucag

SEQ ID NO: 849549 - RNA, 24 nt, Human
agggcugagauuacaggugggagc

SEQ ID NO: 849550 - RNA, 20 nt, Human
agguggauggcaguguugag

SEQ ID NO: 849551 - RNA, 23 nt, Human
agucccaggaccugagggagcuc

SEQ ID NO: 849552 - RNA, 19 nt, Human
aguggugcugggacguggc

SEQ ID NO: 849553 - RNA, 25 nt, Human
aguuucaguuacauuauagagagag

SEQ ID NO: 849554 - RNA, 20 nt, Human
auguugcccaggcuggucuc

SEQ ID NO: 849555 - RNA, 19 nt, Human
cacaguucaggaccaggga

SEQ ID NO: 849556 - RNA, 24 nt, Human
cagggucuugcuauguugcccagg

SEQ ID NO: 849557 - RNA, 19 nt, Human
cauguccccgccuuagucc

SEQ ID NO: 849558 - RNA, 19 nt, Human
cauuccccuucugucagag

SEQ ID NO: 849559 - RNA, 19 nt, Human
ccacugcgcccagccagca

SEQ ID NO: 849560 - RNA, 26 nt, Human
cccagaagugagcuuggaaagggcgg

SEQ ID NO: 849561 - RNA, 20 nt, Human
ccgccaggagacagucuugc

SEQ ID NO: 849562 - RNA, 26 nt, Human
ccuuccaccucagccucgggaagggc

SEQ ID NO: 849563 - RNA, 24 nt, Human
cgggaagggcugagauuacaggug

SEQ ID NO: 849564 - RNA, 18 nt, Human
cucagucccagaagugag

SEQ ID NO: 849565 - RNA, 24 nt, Human
cucgagcaauccuuccaccucagc

SEQ ID NO: 849566 - RNA, 22 nt, Human
cucuggauugguggcuuggccc

SEQ ID NO: 849567 - RNA, 21 nt, Human
cuuccaccucagccucgggaa

SEQ ID NO: 849568 - RNA, 23 nt, Human
gaacaccuggccucgagcaaucc

SEQ ID NO: 849569 - RNA, 21 nt, Human
gagcccauuccccuucuguca

SEQ ID NO: 849570 - RNA, 18 nt, Human
gauuacaggugggagcca

SEQ ID NO: 849571 - RNA, 19 nt, Human
gauuacaggugggagccac

SEQ ID NO: 849572 - RNA, 20 nt, Human
gcagagugggcccugugcug

SEQ ID NO: 849573 - RNA, 19 nt, Human
gcccugugcugaggauggg

SEQ ID NO: 849574 - RNA, 24 nt, Human
gcuauguugcccaggcuggucucg

SEQ ID NO: 849575 - RNA, 23 nt, Human
ggaaagaaacacagaggcugccu

SEQ ID NO: 849576 - RNA, 21 nt, Human
ggcuggugcuugagacugguu

SEQ ID NO: 849577 - RNA, 22 nt, Human
ggggccgacuccaggccugagc

SEQ ID NO: 849578 - RNA, 24 nt, Human
gggggugguccgccaggagacagu

SEQ ID NO: 849579 - RNA, 19 nt, Human
gugguccgccaggagacag

SEQ ID NO: 849580 - RNA, 22 nt, Human
uagagacagggucuugcuaugu

SEQ ID NO: 849581 - RNA, 21 nt, Human
uauguugcccaggcuggucuc

SEQ ID NO: 849582 - RNA, 23 nt, Human
uauguugcccaggcuggucucga

SEQ ID NO: 849583 - RNA, 24 nt, Human
uauguugcccaggcuggucucgaa

SEQ ID NO: 849584 - RNA, 21 nt, Human
ucaauauaaauagagacaggg

SEQ ID NO: 849585 - RNA, 25 nt, Human
ucagucccagaagugagcuuggaaa

SEQ ID NO: 849586 - RNA, 19 nt, Human
uccaccucagccucgggaa

SEQ ID NO: 849587 - RNA, 25 nt, Human
uccggagcugaaguggugcugggac

SEQ ID NO: 849588 - RNA, 23 nt, Human
ucgaacaccuggccucgagcaau

SEQ ID NO: 849589 - RNA, 18 nt, Human
ucuugcuauguugcccag

SEQ ID NO: 849590 - RNA, 19 nt, Human
ucuugcuauguugcccagg

SEQ ID NO: 849591 - RNA, 23 nt, Human
ucuugcuauguugcccaggcugg

SEQ ID NO: 849592 - RNA, 24 nt, Human
ucuugcuauguugcccaggcuggu

SEQ ID NO: 849593 - RNA, 21 nt, Human
ugagauuacaggugggagcca

SEQ ID NO: 849594 - RNA, 22 nt, Human
ugagauuacaggugggagccac

SEQ ID NO: 849595 - RNA, 22 nt, Human
ugagauuacaggugggagccac

SEQ ID NO: 849596 - RNA, 24 nt, Human
ugagauuacaggugggagccacug

SEQ ID NO: 849597 - RNA, 19 nt, Human
ugagcuuggaaagggcggc

SEQ ID NO: 849598 - RNA, 22 nt, Human
ugaggaaacucagucccagaag

SEQ ID NO: 849599 - RNA, 24 nt, Human
ugcccaggcuggucucgaacaccu

SEQ ID NO: 849600 - RNA, 24 nt, Human
ugcuauguugcccaggcuggucuc

SEQ ID NO: 849601 - RNA, 24 nt, Human
ugcuccggagcugaaguggugcug

SEQ ID NO: 849602 - RNA, 26 nt, Human
uggcccagagccagguggauggcagg

SEQ ID NO: 849603 - RNA, 21 nt, Human
uggccucgagcaauccuucca

SEQ ID NO: 849604 - RNA, 19 nt, Human
ugggagccacugcgcccag

SEQ ID NO: 849605 - RNA, 21 nt, Human
ugggggccgacuccaggccug

SEQ ID NO: 849606 - RNA, 22 nt, Human
ugguuggcagagugggcccugu

SEQ ID NO: 849607 - RNA, 23 nt, Human
uuggcagagugggcccugugcug

SEQ ID NO: 849608 - RNA, 28 nt, Human
uuuucuuuuguuauuuuuauuuuucaau

SEQ ID NO: 849609 - RNA, 24 nt, Human
uuuuuuuuuuuucuuuuguuauuu

SEQ ID NO: 849610 - RNA, 27 nt, Human
uuuuuuuuuuuuuuuuuucuuuugggg

SEQ ID NO: 849611 - RNA, 24 nt, Human
uuuuuuuuuuuuuuuuuuucuuuu

SEQ ID NO: 849612 - RNA, 23 nt, Human
aaaaaaaugaagagaggcccagc

SEQ ID NO: 849613 - RNA, 25 nt, Human
aacugguuucuccaauuagccccca

SEQ ID NO: 849614 - RNA, 21 nt, Human
aagaaggccugagaucacgua

SEQ ID NO: 849615 - RNA, 18 nt, Human
aagcaaaaagauaaacug

SEQ ID NO: 849616 - RNA, 19 nt, Human
aaguggcccuucaaaaaaa

SEQ ID NO: 849617 - RNA, 22 nt, Human
acacaccuccagaucuggagcc

SEQ ID NO: 849618 - RNA, 20 nt, Human
agaagcagcacggaagcaac

SEQ ID NO: 849619 - RNA, 21 nt, Human
agcacggaagcaaccaaucaa

SEQ ID NO: 849620 - RNA, 20 nt, Human
agccaugaaagcacagcuga

SEQ ID NO: 849621 - RNA, 20 nt, Human
aggaccaauuaccuccaaac

SEQ ID NO: 849622 - RNA, 20 nt, Human
aggcaguuccaauuguugac

SEQ ID NO: 849623 - RNA, 22 nt, Human
agggcugcccagcuacucaggu

SEQ ID NO: 849624 - RNA, 22 nt, Human
agugauccaagaggcaguucca

SEQ ID NO: 849625 - RNA, 19 nt, Human
aguggcccuucaaaaaaau

SEQ ID NO: 849626 - RNA, 20 nt, Human
aucuggagccaccuucuucc

SEQ ID NO: 849627 - RNA, 19 nt, Human
caaaaaaaauaagcaaaaa

SEQ ID NO: 849628 - RNA, 21 nt, Human
caacccaguagaaaaaugaau

SEQ ID NO: 849629 - RNA, 23 nt, Human
caagggcugcccagcuacucagg

SEQ ID NO: 849630 - RNA, 19 nt, Human
caauaggcacacgagaucc

SEQ ID NO: 849631 - RNA, 22 nt, Human
cacaccuccagaucuggagcca

SEQ ID NO: 849632 - RNA, 19 nt, Human
cagccaugaaagcacagcu

SEQ ID NO: 849633 - RNA, 25 nt, Human
caucaaggggcguucccaucugggg

SEQ ID NO: 849634 - RNA, 22 nt, Human
caucucucuucgcacaguguuc

SEQ ID NO: 849635 - RNA, 24 nt, Human
ccacgccggcagcaccaaggccuc

SEQ ID NO: 849636 - RNA, 25 nt, Human
ccagaacagaaaacacaaguggccc

SEQ ID NO: 849637 - RNA, 18 nt, Human
cccccaucucucuucgca

SEQ ID NO: 849638 - RNA, 20 nt, Human
ccggcagcaccaaggccucu

SEQ ID NO: 849639 - RNA, 23 nt, Human
ccuccaaacauaaacagcuccua

SEQ ID NO: 849640 - RNA, 18 nt, Human
ccuugucacccuccgcag

SEQ ID NO: 849641 - RNA, 24 nt, Human
cgcacaguguuccaucauccagcc

SEQ ID NO: 849642 - RNA, 21 nt, Human
cggcagcaccaaggccucugg

SEQ ID NO: 849643 - RNA, 21 nt, Human
cuccuccagcaaagacaauuu

SEQ ID NO: 849644 - RNA, 22 nt, Human
cucuuccuagaguucccuuaaa

SEQ ID NO: 849645 - RNA, 20 nt, Human
cuggcuuagacccugccaag

SEQ ID NO: 849646 - RNA, 21 nt, Human
cuucaaaaaaaugaagagagg

SEQ ID NO: 849647 - RNA, 19 nt, Human
gaaacaugcagagcaggga

SEQ ID NO: 849648 - RNA, 18 nt, Human
gaggauguacuaagcaug

SEQ ID NO: 849649 - RNA, 24 nt, Human
gcagcacggaagcaaccaaucaac

SEQ ID NO: 849650 - RNA, 23 nt, Human
gcucgcugcccugccucuuugcg

SEQ ID NO: 849651 - RNA, 24 nt, Human
gcugagugauccaagaggcaguuc

SEQ ID NO: 849652 - RNA, 18 nt, Human
ggaagcaaccaaucaacu

SEQ ID NO: 849653 - RNA, 21 nt, Human
ggauguacuaagcaugaagcg

SEQ ID NO: 849654 - RNA, 18 nt, Human
ggccucuuccuagaguuc

SEQ ID NO: 849655 - RNA, 18 nt, Human
ggcugcccagcuacucag

SEQ ID NO: 849656 - RNA, 18 nt, Human
gggcaagagcuaauugug

SEQ ID NO: 849657 - RNA, 24 nt, Human
uaaaaagucaaaaaaaauaagcaa

SEQ ID NO: 849658 - RNA, 21 nt, Human
uaagcaugaagcgcuacuucc

SEQ ID NO: 849659 - RNA, 18 nt, Human
uacaauaaaaagucaaaa

SEQ ID NO: 849660 - RNA, 22 nt, Human
uaccuccaaacauaaacagcuc

SEQ ID NO: 849661 - RNA, 18 nt, Human
uagaaauuacugcaaaga

SEQ ID NO: 849662 - RNA, 21 nt, Human
uccccacgccggcagcaccaa

SEQ ID NO: 849663 - RNA, 19 nt, Human
uccuaugggaacucaggcc

SEQ ID NO: 849664 - RNA, 19 nt, Human
ucuggagccaccuucuucc

SEQ ID NO: 849665 - RNA, 23 nt, Human
ugaagagaggcccagccucuuau

SEQ ID NO: 849666 - RNA, 19 nt, Human
ugaagcgcuacuuccuggc

SEQ ID NO: 849667 - RNA, 24 nt, Human
ugaaguucccagaacagaaaacac

SEQ ID NO: 849668 - RNA, 19 nt, Human
ugaguacgguuuucuccuc

SEQ ID NO: 849669 - RNA, 21 nt, Human
ugagugauccaagaggcaguu

SEQ ID NO: 849670 - RNA, 21 nt, Human
ugccaagggcugcccagcuac

SEQ ID NO: 849671 - RNA, 24 nt, Human
uggaaaauaagacuuacaucucau

SEQ ID NO: 849672 - RNA, 19 nt, Human
uggacaaaggaccaauuac

SEQ ID NO: 849673 - RNA, 24 nt, Human
uggcgugggguaggggcaagagcu

SEQ ID NO: 849674 - RNA, 18 nt, Human
uggcugaguacgguuuuc

SEQ ID NO: 849675 - RNA, 22 nt, Human
ugguuucuccaauuagccccca

SEQ ID NO: 849676 - RNA, 23 nt, Human
uguccugaucuuuuggcugagua

SEQ ID NO: 849677 - RNA, 25 nt, Human
uucaaacuucacaccuaaggaaaau

SEQ ID NO: 849678 - RNA, 24 nt, Human
uucaaaguaguggcuuucaaaauu

SEQ ID NO: 849679 - RNA, 18 nt, Human
uuuaaaaaccuaggccuc

SEQ ID NO: 849680 - RNA, 19 nt, Human
aaaauuuuuggcagucaca

SEQ ID NO: 849681 - RNA, 21 nt, Human
aaacaaauggaaucuauccac

SEQ ID NO: 849682 - RNA, 22 nt, Human
aaagaacucaauuccaaaggau

SEQ ID NO: 849683 - RNA, 21 nt, Human
aaccauccuggaacucaggcc

SEQ ID NO: 849684 - RNA, 26 nt, Human
aacuucagaaaggcaucucuuggcac

SEQ ID NO: 849685 - RNA, 20 nt, Human
aagcagagcuuaaaaacaaa

SEQ ID NO: 849686 - RNA, 22 nt, Human
aagcucuaacacaaagcagagc

SEQ ID NO: 849687 - RNA, 22 nt, Human
acaaagcagagcuuaaaaacaa

SEQ ID NO: 849688 - RNA, 19 nt, Human
acagugaaauaccugcagg

SEQ ID NO: 849689 - RNA, 19 nt, Human
aggaggcuaccaaagccaa

SEQ ID NO: 849690 - RNA, 22 nt, Human
aggaggcuaccaaagccaaggc

SEQ ID NO: 849691 - RNA, 19 nt, Human
aggcaguguggcugugugg

SEQ ID NO: 849692 - RNA, 23 nt, Human
aggcaguguggcuguguggaggg

SEQ ID NO: 849693 - RNA, 23 nt, Human
aggcucuuaacauauugagguuc

SEQ ID NO: 849694 - RNA, 27 nt, Human
aguaaacagugaaauaccugcaggcaa

SEQ ID NO: 849695 - RNA, 24 nt, Human
aucaaacccgguuggggcgaccag

SEQ ID NO: 849696 - RNA, 25 nt, Human
caagaaaaaaccauccuggaacuca

SEQ ID NO: 849697 - RNA, 18 nt, Human
cacggcuuuuaucaguuu

SEQ ID NO: 849698 - RNA, 20 nt, Human
caggaggcuaccaaagccaa

SEQ ID NO: 849699 - RNA, 22 nt, Human
cauauauucuaaacauacaucc

SEQ ID NO: 849700 - RNA, 23 nt, Human
cccaagaaaaaaccauccuggaa

SEQ ID NO: 849701 - RNA, 20 nt, Human
cccuuaagauccuaaaacag

SEQ ID NO: 849702 - RNA, 20 nt, Human
ccggagccucaccuccuccc

SEQ ID NO: 849703 - RNA, 22 nt, Human
ccucccgccucgcagcucaggc

SEQ ID NO: 849704 - RNA, 22 nt, Human
ccugcaggcaaccaugucuaaa

SEQ ID NO: 849705 - RNA, 20 nt, Human
ccugcaggcaaccaugucuu

SEQ ID NO: 849706 - RNA, 20 nt, Human
ccugcgcgcgccgagggccg

SEQ ID NO: 849707 - RNA, 24 nt, Human
cgagcugcggagagaccgcggccc

SEQ ID NO: 849708 - RNA, 23 nt, Human
cucaccuuucacaaaauucuacc

SEQ ID NO: 849709 - RNA, 22 nt, Human
cuccggggcccggaaggagcgg

SEQ ID NO: 849710 - RNA, 21 nt, Human
cugccaggaggcuaccaaagc

SEQ ID NO: 849711 - RNA, 24 nt, Human
gaaaaaaccauccuggaacucagg

SEQ ID NO: 849712 - RNA, 18 nt, Human
gagcgggcgcagcgcggu

SEQ ID NO: 849713 - RNA, 19 nt, Human
gccggagccucaccuccuc

SEQ ID NO: 849714 - RNA, 18 nt, Human
gcgccggagccucaccuc

SEQ ID NO: 849715 - RNA, 26 nt, Human
gcugcggagagaccgcggcccccaaa

SEQ ID NO: 849716 - RNA, 19 nt, Human
ggaaggagcgggcgcagcg

SEQ ID NO: 849717 - RNA, 23 nt, Human
ggagccucaccuccucccgccuc

SEQ ID NO: 849718 - RNA, 19 nt, Human
ggcccggaaggagcgggcg

SEQ ID NO: 849719 - RNA, 21 nt, Human
uaacaacaguaaacagugaaa

SEQ ID NO: 849720 - RNA, 18 nt, Human
uaacacaaagcagagcuu

SEQ ID NO: 849721 - RNA, 24 nt, Human
uaagauccuaaaacagucauauca

SEQ ID NO: 849722 - RNA, 23 nt, Human
uaaucaguguucaaaugcacccu

SEQ ID NO: 849723 - RNA, 22 nt, Human
uaccaaagccaaggcucuuaac

SEQ ID NO: 849724 - RNA, 23 nt, Human
uauaaucaguguucaaaugcacc

SEQ ID NO: 849725 - RNA, 18 nt, Human
uauaucucuaacaacagu

SEQ ID NO: 849726 - RNA, 23 nt, Human
ucaaggaaacaaauggaaucuau

SEQ ID NO: 849727 - RNA, 25 nt, Human
ucaggcgggccaugugacccgcgag

SEQ ID NO: 849728 - RNA, 21 nt, Human
uccccugcgcgcgccgagggc

SEQ ID NO: 849729 - RNA, 23 nt, Human
uccccugcgcgcgccgagggccg

SEQ ID NO: 849730 - RNA, 19 nt, Human
ucugguauugcccaggcug

SEQ ID NO: 849731 - RNA, 18 nt, Human
ugagaaagaacucaauuc

SEQ ID NO: 849732 - RNA, 20 nt, Human
ugagaaagaacucaauucca

SEQ ID NO: 849733 - RNA, 22 nt, Human
uggcaaacugcugcuccugcca

SEQ ID NO: 849734 - RNA, 20 nt, Human
ugggucagacugcaugaggc

SEQ ID NO: 849735 - RNA, 24 nt, Human
uguggcuguguggagggagagguc

SEQ ID NO: 849736 - RNA, 24 nt, Human
uuuuuuuuuuuuuuuuuuuccaag

SEQ ID NO: 849737 - RNA, 24 nt, Human
aaaaaggaccaucccccauacaaa

SEQ ID NO: 849738 - RNA, 22 nt, Human
aaacaccaucuccccagcuguc

SEQ ID NO: 849739 - RNA, 20 nt, Human
aaagaaccaauuucacaaac

SEQ ID NO: 849740 - RNA, 18 nt, Human
aaaugcuagaguuguacu

SEQ ID NO: 849741 - RNA, 19 nt, Human
aacacaguggaaccaauuc

SEQ ID NO: 849742 - RNA, 21 nt, Human
aacacaguggaaccaauuccu

SEQ ID NO: 849743 - RNA, 20 nt, Human
aauuuccgaucccaauucuc

SEQ ID NO: 849744 - RNA, 18 nt, Human
agaguacaacgucacugu

SEQ ID NO: 849745 - RNA, 19 nt, Human
aggaagccacugaggcggc

SEQ ID NO: 849746 - RNA, 19 nt, Human
agggaugaggccguccugc

SEQ ID NO: 849747 - RNA, 22 nt, Human
agggcacugagaucucuacauu

SEQ ID NO: 849748 - RNA, 21 nt, Human
aguggccuugcagugcagaau

SEQ ID NO: 849749 - RNA, 20 nt, Human
auggugcugucguguuggag

SEQ ID NO: 849750 - RNA, 22 nt, Human
auuggggcaaaggccggggcca

SEQ ID NO: 849751 - RNA, 23 nt, Human
cacucuaaagggugaaauggcuc

SEQ ID NO: 849752 - RNA, 19 nt, Human
cagugacaccuccacuucc

SEQ ID NO: 849753 - RNA, 19 nt, Human
caucugaacuugacugacu

SEQ ID NO: 849754 - RNA, 18 nt, Human
caugucccccacuagcac

SEQ ID NO: 849755 - RNA, 21 nt, Human
ccagaaucgcucgaaacacag

SEQ ID NO: 849756 - RNA, 20 nt, Human
ccagauccaaacauccugcc

SEQ ID NO: 849757 - RNA, 21 nt, Human
ccagcugucuuacagcuacca

SEQ ID NO: 849758 - RNA, 23 nt, Human
cccaagauaaauacuuuuugcuc

SEQ ID NO: 849759 - RNA, 18 nt, Human
cccacacaagauuggggc

SEQ ID NO: 849760 - RNA, 25 nt, Human
cccauaacucuuaagaaaaaaaaag

SEQ ID NO: 849761 - RNA, 25 nt, Human
cccccauacaaagaaccaauuucac

SEQ ID NO: 849762 - RNA, 21 nt, Human
ccuacacugcaauauccuaaa

SEQ ID NO: 849763 - RNA, 22 nt, Human
ccuacacugcaauauccuaaac

SEQ ID NO: 849764 - RNA, 19 nt, Human
ccucacacuacugcucuga

SEQ ID NO: 849765 - RNA, 19 nt, Human
ccucugacauucacacucc

SEQ ID NO: 849766 - RNA, 20 nt, Human
ccugcccaacauuguauuug

SEQ ID NO: 849767 - RNA, 23 nt, Human
cuaauggaaccauuuggggaugc

SEQ ID NO: 849768 - RNA, 24 nt, Human
cuaauggaaccauuuggggaugcu

SEQ ID NO: 849769 - RNA, 22 nt, Human
cucacaaugaagaagaguggcc

SEQ ID NO: 849770 - RNA, 21 nt, Human
cuccaagcuuccucacacuac

SEQ ID NO: 849771 - RNA, 21 nt, Human
cucugccaccucauacucucc

SEQ ID NO: 849772 - RNA, 18 nt, Human
cugcaauauccuaaacau

SEQ ID NO: 849773 - RNA, 24 nt, Human
cuucgucuaucucuugaucucuca

SEQ ID NO: 849774 - RNA, 23 nt, Human
cuucugaaaagaccuagcugugu

SEQ ID NO: 849775 - RNA, 24 nt, Human
gaaccaauuucacaaaccuacugg

SEQ ID NO: 849776 - RNA, 20 nt, Human
gaaccuguagucccccuucg

SEQ ID NO: 849777 - RNA, 22 nt, Human
gcacugcuaauggaaccauuug

SEQ ID NO: 849778 - RNA, 23 nt, Human
gcucgaaacacaguggaaccaau

SEQ ID NO: 849779 - RNA, 21 nt, Human
gcuuuuugaggacgcggacug

SEQ ID NO: 849780 - RNA, 20 nt, Human
ggaaccauuuggggaugcuu

SEQ ID NO: 849781 - RNA, 21 nt, Human
ggaagccacugaggcggcugc

SEQ ID NO: 849782 - RNA, 19 nt, Human
gggcaaaggccggggccag

SEQ ID NO: 849783 - RNA, 19 nt, Human
gggcacugagaucucuaca

SEQ ID NO: 849784 - RNA, 23 nt, Human
gggcacugagaucucuacauuua

SEQ ID NO: 849785 - RNA, 18 nt, Human
guccugccaucccacucc

SEQ ID NO: 849786 - RNA, 23 nt, Human
uaaaaauggaugggucuacaaca

SEQ ID NO: 849787 - RNA, 23 nt, Human
uaaaccaccucugacauucacac

SEQ ID NO: 849788 - RNA, 22 nt, Human
uaaaugaagagcaaacacuuca

SEQ ID NO: 849789 - RNA, 27 nt, Human
uaacucucgaaccuguagucccccuuu

SEQ ID NO: 849790 - RNA, 27 nt, Human
uaagaaaaaaaaagcauuaguaaauaa

SEQ ID NO: 849791 - RNA, 24 nt, Human
uaaggcagacuggauaauaaacca

SEQ ID NO: 849792 - RNA, 20 nt, Human
uacaacgucacugugaagag

SEQ ID NO: 849793 - RNA, 19 nt, Human
uacucuccuuucucauugg

SEQ ID NO: 849794 - RNA, 21 nt, Human
uaguaaaugaagagcaaacac

SEQ ID NO: 849795 - RNA, 21 nt, Human
uauacaaacaccaucucccca

SEQ ID NO: 849796 - RNA, 24 nt, Human
uaugugcaucucacaaugaagaag

SEQ ID NO: 849797 - RNA, 24 nt, Human
ucaacuccuccuuuagcaauacgc

SEQ ID NO: 849798 - RNA, 24 nt, Human
ucauugggucguguaaaguuaugu

SEQ ID NO: 849799 - RNA, 21 nt, Human
uccaccacuucugaaaagacc

SEQ ID NO: 849800 - RNA, 21 nt, Human
uccucacacuacugcucugaa

SEQ ID NO: 849801 - RNA, 24 nt, Human
ucgaaacacaguggaaccaauucc

SEQ ID NO: 849802 - RNA, 21 nt, Human
ucugcugcuguucccagcacu

SEQ ID NO: 849803 - RNA, 19 nt, Human
ucuggagauaacugaacug

SEQ ID NO: 849804 - RNA, 20 nt, Human
ucuggagauaacugaacuga

SEQ ID NO: 849805 - RNA, 19 nt, Human
ucugugaacagauuaaggg

SEQ ID NO: 849806 - RNA, 19 nt, Human
ugaaaaaggaccauccccc

SEQ ID NO: 849807 - RNA, 22 nt, Human
ugaaaagaccuagcugugugaa

SEQ ID NO: 849808 - RNA, 24 nt, Human
ugaaaagaccuagcugugugaaaa

SEQ ID NO: 849809 - RNA, 19 nt, Human
ugaaagcacacauguagca

SEQ ID NO: 849810 - RNA, 19 nt, Human
ugaacagauuaaggguaag

SEQ ID NO: 849811 - RNA, 21 nt, Human
ugaagaagaguggccuugcag

SEQ ID NO: 849812 - RNA, 23 nt, Human
ugagaugaaucucgugaucuguc

SEQ ID NO: 849813 - RNA, 20 nt, Human
ugaggagaguacaacgucac

SEQ ID NO: 849814 - RNA, 25 nt, Human
ugcagaaugaggagaguacaacguc

SEQ ID NO: 849815 - RNA, 20 nt, Human
ugcuuggacgagaggaacug

SEQ ID NO: 849816 - RNA, 21 nt, Human
uggaaccaauucccucugcca

SEQ ID NO: 849817 - RNA, 21 nt, Human
uggacgagaggaacugugauc

SEQ ID NO: 849818 - RNA, 20 nt, Human
uggaguuaccaucauaggga

SEQ ID NO: 849819 - RNA, 23 nt, Human
ugugcaguaaaaauggauggguc

SEQ ID NO: 849820 - RNA, 24 nt, Human
uguuaugugcaucucacaaugaag

SEQ ID NO: 849821 - RNA, 22 nt, Human
uuaaaaaagccuacacugcaau

SEQ ID NO: 849822 - RNA, 23 nt, Human
uuaaaaaagccuacacugcaaua

SEQ ID NO: 849823 - RNA, 18 nt, Human
uucaggaauagauaugcc

SEQ ID NO: 849824 - RNA, 19 nt, Human
uuccucacacuacugcucu

SEQ ID NO: 849825 - RNA, 19 nt, Human
uucucuggaucacuggagu

SEQ ID NO: 849826 - RNA, 24 nt, Human
uuggcugugcaguaaaaauggaug

SEQ ID NO: 849827 - RNA, 25 nt, Human
uuggggcaaaggccggggccaguga

SEQ ID NO: 849828 - RNA, 23 nt, Human
uuguacucauuuaaaaaaaaacc

SEQ ID NO: 849829 - RNA, 25 nt, Human
uuucacaaaccuacugguaaacaaa

SEQ ID NO: 849830 - RNA, 21 nt, Human
uuuccauuuaaccaccauuua

SEQ ID NO: 849831 - RNA, 18 nt, Human
uuugauaacucaugcauu

SEQ ID NO: 849832 - RNA, 23 nt, Human
uuuugguguggucaacuccuccu

SEQ ID NO: 849833 - RNA, 20 nt, Human
uuuuuuuuuuaaaacaaugg

SEQ ID NO: 849834 - RNA, 25 nt, Human
aaaagcacuugucagacgagagcuc

SEQ ID NO: 849835 - RNA, 21 nt, Human
aagaaagaaagaaagaaagaa

SEQ ID NO: 849836 - RNA, 23 nt, Human
aagcaaaagcacuugucagacga

SEQ ID NO: 849837 - RNA, 24 nt, Human
aagggucucauucuguugcccagg

SEQ ID NO: 849838 - RNA, 18 nt, Human
acagaggccucucagaau

SEQ ID NO: 849839 - RNA, 26 nt, Human
auaccacccaaaagcugagaaacaga

SEQ ID NO: 849840 - RNA, 18 nt, Human
auucuguugcccaggcug

SEQ ID NO: 849841 - RNA, 24 nt, Human
auucuguugcccaggcuggaguga

SEQ ID NO: 849842 - RNA, 25 nt, Human
caaaaaagaaagaaagaaagaaaaa

SEQ ID NO: 849843 - RNA, 24 nt, Human
cacauggaaucagaauucugggca

SEQ ID NO: 849844 - RNA, 26 nt, Human
cacucuaaauaaacaaagcacuauaa

SEQ ID NO: 849845 - RNA, 20 nt, Human
cagacgagagcucugacucu

SEQ ID NO: 849846 - RNA, 18 nt, Human
cagccccugaaagagagg

SEQ ID NO: 849847 - RNA, 21 nt, Human
cagccccugaaagagagggag

SEQ ID NO: 849848 - RNA, 18 nt, Human
caggcagccccugaaaga

SEQ ID NO: 849849 - RNA, 24 nt, Human
cauucuguugcccaggcuggagug

SEQ ID NO: 849850 - RNA, 22 nt, Human
ccaccacccguggugcgcccug

SEQ ID NO: 849851 - RNA, 25 nt, Human
ccacccaaaagcugagaaacagagg

SEQ ID NO: 849852 - RNA, 24 nt, Human
cccccucccacaauggcugagucc

SEQ ID NO: 849853 - RNA, 20 nt, Human
ccguggugcgcccuggcccu

SEQ ID NO: 849854 - RNA, 20 nt, Human
cgcccuggcccuauuucaac

SEQ ID NO: 849855 - RNA, 22 nt, Human
cgcccuggcccuauuucaaccc

SEQ ID NO: 849856 - RNA, 21 nt, Human
cguggagaauuaaagaggcca

SEQ ID NO: 849857 - RNA, 24 nt, Human
cucauucuguugcccaggcuggag

SEQ ID NO: 849858 - RNA, 19 nt, Human
cuccauggaucaugugcac

SEQ ID NO: 849859 - RNA, 25 nt, Human
cugacucugacuccauggaucaugu

SEQ ID NO: 849860 - RNA, 19 nt, Human
cuguugcccaggcuggagu

SEQ ID NO: 849861 - RNA, 18 nt, Human
gagcacuuagcuuugcgg

SEQ ID NO: 849862 - RNA, 19 nt, Human
gagccugcccucaccagcc

SEQ ID NO: 849863 - RNA, 24 nt, Human
gcuggagugagauucugucuccuc

SEQ ID NO: 849864 - RNA, 21 nt, Human
uauuucaacccuacuuccuau

SEQ ID NO: 849865 - RNA, 23 nt, Human
uccaaaaaagaaagaaagaaaga

SEQ ID NO: 849866 - RNA, 23 nt, Human
ucucauucuguugcccaggcugg

SEQ ID NO: 849867 - RNA, 24 nt, Human
ucucauucuguugcccaggcugga

SEQ ID NO: 849868 - RNA, 24 nt, Human
ucugucuccaaaaaagaaagaaag

SEQ ID NO: 849869 - RNA, 18 nt, Human
ucuguugcccaggcugga

SEQ ID NO: 849870 - RNA, 22 nt, Human
ucuguugcccaggcuggaguga

SEQ ID NO: 849871 - RNA, 19 nt, Human
ugaaagagagggaggugcc

SEQ ID NO: 849872 - RNA, 22 nt, Human
ugaggucauucuucacucacug

SEQ ID NO: 849873 - RNA, 24 nt, Human
ugaggucauucuucacucacuguu

SEQ ID NO: 849874 - RNA, 24 nt, Human
ugcccaggcuggagugagauucug

SEQ ID NO: 849875 - RNA, 18 nt, Human
uggaaucagaauucuggg

SEQ ID NO: 849876 - RNA, 21 nt, Human
uggagugagauucugucucca

SEQ ID NO: 849877 - RNA, 22 nt, Human
uugcccaggcuggagugagauu

SEQ ID NO: 849878 - RNA, 22 nt, Human
uuuuuuuuuuugcggaaggguc

SEQ ID NO: 849879 - RNA, 26 nt, Human
uuuuuuuuuuuugcggaagggucuca

SEQ ID NO: 849880 - RNA, 19 nt, Human
uuuuuuuuuuuuuugcgga

SEQ ID NO: 849881 - RNA, 18 nt, Human
uuuuuuuuuuuuuuuuug

SEQ ID NO: 849882 - RNA, 21 nt, Human
uuuuuuuuuuuuuuuuugcgg

SEQ ID NO: 849883 - RNA, 20 nt, Human
aagcgcagaagccagcgacc

SEQ ID NO: 849884 - RNA, 21 nt, Human
agacuuuccggaucccugagg

SEQ ID NO: 849885 - RNA, 26 nt, Human
aggcgccaggagcaggcaggugggag

SEQ ID NO: 849886 - RNA, 21 nt, Human
aggcggcaguauguaugagga

SEQ ID NO: 849887 - RNA, 21 nt, Human
caaccguguccagcccagaau

SEQ ID NO: 849888 - RNA, 21 nt, Human
caacgcagcggcgagcgggag

SEQ ID NO: 849889 - RNA, 23 nt, Human
cacugcacacaccgggcugcgcg

SEQ ID NO: 849890 - RNA, 18 nt, Human
cagaagccagcgaccugg

SEQ ID NO: 849891 - RNA, 20 nt, Human
cagaagccagcgaccuggag

SEQ ID NO: 849892 - RNA, 21 nt, Human
cagucaaugugcagcaaaccc

SEQ ID NO: 849893 - RNA, 23 nt, Human
ccacaaccguguccagcccagaa

SEQ ID NO: 849894 - RNA, 19 nt, Human
ccacacguggccaaaggaa

SEQ ID NO: 849895 - RNA, 20 nt, Human
ccacugcacacaccgggcug

SEQ ID NO: 849896 - RNA, 22 nt, Human
cccaccgccgucggcccugccu

SEQ ID NO: 849897 - RNA, 19 nt, Human
cccugaggccacugcacac

SEQ ID NO: 849898 - RNA, 20 nt, Human
ccguguccagcccagaauca

SEQ ID NO: 849899 - RNA, 20 nt, Human
ccuccaguugcgggagcgag

SEQ ID NO: 849900 - RNA, 18 nt, Human
cggaucccugaggccacu

SEQ ID NO: 849901 - RNA, 24 nt, Human
cggaucccugaggccacugcacac

SEQ ID NO: 849902 - RNA, 19 nt, Human
cggcccugccuccucugcc

SEQ ID NO: 849903 - RNA, 20 nt, Human
cggucccaacgcagcggcga

SEQ ID NO: 849904 - RNA, 18 nt, Human
cuccucugccgugccucc

SEQ ID NO: 849905 - RNA, 19 nt, Human
cugccuccucugccgugcc

SEQ ID NO: 849906 - RNA, 19 nt, Human
cugccuccucugccgugcc

SEQ ID NO: 849907 - RNA, 20 nt, Human
cugccuccucugccgugccu

SEQ ID NO: 849908 - RNA, 19 nt, Human
cuuuccggaucccugaggc

SEQ ID NO: 849909 - RNA, 21 nt, Human
gagccugcgcaacgcaccgcc

SEQ ID NO: 849910 - RNA, 20 nt, Human
gcaggcaggugggagggaaa

SEQ ID NO: 849911 - RNA, 19 nt, Human
gcagggcagaaacccugcc

SEQ ID NO: 849912 - RNA, 19 nt, Human
gcccugccuccucugccgu

SEQ ID NO: 849913 - RNA, 23 nt, Human
gccugcgcaacgcaccgcccacc

SEQ ID NO: 849914 - RNA, 22 nt, Human
gcgcagaagccagcgaccugga

SEQ ID NO: 849915 - RNA, 18 nt, Human
gcgccaggagcaggcagg

SEQ ID NO: 849916 - RNA, 28 nt, Human
ggcgccaggagcaggcaggugggaggga

SEQ ID NO: 849917 - RNA, 24 nt, Human
gggaaaguguucggcagggcagaa

SEQ ID NO: 849918 - RNA, 21 nt, Human
uccacaaccguguccagccca

SEQ ID NO: 849919 - RNA, 24 nt, Human
uccacaaccguguccagcccagaa

SEQ ID NO: 849920 - RNA, 24 nt, Human
uccagcccagaaucaggaccccca

SEQ ID NO: 849921 - RNA, 23 nt, Human
ucccugaggccacugcacacacc

SEQ ID NO: 849922 - RNA, 22 nt, Human
uccuagacuuuccggaucccug

SEQ ID NO: 849923 - RNA, 21 nt, Human
ucucuggauccacaaccgugu

SEQ ID NO: 849924 - RNA, 24 nt, Human
uggauccacaaccguguccagccc

SEQ ID NO: 849925 - RNA, 22 nt, Human
uggccaaaggacagcacccaga

SEQ ID NO: 849926 - RNA, 19 nt, Human
uuacuggauguuaggagaa

SEQ ID NO: 849927 - RNA, 18 nt, Human
uuuuuuuuuuuuuuccug

SEQ ID NO: 849928 - RNA, 21 nt, Human
aaacacguggcagccccaggc

SEQ ID NO: 849929 - RNA, 23 nt, Human
cagggcacaguggcugugguccc

SEQ ID NO: 849930 - RNA, 20 nt, Human
ggcccagcaggaaacggcag

SEQ ID NO: 849931 - RNA, 18 nt, Human
gucccuucuucagggcuc

SEQ ID NO: 849932 - RNA, 22 nt, Human
uaugcaggggcccagcaggaaa

SEQ ID NO: 849933 - RNA, 23 nt, Human
uggcagccccaggcucaggggca

SEQ ID NO: 849934 - RNA, 18 nt, Human
uucagggcuccaagucac

SEQ ID NO: 849935 - RNA, 27 nt, Human
uuuuuuuuuuuuuuuuuuuuuuugggg

SEQ ID NO: 849936 - RNA, 26 nt, Human
aaaaaaaaaaaccugaaaacagaaaa

SEQ ID NO: 849937 - RNA, 21 nt, Human
aaaaaggcauuuuaaacaaaa

SEQ ID NO: 849938 - RNA, 22 nt, Human
aaaacaaaacaaaaaacaaaaa

SEQ ID NO: 849939 - RNA, 26 nt, Human
aaaacaaaacaaaaaacaaaaaaccc

SEQ ID NO: 849940 - RNA, 24 nt, Human
aaacaaaaaacaaaaaacccugaa

SEQ ID NO: 849941 - RNA, 21 nt, Human
aaagugcugggauuauuaugg

SEQ ID NO: 849942 - RNA, 23 nt, Human
aacccugaaaauaugagcccagg

SEQ ID NO: 849943 - RNA, 24 nt, Human
aaccucaggugaucugcucaccuc

SEQ ID NO: 849944 - RNA, 19 nt, Human
aaccugaaaacagaaaaga

SEQ ID NO: 849945 - RNA, 22 nt, Human
aaggcauuuuaaacaaaaauuc

SEQ ID NO: 849946 - RNA, 23 nt, Human
aagugcugggauuauuaugggcc

SEQ ID NO: 849947 - RNA, 20 nt, Human
aaugagccaauacugcaccu

SEQ ID NO: 849948 - RNA, 20 nt, Human
acaaaacaaaaaacaaaaaa

SEQ ID NO: 849949 - RNA, 21 nt, Human
acaaaacaaaaaacaaaaaac

SEQ ID NO: 849950 - RNA, 24 nt, Human
acaaaacaaaaaacaaaaaacccu

SEQ ID NO: 849951 - RNA, 23 nt, Human
acagagcaagacucugucucaaa

SEQ ID NO: 849952 - RNA, 24 nt, Human
acagagcaagacucugucucaaaa

SEQ ID NO: 849953 - RNA, 18 nt, Human
acagauguccgccaccau

SEQ ID NO: 849954 - RNA, 24 nt, Human
acccugaaaauaugagcccaggag

SEQ ID NO: 849955 - RNA, 25 nt, Human
acccugaaaauaugagcccaggagu

SEQ ID NO: 849956 - RNA, 18 nt, Human
acgggguuucaucguguu

SEQ ID NO: 849957 - RNA, 23 nt, Human
acgggguuucaucguguuggcca

SEQ ID NO: 849958 - RNA, 24 nt, Human
acgggguuucaucguguuggccag

SEQ ID NO: 849959 - RNA, 22 nt, Human
acugcaaccuccaccucccagg

SEQ ID NO: 849960 - RNA, 21 nt, Human
acugcaccuuugugcuucugc

SEQ ID NO: 849961 - RNA, 24 nt, Human
acugcacuacugccugggcaacag

SEQ ID NO: 849962 - RNA, 26 nt, Human
agaaaaaaaaaaaccugaaaacagaa

SEQ ID NO: 849963 - RNA, 21 nt, Human
agaguccuucucauuccaccu

SEQ ID NO: 849964 - RNA, 18 nt, Human
agccacugugcccagccc

SEQ ID NO: 849965 - RNA, 19 nt, Human
agccacugugcccagccca

SEQ ID NO: 849966 - RNA, 24 nt, Human
aggugaucugcucaccucggccuc

SEQ ID NO: 849967 - RNA, 18 nt, Human
aguagcugggauuacaga

SEQ ID NO: 849968 - RNA, 24 nt, Human
agugcaauggcacgaucuuggcuu

SEQ ID NO: 849969 - RNA, 23 nt, Human
aucccagccuccuuucuaauccu

SEQ ID NO: 849970 - RNA, 20 nt, Human
aucgcgccacugcacuacug

SEQ ID NO: 849971 - RNA, 22 nt, Human
caaaacaaaaaacaaaaaaccc

SEQ ID NO: 849972 - RNA, 23 nt, Human
caaaacaaaaaacaaaaaacccu

SEQ ID NO: 849973 - RNA, 25 nt, Human
caaaacaaaaaacaaaaaacccuga

SEQ ID NO: 849974 - RNA, 27 nt, Human
caaagugcugggauuauuaugggcaua

SEQ ID NO: 849975 - RNA, 23 nt, Human
caaccuccaccucccagguucaa

SEQ ID NO: 849976 - RNA, 24 nt, Human
caccucggccucccaaagugcugg

SEQ ID NO: 849977 - RNA, 23 nt, Human
cacuacugccugggcaacagagc

SEQ ID NO: 849978 - RNA, 23 nt, Human
cacugcacuacugccugggcaac

SEQ ID NO: 849979 - RNA, 24 nt, Human
cacugcacuacugccugggcaaca

SEQ ID NO: 849980 - RNA, 23 nt, Human
cagaaaagagggcuuuuacaaug

SEQ ID NO: 849981 - RNA, 20 nt, Human
cagccuccugaguagcuggg

SEQ ID NO: 849982 - RNA, 20 nt, Human
caggaguucgaggcugcaau

SEQ ID NO: 849983 - RNA, 19 nt, Human
caucguguuggccaggcug

SEQ ID NO: 849984 - RNA, 24 nt, Human
caucguguuggccaggcuggucuc

SEQ ID NO: 849985 - RNA, 26 nt, Human
ccaaagugcugggauuauuaugggca

SEQ ID NO: 849986 - RNA, 27 nt, Human
ccaaagugcugggauuauuaugggcau

SEQ ID NO: 849987 - RNA, 24 nt, Human
ccacugcacuacugccugggcaac

SEQ ID NO: 849988 - RNA, 19 nt, Human
ccacugugcccagcccaaa

SEQ ID NO: 849989 - RNA, 23 nt, Human
ccacugugcccagcccaaaaagg

SEQ ID NO: 849990 - RNA, 24 nt, Human
ccacugugcccagcccaaaaaggc

SEQ ID NO: 849991 - RNA, 23 nt, Human
cccagguucaagcaguucuucug

SEQ ID NO: 849992 - RNA, 24 nt, Human
ccuaaccucaggugaucugcucac

SEQ ID NO: 849993 - RNA, 24 nt, Human
ccucccagguucaagcaguucuuc

SEQ ID NO: 849994 - RNA, 23 nt, Human
ccugaguagcugggauuacagau

SEQ ID NO: 849995 - RNA, 22 nt, Human
ccugggcaacagagcaagacuc

SEQ ID NO: 849996 - RNA, 21 nt, Human
ccugggcgacagagugagacc

SEQ ID NO: 849997 - RNA, 24 nt, Human
cgccacugcacuacugccugggca

SEQ ID NO: 849998 - RNA, 18 nt, Human
cguguuggccaggcuggu

SEQ ID NO: 849999 - RNA, 18 nt, Human
cuccugggaaaaugagaa

SEQ ID NO: 850000 - RNA, 23 nt, Human
cugcaaccuccaccucccagguu

SEQ ID NO: 850001 - RNA, 24 nt, Human
cugcaaccuccaccucccagguuc

SEQ ID NO: 850002 - RNA, 22 nt, Human
cugcacuacugccugggcaaca

SEQ ID NO: 850003 - RNA, 23 nt, Human
cugcuucagccuccugaguagcu

SEQ ID NO: 850004 - RNA, 21 nt, Human
cugucucaaaaaaacaaaaca

SEQ ID NO: 850005 - RNA, 24 nt, Human
cuuacugcaaccuccaccucccag

SEQ ID NO: 850006 - RNA, 22 nt, Human
cuuauugccuaggcuggagugc

SEQ ID NO: 850007 - RNA, 24 nt, Human
cuuauugccuaggcuggagugcaa

SEQ ID NO: 850008 - RNA, 24 nt, Human
cuuugugcuucugccugggcgaca

SEQ ID NO: 850009 - RNA, 18 nt, Human
gagacgggguuucaucgu

SEQ ID NO: 850010 - RNA, 24 nt, Human
gagacgggguuucaucguguuggc

SEQ ID NO: 850011 - RNA, 18 nt, Human
gagcccaggaguucgagg

SEQ ID NO: 850012 - RNA, 26 nt, Human
gaguagcugggauuacagauguccgc

SEQ ID NO: 850013 - RNA, 18 nt, Human
gauuacagauguccgcca

SEQ ID NO: 850014 - RNA, 24 nt, Human
gauuacagauguccgccaccaugc

SEQ ID NO: 850015 - RNA, 22 nt, Human
gcaaccuccaccucccagguuc

SEQ ID NO: 850016 - RNA, 24 nt, Human
gccacugcacuacugccugggcaa

SEQ ID NO: 850017 - RNA, 19 nt, Human
gccuaggcuggagugcaau

SEQ ID NO: 850018 - RNA, 23 nt, Human
gccugggcaacagagcaagacuc

SEQ ID NO: 850019 - RNA, 20 nt, Human
gccugggcgacagagugaga

SEQ ID NO: 850020 - RNA, 21 nt, Human
gcucuuauugccuaggcugga

SEQ ID NO: 850021 - RNA, 19 nt, Human
gcuggagugcaauggcacg

SEQ ID NO: 850022 - RNA, 23 nt, Human
gcuggucucaaacuccuaaccuc

SEQ ID NO: 850023 - RNA, 20 nt, Human
ggcauaagccacugugccca

SEQ ID NO: 850024 - RNA, 23 nt, Human
gggguuucaucguguuggccagg

SEQ ID NO: 850025 - RNA, 22 nt, Human
ggguuucaucguguuggccagg

SEQ ID NO: 850026 - RNA, 20 nt, Human
guagcugggauuacagaugu

SEQ ID NO: 850027 - RNA, 19 nt, Human
uaaccucaggugaucugcu

SEQ ID NO: 850028 - RNA, 20 nt, Human
uaaccucaggugaucugcuc

SEQ ID NO: 850029 - RNA, 23 nt, Human
uaagaaaaaaaaaaaccugaaaa

SEQ ID NO: 850030 - RNA, 28 nt, Human
uacagugauaacuccugggaaaaugaga

SEQ ID NO: 850031 - RNA, 21 nt, Human
uacugcaaccuccaccuccca

SEQ ID NO: 850032 - RNA, 19 nt, Human
uagacagaguccuucucau

SEQ ID NO: 850033 - RNA, 19 nt, Human
uaguagagacgggguuuca

SEQ ID NO: 850034 - RNA, 24 nt, Human
uaguagagacgggguuucaucgug

SEQ ID NO: 850035 - RNA, 22 nt, Human
uaugagcccaggaguucgaggc

SEQ ID NO: 850036 - RNA, 24 nt, Human
uauuaugggcauaagccacugugc

SEQ ID NO: 850037 - RNA, 19 nt, Human
uauugccuaggcuggagug

SEQ ID NO: 850038 - RNA, 20 nt, Human
ucagccuccugaguagcugg

SEQ ID NO: 850039 - RNA, 27 nt, Human
ucccaaagugcugggauuauuaugggc

SEQ ID NO: 850040 - RNA, 20 nt, Human
ucccagguucaagcaguucu

SEQ ID NO: 850041 - RNA, 24 nt, Human
ucccagguucaagcaguucuucug

SEQ ID NO: 850042 - RNA, 18 nt, Human
uccugaguagcugggauu

SEQ ID NO: 850043 - RNA, 21 nt, Human
ucgauaagaaaaaaaaaaacc

SEQ ID NO: 850044 - RNA, 18 nt, Human
ucggccucccaaagugcu

SEQ ID NO: 850045 - RNA, 18 nt, Human
ugagcccaggaguucgag

SEQ ID NO: 850046 - RNA, 24 nt, Human
ugaucugcucaccucggccuccca

SEQ ID NO: 850047 - RNA, 20 nt, Human
ugccuaggcuggagugcaau

SEQ ID NO: 850048 - RNA, 21 nt, Human
ugccuaggcuggagugcaaug

SEQ ID NO: 850049 - RNA, 24 nt, Human
ugccuaggcuggagugcaauggca

SEQ ID NO: 850050 - RNA, 24 nt, Human
ugccugggcgacagagugagaccu

SEQ ID NO: 850051 - RNA, 24 nt, Human
ugcucuuauugccuaggcuggagu

SEQ ID NO: 850052 - RNA, 24 nt, Human
ugcuucagccuccugaguagcugg

SEQ ID NO: 850053 - RNA, 24 nt, Human
ugcuucugccugggcgacagagug

SEQ ID NO: 850054 - RNA, 23 nt, Human
uggagugcaauggcacgaucuug

SEQ ID NO: 850055 - RNA, 24 nt, Human
uggagugcaauggcacgaucuugg

SEQ ID NO: 850056 - RNA, 24 nt, Human
uggccaggcuggucucaaacuccu

SEQ ID NO: 850057 - RNA, 19 nt, Human
ugggauuacagauguccgc

SEQ ID NO: 850058 - RNA, 21 nt, Human
ugggauuacagauguccgcca

SEQ ID NO: 850059 - RNA, 24 nt, Human
ugggauuacagauguccgccacca

SEQ ID NO: 850060 - RNA, 25 nt, Human
ugggauuacagauguccgccaccau

SEQ ID NO: 850061 - RNA, 18 nt, Human
ugggauuauuaugggcau

SEQ ID NO: 850062 - RNA, 20 nt, Human
ugggauuauuaugggcauaa

SEQ ID NO: 850063 - RNA, 19 nt, Human
ugggcgacagagugagacc

SEQ ID NO: 850064 - RNA, 21 nt, Human
uguauuuuuaguagagacggg

SEQ ID NO: 850065 - RNA, 21 nt, Human
ugucgauaagaaaaaaaaaaa

SEQ ID NO: 850066 - RNA, 22 nt, Human
ugucgauaagaaaaaaaaaaac

SEQ ID NO: 850067 - RNA, 19 nt, Human
uguuggccaggcuggucuc

SEQ ID NO: 850068 - RNA, 24 nt, Human
uuacugcaaccuccaccucccagg

SEQ ID NO: 850069 - RNA, 25 nt, Human
uuacugcaaccuccaccucccaggu

SEQ ID NO: 850070 - RNA, 18 nt, Human
uuaguagagacgggguuu

SEQ ID NO: 850071 - RNA, 20 nt, Human
uuaguagagacgggguuuca

SEQ ID NO: 850072 - RNA, 24 nt, Human
uuaguagagacgggguuucaucgu

SEQ ID NO: 850073 - RNA, 24 nt, Human
uucagccuccugaguagcugggau

SEQ ID NO: 850074 - RNA, 22 nt, Human
uugcucuuauugccuaggcugg

SEQ ID NO: 850075 - RNA, 23 nt, Human
uugcucuuauugccuaggcugga

SEQ ID NO: 850076 - RNA, 23 nt, Human
uuguauuuuuaguagagacgggg

SEQ ID NO: 850077 - RNA, 24 nt, Human
uugucgauaagaaaaaaaaaaacc

SEQ ID NO: 850078 - RNA, 23 nt, Human
uuucaucguguuggccaggcugu

SEQ ID NO: 850079 - RNA, 24 nt, Human
uuugcucuuauugccuaggcugga

SEQ ID NO: 850080 - RNA, 18 nt, Human
uuuguauuuuuaguagag

SEQ ID NO: 850081 - RNA, 19 nt, Human
uuuguauuuuuaguagaga

SEQ ID NO: 850082 - RNA, 20 nt, Human
uuuguauuuuuaguagagac

SEQ ID NO: 850083 - RNA, 24 nt, Human
uuugugcuucugccugggcgacag

SEQ ID NO: 850084 - RNA, 23 nt, Human
uuuugcucuuauugccuaggcug

SEQ ID NO: 850085 - RNA, 24 nt, Human
uuuugcucuuauugccuaggcugg

SEQ ID NO: 850086 - RNA, 24 nt, Human
uuuuuaguagagacgggguuucau

SEQ ID NO: 850087 - RNA, 22 nt, Human
uuuuuuuuuuuuuugagacgga

SEQ ID NO: 850088 - RNA, 18 nt, Human
uuuuuuuuuuuuuuuuug

SEQ ID NO: 850089 - RNA, 20 nt, Human
aauagaaggaaugcucugga

SEQ ID NO: 850090 - RNA, 22 nt, Human
aaucuguaaaaggcaauuccuu

SEQ ID NO: 850091 - RNA, 22 nt, Human
agacaccguccagcuguccccc

SEQ ID NO: 850092 - RNA, 23 nt, Human
agagagggccugggggauucuga

SEQ ID NO: 850093 - RNA, 22 nt, Human
agauauccucccagagacaucc

SEQ ID NO: 850094 - RNA, 22 nt, Human
auaugauauacacguguauacg

SEQ ID NO: 850095 - RNA, 30 nt, Human
caaaagguacaaaagguguacauugaaaaa

SEQ ID NO: 850096 - RNA, 20 nt, Human
cacacuuucuccauuccaaa

SEQ ID NO: 850097 - RNA, 22 nt, Human
cacauacaucuacacacuuucu

SEQ ID NO: 850098 - RNA, 25 nt, Human
cacccacagccuugcacuguggucc

SEQ ID NO: 850099 - RNA, 21 nt, Human
caccccucuucccagaggcaa

SEQ ID NO: 850100 - RNA, 22 nt, Human
cagaggcaauucaggcugccgg

SEQ ID NO: 850101 - RNA, 23 nt, Human
ccaaaacauaccuuaucucuaac

SEQ ID NO: 850102 - RNA, 19 nt, Human
ccaccccucuucccagagg

SEQ ID NO: 850103 - RNA, 29 nt, Human
cccccauggagugccuacaugucacacuc

SEQ ID NO: 850104 - RNA, 22 nt, Human
cccuguauugguggcacucucc

SEQ ID NO: 850105 - RNA, 18 nt, Human
ccucccagagacauccua

SEQ ID NO: 850106 - RNA, 23 nt, Human
ccucccagagacauccuaggcau

SEQ ID NO: 850107 - RNA, 19 nt, Human
cugccaccaccauaucuag

SEQ ID NO: 850108 - RNA, 19 nt, Human
cugccgggcugcuagauau

SEQ ID NO: 850109 - RNA, 25 nt, Human
cuuuuugcuauuacaauguuucaac

SEQ ID NO: 850110 - RNA, 20 nt, Human
gaaagauucaaaaccucuga

SEQ ID NO: 850111 - RNA, 23 nt, Human
gacauaugauauacacguguaua

SEQ ID NO: 850112 - RNA, 22 nt, Human
gccauuuuauccaaccggaauu

SEQ ID NO: 850113 - RNA, 21 nt, Human
gccuugcacuguggucccacu

SEQ ID NO: 850114 - RNA, 19 nt, Human
guaaaaggcaauuccuuug

SEQ ID NO: 850115 - RNA, 18 nt, Human
uacaaugcaucuucagcc

SEQ ID NO: 850116 - RNA, 24 nt, Human
uacgcauuugcacuuuugauagac

SEQ ID NO: 850117 - RNA, 24 nt, Human
uauacacguguauacgucugugug

SEQ ID NO: 850118 - RNA, 19 nt, Human
uauagauaauacauguaca

SEQ ID NO: 850119 - RNA, 21 nt, Human
uauagauaauacauguacaug

SEQ ID NO: 850120 - RNA, 23 nt, Human
uaugauauacacguguauacguc

SEQ ID NO: 850121 - RNA, 24 nt, Human
uaugcacacacauacaucuacaca

SEQ ID NO: 850122 - RNA, 20 nt, Human
uccaaacauuaggauaccau

SEQ ID NO: 850123 - RNA, 20 nt, Human
uccagcugucccccauggag

SEQ ID NO: 850124 - RNA, 21 nt, Human
ucccacuucuugguucacaug

SEQ ID NO: 850125 - RNA, 26 nt, Human
ucuaugguaguacacacacacagugu

SEQ ID NO: 850126 - RNA, 21 nt, Human
ucuccaguuuugcacauuuau

SEQ ID NO: 850127 - RNA, 22 nt, Human
ucucuaacauuaguguaguucu

SEQ ID NO: 850128 - RNA, 23 nt, Human
ucucuuuuucccuucuuagggaa

SEQ ID NO: 850129 - RNA, 20 nt, Human
ucugaagaugcacagaacaa

SEQ ID NO: 850130 - RNA, 23 nt, Human
ucuucagccuguaauagaaggaa

SEQ ID NO: 850131 - RNA, 21 nt, Human
ugaaaaggaucaagagagggc

SEQ ID NO: 850132 - RNA, 21 nt, Human
ugaaagauucaaaaccucuga

SEQ ID NO: 850133 - RNA, 23 nt, Human
ugagagagacccucuaaaguugg

SEQ ID NO: 850134 - RNA, 19 nt, Human
ugcacuguggucccacuuc

SEQ ID NO: 850135 - RNA, 22 nt, Human
ugcacuguggucccacuucuug

SEQ ID NO: 850136 - RNA, 23 nt, Human
ugcacuguggucccacuucuugg

SEQ ID NO: 850137 - RNA, 23 nt, Human
ugguaguacacacacacaggauc

SEQ ID NO: 850138 - RNA, 24 nt, Human
ugucccccauggagugccuacaug

SEQ ID NO: 850139 - RNA, 28 nt, Human
ugugugaaaacauaugcacacacauagu

SEQ ID NO: 850140 - RNA, 21 nt, Human
uuacaaugcaucuucagccug

SEQ ID NO: 850141 - RNA, 19 nt, Human
uucaaaaccucugacaccu

SEQ ID NO: 850142 - RNA, 24 nt, Human
uucaaaaccucugacaccuuguuu

SEQ ID NO: 850143 - RNA, 22 nt, Human
uucuaugguaguacacacacac

SEQ ID NO: 850144 - RNA, 21 nt, Human
uugcacuguggucccacuucu

SEQ ID NO: 850145 - RNA, 20 nt, Human
uugcuaguucaaagagcuua

SEQ ID NO: 850146 - RNA, 23 nt, Human
aagccucaggguucacucagaau

SEQ ID NO: 850147 - RNA, 23 nt, Human
acagccgcgaagaccaagggccu

SEQ ID NO: 850148 - RNA, 19 nt, Human
aggaagccucaggguucac

SEQ ID NO: 850149 - RNA, 23 nt, Human
aggaggaaaaagaaaucaucugg

SEQ ID NO: 850150 - RNA, 23 nt, Human
aggcaagaaccugaaguaguagc

SEQ ID NO: 850151 - RNA, 22 nt, Human
ccucgguuccucaccacuggcg

SEQ ID NO: 850152 - RNA, 19 nt, Human
ccugcgccuccacagccgc

SEQ ID NO: 850153 - RNA, 21 nt, Human
ccuuagagcucagagacugga

SEQ ID NO: 850154 - RNA, 19 nt, Human
cgcccuucccgggugguuc

SEQ ID NO: 850155 - RNA, 22 nt, Human
cgccgacccgcgcgggccccuc

SEQ ID NO: 850156 - RNA, 23 nt, Human
cgggguucacucaggaagccuca

SEQ ID NO: 850157 - RNA, 18 nt, Human
gacccgcgcgggccccuc

SEQ ID NO: 850158 - RNA, 19 nt, Human
gaccuggggcagaggagga

SEQ ID NO: 850159 - RNA, 21 nt, Human
gggcagaggaggaaaaagaaa

SEQ ID NO: 850160 - RNA, 21 nt, Human
ggggcuggcacccucucagag

SEQ ID NO: 850161 - RNA, 23 nt, Human
ggugguucgggguucacucagga

SEQ ID NO: 850162 - RNA, 20 nt, Human
uaaauacaaaauaguagagg

SEQ ID NO: 850163 - RNA, 19 nt, Human
uagagcucagagacuggaa

SEQ ID NO: 850164 - RNA, 22 nt, Human
uagagcucagagacuggaaggu

SEQ ID NO: 850165 - RNA, 19 nt, Human
uagauuuuauuauggauga

SEQ ID NO: 850166 - RNA, 18 nt, Human
uagccacccaaguccccg

SEQ ID NO: 850167 - RNA, 25 nt, Human
uaguauuccacacaaauuuuuaaaa

SEQ ID NO: 850168 - RNA, 23 nt, Human
uccacagccgcgaagaccaaggg

SEQ ID NO: 850169 - RNA, 22 nt, Human
ucccacccacagcauccgcccu

SEQ ID NO: 850170 - RNA, 20 nt, Human
uccccgagcuccccaguagc

SEQ ID NO: 850171 - RNA, 24 nt, Human
ugguucgggguucacucaggaagc

SEQ ID NO: 850172 - RNA, 18 nt, Human
uguuugcuuucuucugcu

SEQ ID NO: 850173 - RNA, 20 nt, Human
uuuuuuuuuuuuuuuuuggu

SEQ ID NO: 850174 - RNA, 24 nt, Human
uuuuuuuuuuuuuuuuugguauag

SEQ ID NO: 850175 - RNA, 20 nt, Human
uuuuuuuuuuuuuuuuuugg

SEQ ID NO: 850176 - RNA, 23 nt, Human
augucccccaaacccaggggucu

SEQ ID NO: 850177 - RNA, 19 nt, Human
ccagggcccggaagcucca

SEQ ID NO: 850178 - RNA, 19 nt, Human
cccaugucccccaaaccca

SEQ ID NO: 850179 - RNA, 23 nt, Human
ccccaaacccaggggucugccuc

SEQ ID NO: 850180 - RNA, 21 nt, Human
ccccaaaugcccauguccccc

SEQ ID NO: 850181 - RNA, 24 nt, Human
ccccaaaugcccaugucccccaaa

SEQ ID NO: 850182 - RNA, 18 nt, Human
ccgacccggggcgcgcgg

SEQ ID NO: 850183 - RNA, 23 nt, Human
ccggaagcuccagccuccagcgg

SEQ ID NO: 850184 - RNA, 19 nt, Human
cgacccggggcgcgcgggg

SEQ ID NO: 850185 - RNA, 22 nt, Human
gggcccggaagcuccagccucc

SEQ ID NO: 850186 - RNA, 23 nt, Human
gucccccaaacccaggggucugc

SEQ ID NO: 850187 - RNA, 24 nt, Human
uuuuuuuuuuuuuuuuuuuccaag

SEQ ID NO: 850188 - RNA, 23 nt, Human
uuuuuuuuuuuuuuuuuuuucca

SEQ ID NO: 850189 - RNA, 24 nt, Human
uuuuuuuuuuuuuuuuuuuuuccu

SEQ ID NO: 850190 - RNA, 22 nt, Human
aacagaaccaguccauguaugg

SEQ ID NO: 850191 - RNA, 20 nt, Human
agcacuuggaauucaggggu

SEQ ID NO: 850192 - RNA, 21 nt, Human
cccgaagcugaacuuccuggg

SEQ ID NO: 850193 - RNA, 26 nt, Human
cgaagcugaacuuccugggaagcuga

SEQ ID NO: 850194 - RNA, 19 nt, Human
cugggucagagcugguuca

SEQ ID NO: 850195 - RNA, 22 nt, Human
gaagcugauccaauggagcacu

SEQ ID NO: 850196 - RNA, 23 nt, Human
uaacccgaagcugaacuuccugg

SEQ ID NO: 850197 - RNA, 22 nt, Human
uccauguauggaggcaugggca

SEQ ID NO: 850198 - RNA, 21 nt, Human
ugggccuugcuaggcagggag

SEQ ID NO: 850199 - RNA, 24 nt, Human
uguaacucguacguuuuuucuaaa

SEQ ID NO: 850200 - RNA, 19 nt, Human
uguauggaggcaugggcau

SEQ ID NO: 850201 - RNA, 23 nt, Human
uuccugggaagcugauccaaugg

SEQ ID NO: 850202 - RNA, 23 nt, Human
aaaaauaagagagacgagagaga

SEQ ID NO: 850203 - RNA, 24 nt, Human
aaaguacugggauuacaggcguga

SEQ ID NO: 850204 - RNA, 19 nt, Human
aaagugcugggauuacagg

SEQ ID NO: 850205 - RNA, 19 nt, Human
aaagugcugggauuacagg

SEQ ID NO: 850206 - RNA, 20 nt, Human
aaccugcagaccucccaccu

SEQ ID NO: 850207 - RNA, 25 nt, Human
aagaaaaauaagagagaccgguacc

SEQ ID NO: 850208 - RNA, 20 nt, Human
aagcaaaaaccccagcgccc

SEQ ID NO: 850209 - RNA, 19 nt, Human
aaguacugggauuacaggc

SEQ ID NO: 850210 - RNA, 26 nt, Human
aaguacugggauuacaggcgugagcc

SEQ ID NO: 850211 - RNA, 18 nt, Human
aagugcugggauuacagg

SEQ ID NO: 850212 - RNA, 22 nt, Human
aagugcugggauuacaggaguc

SEQ ID NO: 850213 - RNA, 24 nt, Human
aauaaaaaauaaguaaagcacauc

SEQ ID NO: 850214 - RNA, 18 nt, Human
acaggcgcccgccaccuc

SEQ ID NO: 850215 - RNA, 24 nt, Human
accauguuggcuaggcuguucuug

SEQ ID NO: 850216 - RNA, 22 nt, Human
acggagucuugcugucgcccag

SEQ ID NO: 850217 - RNA, 18 nt, Human
acgggguuucaguguuag

SEQ ID NO: 850218 - RNA, 20 nt, Human
acuauaugauuucucaagga

SEQ ID NO: 850219 - RNA, 22 nt, Human
acucccccucggcuugggggau

SEQ ID NO: 850220 - RNA, 25 nt, Human
acucugucgcccaggcuggagugca

SEQ ID NO: 850221 - RNA, 18 nt, Human
acugaagcaaaaacccca

SEQ ID NO: 850222 - RNA, 19 nt, Human
acugcaggcuccacccccc

SEQ ID NO: 850223 - RNA, 19 nt, Human
agaaggcgggaagaaaucu

SEQ ID NO: 850224 - RNA, 19 nt, Human
agagacgagagagagagag

SEQ ID NO: 850225 - RNA, 19 nt, Human
agagagagagagaaagaga

SEQ ID NO: 850226 - RNA, 30 nt, Human
agcuaauuuuuuguauuuuuaguagagacg

SEQ ID NO: 850227 - RNA, 19 nt, Human
agcugauuacaggcacccg

SEQ ID NO: 850228 - RNA, 25 nt, Human
aggcuggagugcaguggcgcgaucu

SEQ ID NO: 850229 - RNA, 18 nt, Human
aggguagaaggcgggaag

SEQ ID NO: 850230 - RNA, 24 nt, Human
aggugaucugcccagcucagccuc

SEQ ID NO: 850231 - RNA, 18 nt, Human
aguagagacgggguuuca

SEQ ID NO: 850232 - RNA, 24 nt, Human
agugauuccccugccucagccucc

SEQ ID NO: 850233 - RNA, 20 nt, Human
agugcaguggcgcgaucucg

SEQ ID NO: 850234 - RNA, 23 nt, Human
agugcaguggcgcgaucucggcu

SEQ ID NO: 850235 - RNA, 24 nt, Human
agugcaguggcgcgaucucggcuc

SEQ ID NO: 850236 - RNA, 20 nt, Human
agugcaguggugcgauuucg

SEQ ID NO: 850237 - RNA, 23 nt, Human
agugcaguggugcgauuucggcu

SEQ ID NO: 850238 - RNA, 24 nt, Human
agugcaguggugcgauuucggcuc

SEQ ID NO: 850239 - RNA, 27 nt, Human
aucuccaacaauaaaccaaauucugag

SEQ ID NO: 850240 - RNA, 21 nt, Human
augcagugcgcuguaccggug

SEQ ID NO: 850241 - RNA, 23 nt, Human
caaaagaaaaauaagagagacga

SEQ ID NO: 850242 - RNA, 24 nt, Human
caaaguacugggauuacaggcgug

SEQ ID NO: 850243 - RNA, 26 nt, Human
caaagugcugggauuacaggagucgu

SEQ ID NO: 850244 - RNA, 21 nt, Human
caacgacccucucccuccuuc

SEQ ID NO: 850245 - RNA, 20 nt, Human
caagugauuccccugccuca

SEQ ID NO: 850246 - RNA, 22 nt, Human
caagugauuccccugccucagc

SEQ ID NO: 850247 - RNA, 22 nt, Human
cacacaauauucgaagacauuc

SEQ ID NO: 850248 - RNA, 23 nt, Human
caccacacccgcuaauuuuugua

SEQ ID NO: 850249 - RNA, 22 nt, Human
caccauguuggcuaggcuguuc

SEQ ID NO: 850250 - RNA, 23 nt, Human
caccauguuggcuaggcuguucu

SEQ ID NO: 850251 - RNA, 24 nt, Human
caccauguuggcuaggcuguucuu

SEQ ID NO: 850252 - RNA, 22 nt, Human
cacgccauucuccugccucagc

SEQ ID NO: 850253 - RNA, 22 nt, Human
cacucugucgcccaggcuggag

SEQ ID NO: 850254 - RNA, 20 nt, Human
cacugcaaccuccgcccccc

SEQ ID NO: 850255 - RNA, 20 nt, Human
cacugcaaccuccgcccccc

SEQ ID NO: 850256 - RNA, 18 nt, Human
cagaacccacccgguuca

SEQ ID NO: 850257 - RNA, 25 nt, Human
cagaaugucuuuuuuuuuuuuuuuu

SEQ ID NO: 850258 - RNA, 23 nt, Human
cagagcagcuacacugaagcaaa

SEQ ID NO: 850259 - RNA, 21 nt, Human
cagagcugagugcaaccugcu

SEQ ID NO: 850260 - RNA, 18 nt, Human
cagcaggaugguuaacgg

SEQ ID NO: 850261 - RNA, 23 nt, Human
cagcccccaucccaucguccgcu

SEQ ID NO: 850262 - RNA, 24 nt, Human
cagcucagccucccaaaguacugg

SEQ ID NO: 850263 - RNA, 21 nt, Human
caggcgcccgccaccucgccc

SEQ ID NO: 850264 - RNA, 24 nt, Human
caggcgugagccaccgugcccggc

SEQ ID NO: 850265 - RNA, 24 nt, Human
cauguuggcuaggcuguucuugaa

SEQ ID NO: 850266 - RNA, 19 nt, Human
cauucaguccccugccuau

SEQ ID NO: 850267 - RNA, 20 nt, Human
ccaaaguacugggauuacag

SEQ ID NO: 850268 - RNA, 22 nt, Human
ccaaaguacugggauuacaggc

SEQ ID NO: 850269 - RNA, 24 nt, Human
ccaaaguacugggauuacaggcgu

SEQ ID NO: 850270 - RNA, 19 nt, Human
ccaaagugcugggauuaca

SEQ ID NO: 850271 - RNA, 21 nt, Human
ccaaagugcugggauuacagg

SEQ ID NO: 850272 - RNA, 24 nt, Human
ccaaagugcugggauuacaggagu

SEQ ID NO: 850273 - RNA, 25 nt, Human
cccccagccucagccaacgcaaguu

SEQ ID NO: 850274 - RNA, 19 nt, Human
cccccggguucaagugauu

SEQ ID NO: 850275 - RNA, 21 nt, Human
ccccggggccugcaggcugug

SEQ ID NO: 850276 - RNA, 20 nt, Human
ccccgggguucacgccauuc

SEQ ID NO: 850277 - RNA, 19 nt, Human
ccccggguucaagugauuc

SEQ ID NO: 850278 - RNA, 24 nt, Human
ccccggguucaagugauuccccug

SEQ ID NO: 850279 - RNA, 24 nt, Human
ccccucggcuugggggauggaggc

SEQ ID NO: 850280 - RNA, 22 nt, Human
cccgaguagcugauuacaggca

SEQ ID NO: 850281 - RNA, 21 nt, Human
cccggguucaagugauucccc

SEQ ID NO: 850282 - RNA, 20 nt, Human
cccucucccuccuucccaaa

SEQ ID NO: 850283 - RNA, 24 nt, Human
cccugccucagccucccgaguagc

SEQ ID NO: 850284 - RNA, 24 nt, Human
ccgccccccggguucaagugauuc

SEQ ID NO: 850285 - RNA, 25 nt, Human
ccggugcgggaguccaggaaggcug

SEQ ID NO: 850286 - RNA, 22 nt, Human
ccucaggugaucugcccagcuc

SEQ ID NO: 850287 - RNA, 19 nt, Human
ccucccgagaagcugggaa

SEQ ID NO: 850288 - RNA, 24 nt, Human
ccugccucggccucccaaagugcu

SEQ ID NO: 850289 - RNA, 24 nt, Human
ccugcucacaacgacccucucccu

SEQ ID NO: 850290 - RNA, 22 nt, Human
cgaagacauucuuccuucuuuc

SEQ ID NO: 850291 - RNA, 23 nt, Human
cgacccucucccuccuucccaaa

SEQ ID NO: 850292 - RNA, 24 nt, Human
cgcccaggcuggagugcaguggcg

SEQ ID NO: 850293 - RNA, 24 nt, Human
cgcccaggcuggagugcaguggug

SEQ ID NO: 850294 - RNA, 22 nt, Human
cgccccccggguucaagugauu

SEQ ID NO: 850295 - RNA, 21 nt, Human
cggggguuucaccauguuggc

SEQ ID NO: 850296 - RNA, 24 nt, Human
cggggguuucaccauguuggcuag

SEQ ID NO: 850297 - RNA, 20 nt, Human
cgugaagugcacccuccgga

SEQ ID NO: 850298 - RNA, 20 nt, Human
cguuuaagacccuccugcua

SEQ ID NO: 850299 - RNA, 25 nt, Human
cuaauuuuuguauuuuuagucgaga

SEQ ID NO: 850300 - RNA, 24 nt, Human
cucacucugucgcccaggcuggag

SEQ ID NO: 850301 - RNA, 22 nt, Human
cucacugcaaccuccgcccccc

SEQ ID NO: 850302 - RNA, 24 nt, Human
cucacugcaaccuccgccccccgg

SEQ ID NO: 850303 - RNA, 24 nt, Human
cucacugcaggcuccaccccccgg

SEQ ID NO: 850304 - RNA, 19 nt, Human
cucagaggcuugagucugg

SEQ ID NO: 850305 - RNA, 18 nt, Human
cucaugauccgccugccu

SEQ ID NO: 850306 - RNA, 25 nt, Human
cuccacacaauauucgaagacauuc

SEQ ID NO: 850307 - RNA, 19 nt, Human
cuccagcccccaucccauc

SEQ ID NO: 850308 - RNA, 24 nt, Human
cuccugaccucaugauccgccugc

SEQ ID NO: 850309 - RNA, 19 nt, Human
cucucccuccuucccaaau

SEQ ID NO: 850310 - RNA, 22 nt, Human
cugaagcaaaaaccccagcgcc

SEQ ID NO: 850311 - RNA, 23 nt, Human
cugcaaccuccgccccccggguu

SEQ ID NO: 850312 - RNA, 24 nt, Human
cugcaaccuccgccccccggguuc

SEQ ID NO: 850313 - RNA, 20 nt, Human
cugccccggggccugcaggc

SEQ ID NO: 850314 - RNA, 23 nt, Human
cugccucagccucccgagaagcu

SEQ ID NO: 850315 - RNA, 23 nt, Human
cugccucagccucccgaguagcu

SEQ ID NO: 850316 - RNA, 19 nt, Human
cuggcuccuuuuggacuag

SEQ ID NO: 850317 - RNA, 18 nt, Human
cugucgcccaggcuggag

SEQ ID NO: 850318 - RNA, 19 nt, Human
cugucgcccaggcuggagu

SEQ ID NO: 850319 - RNA, 23 nt, Human
cuuaggcucacagaaagcacuga

SEQ ID NO: 850320 - RNA, 21 nt, Human
cuuauagaauuggagagaauu

SEQ ID NO: 850321 - RNA, 19 nt, Human
cuuccuucuuucugcugcc

SEQ ID NO: 850322 - RNA, 20 nt, Human
cuugaacuccugaccucagg

SEQ ID NO: 850323 - RNA, 20 nt, Human
cuugccugugucuccucccu

SEQ ID NO: 850324 - RNA, 21 nt, Human
gaccccagugaguuuuagcac

SEQ ID NO: 850325 - RNA, 24 nt, Human
gaccucaggugaucugcccagcuc

SEQ ID NO: 850326 - RNA, 22 nt, Human
gaccucaugauccgccugccuc

SEQ ID NO: 850327 - RNA, 22 nt, Human
gaccucaugauccgccugccuc

SEQ ID NO: 850328 - RNA, 24 nt, Human
gaccucaugauccgccugccucgg

SEQ ID NO: 850329 - RNA, 21 nt, Human
gagaacgaacaaaucaggaug

SEQ ID NO: 850330 - RNA, 20 nt, Human
gagagagaaagagagagaga

SEQ ID NO: 850331 - RNA, 20 nt, Human
gagagagagagagaaagaga

SEQ ID NO: 850332 - RNA, 18 nt, Human
gaggcaaagagacaaacu

SEQ ID NO: 850333 - RNA, 18 nt, Human
gauuacaggcgugagcca

SEQ ID NO: 850334 - RNA, 20 nt, Human
gauuacaggcgugagccacc

SEQ ID NO: 850335 - RNA, 21 nt, Human
gauuacaggcgugagccaccg

SEQ ID NO: 850336 - RNA, 18 nt, Human
gauuucggcucacugcaa

SEQ ID NO: 850337 - RNA, 23 nt, Human
gcccagcuaauuuuuuguauuuu

SEQ ID NO: 850338 - RNA, 19 nt, Human
gcccaggcuggagugcagu

SEQ ID NO: 850339 - RNA, 19 nt, Human
gcccaggcuggagugcagu

SEQ ID NO: 850340 - RNA, 20 nt, Human
gcccaggcuggagugcagug

SEQ ID NO: 850341 - RNA, 20 nt, Human
gcccaggcuggagugcagug

SEQ ID NO: 850342 - RNA, 23 nt, Human
gcccaggcuggagugcaguggug

SEQ ID NO: 850343 - RNA, 19 nt, Human
gcccuaaaaucuccaacaa

SEQ ID NO: 850344 - RNA, 22 nt, Human
gcccuaaaaucuccaacaauaa

SEQ ID NO: 850345 - RNA, 24 nt, Human
gcugucgcccaggcuggagugcag

SEQ ID NO: 850346 - RNA, 21 nt, Human
ggagaaaccguccacaauggg

SEQ ID NO: 850347 - RNA, 22 nt, Human
ggauggaggcugccccggggcc

SEQ ID NO: 850348 - RNA, 18 nt, Human
ggcugccccggggccugc

SEQ ID NO: 850349 - RNA, 19 nt, Human
ggcuguggaccuucucugg

SEQ ID NO: 850350 - RNA, 24 nt, Human
ggcuguucuugaacuccugaccuc

SEQ ID NO: 850351 - RNA, 18 nt, Human
gggaguugaggcuugccu

SEQ ID NO: 850352 - RNA, 18 nt, Human
gggccugcaggcugugua

SEQ ID NO: 850353 - RNA, 24 nt, Human
gggggauggaggcugccccggggc

SEQ ID NO: 850354 - RNA, 19 nt, Human
ggggguuucaccauguugg

SEQ ID NO: 850355 - RNA, 21 nt, Human
ggggguuucaccauguuggcu

SEQ ID NO: 850356 - RNA, 23 nt, Human
gggguuucaccauguuggcuagg

SEQ ID NO: 850357 - RNA, 22 nt, Human
ggguuucaccauguuggcuagg

SEQ ID NO: 850358 - RNA, 23 nt, Human
gucuugcugucgcccaggcugga

SEQ ID NO: 850359 - RNA, 27 nt, Human
gucuuuuuuuuuuuuuuuuuuuuuuug

SEQ ID NO: 850360 - RNA, 24 nt, Human
gugaucugcccagcucagccuccc

SEQ ID NO: 850361 - RNA, 24 nt, Human
gugauuccccugccucagccuccc

SEQ ID NO: 850362 - RNA, 20 nt, Human
gugcgggaguccaggaaggc

SEQ ID NO: 850363 - RNA, 20 nt, Human
gugcugggauuacaggaguc

SEQ ID NO: 850364 - RNA, 25 nt, Human
uaaaaaauaaguaaagcacaucgaa

SEQ ID NO: 850365 - RNA, 18 nt, Human
uaaccauaugaauguauu

SEQ ID NO: 850366 - RNA, 24 nt, Human
uaauuuuuuguauuuuuaguagag

SEQ ID NO: 850367 - RNA, 25 nt, Human
uaauuuuuuguauuuuuaguagaga

SEQ ID NO: 850368 - RNA, 22 nt, Human
uacacugaagcaaaaaccccag

SEQ ID NO: 850369 - RNA, 23 nt, Human
uacaggcacccgccaccacaccc

SEQ ID NO: 850370 - RNA, 23 nt, Human
uacaggcgugagccaccgugccc

SEQ ID NO: 850371 - RNA, 24 nt, Human
uacugggauuacaggcgugagcca

SEQ ID NO: 850372 - RNA, 21 nt, Human
uagcugugugacuuuagacau

SEQ ID NO: 850373 - RNA, 22 nt, Human
uagguuuucagcaccaggaggc

SEQ ID NO: 850374 - RNA, 19 nt, Human
uaguagagacgggguuuca

SEQ ID NO: 850375 - RNA, 22 nt, Human
uaguagagacgggguuucagug

SEQ ID NO: 850376 - RNA, 22 nt, Human
uaguagagacgggguuucaguu

SEQ ID NO: 850377 - RNA, 25 nt, Human
uagucgagacggggguuucaccaug

SEQ ID NO: 850378 - RNA, 18 nt, Human
uauuaaagaagggggggc

SEQ ID NO: 850379 - RNA, 20 nt, Human
ucacgccauucuccugccuc

SEQ ID NO: 850380 - RNA, 18 nt, Human
ucacugcaaccuccgccc

SEQ ID NO: 850381 - RNA, 23 nt, Human
ucacugcaaccuccgccccccgg

SEQ ID NO: 850382 - RNA, 24 nt, Human
ucacugcaaccuccgccccccggg

SEQ ID NO: 850383 - RNA, 27 nt, Human
ucacugcaaccuccgccccccggguuc

SEQ ID NO: 850384 - RNA, 20 nt, Human
ucacugcaggcuccaccccc

SEQ ID NO: 850385 - RNA, 24 nt, Human
ucacugcaggcuccaccccccggg

SEQ ID NO: 850386 - RNA, 19 nt, Human
ucagaacccacccgguuca

SEQ ID NO: 850387 - RNA, 24 nt, Human
ucccaaaguacugggauuacaggc

SEQ ID NO: 850388 - RNA, 18 nt, Human
ucccaaagugcugggauu

SEQ ID NO: 850389 - RNA, 23 nt, Human
ucccaaagugcugggauuacagg

SEQ ID NO: 850390 - RNA, 24 nt, Human
uccccugccucagccucccgagua

SEQ ID NO: 850391 - RNA, 22 nt, Human
ucccgaguagcugauuacaggc

SEQ ID NO: 850392 - RNA, 21 nt, Human
uccugccucagccucccgaga

SEQ ID NO: 850393 - RNA, 22 nt, Human
ucgcccagcuaauuuuuuguau

SEQ ID NO: 850394 - RNA, 22 nt, Human
ucgcccaggcuggagugcagug

SEQ ID NO: 850395 - RNA, 24 nt, Human
ucgcccaggcuggagugcaguggu

SEQ ID NO: 850396 - RNA, 18 nt, Human
ucggccucccaaagugcu

SEQ ID NO: 850397 - RNA, 23 nt, Human
ucucacucugucgcccaggcugg

SEQ ID NO: 850398 - RNA, 24 nt, Human
ucucacucugucgcccaggcugga

SEQ ID NO: 850399 - RNA, 26 nt, Human
ucucacucugucgcccaggcuggagu

SEQ ID NO: 850400 - RNA, 27 nt, Human
ucucacucugucgcccaggcuggagug

SEQ ID NO: 850401 - RNA, 24 nt, Human
ucuccugccucagccucccgagaa

SEQ ID NO: 850402 - RNA, 24 nt, Human
ucuguaacugaucagagccggggc

SEQ ID NO: 850403 - RNA, 24 nt, Human
ucugucgcccaggcuggagugcag

SEQ ID NO: 850404 - RNA, 21 nt, Human
ucuuccuucuuucugcugccu

SEQ ID NO: 850405 - RNA, 23 nt, Human
ucuugaacuccugaccucaggug

SEQ ID NO: 850406 - RNA, 20 nt, Human
ucuugcugucgcccaggcug

SEQ ID NO: 850407 - RNA, 21 nt, Human
ucuugcugucgcccaggcugg

SEQ ID NO: 850408 - RNA, 21 nt, Human
ucuugcugucgcccaggcugg

SEQ ID NO: 850409 - RNA, 22 nt, Human
ucuugcugucgcccaggcugga

SEQ ID NO: 850410 - RNA, 23 nt, Human
ucuugcugucgcccaggcuggag

SEQ ID NO: 850411 - RNA, 24 nt, Human
ucuugcugucgcccaggcuggagu

SEQ ID NO: 850412 - RNA, 18 nt, Human
ucuuuuuuuuuuuuuuuu

SEQ ID NO: 850413 - RNA, 26 nt, Human
ugaagugagguuacucagaacccacc

SEQ ID NO: 850414 - RNA, 20 nt, Human
ugaccucaggugaucugccc

SEQ ID NO: 850415 - RNA, 21 nt, Human
ugaccucaggugaucugccca

SEQ ID NO: 850416 - RNA, 23 nt, Human
ugaccucaggugaucugcccagc

SEQ ID NO: 850417 - RNA, 24 nt, Human
ugaccucaggugaucugcccagcu

SEQ ID NO: 850418 - RNA, 25 nt, Human
ugaccucaggugaucugcccagcuc

SEQ ID NO: 850419 - RNA, 19 nt, Human
ugagugcaaccugcucaca

SEQ ID NO: 850420 - RNA, 20 nt, Human
ugagugcaaccugcucacaa

SEQ ID NO: 850421 - RNA, 19 nt, Human
ugaguuuuagcacuucuac

SEQ ID NO: 850422 - RNA, 24 nt, Human
ugcagugcgcuguaccggugcggg

SEQ ID NO: 850423 - RNA, 22 nt, Human
ugcaguggcgcgaucucggcuc

SEQ ID NO: 850424 - RNA, 19 nt, Human
ugcccagcucagccuccca

SEQ ID NO: 850425 - RNA, 19 nt, Human
ugccccggggccugcaggc

SEQ ID NO: 850426 - RNA, 24 nt, Human
ugccucagccucccgagaagcugg

SEQ ID NO: 850427 - RNA, 24 nt, Human
ugccucagccucccgaguagcuga

SEQ ID NO: 850428 - RNA, 21 nt, Human
ugccucggccucccaaagugc

SEQ ID NO: 850429 - RNA, 24 nt, Human
ugccucggccucccaaagugcugg

SEQ ID NO: 850430 - RNA, 20 nt, Human
ugccugugucuccucccuuu

SEQ ID NO: 850431 - RNA, 20 nt, Human
ugcgggaguccaggaaggcu

SEQ ID NO: 850432 - RNA, 24 nt, Human
uggagucucacucugucgcccagg

SEQ ID NO: 850433 - RNA, 23 nt, Human
uggagugcaguggcgcgaucucg

SEQ ID NO: 850434 - RNA, 24 nt, Human
uggagugcaguggcgcgaucucgg

SEQ ID NO: 850435 - RNA, 23 nt, Human
uggagugcaguggugcgauuucg

SEQ ID NO: 850436 - RNA, 24 nt, Human
uggagugcaguggugcgauuucgg

SEQ ID NO: 850437 - RNA, 24 nt, Human
uggcuaggcuguucuugaacuccu

SEQ ID NO: 850438 - RNA, 21 nt, Human
ugggaauacaggcgcccgcca

SEQ ID NO: 850439 - RNA, 22 nt, Human
ugggaauacaggcgcccgccac

SEQ ID NO: 850440 - RNA, 18 nt, Human
ugggauuacaggcgugag

SEQ ID NO: 850441 - RNA, 21 nt, Human
ugggauuacaggcgugagcca

SEQ ID NO: 850442 - RNA, 22 nt, Human
ugggauuacaggcgugagccac

SEQ ID NO: 850443 - RNA, 23 nt, Human
ugggauuacaggcgugagccacc

SEQ ID NO: 850444 - RNA, 23 nt, Human
ugggauuacaggcgugagccacc

SEQ ID NO: 850445 - RNA, 24 nt, Human
ugggauuacaggcgugagccaccg

SEQ ID NO: 850446 - RNA, 21 nt, Human
uggucucgaucuccugaccuc

SEQ ID NO: 850447 - RNA, 21 nt, Human
uguauuuuuaguagagacggg

SEQ ID NO: 850448 - RNA, 21 nt, Human
uguauuuuuagucgagacggg

SEQ ID NO: 850449 - RNA, 24 nt, Human
uguucuugaacuccugaccucagg

SEQ ID NO: 850450 - RNA, 18 nt, Human
uuaguagagacgggguuu

SEQ ID NO: 850451 - RNA, 20 nt, Human
uuaguagagacgggguuuca

SEQ ID NO: 850452 - RNA, 20 nt, Human
uuaguagagacgggguuuca

SEQ ID NO: 850453 - RNA, 24 nt, Human
uuaguagagacgggguuucagugu

SEQ ID NO: 850454 - RNA, 25 nt, Human
uuagucgagacggggguuucaccau

SEQ ID NO: 850455 - RNA, 21 nt, Human
uucaagugauuccccugccuc

SEQ ID NO: 850456 - RNA, 23 nt, Human
uucaagugauuccccugccucag

SEQ ID NO: 850457 - RNA, 24 nt, Human
uucaagugauuccccugccucagc

SEQ ID NO: 850458 - RNA, 20 nt, Human
uucagcaccaggaggcugug

SEQ ID NO: 850459 - RNA, 19 nt, Human
uuccccugccucagccucc

SEQ ID NO: 850460 - RNA, 23 nt, Human
uucuuccuucuuucugcugccuu

SEQ ID NO: 850461 - RNA, 18 nt, Human
uugggggauggaggcugc

SEQ ID NO: 850462 - RNA, 24 nt, Human
uuguauuuuuagucgagacggggg

SEQ ID NO: 850463 - RNA, 18 nt, Human
uuuaagacccuccugcua

SEQ ID NO: 850464 - RNA, 21 nt, Human
uuucaccauguuggcuaggcu

SEQ ID NO: 850465 - RNA, 21 nt, Human
uuuuguauuuuuagucgagac

SEQ ID NO: 850466 - RNA, 22 nt, Human
uuuuuaguagagacgggguuuc

SEQ ID NO: 850467 - RNA, 25 nt, Human
uuuuuagucgagacggggguuucac

SEQ ID NO: 850468 - RNA, 21 nt, Human
uuuuuguauuuuuaguagaga

SEQ ID NO: 850469 - RNA, 20 nt, Human
uuuuuguauuuuuagucgag

SEQ ID NO: 850470 - RNA, 27 nt, Human
uuuuuuuuuuuuagagauggagucuca

SEQ ID NO: 850471 - RNA, 24 nt, Human
uuuuuuuuuuuugagacggagucu

SEQ ID NO: 850472 - RNA, 22 nt, Human
uuuuuuuuuuuuuugagacgga

SEQ ID NO: 850473 - RNA, 18 nt, Human
uuuuuuuuuuuuuuuuug

SEQ ID NO: 850474 - RNA, 25 nt, Human
uuuuuuuuuuuuuuuuuuaauuuuu

SEQ ID NO: 850475 - RNA, 20 nt, Human
aaacuagcaccuccacaguc

SEQ ID NO: 850476 - RNA, 21 nt, Human
aagcaguggcaaagacuacuu

SEQ ID NO: 850477 - RNA, 21 nt, Human
acagucaaaguguugucaucc

SEQ ID NO: 850478 - RNA, 20 nt, Human
cagggcacuucaguaaucaa

SEQ ID NO: 850479 - RNA, 22 nt, Human
cccauggcacguccggacagcc

SEQ ID NO: 850480 - RNA, 23 nt, Human
cccauggcacguccggacagccg

SEQ ID NO: 850481 - RNA, 25 nt, Human
cccauggcacguccggacagccgug

SEQ ID NO: 850482 - RNA, 23 nt, Human
ccggagcagcccugucgugggag

SEQ ID NO: 850483 - RNA, 19 nt, Human
ccugcgcucaggcccgggg

SEQ ID NO: 850484 - RNA, 19 nt, Human
gacagccguggggucccgg

SEQ ID NO: 850485 - RNA, 20 nt, Human
gagcagcccugucgugggag

SEQ ID NO: 850486 - RNA, 25 nt, Human
ggcccggggcgggucuccgaagcuc

SEQ ID NO: 850487 - RNA, 18 nt, Human
guccggacagccgugggg

SEQ ID NO: 850488 - RNA, 22 nt, Human
gugauguugaccagugcuuucc

SEQ ID NO: 850489 - RNA, 22 nt, Human
guggaggaagcaguggcaaaga

SEQ ID NO: 850490 - RNA, 20 nt, Human
gugggaggggggcuugcugg

SEQ ID NO: 850491 - RNA, 22 nt, Human
uaugaagagcuguuuguggagg

SEQ ID NO: 850492 - RNA, 23 nt, Human
ucacguguaguguuuaccucccu

SEQ ID NO: 850493 - RNA, 20 nt, Human
uccggacagccguggggucc

SEQ ID NO: 850494 - RNA, 18 nt, Human
ugggaggggggcuugcug

SEQ ID NO: 850495 - RNA, 22 nt, Human
uguggaggaagcaguggcaaag

SEQ ID NO: 850496 - RNA, 21 nt, Human
uguuuguggaggaagcagugg

SEQ ID NO: 850497 - RNA, 19 nt, Human
uucccuuucaccacucuuc

SEQ ID NO: 850498 - RNA, 21 nt, Human
uugcccggcagcugcgcgccc

SEQ ID NO: 850499 - RNA, 20 nt, Human
uuuuuuuuuuuuuugcuuuu

SEQ ID NO: 850500 - RNA, 24 nt, Human
uuuuuuuuuuuuuuuuuugcuuuu

SEQ ID NO: 850501 - RNA, 20 nt, Human
uuuuuuuuuuuuuuuuuugg

SEQ ID NO: 850502 - RNA, 21 nt, Human
aaccuagugagaucccaucuc

SEQ ID NO: 850503 - RNA, 21 nt, Human
aagaguccauaguccuuccca

SEQ ID NO: 850504 - RNA, 21 nt, Human
aagguccaagagaacuuccaa

SEQ ID NO: 850505 - RNA, 18 nt, Human
aauccuuggacaccucca

SEQ ID NO: 850506 - RNA, 22 nt, Human
acacaacaagaguccauagucc

SEQ ID NO: 850507 - RNA, 21 nt, Human
agaaaaccucucacagcucca

SEQ ID NO: 850508 - RNA, 22 nt, Human
agaaggcaagcuuucccuccuc

SEQ ID NO: 850509 - RNA, 24 nt, Human
agcaccuugggaggcugagguggg

SEQ ID NO: 850510 - RNA, 19 nt, Human
agccagaaggcaggguaca

SEQ ID NO: 850511 - RNA, 21 nt, Human
agccugggcaaccuagugaga

SEQ ID NO: 850512 - RNA, 23 nt, Human
aggaaaccacuguguuguaaucc

SEQ ID NO: 850513 - RNA, 25 nt, Human
aggaauucgacaccagccugggcaa

SEQ ID NO: 850514 - RNA, 24 nt, Human
aggacugcuugagaccaggaauuc

SEQ ID NO: 850515 - RNA, 18 nt, Human
aggagaggaggcagagau

SEQ ID NO: 850516 - RNA, 19 nt, Human
aggcaggggccuauucuuu

SEQ ID NO: 850517 - RNA, 24 nt, Human
aggcaggguacaaaggagaggagg

SEQ ID NO: 850518 - RNA, 19 nt, Human
aggcggccggggcgcggac

SEQ ID NO: 850519 - RNA, 24 nt, Human
aggcugaggugggaggacugcuug

SEQ ID NO: 850520 - RNA, 18 nt, Human
aggguacaaaggagagga

SEQ ID NO: 850521 - RNA, 24 nt, Human
aggugugguggcucacaccuguaa

SEQ ID NO: 850522 - RNA, 28 nt, Human
caacugcccaguggcugcaauuccuagu

SEQ ID NO: 850523 - RNA, 24 nt, Human
cacaccuguaaucccagcaccuug

SEQ ID NO: 850524 - RNA, 23 nt, Human
caccccaacugcccaguggcugc

SEQ ID NO: 850525 - RNA, 23 nt, Human
caccuguaaucccagcaccuugg

SEQ ID NO: 850526 - RNA, 24 nt, Human
caccuguaaucccagcaccuuggg

SEQ ID NO: 850527 - RNA, 23 nt, Human
cagaugcccaccaccccaggucu

SEQ ID NO: 850528 - RNA, 23 nt, Human
cagcaccuugggaggcugaggug

SEQ ID NO: 850529 - RNA, 24 nt, Human
cagcaccuugggaggcugaggugg

SEQ ID NO: 850530 - RNA, 21 nt, Human
caggaccuggucgcggcuccc

SEQ ID NO: 850531 - RNA, 21 nt, Human
caggucugucugagccaagga

SEQ ID NO: 850532 - RNA, 19 nt, Human
cauggcccaaggcccacag

SEQ ID NO: 850533 - RNA, 21 nt, Human
cauggcuaacuuagucuccuc

SEQ ID NO: 850534 - RNA, 18 nt, Human
ccacagguaaacaaaaac

SEQ ID NO: 850535 - RNA, 21 nt, Human
ccagaguagcucacccaugcc

SEQ ID NO: 850536 - RNA, 21 nt, Human
ccaggguucaaacaucccaag

SEQ ID NO: 850537 - RNA, 25 nt, Human
cccacagguaaacaaaaacacucuu

SEQ ID NO: 850538 - RNA, 27 nt, Human
cccaucucuaucguaauuuuucuaaaa

SEQ ID NO: 850539 - RNA, 19 nt, Human
ccuaguguccacuucccag

SEQ ID NO: 850540 - RNA, 20 nt, Human
ccuaguguccacuucccagu

SEQ ID NO: 850541 - RNA, 19 nt, Human
ccuguaaucccagcaccuu

SEQ ID NO: 850542 - RNA, 25 nt, Human
ccuuccauuccacacaacaagaguc

SEQ ID NO: 850543 - RNA, 24 nt, Human
cgcggcucaucucccaggaagcca

SEQ ID NO: 850544 - RNA, 18 nt, Human
cgggguugagccgggcga

SEQ ID NO: 850545 - RNA, 24 nt, Human
cuaauggcuuagagguuaucuccc

SEQ ID NO: 850546 - RNA, 23 nt, Human
cucacaccuguaaucccagcacc

SEQ ID NO: 850547 - RNA, 24 nt, Human
cucacaccuguaaucccagcaccu

SEQ ID NO: 850548 - RNA, 22 nt, Human
cuccaggcugcaggaaaggcuc

SEQ ID NO: 850549 - RNA, 18 nt, Human
cuuggccagguguggugg

SEQ ID NO: 850550 - RNA, 24 nt, Human
cuuggccaggugugguggcucaca

SEQ ID NO: 850551 - RNA, 24 nt, Human
gaugacagggagagagaccaggaa

SEQ ID NO: 850552 - RNA, 19 nt, Human
gccagaugcccaccacccc

SEQ ID NO: 850553 - RNA, 20 nt, Human
ggccggggcgcggacgucgg

SEQ ID NO: 850554 - RNA, 24 nt, Human
gguggcucacaccuguaaucccag

SEQ ID NO: 850555 - RNA, 18 nt, Human
gugugguggcucacaccu

SEQ ID NO: 850556 - RNA, 22 nt, Human
uaagguaagguccaagagaacu

SEQ ID NO: 850557 - RNA, 22 nt, Human
uacacucauacagaagcuucuc

SEQ ID NO: 850558 - RNA, 19 nt, Human
ucagguaauuuccaggaug

SEQ ID NO: 850559 - RNA, 21 nt, Human
uccacacaacaagaguccaua

SEQ ID NO: 850560 - RNA, 19 nt, Human
uccagggcuuuuacuaggg

SEQ ID NO: 850561 - RNA, 24 nt, Human
ucccaggaagccaccccaacugcc

SEQ ID NO: 850562 - RNA, 18 nt, Human
ucucccagcaaugaugug

SEQ ID NO: 850563 - RNA, 21 nt, Human
ucucccagcaaugaugugugg

SEQ ID NO: 850564 - RNA, 19 nt, Human
ucucccaggaagccacccc

SEQ ID NO: 850565 - RNA, 23 nt, Human
ucucccaggagccaggcaggggc

SEQ ID NO: 850566 - RNA, 22 nt, Human
ucuucaggauaaugcuuaauuc

SEQ ID NO: 850567 - RNA, 20 nt, Human
ugagccaaggacaguuuccu

SEQ ID NO: 850568 - RNA, 24 nt, Human
ugaggugggaggacugcuugagac

SEQ ID NO: 850569 - RNA, 26 nt, Human
ugaggugggaggacugcuugagacca

SEQ ID NO: 850570 - RNA, 20 nt, Human
ugaugacagggagagagacc

SEQ ID NO: 850571 - RNA, 22 nt, Human
ugcuuaauucucccagcaauga

SEQ ID NO: 850572 - RNA, 23 nt, Human
uggaauguccaggguucaaacau

SEQ ID NO: 850573 - RNA, 24 nt, Human
uggccaggugugguggcucacacc

SEQ ID NO: 850574 - RNA, 21 nt, Human
uggcucacaccuguaauccca

SEQ ID NO: 850575 - RNA, 22 nt, Human
uggcucacaccuguaaucccag

SEQ ID NO: 850576 - RNA, 24 nt, Human
uggcucacaccuguaaucccagca

SEQ ID NO: 850577 - RNA, 20 nt, Human
ugggaggacugcuugagacc

SEQ ID NO: 850578 - RNA, 19 nt, Human
ugggaggcugaggugggag

SEQ ID NO: 850579 - RNA, 24 nt, Human
ugguggcucacaccuguaauccca

SEQ ID NO: 850580 - RNA, 24 nt, Human
uuacaguuuauuacagugaaagga

SEQ ID NO: 850581 - RNA, 21 nt, Human
uucagccagaugcccaccacc

SEQ ID NO: 850582 - RNA, 19 nt, Human
uucuuuauuuggaaugucc

SEQ ID NO: 850583 - RNA, 19 nt, Human
uuuuuuuuuuuuuuuugca

SEQ ID NO: 850584 - RNA, 18 nt, Human
uuuuuuuuuuuuuuuuug

SEQ ID NO: 850585 - RNA, 19 nt, Human
uuuuuuuuuuuuuuuuugc

SEQ ID NO: 850586 - RNA, 22 nt, Human
aaaaaaaaaaaaaaaaugaggg

SEQ ID NO: 850587 - RNA, 26 nt, Human
aaaaaaaaaaaaaaugagggauggag

SEQ ID NO: 850588 - RNA, 24 nt, Human
aaacaagacacccaaaucagcagc

SEQ ID NO: 850589 - RNA, 22 nt, Human
aaacaccgcgaacaggaaccaa

SEQ ID NO: 850590 - RNA, 24 nt, Human
aaagggaaggauugagggagacgc

SEQ ID NO: 850591 - RNA, 20 nt, Human
aaguugggaagaaaagggaa

SEQ ID NO: 850592 - RNA, 19 nt, Human
aaugagggauggagaggga

SEQ ID NO: 850593 - RNA, 23 nt, Human
acaccgcgaacaggaaccaagac

SEQ ID NO: 850594 - RNA, 24 nt, Human
agggggaaaguccaaaaaguagaa

SEQ ID NO: 850595 - RNA, 18 nt, Human
agguugggcgggcggccc

SEQ ID NO: 850596 - RNA, 20 nt, Human
agugccuccucgggcugggc

SEQ ID NO: 850597 - RNA, 24 nt, Human
auaaacaccgcgaacaggaaccaa

SEQ ID NO: 850598 - RNA, 18 nt, Human
cacugggaaugggagggg

SEQ ID NO: 850599 - RNA, 21 nt, Human
caguccauucccuauucccca

SEQ ID NO: 850600 - RNA, 22 nt, Human
cauaaacaccgcgaacaggaac

SEQ ID NO: 850601 - RNA, 24 nt, Human
cauaaacaccgcgaacaggaacca

SEQ ID NO: 850602 - RNA, 22 nt, Human
cccacccaccugauuuucuuuu

SEQ ID NO: 850603 - RNA, 24 nt, Human
cccagaccuccuaacccugagugc

SEQ ID NO: 850604 - RNA, 19 nt, Human
cccauaaacaccgcgaaca

SEQ ID NO: 850605 - RNA, 18 nt, Human
cccauaaacaccgcgaca

SEQ ID NO: 850606 - RNA, 21 nt, Human
cccccagaccccagagagccc

SEQ ID NO: 850607 - RNA, 24 nt, Human
cccccagaccccagagagccccac

SEQ ID NO: 850608 - RNA, 22 nt, Human
ccgaagaggcagcggaccaggu

SEQ ID NO: 850609 - RNA, 24 nt, Human
ccuccugacugcuguugcccguau

SEQ ID NO: 850610 - RNA, 20 nt, Human
cuccugacugcuguugcccg

SEQ ID NO: 850611 - RNA, 18 nt, Human
cuggaggacagagcuggg

SEQ ID NO: 850612 - RNA, 23 nt, Human
gaacaggaaccaagacuccaaga

SEQ ID NO: 850613 - RNA, 18 nt, Human
gcccagaccuccuaaccc

SEQ ID NO: 850614 - RNA, 23 nt, Human
gcccguauucccccagaccccag

SEQ ID NO: 850615 - RNA, 20 nt, Human
ggaaaguccaaaaaguagaa

SEQ ID NO: 850616 - RNA, 20 nt, Human
ggaaauaacccauaaacacc

SEQ ID NO: 850617 - RNA, 21 nt, Human
ggcgggcggcccuggccuggc

SEQ ID NO: 850618 - RNA, 22 nt, Human
gggcgggcggcccuggccuggc

SEQ ID NO: 850619 - RNA, 18 nt, Human
uaacccugagugccuccu

SEQ ID NO: 850620 - RNA, 21 nt, Human
uaccccuccugacugcuguug

SEQ ID NO: 850621 - RNA, 22 nt, Human
uagucacugagauuuugaacac

SEQ ID NO: 850622 - RNA, 18 nt, Human
uccaagagauucccaccc

SEQ ID NO: 850623 - RNA, 22 nt, Human
uccaagagauucccacccaccu

SEQ ID NO: 850624 - RNA, 24 nt, Human
ucccccagaccccagagagccccc

SEQ ID NO: 850625 - RNA, 21 nt, Human
ucccucuacccucagccucag

SEQ ID NO: 850626 - RNA, 18 nt, Human
uccugacugcuguugccc

SEQ ID NO: 850627 - RNA, 25 nt, Human
ucggcggcgaagugaugagggcccu

SEQ ID NO: 850628 - RNA, 22 nt, Human
ucuccaagagauucccacccac

SEQ ID NO: 850629 - RNA, 18 nt, Human
ugacaugucuacuugugu

SEQ ID NO: 850630 - RNA, 19 nt, Human
ugagggagacgcuaggcuc

SEQ ID NO: 850631 - RNA, 23 nt, Human
ugagggagacgcuaggcucugga

SEQ ID NO: 850632 - RNA, 25 nt, Human
ugagggauggagagggaaauaaccc

SEQ ID NO: 850633 - RNA, 19 nt, Human
ugagggcccuaguugcuuc

SEQ ID NO: 850634 - RNA, 19 nt, Human
ugagugccuccucgggcug

SEQ ID NO: 850635 - RNA, 21 nt, Human
ugagugccuccucgggcuggg

SEQ ID NO: 850636 - RNA, 19 nt, Human
uggccuggcucugccccgc

SEQ ID NO: 850637 - RNA, 21 nt, Human
ugggaagaaaagggaaggauu

SEQ ID NO: 850638 - RNA, 22 nt, Human
ugggcggcgccggggauucggc

SEQ ID NO: 850639 - RNA, 19 nt, Human
ugggcgggcggcccuggcc

SEQ ID NO: 850640 - RNA, 21 nt, Human
uugcccguauucccccagacc

SEQ ID NO: 850641 - RNA, 23 nt, Human
uuuuuuuuuuuuuuuuugacaug

SEQ ID NO: 850642 - RNA, 20 nt, Human
uuuuuuuuuuuuuuuuuugg

SEQ ID NO: 850643 - RNA, 21 nt, Human
aaagccauuccacauugucuu

SEQ ID NO: 850644 - RNA, 21 nt, Human
aaagcccuucccgcauuccuu

SEQ ID NO: 850645 - RNA, 18 nt, Human
aaaggacuucccacauuu

SEQ ID NO: 850646 - RNA, 18 nt, Human
acaaggugggaaaacuga

SEQ ID NO: 850647 - RNA, 24 nt, Human
accugcuuccacucugaccuccac

SEQ ID NO: 850648 - RNA, 21 nt, Human
agcuuccagcuugcacagcuc

SEQ ID NO: 850649 - RNA, 23 nt, Human
aggaagcuggcuagugaugggcc

SEQ ID NO: 850650 - RNA, 18 nt, Human
aggaauaucagaaaaguu

SEQ ID NO: 850651 - RNA, 21 nt, Human
aggcagaguucaccaugccuc

SEQ ID NO: 850652 - RNA, 25 nt, Human
aggccugcuuugagccuaaaggacu

SEQ ID NO: 850653 - RNA, 19 nt, Human
caaagggcuucucaccagu

SEQ ID NO: 850654 - RNA, 22 nt, Human
caaagggcuucucaccagugug

SEQ ID NO: 850655 - RNA, 21 nt, Human
caacagcuaaggccaggccaa

SEQ ID NO: 850656 - RNA, 20 nt, Human
caaggugggaaaacugacga

SEQ ID NO: 850657 - RNA, 21 nt, Human
cacagcucgcucuggccgucc

SEQ ID NO: 850658 - RNA, 24 nt, Human
cacagcucgcucuggccguccccu

SEQ ID NO: 850659 - RNA, 25 nt, Human
cagaaugagcccaaagguggcugcu

SEQ ID NO: 850660 - RNA, 19 nt, Human
cagaguucaccaugccucc

SEQ ID NO: 850661 - RNA, 19 nt, Human
caucggggcuguggcccag

SEQ ID NO: 850662 - RNA, 18 nt, Human
cauuacauaaggcagagu

SEQ ID NO: 850663 - RNA, 24 nt, Human
ccacauuuguuacauucaaagggc

SEQ ID NO: 850664 - RNA, 19 nt, Human
ccaccugucuguuaacucc

SEQ ID NO: 850665 - RNA, 19 nt, Human
ccagugaugacuggcgcac

SEQ ID NO: 850666 - RNA, 22 nt, Human
cgggacccucucacaccugcuu

SEQ ID NO: 850667 - RNA, 19 nt, Human
cuccauaagguuguugcuc

SEQ ID NO: 850668 - RNA, 19 nt, Human
cuggcgcucucugcuuccu

SEQ ID NO: 850669 - RNA, 22 nt, Human
cuggcgcucucugcuuccuggg

SEQ ID NO: 850670 - RNA, 18 nt, Human
cuguaaaucuuugcuacc

SEQ ID NO: 850671 - RNA, 24 nt, Human
cuuccacucugaccuccacaucua

SEQ ID NO: 850672 - RNA, 21 nt, Human
gaaaggccuuuccacauuccu

SEQ ID NO: 850673 - RNA, 22 nt, Human
gaagcagauguugaucaugagc

SEQ ID NO: 850674 - RNA, 21 nt, Human
gagucccuuccccuaccacaa

SEQ ID NO: 850675 - RNA, 20 nt, Human
gcagaguucaccaugccucc

SEQ ID NO: 850676 - RNA, 22 nt, Human
gcagauguugaucaugagcauu

SEQ ID NO: 850677 - RNA, 19 nt, Human
gcagcuggaggagcacgga

SEQ ID NO: 850678 - RNA, 19 nt, Human
gcgcucucugcuuccuggg

SEQ ID NO: 850679 - RNA, 20 nt, Human
gcuuccacucugaccuccac

SEQ ID NO: 850680 - RNA, 26 nt, Human
ggacccucucacaccugcuuccacuc

SEQ ID NO: 850681 - RNA, 21 nt, Human
gggugagggcgaaagguggug

SEQ ID NO: 850682 - RNA, 20 nt, Human
gguaaguugauaccuacaug

SEQ ID NO: 850683 - RNA, 20 nt, Human
ggugagggcgaaagguggug

SEQ ID NO: 850684 - RNA, 19 nt, Human
gugcagguaggcuggggcc

SEQ ID NO: 850685 - RNA, 19 nt, Human
guugacggcuaguccuaaa

SEQ ID NO: 850686 - RNA, 23 nt, Human
uaaggccaggccaaacuugccga

SEQ ID NO: 850687 - RNA, 18 nt, Human
uaccuacauguaaagccc

SEQ ID NO: 850688 - RNA, 26 nt, Human
uacuuccuucacuuuaagccaauuuu

SEQ ID NO: 850689 - RNA, 20 nt, Human
uaguccucuccaaugcuggu

SEQ ID NO: 850690 - RNA, 21 nt, Human
uaugacccacaaggugggaaa

SEQ ID NO: 850691 - RNA, 21 nt, Human
ucacuagggcagcuggaggag

SEQ ID NO: 850692 - RNA, 18 nt, Human
ucauuuauauaugauccc

SEQ ID NO: 850693 - RNA, 19 nt, Human
uccauacacacuggggccu

SEQ ID NO: 850694 - RNA, 21 nt, Human
uccauacacacuggggccuug

SEQ ID NO: 850695 - RNA, 22 nt, Human
uccauacacacuggggccuugc

SEQ ID NO: 850696 - RNA, 21 nt, Human
ucugaagugauuuuaccuuua

SEQ ID NO: 850697 - RNA, 19 nt, Human
ucugcagcuuccagcuugc

SEQ ID NO: 850698 - RNA, 19 nt, Human
ucuggcgcucucugcuucc

SEQ ID NO: 850699 - RNA, 23 nt, Human
ucuggcgcucucugcuuccuggg

SEQ ID NO: 850700 - RNA, 22 nt, Human
ucuguaaaucuuugcuaccagu

SEQ ID NO: 850701 - RNA, 18 nt, Human
ugaccuccacaucuaacu

SEQ ID NO: 850702 - RNA, 19 nt, Human
ugagaacagcagucaaaga

SEQ ID NO: 850703 - RNA, 19 nt, Human
ugagaacagcagucaaaga

SEQ ID NO: 850704 - RNA, 21 nt, Human
ugagagcugguaugcaauguc

SEQ ID NO: 850705 - RNA, 19 nt, Human
ugaugccuaauaaaaacug

SEQ ID NO: 850706 - RNA, 23 nt, Human
ugcagguaggcuggggccucacu

SEQ ID NO: 850707 - RNA, 21 nt, Human
ugccuuggagucacccucagc

SEQ ID NO: 850708 - RNA, 18 nt, Human
uggaagauguuuacaugc

SEQ ID NO: 850709 - RNA, 24 nt, Human
uggccagugaguuggcgaucagcu

SEQ ID NO: 850710 - RNA, 21 nt, Human
ugggaaaacugacgaaaggcc

SEQ ID NO: 850711 - RNA, 20 nt, Human
uggggccucacuagggcagc

SEQ ID NO: 850712 - RNA, 21 nt, Human
uggggugagggcgaaaggugg

SEQ ID NO: 850713 - RNA, 21 nt, Human
ugggugauuaguucuccagca

SEQ ID NO: 850714 - RNA, 19 nt, Human
uuauuauauacagaagcua

SEQ ID NO: 850715 - RNA, 18 nt, Human
uucacaccaauacaaauu

SEQ ID NO: 850716 - RNA, 19 nt, Human
uucagugggauaaauccau

SEQ ID NO: 850717 - RNA, 25 nt, Human
uugaaaaguucacaccaauacaaau

SEQ ID NO: 850718 - RNA, 21 nt, Human
uugaucaugagcauuaaauau

SEQ ID NO: 850719 - RNA, 20 nt, Human
uuggcagccauguuuucuuc

SEQ ID NO: 850720 - RNA, 21 nt, Human
uugguuuuuguacacauggga

SEQ ID NO: 850721 - RNA, 19 nt, Human
uuguugcuggaagauguuu

SEQ ID NO: 850722 - RNA, 20 nt, Human
aaaguuaagguggaagggaa

SEQ ID NO: 850723 - RNA, 24 nt, Human
aagcaggcugcagccgcucagggc

SEQ ID NO: 850724 - RNA, 19 nt, Human
aagcccaacuggggucacc

SEQ ID NO: 850725 - RNA, 20 nt, Human
aagggacacccaugguauca

SEQ ID NO: 850726 - RNA, 24 nt, Human
aagguuuauugaucauauacaaaa

SEQ ID NO: 850727 - RNA, 23 nt, Human
acacaaccuccccuggcuagacc

SEQ ID NO: 850728 - RNA, 19 nt, Human
acagccaacaggaaggcaa

SEQ ID NO: 850729 - RNA, 19 nt, Human
accacagccuaaaaaagua

SEQ ID NO: 850730 - RNA, 19 nt, Human
accaccacccucuccacca

SEQ ID NO: 850731 - RNA, 20 nt, Human
accagugccaccccgagcag

SEQ ID NO: 850732 - RNA, 22 nt, Human
acccaggacacaggccagaggc

SEQ ID NO: 850733 - RNA, 18 nt, Human
accccgcauccaaacccc

SEQ ID NO: 850734 - RNA, 19 nt, Human
accccgcauccaaacccca

SEQ ID NO: 850735 - RNA, 21 nt, Human
acccucuccaccacccucuca

SEQ ID NO: 850736 - RNA, 21 nt, Human
acuuggcggacaaguuugaga

SEQ ID NO: 850737 - RNA, 19 nt, Human
agcgccaggagagcaacag

SEQ ID NO: 850738 - RNA, 23 nt, Human
aggcaaaaauacaccaaaaagaa

SEQ ID NO: 850739 - RNA, 18 nt, Human
aggcagggcaggcaggga

SEQ ID NO: 850740 - RNA, 23 nt, Human
aggccagacagccaacaggaagg

SEQ ID NO: 850741 - RNA, 24 nt, Human
agggggugggaagaagggcagggc

SEQ ID NO: 850742 - RNA, 22 nt, Human
aggugagaagagaccaccaccc

SEQ ID NO: 850743 - RNA, 22 nt, Human
agucucucagacacgcccugcc

SEQ ID NO: 850744 - RNA, 24 nt, Human
caaaauaaagaaaaccuuauauau

SEQ ID NO: 850745 - RNA, 21 nt, Human
caaagcugcugcuccaggggc

SEQ ID NO: 850746 - RNA, 18 nt, Human
caacaccagugccacccc

SEQ ID NO: 850747 - RNA, 22 nt, Human
caacucugcuuggacccaccuc

SEQ ID NO: 850748 - RNA, 21 nt, Human
caagaacagggaggucucaca

SEQ ID NO: 850749 - RNA, 31 nt, Human
caauaaauacugcgcagggcagggguagggg

SEQ ID NO: 850750 - RNA, 21 nt, Human
cacacaaccuccccuggcuag

SEQ ID NO: 850751 - RNA, 21 nt, Human
cacacucuagcucagacucaa

SEQ ID NO: 850752 - RNA, 21 nt, Human
caccaagaacagggaggucuc

SEQ ID NO: 850753 - RNA, 20 nt, Human
caccacccucuccaccaccc

SEQ ID NO: 850754 - RNA, 22 nt, Human
caccagucagaaguguacacac

SEQ ID NO: 850755 - RNA, 23 nt, Human
cacccaggacacaggccagaggc

SEQ ID NO: 850756 - RNA, 24 nt, Human
caccccgcauccaaaccccagccc

SEQ ID NO: 850757 - RNA, 24 nt, Human
caccccgcauccaaaccccagccc

SEQ ID NO: 850758 - RNA, 20 nt, Human
cacccucuccaccacccucc

SEQ ID NO: 850759 - RNA, 20 nt, Human
cacucccguuugguuaaagg

SEQ ID NO: 850760 - RNA, 21 nt, Human
cagaaaaacugaggugagaag

SEQ ID NO: 850761 - RNA, 21 nt, Human
cagaucccggggucuucuccc

SEQ ID NO: 850762 - RNA, 19 nt, Human
cagcaacaccagugccacc

SEQ ID NO: 850763 - RNA, 24 nt, Human
cagcccuuguccuguugccaggag

SEQ ID NO: 850764 - RNA, 23 nt, Human
cagggcaggcagggacugaucaa

SEQ ID NO: 850765 - RNA, 19 nt, Human
cagguaugguacacaccca

SEQ ID NO: 850766 - RNA, 21 nt, Human
ccaaaccacagccuaaaaaag

SEQ ID NO: 850767 - RNA, 23 nt, Human
ccaaaccacagccuaaaaaagua

SEQ ID NO: 850768 - RNA, 18 nt, Human
ccaaaccccagccccucc

SEQ ID NO: 850769 - RNA, 23 nt, Human
ccaaaccccagccccuccucacu

SEQ ID NO: 850770 - RNA, 23 nt, Human
ccaaagcccaacuggggucacca

SEQ ID NO: 850771 - RNA, 25 nt, Human
ccacacacacaaccuccccuggcua

SEQ ID NO: 850772 - RNA, 21 nt, Human
ccagacagccaacaggaaggc

SEQ ID NO: 850773 - RNA, 25 nt, Human
ccagcaacaccagugccaccccgag

SEQ ID NO: 850774 - RNA, 19 nt, Human
ccaggcccagugcugcccc

SEQ ID NO: 850775 - RNA, 20 nt, Human
cccaaagcaggcugcagccg

SEQ ID NO: 850776 - RNA, 18 nt, Human
ccccgcauccaaacccca

SEQ ID NO: 850777 - RNA, 22 nt, Human
cccgcauccaaaccccagcccc

SEQ ID NO: 850778 - RNA, 19 nt, Human
cccugcccgcccuacacga

SEQ ID NO: 850779 - RNA, 18 nt, Human
cccuggcuagaccuaggc

SEQ ID NO: 850780 - RNA, 18 nt, Human
ccucaccccgcauccaaa

SEQ ID NO: 850781 - RNA, 25 nt, Human
cgcauccaaaccccagccccuccuc

SEQ ID NO: 850782 - RNA, 19 nt, Human
cggggacacacucuagcuc

SEQ ID NO: 850783 - RNA, 20 nt, Human
cgucccaaagcaggcugcag

SEQ ID NO: 850784 - RNA, 22 nt, Human
cuccaucccaccccagcagauc

SEQ ID NO: 850785 - RNA, 21 nt, Human
cugaucaccagucagaagugu

SEQ ID NO: 850786 - RNA, 22 nt, Human
cugcugcuccaggggcagggug

SEQ ID NO: 850787 - RNA, 24 nt, Human
cugggacacaagguugcuggaggg

SEQ ID NO: 850788 - RNA, 18 nt, Human
cuucagggacuagcagau

SEQ ID NO: 850789 - RNA, 25 nt, Human
gaagagaccaccacccucuccacca

SEQ ID NO: 850790 - RNA, 18 nt, Human
gaaggcaaaaauacacca

SEQ ID NO: 850791 - RNA, 23 nt, Human
gagcaacagggcuggacacgcgg

SEQ ID NO: 850792 - RNA, 19 nt, Human
gcagggguagggcaccaag

SEQ ID NO: 850793 - RNA, 21 nt, Human
gccaaagcccucgauucgcug

SEQ ID NO: 850794 - RNA, 23 nt, Human
gccaggcccagugcugccccucc

SEQ ID NO: 850795 - RNA, 22 nt, Human
gccccuccuggacaauaauuua

SEQ ID NO: 850796 - RNA, 26 nt, Human
gccucaccccgcauccaaaccccagc

SEQ ID NO: 850797 - RNA, 21 nt, Human
gcgcuuuggccaaguggccac

SEQ ID NO: 850798 - RNA, 20 nt, Human
ggacacaagguugcuggagg

SEQ ID NO: 850799 - RNA, 22 nt, Human
ggcaaaaauacaccaaaaagaa

SEQ ID NO: 850800 - RNA, 21 nt, Human
ggcagcagggacaacauggga

SEQ ID NO: 850801 - RNA, 21 nt, Human
ggcagggguagggcaccaagg

SEQ ID NO: 850802 - RNA, 19 nt, Human
ggccagaggcaggacaggc

SEQ ID NO: 850803 - RNA, 19 nt, Human
gggaagaagggcagggcug

SEQ ID NO: 850804 - RNA, 26 nt, Human
gggcagggcugggacacaagguugcu

SEQ ID NO: 850805 - RNA, 24 nt, Human
gggugggaagaagggcagggcugg

SEQ ID NO: 850806 - RNA, 19 nt, Human
ggucaccaagaacagggag

SEQ ID NO: 850807 - RNA, 20 nt, Human
ggugggaagaagggcagggc

SEQ ID NO: 850808 - RNA, 19 nt, Human
guacacacccaggacacag

SEQ ID NO: 850809 - RNA, 28 nt, Human
guguacacacauaucugaaacaugcagu

SEQ ID NO: 850810 - RNA, 25 nt, Human
gugucagaaaaacugaggugagaag

SEQ ID NO: 850811 - RNA, 19 nt, Human
uaaccuccaucccacccca

SEQ ID NO: 850812 - RNA, 20 nt, Human
uacuuggcggacaaguuuga

SEQ ID NO: 850813 - RNA, 19 nt, Human
uaucugaaacaugcaccaa

SEQ ID NO: 850814 - RNA, 18 nt, Human
uauucaguggcuucuggg

SEQ ID NO: 850815 - RNA, 18 nt, Human
ucagaaaaacugagguga

SEQ ID NO: 850816 - RNA, 25 nt, Human
ucaggccccugcccgcccuacacga

SEQ ID NO: 850817 - RNA, 18 nt, Human
uccaaaccccagccccuc

SEQ ID NO: 850818 - RNA, 18 nt, Human
ucccagagcggaaacggu

SEQ ID NO: 850819 - RNA, 23 nt, Human
ucccgaccugcuccaaggccaga

SEQ ID NO: 850820 - RNA, 19 nt, Human
ucgauucgcugugucagaa

SEQ ID NO: 850821 - RNA, 24 nt, Human
ucucucagacacgcccugccucug

SEQ ID NO: 850822 - RNA, 21 nt, Human
ugagccagcaacaccagugcc

SEQ ID NO: 850823 - RNA, 18 nt, Human
ugaggugagaagagacca

SEQ ID NO: 850824 - RNA, 24 nt, Human
ugaucauauacaaaauaaagaaaa

SEQ ID NO: 850825 - RNA, 22 nt, Human
ugccaggagaaggcuuucugug

SEQ ID NO: 850826 - RNA, 19 nt, Human
ugcccugcaagaggucagg

SEQ ID NO: 850827 - RNA, 27 nt, Human
ugcgcagggcagggguagggggaacgc

SEQ ID NO: 850828 - RNA, 21 nt, Human
ugcuggaggggccaaagccca

SEQ ID NO: 850829 - RNA, 21 nt, Human
uggacccaccucucagcgcca

SEQ ID NO: 850830 - RNA, 21 nt, Human
uggccaaguggccacuccaga

SEQ ID NO: 850831 - RNA, 21 nt, Human
ugggaagaagggcagggcugg

SEQ ID NO: 850832 - RNA, 23 nt, Human
ugggacuggcccagcagguaugg

SEQ ID NO: 850833 - RNA, 23 nt, Human
ugggggaaaaaucguuaaugugu

SEQ ID NO: 850834 - RNA, 18 nt, Human
uuaaaggcuucagggacu

SEQ ID NO: 850835 - RNA, 25 nt, Human
uucaccaaaccacagccuaaaaaag

SEQ ID NO: 850836 - RNA, 23 nt, Human
uucucccacacacacaaccuccc

SEQ ID NO: 850837 - RNA, 23 nt, Human
uuggacccaccucucagcgccag

SEQ ID NO: 850838 - RNA, 24 nt, Human
uuguuuuuucucuuuaaaagguuu

SEQ ID NO: 850839 - RNA, 22 nt, Human
uuuaauaaccuccaucccaccc

SEQ ID NO: 850840 - RNA, 18 nt, Human
uuuuuuuuuuuuuuuuug

SEQ ID NO: 850841 - RNA, 25 nt, Human
uuuuuuuuuuuuuuuuuuuguuuuu

SEQ ID NO: 850842 - RNA, 19 nt, Human
caggugaaaacgcaaacua

SEQ ID NO: 850843 - RNA, 18 nt, Human
ccgccgggcgaccaggug

SEQ ID NO: 850844 - RNA, 18 nt, Human
uuuuuuuuuuuuuuuuug

SEQ ID NO: 850845 - RNA, 22 nt, Human
uuuuuuuuuuuuuuuuuuuggg

SEQ ID NO: 850846 - RNA, 22 nt, Human
aacaucaaccaccgcaccaucc

SEQ ID NO: 850847 - RNA, 23 nt, Human
acacacacacacacacacacaca

SEQ ID NO: 850848 - RNA, 23 nt, Human
acacacacacacacacacacaca

SEQ ID NO: 850849 - RNA, 23 nt, Human
acacacacacacacacacacaca

SEQ ID NO: 850850 - RNA, 23 nt, Human
acacacacacacacacacacaca

SEQ ID NO: 850851 - RNA, 23 nt, Human
acaguaaauaggccagucaugga

SEQ ID NO: 850852 - RNA, 20 nt, Human
acuccgagggcgagggcgga

SEQ ID NO: 850853 - RNA, 22 nt, Human
agggccuuggcuguggcucugc

SEQ ID NO: 850854 - RNA, 22 nt, Human
auaaaguuuuucgcaaggguuu

SEQ ID NO: 850855 - RNA, 18 nt, Human
cacacacacacacacaca

SEQ ID NO: 850856 - RNA, 20 nt, Human
cacacacacacacacacaca

SEQ ID NO: 850857 - RNA, 20 nt, Human
cacacacacacacacacaca

SEQ ID NO: 850858 - RNA, 20 nt, Human
cacacacacacacacacaca

SEQ ID NO: 850859 - RNA, 20 nt, Human
cacacacacacacacacaca

SEQ ID NO: 850860 - RNA, 20 nt, Human
cacacacacacacacacaca

SEQ ID NO: 850861 - RNA, 20 nt, Human
cacacacacacacacacaca

SEQ ID NO: 850862 - RNA, 22 nt, Human
cacacacacacacacacacaca

SEQ ID NO: 850863 - RNA, 22 nt, Human
cacacacacacacacacacaca

SEQ ID NO: 850864 - RNA, 26 nt, Human
cacacacacacacacacacacacaca

SEQ ID NO: 850865 - RNA, 26 nt, Human
cacacacacacacacacacacacaca

SEQ ID NO: 850866 - RNA, 27 nt, Human
cacacacacacacacacacacacacua

SEQ ID NO: 850867 - RNA, 26 nt, Human
caccauccaggcacuccccagccacc

SEQ ID NO: 850868 - RNA, 21 nt, Human
caccgcgguccuaggccuggg

SEQ ID NO: 850869 - RNA, 18 nt, Human
caccuuuuucccugcaag

SEQ ID NO: 850870 - RNA, 22 nt, Human
cagauuucccugucugcucccc

SEQ ID NO: 850871 - RNA, 26 nt, Human
caggaaggagcugugccucuccccug

SEQ ID NO: 850872 - RNA, 19 nt, Human
caggguuccacccaccgcg

SEQ ID NO: 850873 - RNA, 21 nt, Human
ccccaaaggugaagggcagcu

SEQ ID NO: 850874 - RNA, 23 nt, Human
cccccuacuccgagggcgagggc

SEQ ID NO: 850875 - RNA, 23 nt, Human
cccugucugcuccccucuuccug

SEQ ID NO: 850876 - RNA, 26 nt, Human
ccuccugccucacgggaagccgggga

SEQ ID NO: 850877 - RNA, 26 nt, Human
ccugguccuggccccaugcccucagc

SEQ ID NO: 850878 - RNA, 25 nt, Human
ccugucugcuccccucuuccugugg

SEQ ID NO: 850879 - RNA, 21 nt, Human
ccuguuggggcaguagcaggg

SEQ ID NO: 850880 - RNA, 22 nt, Human
ccuuaugacugucucgggcccc

SEQ ID NO: 850881 - RNA, 19 nt, Human
cgggccccaaaggugaagg

SEQ ID NO: 850882 - RNA, 19 nt, Human
cucagcauccuuaagaaac

SEQ ID NO: 850883 - RNA, 21 nt, Human
cucaggaaggagcugugccuc

SEQ ID NO: 850884 - RNA, 20 nt, Human
cuccggcaaggggagaacuc

SEQ ID NO: 850885 - RNA, 18 nt, Human
cuggccccaugcccucag

SEQ ID NO: 850886 - RNA, 23 nt, Human
cugucugcuccccucuuccugug

SEQ ID NO: 850887 - RNA, 22 nt, Human
gagcagagaccagcauuaggga

SEQ ID NO: 850888 - RNA, 24 nt, Human
gauuggagucccuguuggggcagu

SEQ ID NO: 850889 - RNA, 19 nt, Human
gcacaaagacacacacacc

SEQ ID NO: 850890 - RNA, 19 nt, Human
gccucaguggguacacugu

SEQ ID NO: 850891 - RNA, 21 nt, Human
gcgguccuaggccugggggcg

SEQ ID NO: 850892 - RNA, 20 nt, Human
gcucugcacuggccagcugu

SEQ ID NO: 850893 - RNA, 19 nt, Human
gcuguggcucugccuccug

SEQ ID NO: 850894 - RNA, 23 nt, Human
gcuguggcucugccuccugccuc

SEQ ID NO: 850895 - RNA, 24 nt, Human
ggagucccuguuggggcaguagca

SEQ ID NO: 850896 - RNA, 18 nt, Human
ggcacaaagacacacaca

SEQ ID NO: 850897 - RNA, 21 nt, Human
ggcacaaagacacacacaccc

SEQ ID NO: 850898 - RNA, 19 nt, Human
ggcagcuccggcaagggga

SEQ ID NO: 850899 - RNA, 24 nt, Human
ggcaguggugagaggcugcucagg

SEQ ID NO: 850900 - RNA, 19 nt, Human
gggccucaguucugggauc

SEQ ID NO: 850901 - RNA, 22 nt, Human
gggggcgaaguccaggccuggc

SEQ ID NO: 850902 - RNA, 23 nt, Human
ggugagaggcugcucaggaagga

SEQ ID NO: 850903 - RNA, 24 nt, Human
guccguucucugauagcuuugccc

SEQ ID NO: 850904 - RNA, 19 nt, Human
gugaagggcagcuccggca

SEQ ID NO: 850905 - RNA, 28 nt, Human
guggcaguggugagaggcugcucaggaa

SEQ ID NO: 850906 - RNA, 19 nt, Human
guggcucugccuccugccu

SEQ ID NO: 850907 - RNA, 21 nt, Human
uaaaagagcagcagcucugca

SEQ ID NO: 850908 - RNA, 20 nt, Human
uaacaucaaccaccgcacca

SEQ ID NO: 850909 - RNA, 22 nt, Human
uaacaucaaccaccgcaccauc

SEQ ID NO: 850910 - RNA, 22 nt, Human
uaacaucaaccaccgcaccauc

SEQ ID NO: 850911 - RNA, 20 nt, Human
uaagaaacacggcuguccac

SEQ ID NO: 850912 - RNA, 25 nt, Human
uacacacacacacacacacacacac

SEQ ID NO: 850913 - RNA, 25 nt, Human
uacacacacacacacacacacacag

SEQ ID NO: 850914 - RNA, 18 nt, Human
uagacaacuggcacagaa

SEQ ID NO: 850915 - RNA, 19 nt, Human
ucauccugcccugauccag

SEQ ID NO: 850916 - RNA, 24 nt, Human
uccaccuuuuucccugcaagaaaa

SEQ ID NO: 850917 - RNA, 27 nt, Human
uccaccuuuuucccugcaagaaaacua

SEQ ID NO: 850918 - RNA, 25 nt, Human
uccaucccuuaugacugucucgggc

SEQ ID NO: 850919 - RNA, 18 nt, Human
uccccugguccuggcccc

SEQ ID NO: 850920 - RNA, 18 nt, Human
uccugaauccagauccuc

SEQ ID NO: 850921 - RNA, 24 nt, Human
ugaagggcagcuccggcaagggga

SEQ ID NO: 850922 - RNA, 19 nt, Human
ugggaucuaccacaagguc

SEQ ID NO: 850923 - RNA, 22 nt, Human
ugggcacaaagacacacacacc

SEQ ID NO: 850924 - RNA, 21 nt, Human
ugguaggcagauuucccuguc

SEQ ID NO: 850925 - RNA, 20 nt, Human
uguccaccuuuuucccugca

SEQ ID NO: 850926 - RNA, 19 nt, Human
uguggcaguggugagaggc

SEQ ID NO: 850927 - RNA, 19 nt, Human
uguggcaguggugagaggc

SEQ ID NO: 850928 - RNA, 24 nt, Human
uugguaggcagauuucccugucug

SEQ ID NO: 850929 - RNA, 31 nt, Human
uuuauuguuacacacacacacacacacacag

SEQ ID NO: 850930 - RNA, 18 nt, Human
uuuuuuuuuuuuuuuuug

SEQ ID NO: 850931 - RNA, 23 nt, Human
uuuuuuuuuuuuuuuuugacugg

SEQ ID NO: 850932 - RNA, 18 nt, Human
aagaagaaucuccacaca

SEQ ID NO: 850933 - RNA, 21 nt, Human
agacaccaaggaaggcuuccc

SEQ ID NO: 850934 - RNA, 21 nt, Human
agacagaaaacaucuugagaa

SEQ ID NO: 850935 - RNA, 22 nt, Human
agagugaaagguuucaacacau

SEQ ID NO: 850936 - RNA, 20 nt, Human
agguuuccuacguucaguuu

SEQ ID NO: 850937 - RNA, 23 nt, Human
auauaaccucuuuaaaacaugua

SEQ ID NO: 850938 - RNA, 21 nt, Human
caaaagcauucugauauggca

SEQ ID NO: 850939 - RNA, 18 nt, Human
caagcucaguaaggcccg

SEQ ID NO: 850940 - RNA, 18 nt, Human
caccaaggaaggcuuccc

SEQ ID NO: 850941 - RNA, 20 nt, Human
ccaaaguggaagcuaaaaac

SEQ ID NO: 850942 - RNA, 25 nt, Human
ccuuaugacuguguacauugccacu

SEQ ID NO: 850943 - RNA, 21 nt, Human
gaaagguuucaacacauuccu

SEQ ID NO: 850944 - RNA, 22 nt, Human
gaucugagacaccaaggaaggc

SEQ ID NO: 850945 - RNA, 22 nt, Human
gcuaaaaacaaagaagaaucuc

SEQ ID NO: 850946 - RNA, 22 nt, Human
ggccuauggaaggagccaagau

SEQ ID NO: 850947 - RNA, 24 nt, Human
uaaaaacaaagaagaaucuccaca

SEQ ID NO: 850948 - RNA, 22 nt, Human
uaaggccuauggaaggagccaa

SEQ ID NO: 850949 - RNA, 19 nt, Human
uauauaaccucuuuaaaac

SEQ ID NO: 850950 - RNA, 25 nt, Human
uauggaaggagccaagauuuuccca

SEQ ID NO: 850951 - RNA, 22 nt, Human
ucuucuauuggaauuguuaaga

SEQ ID NO: 850952 - RNA, 21 nt, Human
ugagaaagaugaucgggacac

SEQ ID NO: 850953 - RNA, 22 nt, Human
ugagacaccaaggaagggggag

SEQ ID NO: 850954 - RNA, 21 nt, Human
ugaggaaguaguggcuuuacc

SEQ ID NO: 850955 - RNA, 23 nt, Human
uggaaggagccaagauuuuccca

SEQ ID NO: 850956 - RNA, 18 nt, Human
uguucaguaagugugagg

SEQ ID NO: 850957 - RNA, 24 nt, Human
uucaacacauuccuuacagccaga

SEQ ID NO: 850958 - RNA, 19 nt, Human
uuccuacguucaguuuguu

SEQ ID NO: 850959 - RNA, 23 nt, Human
uucuuuccaaguaucagccccaa

SEQ ID NO: 850960 - RNA, 21 nt, Human
uuugaccuuccauacagucag

SEQ ID NO: 850961 - RNA, 21 nt, Human
aacagguccagcgacuguggc

SEQ ID NO: 850962 - RNA, 19 nt, Human
acagcagcuaggacuggga

SEQ ID NO: 850963 - RNA, 18 nt, Human
acccccucccugucccca

SEQ ID NO: 850964 - RNA, 20 nt, Human
agaagccaggcccugaggcu

SEQ ID NO: 850965 - RNA, 19 nt, Human
agccuggugggcaaggggg

SEQ ID NO: 850966 - RNA, 20 nt, Human
aggagggaggacucucagca

SEQ ID NO: 850967 - RNA, 18 nt, Human
aggcugggguuuggagaa

SEQ ID NO: 850968 - RNA, 18 nt, Human
agggaggcaggguucgug

SEQ ID NO: 850969 - RNA, 23 nt, Human
agggagggguacagacuggaagu

SEQ ID NO: 850970 - RNA, 20 nt, Human
caccauccucuccaggagca

SEQ ID NO: 850971 - RNA, 21 nt, Human
caccccgacugugaugggggc

SEQ ID NO: 850972 - RNA, 20 nt, Human
cacuggccuuucccaggucc

SEQ ID NO: 850973 - RNA, 23 nt, Human
cacuggccuuucccagguccucc

SEQ ID NO: 850974 - RNA, 18 nt, Human
cagcaacaacuccccgcc

SEQ ID NO: 850975 - RNA, 19 nt, Human
cagcagcuaggacugggag

SEQ ID NO: 850976 - RNA, 19 nt, Human
caggagcaggccacuggcc

SEQ ID NO: 850977 - RNA, 20 nt, Human
caggcccugaggcuggagag

SEQ ID NO: 850978 - RNA, 19 nt, Human
cagggcaggagacagcagc

SEQ ID NO: 850979 - RNA, 20 nt, Human
ccacggcagacacccaugcu

SEQ ID NO: 850980 - RNA, 20 nt, Human
ccauguugaugcagagcaac

SEQ ID NO: 850981 - RNA, 19 nt, Human
cccacuggaccaaggucgg

SEQ ID NO: 850982 - RNA, 25 nt, Human
cccagagagccugggacagcggacc

SEQ ID NO: 850983 - RNA, 21 nt, Human
cccagugcucccagccccacg

SEQ ID NO: 850984 - RNA, 18 nt, Human
cccccauucuggguuccu

SEQ ID NO: 850985 - RNA, 20 nt, Human
ccuagggaggcaggguucga

SEQ ID NO: 850986 - RNA, 22 nt, Human
ccucacagagccuccggcaggg

SEQ ID NO: 850987 - RNA, 24 nt, Human
ccucacagagccuccggcagggau

SEQ ID NO: 850988 - RNA, 21 nt, Human
cgccccagugcucccagcccc

SEQ ID NO: 850989 - RNA, 20 nt, Human
cgcuugggagggggccgagu

SEQ ID NO: 850990 - RNA, 21 nt, Human
cggcagcaacaacuccccgcc

SEQ ID NO: 850991 - RNA, 20 nt, Human
cugcugcucugaagagcccc

SEQ ID NO: 850992 - RNA, 22 nt, Human
cuggagacccucaccccgacug

SEQ ID NO: 850993 - RNA, 23 nt, Human
cuggagacccucaccccgacugu

SEQ ID NO: 850994 - RNA, 23 nt, Human
cuggagacccucaccccgacugu

SEQ ID NO: 850995 - RNA, 23 nt, Human
cuggagacccucaccccgacugu

SEQ ID NO: 850996 - RNA, 23 nt, Human
cuggagacccucaccccgacugu

SEQ ID NO: 850997 - RNA, 23 nt, Human
gagccccuggugaguaggaacag

SEQ ID NO: 850998 - RNA, 23 nt, Human
gaggacucucagcagggcaggag

SEQ ID NO: 850999 - RNA, 22 nt, Human
gaggggaggccgugcugguggc

SEQ ID NO: 851000 - RNA, 22 nt, Human
gcacccccucccuguccccaag

SEQ ID NO: 851001 - RNA, 19 nt, Human
gcccacuggaccaaggucg

SEQ ID NO: 851002 - RNA, 22 nt, Human
gccccagugcucccagccccac

SEQ ID NO: 851003 - RNA, 19 nt, Human
gcccccaacagaagccagg

SEQ ID NO: 851004 - RNA, 25 nt, Human
gcccugggcuugcgugguggcccca

SEQ ID NO: 851005 - RNA, 18 nt, Human
gcccuggguuugagcagg

SEQ ID NO: 851006 - RNA, 18 nt, Human
gccugggacagacuugca

SEQ ID NO: 851007 - RNA, 18 nt, Human
ggagcccaggagggagga

SEQ ID NO: 851008 - RNA, 22 nt, Human
ggcauagggcugugggcauggg

SEQ ID NO: 851009 - RNA, 19 nt, Human
ggccacuggccuuucccag

SEQ ID NO: 851010 - RNA, 19 nt, Human
ggcugugggcauggggaca

SEQ ID NO: 851011 - RNA, 22 nt, Human
ggggcagggagcccaggaggga

SEQ ID NO: 851012 - RNA, 19 nt, Human
ggggguagggaggcuggca

SEQ ID NO: 851013 - RNA, 18 nt, Human
gggguagggaggcuggca

SEQ ID NO: 851014 - RNA, 20 nt, Human
ggguagggaggcuggcagau

SEQ ID NO: 851015 - RNA, 19 nt, Human
gguggcugggcggggggca

SEQ ID NO: 851016 - RNA, 22 nt, Human
gguggcugggcggggggcaggg

SEQ ID NO: 851017 - RNA, 22 nt, Human
guugcucuggggggagaucuuc

SEQ ID NO: 851018 - RNA, 19 nt, Human
ucccagagagccugggaca

SEQ ID NO: 851019 - RNA, 21 nt, Human
uccgugcagcgcagggggcug

SEQ ID NO: 851020 - RNA, 19 nt, Human
uccugcugcucugaagagc

SEQ ID NO: 851021 - RNA, 20 nt, Human
ugaagagccccuggugagua

SEQ ID NO: 851022 - RNA, 22 nt, Human
ugaaggaggggcuuaguuuuuc

SEQ ID NO: 851023 - RNA, 18 nt, Human
ugagagcacagacugggu

SEQ ID NO: 851024 - RNA, 19 nt, Human
ugagcagguguccugcugc

SEQ ID NO: 851025 - RNA, 20 nt, Human
ugaguaggaacaggacggca

SEQ ID NO: 851026 - RNA, 22 nt, Human
ugcugggcuccccacagaccuc

SEQ ID NO: 851027 - RNA, 22 nt, Human
uggaggggaggccgugcuggug

SEQ ID NO: 851028 - RNA, 18 nt, Human
uggcugggcggggggcag

SEQ ID NO: 851029 - RNA, 18 nt, Human
uggcugggcggggggcag

SEQ ID NO: 851030 - RNA, 22 nt, Human
ugggagcgggaggcccgccgug

SEQ ID NO: 851031 - RNA, 19 nt, Human
ugggagggggccgaguccu

SEQ ID NO: 851032 - RNA, 23 nt, Human
ugucccgaagcccccauucuggg

SEQ ID NO: 851033 - RNA, 24 nt, Human
uucccagguccuccaggagggcug

SEQ ID NO: 851034 - RNA, 19 nt, Human
uugaugcagagcaacaggu

SEQ ID NO: 851035 - RNA, 19 nt, Human
uugcaggcugggguuugga

SEQ ID NO: 851036 - RNA, 20 nt, Human
uugggagggggccgaguccu

SEQ ID NO: 851037 - RNA, 20 nt, Human
aaaaagaaaaagaaaaaccc

SEQ ID NO: 851038 - RNA, 20 nt, Human
aaacccuaccaagaacaaac

SEQ ID NO: 851039 - RNA, 23 nt, Human
acagccggugcugucacacccaa

SEQ ID NO: 851040 - RNA, 25 nt, Human
agaaaaagaaaaacccuaccaagaa

SEQ ID NO: 851041 - RNA, 23 nt, Human
agccagcaacagccggugcuguc

SEQ ID NO: 851042 - RNA, 28 nt, Human
auguuuauuuaaaaaagaaaaagaaaaa

SEQ ID NO: 851043 - RNA, 24 nt, Human
caaugagaaaucaaugcuuccucu

SEQ ID NO: 851044 - RNA, 18 nt, Human
cacagcccagccaccccc

SEQ ID NO: 851045 - RNA, 22 nt, Human
cacagcccagccacccccacag

SEQ ID NO: 851046 - RNA, 21 nt, Human
cagccacccccacagccucag

SEQ ID NO: 851047 - RNA, 18 nt, Human
ccagccacccccacagcc

SEQ ID NO: 851048 - RNA, 22 nt, Human
ccagccacccccacagccucag

SEQ ID NO: 851049 - RNA, 22 nt, Human
cccagccacccccacagccuca

SEQ ID NO: 851050 - RNA, 22 nt, Human
ccggugcugucacacccaagaa

SEQ ID NO: 851051 - RNA, 25 nt, Human
gaaaaacccuaccaagaacaaaccc

SEQ ID NO: 851052 - RNA, 18 nt, Human
gccacccccacagccuca

SEQ ID NO: 851053 - RNA, 24 nt, Human
gcccacuaccacagcccagccacc

SEQ ID NO: 851054 - RNA, 21 nt, Human
gcugccuaugcccacuaccac

SEQ ID NO: 851055 - RNA, 25 nt, Human
uaccaagaacaaacccuggucaaug

SEQ ID NO: 851056 - RNA, 23 nt, Human
ucaaugagaaaucaaugcuuccu

SEQ ID NO: 851057 - RNA, 22 nt, Human
ucacacccaagaaguacaggua

SEQ ID NO: 851058 - RNA, 27 nt, Human
ugagaaaucaaugcuuccucugaaagc

SEQ ID NO: 851059 - RNA, 21 nt, Human
uuauuuaaaaaagaaaaagaa

SEQ ID NO: 851060 - RNA, 26 nt, Human
uuauuuaaaaaagaaaaagaaaaacc

SEQ ID NO: 851061 - RNA, 18 nt, Human
uucuguggucaaaacugg

SEQ ID NO: 851062 - RNA, 23 nt, Human
uuuaaaaaagaaaaagaaaaacc

SEQ ID NO: 851063 - RNA, 21 nt, Human
agggaacuucucuggcucagu

SEQ ID NO: 851064 - RNA, 19 nt, Human
auugcaguagcaacagcgg

SEQ ID NO: 851065 - RNA, 18 nt, Human
cacagcacagcagaaagc

SEQ ID NO: 851066 - RNA, 20 nt, Human
gcaguagcaacagcggcaac

SEQ ID NO: 851067 - RNA, 22 nt, Human
gcgcagcuccacagagcccucg

SEQ ID NO: 851068 - RNA, 23 nt, Human
ggcaacugacugcaggaucacag

SEQ ID NO: 851069 - RNA, 18 nt, Human
uagcaacagcggcaacug

SEQ ID NO: 851070 - RNA, 22 nt, Human
uagcaacagcggcaacugacug

SEQ ID NO: 851071 - RNA, 21 nt, Human
aaaaacacuaaaagcaagcca

SEQ ID NO: 851072 - RNA, 21 nt, Human
aaaaagacaauggagguggug

SEQ ID NO: 851073 - RNA, 24 nt, Human
aaacaccaaaaacacuaaaagcaa

SEQ ID NO: 851074 - RNA, 20 nt, Human
aacacugccuggacucagau

SEQ ID NO: 851075 - RNA, 21 nt, Human
aacucagcccugccucaguag

SEQ ID NO: 851076 - RNA, 23 nt, Human
aacuccagaaaaccugagugcua

SEQ ID NO: 851077 - RNA, 24 nt, Human
aagacaauggagguggugggugcc

SEQ ID NO: 851078 - RNA, 23 nt, Human
aagcaagccaugaugaauggcac

SEQ ID NO: 851079 - RNA, 21 nt, Human
aauggcacguggugcuugguc

SEQ ID NO: 851080 - RNA, 18 nt, Human
aauugcuugaacucugga

SEQ ID NO: 851081 - RNA, 18 nt, Human
acaccacugcacuccagc

SEQ ID NO: 851082 - RNA, 20 nt, Human
acaccacugcacuccagccu

SEQ ID NO: 851083 - RNA, 24 nt, Human
acagagcaggaagcugucucagaa

SEQ ID NO: 851084 - RNA, 20 nt, Human
acaggaucacuucagccaag

SEQ ID NO: 851085 - RNA, 19 nt, Human
accacugcacuccagccug

SEQ ID NO: 851086 - RNA, 24 nt, Human
accacugcacuccagccuggguga

SEQ ID NO: 851087 - RNA, 18 nt, Human
accccaucacacacacac

SEQ ID NO: 851088 - RNA, 19 nt, Human
accucaguccucuuagcac

SEQ ID NO: 851089 - RNA, 21 nt, Human
accucccugcaggccgccggu

SEQ ID NO: 851090 - RNA, 20 nt, Human
acggaucggcugccuccccu

SEQ ID NO: 851091 - RNA, 24 nt, Human
acugcacuccagccugggugacag

SEQ ID NO: 851092 - RNA, 26 nt, Human
acugcacuccagccugggugacagag

SEQ ID NO: 851093 - RNA, 18 nt, Human
agaaaaccugagugcuac

SEQ ID NO: 851094 - RNA, 21 nt, Human
agacgacaggaucacuucagc

SEQ ID NO: 851095 - RNA, 18 nt, Human
agagcccugggcaguggg

SEQ ID NO: 851096 - RNA, 22 nt, Human
agagguugcagugagcugagau

SEQ ID NO: 851097 - RNA, 24 nt, Human
agagguugcagugagcugagauug

SEQ ID NO: 851098 - RNA, 23 nt, Human
agcccuguucacaccacugcacu

SEQ ID NO: 851099 - RNA, 18 nt, Human
aggaaggagaauugcuug

SEQ ID NO: 851100 - RNA, 26 nt, Human
aggaaggagaauugcuugaacucugg

SEQ ID NO: 851101 - RNA, 20 nt, Human
aggaguuugagaccagccug

SEQ ID NO: 851102 - RNA, 20 nt, Human
aggcagagguugcagugagc

SEQ ID NO: 851103 - RNA, 24 nt, Human
aggcagagguugcagugagcugag

SEQ ID NO: 851104 - RNA, 24 nt, Human
aggcugaggaaggagaauugcuug

SEQ ID NO: 851105 - RNA, 24 nt, Human
aggugcuggcagaggaggcugcuc

SEQ ID NO: 851106 - RNA, 24 nt, Human
aguguugcccgccuguagucucag

SEQ ID NO: 851107 - RNA, 25 nt, Human
aguguugcccgccuguagucucaga

SEQ ID NO: 851108 - RNA, 19 nt, Human
aguugccaaaucuuuggau

SEQ ID NO: 851109 - RNA, 22 nt, Human
auaaaugagcgggaaaugccag

SEQ ID NO: 851110 - RNA, 19 nt, Human
aucacacacacacacacac

SEQ ID NO: 851111 - RNA, 23 nt, Human
aucacuuaaaaacacugccugga

SEQ ID NO: 851112 - RNA, 23 nt, Human
auggugguagcucacgccuguaa

SEQ ID NO: 851113 - RNA, 18 nt, Human
auugcacuccagccuggg

SEQ ID NO: 851114 - RNA, 24 nt, Human
auugcacuccagccugggcaacaa

SEQ ID NO: 851115 - RNA, 24 nt, Human
auugcgcuauugcacuccagccug

SEQ ID NO: 851116 - RNA, 25 nt, Human
caaacucaaaugaccauaggaacuc

SEQ ID NO: 851117 - RNA, 20 nt, Human
caacaagagcaaaaccccau

SEQ ID NO: 851118 - RNA, 21 nt, Human
caacaagagcaaaaccccauc

SEQ ID NO: 851119 - RNA, 18 nt, Human
cacacacacacacacaca

SEQ ID NO: 851120 - RNA, 21 nt, Human
cacaccacugcacuccagccu

SEQ ID NO: 851121 - RNA, 26 nt, Human
caccacugcacuccagccugggugac

SEQ ID NO: 851122 - RNA, 25 nt, Human
cacccuuucucuccaacuccagaaa

SEQ ID NO: 851123 - RNA, 24 nt, Human
caccucugggcugagaaacagcuu

SEQ ID NO: 851124 - RNA, 23 nt, Human
cacgccuguaaucccagcacuug

SEQ ID NO: 851125 - RNA, 24 nt, Human
cacuccagccugggcaacaagagc

SEQ ID NO: 851126 - RNA, 22 nt, Human
cacuccagccugggugacagag

SEQ ID NO: 851127 - RNA, 23 nt, Human
cacuccagccugggugacagagc

SEQ ID NO: 851128 - RNA, 19 nt, Human
cacugcacuccagccuggg

SEQ ID NO: 851129 - RNA, 19 nt, Human
cacugcacuccagccuggg

SEQ ID NO: 851130 - RNA, 22 nt, Human
cacugcacuccagccuggguga

SEQ ID NO: 851131 - RNA, 23 nt, Human
cacugcacuccagccugggugac

SEQ ID NO: 851132 - RNA, 24 nt, Human
cacugcacuccagccugggugaca

SEQ ID NO: 851133 - RNA, 25 nt, Human
cacugcacuccagccugggugacag

SEQ ID NO: 851134 - RNA, 21 nt, Human
cacuuaaaaacacugccugga

SEQ ID NO: 851135 - RNA, 22 nt, Human
cagaaaaccugagugcuacaga

SEQ ID NO: 851136 - RNA, 24 nt, Human
cagaaauaaauaaauaaauaaaua

SEQ ID NO: 851137 - RNA, 21 nt, Human
cagccaaggaguuugagacca

SEQ ID NO: 851138 - RNA, 24 nt, Human
cagcucuugcccuagauucuggga

SEQ ID NO: 851139 - RNA, 22 nt, Human
ccaagaucagacuguccgcacc

SEQ ID NO: 851140 - RNA, 20 nt, Human
ccacugcacuccagccuggg

SEQ ID NO: 851141 - RNA, 20 nt, Human
ccacugcacuccagccuggg

SEQ ID NO: 851142 - RNA, 21 nt, Human
ccacugcacuccagccugggu

SEQ ID NO: 851143 - RNA, 21 nt, Human
ccacugcacuccagccugggu

SEQ ID NO: 851144 - RNA, 24 nt, Human
ccacugcacuccagccugggugac

SEQ ID NO: 851145 - RNA, 20 nt, Human
ccaguacacagucacaggau

SEQ ID NO: 851146 - RNA, 24 nt, Human
ccaucacacacacacacacacaaa

SEQ ID NO: 851147 - RNA, 21 nt, Human
cccaucacacacacacacaca

SEQ ID NO: 851148 - RNA, 20 nt, Human
ccccugagcccaucucgggc

SEQ ID NO: 851149 - RNA, 22 nt, Human
ccccuuauguaggucugggggu

SEQ ID NO: 851150 - RNA, 20 nt, Human
cccguaaugucuagauaguc

SEQ ID NO: 851151 - RNA, 22 nt, Human
cccugagcccaucucgggccuc

SEQ ID NO: 851152 - RNA, 26 nt, Human
ccgacgacggaucggcugccuccccu

SEQ ID NO: 851153 - RNA, 21 nt, Human
ccuccugcgcccgagaaagcc

SEQ ID NO: 851154 - RNA, 19 nt, Human
ccucugggcugagaaacag

SEQ ID NO: 851155 - RNA, 21 nt, Human
ccugcggaaccuccugcgccc

SEQ ID NO: 851156 - RNA, 19 nt, Human
ccugggugacagagcagga

SEQ ID NO: 851157 - RNA, 19 nt, Human
ccuguaaucccagcacuug

SEQ ID NO: 851158 - RNA, 21 nt, Human
ccuguaaucccagcacuugcg

SEQ ID NO: 851159 - RNA, 21 nt, Human
ccuguagucccagcuacuugg

SEQ ID NO: 851160 - RNA, 22 nt, Human
ccuguagucccagcuacuuggg

SEQ ID NO: 851161 - RNA, 24 nt, Human
cgcaggccagauccaguacacagu

SEQ ID NO: 851162 - RNA, 24 nt, Human
cgccuguaaucccagcacuugcgg

SEQ ID NO: 851163 - RNA, 24 nt, Human
cgcuauugcacuccagccugggca

SEQ ID NO: 851164 - RNA, 19 nt, Human
cgggccccugagcccaucu

SEQ ID NO: 851165 - RNA, 19 nt, Human
cuacagaccacuguuugca

SEQ ID NO: 851166 - RNA, 20 nt, Human
cuauugcacuccagccuggg

SEQ ID NO: 851167 - RNA, 24 nt, Human
cuauugcacuccagccugggcaac

SEQ ID NO: 851168 - RNA, 24 nt, Human
cucacgccuguaaucccagcacuu

SEQ ID NO: 851169 - RNA, 25 nt, Human
cucacgccuguaaucccagcacuug

SEQ ID NO: 851170 - RNA, 18 nt, Human
cucagcccugccucagua

SEQ ID NO: 851171 - RNA, 20 nt, Human
cucagcucccaacaacugug

SEQ ID NO: 851172 - RNA, 25 nt, Human
cuccagaaaaccugagugcuacaga

SEQ ID NO: 851173 - RNA, 20 nt, Human
cucccugcaggccgccgcag

SEQ ID NO: 851174 - RNA, 24 nt, Human
cucccugcaggccgccgcagaggu

SEQ ID NO: 851175 - RNA, 20 nt, Human
cuggccuggccugggccugc

SEQ ID NO: 851176 - RNA, 24 nt, Human
cugggcaacaagagcaaaacccca

SEQ ID NO: 851177 - RNA, 18 nt, Human
cuucccuuucuucuucgc

SEQ ID NO: 851178 - RNA, 19 nt, Human
cuucccuuucuucuucgcu

SEQ ID NO: 851179 - RNA, 20 nt, Human
cuugccacccuuucucucca

SEQ ID NO: 851180 - RNA, 24 nt, Human
gaggaaggagaauugcuugaacuc

SEQ ID NO: 851181 - RNA, 20 nt, Human
gaguugccaaaucuuuggau

SEQ ID NO: 851182 - RNA, 24 nt, Human
gcacuccagccugggugacagagc

SEQ ID NO: 851183 - RNA, 18 nt, Human
gcaguaaaaagacaaugg

SEQ ID NO: 851184 - RNA, 23 nt, Human
gccaggcauggugguagcucacg

SEQ ID NO: 851185 - RNA, 19 nt, Human
gcccaagaucagacugucc

SEQ ID NO: 851186 - RNA, 21 nt, Human
gccuuggagagcccugggcag

SEQ ID NO: 851187 - RNA, 22 nt, Human
gcuauugcacuccagccugggc

SEQ ID NO: 851188 - RNA, 24 nt, Human
gcuauugcacuccagccugggcaa

SEQ ID NO: 851189 - RNA, 24 nt, Human
gcucagcucccaacaacugugguu

SEQ ID NO: 851190 - RNA, 20 nt, Human
gcugcaguuagcccuguuca

SEQ ID NO: 851191 - RNA, 22 nt, Human
gcuguacuuuaagauaaacacc

SEQ ID NO: 851192 - RNA, 18 nt, Human
ggagcaaggugcuggcag

SEQ ID NO: 851193 - RNA, 22 nt, Human
ggagcaaggugcuggcagagga

SEQ ID NO: 851194 - RNA, 22 nt, Human
ggaggcugaggaaggagaauug

SEQ ID NO: 851195 - RNA, 24 nt, Human
ggccguaguguugcccgccuguag

SEQ ID NO: 851196 - RNA, 23 nt, Human
ggccuuggagagcccugggcagu

SEQ ID NO: 851197 - RNA, 24 nt, Human
gguagcucacgccuguaaucccag

SEQ ID NO: 851198 - RNA, 23 nt, Human
gguggugggugccuguaguccca

SEQ ID NO: 851199 - RNA, 19 nt, Human
guaaaacaagguucuccuc

SEQ ID NO: 851200 - RNA, 19 nt, Human
guugcagugagcugagauu

SEQ ID NO: 851201 - RNA, 20 nt, Human
guugcccgccuguagucuca

SEQ ID NO: 851202 - RNA, 18 nt, Human
uaaaaagacaauggguaa

SEQ ID NO: 851203 - RNA, 23 nt, Human
uaagauaaacaccaaaaacacua

SEQ ID NO: 851204 - RNA, 27 nt, Human
uaagauaaacaccaaaaacacuaaaag

SEQ ID NO: 851205 - RNA, 21 nt, Human
uaagggcccaagaucagacug

SEQ ID NO: 851206 - RNA, 18 nt, Human
uaccucaguccucuuagc

SEQ ID NO: 851207 - RNA, 20 nt, Human
uaccucaguccucuuagcaa

SEQ ID NO: 851208 - RNA, 18 nt, Human
uagauucugggaccuccc

SEQ ID NO: 851209 - RNA, 22 nt, Human
uagcucacgccuguaaucccag

SEQ ID NO: 851210 - RNA, 24 nt, Human
uagcucacgccuguaaucccagca

SEQ ID NO: 851211 - RNA, 22 nt, Human
uauugcacuccagccugggcaa

SEQ ID NO: 851212 - RNA, 24 nt, Human
uauugcacuccagccugggcaaca

SEQ ID NO: 851213 - RNA, 21 nt, Human
uauuuggacagagacaugggu

SEQ ID NO: 851214 - RNA, 19 nt, Human
ucaaaugaccauaggaacu

SEQ ID NO: 851215 - RNA, 23 nt, Human
ucacaccacugcacuccagccug

SEQ ID NO: 851216 - RNA, 22 nt, Human
uccagccugggugacagagcag

SEQ ID NO: 851217 - RNA, 23 nt, Human
uccagccugggugacagagcagg

SEQ ID NO: 851218 - RNA, 18 nt, Human
ucccugcaggccgccgca

SEQ ID NO: 851219 - RNA, 20 nt, Human
ucccugcaggccgccgcaga

SEQ ID NO: 851220 - RNA, 19 nt, Human
ucucagaaauaaauaaaua

SEQ ID NO: 851221 - RNA, 23 nt, Human
ucucagauauuuggaaggcugau

SEQ ID NO: 851222 - RNA, 23 nt, Human
ucucucuugccacccuuucucuc

SEQ ID NO: 851223 - RNA, 24 nt, Human
ugagauugcgcuauugcacuccag

SEQ ID NO: 851224 - RNA, 20 nt, Human
ugaggcugcaguuagcccug

SEQ ID NO: 851225 - RNA, 18 nt, Human
ugcacuccagccugggca

SEQ ID NO: 851226 - RNA, 19 nt, Human
ugcacuccagccugggcaa

SEQ ID NO: 851227 - RNA, 19 nt, Human
ugcacuccagccugggcaa

SEQ ID NO: 851228 - RNA, 20 nt, Human
ugcacuccagccugggcaac

SEQ ID NO: 851229 - RNA, 22 nt, Human
ugcacuccagccugggcaacaa

SEQ ID NO: 851230 - RNA, 23 nt, Human
ugccuguagucccagcuacuugg

SEQ ID NO: 851231 - RNA, 24 nt, Human
ugccuguagucccagcuacuuggg

SEQ ID NO: 851232 - RNA, 22 nt, Human
ugcgcccgagaaagccucgugc

SEQ ID NO: 851233 - RNA, 23 nt, Human
uggaggcagagguugcagugagc

SEQ ID NO: 851234 - RNA, 18 nt, Human
uggccuggccugggccug

SEQ ID NO: 851235 - RNA, 21 nt, Human
uggccugggccugcggaaccu

SEQ ID NO: 851236 - RNA, 23 nt, Human
ugggaggcugaggaaggagaauu

SEQ ID NO: 851237 - RNA, 23 nt, Human
ugggcaacaagagcaaaacccca

SEQ ID NO: 851238 - RNA, 27 nt, Human
ugggcaguggggagcaaggugcuggga

SEQ ID NO: 851239 - RNA, 18 nt, Human
ugggcugagaaacagcuu

SEQ ID NO: 851240 - RNA, 24 nt, Human
ugguagcucacgccuguaauccca

SEQ ID NO: 851241 - RNA, 20 nt, Human
ugguggggauggguggccgg

SEQ ID NO: 851242 - RNA, 24 nt, Human
uggugggugccuguagucccagcu

SEQ ID NO: 851243 - RNA, 18 nt, Human
uguugcccgccuguaguc

SEQ ID NO: 851244 - RNA, 21 nt, Human
uguugcccgccuguagucuca

SEQ ID NO: 851245 - RNA, 24 nt, Human
uucacaccacugcacuccagccug

SEQ ID NO: 851246 - RNA, 18 nt, Human
uuccuugagcacugcagg

SEQ ID NO: 851247 - RNA, 22 nt, Human
uugcaaacucaaaugaccauag

SEQ ID NO: 851248 - RNA, 20 nt, Human
uugcagugagcugagauugc

SEQ ID NO: 851249 - RNA, 22 nt, Human
uugcagugagcugagauugcgc

SEQ ID NO: 851250 - RNA, 18 nt, Human
uugcuugaacucuggagg

SEQ ID NO: 851251 - RNA, 23 nt, Human
uugggaggcugaggaaggagaau

SEQ ID NO: 851252 - RNA, 21 nt, Human
uuuaagauaaacaccaaaaac

SEQ ID NO: 851253 - RNA, 23 nt, Human
uuuggaaggcugaugggagagga

SEQ ID NO: 851254 - RNA, 24 nt, Human
uuuuacuucucucuugccacccuu

SEQ ID NO: 851255 - RNA, 22 nt, Human
aaacaaaucaaugugaagagac

SEQ ID NO: 851256 - RNA, 22 nt, Human
acaccugauaguuccuagccuu

SEQ ID NO: 851257 - RNA, 21 nt, Human
acauaacuugcagcaucagcc

SEQ ID NO: 851258 - RNA, 19 nt, Human
agugggaaaaagggaaagg

SEQ ID NO: 851259 - RNA, 20 nt, Human
aguuccuagccuuagacaua

SEQ ID NO: 851260 - RNA, 23 nt, Human
auuuagugggaaaaagggaaagg

SEQ ID NO: 851261 - RNA, 23 nt, Human
caaagugcacuggagaguuaaaa

SEQ ID NO: 851262 - RNA, 18 nt, Human
cacuggagaguuaaaaug

SEQ ID NO: 851263 - RNA, 25 nt, Human
cccggcgcaggccggcuguccucuc

SEQ ID NO: 851264 - RNA, 21 nt, Human
gagaguuaaaaugguuacaug

SEQ ID NO: 851265 - RNA, 19 nt, Human
uaagaaaaaauuuaguggg

SEQ ID NO: 851266 - RNA, 19 nt, Human
ugaagagacuuuaauggca

SEQ ID NO: 851267 - RNA, 22 nt, Human
ugugcuacaauuauagacaccu

SEQ ID NO: 851268 - RNA, 24 nt, Human
uuuaagaaaaaauuuagugggaaa

SEQ ID NO: 851269 - RNA, 18 nt, Human
uuuuuuuuuuuuuuuuug

SEQ ID NO: 851270 - RNA, 19 nt, Human
accuacaaugaaaccacuu

SEQ ID NO: 851271 - RNA, 22 nt, Human
acuacuucgaaggcugaggcag

SEQ ID NO: 851272 - RNA, 22 nt, Human
acuucgaaggcugaggcaggag

SEQ ID NO: 851273 - RNA, 23 nt, Human
agccaggcacgguggcgugggcc

SEQ ID NO: 851274 - RNA, 23 nt, Human
agccugggcaacauagaagaccc

SEQ ID NO: 851275 - RNA, 23 nt, Human
agccugggcaacauagaagaccc

SEQ ID NO: 851276 - RNA, 22 nt, Human
aggaaaccauucacuucauagc

SEQ ID NO: 851277 - RNA, 18 nt, Human
aggaguccaucuuggccu

SEQ ID NO: 851278 - RNA, 24 nt, Human
aggaucacuugaucccaggaguuc

SEQ ID NO: 851279 - RNA, 24 nt, Human
aggaucuucccugacauuaaauau

SEQ ID NO: 851280 - RNA, 18 nt, Human
aggcaggaggaucacuug

SEQ ID NO: 851281 - RNA, 24 nt, Human
aggcugaggcaggaggaucacuug

SEQ ID NO: 851282 - RNA, 23 nt, Human
aucacuugaucccaggaguucaa

SEQ ID NO: 851283 - RNA, 22 nt, Human
auuaggaaaugcuaaaaaccca

SEQ ID NO: 851284 - RNA, 21 nt, Human
caaacagauuaacauugcaaa

SEQ ID NO: 851285 - RNA, 18 nt, Human
caacauagaagacccugg

SEQ ID NO: 851286 - RNA, 21 nt, Human
caacauagaagacccugucuc

SEQ ID NO: 851287 - RNA, 23 nt, Human
caauccugaagugaaacacugcg

SEQ ID NO: 851288 - RNA, 21 nt, Human
cacagcacuccgcgauucuaa

SEQ ID NO: 851289 - RNA, 23 nt, Human
cagcucuccagagaauucugaag

SEQ ID NO: 851290 - RNA, 20 nt, Human
caguccuuccagacugggcc

SEQ ID NO: 851291 - RNA, 21 nt, Human
cauuguacacugcgguacacg

SEQ ID NO: 851292 - RNA, 22 nt, Human
ccacuuucuccaaagacucaaa

SEQ ID NO: 851293 - RNA, 21 nt, Human
ccagagaauucugaagcgcag

SEQ ID NO: 851294 - RNA, 20 nt, Human
ccaugcuuucagcuagcugg

SEQ ID NO: 851295 - RNA, 18 nt, Human
ccucgcgguccagcuggg

SEQ ID NO: 851296 - RNA, 21 nt, Human
ccugggcaacauagaagaccc

SEQ ID NO: 851297 - RNA, 21 nt, Human
ccugggcaacauagaagaccc

SEQ ID NO: 851298 - RNA, 21 nt, Human
ccuguagucccaacuacuucg

SEQ ID NO: 851299 - RNA, 22 nt, Human
ccuguagucccaacuacuucga

SEQ ID NO: 851300 - RNA, 23 nt, Human
ccuuccagacugggccagggcug

SEQ ID NO: 851301 - RNA, 20 nt, Human
cgaaacucaguccuuccaga

SEQ ID NO: 851302 - RNA, 22 nt, Human
cggcgucacccucgcgguccag

SEQ ID NO: 851303 - RNA, 22 nt, Human
cuacaaugaaaccacuuucucc

SEQ ID NO: 851304 - RNA, 18 nt, Human
cucuccagagaauucuga

SEQ ID NO: 851305 - RNA, 23 nt, Human
cugggccucggcguccggcagga

SEQ ID NO: 851306 - RNA, 20 nt, Human
cuuccagacugggccagggc

SEQ ID NO: 851307 - RNA, 22 nt, Human
gaaggcugaggcaggaggauca

SEQ ID NO: 851308 - RNA, 19 nt, Human
gauucuaaggaucuucccu

SEQ ID NO: 851309 - RNA, 24 nt, Human
gcaacauagaagacccugucucuu

SEQ ID NO: 851310 - RNA, 23 nt, Human
ggaucacuugaucccaggaguuc

SEQ ID NO: 851311 - RNA, 23 nt, Human
gguggcgugggccuguaguccca

SEQ ID NO: 851312 - RNA, 21 nt, Human
guaaauccuuaagacuuaaaa

SEQ ID NO: 851313 - RNA, 21 nt, Human
guagcuuuucuguuagggucu

SEQ ID NO: 851314 - RNA, 18 nt, Human
guggcgugggccuguagu

SEQ ID NO: 851315 - RNA, 20 nt, Human
uaaagcugguuaaaggcaca

SEQ ID NO: 851316 - RNA, 25 nt, Human
uaaccauucacuucaaauuuacaug

SEQ ID NO: 851317 - RNA, 25 nt, Human
uacacgcauguuucugguaaauccu

SEQ ID NO: 851318 - RNA, 20 nt, Human
uagcugcaaaaacacacugu

SEQ ID NO: 851319 - RNA, 23 nt, Human
uaggugucaaaucagcucuccag

SEQ ID NO: 851320 - RNA, 18 nt, Human
uccaaagacucaaacaga

SEQ ID NO: 851321 - RNA, 22 nt, Human
uccagccaggcacgguggcgug

SEQ ID NO: 851322 - RNA, 22 nt, Human
uccccaggaaaccauucacuuu

SEQ ID NO: 851323 - RNA, 24 nt, Human
ucgaaggcugaggcaggaggauca

SEQ ID NO: 851324 - RNA, 21 nt, Human
ucgccgccggagcugcugccg

SEQ ID NO: 851325 - RNA, 18 nt, Human
ugacgggcaaggcagaua

SEQ ID NO: 851326 - RNA, 20 nt, Human
ugaggcaggaggaucacuug

SEQ ID NO: 851327 - RNA, 24 nt, Human
ugaggcaggaggaucacuugaucc

SEQ ID NO: 851328 - RNA, 25 nt, Human
ugaggcaggaggaucacuugauccc

SEQ ID NO: 851329 - RNA, 24 nt, Human
ugauaaaaucuaaagugaugagaa

SEQ ID NO: 851330 - RNA, 19 nt, Human
ugccaugcuuucagcuagc

SEQ ID NO: 851331 - RNA, 23 nt, Human
ugggcaacauagaagacccuguc

SEQ ID NO: 851332 - RNA, 21 nt, Human
ugugucagguauacauauacc

SEQ ID NO: 851333 - RNA, 22 nt, Human
uuccccaggaaaccauucacuu

SEQ ID NO: 851334 - RNA, 25 nt, Human
uucgaaggcugaggcaggaggauca

SEQ ID NO: 851335 - RNA, 18 nt, Human
uuggugcgcgccucaccc

SEQ ID NO: 851336 - RNA, 22 nt, Human
uuuuuuuuuuuuuuuuuuaaag

SEQ ID NO: 851337 - RNA, 23 nt, Human
aaagggaaaagucaaguugggaa

SEQ ID NO: 851338 - RNA, 20 nt, Human
aacccagaagaaugcaacca

SEQ ID NO: 851339 - RNA, 19 nt, Human
aauuauaguuacugauuug

SEQ ID NO: 851340 - RNA, 19 nt, Human
accccuggcauagcuauuu

SEQ ID NO: 851341 - RNA, 23 nt, Human
acccggaagcccccuccccacuu

SEQ ID NO: 851342 - RNA, 24 nt, Human
agacaaaauuccagucaucauaga

SEQ ID NO: 851343 - RNA, 20 nt, Human
agcaauuuucauauuguuua

SEQ ID NO: 851344 - RNA, 25 nt, Human
aggaaagagaaucuucaaauuucgg

SEQ ID NO: 851345 - RNA, 24 nt, Human
auaaaugcauaucugauugccucc

SEQ ID NO: 851346 - RNA, 20 nt, Human
auaucugauugccuccuuug

SEQ ID NO: 851347 - RNA, 30 nt, Human
auauuguuuauccccaaaucccuccuucaa

SEQ ID NO: 851348 - RNA, 19 nt, Human
aucugauugccuccuuugg

SEQ ID NO: 851349 - RNA, 19 nt, Human
auucacaaacugguuccac

SEQ ID NO: 851350 - RNA, 31 nt, Human
caaaaguaacuccaccuuuggaaaucaaagg

SEQ ID NO: 851351 - RNA, 23 nt, Human
cacacaucuuacuuauccaaagu

SEQ ID NO: 851352 - RNA, 19 nt, Human
cacaccccuggcauagcua

SEQ ID NO: 851353 - RNA, 21 nt, Human
cacaugucaucaggaccaccu

SEQ ID NO: 851354 - RNA, 23 nt, Human
cacuugguucccugcacgugucu

SEQ ID NO: 851355 - RNA, 21 nt, Human
cagagaccaauauuuuuuuca

SEQ ID NO: 851356 - RNA, 19 nt, Human
cagaguaaaaucuaucucu

SEQ ID NO: 851357 - RNA, 21 nt, Human
caggaaagagaaucuucaaau

SEQ ID NO: 851358 - RNA, 21 nt, Human
cauugcuccguucacugagau

SEQ ID NO: 851359 - RNA, 18 nt, Human
ccagaguaacauaaaacc

SEQ ID NO: 851360 - RNA, 19 nt, Human
cccaaaucccuccuucauc

SEQ ID NO: 851361 - RNA, 29 nt, Human
cccaaaucccuccuucaucuuucuaaucu

SEQ ID NO: 851362 - RNA, 18 nt, Human
ccccacuuugagucaucu

SEQ ID NO: 851363 - RNA, 18 nt, Human
ccccaucacaccccuggc

SEQ ID NO: 851364 - RNA, 27 nt, Human
ccccgaagaggugccuucaggucggug

SEQ ID NO: 851365 - RNA, 19 nt, Human
cccggaagcccccucccca

SEQ ID NO: 851366 - RNA, 21 nt, Human
cccggaagcccccuccccacu

SEQ ID NO: 851367 - RNA, 22 nt, Human
cccggaagcccccuccccacuu

SEQ ID NO: 851368 - RNA, 20 nt, Human
ccucaggccccaucacaccc

SEQ ID NO: 851369 - RNA, 21 nt, Human
ccucaggccccaucacacccc

SEQ ID NO: 851370 - RNA, 24 nt, Human
ccugccguugcaucugccuacagu

SEQ ID NO: 851371 - RNA, 23 nt, Human
cgacaggaaagagaaucuucaaa

SEQ ID NO: 851372 - RNA, 27 nt, Human
cgacaggaaagagaaucuucaaauuuc

SEQ ID NO: 851373 - RNA, 21 nt, Human
cgaggcucuauuagcagagga

SEQ ID NO: 851374 - RNA, 19 nt, Human
cgagguuuuuuuuuuuuuu

SEQ ID NO: 851375 - RNA, 21 nt, Human
cgagguuuuuuuuuuuuuuuu

SEQ ID NO: 851376 - RNA, 23 nt, Human
cgcuuuuucuucuggcuggcuca

SEQ ID NO: 851377 - RNA, 20 nt, Human
cggaagcccccuccccacuu

SEQ ID NO: 851378 - RNA, 22 nt, Human
cggcauacaugccucccauucu

SEQ ID NO: 851379 - RNA, 18 nt, Human
cugaccgcuuugggcaca

SEQ ID NO: 851380 - RNA, 24 nt, Human
cuuacggcauacaugccucccauu

SEQ ID NO: 851381 - RNA, 18 nt, Human
cuuguccucccaccacuu

SEQ ID NO: 851382 - RNA, 18 nt, Human
cuuucuaaauuaacugag

SEQ ID NO: 851383 - RNA, 23 nt, Human
gaggugccuucaggucggugcug

SEQ ID NO: 851384 - RNA, 18 nt, Human
gcaacacucugagugggc

SEQ ID NO: 851385 - RNA, 21 nt, Human
gcuacaguucggcaacacucu

SEQ ID NO: 851386 - RNA, 23 nt, Human
gucaucucuggcuuuuccagacu

SEQ ID NO: 851387 - RNA, 20 nt, Human
gucuccgacaggaaagagaa

SEQ ID NO: 851388 - RNA, 18 nt, Human
uaaaugcauaucugauug

SEQ ID NO: 851389 - RNA, 25 nt, Human
uaagcagagaccaauauuguaauga

SEQ ID NO: 851390 - RNA, 22 nt, Human
uacauccauugauagacaaaau

SEQ ID NO: 851391 - RNA, 19 nt, Human
uacauguuugcauuuacuc

SEQ ID NO: 851392 - RNA, 19 nt, Human
uaccagaguaacauaaaac

SEQ ID NO: 851393 - RNA, 21 nt, Human
ucaacccuggcaaaauaaacu

SEQ ID NO: 851394 - RNA, 18 nt, Human
ucaaguugggaacugcuu

SEQ ID NO: 851395 - RNA, 22 nt, Human
ucacaaaaguaacuccaccuuu

SEQ ID NO: 851396 - RNA, 19 nt, Human
ucacaaacugguuccacca

SEQ ID NO: 851397 - RNA, 22 nt, Human
ucagaaacccagaagaaugcaa

SEQ ID NO: 851398 - RNA, 21 nt, Human
ucccugcacgugucugucucc

SEQ ID NO: 851399 - RNA, 19 nt, Human
uccucaggccccaucacac

SEQ ID NO: 851400 - RNA, 18 nt, Human
uccugccguugcaucugc

SEQ ID NO: 851401 - RNA, 19 nt, Human
uccuugauugaaguugagg

SEQ ID NO: 851402 - RNA, 18 nt, Human
ucucaugucuuccuacaa

SEQ ID NO: 851403 - RNA, 18 nt, Human
ugacccggaagcccccuc

SEQ ID NO: 851404 - RNA, 20 nt, Human
ugagacauuaauguauccuc

SEQ ID NO: 851405 - RNA, 25 nt, Human
ugagccaaaggauuaauuacaucca

SEQ ID NO: 851406 - RNA, 21 nt, Human
ugaggcagaugucuuuugccu

SEQ ID NO: 851407 - RNA, 23 nt, Human
ugaggcagaugucuuuugccuuu

SEQ ID NO: 851408 - RNA, 18 nt, Human
ugauagacaaaauuccag

SEQ ID NO: 851409 - RNA, 19 nt, Human
ugauugaaguugaggcaga

SEQ ID NO: 851410 - RNA, 21 nt, Human
ugcagggucacacaucuuacu

SEQ ID NO: 851411 - RNA, 23 nt, Human
ugccaugcucuccucaggcccca

SEQ ID NO: 851412 - RNA, 19 nt, Human
uggccagggcaaauucaca

SEQ ID NO: 851413 - RNA, 20 nt, Human
uggccagggcaaauucacaa

SEQ ID NO: 851414 - RNA, 18 nt, Human
uggcucagcucugcucag

SEQ ID NO: 851415 - RNA, 20 nt, Human
ugucauugcugaggcuaugc

SEQ ID NO: 851416 - RNA, 23 nt, Human
uucaagcagaguauucaaacgag

SEQ ID NO: 851417 - RNA, 21 nt, Human
uucacaaacugguuccaccau

SEQ ID NO: 851418 - RNA, 18 nt, Human
uucuggcuggcucagcuc

SEQ ID NO: 851419 - RNA, 23 nt, Human
uuuaagacaaaauuuuauugccc

SEQ ID NO: 851420 - RNA, 29 nt, Human
uuuuuuuuuuuuuuuuuuuuuguuuuuag

SEQ ID NO: 851421 - RNA, 27 nt, Human
uuuuuuuuuuuuuuuuuuuuuuugggg

SEQ ID NO: 851422 - RNA, 31 nt, Human; identical to SEQ ID NO: 314735

SEQ ID NO: 851423 - RNA, 23 nt, Human
acccacccugcugccugggcaga

SEQ ID NO: 851424 - RNA, 22 nt, Human
acucacaaggccugcuucccuc

SEQ ID NO: 851425 - RNA, 21 nt, Human
agcagccgggugggcagugcc

SEQ ID NO: 851426 - RNA, 19 nt, Human
aggcaggggcccggcugua

SEQ ID NO: 851427 - RNA, 24 nt, Human
aucagcagccgggugggcagugcc

SEQ ID NO: 851428 - RNA, 25 nt, Human
auggucaguguccacucacaaggcc

SEQ ID NO: 851429 - RNA, 20 nt, Human
caaggcuuuuugccuccccu

SEQ ID NO: 851430 - RNA, 24 nt, Human
cacccacaggggagguugggggca

SEQ ID NO: 851431 - RNA, 19 nt, Human
cagcaggagcagaaccagc

SEQ ID NO: 851432 - RNA, 20 nt, Human
caggacccaggagagccugu

SEQ ID NO: 851433 - RNA, 23 nt, Human
caggggcccggcuguacaccugc

SEQ ID NO: 851434 - RNA, 19 nt, Human
cagugcuuuggggccccau

SEQ ID NO: 851435 - RNA, 18 nt, Human
cagugucccugcagcagg

SEQ ID NO: 851436 - RNA, 22 nt, Human
ccacccacccugcugccugggc

SEQ ID NO: 851437 - RNA, 25 nt, Human
ccaggaguaacaggcagccuccucu

SEQ ID NO: 851438 - RNA, 19 nt, Human
ccaugguacccacccaccc

SEQ ID NO: 851439 - RNA, 20 nt, Human
cccacccugcugccugggca

SEQ ID NO: 851440 - RNA, 22 nt, Human
cccacccugcugccugggcaga

SEQ ID NO: 851441 - RNA, 20 nt, Human
ccccagggacucauggucag

SEQ ID NO: 851442 - RNA, 18 nt, Human
cccugcugccugggcaga

SEQ ID NO: 851443 - RNA, 19 nt, Human
cccuguccauggugggcug

SEQ ID NO: 851444 - RNA, 21 nt, Human
ccggcagcagcagcucucgag

SEQ ID NO: 851445 - RNA, 22 nt, Human
ccgggaggacucccagcuggca

SEQ ID NO: 851446 - RNA, 27 nt, Human
ccugcagcaggagcagaaccggggucc

SEQ ID NO: 851447 - RNA, 22 nt, Human
ccuugggcgucacuggcucagg

SEQ ID NO: 851448 - RNA, 21 nt, Human
cgagagcugaggcacaaggca

SEQ ID NO: 851449 - RNA, 21 nt, Human
cgccuaggcaggaaacagcag

SEQ ID NO: 851450 - RNA, 23 nt, Human
cuaggcaggaaacagcagagugu

SEQ ID NO: 851451 - RNA, 22 nt, Human
cucccagcuggcaccaggccau

SEQ ID NO: 851452 - RNA, 23 nt, Human
gaaacagcagagugucuggaggg

SEQ ID NO: 851453 - RNA, 21 nt, Human
gaggacgagguugaggaggaa

SEQ ID NO: 851454 - RNA, 19 nt, Human
gcagaagugcaacauggca

SEQ ID NO: 851455 - RNA, 20 nt, Human
gcagccgggugggcagugcc

SEQ ID NO: 851456 - RNA, 26 nt, Human
gcugaggcacaaggcaggggcccggu

SEQ ID NO: 851457 - RNA, 19 nt, Human
ggaaggguggcucaguggc

SEQ ID NO: 851458 - RNA, 21 nt, Human
ggaccuggguaacaggcaugu

SEQ ID NO: 851459 - RNA, 20 nt, Human
ggagguugggggcagacacc

SEQ ID NO: 851460 - RNA, 20 nt, Human
ggaucaggucacccggcagc

SEQ ID NO: 851461 - RNA, 21 nt, Human
ggcccggcuguacaccugcag

SEQ ID NO: 851462 - RNA, 21 nt, Human
ggcucaguggccucgaagugc

SEQ ID NO: 851463 - RNA, 24 nt, Human
ggcuggggcuggaaggguggcuca

SEQ ID NO: 851464 - RNA, 20 nt, Human
gggcagacacccuucucuuc

SEQ ID NO: 851465 - RNA, 19 nt, Human
gggcuggggcuggaagggu

SEQ ID NO: 851466 - RNA, 24 nt, Human
gggugggcagugccgugcugcugu

SEQ ID NO: 851467 - RNA, 19 nt, Human
gguaacaggcauguccuug

SEQ ID NO: 851468 - RNA, 21 nt, Human
gguggcucaguggccucgaag

SEQ ID NO: 851469 - RNA, 24 nt, Human
guccuugggcgucacuggcucagg

SEQ ID NO: 851470 - RNA, 21 nt, Human
guggaggggugggcacccaug

SEQ ID NO: 851471 - RNA, 18 nt, Human
gugggcuggggcuggaag

SEQ ID NO: 851472 - RNA, 19 nt, Human
uacaggaccuggguaacag

SEQ ID NO: 851473 - RNA, 23 nt, Human
uacccacccacccugcugccugg

SEQ ID NO: 851474 - RNA, 22 nt, Human
uacccuugaacauggugucagg

SEQ ID NO: 851475 - RNA, 23 nt, Human
uagcucgacggacaccgaacagg

SEQ ID NO: 851476 - RNA, 21 nt, Human
ucagggccuugcagugguagc

SEQ ID NO: 851477 - RNA, 20 nt, Human
ucaguguccacucacaaggc

SEQ ID NO: 851478 - RNA, 19 nt, Human
ucccugcagcaggagcaga

SEQ ID NO: 851479 - RNA, 24 nt, Human
ugccgggaggacucccagcuggca

SEQ ID NO: 851480 - RNA, 27 nt, Human
ugccgugcugcuguugcccucagggcc

SEQ ID NO: 851481 - RNA, 19 nt, Human
ugccuccccuaccaugucc

SEQ ID NO: 851482 - RNA, 20 nt, Human
ugccuccccuaccauguccc

SEQ ID NO: 851483 - RNA, 20 nt, Human
ugccugggggaucacucccc

SEQ ID NO: 851484 - RNA, 22 nt, Human
uggcaccaggccaucagcagcc

SEQ ID NO: 851485 - RNA, 21 nt, Human
uggccagugacacccacaggg

SEQ ID NO: 851486 - RNA, 21 nt, Human
uggcucaggggcagaggacga

SEQ ID NO: 851487 - RNA, 21 nt, Human
ugggcagugccgugcugcugu

SEQ ID NO: 851488 - RNA, 19 nt, Human
ugggcuggggcuggaaggg

SEQ ID NO: 851489 - RNA, 22 nt, Human
ugggggaucacuccccccaauu

SEQ ID NO: 851490 - RNA, 19 nt, Human
ugggguugcccugcuuggc

SEQ ID NO: 851491 - RNA, 18 nt, Human
uggugggcuggggcugga

SEQ ID NO: 851492 - RNA, 18 nt, Human
uguccacucacaaggccu

SEQ ID NO: 851493 - RNA, 22 nt, Human
uguugcccucagggccuugcag

SEQ ID NO: 851494 - RNA, 20 nt, Human
uugccuccccuaccaugucc

SEQ ID NO: 851495 - RNA, 23 nt, Human
uuuuuuuuuuuuuaaaagcuuca

SEQ ID NO: 851496 - RNA, 23 nt, Human
uuuuuuuuuuuuuuuuuuaaaag

SEQ ID NO: 851497 - RNA, 25 nt, Human
aaaauaccuucuuccuaaguuuuca

SEQ ID NO: 851498 - RNA, 20 nt, Human
aaaaugauaaagcaagcuga

SEQ ID NO: 851499 - RNA, 21 nt, Human
aagugucucccgaaucuuucc

SEQ ID NO: 851500 - RNA, 19 nt, Human
agcgccuauuucaauguga

SEQ ID NO: 851501 - RNA, 21 nt, Human
caacucagguuuacauuuucu

SEQ ID NO: 851502 - RNA, 20 nt, Human
caagaaaagcuuuccuagug

SEQ ID NO: 851503 - RNA, 19 nt, Human
caccaugaaauugcccaaa

SEQ ID NO: 851504 - RNA, 18 nt, Human
cacuaagacuccgaguca

SEQ ID NO: 851505 - RNA, 25 nt, Human
cagcaaaaaugauaaagcaagcuga

SEQ ID NO: 851506 - RNA, 21 nt, Human
cagcuucauccccucggcaaa

SEQ ID NO: 851507 - RNA, 22 nt, Human
cagcuucauccccucggcaaag

SEQ ID NO: 851508 - RNA, 20 nt, Human
cauacaagcaucaucucagc

SEQ ID NO: 851509 - RNA, 22 nt, Human
cccucggcaaagugucucccga

SEQ ID NO: 851510 - RNA, 21 nt, Human
ccuuccaaaauacgucuccaa

SEQ ID NO: 851511 - RNA, 20 nt, Human
ccuucugaaaaaacaaaaac

SEQ ID NO: 851512 - RNA, 22 nt, Human
cuacuccucgcaaauguuaaaa

SEQ ID NO: 851513 - RNA, 21 nt, Human
cugccuucugaaaaaacaaaa

SEQ ID NO: 851514 - RNA, 21 nt, Human
ggaaaguauucuucccaugga

SEQ ID NO: 851515 - RNA, 18 nt, Human
gucucuagcgcccucugg

SEQ ID NO: 851516 - RNA, 23 nt, Human
gugaaacaccaugaaauugccca

SEQ ID NO: 851517 - RNA, 28 nt, Human
guuuucaucaucacugccuucugaaaaa

SEQ ID NO: 851518 - RNA, 19 nt, Human
uaaaaggacagcaaaaaug

SEQ ID NO: 851519 - RNA, 27 nt, Human
uaaaaggacagcaaaaaugauaaagca

SEQ ID NO: 851520 - RNA, 22 nt, Human
uaacgacacacuaagacuccga

SEQ ID NO: 851521 - RNA, 23 nt, Human
uauugcaaaauaccuucuuccua

SEQ ID NO: 851522 - RNA, 23 nt, Human
ucaggacggaaggugaaauagca

SEQ ID NO: 851523 - RNA, 21 nt, Human
ucccauggacacucagccaag

SEQ ID NO: 851524 - RNA, 23 nt, Human
uccuuccaaaauacgucuccaaa

SEQ ID NO: 851525 - RNA, 23 nt, Human
ugaaaaaacaaaaaccggucaau

SEQ ID NO: 851526 - RNA, 22 nt, Human
ugaaacaccaugaaauugccca

SEQ ID NO: 851527 - RNA, 18 nt, Human
ugaaauagcagaaugagc

SEQ ID NO: 851528 - RNA, 23 nt, Human
ugaauaccaccacucuagucaac

SEQ ID NO: 851529 - RNA, 21 nt, Human
ugaugugcugccuucuccccg

SEQ ID NO: 851530 - RNA, 19 nt, Human
uguccaaauaacgacacac

SEQ ID NO: 851531 - RNA, 18 nt, Human
ugucucccgaaucuuucc

SEQ ID NO: 851532 - RNA, 22 nt, Human
uucaggaccaggccccuacucc

SEQ ID NO: 851533 - RNA, 18 nt, Human
uucaucaucacugccuuc

SEQ ID NO: 851534 - RNA, 19 nt, Human
uuucacaccuccuuccaaa

SEQ ID NO: 851535 - RNA, 24 nt, Human
uuuuuuuuuuuuuuuuuuuuuggg

SEQ ID NO: 851536 - RNA, 19 nt, Human
aaacaagaaaucuuuaagc

SEQ ID NO: 851537 - RNA, 18 nt, Human
aaggcaggaaugcacgug

SEQ ID NO: 851538 - RNA, 21 nt, Human
aggcagggcuccaucaggcuc

SEQ ID NO: 851539 - RNA, 25 nt, Human
cuagaaaagcccacaagguuccaua

SEQ ID NO: 851540 - RNA, 26 nt, Human
gaaaagcccacaagguuccauaaccc

SEQ ID NO: 851541 - RNA, 21 nt, Human
gggagcaguccagguuggggu

SEQ ID NO: 851542 - RNA, 21 nt, Human
uaaccccauaggcauacagcc

SEQ ID NO: 851543 - RNA, 18 nt, Human
uacagccucgacaggcag

SEQ ID NO: 851544 - RNA, 20 nt, Human
ucaggcuccucuugaacugg

SEQ ID NO: 851545 - RNA, 21 nt, Human
uccuucacggaaggcaggaau

SEQ ID NO: 851546 - RNA, 18 nt, Human
uggugggcggggguaggg

SEQ ID NO: 851547 - RNA, 24 nt, Human
aaauuuguauuuuuaguagagacg

SEQ ID NO: 851548 - RNA, 20 nt, Human
acaccacagagcagggaggc

SEQ ID NO: 851549 - RNA, 23 nt, Human
acaggccugcaccaccacgcccg

SEQ ID NO: 851550 - RNA, 23 nt, Human
acauugaaaaaugaccuaagaga

SEQ ID NO: 851551 - RNA, 26 nt, Human
acucuuguacuucuuuuuuuucuuuu

SEQ ID NO: 851552 - RNA, 20 nt, Human
agacggagguugcagugagc

SEQ ID NO: 851553 - RNA, 24 nt, Human
agacggagguugcagugagcugag

SEQ ID NO: 851554 - RNA, 22 nt, Human
agagacggagguugcagugagc

SEQ ID NO: 851555 - RNA, 18 nt, Human
agcaauucuccugcuuua

SEQ ID NO: 851556 - RNA, 18 nt, Human
agccucccgaguagcugg

SEQ ID NO: 851557 - RNA, 18 nt, Human
agggaggccuggcugggc

SEQ ID NO: 851558 - RNA, 18 nt, Human
aguagagacggagguugc

SEQ ID NO: 851559 - RNA, 20 nt, Human
aguagagacggagguugcag

SEQ ID NO: 851560 - RNA, 19 nt, Human
aguagcugggauuacaggc

SEQ ID NO: 851561 - RNA, 20 nt, Human
agugcaauggcgcgaucucg

SEQ ID NO: 851562 - RNA, 24 nt, Human
agugcaauggcgcgaucucggcuc

SEQ ID NO: 851563 - RNA, 22 nt, Human
caagcaauucuccugcuuuagc

SEQ ID NO: 851564 - RNA, 23 nt, Human
caaguaucaaaauggaaauacca

SEQ ID NO: 851565 - RNA, 21 nt, Human
cacauugaaaaaugaccuaag

SEQ ID NO: 851566 - RNA, 20 nt, Human
caccacaaccuccgccuccc

SEQ ID NO: 851567 - RNA, 21 nt, Human
caccacaaccuccgccuccca

SEQ ID NO: 851568 - RNA, 22 nt, Human
caccacaaccuccgccucccag

SEQ ID NO: 851569 - RNA, 23 nt, Human
caccaccacgcccggcuaaauuu

SEQ ID NO: 851570 - RNA, 22 nt, Human
cagagcagggaggccuggcugg

SEQ ID NO: 851571 - RNA, 23 nt, Human
ccacaaccuccgccucccagguu

SEQ ID NO: 851572 - RNA, 24 nt, Human
ccacaaccuccgccucccagguuc

SEQ ID NO: 851573 - RNA, 20 nt, Human
ccacagagcagggaggccuu

SEQ ID NO: 851574 - RNA, 23 nt, Human
cccagguucaagcaauucuccug

SEQ ID NO: 851575 - RNA, 25 nt, Human
cccgaguagcugggauuacaggccu

SEQ ID NO: 851576 - RNA, 27 nt, Human
ccgccucccagguucaagcaauucuuu

SEQ ID NO: 851577 - RNA, 24 nt, Human
ccucccagguucaagcaauucucc

SEQ ID NO: 851578 - RNA, 24 nt, Human
cuaaauuuguauuuuuaguagaga

SEQ ID NO: 851579 - RNA, 24 nt, Human
cucaccacaaccuccgccucccag

SEQ ID NO: 851580 - RNA, 21 nt, Human
cucagauaaugagcuuucaag

SEQ ID NO: 851581 - RNA, 23 nt, Human
cugcuuuagccucccgaguagcu

SEQ ID NO: 851582 - RNA, 19 nt, Human
cuguaguuucuccaaaauu

SEQ ID NO: 851583 - RNA, 24 nt, Human
gaguagcugggauuacaggccugc

SEQ ID NO: 851584 - RNA, 18 nt, Human
ggagguugcagugagcug

SEQ ID NO: 851585 - RNA, 20 nt, Human
ggagguugcagugagcuggc

SEQ ID NO: 851586 - RNA, 19 nt, Human
guacuucuuuuuuuucuuu

SEQ ID NO: 851587 - RNA, 22 nt, Human
guagcugggauuacaggccugc

SEQ ID NO: 851588 - RNA, 18 nt, Human
guugaggucaucauggug

SEQ ID NO: 851589 - RNA, 18 nt, Human
uaaauaacauuuuaauga

SEQ ID NO: 851590 - RNA, 21 nt, Human
uacaggccugcaccaccacgc

SEQ ID NO: 851591 - RNA, 19 nt, Human
uacuucuuuuuuuucuuuu

SEQ ID NO: 851592 - RNA, 20 nt, Human
uaguagagacggagguugca

SEQ ID NO: 851593 - RNA, 20 nt, Human
uaguagagacggagguugca

SEQ ID NO: 851594 - RNA, 23 nt, Human
uaguagagacggagguugcagug

SEQ ID NO: 851595 - RNA, 24 nt, Human
ucaccacaaccuccgccucccagg

SEQ ID NO: 851596 - RNA, 25 nt, Human
ucaccacaaccuccgccucccaggu

SEQ ID NO: 851597 - RNA, 27 nt, Human
ucaccacaaccuccgccucccagguuc

SEQ ID NO: 851598 - RNA, 23 nt, Human
ucacuccuguuguccaggaugga

SEQ ID NO: 851599 - RNA, 23 nt, Human
uccaaaauucccugaucauagcu

SEQ ID NO: 851600 - RNA, 21 nt, Human
ucccagguucaagcaauucuc

SEQ ID NO: 851601 - RNA, 24 nt, Human
ucccagguucaagcaauucuccug

SEQ ID NO: 851602 - RNA, 24 nt, Human
ucccgaguagcugggauuacaggc

SEQ ID NO: 851603 - RNA, 18 nt, Human
ucucuggaaccucucagu

SEQ ID NO: 851604 - RNA, 19 nt, Human
ucucuggaaccucucaguu

SEQ ID NO: 851605 - RNA, 20 nt, Human
ucuggaaccucucaguuucc

SEQ ID NO: 851606 - RNA, 28 nt, Human
ucuuguacuucuuuuuuuucuuuuuuuc

SEQ ID NO: 851607 - RNA, 23 nt, Human
ugaccuaagagaguuguuuugag

SEQ ID NO: 851608 - RNA, 19 nt, Human
ugcugaaaaguccuucuca

SEQ ID NO: 851609 - RNA, 24 nt, Human
uggaaauaccaacagcaagguuuc

SEQ ID NO: 851610 - RNA, 23 nt, Human
uggagugcaauggcgcgaucucg

SEQ ID NO: 851611 - RNA, 24 nt, Human
uggagugcaauggcgcgaucucgg

SEQ ID NO: 851612 - RNA, 24 nt, Human
uggcgcgaucucggcucaccacaa

SEQ ID NO: 851613 - RNA, 21 nt, Human
ugggauuacaggccugcacca

SEQ ID NO: 851614 - RNA, 24 nt, Human
ugggauuacaggccugcaccacca

SEQ ID NO: 851615 - RNA, 24 nt, Human
ugguuacacacauugaaaaaugac

SEQ ID NO: 851616 - RNA, 21 nt, Human
uguauuuuuaguagagacgga

SEQ ID NO: 851617 - RNA, 18 nt, Human
uuacaggccugcaccacc

SEQ ID NO: 851618 - RNA, 23 nt, Human
uuaguagagacggagguugcagu

SEQ ID NO: 851619 - RNA, 19 nt, Human
uuccagggauguccaacac

SEQ ID NO: 851620 - RNA, 24 nt, Human
uucucuggaaccucucaguuucca

SEQ ID NO: 851621 - RNA, 24 nt, Human
uucuuuuuuuucuuuuuuuuuuuu

SEQ ID NO: 851622 - RNA, 29 nt, Human
uucuuuuuuuucuuuuuuuuuuuugagaa

SEQ ID NO: 851623 - RNA, 23 nt, Human
uuguauuuuuaguagagacggag

SEQ ID NO: 851624 - RNA, 24 nt, Human
uuuagccucccgaguagcugggau

SEQ ID NO: 851625 - RNA, 18 nt, Human
uuuguauuuuuaguagag

SEQ ID NO: 851626 - RNA, 19 nt, Human
uuuguauuuuuaguagaga

SEQ ID NO: 851627 - RNA, 18 nt, Human
uuuucuuuuuuuuuuuug

SEQ ID NO: 851628 - RNA, 23 nt, Human
uuuuuaguagagacggagguugc

SEQ ID NO: 851629 - RNA, 26 nt, Human
uuuuuuuuuuuugagacggaguuuca

SEQ ID NO: 851630 - RNA, 21 nt, Human
uuuuuuuuuuuuuuuuuauuu

SEQ ID NO: 851631 - RNA, 24 nt, Human
aaaacaaaaacccuaggaauugaa

SEQ ID NO: 851632 - RNA, 23 nt, Human
aaacaaaaacaaaaacccuagga

SEQ ID NO: 851633 - RNA, 21 nt, Human
aaucgcuugaacccaggaagu

SEQ ID NO: 851634 - RNA, 18 nt, Human
aauuagccaggcauggug

SEQ ID NO: 851635 - RNA, 28 nt, Human
acaaaaacaaaaacccuaggaauugaaa

SEQ ID NO: 851636 - RNA, 24 nt, Human
acagagcaauauuacaucucaaaa

SEQ ID NO: 851637 - RNA, 21 nt, Human
acaucucaaaaacaaaaacaa

SEQ ID NO: 851638 - RNA, 22 nt, Human
accacugcacuccagccugggc

SEQ ID NO: 851639 - RNA, 24 nt, Human
acugcacuccagccugggcaacag

SEQ ID NO: 851640 - RNA, 24 nt, Human
acugcacuccagccugggcaacag

SEQ ID NO: 851641 - RNA, 22 nt, Human
agaaucgcuugaacccaggaag

SEQ ID NO: 851642 - RNA, 21 nt, Human
agcagaugacuugaggucagg

SEQ ID NO: 851643 - RNA, 23 nt, Human
agccaggcaugguggcuggugcc

SEQ ID NO: 851644 - RNA, 23 nt, Human
agccugggcaacagagcaauauu

SEQ ID NO: 851645 - RNA, 23 nt, Human
aggcaggagaaucgcuugaaccc

SEQ ID NO: 851646 - RNA, 24 nt, Human
aggcaggagaaucgcuugaaccca

SEQ ID NO: 851647 - RNA, 24 nt, Human
aggcaugguggcuggugccuguaa

SEQ ID NO: 851648 - RNA, 20 nt, Human
aggcugaggcaggagaaucg

SEQ ID NO: 851649 - RNA, 24 nt, Human
aggcugaggcaggagaaucgcuug

SEQ ID NO: 851650 - RNA, 24 nt, Human
aucauaccacugcacuccagccug

SEQ ID NO: 851651 - RNA, 18 nt, Human
caaaaacccuaggaauug

SEQ ID NO: 851652 - RNA, 24 nt, Human
caacauggagaaaccacaucucua

SEQ ID NO: 851653 - RNA, 19 nt, Human
cacugcacuccagccuggg

SEQ ID NO: 851654 - RNA, 21 nt, Human
cacugcacuccagccugggca

SEQ ID NO: 851655 - RNA, 22 nt, Human
cacugcacuccagccugggcaa

SEQ ID NO: 851656 - RNA, 23 nt, Human
cacugcacuccagccugggcaac

SEQ ID NO: 851657 - RNA, 24 nt, Human
cacugcacuccagccugggcaaca

SEQ ID NO: 851658 - RNA, 27 nt, Human
cacugcacuccagccugggcaacagag

SEQ ID NO: 851659 - RNA, 19 nt, Human
cacuuugugaggucaaggc

SEQ ID NO: 851660 - RNA, 23 nt, Human
cagaugacuugaggucaggauuu

SEQ ID NO: 851661 - RNA, 20 nt, Human
cagcacuuugugaggucaag

SEQ ID NO: 851662 - RNA, 23 nt, Human
cagcacuuugugaggucaaggcc

SEQ ID NO: 851663 - RNA, 24 nt, Human
cagccuggccaacauggagaaacc

SEQ ID NO: 851664 - RNA, 24 nt, Human
caucucaaaaacaaaaacaaaaac

SEQ ID NO: 851665 - RNA, 20 nt, Human
ccacugcacuccagccuggg

SEQ ID NO: 851666 - RNA, 21 nt, Human
ccacugcacuccagccugggc

SEQ ID NO: 851667 - RNA, 23 nt, Human
ccacugcacuccagccugggcaa

SEQ ID NO: 851668 - RNA, 24 nt, Human
ccacugcacuccagccugggcaac

SEQ ID NO: 851669 - RNA, 24 nt, Human
ccagcagaugacuugaggucagga

SEQ ID NO: 851670 - RNA, 23 nt, Human
ccgggccggacggggccgcagcu

SEQ ID NO: 851671 - RNA, 21 nt, Human
ccuggccaacauggagaaacc

SEQ ID NO: 851672 - RNA, 22 nt, Human
ccuggccaacauggagaaacca

SEQ ID NO: 851673 - RNA, 18 nt, Human
ccuguaaucccagcuacu

SEQ ID NO: 851674 - RNA, 18 nt, Human
ccuguaaucccagcuacu

SEQ ID NO: 851675 - RNA, 22 nt, Human
ccuguaaucccagcuacugggg

SEQ ID NO: 851676 - RNA, 22 nt, Human
cucaaaaacaaaaacaaaaacc

SEQ ID NO: 851677 - RNA, 23 nt, Human
cucaaaaacaaaaacaaaaaccc

SEQ ID NO: 851678 - RNA, 20 nt, Human
cuccaauuccaacccaugcc

SEQ ID NO: 851679 - RNA, 21 nt, Human
cugauggaagcaggauucucu

SEQ ID NO: 851680 - RNA, 19 nt, Human
gagaaaccacaucucuacu

SEQ ID NO: 851681 - RNA, 23 nt, Human
gagaucauaccacugcacuccag

SEQ ID NO: 851682 - RNA, 18 nt, Human
gaggucaaggccagcaga

SEQ ID NO: 851683 - RNA, 22 nt, Human
gaggucaaggccagcagaugac

SEQ ID NO: 851684 - RNA, 24 nt, Human
gaugacuugaggucaggauuuuga

SEQ ID NO: 851685 - RNA, 24 nt, Human
gcacuccagccugggcaacagagc

SEQ ID NO: 851686 - RNA, 19 nt, Human
gcagcuccuggcagaccgc

SEQ ID NO: 851687 - RNA, 22 nt, Human
gcaggagaaucgcuugaaccca

SEQ ID NO: 851688 - RNA, 24 nt, Human
gccaacauggagaaaccacaucuc

SEQ ID NO: 851689 - RNA, 23 nt, Human
ggagaaaccacaucucuacuaaa

SEQ ID NO: 851690 - RNA, 21 nt, Human
ggcuggugccuguaaucccag

SEQ ID NO: 851691 - RNA, 22 nt, Human
gggaggcugaggcaggagaauc

SEQ ID NO: 851692 - RNA, 24 nt, Human
gguggcuggugccuguaaucccag

SEQ ID NO: 851693 - RNA, 24 nt, Human
ggugguugcaguaaggugagauca

SEQ ID NO: 851694 - RNA, 20 nt, Human
uaaaaaaacuuucugcagcc

SEQ ID NO: 851695 - RNA, 25 nt, Human
uaaaaauuuaaacaguuaauacaag

SEQ ID NO: 851696 - RNA, 22 nt, Human
uaccacugcacuccagccuggg

SEQ ID NO: 851697 - RNA, 24 nt, Human
uaccacugcacuccagccugggca

SEQ ID NO: 851698 - RNA, 22 nt, Human
uaguucaugacacuaaacugaa

SEQ ID NO: 851699 - RNA, 20 nt, Human
uaucuuagaaaacaaaucuc

SEQ ID NO: 851700 - RNA, 23 nt, Human
ucauaccacugcacuccagccug

SEQ ID NO: 851701 - RNA, 21 nt, Human
ucggcugggccagcacuuugu

SEQ ID NO: 851702 - RNA, 22 nt, Human
ucuaaaaaaacuuucugcagcc

SEQ ID NO: 851703 - RNA, 25 nt, Human
ucucuacuaaaaauacaaaaaaauu

SEQ ID NO: 851704 - RNA, 21 nt, Human
ugaagugaauaguucaugaca

SEQ ID NO: 851705 - RNA, 21 nt, Human
ugagaccagccuggccaacau

SEQ ID NO: 851706 - RNA, 24 nt, Human
ugagaccagccuggccaacaugga

SEQ ID NO: 851707 - RNA, 21 nt, Human
ugaggaacaguuaguaaccac

SEQ ID NO: 851708 - RNA, 20 nt, Human
ugaggcaggagaaucgcuug

SEQ ID NO: 851709 - RNA, 24 nt, Human
ugaggcaggagaaucgcuugaacc

SEQ ID NO: 851710 - RNA, 25 nt, Human
ugaggcaggagaaucgcuugaaccc

SEQ ID NO: 851711 - RNA, 20 nt, Human
ugccuguaaucccagcuacu

SEQ ID NO: 851712 - RNA, 23 nt, Human
ugccuguaaucccagcuacuggg

SEQ ID NO: 851713 - RNA, 22 nt, Human
uggccaacauggagaaaccaca

SEQ ID NO: 851714 - RNA, 21 nt, Human
uggcuggugccuguaauccca

SEQ ID NO: 851715 - RNA, 22 nt, Human
uggcuggugccuguaaucccag

SEQ ID NO: 851716 - RNA, 24 nt, Human
uggcuggugccuguaaucccagcu

SEQ ID NO: 851717 - RNA, 23 nt, Human
ugggccagcacuuugugagguca

SEQ ID NO: 851718 - RNA, 24 nt, Human
ugguggcuggugccuguaauccca

SEQ ID NO: 851719 - RNA, 21 nt, Human
uuaauacaagaaaaauaugaa

SEQ ID NO: 851720 - RNA, 18 nt, Human
uuagccaggcaugguggc

SEQ ID NO: 851721 - RNA, 25 nt, Human
uuagccaggcaugguggcuggugcc

SEQ ID NO: 851722 - RNA, 19 nt, Human
uuccuuuaugacuccagaa

SEQ ID NO: 851723 - RNA, 29 nt, Human
uuuuuuuuuuuuuuuuuuaguggaugggg

SEQ ID NO: 851724 - RNA, 23 nt, Human
aauuuuuauuuuagacucggggg

SEQ ID NO: 851725 - RNA, 22 nt, Human
acccuguaguucccucuuauug

SEQ ID NO: 851726 - RNA, 19 nt, Human
agccuggcgguuggggacc

SEQ ID NO: 851727 - RNA, 24 nt, Human
agcuggauucuagccugagaccug

SEQ ID NO: 851728 - RNA, 25 nt, Human
aggcauuagauugucaugaggagga

SEQ ID NO: 851729 - RNA, 19 nt, Human
agggacugguuuuguggaa

SEQ ID NO: 851730 - RNA, 18 nt, Human
aggugcugcuuaggugag

SEQ ID NO: 851731 - RNA, 21 nt, Human
aucacggccuccagcuccauc

SEQ ID NO: 851732 - RNA, 20 nt, Human
auggcugcugcaacccuagu

SEQ ID NO: 851733 - RNA, 21 nt, Human
auucuagccugagaccuggcu

SEQ ID NO: 851734 - RNA, 25 nt, Human
auucuguccuuucuauggcugcucc

SEQ ID NO: 851735 - RNA, 19 nt, Human
caugaggugcagcucaggc

SEQ ID NO: 851736 - RNA, 19 nt, Human
cccuggagcccgugucccu

SEQ ID NO: 851737 - RNA, 20 nt, Human
ccggggccgggucaggggcu

SEQ ID NO: 851738 - RNA, 24 nt, Human
ccuccagcuccauccacggugugc

SEQ ID NO: 851739 - RNA, 21 nt, Human
ccugcugcguggcccgguucc

SEQ ID NO: 851740 - RNA, 20 nt, Human
ccuggccuugggagcaggag

SEQ ID NO: 851741 - RNA, 18 nt, Human
cgggucaggggcugcggg

SEQ ID NO: 851742 - RNA, 21 nt, Human
cguccggggccgggucagggg

SEQ ID NO: 851743 - RNA, 21 nt, Human
cuccgagggagccaccucccu

SEQ ID NO: 851744 - RNA, 18 nt, Human
cugccagggacagugagc

SEQ ID NO: 851745 - RNA, 20 nt, Human
cuggagaaucuaaugcagug

SEQ ID NO: 851746 - RNA, 20 nt, Human
cuuucuauggcugcugcaac

SEQ ID NO: 851747 - RNA, 20 nt, Human
gagcaggagggggagccggc

SEQ ID NO: 851748 - RNA, 24 nt, Human
gaggcaacggccagagggcggugg

SEQ ID NO: 851749 - RNA, 25 nt, Human
gagguggcugggagccaaagggcag

SEQ ID NO: 851750 - RNA, 20 nt, Human
gaucacggccuccagcucca

SEQ ID NO: 851751 - RNA, 20 nt, Human
gccagagggcgguggugcgg

SEQ ID NO: 851752 - RNA, 19 nt, Human
gcccuggagcccguguccc

SEQ ID NO: 851753 - RNA, 21 nt, Human
gccuuuuuggcaccagggacu

SEQ ID NO: 851754 - RNA, 19 nt, Human
gcgcccacugccgcgcucc

SEQ ID NO: 851755 - RNA, 19 nt, Human
gcgguggugcggccggcgc

SEQ ID NO: 851756 - RNA, 19 nt, Human
gcuccguccggggccgggu

SEQ ID NO: 851757 - RNA, 22 nt, Human
ggccagguaccgguccgcagcc

SEQ ID NO: 851758 - RNA, 19 nt, Human
ggccuugggagcaggaggg

SEQ ID NO: 851759 - RNA, 22 nt, Human
ggcgguggugcggccggcgcuc

SEQ ID NO: 851760 - RNA, 20 nt, Human
gggcagugguccccagccuu

SEQ ID NO: 851761 - RNA, 26 nt, Human
gugcggccggcgcuccguccggggcc

SEQ ID NO: 851762 - RNA, 19 nt, Human
guggaagacaauuuuucca

SEQ ID NO: 851763 - RNA, 20 nt, Human
guuuagggauaaaacuguuc

SEQ ID NO: 851764 - RNA, 18 nt, Human
uaaaacuguuccaccccc

SEQ ID NO: 851765 - RNA, 19 nt, Human
uaccgguccgcagccuggc

SEQ ID NO: 851766 - RNA, 22 nt, Human
uccauccacggugugcaaagga

SEQ ID NO: 851767 - RNA, 21 nt, Human
ucuguccuuucuauggcugcu

SEQ ID NO: 851768 - RNA, 21 nt, Human
ucugugggcagcugccaggga

SEQ ID NO: 851769 - RNA, 23 nt, Human
ugaaccacccuguaguucccuuc

SEQ ID NO: 851770 - RNA, 19 nt, Human
ugacaccaaguagcgacga

SEQ ID NO: 851771 - RNA, 23 nt, Human
ugacaugaggugcagcuuccacg

SEQ ID NO: 851772 - RNA, 24 nt, Human
ugaggagcgcgcagccuggauccc

SEQ ID NO: 851773 - RNA, 22 nt, Human
uggagcccgugucccugucucc

SEQ ID NO: 851774 - RNA, 23 nt, Human
uggcaccagggacugguuuugug

SEQ ID NO: 851775 - RNA, 25 nt, Human
uggcaccagggacugguuuugugga

SEQ ID NO: 851776 - RNA, 24 nt, Human
uggcugggagccaaagggcaggug

SEQ ID NO: 851777 - RNA, 19 nt, Human
uggcuucuggcuggacccc

SEQ ID NO: 851778 - RNA, 20 nt, Human
uggcuucuggcuggaccccu

SEQ ID NO: 851779 - RNA, 18 nt, Human
uucuauggcugcugcaac

SEQ ID NO: 851780 - RNA, 20 nt, Human
uugcgcgcgugcgugcgcug

SEQ ID NO: 851781 - RNA, 27 nt, Human
uuuuuuuuuuucuuuuuuaaaaaauuu

SEQ ID NO: 851782 - RNA, 24 nt, Human
uuuuuuuuuuuuuuuuuucuuuuu

SEQ ID NO: 851783 - RNA, 25 nt, Human
aaacgcucaacaaauaucccggaac

SEQ ID NO: 851784 - RNA, 22 nt, Human
aaccugcguuacuacucaucuc

SEQ ID NO: 851785 - RNA, 18 nt, Human
aagugucucaucuggauu

SEQ ID NO: 851786 - RNA, 30 nt, Human
acaagcccucagagcagaagccacaaggag

SEQ ID NO: 851787 - RNA, 18 nt, Human
acccgcccccgccgccgc

SEQ ID NO: 851788 - RNA, 19 nt, Human
acccgcccccgccgccgcu

SEQ ID NO: 851789 - RNA, 20 nt, Human
aggaaucaagcccgugagaa

SEQ ID NO: 851790 - RNA, 19 nt, Human
aggacaccccgccgagggc

SEQ ID NO: 851791 - RNA, 20 nt, Human
aggcaggaaucaagcccgug

SEQ ID NO: 851792 - RNA, 22 nt, Human
agugauucuuuugggcaacauu

SEQ ID NO: 851793 - RNA, 18 nt, Human
caaauaucccggaacccc

SEQ ID NO: 851794 - RNA, 21 nt, Human
caacaggcggcccgagucccu

SEQ ID NO: 851795 - RNA, 24 nt, Human
cacacacugggcaaaaaaaguccc

SEQ ID NO: 851796 - RNA, 24 nt, Human
caccagcaacaggcggcccgaguc

SEQ ID NO: 851797 - RNA, 18 nt, Human
cagagcccggagacggga

SEQ ID NO: 851798 - RNA, 22 nt, Human
cagcucgccgggagcgcaccuu

SEQ ID NO: 851799 - RNA, 18 nt, Human
caggacaccccgccgagg

SEQ ID NO: 851800 - RNA, 23 nt, Human
ccaccagcaacaggcggcccgag

SEQ ID NO: 851801 - RNA, 26 nt, Human
ccagcaacaggcggcccgagucccuc

SEQ ID NO: 851802 - RNA, 25 nt, Human
cccggaaccccaaucuguaggcagg

SEQ ID NO: 851803 - RNA, 18 nt, Human
ccgcccccgccgccgcuc

SEQ ID NO: 851804 - RNA, 19 nt, Human
ccgcccccgccgccgcucc

SEQ ID NO: 851805 - RNA, 19 nt, Human
ccgccgccgcuccaccagc

SEQ ID NO: 851806 - RNA, 26 nt, Human
ccggcagagcccggagacgggaggcg

SEQ ID NO: 851807 - RNA, 25 nt, Human
cgagggcccggcagagcuggagacc

SEQ ID NO: 851808 - RNA, 20 nt, Human
cggggaaggacggcgcugcc

SEQ ID NO: 851809 - RNA, 22 nt, Human
cucagagcagaagccacaagga

SEQ ID NO: 851810 - RNA, 21 nt, Human
gacaagggcagcucgccggga

SEQ ID NO: 851811 - RNA, 22 nt, Human
gccaaagacaagggcagcucgc

SEQ ID NO: 851812 - RNA, 21 nt, Human
ggaaggacggcgcugccuggg

SEQ ID NO: 851813 - RNA, 22 nt, Human
ggcacacacugggcaaaaaaag

SEQ ID NO: 851814 - RNA, 19 nt, Human
gggcaaaaaaagucccucu

SEQ ID NO: 851815 - RNA, 21 nt, Human
uaacgccuaucguaaacgcuc

SEQ ID NO: 851816 - RNA, 23 nt, Human
uaacucaggcacacacugggcaa

SEQ ID NO: 851817 - RNA, 23 nt, Human
uacgucagaugucugcugggaac

SEQ ID NO: 851818 - RNA, 19 nt, Human
ucagagcagaagccacaag

SEQ ID NO: 851819 - RNA, 24 nt, Human
ucccucugugccaaagacaagggc

SEQ ID NO: 851820 - RNA, 18 nt, Human
ucugugccaaagacaagg

SEQ ID NO: 851821 - RNA, 23 nt, Human
ugagaaagcgcgugugccggagg

SEQ ID NO: 851822 - RNA, 19 nt, Human
ugccuggggcucacugcgg

SEQ ID NO: 851823 - RNA, 21 nt, Human
ugcugggaacacaagcccuca

SEQ ID NO: 851824 - RNA, 18 nt, Human
ugggaacacaagcccuca

SEQ ID NO: 851825 - RNA, 21 nt, Human
uucaucuuuaauguuugcgac

SEQ ID NO: 851826 - RNA, 25 nt, Human
uuuuuggcuguaaaaaaaauucauc

SEQ ID NO: 851827 - RNA, 18 nt, Human
uuuuuuuuuuuuuuuuug

SEQ ID NO: 851828 - RNA, 21 nt, Human
uuuuuuuuuuuuuuuuuggcu

SEQ ID NO: 851829 - RNA, 22 nt, Human
uuuuuuuuuuuuuuuuuuuggc

SEQ ID NO: 851830 - RNA, 21 nt, Human
aagcacuuuaaugcauucacc

SEQ ID NO: 851831 - RNA, 18 nt, Human
acacagacauggccacag

SEQ ID NO: 851832 - RNA, 21 nt, Human
acauggccacagcgcaggcac

SEQ ID NO: 851833 - RNA, 23 nt, Human
accaacccacagucccugcccgc

SEQ ID NO: 851834 - RNA, 23 nt, Human
agagaggccagcccccaucugga

SEQ ID NO: 851835 - RNA, 18 nt, Human
aggcugagcccgcacaca

SEQ ID NO: 851836 - RNA, 20 nt, Human
auggccacagcgcaggcacc

SEQ ID NO: 851837 - RNA, 18 nt, Human
caacccacagucccugcc

SEQ ID NO: 851838 - RNA, 18 nt, Human
caagagaggccagccccc

SEQ ID NO: 851839 - RNA, 21 nt, Human
caagagaggccagcccccauc

SEQ ID NO: 851840 - RNA, 20 nt, Human
caccgcccucacccggccgc

SEQ ID NO: 851841 - RNA, 18 nt, Human
caccgcucccucccaccg

SEQ ID NO: 851842 - RNA, 21 nt, Human
cacuuuaaugcauucaccaac

SEQ ID NO: 851843 - RNA, 21 nt, Human
cagcgcaggcaccgcucccuc

SEQ ID NO: 851844 - RNA, 21 nt, Human
caucuggaggcuccuauggcu

SEQ ID NO: 851845 - RNA, 21 nt, Human
cauggccacagcgcaggcacc

SEQ ID NO: 851846 - RNA, 23 nt, Human
cccacaccuaguguguccaggaa

SEQ ID NO: 851847 - RNA, 23 nt, Human
cccaccgcccucacccggccgcc

SEQ ID NO: 851848 - RNA, 18 nt, Human
ccggcccccugcguacac

SEQ ID NO: 851849 - RNA, 21 nt, Human
ccggccgccggugcaggaaga

SEQ ID NO: 851850 - RNA, 18 nt, Human
ccggccggggccggccug

SEQ ID NO: 851851 - RNA, 22 nt, Human
ccuauggcuucccacaccuagu

SEQ ID NO: 851852 - RNA, 19 nt, Human
ccucccaccgcccucaccc

SEQ ID NO: 851853 - RNA, 25 nt, Human
cguacacagacauggccacagcgca

SEQ ID NO: 851854 - RNA, 20 nt, Human
cucccucccaccgcccucac

SEQ ID NO: 851855 - RNA, 18 nt, Human
cuucgcggggccccggcc

SEQ ID NO: 851856 - RNA, 25 nt, Human
guccggccggggccggccugagggc

SEQ ID NO: 851857 - RNA, 20 nt, Human
ucccacaccuagugugucca

SEQ ID NO: 851858 - RNA, 21 nt, Human
ugagggcacagcuucgcgggg

SEQ ID NO: 851859 - RNA, 25 nt, Human
ugagggcacagcuucgcggggcccc

SEQ ID NO: 851860 - RNA, 22 nt, Human
ugcguacacagacauggccaca

SEQ ID NO: 851861 - RNA, 19 nt, Human
uguccaggaaggcugagcc

SEQ ID NO: 851862 - RNA, 24 nt, Human
uguccggccggggccgggaggucc

SEQ ID NO: 851863 - RNA, 21 nt, Human
uuuuuuuuuuccccaaagcac

SEQ ID NO: 851864 - RNA, 23 nt, Human
uuuuuuuuuuuuuuuuuucccca

SEQ ID NO: 851865 - RNA, 21 nt, Human
aaucagccugccuggaaaccu

SEQ ID NO: 851866 - RNA, 19 nt, Human
agcuggguuuugcacugag

SEQ ID NO: 851867 - RNA, 19 nt, Human
auaaaguuuaaaggccuau

SEQ ID NO: 851868 - RNA, 18 nt, Human
caaaaaccuagagauaac

SEQ ID NO: 851869 - RNA, 22 nt, Human
cagcgaaauuucccgaaggucc

SEQ ID NO: 851870 - RNA, 24 nt, Human
ccacuagccuuuuuaauuuggucu

SEQ ID NO: 851871 - RNA, 22 nt, Human
gacuuagugaaauuacaggcau

SEQ ID NO: 851872 - RNA, 20 nt, Human
gaggaugcuacacagccacu

SEQ ID NO: 851873 - RNA, 21 nt, Human
gccugccuggaaaccucacaa

SEQ ID NO: 851874 - RNA, 20 nt, Human
gcuacacagccacuagccuu

SEQ ID NO: 851875 - RNA, 20 nt, Human
ggaacgcuuugcaccgagag

SEQ ID NO: 851876 - RNA, 20 nt, Human
uacacagccacuagccuuuu

SEQ ID NO: 851877 - RNA, 20 nt, Human
uaccaggugaaaauucugga

SEQ ID NO: 851878 - RNA, 22 nt, Human
ucaaugccagccgguauccagc

SEQ ID NO: 851879 - RNA, 24 nt, Human
ucacaaggcucagggacgcugggu

SEQ ID NO: 851880 - RNA, 24 nt, Human
ucacacaaaaaccuagagauaaca

SEQ ID NO: 851881 - RNA, 18 nt, Human
ugaaaauucuggagcugg

SEQ ID NO: 851882 - RNA, 24 nt, Human
ugaaauuacaggcauaggccucuu

SEQ ID NO: 851883 - RNA, 25 nt, Human
ugaaauuacaggcauaggccucuua

SEQ ID NO: 851884 - RNA, 25 nt, Human
uggguuugucaaugccaaccacagg

SEQ ID NO: 851885 - RNA, 21 nt, Human
uucuggagcuggguuuugcac

SEQ ID NO: 851886 - RNA, 27 nt, Human
uuuuuuuuuuuuuuuuggauuguuuuu

SEQ ID NO: 851887 - RNA, 18 nt, Human
uuuuuuuuuuuuuuuuug

SEQ ID NO: 851888 - RNA, 24 nt, Human
aaagugcugggauuacaggcguga

SEQ ID NO: 851889 - RNA, 19 nt, Human
aagugcugggauuacaggc

SEQ ID NO: 851890 - RNA, 19 nt, Human
aagugcugggauuacaggc

SEQ ID NO: 851891 - RNA, 26 nt, Human
aagugcugggauuacaggcgugagcc

SEQ ID NO: 851892 - RNA, 21 nt, Human
acagcuucuuccagaaccagu

SEQ ID NO: 851893 - RNA, 19 nt, Human
acaggcacccgccaccacg

SEQ ID NO: 851894 - RNA, 24 nt, Human
accauguuggcuaggcuggucucg

SEQ ID NO: 851895 - RNA, 25 nt, Human
acccgccucagccucccaaagugcu

SEQ ID NO: 851896 - RNA, 19 nt, Human
acccucaaacaccgggaag

SEQ ID NO: 851897 - RNA, 22 nt, Human
accggcucccaccucggcguac

SEQ ID NO: 851898 - RNA, 21 nt, Human
agaaaugacaucgucugcagg

SEQ ID NO: 851899 - RNA, 19 nt, Human
agcuccuuaaaggcagauu

SEQ ID NO: 851900 - RNA, 19 nt, Human
aggcagauuccuuuauucu

SEQ ID NO: 851901 - RNA, 19 nt, Human
agggauuccaggucccggc

SEQ ID NO: 851902 - RNA, 18 nt, Human
aggggugaacuccccggc

SEQ ID NO: 851903 - RNA, 24 nt, Human
aggugauccacccgccucagccuc

SEQ ID NO: 851904 - RNA, 21 nt, Human
aguagaggcgagguuucacca

SEQ ID NO: 851905 - RNA, 22 nt, Human
aguagaggcgagguuucaccau

SEQ ID NO: 851906 - RNA, 18 nt, Human
aguagccgggauuacagg

SEQ ID NO: 851907 - RNA, 19 nt, Human
auggucaauccccuauaac

SEQ ID NO: 851908 - RNA, 24 nt, Human
auuuuuguauuuuuaguagaggcg

SEQ ID NO: 851909 - RNA, 24 nt, Human
caaagugcugggauuacaggcgug

SEQ ID NO: 851910 - RNA, 22 nt, Human
caaccgcagugcacgcaaagcc

SEQ ID NO: 851911 - RNA, 22 nt, Human
caagcgaaucuccugccucagc

SEQ ID NO: 851912 - RNA, 23 nt, Human
cacagcccuacugacgagcccga

SEQ ID NO: 851913 - RNA, 24 nt, Human
caccacgccuggcuaauuuuugua

SEQ ID NO: 851914 - RNA, 21 nt, Human
caccauguuggcuaggcuggu

SEQ ID NO: 851915 - RNA, 24 nt, Human
caccauguuggcuaggcuggucuc

SEQ ID NO: 851916 - RNA, 23 nt, Human
cacccgccucagccucccaaagu

SEQ ID NO: 851917 - RNA, 21 nt, Human
cacugcaacuucagccuccca

SEQ ID NO: 851918 - RNA, 22 nt, Human
cacugcaacuucagccucccag

SEQ ID NO: 851919 - RNA, 19 nt, Human
cagcccuacugacgagccc

SEQ ID NO: 851920 - RNA, 20 nt, Human
cagccuccugaguagccggg

SEQ ID NO: 851921 - RNA, 21 nt, Human
caggcacccgccaccacgccu

SEQ ID NO: 851922 - RNA, 22 nt, Human
ccaaagugcugggauuacaggc

SEQ ID NO: 851923 - RNA, 22 nt, Human
ccaaagugcugggauuacaggc

SEQ ID NO: 851924 - RNA, 24 nt, Human
ccaaagugcugggauuacaggcgu

SEQ ID NO: 851925 - RNA, 26 nt, Human
ccacccgccucagccucccaaagugc

SEQ ID NO: 851926 - RNA, 22 nt, Human
cccaaccgcagugcacgcaaag

SEQ ID NO: 851927 - RNA, 23 nt, Human
cccagguucaagcgaaucucccc

SEQ ID NO: 851928 - RNA, 23 nt, Human
cccagguucaagcgaaucuccug

SEQ ID NO: 851929 - RNA, 19 nt, Human
ccccuaagccgacugugag

SEQ ID NO: 851930 - RNA, 24 nt, Human
ccgccucagccucccaaagugcug

SEQ ID NO: 851931 - RNA, 24 nt, Human
ccucccagguucaagcgaaucucc

SEQ ID NO: 851932 - RNA, 22 nt, Human
ccugaccuuaggugauccaccc

SEQ ID NO: 851933 - RNA, 19 nt, Human
ccugaguagccgggauuac

SEQ ID NO: 851934 - RNA, 23 nt, Human
ccugaguagccgggauuacaggc

SEQ ID NO: 851935 - RNA, 24 nt, Human
ccugaguagccgggauuacaggca

SEQ ID NO: 851936 - RNA, 23 nt, Human
ccugccucagccuccugaguagc

SEQ ID NO: 851937 - RNA, 19 nt, Human
cgagguuucaccauguugg

SEQ ID NO: 851938 - RNA, 20 nt, Human
cgagguuucaccauguuggc

SEQ ID NO: 851939 - RNA, 24 nt, Human
cgagguuucaccauguuggcuagg

SEQ ID NO: 851940 - RNA, 20 nt, Human
cggcucacugcaacuucagc

SEQ ID NO: 851941 - RNA, 21 nt, Human
cgggauuacaggcacccgcca

SEQ ID NO: 851942 - RNA, 22 nt, Human
cgggauuacaggcacccgccac

SEQ ID NO: 851943 - RNA, 22 nt, Human
cgucuaaacaaccaggaguggg

SEQ ID NO: 851944 - RNA, 24 nt, Human
cucacugcaacuucagccucccag

SEQ ID NO: 851945 - RNA, 24 nt, Human
cugcaacuucagccucccagguuc

SEQ ID NO: 851946 - RNA, 24 nt, Human
gaccuuaggugauccacccgccuc

SEQ ID NO: 851947 - RNA, 23 nt, Human
gagguuucaccauguuggcuagg

SEQ ID NO: 851948 - RNA, 25 nt, Human
gaguagccgggauuacaggcacccg

SEQ ID NO: 851949 - RNA, 18 nt, Human
gauuacaggcgugagcca

SEQ ID NO: 851950 - RNA, 22 nt, Human
gauuacaggcgugagccaccgc

SEQ ID NO: 851951 - RNA, 23 nt, Human
gauuacaggcgugagccaccgca

SEQ ID NO: 851952 - RNA, 20 nt, Human
gcccaaugcauguuuugagu

SEQ ID NO: 851953 - RNA, 19 nt, Human
gcccaggcuggaguacaau

SEQ ID NO: 851954 - RNA, 20 nt, Human
gcccaggcuggaguacaaug

SEQ ID NO: 851955 - RNA, 18 nt, Human
gcccgaacccucaaacac

SEQ ID NO: 851956 - RNA, 23 nt, Human
gccucagccucccaaagugcugg

SEQ ID NO: 851957 - RNA, 20 nt, Human
gccucagccuccugaguagc

SEQ ID NO: 851958 - RNA, 24 nt, Human
gcgaaucuccugccucagccuccu

SEQ ID NO: 851959 - RNA, 22 nt, Human
gcgagguuucaccauguuggcu

SEQ ID NO: 851960 - RNA, 19 nt, Human
gcucaucgcccaggcugga

SEQ ID NO: 851961 - RNA, 19 nt, Human
gcuggaguacaauggcgcg

SEQ ID NO: 851962 - RNA, 22 nt, Human
ggaguuuugcucaucgcccagg

SEQ ID NO: 851963 - RNA, 24 nt, Human
ggcuggucucgaacuccugaccuu

SEQ ID NO: 851964 - RNA, 24 nt, Human
gggaggcccgaacccucaaacacc

SEQ ID NO: 851965 - RNA, 23 nt, Human
gggauuacaggcacccgccacca

SEQ ID NO: 851966 - RNA, 26 nt, Human
gggcggagccuggcgcuggcccggcg

SEQ ID NO: 851967 - RNA, 19 nt, Human
ggucucgaacuccugaccu

SEQ ID NO: 851968 - RNA, 24 nt, Human
gugauccacccgccucagccuccc

SEQ ID NO: 851969 - RNA, 23 nt, Human
guuuugcucaucgcccaggcugg

SEQ ID NO: 851970 - RNA, 24 nt, Human
guuuugcucaucgcccaggcugga

SEQ ID NO: 851971 - RNA, 21 nt, Human
uaaauguccugguuuugaaaa

SEQ ID NO: 851972 - RNA, 23 nt, Human
uaauuuuuguauuuuuaguagag

SEQ ID NO: 851973 - RNA, 18 nt, Human
uacagcuucuuccagaac

SEQ ID NO: 851974 - RNA, 22 nt, Human
uacaggcacccgccaccacgcc

SEQ ID NO: 851975 - RNA, 23 nt, Human
uacaggcgugagccaccgcaccc

SEQ ID NO: 851976 - RNA, 22 nt, Human
uagaggcgagguuucaccaugu

SEQ ID NO: 851977 - RNA, 24 nt, Human
uaguagaggcgagguuucaccaug

SEQ ID NO: 851978 - RNA, 25 nt, Human
uauucuguuuuucccauacuccuca

SEQ ID NO: 851979 - RNA, 22 nt, Human
uauuuaguauucuuuacagcuu

SEQ ID NO: 851980 - RNA, 18 nt, Human
ucacugcaacuucagccu

SEQ ID NO: 851981 - RNA, 19 nt, Human
ucacugcaacuucagccuc

SEQ ID NO: 851982 - RNA, 20 nt, Human
ucacugcaacuucagccucc

SEQ ID NO: 851983 - RNA, 23 nt, Human
ucacugcaacuucagccucccag

SEQ ID NO: 851984 - RNA, 24 nt, Human
ucacugcaacuucagccucccagg

SEQ ID NO: 851985 - RNA, 21 nt, Human
uccacccgccucagccuccca

SEQ ID NO: 851986 - RNA, 24 nt, Human
ucccaaagugcugggauuacaggc

SEQ ID NO: 851987 - RNA, 21 nt, Human
ucccagguucaagcgaaucuc

SEQ ID NO: 851988 - RNA, 24 nt, Human
ucccagguucaagcgaaucuccug

SEQ ID NO: 851989 - RNA, 24 nt, Human
uccugaguagccgggauuacaggc

SEQ ID NO: 851990 - RNA, 19 nt, Human
uccugccuuagaggaauac

SEQ ID NO: 851991 - RNA, 24 nt, Human
ucuccugccucagccuccugagua

SEQ ID NO: 851992 - RNA, 23 nt, Human
ucucgaacuccugaccuuaggug

SEQ ID NO: 851993 - RNA, 24 nt, Human
ugaccuuaggugauccacccgccu

SEQ ID NO: 851994 - RNA, 19 nt, Human
ugcaacuucagccucccag

SEQ ID NO: 851995 - RNA, 18 nt, Human
ugcaggaagaggcgacag

SEQ ID NO: 851996 - RNA, 24 nt, Human
ugccucagccuccugaguagccgg

SEQ ID NO: 851997 - RNA, 24 nt, Human
ugcugggauuacaggcgugagcca

SEQ ID NO: 851998 - RNA, 24 nt, Human
uggaguacaauggcgcgaucucgg

SEQ ID NO: 851999 - RNA, 23 nt, Human
uggaguuuugcucaucgcccagg

SEQ ID NO: 852000 - RNA, 24 nt, Human
uggcuaggcuggucucgaacuccu

SEQ ID NO: 852001 - RNA, 18 nt, Human
ugggauuacaggcgugag

SEQ ID NO: 852002 - RNA, 19 nt, Human
ugggauuacaggcgugagc

SEQ ID NO: 852003 - RNA, 21 nt, Human
ugggauuacaggcgugagcca

SEQ ID NO: 852004 - RNA, 22 nt, Human
ugggauuacaggcgugagccac

SEQ ID NO: 852005 - RNA, 23 nt, Human
ugggauuacaggcgugagccacc

SEQ ID NO: 852006 - RNA, 24 nt, Human
ugggauuacaggcgugagccaccg

SEQ ID NO: 852007 - RNA, 24 nt, Human
uuaguagaggcgagguuucaccau

SEQ ID NO: 852008 - RNA, 18 nt, Human
uucaagcgaaucuccugc

SEQ ID NO: 852009 - RNA, 19 nt, Human
uucuuccagaaccagucug

SEQ ID NO: 852010 - RNA, 20 nt, Human
uugcucaucgcccaggcugg

SEQ ID NO: 852011 - RNA, 21 nt, Human
uugcucaucgcccaggcugga

SEQ ID NO: 852012 - RNA, 22 nt, Human
uuguaagcuccuuaaaggcaga

SEQ ID NO: 852013 - RNA, 23 nt, Human
uuuauucuguuuuucccauacuc

SEQ ID NO: 852014 - RNA, 24 nt, Human
uuucaccauguuggcuaggcuggu

SEQ ID NO: 852015 - RNA, 24 nt, Human
uuugcucaucgcccaggcuggagu

SEQ ID NO: 852016 - RNA, 23 nt, Human
uuuugcucaucgcccaggcugga

SEQ ID NO: 852017 - RNA, 24 nt, Human
uuuuuaguagaggcgagguuucac

SEQ ID NO: 852018 - RNA, 20 nt, Human
uuuuuguauuuuuaguagag

SEQ ID NO: 852019 - RNA, 27 nt, Human
uuuuuuuuuuuuuuuuuuuuuuugggg

SEQ ID NO: 852020 - RNA, 18 nt, Human
aagcaaauggaacacacc

SEQ ID NO: 852021 - RNA, 27 nt, Human
aagcaaauggaacacaccacggagggg

SEQ ID NO: 852022 - RNA, 22 nt, Human
accggcgugcagggcaccucca

SEQ ID NO: 852023 - RNA, 21 nt, Human
agaggagaaacugcaccuuug

SEQ ID NO: 852024 - RNA, 22 nt, Human
aggaguaggggggcuuguuccu

SEQ ID NO: 852025 - RNA, 21 nt, Human
caccuuugucaacaaagacga

SEQ ID NO: 852026 - RNA, 18 nt, Human
ccacggaggggagacugc

SEQ ID NO: 852027 - RNA, 20 nt, Human
ccaggagaggagaaacugca

SEQ ID NO: 852028 - RNA, 20 nt, Human
cccccgggaggccgccugcu

SEQ ID NO: 852029 - RNA, 18 nt, Human
cccgaccuaaccucccag

SEQ ID NO: 852030 - RNA, 21 nt, Human
ccuccagaugugggaagcaaa

SEQ ID NO: 852031 - RNA, 19 nt, Human
cggaggaguggggcucccg

SEQ ID NO: 852032 - RNA, 21 nt, Human
cucccaggaccggcgugcagg

SEQ ID NO: 852033 - RNA, 18 nt, Human
cuccccuaucucccagga

SEQ ID NO: 852034 - RNA, 24 nt, Human
cucccgcacccccgggaggccgcc

SEQ ID NO: 852035 - RNA, 22 nt, Human
cucgccggggcagccccgaccu

SEQ ID NO: 852036 - RNA, 19 nt, Human
cugggcuugggagcuucug

SEQ ID NO: 852037 - RNA, 19 nt, Human
cuuaaacuuucucagcaga

SEQ ID NO: 852038 - RNA, 22 nt, Human
cuuaggaccccaggcuggcaga

SEQ ID NO: 852039 - RNA, 19 nt, Human
gaaagcugggcuugggagc

SEQ ID NO: 852040 - RNA, 22 nt, Human
gaggccuuuggaaagcugggcu

SEQ ID NO: 852041 - RNA, 24 nt, Human
gaggguggucaggaguaggggggc

SEQ ID NO: 852042 - RNA, 23 nt, Human
gcgguucugcucaugcuccacuc

SEQ ID NO: 852043 - RNA, 20 nt, Human
ggaaagcugggcuugggagc

SEQ ID NO: 852044 - RNA, 19 nt, Human
ggccuuuggaaagcugggc

SEQ ID NO: 852045 - RNA, 19 nt, Human
gggaggcuggcacgucagc

SEQ ID NO: 852046 - RNA, 20 nt, Human
gggaggcuggcacgucagcu

SEQ ID NO: 852047 - RNA, 21 nt, Human
ggggaggcuggcacgucagcu

SEQ ID NO: 852048 - RNA, 19 nt, Human
gugcugggggaggcuggca

SEQ ID NO: 852049 - RNA, 23 nt, Human
uaaccucccagcaggcagcgcau

SEQ ID NO: 852050 - RNA, 20 nt, Human
uaggaccccaggcuggcaga

SEQ ID NO: 852051 - RNA, 21 nt, Human
ucagcagauggugaaauccaa

SEQ ID NO: 852052 - RNA, 24 nt, Human
ucaucgcuuaggaccccaggcugg

SEQ ID NO: 852053 - RNA, 21 nt, Human
uccuccagaugugggaagcaa

SEQ ID NO: 852054 - RNA, 19 nt, Human
ucugcucaucgcuuaggac

SEQ ID NO: 852055 - RNA, 18 nt, Human
ugagcaauccucgugcca

SEQ ID NO: 852056 - RNA, 21 nt, Human
ugcagguucuccccuaucucc

SEQ ID NO: 852057 - RNA, 20 nt, Human
ugcccagaagugacccucgg

SEQ ID NO: 852058 - RNA, 18 nt, Human
ugccugcagguucucccc

SEQ ID NO: 852059 - RNA, 19 nt, Human
ugccugcagguucuccccu

SEQ ID NO: 852060 - RNA, 21 nt, Human
uggaaagcugggcuugggagc

SEQ ID NO: 852061 - RNA, 26 nt, Human
uggaaagcugggcuuggggacagagg

SEQ ID NO: 852062 - RNA, 20 nt, Human
uggaauguucagccgggccc

SEQ ID NO: 852063 - RNA, 18 nt, Human
uggcagaggaggguuuca

SEQ ID NO: 852064 - RNA, 20 nt, Human
uggcagaggaggguuucaac

SEQ ID NO: 852065 - RNA, 22 nt, Human
uggggugggagugggggauucu

SEQ ID NO: 852066 - RNA, 25 nt, Human
uggggugggagugggggauucugcu

SEQ ID NO: 852067 - RNA, 18 nt, Human
uggguuggugggguggga

SEQ ID NO: 852068 - RNA, 18 nt, Human
uggguuggugggguggga

SEQ ID NO: 852069 - RNA, 19 nt, Human
uggucaggaguaggggggc

SEQ ID NO: 852070 - RNA, 20 nt, Human
ugguggggugggaguggggg

SEQ ID NO: 852071 - RNA, 22 nt, Human
ugguggggugggagugggggau

SEQ ID NO: 852072 - RNA, 20 nt, Human
uuuaaacaacaaagguuuau

SEQ ID NO: 852073 - RNA, 25 nt, Human
uuucucagcagauggugaaauccaa

SEQ ID NO: 852074 - RNA, 19 nt, Human
aaagagcccaucaguuugc

SEQ ID NO: 852075 - RNA, 21 nt, Human
aaccgguacagcaaacucaca

SEQ ID NO: 852076 - RNA, 21 nt, Human
auccaccuucccggccagcca

SEQ ID NO: 852077 - RNA, 20 nt, Human
caaggcgaauccaccuuccc

SEQ ID NO: 852078 - RNA, 21 nt, Human
cacacuguguuguuuuucucc

SEQ ID NO: 852079 - RNA, 23 nt, Human
cacaggcggaccugccuggcacc

SEQ ID NO: 852080 - RNA, 20 nt, Human
cacauggagccccaagacuc

SEQ ID NO: 852081 - RNA, 21 nt, Human
caggcggaccugccuggcacc

SEQ ID NO: 852082 - RNA, 18 nt, Human
cauaacagucccaaggac

SEQ ID NO: 852083 - RNA, 22 nt, Human
ccaccagggccuugaauuggca

SEQ ID NO: 852084 - RNA, 22 nt, Human
cccaagacucuggauccccaag

SEQ ID NO: 852085 - RNA, 21 nt, Human
ccccaagacucuggaucccca

SEQ ID NO: 852086 - RNA, 22 nt, Human
ccccaagacucuggauccccaa

SEQ ID NO: 852087 - RNA, 21 nt, Human
cccuaucgccccgccccuccu

SEQ ID NO: 852088 - RNA, 20 nt, Human
cccugcacggcgcaaagagc

SEQ ID NO: 852089 - RNA, 22 nt, Human
ccgugaccgggacaaccgguac

SEQ ID NO: 852090 - RNA, 23 nt, Human
ccucccacccugcacggcgcaaa

SEQ ID NO: 852091 - RNA, 19 nt, Human
ccuggcaccuagccaaggc

SEQ ID NO: 852092 - RNA, 20 nt, Human
cuguugugugugaagcaagc

SEQ ID NO: 852093 - RNA, 19 nt, Human
cuuccaaaaacacacugug

SEQ ID NO: 852094 - RNA, 22 nt, Human
gcugcuaccagaccagucgauc

SEQ ID NO: 852095 - RNA, 21 nt, Human
gguggaggacagucuggagug

SEQ ID NO: 852096 - RNA, 22 nt, Human
uccaccuucccggccagccacc

SEQ ID NO: 852097 - RNA, 19 nt, Human
ucccacccugcacggcgca

SEQ ID NO: 852098 - RNA, 22 nt, Human
uccccaagacucuggaucccua

SEQ ID NO: 852099 - RNA, 20 nt, Human
ucccuaucgccccgccccuc

SEQ ID NO: 852100 - RNA, 18 nt, Human
uccucccacccugcacgg

SEQ ID NO: 852101 - RNA, 19 nt, Human
uccuguugugugugaagca

SEQ ID NO: 852102 - RNA, 18 nt, Human
ucgggcugugacauaagc

SEQ ID NO: 852103 - RNA, 21 nt, Human
ugaccgggacaaccgguacag

SEQ ID NO: 852104 - RNA, 23 nt, Human
uggauccccaagacucuggaucc

SEQ ID NO: 852105 - RNA, 20 nt, Human
ugggguggaggacagucugg

SEQ ID NO: 852106 - RNA, 22 nt, Human
uuuucuguucauaacaguccca

SEQ ID NO: 852107 - RNA, 25 nt, Human
uuuuuuuuuuuuuuuuuuuauuuuu

SEQ ID NO: 852108 - RNA, 25 nt, Human
acaccaccccagggagaggggaacc

SEQ ID NO: 852109 - RNA, 21 nt, Human
acuccuccugcccccaauccu

SEQ ID NO: 852110 - RNA, 21 nt, Human
agaacaugcaucccaauaccc

SEQ ID NO: 852111 - RNA, 22 nt, Human
agaacaugcaucccaauacccu

SEQ ID NO: 852112 - RNA, 27 nt, Human
agacacacccucucugcuggcagugca

SEQ ID NO: 852113 - RNA, 21 nt, Human
aggagaaacaccaccccaggg

SEQ ID NO: 852114 - RNA, 24 nt, Human
cagacuccuccugcccccaauccu

SEQ ID NO: 852115 - RNA, 25 nt, Human
cagcugucaccuuggacuuguugga

SEQ ID NO: 852116 - RNA, 19 nt, Human
caggccuggccacacaugc

SEQ ID NO: 852117 - RNA, 21 nt, Human
ccacacaugcggacagaggau

SEQ ID NO: 852118 - RNA, 24 nt, Human
cccacgccccuagcaccagcuguc

SEQ ID NO: 852119 - RNA, 20 nt, Human
ccccacgccccuagcaccag

SEQ ID NO: 852120 - RNA, 19 nt, Human
ccccagacacacccucucu

SEQ ID NO: 852121 - RNA, 23 nt, Human
cccccaauccucugugccccugc

SEQ ID NO: 852122 - RNA, 21 nt, Human
cccccagacacacccucucug

SEQ ID NO: 852123 - RNA, 24 nt, Human
cccccagacacacccucucugcug

SEQ ID NO: 852124 - RNA, 20 nt, Human
cugcuccaaccuccugggca

SEQ ID NO: 852125 - RNA, 18 nt, Human
gagagaaggauaagccau

SEQ ID NO: 852126 - RNA, 19 nt, Human
gaugcaggggcuagaaagg

SEQ ID NO: 852127 - RNA, 18 nt, Human
ggcuggggucagggggca

SEQ ID NO: 852128 - RNA, 20 nt, Human
gggcagcagccaucugcagg

SEQ ID NO: 852129 - RNA, 18 nt, Human
ggguguggggagggucgg

SEQ ID NO: 852130 - RNA, 19 nt, Human
ggguguggggagggucggg

SEQ ID NO: 852131 - RNA, 22 nt, Human
ggucgggcuggggucagggggc

SEQ ID NO: 852132 - RNA, 20 nt, Human
gguuggggcagcagccaucu

SEQ ID NO: 852133 - RNA, 22 nt, Human
uacccuagaggagaaacaccac

SEQ ID NO: 852134 - RNA, 20 nt, Human
uagcaccagcugucaccuug

SEQ ID NO: 852135 - RNA, 25 nt, Human
uaggugguggcccccagacacaccc

SEQ ID NO: 852136 - RNA, 23 nt, Human
uccagacuccuccugcccccaau

SEQ ID NO: 852137 - RNA, 26 nt, Human
ucccagguuggggcagcagccaucug

SEQ ID NO: 852138 - RNA, 20 nt, Human
ucgggcuggggucagggggc

SEQ ID NO: 852139 - RNA, 20 nt, Human
ugcuccaaccuccugggcag

SEQ ID NO: 852140 - RNA, 26 nt, Human
ugcuccaaccuccugggcagguccca

SEQ ID NO: 852141 - RNA, 19 nt, Human
uggcccccagacacacccu

SEQ ID NO: 852142 - RNA, 22 nt, Human
uggcccccagacacacccucuc

SEQ ID NO: 852143 - RNA, 22 nt, Human
uggggagggucgggcugggguc

SEQ ID NO: 852144 - RNA, 18 nt, Human
uguuggagaugcaggggc

SEQ ID NO: 852145 - RNA, 20 nt, Human
uuuuuuuuuuuuuuuuuugg

SEQ ID NO: 852146 - RNA, 21 nt, Human
ccuaagcaccuuucagguugg

SEQ ID NO: 852147 - RNA, 18 nt, Human
cggaggccuccucugggc

SEQ ID NO: 852148 - RNA, 21 nt, Human
ucucgcgagcgcucccgaccu

SEQ ID NO: 852149 - RNA, 21 nt, Human
uuuuuuuuuuuuuuuuucggu

SEQ ID NO: 852150 - RNA, 23 nt, Human
uuuuuuuuuuuuuuuuuuuucgg

SEQ ID NO: 852151 - RNA, 24 nt, Human
uuuuuuuuuuuuuuuuuuuucggu

SEQ ID NO: 852152 - RNA, 24 nt, Human
uuuuuuuuuuuuuuuuuuuuucgu

SEQ ID NO: 852153 - RNA, 22 nt, Human
aaaaaacaagggcagaacaaga

SEQ ID NO: 852154 - RNA, 18 nt, Human
aaacaagggcagaacaag

SEQ ID NO: 852155 - RNA, 22 nt, Human
aaacaagggcagaacaagagua

SEQ ID NO: 852156 - RNA, 23 nt, Human
aaagaccuugaagcuaaacaaac

SEQ ID NO: 852157 - RNA, 24 nt, Human
aacaagggcagaacaagaguacaa

SEQ ID NO: 852158 - RNA, 21 nt, Human
aauacccauccaaguccaaag

SEQ ID NO: 852159 - RNA, 20 nt, Human
acaauaaaagaagcaucugc

SEQ ID NO: 852160 - RNA, 20 nt, Human
acacugucaaaauguuucuu

SEQ ID NO: 852161 - RNA, 24 nt, Human
acagaaacauucuucucuuccacu

SEQ ID NO: 852162 - RNA, 24 nt, Human
acagcauauugacucuaguugcau

SEQ ID NO: 852163 - RNA, 21 nt, Human
acaguccuaagccugauaugc

SEQ ID NO: 852164 - RNA, 22 nt, Human
agaacaagaguacaauaaaaga

SEQ ID NO: 852165 - RNA, 24 nt, Human
agacacugucaaaauguuucuucu

SEQ ID NO: 852166 - RNA, 21 nt, Human
aggaagagacagaaacaggga

SEQ ID NO: 852167 - RNA, 25 nt, Human
aggcaagagcaggcuguaaaagcaa

SEQ ID NO: 852168 - RNA, 18 nt, Human
agggacuauuccaacauc

SEQ ID NO: 852169 - RNA, 22 nt, Human
augguauuaagaaaaguuggcu

SEQ ID NO: 852170 - RNA, 20 nt, Human
caaguccaaagguggaagaa

SEQ ID NO: 852171 - RNA, 22 nt, Human
cacccguggccgagcucccggc

SEQ ID NO: 852172 - RNA, 23 nt, Human
caucacuccuuuggaauuauuuc

SEQ ID NO: 852173 - RNA, 20 nt, Human
caucuccaaccaagacacug

SEQ ID NO: 852174 - RNA, 21 nt, Human
ccauccaaguccaaaggugga

SEQ ID NO: 852175 - RNA, 21 nt, Human
ccuucaaaaaacaagggcaga

SEQ ID NO: 852176 - RNA, 25 nt, Human
ccuucaaaaaacaagggcagaacaa

SEQ ID NO: 852177 - RNA, 24 nt, Human
gaacaguccugcuaaagaaaccag

SEQ ID NO: 852178 - RNA, 19 nt, Human
gaccaggccucaccgcagc

SEQ ID NO: 852179 - RNA, 19 nt, Human
gcagccggagaccaggccu

SEQ ID NO: 852180 - RNA, 21 nt, Human
guggccgagcucccggcuucc

SEQ ID NO: 852181 - RNA, 19 nt, Human
uaggcaagagcaggcugua

SEQ ID NO: 852182 - RNA, 22 nt, Human
uauacagcauauugacucuagu

SEQ ID NO: 852183 - RNA, 23 nt, Human
uaugguaauaggcaagagcaggc

SEQ ID NO: 852184 - RNA, 22 nt, Human
uaugguauuaagaaaaguuggc

SEQ ID NO: 852185 - RNA, 23 nt, Human
uauuccaacaucacuccuuugga

SEQ ID NO: 852186 - RNA, 22 nt, Human
ucagucauccuuaacaugugac

SEQ ID NO: 852187 - RNA, 22 nt, Human
uccacagaggcugaguagaaca

SEQ ID NO: 852188 - RNA, 18 nt, Human
ucucuuccacuuauuacc

SEQ ID NO: 852189 - RNA, 21 nt, Human
ugaagcuaaacaaacaagcaa

SEQ ID NO: 852190 - RNA, 24 nt, Human
ugaguagaacaguccugcuaaaga

SEQ ID NO: 852191 - RNA, 23 nt, Human
ugucaacauguuuauugcuaaua

SEQ ID NO: 852192 - RNA, 23 nt, Human
uguugcguuuuuuuaauuuuuuu

SEQ ID NO: 852193 - RNA, 22 nt, Human
uuaaaagguauaugguauuaag

SEQ ID NO: 852194 - RNA, 19 nt, Human
uucaucuccaaccaagaca

SEQ ID NO: 852195 - RNA, 19 nt, Human
uuuuuuuuuuuuauaggaa

SEQ ID NO: 852196 - RNA, 23 nt, Human
uuuuuuuuuuuuuuuuuuauagg

SEQ ID NO: 852197 - RNA, 23 nt, Human
aaaaauguccacaguggcaacau

SEQ ID NO: 852198 - RNA, 21 nt, Human
aaacaaacaaaaaacuaaaca

SEQ ID NO: 852199 - RNA, 28 nt, Human
aaacaaacaaaaaacuaaacagucccca

SEQ ID NO: 852200 - RNA, 20 nt, Human
aaacccaaaaggagugaagg

SEQ ID NO: 852201 - RNA, 26 nt, Human
aaacccaaaaggagugaaggccagaa

SEQ ID NO: 852202 - RNA, 23 nt, Human
aacaaaaaacuaaacagucccca

SEQ ID NO: 852203 - RNA, 18 nt, Human
aaggucaaacagguacug

SEQ ID NO: 852204 - RNA, 21 nt, Human
aaucucagcaauuuuccuuuc

SEQ ID NO: 852205 - RNA, 25 nt, Human
acaaacccaaaaggagugaaggcca

SEQ ID NO: 852206 - RNA, 19 nt, Human
accacucaguuccgucuug

SEQ ID NO: 852207 - RNA, 20 nt, Human
accccaggcaccugcaccau

SEQ ID NO: 852208 - RNA, 26 nt, Human
acuccagagcccuuugagagugacca

SEQ ID NO: 852209 - RNA, 22 nt, Human
acuuuguaaauuccagccaaug

SEQ ID NO: 852210 - RNA, 22 nt, Human
agccuaucccuuucuucuucug

SEQ ID NO: 852211 - RNA, 20 nt, Human
agguaguauucacacuucuu

SEQ ID NO: 852212 - RNA, 19 nt, Human
aggugcuuacacgcuucag

SEQ ID NO: 852213 - RNA, 18 nt, Human
aucccuuucuucuucugg

SEQ ID NO: 852214 - RNA, 21 nt, Human
caaaaggagugaaggccagaa

SEQ ID NO: 852215 - RNA, 25 nt, Human
caaacccaaaaggagugaaggccag

SEQ ID NO: 852216 - RNA, 24 nt, Human
caaauuggaaagaugagaaacaga

SEQ ID NO: 852217 - RNA, 20 nt, Human
caacagcaccacagaguuua

SEQ ID NO: 852218 - RNA, 24 nt, Human
cagcagccgcacggugcagcuggu

SEQ ID NO: 852219 - RNA, 21 nt, Human
cagcauccgauguuuuacaga

SEQ ID NO: 852220 - RNA, 19 nt, Human
caggaagacuaaauaccug

SEQ ID NO: 852221 - RNA, 26 nt, Human
caggcgucccucagcccggcagcucc

SEQ ID NO: 852222 - RNA, 19 nt, Human
caugucacuauuuaccugu

SEQ ID NO: 852223 - RNA, 26 nt, Human
ccaaaaggagugaaggccagaaaugc

SEQ ID NO: 852224 - RNA, 20 nt, Human
ccaaugucugugcuuuucuu

SEQ ID NO: 852225 - RNA, 18 nt, Human
ccacauuuccagaggugc

SEQ ID NO: 852226 - RNA, 19 nt, Human
ccacuugaaucuauuugca

SEQ ID NO: 852227 - RNA, 26 nt, Human
cccauuguccagaucccuggccugcc

SEQ ID NO: 852228 - RNA, 19 nt, Human
ccccgucgcugccguugcc

SEQ ID NO: 852229 - RNA, 19 nt, Human
cccgcccgcccgcccggga

SEQ ID NO: 852230 - RNA, 21 nt, Human
cccgucgcugccguugccucc

SEQ ID NO: 852231 - RNA, 18 nt, Human
cccucagcccggcagcuc

SEQ ID NO: 852232 - RNA, 19 nt, Human
ccgauguuuuacagaggag

SEQ ID NO: 852233 - RNA, 19 nt, Human
ccgcacggugcagcuguac

SEQ ID NO: 852234 - RNA, 22 nt, Human
ccgcccgggagcgacgcggcgg

SEQ ID NO: 852235 - RNA, 27 nt, Human
ccucuuguuuccuugaagaacaacaaa

SEQ ID NO: 852236 - RNA, 21 nt, Human
ccugcaaauuggaaagaugag

SEQ ID NO: 852237 - RNA, 24 nt, Human
cgauuccacauuuccagaggugcu

SEQ ID NO: 852238 - RNA, 19 nt, Human
cgcugccguugccuccugc

SEQ ID NO: 852239 - RNA, 22 nt, Human
cggacccuggaccaggcguccc

SEQ ID NO: 852240 - RNA, 22 nt, Human
cuaaauaccugauccaacagca

SEQ ID NO: 852241 - RNA, 30 nt, Human
cuaugaaaaaucaaaauucaaaaccaaaaa

SEQ ID NO: 852242 - RNA, 19 nt, Human
cucccagcuuaucuuucag

SEQ ID NO: 852243 - RNA, 22 nt, Human
cuccgcaccgaccccaggcacc

SEQ ID NO: 852244 - RNA, 20 nt, Human
cucuuguuuccuugaagaac

SEQ ID NO: 852245 - RNA, 23 nt, Human
cuguacucgcgcuccaggcuccu

SEQ ID NO: 852246 - RNA, 23 nt, Human
cuguagccuucaggguguuuccc

SEQ ID NO: 852247 - RNA, 22 nt, Human
cuucccgcccgcccgcccggga

SEQ ID NO: 852248 - RNA, 20 nt, Human
gaagaacaacaaacccaaaa

SEQ ID NO: 852249 - RNA, 19 nt, Human
gaaggccagaaaugcagca

SEQ ID NO: 852250 - RNA, 20 nt, Human
gaccaggcgucccucagccc

SEQ ID NO: 852251 - RNA, 19 nt, Human
gaccccaggcaccugcacc

SEQ ID NO: 852252 - RNA, 30 nt, Human
gccccgucgcugccguugccuccugcuggg

SEQ ID NO: 852253 - RNA, 18 nt, Human
gcccgcccgcccgggagc

SEQ ID NO: 852254 - RNA, 19 nt, Human
gccuuuggcaucucucugg

SEQ ID NO: 852255 - RNA, 22 nt, Human
ggcaaaaaaaacaaacaaaaaa

SEQ ID NO: 852256 - RNA, 20 nt, Human
gguagccggguuccuugguc

SEQ ID NO: 852257 - RNA, 23 nt, Human
uaaaacuucacacggaagcacau

SEQ ID NO: 852258 - RNA, 19 nt, Human
uagagaucccuuuugaucu

SEQ ID NO: 852259 - RNA, 19 nt, Human
uaugaaaaaucaaaauuca

SEQ ID NO: 852260 - RNA, 19 nt, Human
ucaacuaguguccccucug

SEQ ID NO: 852261 - RNA, 24 nt, Human
ucaagagguaguauucacacuucu

SEQ ID NO: 852262 - RNA, 19 nt, Human
uccaggcuccugcugcugc

SEQ ID NO: 852263 - RNA, 20 nt, Human
ucccucagcccggcagcucc

SEQ ID NO: 852264 - RNA, 20 nt, Human
ucccugagucauaaucccca

SEQ ID NO: 852265 - RNA, 24 nt, Human
ucccugagucauaauccccaaucu

SEQ ID NO: 852266 - RNA, 20 nt, Human
ucucccagcuuaucuuucag

SEQ ID NO: 852267 - RNA, 22 nt, Human
ugaaaaaucaaaauucaaaacc

SEQ ID NO: 852268 - RNA, 21 nt, Human
ugaagaacaacaaacccaaaa

SEQ ID NO: 852269 - RNA, 24 nt, Human
ugaagaacaacaaacccaaaagga

SEQ ID NO: 852270 - RNA, 22 nt, Human
ugaauguuuagggaaaaacugg

SEQ ID NO: 852271 - RNA, 18 nt, Human
ugagaaacagagucgcug

SEQ ID NO: 852272 - RNA, 18 nt, Human
ugcaccaucaccccggcc

SEQ ID NO: 852273 - RNA, 24 nt, Human
ugcccugcugaggcugcagugaug

SEQ ID NO: 852274 - RNA, 19 nt, Human
ugcuaggugauacuacugc

SEQ ID NO: 852275 - RNA, 21 nt, Human
uggaccaggcgucccucagcc

SEQ ID NO: 852276 - RNA, 27 nt, Human
uggcaaaaaaaacaaacaaaaaacuaa

SEQ ID NO: 852277 - RNA, 22 nt, Human
uggcaccagcaggaaaagcucc

SEQ ID NO: 852278 - RNA, 21 nt, Human
uguaagcugcuaacaaggcag

SEQ ID NO: 852279 - RNA, 22 nt, Human
uguccccucugcuaggugauac

SEQ ID NO: 852280 - RNA, 19 nt, Human
uuaaaaguucuggcuggca

SEQ ID NO: 852281 - RNA, 18 nt, Human
uuccacauuuccagaggu

SEQ ID NO: 852282 - RNA, 20 nt, Human
uugaagaacaacaaacccaa

SEQ ID NO: 852283 - RNA, 20 nt, Human
uuucuugaaauaacuucuga

SEQ ID NO: 852284 - RNA, 21 nt, Human
uuugcaaccuccgaaauaagc

SEQ ID NO: 852285 - RNA, 23 nt, Human
uuuuuuuuuuuaagaagcaacuu

SEQ ID NO: 852286 - RNA, 20 nt, Human
uuuuuuuuuuuuuaagaagc

SEQ ID NO: 852287 - RNA, 25 nt, Human
uuuuuuuuuuuuuuuuuuuuuaagg

SEQ ID NO: 852288 - RNA, 22 nt, Human
aaacacaaggccccaaauugac

SEQ ID NO: 852289 - RNA, 21 nt, Human
aaaugaccucagaaugggggc

SEQ ID NO: 852290 - RNA, 19 nt, Human
aacacaggcugcugugagg

SEQ ID NO: 852291 - RNA, 22 nt, Human
aaccaaaacacuuaagaaaccu

SEQ ID NO: 852292 - RNA, 18 nt, Human
aacccaaaucuuccccaa

SEQ ID NO: 852293 - RNA, 18 nt, Human
acaaggccccaaauugac

SEQ ID NO: 852294 - RNA, 23 nt, Human
acacucuaggaucgacugcuucc

SEQ ID NO: 852295 - RNA, 18 nt, Human
acagcccuccacuagccc

SEQ ID NO: 852296 - RNA, 18 nt, Human
acaggcuguggccucaca

SEQ ID NO: 852297 - RNA, 20 nt, Human
acaggugaccccagaaagaa

SEQ ID NO: 852298 - RNA, 20 nt, Human
accccagaaagaaaugaagu

SEQ ID NO: 852299 - RNA, 18 nt, Human
agaaagaacccuggggug

SEQ ID NO: 852300 - RNA, 20 nt, Human
agaaagacaaugcauaggag

SEQ ID NO: 852301 - RNA, 21 nt, Human
agagucuagagacaucuauuc

SEQ ID NO: 852302 - RNA, 20 nt, Human
aggaggagagaauggcucug

SEQ ID NO: 852303 - RNA, 20 nt, Human
auaggacaaaggcaacccuu

SEQ ID NO: 852304 - RNA, 21 nt, Human
augucccacaccuccucgcug

SEQ ID NO: 852305 - RNA, 18 nt, Human
caaacacaaggccccaaa

SEQ ID NO: 852306 - RNA, 26 nt, Human
caaagcccaucacaggugaccccaga

SEQ ID NO: 852307 - RNA, 18 nt, Human
caacagaacagauaccuc

SEQ ID NO: 852308 - RNA, 20 nt, Human
caagcucagggauaggacaa

SEQ ID NO: 852309 - RNA, 20 nt, Human
cacaaaaaugaccucagaau

SEQ ID NO: 852310 - RNA, 19 nt, Human
cacacuccagucuccaugg

SEQ ID NO: 852311 - RNA, 24 nt, Human
caccacaucaaagcccaucacagg

SEQ ID NO: 852312 - RNA, 23 nt, Human
cacccaggugucacugcagucaa

SEQ ID NO: 852313 - RNA, 24 nt, Human
cagugaccacagguucuccuagac

SEQ ID NO: 852314 - RNA, 24 nt, Human
cauauacauagucaaauaagaaug

SEQ ID NO: 852315 - RNA, 22 nt, Human
ccaaauucuagacaaucccaca

SEQ ID NO: 852316 - RNA, 21 nt, Human
ccacaucaaagcccaucacaa

SEQ ID NO: 852317 - RNA, 19 nt, Human
cccacaaaaugcuaguauc

SEQ ID NO: 852318 - RNA, 23 nt, Human
ccccaaauugacaccacaucaaa

SEQ ID NO: 852319 - RNA, 21 nt, Human
ccucuggcacaaacacaaggg

SEQ ID NO: 852320 - RNA, 25 nt, Human
cgcuugugcaucuuaggaacccaaa

SEQ ID NO: 852321 - RNA, 23 nt, Human
cggcaguauuuucaacugcaugc

SEQ ID NO: 852322 - RNA, 19 nt, Human
cguuugaagccuucagggu

SEQ ID NO: 852323 - RNA, 18 nt, Human
cuaaaaaucaccugguug

SEQ ID NO: 852324 - RNA, 20 nt, Human
cuagcccauuucccaagggu

SEQ ID NO: 852325 - RNA, 24 nt, Human
gaacagauaccuccggagcaccca

SEQ ID NO: 852326 - RNA, 18 nt, Human
gaggagagaauggcucug

SEQ ID NO: 852327 - RNA, 21 nt, Human
gcccaucacaggugaccccag

SEQ ID NO: 852328 - RNA, 27 nt, Human
gcuggccugcuucugucaacucuacgc

SEQ ID NO: 852329 - RNA, 18 nt, Human
ggaagcuaacuuccuaca

SEQ ID NO: 852330 - RNA, 29 nt, Human
ggagggcagagauaaggcucuccccgagg

SEQ ID NO: 852331 - RNA, 23 nt, Human
ggcuccauggcucuuuagcacag

SEQ ID NO: 852332 - RNA, 19 nt, Human
gggccauuagccucaagca

SEQ ID NO: 852333 - RNA, 19 nt, Human
gggguucacacaguacagu

SEQ ID NO: 852334 - RNA, 20 nt, Human
gugagggaaacugaacagaa

SEQ ID NO: 852335 - RNA, 25 nt, Human
uaacccaagcacucaggcuauuaug

SEQ ID NO: 852336 - RNA, 23 nt, Human
uacgcugguagaagaucucggca

SEQ ID NO: 852337 - RNA, 19 nt, Human
uauaaaagaaagacaaugc

SEQ ID NO: 852338 - RNA, 21 nt, Human
uauaaaagaaagacaaugcau

SEQ ID NO: 852339 - RNA, 22 nt, Human
uauaaaagaaagacaaugcaua

SEQ ID NO: 852340 - RNA, 19 nt, Human
ucaacagcccuccacuagc

SEQ ID NO: 852341 - RNA, 22 nt, Human
ucaacagcccuccacuagccca

SEQ ID NO: 852342 - RNA, 28 nt, Human
ucaacagcccuccacuagcccauuuccc

SEQ ID NO: 852343 - RNA, 24 nt, Human
uccauggcucuuuagcacaggcug

SEQ ID NO: 852344 - RNA, 19 nt, Human
uccuacucaggaggagaga

SEQ ID NO: 852345 - RNA, 18 nt, Human
uccugaaugacucuggaa

SEQ ID NO: 852346 - RNA, 25 nt, Human
ucucuuguugagcaagcucagggau

SEQ ID NO: 852347 - RNA, 19 nt, Human
ucuggaaggacauucuggg

SEQ ID NO: 852348 - RNA, 26 nt, Human
ugaaacaaaacaauuuuaauuucaga

SEQ ID NO: 852349 - RNA, 20 nt, Human
ugaggccuuguaggaaagga

SEQ ID NO: 852350 - RNA, 21 nt, Human
ugagggaaacugaacagaaac

SEQ ID NO: 852351 - RNA, 22 nt, Human
ugcagaaagaacccugggguga

SEQ ID NO: 852352 - RNA, 19 nt, Human
uggccugcuucugucaacu

SEQ ID NO: 852353 - RNA, 24 nt, Human
uggggaagcuaacuuccuacagug

SEQ ID NO: 852354 - RNA, 19 nt, Human
ugggggccauuagccucaa

SEQ ID NO: 852355 - RNA, 23 nt, Human
uugcauggccagucacugugggg

SEQ ID NO: 852356 - RNA, 19 nt, Human
uuuugguuacgauucauua

SEQ ID NO: 852357 - RNA, 19 nt, Human
aaagcaacuuucucccucc

SEQ ID NO: 852358 - RNA, 20 nt, Human
accgaggccuccucaggcag

SEQ ID NO: 852359 - RNA, 19 nt, Human
agaaccagagaaaccaugg

SEQ ID NO: 852360 - RNA, 21 nt, Human
agccgaacgcagcacucggaa

SEQ ID NO: 852361 - RNA, 30 nt, Human
ccucacauugcuauuacgauucaaaagccc

SEQ ID NO: 852362 - RNA, 19 nt, Human
ccuccucaggcaggcaggg

SEQ ID NO: 852363 - RNA, 18 nt, Human
cgaggccacugucuacgc

SEQ ID NO: 852364 - RNA, 23 nt, Human
cgucccuggacaacccugaacgc

SEQ ID NO: 852365 - RNA, 23 nt, Human
cugcagcuccuucgcauccaacc

SEQ ID NO: 852366 - RNA, 31 nt, Human
cuggaaaugguggcaggugaagucucuccuu

SEQ ID NO: 852367 - RNA, 19 nt, Human
gaagucucuccacagcauu

SEQ ID NO: 852368 - RNA, 20 nt, Human
gcagaaagcaacuuucuccc

SEQ ID NO: 852369 - RNA, 18 nt, Human
uagguguaccucacccuc

SEQ ID NO: 852370 - RNA, 23 nt, Human
ucaaacuggcagaaccagagaaa

SEQ ID NO: 852371 - RNA, 21 nt, Human
uccaaccgaggccuccucagg

SEQ ID NO: 852372 - RNA, 21 nt, Human
uccccuggaugcugcagcucc

SEQ ID NO: 852373 - RNA, 24 nt, Human
ucccuggacaacccugaacgccuu

SEQ ID NO: 852374 - RNA, 23 nt, Human
ucuccacagcaugccuugggccu

SEQ ID NO: 852375 - RNA, 18 nt, Human
uggcagaaccagagaaac

SEQ ID NO: 852376 - RNA, 24 nt, Human
uuggugcagaaagcaacuuucucc

SEQ ID NO: 852377 - RNA, 21 nt, Human
uuucacagcaaauuauuuaau

SEQ ID NO: 852378 - RNA, 26 nt, Human
uuuuuuuuuuuuuucacagcaaauua

SEQ ID NO: 852379 - RNA, 24 nt, Human
uuuuuuuuuuuuuuuuuuucacag

SEQ ID NO: 852380 - RNA, 22 nt, Human
aaaaaaaaaaacuguuagaaaa

SEQ ID NO: 852381 - RNA, 24 nt, Human
aaaaagccaaguaguuaaacaaac

SEQ ID NO: 852382 - RNA, 23 nt, Human
aaacaaacuaugauaauauuaau

SEQ ID NO: 852383 - RNA, 24 nt, Human
aaacaugauuauguacgaugugaa

SEQ ID NO: 852384 - RNA, 20 nt, Human
aagcaaaaguaaaaaauagc

SEQ ID NO: 852385 - RNA, 22 nt, Human
aagcaaaaguaaaaaauagcug

SEQ ID NO: 852386 - RNA, 24 nt, Human
aagcaaaaguaaaaaauagcugga

SEQ ID NO: 852387 - RNA, 20 nt, Human
aagcaggcagaucgcuugag

SEQ ID NO: 852388 - RNA, 24 nt, Human
aagcaggcagaucgcuugagccca

SEQ ID NO: 852389 - RNA, 18 nt, Human
aaggcugcagugagccga

SEQ ID NO: 852390 - RNA, 24 nt, Human
aagucaaggcugcagugagccgag

SEQ ID NO: 852391 - RNA, 19 nt, Human
acaaaaaaaaaauacaaaa

SEQ ID NO: 852392 - RNA, 22 nt, Human
acagagcaagaccaucucaaaa

SEQ ID NO: 852393 - RNA, 21 nt, Human
accccauccccaaccacccau

SEQ ID NO: 852394 - RNA, 20 nt, Human
accuguagucccagcuacuc

SEQ ID NO: 852395 - RNA, 24 nt, Human
acgucacugcacuccagccugggc

SEQ ID NO: 852396 - RNA, 24 nt, Human
acugcacuccagccugggcaacag

SEQ ID NO: 852397 - RNA, 24 nt, Human
acugcacuccagccugggcaacag

SEQ ID NO: 852398 - RNA, 22 nt, Human
agaccaucucaaaaaaaaaaac

SEQ ID NO: 852399 - RNA, 22 nt, Human
agagcaagaccaucucaaaaaa

SEQ ID NO: 852400 - RNA, 21 nt, Human
agcaaaaguaaaaaauagcug

SEQ ID NO: 852401 - RNA, 20 nt, Human
agcacucugggaggcugaag

SEQ ID NO: 852402 - RNA, 24 nt, Human
agcuacucaggaggcugagguggg

SEQ ID NO: 852403 - RNA, 18 nt, Human
aggaguucaagacuagcc

SEQ ID NO: 852404 - RNA, 24 nt, Human
aggcugaagcaggcagaucgcuug

SEQ ID NO: 852405 - RNA, 24 nt, Human
aggcugaggugggaugaucacuug

SEQ ID NO: 852406 - RNA, 20 nt, Human
aggcugggugcaguggcuca

SEQ ID NO: 852407 - RNA, 22 nt, Human
aggugggaugaucacuugagcc

SEQ ID NO: 852408 - RNA, 23 nt, Human
aggugggaugaucacuugagccc

SEQ ID NO: 852409 - RNA, 21 nt, Human
aguggcucaugccuguaaucc

SEQ ID NO: 852410 - RNA, 24 nt, Human
aguggcucaugccuguaauccuag

SEQ ID NO: 852411 - RNA, 24 nt, Human
aucacgucacugcacuccagccug

SEQ ID NO: 852412 - RNA, 18 nt, Human
auccccaaccacccaugc

SEQ ID NO: 852413 - RNA, 19 nt, Human
augccuguaauccuagcac

SEQ ID NO: 852414 - RNA, 24 nt, Human
caaaaaaaaaauacaaaaaauuag

SEQ ID NO: 852415 - RNA, 20 nt, Human
caccccauccccaaccaccc

SEQ ID NO: 852416 - RNA, 18 nt, Human
cacugcacuccagccugg

SEQ ID NO: 852417 - RNA, 19 nt, Human
cacugcacuccagccuggg

SEQ ID NO: 852418 - RNA, 19 nt, Human
cacugcacuccagccuggg

SEQ ID NO: 852419 - RNA, 20 nt, Human
cacugcacuccagccugggc

SEQ ID NO: 852420 - RNA, 21 nt, Human
cacugcacuccagccugggca

SEQ ID NO: 852421 - RNA, 22 nt, Human
cacugcacuccagccugggcaa

SEQ ID NO: 852422 - RNA, 23 nt, Human
cacugcacuccagccugggcaac

SEQ ID NO: 852423 - RNA, 24 nt, Human
cacugcacuccagccugggcaaca

SEQ ID NO: 852424 - RNA, 26 nt, Human
cacugcacuccagccugggcaacaga

SEQ ID NO: 852425 - RNA, 19 nt, Human
cagaagucagcagagcucc

SEQ ID NO: 852426 - RNA, 24 nt, Human
cagaucgcuugagcccaggaguuc

SEQ ID NO: 852427 - RNA, 24 nt, Human
cagcuacucaggaggcugaggugg

SEQ ID NO: 852428 - RNA, 22 nt, Human
caggaguuauauucaaaauuug

SEQ ID NO: 852429 - RNA, 20 nt, Human
caugccuguaauccuagcac

SEQ ID NO: 852430 - RNA, 18 nt, Human
cauggcaaaauacccucu

SEQ ID NO: 852431 - RNA, 29 nt, Human
cauggcaaaauacccucucuacaaaaaaa

SEQ ID NO: 852432 - RNA, 25 nt, Human
cccaaauguauucuuccaaaaggac

SEQ ID NO: 852433 - RNA, 21 nt, Human
cccaaccacccaugcccaaau

SEQ ID NO: 852434 - RNA, 19 nt, Human
cccaccccauccccaacca

SEQ ID NO: 852435 - RNA, 21 nt, Human
cccaccccauccccaaccacc

SEQ ID NO: 852436 - RNA, 18 nt, Human
ccccaaccacccaugccc

SEQ ID NO: 852437 - RNA, 18 nt, Human
ccuguaauccuagcacuc

SEQ ID NO: 852438 - RNA, 20 nt, Human
ccuguaauccuagcacucug

SEQ ID NO: 852439 - RNA, 21 nt, Human
ccuguagucccagcuacucag

SEQ ID NO: 852440 - RNA, 24 nt, Human
cgucacugcacuccagccugggca

SEQ ID NO: 852441 - RNA, 22 nt, Human
cuacaaaaaaaaaauacaaaaa

SEQ ID NO: 852442 - RNA, 18 nt, Human
cucaggaggcugaggugg

SEQ ID NO: 852443 - RNA, 23 nt, Human
cucaugccuguaauccuagcacu

SEQ ID NO: 852444 - RNA, 21 nt, Human
cugaggugggaugaucacuug

SEQ ID NO: 852445 - RNA, 20 nt, Human
cugcagugagccgagaucac

SEQ ID NO: 852446 - RNA, 21 nt, Human
gaacaaauauagaaagaugcu

SEQ ID NO: 852447 - RNA, 22 nt, Human
gaacaaauauagaaagaugcuu

SEQ ID NO: 852448 - RNA, 25 nt, Human
gacaauauuaagugaaaaaaaaaaa

SEQ ID NO: 852449 - RNA, 23 nt, Human
gagaucacgucacugcacuccag

SEQ ID NO: 852450 - RNA, 22 nt, Human
gaggcugaggugggaugaucac

SEQ ID NO: 852451 - RNA, 24 nt, Human
gaucacuugagcccaggaagucaa

SEQ ID NO: 852452 - RNA, 24 nt, Human
gaucgcuugagcccaggaguucaa

SEQ ID NO: 852453 - RNA, 24 nt, Human
gcacuccagccugggcaacagagc

SEQ ID NO: 852454 - RNA, 24 nt, Human
gcccaggaagucaaggcugcagug

SEQ ID NO: 852455 - RNA, 22 nt, Human
gcccaggaguucaagacuagcc

SEQ ID NO: 852456 - RNA, 19 nt, Human
gcccuggacuagccccauc

SEQ ID NO: 852457 - RNA, 19 nt, Human
gcugggugcaguggcucau

SEQ ID NO: 852458 - RNA, 23 nt, Human
ggcugggugcaguggcucaugcc

SEQ ID NO: 852459 - RNA, 23 nt, Human
ggugcaguggcucaugccuguaa

SEQ ID NO: 852460 - RNA, 24 nt, Human
gucacugcacuccagccugggcaa

SEQ ID NO: 852461 - RNA, 22 nt, Human
guggugcauaccuguaguccca

SEQ ID NO: 852462 - RNA, 23 nt, Human
uacaaaaaaaaaauacaaaaaau

SEQ ID NO: 852463 - RNA, 26 nt, Human
uacaaaaaaaaaauacaaaaaauuag

SEQ ID NO: 852464 - RNA, 21 nt, Human
uacccagccugaggaaagcac

SEQ ID NO: 852465 - RNA, 30 nt, Human
uacccagccugaggaaagcaccuaggagcc

SEQ ID NO: 852466 - RNA, 24 nt, Human
uaccuguagucccagcuacucagg

SEQ ID NO: 852467 - RNA, 21 nt, Human
uagaaaaagccaaguaguuaa

SEQ ID NO: 852468 - RNA, 21 nt, Human
uagaaaaagccaaguaguuaa

SEQ ID NO: 852469 - RNA, 18 nt, Human
uagcacucugggaggcug

SEQ ID NO: 852470 - RNA, 24 nt, Human
uagcacucugggaggcugaagcag

SEQ ID NO: 852471 - RNA, 21 nt, Human
ucaauauucugcagauuuuaa

SEQ ID NO: 852472 - RNA, 23 nt, Human
ucacgucacugcacuccagccug

SEQ ID NO: 852473 - RNA, 20 nt, Human
ucacugcacuccagccuggg

SEQ ID NO: 852474 - RNA, 21 nt, Human
ucacugcacuccagccugggc

SEQ ID NO: 852475 - RNA, 24 nt, Human
ucacugcacuccagccugggcaac

SEQ ID NO: 852476 - RNA, 20 nt, Human
ucccaccccauccccaacca

SEQ ID NO: 852477 - RNA, 23 nt, Human
ucgcuugagcccaggaguucaag

SEQ ID NO: 852478 - RNA, 28 nt, Human
ucucuacaaaaaaaaaauacaaaaaauu

SEQ ID NO: 852479 - RNA, 25 nt, Human
ugaagcaggcagaucgcuugagccc

SEQ ID NO: 852480 - RNA, 24 nt, Human
ugagacaauauuaagugaaaaaaa

SEQ ID NO: 852481 - RNA, 23 nt, Human
ugagcccaggaguucaagacuag

SEQ ID NO: 852482 - RNA, 22 nt, Human
ugagccgagaucacgucacugc

SEQ ID NO: 852483 - RNA, 24 nt, Human
ugaggugggaugaucacuugagcc

SEQ ID NO: 852484 - RNA, 23 nt, Human
ugccuguaauccuagcacucugg

SEQ ID NO: 852485 - RNA, 24 nt, Human
ugccuguaauccuagcacucuggg

SEQ ID NO: 852486 - RNA, 19 nt, Human
uggcucaugccuguaaucc

SEQ ID NO: 852487 - RNA, 24 nt, Human
uggcucaugccuguaauccuagca

SEQ ID NO: 852488 - RNA, 23 nt, Human
ugggaggcugaagcaggcagauc

SEQ ID NO: 852489 - RNA, 24 nt, Human
ugggaggcugaagcaggcagaucg

SEQ ID NO: 852490 - RNA, 18 nt, Human
uggugcauaccuguaguc

SEQ ID NO: 852491 - RNA, 21 nt, Human
uuagcuggucguggugcauac

SEQ ID NO: 852492 - RNA, 22 nt, Human
uuagcuggucguggugcauacc

SEQ ID NO: 852493 - RNA, 21 nt, Human
uucaaugucccaccccauccc

SEQ ID NO: 852494 - RNA, 19 nt, Human
uucagcacuugcccuggac

SEQ ID NO: 852495 - RNA, 19 nt, Human
uuccaaaaggacauuuucu

SEQ ID NO: 852496 - RNA, 21 nt, Human
uugagcccaggaguucaagac

SEQ ID NO: 852497 - RNA, 18 nt, Human
aaaucaggacaucaagac

SEQ ID NO: 852498 - RNA, 22 nt, Human
aagaaucacguuccuuugagcc

SEQ ID NO: 852499 - RNA, 18 nt, Human
aagcaaguauacaguuua

SEQ ID NO: 852500 - RNA, 24 nt, Human
cacucuauuguuuagacacaugcc

SEQ ID NO: 852501 - RNA, 18 nt, Human
cagccgcuacuggaggag

SEQ ID NO: 852502 - RNA, 18 nt, Human
ccgcuacuggaggagugc

SEQ ID NO: 852503 - RNA, 23 nt, Human
uagaacaaaucaggacaucaaga

SEQ ID NO: 852504 - RNA, 25 nt, Human
uagaacaaaucaggacaucaagaca

SEQ ID NO: 852505 - RNA, 21 nt, Human
ucugaagacuucuuuauaucu

SEQ ID NO: 852506 - RNA, 21 nt, Human
uucccgcguaggcggggcgag

SEQ ID NO: 852507 - RNA, 20 nt, Human
uuggguucccgcguaggcgg

SEQ ID NO: 852508 - RNA, 22 nt, Human
aaaccaaagaugaaaauuacag

SEQ ID NO: 852509 - RNA, 24 nt, Human
aagcaaggagaaaguacggaggca

SEQ ID NO: 852510 - RNA, 20 nt, Human
aagcaauccccuauugcaaa

SEQ ID NO: 852511 - RNA, 18 nt, Human
aaguagggcggugaagcc

SEQ ID NO: 852512 - RNA, 24 nt, Human
aauacaaaauguggaaaauuugga

SEQ ID NO: 852513 - RNA, 22 nt, Human
agauggcagaggcacauagcga

SEQ ID NO: 852514 - RNA, 23 nt, Human
agcagaaaaggaauaaauuccca

SEQ ID NO: 852515 - RNA, 18 nt, Human
aggagagggcuggaggcu

SEQ ID NO: 852516 - RNA, 23 nt, Human
aggcagaaagccuggagagaaau

SEQ ID NO: 852517 - RNA, 22 nt, Human
aggccacaugacacauaucacc

SEQ ID NO: 852518 - RNA, 23 nt, Human
aguacggaggcaguguccaggga

SEQ ID NO: 852519 - RNA, 24 nt, Human
auccccuauugcaaacuuucguua

SEQ ID NO: 852520 - RNA, 22 nt, Human
auugcuucccauuuuucuccau

SEQ ID NO: 852521 - RNA, 24 nt, Human
caaaauugaaaucacauaacaugc

SEQ ID NO: 852522 - RNA, 26 nt, Human
cacccaacugucauccaggaagccug

SEQ ID NO: 852523 - RNA, 22 nt, Human
cacccauauuuuaaaaaacaaa

SEQ ID NO: 852524 - RNA, 22 nt, Human
caccucugcuccaugaugggug

SEQ ID NO: 852525 - RNA, 22 nt, Human
cagcagaaaaggaauaaauucc

SEQ ID NO: 852526 - RNA, 21 nt, Human
cagugacuuuguuccaccaua

SEQ ID NO: 852527 - RNA, 24 nt, Human
caucucggaggcagaaagccugga

SEQ ID NO: 852528 - RNA, 24 nt, Human
caucuggauggagauacaauaauu

SEQ ID NO: 852529 - RNA, 22 nt, Human
ccaaagauagaauucguagguc

SEQ ID NO: 852530 - RNA, 22 nt, Human
ccaauauugggucuuauuuuuu

SEQ ID NO: 852531 - RNA, 22 nt, Human
cccaaccaaaccauugcuuccc

SEQ ID NO: 852532 - RNA, 22 nt, Human
cccacacgcaauguaugggaau

SEQ ID NO: 852533 - RNA, 25 nt, Human
ccccuauugcaaacuuucguuacag

SEQ ID NO: 852534 - RNA, 18 nt, Human
ccuuccgucuuuuuuauc

SEQ ID NO: 852535 - RNA, 22 nt, Human
cguauacaagcauacacccaua

SEQ ID NO: 852536 - RNA, 24 nt, Human
cuccaugaugggugaagauggcag

SEQ ID NO: 852537 - RNA, 20 nt, Human
cucuuggggugcuccuggcc

SEQ ID NO: 852538 - RNA, 21 nt, Human
cuggaggcucgccgucaaugg

SEQ ID NO: 852539 - RNA, 22 nt, Human
cuucccauuuuucuccauugca

SEQ ID NO: 852540 - RNA, 18 nt, Human
cuugguccuugaggcugc

SEQ ID NO: 852541 - RNA, 19 nt, Human
gaaauuacagaaaaaccaa

SEQ ID NO: 852542 - RNA, 18 nt, Human
ggcggagguggaaguagg

SEQ ID NO: 852543 - RNA, 21 nt, Human
ggcggugaagccacagggcac

SEQ ID NO: 852544 - RNA, 18 nt, Human
guucuuuuacaugacuuu

SEQ ID NO: 852545 - RNA, 24 nt, Human
uaacaugcacuauuuuuacaaccu

SEQ ID NO: 852546 - RNA, 19 nt, Human
uacaaagauaaccacucaa

SEQ ID NO: 852547 - RNA, 24 nt, Human
uacacccauauuuuaaaaaacaaa

SEQ ID NO: 852548 - RNA, 19 nt, Human
ucaaaguaggagagggcug

SEQ ID NO: 852549 - RNA, 25 nt, Human
ucagucagauguucuuuuacaugac

SEQ ID NO: 852550 - RNA, 23 nt, Human
uccaccauacaaagauaaccacu

SEQ ID NO: 852551 - RNA, 18 nt, Human
uccagggacagagucacc

SEQ ID NO: 852552 - RNA, 20 nt, Human
ucccaaagauagaauucgua

SEQ ID NO: 852553 - RNA, 23 nt, Human
uccccuauugcaaacuuucguua

SEQ ID NO: 852554 - RNA, 19 nt, Human
uccccugcuucucuaccuc

SEQ ID NO: 852555 - RNA, 22 nt, Human
ugaaaucacauaacaugcacua

SEQ ID NO: 852556 - RNA, 23 nt, Human
ugacuuuguuccaccauacaaag

SEQ ID NO: 852557 - RNA, 21 nt, Human
ugcuccaugaugggugaagau

SEQ ID NO: 852558 - RNA, 21 nt, Human
ugcugggaugaacaucuuauc

SEQ ID NO: 852559 - RNA, 22 nt, Human
ugcuguggccagugaagcaagg

SEQ ID NO: 852560 - RNA, 21 nt, Human
ugcuuccagcucuauuugccu

SEQ ID NO: 852561 - RNA, 18 nt, Human
uguugcagccuaugaguc

SEQ ID NO: 852562 - RNA, 19 nt, Human
uucuugguccuugaggcug

SEQ ID NO: 852563 - RNA, 22 nt, Human
uugcaaugcugggaugaacauc

SEQ ID NO: 852564 - RNA, 20 nt, Human
uuggaaauuacagaaaaacc

SEQ ID NO: 852565 - RNA, 18 nt, Human
uugggucuuauuuuuuuc

SEQ ID NO: 852566 - RNA, 20 nt, Human
uuguuccaccauacaaagau

SEQ ID NO: 852567 - RNA, 20 nt, Human
uuuacuuaagcaauccccua

SEQ ID NO: 852568 - RNA, 26 nt, Human
uuuuaggccacaugacacauaucacc

SEQ ID NO: 852569 - RNA, 21 nt, Human
aaccaggcccccggccgcucc

SEQ ID NO: 852570 - RNA, 23 nt, Human
aacccagaauguggggcuggcgg

SEQ ID NO: 852571 - RNA, 22 nt, Human
aaccgaagccgaaccaggcccc

SEQ ID NO: 852572 - RNA, 20 nt, Human
aagcacauacacaggauucc

SEQ ID NO: 852573 - RNA, 23 nt, Human
aagcagggaaaugacugacagaa

SEQ ID NO: 852574 - RNA, 22 nt, Human
aagccgcagaaaccgaagccga

SEQ ID NO: 852575 - RNA, 24 nt, Human
aagccgcagaaaccgaagccgaac

SEQ ID NO: 852576 - RNA, 22 nt, Human
aagcggccuccaccugcggggc

SEQ ID NO: 852577 - RNA, 18 nt, Human
aagucucuggccuuccag

SEQ ID NO: 852578 - RNA, 20 nt, Human
acagcuccaagcggccucca

SEQ ID NO: 852579 - RNA, 20 nt, Human
acgcggcagaugucgacgcc

SEQ ID NO: 852580 - RNA, 19 nt, Human
acuauccaggccacacacc

SEQ ID NO: 852581 - RNA, 22 nt, Human
agaacaccauauagcauuaaaa

SEQ ID NO: 852582 - RNA, 24 nt, Human
agaauggaggcggcggggaugggg

SEQ ID NO: 852583 - RNA, 19 nt, Human
aggcccccggccgcuccuc

SEQ ID NO: 852584 - RNA, 21 nt, Human
agugacaaaaacgacacaaaa

SEQ ID NO: 852585 - RNA, 21 nt, Human
aguggggacggggcggggagg

SEQ ID NO: 852586 - RNA, 24 nt, Human
auggauuauacaaugcugagugac

SEQ ID NO: 852587 - RNA, 27 nt, Human
caacagaacaccauauagcauuaaaaa

SEQ ID NO: 852588 - RNA, 19 nt, Human
cagaaaccgaagccgaacc

SEQ ID NO: 852589 - RNA, 20 nt, Human
cagaguuuucaaugcucucc

SEQ ID NO: 852590 - RNA, 23 nt, Human
cagcagaguuuucaaugcucucc

SEQ ID NO: 852591 - RNA, 18 nt, Human
caggccacacaccuagaa

SEQ ID NO: 852592 - RNA, 18 nt, Human
cauacaacagaacaccau

SEQ ID NO: 852593 - RNA, 22 nt, Human
cauauagcauuaaaaaugaacu

SEQ ID NO: 852594 - RNA, 22 nt, Human
ccaacaaggauggauuauacaa

SEQ ID NO: 852595 - RNA, 21 nt, Human
ccagguguuucuaaagugcag

SEQ ID NO: 852596 - RNA, 23 nt, Human
cccacgcagcgccgauucggccg

SEQ ID NO: 852597 - RNA, 21 nt, Human
cccgcagcggacuggggcugu

SEQ ID NO: 852598 - RNA, 19 nt, Human
cccgccgcgccgcuggcug

SEQ ID NO: 852599 - RNA, 22 nt, Human
ccgaagccgaaccaggcccccg

SEQ ID NO: 852600 - RNA, 22 nt, Human
ccgcagaaaccgaagccgaacc

SEQ ID NO: 852601 - RNA, 24 nt, Human
ccgcagaaaccgaagccgaaccag

SEQ ID NO: 852602 - RNA, 23 nt, Human
ccgccgcgccgcuggcugagccc

SEQ ID NO: 852603 - RNA, 24 nt, Human
ccgcgaggagccccuccgaggccc

SEQ ID NO: 852604 - RNA, 18 nt, Human
ccgcgccgcuggcugagc

SEQ ID NO: 852605 - RNA, 18 nt, Human
ccggagcccagcuccugc

SEQ ID NO: 852606 - RNA, 19 nt, Human
ccggagcccagcuccugcc

SEQ ID NO: 852607 - RNA, 24 nt, Human
ccucaccggccggaucgucuuccc

SEQ ID NO: 852608 - RNA, 20 nt, Human
ccuccaacagccguggcucc

SEQ ID NO: 852609 - RNA, 23 nt, Human
ccuccagggucccauggcccagc

SEQ ID NO: 852610 - RNA, 29 nt, Human
ccuccagggucccauggcccagcuguccc

SEQ ID NO: 852611 - RNA, 18 nt, Human
ccuccgaggcccacgcgu

SEQ ID NO: 852612 - RNA, 24 nt, Human
ccuggcugcggcgggcccgggggg

SEQ ID NO: 852613 - RNA, 21 nt, Human
cgaagccgaaccaggcccccg

SEQ ID NO: 852614 - RNA, 21 nt, Human
cgagcagcgcccucugccggc

SEQ ID NO: 852615 - RNA, 19 nt, Human
cgcccagaccugcaguaac

SEQ ID NO: 852616 - RNA, 18 nt, Human
cgcggcagaugucgacgc

SEQ ID NO: 852617 - RNA, 25 nt, Human
cggccucgggcaccacauucugggc

SEQ ID NO: 852618 - RNA, 18 nt, Human
cguccggagcccagcucc

SEQ ID NO: 852619 - RNA, 23 nt, Human
cguccggagcccagcuccugccc

SEQ ID NO: 852620 - RNA, 23 nt, Human
cgucuuccccuucggccucgggc

SEQ ID NO: 852621 - RNA, 19 nt, Human
cuaugcccucuacccucuc

SEQ ID NO: 852622 - RNA, 18 nt, Human
cucccagccugggccuca

SEQ ID NO: 852623 - RNA, 21 nt, Human
cucucgggcagguccuucugg

SEQ ID NO: 852624 - RNA, 18 nt, Human
cugaccuuaggcagcaga

SEQ ID NO: 852625 - RNA, 18 nt, Human
cugggcccacaauggcuc

SEQ ID NO: 852626 - RNA, 18 nt, Human
cuugagggugaagggcag

SEQ ID NO: 852627 - RNA, 20 nt, Human
cuugaucuugacccuaugcc

SEQ ID NO: 852628 - RNA, 23 nt, Human
gaagccgcagaaaccgaagccga

SEQ ID NO: 852629 - RNA, 21 nt, Human
gaauaaguggggacggggcgg

SEQ ID NO: 852630 - RNA, 18 nt, Human
gagcaggguggccagaau

SEQ ID NO: 852631 - RNA, 21 nt, Human
gccgccgccuggcugcggcgg

SEQ ID NO: 852632 - RNA, 24 nt, Human
gccuccaacagccguggcuccagc

SEQ ID NO: 852633 - RNA, 19 nt, Human
gccuuccaggggcuggagc

SEQ ID NO: 852634 - RNA, 21 nt, Human
gcucggcgcccagcuccagcu

SEQ ID NO: 852635 - RNA, 22 nt, Human
ggagccccuccgaggcccacgc

SEQ ID NO: 852636 - RNA, 20 nt, Human
ggccagcagcguccagcagc

SEQ ID NO: 852637 - RNA, 23 nt, Human
ggcccugcaacgccuccaacagc

SEQ ID NO: 852638 - RNA, 24 nt, Human
gggaggggcaaauauggggcccuu

SEQ ID NO: 852639 - RNA, 20 nt, Human
gggcagcagggguagccucc

SEQ ID NO: 852640 - RNA, 18 nt, Human
ggggauggggggagcggg

SEQ ID NO: 852641 - RNA, 18 nt, Human
gugaagggcaggacugug

SEQ ID NO: 852642 - RNA, 24 nt, Human
guggggcuggcggccugaacgggg

SEQ ID NO: 852643 - RNA, 24 nt, Human
uaccugggaugagguggguggagc

SEQ ID NO: 852644 - RNA, 19 nt, Human
uagcauuaaaaaugaacuc

SEQ ID NO: 852645 - RNA, 20 nt, Human
uagccucccagccugggccu

SEQ ID NO: 852646 - RNA, 24 nt, Human
uauccaggccacacaccuagaagc

SEQ ID NO: 852647 - RNA, 25 nt, Human
uauccaggccacacaccuagaagcu

SEQ ID NO: 852648 - RNA, 20 nt, Human
uccaagcggccuccaccugc

SEQ ID NO: 852649 - RNA, 18 nt, Human
uccagggucccauggccc

SEQ ID NO: 852650 - RNA, 28 nt, Human
uccccacgcagcgccgauucggccgccc

SEQ ID NO: 852651 - RNA, 20 nt, Human
uccggccccggcccggcgcg

SEQ ID NO: 852652 - RNA, 18 nt, Human
ucggcgcccagcuccagc

SEQ ID NO: 852653 - RNA, 19 nt, Human
ucuaacacucaaaagcaaa

SEQ ID NO: 852654 - RNA, 21 nt, Human
ucuccagguguuucuaaagug

SEQ ID NO: 852655 - RNA, 23 nt, Human
ugacaaaaacgacacaaaagcac

SEQ ID NO: 852656 - RNA, 19 nt, Human
ugacagaagacgaugaccu

SEQ ID NO: 852657 - RNA, 18 nt, Human
ugaccugaaugggggucu

SEQ ID NO: 852658 - RNA, 22 nt, Human
ugaugcugaccuuaggcagcag

SEQ ID NO: 852659 - RNA, 24 nt, Human
ugauggggaggggcaaauaugggg

SEQ ID NO: 852660 - RNA, 19 nt, Human
ugcccgaagccgcagaaac

SEQ ID NO: 852661 - RNA, 20 nt, Human
ugcccgagcagcgcccucug

SEQ ID NO: 852662 - RNA, 19 nt, Human
ugcccgcagcuccggagcc

SEQ ID NO: 852663 - RNA, 24 nt, Human
ugccggccgccgccuggcugcggc

SEQ ID NO: 852664 - RNA, 18 nt, Human
ugccuccagggucccaug

SEQ ID NO: 852665 - RNA, 25 nt, Human
uggagcaggguggccagaauggagg

SEQ ID NO: 852666 - RNA, 18 nt, Human
ugggaugaggugggugga

SEQ ID NO: 852667 - RNA, 20 nt, Human
ugggaugagguggguggagc

SEQ ID NO: 852668 - RNA, 21 nt, Human
ugggcagccuuggaggaaacg

SEQ ID NO: 852669 - RNA, 24 nt, Human
uggggaggggcaaauauggggccc

SEQ ID NO: 852670 - RNA, 19 nt, Human
uggggcuggcggccugaac

SEQ ID NO: 852671 - RNA, 21 nt, Human
uggguggagcuuugaaucuac

SEQ ID NO: 852672 - RNA, 27 nt, Human
uguugcauauacauauacguacacaug

SEQ ID NO: 852673 - RNA, 25 nt, Human
uuaaaaaugaacuccaggacccaac

SEQ ID NO: 852674 - RNA, 22 nt, Human
uuaucuaacacucaaaagcaaa

SEQ ID NO: 852675 - RNA, 19 nt, Human
uucaaacgaaagcagggaa

SEQ ID NO: 852676 - RNA, 20 nt, Human
uuggagcaggguggccagaa

SEQ ID NO: 852677 - RNA, 22 nt, Human
uuuuccuugaccugaauggggg

SEQ ID NO: 852678 - RNA, 18 nt, Human
uuuuuuuuuuuuuuuuug

SEQ ID NO: 852679 - RNA, 19 nt, Human
uuuuuuuuuuuuuuuuugu

SEQ ID NO: 852680 - RNA, 24 nt, Human
aaagugcugagauuacagguguga

SEQ ID NO: 852681 - RNA, 24 nt, Human
aagagcuuucuagaaagaguugaa

SEQ ID NO: 852682 - RNA, 19 nt, Human
aagggguuucaccauguag

SEQ ID NO: 852683 - RNA, 24 nt, Human
aagggguuucaccauguaggcuag

SEQ ID NO: 852684 - RNA, 20 nt, Human
aaguauacgccacaugccag

SEQ ID NO: 852685 - RNA, 20 nt, Human
aagugacucaaagaugagcc

SEQ ID NO: 852686 - RNA, 26 nt, Human
aagugcugagauuacaggugugagcc

SEQ ID NO: 852687 - RNA, 19 nt, Human
aauaucucuccaucccuga

SEQ ID NO: 852688 - RNA, 23 nt, Human
acaguguccuuaccucacaagca

SEQ ID NO: 852689 - RNA, 19 nt, Human
acccaggcuggagugcagu

SEQ ID NO: 852690 - RNA, 22 nt, Human
accugcucuaguuccacuaucc

SEQ ID NO: 852691 - RNA, 23 nt, Human
acuccauaaauaccaagcaaauc

SEQ ID NO: 852692 - RNA, 19 nt, Human
agagucuccugacuccgcc

SEQ ID NO: 852693 - RNA, 18 nt, Human
agagugccaugaaggaaa

SEQ ID NO: 852694 - RNA, 22 nt, Human
agauuacaggugugagccacug

SEQ ID NO: 852695 - RNA, 25 nt, Human
aggcuggagugcaguggcacagucu

SEQ ID NO: 852696 - RNA, 24 nt, Human
agggguuucaccauguaggcuagg

SEQ ID NO: 852697 - RNA, 19 nt, Human
agugauccacccaccucaa

SEQ ID NO: 852698 - RNA, 20 nt, Human
agugcaguggcacagucuug

SEQ ID NO: 852699 - RNA, 24 nt, Human
agugcaguggcacagucuuggcuc

SEQ ID NO: 852700 - RNA, 24 nt, Human
caaagugcugagauuacaggugug

SEQ ID NO: 852701 - RNA, 23 nt, Human
caacagcaaacaaaaugccauca

SEQ ID NO: 852702 - RNA, 21 nt, Human
caagcaacagcaaacaaaaug

SEQ ID NO: 852703 - RNA, 23 nt, Human
caagcauccuuuacuccagccca

SEQ ID NO: 852704 - RNA, 21 nt, Human
caccauguaggcuaggcuggu

SEQ ID NO: 852705 - RNA, 22 nt, Human
caccauguaggcuaggcugguc

SEQ ID NO: 852706 - RNA, 23 nt, Human
cacccaccucaacuucccaaagu

SEQ ID NO: 852707 - RNA, 24 nt, Human
caccucaacuucccaaagugcuga

SEQ ID NO: 852708 - RNA, 24 nt, Human
cacuccacuugcuucacugucacu

SEQ ID NO: 852709 - RNA, 21 nt, Human
cacugcaaccucugccuccug

SEQ ID NO: 852710 - RNA, 23 nt, Human
cacugcaaccucugccuccuggg

SEQ ID NO: 852711 - RNA, 24 nt, Human
cauguaggcuaggcuggucccgaa

SEQ ID NO: 852712 - RNA, 21 nt, Human
ccaaagugcugagauuacagg

SEQ ID NO: 852713 - RNA, 21 nt, Human
ccaaagugcugagauuacagg

SEQ ID NO: 852714 - RNA, 24 nt, Human
ccaaagugcugagauuacaggugu

SEQ ID NO: 852715 - RNA, 19 nt, Human
ccagaggucuuugcuucaa

SEQ ID NO: 852716 - RNA, 22 nt, Human
ccaucccaaccacuccacuugc

SEQ ID NO: 852717 - RNA, 18 nt, Human
ccauugccaguucccagg

SEQ ID NO: 852718 - RNA, 19 nt, Human
ccccauuaccuaucucuuu

SEQ ID NO: 852719 - RNA, 23 nt, Human
cccccauugccaguucccaggcu

SEQ ID NO: 852720 - RNA, 24 nt, Human
cccgaguagcugugacuacaggug

SEQ ID NO: 852721 - RNA, 18 nt, Human
cccggccucaagugaucc

SEQ ID NO: 852722 - RNA, 24 nt, Human
cccggccucaagugauccacccac

SEQ ID NO: 852723 - RNA, 23 nt, Human
ccgccucccgaguagcugugacu

SEQ ID NO: 852724 - RNA, 19 nt, Human
ccuauguggucacuaaagu

SEQ ID NO: 852725 - RNA, 22 nt, Human
ccucaagugauccacccaccuc

SEQ ID NO: 852726 - RNA, 21 nt, Human
ccucucuaacugaugucacuc

SEQ ID NO: 852727 - RNA, 19 nt, Human
ccucugccuccuggguuca

SEQ ID NO: 852728 - RNA, 23 nt, Human
ccuggguucaagagagucuccug

SEQ ID NO: 852729 - RNA, 20 nt, Human
ccuguagccugagccaccac

SEQ ID NO: 852730 - RNA, 24 nt, Human
cucaagugauccacccaccucaac

SEQ ID NO: 852731 - RNA, 24 nt, Human
cucacugcaaccucugccuccugg

SEQ ID NO: 852732 - RNA, 23 nt, Human
cucccggccucaagugauccacc

SEQ ID NO: 852733 - RNA, 27 nt, Human
cucccggccucaagugauccacccacc

SEQ ID NO: 852734 - RNA, 21 nt, Human
cuccuggguucaagagagucu

SEQ ID NO: 852735 - RNA, 20 nt, Human
cucugucacccaggcuggag

SEQ ID NO: 852736 - RNA, 20 nt, Human
cucuugagucccagaccucu

SEQ ID NO: 852737 - RNA, 19 nt, Human
cugacuccgccucccgagu

SEQ ID NO: 852738 - RNA, 23 nt, Human
cugcaaccucugccuccuggguu

SEQ ID NO: 852739 - RNA, 24 nt, Human
cugcaaccucugccuccuggguuc

SEQ ID NO: 852740 - RNA, 18 nt, Human
cugucacccaggcuggag

SEQ ID NO: 852741 - RNA, 19 nt, Human
cugucacccaggcuggagu

SEQ ID NO: 852742 - RNA, 22 nt, Human
cuucacugucacucuacugagu

SEQ ID NO: 852743 - RNA, 21 nt, Human
cuugcucugucacccaggcug

SEQ ID NO: 852744 - RNA, 20 nt, Human
cuuuaaauaucucuccaucc

SEQ ID NO: 852745 - RNA, 21 nt, Human
cuuucuagaaagaguugaaag

SEQ ID NO: 852746 - RNA, 19 nt, Human
gaaaguccuuagcgcaguc

SEQ ID NO: 852747 - RNA, 24 nt, Human
gaccgugcucuccuagauuuccac

SEQ ID NO: 852748 - RNA, 21 nt, Human
gacuacaggugcacaccacca

SEQ ID NO: 852749 - RNA, 21 nt, Human
gacuccgccucccgaguagcu

SEQ ID NO: 852750 - RNA, 25 nt, Human
gagcaccuagcauggugccucaaca

SEQ ID NO: 852751 - RNA, 21 nt, Human
gaucacucugcauuguaagaa

SEQ ID NO: 852752 - RNA, 18 nt, Human
gauuacaggugugagcca

SEQ ID NO: 852753 - RNA, 24 nt, Human
gauuacaggugugagccacugugc

SEQ ID NO: 852754 - RNA, 19 nt, Human
gcaagcaacagcaaacaaa

SEQ ID NO: 852755 - RNA, 20 nt, Human
gcccaugcaucccuacaaca

SEQ ID NO: 852756 - RNA, 19 nt, Human
gccccccaccuuugaccgu

SEQ ID NO: 852757 - RNA, 20 nt, Human
gcgcaguccacaguguccuu

SEQ ID NO: 852758 - RNA, 21 nt, Human
gcucacugcaaccucugccuc

SEQ ID NO: 852759 - RNA, 25 nt, Human
gcucugucacccaggcuggagugca

SEQ ID NO: 852760 - RNA, 19 nt, Human
gcuggagugcaguggcaca

SEQ ID NO: 852761 - RNA, 23 nt, Human
gcuggucccgaacucccggccuc

SEQ ID NO: 852762 - RNA, 22 nt, Human
gcuuccaucccaaccacuccac

SEQ ID NO: 852763 - RNA, 18 nt, Human
gggagcauauguguugac

SEQ ID NO: 852764 - RNA, 19 nt, Human
gggguuucaccauguaggc

SEQ ID NO: 852765 - RNA, 23 nt, Human
gggguuucaccauguaggcuagg

SEQ ID NO: 852766 - RNA, 24 nt, Human
gucuugcucugucacccaggcugg

SEQ ID NO: 852767 - RNA, 24 nt, Human
gugauccacccaccucaacuuccc

SEQ ID NO: 852768 - RNA, 20 nt, Human
uaaaccuguagccugagcca

SEQ ID NO: 852769 - RNA, 19 nt, Human
uaacaaaauauuuaccaag

SEQ ID NO: 852770 - RNA, 24 nt, Human
uacaggugcacaccaccacaucca

SEQ ID NO: 852771 - RNA, 23 nt, Human
uacaggugugagccacugugccc

SEQ ID NO: 852772 - RNA, 24 nt, Human
uacaggugugagccacugugccca

SEQ ID NO: 852773 - RNA, 18 nt, Human
uacuccagcccaugcauc

SEQ ID NO: 852774 - RNA, 25 nt, Human
uagaaagaguugaaaguccuuagcg

SEQ ID NO: 852775 - RNA, 22 nt, Human
uagagaagggguuucaccaugu

SEQ ID NO: 852776 - RNA, 20 nt, Human
uagcaagcaacagcaaacaa

SEQ ID NO: 852777 - RNA, 23 nt, Human
uagcauggugccucaacauaaaa

SEQ ID NO: 852778 - RNA, 24 nt, Human
uaguagagaagggguuucaccaug

SEQ ID NO: 852779 - RNA, 22 nt, Human
uaguauucuuuucaaaaggcca

SEQ ID NO: 852780 - RNA, 23 nt, Human
uauccaaaucuauacaugaacuc

SEQ ID NO: 852781 - RNA, 24 nt, Human
ucaaaguagagaguggugaaccac

SEQ ID NO: 852782 - RNA, 20 nt, Human
ucaagugauccacccaccuc

SEQ ID NO: 852783 - RNA, 24 nt, Human
ucacccaggcuggagugcaguggc

SEQ ID NO: 852784 - RNA, 24 nt, Human
ucacugcaaccucugccuccuggg

SEQ ID NO: 852785 - RNA, 25 nt, Human
ucacugcaaccucugccuccugggu

SEQ ID NO: 852786 - RNA, 27 nt, Human
ucacugcaaccucugccuccuggguuc

SEQ ID NO: 852787 - RNA, 20 nt, Human
ucacugucacucuacugagu

SEQ ID NO: 852788 - RNA, 23 nt, Human
ucaguggccucaaagagcuuucu

SEQ ID NO: 852789 - RNA, 21 nt, Human
uccacccaccucaacuuccca

SEQ ID NO: 852790 - RNA, 20 nt, Human
uccacuugcuucacugucac

SEQ ID NO: 852791 - RNA, 23 nt, Human
ucccaaagugcugagauuacagg

SEQ ID NO: 852792 - RNA, 24 nt, Human
ucccaaccacuccacuugcuucac

SEQ ID NO: 852793 - RNA, 23 nt, Human
ucccgaguagcugugacuacagg

SEQ ID NO: 852794 - RNA, 24 nt, Human
ucccgaguagcugugacuacaggu

SEQ ID NO: 852795 - RNA, 21 nt, Human
uccuggguucaagagagucuc

SEQ ID NO: 852796 - RNA, 24 nt, Human
uccuggguucaagagagucuccug

SEQ ID NO: 852797 - RNA, 20 nt, Human
ucuagagagcaacaguucau

SEQ ID NO: 852798 - RNA, 21 nt, Human
ucuccaucccugacaucaguc

SEQ ID NO: 852799 - RNA, 22 nt, Human
ucuccugacuccgccucccgag

SEQ ID NO: 852800 - RNA, 24 nt, Human
ucugucacccaggcuggagugcag

SEQ ID NO: 852801 - RNA, 22 nt, Human
ucuguccauucccccauuaccu

SEQ ID NO: 852802 - RNA, 23 nt, Human
ucuugcucugucacccaggcugg

SEQ ID NO: 852803 - RNA, 24 nt, Human
ucuugcucugucacccaggcugga

SEQ ID NO: 852804 - RNA, 21 nt, Human
ucuuuagccaguacucucuua

SEQ ID NO: 852805 - RNA, 22 nt, Human
ugacaccugguaugacauuucu

SEQ ID NO: 852806 - RNA, 20 nt, Human
ugacuccgccucccgaguag

SEQ ID NO: 852807 - RNA, 18 nt, Human
ugagacagagucuugcuc

SEQ ID NO: 852808 - RNA, 22 nt, Human
ugagacagagucuugcucuguc

SEQ ID NO: 852809 - RNA, 21 nt, Human
ugagaugucucucuugagucc

SEQ ID NO: 852810 - RNA, 22 nt, Human
ugagaugucucucuugaguccc

SEQ ID NO: 852811 - RNA, 21 nt, Human
ugagauuacaggugugagcca

SEQ ID NO: 852812 - RNA, 22 nt, Human
ugagauuacaggugugagccac

SEQ ID NO: 852813 - RNA, 22 nt, Human
ugagauuacaggugugagccac

SEQ ID NO: 852814 - RNA, 22 nt, Human
ugagauuacaggugugagccac

SEQ ID NO: 852815 - RNA, 24 nt, Human
ugagauuacaggugugagccacug

SEQ ID NO: 852816 - RNA, 19 nt, Human
ugagcaccuagcauggugc

SEQ ID NO: 852817 - RNA, 22 nt, Human
ugagucccagaccucuauaucc

SEQ ID NO: 852818 - RNA, 23 nt, Human
ugauccacccaccucaacuuccc

SEQ ID NO: 852819 - RNA, 22 nt, Human
ugcaguggcacagucuuggcuc

SEQ ID NO: 852820 - RNA, 24 nt, Human
ugcugagauuacaggugugagcca

SEQ ID NO: 852821 - RNA, 23 nt, Human
uggagugcaguggcacagucuug

SEQ ID NO: 852822 - RNA, 24 nt, Human
uggagugcaguggcacagucuugg

SEQ ID NO: 852823 - RNA, 20 nt, Human
uggucccgaacucccggccu

SEQ ID NO: 852824 - RNA, 18 nt, Human
uuaguagagaagggguuu

SEQ ID NO: 852825 - RNA, 22 nt, Human
uuaguagagaagggguuucacc

SEQ ID NO: 852826 - RNA, 24 nt, Human
uuaguagagaagggguuucaccau

SEQ ID NO: 852827 - RNA, 19 nt, Human
uucaagcagagaaugaagg

SEQ ID NO: 852828 - RNA, 21 nt, Human
uucaagcagagaaugaaggaa

SEQ ID NO: 852829 - RNA, 18 nt, Human
uucacugucacucuacug

SEQ ID NO: 852830 - RNA, 21 nt, Human
uucccaaagugcugagauuac

SEQ ID NO: 852831 - RNA, 18 nt, Human
uucccaggcuaagcacca

SEQ ID NO: 852832 - RNA, 24 nt, Human
uucccccauuaccuaucucuuuag

SEQ ID NO: 852833 - RNA, 20 nt, Human
uuccucguaacuugauguug

SEQ ID NO: 852834 - RNA, 19 nt, Human
uucuuuucaaaaggccaaa

SEQ ID NO: 852835 - RNA, 24 nt, Human
uuucaccauguaggcuaggcuggu

SEQ ID NO: 852836 - RNA, 19 nt, Human
uuuccauacucagcagcua

SEQ ID NO: 852837 - RNA, 24 nt, Human
uuuuuaguagagaagggguuucac

SEQ ID NO: 852838 - RNA, 20 nt, Human
uuuuuuuuuuugagacagag

SEQ ID NO: 852839 - RNA, 24 nt, Human
uuuuuuuuuuuugagacagagucu

SEQ ID NO: 852840 - RNA, 20 nt, Human
uuuuuuuuuuuuuuuuuugg

SEQ ID NO: 852841 - RNA, 20 nt, Human
aaaggcugugaagcugccua

SEQ ID NO: 852842 - RNA, 20 nt, Human
agagaagaggaaagaaaagg

SEQ ID NO: 852843 - RNA, 22 nt, Human
agagaccucugauagagaagag

SEQ ID NO: 852844 - RNA, 18 nt, Human
agggccccagcgccccuc

SEQ ID NO: 852845 - RNA, 24 nt, Human
caagggcaguagccucugcaacuu

SEQ ID NO: 852846 - RNA, 19 nt, Human
cagaccuucaagcauccuc

SEQ ID NO: 852847 - RNA, 20 nt, Human
cauuagccacauuuuaaaga

SEQ ID NO: 852848 - RNA, 18 nt, Human
cccagaaaauaaaucaga

SEQ ID NO: 852849 - RNA, 18 nt, Human
cccagggccccagcgccc

SEQ ID NO: 852850 - RNA, 19 nt, Human
ccccagcgccccucgugcc

SEQ ID NO: 852851 - RNA, 18 nt, Human
cgagcccgcgcugcccag

SEQ ID NO: 852852 - RNA, 27 nt, Human
cucaccgcuccagugggaccagcuacu

SEQ ID NO: 852853 - RNA, 25 nt, Human
cucccuggcauacauggaaccccag

SEQ ID NO: 852854 - RNA, 23 nt, Human
gccacauuuuaaagaugagggaa

SEQ ID NO: 852855 - RNA, 19 nt, Human
gcccagggccccagcgccc

SEQ ID NO: 852856 - RNA, 20 nt, Human
gcgcugcccagggccccagc

SEQ ID NO: 852857 - RNA, 18 nt, Human
ggggaagggagagaugga

SEQ ID NO: 852858 - RNA, 19 nt, Human
guuuuauauaccaugucuc

SEQ ID NO: 852859 - RNA, 24 nt, Human
ucaugagugccucccaagggcagu

SEQ ID NO: 852860 - RNA, 23 nt, Human
uccaccucaaguuuaugccagaa

SEQ ID NO: 852861 - RNA, 22 nt, Human
ucccaagggcaguagccucugc

SEQ ID NO: 852862 - RNA, 20 nt, Human
ucgcgcucucucuuucuccc

SEQ ID NO: 852863 - RNA, 24 nt, Human
ucuuucgcgcucucucuuucuccc

SEQ ID NO: 852864 - RNA, 18 nt, Human
ugagugccucccaagggc

SEQ ID NO: 852865 - RNA, 24 nt, Human
uggcauacauggaaccccagaaaa

SEQ ID NO: 852866 - RNA, 22 nt, Human
uguuauagucaucauuauugcu

SEQ ID NO: 852867 - RNA, 26 nt, Human
uguuauagucaucauuauugcuucca

SEQ ID NO: 852868 - RNA, 26 nt, Human
uuauauaccaugucucacuuaauccu

SEQ ID NO: 852869 - RNA, 18 nt, Human
uuuuuuuuuuuuuuuuug

SEQ ID NO: 852870 - RNA, 22 nt, Human
acaaagguagacccccaaaagc

SEQ ID NO: 852871 - RNA, 20 nt, Human
acggccgcguuggguuuugu

SEQ ID NO: 852872 - RNA, 21 nt, Human
agcaguacuggccgcggcgcg

SEQ ID NO: 852873 - RNA, 22 nt, Human
aggcggcgggcgcugugugcuc

SEQ ID NO: 852874 - RNA, 20 nt, Human
auccggaccuggcgguaaga

SEQ ID NO: 852875 - RNA, 19 nt, Human
caaagguagacccccaaaa

SEQ ID NO: 852876 - RNA, 22 nt, Human
caaagguagacccccaaaagcu

SEQ ID NO: 852877 - RNA, 24 nt, Human
caccuccaccucugagggagcaac

SEQ ID NO: 852878 - RNA, 20 nt, Human
cacgccccucugccgaaccc

SEQ ID NO: 852879 - RNA, 21 nt, Human
caguagaaguguuguccugcu

SEQ ID NO: 852880 - RNA, 23 nt, Human
ccaacuggcggucacgccccucu

SEQ ID NO: 852881 - RNA, 18 nt, Human
ccccccuuuuccccugcc

SEQ ID NO: 852882 - RNA, 24 nt, Human
ccccccuuuuccccugccgcgccc

SEQ ID NO: 852883 - RNA, 18 nt, Human
ccccucaccuccaccucu

SEQ ID NO: 852884 - RNA, 21 nt, Human
cccucugccgaacccuuggcc

SEQ ID NO: 852885 - RNA, 18 nt, Human
ccgccgccgccgccucug

SEQ ID NO: 852886 - RNA, 23 nt, Human
ccgcugccgccgccgccgccgcc

SEQ ID NO: 852887 - RNA, 22 nt, Human
ccucccgcggcugcugccccgc

SEQ ID NO: 852888 - RNA, 22 nt, Human
ccucuggcgccucgcucagccc

SEQ ID NO: 852889 - RNA, 22 nt, Human
cgccucuggaucuggacggacc

SEQ ID NO: 852890 - RNA, 23 nt, Human
cgcgcugcgcgccgccgcugccc

SEQ ID NO: 852891 - RNA, 19 nt, Human
cgcucagcccggccaacug

SEQ ID NO: 852892 - RNA, 22 nt, Human
cgcugcccggggagggagacgg

SEQ ID NO: 852893 - RNA, 21 nt, Human
cgcugcgcgccgccgcugccc

SEQ ID NO: 852894 - RNA, 24 nt, Human
cggcggaaggagacgcgcugcgcg

SEQ ID NO: 852895 - RNA, 21 nt, Human
cggcgggcgcugugugcucuu

SEQ ID NO: 852896 - RNA, 20 nt, Human
cgggauagccgcggaggcug

SEQ ID NO: 852897 - RNA, 23 nt, Human
cgguaagagagccagcgcccccc

SEQ ID NO: 852898 - RNA, 20 nt, Human
cucagcccggccaacuggcc

SEQ ID NO: 852899 - RNA, 20 nt, Human
cucccgggauagccgcggag

SEQ ID NO: 852900 - RNA, 18 nt, Human
cuccgcagggccgggcac

SEQ ID NO: 852901 - RNA, 18 nt, Human
cucugcugcuguuacugc

SEQ ID NO: 852902 - RNA, 20 nt, Human
cugccgccgccgccgccgcc

SEQ ID NO: 852903 - RNA, 26 nt, Human
cugcucugcugcuguuacugcgggac

SEQ ID NO: 852904 - RNA, 19 nt, Human
cugcugccccgcccgcgcc

SEQ ID NO: 852905 - RNA, 21 nt, Human
cugugugcucugaacaucaaa

SEQ ID NO: 852906 - RNA, 22 nt, Human
cuucacuuuccccucaccucca

SEQ ID NO: 852907 - RNA, 19 nt, Human
gaccuggcgguaagagagc

SEQ ID NO: 852908 - RNA, 28 nt, Human
gagaagaaugaaaggaucaccgguaccc

SEQ ID NO: 852909 - RNA, 18 nt, Human
gcccuggcccccaucccg

SEQ ID NO: 852910 - RNA, 18 nt, Human
gccgccgccgccgccgcc

SEQ ID NO: 852911 - RNA, 24 nt, Human
gccgcugcccggggagggagacgg

SEQ ID NO: 852912 - RNA, 18 nt, Human
gccucgcucagcccggcc

SEQ ID NO: 852913 - RNA, 19 nt, Human
gcgguggcggcggcugggc

SEQ ID NO: 852914 - RNA, 25 nt, Human
ggacugcuaauucaggcuaacucag

SEQ ID NO: 852915 - RNA, 21 nt, Human
ggagcaacgaauacaaaggua

SEQ ID NO: 852916 - RNA, 18 nt, Human
guccugcucugcugcugu

SEQ ID NO: 852917 - RNA, 21 nt, Human
gucucccgcugccgccgccgc

SEQ ID NO: 852918 - RNA, 22 nt, Human
ucacuuuccccucaccuccacc

SEQ ID NO: 852919 - RNA, 18 nt, Human
ucccccucguuuucccuu

SEQ ID NO: 852920 - RNA, 18 nt, Human
ucccgcugccgccgccgc

SEQ ID NO: 852921 - RNA, 24 nt, Human
ucccgcugccgccgccgccgccgg

SEQ ID NO: 852922 - RNA, 18 nt, Human
ucccugcgucucuccgag

SEQ ID NO: 852923 - RNA, 20 nt, Human
ucggggucuucgacggccgc

SEQ ID NO: 852924 - RNA, 23 nt, Human
ucucccgcugccgccgccgccgc

SEQ ID NO: 852925 - RNA, 19 nt, Human
ugagaagaaugaaaggauc

SEQ ID NO: 852926 - RNA, 22 nt, Human
ugaggcgucaacccaggaguuu

SEQ ID NO: 852927 - RNA, 19 nt, Human
ugaucagaguggaaccacu

SEQ ID NO: 852928 - RNA, 22 nt, Human
ugccucggggucuucgacggcc

SEQ ID NO: 852929 - RNA, 21 nt, Human
ugcuaauucaggcuaacucag

SEQ ID NO: 852930 - RNA, 20 nt, Human
uggccgcggcgcgguggcgg

SEQ ID NO: 852931 - RNA, 21 nt, Human
uguccugcucugcugcuguua

SEQ ID NO: 852932 - RNA, 19 nt, Human
uuaguaucaccacaaauga

SEQ ID NO: 852933 - RNA, 23 nt, Human
uugcaggcuucccucuggcgccu

SEQ ID NO: 852934 - RNA, 23 nt, Human
uugguucugcugugacuuugggg

SEQ ID NO: 852935 - RNA, 24 nt, Human
uuucaguagaaguguuguccugcu

SEQ ID NO: 852936 - RNA, 20 nt, Human
uuucccccucguuuucccuu

SEQ ID NO: 852937 - RNA, 19 nt, Human
uuugcccgcaucccuugcc

SEQ ID NO: 852938 - RNA, 25 nt, Human
aaagaccuugguuucagugggagag

SEQ ID NO: 852939 - RNA, 26 nt, Human
aaaucaauaucuuauaacaaaacuag

SEQ ID NO: 852940 - RNA, 23 nt, Human
aaauccccaauaaaauaaccucu

SEQ ID NO: 852941 - RNA, 19 nt, Human
aaccuagaaguagauggca

SEQ ID NO: 852942 - RNA, 22 nt, Human
aagauguuauuaguucuuaaaa

SEQ ID NO: 852943 - RNA, 21 nt, Human
aagccguagcaaccuagggac

SEQ ID NO: 852944 - RNA, 22 nt, Human
acacacuaaaaccaacuguuca

SEQ ID NO: 852945 - RNA, 19 nt, Human
agccguagcaaccuaggga

SEQ ID NO: 852946 - RNA, 23 nt, Human
aggaaaaaagauuucaacaaaau

SEQ ID NO: 852947 - RNA, 21 nt, Human
auacuaagcuacaacaaaaca

SEQ ID NO: 852948 - RNA, 22 nt, Human
augguuuuauuccuaauuuuua

SEQ ID NO: 852949 - RNA, 18 nt, Human
augugcuugcuaugugug

SEQ ID NO: 852950 - RNA, 24 nt, Human
caaaguuauacaacacacuaaaac

SEQ ID NO: 852951 - RNA, 22 nt, Human
caaauacagauccuaacaaagg

SEQ ID NO: 852952 - RNA, 20 nt, Human
caaauagacuacauaauaua

SEQ ID NO: 852953 - RNA, 18 nt, Human
cacacacuggacaugaag

SEQ ID NO: 852954 - RNA, 18 nt, Human
cagauccuaacaaaggca

SEQ ID NO: 852955 - RNA, 19 nt, Human
ccaauaccuaaugugccag

SEQ ID NO: 852956 - RNA, 20 nt, Human
ccacacacuggacaugaagc

SEQ ID NO: 852957 - RNA, 21 nt, Human
ccacaucccccugaauuaaaa

SEQ ID NO: 852958 - RNA, 24 nt, Human
ccauacaguuuacaaauacacuuu

SEQ ID NO: 852959 - RNA, 21 nt, Human
cccaaaauauaaaauccuaug

SEQ ID NO: 852960 - RNA, 21 nt, Human
cccaacaacauacagaaaaca

SEQ ID NO: 852961 - RNA, 23 nt, Human
ccucuaaaaauaaucuugaccau

SEQ ID NO: 852962 - RNA, 18 nt, Human
ccugaauuaaaaauaacu

SEQ ID NO: 852963 - RNA, 21 nt, Human
cgacuuuccaaacaaccucau

SEQ ID NO: 852964 - RNA, 18 nt, Human
cuacaacaaaacacuuga

SEQ ID NO: 852965 - RNA, 20 nt, Human
cuagaaguagauggcaucca

SEQ ID NO: 852966 - RNA, 21 nt, Human
cuagaaguagauggcauccau

SEQ ID NO: 852967 - RNA, 19 nt, Human
cuccaauaccuaaugugcc

SEQ ID NO: 852968 - RNA, 18 nt, Human
cugacugcucuggcccug

SEQ ID NO: 852969 - RNA, 24 nt, Human
gaacaugauaguuugcugaccucg

SEQ ID NO: 852970 - RNA, 22 nt, Human
gacaucagggaggccaugugcu

SEQ ID NO: 852971 - RNA, 23 nt, Human
gcaaagcaguugcgcuaacaccc

SEQ ID NO: 852972 - RNA, 22 nt, Human
gcaaauacagauccuaacaaag

SEQ ID NO: 852973 - RNA, 24 nt, Human
gcgccuuuuaguuuuuuuuaaaaa

SEQ ID NO: 852974 - RNA, 22 nt, Human
ggaggccaugugcuugcuaugu

SEQ ID NO: 852975 - RNA, 22 nt, Human
gugaaucucuugaaacacuaaa

SEQ ID NO: 852976 - RNA, 25 nt, Human
uaaagaaugcacacacaccaagaaa

SEQ ID NO: 852977 - RNA, 20 nt, Human
uaacaaaacuagccaagauc

SEQ ID NO: 852978 - RNA, 19 nt, Human
uaacaaaggcauccugaca

SEQ ID NO: 852979 - RNA, 24 nt, Human
uaacucuggccuuggccuaaguuu

SEQ ID NO: 852980 - RNA, 22 nt, Human
uaagcuacaacaaaacacuuga

SEQ ID NO: 852981 - RNA, 22 nt, Human
uaauacccaccagcaaccuaga

SEQ ID NO: 852982 - RNA, 18 nt, Human
uaauucuuucaccccaaa

SEQ ID NO: 852983 - RNA, 19 nt, Human
uacaacaaaacacuugaca

SEQ ID NO: 852984 - RNA, 26 nt, Human
uacaacaaaacacuugacaauugcaa

SEQ ID NO: 852985 - RNA, 21 nt, Human
uacagcaaaguuauacaacac

SEQ ID NO: 852986 - RNA, 23 nt, Human
uacaguuuacaaauacacuuuua

SEQ ID NO: 852987 - RNA, 20 nt, Human
uacuucauauacugcaggaa

SEQ ID NO: 852988 - RNA, 22 nt, Human
ucagcuuaaucagggauccuuu

SEQ ID NO: 852989 - RNA, 27 nt, Human
ucagcuuaaucagggauccuuuuccca

SEQ ID NO: 852990 - RNA, 22 nt, Human
uccaaacaaccucauucaccca

SEQ ID NO: 852991 - RNA, 23 nt, Human
ucccccugaauuaaaaauaacuc

SEQ ID NO: 852992 - RNA, 19 nt, Human
uccccgaagcaacuuggcu

SEQ ID NO: 852993 - RNA, 21 nt, Human
uccuggcuguuuccccgaagc

SEQ ID NO: 852994 - RNA, 23 nt, Human
ucuauagucuaaguuucccuuau

SEQ ID NO: 852995 - RNA, 19 nt, Human
ucuuuuaauacucugguac

SEQ ID NO: 852996 - RNA, 22 nt, Human
ugccagauaauucuuucacccc

SEQ ID NO: 852997 - RNA, 21 nt, Human
ugcucuggcccugggcgcucu

SEQ ID NO: 852998 - RNA, 26 nt, Human
ugcucuggcccugggcgcucugacuu

SEQ ID NO: 852999 - RNA, 21 nt, Human
ugguuuuauuccuaauuuuua

SEQ ID NO: 853000 - RNA, 23 nt, Human
ugucaaaauuaguuugauauaca

SEQ ID NO: 853001 - RNA, 21 nt, Human
uucaagaggaagaaggaaaaa

SEQ ID NO: 853002 - RNA, 22 nt, Human
uuuccaaacaaccucauucacc

SEQ ID NO: 853003 - RNA, 22 nt, Human
uuuuuuuuuuauaagaaaaugg

SEQ ID NO: 853004 - RNA, 25 nt, Human
aaaaaaaaaaaaaaaagcuauggaa

SEQ ID NO: 853005 - RNA, 24 nt, Human
aaaaaaaaaaaaaaagcuauggaa

SEQ ID NO: 853006 - RNA, 23 nt, Human
aaaaaaaaaaaaaagcuauggaa

SEQ ID NO: 853007 - RNA, 19 nt, Human
acagggcaagaccccgucu

SEQ ID NO: 853008 - RNA, 22 nt, Human
accccagccugggugacagggc

SEQ ID NO: 853009 - RNA, 20 nt, Human
acccgucuccaccuccccag

SEQ ID NO: 853010 - RNA, 18 nt, Human
accguaccccagccuggg

SEQ ID NO: 853011 - RNA, 21 nt, Human
accguaccccagccuggguga

SEQ ID NO: 853012 - RNA, 24 nt, Human
accguaccccagccugggugacag

SEQ ID NO: 853013 - RNA, 19 nt, Human
accuccccagcagcuguuc

SEQ ID NO: 853014 - RNA, 25 nt, Human
aggaaucuguuguagaagaguugcu

SEQ ID NO: 853015 - RNA, 18 nt, Human
aggcuggagugcaguggc

SEQ ID NO: 853016 - RNA, 22 nt, Human
aggggggcgauggggcacaggg

SEQ ID NO: 853017 - RNA, 25 nt, Human
agugcaguggcgugugaucucagcu

SEQ ID NO: 853018 - RNA, 22 nt, Human
agugcaguggcgugugaucucc

SEQ ID NO: 853019 - RNA, 19 nt, Human
cacagccccauuaugacau

SEQ ID NO: 853020 - RNA, 24 nt, Human
cacccaggcuggagugcaguggcg

SEQ ID NO: 853021 - RNA, 24 nt, Human
caccguaccccagccugggugaca

SEQ ID NO: 853022 - RNA, 20 nt, Human
cagagagauucuaugaccac

SEQ ID NO: 853023 - RNA, 18 nt, Human
cagcucacuguaagcucc

SEQ ID NO: 853024 - RNA, 19 nt, Human
caucccuccuucccucuuu

SEQ ID NO: 853025 - RNA, 23 nt, Human
ccaaaaaaaacugggcggggggc

SEQ ID NO: 853026 - RNA, 24 nt, Human
ccaccguaccccagccugggugac

SEQ ID NO: 853027 - RNA, 21 nt, Human
ccaccuccccagcagcuguuc

SEQ ID NO: 853028 - RNA, 18 nt, Human
ccagucgccugucuccag

SEQ ID NO: 853029 - RNA, 21 nt, Human
cccaggcuggagugcaguggc

SEQ ID NO: 853030 - RNA, 21 nt, Human
cccuccuucccucuuuugguc

SEQ ID NO: 853031 - RNA, 23 nt, Human
ccggcacccgucuccaccucccc

SEQ ID NO: 853032 - RNA, 21 nt, Human
ccguaccccagccugggugac

SEQ ID NO: 853033 - RNA, 20 nt, Human
ccugggugacagggcaagac

SEQ ID NO: 853034 - RNA, 19 nt, Human
cgacuccuaacuuugcccu

SEQ ID NO: 853035 - RNA, 18 nt, Human
cgcagcuccaccucgugc

SEQ ID NO: 853036 - RNA, 19 nt, Human
cgccucccgggcucacgcc

SEQ ID NO: 853037 - RNA, 24 nt, Human
cucacuguaagcuccgccucccgg

SEQ ID NO: 853038 - RNA, 21 nt, Human
cucccggcacccgucuccacc

SEQ ID NO: 853039 - RNA, 22 nt, Human
cuccgcagaaagcucacugcuu

SEQ ID NO: 853040 - RNA, 19 nt, Human
cuccuccacgcgcagcucc

SEQ ID NO: 853041 - RNA, 22 nt, Human
cuccuggauuuccaagccucug

SEQ ID NO: 853042 - RNA, 24 nt, Human
cucguucugucacccaggcuggag

SEQ ID NO: 853043 - RNA, 24 nt, Human
cugcuuccuguggcuccuggauuu

SEQ ID NO: 853044 - RNA, 23 nt, Human
cugggguuuccugucucucccgg

SEQ ID NO: 853045 - RNA, 20 nt, Human
cuuuuggucuccauuuccau

SEQ ID NO: 853046 - RNA, 23 nt, Human
gagugcaguggcgugugaucuca

SEQ ID NO: 853047 - RNA, 24 nt, Human
gccaccguaccccagccuggguga

SEQ ID NO: 853048 - RNA, 23 nt, Human
gcggggaaacugagacaaguucc

SEQ ID NO: 853049 - RNA, 19 nt, Human
gcuggagugcaguggcgug

SEQ ID NO: 853050 - RNA, 21 nt, Human
gcuuccuguggcuccuggauu

SEQ ID NO: 853051 - RNA, 26 nt, Human
ggacuccuccacgcgcagcuccaccu

SEQ ID NO: 853052 - RNA, 18 nt, Human
ggcgauggggcacaggga

SEQ ID NO: 853053 - RNA, 24 nt, Human
guaccccagccugggugacagggc

SEQ ID NO: 853054 - RNA, 23 nt, Human
guucuuugcccguugcacacagu

SEQ ID NO: 853055 - RNA, 22 nt, Human
guugaaaucccuuuugaaaagu

SEQ ID NO: 853056 - RNA, 22 nt, Human
uacaaugagcgccagucgccug

SEQ ID NO: 853057 - RNA, 23 nt, Human
uacauuuuuuuuuuuuuuugaga

SEQ ID NO: 853058 - RNA, 20 nt, Human
uaccccagccugggugacag

SEQ ID NO: 853059 - RNA, 24 nt, Human
uauaucacaaccccauuucuggag

SEQ ID NO: 853060 - RNA, 27 nt, Human
uauggaagccacuaggugagcucuacg

SEQ ID NO: 853061 - RNA, 24 nt, Human
ucacccaggcuggagugcaguggc

SEQ ID NO: 853062 - RNA, 18 nt, Human
ucacuguaagcuccgccu

SEQ ID NO: 853063 - RNA, 19 nt, Human
ucacuguaagcuccgccuc

SEQ ID NO: 853064 - RNA, 24 nt, Human
ucacuguaagcuccgccucccggg

SEQ ID NO: 853065 - RNA, 21 nt, Human
ucagaucuccccacucauucu

SEQ ID NO: 853066 - RNA, 20 nt, Human
ucaucugguggcaucccucc

SEQ ID NO: 853067 - RNA, 21 nt, Human
ucccgggcucacgccauucuc

SEQ ID NO: 853068 - RNA, 24 nt, Human
ucccgggcucacgccauucuccug

SEQ ID NO: 853069 - RNA, 22 nt, Human
uccuaacuuugcccuacucagc

SEQ ID NO: 853070 - RNA, 24 nt, Human
ucguucugucacccaggcuggagu

SEQ ID NO: 853071 - RNA, 19 nt, Human
ucuaugaccacuuccaaaa

SEQ ID NO: 853072 - RNA, 20 nt, Human
ucuccaaaaaaaaaaaaaaa

SEQ ID NO: 853073 - RNA, 19 nt, Human
ucucguucugucacccagg

SEQ ID NO: 853074 - RNA, 22 nt, Human
ucucguucugucacccaggcug

SEQ ID NO: 853075 - RNA, 23 nt, Human
ucucguucugucacccaggcugg

SEQ ID NO: 853076 - RNA, 24 nt, Human
ucucguucugucacccaggcugga

SEQ ID NO: 853077 - RNA, 18 nt, Human
ucugucacccaggcugga

SEQ ID NO: 853078 - RNA, 19 nt, Human
ucugucacccaggcuggag

SEQ ID NO: 853079 - RNA, 24 nt, Human
ucugucacccaggcuggagugcag

SEQ ID NO: 853080 - RNA, 23 nt, Human
ugaccacuuccaaaaaaaacugg

SEQ ID NO: 853081 - RNA, 22 nt, Human
ugagacggagucucguucuguc

SEQ ID NO: 853082 - RNA, 24 nt, Human
ugcaguggcgugugaucucagcuc

SEQ ID NO: 853083 - RNA, 24 nt, Human
ugcccuacucagcucccucggcug

SEQ ID NO: 853084 - RNA, 23 nt, Human
uggaagccacuaggugagcucua

SEQ ID NO: 853085 - RNA, 23 nt, Human
uggacuccuccacgcgcagcucc

SEQ ID NO: 853086 - RNA, 22 nt, Human
uggagugcaguggcgugugauc

SEQ ID NO: 853087 - RNA, 28 nt, Human
uggagugcaguggcgugugggcucuagc

SEQ ID NO: 853088 - RNA, 25 nt, Human
uggcgugugaucucagcucacugua

SEQ ID NO: 853089 - RNA, 22 nt, Human
uggcuccuggauuuccaagccu

SEQ ID NO: 853090 - RNA, 22 nt, Human
ugggcggggggcuuucggcuga

SEQ ID NO: 853091 - RNA, 24 nt, Human
ugggcggggggcuuucggcugagc

SEQ ID NO: 853092 - RNA, 30 nt, Human
uggggcacagggacgggcaggaaucuguuu

SEQ ID NO: 853093 - RNA, 23 nt, Human
ugggguuuccugucucucccggc

SEQ ID NO: 853094 - RNA, 21 nt, Human
ugucacccaggcuggagugca

SEQ ID NO: 853095 - RNA, 22 nt, Human
uguuccgucuuccgggauccca

SEQ ID NO: 853096 - RNA, 18 nt, Human
uuuccaggguggcucugu

SEQ ID NO: 853097 - RNA, 19 nt, Human
uuugaaaaguucuuugccc

SEQ ID NO: 853098 - RNA, 25 nt, Human
uuuuuuuuuuuugagacggagucuc

SEQ ID NO: 853099 - RNA, 22 nt, Human
uuuuuuuuuuuuuugagacgga

SEQ ID NO: 853100 - RNA, 20 nt, Human
uuuuuuuuuuuuuuuuuugg

SEQ ID NO: 853101 - RNA, 23 nt, Human
aaaaaaccacaaaauaaaaaagg

SEQ ID NO: 853102 - RNA, 21 nt, Human
aaaaaagggaucaaucaacau

SEQ ID NO: 853103 - RNA, 22 nt, Human
acuauauuaaaaaaccacaaaa

SEQ ID NO: 853104 - RNA, 30 nt, Human
agagcggagccgggcggcacuccgcggaaa

SEQ ID NO: 853105 - RNA, 21 nt, Human
agccgcgccggcggcagagcg

SEQ ID NO: 853106 - RNA, 20 nt, Human
cacccuucgcugagucccuc

SEQ ID NO: 853107 - RNA, 19 nt, Human
caccggagaugacucgugc

SEQ ID NO: 853108 - RNA, 19 nt, Human
caugagccgcgccggcggc

SEQ ID NO: 853109 - RNA, 22 nt, Human
ccgcccggccgacucugcccau

SEQ ID NO: 853110 - RNA, 21 nt, Human
ccggcccgcccggccgacucu

SEQ ID NO: 853111 - RNA, 20 nt, Human
ccugcaguucauuuaaggau

SEQ ID NO: 853112 - RNA, 22 nt, Human
cgcggaaacccgccagcggcag

SEQ ID NO: 853113 - RNA, 22 nt, Human
cuugguaugcaacagccaugga

SEQ ID NO: 853114 - RNA, 22 nt, Human
gaucaccggagaugacucgugc

SEQ ID NO: 853115 - RNA, 20 nt, Human
gccucggcggcgcccacccu

SEQ ID NO: 853116 - RNA, 22 nt, Human
gccucggcggcgcccacccuuc

SEQ ID NO: 853117 - RNA, 19 nt, Human
uccgcggaaacccgccagc

SEQ ID NO: 853118 - RNA, 26 nt, Human
uccgcggaaacccgccagcggcagga

SEQ ID NO: 853119 - RNA, 24 nt, Human
uccuuccaagagucuugguaugca

SEQ ID NO: 853120 - RNA, 22 nt, Human
uggaggcugugaccuuuuuccu

SEQ ID NO: 853121 - RNA, 23 nt, Human
ugugaccuuuuuccuucuuuucu

SEQ ID NO: 853122 - RNA, 22 nt, Human
uuagaaguccuuccaagagucu

SEQ ID NO: 853123 - RNA, 23 nt, Human
uuuaaggaucaccggagaugacu

SEQ ID NO: 853124 - RNA, 20 nt, Human
uuuuguuuuuuuaaaaggau

SEQ ID NO: 853125 - RNA, 23 nt, Human
uuuuuuuuuguuuuuuuaaaagg

SEQ ID NO: 853126 - RNA, 20 nt, Human
uuuuuuuuuuuuuuuuuugg

SEQ ID NO: 853127 - RNA, 24 nt, Human
uuuuuuuuuuuuuuuuuuguuuuu

SEQ ID NO: 853128 - RNA, 20 nt, Human
acacaaggccugcuucugug

SEQ ID NO: 853129 - RNA, 18 nt, Human
acugcaguccugccccuu

SEQ ID NO: 853130 - RNA, 24 nt, Human
aggaggcagcgcugccagcugcug

SEQ ID NO: 853131 - RNA, 19 nt, Human
aggcagggacuccccaggu

SEQ ID NO: 853132 - RNA, 23 nt, Human
caaauuuauagccuggggaagca

SEQ ID NO: 853133 - RNA, 20 nt, Human
cagcgcugccagcugcuguu

SEQ ID NO: 853134 - RNA, 23 nt, Human
cagcugcuguuugucaaacacac

SEQ ID NO: 853135 - RNA, 23 nt, Human
caggcuaccugcuggccaggccu

SEQ ID NO: 853136 - RNA, 18 nt, Human
ccagggaggagaggcagg

SEQ ID NO: 853137 - RNA, 20 nt, Human
ccaguguccccacuggacac

SEQ ID NO: 853138 - RNA, 21 nt, Human
ccccuucccacaccagugucc

SEQ ID NO: 853139 - RNA, 22 nt, Human
ccccuucugcacaggcuggaga

SEQ ID NO: 853140 - RNA, 18 nt, Human
cccgcagugcacugcagu

SEQ ID NO: 853141 - RNA, 22 nt, Human
ccgcuggaaacacaaggccugc

SEQ ID NO: 853142 - RNA, 22 nt, Human
ccugcuggccaggccuuuccca

SEQ ID NO: 853143 - RNA, 20 nt, Human
cugccccuucccacaccagu

SEQ ID NO: 853144 - RNA, 22 nt, Human
cuucccugccucuuaucagagg

SEQ ID NO: 853145 - RNA, 26 nt, Human
cuucugcacaggcuggagacucccag

SEQ ID NO: 853146 - RNA, 19 nt, Human
ucagguccuucccugccuc

SEQ ID NO: 853147 - RNA, 24 nt, Human
uccccacuggacacuccaaggccc

SEQ ID NO: 853148 - RNA, 20 nt, Human
uccccaggugcugccccuuc

SEQ ID NO: 853149 - RNA, 19 nt, Human
uccucuggggguggccuca

SEQ ID NO: 853150 - RNA, 19 nt, Human
uccucuggggguggccuca

SEQ ID NO: 853151 - RNA, 18 nt, Human
ugagaacaaauuuauagc

SEQ ID NO: 853152 - RNA, 27 nt, Human
ugagaacaaauuuauagccuggggaag

SEQ ID NO: 853153 - RNA, 21 nt, Human
ugcuggccaggccuuucccag

SEQ ID NO: 853154 - RNA, 19 nt, Human
uggcaggaaugugggcagg

SEQ ID NO: 853155 - RNA, 21 nt, Human
uuuuuugggagagacaguuuu

SEQ ID NO: 853156 - RNA, 26 nt, Human
uuuuuuuuuuuuuuuuuuuuuuuggg

SEQ ID NO: 853157 - RNA, 20 nt, Human
aaacgccucacgcacgcccc

SEQ ID NO: 853158 - RNA, 19 nt, Human
ccccaguacccucaaugcc

SEQ ID NO: 853159 - RNA, 21 nt, Human
ccgaggccaccggaccaggaa

SEQ ID NO: 853160 - RNA, 18 nt, Human
cuaaagcauauggguuca

SEQ ID NO: 853161 - RNA, 19 nt, Human
cuuaccgggaccgaggcca

SEQ ID NO: 853162 - RNA, 22 nt, Human
uaaacgccucacgcacgcccca

SEQ ID NO: 853163 - RNA, 23 nt, Human
uaccgggaccgaggccaccggac

SEQ ID NO: 853164 - RNA, 18 nt, Human
uucacauuugaauguccu

SEQ ID NO: 853165 - RNA, 18 nt, Human
uucacccggaaaugaagc

SEQ ID NO: 853166 - RNA, 20 nt, Human
uuuucacauuugaauguccu

SEQ ID NO: 853167 - RNA, 21 nt, Human
aaaaggucaccagaacaagag

SEQ ID NO: 853168 - RNA, 22 nt, Human
acgccgagucgauuggcagcac

SEQ ID NO: 853169 - RNA, 22 nt, Human
acucagcugggucugccaaagc

SEQ ID NO: 853170 - RNA, 31 nt, Human
agacaagacguauucaaaaggucaccagaaa

SEQ ID NO: 853171 - RNA, 23 nt, Human
caaaaggucaccagaaccggggc

SEQ ID NO: 853172 - RNA, 18 nt, Human
cagaacaagagcugaaaa

SEQ ID NO: 853173 - RNA, 19 nt, Human
cagcugggucugccaaagc

SEQ ID NO: 853174 - RNA, 18 nt, Human
ccagaacaagagcugaaa

SEQ ID NO: 853175 - RNA, 22 nt, Human
cugccaaagccgcaaauuccgc

SEQ ID NO: 853176 - RNA, 24 nt, Human
gccuaucuaccacgaccgacgcca

SEQ ID NO: 853177 - RNA, 20 nt, Human
guagacaguuuaaaauccau

SEQ ID NO: 853178 - RNA, 20 nt, Human
uaucacaugaugaguuggca

SEQ ID NO: 853179 - RNA, 22 nt, Human
ucaccagaacaagagcugaaaa

SEQ ID NO: 853180 - RNA, 19 nt, Human
uccgcagcugguguccuuc

SEQ ID NO: 853181 - RNA, 19 nt, Human
ucgauuggcagcacagacg

SEQ ID NO: 853182 - RNA, 19 nt, Human
ucuuuuauagacaagacgu

SEQ ID NO: 853183 - RNA, 19 nt, Human
ugaguuggcauuagcuucu

SEQ ID NO: 853184 - RNA, 21 nt, Human
uuagcuucuccaggcauggga

SEQ ID NO: 853185 - RNA, 23 nt, Human
uucaaaaggucaccagaacaaga

SEQ ID NO: 853186 - RNA, 18 nt, Human
uuuuuuuuuuuuuuuuug

SEQ ID NO: 853187 - RNA, 23 nt, Human
uuuuuuuuuuuuuuuuuuugggu

SEQ ID NO: 853188 - RNA, 24 nt, Human
uuuuuuuuuuuuuuuuuuuuuggg

SEQ ID NO: 853189 - RNA, 24 nt, Human
aaauucacuuaaacucuauuugcc

SEQ ID NO: 853190 - RNA, 20 nt, Human
auagucagggcaauaagagc

SEQ ID NO: 853191 - RNA, 19 nt, Human
caacucuaugguuuucuca

SEQ ID NO: 853192 - RNA, 23 nt, Human
cagaucuccauuugauucucagc

SEQ ID NO: 853193 - RNA, 21 nt, Human
caggcacauaaggauuugguu

SEQ ID NO: 853194 - RNA, 19 nt, Human
cagggcaauaagagcaaag

SEQ ID NO: 853195 - RNA, 20 nt, Human
ccgggccgggccgcagcguc

SEQ ID NO: 853196 - RNA, 21 nt, Human
gagcaaaguuacaguaaaaac

SEQ ID NO: 853197 - RNA, 19 nt, Human
gggccgcagcgucuacaac

SEQ ID NO: 853198 - RNA, 20 nt, Human
gggccgcagcgucuacaacc

SEQ ID NO: 853199 - RNA, 22 nt, Human
guaacaaauuuuaguucucuuc

SEQ ID NO: 853200 - RNA, 21 nt, Human
uaaagcauagagcuguaacaa

SEQ ID NO: 853201 - RNA, 25 nt, Human
uaagagcaaaguuacaguaaaaacg

SEQ ID NO: 853202 - RNA, 22 nt, Human
uaggugagccauuuaauuucug

SEQ ID NO: 853203 - RNA, 21 nt, Human
uagucagggcaauaagagcaa

SEQ ID NO: 853204 - RNA, 23 nt, Human
ugaggacugagauauaauuuuca

SEQ ID NO: 853205 - RNA, 19 nt, Human
uguuuauuuccaggcacau

SEQ ID NO: 853206 - RNA, 25 nt, Human
uuuuuuuuuuuuuuuuuuuuacaag

SEQ ID NO: 853207 - RNA, 21 nt, Human
agaaaugcggcagggcccaga

SEQ ID NO: 853208 - RNA, 21 nt, Human
auaagucaaauauauacuuug

SEQ ID NO: 853209 - RNA, 23 nt, Human
cagggcccagaggcggacugcag

SEQ ID NO: 853210 - RNA, 21 nt, Human
gccaaugaggguaaagagaaa

SEQ ID NO: 853211 - RNA, 21 nt, Human
uagaaugccacuuuaagucuc

SEQ ID NO: 853212 - RNA, 19 nt, Human
ucuccagcagugccugaga

SEQ ID NO: 853213 - RNA, 18 nt, Human
uuuuuuuuuuuuuuuccg

SEQ ID NO: 853214 - RNA, 21 nt, Human
uuuuuuuuuuuuuuuuuccgu

SEQ ID NO: 853215 - RNA, 24 nt, Human
uuuuuuuuuuuuuuuuuuuuccgu

SEQ ID NO: 853216 - RNA, 24 nt, Human
uuuuuuuuuuuuuuuuuuuuuccu

SEQ ID NO: 853217 - RNA, 24 nt, Human
aaacuagucauaguaacugagaaa

SEQ ID NO: 853218 - RNA, 23 nt, Human
aaagaaaaaaaaggucauaggga

SEQ ID NO: 853219 - RNA, 19 nt, Human
aaagaaaugcuacagaaau

SEQ ID NO: 853220 - RNA, 18 nt, Human
aaagaagccaaucugaaa

SEQ ID NO: 853221 - RNA, 19 nt, Human
aaaggucauagggaagaug

SEQ ID NO: 853222 - RNA, 21 nt, Human
aaagucuauuuuuuguaaaag

SEQ ID NO: 853223 - RNA, 24 nt, Human
aaccuaaaacuguucuaaaacaua

SEQ ID NO: 853224 - RNA, 24 nt, Human
aagaaagagagaaggaggaaaaga

SEQ ID NO: 853225 - RNA, 25 nt, Human
aagaaagagagaaggaggaaaagaa

SEQ ID NO: 853226 - RNA, 22 nt, Human
aagaagccaaucugaaaagcua

SEQ ID NO: 853227 - RNA, 25 nt, Human
aaggguuaaaggagagggagggaug

SEQ ID NO: 853228 - RNA, 24 nt, Human
agaaagagagaaggaggaaaagaa

SEQ ID NO: 853229 - RNA, 22 nt, Human
aggaaaagaaacuagugugaua

SEQ ID NO: 853230 - RNA, 20 nt, Human
caugacaagauacagagaaa

SEQ ID NO: 853231 - RNA, 20 nt, Human
cccucacguaaacuauggac

SEQ ID NO: 853232 - RNA, 22 nt, Human
cuaaaaaaaaaaugagcuacau

SEQ ID NO: 853233 - RNA, 22 nt, Human
cuacacuaaaaaaaaaaugagc

SEQ ID NO: 853234 - RNA, 20 nt, Human
cucugcauuuucugcuccau

SEQ ID NO: 853235 - RNA, 21 nt, Human
cugagaaaauacuauggaauu

SEQ ID NO: 853236 - RNA, 20 nt, Human
gagcaagaaagagagaagga

SEQ ID NO: 853237 - RNA, 20 nt, Human
gaggauuuuuuaaggcagug

SEQ ID NO: 853238 - RNA, 21 nt, Human
ggaugaauaaguaaaacacag

SEQ ID NO: 853239 - RNA, 22 nt, Human
gggaggcugugaauguguggag

SEQ ID NO: 853240 - RNA, 24 nt, Human
uaaaaaaauaagagucaugagaaa

SEQ ID NO: 853241 - RNA, 23 nt, Human
uaaaauaaaaaugauaaaucgcu

SEQ ID NO: 853242 - RNA, 27 nt, Human
uaaaauaacuuguaagaguuaaggacc

SEQ ID NO: 853243 - RNA, 20 nt, Human
uaaaggagagggagggauga

SEQ ID NO: 853244 - RNA, 23 nt, Human
uaaagugaccaucuuuucaucuu

SEQ ID NO: 853245 - RNA, 21 nt, Human
uaaaugcauauuaauacauga

SEQ ID NO: 853246 - RNA, 18 nt, Human
uacaacaccaagagugaa

SEQ ID NO: 853247 - RNA, 25 nt, Human
uacuauggaauuuuuuuguauagaa

SEQ ID NO: 853248 - RNA, 19 nt, Human
uagaaccagacaauaaaau

SEQ ID NO: 853249 - RNA, 22 nt, Human
ucaaaacccauauuauguacaa

SEQ ID NO: 853250 - RNA, 19 nt, Human
ucuaaaacauaaagucuau

SEQ ID NO: 853251 - RNA, 18 nt, Human
ucugguaaaagcaaaacu

SEQ ID NO: 853252 - RNA, 19 nt, Human
ugaaacacuucaaccauga

SEQ ID NO: 853253 - RNA, 22 nt, Human
ugaaagaagccaaucugaaaag

SEQ ID NO: 853254 - RNA, 24 nt, Human
ugaaauaaaagaaaaaaaagguca

SEQ ID NO: 853255 - RNA, 22 nt, Human
ugaacaugccgucgacauuuuc

SEQ ID NO: 853256 - RNA, 19 nt, Human
ugacaagauacagagaaac

SEQ ID NO: 853257 - RNA, 18 nt, Human
ugugguagaaccagacaa

SEQ ID NO: 853258 - RNA, 23 nt, Human
ugugucaauguagguucaucagu

SEQ ID NO: 853259 - RNA, 22 nt, Human
uuaaggacauucuuccuaauug

SEQ ID NO: 853260 - RNA, 23 nt, Human
uuacacauuugucaaaacccaua

SEQ ID NO: 853261 - RNA, 21 nt, Human
uuggagcaagaaagagagaag

SEQ ID NO: 853262 - RNA, 20 nt, Human
uuugcugugaaccuaaaacc

SEQ ID NO: 853263 - RNA, 23 nt, Human
uuuuuuguauagaaauggugguu

SEQ ID NO: 853264 - RNA, 22 nt, Human
uuuuuuuuuuugugguagaacc

SEQ ID NO: 853265 - RNA, 19 nt, Human
uuuuuuuuuuuuuuuuugu

SEQ ID NO: 853266 - RNA, 21 nt, Human
uuuuuuuuuuuuuuuuugugg

SEQ ID NO: 853267 - RNA, 27 nt, Human
uuuuuuuuuuuuuuuuuuuuuuugggg

SEQ ID NO: 853268 - RNA, 19 nt, Human
aaagugcugggauuacagg

SEQ ID NO: 853269 - RNA, 24 nt, Human
aaagugcugggauuacaggccuga

SEQ ID NO: 853270 - RNA, 24 nt, Human
aagaugggguuucaccauguuggu

SEQ ID NO: 853271 - RNA, 19 nt, Human
aagugcugggauuacaggc

SEQ ID NO: 853272 - RNA, 19 nt, Human
aagugcugggauuacaggc

SEQ ID NO: 853273 - RNA, 19 nt, Human
aagugcugggauuacaggc

SEQ ID NO: 853274 - RNA, 23 nt, Human
accauguuggucgguuggucucg

SEQ ID NO: 853275 - RNA, 24 nt, Human
acugucacccaggcuggagugcaa

SEQ ID NO: 853276 - RNA, 23 nt, Human
agcgauucuccugccccggcccc

SEQ ID NO: 853277 - RNA, 18 nt, Human
aguagccgggauuacagg

SEQ ID NO: 853278 - RNA, 24 nt, Human
agugcaauggcacgaccucggcuc

SEQ ID NO: 853279 - RNA, 24 nt, Human
agugcugggauuacaggccugagu

SEQ ID NO: 853280 - RNA, 24 nt, Human
augauccgcccgccucggccuccc

SEQ ID NO: 853281 - RNA, 24 nt, Human
augggguuucaccauguuggucgg

SEQ ID NO: 853282 - RNA, 25 nt, Human
augggguuucaccauguuggucggu

SEQ ID NO: 853283 - RNA, 24 nt, Human
caaagugcugggauuacaggccug

SEQ ID NO: 853284 - RNA, 20 nt, Human
caacucaacccugcaacuuc

SEQ ID NO: 853285 - RNA, 24 nt, Human
caacucaacccugcaacuucucag

SEQ ID NO: 853286 - RNA, 19 nt, Human
caagcgauucuccugcccc

SEQ ID NO: 853287 - RNA, 22 nt, Human
cacagcagccggcgguaaggac

SEQ ID NO: 853288 - RNA, 23 nt, Human
caccauguuggucgguuggucuc

SEQ ID NO: 853289 - RNA, 22 nt, Human
caggugcacaccaccaacaccc

SEQ ID NO: 853290 - RNA, 24 nt, Human
caguaaagaugggguuucaccaug

SEQ ID NO: 853291 - RNA, 26 nt, Human
caguaaagaugggguuucaccauguu

SEQ ID NO: 853292 - RNA, 19 nt, Human
ccaaagugcugggauuaca

SEQ ID NO: 853293 - RNA, 22 nt, Human
ccaaagugcugggauuacaggc

SEQ ID NO: 853294 - RNA, 24 nt, Human
ccaaagugcugggauuacaggccu

SEQ ID NO: 853295 - RNA, 18 nt, Human
cccaggcuggagugcaau

SEQ ID NO: 853296 - RNA, 20 nt, Human
cccagguucaagcgauucuc

SEQ ID NO: 853297 - RNA, 23 nt, Human
cccagguucaagcgauucuccug

SEQ ID NO: 853298 - RNA, 23 nt, Human
ccccgaguagccgggauuacagg

SEQ ID NO: 853299 - RNA, 19 nt, Human
cccgaguagccgggauuac

SEQ ID NO: 853300 - RNA, 24 nt, Human
cccgaguagccgggauuacaggug

SEQ ID NO: 853301 - RNA, 23 nt, Human
ccggcgguaaggacggggcguuc

SEQ ID NO: 853302 - RNA, 21 nt, Human
ccugcaacuucucagcucccg

SEQ ID NO: 853303 - RNA, 23 nt, Human
ccugccccggccccccgaguagc

SEQ ID NO: 853304 - RNA, 19 nt, Human
cgauucuccugccccggcc

SEQ ID NO: 853305 - RNA, 24 nt, Human
cgccucggccucccaaagugcugg

SEQ ID NO: 853306 - RNA, 21 nt, Human
cgggaccaacucaacccugca

SEQ ID NO: 853307 - RNA, 22 nt, Human
cgggaccaacucaacccugcaa

SEQ ID NO: 853308 - RNA, 23 nt, Human
cggggcaccaggaagcgggaaga

SEQ ID NO: 853309 - RNA, 22 nt, Human
cucaaggacuugccgggaccaa

SEQ ID NO: 853310 - RNA, 23 nt, Human
cucacugcaaccuccugcuccca

SEQ ID NO: 853311 - RNA, 24 nt, Human
cucacugcaaccuccugcucccag

SEQ ID NO: 853312 - RNA, 23 nt, Human
cucccagguucaagcgauucucc

SEQ ID NO: 853313 - RNA, 24 nt, Human
cuccugaccucaugauccgcccgc

SEQ ID NO: 853314 - RNA, 23 nt, Human
cugcaaccuccugcucccagguu

SEQ ID NO: 853315 - RNA, 24 nt, Human
cugcaaccuccugcucccagguuc

SEQ ID NO: 853316 - RNA, 18 nt, Human
gaagcgggaagacagagg

SEQ ID NO: 853317 - RNA, 22 nt, Human
gaccucaugauccgcccgccuc

SEQ ID NO: 853318 - RNA, 19 nt, Human
gaccucggcucacugcaac

SEQ ID NO: 853319 - RNA, 19 nt, Human
gacgcagucggggcaccag

SEQ ID NO: 853320 - RNA, 19 nt, Human
gaggcacuccacagcagcc

SEQ ID NO: 853321 - RNA, 26 nt, Human
gaguagccgggauuacaggugcacac

SEQ ID NO: 853322 - RNA, 21 nt, Human
gauuacaggccugagucacca

SEQ ID NO: 853323 - RNA, 24 nt, Human
gauuacaggccugagucaccaugc

SEQ ID NO: 853324 - RNA, 19 nt, Human
gcuggagugcaauggcacg

SEQ ID NO: 853325 - RNA, 24 nt, Human
ggagacagcgaggcacuccacagc

SEQ ID NO: 853326 - RNA, 19 nt, Human
gggaagacagaggaacaaa

SEQ ID NO: 853327 - RNA, 23 nt, Human
gggauuacaggugcacaccacca

SEQ ID NO: 853328 - RNA, 18 nt, Human
gggguuucaccauguugg

SEQ ID NO: 853329 - RNA, 20 nt, Human
ggguuucaccauguuggucg

SEQ ID NO: 853330 - RNA, 19 nt, Human
ggucucgaacuccugaccu

SEQ ID NO: 853331 - RNA, 24 nt, Human
gguuggucucgaacuccugaccuc

SEQ ID NO: 853332 - RNA, 22 nt, Human
guaaagaugggguuucaccaug

SEQ ID NO: 853333 - RNA, 19 nt, Human
guagccgggauuacaggug

SEQ ID NO: 853334 - RNA, 23 nt, Human
gucucacugucacccaggcugga

SEQ ID NO: 853335 - RNA, 21 nt, Human
gugcacaccaccaacacccgg

SEQ ID NO: 853336 - RNA, 22 nt, Human
uaaagaugggguuucaccaugu

SEQ ID NO: 853337 - RNA, 24 nt, Human
uauuuuguauuuucaguaaagaug

SEQ ID NO: 853338 - RNA, 18 nt, Human
ucacccaggcuggagugc

SEQ ID NO: 853339 - RNA, 19 nt, Human
ucacugcaaccuccugcuc

SEQ ID NO: 853340 - RNA, 24 nt, Human
ucacugcaaccuccugcucccagg

SEQ ID NO: 853341 - RNA, 23 nt, Human
ucacugucacccaggcuggagug

SEQ ID NO: 853342 - RNA, 24 nt, Human
ucaguaaagaugggguuucaccau

SEQ ID NO: 853343 - RNA, 24 nt, Human
ucccaaagugcugggauuacaggc

SEQ ID NO: 853344 - RNA, 21 nt, Human
ucccagguucaagcgauucuc

SEQ ID NO: 853345 - RNA, 24 nt, Human
ucccagguucaagcgauucuccug

SEQ ID NO: 853346 - RNA, 20 nt, Human
ucggggcaccaggaagcggg

SEQ ID NO: 853347 - RNA, 22 nt, Human
ucucacugucacccaggcugga

SEQ ID NO: 853348 - RNA, 24 nt, Human
ucucacugucacccaggcuggagu

SEQ ID NO: 853349 - RNA, 21 nt, Human
ucucgaacuccugaccucaug

SEQ ID NO: 853350 - RNA, 20 nt, Human
ugccccggccccccgaguaa

SEQ ID NO: 853351 - RNA, 21 nt, Human
ugccccggccccccgaguagc

SEQ ID NO: 853352 - RNA, 24 nt, Human
ugccccggccccccgaguagccgg

SEQ ID NO: 853353 - RNA, 23 nt, Human
uggagugcaauggcacgaccucg

SEQ ID NO: 853354 - RNA, 24 nt, Human
uggagugcaauggcacgaccucgg

SEQ ID NO: 853355 - RNA, 18 nt, Human
ugggauuacaggccugag

SEQ ID NO: 853356 - RNA, 22 nt, Human
ugggauuacaggccugagucac

SEQ ID NO: 853357 - RNA, 24 nt, Human
ugggauuacaggccugagucacca

SEQ ID NO: 853358 - RNA, 25 nt, Human
ugggauuacaggccugagucaccau

SEQ ID NO: 853359 - RNA, 23 nt, Human
ugggguuucaccauguuggucgg

SEQ ID NO: 853360 - RNA, 20 nt, Human
ugucacccaggcuggagugc

SEQ ID NO: 853361 - RNA, 24 nt, Human
uucaagcgauucuccugccccggc

SEQ ID NO: 853362 - RNA, 21 nt, Human
uugccgggaccaacucaaccc

SEQ ID NO: 853363 - RNA, 24 nt, Human
uuggucgguuggucucgaacuccu

SEQ ID NO: 853364 - RNA, 18 nt, Human
uuucaccauguuggucgg

SEQ ID NO: 853365 - RNA, 24 nt, Human
uuuucaguaaagaugggguuucac

SEQ ID NO: 853366 - RNA, 26 nt, Human
uuuuuuuuuuuugugacaaagucuca

SEQ ID NO: 853367 - RNA, 18 nt, Human
uuuuuuuuuuuuuuuuug

SEQ ID NO: 853368 - RNA, 19 nt, Human
uuuuuuuuuuuuuuuuugu

SEQ ID NO: 853369 - RNA, 22 nt, Human
aaccagugcggcgagcgccgcg

SEQ ID NO: 853370 - RNA, 21 nt, Human
acuugacaaccucaaccggac

SEQ ID NO: 853371 - RNA, 21 nt, Human
agcaucugaagauugguuuca

SEQ ID NO: 853372 - RNA, 25 nt, Human
agugcugggcuccgcauccuucuuu

SEQ ID NO: 853373 - RNA, 23 nt, Human
caaaacgcugaguuuggaaauca

SEQ ID NO: 853374 - RNA, 23 nt, Human
caaccggaccgaaggugcugaac

SEQ ID NO: 853375 - RNA, 19 nt, Human
caagccagcgcaucaaugu

SEQ ID NO: 853376 - RNA, 19 nt, Human
cgaaggugcugaacaaccg

SEQ ID NO: 853377 - RNA, 22 nt, Human
cuccuuuuuuuccuucucuuuu

SEQ ID NO: 853378 - RNA, 22 nt, Human
gagcgccgcgaaacccaacgcc

SEQ ID NO: 853379 - RNA, 20 nt, Human
gccgcgaaacccaacgcccg

SEQ ID NO: 853380 - RNA, 19 nt, Human
gucugaacuuagugugaaa

SEQ ID NO: 853381 - RNA, 18 nt, Human
uacaccaaaacgcugagu

SEQ ID NO: 853382 - RNA, 23 nt, Human
ucaaccggaccgaaggugcugaa

SEQ ID NO: 853383 - RNA, 21 nt, Human
ucagcccaguuucagucccuc

SEQ ID NO: 853384 - RNA, 19 nt, Human
ucagucccucuuggaaagg

SEQ ID NO: 853385 - RNA, 22 nt, Human
ugaaagauguucaaauucaaaa

SEQ ID NO: 853386 - RNA, 21 nt, Human
ugacaaccucaaccggaccga

SEQ ID NO: 853387 - RNA, 20 nt, Human
ugaguuuggaaaucaaaagg

SEQ ID NO: 853388 - RNA, 23 nt, Human
uggaaaucaaaagggucagccca

SEQ ID NO: 853389 - RNA, 19 nt, Human
uguaggcuucacagugcug

SEQ ID NO: 853390 - RNA, 21 nt, Human
uucacagugcugggcuccgca

SEQ ID NO: 853391 - RNA, 27 nt, Human
uuuccuccuuuuuuuccuucucuuuuu

SEQ ID NO: 853392 - RNA, 22 nt, Human
uuuuccuucucuuuuucuuggu

SEQ ID NO: 853393 - RNA, 18 nt, Human
uuuuuuuuuuuuuuuuug

SEQ ID NO: 853394 - RNA, 26 nt, Human
uuuuuuuuuuuuuuuuuuugguuuuu

SEQ ID NO: 853395 - RNA, 22 nt, Human
cugaauagacacacauaaccaa

SEQ ID NO: 853396 - RNA, 23 nt, Human
cugaauagacacacauaaccaaa

SEQ ID NO: 853397 - RNA, 18 nt, Human
gaauagacacacauaacc

SEQ ID NO: 853398 - RNA, 21 nt, Human
gaauagacacacauaaccaaa

SEQ ID NO: 853399 - RNA, 21 nt, Human
gccucauuaaacuuugguaau

SEQ ID NO: 853400 - RNA, 21 nt, Human
uaaaaaaugcuguggccucau

SEQ ID NO: 853401 - RNA, 19 nt, Human
uagcugaaucauagauacc

SEQ ID NO: 853402 - RNA, 20 nt, Human
ugaauagacacacauaacca

SEQ ID NO: 853403 - RNA, 18 nt, Human
uuuuuuuuuuuuuuuuug

SEQ ID NO: 853404 - RNA, 20 nt, Human
aaaaucuaaguucacaaaaa

SEQ ID NO: 853405 - RNA, 19 nt, Human
aaacgaacacccacaccuc

SEQ ID NO: 853406 - RNA, 24 nt, Human
aaagugcugggauuacagguguga

SEQ ID NO: 853407 - RNA, 19 nt, Human
aacugaccucgugauccac

SEQ ID NO: 853408 - RNA, 18 nt, Human
aagugcugggauuacagg

SEQ ID NO: 853409 - RNA, 19 nt, Human
aagugcugggauuacaggu

SEQ ID NO: 853410 - RNA, 26 nt, Human
aagugcugggauuacaggugugagcc

SEQ ID NO: 853411 - RNA, 21 nt, Human
accucacgcucacgccgaccg

SEQ ID NO: 853412 - RNA, 18 nt, Human
agccaccaugcccagccc

SEQ ID NO: 853413 - RNA, 20 nt, Human
aguauacauguguauacauu

SEQ ID NO: 853414 - RNA, 20 nt, Human
augggguuucacuguauuag

SEQ ID NO: 853415 - RNA, 24 nt, Human
caaagugcugggauuacaggugug

SEQ ID NO: 853416 - RNA, 19 nt, Human
cacaccucacgcucacgcc

SEQ ID NO: 853417 - RNA, 19 nt, Human
cacccacaccucacgcuca

SEQ ID NO: 853418 - RNA, 23 nt, Human
caccugccucggccucccaaagu

SEQ ID NO: 853419 - RNA, 21 nt, Human
cacuguauuagccaggcuagu

SEQ ID NO: 853420 - RNA, 24 nt, Human
cacuguauuagccaggcuagucuc

SEQ ID NO: 853421 - RNA, 21 nt, Human
ccaaagugcugggauuacagg

SEQ ID NO: 853422 - RNA, 21 nt, Human
ccaaagugcugggauuacagg

SEQ ID NO: 853423 - RNA, 24 nt, Human
ccaaagugcugggauuacaggugu

SEQ ID NO: 853424 - RNA, 22 nt, Human
cccauguggcauuuuccaaggu

SEQ ID NO: 853425 - RNA, 24 nt, Human
ccugccucggccucccaaagugcu

SEQ ID NO: 853426 - RNA, 19 nt, Human
cucacgcucacgccgaccu

SEQ ID NO: 853427 - RNA, 19 nt, Human
cugauuauaacuggauauu

SEQ ID NO: 853428 - RNA, 22 nt, Human
gaccucgugauccaccugccuc

SEQ ID NO: 853429 - RNA, 22 nt, Human
gaccucgugauccaccugccuc

SEQ ID NO: 853430 - RNA, 24 nt, Human
gaccucgugauccaccugccucgg

SEQ ID NO: 853431 - RNA, 18 nt, Human
gagaugggguuucacugu

SEQ ID NO: 853432 - RNA, 18 nt, Human
gauuacaggugugagcca

SEQ ID NO: 853433 - RNA, 21 nt, Human
gauuacaggugugagccacca

SEQ ID NO: 853434 - RNA, 22 nt, Human
gauuacaggugugagccaccau

SEQ ID NO: 853435 - RNA, 24 nt, Human
ggauuacaggugugagccaccaug

SEQ ID NO: 853436 - RNA, 18 nt, Human
gggguuucacuguauuag

SEQ ID NO: 853437 - RNA, 24 nt, Human
gugauccaccugccucggccuccc

SEQ ID NO: 853438 - RNA, 19 nt, Human
guggcauuuuccaagguuu

SEQ ID NO: 853439 - RNA, 20 nt, Human
uaaccauauuaauaccugac

SEQ ID NO: 853440 - RNA, 19 nt, Human
uacaacaacuuucuuuaaa

SEQ ID NO: 853441 - RNA, 24 nt, Human
uacaggugugagccaccaugccca

SEQ ID NO: 853442 - RNA, 22 nt, Human
uaccugagaaacgaacaccuug

SEQ ID NO: 853443 - RNA, 20 nt, Human
uaguagagaugggguuucac

SEQ ID NO: 853444 - RNA, 22 nt, Human
uaguagagaugggguuucacug

SEQ ID NO: 853445 - RNA, 24 nt, Human
uaguagagaugggguuucacugua

SEQ ID NO: 853446 - RNA, 23 nt, Human
ucccaaagugcugggauuacagg

SEQ ID NO: 853447 - RNA, 18 nt, Human
ucggccucccaaagugcu

SEQ ID NO: 853448 - RNA, 22 nt, Human
ugaauugaagaaaaaaggccaa

SEQ ID NO: 853449 - RNA, 21 nt, Human
ugccucggccucccaaagugc

SEQ ID NO: 853450 - RNA, 24 nt, Human
ugccucggccucccaaagugcugg

SEQ ID NO: 853451 - RNA, 24 nt, Human
ugcugggauuacaggugugagcca

SEQ ID NO: 853452 - RNA, 23 nt, Human
uggcaguugaaaucaaaguauac

SEQ ID NO: 853453 - RNA, 18 nt, Human
ugggauuacaggugugag

SEQ ID NO: 853454 - RNA, 22 nt, Human
ugggauuacaggugugagccac

SEQ ID NO: 853455 - RNA, 23 nt, Human
ugggauuacaggugugagccacc

SEQ ID NO: 853456 - RNA, 24 nt, Human
ugggauuacaggugugagccacca

SEQ ID NO: 853457 - RNA, 25 nt, Human
ugggauuacaggugugagccaccau

SEQ ID NO: 853458 - RNA, 24 nt, Human
ugggguuucacuguauuagccagg

SEQ ID NO: 853459 - RNA, 24 nt, Human
uguauacauucuaauccgucaucu

SEQ ID NO: 853460 - RNA, 21 nt, Human
uguauuuuuaguagagauggg

SEQ ID NO: 853461 - RNA, 23 nt, Human
uuaauaccugacagaacguugag

SEQ ID NO: 853462 - RNA, 18 nt, Human
uuaguagagaugggguuu

SEQ ID NO: 853463 - RNA, 21 nt, Human
uuaguagagaugggguuucac

SEQ ID NO: 853464 - RNA, 21 nt, Human
uuaguagagaugggguuucac

SEQ ID NO: 853465 - RNA, 24 nt, Human
uuaguagagaugggguuucacugu

SEQ ID NO: 853466 - RNA, 24 nt, Human
uuguaagaacaauucuaaccauau

SEQ ID NO: 853467 - RNA, 23 nt, Human
uuguauuuuuaguagagaugggg

SEQ ID NO: 853468 - RNA, 21 nt, Human
uuugaauugaagaaaaaaggc

SEQ ID NO: 853469 - RNA, 24 nt, Human
uuuuuaguagagaugggguuucac

SEQ ID NO: 853470 - RNA, 21 nt, Human
uuuuuguauuuuuaguagaga

SEQ ID NO: 853471 - RNA, 21 nt, Human
uuuuuuguauuuuuaguagag

SEQ ID NO: 853472 - RNA, 24 nt, Human
uuuuuuguauuuuuaguagagaug

SEQ ID NO: 853473 - RNA, 18 nt, Human
uuuuuuuuuuuuuuuuug

SEQ ID NO: 853474 - RNA, 25 nt, Human
uuuuuuuuuuuuuuuuuuguauuuu

SEQ ID NO: 853475 - RNA, 22 nt, Human
aggcagggggagcucccagcaa

SEQ ID NO: 853476 - RNA, 21 nt, Human
aguaggggaaagaggcagggg

SEQ ID NO: 853477 - RNA, 21 nt, Human
aucagacagguauuaccgagg

SEQ ID NO: 853478 - RNA, 20 nt, Human
ccagaacagagcaggaaccc

SEQ ID NO: 853479 - RNA, 21 nt, Human
ccagaacagagcaggaaccca

SEQ ID NO: 853480 - RNA, 21 nt, Human
ccccagaacagagcaggaacc

SEQ ID NO: 853481 - RNA, 20 nt, Human
cccuggguuaggggagaaua

SEQ ID NO: 853482 - RNA, 21 nt, Human
ccugcccccaaggccacggaa

SEQ ID NO: 853483 - RNA, 22 nt, Human
cugcccccaaggccacggaauc

SEQ ID NO: 853484 - RNA, 22 nt, Human
cuucuauuccuucuuuguaccc

SEQ ID NO: 853485 - RNA, 20 nt, Human
gccacuuuacugccaauagc

SEQ ID NO: 853486 - RNA, 24 nt, Human
uaguguuuguagcgccacuuuaac

SEQ ID NO: 853487 - RNA, 20 nt, Human
uggacugggcuuucgugggc

SEQ ID NO: 853488 - RNA, 24 nt, Human
ugggaaggggguaugagguggcug

SEQ ID NO: 853489 - RNA, 25 nt, Human
ugggaaggggguaugagguggcugg

SEQ ID NO: 853490 - RNA, 19 nt, Human
uuucgugggcacuuacccu

SEQ ID NO: 853491 - RNA, 26 nt, Human
uuuuuuaguguuuguagcgccacuuu

SEQ ID NO: 853492 - RNA, 20 nt, Human
cgauggcaauguacaagacu

SEQ ID NO: 853493 - RNA, 18 nt, Human
ugcaaggggaaacugggg

SEQ ID NO: 853494 - RNA, 19 nt, Human
uuuuuuuuuuuugcaaggg

SEQ ID NO: 853495 - RNA, 18 nt, Human
uuuuuuuuuuuuuuuuug

SEQ ID NO: 853496 - RNA, 21 nt, Human
uuuuuuuuuuuuuuuuugcaa

SEQ ID NO: 853497 - RNA, 26 nt, Human
uuuuuuuuuuuuuuuuuuugcaaggg

SEQ ID NO: 853498 - RNA, 24 nt, Human
aaaaaaaaaaaaaaagaggccaaa

SEQ ID NO: 853499 - RNA, 21 nt, Human
aaaaaaaaaaaagaggccaaa

SEQ ID NO: 853500 - RNA, 19 nt, Human
aaaaagcuuugcccauaac

SEQ ID NO: 853501 - RNA, 24 nt, Human
acagagcaagacucugccucaaaa

SEQ ID NO: 853502 - RNA, 24 nt, Human
acugcacuccagccugggcaacag

SEQ ID NO: 853503 - RNA, 24 nt, Human
acugcacuccagccugggcaacag

SEQ ID NO: 853504 - RNA, 24 nt, Human
agagauucuccugccucagccucc

SEQ ID NO: 853505 - RNA, 18 nt, Human
agaggcuugagacuuucc

SEQ ID NO: 853506 - RNA, 24 nt, Human
agccugggcaacagagcaagacuc

SEQ ID NO: 853507 - RNA, 21 nt, Human
aggagaauugcccgaacccug

SEQ ID NO: 853508 - RNA, 18 nt, Human
aggcaggagaauugcccg

SEQ ID NO: 853509 - RNA, 25 nt, Human
aggcaggagaauugcccgaacccug

SEQ ID NO: 853510 - RNA, 24 nt, Human
aggcggagguugcagugagccaag

SEQ ID NO: 853511 - RNA, 20 nt, Human
aggcuaaggcaggagaauug

SEQ ID NO: 853512 - RNA, 24 nt, Human
aggucuauucaguugauaaauggc

SEQ ID NO: 853513 - RNA, 24 nt, Human
aucgcgccacugcacuccagccug

SEQ ID NO: 853514 - RNA, 24 nt, Human
caagaucgcgccacugcacuccag

SEQ ID NO: 853515 - RNA, 19 nt, Human
cacugcacuccagccuggg

SEQ ID NO: 853516 - RNA, 21 nt, Human
cacugcacuccagccugggca

SEQ ID NO: 853517 - RNA, 22 nt, Human
cacugcacuccagccugggcaa

SEQ ID NO: 853518 - RNA, 23 nt, Human
cacugcacuccagccugggcaac

SEQ ID NO: 853519 - RNA, 24 nt, Human
cacugcacuccagccugggcaaca

SEQ ID NO: 853520 - RNA, 27 nt, Human
cacugcacuccagccugggcaacagag

SEQ ID NO: 853521 - RNA, 20 nt, Human
ccacugcacuccagccuggg

SEQ ID NO: 853522 - RNA, 20 nt, Human
ccacugcacuccagccuggg

SEQ ID NO: 853523 - RNA, 21 nt, Human
ccacugcacuccagccugggc

SEQ ID NO: 853524 - RNA, 23 nt, Human
ccacugcacuccagccugggcaa

SEQ ID NO: 853525 - RNA, 24 nt, Human
ccacugcacuccagccugggcaac

SEQ ID NO: 853526 - RNA, 22 nt, Human
cccgcaggacggcuagcgagcc

SEQ ID NO: 853527 - RNA, 24 nt, Human
ccuacuccccacacccaguugaug

SEQ ID NO: 853528 - RNA, 18 nt, Human
ccucaaaaaaaaaaaaaa

SEQ ID NO: 853529 - RNA, 18 nt, Human
ccucaaaaaaaaaaaaaa

SEQ ID NO: 853530 - RNA, 24 nt, Human
ccugccucagccucccgagcagcu

SEQ ID NO: 853531 - RNA, 22 nt, Human
ccugggcaacagagcaagacuc

SEQ ID NO: 853532 - RNA, 24 nt, Human
cgccacugcacuccagccugggca

SEQ ID NO: 853533 - RNA, 24 nt, Human
cucugaccuacuccccacacccag

SEQ ID NO: 853534 - RNA, 19 nt, Human
cucugccucaaaaaaaaaa

SEQ ID NO: 853535 - RNA, 22 nt, Human
cucugccucaaaaaaaaaaaaa

SEQ ID NO: 853536 - RNA, 23 nt, Human
cugaccuacuccccacacccagu

SEQ ID NO: 853537 - RNA, 29 nt, Human
cuuuaaaaaaaaaaaaaaaagaggccaaa

SEQ ID NO: 853538 - RNA, 21 nt, Human
gaaaaaagcuuugcccauaac

SEQ ID NO: 853539 - RNA, 23 nt, Human
gaaagagauucuccugccucagc

SEQ ID NO: 853540 - RNA, 23 nt, Human
gaagacaauauugaacaaccccc

SEQ ID NO: 853541 - RNA, 21 nt, Human
gacaucugagccuggaguuug

SEQ ID NO: 853542 - RNA, 24 nt, Human
gagauucuccugccucagccuccc

SEQ ID NO: 853543 - RNA, 20 nt, Human
gagcagcuaggacuacagga

SEQ ID NO: 853544 - RNA, 22 nt, Human
gagcagcuaggacuacaggagg

SEQ ID NO: 853545 - RNA, 23 nt, Human
gagcagcuaggacuacaggaggc

SEQ ID NO: 853546 - RNA, 23 nt, Human
gagguugcagugagccaagaucg

SEQ ID NO: 853547 - RNA, 24 nt, Human
gcacuccagccugggcaacagagc

SEQ ID NO: 853548 - RNA, 20 nt, Human
gccaagaucgcgccacugca

SEQ ID NO: 853549 - RNA, 22 nt, Human
gccacugcacuccagccugggc

SEQ ID NO: 853550 - RNA, 24 nt, Human
gccacugcacuccagccugggcaa

SEQ ID NO: 853551 - RNA, 20 nt, Human
gcccgaacccuggaggcgga

SEQ ID NO: 853552 - RNA, 21 nt, Human
gccucccgagcagcuaggacu

SEQ ID NO: 853553 - RNA, 20 nt, Human
ggagguugcagugagccaag

SEQ ID NO: 853554 - RNA, 24 nt, Human
ggagguugcagugagccaagaucg

SEQ ID NO: 853555 - RNA, 20 nt, Human
gugaggauugagaaggggug

SEQ ID NO: 853556 - RNA, 24 nt, Human
uaacccucugaccuacuccccaca

SEQ ID NO: 853557 - RNA, 21 nt, Human
uaaccugugacaucugagccu

SEQ ID NO: 853558 - RNA, 24 nt, Human
uaaggagaaacuuuuaaccacaaa

SEQ ID NO: 853559 - RNA, 24 nt, Human
uaaggcaggagaauugcccgaacc

SEQ ID NO: 853560 - RNA, 18 nt, Human
ucaaaaaaaaaaaaaagu

SEQ ID NO: 853561 - RNA, 23 nt, Human
ucccgagcagcuaggacuacagg

SEQ ID NO: 853562 - RNA, 22 nt, Human
uccuuuaaaaaaaaaaaaaaaa

SEQ ID NO: 853563 - RNA, 23 nt, Human
ucgcgccacugcacuccagccug

SEQ ID NO: 853564 - RNA, 23 nt, Human
ucugccucaaaaaaaaaaaaaag

SEQ ID NO: 853565 - RNA, 21 nt, Human
ugaccuacuccccacacccag

SEQ ID NO: 853566 - RNA, 24 nt, Human
ugagaaggggugaauagaggcuug

SEQ ID NO: 853567 - RNA, 22 nt, Human
ugagccaagaucgcgccacugc

SEQ ID NO: 853568 - RNA, 23 nt, Human
ugccucagccucccgagcagcua

SEQ ID NO: 853569 - RNA, 24 nt, Human
ugccucagccucccgagcagcuag

SEQ ID NO: 853570 - RNA, 23 nt, Human
uggaggcggagguugcagugagc

SEQ ID NO: 853571 - RNA, 26 nt, Human
ugggauuuccuuuaaaaaaaaaaaaa

SEQ ID NO: 853572 - RNA, 21 nt, Human
ugguaggacuuggaggagaaa

SEQ ID NO: 853573 - RNA, 24 nt, Human
ugguaggacuuggaggagaaaucc

SEQ ID NO: 853574 - RNA, 23 nt, Human
uguugaugcuuaaggaaaaaagc

SEQ ID NO: 853575 - RNA, 23 nt, Human
uuaaggaaaaaagcuuugcccau

SEQ ID NO: 853576 - RNA, 23 nt, Human
uucuuccauuguuauuguucugu

SEQ ID NO: 853577 - RNA, 22 nt, Human
uugcagugagccaagaucgcgc

SEQ ID NO: 853578 - RNA, 21 nt, Human
uuggcaggaugauagcuuugu

SEQ ID NO: 853579 - RNA, 18 nt, Human
uugugaggauugagaagg

SEQ ID NO: 853580 - RNA, 27 nt, Human
uuuaaaaaaaaaaaaaaaagaggccaa

SEQ ID NO: 853581 - RNA, 23 nt, Human
uuucacuaacccucugaccuacu

SEQ ID NO: 853582 - RNA, 21 nt, Human
uuucuuccauuguuauuguua

SEQ ID NO: 853583 - RNA, 27 nt, Human
uuugugauaauguucccaauuucuucc

SEQ ID NO: 853584 - RNA, 23 nt, Human
uuuuuuuuuuuuuuuccuauugg

SEQ ID NO: 853585 - RNA, 22 nt, Human
uuuuuuuuuuuuuuuuccuauu

SEQ ID NO: 853586 - RNA, 19 nt, Human
aaagcucagaaugcuuuuc

SEQ ID NO: 853587 - RNA, 19 nt, Human
aaccugacucagccacuga

SEQ ID NO: 853588 - RNA, 19 nt, Human
aagccagcccuagugucug

SEQ ID NO: 853589 - RNA, 19 nt, Human
accaacuauuaacuccaac

SEQ ID NO: 853590 - RNA, 20 nt, Human
acguggacaacaucccuggg

SEQ ID NO: 853591 - RNA, 18 nt, Human
agaggccaggggagaaaa

SEQ ID NO: 853592 - RNA, 24 nt, Human
agcaccuccccuucagcuuuggag

SEQ ID NO: 853593 - RNA, 22 nt, Human
agcaggagcaacaauggugggg

SEQ ID NO: 853594 - RNA, 23 nt, Human
agcggccccgcaccugcgagagc

SEQ ID NO: 853595 - RNA, 18 nt, Human
aggauaccauuaauuaaa

SEQ ID NO: 853596 - RNA, 19 nt, Human
agggaaguuuccaggccuc

SEQ ID NO: 853597 - RNA, 21 nt, Human
aguaagaggccaggggagaaa

SEQ ID NO: 853598 - RNA, 20 nt, Human
caacaagaucagcccacgug

SEQ ID NO: 853599 - RNA, 20 nt, Human
caacagucccuccgagggaa

SEQ ID NO: 853600 - RNA, 23 nt, Human
cacugacuugagguccugaaagc

SEQ ID NO: 853601 - RNA, 21 nt, Human
cacuuugcaagagcaggagca

SEQ ID NO: 853602 - RNA, 26 nt, Human
cagaaugcuuuuccggagcaccuccc

SEQ ID NO: 853603 - RNA, 23 nt, Human
cagcccccuucccccauuugucu

SEQ ID NO: 853604 - RNA, 22 nt, Human
caguagguucucccccacaggu

SEQ ID NO: 853605 - RNA, 25 nt, Human
ccaccuaaccucauguggauagcua

SEQ ID NO: 853606 - RNA, 24 nt, Human
cccauagcuaaaccaacuauuaac

SEQ ID NO: 853607 - RNA, 22 nt, Human
ccccgcaccugcgagagccaac

SEQ ID NO: 853608 - RNA, 20 nt, Human
cccuccgagggaaguuucca

SEQ ID NO: 853609 - RNA, 19 nt, Human
cugcucuuucugcacuuug

SEQ ID NO: 853610 - RNA, 24 nt, Human
gaccuaccucccugcacacuccac

SEQ ID NO: 853611 - RNA, 19 nt, Human
gacuugagguccugaaagc

SEQ ID NO: 853612 - RNA, 21 nt, Human
gagggaaguuuccaggccuca

SEQ ID NO: 853613 - RNA, 22 nt, Human
ggaaguuuccaggccucacugu

SEQ ID NO: 853614 - RNA, 19 nt, Human
ggagcaccuccccuucagc

SEQ ID NO: 853615 - RNA, 25 nt, Human
ggugugugaaaaaggauaccauuaa

SEQ ID NO: 853616 - RNA, 19 nt, Human
gugugaaaaaggauaccau

SEQ ID NO: 853617 - RNA, 21 nt, Human
uaccucccugcacacuccacc

SEQ ID NO: 853618 - RNA, 20 nt, Human
uagcggccccgcaccugcga

SEQ ID NO: 853619 - RNA, 22 nt, Human
ucccugcacacuccaccuaacc

SEQ ID NO: 853620 - RNA, 24 nt, Human
ucccugcacacuccaccuaaccuc

SEQ ID NO: 853621 - RNA, 19 nt, Human
ucccuggguugccacccaa

SEQ ID NO: 853622 - RNA, 21 nt, Human
ucccuggguugccacccaauu

SEQ ID NO: 853623 - RNA, 22 nt, Human
ucccuggguugccacccaauuc

SEQ ID NO: 853624 - RNA, 20 nt, Human
uccugaaagcguuuccucca

SEQ ID NO: 853625 - RNA, 24 nt, Human
ucugcacuuugcaagagcaggagc

SEQ ID NO: 853626 - RNA, 19 nt, Human
ugaggaaauggcccaagcc

SEQ ID NO: 853627 - RNA, 21 nt, Human
ugcacuuugcaagagcaggag

SEQ ID NO: 853628 - RNA, 21 nt, Human
uggaguucuuuaagcuuaaaa

SEQ ID NO: 853629 - RNA, 22 nt, Human
uuggaguucuuuaagcuuaaaa

SEQ ID NO: 853630 - RNA, 21 nt, Human
uuuaaggugugugaaaaagga

SEQ ID NO: 853631 - RNA, 23 nt, Human
uuuuuuguuucucaggccguuua

SEQ ID NO: 853632 - RNA, 18 nt, Human
uuuuuuuuuuuuuguuuc

SEQ ID NO: 853633 - RNA, 25 nt, Human
uuuuuuuuuuuuuuuguuucucagg

SEQ ID NO: 853634 - RNA, 22 nt, Human
uuuuuuuuuuuuuuuuuuguuu

SEQ ID NO: 853635 - RNA, 27 nt, Human
uuuuuuuuuuuuuuuuuuuuuuugggg

SEQ ID NO: 853636 - RNA, 21 nt, Human
aaaugaaagaggagagacuaa

SEQ ID NO: 853637 - RNA, 21 nt, Human
aagcagaugcccaaccaaugu

SEQ ID NO: 853638 - RNA, 22 nt, Human
aagcagaugcccaaccaauguc

SEQ ID NO: 853639 - RNA, 29 nt, Human
aagcagaugcccaaccaaugucagauaaa

SEQ ID NO: 853640 - RNA, 21 nt, Human
aucauguuuaagcccuggauu

SEQ ID NO: 853641 - RNA, 26 nt, Human
caaaacagagaagcuaccuccaagcc

SEQ ID NO: 853642 - RNA, 20 nt, Human
caacugcaaaacagagaagc

SEQ ID NO: 853643 - RNA, 20 nt, Human
caagaaaugcagcaggaaaa

SEQ ID NO: 853644 - RNA, 26 nt, Human
caagcagaugcccaaccaaucaacgg

SEQ ID NO: 853645 - RNA, 22 nt, Human
caagcagaugcccaaccaaugu

SEQ ID NO: 853646 - RNA, 26 nt, Human
caccagaugguggcuucugcucaguc

SEQ ID NO: 853647 - RNA, 22 nt, Human
cagggaguccuccuuaaaauuu

SEQ ID NO: 853648 - RNA, 18 nt, Human
ccaccgcauuacagaaac

SEQ ID NO: 853649 - RNA, 19 nt, Human
cccauguaauaugcaacca

SEQ ID NO: 853650 - RNA, 21 nt, Human
ccuccaagcagaugcccaacc

SEQ ID NO: 853651 - RNA, 20 nt, Human
ccuuaaaauuuuagaaagaa

SEQ ID NO: 853652 - RNA, 23 nt, Human
cgcggggcgcaggggaagaggcg

SEQ ID NO: 853653 - RNA, 21 nt, Human
cggcguggccuggcuggugcu

SEQ ID NO: 853654 - RNA, 18 nt, Human
cguggccuggcuggugcu

SEQ ID NO: 853655 - RNA, 20 nt, Human
cuaaagaaagagagucaaau

SEQ ID NO: 853656 - RNA, 23 nt, Human
cuaauccaaucauguuuaagccc

SEQ ID NO: 853657 - RNA, 18 nt, Human
gaaaaugaaagaggagag

SEQ ID NO: 853658 - RNA, 20 nt, Human
gaggagagacuaaccuaaaa

SEQ ID NO: 853659 - RNA, 22 nt, Human
gcaaaacagagaagcuaccucc

SEQ ID NO: 853660 - RNA, 24 nt, Human
gcaaaacagagaagcuaccuccaa

SEQ ID NO: 853661 - RNA, 19 nt, Human
gcagagcccucucuaaucc

SEQ ID NO: 853662 - RNA, 20 nt, Human
gcagagcccucucuaaucca

SEQ ID NO: 853663 - RNA, 21 nt, Human
gcagagcccucucuaauccaa

SEQ ID NO: 853664 - RNA, 19 nt, Human
gcccggccugggcgcgggg

SEQ ID NO: 853665 - RNA, 21 nt, Human
gccugggcgcggggcgcaggg

SEQ ID NO: 853666 - RNA, 21 nt, Human
gcggcguggccuggcuggugc

SEQ ID NO: 853667 - RNA, 27 nt, Human
gcuucugcucaguccgggggucauuua

SEQ ID NO: 853668 - RNA, 21 nt, Human
uaaaagacugagguuacuauc

SEQ ID NO: 853669 - RNA, 21 nt, Human
uaccuccaagcagaugcccaa

SEQ ID NO: 853670 - RNA, 21 nt, Human
uauagccccaggugagaacca

SEQ ID NO: 853671 - RNA, 21 nt, Human
ucagauaaccugcagucuggg

SEQ ID NO: 853672 - RNA, 18 nt, Human
ucagcccauguaauaugc

SEQ ID NO: 853673 - RNA, 21 nt, Human
ucggcccggccugggcgcggg

SEQ ID NO: 853674 - RNA, 21 nt, Human
ucuaaagaaagagagucaaau

SEQ ID NO: 853675 - RNA, 18 nt, Human
ucuuuagaugaacagguc

SEQ ID NO: 853676 - RNA, 20 nt, Human
ugaacagaaucuugcuugug

SEQ ID NO: 853677 - RNA, 25 nt, Human
ugcaaaacagagaagcuaccuccaa

SEQ ID NO: 853678 - RNA, 30 nt, Human
ugcaaaacagagaagcuaccuccaagcagg

SEQ ID NO: 853679 - RNA, 18 nt, Human
ugcuugagcuccaugccc

SEQ ID NO: 853680 - RNA, 20 nt, Human
ugguggcuucugcucagucc

SEQ ID NO: 853681 - RNA, 21 nt, Human
uugcuugugacuaucagugug

SEQ ID NO: 853682 - RNA, 22 nt, Human
uuuuuuuuuuuuuuuuuuucag

SEQ ID NO: 853683 - RNA, 21 nt, Human
aaacaggcucccgccaguccc

SEQ ID NO: 853684 - RNA, 19 nt, Human
aaaccggagccgggagcca

SEQ ID NO: 853685 - RNA, 18 nt, Human
aaccacccaggccaaaga

SEQ ID NO: 853686 - RNA, 23 nt, Human
aaccauccagaucccccaaacag

SEQ ID NO: 853687 - RNA, 18 nt, Human
aagagaagcuguggaucu

SEQ ID NO: 853688 - RNA, 23 nt, Human
aaugacagagcagccaggacccc

SEQ ID NO: 853689 - RNA, 24 nt, Human
acagccagcgccugucaggggccc

SEQ ID NO: 853690 - RNA, 20 nt, Human
accgcaguccccagcaaggc

SEQ ID NO: 853691 - RNA, 21 nt, Human
accgcaguccccagcaaggcc

SEQ ID NO: 853692 - RNA, 22 nt, Human
agcaacagugggaaagucaaag

SEQ ID NO: 853693 - RNA, 18 nt, Human
agcagccaggaccccagc

SEQ ID NO: 853694 - RNA, 25 nt, Human
aggcacaggcucuacuagagugagg

SEQ ID NO: 853695 - RNA, 22 nt, Human
aggcggagcugagggcagcagc

SEQ ID NO: 853696 - RNA, 21 nt, Human
agucaaagugaagcaggcucc

SEQ ID NO: 853697 - RNA, 23 nt, Human
caaaccacucacagccagcgccu

SEQ ID NO: 853698 - RNA, 25 nt, Human
caaagcgggguccagccucuccauc

SEQ ID NO: 853699 - RNA, 21 nt, Human
caacuuaaaaaaucaggacau

SEQ ID NO: 853700 - RNA, 22 nt, Human
cacacacaccccuucacauagc

SEQ ID NO: 853701 - RNA, 25 nt, Human
cacucuacucccaccgcagucccca

SEQ ID NO: 853702 - RNA, 22 nt, Human
cagagcgcuaguaggcaggcac

SEQ ID NO: 853703 - RNA, 22 nt, Human
cagaucccccaaacaggcuccc

SEQ ID NO: 853704 - RNA, 18 nt, Human
cagcaaggccgcccuucc

SEQ ID NO: 853705 - RNA, 19 nt, Human
cagcaaggccgcccuuccc

SEQ ID NO: 853706 - RNA, 18 nt, Human
cagcagccagccuuccca

SEQ ID NO: 853707 - RNA, 23 nt, Human
cagcagugcccagcaucccucaa

SEQ ID NO: 853708 - RNA, 24 nt, Human
cagcagugcccagcaucccucaau

SEQ ID NO: 853709 - RNA, 21 nt, Human
cagcuacuucuuuugcaaaau

SEQ ID NO: 853710 - RNA, 20 nt, Human
cagcuccuaguguacaaggg

SEQ ID NO: 853711 - RNA, 20 nt, Human
cagguccccguguuucacuc

SEQ ID NO: 853712 - RNA, 21 nt, Human
caguccccagcaaggccgccc

SEQ ID NO: 853713 - RNA, 25 nt, Human
cauccagaucccccaaacaggcucc

SEQ ID NO: 853714 - RNA, 18 nt, Human
ccagcaaggccgcccuuc

SEQ ID NO: 853715 - RNA, 31 nt, Human
ccagcaucccucaaugacagagcagccaggg

SEQ ID NO: 853716 - RNA, 22 nt, Human
ccagcgccugucaggggcccag

SEQ ID NO: 853717 - RNA, 22 nt, Human
cccagcaaggccgcccuuccca

SEQ ID NO: 853718 - RNA, 19 nt, Human
cccaggacacuggccagcg

SEQ ID NO: 853719 - RNA, 25 nt, Human
cccaggccaaagaaaacaugucggc

SEQ ID NO: 853720 - RNA, 20 nt, Human
ccccagcaaggccgcccuuc

SEQ ID NO: 853721 - RNA, 21 nt, Human
ccccauacccuggccacccgg

SEQ ID NO: 853722 - RNA, 25 nt, Human
cccccaaacaggcucccgccagucc

SEQ ID NO: 853723 - RNA, 27 nt, Human
ccccgccguggacaggaccucggaaau

SEQ ID NO: 853724 - RNA, 26 nt, Human
cccgccagucccauggcuuccagcua

SEQ ID NO: 853725 - RNA, 24 nt, Human
cccgugcucucccccccaucccca

SEQ ID NO: 853726 - RNA, 21 nt, Human
cccucagacccucuccugggc

SEQ ID NO: 853727 - RNA, 27 nt, Human
cccuucccaggcugcacccucuucaaa

SEQ ID NO: 853728 - RNA, 23 nt, Human
ccugcagauuugauuucugaauu

SEQ ID NO: 853729 - RNA, 23 nt, Human
cgagcccagggagggggcggcag

SEQ ID NO: 853730 - RNA, 26 nt, Human
cgagcccagggagggggcggcaggau

SEQ ID NO: 853731 - RNA, 23 nt, Human
cgcaguccccagcaaggccgccc

SEQ ID NO: 853732 - RNA, 19 nt, Human
cggagccgggagccaggcc

SEQ ID NO: 853733 - RNA, 24 nt, Human
cggccacccgccggcccggaaacc

SEQ ID NO: 853734 - RNA, 21 nt, Human
cgugcucucccccccaucccc

SEQ ID NO: 853735 - RNA, 20 nt, Human
cuacaggggcauggggccaa

SEQ ID NO: 853736 - RNA, 18 nt, Human
cucaggguauaaaccacc

SEQ ID NO: 853737 - RNA, 19 nt, Human
cucccaacucaagggccug

SEQ ID NO: 853738 - RNA, 22 nt, Human
cucuagugcccaucaggcagcu

SEQ ID NO: 853739 - RNA, 18 nt, Human
cuggacgagcccagggag

SEQ ID NO: 853740 - RNA, 20 nt, Human
cugggcacaugccccauacc

SEQ ID NO: 853741 - RNA, 22 nt, Human
cugggcacaugccccauacccu

SEQ ID NO: 853742 - RNA, 21 nt, Human
cuucccaggcugcacccucuu

SEQ ID NO: 853743 - RNA, 20 nt, Human
gagcagccaggaccccagcg

SEQ ID NO: 853744 - RNA, 23 nt, Human
gcagcggccucgaggugcaggga

SEQ ID NO: 853745 - RNA, 21 nt, Human
gcagggaauaacccugcagag

SEQ ID NO: 853746 - RNA, 25 nt, Human
gccaggaccccagcggugacugucc

SEQ ID NO: 853747 - RNA, 19 nt, Human
gcccaggacacuggccagc

SEQ ID NO: 853748 - RNA, 19 nt, Human
gccccaggggcaucggagu

SEQ ID NO: 853749 - RNA, 18 nt, Human
gcccggaaaccggagccg

SEQ ID NO: 853750 - RNA, 22 nt, Human
gcggagcugagggcagcagcca

SEQ ID NO: 853751 - RNA, 22 nt, Human
gcugggcacaugccccauaccc

SEQ ID NO: 853752 - RNA, 21 nt, Human
ggaggaagccagacccagggg

SEQ ID NO: 853753 - RNA, 21 nt, Human
ggcacuuaggugaguagaacg

SEQ ID NO: 853754 - RNA, 18 nt, Human
ggcauggggccaaagcug

SEQ ID NO: 853755 - RNA, 25 nt, Human
gggcaucggaguuugagaucucugg

SEQ ID NO: 853756 - RNA, 23 nt, Human
gggcccaggacacuggccagcgg

SEQ ID NO: 853757 - RNA, 20 nt, Human
ggggcauggggccaaagcug

SEQ ID NO: 853758 - RNA, 21 nt, Human
ggggcccaggacacuggccag

SEQ ID NO: 853759 - RNA, 21 nt, Human
guaggcaggcacaggcucuac

SEQ ID NO: 853760 - RNA, 20 nt, Human
uaaaccacccaggccaaaga

SEQ ID NO: 853761 - RNA, 24 nt, Human
uaaaccacccaggccaaagaaaac

SEQ ID NO: 853762 - RNA, 20 nt, Human
uacucccaccgcagucccca

SEQ ID NO: 853763 - RNA, 25 nt, Human
uagcauguacaaaccacucacagcc

SEQ ID NO: 853764 - RNA, 26 nt, Human
uagcauguacaaaccacucacagcca

SEQ ID NO: 853765 - RNA, 21 nt, Human
uaguaggcaggcacaggcucu

SEQ ID NO: 853766 - RNA, 23 nt, Human
ucaaccauccagaucccccaaac

SEQ ID NO: 853767 - RNA, 19 nt, Human
ucccaaacucuccgaaccc

SEQ ID NO: 853768 - RNA, 20 nt, Human
ucccaaacucuccgaacccu

SEQ ID NO: 853769 - RNA, 21 nt, Human
ucccagagggaccuacagggg

SEQ ID NO: 853770 - RNA, 21 nt, Human
ucccaggcugcacccucuuca

SEQ ID NO: 853771 - RNA, 19 nt, Human
ucccauggcuuccagcuac

SEQ ID NO: 853772 - RNA, 18 nt, Human
uccuucagguccccgugu

SEQ ID NO: 853773 - RNA, 22 nt, Human
ucucccccccauccccaccgca

SEQ ID NO: 853774 - RNA, 21 nt, Human
ucugcagccacggugaagaug

SEQ ID NO: 853775 - RNA, 18 nt, Human
ucuggacgagcccaggga

SEQ ID NO: 853776 - RNA, 27 nt, Human
ucuggacgagcccagggagggggcggc

SEQ ID NO: 853777 - RNA, 20 nt, Human
ugacccccaucccaccccuc

SEQ ID NO: 853778 - RNA, 23 nt, Human
ugacuccuaggagucaaccaucc

SEQ ID NO: 853779 - RNA, 24 nt, Human
ugagaaauucccaaacucuccgaa

SEQ ID NO: 853780 - RNA, 26 nt, Human
ugaggcggagcugagggcagcagcca

SEQ ID NO: 853781 - RNA, 21 nt, Human
ugagggcagcagccagccuuc

SEQ ID NO: 853782 - RNA, 23 nt, Human
uggacgagcccagggagggggcg

SEQ ID NO: 853783 - RNA, 25 nt, Human
uggacgagcccagggagggggcggc

SEQ ID NO: 853784 - RNA, 22 nt, Human
uggccugcagauuugauuucug

SEQ ID NO: 853785 - RNA, 18 nt, Human
uggguggggccgggccag

SEQ ID NO: 853786 - RNA, 19 nt, Human
ugucccagguaguguugcc

SEQ ID NO: 853787 - RNA, 19 nt, Human
ugucuuugucuccagcaac

SEQ ID NO: 853788 - RNA, 21 nt, Human
uuaggccugcauucccacacc

SEQ ID NO: 853789 - RNA, 21 nt, Human
uuaggugaguagaacgggcca

SEQ ID NO: 853790 - RNA, 21 nt, Human
uucugccaacaacuuaaaaaa

SEQ ID NO: 853791 - RNA, 20 nt, Human
uuggcccgcagcggccucgg

SEQ ID NO: 853792 - RNA, 19 nt, Human
agccucuagaccacucacu

SEQ ID NO: 853793 - RNA, 24 nt, Human
aggccagguggggcuccuucccag

SEQ ID NO: 853794 - RNA, 18 nt, Human
ggagagaggccagguggg

SEQ ID NO: 853795 - RNA, 26 nt, Human
ggcggaagcugcggaggucagccaag

SEQ ID NO: 853796 - RNA, 20 nt, Human
ggcucuugggccagcagccu

SEQ ID NO: 853797 - RNA, 19 nt, Human
gucagccaagccucgugcc

SEQ ID NO: 853798 - RNA, 22 nt, Human
uagccagagucgggcggaagcu

SEQ ID NO: 853799 - RNA, 21 nt, Human
ucaaggcaguagccuccaaga

SEQ ID NO: 853800 - RNA, 23 nt, Human
ucuagaccacucacuaggacccc

SEQ ID NO: 853801 - RNA, 18 nt, Human
ugggauggguauugccgg

SEQ ID NO: 853802 - RNA, 19 nt, Human
ugggauggguauugccggg

SEQ ID NO: 853803 - RNA, 19 nt, Human
uuccugagccuggcucuug

SEQ ID NO: 853804 - RNA, 20 nt, Human
uuccugagccuggcucuugg

SEQ ID NO: 853805 - RNA, 18 nt, Human
uuuuuuuuuucgaacagg

SEQ ID NO: 853806 - RNA, 21 nt, Human
uuuuuuuuuuuuuuuuuucgg

SEQ ID NO: 853807 - RNA, 21 nt, Human
acacuagaauccaucugucca

SEQ ID NO: 853808 - RNA, 22 nt, Human
acucgcccgcccugcucgcgcc

SEQ ID NO: 853809 - RNA, 22 nt, Human
agaaaaacgcaucccagcccuu

SEQ ID NO: 853810 - RNA, 22 nt, Human
agccccaggcccccguccaggc

SEQ ID NO: 853811 - RNA, 23 nt, Human
caagcaauagguuuacugugcac

SEQ ID NO: 853812 - RNA, 22 nt, Human
cacaccagaauccaucugucca

SEQ ID NO: 853813 - RNA, 22 nt, Human
cacacuagaauccaucugucca

SEQ ID NO: 853814 - RNA, 31 nt, Human
cacagccccaggcccccguccaggccgccuu

SEQ ID NO: 853815 - RNA, 21 nt, Human
caccaagaaaaacgcauccca

SEQ ID NO: 853816 - RNA, 23 nt, Human
caccacugcuugggggucagggg

SEQ ID NO: 853817 - RNA, 18 nt, Human
caccagaggcccucccgg

SEQ ID NO: 853818 - RNA, 19 nt, Human
cacugucaacaggaguggc

SEQ ID NO: 853819 - RNA, 21 nt, Human
cagcagaguugugagcaugca

SEQ ID NO: 853820 - RNA, 24 nt, Human
ccagaggcccucccgggcaucuga

SEQ ID NO: 853821 - RNA, 22 nt, Human
ccccguccaggccgccugcccc

SEQ ID NO: 853822 - RNA, 28 nt, Human
cccgcaggcccaggccuccucccgggcc

SEQ ID NO: 853823 - RNA, 18 nt, Human
cccgcgcccgucccggga

SEQ ID NO: 853824 - RNA, 23 nt, Human
cccgcgggccgccccugcugcuc

SEQ ID NO: 853825 - RNA, 18 nt, Human
ccgcccugcucgcgccgc

SEQ ID NO: 853826 - RNA, 19 nt, Human
ccgcccugcucgcgccgcu

SEQ ID NO: 853827 - RNA, 20 nt, Human
ccgccgccgucgccgcggcc

SEQ ID NO: 853828 - RNA, 19 nt, Human
ccgucgccgcggcccgcuc

SEQ ID NO: 853829 - RNA, 21 nt, Human
cgcccggggccugucagcgcc

SEQ ID NO: 853830 - RNA, 18 nt, Human
cgccgcugcccgcgcccg

SEQ ID NO: 853831 - RNA, 24 nt, Human
cgcgggccgccccugcugcucccg

SEQ ID NO: 853832 - RNA, 23 nt, Human
cggcccgcaggcccaggccuccu

SEQ ID NO: 853833 - RNA, 21 nt, Human
cggggccugucagcgccgccg

SEQ ID NO: 853834 - RNA, 25 nt, Human
cucccgggccgcgccucccgaaggc

SEQ ID NO: 853835 - RNA, 21 nt, Human
cuccucccgggccgcgccucc

SEQ ID NO: 853836 - RNA, 23 nt, Human
cucuccagaccacuucucagcug

SEQ ID NO: 853837 - RNA, 19 nt, Human
cugcugcucccggcccgca

SEQ ID NO: 853838 - RNA, 20 nt, Human
cuuggcccagaggugaugca

SEQ ID NO: 853839 - RNA, 20 nt, Human
cuuuccccacaccagaaucc

SEQ ID NO: 853840 - RNA, 24 nt, Human
gagcaugcaacaccaagaaaaacg

SEQ ID NO: 853841 - RNA, 21 nt, Human
gcccaggccuccucccgggcc

SEQ ID NO: 853842 - RNA, 18 nt, Human
gccgccugccccgccccg

SEQ ID NO: 853843 - RNA, 23 nt, Human
gcucucucucagcugcugcuuag

SEQ ID NO: 853844 - RNA, 23 nt, Human
ggaaaaagugagggagggaaagc

SEQ ID NO: 853845 - RNA, 19 nt, Human
ggaacucgcccgcccugcu

SEQ ID NO: 853846 - RNA, 25 nt, Human
ggccauggggagggagcgcggaacu

SEQ ID NO: 853847 - RNA, 22 nt, Human
ggcccaggccuccucccgggcc

SEQ ID NO: 853848 - RNA, 21 nt, Human
uagaaauaggcuccgcucucu

SEQ ID NO: 853849 - RNA, 19 nt, Human
uagaauccaucuguccagu

SEQ ID NO: 853850 - RNA, 19 nt, Human
uaucugugcuuuccccaca

SEQ ID NO: 853851 - RNA, 21 nt, Human
ucagcgccgccgccgucgccg

SEQ ID NO: 853852 - RNA, 23 nt, Human
uccaguaucugugcuuuccccac

SEQ ID NO: 853853 - RNA, 21 nt, Human
ucccacagccccaggcccccg

SEQ ID NO: 853854 - RNA, 18 nt, Human
uccccacaccagaaucca

SEQ ID NO: 853855 - RNA, 20 nt, Human
ucccgagucuuccucucuca

SEQ ID NO: 853856 - RNA, 24 nt, Human
ucccggcccgcaggcccaggccuc

SEQ ID NO: 853857 - RNA, 19 nt, Human
ucccgggacuuccgcuccc

SEQ ID NO: 853858 - RNA, 20 nt, Human
ucccgggacuuccgcucccu

SEQ ID NO: 853859 - RNA, 24 nt, Human
ucgccgcggcccgcucccggccau

SEQ ID NO: 853860 - RNA, 18 nt, Human
ucgcgccgcugcccgcgc

SEQ ID NO: 853861 - RNA, 23 nt, Human
ucuccagaccacuucucagcugu

SEQ ID NO: 853862 - RNA, 21 nt, Human
ucucucagcugcugcuuagac

SEQ ID NO: 853863 - RNA, 25 nt, Human
ugagggagggaaagcucuccccgag

SEQ ID NO: 853864 - RNA, 23 nt, Human
ugaguguuuacaaaggaaaaagu

SEQ ID NO: 853865 - RNA, 18 nt, Human
ugccccgccccgcccggg

SEQ ID NO: 853866 - RNA, 19 nt, Human
uggcaccagaggcccuccc

SEQ ID NO: 853867 - RNA, 23 nt, Human
uggcuuguccuuggcccagaggu

SEQ ID NO: 853868 - RNA, 23 nt, Human
ugugagcaugcaacaccaagaaa

SEQ ID NO: 853869 - RNA, 22 nt, Human
uuaaauacuuuuaaccugagua

SEQ ID NO: 853870 - RNA, 21 nt, Human
uuggaagaguggcaccacugc

SEQ ID NO: 853871 - RNA, 23 nt, Human
uuggaagaguggcaccacugcuu

SEQ ID NO: 853872 - RNA, 18 nt, Human
uuuacaaaggaaaaagug

SEQ ID NO: 853873 - RNA, 19 nt, Human
uuuuuuuuuuuuagcaguc

SEQ ID NO: 853874 - RNA, 24 nt, Human
aaagugcugggauuacaggcguga

SEQ ID NO: 853875 - RNA, 18 nt, Human
aaauaagcaacugagucc

SEQ ID NO: 853876 - RNA, 20 nt, Human
aagcucacuugcacuccgcc

SEQ ID NO: 853877 - RNA, 19 nt, Human
aagugcugggauuacaggc

SEQ ID NO: 853878 - RNA, 19 nt, Human
aagugcugggauuacaggc

SEQ ID NO: 853879 - RNA, 26 nt, Human
aagugcugggauuacaggcgugagcc

SEQ ID NO: 853880 - RNA, 19 nt, Human
acaggugccugccaccacg

SEQ ID NO: 853881 - RNA, 22 nt, Human
accaucuuggccaggcuggucu

SEQ ID NO: 853882 - RNA, 23 nt, Human
acccaggcuggagugcaguggug

SEQ ID NO: 853883 - RNA, 24 nt, Human
accuugguucaagcaauucuccug

SEQ ID NO: 853884 - RNA, 18 nt, Human
acucuaucacccaggcug

SEQ ID NO: 853885 - RNA, 24 nt, Human
acucuaucacccaggcuggagugc

SEQ ID NO: 853886 - RNA, 18 nt, Human
acugcaaccucugccacc

SEQ ID NO: 853887 - RNA, 22 nt, Human
acugcaaccucugccaccuugg

SEQ ID NO: 853888 - RNA, 18 nt, Human
agcucacuugcacuccgc

SEQ ID NO: 853889 - RNA, 25 nt, Human
aggcuggagugcaguggugugaucu

SEQ ID NO: 853890 - RNA, 21 nt, Human
aguagcugggauuacaggugc

SEQ ID NO: 853891 - RNA, 23 nt, Human
agugcaguggugugaucuuggcu

SEQ ID NO: 853892 - RNA, 23 nt, Human
agugcaguggugugaucuuggcu

SEQ ID NO: 853893 - RNA, 24 nt, Human
agugcaguggugugaucuuggcuu

SEQ ID NO: 853894 - RNA, 18 nt, Human
agugcugggauuacaggc

SEQ ID NO: 853895 - RNA, 19 nt, Human
auuacaggugccugccacc

SEQ ID NO: 853896 - RNA, 19 nt, Human
caaaaaaaaaugaggggcu

SEQ ID NO: 853897 - RNA, 24 nt, Human
caaagugcugggauuacaggcgug

SEQ ID NO: 853898 - RNA, 18 nt, Human
caaauaagcaacugaguc

SEQ ID NO: 853899 - RNA, 22 nt, Human
caagcaauucuccugccucagc

SEQ ID NO: 853900 - RNA, 24 nt, Human
caccacgccuggcuaauuuuugua

SEQ ID NO: 853901 - RNA, 21 nt, Human
caccagggcugguuugaaaac

SEQ ID NO: 853902 - RNA, 21 nt, Human
caccaucuuggccaggcuggu

SEQ ID NO: 853903 - RNA, 24 nt, Human
caccaucuuggccaggcuggucuu

SEQ ID NO: 853904 - RNA, 21 nt, Human
cacccaggcuggagugcagug

SEQ ID NO: 853905 - RNA, 21 nt, Human
caccccggcccgcggggcagc

SEQ ID NO: 853906 - RNA, 25 nt, Human
caccuauagaaggcaaucaaaaaaa

SEQ ID NO: 853907 - RNA, 23 nt, Human
cacucuaucacccaggcuggagu

SEQ ID NO: 853908 - RNA, 24 nt, Human
cacucuaucacccaggcuggagug

SEQ ID NO: 853909 - RNA, 24 nt, Human
caggauuucaccaucuuggccagg

SEQ ID NO: 853910 - RNA, 25 nt, Human
cagggauguggcaaacagaaaaucc

SEQ ID NO: 853911 - RNA, 19 nt, Human
caggugccugccaccacgc

SEQ ID NO: 853912 - RNA, 21 nt, Human
caggugccugccaccacgccu

SEQ ID NO: 853913 - RNA, 23 nt, Human
caggugccugccaccacgccugg

SEQ ID NO: 853914 - RNA, 22 nt, Human
ccaaagugcugggauuacaggc

SEQ ID NO: 853915 - RNA, 22 nt, Human
ccaaagugcugggauuacaggc

SEQ ID NO: 853916 - RNA, 24 nt, Human
ccaaagugcugggauuacaggcgu

SEQ ID NO: 853917 - RNA, 20 nt, Human
ccaccacgccuggcuaauuu

SEQ ID NO: 853918 - RNA, 20 nt, Human
ccaccgcgcccggccacaaa

SEQ ID NO: 853919 - RNA, 20 nt, Human
cccaggcuggagugcagugg

SEQ ID NO: 853920 - RNA, 23 nt, Human
cccgaguagcugggauuacaggu

SEQ ID NO: 853921 - RNA, 24 nt, Human
cccgaguagcugggauuacaggug

SEQ ID NO: 853922 - RNA, 21 nt, Human
ccgaguagcugggauuacagg

SEQ ID NO: 853923 - RNA, 21 nt, Human
ccgcaccccggcccgcggggc

SEQ ID NO: 853924 - RNA, 18 nt, Human
ccgcgcccggccacaaac

SEQ ID NO: 853925 - RNA, 23 nt, Human
ccggccacaaacagcauuuucua

SEQ ID NO: 853926 - RNA, 23 nt, Human
ccugccucagccucccgaguagc

SEQ ID NO: 853927 - RNA, 23 nt, Human
ccuugguucaagcaauucuccug

SEQ ID NO: 853928 - RNA, 20 nt, Human
cucacucuaucacccaggcc

SEQ ID NO: 853929 - RNA, 23 nt, Human
cucagccucccgaguagcuggga

SEQ ID NO: 853930 - RNA, 20 nt, Human
cuccugaccuugugaaucac

SEQ ID NO: 853931 - RNA, 24 nt, Human
cugcaaccucugccaccuugguuc

SEQ ID NO: 853932 - RNA, 23 nt, Human
cugccucagccucccgaguagcu

SEQ ID NO: 853933 - RNA, 21 nt, Human
cuuacugcaaccucugccacc

SEQ ID NO: 853934 - RNA, 19 nt, Human
cuucaagagcagagugucc

SEQ ID NO: 853935 - RNA, 22 nt, Human
gaagcucacuugcacuccgccu

SEQ ID NO: 853936 - RNA, 22 nt, Human
gaccuugugaaucaccggccuc

SEQ ID NO: 853937 - RNA, 24 nt, Human
gaccuugugaaucaccggccucgg

SEQ ID NO: 853938 - RNA, 18 nt, Human
gauuacaggcgugagcca

SEQ ID NO: 853939 - RNA, 22 nt, Human
gauuacaggcgugagccaccgc

SEQ ID NO: 853940 - RNA, 22 nt, Human
gauuacaggcgugagccaccgc

SEQ ID NO: 853941 - RNA, 18 nt, Human
gauuacaggugccugcca

SEQ ID NO: 853942 - RNA, 25 nt, Human
ggaccacauccauuacacaaauaag

SEQ ID NO: 853943 - RNA, 22 nt, Human
ggcuggagugcaguggugugau

SEQ ID NO: 853944 - RNA, 23 nt, Human
ggcuggucuugaacuccugaccu

SEQ ID NO: 853945 - RNA, 20 nt, Human
ggucuugaacuccugaccuu

SEQ ID NO: 853946 - RNA, 18 nt, Human
guagcugggauuacaggu

SEQ ID NO: 853947 - RNA, 24 nt, Human
uaauuuuuguauuuuuauuagaga

SEQ ID NO: 853948 - RNA, 23 nt, Human
uacaggcgugagccaccgcgccc

SEQ ID NO: 853949 - RNA, 22 nt, Human
uacaggugccugccaccacgcc

SEQ ID NO: 853950 - RNA, 23 nt, Human
uacugcaaccucugccaccuugg

SEQ ID NO: 853951 - RNA, 21 nt, Human
uagaaggcaaucaaaaaaaaa

SEQ ID NO: 853952 - RNA, 20 nt, Human
uagagacaggauuucaccau

SEQ ID NO: 853953 - RNA, 21 nt, Human
uaucacccaggcuggagugca

SEQ ID NO: 853954 - RNA, 26 nt, Human
uauuagagacaggauuucaccaucuu

SEQ ID NO: 853955 - RNA, 19 nt, Human
ucaagcaauucuccugccu

SEQ ID NO: 853956 - RNA, 24 nt, Human
ucacccaggcuggagugcaguggu

SEQ ID NO: 853957 - RNA, 24 nt, Human
ucacucuaucacccaggcuggagu

SEQ ID NO: 853958 - RNA, 20 nt, Human
ucagccucccgaguagcugg

SEQ ID NO: 853959 - RNA, 18 nt, Human
uccacaucaccuauagaa

SEQ ID NO: 853960 - RNA, 24 nt, Human
ucccaaagugcugggauuacaggc

SEQ ID NO: 853961 - RNA, 23 nt, Human
ucccgaguagcugggauuacagg

SEQ ID NO: 853962 - RNA, 24 nt, Human
ucccgaguagcugggauuacaggu

SEQ ID NO: 853963 - RNA, 21 nt, Human
ucuaggaggcaucuguugcag

SEQ ID NO: 853964 - RNA, 24 nt, Human
ucuaucacccaggcuggagugcag

SEQ ID NO: 853965 - RNA, 23 nt, Human
ucucacucuaucacccaggcugg

SEQ ID NO: 853966 - RNA, 24 nt, Human
ucucacucuaucacccaggcugga

SEQ ID NO: 853967 - RNA, 26 nt, Human
ucucacucuaucacccaggcuggagu

SEQ ID NO: 853968 - RNA, 27 nt, Human
ucucacucuaucacccaggcuggagug

SEQ ID NO: 853969 - RNA, 24 nt, Human
ucuccugccucagccucccgagua

SEQ ID NO: 853970 - RNA, 19 nt, Human
ucuugaacuccugaccuug

SEQ ID NO: 853971 - RNA, 22 nt, Human
ucuuggccaggcuggucuugaa

SEQ ID NO: 853972 - RNA, 21 nt, Human
ugaaaagacacugcacauuga

SEQ ID NO: 853973 - RNA, 23 nt, Human
ugaaaagacacugcacauugaug

SEQ ID NO: 853974 - RNA, 21 nt, Human
ugcaguggugugaucuuggcu

SEQ ID NO: 853975 - RNA, 24 nt, Human
ugccucagccucccgaguagcugg

SEQ ID NO: 853976 - RNA, 24 nt, Human
ugcugggauuacaggcgugagcca

SEQ ID NO: 853977 - RNA, 19 nt, Human
uggagugcaguggugugau

SEQ ID NO: 853978 - RNA, 23 nt, Human
uggagugcaguggugugaucuug

SEQ ID NO: 853979 - RNA, 24 nt, Human
uggagugcaguggugugaucuugg

SEQ ID NO: 853980 - RNA, 24 nt, Human
uggccaggcuggucuugaacuccu

SEQ ID NO: 853981 - RNA, 18 nt, Human
ugggauuacaggcgugag

SEQ ID NO: 853982 - RNA, 19 nt, Human
ugggauuacaggcgugagc

SEQ ID NO: 853983 - RNA, 21 nt, Human
ugggauuacaggcgugagcca

SEQ ID NO: 853984 - RNA, 22 nt, Human
ugggauuacaggcgugagccac

SEQ ID NO: 853985 - RNA, 23 nt, Human
ugggauuacaggcgugagccacc

SEQ ID NO: 853986 - RNA, 24 nt, Human
ugggauuacaggcgugagccaccg

SEQ ID NO: 853987 - RNA, 21 nt, Human
ugggauuacaggugccugcca

SEQ ID NO: 853988 - RNA, 22 nt, Human
ugggauuacaggugccugccac

SEQ ID NO: 853989 - RNA, 24 nt, Human
ugggauuacaggugccugccacca

SEQ ID NO: 853990 - RNA, 23 nt, Human
ugguucaagcaauucuccugccu

SEQ ID NO: 853991 - RNA, 24 nt, Human
uuacugcaaccucugccaccuugg

SEQ ID NO: 853992 - RNA, 24 nt, Human
uuauuagagacaggauuucaccau

SEQ ID NO: 853993 - RNA, 18 nt, Human
uucaagagcagagugucc

SEQ ID NO: 853994 - RNA, 21 nt, Human
uucaagcaauucuccugccuc

SEQ ID NO: 853995 - RNA, 24 nt, Human
uucaagcaauucuccugccucagc

SEQ ID NO: 853996 - RNA, 19 nt, Human
uugaaaaccugauguaaua

SEQ ID NO: 853997 - RNA, 24 nt, Human
uugcagugucugcuacaccagggc

SEQ ID NO: 853998 - RNA, 24 nt, Human
uuucaccaucuuggccaggcuggu

SEQ ID NO: 853999 - RNA, 20 nt, Human
uuuuuguauuuuuauuagag

SEQ ID NO: 854000 - RNA, 23 nt, Human
uuuuuguauuuuuauuagagaca

SEQ ID NO: 854001 - RNA, 21 nt, Human
uuuuuuuuuuuuuuugucaag

SEQ ID NO: 854002 - RNA, 18 nt, Human
uuuuuuuuuuuuuuuuug

SEQ ID NO: 854003 - RNA, 19 nt, Human
uuuuuuuuuuuuuuuuugu

SEQ ID NO: 854004 - RNA, 22 nt, Human
aaaggggcaacggggaagaucc

SEQ ID NO: 854005 - RNA, 19 nt, Human
ccgguuaggccuuugggcc

SEQ ID NO: 854006 - RNA, 20 nt, Human
cggggaagaucccuaggcca

SEQ ID NO: 854007 - RNA, 27 nt, Human
gagccgagagggaguaggggaagagcu

SEQ ID NO: 854008 - RNA, 19 nt, Human
gaguaggggaagagcuggc

SEQ ID NO: 854009 - RNA, 18 nt, Human
ggaguaggggaagagcug

SEQ ID NO: 854010 - RNA, 22 nt, Human
ggccacaaggagccgagaggga

SEQ ID NO: 854011 - RNA, 19 nt, Human
ggggaagagcuggcccgca

SEQ ID NO: 854012 - RNA, 21 nt, Human
uuuuguuaaauuguucuuaau

SEQ ID NO: 854013 - RNA, 22 nt, Human
uuuuuuuuuuuuuuuuuuucag

SEQ ID NO: 854014 - RNA, 22 nt, Human
aaaugcuggcacuucaggugug

SEQ ID NO: 854015 - RNA, 22 nt, Human
aaaugcuggcacuucaggugug

SEQ ID NO: 854016 - RNA, 23 nt, Human
aaaugcuggcacuucaggugugg

SEQ ID NO: 854017 - RNA, 21 nt, Human
aagccaucggcagcucagcuc

SEQ ID NO: 854018 - RNA, 19 nt, Human
aagccgcucacccggacuc

SEQ ID NO: 854019 - RNA, 24 nt, Human
acccucgcccacuccccaccggcc

SEQ ID NO: 854020 - RNA, 30 nt, Human
accuccaucuccacgauguuucccuccauu

SEQ ID NO: 854021 - RNA, 18 nt, Human
agagagcagccacccaca

SEQ ID NO: 854022 - RNA, 19 nt, Human
agcucagcucacaccugca

SEQ ID NO: 854023 - RNA, 24 nt, Human
aggaacugcugcgcccaccacucg

SEQ ID NO: 854024 - RNA, 24 nt, Human
aggaacugcugcgcccaccacucg

SEQ ID NO: 854025 - RNA, 24 nt, Human
agggaaaaaaaggugcaaaagucc

SEQ ID NO: 854026 - RNA, 24 nt, Human
agggaaaaaaaggugcaaaagucc

SEQ ID NO: 854027 - RNA, 20 nt, Human
caaaguucugcagccgggga

SEQ ID NO: 854028 - RNA, 31 nt, Human
caaaugcuggcacuucagguguggccggcaa

SEQ ID NO: 854029 - RNA, 24 nt, Human
caagucuccccuggagcuaaccac

SEQ ID NO: 854030 - RNA, 21 nt, Human
cacccacagcagccgguggcc

SEQ ID NO: 854031 - RNA, 19 nt, Human
cacgacccaguccaugacc

SEQ ID NO: 854032 - RNA, 18 nt, Human
cacucugcagccggggau

SEQ ID NO: 854033 - RNA, 24 nt, Human
cacucugcagccggggauuggggg

SEQ ID NO: 854034 - RNA, 24 nt, Human
cagaagcaccuccaucuccacgau

SEQ ID NO: 854035 - RNA, 18 nt, Human
cagccacccacagcagcc

SEQ ID NO: 854036 - RNA, 21 nt, Human
cagcugcuguugcaccugcug

SEQ ID NO: 854037 - RNA, 20 nt, Human
caggaucagaggggcugggg

SEQ ID NO: 854038 - RNA, 21 nt, Human
caggcaccccaucgcccaccc

SEQ ID NO: 854039 - RNA, 23 nt, Human
caggcugugggaggagggcaguc

SEQ ID NO: 854040 - RNA, 24 nt, Human
cagggccugggucaggaucagagg

SEQ ID NO: 854041 - RNA, 20 nt, Human
caggucccaggcaccccauc

SEQ ID NO: 854042 - RNA, 23 nt, Human
ccaaaugcuggcacuucaggugu

SEQ ID NO: 854043 - RNA, 23 nt, Human
ccaaaugcuggcacuucaggugu

SEQ ID NO: 854044 - RNA, 18 nt, Human
ccacagaagcaccuccau

SEQ ID NO: 854045 - RNA, 18 nt, Human
ccacauucucgccccaca

SEQ ID NO: 854046 - RNA, 21 nt, Human
ccacauucucgccccacagaa

SEQ ID NO: 854047 - RNA, 20 nt, Human
ccagauccggccccugcgcc

SEQ ID NO: 854048 - RNA, 21 nt, Human
ccaggaacugcugcgcccacc

SEQ ID NO: 854049 - RNA, 21 nt, Human
ccaggaacugcugcgcccacc

SEQ ID NO: 854050 - RNA, 23 nt, Human
cccaacccccccacucugggugu

SEQ ID NO: 854051 - RNA, 26 nt, Human
cccacaccgccgccggcccccggcca

SEQ ID NO: 854052 - RNA, 22 nt, Human
cccacagcagccgguggcccag

SEQ ID NO: 854053 - RNA, 18 nt, Human
ccccaacccccccacucu

SEQ ID NO: 854054 - RNA, 22 nt, Human
ccccaacccccccacucugggu

SEQ ID NO: 854055 - RNA, 25 nt, Human
ccccaggggcuggucgcuggucccu

SEQ ID NO: 854056 - RNA, 25 nt, Human
ccccaggggcuggucgcuggucccu

SEQ ID NO: 854057 - RNA, 23 nt, Human
ccccaucgcccacccagggccug

SEQ ID NO: 854058 - RNA, 25 nt, Human
cccccacgucccaugggaugaggac

SEQ ID NO: 854059 - RNA, 24 nt, Human
ccccccacucuggguguaguucua

SEQ ID NO: 854060 - RNA, 23 nt, Human
cccccggccagauccggccccug

SEQ ID NO: 854061 - RNA, 20 nt, Human
cccccucccagcagccacua

SEQ ID NO: 854062 - RNA, 21 nt, Human
ccccgagggucuugcaggugc

SEQ ID NO: 854063 - RNA, 22 nt, Human
cccugcgccggggcucgcccuc

SEQ ID NO: 854064 - RNA, 20 nt, Human
cccugggcacagugagcagg

SEQ ID NO: 854065 - RNA, 20 nt, Human
cccugggcacagugagcagg

SEQ ID NO: 854066 - RNA, 19 nt, Human
ccggcccccggccagaucc

SEQ ID NO: 854067 - RNA, 19 nt, Human
ccggccccugcgccggggc

SEQ ID NO: 854068 - RNA, 20 nt, Human
ccgggccagcccacuuuccc

SEQ ID NO: 854069 - RNA, 24 nt, Human
ccucccugccagccccaggggcug

SEQ ID NO: 854070 - RNA, 24 nt, Human
ccucccugccagccccaggggcug

SEQ ID NO: 854071 - RNA, 20 nt, Human
ccugaaccagagagagcagc

SEQ ID NO: 854072 - RNA, 24 nt, Human
ccugaaccagagagagcagccacc

SEQ ID NO: 854073 - RNA, 23 nt, Human
ccugcagcccuguguccugaggg

SEQ ID NO: 854074 - RNA, 21 nt, Human
ccugcaucccaucagcagccc

SEQ ID NO: 854075 - RNA, 21 nt, Human
ccuggggggacaggguugggg

SEQ ID NO: 854076 - RNA, 22 nt, Human
ccugggucaggaucagaggggc

SEQ ID NO: 854077 - RNA, 24 nt, Human
cgagacaaggggcgaugccaaagg

SEQ ID NO: 854078 - RNA, 22 nt, Human
cgcagugggugggcagggcgcc

SEQ ID NO: 854079 - RNA, 22 nt, Human
cgcagugggugggcagggcgcc

SEQ ID NO: 854080 - RNA, 19 nt, Human
cgcccacuccccaccggcc

SEQ ID NO: 854081 - RNA, 21 nt, Human
cgccccacagaagcaccucca

SEQ ID NO: 854082 - RNA, 22 nt, Human
cgcccccucccagcagccacua

SEQ ID NO: 854083 - RNA, 22 nt, Human
cggcaggcgcugggaagaaggg

SEQ ID NO: 854084 - RNA, 20 nt, Human
cggcccgagacaaggggcga

SEQ ID NO: 854085 - RNA, 20 nt, Human
cgguggcccaggccucucuu

SEQ ID NO: 854086 - RNA, 20 nt, Human
cguguagcagcgcccccucc

SEQ ID NO: 854087 - RNA, 20 nt, Human
cguguagcagcgcccccucc

SEQ ID NO: 854088 - RNA, 19 nt, Human
cuaggccacauucucgccc

SEQ ID NO: 854089 - RNA, 18 nt, Human
cuccucccugccagcccc

SEQ ID NO: 854090 - RNA, 18 nt, Human
cuccucccugccagcccc

SEQ ID NO: 854091 - RNA, 20 nt, Human
cuccucccugccagccccag

SEQ ID NO: 854092 - RNA, 20 nt, Human
cuccucccugccagccccag

SEQ ID NO: 854093 - RNA, 23 nt, Human
cucgccaggaacugcugcgccca

SEQ ID NO: 854094 - RNA, 23 nt, Human
cucgccaggaacugcugcgccca

SEQ ID NO: 854095 - RNA, 22 nt, Human
cucgcccacuccccaccggccc

SEQ ID NO: 854096 - RNA, 19 nt, Human
cucucugccccaacccccc

SEQ ID NO: 854097 - RNA, 19 nt, Human
cucugccccaaccccccca

SEQ ID NO: 854098 - RNA, 21 nt, Human
cucugccccaacccccccacu

SEQ ID NO: 854099 - RNA, 24 nt, Human
cugcugccaggcugugggaggagg

SEQ ID NO: 854100 - RNA, 25 nt, Human
cuggcacuucagguguggccggcaa

SEQ ID NO: 854101 - RNA, 19 nt, Human
cuuggcccgcccucaccgg

SEQ ID NO: 854102 - RNA, 21 nt, Human
gacuccgagugcggcaggcgc

SEQ ID NO: 854103 - RNA, 20 nt, Human
gagcagccccgggccagccc

SEQ ID NO: 854104 - RNA, 21 nt, Human
gagcagccccgggccagccca

SEQ ID NO: 854105 - RNA, 20 nt, Human
gccccaacccccccacucuu

SEQ ID NO: 854106 - RNA, 19 nt, Human
gccccaggggcuggucgcu

SEQ ID NO: 854107 - RNA, 19 nt, Human
gccccaggggcuggucgcu

SEQ ID NO: 854108 - RNA, 21 nt, Human
ggagcuccucccugccagccc

SEQ ID NO: 854109 - RNA, 21 nt, Human
ggagcuccucccugccagccc

SEQ ID NO: 854110 - RNA, 21 nt, Human
ggcccuuggccauggcagcuu

SEQ ID NO: 854111 - RNA, 21 nt, Human
ggcccuuggccauggcagcuu

SEQ ID NO: 854112 - RNA, 23 nt, Human
ggcugggccaccauccagcugcu

SEQ ID NO: 854113 - RNA, 20 nt, Human
gggacaggguuggggggcuc

SEQ ID NO: 854114 - RNA, 18 nt, Human
ggggacaggguugggggg

SEQ ID NO: 854115 - RNA, 18 nt, Human
ggggggcucacucugcag

SEQ ID NO: 854116 - RNA, 23 nt, Human
guccaugaccaugucucucugcc

SEQ ID NO: 854117 - RNA, 19 nt, Human
gugacuauaacccucgccc

SEQ ID NO: 854118 - RNA, 21 nt, Human
guggccggcacccagccaggc

SEQ ID NO: 854119 - RNA, 19 nt, Human
guguagcagcgcccccucc

SEQ ID NO: 854120 - RNA, 18 nt, Human
uaacccucgcccacuccc

SEQ ID NO: 854121 - RNA, 18 nt, Human
uagcagcgcccccuccca

SEQ ID NO: 854122 - RNA, 18 nt, Human
uagcagcgcccccuccca

SEQ ID NO: 854123 - RNA, 19 nt, Human
ucaaugggcacaaagucug

SEQ ID NO: 854124 - RNA, 22 nt, Human
ucaccggcugggccaccaucca

SEQ ID NO: 854125 - RNA, 19 nt, Human
ucagcucacaccugcagcc

SEQ ID NO: 854126 - RNA, 19 nt, Human
uccacgauguuucccucca

SEQ ID NO: 854127 - RNA, 26 nt, Human
uccccaagccaucggcagcucagcuc

SEQ ID NO: 854128 - RNA, 18 nt, Human
uccccgagggucuugcag

SEQ ID NO: 854129 - RNA, 19 nt, Human
uccccuggggugggaaccu

SEQ ID NO: 854130 - RNA, 24 nt, Human
ucccucauccccuggggugggaac

SEQ ID NO: 854131 - RNA, 18 nt, Human
ucccugagucgggagagu

SEQ ID NO: 854132 - RNA, 19 nt, Human
ucccugccagccccagggg

SEQ ID NO: 854133 - RNA, 19 nt, Human
ucccugccagccccagggg

SEQ ID NO: 854134 - RNA, 22 nt, Human
ucccuggcugcccccacguccc

SEQ ID NO: 854135 - RNA, 22 nt, Human
ucccugggcacagugagcaggg

SEQ ID NO: 854136 - RNA, 22 nt, Human
ucccugggcacagugagcaggg

SEQ ID NO: 854137 - RNA, 19 nt, Human
uccggccccugcgccgggg

SEQ ID NO: 854138 - RNA, 21 nt, Human
ucgcccacuccccaccggcug

SEQ ID NO: 854139 - RNA, 18 nt, Human
ucugcagccggggauugg

SEQ ID NO: 854140 - RNA, 18 nt, Human
ucugcagccggggauugg

SEQ ID NO: 854141 - RNA, 21 nt, Human
ucuuagagugucccaaaccuu

SEQ ID NO: 854142 - RNA, 23 nt, Human
ucuugcaguccccaagccaucgg

SEQ ID NO: 854143 - RNA, 18 nt, Human
ugaaccagagagagcagc

SEQ ID NO: 854144 - RNA, 20 nt, Human
ugaccugagccacgacccag

SEQ ID NO: 854145 - RNA, 18 nt, Human
ugagcagggcugagguca

SEQ ID NO: 854146 - RNA, 18 nt, Human
ugagcagggcugagguca

SEQ ID NO: 854147 - RNA, 24 nt, Human
ugagccacgacccaguccaugacc

SEQ ID NO: 854148 - RNA, 18 nt, Human
ugcaucccaucagcagcc

SEQ ID NO: 854149 - RNA, 21 nt, Human
ugccaccugcaucccaucagc

SEQ ID NO: 854150 - RNA, 22 nt, Human
ugccccaacccccccacucugg

SEQ ID NO: 854151 - RNA, 22 nt, Human
ugcugccuggcagaacucagga

SEQ ID NO: 854152 - RNA, 18 nt, Human
ugcuguugcaccugcugc

SEQ ID NO: 854153 - RNA, 23 nt, Human
uggcagcuugguugggacagccg

SEQ ID NO: 854154 - RNA, 23 nt, Human
uggcagcuugguugggacagccg

SEQ ID NO: 854155 - RNA, 19 nt, Human
uggcagggccugggucagg

SEQ ID NO: 854156 - RNA, 23 nt, Human
ugggaggagggcagucgggcuga

SEQ ID NO: 854157 - RNA, 25 nt, Human
ugggaggagggcagucgggcugagc

SEQ ID NO: 854158 - RNA, 22 nt, Human
uggggggacaggguuggggggc

SEQ ID NO: 854159 - RNA, 20 nt, Human
uggggugggaaccuggcagg

SEQ ID NO: 854160 - RNA, 19 nt, Human
ugggugggcagggcgccau

SEQ ID NO: 854161 - RNA, 19 nt, Human
ugggugggcagggcgccau

SEQ ID NO: 854162 - RNA, 22 nt, Human
uguggccggcacccagccaggc

SEQ ID NO: 854163 - RNA, 21 nt, Human
ugugggcagagaaggcugggc

SEQ ID NO: 854164 - RNA, 21 nt, Human
uugcaggugcccaugcugcca

SEQ ID NO: 854165 - RNA, 18 nt, Human
uuuuuuuuuuuuuuuuug

SEQ ID NO: 854166 - RNA, 18 nt, Human
uuuuuuuuuuuuuuuuug

SEQ ID NO: 854167 - RNA, 22 nt, Human
uuuuuuuuuuuuuuuuugacag

SEQ ID NO: 854168 - RNA, 25 nt, Human
uuuuuuuuuuuuuuuuuuguuuuuu

SEQ ID NO: 854169 - RNA, 18 nt, Human
aaaagacaagaacccaga

SEQ ID NO: 854170 - RNA, 22 nt, Human
aaaagacaagaacccagacaua

SEQ ID NO: 854171 - RNA, 20 nt, Human
aaaagggccuccugcaaggg

SEQ ID NO: 854172 - RNA, 24 nt, Human
aaacagaccacaaaagacaagaac

SEQ ID NO: 854173 - RNA, 25 nt, Human
aaagacaaacagaccacaaaagaca

SEQ ID NO: 854174 - RNA, 21 nt, Human
aaagagguagaaaagacaaac

SEQ ID NO: 854175 - RNA, 20 nt, Human
aacaugccuuggggucagga

SEQ ID NO: 854176 - RNA, 21 nt, Human
aaccacgaugaugaggggccc

SEQ ID NO: 854177 - RNA, 20 nt, Human
aagaacaggagaagcucaug

SEQ ID NO: 854178 - RNA, 21 nt, Human
aagaacccagacauauagaca

SEQ ID NO: 854179 - RNA, 26 nt, Human
aagacaaacagaccacaaaagacaag

SEQ ID NO: 854180 - RNA, 21 nt, Human
aagcucauguaauggauuacc

SEQ ID NO: 854181 - RNA, 21 nt, Human
aaggaggagugggugggaggg

SEQ ID NO: 854182 - RNA, 19 nt, Human
aaggagguggggaaguggg

SEQ ID NO: 854183 - RNA, 22 nt, Human
acaaaagacaagaacccagaca

SEQ ID NO: 854184 - RNA, 26 nt, Human
acaaacagaccacaaaagacaagaac

SEQ ID NO: 854185 - RNA, 19 nt, Human
accgaccuccacucuggcu

SEQ ID NO: 854186 - RNA, 24 nt, Human
accgaccuccacucuggcucccac

SEQ ID NO: 854187 - RNA, 22 nt, Human
acuuuaagaacaugccuugggg

SEQ ID NO: 854188 - RNA, 24 nt, Human
agaaaagacaaacagaccacaaaa

SEQ ID NO: 854189 - RNA, 26 nt, Human
agaaaagacaaacagaccacaaaaga

SEQ ID NO: 854190 - RNA, 23 nt, Human
agaaagagguagaaaagagggac

SEQ ID NO: 854191 - RNA, 19 nt, Human
agaacaggagaagcucaug

SEQ ID NO: 854192 - RNA, 19 nt, Human
agaaggaggaguggguggg

SEQ ID NO: 854193 - RNA, 20 nt, Human
agaccacaaaagacaagaac

SEQ ID NO: 854194 - RNA, 19 nt, Human
agcaaggaagccuccagga

SEQ ID NO: 854195 - RNA, 22 nt, Human
agcaggaaacaagcuuggcuga

SEQ ID NO: 854196 - RNA, 25 nt, Human
aggaaaguggaagaacaggagaagc

SEQ ID NO: 854197 - RNA, 21 nt, Human
aggaaggguaaaagcaggggg

SEQ ID NO: 854198 - RNA, 19 nt, Human
aggagaagcucauguaaug

SEQ ID NO: 854199 - RNA, 20 nt, Human
aggagcagcaaggaagccuc

SEQ ID NO: 854200 - RNA, 19 nt, Human
aggaggagugggugggagg

SEQ ID NO: 854201 - RNA, 24 nt, Human
aggcaggaaaguggaagaacagga

SEQ ID NO: 854202 - RNA, 21 nt, Human
aggguaaaagcagggggcaaa

SEQ ID NO: 854203 - RNA, 19 nt, Human
aguguguaaccuggggccu

SEQ ID NO: 854204 - RNA, 20 nt, Human
auguaugcauguguguauau

SEQ ID NO: 854205 - RNA, 21 nt, Human
auguaugcauguguguauaug

SEQ ID NO: 854206 - RNA, 18 nt, Human
caaagcgguggcccuccc

SEQ ID NO: 854207 - RNA, 19 nt, Human
cagaccacaaaagacaaga

SEQ ID NO: 854208 - RNA, 25 nt, Human
cagacgcaccuguugcaugugcaug

SEQ ID NO: 854209 - RNA, 18 nt, Human
cagagcaggcaggcagcc

SEQ ID NO: 854210 - RNA, 25 nt, Human
cagcugaaaccuguguccaaguagc

SEQ ID NO: 854211 - RNA, 21 nt, Human
caggcaggcagcccacccccu

SEQ ID NO: 854212 - RNA, 21 nt, Human
caugccuuggggucaggagga

SEQ ID NO: 854213 - RNA, 20 nt, Human
caugggguccccaccuuccc

SEQ ID NO: 854214 - RNA, 22 nt, Human
ccacaaaagacaagaacccaga

SEQ ID NO: 854215 - RNA, 20 nt, Human
ccaggcaggaaaguggaaga

SEQ ID NO: 854216 - RNA, 22 nt, Human
ccaggguggcagucccagagga

SEQ ID NO: 854217 - RNA, 28 nt, Human
cccacaagccucagagcaggaaacaagc

SEQ ID NO: 854218 - RNA, 21 nt, Human
cccccugcagcagugcugggc

SEQ ID NO: 854219 - RNA, 21 nt, Human
ccccugcagcagugcugggcu

SEQ ID NO: 854220 - RNA, 26 nt, Human
ccgaccuccacucuggcucccacccc

SEQ ID NO: 854221 - RNA, 18 nt, Human
ccucaggccugguaaccu

SEQ ID NO: 854222 - RNA, 24 nt, Human
ccugagguguagagcacccagaag

SEQ ID NO: 854223 - RNA, 24 nt, Human
cgaugaugaggggccacagaacac

SEQ ID NO: 854224 - RNA, 19 nt, Human
cucagagcaggcaggcagc

SEQ ID NO: 854225 - RNA, 19 nt, Human
cucauguaugcaugugugu

SEQ ID NO: 854226 - RNA, 21 nt, Human
cugcacaugacaaugugcaug

SEQ ID NO: 854227 - RNA, 24 nt, Human
cuggccacacccuaagccuugcaa

SEQ ID NO: 854228 - RNA, 18 nt, Human
cuggggccucagcuucuu

SEQ ID NO: 854229 - RNA, 22 nt, Human
cuuucagggcuggccacacccu

SEQ ID NO: 854230 - RNA, 22 nt, Human
gaaaagacaaacagaccacaaa

SEQ ID NO: 854231 - RNA, 21 nt, Human
gaccacaaaagacaagaaccc

SEQ ID NO: 854232 - RNA, 19 nt, Human
gagcacccagaaggaaggg

SEQ ID NO: 854233 - RNA, 24 nt, Human
gagcaggcaggcagcccacccccu

SEQ ID NO: 854234 - RNA, 21 nt, Human
gagccagagccugggagagaa

SEQ ID NO: 854235 - RNA, 21 nt, Human
gauuacccuccacaggauuau

SEQ ID NO: 854236 - RNA, 19 nt, Human
gccucagcuucuugaucug

SEQ ID NO: 854237 - RNA, 21 nt, Human
gccucagcuucuugaucuggg

SEQ ID NO: 854238 - RNA, 23 nt, Human
gcgugcaugugggcauguaugua

SEQ ID NO: 854239 - RNA, 21 nt, Human
gcugggcagagcaggggaagg

SEQ ID NO: 854240 - RNA, 19 nt, Human
gcuggggccagcugaaacc

SEQ ID NO: 854241 - RNA, 24 nt, Human
gcuggugaagggccugugguucaa

SEQ ID NO: 854242 - RNA, 18 nt, Human
ggaagcaggcgcgugcug

SEQ ID NO: 854243 - RNA, 21 nt, Human
ggagguggggaaguggguguu

SEQ ID NO: 854244 - RNA, 20 nt, Human
ggagugggugggagggaaag

SEQ ID NO: 854245 - RNA, 25 nt, Human
ggagugggugggagggaaaggcugg

SEQ ID NO: 854246 - RNA, 22 nt, Human
ggcugggcagagcaggggaagg

SEQ ID NO: 854247 - RNA, 21 nt, Human
gggcagagcaggggaaggagu

SEQ ID NO: 854248 - RNA, 21 nt, Human
gggccucagcuucuugaucug

SEQ ID NO: 854249 - RNA, 23 nt, Human
ggguguugggguaagggcuggga

SEQ ID NO: 854250 - RNA, 18 nt, Human
ggugggagggaaaggcug

SEQ ID NO: 854251 - RNA, 22 nt, Human
gguguagagcacccagaaggaa

SEQ ID NO: 854252 - RNA, 18 nt, Human
gugcaugagccagagccu

SEQ ID NO: 854253 - RNA, 21 nt, Human
guggaagaacaggagaagcuc

SEQ ID NO: 854254 - RNA, 25 nt, Human
uaaggagguggggaaguggguguug

SEQ ID NO: 854255 - RNA, 22 nt, Human
uagaaaagacaaacagaccaca

SEQ ID NO: 854256 - RNA, 23 nt, Human
uagagcacccagaaggaagggua

SEQ ID NO: 854257 - RNA, 21 nt, Human
uaucacugcaagagaaagagg

SEQ ID NO: 854258 - RNA, 23 nt, Human
ucugggcuggggccagcugaaac

SEQ ID NO: 854259 - RNA, 26 nt, Human
ugagguuagcaugguuaggaguccac

SEQ ID NO: 854260 - RNA, 22 nt, Human
ugcaagagagagcucagagcag

SEQ ID NO: 854261 - RNA, 22 nt, Human
ugcacaugacaaugugcaugcc

SEQ ID NO: 854262 - RNA, 19 nt, Human
ugcaugccaguccagaguu

SEQ ID NO: 854263 - RNA, 24 nt, Human
ugcaugugcaugagccagagccug

SEQ ID NO: 854264 - RNA, 20 nt, Human
uggaaacaaggauggcucua

SEQ ID NO: 854265 - RNA, 24 nt, Human
uggaagaacaggagaagcucaugu

SEQ ID NO: 854266 - RNA, 22 nt, Human
uggcucccaccccacaagccuc

SEQ ID NO: 854267 - RNA, 21 nt, Human
ugggagagaagagagagcgug

SEQ ID NO: 854268 - RNA, 20 nt, Human
ugggcauguauguaucuggg

SEQ ID NO: 854269 - RNA, 20 nt, Human
uggggaaguggguguugggg

SEQ ID NO: 854270 - RNA, 22 nt, Human
uggggaaguggguguuggggaa

SEQ ID NO: 854271 - RNA, 22 nt, Human
uggggucaggaggacauaggug

SEQ ID NO: 854272 - RNA, 24 nt, Human
ugggugggagggaaaggcugggca

SEQ ID NO: 854273 - RNA, 21 nt, Human
uguagagcacccagaaggaag

SEQ ID NO: 854274 - RNA, 18 nt, Human
uguaugcauguguguaua

SEQ ID NO: 854275 - RNA, 19 nt, Human
uguaugcauguguguauau

SEQ ID NO: 854276 - RNA, 27 nt, Human
ugugcuggugaagggccugugguucaa

SEQ ID NO: 854277 - RNA, 20 nt, Human
ugugggcauguauguaucug

SEQ ID NO: 854278 - RNA, 21 nt, Human
uguguaaccuggggccucagc

SEQ ID NO: 854279 - RNA, 24 nt, Human
uguguauaugcaaagcugcacaug

SEQ ID NO: 854280 - RNA, 22 nt, Human
uguguggaggcucauguaugca

SEQ ID NO: 854281 - RNA, 19 nt, Human
uuccugagaguuuuuucuc

SEQ ID NO: 854282 - RNA, 22 nt, Human
uugcagaaggaggagugggugg

SEQ ID NO: 854283 - RNA, 23 nt, Human
uuuuuuuuuuuuuuuucuaauug

SEQ ID NO: 854284 - RNA, 23 nt, Human
uuuuuuuuuuuuuuuuucuaauu

SEQ ID NO: 854285 - RNA, 23 nt, Human
aagucuuugguauggaaugaagc

SEQ ID NO: 854286 - RNA, 20 nt, Human
acgcacccuccaccuugggg

SEQ ID NO: 854287 - RNA, 20 nt, Human
acgcggccggagccggcggc

SEQ ID NO: 854288 - RNA, 21 nt, Human
agcucuauccuuucaaaguca

SEQ ID NO: 854289 - RNA, 21 nt, Human
aguagcggcugcgggccuggc

SEQ ID NO: 854290 - RNA, 18 nt, Human
aguggccauggcacuggg

SEQ ID NO: 854291 - RNA, 23 nt, Human
aucccccuccaggcgccucgcug

SEQ ID NO: 854292 - RNA, 22 nt, Human
caacacgauuccugaguucuga

SEQ ID NO: 854293 - RNA, 20 nt, Human
caaugcaugcaacacgauuc

SEQ ID NO: 854294 - RNA, 19 nt, Human
caguggguaauuucccaag

SEQ ID NO: 854295 - RNA, 21 nt, Human
cauuggcauuggacggagaag

SEQ ID NO: 854296 - RNA, 23 nt, Human
ccacgaaaggccgcccaggcacc

SEQ ID NO: 854297 - RNA, 21 nt, Human
ccaggcacccccggugacccc

SEQ ID NO: 854298 - RNA, 19 nt, Human
cccaaggauucuggggucc

SEQ ID NO: 854299 - RNA, 20 nt, Human
cccacgaaaggccgcccagg

SEQ ID NO: 854300 - RNA, 22 nt, Human
cccccggugaccccauggaagu

SEQ ID NO: 854301 - RNA, 21 nt, Human
ccgagaugguagaucccccuc

SEQ ID NO: 854302 - RNA, 21 nt, Human
ccgagugaguagcggcugcgg

SEQ ID NO: 854303 - RNA, 23 nt, Human
ccgcccaggcacccccggugacc

SEQ ID NO: 854304 - RNA, 21 nt, Human
ccgugugccaccccaauuccu

SEQ ID NO: 854305 - RNA, 19 nt, Human
cggccggagccggcggcgg

SEQ ID NO: 854306 - RNA, 21 nt, Human
cggccggagccggcggcgggu

SEQ ID NO: 854307 - RNA, 22 nt, Human
cggcugcgggccuggcuucggu

SEQ ID NO: 854308 - RNA, 23 nt, Human
cucauuuccacgcacccuccacc

SEQ ID NO: 854309 - RNA, 21 nt, Human
gagaugguagaucccccucca

SEQ ID NO: 854310 - RNA, 22 nt, Human
gaguagcggcugcgggccuggc

SEQ ID NO: 854311 - RNA, 21 nt, Human
gcccaggcacccccggugacc

SEQ ID NO: 854312 - RNA, 20 nt, Human
ggccggagccggcggcgggu

SEQ ID NO: 854313 - RNA, 18 nt, Human
ggguucacggggcuccug

SEQ ID NO: 854314 - RNA, 24 nt, Human
gguaaaaagcuuucucauuuccac

SEQ ID NO: 854315 - RNA, 20 nt, Human
gguggucuggguucacgggg

SEQ ID NO: 854316 - RNA, 20 nt, Human
ggugucccgugugccacccc

SEQ ID NO: 854317 - RNA, 18 nt, Human
guagaucccccuccaggc

SEQ ID NO: 854318 - RNA, 19 nt, Human
guagaucccccuccaggcg

SEQ ID NO: 854319 - RNA, 19 nt, Human
guagaucccccuccaggcg

SEQ ID NO: 854320 - RNA, 30 nt, Human
gucccugucauugccucaggguuuccaacu

SEQ ID NO: 854321 - RNA, 20 nt, Human
gugcaugcccacgaaaggcc

SEQ ID NO: 854322 - RNA, 27 nt, Human
uaaaaagcuuucucauuuccacgcacc

SEQ ID NO: 854323 - RNA, 19 nt, Human
uauccuuucaaagucacca

SEQ ID NO: 854324 - RNA, 26 nt, Human
uauggaaugaagcucuauccuuucaa

SEQ ID NO: 854325 - RNA, 20 nt, Human
ucaccagguucggguuccca

SEQ ID NO: 854326 - RNA, 21 nt, Human
ucgguuacggcuucgguccca

SEQ ID NO: 854327 - RNA, 18 nt, Human
ugaaggcauuggcauugg

SEQ ID NO: 854328 - RNA, 21 nt, Human
ugcucuggcuucgaagugcuu

SEQ ID NO: 854329 - RNA, 19 nt, Human
uggguagaaacaaugcaug

SEQ ID NO: 854330 - RNA, 18 nt, Human
uuaggguguggaagaucc

SEQ ID NO: 854331 - RNA, 18 nt, Human
uuccugaguucugaagaa

SEQ ID NO: 854332 - RNA, 22 nt, Human
uuuuugggguaaaaagcuuucu

SEQ ID NO: 854333 - RNA, 18 nt, Human
uuuuuuuuuuuuuuuuug

SEQ ID NO: 854334 - RNA, 24 nt, Human
aaaacaaacaaaacgacagcacaa

SEQ ID NO: 854335 - RNA, 20 nt, Human
aaacaaaacgacagcacaaa

SEQ ID NO: 854336 - RNA, 20 nt, Human
aaauguaacauccuuaacua

SEQ ID NO: 854337 - RNA, 23 nt, Human
aaauuuccucaguagcccuaccu

SEQ ID NO: 854338 - RNA, 22 nt, Human
aacauguccauauugcacagaa

SEQ ID NO: 854339 - RNA, 25 nt, Human
aagcaaauauugaugauuuagaaau

SEQ ID NO: 854340 - RNA, 18 nt, Human
aaggagcccgagccggau

SEQ ID NO: 854341 - RNA, 23 nt, Human
aaggagcccgagccggaugguuc

SEQ ID NO: 854342 - RNA, 22 nt, Human
acaaacaaaacgacagcacaag

SEQ ID NO: 854343 - RNA, 22 nt, Human
acacagaaagacacacuccaaa

SEQ ID NO: 854344 - RNA, 20 nt, Human
acacagucucaucuuaagaa

SEQ ID NO: 854345 - RNA, 24 nt, Human
acauccuuucaaaauguaacaucc

SEQ ID NO: 854346 - RNA, 25 nt, Human
agaaaaacaaacaaaacgacagcac

SEQ ID NO: 854347 - RNA, 27 nt, Human
agaaaaacaaacaaaacgacagcacaa

SEQ ID NO: 854348 - RNA, 21 nt, Human
agaaagacacacuccaaaagg

SEQ ID NO: 854349 - RNA, 19 nt, Human
agaaaugcaguagcacguu

SEQ ID NO: 854350 - RNA, 26 nt, Human
agaagcaaggaggggggauagggccg

SEQ ID NO: 854351 - RNA, 22 nt, Human
agaaugaacuucuugcugcaaa

SEQ ID NO: 854352 - RNA, 22 nt, Human
agcaaaagugcuuugucucccc

SEQ ID NO: 854353 - RNA, 21 nt, Human
agcagcucccucugggagaaa

SEQ ID NO: 854354 - RNA, 20 nt, Human
agcugcucuagagaaaaugu

SEQ ID NO: 854355 - RNA, 22 nt, Human
agcugcucuagagaaaaugugg

SEQ ID NO: 854356 - RNA, 23 nt, Human
aggaagacaauucuccaaagccu

SEQ ID NO: 854357 - RNA, 20 nt, Human
aggaggggggauagggcugu

SEQ ID NO: 854358 - RNA, 22 nt, Human
agggggcucggggacccagagc

SEQ ID NO: 854359 - RNA, 22 nt, Human
aguagcccugucuccuccgccc

SEQ ID NO: 854360 - RNA, 21 nt, Human
caaaagugcuuugucucccca

SEQ ID NO: 854361 - RNA, 21 nt, Human
caagaagggccagcugcucua

SEQ ID NO: 854362 - RNA, 21 nt, Human
caagcggccgcugcgggacca

SEQ ID NO: 854363 - RNA, 24 nt, Human
caagcuguccuuucaaugcucccc

SEQ ID NO: 854364 - RNA, 21 nt, Human
cacacagaaagacacacucca

SEQ ID NO: 854365 - RNA, 22 nt, Human
cacacuccuuccucuugcaccc

SEQ ID NO: 854366 - RNA, 21 nt, Human
cacagaaagacacacuccaaa

SEQ ID NO: 854367 - RNA, 21 nt, Human
cacuccuuccucuugcacccc

SEQ ID NO: 854368 - RNA, 21 nt, Human
cagaaagacacacuccaaaag

SEQ ID NO: 854369 - RNA, 19 nt, Human
cagaacgccggcaagcggc

SEQ ID NO: 854370 - RNA, 22 nt, Human
caggggagggggcucggggacc

SEQ ID NO: 854371 - RNA, 26 nt, Human
cagugcagccaugacugaccccuugg

SEQ ID NO: 854372 - RNA, 20 nt, Human
cagugucgggacucugacgc

SEQ ID NO: 854373 - RNA, 24 nt, Human
ccccauuucacagaagcaaggagg

SEQ ID NO: 854374 - RNA, 18 nt, Human
cccccagcucugcgccug

SEQ ID NO: 854375 - RNA, 20 nt, Human
cccccggcugcccccagcuc

SEQ ID NO: 854376 - RNA, 22 nt, Human
ccccuuagagcgggccagcagc

SEQ ID NO: 854377 - RNA, 18 nt, Human
cccggcugcccccagcuc

SEQ ID NO: 854378 - RNA, 26 nt, Human
cccggcugcccccagcucugcgccug

SEQ ID NO: 854379 - RNA, 20 nt, Human
cccucugggagaaaugaggc

SEQ ID NO: 854380 - RNA, 24 nt, Human
cccuuagcugugcauacccagagg

SEQ ID NO: 854381 - RNA, 18 nt, Human
ccgagcuuccccaguguc

SEQ ID NO: 854382 - RNA, 18 nt, Human
ccucagccacucgggccc

SEQ ID NO: 854383 - RNA, 26 nt, Human
ccuccgcccccuucccucuccucgcc

SEQ ID NO: 854384 - RNA, 21 nt, Human
ccucuaaaugcaggaaguaag

SEQ ID NO: 854385 - RNA, 18 nt, Human
ccugcaguagcccugucu

SEQ ID NO: 854386 - RNA, 23 nt, Human
ccugcaguagcccugucuccucc

SEQ ID NO: 854387 - RNA, 25 nt, Human
cgacagcacaaguagcagugcagcc

SEQ ID NO: 854388 - RNA, 26 nt, Human
cgacagcacaaguagcagugcagcca

SEQ ID NO: 854389 - RNA, 23 nt, Human
cgcuccgagcuuccccagugucg

SEQ ID NO: 854390 - RNA, 18 nt, Human
cgggaaggaggagggagu

SEQ ID NO: 854391 - RNA, 19 nt, Human
cgggcugggccaggggagg

SEQ ID NO: 854392 - RNA, 21 nt, Human
cgggcugggccaggggagggg

SEQ ID NO: 854393 - RNA, 19 nt, Human
cucgggcccccggcugccc

SEQ ID NO: 854394 - RNA, 22 nt, Human
cugggccaggggagggggcucg

SEQ ID NO: 854395 - RNA, 18 nt, Human
cuguagcaggugccccga

SEQ ID NO: 854396 - RNA, 22 nt, Human
cugucuccuccgcccccuuccc

SEQ ID NO: 854397 - RNA, 19 nt, Human
cuucagggcauguuuucua

SEQ ID NO: 854398 - RNA, 21 nt, Human
cuuuccuucuuguucacuggu

SEQ ID NO: 854399 - RNA, 19 nt, Human
gaaaaacaaacaaaacgac

SEQ ID NO: 854400 - RNA, 20 nt, Human
gaaggaggagggagucgggc

SEQ ID NO: 854401 - RNA, 20 nt, Human
gagcaaaagugcuuugucuc

SEQ ID NO: 854402 - RNA, 21 nt, Human
gcaaacauguccauauugcac

SEQ ID NO: 854403 - RNA, 21 nt, Human
gcaggaggcggcggcagcgga

SEQ ID NO: 854404 - RNA, 19 nt, Human
gccugcaguagcccugucu

SEQ ID NO: 854405 - RNA, 18 nt, Human
gcggcagcggaggcggcg

SEQ ID NO: 854406 - RNA, 23 nt, Human
gcggcggcagcggaggcggcgcu

SEQ ID NO: 854407 - RNA, 18 nt, Human
ggacccagagccaggcag

SEQ ID NO: 854408 - RNA, 18 nt, Human
ggaggagggagucgggcu

SEQ ID NO: 854409 - RNA, 25 nt, Human
gggaaggaggagggagucgggcugg

SEQ ID NO: 854410 - RNA, 23 nt, Human
gggcccccggcugcccccagcuc

SEQ ID NO: 854411 - RNA, 18 nt, Human
ggggacccagagccaggc

SEQ ID NO: 854412 - RNA, 18 nt, Human
ggggagggggcucgggga

SEQ ID NO: 854413 - RNA, 19 nt, Human
ggggcucggggacccagag

SEQ ID NO: 854414 - RNA, 20 nt, Human
gguauaauugaugcauuugu

SEQ ID NO: 854415 - RNA, 21 nt, Human
guagcagugcagccaugacug

SEQ ID NO: 854416 - RNA, 21 nt, Human
gugaggccacaggagccagaa

SEQ ID NO: 854417 - RNA, 25 nt, Human
uaaccuaagaacaacucucuucagg

SEQ ID NO: 854418 - RNA, 30 nt, Human
uaaccuaagaacaacucucuucagggcauu

SEQ ID NO: 854419 - RNA, 22 nt, Human
uaaguauaaugagaaaccacag

SEQ ID NO: 854420 - RNA, 21 nt, Human
uaaguguacaacaaccugacc

SEQ ID NO: 854421 - RNA, 23 nt, Human
uaaguguacaacaaccugacccu

SEQ ID NO: 854422 - RNA, 21 nt, Human
uaauauaucuaacauacaucc

SEQ ID NO: 854423 - RNA, 23 nt, Human
uacccagagggaacgaaacauuc

SEQ ID NO: 854424 - RNA, 21 nt, Human
uagcaggugccccgauuuagg

SEQ ID NO: 854425 - RNA, 23 nt, Human
uaggcaagaguccagagagaaca

SEQ ID NO: 854426 - RNA, 18 nt, Human
uagucuagagucuagggg

SEQ ID NO: 854427 - RNA, 25 nt, Human
uaucauagaaaaacaaacaaaacga

SEQ ID NO: 854428 - RNA, 26 nt, Human
uaucauagaaaaacaaacaaaacgac

SEQ ID NO: 854429 - RNA, 20 nt, Human
uauccaaaagugcuuuggag

SEQ ID NO: 854430 - RNA, 25 nt, Human
uaucuuaucuuuccuccugaguauc

SEQ ID NO: 854431 - RNA, 24 nt, Human
ucccccagcuggucugggcacacu

SEQ ID NO: 854432 - RNA, 23 nt, Human
ucgggaaggaggagggagucggg

SEQ ID NO: 854433 - RNA, 24 nt, Human
ucuaccuaacuggaaaauggagau

SEQ ID NO: 854434 - RNA, 20 nt, Human
ugagaaaccacagaaugugg

SEQ ID NO: 854435 - RNA, 24 nt, Human
ugaguauccaaaagugcuuuggag

SEQ ID NO: 854436 - RNA, 21 nt, Human
ugaugcauuuguggauguucc

SEQ ID NO: 854437 - RNA, 21 nt, Human
ugcaguagcccugucuccucc

SEQ ID NO: 854438 - RNA, 21 nt, Human
ugcauuuguggauguuccauu

SEQ ID NO: 854439 - RNA, 24 nt, Human
ugccccgauuuaggaagacaauuc

SEQ ID NO: 854440 - RNA, 19 nt, Human
ugcuuugucuccccauuuc

SEQ ID NO: 854441 - RNA, 20 nt, Human
uggagauaaaaaaaaaaaaa

SEQ ID NO: 854442 - RNA, 25 nt, Human
uguaucuuaucuuuccuccugagua

SEQ ID NO: 854443 - RNA, 22 nt, Human
uguggcaguaccaggguaaaug

SEQ ID NO: 854444 - RNA, 24 nt, Human
uuaaaacacacagaaagacacacu

SEQ ID NO: 854445 - RNA, 24 nt, Human
uucacagaagcaaggaggggggau

SEQ ID NO: 854446 - RNA, 23 nt, Human
uucccucuccucgccuagcaguc

SEQ ID NO: 854447 - RNA, 24 nt, Human
uuuacacagucucaucuuaagaac

SEQ ID NO: 854448 - RNA, 18 nt, Human
uuuagaaaugcaguagca

SEQ ID NO: 854449 - RNA, 19 nt, Human
uuuuuuuuuuuuuuuuuug

SEQ ID NO: 854450 - RNA, 20 nt, Human
uuuuuuuuuuuuuuuuuugg

SEQ ID NO: 854451 - RNA, 24 nt, Human
aaaugcaccacuuuauuuuccuua

SEQ ID NO: 854452 - RNA, 21 nt, Human
aagccuucuccccagccacaa

SEQ ID NO: 854453 - RNA, 23 nt, Human
acaggcccgagagccaugguggg

SEQ ID NO: 854454 - RNA, 21 nt, Human
acaggcuuguuggcagugggu

SEQ ID NO: 854455 - RNA, 23 nt, Human
agcccccaggcuuccacuccacg

SEQ ID NO: 854456 - RNA, 23 nt, Human
agcuaggcuucuggcggaacuug

SEQ ID NO: 854457 - RNA, 23 nt, Human
aggccggagccggcgcggccaga

SEQ ID NO: 854458 - RNA, 19 nt, Human
aggccggggucccggcggc

SEQ ID NO: 854459 - RNA, 23 nt, Human
cacuucucucuguaggccgggag

SEQ ID NO: 854460 - RNA, 18 nt, Human
cagaggaguccugagauu

SEQ ID NO: 854461 - RNA, 24 nt, Human
cagcagcagcuccuggcccuuggu

SEQ ID NO: 854462 - RNA, 21 nt, Human
cagcccgggcgcggccggcga

SEQ ID NO: 854463 - RNA, 21 nt, Human
cagcuuccucuugcucacaga

SEQ ID NO: 854464 - RNA, 19 nt, Human
caucuccccucuggcccug

SEQ ID NO: 854465 - RNA, 22 nt, Human
caucuccccucuggcccugccc

SEQ ID NO: 854466 - RNA, 18 nt, Human
ccagcccgggcgcggccg

SEQ ID NO: 854467 - RNA, 23 nt, Human
ccagcuggagccucucuucuucc

SEQ ID NO: 854468 - RNA, 20 nt, Human
cccccaggcuuccacuccac

SEQ ID NO: 854469 - RNA, 27 nt, Human
cccccaggcuuccacuccacgggaguc

SEQ ID NO: 854470 - RNA, 24 nt, Human
ccccggaggccggagccggcgcgg

SEQ ID NO: 854471 - RNA, 22 nt, Human
ccccucuggcccugcccaggga

SEQ ID NO: 854472 - RNA, 21 nt, Human
cccgaguggucugcagcuucc

SEQ ID NO: 854473 - RNA, 18 nt, Human
cccggcccccccggaggc

SEQ ID NO: 854474 - RNA, 19 nt, Human
cccucuggcccugcccagg

SEQ ID NO: 854475 - RNA, 21 nt, Human
cccucugugggacacacaggc

SEQ ID NO: 854476 - RNA, 20 nt, Human
cccugcccagggaccuggug

SEQ ID NO: 854477 - RNA, 19 nt, Human
ccggcccccgcggccuccg

SEQ ID NO: 854478 - RNA, 24 nt, Human
ccuccuggacuagcuccagcccca

SEQ ID NO: 854479 - RNA, 18 nt, Human
ccucugcaacgccugguu

SEQ ID NO: 854480 - RNA, 22 nt, Human
ccucuugcucacaggccggggg

SEQ ID NO: 854481 - RNA, 26 nt, Human
ccuggacuagcuccagccccaggaac

SEQ ID NO: 854482 - RNA, 18 nt, Human
ccugggucgcaggcaagu

SEQ ID NO: 854483 - RNA, 18 nt, Human
cgcggccagaggccgggg

SEQ ID NO: 854484 - RNA, 19 nt, Human
cgcuccggcccccgcggcc

SEQ ID NO: 854485 - RNA, 23 nt, Human
cggcccggggccugguccgaccc

SEQ ID NO: 854486 - RNA, 26 nt, Human
cggcggcggggaaggggugcgacugg

SEQ ID NO: 854487 - RNA, 25 nt, Human
cgugcacacggcacgcgaauucaug

SEQ ID NO: 854488 - RNA, 23 nt, Human
cuaaggaaggcgacaucuucacu

SEQ ID NO: 854489 - RNA, 20 nt, Human
cuagcuccagccccaggaac

SEQ ID NO: 854490 - RNA, 22 nt, Human
cucccagccuggcugcagcccg

SEQ ID NO: 854491 - RNA, 20 nt, Human
cuccggcgcgaccgcucucc

SEQ ID NO: 854492 - RNA, 23 nt, Human
cugcaacgccugguucauggacu

SEQ ID NO: 854493 - RNA, 19 nt, Human
cugcacccccuuggcgaag

SEQ ID NO: 854494 - RNA, 22 nt, Human
cugcagcccggggccuuuguga

SEQ ID NO: 854495 - RNA, 20 nt, Human
gacuggcaccaugucccggc

SEQ ID NO: 854496 - RNA, 22 nt, Human
gacugggguggguggcccgcag

SEQ ID NO: 854497 - RNA, 18 nt, Human
gagcccccaggcuuccac

SEQ ID NO: 854498 - RNA, 21 nt, Human
gaggccggggucccggcggcg

SEQ ID NO: 854499 - RNA, 24 nt, Human
gccagaaucagggacucagaagcu

SEQ ID NO: 854500 - RNA, 25 nt, Human
gcccagggaccugguguguggcagc

SEQ ID NO: 854501 - RNA, 18 nt, Human
gcccaguccugaguuggg

SEQ ID NO: 854502 - RNA, 21 nt, Human
gcgcggccagaggccgggguc

SEQ ID NO: 854503 - RNA, 24 nt, Human
gcggcggggaaggggugcgacugg

SEQ ID NO: 854504 - RNA, 21 nt, Human
gcuccuggcccuuggucaugu

SEQ ID NO: 854505 - RNA, 21 nt, Human
ggccagaggccggggucccgg

SEQ ID NO: 854506 - RNA, 23 nt, Human
ggguggcccgaguggucugcagc

SEQ ID NO: 854507 - RNA, 22 nt, Human
uaccugggucgcaggcaaguua

SEQ ID NO: 854508 - RNA, 19 nt, Human
uagcuccagccccaggaac

SEQ ID NO: 854509 - RNA, 27 nt, Human
uagcuccagccccaggaacuacggccu

SEQ ID NO: 854510 - RNA, 31 nt, Human
uagucaagccuucuccccagccacaaguucu

SEQ ID NO: 854511 - RNA, 20 nt, Human
ucaaaaugcaccacuuuauu

SEQ ID NO: 854512 - RNA, 20 nt, Human
ucagccucacucccgguacc

SEQ ID NO: 854513 - RNA, 18 nt, Human
ucaggugugugcaagugg

SEQ ID NO: 854514 - RNA, 25 nt, Human
ucccagccuggcugcagcccggggc

SEQ ID NO: 854515 - RNA, 21 nt, Human
ucccgguaccugggucgcagg

SEQ ID NO: 854516 - RNA, 18 nt, Human
uccgugcacacggcacgc

SEQ ID NO: 854517 - RNA, 18 nt, Human
uccgugcacacggcacgc

SEQ ID NO: 854518 - RNA, 21 nt, Human
uccuggacuagcuccagcccc

SEQ ID NO: 854519 - RNA, 21 nt, Human
ucuggcccugcccagggaccu

SEQ ID NO: 854520 - RNA, 21 nt, Human
ucugggugaggguggcccgag

SEQ ID NO: 854521 - RNA, 19 nt, Human
ugaggggcacaggcccgag

SEQ ID NO: 854522 - RNA, 18 nt, Human
ugcccagggaccuggugu

SEQ ID NO: 854523 - RNA, 23 nt, Human
ugcgacuggcaccaugucccggg

SEQ ID NO: 854524 - RNA, 19 nt, Human
uggcccgcagccccggaag

SEQ ID NO: 854525 - RNA, 23 nt, Human
ugggagcuccuggacagaggagu

SEQ ID NO: 854526 - RNA, 20 nt, Human
ugggccacccaggagcccag

SEQ ID NO: 854527 - RNA, 21 nt, Human
ugggguggguggcccgcagcc

SEQ ID NO: 854528 - RNA, 19 nt, Human
ugucugucauuuucuucuc

SEQ ID NO: 854529 - RNA, 20 nt, Human
uguucaaaucgaggguguug

SEQ ID NO: 854530 - RNA, 22 nt, Human
uucuuugucgucguauguuugc

SEQ ID NO: 854531 - RNA, 18 nt, Human
uugagcacggccuccucc

SEQ ID NO: 854532 - RNA, 23 nt, Human
uugaugcuuggguuacugaacac

SEQ ID NO: 854533 - RNA, 24 nt, Human
uugaugcuuggguuacugaacaca

SEQ ID NO: 854534 - RNA, 20 nt, Human
uuguacugcacccccuuggc

SEQ ID NO: 854535 - RNA, 26 nt, Human
uuuuuauucaaaaugcaccacuuuau

SEQ ID NO: 854536 - RNA, 24 nt, Human
uuuuuuuuuuuuuuuuucacauuu

SEQ ID NO: 854537 - RNA, 27 nt, Human
uuuuuuuuuuuuuuuuuucacauuuaa

SEQ ID NO: 854538 - RNA, 21 nt, Human
aacccccaaaucagugcuccu

SEQ ID NO: 854539 - RNA, 21 nt, Human
aagaguccuucuuuccaggug

SEQ ID NO: 854540 - RNA, 21 nt, Human
aagugacgcccagagaagggg

SEQ ID NO: 854541 - RNA, 21 nt, Human
acacagaaucuggccccccuu

SEQ ID NO: 854542 - RNA, 25 nt, Human
acacagaaucuggccccccuuugca

SEQ ID NO: 854543 - RNA, 20 nt, Human
acccucaaaacccccaaauc

SEQ ID NO: 854544 - RNA, 19 nt, Human
acuaggcuucuaaacuaaa

SEQ ID NO: 854545 - RNA, 21 nt, Human
acuccaggcucaggucuccca

SEQ ID NO: 854546 - RNA, 18 nt, Human
acuguacagaugaggaaa

SEQ ID NO: 854547 - RNA, 24 nt, Human
agaaacacacagaaucuggccccc

SEQ ID NO: 854548 - RNA, 19 nt, Human
agacacagagucucugacc

SEQ ID NO: 854549 - RNA, 26 nt, Human
agagaaacacacagaaucuggccccc

SEQ ID NO: 854550 - RNA, 21 nt, Human
agcuagaagcugaacuggguc

SEQ ID NO: 854551 - RNA, 20 nt, Human
aggaaugagagggcucauca

SEQ ID NO: 854552 - RNA, 19 nt, Human
aggaguggggagagugagg

SEQ ID NO: 854553 - RNA, 21 nt, Human
aggcagggccucaugggucug

SEQ ID NO: 854554 - RNA, 21 nt, Human
aggccuccgggccggcgaccc

SEQ ID NO: 854555 - RNA, 23 nt, Human
agggacuugggccucucacuggc

SEQ ID NO: 854556 - RNA, 18 nt, Human
agggagugggggucauag

SEQ ID NO: 854557 - RNA, 19 nt, Human
agggagugggggucaugag

SEQ ID NO: 854558 - RNA, 18 nt, Human
auagaaaccaucuuccuu

SEQ ID NO: 854559 - RNA, 21 nt, Human
auagaugccccggggcucaga

SEQ ID NO: 854560 - RNA, 19 nt, Human
aucuggaccuccuguagag

SEQ ID NO: 854561 - RNA, 21 nt, Human
caaaacccccaaaucagugcu

SEQ ID NO: 854562 - RNA, 23 nt, Human
caaaacccccaaaucagugcucc

SEQ ID NO: 854563 - RNA, 20 nt, Human
caccgcugcccgcgcgccca

SEQ ID NO: 854564 - RNA, 23 nt, Human
cagacuccaggcucaggucuccc

SEQ ID NO: 854565 - RNA, 22 nt, Human
cagaggccaugaagggggagcc

SEQ ID NO: 854566 - RNA, 23 nt, Human
caggcucaggucucccagcugcu

SEQ ID NO: 854567 - RNA, 23 nt, Human
cagggaccaccugagucagacac

SEQ ID NO: 854568 - RNA, 20 nt, Human
caggucccagacgagaccag

SEQ ID NO: 854569 - RNA, 21 nt, Human
caggucccagacgagaccagg

SEQ ID NO: 854570 - RNA, 22 nt, Human
caucaggcuucccccauucccu

SEQ ID NO: 854571 - RNA, 20 nt, Human
ccaaccccuacuugacccuc

SEQ ID NO: 854572 - RNA, 21 nt, Human
ccaggcagggccucauggguc

SEQ ID NO: 854573 - RNA, 20 nt, Human
cccagagaaggggaacuguc

SEQ ID NO: 854574 - RNA, 21 nt, Human
cccccagacuccaggcucagg

SEQ ID NO: 854575 - RNA, 22 nt, Human
ccccucuucuaccuccgaaucc

SEQ ID NO: 854576 - RNA, 23 nt, Human
ccccucuucuaccuccgaauccu

SEQ ID NO: 854577 - RNA, 21 nt, Human
cccgcgcgcccaccaccuccg

SEQ ID NO: 854578 - RNA, 22 nt, Human
cccuucccagggcacucugcag

SEQ ID NO: 854579 - RNA, 20 nt, Human
ccgagcuacgcccgcucucc

SEQ ID NO: 854580 - RNA, 24 nt, Human
ccgcugcccgcgcgcccaccaccu

SEQ ID NO: 854581 - RNA, 19 nt, Human
ccggagcgcugggacuggc

SEQ ID NO: 854582 - RNA, 20 nt, Human
ccggagcgcugggacuggcg

SEQ ID NO: 854583 - RNA, 20 nt, Human
ccggcgcgggcccgccgcuc

SEQ ID NO: 854584 - RNA, 24 nt, Human
cgaauuaccccuuuugcauacaug

SEQ ID NO: 854585 - RNA, 23 nt, Human
cgcgcgcccaccaccuccggagc

SEQ ID NO: 854586 - RNA, 22 nt, Human
cucagagggacccaggcgacca

SEQ ID NO: 854587 - RNA, 22 nt, Human
cuggauccagagaagccacugu

SEQ ID NO: 854588 - RNA, 23 nt, Human
cuggccccccuuugguccccugg

SEQ ID NO: 854589 - RNA, 18 nt, Human
gaaaggaggaaugagagg

SEQ ID NO: 854590 - RNA, 22 nt, Human
gacauggagggggcacuuugug

SEQ ID NO: 854591 - RNA, 22 nt, Human
gaccaccugagucagacacaga

SEQ ID NO: 854592 - RNA, 24 nt, Human
gaccaggcagggccucaugggucu

SEQ ID NO: 854593 - RNA, 21 nt, Human
gagcgcugggacuggcgucuc

SEQ ID NO: 854594 - RNA, 23 nt, Human
gaggggggucuuuggaagcagag

SEQ ID NO: 854595 - RNA, 18 nt, Human
gaggguggugaaucugga

SEQ ID NO: 854596 - RNA, 18 nt, Human
gccauagcugggcaagga

SEQ ID NO: 854597 - RNA, 22 nt, Human
gcgcgcccaccaccuccggagc

SEQ ID NO: 854598 - RNA, 22 nt, Human
ggacuugggccucucacuggca

SEQ ID NO: 854599 - RNA, 20 nt, Human
ggaguggggagagugagggg

SEQ ID NO: 854600 - RNA, 24 nt, Human
gggagucaccaucgucauaauaaa

SEQ ID NO: 854601 - RNA, 23 nt, Human
gggcacuuugugaaugagagggg

SEQ ID NO: 854602 - RNA, 21 nt, Human
gggccauagcugggcaaggaa

SEQ ID NO: 854603 - RNA, 21 nt, Human
gggucuuuggaagcagagaaa

SEQ ID NO: 854604 - RNA, 19 nt, Human
gugaaucuggaccuccugu

SEQ ID NO: 854605 - RNA, 22 nt, Human
gugcagaggccaugaaggggga

SEQ ID NO: 854606 - RNA, 19 nt, Human
guggugggggagccuuuuc

SEQ ID NO: 854607 - RNA, 20 nt, Human
guguggaggugcagaggcca

SEQ ID NO: 854608 - RNA, 22 nt, Human
guuccaggcccccagacuccag

SEQ ID NO: 854609 - RNA, 20 nt, Human
uaaaacggggaaauucaaac

SEQ ID NO: 854610 - RNA, 29 nt, Human
uacaguaauuuuaaaaaagaaaaaaaaaa

SEQ ID NO: 854611 - RNA, 19 nt, Human
uacuugacccucaaaaccc

SEQ ID NO: 854612 - RNA, 18 nt, Human
uagaaaccaucuuccuuc

SEQ ID NO: 854613 - RNA, 18 nt, Human
ucaggaaugagagggaga

SEQ ID NO: 854614 - RNA, 21 nt, Human
uccagagaagccacugucccc

SEQ ID NO: 854615 - RNA, 21 nt, Human
ucccagcugcugucccagguc

SEQ ID NO: 854616 - RNA, 21 nt, Human
ucccaggucccagacgagacc

SEQ ID NO: 854617 - RNA, 23 nt, Human
ucccucucacagggagugggggu

SEQ ID NO: 854618 - RNA, 22 nt, Human
uccgaauccuccauaauugucc

SEQ ID NO: 854619 - RNA, 22 nt, Human
uccgccgaggagcaggccuccg

SEQ ID NO: 854620 - RNA, 18 nt, Human
ucggugguggugggggag

SEQ ID NO: 854621 - RNA, 18 nt, Human
ucucccagcugcuguccc

SEQ ID NO: 854622 - RNA, 24 nt, Human
ucucccagcugcugucccaggucc

SEQ ID NO: 854623 - RNA, 19 nt, Human
ucuccuagggacuugggcc

SEQ ID NO: 854624 - RNA, 20 nt, Human
ugagagggggccauagcugg

SEQ ID NO: 854625 - RNA, 21 nt, Human
ugagagggggccauagcugga

SEQ ID NO: 854626 - RNA, 22 nt, Human
ugagagggggccauagcugggc

SEQ ID NO: 854627 - RNA, 23 nt, Human
ugagagggggccauagcugggcc

SEQ ID NO: 854628 - RNA, 23 nt, Human
ugagauagaaaccaucuuccuuc

SEQ ID NO: 854629 - RNA, 21 nt, Human
ugaggaaagugacgcccagag

SEQ ID NO: 854630 - RNA, 25 nt, Human
ugcauacauggacacuuacuguaca

SEQ ID NO: 854631 - RNA, 19 nt, Human
ugcccaagggcuuccaagc

SEQ ID NO: 854632 - RNA, 23 nt, Human
uggaacagcugagggucaucagg

SEQ ID NO: 854633 - RNA, 21 nt, Human
uuccucucggugguggugggg

SEQ ID NO: 854634 - RNA, 19 nt, Human
uuggaagguagauguggaa

SEQ ID NO: 854635 - RNA, 21 nt, Human
uugggaguguggaggugcaga

SEQ ID NO: 854636 - RNA, 24 nt, Human
aaacacaggaggaauggacgagcc

SEQ ID NO: 854637 - RNA, 20 nt, Human
aaagaaaccccuagacaaaa

SEQ ID NO: 854638 - RNA, 22 nt, Human
aagagaccucucggcuccggcu

SEQ ID NO: 854639 - RNA, 24 nt, Human
aaucauucaaaaugcaaacuguaa

SEQ ID NO: 854640 - RNA, 24 nt, Human
agacaaaaauuuaaaaaccacagu

SEQ ID NO: 854641 - RNA, 22 nt, Human
agagugugggggggagcaacag

SEQ ID NO: 854642 - RNA, 21 nt, Human
aggaagcauagaagcucuuua

SEQ ID NO: 854643 - RNA, 22 nt, Human
agugugggggggagcaacagag

SEQ ID NO: 854644 - RNA, 22 nt, Human
aucacaaacuucagucccaugg

SEQ ID NO: 854645 - RNA, 21 nt, Human
auggucacaaagcuagagugg

SEQ ID NO: 854646 - RNA, 23 nt, Human
auuacauuuggaccacagugauu

SEQ ID NO: 854647 - RNA, 22 nt, Human
cacaaugaaugucuaccauuuc

SEQ ID NO: 854648 - RNA, 27 nt, Human
cagacugaacaggugacagacugagca

SEQ ID NO: 854649 - RNA, 23 nt, Human
cagcagaugcuguucuaaaaucc

SEQ ID NO: 854650 - RNA, 23 nt, Human
cauuuaggaaaccucugggccaa

SEQ ID NO: 854651 - RNA, 22 nt, Human
cgggggcccaggacaggcccgg

SEQ ID NO: 854652 - RNA, 22 nt, Human
cuccaccaccucccgcggcgcc

SEQ ID NO: 854653 - RNA, 25 nt, Human
cuccggcuaggccuccaccaccucc

SEQ ID NO: 854654 - RNA, 21 nt, Human
cuccguucacgucccuccuca

SEQ ID NO: 854655 - RNA, 26 nt, Human
cucucggcuccggcuaggccuccacc

SEQ ID NO: 854656 - RNA, 19 nt, Human
cuggagagacuccacggua

SEQ ID NO: 854657 - RNA, 19 nt, Human
gacaacagcaaaaggguaa

SEQ ID NO: 854658 - RNA, 19 nt, Human
gcaaacuguaaacacgaca

SEQ ID NO: 854659 - RNA, 21 nt, Human
gcacagaccgggggcccagga

SEQ ID NO: 854660 - RNA, 23 nt, Human
ggcccgggccgggcgcugcggcg

SEQ ID NO: 854661 - RNA, 23 nt, Human
gggagcaacagagaauguaagac

SEQ ID NO: 854662 - RNA, 19 nt, Human
gggcccaggacaggcccgg

SEQ ID NO: 854663 - RNA, 18 nt, Human
ggggacugggcgccggag

SEQ ID NO: 854664 - RNA, 18 nt, Human
ggucccuggguacaucau

SEQ ID NO: 854665 - RNA, 24 nt, Human
guagcauuaacacgggguuugcug

SEQ ID NO: 854666 - RNA, 25 nt, Human
uaaaaaagccaucacaaacuucagu

SEQ ID NO: 854667 - RNA, 23 nt, Human
uaaaauccccaaagaaaccccua

SEQ ID NO: 854668 - RNA, 20 nt, Human
uaagaugcaaagaaauuuuc

SEQ ID NO: 854669 - RNA, 20 nt, Human
uacaucauauauugucuuuc

SEQ ID NO: 854670 - RNA, 18 nt, Human
uaggccuccaccaccucc

SEQ ID NO: 854671 - RNA, 20 nt, Human
uauguguauguauguguggc

SEQ ID NO: 854672 - RNA, 22 nt, Human
ucauucaaaaugcaaacuguaa

SEQ ID NO: 854673 - RNA, 18 nt, Human
uccacgguagcucuagaa

SEQ ID NO: 854674 - RNA, 18 nt, Human
ucccauggucacaaagcu

SEQ ID NO: 854675 - RNA, 19 nt, Human
uccccaaagaaaccccuag

SEQ ID NO: 854676 - RNA, 24 nt, Human
uccccaaagaaaccccuagacaaa

SEQ ID NO: 854677 - RNA, 26 nt, Human
uccccaaagaaaccccuagacaaaaa

SEQ ID NO: 854678 - RNA, 24 nt, Human
ucuaaaauccccaaagaaaccccc

SEQ ID NO: 854679 - RNA, 21 nt, Human
ucuggucccuggguacaucau

SEQ ID NO: 854680 - RNA, 18 nt, Human
ugaaugucuaccauuucu

SEQ ID NO: 854681 - RNA, 20 nt, Human
ugacagacugagcaagagug

SEQ ID NO: 854682 - RNA, 21 nt, Human
ugagcaagaguguggggggga

SEQ ID NO: 854683 - RNA, 21 nt, Human
ugcggcccgggccgggcgcug

SEQ ID NO: 854684 - RNA, 24 nt, Human
ugcuguucuaaaauccccaaagaa

SEQ ID NO: 854685 - RNA, 22 nt, Human
ugggccaaauacuaaaacacag

SEQ ID NO: 854686 - RNA, 20 nt, Human
uguauguguggcucugggga

SEQ ID NO: 854687 - RNA, 21 nt, Human
ugucuaccauuucuaagaugc

SEQ ID NO: 854688 - RNA, 23 nt, Human
uguggcucuggggaucuggacac

SEQ ID NO: 854689 - RNA, 18 nt, Human
ugugggggggagcaacag

SEQ ID NO: 854690 - RNA, 20 nt, Human
uguguaagaauuacauuugg

SEQ ID NO: 854691 - RNA, 18 nt, Human
uguguauguguauguaug

SEQ ID NO: 854692 - RNA, 19 nt, Human
uguguauguguauguaugu

SEQ ID NO: 854693 - RNA, 20 nt, Human
uguguauguguauguaugug

SEQ ID NO: 854694 - RNA, 23 nt, Human
uucgccaagguugaccaccucca

SEQ ID NO: 854695 - RNA, 23 nt, Human
uuuagaauuaaaaaaauauuuau

SEQ ID NO: 854696 - RNA, 26 nt, Human
uuucuuaugggcaccucaacaggaau

SEQ ID NO: 854697 - RNA, 22 nt, Human
uuugcuggaaugccccucccua

SEQ ID NO: 854698 - RNA, 21 nt, Human
aaaacuugugaaauuucuaga

SEQ ID NO: 854699 - RNA, 24 nt, Human
aaacacacccaaagcccagugugc

SEQ ID NO: 854700 - RNA, 22 nt, Human
aaagcccagugugcucuacccc

SEQ ID NO: 854701 - RNA, 18 nt, Human
aaccuuggcuaacuucag

SEQ ID NO: 854702 - RNA, 19 nt, Human
aagaggaauccccccucaa

SEQ ID NO: 854703 - RNA, 18 nt, Human
aaggaaagggagaagcag

SEQ ID NO: 854704 - RNA, 18 nt, Human
aaggaaagggagaagcag

SEQ ID NO: 854705 - RNA, 20 nt, Human
aaggaaagggagaagcaggg

SEQ ID NO: 854706 - RNA, 24 nt, Human
acccaaagcccagugugcucuacc

SEQ ID NO: 854707 - RNA, 18 nt, Human
accggguccugggcgggu

SEQ ID NO: 854708 - RNA, 22 nt, Human
acuucugguuggcagcagcugc

SEQ ID NO: 854709 - RNA, 23 nt, Human
agaagcaggggagguucggggac

SEQ ID NO: 854710 - RNA, 23 nt, Human
agaaggaaagggagaagcagggg

SEQ ID NO: 854711 - RNA, 19 nt, Human
agacacgcgaacauguucc

SEQ ID NO: 854712 - RNA, 22 nt, Human
aggaaauaaauauuuccccaaa

SEQ ID NO: 854713 - RNA, 27 nt, Human
aggaaauaaauauuuccccaaagagga

SEQ ID NO: 854714 - RNA, 23 nt, Human
aggaauccccccucaauuacuuu

SEQ ID NO: 854715 - RNA, 22 nt, Human
aggcagugguuucuaccguccu

SEQ ID NO: 854716 - RNA, 25 nt, Human
aggcagugguuucuaccguccuuuc

SEQ ID NO: 854717 - RNA, 19 nt, Human
agggagaagcaggggaggu

SEQ ID NO: 854718 - RNA, 24 nt, Human
agggagaagcaggggagguucggg

SEQ ID NO: 854719 - RNA, 18 nt, Human
auaacacaaaagcaaccu

SEQ ID NO: 854720 - RNA, 27 nt, Human
augcaggaaauaaauauuuccccaaag

SEQ ID NO: 854721 - RNA, 24 nt, Human
auuuaucgagaagcauucggugcc

SEQ ID NO: 854722 - RNA, 18 nt, Human
caaaagcaaccuuggcua

SEQ ID NO: 854723 - RNA, 28 nt, Human
cagaaggaaagggagaagcaggggaggu

SEQ ID NO: 854724 - RNA, 23 nt, Human
cagugugcucuaccccaaaacuu

SEQ ID NO: 854725 - RNA, 21 nt, Human
cccaaagaggaauccccccuc

SEQ ID NO: 854726 - RNA, 19 nt, Human
cccaaagcccagugugcuc

SEQ ID NO: 854727 - RNA, 25 nt, Human
cccaaagcccagugugcucuacccc

SEQ ID NO: 854728 - RNA, 23 nt, Human
ccccaaaacuugugaaauuucua

SEQ ID NO: 854729 - RNA, 19 nt, Human
ccccgugccgugccgagcc

SEQ ID NO: 854730 - RNA, 24 nt, Human
ccgacggagaaauggacuccucuu

SEQ ID NO: 854731 - RNA, 20 nt, Human
ccggaacagaaggaaaggga

SEQ ID NO: 854732 - RNA, 20 nt, Human
cuuucagacuuaacaaauug

SEQ ID NO: 854733 - RNA, 22 nt, Human
gagaagcaggggagguucgggg

SEQ ID NO: 854734 - RNA, 18 nt, Human
gagcgauccucagccaga

SEQ ID NO: 854735 - RNA, 21 nt, Human
gcacacaggcgcagacacgcg

SEQ ID NO: 854736 - RNA, 21 nt, Human
uaacacaaaagcaaccuuggc

SEQ ID NO: 854737 - RNA, 24 nt, Human
uagauuuuuaccaacaggcaguuu

SEQ ID NO: 854738 - RNA, 21 nt, Human
ucagagaccauaaggggauuu

SEQ ID NO: 854739 - RNA, 19 nt, Human
ucagccagaaaacuggcug

SEQ ID NO: 854740 - RNA, 21 nt, Human
uccucagccagaaaacuggcu

SEQ ID NO: 854741 - RNA, 19 nt, Human
ucggggacgacggcgcucc

SEQ ID NO: 854742 - RNA, 21 nt, Human
ucuaauagauuuuuaccaaca

SEQ ID NO: 854743 - RNA, 21 nt, Human
ucuucucgcuccuguggaguu

SEQ ID NO: 854744 - RNA, 19 nt, Human
ugagaaacacacccaaagc

SEQ ID NO: 854745 - RNA, 22 nt, Human
ugagaaacacacccaaagccca

SEQ ID NO: 854746 - RNA, 19 nt, Human
ugaguguggcaccgggucc

SEQ ID NO: 854747 - RNA, 24 nt, Human
ugcaguacggugguuugcucuuga

SEQ ID NO: 854748 - RNA, 20 nt, Human
ugcucagagaccauaagggg

SEQ ID NO: 854749 - RNA, 25 nt, Human
uggcuaacuucaguaccuuauguaa

SEQ ID NO: 854750 - RNA, 20 nt, Human
uggcugcgcacacaggcgca

SEQ ID NO: 854751 - RNA, 24 nt, Human
uguuuuccucccuugcuuucuuua

SEQ ID NO: 854752 - RNA, 22 nt, Human
uucagacuuaacaaauuggagu

SEQ ID NO: 854753 - RNA, 23 nt, Human
uucuaccguccuuucucacugca

SEQ ID NO: 854754 - RNA, 23 nt, Human
uugcaguacggugguuugcucuu

SEQ ID NO: 854755 - RNA, 18 nt, Human
uugggcgcauguuuuccu

SEQ ID NO: 854756 - RNA, 26 nt, Human
uuucuagagucucaaaaaagugaaua

SEQ ID NO: 854757 - RNA, 18 nt, Human
uuuuuuuuuuuuaugggg

SEQ ID NO: 854758 - RNA, 30 nt, Human
uuuuuuuuuuuuuuuuuuuuuuuuaugggg

SEQ ID NO: 854759 - RNA, 23 nt, Human
agaggcugccuggaggaggcagc

SEQ ID NO: 854760 - RNA, 21 nt, Human
agaggucuaggggcccggggc

SEQ ID NO: 854761 - RNA, 19 nt, Human
aggucuaggggcccggggc

SEQ ID NO: 854762 - RNA, 25 nt, Human
caaccuccggaccccgccaagcccu

SEQ ID NO: 854763 - RNA, 21 nt, Human
cagcccgaggccacggucaca

SEQ ID NO: 854764 - RNA, 18 nt, Human
caggcgcgggcgcgggcc

SEQ ID NO: 854765 - RNA, 24 nt, Human
ccacggucacaggucccaacgucc

SEQ ID NO: 854766 - RNA, 20 nt, Human
cccgccaagcccugcggccg

SEQ ID NO: 854767 - RNA, 20 nt, Human
ccuccggaccccgccaagcc

SEQ ID NO: 854768 - RNA, 20 nt, Human
ccucgggggucgccgggcug

SEQ ID NO: 854769 - RNA, 21 nt, Human
ccugcggccgccucagggcca

SEQ ID NO: 854770 - RNA, 22 nt, Human
ccuguaaucuccgagcccagac

SEQ ID NO: 854771 - RNA, 18 nt, Human
cggcugcgggggcgaggu

SEQ ID NO: 854772 - RNA, 24 nt, Human
cgggccccagaggcugccuggagg

SEQ ID NO: 854773 - RNA, 23 nt, Human
cgggcgcgggccccagaggcugc

SEQ ID NO: 854774 - RNA, 23 nt, Human
cucagggccaugcgucccucgcu

SEQ ID NO: 854775 - RNA, 21 nt, Human
cugcggccggcuuuggaagcc

SEQ ID NO: 854776 - RNA, 25 nt, Human
gagccgcagagccagcuagggacac

SEQ ID NO: 854777 - RNA, 22 nt, Human
gaggaggcagccucgaaggccc

SEQ ID NO: 854778 - RNA, 18 nt, Human
gcccugcggccgccucag

SEQ ID NO: 854779 - RNA, 21 nt, Human
gcuuuggaagcccagcccgag

SEQ ID NO: 854780 - RNA, 18 nt, Human
ggggaugggcagccugaa

SEQ ID NO: 854781 - RNA, 19 nt, Human
ucaaccuccggaccccgcc

SEQ ID NO: 854782 - RNA, 19 nt, Human
uccgagcccagacccggaa

SEQ ID NO: 854783 - RNA, 18 nt, Human
ucuccgagcccagacccg

SEQ ID NO: 854784 - RNA, 19 nt, Human
ucuccgagcccagacccgg

SEQ ID NO: 854785 - RNA, 18 nt, Human
ugagcaggcgcgggcgcg

SEQ ID NO: 854786 - RNA, 26 nt, Human
ugccuggaggaggcagccucgaaggc

SEQ ID NO: 854787 - RNA, 23 nt, Human
ugcgggggcgaggucaaccuccg

SEQ ID NO: 854788 - RNA, 18 nt, Human
uuuuuuuuuuuuuuuuug

SEQ ID NO: 854789 - RNA, 24 nt, Human
uuuuuuuuuuuuuuuuugacaaug

SEQ ID NO: 854790 - RNA, 19 nt, Human
acaaugguguugcuuucuc

SEQ ID NO: 854791 - RNA, 23 nt, Human
agagugcucccauggcaccaccc

SEQ ID NO: 854792 - RNA, 24 nt, Human
agguauguccugggugggggcgcu

SEQ ID NO: 854793 - RNA, 21 nt, Human
cacagccuggagcucccucuu

SEQ ID NO: 854794 - RNA, 26 nt, Human
cacccgaacgcucacuaccugagagc

SEQ ID NO: 854795 - RNA, 20 nt, Human
cccauggcaccacccgaacg

SEQ ID NO: 854796 - RNA, 23 nt, Human
cccccgcccgcaccuuccugagc

SEQ ID NO: 854797 - RNA, 18 nt, Human
ccccgcccgcaccuuccu

SEQ ID NO: 854798 - RNA, 18 nt, Human
cccgaacgcucacuaccu

SEQ ID NO: 854799 - RNA, 21 nt, Human
cccgcaccuuccugagcgcug

SEQ ID NO: 854800 - RNA, 26 nt, Human
ccguccagaccgcgucucccgaucau

SEQ ID NO: 854801 - RNA, 20 nt, Human
ccucccagcccgcccggccg

SEQ ID NO: 854802 - RNA, 24 nt, Human
ccucccagcccgcccggccgggcg

SEQ ID NO: 854803 - RNA, 24 nt, Human
ccucccggcguccggccgaaaacc

SEQ ID NO: 854804 - RNA, 21 nt, Human
ccugagcgcugggcucugggc

SEQ ID NO: 854805 - RNA, 24 nt, Human
ccugagcgcugggcucugggcugg

SEQ ID NO: 854806 - RNA, 21 nt, Human
cgccugaaaaacaaugguguu

SEQ ID NO: 854807 - RNA, 23 nt, Human
cggcucggcucgggggcaaaugg

SEQ ID NO: 854808 - RNA, 18 nt, Human
cggcucgggggcaaaugg

SEQ ID NO: 854809 - RNA, 25 nt, Human
cguccagaccgcgucucccgaucau

SEQ ID NO: 854810 - RNA, 27 nt, Human
cguccucauccucccagcccgcccggc

SEQ ID NO: 854811 - RNA, 21 nt, Human
cuuggguggcuggguccuccu

SEQ ID NO: 854812 - RNA, 18 nt, Human
gacccuuggguggcuggg

SEQ ID NO: 854813 - RNA, 24 nt, Human
gagaugggcaggccaagcaggcca

SEQ ID NO: 854814 - RNA, 19 nt, Human
gagcaaggacaggagggag

SEQ ID NO: 854815 - RNA, 26 nt, Human
gcaccacccgaacgcucacuaccuga

SEQ ID NO: 854816 - RNA, 18 nt, Human
gcaccuuccugagcgcug

SEQ ID NO: 854817 - RNA, 22 nt, Human
gcccgcaccuuccugagcgcug

SEQ ID NO: 854818 - RNA, 18 nt, Human
gcggcgccgcggaggccg

SEQ ID NO: 854819 - RNA, 20 nt, Human
ggaaagccacggcucggcuc

SEQ ID NO: 854820 - RNA, 18 nt, Human
ggacaggagggaggugug

SEQ ID NO: 854821 - RNA, 23 nt, Human
ggcaaauggaggcgccugaaaaa

SEQ ID NO: 854822 - RNA, 19 nt, Human
ggccgaaaacccuccugug

SEQ ID NO: 854823 - RNA, 23 nt, Human
ggcggaaguccagggcagccguc

SEQ ID NO: 854824 - RNA, 21 nt, Human
ggggaagguauguccugggug

SEQ ID NO: 854825 - RNA, 20 nt, Human
gggggcagcaccagccaggg

SEQ ID NO: 854826 - RNA, 19 nt, Human
ucccauggcaccacccgaa

SEQ ID NO: 854827 - RNA, 21 nt, Human
uccgagaugggcaggccaagc

SEQ ID NO: 854828 - RNA, 23 nt, Human
uccgcaggcgcccggcuccuuuc

SEQ ID NO: 854829 - RNA, 18 nt, Human
ucucccccgcccgcaccu

SEQ ID NO: 854830 - RNA, 19 nt, Human
ucuccgcaggcgcccggcu

SEQ ID NO: 854831 - RNA, 24 nt, Human
ucuccgcaggcgcccggcuccuuu

SEQ ID NO: 854832 - RNA, 18 nt, Human
uggguggcuggguccucc

SEQ ID NO: 854833 - RNA, 24 nt, Human
uggguggcuggguccuccuggaga

SEQ ID NO: 854834 - RNA, 25 nt, Human
uguccugggugggggcgcugaucag

SEQ ID NO: 854835 - RNA, 21 nt, Human
uguggcggcggaaguccaggg

SEQ ID NO: 854836 - RNA, 21 nt, Human
uuuacaaauggagcucacagc

SEQ ID NO: 854837 - RNA, 18 nt, Human
uuuuuuuuuuuuucacuu

SEQ ID NO: 854838 - RNA, 19 nt, Human
uuuuuuuuuuuuucacuug

SEQ ID NO: 854839 - RNA, 22 nt, Human
uuuuuuuuuuuuuuuuucacuu

SEQ ID NO: 854840 - RNA, 27 nt, Human
uuuuuuuuuuuuuuuuuucacuugauu

SEQ ID NO: 854841 - RNA, 26 nt, Human
uuuuuuuuuuuuuuuuuuucacuugg

SEQ ID NO: 854842 - RNA, 24 nt, Human
aaauauccaaagcaugacaaaaaa

SEQ ID NO: 854843 - RNA, 24 nt, Human
aacaaacaaaauauauauacugaa

SEQ ID NO: 854844 - RNA, 20 nt, Human
aacauggugagaucccaucu

SEQ ID NO: 854845 - RNA, 21 nt, Human
aacauggugagaucccaucuc

SEQ ID NO: 854846 - RNA, 19 nt, Human
aacccuccugugugugccu

SEQ ID NO: 854847 - RNA, 27 nt, Human
aagauacagaaucagauguucagaaag

SEQ ID NO: 854848 - RNA, 24 nt, Human
acaaaaaagaauaggacaccuaaa

SEQ ID NO: 854849 - RNA, 27 nt, Human
acagcagcagcagugauugccgggcuc

SEQ ID NO: 854850 - RNA, 18 nt, Human
acccugguaaauauaagg

SEQ ID NO: 854851 - RNA, 24 nt, Human
accuaaauggauauaaacacacca

SEQ ID NO: 854852 - RNA, 21 nt, Human
acgccuauaaucccagcaccu

SEQ ID NO: 854853 - RNA, 23 nt, Human
acgccuauaaucccagcaccuug

SEQ ID NO: 854854 - RNA, 24 nt, Human
agacacaguggcuuacgccuauaa

SEQ ID NO: 854855 - RNA, 24 nt, Human
agaucccaucucuaaaacaaacaa

SEQ ID NO: 854856 - RNA, 24 nt, Human
agcaccuugggaggccaagguggg

SEQ ID NO: 854857 - RNA, 20 nt, Human
agcagcagcagugauugcag

SEQ ID NO: 854858 - RNA, 19 nt, Human
agccugggcaacaugguga

SEQ ID NO: 854859 - RNA, 21 nt, Human
agccugggcaacauggugaga

SEQ ID NO: 854860 - RNA, 21 nt, Human
agccugggcaacauggugaga

SEQ ID NO: 854861 - RNA, 24 nt, Human
agccugggcaacauggugagaucc

SEQ ID NO: 854862 - RNA, 21 nt, Human
agcuagguccucuacuccugg

SEQ ID NO: 854863 - RNA, 20 nt, Human
aggacucuucugccaggccu

SEQ ID NO: 854864 - RNA, 18 nt, Human
aggaguucaagacuagcc

SEQ ID NO: 854865 - RNA, 20 nt, Human
aggccaaggugggaggauca

SEQ ID NO: 854866 - RNA, 24 nt, Human
aggccagacacaguggcuuacgcc

SEQ ID NO: 854867 - RNA, 24 nt, Human
aguggcuuacgccuauaaucccag

SEQ ID NO: 854868 - RNA, 23 nt, Human
auaaauccuugaaauauccaaag

SEQ ID NO: 854869 - RNA, 22 nt, Human
auaaucauacacuaggccagac

SEQ ID NO: 854870 - RNA, 22 nt, Human
augacaaaaaagaauaggacac

SEQ ID NO: 854871 - RNA, 21 nt, Human
caaagugcugcaaauuugaua

SEQ ID NO: 854872 - RNA, 22 nt, Human
caacauggugagaucccaucuc

SEQ ID NO: 854873 - RNA, 24 nt, Human
caacauggugagaucccaucucua

SEQ ID NO: 854874 - RNA, 23 nt, Human
cagaggacucuucugccaggccu

SEQ ID NO: 854875 - RNA, 21 nt, Human
cagcaccuugggaggccaagg

SEQ ID NO: 854876 - RNA, 24 nt, Human
cagcaccuugggaggccaaggugg

SEQ ID NO: 854877 - RNA, 21 nt, Human
cagcagcagcagugauugcag

SEQ ID NO: 854878 - RNA, 22 nt, Human
caggaccagaacauugcgugac

SEQ ID NO: 854879 - RNA, 24 nt, Human
cauggugagaucccaucucuaaaa

SEQ ID NO: 854880 - RNA, 19 nt, Human
ccaaagcaugacaaaaaag

SEQ ID NO: 854881 - RNA, 22 nt, Human
ccagaacauugcgugacucaug

SEQ ID NO: 854882 - RNA, 19 nt, Human
ccagcaccuugggaggcca

SEQ ID NO: 854883 - RNA, 24 nt, Human
cccaucucuaaaacaaacaaaaua

SEQ ID NO: 854884 - RNA, 22 nt, Human
ccccagaggacucuucugccag

SEQ ID NO: 854885 - RNA, 18 nt, Human
cccuccccgccuggcacc

SEQ ID NO: 854886 - RNA, 22 nt, Human
ccuauaaucccagcaccuuggg

SEQ ID NO: 854887 - RNA, 21 nt, Human
ccuccccgccuggcacccugc

SEQ ID NO: 854888 - RNA, 18 nt, Human
ccucucgcccccuccccg

SEQ ID NO: 854889 - RNA, 19 nt, Human
ccucucgcccccuccccgc

SEQ ID NO: 854890 - RNA, 23 nt, Human
ccugcagagugcauucuuugccu

SEQ ID NO: 854891 - RNA, 24 nt, Human
ccugggcaacauggugagauccca

SEQ ID NO: 854892 - RNA, 23 nt, Human
cgagcccaggaguucaagacuag

SEQ ID NO: 854893 - RNA, 19 nt, Human
cgagguuuuuuuuuuuuuu

SEQ ID NO: 854894 - RNA, 21 nt, Human
cgagguuuuuuuuuuuuuuuu

SEQ ID NO: 854895 - RNA, 21 nt, Human
cgccuauaaucccagcaccuu

SEQ ID NO: 854896 - RNA, 23 nt, Human
cgccuauaaucccagcaccuugg

SEQ ID NO: 854897 - RNA, 23 nt, Human
cuaaauggauauaaacacaccaa

SEQ ID NO: 854898 - RNA, 24 nt, Human
cuaggccagacacaguggcuuacg

SEQ ID NO: 854899 - RNA, 25 nt, Human
cuggaacccuccugugugugccuaa

SEQ ID NO: 854900 - RNA, 24 nt, Human
cuggccacagcaguuugucugcag

SEQ ID NO: 854901 - RNA, 23 nt, Human
cuggccucagaggggcccacugg

SEQ ID NO: 854902 - RNA, 23 nt, Human
cuuacgccuauaaucccagcacc

SEQ ID NO: 854903 - RNA, 19 nt, Human
gaacauugcgugacucaug

SEQ ID NO: 854904 - RNA, 28 nt, Human
gaacuaguuucaagcaaacugaaacuaa

SEQ ID NO: 854905 - RNA, 24 nt, Human
gaucauucgagcccaggaguucaa

SEQ ID NO: 854906 - RNA, 22 nt, Human
gcccaggaguucaagacuagcc

SEQ ID NO: 854907 - RNA, 20 nt, Human
gccuggcacccugcggcguc

SEQ ID NO: 854908 - RNA, 24 nt, Human
uaaauauaagguuucucuuccaca

SEQ ID NO: 854909 - RNA, 22 nt, Human
uagaaaaagacauccauaaagg

SEQ ID NO: 854910 - RNA, 24 nt, Human
uagaaaaagacauccauaaaggua

SEQ ID NO: 854911 - RNA, 23 nt, Human
ucauucgagcccaggaguucaag

SEQ ID NO: 854912 - RNA, 22 nt, Human
uccaaagcaugacaaaaaagaa

SEQ ID NO: 854913 - RNA, 25 nt, Human
uccuccccagaggacucuucugcca

SEQ ID NO: 854914 - RNA, 20 nt, Human
ugaaauauccaaagcaugac

SEQ ID NO: 854915 - RNA, 22 nt, Human
ugaaauauccaaagcaugacaa

SEQ ID NO: 854916 - RNA, 18 nt, Human
ugacagcagcagcaguga

SEQ ID NO: 854917 - RNA, 19 nt, Human
ugagcuuuuggcaaauuag

SEQ ID NO: 854918 - RNA, 25 nt, Human
ugauaauagcucagaaguacucuug

SEQ ID NO: 854919 - RNA, 18 nt, Human
ugcacacaugggaaaaag

SEQ ID NO: 854920 - RNA, 22 nt, Human
ugcacacaugggaaaaaggcca

SEQ ID NO: 854921 - RNA, 21 nt, Human
uggcuuacgccuauaauccca

SEQ ID NO: 854922 - RNA, 24 nt, Human
uggcuuacgccuauaaucccagca

SEQ ID NO: 854923 - RNA, 22 nt, Human
ugggaaaaaggccagucgcccc

SEQ ID NO: 854924 - RNA, 19 nt, Human
ugggaggccaaggugggag

SEQ ID NO: 854925 - RNA, 24 nt, Human
ugggaggccaaggugggaggauca

SEQ ID NO: 854926 - RNA, 19 nt, Human
uuaaagcuagguccucuac

SEQ ID NO: 854927 - RNA, 23 nt, Human
uucgagcccaggaguucaagacu

SEQ ID NO: 854928 - RNA, 24 nt, Human
uugggguccuccccagaggacucu

SEQ ID NO: 854929 - RNA, 19 nt, Human
uugguuuuaagagaucuag

SEQ ID NO: 854930 - RNA, 23 nt, Human
uuuaaagcuagguccucuacucc

SEQ ID NO: 854931 - RNA, 18 nt, Human
uuuuuuuuuuuuuuucug

SEQ ID NO: 854932 - RNA, 19 nt, Human
uuuuuuuuuuuuuuucugu

SEQ ID NO: 854933 - RNA, 19 nt, Human
aaaaacaccugaaacuagu

SEQ ID NO: 854934 - RNA, 23 nt, Human
aaaaacccaaauuauuugaccca

SEQ ID NO: 854935 - RNA, 26 nt, Human
aaaaacucgaaccaagcacauuggcc

SEQ ID NO: 854936 - RNA, 23 nt, Human
aaaaaucuucuuucccccuaaaa

SEQ ID NO: 854937 - RNA, 19 nt, Human
aaaagucaauuccuaaacc

SEQ ID NO: 854938 - RNA, 20 nt, Human
aaaauaacaacaacaacaaa

SEQ ID NO: 854939 - RNA, 24 nt, Human
aaacaccugaaacuaguggaaaaa

SEQ ID NO: 854940 - RNA, 23 nt, Human
aaacuccugagacacagcagucu

SEQ ID NO: 854941 - RNA, 23 nt, Human
aaacuccuggccucaagcaaucc

SEQ ID NO: 854942 - RNA, 19 nt, Human
aaagugcugggauuacagg

SEQ ID NO: 854943 - RNA, 24 nt, Human
aaagugcugggauuacaggcuuga

SEQ ID NO: 854944 - RNA, 26 nt, Human
aaauaccaaaaaacaaacaaacaaac

SEQ ID NO: 854945 - RNA, 26 nt, Human
aacaacaacaacaaaaaaaaaaacac

SEQ ID NO: 854946 - RNA, 24 nt, Human
aacaacaacaacaaaaaaaaaaag

SEQ ID NO: 854947 - RNA, 27 nt, Human
aacaacaacaacaacaacaaaaaaaaa

SEQ ID NO: 854948 - RNA, 21 nt, Human
aacacucuacuaccaaccaaa

SEQ ID NO: 854949 - RNA, 20 nt, Human
aagaaaagaguacuuacuaa

SEQ ID NO: 854950 - RNA, 22 nt, Human
aagaaaagaguacuuacuaaau

SEQ ID NO: 854951 - RNA, 24 nt, Human
aagcaauccuccugccuggccucc

SEQ ID NO: 854952 - RNA, 23 nt, Human
aagcuaauucaaauacacucauu

SEQ ID NO: 854953 - RNA, 19 nt, Human
aagugcugggauuacaggc

SEQ ID NO: 854954 - RNA, 19 nt, Human
aagugcugggauuacaggc

SEQ ID NO: 854955 - RNA, 26 nt, Human
aagugcugggauuacaggcuugagcu

SEQ ID NO: 854956 - RNA, 18 nt, Human
aauugcuugagccuggga

SEQ ID NO: 854957 - RNA, 24 nt, Human
aauugcuugagccugggaggucga

SEQ ID NO: 854958 - RNA, 24 nt, Human
acaaacaaacaaacaaacaaaaaa

SEQ ID NO: 854959 - RNA, 24 nt, Human
acaacaaaaaaaaaaacaccugaa

SEQ ID NO: 854960 - RNA, 26 nt, Human
acaacaacaaaaaaaaaaacaccuga

SEQ ID NO: 854961 - RNA, 19 nt, Human
acaacaacaacaacaaaaa

SEQ ID NO: 854962 - RNA, 19 nt, Human
acaacaacaacaacaacaa

SEQ ID NO: 854963 - RNA, 20 nt, Human
acaacaacaacaacaacaaa

SEQ ID NO: 854964 - RNA, 21 nt, Human
acaaucaccaaaugcaaauau

SEQ ID NO: 854965 - RNA, 23 nt, Human
acacagcagucuucagugcauuc

SEQ ID NO: 854966 - RNA, 20 nt, Human
accaaaaaacaaacaaacaa

SEQ ID NO: 854967 - RNA, 22 nt, Human
accaauguacuccagccugggc

SEQ ID NO: 854968 - RNA, 26 nt, Human
accaauguacuccagccugggcaaca

SEQ ID NO: 854969 - RNA, 23 nt, Human
acuauguugcccaggcuggucuc

SEQ ID NO: 854970 - RNA, 25 nt, Human
acuauguugcccaggcuggucucaa

SEQ ID NO: 854971 - RNA, 23 nt, Human
agaaacuccugagacacagcagu

SEQ ID NO: 854972 - RNA, 24 nt, Human
agaaauuagaaguuacgucuaacu

SEQ ID NO: 854973 - RNA, 22 nt, Human
agaauugcuugagccugggagg

SEQ ID NO: 854974 - RNA, 19 nt, Human
agauagccaguaggaauag

SEQ ID NO: 854975 - RNA, 22 nt, Human
agcaauccuccugccuggccuc

SEQ ID NO: 854976 - RNA, 24 nt, Human
agccugggcaacagagcaggacuc

SEQ ID NO: 854977 - RNA, 21 nt, Human
agcuacaaacacucuacuacc

SEQ ID NO: 854978 - RNA, 24 nt, Human
aggcugagguaggagaauugcuug

SEQ ID NO: 854979 - RNA, 24 nt, Human
agguaggagaauugcuugagccug

SEQ ID NO: 854980 - RNA, 19 nt, Human
aggucgaggcugcagugaa

SEQ ID NO: 854981 - RNA, 22 nt, Human
aggucuuacuauguugcccagg

SEQ ID NO: 854982 - RNA, 24 nt, Human
agugcugggauuacaggcuugagc

SEQ ID NO: 854983 - RNA, 22 nt, Human
aguucaaaauaacaacaacaac

SEQ ID NO: 854984 - RNA, 22 nt, Human
auaacaacaacaacaacaaaac

SEQ ID NO: 854985 - RNA, 24 nt, Human
auaacaacaacaacaacaacaaaa

SEQ ID NO: 854986 - RNA, 22 nt, Human
auaccaaaaaacaaacaaacaa

SEQ ID NO: 854987 - RNA, 24 nt, Human
aucacaccaauguacuccagccug

SEQ ID NO: 854988 - RNA, 24 nt, Human
auccuauagucccaguuacucagg

SEQ ID NO: 854989 - RNA, 19 nt, Human
augcagaugcacucaauuu

SEQ ID NO: 854990 - RNA, 22 nt, Human
auuaaaaaucuucuuucccccu

SEQ ID NO: 854991 - RNA, 18 nt, Human
caaacacucuacuaccaa

SEQ ID NO: 854992 - RNA, 23 nt, Human
caaagugcugggauuacaggcuu

SEQ ID NO: 854993 - RNA, 19 nt, Human
caacaaaaaaaaaaacacc

SEQ ID NO: 854994 - RNA, 23 nt, Human
caacaaaaaaaaaaacaccugaa

SEQ ID NO: 854995 - RNA, 23 nt, Human
caacaaaaaaaaaaacaccugaa

SEQ ID NO: 854996 - RNA, 20 nt, Human
caacaacaacaacaacaaaa

SEQ ID NO: 854997 - RNA, 25 nt, Human
caagagaaacuccugagacacagca

SEQ ID NO: 854998 - RNA, 26 nt, Human
caagcaauccuccugccuggccuccc

SEQ ID NO: 854999 - RNA, 26 nt, Human
caagcaauccuccugccuggccuccc

SEQ ID NO: 855000 - RNA, 19 nt, Human
caauccuccugccuggccu

SEQ ID NO: 855001 - RNA, 19 nt, Human
caauguacuccagccuggg

SEQ ID NO: 855002 - RNA, 22 nt, Human
caauguacuccagccugggcaa

SEQ ID NO: 855003 - RNA, 23 nt, Human
caauguacuccagccugggcaac

SEQ ID NO: 855004 - RNA, 24 nt, Human
caauguacuccagccugggcaaca

SEQ ID NO: 855005 - RNA, 25 nt, Human
caauguacuccagccugggcaacaa

SEQ ID NO: 855006 - RNA, 24 nt, Human
cacauaaaauuuagcugaaucaaa

SEQ ID NO: 855007 - RNA, 24 nt, Human
caccaauguacuccagccugggca

SEQ ID NO: 855008 - RNA, 26 nt, Human
caccaauguacuccagccugggcaac

SEQ ID NO: 855009 - RNA, 19 nt, Human
cacccauggccgacaccau

SEQ ID NO: 855010 - RNA, 23 nt, Human
caccugaaacuaguggaaaaaac

SEQ ID NO: 855011 - RNA, 24 nt, Human
caggccgcuagccccccgcuuccu

SEQ ID NO: 855012 - RNA, 24 nt, Human
caguuacucaggaggcugagguag

SEQ ID NO: 855013 - RNA, 19 nt, Human
ccaaagugcugggauuaca

SEQ ID NO: 855014 - RNA, 22 nt, Human
ccaaagugcugggauuacaggc

SEQ ID NO: 855015 - RNA, 23 nt, Human
ccaaagugcugggauuacaggcu

SEQ ID NO: 855016 - RNA, 21 nt, Human
ccaauguacuccagccugggc

SEQ ID NO: 855017 - RNA, 23 nt, Human
ccaauguacuccagccugggcaa

SEQ ID NO: 855018 - RNA, 24 nt, Human
ccaauguacuccagccugggcaac

SEQ ID NO: 855019 - RNA, 20 nt, Human
ccagauaagcuacaaacacu

SEQ ID NO: 855020 - RNA, 24 nt, Human
cccaaagugcugggauuacaggcu

SEQ ID NO: 855021 - RNA, 23 nt, Human
cccauggccgacaccaugcuacc

SEQ ID NO: 855022 - RNA, 27 nt, Human
cccauggccgacaccaugcuaccuugu

SEQ ID NO: 855023 - RNA, 19 nt, Human
cccccuaaaauacuuuaaa

SEQ ID NO: 855024 - RNA, 20 nt, Human
cccccuuccaguuccaaaag

SEQ ID NO: 855025 - RNA, 21 nt, Human
cccuccuauuuuaaauuaaaa

SEQ ID NO: 855026 - RNA, 24 nt, Human
cccuccuauuuuaaauuaaaaacc

SEQ ID NO: 855027 - RNA, 22 nt, Human
ccgacaccaugcuaccuucacu

SEQ ID NO: 855028 - RNA, 21 nt, Human
ccuauagucccaguuacucag

SEQ ID NO: 855029 - RNA, 20 nt, Human
ccugccuggccucccaaagu

SEQ ID NO: 855030 - RNA, 18 nt, Human
ccuggccucaagcaaucc

SEQ ID NO: 855031 - RNA, 22 nt, Human
ccugggcaacagagcaggacuc

SEQ ID NO: 855032 - RNA, 21 nt, Human
ccuuccagcaugaaauucuga

SEQ ID NO: 855033 - RNA, 18 nt, Human
cgccaggccgcuagcccc

SEQ ID NO: 855034 - RNA, 22 nt, Human
cuauacaauucuucuugcuccg

SEQ ID NO: 855035 - RNA, 23 nt, Human
cucaagcaauccuccugccuggc

SEQ ID NO: 855036 - RNA, 18 nt, Human
cucaggaggcugagguag

SEQ ID NO: 855037 - RNA, 20 nt, Human
cucauuaggcucagaaacaa

SEQ ID NO: 855038 - RNA, 21 nt, Human
cucauuuuuuucaugccacau

SEQ ID NO: 855039 - RNA, 23 nt, Human
cugccuggccucccaaagugcug

SEQ ID NO: 855040 - RNA, 18 nt, Human
cuggccucaagcaauccu

SEQ ID NO: 855041 - RNA, 20 nt, Human
cuucuugcuccgggacccgc

SEQ ID NO: 855042 - RNA, 27 nt, Human
gaaacuaguggaaaaaacuuccacagc

SEQ ID NO: 855043 - RNA, 21 nt, Human
gaaauaccaaaaaacaaacaa

SEQ ID NO: 855044 - RNA, 18 nt, Human
gaauaugauuccuccagu

SEQ ID NO: 855045 - RNA, 20 nt, Human
gacaggaaaguaagaucugg

SEQ ID NO: 855046 - RNA, 19 nt, Human
gaccagagguccucauuuu

SEQ ID NO: 855047 - RNA, 22 nt, Human
gagcaggacucuuuuuuggaaa

SEQ ID NO: 855048 - RNA, 23 nt, Human
gagguaggagaauugcuugagcc

SEQ ID NO: 855049 - RNA, 19 nt, Human
gauuacaggcuugagcuac

SEQ ID NO: 855050 - RNA, 21 nt, Human
gauuacaggcuugagcuacca

SEQ ID NO: 855051 - RNA, 27 nt, Human
gcaacagagcaggacucuuuuuuggaa

SEQ ID NO: 855052 - RNA, 21 nt, Human
gcccaaaucaagaaauacccc

SEQ ID NO: 855053 - RNA, 24 nt, Human
gccugggaggucgaggcugcagug

SEQ ID NO: 855054 - RNA, 20 nt, Human
gcuaguacccuuaagagcuc

SEQ ID NO: 855055 - RNA, 19 nt, Human
gcuccgggacccgcccgcc

SEQ ID NO: 855056 - RNA, 20 nt, Human
gcugcagaugagcuuucagu

SEQ ID NO: 855057 - RNA, 23 nt, Human
gcuggucucaaacuccuggccuc

SEQ ID NO: 855058 - RNA, 18 nt, Human
gcuugagcuaccacaccc

SEQ ID NO: 855059 - RNA, 24 nt, Human
ggcuggucucaaacuccuggccuc

SEQ ID NO: 855060 - RNA, 24 nt, Human
guacuccagccugggcaacagagc

SEQ ID NO: 855061 - RNA, 21 nt, Human
gugaagcacacauaaauguuu

SEQ ID NO: 855062 - RNA, 23 nt, Human
uaacaacaacaacaacaacaaaa

SEQ ID NO: 855063 - RNA, 21 nt, Human
uaagaguucuaccauggcuaa

SEQ ID NO: 855064 - RNA, 24 nt, Human
uaagcuacaaacacucuacuacca

SEQ ID NO: 855065 - RNA, 24 nt, Human
uaagcuacaaacacucuacuacca

SEQ ID NO: 855066 - RNA, 21 nt, Human
uaccaaaaaacaaacaaacaa

SEQ ID NO: 855067 - RNA, 22 nt, Human
uaccaaaaaacaaacaaacaaa

SEQ ID NO: 855068 - RNA, 23 nt, Human
uaccaaaaaacaaacaaacaaac

SEQ ID NO: 855069 - RNA, 23 nt, Human
uaccaaaaaacaaacaaacaaac

SEQ ID NO: 855070 - RNA, 24 nt, Human
uaccaaaaaacaaacaaacaaaca

SEQ ID NO: 855071 - RNA, 25 nt, Human
uaccaaaaaacaaacaaacaaacaa

SEQ ID NO: 855072 - RNA, 25 nt, Human
uaccaaaaaacaaacaaacaaacaa

SEQ ID NO: 855073 - RNA, 19 nt, Human
uaccacacccugccaugac

SEQ ID NO: 855074 - RNA, 24 nt, Human
uaccagauaagcuacaaacacucu

SEQ ID NO: 855075 - RNA, 23 nt, Human
uaccucauuaggcucagaaacaa

SEQ ID NO: 855076 - RNA, 19 nt, Human
uacuauguugcccaggcug

SEQ ID NO: 855077 - RNA, 21 nt, Human
uacuauguugcccaggcuggu

SEQ ID NO: 855078 - RNA, 27 nt, Human
uacuauguugcccaggcuggucucaaa

SEQ ID NO: 855079 - RNA, 23 nt, Human
uauguugcccaggcuggucucaa

SEQ ID NO: 855080 - RNA, 24 nt, Human
uauguugcccaggcuggucucaaa

SEQ ID NO: 855081 - RNA, 18 nt, Human
uauuaaguccagaucuuu

SEQ ID NO: 855082 - RNA, 22 nt, Human
uauucacuaaaaaacucgaacc

SEQ ID NO: 855083 - RNA, 21 nt, Human
ucacccauggccgacaccaug

SEQ ID NO: 855084 - RNA, 25 nt, Human
ucacuaaaaaacucgaaccaagcac

SEQ ID NO: 855085 - RNA, 18 nt, Human
ucacucuuuaaaauucca

SEQ ID NO: 855086 - RNA, 18 nt, Human
ucauauuucccuuuugcu

SEQ ID NO: 855087 - RNA, 20 nt, Human
ucauauuucccuuuugcuuc

SEQ ID NO: 855088 - RNA, 21 nt, Human
ucauugaauaugauuccucca

SEQ ID NO: 855089 - RNA, 24 nt, Human
ucccaaagugcugggauuacaggc

SEQ ID NO: 855090 - RNA, 25 nt, Human
ucuauccugcuaguacccuuaagag

SEQ ID NO: 855091 - RNA, 19 nt, Human
ucuuacuauguugcccagg

SEQ ID NO: 855092 - RNA, 23 nt, Human
ucuuacuauguugcccaggcugg

SEQ ID NO: 855093 - RNA, 24 nt, Human
ucuuacuauguugcccaggcuggu

SEQ ID NO: 855094 - RNA, 18 nt, Human
ugagccugggaggucgag

SEQ ID NO: 855095 - RNA, 24 nt, Human
ugagccugggaggucgaggcugca

SEQ ID NO: 855096 - RNA, 24 nt, Human
ugaggucuuacuauguugcccagg

SEQ ID NO: 855097 - RNA, 24 nt, Human
ugcccaggcuggucucaaacuccu

SEQ ID NO: 855098 - RNA, 19 nt, Human
ugcuuucauauuucccuuu

SEQ ID NO: 855099 - RNA, 22 nt, Human
uggagaugaggucuuacuaugu

SEQ ID NO: 855100 - RNA, 20 nt, Human
uggccucaagcaauccuccu

SEQ ID NO: 855101 - RNA, 21 nt, Human
uggccucaagcaauccuccug

SEQ ID NO: 855102 - RNA, 24 nt, Human
uggccucaagcaauccuccugccu

SEQ ID NO: 855103 - RNA, 18 nt, Human
ugggauuacaggcuugag

SEQ ID NO: 855104 - RNA, 19 nt, Human
ugggauuacaggcuugagc

SEQ ID NO: 855105 - RNA, 22 nt, Human
ugggauuacaggcuugagcuac

SEQ ID NO: 855106 - RNA, 24 nt, Human
ugggauuacaggcuugagcuacca

SEQ ID NO: 855107 - RNA, 21 nt, Human
uggggccacuuucuguaacuc

SEQ ID NO: 855108 - RNA, 22 nt, Human
uggggccacuuucuguaacuca

SEQ ID NO: 855109 - RNA, 22 nt, Human
uguacuccagccugggcaacag

SEQ ID NO: 855110 - RNA, 22 nt, Human
ugucuuccucucuaaagccucu

SEQ ID NO: 855111 - RNA, 19 nt, Human
ugugaagcacacauaaaug

SEQ ID NO: 855112 - RNA, 25 nt, Human
uguggagaugaggucuuacuauguu

SEQ ID NO: 855113 - RNA, 23 nt, Human
uuaaaaaucuucuuucccccuaa

SEQ ID NO: 855114 - RNA, 19 nt, Human
uuacuaaaugaucccaaau

SEQ ID NO: 855115 - RNA, 24 nt, Human
uucagaacauaaaaauaaauuucc

SEQ ID NO: 855116 - RNA, 26 nt, Human
uuccauuuacagauuucccccuucca

SEQ ID NO: 855117 - RNA, 21 nt, Human
uucccccuaaaauacuuuaaa

SEQ ID NO: 855118 - RNA, 23 nt, Human
uugaagguguuccucaaggacag

SEQ ID NO: 855119 - RNA, 23 nt, Human
uugcuugagccugggaggucgag

SEQ ID NO: 855120 - RNA, 24 nt, Human
uugcuugagccugggaggucgagg

SEQ ID NO: 855121 - RNA, 20 nt, Human
uuuaccagauaagcuacaaa

SEQ ID NO: 855122 - RNA, 20 nt, Human
uuucaugccacaugugaagc

SEQ ID NO: 855123 - RNA, 24 nt, Human
uuucccuuuugcuucuuuucuaga

SEQ ID NO: 855124 - RNA, 27 nt, Human
uuuuuuuuuuuuguggagaugaggucu

SEQ ID NO: 855125 - RNA, 22 nt, Human
uuuuuuuuuuuuuuuuuugugg

SEQ ID NO: 855126 - RNA, 27 nt, Human
aaaaaagaaauacaaagacugaaaaga

SEQ ID NO: 855127 - RNA, 30 nt, Human
aaaaaagaaauacaaagacugaaaagagaa

SEQ ID NO: 855128 - RNA, 23 nt, Human
aaaaagaaauacaaagacugaaa

SEQ ID NO: 855129 - RNA, 26 nt, Human
aaaacaagaaaaaagaaauacaaaga

SEQ ID NO: 855130 - RNA, 23 nt, Human
aaacaagaaaaaagaaauacaag

SEQ ID NO: 855131 - RNA, 22 nt, Human
aaaguguucaacaugagaaaau

SEQ ID NO: 855132 - RNA, 21 nt, Human
aacaagaaaaaagaaauacaa

SEQ ID NO: 855133 - RNA, 24 nt, Human
aaccaaaccucucaccaagcggcc

SEQ ID NO: 855134 - RNA, 26 nt, Human
aaccaaaccucucaccaagcggccca

SEQ ID NO: 855135 - RNA, 25 nt, Human
aagaaaaaagaaauacaaagacuga

SEQ ID NO: 855136 - RNA, 19 nt, Human
aaggagaaggccgggcaug

SEQ ID NO: 855137 - RNA, 19 nt, Human
aaguauaagaugaaggaac

SEQ ID NO: 855138 - RNA, 18 nt, Human
aauaaaacaagaaaaaag

SEQ ID NO: 855139 - RNA, 18 nt, Human
aauaagauuggggugccc

SEQ ID NO: 855140 - RNA, 24 nt, Human
acacgugaaauuugaaaacuguac

SEQ ID NO: 855141 - RNA, 19 nt, Human
accaggaucccaaaggaac

SEQ ID NO: 855142 - RNA, 20 nt, Human
agaaaaaagaaauacaaaga

SEQ ID NO: 855143 - RNA, 19 nt, Human
agaaggccgggcauggugg

SEQ ID NO: 855144 - RNA, 18 nt, Human
agaaugcucagaugcauc

SEQ ID NO: 855145 - RNA, 18 nt, Human
agaccuaacagacuaaca

SEQ ID NO: 855146 - RNA, 20 nt, Human
agacuuuucuagaauggggu

SEQ ID NO: 855147 - RNA, 21 nt, Human
agagaguuuauuuuauacagu

SEQ ID NO: 855148 - RNA, 21 nt, Human
aggcagagguaucaaaccaaa

SEQ ID NO: 855149 - RNA, 21 nt, Human
aggcuguguccacccagaauc

SEQ ID NO: 855150 - RNA, 23 nt, Human
aggcuguguccacccagaaucca

SEQ ID NO: 855151 - RNA, 21 nt, Human
agugguccagucugcagcccc

SEQ ID NO: 855152 - RNA, 28 nt, Human
auaaaacaagaaaaaagaaauacaaaga

SEQ ID NO: 855153 - RNA, 18 nt, Human
caaaccaaaccucucacc

SEQ ID NO: 855154 - RNA, 24 nt, Human
caaaccucucaccaagcggcccag

SEQ ID NO: 855155 - RNA, 24 nt, Human
caaggggcuuggccucucugcguc

SEQ ID NO: 855156 - RNA, 22 nt, Human
caauaaaacaagaaaaaagaaa

SEQ ID NO: 855157 - RNA, 24 nt, Human
caaugcaauaaaacaagaaaaaag

SEQ ID NO: 855158 - RNA, 18 nt, Human
cagguggcagaaaacaau

SEQ ID NO: 855159 - RNA, 23 nt, Human
caguggacaggaaaagaucucaa

SEQ ID NO: 855160 - RNA, 25 nt, Human
cccuccaucauugcuacuauucaac

SEQ ID NO: 855161 - RNA, 25 nt, Human
ccuaacagacuaacacgugaccacc

SEQ ID NO: 855162 - RNA, 20 nt, Human
ccucucgugacagcacaggc

SEQ ID NO: 855163 - RNA, 23 nt, Human
ccuuuggcugugugacccaaggc

SEQ ID NO: 855164 - RNA, 22 nt, Human
cuagaaaauccaaaagaccuaa

SEQ ID NO: 855165 - RNA, 28 nt, Human
gaaaaaagaaauacaaagacugaaaaga

SEQ ID NO: 855166 - RNA, 24 nt, Human
gaaggccgggcaugguggcucaca

SEQ ID NO: 855167 - RNA, 18 nt, Human
gacagugucuucuuuuug

SEQ ID NO: 855168 - RNA, 20 nt, Human
gaggggccuggguaccccuu

SEQ ID NO: 855169 - RNA, 23 nt, Human
gcccccaaccuuacugauggccu

SEQ ID NO: 855170 - RNA, 18 nt, Human
gcggcccaggaggggcag

SEQ ID NO: 855171 - RNA, 19 nt, Human
gcucauuuucaauuaaggc

SEQ ID NO: 855172 - RNA, 23 nt, Human
gcucauuuucaauuaaggcuaaa

SEQ ID NO: 855173 - RNA, 20 nt, Human
ggagccaccuagaagcuggc

SEQ ID NO: 855174 - RNA, 19 nt, Human
ggaguggaugggcagcucu

SEQ ID NO: 855175 - RNA, 22 nt, Human
ggcaugguggcucacaccugua

SEQ ID NO: 855176 - RNA, 18 nt, Human
ggccaccagcagggaccu

SEQ ID NO: 855177 - RNA, 22 nt, Human
ggccuggguaccccuuuugggg

SEQ ID NO: 855178 - RNA, 27 nt, Human
ggccuggguaccccuuuuggggaaacu

SEQ ID NO: 855179 - RNA, 20 nt, Human
gggcacacagaggaggggcc

SEQ ID NO: 855180 - RNA, 18 nt, Human
ggugcagugguccagucu

SEQ ID NO: 855181 - RNA, 24 nt, Human
guacuggaccuuccacaaccggag

SEQ ID NO: 855182 - RNA, 24 nt, Human
guggcagcuaaaguagcuucuuuu

SEQ ID NO: 855183 - RNA, 23 nt, Human
gugggaguggaugggcagcucuu

SEQ ID NO: 855184 - RNA, 20 nt, Human
gugugacccaaggcaagggg

SEQ ID NO: 855185 - RNA, 22 nt, Human
uaaaacaagaaaaaagaaauac

SEQ ID NO: 855186 - RNA, 23 nt, Human
uaaaacaagaaaaaagaaauaca

SEQ ID NO: 855187 - RNA, 22 nt, Human
uaacagacuaacacgugaccac

SEQ ID NO: 855188 - RNA, 20 nt, Human
uacacgugaaauuugaaaac

SEQ ID NO: 855189 - RNA, 18 nt, Human
uacaguaguuguacagua

SEQ ID NO: 855190 - RNA, 21 nt, Human
uagaacagcuugaaaauaaga

SEQ ID NO: 855191 - RNA, 18 nt, Human
uagaaugggguggcagcu

SEQ ID NO: 855192 - RNA, 24 nt, Human
uagcuucuuuuucuuucuuucaga

SEQ ID NO: 855193 - RNA, 23 nt, Human
ucagcauugucguguuuacuggc

SEQ ID NO: 855194 - RNA, 24 nt, Human
uccaaaagaccuaacagacuaaca

SEQ ID NO: 855195 - RNA, 25 nt, Human
uccaaaagaccuaacagacuaacac

SEQ ID NO: 855196 - RNA, 19 nt, Human
ucccuguugccucuggauc

SEQ ID NO: 855197 - RNA, 18 nt, Human
ucguguuuacugaaauac

SEQ ID NO: 855198 - RNA, 20 nt, Human
ucucgugacagcacaggccc

SEQ ID NO: 855199 - RNA, 20 nt, Human
ucugcagcccccaaccuuac

SEQ ID NO: 855200 - RNA, 23 nt, Human
ucugccuccuuuggcugugugac

SEQ ID NO: 855201 - RNA, 20 nt, Human
ucugcuccacggugcagugg

SEQ ID NO: 855202 - RNA, 23 nt, Human
ugacagcacaggcccaugagaca

SEQ ID NO: 855203 - RNA, 20 nt, Human
ugacccaaggcaaggggcuu

SEQ ID NO: 855204 - RNA, 21 nt, Human
ugacccaaggcaaggggcuug

SEQ ID NO: 855205 - RNA, 23 nt, Human
ugagaaaaugugauacauuugau

SEQ ID NO: 855206 - RNA, 21 nt, Human
ugagacgaagcuauuuagaac

SEQ ID NO: 855207 - RNA, 23 nt, Human
ugaggaaaaauguugucaggugg

SEQ ID NO: 855208 - RNA, 19 nt, Human
ugaggggagcugguccggg

SEQ ID NO: 855209 - RNA, 19 nt, Human
ugcagcuggggcacacaga

SEQ ID NO: 855210 - RNA, 25 nt, Human
ugccucuggaucugguugugaguuc

SEQ ID NO: 855211 - RNA, 18 nt, Human
uggagccaccuagaagcu

SEQ ID NO: 855212 - RNA, 18 nt, Human
uggcaggagggaggcaga

SEQ ID NO: 855213 - RNA, 18 nt, Human
uggcucacaccuguaguc

SEQ ID NO: 855214 - RNA, 18 nt, Human
uggcucacaccuguaguc

SEQ ID NO: 855215 - RNA, 20 nt, Human
uggcucacaccuguagucug

SEQ ID NO: 855216 - RNA, 19 nt, Human
uggcucugccuccuuuggc

SEQ ID NO: 855217 - RNA, 18 nt, Human
uggggcacacagaggagg

SEQ ID NO: 855218 - RNA, 23 nt, Human
uggggcacacagaggaggggccu

SEQ ID NO: 855219 - RNA, 24 nt, Human
uggggugggaguggaugggcagcu

SEQ ID NO: 855220 - RNA, 19 nt, Human
uguccauacuuuuugggaa

SEQ ID NO: 855221 - RNA, 20 nt, Human
ugucguguuuacugaaauac

SEQ ID NO: 855222 - RNA, 20 nt, Human
uuggugguacuggaccuucc

SEQ ID NO: 855223 - RNA, 18 nt, Human
uuguacaguaauugagga

SEQ ID NO: 855224 - RNA, 22 nt, Human
uuucagaaugcucagaugcauc

SEQ ID NO: 855225 - RNA, 20 nt, Human
uuugaggggagcugguccgg

SEQ ID NO: 855226 - RNA, 21 nt, Human
uuuuuuuuuuuuuuuuuccag

SEQ ID NO: 855227 - RNA, 24 nt, Human
uuuuuuuuuuuuuuuuuuccaggg

SEQ ID NO: 855228 - RNA, 24 nt, Human
aaagcacugggauuacaggcauga

SEQ ID NO: 855229 - RNA, 25 nt, Human
aagcaauccucccaccucagccucc

SEQ ID NO: 855230 - RNA, 26 nt, Human
aagcacugggauuacaggcaugagcc

SEQ ID NO: 855231 - RNA, 23 nt, Human
acacccggcacauuuuaaaaacg

SEQ ID NO: 855232 - RNA, 21 nt, Human
acagggcaggggagccccagg

SEQ ID NO: 855233 - RNA, 21 nt, Human
acagggccuggggucuguggg

SEQ ID NO: 855234 - RNA, 22 nt, Human
acccacccucucuccagaaccu

SEQ ID NO: 855235 - RNA, 24 nt, Human
accgucccuguuuucucuuccccu

SEQ ID NO: 855236 - RNA, 23 nt, Human
accucagccucccaaagcacugg

SEQ ID NO: 855237 - RNA, 22 nt, Human
acuggggacaugcacagggccu

SEQ ID NO: 855238 - RNA, 21 nt, Human
agacaggagacugaggcccca

SEQ ID NO: 855239 - RNA, 24 nt, Human
agacaggagacugaggccccagga

SEQ ID NO: 855240 - RNA, 18 nt, Human
agcaccuggcccgggacc

SEQ ID NO: 855241 - RNA, 18 nt, Human
agccaccgcaccuggccu

SEQ ID NO: 855242 - RNA, 18 nt, Human
agccuggagagugggcag

SEQ ID NO: 855243 - RNA, 19 nt, Human
agcgggacagauggugggg

SEQ ID NO: 855244 - RNA, 20 nt, Human
agcgggacagauggugggga

SEQ ID NO: 855245 - RNA, 26 nt, Human
agcuccauccacuccuggccgugcga

SEQ ID NO: 855246 - RNA, 19 nt, Human
aggccccaggaggggagga

SEQ ID NO: 855247 - RNA, 21 nt, Human
aggccccaggaggggaggagg

SEQ ID NO: 855248 - RNA, 23 nt, Human
agggaacccagcagccugucucu

SEQ ID NO: 855249 - RNA, 23 nt, Human
agggggcccgggagggcggcagg

SEQ ID NO: 855250 - RNA, 24 nt, Human
augccucagggcccccuccugcug

SEQ ID NO: 855251 - RNA, 24 nt, Human
caaagcacugggauuacaggcaug

SEQ ID NO: 855252 - RNA, 27 nt, Human
caagcaauccucccaccucagccuccc

SEQ ID NO: 855253 - RNA, 27 nt, Human
caagcaauccucccaccucagccuccc

SEQ ID NO: 855254 - RNA, 20 nt, Human
caagugauccucuugccuca

SEQ ID NO: 855255 - RNA, 22 nt, Human
caagugauccucuugccucagc

SEQ ID NO: 855256 - RNA, 23 nt, Human
cacaacggagaggggagugcuca

SEQ ID NO: 855257 - RNA, 18 nt, Human
cacagccucgcagcccuc

SEQ ID NO: 855258 - RNA, 22 nt, Human
cacccagcaucagcccgccucc

SEQ ID NO: 855259 - RNA, 23 nt, Human
caccuccugccugacacuggggg

SEQ ID NO: 855260 - RNA, 22 nt, Human
cagaaccugucgcugugccccg

SEQ ID NO: 855261 - RNA, 21 nt, Human
cagccucgaccuucugggcuc

SEQ ID NO: 855262 - RNA, 24 nt, Human
cagccucgaccuucugggcucaag

SEQ ID NO: 855263 - RNA, 24 nt, Human
cagcucccugcagccucgaccuuc

SEQ ID NO: 855264 - RNA, 19 nt, Human
caggagacugaggccccaa

SEQ ID NO: 855265 - RNA, 24 nt, Human
ccaaagcacugggauuacaggcau

SEQ ID NO: 855266 - RNA, 26 nt, Human
ccaccagcaccuggcccgggacccac

SEQ ID NO: 855267 - RNA, 24 nt, Human
ccagcagccugucucucugguccc

SEQ ID NO: 855268 - RNA, 21 nt, Human
ccaggcucgcgggagcugcug

SEQ ID NO: 855269 - RNA, 24 nt, Human
cccaaagcacugggauuacaggca

SEQ ID NO: 855270 - RNA, 21 nt, Human
cccagcaucagcccgccucca

SEQ ID NO: 855271 - RNA, 19 nt, Human
cccaggcuguccuccucgg

SEQ ID NO: 855272 - RNA, 18 nt, Human
ccccaggcuguccuccuc

SEQ ID NO: 855273 - RNA, 23 nt, Human
ccccaguggugguggccuggccu

SEQ ID NO: 855274 - RNA, 22 nt, Human
ccccgcgacagccuccuugcuc

SEQ ID NO: 855275 - RNA, 23 nt, Human
cccgccuccaccuggaggcccac

SEQ ID NO: 855276 - RNA, 23 nt, Human
cccggcuccggggaaaucgguuc

SEQ ID NO: 855277 - RNA, 23 nt, Human
cccucgaaccucggaggccccca

SEQ ID NO: 855278 - RNA, 18 nt, Human
ccgccacccacagccucg

SEQ ID NO: 855279 - RNA, 21 nt, Human
ccgggacccacccucucucca

SEQ ID NO: 855280 - RNA, 21 nt, Human
ccggggaaaucgguucccucc

SEQ ID NO: 855281 - RNA, 20 nt, Human
ccucccaaagcacugggauu

SEQ ID NO: 855282 - RNA, 24 nt, Human
ccucccaccucagccucccaaagc

SEQ ID NO: 855283 - RNA, 21 nt, Human
ccucccggcuccggggaaauc

SEQ ID NO: 855284 - RNA, 19 nt, Human
ccucgaaccucggaggccc

SEQ ID NO: 855285 - RNA, 21 nt, Human
ccucgaccuucugggcucaag

SEQ ID NO: 855286 - RNA, 20 nt, Human
ccucggaggcccccacgccc

SEQ ID NO: 855287 - RNA, 23 nt, Human
ccuggcccgggacccacccucuc

SEQ ID NO: 855288 - RNA, 21 nt, Human
ccuguuuucucuuccccucuc

SEQ ID NO: 855289 - RNA, 24 nt, Human
ccuucugggcucaagugauccucu

SEQ ID NO: 855290 - RNA, 23 nt, Human
cgauggggugggagacgggaugg

SEQ ID NO: 855291 - RNA, 20 nt, Human
cggcaugugcucugcauccc

SEQ ID NO: 855292 - RNA, 21 nt, Human
cggcaugugcucugcaucccc

SEQ ID NO: 855293 - RNA, 22 nt, Human
cggguugggccgaggagggggc

SEQ ID NO: 855294 - RNA, 21 nt, Human
cuacugcagcuccugcccugg

SEQ ID NO: 855295 - RNA, 24 nt, Human
cucaagcaauccucccaccucagc

SEQ ID NO: 855296 - RNA, 24 nt, Human
cucagcuucuuggguagcugggau

SEQ ID NO: 855297 - RNA, 19 nt, Human
cuccccaguggugguggcc

SEQ ID NO: 855298 - RNA, 18 nt, Human
cuccucgggcuugggggg

SEQ ID NO: 855299 - RNA, 21 nt, Human
cucggccccgcgacagccucc

SEQ ID NO: 855300 - RNA, 23 nt, Human
cugacgaugacgacacacccagc

SEQ ID NO: 855301 - RNA, 22 nt, Human
cugcagccucgaccuucugggc

SEQ ID NO: 855302 - RNA, 23 nt, Human
cugcugcacugggccagccgugc

SEQ ID NO: 855303 - RNA, 18 nt, Human
cuggcccagacuguccca

SEQ ID NO: 855304 - RNA, 20 nt, Human
cugggcucaagugauccucu

SEQ ID NO: 855305 - RNA, 22 nt, Human
cuggucucaagcaauccuccca

SEQ ID NO: 855306 - RNA, 21 nt, Human
gaaaucgguucccuccacugg

SEQ ID NO: 855307 - RNA, 23 nt, Human
gacccacccucucuccagaaccu

SEQ ID NO: 855308 - RNA, 23 nt, Human
gacgaugacgacacacccagcau

SEQ ID NO: 855309 - RNA, 24 nt, Human
gagugcagcagugugaucacagcu

SEQ ID NO: 855310 - RNA, 18 nt, Human
gauuacaggcaugagcca

SEQ ID NO: 855311 - RNA, 22 nt, Human
gauuacaggcaugagccaccgc

SEQ ID NO: 855312 - RNA, 23 nt, Human
gauuacaggcaugagccaccgca

SEQ ID NO: 855313 - RNA, 21 nt, Human
gcaccuggccugguuuagcuu

SEQ ID NO: 855314 - RNA, 18 nt, Human
gcagcuccauccacuccu

SEQ ID NO: 855315 - RNA, 22 nt, Human
gcagcuccauccacuccuggcc

SEQ ID NO: 855316 - RNA, 18 nt, Human
gccccaggcuugccuccc

SEQ ID NO: 855317 - RNA, 19 nt, Human
gccuaagccccgguuuccc

SEQ ID NO: 855318 - RNA, 24 nt, Human
gccucagcuucuuggguagcuggg

SEQ ID NO: 855319 - RNA, 24 nt, Human
gccuggggucuguggggacgugag

SEQ ID NO: 855320 - RNA, 19 nt, Human
ggagggggcccgggagggc

SEQ ID NO: 855321 - RNA, 22 nt, Human
ggauuacaggcaugagccaccg

SEQ ID NO: 855322 - RNA, 18 nt, Human
ggcccgggagggcggcag

SEQ ID NO: 855323 - RNA, 23 nt, Human
gggcacaacggagaggggagugc

SEQ ID NO: 855324 - RNA, 19 nt, Human
gggcagggaacccagcagc

SEQ ID NO: 855325 - RNA, 22 nt, Human
gggcucaagugauccucuugcc

SEQ ID NO: 855326 - RNA, 19 nt, Human
ggggacugggagccuggag

SEQ ID NO: 855327 - RNA, 22 nt, Human
gggggucuccugcugugccucu

SEQ ID NO: 855328 - RNA, 19 nt, Human
gggucuccugcugugccuc

SEQ ID NO: 855329 - RNA, 20 nt, Human
gggucuccugcugugccucu

SEQ ID NO: 855330 - RNA, 22 nt, Human
gggucuugcugugucacccagg

SEQ ID NO: 855331 - RNA, 22 nt, Human
ggguggcgauggggugggagac

SEQ ID NO: 855332 - RNA, 24 nt, Human
ggguucucggccccgcgacagccu

SEQ ID NO: 855333 - RNA, 24 nt, Human
gugauccucuugccucagcuucuu

SEQ ID NO: 855334 - RNA, 21 nt, Human
gugccgccuagagauggggug

SEQ ID NO: 855335 - RNA, 18 nt, Human
guggagauggggucuugc

SEQ ID NO: 855336 - RNA, 22 nt, Human
uacaggcaugagccaccgcacc

SEQ ID NO: 855337 - RNA, 21 nt, Human
uagagauggggugaccuggug

SEQ ID NO: 855338 - RNA, 22 nt, Human
uagagauggggugaccugguga

SEQ ID NO: 855339 - RNA, 19 nt, Human
ucaccagggcacguccccg

SEQ ID NO: 855340 - RNA, 20 nt, Human
ucagcuucuuggguagcugg

SEQ ID NO: 855341 - RNA, 24 nt, Human
uccaugaccucggccuaggccaag

SEQ ID NO: 855342 - RNA, 24 nt, Human
ucccaaagcacugggauuacaggc

SEQ ID NO: 855343 - RNA, 26 nt, Human
uccccaggcuguccuccucgggcuug

SEQ ID NO: 855344 - RNA, 23 nt, Human
ucccgccacccacagccucgcag

SEQ ID NO: 855345 - RNA, 22 nt, Human
ucccugcagccucgaccuucug

SEQ ID NO: 855346 - RNA, 23 nt, Human
ucccugcagccucgaccuucugg

SEQ ID NO: 855347 - RNA, 24 nt, Human
ucccugcagccucgaccuucuggg

SEQ ID NO: 855348 - RNA, 23 nt, Human
ucggaggcccccacgcccaauua

SEQ ID NO: 855349 - RNA, 18 nt, Human
ucgggcuugggggggucu

SEQ ID NO: 855350 - RNA, 24 nt, Human
ucucugugacugucacggccgccc

SEQ ID NO: 855351 - RNA, 22 nt, Human
ucucugugugugucaccguccc

SEQ ID NO: 855352 - RNA, 23 nt, Human
ucucugugugugucaccgucccu

SEQ ID NO: 855353 - RNA, 21 nt, Human
ucugcauccccaggcuguccu

SEQ ID NO: 855354 - RNA, 24 nt, Human
ucuggcucuguugcacaggcugga

SEQ ID NO: 855355 - RNA, 20 nt, Human
ucugggcucaagugauccuc

SEQ ID NO: 855356 - RNA, 18 nt, Human
ucugucccgggagguggc

SEQ ID NO: 855357 - RNA, 24 nt, Human
ucuguugcacaggcuggagugcag

SEQ ID NO: 855358 - RNA, 19 nt, Human
ucuugcugugucacccagg

SEQ ID NO: 855359 - RNA, 23 nt, Human
ucuugcugugucacccaggcugg

SEQ ID NO: 855360 - RNA, 24 nt, Human
ucuugcugugucacccaggcuggu

SEQ ID NO: 855361 - RNA, 24 nt, Human
ucuuggguagcugggaugacaggu

SEQ ID NO: 855362 - RNA, 20 nt, Human
ugaaaggcagcuccauccac

SEQ ID NO: 855363 - RNA, 19 nt, Human
ugaggccccaggaggggag

SEQ ID NO: 855364 - RNA, 19 nt, Human
ugaucacagcucccugcag

SEQ ID NO: 855365 - RNA, 20 nt, Human
ugcacagggccuggggucug

SEQ ID NO: 855366 - RNA, 18 nt, Human
ugcccgagguccagggca

SEQ ID NO: 855367 - RNA, 22 nt, Human
ugcccuggugccgcacuucugu

SEQ ID NO: 855368 - RNA, 21 nt, Human
ugccucagcuucuuggguagc

SEQ ID NO: 855369 - RNA, 22 nt, Human
ugccucagcuucuuggguagcu

SEQ ID NO: 855370 - RNA, 24 nt, Human
ugccucagcuucuuggguagcugg

SEQ ID NO: 855371 - RNA, 21 nt, Human
ugccucagggcccccuccugc

SEQ ID NO: 855372 - RNA, 21 nt, Human
ugccucagggcccccuccugc

SEQ ID NO: 855373 - RNA, 22 nt, Human
ugccucugucugcucuuccuuc

SEQ ID NO: 855374 - RNA, 21 nt, Human
ugcucacauggcgagcacacg

SEQ ID NO: 855375 - RNA, 23 nt, Human
ugcuggccaugccuccacugggg

SEQ ID NO: 855376 - RNA, 19 nt, Human
uggagugcagcagugugau

SEQ ID NO: 855377 - RNA, 20 nt, Human
uggccuggccugaccacggu

SEQ ID NO: 855378 - RNA, 18 nt, Human
uggcugucaccagggcac

SEQ ID NO: 855379 - RNA, 18 nt, Human
ugggauuacaggcaugag

SEQ ID NO: 855380 - RNA, 19 nt, Human
ugggauuacaggcaugagc

SEQ ID NO: 855381 - RNA, 21 nt, Human
ugggauuacaggcaugagcca

SEQ ID NO: 855382 - RNA, 22 nt, Human
ugggauuacaggcaugagccac

SEQ ID NO: 855383 - RNA, 23 nt, Human
ugggauuacaggcaugagccacc

SEQ ID NO: 855384 - RNA, 24 nt, Human
ugggauuacaggcaugagccaccg

SEQ ID NO: 855385 - RNA, 24 nt, Human
ugggauuacaggcaugagccaccg

SEQ ID NO: 855386 - RNA, 21 nt, Human
ugggccgaggagggggcccgg

SEQ ID NO: 855387 - RNA, 22 nt, Human
ugggccgaggagggggcccggg

SEQ ID NO: 855388 - RNA, 24 nt, Human
ugggcucaagugauccucuugccu

SEQ ID NO: 855389 - RNA, 23 nt, Human
uggggaccuggcuuccugccuaa

SEQ ID NO: 855390 - RNA, 24 nt, Human
uggggucuugcugugucacccagg

SEQ ID NO: 855391 - RNA, 19 nt, Human
uggggugggagacgggaug

SEQ ID NO: 855392 - RNA, 21 nt, Human
uggucucaagcaauccuccca

SEQ ID NO: 855393 - RNA, 20 nt, Human
ugguggggagacggcugggg

SEQ ID NO: 855394 - RNA, 25 nt, Human
ugguggggagacggcugggggggcu

SEQ ID NO: 855395 - RNA, 25 nt, Human
ugguuuagcuuuaaaaaaaaaaaaa

SEQ ID NO: 855396 - RNA, 19 nt, Human
ugucacccaggcuggucuc

SEQ ID NO: 855397 - RNA, 21 nt, Human
ugucacccaggcuggucucaa

SEQ ID NO: 855398 - RNA, 25 nt, Human
uguggagauggggucuugcuguguu

SEQ ID NO: 855399 - RNA, 23 nt, Human
ugugucacccaggcuggucucaa

SEQ ID NO: 855400 - RNA, 23 nt, Human
uuaacagacaggagacugaggcc

SEQ ID NO: 855401 - RNA, 23 nt, Human
uuauuuguauugagucagggucu

SEQ ID NO: 855402 - RNA, 18 nt, Human
uuccugccuaagccccgg

SEQ ID NO: 855403 - RNA, 21 nt, Human
uuggaccacaggacuggugug

SEQ ID NO: 855404 - RNA, 23 nt, Human
uuggguagcugggaugacaggug

SEQ ID NO: 855405 - RNA, 23 nt, Human
uuuaaaaaaaaaaaaaucuuucu

SEQ ID NO: 855406 - RNA, 18 nt, Human
uuuuuuuuuuuuuuuuug

SEQ ID NO: 855407 - RNA, 23 nt, Human
uuuuuuuuuuuuuuuuuugguuu

SEQ ID NO: 855408 - RNA, 24 nt, Human
aaaacaaaacaaaacaacaaaaaa

SEQ ID NO: 855409 - RNA, 25 nt, Human
aaaacaaaacaaaacaacaaaaaag

SEQ ID NO: 855410 - RNA, 23 nt, Human
aaaacaacaaaaaaaaacaaagg

SEQ ID NO: 855411 - RNA, 20 nt, Human
aaaacuucuccaaggcucuu

SEQ ID NO: 855412 - RNA, 25 nt, Human
aaacaaaacaaaacaaaacaacaaa

SEQ ID NO: 855413 - RNA, 19 nt, Human
aaacaaaacaaaacaacaa

SEQ ID NO: 855414 - RNA, 21 nt, Human
aaacaaaacaaaacaacaaaa

SEQ ID NO: 855415 - RNA, 22 nt, Human
aaacaaaacaacaaaaaaaaac

SEQ ID NO: 855416 - RNA, 24 nt, Human
aaacaaaacaacaaaaaaaaacaa

SEQ ID NO: 855417 - RNA, 25 nt, Human
aaacaaaacaacaaaaaaaaacaaa

SEQ ID NO: 855418 - RNA, 20 nt, Human
aaacaacaacaacaacaaaa

SEQ ID NO: 855419 - RNA, 22 nt, Human
aaacaacaacaacaacaacaac

SEQ ID NO: 855420 - RNA, 23 nt, Human
aacaacaacaaaaacaaaacaaa

SEQ ID NO: 855421 - RNA, 22 nt, Human
aacaacaacaacaaaaacaaaa

SEQ ID NO: 855422 - RNA, 24 nt, Human
aacaacaacaacaaaaacaaaaca

SEQ ID NO: 855423 - RNA, 22 nt, Human
aacaacaacaacaacaacaaaa

SEQ ID NO: 855424 - RNA, 22 nt, Human
acaaaacaaaacaaaacaacaa

SEQ ID NO: 855425 - RNA, 25 nt, Human
acaaaacaaaacaaaacaacaaaaa

SEQ ID NO: 855426 - RNA, 24 nt, Human
acaaaacaacaaaaaaaaacaaag

SEQ ID NO: 855427 - RNA, 27 nt, Human
acaaaacaacaaaaaaaaacaaagguc

SEQ ID NO: 855428 - RNA, 26 nt, Human
acaacaacaacaaaaacaaaacaaaa

SEQ ID NO: 855429 - RNA, 26 nt, Human
acaacaacaacaacaaaaacaaaaca

SEQ ID NO: 855430 - RNA, 27 nt, Human
acaacaacaacaacaaaaacaaaacaa

SEQ ID NO: 855431 - RNA, 19 nt, Human
acaacaacaacaacaacaa

SEQ ID NO: 855432 - RNA, 19 nt, Human
acaacaacaacaacaacaa

SEQ ID NO: 855433 - RNA, 22 nt, Human
acaacaacaacaacaacaaaaa

SEQ ID NO: 855434 - RNA, 25 nt, Human
acaacaacaacaacaacaaaaacaa

SEQ ID NO: 855435 - RNA, 24 nt, Human
acaacaacaacaacaacaacaaaa

SEQ ID NO: 855436 - RNA, 24 nt, Human
acagaaaaaaauaaaacuucucca

SEQ ID NO: 855437 - RNA, 25 nt, Human
agaaaaaaauaaaacuucuccaagg

SEQ ID NO: 855438 - RNA, 21 nt, Human
agaaccuucuccuuaaauacu

SEQ ID NO: 855439 - RNA, 22 nt, Human
agacauuggaugugcaaaagcc

SEQ ID NO: 855440 - RNA, 24 nt, Human
caaaaacaaaacaaaacaaaacaa

SEQ ID NO: 855441 - RNA, 26 nt, Human
caaaacaaaacaacaaaaaaaaacaa

SEQ ID NO: 855442 - RNA, 19 nt, Human
caaaacagggguccccugc

SEQ ID NO: 855443 - RNA, 21 nt, Human
caaaacagggguccccugcug

SEQ ID NO: 855444 - RNA, 22 nt, Human
caaaacagggguccccugcugg

SEQ ID NO: 855445 - RNA, 23 nt, Human
caacaaaaaaaaacaaagguccc

SEQ ID NO: 855446 - RNA, 24 nt, Human
caacaaaaaaaaacaaagguccca

SEQ ID NO: 855447 - RNA, 24 nt, Human
caacaaaaaaaaacaaagguccca

SEQ ID NO: 855448 - RNA, 26 nt, Human
caacaacaaaaacaaaacaaaacaaa

SEQ ID NO: 855449 - RNA, 27 nt, Human
caacaacaaaaacaaaacaaaacaaaa

SEQ ID NO: 855450 - RNA, 30 nt, Human
caacaacaaaaacaaaacaaaacaaaacaa

SEQ ID NO: 855451 - RNA, 18 nt, Human
caacaacaacaacaacaa

SEQ ID NO: 855452 - RNA, 23 nt, Human
caauccccaaccuccacauccaa

SEQ ID NO: 855453 - RNA, 24 nt, Human
cauaccacucucacucugcacguu

SEQ ID NO: 855454 - RNA, 18 nt, Human
caugcuguggcuguucau

SEQ ID NO: 855455 - RNA, 21 nt, Human
ccaaccuccacauccaauuuu

SEQ ID NO: 855456 - RNA, 24 nt, Human
ccacucucacucugcacguucuca

SEQ ID NO: 855457 - RNA, 19 nt, Human
cccaaccuccacauccaau

SEQ ID NO: 855458 - RNA, 23 nt, Human
cccccgaguaguauaaaaaugag

SEQ ID NO: 855459 - RNA, 21 nt, Human
cuagggagaagggagauccug

SEQ ID NO: 855460 - RNA, 22 nt, Human
cuccauaaaaaggcuucugggc

SEQ ID NO: 855461 - RNA, 22 nt, Human
cuucagcuuugcaggcugggac

SEQ ID NO: 855462 - RNA, 24 nt, Human
gccuagaaccuucuccuuaaauac

SEQ ID NO: 855463 - RNA, 22 nt, Human
gcugguaaacaacaacaacaac

SEQ ID NO: 855464 - RNA, 23 nt, Human
gugcuguugcuccacagcugaca

SEQ ID NO: 855465 - RNA, 18 nt, Human
uaaaaaggcuucugggca

SEQ ID NO: 855466 - RNA, 21 nt, Human
uagacaaaacagggguccccu

SEQ ID NO: 855467 - RNA, 22 nt, Human
uauucuuuccaaacagaaaaaa

SEQ ID NO: 855468 - RNA, 23 nt, Human
ucauaccacucucacucugcacg

SEQ ID NO: 855469 - RNA, 22 nt, Human
ucaugcugcuguuacugacugu

SEQ ID NO: 855470 - RNA, 26 nt, Human
uccacagcugacaaauaccauagaaa

SEQ ID NO: 855471 - RNA, 22 nt, Human
uccacaugacagcaaacagaac

SEQ ID NO: 855472 - RNA, 20 nt, Human
uccccaaccuccacauccaa

SEQ ID NO: 855473 - RNA, 22 nt, Human
ucucaauucugaaccacaugcu

SEQ ID NO: 855474 - RNA, 25 nt, Human
ucucuguaacaugccccaaugacuc

SEQ ID NO: 855475 - RNA, 26 nt, Human
ucuuuugccuggucuuuguucuugac

SEQ ID NO: 855476 - RNA, 18 nt, Human
ugaaccacaugcuuuaag

SEQ ID NO: 855477 - RNA, 19 nt, Human
ugacuguaguucccuccuu

SEQ ID NO: 855478 - RNA, 19 nt, Human
ugcucuggguauucuuucc

SEQ ID NO: 855479 - RNA, 22 nt, Human
ugggaaaagcauaucaaaaaca

SEQ ID NO: 855480 - RNA, 18 nt, Human
uggguuccugacuucagc

SEQ ID NO: 855481 - RNA, 23 nt, Human
uguaaaugcggcuugacauuucu

SEQ ID NO: 855482 - RNA, 23 nt, Human
uguucuugacauagacaaaacag

SEQ ID NO: 855483 - RNA, 21 nt, Human
uucacaguaaucucuuaacac

SEQ ID NO: 855484 - RNA, 21 nt, Human
uucagguagcuuacaggaaaa

SEQ ID NO: 855485 - RNA, 22 nt, Human
uuccugacuucagcuuugcagg

SEQ ID NO: 855486 - RNA, 23 nt, Human
uucggaagccuagaaccuucucc

SEQ ID NO: 855487 - RNA, 23 nt, Human
uucucaauucugaaccacaugcu

SEQ ID NO: 855488 - RNA, 19 nt, Human
uucuccaaggcucuuuucu

SEQ ID NO: 855489 - RNA, 18 nt, Human
uuuccuggucugaauuuc

SEQ ID NO: 855490 - RNA, 18 nt, Human
uuucucaucucuacaaug

SEQ ID NO: 855491 - RNA, 24 nt, Human
uuuguaaaugcggcuugacauuuc

SEQ ID NO: 855492 - RNA, 19 nt, Human
uuuucugaauuuuacugaa

SEQ ID NO: 855493 - RNA, 18 nt, Human
uuuuuuuuuuuuuugcgg

SEQ ID NO: 855494 - RNA, 18 nt, Human
uuuuuuuuuuuuuuuuug

SEQ ID NO: 855495 - RNA, 19 nt, Human
uuuuuuuuuuuuuuuuugc

SEQ ID NO: 855496 - RNA, 27 nt, Human
uuuuuuuuuuuuuuuuugcgguagggg

SEQ ID NO: 855497 - RNA, 25 nt, Human
uuuuuuuuuuuuuuuuuugcgguag

SEQ ID NO: 855498 - RNA, 22 nt, Human
agcccaaugagagacacagcuu

SEQ ID NO: 855499 - RNA, 22 nt, Human
agcucgcgguucucccugcagc

SEQ ID NO: 855500 - RNA, 22 nt, Human
aucccaccucuuuggagcccaa

SEQ ID NO: 855501 - RNA, 20 nt, Human
auggaagucacaccugcccc

SEQ ID NO: 855502 - RNA, 19 nt, Human
caccgggucucagugagcc

SEQ ID NO: 855503 - RNA, 21 nt, Human
caccugccccccggaggcaaa

SEQ ID NO: 855504 - RNA, 19 nt, Human
cccccggaggcaaagccuu

SEQ ID NO: 855505 - RNA, 19 nt, Human
ccccugagagcucgcgguu

SEQ ID NO: 855506 - RNA, 19 nt, Human
cccgcagagcgcguuccuc

SEQ ID NO: 855507 - RNA, 18 nt, Human
cgcagagcgcguuccucg

SEQ ID NO: 855508 - RNA, 22 nt, Human
cugagagcucgcgguucucccu

SEQ ID NO: 855509 - RNA, 20 nt, Human
cuggggccgcuuacuugugg

SEQ ID NO: 855510 - RNA, 20 nt, Human
gagcugcaggacagcuggcu

SEQ ID NO: 855511 - RNA, 18 nt, Human
gcagagcgcguuccucgc

SEQ ID NO: 855512 - RNA, 20 nt, Human
ggcugcacccagcccugggc

SEQ ID NO: 855513 - RNA, 19 nt, Human
uagacuguauauaagaaau

SEQ ID NO: 855514 - RNA, 19 nt, Human
uagacuuguccuucugggg

SEQ ID NO: 855515 - RNA, 23 nt, Human
ucaguucugugcuggucucccca

SEQ ID NO: 855516 - RNA, 20 nt, Human
ucccaccucuuuggagccca

SEQ ID NO: 855517 - RNA, 19 nt, Human
ucuggaccaccgggucuca

SEQ ID NO: 855518 - RNA, 21 nt, Human
ucuggaccaccgggucucagu

SEQ ID NO: 855519 - RNA, 22 nt, Human
ucugugcuggucuccccagagc

SEQ ID NO: 855520 - RNA, 22 nt, Human
ugaaauggaagucacaccugcc

SEQ ID NO: 855521 - RNA, 22 nt, Human
uggagcccaaugagagacacag

SEQ ID NO: 855522 - RNA, 24 nt, Human
uggcaggcacugaugaaauggaag

SEQ ID NO: 855523 - RNA, 21 nt, Human
ugugguuggggacuucggggc

SEQ ID NO: 855524 - RNA, 18 nt, Human
uucugugcuggucucccc

SEQ ID NO: 855525 - RNA, 21 nt, Human
uuuaaaaaaucccaccucuuu

SEQ ID NO: 855526 - RNA, 19 nt, Human
acagcagccccaaaggggc

SEQ ID NO: 855527 - RNA, 21 nt, Human
acccaauccguccaccagcgu

SEQ ID NO: 855528 - RNA, 23 nt, Human
agagcuggguccacuuuggcuuu

SEQ ID NO: 855529 - RNA, 23 nt, Human
auacuccuccucuucuuuggaga

SEQ ID NO: 855530 - RNA, 23 nt, Human
aucaacaccaacuccuugcaccc

SEQ ID NO: 855531 - RNA, 21 nt, Human
cagcagccccaaaggggcagg

SEQ ID NO: 855532 - RNA, 21 nt, Human
ccagcguccccuccaauuucc

SEQ ID NO: 855533 - RNA, 21 nt, Human
cccaggggagcccccuuugcc

SEQ ID NO: 855534 - RNA, 24 nt, Human
cccaguucuguaacuuucuccccu

SEQ ID NO: 855535 - RNA, 22 nt, Human
cuccuccaucaacaccaacucc

SEQ ID NO: 855536 - RNA, 19 nt, Human
cucuggcguccugcuccuc

SEQ ID NO: 855537 - RNA, 20 nt, Human
cuggguccacuuuggcuuug

SEQ ID NO: 855538 - RNA, 19 nt, Human
gaggggucccggcccuggc

SEQ ID NO: 855539 - RNA, 21 nt, Human
ggaauccgaggggucccggcc

SEQ ID NO: 855540 - RNA, 25 nt, Human
ggagcccccuuugcccacgguuccu

SEQ ID NO: 855541 - RNA, 23 nt, Human
gggcaggaaccugggaauccgag

SEQ ID NO: 855542 - RNA, 19 nt, Human
ggggaugaggaagcccacc

SEQ ID NO: 855543 - RNA, 22 nt, Human
ggggaugaggaagcccaccugg

SEQ ID NO: 855544 - RNA, 23 nt, Human
uccguccaccagcguccccucca

SEQ ID NO: 855545 - RNA, 22 nt, Human
ucucccagagagcuggguccac

SEQ ID NO: 855546 - RNA, 21 nt, Human
ucugaacgguuccagggcugg

SEQ ID NO: 855547 - RNA, 24 nt, Human
ucugaacgguuccagggcugggac

SEQ ID NO: 855548 - RNA, 23 nt, Human
uggagaugaagucagggacauag

SEQ ID NO: 855549 - RNA, 19 nt, Human
ugggaauccgagggguccc

SEQ ID NO: 855550 - RNA, 23 nt, Human
ugguauggggucuucuguagcuc

SEQ ID NO: 855551 - RNA, 18 nt, Human
uuggagaugaagucaggg

SEQ ID NO: 855552 - RNA, 21 nt, Human
uuggggcauuaaaaaccuguc

SEQ ID NO: 855553 - RNA, 26 nt, Human
uuuuuuuuuuuuuaaagauuuuuuug

SEQ ID NO: 855554 - RNA, 22 nt, Human
uuuuuuuuuuuuuuuuuuaaag

SEQ ID NO: 855555 - RNA, 22 nt, Human
aaaaagcuucaguuccugcuaa

SEQ ID NO: 855556 - RNA, 23 nt, Human
aaaauccuuuuaucggccugccu

SEQ ID NO: 855557 - RNA, 18 nt, Human
aaauaccaugccaauuca

SEQ ID NO: 855558 - RNA, 30 nt, Human
aaccugguggaugcuccaaaaucgaaccag

SEQ ID NO: 855559 - RNA, 20 nt, Human
aagguggggaaguuagaaaa

SEQ ID NO: 855560 - RNA, 19 nt, Human
acacaguacucuucagccu

SEQ ID NO: 855561 - RNA, 19 nt, Human
accgcagccuugcagagug

SEQ ID NO: 855562 - RNA, 20 nt, Human
agaagccgauuuguggacag

SEQ ID NO: 855563 - RNA, 24 nt, Human
agaggcaguuggccucuggcccua

SEQ ID NO: 855564 - RNA, 20 nt, Human
agcaguggaucucacuguua

SEQ ID NO: 855565 - RNA, 23 nt, Human
agccucagccccucaccgcagcc

SEQ ID NO: 855566 - RNA, 20 nt, Human
agccucugacccuuuacccu

SEQ ID NO: 855567 - RNA, 20 nt, Human
auucaaaauaccaugccaau

SEQ ID NO: 855568 - RNA, 20 nt, Human
caaaacacuaccaugaauaa

SEQ ID NO: 855569 - RNA, 23 nt, Human
caaaauaccaugccaauucagac

SEQ ID NO: 855570 - RNA, 24 nt, Human
caaaaucgaaccaaaacacuacca

SEQ ID NO: 855571 - RNA, 21 nt, Human
caccaggcagccagccucagc

SEQ ID NO: 855572 - RNA, 20 nt, Human
caccgcagccuugcagagug

SEQ ID NO: 855573 - RNA, 21 nt, Human
caccugaugaugagucaacca

SEQ ID NO: 855574 - RNA, 18 nt, Human
cacuaccaugaauaagag

SEQ ID NO: 855575 - RNA, 21 nt, Human
cacugucagggugcuggcacc

SEQ ID NO: 855576 - RNA, 22 nt, Human
cagagaagccgauuuguggaca

SEQ ID NO: 855577 - RNA, 23 nt, Human
caggagacauccacucaaaccac

SEQ ID NO: 855578 - RNA, 21 nt, Human
caguggaucucacuguuaucc

SEQ ID NO: 855579 - RNA, 18 nt, Human
caugaauaagagaugacu

SEQ ID NO: 855580 - RNA, 23 nt, Human
cauucaaaauaccaugccaauuc

SEQ ID NO: 855581 - RNA, 22 nt, Human
ccaaaauaaagacagagaucau

SEQ ID NO: 855582 - RNA, 23 nt, Human
ccaauucagacuuuuuuaaaaca

SEQ ID NO: 855583 - RNA, 24 nt, Human
ccaccaggcagccagccucagccc

SEQ ID NO: 855584 - RNA, 24 nt, Human
ccuaagugggccuuauacuaaaaa

SEQ ID NO: 855585 - RNA, 18 nt, Human
ccucaccgcagccuugca

SEQ ID NO: 855586 - RNA, 25 nt, Human
ccucccccaaaauaaagacagagau

SEQ ID NO: 855587 - RNA, 24 nt, Human
ccuuccugugaaacccaagucaaa

SEQ ID NO: 855588 - RNA, 18 nt, Human
cgauuuguggacagugcc

SEQ ID NO: 855589 - RNA, 20 nt, Human
cuaaaaagcuucaguuccug

SEQ ID NO: 855590 - RNA, 18 nt, Human
gaaacaccugaugaugag

SEQ ID NO: 855591 - RNA, 21 nt, Human
gaacagucccaagaaggccgg

SEQ ID NO: 855592 - RNA, 18 nt, Human
gaaguuagaaaaauagaa

SEQ ID NO: 855593 - RNA, 19 nt, Human
gacacugucagggugcugg

SEQ ID NO: 855594 - RNA, 23 nt, Human
gauuuguggacagugccacccuc

SEQ ID NO: 855595 - RNA, 21 nt, Human
gcaacccuagaggcaguuggc

SEQ ID NO: 855596 - RNA, 21 nt, Human
gcagagugggcucugcagaga

SEQ ID NO: 855597 - RNA, 23 nt, Human
gccuugcagagugggcucugcag

SEQ ID NO: 855598 - RNA, 22 nt, Human
gcuggcacccuaagugggccuu

SEQ ID NO: 855599 - RNA, 21 nt, Human
ggccccuucuaggugcagcug

SEQ ID NO: 855600 - RNA, 19 nt, Human
ggugcuggcacccuaagug

SEQ ID NO: 855601 - RNA, 19 nt, Human
guggaucucacuguuaucc

SEQ ID NO: 855602 - RNA, 20 nt, Human
guuggccucuggcccuagcc

SEQ ID NO: 855603 - RNA, 24 nt, Human
uaaaagcaccuucugauccuugac

SEQ ID NO: 855604 - RNA, 20 nt, Human
uaccaugaauaagagaugac

SEQ ID NO: 855605 - RNA, 26 nt, Human
uacuaaaaagcuucaguuccugcuaa

SEQ ID NO: 855606 - RNA, 20 nt, Human
uagaagacgggauccuugga

SEQ ID NO: 855607 - RNA, 22 nt, Human
uagcaggagcaggaucucaggc

SEQ ID NO: 855608 - RNA, 19 nt, Human
ucaaaccaccuguuacuga

SEQ ID NO: 855609 - RNA, 23 nt, Human
ucaccgcagccuugcagaguggg

SEQ ID NO: 855610 - RNA, 20 nt, Human
uccagcagcauucaaaauac

SEQ ID NO: 855611 - RNA, 23 nt, Human
ucccaccaggcagccagccucag

SEQ ID NO: 855612 - RNA, 20 nt, Human
ucccccaaaauaaagacaga

SEQ ID NO: 855613 - RNA, 22 nt, Human
ucucacuguuauccugugacug

SEQ ID NO: 855614 - RNA, 24 nt, Human
ugacugcacuccucugacacaacu

SEQ ID NO: 855615 - RNA, 22 nt, Human
ugcuccaaaaucgaaccaaaac

SEQ ID NO: 855616 - RNA, 24 nt, Human
uggaucucacuguuauccugugac

SEQ ID NO: 855617 - RNA, 19 nt, Human
uggcacccuaagugggccu

SEQ ID NO: 855618 - RNA, 22 nt, Human
uuacugaggcaccaagcaaccc

SEQ ID NO: 855619 - RNA, 23 nt, Human
uuauuacaguuccagcagcauuc

SEQ ID NO: 855620 - RNA, 21 nt, Human
uucaaaauaccaugccaauuc

SEQ ID NO: 855621 - RNA, 20 nt, Human
uuuuuuuuuuuuuaaaggug

SEQ ID NO: 855622 - RNA, 22 nt, Human
uuuuuuuuuuuuuuuuuaaagg

SEQ ID NO: 855623 - RNA, 21 nt, Human
aaagccccuccaccccucccu

SEQ ID NO: 855624 - RNA, 22 nt, Human
aaagccccuccaccccucccug

SEQ ID NO: 855625 - RNA, 24 nt, Human
accccgcagggcgcaggaaagaaa

SEQ ID NO: 855626 - RNA, 27 nt, Human
cacggcucggccucuuguuucugcggc

SEQ ID NO: 855627 - RNA, 22 nt, Human
ccacccucugggcagugcgagu

SEQ ID NO: 855628 - RNA, 24 nt, Human
ccaccggaccccgcagggcgcagg

SEQ ID NO: 855629 - RNA, 18 nt, Human
ccccugggaaggggauga

SEQ ID NO: 855630 - RNA, 19 nt, Human
ccccugggaaggggaugag

SEQ ID NO: 855631 - RNA, 19 nt, Human
ccuccaccccucccuggug

SEQ ID NO: 855632 - RNA, 19 nt, Human
ccucugggcagugcgaguu

SEQ ID NO: 855633 - RNA, 24 nt, Human
cuccugguauccaccggaccccgc

SEQ ID NO: 855634 - RNA, 21 nt, Human
cuguauuucgggacgguggca

SEQ ID NO: 855635 - RNA, 23 nt, Human
gccccuccaccccucccuggugg

SEQ ID NO: 855636 - RNA, 19 nt, Human
gcugcagcuuaggcggcgg

SEQ ID NO: 855637 - RNA, 19 nt, Human
ggaaagaaagccccuccac

SEQ ID NO: 855638 - RNA, 18 nt, Human
uuuuuuuuuuaaggcaaa

SEQ ID NO: 855639 - RNA, 23 nt, Human
uuuuuuuuuuuuuuuuuuuaagg

SEQ ID NO: 855640 - RNA, 24 nt, Human
aacaagacuggaaauaguuuagaa

SEQ ID NO: 855641 - RNA, 23 nt, Human
aagccaagacacagauggaaaga

SEQ ID NO: 855642 - RNA, 27 nt, Human
agaaaagaaaugaaaaccggucgcgga

SEQ ID NO: 855643 - RNA, 18 nt, Human
auggaguggccggggcgg

SEQ ID NO: 855644 - RNA, 25 nt, Human
caagacacagauggaaagagacuaa

SEQ ID NO: 855645 - RNA, 19 nt, Human
cagugccugauggaguggc

SEQ ID NO: 855646 - RNA, 22 nt, Human
ccaagacacagauggaaagaga

SEQ ID NO: 855647 - RNA, 23 nt, Human
cccgggagcuggcggcgguggcg

SEQ ID NO: 855648 - RNA, 21 nt, Human
cgacugaagaagccaagacac

SEQ ID NO: 855649 - RNA, 23 nt, Human
cgcggccaggcagcccgggcgcc

SEQ ID NO: 855650 - RNA, 25 nt, Human
cggguccccucgccaugggcucaga

SEQ ID NO: 855651 - RNA, 23 nt, Human
cgguggcggggcggcgggggugg

SEQ ID NO: 855652 - RNA, 22 nt, Human
cucccuagcugcgcgcggugcc

SEQ ID NO: 855653 - RNA, 22 nt, Human
cucgacucggcuccggcucugc

SEQ ID NO: 855654 - RNA, 21 nt, Human
gaaaugaaaaccggucgcgga

SEQ ID NO: 855655 - RNA, 22 nt, Human
gcggccaggcagcccgggcgcc

SEQ ID NO: 855656 - RNA, 21 nt, Human
gcgguggcggcggguccccuc

SEQ ID NO: 855657 - RNA, 21 nt, Human
gcgguggcgggcagcgcggag

SEQ ID NO: 855658 - RNA, 24 nt, Human
gcuggcggcgguggcggggcggcg

SEQ ID NO: 855659 - RNA, 18 nt, Human
ggaggcgguggcggcggg

SEQ ID NO: 855660 - RNA, 19 nt, Human
ggcggcggggguggaggcg

SEQ ID NO: 855661 - RNA, 18 nt, Human
ggcggcgguggcggggcg

SEQ ID NO: 855662 - RNA, 19 nt, Human
ggcggggguggaggcggug

SEQ ID NO: 855663 - RNA, 21 nt, Human
gggagcuggcggcgguggcgg

SEQ ID NO: 855664 - RNA, 21 nt, Human
ggggguggaggcgguggcggc

SEQ ID NO: 855665 - RNA, 23 nt, Human
ggggguggaggcgguggcggcgg

SEQ ID NO: 855666 - RNA, 23 nt, Human
gggguggaggcgguggcggcgac

SEQ ID NO: 855667 - RNA, 24 nt, Human
ggguccccucgccaugggcucaga

SEQ ID NO: 855668 - RNA, 24 nt, Human
ggguggaggcgguggcggcggguc

SEQ ID NO: 855669 - RNA, 18 nt, Human
guggcggggcggcggggg

SEQ ID NO: 855670 - RNA, 21 nt, Human
uaaaccgacugaagaagccaa

SEQ ID NO: 855671 - RNA, 23 nt, Human
uaaaccgacugaagaagccaaga

SEQ ID NO: 855672 - RNA, 24 nt, Human
ucagugccugauggaguggccggg

SEQ ID NO: 855673 - RNA, 27 nt, Human
ucagugccugauggaguggccggggcg

SEQ ID NO: 855674 - RNA, 19 nt, Human
ucgccgcgguucucggcuc

SEQ ID NO: 855675 - RNA, 19 nt, Human
ugcccaccgcggcccagag

SEQ ID NO: 855676 - RNA, 20 nt, Human
ugcccgggagcuggcggcgg

SEQ ID NO: 855677 - RNA, 23 nt, Human
ugcccgggagcuggcggcggugg

SEQ ID NO: 855678 - RNA, 22 nt, Human
uggaaagagacuaagaacaaga

SEQ ID NO: 855679 - RNA, 24 nt, Human
uggaaagagacuaagaacaagacu

SEQ ID NO: 855680 - RNA, 18 nt, Human
uggaggcgguggcggcgg

SEQ ID NO: 855681 - RNA, 18 nt, Human
uggccgaggcgguggcgg

SEQ ID NO: 855682 - RNA, 20 nt, Human
uggcggcgguggcggggcgg

SEQ ID NO: 855683 - RNA, 22 nt, Human
aagcccgcucgcugcucccccg

SEQ ID NO: 855684 - RNA, 18 nt, Human
acccgggacaggccugug

SEQ ID NO: 855685 - RNA, 19 nt, Human
agggcgggcgggcgggcgc

SEQ ID NO: 855686 - RNA, 21 nt, Human
cagaauggaaggccaaaggca

SEQ ID NO: 855687 - RNA, 22 nt, Human
cagagcgcugggaacagacgcg

SEQ ID NO: 855688 - RNA, 21 nt, Human
cauugggccuggcaaauaccu

SEQ ID NO: 855689 - RNA, 22 nt, Human
ccagggaaagcagggccagcaa

SEQ ID NO: 855690 - RNA, 24 nt, Human
cccccgcugcccgggcagcucaga

SEQ ID NO: 855691 - RNA, 18 nt, Human
ccccuccuuuuccugucc

SEQ ID NO: 855692 - RNA, 24 nt, Human
cccgcugcccgggcagcucagaca

SEQ ID NO: 855693 - RNA, 18 nt, Human
ccgcagggcgggcgggcg

SEQ ID NO: 855694 - RNA, 24 nt, Human
ccgggacaggccugugccuucucc

SEQ ID NO: 855695 - RNA, 18 nt, Human
ccuggcaaauaccuacca

SEQ ID NO: 855696 - RNA, 21 nt, Human
ccuggcaaauaccuaccaggg

SEQ ID NO: 855697 - RNA, 21 nt, Human
cugacaucuaaagcaaaguau

SEQ ID NO: 855698 - RNA, 21 nt, Human
cugcucccccgcugcccgggc

SEQ ID NO: 855699 - RNA, 19 nt, Human
gauucuggacagguugcuc

SEQ ID NO: 855700 - RNA, 20 nt, Human
gcgggcgggcgggcgcgggg

SEQ ID NO: 855701 - RNA, 18 nt, Human
gcucgcggaagcccgcuc

SEQ ID NO: 855702 - RNA, 23 nt, Human
ggaccgcagggcgggcgggcggg

SEQ ID NO: 855703 - RNA, 24 nt, Human
ggaccgcagggcgggcgggcgggc

SEQ ID NO: 855704 - RNA, 19 nt, Human
ggcgggcgggcgcgggggc

SEQ ID NO: 855705 - RNA, 18 nt, Human
gggacccgggacaggccu

SEQ ID NO: 855706 - RNA, 20 nt, Human
gggcgggcgggcgcgggggc

SEQ ID NO: 855707 - RNA, 21 nt, Human
gggcgggcgggcgcgggggcc

SEQ ID NO: 855708 - RNA, 22 nt, Human
uccuccuuuuuaggccucgcag

SEQ ID NO: 855709 - RNA, 20 nt, Human
ugggaacagacgcgcagacc

SEQ ID NO: 855710 - RNA, 20 nt, Human
uugggucaaaaggcugcugg

SEQ ID NO: 855711 - RNA, 22 nt, Human
uuuuuuuuuuuuuuuuuuacaa

SEQ ID NO: 855712 - RNA, 23 nt, Human
aaaaacaagcagccccuggccua

SEQ ID NO: 855713 - RNA, 25 nt, Human
aagagaagggaaucacaacacagaa

SEQ ID NO: 855714 - RNA, 23 nt, Human
aagcucacagcacgugccccugg

SEQ ID NO: 855715 - RNA, 25 nt, Human
agaagaacacacacggcuccacaaa

SEQ ID NO: 855716 - RNA, 19 nt, Human
agaagggaaucacaacaca

SEQ ID NO: 855717 - RNA, 19 nt, Human
agcagugagcacaaccugg

SEQ ID NO: 855718 - RNA, 20 nt, Human
aggagaggaggccccggggc

SEQ ID NO: 855719 - RNA, 27 nt, Human
agggccccuuggggggaaguggggggc

SEQ ID NO: 855720 - RNA, 20 nt, Human
agucauggucaccaucgcug

SEQ ID NO: 855721 - RNA, 21 nt, Human
agugagcacaaccugggcucc

SEQ ID NO: 855722 - RNA, 21 nt, Human
aucacaacacagaagcugcaa

SEQ ID NO: 855723 - RNA, 20 nt, Human
caacacagaagcugcaaaug

SEQ ID NO: 855724 - RNA, 20 nt, Human
caagcagccccuggccuaga

SEQ ID NO: 855725 - RNA, 20 nt, Human
cacaacacagaagcugcaaa

SEQ ID NO: 855726 - RNA, 21 nt, Human
caccgggaagguggugguggg

SEQ ID NO: 855727 - RNA, 22 nt, Human
cacggcuccacaaaaacaagca

SEQ ID NO: 855728 - RNA, 18 nt, Human
cagccccacuccaucccg

SEQ ID NO: 855729 - RNA, 20 nt, Human
cagccccuggccuagaucua

SEQ ID NO: 855730 - RNA, 26 nt, Human
caggacacaggucgggaccccccucc

SEQ ID NO: 855731 - RNA, 21 nt, Human
cagggcccugcugccugagag

SEQ ID NO: 855732 - RNA, 19 nt, Human
ccacaaaaacaagcagccc

SEQ ID NO: 855733 - RNA, 20 nt, Human
ccacaaaaacaagcagcccc

SEQ ID NO: 855734 - RNA, 19 nt, Human
ccauuugguauuaaaugug

SEQ ID NO: 855735 - RNA, 24 nt, Human
ccccuggcacuggaggggcgccuc

SEQ ID NO: 855736 - RNA, 20 nt, Human
cccucggagccuauuugccc

SEQ ID NO: 855737 - RNA, 20 nt, Human
cccuggugccuucuuuccgc

SEQ ID NO: 855738 - RNA, 19 nt, Human
cccuuggggggaagugggg

SEQ ID NO: 855739 - RNA, 21 nt, Human
cccuuggggggaagugggggg

SEQ ID NO: 855740 - RNA, 19 nt, Human
ccuagaucuacgcagggaa

SEQ ID NO: 855741 - RNA, 20 nt, Human
ccuccccccaccccauuugg

SEQ ID NO: 855742 - RNA, 23 nt, Human
ccuggcacuggaggggcgccucc

SEQ ID NO: 855743 - RNA, 18 nt, Human
ccuggccccgccuccgcc

SEQ ID NO: 855744 - RNA, 20 nt, Human
ccuggccccgccuccgccug

SEQ ID NO: 855745 - RNA, 23 nt, Human
cgauacgggagagcagugagcac

SEQ ID NO: 855746 - RNA, 18 nt, Human
cgccuccgccugucucca

SEQ ID NO: 855747 - RNA, 23 nt, Human
cgcugggcugccuccccagcccc

SEQ ID NO: 855748 - RNA, 23 nt, Human
cggcuccacaaaaacaagcagcc

SEQ ID NO: 855749 - RNA, 22 nt, Human
cgggaccccccuccuccugggg

SEQ ID NO: 855750 - RNA, 19 nt, Human
cgggaugaguguccacugu

SEQ ID NO: 855751 - RNA, 18 nt, Human
cuaggaaacucaguaaca

SEQ ID NO: 855752 - RNA, 21 nt, Human
cucgcgcugggcugccucccc

SEQ ID NO: 855753 - RNA, 19 nt, Human
cuggugccuucuuuccgcc

SEQ ID NO: 855754 - RNA, 30 nt, Human
gaccccccuccuccugggggaacacccacc

SEQ ID NO: 855755 - RNA, 19 nt, Human
gaggaggagaggaggcccc

SEQ ID NO: 855756 - RNA, 21 nt, Human
gccaaagcacaaaguucacug

SEQ ID NO: 855757 - RNA, 20 nt, Human
gccagugccgggcugacacg

SEQ ID NO: 855758 - RNA, 27 nt, Human
gcccuggugccuucuuuccgccaucuc

SEQ ID NO: 855759 - RNA, 23 nt, Human
ggagaggaggccccggggcccuc

SEQ ID NO: 855760 - RNA, 20 nt, Human
ggaggagaggaggccccggg

SEQ ID NO: 855761 - RNA, 20 nt, Human
gggaaggugguggugggcag

SEQ ID NO: 855762 - RNA, 21 nt, Human
gggaaggugguggugggcagg

SEQ ID NO: 855763 - RNA, 19 nt, Human
gggaggacucgcgcugggc

SEQ ID NO: 855764 - RNA, 23 nt, Human
gguggugggcagggccccuuggg

SEQ ID NO: 855765 - RNA, 25 nt, Human
ucagacagccccacuccaucccggg

SEQ ID NO: 855766 - RNA, 22 nt, Human
ucauggucaccaucgcugucac

SEQ ID NO: 855767 - RNA, 21 nt, Human
uccacaaaaacaagcagcccc

SEQ ID NO: 855768 - RNA, 18 nt, Human
uccacugugcccuggugc

SEQ ID NO: 855769 - RNA, 20 nt, Human
uccagggcccugcugccuga

SEQ ID NO: 855770 - RNA, 25 nt, Human
ucccacagucauggucaccaucgcu

SEQ ID NO: 855771 - RNA, 18 nt, Human
ucccgggacugcgcuggg

SEQ ID NO: 855772 - RNA, 19 nt, Human
ucuccagggcccugcugcc

SEQ ID NO: 855773 - RNA, 18 nt, Human
ugacacgaggggcaggau

SEQ ID NO: 855774 - RNA, 18 nt, Human
ugagaggaggagaggagg

SEQ ID NO: 855775 - RNA, 20 nt, Human
ugagaggaggagaggaggcc

SEQ ID NO: 855776 - RNA, 24 nt, Human
ugccccuggcacuggaggggcgcc

SEQ ID NO: 855777 - RNA, 24 nt, Human
ugccgggcugacacgaggggcaac

SEQ ID NO: 855778 - RNA, 18 nt, Human
ugccuccccagccccaac

SEQ ID NO: 855779 - RNA, 24 nt, Human
uggaacgccaaagcacaaaguuca

SEQ ID NO: 855780 - RNA, 24 nt, Human
uggaggggcgccuccccccacccc

SEQ ID NO: 855781 - RNA, 21 nt, Human
ugggggaacacccaccccaau

SEQ ID NO: 855782 - RNA, 21 nt, Human
ugguggugggcagggccccuu

SEQ ID NO: 855783 - RNA, 23 nt, Human
ugguggugggcagggccccuugg

SEQ ID NO: 855784 - RNA, 24 nt, Human
uuuuuuuuuuuuuuuuuaacacug

SEQ ID NO: 855785 - RNA, 18 nt, Human
aaaaaggcuucuaagccc

SEQ ID NO: 855786 - RNA, 21 nt, Human
aaagguauccaagccccagga

SEQ ID NO: 855787 - RNA, 18 nt, Human
aaggaaggagagaaacga

SEQ ID NO: 855788 - RNA, 22 nt, Human
aaguuaaauuacacagcagcuu

SEQ ID NO: 855789 - RNA, 23 nt, Human
acagcagcuuuacacagcaugag

SEQ ID NO: 855790 - RNA, 19 nt, Human
acuuggaaagguauccaag

SEQ ID NO: 855791 - RNA, 20 nt, Human
agaauagaggagaagauggg

SEQ ID NO: 855792 - RNA, 20 nt, Human
agaggagaagauggggaagu

SEQ ID NO: 855793 - RNA, 22 nt, Human
agaggagaagauggggaagugg

SEQ ID NO: 855794 - RNA, 19 nt, Human
agagucccuggauaaagcu

SEQ ID NO: 855795 - RNA, 31 nt, Human
aggaaggaaggagagaaacgaggagaggaaa

SEQ ID NO: 855796 - RNA, 25 nt, Human
aggaaggagagaaacgaggagagga

SEQ ID NO: 855797 - RNA, 20 nt, Human
aggagaagauggggaagugg

SEQ ID NO: 855798 - RNA, 22 nt, Human
caagccccaggauaggggcagg

SEQ ID NO: 855799 - RNA, 23 nt, Human
caagccccaggauaggggcaggg

SEQ ID NO: 855800 - RNA, 24 nt, Human
caagccccaggauaggggcaggga

SEQ ID NO: 855801 - RNA, 19 nt, Human
cacccaugcugagcugagg

SEQ ID NO: 855802 - RNA, 18 nt, Human
cagcaugagauggaaagg

SEQ ID NO: 855803 - RNA, 20 nt, Human
cagcgccucccucccgcucc

SEQ ID NO: 855804 - RNA, 21 nt, Human
cagcgccucccucccgcuccc

SEQ ID NO: 855805 - RNA, 20 nt, Human
caggcccggcagcgccuccc

SEQ ID NO: 855806 - RNA, 18 nt, Human
ccaaaggggugggaaugg

SEQ ID NO: 855807 - RNA, 20 nt, Human
ccaaaggggugggaauggua

SEQ ID NO: 855808 - RNA, 24 nt, Human
ccagaauagaggagaagaugggga

SEQ ID NO: 855809 - RNA, 18 nt, Human
ccccgccugaccgcccuc

SEQ ID NO: 855810 - RNA, 21 nt, Human
cccggcagcgccucccucccg

SEQ ID NO: 855811 - RNA, 18 nt, Human
cccuccucccccuuuccu

SEQ ID NO: 855812 - RNA, 18 nt, Human
ccgcuaugcaacucaggu

SEQ ID NO: 855813 - RNA, 20 nt, Human
ccgucucugcugggggcgug

SEQ ID NO: 855814 - RNA, 24 nt, Human
ccucaaaaaggcuucuaagcccau

SEQ ID NO: 855815 - RNA, 21 nt, Human
ccuccaccuccuucucuuggg

SEQ ID NO: 855816 - RNA, 23 nt, Human
ccugaccgcccucaaaccuggga

SEQ ID NO: 855817 - RNA, 23 nt, Human
ccugccaggaccgcucuccgagu

SEQ ID NO: 855818 - RNA, 18 nt, Human
ccugcccuucaaaucacc

SEQ ID NO: 855819 - RNA, 19 nt, Human
ccuggucccuccucccccu

SEQ ID NO: 855820 - RNA, 23 nt, Human
cuccugagauucuuggcugccuc

SEQ ID NO: 855821 - RNA, 20 nt, Human
cucuccgagugcaagacggg

SEQ ID NO: 855822 - RNA, 18 nt, Human
cugggugggaaggcgugg

SEQ ID NO: 855823 - RNA, 22 nt, Human
cuuccugccaggaccgcucucc

SEQ ID NO: 855824 - RNA, 19 nt, Human
gaaucucucggccccugcc

SEQ ID NO: 855825 - RNA, 18 nt, Human
gacgcugggugggaaggc

SEQ ID NO: 855826 - RNA, 22 nt, Human
gagaagauggggaagugguugu

SEQ ID NO: 855827 - RNA, 19 nt, Human
gagagucgggcgcaacgca

SEQ ID NO: 855828 - RNA, 23 nt, Human
gagauucuuggcugccuccaccu

SEQ ID NO: 855829 - RNA, 21 nt, Human
gcaggggcccgaaccgggugc

SEQ ID NO: 855830 - RNA, 19 nt, Human
gccuguccacgcgcugcag

SEQ ID NO: 855831 - RNA, 18 nt, Human
gcgcaacgcagacgcgcc

SEQ ID NO: 855832 - RNA, 22 nt, Human
ggagagaaacgaggagaggaag

SEQ ID NO: 855833 - RNA, 20 nt, Human
ggccuggaucugagggagag

SEQ ID NO: 855834 - RNA, 24 nt, Human
gugggcaguuccagggacuuggaa

SEQ ID NO: 855835 - RNA, 18 nt, Human
gugggggaaccuggggaa

SEQ ID NO: 855836 - RNA, 18 nt, Human
uaaauuacacagcagcuu

SEQ ID NO: 855837 - RNA, 25 nt, Human
uaaccgcggagagucgggcgcaacg

SEQ ID NO: 855838 - RNA, 19 nt, Human
ucccccuuuccuggaggga

SEQ ID NO: 855839 - RNA, 25 nt, Human
ucccccuuuccuggagggagaacca

SEQ ID NO: 855840 - RNA, 22 nt, Human
uccccgaugguguccuagaggc

SEQ ID NO: 855841 - RNA, 18 nt, Human
ucccucaaaaaggcuucu

SEQ ID NO: 855842 - RNA, 18 nt, Human
ucccuccucccccuuucc

SEQ ID NO: 855843 - RNA, 19 nt, Human
ucccuggauaaagcugguc

SEQ ID NO: 855844 - RNA, 22 nt, Human
uccuggucccuccucccccuuu

SEQ ID NO: 855845 - RNA, 18 nt, Human
ucugagggagagguagug

SEQ ID NO: 855846 - RNA, 23 nt, Human
ucugggccggggaacuccgggac

SEQ ID NO: 855847 - RNA, 21 nt, Human
ugccuggccuugaccccgccu

SEQ ID NO: 855848 - RNA, 19 nt, Human
ugcugggggcguggccauc

SEQ ID NO: 855849 - RNA, 23 nt, Human
ugcugggggcguggccaucuugc

SEQ ID NO: 855850 - RNA, 19 nt, Human
uggagggagaaccacccau

SEQ ID NO: 855851 - RNA, 20 nt, Human
uggccggccuuccugccagg

SEQ ID NO: 855852 - RNA, 26 nt, Human
uggggaagacgcugggugggaaggcg

SEQ ID NO: 855853 - RNA, 24 nt, Human
uucuaagcccauccaggcagccgc

SEQ ID NO: 855854 - RNA, 18 nt, Human
uugaccccgccugaccgc

SEQ ID NO: 855855 - RNA, 22 nt, Human
uuggaaagguauccaagcccca

SEQ ID NO: 855856 - RNA, 19 nt, Human
aaaaagcacaggcaaacaa

SEQ ID NO: 855857 - RNA, 21 nt, Human
aaaaagcacaggcaaacaagc

SEQ ID NO: 855858 - RNA, 22 nt, Human
aaaaagcacaggcaaacaagcg

SEQ ID NO: 855859 - RNA, 21 nt, Human
aaacccagucccacacugagg

SEQ ID NO: 855860 - RNA, 20 nt, Human
aagcugcccacgugaccacc

SEQ ID NO: 855861 - RNA, 24 nt, Human
aauacagggugccaucgggaagga

SEQ ID NO: 855862 - RNA, 21 nt, Human
acccagagcccugauggccuc

SEQ ID NO: 855863 - RNA, 24 nt, Human
acuucacgccagccugggcgacag

SEQ ID NO: 855864 - RNA, 24 nt, Human
agacagcaggucucgcccugagca

SEQ ID NO: 855865 - RNA, 24 nt, Human
agccacucgggagguggaggcaga

SEQ ID NO: 855866 - RNA, 23 nt, Human
agccaggcggcuccaauucuccu

SEQ ID NO: 855867 - RNA, 21 nt, Human
agccugggcgacagagaccga

SEQ ID NO: 855868 - RNA, 19 nt, Human
aggaaugucuuucuccuug

SEQ ID NO: 855869 - RNA, 20 nt, Human
aggcagaagcugcccacgug

SEQ ID NO: 855870 - RNA, 23 nt, Human
aggcagaagcugcccacgugacc

SEQ ID NO: 855871 - RNA, 27 nt, Human
aggccccaggccccucugaggcccagg

SEQ ID NO: 855872 - RNA, 21 nt, Human
agggcugguuccugaggccuc

SEQ ID NO: 855873 - RNA, 18 nt, Human
auacaggcauuccacaag

SEQ ID NO: 855874 - RNA, 21 nt, Human
caagcagcuuggaucagggcc

SEQ ID NO: 855875 - RNA, 23 nt, Human
caagcgguuccucgggcggccca

SEQ ID NO: 855876 - RNA, 23 nt, Human
caaggacaccaagcagcuuggau

SEQ ID NO: 855877 - RNA, 24 nt, Human
cacuucacgccagccugggcgaca

SEQ ID NO: 855878 - RNA, 22 nt, Human
cagaagcugcccacgugaccac

SEQ ID NO: 855879 - RNA, 21 nt, Human
cagaucccagccggccaggga

SEQ ID NO: 855880 - RNA, 20 nt, Human
caggcuccuggcccggccug

SEQ ID NO: 855881 - RNA, 18 nt, Human
caggugucaccagggcug

SEQ ID NO: 855882 - RNA, 23 nt, Human
ccacuucacgccagccugggcga

SEQ ID NO: 855883 - RNA, 18 nt, Human
ccagagcccacaagaacc

SEQ ID NO: 855884 - RNA, 23 nt, Human
ccagccugggcgacagagaccga

SEQ ID NO: 855885 - RNA, 22 nt, Human
ccaggaggucaaggcugcagug

SEQ ID NO: 855886 - RNA, 20 nt, Human
ccaggugucaccagggcugg

SEQ ID NO: 855887 - RNA, 20 nt, Human
ccagucccacacugaggugc

SEQ ID NO: 855888 - RNA, 20 nt, Human
cccacaagaaccuucuccaa

SEQ ID NO: 855889 - RNA, 19 nt, Human
cccacacugaggugcuggg

SEQ ID NO: 855890 - RNA, 19 nt, Human
cccagccggccagggaguc

SEQ ID NO: 855891 - RNA, 19 nt, Human
cccaguaacaacccugggc

SEQ ID NO: 855892 - RNA, 23 nt, Human
ccucgggcggcccaaggagccuu

SEQ ID NO: 855893 - RNA, 20 nt, Human
ccucuugguggccuccugcc

SEQ ID NO: 855894 - RNA, 20 nt, Human
ccucuuuuaaccugcugacc

SEQ ID NO: 855895 - RNA, 21 nt, Human
ccugggcacggggguccaagg

SEQ ID NO: 855896 - RNA, 24 nt, Human
ccuucuccaacaggggagggcgcu

SEQ ID NO: 855897 - RNA, 19 nt, Human
cgaaacagugaaagggagg

SEQ ID NO: 855898 - RNA, 18 nt, Human
cggcaggcuccuggcccu

SEQ ID NO: 855899 - RNA, 20 nt, Human
cggccagggagucuggcccg

SEQ ID NO: 855900 - RNA, 22 nt, Human
cgggaaggacugcagccaggcg

SEQ ID NO: 855901 - RNA, 24 nt, Human
cgucggcaggcuccuggcccuggc

SEQ ID NO: 855902 - RNA, 21 nt, Human
cuccaaacccagucccacacu

SEQ ID NO: 855903 - RNA, 22 nt, Human
cucugugugugucuguguccuu

SEQ ID NO: 855904 - RNA, 22 nt, Human
cugcagccaggcggcuccaauu

SEQ ID NO: 855905 - RNA, 23 nt, Human
cuggcccuggccuucuccagccc

SEQ ID NO: 855906 - RNA, 19 nt, Human
cuguccacaguccagugcu

SEQ ID NO: 855907 - RNA, 23 nt, Human
cuuguggcuuuccacaacuuauu

SEQ ID NO: 855908 - RNA, 19 nt, Human
gaaaaagcacaggcaaaca

SEQ ID NO: 855909 - RNA, 22 nt, Human
gaaagauugcuucagcccagga

SEQ ID NO: 855910 - RNA, 19 nt, Human
gagcuggugggagcgggcu

SEQ ID NO: 855911 - RNA, 24 nt, Human
gccacuucacgccagccugggcga

SEQ ID NO: 855912 - RNA, 22 nt, Human
gccccaggccccucugaggccc

SEQ ID NO: 855913 - RNA, 21 nt, Human
gccccucugaggcccagcuuc

SEQ ID NO: 855914 - RNA, 20 nt, Human
gcccuggccuucuccagccc

SEQ ID NO: 855915 - RNA, 23 nt, Human
ggagcuggugggagcgggcuuaa

SEQ ID NO: 855916 - RNA, 21 nt, Human
ggcaggaggugggcgugcugg

SEQ ID NO: 855917 - RNA, 23 nt, Human
gggaaggacugcagccaggcggc

SEQ ID NO: 855918 - RNA, 18 nt, Human
gggcaggaggugggcgug

SEQ ID NO: 855919 - RNA, 19 nt, Human
gggcauggucuugcaccuc

SEQ ID NO: 855920 - RNA, 22 nt, Human
gggcuuaaccaggagcucgugu

SEQ ID NO: 855921 - RNA, 21 nt, Human
guaggggcuccaucuccaaac

SEQ ID NO: 855922 - RNA, 22 nt, Human
gugguuugaaaacuggacagag

SEQ ID NO: 855923 - RNA, 24 nt, Human
guugcgccacuucacgccagccug

SEQ ID NO: 855924 - RNA, 26 nt, Human
uaagacagcaggucucgcccugagcc

SEQ ID NO: 855925 - RNA, 25 nt, Human
uacaaggacaccaagcagcuuggau

SEQ ID NO: 855926 - RNA, 21 nt, Human
uacagauaagacagcaggucu

SEQ ID NO: 855927 - RNA, 19 nt, Human
uacagggugccaucgggaa

SEQ ID NO: 855928 - RNA, 22 nt, Human
uagcagugugagaacggacuaa

SEQ ID NO: 855929 - RNA, 22 nt, Human
ucaaaucccaaaaccugcaggc

SEQ ID NO: 855930 - RNA, 23 nt, Human
ucagaggccucuuguggcuuucc

SEQ ID NO: 855931 - RNA, 22 nt, Human
uccagccccgcagcuccuugug

SEQ ID NO: 855932 - RNA, 18 nt, Human
uccauuuacagaugaaaa

SEQ ID NO: 855933 - RNA, 24 nt, Human
uccauuuacagaugaaaaagcaca

SEQ ID NO: 855934 - RNA, 18 nt, Human
ucccagccggccagggag

SEQ ID NO: 855935 - RNA, 23 nt, Human
uccgucggcaggcuccuggcccg

SEQ ID NO: 855936 - RNA, 18 nt, Human
uccuacuguccugggcac

SEQ ID NO: 855937 - RNA, 21 nt, Human
uccucaucucuucuucuuaca

SEQ ID NO: 855938 - RNA, 20 nt, Human
uccuccucagaggccucuug

SEQ ID NO: 855939 - RNA, 23 nt, Human
uccuggcccuggccuucuccagc

SEQ ID NO: 855940 - RNA, 23 nt, Human
ucucagacacaggccccaggccc

SEQ ID NO: 855941 - RNA, 24 nt, Human
ucucagacacaggccccaggcccc

SEQ ID NO: 855942 - RNA, 24 nt, Human
ugaaaaagcacaggcaaacaagcg

SEQ ID NO: 855943 - RNA, 22 nt, Human
ugaacacaguguuuacagauaa

SEQ ID NO: 855944 - RNA, 19 nt, Human
ugagaagcagauauucagg

SEQ ID NO: 855945 - RNA, 21 nt, Human
ugagaagcagauauucagggc

SEQ ID NO: 855946 - RNA, 19 nt, Human
ugagcaugcgaacaugaug

SEQ ID NO: 855947 - RNA, 20 nt, Human
ugaggccucugcccugggcu

SEQ ID NO: 855948 - RNA, 21 nt, Human
uggacagaguucaccgcguca

SEQ ID NO: 855949 - RNA, 19 nt, Human
uggaucagggcccacccag

SEQ ID NO: 855950 - RNA, 24 nt, Human
uggcccggccuggccccucgcugg

SEQ ID NO: 855951 - RNA, 24 nt, Human
uggcccggccuggccccucgcugg

SEQ ID NO: 855952 - RNA, 18 nt, Human
ugggaugggcccagagcc

SEQ ID NO: 855953 - RNA, 18 nt, Human
uggggcugucccucugug

SEQ ID NO: 855954 - RNA, 21 nt, Human
uggugcacaacuauaguccca

SEQ ID NO: 855955 - RNA, 23 nt, Human
uuaacuuaucggacaggagcugg

SEQ ID NO: 855956 - RNA, 24 nt, Human
uuccugaggccucugcccugggcu

SEQ ID NO: 855957 - RNA, 23 nt, Human
uugcgccacuucacgccagccug

SEQ ID NO: 855958 - RNA, 24 nt, Human
uugcuucagcccaggaggucaagg

SEQ ID NO: 855959 - RNA, 21 nt, Human
uugguggccuccugcccacug

SEQ ID NO: 855960 - RNA, 18 nt, Human
uugucccauauuuucaug

SEQ ID NO: 855961 - RNA, 18 nt, Human
uuuuuuuuuuuuuuucug

SEQ ID NO: 855962 - RNA, 20 nt, Human
uuuuuuuuuuuuuuucuggu

SEQ ID NO: 855963 - RNA, 21 nt, Human
aaaguaucccacccuacccca

SEQ ID NO: 855964 - RNA, 18 nt, Human
aagcaggagcacuuuaaa

SEQ ID NO: 855965 - RNA, 22 nt, Human
aaguaucccacccuaccccauu

SEQ ID NO: 855966 - RNA, 19 nt, Human
acacuuaggcagagcaggg

SEQ ID NO: 855967 - RNA, 19 nt, Human
accccauuccacccccagu

SEQ ID NO: 855968 - RNA, 19 nt, Human
acccugagccucugaaagc

SEQ ID NO: 855969 - RNA, 20 nt, Human
acgucgccgcgcgggcuggg

SEQ ID NO: 855970 - RNA, 22 nt, Human
acguggacccacuccuucuggc

SEQ ID NO: 855971 - RNA, 21 nt, Human
acuccuucuggccauccaggu

SEQ ID NO: 855972 - RNA, 22 nt, Human
agaaaggaaauugacugacuug

SEQ ID NO: 855973 - RNA, 23 nt, Human
agagacucagcgaagaaggcugc

SEQ ID NO: 855974 - RNA, 18 nt, Human
agcgaagaaggcugcaau

SEQ ID NO: 855975 - RNA, 18 nt, Human
aggcccccccacccugag

SEQ ID NO: 855976 - RNA, 20 nt, Human
agugcauaccacguggaccc

SEQ ID NO: 855977 - RNA, 28 nt, Human
aucccacccuaccccauuccacccccag

SEQ ID NO: 855978 - RNA, 24 nt, Human
augucagggacgaagucuuuuccc

SEQ ID NO: 855979 - RNA, 19 nt, Human
cacuuaggcagagcagggc

SEQ ID NO: 855980 - RNA, 19 nt, Human
caggaagagcugaugagcc

SEQ ID NO: 855981 - RNA, 23 nt, Human
caggcccccccacccugagccuc

SEQ ID NO: 855982 - RNA, 25 nt, Human
cagguggccgugauacgcacgugcg

SEQ ID NO: 855983 - RNA, 22 nt, Human
ccacccugagccucugaaagcu

SEQ ID NO: 855984 - RNA, 19 nt, Human
cccacccuaccccauucca

SEQ ID NO: 855985 - RNA, 23 nt, Human
cccccaguggacagaaaggaaau

SEQ ID NO: 855986 - RNA, 20 nt, Human
ccccccacccugagccucug

SEQ ID NO: 855987 - RNA, 25 nt, Human
ccccccacccugagccucugaaagc

SEQ ID NO: 855988 - RNA, 22 nt, Human
cccccccacccugagccucuga

SEQ ID NO: 855989 - RNA, 21 nt, Human
ccccgcuccgagccccgcccc

SEQ ID NO: 855990 - RNA, 26 nt, Human
ccccuguucaucguacauguacugcc

SEQ ID NO: 855991 - RNA, 21 nt, Human
cccuaccccauuccaccccca

SEQ ID NO: 855992 - RNA, 18 nt, Human
ccgcgcgggcugggccuc

SEQ ID NO: 855993 - RNA, 19 nt, Human
ccgcuccgagccccgcccc

SEQ ID NO: 855994 - RNA, 19 nt, Human
ccugggucgggauuugggg

SEQ ID NO: 855995 - RNA, 23 nt, Human
cgccgcgcgggcugggccuccaa

SEQ ID NO: 855996 - RNA, 19 nt, Human
cgcgggcugggccuccaag

SEQ ID NO: 855997 - RNA, 23 nt, Human
cgcgggcugggccuccaaggccc

SEQ ID NO: 855998 - RNA, 24 nt, Human
cggaacuuguagggacugauguca

SEQ ID NO: 855999 - RNA, 18 nt, Human
cggccuucgggcgcuggu

SEQ ID NO: 856000 - RNA, 26 nt, Human
cucggccccgccccgaagccgguucc

SEQ ID NO: 856001 - RNA, 22 nt, Human
cuuaacaggauccucgggaaaa

SEQ ID NO: 856002 - RNA, 20 nt, Human
gaagaaggcugcaaucuguu

SEQ ID NO: 856003 - RNA, 21 nt, Human
gacagaaaggaaauugacuga

SEQ ID NO: 856004 - RNA, 26 nt, Human
gaccagugguuaggaggagggggugg

SEQ ID NO: 856005 - RNA, 19 nt, Human
gaggaggggguggguagca

SEQ ID NO: 856006 - RNA, 19 nt, Human
gcaggaagagcugaugagc

SEQ ID NO: 856007 - RNA, 18 nt, Human
gccccugccugggucggg

SEQ ID NO: 856008 - RNA, 18 nt, Human
ggagcucagguggccgug

SEQ ID NO: 856009 - RNA, 22 nt, Human
ggcccccccacccugagccucu

SEQ ID NO: 856010 - RNA, 21 nt, Human
gggcagagacucagcgaagaa

SEQ ID NO: 856011 - RNA, 22 nt, Human
gggcgcuggucugcggccaugg

SEQ ID NO: 856012 - RNA, 21 nt, Human
gugcgccacauugcugaugca

SEQ ID NO: 856013 - RNA, 19 nt, Human
guggguggccgucagucgg

SEQ ID NO: 856014 - RNA, 28 nt, Human
uaucccacccuaccccauuccaccccca

SEQ ID NO: 856015 - RNA, 22 nt, Human
uccaaggccccgcuccgagccc

SEQ ID NO: 856016 - RNA, 19 nt, Human
ucccacccuaccccauucc

SEQ ID NO: 856017 - RNA, 18 nt, Human
ucccuggagucugccacu

SEQ ID NO: 856018 - RNA, 20 nt, Human
uccgagccccgccccugccu

SEQ ID NO: 856019 - RNA, 24 nt, Human
ucugcggccaugguggguggccgu

SEQ ID NO: 856020 - RNA, 18 nt, Human
ucuggccauccagguugc

SEQ ID NO: 856021 - RNA, 19 nt, Human
ugacugacuugaggggaug

SEQ ID NO: 856022 - RNA, 21 nt, Human
ugaguugggcagugcauaccc

SEQ ID NO: 856023 - RNA, 22 nt, Human
ugcccuugggcccggacaaucu

SEQ ID NO: 856024 - RNA, 24 nt, Human
ugguuaggaggaggggguggguag

SEQ ID NO: 856025 - RNA, 21 nt, Human
ugucggccuucgggcgcuggu

SEQ ID NO: 856026 - RNA, 22 nt, Human
ugugcaugucaggauuuucuuu

SEQ ID NO: 856027 - RNA, 23 nt, Human
uuuaaaguaucccacccuacccc

SEQ ID NO: 856028 - RNA, 19 nt, Human
uuuuuuuuuuuuuuuuugu

SEQ ID NO: 856029 - RNA, 20 nt, Human
uuuuuuuuuuuuuuuuuugg

SEQ ID NO: 856030 - RNA, 20 nt, Human
aaaaacaaaaacaaaaauca

SEQ ID NO: 856031 - RNA, 22 nt, Human
aaaaacaaaaacaaaaaucacu

SEQ ID NO: 856032 - RNA, 23 nt, Human
aaaaucagagccccuaguccuga

SEQ ID NO: 856033 - RNA, 22 nt, Human
aaacaaaaacaaaaaucacuca

SEQ ID NO: 856034 - RNA, 23 nt, Human
aacuccuguuccaccaacaagga

SEQ ID NO: 856035 - RNA, 18 nt, Human
acaaaaacaaaaacaaaa

SEQ ID NO: 856036 - RNA, 22 nt, Human
agaauccaaaaaucagagcccc

SEQ ID NO: 856037 - RNA, 20 nt, Human
agcugccggguaccuccagc

SEQ ID NO: 856038 - RNA, 21 nt, Human
aggaggggcaagaaugcaggg

SEQ ID NO: 856039 - RNA, 23 nt, Human
agggaggagaagggagaagagga

SEQ ID NO: 856040 - RNA, 22 nt, Human
caaaaaucagagccccuagucc

SEQ ID NO: 856041 - RNA, 23 nt, Human
caacaaaaacaaaaacaaaaauc

SEQ ID NO: 856042 - RNA, 24 nt, Human
caacaaaaacaaaaacaaaaauca

SEQ ID NO: 856043 - RNA, 21 nt, Human
caccuucugcuucagaagcuu

SEQ ID NO: 856044 - RNA, 27 nt, Human
ccgacaaugauggaggcucuggggcgc

SEQ ID NO: 856045 - RNA, 21 nt, Human
ccuccucuccagggcuggugg

SEQ ID NO: 856046 - RNA, 18 nt, Human
cgggagagcugccgggua

SEQ ID NO: 856047 - RNA, 22 nt, Human
cguguguguguguguagcuugu

SEQ ID NO: 856048 - RNA, 21 nt, Human
cuccagcuccccagaacucuc

SEQ ID NO: 856049 - RNA, 24 nt, Human
gaaugcagggagccagcucucugg

SEQ ID NO: 856050 - RNA, 21 nt, Human
gagccccuaguccugauccaa

SEQ ID NO: 856051 - RNA, 18 nt, Human
gaggagaagggagaagag

SEQ ID NO: 856052 - RNA, 22 nt, Human
gaggcucuggggcgcucauuac

SEQ ID NO: 856053 - RNA, 19 nt, Human
gaucucaucuuugccacug

SEQ ID NO: 856054 - RNA, 20 nt, Human
gcaagaaugcagggagccag

SEQ ID NO: 856055 - RNA, 18 nt, Human
gggucgugugugugugug

SEQ ID NO: 856056 - RNA, 18 nt, Human
gucgugugugugugugua

SEQ ID NO: 856057 - RNA, 19 nt, Human
uaccaacaaaaacaaaaac

SEQ ID NO: 856058 - RNA, 23 nt, Human
uaccaacaaaaacaaaaacaaag

SEQ ID NO: 856059 - RNA, 24 nt, Human
ucagucccuuccuccucuccaggg

SEQ ID NO: 856060 - RNA, 23 nt, Human
uccccagaacucucuucgaccag

SEQ ID NO: 856061 - RNA, 19 nt, Human
ucuccgacaaugauggagg

SEQ ID NO: 856062 - RNA, 26 nt, Human
ucuccgacaaugauggaggcucuggg

SEQ ID NO: 856063 - RNA, 21 nt, Human
ucugguccccucgggagagcu

SEQ ID NO: 856064 - RNA, 22 nt, Human
ugagcuccagagcuugcuggcg

SEQ ID NO: 856065 - RNA, 19 nt, Human
ugccggguaccuccagcuc

SEQ ID NO: 856066 - RNA, 21 nt, Human
uggugaggcuuaggaacuccu

SEQ ID NO: 856067 - RNA, 18 nt, Human
ugugccaugugugaggag

SEQ ID NO: 856068 - RNA, 21 nt, Human
uguuccaccaacaaggagauc

SEQ ID NO: 856069 - RNA, 24 nt, Human
uugcuggcguagucagucccuucc

SEQ ID NO: 856070 - RNA, 20 nt, Human
uugugccaugugugaggagg

SEQ ID NO: 856071 - RNA, 22 nt, Human
uugugccaugugugaggagggc

SEQ ID NO: 856072 - RNA, 23 nt, Human
uuuuuuuuuuuucaaguagcuca

SEQ ID NO: 856073 - RNA, 22 nt, Human
uuuuuuuuuuuuuuuuuucaag

SEQ ID NO: 856074 - RNA, 20 nt, Human
aaacgguagcggcggccaca

SEQ ID NO: 856075 - RNA, 19 nt, Human
aaggccccaggccguuggg

SEQ ID NO: 856076 - RNA, 24 nt, Human
aagggggcuuugggacagggaggg

SEQ ID NO: 856077 - RNA, 19 nt, Human
acacugaguucauggacgc

SEQ ID NO: 856078 - RNA, 22 nt, Human
acaugacauaaauaaaaaaaua

SEQ ID NO: 856079 - RNA, 18 nt, Human
accgcagccaucgccauc

SEQ ID NO: 856080 - RNA, 20 nt, Human
acugaguucauggacgcgcc

SEQ ID NO: 856081 - RNA, 22 nt, Human
agggccccgcuggugggagaca

SEQ ID NO: 856082 - RNA, 23 nt, Human
cacccaaccguacuugacguugu

SEQ ID NO: 856083 - RNA, 18 nt, Human
cacccucgcccucgaaac

SEQ ID NO: 856084 - RNA, 19 nt, Human
cacucgggccagccccggg

SEQ ID NO: 856085 - RNA, 22 nt, Human
cagccacaguccgaggucaggc

SEQ ID NO: 856086 - RNA, 22 nt, Human
caggaaggggcgggaagucccg

SEQ ID NO: 856087 - RNA, 19 nt, Human
caggagggccccgcuggug

SEQ ID NO: 856088 - RNA, 18 nt, Human
cagguggggggcugcggc

SEQ ID NO: 856089 - RNA, 18 nt, Human
ccaagggggcuuugggac

SEQ ID NO: 856090 - RNA, 23 nt, Human
ccacacccgacaugacauaaaua

SEQ ID NO: 856091 - RNA, 20 nt, Human
ccagagcucaagaucccaca

SEQ ID NO: 856092 - RNA, 23 nt, Human
ccagcagccacaguucccccaag

SEQ ID NO: 856093 - RNA, 18 nt, Human
ccaggaaggggcgggaag

SEQ ID NO: 856094 - RNA, 21 nt, Human
ccccagccacaguccgagguc

SEQ ID NO: 856095 - RNA, 26 nt, Human
ccccaggccguuggggucugggccuc

SEQ ID NO: 856096 - RNA, 18 nt, Human
ccccaggguaccgggcca

SEQ ID NO: 856097 - RNA, 22 nt, Human
ccccgggagagccaagagcggg

SEQ ID NO: 856098 - RNA, 21 nt, Human
cccgcagccgguucacggggc

SEQ ID NO: 856099 - RNA, 21 nt, Human
cccugaggggggugcccgggg

SEQ ID NO: 856100 - RNA, 20 nt, Human
ccgagggcccaggugggggg

SEQ ID NO: 856101 - RNA, 21 nt, Human
ccgccgcugcuaccgcagcca

SEQ ID NO: 856102 - RNA, 18 nt, Human
ccgcugccccccaagggc

SEQ ID NO: 856103 - RNA, 25 nt, Human
ccucugggaccccgcggccugcggg

SEQ ID NO: 856104 - RNA, 20 nt, Human
ccugaggggggugcccgggg

SEQ ID NO: 856105 - RNA, 21 nt, Human
cgccgggagggcggaccgagg

SEQ ID NO: 856106 - RNA, 21 nt, Human
cgggagagccaagagcggggc

SEQ ID NO: 856107 - RNA, 20 nt, Human
cuggaaacgcuguaugucac

SEQ ID NO: 856108 - RNA, 19 nt, Human
cuguaugucacccucgccc

SEQ ID NO: 856109 - RNA, 19 nt, Human
gaaggcgcuacucggcccc

SEQ ID NO: 856110 - RNA, 23 nt, Human
gacacaaagucccgcuggaaacg

SEQ ID NO: 856111 - RNA, 19 nt, Human
gccagccccgggagagcca

SEQ ID NO: 856112 - RNA, 19 nt, Human
gccccgggagagccaagag

SEQ ID NO: 856113 - RNA, 21 nt, Human
gccucgggccggcggcgcgcg

SEQ ID NO: 856114 - RNA, 21 nt, Human
ggaaacgcuguaugucacccu

SEQ ID NO: 856115 - RNA, 22 nt, Human
ggaaacgcuguaugucacccuc

SEQ ID NO: 856116 - RNA, 19 nt, Human
ggagggcggaccgagggcc

SEQ ID NO: 856117 - RNA, 23 nt, Human
ggaugcuggagauugcuaaagcu

SEQ ID NO: 856118 - RNA, 21 nt, Human
ggcccccagcagccacaguuc

SEQ ID NO: 856119 - RNA, 25 nt, Human
gggaccccgcggccugcgggccucg

SEQ ID NO: 856120 - RNA, 24 nt, Human
gggcggaccgagggcccagguggg

SEQ ID NO: 856121 - RNA, 21 nt, Human
gggcguccagugcaaacuaca

SEQ ID NO: 856122 - RNA, 20 nt, Human
gguaccgggccaggcaacag

SEQ ID NO: 856123 - RNA, 24 nt, Human
gguugcagcugggcuugaggggcu

SEQ ID NO: 856124 - RNA, 21 nt, Human
guccggcucacucgggccagc

SEQ ID NO: 856125 - RNA, 20 nt, Human
uacacagcuuuauuggcccc

SEQ ID NO: 856126 - RNA, 18 nt, Human
uccccucauccccucccu

SEQ ID NO: 856127 - RNA, 18 nt, Human
uccgaggucaggcagccc

SEQ ID NO: 856128 - RNA, 23 nt, Human
ucugugggcucugucccuggcug

SEQ ID NO: 856129 - RNA, 21 nt, Human
ugaggggggugcccggggucc

SEQ ID NO: 856130 - RNA, 18 nt, Human
ugccagagcucaagaucc

SEQ ID NO: 856131 - RNA, 19 nt, Human
ugucccuggcugaauggcc

SEQ ID NO: 856132 - RNA, 21 nt, Human
uucacggggcccggggaaggc

SEQ ID NO: 856133 - RNA, 21 nt, Human
aaaaucacagcagauucaccg

SEQ ID NO: 856134 - RNA, 25 nt, Human
aaagaauauacccuccccugccucc

SEQ ID NO: 856135 - RNA, 23 nt, Human
aaccccgucuuucccuauaacac

SEQ ID NO: 856136 - RNA, 21 nt, Human
acagcagauucaccgaggcuc

SEQ ID NO: 856137 - RNA, 22 nt, Human
accuugagaccuugaagaagaa

SEQ ID NO: 856138 - RNA, 21 nt, Human
agaaacucuauuauccucagc

SEQ ID NO: 856139 - RNA, 22 nt, Human
caaaaucacagcagauucaccg

SEQ ID NO: 856140 - RNA, 23 nt, Human
caaaaucacagcagauucaccga

SEQ ID NO: 856141 - RNA, 22 nt, Human
caaguugcauaaagaguucuga

SEQ ID NO: 856142 - RNA, 24 nt, Human
cacuucgcgcuccuggggauacua

SEQ ID NO: 856143 - RNA, 22 nt, Human
cauaaagaguucugauucccag

SEQ ID NO: 856144 - RNA, 18 nt, Human
ccagccaggauuguaagc

SEQ ID NO: 856145 - RNA, 19 nt, Human
cuccuggggauacuagaag

SEQ ID NO: 856146 - RNA, 20 nt, Human
cucuauuauccucagccacu

SEQ ID NO: 856147 - RNA, 20 nt, Human
gcagagauuacuaagcagcu

SEQ ID NO: 856148 - RNA, 18 nt, Human
gguacagaaacaaagaga

SEQ ID NO: 856149 - RNA, 25 nt, Human
guuacaacugggcgcuugccuuauu

SEQ ID NO: 856150 - RNA, 24 nt, Human
uaacaucaaggcuccaggugagaa

SEQ ID NO: 856151 - RNA, 18 nt, Human
uacccuccccugccucca

SEQ ID NO: 856152 - RNA, 21 nt, Human
ucaagagcauggcugugucuu

SEQ ID NO: 856153 - RNA, 18 nt, Human
ucaccgaggcuccggggg

SEQ ID NO: 856154 - RNA, 21 nt, Human
ucagguacagaaacaaagaga

SEQ ID NO: 856155 - RNA, 25 nt, Human
ucccagagguaagaacugagccucg

SEQ ID NO: 856156 - RNA, 19 nt, Human
ucugauucccagagguaag

SEQ ID NO: 856157 - RNA, 24 nt, Human
ucugcuuuaauauuaagagauggc

SEQ ID NO: 856158 - RNA, 24 nt, Human
ugcuuuaauauuaagagauggcuu

SEQ ID NO: 856159 - RNA, 22 nt, Human
uggcuuucuaguuacauguuua

SEQ ID NO: 856160 - RNA, 19 nt, Human
uguaagugaagaaaucuau

SEQ ID NO: 856161 - RNA, 18 nt, Human
aaaacagucagacacgga

SEQ ID NO: 856162 - RNA, 18 nt, Human
aaaagacaggacccuaug

SEQ ID NO: 856163 - RNA, 28 nt, Human
aaacagccagcgagcagccuggcccagc

SEQ ID NO: 856164 - RNA, 23 nt, Human
aaacagucagacacggaacaugc

SEQ ID NO: 856165 - RNA, 18 nt, Human
aacucaucuuuccaucca

SEQ ID NO: 856166 - RNA, 18 nt, Human
aagcagcagcaacucugg

SEQ ID NO: 856167 - RNA, 21 nt, Human
aagcuaagagcagagcagaga

SEQ ID NO: 856168 - RNA, 18 nt, Human
aagcuguuuucuuggaga

SEQ ID NO: 856169 - RNA, 21 nt, Human
aaggagccuggacucacuggc

SEQ ID NO: 856170 - RNA, 19 nt, Human
acacagcugaaccuccugu

SEQ ID NO: 856171 - RNA, 22 nt, Human
acacgccgccugcaucccaugc

SEQ ID NO: 856172 - RNA, 21 nt, Human
acaggacaucuuaaaaggaaa

SEQ ID NO: 856173 - RNA, 20 nt, Human
accccagggcuccugagggc

SEQ ID NO: 856174 - RNA, 19 nt, Human
agaaugcugucgcuguucu

SEQ ID NO: 856175 - RNA, 24 nt, Human
agagugcggguccccugaggagca

SEQ ID NO: 856176 - RNA, 24 nt, Human
agcaaggacccagaggucugggug

SEQ ID NO: 856177 - RNA, 20 nt, Human
agcacaggagcugauggcag

SEQ ID NO: 856178 - RNA, 18 nt, Human
agccagcgagcagccugg

SEQ ID NO: 856179 - RNA, 24 nt, Human
agcuugggugacgcuccugccugc

SEQ ID NO: 856180 - RNA, 21 nt, Human
aggacaaaguggggaaggcgg

SEQ ID NO: 856181 - RNA, 23 nt, Human
aggacccagaggucugggugcag

SEQ ID NO: 856182 - RNA, 23 nt, Human
aggggcccugcagagcagccacc

SEQ ID NO: 856183 - RNA, 19 nt, Human
agucagacacggaacaugc

SEQ ID NO: 856184 - RNA, 20 nt, Human
auuucaucagggucagaggc

SEQ ID NO: 856185 - RNA, 22 nt, Human
caccgaggcuggggagucgggc

SEQ ID NO: 856186 - RNA, 24 nt, Human
caccuccggccacggccauugcuc

SEQ ID NO: 856187 - RNA, 18 nt, Human
caccugaacggucacagc

SEQ ID NO: 856188 - RNA, 20 nt, Human
caccuggccagaucugagcc

SEQ ID NO: 856189 - RNA, 19 nt, Human
cacuccucauucaguuccc

SEQ ID NO: 856190 - RNA, 23 nt, Human
cagagaaaaucaacagcagcaca

SEQ ID NO: 856191 - RNA, 22 nt, Human
cagagaccagccugccaucugc

SEQ ID NO: 856192 - RNA, 18 nt, Human
cagcgagcagccuggccc

SEQ ID NO: 856193 - RNA, 20 nt, Human
caggcccaggggaagggccc

SEQ ID NO: 856194 - RNA, 24 nt, Human
caucccaugcgcaccuccggccac

SEQ ID NO: 856195 - RNA, 21 nt, Human
caucuuaaaaggaaacccaag

SEQ ID NO: 856196 - RNA, 21 nt, Human
cauggcuccugcugugugcca

SEQ ID NO: 856197 - RNA, 20 nt, Human
cauuuucacucauugugggg

SEQ ID NO: 856198 - RNA, 19 nt, Human
ccacggccauugcucaccu

SEQ ID NO: 856199 - RNA, 21 nt, Human
ccacucccaaaagacaggacc

SEQ ID NO: 856200 - RNA, 20 nt, Human
ccagaggucugggugcaggg

SEQ ID NO: 856201 - RNA, 20 nt, Human
ccagcacuccccacucccaa

SEQ ID NO: 856202 - RNA, 22 nt, Human
ccagcacuccccacucccaaaa

SEQ ID NO: 856203 - RNA, 19 nt, Human
cccagcacuccccacuccc

SEQ ID NO: 856204 - RNA, 22 nt, Human
cccaugcgcaccuccggccacg

SEQ ID NO: 856205 - RNA, 26 nt, Human
cccaugcgcaccuccggccacggcca

SEQ ID NO: 856206 - RNA, 18 nt, Human
ccccagggcuccugaggg

SEQ ID NO: 856207 - RNA, 19 nt, Human
ccgaagcuauuucaucagg

SEQ ID NO: 856208 - RNA, 19 nt, Human
ccucacaggcacacagcug

SEQ ID NO: 856209 - RNA, 19 nt, Human
ccuccugcauuuucacuca

SEQ ID NO: 856210 - RNA, 18 nt, Human
ccucugaagacaaugcug

SEQ ID NO: 856211 - RNA, 23 nt, Human
ccugaacggucacagcucgaccc

SEQ ID NO: 856212 - RNA, 21 nt, Human
ccugggagccggguggguggg

SEQ ID NO: 856213 - RNA, 21 nt, Human
cgccgccugcaucccaugcgc

SEQ ID NO: 856214 - RNA, 22 nt, Human
cgccugcaucccaugcgcaccu

SEQ ID NO: 856215 - RNA, 24 nt, Human
cuagagugucacucaggcuugggg

SEQ ID NO: 856216 - RNA, 21 nt, Human
cucaggacaaaguggggaagg

SEQ ID NO: 856217 - RNA, 21 nt, Human
cucuggugcuggggaggaccc

SEQ ID NO: 856218 - RNA, 21 nt, Human
cuggauaaccuacacaacuca

SEQ ID NO: 856219 - RNA, 20 nt, Human
gaaacuccacuaucugcuaa

SEQ ID NO: 856220 - RNA, 23 nt, Human
gagaugacacuaacaugaucuug

SEQ ID NO: 856221 - RNA, 20 nt, Human
gagggcuuccuaaugaggau

SEQ ID NO: 856222 - RNA, 18 nt, Human
gauccugggagccgggug

SEQ ID NO: 856223 - RNA, 24 nt, Human
gaugccaaggaggacagggguauc

SEQ ID NO: 856224 - RNA, 21 nt, Human
gcagcaacucuggugcugggg

SEQ ID NO: 856225 - RNA, 18 nt, Human
gcaggcucugcacaccca

SEQ ID NO: 856226 - RNA, 19 nt, Human
gccuggcccagcacucccc

SEQ ID NO: 856227 - RNA, 22 nt, Human
gcugccggggaauucucuucug

SEQ ID NO: 856228 - RNA, 22 nt, Human
gcuggggagucgggcucaccaa

SEQ ID NO: 856229 - RNA, 21 nt, Human
gcugugggaacgggcccaggg

SEQ ID NO: 856230 - RNA, 23 nt, Human
ggaagggcccacagugggcugcg

SEQ ID NO: 856231 - RNA, 19 nt, Human
ggagcagggaggcgagggg

SEQ ID NO: 856232 - RNA, 22 nt, Human
ggaggacaggcagcgcccucug

SEQ ID NO: 856233 - RNA, 18 nt, Human
ggauaaccuacacaacuc

SEQ ID NO: 856234 - RNA, 22 nt, Human
ggcaaggagacccaccccaggg

SEQ ID NO: 856235 - RNA, 19 nt, Human
ggcacagugcagccagagg

SEQ ID NO: 856236 - RNA, 19 nt, Human
ggcaggggcugccugagca

SEQ ID NO: 856237 - RNA, 22 nt, Human
ggccacggccauugcucaccuc

SEQ ID NO: 856238 - RNA, 21 nt, Human
ggcccagcacuccccacuccc

SEQ ID NO: 856239 - RNA, 19 nt, Human
ggcccaggggaagggccca

SEQ ID NO: 856240 - RNA, 20 nt, Human
gggaagggcccacagugggc

SEQ ID NO: 856241 - RNA, 24 nt, Human
gggaauucucuucugaagcuuggg

SEQ ID NO: 856242 - RNA, 22 nt, Human
gggugcagguggagggucaugg

SEQ ID NO: 856243 - RNA, 24 nt, Human
gguggucaaugcugaugugggcca

SEQ ID NO: 856244 - RNA, 23 nt, Human
guaagcuaagagcagagcagaga

SEQ ID NO: 856245 - RNA, 25 nt, Human
guggggaaggcggggcaggcucugc

SEQ ID NO: 856246 - RNA, 21 nt, Human
uaaaaggaaacccaaguucau

SEQ ID NO: 856247 - RNA, 24 nt, Human
uaaaaggaaacccaaguucauguu

SEQ ID NO: 856248 - RNA, 22 nt, Human
uaacacaaauggagcguucaca

SEQ ID NO: 856249 - RNA, 22 nt, Human
uaauagagaugacacuaacaug

SEQ ID NO: 856250 - RNA, 20 nt, Human
uaauagagaugacacuaacu

SEQ ID NO: 856251 - RNA, 19 nt, Human
uagagugucacucaggcuu

SEQ ID NO: 856252 - RNA, 22 nt, Human
ucacagcucgacccaagucugc

SEQ ID NO: 856253 - RNA, 18 nt, Human
ucaggcuuggggccggga

SEQ ID NO: 856254 - RNA, 24 nt, Human
ucaucuggauaaccuacacaacuc

SEQ ID NO: 856255 - RNA, 25 nt, Human
uccaaagcaucuaauagagaugaca

SEQ ID NO: 856256 - RNA, 23 nt, Human
ucccaugcgcaccuccggccacg

SEQ ID NO: 856257 - RNA, 24 nt, Human
uccccugaggagcagggaggcgag

SEQ ID NO: 856258 - RNA, 24 nt, Human
uccuagagugucacucaggcuugg

SEQ ID NO: 856259 - RNA, 18 nt, Human
uccugagggcuuccuaau

SEQ ID NO: 856260 - RNA, 25 nt, Human
uccugcauuuucacucauugugggg

SEQ ID NO: 856261 - RNA, 23 nt, Human
uccugcugugugccaggugcugu

SEQ ID NO: 856262 - RNA, 19 nt, Human
ucucaccgagggcaggggc

SEQ ID NO: 856263 - RNA, 23 nt, Human
ucugcuaaaaccuuccauucugu

SEQ ID NO: 856264 - RNA, 21 nt, Human
ugagaaggagccuggacucag

SEQ ID NO: 856265 - RNA, 21 nt, Human
ugcaaaugccaccgaagcuau

SEQ ID NO: 856266 - RNA, 19 nt, Human
ugcaauccuagagugucac

SEQ ID NO: 856267 - RNA, 18 nt, Human
ugccaaggaggacaggca

SEQ ID NO: 856268 - RNA, 23 nt, Human
ugcccaaaucuucugaaugucgc

SEQ ID NO: 856269 - RNA, 21 nt, Human
ugcucccuggauguagccuca

SEQ ID NO: 856270 - RNA, 20 nt, Human
ugcugcccaaaucuucugaa

SEQ ID NO: 856271 - RNA, 18 nt, Human
ugcuuuaauuccuaaggc

SEQ ID NO: 856272 - RNA, 18 nt, Human
uggaaaaugaucacaagg

SEQ ID NO: 856273 - RNA, 18 nt, Human
uggauaaccuacacaacu

SEQ ID NO: 856274 - RNA, 21 nt, Human
uggcacagugcagccagaggg

SEQ ID NO: 856275 - RNA, 18 nt, Human
ugggagccgggugggugg

SEQ ID NO: 856276 - RNA, 20 nt, Human
ugggagccgggugggugggg

SEQ ID NO: 856277 - RNA, 21 nt, Human
uggggaaggcggggcaggcuc

SEQ ID NO: 856278 - RNA, 18 nt, Human
ugugggaacgggcccagg

SEQ ID NO: 856279 - RNA, 23 nt, Human
uucaguguacugaaauucccauc

SEQ ID NO: 856280 - RNA, 19 nt, Human
uucauucuuuaaucuguuc

SEQ ID NO: 856281 - RNA, 23 nt, Human
uuccuaaugaggauccugggagc

SEQ ID NO: 856282 - RNA, 24 nt, Human
uuuuuuuuuuuucaacuuuuaagg

SEQ ID NO: 856283 - RNA, 30 nt, Human
uuuuuuuuuuuuuuuuuuucaacuuuuaaa

SEQ ID NO: 856284 - RNA, 21 nt, Human
auugcaauugaauuauccaau

SEQ ID NO: 856285 - RNA, 21 nt, Human
cggagcugcuuacaagcuucu

SEQ ID NO: 856286 - RNA, 24 nt, Human
ucggagcugcuuacaagcuucuuu

SEQ ID NO: 856287 - RNA, 20 nt, Human
ucuuuagcuuuaagcucauu

SEQ ID NO: 856288 - RNA, 27 nt, Human
uuuuuuuuuuuuuuuuuuuuuuugggg

SEQ ID NO: 856289 - RNA, 23 nt, Human
aaacuugccuaaggccucccaga

SEQ ID NO: 856290 - RNA, 20 nt, Human
aaauagcugggauuacaggc

SEQ ID NO: 856291 - RNA, 24 nt, Human
aaauagcugggauuacaggcuugc

SEQ ID NO: 856292 - RNA, 21 nt, Human
aaccagguaaggugguuucca

SEQ ID NO: 856293 - RNA, 18 nt, Human
aagcgaaaauccaaaugc

SEQ ID NO: 856294 - RNA, 25 nt, Human
aagcgauucuccugccucagccucc

SEQ ID NO: 856295 - RNA, 21 nt, Human
acaggcuugcgccaccacacc

SEQ ID NO: 856296 - RNA, 25 nt, Human
acucuguuguccaggcuggagugca

SEQ ID NO: 856297 - RNA, 24 nt, Human
agagugcugggauuacaggccuga

SEQ ID NO: 856298 - RNA, 24 nt, Human
agcgauucuccugccucagccucc

SEQ ID NO: 856299 - RNA, 25 nt, Human
aggcuggagugcaguggugcgaucu

SEQ ID NO: 856300 - RNA, 24 nt, Human
aggugauccacaugcauuggccuc

SEQ ID NO: 856301 - RNA, 20 nt, Human
agugcaguggugcgaucucg

SEQ ID NO: 856302 - RNA, 23 nt, Human
agugcaguggugcgaucucggcu

SEQ ID NO: 856303 - RNA, 24 nt, Human
agugcaguggugcgaucucggcuc

SEQ ID NO: 856304 - RNA, 18 nt, Human
agugcugggauuacaggc

SEQ ID NO: 856305 - RNA, 22 nt, Human
agugcugggauuacaggccuga

SEQ ID NO: 856306 - RNA, 24 nt, Human
agugcugggauuacaggccugagc

SEQ ID NO: 856307 - RNA, 22 nt, Human
auagcugggauuacaggcuugc

SEQ ID NO: 856308 - RNA, 23 nt, Human
auccagcucgacuguucuugauc

SEQ ID NO: 856309 - RNA, 20 nt, Human
aucucugggcaaggcagcuc

SEQ ID NO: 856310 - RNA, 24 nt, Human
augggguuucaggcaguuggccag

SEQ ID NO: 856311 - RNA, 24 nt, Human
auuuuuguauuuuuaguagagaug

SEQ ID NO: 856312 - RNA, 22 nt, Human
caagcgauucuccugccucagc

SEQ ID NO: 856313 - RNA, 22 nt, Human
cacaggaguugcagccccgccc

SEQ ID NO: 856314 - RNA, 24 nt, Human
caccacaccuggcuaauuuuugua

SEQ ID NO: 856315 - RNA, 24 nt, Human
cacucuguuguccaggcuggagug

SEQ ID NO: 856316 - RNA, 21 nt, Human
cacugcaaccucugccucccg

SEQ ID NO: 856317 - RNA, 23 nt, Human
cacugcaaccucugccucccggg

SEQ ID NO: 856318 - RNA, 18 nt, Human
cagagugcugggauuaca

SEQ ID NO: 856319 - RNA, 21 nt, Human
cagccccgcccccgccccccu

SEQ ID NO: 856320 - RNA, 19 nt, Human
cagcuccugaccccuaccc

SEQ ID NO: 856321 - RNA, 20 nt, Human
caggcaguuggccaggcugg

SEQ ID NO: 856322 - RNA, 24 nt, Human
caggcaguuggccaggcuggucuc

SEQ ID NO: 856323 - RNA, 22 nt, Human
ccacaugcauuggccucccaga

SEQ ID NO: 856324 - RNA, 24 nt, Human
ccacucuguuguccaggcuggagu

SEQ ID NO: 856325 - RNA, 20 nt, Human
ccagaaaguguauuuugaag

SEQ ID NO: 856326 - RNA, 19 nt, Human
ccagagugcugggauuaca

SEQ ID NO: 856327 - RNA, 22 nt, Human
ccagagugcugggauuacaggc

SEQ ID NO: 856328 - RNA, 24 nt, Human
ccagagugcugggauuacaggccu

SEQ ID NO: 856329 - RNA, 23 nt, Human
ccagcgauguugcugccccuccc

SEQ ID NO: 856330 - RNA, 18 nt, Human
ccaggcuggagugcagug

SEQ ID NO: 856331 - RNA, 24 nt, Human
cccaaauagcugggauuacaggcu

SEQ ID NO: 856332 - RNA, 19 nt, Human
ccccgccccccugggauga

SEQ ID NO: 856333 - RNA, 21 nt, Human
cccgccccccugggaugacua

SEQ ID NO: 856334 - RNA, 20 nt, Human
cccggguucaagcgauucuc

SEQ ID NO: 856335 - RNA, 23 nt, Human
cccggguucaagcgauucuccug

SEQ ID NO: 856336 - RNA, 24 nt, Human
ccucccggguucaagcgauucucc

SEQ ID NO: 856337 - RNA, 20 nt, Human
ccugaccucaggugauccac

SEQ ID NO: 856338 - RNA, 23 nt, Human
ccugaccucaggugauccacaug

SEQ ID NO: 856339 - RNA, 24 nt, Human
ccugaccucaggugauccacaugg

SEQ ID NO: 856340 - RNA, 23 nt, Human
cuaauuuuuguauuuuuaguaga

SEQ ID NO: 856341 - RNA, 24 nt, Human
cucacugcaaccucugccucccgg

SEQ ID NO: 856342 - RNA, 24 nt, Human
cucccaaauagcugggauuacagg

SEQ ID NO: 856343 - RNA, 24 nt, Human
cugaccccuacccagggcccuucc

SEQ ID NO: 856344 - RNA, 19 nt, Human
cugcaaccucugccucccg

SEQ ID NO: 856345 - RNA, 23 nt, Human
cugcaaccucugccucccggguu

SEQ ID NO: 856346 - RNA, 24 nt, Human
cugcaaccucugccucccggguuc

SEQ ID NO: 856347 - RNA, 23 nt, Human
cugccucagccucccaaauagcu

SEQ ID NO: 856348 - RNA, 19 nt, Human
gaccucaggugauccacau

SEQ ID NO: 856349 - RNA, 19 nt, Human
gagugcugggauuacaggc

SEQ ID NO: 856350 - RNA, 25 nt, Human
gauacacacacagcucauuuauaca

SEQ ID NO: 856351 - RNA, 20 nt, Human
gaugacuagugcuggacaag

SEQ ID NO: 856352 - RNA, 18 nt, Human
gauuacaggccugagcca

SEQ ID NO: 856353 - RNA, 22 nt, Human
gauuacaggccugagccaccgc

SEQ ID NO: 856354 - RNA, 20 nt, Human
gcacacuccugguaacccca

SEQ ID NO: 856355 - RNA, 18 nt, Human
gcaguuggccaggcuggu

SEQ ID NO: 856356 - RNA, 22 nt, Human
gcaguuggccaggcuggucucg

SEQ ID NO: 856357 - RNA, 24 nt, Human
gccugagccaccgcgccaggccuc

SEQ ID NO: 856358 - RNA, 24 nt, Human
gcgauucuccugccucagccuccc

SEQ ID NO: 856359 - RNA, 23 nt, Human
gcuggucucgaacuccugaccuc

SEQ ID NO: 856360 - RNA, 21 nt, Human
ggcagcuccugaccccuaccc

SEQ ID NO: 856361 - RNA, 24 nt, Human
ggcuggucucgaacuccugaccuc

SEQ ID NO: 856362 - RNA, 22 nt, Human
gggguuucaggcaguuggccag

SEQ ID NO: 856363 - RNA, 22 nt, Human
gguaaggugguuuccaaaagcg

SEQ ID NO: 856364 - RNA, 19 nt, Human
ggucucgaacuccugaccu

SEQ ID NO: 856365 - RNA, 24 nt, Human
gugauccacaugcauuggccuccc

SEQ ID NO: 856366 - RNA, 20 nt, Human
uaaaccauucucagugccca

SEQ ID NO: 856367 - RNA, 24 nt, Human
uaauuuuuguauuuuuaguagaga

SEQ ID NO: 856368 - RNA, 23 nt, Human
uacaccucaggguucccagcgau

SEQ ID NO: 856369 - RNA, 22 nt, Human
uacaggcuugcgccaccacacc

SEQ ID NO: 856370 - RNA, 23 nt, Human
uacccauuuuggggagaggauuc

SEQ ID NO: 856371 - RNA, 20 nt, Human
uagagaugggguuucaggca

SEQ ID NO: 856372 - RNA, 21 nt, Human
uagagaugggguuucaggcag

SEQ ID NO: 856373 - RNA, 19 nt, Human
uaguagagaugggguuuca

SEQ ID NO: 856374 - RNA, 20 nt, Human
uaguagagaugggguuucag

SEQ ID NO: 856375 - RNA, 21 nt, Human
uaguagagaugggguuucagg

SEQ ID NO: 856376 - RNA, 23 nt, Human
uaguagagaugggguuucaggca

SEQ ID NO: 856377 - RNA, 24 nt, Human
ucacugcaaccucugccucccggg

SEQ ID NO: 856378 - RNA, 25 nt, Human
ucacugcaaccucugccucccgggu

SEQ ID NO: 856379 - RNA, 18 nt, Human
ucagccucccaaauagcu

SEQ ID NO: 856380 - RNA, 22 nt, Human
ucaggccauaaaccauucucag

SEQ ID NO: 856381 - RNA, 24 nt, Human
ucccaaauagcugggauuacaggc

SEQ ID NO: 856382 - RNA, 24 nt, Human
ucccacucuguuguccaggcugga

SEQ ID NO: 856383 - RNA, 24 nt, Human
ucccagagugcugggauuacaggc

SEQ ID NO: 856384 - RNA, 19 nt, Human
ucccagcgauguugcugcc

SEQ ID NO: 856385 - RNA, 21 nt, Human
ucccggguucaagcgauucuc

SEQ ID NO: 856386 - RNA, 24 nt, Human
ucccggguucaagcgauucuccug

SEQ ID NO: 856387 - RNA, 27 nt, Human
ucccucauggagcaaaccagguaaggu

SEQ ID NO: 856388 - RNA, 26 nt, Human
ucuccugccucagccucccaaauagc

SEQ ID NO: 856389 - RNA, 23 nt, Human
ucucgaacuccugaccucaggug

SEQ ID NO: 856390 - RNA, 22 nt, Human
ucucugggcaaggcagcuccug

SEQ ID NO: 856391 - RNA, 24 nt, Human
ucuguuguccaggcuggagugcag

SEQ ID NO: 856392 - RNA, 23 nt, Human
ucuugaucaaacuugccuaaggc

SEQ ID NO: 856393 - RNA, 18 nt, Human
ugagacagagucccacuc

SEQ ID NO: 856394 - RNA, 22 nt, Human
ugagacagagucccacucuguu

SEQ ID NO: 856395 - RNA, 18 nt, Human
ugagacgcacacuccugg

SEQ ID NO: 856396 - RNA, 25 nt, Human
ugagacgcacacuccugguaacccc

SEQ ID NO: 856397 - RNA, 22 nt, Human
ugcagccccgcccccgcccccc

SEQ ID NO: 856398 - RNA, 27 nt, Human
ugccucagccucccaaauagcugggau

SEQ ID NO: 856399 - RNA, 22 nt, Human
ugcuacccauuuuggggagagg

SEQ ID NO: 856400 - RNA, 23 nt, Human
uggacaaggaacagccuguuuau

SEQ ID NO: 856401 - RNA, 23 nt, Human
uggagugcaguggugcgaucucg

SEQ ID NO: 856402 - RNA, 24 nt, Human
uggagugcaguggugcgaucucgg

SEQ ID NO: 856403 - RNA, 24 nt, Human
uggccaggcuggucucgaacuccu

SEQ ID NO: 856404 - RNA, 18 nt, Human
ugggauuacaggccugag

SEQ ID NO: 856405 - RNA, 19 nt, Human
ugggauuacaggccugagc

SEQ ID NO: 856406 - RNA, 21 nt, Human
ugggauuacaggccugagcca

SEQ ID NO: 856407 - RNA, 22 nt, Human
ugggauuacaggccugagccac

SEQ ID NO: 856408 - RNA, 23 nt, Human
ugggauuacaggccugagccacc

SEQ ID NO: 856409 - RNA, 24 nt, Human
ugggauuacaggccugagccaccg

SEQ ID NO: 856410 - RNA, 18 nt, Human
ugggauuacaggcuugcg

SEQ ID NO: 856411 - RNA, 24 nt, Human
ugggauuacaggcuugcgccacca

SEQ ID NO: 856412 - RNA, 24 nt, Human
ugggguuucaggcaguuggccagg

SEQ ID NO: 856413 - RNA, 21 nt, Human
uguauuuuuaguagagauggg

SEQ ID NO: 856414 - RNA, 20 nt, Human
uguccaggcuggagugcagu

SEQ ID NO: 856415 - RNA, 24 nt, Human
uguccaggcuggagugcaguggug

SEQ ID NO: 856416 - RNA, 18 nt, Human
uguugcugccccucccuc

SEQ ID NO: 856417 - RNA, 19 nt, Human
uguuguccaggcuggagug

SEQ ID NO: 856418 - RNA, 18 nt, Human
uuaguagagaugggguuu

SEQ ID NO: 856419 - RNA, 21 nt, Human
uucaagcgauucuccugccuc

SEQ ID NO: 856420 - RNA, 23 nt, Human
uucaagcgauucuccugccucag

SEQ ID NO: 856421 - RNA, 24 nt, Human
uucaagcgauucuccugccucagc

SEQ ID NO: 856422 - RNA, 22 nt, Human
uugagacagagucccacucugu

SEQ ID NO: 856423 - RNA, 23 nt, Human
uugcagccccgcccccgcccccc

SEQ ID NO: 856424 - RNA, 22 nt, Human
uuuuuaguagagaugggguuuc

SEQ ID NO: 856425 - RNA, 20 nt, Human
uuuuuguauuuuuaguagag

SEQ ID NO: 856426 - RNA, 20 nt, Human
uuuuuuuuuuugagacagag

SEQ ID NO: 856427 - RNA, 18 nt, Human
uuuuuuuuuuuuuuuuug

SEQ ID NO: 856428 - RNA, 25 nt, Human
aaaaaaaaaagacaaaaaaccucac

SEQ ID NO: 856429 - RNA, 22 nt, Human
aaaaaagacaaaaaaccucaca

SEQ ID NO: 856430 - RNA, 21 nt, Human
aaaaagucuaaaaugcuuaga

SEQ ID NO: 856431 - RNA, 18 nt, Human
aaacagcagaucaagucc

SEQ ID NO: 856432 - RNA, 21 nt, Human
aaacagcagaucaaguccagg

SEQ ID NO: 856433 - RNA, 23 nt, Human
aaacagcagaucaaguccaggga

SEQ ID NO: 856434 - RNA, 19 nt, Human
aaacaggaugagggaccuu

SEQ ID NO: 856435 - RNA, 19 nt, Human
aaacaggaugagggaccuu

SEQ ID NO: 856436 - RNA, 18 nt, Human
aaaccuuccuauuucaac

SEQ ID NO: 856437 - RNA, 24 nt, Human
aaaguagauacagcaauauaccaa

SEQ ID NO: 856438 - RNA, 19 nt, Human
aaccuagccucugaaacag

SEQ ID NO: 856439 - RNA, 19 nt, Human
aaccuguaacucucucccc

SEQ ID NO: 856440 - RNA, 23 nt, Human
aagcaacccacgggauucccucg

SEQ ID NO: 856441 - RNA, 20 nt, Human
aagcccaagucucaccuuuc

SEQ ID NO: 856442 - RNA, 19 nt, Human
aagcgggcagggccugagg

SEQ ID NO: 856443 - RNA, 26 nt, Human
aaguaucccagcccugauaaggcacc

SEQ ID NO: 856444 - RNA, 23 nt, Human
accagauacaugcuaccucccau

SEQ ID NO: 856445 - RNA, 19 nt, Human
accagccucagagggaggc

SEQ ID NO: 856446 - RNA, 25 nt, Human
accagccucagagggaggggaacgc

SEQ ID NO: 856447 - RNA, 19 nt, Human
accuguaacucucuccccc

SEQ ID NO: 856448 - RNA, 20 nt, Human
agaaacaaccuagccucuga

SEQ ID NO: 856449 - RNA, 26 nt, Human
agaugucuuaaggguuugaccugaag

SEQ ID NO: 856450 - RNA, 22 nt, Human
agcaauauaccaaaaaaaaaaa

SEQ ID NO: 856451 - RNA, 19 nt, Human
agcacccucugcccagccu

SEQ ID NO: 856452 - RNA, 22 nt, Human
agcccugauaaggcacccacag

SEQ ID NO: 856453 - RNA, 21 nt, Human
aggaagcgggcagggccugag

SEQ ID NO: 856454 - RNA, 21 nt, Human
aggccaauacauuacaaagga

SEQ ID NO: 856455 - RNA, 22 nt, Human
aggcccucuagcuguucugccu

SEQ ID NO: 856456 - RNA, 21 nt, Human
aggcgggcaggcggggaggcc

SEQ ID NO: 856457 - RNA, 24 nt, Human
agggaccuuuagacacgcaaggag

SEQ ID NO: 856458 - RNA, 19 nt, Human
agguauacacccucauacg

SEQ ID NO: 856459 - RNA, 23 nt, Human
auucagagaccagcuaauuugau

SEQ ID NO: 856460 - RNA, 30 nt, Human
caaaaaaaaaaaaaaaaaaagacaaaaaag

SEQ ID NO: 856461 - RNA, 21 nt, Human
caaaaaaccucacaauaauau

SEQ ID NO: 856462 - RNA, 22 nt, Human
caacaccaaaggccagguugca

SEQ ID NO: 856463 - RNA, 23 nt, Human
caacaccaaaggccagguugcag

SEQ ID NO: 856464 - RNA, 25 nt, Human
caacaccaaaggccagguugcagcu

SEQ ID NO: 856465 - RNA, 24 nt, Human
caaggcgggcaggcggggaggccc

SEQ ID NO: 856466 - RNA, 23 nt, Human
cacagaaacaaccuagccucuga

SEQ ID NO: 856467 - RNA, 21 nt, Human
caccaaaggccagguugcagc

SEQ ID NO: 856468 - RNA, 22 nt, Human
cacuaugaaguacacauuggaa

SEQ ID NO: 856469 - RNA, 21 nt, Human
cagaaguaucccagcccugau

SEQ ID NO: 856470 - RNA, 23 nt, Human
cagaguuaagaccagauacaugc

SEQ ID NO: 856471 - RNA, 20 nt, Human
cagcuucagaugucuuaagg

SEQ ID NO: 856472 - RNA, 19 nt, Human
caguaagccuuugcccugc

SEQ ID NO: 856473 - RNA, 23 nt, Human
caucauguccaaccuguaacucu

SEQ ID NO: 856474 - RNA, 20 nt, Human
ccaaaaaaaaaaaaaaaaaa

SEQ ID NO: 856475 - RNA, 21 nt, Human
cccaagucucaccuuucuaaa

SEQ ID NO: 856476 - RNA, 25 nt, Human
cccuaggucccuaugauuuaaaccc

SEQ ID NO: 856477 - RNA, 22 nt, Human
ccucggcugggcuggggauggg

SEQ ID NO: 856478 - RNA, 23 nt, Human
ccugagaccaggauuccuaaaac

SEQ ID NO: 856479 - RNA, 20 nt, Human
cgcaaggagacaugccucua

SEQ ID NO: 856480 - RNA, 24 nt, Human
cgggcaggcggggaggcccucuuc

SEQ ID NO: 856481 - RNA, 23 nt, Human
cuaaaaggccaauacauuacaaa

SEQ ID NO: 856482 - RNA, 21 nt, Human
cuagccagccaaggcgggcug

SEQ ID NO: 856483 - RNA, 24 nt, Human
cucucucccccucuucuuccauga

SEQ ID NO: 856484 - RNA, 18 nt, Human
cuguucugccucaccugu

SEQ ID NO: 856485 - RNA, 19 nt, Human
gaagccagaaucagaagua

SEQ ID NO: 856486 - RNA, 20 nt, Human
gaccaggauuccuaaaacaa

SEQ ID NO: 856487 - RNA, 19 nt, Human
gacucaaguuuaucaguaa

SEQ ID NO: 856488 - RNA, 21 nt, Human
gacuggggucgggaggguggg

SEQ ID NO: 856489 - RNA, 20 nt, Human
gagaagcccugaacccucgc

SEQ ID NO: 856490 - RNA, 18 nt, Human
gagggggcaguggacagg

SEQ ID NO: 856491 - RNA, 23 nt, Human
gcacgugcuagguguucccauac

SEQ ID NO: 856492 - RNA, 22 nt, Human
gccagaaucagaaguaucccag

SEQ ID NO: 856493 - RNA, 18 nt, Human
gcccugaacccucgcccu

SEQ ID NO: 856494 - RNA, 19 nt, Human
ggcaguggacaggaagcgg

SEQ ID NO: 856495 - RNA, 24 nt, Human
gggaggguggggcaggaaggaagc

SEQ ID NO: 856496 - RNA, 18 nt, Human
gggauggggagggggcag

SEQ ID NO: 856497 - RNA, 24 nt, Human
gggcaguggacaggaagcgggcaa

SEQ ID NO: 856498 - RNA, 18 nt, Human
ggggacuggggucgggag

SEQ ID NO: 856499 - RNA, 23 nt, Human
ggggagggggcaguggacaggaa

SEQ ID NO: 856500 - RNA, 22 nt, Human
ggggauggggagggggcagugg

SEQ ID NO: 856501 - RNA, 22 nt, Human
ggggcaguggacaggaagcggg

SEQ ID NO: 856502 - RNA, 23 nt, Human
guggggcaggaaggaagccagaa

SEQ ID NO: 856503 - RNA, 19 nt, Human
guucccauacgcacaggag

SEQ ID NO: 856504 - RNA, 24 nt, Human
uaaaaggccaauacauuacaaagg

SEQ ID NO: 856505 - RNA, 20 nt, Human
uaacaaacagaauuccacag

SEQ ID NO: 856506 - RNA, 23 nt, Human
uaacaaacagaauuccacagaaa

SEQ ID NO: 856507 - RNA, 20 nt, Human
uaaggcacccacagaaacaa

SEQ ID NO: 856508 - RNA, 23 nt, Human
uaaggcacccacagaaacaaccu

SEQ ID NO: 856509 - RNA, 21 nt, Human
uaaggguuugaccugaagccu

SEQ ID NO: 856510 - RNA, 22 nt, Human
uacaaucagaguuaagaccaga

SEQ ID NO: 856511 - RNA, 18 nt, Human
uacugaagaguguugcug

SEQ ID NO: 856512 - RNA, 24 nt, Human
uagauacagcaauauaccaaaaaa

SEQ ID NO: 856513 - RNA, 25 nt, Human
uauaccaaaaaaaaaaaaaaaaaaa

SEQ ID NO: 856514 - RNA, 23 nt, Human
uauuauguacugaagaguguugc

SEQ ID NO: 856515 - RNA, 21 nt, Human
ucagaacuuuugcuacaauca

SEQ ID NO: 856516 - RNA, 20 nt, Human
uccagagaagcccugaaccc

SEQ ID NO: 856517 - RNA, 20 nt, Human
uccaggcaggaggacugggg

SEQ ID NO: 856518 - RNA, 18 nt, Human
ucccccucuucuuccaug

SEQ ID NO: 856519 - RNA, 20 nt, Human
uccugagaccaggauuccua

SEQ ID NO: 856520 - RNA, 19 nt, Human
ugaaacagcagaucaaguc

SEQ ID NO: 856521 - RNA, 19 nt, Human
ugaaacagcagaucaaguc

SEQ ID NO: 856522 - RNA, 20 nt, Human
ugaaacagcagaucaagucc

SEQ ID NO: 856523 - RNA, 22 nt, Human
ugaaacagcagaucaaguccag

SEQ ID NO: 856524 - RNA, 22 nt, Human
ugagucagaggcagcccaucca

SEQ ID NO: 856525 - RNA, 22 nt, Human
ugauaaggcacccacagaaaca

SEQ ID NO: 856526 - RNA, 23 nt, Human
ugcagcuucagaugucuuaaggg

SEQ ID NO: 856527 - RNA, 24 nt, Human
ugccaaauccggccaugccucuga

SEQ ID NO: 856528 - RNA, 23 nt, Human
ugccucaccuguggggccccagc

SEQ ID NO: 856529 - RNA, 21 nt, Human
ugccucugagucagaggcagc

SEQ ID NO: 856530 - RNA, 24 nt, Human
uggagaaguaagagcucugcauga

SEQ ID NO: 856531 - RNA, 19 nt, Human
uggggauggggagggggca

SEQ ID NO: 856532 - RNA, 20 nt, Human
uuccuaaaacaaacaggaug

SEQ ID NO: 856533 - RNA, 20 nt, Human
uuuaucaguuaagcuuauua

SEQ ID NO: 856534 - RNA, 18 nt, Human
uuuuuuuuuuuuuuuuug

SEQ ID NO: 856535 - RNA, 22 nt, Human
uuuuuuuuuuuuuuuuugacgg

SEQ ID NO: 856536 - RNA, 19 nt, Human
aaaagaagacgcaagaaaa

SEQ ID NO: 856537 - RNA, 22 nt, Human
aaacaguccuccacaggcuucc

SEQ ID NO: 856538 - RNA, 23 nt, Human
aaacucaucaguaaucaaggaca

SEQ ID NO: 856539 - RNA, 24 nt, Human
aaacucaucaguaaucaaggacac

SEQ ID NO: 856540 - RNA, 22 nt, Human
aaacuuuuggaagaaacagucc

SEQ ID NO: 856541 - RNA, 25 nt, Human
aaaggacacaccuacaagaaaaggc

SEQ ID NO: 856542 - RNA, 24 nt, Human
aagaaaaggcaaaauauaugaaaa

SEQ ID NO: 856543 - RNA, 18 nt, Human
aaggggucacccggugag

SEQ ID NO: 856544 - RNA, 22 nt, Human
aagggucagcggucaacagagc

SEQ ID NO: 856545 - RNA, 19 nt, Human
aagguggucaucgucaccu

SEQ ID NO: 856546 - RNA, 19 nt, Human
acaaauugagaagacaagc

SEQ ID NO: 856547 - RNA, 22 nt, Human
accaaaaacaccaaaaaaauca

SEQ ID NO: 856548 - RNA, 23 nt, Human
aggauauaccaaaaacaccaaaa

SEQ ID NO: 856549 - RNA, 24 nt, Human
aggauauaccaaaaaccggggccc

SEQ ID NO: 856550 - RNA, 22 nt, Human
augaaacuggggcagcagccuc

SEQ ID NO: 856551 - RNA, 21 nt, Human
auugucaguuccugaaaucac

SEQ ID NO: 856552 - RNA, 21 nt, Human
caaaaacaccaaaaaaaucaa

SEQ ID NO: 856553 - RNA, 18 nt, Human
caaaaacccaaaaacaaa

SEQ ID NO: 856554 - RNA, 22 nt, Human
caaaaacccaaaaacaaauuga

SEQ ID NO: 856555 - RNA, 18 nt, Human
caaagcaaaggggucacc

SEQ ID NO: 856556 - RNA, 24 nt, Human
caagaaaaggcaaaauauaugaaa

SEQ ID NO: 856557 - RNA, 19 nt, Human
caccagugcaaauacacug

SEQ ID NO: 856558 - RNA, 18 nt, Human
cagcauccaugaaacugg

SEQ ID NO: 856559 - RNA, 18 nt, Human
caggaaaagaagacgcaa

SEQ ID NO: 856560 - RNA, 21 nt, Human
caguaaucaaggacacacaua

SEQ ID NO: 856561 - RNA, 26 nt, Human
cauauaaaugacaaagaauuaguaca

SEQ ID NO: 856562 - RNA, 27 nt, Human
ccaaaaacaccaaaaaaaucaauuuga

SEQ ID NO: 856563 - RNA, 19 nt, Human
ccaaggaccgaagaggaaa

SEQ ID NO: 856564 - RNA, 18 nt, Human
ccacacaaagagaugcug

SEQ ID NO: 856565 - RNA, 18 nt, Human
ccccgugggcaucagggc

SEQ ID NO: 856566 - RNA, 24 nt, Human
cugcuucguggauguacggugcaa

SEQ ID NO: 856567 - RNA, 24 nt, Human
cuuccuguucuccuacaggucuua

SEQ ID NO: 856568 - RNA, 20 nt, Human
gaaaagaagacgcaagaaaa

SEQ ID NO: 856569 - RNA, 19 nt, Human
gaaaaggacacaccuacaa

SEQ ID NO: 856570 - RNA, 21 nt, Human
gaaacaaaaacccaaaaacaa

SEQ ID NO: 856571 - RNA, 21 nt, Human
gaagaaacaguccuccacagg

SEQ ID NO: 856572 - RNA, 18 nt, Human
gaugcuguuuaaaaucgg

SEQ ID NO: 856573 - RNA, 22 nt, Human
gcaaauacacugacacuggcca

SEQ ID NO: 856574 - RNA, 19 nt, Human
gcuacagaggacauaaaug

SEQ ID NO: 856575 - RNA, 22 nt, Human
ggaagaaacaguccuccacagg

SEQ ID NO: 856576 - RNA, 21 nt, Human
ggaccgaagaggaaauugaac

SEQ ID NO: 856577 - RNA, 22 nt, Human
ggcaucagggcuugaggcacca

SEQ ID NO: 856578 - RNA, 20 nt, Human
ggccacacaaagagaugcug

SEQ ID NO: 856579 - RNA, 23 nt, Human
gugaaaggagauauuauuaaugc

SEQ ID NO: 856580 - RNA, 21 nt, Human
uaaaugacaaagaauuaguac

SEQ ID NO: 856581 - RNA, 20 nt, Human
uacaagaaaaggcaaaauau

SEQ ID NO: 856582 - RNA, 30 nt, Human
uacacaggauauaccaaaaacaccaaaaaa

SEQ ID NO: 856583 - RNA, 22 nt, Human
uauaaaugacaaagaauuagua

SEQ ID NO: 856584 - RNA, 24 nt, Human
uauacauguguaagagcuaacacu

SEQ ID NO: 856585 - RNA, 24 nt, Human
uauaccaaaaacaccaaaaaaauc

SEQ ID NO: 856586 - RNA, 25 nt, Human
ucaguccaacaaaugacaauugcuc

SEQ ID NO: 856587 - RNA, 25 nt, Human
ucaguuccugaaaucacugagggaa

SEQ ID NO: 856588 - RNA, 24 nt, Human
uccaacaaaugacaauugcucaaa

SEQ ID NO: 856589 - RNA, 28 nt, Human
ucucugaaacaaaaacccaaaaacaaag

SEQ ID NO: 856590 - RNA, 21 nt, Human
ucugaaacaaaaacccaaaaa

SEQ ID NO: 856591 - RNA, 22 nt, Human
ugaaaaggccaaggaccgaaga

SEQ ID NO: 856592 - RNA, 20 nt, Human
ugaaacaaaaacccaaaaac

SEQ ID NO: 856593 - RNA, 22 nt, Human
ugaaacaaaaacccaaaaacaa

SEQ ID NO: 856594 - RNA, 23 nt, Human
ugaaacaaaaacccaaaaacaaa

SEQ ID NO: 856595 - RNA, 25 nt, Human
ugaaacaaaaacccaaaaacaaauu

SEQ ID NO: 856596 - RNA, 19 nt, Human
ugagaagacaagccacaca

SEQ ID NO: 856597 - RNA, 22 nt, Human
ugagaagacaagccacacagug

SEQ ID NO: 856598 - RNA, 19 nt, Human
ugagggaaauaauuuggca

SEQ ID NO: 856599 - RNA, 21 nt, Human
ugcaaggagacaaauugcagu

SEQ ID NO: 856600 - RNA, 24 nt, Human
ugcuacagaggacauaaauggcaa

SEQ ID NO: 856601 - RNA, 26 nt, Human
ugcuacagaggacauaaauggcaaac

SEQ ID NO: 856602 - RNA, 21 nt, Human
uggaagaaacaguccuccaca

SEQ ID NO: 856603 - RNA, 24 nt, Human
uugaggcaccagugcaaauacacu

SEQ ID NO: 856604 - RNA, 24 nt, Human
uuggugcaguccucacuguuuguc

SEQ ID NO: 856605 - RNA, 18 nt, Human
cacccuuccucuccccuu

SEQ ID NO: 856606 - RNA, 21 nt, Human
cacccuuccucuccccuuacu

SEQ ID NO: 856607 - RNA, 19 nt, Human
caccugguggcaggaacac

SEQ ID NO: 856608 - RNA, 19 nt, Human
ccccuuacuccuuuuccag

SEQ ID NO: 856609 - RNA, 20 nt, Human
ccuuacuccuuuuccagucc

SEQ ID NO: 856610 - RNA, 19 nt, Human
cggcagaccccaccuuccc

SEQ ID NO: 856611 - RNA, 22 nt, Human
cucgcggggagcgggcaccugg

SEQ ID NO: 856612 - RNA, 20 nt, Human
cuuccucuccccuuacuccu

SEQ ID NO: 856613 - RNA, 20 nt, Human
gaccccaccuucccucgugc

SEQ ID NO: 856614 - RNA, 23 nt, Human
gcagaccccaccuucccucgugc

SEQ ID NO: 856615 - RNA, 22 nt, Human
gcucacccuuccucuccccuua

SEQ ID NO: 856616 - RNA, 18 nt, Human
ggggacugaagauagguu

SEQ ID NO: 856617 - RNA, 20 nt, Human
guggggacugaagauagguu

SEQ ID NO: 856618 - RNA, 18 nt, Human
ucagaaaagggcaucacg

SEQ ID NO: 856619 - RNA, 24 nt, Human
uccccuuacuccuuuuccaguccu

SEQ ID NO: 856620 - RNA, 19 nt, Human
ugcagcugcucacccuucc

SEQ ID NO: 856621 - RNA, 21 nt, Human
uggaucguguaaauaaaggua

SEQ ID NO: 856622 - RNA, 21 nt, Human
ugggugguauucugauuggga

SEQ ID NO: 856623 - RNA, 24 nt, Human
ugggugguauucugauugggaagg

SEQ ID NO: 856624 - RNA, 20 nt, Human
uucuucguuguccugugggu

SEQ ID NO: 856625 - RNA, 22 nt, Human
uuguccuuggaggaaaaucuag

SEQ ID NO: 856626 - RNA, 21 nt, Human
uuuuuuggcuaaaauauugcu

SEQ ID NO: 856627 - RNA, 18 nt, Human
uuuuuuuuuuuuuuuuug

SEQ ID NO: 856628 - RNA, 21 nt, Human
uuuuuuuuuuuuuuuuuggcu

SEQ ID NO: 856629 - RNA, 22 nt, Human
uuuuuuuuuuuuuuuuuuuggc

SEQ ID NO: 856630 - RNA, 24 nt, Human
aaagugcugggauuauaggcauga

SEQ ID NO: 856631 - RNA, 20 nt, Human
aagccugaaccagacagcaa

SEQ ID NO: 856632 - RNA, 19 nt, Human
aagugcugggauuauaggc

SEQ ID NO: 856633 - RNA, 21 nt, Human
aagugcugggauuauaggcau

SEQ ID NO: 856634 - RNA, 22 nt, Human
acaggacuaucaggaacccauu

SEQ ID NO: 856635 - RNA, 20 nt, Human
accucacauggaaguagggc

SEQ ID NO: 856636 - RNA, 22 nt, Human
acuccucauuuucccuccccac

SEQ ID NO: 856637 - RNA, 24 nt, Human
agccuugcuauucaaagauggucu

SEQ ID NO: 856638 - RNA, 20 nt, Human
aggauggaacagccaaccgu

SEQ ID NO: 856639 - RNA, 21 nt, Human
aggcaugagccacugugccca

SEQ ID NO: 856640 - RNA, 19 nt, Human
aggcauuugccaccacgcc

SEQ ID NO: 856641 - RNA, 24 nt, Human
aggugauccucccaccuuggccuc

SEQ ID NO: 856642 - RNA, 25 nt, Human
aggugauccucccaccuuggccucc

SEQ ID NO: 856643 - RNA, 21 nt, Human
aguagcugggauuauaggcau

SEQ ID NO: 856644 - RNA, 19 nt, Human
agugcagugguacaaucuc

SEQ ID NO: 856645 - RNA, 19 nt, Human
aucuagagccuugcuauuc

SEQ ID NO: 856646 - RNA, 24 nt, Human
aucucaggccccacccaaaccaac

SEQ ID NO: 856647 - RNA, 22 nt, Human
augccucagccucccgaguagc

SEQ ID NO: 856648 - RNA, 21 nt, Human
auggaaguagggccuacccuc

SEQ ID NO: 856649 - RNA, 20 nt, Human
auggaguuucaucacguugg

SEQ ID NO: 856650 - RNA, 24 nt, Human
caaagugcugggauuauaggcaug

SEQ ID NO: 856651 - RNA, 28 nt, Human
caaguaauucucaugccucagccucccg

SEQ ID NO: 856652 - RNA, 19 nt, Human
cacaggacuaucaggaacc

SEQ ID NO: 856653 - RNA, 20 nt, Human
caccaccaccaccagaaucu

SEQ ID NO: 856654 - RNA, 22 nt, Human
caccagcagcacuggcagcacc

SEQ ID NO: 856655 - RNA, 20 nt, Human
cacguuggccaggcuggccu

SEQ ID NO: 856656 - RNA, 24 nt, Human
cacguuggccaggcuggccuugaa

SEQ ID NO: 856657 - RNA, 23 nt, Human
cacugcgaucucugccuccuggg

SEQ ID NO: 856658 - RNA, 20 nt, Human
cacuuuuuuuuugagacaca

SEQ ID NO: 856659 - RNA, 20 nt, Human
cagaaucucaggccccaccc

SEQ ID NO: 856660 - RNA, 26 nt, Human
caucacguuggccaggcuggccuuga

SEQ ID NO: 856661 - RNA, 27 nt, Human
cauucagaaacacacgacccauuuagc

SEQ ID NO: 856662 - RNA, 24 nt, Human
ccaaagugcugggauuauaggcau

SEQ ID NO: 856663 - RNA, 26 nt, Human
ccaccaccaccaccagaaggccucgg

SEQ ID NO: 856664 - RNA, 21 nt, Human
ccaccacgccuggcuuuuugu

SEQ ID NO: 856665 - RNA, 19 nt, Human
cccacagccccuggccacc

SEQ ID NO: 856666 - RNA, 27 nt, Human
cccacagccccuggccaccaccaccac

SEQ ID NO: 856667 - RNA, 21 nt, Human
ccccacagccccuggccacca

SEQ ID NO: 856668 - RNA, 23 nt, Human
cccgaguagcugggauuauaggc

SEQ ID NO: 856669 - RNA, 24 nt, Human
cccgaguagcugggauuauaggca

SEQ ID NO: 856670 - RNA, 24 nt, Human
ccgaguagcugggauuauaggcau

SEQ ID NO: 856671 - RNA, 26 nt, Human
ccucccaccuuggccucccaaagugc

SEQ ID NO: 856672 - RNA, 24 nt, Human
ccugaccucaggugauccucccac

SEQ ID NO: 856673 - RNA, 19 nt, Human
ccuggccaccaccaccacc

SEQ ID NO: 856674 - RNA, 23 nt, Human
ccuggguucaaguaauucucaug

SEQ ID NO: 856675 - RNA, 18 nt, Human
ccuuauccaccucaacuc

SEQ ID NO: 856676 - RNA, 23 nt, Human
cgucuguugcccagacuggagug

SEQ ID NO: 856677 - RNA, 23 nt, Human
cgucuguugcccagacuggagug

SEQ ID NO: 856678 - RNA, 24 nt, Human
cucacugcgaucucugccuccugg

SEQ ID NO: 856679 - RNA, 23 nt, Human
cucagccucccgaguagcuggga

SEQ ID NO: 856680 - RNA, 24 nt, Human
cucaggugauccucccaccuuggc

SEQ ID NO: 856681 - RNA, 25 nt, Human
cucaugccucagccucccgaguagc

SEQ ID NO: 856682 - RNA, 23 nt, Human
cucauuuucccuccccacagccc

SEQ ID NO: 856683 - RNA, 21 nt, Human
cuccuggguucaaguaauucu

SEQ ID NO: 856684 - RNA, 20 nt, Human
cucugccuccuggguucaag

SEQ ID NO: 856685 - RNA, 18 nt, Human
cucuuuucaucuuccaaa

SEQ ID NO: 856686 - RNA, 26 nt, Human
cugaaccagacagcaauuugcuccuu

SEQ ID NO: 856687 - RNA, 23 nt, Human
cugagguggagaucauagcaacu

SEQ ID NO: 856688 - RNA, 24 nt, Human
cugcgaucucugccuccuggguuc

SEQ ID NO: 856689 - RNA, 22 nt, Human
cuggccaccaccaccaccagaa

SEQ ID NO: 856690 - RNA, 18 nt, Human
cuuauccaccucaacuca

SEQ ID NO: 856691 - RNA, 21 nt, Human
cuuccaaucugaaaagagaug

SEQ ID NO: 856692 - RNA, 21 nt, Human
cuuuuuguauuuuuuguagag

SEQ ID NO: 856693 - RNA, 23 nt, Human
gaccucaggugauccucccaccu

SEQ ID NO: 856694 - RNA, 19 nt, Human
gagaugagcgaaaacagua

SEQ ID NO: 856695 - RNA, 18 nt, Human
gagauggaguuucaucac

SEQ ID NO: 856696 - RNA, 18 nt, Human
gagccacugugcccaaaa

SEQ ID NO: 856697 - RNA, 21 nt, Human
gauuauaggcaugagccacug

SEQ ID NO: 856698 - RNA, 24 nt, Human
gauuauaggcaugagccacugugc

SEQ ID NO: 856699 - RNA, 20 nt, Human
gcacuggcagcaccuaggga

SEQ ID NO: 856700 - RNA, 23 nt, Human
gcuggccuugaacuccugaccuc

SEQ ID NO: 856701 - RNA, 22 nt, Human
ggaguuucaucacguuggccag

SEQ ID NO: 856702 - RNA, 23 nt, Human
ggaguuucaucacguuggccagg

SEQ ID NO: 856703 - RNA, 20 nt, Human
ggccaccaccaccaccagaa

SEQ ID NO: 856704 - RNA, 24 nt, Human
ggcuggccuugaacuccugaccuc

SEQ ID NO: 856705 - RNA, 24 nt, Human
guaauucucaugccucagccuccc

SEQ ID NO: 856706 - RNA, 18 nt, Human
guagcugggauuauaggc

SEQ ID NO: 856707 - RNA, 20 nt, Human
guagcugggauuauaggcau

SEQ ID NO: 856708 - RNA, 20 nt, Human
guauuuuuuguagagaugga

SEQ ID NO: 856709 - RNA, 24 nt, Human
uaauauauccuuuaccugagauuu

SEQ ID NO: 856710 - RNA, 18 nt, Human
uaauggacuagaucagag

SEQ ID NO: 856711 - RNA, 18 nt, Human
uaauuaccucacauggaa

SEQ ID NO: 856712 - RNA, 20 nt, Human
uaauucucaugccucagccu

SEQ ID NO: 856713 - RNA, 18 nt, Human
uaauuuauuugucucccu

SEQ ID NO: 856714 - RNA, 23 nt, Human
uagagccuugcuauucaaagaug

SEQ ID NO: 856715 - RNA, 20 nt, Human
uaggcauuugccaccacgcc

SEQ ID NO: 856716 - RNA, 22 nt, Human
uauauggaaauuuuguaaauuu

SEQ ID NO: 856717 - RNA, 24 nt, Human
ucacugcgaucucugccuccuggg

SEQ ID NO: 856718 - RNA, 25 nt, Human
ucacugcgaucucugccuccugggg

SEQ ID NO: 856719 - RNA, 25 nt, Human
ucacugcgaucucugccuccugggu

SEQ ID NO: 856720 - RNA, 24 nt, Human
ucagaaacacacgacccauuuagc

SEQ ID NO: 856721 - RNA, 20 nt, Human
ucagccucccgaguagcugg

SEQ ID NO: 856722 - RNA, 22 nt, Human
ucaggaacccauucagaaacac

SEQ ID NO: 856723 - RNA, 23 nt, Human
ucagguaacguuugucaugcaac

SEQ ID NO: 856724 - RNA, 18 nt, Human
ucaucuguagcccaguua

SEQ ID NO: 856725 - RNA, 20 nt, Human
ucaucuuccaaaacugaaau

SEQ ID NO: 856726 - RNA, 24 nt, Human
ucccaaagugcugggauuauaggc

SEQ ID NO: 856727 - RNA, 24 nt, Human
ucccgaguagcugggauuauaggc

SEQ ID NO: 856728 - RNA, 21 nt, Human
uccucauuuucccuccccaca

SEQ ID NO: 856729 - RNA, 21 nt, Human
uccuggguucaaguaauucuc

SEQ ID NO: 856730 - RNA, 24 nt, Human
uccuggguucaaguaauucucaug

SEQ ID NO: 856731 - RNA, 23 nt, Human
ucuaauauauccuuuaccugaga

SEQ ID NO: 856732 - RNA, 24 nt, Human
ucuccgucuguugcccagacugga

SEQ ID NO: 856733 - RNA, 23 nt, Human
ucuguagcccaguuaucuagagc

SEQ ID NO: 856734 - RNA, 24 nt, Human
ucuguugcccagacuggagugcag

SEQ ID NO: 856735 - RNA, 27 nt, Human
ugaaccagacagcaauuugcuccuucc

SEQ ID NO: 856736 - RNA, 18 nt, Human
ugaccucaggugauccuc

SEQ ID NO: 856737 - RNA, 20 nt, Human
ugaccucaggugauccuccc

SEQ ID NO: 856738 - RNA, 21 nt, Human
ugaccucaggugauccuccca

SEQ ID NO: 856739 - RNA, 24 nt, Human
ugaccucaggugauccucccaccu

SEQ ID NO: 856740 - RNA, 18 nt, Human
ugagcgaaaacaguauau

SEQ ID NO: 856741 - RNA, 22 nt, Human
ugccaccacgccuggcuuuuug

SEQ ID NO: 856742 - RNA, 21 nt, Human
ugcccagacuggagugcagug

SEQ ID NO: 856743 - RNA, 22 nt, Human
ugccucagccucccgaguagcu

SEQ ID NO: 856744 - RNA, 24 nt, Human
ugccucagccucccgaguagcugg

SEQ ID NO: 856745 - RNA, 23 nt, Human
uggaaauuuuguaaauuagcuug

SEQ ID NO: 856746 - RNA, 18 nt, Human
uggagugcagugguacaa

SEQ ID NO: 856747 - RNA, 19 nt, Human
uggagugcagugguacaau

SEQ ID NO: 856748 - RNA, 23 nt, Human
uggagugcagugguacaaucuca

SEQ ID NO: 856749 - RNA, 24 nt, Human
uggaguuucaucacguuggccagg

SEQ ID NO: 856750 - RNA, 20 nt, Human
uggcagcaccuagggacuug

SEQ ID NO: 856751 - RNA, 22 nt, Human
uggccaccaccaccaccagaau

SEQ ID NO: 856752 - RNA, 24 nt, Human
uggccaggcuggccuugaacuccu

SEQ ID NO: 856753 - RNA, 20 nt, Human
uggccuugaacuccugaccu

SEQ ID NO: 856754 - RNA, 21 nt, Human
ugggaaaaaugcagaaucuca

SEQ ID NO: 856755 - RNA, 18 nt, Human
ugggauuauaggcaugag

SEQ ID NO: 856756 - RNA, 21 nt, Human
ugggauuauaggcaugagcca

SEQ ID NO: 856757 - RNA, 22 nt, Human
ugggauuauaggcaugagccac

SEQ ID NO: 856758 - RNA, 22 nt, Human
ugggauuauaggcaugagccac

SEQ ID NO: 856759 - RNA, 22 nt, Human
ugggauuauaggcaugagccac

SEQ ID NO: 856760 - RNA, 24 nt, Human
ugggauuauaggcaugagccacug

SEQ ID NO: 856761 - RNA, 26 nt, Human
ugggauuauaggcaugagccacugug

SEQ ID NO: 856762 - RNA, 19 nt, Human
ugggauuauaggcauuugc

SEQ ID NO: 856763 - RNA, 21 nt, Human
ugggauuauaggcauuugcca

SEQ ID NO: 856764 - RNA, 24 nt, Human
ugggauuauaggcauuugccacca

SEQ ID NO: 856765 - RNA, 24 nt, Human
ugguacaaucucaacucacugcga

SEQ ID NO: 856766 - RNA, 18 nt, Human
uguaaaaggcaggcuucc

SEQ ID NO: 856767 - RNA, 19 nt, Human
uuaaaccguaacuccucau

SEQ ID NO: 856768 - RNA, 21 nt, Human
uuagcuugcauguuauuaagc

SEQ ID NO: 856769 - RNA, 18 nt, Human
uuaguacuaucuaccacc

SEQ ID NO: 856770 - RNA, 21 nt, Human
uucaaagauggucugugcacc

SEQ ID NO: 856771 - RNA, 23 nt, Human
uucaaguaauucucaugccucag

SEQ ID NO: 856772 - RNA, 18 nt, Human
uucaucuuccaaaacuga

SEQ ID NO: 856773 - RNA, 24 nt, Human
uugccaccacgccuggcuuuuugu

SEQ ID NO: 856774 - RNA, 24 nt, Human
uugcccagacuggagugcaguggu

SEQ ID NO: 856775 - RNA, 18 nt, Human
uuggccucccaaagugcu

SEQ ID NO: 856776 - RNA, 24 nt, Human
uuguagagauggaguuucaucacg

SEQ ID NO: 856777 - RNA, 21 nt, Human
uuucaucacguuggccaggcu

SEQ ID NO: 856778 - RNA, 25 nt, Human
uuuugagacacagucuccgucuguu

SEQ ID NO: 856779 - RNA, 23 nt, Human
uuuuuguauuuuuuguagagaug

SEQ ID NO: 856780 - RNA, 24 nt, Human
uuuuuuguagagauggaguuucau

SEQ ID NO: 856781 - RNA, 19 nt, Human
uuuuuuuuuuuuuuuugcc

SEQ ID NO: 856782 - RNA, 22 nt, Human
uuuuuuuuuuuuuuuuugccuu

SEQ ID NO: 856783 - RNA, 20 nt, Human
uuuuuuuuuuuuuuuuuugg

SEQ ID NO: 856784 - RNA, 23 nt, Human
agcaaaggcagagccaaccacaa

SEQ ID NO: 856785 - RNA, 18 nt, Human
aggaggccuggaccugug

SEQ ID NO: 856786 - RNA, 22 nt, Human
aggcaggagcuagcuguuucuu

SEQ ID NO: 856787 - RNA, 23 nt, Human
cagcaaaggcagagccaaccaca

SEQ ID NO: 856788 - RNA, 27 nt, Human
cagcaaaggcagagccaaccacaacua

SEQ ID NO: 856789 - RNA, 18 nt, Human
caggaggccuggaccugu

SEQ ID NO: 856790 - RNA, 23 nt, Human
caggauaucacaaggccgauuga

SEQ ID NO: 856791 - RNA, 25 nt, Human
ccaaccacaacuacccuuuuuuagc

SEQ ID NO: 856792 - RNA, 21 nt, Human
ccccuggacccgggccugacc

SEQ ID NO: 856793 - RNA, 22 nt, Human
ccccuggacccgggccugaccu

SEQ ID NO: 856794 - RNA, 24 nt, Human
cccugcagccggccacuuccccua

SEQ ID NO: 856795 - RNA, 22 nt, Human
cccuggacccgggccugaccuc

SEQ ID NO: 856796 - RNA, 20 nt, Human
ccgugcagucccugcagccg

SEQ ID NO: 856797 - RNA, 23 nt, Human
ccuggaccugugugucgcagggg

SEQ ID NO: 856798 - RNA, 20 nt, Human
cucacagauugccucaccgu

SEQ ID NO: 856799 - RNA, 24 nt, Human
gaacugguuuuauagguuugggau

SEQ ID NO: 856800 - RNA, 19 nt, Human
gacccgggccugaccucua

SEQ ID NO: 856801 - RNA, 20 nt, Human
ggaagguuacaguuggggca

SEQ ID NO: 856802 - RNA, 24 nt, Human
ggugcauagucacgagguggaggg

SEQ ID NO: 856803 - RNA, 21 nt, Human
guucacauggcaggauaucac

SEQ ID NO: 856804 - RNA, 19 nt, Human
uaaagacagcaaaggcaga

SEQ ID NO: 856805 - RNA, 23 nt, Human
uaaagacagcaaaggcagagcca

SEQ ID NO: 856806 - RNA, 22 nt, Human
uagugguucuccuguugcucaa

SEQ ID NO: 856807 - RNA, 18 nt, Human
uccccuggacccgggccu

SEQ ID NO: 856808 - RNA, 24 nt, Human
ucuucuuuagugguucuccuguug

SEQ ID NO: 856809 - RNA, 24 nt, Human
ugaaaagggagucagcgaagggcg

SEQ ID NO: 856810 - RNA, 21 nt, Human
ugacuccaggaggccuggacc

SEQ ID NO: 856811 - RNA, 23 nt, Human
ugcugcugcugaagggaccgugg

SEQ ID NO: 856812 - RNA, 20 nt, Human
uggagggaguucacauggca

SEQ ID NO: 856813 - RNA, 19 nt, Human
uucacauggcaggauauca

SEQ ID NO: 856814 - RNA, 24 nt, Human
uuucuucuucuuuagugguucucc

SEQ ID NO: 856815 - RNA, 19 nt, Human
uuuuuuuuuuuuuuuuugu

SEQ ID NO: 856816 - RNA, 20 nt, Human
uuuuuuuuuuuuuuuuuugg

SEQ ID NO: 856817 - RNA, 22 nt, Human
aaacacagauccgagcuuuuca

SEQ ID NO: 856818 - RNA, 25 nt, Human
aaacuuuacggaaaugcaacaaucu

SEQ ID NO: 856819 - RNA, 19 nt, Human
aaagacaagggggauggag

SEQ ID NO: 856820 - RNA, 20 nt, Human
aacacagauccgagcuuuuc

SEQ ID NO: 856821 - RNA, 19 nt, Human
aauaacacaaucgacagga

SEQ ID NO: 856822 - RNA, 21 nt, Human
acacaaucgacaggacugucu

SEQ ID NO: 856823 - RNA, 26 nt, Human
accagacgcugcauuucaggugcucc

SEQ ID NO: 856824 - RNA, 19 nt, Human
agacaagggggauggagcu

SEQ ID NO: 856825 - RNA, 21 nt, Human
agauuucacuguuaagaaaau

SEQ ID NO: 856826 - RNA, 24 nt, Human
agauuucacuguuaagaaaauucu

SEQ ID NO: 856827 - RNA, 20 nt, Human
augaguuacuaaauguagca

SEQ ID NO: 856828 - RNA, 22 nt, Human
auggaggacagcuuuuucaggg

SEQ ID NO: 856829 - RNA, 23 nt, Human
caagccuggccuuccccaaacac

SEQ ID NO: 856830 - RNA, 20 nt, Human
cacccucuacccuccccuca

SEQ ID NO: 856831 - RNA, 21 nt, Human
cagcgcugucgcuguggcugc

SEQ ID NO: 856832 - RNA, 19 nt, Human
cagcugaauuucuugggcu

SEQ ID NO: 856833 - RNA, 19 nt, Human
ccuggaacgccgggagcuc

SEQ ID NO: 856834 - RNA, 22 nt, Human
ccuggaacgccgggagcucaga

SEQ ID NO: 856835 - RNA, 25 nt, Human
cgagcuuuucacccucuacccuccc

SEQ ID NO: 856836 - RNA, 20 nt, Human
cgcaggcaagcacaaagaca

SEQ ID NO: 856837 - RNA, 19 nt, Human
gcagugugguaaaaauaua

SEQ ID NO: 856838 - RNA, 20 nt, Human
gcugucgcuguggcugcugc

SEQ ID NO: 856839 - RNA, 19 nt, Human
ggagcgcaagccuggccuu

SEQ ID NO: 856840 - RNA, 21 nt, Human
guggcugcugcugccgcuacg

SEQ ID NO: 856841 - RNA, 18 nt, Human
uaaguuuuggcagucaca

SEQ ID NO: 856842 - RNA, 23 nt, Human
uaugaagaacugugcuguuggug

SEQ ID NO: 856843 - RNA, 18 nt, Human
uaugaucagauuucacug

SEQ ID NO: 856844 - RNA, 19 nt, Human
uaugaucagauuucacugu

SEQ ID NO: 856845 - RNA, 19 nt, Human
ucgcuguggcugcugcugc

SEQ ID NO: 856846 - RNA, 19 nt, Human
ugagauuuuaaaaaauguc

SEQ ID NO: 856847 - RNA, 21 nt, Human
ugcauggauaacugaacaugu

SEQ ID NO: 856848 - RNA, 20 nt, Human
uggagcuucuacacagggcc

SEQ ID NO: 856849 - RNA, 22 nt, Human
uggauaacugaacaugugggag

SEQ ID NO: 856850 - RNA, 26 nt, Human
uggggacgcaggcaagcacaaagaca

SEQ ID NO: 856851 - RNA, 19 nt, Human
ugggugaaaugaguuacua

SEQ ID NO: 856852 - RNA, 18 nt, Human
uuuuuuuuuuuuuuuuug

SEQ ID NO: 856853 - RNA, 21 nt, Human
uuuuuuuuuuuuuuuuuuggg

SEQ ID NO: 856854 - RNA, 19 nt, Human
aaccuugcucuucuuccuc

SEQ ID NO: 856855 - RNA, 20 nt, Human
aagacugcagaaguagauga

SEQ ID NO: 856856 - RNA, 18 nt, Human
acagucauuaauucagag

SEQ ID NO: 856857 - RNA, 20 nt, Human
acugcaagcuccgccuccca

SEQ ID NO: 856858 - RNA, 22 nt, Human
acugcaagcuccgccucccagg

SEQ ID NO: 856859 - RNA, 18 nt, Human
agagaaucgggcuuugca

SEQ ID NO: 856860 - RNA, 21 nt, Human
agcccccagcugcucgguccu

SEQ ID NO: 856861 - RNA, 21 nt, Human
aggagauaacagaaaaacaag

SEQ ID NO: 856862 - RNA, 18 nt, Human
aggcuggagugcaguggc

SEQ ID NO: 856863 - RNA, 20 nt, Human
agugcaguggcucagucucg

SEQ ID NO: 856864 - RNA, 24 nt, Human
agugcaguggcucagucucggcuu

SEQ ID NO: 856865 - RNA, 23 nt, Human
auauacagucauuaauucagagu

SEQ ID NO: 856866 - RNA, 18 nt, Human
cagaaguagaugaagaaa

SEQ ID NO: 856867 - RNA, 22 nt, Human
cagagcaggcugcagcccccag

SEQ ID NO: 856868 - RNA, 22 nt, Human
caugucauucuccugccucagc

SEQ ID NO: 856869 - RNA, 24 nt, Human
cauuuuuuuuuggcugccauuuuu

SEQ ID NO: 856870 - RNA, 23 nt, Human
ccaggcauccaguuaugccugau

SEQ ID NO: 856871 - RNA, 20 nt, Human
ccagucuuaaagcugcagag

SEQ ID NO: 856872 - RNA, 20 nt, Human
cccagguucaugucauucuc

SEQ ID NO: 856873 - RNA, 25 nt, Human
ccuacacugcggcguccgccucaga

SEQ ID NO: 856874 - RNA, 19 nt, Human
ccugcaggccugccuccaa

SEQ ID NO: 856875 - RNA, 22 nt, Human
cgcccagauccagacucacagc

SEQ ID NO: 856876 - RNA, 18 nt, Human
cucaaaacaauaaaacug

SEQ ID NO: 856877 - RNA, 25 nt, Human
cuccugccucagccucuugcgagcu

SEQ ID NO: 856878 - RNA, 24 nt, Human
cugcaagcuccgccucccagguuc

SEQ ID NO: 856879 - RNA, 21 nt, Human
cugccucagccucuugcgagc

SEQ ID NO: 856880 - RNA, 21 nt, Human
cuugcucuauugcccaggcug

SEQ ID NO: 856881 - RNA, 19 nt, Human
cuuucagauaacucaacug

SEQ ID NO: 856882 - RNA, 18 nt, Human
gacagagcaggcugcagc

SEQ ID NO: 856883 - RNA, 19 nt, Human
gagcaggcugcagccccca

SEQ ID NO: 856884 - RNA, 19 nt, Human
gauaacagaaaaacaagga

SEQ ID NO: 856885 - RNA, 23 nt, Human
gccaaaaagccucuucuuacaga

SEQ ID NO: 856886 - RNA, 18 nt, Human
gccgcaggggagcuuuga

SEQ ID NO: 856887 - RNA, 25 nt, Human
gccucccagguucaugucauucucc

SEQ ID NO: 856888 - RNA, 25 nt, Human
gcucuauugcccaggcuggagugca

SEQ ID NO: 856889 - RNA, 25 nt, Human
gcuggagugcaguggcucagucucg

SEQ ID NO: 856890 - RNA, 18 nt, Human
gcuuugacccccucucuc

SEQ ID NO: 856891 - RNA, 19 nt, Human
ggccgcaggggagcuuuga

SEQ ID NO: 856892 - RNA, 19 nt, Human
ggcuggagugcaguggcuc

SEQ ID NO: 856893 - RNA, 20 nt, Human
gggugcgaacgcccagaucc

SEQ ID NO: 856894 - RNA, 24 nt, Human
gucuugcucuauugcccaggcugg

SEQ ID NO: 856895 - RNA, 23 nt, Human
gugacccgaggcuguccucaacc

SEQ ID NO: 856896 - RNA, 19 nt, Human
uaaaaccugacaccauuua

SEQ ID NO: 856897 - RNA, 22 nt, Human
uaacucaacugaagaaguugac

SEQ ID NO: 856898 - RNA, 19 nt, Human
uaacucaugggauggacaa

SEQ ID NO: 856899 - RNA, 22 nt, Human
uagcuaccucaaaggagauaac

SEQ ID NO: 856900 - RNA, 19 nt, Human
uauugcccaggcuggagug

SEQ ID NO: 856901 - RNA, 21 nt, Human
ucaaaggagauaacagaaaaa

SEQ ID NO: 856902 - RNA, 18 nt, Human
ucaagacgaacucuaacu

SEQ ID NO: 856903 - RNA, 22 nt, Human
ucaagacgaacucuaacucaug

SEQ ID NO: 856904 - RNA, 21 nt, Human
uccaaacuacucuggugaccc

SEQ ID NO: 856905 - RNA, 21 nt, Human
ucccagguucaugucauucuc

SEQ ID NO: 856906 - RNA, 24 nt, Human
ucccagguucaugucauucuccug

SEQ ID NO: 856907 - RNA, 24 nt, Human
ucuauugcccaggcuggagugcag

SEQ ID NO: 856908 - RNA, 25 nt, Human
ucuccugccucagccucuugcgagc

SEQ ID NO: 856909 - RNA, 21 nt, Human
ucucucugggaucggugggga

SEQ ID NO: 856910 - RNA, 19 nt, Human
ucuugcucuauugcccagg

SEQ ID NO: 856911 - RNA, 23 nt, Human
ucuugcucuauugcccaggcugg

SEQ ID NO: 856912 - RNA, 24 nt, Human
ucuugcucuauugcccaggcugga

SEQ ID NO: 856913 - RNA, 23 nt, Human
ugaacaccuccuguggcuaccca

SEQ ID NO: 856914 - RNA, 22 nt, Human
ugagauggagucuugcucuauu

SEQ ID NO: 856915 - RNA, 23 nt, Human
ugcaauagaaauagcuauauaaa

SEQ ID NO: 856916 - RNA, 21 nt, Human
ugcccaggcuggagugcagug

SEQ ID NO: 856917 - RNA, 22 nt, Human
ugcccaggcuggagugcagugg

SEQ ID NO: 856918 - RNA, 25 nt, Human
ugcccaggcuggagugcaguggcuc

SEQ ID NO: 856919 - RNA, 26 nt, Human
ugcccuuggucaaaucuaaaugaucu

SEQ ID NO: 856920 - RNA, 23 nt, Human
ugccucagccucuugcgagcuga

SEQ ID NO: 856921 - RNA, 24 nt, Human
ugcucuauugcccaggcuggagug

SEQ ID NO: 856922 - RNA, 23 nt, Human
uggaagauguaaaauaaguaagg

SEQ ID NO: 856923 - RNA, 24 nt, Human
uggagucuugcucuauugcccagg

SEQ ID NO: 856924 - RNA, 23 nt, Human
uggagugcaguggcucagucucg

SEQ ID NO: 856925 - RNA, 24 nt, Human
uggagugcaguggcucagucucgg

SEQ ID NO: 856926 - RNA, 21 nt, Human
uggcagcacucagaaugcaag

SEQ ID NO: 856927 - RNA, 20 nt, Human
ugggauggacaaacuggaag

SEQ ID NO: 856928 - RNA, 19 nt, Human
uuaaaagggcuguuuaaua

SEQ ID NO: 856929 - RNA, 19 nt, Human
uuacugcaagcuccgccuc

SEQ ID NO: 856930 - RNA, 24 nt, Human
uuacugcaagcuccgccucccagg

SEQ ID NO: 856931 - RNA, 24 nt, Human
uugcccaggcuggagugcaguggc

SEQ ID NO: 856932 - RNA, 24 nt, Human
uugcucuauugcccaggcuggagu

SEQ ID NO: 856933 - RNA, 24 nt, Human
uuuuuuuuuuuugagauggagucu

SEQ ID NO: 856934 - RNA, 22 nt, Human
uuuuuuuuuuuuuugagaugga

SEQ ID NO: 856935 - RNA, 20 nt, Human
uuuuuuuuuuuuuuuuuugg

SEQ ID NO: 856936 - RNA, 21 nt, Human
aaacacaacaagcaaacuccu

SEQ ID NO: 856937 - RNA, 18 nt, Human
aagcaaacacaacaagca

SEQ ID NO: 856938 - RNA, 19 nt, Human
aagcaaacacaacaagcaa

SEQ ID NO: 856939 - RNA, 22 nt, Human
aagcaaacacaacaagcaaacu

SEQ ID NO: 856940 - RNA, 21 nt, Human
aaugagccauuugcucagacc

SEQ ID NO: 856941 - RNA, 20 nt, Human
acccacccacuccagccgca

SEQ ID NO: 856942 - RNA, 19 nt, Human
acuggagccuccuggaagg

SEQ ID NO: 856943 - RNA, 24 nt, Human
agcaaacuccuuaccucuggcacc

SEQ ID NO: 856944 - RNA, 19 nt, Human
aggcaaggaggccaggccc

SEQ ID NO: 856945 - RNA, 22 nt, Human
aggccaggcccaggcccugagg

SEQ ID NO: 856946 - RNA, 23 nt, Human
aggccaggcccaggcccugagga

SEQ ID NO: 856947 - RNA, 23 nt, Human
caacaagcaaacuccuuaccucu

SEQ ID NO: 856948 - RNA, 21 nt, Human
caacugucgccuccaagcaaa

SEQ ID NO: 856949 - RNA, 26 nt, Human
caagcaaacacaacaagcaaacuccu

SEQ ID NO: 856950 - RNA, 19 nt, Human
cacacaccccacgaggugg

SEQ ID NO: 856951 - RNA, 23 nt, Human
cacaccccacgaggugggcaccg

SEQ ID NO: 856952 - RNA, 22 nt, Human
cacaggcaaggaggccaggccc

SEQ ID NO: 856953 - RNA, 21 nt, Human
caccaaacagugaucgugauc

SEQ ID NO: 856954 - RNA, 25 nt, Human
cacccacccacuccagccgcagaac

SEQ ID NO: 856955 - RNA, 18 nt, Human
caccuccugcuuucagag

SEQ ID NO: 856956 - RNA, 23 nt, Human
cacuccagccgcagaacugggag

SEQ ID NO: 856957 - RNA, 19 nt, Human
cacucggcccucacacacc

SEQ ID NO: 856958 - RNA, 22 nt, Human
cacuggggcugugguugcugca

SEQ ID NO: 856959 - RNA, 23 nt, Human
cagaccaagauaaggaaacuaga

SEQ ID NO: 856960 - RNA, 20 nt, Human
caggcccaggcccugaggaa

SEQ ID NO: 856961 - RNA, 22 nt, Human
caggcccaggcccugaggaucc

SEQ ID NO: 856962 - RNA, 20 nt, Human
ccaagauaaggaaacuagaa

SEQ ID NO: 856963 - RNA, 22 nt, Human
ccaagcaaacacaacaagcaaa

SEQ ID NO: 856964 - RNA, 26 nt, Human
ccaucucacaggcaaggaggccaggc

SEQ ID NO: 856965 - RNA, 19 nt, Human
cccacgaggugggcaccgu

SEQ ID NO: 856966 - RNA, 18 nt, Human
ccuguacacuggggcugu

SEQ ID NO: 856967 - RNA, 18 nt, Human
cgccuccaagcaaacaca

SEQ ID NO: 856968 - RNA, 18 nt, Human
cggugcuucucccaggcu

SEQ ID NO: 856969 - RNA, 20 nt, Human
cucaugcuugguugcugugc

SEQ ID NO: 856970 - RNA, 20 nt, Human
cugccagaugaucauagugu

SEQ ID NO: 856971 - RNA, 21 nt, Human
cuggaagguacuuuacuggcc

SEQ ID NO: 856972 - RNA, 18 nt, Human
cugggaggggcagguggu

SEQ ID NO: 856973 - RNA, 19 nt, Human
cuuggggcacuuuccccug

SEQ ID NO: 856974 - RNA, 18 nt, Human
gaaaagcuuaacucaguc

SEQ ID NO: 856975 - RNA, 24 nt, Human
gcuuucagagcugcuguaaaaggc

SEQ ID NO: 856976 - RNA, 18 nt, Human
ggaggagacaguggugac

SEQ ID NO: 856977 - RNA, 23 nt, Human
ggcacuuuccccugggaugaucu

SEQ ID NO: 856978 - RNA, 20 nt, Human
gguggucuuggacucuccuu

SEQ ID NO: 856979 - RNA, 21 nt, Human
uaaaaugagccauuugcucag

SEQ ID NO: 856980 - RNA, 21 nt, Human
ucauagugucuuuuuucuccg

SEQ ID NO: 856981 - RNA, 21 nt, Human
uccaagcaaacacaacaagca

SEQ ID NO: 856982 - RNA, 24 nt, Human
uccaagcaaacacaacaagcaaac

SEQ ID NO: 856983 - RNA, 26 nt, Human
uccaagcaaacacaacaagggaguuc

SEQ ID NO: 856984 - RNA, 24 nt, Human
ucuccgaaaagcuuaacucagucc

SEQ ID NO: 856985 - RNA, 20 nt, Human
ucugagaacaccuccugcuu

SEQ ID NO: 856986 - RNA, 23 nt, Human
ugcucagaccaagauaaggaaac

SEQ ID NO: 856987 - RNA, 23 nt, Human
ugcugugcacuuccaagcugggc

SEQ ID NO: 856988 - RNA, 22 nt, Human
ugcuucucccaggcugucauug

SEQ ID NO: 856989 - RNA, 26 nt, Human
uggaagaaauaggaaggcccucaagc

SEQ ID NO: 856990 - RNA, 27 nt, Human
ugggaggggcagguggucuucucccgg

SEQ ID NO: 856991 - RNA, 18 nt, Human
uguguuuacuucaggguc

SEQ ID NO: 856992 - RNA, 19 nt, Human
uucagggucaagucugaga

SEQ ID NO: 856993 - RNA, 25 nt, Human
uuccaagcugggccaaugcgggagg

SEQ ID NO: 856994 - RNA, 23 nt, Human
uugcugcacccacccacuccagc

SEQ ID NO: 856995 - RNA, 21 nt, Human
uuugcucagaccaagauaagg

SEQ ID NO: 856996 - RNA, 18 nt, Human
uuuuuuuuuuuuaaaagg

SEQ ID NO: 856997 - RNA, 24 nt, Human
uuuuuuuuuuuuuuuuuuaaaagg

SEQ ID NO: 856998 - RNA, 20 nt, Human
agccugaggcggagagaggc

SEQ ID NO: 856999 - RNA, 21 nt, Human
caagaggaaaaagucacagcc

SEQ ID NO: 857000 - RNA, 24 nt, Human
caccccugcccgggugcccccgcc

SEQ ID NO: 857001 - RNA, 21 nt, Human
ccagcuguccuccugcucccc

SEQ ID NO: 857002 - RNA, 19 nt, Human
ccaguuggcuggcuggcug

SEQ ID NO: 857003 - RNA, 25 nt, Human
cccugaacuugccuuuuacagcccc

SEQ ID NO: 857004 - RNA, 22 nt, Human
cggcuggacuuuguagccccca

SEQ ID NO: 857005 - RNA, 21 nt, Human
cgucuccugcgggcugcggga

SEQ ID NO: 857006 - RNA, 27 nt, Human
cuccaaaacguugauaaaacaagagga

SEQ ID NO: 857007 - RNA, 21 nt, Human
cuucacgcuggaggcagcugu

SEQ ID NO: 857008 - RNA, 18 nt, Human
cuucgcgccuggggcucc

SEQ ID NO: 857009 - RNA, 19 nt, Human
gccuggggcucccgaaagc

SEQ ID NO: 857010 - RNA, 21 nt, Human
gcgccuggggcucccgaaagc

SEQ ID NO: 857011 - RNA, 19 nt, Human
ggagagaggccgcuucgcg

SEQ ID NO: 857012 - RNA, 18 nt, Human
gugggaaaaccacacuga

SEQ ID NO: 857013 - RNA, 21 nt, Human
uaaaacaagaggaaaaaguca

SEQ ID NO: 857014 - RNA, 23 nt, Human
uaaaacaagaggaaaaagucaca

SEQ ID NO: 857015 - RNA, 18 nt, Human
uaaaucagaagcaucuac

SEQ ID NO: 857016 - RNA, 18 nt, Human
uaaggguuuuucagaaaa

SEQ ID NO: 857017 - RNA, 23 nt, Human
uccaaaacguugauaaaacaaga

SEQ ID NO: 857018 - RNA, 18 nt, Human
ucccccugagcggggagc

SEQ ID NO: 857019 - RNA, 20 nt, Human
ucuccugcgggcugcgggag

SEQ ID NO: 857020 - RNA, 18 nt, Human
ucugaucaccccaacaga

SEQ ID NO: 857021 - RNA, 21 nt, Human
ugaggcggagagaggccgcuu

SEQ ID NO: 857022 - RNA, 20 nt, Human
uggaggcagcuguuuaguuu

SEQ ID NO: 857023 - RNA, 23 nt, Human
uggcuggcuggcuggcuagcugu

SEQ ID NO: 857024 - RNA, 20 nt, Human
ugggaaaaccacacugagcg

SEQ ID NO: 857025 - RNA, 23 nt, Human
uuccaucucuguggcaccuucuu

SEQ ID NO: 857026 - RNA, 21 nt, Human
uuuucagaaaaggaguaggcu

SEQ ID NO: 857027 - RNA, 21 nt, Human
uuuuuuuuuuuuuugacucgg

SEQ ID NO: 857028 - RNA, 24 nt, Human
uuuuuuuuuuuuuuuuugacucgg

SEQ ID NO: 857029 - RNA, 20 nt, Human
uuuuuuuuuuuuuuuuuugg

SEQ ID NO: 857030 - RNA, 21 nt, Human
aacaguaacagagggaugaaa

SEQ ID NO: 857031 - RNA, 22 nt, Human
aaguauuaaagagagagaccag

SEQ ID NO: 857032 - RNA, 18 nt, Human
aaguauuuguauguguga

SEQ ID NO: 857033 - RNA, 20 nt, Human
acaguaagcuguuuuuaauu

SEQ ID NO: 857034 - RNA, 22 nt, Human
agagaccagcaggacuuugccc

SEQ ID NO: 857035 - RNA, 21 nt, Human
auaaugauaaagacaguaagc

SEQ ID NO: 857036 - RNA, 23 nt, Human
caagcauggagcauauuucuugc

SEQ ID NO: 857037 - RNA, 23 nt, Human
cagcaggacuuugcccaguuuug

SEQ ID NO: 857038 - RNA, 21 nt, Human
caugagaacuagcauccagau

SEQ ID NO: 857039 - RNA, 20 nt, Human
cugaggcaugagaacuagca

SEQ ID NO: 857040 - RNA, 19 nt, Human
gagcgcgcgcgccucgugc

SEQ ID NO: 857041 - RNA, 21 nt, Human
gauaccuuuaggaaauuuuag

SEQ ID NO: 857042 - RNA, 24 nt, Human
gauaccuuuaggaaauuuuagggu

SEQ ID NO: 857043 - RNA, 22 nt, Human
gcagaaaccagucaccacuaag

SEQ ID NO: 857044 - RNA, 18 nt, Human
guauuaaagagagagacc

SEQ ID NO: 857045 - RNA, 22 nt, Human
uaaagagagagaccagcaggac

SEQ ID NO: 857046 - RNA, 21 nt, Human
uagugaagacuggcuuuagua

SEQ ID NO: 857047 - RNA, 18 nt, Human
uucccaugucuugcucuc

SEQ ID NO: 857048 - RNA, 21 nt, Human
uugagacacuuaacccaaauc

SEQ ID NO: 857049 - RNA, 22 nt, Human
uuugagaaguauuaaagagaga

SEQ ID NO: 857050 - RNA, 27 nt, Human
aaaaagcaccugcugcaccauaagccc

SEQ ID NO: 857051 - RNA, 24 nt, Human
aaaguuuuauccacuuucccauau

SEQ ID NO: 857052 - RNA, 24 nt, Human
aaaguuuuauccacuuucccauau

SEQ ID NO: 857053 - RNA, 18 nt, Human
aagaacacccacaccccc

SEQ ID NO: 857054 - RNA, 20 nt, Human
aagcaccaggcauacuugac

SEQ ID NO: 857055 - RNA, 20 nt, Human
acaaacacaggcugugggcu

SEQ ID NO: 857056 - RNA, 19 nt, Human
acacaggcugugggcugga

SEQ ID NO: 857057 - RNA, 23 nt, Human
accauugcuacgucccaguccca

SEQ ID NO: 857058 - RNA, 22 nt, Human
accccagggccccugcuguccu

SEQ ID NO: 857059 - RNA, 22 nt, Human
acccuggggcugucuaaguugc

SEQ ID NO: 857060 - RNA, 24 nt, Human
accugggaugggguggggacaggc

SEQ ID NO: 857061 - RNA, 20 nt, Human
acugucacccuggggcuguc

SEQ ID NO: 857062 - RNA, 19 nt, Human
agaaccugcaagagucuca

SEQ ID NO: 857063 - RNA, 18 nt, Human
agacugugcucccuuugg

SEQ ID NO: 857064 - RNA, 24 nt, Human
agcacgucugcugcaaugacaaca

SEQ ID NO: 857065 - RNA, 19 nt, Human
agcugggugcagacugugc

SEQ ID NO: 857066 - RNA, 25 nt, Human
aggccugugguaccgugggagauga

SEQ ID NO: 857067 - RNA, 25 nt, Human
aggccugugguaccgugggagauga

SEQ ID NO: 857068 - RNA, 24 nt, Human
auuuggucuccaggugucaccuuu

SEQ ID NO: 857069 - RNA, 26 nt, Human
caccauaagcccugggauguggcagc

SEQ ID NO: 857070 - RNA, 21 nt, Human
cacccuggggcugucuaaguu

SEQ ID NO: 857071 - RNA, 20 nt, Human
cagcagcucagaauaugaug

SEQ ID NO: 857072 - RNA, 19 nt, Human
cagccagccucugcaggac

SEQ ID NO: 857073 - RNA, 21 nt, Human
cagcgccucccaguggccaga

SEQ ID NO: 857074 - RNA, 24 nt, Human
cagcugggccacugucacccuggg

SEQ ID NO: 857075 - RNA, 24 nt, Human
caggagcccgcuugugcucccggc

SEQ ID NO: 857076 - RNA, 18 nt, Human
caggccugugguaccgug

SEQ ID NO: 857077 - RNA, 18 nt, Human
caggccugugguaccgug

SEQ ID NO: 857078 - RNA, 22 nt, Human
cauugccaucuccaagugcucu

SEQ ID NO: 857079 - RNA, 18 nt, Human
cauugcuacgucccaguc

SEQ ID NO: 857080 - RNA, 21 nt, Human
ccaagugagggaguuagggac

SEQ ID NO: 857081 - RNA, 19 nt, Human
ccacacccccuuguuaccc

SEQ ID NO: 857082 - RNA, 23 nt, Human
ccacugccaagcucuaggacagu

SEQ ID NO: 857083 - RNA, 23 nt, Human
ccacugccaagcucuaggacagu

SEQ ID NO: 857084 - RNA, 21 nt, Human
ccaugugaccaggccuguggu

SEQ ID NO: 857085 - RNA, 22 nt, Human
cccaugugaccaggccuguggu

SEQ ID NO: 857086 - RNA, 18 nt, Human
ccccagggccccugcugu

SEQ ID NO: 857087 - RNA, 18 nt, Human
cccgcagcagcucagaau

SEQ ID NO: 857088 - RNA, 18 nt, Human
cccgcagcagcucagaau

SEQ ID NO: 857089 - RNA, 23 nt, Human
ccucaggagcccgcuugugcucc

SEQ ID NO: 857090 - RNA, 21 nt, Human
ccucuaagcucuggucaccgc

SEQ ID NO: 857091 - RNA, 21 nt, Human
ccugcaggcaagcuaaaccag

SEQ ID NO: 857092 - RNA, 24 nt, Human
ccugcauuuggucuccagguguca

SEQ ID NO: 857093 - RNA, 18 nt, Human
ccuguuaaucaaggcugc

SEQ ID NO: 857094 - RNA, 22 nt, Human
ccuuucgagcagcgccucccag

SEQ ID NO: 857095 - RNA, 21 nt, Human
cgagcagcgccucccaguggc

SEQ ID NO: 857096 - RNA, 18 nt, Human
cggccuagcucgguggug

SEQ ID NO: 857097 - RNA, 19 nt, Human
cuaaaaccccagggccccu

SEQ ID NO: 857098 - RNA, 18 nt, Human
cucaaacuuuucugaucc

SEQ ID NO: 857099 - RNA, 24 nt, Human
cucacagucuucugcaaaauaucc

SEQ ID NO: 857100 - RNA, 24 nt, Human
cucacagucuucugcaaaauaucc

SEQ ID NO: 857101 - RNA, 20 nt, Human
cucuaagcucuggucaccgc

SEQ ID NO: 857102 - RNA, 22 nt, Human
cucuuuagcauuuugcagaugc

SEQ ID NO: 857103 - RNA, 19 nt, Human
cugaugggaugagagcugg

SEQ ID NO: 857104 - RNA, 18 nt, Human
cuggguugugaagggucu

SEQ ID NO: 857105 - RNA, 22 nt, Human
cuugugcucccggcaggcagcc

SEQ ID NO: 857106 - RNA, 18 nt, Human
gaaccgaguguguccagg

SEQ ID NO: 857107 - RNA, 18 nt, Human
gaaccgaguguguccagg

SEQ ID NO: 857108 - RNA, 18 nt, Human
gaaccgaguguguccagg

SEQ ID NO: 857109 - RNA, 18 nt, Human
gaagggucucaaguccaa

SEQ ID NO: 857110 - RNA, 18 nt, Human
gaagggucucaaguccaa

SEQ ID NO: 857111 - RNA, 18 nt, Human
gaccgagccuccugagga

SEQ ID NO: 857112 - RNA, 21 nt, Human
gagcagcgccucccaguggcc

SEQ ID NO: 857113 - RNA, 20 nt, Human
gagggcgcugacuuuuuaga

SEQ ID NO: 857114 - RNA, 20 nt, Human
gagggcgcugacuuuuuaga

SEQ ID NO: 857115 - RNA, 21 nt, Human
gauccuugauucagacaguuu

SEQ ID NO: 857116 - RNA, 26 nt, Human
gauggcaaggccugugaggccggcac

SEQ ID NO: 857117 - RNA, 26 nt, Human
gauggcaaggccugugaggccggcac

SEQ ID NO: 857118 - RNA, 24 nt, Human
gaugggugggacuguguuggccag

SEQ ID NO: 857119 - RNA, 19 nt, Human
gcaaaauaucccgcagcag

SEQ ID NO: 857120 - RNA, 19 nt, Human
gcaaaauaucccgcagcag

SEQ ID NO: 857121 - RNA, 21 nt, Human
gcaaggcugaaaagaacaccc

SEQ ID NO: 857122 - RNA, 25 nt, Human
gcaaggcugaaaagaacacccacac

SEQ ID NO: 857123 - RNA, 18 nt, Human
gcagcgggcuuggcuuuc

SEQ ID NO: 857124 - RNA, 18 nt, Human
gcagcgggcuuggcuuuc

SEQ ID NO: 857125 - RNA, 18 nt, Human
gcagcugcagcgggcuug

SEQ ID NO: 857126 - RNA, 18 nt, Human
gcagcugcagcgggcuug

SEQ ID NO: 857127 - RNA, 18 nt, Human
gcagcugcagcgggcuug

SEQ ID NO: 857128 - RNA, 18 nt, Human
gcagcugcagcgggcuug

SEQ ID NO: 857129 - RNA, 18 nt, Human
gcagcugcagcgggcuug

SEQ ID NO: 857130 - RNA, 20 nt, Human
gccaucuccaagugcucucc

SEQ ID NO: 857131 - RNA, 18 nt, Human
gccugugguaccguggga

SEQ ID NO: 857132 - RNA, 18 nt, Human
gccugugguaccguggga

SEQ ID NO: 857133 - RNA, 19 nt, Human
gcuaaaaccccagggcccc

SEQ ID NO: 857134 - RNA, 19 nt, Human
gcucccggcaggcagccag

SEQ ID NO: 857135 - RNA, 22 nt, Human
gcucccggcaggcagccagccu

SEQ ID NO: 857136 - RNA, 21 nt, Human
ggacauucccucggagcugcu

SEQ ID NO: 857137 - RNA, 21 nt, Human
ggaguuagggacuugggaggg

SEQ ID NO: 857138 - RNA, 19 nt, Human
ggcacaucuugcagauggc

SEQ ID NO: 857139 - RNA, 23 nt, Human
ggcaguuuugauuccugauuugg

SEQ ID NO: 857140 - RNA, 23 nt, Human
ggcaguuuugauuccugauuugg

SEQ ID NO: 857141 - RNA, 20 nt, Human
ggccagaggcuaaaacccca

SEQ ID NO: 857142 - RNA, 19 nt, Human
gggaugggguggggacagg

SEQ ID NO: 857143 - RNA, 20 nt, Human
gggaugggguggggacaggc

SEQ ID NO: 857144 - RNA, 21 nt, Human
gggugggacuguguuggccag

SEQ ID NO: 857145 - RNA, 27 nt, Human
ggguugugaagggucucaaguccaagu

SEQ ID NO: 857146 - RNA, 22 nt, Human
ggucgcugaagauguaugcccg

SEQ ID NO: 857147 - RNA, 20 nt, Human
ggucucaaguccaagugagg

SEQ ID NO: 857148 - RNA, 21 nt, Human
ggugcagacugugcuccccgg

SEQ ID NO: 857149 - RNA, 19 nt, Human
gguggggacaggcaaugag

SEQ ID NO: 857150 - RNA, 21 nt, Human
ggugucaccuuucugccgugu

SEQ ID NO: 857151 - RNA, 18 nt, Human
gugcucccggcaggcaga

SEQ ID NO: 857152 - RNA, 24 nt, Human
uagcauuuugcagaugcuuuucuc

SEQ ID NO: 857153 - RNA, 18 nt, Human
uagcucgguggugaacag

SEQ ID NO: 857154 - RNA, 20 nt, Human
uaggacaguccuguuaauca

SEQ ID NO: 857155 - RNA, 19 nt, Human
uccaagugagggaguuagg

SEQ ID NO: 857156 - RNA, 18 nt, Human
ucccagucccagcugggc

SEQ ID NO: 857157 - RNA, 25 nt, Human
ucccagugaccagaacgagguaccc

SEQ ID NO: 857158 - RNA, 25 nt, Human
ucccagugaccagaacgagguaccc

SEQ ID NO: 857159 - RNA, 23 nt, Human
ucccagugaccagaacgauuacu

SEQ ID NO: 857160 - RNA, 23 nt, Human
ucccagugaccagaacgauuacu

SEQ ID NO: 857161 - RNA, 20 nt, Human
uccuguuaaugaaggcugcc

SEQ ID NO: 857162 - RNA, 23 nt, Human
ucucaaguccaagugagggaguu

SEQ ID NO: 857163 - RNA, 18 nt, Human
ucuccaggugucaccuuu

SEQ ID NO: 857164 - RNA, 18 nt, Human
ucugcaggaccccgacca

SEQ ID NO: 857165 - RNA, 25 nt, Human
ugaaaagaacacccacacccccuug

SEQ ID NO: 857166 - RNA, 22 nt, Human
ugaagggucucaaguccaagug

SEQ ID NO: 857167 - RNA, 22 nt, Human
ugaagggucucaaguccaagug

SEQ ID NO: 857168 - RNA, 22 nt, Human
ugacaacaucuggcuggaaggc

SEQ ID NO: 857169 - RNA, 19 nt, Human
ugaccgagccuccugagga

SEQ ID NO: 857170 - RNA, 20 nt, Human
ugaggccggcaccacugcca

SEQ ID NO: 857171 - RNA, 20 nt, Human
ugaggccggcaccacugcca

SEQ ID NO: 857172 - RNA, 18 nt, Human
ugagggaguuagggacuu

SEQ ID NO: 857173 - RNA, 18 nt, Human
ugaguuaagcucugcucu

SEQ ID NO: 857174 - RNA, 23 nt, Human
ugaguucugagagaaagaaccag

SEQ ID NO: 857175 - RNA, 22 nt, Human
ugaugucaaguuggagguggag

SEQ ID NO: 857176 - RNA, 24 nt, Human
ugcaaugacaacaucuggcuggaa

SEQ ID NO: 857177 - RNA, 20 nt, Human
ugcauuuggucuccaggugu

SEQ ID NO: 857178 - RNA, 23 nt, Human
ugcucuccauagggaaacaguuu

SEQ ID NO: 857179 - RNA, 22 nt, Human
uggagucucagggcaaagccuu

SEQ ID NO: 857180 - RNA, 21 nt, Human
uggcaaggccugugaggccgg

SEQ ID NO: 857181 - RNA, 21 nt, Human
uggcaaggccugugaggccgg

SEQ ID NO: 857182 - RNA, 20 nt, Human
uggcagaaagggggcaccca

SEQ ID NO: 857183 - RNA, 20 nt, Human
ugggaugagagcugggugca

SEQ ID NO: 857184 - RNA, 18 nt, Human
ugggaugggguggggaca

SEQ ID NO: 857185 - RNA, 18 nt, Human
ugggaugggguggggaca

SEQ ID NO: 857186 - RNA, 23 nt, Human
ugggauguggcagcugcagcggg

SEQ ID NO: 857187 - RNA, 25 nt, Human
uggggacaggcaaugaguuaagcuc

SEQ ID NO: 857188 - RNA, 19 nt, Human
ugggguggggacaggcaau

SEQ ID NO: 857189 - RNA, 24 nt, Human
ugggugcagacugugcucccuuug

SEQ ID NO: 857190 - RNA, 23 nt, Human
uggugaccugggauggggugggg

SEQ ID NO: 857191 - RNA, 20 nt, Human
uguaugcccgggggcggcac

SEQ ID NO: 857192 - RNA, 20 nt, Human
ugugaagggucucaagucca

SEQ ID NO: 857193 - RNA, 20 nt, Human
ugugaagggucucaagucca

SEQ ID NO: 857194 - RNA, 18 nt, Human
ugugagguucagcauugc

SEQ ID NO: 857195 - RNA, 21 nt, Human
ugugagguucagcauugccau

SEQ ID NO: 857196 - RNA, 24 nt, Human
uguggcagcugcagcgggcuuggc

SEQ ID NO: 857197 - RNA, 24 nt, Human
uguggcagcugcagcgggcuuggc

SEQ ID NO: 857198 - RNA, 24 nt, Human
uguggcagcugcagcgggcuuggc

SEQ ID NO: 857199 - RNA, 24 nt, Human
uguggcagcugcagcgggcuuggc

SEQ ID NO: 857200 - RNA, 24 nt, Human
uguggcagcugcagcgggcuuggc

SEQ ID NO: 857201 - RNA, 19 nt, Human
uuacaaacacaggcugugg

SEQ ID NO: 857202 - RNA, 23 nt, Human
uuccaguccaaugaaaguuuuau

SEQ ID NO: 857203 - RNA, 23 nt, Human
uuccaguccaaugaaaguuuuau

SEQ ID NO: 857204 - RNA, 24 nt, Human
uucccauauaaaaauucuucccac

SEQ ID NO: 857205 - RNA, 24 nt, Human
uucccauauaaaaauucuucccac

SEQ ID NO: 857206 - RNA, 27 nt, Human
uugaaaaaagcaccugcugcaccauaa

SEQ ID NO: 857207 - RNA, 22 nt, Human
uugugaagggucucaaguccaa

SEQ ID NO: 857208 - RNA, 20 nt, Human
uuuuuuuuuuuuuuguucca

SEQ ID NO: 857209 - RNA, 21 nt, Human
uuuuuuuuuuuuuuguuccaa

SEQ ID NO: 857210 - RNA, 20 nt, Human
uuuuuuuuuuuuuuuuuguu

SEQ ID NO: 857211 - RNA, 20 nt, Human
uuuuuuuuuuuuuuuuuugg

SEQ ID NO: 857212 - RNA, 24 nt, Human
aaaaacauguuguuaaggcucagg

SEQ ID NO: 857213 - RNA, 20 nt, Human
aaacaaagcauacuuagaga

SEQ ID NO: 857214 - RNA, 20 nt, Human
aagucgccucgcccucgcgc

SEQ ID NO: 857215 - RNA, 21 nt, Human
acaaagcauacuuagagagga

SEQ ID NO: 857216 - RNA, 27 nt, Human
acaaagcauacuuagagaggaguagag

SEQ ID NO: 857217 - RNA, 28 nt, Human
acaaagcauacuuagagaggaguagaga

SEQ ID NO: 857218 - RNA, 21 nt, Human
acagaccacgcugccuggagc

SEQ ID NO: 857219 - RNA, 19 nt, Human
acgcugccuggagcagggu

SEQ ID NO: 857220 - RNA, 21 nt, Human
acuuagagaggaguagagaaa

SEQ ID NO: 857221 - RNA, 21 nt, Human
agugcaggcaggcggcaccca

SEQ ID NO: 857222 - RNA, 23 nt, Human
auggucaguuuaaggccuguuua

SEQ ID NO: 857223 - RNA, 22 nt, Human
auugacagcaagccagugauaa

SEQ ID NO: 857224 - RNA, 18 nt, Human
cacugccuccagccucca

SEQ ID NO: 857225 - RNA, 21 nt, Human
cagcauguccccuuuucuguu

SEQ ID NO: 857226 - RNA, 22 nt, Human
cagccuccagcauccagggaga

SEQ ID NO: 857227 - RNA, 23 nt, Human
cagguuccaggcuucuuggguuc

SEQ ID NO: 857228 - RNA, 19 nt, Human
ccagcauccagggagagug

SEQ ID NO: 857229 - RNA, 22 nt, Human
ccaggcuucuuggguucuggga

SEQ ID NO: 857230 - RNA, 25 nt, Human
ccaggcuucuuggguucugggagga

SEQ ID NO: 857231 - RNA, 22 nt, Human
ccaucaggagcacgucacauuc

SEQ ID NO: 857232 - RNA, 23 nt, Human
cccacggcggagcagccuccagc

SEQ ID NO: 857233 - RNA, 18 nt, Human
cccucuucuuucuccucc

SEQ ID NO: 857234 - RNA, 24 nt, Human
cccucuucuuucuccuccugccca

SEQ ID NO: 857235 - RNA, 21 nt, Human
ccucacugccuccagccucca

SEQ ID NO: 857236 - RNA, 18 nt, Human
ccuccagcauccagggag

SEQ ID NO: 857237 - RNA, 22 nt, Human
ccucgcgcuguugcugccucac

SEQ ID NO: 857238 - RNA, 23 nt, Human
ccuggagcagggugaaaugcggc

SEQ ID NO: 857239 - RNA, 22 nt, Human
cgaaaaacaaagcauacuuaga

SEQ ID NO: 857240 - RNA, 18 nt, Human
cgccucgcccucgcgcug

SEQ ID NO: 857241 - RNA, 20 nt, Human
cuagcagugggcgucauagc

SEQ ID NO: 857242 - RNA, 19 nt, Human
cuuagagaggaguagagaa

SEQ ID NO: 857243 - RNA, 21 nt, Human
gagcagccuccagcauccagg

SEQ ID NO: 857244 - RNA, 21 nt, Human
gagugcaggcaaaagcgcggc

SEQ ID NO: 857245 - RNA, 18 nt, Human
gccacagguuccaggcuc

SEQ ID NO: 857246 - RNA, 20 nt, Human
gccauacagaccacgcugcc

SEQ ID NO: 857247 - RNA, 20 nt, Human
gcccacggcggagcagccuc

SEQ ID NO: 857248 - RNA, 19 nt, Human
gcccucuucuuucuccucc

SEQ ID NO: 857249 - RNA, 20 nt, Human
ggcggcacccaguucucuuc

SEQ ID NO: 857250 - RNA, 18 nt, Human
gguguucccuacccugcu

SEQ ID NO: 857251 - RNA, 20 nt, Human
gugaaaugcggccucgugcc

SEQ ID NO: 857252 - RNA, 21 nt, Human
gugggcgucauagccaucagg

SEQ ID NO: 857253 - RNA, 19 nt, Human
uagguuacagauuagcuaa

SEQ ID NO: 857254 - RNA, 21 nt, Human
uagguuacagauuagcuaaaa

SEQ ID NO: 857255 - RNA, 21 nt, Human
ucacugccuccagccuccagc

SEQ ID NO: 857256 - RNA, 18 nt, Human
uccagcauccagggagag

SEQ ID NO: 857257 - RNA, 18 nt, Human
uccagcauccggagagag

SEQ ID NO: 857258 - RNA, 23 nt, Human
ucgcgcuguugcugccucacugc

SEQ ID NO: 857259 - RNA, 21 nt, Human
ucuccuccugcccagggcgga

SEQ ID NO: 857260 - RNA, 27 nt, Human
ucugcagcaaaaacauguuguuaaggc

SEQ ID NO: 857261 - RNA, 20 nt, Human
ucuuccuucuccuccugccc

SEQ ID NO: 857262 - RNA, 20 nt, Human
ucuucuuucuccuccugccc

SEQ ID NO: 857263 - RNA, 20 nt, Human
ucuuggguucugggaggagg

SEQ ID NO: 857264 - RNA, 25 nt, Human
ugcaaagcgauaaaagcaaaggcag

SEQ ID NO: 857265 - RNA, 25 nt, Human
ugccucacugccuccagccuccagc

SEQ ID NO: 857266 - RNA, 20 nt, Human
ugggccagguguucccuacc

SEQ ID NO: 857267 - RNA, 21 nt, Human
uguugcugccucacugccucc

SEQ ID NO: 857268 - RNA, 21 nt, Human
uuacagauuagcuaaaagcau

SEQ ID NO: 857269 - RNA, 23 nt, Human
uuuuuuuuuuuuuuuuuuuucag

SEQ ID NO: 857270 - RNA, 20 nt, Human
accccaagugacaugaaaag

SEQ ID NO: 857271 - RNA, 21 nt, Human
accccaagugacaugaaaagc

SEQ ID NO: 857272 - RNA, 22 nt, Human
acucagagacuuaggagaggag

SEQ ID NO: 857273 - RNA, 21 nt, Human
agagaaacucagagacuuagg

SEQ ID NO: 857274 - RNA, 20 nt, Human
aggagaggaggaaagggggu

SEQ ID NO: 857275 - RNA, 23 nt, Human
aguaaauugaugugaagggucug

SEQ ID NO: 857276 - RNA, 20 nt, Human
caggccccacuccucuccac

SEQ ID NO: 857277 - RNA, 18 nt, Human
ccccugagauaccccaag

SEQ ID NO: 857278 - RNA, 25 nt, Human
cucaggauggcaggaggagagagaa

SEQ ID NO: 857279 - RNA, 21 nt, Human
cuuaggagaggaggaaagggg

SEQ ID NO: 857280 - RNA, 21 nt, Human
gagggguguggaggggcuuug

SEQ ID NO: 857281 - RNA, 23 nt, Human
gggagaggaacgaaaagagaggu

SEQ ID NO: 857282 - RNA, 22 nt, Human
gggcaggccccacuccucucca

SEQ ID NO: 857283 - RNA, 21 nt, Human
ggguguugugggcaggccucg

SEQ ID NO: 857284 - RNA, 21 nt, Human
uaggagaggaggaaagggggu

SEQ ID NO: 857285 - RNA, 19 nt, Human
uaguagagaaagguugaca

SEQ ID NO: 857286 - RNA, 21 nt, Human
uauuuuguuuccuggagcuuu

SEQ ID NO: 857287 - RNA, 23 nt, Human
uauuuuguuuccuggagcuuuca

SEQ ID NO: 857288 - RNA, 22 nt, Human
ucagagacuuaggagaggagga

SEQ ID NO: 857289 - RNA, 21 nt, Human
ucgaagacaacaguaaauuga

SEQ ID NO: 857290 - RNA, 18 nt, Human
ucuaaaauaaaaggcugc

SEQ ID NO: 857291 - RNA, 20 nt, Human
ucuguauuuuguuuccugga

SEQ ID NO: 857292 - RNA, 24 nt, Human
ugaaaagcauacucagggccuaga

SEQ ID NO: 857293 - RNA, 22 nt, Human
ugagauaccccaagugacauga

SEQ ID NO: 857294 - RNA, 24 nt, Human
ugagauaccccaagugacaugaaa

SEQ ID NO: 857295 - RNA, 18 nt, Human
uuaggagaggaggaaagg

SEQ ID NO: 857296 - RNA, 20 nt, Human
uuuccuggagcuuucacugg

SEQ ID NO: 857297 - RNA, 19 nt, Human
uuuuuuuuagaaucaggug

SEQ ID NO: 857298 - RNA, 21 nt, Human
aaagggucuugcuuuguugac

SEQ ID NO: 857299 - RNA, 24 nt, Human
aaaguguugggauuacaggcauga

SEQ ID NO: 857300 - RNA, 21 nt, Human
aaguguugggauuacaggcau

SEQ ID NO: 857301 - RNA, 26 nt, Human
aaguguugggauuacaggcaugagcc

SEQ ID NO: 857302 - RNA, 20 nt, Human
acaccaccgugcccagcuaa

SEQ ID NO: 857303 - RNA, 24 nt, Human
acuauguugcccaggcuggucuug

SEQ ID NO: 857304 - RNA, 25 nt, Human
acuauguugcccaggcuggucuuga

SEQ ID NO: 857305 - RNA, 22 nt, Human
acuccagugauccuccagccuc

SEQ ID NO: 857306 - RNA, 21 nt, Human
acugcagccucgaacuccagu

SEQ ID NO: 857307 - RNA, 20 nt, Human
aggcacacaccaccgugccc

SEQ ID NO: 857308 - RNA, 20 nt, Human
aggcaugagccaccgugccu

SEQ ID NO: 857309 - RNA, 23 nt, Human
aggcaugagccaccgugccuggc

SEQ ID NO: 857310 - RNA, 19 nt, Human
aggcuggagugcaguggca

SEQ ID NO: 857311 - RNA, 19 nt, Human
agggccuccgggcugcuca

SEQ ID NO: 857312 - RNA, 23 nt, Human
agggguguguggucccaggcagg

SEQ ID NO: 857313 - RNA, 19 nt, Human
agucauagcucacugcagc

SEQ ID NO: 857314 - RNA, 21 nt, Human
agugcaguggcacagucauag

SEQ ID NO: 857315 - RNA, 23 nt, Human
agugcaguggcacagucauagcu

SEQ ID NO: 857316 - RNA, 18 nt, Human
auagcucacugcagccuc

SEQ ID NO: 857317 - RNA, 24 nt, Human
caaaguguugggauuacaggcaug

SEQ ID NO: 857318 - RNA, 19 nt, Human
cacacaccaccgugcccag

SEQ ID NO: 857319 - RNA, 24 nt, Human
cacaccaccgugcccagcuaauuu

SEQ ID NO: 857320 - RNA, 21 nt, Human
cacccgggccaggcgcucggc

SEQ ID NO: 857321 - RNA, 19 nt, Human
cacgacacgguggcagagc

SEQ ID NO: 857322 - RNA, 19 nt, Human
cacuauguugcccaggcug

SEQ ID NO: 857323 - RNA, 24 nt, Human
cacuauguugcccaggcuggucuu

SEQ ID NO: 857324 - RNA, 27 nt, Human
cacuauguugcccaggcuggucuugaa

SEQ ID NO: 857325 - RNA, 20 nt, Human
cagcauagauggggucacua

SEQ ID NO: 857326 - RNA, 25 nt, Human
cagccucagccucaccaguagcugg

SEQ ID NO: 857327 - RNA, 23 nt, Human
cagccucgaacuccagugauccu

SEQ ID NO: 857328 - RNA, 27 nt, Human
cagggccagggccugggcacccagcgu

SEQ ID NO: 857329 - RNA, 23 nt, Human
caggucucacuauguugcccagg

SEQ ID NO: 857330 - RNA, 25 nt, Human
caguagcugggacuacaggcacaca

SEQ ID NO: 857331 - RNA, 22 nt, Human
cagugauccuccagccucagcc

SEQ ID NO: 857332 - RNA, 20 nt, Human
caguggcacagucauagcuc

SEQ ID NO: 857333 - RNA, 23 nt, Human
cauccagggccuccgggcugcuc

SEQ ID NO: 857334 - RNA, 23 nt, Human
ccaaaguguugggauuacaggca

SEQ ID NO: 857335 - RNA, 24 nt, Human
ccaaaguguugggauuacaggcau

SEQ ID NO: 857336 - RNA, 23 nt, Human
ccacccgggccaggcgcucggcc

SEQ ID NO: 857337 - RNA, 22 nt, Human
ccaguagcugggacuacaggca

SEQ ID NO: 857338 - RNA, 20 nt, Human
ccauccagggccuccgggcu

SEQ ID NO: 857339 - RNA, 24 nt, Human
cccaaaguguugggauuacaggca

SEQ ID NO: 857340 - RNA, 25 nt, Human
ccuccagccucagccucaccaguag

SEQ ID NO: 857341 - RNA, 19 nt, Human
ccuccggccucagccuccc

SEQ ID NO: 857342 - RNA, 18 nt, Human
ccucuuccccuuccgggu

SEQ ID NO: 857343 - RNA, 18 nt, Human
ccugggcucaagcaaucc

SEQ ID NO: 857344 - RNA, 21 nt, Human
cucacugcagccucgaacucc

SEQ ID NO: 857345 - RNA, 24 nt, Human
cucagccucaccaguagcugggac

SEQ ID NO: 857346 - RNA, 24 nt, Human
cuccagccucagccucaccaguag

SEQ ID NO: 857347 - RNA, 25 nt, Human
cuccagccucagccucaccaguagc

SEQ ID NO: 857348 - RNA, 23 nt, Human
cuccugggcucaagcaauccucc

SEQ ID NO: 857349 - RNA, 19 nt, Human
cuggucuugaacuccuggg

SEQ ID NO: 857350 - RNA, 24 nt, Human
gacuacaggcacacaccaccgugc

SEQ ID NO: 857351 - RNA, 18 nt, Human
gauuacaggcaugagcca

SEQ ID NO: 857352 - RNA, 21 nt, Human
gauuacaggcaugagccaccg

SEQ ID NO: 857353 - RNA, 24 nt, Human
gauuacaggcaugagccaccgugc

SEQ ID NO: 857354 - RNA, 19 nt, Human
gcacacaccaccgugccca

SEQ ID NO: 857355 - RNA, 19 nt, Human
gcagccucgaacuccagug

SEQ ID NO: 857356 - RNA, 19 nt, Human
gcagcuccuggaacagcag

SEQ ID NO: 857357 - RNA, 23 nt, Human
gccucagccucccaaaguguugg

SEQ ID NO: 857358 - RNA, 19 nt, Human
gcuggagugcaguggcaca

SEQ ID NO: 857359 - RNA, 24 nt, Human
ggauuacaggcaugagccaccgug

SEQ ID NO: 857360 - RNA, 18 nt, Human
ggcacccagcgugcccac

SEQ ID NO: 857361 - RNA, 18 nt, Human
ggccagagcucugaggaa

SEQ ID NO: 857362 - RNA, 18 nt, Human
ggcuggucuugaacuccu

SEQ ID NO: 857363 - RNA, 23 nt, Human
gggguguguggucccaggcaggg

SEQ ID NO: 857364 - RNA, 22 nt, Human
gggucuuucuaucccaggggug

SEQ ID NO: 857365 - RNA, 23 nt, Human
ggucccaggcagggagucaggag

SEQ ID NO: 857366 - RNA, 18 nt, Human
guagcugggacuacaggc

SEQ ID NO: 857367 - RNA, 20 nt, Human
guguaacuuucacuccaccc

SEQ ID NO: 857368 - RNA, 22 nt, Human
guugaaguguggcugcagcucc

SEQ ID NO: 857369 - RNA, 19 nt, Human
guugaccaggcuggagugc

SEQ ID NO: 857370 - RNA, 23 nt, Human
uaauuuuuuauuuuuuguagaga

SEQ ID NO: 857371 - RNA, 22 nt, Human
uacaggcaugagccaccgugcc

SEQ ID NO: 857372 - RNA, 22 nt, Human
uagcagaugcuucccgggcugg

SEQ ID NO: 857373 - RNA, 24 nt, Human
uagcucacugcagccucgaacucc

SEQ ID NO: 857374 - RNA, 23 nt, Human
uauguugcccaggcuggucuuga

SEQ ID NO: 857375 - RNA, 24 nt, Human
uauguugcccaggcuggucuugaa

SEQ ID NO: 857376 - RNA, 24 nt, Human
ucaccaguagcugggacuacaggc

SEQ ID NO: 857377 - RNA, 22 nt, Human
ucacugcagccucgaacuccag

SEQ ID NO: 857378 - RNA, 24 nt, Human
ucccaaaguguugggauuacaggc

SEQ ID NO: 857379 - RNA, 21 nt, Human
ucccaggggugugugguccca

SEQ ID NO: 857380 - RNA, 19 nt, Human
uccuccggccucagccucc

SEQ ID NO: 857381 - RNA, 18 nt, Human
uccugggcucaagcaauc

SEQ ID NO: 857382 - RNA, 22 nt, Human
uccugggcucaagcaauccucc

SEQ ID NO: 857383 - RNA, 19 nt, Human
ucucacuauguugcccagg

SEQ ID NO: 857384 - RNA, 23 nt, Human
ucucacuauguugcccaggcugg

SEQ ID NO: 857385 - RNA, 24 nt, Human
ucucacuauguugcccaggcuggu

SEQ ID NO: 857386 - RNA, 26 nt, Human
ucucacuauguugcccaggcuggucu

SEQ ID NO: 857387 - RNA, 27 nt, Human
ucucacuauguugcccaggcuggucuu

SEQ ID NO: 857388 - RNA, 19 nt, Human
ucugcgcagggccagggcc

SEQ ID NO: 857389 - RNA, 23 nt, Human
ucuugaacuccugggcucaagca

SEQ ID NO: 857390 - RNA, 23 nt, Human
ucuugcuuuguugaccaggcugg

SEQ ID NO: 857391 - RNA, 24 nt, Human
ucuugcuuuguugaccaggcugga

SEQ ID NO: 857392 - RNA, 24 nt, Human
ugaacuccugggcucaagcaaucc

SEQ ID NO: 857393 - RNA, 25 nt, Human
ugaacuccugggcucaagcaauccu

SEQ ID NO: 857394 - RNA, 24 nt, Human
ugaccaggcuggagugcaguggca

SEQ ID NO: 857395 - RNA, 19 nt, Human
ugagccaccgugccuggcg

SEQ ID NO: 857396 - RNA, 24 nt, Human
ugcccaggcuggucuugaacuccu

SEQ ID NO: 857397 - RNA, 28 nt, Human
ugcccaggcuggucuugaacuccugggc

SEQ ID NO: 857398 - RNA, 23 nt, Human
ugcgcagggccagggccugggca

SEQ ID NO: 857399 - RNA, 23 nt, Human
uggaacagcaggucggccacgac

SEQ ID NO: 857400 - RNA, 21 nt, Human
uggagugcaguggcacaguca

SEQ ID NO: 857401 - RNA, 24 nt, Human
uggcacagucauagcucacugcag

SEQ ID NO: 857402 - RNA, 21 nt, Human
ugggacuacaggcacacacca

SEQ ID NO: 857403 - RNA, 22 nt, Human
ugggacuacaggcacacaccac

SEQ ID NO: 857404 - RNA, 23 nt, Human
ugggacuacaggcacacaccacc

SEQ ID NO: 857405 - RNA, 24 nt, Human
ugggacuacaggcacacaccaccg

SEQ ID NO: 857406 - RNA, 18 nt, Human
ugggauuacaggcaugag

SEQ ID NO: 857407 - RNA, 21 nt, Human
ugggauuacaggcaugagcca

SEQ ID NO: 857408 - RNA, 22 nt, Human
ugggauuacaggcaugagccac

SEQ ID NO: 857409 - RNA, 23 nt, Human
ugggauuacaggcaugagccacc

SEQ ID NO: 857410 - RNA, 23 nt, Human
ugggauuacaggcaugagccacc

SEQ ID NO: 857411 - RNA, 24 nt, Human
ugggauuacaggcaugagccaccg

SEQ ID NO: 857412 - RNA, 20 nt, Human
ugggcucaagcaauccuccg

SEQ ID NO: 857413 - RNA, 19 nt, Human
ugguccagagcacuagcag

SEQ ID NO: 857414 - RNA, 18 nt, Human
uguugaccaggcuggagu

SEQ ID NO: 857415 - RNA, 19 nt, Human
uuagaagucaauccgccac

SEQ ID NO: 857416 - RNA, 18 nt, Human
uuugagaaagggucuugc

SEQ ID NO: 857417 - RNA, 24 nt, Human
uuuguugaccaggcuggagugcag

SEQ ID NO: 857418 - RNA, 23 nt, Human
uuuuuuuuuuuugagaaaggguc

SEQ ID NO: 857419 - RNA, 24 nt, Human
uuuuuuuuuuuugagaaagggucu

SEQ ID NO: 857420 - RNA, 25 nt, Human
uuuuuuuuuuuuuuuugagaaaggg

SEQ ID NO: 857421 - RNA, 18 nt, Human
uuuuuuuuuuuuuuuuug

SEQ ID NO: 857422 - RNA, 19 nt, Human
agacagcccuggaaaaucc

SEQ ID NO: 857423 - RNA, 21 nt, Human
auaaugcaggacacagguaac

SEQ ID NO: 857424 - RNA, 24 nt, Human
cagugggugauaugagcuggcucc

SEQ ID NO: 857425 - RNA, 18 nt, Human
ccagugggugauaugagc

SEQ ID NO: 857426 - RNA, 22 nt, Human
cccuccgcaccaccuccagacc

SEQ ID NO: 857427 - RNA, 23 nt, Human
cccuggaaaauccagagagcagg

SEQ ID NO: 857428 - RNA, 27 nt, Human
ccucuggcuccuuauuucggggccgcc

SEQ ID NO: 857429 - RNA, 24 nt, Human
cucccuccgcaccaccuccagacc

SEQ ID NO: 857430 - RNA, 23 nt, Human
cuggucccuaggcggcucccucc

SEQ ID NO: 857431 - RNA, 22 nt, Human
gcaggacacagguaacuccucu

SEQ ID NO: 857432 - RNA, 25 nt, Human
ggaaaauccagagagcaggcccagg

SEQ ID NO: 857433 - RNA, 22 nt, Human
ggcuauaaagacagcccuggaa

SEQ ID NO: 857434 - RNA, 20 nt, Human
gucccuggucccuaggcggc

SEQ ID NO: 857435 - RNA, 22 nt, Human
uccagagagcaggcccaggugc

SEQ ID NO: 857436 - RNA, 19 nt, Human
uggucccuaggcggcuccc

SEQ ID NO: 857437 - RNA, 19 nt, Human
aaacauguauaaagcaugu

SEQ ID NO: 857438 - RNA, 19 nt, Human
aaaggagcuuccgucuaca

SEQ ID NO: 857439 - RNA, 22 nt, Human
aaaguccuuucaaacagcccuu

SEQ ID NO: 857440 - RNA, 18 nt, Human
aaccagugccaugccaca

SEQ ID NO: 857441 - RNA, 21 nt, Human
aaccagugccaugccacaaug

SEQ ID NO: 857442 - RNA, 20 nt, Human
aaccauggcucacugcagcc

SEQ ID NO: 857443 - RNA, 20 nt, Human
aagacaaacacagacaggcc

SEQ ID NO: 857444 - RNA, 19 nt, Human
aagcacacaacaaaccgaa

SEQ ID NO: 857445 - RNA, 24 nt, Human
aagcacacaacaaaccgaagcuag

SEQ ID NO: 857446 - RNA, 25 nt, Human
aagugauccucccaccucagccucc

SEQ ID NO: 857447 - RNA, 22 nt, Human
aauaaagagaucgauaaagucc

SEQ ID NO: 857448 - RNA, 21 nt, Human
acaauaagcacacaacaaacc

SEQ ID NO: 857449 - RNA, 25 nt, Human
acaauaagcacacaacaaaccgaag

SEQ ID NO: 857450 - RNA, 19 nt, Human
accucagccuccuguacuu

SEQ ID NO: 857451 - RNA, 21 nt, Human
accugaccuccugggcugaag

SEQ ID NO: 857452 - RNA, 24 nt, Human
accugaccuccugggcugaaguga

SEQ ID NO: 857453 - RNA, 18 nt, Human
acuuugucacccaggcua

SEQ ID NO: 857454 - RNA, 21 nt, Human
acuuugucacccaggcuacag

SEQ ID NO: 857455 - RNA, 18 nt, Human
agacaggccgcaggcagg

SEQ ID NO: 857456 - RNA, 25 nt, Human
agacauguaaaccacucagcccagg

SEQ ID NO: 857457 - RNA, 18 nt, Human
agagauguucaggagcaa

SEQ ID NO: 857458 - RNA, 20 nt, Human
agccucccacccagcagccu

SEQ ID NO: 857459 - RNA, 18 nt, Human
aggacacaggccuuucug

SEQ ID NO: 857460 - RNA, 23 nt, Human
aggcagaugugugagugggcccg

SEQ ID NO: 857461 - RNA, 20 nt, Human
aguggugcaaccauggcuca

SEQ ID NO: 857462 - RNA, 19 nt, Human
auaaaguccuuucaaacag

SEQ ID NO: 857463 - RNA, 25 nt, Human
aucagccucccacccagcagccucc

SEQ ID NO: 857464 - RNA, 18 nt, Human
aucuguaaauuauuccuc

SEQ ID NO: 857465 - RNA, 22 nt, Human
augccacaaugacccacuggcu

SEQ ID NO: 857466 - RNA, 18 nt, Human
caaaacauuccaugaggg

SEQ ID NO: 857467 - RNA, 23 nt, Human
caaacacagacaggccgcaggca

SEQ ID NO: 857468 - RNA, 19 nt, Human
caaaguaggcgcacagggc

SEQ ID NO: 857469 - RNA, 22 nt, Human
caacaucaccaaacaugaguca

SEQ ID NO: 857470 - RNA, 25 nt, Human
caacugcuuaguuuuucauucaaau

SEQ ID NO: 857471 - RNA, 19 nt, Human
cacucagcccaggcccagc

SEQ ID NO: 857472 - RNA, 24 nt, Human
cacuuugucacccaggcuacagug

SEQ ID NO: 857473 - RNA, 18 nt, Human
cagaacuccacacaggga

SEQ ID NO: 857474 - RNA, 22 nt, Human
cagacaggccgcaggcaggcag

SEQ ID NO: 857475 - RNA, 21 nt, Human
cagcaaccagugccaugccac

SEQ ID NO: 857476 - RNA, 18 nt, Human
cagccuugaccugaccuc

SEQ ID NO: 857477 - RNA, 18 nt, Human
cauccaacaucaccaaac

SEQ ID NO: 857478 - RNA, 23 nt, Human
cauggcucacugcagccuugacc

SEQ ID NO: 857479 - RNA, 18 nt, Human
cauguaaaccacucagcc

SEQ ID NO: 857480 - RNA, 19 nt, Human
cauguagacuggugagauc

SEQ ID NO: 857481 - RNA, 20 nt, Human
ccacccagcagccuccaggc

SEQ ID NO: 857482 - RNA, 26 nt, Human
ccagugccaugccacaauggggugca

SEQ ID NO: 857483 - RNA, 19 nt, Human
cccacccagcagccuccag

SEQ ID NO: 857484 - RNA, 18 nt, Human
cccagagacuucucugga

SEQ ID NO: 857485 - RNA, 20 nt, Human
cccaggcuacaguguagugg

SEQ ID NO: 857486 - RNA, 23 nt, Human
ccucccaccucagccuccuguac

SEQ ID NO: 857487 - RNA, 21 nt, Human
ccugaccuccugggcugaagu

SEQ ID NO: 857488 - RNA, 23 nt, Human
ccugaccuccugggcugaaguga

SEQ ID NO: 857489 - RNA, 20 nt, Human
ccugggcugaagugauccuc

SEQ ID NO: 857490 - RNA, 22 nt, Human
ccuguacuuuaauuacuaaaaa

SEQ ID NO: 857491 - RNA, 18 nt, Human
cucacugcagccuugacc

SEQ ID NO: 857492 - RNA, 24 nt, Human
cugaagugauccucccaccucagc

SEQ ID NO: 857493 - RNA, 20 nt, Human
cuggcaccaaaggagcuucc

SEQ ID NO: 857494 - RNA, 20 nt, Human
cuucugucuccucgaugucc

SEQ ID NO: 857495 - RNA, 19 nt, Human
cuugaccugaccuccuggg

SEQ ID NO: 857496 - RNA, 19 nt, Human
gaaaucagagauguucagg

SEQ ID NO: 857497 - RNA, 20 nt, Human
gagacagggucucacuuugu

SEQ ID NO: 857498 - RNA, 20 nt, Human
gaucaaaacauuccaugagg

SEQ ID NO: 857499 - RNA, 22 nt, Human
gcacagggcuauuuuggugaag

SEQ ID NO: 857500 - RNA, 18 nt, Human
gcagaugugugagugggc

SEQ ID NO: 857501 - RNA, 19 nt, Human
ggcagaugugugagugggc

SEQ ID NO: 857502 - RNA, 23 nt, Human
ggcauccaacaucaccaaacaug

SEQ ID NO: 857503 - RNA, 20 nt, Human
ggcccgcagaagaaugucca

SEQ ID NO: 857504 - RNA, 21 nt, Human
gggugcacggcucagagacac

SEQ ID NO: 857505 - RNA, 18 nt, Human
ggucccaccauuugcagu

SEQ ID NO: 857506 - RNA, 21 nt, Human
gugagaucugccagaacucca

SEQ ID NO: 857507 - RNA, 23 nt, Human
gugauccucccaccucagccucc

SEQ ID NO: 857508 - RNA, 24 nt, Human
uaaaaagaaacauguauaaagcau

SEQ ID NO: 857509 - RNA, 21 nt, Human
uaagacaaacacagacaggcc

SEQ ID NO: 857510 - RNA, 23 nt, Human
uaauaagaccgcacccgccuccu

SEQ ID NO: 857511 - RNA, 26 nt, Human
uacuuggccagugacuuggagggguu

SEQ ID NO: 857512 - RNA, 30 nt, Human
ucacugcagccuugaccugaccuccugggg

SEQ ID NO: 857513 - RNA, 21 nt, Human
ucagcccaggcccagcacaca

SEQ ID NO: 857514 - RNA, 20 nt, Human
uccuuggggaaaugcagugu

SEQ ID NO: 857515 - RNA, 19 nt, Human
ucucacuuugucacccagg

SEQ ID NO: 857516 - RNA, 22 nt, Human
ucucacuuugucacccaggcua

SEQ ID NO: 857517 - RNA, 23 nt, Human
ucucacuuugucacccaggcuac

SEQ ID NO: 857518 - RNA, 24 nt, Human
ucucacuuugucacccaggcuaca

SEQ ID NO: 857519 - RNA, 19 nt, Human
ucucuggaaggauggaaau

SEQ ID NO: 857520 - RNA, 21 nt, Human
ucuucugucuccucgaugucc

SEQ ID NO: 857521 - RNA, 23 nt, Human
ucuugggcuuaaguucuggacuu

SEQ ID NO: 857522 - RNA, 19 nt, Human
ugacagcauaagcaacugc

SEQ ID NO: 857523 - RNA, 20 nt, Human
ugacagcauaagcaacugcu

SEQ ID NO: 857524 - RNA, 21 nt, Human
ugaggggacugacuacaaaag

SEQ ID NO: 857525 - RNA, 23 nt, Human
ugccacaauggggugcacggcuc

SEQ ID NO: 857526 - RNA, 22 nt, Human
uggcucacugcagccuugaccu

SEQ ID NO: 857527 - RNA, 25 nt, Human
ugggacuuuggugcuaacacugggu

SEQ ID NO: 857528 - RNA, 24 nt, Human
uggugcaaccauggcucacugcag

SEQ ID NO: 857529 - RNA, 22 nt, Human
uguaguggugcaaccauggcuc

SEQ ID NO: 857530 - RNA, 19 nt, Human
ugucacccaggcuacagug

SEQ ID NO: 857531 - RNA, 22 nt, Human
uucacaaaacuguacagauaua

SEQ ID NO: 857532 - RNA, 23 nt, Human
uuuuuuuuuugagacagggucuc

SEQ ID NO: 857533 - RNA, 20 nt, Human
uuuuuuuuuuugagacaggg

SEQ ID NO: 857534 - RNA, 23 nt, Human
uuuuuuuuuuuugagacaggguc

SEQ ID NO: 857535 - RNA, 26 nt, Human
uuuuuuuuuuuugagacagggucuca

SEQ ID NO: 857536 - RNA, 25 nt, Human
uuuuuuuuuuuuuuugagacagggg

SEQ ID NO: 857537 - RNA, 27 nt, Human
uuuuuuuuuuuuuuuuuuuuuuugggg

SEQ ID NO: 857538 - RNA, 20 nt, Human
aaacccucgaacggucaggc

SEQ ID NO: 857539 - RNA, 20 nt, Human
aaacgaggcugcgaagaggc

SEQ ID NO: 857540 - RNA, 24 nt, Human
aaagugcugggauuacaggcguga

SEQ ID NO: 857541 - RNA, 22 nt, Human
aaaugucagaaaaucacagcgg

SEQ ID NO: 857542 - RNA, 18 nt, Human
aagaacccuucagagccu

SEQ ID NO: 857543 - RNA, 20 nt, Human
aagcagacaaacggaacucc

SEQ ID NO: 857544 - RNA, 19 nt, Human
aagugcugggauuacaggc

SEQ ID NO: 857545 - RNA, 19 nt, Human
aagugcugggauuacaggc

SEQ ID NO: 857546 - RNA, 26 nt, Human
aagugcugggauuacaggcgugagcc

SEQ ID NO: 857547 - RNA, 22 nt, Human
acaaccgaccaagcagacaaac

SEQ ID NO: 857548 - RNA, 23 nt, Human
acaggccugcaccaccacgcccg

SEQ ID NO: 857549 - RNA, 20 nt, Human
accauucaugaaagaugcuc

SEQ ID NO: 857550 - RNA, 18 nt, Human
acccaagacggggcccca

SEQ ID NO: 857551 - RNA, 23 nt, Human
acggcaaaaaaaguaagugaacc

SEQ ID NO: 857552 - RNA, 18 nt, Human
acgggguuucuccauguu

SEQ ID NO: 857553 - RNA, 20 nt, Human
acgggguuucuccauguuga

SEQ ID NO: 857554 - RNA, 23 nt, Human
acgggguuucuccauguugaggc

SEQ ID NO: 857555 - RNA, 26 nt, Human
acgggguuucuccauguugaggcugg

SEQ ID NO: 857556 - RNA, 21 nt, Human
acuccgaggaggccgcgcggg

SEQ ID NO: 857557 - RNA, 18 nt, Human
agcaauucuccugcuuua

SEQ ID NO: 857558 - RNA, 18 nt, Human
agccucccgaguagcugg

SEQ ID NO: 857559 - RNA, 19 nt, Human
agcugggauuacaggccug

SEQ ID NO: 857560 - RNA, 24 nt, Human
aggugauccgcccgucucggccuc

SEQ ID NO: 857561 - RNA, 22 nt, Human
aguagagacgggguuucuccau

SEQ ID NO: 857562 - RNA, 19 nt, Human
aguagcugggauuacaggc

SEQ ID NO: 857563 - RNA, 20 nt, Human
agugcaauggcgcgaucucg

SEQ ID NO: 857564 - RNA, 24 nt, Human
agugcaauggcgcgaucucggcuc

SEQ ID NO: 857565 - RNA, 24 nt, Human
caaagugcugggauuacaggcgug

SEQ ID NO: 857566 - RNA, 22 nt, Human
caacggcaaaaaaaguaaguga

SEQ ID NO: 857567 - RNA, 24 nt, Human
caagacggggccccagccggcgcc

SEQ ID NO: 857568 - RNA, 22 nt, Human
caagcaauucuccugcuuuagc

SEQ ID NO: 857569 - RNA, 21 nt, Human
caccacaaccuccgccuccca

SEQ ID NO: 857570 - RNA, 22 nt, Human
caccacaaccuccgccucccag

SEQ ID NO: 857571 - RNA, 23 nt, Human
caccaccacgcccggcuaaauuu

SEQ ID NO: 857572 - RNA, 18 nt, Human
cagcagcaucaagcgauc

SEQ ID NO: 857573 - RNA, 20 nt, Human
cagcagcaucaagcgaucuu

SEQ ID NO: 857574 - RNA, 24 nt, Human
cagcagcaucaagcgaucuuugga

SEQ ID NO: 857575 - RNA, 23 nt, Human
cagcugcugcuucacuguccacu

SEQ ID NO: 857576 - RNA, 23 nt, Human
caggcgacggcguggacacccaa

SEQ ID NO: 857577 - RNA, 20 nt, Human
ccaaagugcugggauuacag

SEQ ID NO: 857578 - RNA, 22 nt, Human
ccaaagugcugggauuacaggc

SEQ ID NO: 857579 - RNA, 22 nt, Human
ccaaagugcugggauuacaggc

SEQ ID NO: 857580 - RNA, 24 nt, Human
ccaaagugcugggauuacaggcgu

SEQ ID NO: 857581 - RNA, 19 nt, Human
ccaagcagcagcaucaagc

SEQ ID NO: 857582 - RNA, 23 nt, Human
ccacaaccuccgccucccagguu

SEQ ID NO: 857583 - RNA, 24 nt, Human
ccacaaccuccgccucccagguuc

SEQ ID NO: 857584 - RNA, 23 nt, Human
ccaugggcaggcccagccccacu

SEQ ID NO: 857585 - RNA, 22 nt, Human
cccacugccuagcccagcugcu

SEQ ID NO: 857586 - RNA, 23 nt, Human
cccagguucaagcaauucuccug

SEQ ID NO: 857587 - RNA, 21 nt, Human
ccccaugggcaggcccagccc

SEQ ID NO: 857588 - RNA, 19 nt, Human
ccccuuagggcccagcugu

SEQ ID NO: 857589 - RNA, 25 nt, Human
cccgaguagcugggauuacaggccu

SEQ ID NO: 857590 - RNA, 22 nt, Human
cccgucucggccucccaaagug

SEQ ID NO: 857591 - RNA, 27 nt, Human
ccgccucccagguucaagcaauucuuu

SEQ ID NO: 857592 - RNA, 21 nt, Human
ccuagcccagcugcugcuuca

SEQ ID NO: 857593 - RNA, 24 nt, Human
ccucccagguucaagcaauucucc

SEQ ID NO: 857594 - RNA, 18 nt, Human
ccugaccucaggugaucc

SEQ ID NO: 857595 - RNA, 22 nt, Human
ccugaccucaggugauccgccc

SEQ ID NO: 857596 - RNA, 22 nt, Human
ccuggucacccaagccuuucug

SEQ ID NO: 857597 - RNA, 19 nt, Human
ccuuugggcauucucuucc

SEQ ID NO: 857598 - RNA, 19 nt, Human
cgccgcgccccugccccuc

SEQ ID NO: 857599 - RNA, 22 nt, Human
cggaacuccgugagggggacac

SEQ ID NO: 857600 - RNA, 21 nt, Human
cgggguuucuccauguugagg

SEQ ID NO: 857601 - RNA, 23 nt, Human
cguuccuuugggcauucucuucc

SEQ ID NO: 857602 - RNA, 24 nt, Human
cuaaauuuguauuuuuaguagaga

SEQ ID NO: 857603 - RNA, 24 nt, Human
cucaccacaaccuccgccucccag

SEQ ID NO: 857604 - RNA, 26 nt, Human
cuccugaccucaggugauccgcccgu

SEQ ID NO: 857605 - RNA, 23 nt, Human
cugcuuuagccucccgaguagcu

SEQ ID NO: 857606 - RNA, 19 nt, Human
cuggcucagcauucucuuc

SEQ ID NO: 857607 - RNA, 19 nt, Human
cuuaaacccuggcucagca

SEQ ID NO: 857608 - RNA, 19 nt, Human
gaccaagcagacaaacgga

SEQ ID NO: 857609 - RNA, 24 nt, Human
gaccucaggugauccgcccgucuc

SEQ ID NO: 857610 - RNA, 20 nt, Human
gagacgggguuucuccaugu

SEQ ID NO: 857611 - RNA, 24 nt, Human
gaguagcugggauuacaggccugc

SEQ ID NO: 857612 - RNA, 18 nt, Human
gauuacaggcgugagcca

SEQ ID NO: 857613 - RNA, 22 nt, Human
gauuacaggcgugagccaccgc

SEQ ID NO: 857614 - RNA, 22 nt, Human
gauuacaggcgugagccaccgc

SEQ ID NO: 857615 - RNA, 24 nt, Human
gauuauuuugggcacuguauuuuu

SEQ ID NO: 857616 - RNA, 18 nt, Human
gcagaaacguccaggggc

SEQ ID NO: 857617 - RNA, 18 nt, Human
gccgcgccccugccccuc

SEQ ID NO: 857618 - RNA, 28 nt, Human
gccugaagguauucuacucuuaguuauu

SEQ ID NO: 857619 - RNA, 18 nt, Human
gccuggguccuggggcuc

SEQ ID NO: 857620 - RNA, 19 nt, Human
gcggucucaagcgcaagaa

SEQ ID NO: 857621 - RNA, 23 nt, Human
gcuggucucgaacuccugaccuc

SEQ ID NO: 857622 - RNA, 18 nt, Human
ggcguggacacccaagac

SEQ ID NO: 857623 - RNA, 24 nt, Human
ggcuggucucgaacuccugaccuc

SEQ ID NO: 857624 - RNA, 25 nt, Human
gggcggguguuguuucgggagcugc

SEQ ID NO: 857625 - RNA, 19 nt, Human
ggucucgaacuccugaccu

SEQ ID NO: 857626 - RNA, 23 nt, Human
guagagacgggguuucuccaugu

SEQ ID NO: 857627 - RNA, 18 nt, Human
guccccuugcagaacucg

SEQ ID NO: 857628 - RNA, 23 nt, Human
guuccuuugggcauucucuucca

SEQ ID NO: 857629 - RNA, 22 nt, Human
uaagggcuucaacuuaaagucc

SEQ ID NO: 857630 - RNA, 20 nt, Human
uaagugaaccauucaugaaa

SEQ ID NO: 857631 - RNA, 21 nt, Human
uacaggccugcaccaccacgc

SEQ ID NO: 857632 - RNA, 22 nt, Human
uacaggcgugagccaccgcgcc

SEQ ID NO: 857633 - RNA, 22 nt, Human
uacaggcgugagccaccgcgcc

SEQ ID NO: 857634 - RNA, 23 nt, Human
uacaggcgugagccaccgcgccu

SEQ ID NO: 857635 - RNA, 24 nt, Human
uaguagagacgggguuucuccaug

SEQ ID NO: 857636 - RNA, 19 nt, Human
uaucagaaaggucgcucaa

SEQ ID NO: 857637 - RNA, 24 nt, Human
ucaccacaaccuccgccucccagg

SEQ ID NO: 857638 - RNA, 25 nt, Human
ucaccacaaccuccgccucccaggu

SEQ ID NO: 857639 - RNA, 27 nt, Human
ucaccacaaccuccgccucccagguuc

SEQ ID NO: 857640 - RNA, 24 nt, Human
ucacgggcaaacugggcuucaaga

SEQ ID NO: 857641 - RNA, 23 nt, Human
ucacuccuguuguccaggaugga

SEQ ID NO: 857642 - RNA, 23 nt, Human
uccagagaacaaccgaccaagca

SEQ ID NO: 857643 - RNA, 25 nt, Human
uccagagaacaaccgaccaagcaga

SEQ ID NO: 857644 - RNA, 26 nt, Human
uccagagaacaaccgaccaagcagac

SEQ ID NO: 857645 - RNA, 19 nt, Human
uccauggaggaccccagaa

SEQ ID NO: 857646 - RNA, 24 nt, Human
ucccaaagugcugggauuacaggc

SEQ ID NO: 857647 - RNA, 21 nt, Human
ucccagguucaagcaauucuc

SEQ ID NO: 857648 - RNA, 24 nt, Human
ucccagguucaagcaauucuccug

SEQ ID NO: 857649 - RNA, 24 nt, Human
ucccgaguagcugggauuacaggc

SEQ ID NO: 857650 - RNA, 21 nt, Human
uccgaggaggccgcgcggguc

SEQ ID NO: 857651 - RNA, 19 nt, Human
ucucgaacuccugaccuca

SEQ ID NO: 857652 - RNA, 20 nt, Human
ucucggccucccaaagugcu

SEQ ID NO: 857653 - RNA, 21 nt, Human
ucugccuccaaaaugucagaa

SEQ ID NO: 857654 - RNA, 26 nt, Human
ucuuuggaugacuuaaacccuggcuc

SEQ ID NO: 857655 - RNA, 18 nt, Human
ugaccucaggugauccgc

SEQ ID NO: 857656 - RNA, 21 nt, Human
ugaccucaggugauccgcccg

SEQ ID NO: 857657 - RNA, 24 nt, Human
ugaccucaggugauccgcccgucu

SEQ ID NO: 857658 - RNA, 21 nt, Human
ugacuuaaacccuggcucagc

SEQ ID NO: 857659 - RNA, 21 nt, Human
ugagauuauuuugggcacugu

SEQ ID NO: 857660 - RNA, 22 nt, Human
ugaggcuggucucgaacuccug

SEQ ID NO: 857661 - RNA, 19 nt, Human
ugcgaagaggcucaggcug

SEQ ID NO: 857662 - RNA, 24 nt, Human
ugcugggauuacaggcgugagcca

SEQ ID NO: 857663 - RNA, 21 nt, Human
uggacacccaagacggggccc

SEQ ID NO: 857664 - RNA, 23 nt, Human
uggagugcaauggcgcgaucucg

SEQ ID NO: 857665 - RNA, 24 nt, Human
uggagugcaauggcgcgaucucgg

SEQ ID NO: 857666 - RNA, 24 nt, Human
uggcgcgaucucggcucaccacaa

SEQ ID NO: 857667 - RNA, 19 nt, Human
uggcucagcauucucuucc

SEQ ID NO: 857668 - RNA, 21 nt, Human
ugggauuacaggccugcacca

SEQ ID NO: 857669 - RNA, 24 nt, Human
ugggauuacaggccugcaccacca

SEQ ID NO: 857670 - RNA, 18 nt, Human
ugggauuacaggcgugag

SEQ ID NO: 857671 - RNA, 19 nt, Human
ugggauuacaggcgugagc

SEQ ID NO: 857672 - RNA, 21 nt, Human
ugggauuacaggcgugagcca

SEQ ID NO: 857673 - RNA, 22 nt, Human
ugggauuacaggcgugagccac

SEQ ID NO: 857674 - RNA, 23 nt, Human
ugggauuacaggcgugagccacc

SEQ ID NO: 857675 - RNA, 24 nt, Human
ugggauuacaggcgugagccaccg

SEQ ID NO: 857676 - RNA, 21 nt, Human
uguauuuuuaguagagacggg

SEQ ID NO: 857677 - RNA, 26 nt, Human
ugucagaaaaucacagcggucucaag

SEQ ID NO: 857678 - RNA, 19 nt, Human
ugucugggcagggcgaggc

SEQ ID NO: 857679 - RNA, 24 nt, Human
uguugaggcuggucucgaacuccu

SEQ ID NO: 857680 - RNA, 18 nt, Human
uguuggggccgugcggcc

SEQ ID NO: 857681 - RNA, 22 nt, Human
uguuggggccgugcggccgcag

SEQ ID NO: 857682 - RNA, 18 nt, Human
uuaguagagacgggguuu

SEQ ID NO: 857683 - RNA, 24 nt, Human
uuaguagagacgggguuucuccau

SEQ ID NO: 857684 - RNA, 18 nt, Human
uucacuguccacuccgag

SEQ ID NO: 857685 - RNA, 20 nt, Human
uucgggagcugcuuuccaug

SEQ ID NO: 857686 - RNA, 24 nt, Human
uuuagccucccgaguagcugggau

SEQ ID NO: 857687 - RNA, 18 nt, Human
uuuguauuuuuaguagag

SEQ ID NO: 857688 - RNA, 19 nt, Human
uuuguauuuuuaguagaga

SEQ ID NO: 857689 - RNA, 20 nt, Human
uuuguauuuuuaguagagac

SEQ ID NO: 857690 - RNA, 22 nt, Human
uuuuuaguagagacgggguuuc

SEQ ID NO: 857691 - RNA, 26 nt, Human
uuuuuuuuuuuugagacggaguuuca

SEQ ID NO: 857692 - RNA, 22 nt, Human
uuuuuuuuuuuuuugagacgga

SEQ ID NO: 857693 - RNA, 18 nt, Human
uuuuuuuuuuuuuuuuug

SEQ ID NO: 857694 - RNA, 23 nt, Human
aaacaucaaaagguacaauggcc

SEQ ID NO: 857695 - RNA, 25 nt, Human
aaacaucucaacagcagaccagaac

SEQ ID NO: 857696 - RNA, 24 nt, Human
aagaagaaagccaccaacagaagg

SEQ ID NO: 857697 - RNA, 20 nt, Human
aagagacaggacaccaguga

SEQ ID NO: 857698 - RNA, 23 nt, Human
aagagacaggacaccagugagug

SEQ ID NO: 857699 - RNA, 23 nt, Human
aagcagccaccccucccaacaag

SEQ ID NO: 857700 - RNA, 18 nt, Human
aagcauaguugcaaaaug

SEQ ID NO: 857701 - RNA, 23 nt, Human
aagcccucaaaggcagacagucc

SEQ ID NO: 857702 - RNA, 22 nt, Human
aauggguaugggugacaagagg

SEQ ID NO: 857703 - RNA, 23 nt, Human
aauggguaugggugacaagaggg

SEQ ID NO: 857704 - RNA, 19 nt, Human
acacagguaacaagaccag

SEQ ID NO: 857705 - RNA, 21 nt, Human
acagcaccugguggccacacc

SEQ ID NO: 857706 - RNA, 19 nt, Human
agaaagauggggaaauucu

SEQ ID NO: 857707 - RNA, 21 nt, Human
agaagaaagccaccaacagaa

SEQ ID NO: 857708 - RNA, 21 nt, Human
agccaccccucccaacaagag

SEQ ID NO: 857709 - RNA, 22 nt, Human
agccagcgcccuaucaaccugg

SEQ ID NO: 857710 - RNA, 18 nt, Human
aggacaggacgacaagag

SEQ ID NO: 857711 - RNA, 22 nt, Human
aggacaggagggagagucuggc

SEQ ID NO: 857712 - RNA, 22 nt, Human
aggagggagagucuggccaggu

SEQ ID NO: 857713 - RNA, 19 nt, Human
aggccgaggcuggcagagc

SEQ ID NO: 857714 - RNA, 21 nt, Human
agggagaggccgaggcuggca

SEQ ID NO: 857715 - RNA, 18 nt, Human
aggggccaccuuccaccc

SEQ ID NO: 857716 - RNA, 21 nt, Human
auccaaguacccugacccagc

SEQ ID NO: 857717 - RNA, 18 nt, Human
aucccauuuuuuccuuaa

SEQ ID NO: 857718 - RNA, 23 nt, Human
aucuucccuggcauucucuguua

SEQ ID NO: 857719 - RNA, 23 nt, Human
auggccaggggugcggcaggaga

SEQ ID NO: 857720 - RNA, 18 nt, Human
caaaaacuaaaauugcua

SEQ ID NO: 857721 - RNA, 18 nt, Human
caagcagccaccccuccc

SEQ ID NO: 857722 - RNA, 22 nt, Human
caagcagccaccccucccaaca

SEQ ID NO: 857723 - RNA, 23 nt, Human
caaguacccugacccagcacuca

SEQ ID NO: 857724 - RNA, 18 nt, Human
cacagaaacucacagcac

SEQ ID NO: 857725 - RNA, 28 nt, Human
caccagugaguggcugggccaggcggcc

SEQ ID NO: 857726 - RNA, 20 nt, Human
caccccucccaacaagagcc

SEQ ID NO: 857727 - RNA, 23 nt, Human
cacccugaaaugcacccuuugcu

SEQ ID NO: 857728 - RNA, 20 nt, Human
caccucagcgucuacuucca

SEQ ID NO: 857729 - RNA, 22 nt, Human
cacucaucuucccuggcauucu

SEQ ID NO: 857730 - RNA, 21 nt, Human
cagaaacucacagcaccuggu

SEQ ID NO: 857731 - RNA, 25 nt, Human
cagacaguccucaugcgcagcacca

SEQ ID NO: 857732 - RNA, 19 nt, Human
cagccagcgcccuaucaac

SEQ ID NO: 857733 - RNA, 21 nt, Human
cagcccagaggccaugagcca

SEQ ID NO: 857734 - RNA, 24 nt, Human
cagucuguggcccaucuggaaacu

SEQ ID NO: 857735 - RNA, 26 nt, Human
ccaacucuaaaacaaaaucccauuuu

SEQ ID NO: 857736 - RNA, 18 nt, Human
ccagaacuagaaaacaca

SEQ ID NO: 857737 - RNA, 26 nt, Human
ccaggcggccccauuuccuaaaacca

SEQ ID NO: 857738 - RNA, 28 nt, Human
ccaggggugcggcaggagagucgggggc

SEQ ID NO: 857739 - RNA, 20 nt, Human
ccagugaguggcugggccag

SEQ ID NO: 857740 - RNA, 22 nt, Human
cccagaggccaugagccacaga

SEQ ID NO: 857741 - RNA, 18 nt, Human
ccccugggccuauuucca

SEQ ID NO: 857742 - RNA, 20 nt, Human
ccuacauccuucaaaacuca

SEQ ID NO: 857743 - RNA, 21 nt, Human
ccuauuuccaagcagccaccc

SEQ ID NO: 857744 - RNA, 23 nt, Human
ccuccagcgccgccgccccgggc

SEQ ID NO: 857745 - RNA, 24 nt, Human
ccugggacucccagaccuggcaga

SEQ ID NO: 857746 - RNA, 23 nt, Human
cgaggcuggcagagccccugggc

SEQ ID NO: 857747 - RNA, 24 nt, Human
cuagaaaacacagcuucuguguag

SEQ ID NO: 857748 - RNA, 18 nt, Human
cucaaaggcagacagucc

SEQ ID NO: 857749 - RNA, 18 nt, Human
cucacagcaccugguggc

SEQ ID NO: 857750 - RNA, 23 nt, Human
cuggcuaugguacuuuggggaga

SEQ ID NO: 857751 - RNA, 18 nt, Human
gaaacuggcuaugguacu

SEQ ID NO: 857752 - RNA, 19 nt, Human
gaaggcaacucaggaggga

SEQ ID NO: 857753 - RNA, 22 nt, Human
gacaagaggggccaccuuccac

SEQ ID NO: 857754 - RNA, 21 nt, Human
gacccagcacucaucuucccu

SEQ ID NO: 857755 - RNA, 20 nt, Human
gagccccugggccuauuucc

SEQ ID NO: 857756 - RNA, 22 nt, Human
gcagaggguuuuauuagggccc

SEQ ID NO: 857757 - RNA, 20 nt, Human
gccaccaacagaaggcaacc

SEQ ID NO: 857758 - RNA, 20 nt, Human
gccacugauucuccucccca

SEQ ID NO: 857759 - RNA, 21 nt, Human
gcccucaaaggcagacagucc

SEQ ID NO: 857760 - RNA, 20 nt, Human
gcgguucagcucaaggacac

SEQ ID NO: 857761 - RNA, 21 nt, Human
gcuccgucucgagcuccucca

SEQ ID NO: 857762 - RNA, 20 nt, Human
gcugggccaggcggccccau

SEQ ID NO: 857763 - RNA, 26 nt, Human
ggaaggacaggacgacaagagacagg

SEQ ID NO: 857764 - RNA, 18 nt, Human
ggcagacaguccucaugc

SEQ ID NO: 857765 - RNA, 22 nt, Human
ggcagaggguuuuauuagggcc

SEQ ID NO: 857766 - RNA, 24 nt, Human
gggagagucuggccaggugcaccc

SEQ ID NO: 857767 - RNA, 18 nt, Human
gggccaccuuccaccccu

SEQ ID NO: 857768 - RNA, 18 nt, Human
gguaacaagaccagggga

SEQ ID NO: 857769 - RNA, 18 nt, Human
guacacacuuauggucug

SEQ ID NO: 857770 - RNA, 25 nt, Human
gucgggggcagggcagccuucaaau

SEQ ID NO: 857771 - RNA, 18 nt, Human
gugacuccugauucugca

SEQ ID NO: 857772 - RNA, 24 nt, Human
guggcccaucuggaaacuggcuau

SEQ ID NO: 857773 - RNA, 25 nt, Human
uaaaauugcuaucagcccccgccgc

SEQ ID NO: 857774 - RNA, 24 nt, Human
uaagaaauggguaugggugacaag

SEQ ID NO: 857775 - RNA, 21 nt, Human
uaagacauuucccaagaguuc

SEQ ID NO: 857776 - RNA, 21 nt, Human
uacaauggccaggggugcggc

SEQ ID NO: 857777 - RNA, 21 nt, Human
uacagaaucaaaggggaaacc

SEQ ID NO: 857778 - RNA, 19 nt, Human
uagaaaacacagcuucugu

SEQ ID NO: 857779 - RNA, 18 nt, Human
ucaaaacucagacuccac

SEQ ID NO: 857780 - RNA, 22 nt, Human
ucagugcgguucagcucaagga

SEQ ID NO: 857781 - RNA, 26 nt, Human
ucaugcgcagcaccagcacacacaca

SEQ ID NO: 857782 - RNA, 25 nt, Human
uccaagacagaauugcccucagccc

SEQ ID NO: 857783 - RNA, 21 nt, Human
uccaaguacccugacccagca

SEQ ID NO: 857784 - RNA, 21 nt, Human
uccgucucgagcuccuccagc

SEQ ID NO: 857785 - RNA, 21 nt, Human
uccuucaaaacucagacucca

SEQ ID NO: 857786 - RNA, 19 nt, Human
ucugagacccaacuaaggc

SEQ ID NO: 857787 - RNA, 18 nt, Human
ugaaaaccucuuuacaca

SEQ ID NO: 857788 - RNA, 19 nt, Human
ugacaagaggggccaccuu

SEQ ID NO: 857789 - RNA, 22 nt, Human
ugagaggauagggaggccaaaa

SEQ ID NO: 857790 - RNA, 26 nt, Human
ugaggacaagaguucuucagugcggu

SEQ ID NO: 857791 - RNA, 27 nt, Human
ugaggacaagaguucuucagugcgguu

SEQ ID NO: 857792 - RNA, 19 nt, Human
ugcacccuuugcuccaagc

SEQ ID NO: 857793 - RNA, 19 nt, Human
ugcaccguuucauccaagu

SEQ ID NO: 857794 - RNA, 20 nt, Human
ugcaccguuucauccaagua

SEQ ID NO: 857795 - RNA, 21 nt, Human
uggcauucucuguuauccacc

SEQ ID NO: 857796 - RNA, 18 nt, Human
uggccaggggugcggcag

SEQ ID NO: 857797 - RNA, 20 nt, Human
uggcugggccaggcggcccc

SEQ ID NO: 857798 - RNA, 18 nt, Human
ugggccacugauucuccu

SEQ ID NO: 857799 - RNA, 22 nt, Human
uguaguacacacuuauggucug

SEQ ID NO: 857800 - RNA, 20 nt, Human
ugugcaagggaccagcccag

SEQ ID NO: 857801 - RNA, 24 nt, Human
uuccucaggaacagagaacuuugc

SEQ ID NO: 857802 - RNA, 22 nt, Human
uucuccuccccagucuguggcc

SEQ ID NO: 857803 - RNA, 25 nt, Human
uuugcaaugaugaucucaacucugc

SEQ ID NO: 857804 - RNA, 18 nt, Human
uuuggggagauaggaagg

SEQ ID NO: 857805 - RNA, 21 nt, Human
uuuggggagauaggaaggaca

SEQ ID NO: 857806 - RNA, 19 nt, Human
uuuuuuuuuuuuaacaggc

SEQ ID NO: 857807 - RNA, 21 nt, Human
uuuuuuuuuuuuuuuaacagg

SEQ ID NO: 857808 - RNA, 23 nt, Human
uuuuuuuuuuuuuuuuuaacagg

SEQ ID NO: 857809 - RNA, 18 nt, Human
aaagacccucuuagacca

SEQ ID NO: 857810 - RNA, 18 nt, Human
aagcugcugggaucacca

SEQ ID NO: 857811 - RNA, 22 nt, Human
aagcugcugggaucaccacagg

SEQ ID NO: 857812 - RNA, 21 nt, Human
aaggcuucacagcugggggua

SEQ ID NO: 857813 - RNA, 22 nt, Human
aaggggccugggcugcgaccca

SEQ ID NO: 857814 - RNA, 18 nt, Human
aagugugaugcaauaacc

SEQ ID NO: 857815 - RNA, 19 nt, Human
acaaagccagggaacaccu

SEQ ID NO: 857816 - RNA, 20 nt, Human
acaaagccagggaacaccuc

SEQ ID NO: 857817 - RNA, 21 nt, Human
accccgugaggcccagucccu

SEQ ID NO: 857818 - RNA, 21 nt, Human
acccuggaaggggccugggcu

SEQ ID NO: 857819 - RNA, 19 nt, Human
agcccacaggggccucgug

SEQ ID NO: 857820 - RNA, 18 nt, Human
agcccuccccaaacccag

SEQ ID NO: 857821 - RNA, 23 nt, Human
agcccuguaaccaagccaguggg

SEQ ID NO: 857822 - RNA, 18 nt, Human
aggcagggacggggcggc

SEQ ID NO: 857823 - RNA, 19 nt, Human
aggcggggggcacgaaggc

SEQ ID NO: 857824 - RNA, 22 nt, Human
agggagagcggcugggcagggg

SEQ ID NO: 857825 - RNA, 22 nt, Human
agggggaaaggaguggcacccu

SEQ ID NO: 857826 - RNA, 20 nt, Human
aguggcacccuggaaggggc

SEQ ID NO: 857827 - RNA, 18 nt, Human
caaccccucaagaggaag

SEQ ID NO: 857828 - RNA, 18 nt, Human
caagaggaaggcuucaca

SEQ ID NO: 857829 - RNA, 21 nt, Human
caccccgugaggcccaguccu

SEQ ID NO: 857830 - RNA, 19 nt, Human
cacccuggaaggggccugg

SEQ ID NO: 857831 - RNA, 21 nt, Human
cacucuuggaggccccacccc

SEQ ID NO: 857832 - RNA, 20 nt, Human
cagugcugggccuccuggca

SEQ ID NO: 857833 - RNA, 23 nt, Human
caugugagagcccuguaaccaag

SEQ ID NO: 857834 - RNA, 28 nt, Human
cauucugcgccucuggucauguccucca

SEQ ID NO: 857835 - RNA, 22 nt, Human
ccaaggugcugggcauuaaggc

SEQ ID NO: 857836 - RNA, 24 nt, Human
ccacaggggccucgugcucgggaa

SEQ ID NO: 857837 - RNA, 23 nt, Human
cccaccccaccccgugaggccca

SEQ ID NO: 857838 - RNA, 21 nt, Human
cccucaagaggaaggcuucac

SEQ ID NO: 857839 - RNA, 21 nt, Human
cccuguaguggcccagccuga

SEQ ID NO: 857840 - RNA, 19 nt, Human
ccggcccccgggccccgac

SEQ ID NO: 857841 - RNA, 18 nt, Human
ccucuuagaccaugggaa

SEQ ID NO: 857842 - RNA, 23 nt, Human
cgacggcgagacaaagccaggga

SEQ ID NO: 857843 - RNA, 21 nt, Human
cggcccccgggccccgacggc

SEQ ID NO: 857844 - RNA, 23 nt, Human
cggcugggcaggggccaaggcgg

SEQ ID NO: 857845 - RNA, 21 nt, Human
cgggcuaaacccagcccuccc

SEQ ID NO: 857846 - RNA, 24 nt, Human
cgggcuaaacccagcccuccccaa

SEQ ID NO: 857847 - RNA, 19 nt, Human
cucaaccccucaagaggaa

SEQ ID NO: 857848 - RNA, 19 nt, Human
cucccaggcaggagggcuc

SEQ ID NO: 857849 - RNA, 23 nt, Human
cugggcugcgacccacccugggc

SEQ ID NO: 857850 - RNA, 24 nt, Human
cuguauacugcccaccucaacccc

SEQ ID NO: 857851 - RNA, 20 nt, Human
gaacaagcucccaggcagga

SEQ ID NO: 857852 - RNA, 19 nt, Human
gaaucaauccaaggugcug

SEQ ID NO: 857853 - RNA, 19 nt, Human
gaccaugggaaucaaucca

SEQ ID NO: 857854 - RNA, 21 nt, Human
gcagugcugggccuccuggca

SEQ ID NO: 857855 - RNA, 21 nt, Human
gcccggcccccgggccccgac

SEQ ID NO: 857856 - RNA, 18 nt, Human
gccugcaccccaccggca

SEQ ID NO: 857857 - RNA, 19 nt, Human
gccuuagucaaaaagaccc

SEQ ID NO: 857858 - RNA, 19 nt, Human
ggaggaggacagggagagc

SEQ ID NO: 857859 - RNA, 18 nt, Human
ggcaggggccaaggcggg

SEQ ID NO: 857860 - RNA, 22 nt, Human
ggcaggggccaaggcggggggc

SEQ ID NO: 857861 - RNA, 24 nt, Human
ggcggcaacgacggcgagacaaag

SEQ ID NO: 857862 - RNA, 23 nt, Human
gggaauacgcaaggggguggggg

SEQ ID NO: 857863 - RNA, 20 nt, Human
gggcaggggccaaggcgggg

SEQ ID NO: 857864 - RNA, 21 nt, Human
gggcaggggccaaggcggggg

SEQ ID NO: 857865 - RNA, 18 nt, Human
gggccugggcugcgaccc

SEQ ID NO: 857866 - RNA, 24 nt, Human
ggggaaaggaguggcacccuggaa

SEQ ID NO: 857867 - RNA, 24 nt, Human
ggggaauacgcaagggggugggag

SEQ ID NO: 857868 - RNA, 18 nt, Human
gugaggcccagucccuuc

SEQ ID NO: 857869 - RNA, 23 nt, Human
gugaugcaauaaccaaagggucc

SEQ ID NO: 857870 - RNA, 18 nt, Human
gugggaguauggcucccc

SEQ ID NO: 857871 - RNA, 19 nt, Human
uaaacccagcccuccccaa

SEQ ID NO: 857872 - RNA, 24 nt, Human
uaguggcccagccugauccaaagu

SEQ ID NO: 857873 - RNA, 24 nt, Human
uauacugcccaccucaaccccuca

SEQ ID NO: 857874 - RNA, 26 nt, Human
ucagcaccuuccaaagaacaagcucc

SEQ ID NO: 857875 - RNA, 24 nt, Human
ucccaggcaggagggcuccuugca

SEQ ID NO: 857876 - RNA, 18 nt, Human
ucccagugauuacccaag

SEQ ID NO: 857877 - RNA, 19 nt, Human
ucccuguaacauaccaugu

SEQ ID NO: 857878 - RNA, 19 nt, Human
ucccuucccuucuggccag

SEQ ID NO: 857879 - RNA, 21 nt, Human
uccgcccggcccccgggcccc

SEQ ID NO: 857880 - RNA, 21 nt, Human
ucugcgccucuggucaugucc

SEQ ID NO: 857881 - RNA, 22 nt, Human
ucugcgccucuggucauguccu

SEQ ID NO: 857882 - RNA, 22 nt, Human
ugaugcaauaaccaaagggucc

SEQ ID NO: 857883 - RNA, 20 nt, Human
uggaaggggccugggcugcg

SEQ ID NO: 857884 - RNA, 21 nt, Human
uggcacauucugcgccucugg

SEQ ID NO: 857885 - RNA, 20 nt, Human
uggcacccuggaaggggccu

SEQ ID NO: 857886 - RNA, 18 nt, Human
uggcccagccugauccaa

SEQ ID NO: 857887 - RNA, 19 nt, Human
uggcccaucaggcccugua

SEQ ID NO: 857888 - RNA, 19 nt, Human
uggcuccuguauacugccc

SEQ ID NO: 857889 - RNA, 26 nt, Human
ugggccuccuggcacauucugcgccu

SEQ ID NO: 857890 - RNA, 19 nt, Human
ugggggugguuaaggggag

SEQ ID NO: 857891 - RNA, 20 nt, Human
uggucauguccuccacacaa

SEQ ID NO: 857892 - RNA, 21 nt, Human
uggucuguucaaucaaaggcc

SEQ ID NO: 857893 - RNA, 22 nt, Human
uguauacugcccaccucaaccc

SEQ ID NO: 857894 - RNA, 20 nt, Human
uuaaggggaggaggacaggg

SEQ ID NO: 857895 - RNA, 23 nt, Human
uuccaaagaacaagcucccaggc

SEQ ID NO: 857896 - RNA, 22 nt, Human
uuuuuuuuuuuuuuuuuuucag

SEQ ID NO: 857897 - RNA, 24 nt, Human
aaagugcugggauuacaggcauga

SEQ ID NO: 857898 - RNA, 19 nt, Human
aagugcugggauuacaggc

SEQ ID NO: 857899 - RNA, 21 nt, Human
aagugcugggauuacaggcau

SEQ ID NO: 857900 - RNA, 26 nt, Human
aagugcugggauuacaggcaugagcc

SEQ ID NO: 857901 - RNA, 19 nt, Human
acagaggucuccugccucc

SEQ ID NO: 857902 - RNA, 23 nt, Human
acaggugucugccaccacacccg

SEQ ID NO: 857903 - RNA, 24 nt, Human
accucgugaucugccugccuuggc

SEQ ID NO: 857904 - RNA, 27 nt, Human
acugacaucuuucaggaccacaucccc

SEQ ID NO: 857905 - RNA, 20 nt, Human
acugcaagcucugccucccg

SEQ ID NO: 857906 - RNA, 23 nt, Human
acuuuaaaggguagugguuaagg

SEQ ID NO: 857907 - RNA, 21 nt, Human
agaggucuccugccuccucgg

SEQ ID NO: 857908 - RNA, 18 nt, Human
agccucccgaauagcugg

SEQ ID NO: 857909 - RNA, 25 nt, Human
aggcuggagugcaguggugcaaucu

SEQ ID NO: 857910 - RNA, 21 nt, Human
agggguugucuccauaaagga

SEQ ID NO: 857911 - RNA, 20 nt, Human
agugcaguggugcaaucucg

SEQ ID NO: 857912 - RNA, 18 nt, Human
agugcugggauuacaggc

SEQ ID NO: 857913 - RNA, 21 nt, Human
auccuccugccucagccuccc

SEQ ID NO: 857914 - RNA, 19 nt, Human
aucugccugccuuggccuc

SEQ ID NO: 857915 - RNA, 24 nt, Human
caaagugcugggauuacaggcaug

SEQ ID NO: 857916 - RNA, 23 nt, Human
cacaggugucugccaccacaccc

SEQ ID NO: 857917 - RNA, 18 nt, Human
caccguguuagccaggau

SEQ ID NO: 857918 - RNA, 24 nt, Human
caccguguuagccaggauggucuc

SEQ ID NO: 857919 - RNA, 23 nt, Human
cacugcaagcucugccucccggg

SEQ ID NO: 857920 - RNA, 25 nt, Human
cagccucagccucuguuuucuaaag

SEQ ID NO: 857921 - RNA, 22 nt, Human
cagcugguucuccaacaggucc

SEQ ID NO: 857922 - RNA, 21 nt, Human
caugguaaaguuccugaugcc

SEQ ID NO: 857923 - RNA, 19 nt, Human
cauucagggccccaucgaa

SEQ ID NO: 857924 - RNA, 25 nt, Human
cauuucagggcgggacagccuuugg

SEQ ID NO: 857925 - RNA, 23 nt, Human
ccaaagugcugggauuacaggca

SEQ ID NO: 857926 - RNA, 24 nt, Human
ccaaagugcugggauuacaggcau

SEQ ID NO: 857927 - RNA, 24 nt, Human
ccacaucuguggauugggaaaacc

SEQ ID NO: 857928 - RNA, 18 nt, Human
ccaccgugcccagccuca

SEQ ID NO: 857929 - RNA, 21 nt, Human
ccagcccaccucccacaaccc

SEQ ID NO: 857930 - RNA, 24 nt, Human
cccaaagugcugggauuacaggca

SEQ ID NO: 857931 - RNA, 19 nt, Human
cccaccucccacaaccccu

SEQ ID NO: 857932 - RNA, 21 nt, Human
ccccugcgggagaagccccca

SEQ ID NO: 857933 - RNA, 21 nt, Human
cccggguucacgccauccucc

SEQ ID NO: 857934 - RNA, 23 nt, Human
cccggguucacgccauccuccug

SEQ ID NO: 857935 - RNA, 20 nt, Human
ccgaggagagggcagggggc

SEQ ID NO: 857936 - RNA, 18 nt, Human
ccgcagagggcuacgugc

SEQ ID NO: 857937 - RNA, 18 nt, Human
ccgggguuucaccguguu

SEQ ID NO: 857938 - RNA, 20 nt, Human
ccgggguuucaccguguuag

SEQ ID NO: 857939 - RNA, 24 nt, Human
ccucccacaaccccugcgggagaa

SEQ ID NO: 857940 - RNA, 21 nt, Human
ccugaccucgugaucugccug

SEQ ID NO: 857941 - RNA, 22 nt, Human
ccugccuuggccucccaaagug

SEQ ID NO: 857942 - RNA, 26 nt, Human
ccuggccccugccccgagccgguucc

SEQ ID NO: 857943 - RNA, 24 nt, Human
cgcucuguugcccaggcuggagug

SEQ ID NO: 857944 - RNA, 26 nt, Human
cggcgccagcccaccucccacaaccc

SEQ ID NO: 857945 - RNA, 22 nt, Human
cggcggcgccagcccaccuccc

SEQ ID NO: 857946 - RNA, 23 nt, Human
cgggguuucaccguguuagccag

SEQ ID NO: 857947 - RNA, 24 nt, Human
cgggguuucaccguguuagccagg

SEQ ID NO: 857948 - RNA, 21 nt, Human
cuaauuuuuuguauuuuuuag

SEQ ID NO: 857949 - RNA, 24 nt, Human
cucacugcaagcucugccucccgg

SEQ ID NO: 857950 - RNA, 24 nt, Human
cucccgaauagcugggaccacagg

SEQ ID NO: 857951 - RNA, 24 nt, Human
cuccugaccucgugaucugccugc

SEQ ID NO: 857952 - RNA, 24 nt, Human
cucgcucuguugcccaggcuggag

SEQ ID NO: 857953 - RNA, 22 nt, Human
cugcaggucuccugcuuccuga

SEQ ID NO: 857954 - RNA, 23 nt, Human
cugccucagccucccgaauagcu

SEQ ID NO: 857955 - RNA, 23 nt, Human
cugccuuggccucccaaagugcu

SEQ ID NO: 857956 - RNA, 20 nt, Human
cugguaauauugccccauga

SEQ ID NO: 857957 - RNA, 20 nt, Human
cuugggacccugcuuggcuu

SEQ ID NO: 857958 - RNA, 26 nt, Human
gaagcgccuucucaugguaaaguucc

SEQ ID NO: 857959 - RNA, 26 nt, Human
gaauagcugggaccacaggugucugc

SEQ ID NO: 857960 - RNA, 21 nt, Human
gaccucgugaucugccugccu

SEQ ID NO: 857961 - RNA, 24 nt, Human
gaccucgugaucugccugccuugg

SEQ ID NO: 857962 - RNA, 21 nt, Human
gaggagagggcagggggcugg

SEQ ID NO: 857963 - RNA, 21 nt, Human
gagggcagggggcuggagacg

SEQ ID NO: 857964 - RNA, 18 nt, Human
gauuacaggcaugagcca

SEQ ID NO: 857965 - RNA, 21 nt, Human
gauuacaggcaugagccaccg

SEQ ID NO: 857966 - RNA, 24 nt, Human
gauuacaggcaugagccaccgugc

SEQ ID NO: 857967 - RNA, 21 nt, Human
gcacagagggccugggcuccu

SEQ ID NO: 857968 - RNA, 22 nt, Human
gcacugacaucuuucaggacca

SEQ ID NO: 857969 - RNA, 20 nt, Human
gcccaggcuggagugcagug

SEQ ID NO: 857970 - RNA, 28 nt, Human
gcccccaaggggaggagacgggccuggc

SEQ ID NO: 857971 - RNA, 22 nt, Human
gccuuggccucccaaagugcug

SEQ ID NO: 857972 - RNA, 21 nt, Human
gccuugggacccugcuuggcu

SEQ ID NO: 857973 - RNA, 23 nt, Human
gcgggcacuggcgaucuuggcca

SEQ ID NO: 857974 - RNA, 25 nt, Human
gcucuguugcccaggcuggagugca

SEQ ID NO: 857975 - RNA, 24 nt, Human
ggauggucucaaucuccugaccuc

SEQ ID NO: 857976 - RNA, 24 nt, Human
ggauuacaggcaugagccaccgug

SEQ ID NO: 857977 - RNA, 22 nt, Human
gggagaagcccccaaggggagg

SEQ ID NO: 857978 - RNA, 22 nt, Human
gggcggcacagagggccugggc

SEQ ID NO: 857979 - RNA, 23 nt, Human
gggguuucaccguguuagccagg

SEQ ID NO: 857980 - RNA, 20 nt, Human
gguggcgacagccgcacuga

SEQ ID NO: 857981 - RNA, 19 nt, Human
uaaaguuccugaugccgcc

SEQ ID NO: 857982 - RNA, 24 nt, Human
uaauuuuuuguauuuuuuaguaga

SEQ ID NO: 857983 - RNA, 25 nt, Human
uaauuuuuuguauuuuuuaguagag

SEQ ID NO: 857984 - RNA, 24 nt, Human
uacaggcaugagccaccgugccca

SEQ ID NO: 857985 - RNA, 21 nt, Human
uaguagagccgggguuucacc

SEQ ID NO: 857986 - RNA, 24 nt, Human
uaguagagccgggguuucaccgug

SEQ ID NO: 857987 - RNA, 25 nt, Human
uaguagagccgggguuucaccgugu

SEQ ID NO: 857988 - RNA, 19 nt, Human
uauuugguaaaguauaagg

SEQ ID NO: 857989 - RNA, 24 nt, Human
ucaccguguuagccaggauggucu

SEQ ID NO: 857990 - RNA, 18 nt, Human
ucacugcaagcucugccu

SEQ ID NO: 857991 - RNA, 18 nt, Human
ucacugcaagcucugccu

SEQ ID NO: 857992 - RNA, 24 nt, Human
ucacugcaagcucugccucccggg

SEQ ID NO: 857993 - RNA, 20 nt, Human
ucagccucccgaauagcugg

SEQ ID NO: 857994 - RNA, 24 nt, Human
ucccaaagugcugggauuacaggc

SEQ ID NO: 857995 - RNA, 24 nt, Human
ucccggguucacgccauccuccug

SEQ ID NO: 857996 - RNA, 27 nt, Human
uccuccugccucagccucccgaauagc

SEQ ID NO: 857997 - RNA, 20 nt, Human
uccugauggcacaaggacuc

SEQ ID NO: 857998 - RNA, 24 nt, Human
ucgcucuguugcccaggcuggagu

SEQ ID NO: 857999 - RNA, 23 nt, Human
ucggccuugggacccugcuuggc

SEQ ID NO: 858000 - RNA, 21 nt, Human
ucggcggcgccagcccaccuc

SEQ ID NO: 858001 - RNA, 19 nt, Human
ucucgcucuguugcccagg

SEQ ID NO: 858002 - RNA, 23 nt, Human
ucucgcucuguugcccaggcugg

SEQ ID NO: 858003 - RNA, 24 nt, Human
ucucgcucuguugcccaggcugga

SEQ ID NO: 858004 - RNA, 26 nt, Human
ucucgcucuguugcccaggcuggagu

SEQ ID NO: 858005 - RNA, 27 nt, Human
ucucgcucuguugcccaggcuggagug

SEQ ID NO: 858006 - RNA, 18 nt, Human
ucuguugcccaggcugga

SEQ ID NO: 858007 - RNA, 22 nt, Human
ucuuggcugagaugaccagggc

SEQ ID NO: 858008 - RNA, 19 nt, Human
ugaaaagggguugucucca

SEQ ID NO: 858009 - RNA, 23 nt, Human
ugacgugaaaagggguugucucc

SEQ ID NO: 858010 - RNA, 22 nt, Human
ugagggaacauaaaguauuugg

SEQ ID NO: 858011 - RNA, 23 nt, Human
ugccauggugagggucacacuug

SEQ ID NO: 858012 - RNA, 18 nt, Human
ugcccaggcuggagugca

SEQ ID NO: 858013 - RNA, 21 nt, Human
ugcccaggcuggagugcagug

SEQ ID NO: 858014 - RNA, 24 nt, Human
ugcccaggcuggagugcaguggug

SEQ ID NO: 858015 - RNA, 20 nt, Human
ugcccugcuggacagagguu

SEQ ID NO: 858016 - RNA, 27 nt, Human
ugccucagccucccgaauagcugggac

SEQ ID NO: 858017 - RNA, 22 nt, Human
ugccucccggguucacgccauc

SEQ ID NO: 858018 - RNA, 18 nt, Human
ugccugccuuggccuccc

SEQ ID NO: 858019 - RNA, 18 nt, Human
uggagugcaguggugcaa

SEQ ID NO: 858020 - RNA, 23 nt, Human
uggagugcaguggugcaaucucg

SEQ ID NO: 858021 - RNA, 23 nt, Human
uggcucgaagcgggcacuggcga

SEQ ID NO: 858022 - RNA, 21 nt, Human
ugggaccacaggugucugcca

SEQ ID NO: 858023 - RNA, 24 nt, Human
ugggaccacaggugucugccacca

SEQ ID NO: 858024 - RNA, 18 nt, Human
ugggauuacaggcaugag

SEQ ID NO: 858025 - RNA, 21 nt, Human
ugggauuacaggcaugagcca

SEQ ID NO: 858026 - RNA, 22 nt, Human
ugggauuacaggcaugagccac

SEQ ID NO: 858027 - RNA, 23 nt, Human
ugggauuacaggcaugagccacc

SEQ ID NO: 858028 - RNA, 23 nt, Human
ugggauuacaggcaugagccacc

SEQ ID NO: 858029 - RNA, 24 nt, Human
ugggauuacaggcaugagccaccg

SEQ ID NO: 858030 - RNA, 26 nt, Human
ugggauuacaggcaugagccaccgug

SEQ ID NO: 858031 - RNA, 22 nt, Human
ugguucacugugagggcggcac

SEQ ID NO: 858032 - RNA, 20 nt, Human
ugugcuugcucuugauggug

SEQ ID NO: 858033 - RNA, 21 nt, Human
uguugcccaggcuggagugca

SEQ ID NO: 858034 - RNA, 22 nt, Human
uuaguagagccgggguuucacc

SEQ ID NO: 858035 - RNA, 24 nt, Human
uuaguagagccgggguuucaccgu

SEQ ID NO: 858036 - RNA, 24 nt, Human
uuccugauggcacaaggacuccac

SEQ ID NO: 858037 - RNA, 18 nt, Human
uuggccucccaaagugcu

SEQ ID NO: 858038 - RNA, 22 nt, Human
uugggaaaacccagcucugauu

SEQ ID NO: 858039 - RNA, 19 nt, Human
uuucaccguguuagccagg

SEQ ID NO: 858040 - RNA, 23 nt, Human
uuucuuuuuuuuuuuuuugagau

SEQ ID NO: 858041 - RNA, 20 nt, Human
uuucuuuuuuuuuuuuuugg

SEQ ID NO: 858042 - RNA, 24 nt, Human
uuuuuaguagagccgggguuucac

SEQ ID NO: 858043 - RNA, 20 nt, Human
uuuuuguauuuuuuaguaga

SEQ ID NO: 858044 - RNA, 24 nt, Human
uuuuuuguauuuuuuaguagagcc

SEQ ID NO: 858045 - RNA, 26 nt, Human
uuuuuuuuuuuuugagauguagucuc

SEQ ID NO: 858046 - RNA, 21 nt, Human
acggaacaaaugucagcauua

SEQ ID NO: 858047 - RNA, 19 nt, Human
auucagggccguacuaucc

SEQ ID NO: 858048 - RNA, 20 nt, Human
ccacaaggguuggugcauag

SEQ ID NO: 858049 - RNA, 26 nt, Human
cuaaaguaaaggcaaaauucagggcc

SEQ ID NO: 858050 - RNA, 20 nt, Human
uaaaaugugauacucagcuu

SEQ ID NO: 858051 - RNA, 22 nt, Human
uagguggauagaugcacaaauu

SEQ ID NO: 858052 - RNA, 20 nt, Human
ucuaaaaugugauacucagc

SEQ ID NO: 858053 - RNA, 21 nt, Human
uugcuagguggauagaugcac

SEQ ID NO: 858054 - RNA, 19 nt, Human
uuucuauacuuguaacagc

SEQ ID NO: 858055 - RNA, 19 nt, Human
uuuuuuuuuuuuuugagga

SEQ ID NO: 858056 - RNA, 21 nt, Human
uuuuuuuuuuuuuuuuugagg

SEQ ID NO: 858057 - RNA, 27 nt, Human
uuuuuuuuuuuuuuuuuuuuuuugggg

SEQ ID NO: 858058 - RNA, 18 nt, Human
aaacuccaaugguacagc

SEQ ID NO: 858059 - RNA, 20 nt, Human
aaacuccaaugguacagccu

SEQ ID NO: 858060 - RNA, 19 nt, Human
auagaggccaaagcuuaaa

SEQ ID NO: 858061 - RNA, 18 nt, Human
caaagcuuaaaacaauuu

SEQ ID NO: 858062 - RNA, 24 nt, Human
caccagagucccugagccugggga

SEQ ID NO: 858063 - RNA, 20 nt, Human
cagcugccaaggcugcgggg

SEQ ID NO: 858064 - RNA, 19 nt, Human
ccauggcagcugccaaggc

SEQ ID NO: 858065 - RNA, 25 nt, Human
ccccaaacuccaaugguacagccuc

SEQ ID NO: 858066 - RNA, 19 nt, Human
cggguccaccacggagcug

SEQ ID NO: 858067 - RNA, 19 nt, Human
cuaucacguuuccuucugg

SEQ ID NO: 858068 - RNA, 24 nt, Human
cuggauagaggccaaagcuuaaaa

SEQ ID NO: 858069 - RNA, 19 nt, Human
cuggauuuggcaccagagu

SEQ ID NO: 858070 - RNA, 23 nt, Human
cuuuucgguagugguguaccggg

SEQ ID NO: 858071 - RNA, 18 nt, Human
gaggaggaggaggacgug

SEQ ID NO: 858072 - RNA, 18 nt, Human
gcaccagagucccugagc

SEQ ID NO: 858073 - RNA, 23 nt, Human
gcagcagagcagaucuuucugga

SEQ ID NO: 858074 - RNA, 19 nt, Human
ggagcuguccauggcagcu

SEQ ID NO: 858075 - RNA, 20 nt, Human
gggcagcagagcagaucuuu

SEQ ID NO: 858076 - RNA, 25 nt, Human
gggcagcagagcagaucuuucugga

SEQ ID NO: 858077 - RNA, 20 nt, Human
gguccaaggcucaaaauccg

SEQ ID NO: 858078 - RNA, 19 nt, Human
uagaggccaaagcuuaaaa

SEQ ID NO: 858079 - RNA, 21 nt, Human
ucauugucagaauaaccugga

SEQ ID NO: 858080 - RNA, 19 nt, Human
uccauggcagcugccaagg

SEQ ID NO: 858081 - RNA, 21 nt, Human
ucgaggacgcugcucagcggg

SEQ ID NO: 858082 - RNA, 23 nt, Human
ucuggagcuguccauggcagcug

SEQ ID NO: 858083 - RNA, 25 nt, Human
ugagaaaccuaaauugccguaagag

SEQ ID NO: 858084 - RNA, 18 nt, Human
ugcucugacaacucccau

SEQ ID NO: 858085 - RNA, 23 nt, Human
uggaggaggaggaggacguggaa

SEQ ID NO: 858086 - RNA, 25 nt, Human
uggcugcaaacauggagaggggguc

SEQ ID NO: 858087 - RNA, 18 nt, Human
uggggaugggcccggggg

SEQ ID NO: 858088 - RNA, 19 nt, Human
uucauugucagaauaaccu

SEQ ID NO: 858089 - RNA, 21 nt, Human
uuuguaguuccuauuccugga

SEQ ID NO: 858090 - RNA, 24 nt, Human
aaaaugcuucaauccuucuuuauc

SEQ ID NO: 858091 - RNA, 23 nt, Human
aaaauucuuccuuauccaugauu

SEQ ID NO: 858092 - RNA, 18 nt, Human
aaacaagaggcaagucag

SEQ ID NO: 858093 - RNA, 25 nt, Human
aaaugggccuuugaugacaaaguuu

SEQ ID NO: 858094 - RNA, 23 nt, Human
aagcuaagccacuggcaccugau

SEQ ID NO: 858095 - RNA, 26 nt, Human
acccuguaauucaagcuaagccacug

SEQ ID NO: 858096 - RNA, 18 nt, Human
accugauucaugacauga

SEQ ID NO: 858097 - RNA, 20 nt, Human
aggggagggaaggggaaaau

SEQ ID NO: 858098 - RNA, 18 nt, Human
ccacuggcaccugauuca

SEQ ID NO: 858099 - RNA, 19 nt, Human
cccaucaguacccauggcu

SEQ ID NO: 858100 - RNA, 19 nt, Human
ccuguaauucaagcuaagc

SEQ ID NO: 858101 - RNA, 23 nt, Human
ccuugcuuuuccaaguccagcug

SEQ ID NO: 858102 - RNA, 18 nt, Human
cuugcuuuuccaagucca

SEQ ID NO: 858103 - RNA, 21 nt, Human
uagaauaaaaagcuaggaaag

SEQ ID NO: 858104 - RNA, 19 nt, Human
ugacaugaagagguucaag

SEQ ID NO: 858105 - RNA, 25 nt, Human
uuacagaaacaagaggcaagucaga

SEQ ID NO: 858106 - RNA, 21 nt, Human
uugaugacaaaguuuaguuuu

SEQ ID NO: 858107 - RNA, 24 nt, Human
uuuaaaaaugcuucaauccuucuu

SEQ ID NO: 858108 - RNA, 18 nt, Human
uuuaaagcauccauaggg

SEQ ID NO: 858109 - RNA, 23 nt, Human
uuuugaaugggcaauaacauuuu

SEQ ID NO: 858110 - RNA, 19 nt, Human
uuuuuuuuuuugaaugggc

SEQ ID NO: 858111 - RNA, 20 nt, Human
uuuuuuuuuuuugaaugggc

SEQ ID NO: 858112 - RNA, 21 nt, Human
uuuuuuuuuuuuuugaauggg

SEQ ID NO: 858113 - RNA, 18 nt, Human
uuuuuuuuuuuuuuuuug

SEQ ID NO: 858114 - RNA, 24 nt, Human
uuuuuuuuuuuuuuuuugaauggg

SEQ ID NO: 858115 - RNA, 22 nt, Human
aacacccaguuccaaggaggca

SEQ ID NO: 858116 - RNA, 21 nt, Human
aaucgauuaacacaaccauga

SEQ ID NO: 858117 - RNA, 24 nt, Human
acacccuggcucggcucuggggac

SEQ ID NO: 858118 - RNA, 18 nt, Human
agaguccccuccaggucu

SEQ ID NO: 858119 - RNA, 23 nt, Human
agccugggggcauacacgcacuc

SEQ ID NO: 858120 - RNA, 22 nt, Human
aggcagggccgagcaggugggg

SEQ ID NO: 858121 - RNA, 21 nt, Human
aggggucagagggugcagauc

SEQ ID NO: 858122 - RNA, 24 nt, Human
agucccauuccucucacaguccag

SEQ ID NO: 858123 - RNA, 18 nt, Human
auaaagccucauucagga

SEQ ID NO: 858124 - RNA, 21 nt, Human
caacacccaguuccaaggagg

SEQ ID NO: 858125 - RNA, 23 nt, Human
cacaguccaggauauggucaccc

SEQ ID NO: 858126 - RNA, 21 nt, Human
cacauggccucagcugucacc

SEQ ID NO: 858127 - RNA, 21 nt, Human
cacccaguuccaaggaggcac

SEQ ID NO: 858128 - RNA, 20 nt, Human
caccucucugccucuggcuc

SEQ ID NO: 858129 - RNA, 24 nt, Human
cagagaggaaguuccauggacacc

SEQ ID NO: 858130 - RNA, 20 nt, Human
cagccagagauaaagccuca

SEQ ID NO: 858131 - RNA, 26 nt, Human
cauccccacaaucgauuaacacaacc

SEQ ID NO: 858132 - RNA, 18 nt, Human
caucccggcuggcugagg

SEQ ID NO: 858133 - RNA, 18 nt, Human
ccugagauacagagagga

SEQ ID NO: 858134 - RNA, 19 nt, Human
ccuggagcaccugccaccu

SEQ ID NO: 858135 - RNA, 24 nt, Human
ccuggccagcaguuacucuccuca

SEQ ID NO: 858136 - RNA, 20 nt, Human
cuacugaccugagauacaga

SEQ ID NO: 858137 - RNA, 22 nt, Human
cuacugaccugagauacagaga

SEQ ID NO: 858138 - RNA, 19 nt, Human
cuccaggucugucucauug

SEQ ID NO: 858139 - RNA, 20 nt, Human
cucugccucuggcucucuca

SEQ ID NO: 858140 - RNA, 23 nt, Human
cugaggccgcugugagaagaagg

SEQ ID NO: 858141 - RNA, 19 nt, Human
gacaaugacaacggcagcc

SEQ ID NO: 858142 - RNA, 18 nt, Human
gagaagaaggacggcucu

SEQ ID NO: 858143 - RNA, 18 nt, Human
gcagaucacagccuggag

SEQ ID NO: 858144 - RNA, 21 nt, Human
ggagaguccccuccaggucug

SEQ ID NO: 858145 - RNA, 19 nt, Human
ggaggcacacauuaaccuu

SEQ ID NO: 858146 - RNA, 19 nt, Human
ggcauacacgcacucaugu

SEQ ID NO: 858147 - RNA, 22 nt, Human
ggcauacacgcacucaugugua

SEQ ID NO: 858148 - RNA, 21 nt, Human
gugagaagaaggacggcucug

SEQ ID NO: 858149 - RNA, 23 nt, Human
uacacgcacucauguguacucaa

SEQ ID NO: 858150 - RNA, 25 nt, Human
uaggaggucaaugucaggggucaga

SEQ ID NO: 858151 - RNA, 19 nt, Human
ucaccucucugccucuggc

SEQ ID NO: 858152 - RNA, 26 nt, Human
ucaccucucugccucuggcucucuca

SEQ ID NO: 858153 - RNA, 19 nt, Human
ucauucaggauccuacuca

SEQ ID NO: 858154 - RNA, 23 nt, Human
ucauucaggauccuacucacaug

SEQ ID NO: 858155 - RNA, 25 nt, Human
uccauacacaaugacauuucauccc

SEQ ID NO: 858156 - RNA, 24 nt, Human
uccauggacaccaacacccaguuc

SEQ ID NO: 858157 - RNA, 23 nt, Human
uccccuccaggucugucucauug

SEQ ID NO: 858158 - RNA, 19 nt, Human
uccucgggaggaggagaag

SEQ ID NO: 858159 - RNA, 23 nt, Human
uccucgggaggaggagaagccug

SEQ ID NO: 858160 - RNA, 20 nt, Human
ucgggaggaggagaagccug

SEQ ID NO: 858161 - RNA, 26 nt, Human
ucgggaggaggagaagccuggaugug

SEQ ID NO: 858162 - RNA, 20 nt, Human
ucuggcucucucagucgcug

SEQ ID NO: 858163 - RNA, 18 nt, Human
ugagcaggcacuggugca

SEQ ID NO: 858164 - RNA, 23 nt, Human
ugaggccgcugugagaagaagga

SEQ ID NO: 858165 - RNA, 19 nt, Human
ugcgccuacugaccugaga

SEQ ID NO: 858166 - RNA, 22 nt, Human
ugcgccuacugaccugagauac

SEQ ID NO: 858167 - RNA, 23 nt, Human
uggccagcaguuacucuccucaa

SEQ ID NO: 858168 - RNA, 18 nt, Human
uggcugagggagcuggug

SEQ ID NO: 858169 - RNA, 18 nt, Human
ugggacgaacagccagag

SEQ ID NO: 858170 - RNA, 30 nt, Human
ugggcuuuuaaucacacgccaugcaauccu

SEQ ID NO: 858171 - RNA, 21 nt, Human
uguguacucaacguucacaug

SEQ ID NO: 858172 - RNA, 23 nt, Human
uguguacucaacguucacaugca

SEQ ID NO: 858173 - RNA, 25 nt, Human
uuaacacaaccaugauagccaugaa

SEQ ID NO: 858174 - RNA, 21 nt, Human
uuggaugugaggggucuugga

SEQ ID NO: 858175 - RNA, 23 nt, Human
uuuuuuuuuuggagacaaugaca

SEQ ID NO: 858176 - RNA, 18 nt, Human
uuuuuuuuuuuuuuuuug

SEQ ID NO: 858177 - RNA, 22 nt, Human
aagccagcaacccgcaguccug

SEQ ID NO: 858178 - RNA, 18 nt, Human
accucaggggcagagucu

SEQ ID NO: 858179 - RNA, 23 nt, Human
agcacuggguggaucugacugcc

SEQ ID NO: 858180 - RNA, 23 nt, Human
aggggaccuagaugggcaggcag

SEQ ID NO: 858181 - RNA, 21 nt, Human
caagccagcaacccgcagucc

SEQ ID NO: 858182 - RNA, 25 nt, Human
caagccagcaacccgcaguccuggg

SEQ ID NO: 858183 - RNA, 20 nt, Human
cacagagaaaaguugguucc

SEQ ID NO: 858184 - RNA, 26 nt, Human
ccacaugggugcccccagccucuccc

SEQ ID NO: 858185 - RNA, 18 nt, Human
ccaucagaggcugguguc

SEQ ID NO: 858186 - RNA, 21 nt, Human
cccagcacccugagcugcagg

SEQ ID NO: 858187 - RNA, 19 nt, Human
cccagccucuccccacaag

SEQ ID NO: 858188 - RNA, 25 nt, Human
cccagccucuccccacaaguccucc

SEQ ID NO: 858189 - RNA, 18 nt, Human
ccccuccuaccgcaucuc

SEQ ID NO: 858190 - RNA, 21 nt, Human
ccgcaagcagggggguggguc

SEQ ID NO: 858191 - RNA, 20 nt, Human
ccugcaccgucuccuuggaa

SEQ ID NO: 858192 - RNA, 19 nt, Human
ccugcgacggggcaccugg

SEQ ID NO: 858193 - RNA, 21 nt, Human
ccugguccgugucccucccuc

SEQ ID NO: 858194 - RNA, 22 nt, Human
cgccccuccuaccgcaucuccg

SEQ ID NO: 858195 - RNA, 22 nt, Human
cuccccacaaguccuccugagc

SEQ ID NO: 858196 - RNA, 25 nt, Human
cuccccacaaguccuccugagccau

SEQ ID NO: 858197 - RNA, 24 nt, Human
cucgccccuccuaccgcaucuccc

SEQ ID NO: 858198 - RNA, 25 nt, Human
cugacugcccagagagggcacugcc

SEQ ID NO: 858199 - RNA, 19 nt, Human
cugguccgugucccucccu

SEQ ID NO: 858200 - RNA, 21 nt, Human
gagccaucagaggcugguguc

SEQ ID NO: 858201 - RNA, 24 nt, Human
gaggcuggugucucgguggcagcu

SEQ ID NO: 858202 - RNA, 19 nt, Human
ggaccuagaugggcaggca

SEQ ID NO: 858203 - RNA, 20 nt, Human
ggagaggggguuguggggcc

SEQ ID NO: 858204 - RNA, 21 nt, Human
ggaucugacugcccagagagg

SEQ ID NO: 858205 - RNA, 19 nt, Human
ggcaccuggcccgggcguc

SEQ ID NO: 858206 - RNA, 19 nt, Human
gggaccuagaugggcaggc

SEQ ID NO: 858207 - RNA, 20 nt, Human
gggcaggcagcccugcaccc

SEQ ID NO: 858208 - RNA, 19 nt, Human
gggcaguguugguggcugc

SEQ ID NO: 858209 - RNA, 22 nt, Human
gggcgucuuugaccuagcucag

SEQ ID NO: 858210 - RNA, 19 nt, Human
ggggaccuagaugggcagg

SEQ ID NO: 858211 - RNA, 23 nt, Human
guccugaggggcccgggccucgg

SEQ ID NO: 858212 - RNA, 24 nt, Human
guuccugguccgugucccucccuc

SEQ ID NO: 858213 - RNA, 24 nt, Human
uagcucagguuccugguccguguc

SEQ ID NO: 858214 - RNA, 20 nt, Human
uccccaaggucacacagcaa

SEQ ID NO: 858215 - RNA, 22 nt, Human
uccccacaaguccuccugagcc

SEQ ID NO: 858216 - RNA, 18 nt, Human
ucccgagccccagcaccc

SEQ ID NO: 858217 - RNA, 24 nt, Human
ucccgagccccagcacccugagcu

SEQ ID NO: 858218 - RNA, 18 nt, Human
uccugguccgugucccuc

SEQ ID NO: 858219 - RNA, 18 nt, Human
ugaaagaaaggagagggg

SEQ ID NO: 858220 - RNA, 19 nt, Human
ugaaagaaaggagaggggg

SEQ ID NO: 858221 - RNA, 21 nt, Human
ugaccuagcucagguuccugg

SEQ ID NO: 858222 - RNA, 20 nt, Human
ugagcugcaggcacagccaa

SEQ ID NO: 858223 - RNA, 19 nt, Human
ugcgacggggcaccuggcc

SEQ ID NO: 858224 - RNA, 21 nt, Human
uggaguccugaggggcccggg

SEQ ID NO: 858225 - RNA, 25 nt, Human
uggcagcgccgaggaaggggcuucc

SEQ ID NO: 858226 - RNA, 23 nt, Human
ugggucccgagccccagcacccu

SEQ ID NO: 858227 - RNA, 18 nt, Human
uggguggaucugacugcc

SEQ ID NO: 858228 - RNA, 22 nt, Human
uggguggaucugacugcccaga

SEQ ID NO: 858229 - RNA, 21 nt, Human
uugguggcugcagcaggcccc

SEQ ID NO: 858230 - RNA, 18 nt, Human
aaacaggaagagucccug

SEQ ID NO: 858231 - RNA, 24 nt, Human
aaacaggaagagucccugggccca

SEQ ID NO: 858232 - RNA, 21 nt, Human
aagcacagaggagccuggggg

SEQ ID NO: 858233 - RNA, 20 nt, Human
aaggcacaucauugccagca

SEQ ID NO: 858234 - RNA, 20 nt, Human
acauugggcaguggaagggu

SEQ ID NO: 858235 - RNA, 21 nt, Human
acccagccuuacccucagccc

SEQ ID NO: 858236 - RNA, 22 nt, Human
accgaggcccccuuggcggcgg

SEQ ID NO: 858237 - RNA, 23 nt, Human
acucucuuaccugugcaaaauga

SEQ ID NO: 858238 - RNA, 19 nt, Human
agaagcagcucacaaggcc

SEQ ID NO: 858239 - RNA, 22 nt, Human
agacaggucacuauccaucccu

SEQ ID NO: 858240 - RNA, 22 nt, Human
agaccaccugaggucuaggucc

SEQ ID NO: 858241 - RNA, 21 nt, Human
agcagcagcaucacuguggga

SEQ ID NO: 858242 - RNA, 18 nt, Human
agcuguaggagggugggc

SEQ ID NO: 858243 - RNA, 20 nt, Human
aggaaggugcugaccuggac

SEQ ID NO: 858244 - RNA, 23 nt, Human
aggcacaucauugccagcaagcu

SEQ ID NO: 858245 - RNA, 22 nt, Human
agggauggacaaggagcacugu

SEQ ID NO: 858246 - RNA, 24 nt, Human
aggguuuuaaccagaacacaaagu

SEQ ID NO: 858247 - RNA, 23 nt, Human
aguaaagcacagaggagccuggg

SEQ ID NO: 858248 - RNA, 21 nt, Human
aucacuaacaccaagagacca

SEQ ID NO: 858249 - RNA, 22 nt, Human
aucauugccagcaagcugaagc

SEQ ID NO: 858250 - RNA, 20 nt, Human
augggcuccugcccacuggg

SEQ ID NO: 858251 - RNA, 21 nt, Human
caagagaccaccugaggucua

SEQ ID NO: 858252 - RNA, 21 nt, Human
caagcccacaguggagacuga

SEQ ID NO: 858253 - RNA, 21 nt, Human
cacagaggagccugggggagc

SEQ ID NO: 858254 - RNA, 22 nt, Human
cacuuuuuccucucuggggucc

SEQ ID NO: 858255 - RNA, 23 nt, Human
cagauggcuccauagaaagcccc

SEQ ID NO: 858256 - RNA, 23 nt, Human
cagcagcaucacugugggagcuu

SEQ ID NO: 858257 - RNA, 21 nt, Human
caggaagagucccugggccca

SEQ ID NO: 858258 - RNA, 26 nt, Human
caggaaggugcugaccuggacgcccg

SEQ ID NO: 858259 - RNA, 19 nt, Human
ccaacccaaaguucugacu

SEQ ID NO: 858260 - RNA, 24 nt, Human
ccacagacaaaaucugcuccaagg

SEQ ID NO: 858261 - RNA, 22 nt, Human
ccaccugaggucuaggucccca

SEQ ID NO: 858262 - RNA, 19 nt, Human
cccacaguggagacugagg

SEQ ID NO: 858263 - RNA, 21 nt, Human
cccacaguggagacugaggcc

SEQ ID NO: 858264 - RNA, 27 nt, Human
cccagccuuacccucagcccacagggc

SEQ ID NO: 858265 - RNA, 22 nt, Human
ccccacuaaccccugucuccac

SEQ ID NO: 858266 - RNA, 19 nt, Human
cccgcaggaccaccugcua

SEQ ID NO: 858267 - RNA, 21 nt, Human
cccugggcccaggccuggccc

SEQ ID NO: 858268 - RNA, 20 nt, Human
cccugguucaguuccagggg

SEQ ID NO: 858269 - RNA, 22 nt, Human
ccgucaggaagcugggcucuug

SEQ ID NO: 858270 - RNA, 20 nt, Human
ccucccagucccagccuugc

SEQ ID NO: 858271 - RNA, 18 nt, Human
ccucugagcuuaguuucc

SEQ ID NO: 858272 - RNA, 24 nt, Human
ccucuuagaagcagcucacaaggc

SEQ ID NO: 858273 - RNA, 24 nt, Human
cuccaagggauggacaaggagcac

SEQ ID NO: 858274 - RNA, 19 nt, Human
cucuauggcuaggagcugc

SEQ ID NO: 858275 - RNA, 19 nt, Human
cugaagcauaccagcagcc

SEQ ID NO: 858276 - RNA, 18 nt, Human
cugaccuggacgcccgca

SEQ ID NO: 858277 - RNA, 18 nt, Human
cugcugagcugcuagcac

SEQ ID NO: 858278 - RNA, 21 nt, Human
cuggacgcccgcaggaccacc

SEQ ID NO: 858279 - RNA, 21 nt, Human
cugggguccuguguccaaaag

SEQ ID NO: 858280 - RNA, 21 nt, Human
cuugaccugcuuuaccuuaac

SEQ ID NO: 858281 - RNA, 24 nt, Human
cuugccuccuucgucuugcaggug

SEQ ID NO: 858282 - RNA, 25 nt, Human
gaccaccugaggucuagguccccaa

SEQ ID NO: 858283 - RNA, 19 nt, Human
gagcugccaaggccucuug

SEQ ID NO: 858284 - RNA, 18 nt, Human
gcaguggaaggguucugg

SEQ ID NO: 858285 - RNA, 27 nt, Human
gccacaaccuagaucucauucccaacc

SEQ ID NO: 858286 - RNA, 18 nt, Human
gcccccuuggcggcggcc

SEQ ID NO: 858287 - RNA, 24 nt, Human
gcggcucugccucccagucccagc

SEQ ID NO: 858288 - RNA, 20 nt, Human
ggaaggguucuggaaaggaa

SEQ ID NO: 858289 - RNA, 20 nt, Human
ggagcagauccuucucuauc

SEQ ID NO: 858290 - RNA, 18 nt, Human
ggagccugggggagcucc

SEQ ID NO: 858291 - RNA, 21 nt, Human
gggcaucccaggucugccucu

SEQ ID NO: 858292 - RNA, 20 nt, Human
gggcccaggccuggcccacg

SEQ ID NO: 858293 - RNA, 19 nt, Human
gguaaacagccucucccca

SEQ ID NO: 858294 - RNA, 20 nt, Human
ggucaguagggaguuccauc

SEQ ID NO: 858295 - RNA, 19 nt, Human
uaaccagaacacaaagugg

SEQ ID NO: 858296 - RNA, 19 nt, Human
uaaccccugucuccacauu

SEQ ID NO: 858297 - RNA, 21 nt, Human
uacccucagcccacagggcca

SEQ ID NO: 858298 - RNA, 21 nt, Human
uacgaccuugggcaagucacu

SEQ ID NO: 858299 - RNA, 24 nt, Human
uagaggcccugcugagcugcuagc

SEQ ID NO: 858300 - RNA, 23 nt, Human
uagcagcagcaucacugugggag

SEQ ID NO: 858301 - RNA, 19 nt, Human
uagccucuuagaagcagcu

SEQ ID NO: 858302 - RNA, 19 nt, Human
uaggagggugggcuguccu

SEQ ID NO: 858303 - RNA, 20 nt, Human
uagguccccaaagcagaugg

SEQ ID NO: 858304 - RNA, 18 nt, Human
uaugaaacaggaagaguc

SEQ ID NO: 858305 - RNA, 18 nt, Human
ucagcccacagggccacc

SEQ ID NO: 858306 - RNA, 23 nt, Human
ucaguagggaguuccaucccaaa

SEQ ID NO: 858307 - RNA, 21 nt, Human
uccaagggauggacaaggagc

SEQ ID NO: 858308 - RNA, 20 nt, Human
uccaggggugcaggcaaugu

SEQ ID NO: 858309 - RNA, 24 nt, Human
uccauagaaagccccacuaacccc

SEQ ID NO: 858310 - RNA, 18 nt, Human
ucccugaagagaaacugg

SEQ ID NO: 858311 - RNA, 21 nt, Human
ucccugaagagaaacugggga

SEQ ID NO: 858312 - RNA, 21 nt, Human
ucccugaagagaaacuggggc

SEQ ID NO: 858313 - RNA, 18 nt, Human
ucccugggcccaggccug

SEQ ID NO: 858314 - RNA, 22 nt, Human
ucccugggcccaggccuggccc

SEQ ID NO: 858315 - RNA, 18 nt, Human
ucccugguucaguuccag

SEQ ID NO: 858316 - RNA, 18 nt, Human
uccuguguccaaaaggcu

SEQ ID NO: 858317 - RNA, 21 nt, Human
ucuaucccugguucaguucca

SEQ ID NO: 858318 - RNA, 24 nt, Human
ucuauggcuaggagcugccaaggc

SEQ ID NO: 858319 - RNA, 25 nt, Human
ucucuuaccugugcaaaaugaagac

SEQ ID NO: 858320 - RNA, 23 nt, Human
ugaagagaaacuggggcauccca

SEQ ID NO: 858321 - RNA, 18 nt, Human
ugacuucuguacaaacuc

SEQ ID NO: 858322 - RNA, 24 nt, Human
ugccaguagcuugcuuacgaccuu

SEQ ID NO: 858323 - RNA, 21 nt, Human
ugcccuuguuaugcuguucug

SEQ ID NO: 858324 - RNA, 23 nt, Human
ugcccuuguuaugcuguucuggu

SEQ ID NO: 858325 - RNA, 19 nt, Human
ugccucugagcuuaguuuc

SEQ ID NO: 858326 - RNA, 18 nt, Human
ugcuuuaugaguuagggg

SEQ ID NO: 858327 - RNA, 18 nt, Human
uggcuaggagcugccaag

SEQ ID NO: 858328 - RNA, 25 nt, Human
ugggcucuugccaugccaguagcuu

SEQ ID NO: 858329 - RNA, 19 nt, Human
ugguaaacagccucucccc

SEQ ID NO: 858330 - RNA, 23 nt, Human
ugucugcaugggcuccugcccac

SEQ ID NO: 858331 - RNA, 19 nt, Human
ugugcaaaaugaagacagg

SEQ ID NO: 858332 - RNA, 24 nt, Human
uuaaccagaacacaaagugguagu

SEQ ID NO: 858333 - RNA, 21 nt, Human
uucccacacuauaugcaggug

SEQ ID NO: 858334 - RNA, 23 nt, Human
uugaccugcuuuaccuuaaccau

SEQ ID NO: 858335 - RNA, 25 nt, Human
aauuuucagaagacuauaacagcuu

SEQ ID NO: 858336 - RNA, 18 nt, Human
cagguuacugaccgccaa

SEQ ID NO: 858337 - RNA, 22 nt, Human
ccaacacagauuaauuacaaga

SEQ ID NO: 858338 - RNA, 21 nt, Human
cgccaaguccauguuccagac

SEQ ID NO: 858339 - RNA, 26 nt, Human
cgccaaguccauguuccagacauucu

SEQ ID NO: 858340 - RNA, 23 nt, Human
cuacuaccacucuaauuuuccua

SEQ ID NO: 858341 - RNA, 18 nt, Human
cucauagugauaauuuuc

SEQ ID NO: 858342 - RNA, 18 nt, Human
gcagcggcggcgcggcag

SEQ ID NO: 858343 - RNA, 21 nt, Human
ggguacagagggugcagcugu

SEQ ID NO: 858344 - RNA, 20 nt, Human
uaaauaagugacuacuacug

SEQ ID NO: 858345 - RNA, 22 nt, Human
uaauuuucagaagacuauaaca

SEQ ID NO: 858346 - RNA, 20 nt, Human
uagcuauccugcagcggcgg

SEQ ID NO: 858347 - RNA, 21 nt, Human
ugaccgccaaguccauguucc

SEQ ID NO: 858348 - RNA, 24 nt, Human
ugcagcggcggcgcggcagccgcg

SEQ ID NO: 858349 - RNA, 21 nt, Human
uuuuucuuguaugaauucuaa

SEQ ID NO: 858350 - RNA, 18 nt, Human
uuuuuuuuuuuuuucuug

SEQ ID NO: 858351 - RNA, 19 nt, Human
uuuuuuuuuuuuuucuugu

SEQ ID NO: 858352 - RNA, 20 nt, Human
acgucugaaaauauuacuac

SEQ ID NO: 858353 - RNA, 19 nt, Human
agauguaugcuucaacaca

SEQ ID NO: 858354 - RNA, 21 nt, Human
caacuagauuauucucucucu

SEQ ID NO: 858355 - RNA, 24 nt, Human
ccagggccgccgccgcugccgccg

SEQ ID NO: 858356 - RNA, 18 nt, Human
ccgccgccgcugccgccg

SEQ ID NO: 858357 - RNA, 18 nt, Human
ccgcugccgccgccaccg

SEQ ID NO: 858358 - RNA, 23 nt, Human
cgccgccgcugccgccgccaccg

SEQ ID NO: 858359 - RNA, 23 nt, Human
gccccaacuagauuauucucucu

SEQ ID NO: 858360 - RNA, 19 nt, Human
gccgccgccgcugccgccg

SEQ ID NO: 858361 - RNA, 18 nt, Human
ggaggcgggggaggugcu

SEQ ID NO: 858362 - RNA, 23 nt, Human
ggaggugcucagucagggaccua

SEQ ID NO: 858363 - RNA, 23 nt, Human
ggcgggggaggugcucagucagg

SEQ ID NO: 858364 - RNA, 18 nt, Human
gggcagggaggcggggga

SEQ ID NO: 858365 - RNA, 18 nt, Human
ggggcagggaggcggggg

SEQ ID NO: 858366 - RNA, 20 nt, Human
uaugcuucaacacacuuauu

SEQ ID NO: 858367 - RNA, 18 nt, Human
ucaagggauaacauaugu

SEQ ID NO: 858368 - RNA, 19 nt, Human
ucaguguuugccccaacua

SEQ ID NO: 858369 - RNA, 19 nt, Human
uccacugcaaaaagaaagu

SEQ ID NO: 858370 - RNA, 22 nt, Human
uucaacacacuuauuggggaaa

SEQ ID NO: 858371 - RNA, 21 nt, Human
uucccauuccccgcaguccag

SEQ ID NO: 858372 - RNA, 21 nt, Human
uuucaaaaaagaaaagggguc

SEQ ID NO: 858373 - RNA, 24 nt, Human
aaauaagaaccgaccaagccaaac

SEQ ID NO: 858374 - RNA, 21 nt, Human
aagacccucagaccuuaaccc

SEQ ID NO: 858375 - RNA, 20 nt, Human
aaguagcagcaaaagggucu

SEQ ID NO: 858376 - RNA, 20 nt, Human
accuggugaucagcgccgug

SEQ ID NO: 858377 - RNA, 22 nt, Human
agaaccgaccaagccaaacacc

SEQ ID NO: 858378 - RNA, 18 nt, Human
cacaagacccucagaccu

SEQ ID NO: 858379 - RNA, 24 nt, Human
cagggcaaggaggaaacuugggca

SEQ ID NO: 858380 - RNA, 20 nt, Human
ccaaacaccuggugaucagc

SEQ ID NO: 858381 - RNA, 18 nt, Human
ccccacaagacccucaga

SEQ ID NO: 858382 - RNA, 21 nt, Human
ccgaccaagccaaacaccuug

SEQ ID NO: 858383 - RNA, 20 nt, Human
cguggccccacaagacccuc

SEQ ID NO: 858384 - RNA, 23 nt, Human
cucagaccuuaacccgccucagc

SEQ ID NO: 858385 - RNA, 22 nt, Human
cuugggcaggagaugauugcuc

SEQ ID NO: 858386 - RNA, 22 nt, Human
gaccuuaacccgccucagcagc

SEQ ID NO: 858387 - RNA, 21 nt, Human
gccguggccccacaagacccu

SEQ ID NO: 858388 - RNA, 19 nt, Human
gggcaaggaggaaacuugg

SEQ ID NO: 858389 - RNA, 23 nt, Human
guagcagcaaaagggucucuccu

SEQ ID NO: 858390 - RNA, 21 nt, Human
uaggucagaacgaaugaagua

SEQ ID NO: 858391 - RNA, 25 nt, Human
ucagggcaaggaggaaacuugggca

SEQ ID NO: 858392 - RNA, 22 nt, Human
ugaucagcgccguggccccaca

SEQ ID NO: 858393 - RNA, 28 nt, Human
uugggcaggagaugauugccggacuucc

SEQ ID NO: 858394 - RNA, 23 nt, Human
uuuuuaugguucuaacuuuuauu

SEQ ID NO: 858395 - RNA, 21 nt, Human
aaaagaaaaagguaucucugg

SEQ ID NO: 858396 - RNA, 19 nt, Human
acuccgaccauagaaagag

SEQ ID NO: 858397 - RNA, 20 nt, Human
agaaagagagagauacagga

SEQ ID NO: 858398 - RNA, 22 nt, Human
cagcaacacauuuuagggcaac

SEQ ID NO: 858399 - RNA, 21 nt, Human
cgcgcgggccgagggaagauu

SEQ ID NO: 858400 - RNA, 20 nt, Human
gcgggccgagggaagauucc

SEQ ID NO: 858401 - RNA, 24 nt, Human
ggcaacaaaguucagaauggauac

SEQ ID NO: 858402 - RNA, 20 nt, Human
uagauccuccaauauuaaaa

SEQ ID NO: 858403 - RNA, 20 nt, Human
ucucggcuggggaaggaccc

SEQ ID NO: 858404 - RNA, 19 nt, Human
ucuuugaaaaaaguuugcu

SEQ ID NO: 858405 - RNA, 24 nt, Human
ugaauggaguaaaaaagggaagau

SEQ ID NO: 858406 - RNA, 23 nt, Human
ugccagcucuguugguucacauu

SEQ ID NO: 858407 - RNA, 22 nt, Human
ugugauaaauuuguuaacuaga

SEQ ID NO: 858408 - RNA, 22 nt, Human
uguucauccaucaagccaacuc

SEQ ID NO: 858409 - RNA, 21 nt, Human
uuagggcaacaaaguucagaa

SEQ ID NO: 858410 - RNA, 23 nt, Human
uugcuaaguagauccuccaauau

SEQ ID NO: 858411 - RNA, 19 nt, Human
uuuaaaguuugguuguggu

SEQ ID NO: 858412 - RNA, 20 nt, Human
uuugcuaaguagauccucca

SEQ ID NO: 858413 - RNA, 21 nt, Human
uuuuuuuuuuuuuuuuuaaag

SEQ ID NO: 858414 - RNA, 21 nt, Human
aaaaaaaaaaguacaguggga

SEQ ID NO: 858415 - RNA, 19 nt, Human
aaauguugaaagcagcaau

SEQ ID NO: 858416 - RNA, 19 nt, Human
aagacaaaagcgauacaga

SEQ ID NO: 858417 - RNA, 19 nt, Human
aagcagcaauaaagacaaa

SEQ ID NO: 858418 - RNA, 22 nt, Human
aagcagcaauaaagacaaaagc

SEQ ID NO: 858419 - RNA, 18 nt, Human
aaggggccugggaggcaa

SEQ ID NO: 858420 - RNA, 23 nt, Human
aaggggccugggaggcaagcuga

SEQ ID NO: 858421 - RNA, 23 nt, Human
aauguugaaagcagcaauaaaga

SEQ ID NO: 858422 - RNA, 19 nt, Human
agaaacucuugcugaauuu

SEQ ID NO: 858423 - RNA, 19 nt, Human
agagagaggaggacucugc

SEQ ID NO: 858424 - RNA, 21 nt, Human
agagcccaucaucccuccgcc

SEQ ID NO: 858425 - RNA, 22 nt, Human
agagcccaucaucccuccgccu

SEQ ID NO: 858426 - RNA, 23 nt, Human
agagcccaucaucccuccgccuu

SEQ ID NO: 858427 - RNA, 21 nt, Human
agcagcaauaaagacaaaagc

SEQ ID NO: 858428 - RNA, 19 nt, Human
agcgauacagaauaaaagc

SEQ ID NO: 858429 - RNA, 19 nt, Human
aggagcuucucggucagcc

SEQ ID NO: 858430 - RNA, 24 nt, Human
agucagaugcuugccgaccccuca

SEQ ID NO: 858431 - RNA, 22 nt, Human
aucaucccuccgccuuucauug

SEQ ID NO: 858432 - RNA, 24 nt, Human
caaaagguacccucaaaccggggc

SEQ ID NO: 858433 - RNA, 24 nt, Human
caaucaccacacuccgaaaauagu

SEQ ID NO: 858434 - RNA, 19 nt, Human
cacacaggccccaaaccug

SEQ ID NO: 858435 - RNA, 26 nt, Human
cacagagagagcccaucaucccuccg

SEQ ID NO: 858436 - RNA, 22 nt, Human
cacaggccccaaaccugacagg

SEQ ID NO: 858437 - RNA, 23 nt, Human
cacgcugucaccaggcuggagug

SEQ ID NO: 858438 - RNA, 20 nt, Human
cacuccccaaagucucuugc

SEQ ID NO: 858439 - RNA, 18 nt, Human
cagagagagcccaucauc

SEQ ID NO: 858440 - RNA, 23 nt, Human
cagcaaaagguacccucaaacau

SEQ ID NO: 858441 - RNA, 26 nt, Human
cagcaauaaagacaaaagcgauacag

SEQ ID NO: 858442 - RNA, 23 nt, Human
cagcgagcuucuccaucuggacc

SEQ ID NO: 858443 - RNA, 24 nt, Human
cagcuuccggggcugccagcuccc

SEQ ID NO: 858444 - RNA, 18 nt, Human
caggggcuuucuccuccu

SEQ ID NO: 858445 - RNA, 20 nt, Human
caucccugucuuuaggcagg

SEQ ID NO: 858446 - RNA, 24 nt, Human
ccagcccugaugguuucccuuccu

SEQ ID NO: 858447 - RNA, 25 nt, Human
cccaaaccugacagggccgagccca

SEQ ID NO: 858448 - RNA, 20 nt, Human
cccucaaacauaaggcccag

SEQ ID NO: 858449 - RNA, 21 nt, Human
cccucucaaaaaaaaaaguac

SEQ ID NO: 858450 - RNA, 22 nt, Human
cccucucaaaaaaaaaaguaca

SEQ ID NO: 858451 - RNA, 21 nt, Human
ccuaacucaaucacucaguga

SEQ ID NO: 858452 - RNA, 19 nt, Human
ccuccuagucgucucucca

SEQ ID NO: 858453 - RNA, 19 nt, Human
ccucucacggggcuggagg

SEQ ID NO: 858454 - RNA, 20 nt, Human
ccugggucagcucccgcccu

SEQ ID NO: 858455 - RNA, 18 nt, Human
ccuuucauugccaucuuc

SEQ ID NO: 858456 - RNA, 27 nt, Human
ccuuucauugccaucuucagcgauucc

SEQ ID NO: 858457 - RNA, 24 nt, Human
cgcuugaauguuaaccucgggagc

SEQ ID NO: 858458 - RNA, 21 nt, Human
cggagcaccuuccaggagcuu

SEQ ID NO: 858459 - RNA, 22 nt, Human
cggagcaccuuccaggagcuuc

SEQ ID NO: 858460 - RNA, 18 nt, Human
cuaaguccacaaggggcc

SEQ ID NO: 858461 - RNA, 19 nt, Human
cucuggcaacacaggggcu

SEQ ID NO: 858462 - RNA, 18 nt, Human
cugaauauucacaacugc

SEQ ID NO: 858463 - RNA, 23 nt, Human
cuggcaacacaggggcuuucucc

SEQ ID NO: 858464 - RNA, 20 nt, Human
cuuccggggcugccagcucc

SEQ ID NO: 858465 - RNA, 18 nt, Human
gaaagcagcaauaaagac

SEQ ID NO: 858466 - RNA, 20 nt, Human
gaccccucagcaaccugucu

SEQ ID NO: 858467 - RNA, 21 nt, Human
gagaaacucaagggacagucc

SEQ ID NO: 858468 - RNA, 25 nt, Human
gcagcaauaaagacaaaagcgauac

SEQ ID NO: 858469 - RNA, 21 nt, Human
gccugagagagaggaggacuc

SEQ ID NO: 858470 - RNA, 18 nt, Human
ggcccugggucagcuccc

SEQ ID NO: 858471 - RNA, 24 nt, Human
ggcggggcucaccauauccagggg

SEQ ID NO: 858472 - RNA, 19 nt, Human
uaacucaaucacucaguga

SEQ ID NO: 858473 - RNA, 23 nt, Human
uaacucaaucacucagugaccaa

SEQ ID NO: 858474 - RNA, 18 nt, Human
uacugagucggaccuguu

SEQ ID NO: 858475 - RNA, 23 nt, Human
ucaaacauaaggcccagaaacuc

SEQ ID NO: 858476 - RNA, 23 nt, Human
ucacgcugucaccaggcuggagu

SEQ ID NO: 858477 - RNA, 18 nt, Human
ucagaacacacauuucag

SEQ ID NO: 858478 - RNA, 25 nt, Human
ucagaacacacauuucagaggacca

SEQ ID NO: 858479 - RNA, 21 nt, Human
ucagcgagcuucuccaucuuu

SEQ ID NO: 858480 - RNA, 18 nt, Human
ucccucucaaaaaaaaaa

SEQ ID NO: 858481 - RNA, 21 nt, Human
ucucacgcugucaccaggcug

SEQ ID NO: 858482 - RNA, 23 nt, Human
ucucacgcugucaccaggcugga

SEQ ID NO: 858483 - RNA, 22 nt, Human
ucuccuccucuucagccucaga

SEQ ID NO: 858484 - RNA, 20 nt, Human
ucucuggcaacacaggggcu

SEQ ID NO: 858485 - RNA, 20 nt, Human
ucuguacucucuggcaacac

SEQ ID NO: 858486 - RNA, 20 nt, Human
ugagagagaggaggacucug

SEQ ID NO: 858487 - RNA, 21 nt, Human
ugagagagaggaggacucugc

SEQ ID NO: 858488 - RNA, 21 nt, Human
ugccggagggacuugaagacu

SEQ ID NO: 858489 - RNA, 20 nt, Human
ugucuugugcaaaaaugauc

SEQ ID NO: 858490 - RNA, 21 nt, Human
uguggacagccaucccugucu

SEQ ID NO: 858491 - RNA, 21 nt, Human
uucaaaguagaaacgcuugaa

SEQ ID NO: 858492 - RNA, 18 nt, Human
uucauugccaucuucagc

SEQ ID NO: 858493 - RNA, 24 nt, Human
uucccuuccuugcugggacacagc

SEQ ID NO: 858494 - RNA, 20 nt, Human
uuccuugcugggacacagcu

SEQ ID NO: 858495 - RNA, 22 nt, Human
uucuccuccucuucagccucag

SEQ ID NO: 858496 - RNA, 22 nt, Human
uugaaagcagcaauaaagacaa

SEQ ID NO: 858497 - RNA, 23 nt, Human
uugcugggacacagcuccuucca

SEQ ID NO: 858498 - RNA, 19 nt, Human
uuuuuuuuuuuuuuugucu

SEQ ID NO: 858499 - RNA, 23 nt, Human
uuuuuuuuuuuuuuuugucucaa

SEQ ID NO: 858500 - RNA, 18 nt, Human
uuuuuuuuuuuuuuuuug

SEQ ID NO: 858501 - RNA, 19 nt, Human
uuuuuuuuuuuuuuuuugu

SEQ ID NO: 858502 - RNA, 24 nt, Human
uuuuuuuuuuuuuuuuuugucuca

SEQ ID NO: 858503 - RNA, 18 nt, Human
aagccacucucugccccc

SEQ ID NO: 858504 - RNA, 19 nt, Human
accacagacagccacagga

SEQ ID NO: 858505 - RNA, 22 nt, Human
acgcaggcugacugaguucacg

SEQ ID NO: 858506 - RNA, 21 nt, Human
agacagccacaggaccccucg

SEQ ID NO: 858507 - RNA, 23 nt, Human
agccacaggaccccucggagaug

SEQ ID NO: 858508 - RNA, 19 nt, Human
aggaagccacucucugccc

SEQ ID NO: 858509 - RNA, 19 nt, Human
cagcagggcucaugugaug

SEQ ID NO: 858510 - RNA, 24 nt, Human
cagcaggggcuggugccagcgaug

SEQ ID NO: 858511 - RNA, 22 nt, Human
ccaaccaccagcagcagaaugu

SEQ ID NO: 858512 - RNA, 19 nt, Human
ccaguggccaugugucucc

SEQ ID NO: 858513 - RNA, 21 nt, Human
cccaaagggcucugccccucu

SEQ ID NO: 858514 - RNA, 22 nt, Human
ccccaaagggcucugccccucu

SEQ ID NO: 858515 - RNA, 21 nt, Human
cccccuccuucaggaagccac

SEQ ID NO: 858516 - RNA, 19 nt, Human
ccccugcagugccugcgcc

SEQ ID NO: 858517 - RNA, 20 nt, Human
cccugcugugugccugcugu

SEQ ID NO: 858518 - RNA, 21 nt, Human
cccugcugugugccugcugug

SEQ ID NO: 858519 - RNA, 20 nt, Human
ccucugggcaccugacuggc

SEQ ID NO: 858520 - RNA, 22 nt, Human
ccucugggcaccugacuggcuu

SEQ ID NO: 858521 - RNA, 19 nt, Human
ccugcgccacugcccccuc

SEQ ID NO: 858522 - RNA, 21 nt, Human
ccuugggccugcccuggcccc

SEQ ID NO: 858523 - RNA, 21 nt, Human
cucccacgcaggcugacugag

SEQ ID NO: 858524 - RNA, 28 nt, Human
cugccccccaaagggcucugccccucug

SEQ ID NO: 858525 - RNA, 25 nt, Human
cuggugccagcgauggccugagguc

SEQ ID NO: 858526 - RNA, 24 nt, Human
cugugugacaccccugcagugccu

SEQ ID NO: 858527 - RNA, 26 nt, Human
cuucaggaagccacucucugcccccc

SEQ ID NO: 858528 - RNA, 20 nt, Human
gccccauuuccaaggccaug

SEQ ID NO: 858529 - RNA, 19 nt, Human
ggcucugccccucugggca

SEQ ID NO: 858530 - RNA, 18 nt, Human
gggcaggacaggccuggc

SEQ ID NO: 858531 - RNA, 21 nt, Human
gggggcaccacucuggugguc

SEQ ID NO: 858532 - RNA, 24 nt, Human
ggguuuccagccccuguuggugcu

SEQ ID NO: 858533 - RNA, 28 nt, Human
ucaguggccaguggccaugugucuccuu

SEQ ID NO: 858534 - RNA, 20 nt, Human
ucaugugaugauggcaagag

SEQ ID NO: 858535 - RNA, 18 nt, Human
ucucugccccccaaaggg

SEQ ID NO: 858536 - RNA, 18 nt, Human
ucugccccccaaagggcu

SEQ ID NO: 858537 - RNA, 21 nt, Human
ucugggggcaccacucuggug

SEQ ID NO: 858538 - RNA, 22 nt, Human
ugaagccaaccaccagcagcag

SEQ ID NO: 858539 - RNA, 18 nt, Human
ugagccccugcugugugc

SEQ ID NO: 858540 - RNA, 27 nt, Human
ugaguucacggcacacaggccaggguu

SEQ ID NO: 858541 - RNA, 18 nt, Human
ugcagcaggggcuggugc

SEQ ID NO: 858542 - RNA, 21 nt, Human
ugccagcgauggccugagguc

SEQ ID NO: 858543 - RNA, 22 nt, Human
ugcccccuccuucaggaagcca

SEQ ID NO: 858544 - RNA, 26 nt, Human
ugccugcgccacugcccccuccuuca

SEQ ID NO: 858545 - RNA, 19 nt, Human
ugcugugugacaccccugc

SEQ ID NO: 858546 - RNA, 20 nt, Human
uggcaucgcagcugugccca

SEQ ID NO: 858547 - RNA, 18 nt, Human
uggccugagguccgcggg

SEQ ID NO: 858548 - RNA, 18 nt, Human
ugugaugauggcaagagu

SEQ ID NO: 858549 - RNA, 23 nt, Human
uuuuucaaguucaacaagcauuu

SEQ ID NO: 858550 - RNA, 18 nt, Human
aaugagaaagagagaaag

SEQ ID NO: 858551 - RNA, 24 nt, Human
acugcagcucauaaagggagcacu

SEQ ID NO: 858552 - RNA, 25 nt, Human
agaaugagaaagagagaaagacuga

SEQ ID NO: 858553 - RNA, 22 nt, Human
auaauugcagcaaacuuuuuuu

SEQ ID NO: 858554 - RNA, 23 nt, Human
cucauucuggaaaaaaaaaaaaa

SEQ ID NO: 858555 - RNA, 24 nt, Human
cuggaaaaaaaaaaaaaaaguuaa

SEQ ID NO: 858556 - RNA, 19 nt, Human
ggcauuaaaggcuagaaca

SEQ ID NO: 858557 - RNA, 18 nt, Human
uagaacaguggugcaaaa

SEQ ID NO: 858558 - RNA, 21 nt, Human
uagcaccagcauuccaaaaaa

SEQ ID NO: 858559 - RNA, 20 nt, Human
uagcagagcacugugaugcu

SEQ ID NO: 858560 - RNA, 23 nt, Human
ucagcagccuguguuuucagccu

SEQ ID NO: 858561 - RNA, 21 nt, Human
ugagaaagagagaaagacuga

SEQ ID NO: 858562 - RNA, 18 nt, Human
ugcaaaaagcuguaggua

SEQ ID NO: 858563 - RNA, 18 nt, Human
uggaaaaaaaaaaaaaaa

SEQ ID NO: 858564 - RNA, 18 nt, Human
uggcugccaaauauaggg

SEQ ID NO: 858565 - RNA, 23 nt, Human
uugcagcaaacuuuuuuuuuggu

SEQ ID NO: 858566 - RNA, 19 nt, Human
uuuggcugccaaauauagg

SEQ ID NO: 858567 - RNA, 19 nt, Human
uuuuugguucugcugcacu

SEQ ID NO: 858568 - RNA, 19 nt, Human
aaacaaccccugaccccaa

SEQ ID NO: 858569 - RNA, 27 nt, Human
aaacaaccccugaccccaaccucccca

SEQ ID NO: 858570 - RNA, 20 nt, Human
aaacccagaagggcugccca

SEQ ID NO: 858571 - RNA, 19 nt, Human
aaagaaacaaccccugacc

SEQ ID NO: 858572 - RNA, 24 nt, Human
aaaguaccuucacucuugcuauua

SEQ ID NO: 858573 - RNA, 24 nt, Human
aacagagugagucuccgucucaaa

SEQ ID NO: 858574 - RNA, 20 nt, Human
aaccccucuucuccaucaag

SEQ ID NO: 858575 - RNA, 19 nt, Human
aaccccugaccccaaccuc

SEQ ID NO: 858576 - RNA, 24 nt, Human
aaccccugaccccaaccuccccaa

SEQ ID NO: 858577 - RNA, 22 nt, Human
aagagggcagacccugcuguca

SEQ ID NO: 858578 - RNA, 23 nt, Human
aagauagacaagacccaguaucc

SEQ ID NO: 858579 - RNA, 19 nt, Human
aagauccugggcaggaacc

SEQ ID NO: 858580 - RNA, 20 nt, Human
aagaugcccacaccccacag

SEQ ID NO: 858581 - RNA, 19 nt, Human
aagcgccgccccagcccuu

SEQ ID NO: 858582 - RNA, 21 nt, Human
acaaccccugaccccaaccuc

SEQ ID NO: 858583 - RNA, 22 nt, Human
acacggcacuggcagacaaagc

SEQ ID NO: 858584 - RNA, 24 nt, Human
acagagugagucuccgucucaaaa

SEQ ID NO: 858585 - RNA, 24 nt, Human
acagcaccucccucuuggccaaag

SEQ ID NO: 858586 - RNA, 23 nt, Human
acccaguauccugugcaaucugg

SEQ ID NO: 858587 - RNA, 19 nt, Human
accuggagggcuguggggg

SEQ ID NO: 858588 - RNA, 20 nt, Human
accuggagggcugugggggc

SEQ ID NO: 858589 - RNA, 21 nt, Human
accuggagggcugugggggcu

SEQ ID NO: 858590 - RNA, 24 nt, Human
acuccagucugggcaacagaguga

SEQ ID NO: 858591 - RNA, 24 nt, Human
acugcacuccagucugggcaacag

SEQ ID NO: 858592 - RNA, 24 nt, Human
acugcacuccagucugggcaacag

SEQ ID NO: 858593 - RNA, 21 nt, Human
acuucauuuccucccacuggu

SEQ ID NO: 858594 - RNA, 26 nt, Human
agaaacaaccccugaccccaaccucc

SEQ ID NO: 858595 - RNA, 18 nt, Human
agaacgggaggcggcggc

SEQ ID NO: 858596 - RNA, 18 nt, Human
agcaauuuggcugggugg

SEQ ID NO: 858597 - RNA, 19 nt, Human
agccagcaggugcuugggg

SEQ ID NO: 858598 - RNA, 23 nt, Human
agccgggcaugguggcaugugcc

SEQ ID NO: 858599 - RNA, 23 nt, Human
agccuggccaacauggcgaagcc

SEQ ID NO: 858600 - RNA, 23 nt, Human
agcuccaccacuguccugagcag

SEQ ID NO: 858601 - RNA, 21 nt, Human
agcuggcccagguaccugcag

SEQ ID NO: 858602 - RNA, 22 nt, Human
aggacuaggggcuccccacacu

SEQ ID NO: 858603 - RNA, 22 nt, Human
aggaucgcuugaacccaggagg

SEQ ID NO: 858604 - RNA, 23 nt, Human
aggcaggaggaucgcuugaaccc

SEQ ID NO: 858605 - RNA, 24 nt, Human
aggcaggaggaucgcuugaaccca

SEQ ID NO: 858606 - RNA, 18 nt, Human
aggcagguggaucaccug

SEQ ID NO: 858607 - RNA, 26 nt, Human
aggcagguggaucaccugagcucagg

SEQ ID NO: 858608 - RNA, 21 nt, Human
aggccgaggcagguggaucac

SEQ ID NO: 858609 - RNA, 20 nt, Human
aggcgcaccaggcuccugcu

SEQ ID NO: 858610 - RNA, 19 nt, Human
aggcggagguuguaguaag

SEQ ID NO: 858611 - RNA, 24 nt, Human
aggcggagguuguaguaagccaag

SEQ ID NO: 858612 - RNA, 21 nt, Human
aggcugccccagcccguugcu

SEQ ID NO: 858613 - RNA, 26 nt, Human
agggcacugucgggacuggacuuccc

SEQ ID NO: 858614 - RNA, 22 nt, Human
agguggaucaccugagcucagg

SEQ ID NO: 858615 - RNA, 22 nt, Human
agguugggugggcagcugcagg

SEQ ID NO: 858616 - RNA, 22 nt, Human
agucaaggcuuggggucuuggg

SEQ ID NO: 858617 - RNA, 22 nt, Human
agucugggcaacagagugaguc

SEQ ID NO: 858618 - RNA, 18 nt, Human
aucaagauagacaagacc

SEQ ID NO: 858619 - RNA, 24 nt, Human
aucgugccacugcacuccagucug

SEQ ID NO: 858620 - RNA, 21 nt, Human
augacccgggcggcgcggggc

SEQ ID NO: 858621 - RNA, 25 nt, Human
augcagcacuuccaggagagagggg

SEQ ID NO: 858622 - RNA, 20 nt, Human
augcuuccagcagccagcag

SEQ ID NO: 858623 - RNA, 25 nt, Human
auuccaaccccagcagccccaagcc

SEQ ID NO: 858624 - RNA, 22 nt, Human
caaagaaacaaccccugacccc

SEQ ID NO: 858625 - RNA, 19 nt, Human
caaagcaaugggcgggggc

SEQ ID NO: 858626 - RNA, 19 nt, Human
caaagcagcugugccaguc

SEQ ID NO: 858627 - RNA, 22 nt, Human
caaccccugaccccaaccuccc

SEQ ID NO: 858628 - RNA, 20 nt, Human
caacuaacagcaccucccuc

SEQ ID NO: 858629 - RNA, 24 nt, Human
caagaucgugccacugcacuccag

SEQ ID NO: 858630 - RNA, 18 nt, Human
caauggagaugagaccag

SEQ ID NO: 858631 - RNA, 23 nt, Human
cacacggcacuggcagacaaagc

SEQ ID NO: 858632 - RNA, 24 nt, Human
cacaggcaguugcacaaagucccc

SEQ ID NO: 858633 - RNA, 26 nt, Human
caccaccugaagaugcccacacccca

SEQ ID NO: 858634 - RNA, 19 nt, Human
caccucccucuuggccaaa

SEQ ID NO: 858635 - RNA, 21 nt, Human
caccugaagaugcccacaccc

SEQ ID NO: 858636 - RNA, 23 nt, Human
caccugaagaugcccacacccca

SEQ ID NO: 858637 - RNA, 21 nt, Human
cacggcacuggcagacaaagc

SEQ ID NO: 858638 - RNA, 22 nt, Human
cacuccagucugggcaacagag

SEQ ID NO: 858639 - RNA, 22 nt, Human
cacuccagucugggcaacagag

SEQ ID NO: 858640 - RNA, 24 nt, Human
cacuccagucugggcaacagagug

SEQ ID NO: 858641 - RNA, 19 nt, Human
cacugcacuccagucuggg

SEQ ID NO: 858642 - RNA, 21 nt, Human
cacugcacuccagucugggca

SEQ ID NO: 858643 - RNA, 22 nt, Human
cacugcacuccagucugggcaa

SEQ ID NO: 858644 - RNA, 23 nt, Human
cacugcacuccagucugggcaac

SEQ ID NO: 858645 - RNA, 24 nt, Human
cacugcacuccagucugggcaaca

SEQ ID NO: 858646 - RNA, 21 nt, Human
cacugucuaaaucacauccca

SEQ ID NO: 858647 - RNA, 20 nt, Human
cagagcccaccucugccccc

SEQ ID NO: 858648 - RNA, 23 nt, Human
cagcaccucccucuuggccaaag

SEQ ID NO: 858649 - RNA, 18 nt, Human
cagcagccagcaggugcu

SEQ ID NO: 858650 - RNA, 20 nt, Human
cagcagccccaagccugggc

SEQ ID NO: 858651 - RNA, 24 nt, Human
cagcagccccaagccugggccagg

SEQ ID NO: 858652 - RNA, 23 nt, Human
cagcaugugaacaggcugggcag

SEQ ID NO: 858653 - RNA, 21 nt, Human
caggacccaggagugcaggga

SEQ ID NO: 858654 - RNA, 22 nt, Human
caggacccaggagugcagggau

SEQ ID NO: 858655 - RNA, 24 nt, Human
caggagagaggggccuggaggggu

SEQ ID NO: 858656 - RNA, 19 nt, Human
caggauuuuggcugguguc

SEQ ID NO: 858657 - RNA, 22 nt, Human
caggauuuuggcuggugucagg

SEQ ID NO: 858658 - RNA, 24 nt, Human
caggcaguugcacaaaguccccgg

SEQ ID NO: 858659 - RNA, 20 nt, Human
caggcucaguccugcggucu

SEQ ID NO: 858660 - RNA, 22 nt, Human
caggcucaguccugcggucugu

SEQ ID NO: 858661 - RNA, 21 nt, Human
caggggucagaugcccuguaa

SEQ ID NO: 858662 - RNA, 21 nt, Human
cagguggaucaccugagcuca

SEQ ID NO: 858663 - RNA, 25 nt, Human
cauccugaaaacuucauuuccuccc

SEQ ID NO: 858664 - RNA, 28 nt, Human
cauccugccucugugacccucccuaggc

SEQ ID NO: 858665 - RNA, 20 nt, Human
cauccuggagcaggccaggc

SEQ ID NO: 858666 - RNA, 19 nt, Human
ccaaccccagcagccccaa

SEQ ID NO: 858667 - RNA, 22 nt, Human
ccaacugucccacauggcuuca

SEQ ID NO: 858668 - RNA, 18 nt, Human
ccacagucccagugguag

SEQ ID NO: 858669 - RNA, 23 nt, Human
ccaccugaagaugcccacacccc

SEQ ID NO: 858670 - RNA, 19 nt, Human
ccaccuggcauuaaggcaa

SEQ ID NO: 858671 - RNA, 20 nt, Human
ccacugcacuccagucuggg

SEQ ID NO: 858672 - RNA, 20 nt, Human
ccacugcacuccagucuggg

SEQ ID NO: 858673 - RNA, 21 nt, Human
ccacugcacuccagucugggc

SEQ ID NO: 858674 - RNA, 23 nt, Human
ccacugcacuccagucugggcaa

SEQ ID NO: 858675 - RNA, 24 nt, Human
ccacugcacuccagucugggcaac

SEQ ID NO: 858676 - RNA, 26 nt, Human
ccagaacaccaccugaagaugcccac

SEQ ID NO: 858677 - RNA, 23 nt, Human
ccagcugccucgucagcugccuc

SEQ ID NO: 858678 - RNA, 23 nt, Human
ccaucaagauagacaagacccag

SEQ ID NO: 858679 - RNA, 18 nt, Human
cccaagcgccgccccagc

SEQ ID NO: 858680 - RNA, 19 nt, Human
cccagagcacugcugccag

SEQ ID NO: 858681 - RNA, 22 nt, Human
cccagagcgggcuacagcuucc

SEQ ID NO: 858682 - RNA, 21 nt, Human
cccauggccccggcccagagc

SEQ ID NO: 858683 - RNA, 18 nt, Human
ccccaaaaaagaggaagg

SEQ ID NO: 858684 - RNA, 21 nt, Human
ccccaagcgccgccccagccc

SEQ ID NO: 858685 - RNA, 21 nt, Human
ccccaagcgccgccccagccc

SEQ ID NO: 858686 - RNA, 22 nt, Human
ccccaagcgccgccccagcccu

SEQ ID NO: 858687 - RNA, 18 nt, Human
ccccacccucucgcccaa

SEQ ID NO: 858688 - RNA, 18 nt, Human
ccccagcagccccaagcc

SEQ ID NO: 858689 - RNA, 19 nt, Human
ccccagcccguugcuuugg

SEQ ID NO: 858690 - RNA, 18 nt, Human
ccccgcccccuccuuagg

SEQ ID NO: 858691 - RNA, 20 nt, Human
ccccgcugccuccgccuccg

SEQ ID NO: 858692 - RNA, 22 nt, Human
ccccuccuuaggccccgcccca

SEQ ID NO: 858693 - RNA, 18 nt, Human
ccccugaccccaaccucc

SEQ ID NO: 858694 - RNA, 18 nt, Human
cccgcccccuccuuaggc

SEQ ID NO: 858695 - RNA, 22 nt, Human
cccgggcucgagcggcggcccc

SEQ ID NO: 858696 - RNA, 23 nt, Human
cccguggcuagaaugaacaaagc

SEQ ID NO: 858697 - RNA, 20 nt, Human
cccuccuaaacagagcccac

SEQ ID NO: 858698 - RNA, 21 nt, Human
cccuccuaaacagagcccacc

SEQ ID NO: 858699 - RNA, 20 nt, Human
cccucuggggcuagggcagc

SEQ ID NO: 858700 - RNA, 22 nt, Human
ccuaggcagaugagucuugaga

SEQ ID NO: 858701 - RNA, 22 nt, Human
ccugaccccaaccuccccaaaa

SEQ ID NO: 858702 - RNA, 19 nt, Human
ccugagcagacucccaaga

SEQ ID NO: 858703 - RNA, 21 nt, Human
ccugcagcaccauccuggagc

SEQ ID NO: 858704 - RNA, 18 nt, Human
ccuggagcaggccaggcc

SEQ ID NO: 858705 - RNA, 21 nt, Human
ccuggccaacauggcgaagcc

SEQ ID NO: 858706 - RNA, 23 nt, Human
ccuggccaacauggcgaagccug

SEQ ID NO: 858707 - RNA, 20 nt, Human
ccugggcaggaaccccucuu

SEQ ID NO: 858708 - RNA, 23 nt, Human
ccuggucucuacuaaaaauacaa

SEQ ID NO: 858709 - RNA, 21 nt, Human
cgagaccagccuggccaacau

SEQ ID NO: 858710 - RNA, 19 nt, Human
cgagagcccuccaucugac

SEQ ID NO: 858711 - RNA, 26 nt, Human
cgaggcagguggaucaccugagcuca

SEQ ID NO: 858712 - RNA, 21 nt, Human
cgccccaagcgccgccccagc

SEQ ID NO: 858713 - RNA, 20 nt, Human
cggcccagagcgggcuacag

SEQ ID NO: 858714 - RNA, 22 nt, Human
cggcugggccgccccaagcgcc

SEQ ID NO: 858715 - RNA, 18 nt, Human
cggcuggggcgggagggc

SEQ ID NO: 858716 - RNA, 19 nt, Human
cgggaggcggcggcugggc

SEQ ID NO: 858717 - RNA, 23 nt, Human
cgggcacaggcaguugcacaaag

SEQ ID NO: 858718 - RNA, 22 nt, Human
cggugcgugucgaguuccuucu

SEQ ID NO: 858719 - RNA, 22 nt, Human
cuaaacagagcccaccucugcc

SEQ ID NO: 858720 - RNA, 18 nt, Human
cuaugcugucuccagaca

SEQ ID NO: 858721 - RNA, 22 nt, Human
cuccaggcucaguccugcgguc

SEQ ID NO: 858722 - RNA, 27 nt, Human
cuccgucucaaaaaaaaaaaaaaaaau

SEQ ID NO: 858723 - RNA, 24 nt, Human
cucucaaacucacugucguccagc

SEQ ID NO: 858724 - RNA, 19 nt, Human
cugaagaugcccacacccc

SEQ ID NO: 858725 - RNA, 22 nt, Human
cuggcagacaaagcagcugugc

SEQ ID NO: 858726 - RNA, 25 nt, Human
cugggguggggaugggguccgaggg

SEQ ID NO: 858727 - RNA, 22 nt, Human
cuuaaaggacuaggggcucccc

SEQ ID NO: 858728 - RNA, 22 nt, Human
gagaagcaauuuggcugggugg

SEQ ID NO: 858729 - RNA, 19 nt, Human
gagaagccauccucuggga

SEQ ID NO: 858730 - RNA, 19 nt, Human
gaggcagguggaucaccug

SEQ ID NO: 858731 - RNA, 23 nt, Human
gagguuguaguaagccaagaucg

SEQ ID NO: 858732 - RNA, 24 nt, Human
gaucaccugagcucagggguucga

SEQ ID NO: 858733 - RNA, 24 nt, Human
gaucgcuugaacccaggaggcgga

SEQ ID NO: 858734 - RNA, 25 nt, Human
gcaauggagaugagaccagucuaga

SEQ ID NO: 858735 - RNA, 24 nt, Human
gcacuccagucugggcaacagagu

SEQ ID NO: 858736 - RNA, 22 nt, Human
gcaggaggaucgcuugaaccca

SEQ ID NO: 858737 - RNA, 22 nt, Human
gcaugugccuguagucccagcu

SEQ ID NO: 858738 - RNA, 20 nt, Human
gcauuggaagagcaggaccc

SEQ ID NO: 858739 - RNA, 24 nt, Human
gccaacauggcgaagccuggucuc

SEQ ID NO: 858740 - RNA, 20 nt, Human
gccaagaucgugccacugca

SEQ ID NO: 858741 - RNA, 22 nt, Human
gccacugcacuccagucugggc

SEQ ID NO: 858742 - RNA, 24 nt, Human
gccacugcacuccagucugggcaa

SEQ ID NO: 858743 - RNA, 20 nt, Human
gccagcugccucgucagcug

SEQ ID NO: 858744 - RNA, 23 nt, Human
gccccaagcgccgccccagcccu

SEQ ID NO: 858745 - RNA, 18 nt, Human
gccccacccucucgccca

SEQ ID NO: 858746 - RNA, 20 nt, Human
gccccagcccguugcuuugg

SEQ ID NO: 858747 - RNA, 23 nt, Human
gcgggcccggcugggguggggau

SEQ ID NO: 858748 - RNA, 20 nt, Human
gcuacagcuuccgcuucggc

SEQ ID NO: 858749 - RNA, 20 nt, Human
gcuccuggucagcugcagcu

SEQ ID NO: 858750 - RNA, 19 nt, Human
gcuuccagcagccagcagg

SEQ ID NO: 858751 - RNA, 24 nt, Human
ggagguuguaguaagccaagaucg

SEQ ID NO: 858752 - RNA, 23 nt, Human
ggccaccuggcauuaaggcaaug

SEQ ID NO: 858753 - RNA, 20 nt, Human
ggcucaaaggcaacaagggc

SEQ ID NO: 858754 - RNA, 24 nt, Human
ggcucaaaggcaacaagggcacug

SEQ ID NO: 858755 - RNA, 22 nt, Human
ggcucaguccugcggucugugg

SEQ ID NO: 858756 - RNA, 18 nt, Human
ggcuggacugaggugcug

SEQ ID NO: 858757 - RNA, 21 nt, Human
gggcacaggggcauaugcagc

SEQ ID NO: 858758 - RNA, 20 nt, Human
gggcagcuuucucauucauc

SEQ ID NO: 858759 - RNA, 20 nt, Human
gggcugaggcaggaggaucg

SEQ ID NO: 858760 - RNA, 24 nt, Human
gggcugaggcaggaggaucgcuug

SEQ ID NO: 858761 - RNA, 18 nt, Human
gggggcugaggcaggagg

SEQ ID NO: 858762 - RNA, 24 nt, Human
gggguaugcuuccagcagccagca

SEQ ID NO: 858763 - RNA, 18 nt, Human
ggugaaggggcagguacu

SEQ ID NO: 858764 - RNA, 18 nt, Human
ggugucaugugcuguggg

SEQ ID NO: 858765 - RNA, 19 nt, Human
gguugggugggcagcugca

SEQ ID NO: 858766 - RNA, 23 nt, Human
gucaggaggccuccugggugcag

SEQ ID NO: 858767 - RNA, 26 nt, Human
gucaggauuuuggcuggugucaggag

SEQ ID NO: 858768 - RNA, 20 nt, Human
guccaggcucucuggcucca

SEQ ID NO: 858769 - RNA, 19 nt, Human
gugguaucaucaaccacug

SEQ ID NO: 858770 - RNA, 23 nt, Human
uaaaaucucugcaaugcaaaaga

SEQ ID NO: 858771 - RNA, 24 nt, Human
uaacaauuuuaccagaacaccacc

SEQ ID NO: 858772 - RNA, 21 nt, Human
uaacagcaccucccucuuggc

SEQ ID NO: 858773 - RNA, 18 nt, Human
uaacuuguggcaugcccu

SEQ ID NO: 858774 - RNA, 24 nt, Human
uaccccucaaaaaugaaaacuuaa

SEQ ID NO: 858775 - RNA, 25 nt, Human
uacuugcuguguuguaagauccugg

SEQ ID NO: 858776 - RNA, 19 nt, Human
ucaaaaaaaaaaaaaaaaa

SEQ ID NO: 858777 - RNA, 19 nt, Human
ucaaagaaacaaccccuga

SEQ ID NO: 858778 - RNA, 18 nt, Human
ucaaaggcaacaagggca

SEQ ID NO: 858779 - RNA, 18 nt, Human
ucaagacccagcuccacc

SEQ ID NO: 858780 - RNA, 20 nt, Human
ucaagacccagcuccaccac

SEQ ID NO: 858781 - RNA, 18 nt, Human
uccagcagccagcaggug

SEQ ID NO: 858782 - RNA, 19 nt, Human
uccaggagagaggggccug

SEQ ID NO: 858783 - RNA, 18 nt, Human
uccaugaaggccacuccc

SEQ ID NO: 858784 - RNA, 24 nt, Human
ucccacuuugggaggccgaggcag

SEQ ID NO: 858785 - RNA, 18 nt, Human
ucccagagcacugcugcc

SEQ ID NO: 858786 - RNA, 18 nt, Human
ucccagugguagagcugc

SEQ ID NO: 858787 - RNA, 18 nt, Human
uccccaaaaaagaggaag

SEQ ID NO: 858788 - RNA, 19 nt, Human
uccccaaaaaagaggaagg

SEQ ID NO: 858789 - RNA, 26 nt, Human
uccccagccucuugauuuaagucugc

SEQ ID NO: 858790 - RNA, 21 nt, Human
ucccuaggcagaugagucuug

SEQ ID NO: 858791 - RNA, 23 nt, Human
uccuggagcaggccaggccacag

SEQ ID NO: 858792 - RNA, 19 nt, Human
uccuuaggccccgccccaa

SEQ ID NO: 858793 - RNA, 24 nt, Human
uccuuaggccccgccccucgggag

SEQ ID NO: 858794 - RNA, 24 nt, Human
uccuucauacagcuauucuaacaa

SEQ ID NO: 858795 - RNA, 24 nt, Human
ucgcuugaacccaggaggcggagg

SEQ ID NO: 858796 - RNA, 23 nt, Human
ucgugccacugcacuccagucug

SEQ ID NO: 858797 - RNA, 21 nt, Human
ucuaaaucacaucccaccauc

SEQ ID NO: 858798 - RNA, 19 nt, Human
ucuccagcggccagggcuc

SEQ ID NO: 858799 - RNA, 18 nt, Human
ucuccaggcucaguccug

SEQ ID NO: 858800 - RNA, 23 nt, Human
ucuccgccaccgccgccgcugcg

SEQ ID NO: 858801 - RNA, 24 nt, Human
ucuccgccaccgccgccgcugcgg

SEQ ID NO: 858802 - RNA, 25 nt, Human
ucuccgucucaaaaaaaaaaaaaaa

SEQ ID NO: 858803 - RNA, 22 nt, Human
ucucuacuaaaaauacaaaaaa

SEQ ID NO: 858804 - RNA, 22 nt, Human
ucucugaaacccagaagggcug

SEQ ID NO: 858805 - RNA, 24 nt, Human
ucucugcaaugcaaaagaucccuu

SEQ ID NO: 858806 - RNA, 21 nt, Human
ucuuggccaaaggcuuugucu

SEQ ID NO: 858807 - RNA, 21 nt, Human
ugaaaacuucauuuccuccca

SEQ ID NO: 858808 - RNA, 23 nt, Human
ugaaaaugacccauuucccacuu

SEQ ID NO: 858809 - RNA, 26 nt, Human
ugaacaaagcccaacugucccacaug

SEQ ID NO: 858810 - RNA, 19 nt, Human
ugacccgggcggcgcgggg

SEQ ID NO: 858811 - RNA, 19 nt, Human
ugacccgggcggcgcgggg

SEQ ID NO: 858812 - RNA, 20 nt, Human
ugaccuuuaacuuguggcau

SEQ ID NO: 858813 - RNA, 22 nt, Human
ugagaagcaauuuggcugggug

SEQ ID NO: 858814 - RNA, 19 nt, Human
ugagaagccauccucuggg

SEQ ID NO: 858815 - RNA, 19 nt, Human
ugagaauggcucauuacaa

SEQ ID NO: 858816 - RNA, 19 nt, Human
ugagcuggcuaacugcccu

SEQ ID NO: 858817 - RNA, 24 nt, Human
ugaggcaggaggaucgcuugaacc

SEQ ID NO: 858818 - RNA, 25 nt, Human
ugaggcaggaggaucgcuugaaccc

SEQ ID NO: 858819 - RNA, 24 nt, Human
ugccacugcacuccagucugggca

SEQ ID NO: 858820 - RNA, 18 nt, Human
ugcccuguaaugagccac

SEQ ID NO: 858821 - RNA, 26 nt, Human
ugccuccgccuccguccucaugaccc

SEQ ID NO: 858822 - RNA, 23 nt, Human
ugccuguagucccagcuaguggg

SEQ ID NO: 858823 - RNA, 19 nt, Human
ugcuggguggcagggguca

SEQ ID NO: 858824 - RNA, 20 nt, Human
ugcugugcugguccccagca

SEQ ID NO: 858825 - RNA, 22 nt, Human
uggaagagcaggacccaggagu

SEQ ID NO: 858826 - RNA, 24 nt, Human
uggagggguccucagcccuggggg

SEQ ID NO: 858827 - RNA, 24 nt, Human
uggaucaccugagcucagggguuc

SEQ ID NO: 858828 - RNA, 21 nt, Human
uggcaggggucagaugcccug

SEQ ID NO: 858829 - RNA, 18 nt, Human
uggcccagguaccugcag

SEQ ID NO: 858830 - RNA, 23 nt, Human
uggcccagguaccugcagcacca

SEQ ID NO: 858831 - RNA, 22 nt, Human
uggcuagaaugaacaaagccca

SEQ ID NO: 858832 - RNA, 18 nt, Human
uggcuggacugaggugcu

SEQ ID NO: 858833 - RNA, 23 nt, Human
uggcuggguggucucacugcccu

SEQ ID NO: 858834 - RNA, 24 nt, Human
ugggaggccgaggcagguggauca

SEQ ID NO: 858835 - RNA, 20 nt, Human
ugggcagcugucggugucau

SEQ ID NO: 858836 - RNA, 24 nt, Human
ugggccagcugccucgucagcugc

SEQ ID NO: 858837 - RNA, 23 nt, Human
uggggggcugaggcaggaggauc

SEQ ID NO: 858838 - RNA, 23 nt, Human
uggggucagcuaugcugucucca

SEQ ID NO: 858839 - RNA, 23 nt, Human
uggguaggcagguggugguggua

SEQ ID NO: 858840 - RNA, 19 nt, Human
uggucagcugcagcuucug

SEQ ID NO: 858841 - RNA, 20 nt, Human
uggucagcugcagcuucugc

SEQ ID NO: 858842 - RNA, 24 nt, Human
ugguggcaugugccuguaguccca

SEQ ID NO: 858843 - RNA, 19 nt, Human
uggugguaucaucaaccac

SEQ ID NO: 858844 - RNA, 26 nt, Human
uguaaugagccacagaaacuugggcc

SEQ ID NO: 858845 - RNA, 19 nt, Human
ugugaacaggcugggcagc

SEQ ID NO: 858846 - RNA, 18 nt, Human
ugugaagaccagguuggg

SEQ ID NO: 858847 - RNA, 20 nt, Human
ugugcaagaaugcaacacag

SEQ ID NO: 858848 - RNA, 18 nt, Human
uuagagguccccagccuc

SEQ ID NO: 858849 - RNA, 19 nt, Human
uuagagguccccagccucu

SEQ ID NO: 858850 - RNA, 24 nt, Human
uuagccgggcaugguggcaugugc

SEQ ID NO: 858851 - RNA, 18 nt, Human
uucuccgccaccgccgcc

SEQ ID NO: 858852 - RNA, 23 nt, Human
uucuccgccaccgccgccgcugc

SEQ ID NO: 858853 - RNA, 24 nt, Human
uugaacccaggaggcggagguugu

SEQ ID NO: 858854 - RNA, 25 nt, Human
uugggaggccgaggcagguggauca

SEQ ID NO: 858855 - RNA, 22 nt, Human
uuguaguaagccaagaucgugc

SEQ ID NO: 858856 - RNA, 27 nt, Human
aaaaaaagagcuacaauggaacaaaaa

SEQ ID NO: 858857 - RNA, 25 nt, Human
aaaaaagagcuacaauggaacaaaa

SEQ ID NO: 858858 - RNA, 24 nt, Human
aaaaacaaaaacaaaaaaaaagga

SEQ ID NO: 858859 - RNA, 23 nt, Human
aaaaacaaaaacaaaaacaaaaa

SEQ ID NO: 858860 - RNA, 26 nt, Human
aaaaagaaaagcauaauuaccacaaa

SEQ ID NO: 858861 - RNA, 20 nt, Human
aaaaagcuccccuaccaacc

SEQ ID NO: 858862 - RNA, 24 nt, Human
aaaaagcuccccuaccaaccacca

SEQ ID NO: 858863 - RNA, 23 nt, Human
aaaacaaaaacaaaaaaaaagga

SEQ ID NO: 858864 - RNA, 22 nt, Human
aaaacaaaaacaaaaacaaaaa

SEQ ID NO: 858865 - RNA, 24 nt, Human
aaaacaaaaacaaaaacaaaaaaa

SEQ ID NO: 858866 - RNA, 18 nt, Human
aaaacaacccucacccuc

SEQ ID NO: 858867 - RNA, 26 nt, Human
aaacaaaaacaaaaacaaaaaaaaag

SEQ ID NO: 858868 - RNA, 25 nt, Human
aaacaaaaacaaaaacaaaaacaaa

SEQ ID NO: 858869 - RNA, 19 nt, Human
aaacaacccucacccuccg

SEQ ID NO: 858870 - RNA, 21 nt, Human
aaagaaaagcauaauuaccac

SEQ ID NO: 858871 - RNA, 18 nt, Human
aaaggaaaggagaagggg

SEQ ID NO: 858872 - RNA, 27 nt, Human
aacaaaaacaaaaacaaaaaaaaagga

SEQ ID NO: 858873 - RNA, 23 nt, Human
aacagggcugaggcacacagacc

SEQ ID NO: 858874 - RNA, 23 nt, Human
aaccugccccuuaacagggcugg

SEQ ID NO: 858875 - RNA, 21 nt, Human
aaccuuugggcccaacagagg

SEQ ID NO: 858876 - RNA, 26 nt, Human
aacuccauguugcccagaucccacug

SEQ ID NO: 858877 - RNA, 23 nt, Human
aagagcuacaauggaacaaaaca

SEQ ID NO: 858878 - RNA, 19 nt, Human
aagcaacaggacaaugaac

SEQ ID NO: 858879 - RNA, 22 nt, Human
aagcagauacucucaauaauau

SEQ ID NO: 858880 - RNA, 22 nt, Human
aagcagucaguggcugaagaaa

SEQ ID NO: 858881 - RNA, 22 nt, Human
aagcauaauuaccacaaauuac

SEQ ID NO: 858882 - RNA, 21 nt, Human
aaggugcccaagguaaagggc

SEQ ID NO: 858883 - RNA, 24 nt, Human
aaggugcccaagguaaagggcaag

SEQ ID NO: 858884 - RNA, 24 nt, Human
acaaaaacaaaaaaaaaggaaaga

SEQ ID NO: 858885 - RNA, 25 nt, Human
acaaaaacaaaaacaaaaacaaaaa

SEQ ID NO: 858886 - RNA, 25 nt, Human
acagagccucccugaggucucaaag

SEQ ID NO: 858887 - RNA, 19 nt, Human
acagcagggauaucuuggg

SEQ ID NO: 858888 - RNA, 23 nt, Human
accaaaaacaaaaacaaaaacaa

SEQ ID NO: 858889 - RNA, 19 nt, Human
acucuggggugugaggaga

SEQ ID NO: 858890 - RNA, 21 nt, Human
acucuggggugugaggagaug

SEQ ID NO: 858891 - RNA, 23 nt, Human
agagaaaccugccccuuaacagg

SEQ ID NO: 858892 - RNA, 20 nt, Human
agagacagagccucccugag

SEQ ID NO: 858893 - RNA, 18 nt, Human
agagauagauggcuugca

SEQ ID NO: 858894 - RNA, 20 nt, Human
agcagagaccagacgcucau

SEQ ID NO: 858895 - RNA, 24 nt, Human
agcccuugucagccugggauacug

SEQ ID NO: 858896 - RNA, 19 nt, Human
aggaagagggcuaaagaga

SEQ ID NO: 858897 - RNA, 22 nt, Human
aggaagagggcuaaagagaaac

SEQ ID NO: 858898 - RNA, 20 nt, Human
aggagaaggggguccaggaa

SEQ ID NO: 858899 - RNA, 18 nt, Human
aggauuccccccagcccc

SEQ ID NO: 858900 - RNA, 19 nt, Human
aggcaacagcaagcagagc

SEQ ID NO: 858901 - RNA, 18 nt, Human
aggcacacagaccugcug

SEQ ID NO: 858902 - RNA, 18 nt, Human
agggaaaggccucggaua

SEQ ID NO: 858903 - RNA, 20 nt, Human
aguccaugugggucaguccu

SEQ ID NO: 858904 - RNA, 20 nt, Human
auccagagaaggugggagcu

SEQ ID NO: 858905 - RNA, 19 nt, Human
augaacagagggaucuggg

SEQ ID NO: 858906 - RNA, 20 nt, Human
caaaaaaaaaggaaagaaaa

SEQ ID NO: 858907 - RNA, 21 nt, Human
caaaaacaaaaaaaaaggaaa

SEQ ID NO: 858908 - RNA, 27 nt, Human
caaaaacaaaaacaaaaacaaaaaaaa

SEQ ID NO: 858909 - RNA, 25 nt, Human
caaaaacaaaaacaaaaacaaaaac

SEQ ID NO: 858910 - RNA, 21 nt, Human
caaaccagcagaggaaaaaca

SEQ ID NO: 858911 - RNA, 21 nt, Human
caaaggacuaaagcaggacua

SEQ ID NO: 858912 - RNA, 25 nt, Human
caacagaggaaccaguugaaaagga

SEQ ID NO: 858913 - RNA, 18 nt, Human
caacaguccagagaaaga

SEQ ID NO: 858914 - RNA, 23 nt, Human
caacuggcaggauuccccccagc

SEQ ID NO: 858915 - RNA, 22 nt, Human
caagaaacguuuccaagccuca

SEQ ID NO: 858916 - RNA, 21 nt, Human
caagauggggagacuccaccg

SEQ ID NO: 858917 - RNA, 26 nt, Human
cacaaauuacaaaggacuaaagcagg

SEQ ID NO: 858918 - RNA, 19 nt, Human
cacaggaacugagaugggc

SEQ ID NO: 858919 - RNA, 20 nt, Human
cacagggcuucaccaacugg

SEQ ID NO: 858920 - RNA, 24 nt, Human
caccaggaaagggaaaaaaaaaaa

SEQ ID NO: 858921 - RNA, 23 nt, Human
caccucuaucugagccccagggg

SEQ ID NO: 858922 - RNA, 23 nt, Human
cacucccaacucucuugccucca

SEQ ID NO: 858923 - RNA, 24 nt, Human
cagagccucccugaggucucaaag

SEQ ID NO: 858924 - RNA, 21 nt, Human
cagaucacucuacccaggcuu

SEQ ID NO: 858925 - RNA, 19 nt, Human
cagcagggauaucuugggc

SEQ ID NO: 858926 - RNA, 24 nt, Human
cagcagggauaucuugggcacggc

SEQ ID NO: 858927 - RNA, 19 nt, Human
caggauuccccccagcccc

SEQ ID NO: 858928 - RNA, 18 nt, Human
cagggcuucaccaacugg

SEQ ID NO: 858929 - RNA, 23 nt, Human
caguaaguaagcaacaggacaau

SEQ ID NO: 858930 - RNA, 21 nt, Human
cagucaugcccauaaccgaca

SEQ ID NO: 858931 - RNA, 18 nt, Human
caucuuccuugucccucc

SEQ ID NO: 858932 - RNA, 21 nt, Human
cauugcaguaaguaagcaaca

SEQ ID NO: 858933 - RNA, 21 nt, Human
ccacagggcuucaccaacugg

SEQ ID NO: 858934 - RNA, 21 nt, Human
ccaggcuggggcacggcugga

SEQ ID NO: 858935 - RNA, 23 nt, Human
ccaguccaagcccaggcacaucc

SEQ ID NO: 858936 - RNA, 24 nt, Human
ccauuaucauucacagcccaaccc

SEQ ID NO: 858937 - RNA, 22 nt, Human
cccaagcagucaguggcugaag

SEQ ID NO: 858938 - RNA, 23 nt, Human
cccagagguuauguuggcaugga

SEQ ID NO: 858939 - RNA, 24 nt, Human
cccuccguaacuagucaucuuccu

SEQ ID NO: 858940 - RNA, 18 nt, Human
ccucaccucccugcccca

SEQ ID NO: 858941 - RNA, 24 nt, Human
ccuccucaucccuuguucccaggc

SEQ ID NO: 858942 - RNA, 19 nt, Human
ccugccccuuaacagggcu

SEQ ID NO: 858943 - RNA, 22 nt, Human
ccugcugaugucugaugcccag

SEQ ID NO: 858944 - RNA, 19 nt, Human
ccuggcgugaggcaacagc

SEQ ID NO: 858945 - RNA, 24 nt, Human
ccuucugacaacagcagacuccag

SEQ ID NO: 858946 - RNA, 22 nt, Human
ccuugguuugagacaugaaguc

SEQ ID NO: 858947 - RNA, 20 nt, Human
ccuugucagccugggauacu

SEQ ID NO: 858948 - RNA, 18 nt, Human
ccuuugggcccaacagag

SEQ ID NO: 858949 - RNA, 18 nt, Human
ccuuugggcccaacagag

SEQ ID NO: 858950 - RNA, 25 nt, Human
cgaggacacaacaguggcuggagac

SEQ ID NO: 858951 - RNA, 18 nt, Human
cggcaggacggggccugg

SEQ ID NO: 858952 - RNA, 23 nt, Human
cuagucaucuuccuugucccucc

SEQ ID NO: 858953 - RNA, 21 nt, Human
cucagcaccucuaucugagcc

SEQ ID NO: 858954 - RNA, 19 nt, Human
cucaucccuuguucccagg

SEQ ID NO: 858955 - RNA, 20 nt, Human
cuccauguugcccagauccc

SEQ ID NO: 858956 - RNA, 24 nt, Human
cucucuugccuccaggauggaggc

SEQ ID NO: 858957 - RNA, 20 nt, Human
cugaagaaagagaaucaggu

SEQ ID NO: 858958 - RNA, 21 nt, Human
cuucccacauaccaaccacug

SEQ ID NO: 858959 - RNA, 21 nt, Human
cuuccuugucccuccuccuca

SEQ ID NO: 858960 - RNA, 18 nt, Human
cuugcagaaggguaugca

SEQ ID NO: 858961 - RNA, 23 nt, Human
cuugguuugagacaugaagucac

SEQ ID NO: 858962 - RNA, 20 nt, Human
cuugucccuccuccucacuu

SEQ ID NO: 858963 - RNA, 18 nt, Human
cuuugggcccaacagagg

SEQ ID NO: 858964 - RNA, 25 nt, Human
gaaagauucuagccaguccaagccc

SEQ ID NO: 858965 - RNA, 18 nt, Human
gaaccaguugaaaaggag

SEQ ID NO: 858966 - RNA, 23 nt, Human
gaacugagaugggcuucccacag

SEQ ID NO: 858967 - RNA, 21 nt, Human
gaaguccucaccucccugccc

SEQ ID NO: 858968 - RNA, 18 nt, Human
gacugggcagggaaaggc

SEQ ID NO: 858969 - RNA, 23 nt, Human
gagaugggcuucccacauaccaa

SEQ ID NO: 858970 - RNA, 21 nt, Human
gaggaaaaacacugagguuuc

SEQ ID NO: 858971 - RNA, 18 nt, Human
gaggacaaguguguucca

SEQ ID NO: 858972 - RNA, 20 nt, Human
gaggacaaguguguuccaga

SEQ ID NO: 858973 - RNA, 18 nt, Human
gauaggaugaacagaggg

SEQ ID NO: 858974 - RNA, 25 nt, Human
gcaaaaaacaacccucacccuccgu

SEQ ID NO: 858975 - RNA, 18 nt, Human
gccccagggguccaggcu

SEQ ID NO: 858976 - RNA, 25 nt, Human
ggacccuuccacacaggagguacuc

SEQ ID NO: 858977 - RNA, 18 nt, Human
ggagagaauggcaucuuu

SEQ ID NO: 858978 - RNA, 23 nt, Human
ggcaacagcaagcagagcgagga

SEQ ID NO: 858979 - RNA, 18 nt, Human
ggcccaacagaggaacca

SEQ ID NO: 858980 - RNA, 23 nt, Human
ggcuuuuuggcaaaaaacaaccc

SEQ ID NO: 858981 - RNA, 19 nt, Human
gggagggcaaaggugggga

SEQ ID NO: 858982 - RNA, 24 nt, Human
gguguucaccuuuccacucugggg

SEQ ID NO: 858983 - RNA, 21 nt, Human
guaaagggcaagcccuuguca

SEQ ID NO: 858984 - RNA, 19 nt, Human
gugaagaagauggcagccc

SEQ ID NO: 858985 - RNA, 22 nt, Human
guguucaccuuuccacucuggg

SEQ ID NO: 858986 - RNA, 26 nt, Human
guuaccaaaaacaaaaacaaaaacaa

SEQ ID NO: 858987 - RNA, 24 nt, Human
uaaaaagaaaagcauaauuaccac

SEQ ID NO: 858988 - RNA, 23 nt, Human
uaaacucuagguaauaacagccu

SEQ ID NO: 858989 - RNA, 19 nt, Human
uaaagagaaaccugccccu

SEQ ID NO: 858990 - RNA, 19 nt, Human
uaaagagaaaccugccccu

SEQ ID NO: 858991 - RNA, 23 nt, Human
uaacuagucaucuuccuuguccc

SEQ ID NO: 858992 - RNA, 20 nt, Human
uaagagagacagagccuccc

SEQ ID NO: 858993 - RNA, 22 nt, Human
uaagagagacagagccucccug

SEQ ID NO: 858994 - RNA, 18 nt, Human
uaagcugaggacaagugu

SEQ ID NO: 858995 - RNA, 22 nt, Human
uaauucagaucacucuacccag

SEQ ID NO: 858996 - RNA, 18 nt, Human
uacaaaggacuaaagcag

SEQ ID NO: 858997 - RNA, 22 nt, Human
uacaauggaacaaaacaaaaac

SEQ ID NO: 858998 - RNA, 25 nt, Human
uacaguacagggcugcgugaccuga

SEQ ID NO: 858999 - RNA, 22 nt, Human
uaccaaaaacaaaaacaaaaac

SEQ ID NO: 859000 - RNA, 23 nt, Human
uaccaaaaacaaaaacaaaaaca

SEQ ID NO: 859001 - RNA, 23 nt, Human
uaccaaaaacaaaaacaaaaaca

SEQ ID NO: 859002 - RNA, 24 nt, Human
uaccaaaaacaaaaacaaaaacaa

SEQ ID NO: 859003 - RNA, 22 nt, Human
uacccaggcuuuuuggcaaaaa

SEQ ID NO: 859004 - RNA, 19 nt, Human
uagauggcuugcagaaggg

SEQ ID NO: 859005 - RNA, 25 nt, Human
uaggaugaacagagggaucugggca

SEQ ID NO: 859006 - RNA, 19 nt, Human
uagggaaaauccagggacc

SEQ ID NO: 859007 - RNA, 21 nt, Human
uaguaaagauaauguacuacg

SEQ ID NO: 859008 - RNA, 21 nt, Human
ucagcaccucuaucugagccc

SEQ ID NO: 859009 - RNA, 20 nt, Human
ucagcauggcugaaggggga

SEQ ID NO: 859010 - RNA, 19 nt, Human
ucaguggcugaagaaagag

SEQ ID NO: 859011 - RNA, 24 nt, Human
uccaagcccaggcacauccagaga

SEQ ID NO: 859012 - RNA, 23 nt, Human
uccacauauaccuuccugccaca

SEQ ID NO: 859013 - RNA, 25 nt, Human
uccaggcuggggcacggccgggguc

SEQ ID NO: 859014 - RNA, 20 nt, Human
uccccccagcccccaacucc

SEQ ID NO: 859015 - RNA, 19 nt, Human
uccgcaaagccagaugaca

SEQ ID NO: 859016 - RNA, 21 nt, Human
ugaaaaggagggccaaagaca

SEQ ID NO: 859017 - RNA, 21 nt, Human
ugaaggaaagaaaggaaagga

SEQ ID NO: 859018 - RNA, 18 nt, Human
ugagagugaacgugcagu

SEQ ID NO: 859019 - RNA, 25 nt, Human
ugagccccagggguccaggcugggg

SEQ ID NO: 859020 - RNA, 24 nt, Human
ugaggcaacagcaagcagagcgag

SEQ ID NO: 859021 - RNA, 20 nt, Human
ugauucgagccacucccaag

SEQ ID NO: 859022 - RNA, 24 nt, Human
ugcaacaguccagagaaagauucu

SEQ ID NO: 859023 - RNA, 21 nt, Human
ugccagauaauucagaucacu

SEQ ID NO: 859024 - RNA, 22 nt, Human
ugcccauaaccgacacacaucc

SEQ ID NO: 859025 - RNA, 22 nt, Human
uggaacaaaacaaaaacauuua

SEQ ID NO: 859026 - RNA, 18 nt, Human
uggcaaaaaacaacccuc

SEQ ID NO: 859027 - RNA, 20 nt, Human
uggcaaaaaacaacccucac

SEQ ID NO: 859028 - RNA, 22 nt, Human
uggcagcaguguacagacacag

SEQ ID NO: 859029 - RNA, 25 nt, Human
uggcugaagaaagagaaucagguau

SEQ ID NO: 859030 - RNA, 21 nt, Human
ugggcccaacagaggaaccag

SEQ ID NO: 859031 - RNA, 18 nt, Human
ugggcuccaaguucuuau

SEQ ID NO: 859032 - RNA, 20 nt, Human
ugggcuucccacauaccaac

SEQ ID NO: 859033 - RNA, 19 nt, Human
uggggugugaggagauggu

SEQ ID NO: 859034 - RNA, 18 nt, Human
uguacuacgagcguaagg

SEQ ID NO: 859035 - RNA, 21 nt, Human
uguccacauauaccuuccugc

SEQ ID NO: 859036 - RNA, 26 nt, Human
ugucccuccuccucacuucccuucca

SEQ ID NO: 859037 - RNA, 19 nt, Human
uguccgguacaaugugggg

SEQ ID NO: 859038 - RNA, 23 nt, Human
ugugaggagaugguaagcugagg

SEQ ID NO: 859039 - RNA, 20 nt, Human
uuccauucaggagggugcca

SEQ ID NO: 859040 - RNA, 23 nt, Human
uuccugccacagggcuucaccaa

SEQ ID NO: 859041 - RNA, 18 nt, Human
uuguauuaaaaagaaaag

SEQ ID NO: 859042 - RNA, 19 nt, Human
uuuuuuuuuuuuuuuugcc

SEQ ID NO: 859043 - RNA, 25 nt, Human
uuuuuuuuuuuuuuuuuugccuuuu

SEQ ID NO: 859044 - RNA, 20 nt, Human
uuuuuuuuuuuuuuuuuugg

SEQ ID NO: 859045 - RNA, 19 nt, Human
aaaaagcagagaaguagaa

SEQ ID NO: 859046 - RNA, 23 nt, Human
aaaaaugccaaacuaacuggaau

SEQ ID NO: 859047 - RNA, 23 nt, Human
aaaacaaaaacucuccccuagga

SEQ ID NO: 859048 - RNA, 23 nt, Human
aaaaugccaaacuaacuggaaug

SEQ ID NO: 859049 - RNA, 21 nt, Human
aacaaaaacucuccccuagga

SEQ ID NO: 859050 - RNA, 20 nt, Human
aagcaagcccuccuccacag

SEQ ID NO: 859051 - RNA, 20 nt, Human
acaaacgacaaaaaaugcca

SEQ ID NO: 859052 - RNA, 20 nt, Human
acaaacgacaaaaaaugcca

SEQ ID NO: 859053 - RNA, 18 nt, Human
acagcaaccaaagucugu

SEQ ID NO: 859054 - RNA, 18 nt, Human
acuugaauacagcaacca

SEQ ID NO: 859055 - RNA, 22 nt, Human
aggaggaaucugaugacauaag

SEQ ID NO: 859056 - RNA, 23 nt, Human
agguagcauacuggagaaaaagg

SEQ ID NO: 859057 - RNA, 21 nt, Human
cacaaaaaaacacaaccacau

SEQ ID NO: 859058 - RNA, 26 nt, Human
cacaggagaacacggaaacauccaaa

SEQ ID NO: 859059 - RNA, 23 nt, Human
caccacaaauuucuugguaacaa

SEQ ID NO: 859060 - RNA, 20 nt, Human
caccuggaaaggagucgguu

SEQ ID NO: 859061 - RNA, 21 nt, Human
cagccaagucacccuucaccu

SEQ ID NO: 859062 - RNA, 20 nt, Human
cauaauccaaauacuugaau

SEQ ID NO: 859063 - RNA, 22 nt, Human
ccaaucccgccaaagccucgug

SEQ ID NO: 859064 - RNA, 18 nt, Human
ccccgcggggaagggcuc

SEQ ID NO: 859065 - RNA, 20 nt, Human
cccgccccgcggggaagggc

SEQ ID NO: 859066 - RNA, 21 nt, Human
cccgcggggaagggcuccgga

SEQ ID NO: 859067 - RNA, 19 nt, Human
ccugguagguggggagcag

SEQ ID NO: 859068 - RNA, 21 nt, Human
cgacaaaaaaugccaaacuaa

SEQ ID NO: 859069 - RNA, 22 nt, Human
cgacaaaaaaugccaaacuaac

SEQ ID NO: 859070 - RNA, 26 nt, Human
cggagccaaucccgccaaagccuccu

SEQ ID NO: 859071 - RNA, 19 nt, Human
cggggaagggcuccggauc

SEQ ID NO: 859072 - RNA, 18 nt, Human
cuccacagucauaaucca

SEQ ID NO: 859073 - RNA, 20 nt, Human
cuucagccaagucacccuuc

SEQ ID NO: 859074 - RNA, 18 nt, Human
gaaacuuuccucugccua

SEQ ID NO: 859075 - RNA, 24 nt, Human
gaaacuuuccucugccuauuuucu

SEQ ID NO: 859076 - RNA, 24 nt, Human
gaaugaucauccuuccugaaauuu

SEQ ID NO: 859077 - RNA, 23 nt, Human
gacaaaaaaugccaaacuaacug

SEQ ID NO: 859078 - RNA, 20 nt, Human
gagcagcggaccagcccaaa

SEQ ID NO: 859079 - RNA, 22 nt, Human
gccaaucccgccaaagccucgu

SEQ ID NO: 859080 - RNA, 23 nt, Human
gcggaccagcccaaacgcggagc

SEQ ID NO: 859081 - RNA, 18 nt, Human
ggggaagggcuccggauc

SEQ ID NO: 859082 - RNA, 18 nt, Human
gugcacaaacgacaaaaa

SEQ ID NO: 859083 - RNA, 23 nt, Human
uaaaaagcagagaaguagaacca

SEQ ID NO: 859084 - RNA, 23 nt, Human
uaaaaagcagagaaguagaacca

SEQ ID NO: 859085 - RNA, 24 nt, Human
uaaaaagcagagaaguagaaccaa

SEQ ID NO: 859086 - RNA, 24 nt, Human
uaaaacaaaaacucuccccuagga

SEQ ID NO: 859087 - RNA, 22 nt, Human
uagagaugacacaggagaacac

SEQ ID NO: 859088 - RNA, 18 nt, Human
uaucaagccaccuaacuc

SEQ ID NO: 859089 - RNA, 26 nt, Human
uaucaccacaaauuucuugguaacaa

SEQ ID NO: 859090 - RNA, 23 nt, Human
uauggcccaguagagaugacaca

SEQ ID NO: 859091 - RNA, 21 nt, Human
uccacaaaaaaacacaaccac

SEQ ID NO: 859092 - RNA, 25 nt, Human
ucccugccuauuaucaagccaccua

SEQ ID NO: 859093 - RNA, 23 nt, Human
uccuuccugaaauuucucuuaaa

SEQ ID NO: 859094 - RNA, 19 nt, Human
ugaugacauaaggauaaca

SEQ ID NO: 859095 - RNA, 20 nt, Human
ugcacaaacgacaaaaaaug

SEQ ID NO: 859096 - RNA, 24 nt, Human
ugcacaaacgacaaaaaaugcccu

SEQ ID NO: 859097 - RNA, 23 nt, Human
ugcccgguccuauggcccaguag

SEQ ID NO: 859098 - RNA, 22 nt, Human
ugguagguggggagcagcggac

SEQ ID NO: 859099 - RNA, 26 nt, Human
uguaauuaaaacaaaaaccggggucc

SEQ ID NO: 859100 - RNA, 22 nt, Human
uuaagcaagcccuccuccacag

SEQ ID NO: 859101 - RNA, 24 nt, Human
uucaccuggaaaggagucgguugu

SEQ ID NO: 859102 - RNA, 22 nt, Human
uucagccaagucacccuucacc

SEQ ID NO: 859103 - RNA, 20 nt, Human
aaccaagguaaagccaacga

SEQ ID NO: 859104 - RNA, 18 nt, Human
aagcagcaggcgccaggg

SEQ ID NO: 859105 - RNA, 18 nt, Human
aagcagcaggcgccaggg

SEQ ID NO: 859106 - RNA, 20 nt, Human
aagcagcaggcgccaggggg

SEQ ID NO: 859107 - RNA, 25 nt, Human
aagcagcaggcgccagggggcccaa

SEQ ID NO: 859108 - RNA, 23 nt, Human
aagcuggggccaagcagggcgga

SEQ ID NO: 859109 - RNA, 18 nt, Human
aaggggacagaacuaaug

SEQ ID NO: 859110 - RNA, 19 nt, Human
aaguggcugggacaugggg

SEQ ID NO: 859111 - RNA, 24 nt, Human
aaguggcugggacaugggggcugc

SEQ ID NO: 859112 - RNA, 24 nt, Human
agaaaacacuucucauugugaagg

SEQ ID NO: 859113 - RNA, 18 nt, Human
agaacuaaugggggacag

SEQ ID NO: 859114 - RNA, 19 nt, Human
agacaaggagcagaggccu

SEQ ID NO: 859115 - RNA, 20 nt, Human
agccuggcccacaguggcug

SEQ ID NO: 859116 - RNA, 22 nt, Human
aggcuccccccucccccgaccc

SEQ ID NO: 859117 - RNA, 23 nt, Human
aggcuccccccucccccgacccu

SEQ ID NO: 859118 - RNA, 25 nt, Human
agggcguggggcugggggaaggagc

SEQ ID NO: 859119 - RNA, 21 nt, Human
aggggacagaacuaauggggg

SEQ ID NO: 859120 - RNA, 22 nt, Human
caaggacgaccgcgaaccaagg

SEQ ID NO: 859121 - RNA, 25 nt, Human
caagguaaagccaacgaggccaccu

SEQ ID NO: 859122 - RNA, 21 nt, Human
caggacaguaacauccgugcu

SEQ ID NO: 859123 - RNA, 21 nt, Human
cagggcagugagugaugggac

SEQ ID NO: 859124 - RNA, 23 nt, Human
cagugagugaugggacgugcccu

SEQ ID NO: 859125 - RNA, 18 nt, Human
ccagaaaacacuucucau

SEQ ID NO: 859126 - RNA, 23 nt, Human
ccagagacagacaagcuggggcc

SEQ ID NO: 859127 - RNA, 24 nt, Human
ccagagacagacaagcuggggcca

SEQ ID NO: 859128 - RNA, 23 nt, Human
cccacaguggcugccacauuuca

SEQ ID NO: 859129 - RNA, 22 nt, Human
cccccgacccuuuaccuagggc

SEQ ID NO: 859130 - RNA, 25 nt, Human
ccccuaggcuuggccucccagagac

SEQ ID NO: 859131 - RNA, 19 nt, Human
cccuacaaggcuccccccu

SEQ ID NO: 859132 - RNA, 20 nt, Human
cccugcccugagccuggccc

SEQ ID NO: 859133 - RNA, 23 nt, Human
ccuaggcuuggccucccagagac

SEQ ID NO: 859134 - RNA, 19 nt, Human
ccucccagagacucgcgga

SEQ ID NO: 859135 - RNA, 19 nt, Human
ccucgugcgcgacggaggc

SEQ ID NO: 859136 - RNA, 21 nt, Human
ccucuagccccuuccggccgc

SEQ ID NO: 859137 - RNA, 21 nt, Human
cgccccuaggcuuggccuccc

SEQ ID NO: 859138 - RNA, 20 nt, Human
cgccucuagccccuuccggc

SEQ ID NO: 859139 - RNA, 22 nt, Human
cguggggcugggggaaggagca

SEQ ID NO: 859140 - RNA, 22 nt, Human
cuuccgggacgcucacgguggu

SEQ ID NO: 859141 - RNA, 23 nt, Human
gagccuggcccacaguggcugcc

SEQ ID NO: 859142 - RNA, 19 nt, Human
gcaggcgcuguggcgcccc

SEQ ID NO: 859143 - RNA, 18 nt, Human
gcggagcaucugagaccc

SEQ ID NO: 859144 - RNA, 21 nt, Human
ggcguggggcugggggaagga

SEQ ID NO: 859145 - RNA, 19 nt, Human
ggcuggcccaggacccaga

SEQ ID NO: 859146 - RNA, 20 nt, Human
guaaagccaacgaggccacc

SEQ ID NO: 859147 - RNA, 22 nt, Human
uacaaggcuccccccucccccg

SEQ ID NO: 859148 - RNA, 22 nt, Human
uagaggccucccuacaaggcuc

SEQ ID NO: 859149 - RNA, 24 nt, Human
uauuaucagguauccuggcuggcc

SEQ ID NO: 859150 - RNA, 18 nt, Human
ucacacgacucacccaga

SEQ ID NO: 859151 - RNA, 21 nt, Human
ucccagagacucgcggacgcu

SEQ ID NO: 859152 - RNA, 21 nt, Human
ucccccgacccuuuaccuagg

SEQ ID NO: 859153 - RNA, 25 nt, Human
ucccuacaaggcuccccccuccccc

SEQ ID NO: 859154 - RNA, 27 nt, Human
uccgugcugcuggcugggacccagaag

SEQ ID NO: 859155 - RNA, 18 nt, Human
uccugagucacacgacuc

SEQ ID NO: 859156 - RNA, 19 nt, Human
ugagucacacgacucaccc

SEQ ID NO: 859157 - RNA, 18 nt, Human
ugcccccucugguagggc

SEQ ID NO: 859158 - RNA, 21 nt, Human
uggcccaggacccagagacag

SEQ ID NO: 859159 - RNA, 23 nt, Human
uggcugccacauuucagacaggg

SEQ ID NO: 859160 - RNA, 21 nt, Human
uggcugggacaugggggcugc

SEQ ID NO: 859161 - RNA, 23 nt, Human
uggggccaagcagggcggagcau

SEQ ID NO: 859162 - RNA, 20 nt, Human
ugguagggcguggggcuggg

SEQ ID NO: 859163 - RNA, 20 nt, Human
ugguagggcguggggcuggg

SEQ ID NO: 859164 - RNA, 21 nt, Human
uguggcgccccuaggcuuggc

SEQ ID NO: 859165 - RNA, 27 nt, Human
uuacagguaagaaagacaaggagcaga

SEQ ID NO: 859166 - RNA, 19 nt, Human
uugcccccucugguagggc

SEQ ID NO: 859167 - RNA, 23 nt, Human
uuuuuuuuuuuuuucacccaaug

SEQ ID NO: 859168 - RNA, 23 nt, Human
uuuuuuuuuuuuuuuucacccaa

SEQ ID NO: 859169 - RNA, 18 nt, Human
acacauggcagguggagc

SEQ ID NO: 859170 - RNA, 25 nt, Human
agcccagccgcgaguucuccuggag

SEQ ID NO: 859171 - RNA, 25 nt, Human
caccccacuaggggcccugucccca

SEQ ID NO: 859172 - RNA, 22 nt, Human
cagcccagccgcgaguucuccu

SEQ ID NO: 859173 - RNA, 22 nt, Human
cauacacauggcagguggagca

SEQ ID NO: 859174 - RNA, 18 nt, Human
caugucgucuucccucuc

SEQ ID NO: 859175 - RNA, 19 nt, Human
ccaauaugaguccacuccu

SEQ ID NO: 859176 - RNA, 24 nt, Human
ccacuccuacucaaacccugauuc

SEQ ID NO: 859177 - RNA, 22 nt, Human
ccagguguucaugucagugggg

SEQ ID NO: 859178 - RNA, 18 nt, Human
ccccaccagagccuggac

SEQ ID NO: 859179 - RNA, 23 nt, Human
cccugauucucaggggccugggg

SEQ ID NO: 859180 - RNA, 21 nt, Human
ccugauucucaggggccuggg

SEQ ID NO: 859181 - RNA, 21 nt, Human
cugggcagggcuggcaccugg

SEQ ID NO: 859182 - RNA, 20 nt, Human
ggcagggcuggcaccuggcu

SEQ ID NO: 859183 - RNA, 20 nt, Human
ggcagguggagcaggccagg

SEQ ID NO: 859184 - RNA, 21 nt, Human
gggggccaugucuagcauguc

SEQ ID NO: 859185 - RNA, 19 nt, Human
guggagcaggccagggagg

SEQ ID NO: 859186 - RNA, 19 nt, Human
ucaggggccuggggaaggc

SEQ ID NO: 859187 - RNA, 22 nt, Human
ucaguggggcuuggggacaugg

SEQ ID NO: 859188 - RNA, 22 nt, Human
uccacuccuacucaaacccuga

SEQ ID NO: 859189 - RNA, 25 nt, Human
uccagguguucaugucaguggggcu

SEQ ID NO: 859190 - RNA, 21 nt, Human
ucccucaaucugggcccuggg

SEQ ID NO: 859191 - RNA, 18 nt, Human
uccgcuccuuccagcucc

SEQ ID NO: 859192 - RNA, 20 nt, Human
uccucgggaggaggcaggag

SEQ ID NO: 859193 - RNA, 24 nt, Human
ucucaggggccuggggaaggccac

SEQ ID NO: 859194 - RNA, 25 nt, Human
ucucaggggccuggggaaggcccca

SEQ ID NO: 859195 - RNA, 23 nt, Human
ucucucccaagcagggguguugu

SEQ ID NO: 859196 - RNA, 23 nt, Human
ugaguccacuccuacucaaaccc

SEQ ID NO: 859197 - RNA, 22 nt, Human
uggacaugggacucucucccaa

SEQ ID NO: 859198 - RNA, 19 nt, Human
uggcagcccagccgcgagu

SEQ ID NO: 859199 - RNA, 21 nt, Human
uggcagguggagcaggccagg

SEQ ID NO: 859200 - RNA, 19 nt, Human
uggccauccacguagaagu

SEQ ID NO: 859201 - RNA, 18 nt, Human
uuuuuuuuuuuuuuucug

SEQ ID NO: 859202 - RNA, 19 nt, Human
uuuuuuuuuuuuuuucugu

SEQ ID NO: 859203 - RNA, 24 nt, Human
cagcaggccauucugugacaguuc

SEQ ID NO: 859204 - RNA, 19 nt, Human
cauccugaguuccaagucc

SEQ ID NO: 859205 - RNA, 22 nt, Human
caugacacagacgguuuauuca

SEQ ID NO: 859206 - RNA, 26 nt, Human
uccacccgccacaguuccacauccca

SEQ ID NO: 859207 - RNA, 21 nt, Human
ugaguuccaaguccauguccu

SEQ ID NO: 859208 - RNA, 18 nt, Human
uguccugacugaguggug

SEQ ID NO: 859209 - RNA, 18 nt, Human
uuuuuuuuuuuuuuuuug

SEQ ID NO: 859210 - RNA, 22 nt, Human
uuuuuuuuuuuuuuuuugccau

SEQ ID NO: 859211 - RNA, 25 nt, Human
uuuuuuuuuuuuuuuuuugccauga

SEQ ID NO: 859212 - RNA, 20 nt, Human
acccgcccugccuugcugcc

SEQ ID NO: 859213 - RNA, 24 nt, Human
caaggaauaccauaucccucuuuc

SEQ ID NO: 859214 - RNA, 25 nt, Human
cauuacaaccauuguggauauugcu

SEQ ID NO: 859215 - RNA, 22 nt, Human
ccauaucccucuuuccucucug

SEQ ID NO: 859216 - RNA, 21 nt, Human
cccgcuggguucuccucggca

SEQ ID NO: 859217 - RNA, 20 nt, Human
cccucuuuccucucugaccc

SEQ ID NO: 859218 - RNA, 20 nt, Human
cccucuuuccucucugaccc

SEQ ID NO: 859219 - RNA, 21 nt, Human
cccugccuugcugccagcaaa

SEQ ID NO: 859220 - RNA, 23 nt, Human
cgcuggguucuccucggcagcgc

SEQ ID NO: 859221 - RNA, 20 nt, Human
cgucucccuccgggagcagg

SEQ ID NO: 859222 - RNA, 22 nt, Human
cucagcacuuggccuauuccua

SEQ ID NO: 859223 - RNA, 24 nt, Human
gaguaaaucucuuuccccagauuc

SEQ ID NO: 859224 - RNA, 24 nt, Human
uaccauaucccucuuuccucucug

SEQ ID NO: 859225 - RNA, 21 nt, Human
ucccucuuuccucucugaccc

SEQ ID NO: 859226 - RNA, 23 nt, Human
uccugaaauguucucccgcuggg

SEQ ID NO: 859227 - RNA, 22 nt, Human
ugaaauguucucccgcuggguu

SEQ ID NO: 859228 - RNA, 21 nt, Human
uuccccagauuccaaggaaua

SEQ ID NO: 859229 - RNA, 23 nt, Human
uuucagagaguaaaucucuuucc

SEQ ID NO: 859230 - RNA, 18 nt, Human
uuuuuuuuuuucagagag

SEQ ID NO: 859231 - RNA, 21 nt, Human
uuuuuuuuuuuuuuuuuucag

SEQ ID NO: 859232 - RNA, 20 nt, Human
uuuuuuuuuuuuuuuuuugg

SEQ ID NO: 859233 - RNA, 24 nt, Human
uuuuuuuuuuuuuuuuuuguuuuu

SEQ ID NO: 859234 - RNA, 22 nt, Human
aaacagccagaagaaaauuugc

SEQ ID NO: 859235 - RNA, 20 nt, Human
aagccucaguuucuucacug

SEQ ID NO: 859236 - RNA, 21 nt, Human
aagccucaguuucuucacugg

SEQ ID NO: 859237 - RNA, 20 nt, Human
acuaaaacagccagaagaaa

SEQ ID NO: 859238 - RNA, 18 nt, Human
agccagaagaaaauuugc

SEQ ID NO: 859239 - RNA, 23 nt, Human
cccccaauuugaguacauacuac

SEQ ID NO: 859240 - RNA, 20 nt, Human
cuaaaacagccagaagaaaa

SEQ ID NO: 859241 - RNA, 18 nt, Human
cuguaaaaaaaauacuac

SEQ ID NO: 859242 - RNA, 24 nt, Human
gagaagccucaguuucuucacuga

SEQ ID NO: 859243 - RNA, 20 nt, Human
gcgcaugcguccaacuuccc

SEQ ID NO: 859244 - RNA, 19 nt, Human
uaacugcaaaauucuaaag

SEQ ID NO: 859245 - RNA, 23 nt, Human
uacaagaaacauguaggguuuuu

SEQ ID NO: 859246 - RNA, 25 nt, Human
uacauacuacuguuaacugcaaaau

SEQ ID NO: 859247 - RNA, 18 nt, Human
uacauauuuuuaucuaga

SEQ ID NO: 859248 - RNA, 23 nt, Human
uuuuuuuuuuuuuuuuuuacuaa

SEQ ID NO: 859249 - RNA, 23 nt, Human
aagcaaacuucaccaaacauaga

SEQ ID NO: 859250 - RNA, 19 nt, Human
caagugcucuuuuccacaa

SEQ ID NO: 859251 - RNA, 21 nt, Human
ggaaaagcaaacuucaccaaa

SEQ ID NO: 859252 - RNA, 20 nt, Human
gguuuaaucaagcauguagu

SEQ ID NO: 859253 - RNA, 21 nt, Human
uacaagcauuuaaugguuuaa

SEQ ID NO: 859254 - RNA, 24 nt, Human
uuaaaguuacaagcauuuaauggu

SEQ ID NO: 859255 - RNA, 19 nt, Human
uucaagugcucuuuuccac

SEQ ID NO: 859256 - RNA, 23 nt, Human
uuuuuuuuuuaaaguuacaagca

SEQ ID NO: 859257 - RNA, 19 nt, Human
uuuuuuuuuuuuuuuuuaa

SEQ ID NO: 859258 - RNA, 24 nt, Human
aaaaaaaacaaaaaacuaaccaag

SEQ ID NO: 859259 - RNA, 22 nt, Human
aaaaaacaaaaaacuaaccaag

SEQ ID NO: 859260 - RNA, 19 nt, Human
aaaaaacuaaccaagggca

SEQ ID NO: 859261 - RNA, 19 nt, Human
aaaguacugggauuacagg

SEQ ID NO: 859262 - RNA, 19 nt, Human
aaaguacugggauuacagg

SEQ ID NO: 859263 - RNA, 22 nt, Human
aaaugcccccuucagacugacc

SEQ ID NO: 859264 - RNA, 24 nt, Human
aaggugccucaagaaaaugccagg

SEQ ID NO: 859265 - RNA, 18 nt, Human
aaguacugggauuacagg

SEQ ID NO: 859266 - RNA, 26 nt, Human
aaguacugggauuacagguguaagcc

SEQ ID NO: 859267 - RNA, 24 nt, Human
aagugcuuugggaggccaagaagg

SEQ ID NO: 859268 - RNA, 18 nt, Human
accaaaaaaaaaacaaaa

SEQ ID NO: 859269 - RNA, 21 nt, Human
accaagccaccuuuaaugaac

SEQ ID NO: 859270 - RNA, 25 nt, Human
acccacuucggccucccaaaguacu

SEQ ID NO: 859271 - RNA, 23 nt, Human
accucagcuuccugaguagcugg

SEQ ID NO: 859272 - RNA, 20 nt, Human
acuacagcucucuccacauu

SEQ ID NO: 859273 - RNA, 22 nt, Human
agaaagaccagccaggcacagg

SEQ ID NO: 859274 - RNA, 19 nt, Human
agaccaggguugcaggugc

SEQ ID NO: 859275 - RNA, 23 nt, Human
agagaagcagacuaucacuuuuu

SEQ ID NO: 859276 - RNA, 18 nt, Human
agagauccucucaccuca

SEQ ID NO: 859277 - RNA, 20 nt, Human
agcgauccacccacuucggc

SEQ ID NO: 859278 - RNA, 23 nt, Human
agcuggacccaccguuuuaccua

SEQ ID NO: 859279 - RNA, 24 nt, Human
aggaguucaaaaccaaccuggacc

SEQ ID NO: 859280 - RNA, 24 nt, Human
aggaucgcuugagcccaggaguuc

SEQ ID NO: 859281 - RNA, 19 nt, Human
aggcacaggcucacaucug

SEQ ID NO: 859282 - RNA, 23 nt, Human
aggccaggugccacuccagggaa

SEQ ID NO: 859283 - RNA, 25 nt, Human
aggcuggagugcaguugcacgaucu

SEQ ID NO: 859284 - RNA, 18 nt, Human
aggguagaaaacuugaaa

SEQ ID NO: 859285 - RNA, 19 nt, Human
aguagccgggauuacaggc

SEQ ID NO: 859286 - RNA, 25 nt, Human
aguagccgggauuacaggcgcaugc

SEQ ID NO: 859287 - RNA, 18 nt, Human
aguagcugggacuacagg

SEQ ID NO: 859288 - RNA, 24 nt, Human
agugauucugcugccucagccucc

SEQ ID NO: 859289 - RNA, 24 nt, Human
agugcaguugcacgaucuuggcuc

SEQ ID NO: 859290 - RNA, 19 nt, Human
agugcuuugggaggccaag

SEQ ID NO: 859291 - RNA, 20 nt, Human
auagaccaggguugcaggug

SEQ ID NO: 859292 - RNA, 18 nt, Human
auaugaguguguguguau

SEQ ID NO: 859293 - RNA, 22 nt, Human
auccaagugcuuugggaggcca

SEQ ID NO: 859294 - RNA, 19 nt, Human
auggucaaagcagauaggc

SEQ ID NO: 859295 - RNA, 19 nt, Human
auuacaggcgcaugccacc

SEQ ID NO: 859296 - RNA, 24 nt, Human
auuuuuguauuuuuaguagagaca

SEQ ID NO: 859297 - RNA, 25 nt, Human
caaagcagauaggcacagaaaagca

SEQ ID NO: 859298 - RNA, 24 nt, Human
caaaguacugggauuacaggugua

SEQ ID NO: 859299 - RNA, 27 nt, Human
caacucugucuuccuaggaaccaggga

SEQ ID NO: 859300 - RNA, 19 nt, Human
caagcgauccacccacuuc

SEQ ID NO: 859301 - RNA, 24 nt, Human
caagguuucaccauguugaccagg

SEQ ID NO: 859302 - RNA, 22 nt, Human
caagugauucugcugccucagc

SEQ ID NO: 859303 - RNA, 24 nt, Human
cacaucuguaauccaagugcuuug

SEQ ID NO: 859304 - RNA, 24 nt, Human
caccacacccagcuaauuuuugua

SEQ ID NO: 859305 - RNA, 19 nt, Human
caccagggaguugugggag

SEQ ID NO: 859306 - RNA, 21 nt, Human
caccauguugaccaggcuggu

SEQ ID NO: 859307 - RNA, 22 nt, Human
caccauguugaccaggcugguc

SEQ ID NO: 859308 - RNA, 31 nt, Human
caccauguugaccaggcuggucacgaacucc

SEQ ID NO: 859309 - RNA, 21 nt, Human
cacugcacccagcuguaagac

SEQ ID NO: 859310 - RNA, 23 nt, Human
cagaaaggacagagggcuaaagg

SEQ ID NO: 859311 - RNA, 19 nt, Human
cagaaucugauggcagccc

SEQ ID NO: 859312 - RNA, 20 nt, Human
cagagugccaggugccucuc

SEQ ID NO: 859313 - RNA, 20 nt, Human
cagagugggcugggcugggc

SEQ ID NO: 859314 - RNA, 25 nt, Human
cagauaggcacagaaaagcaucuau

SEQ ID NO: 859315 - RNA, 21 nt, Human
cagcgacagaaacggaagaga

SEQ ID NO: 859316 - RNA, 20 nt, Human
cagcuuccugaguagcuggg

SEQ ID NO: 859317 - RNA, 23 nt, Human
caggugccuggaguacagggaca

SEQ ID NO: 859318 - RNA, 23 nt, Human
caguacagaaaggccaggugcca

SEQ ID NO: 859319 - RNA, 24 nt, Human
caucuguaauccaagugcuuuggg

SEQ ID NO: 859320 - RNA, 24 nt, Human
caugccaccacacccagcuaauuu

SEQ ID NO: 859321 - RNA, 18 nt, Human
cauggucaaagcagauag

SEQ ID NO: 859322 - RNA, 24 nt, Human
cauguugaccaggcuggucacgaa

SEQ ID NO: 859323 - RNA, 24 nt, Human
ccaaaaaaaaaacaaaaaacuaac

SEQ ID NO: 859324 - RNA, 21 nt, Human
ccaaaguacugggauuacagg

SEQ ID NO: 859325 - RNA, 24 nt, Human
ccaaaguacugggauuacaggugu

SEQ ID NO: 859326 - RNA, 22 nt, Human
ccacugcacccagcuguaagac

SEQ ID NO: 859327 - RNA, 19 nt, Human
ccacugcgcccagccggca

SEQ ID NO: 859328 - RNA, 21 nt, Human
ccacugcgcccagccggcagg

SEQ ID NO: 859329 - RNA, 21 nt, Human
ccacugcgcccagccggcagg

SEQ ID NO: 859330 - RNA, 21 nt, Human
ccagccaggcacaggcucaca

SEQ ID NO: 859331 - RNA, 19 nt, Human
ccagcccugauggagcugg

SEQ ID NO: 859332 - RNA, 18 nt, Human
cccaggcuggagugcagu

SEQ ID NO: 859333 - RNA, 19 nt, Human
cccgaguagccgggauuac

SEQ ID NO: 859334 - RNA, 24 nt, Human
cccgaguagccgggauuacaggcg

SEQ ID NO: 859335 - RNA, 22 nt, Human
ccucaagcgauccacccacuuc

SEQ ID NO: 859336 - RNA, 19 nt, Human
ccucuaagggcagaguggg

SEQ ID NO: 859337 - RNA, 23 nt, Human
ccugaguagcugggacuacaggu

SEQ ID NO: 859338 - RNA, 24 nt, Human
ccugaguagcugggacuacaggua

SEQ ID NO: 859339 - RNA, 24 nt, Human
ccugcccucaagcgauccacccac

SEQ ID NO: 859340 - RNA, 20 nt, Human
ccuggaguacagggacagca

SEQ ID NO: 859341 - RNA, 20 nt, Human
ccugugcaggcccgcagagu

SEQ ID NO: 859342 - RNA, 23 nt, Human
cgacugcagcgacagaaacggaa

SEQ ID NO: 859343 - RNA, 20 nt, Human
cgcaugccaccacacccagc

SEQ ID NO: 859344 - RNA, 22 nt, Human
cggaagagaguggaaucgaaaa

SEQ ID NO: 859345 - RNA, 21 nt, Human
cgggauuacaggcgcaugcca

SEQ ID NO: 859346 - RNA, 22 nt, Human
cgggauuacaggcgcaugccac

SEQ ID NO: 859347 - RNA, 24 nt, Human
cgggauuacaggcgcaugccacca

SEQ ID NO: 859348 - RNA, 22 nt, Human
cgguuucaagugauucugcugc

SEQ ID NO: 859349 - RNA, 25 nt, Human
cgguuucaagugauucugcugccuc

SEQ ID NO: 859350 - RNA, 23 nt, Human
cuaauuuuuguauuuuuaguaga

SEQ ID NO: 859351 - RNA, 27 nt, Human
cuagagauccucucaccucagcuuccu

SEQ ID NO: 859352 - RNA, 27 nt, Human
cuagagauccucucaccucagcuuccu

SEQ ID NO: 859353 - RNA, 24 nt, Human
cucaagcgauccacccacuucggc

SEQ ID NO: 859354 - RNA, 24 nt, Human
cucacaucuguaauccaagugcuu

SEQ ID NO: 859355 - RNA, 24 nt, Human
cucaccucagcuuccugaguagcu

SEQ ID NO: 859356 - RNA, 24 nt, Human
cucacugcaaccucugccuuccgg

SEQ ID NO: 859357 - RNA, 24 nt, Human
cucagcuuccugaguagcugggac

SEQ ID NO: 859358 - RNA, 25 nt, Human
cucauguuaaacuugaaagguuuuc

SEQ ID NO: 859359 - RNA, 18 nt, Human
cuccucuacuauuuuggc

SEQ ID NO: 859360 - RNA, 21 nt, Human
cuccucuacuauuuuggcucc

SEQ ID NO: 859361 - RNA, 23 nt, Human
cucuaccaaaaaaaaaacaaaaa

SEQ ID NO: 859362 - RNA, 21 nt, Human
cucugggaccagagagggccc

SEQ ID NO: 859363 - RNA, 19 nt, Human
cucuuuugcccaggcugga

SEQ ID NO: 859364 - RNA, 20 nt, Human
cugcaaccucugccuuccgg

SEQ ID NO: 859365 - RNA, 23 nt, Human
cugcaaccucugccuuccgguuu

SEQ ID NO: 859366 - RNA, 24 nt, Human
cugcaaccucugccuuccgguuuc

SEQ ID NO: 859367 - RNA, 21 nt, Human
cuggauacugauagcuucauc

SEQ ID NO: 859368 - RNA, 20 nt, Human
cuuccgguuucaagugauuc

SEQ ID NO: 859369 - RNA, 23 nt, Human
cuuuugcccaggcuggagugcag

SEQ ID NO: 859370 - RNA, 23 nt, Human
gaagggccucuaagggcagagug

SEQ ID NO: 859371 - RNA, 21 nt, Human
gacaggaaagggagggucuag

SEQ ID NO: 859372 - RNA, 21 nt, Human
gaccaacagugagacucuguc

SEQ ID NO: 859373 - RNA, 18 nt, Human
gaccaggguugcaggugc

SEQ ID NO: 859374 - RNA, 23 nt, Human
gacuacagguauauaccacugca

SEQ ID NO: 859375 - RNA, 18 nt, Human
gacuuagaggcucuccuu

SEQ ID NO: 859376 - RNA, 20 nt, Human
gagggggugggagguaagga

SEQ ID NO: 859377 - RNA, 25 nt, Human
gaguagcugggacuacagguauaua

SEQ ID NO: 859378 - RNA, 25 nt, Human
gaguguguguguaugaaguuaacuu

SEQ ID NO: 859379 - RNA, 24 nt, Human
gaucgcuugagcccaggaguucaa

SEQ ID NO: 859380 - RNA, 18 nt, Human
gauuacaggcgcaugcca

SEQ ID NO: 859381 - RNA, 18 nt, Human
gauuacagguguaagcca

SEQ ID NO: 859382 - RNA, 22 nt, Human
gauuacagguguaagccacugc

SEQ ID NO: 859383 - RNA, 22 nt, Human
gauuacagguguaagccacugc

SEQ ID NO: 859384 - RNA, 19 nt, Human
gcaugccaccacacccagc

SEQ ID NO: 859385 - RNA, 19 nt, Human
gcccaggcuggagugcagu

SEQ ID NO: 859386 - RNA, 24 nt, Human
gcgauccacccacuucggccuccc

SEQ ID NO: 859387 - RNA, 24 nt, Human
gcuaaaguacagaaacuauuucua

SEQ ID NO: 859388 - RNA, 20 nt, Human
gcucacugcaaccucugccu

SEQ ID NO: 859389 - RNA, 20 nt, Human
gcucuuuugcccaggcugga

SEQ ID NO: 859390 - RNA, 23 nt, Human
gcugccucagccucccgaguagc

SEQ ID NO: 859391 - RNA, 19 nt, Human
gcuggagugcaguugcacg

SEQ ID NO: 859392 - RNA, 23 nt, Human
ggacagagggcuaaagggccuug

SEQ ID NO: 859393 - RNA, 23 nt, Human
ggaucgcuugagcccaggaguuc

SEQ ID NO: 859394 - RNA, 22 nt, Human
ggauuacagguguaagccacug

SEQ ID NO: 859395 - RNA, 23 nt, Human
gggauuacaggcgcaugccacca

SEQ ID NO: 859396 - RNA, 22 nt, Human
gggcugggcugagcugagcugg

SEQ ID NO: 859397 - RNA, 18 nt, Human
ggggagaagcaccgccug

SEQ ID NO: 859398 - RNA, 24 nt, Human
gugauucugcugccucagccuccc

SEQ ID NO: 859399 - RNA, 23 nt, Human
guggaacagaacccagcagccuu

SEQ ID NO: 859400 - RNA, 24 nt, Human
guuuugcucuuuugcccaggcugg

SEQ ID NO: 859401 - RNA, 22 nt, Human
uaaaagccagauaaaacuacag

SEQ ID NO: 859402 - RNA, 18 nt, Human
uaagggcagagugggcug

SEQ ID NO: 859403 - RNA, 24 nt, Human
uaauuuuuguauuuuuaguagaga

SEQ ID NO: 859404 - RNA, 24 nt, Human
uacaggcgcaugccaccacaccca

SEQ ID NO: 859405 - RNA, 24 nt, Human
uacagguauauaccacugcaccca

SEQ ID NO: 859406 - RNA, 24 nt, Human
uacagguguaagccacugcgccca

SEQ ID NO: 859407 - RNA, 24 nt, Human
uaccaaaaaaaaaacaaaaaacua

SEQ ID NO: 859408 - RNA, 21 nt, Human
uaccuaccuguguccacucac

SEQ ID NO: 859409 - RNA, 24 nt, Human
uacugggauuacagguguaagcca

SEQ ID NO: 859410 - RNA, 22 nt, Human
uagagacaagguuucaccaugu

SEQ ID NO: 859411 - RNA, 20 nt, Human
uagcuggagaacaacucugu

SEQ ID NO: 859412 - RNA, 24 nt, Human
uaguagagacaagguuucaccaug

SEQ ID NO: 859413 - RNA, 26 nt, Human
uaguagagacaagguuucaccauguu

SEQ ID NO: 859414 - RNA, 20 nt, Human
uauauaccacugcacccagc

SEQ ID NO: 859415 - RNA, 19 nt, Human
uaucacuuuuucacauggu

SEQ ID NO: 859416 - RNA, 18 nt, Human
ucacugcaaccucugccu

SEQ ID NO: 859417 - RNA, 23 nt, Human
ucacugcaaccucugccuuccgg

SEQ ID NO: 859418 - RNA, 21 nt, Human
ucagccucccgaguagccggg

SEQ ID NO: 859419 - RNA, 23 nt, Human
ucagcuuccugaguagcugggac

SEQ ID NO: 859420 - RNA, 23 nt, Human
ucccaaaguacugggauuacagg

SEQ ID NO: 859421 - RNA, 20 nt, Human
uccccugaaaguccuuggag

SEQ ID NO: 859422 - RNA, 24 nt, Human
ucccgaguagccgggauuacaggc

SEQ ID NO: 859423 - RNA, 24 nt, Human
uccugaguagcugggacuacaggu

SEQ ID NO: 859424 - RNA, 21 nt, Human
uccugcccucaagcgauccac

SEQ ID NO: 859425 - RNA, 26 nt, Human
ucuaaggugccucaagaaaaugccag

SEQ ID NO: 859426 - RNA, 20 nt, Human
ucugucuuuggcucuguuuu

SEQ ID NO: 859427 - RNA, 22 nt, Human
ucuuuggggagaagggccucua

SEQ ID NO: 859428 - RNA, 24 nt, Human
ucuuuugcccaggcuggagugcag

SEQ ID NO: 859429 - RNA, 20 nt, Human
ugacaggaaagggagggucu

SEQ ID NO: 859430 - RNA, 23 nt, Human
ugacaggaaagggagggucuaga

SEQ ID NO: 859431 - RNA, 20 nt, Human
ugaccaggcuggucacgaac

SEQ ID NO: 859432 - RNA, 24 nt, Human
ugaccaggcuggucacgaacuccu

SEQ ID NO: 859433 - RNA, 23 nt, Human
ugagcccaggaguucaaaaccaa

SEQ ID NO: 859434 - RNA, 18 nt, Human
ugagcugggcgguggugg

SEQ ID NO: 859435 - RNA, 18 nt, Human
ugcccaggcuggagugca

SEQ ID NO: 859436 - RNA, 20 nt, Human
ugcccaggcuggagugcagu

SEQ ID NO: 859437 - RNA, 23 nt, Human
ugcccaggcuggagugcaguugc

SEQ ID NO: 859438 - RNA, 24 nt, Human
ugccucagccucccgaguagccgg

SEQ ID NO: 859439 - RNA, 24 nt, Human
ugccucucuccccuccucuacuau

SEQ ID NO: 859440 - RNA, 21 nt, Human
ugcucuuuugcccaggcugga

SEQ ID NO: 859441 - RNA, 24 nt, Human
ugcucuuuugcccaggcuggagug

SEQ ID NO: 859442 - RNA, 23 nt, Human
uggaacagaacccagcagccuuc

SEQ ID NO: 859443 - RNA, 21 nt, Human
uggagaacaacucugucuucc

SEQ ID NO: 859444 - RNA, 20 nt, Human
uggagugcaguugcacgauc

SEQ ID NO: 859445 - RNA, 23 nt, Human
uggagugcaguugcacgaucuug

SEQ ID NO: 859446 - RNA, 24 nt, Human
uggagugcaguugcacgaucuugg

SEQ ID NO: 859447 - RNA, 21 nt, Human
ugggacuacagguauauacca

SEQ ID NO: 859448 - RNA, 24 nt, Human
ugggacuacagguauauaccacug

SEQ ID NO: 859449 - RNA, 23 nt, Human
ugggaggccaagaagggaggauc

SEQ ID NO: 859450 - RNA, 19 nt, Human
ugggauuacagguguaagc

SEQ ID NO: 859451 - RNA, 21 nt, Human
ugggauuacagguguaagcca

SEQ ID NO: 859452 - RNA, 22 nt, Human
ugggauuacagguguaagccac

SEQ ID NO: 859453 - RNA, 22 nt, Human
ugggauuacagguguaagccac

SEQ ID NO: 859454 - RNA, 24 nt, Human
ugggauuacagguguaagccacug

SEQ ID NO: 859455 - RNA, 20 nt, Human
ugggcugagcugagcugggc

SEQ ID NO: 859456 - RNA, 19 nt, Human
ugggcugggcugggcugag

SEQ ID NO: 859457 - RNA, 20 nt, Human
ugggcugggcugggcugagc

SEQ ID NO: 859458 - RNA, 26 nt, Human
ugggggaaacuggaggauaugagugu

SEQ ID NO: 859459 - RNA, 22 nt, Human
uggggugaaaugcccccuucag

SEQ ID NO: 859460 - RNA, 23 nt, Human
ugguggggagaagcaccgccugg

SEQ ID NO: 859461 - RNA, 22 nt, Human
ugugcugcuccacauugucaaa

SEQ ID NO: 859462 - RNA, 21 nt, Human
uuaccuaccuguguccacuca

SEQ ID NO: 859463 - RNA, 24 nt, Human
uuaguagagacaagguuucaccau

SEQ ID NO: 859464 - RNA, 22 nt, Human
uucaaaaccaaccuggaccaac

SEQ ID NO: 859465 - RNA, 23 nt, Human
uucaaaaccaaccuggaccaaca

SEQ ID NO: 859466 - RNA, 23 nt, Human
uucaagugauucugcugccucag

SEQ ID NO: 859467 - RNA, 20 nt, Human
uucaggucugggaucccagg

SEQ ID NO: 859468 - RNA, 20 nt, Human
uuccucaagaaagaccagcc

SEQ ID NO: 859469 - RNA, 22 nt, Human
uuccugggcucuagagauccuc

SEQ ID NO: 859470 - RNA, 23 nt, Human
uuccugggcucuagagauccucu

SEQ ID NO: 859471 - RNA, 22 nt, Human
uugcccaggcuggagugcaguu

SEQ ID NO: 859472 - RNA, 22 nt, Human
uugcucuuuugcccaggcugga

SEQ ID NO: 859473 - RNA, 24 nt, Human
uugcucuuuugcccaggcuggagu

SEQ ID NO: 859474 - RNA, 21 nt, Human
uuucaagugauucugcugccu

SEQ ID NO: 859475 - RNA, 24 nt, Human
uuucaccauguugaccaggcuggu

SEQ ID NO: 859476 - RNA, 24 nt, Human
uuuugcucuuuugcccaggcugga

SEQ ID NO: 859477 - RNA, 24 nt, Human
uuuuuaguagagacaagguuucac

SEQ ID NO: 859478 - RNA, 20 nt, Human
uuuuuguauuuuuaguagag

SEQ ID NO: 859479 - RNA, 20 nt, Human
aaaaaauaaauacaacuguc

SEQ ID NO: 859480 - RNA, 22 nt, Human
aaagaucuuaguucuguaagac

SEQ ID NO: 859481 - RNA, 23 nt, Human
acaguggcuuucugucgucuccc

SEQ ID NO: 859482 - RNA, 21 nt, Human
accuaugcccaccacaacaga

SEQ ID NO: 859483 - RNA, 23 nt, Human
accuaugcccaccacaacagaga

SEQ ID NO: 859484 - RNA, 18 nt, Human
acugcugcuugaauguuc

SEQ ID NO: 859485 - RNA, 21 nt, Human
agaaaaauagaaaaugauagc

SEQ ID NO: 859486 - RNA, 19 nt, Human
agacaugaaauacagcagc

SEQ ID NO: 859487 - RNA, 18 nt, Human
agagagccuugggacggc

SEQ ID NO: 859488 - RNA, 21 nt, Human
agucagacugaggagaaccug

SEQ ID NO: 859489 - RNA, 26 nt, Human
aguugugagagccacaacagaggcuu

SEQ ID NO: 859490 - RNA, 18 nt, Human
aucugcacgaacaugaga

SEQ ID NO: 859491 - RNA, 24 nt, Human
caccuaugcccaccacaacagaga

SEQ ID NO: 859492 - RNA, 22 nt, Human
cacguucaaguggcuuccagug

SEQ ID NO: 859493 - RNA, 24 nt, Human
caucauaaauucagagugauguuu

SEQ ID NO: 859494 - RNA, 19 nt, Human
ccacccuccucaaaaggaa

SEQ ID NO: 859495 - RNA, 18 nt, Human
ccaguggauuuuuccagc

SEQ ID NO: 859496 - RNA, 18 nt, Human
cccuggugcacccguggg

SEQ ID NO: 859497 - RNA, 23 nt, Human
ccuccucaaaaggacacguucaa

SEQ ID NO: 859498 - RNA, 18 nt, Human
ccuuuuaaccaagaagua

SEQ ID NO: 859499 - RNA, 26 nt, Human
cuccccacaaacuuuuuuaaacaaaa

SEQ ID NO: 859500 - RNA, 20 nt, Human
cuccucaaaaggacacguuu

SEQ ID NO: 859501 - RNA, 22 nt, Human
cugaagacccuucaucuuccuu

SEQ ID NO: 859502 - RNA, 23 nt, Human
cugaagacccuucaucuuccuua

SEQ ID NO: 859503 - RNA, 26 nt, Human
cuuuccuccccacaaacuuuuuuuuu

SEQ ID NO: 859504 - RNA, 19 nt, Human
cuuuugggcguggcuccac

SEQ ID NO: 859505 - RNA, 20 nt, Human
gaacagguaguucgcauuua

SEQ ID NO: 859506 - RNA, 22 nt, Human
gacugaggagaaccuggauucc

SEQ ID NO: 859507 - RNA, 23 nt, Human
gcagcaguccugguuuacucucu

SEQ ID NO: 859508 - RNA, 18 nt, Human
gcccaauauuugucuuug

SEQ ID NO: 859509 - RNA, 21 nt, Human
ggaagcugugcgggcagcagu

SEQ ID NO: 859510 - RNA, 22 nt, Human
guaguaagguugcuuuccugau

SEQ ID NO: 859511 - RNA, 25 nt, Human
gucaaguccuucccaucagaccuca

SEQ ID NO: 859512 - RNA, 20 nt, Human
gugaagggacauucucuaca

SEQ ID NO: 859513 - RNA, 19 nt, Human
guggcuuccaguguuaaaa

SEQ ID NO: 859514 - RNA, 18 nt, Human
guucuuggaggcuguuuc

SEQ ID NO: 859515 - RNA, 18 nt, Human
uaaaggaaagaggugucu

SEQ ID NO: 859516 - RNA, 18 nt, Human
uaaaggaaagaggugucu

SEQ ID NO: 859517 - RNA, 23 nt, Human
uacucuugacagccaagauacau

SEQ ID NO: 859518 - RNA, 18 nt, Human
uagcaggaguagcuccag

SEQ ID NO: 859519 - RNA, 22 nt, Human
ucagaccucagcccuggugcac

SEQ ID NO: 859520 - RNA, 18 nt, Human
ucagacugaggagaaccu

SEQ ID NO: 859521 - RNA, 19 nt, Human
ucaucuuccuuaucacaag

SEQ ID NO: 859522 - RNA, 20 nt, Human
ucauuugaauauuaauggcu

SEQ ID NO: 859523 - RNA, 20 nt, Human
uccucaaaaggacacguuca

SEQ ID NO: 859524 - RNA, 23 nt, Human
uccuccccacaaacuuuuuuaaa

SEQ ID NO: 859525 - RNA, 22 nt, Human
ucucugaaaaagaucuuaguuc

SEQ ID NO: 859526 - RNA, 24 nt, Human
ucucugaaaaagaucuuaguucug

SEQ ID NO: 859527 - RNA, 25 nt, Human
ucuguacuguugugucccacccucc

SEQ ID NO: 859528 - RNA, 22 nt, Human
ugaaaacacugcaacagugaac

SEQ ID NO: 859529 - RNA, 24 nt, Human
ugaaauacagcagcagguuaccag

SEQ ID NO: 859530 - RNA, 22 nt, Human
ugaagacccuucaucuuccuua

SEQ ID NO: 859531 - RNA, 21 nt, Human
ugaauguucuuggaggcuguu

SEQ ID NO: 859532 - RNA, 21 nt, Human
ugaccucagugauguggagcu

SEQ ID NO: 859533 - RNA, 20 nt, Human
ugacuuagggaaagaugagu

SEQ ID NO: 859534 - RNA, 18 nt, Human
ugagacagaggugccagc

SEQ ID NO: 859535 - RNA, 19 nt, Human
ugagacagaggugccagcu

SEQ ID NO: 859536 - RNA, 20 nt, Human
ugagacagaggugccagcug

SEQ ID NO: 859537 - RNA, 18 nt, Human
ugagcuuuuccauccgua

SEQ ID NO: 859538 - RNA, 20 nt, Human
ugauguggagcuugaugacu

SEQ ID NO: 859539 - RNA, 26 nt, Human
ugauuuccugcccaauauuugucuuu

SEQ ID NO: 859540 - RNA, 22 nt, Human
ugcaacagugaacuuuugcauc

SEQ ID NO: 859541 - RNA, 19 nt, Human
uggaaaccgggcucaguga

SEQ ID NO: 859542 - RNA, 23 nt, Human
uguguguuuuggucauuuuuccc

SEQ ID NO: 859543 - RNA, 18 nt, Human
uucaccugaguucugagc

SEQ ID NO: 859544 - RNA, 21 nt, Human
uucuucucugaagacccuuca

SEQ ID NO: 859545 - RNA, 23 nt, Human
uugaaaacacugcaacagugaac

SEQ ID NO: 859546 - RNA, 20 nt, Human
uugaagaaaacuuggcuguc

SEQ ID NO: 859547 - RNA, 24 nt, Human
uugacagccaagauacauuucagu

SEQ ID NO: 859548 - RNA, 19 nt, Human
uuguaaaugugugugugug

SEQ ID NO: 859549 - RNA, 20 nt, Human
uuguaaaugugugugugugu

SEQ ID NO: 859550 - RNA, 19 nt, Human
uuuauuguaacuuaaaaaa

SEQ ID NO: 859551 - RNA, 21 nt, Human
aaacaaauuuaaugaccaaau

SEQ ID NO: 859552 - RNA, 26 nt, Human
aaacaggagagggagaggagggaccc

SEQ ID NO: 859553 - RNA, 24 nt, Human
aaagacagaaagagacagaaagaa

SEQ ID NO: 859554 - RNA, 23 nt, Human
aaagagacagaaagaagcccaga

SEQ ID NO: 859555 - RNA, 22 nt, Human
aacagagagggggagacagacc

SEQ ID NO: 859556 - RNA, 19 nt, Human
aacaguggccaggcccucc

SEQ ID NO: 859557 - RNA, 21 nt, Human
aaccccagaaacagugggggu

SEQ ID NO: 859558 - RNA, 20 nt, Human
aagaagcccagacagacacc

SEQ ID NO: 859559 - RNA, 24 nt, Human
aagacagaaagagacagaaagaag

SEQ ID NO: 859560 - RNA, 22 nt, Human
aagcccagacagacaccaagaa

SEQ ID NO: 859561 - RNA, 22 nt, Human
aagcgcuccguagcagaggcuu

SEQ ID NO: 859562 - RNA, 22 nt, Human
acagcgcagacauaaacagaga

SEQ ID NO: 859563 - RNA, 19 nt, Human
accuuuccuguggcccagg

SEQ ID NO: 859564 - RNA, 23 nt, Human
acuaaccuccggcccacgcacgc

SEQ ID NO: 859565 - RNA, 18 nt, Human
acuugucccuccaaugcu

SEQ ID NO: 859566 - RNA, 20 nt, Human
agaaacaguggggguggggg

SEQ ID NO: 859567 - RNA, 21 nt, Human
agaaagacagaaagagacaga

SEQ ID NO: 859568 - RNA, 23 nt, Human
agaaagacagaaagagacagaaa

SEQ ID NO: 859569 - RNA, 24 nt, Human
agaaagacagaggcaggagacagg

SEQ ID NO: 859570 - RNA, 18 nt, Human
agaaagagacagaaagaa

SEQ ID NO: 859571 - RNA, 23 nt, Human
agaaagagacagaaagaagccca

SEQ ID NO: 859572 - RNA, 26 nt, Human
agacagaaagacagaaagagacagaa

SEQ ID NO: 859573 - RNA, 19 nt, Human
agacagacagcacgggagg

SEQ ID NO: 859574 - RNA, 23 nt, Human
agagacagaaagacagaaagaga

SEQ ID NO: 859575 - RNA, 18 nt, Human
agagagagggggagaaag

SEQ ID NO: 859576 - RNA, 19 nt, Human
agagagggggagaaaggga

SEQ ID NO: 859577 - RNA, 19 nt, Human
agagauaaaggcugagaga

SEQ ID NO: 859578 - RNA, 21 nt, Human
agagauaugaccccaaggucc

SEQ ID NO: 859579 - RNA, 25 nt, Human
agagcugcccccauccucccugccu

SEQ ID NO: 859580 - RNA, 20 nt, Human
agaggcaugaggagucccua

SEQ ID NO: 859581 - RNA, 23 nt, Human
agagggggagacagacagcacgg

SEQ ID NO: 859582 - RNA, 19 nt, Human
agaggggggcugguggggc

SEQ ID NO: 859583 - RNA, 22 nt, Human
agccagccagagcacuggaaag

SEQ ID NO: 859584 - RNA, 20 nt, Human
agcuggccuccggcaagggg

SEQ ID NO: 859585 - RNA, 26 nt, Human
aggcagaaggagagaugggaaccuaa

SEQ ID NO: 859586 - RNA, 23 nt, Human
aggcaggagacaggggggacccc

SEQ ID NO: 859587 - RNA, 21 nt, Human
aggcagguaagagacagacag

SEQ ID NO: 859588 - RNA, 18 nt, Human
aggcccagagugaggcag

SEQ ID NO: 859589 - RNA, 20 nt, Human
aggccccgugauccacagcc

SEQ ID NO: 859590 - RNA, 23 nt, Human
aggcggaggaagggaaaauugug

SEQ ID NO: 859591 - RNA, 19 nt, Human
aggcucggaggucaggaac

SEQ ID NO: 859592 - RNA, 26 nt, Human
agggaaccccagaaacagugggggug

SEQ ID NO: 859593 - RNA, 23 nt, Human
agggggaagaaggggcccagagc

SEQ ID NO: 859594 - RNA, 27 nt, Human
aucuugucugccuccauccagcucuca

SEQ ID NO: 859595 - RNA, 22 nt, Human
auggcccugacaccugagaggc

SEQ ID NO: 859596 - RNA, 23 nt, Human
caaaacccagagauaaaggcuga

SEQ ID NO: 859597 - RNA, 20 nt, Human
caccaagaaagacagaggca

SEQ ID NO: 859598 - RNA, 21 nt, Human
cacuaguucauggggccaucu

SEQ ID NO: 859599 - RNA, 25 nt, Human
cacugagcaggccuggaaucagcug

SEQ ID NO: 859600 - RNA, 18 nt, Human
cagaaacagugggggugg

SEQ ID NO: 859601 - RNA, 19 nt, Human
cagacagcacgggaggcag

SEQ ID NO: 859602 - RNA, 18 nt, Human
cagacagcucucauccug

SEQ ID NO: 859603 - RNA, 22 nt, Human
cagagccuaaggcagagagaga

SEQ ID NO: 859604 - RNA, 19 nt, Human
cagcaccggaaccaaacug

SEQ ID NO: 859605 - RNA, 24 nt, Human
caggagccgggugugggggcaugg

SEQ ID NO: 859606 - RNA, 22 nt, Human
caggauaccaccauuccaucuc

SEQ ID NO: 859607 - RNA, 22 nt, Human
caggcagguaagagacagacag

SEQ ID NO: 859608 - RNA, 20 nt, Human
caguggggguggggguuguc

SEQ ID NO: 859609 - RNA, 20 nt, Human
caucuugucugccuccaucc

SEQ ID NO: 859610 - RNA, 18 nt, Human
cauuuggggaguguaaac

SEQ ID NO: 859611 - RNA, 22 nt, Human
ccagacagacaccaagaaagac

SEQ ID NO: 859612 - RNA, 21 nt, Human
ccagccacgaaaggcccugcc

SEQ ID NO: 859613 - RNA, 23 nt, Human
ccagcuggccuccggcaagggga

SEQ ID NO: 859614 - RNA, 20 nt, Human
ccagguuugagggaaggggg

SEQ ID NO: 859615 - RNA, 18 nt, Human
cccagacagacaccaaga

SEQ ID NO: 859616 - RNA, 21 nt, Human
ccccccucccucuacacucaa

SEQ ID NO: 859617 - RNA, 22 nt, Human
ccccccucccucuacacucaag

SEQ ID NO: 859618 - RNA, 19 nt, Human
ccccuggggcuguauuacu

SEQ ID NO: 859619 - RNA, 20 nt, Human
ccccuggggcuguauuacuc

SEQ ID NO: 859620 - RNA, 24 nt, Human
cccuaggccccgacuuggugaccc

SEQ ID NO: 859621 - RNA, 20 nt, Human
cccugcgguggagacagagc

SEQ ID NO: 859622 - RNA, 21 nt, Human
ccggguccgggugcaccgcug

SEQ ID NO: 859623 - RNA, 18 nt, Human
ccuccggcaaggggagga

SEQ ID NO: 859624 - RNA, 26 nt, Human
ccugcgguggagacagagccuaaggc

SEQ ID NO: 859625 - RNA, 19 nt, Human
ccuggguucccacaggccc

SEQ ID NO: 859626 - RNA, 20 nt, Human
cgccugagaauguuccgggu

SEQ ID NO: 859627 - RNA, 21 nt, Human
cgccuggguucccacaggccc

SEQ ID NO: 859628 - RNA, 22 nt, Human
cgggacaguggcuagcacggag

SEQ ID NO: 859629 - RNA, 20 nt, Human
cgggcccugcggccagcugg

SEQ ID NO: 859630 - RNA, 20 nt, Human
cuaccaucugacccuucuca

SEQ ID NO: 859631 - RNA, 18 nt, Human
cuagagagguggaaaugu

SEQ ID NO: 859632 - RNA, 20 nt, Human
cugagagauaugaccccaag

SEQ ID NO: 859633 - RNA, 18 nt, Human
cugcaugcacacuugucc

SEQ ID NO: 859634 - RNA, 20 nt, Human
cugcaugcacacuugucccu

SEQ ID NO: 859635 - RNA, 21 nt, Human
cugcaugcacacuugucccuc

SEQ ID NO: 859636 - RNA, 20 nt, Human
cugcccccauccucccugcc

SEQ ID NO: 859637 - RNA, 21 nt, Human
cugcccccauccucccugccu

SEQ ID NO: 859638 - RNA, 19 nt, Human
cugcugcuuccuccucugg

SEQ ID NO: 859639 - RNA, 25 nt, Human
cuggaaucagcugccuuguugggga

SEQ ID NO: 859640 - RNA, 20 nt, Human
cuugucugccuccauccagc

SEQ ID NO: 859641 - RNA, 22 nt, Human
gaaaggcccugccagcuggccu

SEQ ID NO: 859642 - RNA, 20 nt, Human
gacagaaagacagaaagaga

SEQ ID NO: 859643 - RNA, 20 nt, Human
gacagagagggacagugaga

SEQ ID NO: 859644 - RNA, 25 nt, Human
gacagugagagcagaggccuagaga

SEQ ID NO: 859645 - RNA, 23 nt, Human
gacaguggcuagcacggagcccc

SEQ ID NO: 859646 - RNA, 23 nt, Human
gagcugcccccauccucccugcc

SEQ ID NO: 859647 - RNA, 20 nt, Human
gaggcagaaggagagauggg

SEQ ID NO: 859648 - RNA, 18 nt, Human
gaggcagcugcgcugggg

SEQ ID NO: 859649 - RNA, 18 nt, Human
gaggguccuucaggcuug

SEQ ID NO: 859650 - RNA, 18 nt, Human
gaggucaggaaccgugga

SEQ ID NO: 859651 - RNA, 24 nt, Human
gaguggccuugaggaagcaacauc

SEQ ID NO: 859652 - RNA, 19 nt, Human
gaugguggugugugugggu

SEQ ID NO: 859653 - RNA, 26 nt, Human
gcaggagacagggugggaggucgacc

SEQ ID NO: 859654 - RNA, 22 nt, Human
gcagggggcuccauggggcggg

SEQ ID NO: 859655 - RNA, 21 nt, Human
gcccgguggcugagucaccag

SEQ ID NO: 859656 - RNA, 21 nt, Human
gcccugacaccugagaggcca

SEQ ID NO: 859657 - RNA, 22 nt, Human
gccuaccaucugacccuucuca

SEQ ID NO: 859658 - RNA, 19 nt, Human
gccuaucaccaagggcuga

SEQ ID NO: 859659 - RNA, 21 nt, Human
gccuugaggaagcaacaucuu

SEQ ID NO: 859660 - RNA, 21 nt, Human
gcucggaggucaggaaccgug

SEQ ID NO: 859661 - RNA, 21 nt, Human
ggaaccccagaaacagugggg

SEQ ID NO: 859662 - RNA, 18 nt, Human
ggaagaaggggcccagag

SEQ ID NO: 859663 - RNA, 21 nt, Human
ggaaucagcugccuuguuggg

SEQ ID NO: 859664 - RNA, 18 nt, Human
ggagacagggugggagag

SEQ ID NO: 859665 - RNA, 21 nt, Human
ggagacagggugggagagaug

SEQ ID NO: 859666 - RNA, 24 nt, Human
ggagaggaaggcggaggaagggaa

SEQ ID NO: 859667 - RNA, 24 nt, Human
ggccagacagccaagugguuucua

SEQ ID NO: 859668 - RNA, 19 nt, Human
ggcucggaggucaggaacc

SEQ ID NO: 859669 - RNA, 23 nt, Human
ggcugagagacagacagagaggg

SEQ ID NO: 859670 - RNA, 23 nt, Human
gggacaguggcuagcacggagaa

SEQ ID NO: 859671 - RNA, 21 nt, Human
gggccccgcacacuaaccucc

SEQ ID NO: 859672 - RNA, 23 nt, Human
gggcggcagggggcuccaugggg

SEQ ID NO: 859673 - RNA, 21 nt, Human
gggcuccauggggcgggcccu

SEQ ID NO: 859674 - RNA, 22 nt, Human
gggcugguggggcugagaaggg

SEQ ID NO: 859675 - RNA, 26 nt, Human
ggggaagaaggggcccagagccugga

SEQ ID NO: 859676 - RNA, 18 nt, Human
ggggauggggauggggca

SEQ ID NO: 859677 - RNA, 20 nt, Human
ggggauggggcaggcggugg

SEQ ID NO: 859678 - RNA, 20 nt, Human
gggguggggguugucugaga

SEQ ID NO: 859679 - RNA, 18 nt, Human
ggguuccuguuucauuuc

SEQ ID NO: 859680 - RNA, 18 nt, Human
gguagaguccccccuccc

SEQ ID NO: 859681 - RNA, 24 nt, Human
gugaggcagaaggagagaugggaa

SEQ ID NO: 859682 - RNA, 22 nt, Human
gugggagagaugagaaagggaa

SEQ ID NO: 859683 - RNA, 21 nt, Human
guuccggguccgggugcaccg

SEQ ID NO: 859684 - RNA, 18 nt, Human
uaaggcagagagagaggg

SEQ ID NO: 859685 - RNA, 21 nt, Human
uagcugcugcuuccuccucug

SEQ ID NO: 859686 - RNA, 25 nt, Human
uaguucauggggccaucugaggauc

SEQ ID NO: 859687 - RNA, 19 nt, Human
uaucaccaagggcugauac

SEQ ID NO: 859688 - RNA, 21 nt, Human
uauuacucaguggucaggguu

SEQ ID NO: 859689 - RNA, 25 nt, Human
uauuacucaguggucaggguucugc

SEQ ID NO: 859690 - RNA, 19 nt, Human
uccaaugcugucucacucu

SEQ ID NO: 859691 - RNA, 24 nt, Human
uccaggccuccuuugacccacuuc

SEQ ID NO: 859692 - RNA, 22 nt, Human
uccccccucccucuacacucaa

SEQ ID NO: 859693 - RNA, 21 nt, Human
ucgcucugagcaucuugucug

SEQ ID NO: 859694 - RNA, 23 nt, Human
ucggaggucaggaaccguggacu

SEQ ID NO: 859695 - RNA, 20 nt, Human
ucuaggccuggguuccuguu

SEQ ID NO: 859696 - RNA, 22 nt, Human
ucucacucuggauggcccugac

SEQ ID NO: 859697 - RNA, 26 nt, Human
ucugcugggggagcaggagccgggug

SEQ ID NO: 859698 - RNA, 18 nt, Human
ugaccaaaugauagacug

SEQ ID NO: 859699 - RNA, 27 nt, Human
ugagaaggguagaguccccccucccuc

SEQ ID NO: 859700 - RNA, 23 nt, Human
ugagagacagacagagagggaca

SEQ ID NO: 859701 - RNA, 22 nt, Human
ugagagcagaggccuagagagg

SEQ ID NO: 859702 - RNA, 19 nt, Human
ugagaugguggugugugug

SEQ ID NO: 859703 - RNA, 19 nt, Human
ugaggaagcaacaucuuuc

SEQ ID NO: 859704 - RNA, 18 nt, Human
ugccuccauccagcucuc

SEQ ID NO: 859705 - RNA, 19 nt, Human
ugcggccagcugggggcag

SEQ ID NO: 859706 - RNA, 21 nt, Human
ugcgguggagacagagccuaa

SEQ ID NO: 859707 - RNA, 21 nt, Human
uggagacagagccuaaggcag

SEQ ID NO: 859708 - RNA, 18 nt, Human
uggcuagcacggagcccu

SEQ ID NO: 859709 - RNA, 24 nt, Human
ugggcagaggggggcugguggggc

SEQ ID NO: 859710 - RNA, 21 nt, Human
ugggggagcaggagccgggug

SEQ ID NO: 859711 - RNA, 19 nt, Human
ugguggggcugagaagggu

SEQ ID NO: 859712 - RNA, 19 nt, Human
ugguugggcagaggggggc

SEQ ID NO: 859713 - RNA, 20 nt, Human
ugguugggcagaggggggcu

SEQ ID NO: 859714 - RNA, 23 nt, Human
uguaaacaaauuuaaugaccaaa

SEQ ID NO: 859715 - RNA, 23 nt, Human
ugucaggcacuucgcucgggccu

SEQ ID NO: 859716 - RNA, 22 nt, Human
ugucugagaugagacuagaccc

SEQ ID NO: 859717 - RNA, 23 nt, Human
ugugugcccccucaacaguggcc

SEQ ID NO: 859718 - RNA, 23 nt, Human
uuccaggccuccuuugacccacu

SEQ ID NO: 859719 - RNA, 22 nt, Human
uugcccugugugcccccucaac

SEQ ID NO: 859720 - RNA, 19 nt, Human
uuucaccuugggcccugcg

SEQ ID NO: 859721 - RNA, 19 nt, Human
uuuccaggccuccuuugac

SEQ ID NO: 859722 - RNA, 23 nt, Human
uuucugagagauaugaccccaag

SEQ ID NO: 859723 - RNA, 18 nt, Human
uuuuuuuuuuauagcaaa

SEQ ID NO: 859724 - RNA, 22 nt, Human
aagcuuuacucagaggaacagc

SEQ ID NO: 859725 - RNA, 18 nt, Human
agcaaauggcccccuccc

SEQ ID NO: 859726 - RNA, 24 nt, Human
agcacagggauugggggacuucca

SEQ ID NO: 859727 - RNA, 19 nt, Human
aggcagagcugcugggagg

SEQ ID NO: 859728 - RNA, 20 nt, Human
auccgcccuccccgcuccuc

SEQ ID NO: 859729 - RNA, 22 nt, Human
caaauggcccccucccaucccu

SEQ ID NO: 859730 - RNA, 25 nt, Human
cagaggaacagcaaauggcccccuc

SEQ ID NO: 859731 - RNA, 18 nt, Human
cagcaaauggcccccucc

SEQ ID NO: 859732 - RNA, 24 nt, Human
cagcaaauggcccccucccauccc

SEQ ID NO: 859733 - RNA, 20 nt, Human
ccauccccucaucgggaucc

SEQ ID NO: 859734 - RNA, 19 nt, Human
ccccagcccugggauggcg

SEQ ID NO: 859735 - RNA, 28 nt, Human
cccccaagcccacgaucugggggcaggg

SEQ ID NO: 859736 - RNA, 18 nt, Human
cccccucccaucccugcu

SEQ ID NO: 859737 - RNA, 20 nt, Human
ccccugggauagaauccugg

SEQ ID NO: 859738 - RNA, 19 nt, Human
cgaggacccuucugccucc

SEQ ID NO: 859739 - RNA, 22 nt, Human
cugcugggaggaagaagaagaa

SEQ ID NO: 859740 - RNA, 18 nt, Human
gauccgcccuccccgcuc

SEQ ID NO: 859741 - RNA, 20 nt, Human
gcugggaggaagaagaagaa

SEQ ID NO: 859742 - RNA, 20 nt, Human
ggacccagaaaacccccugg

SEQ ID NO: 859743 - RNA, 19 nt, Human
ggcgcgguccauccccuca

SEQ ID NO: 859744 - RNA, 22 nt, Human
ggcuguggcuuccaggcugcag

SEQ ID NO: 859745 - RNA, 20 nt, Human
uccccgcuccuccccagccc

SEQ ID NO: 859746 - RNA, 21 nt, Human
uccccgcuccuccccagcccu

SEQ ID NO: 859747 - RNA, 21 nt, Human
uccccgugcuugagagggcuc

SEQ ID NO: 859748 - RNA, 23 nt, Human
uccgcccuccccgcuccucccca

SEQ ID NO: 859749 - RNA, 21 nt, Human
uccugaaaugggcgaggaccc

SEQ ID NO: 859750 - RNA, 22 nt, Human
ugcagcuuucuugcuguccccc

SEQ ID NO: 859751 - RNA, 23 nt, Human
uggcaacaccucaagccuguggg

SEQ ID NO: 859752 - RNA, 23 nt, Human
uggcuuccaggcugcagauuccu

SEQ ID NO: 859753 - RNA, 23 nt, Human
ugggauagaauccuggcaacacc

SEQ ID NO: 859754 - RNA, 25 nt, Human
ugggggacccagaaaacccccuggg

SEQ ID NO: 859755 - RNA, 23 nt, Human
ugggggacuuccaggcagagcug

SEQ ID NO: 859756 - RNA, 24 nt, Human
ugggggcaggagcacagggauugg

SEQ ID NO: 859757 - RNA, 18 nt, Human
uuugcagcuuucuugcug

SEQ ID NO: 859758 - RNA, 23 nt, Human
uuuucaugcagaacaagcuuuac

SEQ ID NO: 859759 - RNA, 23 nt, Human
aaagugcuguagcucacuggcuc

SEQ ID NO: 859760 - RNA, 23 nt, Human
acagcagaggcuguuagaaaccu

SEQ ID NO: 859761 - RNA, 23 nt, Human
acuucagaaauuucaaaaacaac

SEQ ID NO: 859762 - RNA, 21 nt, Human
agaggcuguuagaaaccuugg

SEQ ID NO: 859763 - RNA, 19 nt, Human
caacagcagaggcuguuag

SEQ ID NO: 859764 - RNA, 19 nt, Human
cauguuacacaaauuuucc

SEQ ID NO: 859765 - RNA, 22 nt, Human
gagagacagcacuuuuuauaca

SEQ ID NO: 859766 - RNA, 20 nt, Human
gcauuuugguauauaacacu

SEQ ID NO: 859767 - RNA, 22 nt, Human
uacaacagcagaggcuguuaga

SEQ ID NO: 859768 - RNA, 20 nt, Human
uacccaaaucuugaggcauu

SEQ ID NO: 859769 - RNA, 22 nt, Human
uaccucaaaaacauguuacaca

SEQ ID NO: 859770 - RNA, 19 nt, Human
uacugagagacagcacuuu

SEQ ID NO: 859771 - RNA, 21 nt, Human
uacugagagacagcacuuuuu

SEQ ID NO: 859772 - RNA, 19 nt, Human
uauacaacagcagaggcug

SEQ ID NO: 859773 - RNA, 24 nt, Human
uauuuacaacuuacagauuuuaca

SEQ ID NO: 859774 - RNA, 22 nt, Human
uggcauuuugguauauaacacu

SEQ ID NO: 859775 - RNA, 23 nt, Human
uuuuuauacaacagcagaggcug

SEQ ID NO: 859776 - RNA, 19 nt, Human
aaaaaaccucaacacaaga

SEQ ID NO: 859777 - RNA, 24 nt, Human
aaaaacauucucugcaaaugagga

SEQ ID NO: 859778 - RNA, 23 nt, Human
aaagacaaaaaaaaaagcuccug

SEQ ID NO: 859779 - RNA, 26 nt, Human
aaauaaccagugaaaacccaugaagc

SEQ ID NO: 859780 - RNA, 18 nt, Human
aaauaaccagugaacagc

SEQ ID NO: 859781 - RNA, 23 nt, Human
aaauaaccagugaacagcaacau

SEQ ID NO: 859782 - RNA, 20 nt, Human
aaauuaguaggcucaaauaa

SEQ ID NO: 859783 - RNA, 19 nt, Human
aacauuuuaucuuccuuua

SEQ ID NO: 859784 - RNA, 20 nt, Human
aagaaggguaggaggcggug

SEQ ID NO: 859785 - RNA, 21 nt, Human
aagcaaugcugccuuggccuc

SEQ ID NO: 859786 - RNA, 22 nt, Human
aagcagaagccgaugggcagag

SEQ ID NO: 859787 - RNA, 22 nt, Human
aagcagaagccgaugggcagag

SEQ ID NO: 859788 - RNA, 22 nt, Human
aagcagaagccggucggcagag

SEQ ID NO: 859789 - RNA, 21 nt, Human
aagcuacacauuuuuucccug

SEQ ID NO: 859790 - RNA, 26 nt, Human
aagcugcuccuccucuggcucuucca

SEQ ID NO: 859791 - RNA, 20 nt, Human
acaagaaaggaacuuucagc

SEQ ID NO: 859792 - RNA, 23 nt, Human
acacauuuuuucccuggagguuc

SEQ ID NO: 859793 - RNA, 21 nt, Human
acagacagcaugaaagggaac

SEQ ID NO: 859794 - RNA, 19 nt, Human
accaguauacacacaugca

SEQ ID NO: 859795 - RNA, 19 nt, Human
accaugccagauguagcau

SEQ ID NO: 859796 - RNA, 19 nt, Human
accuggaggcugcaaggcu

SEQ ID NO: 859797 - RNA, 18 nt, Human
aggaggcggugguggugg

SEQ ID NO: 859798 - RNA, 25 nt, Human
aggcgguggagggggagccuggggc

SEQ ID NO: 859799 - RNA, 23 nt, Human
aggcucaaauaaaaaucugaaac

SEQ ID NO: 859800 - RNA, 19 nt, Human
auacuaaaguacugaaacc

SEQ ID NO: 859801 - RNA, 22 nt, Human
aucaaaacauguccuaauuuua

SEQ ID NO: 859802 - RNA, 18 nt, Human
auccucuccuuguucuug

SEQ ID NO: 859803 - RNA, 20 nt, Human
augaaagggaaccgcauaca

SEQ ID NO: 859804 - RNA, 19 nt, Human
augacauuuucccauuuuu

SEQ ID NO: 859805 - RNA, 20 nt, Human
auuccuccucuggaaguauc

SEQ ID NO: 859806 - RNA, 22 nt, Human
caaacgauggcaucaaaaccaa

SEQ ID NO: 859807 - RNA, 19 nt, Human
cacaagaaaggaacuuuca

SEQ ID NO: 859808 - RNA, 18 nt, Human
caccggaccuggaggcug

SEQ ID NO: 859809 - RNA, 19 nt, Human
cagaagccgaugggcagag

SEQ ID NO: 859810 - RNA, 19 nt, Human
cagaagccggucggcagag

SEQ ID NO: 859811 - RNA, 23 nt, Human
cagacaaacucauaacucuaaag

SEQ ID NO: 859812 - RNA, 24 nt, Human
cagcacucucaaacgauggcauca

SEQ ID NO: 859813 - RNA, 25 nt, Human
caguauacacacaugcaaccacaca

SEQ ID NO: 859814 - RNA, 22 nt, Human
cauccuuggggucucuagcugg

SEQ ID NO: 859815 - RNA, 24 nt, Human
caucugagagccuaauaauuguuc

SEQ ID NO: 859816 - RNA, 22 nt, Human
cauuuuuuuaauaaaaagaaaa

SEQ ID NO: 859817 - RNA, 22 nt, Human
ccaaaaaaugacauuuucccau

SEQ ID NO: 859818 - RNA, 21 nt, Human
ccaugccagauguagcauuca

SEQ ID NO: 859819 - RNA, 23 nt, Human
cccaaaaaaugacauuuucccau

SEQ ID NO: 859820 - RNA, 23 nt, Human
cccacaccacgacacaucagcgg

SEQ ID NO: 859821 - RNA, 23 nt, Human
ccccacaccacgacacaucagcg

SEQ ID NO: 859822 - RNA, 22 nt, Human
cccuggagguucacucaggaug

SEQ ID NO: 859823 - RNA, 18 nt, Human
cccuuugaagugcggguu

SEQ ID NO: 859824 - RNA, 22 nt, Human
ccuccuguaaauucaucuaaag

SEQ ID NO: 859825 - RNA, 22 nt, Human
ccugaaacuccuaagaagaaag

SEQ ID NO: 859826 - RNA, 26 nt, Human
ccugccccucucggugcucucucucc

SEQ ID NO: 859827 - RNA, 18 nt, Human
ccuggcugagugaauggu

SEQ ID NO: 859828 - RNA, 23 nt, Human
ccugggccuggcaggaacggcug

SEQ ID NO: 859829 - RNA, 20 nt, Human
cuccucgccguccuccccgc

SEQ ID NO: 859830 - RNA, 21 nt, Human
cucuggggucccacggcaggu

SEQ ID NO: 859831 - RNA, 23 nt, Human
cugcggcuggaacaggccggggc

SEQ ID NO: 859832 - RNA, 18 nt, Human
cuggagcuguagcguccu

SEQ ID NO: 859833 - RNA, 24 nt, Human
cugggccuggcaggaacggcuguc

SEQ ID NO: 859834 - RNA, 23 nt, Human
cuguccuugcugauuaaaugcug

SEQ ID NO: 859835 - RNA, 20 nt, Human
cuucaaauaaccagugaaaa

SEQ ID NO: 859836 - RNA, 19 nt, Human
cuugaacaggcgugaccac

SEQ ID NO: 859837 - RNA, 19 nt, Human
gaaagauguuacagacgca

SEQ ID NO: 859838 - RNA, 23 nt, Human
gaacaggcgugaccaccgucccu

SEQ ID NO: 859839 - RNA, 18 nt, Human
gaacugguagcaagggca

SEQ ID NO: 859840 - RNA, 21 nt, Human
gacacaucagcggaccuccuc

SEQ ID NO: 859841 - RNA, 19 nt, Human
gaccuggaggcugcaaggc

SEQ ID NO: 859842 - RNA, 19 nt, Human
gacugauucuuuuugccag

SEQ ID NO: 859843 - RNA, 30 nt, Human
gcuaaagugcagaauccccaccggaccugg

SEQ ID NO: 859844 - RNA, 24 nt, Human
gcucucucuccucuggucccccac

SEQ ID NO: 859845 - RNA, 23 nt, Human
gcugcaccggaagcagcggcugc

SEQ ID NO: 859846 - RNA, 21 nt, Human
ggaaaaagcagguggcgagaa

SEQ ID NO: 859847 - RNA, 23 nt, Human
ggagccuggggcucucuagaggc

SEQ ID NO: 859848 - RNA, 20 nt, Human
ggauggguggugcgggugcu

SEQ ID NO: 859849 - RNA, 25 nt, Human
ggcagaaacggcuguccugggccug

SEQ ID NO: 859850 - RNA, 22 nt, Human
ggcagagggcacucaaggccuu

SEQ ID NO: 859851 - RNA, 22 nt, Human
ggcagagggcacucaaggccuu

SEQ ID NO: 859852 - RNA, 19 nt, Human
ggccuggcaggaacggcug

SEQ ID NO: 859853 - RNA, 19 nt, Human
ggcucaaauaaaaaucuga

SEQ ID NO: 859854 - RNA, 24 nt, Human
gggcagagggcacucaaggccuuc

SEQ ID NO: 859855 - RNA, 22 nt, Human
uaaaaaaccucaacacaagaaa

SEQ ID NO: 859856 - RNA, 19 nt, Human
uaaaaacauuuuaucuucc

SEQ ID NO: 859857 - RNA, 18 nt, Human
uaaaaugcaguaauaagc

SEQ ID NO: 859858 - RNA, 21 nt, Human
uaaagugcagaauccccaccg

SEQ ID NO: 859859 - RNA, 24 nt, Human
uaaccagugaaaacccaugaagca

SEQ ID NO: 859860 - RNA, 21 nt, Human
uaaguaacauuguugaaaaaa

SEQ ID NO: 859861 - RNA, 18 nt, Human
uaauaguaacccuacaau

SEQ ID NO: 859862 - RNA, 21 nt, Human
uaguaggcucaaauaaaaauc

SEQ ID NO: 859863 - RNA, 18 nt, Human
uauacaauucugauccau

SEQ ID NO: 859864 - RNA, 22 nt, Human
uauacaauucugauccaucaga

SEQ ID NO: 859865 - RNA, 23 nt, Human
uauggaacacaaagccuugaagc

SEQ ID NO: 859866 - RNA, 21 nt, Human
ucaaauaaccagugaaaaccc

SEQ ID NO: 859867 - RNA, 19 nt, Human
ucaaauucaagcaaugcug

SEQ ID NO: 859868 - RNA, 19 nt, Human
ucauacuguccuucuucug

SEQ ID NO: 859869 - RNA, 25 nt, Human
uccagauuggucguuaguguuguca

SEQ ID NO: 859870 - RNA, 18 nt, Human
uccaucagauuugugaua

SEQ ID NO: 859871 - RNA, 22 nt, Human
ucccugaggcggggaugggugg

SEQ ID NO: 859872 - RNA, 23 nt, Human
ucccugaggcggggauggguggu

SEQ ID NO: 859873 - RNA, 20 nt, Human
uccuugcugauuaaaugcug

SEQ ID NO: 859874 - RNA, 18 nt, Human
ucucggugcucucucucc

SEQ ID NO: 859875 - RNA, 21 nt, Human
ucugcaauggggauguauuaa

SEQ ID NO: 859876 - RNA, 22 nt, Human
ucugcugaaagcuccaaaguuu

SEQ ID NO: 859877 - RNA, 20 nt, Human
ucuuuaaauaaccacaaauu

SEQ ID NO: 859878 - RNA, 20 nt, Human
ugaaagcuccaaaguuucug

SEQ ID NO: 859879 - RNA, 18 nt, Human
ugaagcagaagccggucg

SEQ ID NO: 859880 - RNA, 22 nt, Human
ugaggcggcggaggcgguggag

SEQ ID NO: 859881 - RNA, 20 nt, Human
ugaggcggggguggggcucu

SEQ ID NO: 859882 - RNA, 22 nt, Human
ugcaauggggauguauuaauug

SEQ ID NO: 859883 - RNA, 18 nt, Human
ugcagacaaacucauaac

SEQ ID NO: 859884 - RNA, 22 nt, Human
ugccuuggccucugcugaaagc

SEQ ID NO: 859885 - RNA, 22 nt, Human
ugcuccuccucuggcucuucca

SEQ ID NO: 859886 - RNA, 21 nt, Human
uggcgagaagaugugcauuua

SEQ ID NO: 859887 - RNA, 20 nt, Human
uggcucggaacugguagcaa

SEQ ID NO: 859888 - RNA, 21 nt, Human
ugggaaucucuggggucccac

SEQ ID NO: 859889 - RNA, 24 nt, Human
uggggcucuccacugguccuggag

SEQ ID NO: 859890 - RNA, 21 nt, Human
ugguggagggggacuucgcug

SEQ ID NO: 859891 - RNA, 22 nt, Human
uggugguggagggggacuucgc

SEQ ID NO: 859892 - RNA, 23 nt, Human
uggugguggagggggacuucgcu

SEQ ID NO: 859893 - RNA, 19 nt, Human
ugguucaccugaaacuccu

SEQ ID NO: 859894 - RNA, 20 nt, Human
uguaugcuguggaaauucug

SEQ ID NO: 859895 - RNA, 24 nt, Human
ugucagagaguucaaaugauguaa

SEQ ID NO: 859896 - RNA, 24 nt, Human
uguuaagaaggguaggaggcggug

SEQ ID NO: 859897 - RNA, 18 nt, Human
uguuacagacgcauguca

SEQ ID NO: 859898 - RNA, 19 nt, Human
uucaaauucaagcaaugcu

SEQ ID NO: 859899 - RNA, 23 nt, Human
uucagcgauaccaaaacuucauu

SEQ ID NO: 859900 - RNA, 22 nt, Human
uucaucuucauuaucacucugc

SEQ ID NO: 859901 - RNA, 25 nt, Human
uucucugcaaaugaggacauucuau

SEQ ID NO: 859902 - RNA, 23 nt, Human
uugaaaauuucugcaauggggau

SEQ ID NO: 859903 - RNA, 24 nt, Human
uugaagcuacacauuuuuucccug

SEQ ID NO: 859904 - RNA, 21 nt, Human
uugauguccuuuugaaguucc

SEQ ID NO: 859905 - RNA, 21 nt, Human
uuuagacuugcugaugaaggu

SEQ ID NO: 859906 - RNA, 22 nt, Human
uuugccagauagcaaaucuucu

SEQ ID NO: 859907 - RNA, 21 nt, Human
uuuuauacagaugagcaaaug

SEQ ID NO: 859908 - RNA, 23 nt, Human
uuuuuuuuuuuuuuuuuuacaag

SEQ ID NO: 859909 - RNA, 29 nt, Human
uuuuuuuuuuuuuuuuuuuuuuacaagaa

SEQ ID NO: 859910 - RNA, 21 nt, Human
aacccaaggcagaagaacagg

SEQ ID NO: 859911 - RNA, 19 nt, Human
agauguuucagccacgacc

SEQ ID NO: 859912 - RNA, 21 nt, Human
agcagguggaagcuggggcag

SEQ ID NO: 859913 - RNA, 18 nt, Human
agcugggggcaggaagcc

SEQ ID NO: 859914 - RNA, 25 nt, Human
aggaagccaacccaggccccauagg

SEQ ID NO: 859915 - RNA, 20 nt, Human
aggcagaagaacaggagccc

SEQ ID NO: 859916 - RNA, 20 nt, Human
auauugcuuggaaugcuuua

SEQ ID NO: 859917 - RNA, 21 nt, Human
augagauggucagguggguca

SEQ ID NO: 859918 - RNA, 19 nt, Human
caaaucccauggccuggaa

SEQ ID NO: 859919 - RNA, 21 nt, Human
caaaucccauggccuggagag

SEQ ID NO: 859920 - RNA, 21 nt, Human
caacccaaggcagaagaacag

SEQ ID NO: 859921 - RNA, 20 nt, Human
cagaagaacaggagccucug

SEQ ID NO: 859922 - RNA, 24 nt, Human
cagauguuucagccacgaccaaug

SEQ ID NO: 859923 - RNA, 19 nt, Human
cagcacucaggucccuugg

SEQ ID NO: 859924 - RNA, 19 nt, Human
cagcagcuggagggccugc

SEQ ID NO: 859925 - RNA, 19 nt, Human
caggagccucuguggccag

SEQ ID NO: 859926 - RNA, 18 nt, Human
cucaggucccuugggcuc

SEQ ID NO: 859927 - RNA, 21 nt, Human
cugcagcugggggcaggaagc

SEQ ID NO: 859928 - RNA, 19 nt, Human
cuguggccagcagcuggag

SEQ ID NO: 859929 - RNA, 22 nt, Human
cuugagcuugcggauagcagca

SEQ ID NO: 859930 - RNA, 18 nt, Human
gaagccaacccaggcccc

SEQ ID NO: 859931 - RNA, 18 nt, Human
gaagccaacccaggcccc

SEQ ID NO: 859932 - RNA, 18 nt, Human
gcagaaagggugagggca

SEQ ID NO: 859933 - RNA, 21 nt, Human
gcagauggggagcagguggaa

SEQ ID NO: 859934 - RNA, 22 nt, Human
gcuggagggccugcucaaucug

SEQ ID NO: 859935 - RNA, 18 nt, Human
ggacuguuccaggcuugu

SEQ ID NO: 859936 - RNA, 24 nt, Human
ggcagaagaacaggagccucugug

SEQ ID NO: 859937 - RNA, 21 nt, Human
gggcagaaagggugagggcag

SEQ ID NO: 859938 - RNA, 18 nt, Human
uagaaucucugggaucuu

SEQ ID NO: 859939 - RNA, 20 nt, Human
uagcaagcaaacaaguaggc

SEQ ID NO: 859940 - RNA, 19 nt, Human
uagcugcagcugggggcag

SEQ ID NO: 859941 - RNA, 23 nt, Human
uauuccaggacuucuccuggcug

SEQ ID NO: 859942 - RNA, 22 nt, Human
ucaggaaaggugcaaaaggcaa

SEQ ID NO: 859943 - RNA, 22 nt, Human
ucaggucccuugggcucagcug

SEQ ID NO: 859944 - RNA, 25 nt, Human
ucaggugggucagcaggcagguagc

SEQ ID NO: 859945 - RNA, 28 nt, Human
ucccuugggcucagcuguaucugaaaca

SEQ ID NO: 859946 - RNA, 18 nt, Human
ucucagguauugugcucu

SEQ ID NO: 859947 - RNA, 23 nt, Human
ucuguggccagcagcuggagggc

SEQ ID NO: 859948 - RNA, 21 nt, Human
ugagauggucaggugggucag

SEQ ID NO: 859949 - RNA, 21 nt, Human
ugagugccuguagauuggcau

SEQ ID NO: 859950 - RNA, 21 nt, Human
ugcagagggugggaagggucc

SEQ ID NO: 859951 - RNA, 23 nt, Human
ugccuguagauuggcaugguggu

SEQ ID NO: 859952 - RNA, 22 nt, Human
ugcuaaaacaaaucucaggagc

SEQ ID NO: 859953 - RNA, 18 nt, Human
uggcagcacucagguccc

SEQ ID NO: 859954 - RNA, 21 nt, Human
uggcagcacucaggucccuug

SEQ ID NO: 859955 - RNA, 19 nt, Human
uggcaugccacaugggcuu

SEQ ID NO: 859956 - RNA, 20 nt, Human
ugggcagauggggagcaggu

SEQ ID NO: 859957 - RNA, 24 nt, Human
ugggggcaggaagccaacccaggc

SEQ ID NO: 859958 - RNA, 19 nt, Human
ugguguccccuucaguagc

SEQ ID NO: 859959 - RNA, 19 nt, Human
ugguuagaaucucugggau

SEQ ID NO: 859960 - RNA, 22 nt, Human
ugguucccaaaucccauggccu

SEQ ID NO: 859961 - RNA, 18 nt, Human
uguucgagagauggcaug

SEQ ID NO: 859962 - RNA, 18 nt, Human
uucgagagauggcaugcc

SEQ ID NO: 859963 - RNA, 18 nt, Human
uuuuuuuuuuuuuuuuug

SEQ ID NO: 859964 - RNA, 26 nt, Human
aaagaagcccagccucucucccugga

SEQ ID NO: 859965 - RNA, 19 nt, Human
aacaaaugagagaaagaag

SEQ ID NO: 859966 - RNA, 22 nt, Human
aacuuacacauuacacauaaga

SEQ ID NO: 859967 - RNA, 18 nt, Human
aauuuggguuuuuuccuu

SEQ ID NO: 859968 - RNA, 19 nt, Human
acaaaugagagaaagaagc

SEQ ID NO: 859969 - RNA, 19 nt, Human
acucacgugacaauucacc

SEQ ID NO: 859970 - RNA, 22 nt, Human
acuuucacauuugaucuuuagc

SEQ ID NO: 859971 - RNA, 23 nt, Human
agacagcugcucggcgugugugu

SEQ ID NO: 859972 - RNA, 28 nt, Human
agacuucuaaccugcagagacagagcuc

SEQ ID NO: 859973 - RNA, 25 nt, Human
agagaagccccagauggggcuugga

SEQ ID NO: 859974 - RNA, 20 nt, Human
agccaggaaaccugccacaa

SEQ ID NO: 859975 - RNA, 19 nt, Human
aggagaagccaugcaugaa

SEQ ID NO: 859976 - RNA, 19 nt, Human
aguaaaaaauacauauaca

SEQ ID NO: 859977 - RNA, 20 nt, Human
caaggagcagacuucacucu

SEQ ID NO: 859978 - RNA, 23 nt, Human
cacagaggaaagcagcauuuuga

SEQ ID NO: 859979 - RNA, 21 nt, Human
cagacuucacucuuacuggcc

SEQ ID NO: 859980 - RNA, 23 nt, Human
cauauacacagacauaaacaccc

SEQ ID NO: 859981 - RNA, 22 nt, Human
ccacgcugcucgcucuggaccc

SEQ ID NO: 859982 - RNA, 19 nt, Human
cccacauuuucacacuucu

SEQ ID NO: 859983 - RNA, 19 nt, Human
cccaguaaacgcuuggcuc

SEQ ID NO: 859984 - RNA, 24 nt, Human
cccggaggaaaucgggaggggcgg

SEQ ID NO: 859985 - RNA, 19 nt, Human
cggaagaggcaagaaaaua

SEQ ID NO: 859986 - RNA, 20 nt, Human
cggcgugugugugugugugu

SEQ ID NO: 859987 - RNA, 19 nt, Human
cgggcucagccaggaaacc

SEQ ID NO: 859988 - RNA, 21 nt, Human
cgugugugugugugugugugu

SEQ ID NO: 859989 - RNA, 23 nt, Human
cuccacgcugcucgcucuggacc

SEQ ID NO: 859990 - RNA, 22 nt, Human
cugcucgcucuggacccgagac

SEQ ID NO: 859991 - RNA, 30 nt, Human
cugcucggcgugugugugugugugugugug

SEQ ID NO: 859992 - RNA, 21 nt, Human
cuggcccuuuuuaagugcagg

SEQ ID NO: 859993 - RNA, 21 nt, Human
cuucaguggauuucucccugc

SEQ ID NO: 859994 - RNA, 23 nt, Human
cuugcagcuguuuucuuugugga

SEQ ID NO: 859995 - RNA, 20 nt, Human
gcagagacagagcucagcca

SEQ ID NO: 859996 - RNA, 20 nt, Human
gcccauuuguuccacaagga

SEQ ID NO: 859997 - RNA, 24 nt, Human
ggaaauuuggguuuuuuccuucag

SEQ ID NO: 859998 - RNA, 21 nt, Human
ggacccgagacagcugcucgg

SEQ ID NO: 859999 - RNA, 21 nt, Human
gugugugugugugugugugug

SEQ ID NO: 860000 - RNA, 21 nt, Human
gugugugugugugugugugug

SEQ ID NO: 860001 - RNA, 21 nt, Human
gugugugugugugugugugug

SEQ ID NO: 860002 - RNA, 21 nt, Human
gugugugugugugugugugug

SEQ ID NO: 860003 - RNA, 21 nt, Human
gugugugugugugugugugug

SEQ ID NO: 860004 - RNA, 21 nt, Human
gugugugugugugugugugug

SEQ ID NO: 860005 - RNA, 21 nt, Human
gugugugugugugugugugug

SEQ ID NO: 860006 - RNA, 21 nt, Human
gugugugugugugugugugug

SEQ ID NO: 860007 - RNA, 21 nt, Human
gugugugugugugugugugug

SEQ ID NO: 860008 - RNA, 22 nt, Human
guuuucuuuguggaguggaaau

SEQ ID NO: 860009 - RNA, 23 nt, Human
uaaccugcagagacagagcucag

SEQ ID NO: 860010 - RNA, 19 nt, Human
uacacagacauaaacaccc

SEQ ID NO: 860011 - RNA, 19 nt, Human
uacacagacauaaacaccc

SEQ ID NO: 860012 - RNA, 21 nt, Human
uacacagacauaaacacccac

SEQ ID NO: 860013 - RNA, 18 nt, Human
uagcccggaggaaaucgg

SEQ ID NO: 860014 - RNA, 23 nt, Human
uccacaaggaacaaaugagagaa

SEQ ID NO: 860015 - RNA, 19 nt, Human
ucccugggggcuugcagcu

SEQ ID NO: 860016 - RNA, 22 nt, Human
ucucccugcugcugucacugag

SEQ ID NO: 860017 - RNA, 24 nt, Human
ugagaaaaguuuuauauggaaaca

SEQ ID NO: 860018 - RNA, 18 nt, Human
ugccagccccagguaagu

SEQ ID NO: 860019 - RNA, 24 nt, Human
ugcuugggacacaagcaugaaugu

SEQ ID NO: 860020 - RNA, 24 nt, Human
uggacccgagacagcugcucggcg

SEQ ID NO: 860021 - RNA, 20 nt, Human
uggcccuuuuuaagugcagg

SEQ ID NO: 860022 - RNA, 23 nt, Human
ugggacacaagcaugaauguccg

SEQ ID NO: 860023 - RNA, 18 nt, Human
uguccggaagaggcaaga

SEQ ID NO: 860024 - RNA, 23 nt, Human
ugugagacacagaggaaagcagc

SEQ ID NO: 860025 - RNA, 18 nt, Human
ugugugugugugugugug

SEQ ID NO: 860026 - RNA, 18 nt, Human
ugugugugugugugugug

SEQ ID NO: 860027 - RNA, 18 nt, Human
ugugugugugugugugug

SEQ ID NO: 860028 - RNA, 18 nt, Human
ugugugugugugugugug

SEQ ID NO: 860029 - RNA, 18 nt, Human
ugugugugugugugugug

SEQ ID NO: 860030 - RNA, 18 nt, Human
ugugugugugugugugug

SEQ ID NO: 860031 - RNA, 18 nt, Human
ugugugugugugugugug

SEQ ID NO: 860032 - RNA, 18 nt, Human
ugugugugugugugugug

SEQ ID NO: 860033 - RNA, 18 nt, Human
ugugugugugugugugug

SEQ ID NO: 860034 - RNA, 18 nt, Human
ugugugugugugugugug

SEQ ID NO: 860035 - RNA, 18 nt, Human
ugugugugugugugugug

SEQ ID NO: 860036 - RNA, 18 nt, Human
ugugugugugugugugug

SEQ ID NO: 860037 - RNA, 18 nt, Human
ugugugugugugugugug

SEQ ID NO: 860038 - RNA, 18 nt, Human
ugugugugugugugugug

SEQ ID NO: 860039 - RNA, 18 nt, Human
ugugugugugugugugug

SEQ ID NO: 860040 - RNA, 18 nt, Human
ugugugugugugugugug

SEQ ID NO: 860041 - RNA, 18 nt, Human
ugugugugugugugugug

SEQ ID NO: 860042 - RNA, 18 nt, Human
ugugugugugugugugug

SEQ ID NO: 860043 - RNA, 18 nt, Human
ugugugugugugugugug

SEQ ID NO: 860044 - RNA, 18 nt, Human
ugugugugugugugugug

SEQ ID NO: 860045 - RNA, 18 nt, Human
ugugugugugugugugug

SEQ ID NO: 860046 - RNA, 18 nt, Human
ugugugugugugugugug

SEQ ID NO: 860047 - RNA, 21 nt, Human
ugugugugugugugugugugu

SEQ ID NO: 860048 - RNA, 21 nt, Human
ugugugugugugugugugugu

SEQ ID NO: 860049 - RNA, 21 nt, Human
ugugugugugugugugugugu

SEQ ID NO: 860050 - RNA, 21 nt, Human
ugugugugugugugugugugu

SEQ ID NO: 860051 - RNA, 21 nt, Human
ugugugugugugugugugugu

SEQ ID NO: 860052 - RNA, 21 nt, Human
ugugugugugugugugugugu

SEQ ID NO: 860053 - RNA, 21 nt, Human
ugugugugugugugugugugu

SEQ ID NO: 860054 - RNA, 21 nt, Human
ugugugugugugugugugugu

SEQ ID NO: 860055 - RNA, 21 nt, Human
ugugugugugugugugugugu

SEQ ID NO: 860056 - RNA, 21 nt, Human
ugugugugugugugugugugu

SEQ ID NO: 860057 - RNA, 21 nt, Human
ugugugugugugugugugugu

SEQ ID NO: 860058 - RNA, 21 nt, Human
ugugugugugugugugugugu

SEQ ID NO: 860059 - RNA, 21 nt, Human
ugugugugugugugugugugu

SEQ ID NO: 860060 - RNA, 21 nt, Human
ugugugugugugugugugugu

SEQ ID NO: 860061 - RNA, 21 nt, Human
ugugugugugugugugugugu

SEQ ID NO: 860062 - RNA, 21 nt, Human
ugugugugugugugugugugu

SEQ ID NO: 860063 - RNA, 21 nt, Human
ugugugugugugugugugugu

SEQ ID NO: 860064 - RNA, 21 nt, Human
ugugugugugugugugugugu

SEQ ID NO: 860065 - RNA, 21 nt, Human
ugugugugugugugugugugu

SEQ ID NO: 860066 - RNA, 21 nt, Human
ugugugugugugugugugugu

SEQ ID NO: 860067 - RNA, 21 nt, Human
ugugugugugugugugugugu

SEQ ID NO: 860068 - RNA, 21 nt, Human
ugugugugugugugugugugu

SEQ ID NO: 860069 - RNA, 21 nt, Human
ugugugugugugugugugugu

SEQ ID NO: 860070 - RNA, 21 nt, Human
ugugugugugugugugugugu

SEQ ID NO: 860071 - RNA, 21 nt, Human
ugugugugugugugugugugu

SEQ ID NO: 860072 - RNA, 21 nt, Human
ugugugugugugugugugugu

SEQ ID NO: 860073 - RNA, 21 nt, Human
ugugugugugugugugugugu

SEQ ID NO: 860074 - RNA, 21 nt, Human
ugugugugugugugugugugu

SEQ ID NO: 860075 - RNA, 21 nt, Human
ugugugugugugugugugugu

SEQ ID NO: 860076 - RNA, 21 nt, Human
ugugugugugugugugugugu

SEQ ID NO: 860077 - RNA, 21 nt, Human
ugugugugugugugugugugu

SEQ ID NO: 860078 - RNA, 21 nt, Human
ugugugugugugugugugugu

SEQ ID NO: 860079 - RNA, 21 nt, Human
ugugugugugugugugugugu

SEQ ID NO: 860080 - RNA, 21 nt, Human
ugugugugugugugugugugu

SEQ ID NO: 860081 - RNA, 21 nt, Human
ugugugugugugugugugugu

SEQ ID NO: 860082 - RNA, 21 nt, Human
ugugugugugugugugugugu

SEQ ID NO: 860083 - RNA, 21 nt, Human
ugugugugugugugugugugu

SEQ ID NO: 860084 - RNA, 21 nt, Human
ugugugugugugugugugugu

SEQ ID NO: 860085 - RNA, 21 nt, Human
ugugugugugugugugugugu

SEQ ID NO: 860086 - RNA, 21 nt, Human
ugugugugugugugugugugu

SEQ ID NO: 860087 - RNA, 21 nt, Human
ugugugugugugugugugugu

SEQ ID NO: 860088 - RNA, 22 nt, Human
ugugugugugugugugugugua

SEQ ID NO: 860089 - RNA, 22 nt, Human
ugugugugugugugugugugug

SEQ ID NO: 860090 - RNA, 22 nt, Human
ugugugugugugugugugugug

SEQ ID NO: 860091 - RNA, 22 nt, Human
ugugugugugugugugugugug

SEQ ID NO: 860092 - RNA, 22 nt, Human
ugugugugugugugugugugug

SEQ ID NO: 860093 - RNA, 22 nt, Human
ugugugugugugugugugugug

SEQ ID NO: 860094 - RNA, 22 nt, Human
ugugugugugugugugugugug

SEQ ID NO: 860095 - RNA, 22 nt, Human
ugugugugugugugugugugug

SEQ ID NO: 860096 - RNA, 22 nt, Human
ugugugugugugugugugugug

SEQ ID NO: 860097 - RNA, 22 nt, Human
ugugugugugugugugugugug

SEQ ID NO: 860098 - RNA, 22 nt, Human
ugugugugugugugugugugug

SEQ ID NO: 860099 - RNA, 22 nt, Human
ugugugugugugugugugugug

SEQ ID NO: 860100 - RNA, 22 nt, Human
uucuccaaguacuuucacauuu

SEQ ID NO: 860101 - RNA, 20 nt, Human
uuucucccugcugcugucac

SEQ ID NO: 860102 - RNA, 19 nt, Human
aacaccagcgcuucccgcc

SEQ ID NO: 860103 - RNA, 22 nt, Human
acaccagcgcuucccgccuggc

SEQ ID NO: 860104 - RNA, 23 nt, Human
acccagggucucguccugcagcg

SEQ ID NO: 860105 - RNA, 22 nt, Human
agcuuugcuuuucuucauuugg

SEQ ID NO: 860106 - RNA, 22 nt, Human
aggcucggcacagcgaaggcuu

SEQ ID NO: 860107 - RNA, 18 nt, Human
aggcugcaagccugggua

SEQ ID NO: 860108 - RNA, 19 nt, Human
cacccagggucucguccug

SEQ ID NO: 860109 - RNA, 18 nt, Human
cacgcugacaggcacggg

SEQ ID NO: 860110 - RNA, 21 nt, Human
cagaaacacaaggcucggcac

SEQ ID NO: 860111 - RNA, 25 nt, Human
ccccgacugucgccagcgccgcaac

SEQ ID NO: 860112 - RNA, 19 nt, Human
ccccggccccgggccgcuc

SEQ ID NO: 860113 - RNA, 21 nt, Human
ccccgggccgcucgcaacccc

SEQ ID NO: 860114 - RNA, 19 nt, Human
ccccuacgccgccccucgu

SEQ ID NO: 860115 - RNA, 30 nt, Human
cccggccccgggccgcucgcaaccccgacc

SEQ ID NO: 860116 - RNA, 21 nt, Human
ccuggcugaguggccccggcc

SEQ ID NO: 860117 - RNA, 23 nt, Human
cgccagcgccgcaacaccccccu

SEQ ID NO: 860118 - RNA, 27 nt, Human
cgccuggcugaguggccccggcugcgc

SEQ ID NO: 860119 - RNA, 18 nt, Human
cguccugcagcggcccug

SEQ ID NO: 860120 - RNA, 22 nt, Human
cuccgccccuacgccgccccuc

SEQ ID NO: 860121 - RNA, 22 nt, Human
cucguccugcagcggcccuggc

SEQ ID NO: 860122 - RNA, 20 nt, Human
cuugcacccgccucccggga

SEQ ID NO: 860123 - RNA, 21 nt, Human
gaccuccgccccuacgccgcc

SEQ ID NO: 860124 - RNA, 19 nt, Human
gauuccuggccugggcgga

SEQ ID NO: 860125 - RNA, 24 nt, Human
ucagaaacacaaggcucggcacag

SEQ ID NO: 860126 - RNA, 19 nt, Human
uccccgcggaugcccugga

SEQ ID NO: 860127 - RNA, 19 nt, Human
ucgugcggacgcacucagg

SEQ ID NO: 860128 - RNA, 20 nt, Human
ugcgucagaaacacaaggcu

SEQ ID NO: 860129 - RNA, 23 nt, Human
uggacggcccuccacugcgaggg

SEQ ID NO: 860130 - RNA, 19 nt, Human
uggagacgguuccgcccuc

SEQ ID NO: 860131 - RNA, 18 nt, Human
ugggcggaugcacuggca

SEQ ID NO: 860132 - RNA, 22 nt, Human
uucgucuccccgcggaugcccu

SEQ ID NO: 860133 - RNA, 23 nt, Human
uugcacccgccucccgggacccc

SEQ ID NO: 860134 - RNA, 24 nt, Human
uuuuuuuuuuuuuuuuuaagcuuu

SEQ ID NO: 860135 - RNA, 21 nt, Human
uuuuuuuuuuuuuuuuuuaag

SEQ ID NO: 860136 - RNA, 23 nt, Human
aaacugacaaccucauuuucuca

SEQ ID NO: 860137 - RNA, 26 nt, Human
aaccagacagggaauguucaccuuca

SEQ ID NO: 860138 - RNA, 19 nt, Human
aaggacccagaagacacaa

SEQ ID NO: 860139 - RNA, 21 nt, Human
aaucugcagcuauccuucccc

SEQ ID NO: 860140 - RNA, 19 nt, Human
aaucuuguccgccuucccc

SEQ ID NO: 860141 - RNA, 18 nt, Human
aaugccaauucauuccca

SEQ ID NO: 860142 - RNA, 18 nt, Human
aauucauucccacauccc

SEQ ID NO: 860143 - RNA, 23 nt, Human
acacacacacacacacacacaca

SEQ ID NO: 860144 - RNA, 23 nt, Human
acacacacacacacacacacaca

SEQ ID NO: 860145 - RNA, 23 nt, Human
acacacacacacacacacacaca

SEQ ID NO: 860146 - RNA, 23 nt, Human
acacacacacacacacacacaca

SEQ ID NO: 860147 - RNA, 23 nt, Human
acacacacacacacacacacaca

SEQ ID NO: 860148 - RNA, 23 nt, Human
acacacacacacacacacacaca

SEQ ID NO: 860149 - RNA, 23 nt, Human
acacacacacacacacacacaca

SEQ ID NO: 860150 - RNA, 23 nt, Human
acacacacacacacacacacaca

SEQ ID NO: 860151 - RNA, 23 nt, Human
acacacacacacacacacacacg

SEQ ID NO: 860152 - RNA, 29 nt, Human
acacacacacacacacacacacggcucca

SEQ ID NO: 860153 - RNA, 22 nt, Human
acacacacacacacacacacag

SEQ ID NO: 860154 - RNA, 21 nt, Human
acacacacacacacacacggc

SEQ ID NO: 860155 - RNA, 20 nt, Human
accauguugaccaggcuggu

SEQ ID NO: 860156 - RNA, 23 nt, Human
accauguugaccaggcuggucuc

SEQ ID NO: 860157 - RNA, 21 nt, Human
acccuugacucaguccaacca

SEQ ID NO: 860158 - RNA, 19 nt, Human
accucacccacccugccca

SEQ ID NO: 860159 - RNA, 19 nt, Human
accuggcccuccugcaaac

SEQ ID NO: 860160 - RNA, 22 nt, Human
acugagcaccgacuccguacca

SEQ ID NO: 860161 - RNA, 19 nt, Human
agaaaugggguuuuaccau

SEQ ID NO: 860162 - RNA, 19 nt, Human
agauggccggaaagaccag

SEQ ID NO: 860163 - RNA, 18 nt, Human
agccaagugcaacaucgg

SEQ ID NO: 860164 - RNA, 24 nt, Human
agccugucagcaaugaaaggaccc

SEQ ID NO: 860165 - RNA, 18 nt, Human
aggaccccagaagggcaa

SEQ ID NO: 860166 - RNA, 19 nt, Human
aggcaaaaauaugcacgug

SEQ ID NO: 860167 - RNA, 19 nt, Human
agggaauguucaccuucaa

SEQ ID NO: 860168 - RNA, 24 nt, Human
aggugaucugccugccucggccuc

SEQ ID NO: 860169 - RNA, 20 nt, Human
aucccuccaagacccaggag

SEQ ID NO: 860170 - RNA, 19 nt, Human
augggguuuuaccauguug

SEQ ID NO: 860171 - RNA, 24 nt, Human
augggguuuuaccauguugaccag

SEQ ID NO: 860172 - RNA, 22 nt, Human
auucauucccacaucccuccaa

SEQ ID NO: 860173 - RNA, 22 nt, Human
caaccagacagggaauguucac

SEQ ID NO: 860174 - RNA, 24 nt, Human
caaccucauuuucucaagcugaag

SEQ ID NO: 860175 - RNA, 25 nt, Human
caaccucauuuucucaagcugaaga

SEQ ID NO: 860176 - RNA, 24 nt, Human
caagcuccucucuccacggccauc

SEQ ID NO: 860177 - RNA, 26 nt, Human
caagcuccucucuccacggccauccu

SEQ ID NO: 860178 - RNA, 24 nt, Human
caagugaauauaccuggcccuccu

SEQ ID NO: 860179 - RNA, 28 nt, Human
caagugaauauaccuggcccuccugcaa

SEQ ID NO: 860180 - RNA, 20 nt, Human
cacacacacacacacacaca

SEQ ID NO: 860181 - RNA, 20 nt, Human
cacacacacacacacacaca

SEQ ID NO: 860182 - RNA, 20 nt, Human
cacacacacacacacacaca

SEQ ID NO: 860183 - RNA, 20 nt, Human
cacacacacacacacacaca

SEQ ID NO: 860184 - RNA, 20 nt, Human
cacacacacacacacacaca

SEQ ID NO: 860185 - RNA, 20 nt, Human
cacacacacacacacacaca

SEQ ID NO: 860186 - RNA, 20 nt, Human
cacacacacacacacacaca

SEQ ID NO: 860187 - RNA, 20 nt, Human
cacacacacacacacacaca

SEQ ID NO: 860188 - RNA, 20 nt, Human
cacacacacacacacacaca

SEQ ID NO: 860189 - RNA, 20 nt, Human
cacacacacacacacacaca

SEQ ID NO: 860190 - RNA, 20 nt, Human
cacacacacacacacacaca

SEQ ID NO: 860191 - RNA, 20 nt, Human
cacacacacacacacacaca

SEQ ID NO: 860192 - RNA, 20 nt, Human
cacacacacacacacacaca

SEQ ID NO: 860193 - RNA, 22 nt, Human
cacacacacacacacacacaca

SEQ ID NO: 860194 - RNA, 22 nt, Human
cacacacacacacacacacaca

SEQ ID NO: 860195 - RNA, 22 nt, Human
cacacacacacacacacacaca

SEQ ID NO: 860196 - RNA, 26 nt, Human
cacacacacacacacacacacacaca

SEQ ID NO: 860197 - RNA, 26 nt, Human
cacacacacacacacacacacacaca

SEQ ID NO: 860198 - RNA, 26 nt, Human
cacacacacacacacacacacacaca

SEQ ID NO: 860199 - RNA, 26 nt, Human
cacacacacacacacacacacacaca

SEQ ID NO: 860200 - RNA, 26 nt, Human
cacacacacacacacacacacacaca

SEQ ID NO: 860201 - RNA, 23 nt, Human
cacggaacaaagccaccuccugg

SEQ ID NO: 860202 - RNA, 21 nt, Human
cacuucaaucuaagccaggag

SEQ ID NO: 860203 - RNA, 19 nt, Human
cagaauccccaaaggguca

SEQ ID NO: 860204 - RNA, 26 nt, Human
cagacccuugacucaguccaaccaga

SEQ ID NO: 860205 - RNA, 21 nt, Human
cagaggugacuaaacuuccaa

SEQ ID NO: 860206 - RNA, 26 nt, Human
cagcaagaaagauggccggaaagacc

SEQ ID NO: 860207 - RNA, 22 nt, Human
cagcagugacaacugaaauaaa

SEQ ID NO: 860208 - RNA, 30 nt, Human
cagcagugacaacugaaauaaauacagccc

SEQ ID NO: 860209 - RNA, 22 nt, Human
caggugaucugccugccucggc

SEQ ID NO: 860210 - RNA, 24 nt, Human
caucacacacacuucaaucuaagc

SEQ ID NO: 860211 - RNA, 21 nt, Human
caucuccaucccuuucagagg

SEQ ID NO: 860212 - RNA, 24 nt, Human
cauguugaccaggcuggucucaaa

SEQ ID NO: 860213 - RNA, 22 nt, Human
ccaaagucauuuccugcaauua

SEQ ID NO: 860214 - RNA, 19 nt, Human
ccaauucauucccacaucc

SEQ ID NO: 860215 - RNA, 20 nt, Human
cccaaggcucaagagggcca

SEQ ID NO: 860216 - RNA, 24 nt, Human
cccacccugcccaaggcucaagag

SEQ ID NO: 860217 - RNA, 23 nt, Human
cccaugcuaagcagccacucagu

SEQ ID NO: 860218 - RNA, 19 nt, Human
cccuccugcaaacuuugca

SEQ ID NO: 860219 - RNA, 24 nt, Human
ccgagccuagcgcgguggcccaug

SEQ ID NO: 860220 - RNA, 21 nt, Human
ccugaccucaggugaucugcc

SEQ ID NO: 860221 - RNA, 23 nt, Human
ccugaccucaggugaucugccug

SEQ ID NO: 860222 - RNA, 24 nt, Human
ccuugcuggaaacugacaaccuca

SEQ ID NO: 860223 - RNA, 22 nt, Human
cgcacagcuccuucucauugca

SEQ ID NO: 860224 - RNA, 18 nt, Human
cggaacaaagccaccucc

SEQ ID NO: 860225 - RNA, 22 nt, Human
cggcuccagccuuuccaacuuu

SEQ ID NO: 860226 - RNA, 21 nt, Human
cucacacacacacacacacac

SEQ ID NO: 860227 - RNA, 26 nt, Human
cuccugaccucaggugaucugccugc

SEQ ID NO: 860228 - RNA, 27 nt, Human
cuccuggucaucugcaccucacccacc

SEQ ID NO: 860229 - RNA, 31 nt, Human; identical to SEQ ID NO: 661661

SEQ ID NO: 860230 - RNA, 20 nt, Human
cugaaacuggacaagagccu

SEQ ID NO: 860231 - RNA, 20 nt, Human
cugagcaccgacuccguacc

SEQ ID NO: 860232 - RNA, 20 nt, Human
cuggaaacugacaaccucau

SEQ ID NO: 860233 - RNA, 23 nt, Human
cuucauaaauauugccuuuccca

SEQ ID NO: 860234 - RNA, 24 nt, Human
gaccucaggugaucugccugccuc

SEQ ID NO: 860235 - RNA, 20 nt, Human
gagagcuuggggaagcaggg

SEQ ID NO: 860236 - RNA, 18 nt, Human
gcaagcuccucucuccac

SEQ ID NO: 860237 - RNA, 23 nt, Human
gcuggucucaaacuccugaccuc

SEQ ID NO: 860238 - RNA, 21 nt, Human
ggaaggcauucacacacuccu

SEQ ID NO: 860239 - RNA, 20 nt, Human
ggacccagaagacacaagug

SEQ ID NO: 860240 - RNA, 20 nt, Human
ggagaaaucagucuggugga

SEQ ID NO: 860241 - RNA, 24 nt, Human
ggcuggucucaaacuccugaccuc

SEQ ID NO: 860242 - RNA, 21 nt, Human
gggccucuggucccauuccaa

SEQ ID NO: 860243 - RNA, 22 nt, Human
gggguuuuaccauguugaccag

SEQ ID NO: 860244 - RNA, 23 nt, Human
gggguuuuaccauguugaccagg

SEQ ID NO: 860245 - RNA, 21 nt, Human
gucagccuugcuggaaacuga

SEQ ID NO: 860246 - RNA, 18 nt, Human
uaaauauugccuuuccca

SEQ ID NO: 860247 - RNA, 23 nt, Human
uacaaaugugacauuuaaagcac

SEQ ID NO: 860248 - RNA, 21 nt, Human
uaccauguugaccaggcuggu

SEQ ID NO: 860249 - RNA, 24 nt, Human
uaccauguugaccaggcuggucuc

SEQ ID NO: 860250 - RNA, 27 nt, Human
uaccauguugaccaggcuggucucaaa

SEQ ID NO: 860251 - RNA, 21 nt, Human
uaccuggcccuccugcaaacu

SEQ ID NO: 860252 - RNA, 24 nt, Human
uagcagaaaugggguuuuaccaug

SEQ ID NO: 860253 - RNA, 21 nt, Human
uagguucuuggggcugccucu

SEQ ID NO: 860254 - RNA, 18 nt, Human
ucaaagcugagcugggac

SEQ ID NO: 860255 - RNA, 19 nt, Human
ucaaagcugagcugggaca

SEQ ID NO: 860256 - RNA, 19 nt, Human
ucaaucuaagccaggaguu

SEQ ID NO: 860257 - RNA, 21 nt, Human
ucagcucuguuuugcaaacac

SEQ ID NO: 860258 - RNA, 22 nt, Human
ucauucccacaucccuccaaga

SEQ ID NO: 860259 - RNA, 18 nt, Human
ucccuugaggaagguggc

SEQ ID NO: 860260 - RNA, 20 nt, Human
uccguuuucagcucuguuuu

SEQ ID NO: 860261 - RNA, 21 nt, Human
ucucacacacacacacacaca

SEQ ID NO: 860262 - RNA, 18 nt, Human
ucucagaggcauaagcca

SEQ ID NO: 860263 - RNA, 20 nt, Human
ugaaauaaauacagccgugg

SEQ ID NO: 860264 - RNA, 24 nt, Human
ugaccaggcuggucucaaacuccu

SEQ ID NO: 860265 - RNA, 18 nt, Human
ugaccucaggugaucugc

SEQ ID NO: 860266 - RNA, 20 nt, Human
ugaccucaggugaucugccu

SEQ ID NO: 860267 - RNA, 24 nt, Human
ugaccucaggugaucugccugccu

SEQ ID NO: 860268 - RNA, 20 nt, Human
ugagcuggcagugggagggc

SEQ ID NO: 860269 - RNA, 22 nt, Human
ugagcuggcagugggagggcuc

SEQ ID NO: 860270 - RNA, 21 nt, Human
ugaggaagguggcaagaggug

SEQ ID NO: 860271 - RNA, 20 nt, Human
ugcugacuugccagcaagaa

SEQ ID NO: 860272 - RNA, 27 nt, Human
uggcaagagguguagaucaaagcugag

SEQ ID NO: 860273 - RNA, 24 nt, Human
ugggguuuuaccauguugaccagg

SEQ ID NO: 860274 - RNA, 19 nt, Human
ugguggaugucagccuugc

SEQ ID NO: 860275 - RNA, 19 nt, Human
ugucagcaaugaaaggacc

SEQ ID NO: 860276 - RNA, 19 nt, Human
ugugauggcugaauggagu

SEQ ID NO: 860277 - RNA, 24 nt, Human
uuagcagaaaugggguuuuaccau

SEQ ID NO: 860278 - RNA, 22 nt, Human
uucagcccugaaacuggacaag

SEQ ID NO: 860279 - RNA, 22 nt, Human
uucccacaucccuccaagaccc

SEQ ID NO: 860280 - RNA, 18 nt, Human
uuuaaagcaccuuuggca

SEQ ID NO: 860281 - RNA, 19 nt, Human
uuuaaagcaccuuuggcac

SEQ ID NO: 860282 - RNA, 21 nt, Human
uuucaagggccucugguccca

SEQ ID NO: 860283 - RNA, 18 nt, Human
uuugcaaacacugagcac

SEQ ID NO: 860284 - RNA, 20 nt, Human
uuuugcaaacacugagcacc

SEQ ID NO: 860285 - RNA, 24 nt, Human
uuuuuagcagaaaugggguuuuac

SEQ ID NO: 860286 - RNA, 20 nt, Human
aaaaauagcuacagugcuac

SEQ ID NO: 860287 - RNA, 20 nt, Human
caaagccggacccgcccccu

SEQ ID NO: 860288 - RNA, 20 nt, Human
caaggcccgacccgccggcu

SEQ ID NO: 860289 - RNA, 24 nt, Human
caaguauccugaauguaaccauga

SEQ ID NO: 860290 - RNA, 20 nt, Human
caauugcaaaacagguuuac

SEQ ID NO: 860291 - RNA, 25 nt, Human
ccgacccgccggcuuuucaaagccg

SEQ ID NO: 860292 - RNA, 18 nt, Human
ccuccccucgcacuuggu

SEQ ID NO: 860293 - RNA, 22 nt, Human
cucaaguauccugaauguaacc

SEQ ID NO: 860294 - RNA, 22 nt, Human
cuuccaccucaaggcccgaccc

SEQ ID NO: 860295 - RNA, 24 nt, Human
gaaaauggaggcuucaauugcaaa

SEQ ID NO: 860296 - RNA, 23 nt, Human
gcuucgccuguccuccccucgca

SEQ ID NO: 860297 - RNA, 23 nt, Human
ggagacgcaggagggguggcugc

SEQ ID NO: 860298 - RNA, 25 nt, Human
gggguggcugcgaggcgugaggcag

SEQ ID NO: 860299 - RNA, 22 nt, Human
uaaaaaauagcuacagugcuac

SEQ ID NO: 860300 - RNA, 24 nt, Human
ucaaagccggacccgcccccuugc

SEQ ID NO: 860301 - RNA, 20 nt, Human
ucaaggcccgacccgccggc

SEQ ID NO: 860302 - RNA, 20 nt, Human
ucgccuguccuccccucgca

SEQ ID NO: 860303 - RNA, 20 nt, Human
acaggauaauaaaacaugua

SEQ ID NO: 860304 - RNA, 19 nt, Human
accacccucuggggacagg

SEQ ID NO: 860305 - RNA, 22 nt, Human
accacccucuggggacaggaua

SEQ ID NO: 860306 - RNA, 20 nt, Human
agaugggaaguggggagggg

SEQ ID NO: 860307 - RNA, 19 nt, Human
cacccaugccaggcaaggc

SEQ ID NO: 860308 - RNA, 23 nt, Human
ccccagcuggggcugugugggac

SEQ ID NO: 860309 - RNA, 20 nt, Human
cuccaggaacaguccccacc

SEQ ID NO: 860310 - RNA, 18 nt, Human
cugcgcugaucacgucgu

SEQ ID NO: 860311 - RNA, 23 nt, Human
gcuguuugccccagcuggggcug

SEQ ID NO: 860312 - RNA, 18 nt, Human
ggagagacugcaggucug

SEQ ID NO: 860313 - RNA, 24 nt, Human
ggcugugugggacggggucucagg

SEQ ID NO: 860314 - RNA, 24 nt, Human
gucaacguggacuagcucguguca

SEQ ID NO: 860315 - RNA, 18 nt, Human
gucaucugcucgagaggg

SEQ ID NO: 860316 - RNA, 20 nt, Human
uccaccuucuaggagagcca

SEQ ID NO: 860317 - RNA, 24 nt, Human
ugagcagugagggccagagacuag

SEQ ID NO: 860318 - RNA, 20 nt, Human
ugccaggcaaggccuaggga

SEQ ID NO: 860319 - RNA, 19 nt, Human
ugccccagcuggggcugug

SEQ ID NO: 860320 - RNA, 23 nt, Human
ugcucgagaggggcugucgcugu

SEQ ID NO: 860321 - RNA, 20 nt, Human
uggagcccugggcucauccu

SEQ ID NO: 860322 - RNA, 18 nt, Human
ugggaaguggggaggggg

SEQ ID NO: 860323 - RNA, 20 nt, Human
ugggaaguggggagggggcu

SEQ ID NO: 860324 - RNA, 21 nt, Human
ugggaaguggggagggggcuc

SEQ ID NO: 860325 - RNA, 28 nt, Human
ugggacggggucucaggugaggaaucuu

SEQ ID NO: 860326 - RNA, 27 nt, Human
uggggacaggauaauaaaacauguaau

SEQ ID NO: 860327 - RNA, 19 nt, Human
uggggcugugugggacggg

SEQ ID NO: 860328 - RNA, 22 nt, Human
ugguuucuggauaaaccacccu

SEQ ID NO: 860329 - RNA, 19 nt, Human
uguaauauuuuuaagaagg

SEQ ID NO: 860330 - RNA, 18 nt, Human
uuuuuuuuuuuuuucuug

SEQ ID NO: 860331 - RNA, 18 nt, Human
uuuuuuuuuuuuuucuug

SEQ ID NO: 860332 - RNA, 22 nt, Human
aaagucuguucuccccacccuc

SEQ ID NO: 860333 - RNA, 23 nt, Human
agggaaaaagucuguucucccca

SEQ ID NO: 860334 - RNA, 20 nt, Human
agggaggggcgcgggcggcg

SEQ ID NO: 860335 - RNA, 22 nt, Human
caccgcacgccccgcggcaggu

SEQ ID NO: 860336 - RNA, 21 nt, Human
caccucaaacaacuuccugga

SEQ ID NO: 860337 - RNA, 19 nt, Human
cacucgcuggcugcucuuc

SEQ ID NO: 860338 - RNA, 19 nt, Human
cacucucccucucucuuuu

SEQ ID NO: 860339 - RNA, 21 nt, Human
cacucucccucucucuuuuuc

SEQ ID NO: 860340 - RNA, 19 nt, Human
cccaagcaccgcacgcccc

SEQ ID NO: 860341 - RNA, 18 nt, Human
cccagggaggggcgcggg

SEQ ID NO: 860342 - RNA, 21 nt, Human
ccccccuucacucucacuuuc

SEQ ID NO: 860343 - RNA, 19 nt, Human
cccccucacucgucccccc

SEQ ID NO: 860344 - RNA, 19 nt, Human
cccccucuccuucuccucc

SEQ ID NO: 860345 - RNA, 18 nt, Human
cccgggcugcucccaggg

SEQ ID NO: 860346 - RNA, 20 nt, Human
ccgcggcagguuggcggcga

SEQ ID NO: 860347 - RNA, 19 nt, Human
ccgcggucccgggcugcuc

SEQ ID NO: 860348 - RNA, 19 nt, Human
ccucaaacaacuuccugga

SEQ ID NO: 860349 - RNA, 21 nt, Human
ccucacucguccccccccuuc

SEQ ID NO: 860350 - RNA, 22 nt, Human
ccucacucguccccccccuuca

SEQ ID NO: 860351 - RNA, 26 nt, Human
ccuccccccucacucgucacccgagg

SEQ ID NO: 860352 - RNA, 21 nt, Human
ccuccucuucuucccccucuc

SEQ ID NO: 860353 - RNA, 18 nt, Human
cggucccgggcugcuccc

SEQ ID NO: 860354 - RNA, 20 nt, Human
cguccccccccuucacucuc

SEQ ID NO: 860355 - RNA, 23 nt, Human
cucucccucucucuuuuucuuuu

SEQ ID NO: 860356 - RNA, 19 nt, Human
cuucuccuccuccuccucc

SEQ ID NO: 860357 - RNA, 21 nt, Human
cuuucuuucuuuccgcuuucu

SEQ ID NO: 860358 - RNA, 21 nt, Human
gaaaaagucuguucuccccac

SEQ ID NO: 860359 - RNA, 20 nt, Human
gagggggcgccgagccuucc

SEQ ID NO: 860360 - RNA, 24 nt, Human
ggucccgggcugcucccagggagg

SEQ ID NO: 860361 - RNA, 21 nt, Human
guucuccccacccuccccccu

SEQ ID NO: 860362 - RNA, 21 nt, Human
uaauuuccuaugaugcaccuc

SEQ ID NO: 860363 - RNA, 19 nt, Human
ucacucucccucucucuuu

SEQ ID NO: 860364 - RNA, 18 nt, Human
ucccagggaggggcgcgg

SEQ ID NO: 860365 - RNA, 19 nt, Human
uccccacccuccccccuca

SEQ ID NO: 860366 - RNA, 20 nt, Human
ucucccagauucacucuccc

SEQ ID NO: 860367 - RNA, 19 nt, Human
ucuguucuccccacccucc

SEQ ID NO: 860368 - RNA, 20 nt, Human
ucuuucuuuccgcuuucucc

SEQ ID NO: 860369 - RNA, 22 nt, Human
ucuuucuuuccgcuuucuccuu

SEQ ID NO: 860370 - RNA, 24 nt, Human
ucuuucuuucuuuccgcuuucucc

SEQ ID NO: 860371 - RNA, 20 nt, Human
ucuuuuucuuuucuuucuuu

SEQ ID NO: 860372 - RNA, 24 nt, Human
uguucuccccacccuccccccuca

SEQ ID NO: 860373 - RNA, 21 nt, Human
uuccaaccgcggucccgggcu

SEQ ID NO: 860374 - RNA, 18 nt, Human
uucccccucuccuucucc

SEQ ID NO: 860375 - RNA, 18 nt, Human
uucuccccacccuccccc

SEQ ID NO: 860376 - RNA, 22 nt, Human
uucuccuccuccuccuccucgc

SEQ ID NO: 860377 - RNA, 18 nt, Human
uuggcggcgagggagggg

SEQ ID NO: 860378 - RNA, 23 nt, Human
aacacaacuuuuucucguguucu

SEQ ID NO: 860379 - RNA, 23 nt, Human
cuccagcauucuggccucgugcc

SEQ ID NO: 860380 - RNA, 21 nt, Human
gaagguaguauguucagaguc

SEQ ID NO: 860381 - RNA, 18 nt, Human
uaguauguucagagucuu

SEQ ID NO: 860382 - RNA, 24 nt, Human
uccuuuggcauagcuaauuuccag

SEQ ID NO: 860383 - RNA, 20 nt, Human
ugaaaugugucuggcuuuug

SEQ ID NO: 860384 - RNA, 22 nt, Human
ugaggcccaggcccaggcacug

SEQ ID NO: 860385 - RNA, 18 nt, Human
ugucuggcuuuuguccuu

SEQ ID NO: 860386 - RNA, 20 nt, Human
uugccaguuucugaaguccu

SEQ ID NO: 860387 - RNA, 22 nt, Human
uugcuugccaguuucugaaguc

SEQ ID NO: 860388 - RNA, 24 nt, Human
uuuuguccuuucaccuacgcucca

SEQ ID NO: 860389 - RNA, 26 nt, Human
uuuuuuuuuuaaagguaagagcacuu

SEQ ID NO: 860390 - RNA, 20 nt, Human
uuuuuuuuuuuuuaaaggua

SEQ ID NO: 860391 - RNA, 22 nt, Human
uuuuuuuuuuuuuuuuuaaagg

SEQ ID NO: 860392 - RNA, 19 nt, Human
aaaccaagcagaggaagcc

SEQ ID NO: 860393 - RNA, 18 nt, Human
aagcuuuugaacagaccc

SEQ ID NO: 860394 - RNA, 18 nt, Human
aauuuauucguccuccuc

SEQ ID NO: 860395 - RNA, 21 nt, Human
acagacccucaaaccaagcag

SEQ ID NO: 860396 - RNA, 22 nt, Human
acuucagaggcgcccgcucagg

SEQ ID NO: 860397 - RNA, 20 nt, Human
agacccucaaaccaagcaga

SEQ ID NO: 860398 - RNA, 20 nt, Human
agcuuccacaauggaaugga

SEQ ID NO: 860399 - RNA, 22 nt, Human
caggcgaggcugcggugaagcc

SEQ ID NO: 860400 - RNA, 23 nt, Human
cccaaagcuuuugaacagacccu

SEQ ID NO: 860401 - RNA, 22 nt, Human
ccgaagcccggcccugaccccg

SEQ ID NO: 860402 - RNA, 20 nt, Human
ccgcgccccgcucccuccag

SEQ ID NO: 860403 - RNA, 20 nt, Human
ccggaggcccgcccucgugc

SEQ ID NO: 860404 - RNA, 20 nt, Human
ccggcccugaccccgcggac

SEQ ID NO: 860405 - RNA, 24 nt, Human
ccuggcaccuggcccagcuuccac

SEQ ID NO: 860406 - RNA, 19 nt, Human
ccuucccuccuuuuacucc

SEQ ID NO: 860407 - RNA, 20 nt, Human
cgccccgcucccuccagcaa

SEQ ID NO: 860408 - RNA, 23 nt, Human
cgcccuccacuucagaggcgccc

SEQ ID NO: 860409 - RNA, 21 nt, Human
cucaaaccaagcagaggaagc

SEQ ID NO: 860410 - RNA, 20 nt, Human
cuccagcaccucgccgggcc

SEQ ID NO: 860411 - RNA, 21 nt, Human
cucccgaggcccgcggcccag

SEQ ID NO: 860412 - RNA, 20 nt, Human
gauccgcgccccgcucccuc

SEQ ID NO: 860413 - RNA, 20 nt, Human
gcccaggcggcccgcccucc

SEQ ID NO: 860414 - RNA, 24 nt, Human
ucaaaccaagcagaggaagccaug

SEQ ID NO: 860415 - RNA, 18 nt, Human
ucccuaauuggcccaaag

SEQ ID NO: 860416 - RNA, 22 nt, Human
ucccuaauuggcccaaagcuuu

SEQ ID NO: 860417 - RNA, 22 nt, Human
ucccugaaggagagugucccug

SEQ ID NO: 860418 - RNA, 24 nt, Human
ucccugaaggagagugucccuggc

SEQ ID NO: 860419 - RNA, 22 nt, Human
ucccuggcaccuggcccagcuu

SEQ ID NO: 860420 - RNA, 23 nt, Human
ucccuggcaccuggcccagcuuc

SEQ ID NO: 860421 - RNA, 18 nt, Human
uccgcgccccgcucccuc

SEQ ID NO: 860422 - RNA, 20 nt, Human
uccgcgccccgcucccucca

SEQ ID NO: 860423 - RNA, 22 nt, Human
ugaacagacccucaaaccaagc

SEQ ID NO: 860424 - RNA, 25 nt, Human
ugaacagacccucaaaccaagcaga

SEQ ID NO: 860425 - RNA, 22 nt, Human
uggcccaaagcuuuugaacagg

SEQ ID NO: 860426 - RNA, 23 nt, Human
uggugugccuuccaccacuggag

SEQ ID NO: 860427 - RNA, 20 nt, Human
uuacucccuaauuggcccaa

SEQ ID NO: 860428 - RNA, 21 nt, Human
uugaacagacccucaaaccaa

SEQ ID NO: 860429 - RNA, 18 nt, Human
uuuuuuuuuuaaaacaaa

SEQ ID NO: 860430 - RNA, 23 nt, Human
aaaaucagaaaucaccuguaacc

SEQ ID NO: 860431 - RNA, 22 nt, Human
aaaucccuggaguagacaaucc

SEQ ID NO: 860432 - RNA, 19 nt, Human
aagcgccccgggggucgga

SEQ ID NO: 860433 - RNA, 26 nt, Human
aaggacccagccacugcuggccaccc

SEQ ID NO: 860434 - RNA, 21 nt, Human
accugucccgagacccgagag

SEQ ID NO: 860435 - RNA, 19 nt, Human
acugaccccugcgccacgc

SEQ ID NO: 860436 - RNA, 24 nt, Human
agcccggggcucgcucgggcgcgc

SEQ ID NO: 860437 - RNA, 22 nt, Human
aggacggaggggcgcggaagga

SEQ ID NO: 860438 - RNA, 19 nt, Human
aggugcucagggaaaggag

SEQ ID NO: 860439 - RNA, 19 nt, Human
cacccuggccucugcucug

SEQ ID NO: 860440 - RNA, 21 nt, Human
cagccacugcuggccacccug

SEQ ID NO: 860441 - RNA, 20 nt, Human
ccaggaacagugccugugcc

SEQ ID NO: 860442 - RNA, 22 nt, Human
cccacgaucuccugcacccgcc

SEQ ID NO: 860443 - RNA, 21 nt, Human
ccccacuccggacgcuuccuc

SEQ ID NO: 860444 - RNA, 21 nt, Human
cccgagagaaccacugacccc

SEQ ID NO: 860445 - RNA, 21 nt, Human
cccuccucaccuccucugcca

SEQ ID NO: 860446 - RNA, 21 nt, Human
ccuccucaccuccucugccau

SEQ ID NO: 860447 - RNA, 19 nt, Human
cgccccuccucaccacggc

SEQ ID NO: 860448 - RNA, 19 nt, Human
cucagggaaaggaggacgg

SEQ ID NO: 860449 - RNA, 20 nt, Human
cucgaagcgccccggggguc

SEQ ID NO: 860450 - RNA, 20 nt, Human
cucuggggaggcgccccucc

SEQ ID NO: 860451 - RNA, 21 nt, Human
cugaccccugcgccacgcugg

SEQ ID NO: 860452 - RNA, 20 nt, Human
cugggcccgaggggagcccg

SEQ ID NO: 860453 - RNA, 21 nt, Human
cuggggaggcgccccuccuca

SEQ ID NO: 860454 - RNA, 18 nt, Human
cuggugaugaaggugcuc

SEQ ID NO: 860455 - RNA, 23 nt, Human
gagcacugacaugcuguggucca

SEQ ID NO: 860456 - RNA, 18 nt, Human
gccugcaggccgggcugg

SEQ ID NO: 860457 - RNA, 20 nt, Human
gcgcggaaggacccagccag

SEQ ID NO: 860458 - RNA, 28 nt, Human
gcggaaggacccagccacugcuggccag

SEQ ID NO: 860459 - RNA, 19 nt, Human
gcggggccggggugcgcga

SEQ ID NO: 860460 - RNA, 19 nt, Human
gggccggggugcgcgaggg

SEQ ID NO: 860461 - RNA, 20 nt, Human
gggcgcccacgaucuccugc

SEQ ID NO: 860462 - RNA, 19 nt, Human
ggggucggaguccgggccc

SEQ ID NO: 860463 - RNA, 19 nt, Human
gucaaaaucagaaaucacc

SEQ ID NO: 860464 - RNA, 24 nt, Human
gucccgagacccgagagaaccacu

SEQ ID NO: 860465 - RNA, 22 nt, Human
uagacaaucccuagagcacuga

SEQ ID NO: 860466 - RNA, 18 nt, Human
ucaaaaucagaaaucacc

SEQ ID NO: 860467 - RNA, 21 nt, Human
ucagaaaucaccuguaaccgg

SEQ ID NO: 860468 - RNA, 24 nt, Human
ucccgagacccgagagaaccacug

SEQ ID NO: 860469 - RNA, 22 nt, Human
ucccuggaguagacaaucccua

SEQ ID NO: 860470 - RNA, 19 nt, Human
ucuccugcacccgcccagg

SEQ ID NO: 860471 - RNA, 23 nt, Human
ugcaggccgggcuggagccugcg

SEQ ID NO: 860472 - RNA, 24 nt, Human
ugcgcgaggggggcggcuacuggc

SEQ ID NO: 860473 - RNA, 20 nt, Human
uggccugggugaagcggcgg

SEQ ID NO: 860474 - RNA, 24 nt, Human
uggggaggcgccccuccucaccac

SEQ ID NO: 860475 - RNA, 18 nt, Human
uuuuuuuuuuuuuuucug

SEQ ID NO: 860476 - RNA, 23 nt, Human
uuuuuuuuuuuuuuuuucuguuu

SEQ ID NO: 860477 - RNA, 21 nt, Human
acagacgacccgggucucaaa

SEQ ID NO: 860478 - RNA, 20 nt, Human
acccgcggggccggcagggc

SEQ ID NO: 860479 - RNA, 23 nt, Human
acgacccgggucucaaagaggcg

SEQ ID NO: 860480 - RNA, 19 nt, Human
acgcagccccugguccauc

SEQ ID NO: 860481 - RNA, 19 nt, Human
agccgcgacaccaccaaca

SEQ ID NO: 860482 - RNA, 22 nt, Human
caccaccaacagucgccgcaac

SEQ ID NO: 860483 - RNA, 18 nt, Human
cagccccugguccaucuc

SEQ ID NO: 860484 - RNA, 19 nt, Human
cagccccugguccaucucg

SEQ ID NO: 860485 - RNA, 22 nt, Human
cagccccugguccaucucgggc

SEQ ID NO: 860486 - RNA, 22 nt, Human
caggcgccucccacgggguucc

SEQ ID NO: 860487 - RNA, 19 nt, Human
cccgcagccgcgacaccac

SEQ ID NO: 860488 - RNA, 19 nt, Human
cccgcagugcuuggggacc

SEQ ID NO: 860489 - RNA, 21 nt, Human
cccgccgcgcgcaggcggccg

SEQ ID NO: 860490 - RNA, 23 nt, Human
cccgccgcgcgcaggcggccgca

SEQ ID NO: 860491 - RNA, 19 nt, Human
ccgugcaggaagcagccuc

SEQ ID NO: 860492 - RNA, 21 nt, Human
cgaccgggaagaaggggccgg

SEQ ID NO: 860493 - RNA, 21 nt, Human
cgcagccgcgacaccaccaac

SEQ ID NO: 860494 - RNA, 19 nt, Human
cgggaccccuucccggugu

SEQ ID NO: 860495 - RNA, 23 nt, Human
cgggacgcagccccugguccauc

SEQ ID NO: 860496 - RNA, 18 nt, Human
gacccgggcggagagcaa

SEQ ID NO: 860497 - RNA, 20 nt, Human
gacccgggucucaaagaggc

SEQ ID NO: 860498 - RNA, 23 nt, Human
gagguccugggagcgcggggcug

SEQ ID NO: 860499 - RNA, 27 nt, Human
gagguccugggagcgcggggcugggcg

SEQ ID NO: 860500 - RNA, 18 nt, Human
gcguggaacagacgaccc

SEQ ID NO: 860501 - RNA, 18 nt, Human
gcucccacguggcgucga

SEQ ID NO: 860502 - RNA, 21 nt, Human
ggagcccuucccaggcgccuu

SEQ ID NO: 860503 - RNA, 18 nt, Human
ggagcgcggggcugggcg

SEQ ID NO: 860504 - RNA, 19 nt, Human
uacaggagacggggccucc

SEQ ID NO: 860505 - RNA, 21 nt, Human
uacugcgcccggguccucccg

SEQ ID NO: 860506 - RNA, 25 nt, Human
ucgccgcaaccgccgcguggaacag

SEQ ID NO: 860507 - RNA, 22 nt, Human
ucucaaagaggcggcgcgggcg

SEQ ID NO: 860508 - RNA, 20 nt, Human
ugaaagggagccgcgcggug

SEQ ID NO: 860509 - RNA, 23 nt, Human
uggggucccgcagugcuugggga

SEQ ID NO: 860510 - RNA, 21 nt, Human
uucacggugacaucgcaaaag

SEQ ID NO: 860511 - RNA, 21 nt, Human
aaggggccccguggggccugc

SEQ ID NO: 860512 - RNA, 22 nt, Human
accuggugccgcagggcguucu

SEQ ID NO: 860513 - RNA, 24 nt, Human
agccgccucugccgcaacaccacc

SEQ ID NO: 860514 - RNA, 22 nt, Human
agcuggagcuccuccagccgcc

SEQ ID NO: 860515 - RNA, 25 nt, Human
aggccggggcggacccagcugggga

SEQ ID NO: 860516 - RNA, 23 nt, Human
agggaucgggggcuccgaagggg

SEQ ID NO: 860517 - RNA, 18 nt, Human
caccuggugccgcagggc

SEQ ID NO: 860518 - RNA, 22 nt, Human
caccuggugccgcagggcguuc

SEQ ID NO: 860519 - RNA, 23 nt, Human
ccccuuccuccccuccgggcgcc

SEQ ID NO: 860520 - RNA, 21 nt, Human
cccggccccuuccuccccucc

SEQ ID NO: 860521 - RNA, 24 nt, Human
ccgcuggccgccuccguucccggu

SEQ ID NO: 860522 - RNA, 21 nt, Human
ccuccagccgccucugccgca

SEQ ID NO: 860523 - RNA, 20 nt, Human
ccuccgggcgccgcuggccg

SEQ ID NO: 860524 - RNA, 19 nt, Human
ccucugccgcaacaccacc

SEQ ID NO: 860525 - RNA, 19 nt, Human
ccugcgcuagacccggagg

SEQ ID NO: 860526 - RNA, 21 nt, Human
ccugcgcuagacccggaggga

SEQ ID NO: 860527 - RNA, 18 nt, Human
cgggggcuccgaaggggg

SEQ ID NO: 860528 - RNA, 21 nt, Human
cuccuccagccgccucugccg

SEQ ID NO: 860529 - RNA, 19 nt, Human
cuggaccacuuucucaucu

SEQ ID NO: 860530 - RNA, 23 nt, Human
cuugagcagguccagcagcuuua

SEQ ID NO: 860531 - RNA, 19 nt, Human
gccccguggggccugcgcu

SEQ ID NO: 860532 - RNA, 20 nt, Human
gccggggcggacccagcugg

SEQ ID NO: 860533 - RNA, 23 nt, Human
gccugcgcuagacccggagggau

SEQ ID NO: 860534 - RNA, 19 nt, Human
gcugacugauggucucccu

SEQ ID NO: 860535 - RNA, 19 nt, Human
ggagcuccuccagccgccu

SEQ ID NO: 860536 - RNA, 18 nt, Human
ggccccuuccuccccucc

SEQ ID NO: 860537 - RNA, 21 nt, Human
gguccgggccgcguucagccc

SEQ ID NO: 860538 - RNA, 26 nt, Human
guucugcugcuucaccuucucccuca

SEQ ID NO: 860539 - RNA, 21 nt, Human
uagacccggagggaucggggg

SEQ ID NO: 860540 - RNA, 22 nt, Human
ucccuugagcagguccagcagc

SEQ ID NO: 860541 - RNA, 21 nt, Human
ucucccuugagcagguccagc

SEQ ID NO: 860542 - RNA, 21 nt, Human
ucugcugcuucaccuucuccc

SEQ ID NO: 860543 - RNA, 18 nt, Human
ugaaggggccccgugggg

SEQ ID NO: 860544 - RNA, 18 nt, Human
ugacugauggucucccuc

SEQ ID NO: 860545 - RNA, 24 nt, Human
ugccuggaccacuuucucaucucc

SEQ ID NO: 860546 - RNA, 18 nt, Human
uguccuguucuucaggua

SEQ ID NO: 860547 - RNA, 23 nt, Human
uuccagugccuuagucuccuugc

SEQ ID NO: 860548 - RNA, 20 nt, Human
uugcggagcugacugauggu

SEQ ID NO: 860549 - RNA, 23 nt, Human
uuuuuuuuuuuuuuuuuucaugg

SEQ ID NO: 860550 - RNA, 18 nt, Human
aacagcccugaauggcag

SEQ ID NO: 860551 - RNA, 22 nt, Human
aacagcccugaauggcagggau

SEQ ID NO: 860552 - RNA, 18 nt, Human
aaggaggcccgaggagag

SEQ ID NO: 860553 - RNA, 25 nt, Human
agaaauccccccaucaaagucacca

SEQ ID NO: 860554 - RNA, 21 nt, Human
agaggaucgaaucucuggaac

SEQ ID NO: 860555 - RNA, 24 nt, Human
agaggcuguccaggagcugcccag

SEQ ID NO: 860556 - RNA, 23 nt, Human
aggcagagguggcuaggcugggu

SEQ ID NO: 860557 - RNA, 25 nt, Human
aggccagcgccgagcgcggcccgga

SEQ ID NO: 860558 - RNA, 21 nt, Human
aggccuggcgcgucugggccc

SEQ ID NO: 860559 - RNA, 24 nt, Human
aggcggccaaaggcccuuccuguc

SEQ ID NO: 860560 - RNA, 23 nt, Human
aggcugcuggccuggugcuggcu

SEQ ID NO: 860561 - RNA, 20 nt, Human
agugccaguccccagguggc

SEQ ID NO: 860562 - RNA, 18 nt, Human
caccacagugccaguccc

SEQ ID NO: 860563 - RNA, 23 nt, Human
caccagucugcacacccaccugc

SEQ ID NO: 860564 - RNA, 22 nt, Human
cagcaggccagcgccgagcgcg

SEQ ID NO: 860565 - RNA, 19 nt, Human
cagccaccccuggaguccc

SEQ ID NO: 860566 - RNA, 22 nt, Human
cagggcggagccaguguccacu

SEQ ID NO: 860567 - RNA, 19 nt, Human
cagucucccagccaccccu

SEQ ID NO: 860568 - RNA, 18 nt, Human
caguggguccucauggcc

SEQ ID NO: 860569 - RNA, 22 nt, Human
cauuccugucccaaggcgaagg

SEQ ID NO: 860570 - RNA, 18 nt, Human
ccaaggcgaagggucuug

SEQ ID NO: 860571 - RNA, 19 nt, Human
ccaccccuggaguccccag

SEQ ID NO: 860572 - RNA, 22 nt, Human
ccaccugcagcuguccugaucc

SEQ ID NO: 860573 - RNA, 28 nt, Human
ccagaaauccccccaucaaagucaccaa

SEQ ID NO: 860574 - RNA, 22 nt, Human
ccagagccuugacauaaccaga

SEQ ID NO: 860575 - RNA, 20 nt, Human
ccagcgccgagcgcggcccg

SEQ ID NO: 860576 - RNA, 23 nt, Human
ccagggagaaggaggcccgagga

SEQ ID NO: 860577 - RNA, 18 nt, Human
ccccuggaguccccagcc

SEQ ID NO: 860578 - RNA, 19 nt, Human
ccccuggaguccccagccc

SEQ ID NO: 860579 - RNA, 20 nt, Human
ccuccggccggcggacccgc

SEQ ID NO: 860580 - RNA, 24 nt, Human
ccuccggccggcggacccgccggg

SEQ ID NO: 860581 - RNA, 23 nt, Human
cucaagugcucccggaggcagcc

SEQ ID NO: 860582 - RNA, 18 nt, Human
cuggagccaagaggcugu

SEQ ID NO: 860583 - RNA, 23 nt, Human
gagccgggcaggggccacagggu

SEQ ID NO: 860584 - RNA, 21 nt, Human
gagccuugacauaaccagaaa

SEQ ID NO: 860585 - RNA, 23 nt, Human
gaucuuucuucuccuguauggac

SEQ ID NO: 860586 - RNA, 18 nt, Human
gcaggugcccauuccugu

SEQ ID NO: 860587 - RNA, 21 nt, Human
gcccugaauggcagggaugag

SEQ ID NO: 860588 - RNA, 22 nt, Human
gcuggagccaagaggcugucca

SEQ ID NO: 860589 - RNA, 22 nt, Human
ggagggcugacccaagaggcag

SEQ ID NO: 860590 - RNA, 23 nt, Human
ggaggggccccaccaccuggggg

SEQ ID NO: 860591 - RNA, 18 nt, Human
ggccacauugggccacug

SEQ ID NO: 860592 - RNA, 22 nt, Human
ggccagcgccgagcgcggcccg

SEQ ID NO: 860593 - RNA, 20 nt, Human
ggcuaggcuggguguugacc

SEQ ID NO: 860594 - RNA, 21 nt, Human
ggcuaggcuggguguugaccu

SEQ ID NO: 860595 - RNA, 19 nt, Human
ggcugcuggccuggugcug

SEQ ID NO: 860596 - RNA, 25 nt, Human
ggggaagggagguuguuugcagaaa

SEQ ID NO: 860597 - RNA, 21 nt, Human
ggggagcagaauggguggggg

SEQ ID NO: 860598 - RNA, 22 nt, Human
gggugggggagccgggcagggg

SEQ ID NO: 860599 - RNA, 18 nt, Human
ggugggggagccgggcag

SEQ ID NO: 860600 - RNA, 18 nt, Human
gucaaggagggcugaccc

SEQ ID NO: 860601 - RNA, 24 nt, Human
gucucccagccaccccuggagucc

SEQ ID NO: 860602 - RNA, 20 nt, Human
uaaccagaaauccccccauc

SEQ ID NO: 860603 - RNA, 19 nt, Human
uacccaaggcggccaaagg

SEQ ID NO: 860604 - RNA, 20 nt, Human
uaccucaagugcucccggag

SEQ ID NO: 860605 - RNA, 22 nt, Human
uaccucaagugcucccggaggc

SEQ ID NO: 860606 - RNA, 22 nt, Human
ucaacuacccaaggcggccaaa

SEQ ID NO: 860607 - RNA, 24 nt, Human
ucaaggagggcugacccaagaggc

SEQ ID NO: 860608 - RNA, 19 nt, Human
uccccagguggccagggcg

SEQ ID NO: 860609 - RNA, 21 nt, Human
uccccagguggccagggcgga

SEQ ID NO: 860610 - RNA, 20 nt, Human
uccugccccugccuccucca

SEQ ID NO: 860611 - RNA, 22 nt, Human
ucuccuguauggacucagaagc

SEQ ID NO: 860612 - RNA, 23 nt, Human
ugacauaaccagaaaucccccca

SEQ ID NO: 860613 - RNA, 20 nt, Human
ugauccgccgaggccuccuu

SEQ ID NO: 860614 - RNA, 20 nt, Human
ugcagaaagacuuagcuaca

SEQ ID NO: 860615 - RNA, 23 nt, Human
ugcagaaagacuuagcuacaagg

SEQ ID NO: 860616 - RNA, 24 nt, Human
ugcccaguggguccucauggccug

SEQ ID NO: 860617 - RNA, 25 nt, Human
ugccccugccuccuccaggcgcugg

SEQ ID NO: 860618 - RNA, 19 nt, Human
ugccuccuccaggcgcugg

SEQ ID NO: 860619 - RNA, 23 nt, Human
ugcucccggaggcagccuaggac

SEQ ID NO: 860620 - RNA, 22 nt, Human
uggcuaggcuggguguugaccu

SEQ ID NO: 860621 - RNA, 19 nt, Human
ugggggagccgggcagggg

SEQ ID NO: 860622 - RNA, 22 nt, Human
ugggggcuggagccaagaggcu

SEQ ID NO: 860623 - RNA, 18 nt, Human
uguccaggagcugcccag

SEQ ID NO: 860624 - RNA, 20 nt, Human
uugacauaaccagaaauccc

SEQ ID NO: 860625 - RNA, 20 nt, Human
uuuuuuuuuuuuuuuugcaa

SEQ ID NO: 860626 - RNA, 22 nt, Human
uuuuuuuuuuuuuuuugcaagu

SEQ ID NO: 860627 - RNA, 19 nt, Human
agaaaacuugccaaguucu

SEQ ID NO: 860628 - RNA, 22 nt, Human
auccaggcaugauuaacuugac

SEQ ID NO: 860629 - RNA, 21 nt, Human
caaauggagaaaacuugccaa

SEQ ID NO: 860630 - RNA, 19 nt, Human
caacauccaggcaugauua

SEQ ID NO: 860631 - RNA, 23 nt, Human
cacaucuuuuaaacugagguaga

SEQ ID NO: 860632 - RNA, 25 nt, Human
cccccgggcagcccucagaaaugug

SEQ ID NO: 860633 - RNA, 23 nt, Human
cugaggaaaaaucaauagcauuc

SEQ ID NO: 860634 - RNA, 25 nt, Human
uaacuugaccacauauuaucacauc

SEQ ID NO: 860635 - RNA, 23 nt, Human
ucaacauccaggcaugauuaacu

SEQ ID NO: 860636 - RNA, 18 nt, Human
ucggagaagacaaccacg

SEQ ID NO: 860637 - RNA, 24 nt, Human
ugaccacauauuaucacaucuuuu

SEQ ID NO: 860638 - RNA, 27 nt, Human
ugaggaaaaaucaauagcauuccacag

SEQ ID NO: 860639 - RNA, 25 nt, Human
ugauucaucugugaauguugggcag

SEQ ID NO: 860640 - RNA, 21 nt, Human
uggcugacagaucugaaaguu

SEQ ID NO: 860641 - RNA, 18 nt, Human
uguguuagacagauugag

SEQ ID NO: 860642 - RNA, 20 nt, Human
uuccugcuugaggcugaagg

SEQ ID NO: 860643 - RNA, 21 nt, Human
uuuacauuguuauugagauuc

SEQ ID NO: 860644 - RNA, 21 nt, Human
uuuuguucuuccugcuugagg

SEQ ID NO: 860645 - RNA, 23 nt, Human
uuuuuuguucuuccugcuugagg

SEQ ID NO: 860646 - RNA, 19 nt, Human
uuuuuuuuuuuuuuuugcu

SEQ ID NO: 860647 - RNA, 20 nt, Human
uuuuuuuuuuuuuuuugcuu

SEQ ID NO: 860648 - RNA, 21 nt, Human
aacauuuuuauuguaaaaagu

SEQ ID NO: 860649 - RNA, 18 nt, Human
aagcuugcccacgaccgc

SEQ ID NO: 860650 - RNA, 21 nt, Human
agacacauuuuucuguacaaa

SEQ ID NO: 860651 - RNA, 21 nt, Human
aggcccagcgcucccggcccg

SEQ ID NO: 860652 - RNA, 21 nt, Human
caggcccagcgcucccggccc

SEQ ID NO: 860653 - RNA, 26 nt, Human
cauuuuuauuguaaaaaguucaagaa

SEQ ID NO: 860654 - RNA, 25 nt, Human
ccauuuacaagccaaaaaguaucag

SEQ ID NO: 860655 - RNA, 21 nt, Human
cccgcuggguaaccgucccag

SEQ ID NO: 860656 - RNA, 19 nt, Human
cgaccgucucaaggugaca

SEQ ID NO: 860657 - RNA, 24 nt, Human
cugauugcaaaauaggucucucuc

SEQ ID NO: 860658 - RNA, 20 nt, Human
cuucccggcaggcccagcgc

SEQ ID NO: 860659 - RNA, 23 nt, Human
uaaauaaauaaucuaaaaaucaa

SEQ ID NO: 860660 - RNA, 23 nt, Human
ugcaaaauaggucucucucucga

SEQ ID NO: 860661 - RNA, 18 nt, Human
uuuauuguaaaaaguuca

SEQ ID NO: 860662 - RNA, 19 nt, Human
aaaauaaaaaugacugguu

SEQ ID NO: 860663 - RNA, 21 nt, Human
aaacaaguuguaaacaauaua

SEQ ID NO: 860664 - RNA, 20 nt, Human
aaacaggagaauugcuugaa

SEQ ID NO: 860665 - RNA, 24 nt, Human
aaacaggagaauugcuugaaucug

SEQ ID NO: 860666 - RNA, 25 nt, Human
aacaagccaggacaguggacagacg

SEQ ID NO: 860667 - RNA, 19 nt, Human
aacauggugaaaccccauc

SEQ ID NO: 860668 - RNA, 20 nt, Human
aacauggugaaaccccaucu

SEQ ID NO: 860669 - RNA, 21 nt, Human
aacauggugaaaccccaucuc

SEQ ID NO: 860670 - RNA, 21 nt, Human
aacauggugaaaccccaucuc

SEQ ID NO: 860671 - RNA, 23 nt, Human
aagagcgaaacucugucucaaaa

SEQ ID NO: 860672 - RNA, 26 nt, Human
aauucuugguuguuuucggcugggca

SEQ ID NO: 860673 - RNA, 20 nt, Human
aauugcuugaaucugggugg

SEQ ID NO: 860674 - RNA, 20 nt, Human
acaagagcgaaacucugucu

SEQ ID NO: 860675 - RNA, 21 nt, Human
acaagagcgaaacucugucuc

SEQ ID NO: 860676 - RNA, 24 nt, Human
accaacauggugaaaccccaucuc

SEQ ID NO: 860677 - RNA, 22 nt, Human
accauugcacuccagccugggc

SEQ ID NO: 860678 - RNA, 18 nt, Human
accccaucucuacuaaaa

SEQ ID NO: 860679 - RNA, 24 nt, Human
accugaggucaggaguucaagacc

SEQ ID NO: 860680 - RNA, 19 nt, Human
acgcuggaucccuggcugg

SEQ ID NO: 860681 - RNA, 18 nt, Human
acucgggaggcugaaaca

SEQ ID NO: 860682 - RNA, 18 nt, Human
acuuggaguucuucuuuc

SEQ ID NO: 860683 - RNA, 22 nt, Human
agacuggaggugggagaggcag

SEQ ID NO: 860684 - RNA, 18 nt, Human
agagcgaaacucugucuc

SEQ ID NO: 860685 - RNA, 24 nt, Human
agcacuuugggagccugacguggg

SEQ ID NO: 860686 - RNA, 24 nt, Human
agccugaccaacauggugaaaccc

SEQ ID NO: 860687 - RNA, 18 nt, Human
agcucugcuccagcuaca

SEQ ID NO: 860688 - RNA, 21 nt, Human
agcugggcguggugaugggug

SEQ ID NO: 860689 - RNA, 24 nt, Human
aggcaggugccacccgcaggaguu

SEQ ID NO: 860690 - RNA, 23 nt, Human
agugguucaugccuguaaucuca

SEQ ID NO: 860691 - RNA, 24 nt, Human
agugguucaugccuguaaucucag

SEQ ID NO: 860692 - RNA, 23 nt, Human
aucaccugaggucaggaguucaa

SEQ ID NO: 860693 - RNA, 24 nt, Human
aucaccugaggucaggaguucaag

SEQ ID NO: 860694 - RNA, 19 nt, Human
augccuguaaucucagcac

SEQ ID NO: 860695 - RNA, 24 nt, Human
auugcacuccagccugggcaacaa

SEQ ID NO: 860696 - RNA, 21 nt, Human
auugcagugagcugaaauugc

SEQ ID NO: 860697 - RNA, 24 nt, Human
auuuggguguaggaaucuuggcug

SEQ ID NO: 860698 - RNA, 23 nt, Human
caacaagagcgaaacucugucuc

SEQ ID NO: 860699 - RNA, 24 nt, Human
caacauggugaaaccccaucucua

SEQ ID NO: 860700 - RNA, 18 nt, Human
caagccaggacaguggac

SEQ ID NO: 860701 - RNA, 20 nt, Human
caagccaggacaguggacag

SEQ ID NO: 860702 - RNA, 25 nt, Human
cacaauguauucauacuuuaaaacu

SEQ ID NO: 860703 - RNA, 20 nt, Human
caccauugcacuccagccug

SEQ ID NO: 860704 - RNA, 23 nt, Human
caccugaggucaggaguucaaga

SEQ ID NO: 860705 - RNA, 24 nt, Human
cacuccagccugggcaacaagagc

SEQ ID NO: 860706 - RNA, 25 nt, Human
cacuccagccugggcaacaagagcg

SEQ ID NO: 860707 - RNA, 20 nt, Human
cagaacgguugcccgggaga

SEQ ID NO: 860708 - RNA, 18 nt, Human
cagcacuuugggagccug

SEQ ID NO: 860709 - RNA, 20 nt, Human
cagcacuuugggagccugac

SEQ ID NO: 860710 - RNA, 22 nt, Human
cagcacuuugggagccugacgu

SEQ ID NO: 860711 - RNA, 20 nt, Human
caugccuguaaucucagcac

SEQ ID NO: 860712 - RNA, 24 nt, Human
caugccuguaaucucagcacuuug

SEQ ID NO: 860713 - RNA, 19 nt, Human
cauugcacuccagccuggg

SEQ ID NO: 860714 - RNA, 21 nt, Human
cauugcacuccagccugggca

SEQ ID NO: 860715 - RNA, 20 nt, Human
ccauugcacuccagccuggg

SEQ ID NO: 860716 - RNA, 21 nt, Human
ccauugcacuccagccugggc

SEQ ID NO: 860717 - RNA, 22 nt, Human
ccauugcacuccagccugggca

SEQ ID NO: 860718 - RNA, 23 nt, Human
ccauugcacuccagccugggcaa

SEQ ID NO: 860719 - RNA, 24 nt, Human
ccauugcacuccagccugggcaac

SEQ ID NO: 860720 - RNA, 25 nt, Human
ccauugcacuccagccugggcaaca

SEQ ID NO: 860721 - RNA, 21 nt, Human
ccgaguugaauaaaauagucc

SEQ ID NO: 860722 - RNA, 24 nt, Human
ccugaccaacauggugaaacccca

SEQ ID NO: 860723 - RNA, 20 nt, Human
ccugcaucccucuccguucu

SEQ ID NO: 860724 - RNA, 21 nt, Human
cggcagaaagaggaggaaccc

SEQ ID NO: 860725 - RNA, 22 nt, Human
cggcagaaagaggaggaaccgg

SEQ ID NO: 860726 - RNA, 20 nt, Human
cggcugggcacagugguuca

SEQ ID NO: 860727 - RNA, 24 nt, Human
cgugauacugaacacaccgacuaa

SEQ ID NO: 860728 - RNA, 21 nt, Human
cucugcagccaggaccccagu

SEQ ID NO: 860729 - RNA, 18 nt, Human
cugcaauuccagcuacuc

SEQ ID NO: 860730 - RNA, 21 nt, Human
cugcaauuccagcuacucggg

SEQ ID NO: 860731 - RNA, 19 nt, Human
cuggguggcagagauugca

SEQ ID NO: 860732 - RNA, 19 nt, Human
cugugcacacggcugggca

SEQ ID NO: 860733 - RNA, 23 nt, Human
cuugguuguuuucggcugggcac

SEQ ID NO: 860734 - RNA, 23 nt, Human
gacguggguggaucaccugaggu

SEQ ID NO: 860735 - RNA, 21 nt, Human
gacuggaggugggagaggcag

SEQ ID NO: 860736 - RNA, 18 nt, Human
gagcucgcccccaacucc

SEQ ID NO: 860737 - RNA, 23 nt, Human
gagcucgcccccaacuccaugcc

SEQ ID NO: 860738 - RNA, 22 nt, Human
gagcucugcuccagcuacacug

SEQ ID NO: 860739 - RNA, 21 nt, Human
gaggaggaaccggaugcagug

SEQ ID NO: 860740 - RNA, 19 nt, Human
gaguugaauaaaauagucc

SEQ ID NO: 860741 - RNA, 23 nt, Human
gaucaccugaggucaggaguuca

SEQ ID NO: 860742 - RNA, 24 nt, Human
gaucaccugaggucaggaguucaa

SEQ ID NO: 860743 - RNA, 23 nt, Human
gaucccuggcuggccugcauccc

SEQ ID NO: 860744 - RNA, 21 nt, Human
gcagaaagaggaggaaccgga

SEQ ID NO: 860745 - RNA, 20 nt, Human
gcagacagcucugcagccag

SEQ ID NO: 860746 - RNA, 18 nt, Human
gcccaacguggggagcag

SEQ ID NO: 860747 - RNA, 24 nt, Human
ggagaaggcagcgcuuggaacaag

SEQ ID NO: 860748 - RNA, 22 nt, Human
ggaucaccugaggucaggaguu

SEQ ID NO: 860749 - RNA, 23 nt, Human
ggcacagugguucaugccuguaa

SEQ ID NO: 860750 - RNA, 23 nt, Human
gggaagacgcuggaucccuggcu

SEQ ID NO: 860751 - RNA, 23 nt, Human
gggcguggugaugggugucugca

SEQ ID NO: 860752 - RNA, 19 nt, Human
ggggagcagacagcucugc

SEQ ID NO: 860753 - RNA, 23 nt, Human
guacaugacugacaagaccagug

SEQ ID NO: 860754 - RNA, 19 nt, Human
uaaaaugggggccuuuggc

SEQ ID NO: 860755 - RNA, 19 nt, Human
uaaaauuagcugggcgugg

SEQ ID NO: 860756 - RNA, 19 nt, Human
uaccucaucgacguuccca

SEQ ID NO: 860757 - RNA, 20 nt, Human
uacugaugagcucgccccca

SEQ ID NO: 860758 - RNA, 23 nt, Human
ucaugccuguaaucucagcacuu

SEQ ID NO: 860759 - RNA, 23 nt, Human
ucgggaggcugaaacaggagaau

SEQ ID NO: 860760 - RNA, 22 nt, Human
ucucuacuaaaaauacauaaaa

SEQ ID NO: 860761 - RNA, 21 nt, Human
ucugcaauuccagcuacucgg

SEQ ID NO: 860762 - RNA, 20 nt, Human
ucuugguuguuuucggcugg

SEQ ID NO: 860763 - RNA, 25 nt, Human
ugaaacaggagaauugcuugaaucu

SEQ ID NO: 860764 - RNA, 19 nt, Human
ugaaaccccaucucuacua

SEQ ID NO: 860765 - RNA, 19 nt, Human
ugacauggagucgcaugaa

SEQ ID NO: 860766 - RNA, 24 nt, Human
ugaccaacauggugaaaccccauc

SEQ ID NO: 860767 - RNA, 18 nt, Human
ugacguggguggaucacc

SEQ ID NO: 860768 - RNA, 24 nt, Human
ugacguggguggaucaccugaggu

SEQ ID NO: 860769 - RNA, 26 nt, Human
ugacguggguggaucaccugagguca

SEQ ID NO: 860770 - RNA, 21 nt, Human
ugcaccauugcacuccagccu

SEQ ID NO: 860771 - RNA, 19 nt, Human
ugcacuccagccugggcaa

SEQ ID NO: 860772 - RNA, 22 nt, Human
ugcacuccagccugggcaacaa

SEQ ID NO: 860773 - RNA, 23 nt, Human
ugccuguaaucucagcacuuugg

SEQ ID NO: 860774 - RNA, 23 nt, Human
ugccuguaaucucagcacuuugg

SEQ ID NO: 860775 - RNA, 24 nt, Human
ugccuguaaucucagcacuuuggg

SEQ ID NO: 860776 - RNA, 24 nt, Human
uggaucaccugaggucaggaguuc

SEQ ID NO: 860777 - RNA, 27 nt, Human
uggaucaccugaggucaggaguucaag

SEQ ID NO: 860778 - RNA, 18 nt, Human
uggaucccuggcuggccu

SEQ ID NO: 860779 - RNA, 18 nt, Human
uggcagagauugcaguga

SEQ ID NO: 860780 - RNA, 19 nt, Human
uggcuggaguugcccaacg

SEQ ID NO: 860781 - RNA, 22 nt, Human
uggcuggaguugcccaacgugg

SEQ ID NO: 860782 - RNA, 19 nt, Human
ugggagaggcaggugccac

SEQ ID NO: 860783 - RNA, 24 nt, Human
uggguggaucaccugaggucagga

SEQ ID NO: 860784 - RNA, 23 nt, Human
uggugaugggugucugcaauucc

SEQ ID NO: 860785 - RNA, 22 nt, Human
ugguucaugccuguaaucucag

SEQ ID NO: 860786 - RNA, 24 nt, Human
ugguucaugccuguaaucucagca

SEQ ID NO: 860787 - RNA, 22 nt, Human
uguaggaaucuuggcuggaguu

SEQ ID NO: 860788 - RNA, 24 nt, Human
ugucugcaauuccagcuacucggg

SEQ ID NO: 860789 - RNA, 24 nt, Human
ugugcacacggcugggcacacgca

SEQ ID NO: 860790 - RNA, 23 nt, Human
ugugcagacgaacacugugugca

SEQ ID NO: 860791 - RNA, 21 nt, Human
ugugcagacggaggccaugga

SEQ ID NO: 860792 - RNA, 19 nt, Human
uuagcugggcguggugaug

SEQ ID NO: 860793 - RNA, 23 nt, Human
uuagcugggcguggugaugggug

SEQ ID NO: 860794 - RNA, 24 nt, Human
uuagcugggcguggugaugggugu

SEQ ID NO: 860795 - RNA, 23 nt, Human
uugcaccauugcacuccagccug

SEQ ID NO: 860796 - RNA, 31 nt, Human
uugcaccauugcacuccagccugggcaacaa

SEQ ID NO: 860797 - RNA, 22 nt, Human
uugcagugagcugaaauugcac

SEQ ID NO: 860798 - RNA, 20 nt, Human
uugcccgggagagucggcag

SEQ ID NO: 860799 - RNA, 18 nt, Human
uugcuugaaucugggugg

SEQ ID NO: 860800 - RNA, 18 nt, Human
uuggcccuugucuugagc

SEQ ID NO: 860801 - RNA, 23 nt, Human
uuuuuuuuuuuuuuuuucacaau

SEQ ID NO: 860802 - RNA, 24 nt, Human
uuuuuuuuuuuuuuuuucacaaug

SEQ ID NO: 860803 - RNA, 18 nt, Human
aaaaaaacagaccaaaaa

SEQ ID NO: 860804 - RNA, 21 nt, Human
aaaaagaggaagauuuagaga

SEQ ID NO: 860805 - RNA, 24 nt, Human
aacaaauucuuaaauagaacaaaa

SEQ ID NO: 860806 - RNA, 21 nt, Human
aaccagagccauccuuucuuc

SEQ ID NO: 860807 - RNA, 24 nt, Human
aagaaaagcagagaagagagaggc

SEQ ID NO: 860808 - RNA, 21 nt, Human
aagagacacucccucaugacu

SEQ ID NO: 860809 - RNA, 18 nt, Human
aagccacccacccuuccc

SEQ ID NO: 860810 - RNA, 24 nt, Human
aagccacccacccuucccacaacc

SEQ ID NO: 860811 - RNA, 19 nt, Human
acagaaaggcucuaccuuc

SEQ ID NO: 860812 - RNA, 19 nt, Human
acagcuguagccaugcccc

SEQ ID NO: 860813 - RNA, 25 nt, Human
accagagccauccuuucuuccaccu

SEQ ID NO: 860814 - RNA, 18 nt, Human
acccccggcaagccccgg

SEQ ID NO: 860815 - RNA, 20 nt, Human
acuguagccuuggccuuuca

SEQ ID NO: 860816 - RNA, 19 nt, Human
agaccaaaaaccuucuguc

SEQ ID NO: 860817 - RNA, 22 nt, Human
agagaagagagaggcaugggga

SEQ ID NO: 860818 - RNA, 22 nt, Human
aggaaaaaagaggaagauuuag

SEQ ID NO: 860819 - RNA, 18 nt, Human
aggcauggggaggguggg

SEQ ID NO: 860820 - RNA, 22 nt, Human
aggcauggggaggguggggggu

SEQ ID NO: 860821 - RNA, 25 nt, Human
agugagaagaaaagcagagaagaga

SEQ ID NO: 860822 - RNA, 23 nt, Human
augccccagaggccccgggcaac

SEQ ID NO: 860823 - RNA, 22 nt, Human
augcgcccccagcccagccccu

SEQ ID NO: 860824 - RNA, 21 nt, Human
caagaagagacacucccucau

SEQ ID NO: 860825 - RNA, 18 nt, Human
cacacuugggcacagagg

SEQ ID NO: 860826 - RNA, 24 nt, Human
cacagcccagucacaacccccuuu

SEQ ID NO: 860827 - RNA, 21 nt, Human
caccccacccucacacagcca

SEQ ID NO: 860828 - RNA, 25 nt, Human
caccccacccucacacagcccaguc

SEQ ID NO: 860829 - RNA, 23 nt, Human
caccccuguggcccucuuguggc

SEQ ID NO: 860830 - RNA, 21 nt, Human
cacccuggcuggggcggggcc

SEQ ID NO: 860831 - RNA, 21 nt, Human
cacuacgugggcauuaacacc

SEQ ID NO: 860832 - RNA, 19 nt, Human
cagcccagccccugccucc

SEQ ID NO: 860833 - RNA, 20 nt, Human
cagcccagucacaacccccu

SEQ ID NO: 860834 - RNA, 23 nt, Human
cagccccuccaggugggggugau

SEQ ID NO: 860835 - RNA, 18 nt, Human
cagccccugccuccucuc

SEQ ID NO: 860836 - RNA, 24 nt, Human
caugcaaaacacacaacggagaag

SEQ ID NO: 860837 - RNA, 21 nt, Human
ccacaaccauaaaaacguaca

SEQ ID NO: 860838 - RNA, 22 nt, Human
ccaccccacccucacacagccc

SEQ ID NO: 860839 - RNA, 20 nt, Human
ccacccuucccacaaccaua

SEQ ID NO: 860840 - RNA, 21 nt, Human
ccagaggccuccacuacgugg

SEQ ID NO: 860841 - RNA, 21 nt, Human
ccagccccuccaggugggggu

SEQ ID NO: 860842 - RNA, 19 nt, Human
ccagugaccuuggaaugca

SEQ ID NO: 860843 - RNA, 24 nt, Human
cccagcccagccccugccuccucu

SEQ ID NO: 860844 - RNA, 21 nt, Human
ccccaagaagagacacucccu

SEQ ID NO: 860845 - RNA, 24 nt, Human
ccccagaggccccgggcaaccccc

SEQ ID NO: 860846 - RNA, 19 nt, Human
ccccagcccagccccugcc

SEQ ID NO: 860847 - RNA, 21 nt, Human
cccccagcccagccccugccu

SEQ ID NO: 860848 - RNA, 21 nt, Human
cccccucccaccccacccuca

SEQ ID NO: 860849 - RNA, 25 nt, Human
ccccgggcaacccccggcaagcccc

SEQ ID NO: 860850 - RNA, 20 nt, Human
ccccugccuccucuccaaac

SEQ ID NO: 860851 - RNA, 18 nt, Human
cccgcacauccuaggagg

SEQ ID NO: 860852 - RNA, 25 nt, Human
cccuguacuguagccuuggccuuuc

SEQ ID NO: 860853 - RNA, 24 nt, Human
cccuuaauucuaaagccacccacc

SEQ ID NO: 860854 - RNA, 21 nt, Human
ccucacacagcccagucacaa

SEQ ID NO: 860855 - RNA, 24 nt, Human
ccucccaccccacccucacacagc

SEQ ID NO: 860856 - RNA, 24 nt, Human
ccuguggcccucuuguggcccucu

SEQ ID NO: 860857 - RNA, 19 nt, Human
ccuuucuuccaccucccgc

SEQ ID NO: 860858 - RNA, 21 nt, Human
cuaaagccacccacccuuccc

SEQ ID NO: 860859 - RNA, 25 nt, Human
cucccaccccacccucacacagccc

SEQ ID NO: 860860 - RNA, 21 nt, Human
cugccacagcuguagccaugc

SEQ ID NO: 860861 - RNA, 19 nt, Human
cugccuccucuccaaacac

SEQ ID NO: 860862 - RNA, 19 nt, Human
cugccuccucuccaaacac

SEQ ID NO: 860863 - RNA, 24 nt, Human
cugcugggagccuugagcccacag

SEQ ID NO: 860864 - RNA, 22 nt, Human
gaaaagcagagaagagagaggc

SEQ ID NO: 860865 - RNA, 26 nt, Human
gacacucccucaugacugucacucuu

SEQ ID NO: 860866 - RNA, 18 nt, Human
gacuaaaaaaacagacca

SEQ ID NO: 860867 - RNA, 20 nt, Human
gagaagaaaagcagagaaga

SEQ ID NO: 860868 - RNA, 23 nt, Human
gagaggcauggggaggguggggg

SEQ ID NO: 860869 - RNA, 22 nt, Human
gcacauccuaggagggguuggg

SEQ ID NO: 860870 - RNA, 20 nt, Human
gccacccacccuucccacaa

SEQ ID NO: 860871 - RNA, 21 nt, Human
gcccccagcccagccccugcc

SEQ ID NO: 860872 - RNA, 20 nt, Human
gccccgggagugggggcagg

SEQ ID NO: 860873 - RNA, 23 nt, Human
gcccuguacuguagccuuggccu

SEQ ID NO: 860874 - RNA, 19 nt, Human
gcucucguucuuaccuugg

SEQ ID NO: 860875 - RNA, 23 nt, Human
ggaagugagaagaaaagcagaga

SEQ ID NO: 860876 - RNA, 21 nt, Human
ggagaagcgagcgcucccagg

SEQ ID NO: 860877 - RNA, 23 nt, Human
gggcagcccggcuggcugugagg

SEQ ID NO: 860878 - RNA, 21 nt, Human
gggcaggggcccuugagggac

SEQ ID NO: 860879 - RNA, 21 nt, Human
gggcccccucccaccccaccc

SEQ ID NO: 860880 - RNA, 23 nt, Human
ggggagggugggggguugcuggg

SEQ ID NO: 860881 - RNA, 19 nt, Human
uaaagccacccacccuucc

SEQ ID NO: 860882 - RNA, 21 nt, Human
uaaauagaacaaaauaaacac

SEQ ID NO: 860883 - RNA, 18 nt, Human
uaccuugggcccucuuac

SEQ ID NO: 860884 - RNA, 20 nt, Human
ucaagcacugcacauggacu

SEQ ID NO: 860885 - RNA, 22 nt, Human
ucagcugacaacucccggccac

SEQ ID NO: 860886 - RNA, 23 nt, Human
uccccaagaagagacacucccuc

SEQ ID NO: 860887 - RNA, 18 nt, Human
ucccucaugacugucacu

SEQ ID NO: 860888 - RNA, 20 nt, Human
ucuaaagccacccacccuuc

SEQ ID NO: 860889 - RNA, 20 nt, Human
ucuaccuucuuuccucccca

SEQ ID NO: 860890 - RNA, 23 nt, Human
ucuaccuucuuuccuccccaaga

SEQ ID NO: 860891 - RNA, 22 nt, Human
ucugcugggagccuugagccca

SEQ ID NO: 860892 - RNA, 24 nt, Human
ugaaugggcagcccggcuggcugu

SEQ ID NO: 860893 - RNA, 23 nt, Human
ugcaaaacacacaacggagaagc

SEQ ID NO: 860894 - RNA, 23 nt, Human
ugcaugccacugccaggcaugau

SEQ ID NO: 860895 - RNA, 20 nt, Human
ugccccagaggccccgggca

SEQ ID NO: 860896 - RNA, 19 nt, Human
uggaaugcaggaucugcca

SEQ ID NO: 860897 - RNA, 19 nt, Human
uggcacaauuccugccucu

SEQ ID NO: 860898 - RNA, 19 nt, Human
uggcuggggcggggcccug

SEQ ID NO: 860899 - RNA, 21 nt, Human
uggcuggggcggggcccugua

SEQ ID NO: 860900 - RNA, 24 nt, Human
uggcugugaggcgccagcacacug

SEQ ID NO: 860901 - RNA, 18 nt, Human
ugggaaagggcccaggcc

SEQ ID NO: 860902 - RNA, 23 nt, Human
ugggaaagggcccaggccccauu

SEQ ID NO: 860903 - RNA, 19 nt, Human
ugggcacagaggcucugcc

SEQ ID NO: 860904 - RNA, 24 nt, Human
uggggagggugggggguugcuggg

SEQ ID NO: 860905 - RNA, 26 nt, Human
uguacuguagccuuggccuuucauuc

SEQ ID NO: 860906 - RNA, 21 nt, Human
uugcugggcccccucccaccc

SEQ ID NO: 860907 - RNA, 24 nt, Human
aaaaaagaaaaaaaaaguaaagag

SEQ ID NO: 860908 - RNA, 18 nt, Human
aaaaagaaaaaagaaaaa

SEQ ID NO: 860909 - RNA, 23 nt, Human
aaaacaaauacagccacauccuc

SEQ ID NO: 860910 - RNA, 21 nt, Human
aaaagaccuaucugauaaagg

SEQ ID NO: 860911 - RNA, 22 nt, Human
aaacaaauacagccacauccuc

SEQ ID NO: 860912 - RNA, 24 nt, Human
aaacaaauacagccacauccucau

SEQ ID NO: 860913 - RNA, 22 nt, Human
aaaccagucuuagauuguauua

SEQ ID NO: 860914 - RNA, 21 nt, Human
aaagaaaaaaaaaguaaagag

SEQ ID NO: 860915 - RNA, 23 nt, Human
aaagaaaaaaaaaguaaagagaa

SEQ ID NO: 860916 - RNA, 21 nt, Human
aauggaaaagugaaacuuaga

SEQ ID NO: 860917 - RNA, 21 nt, Human
acagaagucccacaacaugag

SEQ ID NO: 860918 - RNA, 21 nt, Human
acccuaaacacacacagaagu

SEQ ID NO: 860919 - RNA, 25 nt, Human
acccucaucuucccuuaagagacca

SEQ ID NO: 860920 - RNA, 22 nt, Human
accugugucugguuuucacaga

SEQ ID NO: 860921 - RNA, 28 nt, Human
agaaaaaagaaaaaaaaaguaaagagaa

SEQ ID NO: 860922 - RNA, 24 nt, Human
agcacuuugggaggcugaggcagg

SEQ ID NO: 860923 - RNA, 24 nt, Human
aggcaggaauuugaggcacaugcg

SEQ ID NO: 860924 - RNA, 18 nt, Human
aggcaggcggaucacuug

SEQ ID NO: 860925 - RNA, 22 nt, Human
aggcaggcggaucacuugaggu

SEQ ID NO: 860926 - RNA, 26 nt, Human
aggcaggcggaucacuugaggucagg

SEQ ID NO: 860927 - RNA, 21 nt, Human
aggcugaggcaggcggaucac

SEQ ID NO: 860928 - RNA, 24 nt, Human
aggcugaggcaggcggaucacuug

SEQ ID NO: 860929 - RNA, 21 nt, Human
aggcuuagcauagccuaaagc

SEQ ID NO: 860930 - RNA, 21 nt, Human
agggauaagguuacacccacu

SEQ ID NO: 860931 - RNA, 23 nt, Human
auacaaggaacacuuaaaauuca

SEQ ID NO: 860932 - RNA, 23 nt, Human
auacagccacauccucaucuaca

SEQ ID NO: 860933 - RNA, 21 nt, Human
auauuguaaauaaacuuuuag

SEQ ID NO: 860934 - RNA, 23 nt, Human
aucccaaucaguacauuuuucuc

SEQ ID NO: 860935 - RNA, 20 nt, Human
augagaaccaaacaacaaug

SEQ ID NO: 860936 - RNA, 22 nt, Human
caacaggaagguucaauggugg

SEQ ID NO: 860937 - RNA, 19 nt, Human
caacccuaaacacacacag

SEQ ID NO: 860938 - RNA, 22 nt, Human
caagacacuguucucuccuucc

SEQ ID NO: 860939 - RNA, 21 nt, Human
caagcaauacuggcuuuucuc

SEQ ID NO: 860940 - RNA, 19 nt, Human
caaggaacacuuaaaauuc

SEQ ID NO: 860941 - RNA, 22 nt, Human
caaggacaaaccagucuuagau

SEQ ID NO: 860942 - RNA, 22 nt, Human
cacacacaucacacaugcauug

SEQ ID NO: 860943 - RNA, 24 nt, Human
cacaccuguaaucccagcacuuug

SEQ ID NO: 860944 - RNA, 28 nt, Human
caccccacaauguccacucaaaucccaa

SEQ ID NO: 860945 - RNA, 23 nt, Human
caccuguaaucccagcacuuugg

SEQ ID NO: 860946 - RNA, 24 nt, Human
caccuguaaucccagcacuuuggg

SEQ ID NO: 860947 - RNA, 23 nt, Human
cagauaccucaccaaagcuauac

SEQ ID NO: 860948 - RNA, 24 nt, Human
cagcacuuugggaggcugaggcag

SEQ ID NO: 860949 - RNA, 26 nt, Human
cagcacuuugggaggcugaggcaggc

SEQ ID NO: 860950 - RNA, 21 nt, Human
caggaagguucaaugguggga

SEQ ID NO: 860951 - RNA, 19 nt, Human
caggaauuugaggcacaug

SEQ ID NO: 860952 - RNA, 24 nt, Human
caggcggaucacuugaggucagga

SEQ ID NO: 860953 - RNA, 23 nt, Human
ccaacccaucagcauccccaaga

SEQ ID NO: 860954 - RNA, 24 nt, Human
cccacaauguccacucaaauccca

SEQ ID NO: 860955 - RNA, 20 nt, Human
cccauacucauuauauucca

SEQ ID NO: 860956 - RNA, 21 nt, Human
ccccaagacacuguucucucc

SEQ ID NO: 860957 - RNA, 18 nt, Human
ccccgcggcgcuccccuc

SEQ ID NO: 860958 - RNA, 18 nt, Human
cccgcggcgcuccccucu

SEQ ID NO: 860959 - RNA, 18 nt, Human
cccugggugcugcccugc

SEQ ID NO: 860960 - RNA, 20 nt, Human
cccugggugcugcccugcgg

SEQ ID NO: 860961 - RNA, 18 nt, Human
cccuuccucuuccuuguu

SEQ ID NO: 860962 - RNA, 23 nt, Human
ccucuauauuccaguccucucua

SEQ ID NO: 860963 - RNA, 28 nt, Human
ccugcaggauuccccuuccucuuccuug

SEQ ID NO: 860964 - RNA, 20 nt, Human
ccuggccaccugugucuggu

SEQ ID NO: 860965 - RNA, 21 nt, Human
ccugggaucuuaacaucuucu

SEQ ID NO: 860966 - RNA, 24 nt, Human
cggaucacuugaggucaggaguuc

SEQ ID NO: 860967 - RNA, 21 nt, Human
cggcgcuccccgcggcgcucc

SEQ ID NO: 860968 - RNA, 22 nt, Human
cucacaccuguaaucccagcac

SEQ ID NO: 860969 - RNA, 24 nt, Human
cucacaccuguaaucccagcacuu

SEQ ID NO: 860970 - RNA, 18 nt, Human
cucuauauuccaguccuc

SEQ ID NO: 860971 - RNA, 18 nt, Human
cugucauaugccuucucc

SEQ ID NO: 860972 - RNA, 20 nt, Human
cuucccgcggcgcuccccgc

SEQ ID NO: 860973 - RNA, 19 nt, Human
gaaacuuagagcuuaaaau

SEQ ID NO: 860974 - RNA, 19 nt, Human
gaacucaaaacaaauacag

SEQ ID NO: 860975 - RNA, 21 nt, Human
gacucacaccuguaaucccag

SEQ ID NO: 860976 - RNA, 21 nt, Human
gagacagguuguuaggagcac

SEQ ID NO: 860977 - RNA, 23 nt, Human
gaggaaaggcaggaauuugaggc

SEQ ID NO: 860978 - RNA, 21 nt, Human
gaucacuugaggucaggaguu

SEQ ID NO: 860979 - RNA, 24 nt, Human
gaucacuugaggucaggaguucga

SEQ ID NO: 860980 - RNA, 18 nt, Human
ggacaaaccagucuuaga

SEQ ID NO: 860981 - RNA, 23 nt, Human
ggaucacuugaggucaggaguuc

SEQ ID NO: 860982 - RNA, 24 nt, Human
ggaucacuugaggucaggaguucg

SEQ ID NO: 860983 - RNA, 18 nt, Human
ggggaaacugaggcucag

SEQ ID NO: 860984 - RNA, 18 nt, Human
ggggaauggggaaacuga

SEQ ID NO: 860985 - RNA, 21 nt, Human
gugaaacuuagagcuuaaaau

SEQ ID NO: 860986 - RNA, 19 nt, Human
gugcucacacacaucacac

SEQ ID NO: 860987 - RNA, 26 nt, Human
gugcugcccugcggaaaggggucaac

SEQ ID NO: 860988 - RNA, 20 nt, Human
uaaaaaugggcaaaaccucu

SEQ ID NO: 860989 - RNA, 22 nt, Human
uaaaaaugggcaaaaccucuaa

SEQ ID NO: 860990 - RNA, 18 nt, Human
uaaacacacacagaaguc

SEQ ID NO: 860991 - RNA, 22 nt, Human
uaaacacacacagaagucccac

SEQ ID NO: 860992 - RNA, 23 nt, Human
uaaaccagaacugcaaaucuaua

SEQ ID NO: 860993 - RNA, 23 nt, Human
uaacagauaccucaccaaagcua

SEQ ID NO: 860994 - RNA, 24 nt, Human
uaagaaacaauacauuaugagaac

SEQ ID NO: 860995 - RNA, 24 nt, Human
uaaucaccugcugccaacccuaaa

SEQ ID NO: 860996 - RNA, 22 nt, Human
uacauuaugagaaccaaacaac

SEQ ID NO: 860997 - RNA, 21 nt, Human
uaccauuucuuuaaaaaaaga

SEQ ID NO: 860998 - RNA, 19 nt, Human
uacuugucagauuuugaua

SEQ ID NO: 860999 - RNA, 23 nt, Human
uagaacucaaaacaaauacagcc

SEQ ID NO: 861000 - RNA, 25 nt, Human
uagaucauaaaaucauagcccaauu

SEQ ID NO: 861001 - RNA, 20 nt, Human
uaggacacaacauuucuugu

SEQ ID NO: 861002 - RNA, 21 nt, Human
uauacagauggcaaacauaug

SEQ ID NO: 861003 - RNA, 23 nt, Human
uauccccauuuuucuauuggggg

SEQ ID NO: 861004 - RNA, 24 nt, Human
ucaccugcugccaacccuaaacac

SEQ ID NO: 861005 - RNA, 19 nt, Human
ucagccucucaagagacag

SEQ ID NO: 861006 - RNA, 23 nt, Human
uccagacuaggacacauuaggac

SEQ ID NO: 861007 - RNA, 21 nt, Human
uccaucaaaaguauucuuuga

SEQ ID NO: 861008 - RNA, 24 nt, Human
ucccugcaggauuccccuuccucu

SEQ ID NO: 861009 - RNA, 24 nt, Human
uccgaccagauguggugacucaca

SEQ ID NO: 861010 - RNA, 23 nt, Human
ucuacccucaucuucccuuaaga

SEQ ID NO: 861011 - RNA, 22 nt, Human
ucuaggaugugaauaguaacuc

SEQ ID NO: 861012 - RNA, 22 nt, Human
ucucuugaggaaaggcaggaau

SEQ ID NO: 861013 - RNA, 23 nt, Human
ucucuuuuuccuugacucuagga

SEQ ID NO: 861014 - RNA, 20 nt, Human
ugaaagugaaccccugauga

SEQ ID NO: 861015 - RNA, 22 nt, Human
ugacucacaccuguaaucccag

SEQ ID NO: 861016 - RNA, 24 nt, Human
ugacucacaccuguaaucccagca

SEQ ID NO: 861017 - RNA, 19 nt, Human
ugagaaaauaagccacagc

SEQ ID NO: 861018 - RNA, 18 nt, Human
ugagauucaauucugaca

SEQ ID NO: 861019 - RNA, 25 nt, Human
ugaggcacaugcgcuucccgcggcg

SEQ ID NO: 861020 - RNA, 24 nt, Human
ugaggcaggcggaucacuugaggu

SEQ ID NO: 861021 - RNA, 26 nt, Human
ugaggcaggcggaucacuugagguca

SEQ ID NO: 861022 - RNA, 20 nt, Human
ugcaaaagaccuaucugaua

SEQ ID NO: 861023 - RNA, 20 nt, Human
ugcauugcuguccucucauu

SEQ ID NO: 861024 - RNA, 23 nt, Human
ugcgcuucccgcggcgcuccccg

SEQ ID NO: 861025 - RNA, 25 nt, Human
ugcuaccauuucuuuaaaaaaagaa

SEQ ID NO: 861026 - RNA, 28 nt, Human
ugcucacacacaucacacaugcauugcu

SEQ ID NO: 861027 - RNA, 19 nt, Human
ugcugccaacccuaaacac

SEQ ID NO: 861028 - RNA, 18 nt, Human
uggcuggaauucaugcug

SEQ ID NO: 861029 - RNA, 18 nt, Human
ugggaaauuaccuguaug

SEQ ID NO: 861030 - RNA, 18 nt, Human
ugggaggcugaggcaggc

SEQ ID NO: 861031 - RNA, 20 nt, Human
ugggaggcugaggcaggcgg

SEQ ID NO: 861032 - RNA, 24 nt, Human
ugggaggcugaggcaggcggauca

SEQ ID NO: 861033 - RNA, 23 nt, Human
uggggggaauggggaaacugagg

SEQ ID NO: 861034 - RNA, 24 nt, Human
uggugacucacaccuguaauccca

SEQ ID NO: 861035 - RNA, 27 nt, Human
ugugugcucacacacaucacacaugca

SEQ ID NO: 861036 - RNA, 24 nt, Human
uuauuggugaacugcagauuaaaa

SEQ ID NO: 861037 - RNA, 20 nt, Human
uuccucuuccuuguucagcc

SEQ ID NO: 861038 - RNA, 25 nt, Human
uugggaggcugaggcaggcggauca

SEQ ID NO: 861039 - RNA, 22 nt, Human
uuguauuauccuauuuaaacca

SEQ ID NO: 861040 - RNA, 24 nt, Human
uuucauggcuuuuaaugagccauu

SEQ ID NO: 861041 - RNA, 19 nt, Human
uuuuuuuuuuuaagggugg

SEQ ID NO: 861042 - RNA, 18 nt, Human
uuuuuuuuuuuuuaaggg

SEQ ID NO: 861043 - RNA, 22 nt, Human
uuuuuuuuuuuuuuuuuaaggg

SEQ ID NO: 861044 - RNA, 24 nt, Human
uuuuuuuuuuuuuuuuuaagggug

SEQ ID NO: 861045 - RNA, 21 nt, Human
aagaaaagcuucccagggaaa

SEQ ID NO: 861046 - RNA, 23 nt, Human
aagagacuaaagaccccaacuca

SEQ ID NO: 861047 - RNA, 18 nt, Human
aagcaaaaucugaucagc

SEQ ID NO: 861048 - RNA, 18 nt, Human
acacuaaacacuacccug

SEQ ID NO: 861049 - RNA, 25 nt, Human
acaggacaggaaaagcuccugcgaa

SEQ ID NO: 861050 - RNA, 20 nt, Human
accugcaaagagaugugucc

SEQ ID NO: 861051 - RNA, 24 nt, Human
accugcaaagagauguguccagca

SEQ ID NO: 861052 - RNA, 20 nt, Human
acuucaucacuggggcacaa

SEQ ID NO: 861053 - RNA, 18 nt, Human
agcaaaaucugaucagcu

SEQ ID NO: 861054 - RNA, 23 nt, Human
agcugcagggauaggugggugug

SEQ ID NO: 861055 - RNA, 22 nt, Human
aggaaauaauccacccuguguc

SEQ ID NO: 861056 - RNA, 20 nt, Human
aggcccccugucccuugcag

SEQ ID NO: 861057 - RNA, 21 nt, Human
agggauagguggguguggaua

SEQ ID NO: 861058 - RNA, 19 nt, Human
auaaaagucugcugcccuc

SEQ ID NO: 861059 - RNA, 22 nt, Human
auaaaagucugcugcccucaga

SEQ ID NO: 861060 - RNA, 21 nt, Human
caaauauuaacacuaaacacu

SEQ ID NO: 861061 - RNA, 21 nt, Human
caaauucugcuaauauccaaa

SEQ ID NO: 861062 - RNA, 23 nt, Human
caacgcgggacaugaaaccuccu

SEQ ID NO: 861063 - RNA, 20 nt, Human
caacuggaaaaccacaggac

SEQ ID NO: 861064 - RNA, 26 nt, Human
caagaaaagcuucccagggaaacuaa

SEQ ID NO: 861065 - RNA, 23 nt, Human
caccaaacagaauauuaaagcaa

SEQ ID NO: 861066 - RNA, 19 nt, Human
cacuggggcacaaugagcu

SEQ ID NO: 861067 - RNA, 22 nt, Human
cagacacucagcauauucugcc

SEQ ID NO: 861068 - RNA, 26 nt, Human
cagcuggcuuuuccucccuggggcuc

SEQ ID NO: 861069 - RNA, 20 nt, Human
caggaaaagcuccugcgaau

SEQ ID NO: 861070 - RNA, 24 nt, Human
caggaaacaucuaauccaugcuca

SEQ ID NO: 861071 - RNA, 19 nt, Human
caggcugacuccagacacu

SEQ ID NO: 861072 - RNA, 21 nt, Human
cauucugccucuccaugggag

SEQ ID NO: 861073 - RNA, 20 nt, Human
ccacaggacaggaaaagcuc

SEQ ID NO: 861074 - RNA, 21 nt, Human
cccccugucccuugcagaauc

SEQ ID NO: 861075 - RNA, 18 nt, Human
ccgggaccuccucuuggg

SEQ ID NO: 861076 - RNA, 18 nt, Human
ccucugaacuccgccugg

SEQ ID NO: 861077 - RNA, 21 nt, Human
ccucugaacuccgccuggccu

SEQ ID NO: 861078 - RNA, 20 nt, Human
ccugccauucugccucucca

SEQ ID NO: 861079 - RNA, 18 nt, Human
cgaauggagcacuuuuuu

SEQ ID NO: 861080 - RNA, 22 nt, Human
cgggacaugaaaccuccugcca

SEQ ID NO: 861081 - RNA, 22 nt, Human
cuccagacacucagcauauucu

SEQ ID NO: 861082 - RNA, 20 nt, Human
cuccagcuggcuuuuccucc

SEQ ID NO: 861083 - RNA, 24 nt, Human
cugccucugggccagaggucuggg

SEQ ID NO: 861084 - RNA, 19 nt, Human
cugcugcccucagauucag

SEQ ID NO: 861085 - RNA, 22 nt, Human
cugcugcuacaacuguugcugc

SEQ ID NO: 861086 - RNA, 26 nt, Human
cugcugcugcuacaacuguugcugcc

SEQ ID NO: 861087 - RNA, 19 nt, Human
cugggccagaggucugggg

SEQ ID NO: 861088 - RNA, 24 nt, Human
cuggggcgauuccgggaccuccuc

SEQ ID NO: 861089 - RNA, 18 nt, Human
cugugagucaagaaaagc

SEQ ID NO: 861090 - RNA, 21 nt, Human
cuuacacucaccaaacagaau

SEQ ID NO: 861091 - RNA, 19 nt, Human
cuucuguaacuuacagggu

SEQ ID NO: 861092 - RNA, 22 nt, Human
gaaaaacuguaaaugggaugag

SEQ ID NO: 861093 - RNA, 19 nt, Human
gauucuggaaaugcaaauu

SEQ ID NO: 861094 - RNA, 20 nt, Human
ggaaaugcaaauucauccuc

SEQ ID NO: 861095 - RNA, 18 nt, Human
ggaguucuccacauucuc

SEQ ID NO: 861096 - RNA, 18 nt, Human
gggagaagggagugagcc

SEQ ID NO: 861097 - RNA, 21 nt, Human
gggagaagggagugagccgag

SEQ ID NO: 861098 - RNA, 24 nt, Human
gggcuccacaggcugaccagugcc

SEQ ID NO: 861099 - RNA, 23 nt, Human
uaaaaacaguuuugaaaaaaaau

SEQ ID NO: 861100 - RNA, 23 nt, Human
uaaacucaagcugauaaaagucu

SEQ ID NO: 861101 - RNA, 21 nt, Human
uaagaagagacuaaagacccc

SEQ ID NO: 861102 - RNA, 22 nt, Human
uaagaagagacuaaagacccca

SEQ ID NO: 861103 - RNA, 23 nt, Human
uacaaauuacaaacuacuuaaaa

SEQ ID NO: 861104 - RNA, 24 nt, Human
uacaacuguugcugcuaccugcaa

SEQ ID NO: 861105 - RNA, 23 nt, Human
uacacucaccaaacagaauauua

SEQ ID NO: 861106 - RNA, 23 nt, Human
uacaggguuucuauuuuauguuu

SEQ ID NO: 861107 - RNA, 18 nt, Human
uaccaaaucagcacacug

SEQ ID NO: 861108 - RNA, 23 nt, Human
uacccaagcaaaaucugaucagc

SEQ ID NO: 861109 - RNA, 21 nt, Human
uacccuggaguuagaaaaacu

SEQ ID NO: 861110 - RNA, 21 nt, Human
uacccuggaguuagaaaaacu

SEQ ID NO: 861111 - RNA, 23 nt, Human
ucaagaaaagcuucccagggaaa

SEQ ID NO: 861112 - RNA, 25 nt, Human
ucaggcugacuccagacacucagca

SEQ ID NO: 861113 - RNA, 18 nt, Human
uccagcaacuucaucacu

SEQ ID NO: 861114 - RNA, 22 nt, Human
ucccacaccuauuuucugccuc

SEQ ID NO: 861115 - RNA, 19 nt, Human
ucccaggaaacaucuaauc

SEQ ID NO: 861116 - RNA, 21 nt, Human
ucccuuacacucaccaaacag

SEQ ID NO: 861117 - RNA, 18 nt, Human
ucugaagucaguguagga

SEQ ID NO: 861118 - RNA, 21 nt, Human
ucugacagacuguuuucugaa

SEQ ID NO: 861119 - RNA, 26 nt, Human
ucugccucugggccagaggucugggg

SEQ ID NO: 861120 - RNA, 21 nt, Human
ucugggccagaggucuggggc

SEQ ID NO: 861121 - RNA, 19 nt, Human
ugacaauaucagucccaac

SEQ ID NO: 861122 - RNA, 19 nt, Human
ugacuccagacacucagca

SEQ ID NO: 861123 - RNA, 23 nt, Human
ugcagaaucccuuacacucacca

SEQ ID NO: 861124 - RNA, 22 nt, Human
ugccucugggccagaggucugg

SEQ ID NO: 861125 - RNA, 20 nt, Human
uggccaccuaaaauuaguuu

SEQ ID NO: 861126 - RNA, 21 nt, Human
uggcuuuuccucccuggggcu

SEQ ID NO: 861127 - RNA, 23 nt, Human
ugggcagaagaaccugggcugug

SEQ ID NO: 861128 - RNA, 20 nt, Human
uguggauagcauccagggcu

SEQ ID NO: 861129 - RNA, 25 nt, Human
uuacaaauuacaaacuacuuaaaaa

SEQ ID NO: 861130 - RNA, 19 nt, Human
uucaaauuuggaucaaauu

SEQ ID NO: 861131 - RNA, 24 nt, Human
uuuuuucccaaauucugcuaauau

SEQ ID NO: 861132 - RNA, 18 nt, Human
acaggccccucccaggcu

SEQ ID NO: 861133 - RNA, 23 nt, Human
agaggguuuuggcacaggccccu

SEQ ID NO: 861134 - RNA, 20 nt, Human
agcccggaccccugguuccc

SEQ ID NO: 861135 - RNA, 24 nt, Human
aggcagaagcggaaucaccgccca

SEQ ID NO: 861136 - RNA, 19 nt, Human
agugguggaaaagcugagg

SEQ ID NO: 861137 - RNA, 23 nt, Human
cacacaccuuggccguuuaugua

SEQ ID NO: 861138 - RNA, 19 nt, Human
cacaggccccucccaggcu

SEQ ID NO: 861139 - RNA, 23 nt, Human
caccgggagcuaaagugucagcc

SEQ ID NO: 861140 - RNA, 18 nt, Human
cccaggcagaagcggaau

SEQ ID NO: 861141 - RNA, 20 nt, Human
cccccaaaaguuugccucua

SEQ ID NO: 861142 - RNA, 21 nt, Human
cccggcccgcgccuuccuucu

SEQ ID NO: 861143 - RNA, 27 nt, Human
cccggcccgcgccuuccuucuuccucc

SEQ ID NO: 861144 - RNA, 22 nt, Human
cccuggcuccgaguccgccucc

SEQ ID NO: 861145 - RNA, 18 nt, Human
ccgcccaguccccaggca

SEQ ID NO: 861146 - RNA, 19 nt, Human
ccgccuccgucuccuaauc

SEQ ID NO: 861147 - RNA, 19 nt, Human
ccgggcacacaccuuggcc

SEQ ID NO: 861148 - RNA, 19 nt, Human
ccucccagagcggggcggg

SEQ ID NO: 861149 - RNA, 24 nt, Human
ccucucgggggccauggcaggagc

SEQ ID NO: 861150 - RNA, 21 nt, Human
ccugguucccuggcuccgagu

SEQ ID NO: 861151 - RNA, 23 nt, Human
cgacuccagcucuagcccggacc

SEQ ID NO: 861152 - RNA, 21 nt, Human
cuccagcucuagcccggaccu

SEQ ID NO: 861153 - RNA, 20 nt, Human
gcucacgacuccagcucuag

SEQ ID NO: 861154 - RNA, 19 nt, Human
ggaagggcgcggggaauga

SEQ ID NO: 861155 - RNA, 19 nt, Human
ggacuagaaagcaguggug

SEQ ID NO: 861156 - RNA, 22 nt, Human
ggcgcgcgcucacgacuccagc

SEQ ID NO: 861157 - RNA, 24 nt, Human
uaggaguuaaaggacuagaaagca

SEQ ID NO: 861158 - RNA, 21 nt, Human
ucaccgcccaguccccaggca

SEQ ID NO: 861159 - RNA, 18 nt, Human
ucuuuuuuuuuuuuuuuu

SEQ ID NO: 861160 - RNA, 18 nt, Human
ucuuuuuuuuuuuuuuuu

SEQ ID NO: 861161 - RNA, 24 nt, Human
uuuggcacaggccccucccaggcu

SEQ ID NO: 861162 - RNA, 30 nt, Human; identical to SEQ ID NO: 289986

SEQ ID NO: 861163 - RNA, 32 nt, Human; identical to SEQ ID NO: 423254

SEQ ID NO: 861164 - RNA, 21 nt, Human
uuuuuuuuuuuuuuuuuccgg

SEQ ID NO: 861165 - RNA, 24 nt, Human
uuuuuuuuuuuuuuuuuucuuuuu

SEQ ID NO: 861166 - RNA, 24 nt, Human
uuuuuuuuuuuuuuuuuuucuuuu

SEQ ID NO: 861167 - RNA, 25 nt, Human
uuuuuuuuuuuuuuuuuuucuuuuu

SEQ ID NO: 861168 - RNA, 23 nt, Human
uuuuuuuuuuuuuuuuuuuuccg

SEQ ID NO: 861169 - RNA, 24 nt, Human
uuuuuuuuuuuuuuuuuuuucuuu

SEQ ID NO: 861170 - RNA, 26 nt, Human
uuuuuuuuuuuuuuuuuuuuuccggg

SEQ ID NO: 861171 - RNA, 24 nt, Human
uuuuuuuuuuuuuuuuuuuuuccu

SEQ ID NO: 861172 - RNA, 26 nt, Human
uuuuuuuuuuuuuuuuuuuuuucuuu

SEQ ID NO: 861173 - RNA, 24 nt, Human
acagcagcaggagaaaaucgggac

SEQ ID NO: 861174 - RNA, 23 nt, Human
agaaaaucgggacuccgaccucc

SEQ ID NO: 861175 - RNA, 21 nt, Human
auuaagcaggggaguggaggg

SEQ ID NO: 861176 - RNA, 22 nt, Human
caacagcaucuaggauuuuuga

SEQ ID NO: 861177 - RNA, 20 nt, Human
ccacagcagcaggagaaaau

SEQ ID NO: 861178 - RNA, 19 nt, Human
cgggccacagcagcaggag

SEQ ID NO: 861179 - RNA, 24 nt, Human
cgguagggccagugguugcucccu

SEQ ID NO: 861180 - RNA, 19 nt, Human
ggccagugguugcucccug

SEQ ID NO: 861181 - RNA, 21 nt, Human
guagggccagugguugcuccc

SEQ ID NO: 861182 - RNA, 24 nt, Human
uaagcaggggaguggaggggagau

SEQ ID NO: 861183 - RNA, 18 nt, Human
ucaaggccagacccuggg

SEQ ID NO: 861184 - RNA, 19 nt, Human
uccccagcgacacaugggc

SEQ ID NO: 861185 - RNA, 22 nt, Human
uccccagcgacacaugggccuc

SEQ ID NO: 861186 - RNA, 21 nt, Human
uccgggccacagcagcaggag

SEQ ID NO: 861187 - RNA, 18 nt, Human
uggaggggagauguggca

SEQ ID NO: 861188 - RNA, 20 nt, Human
uuuuuuuuuuaaauacaagu

SEQ ID NO: 861189 - RNA, 18 nt, Human
aaaaaaaaaagccaagag

SEQ ID NO: 861190 - RNA, 19 nt, Human
aaaaaccgaaagaccccca

SEQ ID NO: 861191 - RNA, 19 nt, Human
aaaaagacuucugcacccc

SEQ ID NO: 861192 - RNA, 19 nt, Human
aaaaagccaagagacuggu

SEQ ID NO: 861193 - RNA, 22 nt, Human
aaaacaaaaacucaaaaaaccc

SEQ ID NO: 861194 - RNA, 21 nt, Human
aaaagccagacccaaaaccaa

SEQ ID NO: 861195 - RNA, 23 nt, Human
aaaagccagacccaaaaccaaaa

SEQ ID NO: 861196 - RNA, 20 nt, Human
aaacaaaaacucaaaaaacc

SEQ ID NO: 861197 - RNA, 18 nt, Human
aaacaaaacagagcagaa

SEQ ID NO: 861198 - RNA, 23 nt, Human
aaacaauaccacuacaaaaagca

SEQ ID NO: 861199 - RNA, 22 nt, Human
aaacacacuucaguaacaaaag

SEQ ID NO: 861200 - RNA, 21 nt, Human
aaacagagcagaaaaggaacc

SEQ ID NO: 861201 - RNA, 20 nt, Human
aaacagauacaguaaacacc

SEQ ID NO: 861202 - RNA, 18 nt, Human
aaaccaacagccaaccug

SEQ ID NO: 861203 - RNA, 18 nt, Human
aaaccccccagacaaggg

SEQ ID NO: 861204 - RNA, 18 nt, Human
aaagcaguacccaugaag

SEQ ID NO: 861205 - RNA, 19 nt, Human
aaauccaugcaacaccuuu

SEQ ID NO: 861206 - RNA, 24 nt, Human
aaaugaccccagauuuuucaaggu

SEQ ID NO: 861207 - RNA, 18 nt, Human
aacaaaaugaccccagau

SEQ ID NO: 861208 - RNA, 21 nt, Human
aacaauacaacacaacacaac

SEQ ID NO: 861209 - RNA, 21 nt, Human
aaccaaaaagcaccugccaag

SEQ ID NO: 861210 - RNA, 22 nt, Human
aaccgaaagacccccaaaucca

SEQ ID NO: 861211 - RNA, 18 nt, Human
aaccucgcacuccagcuc

SEQ ID NO: 861212 - RNA, 26 nt, Human
aagaaaaaaaaggguauugaaaccaa

SEQ ID NO: 861213 - RNA, 20 nt, Human
aagaucacggaaaaaucacc

SEQ ID NO: 861214 - RNA, 19 nt, Human
aagccagacccaaaaccaa

SEQ ID NO: 861215 - RNA, 20 nt, Human
aaguaggccaaaucgcucgg

SEQ ID NO: 861216 - RNA, 23 nt, Human
aaugaccccagauuuuucaaggu

SEQ ID NO: 861217 - RNA, 19 nt, Human
acaaaaacucaaaaaaccc

SEQ ID NO: 861218 - RNA, 20 nt, Human
acaagaaaaaccaacacucc

SEQ ID NO: 861219 - RNA, 21 nt, Human
acaagaaaaaccaacacucca

SEQ ID NO: 861220 - RNA, 18 nt, Human
acagaaagggagauagcu

SEQ ID NO: 861221 - RNA, 20 nt, Human
acagcuauauuaaaguggau

SEQ ID NO: 861222 - RNA, 20 nt, Human
acaucacuccuguuuuucuc

SEQ ID NO: 861223 - RNA, 21 nt, Human
accaagggaagaacaauacaa

SEQ ID NO: 861224 - RNA, 19 nt, Human
accgaaagacccccaaauc

SEQ ID NO: 861225 - RNA, 21 nt, Human
acggcaaccacaccgccuaac

SEQ ID NO: 861226 - RNA, 18 nt, Human
acuccccuuccucaaaaa

SEQ ID NO: 861227 - RNA, 25 nt, Human
acuccuguuuuucuccccucuuuuc

SEQ ID NO: 861228 - RNA, 18 nt, Human
acuucccuugcacgcaac

SEQ ID NO: 861229 - RNA, 23 nt, Human
agaaaaaccaacacuccaacaaa

SEQ ID NO: 861230 - RNA, 23 nt, Human
agaaagcuucagcagcaaggggg

SEQ ID NO: 861231 - RNA, 18 nt, Human
agaaaggaaaaaaagaaa

SEQ ID NO: 861232 - RNA, 19 nt, Human
agaacguugauagcaccuc

SEQ ID NO: 861233 - RNA, 23 nt, Human
agacccaaaaccaaaaaccgaaa

SEQ ID NO: 861234 - RNA, 18 nt, Human
agaggacagaagcugucc

SEQ ID NO: 861235 - RNA, 26 nt, Human
agauccaucuggucucccuuggugug

SEQ ID NO: 861236 - RNA, 28 nt, Human
agcaaaacuuaaacaugaaauacagcca

SEQ ID NO: 861237 - RNA, 22 nt, Human
agcaagggggggauaaagagcu

SEQ ID NO: 861238 - RNA, 23 nt, Human
agcaccacuggcuuuucacagcu

SEQ ID NO: 861239 - RNA, 23 nt, Human
aggaaaaaaagaaaaugaucaaa

SEQ ID NO: 861240 - RNA, 20 nt, Human
aggaagauucacacaugcca

SEQ ID NO: 861241 - RNA, 21 nt, Human
aggaaggagauccaucugguc

SEQ ID NO: 861242 - RNA, 23 nt, Human
aggcacccccgcaucuaccuaag

SEQ ID NO: 861243 - RNA, 23 nt, Human
aggcagaaguacccaacuccccu

SEQ ID NO: 861244 - RNA, 18 nt, Human
aggcugcugguggugagg

SEQ ID NO: 861245 - RNA, 23 nt, Human
agggcugggagcaccagaggggg

SEQ ID NO: 861246 - RNA, 21 nt, Human
aggggagaaaggaaaaaaaga

SEQ ID NO: 861247 - RNA, 24 nt, Human
agugaugaguuaccccugaaugac

SEQ ID NO: 861248 - RNA, 22 nt, Human
agugccaguaaaaaauaaaaau

SEQ ID NO: 861249 - RNA, 24 nt, Human
aguggggacauccaauggagacug

SEQ ID NO: 861250 - RNA, 20 nt, Human
aguuucuucuucaaagugcu

SEQ ID NO: 861251 - RNA, 20 nt, Human
auaaaaaccccccagacaag

SEQ ID NO: 861252 - RNA, 22 nt, Human
auaaaacacacuucaguaacaa

SEQ ID NO: 861253 - RNA, 24 nt, Human
auaaaacacacuucaguaacaaaa

SEQ ID NO: 861254 - RNA, 20 nt, Human
auagagauaaaaagacuucu

SEQ ID NO: 861255 - RNA, 21 nt, Human
auaugcgcaucuauauaugua

SEQ ID NO: 861256 - RNA, 20 nt, Human
aucagaauagaagccaauga

SEQ ID NO: 861257 - RNA, 22 nt, Human
auccacauggcuagcaugagau

SEQ ID NO: 861258 - RNA, 22 nt, Human
aucucguagcacagaacuuuac

SEQ ID NO: 861259 - RNA, 23 nt, Human
augaaaaagaaaugacaucacuc

SEQ ID NO: 861260 - RNA, 20 nt, Human
augaaauuagguuaucauua

SEQ ID NO: 861261 - RNA, 18 nt, Human
augaaccaaggcuguuug

SEQ ID NO: 861262 - RNA, 24 nt, Human
augcaccauuguccaauguggaaa

SEQ ID NO: 861263 - RNA, 22 nt, Human
augguguccguggacagggcac

SEQ ID NO: 861264 - RNA, 19 nt, Human
auuaaaacaccauagcacc

SEQ ID NO: 861265 - RNA, 19 nt, Human
caaaaaccgaaagaccccc

SEQ ID NO: 861266 - RNA, 23 nt, Human
caaaaaccgaaagacccccaaau

SEQ ID NO: 861267 - RNA, 21 nt, Human
caaaaccaaaaaccgaaagac

SEQ ID NO: 861268 - RNA, 19 nt, Human
caaaacgcgaagagggagc

SEQ ID NO: 861269 - RNA, 18 nt, Human
caaaagcaccacagagac

SEQ ID NO: 861270 - RNA, 20 nt, Human
caaaauagcauuuaaaggac

SEQ ID NO: 861271 - RNA, 25 nt, Human
caaacaauaccacuacaaaaagcau

SEQ ID NO: 861272 - RNA, 19 nt, Human
caaacagauacaguaaaca

SEQ ID NO: 861273 - RNA, 25 nt, Human
caacaggcagggaaaacaaaacaga

SEQ ID NO: 861274 - RNA, 26 nt, Human
caacuaaaaagcagccucaguggcau

SEQ ID NO: 861275 - RNA, 22 nt, Human
caagacaggaucagggacaguc

SEQ ID NO: 861276 - RNA, 22 nt, Human
caagagacuggagcccaccuug

SEQ ID NO: 861277 - RNA, 22 nt, Human
caaggcacccggaagcucagga

SEQ ID NO: 861278 - RNA, 23 nt, Human
caagggaagaacaauacaacaca

SEQ ID NO: 861279 - RNA, 20 nt, Human
caauacaacacaacacaaca

SEQ ID NO: 861280 - RNA, 25 nt, Human
caauacaacacaacacaacacugcu

SEQ ID NO: 861281 - RNA, 19 nt, Human
caauaccacuacaaaaagc

SEQ ID NO: 861282 - RNA, 25 nt, Human
cacaaaaauuaagcaccacauucuc

SEQ ID NO: 861283 - RNA, 20 nt, Human
cacaaaauggagcuuccugg

SEQ ID NO: 861284 - RNA, 21 nt, Human
cacaacacaacacugcucaga

SEQ ID NO: 861285 - RNA, 21 nt, Human
cacaacacugcucagagcaga

SEQ ID NO: 861286 - RNA, 23 nt, Human
cacaacacugcucagagcagauu

SEQ ID NO: 861287 - RNA, 18 nt, Human
cacaagaaaaaccaacac

SEQ ID NO: 861288 - RNA, 22 nt, Human
cacaagaaaaaccaacacucca

SEQ ID NO: 861289 - RNA, 23 nt, Human
cacacuucaguaacaaaaggaaa

SEQ ID NO: 861290 - RNA, 21 nt, Human
cacagagacagcucgggccag

SEQ ID NO: 861291 - RNA, 18 nt, Human
cacagagcaccacuggcu

SEQ ID NO: 861292 - RNA, 18 nt, Human
cacagcaccaugcacaga

SEQ ID NO: 861293 - RNA, 28 nt, Human
caccaagggaagaacaauacaacacaac

SEQ ID NO: 861294 - RNA, 30 nt, Human
caccaagggaagaacaauacaacacaacag

SEQ ID NO: 861295 - RNA, 21 nt, Human
caccacacacacauccacaug

SEQ ID NO: 861296 - RNA, 19 nt, Human
cacccccaacccgccccca

SEQ ID NO: 861297 - RNA, 19 nt, Human
caccguguggccacauucc

SEQ ID NO: 861298 - RNA, 19 nt, Human
cagaaguacccaacucccc

SEQ ID NO: 861299 - RNA, 19 nt, Human
cagaauuucagaacagcua

SEQ ID NO: 861300 - RNA, 22 nt, Human
cagacccaaaaccaaaaaccga

SEQ ID NO: 861301 - RNA, 22 nt, Human
cagauacaguaaacacccagca

SEQ ID NO: 861302 - RNA, 21 nt, Human
cagcaacaaugacugagaaag

SEQ ID NO: 861303 - RNA, 26 nt, Human
cagcaacaaugacugagaaagcucaa

SEQ ID NO: 861304 - RNA, 22 nt, Human
cagcaagacaggaucagggaca

SEQ ID NO: 861305 - RNA, 22 nt, Human
cagcagcaagggggggauaaag

SEQ ID NO: 861306 - RNA, 22 nt, Human
caggaagauucacacaugccaa

SEQ ID NO: 861307 - RNA, 18 nt, Human
caggccgguucucagcuc

SEQ ID NO: 861308 - RNA, 18 nt, Human
cauaaauacauauauaug

SEQ ID NO: 861309 - RNA, 21 nt, Human
caucaagccugagaagacagg

SEQ ID NO: 861310 - RNA, 19 nt, Human
caucuaauggcuuuccuac

SEQ ID NO: 861311 - RNA, 20 nt, Human
caucucuuuccacgcacacc

SEQ ID NO: 861312 - RNA, 24 nt, Human
caugaaaaagaaaugacaucacuc

SEQ ID NO: 861313 - RNA, 22 nt, Human
cauuacuauugucgcuuuuaaa

SEQ ID NO: 861314 - RNA, 19 nt, Human
cauucaccacacacacauc

SEQ ID NO: 861315 - RNA, 19 nt, Human
ccaaaagaggggagggaaa

SEQ ID NO: 861316 - RNA, 24 nt, Human
ccacacacacauccacauggcuaa

SEQ ID NO: 861317 - RNA, 22 nt, Human
ccacagagacagcucgggccag

SEQ ID NO: 861318 - RNA, 21 nt, Human
ccagacccaaaaccaaaaacc

SEQ ID NO: 861319 - RNA, 20 nt, Human
ccagagggggccgccccucc

SEQ ID NO: 861320 - RNA, 23 nt, Human
ccaggcccgacgcugagguacgc

SEQ ID NO: 861321 - RNA, 20 nt, Human
cccacucccgaucacagaaa

SEQ ID NO: 861322 - RNA, 27 nt, Human
ccccaaauccaugcaacaccuuuaguc

SEQ ID NO: 861323 - RNA, 20 nt, Human
ccccauucaccacacacaca

SEQ ID NO: 861324 - RNA, 24 nt, Human
ccccauucaccacacacacaucca

SEQ ID NO: 861325 - RNA, 24 nt, Human
ccccccagacaagggggggggaca

SEQ ID NO: 861326 - RNA, 19 nt, Human
cccccgcaucuaccuaagc

SEQ ID NO: 861327 - RNA, 18 nt, Human
ccccugcccaccaugguc

SEQ ID NO: 861328 - RNA, 19 nt, Human
cccgcccccagguaugagg

SEQ ID NO: 861329 - RNA, 22 nt, Human
cccugcccaccauggucccagc

SEQ ID NO: 861330 - RNA, 18 nt, Human
ccucaaaagaaaaaaaag

SEQ ID NO: 861331 - RNA, 22 nt, Human
ccucgcacuccagcuccagcgu

SEQ ID NO: 861332 - RNA, 25 nt, Human
ccugcuaaaagccagacccaaaacc

SEQ ID NO: 861333 - RNA, 18 nt, Human
ccuuccaaaccaacagcc

SEQ ID NO: 861334 - RNA, 25 nt, Human
ccuuccucaaaaacaaaaacucaaa

SEQ ID NO: 861335 - RNA, 19 nt, Human
cgacaacgucacaaaaauu

SEQ ID NO: 861336 - RNA, 24 nt, Human
cgcacagcaccaugcacagagcac

SEQ ID NO: 861337 - RNA, 20 nt, Human
cgcccuuucuuucacaucaa

SEQ ID NO: 861338 - RNA, 19 nt, Human
cgcgaagagggagcaaaca

SEQ ID NO: 861339 - RNA, 27 nt, Human
cggccccuaagaaccucgcacuccuuu

SEQ ID NO: 861340 - RNA, 21 nt, Human
cggcuacuauuuacaauuucu

SEQ ID NO: 861341 - RNA, 22 nt, Human
cgggucuaagacagcaccaaaa

SEQ ID NO: 861342 - RNA, 24 nt, Human
cgguaaacgggucuaagacagcac

SEQ ID NO: 861343 - RNA, 22 nt, Human
cuaaaagccagacccaaaacca

SEQ ID NO: 861344 - RNA, 23 nt, Human
cuaaaagccagacccaaaaccaa

SEQ ID NO: 861345 - RNA, 21 nt, Human
cuaagcacggagucaaaugag

SEQ ID NO: 861346 - RNA, 22 nt, Human
cuaucaugcuaggagaggcaga

SEQ ID NO: 861347 - RNA, 18 nt, Human
cucaaaaaacccuucgcc

SEQ ID NO: 861348 - RNA, 19 nt, Human
cucaaaaaacccuucgccc

SEQ ID NO: 861349 - RNA, 25 nt, Human
cucaaaaacaaaaacucaaaaaacc

SEQ ID NO: 861350 - RNA, 26 nt, Human
cucaaaaacaaaaacucaaaaaaccc

SEQ ID NO: 861351 - RNA, 21 nt, Human
cucccacaauuacauguuaaa

SEQ ID NO: 861352 - RNA, 19 nt, Human
cuccccuuccucaaaaaca

SEQ ID NO: 861353 - RNA, 20 nt, Human
cuccgcacagcaccaugcac

SEQ ID NO: 861354 - RNA, 19 nt, Human
cucgccagcgcccgagggg

SEQ ID NO: 861355 - RNA, 21 nt, Human
cuuagcacccugggcugcagg

SEQ ID NO: 861356 - RNA, 19 nt, Human
cuuggcaacauggugggca

SEQ ID NO: 861357 - RNA, 20 nt, Human
cuuuccuugcuuuagcgcuu

SEQ ID NO: 861358 - RNA, 22 nt, Human
gaagggguguaugucgggaggg

SEQ ID NO: 861359 - RNA, 20 nt, Human
gaaguggggguaagggaggg

SEQ ID NO: 861360 - RNA, 19 nt, Human
gagaagccuauugcucugc

SEQ ID NO: 861361 - RNA, 23 nt, Human
gagcaaagaaagcuccuuccuuu

SEQ ID NO: 861362 - RNA, 18 nt, Human
gagggcaaaagcaccaca

SEQ ID NO: 861363 - RNA, 24 nt, Human
gauaaaaagacuucugcaccccca

SEQ ID NO: 861364 - RNA, 23 nt, Human
gaucaggauagaugcauuaacug

SEQ ID NO: 861365 - RNA, 24 nt, Human
gaucauuuaaaaugaaguuuucaa

SEQ ID NO: 861366 - RNA, 19 nt, Human
gaugaagaggggagaaagg

SEQ ID NO: 861367 - RNA, 24 nt, Human
gcaaacaauaccacuacaaaaagc

SEQ ID NO: 861368 - RNA, 20 nt, Human
gcaagacaggaucagggaca

SEQ ID NO: 861369 - RNA, 19 nt, Human
gcacccccaacccgccccc

SEQ ID NO: 861370 - RNA, 21 nt, Human
gcacccggaagcucaggaacu

SEQ ID NO: 861371 - RNA, 19 nt, Human
gcacgcaacaggcagggaa

SEQ ID NO: 861372 - RNA, 19 nt, Human
gcagcuggcuaauaaaacu

SEQ ID NO: 861373 - RNA, 21 nt, Human
gcucccaucaggcccaaccuc

SEQ ID NO: 861374 - RNA, 19 nt, Human
gcuccgcacagcaccaugc

SEQ ID NO: 861375 - RNA, 20 nt, Human
gcugaagaaugaaaaacaaa

SEQ ID NO: 861376 - RNA, 21 nt, Human
gcuuggcucgccagacccagc

SEQ ID NO: 861377 - RNA, 22 nt, Human
ggaaccaaaaagcaccugccaa

SEQ ID NO: 861378 - RNA, 19 nt, Human
ggaaggaccaagagggggc

SEQ ID NO: 861379 - RNA, 21 nt, Human
ggacuggaaaagggaccccag

SEQ ID NO: 861380 - RNA, 20 nt, Human
ggacuuaaaaaaugauagug

SEQ ID NO: 861381 - RNA, 24 nt, Human
ggagggaaaaaaaaaagccaagag

SEQ ID NO: 861382 - RNA, 21 nt, Human
gggaaacauuggcccugcuaa

SEQ ID NO: 861383 - RNA, 19 nt, Human
gggaaguggggguaaggga

SEQ ID NO: 861384 - RNA, 18 nt, Human
gggagaaaggaaaaaaag

SEQ ID NO: 861385 - RNA, 25 nt, Human
gggcgggggagcacuacuggccuuu

SEQ ID NO: 861386 - RNA, 23 nt, Human
ggggagggaaaaaaaaaagccaa

SEQ ID NO: 861387 - RNA, 19 nt, Human
gggggauaaagagcugugc

SEQ ID NO: 861388 - RNA, 24 nt, Human
gguuucuccuuucaucuaauggcu

SEQ ID NO: 861389 - RNA, 22 nt, Human
gucuaagacagcaccaaaagag

SEQ ID NO: 861390 - RNA, 20 nt, Human
gugcuuccaaacagauacag

SEQ ID NO: 861391 - RNA, 23 nt, Human
gugggguggugggcgucuguggg

SEQ ID NO: 861392 - RNA, 23 nt, Human
guuaaaaccagaccacauaaaug

SEQ ID NO: 861393 - RNA, 21 nt, Human
guuugacuuggugaugaugag

SEQ ID NO: 861394 - RNA, 20 nt, Human
uaaaaaacugccacuaagac

SEQ ID NO: 861395 - RNA, 19 nt, Human
uaaaaacaaagagaaaaua

SEQ ID NO: 861396 - RNA, 21 nt, Human
uaaaaagcagccucaguggca

SEQ ID NO: 861397 - RNA, 18 nt, Human
uaaaagccagacccaaaa

SEQ ID NO: 861398 - RNA, 19 nt, Human
uaaaagccagacccaaaac

SEQ ID NO: 861399 - RNA, 22 nt, Human
uaaaggacccaauuuuuccuca

SEQ ID NO: 861400 - RNA, 25 nt, Human
uaaauacauauauaugauaugcgca

SEQ ID NO: 861401 - RNA, 20 nt, Human
uaagaaccucgcacuccagc

SEQ ID NO: 861402 - RNA, 23 nt, Human
uaagcacggagucaaaugagacc

SEQ ID NO: 861403 - RNA, 19 nt, Human
uaaguguaggcccccgaac

SEQ ID NO: 861404 - RNA, 20 nt, Human
uacaaaaagcaucccugaua

SEQ ID NO: 861405 - RNA, 21 nt, Human
uacagcaccaggcuccgcaca

SEQ ID NO: 861406 - RNA, 21 nt, Human
uacccaacuccccuuccucaa

SEQ ID NO: 861407 - RNA, 24 nt, Human
uagaguuuuaaaaacaaagagaaa

SEQ ID NO: 861408 - RNA, 18 nt, Human
uagcacccugggcugcag

SEQ ID NO: 861409 - RNA, 21 nt, Human
uagcaugagaucauuucugcu

SEQ ID NO: 861410 - RNA, 18 nt, Human
uagcuuguauugguuucu

SEQ ID NO: 861411 - RNA, 27 nt, Human
uaggcaaaaagcaacuuuagaccuugc

SEQ ID NO: 861412 - RNA, 18 nt, Human
uagguuagcaccaacuaa

SEQ ID NO: 861413 - RNA, 23 nt, Human
uagguuaucaucgacucauuguc

SEQ ID NO: 861414 - RNA, 18 nt, Human
uauaugucuaaagcaugc

SEQ ID NO: 861415 - RNA, 24 nt, Human
uaucacaagaaaaaccaacacucc

SEQ ID NO: 861416 - RNA, 19 nt, Human
uauuuugugagaaccugcu

SEQ ID NO: 861417 - RNA, 25 nt, Human
ucaaaagcaaaacuuaaacaugaaa

SEQ ID NO: 861418 - RNA, 20 nt, Human
ucaaaagcaaaacuuaaacu

SEQ ID NO: 861419 - RNA, 19 nt, Human
ucaaaugacagcaacaaug

SEQ ID NO: 861420 - RNA, 21 nt, Human
ucacggaaaaaucacccgaca

SEQ ID NO: 861421 - RNA, 19 nt, Human
uccacgcacaccaucguca

SEQ ID NO: 861422 - RNA, 21 nt, Human
ucccaucaggcccaaccucuc

SEQ ID NO: 861423 - RNA, 19 nt, Human
uccccgugugaagagugau

SEQ ID NO: 861424 - RNA, 20 nt, Human
uccccucaaaagaaaaaaaa

SEQ ID NO: 861425 - RNA, 22 nt, Human
uccgcacagcaccaugcacaga

SEQ ID NO: 861426 - RNA, 21 nt, Human
uccgcuaucuuaacugcugaa

SEQ ID NO: 861427 - RNA, 21 nt, Human
uccugaggcucccuuccccaa

SEQ ID NO: 861428 - RNA, 18 nt, Human
uccugcccauccuuuacc

SEQ ID NO: 861429 - RNA, 20 nt, Human
ucgaacuuggucaugcuguu

SEQ ID NO: 861430 - RNA, 19 nt, Human
ucgacuccaagccggggac

SEQ ID NO: 861431 - RNA, 24 nt, Human
ucgagugagcaaagaaagcuccuu

SEQ ID NO: 861432 - RNA, 22 nt, Human
ucucugggcacaggcucagccu

SEQ ID NO: 861433 - RNA, 20 nt, Human
ucugauuguuaaacaugauu

SEQ ID NO: 861434 - RNA, 21 nt, Human
ucugcacccccaacccgcccc

SEQ ID NO: 861435 - RNA, 26 nt, Human
ucugugcugcggucucugcucagggg

SEQ ID NO: 861436 - RNA, 20 nt, Human
ucuucucaugauaaaaaugu

SEQ ID NO: 861437 - RNA, 19 nt, Human
ucuugccugcagcucugca

SEQ ID NO: 861438 - RNA, 22 nt, Human
ugaagccccccauucaccacac

SEQ ID NO: 861439 - RNA, 20 nt, Human
ugacagcaacaaugacugag

SEQ ID NO: 861440 - RNA, 23 nt, Human
ugacagcauggaggaagcaggcu

SEQ ID NO: 861441 - RNA, 18 nt, Human
ugacucaccucucagcag

SEQ ID NO: 861442 - RNA, 19 nt, Human
ugacucaccucucagcagc

SEQ ID NO: 861443 - RNA, 18 nt, Human
ugagaggcagaagcaacg

SEQ ID NO: 861444 - RNA, 20 nt, Human
ugagaggcagaagcaacgcu

SEQ ID NO: 861445 - RNA, 22 nt, Human
ugagaggcagaagcaacgcugg

SEQ ID NO: 861446 - RNA, 21 nt, Human
ugaggcucccuuccccaaagg

SEQ ID NO: 861447 - RNA, 21 nt, Human
ugagggcaaaagcaccacaga

SEQ ID NO: 861448 - RNA, 19 nt, Human
ugagguagguuagacaugu

SEQ ID NO: 861449 - RNA, 22 nt, Human
ugauucaugaagacccauaucu

SEQ ID NO: 861450 - RNA, 20 nt, Human
ugcacagagcaccacuggcu

SEQ ID NO: 861451 - RNA, 18 nt, Human
ugcacccccaacccgccc

SEQ ID NO: 861452 - RNA, 21 nt, Human
ugcacccccaacccgccccca

SEQ ID NO: 861453 - RNA, 27 nt, Human
ugcagaaacugaugaaccaaggcuggu

SEQ ID NO: 861454 - RNA, 23 nt, Human
ugccagcaucucguggggcuggc

SEQ ID NO: 861455 - RNA, 22 nt, Human
ugcucaggacaucuuacaacga

SEQ ID NO: 861456 - RNA, 18 nt, Human
ugcucaguaaauaccugu

SEQ ID NO: 861457 - RNA, 19 nt, Human
uggaaccaaaaagcaccug

SEQ ID NO: 861458 - RNA, 22 nt, Human
uggaaccaaaaagcaccugcca

SEQ ID NO: 861459 - RNA, 25 nt, Human
uggaaccaaaaagcaccugccaagc

SEQ ID NO: 861460 - RNA, 19 nt, Human
uggaauguucacaugagcc

SEQ ID NO: 861461 - RNA, 21 nt, Human
uggagacugccucuugacuca

SEQ ID NO: 861462 - RNA, 19 nt, Human
uggagcucugggcaaaggg

SEQ ID NO: 861463 - RNA, 18 nt, Human
uggccauguacuacagca

SEQ ID NO: 861464 - RNA, 18 nt, Human
uggccuggggugcaucug

SEQ ID NO: 861465 - RNA, 22 nt, Human
ugggcaaagggggagggguccc

SEQ ID NO: 861466 - RNA, 23 nt, Human
ugggcacggccccuaagaaccuc

SEQ ID NO: 861467 - RNA, 22 nt, Human
ugggcgucugugggaacagccu

SEQ ID NO: 861468 - RNA, 18 nt, Human
uggggaaguggggguaag

SEQ ID NO: 861469 - RNA, 22 nt, Human
uggggaaguggggguaagggag

SEQ ID NO: 861470 - RNA, 19 nt, Human
ugggucagagaaugaagcc

SEQ ID NO: 861471 - RNA, 23 nt, Human
uguaggaugugaccugcccaaga

SEQ ID NO: 861472 - RNA, 24 nt, Human
ugucaugauguccuguuuuugagg

SEQ ID NO: 861473 - RNA, 18 nt, Human
uguuugggcugggggaca

SEQ ID NO: 861474 - RNA, 22 nt, Human
uuaaaacaccauagcaccauuu

SEQ ID NO: 861475 - RNA, 23 nt, Human
uuaaaacaccauagcaccauuuu

SEQ ID NO: 861476 - RNA, 22 nt, Human
uuaagaucacggaaaaaucacc

SEQ ID NO: 861477 - RNA, 21 nt, Human
uuacaguuaaaaccagaccac

SEQ ID NO: 861478 - RNA, 22 nt, Human
uuagaccuugcauuucugugcu

SEQ ID NO: 861479 - RNA, 24 nt, Human
uuagcaugcucauuaaagacucug

SEQ ID NO: 861480 - RNA, 24 nt, Human
uucaaagaaccgaaugaaugcacc

SEQ ID NO: 861481 - RNA, 21 nt, Human
uuccaccagcuuugccuuggu

SEQ ID NO: 861482 - RNA, 18 nt, Human
uucugagguuuggaccau

SEQ ID NO: 861483 - RNA, 22 nt, Human
uucugcacccccaacccgcccc

SEQ ID NO: 861484 - RNA, 21 nt, Human
uugaggcacgucagggauauc

SEQ ID NO: 861485 - RNA, 22 nt, Human
uuggagcucugggcaaaggggg

SEQ ID NO: 861486 - RNA, 21 nt, Human
uuggccaccaagggaagaaca

SEQ ID NO: 861487 - RNA, 18 nt, Human
uuggguucaacuuccugu

SEQ ID NO: 861488 - RNA, 22 nt, Human
uugguccaggguauguugaagu

SEQ ID NO: 861489 - RNA, 24 nt, Human
uuguuuggccaccaagggaagaac

SEQ ID NO: 861490 - RNA, 23 nt, Human
aacuuaccuuuccagucuucucc

SEQ ID NO: 861491 - RNA, 19 nt, Human
aagagaagggacaaaagca

SEQ ID NO: 861492 - RNA, 23 nt, Human
aagagaagggacaaaagcaaugu

SEQ ID NO: 861493 - RNA, 20 nt, Human
aagcaaaaaggacacggggu

SEQ ID NO: 861494 - RNA, 22 nt, Human
aaggcagugggcauaaggaggg

SEQ ID NO: 861495 - RNA, 21 nt, Human
acauuuaacaaucaaggucau

SEQ ID NO: 861496 - RNA, 21 nt, Human
acccaggccgucuccagccuc

SEQ ID NO: 861497 - RNA, 19 nt, Human
acccauuugccccuaguga

SEQ ID NO: 861498 - RNA, 18 nt, Human
agaaagacaaccaguucu

SEQ ID NO: 861499 - RNA, 24 nt, Human
agccauuaaaacaauguucuugac

SEQ ID NO: 861500 - RNA, 18 nt, Human
caaaaaggacacggggug

SEQ ID NO: 861501 - RNA, 23 nt, Human
caaacucaugccacaacacagcc

SEQ ID NO: 861502 - RNA, 19 nt, Human
caacagcaacauaccaucg

SEQ ID NO: 861503 - RNA, 23 nt, Human
caacauaccaucggcauggcacu

SEQ ID NO: 861504 - RNA, 21 nt, Human
caacuuaccuuuccagucuuc

SEQ ID NO: 861505 - RNA, 18 nt, Human
cacauuaaauuucauuca

SEQ ID NO: 861506 - RNA, 22 nt, Human
caccacugcuccacccaccuga

SEQ ID NO: 861507 - RNA, 20 nt, Human
cagccaacagcaacauacca

SEQ ID NO: 861508 - RNA, 20 nt, Human
cagcugcagaaggcaaccca

SEQ ID NO: 861509 - RNA, 26 nt, Human
caugcaaacucaugccacaacacagc

SEQ ID NO: 861510 - RNA, 18 nt, Human
caugccuccagaaaguca

SEQ ID NO: 861511 - RNA, 21 nt, Human
cauggcacugagagcaagcaa

SEQ ID NO: 861512 - RNA, 19 nt, Human
ccacugcuccacccaccug

SEQ ID NO: 861513 - RNA, 20 nt, Human
cccauucagucuuuacuugu

SEQ ID NO: 861514 - RNA, 25 nt, Human
ccuccagaaagucaugcaaacucau

SEQ ID NO: 861515 - RNA, 19 nt, Human
ccugcccaacucauccugc

SEQ ID NO: 861516 - RNA, 22 nt, Human
cggccuccgcuucgccagcacc

SEQ ID NO: 861517 - RNA, 22 nt, Human
gaacccugacccuuuucccugc

SEQ ID NO: 861518 - RNA, 22 nt, Human
gacccaagaccagaugaagaga

SEQ ID NO: 861519 - RNA, 19 nt, Human
gacccuuuucccugcccaa

SEQ ID NO: 861520 - RNA, 20 nt, Human
gagagcaagcaaaaaggaca

SEQ ID NO: 861521 - RNA, 20 nt, Human
gcaagcaaaaaggacacggg

SEQ ID NO: 861522 - RNA, 19 nt, Human
gcacugagagcaagcaaaa

SEQ ID NO: 861523 - RNA, 19 nt, Human
gcagugggcauaaggaggg

SEQ ID NO: 861524 - RNA, 22 nt, Human
gcccaccacacauuccuuaccu

SEQ ID NO: 861525 - RNA, 19 nt, Human
gccuucaucucagccccau

SEQ ID NO: 861526 - RNA, 21 nt, Human
ggacacggggugacuucacug

SEQ ID NO: 861527 - RNA, 20 nt, Human
ggaucugaggcccaccacac

SEQ ID NO: 861528 - RNA, 24 nt, Human
ggcacugagagcaagcaaaaagga

SEQ ID NO: 861529 - RNA, 26 nt, Human
guggcuuagaaaccugagcuugguuu

SEQ ID NO: 861530 - RNA, 25 nt, Human
uaccuucaacuuaccuuuccagucu

SEQ ID NO: 861531 - RNA, 22 nt, Human
uaugucuucauaaaacuaccau

SEQ ID NO: 861532 - RNA, 24 nt, Human
uauucaaauauaacuacauuuaac

SEQ ID NO: 861533 - RNA, 22 nt, Human
ucaccacauugaauaaucguau

SEQ ID NO: 861534 - RNA, 21 nt, Human
ucagccccauucagucuuuac

SEQ ID NO: 861535 - RNA, 24 nt, Human
ucauacucuucuuucaaaacccag

SEQ ID NO: 861536 - RNA, 24 nt, Human
uccggccuccgcuucgccagcacc

SEQ ID NO: 861537 - RNA, 18 nt, Human
ucggcauggcacugagag

SEQ ID NO: 861538 - RNA, 25 nt, Human
ucuaacagucuucuuaccaguuccc

SEQ ID NO: 861539 - RNA, 22 nt, Human
ucucugaaugugguuccagcuu

SEQ ID NO: 861540 - RNA, 21 nt, Human
ugacccaagaccagaugaaga

SEQ ID NO: 861541 - RNA, 19 nt, Human
ugagagcaagcaaaaagga

SEQ ID NO: 861542 - RNA, 23 nt, Human
ugagauucuagguggagcaaucu

SEQ ID NO: 861543 - RNA, 24 nt, Human
ugcaaauagaaaucuuacuucuaa

SEQ ID NO: 861544 - RNA, 22 nt, Human
ugcaugaguuucuucacauuuc

SEQ ID NO: 861545 - RNA, 21 nt, Human
ugcuccacccaccugagauuc

SEQ ID NO: 861546 - RNA, 25 nt, Human
uguggcuuagaaaccugagcuuggu

SEQ ID NO: 861547 - RNA, 19 nt, Human
uuaaagaaagacaaccagu

SEQ ID NO: 861548 - RNA, 19 nt, Human
uucacugucuccacuugaa

SEQ ID NO: 861549 - RNA, 18 nt, Human
uucauugucggcagccau

SEQ ID NO: 861550 - RNA, 25 nt, Human
uucgccagcacccaggccgucucca

SEQ ID NO: 861551 - RNA, 19 nt, Human
uuuaaacaaagauaaguga

SEQ ID NO: 861552 - RNA, 22 nt, Human
uuuagaaaaacccauuugcccc

SEQ ID NO: 861553 - RNA, 18 nt, Human
uuuccuuuccuuggaaac

SEQ ID NO: 861554 - RNA, 18 nt, Human
uuuuuuuuuuuuuuuuug

SEQ ID NO: 861555 - RNA, 23 nt, Human
uuuuuuuuuuuuuuuuuggaaau

SEQ ID NO: 861556 - RNA, 21 nt, Human
aacuuaguauuuccaagacaa

SEQ ID NO: 861557 - RNA, 21 nt, Human
acuuaguauuuccaagacaaa

SEQ ID NO: 861558 - RNA, 19 nt, Human
agccgccgcccuccgacgc

SEQ ID NO: 861559 - RNA, 22 nt, Human
ccgccgucggcagccgccgccc

SEQ ID NO: 861560 - RNA, 23 nt, Human
ccgccgucggcagccgccgcccu

SEQ ID NO: 861561 - RNA, 19 nt, Human
gaacaucugauagaaaacc

SEQ ID NO: 861562 - RNA, 26 nt, Human
guggaacaucugauagaaaacccagu

SEQ ID NO: 861563 - RNA, 21 nt, Human
uaccccaacuuaguauuucca

SEQ ID NO: 861564 - RNA, 23 nt, Human
uacuccuauucuauauacaggga

SEQ ID NO: 861565 - RNA, 21 nt, Human
ucccgccgucggcagccgccg

SEQ ID NO: 861566 - RNA, 22 nt, Human
ucuucaguuuuaaacaucagcc

SEQ ID NO: 861567 - RNA, 23 nt, Human
ugauagaaaacccagucccgccg

SEQ ID NO: 861568 - RNA, 18 nt, Human
uuuuuuuuuuuuuuuucg

SEQ ID NO: 861569 - RNA, 23 nt, Human
uuuuuuuuuuuuuuuuucgacau

SEQ ID NO: 861570 - RNA, 24 nt, Human
uuuuuuuuuuuuuuuuuuuuucgu

SEQ ID NO: 861571 - RNA, 24 nt, Human
agaccuggauccucgauuuauacu

SEQ ID NO: 861572 - RNA, 22 nt, Human
aguguaguuuugcaaaauacau

SEQ ID NO: 861573 - RNA, 18 nt, Human
cacccaucuucgcucaaa

SEQ ID NO: 861574 - RNA, 24 nt, Human
gaacagggacuaagagaagaacuc

SEQ ID NO: 861575 - RNA, 23 nt, Human
gggaacagggacuaagagaagaa

SEQ ID NO: 861576 - RNA, 21 nt, Human
uaagagaagaacuccaagagc

SEQ ID NO: 861577 - RNA, 20 nt, Human
uaucagaaacuucaguguag

SEQ ID NO: 861578 - RNA, 19 nt, Human
ucgcucaaaacaugucccg

SEQ ID NO: 861579 - RNA, 19 nt, Human
ucucgauucuuccuucauu

SEQ ID NO: 861580 - RNA, 28 nt, Human
uuuuuuuuuuugacaagaaguaagcguu

SEQ ID NO: 861581 - RNA, 18 nt, Human
uuuuuuuuuuuuuuuuug

SEQ ID NO: 861582 - RNA, 23 nt, Human
uuuuuuuuuuuuuuuuugacaag

SEQ ID NO: 861583 - RNA, 22 nt, Human
agaaggacaggcagcuuccagg

SEQ ID NO: 861584 - RNA, 23 nt, Human
agggagaaggacaggcagcuucc

SEQ ID NO: 861585 - RNA, 21 nt, Human
cacaugcccggauggcaaagc

SEQ ID NO: 861586 - RNA, 18 nt, Human
ccgcagcuaauccagucc

SEQ ID NO: 861587 - RNA, 18 nt, Human
cuuccagggcuccgcagc

SEQ ID NO: 861588 - RNA, 22 nt, Human
gagaaggacaggcagcuuccag

SEQ ID NO: 861589 - RNA, 21 nt, Human
uaauccaguccaccacccgga

SEQ ID NO: 861590 - RNA, 19 nt, Human
uacccacaucgucgguggu

SEQ ID NO: 861591 - RNA, 22 nt, Human
uccaguccaccacccggacaca

SEQ ID NO: 861592 - RNA, 20 nt, Human
uccauacccacaucgucggu

SEQ ID NO: 861593 - RNA, 22 nt, Human
ugguuaagcacagggagaagga

SEQ ID NO: 861594 - RNA, 20 nt, Human
uuggaaaagaagggguucug

SEQ ID NO: 861595 - RNA, 22 nt, Human
uuuuuuuuuuuuuuuuucggau

SEQ ID NO: 861596 - RNA, 23 nt, Human
uuuuuuuuuuuuuuuuuuuucgg

SEQ ID NO: 861597 - RNA, 24 nt, Human
uuuuuuuuuuuuuuuuuuuuucgu

SEQ ID NO: 861598 - RNA, 18 nt, Human
agcccuccagggaucuuu

SEQ ID NO: 861599 - RNA, 21 nt, Human
caaaaauacgaacuagcccuc

SEQ ID NO: 861600 - RNA, 24 nt, Human
cuccaacggucaggggacacagcc

SEQ ID NO: 861601 - RNA, 18 nt, Human
gagggugcggggaugcgg

SEQ ID NO: 861602 - RNA, 23 nt, Human
uaacacaaaaauacgaacuagcc

SEQ ID NO: 861603 - RNA, 24 nt, Human
uaacacaaaaauacgaacuagccc

SEQ ID NO: 861604 - RNA, 18 nt, Human
ugccuugagggugcgggg

SEQ ID NO: 861605 - RNA, 18 nt, Human
ugcggggaugcggggguc

SEQ ID NO: 861606 - RNA, 22 nt, Human
uggaggugccuugagggugcgg

SEQ ID NO: 861607 - RNA, 18 nt, Human
uuuuuuuuuuuuuuuucg

SEQ ID NO: 861608 - RNA, 22 nt, Human
uuuuuuuuuuuuuuuuucgcaa

SEQ ID NO: 861609 - RNA, 24 nt, Human
uuuuuuuuuuuuuuuuuuuuucgu

SEQ ID NO: 861610 - RNA, 21 nt, Human
aaauggcccacagaccaaaag

SEQ ID NO: 861611 - RNA, 20 nt, Human
aagcuccaggagugcuuuuc

SEQ ID NO: 861612 - RNA, 24 nt, Human
aaguagcugggauuacaggcaugu

SEQ ID NO: 861613 - RNA, 25 nt, Human
aaguagcugggauuacaggcaugua

SEQ ID NO: 861614 - RNA, 25 nt, Human
aagugauccucccaccucagccucc

SEQ ID NO: 861615 - RNA, 22 nt, Human
aauaucaaaauccuuccuggcu

SEQ ID NO: 861616 - RNA, 23 nt, Human
accucagccucccaaguagcugg

SEQ ID NO: 861617 - RNA, 19 nt, Human
aguucaagugauccuccca

SEQ ID NO: 861618 - RNA, 19 nt, Human
aucaaaauccuuccuggcu

SEQ ID NO: 861619 - RNA, 21 nt, Human
aucaaaauccuuccuggcuga

SEQ ID NO: 861620 - RNA, 25 nt, Human
caaacuccugaguucaagugauccu

SEQ ID NO: 861621 - RNA, 27 nt, Human
caagugauccucccaccucagccuccc

SEQ ID NO: 861622 - RNA, 27 nt, Human
caagugauccucccaccucagccuccc

SEQ ID NO: 861623 - RNA, 24 nt, Human
cagggucucgcuguguugcccugg

SEQ ID NO: 861624 - RNA, 23 nt, Human
caucaguuucugacugaagugga

SEQ ID NO: 861625 - RNA, 23 nt, Human
ccaaguagcugggauuacaggca

SEQ ID NO: 861626 - RNA, 24 nt, Human
ccaaguagcugggauuacaggcau

SEQ ID NO: 861627 - RNA, 23 nt, Human
cccaaguagcugggauuacaggc

SEQ ID NO: 861628 - RNA, 24 nt, Human
cccaaguagcugggauuacaggca

SEQ ID NO: 861629 - RNA, 23 nt, Human
cccaccucagccucccaaguagc

SEQ ID NO: 861630 - RNA, 23 nt, Human
ccucccaccucagccucccaagu

SEQ ID NO: 861631 - RNA, 26 nt, Human
ccucccaccucagccucccaaguagc

SEQ ID NO: 861632 - RNA, 20 nt, Human
ccugaguucaagugauccuc

SEQ ID NO: 861633 - RNA, 24 nt, Human
cucagccucccaaguagcugggau

SEQ ID NO: 861634 - RNA, 18 nt, Human
cuccuugaaucuucugga

SEQ ID NO: 861635 - RNA, 21 nt, Human
gauuacaggcauguaccacug

SEQ ID NO: 861636 - RNA, 24 nt, Human
gauuacaggcauguaccacugugc

SEQ ID NO: 861637 - RNA, 23 nt, Human
gcccuggcugcucucaaacuccu

SEQ ID NO: 861638 - RNA, 24 nt, Human
ggauuacaggcauguaccacugug

SEQ ID NO: 861639 - RNA, 18 nt, Human
gguccuucacaggcuuac

SEQ ID NO: 861640 - RNA, 18 nt, Human
guagcugggauuacaggc

SEQ ID NO: 861641 - RNA, 24 nt, Human
guaucuccaucgguguggucacaa

SEQ ID NO: 861642 - RNA, 24 nt, Human
gugauccucccaccucagccuccc

SEQ ID NO: 861643 - RNA, 23 nt, Human
uaaauaaaaagcucuuccaaaac

SEQ ID NO: 861644 - RNA, 21 nt, Human
uaaauggcccacagaccaaaa

SEQ ID NO: 861645 - RNA, 22 nt, Human
uacaggcauguaccacugugcc

SEQ ID NO: 861646 - RNA, 21 nt, Human
uaccacugugccuagcugaaa

SEQ ID NO: 861647 - RNA, 18 nt, Human
uagaauccagucguuaac

SEQ ID NO: 861648 - RNA, 20 nt, Human
uauaaauaaaaagcucuucc

SEQ ID NO: 861649 - RNA, 20 nt, Human
ucagccucccaaguagcugg

SEQ ID NO: 861650 - RNA, 24 nt, Human
ucccaaguagcugggauuacaggc

SEQ ID NO: 861651 - RNA, 21 nt, Human
ucccuagaaguccaagcuggu

SEQ ID NO: 861652 - RNA, 21 nt, Human
uccugaguucaagugauccuc

SEQ ID NO: 861653 - RNA, 23 nt, Human
ucucaaacuccugaguucaagug

SEQ ID NO: 861654 - RNA, 19 nt, Human
ucucgcuguguugcccugg

SEQ ID NO: 861655 - RNA, 21 nt, Human
uggcccacagaccaaaagucu

SEQ ID NO: 861656 - RNA, 21 nt, Human
ugggauuacaggcauguacca

SEQ ID NO: 861657 - RNA, 23 nt, Human
ugggauuacaggcauguaccacu

SEQ ID NO: 861658 - RNA, 24 nt, Human
ugggauuacaggcauguaccacug

SEQ ID NO: 861659 - RNA, 24 nt, Human
uguguugcccuggcugcucucaaa

SEQ ID NO: 861660 - RNA, 22 nt, Human
uguugcccuggcugcucucaaa

SEQ ID NO: 861661 - RNA, 20 nt, Human
uuaaauggcccacagaccaa

SEQ ID NO: 861662 - RNA, 23 nt, Human
uucaagugauccucccaccucag

SEQ ID NO: 861663 - RNA, 24 nt, Human
uucaagugauccucccaccucagc

SEQ ID NO: 861664 - RNA, 18 nt, Human
uuuucuagcaaaaacccc

SEQ ID NO: 861665 - RNA, 24 nt, Human
uuuuuuuuuugggacagggucucg

SEQ ID NO: 861666 - RNA, 25 nt, Human
uuuuuuuuuuuugggacagggucuc

SEQ ID NO: 861667 - RNA, 26 nt, Human
uuuuuuuuuuuuuuuuugggacaggg

SEQ ID NO: 861668 - RNA, 24 nt, Human
uuuuuuuuuuuuuuuuuuuuuggg

SEQ ID NO: 861669 - RNA, 18 nt, Human
aacuccugccuucacccc

SEQ ID NO: 861670 - RNA, 23 nt, Human
aagcaggcaccagcucacccucc

SEQ ID NO: 861671 - RNA, 19 nt, Human
aaguggacccgccaauccc

SEQ ID NO: 861672 - RNA, 21 nt, Human
acacagccucucccugggucc

SEQ ID NO: 861673 - RNA, 19 nt, Human
accaccaagucuccaaguc

SEQ ID NO: 861674 - RNA, 21 nt, Human
accccagcagggacacagccu

SEQ ID NO: 861675 - RNA, 21 nt, Human
accccgccgucaccgcauaca

SEQ ID NO: 861676 - RNA, 19 nt, Human
agcacaauccuccuccugg

SEQ ID NO: 861677 - RNA, 25 nt, Human
agccaaauaaaacauaaaaacagaa

SEQ ID NO: 861678 - RNA, 19 nt, Human
agccucucagcggugggga

SEQ ID NO: 861679 - RNA, 20 nt, Human
aggccagcaaaugccaacca

SEQ ID NO: 861680 - RNA, 18 nt, Human
agggcuccuguggcuacg

SEQ ID NO: 861681 - RNA, 25 nt, Human
aggugcggaggcagccucucagcgg

SEQ ID NO: 861682 - RNA, 21 nt, Human
aguucggcuauuucagagagg

SEQ ID NO: 861683 - RNA, 21 nt, Human
caaaggccccuccccaccccc

SEQ ID NO: 861684 - RNA, 24 nt, Human
caagccaaauaaaacauaaaaaca

SEQ ID NO: 861685 - RNA, 23 nt, Human
caaucccgaggaagaaccggagg

SEQ ID NO: 861686 - RNA, 20 nt, Human
cacagcagcuucggccucaa

SEQ ID NO: 861687 - RNA, 23 nt, Human
cacaguaaagcuggaccugagac

SEQ ID NO: 861688 - RNA, 18 nt, Human
caccaagucuccaagucc

SEQ ID NO: 861689 - RNA, 22 nt, Human
cacucuggcuuuggcucagccc

SEQ ID NO: 861690 - RNA, 23 nt, Human
cagaccaccaagucuccaagucc

SEQ ID NO: 861691 - RNA, 25 nt, Human
cagcagcuucggccucaaagccaag

SEQ ID NO: 861692 - RNA, 19 nt, Human
cagcccccagaaaccaagg

SEQ ID NO: 861693 - RNA, 20 nt, Human
cagcucagaccaccaagucu

SEQ ID NO: 861694 - RNA, 18 nt, Human
cagcuuucauacuagggc

SEQ ID NO: 861695 - RNA, 21 nt, Human
caggagagggggugcugggcc

SEQ ID NO: 861696 - RNA, 26 nt, Human
caggcugagguccccacaaaucugcc

SEQ ID NO: 861697 - RNA, 22 nt, Human
ccaaaaagaauugcaaagcucc

SEQ ID NO: 861698 - RNA, 24 nt, Human
ccaaaauaaaacaagccaaauaaa

SEQ ID NO: 861699 - RNA, 21 nt, Human
ccaacuccugccuucaccccc

SEQ ID NO: 861700 - RNA, 24 nt, Human
ccaaucccgaggaagaaccggagg

SEQ ID NO: 861701 - RNA, 20 nt, Human
ccagacagccacaguaaagc

SEQ ID NO: 861702 - RNA, 21 nt, Human
ccagcccccagaaaccaaggg

SEQ ID NO: 861703 - RNA, 19 nt, Human
cccagcccuggccugggaa

SEQ ID NO: 861704 - RNA, 19 nt, Human
cccauauugcacuugguca

SEQ ID NO: 861705 - RNA, 19 nt, Human
ccccacaaaucugccccca

SEQ ID NO: 861706 - RNA, 22 nt, Human
ccccagagcccuggcaagugga

SEQ ID NO: 861707 - RNA, 27 nt, Human
ccccgccgucaccgcauacagaaucua

SEQ ID NO: 861708 - RNA, 22 nt, Human
ccccucacaggccaccacaccc

SEQ ID NO: 861709 - RNA, 21 nt, Human
ccgcccgugauugucucugcc

SEQ ID NO: 861710 - RNA, 20 nt, Human
ccgccgucaccgcauacagg

SEQ ID NO: 861711 - RNA, 24 nt, Human
ccucacaggccaccacaccccgcc

SEQ ID NO: 861712 - RNA, 23 nt, Human
ccugccaggccagcaaaugccaa

SEQ ID NO: 861713 - RNA, 18 nt, Human
ccugggcagcagucaggu

SEQ ID NO: 861714 - RNA, 21 nt, Human
ccugggcagcagucaggugcg

SEQ ID NO: 861715 - RNA, 23 nt, Human
ccugguccugaccugcccccaac

SEQ ID NO: 861716 - RNA, 22 nt, Human
ccugugacccagcccuggccug

SEQ ID NO: 861717 - RNA, 22 nt, Human
cgaggaagaaccggaggacuug

SEQ ID NO: 861718 - RNA, 18 nt, Human
cgcccccgggcggacccu

SEQ ID NO: 861719 - RNA, 22 nt, Human
cgcucaguaaggggacacaguc

SEQ ID NO: 861720 - RNA, 22 nt, Human
cuaauccaaaauaaaacaagcc

SEQ ID NO: 861721 - RNA, 21 nt, Human
cugccuucacccccugccagg

SEQ ID NO: 861722 - RNA, 20 nt, Human
cuggcaggcugcugggcgcc

SEQ ID NO: 861723 - RNA, 24 nt, Human
cugugacccagcccuggccuggga

SEQ ID NO: 861724 - RNA, 24 nt, Human
gaggggguugaaggguuagcagaa

SEQ ID NO: 861725 - RNA, 21 nt, Human
gaucugggagacguuuccccu

SEQ ID NO: 861726 - RNA, 21 nt, Human
gccaggggccccucacaggcc

SEQ ID NO: 861727 - RNA, 23 nt, Human
gcccccagaaaccaagggcagca

SEQ ID NO: 861728 - RNA, 22 nt, Human
gccucaaagccaagggagcgau

SEQ ID NO: 861729 - RNA, 19 nt, Human
gccuucacccccugccagg

SEQ ID NO: 861730 - RNA, 23 nt, Human
gcggacacuaguacaaaauaagu

SEQ ID NO: 861731 - RNA, 18 nt, Human
gcugcugggcgcccucca

SEQ ID NO: 861732 - RNA, 20 nt, Human
gcugggccgagccgggcugg

SEQ ID NO: 861733 - RNA, 21 nt, Human
ggaagaaccggaggacuuggg

SEQ ID NO: 861734 - RNA, 21 nt, Human
ggccaggggccccucacaggc

SEQ ID NO: 861735 - RNA, 21 nt, Human
gggcagcagucaggugcggag

SEQ ID NO: 861736 - RNA, 22 nt, Human
gggccgagccgggcuggcagga

SEQ ID NO: 861737 - RNA, 26 nt, Human
gggccguggccacucuggcuuuggcu

SEQ ID NO: 861738 - RNA, 24 nt, Human
ggggccccucacaggccaccacac

SEQ ID NO: 861739 - RNA, 20 nt, Human
guccuuguuguucuccaaac

SEQ ID NO: 861740 - RNA, 22 nt, Human
gucugucccguccccuccuuuu

SEQ ID NO: 861741 - RNA, 19 nt, Human
guggacccgccaaucccga

SEQ ID NO: 861742 - RNA, 21 nt, Human
guggacccgccaaucccgagg

SEQ ID NO: 861743 - RNA, 20 nt, Human
guggccacucuggcuuuggc

SEQ ID NO: 861744 - RNA, 22 nt, Human
uaaaacaagccaaauaaaacau

SEQ ID NO: 861745 - RNA, 22 nt, Human
uaaaacauaaaaacagaaaaua

SEQ ID NO: 861746 - RNA, 23 nt, Human
uaauccaaaauaaaacaagccaa

SEQ ID NO: 861747 - RNA, 23 nt, Human
uaggaggcgaggggguugaaggg

SEQ ID NO: 861748 - RNA, 22 nt, Human
ucacuacaucagcacaauccuc

SEQ ID NO: 861749 - RNA, 21 nt, Human
ucagggucugggugcagacgg

SEQ ID NO: 861750 - RNA, 19 nt, Human
uccccacaaaucugccccc

SEQ ID NO: 861751 - RNA, 19 nt, Human
uccccuccuuuucucuaca

SEQ ID NO: 861752 - RNA, 20 nt, Human
ucccgggagugcccgguccu

SEQ ID NO: 861753 - RNA, 25 nt, Human
ucccuggguccugguccuuccgaug

SEQ ID NO: 861754 - RNA, 24 nt, Human
uccuguggcuacguacaaucaacu

SEQ ID NO: 861755 - RNA, 18 nt, Human
ucggccucaaagccaagg

SEQ ID NO: 861756 - RNA, 21 nt, Human
ugacccagcccuggccuggga

SEQ ID NO: 861757 - RNA, 18 nt, Human
ugaccugcccccaacucc

SEQ ID NO: 861758 - RNA, 25 nt, Human
ugagaccccagcagggacacagccu

SEQ ID NO: 861759 - RNA, 22 nt, Human
ugccaaccagcccccagaaacc

SEQ ID NO: 861760 - RNA, 19 nt, Human
ugcugggcgcccuccagga

SEQ ID NO: 861761 - RNA, 23 nt, Human
uggcaaguggacccgccaauccc

SEQ ID NO: 861762 - RNA, 25 nt, Human
uggcaggcugcugggcgcccuccuc

SEQ ID NO: 861763 - RNA, 18 nt, Human
uggccacucuggcuuugg

SEQ ID NO: 861764 - RNA, 19 nt, Human
uggccacucuggcuuuggc

SEQ ID NO: 861765 - RNA, 21 nt, Human
uggccacucuggcuuuggcuc

SEQ ID NO: 861766 - RNA, 27 nt, Human
ugggaaggauccagacagccacaguag

SEQ ID NO: 861767 - RNA, 23 nt, Human
ugggccaggggccccucacaggc

SEQ ID NO: 861768 - RNA, 19 nt, Human
ugggcgcccuccaggagag

SEQ ID NO: 861769 - RNA, 21 nt, Human
uggguccugguccugaccugc

SEQ ID NO: 861770 - RNA, 21 nt, Human
ugggugcagacggcaacggcc

SEQ ID NO: 861771 - RNA, 21 nt, Human
uucacccccugccaggccagc

SEQ ID NO: 861772 - RNA, 20 nt, Human
uuccugugacccagcccugg

SEQ ID NO: 861773 - RNA, 22 nt, Human
uucuuaacaguacucacuuuaa

SEQ ID NO: 861774 - RNA, 20 nt, Human
uuguguguagguuuuauucc

SEQ ID NO: 861775 - RNA, 21 nt, Human
uuuggcucagcccagccugga

SEQ ID NO: 861776 - RNA, 20 nt, Human
aaacugcugggauuacaggc

SEQ ID NO: 861777 - RNA, 24 nt, Human
aaacugcugggauuacaggcguga

SEQ ID NO: 861778 - RNA, 21 nt, Human
aaccccugaccucaaguguuc

SEQ ID NO: 861779 - RNA, 22 nt, Human
accccccucucccccucccagu

SEQ ID NO: 861780 - RNA, 22 nt, Human
acccgccucggcuucccaaacu

SEQ ID NO: 861781 - RNA, 25 nt, Human
acucugucgcccaggcuggagugca

SEQ ID NO: 861782 - RNA, 23 nt, Human
aggacggggucucaggauggggc

SEQ ID NO: 861783 - RNA, 23 nt, Human
aggcgugagccaccgugucuggc

SEQ ID NO: 861784 - RNA, 25 nt, Human
aggcuggagugcaguggcgcaaucu

SEQ ID NO: 861785 - RNA, 20 nt, Human
agguucuugggggaaagugg

SEQ ID NO: 861786 - RNA, 20 nt, Human
agugcaguggcgcaaucucg

SEQ ID NO: 861787 - RNA, 24 nt, Human
agugcaguggcgcaaucucggcuc

SEQ ID NO: 861788 - RNA, 21 nt, Human
aucaccccccucucccccucc

SEQ ID NO: 861789 - RNA, 24 nt, Human
caaacugcugggauuacaggcgug

SEQ ID NO: 861790 - RNA, 26 nt, Human
caagccaggcuggucucaaaccccug

SEQ ID NO: 861791 - RNA, 21 nt, Human
caccccccucucccccuccca

SEQ ID NO: 861792 - RNA, 24 nt, Human
cacucugucgcccaggcuggagug

SEQ ID NO: 861793 - RNA, 21 nt, Human
cacugcaaccuccgccuccca

SEQ ID NO: 861794 - RNA, 22 nt, Human
cauuacagaaaugaggacgggg

SEQ ID NO: 861795 - RNA, 20 nt, Human
ccaaacugcugggauuacag

SEQ ID NO: 861796 - RNA, 22 nt, Human
ccaaacugcugggauuacaggc

SEQ ID NO: 861797 - RNA, 22 nt, Human
ccaaacugcugggauuacaggc

SEQ ID NO: 861798 - RNA, 24 nt, Human
ccaaacugcugggauuacaggcgu

SEQ ID NO: 861799 - RNA, 23 nt, Human
ccacccgccucggcuucccaaac

SEQ ID NO: 861800 - RNA, 22 nt, Human
ccuaugggugggguccuguuga

SEQ ID NO: 861801 - RNA, 24 nt, Human
ccucccagguucaagccaggcugg

SEQ ID NO: 861802 - RNA, 19 nt, Human
ccucccaguugacagacuu

SEQ ID NO: 861803 - RNA, 23 nt, Human
ccugaccucaaguguuccacccg

SEQ ID NO: 861804 - RNA, 22 nt, Human
ccuggcccaucaccccccucuc

SEQ ID NO: 861805 - RNA, 24 nt, Human
cgcccaggcuggagugcaguggcg

SEQ ID NO: 861806 - RNA, 19 nt, Human
cgccucccagguucaagcc

SEQ ID NO: 861807 - RNA, 24 nt, Human
cucacucugucgcccaggcuggag

SEQ ID NO: 861808 - RNA, 24 nt, Human
cucacugcaaccuccgccucccag

SEQ ID NO: 861809 - RNA, 23 nt, Human
cugcaaccuccgccucccagguu

SEQ ID NO: 861810 - RNA, 24 nt, Human
cugcaaccuccgccucccagguuc

SEQ ID NO: 861811 - RNA, 24 nt, Human
gaccucaaguguuccacccgccuc

SEQ ID NO: 861812 - RNA, 18 nt, Human
gauuacaggcgugagcca

SEQ ID NO: 861813 - RNA, 21 nt, Human
gauuacaggcgugagccaccg

SEQ ID NO: 861814 - RNA, 24 nt, Human
gauuacaggcgugagccaccgugu

SEQ ID NO: 861815 - RNA, 19 nt, Human
gcccaggcuggagugcagu

SEQ ID NO: 861816 - RNA, 20 nt, Human
gcccaggcuggagugcagug

SEQ ID NO: 861817 - RNA, 23 nt, Human
gcccaucaccccccucucccccu

SEQ ID NO: 861818 - RNA, 23 nt, Human
gccucggcuucccaaacugcugg

SEQ ID NO: 861819 - RNA, 24 nt, Human
gccucggcuucccaaacugcuggg

SEQ ID NO: 861820 - RNA, 19 nt, Human
gcuggagugcaguggcgca

SEQ ID NO: 861821 - RNA, 23 nt, Human
gcuggucucaaaccccugaccuc

SEQ ID NO: 861822 - RNA, 23 nt, Human
ggacggggucucaggauggggcu

SEQ ID NO: 861823 - RNA, 21 nt, Human
gguucaagccaggcuggucuc

SEQ ID NO: 861824 - RNA, 24 nt, Human
guguuccacccgccucggcuuccc

SEQ ID NO: 861825 - RNA, 23 nt, Human
uacaggcgugagccaccgugucu

SEQ ID NO: 861826 - RNA, 20 nt, Human
uagguucuugggggaaagug

SEQ ID NO: 861827 - RNA, 20 nt, Human
ucaccccccucucccccucc

SEQ ID NO: 861828 - RNA, 24 nt, Human
ucacucugucgcccaggcuggagu

SEQ ID NO: 861829 - RNA, 19 nt, Human
ucacugcaaccuccgccuc

SEQ ID NO: 861830 - RNA, 24 nt, Human
ucacugcaaccuccgccucccagg

SEQ ID NO: 861831 - RNA, 25 nt, Human
ucacugcaaccuccgccucccaggu

SEQ ID NO: 861832 - RNA, 27 nt, Human
ucacugcaaccuccgccucccagguuc

SEQ ID NO: 861833 - RNA, 23 nt, Human
uccaucauuacagaaaugaggac

SEQ ID NO: 861834 - RNA, 24 nt, Human
ucccaaacugcugggauuacaggc

SEQ ID NO: 861835 - RNA, 21 nt, Human
ucccagguucaagccaggcug

SEQ ID NO: 861836 - RNA, 24 nt, Human
ucgcccaggcuggagugcaguggc

SEQ ID NO: 861837 - RNA, 22 nt, Human
ucucacucugucgcccaggcug

SEQ ID NO: 861838 - RNA, 23 nt, Human
ucucacucugucgcccaggcugg

SEQ ID NO: 861839 - RNA, 24 nt, Human
ucucacucugucgcccaggcugga

SEQ ID NO: 861840 - RNA, 26 nt, Human
ucucacucugucgcccaggcuggagu

SEQ ID NO: 861841 - RNA, 21 nt, Human
ucucaggauggggcugacagg

SEQ ID NO: 861842 - RNA, 24 nt, Human
ucugucgcccaggcuggagugcag

SEQ ID NO: 861843 - RNA, 24 nt, Human
ugacaggcucccaauccuccugcu

SEQ ID NO: 861844 - RNA, 22 nt, Human
ugagacggagucucacucuguc

SEQ ID NO: 861845 - RNA, 23 nt, Human
ugcaguggcgcaaucucggcuca

SEQ ID NO: 861846 - RNA, 24 nt, Human
ugcugggauuacaggcgugagcca

SEQ ID NO: 861847 - RNA, 23 nt, Human
uggagugcaguggcgcaaucucg

SEQ ID NO: 861848 - RNA, 24 nt, Human
uggagugcaguggcgcaaucucgg

SEQ ID NO: 861849 - RNA, 18 nt, Human
ugggauuacaggcgugag

SEQ ID NO: 861850 - RNA, 21 nt, Human
ugggauuacaggcgugagcca

SEQ ID NO: 861851 - RNA, 22 nt, Human
ugggauuacaggcgugagccac

SEQ ID NO: 861852 - RNA, 23 nt, Human
ugggauuacaggcgugagccacc

SEQ ID NO: 861853 - RNA, 23 nt, Human
ugggauuacaggcgugagccacc

SEQ ID NO: 861854 - RNA, 24 nt, Human
ugggauuacaggcgugagccaccg

SEQ ID NO: 861855 - RNA, 22 nt, Human
uguuccacccgccucggcuucc

SEQ ID NO: 861856 - RNA, 24 nt, Human
uguuccacccgccucggcuuccca

SEQ ID NO: 861857 - RNA, 22 nt, Human
uuuuuuuugagacggagucuca

SEQ ID NO: 861858 - RNA, 23 nt, Human
uuuuuuuuuuuuuucuucacaag

SEQ ID NO: 861859 - RNA, 21 nt, Human
aaccaggaaaagagaugucca

SEQ ID NO: 861860 - RNA, 22 nt, Human
aaccaggaaaagagauguccag

SEQ ID NO: 861861 - RNA, 21 nt, Human
aaggaccaugaagugccaugg

SEQ ID NO: 861862 - RNA, 19 nt, Human
acccgccuccgcacucacc

SEQ ID NO: 861863 - RNA, 18 nt, Human
acccgugaccacggccgu

SEQ ID NO: 861864 - RNA, 23 nt, Human
agaaaguaaccacggaggucaag

SEQ ID NO: 861865 - RNA, 20 nt, Human
agaugaccccagcccugcau

SEQ ID NO: 861866 - RNA, 26 nt, Human
agcagcaaccccgcgcccagcagcag

SEQ ID NO: 861867 - RNA, 23 nt, Human
aggaaaagagauguccagggcac

SEQ ID NO: 861868 - RNA, 18 nt, Human
cacccauuauuccuucaa

SEQ ID NO: 861869 - RNA, 20 nt, Human
cacccgccuccgcacucacc

SEQ ID NO: 861870 - RNA, 21 nt, Human
cacggcggggccuucaccagg

SEQ ID NO: 861871 - RNA, 18 nt, Human
cacugugagacccuaggc

SEQ ID NO: 861872 - RNA, 21 nt, Human
cagaucccaggcccuccuccu

SEQ ID NO: 861873 - RNA, 22 nt, Human
cagcagcaaccccgcgcccagc

SEQ ID NO: 861874 - RNA, 23 nt, Human
cagcugcccugcccugacucacu

SEQ ID NO: 861875 - RNA, 20 nt, Human
cauccaaauuuccgagaagc

SEQ ID NO: 861876 - RNA, 19 nt, Human
cauggcaagcauccuggcc

SEQ ID NO: 861877 - RNA, 23 nt, Human
ccagcccugcauccgcccggaag

SEQ ID NO: 861878 - RNA, 22 nt, Human
cccaugccgccgcacggcgggg

SEQ ID NO: 861879 - RNA, 20 nt, Human
ccccgcagguugcccaugcc

SEQ ID NO: 861880 - RNA, 21 nt, Human
ccccgccagcucgcacucacc

SEQ ID NO: 861881 - RNA, 23 nt, Human
ccccgccagcucgcacucacccg

SEQ ID NO: 861882 - RNA, 22 nt, Human
cccuaggcgagucccuuagcuc

SEQ ID NO: 861883 - RNA, 18 nt, Human
cccuccuccuacucacug

SEQ ID NO: 861884 - RNA, 19 nt, Human
ccgccggcccggccuccuc

SEQ ID NO: 861885 - RNA, 26 nt, Human
ccgcgcccagcagcagcgccuccaug

SEQ ID NO: 861886 - RNA, 24 nt, Human
ccgcuucauuaacauggggguaau

SEQ ID NO: 861887 - RNA, 21 nt, Human
ccucagacccuuggguucaga

SEQ ID NO: 861888 - RNA, 19 nt, Human
ccuuggguucagaucccag

SEQ ID NO: 861889 - RNA, 27 nt, Human
cggcccuggccucagacccuuggguuc

SEQ ID NO: 861890 - RNA, 21 nt, Human
cuaauuccgcuucauuaacau

SEQ ID NO: 861891 - RNA, 22 nt, Human
cucugcuccagagcugaucaga

SEQ ID NO: 861892 - RNA, 18 nt, Human
cuuuccgaugccgcuguu

SEQ ID NO: 861893 - RNA, 19 nt, Human
gagaagcacagugucuagc

SEQ ID NO: 861894 - RNA, 19 nt, Human
gagcccggcgggccgcugc

SEQ ID NO: 861895 - RNA, 21 nt, Human
gcacagugucuagcauacccc

SEQ ID NO: 861896 - RNA, 22 nt, Human
gcagcagcgccuccaugccucg

SEQ ID NO: 861897 - RNA, 21 nt, Human
gccauggcaagcauccuggcc

SEQ ID NO: 861898 - RNA, 22 nt, Human
gccauggcaagcauccuggccu

SEQ ID NO: 861899 - RNA, 22 nt, Human
gccgcuguuggcgccugcggac

SEQ ID NO: 861900 - RNA, 19 nt, Human
gggcgggagccgagcugag

SEQ ID NO: 861901 - RNA, 20 nt, Human
guggggccugaaaauacuac

SEQ ID NO: 861902 - RNA, 18 nt, Human
uaagcgcccagcagcaac

SEQ ID NO: 861903 - RNA, 23 nt, Human
uacucacugugagacccuaggcg

SEQ ID NO: 861904 - RNA, 22 nt, Human
uagacaagcacguaagcgccca

SEQ ID NO: 861905 - RNA, 18 nt, Human
uagcauaccccuaucucu

SEQ ID NO: 861906 - RNA, 22 nt, Human
ucacauugcaaacucccugccu

SEQ ID NO: 861907 - RNA, 21 nt, Human
ucacucucaggaagaaauaau

SEQ ID NO: 861908 - RNA, 23 nt, Human
ucaggaagaaauaaucacccauu

SEQ ID NO: 861909 - RNA, 19 nt, Human
uccagggcacagcuugggg

SEQ ID NO: 861910 - RNA, 24 nt, Human
ucccuuagcucgggagccuaauuc

SEQ ID NO: 861911 - RNA, 21 nt, Human
uccgcgcgccccgccagcucg

SEQ ID NO: 861912 - RNA, 23 nt, Human
uccgcgcgccccgccagcucgca

SEQ ID NO: 861913 - RNA, 26 nt, Human
uccuccuacucacugugagacccuag

SEQ ID NO: 861914 - RNA, 21 nt, Human
ucucaggaagaaauaaucacc

SEQ ID NO: 861915 - RNA, 21 nt, Human
ugcccugacucacuucucagc

SEQ ID NO: 861916 - RNA, 19 nt, Human
ugccucugcuccagagcug

SEQ ID NO: 861917 - RNA, 18 nt, Human
uggggccccagaaaguaa

SEQ ID NO: 861918 - RNA, 18 nt, Human
uggggguaauuuaacuac

SEQ ID NO: 861919 - RNA, 25 nt, Human
uuaacuaccuagcuagacgguugca

SEQ ID NO: 861920 - RNA, 21 nt, Human
uugcaaacucccugccucugc

SEQ ID NO: 861921 - RNA, 24 nt, Human
uugcaaacucccugccucugcucc

SEQ ID NO: 861922 - RNA, 23 nt, Human
uuuuuuuuuggcggucaacgcgc

SEQ ID NO: 861923 - RNA, 19 nt, Human
uuuuuuuuuuuuggcgguc

SEQ ID NO: 861924 - RNA, 18 nt, Human
uuuuuuuuuuuuuuuuug

SEQ ID NO: 861925 - RNA, 22 nt, Human
uuuuuuuuuuuuuuuuuggcgg

SEQ ID NO: 861926 - RNA, 23 nt, Human
uuuuuuuuuuuuuuuuuggcggu

SEQ ID NO: 861927 - RNA, 22 nt, Human
uuuuuuuuuuuuuuuuuuuggc

SEQ ID NO: 861928 - RNA, 25 nt, Human
aagaggccaggaaagcaugguggga

SEQ ID NO: 861929 - RNA, 23 nt, Human
aagaggccaggaaagcauguugc

SEQ ID NO: 861930 - RNA, 22 nt, Human
aagcccacugcuggaguuuugg

SEQ ID NO: 861931 - RNA, 22 nt, Human
aagccuucggagacugcagccc

SEQ ID NO: 861932 - RNA, 23 nt, Human
acaccgagguccacucuccgcac

SEQ ID NO: 861933 - RNA, 24 nt, Human
acagauucucuccaaaugcaucaa

SEQ ID NO: 861934 - RNA, 22 nt, Human
acccaagaacagccacccugau

SEQ ID NO: 861935 - RNA, 27 nt, Human
acugcagcccauccagaaaggaccuug

SEQ ID NO: 861936 - RNA, 18 nt, Human
agaaaacaaucacaguuu

SEQ ID NO: 861937 - RNA, 27 nt, Human
agaaaacaaucacaguuucgggauggc

SEQ ID NO: 861938 - RNA, 18 nt, Human
agaccucgccgcgcccag

SEQ ID NO: 861939 - RNA, 24 nt, Human
agcaaggguucuccaaggaccgcg

SEQ ID NO: 861940 - RNA, 22 nt, Human
agcgauggcagugcacgcagcc

SEQ ID NO: 861941 - RNA, 23 nt, Human
aggaaagauggcagcacugugag

SEQ ID NO: 861942 - RNA, 21 nt, Human
agggauggggaggcgaggcca

SEQ ID NO: 861943 - RNA, 21 nt, Human
augaggugagccggccacuug

SEQ ID NO: 861944 - RNA, 23 nt, Human
caaaaaacagcuuucuggaggca

SEQ ID NO: 861945 - RNA, 23 nt, Human
caaggguucuccaaggaccgcgc

SEQ ID NO: 861946 - RNA, 19 nt, Human
cacagcucagcccuggguc

SEQ ID NO: 861947 - RNA, 20 nt, Human
cacagcucagcccugggucc

SEQ ID NO: 861948 - RNA, 19 nt, Human
caccagaccucgccgcgcc

SEQ ID NO: 861949 - RNA, 22 nt, Human
caccagaccucgccgcgcccag

SEQ ID NO: 861950 - RNA, 18 nt, Human
cacccaagaacagccacc

SEQ ID NO: 861951 - RNA, 18 nt, Human
cacgcagccccgcacaca

SEQ ID NO: 861952 - RNA, 20 nt, Human
cagaccccggaucgccgccu

SEQ ID NO: 861953 - RNA, 23 nt, Human
cagauucucuccaaaugcaucaa

SEQ ID NO: 861954 - RNA, 25 nt, Human
cagccccgcacacaccgagguccac

SEQ ID NO: 861955 - RNA, 23 nt, Human
cagugcacgcagccccgcacaca

SEQ ID NO: 861956 - RNA, 23 nt, Human
cauccagaaaggaccacugucuc

SEQ ID NO: 861957 - RNA, 23 nt, Human
cauguugccccugcaguugugga

SEQ ID NO: 861958 - RNA, 22 nt, Human
ccaagaacagccacccugaucu

SEQ ID NO: 861959 - RNA, 18 nt, Human
ccagaccucgccgcgccc

SEQ ID NO: 861960 - RNA, 25 nt, Human
ccauaaccaugucugacccccuggg

SEQ ID NO: 861961 - RNA, 21 nt, Human
cccccaaaaaacagcuuucug

SEQ ID NO: 861962 - RNA, 20 nt, Human
ccccgcacacaccgaggucc

SEQ ID NO: 861963 - RNA, 25 nt, Human
ccccggaucgccgccuccucgggag

SEQ ID NO: 861964 - RNA, 18 nt, Human
cccgcacacaccgagguc

SEQ ID NO: 861965 - RNA, 20 nt, Human
cccgcacacaccgaggucca

SEQ ID NO: 861966 - RNA, 20 nt, Human
cccuggguccacgccggcuc

SEQ ID NO: 861967 - RNA, 21 nt, Human
cggccgacgcuuccacauuca

SEQ ID NO: 861968 - RNA, 23 nt, Human
cucgucgggauggcccucguggu

SEQ ID NO: 861969 - RNA, 18 nt, Human
gaagaggccaggaaagca

SEQ ID NO: 861970 - RNA, 21 nt, Human
gaggcgaggccaggccgcaga

SEQ ID NO: 861971 - RNA, 26 nt, Human
gccaaguccuccgucccccaaaaaac

SEQ ID NO: 861972 - RNA, 24 nt, Human
gccgcagagugagcgucauucucc

SEQ ID NO: 861973 - RNA, 23 nt, Human
gcgauggcagugcacgcagcccc

SEQ ID NO: 861974 - RNA, 20 nt, Human
gcucguguagagggagcgau

SEQ ID NO: 861975 - RNA, 19 nt, Human
gcucuccccaucaauccug

SEQ ID NO: 861976 - RNA, 20 nt, Human
ggaauuccagaauuccaggc

SEQ ID NO: 861977 - RNA, 23 nt, Human
ggcaggaaugaggugagccggcc

SEQ ID NO: 861978 - RNA, 18 nt, Human
gggauggggaggcgaggc

SEQ ID NO: 861979 - RNA, 21 nt, Human
gggauggggaggcgaggccag

SEQ ID NO: 861980 - RNA, 18 nt, Human
ggucacagcucagcccug

SEQ ID NO: 861981 - RNA, 18 nt, Human
uaaccaugucugaccccc

SEQ ID NO: 861982 - RNA, 23 nt, Human
ucacagcucagcccuggguccac

SEQ ID NO: 861983 - RNA, 22 nt, Human
uccagaaaggaccacugucucc

SEQ ID NO: 861984 - RNA, 19 nt, Human
ucuccgcacagcccacgcu

SEQ ID NO: 861985 - RNA, 19 nt, Human
ugcagaagggauggggagg

SEQ ID NO: 861986 - RNA, 25 nt, Human
uggcagcacugugagaacacggacc

SEQ ID NO: 861987 - RNA, 19 nt, Human
ugggaauuccagaauucca

SEQ ID NO: 861988 - RNA, 23 nt, Human
ugucugacccccugggaauucca

SEQ ID NO: 861989 - RNA, 22 nt, Human
uucccauaaccaugucugaccc

SEQ ID NO: 861990 - RNA, 18 nt, Human
uucgccugggcucucccc

SEQ ID NO: 861991 - RNA, 22 nt, Human
uuugcagaagggauggggaggc

SEQ ID NO: 861992 - RNA, 20 nt, Human
uuuuuuuuuuuuuuuuucac

SEQ ID NO: 861993 - RNA, 24 nt, Human
uuuuuuuuuuuuuuuuuuuucacg

SEQ ID NO: 861994 - RNA, 21 nt, Human
aacuuccccgcaccccagcac

SEQ ID NO: 861995 - RNA, 20 nt, Human
aauaaugaagaaaacagauu

SEQ ID NO: 861996 - RNA, 23 nt, Human
aaugaagaaaacagauuuuguaa

SEQ ID NO: 861997 - RNA, 18 nt, Human
agcgcccccuugcuccuc

SEQ ID NO: 861998 - RNA, 24 nt, Human
auaaugaagaaaacagauuuugua

SEQ ID NO: 861999 - RNA, 19 nt, Human
augcucaucccaauaauga

SEQ ID NO: 862000 - RNA, 21 nt, Human
cacaaccuuagcccuccgucc

SEQ ID NO: 862001 - RNA, 23 nt, Human
cacacaaccuuagcccuccgucc

SEQ ID NO: 862002 - RNA, 22 nt, Human
caccaagcggccucugcucccc

SEQ ID NO: 862003 - RNA, 22 nt, Human
caccccagcucucucucgccgg

SEQ ID NO: 862004 - RNA, 21 nt, Human
cagcgccuuccacacaaccuu

SEQ ID NO: 862005 - RNA, 18 nt, Human
ccccagcaccccagcucu

SEQ ID NO: 862006 - RNA, 26 nt, Human
ccccagcaccccagcucucucucgcc

SEQ ID NO: 862007 - RNA, 24 nt, Human
ccccgcaccccagcaccccagcuc

SEQ ID NO: 862008 - RNA, 21 nt, Human
cccgcaccccagcaccccagc

SEQ ID NO: 862009 - RNA, 18 nt, Human
cccuccguccggggaucc

SEQ ID NO: 862010 - RNA, 21 nt, Human
ccuagcgcccccuugcuccuc

SEQ ID NO: 862011 - RNA, 22 nt, Human
cuccccaacuuccccgcacccc

SEQ ID NO: 862012 - RNA, 19 nt, Human
cuuagcccuccguccgggg

SEQ ID NO: 862013 - RNA, 20 nt, Human
cuuccacacaaccuuagccc

SEQ ID NO: 862014 - RNA, 21 nt, Human
cuuccccgcaccccagcaccc

SEQ ID NO: 862015 - RNA, 22 nt, Human
gcggccucugcuccccaacuuc

SEQ ID NO: 862016 - RNA, 24 nt, Human
uacaagggugguuuaauacuagaa

SEQ ID NO: 862017 - RNA, 22 nt, Human
uacccuacucggacaccaagcg

SEQ ID NO: 862018 - RNA, 18 nt, Human
uccacacaaccuuagccc

SEQ ID NO: 862019 - RNA, 20 nt, Human
uccccaacuuccccgcaccc

SEQ ID NO: 862020 - RNA, 21 nt, Human
uccccaacuuccccgcacccc

SEQ ID NO: 862021 - RNA, 20 nt, Human
uccccgcaccccagcacccc

SEQ ID NO: 862022 - RNA, 21 nt, Human
ucgcaacccaguucccuuucc

SEQ ID NO: 862023 - RNA, 18 nt, Human
uuccacacaaccuuagcc

SEQ ID NO: 862024 - RNA, 24 nt, Human
uuuccuagcgcccccuugcuccuc

SEQ ID NO: 862025 - RNA, 19 nt, Human
cggcggggcugggcucuca

SEQ ID NO: 862026 - RNA, 22 nt, Human
cucagcgcggggcggcccuagc

SEQ ID NO: 862027 - RNA, 21 nt, Human
gcaggaagugcuuggcguccc

SEQ ID NO: 862028 - RNA, 18 nt, Human
gcgcagccacccagcucc

SEQ ID NO: 862029 - RNA, 21 nt, Human
gcggcaggaagugcuuggcgu

SEQ ID NO: 862030 - RNA, 24 nt, Human
gcgggcagcggcggggcugggcuc

SEQ ID NO: 862031 - RNA, 23 nt, Human
gcgggcgggcagcggcggggcug

SEQ ID NO: 862032 - RNA, 19 nt, Human
ggcagcggcggggcugggc

SEQ ID NO: 862033 - RNA, 23 nt, Human
ggcccgguccggccugggcagcu

SEQ ID NO: 862034 - RNA, 24 nt, Human
guuuguauuaguaacgcaugcaag

SEQ ID NO: 862035 - RNA, 20 nt, Human
ucucaggcaacaguagcagu

SEQ ID NO: 862036 - RNA, 22 nt, Human
ucucaggcaacaguagcaguuc

SEQ ID NO: 862037 - RNA, 23 nt, Human
ucugcgggcgcccggcccggucc

SEQ ID NO: 862038 - RNA, 24 nt, Human
ugggcucucagcgcggggcggccc

SEQ ID NO: 862039 - RNA, 23 nt, Human
uguauuaguaacgcaugcaagca

SEQ ID NO: 862040 - RNA, 24 nt, Human
acaccagaccaccacacacgaggc

SEQ ID NO: 862041 - RNA, 20 nt, Human
acacugacacucagcagaau

SEQ ID NO: 862042 - RNA, 21 nt, Human
acccagagcccccaagcccac

SEQ ID NO: 862043 - RNA, 18 nt, Human
acccggaccggcggaauc

SEQ ID NO: 862044 - RNA, 21 nt, Human
accuagcuggggaacagauuc

SEQ ID NO: 862045 - RNA, 21 nt, Human
agaacacuuuauuuguaaagg

SEQ ID NO: 862046 - RNA, 19 nt, Human
agacaggaaaucacaacaa

SEQ ID NO: 862047 - RNA, 22 nt, Human
auuuguaaaggagcaaagaccg

SEQ ID NO: 862048 - RNA, 24 nt, Human
caaggcaaacgagacaggaaauca

SEQ ID NO: 862049 - RNA, 27 nt, Human
cacaaaaucgggacgagaagccuuuaa

SEQ ID NO: 862050 - RNA, 18 nt, Human
cacccagagcccccaagc

SEQ ID NO: 862051 - RNA, 19 nt, Human
cacccagagcccccaagcc

SEQ ID NO: 862052 - RNA, 20 nt, Human
cacccagagcccccaagccc

SEQ ID NO: 862053 - RNA, 18 nt, Human
caccguccacaccagacc

SEQ ID NO: 862054 - RNA, 22 nt, Human
cauggugguggcagacacccuu

SEQ ID NO: 862055 - RNA, 24 nt, Human
ccagagcccccaagcccacggcag

SEQ ID NO: 862056 - RNA, 22 nt, Human
ccagccccaccccugacugcgc

SEQ ID NO: 862057 - RNA, 22 nt, Human
cccaaaucgaggcccgcgggac

SEQ ID NO: 862058 - RNA, 20 nt, Human
cccagagcccccaagcccac

SEQ ID NO: 862059 - RNA, 21 nt, Human
cccagccccaccccugacugc

SEQ ID NO: 862060 - RNA, 19 nt, Human
ccugacugcgcuggguagg

SEQ ID NO: 862061 - RNA, 19 nt, Human
cgagacaggaaaucacaac

SEQ ID NO: 862062 - RNA, 23 nt, Human
cgcucugggucccagccccaccc

SEQ ID NO: 862063 - RNA, 18 nt, Human
cggcggaaucacacccag

SEQ ID NO: 862064 - RNA, 21 nt, Human
cggucaaggcaaacgagacag

SEQ ID NO: 862065 - RNA, 21 nt, Human
cucugggucccagccccaccc

SEQ ID NO: 862066 - RNA, 19 nt, Human
cugagauacggcugagcac

SEQ ID NO: 862067 - RNA, 24 nt, Human
cugggucccagccccaccccugac

SEQ ID NO: 862068 - RNA, 23 nt, Human
gagacaggaaaucacaacaauca

SEQ ID NO: 862069 - RNA, 19 nt, Human
gcagaaccaggagcgaccc

SEQ ID NO: 862070 - RNA, 20 nt, Human
gcuccggcaccuguccuccu

SEQ ID NO: 862071 - RNA, 21 nt, Human
ggaaucacacccagagccccc

SEQ ID NO: 862072 - RNA, 22 nt, Human
gggacaccuggacucggcagcc

SEQ ID NO: 862073 - RNA, 18 nt, Human
ucaggcauggugguggca

SEQ ID NO: 862074 - RNA, 23 nt, Human
uccaccguccacaccagaccacc

SEQ ID NO: 862075 - RNA, 19 nt, Human
ucccagccccaccccugac

SEQ ID NO: 862076 - RNA, 18 nt, Human
uccccaccuagcugggga

SEQ ID NO: 862077 - RNA, 19 nt, Human
uccggcaccuguccuccug

SEQ ID NO: 862078 - RNA, 23 nt, Human
ucuacagacagcccaccugugaa

SEQ ID NO: 862079 - RNA, 19 nt, Human
ugaauuuuccccaccuagc

SEQ ID NO: 862080 - RNA, 21 nt, Human
ugggucaggcauggugguggc

SEQ ID NO: 862081 - RNA, 20 nt, Human
ugggucccagccccaccccu

SEQ ID NO: 862082 - RNA, 19 nt, Human
uguaaaggagcaaagaccg

SEQ ID NO: 862083 - RNA, 25 nt, Human
uguaaaggagcaaagaccgucgacc

SEQ ID NO: 862084 - RNA, 19 nt, Human
uugaaacagaacacuuuau

SEQ ID NO: 862085 - RNA, 21 nt, Human
uuggcuaucacaaaaucggga

SEQ ID NO: 862086 - RNA, 20 nt, Human
uuuuugaaacagaacacuuu

SEQ ID NO: 862087 - RNA, 21 nt, Human
uuuuuuuuugaaacagaacac

SEQ ID NO: 862088 - RNA, 18 nt, Human
uuuuuuuuuuuuuuuuug

SEQ ID NO: 862089 - RNA, 24 nt, Human
aaagcaccuacuacaugaaggcac

SEQ ID NO: 862090 - RNA, 21 nt, Human
aagaggucagucuuuuguacc

SEQ ID NO: 862091 - RNA, 21 nt, Human
aagcaccuacuacaugaaggc

SEQ ID NO: 862092 - RNA, 18 nt, Human
acccuggaaauugccuga

SEQ ID NO: 862093 - RNA, 30 nt, Human
acucugaaaaccuucacucuagagaagagg

SEQ ID NO: 862094 - RNA, 19 nt, Human
agaaugcugugccaacccc

SEQ ID NO: 862095 - RNA, 20 nt, Human
agcaaguucacagguaaugc

SEQ ID NO: 862096 - RNA, 21 nt, Human
aggaaaaaaacugaguaagaa

SEQ ID NO: 862097 - RNA, 19 nt, Human
agguagcaauucuuuucua

SEQ ID NO: 862098 - RNA, 20 nt, Human
agugagggaagcagcguagg

SEQ ID NO: 862099 - RNA, 21 nt, Human
agugagggaagcagcguagga

SEQ ID NO: 862100 - RNA, 22 nt, Human
augaaggcacaugccagggaca

SEQ ID NO: 862101 - RNA, 20 nt, Human
cagaacaucuagauucacag

SEQ ID NO: 862102 - RNA, 23 nt, Human
cauccugcccacuggccgcucca

SEQ ID NO: 862103 - RNA, 23 nt, Human
ccaacccccagagauucugauuc

SEQ ID NO: 862104 - RNA, 22 nt, Human
cccaagcuggggcuauguagac

SEQ ID NO: 862105 - RNA, 25 nt, Human
cccccagagauucugauucaguagg

SEQ ID NO: 862106 - RNA, 19 nt, Human
ccgcuccacugcgcagccc

SEQ ID NO: 862107 - RNA, 18 nt, Human
ccuggaaauugccugaug

SEQ ID NO: 862108 - RNA, 22 nt, Human
ccugggccggggggacuggggc

SEQ ID NO: 862109 - RNA, 25 nt, Human
cuacuacaugaaggcacaugccagg

SEQ ID NO: 862110 - RNA, 20 nt, Human
gagugcucuuaggagaaggg

SEQ ID NO: 862111 - RNA, 23 nt, Human
gauacaugaggcuuugaaaagga

SEQ ID NO: 862112 - RNA, 20 nt, Human
gcaagacucuagaccaaccc

SEQ ID NO: 862113 - RNA, 18 nt, Human
gccgccugggccgggggg

SEQ ID NO: 862114 - RNA, 18 nt, Human
gggcagaggggucuggcu

SEQ ID NO: 862115 - RNA, 23 nt, Human
gguggggccugaggauuuguauu

SEQ ID NO: 862116 - RNA, 26 nt, Human
guaaaucagaaugcugugccaacccc

SEQ ID NO: 862117 - RNA, 19 nt, Human
guaggacagaggaaaaaaa

SEQ ID NO: 862118 - RNA, 19 nt, Human
gucugggagauacaugagg

SEQ ID NO: 862119 - RNA, 19 nt, Human
uaaugcugaugaugcacuc

SEQ ID NO: 862120 - RNA, 20 nt, Human
uacuacaugaaggcacaugc

SEQ ID NO: 862121 - RNA, 21 nt, Human
uacuacaugaaggcacaugcc

SEQ ID NO: 862122 - RNA, 23 nt, Human
uagcacccacagcaucucgcaaa

SEQ ID NO: 862123 - RNA, 23 nt, Human
uauguuccuguugucaucucaca

SEQ ID NO: 862124 - RNA, 24 nt, Human
ucaaaauuagaauacaucaaaauc

SEQ ID NO: 862125 - RNA, 21 nt, Human
ucgucauccugcccacuggcc

SEQ ID NO: 862126 - RNA, 19 nt, Human
ucuagaccaacccuggaaa

SEQ ID NO: 862127 - RNA, 21 nt, Human
ucugaaaaccuucacucuaga

SEQ ID NO: 862128 - RNA, 18 nt, Human
ugaaaaggaaguagcugc

SEQ ID NO: 862129 - RNA, 24 nt, Human
ugaaaaggaaguagcugcaaguug

SEQ ID NO: 862130 - RNA, 20 nt, Human
ugaaauuaaaagaaaauggc

SEQ ID NO: 862131 - RNA, 22 nt, Human
ugaggcuuugaaaaggaaguag

SEQ ID NO: 862132 - RNA, 21 nt, Human
ugaguaagaaugugcucucag

SEQ ID NO: 862133 - RNA, 20 nt, Human
ugauguaagaggucagucuu

SEQ ID NO: 862134 - RNA, 20 nt, Human
ugauuccaugaggagcucug

SEQ ID NO: 862135 - RNA, 25 nt, Human
uggcaagacucuagaccaacccugg

SEQ ID NO: 862136 - RNA, 25 nt, Human
uggggcagaggggucuggcucguca

SEQ ID NO: 862137 - RNA, 24 nt, Human
uucauaacagucucugcuccugag

SEQ ID NO: 862138 - RNA, 19 nt, Human
uucucgugcaagugguuua

SEQ ID NO: 862139 - RNA, 21 nt, Human
uuguugaaacauucuuacuug

SEQ ID NO: 862140 - RNA, 19 nt, Human
uuuuuuuucucgugcaagu

SEQ ID NO: 862141 - RNA, 20 nt, Human
uuuuuuuuuuuuuuucucgu

SEQ ID NO: 862142 - RNA, 24 nt, Human
uuuuuuuuuuuuuuuuuucucggg

SEQ ID NO: 862143 - RNA, 23 nt, Human
aauauguaugcaacagaaacuaa

SEQ ID NO: 862144 - RNA, 26 nt, Human
aaucaaaaguauuuuccaaaguugaa

SEQ ID NO: 862145 - RNA, 18 nt, Human
augcauauauguaaacuu

SEQ ID NO: 862146 - RNA, 24 nt, Human
cgcauguguguauuucaguauccu

SEQ ID NO: 862147 - RNA, 21 nt, Human
cuuuaugaauguauaugcauc

SEQ ID NO: 862148 - RNA, 24 nt, Human
gcauguguguauuucaguauccug

SEQ ID NO: 862149 - RNA, 22 nt, Human
uaaaugcauauauguaaacuug

SEQ ID NO: 862150 - RNA, 24 nt, Human
uaaaugcauauauguaaacuugug

SEQ ID NO: 862151 - RNA, 18 nt, Human
ucauguguacgcaugugu

SEQ ID NO: 862152 - RNA, 25 nt, Human
uccaugcuacauacauggaaguuaa

SEQ ID NO: 862153 - RNA, 23 nt, Human
ugaacauuauuaaaugaaaguaa

SEQ ID NO: 862154 - RNA, 18 nt, Human
uguguacgcaugugugua

SEQ ID NO: 862155 - RNA, 18 nt, Human
uuuuuuuuuuuuuuuuug

SEQ ID NO: 862156 - RNA, 19 nt, Human
uuuuuuuuuuuuuuuuugu

SEQ ID NO: 862157 - RNA, 23 nt, Human
aaagcugauucgacuaagcccca

SEQ ID NO: 862158 - RNA, 22 nt, Human
agccccagaagaaaacagccag

SEQ ID NO: 862159 - RNA, 19 nt, Human
agcugauucgacuaagccc

SEQ ID NO: 862160 - RNA, 19 nt, Human
cauuacaaagcugauucga

SEQ ID NO: 862161 - RNA, 21 nt, Human
gacuaagccccagaagaaaac

SEQ ID NO: 862162 - RNA, 19 nt, Human
gcuuucuggagccuccucu

SEQ ID NO: 862163 - RNA, 25 nt, Human
uaagccccagaagaaaacagccagg

SEQ ID NO: 862164 - RNA, 26 nt, Human
uuuuuugcuguuaugauuuuauugcc

SEQ ID NO: 862165 - RNA, 21 nt, Human
uuuuuuuuuuuuuuuugcugu

SEQ ID NO: 862166 - RNA, 18 nt, Human
uuuuuuuuuuuuuuuuug

SEQ ID NO: 862167 - RNA, 20 nt, Human
uuuuuuuuuuuuuuuuugcu

SEQ ID NO: 862168 - RNA, 30 nt, Human
aauauauacauauauacagacauauggcau

SEQ ID NO: 862169 - RNA, 23 nt, Human
accauccccugcaggacaggccu

SEQ ID NO: 862170 - RNA, 19 nt, Human
agaauggcaggggccaccc

SEQ ID NO: 862171 - RNA, 22 nt, Human
agcagacaaggagcugaccuca

SEQ ID NO: 862172 - RNA, 19 nt, Human
agcccccaucccugcccaa

SEQ ID NO: 862173 - RNA, 19 nt, Human
augugcagacacaggcacg

SEQ ID NO: 862174 - RNA, 21 nt, Human
caagccuagcccccaucccug

SEQ ID NO: 862175 - RNA, 21 nt, Human
cagacaaggagcugaccucau

SEQ ID NO: 862176 - RNA, 21 nt, Human
caucccugcccaagaccaucc

SEQ ID NO: 862177 - RNA, 22 nt, Human
cauucagaauggcaggggccac

SEQ ID NO: 862178 - RNA, 20 nt, Human
ccccaucccugcccaagaca

SEQ ID NO: 862179 - RNA, 22 nt, Human
ccuagcccccaucccugcccaa

SEQ ID NO: 862180 - RNA, 21 nt, Human
ccugcccaagaccauccccug

SEQ ID NO: 862181 - RNA, 22 nt, Human
ccugcccaagaccauccccugc

SEQ ID NO: 862182 - RNA, 18 nt, Human
gaugggcgaguggugggg

SEQ ID NO: 862183 - RNA, 20 nt, Human
ggccacccagcagacaagga

SEQ ID NO: 862184 - RNA, 20 nt, Human
ggggguuucagacuugaugg

SEQ ID NO: 862185 - RNA, 22 nt, Human
gugcagacacaggcacgcccag

SEQ ID NO: 862186 - RNA, 24 nt, Human
guucaaaauauauacauauauaca

SEQ ID NO: 862187 - RNA, 20 nt, Human
uauacauauauacagacaua

SEQ ID NO: 862188 - RNA, 28 nt, Human
uauauacauauauacagacauauguaca

SEQ ID NO: 862189 - RNA, 20 nt, Human
uauguacauccacaugugca

SEQ ID NO: 862190 - RNA, 23 nt, Human
ucaaaauauauacauauauacag

SEQ ID NO: 862191 - RNA, 21 nt, Human
ucagaauggcaggggccaccc

SEQ ID NO: 862192 - RNA, 21 nt, Human
uccacaugugcagacacaggc

SEQ ID NO: 862193 - RNA, 22 nt, Human
uccccugcaggacaggccugau

SEQ ID NO: 862194 - RNA, 18 nt, Human
ucccugcccaagaccauc

SEQ ID NO: 862195 - RNA, 19 nt, Human
ucccugcccaagaccaucc

SEQ ID NO: 862196 - RNA, 23 nt, Human
ugauggcaagccuagcccccucu

SEQ ID NO: 862197 - RNA, 24 nt, Human
uggcaagccuagcccccaucccug

SEQ ID NO: 862198 - RNA, 19 nt, Human
uggcaggggccacccagca

SEQ ID NO: 862199 - RNA, 21 nt, Human
uggggguuucagacuugaugg

SEQ ID NO: 862200 - RNA, 19 nt, Human
uguugcugguucugccucc

SEQ ID NO: 862201 - RNA, 20 nt, Human
uucagaauggcaggggccac

SEQ ID NO: 862202 - RNA, 19 nt, Human
uuguugcugguucugccuc

SEQ ID NO: 862203 - RNA, 18 nt, Human
uuuuuuuuuuuuuuuucg

SEQ ID NO: 862204 - RNA, 19 nt, Human
aaaaugccccaccaucuuc

SEQ ID NO: 862205 - RNA, 19 nt, Human
aaacaaaaugcaaacuaca

SEQ ID NO: 862206 - RNA, 24 nt, Human
aaaccaaacuaaacaaaaugcaaa

SEQ ID NO: 862207 - RNA, 21 nt, Human
aacacauuuuucucugccacc

SEQ ID NO: 862208 - RNA, 25 nt, Human
aauagccacauaugugaaaccuuuu

SEQ ID NO: 862209 - RNA, 19 nt, Human
aauauacccacuuccaaaa

SEQ ID NO: 862210 - RNA, 19 nt, Human
agaaagaaaacaguagagg

SEQ ID NO: 862211 - RNA, 19 nt, Human
agaaagaaaacaguagagg

SEQ ID NO: 862212 - RNA, 24 nt, Human
agaaagaaaacaguagaggaaugu

SEQ ID NO: 862213 - RNA, 21 nt, Human
auaaccucaaauauacccacu

SEQ ID NO: 862214 - RNA, 20 nt, Human
auccaaauuaaaaaugaagc

SEQ ID NO: 862215 - RNA, 23 nt, Human
caaaacaugauuguaauauuaca

SEQ ID NO: 862216 - RNA, 19 nt, Human
caaaaugcaaacuacagug

SEQ ID NO: 862217 - RNA, 24 nt, Human
caaauauacccacuuccaaaacua

SEQ ID NO: 862218 - RNA, 21 nt, Human
caaaucaaaggucucuagcag

SEQ ID NO: 862219 - RNA, 31 nt, Human
caauaugauuucucucccuuucagaagccuu

SEQ ID NO: 862220 - RNA, 20 nt, Human
caaugcaguuugggaaaugg

SEQ ID NO: 862221 - RNA, 21 nt, Human
caaugcaguuugggaaaugga

SEQ ID NO: 862222 - RNA, 19 nt, Human
caccaacacugauuuccaa

SEQ ID NO: 862223 - RNA, 20 nt, Human
caccaucuucuucacugcau

SEQ ID NO: 862224 - RNA, 18 nt, Human
cacccuuucccccacacu

SEQ ID NO: 862225 - RNA, 20 nt, Human
cacccuuucccccacacuuc

SEQ ID NO: 862226 - RNA, 21 nt, Human
caccgggccccgggcuauccc

SEQ ID NO: 862227 - RNA, 20 nt, Human
cacugcauuacagcuuagca

SEQ ID NO: 862228 - RNA, 24 nt, Human
cacugcauuacagcuuagcaaggc

SEQ ID NO: 862229 - RNA, 20 nt, Human
cacuucagaaaaaccaccaa

SEQ ID NO: 862230 - RNA, 30 nt, Human
cagaaaaaccaccaauuccuuccuagaggg

SEQ ID NO: 862231 - RNA, 21 nt, Human
cagaaacauccaaauuaaaaa

SEQ ID NO: 862232 - RNA, 19 nt, Human
cagaaagaaaacaguagag

SEQ ID NO: 862233 - RNA, 25 nt, Human
cagcaagaaaccacccuuuccccca

SEQ ID NO: 862234 - RNA, 18 nt, Human
caguagaggaauguggca

SEQ ID NO: 862235 - RNA, 21 nt, Human
caguaucagaaagaaaacagu

SEQ ID NO: 862236 - RNA, 25 nt, Human
caguugacaaacaugcaaaauaacu

SEQ ID NO: 862237 - RNA, 22 nt, Human
cauccaaauuaaaaaugaagca

SEQ ID NO: 862238 - RNA, 20 nt, Human
cauccagacauccccgguuc

SEQ ID NO: 862239 - RNA, 18 nt, Human
cgggccccgggcuauccc

SEQ ID NO: 862240 - RNA, 23 nt, Human
cuaaaaccaaacuaaacaaaaug

SEQ ID NO: 862241 - RNA, 21 nt, Human
cuagcauguccaguaucagaa

SEQ ID NO: 862242 - RNA, 22 nt, Human
gaaaacaguagaggaauguggc

SEQ ID NO: 862243 - RNA, 21 nt, Human
ggacagaugcucacgugcucu

SEQ ID NO: 862244 - RNA, 22 nt, Human
ggacagaugcucacgugcucuc

SEQ ID NO: 862245 - RNA, 21 nt, Human
gugggacaaagaacugacucu

SEQ ID NO: 862246 - RNA, 22 nt, Human
uaaaauuccaggagacauucuu

SEQ ID NO: 862247 - RNA, 28 nt, Human
uaacuaaaugagauauaaccucaaauau

SEQ ID NO: 862248 - RNA, 26 nt, Human
uaauuuccaaaucaaaggucucuagc

SEQ ID NO: 862249 - RNA, 24 nt, Human
uacugaacacuaaagauaaagagg

SEQ ID NO: 862250 - RNA, 24 nt, Human
uacuggccaugaaauccagcaaga

SEQ ID NO: 862251 - RNA, 20 nt, Human
uagaaaggacagaugcucac

SEQ ID NO: 862252 - RNA, 21 nt, Human
uagccacauaugugaaaccuu

SEQ ID NO: 862253 - RNA, 18 nt, Human
uaguagagcuaaaaccaa

SEQ ID NO: 862254 - RNA, 18 nt, Human
uauccccgcugcuacuga

SEQ ID NO: 862255 - RNA, 22 nt, Human
ucaaaggucucuagcagaaaca

SEQ ID NO: 862256 - RNA, 19 nt, Human
ucacugcauuacagcuuag

SEQ ID NO: 862257 - RNA, 20 nt, Human
ucacugcauuacagcuuagc

SEQ ID NO: 862258 - RNA, 18 nt, Human
ucagaacaucuaacccug

SEQ ID NO: 862259 - RNA, 22 nt, Human
uccaaguuacuagcauguccag

SEQ ID NO: 862260 - RNA, 21 nt, Human
uccaguaucagaaagaaaaca

SEQ ID NO: 862261 - RNA, 18 nt, Human
ucuagcagaaacauccaa

SEQ ID NO: 862262 - RNA, 18 nt, Human
ugaaaaacauaauggccu

SEQ ID NO: 862263 - RNA, 20 nt, Human
ugaaaccuuaguagagcuaa

SEQ ID NO: 862264 - RNA, 20 nt, Human
ugaaugaggacauuaauggg

SEQ ID NO: 862265 - RNA, 24 nt, Human
ugaaugaggacauuaaugggaaug

SEQ ID NO: 862266 - RNA, 23 nt, Human
ugacaaacaugcaaaauaacuaa

SEQ ID NO: 862267 - RNA, 22 nt, Human
ugccccaccaucuucuucacug

SEQ ID NO: 862268 - RNA, 18 nt, Human
uggcuucaagcaaccucc

SEQ ID NO: 862269 - RNA, 19 nt, Human
uggcuucaagcaaccucca

SEQ ID NO: 862270 - RNA, 21 nt, Human
uugaaugaggacauuaauggg

SEQ ID NO: 862271 - RNA, 21 nt, Human
uuugggaaaugggccaugaaa

SEQ ID NO: 862272 - RNA, 24 nt, Human
uuuuuuuuuuuaguguuaaaaugu

SEQ ID NO: 862273 - RNA, 19 nt, Human
aaagcucaucgaggcacga

SEQ ID NO: 862274 - RNA, 21 nt, Human
aagaaagagaauggaggaaaa

SEQ ID NO: 862275 - RNA, 22 nt, Human
acugcagcugcgcggaccgcac

SEQ ID NO: 862276 - RNA, 22 nt, Human
aggcacgaaggagaugaaccgc

SEQ ID NO: 862277 - RNA, 21 nt, Human
aggccggaagcgggcugcgaa

SEQ ID NO: 862278 - RNA, 19 nt, Human
aggugaagaaagagaaugg

SEQ ID NO: 862279 - RNA, 19 nt, Human
ccagcucgugcaggcaucg

SEQ ID NO: 862280 - RNA, 19 nt, Human
ccuuucauuuugaccaucu

SEQ ID NO: 862281 - RNA, 20 nt, Human
cgaagcaccgcgccugcgcc

SEQ ID NO: 862282 - RNA, 20 nt, Human
cgcccccuuacugcagcugc

SEQ ID NO: 862283 - RNA, 21 nt, Human
cucaagaggugaagaaagaga

SEQ ID NO: 862284 - RNA, 23 nt, Human
ggugaagaaagagaauggaggaa

SEQ ID NO: 862285 - RNA, 20 nt, Human
gugaggccggaagcgggcug

SEQ ID NO: 862286 - RNA, 19 nt, Human
ucagcuacagauaggcuaa

SEQ ID NO: 862287 - RNA, 19 nt, Human
ucgcaggugugaugcuugg

SEQ ID NO: 862288 - RNA, 19 nt, Human
ugaccaucucauagccacu

SEQ ID NO: 862289 - RNA, 23 nt, Human
ugaggccggaagcgggcugcgaa

SEQ ID NO: 862290 - RNA, 18 nt, Human
ugcuuggcaggugugagg

SEQ ID NO: 862291 - RNA, 19 nt, Human
uggcaggugugaugcuugg

SEQ ID NO: 862292 - RNA, 19 nt, Human
uggcaggugugaugcuugg

SEQ ID NO: 862293 - RNA, 19 nt, Human
uggcaggugugaugcuugg

SEQ ID NO: 862294 - RNA, 24 nt, Human
ugugaugcuuggcaggugugaggc

SEQ ID NO: 862295 - RNA, 22 nt, Human
uuuugaccaucucauagccacu

SEQ ID NO: 862296 - RNA, 18 nt, Human
uuuuuuuuuuuuuuuuug

SEQ ID NO: 862297 - RNA, 20 nt, Human
uuuuuuuuuuuuuuuuuggu

SEQ ID NO: 862298 - RNA, 23 nt, Human
acucuuauugcccaggcuggagu

SEQ ID NO: 862299 - RNA, 24 nt, Human
acucuuauugcccaggcuggagug

SEQ ID NO: 862300 - RNA, 19 nt, Human
agaggcgaccuagagcucc

SEQ ID NO: 862301 - RNA, 18 nt, Human
agccuccugaguagcugg

SEQ ID NO: 862302 - RNA, 19 nt, Human
agcgaagaggcgaccuaga

SEQ ID NO: 862303 - RNA, 20 nt, Human
aggacacagggccacagagg

SEQ ID NO: 862304 - RNA, 25 nt, Human
aggagcagaggacacagaguagcga

SEQ ID NO: 862305 - RNA, 24 nt, Human
aggugauccucccaccuuggccuc

SEQ ID NO: 862306 - RNA, 21 nt, Human
aguagcugggauuacaggcau

SEQ ID NO: 862307 - RNA, 23 nt, Human
aguagcugggauuacaggcaugu

SEQ ID NO: 862308 - RNA, 23 nt, Human
aguagcugggauuacaggcaugu

SEQ ID NO: 862309 - RNA, 20 nt, Human
auccucccaccuuggccucc

SEQ ID NO: 862310 - RNA, 20 nt, Human
caccacaaccucugccucca

SEQ ID NO: 862311 - RNA, 20 nt, Human
caccacaaccucugccucca

SEQ ID NO: 862312 - RNA, 22 nt, Human
caguagagacuggguuucuccg

SEQ ID NO: 862313 - RNA, 21 nt, Human
ccaauaccuacaggacacagg

SEQ ID NO: 862314 - RNA, 24 nt, Human
ccacaaccucugccuccaggguuc

SEQ ID NO: 862315 - RNA, 18 nt, Human
cccaggcuggagugcaau

SEQ ID NO: 862316 - RNA, 19 nt, Human
cccaggcuggagugcaaug

SEQ ID NO: 862317 - RNA, 26 nt, Human
ccucccaccuuggccucccaaagugc

SEQ ID NO: 862318 - RNA, 23 nt, Human
ccugaguagcugggauuacaggc

SEQ ID NO: 862319 - RNA, 24 nt, Human
ccugaguagcugggauuacaggca

SEQ ID NO: 862320 - RNA, 21 nt, Human
cuacaggacacagggccacag

SEQ ID NO: 862321 - RNA, 19 nt, Human
cuaggcuucuaaggggucc

SEQ ID NO: 862322 - RNA, 19 nt, Human
cucuuauugcccaggcugg

SEQ ID NO: 862323 - RNA, 23 nt, Human
cugaguagcugggauuacaggca

SEQ ID NO: 862324 - RNA, 24 nt, Human
cugaguagcugggauuacaggcau

SEQ ID NO: 862325 - RNA, 20 nt, Human
cugccuccaggguucaagcc

SEQ ID NO: 862326 - RNA, 24 nt, Human
cuuauugcccaggcuggagugcaa

SEQ ID NO: 862327 - RNA, 24 nt, Human
gacaucaggugauccucccaccuu

SEQ ID NO: 862328 - RNA, 22 nt, Human
gaguagcugggauuacaggcau

SEQ ID NO: 862329 - RNA, 18 nt, Human
gauuacaggcaugugcca

SEQ ID NO: 862330 - RNA, 22 nt, Human
gauuacaggcaugugccaccau

SEQ ID NO: 862331 - RNA, 24 nt, Human
ggauuacaggcaugugccaccaug

SEQ ID NO: 862332 - RNA, 19 nt, Human
ggccacagagggugggccu

SEQ ID NO: 862333 - RNA, 24 nt, Human
ggguucaagccuccugaguagcug

SEQ ID NO: 862334 - RNA, 18 nt, Human
guagcugggauuacaggc

SEQ ID NO: 862335 - RNA, 20 nt, Human
guagcugggauuacaggcau

SEQ ID NO: 862336 - RNA, 23 nt, Human
uacaaugcuuccaaaaaucugcu

SEQ ID NO: 862337 - RNA, 19 nt, Human
uauugcccaggcuggagug

SEQ ID NO: 862338 - RNA, 20 nt, Human
uauugcccaggcuggagugc

SEQ ID NO: 862339 - RNA, 19 nt, Human
ucaagccuccugaguagcu

SEQ ID NO: 862340 - RNA, 25 nt, Human
ucaccacaaccucugccuccagggu

SEQ ID NO: 862341 - RNA, 27 nt, Human
ucaccacaaccucugccuccaggguuc

SEQ ID NO: 862342 - RNA, 22 nt, Human
ucacucuuauugcccaggcugg

SEQ ID NO: 862343 - RNA, 23 nt, Human
ucacucuuauugcccaggcugga

SEQ ID NO: 862344 - RNA, 24 nt, Human
ucaguagagacuggguuucuccgu

SEQ ID NO: 862345 - RNA, 24 nt, Human
uccugaguagcugggauuacaggc

SEQ ID NO: 862346 - RNA, 22 nt, Human
ucugaucucaaacucccgacau

SEQ ID NO: 862347 - RNA, 22 nt, Human
ugaacaaguauacuuuuaaugu

SEQ ID NO: 862348 - RNA, 18 nt, Human
ugcccaggcuggagugca

SEQ ID NO: 862349 - RNA, 21 nt, Human
ugcccaggcuggagugcaaug

SEQ ID NO: 862350 - RNA, 21 nt, Human
ugggauuacaggcaugugcca

SEQ ID NO: 862351 - RNA, 22 nt, Human
ugggauuacaggcaugugccac

SEQ ID NO: 862352 - RNA, 24 nt, Human
ugggauuacaggcaugugccacca

SEQ ID NO: 862353 - RNA, 20 nt, Human
uguggaucucccaauaccua

SEQ ID NO: 862354 - RNA, 24 nt, Human
uucacucuuauugcccaggcugga

SEQ ID NO: 862355 - RNA, 18 nt, Human
uuggccucccaaagugcu

SEQ ID NO: 862356 - RNA, 24 nt, Human
uuuuuuuuuugaacaaguauacuu

SEQ ID NO: 862357 - RNA, 27 nt, Human
uuuuuuuuuuuuuuuuuuuuuuugggg

SEQ ID NO: 862358 - RNA, 25 nt, Human
aaaaagaucaguauaaauaugaaua

SEQ ID NO: 862359 - RNA, 24 nt, Human
aaagaucaguauaaauaugaauaa

SEQ ID NO: 862360 - RNA, 20 nt, Human
aaauggaauaacaccaaaua

SEQ ID NO: 862361 - RNA, 26 nt, Human
aagaaaccagaaucaagcagugggca

SEQ ID NO: 862362 - RNA, 23 nt, Human
aaggaaaagacugugaacauaaa

SEQ ID NO: 862363 - RNA, 20 nt, Human
acacauuagguacuauuacu

SEQ ID NO: 862364 - RNA, 21 nt, Human
acacugaacagauacaggacu

SEQ ID NO: 862365 - RNA, 19 nt, Human
acagauacaggacuaaagu

SEQ ID NO: 862366 - RNA, 18 nt, Human
acauguagagagauuaag

SEQ ID NO: 862367 - RNA, 25 nt, Human
acucaaugcuuauaacaacccuaca

SEQ ID NO: 862368 - RNA, 20 nt, Human
aggaaauguuagcuaugagc

SEQ ID NO: 862369 - RNA, 22 nt, Human
augagccuaaaggaaaagacug

SEQ ID NO: 862370 - RNA, 25 nt, Human
caacaaauacuggcuauuucuagaa

SEQ ID NO: 862371 - RNA, 21 nt, Human
caacccuacacauuagguacu

SEQ ID NO: 862372 - RNA, 21 nt, Human
caacuaguaaaggaacuaaca

SEQ ID NO: 862373 - RNA, 18 nt, Human
cacagcauuaauccaggg

SEQ ID NO: 862374 - RNA, 20 nt, Human
cacugcuggauggaaaaaga

SEQ ID NO: 862375 - RNA, 20 nt, Human
cagaaucaagcaaggggcca

SEQ ID NO: 862376 - RNA, 23 nt, Human
cauguagagagauuaagugacuu

SEQ ID NO: 862377 - RNA, 20 nt, Human
cauuacaggaaucacuucuc

SEQ ID NO: 862378 - RNA, 18 nt, Human
ccaauaucaucaucauug

SEQ ID NO: 862379 - RNA, 20 nt, Human
cugaacagauacaggacuaa

SEQ ID NO: 862380 - RNA, 21 nt, Human
gaaaaucuguaacugugaaga

SEQ ID NO: 862381 - RNA, 20 nt, Human
gaaauaccaucauuuuauag

SEQ ID NO: 862382 - RNA, 22 nt, Human
gaaguaaaacaagaaaccagaa

SEQ ID NO: 862383 - RNA, 19 nt, Human
gcaaauggaauaacaccaa

SEQ ID NO: 862384 - RNA, 21 nt, Human
gcaacaguucaaauacguaau

SEQ ID NO: 862385 - RNA, 20 nt, Human
gccuucaugacagcugucac

SEQ ID NO: 862386 - RNA, 23 nt, Human
ggccaugauuucuugucugggau

SEQ ID NO: 862387 - RNA, 22 nt, Human
guuucuuuaaauagcaaaugga

SEQ ID NO: 862388 - RNA, 21 nt, Human
uaaagcaacuaguaaaggaac

SEQ ID NO: 862389 - RNA, 22 nt, Human
uaaaggaacuaacauguaggca

SEQ ID NO: 862390 - RNA, 20 nt, Human
uaacuuaaguucaucuacag

SEQ ID NO: 862391 - RNA, 28 nt, Human
uaaguagacagucuguuauuguaaugac

SEQ ID NO: 862392 - RNA, 22 nt, Human
uaaguucaucuacaguacaacu

SEQ ID NO: 862393 - RNA, 23 nt, Human
uagaagaaauguaaauaggaaau

SEQ ID NO: 862394 - RNA, 22 nt, Human
uagcuuuaaugagaaguaaaac

SEQ ID NO: 862395 - RNA, 24 nt, Human
uaggaaauguuagcuaugagcuaa

SEQ ID NO: 862396 - RNA, 20 nt, Human
uauauuauuuaucuuacuca

SEQ ID NO: 862397 - RNA, 20 nt, Human
uaucaucaucauugaguacu

SEQ ID NO: 862398 - RNA, 18 nt, Human
ucuugucugggauggaac

SEQ ID NO: 862399 - RNA, 18 nt, Human
ucuuucuuccaaaucuug

SEQ ID NO: 862400 - RNA, 23 nt, Human
ugaaaaauaacacaaauuuaagc

SEQ ID NO: 862401 - RNA, 25 nt, Human
ugaaaagaaaaauucuuacuugaga

SEQ ID NO: 862402 - RNA, 21 nt, Human
ugaagaaauugacauguagag

SEQ ID NO: 862403 - RNA, 22 nt, Human
ugagaagaaagccuucaugaca

SEQ ID NO: 862404 - RNA, 23 nt, Human
ugagaaguaaaacaagaaaccag

SEQ ID NO: 862405 - RNA, 25 nt, Human
ugagaaguaaaacaagaaaccagaa

SEQ ID NO: 862406 - RNA, 22 nt, Human
ugucacauuauccaaaugcucc

SEQ ID NO: 862407 - RNA, 25 nt, Human
uguuuuuauguuccaggcacuguuc

SEQ ID NO: 862408 - RNA, 22 nt, Human
uuaaaaguaaaauuucaugaaa

SEQ ID NO: 862409 - RNA, 19 nt, Human
uuuuuuuuuuuuuugccuu

SEQ ID NO: 862410 - RNA, 18 nt, Human
uuuuuuuuuuuuuuuuug

SEQ ID NO: 862411 - RNA, 22 nt, Human
uuuuuuuuuuuuuuuuugccuu

SEQ ID NO: 862412 - RNA, 24 nt, Human
acagauccuagauaaucaguugca

SEQ ID NO: 862413 - RNA, 20 nt, Human
agaaagauuugaaauggaca

SEQ ID NO: 862414 - RNA, 20 nt, Human
aucacaaugcuuguguuuga

SEQ ID NO: 862415 - RNA, 19 nt, Human
cugccugcugcacuuucuc

SEQ ID NO: 862416 - RNA, 18 nt, Human
gaggagaaggaagguaaa

SEQ ID NO: 862417 - RNA, 19 nt, Human
ggaagguaaaacuguuaag

SEQ ID NO: 862418 - RNA, 22 nt, Human
uacacagauccuagauaaucag

SEQ ID NO: 862419 - RNA, 26 nt, Human
ucaguauggcaauggaaagguuucuu

SEQ ID NO: 862420 - RNA, 19 nt, Human
uccuagauaaucaguugca

SEQ ID NO: 862421 - RNA, 20 nt, Human
ugaaauggacaguggaauca

SEQ ID NO: 862422 - RNA, 22 nt, Human
uguugccguuaaaggguuaucu

SEQ ID NO: 862423 - RNA, 19 nt, Human
uucccucaagaagaugauc

SEQ ID NO: 862424 - RNA, 21 nt, Human
uuggcacuaaugauuggcuuu

SEQ ID NO: 862425 - RNA, 23 nt, Human
uuuuuuuuuuuugaaagcagacu

SEQ ID NO: 862426 - RNA, 18 nt, Human
uuuuuuuuuuuuuuuuug

SEQ ID NO: 862427 - RNA, 24 nt, Human
ugaggauagugggcgagaacuuug

SEQ ID NO: 862428 - RNA, 19 nt, Human
uggaagacaaaaagucugc

SEQ ID NO: 862429 - RNA, 18 nt, Human
ugguuuauuugcuuguaa

SEQ ID NO: 862430 - RNA, 19 nt, Human
uucuuaauggggcuggaag

SEQ ID NO: 862431 - RNA, 21 nt, Human
uuugaauguucuuuucaaagg

SEQ ID NO: 862432 - RNA, 24 nt, Human
uuuuuuuuuuuguuugaccaguuc

SEQ ID NO: 862433 - RNA, 18 nt, Human
uuuuuuuuuuuuuuuuug

SEQ ID NO: 862434 - RNA, 22 nt, Human
uuuuuuuuuuuuuuuuuuguuu

SEQ ID NO: 862435 - RNA, 23 nt, Human
agacugcaguuuuccagucuuuu

SEQ ID NO: 862436 - RNA, 23 nt, Human
cauaccaaagacggguggaaaag

SEQ ID NO: 862437 - RNA, 21 nt, Human
ccuugcucgcuccgucccucu

SEQ ID NO: 862438 - RNA, 20 nt, Human
gaacugauuuuauuagccaa

SEQ ID NO: 862439 - RNA, 21 nt, Human
uauuacagacugcaguuuucc

SEQ ID NO: 862440 - RNA, 21 nt, Human
uggaggccuggcccucgugcc

SEQ ID NO: 862441 - RNA, 23 nt, Human
uuggguguaaggccggcuuggag

SEQ ID NO: 862442 - RNA, 22 nt, Human
uuuuuuuuuuuuuuuuucccag

SEQ ID NO: 862443 - RNA, 25 nt, Human
uuuuuuuuuuuuuuuuuucccaguu

SEQ ID NO: 862444 - RNA, 23 nt, Human
uuuuuuuuuuuuuuuuuuuccca

SEQ ID NO: 862445 - RNA, 23 nt, Human
uuuuuuuuuuuuuuuuuuuuccc

SEQ ID NO: 862446 - RNA, 24 nt, Human
uuuuuuuuuuuuuuuuuuuuuccu

SEQ ID NO: 862447 - RNA, 22 nt, Human
aaccccaaguccuaagucagga

SEQ ID NO: 862448 - RNA, 23 nt, Human
aaccccaaguccuaagucaggaa

SEQ ID NO: 862449 - RNA, 21 nt, Human
aauggcaggaaggguggagga

SEQ ID NO: 862450 - RNA, 22 nt, Human
acccaaccccaaguccuaaguc

SEQ ID NO: 862451 - RNA, 23 nt, Human
aggaaggguggaggaccaugcuc

SEQ ID NO: 862452 - RNA, 24 nt, Human
caaguccuaagucaggaauuccuu

SEQ ID NO: 862453 - RNA, 20 nt, Human
ccaaguccuaagucaggaau

SEQ ID NO: 862454 - RNA, 21 nt, Human
ccccugggauguaagcaccuu

SEQ ID NO: 862455 - RNA, 27 nt, Human
ccgccgggcagccagagccgccggccc

SEQ ID NO: 862456 - RNA, 21 nt, Human
gagcccagggcagaauggcag

SEQ ID NO: 862457 - RNA, 18 nt, Human
gaggagcccagggcagaa

SEQ ID NO: 862458 - RNA, 18 nt, Human
uaagcaccuuggacccaa

SEQ ID NO: 862459 - RNA, 19 nt, Human
uuuuuuuuuuucuggaucu

SEQ ID NO: 862460 - RNA, 18 nt, Human
uuuuuuuuuuuuuuucug

SEQ ID NO: 862461 - RNA, 18 nt, Human
uuuuuuuuuuuuuuucug

SEQ ID NO: 862462 - RNA, 19 nt, Human
aaaaaaaacaauacaaaga

SEQ ID NO: 862463 - RNA, 23 nt, Human
aaaaaaaacaauacaaagaguga

SEQ ID NO: 862464 - RNA, 24 nt, Human
aaaaaaaacaauacaaagagugaa

SEQ ID NO: 862465 - RNA, 26 nt, Human
aaaaaacaauacaaagagugaaagga

SEQ ID NO: 862466 - RNA, 19 nt, Human
aaaguacaaaugacuacaa

SEQ ID NO: 862467 - RNA, 20 nt, Human
aaaugcagcacccauuacaa

SEQ ID NO: 862468 - RNA, 26 nt, Human
aaauggauuucucuucuauuaaaaac

SEQ ID NO: 862469 - RNA, 19 nt, Human
aagaaaagcuuucacgggg

SEQ ID NO: 862470 - RNA, 19 nt, Human
aagaacaguaaagcccaac

SEQ ID NO: 862471 - RNA, 21 nt, Human
aagagccucuuugaaaauuaa

SEQ ID NO: 862472 - RNA, 22 nt, Human
aagcaaaagcuguuagagucua

SEQ ID NO: 862473 - RNA, 20 nt, Human
aauacaaagagugaaaggaa

SEQ ID NO: 862474 - RNA, 22 nt, Human
aauguacucaaaguuacauuaa

SEQ ID NO: 862475 - RNA, 20 nt, Human
acaugagucaggaugauuuu

SEQ ID NO: 862476 - RNA, 20 nt, Human
acucaaaguuacauuaagaa

SEQ ID NO: 862477 - RNA, 20 nt, Human
agcaagaacaguaaagccca

SEQ ID NO: 862478 - RNA, 22 nt, Human
agcauuacauaauaaugcuacu

SEQ ID NO: 862479 - RNA, 18 nt, Human
agguuaagaaaauacuga

SEQ ID NO: 862480 - RNA, 20 nt, Human
auaaaauaucuucccucccc

SEQ ID NO: 862481 - RNA, 25 nt, Human
caagaacaguaaagcccaacuaaug

SEQ ID NO: 862482 - RNA, 21 nt, Human
caccaaaguuuucuggaaaua

SEQ ID NO: 862483 - RNA, 22 nt, Human
ccaggcagauguauaugccaua

SEQ ID NO: 862484 - RNA, 23 nt, Human
ccauaccccuacccgaaaucuua

SEQ ID NO: 862485 - RNA, 19 nt, Human
ccccauaccccuacccgaa

SEQ ID NO: 862486 - RNA, 21 nt, Human
ccccauaccccuacccgaaau

SEQ ID NO: 862487 - RNA, 23 nt, Human
cuuuugucucaagaauuaucacc

SEQ ID NO: 862488 - RNA, 22 nt, Human
gguuauguugacaucuagaaga

SEQ ID NO: 862489 - RNA, 19 nt, Human
gguugguuauguugacauc

SEQ ID NO: 862490 - RNA, 18 nt, Human
uaaaauaucuucccuccc

SEQ ID NO: 862491 - RNA, 26 nt, Human
uaaagaacacaacacaugagucagga

SEQ ID NO: 862492 - RNA, 23 nt, Human
uaagaaaagcuuucacgggggua

SEQ ID NO: 862493 - RNA, 18 nt, Human
uaagaaacacuuuaauaa

SEQ ID NO: 862494 - RNA, 22 nt, Human
uaaggaauaaaaaccuuaaaaa

SEQ ID NO: 862495 - RNA, 27 nt, Human
uacaauagcaagaacaguaaagcccaa

SEQ ID NO: 862496 - RNA, 22 nt, Human
uagcaagaacaguaaagcccaa

SEQ ID NO: 862497 - RNA, 21 nt, Human
ucaaaguacaaaugacuacaa

SEQ ID NO: 862498 - RNA, 22 nt, Human
ucacaaagguuaagaaaauacu

SEQ ID NO: 862499 - RNA, 24 nt, Human
ucacaaagguuaagaaaauacuga

SEQ ID NO: 862500 - RNA, 18 nt, Human
uccacauaagaauuaaau

SEQ ID NO: 862501 - RNA, 21 nt, Human
uccccaaggaaccucugaucc

SEQ ID NO: 862502 - RNA, 24 nt, Human
uuaaaaauaaagaacacaacacau

SEQ ID NO: 862503 - RNA, 21 nt, Human
uuagcaagaucuuuucuuuuu

SEQ ID NO: 862504 - RNA, 18 nt, Human
uuuuuuuuuuucucuuug

SEQ ID NO: 862505 - RNA, 20 nt, Human
uuuuuuuuuuuuuuuucucu

SEQ ID NO: 862506 - RNA, 23 nt, Human
uuuuuuuuuuuuuuuuucucuuu

SEQ ID NO: 862507 - RNA, 25 nt, Human
uuuuuuuuuuuuuuuuuuuauuuuu

SEQ ID NO: 862508 - RNA, 22 nt, Human
aaacacagcucuuuaaaacagg

SEQ ID NO: 862509 - RNA, 21 nt, Human
aaccaaacacagagaggccca

SEQ ID NO: 862510 - RNA, 18 nt, Human
aaccuccagacaacgcuc

SEQ ID NO: 862511 - RNA, 18 nt, Human
aagagaccaaugucgagu

SEQ ID NO: 862512 - RNA, 21 nt, Human
aagaggugaagaggagagggg

SEQ ID NO: 862513 - RNA, 20 nt, Human
aagcaaugaaucuauuuuaa

SEQ ID NO: 862514 - RNA, 20 nt, Human
aagcaucuuguuuugacaau

SEQ ID NO: 862515 - RNA, 19 nt, Human
aagcggaaacaggcaagcg

SEQ ID NO: 862516 - RNA, 23 nt, Human
acaaaacacagcucuuuaaaaca

SEQ ID NO: 862517 - RNA, 19 nt, Human
acaauucauccaaacggcc

SEQ ID NO: 862518 - RNA, 18 nt, Human
acacaggcuuggcauugg

SEQ ID NO: 862519 - RNA, 19 nt, Human
acagaacaaugacuucucu

SEQ ID NO: 862520 - RNA, 23 nt, Human
acagcauaauuuucuugccucuc

SEQ ID NO: 862521 - RNA, 20 nt, Human
accaaacacagagaggccca

SEQ ID NO: 862522 - RNA, 19 nt, Human
acccagcaagcaagaaaug

SEQ ID NO: 862523 - RNA, 21 nt, Human
accuccuguggacgagagguu

SEQ ID NO: 862524 - RNA, 18 nt, Human
agaggagacagaccuuag

SEQ ID NO: 862525 - RNA, 20 nt, Human
agaggagacagaccuuagga

SEQ ID NO: 862526 - RNA, 19 nt, Human
agaggagagggggugcugg

SEQ ID NO: 862527 - RNA, 18 nt, Human
agcaaaaaccuaggccuc

SEQ ID NO: 862528 - RNA, 23 nt, Human
aggaagaggugaagaggagggac

SEQ ID NO: 862529 - RNA, 23 nt, Human
aggaagaugcuuuauacucuucu

SEQ ID NO: 862530 - RNA, 21 nt, Human
aggagagggggugcugggggc

SEQ ID NO: 862531 - RNA, 21 nt, Human
aggagaugggagcugaggaca

SEQ ID NO: 862532 - RNA, 24 nt, Human
aggcccuacaucuggaggcuggug

SEQ ID NO: 862533 - RNA, 22 nt, Human
aggcccugcacaguucuccggu

SEQ ID NO: 862534 - RNA, 24 nt, Human
aggcugcaggagguggagaaagug

SEQ ID NO: 862535 - RNA, 26 nt, Human
agggagcgggugccacacaugugcuc

SEQ ID NO: 862536 - RNA, 23 nt, Human
aucuaaaucccagcaaaaaccua

SEQ ID NO: 862537 - RNA, 18 nt, Human
caaaacaaaacacagcuc

SEQ ID NO: 862538 - RNA, 22 nt, Human
caaaacacagcucuuuaaaaca

SEQ ID NO: 862539 - RNA, 18 nt, Human
caacagggaggcugcagg

SEQ ID NO: 862540 - RNA, 20 nt, Human
caaggcugcaggccccuggg

SEQ ID NO: 862541 - RNA, 20 nt, Human
caauucauccaaacggccuu

SEQ ID NO: 862542 - RNA, 23 nt, Human
cacagccagcuggcacacaagag

SEQ ID NO: 862543 - RNA, 26 nt, Human
caccagcagccgucagcccgugcucc

SEQ ID NO: 862544 - RNA, 23 nt, Human
caccaggugcaagagucuagaaa

SEQ ID NO: 862545 - RNA, 21 nt, Human
caccgugccuggggaccagcg

SEQ ID NO: 862546 - RNA, 18 nt, Human
cacgguagaccaaggcug

SEQ ID NO: 862547 - RNA, 24 nt, Human
cagaacaaugacuucucugaaaac

SEQ ID NO: 862548 - RNA, 21 nt, Human
cagcaagcaagaaaugcacuc

SEQ ID NO: 862549 - RNA, 22 nt, Human
cagcaagcaagaaaugcacucu

SEQ ID NO: 862550 - RNA, 21 nt, Human
cagcagccgucagcccgugcu

SEQ ID NO: 862551 - RNA, 22 nt, Human
cagcaggaagaggugaagagga

SEQ ID NO: 862552 - RNA, 20 nt, Human
cagcgcagcagaagggugcc

SEQ ID NO: 862553 - RNA, 22 nt, Human
cagcucuccugggcauccuuga

SEQ ID NO: 862554 - RNA, 20 nt, Human
cagcuggcacacaagaggca

SEQ ID NO: 862555 - RNA, 23 nt, Human
caggccccugggucaccuauccu

SEQ ID NO: 862556 - RNA, 25 nt, Human
caucaggccaaccaugcuaacugca

SEQ ID NO: 862557 - RNA, 21 nt, Human
caucaucgcugccauuaggga

SEQ ID NO: 862558 - RNA, 20 nt, Human
cauugggcuccagccccugg

SEQ ID NO: 862559 - RNA, 20 nt, Human
cauugggcuccagccccugg

SEQ ID NO: 862560 - RNA, 24 nt, Human
ccacacaugugcuccgacacuccu

SEQ ID NO: 862561 - RNA, 21 nt, Human
ccacaggcugugcgccucagc

SEQ ID NO: 862562 - RNA, 18 nt, Human
ccacuggaucaggaccaa

SEQ ID NO: 862563 - RNA, 21 nt, Human
ccagcggcuagcaacacccag

SEQ ID NO: 862564 - RNA, 31 nt, Human
cccaaaauauuccagcauugaguggcaauuu

SEQ ID NO: 862565 - RNA, 19 nt, Human
ccccugugugugggcaggc

SEQ ID NO: 862566 - RNA, 18 nt, Human
cccugggcaaaggccaug

SEQ ID NO: 862567 - RNA, 25 nt, Human
ccuccagacaacgcuccaggaaggc

SEQ ID NO: 862568 - RNA, 29 nt, Human
ccuccuguggacgagagguucccguggac

SEQ ID NO: 862569 - RNA, 27 nt, Human
ccuggaaccuccagacaacgcuccagg

SEQ ID NO: 862570 - RNA, 21 nt, Human
ccuugagcucuugcucggcuc

SEQ ID NO: 862571 - RNA, 19 nt, Human
cgagcagcugcagggucgc

SEQ ID NO: 862572 - RNA, 26 nt, Human
cgcuccaggaaggcuguuucccuggg

SEQ ID NO: 862573 - RNA, 19 nt, Human
cgcugcugcugccauugcu

SEQ ID NO: 862574 - RNA, 18 nt, Human
cgcuggggacaacacagg

SEQ ID NO: 862575 - RNA, 18 nt, Human
cucccgagccacagccag

SEQ ID NO: 862576 - RNA, 24 nt, Human
cucgccgugccuucacccugguca

SEQ ID NO: 862577 - RNA, 18 nt, Human
cucuggaagugugguggg

SEQ ID NO: 862578 - RNA, 23 nt, Human
cugaaaauaucuaaaucccagca

SEQ ID NO: 862579 - RNA, 19 nt, Human
cugaaacggaugcaccaug

SEQ ID NO: 862580 - RNA, 25 nt, Human
cugccccacuucacguccauuaugu

SEQ ID NO: 862581 - RNA, 19 nt, Human
cugcucccgagccacagcc

SEQ ID NO: 862582 - RNA, 24 nt, Human
cuggaaccuccagacaacgcucca

SEQ ID NO: 862583 - RNA, 24 nt, Human
cuuuugguuccuaagacacuuggg

SEQ ID NO: 862584 - RNA, 23 nt, Human
gaaaggcaccagcagccgucagc

SEQ ID NO: 862585 - RNA, 18 nt, Human
gaagaggagagggggugc

SEQ ID NO: 862586 - RNA, 20 nt, Human
gacacaggggcuucucauuu

SEQ ID NO: 862587 - RNA, 23 nt, Human
gacauuucacuuccagacuguga

SEQ ID NO: 862588 - RNA, 21 nt, Human
gaccaaaaaacccuccaucau

SEQ ID NO: 862589 - RNA, 18 nt, Human
gaggcugcccugucccug

SEQ ID NO: 862590 - RNA, 24 nt, Human
gcaccagcagccgucagcccgugc

SEQ ID NO: 862591 - RNA, 19 nt, Human
gcagauacuuccccaugcu

SEQ ID NO: 862592 - RNA, 24 nt, Human
gccacagauguuuguggacauuuc

SEQ ID NO: 862593 - RNA, 21 nt, Human
gcgaaacaaaacaaaacacag

SEQ ID NO: 862594 - RNA, 21 nt, Human
gcuccaggaaggcuguuuccc

SEQ ID NO: 862595 - RNA, 24 nt, Human
gcugaugucuguugaaacccagca

SEQ ID NO: 862596 - RNA, 24 nt, Human
gcuggcacacaagaggcacgucug

SEQ ID NO: 862597 - RNA, 21 nt, Human
gcuuccucguggccagcagga

SEQ ID NO: 862598 - RNA, 22 nt, Human
ggaagaggugaagaggagaggg

SEQ ID NO: 862599 - RNA, 21 nt, Human
ggaagaugcuuuauacucuuc

SEQ ID NO: 862600 - RNA, 18 nt, Human
ggaggugcacacagcccc

SEQ ID NO: 862601 - RNA, 18 nt, Human
ggccugcgucugcucccg

SEQ ID NO: 862602 - RNA, 20 nt, Human
ggcuccagccccuggaucuu

SEQ ID NO: 862603 - RNA, 18 nt, Human
ggcucugggaggcugccc

SEQ ID NO: 862604 - RNA, 18 nt, Human
gggcggugcggggagggg

SEQ ID NO: 862605 - RNA, 18 nt, Human
ggggugcugggggcggug

SEQ ID NO: 862606 - RNA, 21 nt, Human
gggugucuccauucuggcuuc

SEQ ID NO: 862607 - RNA, 21 nt, Human
ggugcugggggcggugcgggg

SEQ ID NO: 862608 - RNA, 18 nt, Human
gucagcuuggacugaguu

SEQ ID NO: 862609 - RNA, 21 nt, Human
gugcaucuguuuccauccgca

SEQ ID NO: 862610 - RNA, 18 nt, Human
gugccacacaugugcucc

SEQ ID NO: 862611 - RNA, 20 nt, Human
gugcucccagucccgcuccu

SEQ ID NO: 862612 - RNA, 21 nt, Human
guggacauuucacuuccagac

SEQ ID NO: 862613 - RNA, 19 nt, Human
guggcaucagucuucaugg

SEQ ID NO: 862614 - RNA, 21 nt, Human
gugugggcaggcucaggugug

SEQ ID NO: 862615 - RNA, 19 nt, Human
uaaaaaguaaucccucggg

SEQ ID NO: 862616 - RNA, 21 nt, Human
uaaaauggcccaguguaagaa

SEQ ID NO: 862617 - RNA, 23 nt, Human
uacagugguuugaaaaugggagu

SEQ ID NO: 862618 - RNA, 21 nt, Human
uagcaacacccagcaggcccu

SEQ ID NO: 862619 - RNA, 22 nt, Human
uagcaacacccagcaggcccua

SEQ ID NO: 862620 - RNA, 20 nt, Human
uaggcccugcacaguucucc

SEQ ID NO: 862621 - RNA, 23 nt, Human
uaggccucaacuuuggaacccag

SEQ ID NO: 862622 - RNA, 23 nt, Human
uauagcaaaucucucauuuguac

SEQ ID NO: 862623 - RNA, 19 nt, Human
ucaccaaauugggguagca

SEQ ID NO: 862624 - RNA, 21 nt, Human
ucacugcaggccgggaccauc

SEQ ID NO: 862625 - RNA, 19 nt, Human
ucagaccaaauuuauugcc

SEQ ID NO: 862626 - RNA, 27 nt, Human
ucauagaucuuucuaggcagaaggccu

SEQ ID NO: 862627 - RNA, 22 nt, Human
ucauccaaacggccuuaggccc

SEQ ID NO: 862628 - RNA, 23 nt, Human
uccagacugugacgucugaagau

SEQ ID NO: 862629 - RNA, 22 nt, Human
uccauucuggcuucaccagaga

SEQ ID NO: 862630 - RNA, 18 nt, Human
ucccagucccgcuccugc

SEQ ID NO: 862631 - RNA, 25 nt, Human
ucccgcuccugccgcuguaacugga

SEQ ID NO: 862632 - RNA, 18 nt, Human
uccggucucuggaagugu

SEQ ID NO: 862633 - RNA, 21 nt, Human
uccuaagcccaagacgugccc

SEQ ID NO: 862634 - RNA, 18 nt, Human
uccuuuggugagauggcc

SEQ ID NO: 862635 - RNA, 19 nt, Human
ucgcugccagagggagcgg

SEQ ID NO: 862636 - RNA, 23 nt, Human
ucgcugccagagggagcgggugc

SEQ ID NO: 862637 - RNA, 19 nt, Human
ucgcuggggacaacacagg

SEQ ID NO: 862638 - RNA, 19 nt, Human
ucggagcuggaggaagggu

SEQ ID NO: 862639 - RNA, 18 nt, Human
ucggcucugggaggcugc

SEQ ID NO: 862640 - RNA, 21 nt, Human
ucucugaaaaccaugaggcuc

SEQ ID NO: 862641 - RNA, 18 nt, Human
ucucuggaaguguggugg

SEQ ID NO: 862642 - RNA, 19 nt, Human
ucuuuuguucuuuuggcug

SEQ ID NO: 862643 - RNA, 18 nt, Human
ugaaaauaucuaaauccc

SEQ ID NO: 862644 - RNA, 24 nt, Human
ugaagaggagagggggugcugggg

SEQ ID NO: 862645 - RNA, 21 nt, Human
ugaaugcugaguucuggguuu

SEQ ID NO: 862646 - RNA, 21 nt, Human
ugacccaaaauauuccagcau

SEQ ID NO: 862647 - RNA, 21 nt, Human
ugaggacaaggcugcaggccc

SEQ ID NO: 862648 - RNA, 23 nt, Human
ugaggacaaggcugcaggccccu

SEQ ID NO: 862649 - RNA, 18 nt, Human
ugaggacuuuggcacuuu

SEQ ID NO: 862650 - RNA, 21 nt, Human
ugaguucuggguuucugcccc

SEQ ID NO: 862651 - RNA, 21 nt, Human
ugcaggagguggagaaagugc

SEQ ID NO: 862652 - RNA, 20 nt, Human
ugcccugggcaaaggccaug

SEQ ID NO: 862653 - RNA, 21 nt, Human
ugcccugucccuggaaccucc

SEQ ID NO: 862654 - RNA, 19 nt, Human
ugccugaaaauaucuaaau

SEQ ID NO: 862655 - RNA, 18 nt, Human
ugcugagugucccgggag

SEQ ID NO: 862656 - RNA, 19 nt, Human
ugcugggggcggugcgggg

SEQ ID NO: 862657 - RNA, 21 nt, Human
ugcuuggaaccaaacacagag

SEQ ID NO: 862658 - RNA, 18 nt, Human
uggaacccagucauagac

SEQ ID NO: 862659 - RNA, 22 nt, Human
uggaagcaucuuguuuugacug

SEQ ID NO: 862660 - RNA, 18 nt, Human
ugggaagugcuuggaacc

SEQ ID NO: 862661 - RNA, 19 nt, Human
ugggaagugcuuggaacca

SEQ ID NO: 862662 - RNA, 22 nt, Human
ugggacacccagcuggaagugc

SEQ ID NO: 862663 - RNA, 19 nt, Human
ugggagaggagggaugcgc

SEQ ID NO: 862664 - RNA, 20 nt, Human
ugggaguuugaggugggaag

SEQ ID NO: 862665 - RNA, 20 nt, Human
uggggcauaaucagccuaua

SEQ ID NO: 862666 - RNA, 21 nt, Human
ugggggcggugcggggagggg

SEQ ID NO: 862667 - RNA, 23 nt, Human
ugguccguauagccuuuucugcc

SEQ ID NO: 862668 - RNA, 22 nt, Human
uguugaagaguggguaaauuug

SEQ ID NO: 862669 - RNA, 21 nt, Human
uguuuccauccgcaucuggua

SEQ ID NO: 862670 - RNA, 20 nt, Human
uguuuguggacauuucacuu

SEQ ID NO: 862671 - RNA, 20 nt, Human
uuacaugguccauugcgggg

SEQ ID NO: 862672 - RNA, 20 nt, Human
uucuggguuucugccccacu

SEQ ID NO: 862673 - RNA, 23 nt, Human
uugcacguaucuucaaggcuccc

SEQ ID NO: 862674 - RNA, 18 nt, Human
uugcucggcucugggagg

SEQ ID NO: 862675 - RNA, 24 nt, Human
uugcucuguaaagcugcagcacaa

SEQ ID NO: 862676 - RNA, 20 nt, Human
uugcugggccuuaaggaaac

SEQ ID NO: 862677 - RNA, 18 nt, Human
uuuaaaacagggacagcu

SEQ ID NO: 862678 - RNA, 20 nt, Human
uuuacacaaccgaaguuccu

SEQ ID NO: 862679 - RNA, 21 nt, Human
uuuucuugccucuccugaauc

SEQ ID NO: 862680 - RNA, 23 nt, Human
uuuugcuauuaaaaguugagaaa

SEQ ID NO: 862681 - RNA, 24 nt, Human
uuuuugcuauuaaaaguugagaaa

SEQ ID NO: 862682 - RNA, 18 nt, Human
uuuuuuuuuuuuuuucug

SEQ ID NO: 862683 - RNA, 21 nt, Human
acagcuaacuuacaagggccu

SEQ ID NO: 862684 - RNA, 21 nt, Human
agccucaggcccggacccugg

SEQ ID NO: 862685 - RNA, 18 nt, Human
caagggccugaacccggc

SEQ ID NO: 862686 - RNA, 23 nt, Human
ccccugaaaaccuuuauuuugaa

SEQ ID NO: 862687 - RNA, 21 nt, Human
ccuagagacagcaaacuucug

SEQ ID NO: 862688 - RNA, 21 nt, Human
cgccagccucaggcccggacc

SEQ ID NO: 862689 - RNA, 25 nt, Human
cuucugcuguacagcuaacuuacaa

SEQ ID NO: 862690 - RNA, 24 nt, Human
gaaacucuuaccaagcauguguac

SEQ ID NO: 862691 - RNA, 21 nt, Human
gugaaccccugaaaaccuuua

SEQ ID NO: 862692 - RNA, 18 nt, Human
uaagugaaccccugaaaa

SEQ ID NO: 862693 - RNA, 20 nt, Human
uacauuuccgaaaaucugau

SEQ ID NO: 862694 - RNA, 20 nt, Human
uaccaagcauguguacccau

SEQ ID NO: 862695 - RNA, 19 nt, Human
ucagccacaccuccugucu

SEQ ID NO: 862696 - RNA, 24 nt, Human
ugaaaaccuuuauuuugaaauuga

SEQ ID NO: 862697 - RNA, 28 nt, Human
ugacagaagauaaaacuuaaggggaccc

SEQ ID NO: 862698 - RNA, 20 nt, Human
ugcuguacagcuaacuuaca

SEQ ID NO: 862699 - RNA, 24 nt, Human
uuuuuuuuuuuuuuuuguuacagg

SEQ ID NO: 862700 - RNA, 18 nt, Human
uuuuuuuuuuuuuuuuug

SEQ ID NO: 862701 - RNA, 20 nt, Human
uuuuuuuuuuuuuuuuuguu

SEQ ID NO: 862702 - RNA, 18 nt, Human
aaacagccacuuccccuc

SEQ ID NO: 862703 - RNA, 27 nt, Human
acaccugugcccacacacgcacacaga

SEQ ID NO: 862704 - RNA, 22 nt, Human
agcagccaaacagccacuuccc

SEQ ID NO: 862705 - RNA, 18 nt, Human
agcaggaaaugacugaaa

SEQ ID NO: 862706 - RNA, 21 nt, Human
cacacagaccacauccgcagc

SEQ ID NO: 862707 - RNA, 28 nt, Human
cacaccugugcccacacacgcacacagu

SEQ ID NO: 862708 - RNA, 19 nt, Human
cacacgcacacagaccaca

SEQ ID NO: 862709 - RNA, 22 nt, Human
cagccaaacagccacuuccccu

SEQ ID NO: 862710 - RNA, 19 nt, Human
ccaguggccucauggucuc

SEQ ID NO: 862711 - RNA, 21 nt, Human
cccacacacgcacacagacca

SEQ ID NO: 862712 - RNA, 23 nt, Human
cccacacacgcacacagaccaca

SEQ ID NO: 862713 - RNA, 20 nt, Human
ccgcagcaggugggccuggc

SEQ ID NO: 862714 - RNA, 19 nt, Human
ccugggagggggaaagccc

SEQ ID NO: 862715 - RNA, 24 nt, Human
cucacacacucacaccugugccca

SEQ ID NO: 862716 - RNA, 21 nt, Human
ggaggcccaagaauuaaagua

SEQ ID NO: 862717 - RNA, 24 nt, Human
gggagggggaaagcccaguggccu

SEQ ID NO: 862718 - RNA, 18 nt, Human
gucuucauguugucagca

SEQ ID NO: 862719 - RNA, 21 nt, Human
ucacacacucacaccugugcc

SEQ ID NO: 862720 - RNA, 19 nt, Human
ugcccacacacgcacacag

SEQ ID NO: 862721 - RNA, 23 nt, Human
uggccagacaccuaugggacacu

SEQ ID NO: 862722 - RNA, 25 nt, Human
ugugcccacacacgcacacagacca

SEQ ID NO: 862723 - RNA, 22 nt, Human
uuuuuuuuuuuuuuuuuuucag

SEQ ID NO: 862724 - RNA, 18 nt, Human
aaaaaaaacagacaaugg

SEQ ID NO: 862725 - RNA, 19 nt, Human
aaaaaaacagacaaugggg

SEQ ID NO: 862726 - RNA, 18 nt, Human
aaaaaagcgggggcgacc

SEQ ID NO: 862727 - RNA, 23 nt, Human
aaaaagaaaaagacaacagagaa

SEQ ID NO: 862728 - RNA, 19 nt, Human
aaaaagcgggggcgacucc

SEQ ID NO: 862729 - RNA, 22 nt, Human
aaaagaaaaagacaacagagaa

SEQ ID NO: 862730 - RNA, 21 nt, Human
aaagaaaaagacaacagagaa

SEQ ID NO: 862731 - RNA, 23 nt, Human
aacacuuccccggcccgguacca

SEQ ID NO: 862732 - RNA, 21 nt, Human
aacauagugggaaccccaucu

SEQ ID NO: 862733 - RNA, 19 nt, Human
aacauggugaaaccccauc

SEQ ID NO: 862734 - RNA, 20 nt, Human
aacauggugaaaccccaucu

SEQ ID NO: 862735 - RNA, 21 nt, Human
aacauggugaaaccccaucuc

SEQ ID NO: 862736 - RNA, 21 nt, Human
aacauggugaaaccccaucuc

SEQ ID NO: 862737 - RNA, 20 nt, Human
aagaaaaagacaacagagaa

SEQ ID NO: 862738 - RNA, 22 nt, Human
aagaaaaagacaacagagaaaa

SEQ ID NO: 862739 - RNA, 19 nt, Human
aauaucucuggauacagcu

SEQ ID NO: 862740 - RNA, 18 nt, Human
aauugcuugaaccgagga

SEQ ID NO: 862741 - RNA, 18 nt, Human
acaccacugcauuccagc

SEQ ID NO: 862742 - RNA, 20 nt, Human
acaccacugcauuccagccu

SEQ ID NO: 862743 - RNA, 22 nt, Human
acaccacugcauuccagccugg

SEQ ID NO: 862744 - RNA, 19 nt, Human
acauagugggaaccccauc

SEQ ID NO: 862745 - RNA, 21 nt, Human
acauagugggaaccccaucuc

SEQ ID NO: 862746 - RNA, 19 nt, Human
accacugcauuccagccug

SEQ ID NO: 862747 - RNA, 21 nt, Human
accaggcauaguguugcccac

SEQ ID NO: 862748 - RNA, 22 nt, Human
accauugcacuccagccugggc

SEQ ID NO: 862749 - RNA, 24 nt, Human
accccaucucuacuaaaaauacaa

SEQ ID NO: 862750 - RNA, 19 nt, Human
accucaauccucuuagcau

SEQ ID NO: 862751 - RNA, 18 nt, Human
accucagcccugccucag

SEQ ID NO: 862752 - RNA, 21 nt, Human
accucccugcaggccgcuggu

SEQ ID NO: 862753 - RNA, 21 nt, Human
acggcggcagcgcgaccccuc

SEQ ID NO: 862754 - RNA, 18 nt, Human
acugcauuccagccuggg

SEQ ID NO: 862755 - RNA, 22 nt, Human
acugcauuccagccugggugag

SEQ ID NO: 862756 - RNA, 22 nt, Human
acugcauuccagccugggugag

SEQ ID NO: 862757 - RNA, 22 nt, Human
agaaucgcuugacuccaggagg

SEQ ID NO: 862758 - RNA, 24 nt, Human
agcacuuugggaggcagagguggg

SEQ ID NO: 862759 - RNA, 24 nt, Human
agcacuuugggaggccaagguggg

SEQ ID NO: 862760 - RNA, 19 nt, Human
agcaggucuaggcugcagu

SEQ ID NO: 862761 - RNA, 23 nt, Human
agccgggcauaguggcaggugcc

SEQ ID NO: 862762 - RNA, 24 nt, Human
agccuagccaacauggugaaaccc

SEQ ID NO: 862763 - RNA, 25 nt, Human
agccugaucaacauagugggaaccc

SEQ ID NO: 862764 - RNA, 20 nt, Human
aggaguuugagaccagccug

SEQ ID NO: 862765 - RNA, 21 nt, Human
aggcagagguggguggaucac

SEQ ID NO: 862766 - RNA, 18 nt, Human
aggcaggagaaucgcuug

SEQ ID NO: 862767 - RNA, 24 nt, Human
aggcauaguguugcccaccuguag

SEQ ID NO: 862768 - RNA, 21 nt, Human
aggccaaggugggcgaauugc

SEQ ID NO: 862769 - RNA, 24 nt, Human
aggccaggugagguggcucacgcc

SEQ ID NO: 862770 - RNA, 24 nt, Human
aggcuggggcaggaggauuccuug

SEQ ID NO: 862771 - RNA, 19 nt, Human
agggaaggagggacgucag

SEQ ID NO: 862772 - RNA, 20 nt, Human
agggaaggagggacgucagu

SEQ ID NO: 862773 - RNA, 24 nt, Human
aggggggugggcaaaaaagcgggg

SEQ ID NO: 862774 - RNA, 25 nt, Human
aggggggugggcaaaaaagcgggga

SEQ ID NO: 862775 - RNA, 25 nt, Human
aggggggugggcaaaaaagcggggg

SEQ ID NO: 862776 - RNA, 24 nt, Human
aggugagguggcucacgccuguaa

SEQ ID NO: 862777 - RNA, 23 nt, Human
aggugcuggcagaagaggcugcu

SEQ ID NO: 862778 - RNA, 24 nt, Human
agguggaaguugcagugagucgag

SEQ ID NO: 862779 - RNA, 21 nt, Human
agguggguggaucaccugagg

SEQ ID NO: 862780 - RNA, 21 nt, Human
agugcaguggcuccccuguaa

SEQ ID NO: 862781 - RNA, 24 nt, Human
aguggcaggugccuguaauuccag

SEQ ID NO: 862782 - RNA, 22 nt, Human
aguggcuccccuguaaucccag

SEQ ID NO: 862783 - RNA, 24 nt, Human
auaaaacggcggcagcgcgacccc

SEQ ID NO: 862784 - RNA, 22 nt, Human
aucccagcacuuugggaggcca

SEQ ID NO: 862785 - RNA, 24 nt, Human
aucgcaccauugcacuccagccug

SEQ ID NO: 862786 - RNA, 28 nt, Human
aucgcaccauugcacuccagccugggca

SEQ ID NO: 862787 - RNA, 20 nt, Human
auggaggucugggggguucu

SEQ ID NO: 862788 - RNA, 22 nt, Human
augugcuccaccaguguggagc

SEQ ID NO: 862789 - RNA, 24 nt, Human
auugcacuccagccugggcaacaa

SEQ ID NO: 862790 - RNA, 22 nt, Human
caaaaaaaacagacaaugggua

SEQ ID NO: 862791 - RNA, 23 nt, Human
caaaaaguuagccgggcauagug

SEQ ID NO: 862792 - RNA, 24 nt, Human
caacauggugaaaccccaucucua

SEQ ID NO: 862793 - RNA, 21 nt, Human
cacaccacugcauuccagccu

SEQ ID NO: 862794 - RNA, 20 nt, Human
caccccaggccagcucuugc

SEQ ID NO: 862795 - RNA, 23 nt, Human
caccuguagucacagccaucuga

SEQ ID NO: 862796 - RNA, 24 nt, Human
cacgccuguaaucccagcacuuug

SEQ ID NO: 862797 - RNA, 24 nt, Human
cacuccagccugggcaacaagagc

SEQ ID NO: 862798 - RNA, 22 nt, Human
cacucgggacagcgguggggcc

SEQ ID NO: 862799 - RNA, 19 nt, Human
cacugcauuccagccuggg

SEQ ID NO: 862800 - RNA, 19 nt, Human
cacugcauuccagccuggg

SEQ ID NO: 862801 - RNA, 22 nt, Human
cacugcauuccagccuggguga

SEQ ID NO: 862802 - RNA, 22 nt, Human
cacugcauuccagccuggguga

SEQ ID NO: 862803 - RNA, 20 nt, Human
cagagguggguggaucaccu

SEQ ID NO: 862804 - RNA, 22 nt, Human
cagagguggguggaucaccuga

SEQ ID NO: 862805 - RNA, 24 nt, Human
cagcacuuugggaggcagaggugg

SEQ ID NO: 862806 - RNA, 24 nt, Human
cagcacuuugggaggccaaggugg

SEQ ID NO: 862807 - RNA, 24 nt, Human
cagccaucugagaggcuggggcag

SEQ ID NO: 862808 - RNA, 22 nt, Human
cagccccccagggcgccggccc

SEQ ID NO: 862809 - RNA, 21 nt, Human
caguagagcccccgaaggccc

SEQ ID NO: 862810 - RNA, 26 nt, Human
cagugcaguggcuccccuguaauccc

SEQ ID NO: 862811 - RNA, 23 nt, Human
caguggcuccccuguaaucccag

SEQ ID NO: 862812 - RNA, 19 nt, Human
cagugugaacgcgcaggug

SEQ ID NO: 862813 - RNA, 22 nt, Human
cauaguggcaggugccuguaau

SEQ ID NO: 862814 - RNA, 24 nt, Human
caucucugggaggagaaacagcuu

SEQ ID NO: 862815 - RNA, 22 nt, Human
cauuccagccugggugaggagc

SEQ ID NO: 862816 - RNA, 19 nt, Human
cauugcacuccagccuggg

SEQ ID NO: 862817 - RNA, 21 nt, Human
cauugcacuccagccugggca

SEQ ID NO: 862818 - RNA, 22 nt, Human
ccaagaucagacuguccgcacc

SEQ ID NO: 862819 - RNA, 22 nt, Human
ccaccuguagucacagccaucu

SEQ ID NO: 862820 - RNA, 20 nt, Human
ccacugcauuccagccuggg

SEQ ID NO: 862821 - RNA, 20 nt, Human
ccacugcauuccagccuggg

SEQ ID NO: 862822 - RNA, 21 nt, Human
ccacugcauuccagccugggu

SEQ ID NO: 862823 - RNA, 21 nt, Human
ccacugcauuccagccugggu

SEQ ID NO: 862824 - RNA, 23 nt, Human
ccacugcauuccagccuggguga

SEQ ID NO: 862825 - RNA, 24 nt, Human
ccacugcauuccagccugggugag

SEQ ID NO: 862826 - RNA, 19 nt, Human
ccagccugggugaggagca

SEQ ID NO: 862827 - RNA, 22 nt, Human
ccagccugggugaggagcaaga

SEQ ID NO: 862828 - RNA, 20 nt, Human
ccauugcacuccagccuggg

SEQ ID NO: 862829 - RNA, 21 nt, Human
ccauugcacuccagccugggc

SEQ ID NO: 862830 - RNA, 23 nt, Human
ccauugcacuccagccugggcaa

SEQ ID NO: 862831 - RNA, 24 nt, Human
ccauugcacuccagccugggcaac

SEQ ID NO: 862832 - RNA, 25 nt, Human
ccauugcacuccagccugggcaaca

SEQ ID NO: 862833 - RNA, 18 nt, Human
cccacaaugucuagaugg

SEQ ID NO: 862834 - RNA, 24 nt, Human
cccacaggcggguccagguccccg

SEQ ID NO: 862835 - RNA, 25 nt, Human
cccacaggcggguccagguccccgc

SEQ ID NO: 862836 - RNA, 20 nt, Human
cccacuagaggggauggaac

SEQ ID NO: 862837 - RNA, 21 nt, Human
cccccagggcgccggccccua

SEQ ID NO: 862838 - RNA, 20 nt, Human
ccccccagggcgccggcccc

SEQ ID NO: 862839 - RNA, 18 nt, Human
ccccgggccgauggaccc

SEQ ID NO: 862840 - RNA, 20 nt, Human
ccccugagcccaucucgggc

SEQ ID NO: 862841 - RNA, 19 nt, Human
ccccuguaaucccagcacu

SEQ ID NO: 862842 - RNA, 23 nt, Human
ccccuguggcuguaaaugugcuc

SEQ ID NO: 862843 - RNA, 19 nt, Human
cccgcacacguagcagccg

SEQ ID NO: 862844 - RNA, 21 nt, Human
cccgcacacguagcagccgug

SEQ ID NO: 862845 - RNA, 18 nt, Human
ccgaggaguuugagacca

SEQ ID NO: 862846 - RNA, 23 nt, Human
ccgcgcccgagaacacuuccccg

SEQ ID NO: 862847 - RNA, 18 nt, Human
ccgggccuuggacagcug

SEQ ID NO: 862848 - RNA, 24 nt, Human
ccuagccaacauggugaaacccca

SEQ ID NO: 862849 - RNA, 19 nt, Human
ccucccugcaggccgcugc

SEQ ID NO: 862850 - RNA, 20 nt, Human
ccucgcccccgggccgaugg

SEQ ID NO: 862851 - RNA, 25 nt, Human
ccugaucaacauagugggaacccca

SEQ ID NO: 862852 - RNA, 22 nt, Human
ccuguaaucccagcacuuuggg

SEQ ID NO: 862853 - RNA, 18 nt, Human
ccuguaauuccagcuacu

SEQ ID NO: 862854 - RNA, 25 nt, Human
ccuguaauuccagcuacuugggugg

SEQ ID NO: 862855 - RNA, 21 nt, Human
ccuguauggaggucugggggg

SEQ ID NO: 862856 - RNA, 19 nt, Human
cgagaacacuuccccggcc

SEQ ID NO: 862857 - RNA, 24 nt, Human
cgagaccagccuagccaacauggu

SEQ ID NO: 862858 - RNA, 21 nt, Human
cgcaccauugcacuccagccu

SEQ ID NO: 862859 - RNA, 21 nt, Human
cgccgugcggcgcaugaaggc

SEQ ID NO: 862860 - RNA, 24 nt, Human
cgccuguaaucccagcacuuuggg

SEQ ID NO: 862861 - RNA, 19 nt, Human
cgggccccugagcccaucu

SEQ ID NO: 862862 - RNA, 20 nt, Human
cuacgccccucgcccccggg

SEQ ID NO: 862863 - RNA, 22 nt, Human
cucaccucagcccugccucagc

SEQ ID NO: 862864 - RNA, 22 nt, Human
cucacgccuguaaucccagcac

SEQ ID NO: 862865 - RNA, 24 nt, Human
cucacgccuguaaucccagcacuu

SEQ ID NO: 862866 - RNA, 26 nt, Human
cucagcccugccucagcaaagggggc

SEQ ID NO: 862867 - RNA, 24 nt, Human
cuccccuggccaggccugggcaug

SEQ ID NO: 862868 - RNA, 22 nt, Human
cuccccuguaaucccagcacuu

SEQ ID NO: 862869 - RNA, 24 nt, Human
cuccccuguaaucccagcacuuug

SEQ ID NO: 862870 - RNA, 20 nt, Human
cucccugcaggccgcugcag

SEQ ID NO: 862871 - RNA, 21 nt, Human
cucuacuaaaaauacaaaaag

SEQ ID NO: 862872 - RNA, 19 nt, Human
cuugcgguggauucuggga

SEQ ID NO: 862873 - RNA, 23 nt, Human
gaagaggcugcugagagcccaag

SEQ ID NO: 862874 - RNA, 23 nt, Human
gacagcgguggggccgcuccccc

SEQ ID NO: 862875 - RNA, 18 nt, Human
gagaacacuuccccggcc

SEQ ID NO: 862876 - RNA, 20 nt, Human
gagaacacuuccccggcccg

SEQ ID NO: 862877 - RNA, 23 nt, Human
gagaucgcaccauugcacuccag

SEQ ID NO: 862878 - RNA, 20 nt, Human
gagcccagggcagcggggag

SEQ ID NO: 862879 - RNA, 20 nt, Human
gaggauuccuugagcccagc

SEQ ID NO: 862880 - RNA, 19 nt, Human
gaggccaaggugggcgaau

SEQ ID NO: 862881 - RNA, 18 nt, Human
gagguggguggaucaccu

SEQ ID NO: 862882 - RNA, 18 nt, Human
gaucaccugagggcagga

SEQ ID NO: 862883 - RNA, 24 nt, Human
gaucaccugagggcaggaguucga

SEQ ID NO: 862884 - RNA, 20 nt, Human
gcaccauugcacuccagccu

SEQ ID NO: 862885 - RNA, 20 nt, Human
gcacuuugggaggccaaggu

SEQ ID NO: 862886 - RNA, 24 nt, Human
gccaacauggugaaaccccaucuc

SEQ ID NO: 862887 - RNA, 21 nt, Human
gccacacugcgggcagcggua

SEQ ID NO: 862888 - RNA, 21 nt, Human
gccagcucuugcgguggauuc

SEQ ID NO: 862889 - RNA, 19 nt, Human
gcccaagaucagacugucc

SEQ ID NO: 862890 - RNA, 26 nt, Human
gccccuguggcuguaaaugugcucca

SEQ ID NO: 862891 - RNA, 21 nt, Human
gcccugccucagcaaaggggg

SEQ ID NO: 862892 - RNA, 18 nt, Human
gccgugcggcgcaugaag

SEQ ID NO: 862893 - RNA, 22 nt, Human
gccuuggagagcccagggcagc

SEQ ID NO: 862894 - RNA, 19 nt, Human
gcgccggccccuacgcccc

SEQ ID NO: 862895 - RNA, 23 nt, Human
gcuggggcaggaggauuccuuga

SEQ ID NO: 862896 - RNA, 23 nt, Human
ggaaggagggacgucaguagagc

SEQ ID NO: 862897 - RNA, 24 nt, Human
ggaaguugcagugagucgagaucg

SEQ ID NO: 862898 - RNA, 22 nt, Human
ggagcaaggugcuggcagaaga

SEQ ID NO: 862899 - RNA, 22 nt, Human
ggcaggaggauuccuugagccc

SEQ ID NO: 862900 - RNA, 21 nt, Human
ggcaugcggaaccucccgcgc

SEQ ID NO: 862901 - RNA, 22 nt, Human
ggccccuacgccccucgccccc

SEQ ID NO: 862902 - RNA, 23 nt, Human
ggccuuggagagcccagggcagc

SEQ ID NO: 862903 - RNA, 20 nt, Human
ggcggcagcgcgaccccucg

SEQ ID NO: 862904 - RNA, 24 nt, Human
gggcauaguggcaggugccuguaa

SEQ ID NO: 862905 - RNA, 20 nt, Human
gggcgacuccggcgccgggc

SEQ ID NO: 862906 - RNA, 23 nt, Human
gggguucucaccucagcccugcc

SEQ ID NO: 862907 - RNA, 23 nt, Human
ggguucucaccucagcccugccu

SEQ ID NO: 862908 - RNA, 24 nt, Human
ggugccuguaauuccagcuacuug

SEQ ID NO: 862909 - RNA, 23 nt, Human
gguggcucacgccuguaauccca

SEQ ID NO: 862910 - RNA, 24 nt, Human
gguggcucacgccuguaaucccag

SEQ ID NO: 862911 - RNA, 18 nt, Human
guggccgaagcccuugcc

SEQ ID NO: 862912 - RNA, 23 nt, Human
guggcuccccuguaaucccagca

SEQ ID NO: 862913 - RNA, 18 nt, Human
uaaacaaaaaaaacagac

SEQ ID NO: 862914 - RNA, 22 nt, Human
uaaauaaacaaaaaaaacagac

SEQ ID NO: 862915 - RNA, 18 nt, Human
uaccucaauccucuuagc

SEQ ID NO: 862916 - RNA, 18 nt, Human
uagagcccccgaaggccc

SEQ ID NO: 862917 - RNA, 24 nt, Human
uaguggcaggugccuguaauucca

SEQ ID NO: 862918 - RNA, 23 nt, Human
ucacaccacugcauuccagccug

SEQ ID NO: 862919 - RNA, 20 nt, Human
ucagcgccgugcggcgcaug

SEQ ID NO: 862920 - RNA, 22 nt, Human
ucaggccgaagcagcggccaca

SEQ ID NO: 862921 - RNA, 24 nt, Human
uccaccaguguggagcgccaggcg

SEQ ID NO: 862922 - RNA, 18 nt, Human
uccagccugggugaggag

SEQ ID NO: 862923 - RNA, 22 nt, Human
uccagccugggugaggagcaag

SEQ ID NO: 862924 - RNA, 18 nt, Human
uccauggucagaacugga

SEQ ID NO: 862925 - RNA, 18 nt, Human
ucccugcaggccgcugca

SEQ ID NO: 862926 - RNA, 20 nt, Human
ucccugcaggccgcugcaga

SEQ ID NO: 862927 - RNA, 23 nt, Human
ucgcaccauugcacuccagccug

SEQ ID NO: 862928 - RNA, 31 nt, Human; identical to SEQ ID NO: 515949

SEQ ID NO: 862929 - RNA, 24 nt, Human
ucucuacuaaaaauacaaaaaguu

SEQ ID NO: 862930 - RNA, 19 nt, Human
ugaaaccccaucucuacua

SEQ ID NO: 862931 - RNA, 23 nt, Human
ugagaccagccugaucaacauag

SEQ ID NO: 862932 - RNA, 24 nt, Human
ugagaccagccugaucaacauagu

SEQ ID NO: 862933 - RNA, 21 nt, Human
ugagagcccaagaucagacug

SEQ ID NO: 862934 - RNA, 20 nt, Human
ugagcccagcaggucuaggc

SEQ ID NO: 862935 - RNA, 19 nt, Human
ugaggagcaagaugcuguc

SEQ ID NO: 862936 - RNA, 20 nt, Human
ugaggcaggagaaucgcuug

SEQ ID NO: 862937 - RNA, 25 nt, Human
ugaggcaggagaaucgcuugacucc

SEQ ID NO: 862938 - RNA, 22 nt, Human
ugagucgagaucgcaccauugc

SEQ ID NO: 862939 - RNA, 19 nt, Human
ugcacuccagccugggcaa

SEQ ID NO: 862940 - RNA, 22 nt, Human
ugcacuccagccugggcaacaa

SEQ ID NO: 862941 - RNA, 24 nt, Human
ugccuguaauuccagcuacuuggg

SEQ ID NO: 862942 - RNA, 18 nt, Human
ugcuccaccaguguggag

SEQ ID NO: 862943 - RNA, 19 nt, Human
ugcugagagcccaagauca

SEQ ID NO: 862944 - RNA, 19 nt, Human
uggaagcccacaggcgggu

SEQ ID NO: 862945 - RNA, 24 nt, Human
uggaucaccugagggcaggaguuc

SEQ ID NO: 862946 - RNA, 22 nt, Human
uggcaggugccuguaauuccag

SEQ ID NO: 862947 - RNA, 24 nt, Human
uggcucacgccuguaaucccagca

SEQ ID NO: 862948 - RNA, 24 nt, Human
uggcugaggcaggagaaucgcuug

SEQ ID NO: 862949 - RNA, 19 nt, Human
ugggaggcagaggugggug

SEQ ID NO: 862950 - RNA, 20 nt, Human
ugggaggcagaggugggugg

SEQ ID NO: 862951 - RNA, 24 nt, Human
ugggaggcagagguggguggauca

SEQ ID NO: 862952 - RNA, 22 nt, Human
ugggaggccaaggugggcgaau

SEQ ID NO: 862953 - RNA, 24 nt, Human
ugggaggccaaggugggcgaauug

SEQ ID NO: 862954 - RNA, 19 nt, Human
uggggcaggaggauuccuu

SEQ ID NO: 862955 - RNA, 24 nt, Human
uggggcaggaggauuccuugagcc

SEQ ID NO: 862956 - RNA, 19 nt, Human
ugggugaggagcaagaugc

SEQ ID NO: 862957 - RNA, 24 nt, Human
uggguggaucaccugagggcagga

SEQ ID NO: 862958 - RNA, 18 nt, Human
uggguggcugaggcagga

SEQ ID NO: 862959 - RNA, 24 nt, Human
uucacaccacugcauuccagccug

SEQ ID NO: 862960 - RNA, 19 nt, Human
uucccuguauggaggucug

SEQ ID NO: 862961 - RNA, 19 nt, Human
uuccuugagcccagcaggu

SEQ ID NO: 862962 - RNA, 23 nt, Human
uuccuugagcccagcaggucuag

SEQ ID NO: 862963 - RNA, 22 nt, Human
uucucaccucagcccugccuca

SEQ ID NO: 862964 - RNA, 19 nt, Human
uugcagugagucgagaucg

SEQ ID NO: 862965 - RNA, 22 nt, Human
uugcagugagucgagaucgcac

SEQ ID NO: 862966 - RNA, 19 nt, Human
uugcgguggauucugggac

SEQ ID NO: 862967 - RNA, 20 nt, Human
uugcuucccuguauggaggu

SEQ ID NO: 862968 - RNA, 20 nt, Human
uugggaggcagaggugggug

SEQ ID NO: 862969 - RNA, 25 nt, Human
uuggguggcugaggcaggagaaucg

SEQ ID NO: 862970 - RNA, 26 nt, Human
uuuuuuuuuuuuuuccaauacagggg

SEQ ID NO: 862971 - RNA, 21 nt, Human
aaaaaaacccaaacaauacca

SEQ ID NO: 862972 - RNA, 24 nt, Human
aaaaaacccaaacaauaccaagug

SEQ ID NO: 862973 - RNA, 23 nt, Human
aaaaacaaacaaaaccacgccca

SEQ ID NO: 862974 - RNA, 20 nt, Human
aaaaagaaaacgaagcaaaa

SEQ ID NO: 862975 - RNA, 21 nt, Human
aaaaagaaaacgaagcaaaac

SEQ ID NO: 862976 - RNA, 19 nt, Human
aaaaagcaaaaaagaaaac

SEQ ID NO: 862977 - RNA, 25 nt, Human
aaaaaugggcaaucauaaaaccccc

SEQ ID NO: 862978 - RNA, 21 nt, Human
aaaacaaacaaaaccacgccc

SEQ ID NO: 862979 - RNA, 19 nt, Human
aaaacaaagcaaaacagcc

SEQ ID NO: 862980 - RNA, 24 nt, Human
aaaaccaaaaaaaaacccaaacaa

SEQ ID NO: 862981 - RNA, 24 nt, Human
aaaagaaaacgaagcaaaacaaaa

SEQ ID NO: 862982 - RNA, 21 nt, Human
aaacaaaaccacgcccacaca

SEQ ID NO: 862983 - RNA, 23 nt, Human
aaacaaacaaaaccacgcccaca

SEQ ID NO: 862984 - RNA, 18 nt, Human
aaacaaagcaaaacagcc

SEQ ID NO: 862985 - RNA, 23 nt, Human
aaacaaccacugagucugaaggc

SEQ ID NO: 862986 - RNA, 19 nt, Human
aaaccaaaaaaaaacccaa

SEQ ID NO: 862987 - RNA, 19 nt, Human
aaacgaagcaaaacaaaaa

SEQ ID NO: 862988 - RNA, 23 nt, Human
aaacgaagcaaaacaaaaagcaa

SEQ ID NO: 862989 - RNA, 19 nt, Human
aaagaaaacgaagcaaaac

SEQ ID NO: 862990 - RNA, 25 nt, Human
aaagaaaacgaagcaaaacaaaaag

SEQ ID NO: 862991 - RNA, 24 nt, Human
aaagcaaaaaagaaaacgaagcaa

SEQ ID NO: 862992 - RNA, 20 nt, Human
aaaugcuaaagguagaagca

SEQ ID NO: 862993 - RNA, 19 nt, Human
aacaaaaccaaaaaaaaac

SEQ ID NO: 862994 - RNA, 20 nt, Human
aacaaaaccaaaaaaaaacc

SEQ ID NO: 862995 - RNA, 24 nt, Human
aacaaaaccaaaaaaaaacccaaa

SEQ ID NO: 862996 - RNA, 26 nt, Human
aacaacaacaacaaaaccaaaaaaaa

SEQ ID NO: 862997 - RNA, 24 nt, Human
aacagagugagacucugucucaaa

SEQ ID NO: 862998 - RNA, 24 nt, Human
aacagccgggcgcgguggcucaca

SEQ ID NO: 862999 - RNA, 24 nt, Human
aaccaguauacuugacuuugagug

SEQ ID NO: 863000 - RNA, 19 nt, Human
aacccaaacaauaccaagu

SEQ ID NO: 863001 - RNA, 22 nt, Human
aacccuggacugacugcuuuaa

SEQ ID NO: 863002 - RNA, 22 nt, Human
aagcaaaaaagaaaacgaagca

SEQ ID NO: 863003 - RNA, 23 nt, Human
aagcaaaaaagaaaacgaagcaa

SEQ ID NO: 863004 - RNA, 24 nt, Human
aagcaaaaaagaaaacgaagcaaa

SEQ ID NO: 863005 - RNA, 24 nt, Human
aagcaaaacaaaaagcaauaccag

SEQ ID NO: 863006 - RNA, 19 nt, Human
aagcaaaacagccgggcgc

SEQ ID NO: 863007 - RNA, 25 nt, Human
aagggccaugguggugauucuuaga

SEQ ID NO: 863008 - RNA, 23 nt, Human
aaugugcuggugaccuucaaccu

SEQ ID NO: 863009 - RNA, 23 nt, Human
acaaaaccaaaaaaaaacccaaa

SEQ ID NO: 863010 - RNA, 24 nt, Human
acaaaaccaaaaaaaaacccaaac

SEQ ID NO: 863011 - RNA, 21 nt, Human
acaaacaaaaccacgcccaca

SEQ ID NO: 863012 - RNA, 23 nt, Human
acaaacaaaaccacgcccacaca

SEQ ID NO: 863013 - RNA, 26 nt, Human
acaacaacaaaaccaaaaaaaaaccc

SEQ ID NO: 863014 - RNA, 18 nt, Human
acacacuaacaacaacaa

SEQ ID NO: 863015 - RNA, 20 nt, Human
acacuaacaacaacaacaaa

SEQ ID NO: 863016 - RNA, 21 nt, Human
acagagugagacucugucuca

SEQ ID NO: 863017 - RNA, 24 nt, Human
acagagugagacucugucucaaaa

SEQ ID NO: 863018 - RNA, 22 nt, Human
accaaaaaaaaacccaaacaau

SEQ ID NO: 863019 - RNA, 20 nt, Human
accaugacgagaaaaggaau

SEQ ID NO: 863020 - RNA, 23 nt, Human
accggggcacaagaacuugccua

SEQ ID NO: 863021 - RNA, 22 nt, Human
accuugucuccaaaaacaaaca

SEQ ID NO: 863022 - RNA, 19 nt, Human
acgaagcaaaacaaaaagc

SEQ ID NO: 863023 - RNA, 23 nt, Human
acgccacugcacuccagcugggc

SEQ ID NO: 863024 - RNA, 23 nt, Human
acuaacaacaacaacaaaaccaa

SEQ ID NO: 863025 - RNA, 19 nt, Human
acugcacuccagcccuggg

SEQ ID NO: 863026 - RNA, 25 nt, Human
acugcacuccagcccugggcgacag

SEQ ID NO: 863027 - RNA, 20 nt, Human
acugcacuccagcccugggg

SEQ ID NO: 863028 - RNA, 23 nt, Human
acugcacuccagcugggcaacag

SEQ ID NO: 863029 - RNA, 23 nt, Human
acugcacuccagcugggcaacag

SEQ ID NO: 863030 - RNA, 23 nt, Human
agaaaacgaagcaaaacaaaaag

SEQ ID NO: 863031 - RNA, 24 nt, Human
agacacgcacucucccccuagcaa

SEQ ID NO: 863032 - RNA, 22 nt, Human
agacagaaaaaugggcaaucau

SEQ ID NO: 863033 - RNA, 23 nt, Human
agagcuugcagugagccgagauc

SEQ ID NO: 863034 - RNA, 23 nt, Human
agaggagaguacugcugcccagu

SEQ ID NO: 863035 - RNA, 18 nt, Human
agagugaaaaggggccuu

SEQ ID NO: 863036 - RNA, 24 nt, Human
agcacuuugggaggccgagguggg

SEQ ID NO: 863037 - RNA, 18 nt, Human
agccggccgugguggcgg

SEQ ID NO: 863038 - RNA, 22 nt, Human
agccgggcgugguggugcacgc

SEQ ID NO: 863039 - RNA, 23 nt, Human
agccgggcgugguggugcacgcc

SEQ ID NO: 863040 - RNA, 25 nt, Human
agcggcggaagcaggaaaugcuaaa

SEQ ID NO: 863041 - RNA, 23 nt, Human
agcugggcaacagagugagacuc

SEQ ID NO: 863042 - RNA, 19 nt, Human
aggagcagggaggaggcgg

SEQ ID NO: 863043 - RNA, 21 nt, Human
aggcagagcuugcagugagcc

SEQ ID NO: 863044 - RNA, 24 nt, Human
aggcagagcuugcagugagccgag

SEQ ID NO: 863045 - RNA, 24 nt, Human
aggcaggagaauggcgugaacccg

SEQ ID NO: 863046 - RNA, 23 nt, Human
aggcaggaggaucgcuugggccc

SEQ ID NO: 863047 - RNA, 25 nt, Human
aggcaggaggaucgcuugggcccug

SEQ ID NO: 863048 - RNA, 18 nt, Human
aggccgaggugggcggau

SEQ ID NO: 863049 - RNA, 19 nt, Human
aggcugaggcaggagaaug

SEQ ID NO: 863050 - RNA, 22 nt, Human
agggcaccuggauuaaagcccu

SEQ ID NO: 863051 - RNA, 22 nt, Human
agguaggaggaaaucuggagag

SEQ ID NO: 863052 - RNA, 20 nt, Human
agguugaggcaggaggaucg

SEQ ID NO: 863053 - RNA, 24 nt, Human
agguugaggcaggaggaucgcuug

SEQ ID NO: 863054 - RNA, 23 nt, Human
aucacgccacugcacuccagcug

SEQ ID NO: 863055 - RNA, 23 nt, Human
auccagccuuuuagugguugaaa

SEQ ID NO: 863056 - RNA, 25 nt, Human
aucgcgccacugcacuccagcccug

SEQ ID NO: 863057 - RNA, 23 nt, Human
caaaaaaaaacccaaacaauacc

SEQ ID NO: 863058 - RNA, 27 nt, Human
caaaaagcaaaaaagaaaacgaagcaa

SEQ ID NO: 863059 - RNA, 28 nt, Human
caaaacaaaaagcaauaccagccgggcg

SEQ ID NO: 863060 - RNA, 22 nt, Human
caaaacagccgggcgcgguggc

SEQ ID NO: 863061 - RNA, 24 nt, Human
caaagcccauccuccuugcuucuc

SEQ ID NO: 863062 - RNA, 21 nt, Human
caacaaaaccaaaaaaaaacc

SEQ ID NO: 863063 - RNA, 25 nt, Human
caacaaaaccaaaaaaaaacccaaa

SEQ ID NO: 863064 - RNA, 28 nt, Human
caacaacaacaaaaccaaaaaaaaaccc

SEQ ID NO: 863065 - RNA, 24 nt, Human
cacaccuguaaucccagcacuuug

SEQ ID NO: 863066 - RNA, 20 nt, Human
caccccacaaacuguuccuu

SEQ ID NO: 863067 - RNA, 24 nt, Human
caccccggaauugaggacacaggg

SEQ ID NO: 863068 - RNA, 19 nt, Human
caccucacuggauuccacc

SEQ ID NO: 863069 - RNA, 24 nt, Human
caccuggauuaaagcccugugggc

SEQ ID NO: 863070 - RNA, 19 nt, Human
caccuguaaucccagcacu

SEQ ID NO: 863071 - RNA, 24 nt, Human
caccuguaaucccagcacuuuggg

SEQ ID NO: 863072 - RNA, 18 nt, Human
cacgccuguaaucccagc

SEQ ID NO: 863073 - RNA, 19 nt, Human
cacgccuguaaucccagcu

SEQ ID NO: 863074 - RNA, 24 nt, Human
cacuccagcccugggcgacagagc

SEQ ID NO: 863075 - RNA, 21 nt, Human
cacuccagcugggcaacagag

SEQ ID NO: 863076 - RNA, 22 nt, Human
cacuccagcugggcaacagagu

SEQ ID NO: 863077 - RNA, 20 nt, Human
cacugcacuccagcccuggg

SEQ ID NO: 863078 - RNA, 21 nt, Human
cacugcacuccagcccugggc

SEQ ID NO: 863079 - RNA, 23 nt, Human
cacugcacuccagcccugggcga

SEQ ID NO: 863080 - RNA, 24 nt, Human
cacugcacuccagcccugggcgac

SEQ ID NO: 863081 - RNA, 25 nt, Human
cacugcacuccagcccugggcgaca

SEQ ID NO: 863082 - RNA, 18 nt, Human
cacugcacuccagcuggg

SEQ ID NO: 863083 - RNA, 20 nt, Human
cacugcacuccagcugggca

SEQ ID NO: 863084 - RNA, 21 nt, Human
cacugcacuccagcugggcaa

SEQ ID NO: 863085 - RNA, 23 nt, Human
cacugcacuccagcugggcaaca

SEQ ID NO: 863086 - RNA, 24 nt, Human
cagcacuuugggaggccgaggugg

SEQ ID NO: 863087 - RNA, 23 nt, Human
cagccuuucuccuucgugggccc

SEQ ID NO: 863088 - RNA, 22 nt, Human
cagcuaaaccugagauccaagc

SEQ ID NO: 863089 - RNA, 24 nt, Human
cagcuacucgggaggcugaggcag

SEQ ID NO: 863090 - RNA, 24 nt, Human
cagcuauccgggagguugaggcag

SEQ ID NO: 863091 - RNA, 21 nt, Human
caggagaugccacugcaggac

SEQ ID NO: 863092 - RNA, 27 nt, Human
ccaaacaauaccaaguguguaccauga

SEQ ID NO: 863093 - RNA, 24 nt, Human
ccaagcccagccuggcucuucacu

SEQ ID NO: 863094 - RNA, 21 nt, Human
ccacacacuaacaacaacaac

SEQ ID NO: 863095 - RNA, 24 nt, Human
ccacagagcacagcucgggccucu

SEQ ID NO: 863096 - RNA, 21 nt, Human
ccacugcacuccagcccuggg

SEQ ID NO: 863097 - RNA, 22 nt, Human
ccacugcacuccagcccugggc

SEQ ID NO: 863098 - RNA, 25 nt, Human
ccacugcacuccagcccugggcgac

SEQ ID NO: 863099 - RNA, 19 nt, Human
ccacugcacuccagcuggg

SEQ ID NO: 863100 - RNA, 19 nt, Human
ccacugcacuccagcuggg

SEQ ID NO: 863101 - RNA, 20 nt, Human
ccacugcacuccagcugggc

SEQ ID NO: 863102 - RNA, 23 nt, Human
ccagccgggcgugguggugcacg

SEQ ID NO: 863103 - RNA, 21 nt, Human
ccaucagugagcagcagcagc

SEQ ID NO: 863104 - RNA, 24 nt, Human
ccauccuccuugcuucucccuggc

SEQ ID NO: 863105 - RNA, 24 nt, Human
cccaaacccuggacugacugcuuu

SEQ ID NO: 863106 - RNA, 19 nt, Human
cccacacacuaacaacaac

SEQ ID NO: 863107 - RNA, 22 nt, Human
cccacacacuaacaacaacaac

SEQ ID NO: 863108 - RNA, 25 nt, Human
cccacacacuaacaacaacaacaaa

SEQ ID NO: 863109 - RNA, 22 nt, Human
cccccaaacccuggacugacuu

SEQ ID NO: 863110 - RNA, 22 nt, Human
cccccuagcaaucccaccccgg

SEQ ID NO: 863111 - RNA, 25 nt, Human
ccccgcgcucagcccuuggugcccu

SEQ ID NO: 863112 - RNA, 19 nt, Human
ccccuagcaaucccacccc

SEQ ID NO: 863113 - RNA, 21 nt, Human
ccgugggcgccggaccuuggc

SEQ ID NO: 863114 - RNA, 21 nt, Human
ccucagcuaaaccugagaucc

SEQ ID NO: 863115 - RNA, 25 nt, Human
ccucccaaagacaucccucuagggg

SEQ ID NO: 863116 - RNA, 24 nt, Human
ccuccuugcuucucccuggcacaa

SEQ ID NO: 863117 - RNA, 23 nt, Human
ccucugaaacaaccacugagucu

SEQ ID NO: 863118 - RNA, 18 nt, Human
ccugagauccaagcgcuc

SEQ ID NO: 863119 - RNA, 22 nt, Human
ccuggauuaaagcccugugggc

SEQ ID NO: 863120 - RNA, 20 nt, Human
ccuguaaucccagcuauccg

SEQ ID NO: 863121 - RNA, 21 nt, Human
ccuguaaucccagcuauccgg

SEQ ID NO: 863122 - RNA, 19 nt, Human
ccuguagucccagcuacuc

SEQ ID NO: 863123 - RNA, 21 nt, Human
ccuguagucccagcuacucgg

SEQ ID NO: 863124 - RNA, 22 nt, Human
ccuguagucccagcuacucggg

SEQ ID NO: 863125 - RNA, 24 nt, Human
cgagaccagccugaccuacauagu

SEQ ID NO: 863126 - RNA, 24 nt, Human
cgagaucacgccacugcacuccag

SEQ ID NO: 863127 - RNA, 27 nt, Human
cgccacugcacuccagcccugggcgac

SEQ ID NO: 863128 - RNA, 24 nt, Human
cgccuguaaucccagcuauccggg

SEQ ID NO: 863129 - RNA, 22 nt, Human
cggaagacagaaaaaugggcaa

SEQ ID NO: 863130 - RNA, 18 nt, Human
cggaagcaggaaaugcua

SEQ ID NO: 863131 - RNA, 22 nt, Human
cggaagcaggaaaugcuaaagg

SEQ ID NO: 863132 - RNA, 22 nt, Human
cggaucacgaggucaggaguuc

SEQ ID NO: 863133 - RNA, 22 nt, Human
cucacaccuguaaucccagcac

SEQ ID NO: 863134 - RNA, 24 nt, Human
cucacaccuguaaucccagcacuu

SEQ ID NO: 863135 - RNA, 18 nt, Human
cuccaaccaguauacuug

SEQ ID NO: 863136 - RNA, 23 nt, Human
cuccaagcccagccuggcucuuc

SEQ ID NO: 863137 - RNA, 21 nt, Human
cuccaaucuuucuucuguacc

SEQ ID NO: 863138 - RNA, 23 nt, Human
cugcccagugcaccccacaaacu

SEQ ID NO: 863139 - RNA, 18 nt, Human
cugggauggcaacaaggg

SEQ ID NO: 863140 - RNA, 21 nt, Human
cuucccucccaaagacauccc

SEQ ID NO: 863141 - RNA, 22 nt, Human
cuucucccuggcacaagggcca

SEQ ID NO: 863142 - RNA, 19 nt, Human
cuugggcccuggaagucga

SEQ ID NO: 863143 - RNA, 26 nt, Human
cuugggcccuggaagucgaggcuuca

SEQ ID NO: 863144 - RNA, 20 nt, Human
gaacccgggaggcagagcuu

SEQ ID NO: 863145 - RNA, 18 nt, Human
gaacugaaagaaccaaua

SEQ ID NO: 863146 - RNA, 19 nt, Human
gaccuugucuccaaaaaca

SEQ ID NO: 863147 - RNA, 18 nt, Human
gacuggagcuccugcgaa

SEQ ID NO: 863148 - RNA, 19 nt, Human
gagagccccggacuggagc

SEQ ID NO: 863149 - RNA, 19 nt, Human
gagcuccugcgaacucccc

SEQ ID NO: 863150 - RNA, 18 nt, Human
gagcuugcagugagccga

SEQ ID NO: 863151 - RNA, 24 nt, Human
gaggugggcggauugggcggauca

SEQ ID NO: 863152 - RNA, 21 nt, Human
gaucacgaggucaggaguucg

SEQ ID NO: 863153 - RNA, 22 nt, Human
gaucacgaggucaggaguucga

SEQ ID NO: 863154 - RNA, 24 nt, Human
gaucacgaggucaggaguucgaga

SEQ ID NO: 863155 - RNA, 21 nt, Human
gaucgcgccacugcacuccag

SEQ ID NO: 863156 - RNA, 24 nt, Human
gauugggcggaucacgaggucagg

SEQ ID NO: 863157 - RNA, 22 nt, Human
gcaaauggagauccccacucuc

SEQ ID NO: 863158 - RNA, 24 nt, Human
gcaacagagugagacucugucuca

SEQ ID NO: 863159 - RNA, 25 nt, Human
gccacugcacuccagcccugggcga

SEQ ID NO: 863160 - RNA, 23 nt, Human
gccacugcacuccagcugggcaa

SEQ ID NO: 863161 - RNA, 24 nt, Human
gccacugcacuccagcugggcaac

SEQ ID NO: 863162 - RNA, 19 nt, Human
gccaugaucgcgccacugc

SEQ ID NO: 863163 - RNA, 21 nt, Human
gcccugugggccaagaguugu

SEQ ID NO: 863164 - RNA, 20 nt, Human
gccgagaucacgccacugca

SEQ ID NO: 863165 - RNA, 23 nt, Human
gccuguagucccagcuacucggg

SEQ ID NO: 863166 - RNA, 21 nt, Human
gcggcaacagcuugcggcugc

SEQ ID NO: 863167 - RNA, 18 nt, Human
gcggcgaaggcggcgcca

SEQ ID NO: 863168 - RNA, 24 nt, Human
gcgggccagggccgagacgcgagu

SEQ ID NO: 863169 - RNA, 22 nt, Human
gcugaggcaggagaauggcgug

SEQ ID NO: 863170 - RNA, 20 nt, Human
gcugggcgcaggggcuggcg

SEQ ID NO: 863171 - RNA, 18 nt, Human
gcuucauuuucugaugca

SEQ ID NO: 863172 - RNA, 25 nt, Human
ggaaacgucggaagacagaaaaaug

SEQ ID NO: 863173 - RNA, 19 nt, Human
ggaagacagaaaaaugggc

SEQ ID NO: 863174 - RNA, 24 nt, Human
ggagaugccacugcaggacccaag

SEQ ID NO: 863175 - RNA, 18 nt, Human
ggagcuccugcgaacucc

SEQ ID NO: 863176 - RNA, 22 nt, Human
ggaugcugggaggagccugggc

SEQ ID NO: 863177 - RNA, 24 nt, Human
ggcagaugggacuuuugagagaaa

SEQ ID NO: 863178 - RNA, 19 nt, Human
ggccgugguggcgggcgcc

SEQ ID NO: 863179 - RNA, 20 nt, Human
ggccgugguggcgggcgccu

SEQ ID NO: 863180 - RNA, 24 nt, Human
ggccgugguggcgggcgccuguag

SEQ ID NO: 863181 - RNA, 20 nt, Human
ggcgccggaccuuggcuugg

SEQ ID NO: 863182 - RNA, 19 nt, Human
ggcggaucacgaggucagg

SEQ ID NO: 863183 - RNA, 23 nt, Human
ggcggaucacgaggucaggaguu

SEQ ID NO: 863184 - RNA, 23 nt, Human
ggcgugggcuacgcgcuccucgu

SEQ ID NO: 863185 - RNA, 21 nt, Human
ggcucacaccuguaaucccag

SEQ ID NO: 863186 - RNA, 26 nt, Human
ggcugugcaggcggccauggauuccu

SEQ ID NO: 863187 - RNA, 20 nt, Human
gggaggccgaggugggcgga

SEQ ID NO: 863188 - RNA, 22 nt, Human
gggagguugaggcaggaggauc

SEQ ID NO: 863189 - RNA, 25 nt, Human
gggcaaauggagauccccacucucu

SEQ ID NO: 863190 - RNA, 20 nt, Human
gggccagggccgagacgcga

SEQ ID NO: 863191 - RNA, 24 nt, Human
gggcgcgguggcucacaccuguaa

SEQ ID NO: 863192 - RNA, 18 nt, Human
gggcgcucuagccugcgc

SEQ ID NO: 863193 - RNA, 19 nt, Human
gggcggguggagagccccg

SEQ ID NO: 863194 - RNA, 24 nt, Human
gggcgugguggugcacgccuguaa

SEQ ID NO: 863195 - RNA, 24 nt, Human
gguggcgggcgccuguagucccag

SEQ ID NO: 863196 - RNA, 23 nt, Human
gguggcucacaccuguaauccca

SEQ ID NO: 863197 - RNA, 24 nt, Human
gguggcucacaccuguaaucccag

SEQ ID NO: 863198 - RNA, 24 nt, Human
gguggugcacgccuguaaucccag

SEQ ID NO: 863199 - RNA, 19 nt, Human
guuuacucuuuggcaggag

SEQ ID NO: 863200 - RNA, 18 nt, Human
uaaaauaaauguuaaaga

SEQ ID NO: 863201 - RNA, 22 nt, Human
uaacaacaacaacaaaaccaaa

SEQ ID NO: 863202 - RNA, 20 nt, Human
uacauagugaaacucuuucu

SEQ ID NO: 863203 - RNA, 23 nt, Human
uaucgugaccccgggagagcggc

SEQ ID NO: 863204 - RNA, 20 nt, Human
ucaacccccucagcuaaacc

SEQ ID NO: 863205 - RNA, 18 nt, Human
ucacgaggucaggaguuc

SEQ ID NO: 863206 - RNA, 24 nt, Human
ucacgaggucaggaguucgagacc

SEQ ID NO: 863207 - RNA, 22 nt, Human
ucacgccacugcacuccagcug

SEQ ID NO: 863208 - RNA, 23 nt, Human
ucacuuuggucuuggaagaaggc

SEQ ID NO: 863209 - RNA, 22 nt, Human
ucagggcaggggaaaaugccca

SEQ ID NO: 863210 - RNA, 19 nt, Human
uccaagcgcuccggauucc

SEQ ID NO: 863211 - RNA, 25 nt, Human
uccagcccugggcgacagagcgaga

SEQ ID NO: 863212 - RNA, 23 nt, Human
uccagcugggcaacagagugaga

SEQ ID NO: 863213 - RNA, 18 nt, Human
ucccaaccugguauguuu

SEQ ID NO: 863214 - RNA, 21 nt, Human
uccgcaaggcgggccagggcc

SEQ ID NO: 863215 - RNA, 18 nt, Human
uccucugucccagagagg

SEQ ID NO: 863216 - RNA, 23 nt, Human
ucuaggguccugugggcuccaag

SEQ ID NO: 863217 - RNA, 21 nt, Human
ucuaugguuucugcuauaggg

SEQ ID NO: 863218 - RNA, 18 nt, Human
ucucaaaaagcaaaaaag

SEQ ID NO: 863219 - RNA, 23 nt, Human
ucuccaaccaguauacuugacuu

SEQ ID NO: 863220 - RNA, 24 nt, Human
ucuccgggguccugugagcugccg

SEQ ID NO: 863221 - RNA, 18 nt, Human
ucucuacuaaaaauacaa

SEQ ID NO: 863222 - RNA, 22 nt, Human
ucucuacuaaaaauacaaaaaa

SEQ ID NO: 863223 - RNA, 23 nt, Human
ucugaaacaaccacugagucuga

SEQ ID NO: 863224 - RNA, 23 nt, Human
ucugucccagagaggguugggca

SEQ ID NO: 863225 - RNA, 19 nt, Human
ucuuggaagaaggccucag

SEQ ID NO: 863226 - RNA, 18 nt, Human
ucuuggacaccucaaccc

SEQ ID NO: 863227 - RNA, 21 nt, Human
ucuuucuucuguaccuucuuc

SEQ ID NO: 863228 - RNA, 21 nt, Human
ugaaaacaaagcaaaacagcc

SEQ ID NO: 863229 - RNA, 22 nt, Human
ugaaacaaccacugagucugaa

SEQ ID NO: 863230 - RNA, 24 nt, Human
ugaacugaaagaaccaauaaaauc

SEQ ID NO: 863231 - RNA, 20 nt, Human
ugaaggcuggcuccaguuga

SEQ ID NO: 863232 - RNA, 23 nt, Human
ugaaggcuggcuccaguugagaa

SEQ ID NO: 863233 - RNA, 20 nt, Human
ugaccccgggagagcggcgg

SEQ ID NO: 863234 - RNA, 18 nt, Human
ugacugcaggaaaccaca

SEQ ID NO: 863235 - RNA, 22 nt, Human
ugagccgagaucacgccacugc

SEQ ID NO: 863236 - RNA, 23 nt, Human
ugaggcaggagaauggcgugaac

SEQ ID NO: 863237 - RNA, 24 nt, Human
ugaggcaggagaauggcgugaacc

SEQ ID NO: 863238 - RNA, 25 nt, Human
ugaggcaggagaauggcgugaaccc

SEQ ID NO: 863239 - RNA, 24 nt, Human
ugaggcaggaggaucgcuugggcc

SEQ ID NO: 863240 - RNA, 25 nt, Human
ugaggcaggaggaucgcuugggccc

SEQ ID NO: 863241 - RNA, 18 nt, Human
ugaggggauggagaggga

SEQ ID NO: 863242 - RNA, 21 nt, Human
ugccagcacuucuuggacacc

SEQ ID NO: 863243 - RNA, 19 nt, Human
ugcccagugcaccccacaa

SEQ ID NO: 863244 - RNA, 18 nt, Human
ugcuaagcgauuauacgc

SEQ ID NO: 863245 - RNA, 22 nt, Human
ugcugcccagugcaccccacaa

SEQ ID NO: 863246 - RNA, 22 nt, Human
ugcugggaggagccugggcuau

SEQ ID NO: 863247 - RNA, 26 nt, Human
uggacugacugcuuuaagguccgcaa

SEQ ID NO: 863248 - RNA, 19 nt, Human
uggauuaaagcccuguggg

SEQ ID NO: 863249 - RNA, 21 nt, Human
uggcucacaccuguaauccca

SEQ ID NO: 863250 - RNA, 22 nt, Human
uggcucacaccuguaaucccag

SEQ ID NO: 863251 - RNA, 24 nt, Human
uggcucacaccuguaaucccagca

SEQ ID NO: 863252 - RNA, 19 nt, Human
ugggaggccgaggugggcg

SEQ ID NO: 863253 - RNA, 22 nt, Human
ugggaggccgaggugggcggau

SEQ ID NO: 863254 - RNA, 24 nt, Human
ugggaggccgaggugggcggauug

SEQ ID NO: 863255 - RNA, 21 nt, Human
ugggcaacagagugagacucu

SEQ ID NO: 863256 - RNA, 24 nt, Human
ugguagucccgaggaagggugggc

SEQ ID NO: 863257 - RNA, 19 nt, Human
uggugaacugaaagaacca

SEQ ID NO: 863258 - RNA, 20 nt, Human
uggugauucuuagagugcaa

SEQ ID NO: 863259 - RNA, 21 nt, Human
uggugcacgccuguaauccca

SEQ ID NO: 863260 - RNA, 22 nt, Human
uggugcacgccuguaaucccag

SEQ ID NO: 863261 - RNA, 24 nt, Human
ugguggcgggcgccuguaguccca

SEQ ID NO: 863262 - RNA, 24 nt, Human
ugguggugcacgccuguaauccca

SEQ ID NO: 863263 - RNA, 22 nt, Human
ugguguuuacucuuuggcagga

SEQ ID NO: 863264 - RNA, 22 nt, Human
ugguuggcggcgaaggcggcgc

SEQ ID NO: 863265 - RNA, 23 nt, Human
ugugagcugccgucgggugagca

SEQ ID NO: 863266 - RNA, 23 nt, Human
uguguaccaugacgagaaaagga

SEQ ID NO: 863267 - RNA, 21 nt, Human
uguguagaugcccuccaugcg

SEQ ID NO: 863268 - RNA, 19 nt, Human
uguguauguguguagaugc

SEQ ID NO: 863269 - RNA, 23 nt, Human
uucaccucacuggauuccaccac

SEQ ID NO: 863270 - RNA, 20 nt, Human
uucagagugcuagggcuuua

SEQ ID NO: 863271 - RNA, 21 nt, Human
uucagugagccaugaucgcgc

SEQ ID NO: 863272 - RNA, 24 nt, Human
uucucccuggcacaagggccaugg

SEQ ID NO: 863273 - RNA, 18 nt, Human
uugcagugagccgagauc

SEQ ID NO: 863274 - RNA, 20 nt, Human
uugcagugagccgagaucac

SEQ ID NO: 863275 - RNA, 21 nt, Human
uugcagugagccgagaucacg

SEQ ID NO: 863276 - RNA, 24 nt, Human
uuuccucugucccagagaggguug

SEQ ID NO: 863277 - RNA, 21 nt, Human
uuucugcuauagggcgcucua

SEQ ID NO: 863278 - RNA, 24 nt, Human
uuuuccucugucccagagaggguu

SEQ ID NO: 863279 - RNA, 22 nt, Human
uuuuuuuuuuuuuuuuuuucag

SEQ ID NO: 863280 - RNA, 20 nt, Human
accgcccccgucauacaugc

SEQ ID NO: 863281 - RNA, 18 nt, Human
acuggccuccauucuggc

SEQ ID NO: 863282 - RNA, 19 nt, Human
agcgccggccccaggaggg

SEQ ID NO: 863283 - RNA, 19 nt, Human
aggaagggggccagaaagc

SEQ ID NO: 863284 - RNA, 24 nt, Human
aggcacacgagaugcaggcagcgg

SEQ ID NO: 863285 - RNA, 21 nt, Human
aggcugaggucuccucugugu

SEQ ID NO: 863286 - RNA, 21 nt, Human
cacacagcgcucacagugcag

SEQ ID NO: 863287 - RNA, 18 nt, Human
cagccaggcauccucaca

SEQ ID NO: 863288 - RNA, 21 nt, Human
cagcccgggucacaccugcag

SEQ ID NO: 863289 - RNA, 20 nt, Human
cagcgcucacagugcagccc

SEQ ID NO: 863290 - RNA, 22 nt, Human
caggagccgucaggugcacagc

SEQ ID NO: 863291 - RNA, 19 nt, Human
caggagggacggacggaug

SEQ ID NO: 863292 - RNA, 21 nt, Human
caucugugugcuccucugcuc

SEQ ID NO: 863293 - RNA, 20 nt, Human
cauucuggcagggggacugc

SEQ ID NO: 863294 - RNA, 21 nt, Human
cccgggucacaccugcaggag

SEQ ID NO: 863295 - RNA, 23 nt, Human
ccucccagcccgggucacaccug

SEQ ID NO: 863296 - RNA, 20 nt, Human
cggccggacgcguggacacc

SEQ ID NO: 863297 - RNA, 22 nt, Human
cucccagcccgggucacaccug

SEQ ID NO: 863298 - RNA, 21 nt, Human
cucugcuccuccucgcccucc

SEQ ID NO: 863299 - RNA, 20 nt, Human
cuggccuccauucuggcagg

SEQ ID NO: 863300 - RNA, 21 nt, Human
cugugugcuccucugcuccuc

SEQ ID NO: 863301 - RNA, 19 nt, Human
cuucaucugugugcuccuc

SEQ ID NO: 863302 - RNA, 22 nt, Human
gacggccggacgcguggacacc

SEQ ID NO: 863303 - RNA, 18 nt, Human
ggccaggucacaguggga

SEQ ID NO: 863304 - RNA, 21 nt, Human
uacccaagcugaaggguggug

SEQ ID NO: 863305 - RNA, 26 nt, Human
uacccaagcugaaggguggugagaac

SEQ ID NO: 863306 - RNA, 19 nt, Human
ucacagugggagcugcagu

SEQ ID NO: 863307 - RNA, 24 nt, Human
ucaucugugugcuccucugcuccu

SEQ ID NO: 863308 - RNA, 18 nt, Human
ucuggugugaggcugagg

SEQ ID NO: 863309 - RNA, 21 nt, Human
ugaccgggagcccccagaaug

SEQ ID NO: 863310 - RNA, 19 nt, Human
ugccauggcugguggcagg

SEQ ID NO: 863311 - RNA, 20 nt, Human
uggaagaggugaggaagggg

SEQ ID NO: 863312 - RNA, 19 nt, Human
uggccuccauucuggcagg

SEQ ID NO: 863313 - RNA, 21 nt, Human
ugguggcagguaccgugcugg

SEQ ID NO: 863314 - RNA, 25 nt, Human
uuuuuuuuuuuuuuuuuugcauuuu

SEQ ID NO: 863315 - RNA, 27 nt, Human
uuuuuuuuuuuuuuuuuuuuuuugggg

SEQ ID NO: 863316 - RNA, 21 nt, Human
aaaagagccacucagccugga

SEQ ID NO: 863317 - RNA, 23 nt, Human
aaacugcuucuacuuuuugacua

SEQ ID NO: 863318 - RNA, 18 nt, Human
aaauacacccuaaguuac

SEQ ID NO: 863319 - RNA, 24 nt, Human
aaccaacugaaguaugaaaacaaa

SEQ ID NO: 863320 - RNA, 25 nt, Human
aacuacucuuccaaacugcuucuac

SEQ ID NO: 863321 - RNA, 25 nt, Human
aagaggaaaacacagaauacaagaa

SEQ ID NO: 863322 - RNA, 20 nt, Human
aagcaauaccuuaggaacaa

SEQ ID NO: 863323 - RNA, 23 nt, Human
aagcaauaccuuaggaacaacca

SEQ ID NO: 863324 - RNA, 21 nt, Human
aagggaccuugucucaaaaac

SEQ ID NO: 863325 - RNA, 20 nt, Human
aaggucuucugcuggacucu

SEQ ID NO: 863326 - RNA, 24 nt, Human
acacagagguugcagugagccaag

SEQ ID NO: 863327 - RNA, 22 nt, Human
acagagguugcagugagccaag

SEQ ID NO: 863328 - RNA, 21 nt, Human
acuacucuuccaaacugcuuc

SEQ ID NO: 863329 - RNA, 18 nt, Human
acucuaaccugggugaca

SEQ ID NO: 863330 - RNA, 18 nt, Human
agaggugcccaggucauc

SEQ ID NO: 863331 - RNA, 22 nt, Human
agagguugcagugagccaagau

SEQ ID NO: 863332 - RNA, 24 nt, Human
agagguugcagugagccaagauug

SEQ ID NO: 863333 - RNA, 19 nt, Human
agaguugacaaagcaaauc

SEQ ID NO: 863334 - RNA, 21 nt, Human
agcaaaguggaccaaaaaaga

SEQ ID NO: 863335 - RNA, 19 nt, Human
agcauggugacacgcaccu

SEQ ID NO: 863336 - RNA, 24 nt, Human
agccuggacaauauagugaggccu

SEQ ID NO: 863337 - RNA, 25 nt, Human
agccuggacaauauagugaggccuc

SEQ ID NO: 863338 - RNA, 23 nt, Human
agcuacuugggaggcugaggcag

SEQ ID NO: 863339 - RNA, 23 nt, Human
aggacacagagguugcagugagc

SEQ ID NO: 863340 - RNA, 18 nt, Human
aggcagauuccaaaacca

SEQ ID NO: 863341 - RNA, 18 nt, Human
aggcaggaggaucacuug

SEQ ID NO: 863342 - RNA, 23 nt, Human
aggcaggaggaucacuugagccc

SEQ ID NO: 863343 - RNA, 24 nt, Human
aggcaggaggaucacuugagccca

SEQ ID NO: 863344 - RNA, 24 nt, Human
aggcugaggcaggaggaucacuug

SEQ ID NO: 863345 - RNA, 21 nt, Human
aucuacucuaaccugggugac

SEQ ID NO: 863346 - RNA, 23 nt, Human
caaagcaaaucuaauaaaaagua

SEQ ID NO: 863347 - RNA, 23 nt, Human
caagcaauaccuuaggaacaacc

SEQ ID NO: 863348 - RNA, 22 nt, Human
caauugcuuaacaucaccaggu

SEQ ID NO: 863349 - RNA, 24 nt, Human
caccugugguccuagcuacuuggg

SEQ ID NO: 863350 - RNA, 21 nt, Human
cacuucauaccucagcaaagu

SEQ ID NO: 863351 - RNA, 23 nt, Human
cacuucucuucuuuccuuauuca

SEQ ID NO: 863352 - RNA, 19 nt, Human
cagaaagggaccuugucuc

SEQ ID NO: 863353 - RNA, 25 nt, Human
ccaaaaaagaggaaaacacagaaua

SEQ ID NO: 863354 - RNA, 26 nt, Human
ccaaaaaagaggaaaacacagaauac

SEQ ID NO: 863355 - RNA, 20 nt, Human
ccacuucucuucuuuccuua

SEQ ID NO: 863356 - RNA, 19 nt, Human
ccaggacacagagguugca

SEQ ID NO: 863357 - RNA, 18 nt, Human
cccaggucaucucggcga

SEQ ID NO: 863358 - RNA, 27 nt, Human
cucucuuucuguucucagccucugccc

SEQ ID NO: 863359 - RNA, 23 nt, Human
cuuuuagccaccuggcucuugau

SEQ ID NO: 863360 - RNA, 20 nt, Human
gaaaaaggacuucuugauaa

SEQ ID NO: 863361 - RNA, 24 nt, Human
gaucacuugagcccaggacacaga

SEQ ID NO: 863362 - RNA, 22 nt, Human
gcagauuccaaaaccaacugaa

SEQ ID NO: 863363 - RNA, 20 nt, Human
gccuggacaauauagugagg

SEQ ID NO: 863364 - RNA, 18 nt, Human
gggauuuauuuuggaaau

SEQ ID NO: 863365 - RNA, 19 nt, Human
guacagaauuggaaaaagg

SEQ ID NO: 863366 - RNA, 21 nt, Human
uaaaacacauauauuuaaugu

SEQ ID NO: 863367 - RNA, 24 nt, Human
uacaagaaagaguugacaaagcaa

SEQ ID NO: 863368 - RNA, 19 nt, Human
uacagccccuccacccucu

SEQ ID NO: 863369 - RNA, 20 nt, Human
uacagccccuccacccucuc

SEQ ID NO: 863370 - RNA, 22 nt, Human
uaccuuaggaacaaccauugcu

SEQ ID NO: 863371 - RNA, 20 nt, Human
uacucuaaccugggugacag

SEQ ID NO: 863372 - RNA, 20 nt, Human
uaguacacuucauaccucag

SEQ ID NO: 863373 - RNA, 21 nt, Human
uauaaggcagauuccaaaacc

SEQ ID NO: 863374 - RNA, 22 nt, Human
uaucuuuaacuggucauggcuu

SEQ ID NO: 863375 - RNA, 23 nt, Human
uaugauucuacuuuuugacaggc

SEQ ID NO: 863376 - RNA, 23 nt, Human
uauuagaagacucagaugcuuca

SEQ ID NO: 863377 - RNA, 25 nt, Human
ucacuccguugccaauguccucaau

SEQ ID NO: 863378 - RNA, 23 nt, Human
ucucauccaaagaguaagccaaa

SEQ ID NO: 863379 - RNA, 21 nt, Human
ucugcaaauaucuuuaacugg

SEQ ID NO: 863380 - RNA, 24 nt, Human
ugacacgcaccugugguccuagcu

SEQ ID NO: 863381 - RNA, 22 nt, Human
ugacagaaagggaccuugucuc

SEQ ID NO: 863382 - RNA, 19 nt, Human
ugaccaagguguaacucug

SEQ ID NO: 863383 - RNA, 20 nt, Human
ugaccaagguguaacucugc

SEQ ID NO: 863384 - RNA, 21 nt, Human
ugacuuaaccaaugcccuaga

SEQ ID NO: 863385 - RNA, 19 nt, Human
ugagccaagauugugccac

SEQ ID NO: 863386 - RNA, 22 nt, Human
ugagccaagauugugccacuga

SEQ ID NO: 863387 - RNA, 20 nt, Human
ugaggcaggaggaucacuug

SEQ ID NO: 863388 - RNA, 24 nt, Human
ugaggcaggaggaucacuugagcc

SEQ ID NO: 863389 - RNA, 25 nt, Human
ugaggcaggaggaucacuugagccc

SEQ ID NO: 863390 - RNA, 23 nt, Human
ugaucaguauuugccgauucaac

SEQ ID NO: 863391 - RNA, 23 nt, Human
ugaucuaucauuuugaucacucc

SEQ ID NO: 863392 - RNA, 22 nt, Human
ugauuugaacaguccuuauggu

SEQ ID NO: 863393 - RNA, 23 nt, Human
ugauuugaacaguccuuaugguu

SEQ ID NO: 863394 - RNA, 18 nt, Human
uggaaauaaaccaacuuc

SEQ ID NO: 863395 - RNA, 20 nt, Human
ugggaggcugaggcaggagg

SEQ ID NO: 863396 - RNA, 24 nt, Human
ugggaggcugaggcaggaggauca

SEQ ID NO: 863397 - RNA, 22 nt, Human
uuacagccccuccacccucucu

SEQ ID NO: 863398 - RNA, 23 nt, Human
uuccaaaaccaacugaaguauga

SEQ ID NO: 863399 - RNA, 22 nt, Human
uucuaccgccucaucuucucug

SEQ ID NO: 863400 - RNA, 20 nt, Human
uucucagccucugccacuuc

SEQ ID NO: 863401 - RNA, 18 nt, Human
uucuccccuuuccuuggg

SEQ ID NO: 863402 - RNA, 21 nt, Human
uugacuacugccuccuacacu

SEQ ID NO: 863403 - RNA, 20 nt, Human
uugaugcuuaugagugugaa

SEQ ID NO: 863404 - RNA, 22 nt, Human
uugcagugagccaagauugugc

SEQ ID NO: 863405 - RNA, 19 nt, Human
uugcuacaugcuucuuucc

SEQ ID NO: 863406 - RNA, 25 nt, Human
uugggaggcugaggcaggaggauca

SEQ ID NO: 863407 - RNA, 23 nt, Human
uuuaaaacacauauauuuaaugu

SEQ ID NO: 863408 - RNA, 21 nt, Human
uuuguaacuacucuuccaaac

SEQ ID NO: 863409 - RNA, 18 nt, Human
uuuuaggccucaugaucu

SEQ ID NO: 863410 - RNA, 19 nt, Human
uuuuuugucaggggauuua

SEQ ID NO: 863411 - RNA, 20 nt, Human
uuuuuuuuuuaaaacacaua

SEQ ID NO: 863412 - RNA, 19 nt, Human
agaaggcucgggcagaguc

SEQ ID NO: 863413 - RNA, 24 nt, Human
agcgguacuuucuggcuggcuuga

SEQ ID NO: 863414 - RNA, 21 nt, Human
agggggccccuguguaggggu

SEQ ID NO: 863415 - RNA, 18 nt, Human
auggagcaaaggaguaga

SEQ ID NO: 863416 - RNA, 21 nt, Human
cagcucucaucccccagcccc

SEQ ID NO: 863417 - RNA, 20 nt, Human
cagcuucuugggggccuccu

SEQ ID NO: 863418 - RNA, 21 nt, Human
ccccuuuggugcucacuaccu

SEQ ID NO: 863419 - RNA, 19 nt, Human
ccgucgggcgccgccggcg

SEQ ID NO: 863420 - RNA, 23 nt, Human
gccucaggguuccgcacaucuuu

SEQ ID NO: 863421 - RNA, 23 nt, Human
ggaguagagaagggggacaggag

SEQ ID NO: 863422 - RNA, 18 nt, Human
gggacaggaguuaggggg

SEQ ID NO: 863423 - RNA, 19 nt, Human
gggggccccuguguagggg

SEQ ID NO: 863424 - RNA, 18 nt, Human
ucaucuccucggccucag

SEQ ID NO: 863425 - RNA, 20 nt, Human
ucccucugggaucugagccu

SEQ ID NO: 863426 - RNA, 18 nt, Human
ucgcuccccuuuggugcu

SEQ ID NO: 863427 - RNA, 24 nt, Human
ucggaucagcuucuugggggccuc

SEQ ID NO: 863428 - RNA, 22 nt, Human
ugagguugauguauguggccuu

SEQ ID NO: 863429 - RNA, 24 nt, Human
uuccgcacaucuuugaaucgcucc

SEQ ID NO: 863430 - RNA, 19 nt, Human
uuccuugggccaccuuuac

SEQ ID NO: 863431 - RNA, 22 nt, Human
uuuuuuuuuuccuugggccacc

SEQ ID NO: 863432 - RNA, 26 nt, Human
uuuuuuuuuuuuuuuuuuuccuuggg

SEQ ID NO: 863433 - RNA, 18 nt, Human
ccucgcagccuggccugg

SEQ ID NO: 863434 - RNA, 19 nt, Human
gcccaagguccuucccagc

SEQ ID NO: 863435 - RNA, 20 nt, Human
gcccucucccuccugccggg

SEQ ID NO: 863436 - RNA, 19 nt, Human
gcuggcggugugcccucuc

SEQ ID NO: 863437 - RNA, 22 nt, Human
ggguccgcggcccucgcagccu

SEQ ID NO: 863438 - RNA, 19 nt, Human
ucgcagccuggccuggggc

SEQ ID NO: 863439 - RNA, 22 nt, Human
agagaguucugcagugcccccg

SEQ ID NO: 863440 - RNA, 20 nt, Human
aggaggacccggcagcugug

SEQ ID NO: 863441 - RNA, 20 nt, Human
cagugucaagcuggcagcgc

SEQ ID NO: 863442 - RNA, 19 nt, Human
ccggcagcuguggccaccc

SEQ ID NO: 863443 - RNA, 22 nt, Human
gccgcgacccggacgcuuuggc

SEQ ID NO: 863444 - RNA, 20 nt, Human
ggaagggugaaggcauuuua

SEQ ID NO: 863445 - RNA, 20 nt, Human
uagcucugaagcucaaucau

SEQ ID NO: 863446 - RNA, 21 nt, Human
ucccacucgccgcgacccgga

SEQ ID NO: 863447 - RNA, 21 nt, Human
ucugcagugcccccgcauugg

SEQ ID NO: 863448 - RNA, 23 nt, Human
ugaagcucaaucaugacauuucu

SEQ ID NO: 863449 - RNA, 18 nt, Human
uggcuggauuccccagug

SEQ ID NO: 863450 - RNA, 21 nt, Human
uggcuggauuccccaguguca

SEQ ID NO: 863451 - RNA, 20 nt, Human
uuccccagugucaagcuggc

SEQ ID NO: 863452 - RNA, 24 nt, Human
uucucgggucccaggggccgcggg

SEQ ID NO: 863453 - RNA, 19 nt, Human
agaguugcaggacagggga

SEQ ID NO: 863454 - RNA, 25 nt, Human
agccugguucagagaagggccccaa

SEQ ID NO: 863455 - RNA, 18 nt, Human
aggccaggggagggcugg

SEQ ID NO: 863456 - RNA, 22 nt, Human
agggccccaaaagguaggccag

SEQ ID NO: 863457 - RNA, 23 nt, Human
cagaguugcaggacaggggagcc

SEQ ID NO: 863458 - RNA, 18 nt, Human
cagcaggaccaugccccu

SEQ ID NO: 863459 - RNA, 18 nt, Human
ccaggggagggcuggggg

SEQ ID NO: 863460 - RNA, 23 nt, Human
cccaggauugcccaucuuucuca

SEQ ID NO: 863461 - RNA, 21 nt, Human
ccccaaaagguaggccagggg

SEQ ID NO: 863462 - RNA, 18 nt, Human
cccugugaaugacagagu

SEQ ID NO: 863463 - RNA, 22 nt, Human
ccucaagccagcccaggauugc

SEQ ID NO: 863464 - RNA, 18 nt, Human
ccucugcccaugauuccc

SEQ ID NO: 863465 - RNA, 20 nt, Human
ccugguucagagaagggccc

SEQ ID NO: 863466 - RNA, 19 nt, Human
cucugcccaugauucccuc

SEQ ID NO: 863467 - RNA, 21 nt, Human
gacuugcuucuggcugggcug

SEQ ID NO: 863468 - RNA, 20 nt, Human
gagggcugggggcugggacu

SEQ ID NO: 863469 - RNA, 22 nt, Human
gcugggggcugggacuugcuuc

SEQ ID NO: 863470 - RNA, 21 nt, Human
ggagggcugggggcugggacu

SEQ ID NO: 863471 - RNA, 20 nt, Human
gggcugggggcugggacuug

SEQ ID NO: 863472 - RNA, 27 nt, Human
ggggcugggacuugcuucuggcugggc

SEQ ID NO: 863473 - RNA, 19 nt, Human
uaaucucuggccccauccc

SEQ ID NO: 863474 - RNA, 23 nt, Human
uccagacauuuacugucuagacu

SEQ ID NO: 863475 - RNA, 27 nt, Human
ucucacaacaccccugugucacaugaa

SEQ ID NO: 863476 - RNA, 18 nt, Human
ucucuggccccaucccag

SEQ ID NO: 863477 - RNA, 23 nt, Human
ucuggccccaucccagcucucac

SEQ ID NO: 863478 - RNA, 20 nt, Human
ugucuagacuggcuacggga

SEQ ID NO: 863479 - RNA, 21 nt, Human
uucauccuagugucucagaug

SEQ ID NO: 863480 - RNA, 21 nt, Human
uuuacugucuagacuggcuac

SEQ ID NO: 863481 - RNA, 21 nt, Human
aaagacugaagcucuaaauaa

SEQ ID NO: 863482 - RNA, 23 nt, Human
aagaaugaagggugauggcacaa

SEQ ID NO: 863483 - RNA, 20 nt, Human
aagagcccucugccuucccg

SEQ ID NO: 863484 - RNA, 23 nt, Human
aaucuucuggguccucuuuauua

SEQ ID NO: 863485 - RNA, 22 nt, Human
accuacacauaugaaaaaaaua

SEQ ID NO: 863486 - RNA, 26 nt, Human
acucaauugggguccagcucccaacu

SEQ ID NO: 863487 - RNA, 19 nt, Human
agaguuccugcaccccaua

SEQ ID NO: 863488 - RNA, 18 nt, Human
aggcaaagguccagggca

SEQ ID NO: 863489 - RNA, 19 nt, Human
caacuuugcugccccaucc

SEQ ID NO: 863490 - RNA, 21 nt, Human
caccagcccgguccucaaaau

SEQ ID NO: 863491 - RNA, 19 nt, Human
caccucaccuuuccugccc

SEQ ID NO: 863492 - RNA, 22 nt, Human
cagcaacaccucaccuuuccug

SEQ ID NO: 863493 - RNA, 19 nt, Human
cagggcccccgugguuucc

SEQ ID NO: 863494 - RNA, 23 nt, Human
caguaguauagucgcaccagccc

SEQ ID NO: 863495 - RNA, 19 nt, Human
cccagaguuccugcacccc

SEQ ID NO: 863496 - RNA, 22 nt, Human
cccauagcccauggcauccauc

SEQ ID NO: 863497 - RNA, 20 nt, Human
ccccaaaagcccaaguugcu

SEQ ID NO: 863498 - RNA, 19 nt, Human
ccccagagagaagugggau

SEQ ID NO: 863499 - RNA, 23 nt, Human
ccccauccccaaaagcccaaguu

SEQ ID NO: 863500 - RNA, 18 nt, Human
ccccgugguuuccgcgcc

SEQ ID NO: 863501 - RNA, 18 nt, Human
ccgcgcccuuuugccaga

SEQ ID NO: 863502 - RNA, 21 nt, Human
ccgcuggcuacagcgccgccc

SEQ ID NO: 863503 - RNA, 22 nt, Human
ccuaccagccacagagccaccc

SEQ ID NO: 863504 - RNA, 18 nt, Human
cgccgccccagagagaag

SEQ ID NO: 863505 - RNA, 19 nt, Human
cucaccuuuccugccccca

SEQ ID NO: 863506 - RNA, 22 nt, Human
cuucagggcccccagaguuccu

SEQ ID NO: 863507 - RNA, 23 nt, Human
cuucagggcccccagaguuccug

SEQ ID NO: 863508 - RNA, 19 nt, Human
gaagggugauggcacaauc

SEQ ID NO: 863509 - RNA, 19 nt, Human
gagggcugccuuucgcugc

SEQ ID NO: 863510 - RNA, 20 nt, Human
gccccauccccaaaagccca

SEQ ID NO: 863511 - RNA, 26 nt, Human
gcgccgccccagagagaagggaacgc

SEQ ID NO: 863512 - RNA, 22 nt, Human
gggaagaaugaagggugauggc

SEQ ID NO: 863513 - RNA, 21 nt, Human
gggaauaagggagacacaaac

SEQ ID NO: 863514 - RNA, 24 nt, Human
ggggagggaagcaaauccuucagg

SEQ ID NO: 863515 - RNA, 20 nt, Human
gggguccagcucccaacuuu

SEQ ID NO: 863516 - RNA, 24 nt, Human
uaacugggaauaagggagacacaa

SEQ ID NO: 863517 - RNA, 23 nt, Human
ucacgaaggcccugugugcucca

SEQ ID NO: 863518 - RNA, 20 nt, Human
uccagggcaauuugcuccca

SEQ ID NO: 863519 - RNA, 23 nt, Human
uccuaccagccacagagccaccc

SEQ ID NO: 863520 - RNA, 23 nt, Human
ucucagggcccccgugguuuccg

SEQ ID NO: 863521 - RNA, 22 nt, Human
ucugccuucccaggggagggaa

SEQ ID NO: 863522 - RNA, 19 nt, Human
ucugggaagaaugaagggu

SEQ ID NO: 863523 - RNA, 18 nt, Human
ugaagggugauggcacaa

SEQ ID NO: 863524 - RNA, 18 nt, Human
ugccccauccccaaaagc

SEQ ID NO: 863525 - RNA, 23 nt, Human
ugcccccauucaggcaaagguug

SEQ ID NO: 863526 - RNA, 21 nt, Human
ugggaagaaugaagggugaug

SEQ ID NO: 863527 - RNA, 19 nt, Human
ugggacccuuagcagaggg

SEQ ID NO: 863528 - RNA, 25 nt, Human
uuuuuuuuuuuaacaaaagaucuca

SEQ ID NO: 863529 - RNA, 18 nt, Human
uuuuuuuuuuuuucccug

SEQ ID NO: 863530 - RNA, 22 nt, Human
uuuuuuuuuuuuuucccuguuu

SEQ ID NO: 863531 - RNA, 21 nt, Human
aaggcuagguguggggagcag

SEQ ID NO: 863532 - RNA, 21 nt, Human
aaggggcagcagggauugcaa

SEQ ID NO: 863533 - RNA, 19 nt, Human
acccuggguggcuaagggg

SEQ ID NO: 863534 - RNA, 24 nt, Human
accuggucucaggucacucugugc

SEQ ID NO: 863535 - RNA, 23 nt, Human
acuaaaguaggcaaggaaagcca

SEQ ID NO: 863536 - RNA, 22 nt, Human
agacccuggguggcuaaggggc

SEQ ID NO: 863537 - RNA, 21 nt, Human
agccagcuccaguggcucugc

SEQ ID NO: 863538 - RNA, 20 nt, Human
aggaucagaggcaucuacca

SEQ ID NO: 863539 - RNA, 21 nt, Human
aggcaggggcaggccccagag

SEQ ID NO: 863540 - RNA, 18 nt, Human
aggcuguugggagcuggg

SEQ ID NO: 863541 - RNA, 19 nt, Human
aggguccggaaucagggug

SEQ ID NO: 863542 - RNA, 23 nt, Human
auagcaaauggaugacagcuggg

SEQ ID NO: 863543 - RNA, 23 nt, Human
caaccuccagagaauaaccuggc

SEQ ID NO: 863544 - RNA, 18 nt, Human
caacugggccuucuugca

SEQ ID NO: 863545 - RNA, 20 nt, Human
caagacagcccucaggguga

SEQ ID NO: 863546 - RNA, 23 nt, Human
cacacaagacccuggguggcuaa

SEQ ID NO: 863547 - RNA, 19 nt, Human
cacacuucacaucuccuag

SEQ ID NO: 863548 - RNA, 22 nt, Human
cacagcaaagcccaauacugcu

SEQ ID NO: 863549 - RNA, 22 nt, Human
caccacauagccagccaggaau

SEQ ID NO: 863550 - RNA, 18 nt, Human
cagaacaaaggcuaggug

SEQ ID NO: 863551 - RNA, 18 nt, Human
cagcgagccauccuggcc

SEQ ID NO: 863552 - RNA, 20 nt, Human
cagcgagccauccuggccca

SEQ ID NO: 863553 - RNA, 18 nt, Human
caggccccagagugggaa

SEQ ID NO: 863554 - RNA, 19 nt, Human
caggccccagagugggaag

SEQ ID NO: 863555 - RNA, 25 nt, Human
caggcugaggaacuacuguccacaa

SEQ ID NO: 863556 - RNA, 23 nt, Human
caguuuggccaccacauagccag

SEQ ID NO: 863557 - RNA, 18 nt, Human
cauccugccucuuccaug

SEQ ID NO: 863558 - RNA, 18 nt, Human
cauccugccucuuccaug

SEQ ID NO: 863559 - RNA, 25 nt, Human
cauccugccucuuccauggcaccua

SEQ ID NO: 863560 - RNA, 24 nt, Human
ccaaacccacacuucacaucuccu

SEQ ID NO: 863561 - RNA, 22 nt, Human
ccacagcaaagcccaauacugc

SEQ ID NO: 863562 - RNA, 19 nt, Human
ccaccugaaggcugagcug

SEQ ID NO: 863563 - RNA, 21 nt, Human
ccaggaaggagaagccgugga

SEQ ID NO: 863564 - RNA, 19 nt, Human
cccacacaagacccugggu

SEQ ID NO: 863565 - RNA, 18 nt, Human
cccaggggcuacauuccc

SEQ ID NO: 863566 - RNA, 18 nt, Human
cccauggagcuaggaagg

SEQ ID NO: 863567 - RNA, 23 nt, Human
ccccuugcguagcaacugcaaau

SEQ ID NO: 863568 - RNA, 21 nt, Human
cccuucauccaccaaccucca

SEQ ID NO: 863569 - RNA, 22 nt, Human
cccuucauccaccaaccuccag

SEQ ID NO: 863570 - RNA, 19 nt, Human
ccuagagcuagucgggccc

SEQ ID NO: 863571 - RNA, 23 nt, Human
ccucacuucuccagcuuuucuca

SEQ ID NO: 863572 - RNA, 23 nt, Human
ccuccagagaauaaccuggcugc

SEQ ID NO: 863573 - RNA, 21 nt, Human
ccuuaaccaaacccacacuuc

SEQ ID NO: 863574 - RNA, 18 nt, Human
ccuugaagccacagucuu

SEQ ID NO: 863575 - RNA, 21 nt, Human
cuacagguuuccuguaccugg

SEQ ID NO: 863576 - RNA, 25 nt, Human
cucagggugaacagagaggucagga

SEQ ID NO: 863577 - RNA, 19 nt, Human
cucugugcagagcuucccc

SEQ ID NO: 863578 - RNA, 18 nt, Human
cugcaggcuuuccagcug

SEQ ID NO: 863579 - RNA, 22 nt, Human
cugcaggcuuuccagcugguuc

SEQ ID NO: 863580 - RNA, 22 nt, Human
cugggagggggaucugguggug

SEQ ID NO: 863581 - RNA, 18 nt, Human
cuguggcaacugggccuu

SEQ ID NO: 863582 - RNA, 23 nt, Human
cuuaggcagagaauccuugucau

SEQ ID NO: 863583 - RNA, 23 nt, Human
cuugaagaguaaggggcuggugg

SEQ ID NO: 863584 - RNA, 18 nt, Human
gaggaacuacuguccaca

SEQ ID NO: 863585 - RNA, 22 nt, Human
gaggaaggccugggagggggau

SEQ ID NO: 863586 - RNA, 20 nt, Human
gagggggaucuggugguggc

SEQ ID NO: 863587 - RNA, 23 nt, Human
gcagagcuuccccaggcuguugg

SEQ ID NO: 863588 - RNA, 24 nt, Human
gcagagcuuccccaggcuguuggg

SEQ ID NO: 863589 - RNA, 18 nt, Human
gcccacagcaaagcccaa

SEQ ID NO: 863590 - RNA, 19 nt, Human
gcugaugggagagggagga

SEQ ID NO: 863591 - RNA, 20 nt, Human
ggaagaacuugguugggggu

SEQ ID NO: 863592 - RNA, 23 nt, Human
ggaagaacuugguuggggguggg

SEQ ID NO: 863593 - RNA, 25 nt, Human
ggaaucaggguggaaguugucaggg

SEQ ID NO: 863594 - RNA, 19 nt, Human
ggagacugcuaggcagggg

SEQ ID NO: 863595 - RNA, 18 nt, Human
ggaggaaggccugggagg

SEQ ID NO: 863596 - RNA, 24 nt, Human
gggagcagcacuguggagagggca

SEQ ID NO: 863597 - RNA, 20 nt, Human
gggaucuggugguggcgccc

SEQ ID NO: 863598 - RNA, 21 nt, Human
ggguggcuaaggggcagcagg

SEQ ID NO: 863599 - RNA, 20 nt, Human
gguccuugaagccacagucu

SEQ ID NO: 863600 - RNA, 21 nt, Human
gucuuggggcgagucccaugg

SEQ ID NO: 863601 - RNA, 25 nt, Human
uaagccagggcccaggggcuacauu

SEQ ID NO: 863602 - RNA, 19 nt, Human
uacagguuuccuguaccug

SEQ ID NO: 863603 - RNA, 22 nt, Human
uaccuccuaggagccucagagu

SEQ ID NO: 863604 - RNA, 21 nt, Human
uaccuuaauucuuuagucugg

SEQ ID NO: 863605 - RNA, 18 nt, Human
uauggagccagcucccag

SEQ ID NO: 863606 - RNA, 27 nt, Human
uccagagaauaaccuggcugcccucac

SEQ ID NO: 863607 - RNA, 19 nt, Human
uccagggugcaggcugagg

SEQ ID NO: 863608 - RNA, 18 nt, Human
ucccaggaaggagaagcc

SEQ ID NO: 863609 - RNA, 20 nt, Human
ucccaggaaggagaagccgu

SEQ ID NO: 863610 - RNA, 26 nt, Human
ucccugagaugagucaagcccagccc

SEQ ID NO: 863611 - RNA, 19 nt, Human
ucccuuauggaagagucau

SEQ ID NO: 863612 - RNA, 18 nt, Human
uccgccaucuuccccgcc

SEQ ID NO: 863613 - RNA, 19 nt, Human
uccgccaucuuccccgccc

SEQ ID NO: 863614 - RNA, 24 nt, Human
ucgggccccuugcguagcaacugc

SEQ ID NO: 863615 - RNA, 18 nt, Human
ucuccaccugaaggcuga

SEQ ID NO: 863616 - RNA, 18 nt, Human
ucuccagcuuuucucaca

SEQ ID NO: 863617 - RNA, 21 nt, Human
ucuccagcuuuucucacaagg

SEQ ID NO: 863618 - RNA, 23 nt, Human
ucugggguuuccagaacaaaggc

SEQ ID NO: 863619 - RNA, 19 nt, Human
ugaacagagaggucaggag

SEQ ID NO: 863620 - RNA, 18 nt, Human
ugaagaguaaggggcugg

SEQ ID NO: 863621 - RNA, 23 nt, Human
ugagaugagucaagcccagcccu

SEQ ID NO: 863622 - RNA, 18 nt, Human
ugcaccauggcugggcug

SEQ ID NO: 863623 - RNA, 19 nt, Human
ugcccucacuucuccagcu

SEQ ID NO: 863624 - RNA, 19 nt, Human
ugcucauccugccucuucc

SEQ ID NO: 863625 - RNA, 24 nt, Human
ugcucauccugccucuuccauggc

SEQ ID NO: 863626 - RNA, 20 nt, Human
uggaagaacuugguuggggg

SEQ ID NO: 863627 - RNA, 21 nt, Human
uggaagggugaggaucccuua

SEQ ID NO: 863628 - RNA, 19 nt, Human
uggagcuaggaaggggaag

SEQ ID NO: 863629 - RNA, 18 nt, Human
uggcugggcuggacuagc

SEQ ID NO: 863630 - RNA, 18 nt, Human
ugggagacugcuaggcag

SEQ ID NO: 863631 - RNA, 21 nt, Human
ugggagggggaucugguggug

SEQ ID NO: 863632 - RNA, 21 nt, Human
ugggagggggaucugguggug

SEQ ID NO: 863633 - RNA, 20 nt, Human
ugggggugggggaugguaag

SEQ ID NO: 863634 - RNA, 21 nt, Human
ugggggugggggaugguaagc

SEQ ID NO: 863635 - RNA, 22 nt, Human
uggguggcuaaggggcagcagg

SEQ ID NO: 863636 - RNA, 21 nt, Human
ugguugggggugggggauggu

SEQ ID NO: 863637 - RNA, 22 nt, Human
uguuacagggcugcugauggga

SEQ ID NO: 863638 - RNA, 18 nt, Human
uuaaagagacacugauug

SEQ ID NO: 863639 - RNA, 23 nt, Human
uuuuuuuuuuuuuuuugcugugg

SEQ ID NO: 863640 - RNA, 20 nt, Human
uuuuuuuuuuuuuuuuugcu

SEQ ID NO: 863641 - RNA, 24 nt, Human
uuuuuuuuuuuuuuuuugcugugg

SEQ ID NO: 863642 - RNA, 21 nt, Human
uuuuuuuuuuuuuuuuuuugg

SEQ ID NO: 863643 - RNA, 21 nt, Human
aaacacaaagcccccacguuc

SEQ ID NO: 863644 - RNA, 18 nt, Human
aaagcccccacguucccc

SEQ ID NO: 863645 - RNA, 25 nt, Human
aaauagugagugaaaaguacaaaac

SEQ ID NO: 863646 - RNA, 19 nt, Human
aacacuccuguuucuccaa

SEQ ID NO: 863647 - RNA, 24 nt, Human
aagccugaguuccuacugcccaaa

SEQ ID NO: 863648 - RNA, 19 nt, Human
aaggagcaggcucugcugu

SEQ ID NO: 863649 - RNA, 24 nt, Human
aaggaucacucacagcccagaagc

SEQ ID NO: 863650 - RNA, 25 nt, Human
aaggaucacucacagcccagaagcc

SEQ ID NO: 863651 - RNA, 25 nt, Human
aaguaucaaaggaucacucacagcc

SEQ ID NO: 863652 - RNA, 19 nt, Human
aauugcuguacagucaucu

SEQ ID NO: 863653 - RNA, 19 nt, Human
acaaaacacaaagccccca

SEQ ID NO: 863654 - RNA, 27 nt, Human
acaaaacacaaagcccccacguucccc

SEQ ID NO: 863655 - RNA, 23 nt, Human
acacaaauucuaaaacaugaagc

SEQ ID NO: 863656 - RNA, 18 nt, Human
acagcccagaagccccaa

SEQ ID NO: 863657 - RNA, 20 nt, Human
acuagauaagugaacacucc

SEQ ID NO: 863658 - RNA, 21 nt, Human
agcucagucucucccaccccc

SEQ ID NO: 863659 - RNA, 25 nt, Human
aggaucacucacagcccagaagccc

SEQ ID NO: 863660 - RNA, 21 nt, Human
auaguuuuuaaucauaagcuu

SEQ ID NO: 863661 - RNA, 24 nt, Human
caaaacacaaagcccccacguucc

SEQ ID NO: 863662 - RNA, 18 nt, Human
caaaggaucacucacagc

SEQ ID NO: 863663 - RNA, 19 nt, Human
cacguacuccaagcucagc

SEQ ID NO: 863664 - RNA, 22 nt, Human
cacugcagaccagaagccugag

SEQ ID NO: 863665 - RNA, 22 nt, Human
cagccucucggccagcggcccc

SEQ ID NO: 863666 - RNA, 23 nt, Human
cccagaagccccaaauuagugac

SEQ ID NO: 863667 - RNA, 19 nt, Human
ccccaaauuagugacaagg

SEQ ID NO: 863668 - RNA, 19 nt, Human
ccucucggccagcggcccc

SEQ ID NO: 863669 - RNA, 18 nt, Human
cgccucagccucucggcc

SEQ ID NO: 863670 - RNA, 20 nt, Human
cuacugcccaaacugguucu

SEQ ID NO: 863671 - RNA, 24 nt, Human
cucacagcccagaagccccaaauu

SEQ ID NO: 863672 - RNA, 21 nt, Human
cugcuguuccaagcgacucag

SEQ ID NO: 863673 - RNA, 23 nt, Human
gaaaaguacaaaacacaaagccc

SEQ ID NO: 863674 - RNA, 20 nt, Human
gagcaggcucugcuguucca

SEQ ID NO: 863675 - RNA, 24 nt, Human
gaggcgaacaggcuccacugcaga

SEQ ID NO: 863676 - RNA, 19 nt, Human
gccgccucagccucucggc

SEQ ID NO: 863677 - RNA, 21 nt, Human
guacaaaacacaaagccccca

SEQ ID NO: 863678 - RNA, 23 nt, Human
uacugcccaaacugguucugugg

SEQ ID NO: 863679 - RNA, 21 nt, Human
uaugcuaaaaauaguuuagca

SEQ ID NO: 863680 - RNA, 22 nt, Human
ucagucucucccacccccaauu

SEQ ID NO: 863681 - RNA, 20 nt, Human
uccacugcagaccagaagcu

SEQ ID NO: 863682 - RNA, 18 nt, Human
ucccagcacaagcaggau

SEQ ID NO: 863683 - RNA, 18 nt, Human
ucuaaaacaugaagcugu

SEQ ID NO: 863684 - RNA, 20 nt, Human
ucugugaaacaggcuaaggc

SEQ ID NO: 863685 - RNA, 18 nt, Human
ugaaaaguacaaaacaca

SEQ ID NO: 863686 - RNA, 23 nt, Human
ugagugaaaaguacaaaacacaa

SEQ ID NO: 863687 - RNA, 19 nt, Human
ugaguuccuacugcccaaa

SEQ ID NO: 863688 - RNA, 23 nt, Human
ugcacuagauaagugaacacucc

SEQ ID NO: 863689 - RNA, 22 nt, Human
ugcccaaacugguucuguggaa

SEQ ID NO: 863690 - RNA, 20 nt, Human
ugugaaacaggcuaaggcaa

SEQ ID NO: 863691 - RNA, 21 nt, Human
ugugaaacaggcuaaggcaag

SEQ ID NO: 863692 - RNA, 18 nt, Human
uuuuuuuuuuuuuuguuc

SEQ ID NO: 863693 - RNA, 18 nt, Human
uuuuuuuuuuuuuuuuug

SEQ ID NO: 863694 - RNA, 20 nt, Human
uuuuuuuuuuuuuuuuuguu

SEQ ID NO: 863695 - RNA, 21 nt, Human
agcgggaggaggaggagcugg

SEQ ID NO: 863696 - RNA, 23 nt, Human
aggagccggcuggacugcgggag

SEQ ID NO: 863697 - RNA, 21 nt, Human
agggcuccgggaggcgcgggg

SEQ ID NO: 863698 - RNA, 18 nt, Human
cagcgcgccuucucggcg

SEQ ID NO: 863699 - RNA, 18 nt, Human
cccccucucccuccucuc

SEQ ID NO: 863700 - RNA, 21 nt, Human
ccccgcgccggcgcugcgcuc

SEQ ID NO: 863701 - RNA, 21 nt, Human
ccccgggagcaggagcagcgg

SEQ ID NO: 863702 - RNA, 23 nt, Human
cccgccucucccuggacuccucc

SEQ ID NO: 863703 - RNA, 20 nt, Human
cccucucccuccucucccuc

SEQ ID NO: 863704 - RNA, 22 nt, Human
ccgcgccggcgcugcgcucugc

SEQ ID NO: 863705 - RNA, 18 nt, Human
ccgcugcguguccagccc

SEQ ID NO: 863706 - RNA, 24 nt, Human
ccuggacuccuccccucccccucu

SEQ ID NO: 863707 - RNA, 18 nt, Human
cgggagcaggagcagcgg

SEQ ID NO: 863708 - RNA, 19 nt, Human
cgggaggaggaggagcugg

SEQ ID NO: 863709 - RNA, 24 nt, Human
cgggcugcuccccugcgcugcguu

SEQ ID NO: 863710 - RNA, 22 nt, Human
cucccccucucccuccucuccc

SEQ ID NO: 863711 - RNA, 20 nt, Human
gacugcgggagugccgggcg

SEQ ID NO: 863712 - RNA, 21 nt, Human
gagcaggagcagcgggaggaa

SEQ ID NO: 863713 - RNA, 22 nt, Human
gagccguggccgggcuagagga

SEQ ID NO: 863714 - RNA, 20 nt, Human
gaggaggagcuggcgcggcg

SEQ ID NO: 863715 - RNA, 18 nt, Human
gagugccgggcggcucgc

SEQ ID NO: 863716 - RNA, 20 nt, Human
gaucccgccucucccuggac

SEQ ID NO: 863717 - RNA, 21 nt, Human
gccccgggagcaggagcagcg

SEQ ID NO: 863718 - RNA, 23 nt, Human
gccggcgcugcgcucugcgaugc

SEQ ID NO: 863719 - RNA, 27 nt, Human
gcgcaugggagcagcgggggggaggag

SEQ ID NO: 863720 - RNA, 18 nt, Human
gcgcggggcgggcucggg

SEQ ID NO: 863721 - RNA, 20 nt, Human
ggagcagcgggggggagggc

SEQ ID NO: 863722 - RNA, 24 nt, Human
ggccgugaucccgccucucccugg

SEQ ID NO: 863723 - RNA, 21 nt, Human
gggagcagcgggggggagggc

SEQ ID NO: 863724 - RNA, 22 nt, Human
gggagcagcgggggggagggcu

SEQ ID NO: 863725 - RNA, 21 nt, Human
gggaggugaaaguggggagaa

SEQ ID NO: 863726 - RNA, 18 nt, Human
gggagugccgggcggcuc

SEQ ID NO: 863727 - RNA, 20 nt, Human
gggggagggcuccgggaggc

SEQ ID NO: 863728 - RNA, 20 nt, Human
gggggggagggcuccgggag

SEQ ID NO: 863729 - RNA, 22 nt, Human
uagaggagccggcuggacugcg

SEQ ID NO: 863730 - RNA, 22 nt, Human
uauaaaguuuggguggggaggu

SEQ ID NO: 863731 - RNA, 18 nt, Human
ucagcagccugggccgug

SEQ ID NO: 863732 - RNA, 22 nt, Human
uccccucccccucucccuccuc

SEQ ID NO: 863733 - RNA, 18 nt, Human
ucccucgcucgcccuccc

SEQ ID NO: 863734 - RNA, 18 nt, Human
ucccuggacuccuccccu

SEQ ID NO: 863735 - RNA, 23 nt, Human
ucccuggacuccuccccuccccc

SEQ ID NO: 863736 - RNA, 20 nt, Human
ucgccccgggagcaggagcu

SEQ ID NO: 863737 - RNA, 23 nt, Human
ucgcggccccgcgccggcgcugc

SEQ ID NO: 863738 - RNA, 22 nt, Human
ugaaaguggggagaaggggagu

SEQ ID NO: 863739 - RNA, 23 nt, Human
ugcgcugcguucucgcggccccg

SEQ ID NO: 863740 - RNA, 19 nt, Human
ugggagcagcgggggggag

SEQ ID NO: 863741 - RNA, 21 nt, Human
uggggaggugaaaguggggag

SEQ ID NO: 863742 - RNA, 24 nt, Human
uggggaggugaaaguggggagaag

SEQ ID NO: 863743 - RNA, 24 nt, Human
uuccuuucguggcccgaguccucc

SEQ ID NO: 863744 - RNA, 21 nt, Human
uucguggcccgaguccucccc

SEQ ID NO: 863745 - RNA, 20 nt, Human
uuuauaaaguuugggugggg

SEQ ID NO: 863746 - RNA, 21 nt, Human
uuuuauaaaguuugggugggg

SEQ ID NO: 863747 - RNA, 24 nt, Human
uuuuauaaaguuuggguggggagg

SEQ ID NO: 863748 - RNA, 29 nt, Human
uuuuuuuuuuuuuuuuuuuucuauaaaaa

SEQ ID NO: 863749 - RNA, 21 nt, Human
aaaaaaaaaaaaaagcaauug

SEQ ID NO: 863750 - RNA, 22 nt, Human
aaaagcauuuucuauuuuaaaa

SEQ ID NO: 863751 - RNA, 19 nt, Human
aaacgagcacaucuaagca

SEQ ID NO: 863752 - RNA, 23 nt, Human
aaugcaaaaaaaaaaaaaagcaa

SEQ ID NO: 863753 - RNA, 19 nt, Human
acaaaugcaaaaaaaaaaa

SEQ ID NO: 863754 - RNA, 24 nt, Human
acaaaugcaaaaaaaaaaaaaagc

SEQ ID NO: 863755 - RNA, 18 nt, Human
agauguaaaacuaugacc

SEQ ID NO: 863756 - RNA, 22 nt, Human
agguuugaggcagcuguacugc

SEQ ID NO: 863757 - RNA, 19 nt, Human
augguaacagaguaaaugc

SEQ ID NO: 863758 - RNA, 19 nt, Human
auuacugauuucccucuaa

SEQ ID NO: 863759 - RNA, 21 nt, Human
caaccucuagaauuuuagaaa

SEQ ID NO: 863760 - RNA, 27 nt, Human
cagcucaggccgaaccccgccggcgag

SEQ ID NO: 863761 - RNA, 25 nt, Human
cauucaugagcugauuauaucaacc

SEQ ID NO: 863762 - RNA, 22 nt, Human
ccucuagaauuuuagaaacgag

SEQ ID NO: 863763 - RNA, 20 nt, Human
cguggaacuccagaccacuc

SEQ ID NO: 863764 - RNA, 24 nt, Human
cuuaaagcacuauuaagucaugaa

SEQ ID NO: 863765 - RNA, 19 nt, Human
ggagagguggccucugguc

SEQ ID NO: 863766 - RNA, 21 nt, Human
guaaaacuaugaccaacagaa

SEQ ID NO: 863767 - RNA, 18 nt, Human
uaaaaagagacucaagug

SEQ ID NO: 863768 - RNA, 21 nt, Human
uaacaaaugcaaaaaaaaaaa

SEQ ID NO: 863769 - RNA, 22 nt, Human
uaacaaaugcaaaaaaaaaaaa

SEQ ID NO: 863770 - RNA, 24 nt, Human
uaacaaaugcaaaaaaaaaaaaaa

SEQ ID NO: 863771 - RNA, 23 nt, Human
uagaauuuuagaaacgagcacau

SEQ ID NO: 863772 - RNA, 18 nt, Human
uaugucaauccagcucag

SEQ ID NO: 863773 - RNA, 21 nt, Human
uauucccagcaaccaucgcau

SEQ ID NO: 863774 - RNA, 24 nt, Human
ucagauguaaaacuaugaccaaca

SEQ ID NO: 863775 - RNA, 27 nt, Human
uccaaaaaaucaauaauccauucugua

SEQ ID NO: 863776 - RNA, 19 nt, Human
uccacaguuucagguauuc

SEQ ID NO: 863777 - RNA, 26 nt, Human
ucccaaagguuugaggcagcuguacu

SEQ ID NO: 863778 - RNA, 18 nt, Human
ucccagcaaccaucgcau

SEQ ID NO: 863779 - RNA, 23 nt, Human
uccuagaggucaaauaauauacc

SEQ ID NO: 863780 - RNA, 24 nt, Human
ucucuuaccuuacaaaguaaaagc

SEQ ID NO: 863781 - RNA, 22 nt, Human
ugaccaacagaagacacccaaa

SEQ ID NO: 863782 - RNA, 22 nt, Human
uguuauguacaaucuaucacaa

SEQ ID NO: 863783 - RNA, 20 nt, Human
uuaaagucucaacuuccaaa

SEQ ID NO: 863784 - RNA, 19 nt, Human
uuucccucuaaaaagagac

SEQ ID NO: 863785 - RNA, 23 nt, Human
uuuuuuuuuuucuuccuuauuuu

SEQ ID NO: 863786 - RNA, 24 nt, Human
aaagugcugagauuacaggcguga

SEQ ID NO: 863787 - RNA, 24 nt, Human
aaagugcugggauuacagguguga

SEQ ID NO: 863788 - RNA, 24 nt, Human
aaagugcugggauuauaggcguga

SEQ ID NO: 863789 - RNA, 24 nt, Human
aaauuguugggauuacagguauga

SEQ ID NO: 863790 - RNA, 23 nt, Human
aacugguucgaacuccugagcuc

SEQ ID NO: 863791 - RNA, 23 nt, Human
aagcgucgcaugccucagccucc

SEQ ID NO: 863792 - RNA, 23 nt, Human
aagcucagccucccgaguagcug

SEQ ID NO: 863793 - RNA, 19 nt, Human
aaggagcugggauuacagg

SEQ ID NO: 863794 - RNA, 24 nt, Human
aagugauccacccgccucggccuc

SEQ ID NO: 863795 - RNA, 26 nt, Human
aagugcugagauuacaggcgugagcc

SEQ ID NO: 863796 - RNA, 18 nt, Human
aagugcugggauuacagg

SEQ ID NO: 863797 - RNA, 19 nt, Human
aagugcugggauuacaggu

SEQ ID NO: 863798 - RNA, 26 nt, Human
aagugcugggauuacaggugugagcc

SEQ ID NO: 863799 - RNA, 19 nt, Human
aagugcugggauuauaggc

SEQ ID NO: 863800 - RNA, 19 nt, Human
aagugcugggauuauaggc

SEQ ID NO: 863801 - RNA, 26 nt, Human
aagugcugggauuauaggcgugagcc

SEQ ID NO: 863802 - RNA, 19 nt, Human
acaggcacccuccaccucc

SEQ ID NO: 863803 - RNA, 20 nt, Human
acaggcacccuccaccuccc

SEQ ID NO: 863804 - RNA, 18 nt, Human
acaggguuucaccauguu

SEQ ID NO: 863805 - RNA, 18 nt, Human
acaggguuucaccauguu

SEQ ID NO: 863806 - RNA, 19 nt, Human
acaggguuucaccauguuu

SEQ ID NO: 863807 - RNA, 21 nt, Human
acaggguuucaccauguuugg

SEQ ID NO: 863808 - RNA, 25 nt, Human
acaggguuucaccauguuuggccag

SEQ ID NO: 863809 - RNA, 19 nt, Human
acaggguuuugccauguug

SEQ ID NO: 863810 - RNA, 20 nt, Human
acaggguuuugccauguugu

SEQ ID NO: 863811 - RNA, 24 nt, Human
acaggguuuugccauguuguccag

SEQ ID NO: 863812 - RNA, 24 nt, Human
accauguugggcaggauggucucg

SEQ ID NO: 863813 - RNA, 23 nt, Human
accauguuuggccaggcuggucu

SEQ ID NO: 863814 - RNA, 19 nt, Human
acccagugcuugggcuuua

SEQ ID NO: 863815 - RNA, 24 nt, Human
acccugcccccaaacaggccaugg

SEQ ID NO: 863816 - RNA, 21 nt, Human
accuggacucuggcuggguca

SEQ ID NO: 863817 - RNA, 18 nt, Human
acgggguuucaccauguu

SEQ ID NO: 863818 - RNA, 23 nt, Human
acgggguuucaccauguugggca

SEQ ID NO: 863819 - RNA, 24 nt, Human
acgggguuucaccauguugggcag

SEQ ID NO: 863820 - RNA, 18 nt, Human
acuaacauaguuaacacc

SEQ ID NO: 863821 - RNA, 21 nt, Human
acuacaggcgcaugcuaccau

SEQ ID NO: 863822 - RNA, 18 nt, Human
agacaggguuucaccaug

SEQ ID NO: 863823 - RNA, 18 nt, Human
agacaggguuuugccaug

SEQ ID NO: 863824 - RNA, 23 nt, Human
agauuacaggcgugagccagugc

SEQ ID NO: 863825 - RNA, 23 nt, Human
agcagcugggauuacaggugcgu

SEQ ID NO: 863826 - RNA, 18 nt, Human
agccuccagagcagcugg

SEQ ID NO: 863827 - RNA, 19 nt, Human
agcucagccucccgaguag

SEQ ID NO: 863828 - RNA, 18 nt, Human
agcuuccacaucauuccc

SEQ ID NO: 863829 - RNA, 20 nt, Human
agcuucccaaagagcuggga

SEQ ID NO: 863830 - RNA, 19 nt, Human
aggaagauguggggcuucu

SEQ ID NO: 863831 - RNA, 25 nt, Human
aggcacccuccaucaugccuggggg

SEQ ID NO: 863832 - RNA, 24 nt, Human
aggcaggcggcccacagugcccca

SEQ ID NO: 863833 - RNA, 26 nt, Human
aggcaggcggcccacagugccccagg

SEQ ID NO: 863834 - RNA, 18 nt, Human
aggcaggguuucgccaug

SEQ ID NO: 863835 - RNA, 23 nt, Human
aggcaggguuucgccauguugcc

SEQ ID NO: 863836 - RNA, 19 nt, Human
aggcgugagccaccgcacc

SEQ ID NO: 863837 - RNA, 25 nt, Human
aggcuggagugcaguggcgcaaucu

SEQ ID NO: 863838 - RNA, 25 nt, Human
aggcuggagugcaguggcgcgaucu

SEQ ID NO: 863839 - RNA, 25 nt, Human
aggcuggagugcaguggugcgaucu

SEQ ID NO: 863840 - RNA, 22 nt, Human
aggugauccgcccaccuuggcc

SEQ ID NO: 863841 - RNA, 23 nt, Human
aggugugagccaccgugccuggc

SEQ ID NO: 863842 - RNA, 22 nt, Human
aguagaaacgggguuucaccau

SEQ ID NO: 863843 - RNA, 18 nt, Human
aguagcuggcauuacagg

SEQ ID NO: 863844 - RNA, 18 nt, Human
aguagcugggacuacagg

SEQ ID NO: 863845 - RNA, 19 nt, Human
aguagcugggacuacaggc

SEQ ID NO: 863846 - RNA, 24 nt, Human
agugauucucgugccucagccucc

SEQ ID NO: 863847 - RNA, 18 nt, Human
agugcagccuggaccuca

SEQ ID NO: 863848 - RNA, 23 nt, Human
agugcaguggcgcaaucuuggcu

SEQ ID NO: 863849 - RNA, 24 nt, Human
agugcaguggcgcaaucuuggcuc

SEQ ID NO: 863850 - RNA, 20 nt, Human
agugcaguggcgcgaucucg

SEQ ID NO: 863851 - RNA, 23 nt, Human
agugcaguggcgcgaucucggcu

SEQ ID NO: 863852 - RNA, 24 nt, Human
agugcaguggcgcgaucucggcuc

SEQ ID NO: 863853 - RNA, 20 nt, Human
agugcaguggugcgaucuug

SEQ ID NO: 863854 - RNA, 24 nt, Human
agugcaguggugcgaucuuggauc

SEQ ID NO: 863855 - RNA, 20 nt, Human
auccgcccaccuuggccacc

SEQ ID NO: 863856 - RNA, 24 nt, Human
augaucugcccaccucggccuccc

SEQ ID NO: 863857 - RNA, 24 nt, Human
auguuuggccaggcuggucuugaa

SEQ ID NO: 863858 - RNA, 19 nt, Human
auuacaggugcgugccacc

SEQ ID NO: 863859 - RNA, 21 nt, Human
auucaggacgcagccugugag

SEQ ID NO: 863860 - RNA, 21 nt, Human
auucucccgccucagcuuccc

SEQ ID NO: 863861 - RNA, 18 nt, Human
auugcucugucgcccagg

SEQ ID NO: 863862 - RNA, 24 nt, Human
auuuuuauuugagacagggucugg

SEQ ID NO: 863863 - RNA, 24 nt, Human
auuuuuuuuuuuuuuugagacggg

SEQ ID NO: 863864 - RNA, 21 nt, Human
caaagagcugggacuaaaggc

SEQ ID NO: 863865 - RNA, 22 nt, Human
caaagagcugggacuaaaggca

SEQ ID NO: 863866 - RNA, 24 nt, Human
caaagugcugagauuacaggcgug

SEQ ID NO: 863867 - RNA, 24 nt, Human
caaagugcugggauuacaggugug

SEQ ID NO: 863868 - RNA, 24 nt, Human
caaagugcugggauuauaggcgug

SEQ ID NO: 863869 - RNA, 24 nt, Human
caaggagcugggauuacaggcacc

SEQ ID NO: 863870 - RNA, 22 nt, Human
caagugauucucgugccucagc

SEQ ID NO: 863871 - RNA, 28 nt, Human
caagugauucucgugccucagccucccg

SEQ ID NO: 863872 - RNA, 22 nt, Human
caagugauuugcuugccuuggc

SEQ ID NO: 863873 - RNA, 19 nt, Human
cacaccgaucgcuuggcag

SEQ ID NO: 863874 - RNA, 18 nt, Human
caccaugccuggccauuu

SEQ ID NO: 863875 - RNA, 18 nt, Human
caccauguugggcaggau

SEQ ID NO: 863876 - RNA, 24 nt, Human
caccauguugggcaggauggucuc

SEQ ID NO: 863877 - RNA, 22 nt, Human
caccauguuuggccaggcuggu

SEQ ID NO: 863878 - RNA, 24 nt, Human
caccauguuuggccaggcuggucu

SEQ ID NO: 863879 - RNA, 25 nt, Human
caccauguuuggccaggcuggucuu

SEQ ID NO: 863880 - RNA, 23 nt, Human
cacccgccucggccucccaaagu

SEQ ID NO: 863881 - RNA, 24 nt, Human
caccucggccucccaaagugcugg

SEQ ID NO: 863882 - RNA, 19 nt, Human
cacguacgugacaacaagc

SEQ ID NO: 863883 - RNA, 21 nt, Human
cacugcaaccuccgccuccug

SEQ ID NO: 863884 - RNA, 23 nt, Human
cacugcaaccuccgccuccuggg

SEQ ID NO: 863885 - RNA, 19 nt, Human
cacugcaaccucugccugc

SEQ ID NO: 863886 - RNA, 23 nt, Human
cacugcaaccucugccugcuggg

SEQ ID NO: 863887 - RNA, 21 nt, Human
cagccugugaggacccaccag

SEQ ID NO: 863888 - RNA, 21 nt, Human
cagcugggauuacaggugcgu

SEQ ID NO: 863889 - RNA, 25 nt, Human
caggguuucaccauguuuggccagg

SEQ ID NO: 863890 - RNA, 18 nt, Human
caggguuucgccauguug

SEQ ID NO: 863891 - RNA, 18 nt, Human
caggguuuugccauguug

SEQ ID NO: 863892 - RNA, 21 nt, Human
caucagcaggcaggcggccca

SEQ ID NO: 863893 - RNA, 21 nt, Human
caugccuggcuaauuuuugua

SEQ ID NO: 863894 - RNA, 22 nt, Human
caugcuauucuccugccuuagc

SEQ ID NO: 863895 - RNA, 23 nt, Human
cauguugcccaaacugguucgaa

SEQ ID NO: 863896 - RNA, 20 nt, Human
cauguuguccagacugaucu

SEQ ID NO: 863897 - RNA, 24 nt, Human
cauguuguccagacugaucuugaa

SEQ ID NO: 863898 - RNA, 19 nt, Human
cauugaagaaucuacuaac

SEQ ID NO: 863899 - RNA, 22 nt, Human
ccaaagugcugagauuacaggc

SEQ ID NO: 863900 - RNA, 22 nt, Human
ccaaagugcugagauuacaggc

SEQ ID NO: 863901 - RNA, 24 nt, Human
ccaaagugcugagauuacaggcgu

SEQ ID NO: 863902 - RNA, 21 nt, Human
ccaaagugcugggauuacagg

SEQ ID NO: 863903 - RNA, 21 nt, Human
ccaaagugcugggauuacagg

SEQ ID NO: 863904 - RNA, 24 nt, Human
ccaaagugcugggauuacaggugu

SEQ ID NO: 863905 - RNA, 22 nt, Human
ccaaagugcugggauuauaggc

SEQ ID NO: 863906 - RNA, 24 nt, Human
ccaaagugcugggauuauaggcgu

SEQ ID NO: 863907 - RNA, 21 nt, Human
ccaaauuguugggauuacagg

SEQ ID NO: 863908 - RNA, 21 nt, Human
ccaaauuguugggauuacagg

SEQ ID NO: 863909 - RNA, 21 nt, Human
ccaaauuguugggauuacagg

SEQ ID NO: 863910 - RNA, 24 nt, Human
ccaaauuguugggauuacagguau

SEQ ID NO: 863911 - RNA, 19 nt, Human
ccaaggagcugggauuaca

SEQ ID NO: 863912 - RNA, 20 nt, Human
ccaccacacccagcuaauuu

SEQ ID NO: 863913 - RNA, 22 nt, Human
ccagagcagcugggauuacagg

SEQ ID NO: 863914 - RNA, 22 nt, Human
ccagagcagcugggauuacagg

SEQ ID NO: 863915 - RNA, 25 nt, Human
ccagcuaauuuuugcauguuuugua

SEQ ID NO: 863916 - RNA, 18 nt, Human
ccaggcuggagugcagug

SEQ ID NO: 863917 - RNA, 21 nt, Human
ccaggcuggagugcaguggug

SEQ ID NO: 863918 - RNA, 21 nt, Human
ccauguuguccagacugaucu

SEQ ID NO: 863919 - RNA, 18 nt, Human
cccaaacaggccaugggg

SEQ ID NO: 863920 - RNA, 23 nt, Human
cccaaagugcugagauuacaggc

SEQ ID NO: 863921 - RNA, 19 nt, Human
cccaaggagcugggauuac

SEQ ID NO: 863922 - RNA, 24 nt, Human
cccaaggagcugggauuacaggca

SEQ ID NO: 863923 - RNA, 21 nt, Human
cccacagugccccaggaccua

SEQ ID NO: 863924 - RNA, 22 nt, Human
cccacagugccccaggaccuac

SEQ ID NO: 863925 - RNA, 24 nt, Human
cccaggaccuacccugcccccaaa

SEQ ID NO: 863926 - RNA, 22 nt, Human
cccaggcuggagugcaguggcg

SEQ ID NO: 863927 - RNA, 22 nt, Human
ccccaggaccuacccugccccc

SEQ ID NO: 863928 - RNA, 23 nt, Human
cccccaaacaggccauggggccc

SEQ ID NO: 863929 - RNA, 23 nt, Human
cccgaguagcuggcauuacaggc

SEQ ID NO: 863930 - RNA, 23 nt, Human
cccgaguagcugggacuacaggc

SEQ ID NO: 863931 - RNA, 24 nt, Human
cccgaguagcugggacuacaggcg

SEQ ID NO: 863932 - RNA, 22 nt, Human
ccggguucaugcuauucuccug

SEQ ID NO: 863933 - RNA, 24 nt, Human
ccuccgccuccuggguucaagcgu

SEQ ID NO: 863934 - RNA, 22 nt, Human
ccugagcucaagugauuugcuu

SEQ ID NO: 863935 - RNA, 23 nt, Human
ccugagcucaagugauuugcuug

SEQ ID NO: 863936 - RNA, 22 nt, Human
ccugaucucaagugauccaccc

SEQ ID NO: 863937 - RNA, 21 nt, Human
ccugccuuagccucccaagga

SEQ ID NO: 863938 - RNA, 26 nt, Human
ccuggccaauauuuuuaaauaguucu

SEQ ID NO: 863939 - RNA, 22 nt, Human
ccugugaggacccaccagcuga

SEQ ID NO: 863940 - RNA, 30 nt, Human
cgccauguugcccaaacugguucgaacucc

SEQ ID NO: 863941 - RNA, 24 nt, Human
cgccucggccucccaaagugcugg

SEQ ID NO: 863942 - RNA, 24 nt, Human
cgggguuucaccauguugggcagg

SEQ ID NO: 863943 - RNA, 21 nt, Human
cucaagugauccacccgccuc

SEQ ID NO: 863944 - RNA, 20 nt, Human
cucaagugauuugcuugccu

SEQ ID NO: 863945 - RNA, 22 nt, Human
cucacugcaaccuccaccuacc

SEQ ID NO: 863946 - RNA, 24 nt, Human
cucacugcaaccuccaccuaccgg

SEQ ID NO: 863947 - RNA, 19 nt, Human
cucacugcaaccucugccu

SEQ ID NO: 863948 - RNA, 24 nt, Human
cucagccucccgaguagcugggac

SEQ ID NO: 863949 - RNA, 24 nt, Human
cucaggugauccgcccaccuuggc

SEQ ID NO: 863950 - RNA, 25 nt, Human
cuccacggccagcacaccgaucgcu

SEQ ID NO: 863951 - RNA, 20 nt, Human
cuccugaccucaugaucugc

SEQ ID NO: 863952 - RNA, 18 nt, Human
cuccugagcucaagugau

SEQ ID NO: 863953 - RNA, 23 nt, Human
cucgcuuugucgucaggcuggag

SEQ ID NO: 863954 - RNA, 25 nt, Human
cucgugccucagccucccgaguagc

SEQ ID NO: 863955 - RNA, 19 nt, Human
cucugucgcccaggcugga

SEQ ID NO: 863956 - RNA, 23 nt, Human
cugaccucaggugauccgcccac

SEQ ID NO: 863957 - RNA, 24 nt, Human
cugcaaccuccaccuaccggguuc

SEQ ID NO: 863958 - RNA, 23 nt, Human
cugcaaccuccgccuccuggguu

SEQ ID NO: 863959 - RNA, 24 nt, Human
cugcaaccuccgccuccuggguuc

SEQ ID NO: 863960 - RNA, 20 nt, Human
cugcaaccucugccugcugg

SEQ ID NO: 863961 - RNA, 24 nt, Human
cugcaaccucugccugcuggguuc

SEQ ID NO: 863962 - RNA, 23 nt, Human
cugccugcuggguucaagugauu

SEQ ID NO: 863963 - RNA, 23 nt, Human
cugccuuagccucccaaggagcu

SEQ ID NO: 863964 - RNA, 19 nt, Human
cugucgcccaggcuggagu

SEQ ID NO: 863965 - RNA, 24 nt, Human
cuuagccucccaaggagcugggau

SEQ ID NO: 863966 - RNA, 18 nt, Human
cuugagaucagcuccagu

SEQ ID NO: 863967 - RNA, 20 nt, Human
cuugccuuggccucccaaau

SEQ ID NO: 863968 - RNA, 18 nt, Human
gaaaagaggaaaauagug

SEQ ID NO: 863969 - RNA, 24 nt, Human
gacaacaagcuggccuagagccca

SEQ ID NO: 863970 - RNA, 20 nt, Human
gacaggguuucaccauguuu

SEQ ID NO: 863971 - RNA, 19 nt, Human
gacaggguuuugccauguu

SEQ ID NO: 863972 - RNA, 23 nt, Human
gacaggguuuugccauguugucc

SEQ ID NO: 863973 - RNA, 23 nt, Human
gaccucaggugauccgcccaccu

SEQ ID NO: 863974 - RNA, 22 nt, Human
gaccucaugaucugcccaccuc

SEQ ID NO: 863975 - RNA, 24 nt, Human
gacggagucucgcuuugucgucag

SEQ ID NO: 863976 - RNA, 22 nt, Human
gacuacaggcgcaugcuaccau

SEQ ID NO: 863977 - RNA, 24 nt, Human
gacugaucuugaacuccugaucuc

SEQ ID NO: 863978 - RNA, 24 nt, Human
gagcucaagugauuugcuugccuu

SEQ ID NO: 863979 - RNA, 24 nt, Human
gaguagcuggcauuacaggcacac

SEQ ID NO: 863980 - RNA, 26 nt, Human
gaguagcugggacuacaggcgcaugc

SEQ ID NO: 863981 - RNA, 18 nt, Human
gauuacaggcgugagcca

SEQ ID NO: 863982 - RNA, 22 nt, Human
gauuacaggcgugagccagugc

SEQ ID NO: 863983 - RNA, 18 nt, Human
gauuacagguaugaguca

SEQ ID NO: 863984 - RNA, 21 nt, Human
gauuacagguaugagucacca

SEQ ID NO: 863985 - RNA, 22 nt, Human
gauuacagguaugagucaccau

SEQ ID NO: 863986 - RNA, 18 nt, Human
gauuacaggugcgugcca

SEQ ID NO: 863987 - RNA, 18 nt, Human
gauuacaggugugagcca

SEQ ID NO: 863988 - RNA, 21 nt, Human
gauuacaggugugagccaccg

SEQ ID NO: 863989 - RNA, 24 nt, Human
gauuacaggugugagccaccgugc

SEQ ID NO: 863990 - RNA, 18 nt, Human
gauuauaggcgugagcca

SEQ ID NO: 863991 - RNA, 22 nt, Human
gauuauaggcgugagccaccgc

SEQ ID NO: 863992 - RNA, 23 nt, Human
gauuauaggcgugagccaccgca

SEQ ID NO: 863993 - RNA, 22 nt, Human
gcaaccucugccugcuggguuc

SEQ ID NO: 863994 - RNA, 18 nt, Human
gcagcugggauuacaggu

SEQ ID NO: 863995 - RNA, 18 nt, Human
gcagcugggauuacaggu

SEQ ID NO: 863996 - RNA, 18 nt, Human
gcaggguuucgccauguu

SEQ ID NO: 863997 - RNA, 19 nt, Human
gcaggguuucgccauguug

SEQ ID NO: 863998 - RNA, 20 nt, Human
gcauuacaggcacacgccac

SEQ ID NO: 863999 - RNA, 19 nt, Human
gcccaggcuggagugcagu

SEQ ID NO: 864000 - RNA, 20 nt, Human
gcccaggcuggagugcagug

SEQ ID NO: 864001 - RNA, 23 nt, Human
gccucagcuucccaaagagcugg

SEQ ID NO: 864002 - RNA, 24 nt, Human
gccucagcuucccaaagagcuggg

SEQ ID NO: 864003 - RNA, 20 nt, Human
gccugugaggacccaccagc

SEQ ID NO: 864004 - RNA, 20 nt, Human
gcucagccucccgaguagcu

SEQ ID NO: 864005 - RNA, 20 nt, Human
gcucugucgcccaggcugga

SEQ ID NO: 864006 - RNA, 25 nt, Human
gcucugucgcccaggcuggagugca

SEQ ID NO: 864007 - RNA, 19 nt, Human
gcuggagugcaguggcgca

SEQ ID NO: 864008 - RNA, 19 nt, Human
gcuggagugcaguggcgcg

SEQ ID NO: 864009 - RNA, 24 nt, Human
ggacuaaaggcacccuccaucaug

SEQ ID NO: 864010 - RNA, 18 nt, Human
ggagcugggauuacaggc

SEQ ID NO: 864011 - RNA, 21 nt, Human
gggacuaaaggcacccuccau

SEQ ID NO: 864012 - RNA, 24 nt, Human
gggacuaaaggcacccuccaucau

SEQ ID NO: 864013 - RNA, 18 nt, Human
gggguuucaccauguugg

SEQ ID NO: 864014 - RNA, 24 nt, Human
gggguuucaccauguugggcagga

SEQ ID NO: 864015 - RNA, 20 nt, Human
ggucucgaucuccugaccuc

SEQ ID NO: 864016 - RNA, 19 nt, Human
guagacaggguuucaccau

SEQ ID NO: 864017 - RNA, 21 nt, Human
guagagacaggguuuugccau

SEQ ID NO: 864018 - RNA, 21 nt, Human
guagaggcaggguuucgccau

SEQ ID NO: 864019 - RNA, 22 nt, Human
guagaggcaggguuucgccaug

SEQ ID NO: 864020 - RNA, 24 nt, Human
gucucgcuuugucgucaggcugga

SEQ ID NO: 864021 - RNA, 18 nt, Human
gugaaaggagcuccaucu

SEQ ID NO: 864022 - RNA, 24 nt, Human
gugauccacccgccucggccuccc

SEQ ID NO: 864023 - RNA, 24 nt, Human
gugauucucgugccucagccuccc

SEQ ID NO: 864024 - RNA, 22 nt, Human
gugccucagccucccgaguagc

SEQ ID NO: 864025 - RNA, 23 nt, Human
guucgaacuccugagcucaagug

SEQ ID NO: 864026 - RNA, 22 nt, Human
guuuggucuuccaggcuggagu

SEQ ID NO: 864027 - RNA, 22 nt, Human
uaauuuuugcauuuuuaguaga

SEQ ID NO: 864028 - RNA, 24 nt, Human
uacaggcacacgccaccacaccca

SEQ ID NO: 864029 - RNA, 22 nt, Human
uacagguaugagucaccaugcc

SEQ ID NO: 864030 - RNA, 24 nt, Human
uacaggugcgugccaccacaccca

SEQ ID NO: 864031 - RNA, 22 nt, Human
uacaggugugagccaccgugcc

SEQ ID NO: 864032 - RNA, 22 nt, Human
uacaggugugagccaccgugcc

SEQ ID NO: 864033 - RNA, 23 nt, Human
uacaggugugagccaccgugccu

SEQ ID NO: 864034 - RNA, 20 nt, Human
uacccugcccccaaacaggc

SEQ ID NO: 864035 - RNA, 24 nt, Human
uaccggguucaugcuauucuccug

SEQ ID NO: 864036 - RNA, 24 nt, Human
uacgugacaacaagcuggccuaga

SEQ ID NO: 864037 - RNA, 22 nt, Human
uagaaacgggguuucaccaugu

SEQ ID NO: 864038 - RNA, 21 nt, Human
uagagacaggguuuugccaug

SEQ ID NO: 864039 - RNA, 22 nt, Human
uagagacaggguuuugccaugu

SEQ ID NO: 864040 - RNA, 21 nt, Human
uagaggcaggguuucgccaug

SEQ ID NO: 864041 - RNA, 22 nt, Human
uagaggcaggguuucgccaugu

SEQ ID NO: 864042 - RNA, 24 nt, Human
uagcauugaagaaucuacuaacau

SEQ ID NO: 864043 - RNA, 18 nt, Human
uagcuggcauuacaggca

SEQ ID NO: 864044 - RNA, 24 nt, Human
uaguagaaacgggguuucaccaug

SEQ ID NO: 864045 - RNA, 26 nt, Human
uaguagaaacgggguuucaccauguu

SEQ ID NO: 864046 - RNA, 21 nt, Human
uaguucuguuuugaauuggua

SEQ ID NO: 864047 - RNA, 23 nt, Human
uauaggcgugagccaccgcaccu

SEQ ID NO: 864048 - RNA, 23 nt, Human
uaugagucaccaugccuggccau

SEQ ID NO: 864049 - RNA, 26 nt, Human
uauuauuauuuuuugauacagagucu

SEQ ID NO: 864050 - RNA, 19 nt, Human
uauucucccgccucagcuu

SEQ ID NO: 864051 - RNA, 19 nt, Human
uauucuccugccuuagccu

SEQ ID NO: 864052 - RNA, 19 nt, Human
uauugcucugucgcccagg

SEQ ID NO: 864053 - RNA, 23 nt, Human
uauugcucugucgcccaggcugg

SEQ ID NO: 864054 - RNA, 24 nt, Human
uauugcucugucgcccaggcugga

SEQ ID NO: 864055 - RNA, 18 nt, Human
ucacugcaaccuccaccu

SEQ ID NO: 864056 - RNA, 24 nt, Human
ucacugcaaccuccaccuaccggg

SEQ ID NO: 864057 - RNA, 23 nt, Human
ucacugcaaccuccgccuccugg

SEQ ID NO: 864058 - RNA, 24 nt, Human
ucacugcaaccuccgccuccuggg

SEQ ID NO: 864059 - RNA, 25 nt, Human
ucacugcaaccuccgccuccugggu

SEQ ID NO: 864060 - RNA, 27 nt, Human
ucacugcaaccuccgccuccuggguuc

SEQ ID NO: 864061 - RNA, 24 nt, Human
ucacugcaaccucugccugcuggg

SEQ ID NO: 864062 - RNA, 18 nt, Human
ucagcaggcaggcggccc

SEQ ID NO: 864063 - RNA, 20 nt, Human
ucagccucccgaguagcugg

SEQ ID NO: 864064 - RNA, 23 nt, Human
ucagccucccgaguagcugggac

SEQ ID NO: 864065 - RNA, 19 nt, Human
ucaugcuauucucccgccu

SEQ ID NO: 864066 - RNA, 24 nt, Human
uccagagcagcugggauuacaggu

SEQ ID NO: 864067 - RNA, 19 nt, Human
ucccaaagagcugggacua

SEQ ID NO: 864068 - RNA, 24 nt, Human
ucccaaagagcugggacuaaaggc

SEQ ID NO: 864069 - RNA, 23 nt, Human
ucccaaagugcugggauuacagg

SEQ ID NO: 864070 - RNA, 24 nt, Human
ucccaaagugcugggauuauaggc

SEQ ID NO: 864071 - RNA, 23 nt, Human
ucccaaauuguugggauuacagg

SEQ ID NO: 864072 - RNA, 24 nt, Human
ucccaaggagcugggauuacaggc

SEQ ID NO: 864073 - RNA, 24 nt, Human
ucccgaguagcuggcauuacaggc

SEQ ID NO: 864074 - RNA, 24 nt, Human
ucccgaguagcugggacuacaggc

SEQ ID NO: 864075 - RNA, 24 nt, Human
ucgcccaggcuggagugcaguggc

SEQ ID NO: 864076 - RNA, 18 nt, Human
ucggccucccaaagugcu

SEQ ID NO: 864077 - RNA, 18 nt, Human
ucggccucccaaagugcu

SEQ ID NO: 864078 - RNA, 24 nt, Human
ucgucaggcuggagugcaguggcg

SEQ ID NO: 864079 - RNA, 26 nt, Human
ucuccugccuuagccucccaaggagc

SEQ ID NO: 864080 - RNA, 22 nt, Human
ucucgcuuugucgucaggcugg

SEQ ID NO: 864081 - RNA, 23 nt, Human
ucucgcuuugucgucaggcugga

SEQ ID NO: 864082 - RNA, 23 nt, Human
ucucguuuggucuuccaggcugg

SEQ ID NO: 864083 - RNA, 24 nt, Human
ucucguuuggucuuccaggcugga

SEQ ID NO: 864084 - RNA, 21 nt, Human
ucuggcucuguugccuagugg

SEQ ID NO: 864085 - RNA, 24 nt, Human
ucugucgcccaggcuggagugcag

SEQ ID NO: 864086 - RNA, 24 nt, Human
ucuuccaggcuggagugcaguggu

SEQ ID NO: 864087 - RNA, 21 nt, Human
ucuugaacuccugaucucaag

SEQ ID NO: 864088 - RNA, 18 nt, Human
ugaccucaggugauccgc

SEQ ID NO: 864089 - RNA, 21 nt, Human
ugaccucaggugauccgccca

SEQ ID NO: 864090 - RNA, 24 nt, Human
ugaccucaggugauccgcccaccu

SEQ ID NO: 864091 - RNA, 22 nt, Human
ugagacagggucuggcucuguu

SEQ ID NO: 864092 - RNA, 18 nt, Human
ugagauuacaggcgugag

SEQ ID NO: 864093 - RNA, 18 nt, Human
ugagauuacaggcgugag

SEQ ID NO: 864094 - RNA, 19 nt, Human
ugagauuacaggcgugagc

SEQ ID NO: 864095 - RNA, 21 nt, Human
ugagauuacaggcgugagcca

SEQ ID NO: 864096 - RNA, 24 nt, Human
ugagauuacaggcgugagccagug

SEQ ID NO: 864097 - RNA, 27 nt, Human
ugagauuacaggcgugagccagugcgc

SEQ ID NO: 864098 - RNA, 31 nt, Human
ugagauuacaggcgugagccagugcgcccgg

SEQ ID NO: 864099 - RNA, 20 nt, Human
ugagcucaagugauuugcuu

SEQ ID NO: 864100 - RNA, 19 nt, Human
ugaggacccaccagcugac

SEQ ID NO: 864101 - RNA, 24 nt, Human
ugaucucaagugauccacccgccu

SEQ ID NO: 864102 - RNA, 24 nt, Human
ugaucugcccaccucggccuccca

SEQ ID NO: 864103 - RNA, 22 nt, Human
ugcaguggcgcaaucuuggcuc

SEQ ID NO: 864104 - RNA, 23 nt, Human
ugcaguggcgcaaucuuggcuca

SEQ ID NO: 864105 - RNA, 22 nt, Human
ugcaguggcgcgaucucggcuc

SEQ ID NO: 864106 - RNA, 24 nt, Human
ugccauguuguccagacugaucuu

SEQ ID NO: 864107 - RNA, 27 nt, Human
ugccauguuguccagacugaucuugaa

SEQ ID NO: 864108 - RNA, 20 nt, Human
ugccccaggaccuacccugc

SEQ ID NO: 864109 - RNA, 24 nt, Human
ugccucagccuccagagcagcugg

SEQ ID NO: 864110 - RNA, 22 nt, Human
ugccucagccucccgaguagcu

SEQ ID NO: 864111 - RNA, 24 nt, Human
ugccucagccucccgaguagcugg

SEQ ID NO: 864112 - RNA, 22 nt, Human
ugccugcuggguucaagugauu

SEQ ID NO: 864113 - RNA, 24 nt, Human
ugccuuagccucccaaggagcugg

SEQ ID NO: 864114 - RNA, 18 nt, Human
ugccuuggccucccaaau

SEQ ID NO: 864115 - RNA, 20 nt, Human
ugcgugccaccacacccagc

SEQ ID NO: 864116 - RNA, 24 nt, Human
ugcucugucgcccaggcuggagug

SEQ ID NO: 864117 - RNA, 24 nt, Human
ugcugagauuacaggcgugagcca

SEQ ID NO: 864118 - RNA, 24 nt, Human
ugcugggauuacaggugugagcca

SEQ ID NO: 864119 - RNA, 18 nt, Human
ugcuugccuuggccuccc

SEQ ID NO: 864120 - RNA, 23 nt, Human
uggagugcaguggcgcaaucuug

SEQ ID NO: 864121 - RNA, 24 nt, Human
uggagugcaguggcgcaaucuugg

SEQ ID NO: 864122 - RNA, 23 nt, Human
uggagugcaguggcgcgaucucg

SEQ ID NO: 864123 - RNA, 24 nt, Human
uggagugcaguggcgcgaucucgg

SEQ ID NO: 864124 - RNA, 23 nt, Human
uggagugcaguggugcgaucuug

SEQ ID NO: 864125 - RNA, 24 nt, Human
uggagugcaguggugcgaucuugg

SEQ ID NO: 864126 - RNA, 23 nt, Human
uggcaugcaauaaaauugcauuu

SEQ ID NO: 864127 - RNA, 22 nt, Human
uggcauuacaggcacacgccac

SEQ ID NO: 864128 - RNA, 24 nt, Human
uggcauuacaggcacacgccacca

SEQ ID NO: 864129 - RNA, 26 nt, Human
uggccaggcuggucuugaacugaccu

SEQ ID NO: 864130 - RNA, 21 nt, Human
uggcucacugcaaccucugcc

SEQ ID NO: 864131 - RNA, 21 nt, Human
ugggacuaaaggcacccucca

SEQ ID NO: 864132 - RNA, 22 nt, Human
ugggacuacaggcgcaugcuac

SEQ ID NO: 864133 - RNA, 24 nt, Human
ugggacuacaggcgcaugcuacca

SEQ ID NO: 864134 - RNA, 25 nt, Human
ugggacuacaggcgcaugcuaccau

SEQ ID NO: 864135 - RNA, 21 nt, Human
ugggauuacaggcacccucca

SEQ ID NO: 864136 - RNA, 22 nt, Human
ugggauuacaggcacccuccac

SEQ ID NO: 864137 - RNA, 18 nt, Human
ugggauuacagguaugag

SEQ ID NO: 864138 - RNA, 22 nt, Human
ugggauuacagguaugagucac

SEQ ID NO: 864139 - RNA, 23 nt, Human
ugggauuacagguaugagucacc

SEQ ID NO: 864140 - RNA, 24 nt, Human
ugggauuacagguaugagucacca

SEQ ID NO: 864141 - RNA, 25 nt, Human
ugggauuacagguaugagucaccau

SEQ ID NO: 864142 - RNA, 18 nt, Human
ugggauuacaggugcgug

SEQ ID NO: 864143 - RNA, 21 nt, Human
ugggauuacaggugcgugcca

SEQ ID NO: 864144 - RNA, 22 nt, Human
ugggauuacaggugcgugccac

SEQ ID NO: 864145 - RNA, 24 nt, Human
ugggauuacaggugcgugccacca

SEQ ID NO: 864146 - RNA, 18 nt, Human
ugggauuacaggugugag

SEQ ID NO: 864147 - RNA, 21 nt, Human
ugggauuacaggugugagcca

SEQ ID NO: 864148 - RNA, 22 nt, Human
ugggauuacaggugugagccac

SEQ ID NO: 864149 - RNA, 23 nt, Human
ugggauuacaggugugagccacc

SEQ ID NO: 864150 - RNA, 23 nt, Human
ugggauuacaggugugagccacc

SEQ ID NO: 864151 - RNA, 24 nt, Human
ugggauuacaggugugagccaccg

SEQ ID NO: 864152 - RNA, 18 nt, Human
ugggauuauaggcgugag

SEQ ID NO: 864153 - RNA, 19 nt, Human
ugggauuauaggcgugagc

SEQ ID NO: 864154 - RNA, 21 nt, Human
ugggauuauaggcgugagcca

SEQ ID NO: 864155 - RNA, 22 nt, Human
ugggauuauaggcgugagccac

SEQ ID NO: 864156 - RNA, 23 nt, Human
ugggauuauaggcgugagccacc

SEQ ID NO: 864157 - RNA, 24 nt, Human
ugggauuauaggcgugagccaccg

SEQ ID NO: 864158 - RNA, 23 nt, Human
uggguucaagugauucucgugcc

SEQ ID NO: 864159 - RNA, 21 nt, Human
uggucuugaacugaccucagg

SEQ ID NO: 864160 - RNA, 24 nt, Human
uguagagacaggguuuugccaugu

SEQ ID NO: 864161 - RNA, 24 nt, Human
uguagaggcaggguuucgccaugu

SEQ ID NO: 864162 - RNA, 24 nt, Human
uguccagacugaucuugaacuccu

SEQ ID NO: 864163 - RNA, 18 nt, Human
ugucgucaggcuggagug

SEQ ID NO: 864164 - RNA, 23 nt, Human
ugugaaaggagcuccaucugcuu

SEQ ID NO: 864165 - RNA, 23 nt, Human
uguggaaaccuggacucuggcug

SEQ ID NO: 864166 - RNA, 20 nt, Human
uguugggauuacagguauga

SEQ ID NO: 864167 - RNA, 24 nt, Human
uuaguagaaacgggguuucaccau

SEQ ID NO: 864168 - RNA, 23 nt, Human
uucaagugauucucgugccucag

SEQ ID NO: 864169 - RNA, 22 nt, Human
uuccaggcuggagugcaguggu

SEQ ID NO: 864170 - RNA, 23 nt, Human
uuccaggcuggagugcaguggug

SEQ ID NO: 864171 - RNA, 22 nt, Human
uugagacagggucuggcucugu

SEQ ID NO: 864172 - RNA, 22 nt, Human
uugagacagggucuggcucugu

SEQ ID NO: 864173 - RNA, 20 nt, Human
uugcucugucgcccaggcug

SEQ ID NO: 864174 - RNA, 22 nt, Human
uugcucugucgcccaggcugga

SEQ ID NO: 864175 - RNA, 24 nt, Human
uuggccaggcuggucuugaacuga

SEQ ID NO: 864176 - RNA, 24 nt, Human
uugggauuacagguaugagucacc

SEQ ID NO: 864177 - RNA, 24 nt, Human
uuggucuuccaggcuggagugcag

SEQ ID NO: 864178 - RNA, 22 nt, Human
uuguagacaggguuucaccaug

SEQ ID NO: 864179 - RNA, 24 nt, Human
uuguagagacaggguuuugccaug

SEQ ID NO: 864180 - RNA, 24 nt, Human
uuguagaggcaggguuucgccaug

SEQ ID NO: 864181 - RNA, 19 nt, Human
uuucaccauguugggcagg

SEQ ID NO: 864182 - RNA, 25 nt, Human
uuucaccauguuuggccaggcuggu

SEQ ID NO: 864183 - RNA, 21 nt, Human
uuucgccauguugcccaaacu

SEQ ID NO: 864184 - RNA, 22 nt, Human
uuuguagacaggguuucaccau

SEQ ID NO: 864185 - RNA, 20 nt, Human
uuuguagagacaggguuuug

SEQ ID NO: 864186 - RNA, 23 nt, Human
uuuguagagacaggguuuugcca

SEQ ID NO: 864187 - RNA, 24 nt, Human
uuuguagagacaggguuuugccau

SEQ ID NO: 864188 - RNA, 18 nt, Human
uuuguagaggcaggguuu

SEQ ID NO: 864189 - RNA, 24 nt, Human
uuuguagaggcaggguuucgccau

SEQ ID NO: 864190 - RNA, 23 nt, Human
uuugucgucaggcuggagugcag

SEQ ID NO: 864191 - RNA, 18 nt, Human
uuuugccauguuguccag

SEQ ID NO: 864192 - RNA, 24 nt, Human
uuuuguagacaggguuucaccaug

SEQ ID NO: 864193 - RNA, 24 nt, Human
uuuuuaguagaaacgggguuucac

SEQ ID NO: 864194 - RNA, 21 nt, Human
uuuuuuguagagacaggguuu

SEQ ID NO: 864195 - RNA, 24 nt, Human
uuuuuuguagagacaggguuuugc

SEQ ID NO: 864196 - RNA, 19 nt, Human
uuuuuuuuuuugagacggg

SEQ ID NO: 864197 - RNA, 23 nt, Human
uuuuuuuuuuugagacgggagua

SEQ ID NO: 864198 - RNA, 25 nt, Human
uuuuuuuuuuuugagacggagucuc

SEQ ID NO: 864199 - RNA, 22 nt, Human
uuuuuuuuuuuuuugagacgga

SEQ ID NO: 864200 - RNA, 22 nt, Human
uuuuuuuuuuuuuugagacggg

SEQ ID NO: 864201 - RNA, 18 nt, Human
uuuuuuuuuuuuuuuuug

SEQ ID NO: 864202 - RNA, 23 nt, Human
aaaagcucugcucccugcaaccu

SEQ ID NO: 864203 - RNA, 19 nt, Human
aagaauguacaguucuugg

SEQ ID NO: 864204 - RNA, 19 nt, Human
agaggaaggagggauggga

SEQ ID NO: 864205 - RNA, 20 nt, Human
agaggaaggagggaugggag

SEQ ID NO: 864206 - RNA, 21 nt, Human
aggagggaugggagcugaauc

SEQ ID NO: 864207 - RNA, 22 nt, Human
aguauugaaaaguggagaggaa

SEQ ID NO: 864208 - RNA, 26 nt, Human
agucaccagcucacugaggaaccaga

SEQ ID NO: 864209 - RNA, 21 nt, Human
cacacagaccugccuggaagc

SEQ ID NO: 864210 - RNA, 25 nt, Human
cacaccccugcgcacgugcagcccc

SEQ ID NO: 864211 - RNA, 19 nt, Human
caggucccaggcccccucu

SEQ ID NO: 864212 - RNA, 18 nt, Human
cccaggcccccucugggc

SEQ ID NO: 864213 - RNA, 21 nt, Human
cccaggcccccucugggcuuc

SEQ ID NO: 864214 - RNA, 23 nt, Human
ccccugcgcacgugcagcccccg

SEQ ID NO: 864215 - RNA, 24 nt, Human
ccuccaggccugggauggaccuag

SEQ ID NO: 864216 - RNA, 19 nt, Human
cgcccccaucucugccagg

SEQ ID NO: 864217 - RNA, 22 nt, Human
cgcccccaucucugccaggucc

SEQ ID NO: 864218 - RNA, 24 nt, Human
cuauugucuguauuugccggugcc

SEQ ID NO: 864219 - RNA, 18 nt, Human
cucccugcaaccucccca

SEQ ID NO: 864220 - RNA, 18 nt, Human
cucugggcuucuguccca

SEQ ID NO: 864221 - RNA, 19 nt, Human
cuggaagccuucaaaggcc

SEQ ID NO: 864222 - RNA, 19 nt, Human
cuuggagaaggagaggaag

SEQ ID NO: 864223 - RNA, 21 nt, Human
gagaggaaggagggaugggag

SEQ ID NO: 864224 - RNA, 22 nt, Human
gagaggaaggagggaugggagc

SEQ ID NO: 864225 - RNA, 21 nt, Human
gaggaaggagggaugggagcu

SEQ ID NO: 864226 - RNA, 24 nt, Human
gcagccuuugggaagguguggggg

SEQ ID NO: 864227 - RNA, 20 nt, Human
gccauggguuuggagugcca

SEQ ID NO: 864228 - RNA, 21 nt, Human
ggagaggaaggagggauggga

SEQ ID NO: 864229 - RNA, 19 nt, Human
ggagucaccugccagucac

SEQ ID NO: 864230 - RNA, 23 nt, Human
ggucgggguggggguccccguuc

SEQ ID NO: 864231 - RNA, 19 nt, Human
gucuguauuugccggugcc

SEQ ID NO: 864232 - RNA, 24 nt, Human
uauugaaaaguggagaggaaccgg

SEQ ID NO: 864233 - RNA, 26 nt, Human
ucagagcagccuuugggaaggugugg

SEQ ID NO: 864234 - RNA, 24 nt, Human
ucccaggcccccucugggcuucug

SEQ ID NO: 864235 - RNA, 21 nt, Human
ucucuccaucagaaugaaagc

SEQ ID NO: 864236 - RNA, 24 nt, Human
ugaaagcuccucgagggcagggac

SEQ ID NO: 864237 - RNA, 18 nt, Human
ugaaggcacuuggagaag

SEQ ID NO: 864238 - RNA, 19 nt, Human
ugagcagcggccugaggug

SEQ ID NO: 864239 - RNA, 19 nt, Human
ugaggugcugugucugaca

SEQ ID NO: 864240 - RNA, 20 nt, Human
ugaggugcugugucugacau

SEQ ID NO: 864241 - RNA, 21 nt, Human
ugcaacaggcacucaauaaau

SEQ ID NO: 864242 - RNA, 23 nt, Human
ugccuguaugcaacaggcacuca

SEQ ID NO: 864243 - RNA, 22 nt, Human
ugcugagggagucaccugcccc

SEQ ID NO: 864244 - RNA, 23 nt, Human
uggacaggcaugaguuagauucu

SEQ ID NO: 864245 - RNA, 21 nt, Human
uggauucccaacugucagccu

SEQ ID NO: 864246 - RNA, 23 nt, Human
uggauucccaacugucagccucc

SEQ ID NO: 864247 - RNA, 23 nt, Human
ugggcuucugucccacacagacc

SEQ ID NO: 864248 - RNA, 22 nt, Human
uguagacuggacaggcaugagu

SEQ ID NO: 864249 - RNA, 18 nt, Human
uucuugguuugaaggcac

SEQ ID NO: 864250 - RNA, 21 nt, Human
uucuugguuugaaggcacuug

SEQ ID NO: 864251 - RNA, 18 nt, Human
uugcuggggacagaggca

SEQ ID NO: 864252 - RNA, 21 nt, Human
uugguuugaaggcacuuggag

SEQ ID NO: 864253 - RNA, 19 nt, Human
uuuuuuuuuuuuuuuugca

SEQ ID NO: 864254 - RNA, 18 nt, Human
uuuuuuuuuuuuuuuuug

SEQ ID NO: 864255 - RNA, 23 nt, Human
uuuuuuuuuuuuuuuuugcauuu

SEQ ID NO: 864256 - RNA, 21 nt, Human
aaacacacaagacacaaagaa

SEQ ID NO: 864257 - RNA, 20 nt, Human
aagacacaaagaaagcccaa

SEQ ID NO: 864258 - RNA, 18 nt, Human
aggggugagaggacacag

SEQ ID NO: 864259 - RNA, 23 nt, Human
caagacacaaagaaagcccaaua

SEQ ID NO: 864260 - RNA, 27 nt, Human
caauaaagcugugagucccaguuuggu

SEQ ID NO: 864261 - RNA, 23 nt, Human
caccucuggaugcacaacagcuc

SEQ ID NO: 864262 - RNA, 22 nt, Human
cccugggugacugcauugcugg

SEQ ID NO: 864263 - RNA, 19 nt, Human
gcacaacagcucguggccu

SEQ ID NO: 864264 - RNA, 21 nt, Human
gcccaauaaagcugugagucc

SEQ ID NO: 864265 - RNA, 19 nt, Human
ggaaagaaggggugagagg

SEQ ID NO: 864266 - RNA, 21 nt, Human
gggaaagaaggggugagagga

SEQ ID NO: 864267 - RNA, 20 nt, Human
uaaaagaaacacacaagaca

SEQ ID NO: 864268 - RNA, 20 nt, Human
uccucaguaucccugggaaa

SEQ ID NO: 864269 - RNA, 21 nt, Human
uccucaguaucccugggaaag

SEQ ID NO: 864270 - RNA, 23 nt, Human
uuuuuuuuuuuuuuuuuaccuuu

SEQ ID NO: 864271 - RNA, 29 nt, Human
uuuuuuuuuuuuuuuuuuuaccuuuuuaa

SEQ ID NO: 864272 - RNA, 19 nt, Human
aggcgggcgggcggggugc

SEQ ID NO: 864273 - RNA, 23 nt, Human
caccgccgccaccagagccgccu

SEQ ID NO: 864274 - RNA, 23 nt, Human
ccaccgccgccaccagagccgcc

SEQ ID NO: 864275 - RNA, 21 nt, Human
cgaccgaggagcagaccuggc

SEQ ID NO: 864276 - RNA, 19 nt, Human
cgcaggguguggaugggcc

SEQ ID NO: 864277 - RNA, 19 nt, Human
cgccgccucggccgccgcc

SEQ ID NO: 864278 - RNA, 18 nt, Human
cuccuaugagguuggaag

SEQ ID NO: 864279 - RNA, 22 nt, Human
cucggccgccgccucagccucc

SEQ ID NO: 864280 - RNA, 18 nt, Human
cuggcaggaggcgccugu

SEQ ID NO: 864281 - RNA, 20 nt, Human
gccucggccgccgccucagc

SEQ ID NO: 864282 - RNA, 22 nt, Human
ggaggcgggcgggcggggugcu

SEQ ID NO: 864283 - RNA, 20 nt, Human
ggaugggccggcagggaggc

SEQ ID NO: 864284 - RNA, 27 nt, Human
gggccggcagggaggcgggcgggcggg

SEQ ID NO: 864285 - RNA, 19 nt, Human
uaacuuccagccacggccu

SEQ ID NO: 864286 - RNA, 21 nt, Human
uaacuuccagccacggccucg

SEQ ID NO: 864287 - RNA, 20 nt, Human
uaugagguuggaaguggugu

SEQ ID NO: 864288 - RNA, 18 nt, Human
uccuccgucgccgccucg

SEQ ID NO: 864289 - RNA, 18 nt, Human
ucgccgccucggccgccg

SEQ ID NO: 864290 - RNA, 20 nt, Human
ucgccgccucggccgccgcc

SEQ ID NO: 864291 - RNA, 20 nt, Human
uggcgggcaggcgggugggc

SEQ ID NO: 864292 - RNA, 20 nt, Human
ugguguggacgcagggugug

SEQ ID NO: 864293 - RNA, 22 nt, Human
uuuccuccgucgccgccucggc

SEQ ID NO: 864294 - RNA, 18 nt, Human
uuuuuuuuuuuugggucu

SEQ ID NO: 864295 - RNA, 18 nt, Human
uuuuuuuuuuuuuuuuug

SEQ ID NO: 864296 - RNA, 22 nt, Human
uuuuuuuuuuuuuuuuuuuggg

SEQ ID NO: 864297 - RNA, 24 nt, Human
uuuuuuuuuuuuuuuuuuuggguc

SEQ ID NO: 864298 - RNA, 22 nt, Human
aaauaccagaaauuaaagagcu

SEQ ID NO: 864299 - RNA, 19 nt, Human
aggcgcagguccgggcaca

SEQ ID NO: 864300 - RNA, 22 nt, Human
cagaaggcgcagguccgggcac

SEQ ID NO: 864301 - RNA, 22 nt, Human
ccgccgccgccgccgaguccgu

SEQ ID NO: 864302 - RNA, 20 nt, Human
ccgccgccgccgccgccgcc

SEQ ID NO: 864303 - RNA, 24 nt, Human
ccgccgccgccgccgccgccgagu

SEQ ID NO: 864304 - RNA, 20 nt, Human
gacccagaaggcgcaggucc

SEQ ID NO: 864305 - RNA, 20 nt, Human
gauggggugcggguggggcg

SEQ ID NO: 864306 - RNA, 22 nt, Human
gccgccgccgccgccgccgccg

SEQ ID NO: 864307 - RNA, 19 nt, Human
uaccagaaauuaaagagcu

SEQ ID NO: 864308 - RNA, 24 nt, Human
uaccagaaauuaaagagcugacag

SEQ ID NO: 864309 - RNA, 21 nt, Human
ucagagacccagaaggcgcag

SEQ ID NO: 864310 - RNA, 22 nt, Human
uggggugcggguggggcgcagg

SEQ ID NO: 864311 - RNA, 19 nt, Human
aagcagugggcccacccuc

SEQ ID NO: 864312 - RNA, 19 nt, Human
agccgggggcgccggccgc

SEQ ID NO: 864313 - RNA, 20 nt, Human
agccgggggcgccggccgcc

SEQ ID NO: 864314 - RNA, 24 nt, Human
agccgggggcgccggccgcccggc

SEQ ID NO: 864315 - RNA, 19 nt, Human
aguucuuauugauaguccc

SEQ ID NO: 864316 - RNA, 23 nt, Human
caaagcagugggcccacccuccc

SEQ ID NO: 864317 - RNA, 18 nt, Human
cacccucccuccuaccag

SEQ ID NO: 864318 - RNA, 18 nt, Human
cagccccuccccagcacc

SEQ ID NO: 864319 - RNA, 21 nt, Human
cagugggcccacccucccucc

SEQ ID NO: 864320 - RNA, 20 nt, Human
cccuccuaccagccccuccc

SEQ ID NO: 864321 - RNA, 18 nt, Human
ccgcugccccggcggggc

SEQ ID NO: 864322 - RNA, 21 nt, Human
ccggccccggcgaagcccucg

SEQ ID NO: 864323 - RNA, 18 nt, Human
ccuccaaagcagugggcc

SEQ ID NO: 864324 - RNA, 21 nt, Human
ccuccaaagcagugggcccac

SEQ ID NO: 864325 - RNA, 20 nt, Human
ccuccuaccagccccucccc

SEQ ID NO: 864326 - RNA, 21 nt, Human
ccuccuaccagccccucccca

SEQ ID NO: 864327 - RNA, 22 nt, Human
ccuccuaccagccccuccccag

SEQ ID NO: 864328 - RNA, 21 nt, Human
cgggagcagccgggggcgccg

SEQ ID NO: 864329 - RNA, 22 nt, Human
cgggagcagccgggggcgccgg

SEQ ID NO: 864330 - RNA, 24 nt, Human
cucccuccuaccagccccucccca

SEQ ID NO: 864331 - RNA, 23 nt, Human
gcucucaccaccgcugccccggc

SEQ ID NO: 864332 - RNA, 18 nt, Human
ggagcagccgggggcgcc

SEQ ID NO: 864333 - RNA, 20 nt, Human
ggcggcgggagcagccgggg

SEQ ID NO: 864334 - RNA, 21 nt, Human
gggcccacccucccuccuacc

SEQ ID NO: 864335 - RNA, 25 nt, Human
ggggcgcggguccgggcggcggcgg

SEQ ID NO: 864336 - RNA, 19 nt, Human
uaccagccccuccccagca

SEQ ID NO: 864337 - RNA, 18 nt, Human
uccccagcacccagcccc

SEQ ID NO: 864338 - RNA, 25 nt, Human
uccuaccagccccuccccagcaccc

SEQ ID NO: 864339 - RNA, 18 nt, Human
uuuuuuuuuuuuuuuuug

SEQ ID NO: 864340 - RNA, 21 nt, Human
uuuuuuuuuuuuuuuuugcgu

SEQ ID NO: 864341 - RNA, 25 nt, Human
aaaaaaaaaaaacacauccauaagc

SEQ ID NO: 864342 - RNA, 18 nt, Human
aaaaaaaaaacacaucca

SEQ ID NO: 864343 - RNA, 24 nt, Human
aaacucacuccucucuccacccac

SEQ ID NO: 864344 - RNA, 18 nt, Human
aaucgcuugaauccggga

SEQ ID NO: 864345 - RNA, 24 nt, Human
acagagcgagacuccaucucaaaa

SEQ ID NO: 864346 - RNA, 20 nt, Human
acauccagauuguuguacag

SEQ ID NO: 864347 - RNA, 23 nt, Human
accaccuuccugagggaaagcca

SEQ ID NO: 864348 - RNA, 18 nt, Human
accucgucucuacuaaaa

SEQ ID NO: 864349 - RNA, 19 nt, Human
acuauauuuuccuacaucu

SEQ ID NO: 864350 - RNA, 28 nt, Human
acuccaucucaaaaaaaaaaaaaaaaaa

SEQ ID NO: 864351 - RNA, 23 nt, Human
acugcacuccagccuggcgacag

SEQ ID NO: 864352 - RNA, 25 nt, Human
acugcacuccagccuggcgacagag

SEQ ID NO: 864353 - RNA, 18 nt, Human
agacucauucagggaauu

SEQ ID NO: 864354 - RNA, 24 nt, Human
agagggugcagugagcugaggucg

SEQ ID NO: 864355 - RNA, 24 nt, Human
agcacuuugggaggcugagguggg

SEQ ID NO: 864356 - RNA, 23 nt, Human
agccaccaccuuccugagggaaa

SEQ ID NO: 864357 - RNA, 22 nt, Human
agccagagauuaaaagcucacu

SEQ ID NO: 864358 - RNA, 21 nt, Human
agccuggcgacagagcgagac

SEQ ID NO: 864359 - RNA, 23 nt, Human
agccuggcgacagagcgagacuc

SEQ ID NO: 864360 - RNA, 23 nt, Human
agcugggcgugguggcgcaugcc

SEQ ID NO: 864361 - RNA, 24 nt, Human
aggcaggagaaucgcuugaauccg

SEQ ID NO: 864362 - RNA, 20 nt, Human
aggcugaggcaggagaaucg

SEQ ID NO: 864363 - RNA, 24 nt, Human
aggcugaggcaggagaaucgcuug

SEQ ID NO: 864364 - RNA, 20 nt, Human
aggcugaggugggcggauca

SEQ ID NO: 864365 - RNA, 24 nt, Human
aucacugaaaaaaaagggucaaga

SEQ ID NO: 864366 - RNA, 20 nt, Human
auggugaaaccucgucucua

SEQ ID NO: 864367 - RNA, 25 nt, Human
caaaaaaaauuagcugggcguggug

SEQ ID NO: 864368 - RNA, 25 nt, Human
caccacugcacuccagccuggcgac

SEQ ID NO: 864369 - RNA, 21 nt, Human
cacccacaacuauauuuuccu

SEQ ID NO: 864370 - RNA, 22 nt, Human
cacuccagccuggcgacagagc

SEQ ID NO: 864371 - RNA, 23 nt, Human
cacuccagccuggcgacagagcg

SEQ ID NO: 864372 - RNA, 18 nt, Human
cacugcacuccagccugg

SEQ ID NO: 864373 - RNA, 18 nt, Human
cacugcacuccagccugg

SEQ ID NO: 864374 - RNA, 22 nt, Human
cacugcacuccagccuggcgac

SEQ ID NO: 864375 - RNA, 23 nt, Human
cacugcacuccagccuggcgaca

SEQ ID NO: 864376 - RNA, 24 nt, Human
cacugcacuccagccuggcgacag

SEQ ID NO: 864377 - RNA, 21 nt, Human
cagcacuuugggaggcugagg

SEQ ID NO: 864378 - RNA, 24 nt, Human
cagcacuuugggaggcugaggugg

SEQ ID NO: 864379 - RNA, 25 nt, Human
caucucaaaaaaaaaaaaaaaaaaa

SEQ ID NO: 864380 - RNA, 21 nt, Human
caucuggcugggcgcgguggc

SEQ ID NO: 864381 - RNA, 21 nt, Human
caugccaccuucccaccuaaa

SEQ ID NO: 864382 - RNA, 24 nt, Human
caugccaccuucccaccuaaacaa

SEQ ID NO: 864383 - RNA, 20 nt, Human
ccaccuaaacaaacucacuc

SEQ ID NO: 864384 - RNA, 21 nt, Human
ccaccuaaacaaacucacucc

SEQ ID NO: 864385 - RNA, 22 nt, Human
ccaccuuccugagggaaagcca

SEQ ID NO: 864386 - RNA, 19 nt, Human
ccacugcacuccagccugg

SEQ ID NO: 864387 - RNA, 19 nt, Human
ccacugcacuccagccugg

SEQ ID NO: 864388 - RNA, 20 nt, Human
ccacugcacuccagccuggc

SEQ ID NO: 864389 - RNA, 23 nt, Human
ccacugcacuccagccuggcgac

SEQ ID NO: 864390 - RNA, 19 nt, Human
cccaccuaaacaaacucac

SEQ ID NO: 864391 - RNA, 23 nt, Human
ccuaaacaaacucacuccucucu

SEQ ID NO: 864392 - RNA, 21 nt, Human
ccuggcgacagagcgagacuc

SEQ ID NO: 864393 - RNA, 21 nt, Human
ccuggcuaauauggugaaacc

SEQ ID NO: 864394 - RNA, 21 nt, Human
ccuggcuaauauggugaaacc

SEQ ID NO: 864395 - RNA, 24 nt, Human
ccuggcuaauauggugaaaccucg

SEQ ID NO: 864396 - RNA, 22 nt, Human
ccuguaaucucagcacuuuggg

SEQ ID NO: 864397 - RNA, 23 nt, Human
cgagacuccaucucaaaaaaaaa

SEQ ID NO: 864398 - RNA, 21 nt, Human
cgcaccacugcacuccagccu

SEQ ID NO: 864399 - RNA, 18 nt, Human
cucaaaaaaaaaaaaaaa

SEQ ID NO: 864400 - RNA, 27 nt, Human
cucaaaaaaaaaaaaaaaaaaacacaa

SEQ ID NO: 864401 - RNA, 19 nt, Human
cucacuccucucuccaccc

SEQ ID NO: 864402 - RNA, 24 nt, Human
cuccagccuggcgacagagcgaga

SEQ ID NO: 864403 - RNA, 19 nt, Human
cuccaucucaaaaaaaaaa

SEQ ID NO: 864404 - RNA, 19 nt, Human
cuugugggaaaaggguaac

SEQ ID NO: 864405 - RNA, 19 nt, Human
gaaaccucgucucuacuaa

SEQ ID NO: 864406 - RNA, 18 nt, Human
gagauauuuaaacauaga

SEQ ID NO: 864407 - RNA, 20 nt, Human
gcaccacugcacuccagccu

SEQ ID NO: 864408 - RNA, 23 nt, Human
gcacuccagccuggcgacagagc

SEQ ID NO: 864409 - RNA, 25 nt, Human
gccaccuucccaccuaaacaaacuc

SEQ ID NO: 864410 - RNA, 19 nt, Human
gccuguaaucucagcacuu

SEQ ID NO: 864411 - RNA, 24 nt, Human
gcuaauauggugaaaccucgucuc

SEQ ID NO: 864412 - RNA, 21 nt, Human
ggaaagccaugaugccaaucc

SEQ ID NO: 864413 - RNA, 23 nt, Human
ggcgcgguggcuuaugccuguaa

SEQ ID NO: 864414 - RNA, 21 nt, Human
ggcggaucaggaggucaggag

SEQ ID NO: 864415 - RNA, 20 nt, Human
gggaggcugaggugggcgga

SEQ ID NO: 864416 - RNA, 23 nt, Human
gguggcuuaugccuguaaucuca

SEQ ID NO: 864417 - RNA, 24 nt, Human
gguggcuuaugccuguaaucucag

SEQ ID NO: 864418 - RNA, 20 nt, Human
guaacagagucacauccaga

SEQ ID NO: 864419 - RNA, 21 nt, Human
guacugcccuuuauuuacaca

SEQ ID NO: 864420 - RNA, 24 nt, Human
gucgcaccacugcacuccagccug

SEQ ID NO: 864421 - RNA, 22 nt, Human
gugcagugagcugaggucgcac

SEQ ID NO: 864422 - RNA, 23 nt, Human
uaaaaggcacuuucauagagaua

SEQ ID NO: 864423 - RNA, 22 nt, Human
uaauauggugaaaccucgucuc

SEQ ID NO: 864424 - RNA, 24 nt, Human
uaauauggugaaaccucgucucua

SEQ ID NO: 864425 - RNA, 23 nt, Human
uaaucacugaaaaaaaaggguca

SEQ ID NO: 864426 - RNA, 23 nt, Human
uaaugacaacuucaucccaugcc

SEQ ID NO: 864427 - RNA, 21 nt, Human
uacacagagaagaugcucagu

SEQ ID NO: 864428 - RNA, 26 nt, Human
uacaguuaccacaaaaauaaaauagg

SEQ ID NO: 864429 - RNA, 21 nt, Human
uagaaacaaagcuucaaacau

SEQ ID NO: 864430 - RNA, 20 nt, Human
uaugccuguaaucucagcac

SEQ ID NO: 864431 - RNA, 24 nt, Human
uaugccuguaaucucagcacuuug

SEQ ID NO: 864432 - RNA, 21 nt, Human
ucaaaaaaaaaaaaaaaaaaa

SEQ ID NO: 864433 - RNA, 24 nt, Human
ucaggaggucaggagauggagacc

SEQ ID NO: 864434 - RNA, 18 nt, Human
uccacaccuggguugugg

SEQ ID NO: 864435 - RNA, 22 nt, Human
uccagccuggcgacagagcgag

SEQ ID NO: 864436 - RNA, 21 nt, Human
uccauaagcaaggucccaguc

SEQ ID NO: 864437 - RNA, 23 nt, Human
uccaucucaaaaaaaaaaaaaaa

SEQ ID NO: 864438 - RNA, 23 nt, Human
ucgcaccacugcacuccagccug

SEQ ID NO: 864439 - RNA, 24 nt, Human
ucgcuugaauccgggacacagagg

SEQ ID NO: 864440 - RNA, 24 nt, Human
ucgggaggcugaggcaggagaauc

SEQ ID NO: 864441 - RNA, 19 nt, Human
ucuaccucucuucucucca

SEQ ID NO: 864442 - RNA, 21 nt, Human
ucucuacuaaaaauccaaaaa

SEQ ID NO: 864443 - RNA, 25 nt, Human
ucucuacuaaaaauccaaaaaaaau

SEQ ID NO: 864444 - RNA, 24 nt, Human
ucuugugggaaaaggguaacagag

SEQ ID NO: 864445 - RNA, 22 nt, Human
ugagcugaggucgcaccacugc

SEQ ID NO: 864446 - RNA, 22 nt, Human
ugaggcaggagaaucgcuugaa

SEQ ID NO: 864447 - RNA, 25 nt, Human
ugaggcaggagaaucgcuugaaucc

SEQ ID NO: 864448 - RNA, 24 nt, Human
ugaggucgcaccacugcacuccag

SEQ ID NO: 864449 - RNA, 20 nt, Human
ugaggugggcggaucaggag

SEQ ID NO: 864450 - RNA, 21 nt, Human
ugaggugggcggaucaggagg

SEQ ID NO: 864451 - RNA, 22 nt, Human
ugaggugggcggaucaggaggu

SEQ ID NO: 864452 - RNA, 24 nt, Human
ugaggugggcggaucaggagguca

SEQ ID NO: 864453 - RNA, 23 nt, Human
ugccuguaaucucagcacuuugg

SEQ ID NO: 864454 - RNA, 23 nt, Human
ugccuguaaucucagcacuuugg

SEQ ID NO: 864455 - RNA, 24 nt, Human
ugccuguagucccugcuauucggg

SEQ ID NO: 864456 - RNA, 23 nt, Human
ugcuauucgggaggcugaggcag

SEQ ID NO: 864457 - RNA, 24 nt, Human
uggcuuaugccuguaaucucagca

SEQ ID NO: 864458 - RNA, 19 nt, Human
ugggaggcugaggugggcg

SEQ ID NO: 864459 - RNA, 24 nt, Human
ugggaggcugaggugggcggauca

SEQ ID NO: 864460 - RNA, 22 nt, Human
ugggcggaucaggaggucagga

SEQ ID NO: 864461 - RNA, 20 nt, Human
uggguuaagaucagccagag

SEQ ID NO: 864462 - RNA, 23 nt, Human
ugguggcgcaugccuguaguccc

SEQ ID NO: 864463 - RNA, 18 nt, Human
uuagcugggcgugguggc

SEQ ID NO: 864464 - RNA, 19 nt, Human
uuagcugggcgugguggcg

SEQ ID NO: 864465 - RNA, 24 nt, Human
uuagcugggcgugguggcgcaugc

SEQ ID NO: 864466 - RNA, 25 nt, Human
uugggaggcugaggugggcggauca

SEQ ID NO: 864467 - RNA, 23 nt, Human
uuugcuaaucacugaaaaaaaag

SEQ ID NO: 864468 - RNA, 18 nt, Human
aaacaggccccccagccc

SEQ ID NO: 864469 - RNA, 23 nt, Human
aagcaccagguugcccacccucc

SEQ ID NO: 864470 - RNA, 18 nt, Human
acaggccccccagcccac

SEQ ID NO: 864471 - RNA, 18 nt, Human
agaagcccggcuccccag

SEQ ID NO: 864472 - RNA, 19 nt, Human
agcaccagguugcccaccc

SEQ ID NO: 864473 - RNA, 22 nt, Human
cacacaggccccacugaguggu

SEQ ID NO: 864474 - RNA, 19 nt, Human
caccagguugcccacccuc

SEQ ID NO: 864475 - RNA, 20 nt, Human
cacgaggagggacgcaggcc

SEQ ID NO: 864476 - RNA, 21 nt, Human
cagcccacggugccccuucag

SEQ ID NO: 864477 - RNA, 19 nt, Human
caggagcggaacccggccg

SEQ ID NO: 864478 - RNA, 24 nt, Human
ccaaaacaggccccccagcccacg

SEQ ID NO: 864479 - RNA, 25 nt, Human
ccaaaacaggccccccagcccacgg

SEQ ID NO: 864480 - RNA, 20 nt, Human
cccagcccacggugccccuu

SEQ ID NO: 864481 - RNA, 19 nt, Human
ccccacuucccagacaccc

SEQ ID NO: 864482 - RNA, 21 nt, Human
ccccccagcccacggugcccc

SEQ ID NO: 864483 - RNA, 22 nt, Human
ccccgugugccccacuucccag

SEQ ID NO: 864484 - RNA, 19 nt, Human
cccgugugccccacuuccc

SEQ ID NO: 864485 - RNA, 22 nt, Human
cccgugugccccacuucccaga

SEQ ID NO: 864486 - RNA, 21 nt, Human
ccuccgaggcugggcagaugg

SEQ ID NO: 864487 - RNA, 19 nt, Human
cgagguuuuuuuuuuuuuu

SEQ ID NO: 864488 - RNA, 21 nt, Human
cgagguuuuuuuuuuuuuuuu

SEQ ID NO: 864489 - RNA, 19 nt, Human
cggcuccccaggaacuccc

SEQ ID NO: 864490 - RNA, 22 nt, Human
cucggcgcccacacaggcccca

SEQ ID NO: 864491 - RNA, 19 nt, Human
gagaagcccggcuccccag

SEQ ID NO: 864492 - RNA, 19 nt, Human
gagguggcccucauguggg

SEQ ID NO: 864493 - RNA, 19 nt, Human
gcagauggcuggccagggc

SEQ ID NO: 864494 - RNA, 20 nt, Human
gcagauggcuggccagggcc

SEQ ID NO: 864495 - RNA, 18 nt, Human
ggaggccccgugugcccc

SEQ ID NO: 864496 - RNA, 21 nt, Human
ggcugggcagauggcuggcca

SEQ ID NO: 864497 - RNA, 18 nt, Human
gguccagcuggccgaggu

SEQ ID NO: 864498 - RNA, 19 nt, Human
uaggaagggcugugcgaag

SEQ ID NO: 864499 - RNA, 20 nt, Human
ucacgaggagggacgcaggc

SEQ ID NO: 864500 - RNA, 19 nt, Human
uccccaggaacuccccggc

SEQ ID NO: 864501 - RNA, 21 nt, Human
ucucggcgcccacacaggccc

SEQ ID NO: 864502 - RNA, 22 nt, Human
ucucggcgcccacacaggcccc

SEQ ID NO: 864503 - RNA, 21 nt, Human
ugagugguccuguguguccaa

SEQ ID NO: 864504 - RNA, 23 nt, Human
ugccccacuucccagacacccag

SEQ ID NO: 864505 - RNA, 22 nt, Human
ugccugcuccaaaacaggcccc

SEQ ID NO: 864506 - RNA, 22 nt, Human
uucagggcggggcccgcucucc

SEQ ID NO: 864507 - RNA, 24 nt, Human
uucauaguugggaggccccgugug

SEQ ID NO: 864508 - RNA, 18 nt, Human
uuuuuuuuuuuuuuuuug

SEQ ID NO: 864509 - RNA, 24 nt, Human
uuuuuuuuuuuuuuuuuggccuuu

SEQ ID NO: 864510 - RNA, 22 nt, Human
uuuuuuuuuuuuuuuuuuuggc

SEQ ID NO: 864511 - RNA, 20 nt, Human
aagcucaguuacauggcuau

SEQ ID NO: 864512 - RNA, 20 nt, Human
agcacguugggaggcugaag

SEQ ID NO: 864513 - RNA, 21 nt, Human
agccugggcaacaugaugaaa

SEQ ID NO: 864514 - RNA, 24 nt, Human
agccugggcaacaugaugaaaucc

SEQ ID NO: 864515 - RNA, 20 nt, Human
agguauauauguauuagcca

SEQ ID NO: 864516 - RNA, 23 nt, Human
cagcaagauccucuuccaagcuc

SEQ ID NO: 864517 - RNA, 18 nt, Human
cagcacguugggaggcug

SEQ ID NO: 864518 - RNA, 24 nt, Human
cauccauguucugagcauuaggaa

SEQ ID NO: 864519 - RNA, 19 nt, Human
ccagcuguugccaugugac

SEQ ID NO: 864520 - RNA, 22 nt, Human
ccaggacagcaagauccucuuc

SEQ ID NO: 864521 - RNA, 18 nt, Human
cccccgggaccccgcagg

SEQ ID NO: 864522 - RNA, 22 nt, Human
cccccgggaccccgcaggguca

SEQ ID NO: 864523 - RNA, 18 nt, Human
ccccgggaccccgcaggg

SEQ ID NO: 864524 - RNA, 19 nt, Human
ccgcggccgccggcuccgc

SEQ ID NO: 864525 - RNA, 22 nt, Human
ccugggcaacaugaugaaaucc

SEQ ID NO: 864526 - RNA, 24 nt, Human
ccugggcaacaugaugaaauccug

SEQ ID NO: 864527 - RNA, 18 nt, Human
cggcucccccuccccccc

SEQ ID NO: 864528 - RNA, 20 nt, Human
cucccgcggccgccggcucc

SEQ ID NO: 864529 - RNA, 21 nt, Human
cuguaaucccagcacguuggg

SEQ ID NO: 864530 - RNA, 24 nt, Human
gcuguaaucccagcacguugggag

SEQ ID NO: 864531 - RNA, 22 nt, Human
ggaccccgcagggucagcuccc

SEQ ID NO: 864532 - RNA, 20 nt, Human
ggggaggggaggcccggcag

SEQ ID NO: 864533 - RNA, 19 nt, Human
uacccccccgccaaagguu

SEQ ID NO: 864534 - RNA, 26 nt, Human
ucagugggggcuucgcggcucccccu

SEQ ID NO: 864535 - RNA, 22 nt, Human
uccaagcucaguuacauggcua

SEQ ID NO: 864536 - RNA, 22 nt, Human
uccacaaagcuuggacuaucca

SEQ ID NO: 864537 - RNA, 21 nt, Human
uccccccccgggaccccgcag

SEQ ID NO: 864538 - RNA, 23 nt, Human
ucccccuccccccccgggacccc

SEQ ID NO: 864539 - RNA, 21 nt, Human
uggcaugaccaccggcuguaa

SEQ ID NO: 864540 - RNA, 19 nt, Human
uggcugaguuccuuaccac

SEQ ID NO: 864541 - RNA, 18 nt, Human
ugggaggcugaaggcugg

SEQ ID NO: 864542 - RNA, 22 nt, Human
ugugacgaauuacccccccgcc

SEQ ID NO: 864543 - RNA, 21 nt, Human
uucagguacugggauccaguu

SEQ ID NO: 864544 - RNA, 18 nt, Human
uugggaggcugaaggcug

SEQ ID NO: 864545 - RNA, 21 nt, Human
uuuuuuuuuuuuuuuuuuaca

SEQ ID NO: 864546 - RNA, 22 nt, Human
aaaaauaagccaucucucggac

SEQ ID NO: 864547 - RNA, 23 nt, Human
aaacagaggucaucaaggccaag

SEQ ID NO: 864548 - RNA, 26 nt, Human
aacaguccuucugcaggcaugccucc

SEQ ID NO: 864549 - RNA, 21 nt, Human
aagcacgcuuuguugaaaaua

SEQ ID NO: 864550 - RNA, 22 nt, Human
aagcugaggggcugggagagcu

SEQ ID NO: 864551 - RNA, 18 nt, Human
aagggcaccuucuccugu

SEQ ID NO: 864552 - RNA, 24 nt, Human
aaguguccucccugaguccugccc

SEQ ID NO: 864553 - RNA, 23 nt, Human
acugcguguaacacccgucuccu

SEQ ID NO: 864554 - RNA, 22 nt, Human
acuggaagccccugggcagcag

SEQ ID NO: 864555 - RNA, 24 nt, Human
agaaacagaggucaucaaggccaa

SEQ ID NO: 864556 - RNA, 19 nt, Human
agacacauggccccaagug

SEQ ID NO: 864557 - RNA, 24 nt, Human
agacacauggccccaaguguccuc

SEQ ID NO: 864558 - RNA, 18 nt, Human
agcagugggggugggcug

SEQ ID NO: 864559 - RNA, 22 nt, Human
agccauauacaagucuacagcc

SEQ ID NO: 864560 - RNA, 20 nt, Human
agcugaggggcugggagagc

SEQ ID NO: 864561 - RNA, 22 nt, Human
agcuggggauggcucccugagc

SEQ ID NO: 864562 - RNA, 23 nt, Human
aggaagaaacagaggucaucaag

SEQ ID NO: 864563 - RNA, 24 nt, Human
aggaagaaacagaggucaucaagg

SEQ ID NO: 864564 - RNA, 19 nt, Human
aggaagagccgguccaggg

SEQ ID NO: 864565 - RNA, 18 nt, Human
aggcccccaccacucucc

SEQ ID NO: 864566 - RNA, 19 nt, Human
aggggucaagagcgccagg

SEQ ID NO: 864567 - RNA, 19 nt, Human
aggucaggugacccgggga

SEQ ID NO: 864568 - RNA, 21 nt, Human
aguccucacuggaaucagggg

SEQ ID NO: 864569 - RNA, 25 nt, Human
caacaagcgcauccgugcgggacca

SEQ ID NO: 864570 - RNA, 19 nt, Human
caacggcagcaaacgugaa

SEQ ID NO: 864571 - RNA, 21 nt, Human
caagaggacaccuggcuuggc

SEQ ID NO: 864572 - RNA, 21 nt, Human
caaguguccucccugaguccu

SEQ ID NO: 864573 - RNA, 19 nt, Human
caccaccagagggacagaa

SEQ ID NO: 864574 - RNA, 20 nt, Human
caccaccagagggacagaag

SEQ ID NO: 864575 - RNA, 18 nt, Human
caccagagggacagaagu

SEQ ID NO: 864576 - RNA, 21 nt, Human
caccauccugcugcccucagg

SEQ ID NO: 864577 - RNA, 20 nt, Human
caccggagaacacuugggga

SEQ ID NO: 864578 - RNA, 21 nt, Human
caccggagaacacuuggggag

SEQ ID NO: 864579 - RNA, 18 nt, Human
caccuggcuuggccuggc

SEQ ID NO: 864580 - RNA, 20 nt, Human
caccugggacccuggugcuc

SEQ ID NO: 864581 - RNA, 21 nt, Human
cacggccaaguauacacaggc

SEQ ID NO: 864582 - RNA, 21 nt, Human
cacucagccucuguccugccu

SEQ ID NO: 864583 - RNA, 23 nt, Human
cagaacuccccagcacuguuucc

SEQ ID NO: 864584 - RNA, 21 nt, Human
cagaggucaucaaggccaagc

SEQ ID NO: 864585 - RNA, 23 nt, Human
cagcagggagagggaaggggcuc

SEQ ID NO: 864586 - RNA, 19 nt, Human
cagcagugggggugggcug

SEQ ID NO: 864587 - RNA, 19 nt, Human
cagcagugggggugggcug

SEQ ID NO: 864588 - RNA, 22 nt, Human
cagcagugggggugggcugcgg

SEQ ID NO: 864589 - RNA, 23 nt, Human
cagcagugggggugggcugcggc

SEQ ID NO: 864590 - RNA, 21 nt, Human
cagcaucccacguucuguugc

SEQ ID NO: 864591 - RNA, 20 nt, Human
cagccacgcugaaaccccuc

SEQ ID NO: 864592 - RNA, 24 nt, Human
cagcccccgccccacgcagcugcc

SEQ ID NO: 864593 - RNA, 28 nt, Human
cagccucuaggcauccaccagcuucccu

SEQ ID NO: 864594 - RNA, 22 nt, Human
cagccugagcccccaacggcag

SEQ ID NO: 864595 - RNA, 23 nt, Human
cagccugagcccccaacggcagc

SEQ ID NO: 864596 - RNA, 21 nt, Human
caggccccggggccucagagg

SEQ ID NO: 864597 - RNA, 19 nt, Human
cagggccaguccucacugg

SEQ ID NO: 864598 - RNA, 24 nt, Human
ccaccaguccucugcaguuucucc

SEQ ID NO: 864599 - RNA, 21 nt, Human
ccacucagccucuguccugcc

SEQ ID NO: 864600 - RNA, 24 nt, Human
ccagaccaccuuuccacucagccu

SEQ ID NO: 864601 - RNA, 23 nt, Human
ccagagggacagaaguggccagg

SEQ ID NO: 864602 - RNA, 21 nt, Human
ccagcuucccugagcugugca

SEQ ID NO: 864603 - RNA, 19 nt, Human
ccaggcagcugguccaccc

SEQ ID NO: 864604 - RNA, 24 nt, Human
ccaggggggguccaucuuugggcc

SEQ ID NO: 864605 - RNA, 24 nt, Human
ccaggucugccugugucugggucu

SEQ ID NO: 864606 - RNA, 18 nt, Human
ccaugacaccugggaccc

SEQ ID NO: 864607 - RNA, 25 nt, Human
cccaaguguccucccugaguccugc

SEQ ID NO: 864608 - RNA, 23 nt, Human
cccacaggacgcagccacgcuga

SEQ ID NO: 864609 - RNA, 21 nt, Human
cccauuccacccuaacccgga

SEQ ID NO: 864610 - RNA, 23 nt, Human
cccauuccacccuaacccggaaa

SEQ ID NO: 864611 - RNA, 21 nt, Human
ccccaccacucuccucccagc

SEQ ID NO: 864612 - RNA, 20 nt, Human
ccccacccaggccaccaucc

SEQ ID NO: 864613 - RNA, 23 nt, Human
ccccacgcagcugccggucucgg

SEQ ID NO: 864614 - RNA, 19 nt, Human
cccccacaggacgcagcca

SEQ ID NO: 864615 - RNA, 18 nt, Human
ccccgccccaacaggccc

SEQ ID NO: 864616 - RNA, 19 nt, Human
ccccgccccaacaggcccc

SEQ ID NO: 864617 - RNA, 21 nt, Human
cccugcaggcaucugggccug

SEQ ID NO: 864618 - RNA, 22 nt, Human
cccugcaucugucccgagagcc

SEQ ID NO: 864619 - RNA, 22 nt, Human
ccggucucgggcgccgggcgca

SEQ ID NO: 864620 - RNA, 19 nt, Human
ccuacagaaccacgugcug

SEQ ID NO: 864621 - RNA, 23 nt, Human
ccucagaggaugcugcgccaggc

SEQ ID NO: 864622 - RNA, 21 nt, Human
ccucuaggcauccaccagcuu

SEQ ID NO: 864623 - RNA, 21 nt, Human
ccugagcuggggaccuagaag

SEQ ID NO: 864624 - RNA, 21 nt, Human
ccugcagccaugcugcacguc

SEQ ID NO: 864625 - RNA, 22 nt, Human
ccugcaggcaucugggccugaa

SEQ ID NO: 864626 - RNA, 19 nt, Human
ccugggcagcaggucaggu

SEQ ID NO: 864627 - RNA, 23 nt, Human
ccuucagccucuaggcauccacc

SEQ ID NO: 864628 - RNA, 20 nt, Human
cgccuugccgugaaucucca

SEQ ID NO: 864629 - RNA, 21 nt, Human
cggucucgggcgccgggcgca

SEQ ID NO: 864630 - RNA, 21 nt, Human
cuaugcccucucuccagacac

SEQ ID NO: 864631 - RNA, 24 nt, Human
cucaucggcaggcuaguguaacaa

SEQ ID NO: 864632 - RNA, 19 nt, Human
cuccagcagcccaggugcc

SEQ ID NO: 864633 - RNA, 18 nt, Human
cuccagcaucccacguuc

SEQ ID NO: 864634 - RNA, 19 nt, Human
cucuuccaaccccgcccca

SEQ ID NO: 864635 - RNA, 24 nt, Human
cugcaggcaugccuccagcauccc

SEQ ID NO: 864636 - RNA, 18 nt, Human
cuggaacagccgcuccag

SEQ ID NO: 864637 - RNA, 20 nt, Human
cuguccugccucgccuguug

SEQ ID NO: 864638 - RNA, 18 nt, Human
gaacagcagugggggugg

SEQ ID NO: 864639 - RNA, 28 nt, Human
gaaguccucucaauauuugagucucuuc

SEQ ID NO: 864640 - RNA, 20 nt, Human
gacagaaguggccaggccca

SEQ ID NO: 864641 - RNA, 20 nt, Human
gacgcagccacgcugaaacc

SEQ ID NO: 864642 - RNA, 22 nt, Human
gacgcagccacgcugaaacccc

SEQ ID NO: 864643 - RNA, 18 nt, Human
gagagcaucauuuauggc

SEQ ID NO: 864644 - RNA, 23 nt, Human
gagcuggggauggcucccugagc

SEQ ID NO: 864645 - RNA, 20 nt, Human
gcaaagcacauacucgcuga

SEQ ID NO: 864646 - RNA, 18 nt, Human
gcagcacacaucccugca

SEQ ID NO: 864647 - RNA, 21 nt, Human
gcagccugagcccccaacggc

SEQ ID NO: 864648 - RNA, 22 nt, Human
gccccaggcuuuacgccuugcc

SEQ ID NO: 864649 - RNA, 24 nt, Human
gccccgcccaccaguccucugcag

SEQ ID NO: 864650 - RNA, 19 nt, Human
gcccucagggccuugauuc

SEQ ID NO: 864651 - RNA, 19 nt, Human
gcugcacgucugacugaga

SEQ ID NO: 864652 - RNA, 18 nt, Human
gcugcgaagcugaggggc

SEQ ID NO: 864653 - RNA, 18 nt, Human
gcuuuguugaaaauacuc

SEQ ID NO: 864654 - RNA, 21 nt, Human
ggaaggggcuccagaccaccu

SEQ ID NO: 864655 - RNA, 22 nt, Human
ggaccuagaagacgcugcugac

SEQ ID NO: 864656 - RNA, 20 nt, Human
ggaggcaaaaagaggcuuug

SEQ ID NO: 864657 - RNA, 23 nt, Human
ggaggcaaaaagaggcuuugggu

SEQ ID NO: 864658 - RNA, 20 nt, Human
gggauggcucccugagcugg

SEQ ID NO: 864659 - RNA, 22 nt, Human
gggauucucuuggcagcuggug

SEQ ID NO: 864660 - RNA, 22 nt, Human
gggccccuucaugguggggccc

SEQ ID NO: 864661 - RNA, 18 nt, Human
gggcuccagaccaccuuu

SEQ ID NO: 864662 - RNA, 21 nt, Human
ggggauggcucccugagcugg

SEQ ID NO: 864663 - RNA, 20 nt, Human
ggggggcccaggugggcacu

SEQ ID NO: 864664 - RNA, 20 nt, Human
guccucccugaguccugccc

SEQ ID NO: 864665 - RNA, 22 nt, Human
guucuguugccaugacaccugg

SEQ ID NO: 864666 - RNA, 26 nt, Human
uagaaaaauaagccaucucucggacg

SEQ ID NO: 864667 - RNA, 21 nt, Human
uaggcuuccaucccugcccag

SEQ ID NO: 864668 - RNA, 24 nt, Human
uauacacaggcagaacuccccagc

SEQ ID NO: 864669 - RNA, 20 nt, Human
uaugcucgcugcgcgggucg

SEQ ID NO: 864670 - RNA, 22 nt, Human
ucaaggccaagcugcaagagga

SEQ ID NO: 864671 - RNA, 21 nt, Human
ucagggccaguccucacugga

SEQ ID NO: 864672 - RNA, 21 nt, Human
uccaaggucagcagggagagg

SEQ ID NO: 864673 - RNA, 21 nt, Human
uccacaacuauguggguuugu

SEQ ID NO: 864674 - RNA, 20 nt, Human
ucccuacagaaccacgugcu

SEQ ID NO: 864675 - RNA, 20 nt, Human
ucccuacagaaccacgugcu

SEQ ID NO: 864676 - RNA, 20 nt, Human
ucccugcccagaguaucguu

SEQ ID NO: 864677 - RNA, 18 nt, Human
ucccugggggggcccagg

SEQ ID NO: 864678 - RNA, 21 nt, Human
ucccugggggggcccaggugg

SEQ ID NO: 864679 - RNA, 18 nt, Human
ucgcugaacugggaggag

SEQ ID NO: 864680 - RNA, 23 nt, Human
ucgcugggccagcuuuggacccu

SEQ ID NO: 864681 - RNA, 22 nt, Human
ucgggcgccgggcgcagcuucg

SEQ ID NO: 864682 - RNA, 21 nt, Human
ucguggggcaggcagcagguc

SEQ ID NO: 864683 - RNA, 23 nt, Human
ucucugcaggcguccacaacuau

SEQ ID NO: 864684 - RNA, 23 nt, Human
ucuguugccaugacaccugggac

SEQ ID NO: 864685 - RNA, 19 nt, Human
ugaaguagcugcagacggc

SEQ ID NO: 864686 - RNA, 22 nt, Human
ugaccccucagguuagcaaacc

SEQ ID NO: 864687 - RNA, 23 nt, Human
ugaccccucagguuagcaaaccu

SEQ ID NO: 864688 - RNA, 22 nt, Human
ugacccggggagugcagccuga

SEQ ID NO: 864689 - RNA, 18 nt, Human
ugagaaaacuggagcugg

SEQ ID NO: 864690 - RNA, 18 nt, Human
ugagaacugagcaccaga

SEQ ID NO: 864691 - RNA, 19 nt, Human
ugcaagaggacaccuggcu

SEQ ID NO: 864692 - RNA, 22 nt, Human
ugccaggcagcugguccacccu

SEQ ID NO: 864693 - RNA, 22 nt, Human
ugcccagaguaucguuggaagc

SEQ ID NO: 864694 - RNA, 18 nt, Human
ugcccaggaagaaacaga

SEQ ID NO: 864695 - RNA, 21 nt, Human
ugcguguaacacccgucuccu

SEQ ID NO: 864696 - RNA, 18 nt, Human
uggaaugcgugcacaggg

SEQ ID NO: 864697 - RNA, 19 nt, Human
uggagggagagaaaaagga

SEQ ID NO: 864698 - RNA, 23 nt, Human
uggagggagagaaaaaggagaag

SEQ ID NO: 864699 - RNA, 26 nt, Human
uggagggagagaaaaaggagaagucc

SEQ ID NO: 864700 - RNA, 23 nt, Human
uggcagggaggugggugccugcu

SEQ ID NO: 864701 - RNA, 22 nt, Human
uggcucccugagcuggggaccu

SEQ ID NO: 864702 - RNA, 19 nt, Human
ugggagcucuggagggaga

SEQ ID NO: 864703 - RNA, 19 nt, Human
ugggaggaguccacaccgc

SEQ ID NO: 864704 - RNA, 20 nt, Human
uggggagcugucacaaggcc

SEQ ID NO: 864705 - RNA, 23 nt, Human
uuccaaccccgccccaacaggcc

SEQ ID NO: 864706 - RNA, 23 nt, Human
uucccuguccuucagccucuagg

SEQ ID NO: 864707 - RNA, 19 nt, Human
uugaaaauacucugggcca

SEQ ID NO: 864708 - RNA, 21 nt, Human
uuggcagcuggugggugccug

SEQ ID NO: 864709 - RNA, 22 nt, Human
uuggggagcugucacaaggcca

SEQ ID NO: 864710 - RNA, 24 nt, Human
uuuugcaguuagggcugcauccau

SEQ ID NO: 864711 - RNA, 20 nt, Human
uuuuuuuuuuuuuuuuuugg

SEQ ID NO: 864712 - RNA, 23 nt, Human
agauguguuuauuuuggagccua

SEQ ID NO: 864713 - RNA, 20 nt, Human
cacuggaggggugagagcuc

SEQ ID NO: 864714 - RNA, 20 nt, Human
cagugaggaagccccuggag

SEQ ID NO: 864715 - RNA, 20 nt, Human
ccccuggaggaaagucuuuc

SEQ ID NO: 864716 - RNA, 19 nt, Human
cuuuccggcaauuccccag

SEQ ID NO: 864717 - RNA, 20 nt, Human
gaagccccuggaggaaaguc

SEQ ID NO: 864718 - RNA, 19 nt, Human
guuugcucuuuccggcaau

SEQ ID NO: 864719 - RNA, 19 nt, Human
uccccagugaggaagcccc

SEQ ID NO: 864720 - RNA, 23 nt, Human
uccggcaauuccccagugaggaa

SEQ ID NO: 864721 - RNA, 18 nt, Human
uguguuuauuuuggagcc

SEQ ID NO: 864722 - RNA, 21 nt, Human
uguguuuauuuuggagccuac

SEQ ID NO: 864723 - RNA, 23 nt, Human
uuauuguuuguuuugaaacuuuu

SEQ ID NO: 864724 - RNA, 21 nt, Human
uugaaacuuuuaauccaauaa

SEQ ID NO: 864725 - RNA, 19 nt, Human
uuguuugcucuuuccggca

SEQ ID NO: 864726 - RNA, 20 nt, Human
uuguuuguuuugaaacuuuu

SEQ ID NO: 864727 - RNA, 19 nt, Human
uuuuuuguuugcucuuucc

SEQ ID NO: 864728 - RNA, 25 nt, Human
uuuuuuuuuuuuuuuucauuauuuu

SEQ ID NO: 864729 - RNA, 21 nt, Human
uuuuuuuuuuuuuuuuucauu

SEQ ID NO: 864730 - RNA, 18 nt, Human
aaauuaggcaggaaaaaa

SEQ ID NO: 864731 - RNA, 22 nt, Human
acagcacagcguuccccacagu

SEQ ID NO: 864732 - RNA, 18 nt, Human
acaguucucugcucugcu

SEQ ID NO: 864733 - RNA, 19 nt, Human
aggaaaaaaaaacccaagg

SEQ ID NO: 864734 - RNA, 18 nt, Human
aggcaggaaaaaaaaacc

SEQ ID NO: 864735 - RNA, 18 nt, Human
aggcaggaaaaaaaaacc

SEQ ID NO: 864736 - RNA, 21 nt, Human
aggcaggaaaaaaaaacccaa

SEQ ID NO: 864737 - RNA, 23 nt, Human
aggcaggaaaaaaaaacccaagg

SEQ ID NO: 864738 - RNA, 23 nt, Human
cacaguucucugcucugcucucc

SEQ ID NO: 864739 - RNA, 20 nt, Human
cagcguuccccacaguucuc

SEQ ID NO: 864740 - RNA, 18 nt, Human
guuggaaaucacagaaau

SEQ ID NO: 864741 - RNA, 20 nt, Human
guuuauagucauuucauguu

SEQ ID NO: 864742 - RNA, 20 nt, Human
uaggcaggaaaaaaaaaccu

SEQ ID NO: 864743 - RNA, 30 nt, Human
ucuccugcgagccggggaaggagaggggcu

SEQ ID NO: 864744 - RNA, 18 nt, Human
ugagcucgggcgggggcu

SEQ ID NO: 864745 - RNA, 19 nt, Human
ugagcucgggcgggggcug

SEQ ID NO: 864746 - RNA, 18 nt, Human
ugcucugcucuccugcga

SEQ ID NO: 864747 - RNA, 18 nt, Human
uuggaaaucacagaaauu

SEQ ID NO: 864748 - RNA, 21 nt, Human
uugguuggaaaucacagaaau

SEQ ID NO: 864749 - RNA, 21 nt, Human
uuuuuuuuuuuuuuuuucauu

SEQ ID NO: 864750 - RNA, 21 nt, Human
aaagauuaucacacuggauaa

SEQ ID NO: 864751 - RNA, 22 nt, Human
aagaacagaaaagaauguugac

SEQ ID NO: 864752 - RNA, 22 nt, Human
aagaugccaggguuccuaagua

SEQ ID NO: 864753 - RNA, 22 nt, Human
aagcaccgaagaacccagcgac

SEQ ID NO: 864754 - RNA, 19 nt, Human
aagccaguaccaaaugcgc

SEQ ID NO: 864755 - RNA, 20 nt, Human
aaguaucacaaaagccagua

SEQ ID NO: 864756 - RNA, 19 nt, Human
aauaauuaaugccaagaac

SEQ ID NO: 864757 - RNA, 21 nt, Human
aaugccaagaacagaaaagaa

SEQ ID NO: 864758 - RNA, 20 nt, Human
acaaaccucaaggacccaga

SEQ ID NO: 864759 - RNA, 22 nt, Human
acagcaauaauuaaugccaaga

SEQ ID NO: 864760 - RNA, 20 nt, Human
acauuuuauuuaaacuuuuu

SEQ ID NO: 864761 - RNA, 25 nt, Human
acguguugcccggcccgccaagcgg

SEQ ID NO: 864762 - RNA, 21 nt, Human
agagacggcggcagcuccagg

SEQ ID NO: 864763 - RNA, 18 nt, Human
agcagccacagccugugg

SEQ ID NO: 864764 - RNA, 19 nt, Human
agcagccacagccuguggc

SEQ ID NO: 864765 - RNA, 22 nt, Human
agcaggugccaggugcgacaca

SEQ ID NO: 864766 - RNA, 18 nt, Human
agccacagccuguggcug

SEQ ID NO: 864767 - RNA, 19 nt, Human
agccuguggcuggggugcu

SEQ ID NO: 864768 - RNA, 18 nt, Human
agcgggccaaggccagga

SEQ ID NO: 864769 - RNA, 19 nt, Human
agcguccagcccugcccaa

SEQ ID NO: 864770 - RNA, 27 nt, Human
aggggguaucauggcuuugggacggac

SEQ ID NO: 864771 - RNA, 18 nt, Human
aggucccagcguccagcc

SEQ ID NO: 864772 - RNA, 21 nt, Human
auuucuuccuggucaucaaag

SEQ ID NO: 864773 - RNA, 23 nt, Human
caccgaagaacccagcgacgccg

SEQ ID NO: 864774 - RNA, 19 nt, Human
cagaagcaccgaagaaccc

SEQ ID NO: 864775 - RNA, 19 nt, Human
cagaccccacagcagaccc

SEQ ID NO: 864776 - RNA, 18 nt, Human
cagacgcaggcggguggc

SEQ ID NO: 864777 - RNA, 19 nt, Human
cagcgacgccggugggacc

SEQ ID NO: 864778 - RNA, 21 nt, Human
cagcuccaggucccagcgucc

SEQ ID NO: 864779 - RNA, 25 nt, Human
cagcuccaggucccagcguccagcc

SEQ ID NO: 864780 - RNA, 18 nt, Human
cagcugccccacugcucc

SEQ ID NO: 864781 - RNA, 20 nt, Human
cauggcucgccugagcucug

SEQ ID NO: 864782 - RNA, 24 nt, Human
ccacagccuguggcuggggugcuu

SEQ ID NO: 864783 - RNA, 18 nt, Human
ccagggcagaccccacag

SEQ ID NO: 864784 - RNA, 21 nt, Human
cccacugcuccuuccauccuu

SEQ ID NO: 864785 - RNA, 18 nt, Human
cccaggcccccaagcucu

SEQ ID NO: 864786 - RNA, 20 nt, Human
ccccaaucccccaaugcuug

SEQ ID NO: 864787 - RNA, 22 nt, Human
ccccacugcuccuuccauccuu

SEQ ID NO: 864788 - RNA, 19 nt, Human
cccccaagcucugccacca

SEQ ID NO: 864789 - RNA, 22 nt, Human
ccccugcccaggcccccaagcu

SEQ ID NO: 864790 - RNA, 18 nt, Human
ccccuucucugccggccc

SEQ ID NO: 864791 - RNA, 18 nt, Human
cccgccaagcgggccccu

SEQ ID NO: 864792 - RNA, 22 nt, Human
cccgccaagcgggccccugccc

SEQ ID NO: 864793 - RNA, 22 nt, Human
cccugcccaggcccccaagcuc

SEQ ID NO: 864794 - RNA, 20 nt, Human
ccgcccgccgcccgcugucc

SEQ ID NO: 864795 - RNA, 20 nt, Human
ccgcccgccgcccgcugucc

SEQ ID NO: 864796 - RNA, 22 nt, Human
ccggccccgccucugcugggag

SEQ ID NO: 864797 - RNA, 20 nt, Human
ccggcuccccuucugcgcgg

SEQ ID NO: 864798 - RNA, 22 nt, Human
ccggggcagggucgggcugggc

SEQ ID NO: 864799 - RNA, 22 nt, Human
ccucaaggacccagacacacag

SEQ ID NO: 864800 - RNA, 21 nt, Human
cgcgccgcccgccgcccgcug

SEQ ID NO: 864801 - RNA, 27 nt, Human
cguccccucccgcagcggggcacaguc

SEQ ID NO: 864802 - RNA, 24 nt, Human
cuaaguaucacaaaagccaguacc

SEQ ID NO: 864803 - RNA, 23 nt, Human
cuccaggucccagcguccagccc

SEQ ID NO: 864804 - RNA, 18 nt, Human
cuccuuccauccuugccc

SEQ ID NO: 864805 - RNA, 26 nt, Human
cucgcgcgucggucccuucuucccac

SEQ ID NO: 864806 - RNA, 20 nt, Human
cugccaccacuggggugccg

SEQ ID NO: 864807 - RNA, 21 nt, Human
cugcuccuuccauccuugccc

SEQ ID NO: 864808 - RNA, 22 nt, Human
cugcuccuuccauccuugcccc

SEQ ID NO: 864809 - RNA, 19 nt, Human
cuggucaucaaagagaaac

SEQ ID NO: 864810 - RNA, 23 nt, Human
cuucucugccggccccgccucug

SEQ ID NO: 864811 - RNA, 22 nt, Human
cuuuuuuuuuuaaaaaaaagac

SEQ ID NO: 864812 - RNA, 20 nt, Human
gacucgcgcgucggucccuu

SEQ ID NO: 864813 - RNA, 19 nt, Human
gagcagccacagccugugg

SEQ ID NO: 864814 - RNA, 23 nt, Human
gcagcagccuggguuccucccgg

SEQ ID NO: 864815 - RNA, 23 nt, Human
gcaggcggguggcugcgcuuccc

SEQ ID NO: 864816 - RNA, 22 nt, Human
gccccugcccaggcccccaagc

SEQ ID NO: 864817 - RNA, 18 nt, Human
gccguccccucccgcagc

SEQ ID NO: 864818 - RNA, 20 nt, Human
gcgacacaggagcggggaca

SEQ ID NO: 864819 - RNA, 20 nt, Human
gcgcaagguggaaguggggc

SEQ ID NO: 864820 - RNA, 23 nt, Human
gcggggacaucccugaccccaga

SEQ ID NO: 864821 - RNA, 18 nt, Human
ggaccaggcggcccugcu

SEQ ID NO: 864822 - RNA, 23 nt, Human
ggcagggucgggcugggcagggc

SEQ ID NO: 864823 - RNA, 19 nt, Human
ggccggggcagggucgggc

SEQ ID NO: 864824 - RNA, 24 nt, Human
ggcugggcagggcagcagccuggg

SEQ ID NO: 864825 - RNA, 20 nt, Human
gggccccugcccaggccccc

SEQ ID NO: 864826 - RNA, 23 nt, Human
gggugcugggauuucuuccuggu

SEQ ID NO: 864827 - RNA, 22 nt, Human
uaaugccaagaacagaaaagaa

SEQ ID NO: 864828 - RNA, 24 nt, Human
uacaaaccucaaggacccagacac

SEQ ID NO: 864829 - RNA, 23 nt, Human
uagaaaagaugccaggguuccua

SEQ ID NO: 864830 - RNA, 23 nt, Human
uauagaaaagaugccaggguucc

SEQ ID NO: 864831 - RNA, 21 nt, Human
ucaaagagaaacguacaaacc

SEQ ID NO: 864832 - RNA, 20 nt, Human
ucccugaccccagacgcagg

SEQ ID NO: 864833 - RNA, 19 nt, Human
ugaaaagauuaucacacug

SEQ ID NO: 864834 - RNA, 22 nt, Human
ugcaggcuccuccugugagcuc

SEQ ID NO: 864835 - RNA, 18 nt, Human
ugccaagaacagaaaaga

SEQ ID NO: 864836 - RNA, 22 nt, Human
ugcccaggcccccaagcucugc

SEQ ID NO: 864837 - RNA, 18 nt, Human
ugccccacugcuccuucc

SEQ ID NO: 864838 - RNA, 19 nt, Human
ugcccggcccgccaagcgg

SEQ ID NO: 864839 - RNA, 21 nt, Human
ugcuccuuccauccuugcccc

SEQ ID NO: 864840 - RNA, 19 nt, Human
ugcucuggcggccucggcg

SEQ ID NO: 864841 - RNA, 20 nt, Human
uggaaguggggccggggcag

SEQ ID NO: 864842 - RNA, 22 nt, Human
uggaggaggccccuucucugcc

SEQ ID NO: 864843 - RNA, 20 nt, Human
uggccagggcagaccccaca

SEQ ID NO: 864844 - RNA, 24 nt, Human
uggccagggcagaccccacagcag

SEQ ID NO: 864845 - RNA, 18 nt, Human
uggguggaggaggccccu

SEQ ID NO: 864846 - RNA, 19 nt, Human
uggguggaggaggccccuu

SEQ ID NO: 864847 - RNA, 22 nt, Human
uggguggaggaggccccuucuc

SEQ ID NO: 864848 - RNA, 18 nt, Human
uuaaugccaagaacagaa

SEQ ID NO: 864849 - RNA, 23 nt, Human
uuaaugccaagaacagaaaagaa

SEQ ID NO: 864850 - RNA, 24 nt, Human
uuccauaaaaauacuauuauuccu

SEQ ID NO: 864851 - RNA, 22 nt, Human
accccuagggccugggauuccc

SEQ ID NO: 864852 - RNA, 26 nt, Human
accccuuugccuccucugacaccccc

SEQ ID NO: 864853 - RNA, 21 nt, Human
cacacagccuuuauugagcag

SEQ ID NO: 864854 - RNA, 24 nt, Human
caccacaguccugaccgcagcugg

SEQ ID NO: 864855 - RNA, 24 nt, Human
cacuuccugagcaaaugugacccc

SEQ ID NO: 864856 - RNA, 22 nt, Human
cagcuacugggcagugacgcug

SEQ ID NO: 864857 - RNA, 23 nt, Human
cagcugggaccccuuugccuccu

SEQ ID NO: 864858 - RNA, 22 nt, Human
ccaagaccaccccgaaaugcag

SEQ ID NO: 864859 - RNA, 24 nt, Human
ccacuuccugagcaaaugugaccc

SEQ ID NO: 864860 - RNA, 18 nt, Human
cccaccgucuccugaggc

SEQ ID NO: 864861 - RNA, 21 nt, Human
cgaaaugcagcggccccaccg

SEQ ID NO: 864862 - RNA, 23 nt, Human
cggugaggccaggggcagcagug

SEQ ID NO: 864863 - RNA, 18 nt, Human
cucaauuugauacccacu

SEQ ID NO: 864864 - RNA, 19 nt, Human
gccaggggcagcagugcgg

SEQ ID NO: 864865 - RNA, 22 nt, Human
ugcagcggccccaccgucuccu

SEQ ID NO: 864866 - RNA, 23 nt, Human
uuccugagcaaaugugaccccua

SEQ ID NO: 864867 - RNA, 22 nt, Human
uuuuuuuuuuuuuuuuuuucag

SEQ ID NO: 864868 - RNA, 19 nt, Human
agaaauacacucuaagaac

SEQ ID NO: 864869 - RNA, 24 nt, Human
agauacugcagacagguccaagcu

SEQ ID NO: 864870 - RNA, 24 nt, Human
agcugcuggaggcgcucguaaacc

SEQ ID NO: 864871 - RNA, 18 nt, Human
aggagcugugggaaggag

SEQ ID NO: 864872 - RNA, 18 nt, Human
agguggcuguugagggca

SEQ ID NO: 864873 - RNA, 24 nt, Human
aguagcuuugcaucgcccugggag

SEQ ID NO: 864874 - RNA, 18 nt, Human
aucucagagacuuggcca

SEQ ID NO: 864875 - RNA, 18 nt, Human
caagagaucugcaccgac

SEQ ID NO: 864876 - RNA, 19 nt, Human
caccgacaucuguacaaua

SEQ ID NO: 864877 - RNA, 22 nt, Human
caccuuaguccuaggacaggag

SEQ ID NO: 864878 - RNA, 21 nt, Human
cagccaguccaguucuuugac

SEQ ID NO: 864879 - RNA, 21 nt, Human
caggcauuuuucaaucugugg

SEQ ID NO: 864880 - RNA, 20 nt, Human
cauaacaggcggucugcgca

SEQ ID NO: 864881 - RNA, 27 nt, Human
ccaccuuaguccuaggacaggaguugg

SEQ ID NO: 864882 - RNA, 22 nt, Human
ccagagcuccagcugcuggagg

SEQ ID NO: 864883 - RNA, 19 nt, Human
cccagccugggaucccacc

SEQ ID NO: 864884 - RNA, 20 nt, Human
cccucagaggugagaauggg

SEQ ID NO: 864885 - RNA, 19 nt, Human
ccgcggggcccagccuggg

SEQ ID NO: 864886 - RNA, 25 nt, Human
ccucuugugaccaacugaaggggac

SEQ ID NO: 864887 - RNA, 25 nt, Human
cgcccugggagaagaucucagagac

SEQ ID NO: 864888 - RNA, 24 nt, Human
cgggagagcguuuuaaacacagca

SEQ ID NO: 864889 - RNA, 20 nt, Human
cuggaggcgcucguaaaccg

SEQ ID NO: 864890 - RNA, 19 nt, Human
cugguggaggcgauggguc

SEQ ID NO: 864891 - RNA, 18 nt, Human
gaauggguccucagcaug

SEQ ID NO: 864892 - RNA, 19 nt, Human
gagacgccgcgccuggugg

SEQ ID NO: 864893 - RNA, 25 nt, Human
gagcugcuccagcgcgugcaggcag

SEQ ID NO: 864894 - RNA, 24 nt, Human
gagcuucugauuuuacuagaaaua

SEQ ID NO: 864895 - RNA, 19 nt, Human
gaugaucuuccagagcucc

SEQ ID NO: 864896 - RNA, 21 nt, Human
gccugggaucccacccgacuc

SEQ ID NO: 864897 - RNA, 31 nt, Human
gcuccagcgcgugcaggcaggagcggaaguu

SEQ ID NO: 864898 - RNA, 18 nt, Human
gcugugggaaggaggccu

SEQ ID NO: 864899 - RNA, 24 nt, Human
ggcaggucccagaggagauacugc

SEQ ID NO: 864900 - RNA, 18 nt, Human
gguggugugaucguacag

SEQ ID NO: 864901 - RNA, 20 nt, Human
gucccagaggagauacugca

SEQ ID NO: 864902 - RNA, 23 nt, Human
gugaccaacugaaggggaccuug

SEQ ID NO: 864903 - RNA, 20 nt, Human
gugcaggcaggagcggaagu

SEQ ID NO: 864904 - RNA, 21 nt, Human
uaacuauaccaccuccagugg

SEQ ID NO: 864905 - RNA, 21 nt, Human
uaagaacagucgagacgccgc

SEQ ID NO: 864906 - RNA, 28 nt, Human
ucagaaauuuccucuugugaccaacuga

SEQ ID NO: 864907 - RNA, 24 nt, Human
ucagugugaaguugagccucuucu

SEQ ID NO: 864908 - RNA, 21 nt, Human
uccacgggcuccaccacgaag

SEQ ID NO: 864909 - RNA, 18 nt, Human
ucccacccgacucccguc

SEQ ID NO: 864910 - RNA, 20 nt, Human
uccgugccaugguggcugcg

SEQ ID NO: 864911 - RNA, 19 nt, Human
ucucagagacuuggccagg

SEQ ID NO: 864912 - RNA, 21 nt, Human
ucugcgaugaucuuccagagc

SEQ ID NO: 864913 - RNA, 19 nt, Human
ugggaucccacccgacucc

SEQ ID NO: 864914 - RNA, 21 nt, Human
uggguccucagcauggcaggu

SEQ ID NO: 864915 - RNA, 19 nt, Human
uguacaauaaacgguccgu

SEQ ID NO: 864916 - RNA, 24 nt, Human
ugugaucguacaggucagaaauuu

SEQ ID NO: 864917 - RNA, 25 nt, Human
uuuuuugcuuuggugagcuucugau

SEQ ID NO: 864918 - RNA, 23 nt, Human
uuuuuuuuuuuuuuuugcuuugg

SEQ ID NO: 864919 - RNA, 18 nt, Human
uuuuuuuuuuuuuuuuug

SEQ ID NO: 864920 - RNA, 23 nt, Human
uuuuuuuuuuuuuuuuuugcuuu

SEQ ID NO: 864921 - RNA, 26 nt, Human
uuuuuuuuuuuuuuuuuuugcuuugg

SEQ ID NO: 864922 - RNA, 24 nt, Human
acagcucgcuccaucuccagaacu

SEQ ID NO: 864923 - RNA, 22 nt, Human
accgucccgaacccuuccgcca

SEQ ID NO: 864924 - RNA, 18 nt, Human
accucugacccagaggca

SEQ ID NO: 864925 - RNA, 21 nt, Human
acgcaaccucacgaggccuua

SEQ ID NO: 864926 - RNA, 21 nt, Human
auggagccgcugcaaggccug

SEQ ID NO: 864927 - RNA, 22 nt, Human
cacagcucgcuccaucuccaga

SEQ ID NO: 864928 - RNA, 26 nt, Human
cacucuaaaacccugagcuggcuggg

SEQ ID NO: 864929 - RNA, 18 nt, Human
cagaacuacaagucccag

SEQ ID NO: 864930 - RNA, 18 nt, Human
ccaucuccagaacuacaa

SEQ ID NO: 864931 - RNA, 20 nt, Human
ccgucccgaacccuuccgcc

SEQ ID NO: 864932 - RNA, 33 nt, Human
ccugaaacuuuauuguaaaaaaaaaaaaaagga

SEQ ID NO: 864933 - RNA, 22 nt, Human
ccuggaacaccucugacccaga

SEQ ID NO: 864934 - RNA, 22 nt, Human
cgcgccgcccgucuuccgcgcc

SEQ ID NO: 864935 - RNA, 21 nt, Human
gcugcaaggccuggaacaccu

SEQ ID NO: 864936 - RNA, 22 nt, Human
uccaucuccagaacuacaaguc

SEQ ID NO: 864937 - RNA, 25 nt, Human
uccgccacgcgccgcccgucuuccg

SEQ ID NO: 864938 - RNA, 27 nt, Human
uccgccacgcgccgcccgucuuccgcg

SEQ ID NO: 864939 - RNA, 18 nt, Human
uccgcgcgcgacgcaacc

SEQ ID NO: 864940 - RNA, 20 nt, Human
uccgcgcgcgacgcaaccuc

SEQ ID NO: 864941 - RNA, 21 nt, Human
uccgcgcgcgacgcaaccuca

SEQ ID NO: 864942 - RNA, 22 nt, Human
uccgcgcgcgacgcaaccucac

SEQ ID NO: 864943 - RNA, 22 nt, Human
ucuccguggcgcccuaccgccu

SEQ ID NO: 864944 - RNA, 23 nt, Human
ucuuccgcgcccgcgcagaaccu

SEQ ID NO: 864945 - RNA, 23 nt, Human
ugacccagaggcaccgcgagcgg

SEQ ID NO: 864946 - RNA, 20 nt, Human
uggaacaccucugacccaga

SEQ ID NO: 864947 - RNA, 23 nt, Human
uggaacaccucugacccagaggc

SEQ ID NO: 864948 - RNA, 21 nt, Human
uuaaaaaagccugaaacuuua

SEQ ID NO: 864949 - RNA, 24 nt, Human
uuauuguaaaaaaaaaaaaaagaa

SEQ ID NO: 864950 - RNA, 22 nt, Human
aagcagccccagggagcagagu

SEQ ID NO: 864951 - RNA, 19 nt, Human
aagcuuggaaaaauaggac

SEQ ID NO: 864952 - RNA, 24 nt, Human
acccuccccaucagaguuuuaaaa

SEQ ID NO: 864953 - RNA, 18 nt, Human
agagggacuguguccuga

SEQ ID NO: 864954 - RNA, 21 nt, Human
agcaaggacuucaggcccaaa

SEQ ID NO: 864955 - RNA, 20 nt, Human
aggccaggucccacagggug

SEQ ID NO: 864956 - RNA, 23 nt, Human
aggguccaguuuuacggguccag

SEQ ID NO: 864957 - RNA, 24 nt, Human
cagaguccuagcuccaggggaguc

SEQ ID NO: 864958 - RNA, 23 nt, Human
cagggucucccagguccagucuu

SEQ ID NO: 864959 - RNA, 18 nt, Human
ccaguuuggguuguucag

SEQ ID NO: 864960 - RNA, 21 nt, Human
ccccuaaauauugggccucua

SEQ ID NO: 864961 - RNA, 21 nt, Human
cuguccccaaggcuucuguag

SEQ ID NO: 864962 - RNA, 19 nt, Human
gaggacccuuagagggggg

SEQ ID NO: 864963 - RNA, 21 nt, Human
gagggacuguguccugacucg

SEQ ID NO: 864964 - RNA, 22 nt, Human
gcagcaaggacuucaggcccaa

SEQ ID NO: 864965 - RNA, 20 nt, Human
gggcucuggagggagcaucu

SEQ ID NO: 864966 - RNA, 19 nt, Human
gggugcugagucaagauug

SEQ ID NO: 864967 - RNA, 21 nt, Human
uacggguccaguuuggguugu

SEQ ID NO: 864968 - RNA, 18 nt, Human
uagaagcagccccaggga

SEQ ID NO: 864969 - RNA, 20 nt, Human
uagaagcagccccagggagc

SEQ ID NO: 864970 - RNA, 22 nt, Human
ucaagccccagauuuaagcacu

SEQ ID NO: 864971 - RNA, 20 nt, Human
ucagggucagggucucccag

SEQ ID NO: 864972 - RNA, 21 nt, Human
uccccgacacccuccccauca

SEQ ID NO: 864973 - RNA, 20 nt, Human
uccguggggccagaggaccc

SEQ ID NO: 864974 - RNA, 23 nt, Human
ucggcucaaaucuguggcaacgg

SEQ ID NO: 864975 - RNA, 21 nt, Human
ucugcagcaaggacuucaggc

SEQ ID NO: 864976 - RNA, 20 nt, Human
ucuguggcaacggagucucc

SEQ ID NO: 864977 - RNA, 21 nt, Human
ucuuguuuugccccggugucc

SEQ ID NO: 864978 - RNA, 21 nt, Human
ugacucggcucaaaucugugg

SEQ ID NO: 864979 - RNA, 25 nt, Human
ugagcuagaagcagccccagggagc

SEQ ID NO: 864980 - RNA, 25 nt, Human
ugaguuugaggccaggucccacagg

SEQ ID NO: 864981 - RNA, 20 nt, Human
ugccccgguguccccgacac

SEQ ID NO: 864982 - RNA, 24 nt, Human
ugcuaagcagccaaacgguggggu

SEQ ID NO: 864983 - RNA, 23 nt, Human
ugggccucuaggguccaguuuua

SEQ ID NO: 864984 - RNA, 19 nt, Human
uggugaguuugaggccagg

SEQ ID NO: 864985 - RNA, 22 nt, Human
uguccccgacacccuccccauu

SEQ ID NO: 864986 - RNA, 20 nt, Human
uguccguggggccagaggac

SEQ ID NO: 864987 - RNA, 26 nt, Human
uucugcauucagauauuggggugcug

SEQ ID NO: 864988 - RNA, 28 nt, Human
uuucuuguuuugccccgguguccccgac

SEQ ID NO: 864989 - RNA, 18 nt, Human
uuuuuuuuuuuuuuuucg

SEQ ID NO: 864990 - RNA, 23 nt, Human
uuuuuuuuuuuuuuuucgcccaa

SEQ ID NO: 864991 - RNA, 21 nt, Human
cauccuuauauccaaugggga

SEQ ID NO: 864992 - RNA, 23 nt, Human
cgcuuccggucgccgccaccccu

SEQ ID NO: 864993 - RNA, 22 nt, Human
cuuccggucgccgccaccccuu

SEQ ID NO: 864994 - RNA, 27 nt, Human
uaccagucauccuuauauccaaugggg

SEQ ID NO: 864995 - RNA, 22 nt, Human
ucccagcucucucugcgccucu

SEQ ID NO: 864996 - RNA, 19 nt, Human
uccuuauauccaaugggga

SEQ ID NO: 864997 - RNA, 21 nt, Human
uuagauuaaaguagcaaugag

SEQ ID NO: 864998 - RNA, 21 nt, Human
aaguuucaaguugucacccau

SEQ ID NO: 864999 - RNA, 26 nt, Human
acaggcaccuuuagaauuuuuuaaac

SEQ ID NO: 865000 - RNA, 19 nt, Human
agaaaaugccaucucccac

SEQ ID NO: 865001 - RNA, 22 nt, Human
agaagaaaaugccaucucccac

SEQ ID NO: 865002 - RNA, 18 nt, Human
caccccauccucaaccuc

SEQ ID NO: 865003 - RNA, 26 nt, Human
ccaccaggacaccccauccucaaccu

SEQ ID NO: 865004 - RNA, 24 nt, Human
ccuggacuucccccaaauaaagaa

SEQ ID NO: 865005 - RNA, 21 nt, Human
cuucaggguucugaaguuuca

SEQ ID NO: 865006 - RNA, 19 nt, Human
gccaucucccacugguacu

SEQ ID NO: 865007 - RNA, 19 nt, Human
gccaucucccacugguacu

SEQ ID NO: 865008 - RNA, 19 nt, Human
uccaccaggacaccccauc

SEQ ID NO: 865009 - RNA, 21 nt, Human
uggcaaaacuuuuauugaaca

SEQ ID NO: 865010 - RNA, 21 nt, Human
uucuccuggacuucccccaaa

SEQ ID NO: 865011 - RNA, 21 nt, Human
aaaaugcaauauuuugacaca

SEQ ID NO: 865012 - RNA, 20 nt, Human
agaaaaaaacauuaggauga

SEQ ID NO: 865013 - RNA, 21 nt, Human
aggcacugcagucggagucuu

SEQ ID NO: 865014 - RNA, 24 nt, Human
cacucucuuaguauuaauuggagg

SEQ ID NO: 865015 - RNA, 21 nt, Human
cagaaaaugcaauauuuugac

SEQ ID NO: 865016 - RNA, 20 nt, Human
caggggcccugguccacucu

SEQ ID NO: 865017 - RNA, 23 nt, Human
cauuuggagccacauggcugucc

SEQ ID NO: 865018 - RNA, 18 nt, Human
ccaucugucuuccucagg

SEQ ID NO: 865019 - RNA, 24 nt, Human
cccagcagagccccuggccaggca

SEQ ID NO: 865020 - RNA, 21 nt, Human
ccucaggggcccugguccacu

SEQ ID NO: 865021 - RNA, 23 nt, Human
ccucaggggcccugguccacucu

SEQ ID NO: 865022 - RNA, 23 nt, Human
cucacugucaaucucuacucugg

SEQ ID NO: 865023 - RNA, 24 nt, Human
cucugguucugccuuuucuccacc

SEQ ID NO: 865024 - RNA, 20 nt, Human
gagccccuggccaggacccu

SEQ ID NO: 865025 - RNA, 21 nt, Human
gcgcgcugucccugccaucug

SEQ ID NO: 865026 - RNA, 22 nt, Human
ggccguggugagcuuuuucuug

SEQ ID NO: 865027 - RNA, 22 nt, Human
gucaaucucuacucugguucug

SEQ ID NO: 865028 - RNA, 21 nt, Human
gugaaaucaaauacgauucug

SEQ ID NO: 865029 - RNA, 25 nt, Human
ucaaucucuacucugguucugccuu

SEQ ID NO: 865030 - RNA, 23 nt, Human
ucaggggcccugguccacucucu

SEQ ID NO: 865031 - RNA, 19 nt, Human
ucucuacucugguucugcc

SEQ ID NO: 865032 - RNA, 21 nt, Human
ucucuacucugguucugccuu

SEQ ID NO: 865033 - RNA, 21 nt, Human
uggccuggaucgccaucucuc

SEQ ID NO: 865034 - RNA, 21 nt, Human
ugguccacucucuuaguauua

SEQ ID NO: 865035 - RNA, 21 nt, Human
uggugagcuuuuucuuggccu

SEQ ID NO: 865036 - RNA, 24 nt, Human
uggugagcuuuuucuuggccugga

SEQ ID NO: 865037 - RNA, 24 nt, Human
uucuuggccuggaucgccaucuua

SEQ ID NO: 865038 - RNA, 25 nt, Human
uugguggccguggugagcuuuuucu

SEQ ID NO: 865039 - RNA, 20 nt, Human
uuuauuucugccuguuuuuu

SEQ ID NO: 865040 - RNA, 21 nt, Human
uuuugagcugacauuuaguca

SEQ ID NO: 865041 - RNA, 21 nt, Human
uuuuugacuacucaaugucuu

SEQ ID NO: 865042 - RNA, 20 nt, Human
aaaaagacucucaggcgcuc

SEQ ID NO: 865043 - RNA, 19 nt, Human
aaaaugcugggauuacagg

SEQ ID NO: 865044 - RNA, 19 nt, Human
aaaaugcugggauuacagg

SEQ ID NO: 865045 - RNA, 19 nt, Human
aaguagcugggauuacagg

SEQ ID NO: 865046 - RNA, 18 nt, Human
aauuuuuuguauuuucag

SEQ ID NO: 865047 - RNA, 23 nt, Human
aauuuuuuguauuuucaguagag

SEQ ID NO: 865048 - RNA, 24 nt, Human
acaagguuucaccauguuggccag

SEQ ID NO: 865049 - RNA, 18 nt, Human
acaggugcccaccacacc

SEQ ID NO: 865050 - RNA, 23 nt, Human
accucagccucucaaaaugcugg

SEQ ID NO: 865051 - RNA, 25 nt, Human
acuccaucgcccaggcuggagugca

SEQ ID NO: 865052 - RNA, 19 nt, Human
acucugaaaggcaaaaaga

SEQ ID NO: 865053 - RNA, 22 nt, Human
agaaaucgccaggucccugaac

SEQ ID NO: 865054 - RNA, 24 nt, Human
agcuucuucucuccagagugaguu

SEQ ID NO: 865055 - RNA, 25 nt, Human
aggcuggagugcaguggcaugaucu

SEQ ID NO: 865056 - RNA, 22 nt, Human
agguuucaccauguuggccagg

SEQ ID NO: 865057 - RNA, 22 nt, Human
aguaauuuucaugcagcuucuu

SEQ ID NO: 865058 - RNA, 19 nt, Human
agugauccacccaccucag

SEQ ID NO: 865059 - RNA, 24 nt, Human
agugauucacuugccucagccucc

SEQ ID NO: 865060 - RNA, 18 nt, Human
agugcaguggcaugaucu

SEQ ID NO: 865061 - RNA, 19 nt, Human
agugcaguggcaugaucuc

SEQ ID NO: 865062 - RNA, 21 nt, Human
agugcaguggcaugaucucug

SEQ ID NO: 865063 - RNA, 24 nt, Human
auuccucuuuaaacaggguuauug

SEQ ID NO: 865064 - RNA, 21 nt, Human
auuuucaguagagacaagguu

SEQ ID NO: 865065 - RNA, 19 nt, Human
caaaaugcugggauuacag

SEQ ID NO: 865066 - RNA, 27 nt, Human
caaaaugcugggauuacaggaauuaag

SEQ ID NO: 865067 - RNA, 24 nt, Human
caagguuucaccauguuggccagg

SEQ ID NO: 865068 - RNA, 19 nt, Human
caagugauccacccaccuc

SEQ ID NO: 865069 - RNA, 22 nt, Human
caagugauucacuugccucagc

SEQ ID NO: 865070 - RNA, 18 nt, Human
caccauguuggccagggu

SEQ ID NO: 865071 - RNA, 22 nt, Human
caccauguuggccagggugguc

SEQ ID NO: 865072 - RNA, 24 nt, Human
caccauguuggccaggguggucuc

SEQ ID NO: 865073 - RNA, 22 nt, Human
cacccaccucagccucucaaaa

SEQ ID NO: 865074 - RNA, 23 nt, Human
cacccaccucagccucucaaaau

SEQ ID NO: 865075 - RNA, 24 nt, Human
cacuccaucgcccaggcuggagug

SEQ ID NO: 865076 - RNA, 23 nt, Human
cacugcaaccucugcuuccuggg

SEQ ID NO: 865077 - RNA, 25 nt, Human
cagaacccuccuuucauugauguca

SEQ ID NO: 865078 - RNA, 24 nt, Human
caguagagacaagguuucaccaug

SEQ ID NO: 865079 - RNA, 25 nt, Human
caguagagacaagguuucaccaugu

SEQ ID NO: 865080 - RNA, 21 nt, Human
ccaaguagcugggauuacagg

SEQ ID NO: 865081 - RNA, 23 nt, Human
cccaaguagcugggauuacaggu

SEQ ID NO: 865082 - RNA, 24 nt, Human
cccaaguagcugggauuacaggug

SEQ ID NO: 865083 - RNA, 22 nt, Human
ccgggaagauccuggggacgga

SEQ ID NO: 865084 - RNA, 25 nt, Human
ccucuuuaaacaggguuauugggau

SEQ ID NO: 865085 - RNA, 24 nt, Human
ccugaccucaagugauccacccac

SEQ ID NO: 865086 - RNA, 20 nt, Human
ccuggguucaagugauucac

SEQ ID NO: 865087 - RNA, 21 nt, Human
ccuggguucaagugauucacu

SEQ ID NO: 865088 - RNA, 22 nt, Human
ccuggguucaagugauucacuu

SEQ ID NO: 865089 - RNA, 23 nt, Human
cgaggugagaacgugucagaacc

SEQ ID NO: 865090 - RNA, 24 nt, Human
cucaagugauccacccaccucagc

SEQ ID NO: 865091 - RNA, 18 nt, Human
cucacuccaucgcccagg

SEQ ID NO: 865092 - RNA, 24 nt, Human
cucacugcaaccucugcuuccugg

SEQ ID NO: 865093 - RNA, 24 nt, Human
cucagccucccaaguagcugggau

SEQ ID NO: 865094 - RNA, 21 nt, Human
cucugaaaggcaaaaagacuc

SEQ ID NO: 865095 - RNA, 19 nt, Human
cugcaaccucugcuuccug

SEQ ID NO: 865096 - RNA, 23 nt, Human
cugcaaccucugcuuccuggguu

SEQ ID NO: 865097 - RNA, 24 nt, Human
cugcaaccucugcuuccuggguuc

SEQ ID NO: 865098 - RNA, 23 nt, Human
cuugccucagccucccaaguagc

SEQ ID NO: 865099 - RNA, 22 nt, Human
gaacaaaugagagcuuucccac

SEQ ID NO: 865100 - RNA, 24 nt, Human
gaccucaagugauccacccaccuc

SEQ ID NO: 865101 - RNA, 23 nt, Human
gcccaggcuggagugcaguggca

SEQ ID NO: 865102 - RNA, 24 nt, Human
gcccaggcuggagugcaguggcau

SEQ ID NO: 865103 - RNA, 25 nt, Human
gcuggagugcaguggcaugaucucu

SEQ ID NO: 865104 - RNA, 23 nt, Human
ggccaggguggucucaaacuccu

SEQ ID NO: 865105 - RNA, 21 nt, Human
gggaagauccuggggacggag

SEQ ID NO: 865106 - RNA, 24 nt, Human
ggguggucucaaacuccugaccuc

SEQ ID NO: 865107 - RNA, 24 nt, Human
ggguucaagugauucacuugccuc

SEQ ID NO: 865108 - RNA, 22 nt, Human
gugauccacccaccucagccuc

SEQ ID NO: 865109 - RNA, 18 nt, Human
gugauucacuugccucag

SEQ ID NO: 865110 - RNA, 24 nt, Human
gugauucacuugccucagccuccc

SEQ ID NO: 865111 - RNA, 24 nt, Human
guucaagugauucacuugccucag

SEQ ID NO: 865112 - RNA, 22 nt, Human
guuggccaggguggucucaaac

SEQ ID NO: 865113 - RNA, 19 nt, Human
uacaggugcccaccacacc

SEQ ID NO: 865114 - RNA, 22 nt, Human
uagagacaagguuucaccaugu

SEQ ID NO: 865115 - RNA, 24 nt, Human
ucaaaaugcugggauuacaggaau

SEQ ID NO: 865116 - RNA, 24 nt, Human
ucaccauguuggccaggguggucu

SEQ ID NO: 865117 - RNA, 24 nt, Human
ucacuccaucgcccaggcuggagu

SEQ ID NO: 865118 - RNA, 24 nt, Human
ucacugcaaccucugcuuccuggg

SEQ ID NO: 865119 - RNA, 18 nt, Human
ucagaacccuccuuucau

SEQ ID NO: 865120 - RNA, 20 nt, Human
ucagccucccaaguagcugg

SEQ ID NO: 865121 - RNA, 18 nt, Human
ucagccucucaaaaugcu

SEQ ID NO: 865122 - RNA, 24 nt, Human
ucaguagagacaagguuucaccau

SEQ ID NO: 865123 - RNA, 21 nt, Human
ucaugcagcuucuucucucca

SEQ ID NO: 865124 - RNA, 24 nt, Human
uccaucgcccaggcuggagugcag

SEQ ID NO: 865125 - RNA, 23 nt, Human
ucccaaguagcugggauuacagg

SEQ ID NO: 865126 - RNA, 24 nt, Human
ucccaaguagcugggauuacaggu

SEQ ID NO: 865127 - RNA, 19 nt, Human
ucccaggccagugaggccu

SEQ ID NO: 865128 - RNA, 27 nt, Human
ucccugaaccgggaagauccuggggac

SEQ ID NO: 865129 - RNA, 19 nt, Human
uccggaacacucagaaauc

SEQ ID NO: 865130 - RNA, 19 nt, Human
uccuggguucaagugauuc

SEQ ID NO: 865131 - RNA, 23 nt, Human
uccuggguucaagugauucacuu

SEQ ID NO: 865132 - RNA, 24 nt, Human
ucgcccaggcuggagugcaguggc

SEQ ID NO: 865133 - RNA, 23 nt, Human
ucucaaaaugcugggauuacagg

SEQ ID NO: 865134 - RNA, 23 nt, Human
ucucacuccaucgcccaggcugg

SEQ ID NO: 865135 - RNA, 24 nt, Human
ucucacuccaucgcccaggcugga

SEQ ID NO: 865136 - RNA, 26 nt, Human
ucucacuccaucgcccaggcuggagu

SEQ ID NO: 865137 - RNA, 27 nt, Human
ucucacuccaucgcccaggcuggagug

SEQ ID NO: 865138 - RNA, 18 nt, Human
ucuccagagugaguucau

SEQ ID NO: 865139 - RNA, 22 nt, Human
ucuuuaaacaggguuauuggga

SEQ ID NO: 865140 - RNA, 22 nt, Human
ugaaaggcaaaaagacucucag

SEQ ID NO: 865141 - RNA, 23 nt, Human
ugagaacgugucagaacccuccu

SEQ ID NO: 865142 - RNA, 22 nt, Human
ugagauggagucucacuccauc

SEQ ID NO: 865143 - RNA, 24 nt, Human
ugauccacccaccucagccucuca

SEQ ID NO: 865144 - RNA, 23 nt, Human
ugaucucugcucacugcaaccuc

SEQ ID NO: 865145 - RNA, 19 nt, Human
ugcaaccucugcuuccugg

SEQ ID NO: 865146 - RNA, 22 nt, Human
ugccucagccucccaaguagcu

SEQ ID NO: 865147 - RNA, 24 nt, Human
ugccucagccucccaaguagcugg

SEQ ID NO: 865148 - RNA, 23 nt, Human
uggacaguggcaaucuccauucc

SEQ ID NO: 865149 - RNA, 24 nt, Human
uggagucucacuccaucgcccagg

SEQ ID NO: 865150 - RNA, 19 nt, Human
uggagugcaguggcaugau

SEQ ID NO: 865151 - RNA, 22 nt, Human
uggagugcaguggcaugaucuc

SEQ ID NO: 865152 - RNA, 23 nt, Human
uggagugcaguggcaugaucucu

SEQ ID NO: 865153 - RNA, 24 nt, Human
uggagugcaguggcaugaucucug

SEQ ID NO: 865154 - RNA, 24 nt, Human
uggccaggguggucucaaacuccu

SEQ ID NO: 865155 - RNA, 21 nt, Human
ugggauuacaggugcccacca

SEQ ID NO: 865156 - RNA, 24 nt, Human
uggguucaagugauucacuugccc

SEQ ID NO: 865157 - RNA, 27 nt, Human
uuaaguaauuuucaugcagcuucuucu

SEQ ID NO: 865158 - RNA, 23 nt, Human
uucaagugauucacuugccucag

SEQ ID NO: 865159 - RNA, 20 nt, Human
uuccggaacacucagaaauc

SEQ ID NO: 865160 - RNA, 19 nt, Human
uuucaccauguuggccagg

SEQ ID NO: 865161 - RNA, 24 nt, Human
uuuucaguagagacaagguuucac

SEQ ID NO: 865162 - RNA, 24 nt, Human
uuuuuuguauuuucaguagagaca

SEQ ID NO: 865163 - RNA, 26 nt, Human
uuuuuuuuuuuugagauggagucuca

SEQ ID NO: 865164 - RNA, 22 nt, Human
uuuuuuuuuuuuuugagaugga

SEQ ID NO: 865165 - RNA, 20 nt, Human
uuuuuuuuuuuuuuuuuugg

SEQ ID NO: 865166 - RNA, 19 nt, Human
aaaauggagcaaacacugc

SEQ ID NO: 865167 - RNA, 19 nt, Human
aaaucaaucuuaaguacug

SEQ ID NO: 865168 - RNA, 19 nt, Human
aacccagcccauccaauag

SEQ ID NO: 865169 - RNA, 20 nt, Human
aagaaaacaaauauugcaaa

SEQ ID NO: 865170 - RNA, 23 nt, Human
aagugcugagaugucaggcauga

SEQ ID NO: 865171 - RNA, 26 nt, Human
acacugcaauuuccacuuaggguccu

SEQ ID NO: 865172 - RNA, 18 nt, Human
acaggguuucaccauguu

SEQ ID NO: 865173 - RNA, 19 nt, Human
acaggguuucaccauguug

SEQ ID NO: 865174 - RNA, 24 nt, Human
acaggguuucaccauguugaccag

SEQ ID NO: 865175 - RNA, 21 nt, Human
agcaauggagacaaaauaacc

SEQ ID NO: 865176 - RNA, 20 nt, Human
agcgauuuucuugccucagc

SEQ ID NO: 865177 - RNA, 22 nt, Human
aggagagacaggguuucaccau

SEQ ID NO: 865178 - RNA, 21 nt, Human
aggcaugaguuacuaaaccca

SEQ ID NO: 865179 - RNA, 18 nt, Human
aguaguugggauuacagg

SEQ ID NO: 865180 - RNA, 18 nt, Human
agugacacaucaggaaaa

SEQ ID NO: 865181 - RNA, 24 nt, Human
agugcaauggccugaucucggcuc

SEQ ID NO: 865182 - RNA, 23 nt, Human
auauacaagaaaacaaauauugc

SEQ ID NO: 865183 - RNA, 21 nt, Human
aucaggaaaauacauuaucuc

SEQ ID NO: 865184 - RNA, 22 nt, Human
augccaggcuaauuuucuguau

SEQ ID NO: 865185 - RNA, 22 nt, Human
caaaaaauguagauaugcggca

SEQ ID NO: 865186 - RNA, 26 nt, Human
caaacaaagauacauacauauaugug

SEQ ID NO: 865187 - RNA, 22 nt, Human
caauggagacaaaauaaccaug

SEQ ID NO: 865188 - RNA, 21 nt, Human
cacacauauauacaagaaaac

SEQ ID NO: 865189 - RNA, 21 nt, Human
caccauguugaccaggcuggu

SEQ ID NO: 865190 - RNA, 22 nt, Human
caccauguugaccaggcugguc

SEQ ID NO: 865191 - RNA, 24 nt, Human
cacugcaauuuccacuuagggccu

SEQ ID NO: 865192 - RNA, 24 nt, Human
cacugcaauuuccacuuagggucu

SEQ ID NO: 865193 - RNA, 20 nt, Human
caggccaauguacaaacucu

SEQ ID NO: 865194 - RNA, 19 nt, Human
cagggccaacugcgggagg

SEQ ID NO: 865195 - RNA, 24 nt, Human
caggguuucaccauguugaccagg

SEQ ID NO: 865196 - RNA, 25 nt, Human
caggugcaugccaccaugccaggcu

SEQ ID NO: 865197 - RNA, 24 nt, Human
cauguugaccaggcuggucuggaa

SEQ ID NO: 865198 - RNA, 18 nt, Human
cccaggcuggagugcaau

SEQ ID NO: 865199 - RNA, 20 nt, Human
cccagguuccagcgauuuuc

SEQ ID NO: 865200 - RNA, 19 nt, Human
cccucaggccguacguaac

SEQ ID NO: 865201 - RNA, 24 nt, Human
ccuauugcccaggcuggagugcaa

SEQ ID NO: 865202 - RNA, 27 nt, Human
ccucagcugaguaguugggauuacagg

SEQ ID NO: 865203 - RNA, 29 nt, Human
ccucagcugaguaguugggauuacaggug

SEQ ID NO: 865204 - RNA, 18 nt, Human
ccucaugguccaccugcu

SEQ ID NO: 865205 - RNA, 22 nt, Human
ccuccagcaaacaaagauacau

SEQ ID NO: 865206 - RNA, 22 nt, Human
ccugaagugcugagaugucagg

SEQ ID NO: 865207 - RNA, 26 nt, Human
cggaacaccacagggccaacugcggg

SEQ ID NO: 865208 - RNA, 22 nt, Human
cuaaacccagcccauccaauag

SEQ ID NO: 865209 - RNA, 24 nt, Human
cugaagugcugagaugucaggcau

SEQ ID NO: 865210 - RNA, 23 nt, Human
cugaguaguugggauuacaggug

SEQ ID NO: 865211 - RNA, 24 nt, Human
cugcagcuuccacuucccagguuc

SEQ ID NO: 865212 - RNA, 24 nt, Human
cugcuccguacuccugaagugcug

SEQ ID NO: 865213 - RNA, 24 nt, Human
cuucccagguuccagcgauuuucu

SEQ ID NO: 865214 - RNA, 18 nt, Human
cuugccucagcugaguag

SEQ ID NO: 865215 - RNA, 21 nt, Human
gacagcuggagcuaccccgcc

SEQ ID NO: 865216 - RNA, 21 nt, Human
gaccucaugguccaccugcuc

SEQ ID NO: 865217 - RNA, 22 nt, Human
gagagacaggguuucaccaugu

SEQ ID NO: 865218 - RNA, 18 nt, Human
gauuacaggugcaugcca

SEQ ID NO: 865219 - RNA, 24 nt, Human
gauuacaggugcaugccaccaugc

SEQ ID NO: 865220 - RNA, 27 nt, Human
gcccuauugcccaggcuggagugcaau

SEQ ID NO: 865221 - RNA, 18 nt, Human
gcucacugcagcuuccac

SEQ ID NO: 865222 - RNA, 19 nt, Human
gcuggagugcaauggccug

SEQ ID NO: 865223 - RNA, 23 nt, Human
gcuggucuggaaguccugaccuc

SEQ ID NO: 865224 - RNA, 18 nt, Human
ggagacaaaauaaccaug

SEQ ID NO: 865225 - RNA, 22 nt, Human
ggagagacaggguuucaccaug

SEQ ID NO: 865226 - RNA, 25 nt, Human
guauuuauuuauuuauuuauuuauu

SEQ ID NO: 865227 - RNA, 22 nt, Human
uaauuacacaucugguuauuaa

SEQ ID NO: 865228 - RNA, 22 nt, Human
uaauuuucuguauuuuuaggag

SEQ ID NO: 865229 - RNA, 23 nt, Human
uaauuuucuguauuuuuaggaga

SEQ ID NO: 865230 - RNA, 24 nt, Human
uacaauuuuacaacaaauuuuaga

SEQ ID NO: 865231 - RNA, 18 nt, Human
uacagguuagaauacaca

SEQ ID NO: 865232 - RNA, 22 nt, Human
uagaauacacacauucucagac

SEQ ID NO: 865233 - RNA, 23 nt, Human
uagaauacacacauucucagaca

SEQ ID NO: 865234 - RNA, 24 nt, Human
uaggagagacaggguuucaccaug

SEQ ID NO: 865235 - RNA, 23 nt, Human
uaucaaaaagugacacaucagga

SEQ ID NO: 865236 - RNA, 20 nt, Human
uaucuacaugcauaacauag

SEQ ID NO: 865237 - RNA, 19 nt, Human
uauugcccaggcuggagug

SEQ ID NO: 865238 - RNA, 20 nt, Human
uauugcccaggcuggagugc

SEQ ID NO: 865239 - RNA, 24 nt, Human
ucacugcagcuuccacuucccagg

SEQ ID NO: 865240 - RNA, 18 nt, Human
ucccagguuccagcgauu

SEQ ID NO: 865241 - RNA, 21 nt, Human
ucccagguuccagcgauuuuc

SEQ ID NO: 865242 - RNA, 24 nt, Human
uccugaagugcugagaugucaggc

SEQ ID NO: 865243 - RNA, 22 nt, Human
ucuccaauuaauuacacaucug

SEQ ID NO: 865244 - RNA, 23 nt, Human
ucuugcccuauugcccaggcugg

SEQ ID NO: 865245 - RNA, 24 nt, Human
ucuugcccuauugcccaggcugga

SEQ ID NO: 865246 - RNA, 22 nt, Human
ugagauggacucuugcccuauu

SEQ ID NO: 865247 - RNA, 22 nt, Human
ugagaugucaggcaugaguuac

SEQ ID NO: 865248 - RNA, 24 nt, Human
ugagaugucaggcaugaguuacua

SEQ ID NO: 865249 - RNA, 27 nt, Human
ugaguaguugggauuacaggugcaugc

SEQ ID NO: 865250 - RNA, 21 nt, Human
ugaguuacuaaacccagccca

SEQ ID NO: 865251 - RNA, 23 nt, Human
ugcagcuuccacuucccagguuc

SEQ ID NO: 865252 - RNA, 24 nt, Human
ugcauagauguuugcacacauaua

SEQ ID NO: 865253 - RNA, 18 nt, Human
ugcccaggcuggagugca

SEQ ID NO: 865254 - RNA, 21 nt, Human
ugcccaggcuggagugcaaug

SEQ ID NO: 865255 - RNA, 24 nt, Human
ugcccuauugcccaggcuggagug

SEQ ID NO: 865256 - RNA, 25 nt, Human
ugcccuauugcccaggcuggagugc

SEQ ID NO: 865257 - RNA, 18 nt, Human
uggaaguccugaccucau

SEQ ID NO: 865258 - RNA, 19 nt, Human
uggagugcaauggccugau

SEQ ID NO: 865259 - RNA, 23 nt, Human
uggagugcaauggccugaucucg

SEQ ID NO: 865260 - RNA, 24 nt, Human
uggagugcaauggccugaucucgg

SEQ ID NO: 865261 - RNA, 21 nt, Human
ugggauuacaggugcaugcca

SEQ ID NO: 865262 - RNA, 22 nt, Human
ugggauuacaggugcaugccac

SEQ ID NO: 865263 - RNA, 24 nt, Human
ugggauuacaggugcaugccacca

SEQ ID NO: 865264 - RNA, 25 nt, Human
ugggauuacaggugcaugccaccau

SEQ ID NO: 865265 - RNA, 26 nt, Human
ugggccccaaaguagaaaacucuaaa

SEQ ID NO: 865266 - RNA, 20 nt, Human
uguaucaaaauuacaaagca

SEQ ID NO: 865267 - RNA, 21 nt, Human
ugucuuauccuccagcaaaca

SEQ ID NO: 865268 - RNA, 19 nt, Human
uuagauuauugaagguuag

SEQ ID NO: 865269 - RNA, 24 nt, Human
uuaggagagacaggguuucaccau

SEQ ID NO: 865270 - RNA, 18 nt, Human
uuauuuauuuauuuauuu

SEQ ID NO: 865271 - RNA, 19 nt, Human
uuauuuauuuauuuauuua

SEQ ID NO: 865272 - RNA, 25 nt, Human
uuauuuauuuauuuauuuauuuauu

SEQ ID NO: 865273 - RNA, 25 nt, Human
uuauuuauuuauuuauuuauuuauu

SEQ ID NO: 865274 - RNA, 25 nt, Human
uuauuuauuuauuuauuuauuuauu

SEQ ID NO: 865275 - RNA, 26 nt, Human
uuauuuauuuauuuauuuauuuauug

SEQ ID NO: 865276 - RNA, 25 nt, Human
uucugggccccaaaguagaaaacuc

SEQ ID NO: 865277 - RNA, 23 nt, Human
uugaccaggcuggucuggaaguc

SEQ ID NO: 865278 - RNA, 24 nt, Human
uugcccuauugcccaggcuggagu

SEQ ID NO: 865279 - RNA, 24 nt, Human
uuucaccauguugaccaggcuggu

SEQ ID NO: 865280 - RNA, 19 nt, Human
uuucuguauuuuuaggaga

SEQ ID NO: 865281 - RNA, 22 nt, Human
uuuuaaauauugcuuacuuuga

SEQ ID NO: 865282 - RNA, 24 nt, Human
uuuuuaggagagacaggguuucac

SEQ ID NO: 865283 - RNA, 25 nt, Human
uuuuuucuuuuuuaaaaaauacgug

SEQ ID NO: 865284 - RNA, 22 nt, Human
aaacaaauaacuuagagacuca

SEQ ID NO: 865285 - RNA, 18 nt, Human
aaagcuucucuguccaca

SEQ ID NO: 865286 - RNA, 23 nt, Human
aaauaaacaggauuuaaaaauau

SEQ ID NO: 865287 - RNA, 26 nt, Human
aagacaugcauguugugauacaccaa

SEQ ID NO: 865288 - RNA, 23 nt, Human
acaaaacaccauagaagguuaca

SEQ ID NO: 865289 - RNA, 19 nt, Human
acaaaaugaccaugaaagu

SEQ ID NO: 865290 - RNA, 20 nt, Human
acaaaguagugaauauauuc

SEQ ID NO: 865291 - RNA, 22 nt, Human
acaaggcuguuuugugcuaaaa

SEQ ID NO: 865292 - RNA, 23 nt, Human
accauagaagguuacaagaaugc

SEQ ID NO: 865293 - RNA, 19 nt, Human
agagcucugauuuacauuc

SEQ ID NO: 865294 - RNA, 18 nt, Human
aggaagugacgauugaca

SEQ ID NO: 865295 - RNA, 23 nt, Human
aggaagugacgauugacauuuuc

SEQ ID NO: 865296 - RNA, 23 nt, Human
aguucaaauguucauuguguugg

SEQ ID NO: 865297 - RNA, 19 nt, Human
auacuagagacuuuaagcu

SEQ ID NO: 865298 - RNA, 24 nt, Human
augcucagcuugcccucucuauug

SEQ ID NO: 865299 - RNA, 23 nt, Human
augguccacaagauaagagccac

SEQ ID NO: 865300 - RNA, 25 nt, Human
caaaccagaaaauuuucauaaacac

SEQ ID NO: 865301 - RNA, 22 nt, Human
caacacuccauaaacacaaaga

SEQ ID NO: 865302 - RNA, 22 nt, Human
cacaacccaggacuugcugccu

SEQ ID NO: 865303 - RNA, 19 nt, Human
cacaucaaaaugcauaaga

SEQ ID NO: 865304 - RNA, 18 nt, Human
caccauagaagguuacaa

SEQ ID NO: 865305 - RNA, 22 nt, Human
cacuugucccucuuuuuaugaa

SEQ ID NO: 865306 - RNA, 23 nt, Human
cagaacuuggguaaagccagaga

SEQ ID NO: 865307 - RNA, 21 nt, Human
cagauaucaucuaagacacaa

SEQ ID NO: 865308 - RNA, 20 nt, Human
cagcaccagccacuuguccc

SEQ ID NO: 865309 - RNA, 22 nt, Human
cagcaccagccacuugucccuc

SEQ ID NO: 865310 - RNA, 26 nt, Human
caucuccauuauucuaagaaaacaac

SEQ ID NO: 865311 - RNA, 20 nt, Human
cauucaauacucucugcauu

SEQ ID NO: 865312 - RNA, 24 nt, Human
ccucuccugaaagaaaauagaggu

SEQ ID NO: 865313 - RNA, 22 nt, Human
cuaagaaaacaacacuccauaa

SEQ ID NO: 865314 - RNA, 22 nt, Human
cuacacuaaaaucagaauuagu

SEQ ID NO: 865315 - RNA, 20 nt, Human
gaaaaugcuuauucaugcac

SEQ ID NO: 865316 - RNA, 20 nt, Human
gaaauuauuauaacaucuuu

SEQ ID NO: 865317 - RNA, 21 nt, Human
gacugcagaagaaugcaaaug

SEQ ID NO: 865318 - RNA, 22 nt, Human
gagaacucucuuugggguacag

SEQ ID NO: 865319 - RNA, 24 nt, Human
ggcauauggaagccauuuuuaauu

SEQ ID NO: 865320 - RNA, 25 nt, Human
gggaaaagaaaaacuuaaauuuuaa

SEQ ID NO: 865321 - RNA, 20 nt, Human
guaucuguauauauaacaag

SEQ ID NO: 865322 - RNA, 22 nt, Human
uaaaaauaaagcuucucugucc

SEQ ID NO: 865323 - RNA, 20 nt, Human
uaagaaaacaacacuccaua

SEQ ID NO: 865324 - RNA, 27 nt, Human
uaagaaaacaacacuccauaaacacaa

SEQ ID NO: 865325 - RNA, 22 nt, Human
uaagagccacaaaacaccauag

SEQ ID NO: 865326 - RNA, 22 nt, Human
uaaguaucauuuuucacaaccc

SEQ ID NO: 865327 - RNA, 23 nt, Human
uaauccaacuucccucuccugaa

SEQ ID NO: 865328 - RNA, 21 nt, Human
uacagauaucaucuaagacac

SEQ ID NO: 865329 - RNA, 21 nt, Human
uacagaugcucagcuugcccu

SEQ ID NO: 865330 - RNA, 28 nt, Human
uacuaaaaauaaagcuucucuguccaca

SEQ ID NO: 865331 - RNA, 23 nt, Human
uagaagguuacaagaaugcaaau

SEQ ID NO: 865332 - RNA, 23 nt, Human
uagccaucuaugaugaauaauau

SEQ ID NO: 865333 - RNA, 18 nt, Human
uauaacaagguacucucc

SEQ ID NO: 865334 - RNA, 21 nt, Human
uauaacaucuuucacaucaaa

SEQ ID NO: 865335 - RNA, 22 nt, Human
ucagaacuuggguaaagccaga

SEQ ID NO: 865336 - RNA, 20 nt, Human
ucauauguagcacuaaaugu

SEQ ID NO: 865337 - RNA, 21 nt, Human
ucaucuaagacacaaggcugu

SEQ ID NO: 865338 - RNA, 23 nt, Human
uccaacaucacuaaucacgcaac

SEQ ID NO: 865339 - RNA, 22 nt, Human
uccaauuagccaucuaugauga

SEQ ID NO: 865340 - RNA, 19 nt, Human
uccacaagauaagagccac

SEQ ID NO: 865341 - RNA, 25 nt, Human
ucuaagaaaacaacacuccauaaac

SEQ ID NO: 865342 - RNA, 19 nt, Human
ugaaauggaagauggugag

SEQ ID NO: 865343 - RNA, 22 nt, Human
ugaaauggaagauggugaggcg

SEQ ID NO: 865344 - RNA, 23 nt, Human
ugcauauuacauacuagagacuu

SEQ ID NO: 865345 - RNA, 23 nt, Human
uggaaauacagaugcucagcuug

SEQ ID NO: 865346 - RNA, 20 nt, Human
uggcauauggaagccauuuu

SEQ ID NO: 865347 - RNA, 20 nt, Human
ugggguacagaguggcauau

SEQ ID NO: 865348 - RNA, 21 nt, Human
ugugcuaaaaugcuuccaaca

SEQ ID NO: 865349 - RNA, 19 nt, Human
uuaauuuaggggcuacacu

SEQ ID NO: 865350 - RNA, 20 nt, Human
uuacuaaugggggaaaagaa

SEQ ID NO: 865351 - RNA, 26 nt, Human
uugagaauuuuuaauaauuacauuga

SEQ ID NO: 865352 - RNA, 23 nt, Human
uugugcuaaaaugcuuccaacug

SEQ ID NO: 865353 - RNA, 21 nt, Human
uuuaagcuacaaaauacuucu

SEQ ID NO: 865354 - RNA, 25 nt, Human
uuucuugauaaugaauacauucugg

SEQ ID NO: 865355 - RNA, 19 nt, Human
uuuugugcuaaaaugcuuc

SEQ ID NO: 865356 - RNA, 25 nt, Human
aaggagccuggagggaggaagggug

SEQ ID NO: 865357 - RNA, 20 nt, Human
aaggggguucucgcucgguc

SEQ ID NO: 865358 - RNA, 21 nt, Human
aagucagucucuggccacuaa

SEQ ID NO: 865359 - RNA, 23 nt, Human
acacacacacacacacacacaca

SEQ ID NO: 865360 - RNA, 23 nt, Human
acacacacacacacacacacaca

SEQ ID NO: 865361 - RNA, 23 nt, Human
acacacacacacacacacacaca

SEQ ID NO: 865362 - RNA, 23 nt, Human
acacacacacacacacacacaca

SEQ ID NO: 865363 - RNA, 23 nt, Human
acacacacacacacacacacaca

SEQ ID NO: 865364 - RNA, 24 nt, Human
acacacacacacacacacacacag

SEQ ID NO: 865365 - RNA, 21 nt, Human
acacacacacacacacacgca

SEQ ID NO: 865366 - RNA, 23 nt, Human
acacacacacacacacacgcacg

SEQ ID NO: 865367 - RNA, 25 nt, Human
acacacacgcacgcacgcaccaccu

SEQ ID NO: 865368 - RNA, 20 nt, Human
accgugggggcgcgggaagg

SEQ ID NO: 865369 - RNA, 22 nt, Human
agacauguaccagaacaauaua

SEQ ID NO: 865370 - RNA, 23 nt, Human
agacauguaccagaacaauauaa

SEQ ID NO: 865371 - RNA, 26 nt, Human
caaccacccacacuccgcagccacuc

SEQ ID NO: 865372 - RNA, 20 nt, Human
cacacacacacacacacaca

SEQ ID NO: 865373 - RNA, 20 nt, Human
cacacacacacacacacaca

SEQ ID NO: 865374 - RNA, 20 nt, Human
cacacacacacacacacaca

SEQ ID NO: 865375 - RNA, 20 nt, Human
cacacacacacacacacaca

SEQ ID NO: 865376 - RNA, 20 nt, Human
cacacacacacacacacaca

SEQ ID NO: 865377 - RNA, 20 nt, Human
cacacacacacacacacaca

SEQ ID NO: 865378 - RNA, 20 nt, Human
cacacacacacacacacaca

SEQ ID NO: 865379 - RNA, 20 nt, Human
cacacacacacacacacaca

SEQ ID NO: 865380 - RNA, 22 nt, Human
cacacacacacacacacacaca

SEQ ID NO: 865381 - RNA, 22 nt, Human
cacacacacacacacacacaca

SEQ ID NO: 865382 - RNA, 22 nt, Human
cacacacacacacacacacaca

SEQ ID NO: 865383 - RNA, 26 nt, Human
cacacacacacacacacacacacaca

SEQ ID NO: 865384 - RNA, 26 nt, Human
cacacacacacacacacacacacaca

SEQ ID NO: 865385 - RNA, 26 nt, Human
cacacacacacacacacacacacaca

SEQ ID NO: 865386 - RNA, 26 nt, Human
cacacacacacacacacacacacaca

SEQ ID NO: 865387 - RNA, 26 nt, Human
cacacacacacacacacacacacaca

SEQ ID NO: 865388 - RNA, 26 nt, Human
cacacacacacacacacacacacacg

SEQ ID NO: 865389 - RNA, 25 nt, Human
cacacacacacacacacacgcacgc

SEQ ID NO: 865390 - RNA, 26 nt, Human
cacacacacacacacacgcacgcacg

SEQ ID NO: 865391 - RNA, 25 nt, Human
cacacacacacacacgcacgcacgc

SEQ ID NO: 865392 - RNA, 24 nt, Human
cacacacacacacgcacgcacgca

SEQ ID NO: 865393 - RNA, 21 nt, Human
cacuccgcagccacucgugcc

SEQ ID NO: 865394 - RNA, 21 nt, Human
ccacacacacacacacacaca

SEQ ID NO: 865395 - RNA, 22 nt, Human
ccccgcacgccccccacaccug

SEQ ID NO: 865396 - RNA, 18 nt, Human
ccccuuuugucucgugcc

SEQ ID NO: 865397 - RNA, 18 nt, Human
ccccuuuugucucgugcc

SEQ ID NO: 865398 - RNA, 30 nt, Human
cccgagcuccacacacacacacacacacag

SEQ ID NO: 865399 - RNA, 18 nt, Human
ccucacgcccaaccaccc

SEQ ID NO: 865400 - RNA, 26 nt, Human
cgagcuccacacacacacacacacag

SEQ ID NO: 865401 - RNA, 20 nt, Human
cgcucgguccgcaaccgugg

SEQ ID NO: 865402 - RNA, 19 nt, Human
cuccgcagccacucgugcc

SEQ ID NO: 865403 - RNA, 26 nt, Human
cucuggagucucuggaauaaaaccuu

SEQ ID NO: 865404 - RNA, 24 nt, Human
cuuaucuggaggggauucucucca

SEQ ID NO: 865405 - RNA, 20 nt, Human
cuuggcacccgagcuccacc

SEQ ID NO: 865406 - RNA, 21 nt, Human
gaagacagcagggacucgcac

SEQ ID NO: 865407 - RNA, 18 nt, Human
gccgacugccgggcugcg

SEQ ID NO: 865408 - RNA, 21 nt, Human
uagaauuucagacauguacca

SEQ ID NO: 865409 - RNA, 22 nt, Human
uauauaaaaaucagcugaacaa

SEQ ID NO: 865410 - RNA, 20 nt, Human
ucaaaaucucuuaucuggag

SEQ ID NO: 865411 - RNA, 18 nt, Human
ucaaugacaaauguaaga

SEQ ID NO: 865412 - RNA, 19 nt, Human
ucacgcccaaccacccaca

SEQ ID NO: 865413 - RNA, 18 nt, Human
ucagacauguaccagaac

SEQ ID NO: 865414 - RNA, 20 nt, Human
uccacacacacacacacaca

SEQ ID NO: 865415 - RNA, 21 nt, Human
uccacacacacacacacacac

SEQ ID NO: 865416 - RNA, 24 nt, Human
uccacacacacacacacacacaca

SEQ ID NO: 865417 - RNA, 25 nt, Human
uccacacacacacacacacacacag

SEQ ID NO: 865418 - RNA, 23 nt, Human
ucgcacccggggacugacggcuc

SEQ ID NO: 865419 - RNA, 21 nt, Human
ucgcucgguccgcaaccgugg

SEQ ID NO: 865420 - RNA, 21 nt, Human
ucggcgucaggcgcucuccuc

SEQ ID NO: 865421 - RNA, 18 nt, Human
ucgugccaccccgcacgc

SEQ ID NO: 865422 - RNA, 18 nt, Human
ucucuccaagcaauagaa

SEQ ID NO: 865423 - RNA, 24 nt, Human
ugacaaauguaagaauuuuaaaaa

SEQ ID NO: 865424 - RNA, 19 nt, Human
ugccgggcugcgccugcgg

SEQ ID NO: 865425 - RNA, 22 nt, Human
uggagggaggaaggguguggaa

SEQ ID NO: 865426 - RNA, 20 nt, Human
uggagucucuggaauaaaac

SEQ ID NO: 865427 - RNA, 19 nt, Human
uggcacccgagcuccacac

SEQ ID NO: 865428 - RNA, 28 nt, Human
ugucucgugccaccccgcacgcccccca

SEQ ID NO: 865429 - RNA, 23 nt, Human
uuauguuuuucacucaaaaucuc

SEQ ID NO: 865430 - RNA, 21 nt, Human
uuuuaaaaaugaaaaauggca

SEQ ID NO: 865431 - RNA, 23 nt, Human
aagggaaggggaggaggggcaaa

SEQ ID NO: 865432 - RNA, 23 nt, Human
aaguaucuccccaguuuucagcc

SEQ ID NO: 865433 - RNA, 25 nt, Human
acagagccuccuucaacucuugaca

SEQ ID NO: 865434 - RNA, 27 nt, Human
accaggugcugccugccccguccugcu

SEQ ID NO: 865435 - RNA, 20 nt, Human
acgcuggcucuggggcugga

SEQ ID NO: 865436 - RNA, 19 nt, Human
acucuugacaaacuggagg

SEQ ID NO: 865437 - RNA, 22 nt, Human
agaaggcaggcaagggggacag

SEQ ID NO: 865438 - RNA, 18 nt, Human
agcagugggggacaggca

SEQ ID NO: 865439 - RNA, 20 nt, Human
aggagggguguggcuggagg

SEQ ID NO: 865440 - RNA, 20 nt, Human
aggcagagcccucagcugua

SEQ ID NO: 865441 - RNA, 21 nt, Human
aggccccaagacuuccagaag

SEQ ID NO: 865442 - RNA, 21 nt, Human
agggaagaaggcaggcaaggg

SEQ ID NO: 865443 - RNA, 20 nt, Human
agggcuagggguggggggag

SEQ ID NO: 865444 - RNA, 20 nt, Human
aggggaugucugauugcuuc

SEQ ID NO: 865445 - RNA, 19 nt, Human
agggguguggcuggaggag

SEQ ID NO: 865446 - RNA, 23 nt, Human
agggguguggcuggaggagcagc

SEQ ID NO: 865447 - RNA, 24 nt, Human
auccccccaggcuucuacuugcua

SEQ ID NO: 865448 - RNA, 20 nt, Human
cacgcauccccccaggcuuc

SEQ ID NO: 865449 - RNA, 23 nt, Human
cagagccuccuucaacucuugac

SEQ ID NO: 865450 - RNA, 19 nt, Human
cagccaggucaccuggcca

SEQ ID NO: 865451 - RNA, 24 nt, Human
cagccuggggagggucucaggagc

SEQ ID NO: 865452 - RNA, 19 nt, Human
cagcggccacuccauguuu

SEQ ID NO: 865453 - RNA, 20 nt, Human
caggcaagggggacagggag

SEQ ID NO: 865454 - RNA, 19 nt, Human
caggcccagagaagggccc

SEQ ID NO: 865455 - RNA, 23 nt, Human
ccagaagggaaggggaggagggg

SEQ ID NO: 865456 - RNA, 24 nt, Human
cccccaggcuucuacuugcuaguc

SEQ ID NO: 865457 - RNA, 22 nt, Human
cccguccugcuuccugcaggag

SEQ ID NO: 865458 - RNA, 18 nt, Human
cccucaucucuaccccca

SEQ ID NO: 865459 - RNA, 20 nt, Human
cccucccccaccacagcugc

SEQ ID NO: 865460 - RNA, 23 nt, Human
ccucccccaccacagcugcugga

SEQ ID NO: 865461 - RNA, 22 nt, Human
ccugccccguccugcuuccugc

SEQ ID NO: 865462 - RNA, 21 nt, Human
ccuggaagcagggcccaaggg

SEQ ID NO: 865463 - RNA, 18 nt, Human
ccuggagggagcuuaggg

SEQ ID NO: 865464 - RNA, 21 nt, Human
ccuucagcuacucagguccau

SEQ ID NO: 865465 - RNA, 24 nt, Human
cguucuccccucuaagggugccca

SEQ ID NO: 865466 - RNA, 24 nt, Human
cuaccaggugcugccugccccguc

SEQ ID NO: 865467 - RNA, 19 nt, Human
cucagguccauucaucuuc

SEQ ID NO: 865468 - RNA, 22 nt, Human
cucccccaccacagcugcugga

SEQ ID NO: 865469 - RNA, 21 nt, Human
cuccccucaucucuaccccca

SEQ ID NO: 865470 - RNA, 19 nt, Human
cucccuccccucaucucua

SEQ ID NO: 865471 - RNA, 19 nt, Human
gaaggggaggaggggcaaa

SEQ ID NO: 865472 - RNA, 21 nt, Human
gaaggggaggaggggcaaagc

SEQ ID NO: 865473 - RNA, 19 nt, Human
gacagagcagggaagaagg

SEQ ID NO: 865474 - RNA, 21 nt, Human
gacaggcagagcccucagcug

SEQ ID NO: 865475 - RNA, 22 nt, Human
gagcaggagggguguggcugga

SEQ ID NO: 865476 - RNA, 23 nt, Human
gagcaggagggguguggcuggag

SEQ ID NO: 865477 - RNA, 21 nt, Human
gaggaaacugaggcacacgca

SEQ ID NO: 865478 - RNA, 19 nt, Human
gaggggaacccucccccaa

SEQ ID NO: 865479 - RNA, 19 nt, Human
gcaaagcacugugccuacc

SEQ ID NO: 865480 - RNA, 20 nt, Human
gcacacgcauccccccaggc

SEQ ID NO: 865481 - RNA, 22 nt, Human
gcacugugccuaccaggugcug

SEQ ID NO: 865482 - RNA, 24 nt, Human
gccacagagccuccuucaacucuu

SEQ ID NO: 865483 - RNA, 22 nt, Human
gcccaggcccagagaagggccc

SEQ ID NO: 865484 - RNA, 21 nt, Human
gccuaccaggugcugccugcc

SEQ ID NO: 865485 - RNA, 21 nt, Human
gccuuccuucagcuacucagg

SEQ ID NO: 865486 - RNA, 20 nt, Human
gcugccugccccguccugcu

SEQ ID NO: 865487 - RNA, 22 nt, Human
ggaggggcaaagcacugugccu

SEQ ID NO: 865488 - RNA, 23 nt, Human
ggagggguguggcuggaggagca

SEQ ID NO: 865489 - RNA, 19 nt, Human
ggaggugggaagggagaga

SEQ ID NO: 865490 - RNA, 18 nt, Human
ggccacagagccuccuuc

SEQ ID NO: 865491 - RNA, 19 nt, Human
gggacagagcagggaagaa

SEQ ID NO: 865492 - RNA, 21 nt, Human
gggagugcugggcucuggcgc

SEQ ID NO: 865493 - RNA, 19 nt, Human
ggggacagagcagggaaga

SEQ ID NO: 865494 - RNA, 20 nt, Human
ggggacagggagaccuggaa

SEQ ID NO: 865495 - RNA, 21 nt, Human
ggguagggaggggccuuccuu

SEQ ID NO: 865496 - RNA, 23 nt, Human
ggucaccuggccacagagccucc

SEQ ID NO: 865497 - RNA, 18 nt, Human
guggaaggcagccagguc

SEQ ID NO: 865498 - RNA, 19 nt, Human
guggagcggggcaggccag

SEQ ID NO: 865499 - RNA, 19 nt, Human
guggcuggaggagcagcug

SEQ ID NO: 865500 - RNA, 18 nt, Human
uacaaggaguggaaggca

SEQ ID NO: 865501 - RNA, 23 nt, Human
uacaaggaguggaaggcagccag

SEQ ID NO: 865502 - RNA, 19 nt, Human
uaccaggugcugccugccc

SEQ ID NO: 865503 - RNA, 21 nt, Human
uagcaccuggccucuuuuccc

SEQ ID NO: 865504 - RNA, 18 nt, Human
uagcagugggggacaggc

SEQ ID NO: 865505 - RNA, 21 nt, Human
uccagaagggaaggggaggaa

SEQ ID NO: 865506 - RNA, 18 nt, Human
ucccccaccacagcugcu

SEQ ID NO: 865507 - RNA, 19 nt, Human
ucuacuugcuaguccaagg

SEQ ID NO: 865508 - RNA, 21 nt, Human
ucuggcgccugucugccuucc

SEQ ID NO: 865509 - RNA, 22 nt, Human
ugagaaaggcucauuuuuagca

SEQ ID NO: 865510 - RNA, 22 nt, Human
ugagcuguaagcagccugggga

SEQ ID NO: 865511 - RNA, 19 nt, Human
ugaggccccaagacuucca

SEQ ID NO: 865512 - RNA, 24 nt, Human
ugagguacaaggaguggaaggcag

SEQ ID NO: 865513 - RNA, 19 nt, Human
ugauugcuucguucucccc

SEQ ID NO: 865514 - RNA, 19 nt, Human
ugcaagcacugaggcccca

SEQ ID NO: 865515 - RNA, 22 nt, Human
ugcaagcacugaggccccaaga

SEQ ID NO: 865516 - RNA, 24 nt, Human
ugcaagcacugaggccccaagacu

SEQ ID NO: 865517 - RNA, 21 nt, Human
ugcccaggcccagagaagggc

SEQ ID NO: 865518 - RNA, 20 nt, Human
ugccuggagggagcuuaggg

SEQ ID NO: 865519 - RNA, 18 nt, Human
ugcuggaaaagggagugc

SEQ ID NO: 865520 - RNA, 18 nt, Human
ugcuucguucuccccucu

SEQ ID NO: 865521 - RNA, 23 nt, Human
uggaagcagggcccaaggggaug

SEQ ID NO: 865522 - RNA, 25 nt, Human
uggaagcagggcccaaggggauguc

SEQ ID NO: 865523 - RNA, 19 nt, Human
uggaaggcagccaggucac

SEQ ID NO: 865524 - RNA, 23 nt, Human
uggaaggcagccaggucaccugg

SEQ ID NO: 865525 - RNA, 18 nt, Human
uggcuggaggagcagcug

SEQ ID NO: 865526 - RNA, 24 nt, Human
uggggggagcaggagggguguggc

SEQ ID NO: 865527 - RNA, 21 nt, Human
uguggaggaggaaacugaggc

SEQ ID NO: 865528 - RNA, 21 nt, Human
uuaacuuacucccuccccuca

SEQ ID NO: 865529 - RNA, 22 nt, Human
aaaaggaaggcagcugcuuggc

SEQ ID NO: 865530 - RNA, 23 nt, Human
aacccccagggcuacccaccccc

SEQ ID NO: 865531 - RNA, 21 nt, Human
aagcagauggucagcagugcu

SEQ ID NO: 865532 - RNA, 20 nt, Human
acagagcagcggcugacccc

SEQ ID NO: 865533 - RNA, 19 nt, Human
acaucaguuccugugguuc

SEQ ID NO: 865534 - RNA, 21 nt, Human
accgccgccucccgcucaggu

SEQ ID NO: 865535 - RNA, 22 nt, Human
agacugagcaacccuacccagc

SEQ ID NO: 865536 - RNA, 19 nt, Human
agagggaggggaaccccca

SEQ ID NO: 865537 - RNA, 19 nt, Human
aggauaagucccuaaccuc

SEQ ID NO: 865538 - RNA, 22 nt, Human
aggcagcugcuuggcuuccuuc

SEQ ID NO: 865539 - RNA, 19 nt, Human
caccagggaggggccaggc

SEQ ID NO: 865540 - RNA, 19 nt, Human
cacuguccccaccagggag

SEQ ID NO: 865541 - RNA, 21 nt, Human
cagagcagcggcugaccccac

SEQ ID NO: 865542 - RNA, 24 nt, Human
cagcagugcucuuaucugccccuc

SEQ ID NO: 865543 - RNA, 23 nt, Human
cagcggcugaccccacccccaca

SEQ ID NO: 865544 - RNA, 19 nt, Human
cagcugcuuggcuuccuuc

SEQ ID NO: 865545 - RNA, 22 nt, Human
cagcugcuuggcuuccuucuag

SEQ ID NO: 865546 - RNA, 21 nt, Human
cagugcucuuaucugccccuc

SEQ ID NO: 865547 - RNA, 20 nt, Human
ccaccgccaccgccgccacc

SEQ ID NO: 865548 - RNA, 31 nt, Human
ccaccgccaccgccgcuaccggguccccagg

SEQ ID NO: 865549 - RNA, 21 nt, Human
ccaccgccgccaccgccaccg

SEQ ID NO: 865550 - RNA, 23 nt, Human
ccaccgccgccaccgccaccgcc

SEQ ID NO: 865551 - RNA, 21 nt, Human
ccccaaagacugagcaacccu

SEQ ID NO: 865552 - RNA, 24 nt, Human
ccccaaagacugagcaacccuacc

SEQ ID NO: 865553 - RNA, 23 nt, Human
ccccuccaaaccuaagugagggc

SEQ ID NO: 865554 - RNA, 20 nt, Human
ccgccaccgccaccgccgcu

SEQ ID NO: 865555 - RNA, 18 nt, Human
ccgccgccaccgccaccg

SEQ ID NO: 865556 - RNA, 21 nt, Human
ccgccgccaccgccaccgccg

SEQ ID NO: 865557 - RNA, 28 nt, Human
ccgccgccaccgccaccgccgcuaccgg

SEQ ID NO: 865558 - RNA, 21 nt, Human
ccucugccgucgccgcagcca

SEQ ID NO: 865559 - RNA, 22 nt, Human
ccuucuagaagccccgggagcc

SEQ ID NO: 865560 - RNA, 24 nt, Human
cgccaccgccgcuaccgggucccc

SEQ ID NO: 865561 - RNA, 24 nt, Human
cgccucugccgucgccgcagccac

SEQ ID NO: 865562 - RNA, 19 nt, Human
cggcgauccggcucccuuc

SEQ ID NO: 865563 - RNA, 22 nt, Human
cugaccccacccccacaggaca

SEQ ID NO: 865564 - RNA, 18 nt, Human
cugaggccagagccaacc

SEQ ID NO: 865565 - RNA, 24 nt, Human
gaacccccagggcuacccaccccc

SEQ ID NO: 865566 - RNA, 19 nt, Human
gaauguguaagggacagga

SEQ ID NO: 865567 - RNA, 22 nt, Human
gagccuuuaacuaccccagcuc

SEQ ID NO: 865568 - RNA, 23 nt, Human
gcaauagcagcagcaaaguccua

SEQ ID NO: 865569 - RNA, 20 nt, Human
gcagcugcuuggcuuccuuc

SEQ ID NO: 865570 - RNA, 19 nt, Human
gccccgggagccuuuaacu

SEQ ID NO: 865571 - RNA, 24 nt, Human
gccccgggagccuuuaacuacccc

SEQ ID NO: 865572 - RNA, 19 nt, Human
gccgcagccaccgccaccg

SEQ ID NO: 865573 - RNA, 23 nt, Human
gcuggaaccgucuucagggccca

SEQ ID NO: 865574 - RNA, 21 nt, Human
ggaacccccagggcuacccac

SEQ ID NO: 865575 - RNA, 22 nt, Human
ggacacaauguggggagaggag

SEQ ID NO: 865576 - RNA, 23 nt, Human
ggagccuuuaacuaccccagcuc

SEQ ID NO: 865577 - RNA, 20 nt, Human
ggccgccaccgccgccuccc

SEQ ID NO: 865578 - RNA, 22 nt, Human
ggccugguuccuuccuaccucu

SEQ ID NO: 865579 - RNA, 21 nt, Human
gggcgccugcgcgccgcgcgc

SEQ ID NO: 865580 - RNA, 21 nt, Human
gguaaaaaaggucgggaggag

SEQ ID NO: 865581 - RNA, 21 nt, Human
gugagggccugguuccuuccu

SEQ ID NO: 865582 - RNA, 20 nt, Human
uaagucccuaaccuccccca

SEQ ID NO: 865583 - RNA, 21 nt, Human
uacacaucaguuccugugguu

SEQ ID NO: 865584 - RNA, 18 nt, Human
uacccacccccacccugc

SEQ ID NO: 865585 - RNA, 21 nt, Human
uacccacccccacccugccuc

SEQ ID NO: 865586 - RNA, 26 nt, Human
ucagcagugcucuuaucugccccucc

SEQ ID NO: 865587 - RNA, 20 nt, Human
ucaguuccugugguucugua

SEQ ID NO: 865588 - RNA, 20 nt, Human
ugagcaacccuacccagccc

SEQ ID NO: 865589 - RNA, 21 nt, Human
ugagcaacccuacccagccca

SEQ ID NO: 865590 - RNA, 20 nt, Human
ugagggccugguuccuuccu

SEQ ID NO: 865591 - RNA, 23 nt, Human
ugaggguacugaggccagagcca

SEQ ID NO: 865592 - RNA, 19 nt, Human
ugcaauagcagcagcaaag

SEQ ID NO: 865593 - RNA, 19 nt, Human
ugcccuggaauguguaagg

SEQ ID NO: 865594 - RNA, 19 nt, Human
ugcucuuaucugccccucc

SEQ ID NO: 865595 - RNA, 19 nt, Human
uggggagaggagacugagg

SEQ ID NO: 865596 - RNA, 23 nt, Human
uguggggagaggagacugagggu

SEQ ID NO: 865597 - RNA, 19 nt, Human
uuccugugguucuguacag

SEQ ID NO: 865598 - RNA, 23 nt, Human
uuccuucuagaagccccgggagc

SEQ ID NO: 865599 - RNA, 18 nt, Human
uuuuuuuuuuuuagaguc

SEQ ID NO: 865600 - RNA, 24 nt, Human
cacccacucuccguccucuccaca

SEQ ID NO: 865601 - RNA, 21 nt, Human
cagauccagggaaagauaaag

SEQ ID NO: 865602 - RNA, 18 nt, Human
ccccacacuucgagucug

SEQ ID NO: 865603 - RNA, 22 nt, Human
ccguccucuccacaugcagauc

SEQ ID NO: 865604 - RNA, 20 nt, Human
cuggaaggacgcuggucucu

SEQ ID NO: 865605 - RNA, 21 nt, Human
gcuugugugcacccacucucc

SEQ ID NO: 865606 - RNA, 18 nt, Human
ggaaggacgcuggucucu

SEQ ID NO: 865607 - RNA, 21 nt, Human
uaccuacaacagacuccgcgg

SEQ ID NO: 865608 - RNA, 22 nt, Human
ucaacgcugaggucugaacagc

SEQ ID NO: 865609 - RNA, 23 nt, Human
ucagugugauaguagcucagauu

SEQ ID NO: 865610 - RNA, 25 nt, Human
agccggcgccggcggccugguuacc

SEQ ID NO: 865611 - RNA, 20 nt, Human
cacauggccgcgcacacgcc

SEQ ID NO: 865612 - RNA, 25 nt, Human
cacccugccuccgacucgccaggaa

SEQ ID NO: 865613 - RNA, 22 nt, Human
cccaggagaagcaguucccgcc

SEQ ID NO: 865614 - RNA, 21 nt, Human
ccgcgcacacgccucggggcc

SEQ ID NO: 865615 - RNA, 22 nt, Human
ccgcgcacacgccucggggccg

SEQ ID NO: 865616 - RNA, 24 nt, Human
ccgcgcacacgccucggggccgcg

SEQ ID NO: 865617 - RNA, 25 nt, Human
ccgggcuccaggggcucggaggguc

SEQ ID NO: 865618 - RNA, 22 nt, Human
ccugaggugggggccgggccag

SEQ ID NO: 865619 - RNA, 20 nt, Human
cgccucggggccgcgccgca

SEQ ID NO: 865620 - RNA, 21 nt, Human
cgcugugugcgcggggcuucc

SEQ ID NO: 865621 - RNA, 22 nt, Human
cucggagggucgcggccggggu

SEQ ID NO: 865622 - RNA, 22 nt, Human
cuuccugaggugggggccgggc

SEQ ID NO: 865623 - RNA, 21 nt, Human
gaggcuuccugaggugggggc

SEQ ID NO: 865624 - RNA, 23 nt, Human
gcgccgcaggcacacgccuccgc

SEQ ID NO: 865625 - RNA, 18 nt, Human
ggccgggccaggauggcu

SEQ ID NO: 865626 - RNA, 22 nt, Human
ggcggccugguuacccgggcuc

SEQ ID NO: 865627 - RNA, 21 nt, Human
gggccgggccaggauggcugc

SEQ ID NO: 865628 - RNA, 22 nt, Human
ggucucugggcgggccguggga

SEQ ID NO: 865629 - RNA, 24 nt, Human
uaagcgcacauggccgcgcacacg

SEQ ID NO: 865630 - RNA, 22 nt, Human
uacauaggugccugauggaaug

SEQ ID NO: 865631 - RNA, 18 nt, Human
uccugggcggcccaggag

SEQ ID NO: 865632 - RNA, 22 nt, Human
ucucugggcgggccgugggagg

SEQ ID NO: 865633 - RNA, 24 nt, Human
ugaaauuaagagauuuucucgguc

SEQ ID NO: 865634 - RNA, 19 nt, Human
ugagguaagagcgcgcugc

SEQ ID NO: 865635 - RNA, 20 nt, Human
ugcgcggggcuuccagggug

SEQ ID NO: 865636 - RNA, 28 nt, Human
ugcgcggggcuuccaggguggcgggucc

SEQ ID NO: 865637 - RNA, 21 nt, Human
ugcugaguuucuucaucuaca

SEQ ID NO: 865638 - RNA, 20 nt, Human
uggaaugucacagauaacuc

SEQ ID NO: 865639 - RNA, 19 nt, Human
uggccgcgcacacgccucg

SEQ ID NO: 865640 - RNA, 20 nt, Human
uggcggguccccgcgagccg

SEQ ID NO: 865641 - RNA, 20 nt, Human
uggcugcagcgcagcgacgg

SEQ ID NO: 865642 - RNA, 20 nt, Human
uuaccugggccccacccugc

SEQ ID NO: 865643 - RNA, 19 nt, Human
uucaucuacaauccgcgcu

SEQ ID NO: 865644 - RNA, 20 nt, Human
uuccaggguggcgggucccc

SEQ ID NO: 865645 - RNA, 21 nt, Human
uuccaggguggcggguccccg

SEQ ID NO: 865646 - RNA, 21 nt, Human
uuccugaggugggggccgggc

SEQ ID NO: 865647 - RNA, 21 nt, Human
uuuuuuuuuccacugaaauua

SEQ ID NO: 865648 - RNA, 21 nt, Human
uuuuuuuuuuuuuuuuccacu

SEQ ID NO: 865649 - RNA, 22 nt, Human
uuuuuuuuuuuuuuuuccacug

SEQ ID NO: 865650 - RNA, 20 nt, Human
aaagagaagccacuauaaau

SEQ ID NO: 865651 - RNA, 22 nt, Human
aacugacgauauccacagcccu

SEQ ID NO: 865652 - RNA, 18 nt, Human
acagaugacaaacuccau

SEQ ID NO: 865653 - RNA, 19 nt, Human
aggaagggaagauuucuaa

SEQ ID NO: 865654 - RNA, 23 nt, Human
aggacccaggcaugccuggccca

SEQ ID NO: 865655 - RNA, 19 nt, Human
aggcagaggcaggacccag

SEQ ID NO: 865656 - RNA, 20 nt, Human
aggcaggagucuguguuugg

SEQ ID NO: 865657 - RNA, 25 nt, Human
aggcaggagucuguguuuggggguc

SEQ ID NO: 865658 - RNA, 25 nt, Human
aggcaugccuggcccacaggaaggu

SEQ ID NO: 865659 - RNA, 19 nt, Human
aggcuggggaccacugcaa

SEQ ID NO: 865660 - RNA, 19 nt, Human
agggaaucuucucgucaug

SEQ ID NO: 865661 - RNA, 20 nt, Human
agugagacuuuuuuugagug

SEQ ID NO: 865662 - RNA, 21 nt, Human
cacagaagagagucuccacug

SEQ ID NO: 865663 - RNA, 22 nt, Human
cagaagagagucuccacuggua

SEQ ID NO: 865664 - RNA, 23 nt, Human
cagcaucggcagagggcaggcag

SEQ ID NO: 865665 - RNA, 20 nt, Human
cagcucaagaccaugggcag

SEQ ID NO: 865666 - RNA, 21 nt, Human
caucacuaaugcacuaacguc

SEQ ID NO: 865667 - RNA, 18 nt, Human
caucggcagagggcaggc

SEQ ID NO: 865668 - RNA, 18 nt, Human
cauggcuagacacucccc

SEQ ID NO: 865669 - RNA, 19 nt, Human
cauggcuagacacucccca

SEQ ID NO: 865670 - RNA, 24 nt, Human
cauuuuauucucucauucagcuca

SEQ ID NO: 865671 - RNA, 24 nt, Human
ccacagcccuauaccuaccauccg

SEQ ID NO: 865672 - RNA, 19 nt, Human
ccccugcuccuccucuucc

SEQ ID NO: 865673 - RNA, 22 nt, Human
cccugcuccuccucuucccuug

SEQ ID NO: 865674 - RNA, 20 nt, Human
ccucuuggaauacuugguca

SEQ ID NO: 865675 - RNA, 20 nt, Human
cguccucuauuacagaugac

SEQ ID NO: 865676 - RNA, 22 nt, Human
cucuuggaauacuuggucaaac

SEQ ID NO: 865677 - RNA, 22 nt, Human
gacacuccccaaugcucugcuc

SEQ ID NO: 865678 - RNA, 21 nt, Human
gaggcaggacccaggcaugcc

SEQ ID NO: 865679 - RNA, 19 nt, Human
gaugcagagggaaucuucu

SEQ ID NO: 865680 - RNA, 21 nt, Human
gcacuaacguccucuauuaca

SEQ ID NO: 865681 - RNA, 19 nt, Human
gcggcuggguaucagggcc

SEQ ID NO: 865682 - RNA, 22 nt, Human
ggacccaggcaugccuggccca

SEQ ID NO: 865683 - RNA, 20 nt, Human
ggagaucacaauagucagug

SEQ ID NO: 865684 - RNA, 25 nt, Human
ggcggcuggguaucagggccugggc

SEQ ID NO: 865685 - RNA, 21 nt, Human
gguaagcaguuuuuucaucac

SEQ ID NO: 865686 - RNA, 23 nt, Human
uaagaaagguauacaauuggcag

SEQ ID NO: 865687 - RNA, 23 nt, Human
uaaggaggguuuagaaaaagaga

SEQ ID NO: 865688 - RNA, 19 nt, Human
uagacacuccccaaugcuc

SEQ ID NO: 865689 - RNA, 20 nt, Human
uaucagggccugggcacccc

SEQ ID NO: 865690 - RNA, 23 nt, Human
ucaaucccgcuggacacacauau

SEQ ID NO: 865691 - RNA, 21 nt, Human
ucagugguaagcaguuuuuuc

SEQ ID NO: 865692 - RNA, 23 nt, Human
uccacuuucccacagagcugcca

SEQ ID NO: 865693 - RNA, 18 nt, Human
ucccacagagcugccagg

SEQ ID NO: 865694 - RNA, 20 nt, Human
ucuaggagacuaaggagggu

SEQ ID NO: 865695 - RNA, 19 nt, Human
ucuuaucuggucgucuucu

SEQ ID NO: 865696 - RNA, 22 nt, Human
ugcuccaggcuggggaccacug

SEQ ID NO: 865697 - RNA, 20 nt, Human
ugcucugcuccaggcugggg

SEQ ID NO: 865698 - RNA, 19 nt, Human
uggggucuuccacuuuccc

SEQ ID NO: 865699 - RNA, 24 nt, Human
ugggguucgccgugaugcagaggg

SEQ ID NO: 865700 - RNA, 21 nt, Human
uguaaaggagauacaaaggua

SEQ ID NO: 865701 - RNA, 23 nt, Human
uucuucacagaagagagucucca

SEQ ID NO: 865702 - RNA, 19 nt, Human
uugagugucaaucccgcug

SEQ ID NO: 865703 - RNA, 20 nt, Human
uugagugucaaucccgcugg

SEQ ID NO: 865704 - RNA, 27 nt, Human
uuucccacagagcugccaggcagaggc

SEQ ID NO: 865705 - RNA, 23 nt, Human
uuucuaggagacuaaggaggguu

SEQ ID NO: 865706 - RNA, 22 nt, Human
uuugaucucucaugauguaaag

SEQ ID NO: 865707 - RNA, 18 nt, Human
uuuuuuuuuuuuuuuugc

SEQ ID NO: 865708 - RNA, 19 nt, Human
uuuuuuuuuuuuuuuugca

SEQ ID NO: 865709 - RNA, 18 nt, Human
aacuaguuugguuuauuc

SEQ ID NO: 865710 - RNA, 23 nt, Human
aagcagcaagcagaaaaggggac

SEQ ID NO: 865711 - RNA, 23 nt, Human
agcagaaaagcaccuucauucac

SEQ ID NO: 865712 - RNA, 22 nt, Human
agugcugcaggggccaugcagg

SEQ ID NO: 865713 - RNA, 21 nt, Human
caaaaggauugacugaagcag

SEQ ID NO: 865714 - RNA, 23 nt, Human
caacuggugagugcugcaggggc

SEQ ID NO: 865715 - RNA, 22 nt, Human
ccaaaggcuggcuuuuggugcc

SEQ ID NO: 865716 - RNA, 25 nt, Human
ccagcccuuccaaaggcuggcuuuu

SEQ ID NO: 865717 - RNA, 18 nt, Human
cuggaacucuuaaagugg

SEQ ID NO: 865718 - RNA, 18 nt, Human
cuggcuuuuggugccuuu

SEQ ID NO: 865719 - RNA, 18 nt, Human
gcagcagcuucgacgugu

SEQ ID NO: 865720 - RNA, 24 nt, Human
ggaaagaagggcacaguccaccag

SEQ ID NO: 865721 - RNA, 19 nt, Human
ggaaguugcuccaccuaca

SEQ ID NO: 865722 - RNA, 21 nt, Human
ggaaguugcuccaccuacauu

SEQ ID NO: 865723 - RNA, 19 nt, Human
uaaaguggugagaucauca

SEQ ID NO: 865724 - RNA, 27 nt, Human
uauucugcauccugcauccccggauga

SEQ ID NO: 865725 - RNA, 18 nt, Human
ucuggaacucuuaaagug

SEQ ID NO: 865726 - RNA, 27 nt, Human
ugacugaagcagcaagcagaaaagcac

SEQ ID NO: 865727 - RNA, 19 nt, Human
ugagaucaucaaaaggauu

SEQ ID NO: 865728 - RNA, 20 nt, Human
ugccuuuccaaggggagggg

SEQ ID NO: 865729 - RNA, 21 nt, Human
uguugcagggaaguugcucca

SEQ ID NO: 865730 - RNA, 18 nt, Human
uucugcauccugcauccc

SEQ ID NO: 865731 - RNA, 19 nt, Human
aaacaggcaaauaaccaga

SEQ ID NO: 865732 - RNA, 19 nt, Human
acaacuuuuuucucccugu

SEQ ID NO: 865733 - RNA, 21 nt, Human
acaggcaaauaaccagauaug

SEQ ID NO: 865734 - RNA, 22 nt, Human
accuucucuauaccagcuguua

SEQ ID NO: 865735 - RNA, 23 nt, Human
acugcaaaugucaugggccacag

SEQ ID NO: 865736 - RNA, 21 nt, Human
acugcagucuccaugucucuu

SEQ ID NO: 865737 - RNA, 23 nt, Human
acugcuuccccuuucuuucuucu

SEQ ID NO: 865738 - RNA, 24 nt, Human
agaaagaaaagggcaguuuucugg

SEQ ID NO: 865739 - RNA, 24 nt, Human
agauaugcacaauacaauaugacc

SEQ ID NO: 865740 - RNA, 19 nt, Human
augaccuagguauguaugu

SEQ ID NO: 865741 - RNA, 23 nt, Human
augcacaauacaauaugaccagu

SEQ ID NO: 865742 - RNA, 18 nt, Human
caagucagauguuugucc

SEQ ID NO: 865743 - RNA, 23 nt, Human
cacaucaaaucuuuauucuaccc

SEQ ID NO: 865744 - RNA, 24 nt, Human
cacccuauuucucuccggauugcu

SEQ ID NO: 865745 - RNA, 20 nt, Human
caccuuuccaggaacaaugg

SEQ ID NO: 865746 - RNA, 21 nt, Human
cagauucugaggaaucaaagg

SEQ ID NO: 865747 - RNA, 23 nt, Human
cagugcuauaaaggaaggccaga

SEQ ID NO: 865748 - RNA, 21 nt, Human
cauagacaaggggccagacca

SEQ ID NO: 865749 - RNA, 19 nt, Human
cccaguaucuccgucccuu

SEQ ID NO: 865750 - RNA, 20 nt, Human
cccuuucuuucuucuucgcc

SEQ ID NO: 865751 - RNA, 22 nt, Human
cccuuucuuucuucuucgccuu

SEQ ID NO: 865752 - RNA, 20 nt, Human
cuaaggaaugcagaugaaaa

SEQ ID NO: 865753 - RNA, 21 nt, Human
cucaagagagagagaaucuga

SEQ ID NO: 865754 - RNA, 22 nt, Human
cuuucuuucuucuucgccuucu

SEQ ID NO: 865755 - RNA, 19 nt, Human
gggagguugaacuggcucu

SEQ ID NO: 865756 - RNA, 21 nt, Human
gggggagguugaacuggcucu

SEQ ID NO: 865757 - RNA, 22 nt, Human
guaucuccgucccuuucuucac

SEQ ID NO: 865758 - RNA, 19 nt, Human
gugucuacucccaagugac

SEQ ID NO: 865759 - RNA, 23 nt, Human
uacccauucuuccuuugaacagg

SEQ ID NO: 865760 - RNA, 19 nt, Human
uaggaugagagaaagaaaa

SEQ ID NO: 865761 - RNA, 23 nt, Human
ucagaaacaauguguuggagaca

SEQ ID NO: 865762 - RNA, 20 nt, Human
ucagcuguccaagucagaug

SEQ ID NO: 865763 - RNA, 23 nt, Human
ucauagacaaggggccagaccac

SEQ ID NO: 865764 - RNA, 24 nt, Human
ucauggaaaacaggcaaauaacca

SEQ ID NO: 865765 - RNA, 21 nt, Human
ucccccuuuaacccccucuua

SEQ ID NO: 865766 - RNA, 20 nt, Human
ucuuucuucuucgccuuccc

SEQ ID NO: 865767 - RNA, 21 nt, Human
ugaccagugcuauaaaggaag

SEQ ID NO: 865768 - RNA, 18 nt, Human
ugaccuagguauguaugu

SEQ ID NO: 865769 - RNA, 19 nt, Human
ugagagaaagaaaagggca

SEQ ID NO: 865770 - RNA, 20 nt, Human
uggaaaacaggcaaauaacc

SEQ ID NO: 865771 - RNA, 21 nt, Human
uggaaaugugaugugagcuga

SEQ ID NO: 865772 - RNA, 19 nt, Human
ugggaauguuucccucuga

SEQ ID NO: 865773 - RNA, 23 nt, Human
uggguagggaagaagcagcauuu

SEQ ID NO: 865774 - RNA, 23 nt, Human
ugguagggaucaccuuuccagga

SEQ ID NO: 865775 - RNA, 23 nt, Human
uguuucccucugaaggcuuggga

SEQ ID NO: 865776 - RNA, 19 nt, Human
uuuuuuuuuuuuuuugugu

SEQ ID NO: 865777 - RNA, 21 nt, Human
agcaugggcaccagccucacu

SEQ ID NO: 865778 - RNA, 19 nt, Human
auguggaguugauguggag

SEQ ID NO: 865779 - RNA, 23 nt, Human
auuuuauuauacaaaacuagauu

SEQ ID NO: 865780 - RNA, 21 nt, Human
ccuuggaugucagcuuggccc

SEQ ID NO: 865781 - RNA, 22 nt, Human
cgaggcgcuuggcggggucuac

SEQ ID NO: 865782 - RNA, 23 nt, Human
cggaacagaacacuccccacugg

SEQ ID NO: 865783 - RNA, 20 nt, Human
cggccaggauaugccggaac

SEQ ID NO: 865784 - RNA, 18 nt, Human
cugauuccacucaucagu

SEQ ID NO: 865785 - RNA, 19 nt, Human
gcgcauguggaguugaugu

SEQ ID NO: 865786 - RNA, 22 nt, Human
ggaguuguagcugacuggcugg

SEQ ID NO: 865787 - RNA, 21 nt, Human
ggccacagcuaguaaauuacc

SEQ ID NO: 865788 - RNA, 19 nt, Human
gguggggucagccuggccu

SEQ ID NO: 865789 - RNA, 20 nt, Human
guggagcaugggcaccagcc

SEQ ID NO: 865790 - RNA, 18 nt, Human
ugaaaagaaguuuauugc

SEQ ID NO: 865791 - RNA, 22 nt, Human
ugccggaacagaacacucccca

SEQ ID NO: 865792 - RNA, 21 nt, Human
uggccccucaaggggucccuc

SEQ ID NO: 865793 - RNA, 22 nt, Human
uuggcggggucuaccagccgcu

SEQ ID NO: 865794 - RNA, 24 nt, Human
uuuguaguugcugaaaagaaguuu

SEQ ID NO: 865795 - RNA, 21 nt, Human
uuuuuuuuuuuuuuuuguagu

SEQ ID NO: 865796 - RNA, 22 nt, Human
aaucguucccuccguguccccg

SEQ ID NO: 865797 - RNA, 20 nt, Human
caacagguguggugccuggg

SEQ ID NO: 865798 - RNA, 18 nt, Human
cacugcaaccucugccuc

SEQ ID NO: 865799 - RNA, 21 nt, Human
cacugcaaccucugccuccca

SEQ ID NO: 865800 - RNA, 21 nt, Human
caguuggguuuucccagauuu

SEQ ID NO: 865801 - RNA, 22 nt, Human
ccagguucaagcgaucccccuc

SEQ ID NO: 865802 - RNA, 20 nt, Human
cccagguucaagcgaucccc

SEQ ID NO: 865803 - RNA, 19 nt, Human
ccggcguuguacucuuucc

SEQ ID NO: 865804 - RNA, 21 nt, Human
ccucccagguucaagcgaucc

SEQ ID NO: 865805 - RNA, 22 nt, Human
ccuuuuccuuuuggaagauccc

SEQ ID NO: 865806 - RNA, 19 nt, Human
cgacuggucaccuuuuccu

SEQ ID NO: 865807 - RNA, 24 nt, Human
cgcucugucacccaggcuggguug

SEQ ID NO: 865808 - RNA, 20 nt, Human
cggcguuguacucuuuccca

SEQ ID NO: 865809 - RNA, 23 nt, Human
cucugucacccaggcuggguugc

SEQ ID NO: 865810 - RNA, 23 nt, Human
cugcaaccucugccucccagguu

SEQ ID NO: 865811 - RNA, 24 nt, Human
cugcaaccucugccucccagguuc

SEQ ID NO: 865812 - RNA, 19 nt, Human
gacuggucaccuuuuccuu

SEQ ID NO: 865813 - RNA, 22 nt, Human
gaucucuguucacugcaaccuc

SEQ ID NO: 865814 - RNA, 22 nt, Human
gcaaccucugccucccagguuc

SEQ ID NO: 865815 - RNA, 21 nt, Human
gucacccaggcuggguugcag

SEQ ID NO: 865816 - RNA, 22 nt, Human
gucaccuuuuccuuuuggaaga

SEQ ID NO: 865817 - RNA, 20 nt, Human
gucuccagcagaucucagcc

SEQ ID NO: 865818 - RNA, 21 nt, Human
guugcaguggcgcgaucucug

SEQ ID NO: 865819 - RNA, 27 nt, Human
uauuuuuuuucuuuuuauauuuugaga

SEQ ID NO: 865820 - RNA, 25 nt, Human
ucaccuuuuccuuuuggaagauccc

SEQ ID NO: 865821 - RNA, 19 nt, Human
ucacugcaaccucugccuc

SEQ ID NO: 865822 - RNA, 23 nt, Human
ucacugcaaccucugccucccag

SEQ ID NO: 865823 - RNA, 24 nt, Human
ucacugcaaccucugccucccagg

SEQ ID NO: 865824 - RNA, 25 nt, Human
ucacugcaaccucugccucccaggu

SEQ ID NO: 865825 - RNA, 25 nt, Human
ucagaugaucaacaauccauguuag

SEQ ID NO: 865826 - RNA, 18 nt, Human
ucccagauuucucgacug

SEQ ID NO: 865827 - RNA, 18 nt, Human
ucccagguucaagcgauc

SEQ ID NO: 865828 - RNA, 23 nt, Human
ucgcucugucacccaggcugggu

SEQ ID NO: 865829 - RNA, 19 nt, Human
ucucgcucugucacccagg

SEQ ID NO: 865830 - RNA, 22 nt, Human
ucucgcucugucacccaggcug

SEQ ID NO: 865831 - RNA, 23 nt, Human
ucucgcucugucacccaggcugg

SEQ ID NO: 865832 - RNA, 23 nt, Human
ucucgcucugucacccaggcugg

SEQ ID NO: 865833 - RNA, 24 nt, Human
ucucgcucugucacccaggcuggg

SEQ ID NO: 865834 - RNA, 26 nt, Human
ucucgcucugucacccaggcuggguu

SEQ ID NO: 865835 - RNA, 27 nt, Human
ucucgcucugucacccaggcuggguug

SEQ ID NO: 865836 - RNA, 24 nt, Human
ucugucacccaggcuggguugcag

SEQ ID NO: 865837 - RNA, 18 nt, Human
ugagacaaagucucgcuc

SEQ ID NO: 865838 - RNA, 22 nt, Human
ugagacaaagucucgcucuguc

SEQ ID NO: 865839 - RNA, 24 nt, Human
ugccucccagguucaagcgauccc

SEQ ID NO: 865840 - RNA, 19 nt, Human
uggguugcaguggcgcgau

SEQ ID NO: 865841 - RNA, 19 nt, Human
uucaagcgaucccccuccg

SEQ ID NO: 865842 - RNA, 20 nt, Human
uuuuuuuuuuuuuuguucca

SEQ ID NO: 865843 - RNA, 20 nt, Human
uuuuuuuuuuuuuuguucca

SEQ ID NO: 865844 - RNA, 19 nt, Human
uuuuuuuuuuuuuuuuguu

SEQ ID NO: 865845 - RNA, 18 nt, Human
accacggaaggaaagaca

SEQ ID NO: 865846 - RNA, 24 nt, Human
cggaaggaaagacagaauuuucau

SEQ ID NO: 865847 - RNA, 23 nt, Human
uugcaaauugauccacacucaau

SEQ ID NO: 865848 - RNA, 22 nt, Human
uuuuuuuuuuuuuuuugcaaau

SEQ ID NO: 865849 - RNA, 25 nt, Human
uuuuuuuuuuuuuuuugcaaauuga

SEQ ID NO: 865850 - RNA, 23 nt, Human
aaaacauuacaccucuggccccc

SEQ ID NO: 865851 - RNA, 20 nt, Human
aaacaagucugaaacccaga

SEQ ID NO: 865852 - RNA, 23 nt, Human
aaacaagucugaaacccagaaag

SEQ ID NO: 865853 - RNA, 23 nt, Human
aaaugucuauucaaguccuuucc

SEQ ID NO: 865854 - RNA, 24 nt, Human
aacuccaaagugucaucucaauau

SEQ ID NO: 865855 - RNA, 20 nt, Human
aagcaaacugaagacuuucc

SEQ ID NO: 865856 - RNA, 22 nt, Human
aagcaaacugaagacuuuccau

SEQ ID NO: 865857 - RNA, 19 nt, Human
aaggccucaaaagucucag

SEQ ID NO: 865858 - RNA, 20 nt, Human
aagugagaaacaggagaaag

SEQ ID NO: 865859 - RNA, 18 nt, Human
acuuguagaccuguccuc

SEQ ID NO: 865860 - RNA, 21 nt, Human
agaaagcaaacugaagacuuu

SEQ ID NO: 865861 - RNA, 24 nt, Human
agaccggaacccaaacgcagcgga

SEQ ID NO: 865862 - RNA, 20 nt, Human
aucacauugugggggagagg

SEQ ID NO: 865863 - RNA, 21 nt, Human
auugugggggagagggggggc

SEQ ID NO: 865864 - RNA, 20 nt, Human
auuucuuguuuuccaucuuu

SEQ ID NO: 865865 - RNA, 20 nt, Human
caaaauccaugucaucacau

SEQ ID NO: 865866 - RNA, 24 nt, Human
caagucugaaacccagaaagcaaa

SEQ ID NO: 865867 - RNA, 19 nt, Human
caauccuaaaaaccaccag

SEQ ID NO: 865868 - RNA, 19 nt, Human
caauguucuccaacauucc

SEQ ID NO: 865869 - RNA, 24 nt, Human
cacauguaaaauauauucaucuca

SEQ ID NO: 865870 - RNA, 24 nt, Human
caccagagacagggccuccaaaua

SEQ ID NO: 865871 - RNA, 23 nt, Human
caccggggccacuggagaagcgg

SEQ ID NO: 865872 - RNA, 21 nt, Human
caccucuggcccccaaaaucc

SEQ ID NO: 865873 - RNA, 24 nt, Human
cagaaagcaaacugaagacuuucc

SEQ ID NO: 865874 - RNA, 24 nt, Human
caucacauguaaaauauauucauc

SEQ ID NO: 865875 - RNA, 27 nt, Human
caucccaaaggccucaaaagguccuuc

SEQ ID NO: 865876 - RNA, 22 nt, Human
caugauguccuccaauccuaaa

SEQ ID NO: 865877 - RNA, 18 nt, Human
cauucccagugauagugc

SEQ ID NO: 865878 - RNA, 18 nt, Human
ccaaaagugagaaacagg

SEQ ID NO: 865879 - RNA, 24 nt, Human
ccuggcuuccagggugucccgggg

SEQ ID NO: 865880 - RNA, 22 nt, Human
cgcagcggacacgaaacccgcu

SEQ ID NO: 865881 - RNA, 19 nt, Human
cgguggagccaccggggcc

SEQ ID NO: 865882 - RNA, 20 nt, Human
cucaucccaaaggccucaaa

SEQ ID NO: 865883 - RNA, 23 nt, Human
cuccaacauuccacauccuugac

SEQ ID NO: 865884 - RNA, 19 nt, Human
cucccaaacaagucugaaa

SEQ ID NO: 865885 - RNA, 21 nt, Human
cucccaaacaagucugaaacc

SEQ ID NO: 865886 - RNA, 22 nt, Human
cucccaaacaagucugaaaccc

SEQ ID NO: 865887 - RNA, 19 nt, Human
cugagguggcauacacuca

SEQ ID NO: 865888 - RNA, 21 nt, Human
cuuguuuuccaucuuugauac

SEQ ID NO: 865889 - RNA, 26 nt, Human
gauuccuauuccaaaagugagaaaca

SEQ ID NO: 865890 - RNA, 18 nt, Human
gcacaauguucuccaaca

SEQ ID NO: 865891 - RNA, 19 nt, Human
gcuaucuucucacugcacc

SEQ ID NO: 865892 - RNA, 20 nt, Human
gcugcgguggagccaccggg

SEQ ID NO: 865893 - RNA, 21 nt, Human
ggaaguccaauaucaaggcac

SEQ ID NO: 865894 - RNA, 18 nt, Human
ggagaagcggagaccgga

SEQ ID NO: 865895 - RNA, 25 nt, Human
ggagaagcggagaccggaacccaaa

SEQ ID NO: 865896 - RNA, 20 nt, Human
ggggagagggggggcacggg

SEQ ID NO: 865897 - RNA, 23 nt, Human
ggggagagggggggcacgggggu

SEQ ID NO: 865898 - RNA, 18 nt, Human
ggguugcuaaaacaaaau

SEQ ID NO: 865899 - RNA, 21 nt, Human
gugaaaaccaaacuagucaug

SEQ ID NO: 865900 - RNA, 22 nt, Human
uaagggccugcuucccgguuca

SEQ ID NO: 865901 - RNA, 24 nt, Human
uauucaaguccuuuccuccauuuu

SEQ ID NO: 865902 - RNA, 20 nt, Human
ucaacauaugaaucugaggu

SEQ ID NO: 865903 - RNA, 20 nt, Human
ucaauaucacaucacucaga

SEQ ID NO: 865904 - RNA, 19 nt, Human
uccaaaagugagaaacagg

SEQ ID NO: 865905 - RNA, 23 nt, Human
uccaaaagugagaaacaggagaa

SEQ ID NO: 865906 - RNA, 23 nt, Human
ucccaaacaagucugaaacccag

SEQ ID NO: 865907 - RNA, 26 nt, Human
ucccagugauagugcacaagguaccc

SEQ ID NO: 865908 - RNA, 20 nt, Human
uccggccugugcagguccca

SEQ ID NO: 865909 - RNA, 25 nt, Human
ucuauucaaguccuuuccuccauuu

SEQ ID NO: 865910 - RNA, 18 nt, Human
ucucaguuaauuccagca

SEQ ID NO: 865911 - RNA, 22 nt, Human
ucugaaacccagaaagcaaacu

SEQ ID NO: 865912 - RNA, 23 nt, Human
ugaaaaccaaacuagucauguau

SEQ ID NO: 865913 - RNA, 23 nt, Human
ugagaaacaggagaaagggguga

SEQ ID NO: 865914 - RNA, 22 nt, Human
ugauguccuccaauccuaaaaa

SEQ ID NO: 865915 - RNA, 20 nt, Human
ugcgguggagccaccggggc

SEQ ID NO: 865916 - RNA, 24 nt, Human
ugcuaaaacaaaauaccauaaauu

SEQ ID NO: 865917 - RNA, 23 nt, Human
ugcugaggcaaaauucuucuuca

SEQ ID NO: 865918 - RNA, 18 nt, Human
uggagaaaugucuauuca

SEQ ID NO: 865919 - RNA, 18 nt, Human
uggagccaccggggccac

SEQ ID NO: 865920 - RNA, 19 nt, Human
uggcauacacucagccaaa

SEQ ID NO: 865921 - RNA, 19 nt, Human
uggcuuccagggugucccu

SEQ ID NO: 865922 - RNA, 19 nt, Human
ugguaagggccugcuuccc

SEQ ID NO: 865923 - RNA, 20 nt, Human
ugguaagggccugcuucccg

SEQ ID NO: 865924 - RNA, 22 nt, Human
ugguaagggccugcuucccggu

SEQ ID NO: 865925 - RNA, 21 nt, Human
uugaguuugauuuguauuucc

SEQ ID NO: 865926 - RNA, 22 nt, Human
uuucuuguuuuccaucuuugau

SEQ ID NO: 865927 - RNA, 20 nt, Human
uuuggagaaaugucuauuca

SEQ ID NO: 865928 - RNA, 24 nt, Human
aaaaaaccaugcaaaacuagccua

SEQ ID NO: 865929 - RNA, 19 nt, Human
aacaacaaaaagaaugccu

SEQ ID NO: 865930 - RNA, 18 nt, Human
aagaagccaggcacaaag

SEQ ID NO: 865931 - RNA, 21 nt, Human
aaugccuacccuaccccaagc

SEQ ID NO: 865932 - RNA, 24 nt, Human
acagaagaugaguagaaccaagaa

SEQ ID NO: 865933 - RNA, 18 nt, Human
acugagggaggugucaag

SEQ ID NO: 865934 - RNA, 19 nt, Human
agaaacaugagagggcguc

SEQ ID NO: 865935 - RNA, 22 nt, Human
agaagaaacaugagagggcguc

SEQ ID NO: 865936 - RNA, 24 nt, Human
agaauuccuccacauuccaauccc

SEQ ID NO: 865937 - RNA, 20 nt, Human
agcaaauagaaaaugauacu

SEQ ID NO: 865938 - RNA, 21 nt, Human
agcaauaaacaacaaaaagaa

SEQ ID NO: 865939 - RNA, 21 nt, Human
agggcgucugggugcuggcaa

SEQ ID NO: 865940 - RNA, 24 nt, Human
auguggauaaauacauuaugguau

SEQ ID NO: 865941 - RNA, 21 nt, Human
auguuugucauguuucacaau

SEQ ID NO: 865942 - RNA, 20 nt, Human
auuucauuuacugagagugg

SEQ ID NO: 865943 - RNA, 27 nt, Human
auuucauuuacugagaguggagaacaa

SEQ ID NO: 865944 - RNA, 20 nt, Human
caacaaaaagaaugccuacc

SEQ ID NO: 865945 - RNA, 25 nt, Human
caacagcacuuugaacaacuucuaa

SEQ ID NO: 865946 - RNA, 21 nt, Human
caagaaagcuaauagguggca

SEQ ID NO: 865947 - RNA, 22 nt, Human
cacggcaaaaccauaggagaag

SEQ ID NO: 865948 - RNA, 24 nt, Human
cagugguuaccuuuguguggagag

SEQ ID NO: 865949 - RNA, 22 nt, Human
cauuccagauuugaccugguug

SEQ ID NO: 865950 - RNA, 27 nt, Human
ccacauugccccuucuagaauuccucc

SEQ ID NO: 865951 - RNA, 22 nt, Human
cccgggagccucuacccgaccu

SEQ ID NO: 865952 - RNA, 18 nt, Human
cccuucgcuuccucucuc

SEQ ID NO: 865953 - RNA, 23 nt, Human
cgcuuccucucucggcagcacgc

SEQ ID NO: 865954 - RNA, 18 nt, Human
cuacagcuacauucaaua

SEQ ID NO: 865955 - RNA, 20 nt, Human
cuuccacggcaaaaccauag

SEQ ID NO: 865956 - RNA, 19 nt, Human
gaaacccaggggacagaag

SEQ ID NO: 865957 - RNA, 24 nt, Human
gaaagaagccaggcacaaagaaga

SEQ ID NO: 865958 - RNA, 18 nt, Human
gaaccaagaaagcuaaua

SEQ ID NO: 865959 - RNA, 19 nt, Human
gagagggcgucugggugcu

SEQ ID NO: 865960 - RNA, 22 nt, Human
gagagugagccaggagaaguga

SEQ ID NO: 865961 - RNA, 23 nt, Human
gagcuuuugggaagcagggaggg

SEQ ID NO: 865962 - RNA, 24 nt, Human
gagggcgucugggugcuggcaaca

SEQ ID NO: 865963 - RNA, 23 nt, Human
gcagggagggacucuggucugga

SEQ ID NO: 865964 - RNA, 25 nt, Human
gcuuuugggaagcagggagggacuc

SEQ ID NO: 865965 - RNA, 23 nt, Human
ggaagcagcaauaaacaacaaaa

SEQ ID NO: 865966 - RNA, 25 nt, Human
ggacagaagaugaguagaaccaaga

SEQ ID NO: 865967 - RNA, 20 nt, Human
gggagagugagagugagcca

SEQ ID NO: 865968 - RNA, 21 nt, Human
uaaaauucaaaaaaaccaugc

SEQ ID NO: 865969 - RNA, 23 nt, Human
uaagcuaaaaauaauuucauuua

SEQ ID NO: 865970 - RNA, 20 nt, Human
uaccccaagcccaguggaac

SEQ ID NO: 865971 - RNA, 20 nt, Human
uaccuuuguguggagaguga

SEQ ID NO: 865972 - RNA, 24 nt, Human
uagacauagauagauagauagaua

SEQ ID NO: 865973 - RNA, 22 nt, Human
uagauagauagauagacagaua

SEQ ID NO: 865974 - RNA, 22 nt, Human
uagauagauagauagauagaca

SEQ ID NO: 865975 - RNA, 22 nt, Human
uagauagauagauagauagaua

SEQ ID NO: 865976 - RNA, 22 nt, Human
uagauagauagauagauagaua

SEQ ID NO: 865977 - RNA, 22 nt, Human
uagauagauagauagauagaua

SEQ ID NO: 865978 - RNA, 22 nt, Human
uagauagauagauagauagaua

SEQ ID NO: 865979 - RNA, 22 nt, Human
uagauagauagauagauagaua

SEQ ID NO: 865980 - RNA, 22 nt, Human
uagauagauagauagauagaua

SEQ ID NO: 865981 - RNA, 19 nt, Human
uaggagaaguauggaagug

SEQ ID NO: 865982 - RNA, 22 nt, Human
uaucccaaauaugcuuguuuca

SEQ ID NO: 865983 - RNA, 19 nt, Human
ucaaaaaaaccaugcaaaa

SEQ ID NO: 865984 - RNA, 20 nt, Human
ucaagguguugggaggauca

SEQ ID NO: 865985 - RNA, 22 nt, Human
uccacggcaaaaccauaggaga

SEQ ID NO: 865986 - RNA, 18 nt, Human
ucuaagcuaaaaauaauu

SEQ ID NO: 865987 - RNA, 25 nt, Human
ucucucggcagcacgcaggucccgg

SEQ ID NO: 865988 - RNA, 19 nt, Human
ucuggucuggaagcagcaa

SEQ ID NO: 865989 - RNA, 19 nt, Human
ugaaaaaguuaaaagcaaa

SEQ ID NO: 865990 - RNA, 25 nt, Human
ugaaagaagccaggcacaaagaaga

SEQ ID NO: 865991 - RNA, 19 nt, Human
ugaauaaacuacagcuaca

SEQ ID NO: 865992 - RNA, 23 nt, Human
ugaauaaacuacagcuacauuca

SEQ ID NO: 865993 - RNA, 19 nt, Human
ugaaugccauaaaauucug

SEQ ID NO: 865994 - RNA, 20 nt, Human
ugaaugccauaaaauucugg

SEQ ID NO: 865995 - RNA, 23 nt, Human
ugaccugguuggugguuacaugg

SEQ ID NO: 865996 - RNA, 21 nt, Human
ugagccaggagaagugaaacc

SEQ ID NO: 865997 - RNA, 18 nt, Human
ugaucuugugccauuccu

SEQ ID NO: 865998 - RNA, 18 nt, Human
ugccauaaaauucugggc

SEQ ID NO: 865999 - RNA, 18 nt, Human
ugccauuccuucuugcau

SEQ ID NO: 866000 - RNA, 23 nt, Human
uggaacaauuauucaauuaaaac

SEQ ID NO: 866001 - RNA, 24 nt, Human
uggaagcagcaauaaacaacaaaa

SEQ ID NO: 866002 - RNA, 18 nt, Human
uggagagugaggagacug

SEQ ID NO: 866003 - RNA, 21 nt, Human
uggcaacauuccagauuugac

SEQ ID NO: 866004 - RNA, 22 nt, Human
ugggaggaucaucuuuguaaua

SEQ ID NO: 866005 - RNA, 20 nt, Human
ugggcagugguuaccuuugu

SEQ ID NO: 866006 - RNA, 18 nt, Human
ugucuaagcuaaaaauaa

SEQ ID NO: 866007 - RNA, 19 nt, Human
uguggauaaauacauuaug

SEQ ID NO: 866008 - RNA, 23 nt, Human
uuaaaagcaaauagaaaaugaua

SEQ ID NO: 866009 - RNA, 21 nt, Human
uuacugagggaggugucaagg

SEQ ID NO: 866010 - RNA, 19 nt, Human
uucugggcagugguuaccu

SEQ ID NO: 866011 - RNA, 24 nt, Human
uucugggcagugguuaccuuugug

SEQ ID NO: 866012 - RNA, 18 nt, Human
uugggaggaucaucuuug

SEQ ID NO: 866013 - RNA, 19 nt, Human
uuuguaauacugaaaucac

SEQ ID NO: 866014 - RNA, 18 nt, Human
uuugucauguuucacaau

SEQ ID NO: 866015 - RNA, 20 nt, Human
uuuuuuuuuuuuuuuuguuu

SEQ ID NO: 866016 - RNA, 25 nt, Human
aagacagcuccaccagccacaaaua

SEQ ID NO: 866017 - RNA, 24 nt, Human
ccccgagagagagacggagagaag

SEQ ID NO: 866018 - RNA, 23 nt, Human
gagagagacggagagaagguaac

SEQ ID NO: 866019 - RNA, 23 nt, Human
gguaacugcccaucucccuacag

SEQ ID NO: 866020 - RNA, 24 nt, Human
guucucuucguuuaagacagcucc

SEQ ID NO: 866021 - RNA, 18 nt, Human
uccaccagccacaaauag

SEQ ID NO: 866022 - RNA, 19 nt, Human
uccccgagagagagacgga

SEQ ID NO: 866023 - RNA, 20 nt, Human
ucccugggcgguuguagccc

SEQ ID NO: 866024 - RNA, 23 nt, Human
ugggcgguuguagcccuggcucc

SEQ ID NO: 866025 - RNA, 23 nt, Human
uuuuuuuuuuuucuuuuggaguu

SEQ ID NO: 866026 - RNA, 28 nt, Human
uuuuuuuuuuuuuuuucuuuuggaguug

SEQ ID NO: 866027 - RNA, 25 nt, Human
uuuuuuuuuuuuuuuucuuuugggg

SEQ ID NO: 866028 - RNA, 26 nt, Human
aaaaaaaaaaaacauaaaugacuagg

SEQ ID NO: 866029 - RNA, 21 nt, Human
aaauaccuuuuuaaaaccaaa

SEQ ID NO: 866030 - RNA, 27 nt, Human
aagcauaacuauaaaaugcuuaaauac

SEQ ID NO: 866031 - RNA, 19 nt, Human
acaaagaauaucaaaaaca

SEQ ID NO: 866032 - RNA, 21 nt, Human
aggggaccagucggucagagc

SEQ ID NO: 866033 - RNA, 19 nt, Human
aguagaagaaaauccuaga

SEQ ID NO: 866034 - RNA, 23 nt, Human
auaucaaaaacacaaagcauaac

SEQ ID NO: 866035 - RNA, 21 nt, Human
caaaaacacaaagcauaacua

SEQ ID NO: 866036 - RNA, 22 nt, Human
caacauuaaaaacccauaacac

SEQ ID NO: 866037 - RNA, 20 nt, Human
caagagaaaccacugaauag

SEQ ID NO: 866038 - RNA, 20 nt, Human
ccaguacagauagugauccu

SEQ ID NO: 866039 - RNA, 20 nt, Human
ccgauucuaaaauaaaacaa

SEQ ID NO: 866040 - RNA, 18 nt, Human
cuucaaauguugguccua

SEQ ID NO: 866041 - RNA, 20 nt, Human
gccaccguuuaggggaccag

SEQ ID NO: 866042 - RNA, 25 nt, Human
uaaaucccggggcccaacgaccaaa

SEQ ID NO: 866043 - RNA, 24 nt, Human
uaacaauacaaagaauaucaaaaa

SEQ ID NO: 866044 - RNA, 19 nt, Human
uaugcaaaaaaaaaaaaaa

SEQ ID NO: 866045 - RNA, 30 nt, Human
uaugcaaacccgauucuaaaauaaaacaaa

SEQ ID NO: 866046 - RNA, 18 nt, Human
ucccggggcccaacgacc

SEQ ID NO: 866047 - RNA, 25 nt, Human
ugcaaguuuucauacuacaaauuua

SEQ ID NO: 866048 - RNA, 21 nt, Human
ugguccuaaaucccggggccc

SEQ ID NO: 866049 - RNA, 20 nt, Human
uuaugcaaaaaaaaaaaaaa

SEQ ID NO: 866050 - RNA, 25 nt, Human
uuuaguaaaauuaugcaaaaaaaaa

SEQ ID NO: 866051 - RNA, 21 nt, Human
uuuuuuuuuuuuagaagcauc

SEQ ID NO: 866052 - RNA, 20 nt, Human
cagcggggcagcuccaaccc

SEQ ID NO: 866053 - RNA, 18 nt, Human
ccugccgcccaccagggc

SEQ ID NO: 866054 - RNA, 23 nt, Human
gacuguguguggucagccgguug

SEQ ID NO: 866055 - RNA, 19 nt, Human
ggacuggggggaagcaccg

SEQ ID NO: 866056 - RNA, 18 nt, Human
aagacauuacauauuuag

SEQ ID NO: 866057 - RNA, 19 nt, Human
acacaagugcaaagaccaa

SEQ ID NO: 866058 - RNA, 23 nt, Human
accaaucauaaccucaguucuua

SEQ ID NO: 866059 - RNA, 18 nt, Human
acgccaggaccgacagga

SEQ ID NO: 866060 - RNA, 20 nt, Human
agcaaauaaugaaugaacaa

SEQ ID NO: 866061 - RNA, 18 nt, Human
agugcaaagaccaagaaa

SEQ ID NO: 866062 - RNA, 23 nt, Human
auacaccacuacaaucgugcaaa

SEQ ID NO: 866063 - RNA, 20 nt, Human
auucaggaggccaacuuaau

SEQ ID NO: 866064 - RNA, 20 nt, Human
caauauuaagagauuaucga

SEQ ID NO: 866065 - RNA, 22 nt, Human
caccacuacaaucgugcaaaaa

SEQ ID NO: 866066 - RNA, 18 nt, Human
cacuaguaguuuucuagc

SEQ ID NO: 866067 - RNA, 23 nt, Human
cacuuucaacaccaagucaaagg

SEQ ID NO: 866068 - RNA, 20 nt, Human
cagcaaauaaugaaugaaca

SEQ ID NO: 866069 - RNA, 22 nt, Human
ccucuucauuuucagaggcaug

SEQ ID NO: 866070 - RNA, 23 nt, Human
cuggacuguccucuucauuuuca

SEQ ID NO: 866071 - RNA, 20 nt, Human
ggcaaaauaagcuaauucca

SEQ ID NO: 866072 - RNA, 21 nt, Human
uaagagauuaucgaggccaaa

SEQ ID NO: 866073 - RNA, 23 nt, Human
uacuauucagaaggaaagacagg

SEQ ID NO: 866074 - RNA, 20 nt, Human
uaucagacacaagugcaaag

SEQ ID NO: 866075 - RNA, 23 nt, Human
ucaggaggccaacuuaaugccuu

SEQ ID NO: 866076 - RNA, 24 nt, Human
ucaggaggccaacuuaaugccuug

SEQ ID NO: 866077 - RNA, 20 nt, Human
uccugcaguccaugguuaca

SEQ ID NO: 866078 - RNA, 23 nt, Human
uuaauauuuagaacagugccuaa

SEQ ID NO: 866079 - RNA, 19 nt, Human
uuaaugcaaaaugcgaauc

SEQ ID NO: 866080 - RNA, 22 nt, Human
uucagaaggaaagacaggaaga

SEQ ID NO: 866081 - RNA, 18 nt, Human
aagcccccaacauacccc

SEQ ID NO: 866082 - RNA, 19 nt, Human
aaggcaggcgcggggagcc

SEQ ID NO: 866083 - RNA, 18 nt, Human
acaccccccaaccuuccc

SEQ ID NO: 866084 - RNA, 26 nt, Human
agacaccccccaaccuuccccccacc

SEQ ID NO: 866085 - RNA, 21 nt, Human
agcaaauggccggggcucccu

SEQ ID NO: 866086 - RNA, 21 nt, Human
agcaggagcaggugagggcaa

SEQ ID NO: 866087 - RNA, 21 nt, Human
aggaaggggcugaggggggcg

SEQ ID NO: 866088 - RNA, 23 nt, Human
aggcacggagguagcgauagacc

SEQ ID NO: 866089 - RNA, 24 nt, Human
aggcaggcgcggggagccuggcuu

SEQ ID NO: 866090 - RNA, 23 nt, Human
aggcuggggcagggguggggagg

SEQ ID NO: 866091 - RNA, 21 nt, Human
agggcagucucuggggagugc

SEQ ID NO: 866092 - RNA, 21 nt, Human
agggcucagaucccugggggu

SEQ ID NO: 866093 - RNA, 18 nt, Human
aggggagggagcucccca

SEQ ID NO: 866094 - RNA, 21 nt, Human
augccuccagacaccccccaa

SEQ ID NO: 866095 - RNA, 22 nt, Human
caagggcuccuucuggaggucc

SEQ ID NO: 866096 - RNA, 23 nt, Human
cacacccggccucccugagaccc

SEQ ID NO: 866097 - RNA, 25 nt, Human
caccaugagaaagaugaggucaacu

SEQ ID NO: 866098 - RNA, 18 nt, Human
caccccaauagcaccagg

SEQ ID NO: 866099 - RNA, 19 nt, Human
caccccccaaccuuccccc

SEQ ID NO: 866100 - RNA, 23 nt, Human
caccccccaaccuuccccccacc

SEQ ID NO: 866101 - RNA, 18 nt, Human
cacccccuacaucaguuc

SEQ ID NO: 866102 - RNA, 26 nt, Human
cacccccuacaucaguuccaccucgu

SEQ ID NO: 866103 - RNA, 21 nt, Human
cacccggccucccugagaccc

SEQ ID NO: 866104 - RNA, 18 nt, Human
cagacaccccccaaccuu

SEQ ID NO: 866105 - RNA, 25 nt, Human
cagcucccucccagagguccaaggg

SEQ ID NO: 866106 - RNA, 21 nt, Human
caggaaggcacggagguagcg

SEQ ID NO: 866107 - RNA, 18 nt, Human
cagggcucagaucccugg

SEQ ID NO: 866108 - RNA, 24 nt, Human
caguuccaccuccuccugaggccu

SEQ ID NO: 866109 - RNA, 24 nt, Human
caugccuccagacaccccccaacc

SEQ ID NO: 866110 - RNA, 21 nt, Human
ccaauagcaccaggauagcac

SEQ ID NO: 866111 - RNA, 23 nt, Human
cccagagguccaagggcuccuuc

SEQ ID NO: 866112 - RNA, 18 nt, Human
ccccaacauaccccuuuc

SEQ ID NO: 866113 - RNA, 24 nt, Human
ccccaauagcaccaggauagcacc

SEQ ID NO: 866114 - RNA, 24 nt, Human
ccccaccgcagacagcugcagagc

SEQ ID NO: 866115 - RNA, 23 nt, Human
cccccaaccuuccccccaccgca

SEQ ID NO: 866116 - RNA, 22 nt, Human
cccccaccgcagacagcugcag

SEQ ID NO: 866117 - RNA, 19 nt, Human
ccccccaaccuucccccca

SEQ ID NO: 866118 - RNA, 18 nt, Human
ccccccaccgcagacagc

SEQ ID NO: 866119 - RNA, 22 nt, Human
cccuggggguguccaaaccaac

SEQ ID NO: 866120 - RNA, 24 nt, Human
cccuuucuggugugggggagggga

SEQ ID NO: 866121 - RNA, 21 nt, Human
ccuccagacaccccccaaccu

SEQ ID NO: 866122 - RNA, 20 nt, Human
ccucccugagacccacgggg

SEQ ID NO: 866123 - RNA, 21 nt, Human
ccucuggcagagagcaggagc

SEQ ID NO: 866124 - RNA, 25 nt, Human
cgagguagggguccaggacgaggcu

SEQ ID NO: 866125 - RNA, 22 nt, Human
cggauggcuccugcaguccuga

SEQ ID NO: 866126 - RNA, 19 nt, Human
cucccugcugggccucccc

SEQ ID NO: 866127 - RNA, 19 nt, Human
cucccugugggaguggggg

SEQ ID NO: 866128 - RNA, 22 nt, Human
cugccccuuauggcuuugcucc

SEQ ID NO: 866129 - RNA, 20 nt, Human
cuggggcagggguggggagg

SEQ ID NO: 866130 - RNA, 21 nt, Human
gacccucucucccugcugggc

SEQ ID NO: 866131 - RNA, 21 nt, Human
gagcaggagcaggugagggca

SEQ ID NO: 866132 - RNA, 19 nt, Human
gaggggggcggauggcucc

SEQ ID NO: 866133 - RNA, 25 nt, Human
gagguccuggguagcagcuaggaga

SEQ ID NO: 866134 - RNA, 22 nt, Human
gcagagagcaggagcaggugag

SEQ ID NO: 866135 - RNA, 18 nt, Human
gcaggaaggcacggaggu

SEQ ID NO: 866136 - RNA, 21 nt, Human
gcaggagcaggugagggcaag

SEQ ID NO: 866137 - RNA, 18 nt, Human
gcaggaugguaaagccac

SEQ ID NO: 866138 - RNA, 18 nt, Human
gccacccccuacaucagu

SEQ ID NO: 866139 - RNA, 22 nt, Human
gcccugcggaccaugcugccuc

SEQ ID NO: 866140 - RNA, 23 nt, Human
gccuccagacaccccccaaccuu

SEQ ID NO: 866141 - RNA, 18 nt, Human
gccuccccguccggccug

SEQ ID NO: 866142 - RNA, 18 nt, Human
ggaaggggcugagggggg

SEQ ID NO: 866143 - RNA, 21 nt, Human
ggacgaggcugguggccaggu

SEQ ID NO: 866144 - RNA, 20 nt, Human
ggcgcggggagccuggcuug

SEQ ID NO: 866145 - RNA, 20 nt, Human
ggcucccugugggagugggg

SEQ ID NO: 866146 - RNA, 23 nt, Human
gggcagcaaauggccggggcucc

SEQ ID NO: 866147 - RNA, 18 nt, Human
gggcagggguggggaggg

SEQ ID NO: 866148 - RNA, 20 nt, Human
gggcugaggggggcggaugg

SEQ ID NO: 866149 - RNA, 21 nt, Human
ggggagccuggcuuggugcug

SEQ ID NO: 866150 - RNA, 23 nt, Human
gggggguggugaggggaacaugc

SEQ ID NO: 866151 - RNA, 18 nt, Human
ggguggcucaggggucag

SEQ ID NO: 866152 - RNA, 18 nt, Human
gguggcucaggggucagc

SEQ ID NO: 866153 - RNA, 19 nt, Human
ggugugggggaggggaggg

SEQ ID NO: 866154 - RNA, 21 nt, Human
guccaaaccaaccccauucca

SEQ ID NO: 866155 - RNA, 24 nt, Human
guccugaggcuggggcaggggugg

SEQ ID NO: 866156 - RNA, 26 nt, Human
guccugaggcuggggcaggggugggg

SEQ ID NO: 866157 - RNA, 22 nt, Human
gugagggcaaggcaggcgcggg

SEQ ID NO: 866158 - RNA, 18 nt, Human
gugagggcagucucuggg

SEQ ID NO: 866159 - RNA, 21 nt, Human
uaccccuuucugguguggggg

SEQ ID NO: 866160 - RNA, 21 nt, Human
ucaucuuaugggugcggaaac

SEQ ID NO: 866161 - RNA, 22 nt, Human
uccaggacgaggcugguggcca

SEQ ID NO: 866162 - RNA, 18 nt, Human
ucccagagguccaagggc

SEQ ID NO: 866163 - RNA, 20 nt, Human
ucccugagacccacgggggg

SEQ ID NO: 866164 - RNA, 23 nt, Human
ucccugagacccacggggggugg

SEQ ID NO: 866165 - RNA, 18 nt, Human
ucccugcugggccucccc

SEQ ID NO: 866166 - RNA, 21 nt, Human
ucccuggggaggaaggggcug

SEQ ID NO: 866167 - RNA, 18 nt, Human
ucccugugggaguggggg

SEQ ID NO: 866168 - RNA, 22 nt, Human
ucccugugggaguggggguggc

SEQ ID NO: 866169 - RNA, 21 nt, Human
uccugaggcuggggcaggggu

SEQ ID NO: 866170 - RNA, 23 nt, Human
uccugaggcuggggcaggggugg

SEQ ID NO: 866171 - RNA, 20 nt, Human
ucucgugcugucacucuguc

SEQ ID NO: 866172 - RNA, 18 nt, Human
ugagagcgaacccagucc

SEQ ID NO: 866173 - RNA, 18 nt, Human
ugagggcaaggcaggcgc

SEQ ID NO: 866174 - RNA, 19 nt, Human
ugagggcaaggcaggcgcg

SEQ ID NO: 866175 - RNA, 19 nt, Human
ugagggcaaggcaggcgcg

SEQ ID NO: 866176 - RNA, 20 nt, Human
ugagggcagucucuggggag

SEQ ID NO: 866177 - RNA, 18 nt, Human
ugcagagcugagagcgaa

SEQ ID NO: 866178 - RNA, 22 nt, Human
ugcaguccugaggcuggggcag

SEQ ID NO: 866179 - RNA, 18 nt, Human
ugccgugggguggccccu

SEQ ID NO: 866180 - RNA, 24 nt, Human
ugccuccagacaccccccaaccuu

SEQ ID NO: 866181 - RNA, 21 nt, Human
ugcugggccuccccguccggc

SEQ ID NO: 866182 - RNA, 27 nt, Human
ugcuuccaagcccccaacauaccccuu

SEQ ID NO: 866183 - RNA, 20 nt, Human
uggcagagagcaggagcagg

SEQ ID NO: 866184 - RNA, 22 nt, Human
uggcagagagcaggagcaggug

SEQ ID NO: 866185 - RNA, 23 nt, Human
uggcagagagcaggagcagguga

SEQ ID NO: 866186 - RNA, 19 nt, Human
uggccaggucgucguucuc

SEQ ID NO: 866187 - RNA, 18 nt, Human
uggcucaggggucagcag

SEQ ID NO: 866188 - RNA, 21 nt, Human
uggcuuugcucccuggggagg

SEQ ID NO: 866189 - RNA, 21 nt, Human
ugggaguggggguggcucagg

SEQ ID NO: 866190 - RNA, 22 nt, Human
uggggaggaaggggcugagggg

SEQ ID NO: 866191 - RNA, 25 nt, Human
uggggaggaaggggcugaggggggc

SEQ ID NO: 866192 - RNA, 19 nt, Human
ugggggacgcuggugagcc

SEQ ID NO: 866193 - RNA, 21 nt, Human
ugggggaggggagggagcucc

SEQ ID NO: 866194 - RNA, 21 nt, Human
ugggguggccccugccccuua

SEQ ID NO: 866195 - RNA, 18 nt, Human
ugggugcggaaaccgagg

SEQ ID NO: 866196 - RNA, 19 nt, Human
uggugcugacuccacuccc

SEQ ID NO: 866197 - RNA, 19 nt, Human
uuuuuuuuuuuuuuuugcu

SEQ ID NO: 866198 - RNA, 20 nt, Human
uuuuuuuuuuuuuuuugcug

SEQ ID NO: 866199 - RNA, 20 nt, Human
uuuuuuuuuuuuuuuuugcu

SEQ ID NO: 866200 - RNA, 27 nt, Human
uuuuuuuuuuuuuuuuuuuuuuugggg

SEQ ID NO: 866201 - RNA, 22 nt, Human
aaaaggaaaaaaaaguacuaug

SEQ ID NO: 866202 - RNA, 23 nt, Human
aaacaaaaacuucaauauucagu

SEQ ID NO: 866203 - RNA, 18 nt, Human
agauaacgcggacagcgc

SEQ ID NO: 866204 - RNA, 19 nt, Human
aggagauaacgcggacagc

SEQ ID NO: 866205 - RNA, 23 nt, Human
auaaacauaacucaaaacaaaaa

SEQ ID NO: 866206 - RNA, 27 nt, Human
cagagacagcagcaagcggaggagcag

SEQ ID NO: 866207 - RNA, 18 nt, Human
cagcagcaagcggaggag

SEQ ID NO: 866208 - RNA, 20 nt, Human
cagcagcaagcggaggagca

SEQ ID NO: 866209 - RNA, 18 nt, Human
caucacauuagcuuguau

SEQ ID NO: 866210 - RNA, 21 nt, Human
cccagcccggccgccgcccgc

SEQ ID NO: 866211 - RNA, 24 nt, Human
ccccucagcgcuggcacccaguuc

SEQ ID NO: 866212 - RNA, 18 nt, Human
ccgccgcccgcucccagg

SEQ ID NO: 866213 - RNA, 21 nt, Human
ccggccgccgcccgcucccag

SEQ ID NO: 866214 - RNA, 19 nt, Human
cgccagcccgcaccggcgc

SEQ ID NO: 866215 - RNA, 22 nt, Human
cgggaggagauaacgcggacag

SEQ ID NO: 866216 - RNA, 20 nt, Human
cgucuuucucugaccgggac

SEQ ID NO: 866217 - RNA, 21 nt, Human
cuggaagccccucagcgcugg

SEQ ID NO: 866218 - RNA, 23 nt, Human
cuuucauaugaaugaaaaugcac

SEQ ID NO: 866219 - RNA, 21 nt, Human
gagacagcagcaagcggagga

SEQ ID NO: 866220 - RNA, 18 nt, Human
gcgcggcccagcccggcc

SEQ ID NO: 866221 - RNA, 21 nt, Human
ggaggagauaacgcggacagc

SEQ ID NO: 866222 - RNA, 23 nt, Human
gggaauugaaagguuugcauuuu

SEQ ID NO: 866223 - RNA, 24 nt, Human
guccgcuggaagccccucagcgcu

SEQ ID NO: 866224 - RNA, 22 nt, Human
uaaacauaacucaaaacaaaaa

SEQ ID NO: 866225 - RNA, 24 nt, Human
uaacaagaaaaaccuccuuuaaaa

SEQ ID NO: 866226 - RNA, 20 nt, Human
uaacucaaaacaaaaacuuc

SEQ ID NO: 866227 - RNA, 21 nt, Human
uaacucaaaacaaaaacuuca

SEQ ID NO: 866228 - RNA, 23 nt, Human
uauccucgucgucuuucucugac

SEQ ID NO: 866229 - RNA, 23 nt, Human
ucacauguaacaagaaaaaccuc

SEQ ID NO: 866230 - RNA, 18 nt, Human
uccgcuggaagccccuca

SEQ ID NO: 866231 - RNA, 21 nt, Human
uccgcuggaagccccucagcg

SEQ ID NO: 866232 - RNA, 22 nt, Human
uccuuuaaaaaaaggaaaaaaa

SEQ ID NO: 866233 - RNA, 22 nt, Human
ucgccgguggacacugcgguuc

SEQ ID NO: 866234 - RNA, 19 nt, Human
ucuaagaagagguguggcu

SEQ ID NO: 866235 - RNA, 19 nt, Human
uggcucaaugcccaucaca

SEQ ID NO: 866236 - RNA, 19 nt, Human
uguaacaagaaaaaccucc

SEQ ID NO: 866237 - RNA, 24 nt, Human
uuuuuuuuuuuuuuuuucacaaau

SEQ ID NO: 866238 - RNA, 22 nt, Human
aaaccucugccacaaucacuca

SEQ ID NO: 866239 - RNA, 22 nt, Human
aacaaagaaauucuaggaaugc

SEQ ID NO: 866240 - RNA, 19 nt, Human
augaacacagacaaacauc

SEQ ID NO: 866241 - RNA, 19 nt, Human
caaaaugaaagucaagguc

SEQ ID NO: 866242 - RNA, 19 nt, Human
caacagacucaugguaaug

SEQ ID NO: 866243 - RNA, 20 nt, Human
cagcuggccugauaaugaua

SEQ ID NO: 866244 - RNA, 22 nt, Human
caggucaaggcaagaggcugca

SEQ ID NO: 866245 - RNA, 18 nt, Human
cauggcacaaaccucugc

SEQ ID NO: 866246 - RNA, 18 nt, Human
ccucugccacaaucacuc

SEQ ID NO: 866247 - RNA, 22 nt, Human
ccugaacuacaacaauauagag

SEQ ID NO: 866248 - RNA, 22 nt, Human
gaacacagacaaacaucaaagu

SEQ ID NO: 866249 - RNA, 19 nt, Human
gaggcugcagcuggccuga

SEQ ID NO: 866250 - RNA, 19 nt, Human
gcaagugaauuugcugaug

SEQ ID NO: 866251 - RNA, 26 nt, Human
gccacaaucacucauaauaauucaac

SEQ ID NO: 866252 - RNA, 21 nt, Human
uacaaaaugaaagucaagguc

SEQ ID NO: 866253 - RNA, 23 nt, Human
uacaacaauauagagucccauuu

SEQ ID NO: 866254 - RNA, 23 nt, Human
ucucuuagucaaugaagaccuga

SEQ ID NO: 866255 - RNA, 18 nt, Human
ugaaagucaaggucacuu

SEQ ID NO: 866256 - RNA, 20 nt, Human
ugaacacagacaaacaucaa

SEQ ID NO: 866257 - RNA, 26 nt, Human
ugaacacagacaaacaucaaaguuuu

SEQ ID NO: 866258 - RNA, 22 nt, Human
ugacaacagacucaugguaaug

SEQ ID NO: 866259 - RNA, 19 nt, Human
uuuuuuuuuuuuuuuugca

SEQ ID NO: 866260 - RNA, 22 nt, Human
uuuuuuuuuuuuuuuuugcauu

SEQ ID NO: 866261 - RNA, 27 nt, Human
uuuuuuuuuuuuuuuuuuuuuuugggg

SEQ ID NO: 866262 - RNA, 20 nt, Human
aaaggcuucguccagcgaga

SEQ ID NO: 866263 - RNA, 22 nt, Human
acccccaauaaaacugagaagu

SEQ ID NO: 866264 - RNA, 25 nt, Human
acuccgugacaccaagacgguucug

SEQ ID NO: 866265 - RNA, 18 nt, Human
acucuucccuccaccauc

SEQ ID NO: 866266 - RNA, 21 nt, Human
agacacccccaauaaaacuga

SEQ ID NO: 866267 - RNA, 20 nt, Human
caccaagacgguucugccgg

SEQ ID NO: 866268 - RNA, 22 nt, Human
cacuacgcagccugggcucagc

SEQ ID NO: 866269 - RNA, 20 nt, Human
cagaaggcacacacgggcca

SEQ ID NO: 866270 - RNA, 24 nt, Human
ccaccccuuccaucucgaaaggcc

SEQ ID NO: 866271 - RNA, 20 nt, Human
ccccgagguucucuucuggg

SEQ ID NO: 866272 - RNA, 28 nt, Human
cccgaccccuuccccgagguucucuucc

SEQ ID NO: 866273 - RNA, 20 nt, Human
cgcagagaacagaggcuccc

SEQ ID NO: 866274 - RNA, 23 nt, Human
cgggugggaagcaccuggacucc

SEQ ID NO: 866275 - RNA, 19 nt, Human
cuuguggucacuacgcagc

SEQ ID NO: 866276 - RNA, 21 nt, Human
gaccccuuccccgagguucuc

SEQ ID NO: 866277 - RNA, 18 nt, Human
gcaggcucucggcagagg

SEQ ID NO: 866278 - RNA, 18 nt, Human
gccaccccuuccaucucg

SEQ ID NO: 866279 - RNA, 23 nt, Human
gccggcggggaggggcugcccga

SEQ ID NO: 866280 - RNA, 26 nt, Human
gcugcccgaccccuuccccgagguuc

SEQ ID NO: 866281 - RNA, 18 nt, Human
gcuggacucuucccucca

SEQ ID NO: 866282 - RNA, 24 nt, Human
gggaggggcugcccgaccccuucc

SEQ ID NO: 866283 - RNA, 19 nt, Human
gucacacuccucgccacac

SEQ ID NO: 866284 - RNA, 23 nt, Human
ucacuacgcagccugggcucagc

SEQ ID NO: 866285 - RNA, 23 nt, Human
uccaucucgaaaggcuucgucca

SEQ ID NO: 866286 - RNA, 19 nt, Human
uccugccgucacacuccuc

SEQ ID NO: 866287 - RNA, 23 nt, Human
ucggcagaggcuggacucuuccc

SEQ ID NO: 866288 - RNA, 20 nt, Human
ugagaaguuccuuuccgagg

SEQ ID NO: 866289 - RNA, 20 nt, Human
ugcacccguggcuccugccg

SEQ ID NO: 866290 - RNA, 22 nt, Human
ugcgaccgggugggaagcaccu

SEQ ID NO: 866291 - RNA, 20 nt, Human
uuccaucucgaaaggcuucg

SEQ ID NO: 866292 - RNA, 19 nt, Human
uuccugacagccucccuga

SEQ ID NO: 866293 - RNA, 24 nt, Human
uucucuucugggaguccggccacc

SEQ ID NO: 866294 - RNA, 18 nt, Human
uucugggaguccggccac

SEQ ID NO: 866295 - RNA, 19 nt, Human
uugcacccguggcuccugc

SEQ ID NO: 866296 - RNA, 21 nt, Human
aaagcucccuaccagccgccu

SEQ ID NO: 866297 - RNA, 24 nt, Human
aaccccagccaaagccgcuggcau

SEQ ID NO: 866298 - RNA, 22 nt, Human
aagacccacccccagaacccuc

SEQ ID NO: 866299 - RNA, 22 nt, Human
aagacucaauucucaaugaacc

SEQ ID NO: 866300 - RNA, 23 nt, Human
acccacccccagaacccucgcua

SEQ ID NO: 866301 - RNA, 26 nt, Human
acccccagaacccucgcuagcacgaa

SEQ ID NO: 866302 - RNA, 21 nt, Human
accgaaucucugaaaugaaag

SEQ ID NO: 866303 - RNA, 19 nt, Human
agcggcguagccuccagga

SEQ ID NO: 866304 - RNA, 19 nt, Human
aggaccacccccagcucca

SEQ ID NO: 866305 - RNA, 22 nt, Human
aggcaaauguaggguggggggu

SEQ ID NO: 866306 - RNA, 23 nt, Human
aggcaugcaucuucuuaaaaacc

SEQ ID NO: 866307 - RNA, 24 nt, Human
aggcggcgacgccccaggacugag

SEQ ID NO: 866308 - RNA, 22 nt, Human
aggcuucagaccaaccccagcc

SEQ ID NO: 866309 - RNA, 19 nt, Human
agggaugguuucgcaucgu

SEQ ID NO: 866310 - RNA, 19 nt, Human
auaggauguggcugagacc

SEQ ID NO: 866311 - RNA, 22 nt, Human
caagaucaccaagacccacccc

SEQ ID NO: 866312 - RNA, 23 nt, Human
caagaucaccaagacccaccccc

SEQ ID NO: 866313 - RNA, 22 nt, Human
caaggcccuggcgugagcuccu

SEQ ID NO: 866314 - RNA, 22 nt, Human
cacccccagcuccacccaaggc

SEQ ID NO: 866315 - RNA, 24 nt, Human
cacccccuucagcuaagggcaccc

SEQ ID NO: 866316 - RNA, 23 nt, Human
cacccgcaguccuaggaccaccc

SEQ ID NO: 866317 - RNA, 21 nt, Human
cagcaggcgugggccuccccc

SEQ ID NO: 866318 - RNA, 21 nt, Human
cagcaggcgugggccucccuc

SEQ ID NO: 866319 - RNA, 18 nt, Human
cagccccacgccaccccg

SEQ ID NO: 866320 - RNA, 19 nt, Human
cagcggcguagccuccagg

SEQ ID NO: 866321 - RNA, 21 nt, Human
cagcggcguagccuccaggag

SEQ ID NO: 866322 - RNA, 22 nt, Human
caggacugaggagucccucaga

SEQ ID NO: 866323 - RNA, 20 nt, Human
caggaggaaaugcuuuggua

SEQ ID NO: 866324 - RNA, 22 nt, Human
caguccacgcuucuccccaccc

SEQ ID NO: 866325 - RNA, 19 nt, Human
caguccuaggaccaccccc

SEQ ID NO: 866326 - RNA, 23 nt, Human
caugaucggauucugggucagcc

SEQ ID NO: 866327 - RNA, 22 nt, Human
ccaguccacgcuucuccccacc

SEQ ID NO: 866328 - RNA, 21 nt, Human
cccacccccagaacccucgcu

SEQ ID NO: 866329 - RNA, 18 nt, Human
cccacgccaccccgggga

SEQ ID NO: 866330 - RNA, 25 nt, Human
cccaggccauaaauaacuuuuaaaa

SEQ ID NO: 866331 - RNA, 25 nt, Human
ccccagaacccgcguugguccagca

SEQ ID NO: 866332 - RNA, 21 nt, Human
ccccagcugcagcccagcucc

SEQ ID NO: 866333 - RNA, 20 nt, Human
ccccagggcuggguggcguc

SEQ ID NO: 866334 - RNA, 22 nt, Human
cccccagaacccucgcuagcac

SEQ ID NO: 866335 - RNA, 18 nt, Human
cccccagaacccucgcuu

SEQ ID NO: 866336 - RNA, 24 nt, Human
cccgcaguccuaggaccaccccca

SEQ ID NO: 866337 - RNA, 23 nt, Human
cccggcuccugggcucagcgggg

SEQ ID NO: 866338 - RNA, 20 nt, Human
ccucaaggcccuggcgugag

SEQ ID NO: 866339 - RNA, 23 nt, Human
ccuccaauuacccacaggcugcc

SEQ ID NO: 866340 - RNA, 21 nt, Human
ccuguccucaaggcccuggcc

SEQ ID NO: 866341 - RNA, 19 nt, Human
cgacgccccaggacugagg

SEQ ID NO: 866342 - RNA, 25 nt, Human
cgcgugcaggcuucagaccaacccc

SEQ ID NO: 866343 - RNA, 18 nt, Human
cuguccucaaggcccugg

SEQ ID NO: 866344 - RNA, 21 nt, Human
gaagcccagccagucgggucc

SEQ ID NO: 866345 - RNA, 18 nt, Human
gaccugcggguuuugggg

SEQ ID NO: 866346 - RNA, 21 nt, Human
gagcccagccugcaaggcugu

SEQ ID NO: 866347 - RNA, 21 nt, Human
gcaugcaucuucuuaaaaacc

SEQ ID NO: 866348 - RNA, 27 nt, Human
gccaaaauacauaggauguggcugguc

SEQ ID NO: 866349 - RNA, 24 nt, Human
gcgcgugcccauggcucaguuuug

SEQ ID NO: 866350 - RNA, 21 nt, Human
gcgcuaggcuucgagucacac

SEQ ID NO: 866351 - RNA, 20 nt, Human
gcuucuccccacccccuuca

SEQ ID NO: 866352 - RNA, 19 nt, Human
gcuuugcuccuccagagcc

SEQ ID NO: 866353 - RNA, 22 nt, Human
ggaaaaaaaaaagaacacauua

SEQ ID NO: 866354 - RNA, 26 nt, Human
ggaaagaggacacagucugucgccag

SEQ ID NO: 866355 - RNA, 22 nt, Human
ggacaaaugcaaauuguuuccc

SEQ ID NO: 866356 - RNA, 21 nt, Human
ggcaggcaaagcucccuacca

SEQ ID NO: 866357 - RNA, 19 nt, Human
ggcguagccuccaggagga

SEQ ID NO: 866358 - RNA, 25 nt, Human
ggcgugcuguuuucaggacaggacu

SEQ ID NO: 866359 - RNA, 18 nt, Human
ggcucaguuuuggugucu

SEQ ID NO: 866360 - RNA, 21 nt, Human
gggaaagaggacacagucugu

SEQ ID NO: 866361 - RNA, 21 nt, Human
gggagcacagcggcguagccu

SEQ ID NO: 866362 - RNA, 20 nt, Human
ggguccgggugauuccugcu

SEQ ID NO: 866363 - RNA, 24 nt, Human
ggguucugugggccuggggcgugc

SEQ ID NO: 866364 - RNA, 18 nt, Human
gguccagcaggcgugggc

SEQ ID NO: 866365 - RNA, 19 nt, Human
guccacgcuucuccccacc

SEQ ID NO: 866366 - RNA, 18 nt, Human
gugcaugaucggauucug

SEQ ID NO: 866367 - RNA, 21 nt, Human
uaaaaaaauaaauauccauua

SEQ ID NO: 866368 - RNA, 24 nt, Human
uaaaaaaauaaauauccauuaaaa

SEQ ID NO: 866369 - RNA, 26 nt, Human
uaacuuuuaaaaauuugauuuucuua

SEQ ID NO: 866370 - RNA, 25 nt, Human
uacaaaaaaguuuccagucauaaaa

SEQ ID NO: 866371 - RNA, 23 nt, Human
uagcacgaagcccagccagucgg

SEQ ID NO: 866372 - RNA, 25 nt, Human
uaggacaagaucaccaagacccacc

SEQ ID NO: 866373 - RNA, 21 nt, Human
ucaccaagacccacccccaga

SEQ ID NO: 866374 - RNA, 23 nt, Human
uccccacccccuucagcuaaggg

SEQ ID NO: 866375 - RNA, 18 nt, Human
ucccugagcccagccugc

SEQ ID NO: 866376 - RNA, 24 nt, Human
ugaaaugaaaguccaugccagccc

SEQ ID NO: 866377 - RNA, 19 nt, Human
ugagcuccugaccugugua

SEQ ID NO: 866378 - RNA, 22 nt, Human
ugagcugcacuuucugaaggag

SEQ ID NO: 866379 - RNA, 25 nt, Human
ugaggacaggugcaugaucggauuc

SEQ ID NO: 866380 - RNA, 21 nt, Human
ugcagguugugcugugacgcu

SEQ ID NO: 866381 - RNA, 18 nt, Human
ugcccauggcucaguuuu

SEQ ID NO: 866382 - RNA, 24 nt, Human
ugccccagccccacgccaccccgg

SEQ ID NO: 866383 - RNA, 20 nt, Human
uggaagaggcugcaggcggc

SEQ ID NO: 866384 - RNA, 21 nt, Human
uggaagaggcugcaggcggcg

SEQ ID NO: 866385 - RNA, 19 nt, Human
uguacugaccaauguaaaa

SEQ ID NO: 866386 - RNA, 26 nt, Human
ugugacgcucgcuggacgcagggcuu

SEQ ID NO: 866387 - RNA, 21 nt, Human
aaaugcuuguuuuguaguucu

SEQ ID NO: 866388 - RNA, 23 nt, Human
acugcuccacaaaugaccaagua

SEQ ID NO: 866389 - RNA, 18 nt, Human
aguauuugauagaugaaa

SEQ ID NO: 866390 - RNA, 19 nt, Human
aguauuugauagaugaaaa

SEQ ID NO: 866391 - RNA, 24 nt, Human
auuugauagaugaaaaaauuuauu

SEQ ID NO: 866392 - RNA, 19 nt, Human
cacaaaaggaaaaacuuca

SEQ ID NO: 866393 - RNA, 21 nt, Human
caucaucuuccaaagguuucu

SEQ ID NO: 866394 - RNA, 21 nt, Human
cuacacaaaaggaaaaacuuc

SEQ ID NO: 866395 - RNA, 18 nt, Human
cuuuuuucuccuugacuu

SEQ ID NO: 866396 - RNA, 21 nt, Human
gaguuugauccuuuuuucucc

SEQ ID NO: 866397 - RNA, 18 nt, Human
gccgccgcgccguggucc

SEQ ID NO: 866398 - RNA, 24 nt, Human
uaaacgucuccauauguuuuucug

SEQ ID NO: 866399 - RNA, 27 nt, Human
uagccuaauaauauuucuuaucacauc

SEQ ID NO: 866400 - RNA, 19 nt, Human
uaucauaggacacaggccu

SEQ ID NO: 866401 - RNA, 22 nt, Human
uauuaaauaacaugcucccaag

SEQ ID NO: 866402 - RNA, 19 nt, Human
uccauauguuuuucugaac

SEQ ID NO: 866403 - RNA, 20 nt, Human
ucccuuucuccuuaagggaa

SEQ ID NO: 866404 - RNA, 23 nt, Human
ucuccuugacuucccuuucuccu

SEQ ID NO: 866405 - RNA, 18 nt, Human
ucuguucuaucauaggac

SEQ ID NO: 866406 - RNA, 21 nt, Human
ugaacaaaacuauaaaggaac

SEQ ID NO: 866407 - RNA, 22 nt, Human
ugaagcaguaauaacccaaaau

SEQ ID NO: 866408 - RNA, 18 nt, Human
ugagauaaaugaagcagu

SEQ ID NO: 866409 - RNA, 23 nt, Human
uuauaguucccauuaagcuagca

SEQ ID NO: 866410 - RNA, 26 nt, Human
uucuuuauuauuauaguucccauuaa

SEQ ID NO: 866411 - RNA, 20 nt, Human
uugguucuguucuaucauag

SEQ ID NO: 866412 - RNA, 20 nt, Human
uuugauccuuuuuucuccuu

SEQ ID NO: 866413 - RNA, 18 nt, Human
uuuuuuuuuuuuuuuuug

SEQ ID NO: 866414 - RNA, 24 nt, Human
uuuuuuuuuuuuuuuuugauaaag

SEQ ID NO: 866415 - RNA, 19 nt, Human
aaaauacugcuacaccagc

SEQ ID NO: 866416 - RNA, 25 nt, Human
aaaauacugcuacaccagccaauca

SEQ ID NO: 866417 - RNA, 18 nt, Human
aaagugcugggauuacaa

SEQ ID NO: 866418 - RNA, 24 nt, Human
aaagugcugggauuacaagcguga

SEQ ID NO: 866419 - RNA, 22 nt, Human
aaguagcugggauuacaggcau

SEQ ID NO: 866420 - RNA, 24 nt, Human
aaguagcugggauuacaggcauac

SEQ ID NO: 866421 - RNA, 19 nt, Human
aagugcugggauuacaagc

SEQ ID NO: 866422 - RNA, 19 nt, Human
aagugcugggauuacaagc

SEQ ID NO: 866423 - RNA, 26 nt, Human
aagugcugggauuacaagcgugagcc

SEQ ID NO: 866424 - RNA, 20 nt, Human
acgggguuucuccauguugg

SEQ ID NO: 866425 - RNA, 21 nt, Human
acgggguuucuccauguuggu

SEQ ID NO: 866426 - RNA, 24 nt, Human
acgggguuucuccauguuggucag

SEQ ID NO: 866427 - RNA, 24 nt, Human
agaggaaagagagcaggcagaggg

SEQ ID NO: 866428 - RNA, 26 nt, Human
agauuaggguggauaaggacacugcu

SEQ ID NO: 866429 - RNA, 22 nt, Human
agauucuccugccucagccucc

SEQ ID NO: 866430 - RNA, 22 nt, Human
aggccuaccuaccccauuaggc

SEQ ID NO: 866431 - RNA, 25 nt, Human
agguaguucagcuggacaaugaggg

SEQ ID NO: 866432 - RNA, 24 nt, Human
aggugauccgcccaccucggcuuc

SEQ ID NO: 866433 - RNA, 20 nt, Human
agugcaauggugcaauuucg

SEQ ID NO: 866434 - RNA, 24 nt, Human
agugcaauggugcaauuucggcuc

SEQ ID NO: 866435 - RNA, 24 nt, Human
caaagugcugggauuacaagcgug

SEQ ID NO: 866436 - RNA, 22 nt, Human
caagagauucuccugccucagc

SEQ ID NO: 866437 - RNA, 22 nt, Human
caccucaaccuccgccucccgg

SEQ ID NO: 866438 - RNA, 24 nt, Human
caccucggcuucccaaagugcugg

SEQ ID NO: 866439 - RNA, 18 nt, Human
cacugcucaccacccucc

SEQ ID NO: 866440 - RNA, 24 nt, Human
cauguuggucaggcuggucuugaa

SEQ ID NO: 866441 - RNA, 22 nt, Human
ccaaagugcugggauuacaagc

SEQ ID NO: 866442 - RNA, 24 nt, Human
ccaaagugcugggauuacaagcgu

SEQ ID NO: 866443 - RNA, 19 nt, Human
ccauguuggucaggcuggu

SEQ ID NO: 866444 - RNA, 21 nt, Human
ccauguuggucaggcuggucu

SEQ ID NO: 866445 - RNA, 24 nt, Human
cccgaccucaggugauccgcccac

SEQ ID NO: 866446 - RNA, 23 nt, Human
ccuaaguagcugggauuacaggc

SEQ ID NO: 866447 - RNA, 24 nt, Human
ccuaaguagcugggauuacaggca

SEQ ID NO: 866448 - RNA, 23 nt, Human
ccucaaccuccgccucccgguuu

SEQ ID NO: 866449 - RNA, 24 nt, Human
ccucaaccuccgccucccgguuuc

SEQ ID NO: 866450 - RNA, 24 nt, Human
ccucccgguuucaagagauucucc

SEQ ID NO: 866451 - RNA, 18 nt, Human
cgaccucaggugauccgc

SEQ ID NO: 866452 - RNA, 24 nt, Human
cgggguuucuccauguuggucagg

SEQ ID NO: 866453 - RNA, 23 nt, Human
cuaaguagcugggauuacaggca

SEQ ID NO: 866454 - RNA, 24 nt, Human
cuaaguagcugggauuacaggcau

SEQ ID NO: 866455 - RNA, 23 nt, Human
cucagccuccuaaguagcuggga

SEQ ID NO: 866456 - RNA, 24 nt, Human
cuccauguuggucaggcuggucuu

SEQ ID NO: 866457 - RNA, 19 nt, Human
cucuuauugcccaggcugg

SEQ ID NO: 866458 - RNA, 21 nt, Human
cucuuauugcccaggcuggag

SEQ ID NO: 866459 - RNA, 23 nt, Human
cugccucagccuccuaaguagcu

SEQ ID NO: 866460 - RNA, 22 nt, Human
cuguauuuuuaguagacacggg

SEQ ID NO: 866461 - RNA, 24 nt, Human
cuuauugcccaggcuggagugcaa

SEQ ID NO: 866462 - RNA, 20 nt, Human
gacaaugagggaguaugaga

SEQ ID NO: 866463 - RNA, 24 nt, Human
gacacgggguuucuccauguuggu

SEQ ID NO: 866464 - RNA, 24 nt, Human
gaccucaggugauccgcccaccuc

SEQ ID NO: 866465 - RNA, 22 nt, Human
gaggguccugacucccagggga

SEQ ID NO: 866466 - RNA, 18 nt, Human
gauuacaagcgugagcca

SEQ ID NO: 866467 - RNA, 22 nt, Human
gauuacaagcgugagccacugc

SEQ ID NO: 866468 - RNA, 22 nt, Human
gauuacaagcgugagccacugc

SEQ ID NO: 866469 - RNA, 18 nt, Human
gauuacaggcauacgcca

SEQ ID NO: 866470 - RNA, 24 nt, Human
gauuacaggcauacgccaccaugc

SEQ ID NO: 866471 - RNA, 21 nt, Human
gauucuccugccucagccucc

SEQ ID NO: 866472 - RNA, 19 nt, Human
gcccaggcuggagugcaau

SEQ ID NO: 866473 - RNA, 20 nt, Human
gccucagccuccuaaguagc

SEQ ID NO: 866474 - RNA, 23 nt, Human
gcucuuauugcccaggcuggagu

SEQ ID NO: 866475 - RNA, 21 nt, Human
gcugggauuacaagcgugagc

SEQ ID NO: 866476 - RNA, 23 nt, Human
gcuggucuugaacucccgaccuc

SEQ ID NO: 866477 - RNA, 24 nt, Human
ggauuacaggcauacgccaccaug

SEQ ID NO: 866478 - RNA, 24 nt, Human
ggcuggucuugaacucccgaccuc

SEQ ID NO: 866479 - RNA, 19 nt, Human
ggggaauagaggaugaagg

SEQ ID NO: 866480 - RNA, 23 nt, Human
gggguuucuccauguuggucagg

SEQ ID NO: 866481 - RNA, 20 nt, Human
guagcugggauuacaggcau

SEQ ID NO: 866482 - RNA, 24 nt, Human
gugauccgcccaccucggcuuccc

SEQ ID NO: 866483 - RNA, 23 nt, Human
guucagcuggacaaugagggagu

SEQ ID NO: 866484 - RNA, 22 nt, Human
uaacugccauuucuaaagagga

SEQ ID NO: 866485 - RNA, 19 nt, Human
uaaggacacugcucaccac

SEQ ID NO: 866486 - RNA, 24 nt, Human
uacaagcgugagccacugcgccca

SEQ ID NO: 866487 - RNA, 22 nt, Human
uacaggcauacgccaccaugcc

SEQ ID NO: 866488 - RNA, 24 nt, Human
uaguagacacgggguuucuccaug

SEQ ID NO: 866489 - RNA, 19 nt, Human
uauugcccaggcuggagug

SEQ ID NO: 866490 - RNA, 20 nt, Human
uauugcccaggcuggagugc

SEQ ID NO: 866491 - RNA, 26 nt, Human
ucaccucaaccuccgccucccgguuu

SEQ ID NO: 866492 - RNA, 18 nt, Human
ucccaaagugcugggauu

SEQ ID NO: 866493 - RNA, 24 nt, Human
ucccaaagugcugggauuacaagc

SEQ ID NO: 866494 - RNA, 24 nt, Human
ucccgguuucaagagauucuccug

SEQ ID NO: 866495 - RNA, 24 nt, Human
uccuaaguagcugggauuacaggc

SEQ ID NO: 866496 - RNA, 22 nt, Human
ucgcucuuauugcccaggcugg

SEQ ID NO: 866497 - RNA, 23 nt, Human
ucgcucuuauugcccaggcugga

SEQ ID NO: 866498 - RNA, 23 nt, Human
ucuaaagaggaaagagagcaggc

SEQ ID NO: 866499 - RNA, 24 nt, Human
ucuccugccucagccuccuaagua

SEQ ID NO: 866500 - RNA, 23 nt, Human
ugauccgcccaccucggcuuccc

SEQ ID NO: 866501 - RNA, 23 nt, Human
ugcaauggugcaauuucggcucc

SEQ ID NO: 866502 - RNA, 18 nt, Human
ugcccaggcuggagugca

SEQ ID NO: 866503 - RNA, 21 nt, Human
ugcccaggcuggagugcaaug

SEQ ID NO: 866504 - RNA, 24 nt, Human
ugcccaggcuggagugcaauggug

SEQ ID NO: 866505 - RNA, 24 nt, Human
ugccucagccuccuaaguagcugg

SEQ ID NO: 866506 - RNA, 19 nt, Human
ugccugagccucggcaccc

SEQ ID NO: 866507 - RNA, 24 nt, Human
ugcugggauuacaagcgugagcca

SEQ ID NO: 866508 - RNA, 28 nt, Human
uggagugcaauggugcaauucuagcacg

SEQ ID NO: 866509 - RNA, 23 nt, Human
uggagugcaauggugcaauuucg

SEQ ID NO: 866510 - RNA, 24 nt, Human
uggagugcaauggugcaauuucgg

SEQ ID NO: 866511 - RNA, 18 nt, Human
uggcaggaagaaagaaug

SEQ ID NO: 866512 - RNA, 19 nt, Human
ugggauuacaagcgugagc

SEQ ID NO: 866513 - RNA, 21 nt, Human
ugggauuacaagcgugagcca

SEQ ID NO: 866514 - RNA, 22 nt, Human
ugggauuacaagcgugagccac

SEQ ID NO: 866515 - RNA, 22 nt, Human
ugggauuacaagcgugagccac

SEQ ID NO: 866516 - RNA, 24 nt, Human
ugggauuacaagcgugagccacug

SEQ ID NO: 866517 - RNA, 26 nt, Human
ugggauuacaagcgugagccacugcg

SEQ ID NO: 866518 - RNA, 22 nt, Human
ugggauuacaggcauacgccac

SEQ ID NO: 866519 - RNA, 24 nt, Human
ugggauuacaggcauacgccacca

SEQ ID NO: 866520 - RNA, 22 nt, Human
uggggucaggcagccucaaccc

SEQ ID NO: 866521 - RNA, 23 nt, Human
uggucaggcuggucuugaacucc

SEQ ID NO: 866522 - RNA, 19 nt, Human
ugguugguggcaggaagaa

SEQ ID NO: 866523 - RNA, 24 nt, Human
uuaguagacacgggguuucuccau

SEQ ID NO: 866524 - RNA, 23 nt, Human
uucaagagauucuccugccucag

SEQ ID NO: 866525 - RNA, 24 nt, Human
uucgcucuuauugcccaggcugga

SEQ ID NO: 866526 - RNA, 18 nt, Human
uugcccaggcuggagugc

SEQ ID NO: 866527 - RNA, 24 nt, Human
uuucgcucuuauugcccaggcugg

SEQ ID NO: 866528 - RNA, 21 nt, Human
uuucuccauguuggucaggcu

SEQ ID NO: 866529 - RNA, 25 nt, Human
uuuuuuuuuuuugagauggaguuuc

SEQ ID NO: 866530 - RNA, 27 nt, Human
uuuuuuuuuuuuuuuuuuuuuuugggg

SEQ ID NO: 866531 - RNA, 20 nt, Human
aaacauccauaagaacaucc

SEQ ID NO: 866532 - RNA, 19 nt, Human
aaaguacacaggcagacga

SEQ ID NO: 866533 - RNA, 20 nt, Human
aauccaaaccaaccagccaa

SEQ ID NO: 866534 - RNA, 19 nt, Human
acaaauccaaaccaaccag

SEQ ID NO: 866535 - RNA, 18 nt, Human
acauuauguuaccaaaug

SEQ ID NO: 866536 - RNA, 24 nt, Human
acauuauguuaccaaaugcuaaca

SEQ ID NO: 866537 - RNA, 31 nt, Human
agaaacauccauaagaacauccaaaaacauu

SEQ ID NO: 866538 - RNA, 22 nt, Human
agggaagaaacauccauaagaa

SEQ ID NO: 866539 - RNA, 24 nt, Human
agguguggagaccaauuugcuucg

SEQ ID NO: 866540 - RNA, 19 nt, Human
auaagaacauccaaaaaca

SEQ ID NO: 866541 - RNA, 19 nt, Human
cauccaaaaacauuauguu

SEQ ID NO: 866542 - RNA, 18 nt, Human
cucguggccucggcgugg

SEQ ID NO: 866543 - RNA, 20 nt, Human
gcaucccaggguucaaauca

SEQ ID NO: 866544 - RNA, 20 nt, Human
ggaagaaacauccauaagaa

SEQ ID NO: 866545 - RNA, 18 nt, Human
uaagaacauccaaaaaca

SEQ ID NO: 866546 - RNA, 23 nt, Human
uacaaauccaaaccaaccagcca

SEQ ID NO: 866547 - RNA, 20 nt, Human
uacacaggcagacgauuuua

SEQ ID NO: 866548 - RNA, 21 nt, Human
uagagcaucccaggguucaaa

SEQ ID NO: 866549 - RNA, 23 nt, Human
ucaaaucacaauuugggauacaa

SEQ ID NO: 866550 - RNA, 22 nt, Human
ucuacaaaguacacaggcagac

SEQ ID NO: 866551 - RNA, 18 nt, Human
ucuggaugaugcucaauu

SEQ ID NO: 866552 - RNA, 20 nt, Human
ucuggaugaugcucaauucc

SEQ ID NO: 866553 - RNA, 18 nt, Human
ugaaauacucguggccuc

SEQ ID NO: 866554 - RNA, 22 nt, Human
ugaauaguaccauucacaucua

SEQ ID NO: 866555 - RNA, 18 nt, Human
uggaugaugcucaauucc

SEQ ID NO: 866556 - RNA, 22 nt, Human
uuagaaaaaugcucaauuuuuu

SEQ ID NO: 866557 - RNA, 25 nt, Human
uuuuuuuuuuuuagaaaaaugcuca

SEQ ID NO: 866558 - RNA, 23 nt, Human
aaaaacauguuuuccuccucuuc

SEQ ID NO: 866559 - RNA, 23 nt, Human
aagaaccccacuuuugcaagccu

SEQ ID NO: 866560 - RNA, 21 nt, Human
aaggauaguauggugggcagg

SEQ ID NO: 866561 - RNA, 18 nt, Human
acauguuuuccuccucuu

SEQ ID NO: 866562 - RNA, 19 nt, Human
acucaugcagcugcucuuc

SEQ ID NO: 866563 - RNA, 20 nt, Human
acucuugcauccauuuucug

SEQ ID NO: 866564 - RNA, 22 nt, Human
acucuuuuuuuuugccuucuuu

SEQ ID NO: 866565 - RNA, 21 nt, Human
agauggagaggacuacgugga

SEQ ID NO: 866566 - RNA, 18 nt, Human
aggcagucauagggguau

SEQ ID NO: 866567 - RNA, 18 nt, Human
aggugacuaggugauggg

SEQ ID NO: 866568 - RNA, 22 nt, Human
auaggaaauagcuccagcugua

SEQ ID NO: 866569 - RNA, 20 nt, Human
aucagcuucuacucuugcau

SEQ ID NO: 866570 - RNA, 20 nt, Human
caggacccaugcauugcugu

SEQ ID NO: 866571 - RNA, 20 nt, Human
ccauuuucugaguacaccac

SEQ ID NO: 866572 - RNA, 23 nt, Human
ccccuuccaaaaacugucuuccu

SEQ ID NO: 866573 - RNA, 21 nt, Human
cgggcagauggagaggacuac

SEQ ID NO: 866574 - RNA, 21 nt, Human
cugaaguggauuuagguccau

SEQ ID NO: 866575 - RNA, 21 nt, Human
gacuacguggacagacaggac

SEQ ID NO: 866576 - RNA, 22 nt, Human
gaguacaccacugagaaagaaa

SEQ ID NO: 866577 - RNA, 19 nt, Human
ggugauggguguugcuggu

SEQ ID NO: 866578 - RNA, 20 nt, Human
guccaucucuugauuggggg

SEQ ID NO: 866579 - RNA, 26 nt, Human
guggcucuuggcugcuggcuucacuu

SEQ ID NO: 866580 - RNA, 18 nt, Human
uaccaucuucuuuuacau

SEQ ID NO: 866581 - RNA, 22 nt, Human
uagggucccuuuuguuucaaau

SEQ ID NO: 866582 - RNA, 25 nt, Human
uagggucccuuuuguuucaaaucag

SEQ ID NO: 866583 - RNA, 19 nt, Human
uaugcuugccccuuccaaa

SEQ ID NO: 866584 - RNA, 21 nt, Human
ucagaaagaaccccacuuuug

SEQ ID NO: 866585 - RNA, 22 nt, Human
ucaugagcugaguccaucucuu

SEQ ID NO: 866586 - RNA, 21 nt, Human
ucaugcagcugcucuuccuuc

SEQ ID NO: 866587 - RNA, 19 nt, Human
ucuguucagaauaauaguc

SEQ ID NO: 866588 - RNA, 19 nt, Human
ucuguucuucaucauuucu

SEQ ID NO: 866589 - RNA, 24 nt, Human
ugaagauuucuagggucccuuuug

SEQ ID NO: 866590 - RNA, 18 nt, Human
ugagaaaccaacacauua

SEQ ID NO: 866591 - RNA, 23 nt, Human
ugagaaagaaacaggcucuguuc

SEQ ID NO: 866592 - RNA, 22 nt, Human
ugagucacaggacuggguggag

SEQ ID NO: 866593 - RNA, 18 nt, Human
ugagucaugagucacagg

SEQ ID NO: 866594 - RNA, 23 nt, Human
uggauuuagguccaugcugggaa

SEQ ID NO: 866595 - RNA, 24 nt, Human
ugggcaggugacuaggugaugggu

SEQ ID NO: 866596 - RNA, 20 nt, Human
uguuucaaaucagucucccu

SEQ ID NO: 866597 - RNA, 19 nt, Human
uuccaaaucauuaugcuug

SEQ ID NO: 866598 - RNA, 21 nt, Human
uugggggugagucaugaguca

SEQ ID NO: 866599 - RNA, 27 nt, Human
uugguauuauuauagaaaguuuccugg

SEQ ID NO: 866600 - RNA, 26 nt, Human
uuuaaauccaaagucaaucugacaac

SEQ ID NO: 866601 - RNA, 22 nt, Human
uuucuuuguucauuuuuggcug

SEQ ID NO: 866602 - RNA, 22 nt, Human
uuugcaagccucgaggaucagc

SEQ ID NO: 866603 - RNA, 27 nt, Human
uuuucuguuugccauccucuuuccuug

SEQ ID NO: 866604 - RNA, 25 nt, Human
uuuuguuucaaaucagucucccuga

SEQ ID NO: 866605 - RNA, 22 nt, Human
aaacacacacacacacacccuc

SEQ ID NO: 866606 - RNA, 19 nt, Human
aaaucucucccucccauuc

SEQ ID NO: 866607 - RNA, 24 nt, Human
aacaaggugcagggauggcaaagg

SEQ ID NO: 866608 - RNA, 20 nt, Human
aaggugcagggauggcaaag

SEQ ID NO: 866609 - RNA, 23 nt, Human
acacacacacacacccucuugug

SEQ ID NO: 866610 - RNA, 19 nt, Human
accaaacacacacacacac

SEQ ID NO: 866611 - RNA, 23 nt, Human
agaaugauccacaugggaacuca

SEQ ID NO: 866612 - RNA, 23 nt, Human
agggauggcaaagggggcuucua

SEQ ID NO: 866613 - RNA, 20 nt, Human
cacacacaccaaacacacac

SEQ ID NO: 866614 - RNA, 27 nt, Human
cacacacaccaaacacacacacacaca

SEQ ID NO: 866615 - RNA, 26 nt, Human
caccaaacacacacacacacacccuc

SEQ ID NO: 866616 - RNA, 21 nt, Human
cacccgaaacaaggugcaggg

SEQ ID NO: 866617 - RNA, 21 nt, Human
cagccaggacagggucuguac

SEQ ID NO: 866618 - RNA, 24 nt, Human
cauuguguuauaucaauagcuuca

SEQ ID NO: 866619 - RNA, 18 nt, Human
ccacacacacaccaaaca

SEQ ID NO: 866620 - RNA, 21 nt, Human
ccacacacacaccaaacacac

SEQ ID NO: 866621 - RNA, 24 nt, Human
ccacacacacaccaaacacacaca

SEQ ID NO: 866622 - RNA, 31 nt, Human
ccacacacacaccaaacacacacacacacag

SEQ ID NO: 866623 - RNA, 19 nt, Human
ccacuggguugggggcuga

SEQ ID NO: 866624 - RNA, 19 nt, Human
ccaggacagggucuguacu

SEQ ID NO: 866625 - RNA, 19 nt, Human
cccccccuccacacacaca

SEQ ID NO: 866626 - RNA, 21 nt, Human
cccccccuccacacacacacc

SEQ ID NO: 866627 - RNA, 20 nt, Human
cccuccacacacacaccaaa

SEQ ID NO: 866628 - RNA, 30 nt, Human
ccuuuuguuucaaagggcagagauggagac

SEQ ID NO: 866629 - RNA, 18 nt, Human
cucaaaucucucccuccc

SEQ ID NO: 866630 - RNA, 24 nt, Human
cucaaaucucucccucccauucau

SEQ ID NO: 866631 - RNA, 25 nt, Human
cucaaaucucucccucccauucauc

SEQ ID NO: 866632 - RNA, 21 nt, Human
cuccacacacacaccaaacac

SEQ ID NO: 866633 - RNA, 23 nt, Human
cuuggacucaaaucucucccucc

SEQ ID NO: 866634 - RNA, 20 nt, Human
gcccccccuccacacacaca

SEQ ID NO: 866635 - RNA, 22 nt, Human
gcccccccuccacacacacacc

SEQ ID NO: 866636 - RNA, 21 nt, Human
gccgggccuccacuggguugg

SEQ ID NO: 866637 - RNA, 23 nt, Human
gcuuggacucaaaucucucccuc

SEQ ID NO: 866638 - RNA, 22 nt, Human
ggauggcaaagggggcuucuag

SEQ ID NO: 866639 - RNA, 19 nt, Human
gggauggcaaagggggcuu

SEQ ID NO: 866640 - RNA, 22 nt, Human
ucaaagggcagagauggagaca

SEQ ID NO: 866641 - RNA, 27 nt, Human
ucagugauguauccagcggcccccccu

SEQ ID NO: 866642 - RNA, 18 nt, Human
uccacacacacaccaaac

SEQ ID NO: 866643 - RNA, 24 nt, Human
uccacacacacaccaaacacacac

SEQ ID NO: 866644 - RNA, 27 nt, Human
uccacacacacaccaaacacacacaca

SEQ ID NO: 866645 - RNA, 23 nt, Human
ugcagggauggcaaagggggcuu

SEQ ID NO: 866646 - RNA, 27 nt, Human
ugcuuggacucaaaucucucccuccca

SEQ ID NO: 866647 - RNA, 22 nt, Human
uugcgugguggcaaaggcuccc

SEQ ID NO: 866648 - RNA, 18 nt, Human
uuuuuuuuuuuuuuucug

SEQ ID NO: 866649 - RNA, 19 nt, Human
aaaaaagagauauguauaa

SEQ ID NO: 866650 - RNA, 21 nt, Human
aaaaaccuacuauguuccaaa

SEQ ID NO: 866651 - RNA, 18 nt, Human
aacagaauaaaaaagaga

SEQ ID NO: 866652 - RNA, 20 nt, Human
aagaaaccuagaguaaaaua

SEQ ID NO: 866653 - RNA, 24 nt, Human
aauaaaaagacugacuugaaagga

SEQ ID NO: 866654 - RNA, 22 nt, Human
acagauuccucacugcuggcca

SEQ ID NO: 866655 - RNA, 26 nt, Human
agaaaaagaaguaaucgacauaaaaa

SEQ ID NO: 866656 - RNA, 19 nt, Human
agaagauugaaauguaaua

SEQ ID NO: 866657 - RNA, 20 nt, Human
agacagaaaauuuuaauaau

SEQ ID NO: 866658 - RNA, 29 nt, Human
agacagaagauugaaauguaagggacccc

SEQ ID NO: 866659 - RNA, 20 nt, Human
agccaagaaaaagaaguaau

SEQ ID NO: 866660 - RNA, 21 nt, Human
aggaaagggaacuuccucaau

SEQ ID NO: 866661 - RNA, 22 nt, Human
aguaaaauauuaguauagacaa

SEQ ID NO: 866662 - RNA, 20 nt, Human
auaagccaagaaaaagaagu

SEQ ID NO: 866663 - RNA, 18 nt, Human
auccagccaccccaagac

SEQ ID NO: 866664 - RNA, 23 nt, Human
auccuagccaauucaauaagcca

SEQ ID NO: 866665 - RNA, 18 nt, Human
caaacaccaacggaagcc

SEQ ID NO: 866666 - RNA, 22 nt, Human
cacugcuggccaucauuugugg

SEQ ID NO: 866667 - RNA, 26 nt, Human
caguaauauauaaaagcacaacacau

SEQ ID NO: 866668 - RNA, 27 nt, Human
ccaauucaauaagccaagaaaaagaaa

SEQ ID NO: 866669 - RNA, 18 nt, Human
ccaguuaaaaaccuacua

SEQ ID NO: 866670 - RNA, 20 nt, Human
cccaggagcgaagagugugg

SEQ ID NO: 866671 - RNA, 23 nt, Human
ccccuaagacucugcaguugccu

SEQ ID NO: 866672 - RNA, 22 nt, Human
ccuacuauguuccaaacaccaa

SEQ ID NO: 866673 - RNA, 22 nt, Human
ccugauuaugggccaguagcac

SEQ ID NO: 866674 - RNA, 24 nt, Human
gaaaaagaaguaaucgacauaaaa

SEQ ID NO: 866675 - RNA, 19 nt, Human
gaagacauuugacaaaacu

SEQ ID NO: 866676 - RNA, 18 nt, Human
gcacaacacaucauagcc

SEQ ID NO: 866677 - RNA, 18 nt, Human
gccaagaaaaagaaguaa

SEQ ID NO: 866678 - RNA, 20 nt, Human
gcuuacauaacauauucuac

SEQ ID NO: 866679 - RNA, 20 nt, Human
ggaccaggaacaaggcaaga

SEQ ID NO: 866680 - RNA, 20 nt, Human
gucuucucuccucaggccuu

SEQ ID NO: 866681 - RNA, 23 nt, Human
uaaaagcacaacacaucauagcc

SEQ ID NO: 866682 - RNA, 26 nt, Human
uaaaauaaaaagacugacuugaaagg

SEQ ID NO: 866683 - RNA, 21 nt, Human
uaaaaucuacaauuaacacau

SEQ ID NO: 866684 - RNA, 23 nt, Human
uaacugacccaaggucaaacaga

SEQ ID NO: 866685 - RNA, 23 nt, Human
uaagccaagaaaaagaaguaauc

SEQ ID NO: 866686 - RNA, 23 nt, Human
ucaacauuuacugaagauccugg

SEQ ID NO: 866687 - RNA, 24 nt, Human
ucagcaugacuaugugucuucucu

SEQ ID NO: 866688 - RNA, 18 nt, Human
uccaaacaccaacggaag

SEQ ID NO: 866689 - RNA, 19 nt, Human
uccagacaaagaaacuaag

SEQ ID NO: 866690 - RNA, 23 nt, Human
uccaugugaguugacuucccagg

SEQ ID NO: 866691 - RNA, 18 nt, Human
uccucacugcuggccauc

SEQ ID NO: 866692 - RNA, 20 nt, Human
ucgacauaaaaauuagaaag

SEQ ID NO: 866693 - RNA, 21 nt, Human
ugacaaaacuucaauacaugu

SEQ ID NO: 866694 - RNA, 24 nt, Human
ugacccaaggucaaacagauauua

SEQ ID NO: 866695 - RNA, 23 nt, Human
uggaaauauaaauuaauaugaug

SEQ ID NO: 866696 - RNA, 20 nt, Human
ugugcagucuugcugcacgg

SEQ ID NO: 866697 - RNA, 20 nt, Human
ugugcagucuugcugcacgu

SEQ ID NO: 866698 - RNA, 22 nt, Human
uuagauaacccccuaagacucu

SEQ ID NO: 866699 - RNA, 18 nt, Human
uuaguauagacaagugaa

SEQ ID NO: 866700 - RNA, 22 nt, Human
uuccucacugcuggccaucauu

SEQ ID NO: 866701 - RNA, 23 nt, Human
uuugacaaaacuucaauacaugu

SEQ ID NO: 866702 - RNA, 28 nt, Human
uuuuuuuuuuuuuuuuuuuuuuuggggg

SEQ ID NO: 866703 - RNA, 22 nt, Human
cacggcgagucacucucagcac

SEQ ID NO: 866704 - RNA, 23 nt, Human
cacggcgagucacucucagcaca

SEQ ID NO: 866705 - RNA, 19 nt, Human
cagcaccacuuggaaaccg

SEQ ID NO: 866706 - RNA, 20 nt, Human
cccggaccagaaccuggcuu

SEQ ID NO: 866707 - RNA, 20 nt, Human
ccucagggaaaagcacugug

SEQ ID NO: 866708 - RNA, 18 nt, Human
cucccuucagucugcagc

SEQ ID NO: 866709 - RNA, 18 nt, Human
cugucccccgcccucagg

SEQ ID NO: 866710 - RNA, 21 nt, Human
gcgggacagcaggagaccacg

SEQ ID NO: 866711 - RNA, 23 nt, Human
ggaccagaaccuggcuuccugga

SEQ ID NO: 866712 - RNA, 21 nt, Human
ggaggugagugcccuaagccc

SEQ ID NO: 866713 - RNA, 20 nt, Human
uacccggaccagaaccuggc

SEQ ID NO: 866714 - RNA, 21 nt, Human
uccccacggcgagucacucuu

SEQ ID NO: 866715 - RNA, 21 nt, Human
uccuggauccagggguguccu

SEQ ID NO: 866716 - RNA, 21 nt, Human
ucugggugaaaugaucagccu

SEQ ID NO: 866717 - RNA, 26 nt, Human
ugaccaaaagauuccuguggaaacag

SEQ ID NO: 866718 - RNA, 23 nt, Human
uucuuucuugccguugcucccuu

SEQ ID NO: 866719 - RNA, 24 nt, Human
uuucuugccguugcucccuucagu

SEQ ID NO: 866720 - RNA, 22 nt, Human
aaaaaaccagacaacaaaaaac

SEQ ID NO: 866721 - RNA, 25 nt, Human
aaacaaaaaaaccagacaacaaaaa

SEQ ID NO: 866722 - RNA, 27 nt, Human
aaacaaaaaaaccagacaacaaaaaaa

SEQ ID NO: 866723 - RNA, 21 nt, Human
aaacaaacaaacaaaaaaacc

SEQ ID NO: 866724 - RNA, 23 nt, Human
aaaucaccuacucaaaaagcaga

SEQ ID NO: 866725 - RNA, 20 nt, Human
aacaaaaaaaccagacaaca

SEQ ID NO: 866726 - RNA, 25 nt, Human
aacaaacaaaaaaaccagacaacaa

SEQ ID NO: 866727 - RNA, 28 nt, Human
aacacucuugcuaacaauuuagugucua

SEQ ID NO: 866728 - RNA, 19 nt, Human
aaccagacaacaaaaaacu

SEQ ID NO: 866729 - RNA, 18 nt, Human
aagcagacucagaaaccc

SEQ ID NO: 866730 - RNA, 21 nt, Human
aaugaauggcucccaaaguca

SEQ ID NO: 866731 - RNA, 27 nt, Human
acaaacaaaaaaaccagacaacaaaaa

SEQ ID NO: 866732 - RNA, 18 nt, Human
acaacaaaaaacucaaca

SEQ ID NO: 866733 - RNA, 21 nt, Human
acaacaaaaaacucaacaagc

SEQ ID NO: 866734 - RNA, 23 nt, Human
accaggaacuagcucaacacucu

SEQ ID NO: 866735 - RNA, 24 nt, Human
agcagacucagaaacccaagguuu

SEQ ID NO: 866736 - RNA, 24 nt, Human
agccgaacagcacaaucaugcaga

SEQ ID NO: 866737 - RNA, 18 nt, Human
aggaaggcuggugucucu

SEQ ID NO: 866738 - RNA, 18 nt, Human
aggauuucaaaaaccacc

SEQ ID NO: 866739 - RNA, 24 nt, Human
agguggcccguuccuuaaagccuu

SEQ ID NO: 866740 - RNA, 21 nt, Human
aguagacagcauuucaauuca

SEQ ID NO: 866741 - RNA, 24 nt, Human
aucaccuacucaaaaagcagacuc

SEQ ID NO: 866742 - RNA, 21 nt, Human
auuuuggcaacaaaaccagga

SEQ ID NO: 866743 - RNA, 24 nt, Human
caaaggggucaaggcagaggaaag

SEQ ID NO: 866744 - RNA, 21 nt, Human
caacaaaaccaggauucccuu

SEQ ID NO: 866745 - RNA, 23 nt, Human
caaccucaaaaucaccuacucaa

SEQ ID NO: 866746 - RNA, 24 nt, Human
caagcaaaucacacaguuguggga

SEQ ID NO: 866747 - RNA, 24 nt, Human
caccaggaacuagcucaacacucu

SEQ ID NO: 866748 - RNA, 20 nt, Human
cacugaguggccaagcagac

SEQ ID NO: 866749 - RNA, 18 nt, Human
cagggccccuggccgggc

SEQ ID NO: 866750 - RNA, 19 nt, Human
ccaccaacauucaggcuca

SEQ ID NO: 866751 - RNA, 19 nt, Human
cccgggaaagugaguuccu

SEQ ID NO: 866752 - RNA, 21 nt, Human
cccuggccgggcccagaggcc

SEQ ID NO: 866753 - RNA, 20 nt, Human
cccuuaauauccccacaacu

SEQ ID NO: 866754 - RNA, 22 nt, Human
ccuccagguuuaccuccaaguc

SEQ ID NO: 866755 - RNA, 21 nt, Human
cgaacagcacaaucaugcaga

SEQ ID NO: 866756 - RNA, 23 nt, Human
cgcugggauucaagagccgaaca

SEQ ID NO: 866757 - RNA, 18 nt, Human
cuagaugaaggccccugg

SEQ ID NO: 866758 - RNA, 20 nt, Human
cucaacacucuugcuaacaa

SEQ ID NO: 866759 - RNA, 27 nt, Human
cucagcaaguaacacugaauguccaaa

SEQ ID NO: 866760 - RNA, 22 nt, Human
cuccugaaacccuuucaguaga

SEQ ID NO: 866761 - RNA, 20 nt, Human
cuggaaaaugcuguauuucc

SEQ ID NO: 866762 - RNA, 22 nt, Human
cuuaauauccccacaacugcuc

SEQ ID NO: 866763 - RNA, 18 nt, Human
gaaaaugcuguauuuccu

SEQ ID NO: 866764 - RNA, 22 nt, Human
ggccaagcagacccuguuggga

SEQ ID NO: 866765 - RNA, 20 nt, Human
gggccccuggccgggcccag

SEQ ID NO: 866766 - RNA, 24 nt, Human
guaacacugaauguccaaaaauac

SEQ ID NO: 866767 - RNA, 25 nt, Human
uaaacaaacaaacaaaaaaaccaga

SEQ ID NO: 866768 - RNA, 22 nt, Human
uaacaaaggggucaaggcagag

SEQ ID NO: 866769 - RNA, 22 nt, Human
uaccuccaagucaggauuucaa

SEQ ID NO: 866770 - RNA, 25 nt, Human
uauuuacuuuuuuuccuuccuccag

SEQ ID NO: 866771 - RNA, 19 nt, Human
ucaaaaucaccuacucaaa

SEQ ID NO: 866772 - RNA, 19 nt, Human
uccuuuuuagaaaugaggu

SEQ ID NO: 866773 - RNA, 19 nt, Human
ucuauggggaaugcaauuu

SEQ ID NO: 866774 - RNA, 18 nt, Human
ucucuguuacagguggcc

SEQ ID NO: 866775 - RNA, 19 nt, Human
ucuguggaaacacuucacc

SEQ ID NO: 866776 - RNA, 19 nt, Human
ugaauggcucccaaaguca

SEQ ID NO: 866777 - RNA, 24 nt, Human
ugguauaaacaaacaaacaaaaaa

SEQ ID NO: 866778 - RNA, 21 nt, Human
uguacaaugaauggcucccaa

SEQ ID NO: 866779 - RNA, 25 nt, Human
uguccaaaaauacggcuguguuaaa

SEQ ID NO: 866780 - RNA, 24 nt, Human
uuacauaaacgcuccugaaacccu

SEQ ID NO: 866781 - RNA, 21 nt, Human
uuaggguuaaucgcagcugca

SEQ ID NO: 866782 - RNA, 23 nt, Human
uucaauucagagaccaaagugaa

SEQ ID NO: 866783 - RNA, 23 nt, Human
uuuuuuuuuuuuuuuuuuccuuu

SEQ ID NO: 866784 - RNA, 25 nt, Human
uuuuuuuuuuuuuuuuuuccuuuuu

SEQ ID NO: 866785 - RNA, 27 nt, Human
uuuuuuuuuuuuuuuuuuccuuuuuag

SEQ ID NO: 866786 - RNA, 22 nt, Human
aaaauuccccugugcccagccc

SEQ ID NO: 866787 - RNA, 27 nt, Human
aaagacccccccaggaauuccacaccc

SEQ ID NO: 866788 - RNA, 21 nt, Human
aacggggcagcaaaggagccc

SEQ ID NO: 866789 - RNA, 26 nt, Human
acccuggagccgcuugcgugcguccu

SEQ ID NO: 866790 - RNA, 18 nt, Human
acgcaccgauccugcgag

SEQ ID NO: 866791 - RNA, 23 nt, Human
agagaaacacagaacucagcacg

SEQ ID NO: 866792 - RNA, 19 nt, Human
aggcaggguuacccgcugc

SEQ ID NO: 866793 - RNA, 19 nt, Human
agugggugcgggggugggc

SEQ ID NO: 866794 - RNA, 23 nt, Human
augcugcugcccugagacccccu

SEQ ID NO: 866795 - RNA, 21 nt, Human
auuagugggugcggggguggg

SEQ ID NO: 866796 - RNA, 22 nt, Human
cacagaacucagcacgcucagg

SEQ ID NO: 866797 - RNA, 21 nt, Human
cagaacaaggcaggguuaccc

SEQ ID NO: 866798 - RNA, 22 nt, Human
cagaauagagauguucugagga

SEQ ID NO: 866799 - RNA, 20 nt, Human
caggaaaagcagaauuagug

SEQ ID NO: 866800 - RNA, 22 nt, Human
ccccaggaauuccacaccccuc

SEQ ID NO: 866801 - RNA, 22 nt, Human
ccccccaggaauuccacacccc

SEQ ID NO: 866802 - RNA, 21 nt, Human
ccccugugcccagccccacga

SEQ ID NO: 866803 - RNA, 21 nt, Human
cccuaggagcccugggugaca

SEQ ID NO: 866804 - RNA, 24 nt, Human
cccugugcccagccccacgacucc

SEQ ID NO: 866805 - RNA, 23 nt, Human
ccgcgccggcgaaacgucaccac

SEQ ID NO: 866806 - RNA, 21 nt, Human
ccuccgcugccugcacaucug

SEQ ID NO: 866807 - RNA, 18 nt, Human
ccugugcccagccccacg

SEQ ID NO: 866808 - RNA, 24 nt, Human
ccuucuaagcauucuucagagcag

SEQ ID NO: 866809 - RNA, 19 nt, Human
cgcgcguggcggggacgua

SEQ ID NO: 866810 - RNA, 20 nt, Human
cucaagacuucuaccuaucu

SEQ ID NO: 866811 - RNA, 24 nt, Human
cuggccccucagguuccacaccuc

SEQ ID NO: 866812 - RNA, 20 nt, Human
cuggcggccuugcucgcgcu

SEQ ID NO: 866813 - RNA, 21 nt, Human
gacccccucaaggcaccggga

SEQ ID NO: 866814 - RNA, 24 nt, Human
gccagaauuaaagacccccccagg

SEQ ID NO: 866815 - RNA, 22 nt, Human
ggacaucuggcucuggugucug

SEQ ID NO: 866816 - RNA, 19 nt, Human
gugcgggggugggcugggg

SEQ ID NO: 866817 - RNA, 24 nt, Human
gugggugcgggggugggcuggggu

SEQ ID NO: 866818 - RNA, 21 nt, Human
uagugggugcgggggugggcu

SEQ ID NO: 866819 - RNA, 24 nt, Human
uccacaccucuauucagagaaaca

SEQ ID NO: 866820 - RNA, 24 nt, Human
uccauggaggccuucagagaggcc

SEQ ID NO: 866821 - RNA, 18 nt, Human
uccccugugcccagcccc

SEQ ID NO: 866822 - RNA, 23 nt, Human
ucuuucuccuccuccgcugccug

SEQ ID NO: 866823 - RNA, 21 nt, Human
ugacagaacggggcagcaaag

SEQ ID NO: 866824 - RNA, 22 nt, Human
ugcccagccccacgacuccagc

SEQ ID NO: 866825 - RNA, 22 nt, Human
ugcccugagacccccucaaggc

SEQ ID NO: 866826 - RNA, 24 nt, Human
ugcccugagacccccucaaggcac

SEQ ID NO: 866827 - RNA, 18 nt, Human
ugcccuggcauggcagag

SEQ ID NO: 866828 - RNA, 22 nt, Human
uggccccucagguuccacaccu

SEQ ID NO: 866829 - RNA, 23 nt, Human
uggcggggacguacccuggagcc

SEQ ID NO: 866830 - RNA, 24 nt, Human
uggugggggacaucuggcucuggu

SEQ ID NO: 866831 - RNA, 21 nt, Human
uuagugggugcgggggugggc

SEQ ID NO: 866832 - RNA, 22 nt, Human
uucagagaggccugcuggcccc

SEQ ID NO: 866833 - RNA, 21 nt, Human
uuccccugugcccagccccac

SEQ ID NO: 866834 - RNA, 21 nt, Human
uuucccuuuuuaguaauggug

SEQ ID NO: 866835 - RNA, 25 nt, Human
uuuuuuuuuuuuuuuuucccuuuuu

SEQ ID NO: 866836 - RNA, 29 nt, Human
uuuuuuuuuuuuuuuuuuucccuuuuuag

SEQ ID NO: 866837 - RNA, 21 nt, Human
aagcgccacagcgccucgagc

SEQ ID NO: 866838 - RNA, 22 nt, Human
agccagcgaaucacccucgacc

SEQ ID NO: 866839 - RNA, 18 nt, Human
aggcugcggccacgcguc

SEQ ID NO: 866840 - RNA, 19 nt, Human
aggcugcggccacgcguca

SEQ ID NO: 866841 - RNA, 24 nt, Human
agggaggaggcugcgucaggcccg

SEQ ID NO: 866842 - RNA, 24 nt, Human
agggggaagguugccuggcgacgg

SEQ ID NO: 866843 - RNA, 21 nt, Human
agguggaguuggacagcccca

SEQ ID NO: 866844 - RNA, 23 nt, Human
cacgcugcguucuugggccgcug

SEQ ID NO: 866845 - RNA, 24 nt, Human
cagcgaaucacccucgaccggccc

SEQ ID NO: 866846 - RNA, 22 nt, Human
ccagacaccgcaagggggugcu

SEQ ID NO: 866847 - RNA, 18 nt, Human
cccgaaugagcaccacac

SEQ ID NO: 866848 - RNA, 18 nt, Human
cccgcugaucucagcacu

SEQ ID NO: 866849 - RNA, 19 nt, Human
cccucgaccggccccgaag

SEQ ID NO: 866850 - RNA, 18 nt, Human
cccuuccccaucgccccg

SEQ ID NO: 866851 - RNA, 20 nt, Human
ccgcgccgcuuccuccagaa

SEQ ID NO: 866852 - RNA, 18 nt, Human
cgaccggccccgaagcuc

SEQ ID NO: 866853 - RNA, 19 nt, Human
cgcccuccgggaucacccu

SEQ ID NO: 866854 - RNA, 24 nt, Human
cgcccucgcccugcuccugcuugc

SEQ ID NO: 866855 - RNA, 21 nt, Human
cuaaggccccagccaugacuc

SEQ ID NO: 866856 - RNA, 23 nt, Human
cuccauccgcaugcucagcagcu

SEQ ID NO: 866857 - RNA, 22 nt, Human
cugcuccugcuugcgguucucg

SEQ ID NO: 866858 - RNA, 20 nt, Human
cuggcucugguccuccaucc

SEQ ID NO: 866859 - RNA, 19 nt, Human
cuucccgauucuacugagc

SEQ ID NO: 866860 - RNA, 24 nt, Human
gaguguguagccgcccuccgggau

SEQ ID NO: 866861 - RNA, 20 nt, Human
gcccaggguccaucucggcc

SEQ ID NO: 866862 - RNA, 19 nt, Human
gccccgccucacagugcag

SEQ ID NO: 866863 - RNA, 21 nt, Human
gcccucgcccugcuccugcuu

SEQ ID NO: 866864 - RNA, 19 nt, Human
ggaggaggcugcgucaggc

SEQ ID NO: 866865 - RNA, 23 nt, Human
uaaagccagcgaaucacccucga

SEQ ID NO: 866866 - RNA, 18 nt, Human
uaccagaugccucaguaa

SEQ ID NO: 866867 - RNA, 23 nt, Human
uaggcgcccucgcccugcuccug

SEQ ID NO: 866868 - RNA, 21 nt, Human
ucacccucgaccggccccgaa

SEQ ID NO: 866869 - RNA, 22 nt, Human
ucaggcccgacacgguggagcg

SEQ ID NO: 866870 - RNA, 21 nt, Human
uccaucaccaggcugcggcca

SEQ ID NO: 866871 - RNA, 23 nt, Human
uccaucaccaggcugcggccacg

SEQ ID NO: 866872 - RNA, 22 nt, Human
uccuccagacaccgcaaggggg

SEQ ID NO: 866873 - RNA, 19 nt, Human
uccugggaacucgcccaga

SEQ ID NO: 866874 - RNA, 19 nt, Human
ucgaccggccccgaagcuc

SEQ ID NO: 866875 - RNA, 19 nt, Human
ucgccccgccucacagugc

SEQ ID NO: 866876 - RNA, 20 nt, Human
uggaguuggacagccccagc

SEQ ID NO: 866877 - RNA, 22 nt, Human
uggauucuugcacgcugcguuc

SEQ ID NO: 866878 - RNA, 21 nt, Human
uggcggggcuucggcccuucc

SEQ ID NO: 866879 - RNA, 26 nt, Human
uuaaagccagcgaaucacccucgacc

SEQ ID NO: 866880 - RNA, 21 nt, Human
uucaccuguagguugauggcc

SEQ ID NO: 866881 - RNA, 21 nt, Human
uucagcggccucuucaggccc

SEQ ID NO: 866882 - RNA, 20 nt, Human
uucauggugaacaccagcca

SEQ ID NO: 866883 - RNA, 20 nt, Human
uucauggugaacaccagcca

SEQ ID NO: 866884 - RNA, 19 nt, Human
uuccuccagacaccgcaag

SEQ ID NO: 866885 - RNA, 21 nt, Human
aagaaccaagggcugcaggcg

SEQ ID NO: 866886 - RNA, 18 nt, Human
aagaacuuuuuaccuagc

SEQ ID NO: 866887 - RNA, 24 nt, Human
accgaacuccaccagaggcugcgg

SEQ ID NO: 866888 - RNA, 19 nt, Human
agaggccaacgcaaguaua

SEQ ID NO: 866889 - RNA, 21 nt, Human
agccccaccagcccugaacaa

SEQ ID NO: 866890 - RNA, 19 nt, Human
agccuggcuccccgucccg

SEQ ID NO: 866891 - RNA, 24 nt, Human
agcugcaccuugcgccccagcccc

SEQ ID NO: 866892 - RNA, 19 nt, Human
agggaaaaaacugacgcca

SEQ ID NO: 866893 - RNA, 23 nt, Human
agggaaaaaacugacgccagagg

SEQ ID NO: 866894 - RNA, 21 nt, Human
cacagggaucuuucuccuccc

SEQ ID NO: 866895 - RNA, 19 nt, Human
caccagcccugaacaaggc

SEQ ID NO: 866896 - RNA, 18 nt, Human
caccaugcccuuuaaaac

SEQ ID NO: 866897 - RNA, 25 nt, Human
caccuugcgccccagccccaccagc

SEQ ID NO: 866898 - RNA, 22 nt, Human
cagcugcaccuugcgccccagc

SEQ ID NO: 866899 - RNA, 24 nt, Human
caggacuccucuaguccaaucucc

SEQ ID NO: 866900 - RNA, 19 nt, Human
cagggaucuuucuccuccc

SEQ ID NO: 866901 - RNA, 21 nt, Human
cauugucagcugcaccuugcg

SEQ ID NO: 866902 - RNA, 22 nt, Human
ccaaacucggaaagggccgcgc

SEQ ID NO: 866903 - RNA, 20 nt, Human
ccaccagaggcugcggcucc

SEQ ID NO: 866904 - RNA, 20 nt, Human
ccagaggcugcggcuccucu

SEQ ID NO: 866905 - RNA, 21 nt, Human
ccagaggcugcggcuccucuc

SEQ ID NO: 866906 - RNA, 21 nt, Human
ccccacacccgaccgaacucc

SEQ ID NO: 866907 - RNA, 18 nt, Human
cccggcacugucucggcc

SEQ ID NO: 866908 - RNA, 19 nt, Human
ccgaccgaacuccaccaga

SEQ ID NO: 866909 - RNA, 19 nt, Human
ccgaccgaacuccaccaga

SEQ ID NO: 866910 - RNA, 21 nt, Human
cgaccgaacuccaccagaggc

SEQ ID NO: 866911 - RNA, 22 nt, Human
cgaccgaacuccaccagaggcu

SEQ ID NO: 866912 - RNA, 20 nt, Human
cgcggaggagucagugaccg

SEQ ID NO: 866913 - RNA, 23 nt, Human
cuccaaacauuauuucaccacuc

SEQ ID NO: 866914 - RNA, 20 nt, Human
cucggccggcugugcgaccc

SEQ ID NO: 866915 - RNA, 21 nt, Human
cugauaguuuucuggugcugg

SEQ ID NO: 866916 - RNA, 25 nt, Human
cuguaacacucuuucgggaacagcu

SEQ ID NO: 866917 - RNA, 23 nt, Human
cuguuguguucuguaacacucuu

SEQ ID NO: 866918 - RNA, 22 nt, Human
cuugcgccccagccccaccagc

SEQ ID NO: 866919 - RNA, 18 nt, Human
cuuucgggaacagcuuag

SEQ ID NO: 866920 - RNA, 21 nt, Human
gaaaaaacugacgccagaggc

SEQ ID NO: 866921 - RNA, 24 nt, Human
gaaaaaacugacgccagaggcagg

SEQ ID NO: 866922 - RNA, 22 nt, Human
gaauauuguacaauacuguugu

SEQ ID NO: 866923 - RNA, 19 nt, Human
gcacgaggaaagcgcggag

SEQ ID NO: 866924 - RNA, 19 nt, Human
gccccagccccaccagccc

SEQ ID NO: 866925 - RNA, 19 nt, Human
gcccugaacaaggcgccgg

SEQ ID NO: 866926 - RNA, 24 nt, Human
gcgcggaggagucagugaccgggc

SEQ ID NO: 866927 - RNA, 19 nt, Human
gcuccccgucccggcacug

SEQ ID NO: 866928 - RNA, 21 nt, Human
ggcuccccgucccggcacugu

SEQ ID NO: 866929 - RNA, 21 nt, Human
gggaguuagaggccaacgcaa

SEQ ID NO: 866930 - RNA, 18 nt, Human
guuuccaagaaccaaggg

SEQ ID NO: 866931 - RNA, 22 nt, Human
uaguuguuggugaaauuagaaa

SEQ ID NO: 866932 - RNA, 19 nt, Human
uccaccagaggcugcggcu

SEQ ID NO: 866933 - RNA, 19 nt, Human
ucgcugcaaaacaccaaac

SEQ ID NO: 866934 - RNA, 21 nt, Human
ucggaagagcgagauuuccuu

SEQ ID NO: 866935 - RNA, 19 nt, Human
ucucgcccuggaggacuuu

SEQ ID NO: 866936 - RNA, 20 nt, Human
ugaaagugcuucauaaacug

SEQ ID NO: 866937 - RNA, 21 nt, Human
ugaccgggcgcacucggaagc

SEQ ID NO: 866938 - RNA, 22 nt, Human
ugaccgggcgcacucggaagcc

SEQ ID NO: 866939 - RNA, 21 nt, Human
ugacuacccccacacccgacc

SEQ ID NO: 866940 - RNA, 24 nt, Human
ugaguggaugagggaaaaaacuga

SEQ ID NO: 866941 - RNA, 18 nt, Human
uggugcugggagcaccau

SEQ ID NO: 866942 - RNA, 19 nt, Human
uugcuucuuuccuugacua

SEQ ID NO: 866943 - RNA, 24 nt, Human
aaacuucugggcucaaaugauccu

SEQ ID NO: 866944 - RNA, 21 nt, Human
aacugauuggggagugaggug

SEQ ID NO: 866945 - RNA, 21 nt, Human
acuacaggccugaaauacugu

SEQ ID NO: 866946 - RNA, 19 nt, Human
aguagcugggacuacaggc

SEQ ID NO: 866947 - RNA, 19 nt, Human
aguagcugggacuacaggc

SEQ ID NO: 866948 - RNA, 19 nt, Human
caaaugauccuccugcuuc

SEQ ID NO: 866949 - RNA, 21 nt, Human
cacaguguggcuuggugccaa

SEQ ID NO: 866950 - RNA, 21 nt, Human
cacggacccacgcauggaccc

SEQ ID NO: 866951 - RNA, 20 nt, Human
caggcucaaacuucugggcu

SEQ ID NO: 866952 - RNA, 18 nt, Human
cccgugccugcagcgcgc

SEQ ID NO: 866953 - RNA, 19 nt, Human
ccugcggggaggggcuggu

SEQ ID NO: 866954 - RNA, 20 nt, Human
cgagcuggaaucugcaggug

SEQ ID NO: 866955 - RNA, 19 nt, Human
cuauaauaccaaaccacaa

SEQ ID NO: 866956 - RNA, 23 nt, Human
cuaucucucucucucucucuuuu

SEQ ID NO: 866957 - RNA, 24 nt, Human
cucaaaugauccuccugcuucugc

SEQ ID NO: 866958 - RNA, 24 nt, Human
cucggccuccggaguagcugggac

SEQ ID NO: 866959 - RNA, 24 nt, Human
cucucucucucucucuuuuaacuu

SEQ ID NO: 866960 - RNA, 23 nt, Human
cucucucucucucuuuuaacuga

SEQ ID NO: 866961 - RNA, 23 nt, Human
cugccucggccuccggaguagcu

SEQ ID NO: 866962 - RNA, 22 nt, Human
cugguccauccccggccagcca

SEQ ID NO: 866963 - RNA, 23 nt, Human
cuucugggcucaaaugauccucc

SEQ ID NO: 866964 - RNA, 25 nt, Human
cuucugggcucaaaugauccuccug

SEQ ID NO: 866965 - RNA, 20 nt, Human
gacccagcgacccacggacc

SEQ ID NO: 866966 - RNA, 27 nt, Human
gaguagcugggacuacaggccugaaau

SEQ ID NO: 866967 - RNA, 18 nt, Human
gcgcggguggcccucgug

SEQ ID NO: 866968 - RNA, 19 nt, Human
ggaaauguguacuucuucc

SEQ ID NO: 866969 - RNA, 19 nt, Human
ggagugagguggggggggg

SEQ ID NO: 866970 - RNA, 19 nt, Human
gggcucaaaugauccuccu

SEQ ID NO: 866971 - RNA, 18 nt, Human
ggggagugaggugggggg

SEQ ID NO: 866972 - RNA, 23 nt, Human
ggggagugagguggggggggggg

SEQ ID NO: 866973 - RNA, 24 nt, Human
gggggucuugcuacauugcccagg

SEQ ID NO: 866974 - RNA, 22 nt, Human
gggucuugcuacauugcccagg

SEQ ID NO: 866975 - RNA, 21 nt, Human
gucgagugcacaguguggcuu

SEQ ID NO: 866976 - RNA, 19 nt, Human
uaccugggcgcggcgcggg

SEQ ID NO: 866977 - RNA, 26 nt, Human
uaucucucucucucucucuuuuaaag

SEQ ID NO: 866978 - RNA, 19 nt, Human
ucaaaccucagccauauga

SEQ ID NO: 866979 - RNA, 22 nt, Human
ucaaaugauccuccugcuucug

SEQ ID NO: 866980 - RNA, 18 nt, Human
uccccggccagccacgga

SEQ ID NO: 866981 - RNA, 23 nt, Human
uccccggccagccacggacccac

SEQ ID NO: 866982 - RNA, 24 nt, Human
uccggaguagcugggacuacaggc

SEQ ID NO: 866983 - RNA, 22 nt, Human
ucugggcucaaaugauccuccu

SEQ ID NO: 866984 - RNA, 20 nt, Human
ugaggugggggggggggguc

SEQ ID NO: 866985 - RNA, 21 nt, Human
ugagguggggggggggggucu

SEQ ID NO: 866986 - RNA, 23 nt, Human
ugagguggggggggggggucuug

SEQ ID NO: 866987 - RNA, 23 nt, Human
ugcccaggcucaaacuucugggc

SEQ ID NO: 866988 - RNA, 23 nt, Human
ugccccugcggggaggggcuggu

SEQ ID NO: 866989 - RNA, 23 nt, Human
ugccucagcuucugccucggccu

SEQ ID NO: 866990 - RNA, 24 nt, Human
ugccucggccuccggaguagcugg

SEQ ID NO: 866991 - RNA, 19 nt, Human
ugcuacauugcccaggcuc

SEQ ID NO: 866992 - RNA, 20 nt, Human
uggaaauguguacuucuucc

SEQ ID NO: 866993 - RNA, 19 nt, Human
uggcaugagcuguaguuca

SEQ ID NO: 866994 - RNA, 20 nt, Human
uggcaugagcuguaguucaa

SEQ ID NO: 866995 - RNA, 18 nt, Human
ugggacuacaggccugaa

SEQ ID NO: 866996 - RNA, 19 nt, Human
ugggacuacaggccugaaa

SEQ ID NO: 866997 - RNA, 24 nt, Human
ugggacuacaggccugaaauacug

SEQ ID NO: 866998 - RNA, 24 nt, Human
ugggcucaaaugauccuccugcuu

SEQ ID NO: 866999 - RNA, 23 nt, Human
uggggggggggggucuugcuaca

SEQ ID NO: 867000 - RNA, 20 nt, Human
uuggggagugaggugggggg

SEQ ID NO: 867001 - RNA, 22 nt, Human
uuggggagugaggugggggggg

SEQ ID NO: 867002 - RNA, 23 nt, Human
uuuuuuuuuuuuuuucuguaauu

SEQ ID NO: 867003 - RNA, 23 nt, Human
uuuuuuuuuuuuuuuuuuucugu

SEQ ID NO: 867004 - RNA, 27 nt, Human
uuuuuuuuuuuuuuuuuuuuucugggg

SEQ ID NO: 867005 - RNA, 24 nt, Human
uuuuuuuuuuuuuuuuuuuuucuu

SEQ ID NO: 867006 - RNA, 20 nt, Human
aaaaaaagaguccuggagaa

SEQ ID NO: 867007 - RNA, 22 nt, Human
agaaagagccagagagaauggu

SEQ ID NO: 867008 - RNA, 26 nt, Human
agaggaagacagaaagagccagagag

SEQ ID NO: 867009 - RNA, 20 nt, Human
agccagagagaaugaggagg

SEQ ID NO: 867010 - RNA, 24 nt, Human
agccagagagaaugaggaggugag

SEQ ID NO: 867011 - RNA, 22 nt, Human
agggaggagggugagaagagga

SEQ ID NO: 867012 - RNA, 23 nt, Human
aggggagggaggagggugagaag

SEQ ID NO: 867013 - RNA, 21 nt, Human
ccccgcgcuuggccucgugcc

SEQ ID NO: 867014 - RNA, 22 nt, Human
ccgcugcauuaaauaguuaugu

SEQ ID NO: 867015 - RNA, 25 nt, Human
cgccaggugccgcgcaaaggacucc

SEQ ID NO: 867016 - RNA, 23 nt, Human
cgcuccggccccgcgcuuggccu

SEQ ID NO: 867017 - RNA, 18 nt, Human
cucaagguaaaaaaagag

SEQ ID NO: 867018 - RNA, 28 nt, Human
cucaagguaaaaaaagaguccuggagaa

SEQ ID NO: 867019 - RNA, 23 nt, Human
cugcgggaagcaucucgguuucc

SEQ ID NO: 867020 - RNA, 25 nt, Human
gagccagagagaaugaggaggugag

SEQ ID NO: 867021 - RNA, 21 nt, Human
gaggaagacagaaagagccag

SEQ ID NO: 867022 - RNA, 21 nt, Human
gaggagggugagaagaggaag

SEQ ID NO: 867023 - RNA, 23 nt, Human
gagggaggagggugagaagagga

SEQ ID NO: 867024 - RNA, 23 nt, Human
gagucccaggccaugggcaggug

SEQ ID NO: 867025 - RNA, 23 nt, Human
gccgcgcaaaggacuccgggaag

SEQ ID NO: 867026 - RNA, 23 nt, Human
gggaggagggugagaagaggaag

SEQ ID NO: 867027 - RNA, 24 nt, Human
ggggagggaggagggugagaagag

SEQ ID NO: 867028 - RNA, 20 nt, Human
guccucucagggaaggcugu

SEQ ID NO: 867029 - RNA, 18 nt, Human
ucccaggccaugggcagg

SEQ ID NO: 867030 - RNA, 21 nt, Human
uccgggaaggccgcuccggcc

SEQ ID NO: 867031 - RNA, 19 nt, Human
ugaggaggugagaaggggg

SEQ ID NO: 867032 - RNA, 21 nt, Human
ugaggaggugagaaggggggg

SEQ ID NO: 867033 - RNA, 23 nt, Human
ugcgggaagcaucucgguuuccu

SEQ ID NO: 867034 - RNA, 21 nt, Human
uuuuuuuuuuuuuuuuuccgg

SEQ ID NO: 867035 - RNA, 23 nt, Human
uuuuuuuuuuuuuuuuuuuccgg

SEQ ID NO: 867036 - RNA, 21 nt, Human
aaacaaaaauggauuucagga

SEQ ID NO: 867037 - RNA, 22 nt, Human
aacauacaauauacacacauaa

SEQ ID NO: 867038 - RNA, 18 nt, Human
aggaggaggaggaagggc

SEQ ID NO: 867039 - RNA, 21 nt, Human
aggcggcggcagaggaggagg

SEQ ID NO: 867040 - RNA, 20 nt, Human
aggcggcggcgacugaggag

SEQ ID NO: 867041 - RNA, 18 nt, Human
auacacacauaaaguaca

SEQ ID NO: 867042 - RNA, 24 nt, Human
caacauacaauauacacacauaaa

SEQ ID NO: 867043 - RNA, 27 nt, Human
caaccagcucuuacaccugcucuacca

SEQ ID NO: 867044 - RNA, 19 nt, Human
cacacaauauuauuaauag

SEQ ID NO: 867045 - RNA, 23 nt, Human
cacacauaaaguacaagcagcca

SEQ ID NO: 867046 - RNA, 24 nt, Human
cacacauaaaguacaagcagccac

SEQ ID NO: 867047 - RNA, 20 nt, Human
cacgaagaucuccucccagc

SEQ ID NO: 867048 - RNA, 19 nt, Human
cagcggccgccggcucccc

SEQ ID NO: 867049 - RNA, 21 nt, Human
cagcugccucuccgccccgcu

SEQ ID NO: 867050 - RNA, 19 nt, Human
caggaaccaugcugacauu

SEQ ID NO: 867051 - RNA, 19 nt, Human
caggucccaaggaagaggg

SEQ ID NO: 867052 - RNA, 20 nt, Human
cauaaaaacuaucagcugac

SEQ ID NO: 867053 - RNA, 26 nt, Human
cauacaauauacacacauaaaguacc

SEQ ID NO: 867054 - RNA, 19 nt, Human
cccagggcccgcgccgccc

SEQ ID NO: 867055 - RNA, 21 nt, Human
ccccagagcccugggcggcag

SEQ ID NO: 867056 - RNA, 23 nt, Human
cccccgcagcugccucuccgccc

SEQ ID NO: 867057 - RNA, 21 nt, Human
cccgcagcugccucuccgccc

SEQ ID NO: 867058 - RNA, 18 nt, Human
ccucccagggcccgcgcc

SEQ ID NO: 867059 - RNA, 21 nt, Human
cgaagaucuccucccagcucg

SEQ ID NO: 867060 - RNA, 20 nt, Human
cggauggauugcuaccuggg

SEQ ID NO: 867061 - RNA, 19 nt, Human
cggcccggcgcgggcucag

SEQ ID NO: 867062 - RNA, 20 nt, Human
cggcuccccccgcagcugcc

SEQ ID NO: 867063 - RNA, 18 nt, Human
cggcuggcuccgggcgcc

SEQ ID NO: 867064 - RNA, 21 nt, Human
cgggcggcggcgacugaggag

SEQ ID NO: 867065 - RNA, 19 nt, Human
cgggcucagaggcgcgcgg

SEQ ID NO: 867066 - RNA, 19 nt, Human
cucccagggcccgcgccgc

SEQ ID NO: 867067 - RNA, 24 nt, Human
gagggcgcgggcggcgcgggcggc

SEQ ID NO: 867068 - RNA, 20 nt, Human
gagggucagugaggcuggac

SEQ ID NO: 867069 - RNA, 25 nt, Human
gauaucucucauuacuucaaauccu

SEQ ID NO: 867070 - RNA, 21 nt, Human
gccccagagcccugggcggca

SEQ ID NO: 867071 - RNA, 18 nt, Human
gcccugggcggcagcagc

SEQ ID NO: 867072 - RNA, 28 nt, Human
gcggcagcagcggccgccggcucccccc

SEQ ID NO: 867073 - RNA, 21 nt, Human
gcggcggcgacugaggaggcg

SEQ ID NO: 867074 - RNA, 21 nt, Human
gcggcggcgacugaggaggcg

SEQ ID NO: 867075 - RNA, 26 nt, Human
gcuccccccgcagcugccucuccgcc

SEQ ID NO: 867076 - RNA, 18 nt, Human
ggagguucaagaauccau

SEQ ID NO: 867077 - RNA, 21 nt, Human
ggcaggucccaaggaagaggg

SEQ ID NO: 867078 - RNA, 23 nt, Human
ggcgcgcggagggcgcgggcggc

SEQ ID NO: 867079 - RNA, 18 nt, Human
ggcggcgcgggcggcggc

SEQ ID NO: 867080 - RNA, 18 nt, Human
ggcuccgggcgccccucc

SEQ ID NO: 867081 - RNA, 18 nt, Human
gggcggcgcgggcggcgg

SEQ ID NO: 867082 - RNA, 18 nt, Human
gguucuguguuuuguuug

SEQ ID NO: 867083 - RNA, 20 nt, Human
uaaaguacaagcagccaccg

SEQ ID NO: 867084 - RNA, 22 nt, Human
uacaaaaaagaaauaaggcugc

SEQ ID NO: 867085 - RNA, 18 nt, Human
uaccugggaaaauggacc

SEQ ID NO: 867086 - RNA, 20 nt, Human
ugggaaggggccggcgcggc

SEQ ID NO: 867087 - RNA, 23 nt, Human
ugggaaggggccggcgcggcccg

SEQ ID NO: 867088 - RNA, 21 nt, Human
uugccuguuuguuuucaaugg

SEQ ID NO: 867089 - RNA, 23 nt, Human
uuuuuugccuguuuguuuucaau

SEQ ID NO: 867090 - RNA, 19 nt, Human
aaccgggcagcccccaccc

SEQ ID NO: 867091 - RNA, 20 nt, Human
aaccgggcagcccccacccc

SEQ ID NO: 867092 - RNA, 20 nt, Human
agaugggaagacccagccuu

SEQ ID NO: 867093 - RNA, 20 nt, Human
aggccgggacccgccgggaa

SEQ ID NO: 867094 - RNA, 24 nt, Human
auagaccuuuuuucccaccaguuu

SEQ ID NO: 867095 - RNA, 22 nt, Human
auugcacuaaugcagacaguuu

SEQ ID NO: 867096 - RNA, 21 nt, Human
caaccgggcagcccccacccc

SEQ ID NO: 867097 - RNA, 18 nt, Human
cacccgcgcgagccccgc

SEQ ID NO: 867098 - RNA, 22 nt, Human
cagccuuugguauaaauaacuu

SEQ ID NO: 867099 - RNA, 25 nt, Human
ccagauauuuaaugcaagaugcaau

SEQ ID NO: 867100 - RNA, 22 nt, Human
cccaccccgcucgaacgccgag

SEQ ID NO: 867101 - RNA, 20 nt, Human
ccgcgcgagccccgccgccu

SEQ ID NO: 867102 - RNA, 25 nt, Human
cgcgagcacgcaggcgcgugcacgc

SEQ ID NO: 867103 - RNA, 23 nt, Human
gagagacaaagaaacucuacugg

SEQ ID NO: 867104 - RNA, 18 nt, Human
gcagaggccgggacccgc

SEQ ID NO: 867105 - RNA, 19 nt, Human
gcauuauuccuuuccagca

SEQ ID NO: 867106 - RNA, 24 nt, Human
uaaauaacuuacuuccacaaaaau

SEQ ID NO: 867107 - RNA, 19 nt, Human
uacuauagaccuuuuuucc

SEQ ID NO: 867108 - RNA, 24 nt, Human
uagauaagcuucucucuugugcuu

SEQ ID NO: 867109 - RNA, 24 nt, Human
uauauacuuuagaugagagacaaa

SEQ ID NO: 867110 - RNA, 25 nt, Human
ucucuugugcuuuuucuacuuuggg

SEQ ID NO: 867111 - RNA, 20 nt, Human
ugauagauaagcuucucucu

SEQ ID NO: 867112 - RNA, 22 nt, Human
ugggaagacccagccuuuggua

SEQ ID NO: 867113 - RNA, 22 nt, Human
ugugcuuuuucuacuuugggag

SEQ ID NO: 867114 - RNA, 25 nt, Human
uuagaugggaagacccagccuuugg

SEQ ID NO: 867115 - RNA, 19 nt, Human
uuccuuuccagcagcgcca

SEQ ID NO: 867116 - RNA, 19 nt, Human
uugauagauaagcuucucu

SEQ ID NO: 867117 - RNA, 21 nt, Human
uugauagauaagcuucucucu

SEQ ID NO: 867118 - RNA, 23 nt, Human
uugugcuuuuucuacuuugggag

SEQ ID NO: 867119 - RNA, 25 nt, Human
uuuacuauagaccuuuuuucccacc

SEQ ID NO: 867120 - RNA, 18 nt, Human
uuuuuuuuuuuuuuuuug

SEQ ID NO: 867121 - RNA, 25 nt, Human
uuuuuuuuuuuuuuuuuugaauuuu

SEQ ID NO: 867122 - RNA, 25 nt, Human
aaaagaaagaagaaaagagaaaaaa

SEQ ID NO: 867123 - RNA, 21 nt, Human
aaaagaggaaaagaaagaaga

SEQ ID NO: 867124 - RNA, 21 nt, Human
aaacccccuugagugcuccuc

SEQ ID NO: 867125 - RNA, 23 nt, Human
aaacugcaacggaccaccauuua

SEQ ID NO: 867126 - RNA, 23 nt, Human
aaagagaaaaaagaaaaaagggg

SEQ ID NO: 867127 - RNA, 23 nt, Human
aaaggaaaagacacagaguacau

SEQ ID NO: 867128 - RNA, 19 nt, Human
aagagcgugaaguucacag

SEQ ID NO: 867129 - RNA, 23 nt, Human
aauccugucccccugcucagaac

SEQ ID NO: 867130 - RNA, 24 nt, Human
acaacaauaaauaagugcagguac

SEQ ID NO: 867131 - RNA, 22 nt, Human
accagagccuuccuguaaacca

SEQ ID NO: 867132 - RNA, 21 nt, Human
accauuuacacaagucacacc

SEQ ID NO: 867133 - RNA, 19 nt, Human
agaaaagagaaaaaagaaa

SEQ ID NO: 867134 - RNA, 22 nt, Human
agaaagaagaaaagagaaaaaa

SEQ ID NO: 867135 - RNA, 23 nt, Human
agaaagaagaaaagagaaaaaag

SEQ ID NO: 867136 - RNA, 24 nt, Human
agaggaaaagaaagaagaaaagag

SEQ ID NO: 867137 - RNA, 19 nt, Human
agcuccuccacacacgccc

SEQ ID NO: 867138 - RNA, 18 nt, Human
aggaaaagaaagaagaaa

SEQ ID NO: 867139 - RNA, 21 nt, Human
aggcacaacucagccaggccu

SEQ ID NO: 867140 - RNA, 23 nt, Human
auggaacaguuaaaaaaacaaaa

SEQ ID NO: 867141 - RNA, 21 nt, Human
cacaccaaaaucaacugacac

SEQ ID NO: 867142 - RNA, 20 nt, Human
cacuugcuguaagauaagug

SEQ ID NO: 867143 - RNA, 22 nt, Human
cagcuccuccacacacgcccaa

SEQ ID NO: 867144 - RNA, 19 nt, Human
caguuaaaaaaacaaaaaa

SEQ ID NO: 867145 - RNA, 24 nt, Human
cauugccaugaaccauuuacacaa

SEQ ID NO: 867146 - RNA, 19 nt, Human
ccacucuaaaggaaaagac

SEQ ID NO: 867147 - RNA, 22 nt, Human
ccagagccuuccuguaaaccau

SEQ ID NO: 867148 - RNA, 23 nt, Human
ccagcccuuucuggaaccaggaa

SEQ ID NO: 867149 - RNA, 18 nt, Human
ccgaaacgauuaugcccc

SEQ ID NO: 867150 - RNA, 21 nt, Human
ccucaucaauccugucccccu

SEQ ID NO: 867151 - RNA, 20 nt, Human
ccugggaagaccaaaccccc

SEQ ID NO: 867152 - RNA, 22 nt, Human
ccugggaagaccaaacccccuu

SEQ ID NO: 867153 - RNA, 22 nt, Human
ccuuccuguaaaccaugagagc

SEQ ID NO: 867154 - RNA, 18 nt, Human
cgaaacgauuaugccccc

SEQ ID NO: 867155 - RNA, 18 nt, Human
cgggaggacccgacugcg

SEQ ID NO: 867156 - RNA, 18 nt, Human
cucaggcccucuuccugg

SEQ ID NO: 867157 - RNA, 24 nt, Human
cuccuccacacacgcccaacugag

SEQ ID NO: 867158 - RNA, 21 nt, Human
cuguaaaccaugagagcuuac

SEQ ID NO: 867159 - RNA, 19 nt, Human
cuguaagaauaguguucca

SEQ ID NO: 867160 - RNA, 19 nt, Human
cuguagcaguuccacaggc

SEQ ID NO: 867161 - RNA, 19 nt, Human
gaaaggcauucuguaagaa

SEQ ID NO: 867162 - RNA, 19 nt, Human
gcacaacucagccaggccu

SEQ ID NO: 867163 - RNA, 19 nt, Human
gcuccuccacacacgccca

SEQ ID NO: 867164 - RNA, 24 nt, Human
ggaaccagagccuuccuguaaacc

SEQ ID NO: 867165 - RNA, 20 nt, Human
gggcgggaggacccgacugc

SEQ ID NO: 867166 - RNA, 24 nt, Human
gggcgggaggacccgacugcgggg

SEQ ID NO: 867167 - RNA, 21 nt, Human
gucaaagucugggguugaaga

SEQ ID NO: 867168 - RNA, 28 nt, Human
uauacagucaaagucugggguugaagag

SEQ ID NO: 867169 - RNA, 23 nt, Human
ucacaccaaaaucaacugacaca

SEQ ID NO: 867170 - RNA, 26 nt, Human
ucagccaggccuaggaagcaacccaa

SEQ ID NO: 867171 - RNA, 25 nt, Human
ucaggcccucuuccugggaagacca

SEQ ID NO: 867172 - RNA, 22 nt, Human
uccacacacgcccaacugagca

SEQ ID NO: 867173 - RNA, 21 nt, Human
uccacaggcccucuuggcccu

SEQ ID NO: 867174 - RNA, 21 nt, Human
uccaucuuguacauaaagaaa

SEQ ID NO: 867175 - RNA, 24 nt, Human
ucuaaaggaaaagacacagaguac

SEQ ID NO: 867176 - RNA, 19 nt, Human
ucugggguugaagagcgug

SEQ ID NO: 867177 - RNA, 20 nt, Human
ugaaguucacagcuccucca

SEQ ID NO: 867178 - RNA, 24 nt, Human
uguaagaauaguguuccagaguua

SEQ ID NO: 867179 - RNA, 21 nt, Human
uuaggcacaacucagccaggc

SEQ ID NO: 867180 - RNA, 21 nt, Human
uuggggaaaaagaggaaaaga

SEQ ID NO: 867181 - RNA, 19 nt, Human
uuguacauaaagaaagaaa

SEQ ID NO: 867182 - RNA, 25 nt, Human
uuuuuuuuuuuuuuuuuuucuuuuu

SEQ ID NO: 867183 - RNA, 18 nt, Human
aaaaggagagccacccac

SEQ ID NO: 867184 - RNA, 20 nt, Human
aaacaaaaggagagccaccc

SEQ ID NO: 867185 - RNA, 19 nt, Human
aacucccgccucuggcacc

SEQ ID NO: 867186 - RNA, 20 nt, Human
aaggagccacggggcugggu

SEQ ID NO: 867187 - RNA, 22 nt, Human
aaugcaggcccugaugaggagg

SEQ ID NO: 867188 - RNA, 20 nt, Human
aaugggguguggacugagug

SEQ ID NO: 867189 - RNA, 19 nt, Human
acaaaccaaugaauaugac

SEQ ID NO: 867190 - RNA, 22 nt, Human
acccuaaggccaaucaaggagc

SEQ ID NO: 867191 - RNA, 19 nt, Human
accuucucagaaccucaaa

SEQ ID NO: 867192 - RNA, 19 nt, Human
acucuuugucaggucucag

SEQ ID NO: 867193 - RNA, 23 nt, Human
acuucgugcugggcccccccagg

SEQ ID NO: 867194 - RNA, 21 nt, Human
agaggggagcagcuguguccu

SEQ ID NO: 867195 - RNA, 20 nt, Human
agcagcagcugaguugccaa

SEQ ID NO: 867196 - RNA, 18 nt, Human
agcagcgggagagggaac

SEQ ID NO: 867197 - RNA, 22 nt, Human
agccaugaccucugaacccaga

SEQ ID NO: 867198 - RNA, 18 nt, Human
agccugcagccccugccu

SEQ ID NO: 867199 - RNA, 22 nt, Human
aggaggugaugggaaggucaag

SEQ ID NO: 867200 - RNA, 19 nt, Human
aggcagcagaacucacccu

SEQ ID NO: 867201 - RNA, 24 nt, Human
aggccagguucugaccuccaggug

SEQ ID NO: 867202 - RNA, 25 nt, Human
aggccagguucugaccuccaggugu

SEQ ID NO: 867203 - RNA, 19 nt, Human
aggcugagccugcagcccc

SEQ ID NO: 867204 - RNA, 22 nt, Human
aguuacaagaaaauaaagcuga

SEQ ID NO: 867205 - RNA, 24 nt, Human
auccuguuccccucccccagccca

SEQ ID NO: 867206 - RNA, 19 nt, Human
augaccucugaacccagaa

SEQ ID NO: 867207 - RNA, 26 nt, Human
caaaaggagagccacccacggagaua

SEQ ID NO: 867208 - RNA, 19 nt, Human
caaacccugaggcacucag

SEQ ID NO: 867209 - RNA, 22 nt, Human
caacucaagucuuggccugccu

SEQ ID NO: 867210 - RNA, 21 nt, Human
caccaccucugggaaccacca

SEQ ID NO: 867211 - RNA, 20 nt, Human
cacgcagcaguugggaaggu

SEQ ID NO: 867212 - RNA, 20 nt, Human
cacucccagcugcaaccaug

SEQ ID NO: 867213 - RNA, 22 nt, Human
cagaacacauggaagcagcagc

SEQ ID NO: 867214 - RNA, 21 nt, Human
caggcccucccugccagggug

SEQ ID NO: 867215 - RNA, 22 nt, Human
caggcccugaugaggaggugau

SEQ ID NO: 867216 - RNA, 20 nt, Human
cagguucugaccuccaggug

SEQ ID NO: 867217 - RNA, 21 nt, Human
cauccuguuccccucccccag

SEQ ID NO: 867218 - RNA, 23 nt, Human
caugaggggcacauagcaagcac

SEQ ID NO: 867219 - RNA, 23 nt, Human
ccaaggcccccuccacuauggac

SEQ ID NO: 867220 - RNA, 21 nt, Human
ccagaacacauggaagcagca

SEQ ID NO: 867221 - RNA, 22 nt, Human
ccagaacacauggaagcagcag

SEQ ID NO: 867222 - RNA, 23 nt, Human
ccagcacagggccaggcacacag

SEQ ID NO: 867223 - RNA, 21 nt, Human
ccagcccacucccagcugcaa

SEQ ID NO: 867224 - RNA, 23 nt, Human
ccagugcccagcacagggccagg

SEQ ID NO: 867225 - RNA, 19 nt, Human
ccaguuccccaaguagacc

SEQ ID NO: 867226 - RNA, 19 nt, Human
cccacauuuccaauggggu

SEQ ID NO: 867227 - RNA, 22 nt, Human
cccacucccagcugcaaccaug

SEQ ID NO: 867228 - RNA, 19 nt, Human
cccagcacagggccaggca

SEQ ID NO: 867229 - RNA, 30 nt, Human
ccccaaguagaccgcacuccuggccaccaa

SEQ ID NO: 867230 - RNA, 26 nt, Human
ccccgcccuaccuuucggccuccccc

SEQ ID NO: 867231 - RNA, 19 nt, Human
cccugagauaggagggccc

SEQ ID NO: 867232 - RNA, 20 nt, Human
cccugaggcacucagggcuc

SEQ ID NO: 867233 - RNA, 19 nt, Human
cccugccagggugguuggg

SEQ ID NO: 867234 - RNA, 18 nt, Human
ccuagcccugacacaggu

SEQ ID NO: 867235 - RNA, 25 nt, Human
ccucccccagcccacucccagcugc

SEQ ID NO: 867236 - RNA, 21 nt, Human
ccucugggaaccaccaucauc

SEQ ID NO: 867237 - RNA, 24 nt, Human
ccugaggcuuucaaaacccagaac

SEQ ID NO: 867238 - RNA, 19 nt, Human
ccugcagccccugccuccu

SEQ ID NO: 867239 - RNA, 21 nt, Human
ccuguuccccucccccagccc

SEQ ID NO: 867240 - RNA, 25 nt, Human
cgccucuggcaccugguuugugcuc

SEQ ID NO: 867241 - RNA, 22 nt, Human
cuauggacucugccaggugagg

SEQ ID NO: 867242 - RNA, 20 nt, Human
cucaauaaagauuuauuaca

SEQ ID NO: 867243 - RNA, 18 nt, Human
cucauugggaagauggga

SEQ ID NO: 867244 - RNA, 20 nt, Human
cuccacuauggacucugcca

SEQ ID NO: 867245 - RNA, 20 nt, Human
cuccuagcccugacacaggu

SEQ ID NO: 867246 - RNA, 20 nt, Human
cuggcaccugguuugugcuc

SEQ ID NO: 867247 - RNA, 18 nt, Human
cuguuccccucccccagc

SEQ ID NO: 867248 - RNA, 22 nt, Human
cuucacuuuccucaucgcuaaa

SEQ ID NO: 867249 - RNA, 19 nt, Human
cuucgugcugggccccccc

SEQ ID NO: 867250 - RNA, 22 nt, Human
cuugaccuucucagaaccucaa

SEQ ID NO: 867251 - RNA, 23 nt, Human
gaacccagaacacauggaagcag

SEQ ID NO: 867252 - RNA, 18 nt, Human
gaaccccugagagacccu

SEQ ID NO: 867253 - RNA, 21 nt, Human
gaacuccugcacacccuucaa

SEQ ID NO: 867254 - RNA, 20 nt, Human
gaagacagaggacaggccag

SEQ ID NO: 867255 - RNA, 24 nt, Human
gcacagggccaggcacacaguggu

SEQ ID NO: 867256 - RNA, 18 nt, Human
gcagaacucacccucagg

SEQ ID NO: 867257 - RNA, 20 nt, Human
gcagaacucacccucaggag

SEQ ID NO: 867258 - RNA, 21 nt, Human
gcccagcacagggccaggcac

SEQ ID NO: 867259 - RNA, 19 nt, Human
gccugagaauccagcugcu

SEQ ID NO: 867260 - RNA, 22 nt, Human
gcugcuggggcugcccuugacc

SEQ ID NO: 867261 - RNA, 21 nt, Human
ggcaccugguuugugcucuga

SEQ ID NO: 867262 - RNA, 18 nt, Human
ggcccagccugagaaucc

SEQ ID NO: 867263 - RNA, 19 nt, Human
ggcccccccaggugaagcu

SEQ ID NO: 867264 - RNA, 18 nt, Human
ggcugggaugugacuucg

SEQ ID NO: 867265 - RNA, 19 nt, Human
gggagcagcuguguccuug

SEQ ID NO: 867266 - RNA, 19 nt, Human
ggggcaugaaaaaaaacuc

SEQ ID NO: 867267 - RNA, 18 nt, Human
ggugacagcagcgaggaa

SEQ ID NO: 867268 - RNA, 23 nt, Human
ggugaugggaaggucaaggggcu

SEQ ID NO: 867269 - RNA, 22 nt, Human
ggugcacgggaacgucugcuga

SEQ ID NO: 867270 - RNA, 24 nt, Human
gugcugggcccccccaggugaagc

SEQ ID NO: 867271 - RNA, 18 nt, Human
guggguggcaagaagaca

SEQ ID NO: 867272 - RNA, 22 nt, Human
uaaaacaaaaggagagccaccc

SEQ ID NO: 867273 - RNA, 20 nt, Human
uaaggccaaucaaggagcca

SEQ ID NO: 867274 - RNA, 26 nt, Human
uagcaagcacuccauaaaugcaggcc

SEQ ID NO: 867275 - RNA, 21 nt, Human
ucagaccaggcccucccugcc

SEQ ID NO: 867276 - RNA, 19 nt, Human
ucagagugcugugggccug

SEQ ID NO: 867277 - RNA, 19 nt, Human
uccagugggaggaaggggg

SEQ ID NO: 867278 - RNA, 21 nt, Human
uccauugccaaacccugaggc

SEQ ID NO: 867279 - RNA, 19 nt, Human
ucccccagcccacucccag

SEQ ID NO: 867280 - RNA, 21 nt, Human
uccccucccccagcccacucc

SEQ ID NO: 867281 - RNA, 24 nt, Human
ucugccaggugaggggcccagccu

SEQ ID NO: 867282 - RNA, 19 nt, Human
ucugucuuaggcugacgca

SEQ ID NO: 867283 - RNA, 18 nt, Human
ugacagcagcgaggaagc

SEQ ID NO: 867284 - RNA, 25 nt, Human
ugacagcagcgaggaagcugugaag

SEQ ID NO: 867285 - RNA, 18 nt, Human
ugaccuccagguguggag

SEQ ID NO: 867286 - RNA, 24 nt, Human
ugcacgggaacgucugcugaugcc

SEQ ID NO: 867287 - RNA, 19 nt, Human
ugccagggugguuggggca

SEQ ID NO: 867288 - RNA, 22 nt, Human
ugccaggugaggggcccagccu

SEQ ID NO: 867289 - RNA, 20 nt, Human
ugccaugaggggcacauagc

SEQ ID NO: 867290 - RNA, 19 nt, Human
ugccaugcuggccggccug

SEQ ID NO: 867291 - RNA, 19 nt, Human
ugcccagcacagggccagg

SEQ ID NO: 867292 - RNA, 22 nt, Human
ugcccccugggcugggcauccu

SEQ ID NO: 867293 - RNA, 24 nt, Human
ugcugggcccccccaggugaagcu

SEQ ID NO: 867294 - RNA, 24 nt, Human
ugggaagguuggccugaggcuuuc

SEQ ID NO: 867295 - RNA, 19 nt, Human
ugggagggcugugccuguu

SEQ ID NO: 867296 - RNA, 19 nt, Human
uggggcugggaugugacuu

SEQ ID NO: 867297 - RNA, 20 nt, Human
uguccagugggaggaagggg

SEQ ID NO: 867298 - RNA, 20 nt, Human
uguugaggggugggggcugg

SEQ ID NO: 867299 - RNA, 19 nt, Human
uuccccaaguagaccgcac

SEQ ID NO: 867300 - RNA, 20 nt, Human
uucuguggccauacagugcu

SEQ ID NO: 867301 - RNA, 23 nt, Human
uuggggcaugaaaaaaaacucuu

SEQ ID NO: 867302 - RNA, 22 nt, Human
uuuucacagaugauggcuccug

SEQ ID NO: 867303 - RNA, 21 nt, Human
caccgcacgcuucccaccaac

SEQ ID NO: 867304 - RNA, 20 nt, Human
cauccgggaucccucgugcc

SEQ ID NO: 867305 - RNA, 19 nt, Human
ccaccaacuugauccacau

SEQ ID NO: 867306 - RNA, 19 nt, Human
ccgcacgcuucccaccaac

SEQ ID NO: 867307 - RNA, 20 nt, Human
ucccaccaacuugauccaca

SEQ ID NO: 867308 - RNA, 19 nt, Human
uuuuuuuuuuuuuuucuaa

SEQ ID NO: 867309 - RNA, 22 nt, Human
uuuuuuuuuuuuuuuuuuuucu

SEQ ID NO: 867310 - RNA, 22 nt, Human
aaaaacaccuucacagaaacau

SEQ ID NO: 867311 - RNA, 29 nt, Human
aaccaacuguaaaauacuuucagauccuu

SEQ ID NO: 867312 - RNA, 20 nt, Human
aaggcugaaggcugucugcu

SEQ ID NO: 867313 - RNA, 23 nt, Human
aagugucagcagguugggaggcc

SEQ ID NO: 867314 - RNA, 21 nt, Human
acaucuagauuguuugaccau

SEQ ID NO: 867315 - RNA, 22 nt, Human
accaaugucaauguuagucuca

SEQ ID NO: 867316 - RNA, 24 nt, Human
acuuugagaaccacuagugcaaag

SEQ ID NO: 867317 - RNA, 18 nt, Human
aggccauuuacaacaugg

SEQ ID NO: 867318 - RNA, 18 nt, Human
caagaucaaagugucagc

SEQ ID NO: 867319 - RNA, 19 nt, Human
cacauccauggguuccaca

SEQ ID NO: 867320 - RNA, 26 nt, Human
caggcaaccugcuuuacucaaagucc

SEQ ID NO: 867321 - RNA, 19 nt, Human
caggugaugcugcugccac

SEQ ID NO: 867322 - RNA, 22 nt, Human
cauccaaaaacaccuucacaga

SEQ ID NO: 867323 - RNA, 20 nt, Human
cauccaaaaacaccuucacu

SEQ ID NO: 867324 - RNA, 21 nt, Human
cauccauggauucaaccaacu

SEQ ID NO: 867325 - RNA, 23 nt, Human
ccaaaaacaccuucacagaaaca

SEQ ID NO: 867326 - RNA, 19 nt, Human
ccaagaucaaagugucagc

SEQ ID NO: 867327 - RNA, 19 nt, Human
ccucagucuuugcucuguu

SEQ ID NO: 867328 - RNA, 20 nt, Human
gaaggcugucugcuggugga

SEQ ID NO: 867329 - RNA, 23 nt, Human
gaggugacgcugcaguucaaggc

SEQ ID NO: 867330 - RNA, 19 nt, Human
gcagagauucugauagguc

SEQ ID NO: 867331 - RNA, 21 nt, Human
gcugccacugguccagggccc

SEQ ID NO: 867332 - RNA, 19 nt, Human
ggcccagggaagaggugac

SEQ ID NO: 867333 - RNA, 23 nt, Human
uaaaauacuuucagauccuugaa

SEQ ID NO: 867334 - RNA, 26 nt, Human
ucauccaaaaacaccuucacagaaac

SEQ ID NO: 867335 - RNA, 24 nt, Human
uccaaaaacaccuucacagaaaca

SEQ ID NO: 867336 - RNA, 23 nt, Human
uccuucacauccauggguuccac

SEQ ID NO: 867337 - RNA, 24 nt, Human
ucugccaggcaaacagcucugccc

SEQ ID NO: 867338 - RNA, 25 nt, Human
uguuccugcagagauuccucgucga

SEQ ID NO: 867339 - RNA, 23 nt, Human
uuauggcacgcaggcaaccugcu

SEQ ID NO: 867340 - RNA, 24 nt, Human
uucaaaauguuccugcagagauuc

SEQ ID NO: 867341 - RNA, 18 nt, Human
uuucucacaaguucccag

SEQ ID NO: 867342 - RNA, 22 nt, Human
uuucucaggggaccucagucuu

SEQ ID NO: 867343 - RNA, 20 nt, Human
uuugcuccuccucugccagg

SEQ ID NO: 867344 - RNA, 19 nt, Human
uuuuuuuuuuuuguacaga

SEQ ID NO: 867345 - RNA, 21 nt, Human
uuuuuuuuuuuuuuuguacag

SEQ ID NO: 867346 - RNA, 19 nt, Human
uuuuuuuuuuuuuuuuugu

SEQ ID NO: 867347 - RNA, 20 nt, Human
uuuuuuuuuuuuuuuuuugg

SEQ ID NO: 867348 - RNA, 23 nt, Human
aagcuggagccaauugggaggga

SEQ ID NO: 867349 - RNA, 23 nt, Human
aaggaguugacccauuuagagcc

SEQ ID NO: 867350 - RNA, 22 nt, Human
aaucaaaaaaagagcuguccag

SEQ ID NO: 867351 - RNA, 20 nt, Human
acagcuccucucaccuccuc

SEQ ID NO: 867352 - RNA, 21 nt, Human
acgaaggcuggcaaagaucca

SEQ ID NO: 867353 - RNA, 18 nt, Human
agccaaugccgugcgagc

SEQ ID NO: 867354 - RNA, 21 nt, Human
aggcagggacaguuuggggcc

SEQ ID NO: 867355 - RNA, 24 nt, Human
aggcggaaaacaaaggaguugacc

SEQ ID NO: 867356 - RNA, 19 nt, Human
agggccccugccccccacc

SEQ ID NO: 867357 - RNA, 24 nt, Human
agguggggggcgaggggcgggagc

SEQ ID NO: 867358 - RNA, 21 nt, Human
aucaugaccacaguaaacgaa

SEQ ID NO: 867359 - RNA, 23 nt, Human
aucccguuauccugagucccuca

SEQ ID NO: 867360 - RNA, 20 nt, Human
auccgaaccaguugacaagg

SEQ ID NO: 867361 - RNA, 24 nt, Human
auggaaccaaugaaagggggugcc

SEQ ID NO: 867362 - RNA, 23 nt, Human
auuggcagaggcgggacaaucuu

SEQ ID NO: 867363 - RNA, 21 nt, Human
caaaaaaagagcuguccagcg

SEQ ID NO: 867364 - RNA, 24 nt, Human
cacgcccccaggaagcuggagcca

SEQ ID NO: 867365 - RNA, 20 nt, Human
cacucucucccccacaccag

SEQ ID NO: 867366 - RNA, 24 nt, Human
ccaaccgggcuuaaucagcccaua

SEQ ID NO: 867367 - RNA, 18 nt, Human
cccaaucgggaaacggga

SEQ ID NO: 867368 - RNA, 23 nt, Human
cccacaauaaacuucuucgacaa

SEQ ID NO: 867369 - RNA, 18 nt, Human
ccccaaccccucacucuc

SEQ ID NO: 867370 - RNA, 19 nt, Human
ccccaggaagcuggagcca

SEQ ID NO: 867371 - RNA, 20 nt, Human
ccccuaagaaaaauggcccc

SEQ ID NO: 867372 - RNA, 19 nt, Human
ccccucacucucuccccca

SEQ ID NO: 867373 - RNA, 24 nt, Human
cccucacucucucccccacaccag

SEQ ID NO: 867374 - RNA, 18 nt, Human
cccucagugccucuugug

SEQ ID NO: 867375 - RNA, 21 nt, Human
cccucagugccucuuguggug

SEQ ID NO: 867376 - RNA, 18 nt, Human
cccuccaaccugcuccca

SEQ ID NO: 867377 - RNA, 18 nt, Human
cccucccaacugccgauc

SEQ ID NO: 867378 - RNA, 21 nt, Human
ccgcacacuccgccucccuua

SEQ ID NO: 867379 - RNA, 23 nt, Human
ccgccuagagcauuuccauuugc

SEQ ID NO: 867380 - RNA, 18 nt, Human
ccgggaguggggcggggg

SEQ ID NO: 867381 - RNA, 21 nt, Human
ccguucggcucuuccagcugu

SEQ ID NO: 867382 - RNA, 21 nt, Human
ccuaagaaaaauggccccgcc

SEQ ID NO: 867383 - RNA, 20 nt, Human
ccuuggguggacgagggccc

SEQ ID NO: 867384 - RNA, 24 nt, Human
cgaucccccaaccccucacucucu

SEQ ID NO: 867385 - RNA, 21 nt, Human
cgcggcaggucgugggcugga

SEQ ID NO: 867386 - RNA, 26 nt, Human
cggcgcggcaggucgugggggacgcc

SEQ ID NO: 867387 - RNA, 27 nt, Human
cguagccagcauggccggcccggcgcc

SEQ ID NO: 867388 - RNA, 21 nt, Human
cucagagcgccccucccaacu

SEQ ID NO: 867389 - RNA, 23 nt, Human
cuguggagguggggggcgagggg

SEQ ID NO: 867390 - RNA, 18 nt, Human
gaccugacgucccugacc

SEQ ID NO: 867391 - RNA, 21 nt, Human
gagcuuagaacucagcgagcc

SEQ ID NO: 867392 - RNA, 19 nt, Human
gagguggggggcgaggggc

SEQ ID NO: 867393 - RNA, 19 nt, Human
gcaggucgugggcuggaag

SEQ ID NO: 867394 - RNA, 20 nt, Human
gccaauucugggaagaggag

SEQ ID NO: 867395 - RNA, 18 nt, Human
gccacaggggcuucaucc

SEQ ID NO: 867396 - RNA, 21 nt, Human
gccccgggaguggggcggggg

SEQ ID NO: 867397 - RNA, 21 nt, Human
gccccucccaacugccgaucc

SEQ ID NO: 867398 - RNA, 26 nt, Human
gcgcaguugccccgccuccucuccgc

SEQ ID NO: 867399 - RNA, 24 nt, Human
gcuucguuucugggggcacugacg

SEQ ID NO: 867400 - RNA, 22 nt, Human
ggaaaacaaaggaguugaccca

SEQ ID NO: 867401 - RNA, 21 nt, Human
ggauggauggaaccaaugaaa

SEQ ID NO: 867402 - RNA, 21 nt, Human
ggcagcauuucuugcuucggu

SEQ ID NO: 867403 - RNA, 18 nt, Human
ggccggagagugagggcc

SEQ ID NO: 867404 - RNA, 20 nt, Human
ggccggcccggcgccgucac

SEQ ID NO: 867405 - RNA, 18 nt, Human
ggccggucccggaucggc

SEQ ID NO: 867406 - RNA, 20 nt, Human
ggcggaaaacaaaggaguug

SEQ ID NO: 867407 - RNA, 19 nt, Human
ggcggacgcggcccggggc

SEQ ID NO: 867408 - RNA, 19 nt, Human
gggauggagccaaugccgu

SEQ ID NO: 867409 - RNA, 20 nt, Human
ggggauggagccaaugccgu

SEQ ID NO: 867410 - RNA, 20 nt, Human
ggggauggauggaaccaaug

SEQ ID NO: 867411 - RNA, 26 nt, Human
guagccagcauggccggcccggcgcc

SEQ ID NO: 867412 - RNA, 24 nt, Human
uagaacucagcgagccaaucccuu

SEQ ID NO: 867413 - RNA, 23 nt, Human
uagaaggaaucugucgcuaggcg

SEQ ID NO: 867414 - RNA, 19 nt, Human
ucaggaaaagcggacggug

SEQ ID NO: 867415 - RNA, 19 nt, Human
ucagggaacaaguugucgg

SEQ ID NO: 867416 - RNA, 19 nt, Human
ucccccaaccccucacucu

SEQ ID NO: 867417 - RNA, 20 nt, Human
ucuugugguguacagcuccu

SEQ ID NO: 867418 - RNA, 20 nt, Human
ugacucagaaauucguccgg

SEQ ID NO: 867419 - RNA, 19 nt, Human
ugagggccccugcccccca

SEQ ID NO: 867420 - RNA, 24 nt, Human
uggaaccaaugaaagggggugcca

SEQ ID NO: 867421 - RNA, 21 nt, Human
uggcaaagauccaacacggca

SEQ ID NO: 867422 - RNA, 22 nt, Human
uggcaaagauccaacacggcag

SEQ ID NO: 867423 - RNA, 19 nt, Human
uggcagaggcgggacaauc

SEQ ID NO: 867424 - RNA, 24 nt, Human
uggcagaggcgggacaaucuuggg

SEQ ID NO: 867425 - RNA, 18 nt, Human
ugggagggagaacucagg

SEQ ID NO: 867426 - RNA, 22 nt, Human
uggggccaucccugaggggguc

SEQ ID NO: 867427 - RNA, 22 nt, Human
uggggggcgaggggcgggagcu

SEQ ID NO: 867428 - RNA, 18 nt, Human
ugguaccauccuggaugc

SEQ ID NO: 867429 - RNA, 19 nt, Human
ugucgggacgugggcaaag

SEQ ID NO: 867430 - RNA, 23 nt, Human
uuaaucucagagcgccccuccca

SEQ ID NO: 867431 - RNA, 22 nt, Human
uugccccuaagaaaaauggccc

SEQ ID NO: 867432 - RNA, 21 nt, Human
uuugagccaaucaaaaaaaga

SEQ ID NO: 867433 - RNA, 20 nt, Human
aaaagaugagggaggggagu

SEQ ID NO: 867434 - RNA, 22 nt, Human
accguaauggauucaauuucaa

SEQ ID NO: 867435 - RNA, 23 nt, Human
accuccuugcuuucacugucagc

SEQ ID NO: 867436 - RNA, 19 nt, Human
agaagaaaauaaaugggga

SEQ ID NO: 867437 - RNA, 22 nt, Human
agcaggagggacuccuucaggg

SEQ ID NO: 867438 - RNA, 22 nt, Human
aggcugcacucaaucaugggcc

SEQ ID NO: 867439 - RNA, 19 nt, Human
agggugcacuguggcaggg

SEQ ID NO: 867440 - RNA, 22 nt, Human
agugagacacucauuuucaaac

SEQ ID NO: 867441 - RNA, 24 nt, Human
agugaugguggcagguccaagaga

SEQ ID NO: 867442 - RNA, 20 nt, Human
caaacaagucucccuugaga

SEQ ID NO: 867443 - RNA, 23 nt, Human
cacucauuuucaaacaagucucc

SEQ ID NO: 867444 - RNA, 21 nt, Human
cacugcuucgcuccacagaag

SEQ ID NO: 867445 - RNA, 19 nt, Human
cacugucagcaggagggac

SEQ ID NO: 867446 - RNA, 21 nt, Human
cagugcugcccaccuccuugc

SEQ ID NO: 867447 - RNA, 19 nt, Human
ccaccucccucuuuuuuuu

SEQ ID NO: 867448 - RNA, 24 nt, Human
ccaucccaauuccaauccugaccc

SEQ ID NO: 867449 - RNA, 26 nt, Human
cccacccugcuuuauuuacaacacgc

SEQ ID NO: 867450 - RNA, 19 nt, Human
ccggugccgccucuagugc

SEQ ID NO: 867451 - RNA, 25 nt, Human
cgcccccuccccuccucccgguccg

SEQ ID NO: 867452 - RNA, 20 nt, Human
cggccgauauuauuaaaaac

SEQ ID NO: 867453 - RNA, 22 nt, Human
cggcgccccccuccccggagcc

SEQ ID NO: 867454 - RNA, 28 nt, Human
cugaggacccugaggcucaguucccaaa

SEQ ID NO: 867455 - RNA, 21 nt, Human
cugucagcaggagggacuccu

SEQ ID NO: 867456 - RNA, 24 nt, Human
cugucccauuccaucccaauucca

SEQ ID NO: 867457 - RNA, 21 nt, Human
gacaguauccaagcuccaggg

SEQ ID NO: 867458 - RNA, 18 nt, Human
gaguccgcuagccgcugc

SEQ ID NO: 867459 - RNA, 19 nt, Human
gauguccucguccaugacc

SEQ ID NO: 867460 - RNA, 19 nt, Human
gccucaguuccuugcauuu

SEQ ID NO: 867461 - RNA, 22 nt, Human
gcgccccccuccccggagccgg

SEQ ID NO: 867462 - RNA, 22 nt, Human
ggaggggagugcuaauauuuac

SEQ ID NO: 867463 - RNA, 21 nt, Human
ggcaauaaaagaagucgggga

SEQ ID NO: 867464 - RNA, 25 nt, Human
ggcaucuccaucuuggcuuguuuca

SEQ ID NO: 867465 - RNA, 18 nt, Human
gggcaucuggccucaguu

SEQ ID NO: 867466 - RNA, 20 nt, Human
gggccuaggagccucagggg

SEQ ID NO: 867467 - RNA, 26 nt, Human
gguccggcgccccccuccccggagcc

SEQ ID NO: 867468 - RNA, 21 nt, Human
uagaagaaaauaaauggggag

SEQ ID NO: 867469 - RNA, 24 nt, Human
uaggcugaggacccugaggcucag

SEQ ID NO: 867470 - RNA, 18 nt, Human
uaggggaaguccaaaauu

SEQ ID NO: 867471 - RNA, 22 nt, Human
uaggggaaguccaaaauuaaaa

SEQ ID NO: 867472 - RNA, 19 nt, Human
uaguacuccaccuuugagc

SEQ ID NO: 867473 - RNA, 27 nt, Human
ucacuggagcuggcaucuccaucuugg

SEQ ID NO: 867474 - RNA, 20 nt, Human
uccaaaauuaaaaauacaac

SEQ ID NO: 867475 - RNA, 21 nt, Human
uccaauccugacccagaaagu

SEQ ID NO: 867476 - RNA, 24 nt, Human
ucccauccccaaccguaauggauu

SEQ ID NO: 867477 - RNA, 23 nt, Human
ucccaugagucaucaccugauuc

SEQ ID NO: 867478 - RNA, 24 nt, Human
ucccgguccggcgccccccucccc

SEQ ID NO: 867479 - RNA, 21 nt, Human
ucuagugcucgaugcucccac

SEQ ID NO: 867480 - RNA, 21 nt, Human
ucugcuuuccuuccucacuuc

SEQ ID NO: 867481 - RNA, 23 nt, Human
ugaaauagaagaaaagaugaggg

SEQ ID NO: 867482 - RNA, 18 nt, Human
ugaggacccugaggcuca

SEQ ID NO: 867483 - RNA, 19 nt, Human
ugcauuucuggcaauaaaa

SEQ ID NO: 867484 - RNA, 21 nt, Human
uggauccacgucccacacagg

SEQ ID NO: 867485 - RNA, 19 nt, Human
ugggaaagugagacacuca

SEQ ID NO: 867486 - RNA, 18 nt, Human
uggucuucuuaaucuuag

SEQ ID NO: 867487 - RNA, 18 nt, Human
uuccuuccucacuuggcc

SEQ ID NO: 867488 - RNA, 20 nt, Human
uuuuuuuuuuuuaaagagcc

SEQ ID NO: 867489 - RNA, 19 nt, Human
uuuuuuuuuuuuuuuuuaa

SEQ ID NO: 867490 - RNA, 18 nt, Human
aaagucccccgggccccc

SEQ ID NO: 867491 - RNA, 20 nt, Human
accagcccgggcucggccuc

SEQ ID NO: 867492 - RNA, 21 nt, Human
acggcgccggacacacuaccg

SEQ ID NO: 867493 - RNA, 19 nt, Human
acguuacagaacaagcagc

SEQ ID NO: 867494 - RNA, 18 nt, Human
caccagcccgggcucggc

SEQ ID NO: 867495 - RNA, 20 nt, Human
caguggaagaaaugcccgcg

SEQ ID NO: 867496 - RNA, 19 nt, Human
ccacaguccucccgaucug

SEQ ID NO: 867497 - RNA, 20 nt, Human
cguuacagaacaagcagcga

SEQ ID NO: 867498 - RNA, 23 nt, Human
gaacaagcagcgaauucaaccac

SEQ ID NO: 867499 - RNA, 21 nt, Human
gggcucggccucucgcuuucu

SEQ ID NO: 867500 - RNA, 19 nt, Human
uaaaaaagucccccgggcc

SEQ ID NO: 867501 - RNA, 23 nt, Human
uaacguuacagaacaagcagcga

SEQ ID NO: 867502 - RNA, 19 nt, Human
uaaggaagucuacauggug

SEQ ID NO: 867503 - RNA, 27 nt, Human
ucaaccacuuaagaacuaaggaagucu

SEQ ID NO: 867504 - RNA, 23 nt, Human
uccucccgaucugguuuuuuaaa

SEQ ID NO: 867505 - RNA, 23 nt, Human
ucucacgcuucauuuaaucugaa

SEQ ID NO: 867506 - RNA, 20 nt, Human
uggaagaaaugcccgcggcg

SEQ ID NO: 867507 - RNA, 21 nt, Human
uuaagaacuaaggaagucuac

SEQ ID NO: 867508 - RNA, 21 nt, Human
uuacaggcucuccgucuucag

SEQ ID NO: 867509 - RNA, 19 nt, Human
uuuuugucucacgcuucau

SEQ ID NO: 867510 - RNA, 19 nt, Human
uuuuuuuuuuuuuuugucu

SEQ ID NO: 867511 - RNA, 18 nt, Human
uuuuuuuuuuuuuuuuug

SEQ ID NO: 867512 - RNA, 19 nt, Human
uuuuuuuuuuuuuuuuugu

SEQ ID NO: 867513 - RNA, 24 nt, Human
uuuuuuuuuuuuuuuuuugucuca

SEQ ID NO: 867514 - RNA, 18 nt, Human
aauaaaaggacacccaga

SEQ ID NO: 867515 - RNA, 23 nt, Human
aauaaaaggacacccagaagaaa

SEQ ID NO: 867516 - RNA, 21 nt, Human
acccagaagaaacucacucag

SEQ ID NO: 867517 - RNA, 20 nt, Human
acccagaauaaaaggacacc

SEQ ID NO: 867518 - RNA, 20 nt, Human
acuccaccuccuuccuucaa

SEQ ID NO: 867519 - RNA, 23 nt, Human
agaauaaaaggacacccagaaga

SEQ ID NO: 867520 - RNA, 20 nt, Human
aggaacaaaagagaacacgg

SEQ ID NO: 867521 - RNA, 20 nt, Human
agggaggugggggguugggg

SEQ ID NO: 867522 - RNA, 19 nt, Human
aggugggggguugggggcg

SEQ ID NO: 867523 - RNA, 24 nt, Human
agucaggcugaauuuauucagaau

SEQ ID NO: 867524 - RNA, 25 nt, Human
ccagaauaaaaggacacccagaaga

SEQ ID NO: 867525 - RNA, 26 nt, Human
cccgggccgagcaccgcgccuccccc

SEQ ID NO: 867526 - RNA, 18 nt, Human
cccggggccgggagaggg

SEQ ID NO: 867527 - RNA, 22 nt, Human
ccucccgcucgcgcucccgggc

SEQ ID NO: 867528 - RNA, 18 nt, Human
cgacagcagcggaggcug

SEQ ID NO: 867529 - RNA, 21 nt, Human
cgacagcagcggaggcugccc

SEQ ID NO: 867530 - RNA, 21 nt, Human
cucccgggccgagcaccgcgc

SEQ ID NO: 867531 - RNA, 24 nt, Human
cugccccggcugcagcggcugugg

SEQ ID NO: 867532 - RNA, 24 nt, Human
cugcgggucucugcuccucccgcu

SEQ ID NO: 867533 - RNA, 21 nt, Human
cuuagaggagccgcaggugcc

SEQ ID NO: 867534 - RNA, 21 nt, Human
gaacacggacucccgcucccu

SEQ ID NO: 867535 - RNA, 21 nt, Human
gcaggaggggguggcaucucc

SEQ ID NO: 867536 - RNA, 18 nt, Human
ggccgggagagggcaagc

SEQ ID NO: 867537 - RNA, 19 nt, Human
ggugggggguugggggcga

SEQ ID NO: 867538 - RNA, 18 nt, Human
gugggggguugggggcga

SEQ ID NO: 867539 - RNA, 22 nt, Human
uaaaaggacacccagaagaaac

SEQ ID NO: 867540 - RNA, 19 nt, Human
ucacucagggagguggggg

SEQ ID NO: 867541 - RNA, 26 nt, Human
ucacucagggaggugggggguugggg

SEQ ID NO: 867542 - RNA, 19 nt, Human
ucagaggaggcgacagcag

SEQ ID NO: 867543 - RNA, 23 nt, Human
ucccgcucccuacccagaauaaa

SEQ ID NO: 867544 - RNA, 21 nt, Human
ucccggagucccggggccggg

SEQ ID NO: 867545 - RNA, 19 nt, Human
ucccggcugcgggucucug

SEQ ID NO: 867546 - RNA, 18 nt, Human
ucuuucauuauuugcaca

SEQ ID NO: 867547 - RNA, 19 nt, Human
ugcacaggaacaaaagaga

SEQ ID NO: 867548 - RNA, 21 nt, Human
ugcacaggaacaaaagagaac

SEQ ID NO: 867549 - RNA, 22 nt, Human
ugcacaggaacaaaagagaaca

SEQ ID NO: 867550 - RNA, 23 nt, Human
ugcagcggcuguggcugccgagg

SEQ ID NO: 867551 - RNA, 23 nt, Human
ugcuggggcccgcgcuccggggg

SEQ ID NO: 867552 - RNA, 20 nt, Human
ugcuggggcccgcgcugcug

SEQ ID NO: 867553 - RNA, 27 nt, Human
ugcuggggcccgcgcugcugccgcgga

SEQ ID NO: 867554 - RNA, 21 nt, Human
uggaagaacaaugcaggaggg

SEQ ID NO: 867555 - RNA, 18 nt, Human
ugggggguugggggcgag

SEQ ID NO: 867556 - RNA, 19 nt, Human
uuuuuuuuuuuuugggggu

SEQ ID NO: 867557 - RNA, 20 nt, Human
uuuuuuuuuuuuuuuggggg

SEQ ID NO: 867558 - RNA, 18 nt, Human
uuuuuuuuuuuuuuuuug

SEQ ID NO: 867559 - RNA, 21 nt, Human
uuuuuuuuuuuuuuuuugggg

SEQ ID NO: 867560 - RNA, 22 nt, Human
uuuuuuuuuuuuuuuuuggggg

SEQ ID NO: 867561 - RNA, 25 nt, Human
uuuuuuuuuuuuuuuuuggggguga

SEQ ID NO: 867562 - RNA, 19 nt, Human
aagcaccaggaccacagaa

SEQ ID NO: 867563 - RNA, 19 nt, Human
acgcaccagggccgggggc

SEQ ID NO: 867564 - RNA, 19 nt, Human
agagggaggcacucuccgu

SEQ ID NO: 867565 - RNA, 23 nt, Human
agcugcuguugucuucacagccg

SEQ ID NO: 867566 - RNA, 24 nt, Human
caacaugaggaaacugaggccaga

SEQ ID NO: 867567 - RNA, 22 nt, Human
cacgcaccacgcaccacgcacc

SEQ ID NO: 867568 - RNA, 22 nt, Human
cacgcaccacgcaccgcgcaca

SEQ ID NO: 867569 - RNA, 21 nt, Human
cacgccacgccacuccacgcc

SEQ ID NO: 867570 - RNA, 22 nt, Human
cacgccacgccacuccacgccc

SEQ ID NO: 867571 - RNA, 23 nt, Human
cacgccacuccacgccacgccac

SEQ ID NO: 867572 - RNA, 20 nt, Human
ccacgcaccgcgcacagccg

SEQ ID NO: 867573 - RNA, 22 nt, Human
ccacgccacgccacuccacgcc

SEQ ID NO: 867574 - RNA, 22 nt, Human
ccacgccacgccacuccacgcc

SEQ ID NO: 867575 - RNA, 24 nt, Human
ccacgccacgccacuccacgcccc

SEQ ID NO: 867576 - RNA, 18 nt, Human
ccacuguccagccccagg

SEQ ID NO: 867577 - RNA, 18 nt, Human
cccauguggccuuagggu

SEQ ID NO: 867578 - RNA, 21 nt, Human
cccgccacgccacgccacucc

SEQ ID NO: 867579 - RNA, 22 nt, Human
cccgccacgccacgccacucca

SEQ ID NO: 867580 - RNA, 20 nt, Human
cccgcgccgcgagaccccgc

SEQ ID NO: 867581 - RNA, 21 nt, Human
ccgcaggcugguaggguccac

SEQ ID NO: 867582 - RNA, 19 nt, Human
ccgcgccacgugccgccgc

SEQ ID NO: 867583 - RNA, 20 nt, Human
ccgcgccacgugccgccgcu

SEQ ID NO: 867584 - RNA, 20 nt, Human
ccgcgccgcgagaccccgcc

SEQ ID NO: 867585 - RNA, 18 nt, Human
ccggccauaccaccuucc

SEQ ID NO: 867586 - RNA, 23 nt, Human
ccuggccugagcccauguggccg

SEQ ID NO: 867587 - RNA, 24 nt, Human
cgccgcgagaccccgccacgccac

SEQ ID NO: 867588 - RNA, 26 nt, Human
cgcgagaccccgccacgccacgccac

SEQ ID NO: 867589 - RNA, 26 nt, Human
cgcugaggcccccaggcuggcgguga

SEQ ID NO: 867590 - RNA, 22 nt, Human
cggccucugccccauaagggag

SEQ ID NO: 867591 - RNA, 22 nt, Human
cgugucugaagacuugccucac

SEQ ID NO: 867592 - RNA, 19 nt, Human
cuccacgccacgccacucc

SEQ ID NO: 867593 - RNA, 21 nt, Human
cuuagcaucggccucagcugc

SEQ ID NO: 867594 - RNA, 22 nt, Human
cuucacagccggccauaccacc

SEQ ID NO: 867595 - RNA, 23 nt, Human
gagcagccagaggccuuugaggg

SEQ ID NO: 867596 - RNA, 22 nt, Human
gagccccuuggucccgucccag

SEQ ID NO: 867597 - RNA, 23 nt, Human
gcaccagggccgggggcagggag

SEQ ID NO: 867598 - RNA, 25 nt, Human
gccacuccacgccccgcacccgcgc

SEQ ID NO: 867599 - RNA, 18 nt, Human
gccgcgagaccccgccac

SEQ ID NO: 867600 - RNA, 19 nt, Human
ggccugagcccauguggcc

SEQ ID NO: 867601 - RNA, 21 nt, Human
gggaggcacucuccguccaca

SEQ ID NO: 867602 - RNA, 22 nt, Human
gggggcucugggaacaggaggg

SEQ ID NO: 867603 - RNA, 21 nt, Human
gugucugaagacuugccucac

SEQ ID NO: 867604 - RNA, 19 nt, Human
uccacgccacgccacucca

SEQ ID NO: 867605 - RNA, 19 nt, Human
uccacgccacgccacucca

SEQ ID NO: 867606 - RNA, 21 nt, Human
uccacgccacgccacuccacg

SEQ ID NO: 867607 - RNA, 24 nt, Human
ucguaucacgcaccacgcaccacg

SEQ ID NO: 867608 - RNA, 18 nt, Human
ucuccguccacagcuccg

SEQ ID NO: 867609 - RNA, 24 nt, Human
ucugaagacuugccucacuguccu

SEQ ID NO: 867610 - RNA, 20 nt, Human
ugaggaaacugaggccagag

SEQ ID NO: 867611 - RNA, 24 nt, Human
ugaggaaacugaggccagagggag

SEQ ID NO: 867612 - RNA, 18 nt, Human
ugaggggaugaaggccug

SEQ ID NO: 867613 - RNA, 22 nt, Human
ugcacggggcggucucgggggc

SEQ ID NO: 867614 - RNA, 22 nt, Human
uggaagcaccaggaccacagaa

SEQ ID NO: 867615 - RNA, 24 nt, Human
uggaagcaccaggaccacagaaca

SEQ ID NO: 867616 - RNA, 18 nt, Human
ugggaacaggagggucag

SEQ ID NO: 867617 - RNA, 18 nt, Human
ugggcggccucugcccca

SEQ ID NO: 867618 - RNA, 21 nt, Human
uguugucuucacagccggcca

SEQ ID NO: 867619 - RNA, 21 nt, Human
aacuacaaagcugaaaguuuc

SEQ ID NO: 867620 - RNA, 22 nt, Human
aggguaagauagaagaggagaa

SEQ ID NO: 867621 - RNA, 20 nt, Human
cacugcggccacugcagggc

SEQ ID NO: 867622 - RNA, 25 nt, Human
cauggaaaacacugaaguugcccug

SEQ ID NO: 867623 - RNA, 21 nt, Human
ccacugcagggccgguccguc

SEQ ID NO: 867624 - RNA, 18 nt, Human
ccccccgccgccagccgc

SEQ ID NO: 867625 - RNA, 24 nt, Human
ccucaaggcgggaugucgggagga

SEQ ID NO: 867626 - RNA, 21 nt, Human
cgaggcgagagcgggcggagg

SEQ ID NO: 867627 - RNA, 20 nt, Human
cgccgccagccgcgauuccg

SEQ ID NO: 867628 - RNA, 22 nt, Human
cgccucagccuccucaaggcgg

SEQ ID NO: 867629 - RNA, 22 nt, Human
cgcgauuccgccucagccuccu

SEQ ID NO: 867630 - RNA, 23 nt, Human
cucaaggcgggaugucgggagga

SEQ ID NO: 867631 - RNA, 21 nt, Human
cugaucugcuuuaaauaacau

SEQ ID NO: 867632 - RNA, 21 nt, Human
gagggccggguccgggcuguc

SEQ ID NO: 867633 - RNA, 18 nt, Human
guaagauagaagaggaga

SEQ ID NO: 867634 - RNA, 23 nt, Human
gucgggaggagaggcgacugccu

SEQ ID NO: 867635 - RNA, 24 nt, Human
uacauauccacauggaaaacacug

SEQ ID NO: 867636 - RNA, 20 nt, Human
uagcggcacugccagaggcg

SEQ ID NO: 867637 - RNA, 22 nt, Human
uccacauggaaaacacugaagu

SEQ ID NO: 867638 - RNA, 19 nt, Human
uccgggcugucacugcggc

SEQ ID NO: 867639 - RNA, 21 nt, Human
uccgggcugucacugcggcca

SEQ ID NO: 867640 - RNA, 20 nt, Human
ugagggaaagcaauagcaug

SEQ ID NO: 867641 - RNA, 21 nt, Human
ugaggguaagauagaagagga

SEQ ID NO: 867642 - RNA, 21 nt, Human
uuuacauauccacauggaaaa

SEQ ID NO: 867643 - RNA, 18 nt, Human
aaaaggucccugugcuuc

SEQ ID NO: 867644 - RNA, 23 nt, Human
aggaggcccuggggucagaggac

SEQ ID NO: 867645 - RNA, 19 nt, Human
agggaguuuccagccccuc

SEQ ID NO: 867646 - RNA, 18 nt, Human
aggucuuuccuggggcug

SEQ ID NO: 867647 - RNA, 20 nt, Human
cacgugaccaggagcaaggu

SEQ ID NO: 867648 - RNA, 20 nt, Human
ccucuguuuccugaaaaggu

SEQ ID NO: 867649 - RNA, 19 nt, Human
ccugaaaaggucccugugc

SEQ ID NO: 867650 - RNA, 19 nt, Human
ccuggaggagaagcgggac

SEQ ID NO: 867651 - RNA, 18 nt, Human
cuccagcccucuguuucc

SEQ ID NO: 867652 - RNA, 18 nt, Human
gacugugggugaugaggg

SEQ ID NO: 867653 - RNA, 20 nt, Human
gcccuggggucagaggacuc

SEQ ID NO: 867654 - RNA, 20 nt, Human
uaacugggguggaaguugag

SEQ ID NO: 867655 - RNA, 20 nt, Human
ugccuggaggagaagcggga

SEQ ID NO: 867656 - RNA, 18 nt, Human
uggggcugcugggcuccc

SEQ ID NO: 867657 - RNA, 23 nt, Human
uuccuggggcugcugggcucccg

SEQ ID NO: 867658 - RNA, 25 nt, Human
uugccaagcgacggccaggucacgu

SEQ ID NO: 867659 - RNA, 19 nt, Human
uuuuuuuucaggaugugac

SEQ ID NO: 867660 - RNA, 23 nt, Human
uuuuuuuuuuuuuuuuuuucagg

SEQ ID NO: 867661 - RNA, 24 nt, Human
aaagugcugggauuacagguguga

SEQ ID NO: 867662 - RNA, 22 nt, Human
aacaccccccuuagucaaaggc

SEQ ID NO: 867663 - RNA, 18 nt, Human
aagugcugggauuacagg

SEQ ID NO: 867664 - RNA, 19 nt, Human
aagugcugggauuacaggu

SEQ ID NO: 867665 - RNA, 26 nt, Human
aagugcugggauuacaggugugagcc

SEQ ID NO: 867666 - RNA, 21 nt, Human
acaggugcccaccaccaugcc

SEQ ID NO: 867667 - RNA, 25 nt, Human
acccgccuuggccucccaaagugcu

SEQ ID NO: 867668 - RNA, 21 nt, Human
agaaaucuggcgaaaacagga

SEQ ID NO: 867669 - RNA, 24 nt, Human
aggugauugacccgccuuggccuc

SEQ ID NO: 867670 - RNA, 23 nt, Human
auauuggccaggcugguugcgaa

SEQ ID NO: 867671 - RNA, 24 nt, Human
caaagugcugggauuacaggugug

SEQ ID NO: 867672 - RNA, 24 nt, Human
cacaaagccaccgccgcgaagcag

SEQ ID NO: 867673 - RNA, 21 nt, Human
caccauauuggccaggcuggu

SEQ ID NO: 867674 - RNA, 22 nt, Human
caccauauuggccaggcugguu

SEQ ID NO: 867675 - RNA, 31 nt, Human
caccauauuggccaggcugguugcgaacucc

SEQ ID NO: 867676 - RNA, 21 nt, Human
cagaaugaugcccaagcccug

SEQ ID NO: 867677 - RNA, 23 nt, Human
cagaaugaugcccaagcccuggg

SEQ ID NO: 867678 - RNA, 19 nt, Human
caggugcccaccaccaugc

SEQ ID NO: 867679 - RNA, 24 nt, Human
cauauuggccaggcugguugcgaa

SEQ ID NO: 867680 - RNA, 27 nt, Human
caucagagaauugcuguaaaaaccuag

SEQ ID NO: 867681 - RNA, 21 nt, Human
ccaaagugcugggauuacagg

SEQ ID NO: 867682 - RNA, 21 nt, Human
ccaaagugcugggauuacagg

SEQ ID NO: 867683 - RNA, 24 nt, Human
ccaaagugcugggauuacaggugu

SEQ ID NO: 867684 - RNA, 20 nt, Human
ccacuuguuaaagaaauaca

SEQ ID NO: 867685 - RNA, 20 nt, Human
ccaggcuucaagcgauucuc

SEQ ID NO: 867686 - RNA, 19 nt, Human
ccauucaaauacuguuacu

SEQ ID NO: 867687 - RNA, 19 nt, Human
cccaggcuggaguacaaug

SEQ ID NO: 867688 - RNA, 19 nt, Human
cccagguagcugggaucac

SEQ ID NO: 867689 - RNA, 24 nt, Human
ccuccaggcuucaagcgauucucc

SEQ ID NO: 867690 - RNA, 23 nt, Human
ccucuuuggacuggcauuuaggu

SEQ ID NO: 867691 - RNA, 22 nt, Human
ccugaccucaggugauugaccc

SEQ ID NO: 867692 - RNA, 19 nt, Human
cgaaaacaggaauuguuag

SEQ ID NO: 867693 - RNA, 23 nt, Human
cgccuccaggcuucaagcgauuc

SEQ ID NO: 867694 - RNA, 22 nt, Human
cuaauaagguuaaguucucuuu

SEQ ID NO: 867695 - RNA, 22 nt, Human
cuaccauaucaaggucaucaga

SEQ ID NO: 867696 - RNA, 24 nt, Human
cuaccauaucaaggucaucagaga

SEQ ID NO: 867697 - RNA, 24 nt, Human
cucagccucccagguagcugggau

SEQ ID NO: 867698 - RNA, 19 nt, Human
cuccuuccucagccuccca

SEQ ID NO: 867699 - RNA, 20 nt, Human
cucgcucccugcaggcugca

SEQ ID NO: 867700 - RNA, 20 nt, Human
cucuuguugcccaggcugga

SEQ ID NO: 867701 - RNA, 23 nt, Human
cugcaggcugcagcgggagggcu

SEQ ID NO: 867702 - RNA, 23 nt, Human
gaccucaggugauugacccgccu

SEQ ID NO: 867703 - RNA, 18 nt, Human
gagaguaaccgguucacc

SEQ ID NO: 867704 - RNA, 19 nt, Human
gaucacaggugcccaccac

SEQ ID NO: 867705 - RNA, 18 nt, Human
gauuacaggugugagcca

SEQ ID NO: 867706 - RNA, 22 nt, Human
gauuacaggugugagccacugc

SEQ ID NO: 867707 - RNA, 22 nt, Human
gauuacaggugugagccacugc

SEQ ID NO: 867708 - RNA, 21 nt, Human
gauucuccuuccucagccucc

SEQ ID NO: 867709 - RNA, 24 nt, Human
gcauuuagguugccauucaagaag

SEQ ID NO: 867710 - RNA, 24 nt, Human
gcccaggcuggaguacaauggcau

SEQ ID NO: 867711 - RNA, 20 nt, Human
gcccgaaagcagcucugaga

SEQ ID NO: 867712 - RNA, 22 nt, Human
gccuuggccucccaaagugcug

SEQ ID NO: 867713 - RNA, 20 nt, Human
gcucuuguugcccaggcugg

SEQ ID NO: 867714 - RNA, 21 nt, Human
gcucuuguugcccaggcugga

SEQ ID NO: 867715 - RNA, 19 nt, Human
gcuggaguacaauggcaug

SEQ ID NO: 867716 - RNA, 23 nt, Human
gcugguugcgaacuccugaccuc

SEQ ID NO: 867717 - RNA, 24 nt, Human
ggcugguugcgaacuccugaccuc

SEQ ID NO: 867718 - RNA, 20 nt, Human
ggcuucaagcgauucuccuu

SEQ ID NO: 867719 - RNA, 19 nt, Human
gggagggcuggaccuggaa

SEQ ID NO: 867720 - RNA, 18 nt, Human
ggggucucaccauauugg

SEQ ID NO: 867721 - RNA, 22 nt, Human
ggggucucaccauauuggccag

SEQ ID NO: 867722 - RNA, 22 nt, Human
gggucucaccauauuggccagg

SEQ ID NO: 867723 - RNA, 24 nt, Human
gugauugacccgccuuggccuccc

SEQ ID NO: 867724 - RNA, 21 nt, Human
gugcagccuccgccuccaggc

SEQ ID NO: 867725 - RNA, 24 nt, Human
uaacuuuuugcauuuuuaguagag

SEQ ID NO: 867726 - RNA, 21 nt, Human
uaagaaggauauaauauaaua

SEQ ID NO: 867727 - RNA, 25 nt, Human
uaagaugauucacaaauagugcaaa

SEQ ID NO: 867728 - RNA, 23 nt, Human
uacacagcguucuaccauaucaa

SEQ ID NO: 867729 - RNA, 19 nt, Human
uacaggugugagccacugc

SEQ ID NO: 867730 - RNA, 23 nt, Human
uacaggugugagccacugcgccc

SEQ ID NO: 867731 - RNA, 20 nt, Human
uagagauggggucucaccau

SEQ ID NO: 867732 - RNA, 23 nt, Human
uaguagagauggggucucaccau

SEQ ID NO: 867733 - RNA, 26 nt, Human
uaguagagauggggucucaccauauu

SEQ ID NO: 867734 - RNA, 23 nt, Human
ucaacaccccccuuagucaaagg

SEQ ID NO: 867735 - RNA, 23 nt, Human
ucaagcugagggaagccucgugc

SEQ ID NO: 867736 - RNA, 19 nt, Human
ucagugcagccuccgccuc

SEQ ID NO: 867737 - RNA, 23 nt, Human
ucagugcagccuccgccuccagg

SEQ ID NO: 867738 - RNA, 23 nt, Human
ucccaaagugcugggauuacagg

SEQ ID NO: 867739 - RNA, 23 nt, Human
ucccagguagcugggaucacagg

SEQ ID NO: 867740 - RNA, 18 nt, Human
ucccugcaggcugcagcg

SEQ ID NO: 867741 - RNA, 19 nt, Human
ugaaaauguuuugaugcca

SEQ ID NO: 867742 - RNA, 18 nt, Human
ugaccucaggugauugac

SEQ ID NO: 867743 - RNA, 24 nt, Human
ugaccucaggugauugacccgccu

SEQ ID NO: 867744 - RNA, 22 nt, Human
ugcaggcugcagcgggagggcu

SEQ ID NO: 867745 - RNA, 24 nt, Human
ugcccaggcuggaguacaauggca

SEQ ID NO: 867746 - RNA, 24 nt, Human
ugcucuuguugcccaggcuggagu

SEQ ID NO: 867747 - RNA, 24 nt, Human
ugcugggauuacaggugugagcca

SEQ ID NO: 867748 - RNA, 20 nt, Human
uggcacaaagccaccgccgc

SEQ ID NO: 867749 - RNA, 18 nt, Human
uggcaugaccucagcuca

SEQ ID NO: 867750 - RNA, 23 nt, Human
uggcaugaccucagcucagugca

SEQ ID NO: 867751 - RNA, 18 nt, Human
uggcauuuagguugccau

SEQ ID NO: 867752 - RNA, 24 nt, Human
uggccaggcugguugcgaacuccu

SEQ ID NO: 867753 - RNA, 21 nt, Human
ugggaucacaggugcccacca

SEQ ID NO: 867754 - RNA, 24 nt, Human
ugggaucacaggugcccaccacca

SEQ ID NO: 867755 - RNA, 25 nt, Human
ugggaucacaggugcccaccaccau

SEQ ID NO: 867756 - RNA, 18 nt, Human
ugggauuacaggugugag

SEQ ID NO: 867757 - RNA, 19 nt, Human
ugggauuacaggugugagc

SEQ ID NO: 867758 - RNA, 21 nt, Human
ugggauuacaggugugagcca

SEQ ID NO: 867759 - RNA, 22 nt, Human
ugggauuacaggugugagccac

SEQ ID NO: 867760 - RNA, 22 nt, Human
ugggauuacaggugugagccac

SEQ ID NO: 867761 - RNA, 24 nt, Human
ugggauuacaggugugagccacug

SEQ ID NO: 867762 - RNA, 24 nt, Human
uggggucucaccauauuggccagg

SEQ ID NO: 867763 - RNA, 23 nt, Human
uggguccagaaugaugcccaagc

SEQ ID NO: 867764 - RNA, 24 nt, Human
uguaaaaaccuagugucuauguca

SEQ ID NO: 867765 - RNA, 19 nt, Human
uguuucaagcugagggaag

SEQ ID NO: 867766 - RNA, 24 nt, Human
uguuuugaugccauucaaauacug

SEQ ID NO: 867767 - RNA, 18 nt, Human
uuaguagagauggggucu

SEQ ID NO: 867768 - RNA, 24 nt, Human
uuaguagagauggggucucaccau

SEQ ID NO: 867769 - RNA, 23 nt, Human
uucaagcgauucuccuuccucag

SEQ ID NO: 867770 - RNA, 24 nt, Human
uucaagcgauucuccuuccucagc

SEQ ID NO: 867771 - RNA, 19 nt, Human
uuccucagccucccaggua

SEQ ID NO: 867772 - RNA, 24 nt, Human
uuccucagccucccagguagcugg

SEQ ID NO: 867773 - RNA, 23 nt, Human
uugaauaagcaucauaaaaaaau

SEQ ID NO: 867774 - RNA, 22 nt, Human
uugcucuuguugcccaggcugg

SEQ ID NO: 867775 - RNA, 23 nt, Human
uugcucuuguugcccaggcugga

SEQ ID NO: 867776 - RNA, 18 nt, Human
uuggccucccaaagugcu

SEQ ID NO: 867777 - RNA, 24 nt, Human
uuugcucuuguugcccaggcugga

SEQ ID NO: 867778 - RNA, 22 nt, Human
uuuugaugccauucaaauacug

SEQ ID NO: 867779 - RNA, 24 nt, Human
uuuugcucuuguugcccaggcugg

SEQ ID NO: 867780 - RNA, 24 nt, Human
uuuuuaguagagauggggucucac

SEQ ID NO: 867781 - RNA, 21 nt, Human
uuuuugcauuuuuaguagaga

SEQ ID NO: 867782 - RNA, 23 nt, Human
uuuuugcauuuuuaguagagaug

SEQ ID NO: 867783 - RNA, 22 nt, Human
uuuuuuuuuuuuuugagacgga

SEQ ID NO: 867784 - RNA, 18 nt, Human
uuuuuuuuuuuuuuuuug

SEQ ID NO: 867785 - RNA, 21 nt, Human
aaaaaaaaaaaaaaaaaggga

SEQ ID NO: 867786 - RNA, 26 nt, Human
aaaaaaaaaaaucaacccacaacaug

SEQ ID NO: 867787 - RNA, 24 nt, Human
aaaaaagggaaaauucucuucagu

SEQ ID NO: 867788 - RNA, 24 nt, Human
aaacucaugcucccauucuaacag

SEQ ID NO: 867789 - RNA, 23 nt, Human
aaacuccuggacucaagcaauuc

SEQ ID NO: 867790 - RNA, 20 nt, Human
aaagugcugggauuacaggc

SEQ ID NO: 867791 - RNA, 24 nt, Human
aaagugcugggauuacaggcguga

SEQ ID NO: 867792 - RNA, 24 nt, Human
aaaguguugggacuacaggcguga

SEQ ID NO: 867793 - RNA, 24 nt, Human
aaaguguugggauuacagguguga

SEQ ID NO: 867794 - RNA, 21 nt, Human
aacaaaauggcggacccggaa

SEQ ID NO: 867795 - RNA, 19 nt, Human
aagaggauuaauaugaaca

SEQ ID NO: 867796 - RNA, 18 nt, Human
aagcaucugaacuauaga

SEQ ID NO: 867797 - RNA, 25 nt, Human
aagcgauccucccaccucagccucc

SEQ ID NO: 867798 - RNA, 24 nt, Human
aaguaacugggacuacaggcgugu

SEQ ID NO: 867799 - RNA, 24 nt, Human
aaguagcugggauuacaggcaggu

SEQ ID NO: 867800 - RNA, 19 nt, Human
aagugcugggauuacaggc

SEQ ID NO: 867801 - RNA, 19 nt, Human
aagugcugggauuacaggc

SEQ ID NO: 867802 - RNA, 26 nt, Human
aagugcugggauuacaggcgugagcc

SEQ ID NO: 867803 - RNA, 19 nt, Human
aaguguugggacuacaggc

SEQ ID NO: 867804 - RNA, 26 nt, Human
aaguguugggacuacaggcgugagcc

SEQ ID NO: 867805 - RNA, 21 nt, Human
aaguguugggauuacaggugu

SEQ ID NO: 867806 - RNA, 26 nt, Human
aaguguugggauuacaggugugagcc

SEQ ID NO: 867807 - RNA, 24 nt, Human
acagagucagaccgugucucaaaa

SEQ ID NO: 867808 - RNA, 24 nt, Human
accgcacuccagccugggugacag

SEQ ID NO: 867809 - RNA, 26 nt, Human
accgcacuccagccugggugacagag

SEQ ID NO: 867810 - RNA, 24 nt, Human
accuugugauccgccugccucugc

SEQ ID NO: 867811 - RNA, 18 nt, Human
acggggugucaccauguu

SEQ ID NO: 867812 - RNA, 20 nt, Human
acggggugucaccauguugg

SEQ ID NO: 867813 - RNA, 24 nt, Human
acggggugucaccauguuggccag

SEQ ID NO: 867814 - RNA, 19 nt, Human
acuacaggcgugugccacu

SEQ ID NO: 867815 - RNA, 22 nt, Human
agaaaaaauguucccuaaauau

SEQ ID NO: 867816 - RNA, 18 nt, Human
agacagagucucacugug

SEQ ID NO: 867817 - RNA, 24 nt, Human
agagaaacuuccugagcccaagca

SEQ ID NO: 867818 - RNA, 19 nt, Human
agagauggaguuucaccgu

SEQ ID NO: 867819 - RNA, 19 nt, Human
agccaccacacgcagcuua

SEQ ID NO: 867820 - RNA, 24 nt, Human
agccugggugacagagucagaccg

SEQ ID NO: 867821 - RNA, 24 nt, Human
agcgauucuccugccucagccucc

SEQ ID NO: 867822 - RNA, 22 nt, Human
aggaaucugugaagggaaaaug

SEQ ID NO: 867823 - RNA, 24 nt, Human
aggcacaagcgauccucccaccuc

SEQ ID NO: 867824 - RNA, 19 nt, Human
aggcggagguugcagugag

SEQ ID NO: 867825 - RNA, 24 nt, Human
aggcggagguugcagugagccaag

SEQ ID NO: 867826 - RNA, 25 nt, Human
aggcuggagugcaguggcacgaucu

SEQ ID NO: 867827 - RNA, 23 nt, Human
aguaacugggacuacaggcgugu

SEQ ID NO: 867828 - RNA, 25 nt, Human
aguagcugggauuacaggcaggugc

SEQ ID NO: 867829 - RNA, 20 nt, Human
agugcaguggcacgaucuug

SEQ ID NO: 867830 - RNA, 23 nt, Human
agugcaguggcacgaucuuggcu

SEQ ID NO: 867831 - RNA, 24 nt, Human
agugcaguggcacgaucuuggcuc

SEQ ID NO: 867832 - RNA, 18 nt, Human
agugcugggauuacaggc

SEQ ID NO: 867833 - RNA, 18 nt, Human
agugcugggauuacaggc

SEQ ID NO: 867834 - RNA, 21 nt, Human
aguguaauggugcgaucucag

SEQ ID NO: 867835 - RNA, 24 nt, Human
aguguaauggugcgaucucagcuc

SEQ ID NO: 867836 - RNA, 18 nt, Human
auagacacauaauggaua

SEQ ID NO: 867837 - RNA, 18 nt, Human
auggaguuucaccguguu

SEQ ID NO: 867838 - RNA, 20 nt, Human
auggaguuucaccguguuag

SEQ ID NO: 867839 - RNA, 21 nt, Human
auucuccugccucagccuccc

SEQ ID NO: 867840 - RNA, 24 nt, Human
auuuuuguauuuuuaguagagacg

SEQ ID NO: 867841 - RNA, 22 nt, Human
caaaaaaaaaaaaaaaaaggga

SEQ ID NO: 867842 - RNA, 24 nt, Human
caaaguguugggacuacaggcgug

SEQ ID NO: 867843 - RNA, 24 nt, Human
caaaguguugggauuacaggugug

SEQ ID NO: 867844 - RNA, 23 nt, Human
caaccuccaccucccagguucaa

SEQ ID NO: 867845 - RNA, 22 nt, Human
caagcaauucuccugccucagc

SEQ ID NO: 867846 - RNA, 27 nt, Human
caagcaauucuccugccucagccuccc

SEQ ID NO: 867847 - RNA, 20 nt, Human
caagcgauccucccaccuca

SEQ ID NO: 867848 - RNA, 22 nt, Human
caagcgauccucccaccucagc

SEQ ID NO: 867849 - RNA, 27 nt, Human
caagcgauccucccaccucagccuccu

SEQ ID NO: 867850 - RNA, 22 nt, Human
caagcgauucuccugccucagc

SEQ ID NO: 867851 - RNA, 27 nt, Human
caagcgauucuccugccucagccuccc

SEQ ID NO: 867852 - RNA, 24 nt, Human
caauuuuuuguauuuuuaguagag

SEQ ID NO: 867853 - RNA, 20 nt, Human
caccaccgcacuccagccug

SEQ ID NO: 867854 - RNA, 26 nt, Human
caccaccgcacuccagccugggugac

SEQ ID NO: 867855 - RNA, 18 nt, Human
caccauguuggccaggau

SEQ ID NO: 867856 - RNA, 22 nt, Human
caccauguuggccaggaugauc

SEQ ID NO: 867857 - RNA, 23 nt, Human
caccauguuggccaggaugaucu

SEQ ID NO: 867858 - RNA, 24 nt, Human
caccauguuggccaggaugaucuu

SEQ ID NO: 867859 - RNA, 18 nt, Human
caccguguuagccaggau

SEQ ID NO: 867860 - RNA, 22 nt, Human
caccguguuagccaggauguuc

SEQ ID NO: 867861 - RNA, 23 nt, Human
caccguguuagccaggauguucu

SEQ ID NO: 867862 - RNA, 24 nt, Human
caccguguuagccaggauguucuu

SEQ ID NO: 867863 - RNA, 24 nt, Human
caccucagccuccugaguagcugg

SEQ ID NO: 867864 - RNA, 22 nt, Human
cacuccagccugggugacagag

SEQ ID NO: 867865 - RNA, 22 nt, Human
cacuccagccugggugacagag

SEQ ID NO: 867866 - RNA, 21 nt, Human
cacugcaaccuccaccuccca

SEQ ID NO: 867867 - RNA, 21 nt, Human
cacugcaaccuccgccucccg

SEQ ID NO: 867868 - RNA, 23 nt, Human
cacugcaaccuccgccucccggg

SEQ ID NO: 867869 - RNA, 22 nt, Human
cacugugucgccaggcuggagu

SEQ ID NO: 867870 - RNA, 24 nt, Human
cacugugucgccaggcuggagugc

SEQ ID NO: 867871 - RNA, 24 nt, Human
cagagucuggcucuguugcccagg

SEQ ID NO: 867872 - RNA, 23 nt, Human
cagccucccaaguaacugggacu

SEQ ID NO: 867873 - RNA, 19 nt, Human
cagccuccugaguagcugg

SEQ ID NO: 867874 - RNA, 21 nt, Human
cagguuucuauguugcccagg

SEQ ID NO: 867875 - RNA, 19 nt, Human
caguggcacgaucuuggcu

SEQ ID NO: 867876 - RNA, 22 nt, Human
ccaaaguguugggacuacaggc

SEQ ID NO: 867877 - RNA, 24 nt, Human
ccaaaguguugggacuacaggcgu

SEQ ID NO: 867878 - RNA, 21 nt, Human
ccaaaguguugggauuacagg

SEQ ID NO: 867879 - RNA, 21 nt, Human
ccaaaguguugggauuacagg

SEQ ID NO: 867880 - RNA, 24 nt, Human
ccaaaguguugggauuacaggugu

SEQ ID NO: 867881 - RNA, 23 nt, Human
ccaaguagcugggauuacaggca

SEQ ID NO: 867882 - RNA, 20 nt, Human
ccaccacgcccggcuaauuu

SEQ ID NO: 867883 - RNA, 18 nt, Human
ccaccgcacuccagccug

SEQ ID NO: 867884 - RNA, 20 nt, Human
ccaccgcacuccagccuggg

SEQ ID NO: 867885 - RNA, 20 nt, Human
ccaccgcacuccagccuggg

SEQ ID NO: 867886 - RNA, 21 nt, Human
ccaccgcacuccagccugggu

SEQ ID NO: 867887 - RNA, 21 nt, Human
ccaccgcacuccagccugggu

SEQ ID NO: 867888 - RNA, 23 nt, Human
ccaccgcacuccagccuggguga

SEQ ID NO: 867889 - RNA, 24 nt, Human
ccaccgcacuccagccugggugac

SEQ ID NO: 867890 - RNA, 25 nt, Human
ccaccgcacuccagccugggugaca

SEQ ID NO: 867891 - RNA, 23 nt, Human
ccaccucagccuccugaguagcu

SEQ ID NO: 867892 - RNA, 27 nt, Human
ccaccucccagguucaagcaauucuuu

SEQ ID NO: 867893 - RNA, 21 nt, Human
ccaggauguucuugaucugac

SEQ ID NO: 867894 - RNA, 23 nt, Human
cccaaaguguugggacuacaggc

SEQ ID NO: 867895 - RNA, 24 nt, Human
cccaaguaacugggacuacaggcg

SEQ ID NO: 867896 - RNA, 23 nt, Human
cccaaguagcugggauuacaggc

SEQ ID NO: 867897 - RNA, 24 nt, Human
cccaaguagcugggauuacaggca

SEQ ID NO: 867898 - RNA, 23 nt, Human
cccaccucagccuccugaguagc

SEQ ID NO: 867899 - RNA, 23 nt, Human
cccagguucaagcaauucuccug

SEQ ID NO: 867900 - RNA, 19 nt, Human
cccccgagguucaucgccu

SEQ ID NO: 867901 - RNA, 21 nt, Human
ccccucagaaaaaauguuccc

SEQ ID NO: 867902 - RNA, 22 nt, Human
ccccucguggagaaacagaggc

SEQ ID NO: 867903 - RNA, 20 nt, Human
cccggguucaagcgauucuc

SEQ ID NO: 867904 - RNA, 23 nt, Human
cccggguucaagcgauucuccug

SEQ ID NO: 867905 - RNA, 22 nt, Human
cccugcuauaguuuucuucuua

SEQ ID NO: 867906 - RNA, 23 nt, Human
ccgaaagugcugggauuacaggc

SEQ ID NO: 867907 - RNA, 24 nt, Human
ccgccucccggguucaagcgauuc

SEQ ID NO: 867908 - RNA, 26 nt, Human
ccgugucucaaaaaaaaaaaaaaaaa

SEQ ID NO: 867909 - RNA, 25 nt, Human
ccgugucucaaaaaaaaaaaaaaag

SEQ ID NO: 867910 - RNA, 24 nt, Human
ccucccagguucaagcaauucucc

SEQ ID NO: 867911 - RNA, 24 nt, Human
ccucccggguucaagcgauucucc

SEQ ID NO: 867912 - RNA, 23 nt, Human
ccugccucagccucccaaguagc

SEQ ID NO: 867913 - RNA, 19 nt, Human
ccugccucugccuccgaaa

SEQ ID NO: 867914 - RNA, 21 nt, Human
ccugcuccuuuggaaauggac

SEQ ID NO: 867915 - RNA, 24 nt, Human
ccuguccucccagcuacucaggag

SEQ ID NO: 867916 - RNA, 26 nt, Human
ccuucucuaguuaagacucccuguca

SEQ ID NO: 867917 - RNA, 24 nt, Human
cgaaagugcugggauuacaggcgu

SEQ ID NO: 867918 - RNA, 20 nt, Human
cggagguugcagugagccaa

SEQ ID NO: 867919 - RNA, 21 nt, Human
cggagguugcagugagccaag

SEQ ID NO: 867920 - RNA, 24 nt, Human
cggggugucaccauguuggccagg

SEQ ID NO: 867921 - RNA, 21 nt, Human
cgugagccaccacgccuggcc

SEQ ID NO: 867922 - RNA, 18 nt, Human
cucaaaaaaaaaaaaaaa

SEQ ID NO: 867923 - RNA, 26 nt, Human
cucaaaaaaaaaaaaaaaaagggaaa

SEQ ID NO: 867924 - RNA, 24 nt, Human
cucaagcaauucucccauuucaac

SEQ ID NO: 867925 - RNA, 24 nt, Human
cucacugcaaccuccaccucccag

SEQ ID NO: 867926 - RNA, 24 nt, Human
cucacugcaaccuccgccucccgg

SEQ ID NO: 867927 - RNA, 21 nt, Human
cucacugcaguuuugaccucc

SEQ ID NO: 867928 - RNA, 24 nt, Human
cucagccucccaaguagcugggau

SEQ ID NO: 867929 - RNA, 25 nt, Human
cuccugccucagccucccaaguagc

SEQ ID NO: 867930 - RNA, 24 nt, Human
cucuugaccuugugauccgccugc

SEQ ID NO: 867931 - RNA, 18 nt, Human
cugagcccaagcauugua

SEQ ID NO: 867932 - RNA, 23 nt, Human
cugcaaccuccaccucccagguu

SEQ ID NO: 867933 - RNA, 24 nt, Human
cugcaaccuccaccucccagguuc

SEQ ID NO: 867934 - RNA, 23 nt, Human
cugcaaccuccgccucccggguu

SEQ ID NO: 867935 - RNA, 23 nt, Human
cugccucagccucccaaguagcu

SEQ ID NO: 867936 - RNA, 24 nt, Human
cugugucgccaggcuggagugcag

SEQ ID NO: 867937 - RNA, 23 nt, Human
gaaaaugaucagaaaacucaugc

SEQ ID NO: 867938 - RNA, 24 nt, Human
gaaagugcugggauuacaggcgug

SEQ ID NO: 867939 - RNA, 21 nt, Human
gaacacagugcaaauuguggc

SEQ ID NO: 867940 - RNA, 27 nt, Human
gaaggcgccgcgaguaagauuucuggc

SEQ ID NO: 867941 - RNA, 22 nt, Human
gaccucgugauccgcccgccuc

SEQ ID NO: 867942 - RNA, 22 nt, Human
gaccucgugauccgcccgccuc

SEQ ID NO: 867943 - RNA, 24 nt, Human
gaccucgugauccgcccgccucgg

SEQ ID NO: 867944 - RNA, 22 nt, Human
gaccuugugauccgccugccuc

SEQ ID NO: 867945 - RNA, 24 nt, Human
gaccuugugauccgccugccucug

SEQ ID NO: 867946 - RNA, 18 nt, Human
gacuacaggcgugagcca

SEQ ID NO: 867947 - RNA, 21 nt, Human
gacuacaggcgugagccacca

SEQ ID NO: 867948 - RNA, 24 nt, Human
gacuacaggcgugugccacuaugc

SEQ ID NO: 867949 - RNA, 19 nt, Human
gagguugcagugagccaag

SEQ ID NO: 867950 - RNA, 23 nt, Human
gagguugcagugagccaagauug

SEQ ID NO: 867951 - RNA, 24 nt, Human
gaucugaccucgugauccgcccgc

SEQ ID NO: 867952 - RNA, 18 nt, Human
gauuacaggcgugagccg

SEQ ID NO: 867953 - RNA, 22 nt, Human
gauuacaggcgugagccgcugc

SEQ ID NO: 867954 - RNA, 18 nt, Human
gauuacaggugugagcca

SEQ ID NO: 867955 - RNA, 21 nt, Human
gauuacaggugugagccacca

SEQ ID NO: 867956 - RNA, 22 nt, Human
gauuacaggugugagccaccac

SEQ ID NO: 867957 - RNA, 22 nt, Human
gcaacaaaauggcggacccgga

SEQ ID NO: 867958 - RNA, 22 nt, Human
gcaaccuccaccucccagguuc

SEQ ID NO: 867959 - RNA, 22 nt, Human
gcaaccuccgccucccggguuc

SEQ ID NO: 867960 - RNA, 24 nt, Human
gcacuccagccugggugacagagu

SEQ ID NO: 867961 - RNA, 23 nt, Human
gcccggccaauuuuuuguauuuu

SEQ ID NO: 867962 - RNA, 23 nt, Human
gcccggcuaauuuuuuguauuuu

SEQ ID NO: 867963 - RNA, 23 nt, Human
gccucggccucccaaaguguugg

SEQ ID NO: 867964 - RNA, 24 nt, Human
gcgauucuccugccucagccuccc

SEQ ID NO: 867965 - RNA, 21 nt, Human
gcucacugcaguuuugaccuc

SEQ ID NO: 867966 - RNA, 22 nt, Human
gcucacugcaguuuugaccucc

SEQ ID NO: 867967 - RNA, 27 nt, Human
gcucuguugcccaggcuggaguguaau

SEQ ID NO: 867968 - RNA, 19 nt, Human
ggacccggaaaugaaggcg

SEQ ID NO: 867969 - RNA, 19 nt, Human
ggacuacaggcgugagcca

SEQ ID NO: 867970 - RNA, 24 nt, Human
ggacuacaggcgugugccacuaug

SEQ ID NO: 867971 - RNA, 22 nt, Human
ggagguugcagugagccaagau

SEQ ID NO: 867972 - RNA, 24 nt, Human
ggagguugcagugagccaagauug

SEQ ID NO: 867973 - RNA, 22 nt, Human
ggaguuucaccguguuagccag

SEQ ID NO: 867974 - RNA, 20 nt, Human
ggcauuuucaggucacuuga

SEQ ID NO: 867975 - RNA, 24 nt, Human
ggcucuguugcccaggcuggagug

SEQ ID NO: 867976 - RNA, 23 nt, Human
ggggugucaccauguuggccagg

SEQ ID NO: 867977 - RNA, 19 nt, Human
gggugucaccauguuggcc

SEQ ID NO: 867978 - RNA, 23 nt, Human
guagagacggggugucaccaugu

SEQ ID NO: 867979 - RNA, 18 nt, Human
guagcugggauuacaggc

SEQ ID NO: 867980 - RNA, 24 nt, Human
gucaguuauuuaaaaaaaaaaauc

SEQ ID NO: 867981 - RNA, 24 nt, Human
gugauccgcccgccucggccuccc

SEQ ID NO: 867982 - RNA, 23 nt, Human
guggagaaacagaggcaacaaaa

SEQ ID NO: 867983 - RNA, 23 nt, Human
uaaaaaaaaaaaucaacccacaa

SEQ ID NO: 867984 - RNA, 27 nt, Human
uaaaaaaaaaaaucaacccacaacaug

SEQ ID NO: 867985 - RNA, 28 nt, Human
uaaaagaggauuaauaugaacacagugg

SEQ ID NO: 867986 - RNA, 18 nt, Human
uaaagcaaugauaugagc

SEQ ID NO: 867987 - RNA, 24 nt, Human
uaauuuuuguauuuuuaguagaga

SEQ ID NO: 867988 - RNA, 22 nt, Human
uacaggcgugagccaccacgcc

SEQ ID NO: 867989 - RNA, 23 nt, Human
uacaggcgugagccaccacgccu

SEQ ID NO: 867990 - RNA, 19 nt, Human
uacaggcgugagccgcugc

SEQ ID NO: 867991 - RNA, 21 nt, Human
uacaggugugagccaccacac

SEQ ID NO: 867992 - RNA, 19 nt, Human
uacgcaucauaaaucuaag

SEQ ID NO: 867993 - RNA, 25 nt, Human
uacuuuuugcccuuuucaugugugc

SEQ ID NO: 867994 - RNA, 22 nt, Human
uagagacggggugucaccaugu

SEQ ID NO: 867995 - RNA, 20 nt, Human
uagcuggaaccauaggugcc

SEQ ID NO: 867996 - RNA, 24 nt, Human
uaggugccugucaccauacuuggc

SEQ ID NO: 867997 - RNA, 24 nt, Human
uaguagagacggggugucaccaug

SEQ ID NO: 867998 - RNA, 21 nt, Human
uaguagagauggaguuucacc

SEQ ID NO: 867999 - RNA, 24 nt, Human
uaguagagauggaguuucaccgug

SEQ ID NO: 868000 - RNA, 26 nt, Human
uaguagagauggaguuucaccguguu

SEQ ID NO: 868001 - RNA, 24 nt, Human
uauguugcccaggcgcaucucaaa

SEQ ID NO: 868002 - RNA, 22 nt, Human
ucaccguguuagccaggauguu

SEQ ID NO: 868003 - RNA, 24 nt, Human
ucacugcaaccuccaccucccagg

SEQ ID NO: 868004 - RNA, 25 nt, Human
ucacugcaaccuccaccucccaggu

SEQ ID NO: 868005 - RNA, 27 nt, Human
ucacugcaaccuccaccucccagguuc

SEQ ID NO: 868006 - RNA, 23 nt, Human
ucacugcaaccuccgccucccgg

SEQ ID NO: 868007 - RNA, 24 nt, Human
ucacugcaaccuccgccucccggg

SEQ ID NO: 868008 - RNA, 25 nt, Human
ucacugcaaccuccgccucccgggu

SEQ ID NO: 868009 - RNA, 27 nt, Human
ucacugcaaccuccgccucccggguuc

SEQ ID NO: 868010 - RNA, 24 nt, Human
ucacugcaguuuugaccuccaagg

SEQ ID NO: 868011 - RNA, 28 nt, Human
ucacugcaguuuugaccucggguccucc

SEQ ID NO: 868012 - RNA, 23 nt, Human
ucagaaaacucaugcucccauuc

SEQ ID NO: 868013 - RNA, 20 nt, Human
ucagccucccaaguagcugg

SEQ ID NO: 868014 - RNA, 23 nt, Human
ucagccuccugaguagcuggaac

SEQ ID NO: 868015 - RNA, 21 nt, Human
ucaguuauuuaaaaaaaaaaa

SEQ ID NO: 868016 - RNA, 24 nt, Human
uccagccugggugacagagucaga

SEQ ID NO: 868017 - RNA, 24 nt, Human
ucccaaaguguugggacuacaggc

SEQ ID NO: 868018 - RNA, 23 nt, Human
ucccaaaguguugggauuacagg

SEQ ID NO: 868019 - RNA, 24 nt, Human
ucccaaguaacugggacuacaggc

SEQ ID NO: 868020 - RNA, 24 nt, Human
ucccaaguagcugggauuacaggc

SEQ ID NO: 868021 - RNA, 21 nt, Human
ucccagguucaagcaauucuc

SEQ ID NO: 868022 - RNA, 24 nt, Human
ucccagguucaagcaauucuccug

SEQ ID NO: 868023 - RNA, 21 nt, Human
ucccggguucaagcgauucuc

SEQ ID NO: 868024 - RNA, 24 nt, Human
ucccggguucaagcgauucuccug

SEQ ID NO: 868025 - RNA, 24 nt, Human
uccgaaagugcugggauuacaggc

SEQ ID NO: 868026 - RNA, 26 nt, Human
uccucccaccucagccuccugaguag

SEQ ID NO: 868027 - RNA, 23 nt, Human
uccugagcccaagcauuguaccc

SEQ ID NO: 868028 - RNA, 24 nt, Human
uccugaguagcuggaaccauaggu

SEQ ID NO: 868029 - RNA, 23 nt, Human
ucguccgggacgcugccggccac

SEQ ID NO: 868030 - RNA, 26 nt, Human
ucuauguuuaaagcaaugauaugagc

SEQ ID NO: 868031 - RNA, 19 nt, Human
ucucaaaaaaaaaaaaaaa

SEQ ID NO: 868032 - RNA, 23 nt, Human
ucucacugugucgccaggcugga

SEQ ID NO: 868033 - RNA, 25 nt, Human
ucucacugugucgccaggcuggagu

SEQ ID NO: 868034 - RNA, 25 nt, Human
ucuccugccucagccucccaaguaa

SEQ ID NO: 868035 - RNA, 23 nt, Human
ucuggcucuguugcccaggcugg

SEQ ID NO: 868036 - RNA, 24 nt, Human
ucuggcucuguugcccaggcugga

SEQ ID NO: 868037 - RNA, 24 nt, Human
ucuguugcccaggcuggaguguaa

SEQ ID NO: 868038 - RNA, 25 nt, Human
ucuugcucugucacucaagccugga

SEQ ID NO: 868039 - RNA, 20 nt, Human
ugacagagucagaccguguc

SEQ ID NO: 868040 - RNA, 19 nt, Human
ugagacagagucucacugu

SEQ ID NO: 868041 - RNA, 22 nt, Human
ugagacagagucuggcucuguu

SEQ ID NO: 868042 - RNA, 20 nt, Human
ugaguagcuggaaccauagg

SEQ ID NO: 868043 - RNA, 31 nt, Human
ugauaugagcuaagaaauuugguccuuuauu

SEQ ID NO: 868044 - RNA, 23 nt, Human
ugaugugguggcauaugccuguc

SEQ ID NO: 868045 - RNA, 24 nt, Human
ugcacagagaaacuuccugagccc

SEQ ID NO: 868046 - RNA, 21 nt, Human
ugcaccaccgcacuccagccu

SEQ ID NO: 868047 - RNA, 22 nt, Human
ugcaguggcacgaucuuggcuc

SEQ ID NO: 868048 - RNA, 25 nt, Human
ugcccaggcgcaucucaaacuccug

SEQ ID NO: 868049 - RNA, 21 nt, Human
ugcccaggcuggaguguaaug

SEQ ID NO: 868050 - RNA, 24 nt, Human
ugcccaggcuggaguguaauggug

SEQ ID NO: 868051 - RNA, 24 nt, Human
ugccucagccucccaaguaacugg

SEQ ID NO: 868052 - RNA, 24 nt, Human
ugccucagccucccaaguagcugg

SEQ ID NO: 868053 - RNA, 22 nt, Human
ugccucugccuccgaaagugcu

SEQ ID NO: 868054 - RNA, 24 nt, Human
ugccuggguaauuuuuguauuuuu

SEQ ID NO: 868055 - RNA, 24 nt, Human
ugccuguccucccagcuacucagg

SEQ ID NO: 868056 - RNA, 21 nt, Human
ugcugaggcacuucugaggug

SEQ ID NO: 868057 - RNA, 20 nt, Human
ugcugggauuacaggcguga

SEQ ID NO: 868058 - RNA, 24 nt, Human
uggaaccauaggugccugucacca

SEQ ID NO: 868059 - RNA, 23 nt, Human
uggaggcggagguugcagugagc

SEQ ID NO: 868060 - RNA, 23 nt, Human
uggagugcaguggcacgaucuug

SEQ ID NO: 868061 - RNA, 24 nt, Human
uggagugcaguggcacgaucuugg

SEQ ID NO: 868062 - RNA, 23 nt, Human
uggaguguaauggugcgaucuca

SEQ ID NO: 868063 - RNA, 24 nt, Human
uggaguguaauggugcgaucucag

SEQ ID NO: 868064 - RNA, 24 nt, Human
uggaguuucaccguguuagccagg

SEQ ID NO: 868065 - RNA, 21 nt, Human
uggccuaguuuccuuuuuccu

SEQ ID NO: 868066 - RNA, 24 nt, Human
uggcucuguugcccaggcuggagu

SEQ ID NO: 868067 - RNA, 18 nt, Human
ugggacuacaggcgugag

SEQ ID NO: 868068 - RNA, 19 nt, Human
ugggacuacaggcgugagc

SEQ ID NO: 868069 - RNA, 22 nt, Human
ugggacuacaggcgugagccac

SEQ ID NO: 868070 - RNA, 24 nt, Human
ugggacuacaggcgugagccacca

SEQ ID NO: 868071 - RNA, 18 nt, Human
ugggacuacaggcgugug

SEQ ID NO: 868072 - RNA, 21 nt, Human
ugggacuacaggcgugugcca

SEQ ID NO: 868073 - RNA, 22 nt, Human
ugggacuacaggcgugugccac

SEQ ID NO: 868074 - RNA, 22 nt, Human
ugggacuacaggcgugugccac

SEQ ID NO: 868075 - RNA, 22 nt, Human
ugggacuacaggcgugugccac

SEQ ID NO: 868076 - RNA, 24 nt, Human
ugggacuacaggcgugugccacua

SEQ ID NO: 868077 - RNA, 21 nt, Human
ugggauuacaggcaggugcca

SEQ ID NO: 868078 - RNA, 22 nt, Human
ugggauuacaggcaggugccac

SEQ ID NO: 868079 - RNA, 24 nt, Human
ugggauuacaggcaggugccacca

SEQ ID NO: 868080 - RNA, 18 nt, Human
ugggauuacaggcgugag

SEQ ID NO: 868081 - RNA, 19 nt, Human
ugggauuacaggcgugagc

SEQ ID NO: 868082 - RNA, 20 nt, Human
ugggauuacaggcgugagcc

SEQ ID NO: 868083 - RNA, 20 nt, Human
ugggauuacaggcgugagcc

SEQ ID NO: 868084 - RNA, 21 nt, Human
ugggauuacaggcgugagccg

SEQ ID NO: 868085 - RNA, 21 nt, Human
ugggauuacaggcgugagccg

SEQ ID NO: 868086 - RNA, 22 nt, Human
ugggauuacaggcgugagccgc

SEQ ID NO: 868087 - RNA, 24 nt, Human
ugggauuacaggcgugagccgcug

SEQ ID NO: 868088 - RNA, 24 nt, Human
ugggauuacaggcgugagccgcug

SEQ ID NO: 868089 - RNA, 18 nt, Human
ugggauuacaggugugag

SEQ ID NO: 868090 - RNA, 19 nt, Human
ugggauuacaggugugagc

SEQ ID NO: 868091 - RNA, 22 nt, Human
ugggauuacaggugugagccac

SEQ ID NO: 868092 - RNA, 23 nt, Human
ugggauuacaggugugagccacc

SEQ ID NO: 868093 - RNA, 24 nt, Human
ugggauuacaggugugagccacca

SEQ ID NO: 868094 - RNA, 24 nt, Human
uggugcaaccauggcucacugcag

SEQ ID NO: 868095 - RNA, 24 nt, Human
uggugcgaucucagcucacugcaa

SEQ ID NO: 868096 - RNA, 24 nt, Human
ugguggcauaugccuguccuccca

SEQ ID NO: 868097 - RNA, 21 nt, Human
uguauuuuuaguagagacggg

SEQ ID NO: 868098 - RNA, 22 nt, Human
uguauuuuuaguagagauggag

SEQ ID NO: 868099 - RNA, 20 nt, Human
ugucuaacuucccuuccaau

SEQ ID NO: 868100 - RNA, 20 nt, Human
uguugcccaggcuggagugu

SEQ ID NO: 868101 - RNA, 19 nt, Human
uguuugucuucuguauauu

SEQ ID NO: 868102 - RNA, 19 nt, Human
uguuuguuuuguuuuuuug

SEQ ID NO: 868103 - RNA, 24 nt, Human
uuaguagagacggggugucaccau

SEQ ID NO: 868104 - RNA, 18 nt, Human
uuaguagagauggaguuu

SEQ ID NO: 868105 - RNA, 22 nt, Human
uuaguagagauggaguuucacc

SEQ ID NO: 868106 - RNA, 24 nt, Human
uuaguagagauggaguuucaccgu

SEQ ID NO: 868107 - RNA, 21 nt, Human
uucaagcaauucuccugccuc

SEQ ID NO: 868108 - RNA, 24 nt, Human
uucaagcaauucuccugccucagc

SEQ ID NO: 868109 - RNA, 21 nt, Human
uucaagcgauucuccugccuc

SEQ ID NO: 868110 - RNA, 23 nt, Human
uucaagcgauucuccugccucag

SEQ ID NO: 868111 - RNA, 24 nt, Human
uucaagcgauucuccugccucagc

SEQ ID NO: 868112 - RNA, 19 nt, Human
uuccaauugguuuuuccaa

SEQ ID NO: 868113 - RNA, 25 nt, Human
uuccugagcccaagcauuguacccu

SEQ ID NO: 868114 - RNA, 22 nt, Human
uugcacagagaaacuuccugag

SEQ ID NO: 868115 - RNA, 22 nt, Human
uugcagugagccaagauugcac

SEQ ID NO: 868116 - RNA, 18 nt, Human
uugcccaggcuggagugu

SEQ ID NO: 868117 - RNA, 21 nt, Human
uugggauuacaggugugagcc

SEQ ID NO: 868118 - RNA, 23 nt, Human
uuguauuuuuaguagagacgggg

SEQ ID NO: 868119 - RNA, 23 nt, Human
uuguauuuuuaguagagauggag

SEQ ID NO: 868120 - RNA, 23 nt, Human
uuguuuguuuguuuuguuuuuuu

SEQ ID NO: 868121 - RNA, 19 nt, Human
uuguuuuuuugagacagag

SEQ ID NO: 868122 - RNA, 19 nt, Human
uuucaccguguuagccagg

SEQ ID NO: 868123 - RNA, 20 nt, Human
uuuuguauuuuuaguagaga

SEQ ID NO: 868124 - RNA, 24 nt, Human
uuuuuaguagagacggggugucac

SEQ ID NO: 868125 - RNA, 24 nt, Human
uuuuuaguagagauggaguuucac

SEQ ID NO: 868126 - RNA, 20 nt, Human
uuuuuguauuuuuaguagag

SEQ ID NO: 868127 - RNA, 21 nt, Human
uuuuuguauuuuuaguagaga

SEQ ID NO: 868128 - RNA, 23 nt, Human
uuuuuuuuugagacagagucugg

SEQ ID NO: 868129 - RNA, 25 nt, Human
uuuuuuuuuuugagacagagucugg

SEQ ID NO: 868130 - RNA, 23 nt, Human
aaauaaaccucaaaauuguacuc

SEQ ID NO: 868131 - RNA, 20 nt, Human
aaauacauauuuacaaauaa

SEQ ID NO: 868132 - RNA, 21 nt, Human
aacagagugagaucccaucuc

SEQ ID NO: 868133 - RNA, 23 nt, Human
aagcaaauuucaaaauuagcugg

SEQ ID NO: 868134 - RNA, 21 nt, Human
aaggagggguacacuccaagc

SEQ ID NO: 868135 - RNA, 19 nt, Human
aauaaaccucaaaauugua

SEQ ID NO: 868136 - RNA, 19 nt, Human
aauaaugguucuucgcaca

SEQ ID NO: 868137 - RNA, 18 nt, Human
acugcacuccagucuggg

SEQ ID NO: 868138 - RNA, 23 nt, Human
acugcacuccagucugggcaaca

SEQ ID NO: 868139 - RNA, 23 nt, Human
agcugggcaugguggcacacgcc

SEQ ID NO: 868140 - RNA, 24 nt, Human
aggcaugguggcucacaccuguaa

SEQ ID NO: 868141 - RNA, 19 nt, Human
agggguacacuccaagcgc

SEQ ID NO: 868142 - RNA, 18 nt, Human
agugucuauucaucuuaa

SEQ ID NO: 868143 - RNA, 23 nt, Human
aucccagcacuuuggaaguccac

SEQ ID NO: 868144 - RNA, 24 nt, Human
auuaugccacugcacuccagucug

SEQ ID NO: 868145 - RNA, 24 nt, Human
auucugagaccagccuggacaaca

SEQ ID NO: 868146 - RNA, 19 nt, Human
caaaauuagcugggcaugg

SEQ ID NO: 868147 - RNA, 24 nt, Human
cacaccuguaaucccagcacuuug

SEQ ID NO: 868148 - RNA, 18 nt, Human
caccuguaaucccagcac

SEQ ID NO: 868149 - RNA, 19 nt, Human
caccuguaaucccagcacu

SEQ ID NO: 868150 - RNA, 19 nt, Human
cacugcacuccagucuggg

SEQ ID NO: 868151 - RNA, 21 nt, Human
cacugcacuccagucugggca

SEQ ID NO: 868152 - RNA, 22 nt, Human
cacugcacuccagucugggcaa

SEQ ID NO: 868153 - RNA, 23 nt, Human
cacugcacuccagucugggcaac

SEQ ID NO: 868154 - RNA, 24 nt, Human
cacugcacuccagucugggcaaca

SEQ ID NO: 868155 - RNA, 19 nt, Human
caguuagugcuugacacgu

SEQ ID NO: 868156 - RNA, 24 nt, Human
caucaguauuuucuggcuaugaaa

SEQ ID NO: 868157 - RNA, 20 nt, Human
ccaagaaauggcaaacuauc

SEQ ID NO: 868158 - RNA, 20 nt, Human
ccacugcacuccagucuggg

SEQ ID NO: 868159 - RNA, 20 nt, Human
ccacugcacuccagucuggg

SEQ ID NO: 868160 - RNA, 21 nt, Human
ccacugcacuccagucugggc

SEQ ID NO: 868161 - RNA, 23 nt, Human
ccacugcacuccagucugggcaa

SEQ ID NO: 868162 - RNA, 24 nt, Human
ccacugcacuccagucugggcaac

SEQ ID NO: 868163 - RNA, 22 nt, Human
ccagccuggacaacagagugag

SEQ ID NO: 868164 - RNA, 27 nt, Human
cccaagaaauggcaaacuaucuauaaa

SEQ ID NO: 868165 - RNA, 22 nt, Human
ccccaggaaaggagggguacac

SEQ ID NO: 868166 - RNA, 21 nt, Human
ccuauagucccagcuaaucag

SEQ ID NO: 868167 - RNA, 24 nt, Human
cgccuauagucccagcuaaucagg

SEQ ID NO: 868168 - RNA, 22 nt, Human
cucacaccuguaaucccagcac

SEQ ID NO: 868169 - RNA, 24 nt, Human
cucacaccuguaaucccagcacuu

SEQ ID NO: 868170 - RNA, 19 nt, Human
cugaauaucuuuaagugaa

SEQ ID NO: 868171 - RNA, 20 nt, Human
cugauugccaaaaaaguguu

SEQ ID NO: 868172 - RNA, 22 nt, Human
gaaaauuuuccaagcauuguac

SEQ ID NO: 868173 - RNA, 19 nt, Human
gaaguccacugugggagga

SEQ ID NO: 868174 - RNA, 21 nt, Human
gcacagcuacaaacugauugc

SEQ ID NO: 868175 - RNA, 22 nt, Human
gccacugcacuccagucugggc

SEQ ID NO: 868176 - RNA, 24 nt, Human
gccacugcacuccagucugggcaa

SEQ ID NO: 868177 - RNA, 18 nt, Human
ggaucacucaccagaauu

SEQ ID NO: 868178 - RNA, 22 nt, Human
ggcaugguggcacacgccuaua

SEQ ID NO: 868179 - RNA, 21 nt, Human
ggccaggcaugguggcucaca

SEQ ID NO: 868180 - RNA, 24 nt, Human
gguggcacacgccuauagucccag

SEQ ID NO: 868181 - RNA, 24 nt, Human
gguggcucacaccuguaaucccag

SEQ ID NO: 868182 - RNA, 21 nt, Human
guacucuuauagaacuuauuu

SEQ ID NO: 868183 - RNA, 21 nt, Human
guccuuagcaacgggguccag

SEQ ID NO: 868184 - RNA, 23 nt, Human
guuaacgaaggcuacucucgacu

SEQ ID NO: 868185 - RNA, 20 nt, Human
uaaaaagacacuagaaaaua

SEQ ID NO: 868186 - RNA, 27 nt, Human
uaaacaacauacuuguaauccugaaag

SEQ ID NO: 868187 - RNA, 23 nt, Human
uaaacuagaauacucugaaaauu

SEQ ID NO: 868188 - RNA, 18 nt, Human
uacaagcaaauuucaaaa

SEQ ID NO: 868189 - RNA, 28 nt, Human
uaccccaggaaaggagggguacacucca

SEQ ID NO: 868190 - RNA, 20 nt, Human
uagcaacgggguccagcggc

SEQ ID NO: 868191 - RNA, 22 nt, Human
uagcugggcaugguggcacacg

SEQ ID NO: 868192 - RNA, 22 nt, Human
uauagucccagcuaaucaggag

SEQ ID NO: 868193 - RNA, 24 nt, Human
uaugauuaugccacugcacuccag

SEQ ID NO: 868194 - RNA, 25 nt, Human
ucaacagguagaaaaaacaauuuuu

SEQ ID NO: 868195 - RNA, 24 nt, Human
ucaauaaugguucuucgcacaaau

SEQ ID NO: 868196 - RNA, 18 nt, Human
ucaguauuuucuggcuau

SEQ ID NO: 868197 - RNA, 21 nt, Human
uccaagcgcucacgaucucaa

SEQ ID NO: 868198 - RNA, 26 nt, Human
uccauuaguaacuguucuccucgugg

SEQ ID NO: 868199 - RNA, 23 nt, Human
ucucuacaagcaaauuucaaaau

SEQ ID NO: 868200 - RNA, 24 nt, Human
ugacacgucaacagguagaaaaaa

SEQ ID NO: 868201 - RNA, 24 nt, Human
ugccaaaaaaguguuauaaauaaa

SEQ ID NO: 868202 - RNA, 24 nt, Human
ugccacugcacuccagucugggca

SEQ ID NO: 868203 - RNA, 21 nt, Human
uggcucacaccuguaauccca

SEQ ID NO: 868204 - RNA, 24 nt, Human
uggcucacaccuguaaucccagca

SEQ ID NO: 868205 - RNA, 18 nt, Human
uggcugugauuuacaaaa

SEQ ID NO: 868206 - RNA, 20 nt, Human
uggggccaggcaugguggcu

SEQ ID NO: 868207 - RNA, 24 nt, Human
ugguggcucacaccuguaauccca

SEQ ID NO: 868208 - RNA, 23 nt, Human
uguauucacaaacauuuguccac

SEQ ID NO: 868209 - RNA, 20 nt, Human
uguccacuauuuuaaacuuc

SEQ ID NO: 868210 - RNA, 21 nt, Human
uuaaacccaagaaauggcaaa

SEQ ID NO: 868211 - RNA, 20 nt, Human
uuaacauuuuaauugcugaa

SEQ ID NO: 868212 - RNA, 18 nt, Human
uuagcugggcaugguggc

SEQ ID NO: 868213 - RNA, 24 nt, Human
uuagcugggcaugguggcacacgc

SEQ ID NO: 868214 - RNA, 23 nt, Human
uuaugccacugcacuccagucug

SEQ ID NO: 868215 - RNA, 22 nt, Human
uucacaaacauuuguccacuau

SEQ ID NO: 868216 - RNA, 24 nt, Human
uuuaauaacuuuccauuaguaacu

SEQ ID NO: 868217 - RNA, 19 nt, Human
uuuacaaaagaauaaaaua

SEQ ID NO: 868218 - RNA, 25 nt, Human
uuuuuuguugaugaauaacuuugau

SEQ ID NO: 868219 - RNA, 24 nt, Human
aaaggccccccaacagaaugaaag

SEQ ID NO: 868220 - RNA, 24 nt, Human
aaagugcugggauuacaggcauga

SEQ ID NO: 868221 - RNA, 25 nt, Human
aagaagccgagcggagccccgagua

SEQ ID NO: 868222 - RNA, 19 nt, Human
aagugcugggauuacaggc

SEQ ID NO: 868223 - RNA, 21 nt, Human
aagugcugggauuacaggcau

SEQ ID NO: 868224 - RNA, 26 nt, Human
aagugcugggauuacaggcaugagcc

SEQ ID NO: 868225 - RNA, 21 nt, Human
accacggccucccaaagugcu

SEQ ID NO: 868226 - RNA, 24 nt, Human
accauguuggucaggcuggucucg

SEQ ID NO: 868227 - RNA, 24 nt, Human
acucuuguugcccaggcuggagug

SEQ ID NO: 868228 - RNA, 22 nt, Human
acugcaaccuccgccccccagg

SEQ ID NO: 868229 - RNA, 21 nt, Human
agguucaagugauucuccugc

SEQ ID NO: 868230 - RNA, 22 nt, Human
agguucaagugauucuccugcc

SEQ ID NO: 868231 - RNA, 21 nt, Human
aguaacugggauuacaggcau

SEQ ID NO: 868232 - RNA, 23 nt, Human
aguaacugggauuacaggcaugc

SEQ ID NO: 868233 - RNA, 24 nt, Human
agugauucuccugccucagccucc

SEQ ID NO: 868234 - RNA, 18 nt, Human
agugcugggauuacaggc

SEQ ID NO: 868235 - RNA, 21 nt, Human
augggguuucaccauguuggu

SEQ ID NO: 868236 - RNA, 23 nt, Human
augggguuucaccauguugguca

SEQ ID NO: 868237 - RNA, 24 nt, Human
augggguuucaccauguuggucag

SEQ ID NO: 868238 - RNA, 18 nt, Human
auucuccugccucagccu

SEQ ID NO: 868239 - RNA, 24 nt, Human
caaagugcugggauuacaggcaug

SEQ ID NO: 868240 - RNA, 24 nt, Human
caaccuccgccccccagguucaag

SEQ ID NO: 868241 - RNA, 19 nt, Human
caacgccaugaaaucagag

SEQ ID NO: 868242 - RNA, 20 nt, Human
caagugauucuccugccuca

SEQ ID NO: 868243 - RNA, 22 nt, Human
caagugauucuccugccucagc

SEQ ID NO: 868244 - RNA, 21 nt, Human
caccauguuggucaggcuggu

SEQ ID NO: 868245 - RNA, 24 nt, Human
caccauguuggucaggcuggucuc

SEQ ID NO: 868246 - RNA, 24 nt, Human
cacucuuguugcccaggcuggagu

SEQ ID NO: 868247 - RNA, 20 nt, Human
cagccuccugaguaacuggg

SEQ ID NO: 868248 - RNA, 20 nt, Human
caggugauccgcccaccacg

SEQ ID NO: 868249 - RNA, 25 nt, Human
cauauauauaugucccccauguucu

SEQ ID NO: 868250 - RNA, 23 nt, Human
ccaaagugcugggauuacaggca

SEQ ID NO: 868251 - RNA, 24 nt, Human
ccaaagugcugggauuacaggcau

SEQ ID NO: 868252 - RNA, 23 nt, Human
ccaacagaaugaaagguguuaaa

SEQ ID NO: 868253 - RNA, 24 nt, Human
cccaaagugcugggauuacaggca

SEQ ID NO: 868254 - RNA, 19 nt, Human
cccaggcuggagugcaacg

SEQ ID NO: 868255 - RNA, 21 nt, Human
cccagguucaagugauucucc

SEQ ID NO: 868256 - RNA, 18 nt, Human
ccccagaauuccagaacc

SEQ ID NO: 868257 - RNA, 21 nt, Human
ccccagguucaagugauucuc

SEQ ID NO: 868258 - RNA, 24 nt, Human
ccccagguucaagugauucuccug

SEQ ID NO: 868259 - RNA, 23 nt, Human
cccccagguucaagugauucucc

SEQ ID NO: 868260 - RNA, 24 nt, Human
ccccccagguucaagugauucucc

SEQ ID NO: 868261 - RNA, 22 nt, Human
ccccgaguauuggguguugccc

SEQ ID NO: 868262 - RNA, 24 nt, Human
ccgccccccagguucaagugauuc

SEQ ID NO: 868263 - RNA, 24 nt, Human
ccugaccucaggugauccgcccac

SEQ ID NO: 868264 - RNA, 19 nt, Human
ccugaguaacugggauuac

SEQ ID NO: 868265 - RNA, 23 nt, Human
ccugaguaacugggauuacaggc

SEQ ID NO: 868266 - RNA, 24 nt, Human
ccugaguaacugggauuacaggca

SEQ ID NO: 868267 - RNA, 22 nt, Human
cgccccccagguucaagugauu

SEQ ID NO: 868268 - RNA, 18 nt, Human
cgcccggccucauuucuu

SEQ ID NO: 868269 - RNA, 25 nt, Human
cgcgaagaagccgagcggagccccg

SEQ ID NO: 868270 - RNA, 18 nt, Human
cucuuguugcccaggcug

SEQ ID NO: 868271 - RNA, 23 nt, Human
cugaguaacugggauuacaggca

SEQ ID NO: 868272 - RNA, 24 nt, Human
cugaguaacugggauuacaggcau

SEQ ID NO: 868273 - RNA, 23 nt, Human
cugcaaccuccgccccccagguu

SEQ ID NO: 868274 - RNA, 24 nt, Human
cugcaaccuccgccccccagguuc

SEQ ID NO: 868275 - RNA, 23 nt, Human
cugccucagccuccugaguaacu

SEQ ID NO: 868276 - RNA, 22 nt, Human
cuuacugcaaccuccgcccccc

SEQ ID NO: 868277 - RNA, 24 nt, Human
cuuguugcccaggcuggagugcaa

SEQ ID NO: 868278 - RNA, 22 nt, Human
cuuuaaaagauguaaaaaaaaa

SEQ ID NO: 868279 - RNA, 23 nt, Human
cuuuuuggagucuuauucgaaua

SEQ ID NO: 868280 - RNA, 22 nt, Human
gaccucaggugauccgcccacc

SEQ ID NO: 868281 - RNA, 24 nt, Human
gagaugggguuucaccauguuggu

SEQ ID NO: 868282 - RNA, 22 nt, Human
gaguaacugggauuacaggcau

SEQ ID NO: 868283 - RNA, 18 nt, Human
gauuacaggcaugagcca

SEQ ID NO: 868284 - RNA, 22 nt, Human
gauuacaggcaugagccacugc

SEQ ID NO: 868285 - RNA, 22 nt, Human
gauuacaggcaugagccacugc

SEQ ID NO: 868286 - RNA, 18 nt, Human
gauuacaggcaugcgcca

SEQ ID NO: 868287 - RNA, 22 nt, Human
gcaaccuccgccccccagguuc

SEQ ID NO: 868288 - RNA, 19 nt, Human
gccaugaaaucagaguaac

SEQ ID NO: 868289 - RNA, 19 nt, Human
gcccaggcuggagugcaac

SEQ ID NO: 868290 - RNA, 20 nt, Human
gcgcgaagaagccgagcgga

SEQ ID NO: 868291 - RNA, 23 nt, Human
gcuggucucgaacuccugaccuc

SEQ ID NO: 868292 - RNA, 22 nt, Human
ggauuacaggcaugagccacug

SEQ ID NO: 868293 - RNA, 19 nt, Human
ggauuacaggcaugcgcca

SEQ ID NO: 868294 - RNA, 24 nt, Human
ggcuggucucgaacuccugaccuc

SEQ ID NO: 868295 - RNA, 22 nt, Human
gggguuucaccauguuggucag

SEQ ID NO: 868296 - RNA, 19 nt, Human
ggucucgaacuccugaccu

SEQ ID NO: 868297 - RNA, 20 nt, Human
guaacugggauuacaggcau

SEQ ID NO: 868298 - RNA, 19 nt, Human
guagagaugggguuucacc

SEQ ID NO: 868299 - RNA, 21 nt, Human
guagagaugggguuucaccau

SEQ ID NO: 868300 - RNA, 22 nt, Human
guagagaugggguuucaccaug

SEQ ID NO: 868301 - RNA, 23 nt, Human
guagagaugggguuucaccaugu

SEQ ID NO: 868302 - RNA, 23 nt, Human
gugauucuccugccucagccucc

SEQ ID NO: 868303 - RNA, 19 nt, Human
gugccucagcccgcugcgg

SEQ ID NO: 868304 - RNA, 22 nt, Human
gugccucagcccgcugcggagc

SEQ ID NO: 868305 - RNA, 23 nt, Human
guuaaaucaggucaucuugaaua

SEQ ID NO: 868306 - RNA, 18 nt, Human
guugccagcuugcauggu

SEQ ID NO: 868307 - RNA, 19 nt, Human
uaacagguuuucugucacu

SEQ ID NO: 868308 - RNA, 22 nt, Human
uaagacuacaaagcagcauaac

SEQ ID NO: 868309 - RNA, 23 nt, Human
uaauuuuguauuuuucguagaga

SEQ ID NO: 868310 - RNA, 25 nt, Human
uaauuuuguauuuuucguagagaug

SEQ ID NO: 868311 - RNA, 23 nt, Human
uacaggcaugagccacugcgccc

SEQ ID NO: 868312 - RNA, 20 nt, Human
uacaggcaugcgccaucaca

SEQ ID NO: 868313 - RNA, 21 nt, Human
uacugcaaccuccgcccccca

SEQ ID NO: 868314 - RNA, 22 nt, Human
uagagaugggguuucaccaugu

SEQ ID NO: 868315 - RNA, 26 nt, Human
uauacauauauauaugucccccaugu

SEQ ID NO: 868316 - RNA, 22 nt, Human
uauaggaaaucaaaggcccccc

SEQ ID NO: 868317 - RNA, 22 nt, Human
uauucgaauauauacauauaua

SEQ ID NO: 868318 - RNA, 19 nt, Human
ucaagugauucuccugccu

SEQ ID NO: 868319 - RNA, 21 nt, Human
ucacucuuguugcccaggcug

SEQ ID NO: 868320 - RNA, 23 nt, Human
ucacucuuguugcccaggcugga

SEQ ID NO: 868321 - RNA, 24 nt, Human
ucccaaagugcugggauuacaggc

SEQ ID NO: 868322 - RNA, 24 nt, Human
uccugaguaacugggauuacaggc

SEQ ID NO: 868323 - RNA, 21 nt, Human
ucguagagaugggguuucacc

SEQ ID NO: 868324 - RNA, 24 nt, Human
ucguagagaugggguuucaccaug

SEQ ID NO: 868325 - RNA, 24 nt, Human
ucuccugccucagccuccugagua

SEQ ID NO: 868326 - RNA, 23 nt, Human
ucucgaacuccugaccucaggug

SEQ ID NO: 868327 - RNA, 22 nt, Human
ucuuguugcccaggcuggagug

SEQ ID NO: 868328 - RNA, 18 nt, Human
ugaccucaggugauccgc

SEQ ID NO: 868329 - RNA, 21 nt, Human
ugaccucaggugauccgccca

SEQ ID NO: 868330 - RNA, 24 nt, Human
ugauccgcccaccacggccuccca

SEQ ID NO: 868331 - RNA, 21 nt, Human
ugaugcaauguauagcacuuu

SEQ ID NO: 868332 - RNA, 20 nt, Human
ugcaauguauagcacuuuuu

SEQ ID NO: 868333 - RNA, 25 nt, Human
ugcauguaguauauuuuucccucgg

SEQ ID NO: 868334 - RNA, 18 nt, Human
ugcccaggcuggagugca

SEQ ID NO: 868335 - RNA, 21 nt, Human
ugcccaggcuggagugcaacg

SEQ ID NO: 868336 - RNA, 20 nt, Human
ugccucagcccgcugcggag

SEQ ID NO: 868337 - RNA, 24 nt, Human
ugccucagccuccugaguaacugg

SEQ ID NO: 868338 - RNA, 24 nt, Human
uggagugcaacggcgcgaucucgg

SEQ ID NO: 868339 - RNA, 18 nt, Human
ugggauuacaggcaugag

SEQ ID NO: 868340 - RNA, 19 nt, Human
ugggauuacaggcaugagc

SEQ ID NO: 868341 - RNA, 21 nt, Human
ugggauuacaggcaugagcca

SEQ ID NO: 868342 - RNA, 22 nt, Human
ugggauuacaggcaugagccac

SEQ ID NO: 868343 - RNA, 22 nt, Human
ugggauuacaggcaugagccac

SEQ ID NO: 868344 - RNA, 23 nt, Human
ugggauuacaggcaugagccacu

SEQ ID NO: 868345 - RNA, 24 nt, Human
ugggauuacaggcaugagccacug

SEQ ID NO: 868346 - RNA, 26 nt, Human
ugggauuacaggcaugagccacugcg

SEQ ID NO: 868347 - RNA, 18 nt, Human
ugggauuacaggcaugcg

SEQ ID NO: 868348 - RNA, 19 nt, Human
ugggauuacaggcaugcgc

SEQ ID NO: 868349 - RNA, 21 nt, Human
ugggauuacaggcaugcgcca

SEQ ID NO: 868350 - RNA, 21 nt, Human
ugggauuacaggcaugcgcca

SEQ ID NO: 868351 - RNA, 22 nt, Human
ugggauuacaggcaugcgccau

SEQ ID NO: 868352 - RNA, 24 nt, Human
ugggauuacaggcaugcgccauca

SEQ ID NO: 868353 - RNA, 24 nt, Human
ugggauuacaggcaugcgccauca

SEQ ID NO: 868354 - RNA, 24 nt, Human
ugggguuucaccauguuggucagg

SEQ ID NO: 868355 - RNA, 24 nt, Human
uggucaggcuggucucgaacuccu

SEQ ID NO: 868356 - RNA, 20 nt, Human
uguugcccaggcuggagugc

SEQ ID NO: 868357 - RNA, 20 nt, Human
uuaaauaagcauuuaaaaau

SEQ ID NO: 868358 - RNA, 23 nt, Human
uuaacagccucuucaccauuagc

SEQ ID NO: 868359 - RNA, 18 nt, Human
uuacugcaaccuccgccc

SEQ ID NO: 868360 - RNA, 24 nt, Human
uuacugcaaccuccgccccccagg

SEQ ID NO: 868361 - RNA, 21 nt, Human
uucaagugauucuccugccuc

SEQ ID NO: 868362 - RNA, 23 nt, Human
uucaagugauucuccugccucag

SEQ ID NO: 868363 - RNA, 24 nt, Human
uucaagugauucuccugccucagc

SEQ ID NO: 868364 - RNA, 24 nt, Human
uucacucuuguugcccaggcugga

SEQ ID NO: 868365 - RNA, 24 nt, Human
uucguagagaugggguuucaccau

SEQ ID NO: 868366 - RNA, 24 nt, Human
uuucaccauguuggucaggcuggu

SEQ ID NO: 868367 - RNA, 24 nt, Human
uuucacucuuguugcccaggcugg

SEQ ID NO: 868368 - RNA, 20 nt, Human
uuuuguauuuuucguagaga

SEQ ID NO: 868369 - RNA, 24 nt, Human
uuuuucguagagaugggguuucac

SEQ ID NO: 868370 - RNA, 20 nt, Human
aaagcagaccaaccccagga

SEQ ID NO: 868371 - RNA, 20 nt, Human
aaccccaggaucuccagcau

SEQ ID NO: 868372 - RNA, 25 nt, Human
aagaauccaaagcacuguacagaug

SEQ ID NO: 868373 - RNA, 18 nt, Human
aagcagaccaaccccagg

SEQ ID NO: 868374 - RNA, 19 nt, Human
aauccaaagcacuguacag

SEQ ID NO: 868375 - RNA, 21 nt, Human
acaacuggaucgcccuaggac

SEQ ID NO: 868376 - RNA, 25 nt, Human
acaacuggaucgcccuaggacacag

SEQ ID NO: 868377 - RNA, 20 nt, Human
acacaaagcagaccaacccc

SEQ ID NO: 868378 - RNA, 18 nt, Human
aguaccauacacaaagca

SEQ ID NO: 868379 - RNA, 22 nt, Human
caaguaccauacacaaagcaga

SEQ ID NO: 868380 - RNA, 21 nt, Human
cacuguacagaugaucaaaac

SEQ ID NO: 868381 - RNA, 22 nt, Human
cagcugcaccucuccuuacaga

SEQ ID NO: 868382 - RNA, 25 nt, Human
cagcugcaccucuccuuacagagcc

SEQ ID NO: 868383 - RNA, 24 nt, Human
ccauaauacauaagcaugacacag

SEQ ID NO: 868384 - RNA, 24 nt, Human
ccauacacaaagcagaccaacccc

SEQ ID NO: 868385 - RNA, 22 nt, Human
cccaccagucacugcuucuaga

SEQ ID NO: 868386 - RNA, 24 nt, Human
cugggguaggccugggaggaagaa

SEQ ID NO: 868387 - RNA, 21 nt, Human
gcucacugggguaggccuggg

SEQ ID NO: 868388 - RNA, 21 nt, Human
gcugcacaacuggaucgcccu

SEQ ID NO: 868389 - RNA, 24 nt, Human
gcugcaccucuccuuacagagcca

SEQ ID NO: 868390 - RNA, 20 nt, Human
gcugcagcugcaccucuccu

SEQ ID NO: 868391 - RNA, 19 nt, Human
ggcuuuuguuuggcaacag

SEQ ID NO: 868392 - RNA, 20 nt, Human
uagaacacugcugcagcugc

SEQ ID NO: 868393 - RNA, 25 nt, Human
ucacugggguaggccugggaggaag

SEQ ID NO: 868394 - RNA, 24 nt, Human
uccaucagaggccugcuucccuug

SEQ ID NO: 868395 - RNA, 18 nt, Human
ucccuuggcugaugguca

SEQ ID NO: 868396 - RNA, 24 nt, Human
uggaacugucagaaagccccacca

SEQ ID NO: 868397 - RNA, 23 nt, Human
ugggaggaagaauccaaagcacu

SEQ ID NO: 868398 - RNA, 19 nt, Human
uguacagaugaucaaaaaa

SEQ ID NO: 868399 - RNA, 19 nt, Human
ugucagaaagccccaccag

SEQ ID NO: 868400 - RNA, 24 nt, Human
aaaaaagucuuuggauaacaacua

SEQ ID NO: 868401 - RNA, 22 nt, Human
aaccauuuaaaaaucagaucua

SEQ ID NO: 868402 - RNA, 25 nt, Human
aaccauuuaaaaaucagaucuacga

SEQ ID NO: 868403 - RNA, 27 nt, Human
aacucauaacaaaacgcccacgcgucc

SEQ ID NO: 868404 - RNA, 21 nt, Human
aagauggauaugcauuacaaa

SEQ ID NO: 868405 - RNA, 19 nt, Human
aagcaaaguguucagaucu

SEQ ID NO: 868406 - RNA, 21 nt, Human
aagcacauguaaguaaaggua

SEQ ID NO: 868407 - RNA, 24 nt, Human
aagccuuguaaaaagauccuuugg

SEQ ID NO: 868408 - RNA, 22 nt, Human
aaugcuccagagaauccaaagc

SEQ ID NO: 868409 - RNA, 20 nt, Human
acaagacacaaauacauaau

SEQ ID NO: 868410 - RNA, 22 nt, Human
acagaucuucacuauguguuau

SEQ ID NO: 868411 - RNA, 19 nt, Human
acaucaaagugcuccuagu

SEQ ID NO: 868412 - RNA, 22 nt, Human
acugcuacaacauggacuucug

SEQ ID NO: 868413 - RNA, 22 nt, Human
agauauggccucagugauuucc

SEQ ID NO: 868414 - RNA, 22 nt, Human
aguguugcuuuggcaaaugguu

SEQ ID NO: 868415 - RNA, 26 nt, Human
auaaagcacauguaaguaaagguacu

SEQ ID NO: 868416 - RNA, 19 nt, Human
auuaaaacagaaaauucuu

SEQ ID NO: 868417 - RNA, 19 nt, Human
auuacaaaugaauugugcu

SEQ ID NO: 868418 - RNA, 20 nt, Human
caaaaaauucaagugaccau

SEQ ID NO: 868419 - RNA, 23 nt, Human
caaaugguuuuuauucuaaccca

SEQ ID NO: 868420 - RNA, 18 nt, Human
cacagaucuucacuaugu

SEQ ID NO: 868421 - RNA, 21 nt, Human
caguauuaaaaguauagagcu

SEQ ID NO: 868422 - RNA, 20 nt, Human
cauaacaaaacgcccacgcg

SEQ ID NO: 868423 - RNA, 23 nt, Human
cuauagcuuaaugugacuaauuu

SEQ ID NO: 868424 - RNA, 21 nt, Human
cucaaauucuaacugcuacaa

SEQ ID NO: 868425 - RNA, 24 nt, Human
cucagagucaauaccacaggaagc

SEQ ID NO: 868426 - RNA, 19 nt, Human
gaccuggcacuaguguagg

SEQ ID NO: 868427 - RNA, 23 nt, Human
gagauuuuaacaucuuacaauag

SEQ ID NO: 868428 - RNA, 19 nt, Human
ggucuucuuaaauuggcug

SEQ ID NO: 868429 - RNA, 18 nt, Human
uaaaaagauauggccuca

SEQ ID NO: 868430 - RNA, 23 nt, Human
uaaaacauaauugucacaagaca

SEQ ID NO: 868431 - RNA, 22 nt, Human
uaaaauuacaauaaacaacuga

SEQ ID NO: 868432 - RNA, 19 nt, Human
uaaagcaccuuggauugaa

SEQ ID NO: 868433 - RNA, 20 nt, Human
uaaucuacuccccuaauuaa

SEQ ID NO: 868434 - RNA, 19 nt, Human
uagugaggaggaaugaugu

SEQ ID NO: 868435 - RNA, 27 nt, Human
ucaaauucuaacugcuacaacauggac

SEQ ID NO: 868436 - RNA, 21 nt, Human
uccagagaauccaaagcagca

SEQ ID NO: 868437 - RNA, 24 nt, Human
ucuuuuuaaagcuauucugguuua

SEQ ID NO: 868438 - RNA, 19 nt, Human
ugaacaauuuuaaaagccc

SEQ ID NO: 868439 - RNA, 20 nt, Human
ugacaaaagcuaaauuuaug

SEQ ID NO: 868440 - RNA, 20 nt, Human
ugagacuucaugaggggucu

SEQ ID NO: 868441 - RNA, 23 nt, Human
ugcuccagagaauccaaagcagc

SEQ ID NO: 868442 - RNA, 24 nt, Human
uggauugaauccaagauggauaug

SEQ ID NO: 868443 - RNA, 26 nt, Human
uggccucagugauuuccucuuagcau

SEQ ID NO: 868444 - RNA, 19 nt, Human
ugucaaagcaaccaaccau

SEQ ID NO: 868445 - RNA, 20 nt, Human
uucaacuggaagagccacag

SEQ ID NO: 868446 - RNA, 21 nt, Human
uuucaacuggaagagccacag

SEQ ID NO: 868447 - RNA, 23 nt, Human
uuucaacuggaagagccacaguu

SEQ ID NO: 868448 - RNA, 20 nt, Human
aaacagguacacaagguccu

SEQ ID NO: 868449 - RNA, 23 nt, Human
aagaaaaccuuccagcaggagcc

SEQ ID NO: 868450 - RNA, 24 nt, Human
aaggagaaagagcaggguacacag

SEQ ID NO: 868451 - RNA, 24 nt, Human
aagugccagcaagcugcaagugcu

SEQ ID NO: 868452 - RNA, 23 nt, Human
acagggcaaaggaggcugcggaa

SEQ ID NO: 868453 - RNA, 21 nt, Human
acccauccugccacccauccu

SEQ ID NO: 868454 - RNA, 25 nt, Human
acuucuuuuuuuuuuugcaauuugg

SEQ ID NO: 868455 - RNA, 19 nt, Human
agcacaagaaaaccuucca

SEQ ID NO: 868456 - RNA, 19 nt, Human
agcaggauguacuugggug

SEQ ID NO: 868457 - RNA, 19 nt, Human
aggaagcagaaugcuagaa

SEQ ID NO: 868458 - RNA, 19 nt, Human
aggcagcugguccugggca

SEQ ID NO: 868459 - RNA, 19 nt, Human
aggcugcaucugcuugaaa

SEQ ID NO: 868460 - RNA, 21 nt, Human
agggcugggacugccggcuuc

SEQ ID NO: 868461 - RNA, 24 nt, Human
aggggacacaguggcuguuccagg

SEQ ID NO: 868462 - RNA, 21 nt, Human
agugaagacgcucaggaagga

SEQ ID NO: 868463 - RNA, 21 nt, Human
caaacagguacacaagguccu

SEQ ID NO: 868464 - RNA, 24 nt, Human
caagaaaaccuuccagcaggagcc

SEQ ID NO: 868465 - RNA, 19 nt, Human
caagcugcaagugcugcca

SEQ ID NO: 868466 - RNA, 18 nt, Human
caaugagccccugcccua

SEQ ID NO: 868467 - RNA, 22 nt, Human
cagaaugcuagaaggccuugca

SEQ ID NO: 868468 - RNA, 19 nt, Human
caggagccaggugggccug

SEQ ID NO: 868469 - RNA, 21 nt, Human
caggauguacuuggguggugu

SEQ ID NO: 868470 - RNA, 20 nt, Human
cagggcaaaggaggcugcgg

SEQ ID NO: 868471 - RNA, 18 nt, Human
caguugggcaccaugugc

SEQ ID NO: 868472 - RNA, 19 nt, Human
cauagccaauccuggccuc

SEQ ID NO: 868473 - RNA, 24 nt, Human
ccaaggacucaaagucucagaggc

SEQ ID NO: 868474 - RNA, 22 nt, Human
ccaggaagcagaaugcuagaag

SEQ ID NO: 868475 - RNA, 21 nt, Human
ccaguaccugcaggucacagg

SEQ ID NO: 868476 - RNA, 21 nt, Human
ccccauggcagucaguggagg

SEQ ID NO: 868477 - RNA, 23 nt, Human
ccccugcccuagaagggcuacag

SEQ ID NO: 868478 - RNA, 19 nt, Human
ccugaggcugugaggcugu

SEQ ID NO: 868479 - RNA, 21 nt, Human
ccugccacccauccuccuucc

SEQ ID NO: 868480 - RNA, 18 nt, Human
ccuuccagcaggagccag

SEQ ID NO: 868481 - RNA, 23 nt, Human
cgagcacaagaaaaccuuccagc

SEQ ID NO: 868482 - RNA, 20 nt, Human
cucagguugguucuuguugg

SEQ ID NO: 868483 - RNA, 24 nt, Human
cucccauggcuucaaagauggucc

SEQ ID NO: 868484 - RNA, 18 nt, Human
cucucaggccacugucag

SEQ ID NO: 868485 - RNA, 19 nt, Human
cugcagcuccucguuccag

SEQ ID NO: 868486 - RNA, 20 nt, Human
cugggcaucaacauguggcu

SEQ ID NO: 868487 - RNA, 21 nt, Human
cugggguugcaggggacacag

SEQ ID NO: 868488 - RNA, 20 nt, Human
cugguccugggcaucaacau

SEQ ID NO: 868489 - RNA, 27 nt, Human
cuuucugcuccugccgucucucaggcc

SEQ ID NO: 868490 - RNA, 23 nt, Human
gaagcagaaugcuagaaggccuu

SEQ ID NO: 868491 - RNA, 20 nt, Human
gaaugaaggagaaagagcag

SEQ ID NO: 868492 - RNA, 23 nt, Human
gagaaagagcaggguacacagau

SEQ ID NO: 868493 - RNA, 20 nt, Human
gcugugaucacaaacaggua

SEQ ID NO: 868494 - RNA, 23 nt, Human
ggauggcccuggccacucagccc

SEQ ID NO: 868495 - RNA, 20 nt, Human
ggccugaggcugugaggcug

SEQ ID NO: 868496 - RNA, 22 nt, Human
ggggacacaguggcuguuccag

SEQ ID NO: 868497 - RNA, 18 nt, Human
gugaugguggcucucacc

SEQ ID NO: 868498 - RNA, 21 nt, Human
uaaccgcacuaaugacuuuua

SEQ ID NO: 868499 - RNA, 20 nt, Human
uaagugccagcaagcugcaa

SEQ ID NO: 868500 - RNA, 19 nt, Human
uaccugcaggucacagggc

SEQ ID NO: 868501 - RNA, 21 nt, Human
uauuuuuuccucauuucucuc

SEQ ID NO: 868502 - RNA, 26 nt, Human
ucagcccagauagcaaggagggccuu

SEQ ID NO: 868503 - RNA, 20 nt, Human
uccacagccuugaccuccaa

SEQ ID NO: 868504 - RNA, 18 nt, Human
ucccauggcuucaaagau

SEQ ID NO: 868505 - RNA, 21 nt, Human
ucccauggcuucaaagauggu

SEQ ID NO: 868506 - RNA, 21 nt, Human
ucucccauggcuucaaagauu

SEQ ID NO: 868507 - RNA, 19 nt, Human
ucucucaguaaccgcacua

SEQ ID NO: 868508 - RNA, 21 nt, Human
ucucucccgagcacaagaaaa

SEQ ID NO: 868509 - RNA, 23 nt, Human
ugaaggauguggagccccagaag

SEQ ID NO: 868510 - RNA, 21 nt, Human
ugaugguggcucucacccucu

SEQ ID NO: 868511 - RNA, 23 nt, Human
ugaugguggcucucacccucucc

SEQ ID NO: 868512 - RNA, 20 nt, Human
ugcaggggacacaguggcug

SEQ ID NO: 868513 - RNA, 22 nt, Human
uggagggugggaagcuggaugg

SEQ ID NO: 868514 - RNA, 21 nt, Human
uggauggaguagaauaaaggc

SEQ ID NO: 868515 - RNA, 18 nt, Human
uggucaggcugcaucugc

SEQ ID NO: 868516 - RNA, 22 nt, Human
uggugugcagucgguggggucc

SEQ ID NO: 868517 - RNA, 22 nt, Human
uucaggggcuuuuagucaccgu

SEQ ID NO: 868518 - RNA, 23 nt, Human
uuccagggucccuagcaggaugu

SEQ ID NO: 868519 - RNA, 19 nt, Human
uuggccuuggcccuaaugg

SEQ ID NO: 868520 - RNA, 25 nt, Human
uuggccuuggcccuaauggucaggc

SEQ ID NO: 868521 - RNA, 23 nt, Human
uuggguggugugcagucgguggg

SEQ ID NO: 868522 - RNA, 20 nt, Human
uuuggccuuggcccuaaugg

SEQ ID NO: 868523 - RNA, 22 nt, Human
aaaccaccaggggccacagcag

SEQ ID NO: 868524 - RNA, 24 nt, Human
aacacagccaacacagcacagcca

SEQ ID NO: 868525 - RNA, 20 nt, Human
aacucgggcacacucagcag

SEQ ID NO: 868526 - RNA, 19 nt, Human
aagccagccagcucugccu

SEQ ID NO: 868527 - RNA, 18 nt, Human
aagcccagcucugcauuc

SEQ ID NO: 868528 - RNA, 22 nt, Human
aagguuuccuuagcugccacau

SEQ ID NO: 868529 - RNA, 23 nt, Human
aaugcuguuuucuucacauccac

SEQ ID NO: 868530 - RNA, 20 nt, Human
acacacugccccaccccaga

SEQ ID NO: 868531 - RNA, 20 nt, Human
acacugccccaccccagagu

SEQ ID NO: 868532 - RNA, 27 nt, Human
acacugccccaccccagagugguaggc

SEQ ID NO: 868533 - RNA, 21 nt, Human
acccagaggagcaguaaggaa

SEQ ID NO: 868534 - RNA, 19 nt, Human
accccgcacccucacuguc

SEQ ID NO: 868535 - RNA, 22 nt, Human
accccgcacccucacugucaga

SEQ ID NO: 868536 - RNA, 22 nt, Human
accuaagaguguaacuacuggc

SEQ ID NO: 868537 - RNA, 19 nt, Human
agagcacaugcucaccaag

SEQ ID NO: 868538 - RNA, 25 nt, Human
agauccagcagaaaauaggccaaaa

SEQ ID NO: 868539 - RNA, 19 nt, Human
agcacagccagagcagacu

SEQ ID NO: 868540 - RNA, 21 nt, Human
agcucucccuccucucccucc

SEQ ID NO: 868541 - RNA, 23 nt, Human
aggaagacagcaaccagaagagg

SEQ ID NO: 868542 - RNA, 19 nt, Human
aggagcaguaaggaagcuc

SEQ ID NO: 868543 - RNA, 22 nt, Human
aggagcaguaaggaagcuccua

SEQ ID NO: 868544 - RNA, 20 nt, Human
aggcaaaggaggaaacagca

SEQ ID NO: 868545 - RNA, 22 nt, Human
aggcaaaggaggaaacagcaac

SEQ ID NO: 868546 - RNA, 19 nt, Human
aggcugugcagcggcuucu

SEQ ID NO: 868547 - RNA, 24 nt, Human
agggagaaagcgaggcugccagag

SEQ ID NO: 868548 - RNA, 20 nt, Human
aggggcuggggugaguccug

SEQ ID NO: 868549 - RNA, 24 nt, Human
agugcguguucacaaaguggaggg

SEQ ID NO: 868550 - RNA, 24 nt, Human
caagauagaagccuccucaucuga

SEQ ID NO: 868551 - RNA, 21 nt, Human
cacagcacagccagagcagac

SEQ ID NO: 868552 - RNA, 22 nt, Human
cacagcaggauacucaacaaga

SEQ ID NO: 868553 - RNA, 18 nt, Human
caccaggggccacagcag

SEQ ID NO: 868554 - RNA, 19 nt, Human
cagcagaaaauaggccaaa

SEQ ID NO: 868555 - RNA, 18 nt, Human
cagcagcuccugcaggug

SEQ ID NO: 868556 - RNA, 19 nt, Human
caggagccucccuaaagcu

SEQ ID NO: 868557 - RNA, 21 nt, Human
ccagagcagacucgaacgcag

SEQ ID NO: 868558 - RNA, 24 nt, Human
ccagccgcggagccgcagccacag

SEQ ID NO: 868559 - RNA, 20 nt, Human
ccaggagccucccuaaagcu

SEQ ID NO: 868560 - RNA, 21 nt, Human
ccagggguggagcaucagggg

SEQ ID NO: 868561 - RNA, 18 nt, Human
cccacacacugccccacc

SEQ ID NO: 868562 - RNA, 19 nt, Human
cccacacacugccccaccc

SEQ ID NO: 868563 - RNA, 25 nt, Human
cccagaccaggagccucccuaaagc

SEQ ID NO: 868564 - RNA, 22 nt, Human
cccagccgcggagccgcagcca

SEQ ID NO: 868565 - RNA, 24 nt, Human
cccagccgcggagccgcagccaca

SEQ ID NO: 868566 - RNA, 19 nt, Human
ccccacacacugccccacc

SEQ ID NO: 868567 - RNA, 20 nt, Human
cccccugauccagcaacuca

SEQ ID NO: 868568 - RNA, 22 nt, Human
cccgcacccucacugucagagu

SEQ ID NO: 868569 - RNA, 19 nt, Human
cccugccccauugaagugc

SEQ ID NO: 868570 - RNA, 22 nt, Human
ccgccgccagcaccgccuccca

SEQ ID NO: 868571 - RNA, 20 nt, Human
ccgccucggccguggccgcc

SEQ ID NO: 868572 - RNA, 26 nt, Human
ccgcugcgccgccgccagcaccgccu

SEQ ID NO: 868573 - RNA, 21 nt, Human
ccgggcgccugaccccgcacc

SEQ ID NO: 868574 - RNA, 22 nt, Human
ccguggccgccuccuccucugc

SEQ ID NO: 868575 - RNA, 18 nt, Human
ccucaguggugagugccu

SEQ ID NO: 868576 - RNA, 18 nt, Human
ccucccagccgcggagcc

SEQ ID NO: 868577 - RNA, 19 nt, Human
cggccguggccgccuccuc

SEQ ID NO: 868578 - RNA, 19 nt, Human
cguggccaggcgucccacc

SEQ ID NO: 868579 - RNA, 28 nt, Human
cguggccaggcgucccaccgccucggcc

SEQ ID NO: 868580 - RNA, 24 nt, Human
cuaaagcuuggccagugcccacgg

SEQ ID NO: 868581 - RNA, 18 nt, Human
cuaaucucaagagagagc

SEQ ID NO: 868582 - RNA, 20 nt, Human
cuaaucucaagagagagcac

SEQ ID NO: 868583 - RNA, 20 nt, Human
cucacugucagaguguggcu

SEQ ID NO: 868584 - RNA, 23 nt, Human
cucccacaccagcaaccgcugcg

SEQ ID NO: 868585 - RNA, 21 nt, Human
cuccugggggugcauucuucc

SEQ ID NO: 868586 - RNA, 19 nt, Human
cucugcauucagcugcucc

SEQ ID NO: 868587 - RNA, 23 nt, Human
cucuuuacuucccagaccaggag

SEQ ID NO: 868588 - RNA, 21 nt, Human
cugcagcuccuuccucaacgg

SEQ ID NO: 868589 - RNA, 22 nt, Human
cugcgccgccgccagcaccgcc

SEQ ID NO: 868590 - RNA, 25 nt, Human
cugcgccgccgccagcaccgccucc

SEQ ID NO: 868591 - RNA, 22 nt, Human
cuggauucugccucuuguacug

SEQ ID NO: 868592 - RNA, 21 nt, Human
gagcaggggcuccaggcgagu

SEQ ID NO: 868593 - RNA, 19 nt, Human
gaggaaacagcaacacucc

SEQ ID NO: 868594 - RNA, 18 nt, Human
gagggacgaggaagacag

SEQ ID NO: 868595 - RNA, 20 nt, Human
gauccagcagaaaauaggcc

SEQ ID NO: 868596 - RNA, 24 nt, Human
gccaaggccaaugcuguuuucuuc

SEQ ID NO: 868597 - RNA, 24 nt, Human
gccagcucucccuccucucccucc

SEQ ID NO: 868598 - RNA, 21 nt, Human
gcccgggauacggagaagcca

SEQ ID NO: 868599 - RNA, 19 nt, Human
gccucgcuuucacucucug

SEQ ID NO: 868600 - RNA, 19 nt, Human
gcgccgccgccagcaccgc

SEQ ID NO: 868601 - RNA, 18 nt, Human
gcuggggugaguccuggg

SEQ ID NO: 868602 - RNA, 22 nt, Human
ggagaagccagccagcucugcc

SEQ ID NO: 868603 - RNA, 20 nt, Human
ggagaauggaaggggagggg

SEQ ID NO: 868604 - RNA, 18 nt, Human
ggcaggcaggggcugggg

SEQ ID NO: 868605 - RNA, 19 nt, Human
ggcaggcaggggcuggggu

SEQ ID NO: 868606 - RNA, 18 nt, Human
gugccugcagcuccuucc

SEQ ID NO: 868607 - RNA, 27 nt, Human
guggccaggcgucccaccgccucggcc

SEQ ID NO: 868608 - RNA, 28 nt, Human
uacuucccagaccaggagccucccuaaa

SEQ ID NO: 868609 - RNA, 20 nt, Human
uagugucccaacacagccaa

SEQ ID NO: 868610 - RNA, 21 nt, Human
ucaacaagacaauguaggaaa

SEQ ID NO: 868611 - RNA, 22 nt, Human
ucacauccaccacuggggagaa

SEQ ID NO: 868612 - RNA, 18 nt, Human
ucacucucugucucugcc

SEQ ID NO: 868613 - RNA, 20 nt, Human
ucacuuggcaggcucugcug

SEQ ID NO: 868614 - RNA, 24 nt, Human
ucaggggcaggcaggggcuggggu

SEQ ID NO: 868615 - RNA, 23 nt, Human
uccaagauagaagccuccucauc

SEQ ID NO: 868616 - RNA, 18 nt, Human
uccccacacacugcccca

SEQ ID NO: 868617 - RNA, 19 nt, Human
uccucaguggugagugccu

SEQ ID NO: 868618 - RNA, 23 nt, Human
uccucuggaucagcucaugauaa

SEQ ID NO: 868619 - RNA, 18 nt, Human
uccucuuccucuuccucc

SEQ ID NO: 868620 - RNA, 23 nt, Human
ucucugccaguggcucaucaccu

SEQ ID NO: 868621 - RNA, 22 nt, Human
ucucuggcuccaagcccagcuc

SEQ ID NO: 868622 - RNA, 19 nt, Human
ucugccucgcuuucacucu

SEQ ID NO: 868623 - RNA, 23 nt, Human
ucuguaauggccaaggccggggc

SEQ ID NO: 868624 - RNA, 21 nt, Human
ucuuccucuuccuccgagucc

SEQ ID NO: 868625 - RNA, 23 nt, Human
ugaaaggccgggcugaauggggc

SEQ ID NO: 868626 - RNA, 23 nt, Human
ugaagugcguguucacaaagugg

SEQ ID NO: 868627 - RNA, 20 nt, Human
ugaauggggcaaggaugcag

SEQ ID NO: 868628 - RNA, 22 nt, Human
ugaauggggcaaggaugcagug

SEQ ID NO: 868629 - RNA, 21 nt, Human
ugacagagcuugaggacggcc

SEQ ID NO: 868630 - RNA, 21 nt, Human
ugaccaggcugugcagcggcu

SEQ ID NO: 868631 - RNA, 20 nt, Human
ugagcgcggccgccgugacc

SEQ ID NO: 868632 - RNA, 18 nt, Human
ugaggacggccuaguagg

SEQ ID NO: 868633 - RNA, 19 nt, Human
ugcacagauguuagugucc

SEQ ID NO: 868634 - RNA, 20 nt, Human
ugccuaggcucagacccaga

SEQ ID NO: 868635 - RNA, 21 nt, Human
ugccucgcuuucacucucugu

SEQ ID NO: 868636 - RNA, 19 nt, Human
ugccugcagcuccuuccuc

SEQ ID NO: 868637 - RNA, 26 nt, Human
ugcggccgggcgccugaccccgcacc

SEQ ID NO: 868638 - RNA, 21 nt, Human
ugcuccagcucccccugaucc

SEQ ID NO: 868639 - RNA, 18 nt, Human
ugcuguuuucuucacauc

SEQ ID NO: 868640 - RNA, 23 nt, Human
uggaacauagugucccaacacag

SEQ ID NO: 868641 - RNA, 18 nt, Human
uggaaggggagggggcug

SEQ ID NO: 868642 - RNA, 23 nt, Human
uggccaggcgucccaccgccucg

SEQ ID NO: 868643 - RNA, 20 nt, Human
uggccgccuccuccucugcc

SEQ ID NO: 868644 - RNA, 19 nt, Human
uggcuccucuggggaugau

SEQ ID NO: 868645 - RNA, 20 nt, Human
ugggagaauggaaggggagg

SEQ ID NO: 868646 - RNA, 28 nt, Human
uggggagaagccagccagcucugccucg

SEQ ID NO: 868647 - RNA, 21 nt, Human
uggggcaaggaugcagugaag

SEQ ID NO: 868648 - RNA, 19 nt, Human
uggggugaguccuggggaa

SEQ ID NO: 868649 - RNA, 24 nt, Human
ugucucuggcuccaagcccagcuc

SEQ ID NO: 868650 - RNA, 26 nt, Human
uguggcuccucuggggaugaugcuga

SEQ ID NO: 868651 - RNA, 22 nt, Human
uuaguguccacuuccugacccu

SEQ ID NO: 868652 - RNA, 21 nt, Human
uucacaaaguggaggggggau

SEQ ID NO: 868653 - RNA, 20 nt, Human
uuccuccgaguccagggcuu

SEQ ID NO: 868654 - RNA, 23 nt, Human
uuccucuuccuccgaguccaggg

SEQ ID NO: 868655 - RNA, 21 nt, Human
uugaagugcguguucacaaag

SEQ ID NO: 868656 - RNA, 22 nt, Human
acuaaguugcaggcuggagcag

SEQ ID NO: 868657 - RNA, 20 nt, Human
acuuccaggagugcucuggg

SEQ ID NO: 868658 - RNA, 19 nt, Human
agagaggggaacugggggc

SEQ ID NO: 868659 - RNA, 18 nt, Human
agaggcacauuugcaagg

SEQ ID NO: 868660 - RNA, 18 nt, Human
agccugcggagccacugg

SEQ ID NO: 868661 - RNA, 18 nt, Human
agucccacuuccaggagu

SEQ ID NO: 868662 - RNA, 21 nt, Human
agugcaggagcagucuggaga

SEQ ID NO: 868663 - RNA, 19 nt, Human
cagcccagaguggcagcag

SEQ ID NO: 868664 - RNA, 18 nt, Human
cagcgaggccaccugcca

SEQ ID NO: 868665 - RNA, 21 nt, Human
ccaacagcugagacgggaggc

SEQ ID NO: 868666 - RNA, 23 nt, Human
ccugcucacagcccuucagucug

SEQ ID NO: 868667 - RNA, 24 nt, Human
ccuggcaggacugucacaggguuc

SEQ ID NO: 868668 - RNA, 24 nt, Human
ccuuacaccugcucacagcccuuc

SEQ ID NO: 868669 - RNA, 18 nt, Human
cucugggccacucagccu

SEQ ID NO: 868670 - RNA, 19 nt, Human
cucugggccacucagccug

SEQ ID NO: 868671 - RNA, 22 nt, Human
cugccaggcuguccugggccau

SEQ ID NO: 868672 - RNA, 24 nt, Human
cuuacaccugcucacagcccuuca

SEQ ID NO: 868673 - RNA, 19 nt, Human
gaggccaccugccaggcug

SEQ ID NO: 868674 - RNA, 20 nt, Human
gagugugggggcagagaggg

SEQ ID NO: 868675 - RNA, 19 nt, Human
gcaggagcagucuggagag

SEQ ID NO: 868676 - RNA, 18 nt, Human
gccaggaggccugguucc

SEQ ID NO: 868677 - RNA, 19 nt, Human
gccugccuacugucuccca

SEQ ID NO: 868678 - RNA, 18 nt, Human
gcucugggccacucagcc

SEQ ID NO: 868679 - RNA, 20 nt, Human
ggacaagaacgggcagagaa

SEQ ID NO: 868680 - RNA, 18 nt, Human
ggagcccuuacaccugcu

SEQ ID NO: 868681 - RNA, 21 nt, Human
ggcagagaaggugcugcgggg

SEQ ID NO: 868682 - RNA, 20 nt, Human
ggcagagaggggaacugggg

SEQ ID NO: 868683 - RNA, 22 nt, Human
ggcagagaggggaacugggggc

SEQ ID NO: 868684 - RNA, 18 nt, Human
ggcagcagcugcggacac

SEQ ID NO: 868685 - RNA, 23 nt, Human
gggauggccugggcccuggcagg

SEQ ID NO: 868686 - RNA, 20 nt, Human
gggcagagaggggaacuggg

SEQ ID NO: 868687 - RNA, 21 nt, Human
gggcagagaggggaacugggg

SEQ ID NO: 868688 - RNA, 21 nt, Human
ggggaggggguaagugcagga

SEQ ID NO: 868689 - RNA, 24 nt, Human
ggguaagugcaggagcagucugga

SEQ ID NO: 868690 - RNA, 21 nt, Human
gugggggcagagaggggaacu

SEQ ID NO: 868691 - RNA, 19 nt, Human
uaccuuucucgccuguagc

SEQ ID NO: 868692 - RNA, 20 nt, Human
uaccuuucucgccuguagcc

SEQ ID NO: 868693 - RNA, 20 nt, Human
ucacagcccuucagucuguc

SEQ ID NO: 868694 - RNA, 22 nt, Human
ucaggaggaaguaauuccuucc

SEQ ID NO: 868695 - RNA, 21 nt, Human
ugcaggagcagucuggagagg

SEQ ID NO: 868696 - RNA, 24 nt, Human
uggagggaugguggggaggggcug

SEQ ID NO: 868697 - RNA, 24 nt, Human
uggcagcagcugcggacacaggcu

SEQ ID NO: 868698 - RNA, 21 nt, Human
uggcaggacugucacaggguu

SEQ ID NO: 868699 - RNA, 28 nt, Human
ugggggcagagaggggaacugggggcag

SEQ ID NO: 868700 - RNA, 21 nt, Human
ugugggggcagagaggggaac

SEQ ID NO: 868701 - RNA, 18 nt, Human
uucagucuguccuugcag

SEQ ID NO: 868702 - RNA, 21 nt, Human
uuuuuuuuuugaaaacagaag

SEQ ID NO: 868703 - RNA, 23 nt, Human
uuuuuuuuuuuuuuuuuuuuggg

SEQ ID NO: 868704 - RNA, 18 nt, Human
aaaaacacaagcucuccc

SEQ ID NO: 868705 - RNA, 22 nt, Human
aaacagacgauuuuccccucca

SEQ ID NO: 868706 - RNA, 23 nt, Human
aaacagacgauuuuccccuccac

SEQ ID NO: 868707 - RNA, 22 nt, Human
aacacaagcucucccguuuacc

SEQ ID NO: 868708 - RNA, 18 nt, Human
accacagcccuuggaucu

SEQ ID NO: 868709 - RNA, 21 nt, Human
accacagcccuuggaucugca

SEQ ID NO: 868710 - RNA, 23 nt, Human
accacagcccuuggaucugcacc

SEQ ID NO: 868711 - RNA, 19 nt, Human
agcaggcacuuuacaauga

SEQ ID NO: 868712 - RNA, 23 nt, Human
auagacuaauaagccaagagcuu

SEQ ID NO: 868713 - RNA, 22 nt, Human
caccagccugggcauccagaau

SEQ ID NO: 868714 - RNA, 22 nt, Human
cagcagauacauguccugaaau

SEQ ID NO: 868715 - RNA, 23 nt, Human
cagcaggcacuuuacaaugagcc

SEQ ID NO: 868716 - RNA, 21 nt, Human
caguacucggagacaaaggca

SEQ ID NO: 868717 - RNA, 18 nt, Human
cccaaaccaucccucccc

SEQ ID NO: 868718 - RNA, 19 nt, Human
cccaaaccaucccuccccc

SEQ ID NO: 868719 - RNA, 20 nt, Human
cccuccaccuugaaaauaaa

SEQ ID NO: 868720 - RNA, 18 nt, Human
cucugcuccgcucgcacc

SEQ ID NO: 868721 - RNA, 21 nt, Human
cuucaaaaacacaagcucucc

SEQ ID NO: 868722 - RNA, 22 nt, Human
gcaggcacuuuacaaugagccc

SEQ ID NO: 868723 - RNA, 21 nt, Human
gcaguacucggagacaaaggc

SEQ ID NO: 868724 - RNA, 19 nt, Human
uaccacagcccuuggaucu

SEQ ID NO: 868725 - RNA, 18 nt, Human
uccaccuucucugggaag

SEQ ID NO: 868726 - RNA, 19 nt, Human
uccaccuugaaaauaaaau

SEQ ID NO: 868727 - RNA, 19 nt, Human
ucccccagugcacacaggu

SEQ ID NO: 868728 - RNA, 21 nt, Human
ucccccagugcacacaggugc

SEQ ID NO: 868729 - RNA, 22 nt, Human
ugaccaacaccagccgccacgc

SEQ ID NO: 868730 - RNA, 22 nt, Human
ugcagcaggcacuuuacaauga

SEQ ID NO: 868731 - RNA, 24 nt, Human
ugcaguacucggagacaaagucca

SEQ ID NO: 868732 - RNA, 22 nt, Human
ugcccaaaccaucccuccccca

SEQ ID NO: 868733 - RNA, 23 nt, Human
ugcccaaaccaucccucccccag

SEQ ID NO: 868734 - RNA, 19 nt, Human
uggaucugcaccugcccaa

SEQ ID NO: 868735 - RNA, 22 nt, Human
uguauagacuaauaagccaaga

SEQ ID NO: 868736 - RNA, 18 nt, Human
uuuuuuuuuuuuuuuuug

SEQ ID NO: 868737 - RNA, 19 nt, Human
uuuuuuuuuuuuuuuuugu

SEQ ID NO: 868738 - RNA, 21 nt, Human
aacaaagcugaaccccaauaa

SEQ ID NO: 868739 - RNA, 22 nt, Human
aacaacacaaacauaugaccca

SEQ ID NO: 868740 - RNA, 19 nt, Human
aacaaggggagcaguggaa

SEQ ID NO: 868741 - RNA, 19 nt, Human
aagcggccaccucuggaag

SEQ ID NO: 868742 - RNA, 24 nt, Human
aauauggccuugggaugccuugau

SEQ ID NO: 868743 - RNA, 24 nt, Human
aauauuaugguaagguuaaaaagg

SEQ ID NO: 868744 - RNA, 24 nt, Human
aauugcccuauuuuaaaucuccau

SEQ ID NO: 868745 - RNA, 21 nt, Human
agagcuccccauauaauuuuc

SEQ ID NO: 868746 - RNA, 22 nt, Human
agcauuuucccaccagggaaag

SEQ ID NO: 868747 - RNA, 19 nt, Human
agccggccgggaacaaggg

SEQ ID NO: 868748 - RNA, 19 nt, Human
aggaagggcaagcauuuua

SEQ ID NO: 868749 - RNA, 19 nt, Human
aggaaugggcauaaaggga

SEQ ID NO: 868750 - RNA, 22 nt, Human
aucucuucccacuaaauugccc

SEQ ID NO: 868751 - RNA, 23 nt, Human
aucugcaucuaaacccucuccaa

SEQ ID NO: 868752 - RNA, 18 nt, Human
aucuuugauuacauauau

SEQ ID NO: 868753 - RNA, 21 nt, Human
auggauuccugagggcuccau

SEQ ID NO: 868754 - RNA, 18 nt, Human
auuaaacaugacauccaa

SEQ ID NO: 868755 - RNA, 23 nt, Human
caacaacacgcuagaaaauuaaa

SEQ ID NO: 868756 - RNA, 21 nt, Human
caaucugacuauaagagcauc

SEQ ID NO: 868757 - RNA, 19 nt, Human
cacacuuuugaaggccauc

SEQ ID NO: 868758 - RNA, 23 nt, Human
cacuguaacauucagcuucuaca

SEQ ID NO: 868759 - RNA, 21 nt, Human
caucuagggucucaucugcuc

SEQ ID NO: 868760 - RNA, 19 nt, Human
caucugcuccugccucugc

SEQ ID NO: 868761 - RNA, 22 nt, Human
caucugguccugcuuauccucc

SEQ ID NO: 868762 - RNA, 27 nt, Human
cauugagaacacacuuuugaaggccau

SEQ ID NO: 868763 - RNA, 24 nt, Human
cauuuuaaagcuccagggccggga

SEQ ID NO: 868764 - RNA, 25 nt, Human
ccaauauucaaguucaauucccaau

SEQ ID NO: 868765 - RNA, 19 nt, Human
ccucugcauggcuugccuc

SEQ ID NO: 868766 - RNA, 20 nt, Human
ccucugcauggcuugccucc

SEQ ID NO: 868767 - RNA, 23 nt, Human
ccugggauccccaggugcucaag

SEQ ID NO: 868768 - RNA, 18 nt, Human
cuccugccucugcauggc

SEQ ID NO: 868769 - RNA, 19 nt, Human
cugcauggcuugccuccgc

SEQ ID NO: 868770 - RNA, 19 nt, Human
cugugcaugagucugccgu

SEQ ID NO: 868771 - RNA, 18 nt, Human
gaaaaaaagcugaaaaug

SEQ ID NO: 868772 - RNA, 18 nt, Human
gaagggcaagcauuuuaa

SEQ ID NO: 868773 - RNA, 24 nt, Human
gcaacaacacaaacauaugaccca

SEQ ID NO: 868774 - RNA, 19 nt, Human
gcgucucugagggucugac

SEQ ID NO: 868775 - RNA, 18 nt, Human
gcuagaaaauuaaacuua

SEQ ID NO: 868776 - RNA, 18 nt, Human
gcuccugccugccaucca

SEQ ID NO: 868777 - RNA, 21 nt, Human
ggaaauggggucacaccaaau

SEQ ID NO: 868778 - RNA, 19 nt, Human
ggaagggcaagcauuuuaa

SEQ ID NO: 868779 - RNA, 21 nt, Human
ggccaucuuuuuuuuuuuuuu

SEQ ID NO: 868780 - RNA, 26 nt, Human
gggaggcagccagccggccgggaaca

SEQ ID NO: 868781 - RNA, 20 nt, Human
gggcaaucuuuuuuuucuuu

SEQ ID NO: 868782 - RNA, 22 nt, Human
guaagacaacaacacgcuagaa

SEQ ID NO: 868783 - RNA, 18 nt, Human
guauauauaacauaugua

SEQ ID NO: 868784 - RNA, 26 nt, Human
guccugcuuauccuccaguuuauuca

SEQ ID NO: 868785 - RNA, 20 nt, Human
gugcuggacacagcacgggg

SEQ ID NO: 868786 - RNA, 22 nt, Human
uaagacaacaacacgcuagaaa

SEQ ID NO: 868787 - RNA, 22 nt, Human
uaaucugcucuuuauuuucccc

SEQ ID NO: 868788 - RNA, 20 nt, Human
uacagcaacaacacaaacau

SEQ ID NO: 868789 - RNA, 21 nt, Human
uaccucaccugaccaggguuc

SEQ ID NO: 868790 - RNA, 19 nt, Human
uagauaaacauguuccuca

SEQ ID NO: 868791 - RNA, 18 nt, Human
uaggaaaaaaagcugaaa

SEQ ID NO: 868792 - RNA, 21 nt, Human
uauaaagccacagaucauucu

SEQ ID NO: 868793 - RNA, 20 nt, Human
uaucgcucuacuaccucaaa

SEQ ID NO: 868794 - RNA, 18 nt, Human
uauguauauauaacauau

SEQ ID NO: 868795 - RNA, 19 nt, Human
uauguauauauaacauaug

SEQ ID NO: 868796 - RNA, 21 nt, Human
uauguauauauaacauaugua

SEQ ID NO: 868797 - RNA, 26 nt, Human
uauucaaguucaauucccaaucugac

SEQ ID NO: 868798 - RNA, 18 nt, Human
ucagaucuucagaguagc

SEQ ID NO: 868799 - RNA, 25 nt, Human
ucauacaacauugagaacacacuuu

SEQ ID NO: 868800 - RNA, 19 nt, Human
ucauacauccacauaugua

SEQ ID NO: 868801 - RNA, 21 nt, Human
uccauggauuccugagggcuc

SEQ ID NO: 868802 - RNA, 19 nt, Human
ucccuuuuccuucucugug

SEQ ID NO: 868803 - RNA, 18 nt, Human
ucgcucuacuaccucaaa

SEQ ID NO: 868804 - RNA, 21 nt, Human
ucucugugcaugagucugccg

SEQ ID NO: 868805 - RNA, 21 nt, Human
ucugcaucuaaacccucucca

SEQ ID NO: 868806 - RNA, 19 nt, Human
ucugcucuuuauuuucccc

SEQ ID NO: 868807 - RNA, 18 nt, Human
ucuuuguggguugaagag

SEQ ID NO: 868808 - RNA, 19 nt, Human
ugacccaauauucaaguuc

SEQ ID NO: 868809 - RNA, 19 nt, Human
ugagaagggaggaaauggg

SEQ ID NO: 868810 - RNA, 22 nt, Human
ugagaagggaggaaaugggguc

SEQ ID NO: 868811 - RNA, 18 nt, Human
ugagauguucccuuuucc

SEQ ID NO: 868812 - RNA, 24 nt, Human
ugagggcuccaugcuccugccugc

SEQ ID NO: 868813 - RNA, 19 nt, Human
ugagucugccgucuucccc

SEQ ID NO: 868814 - RNA, 18 nt, Human
ugauagacuacagcaaca

SEQ ID NO: 868815 - RNA, 20 nt, Human
ugauuuguuugggcaaucuu

SEQ ID NO: 868816 - RNA, 24 nt, Human
ugcgagcagguuugcagugccaag

SEQ ID NO: 868817 - RNA, 18 nt, Human
uggaagcugagagcugga

SEQ ID NO: 868818 - RNA, 21 nt, Human
uggauggaauuaaacaugaca

SEQ ID NO: 868819 - RNA, 20 nt, Human
ugggaugccuugauguccuc

SEQ ID NO: 868820 - RNA, 18 nt, Human
uggggucacaccaaauca

SEQ ID NO: 868821 - RNA, 24 nt, Human
uguauacuuacacacauugguaua

SEQ ID NO: 868822 - RNA, 24 nt, Human
uguugacaauucauaggaaaaaaa

SEQ ID NO: 868823 - RNA, 19 nt, Human
uguuggaggggauacagga

SEQ ID NO: 868824 - RNA, 21 nt, Human
uuaagaaucacucaaagaauc

SEQ ID NO: 868825 - RNA, 22 nt, Human
uucaaaauauacuaucaaacua

SEQ ID NO: 868826 - RNA, 18 nt, Human
uucagcuucuacaggagg

SEQ ID NO: 868827 - RNA, 23 nt, Human
uucauaggaaaaaaagcugaaaa

SEQ ID NO: 868828 - RNA, 26 nt, Human
uucauaggaaaaaaagcugaaaaugu

SEQ ID NO: 868829 - RNA, 24 nt, Human
uucucguggcaucuagggucucau

SEQ ID NO: 868830 - RNA, 21 nt, Human
uugaagagagacaacaaccga

SEQ ID NO: 868831 - RNA, 23 nt, Human
uugaaggccaucuuuuuuuuuuu

SEQ ID NO: 868832 - RNA, 23 nt, Human
uuggaauucucccugaguuaauu

SEQ ID NO: 868833 - RNA, 18 nt, Human
uuuaaggaaaaugcagaa

SEQ ID NO: 868834 - RNA, 21 nt, Human
uuuuuucuuuuuuaaagauug

SEQ ID NO: 868835 - RNA, 19 nt, Human
uuuuuuuuuuuuuaaggaa

SEQ ID NO: 868836 - RNA, 21 nt, Human
accaacuucacucccuccccu

SEQ ID NO: 868837 - RNA, 25 nt, Human
acuucacucccuccccuguccucag

SEQ ID NO: 868838 - RNA, 21 nt, Human
agaugccccgaggagcacaga

SEQ ID NO: 868839 - RNA, 23 nt, Human
agccgcuggaaggggggugagcc

SEQ ID NO: 868840 - RNA, 24 nt, Human
agggcagggggugcagccccaggu

SEQ ID NO: 868841 - RNA, 23 nt, Human
agggucagaagucacagggagcc

SEQ ID NO: 868842 - RNA, 23 nt, Human
augcugccaccaagccccugggg

SEQ ID NO: 868843 - RNA, 23 nt, Human
caaaccaacuucacucccucccc

SEQ ID NO: 868844 - RNA, 19 nt, Human
caaagcaacacagaggagc

SEQ ID NO: 868845 - RNA, 25 nt, Human
caaagcaacacagaggagcaagggc

SEQ ID NO: 868846 - RNA, 23 nt, Human
caagucagcaggucccuggggag

SEQ ID NO: 868847 - RNA, 23 nt, Human
cagaagggucugagggcaugaug

SEQ ID NO: 868848 - RNA, 18 nt, Human
cagagcccuggaggagug

SEQ ID NO: 868849 - RNA, 22 nt, Human
cagcgggcagagcccagaaggg

SEQ ID NO: 868850 - RNA, 21 nt, Human
cagcugcuggcccagccagga

SEQ ID NO: 868851 - RNA, 19 nt, Human
cagggggugcagccccagg

SEQ ID NO: 868852 - RNA, 19 nt, Human
cagggggugcagccccagg

SEQ ID NO: 868853 - RNA, 20 nt, Human
ccaccccaaaccaacuucac

SEQ ID NO: 868854 - RNA, 27 nt, Human
ccacccgugagcaaaggccgcaggggu

SEQ ID NO: 868855 - RNA, 18 nt, Human
ccagccgcuggaaggggg

SEQ ID NO: 868856 - RNA, 19 nt, Human
ccaggaaagcgggaccagc

SEQ ID NO: 868857 - RNA, 22 nt, Human
ccaggggugggcagggccaccc

SEQ ID NO: 868858 - RNA, 23 nt, Human
cccagccccaggcuuugucccac

SEQ ID NO: 868859 - RNA, 18 nt, Human
cccaggaggagugggacu

SEQ ID NO: 868860 - RNA, 24 nt, Human
ccccaacuucaaggcugccaaguu

SEQ ID NO: 868861 - RNA, 27 nt, Human
ccccagcccuagacuccagcccaggca

SEQ ID NO: 868862 - RNA, 19 nt, Human
cccccagcgggcagagccc

SEQ ID NO: 868863 - RNA, 27 nt, Human
cccccagcgggcagagcccagaagggu

SEQ ID NO: 868864 - RNA, 22 nt, Human
ccccgaggagcacagacaggag

SEQ ID NO: 868865 - RNA, 27 nt, Human
ccccgcccagccccaggcuuuguccca

SEQ ID NO: 868866 - RNA, 28 nt, Human
ccccugggggagggguguggggcgcugc

SEQ ID NO: 868867 - RNA, 21 nt, Human
ccgcccagccccaggcuuugu

SEQ ID NO: 868868 - RNA, 22 nt, Human
ccggagcaucaggagaugcccc

SEQ ID NO: 868869 - RNA, 23 nt, Human
ccuccaggaacaucucccagccc

SEQ ID NO: 868870 - RNA, 23 nt, Human
ccucugcauacgcccaggccaaa

SEQ ID NO: 868871 - RNA, 19 nt, Human
ccugccgaggcugacccca

SEQ ID NO: 868872 - RNA, 25 nt, Human
cgcccaggccaaauuccaggaaagc

SEQ ID NO: 868873 - RNA, 18 nt, Human
cggccucugcauacgccc

SEQ ID NO: 868874 - RNA, 19 nt, Human
cuccugccgaggcugaccc

SEQ ID NO: 868875 - RNA, 22 nt, Human
cucugcauacgcccaggccaaa

SEQ ID NO: 868876 - RNA, 20 nt, Human
cugagggcaugaugggcauc

SEQ ID NO: 868877 - RNA, 18 nt, Human
cugccaccaagccccugg

SEQ ID NO: 868878 - RNA, 27 nt, Human
cugccgaggcugaccccaacuucaagg

SEQ ID NO: 868879 - RNA, 19 nt, Human
gacuccagcccaggcagag

SEQ ID NO: 868880 - RNA, 18 nt, Human
gaguguccuccuccagga

SEQ ID NO: 868881 - RNA, 24 nt, Human
gaugggaguguccuccaggaaugu

SEQ ID NO: 868882 - RNA, 22 nt, Human
gcagcugcuggcccagccagga

SEQ ID NO: 868883 - RNA, 19 nt, Human
gcccccgcccagccccagg

SEQ ID NO: 868884 - RNA, 19 nt, Human
ggaguguccuccaggaaug

SEQ ID NO: 868885 - RNA, 24 nt, Human
ggcagagcccagaagggucugagg

SEQ ID NO: 868886 - RNA, 19 nt, Human
ggcagggggugcagcccca

SEQ ID NO: 868887 - RNA, 21 nt, Human
ggcagggggugcagccccagg

SEQ ID NO: 868888 - RNA, 22 nt, Human
ggcagggggugcagccccaggu

SEQ ID NO: 868889 - RNA, 20 nt, Human
ggcaugaugggcaucagugg

SEQ ID NO: 868890 - RNA, 19 nt, Human
ggccucugcauacgcccag

SEQ ID NO: 868891 - RNA, 19 nt, Human
gggcagagaaagggcaggg

SEQ ID NO: 868892 - RNA, 24 nt, Human
ggguagggauggggcagagaaagg

SEQ ID NO: 868893 - RNA, 23 nt, Human
gggucagaagucacagggagccc

SEQ ID NO: 868894 - RNA, 24 nt, Human
ggugggggcuaugcugccaccaag

SEQ ID NO: 868895 - RNA, 19 nt, Human
gugcagcugcuggcccagc

SEQ ID NO: 868896 - RNA, 25 nt, Human
uagccccagcccuagacuccagccc

SEQ ID NO: 868897 - RNA, 18 nt, Human
uaggguagggauggggca

SEQ ID NO: 868898 - RNA, 19 nt, Human
ucccacauggugguacagg

SEQ ID NO: 868899 - RNA, 20 nt, Human
ucugaugggaguguccucca

SEQ ID NO: 868900 - RNA, 18 nt, Human
ugagcaaaggccgcaggg

SEQ ID NO: 868901 - RNA, 19 nt, Human
uggaggagugggacuccug

SEQ ID NO: 868902 - RNA, 21 nt, Human
uggcaggcagcaccccaggag

SEQ ID NO: 868903 - RNA, 18 nt, Human
uggcccaaagcaacacag

SEQ ID NO: 868904 - RNA, 24 nt, Human
uggcccaaagcaacacagaggagc

SEQ ID NO: 868905 - RNA, 21 nt, Human
ugggauuuugguugugccagg

SEQ ID NO: 868906 - RNA, 21 nt, Human
ugggcagggccacccgugagc

SEQ ID NO: 868907 - RNA, 19 nt, Human
uggggcagagaaagggcag

SEQ ID NO: 868908 - RNA, 23 nt, Human
uggggcagagaaagggcaggggg

SEQ ID NO: 868909 - RNA, 18 nt, Human
uggugccuggagucccac

SEQ ID NO: 868910 - RNA, 24 nt, Human
ugguggcagguccaccagcagaug

SEQ ID NO: 868911 - RNA, 18 nt, Human
ugguugugccaggggugg

SEQ ID NO: 868912 - RNA, 18 nt, Human
ugugaugguggcaggucc

SEQ ID NO: 868913 - RNA, 25 nt, Human
uucaagucagcaggucccuggggag

SEQ ID NO: 868914 - RNA, 20 nt, Human
uuugguugugccaggggugg

SEQ ID NO: 868915 - RNA, 25 nt, Human
uuuuuuuuuuuuaaaaaucagaugg

SEQ ID NO: 868916 - RNA, 18 nt, Human
aaacaggaacacacuucu

SEQ ID NO: 868917 - RNA, 18 nt, Human
acaggaacacacuucucc

SEQ ID NO: 868918 - RNA, 20 nt, Human
agacacacaacacacaaaca

SEQ ID NO: 868919 - RNA, 20 nt, Human
agcuaccagacaaagcaacu

SEQ ID NO: 868920 - RNA, 19 nt, Human
agcuggccaacucccugca

SEQ ID NO: 868921 - RNA, 24 nt, Human
cacacagacacucacagacacaca

SEQ ID NO: 868922 - RNA, 27 nt, Human
caccaaggcugagggugauccgggagc

SEQ ID NO: 868923 - RNA, 21 nt, Human
cacucacagacacacaacaca

SEQ ID NO: 868924 - RNA, 21 nt, Human
caggaacacacuucuccuggu

SEQ ID NO: 868925 - RNA, 20 nt, Human
ccaaguucaguuuuauuugg

SEQ ID NO: 868926 - RNA, 23 nt, Human
ccacugagcaccaaggcugaggg

SEQ ID NO: 868927 - RNA, 21 nt, Human
cccugauggcaggcccaggga

SEQ ID NO: 868928 - RNA, 22 nt, Human
cgugacacaaucagcacugaag

SEQ ID NO: 868929 - RNA, 18 nt, Human
cucacagacacacaacac

SEQ ID NO: 868930 - RNA, 18 nt, Human
cucccugcacagagcucu

SEQ ID NO: 868931 - RNA, 22 nt, Human
cucgggaccacugagcaccaag

SEQ ID NO: 868932 - RNA, 19 nt, Human
cugcucccuccaccugccc

SEQ ID NO: 868933 - RNA, 20 nt, Human
cugcucccuccaccugcccc

SEQ ID NO: 868934 - RNA, 18 nt, Human
cuggaggugggacggagg

SEQ ID NO: 868935 - RNA, 19 nt, Human
cuguggguuaacauucaug

SEQ ID NO: 868936 - RNA, 22 nt, Human
cuucuauucggcuggagguggg

SEQ ID NO: 868937 - RNA, 19 nt, Human
gaagacugcucccuccacc

SEQ ID NO: 868938 - RNA, 23 nt, Human
gacacucacagacacacaacaca

SEQ ID NO: 868939 - RNA, 19 nt, Human
gcuggggcucugccuucuc

SEQ ID NO: 868940 - RNA, 23 nt, Human
ggcacagaggugcuggggcucug

SEQ ID NO: 868941 - RNA, 19 nt, Human
ggcagguacacaauuuucu

SEQ ID NO: 868942 - RNA, 21 nt, Human
ggcggggggugggggucuagg

SEQ ID NO: 868943 - RNA, 18 nt, Human
gggggcacagaggugcug

SEQ ID NO: 868944 - RNA, 21 nt, Human
ggugggacggaggaaggaaug

SEQ ID NO: 868945 - RNA, 21 nt, Human
gugcuggggcucugccuucuc

SEQ ID NO: 868946 - RNA, 21 nt, Human
uaagcaggacuggaaucuguu

SEQ ID NO: 868947 - RNA, 21 nt, Human
uauucggcuggaggugggacg

SEQ ID NO: 868948 - RNA, 21 nt, Human
ucaguuuuauuugguugcuga

SEQ ID NO: 868949 - RNA, 19 nt, Human
ucccugauggcaggcccag

SEQ ID NO: 868950 - RNA, 24 nt, Human
uccuuggauucuguggguuaacau

SEQ ID NO: 868951 - RNA, 22 nt, Human
ucucuugagcuaccagacaaag

SEQ ID NO: 868952 - RNA, 23 nt, Human
ucugcucgugaagaaacaggaac

SEQ ID NO: 868953 - RNA, 24 nt, Human
ucuugagcuaccagacaaagcaac

SEQ ID NO: 868954 - RNA, 23 nt, Human
ugaaaaguuuggagcaaauguac

SEQ ID NO: 868955 - RNA, 22 nt, Human
ugaagaccaaacugccacugag

SEQ ID NO: 868956 - RNA, 23 nt, Human
ugaauaauugugcauuugccaua

SEQ ID NO: 868957 - RNA, 19 nt, Human
ugaggcagcccagcaggga

SEQ ID NO: 868958 - RNA, 24 nt, Human
ugaggggaggaagaacgaagacug

SEQ ID NO: 868959 - RNA, 18 nt, Human
ugcacagagcucuggggg

SEQ ID NO: 868960 - RNA, 21 nt, Human
ugccagggaucuggaagccuu

SEQ ID NO: 868961 - RNA, 19 nt, Human
ugcucccuccaccugcccc

SEQ ID NO: 868962 - RNA, 21 nt, Human
ugcucgugaagaaacaggaac

SEQ ID NO: 868963 - RNA, 22 nt, Human
uggaaucuguuccugccaggga

SEQ ID NO: 868964 - RNA, 19 nt, Human
uggcaggcccagggaaccu

SEQ ID NO: 868965 - RNA, 22 nt, Human
uggcggggggugggggucuagg

SEQ ID NO: 868966 - RNA, 23 nt, Human
uggggggcacagaggugcugggg

SEQ ID NO: 868967 - RNA, 20 nt, Human
ugugcccuugguggccgaug

SEQ ID NO: 868968 - RNA, 18 nt, Human
uuaacauucaugcuuugu

SEQ ID NO: 868969 - RNA, 18 nt, Human
uuuuuuuuuuuuuuuuug

SEQ ID NO: 868970 - RNA, 19 nt, Human
uuuuuuuuuuuuuuuuuug

SEQ ID NO: 868971 - RNA, 21 nt, Human
aaaaaaaaaaagaguuccaaa

SEQ ID NO: 868972 - RNA, 26 nt, Human
aaaauccagacaauuugucacaagaa

SEQ ID NO: 868973 - RNA, 22 nt, Human
acaaaacuaaaaaccacaagga

SEQ ID NO: 868974 - RNA, 24 nt, Human
aucuccagcaaugauuauuuccaa

SEQ ID NO: 868975 - RNA, 20 nt, Human
caaaccagcugugccgcagc

SEQ ID NO: 868976 - RNA, 21 nt, Human
ccagcaaugauuauuuccaaa

SEQ ID NO: 868977 - RNA, 19 nt, Human
cccccgccccucagcucuc

SEQ ID NO: 868978 - RNA, 22 nt, Human
ccccgccccucagcucucuuuu

SEQ ID NO: 868979 - RNA, 19 nt, Human
ccgcagcgcccccgccccu

SEQ ID NO: 868980 - RNA, 18 nt, Human
ccgccccucagcucucuu

SEQ ID NO: 868981 - RNA, 23 nt, Human
ggcaugugauagaagcuguagcc

SEQ ID NO: 868982 - RNA, 21 nt, Human
gugccgcagcgcccccgcccc

SEQ ID NO: 868983 - RNA, 18 nt, Human
uacaaaacuaaaaaccac

SEQ ID NO: 868984 - RNA, 21 nt, Human
uacaaaacuaaaaaccacaag

SEQ ID NO: 868985 - RNA, 24 nt, Human
uccaaaauguaaagauuugaaaca

SEQ ID NO: 868986 - RNA, 25 nt, Human
ugaaacauaauuuauacaaaacuaa

SEQ ID NO: 868987 - RNA, 18 nt, Human
uugcucaaaccagcugug

SEQ ID NO: 868988 - RNA, 19 nt, Human
uuuuuuuuuuuuagaggaa

SEQ ID NO: 868989 - RNA, 22 nt, Human
uuuuuuuuuuuuuuuuuagagg

SEQ ID NO: 868990 - RNA, 22 nt, Human
aagcgcacccagcacugggagg

SEQ ID NO: 868991 - RNA, 25 nt, Human
acccacagguagccaagaugcacaa

SEQ ID NO: 868992 - RNA, 19 nt, Human
agaaucgugaaacuugugg

SEQ ID NO: 868993 - RNA, 20 nt, Human
agguagccaagaugcacaag

SEQ ID NO: 868994 - RNA, 23 nt, Human
agguccaacaguguuagccagaa

SEQ ID NO: 868995 - RNA, 25 nt, Human
cacagcaguaaggacuugaaugaga

SEQ ID NO: 868996 - RNA, 22 nt, Human
ccacagguagccaagaugcaca

SEQ ID NO: 868997 - RNA, 18 nt, Human
ccccgugccgacccccuc

SEQ ID NO: 868998 - RNA, 22 nt, Human
cgugccgacccccucacgacgc

SEQ ID NO: 868999 - RNA, 20 nt, Human
gacccccucacgacgcggcc

SEQ ID NO: 869000 - RNA, 21 nt, Human
gcacaagaccgcccgacuccc

SEQ ID NO: 869001 - RNA, 23 nt, Human
gcacccagcacugggaggaaaug

SEQ ID NO: 869002 - RNA, 22 nt, Human
gcacugggaggaaauguggcuu

SEQ ID NO: 869003 - RNA, 19 nt, Human
gcgaugcagaaggcggccu

SEQ ID NO: 869004 - RNA, 20 nt, Human
ggacuugaaugagaaucgug

SEQ ID NO: 869005 - RNA, 24 nt, Human
ucguacugaaagacuacauucagu

SEQ ID NO: 869006 - RNA, 22 nt, Human
ugguauuuguucuucacagcag

SEQ ID NO: 869007 - RNA, 18 nt, Human
uuaggugucuagguggaa

SEQ ID NO: 869008 - RNA, 24 nt, Human
uuuuuuuuuuuuuuuuucaguuuu

SEQ ID NO: 869009 - RNA, 22 nt, Human
uuuuuuuuuuuuuuuuuuucag

SEQ ID NO: 869010 - RNA, 18 nt, Human
aaacaaggaaucacccaa

SEQ ID NO: 869011 - RNA, 22 nt, Human
aauugucugcagauuacucuca

SEQ ID NO: 869012 - RNA, 22 nt, Human
agcaaggagacacuuaagauca

SEQ ID NO: 869013 - RNA, 22 nt, Human
agcacauagaauacccuuagau

SEQ ID NO: 869014 - RNA, 18 nt, Human
auagaauacccuuagaua

SEQ ID NO: 869015 - RNA, 18 nt, Human
auagucuaaaaacaagga

SEQ ID NO: 869016 - RNA, 24 nt, Human
aucccuguucucaaguguuaaaaa

SEQ ID NO: 869017 - RNA, 21 nt, Human
caaggaaucacccaaguaaga

SEQ ID NO: 869018 - RNA, 21 nt, Human
cacuggagccugaagcaaagu

SEQ ID NO: 869019 - RNA, 22 nt, Human
cauacaccccuuuuaaauuguc

SEQ ID NO: 869020 - RNA, 19 nt, Human
caucaagugagcuacaaau

SEQ ID NO: 869021 - RNA, 26 nt, Human
ccacaaauacguuuauuccucuaaaa

SEQ ID NO: 869022 - RNA, 20 nt, Human
ccgcgcggcagccucagggu

SEQ ID NO: 869023 - RNA, 19 nt, Human
ccugcacuggagccugaag

SEQ ID NO: 869024 - RNA, 21 nt, Human
cguggagaucccccagauccc

SEQ ID NO: 869025 - RNA, 19 nt, Human
cuguucucaaguguuaaaa

SEQ ID NO: 869026 - RNA, 20 nt, Human
gacacuuaagaucaauucaa

SEQ ID NO: 869027 - RNA, 21 nt, Human
gagcaaggagacacuuaagau

SEQ ID NO: 869028 - RNA, 20 nt, Human
uaaaaacaaggaaucaccca

SEQ ID NO: 869029 - RNA, 19 nt, Human
uaacuccuaucccaguuuc

SEQ ID NO: 869030 - RNA, 19 nt, Human
uaccagagcaaggagacac

SEQ ID NO: 869031 - RNA, 22 nt, Human
ucaagugagcuacaaaucuauc

SEQ ID NO: 869032 - RNA, 25 nt, Human
ucauuugucacauauuucaggcccu

SEQ ID NO: 869033 - RNA, 26 nt, Human
ucuaacuccuaucccaguuucuuuuu

SEQ ID NO: 869034 - RNA, 19 nt, Human
aaagugcugggauuacagg

SEQ ID NO: 869035 - RNA, 19 nt, Human
aaagugcugggauuacagg

SEQ ID NO: 869036 - RNA, 18 nt, Human
aagugcugggauuacagg

SEQ ID NO: 869037 - RNA, 19 nt, Human
aagugcugggauuacaggu

SEQ ID NO: 869038 - RNA, 18 nt, Human
accaagcaauccucccac

SEQ ID NO: 869039 - RNA, 24 nt, Human
accaagcaauccucccaccucugc

SEQ ID NO: 869040 - RNA, 23 nt, Human
accucugccucccaaagugcugg

SEQ ID NO: 869041 - RNA, 21 nt, Human
acggggucuuguuauguucca

SEQ ID NO: 869042 - RNA, 21 nt, Human
agccaagugccaguaaucaca

SEQ ID NO: 869043 - RNA, 24 nt, Human
auaguagagacggggucuuguuau

SEQ ID NO: 869044 - RNA, 24 nt, Human
auccucccaccucugccucccaaa

SEQ ID NO: 869045 - RNA, 19 nt, Human
auguuccacaggcuggucu

SEQ ID NO: 869046 - RNA, 24 nt, Human
caaagugcugggauuacaggugca

SEQ ID NO: 869047 - RNA, 27 nt, Human
caagcaauccucccaccucugccuccc

SEQ ID NO: 869048 - RNA, 28 nt, Human
caagcaauccucccaccucugccuccca

SEQ ID NO: 869049 - RNA, 19 nt, Human
caagucaccacgcccggcc

SEQ ID NO: 869050 - RNA, 19 nt, Human
caccacgcccggccuauuu

SEQ ID NO: 869051 - RNA, 23 nt, Human
caggcuggucuugaacuccuggg

SEQ ID NO: 869052 - RNA, 20 nt, Human
ccaaagugcugggauuacag

SEQ ID NO: 869053 - RNA, 21 nt, Human
ccaaagugcugggauuacagg

SEQ ID NO: 869054 - RNA, 21 nt, Human
ccaaagugcugggauuacagg

SEQ ID NO: 869055 - RNA, 22 nt, Human
ccaaagugcugggauuacaggu

SEQ ID NO: 869056 - RNA, 21 nt, Human
ccagcacucucuguagccaag

SEQ ID NO: 869057 - RNA, 21 nt, Human
ccaguaccuguacaggccagg

SEQ ID NO: 869058 - RNA, 25 nt, Human
cccccuugucccucagaugcaucca

SEQ ID NO: 869059 - RNA, 23 nt, Human
ccgccccccuugucccucagaug

SEQ ID NO: 869060 - RNA, 22 nt, Human
ccucccaccucugccucccaaa

SEQ ID NO: 869061 - RNA, 26 nt, Human
ccucccaccucugccucccaaagugc

SEQ ID NO: 869062 - RNA, 20 nt, Human
cucacuucccaccucgugcc

SEQ ID NO: 869063 - RNA, 28 nt, Human
cuccagcacucucuguagccaagugccc

SEQ ID NO: 869064 - RNA, 19 nt, Human
cuggucuugaacuccuggg

SEQ ID NO: 869065 - RNA, 19 nt, Human
cuucggagaccgccccccu

SEQ ID NO: 869066 - RNA, 22 nt, Human
cuuguuauguuccacaggcugg

SEQ ID NO: 869067 - RNA, 24 nt, Human
gaucauacuccacugugguccuga

SEQ ID NO: 869068 - RNA, 21 nt, Human
gcaauccucccaccucugccu

SEQ ID NO: 869069 - RNA, 18 nt, Human
ggcuggucuugaacuccu

SEQ ID NO: 869070 - RNA, 24 nt, Human
gggaccaagcaauccucccaccuc

SEQ ID NO: 869071 - RNA, 23 nt, Human
guagagacggggucuuguuaugu

SEQ ID NO: 869072 - RNA, 21 nt, Human
gugcugggauuacaggugcaa

SEQ ID NO: 869073 - RNA, 24 nt, Human
guuauguuccacaggcuggucuug

SEQ ID NO: 869074 - RNA, 24 nt, Human
uacacuguucuccagcacucucug

SEQ ID NO: 869075 - RNA, 20 nt, Human
uacuccacugugguccugaa

SEQ ID NO: 869076 - RNA, 24 nt, Human
uaguagagacggggucuuguuaug

SEQ ID NO: 869077 - RNA, 24 nt, Human
uauguuccacaggcuggucuugaa

SEQ ID NO: 869078 - RNA, 24 nt, Human
uccacaggcuggucuugaacuccu

SEQ ID NO: 869079 - RNA, 25 nt, Human
uccacaggcuggucuugaacuccug

SEQ ID NO: 869080 - RNA, 23 nt, Human
ucccaaagugcugggauuacagg

SEQ ID NO: 869081 - RNA, 18 nt, Human
ucccucagaugcauccaa

SEQ ID NO: 869082 - RNA, 21 nt, Human
ucuugaacuccugggaccaag

SEQ ID NO: 869083 - RNA, 24 nt, Human
ucuuguuauguuccacaggcuggu

SEQ ID NO: 869084 - RNA, 24 nt, Human
ugaacuccugggaccaagcaaucc

SEQ ID NO: 869085 - RNA, 24 nt, Human
ugcugggauuacaggugcaaguca

SEQ ID NO: 869086 - RNA, 21 nt, Human
ugggaccaagcaauccuccca

SEQ ID NO: 869087 - RNA, 22 nt, Human
ugggauuacaggugcaagucac

SEQ ID NO: 869088 - RNA, 24 nt, Human
ugggauuacaggugcaagucacca

SEQ ID NO: 869089 - RNA, 18 nt, Human
aaacgcggagguuggagc

SEQ ID NO: 869090 - RNA, 18 nt, Human
aaagauggggaggaagac

SEQ ID NO: 869091 - RNA, 22 nt, Human
aaauauucuuccagguuucucc

SEQ ID NO: 869092 - RNA, 18 nt, Human
aacccgccucuggcuucu

SEQ ID NO: 869093 - RNA, 22 nt, Human
aagcauugggagggugugagcu

SEQ ID NO: 869094 - RNA, 23 nt, Human
acccaggcuggagugcaguggug

SEQ ID NO: 869095 - RNA, 23 nt, Human
accccaaggccgccgugggccac

SEQ ID NO: 869096 - RNA, 23 nt, Human
accccaucccugcaggagcuggg

SEQ ID NO: 869097 - RNA, 18 nt, Human
agcagagggagcagggcc

SEQ ID NO: 869098 - RNA, 23 nt, Human
aggaaagccggcuggucuccaag

SEQ ID NO: 869099 - RNA, 24 nt, Human
aggagggaauggacuugucuguca

SEQ ID NO: 869100 - RNA, 22 nt, Human
aggauggaaagauggggaggaa

SEQ ID NO: 869101 - RNA, 25 nt, Human
aggcuggagugcaguggugcaaucu

SEQ ID NO: 869102 - RNA, 20 nt, Human
agugcaguggugcaaucucg

SEQ ID NO: 869103 - RNA, 24 nt, Human
agugcaguggugcaaucucggcuc

SEQ ID NO: 869104 - RNA, 25 nt, Human
augggaugugagcagaaacgagaau

SEQ ID NO: 869105 - RNA, 18 nt, Human
auuagccacuaccaaacc

SEQ ID NO: 869106 - RNA, 21 nt, Human
caaacgagcucuguggaagcu

SEQ ID NO: 869107 - RNA, 24 nt, Human
caaccaugccucacaguugagcaa

SEQ ID NO: 869108 - RNA, 19 nt, Human
caagugaggcgaagacccg

SEQ ID NO: 869109 - RNA, 24 nt, Human
cacccaggcuggagugcaguggug

SEQ ID NO: 869110 - RNA, 24 nt, Human
cacuccauuccucagcacguuccu

SEQ ID NO: 869111 - RNA, 19 nt, Human
cagagcagagggagcaggg

SEQ ID NO: 869112 - RNA, 22 nt, Human
cauccgggggccccgugugucc

SEQ ID NO: 869113 - RNA, 22 nt, Human
caugggaaauggggcagggggc

SEQ ID NO: 869114 - RNA, 20 nt, Human
ccacugggcugugcuugugc

SEQ ID NO: 869115 - RNA, 20 nt, Human
ccagaucugccaucguguuc

SEQ ID NO: 869116 - RNA, 20 nt, Human
ccagcagugcggaggggcag

SEQ ID NO: 869117 - RNA, 23 nt, Human
ccaggagccuguuuuccuucccc

SEQ ID NO: 869118 - RNA, 20 nt, Human
ccaugccucacaguugagca

SEQ ID NO: 869119 - RNA, 18 nt, Human
ccccagagcagagggagc

SEQ ID NO: 869120 - RNA, 20 nt, Human
cccgugcccagcagacaagg

SEQ ID NO: 869121 - RNA, 23 nt, Human
cccuuagccaccaaccaugccuc

SEQ ID NO: 869122 - RNA, 20 nt, Human
ccgugcccagcagacaaggc

SEQ ID NO: 869123 - RNA, 19 nt, Human
ccuccucugcugcuccugg

SEQ ID NO: 869124 - RNA, 27 nt, Human
ccugcccagcaaguuuaagggccgugg

SEQ ID NO: 869125 - RNA, 20 nt, Human
cgccucuggcuucugagcuu

SEQ ID NO: 869126 - RNA, 23 nt, Human
cgugacgcugucuuccugacucg

SEQ ID NO: 869127 - RNA, 24 nt, Human
cucaugggaaauggggcagggggc

SEQ ID NO: 869128 - RNA, 24 nt, Human
cucgcucugucacccaggcuggag

SEQ ID NO: 869129 - RNA, 20 nt, Human
cucugucacccaggcuggag

SEQ ID NO: 869130 - RNA, 23 nt, Human
cucugucacccaggcuggagugc

SEQ ID NO: 869131 - RNA, 18 nt, Human
cugagccuuggggagggg

SEQ ID NO: 869132 - RNA, 27 nt, Human
cugcugggcucugugugacuggaaacc

SEQ ID NO: 869133 - RNA, 21 nt, Human
cuggcggguggaaguguggcc

SEQ ID NO: 869134 - RNA, 18 nt, Human
cuggcuuggggauggaaa

SEQ ID NO: 869135 - RNA, 18 nt, Human
cugugcuugugcuggggc

SEQ ID NO: 869136 - RNA, 20 nt, Human
cuuacacuuugauauuaaac

SEQ ID NO: 869137 - RNA, 18 nt, Human
gaaggauggaaagauggg

SEQ ID NO: 869138 - RNA, 23 nt, Human
gagcagguacacagaaggagcuc

SEQ ID NO: 869139 - RNA, 20 nt, Human
gaguggcugucacaggccug

SEQ ID NO: 869140 - RNA, 24 nt, Human
gcacaggaaaacgcggagguugga

SEQ ID NO: 869141 - RNA, 18 nt, Human
gcagcggguggcucagaa

SEQ ID NO: 869142 - RNA, 23 nt, Human
gccacugggcugugcuugugcug

SEQ ID NO: 869143 - RNA, 24 nt, Human
gcggagguuggagcacccccagga

SEQ ID NO: 869144 - RNA, 23 nt, Human
ggccgugggcaggccuuguagcc

SEQ ID NO: 869145 - RNA, 19 nt, Human
ggcucagaagugggagcag

SEQ ID NO: 869146 - RNA, 21 nt, Human
gggcuccaaaccugcccagca

SEQ ID NO: 869147 - RNA, 18 nt, Human
gggcucccagacaccccc

SEQ ID NO: 869148 - RNA, 21 nt, Human
ggggaggaagacccuggcggg

SEQ ID NO: 869149 - RNA, 20 nt, Human
ggggcuggcagagagcugcc

SEQ ID NO: 869150 - RNA, 19 nt, Human
gguggcucagaagugggag

SEQ ID NO: 869151 - RNA, 20 nt, Human
gugcuggggcucccagaggc

SEQ ID NO: 869152 - RNA, 20 nt, Human
uagccaccaaccaugccuca

SEQ ID NO: 869153 - RNA, 25 nt, Human
uauuuauuuuuuuuagauggagucu

SEQ ID NO: 869154 - RNA, 24 nt, Human
ucacccaggcuggagugcaguggu

SEQ ID NO: 869155 - RNA, 21 nt, Human
ucccagacacccccagagcag

SEQ ID NO: 869156 - RNA, 18 nt, Human
ucccaugggcuccaaacc

SEQ ID NO: 869157 - RNA, 21 nt, Human
ucccugcaggagcuggggcag

SEQ ID NO: 869158 - RNA, 24 nt, Human
ucccugcaggagcuggggcaggug

SEQ ID NO: 869159 - RNA, 23 nt, Human
uccguggaguagaagaaggggca

SEQ ID NO: 869160 - RNA, 19 nt, Human
uccucagcacguuccuggc

SEQ ID NO: 869161 - RNA, 20 nt, Human
uccuggaguggcugucacag

SEQ ID NO: 869162 - RNA, 22 nt, Human
uccuggaguggcugucacaggc

SEQ ID NO: 869163 - RNA, 24 nt, Human
ucgcucugucacccaggcuggagu

SEQ ID NO: 869164 - RNA, 20 nt, Human
ucggaccccaucccugcagg

SEQ ID NO: 869165 - RNA, 19 nt, Human
ucggggcccaggaacgagc

SEQ ID NO: 869166 - RNA, 18 nt, Human
ucuccaagugaggcgaag

SEQ ID NO: 869167 - RNA, 24 nt, Human
ucuccaagugaggcgaagacccgu

SEQ ID NO: 869168 - RNA, 19 nt, Human
ucucgcucugucacccagg

SEQ ID NO: 869169 - RNA, 23 nt, Human
ucucgcucugucacccaggcugg

SEQ ID NO: 869170 - RNA, 24 nt, Human
ucucgcucugucacccaggcugga

SEQ ID NO: 869171 - RNA, 26 nt, Human
ucucgcucugucacccaggcuggagu

SEQ ID NO: 869172 - RNA, 27 nt, Human
ucucgcucugucacccaggcuggagug

SEQ ID NO: 869173 - RNA, 20 nt, Human
ucucggggcuggcagagagc

SEQ ID NO: 869174 - RNA, 24 nt, Human
ucugucacccaggcuggagugcag

SEQ ID NO: 869175 - RNA, 24 nt, Human
ucuuagagcugagccuuggggagg

SEQ ID NO: 869176 - RNA, 19 nt, Human
ugacgcugucuuccugacu

SEQ ID NO: 869177 - RNA, 21 nt, Human
ugacucggggcccaggaacga

SEQ ID NO: 869178 - RNA, 24 nt, Human
ugacuggaaaccagggaaggagac

SEQ ID NO: 869179 - RNA, 21 nt, Human
ugagagugaaggccaggagcc

SEQ ID NO: 869180 - RNA, 20 nt, Human
ugagcuucagcauauaagca

SEQ ID NO: 869181 - RNA, 18 nt, Human
ugaggcaggaacuggguu

SEQ ID NO: 869182 - RNA, 22 nt, Human
ugcaguggugcaaucucggcuc

SEQ ID NO: 869183 - RNA, 23 nt, Human
ugcccagcagacaaggccggggc

SEQ ID NO: 869184 - RNA, 18 nt, Human
ugcuugugcuggggcucc

SEQ ID NO: 869185 - RNA, 21 nt, Human
ugcuuuaaucccccuguuugc

SEQ ID NO: 869186 - RNA, 24 nt, Human
uggacuugucugucacgcaggggc

SEQ ID NO: 869187 - RNA, 23 nt, Human
uggagugcaguggugcaaucucg

SEQ ID NO: 869188 - RNA, 24 nt, Human
uggagugcaguggugcaaucucgg

SEQ ID NO: 869189 - RNA, 19 nt, Human
uggaguggcugucacaggc

SEQ ID NO: 869190 - RNA, 20 nt, Human
uggcugaggcaggaacuggg

SEQ ID NO: 869191 - RNA, 20 nt, Human
ugggagggugugagcugggg

SEQ ID NO: 869192 - RNA, 20 nt, Human
ugggcuccaaaccugcccag

SEQ ID NO: 869193 - RNA, 23 nt, Human
uggggcucccagaggcauccggg

SEQ ID NO: 869194 - RNA, 22 nt, Human
ugucugcugggucagcacugcc

SEQ ID NO: 869195 - RNA, 21 nt, Human
uguggaagcucagcaggaagg

SEQ ID NO: 869196 - RNA, 24 nt, Human
ugugucaggaggugacggcuggag

SEQ ID NO: 869197 - RNA, 22 nt, Human
uuagauggagucucgcucuguc

SEQ ID NO: 869198 - RNA, 20 nt, Human
uuuuuuuuagauggagucuc

SEQ ID NO: 869199 - RNA, 18 nt, Human
uuuuuuuuuuuuuuuucg

SEQ ID NO: 869200 - RNA, 22 nt, Human
uuuuuuuuuuuuuuuuucgaau

SEQ ID NO: 869201 - RNA, 18 nt, Human
aagacucccagugggugg

SEQ ID NO: 869202 - RNA, 22 nt, Human
aggccaggcggcggccccgggc

SEQ ID NO: 869203 - RNA, 18 nt, Human
caggcggcggccccgggc

SEQ ID NO: 869204 - RNA, 19 nt, Human
caggcggcggccccgggcc

SEQ ID NO: 869205 - RNA, 20 nt, Human
ccacgaggcucaucccuugg

SEQ ID NO: 869206 - RNA, 21 nt, Human
ccaggccaggcggcggccccg

SEQ ID NO: 869207 - RNA, 18 nt, Human
ccagggagggacucccag

SEQ ID NO: 869208 - RNA, 18 nt, Human
ccccacgaggcucauccc

SEQ ID NO: 869209 - RNA, 19 nt, Human
ccugccccuccaaguacac

SEQ ID NO: 869210 - RNA, 24 nt, Human
ccuuacccuggucuggaggccaga

SEQ ID NO: 869211 - RNA, 21 nt, Human
cggccccgggcccucugcccc

SEQ ID NO: 869212 - RNA, 25 nt, Human
cugagaauaaaaaccagggagggac

SEQ ID NO: 869213 - RNA, 19 nt, Human
gaaagggcucccugccccu

SEQ ID NO: 869214 - RNA, 22 nt, Human
gagaauaaaaaccagggaggga

SEQ ID NO: 869215 - RNA, 18 nt, Human
gcugugagcaccuguugg

SEQ ID NO: 869216 - RNA, 24 nt, Human
ggguggcugcagccccugccucgg

SEQ ID NO: 869217 - RNA, 23 nt, Human
uaaaaaccagggagggacuccca

SEQ ID NO: 869218 - RNA, 18 nt, Human
uacugagaauaaaaacca

SEQ ID NO: 869219 - RNA, 22 nt, Human
ucccuuggagcacacaggaagc

SEQ ID NO: 869220 - RNA, 23 nt, Human
ugagguacugagaauaaaaacca

SEQ ID NO: 869221 - RNA, 20 nt, Human
uggcugcagccccugccucg

SEQ ID NO: 869222 - RNA, 21 nt, Human
uggguggcugcagccccugcc

SEQ ID NO: 869223 - RNA, 18 nt, Human
uuuuuuuuuuuuuuuuug

SEQ ID NO: 869224 - RNA, 21 nt, Human
uuuuuuuuuuuuuuuuugagg

SEQ ID NO: 869225 - RNA, 21 nt, Human
aaaaaaaagccggguauggug

SEQ ID NO: 869226 - RNA, 22 nt, Human
aaaaggccaggaguggaagaca

SEQ ID NO: 869227 - RNA, 21 nt, Human
aacagagugaggcccugucuc

SEQ ID NO: 869228 - RNA, 22 nt, Human
aaccguuuuuaaaaaccccauu

SEQ ID NO: 869229 - RNA, 25 nt, Human
aagaagccugcaaaacaaauacgua

SEQ ID NO: 869230 - RNA, 19 nt, Human
aagcugaagggcucccagg

SEQ ID NO: 869231 - RNA, 20 nt, Human
aaggucucauguagccugug

SEQ ID NO: 869232 - RNA, 23 nt, Human
acagagugaggcccugucucaaa

SEQ ID NO: 869233 - RNA, 24 nt, Human
acagagugaggcccugucucaaaa

SEQ ID NO: 869234 - RNA, 19 nt, Human
accccauugugaacauuuu

SEQ ID NO: 869235 - RNA, 24 nt, Human
acccugucucuacaaaauauacaa

SEQ ID NO: 869236 - RNA, 23 nt, Human
acucacacaagcacuugucccua

SEQ ID NO: 869237 - RNA, 18 nt, Human
acugcacuccggccuggg

SEQ ID NO: 869238 - RNA, 24 nt, Human
acugcacuccggccuggggaacag

SEQ ID NO: 869239 - RNA, 19 nt, Human
agacacuucaagggcccca

SEQ ID NO: 869240 - RNA, 18 nt, Human
agaggaacuugaugacca

SEQ ID NO: 869241 - RNA, 19 nt, Human
agauucggaaagcagguuc

SEQ ID NO: 869242 - RNA, 22 nt, Human
agcacaggcaccagaaugaucc

SEQ ID NO: 869243 - RNA, 21 nt, Human
agcacuuuugggagguugagg

SEQ ID NO: 869244 - RNA, 21 nt, Human
agccaggagguuucacguggc

SEQ ID NO: 869245 - RNA, 23 nt, Human
agccgggugugguggugcaagcc

SEQ ID NO: 869246 - RNA, 24 nt, Human
agccuguagucccagcuauucagg

SEQ ID NO: 869247 - RNA, 24 nt, Human
agcuauucaggaggcugagguggg

SEQ ID NO: 869248 - RNA, 23 nt, Human
aggaaacuugaaccacagagcug

SEQ ID NO: 869249 - RNA, 25 nt, Human
aggcccacagguaagauggccagga

SEQ ID NO: 869250 - RNA, 21 nt, Human
aggcugaggugggaggaucac

SEQ ID NO: 869251 - RNA, 24 nt, Human
agggagcagacacuucaagggccc

SEQ ID NO: 869252 - RNA, 20 nt, Human
agggagcugugcagucucag

SEQ ID NO: 869253 - RNA, 18 nt, Human
agggccccaaaaggccag

SEQ ID NO: 869254 - RNA, 19 nt, Human
aggggccugcugcagaugg

SEQ ID NO: 869255 - RNA, 19 nt, Human
agguggaggcugcagugag

SEQ ID NO: 869256 - RNA, 20 nt, Human
agguggaggcugcagugagc

SEQ ID NO: 869257 - RNA, 24 nt, Human
agguugaggcagaugaauugcuug

SEQ ID NO: 869258 - RNA, 21 nt, Human
aguauggaaggcccggaagga

SEQ ID NO: 869259 - RNA, 24 nt, Human
aucguaccacugcacuccggccug

SEQ ID NO: 869260 - RNA, 26 nt, Human
caaaacaaauacguaagaacuggaua

SEQ ID NO: 869261 - RNA, 25 nt, Human
caaaaggccaggagaaagaaaaaaa

SEQ ID NO: 869262 - RNA, 20 nt, Human
caaggagaugacucacaugg

SEQ ID NO: 869263 - RNA, 22 nt, Human
caauguggcgaaacccugucuc

SEQ ID NO: 869264 - RNA, 24 nt, Human
caauguggcgaaacccugucucua

SEQ ID NO: 869265 - RNA, 19 nt, Human
cacacacagccgggugagc

SEQ ID NO: 869266 - RNA, 20 nt, Human
cacccagugugaacuuugga

SEQ ID NO: 869267 - RNA, 19 nt, Human
caccuagggaaguauggaa

SEQ ID NO: 869268 - RNA, 24 nt, Human
cacuccggccuggggaacagagug

SEQ ID NO: 869269 - RNA, 18 nt, Human
cacugcacuccggccugg

SEQ ID NO: 869270 - RNA, 19 nt, Human
cacugcacuccggccuggg

SEQ ID NO: 869271 - RNA, 22 nt, Human
cacugcacuccggccuggggaa

SEQ ID NO: 869272 - RNA, 24 nt, Human
cacugcacuccggccuggggaaca

SEQ ID NO: 869273 - RNA, 26 nt, Human
cagaaugaucccagggcucagcucca

SEQ ID NO: 869274 - RNA, 21 nt, Human
cagacacuucaagggccccaa

SEQ ID NO: 869275 - RNA, 25 nt, Human
cagcacuuuugggagguugaggcag

SEQ ID NO: 869276 - RNA, 18 nt, Human
cagccugcaaggagauga

SEQ ID NO: 869277 - RNA, 24 nt, Human
cagcuauucaggaggcugaggugg

SEQ ID NO: 869278 - RNA, 18 nt, Human
caggaaacagcacccugc

SEQ ID NO: 869279 - RNA, 20 nt, Human
caggagguggaggcugcagu

SEQ ID NO: 869280 - RNA, 23 nt, Human
caucccuguaauccagcacuuuu

SEQ ID NO: 869281 - RNA, 22 nt, Human
ccacggagcuuagccuucagga

SEQ ID NO: 869282 - RNA, 19 nt, Human
ccacugcacuccggccugg

SEQ ID NO: 869283 - RNA, 20 nt, Human
ccacugcacuccggccuggg

SEQ ID NO: 869284 - RNA, 20 nt, Human
ccacugcacuccggccuggg

SEQ ID NO: 869285 - RNA, 21 nt, Human
ccacugcacuccggccugggg

SEQ ID NO: 869286 - RNA, 24 nt, Human
ccacugcacuccggccuggggaac

SEQ ID NO: 869287 - RNA, 22 nt, Human
ccaggagguggaggcugcagug

SEQ ID NO: 869288 - RNA, 21 nt, Human
cccagggcucagcuccaaggc

SEQ ID NO: 869289 - RNA, 23 nt, Human
cccauugugaacauuuuuggaac

SEQ ID NO: 869290 - RNA, 20 nt, Human
cccuggccuuccugcucuuc

SEQ ID NO: 869291 - RNA, 21 nt, Human
ccggccuggggaacagaguga

SEQ ID NO: 869292 - RNA, 18 nt, Human
ccgggugagccccgcagg

SEQ ID NO: 869293 - RNA, 19 nt, Human
ccuggaguccccgcaaagg

SEQ ID NO: 869294 - RNA, 22 nt, Human
ccugggcaauguggcgaaaccc

SEQ ID NO: 869295 - RNA, 24 nt, Human
ccugggcaauguggcgaaacccug

SEQ ID NO: 869296 - RNA, 21 nt, Human
ccugggccugggcaauguggc

SEQ ID NO: 869297 - RNA, 18 nt, Human
ccuggggcugcaggccag

SEQ ID NO: 869298 - RNA, 24 nt, Human
ccuguacacauagcugacucugaa

SEQ ID NO: 869299 - RNA, 21 nt, Human
ccuguagucccagcuauucag

SEQ ID NO: 869300 - RNA, 19 nt, Human
ccugugguggggcagugaa

SEQ ID NO: 869301 - RNA, 20 nt, Human
cucacacaagcacuuguccc

SEQ ID NO: 869302 - RNA, 23 nt, Human
cucaucccuguaauccagcacuu

SEQ ID NO: 869303 - RNA, 23 nt, Human
cugagcugaggcgagacccacac

SEQ ID NO: 869304 - RNA, 22 nt, Human
cugcagugagcugugaucguac

SEQ ID NO: 869305 - RNA, 20 nt, Human
gaaagcacguggguuccaga

SEQ ID NO: 869306 - RNA, 18 nt, Human
gaacagagugaggcccug

SEQ ID NO: 869307 - RNA, 20 nt, Human
gaaccacagagcugcuggcg

SEQ ID NO: 869308 - RNA, 25 nt, Human
gaaguccccacacaagugcacccuu

SEQ ID NO: 869309 - RNA, 21 nt, Human
gaccuuggcagccugcaagga

SEQ ID NO: 869310 - RNA, 23 nt, Human
gagcagacacuucaagggcccca

SEQ ID NO: 869311 - RNA, 21 nt, Human
gaguggaagacaggcccuagc

SEQ ID NO: 869312 - RNA, 18 nt, Human
gaugaccaggagccgugg

SEQ ID NO: 869313 - RNA, 19 nt, Human
gccgggugagccccgcagg

SEQ ID NO: 869314 - RNA, 23 nt, Human
gccugggcaauguggcgaaaccc

SEQ ID NO: 869315 - RNA, 23 nt, Human
gccuguagucccagcuauucagg

SEQ ID NO: 869316 - RNA, 20 nt, Human
gccugugcccuggccuuccu

SEQ ID NO: 869317 - RNA, 20 nt, Human
gcugugaucguaccacugca

SEQ ID NO: 869318 - RNA, 24 nt, Human
gcuguugcugggaggggccugcuu

SEQ ID NO: 869319 - RNA, 20 nt, Human
ggaaggacacacacagccgg

SEQ ID NO: 869320 - RNA, 20 nt, Human
ggagaaagaaaaaaaaaagc

SEQ ID NO: 869321 - RNA, 18 nt, Human
ggagcugugcagucucag

SEQ ID NO: 869322 - RNA, 18 nt, Human
ggaggcugcagugagcug

SEQ ID NO: 869323 - RNA, 24 nt, Human
ggaggcugcagugagcugugaucg

SEQ ID NO: 869324 - RNA, 25 nt, Human
ggcccugucucaaaaggccaggagu

SEQ ID NO: 869325 - RNA, 22 nt, Human
ggccugggcaauguggcgaaac

SEQ ID NO: 869326 - RNA, 18 nt, Human
ggcgaaggggguggguga

SEQ ID NO: 869327 - RNA, 23 nt, Human
gggccugcugcagauggcugcgg

SEQ ID NO: 869328 - RNA, 25 nt, Human
gggucucugcuguacaggaccuugg

SEQ ID NO: 869329 - RNA, 22 nt, Human
ggguguguucugagcugaggcg

SEQ ID NO: 869330 - RNA, 23 nt, Human
gguaugguggcucaucccuguaa

SEQ ID NO: 869331 - RNA, 19 nt, Human
ggugagccccgcagggagc

SEQ ID NO: 869332 - RNA, 23 nt, Human
gguggcucaucccuguaauccag

SEQ ID NO: 869333 - RNA, 23 nt, Human
gguuugggucucugcuguacagg

SEQ ID NO: 869334 - RNA, 23 nt, Human
gucucaggucguccaguccuggg

SEQ ID NO: 869335 - RNA, 21 nt, Human
guggaagacaggcccuagcca

SEQ ID NO: 869336 - RNA, 20 nt, Human
guggaggcugcagugagcug

SEQ ID NO: 869337 - RNA, 24 nt, Human
uacaaacagguaguucugaaagca

SEQ ID NO: 869338 - RNA, 18 nt, Human
uacaggaccuuggcagcc

SEQ ID NO: 869339 - RNA, 20 nt, Human
uaccgccugugcccuggccu

SEQ ID NO: 869340 - RNA, 26 nt, Human
uaccgccugugcccuggccuuccugc

SEQ ID NO: 869341 - RNA, 23 nt, Human
uaugagaaggcuguugcugggag

SEQ ID NO: 869342 - RNA, 24 nt, Human
ucacaugagcccaggagguggagg

SEQ ID NO: 869343 - RNA, 23 nt, Human
ucacugauaugguaaugccuccu

SEQ ID NO: 869344 - RNA, 18 nt, Human
ucaguccaggaaacaagc

SEQ ID NO: 869345 - RNA, 28 nt, Human
ucccuguaauccagcacuuuucccuggg

SEQ ID NO: 869346 - RNA, 23 nt, Human
uccggccuggggaacagagugag

SEQ ID NO: 869347 - RNA, 24 nt, Human
uccggccuggggaacagagugagg

SEQ ID NO: 869348 - RNA, 23 nt, Human
ucguaccacugcacuccggccug

SEQ ID NO: 869349 - RNA, 19 nt, Human
ucuccaagcaggugguccu

SEQ ID NO: 869350 - RNA, 20 nt, Human
ucuccaagcaggugguccug

SEQ ID NO: 869351 - RNA, 23 nt, Human
ucugaagacugcuaagaggguuu

SEQ ID NO: 869352 - RNA, 20 nt, Human
ugacucacauggaagucccc

SEQ ID NO: 869353 - RNA, 20 nt, Human
ugagaaggcuguugcuggga

SEQ ID NO: 869354 - RNA, 20 nt, Human
ugagaccagccugggccugg

SEQ ID NO: 869355 - RNA, 23 nt, Human
ugagcccagaaguuugagaccag

SEQ ID NO: 869356 - RNA, 22 nt, Human
ugaggaaacuugaaccacagag

SEQ ID NO: 869357 - RNA, 25 nt, Human
ugaggcagaugaauugcuugagccc

SEQ ID NO: 869358 - RNA, 24 nt, Human
ugaggcgagacccacacgaaaucu

SEQ ID NO: 869359 - RNA, 18 nt, Human
ugaggugggaggaucaca

SEQ ID NO: 869360 - RNA, 19 nt, Human
ugaggugggaggaucacau

SEQ ID NO: 869361 - RNA, 24 nt, Human
ugaggugggaggaucacaugagcc

SEQ ID NO: 869362 - RNA, 26 nt, Human
ugaggugggaggaucacaugagccca

SEQ ID NO: 869363 - RNA, 18 nt, Human
ugauaugguaaugccucc

SEQ ID NO: 869364 - RNA, 18 nt, Human
ugcugaaccaagaagccu

SEQ ID NO: 869365 - RNA, 22 nt, Human
uggaguccccgcaaagggagcc

SEQ ID NO: 869366 - RNA, 18 nt, Human
uggcucaucccuguaauc

SEQ ID NO: 869367 - RNA, 19 nt, Human
uggcucaucccuguaaucc

SEQ ID NO: 869368 - RNA, 23 nt, Human
uggcucaucccuguaauccagca

SEQ ID NO: 869369 - RNA, 24 nt, Human
ugggaggaucacaugagcccagga

SEQ ID NO: 869370 - RNA, 22 nt, Human
ugggaggggccugcugcagaug

SEQ ID NO: 869371 - RNA, 22 nt, Human
ugggagguugaggcagaugaau

SEQ ID NO: 869372 - RNA, 24 nt, Human
ugggagguugaggcagaugaauug

SEQ ID NO: 869373 - RNA, 24 nt, Human
ugggcaauguggcgaaacccuguc

SEQ ID NO: 869374 - RNA, 21 nt, Human
uggggaacagagugaggcccu

SEQ ID NO: 869375 - RNA, 18 nt, Human
uggggcugcaggccaguu

SEQ ID NO: 869376 - RNA, 18 nt, Human
uggugcaagccuguaguc

SEQ ID NO: 869377 - RNA, 22 nt, Human
ugguggcucaucccuguaaucc

SEQ ID NO: 869378 - RNA, 24 nt, Human
ugguggugcaagccuguaguccca

SEQ ID NO: 869379 - RNA, 18 nt, Human
ugugguggggcagugaac

SEQ ID NO: 869380 - RNA, 20 nt, Human
uuagccgggugugguggugc

SEQ ID NO: 869381 - RNA, 24 nt, Human
uuagccgggugugguggugcaagc

SEQ ID NO: 869382 - RNA, 19 nt, Human
uucaggcagaagugagaag

SEQ ID NO: 869383 - RNA, 21 nt, Human
uugcuugagcccagaaguuug

SEQ ID NO: 869384 - RNA, 24 nt, Human
uugcuugagcccagaaguuugaga

SEQ ID NO: 869385 - RNA, 24 nt, Human
uuggaacaagccucuuagaggguc

SEQ ID NO: 869386 - RNA, 18 nt, Human
uuugggucucugcuguac

SEQ ID NO: 869387 - RNA, 19 nt, Human
agacaggggcggcccgagc

SEQ ID NO: 869388 - RNA, 20 nt, Human
agagaaaaaaaaaauaacug

SEQ ID NO: 869389 - RNA, 26 nt, Human
agagaaaaaaaaaauaacugccuggg

SEQ ID NO: 869390 - RNA, 19 nt, Human
cagcgccgcaaagcuccgc

SEQ ID NO: 869391 - RNA, 24 nt, Human
cagcgccgcaaagcuccgcucaga

SEQ ID NO: 869392 - RNA, 18 nt, Human
caggauggaugaccaaca

SEQ ID NO: 869393 - RNA, 19 nt, Human
cccaggcugcggcagcgcg

SEQ ID NO: 869394 - RNA, 20 nt, Human
cccuggggaaucccaggcug

SEQ ID NO: 869395 - RNA, 21 nt, Human
ccgcaaagcuccgcucagaca

SEQ ID NO: 869396 - RNA, 20 nt, Human
ccuguaagcuucagcgccgc

SEQ ID NO: 869397 - RNA, 25 nt, Human
cuccgggggggucccuggggaaucc

SEQ ID NO: 869398 - RNA, 26 nt, Human
cuuuacuagaaauauagagaaaaaaa

SEQ ID NO: 869399 - RNA, 18 nt, Human
gcaaagcuccgcucagac

SEQ ID NO: 869400 - RNA, 20 nt, Human
gcaaagcuccgcucagacag

SEQ ID NO: 869401 - RNA, 25 nt, Human
gccgcaaagcuccgcucagacaggg

SEQ ID NO: 869402 - RNA, 21 nt, Human
gcuccgggggggucccugggg

SEQ ID NO: 869403 - RNA, 24 nt, Human
ggagcaucuccgaacucagcguag

SEQ ID NO: 869404 - RNA, 18 nt, Human
gggggggucccuggggaa

SEQ ID NO: 869405 - RNA, 23 nt, Human
uauagagaaaaaaaaaauaacug

SEQ ID NO: 869406 - RNA, 21 nt, Human
ucagacaggggcggcccgagc

SEQ ID NO: 869407 - RNA, 21 nt, Human
ucccuggggaaucccaggcug

SEQ ID NO: 869408 - RNA, 24 nt, Human
uccgccaaucagacgccgggcgag

SEQ ID NO: 869409 - RNA, 21 nt, Human
uggagcaucuccgaacucagc

SEQ ID NO: 869410 - RNA, 24 nt, Human
uuuuuuuuuuuuuuuuuuuuucag

SEQ ID NO: 869411 - RNA, 18 nt, Human
aacagcugacccuggggg

SEQ ID NO: 869412 - RNA, 20 nt, Human
aaccaggucucuaguuuguu

SEQ ID NO: 869413 - RNA, 19 nt, Human
aagagucagaaccacaggu

SEQ ID NO: 869414 - RNA, 23 nt, Human
aagagucagaaccacagguggga

SEQ ID NO: 869415 - RNA, 23 nt, Human
aagaugacauccucauuucuacc

SEQ ID NO: 869416 - RNA, 22 nt, Human
aaggggaggccgcauacuugcc

SEQ ID NO: 869417 - RNA, 21 nt, Human
aauagccccagaagcaagagc

SEQ ID NO: 869418 - RNA, 23 nt, Human
acacugacccuccaauagcccca

SEQ ID NO: 869419 - RNA, 21 nt, Human
acagcugacccugggggugag

SEQ ID NO: 869420 - RNA, 19 nt, Human
accacacccaacagcacca

SEQ ID NO: 869421 - RNA, 18 nt, Human
acgcagugugcgggcugg

SEQ ID NO: 869422 - RNA, 24 nt, Human
acgcugcaggaacaaagggggacc

SEQ ID NO: 869423 - RNA, 21 nt, Human
agaccacacccaacagcacca

SEQ ID NO: 869424 - RNA, 18 nt, Human
aggaaaaguggggaggcc

SEQ ID NO: 869425 - RNA, 25 nt, Human
aggaaaaguggggaggccauaaagg

SEQ ID NO: 869426 - RNA, 25 nt, Human
aggaacaaagggggacagcaucagc

SEQ ID NO: 869427 - RNA, 21 nt, Human
aggacacccuauuccugcuaa

SEQ ID NO: 869428 - RNA, 19 nt, Human
aggcaccaugaggcugccc

SEQ ID NO: 869429 - RNA, 25 nt, Human
aggcagcccugggugcugggggcag

SEQ ID NO: 869430 - RNA, 19 nt, Human
agggaaucucagagcccag

SEQ ID NO: 869431 - RNA, 19 nt, Human
auccuuuccaccccucccu

SEQ ID NO: 869432 - RNA, 22 nt, Human
auccuuuccaccccucccuccc

SEQ ID NO: 869433 - RNA, 18 nt, Human
auucagucacagacacug

SEQ ID NO: 869434 - RNA, 21 nt, Human
caacagcaccacaaagacagg

SEQ ID NO: 869435 - RNA, 26 nt, Human
caacagcaccacaaagacaggcaccc

SEQ ID NO: 869436 - RNA, 19 nt, Human
caagagccuagggcccagc

SEQ ID NO: 869437 - RNA, 19 nt, Human
caagcaaagugcuuugaaa

SEQ ID NO: 869438 - RNA, 24 nt, Human
caauagccccagaagcaagagccu

SEQ ID NO: 869439 - RNA, 22 nt, Human
cacacaguugucgguaauguuc

SEQ ID NO: 869440 - RNA, 25 nt, Human
caccacaaagacaggcaccaugagg

SEQ ID NO: 869441 - RNA, 20 nt, Human
caccccucccuccccggccc

SEQ ID NO: 869442 - RNA, 30 nt, Human
caccccucccuccccggcccuugggcccag

SEQ ID NO: 869443 - RNA, 21 nt, Human
cagaaccacaggugggaggga

SEQ ID NO: 869444 - RNA, 24 nt, Human
cagagcccaggcuccccacugagc

SEQ ID NO: 869445 - RNA, 23 nt, Human
cagcaccacaaagacaggcacca

SEQ ID NO: 869446 - RNA, 18 nt, Human
cauaaaggagaaagacca

SEQ ID NO: 869447 - RNA, 21 nt, Human
caucacauccuuuccaccccu

SEQ ID NO: 869448 - RNA, 25 nt, Human
caucacauccuuuccaccccucccu

SEQ ID NO: 869449 - RNA, 31 nt, Human
ccacacccaacagcaccacaaagacaggcag

SEQ ID NO: 869450 - RNA, 21 nt, Human
ccaccccucccuccccggccc

SEQ ID NO: 869451 - RNA, 18 nt, Human
cccaacagcaccacaaag

SEQ ID NO: 869452 - RNA, 19 nt, Human
cccacugagcuuggccagc

SEQ ID NO: 869453 - RNA, 19 nt, Human
cccagcgauccauacccag

SEQ ID NO: 869454 - RNA, 24 nt, Human
ccccagaagcaagagccuagggcc

SEQ ID NO: 869455 - RNA, 20 nt, Human
cccuugcaggcagcccuggg

SEQ ID NO: 869456 - RNA, 21 nt, Human
cccuugggcccagcucuggcc

SEQ ID NO: 869457 - RNA, 21 nt, Human
ccggcccuugggcccagcucu

SEQ ID NO: 869458 - RNA, 20 nt, Human
ccuccaauagccccagaagc

SEQ ID NO: 869459 - RNA, 23 nt, Human
cgcauacuugccuccuguguccu

SEQ ID NO: 869460 - RNA, 21 nt, Human
cuacggaguugugcuggggcc

SEQ ID NO: 869461 - RNA, 19 nt, Human
cuccccggcccuugggccc

SEQ ID NO: 869462 - RNA, 20 nt, Human
cuccuucagaggacccuaaa

SEQ ID NO: 869463 - RNA, 20 nt, Human
cugcaggaacaaagggggac

SEQ ID NO: 869464 - RNA, 22 nt, Human
cuggaacagcugacccuggggg

SEQ ID NO: 869465 - RNA, 24 nt, Human
cuugcaggcagcccugggugcugg

SEQ ID NO: 869466 - RNA, 19 nt, Human
gagcagcagcuguggccug

SEQ ID NO: 869467 - RNA, 20 nt, Human
gagcagcagcuguggccugg

SEQ ID NO: 869468 - RNA, 24 nt, Human
gagcgguggcagugaaucacacag

SEQ ID NO: 869469 - RNA, 25 nt, Human
gagcuuggccagcagcuuugaacuc

SEQ ID NO: 869470 - RNA, 21 nt, Human
gcagcccugggugcugggggc

SEQ ID NO: 869471 - RNA, 21 nt, Human
gcccuugcaggcagcccuggg

SEQ ID NO: 869472 - RNA, 19 nt, Human
gcugacccugggggugagc

SEQ ID NO: 869473 - RNA, 20 nt, Human
ggagacaguggcaggugcug

SEQ ID NO: 869474 - RNA, 20 nt, Human
ggcaggguaggacgcuggcc

SEQ ID NO: 869475 - RNA, 19 nt, Human
gggacagcaucagcagagc

SEQ ID NO: 869476 - RNA, 20 nt, Human
gggccaaggaggcugagggg

SEQ ID NO: 869477 - RNA, 19 nt, Human
gggcccagcucuggccagg

SEQ ID NO: 869478 - RNA, 19 nt, Human
gggucuuguagcaggcggc

SEQ ID NO: 869479 - RNA, 19 nt, Human
ggguggcucaguggccgag

SEQ ID NO: 869480 - RNA, 20 nt, Human
guggcucaguggccgagggg

SEQ ID NO: 869481 - RNA, 23 nt, Human
uaaaauaaaaugcaagcaaagug

SEQ ID NO: 869482 - RNA, 21 nt, Human
uaaaaugcaagcaaagugcuu

SEQ ID NO: 869483 - RNA, 18 nt, Human
uaacugacccagcccuca

SEQ ID NO: 869484 - RNA, 24 nt, Human
uaccagaccacacccaacagcacc

SEQ ID NO: 869485 - RNA, 24 nt, Human
uacuaggaagcugaagaagacggu

SEQ ID NO: 869486 - RNA, 22 nt, Human
uagguucuaacugacccagccc

SEQ ID NO: 869487 - RNA, 20 nt, Human
ucacauccuuuccaccccuc

SEQ ID NO: 869488 - RNA, 20 nt, Human
ucagagcccaggcuccccac

SEQ ID NO: 869489 - RNA, 21 nt, Human
ucagaggacccuaaaagugaa

SEQ ID NO: 869490 - RNA, 18 nt, Human
ucagcagagccugagggg

SEQ ID NO: 869491 - RNA, 23 nt, Human
ucagcagagccugagggguugca

SEQ ID NO: 869492 - RNA, 21 nt, Human
ucaguggccgagggggccaag

SEQ ID NO: 869493 - RNA, 21 nt, Human
uccacgcugcaggaacaaagg

SEQ ID NO: 869494 - RNA, 21 nt, Human
uccauacaucccaaauacuag

SEQ ID NO: 869495 - RNA, 23 nt, Human
uccccggcccuugggcccagcuc

SEQ ID NO: 869496 - RNA, 28 nt, Human
ucuguacuccuguggaugagaaggggag

SEQ ID NO: 869497 - RNA, 21 nt, Human
ugacccagcccucaugagguu

SEQ ID NO: 869498 - RNA, 19 nt, Human
ugagaaggggaggccgcau

SEQ ID NO: 869499 - RNA, 25 nt, Human
ugcccuugcaggcagcccugggugc

SEQ ID NO: 869500 - RNA, 20 nt, Human
uggcugagaaauggaaggau

SEQ ID NO: 869501 - RNA, 22 nt, Human
ugggaagagucagaaccacagg

SEQ ID NO: 869502 - RNA, 22 nt, Human
ugggcaggguaggacgcuggcc

SEQ ID NO: 869503 - RNA, 22 nt, Human
uggggaggccauaaaggagaaa

SEQ ID NO: 869504 - RNA, 19 nt, Human
ugugcuggggccaugcuga

SEQ ID NO: 869505 - RNA, 21 nt, Human
uugaaagaagggaggacaccc

SEQ ID NO: 869506 - RNA, 23 nt, Human
uuggccagcagcuuugaacuccu

SEQ ID NO: 869507 - RNA, 24 nt, Human
uuuccaccccucccuccccggccc

SEQ ID NO: 869508 - RNA, 22 nt, Human
uuuggcugagaaauggaaggau

SEQ ID NO: 869509 - RNA, 22 nt, Human
uuuuuauuuuuuuuuuugcagg

SEQ ID NO: 869510 - RNA, 18 nt, Human
uuuuuuuuuugcaggacc

SEQ ID NO: 869511 - RNA, 25 nt, Human
uuuuuuuuuuuuuuuuuuuauuuuu

SEQ ID NO: 869512 - RNA, 19 nt, Human
aagcagaggaagccugagc

SEQ ID NO: 869513 - RNA, 18 nt, Human
aagcugaggcaggagagg

SEQ ID NO: 869514 - RNA, 23 nt, Human
aagggacaagaaaaccaggccca

SEQ ID NO: 869515 - RNA, 21 nt, Human
acaaagcagaggaagccugag

SEQ ID NO: 869516 - RNA, 20 nt, Human
acacccaaggcaagggugac

SEQ ID NO: 869517 - RNA, 24 nt, Human
acuccgagggacagugcuuccggg

SEQ ID NO: 869518 - RNA, 23 nt, Human
agacaaagcagaggaagccugag

SEQ ID NO: 869519 - RNA, 18 nt, Human
aggagaugcuuuauuuca

SEQ ID NO: 869520 - RNA, 21 nt, Human
aggcaggagagggacacccaa

SEQ ID NO: 869521 - RNA, 23 nt, Human
aggcaggagagggacacccaagg

SEQ ID NO: 869522 - RNA, 19 nt, Human
aggcccaaagugagggcag

SEQ ID NO: 869523 - RNA, 18 nt, Human
aggccuuucuuguuggcu

SEQ ID NO: 869524 - RNA, 21 nt, Human
agguacaauaggccacaccuc

SEQ ID NO: 869525 - RNA, 20 nt, Human
caaagcagaggaagccugag

SEQ ID NO: 869526 - RNA, 21 nt, Human
cacccaaggcaagggugacag

SEQ ID NO: 869527 - RNA, 23 nt, Human
cacccaaggcaagggugacaggc

SEQ ID NO: 869528 - RNA, 23 nt, Human
caccucuguccugcaccugggaa

SEQ ID NO: 869529 - RNA, 23 nt, Human
cagucucaacuacuggucccaca

SEQ ID NO: 869530 - RNA, 21 nt, Human
ccaaagugagggcagcgcaga

SEQ ID NO: 869531 - RNA, 21 nt, Human
ccaaucaugcuggccuucuuc

SEQ ID NO: 869532 - RNA, 18 nt, Human
ccagacacgugcccagag

SEQ ID NO: 869533 - RNA, 22 nt, Human
ccagggugggagcaaccacaga

SEQ ID NO: 869534 - RNA, 24 nt, Human
cccaaagugagggcagcgcagaga

SEQ ID NO: 869535 - RNA, 20 nt, Human
cccacagaagaagucuucag

SEQ ID NO: 869536 - RNA, 18 nt, Human
ccccgaguccggggaguc

SEQ ID NO: 869537 - RNA, 21 nt, Human
ccccggcuguguccacucucc

SEQ ID NO: 869538 - RNA, 24 nt, Human
ccucuaaaauuaagcugaggcagg

SEQ ID NO: 869539 - RNA, 21 nt, Human
ccugcguuggggcagucucaa

SEQ ID NO: 869540 - RNA, 18 nt, Human
cuuucuuguuggcuggag

SEQ ID NO: 869541 - RNA, 19 nt, Human
gacaagaaaaccaggccca

SEQ ID NO: 869542 - RNA, 19 nt, Human
gagggcagcgcagagauga

SEQ ID NO: 869543 - RNA, 19 nt, Human
gagucgccggggccuugga

SEQ ID NO: 869544 - RNA, 18 nt, Human
gcgggugggccucggcgg

SEQ ID NO: 869545 - RNA, 22 nt, Human
ggagagccagucuccggccgga

SEQ ID NO: 869546 - RNA, 19 nt, Human
gucuccggccggauucugg

SEQ ID NO: 869547 - RNA, 21 nt, Human
ucagggaaaacacccagggug

SEQ ID NO: 869548 - RNA, 19 nt, Human
uccggccggauucuggugc

SEQ ID NO: 869549 - RNA, 24 nt, Human
uccugcaccugggaaccuugggca

SEQ ID NO: 869550 - RNA, 20 nt, Human
uccugcguuggggcagucuc

SEQ ID NO: 869551 - RNA, 18 nt, Human
ucuguccugcaccuggga

SEQ ID NO: 869552 - RNA, 24 nt, Human
ugaagggacaagaaaaccaggccc

SEQ ID NO: 869553 - RNA, 21 nt, Human
ugaccagacacgugcccagag

SEQ ID NO: 869554 - RNA, 18 nt, Human
ugaggcaggagagggaca

SEQ ID NO: 869555 - RNA, 21 nt, Human
ugccugcucaugguggguugu

SEQ ID NO: 869556 - RNA, 20 nt, Human
uggaugagcagagcaaccac

SEQ ID NO: 869557 - RNA, 25 nt, Human
uggaugugaccagacacgugcccag

SEQ ID NO: 869558 - RNA, 23 nt, Human
uguccugcguuggggcagucuca

SEQ ID NO: 869559 - RNA, 28 nt, Human
ugugaccagacacgugcccagagcugcc

SEQ ID NO: 869560 - RNA, 20 nt, Human
uucagaacaagguacaauag

SEQ ID NO: 869561 - RNA, 19 nt, Human
uuggggcagucucaacuac

SEQ ID NO: 869562 - RNA, 18 nt, Human
uuguccugcguuggggca

SEQ ID NO: 869563 - RNA, 19 nt, Human
uuguccugcguuggggcag

SEQ ID NO: 869564 - RNA, 22 nt, Human
uuguugugguguggcuccuuuc

SEQ ID NO: 869565 - RNA, 23 nt, Human
uuuuuuuuuuuuuuuuaagcagg

SEQ ID NO: 869566 - RNA, 19 nt, Human
uuuuuuuuuuuuuuuuuaa

SEQ ID NO: 869567 - RNA, 21 nt, Human
aacugcuucuuucagcuccug

SEQ ID NO: 869568 - RNA, 19 nt, Human
accccuccccuucuaucuc

SEQ ID NO: 869569 - RNA, 20 nt, Human
acucccucagagacagagug

SEQ ID NO: 869570 - RNA, 19 nt, Human
acuccuaacacugcucuuc

SEQ ID NO: 869571 - RNA, 20 nt, Human
agccuacuccccaaacccgc

SEQ ID NO: 869572 - RNA, 18 nt, Human
cacugcucuuccucuaca

SEQ ID NO: 869573 - RNA, 21 nt, Human
cagcuugucuggaagaaccga

SEQ ID NO: 869574 - RNA, 18 nt, Human
cccuccccuucuaucuca

SEQ ID NO: 869575 - RNA, 18 nt, Human
cccuccucccucuccucc

SEQ ID NO: 869576 - RNA, 19 nt, Human
cccucuccuccuaccccuc

SEQ ID NO: 869577 - RNA, 24 nt, Human
ccucccucuccuccuaccccuccc

SEQ ID NO: 869578 - RNA, 21 nt, Human
cuacccuccucccucuccucc

SEQ ID NO: 869579 - RNA, 22 nt, Human
cuacuccccaaacccgcuuaac

SEQ ID NO: 869580 - RNA, 19 nt, Human
cucaagccuacuccccaaa

SEQ ID NO: 869581 - RNA, 21 nt, Human
cucccucuccuccuaccccuc

SEQ ID NO: 869582 - RNA, 20 nt, Human
cuccuaccccuccccuucua

SEQ ID NO: 869583 - RNA, 20 nt, Human
cuccucccucuccuccuacc

SEQ ID NO: 869584 - RNA, 28 nt, Human
cugauggugaugugguaggcaguucuuu

SEQ ID NO: 869585 - RNA, 19 nt, Human
cuggaagaaccgaaggaug

SEQ ID NO: 869586 - RNA, 19 nt, Human
cuggccccucuuugaaauc

SEQ ID NO: 869587 - RNA, 23 nt, Human
uaacuccuaacacugcucuuccu

SEQ ID NO: 869588 - RNA, 19 nt, Human
uaacugcuucuuucagcuc

SEQ ID NO: 869589 - RNA, 22 nt, Human
uaagguagggcucaagccuacu

SEQ ID NO: 869590 - RNA, 20 nt, Human
uccccaaacccgcuuaacuc

SEQ ID NO: 869591 - RNA, 20 nt, Human
ucccucagagacagagugga

SEQ ID NO: 869592 - RNA, 18 nt, Human
ucccucuccuccuacccc

SEQ ID NO: 869593 - RNA, 18 nt, Human
uccuccuaccccuccccu

SEQ ID NO: 869594 - RNA, 22 nt, Human
ugaccuaacugcuucuuucagc

SEQ ID NO: 869595 - RNA, 21 nt, Human
uggccauggucagcgucuugc

SEQ ID NO: 869596 - RNA, 22 nt, Human
uggccauggucagcgucuugca

SEQ ID NO: 869597 - RNA, 20 nt, Human
uggucagcgucuugcagcuu

SEQ ID NO: 869598 - RNA, 21 nt, Human
ugucuggaagaaccgaaggau

SEQ ID NO: 869599 - RNA, 20 nt, Human
ugucuuccuacccuccuccc

SEQ ID NO: 869600 - RNA, 22 nt, Human
ugucuuccuacccuccucccuc

SEQ ID NO: 869601 - RNA, 18 nt, Human
uuuuuuuuuuuuuuuuug

SEQ ID NO: 869602 - RNA, 20 nt, Human
uuuuuuuuuuuuuuuuuugg

SEQ ID NO: 869603 - RNA, 20 nt, Human
aaaaagacaacggcaaccga

SEQ ID NO: 869604 - RNA, 21 nt, Human
accuguggacgaggguucccu

SEQ ID NO: 869605 - RNA, 18 nt, Human
agaaauugcauucuguac

SEQ ID NO: 869606 - RNA, 22 nt, Human
agagaacuugucacuaguaauu

SEQ ID NO: 869607 - RNA, 24 nt, Human
caagagcaagggguggccaccugu

SEQ ID NO: 869608 - RNA, 24 nt, Human
caaggaaaaaagacaacggcaacc

SEQ ID NO: 869609 - RNA, 24 nt, Human
cagaacacguugcccaccucgcaa

SEQ ID NO: 869610 - RNA, 18 nt, Human
ccaccuguggacgagggu

SEQ ID NO: 869611 - RNA, 21 nt, Human
cccauggccacugcgcucauu

SEQ ID NO: 869612 - RNA, 18 nt, Human
ccccauggccacugcgcu

SEQ ID NO: 869613 - RNA, 21 nt, Human
ccgagucaaggaaaaaagaca

SEQ ID NO: 869614 - RNA, 23 nt, Human
cucaagagcaagggguggccacc

SEQ ID NO: 869615 - RNA, 19 nt, Human
cucgagaugguagguggcu

SEQ ID NO: 869616 - RNA, 21 nt, Human
gagcaagggguggccaccugu

SEQ ID NO: 869617 - RNA, 22 nt, Human
gagcguuauuaaaacccuacua

SEQ ID NO: 869618 - RNA, 21 nt, Human
gagguuuugggugggacucaa

SEQ ID NO: 869619 - RNA, 21 nt, Human
gugggacucaagagcaagggg

SEQ ID NO: 869620 - RNA, 19 nt, Human
uaacagaacacguugccca

SEQ ID NO: 869621 - RNA, 23 nt, Human
ucaaaggggccccgggggcggcg

SEQ ID NO: 869622 - RNA, 20 nt, Human
uccccauggccacugcgcuc

SEQ ID NO: 869623 - RNA, 21 nt, Human
uccgagucaaggaaaaaagac

SEQ ID NO: 869624 - RNA, 19 nt, Human
ugaugaccacacgggaacc

SEQ ID NO: 869625 - RNA, 21 nt, Human
uguccaucaaaggggccccgg

SEQ ID NO: 869626 - RNA, 19 nt, Human
uuuuuuuuuuuuagagauc

SEQ ID NO: 869627 - RNA, 19 nt, Human
aaagaaggaaaaauagaac

SEQ ID NO: 869628 - RNA, 19 nt, Human
aaagugcuaggauuauagg

SEQ ID NO: 869629 - RNA, 24 nt, Human
aaagugcuaggauuauaggcauga

SEQ ID NO: 869630 - RNA, 24 nt, Human
aagaaggaaaaauagaacuaagaa

SEQ ID NO: 869631 - RNA, 19 nt, Human
aauagaacuaagaauauca

SEQ ID NO: 869632 - RNA, 24 nt, Human
accauguuggccaagcuggucuug

SEQ ID NO: 869633 - RNA, 22 nt, Human
agagagaaagagggaaccccga

SEQ ID NO: 869634 - RNA, 24 nt, Human
agcuggucuugaacuccugaccuc

SEQ ID NO: 869635 - RNA, 18 nt, Human
aggaagccucccagcuca

SEQ ID NO: 869636 - RNA, 19 nt, Human
aggcaugagccacugugcc

SEQ ID NO: 869637 - RNA, 22 nt, Human
aggcaugagccacugugccugg

SEQ ID NO: 869638 - RNA, 23 nt, Human
aggccaggaaaggauaggucuga

SEQ ID NO: 869639 - RNA, 25 nt, Human
aggcuggagugcagugggaagaucu

SEQ ID NO: 869640 - RNA, 24 nt, Human
aggugaucugcccgccucggccuc

SEQ ID NO: 869641 - RNA, 19 nt, Human
aguagcugggauuaaaggc

SEQ ID NO: 869642 - RNA, 24 nt, Human
agugcagugggaagaucucagcuc

SEQ ID NO: 869643 - RNA, 18 nt, Human
augggguuucaccauguu

SEQ ID NO: 869644 - RNA, 22 nt, Human
augggguuucaccauguuggcc

SEQ ID NO: 869645 - RNA, 25 nt, Human
augggguuucaccauguuggccaag

SEQ ID NO: 869646 - RNA, 24 nt, Human
auuuuuguauuuuugguagagaug

SEQ ID NO: 869647 - RNA, 24 nt, Human
caaagugcuaggauuauaggcaug

SEQ ID NO: 869648 - RNA, 18 nt, Human
caaccuccaccuccugga

SEQ ID NO: 869649 - RNA, 22 nt, Human
caccaccacgucuggcuaauuu

SEQ ID NO: 869650 - RNA, 24 nt, Human
caccacgucuggcuaauuuuugua

SEQ ID NO: 869651 - RNA, 21 nt, Human
caccauguuggccaagcuggu

SEQ ID NO: 869652 - RNA, 23 nt, Human
caccauguuggccaagcuggucu

SEQ ID NO: 869653 - RNA, 24 nt, Human
caccauguuggccaagcuggucuu

SEQ ID NO: 869654 - RNA, 27 nt, Human
caccauguuggccaagcuggucuugaa

SEQ ID NO: 869655 - RNA, 22 nt, Human
cacccggggccccggccucguc

SEQ ID NO: 869656 - RNA, 23 nt, Human
cacccggggccccggccucgucc

SEQ ID NO: 869657 - RNA, 21 nt, Human
cacugcaaccuccaccuccug

SEQ ID NO: 869658 - RNA, 19 nt, Human
cacugugccuggucaagau

SEQ ID NO: 869659 - RNA, 22 nt, Human
caugugauucuccugccucagc

SEQ ID NO: 869660 - RNA, 24 nt, Human
cauguuggccaagcuggucuugaa

SEQ ID NO: 869661 - RNA, 24 nt, Human
ccaaagugcuaggauuauaggcau

SEQ ID NO: 869662 - RNA, 24 nt, Human
ccaaccagugacauucuugacugg

SEQ ID NO: 869663 - RNA, 18 nt, Human
ccaggauucugugaaccc

SEQ ID NO: 869664 - RNA, 21 nt, Human
ccaggauucugugaaccccuc

SEQ ID NO: 869665 - RNA, 18 nt, Human
cccauaucucaaccccca

SEQ ID NO: 869666 - RNA, 26 nt, Human
ccccauaucucaacccccacgucagc

SEQ ID NO: 869667 - RNA, 19 nt, Human
cccgaguagcugggauuaa

SEQ ID NO: 869668 - RNA, 19 nt, Human
ccuccaccuccuggauuca

SEQ ID NO: 869669 - RNA, 19 nt, Human
ccucccagcucagaggguc

SEQ ID NO: 869670 - RNA, 22 nt, Human
ccucccagcucagaggguccug

SEQ ID NO: 869671 - RNA, 24 nt, Human
ccuccuggauucaugugauucucc

SEQ ID NO: 869672 - RNA, 22 nt, Human
ccugaccucaggugaucugccc

SEQ ID NO: 869673 - RNA, 24 nt, Human
cgccucggccucccaaagugcuag

SEQ ID NO: 869674 - RNA, 22 nt, Human
cggguccucuccccggugcccc

SEQ ID NO: 869675 - RNA, 23 nt, Human
cgugcaccaccacgucuggcuaa

SEQ ID NO: 869676 - RNA, 24 nt, Human
cucacugcaaccuccaccuccugg

SEQ ID NO: 869677 - RNA, 24 nt, Human
cucagccucccgaguagcugggau

SEQ ID NO: 869678 - RNA, 24 nt, Human
cucauccccauaucucaaccccca

SEQ ID NO: 869679 - RNA, 19 nt, Human
cuccaaaagcugugacucu

SEQ ID NO: 869680 - RNA, 26 nt, Human
cuccugaccucaggugaucugcccgc

SEQ ID NO: 869681 - RNA, 23 nt, Human
cugcaaccuccaccuccuggauu

SEQ ID NO: 869682 - RNA, 23 nt, Human
cugccucagccucccgaguagcu

SEQ ID NO: 869683 - RNA, 24 nt, Human
gaccucaggugaucugcccgccuc

SEQ ID NO: 869684 - RNA, 18 nt, Human
gagaugggguuucaccau

SEQ ID NO: 869685 - RNA, 24 nt, Human
gagaugggguuucaccauguuggc

SEQ ID NO: 869686 - RNA, 21 nt, Human
gaggguccuggguccgggucc

SEQ ID NO: 869687 - RNA, 19 nt, Human
gauuauaggcaugagccac

SEQ ID NO: 869688 - RNA, 21 nt, Human
gauuauaggcaugagccacug

SEQ ID NO: 869689 - RNA, 22 nt, Human
gcaaccuccaccuccuggauuc

SEQ ID NO: 869690 - RNA, 20 nt, Human
gccucagccucccgaguagc

SEQ ID NO: 869691 - RNA, 21 nt, Human
gcgcaggaagccucccagcuc

SEQ ID NO: 869692 - RNA, 22 nt, Human
ggauuauaggcaugagccacug

SEQ ID NO: 869693 - RNA, 18 nt, Human
gggguuucaccauguugg

SEQ ID NO: 869694 - RNA, 22 nt, Human
gggguuucaccauguuggccaa

SEQ ID NO: 869695 - RNA, 18 nt, Human
ggguuucaccauguuggc

SEQ ID NO: 869696 - RNA, 22 nt, Human
ggguuucaccauguuggccaag

SEQ ID NO: 869697 - RNA, 21 nt, Human
gguagagaugggguuucacca

SEQ ID NO: 869698 - RNA, 19 nt, Human
ggucuugaacuccugaccu

SEQ ID NO: 869699 - RNA, 19 nt, Human
guagagaugggguuucacc

SEQ ID NO: 869700 - RNA, 21 nt, Human
guagagaugggguuucaccau

SEQ ID NO: 869701 - RNA, 22 nt, Human
guagagaugggguuucaccaug

SEQ ID NO: 869702 - RNA, 23 nt, Human
guagagaugggguuucaccaugu

SEQ ID NO: 869703 - RNA, 24 nt, Human
gugaucugcccgccucggccuccc

SEQ ID NO: 869704 - RNA, 24 nt, Human
gugauucuccugccucagccuccc

SEQ ID NO: 869705 - RNA, 23 nt, Human
uaagaauaucaugccaaccagug

SEQ ID NO: 869706 - RNA, 24 nt, Human
uaauuuuuguauuuuugguagaga

SEQ ID NO: 869707 - RNA, 22 nt, Human
uagagaugggguuucaccaugu

SEQ ID NO: 869708 - RNA, 21 nt, Human
uaggauuauaggcaugagcca

SEQ ID NO: 869709 - RNA, 22 nt, Human
uaggauuauaggcaugagccac

SEQ ID NO: 869710 - RNA, 22 nt, Human
uaggauuauaggcaugagccac

SEQ ID NO: 869711 - RNA, 23 nt, Human
uaggauuauaggcaugagccacu

SEQ ID NO: 869712 - RNA, 24 nt, Human
uaggauuauaggcaugagccacug

SEQ ID NO: 869713 - RNA, 19 nt, Human
uauuuuugguagagauggg

SEQ ID NO: 869714 - RNA, 23 nt, Human
ucaacccccacgucagcccugga

SEQ ID NO: 869715 - RNA, 19 nt, Human
ucacugcaaccuccaccuc

SEQ ID NO: 869716 - RNA, 23 nt, Human
ucacugcaaccuccaccuccugg

SEQ ID NO: 869717 - RNA, 24 nt, Human
ucacugcaaccuccaccuccugga

SEQ ID NO: 869718 - RNA, 20 nt, Human
ucagccucccgaguagcugg

SEQ ID NO: 869719 - RNA, 24 nt, Human
ucccaaagugcuaggauuauaggc

SEQ ID NO: 869720 - RNA, 24 nt, Human
ucccagcucagaggguccuggguc

SEQ ID NO: 869721 - RNA, 24 nt, Human
ucccgaguagcugggauuaaaggc

SEQ ID NO: 869722 - RNA, 24 nt, Human
uccuggauucaugugauucuccug

SEQ ID NO: 869723 - RNA, 18 nt, Human
uccuggguccggguccuc

SEQ ID NO: 869724 - RNA, 18 nt, Human
ucggccucccaaagugcu

SEQ ID NO: 869725 - RNA, 21 nt, Human
ucucaacccccacgucagccc

SEQ ID NO: 869726 - RNA, 24 nt, Human
ucuccugccucagccucccgagua

SEQ ID NO: 869727 - RNA, 24 nt, Human
ucuucauccucauccccauaucuc

SEQ ID NO: 869728 - RNA, 23 nt, Human
ucuugaacuccugaccucaggug

SEQ ID NO: 869729 - RNA, 19 nt, Human
ucuugacuggagcugcugc

SEQ ID NO: 869730 - RNA, 18 nt, Human
ugaccucaggugaucugc

SEQ ID NO: 869731 - RNA, 20 nt, Human
ugaccucaggugaucugccc

SEQ ID NO: 869732 - RNA, 24 nt, Human
ugaccucaggugaucugcccgccu

SEQ ID NO: 869733 - RNA, 20 nt, Human
ugauucuccugccucagccu

SEQ ID NO: 869734 - RNA, 25 nt, Human
ugcccgccugccgggugccacccgg

SEQ ID NO: 869735 - RNA, 24 nt, Human
ugccucagccucccgaguagcugg

SEQ ID NO: 869736 - RNA, 23 nt, Human
uggagugcagugggaagaucuca

SEQ ID NO: 869737 - RNA, 18 nt, Human
uggcagagagaaagaggg

SEQ ID NO: 869738 - RNA, 24 nt, Human
uggccaagcuggucuugaacuccu

SEQ ID NO: 869739 - RNA, 24 nt, Human
ugggaagaucucagcucacugcaa

SEQ ID NO: 869740 - RNA, 24 nt, Human
ugggauuaaaggcgugcaccacca

SEQ ID NO: 869741 - RNA, 24 nt, Human
ugggguuucaccauguuggccaag

SEQ ID NO: 869742 - RNA, 24 nt, Human
ugguagagaugggguuucaccaug

SEQ ID NO: 869743 - RNA, 18 nt, Human
ugugacucuauggggucc

SEQ ID NO: 869744 - RNA, 24 nt, Human
ugugauucuccugccucagccucc

SEQ ID NO: 869745 - RNA, 23 nt, Human
uuauuggccaggcuggagugcag

SEQ ID NO: 869746 - RNA, 18 nt, Human
uucaugugauucuccugc

SEQ ID NO: 869747 - RNA, 23 nt, Human
uucaugugauucuccugccucag

SEQ ID NO: 869748 - RNA, 18 nt, Human
uugcagauggggaaguca

SEQ ID NO: 869749 - RNA, 20 nt, Human
uugcuggagacaggucuuau

SEQ ID NO: 869750 - RNA, 21 nt, Human
uugcuggagacaggucuuauu

SEQ ID NO: 869751 - RNA, 18 nt, Human
uuggccaggcuggagugc

SEQ ID NO: 869752 - RNA, 24 nt, Human
uugguagagaugggguuucaccau

SEQ ID NO: 869753 - RNA, 21 nt, Human
uuucaccauguuggccaagcu

SEQ ID NO: 869754 - RNA, 22 nt, Human
uuuuugguagagaugggguuuc

SEQ ID NO: 869755 - RNA, 24 nt, Human
uuuuugguagagaugggguuucac

SEQ ID NO: 869756 - RNA, 20 nt, Human
uuuuuguauuuuugguagag

SEQ ID NO: 869757 - RNA, 24 nt, Human
uuuuuuuuuugagacagggucuug

SEQ ID NO: 869758 - RNA, 20 nt, Human
uuuuuuuuuuugagacaggg

SEQ ID NO: 869759 - RNA, 23 nt, Human
uuuuuuuuuuuugagacaggguc

SEQ ID NO: 869760 - RNA, 24 nt, Human
uuuuuuuuuuuugagacagggucu

SEQ ID NO: 869761 - RNA, 24 nt, Human
uuuuuuuuuuuuuuugagacaggg

SEQ ID NO: 869762 - RNA, 19 nt, Human
aaaaagaguuuauuuagaa

SEQ ID NO: 869763 - RNA, 20 nt, Human
aaacacacacacaaagaaga

SEQ ID NO: 869764 - RNA, 24 nt, Human
aaacacacacacaaagaagauacc

SEQ ID NO: 869765 - RNA, 22 nt, Human
aaacagaaggauccccugaaca

SEQ ID NO: 869766 - RNA, 22 nt, Human
aaacagaaucagaaacucuaga

SEQ ID NO: 869767 - RNA, 27 nt, Human
aacaccuaucuaucuuagagcuuaagc

SEQ ID NO: 869768 - RNA, 19 nt, Human
aacagaaggauccccugaa

SEQ ID NO: 869769 - RNA, 24 nt, Human
aagaguuuauuuagaaaguaucau

SEQ ID NO: 869770 - RNA, 18 nt, Human
acagcugccacagccgug

SEQ ID NO: 869771 - RNA, 25 nt, Human
acgcagggugcgggagcuggcaggg

SEQ ID NO: 869772 - RNA, 18 nt, Human
acuggaaucuuucaauga

SEQ ID NO: 869773 - RNA, 20 nt, Human
agauacugagaaugagccuc

SEQ ID NO: 869774 - RNA, 18 nt, Human
aggcagaggcuggucgag

SEQ ID NO: 869775 - RNA, 23 nt, Human
agggugcgggagcugggcaggag

SEQ ID NO: 869776 - RNA, 21 nt, Human
agucucaaaggaaaccaugua

SEQ ID NO: 869777 - RNA, 19 nt, Human
aguucaugugggcucuggc

SEQ ID NO: 869778 - RNA, 21 nt, Human
aucacggcuaaccucucacac

SEQ ID NO: 869779 - RNA, 21 nt, Human
augcaucccauucuucauaca

SEQ ID NO: 869780 - RNA, 21 nt, Human
augcugcuguuaucuucugcc

SEQ ID NO: 869781 - RNA, 22 nt, Human
caaaaucacucaacucaggagc

SEQ ID NO: 869782 - RNA, 24 nt, Human
caaaaucacucaacucaggagcca

SEQ ID NO: 869783 - RNA, 18 nt, Human
caagagaaggucaaaggg

SEQ ID NO: 869784 - RNA, 25 nt, Human
caaggccaccuuuccagaacucgug

SEQ ID NO: 869785 - RNA, 18 nt, Human
caccuaucuaucuuagag

SEQ ID NO: 869786 - RNA, 21 nt, Human
cagccgugcacaccagggcca

SEQ ID NO: 869787 - RNA, 19 nt, Human
cagcggccgugaagguauc

SEQ ID NO: 869788 - RNA, 22 nt, Human
cagggccagagcagcccacuga

SEQ ID NO: 869789 - RNA, 22 nt, Human
ccaugccuacccuuucuaagga

SEQ ID NO: 869790 - RNA, 21 nt, Human
ccccugaacaguaacugauuu

SEQ ID NO: 869791 - RNA, 18 nt, Human
cccuggauacccaggccu

SEQ ID NO: 869792 - RNA, 18 nt, Human
ccgugcacaccagggcca

SEQ ID NO: 869793 - RNA, 20 nt, Human
ccuaaacgcagggugcggga

SEQ ID NO: 869794 - RNA, 21 nt, Human
cuaaccucucacacugagaga

SEQ ID NO: 869795 - RNA, 24 nt, Human
cucccaggucauuccaagucggcu

SEQ ID NO: 869796 - RNA, 18 nt, Human
cugcagccgcuggcagug

SEQ ID NO: 869797 - RNA, 26 nt, Human
cugccacagccgugcacaccagggcc

SEQ ID NO: 869798 - RNA, 19 nt, Human
cuggucuugucaccccagg

SEQ ID NO: 869799 - RNA, 18 nt, Human
cuguaugugcuuauuccc

SEQ ID NO: 869800 - RNA, 18 nt, Human
cuucugccucagacagac

SEQ ID NO: 869801 - RNA, 20 nt, Human
gaacgucaauacugccacaa

SEQ ID NO: 869802 - RNA, 20 nt, Human
gagccucccuggauacccag

SEQ ID NO: 869803 - RNA, 19 nt, Human
gcacaccagggccagagca

SEQ ID NO: 869804 - RNA, 25 nt, Human
gcagaccaaguauagcaagccucua

SEQ ID NO: 869805 - RNA, 22 nt, Human
gcagagccucccuggauaccca

SEQ ID NO: 869806 - RNA, 20 nt, Human
ggaauuuuccaugccuaccc

SEQ ID NO: 869807 - RNA, 20 nt, Human
ggccaaguauccacaucccc

SEQ ID NO: 869808 - RNA, 20 nt, Human
ggugacaaauacaacuggaa

SEQ ID NO: 869809 - RNA, 18 nt, Human
guuuuuuuaaaaaaagaa

SEQ ID NO: 869810 - RNA, 19 nt, Human
uaaaaggacuacugagaaa

SEQ ID NO: 869811 - RNA, 23 nt, Human
uaaacgcagggugcgggagcugg

SEQ ID NO: 869812 - RNA, 26 nt, Human
uacugccacaaggccaccuuuccaga

SEQ ID NO: 869813 - RNA, 27 nt, Human
uagcucgaugguaaaaggacaaacacc

SEQ ID NO: 869814 - RNA, 21 nt, Human
ucaacagcugccacagccgug

SEQ ID NO: 869815 - RNA, 18 nt, Human
ucaauacugccacaaggc

SEQ ID NO: 869816 - RNA, 19 nt, Human
uccaagucggcugcagccg

SEQ ID NO: 869817 - RNA, 22 nt, Human
uccacaccagggcgcgaagaac

SEQ ID NO: 869818 - RNA, 23 nt, Human
ucccaggucauuccaagucggcu

SEQ ID NO: 869819 - RNA, 19 nt, Human
ucccuggauacccaggccu

SEQ ID NO: 869820 - RNA, 22 nt, Human
ucccuggauacccaggccuggg

SEQ ID NO: 869821 - RNA, 18 nt, Human
ucuaguuagggcccuuca

SEQ ID NO: 869822 - RNA, 24 nt, Human
ucugcuuucugaacagccaccacu

SEQ ID NO: 869823 - RNA, 24 nt, Human
ucuguagaguguguuggcuuggaa

SEQ ID NO: 869824 - RNA, 26 nt, Human
ucuuuggucuugagaucaaaugcauc

SEQ ID NO: 869825 - RNA, 25 nt, Human
ugacaaauacaacuggaaaggguuc

SEQ ID NO: 869826 - RNA, 20 nt, Human
ugagauacugagaaugagcc

SEQ ID NO: 869827 - RNA, 22 nt, Human
ugagauacugagaaugagccuc

SEQ ID NO: 869828 - RNA, 20 nt, Human
uggaaaacacacacacaaag

SEQ ID NO: 869829 - RNA, 26 nt, Human
uggaaaacacacacacaaagaagaua

SEQ ID NO: 869830 - RNA, 24 nt, Human
uggccucugugggacugaacuccu

SEQ ID NO: 869831 - RNA, 24 nt, Human
ugggaggugggugaagaguguugg

SEQ ID NO: 869832 - RNA, 19 nt, Human
ugggcaggagaggugaccu

SEQ ID NO: 869833 - RNA, 19 nt, Human
ugggccaaguauccacauc

SEQ ID NO: 869834 - RNA, 21 nt, Human
uggguuuuugcauuucaaucu

SEQ ID NO: 869835 - RNA, 23 nt, Human
uuaaucacaaggacagcaugagu

SEQ ID NO: 869836 - RNA, 18 nt, Human
gccacuccuccaggccac

SEQ ID NO: 869837 - RNA, 18 nt, Human
ugaaugaaugggaaaagg

SEQ ID NO: 869838 - RNA, 21 nt, Human
ugugaaugaaugggaaaaggg

SEQ ID NO: 869839 - RNA, 21 nt, Human
uuuuuuuuuuuuuuuucucag

SEQ ID NO: 869840 - RNA, 23 nt, Human
uuuuuuuuuuuuuuuuuuucuca

SEQ ID NO: 869841 - RNA, 24 nt, Human
uuuuuuuuuuuuuuuuuuuuucuu

SEQ ID NO: 869842 - RNA, 19 nt, Human
aagcuguuuucugcuaccc

SEQ ID NO: 869843 - RNA, 20 nt, Human
aauuuuguccuuuuggaaca

SEQ ID NO: 869844 - RNA, 23 nt, Human
accucuuuugugcagaauccuca

SEQ ID NO: 869845 - RNA, 24 nt, Human
agagcaguuuuccugaagccuagg

SEQ ID NO: 869846 - RNA, 26 nt, Human
aggaaagaauacaacuugauagaaaa

SEQ ID NO: 869847 - RNA, 24 nt, Human
aggaaugcaacuaauauuguugag

SEQ ID NO: 869848 - RNA, 24 nt, Human
aggcgucuguccaugguacuuccu

SEQ ID NO: 869849 - RNA, 23 nt, Human
aucauguccauaguuucagccug

SEQ ID NO: 869850 - RNA, 22 nt, Human
caauccaacugcacugcuuugu

SEQ ID NO: 869851 - RNA, 20 nt, Human
caccccugguaggcgucugu

SEQ ID NO: 869852 - RNA, 18 nt, Human
cagauugcacuaaaaaac

SEQ ID NO: 869853 - RNA, 19 nt, Human
cagcuccuaagguaacacc

SEQ ID NO: 869854 - RNA, 24 nt, Human
cauucaggauuaaagaguuaggaa

SEQ ID NO: 869855 - RNA, 22 nt, Human
cggggccacuuuuuccuggagg

SEQ ID NO: 869856 - RNA, 18 nt, Human
cugcuacccuuuccuguc

SEQ ID NO: 869857 - RNA, 25 nt, Human
cuuccaagucaaauaccaauugcau

SEQ ID NO: 869858 - RNA, 18 nt, Human
cuugauagaaaaacgucu

SEQ ID NO: 869859 - RNA, 22 nt, Human
gaaggggacaacauucauuagg

SEQ ID NO: 869860 - RNA, 19 nt, Human
gagcaguuuuccugaagcc

SEQ ID NO: 869861 - RNA, 23 nt, Human
gcggcagaucgcgcgcgggagcc

SEQ ID NO: 869862 - RNA, 21 nt, Human
ggagccgcgggacccgggaag

SEQ ID NO: 869863 - RNA, 21 nt, Human
ggccacuuuuuccuggagggu

SEQ ID NO: 869864 - RNA, 24 nt, Human
uaaagaguuaggaaggauaaauua

SEQ ID NO: 869865 - RNA, 22 nt, Human
uaacaccauugaaggggacaac

SEQ ID NO: 869866 - RNA, 20 nt, Human
uaauuccggaauuuuuccuu

SEQ ID NO: 869867 - RNA, 19 nt, Human
uagaacaggaaagaauaca

SEQ ID NO: 869868 - RNA, 22 nt, Human
uauagaacaggaaagaauacaa

SEQ ID NO: 869869 - RNA, 19 nt, Human
uaugaaagucaguggagau

SEQ ID NO: 869870 - RNA, 23 nt, Human
ucaaauaccaauugcaugcuaac

SEQ ID NO: 869871 - RNA, 19 nt, Human
uccaugauggguaaugggg

SEQ ID NO: 869872 - RNA, 23 nt, Human
uccuggaggguuuccaugauggg

SEQ ID NO: 869873 - RNA, 24 nt, Human
uccuuacaauccaacugcacugcu

SEQ ID NO: 869874 - RNA, 19 nt, Human
ucuucagaaaucaugucca

SEQ ID NO: 869875 - RNA, 21 nt, Human
ucuuuugugcagaauccucag

SEQ ID NO: 869876 - RNA, 20 nt, Human
ugaauugaauguucagcucc

SEQ ID NO: 869877 - RNA, 20 nt, Human
ugcuuugucaccccugguag

SEQ ID NO: 869878 - RNA, 22 nt, Human
uggacauuugcuuuaugaaagu

SEQ ID NO: 869879 - RNA, 18 nt, Human
ugugcagaauccucaggc

SEQ ID NO: 869880 - RNA, 20 nt, Human
uucaaaaaauacaacacaac

SEQ ID NO: 869881 - RNA, 25 nt, Human
uucaggauuaaagaguuaggaagga

SEQ ID NO: 869882 - RNA, 20 nt, Human
uugauagaaaaacgucuuug

SEQ ID NO: 869883 - RNA, 22 nt, Human
uugcccagcagccggccgcggc

SEQ ID NO: 869884 - RNA, 21 nt, Human
aggaggcucgcgggggccagc

SEQ ID NO: 869885 - RNA, 21 nt, Human
ccagcgcacgcgggccuagcc

SEQ ID NO: 869886 - RNA, 22 nt, Human
ccccuuauaaggaagacagaaa

SEQ ID NO: 869887 - RNA, 21 nt, Human
ccgccacagcaaacgccaccu

SEQ ID NO: 869888 - RNA, 18 nt, Human
cgggggccagcgcggagg

SEQ ID NO: 869889 - RNA, 18 nt, Human
gccacagcaaacgccacc

SEQ ID NO: 869890 - RNA, 23 nt, Human
gccagggcaggaggcucgcgggg

SEQ ID NO: 869891 - RNA, 21 nt, Human
uuauauccagacugcauuacu

SEQ ID NO: 869892 - RNA, 18 nt, Human
uuuuuuuuuuuuuuucug

SEQ ID NO: 869893 - RNA, 22 nt, Human
uuuuuuuuuuuuuuucuguguu

SEQ ID NO: 869894 - RNA, 23 nt, Human
uuuuuuuuuuuuuuuuuuucugu

SEQ ID NO: 869895 - RNA, 24 nt, Human
uuuuuuuuuuuuuuuuuuuuucuu

SEQ ID NO: 869896 - RNA, 19 nt, Human
acuugaugcuccaaccucc

SEQ ID NO: 869897 - RNA, 20 nt, Human
agaaggcaacaccaagggga

SEQ ID NO: 869898 - RNA, 22 nt, Human
agaaugccucucauuuaggccu

SEQ ID NO: 869899 - RNA, 22 nt, Human
agacagguucaguaauguccuu

SEQ ID NO: 869900 - RNA, 22 nt, Human
agaugggggagugaaggggccg

SEQ ID NO: 869901 - RNA, 19 nt, Human
agggaaauguguggagaug

SEQ ID NO: 869902 - RNA, 23 nt, Human
agggaaauguguggagaugcaag

SEQ ID NO: 869903 - RNA, 19 nt, Human
agugaaggggccggcugga

SEQ ID NO: 869904 - RNA, 18 nt, Human
aucaauagcccugucccc

SEQ ID NO: 869905 - RNA, 18 nt, Human
augaaggaagccccaccu

SEQ ID NO: 869906 - RNA, 19 nt, Human
caagacagguucaguaaug

SEQ ID NO: 869907 - RNA, 18 nt, Human
ccagaguuucgaggcaca

SEQ ID NO: 869908 - RNA, 18 nt, Human
ccccaacaaaguaugaag

SEQ ID NO: 869909 - RNA, 22 nt, Human
ccggcuggaacuugaugcucca

SEQ ID NO: 869910 - RNA, 23 nt, Human
ccucugagguuccacagaaaagc

SEQ ID NO: 869911 - RNA, 20 nt, Human
ggaccuuaucaauagcccug

SEQ ID NO: 869912 - RNA, 21 nt, Human
uccagaguuucgaggcacagc

SEQ ID NO: 869913 - RNA, 22 nt, Human
uccagggcagccaaccagucag

SEQ ID NO: 869914 - RNA, 22 nt, Human
uggaacuugaugcuccaaccuc

SEQ ID NO: 869915 - RNA, 23 nt, Human
uggaacuugaugcuccaaccucc

SEQ ID NO: 869916 - RNA, 18 nt, Human
uggccucugagguuccac

SEQ ID NO: 869917 - RNA, 23 nt, Human
aaagcggagcccaagccgcgacc

SEQ ID NO: 869918 - RNA, 20 nt, Human
aagccgcgaccaacuugaaa

SEQ ID NO: 869919 - RNA, 21 nt, Human
aagccgcgaccaacuugaaau

SEQ ID NO: 869920 - RNA, 24 nt, Human
aggugauacaaauguggaaggagg

SEQ ID NO: 869921 - RNA, 21 nt, Human
caaagcggagcccaagccgcg

SEQ ID NO: 869922 - RNA, 18 nt, Human
cagacagauuauaugaac

SEQ ID NO: 869923 - RNA, 22 nt, Human
ccccuccccaaagcggagccca

SEQ ID NO: 869924 - RNA, 21 nt, Human
ccuccccaaagcggagcccaa

SEQ ID NO: 869925 - RNA, 28 nt, Human
cuccuuucucccuucauacaauugagaa

SEQ ID NO: 869926 - RNA, 20 nt, Human
cugcugccccuccccaaagc

SEQ ID NO: 869927 - RNA, 24 nt, Human
cugcugccccuccccaaagcggag

SEQ ID NO: 869928 - RNA, 24 nt, Human
gcucccaccccuaauuaucuccac

SEQ ID NO: 869929 - RNA, 20 nt, Human
guuacucucuguauccuaaa

SEQ ID NO: 869930 - RNA, 20 nt, Human
uaaaaguauaaaaccaggcu

SEQ ID NO: 869931 - RNA, 23 nt, Human
uaaaccugcugccccuccccaaa

SEQ ID NO: 869932 - RNA, 21 nt, Human
uaauagguacaguuacucucu

SEQ ID NO: 869933 - RNA, 24 nt, Human
uauaaaaccaggcuuacuccuuca

SEQ ID NO: 869934 - RNA, 22 nt, Human
uauccuaaagaaagacacgagg

SEQ ID NO: 869935 - RNA, 19 nt, Human
uccccaagauagcaaaggu

SEQ ID NO: 869936 - RNA, 24 nt, Human
ucucagcucuaacaaccccaguuc

SEQ ID NO: 869937 - RNA, 26 nt, Human
ugaagaaacaaauaauagguacagcg

SEQ ID NO: 869938 - RNA, 23 nt, Human
ugaauaaaccugcugccccuccc

SEQ ID NO: 869939 - RNA, 21 nt, Human
ugaccaaaugauuugcuuguc

SEQ ID NO: 869940 - RNA, 22 nt, Human
ugaccaaaugauuugcuugucu

SEQ ID NO: 869941 - RNA, 21 nt, Human
ugauacaaauguggaaggagg

SEQ ID NO: 869942 - RNA, 22 nt, Human
ugcucccaccccuaauuaucuc

SEQ ID NO: 869943 - RNA, 19 nt, Human
ugcugccccuccccaaagc

SEQ ID NO: 869944 - RNA, 24 nt, Human
uucaaacugcucccaccccuaauu

SEQ ID NO: 869945 - RNA, 19 nt, Human
uugacagauaaaaacacuu

SEQ ID NO: 869946 - RNA, 18 nt, Human
uuuuuuuuuuuuuuuuug

SEQ ID NO: 869947 - RNA, 22 nt, Human
uuuuuuuuuuuuuuuuugacag

SEQ ID NO: 869948 - RNA, 23 nt, Human
aaacaggaauagaauaaggggac

SEQ ID NO: 869949 - RNA, 23 nt, Human
aaagccagggcaggugguaggug

SEQ ID NO: 869950 - RNA, 19 nt, Human
aaaggaacagccagggagg

SEQ ID NO: 869951 - RNA, 25 nt, Human
aaaggggaaagcugguauuccgucg

SEQ ID NO: 869952 - RNA, 23 nt, Human
aacucuaaauuccucaccauccu

SEQ ID NO: 869953 - RNA, 19 nt, Human
aagcaucagaucugagcca

SEQ ID NO: 869954 - RNA, 19 nt, Human
aagccauggccccucccca

SEQ ID NO: 869955 - RNA, 22 nt, Human
acagcagaacccugaaagaccc

SEQ ID NO: 869956 - RNA, 21 nt, Human
acaggaggcugggacccagaa

SEQ ID NO: 869957 - RNA, 20 nt, Human
acaguucaucucuguaccug

SEQ ID NO: 869958 - RNA, 20 nt, Human
acccuuucucugugaccaaa

SEQ ID NO: 869959 - RNA, 25 nt, Human
agaagccugcacggaagccugaaag

SEQ ID NO: 869960 - RNA, 23 nt, Human
agaagguaaaugcuaaagccaag

SEQ ID NO: 869961 - RNA, 22 nt, Human
agacaggaaaggggucugcugg

SEQ ID NO: 869962 - RNA, 21 nt, Human
agagauuggauguggugggca

SEQ ID NO: 869963 - RNA, 21 nt, Human
agaggaaauauuuucaagcac

SEQ ID NO: 869964 - RNA, 19 nt, Human
agagggaggaaaguagggc

SEQ ID NO: 869965 - RNA, 18 nt, Human
agagugcaucagagaggc

SEQ ID NO: 869966 - RNA, 28 nt, Human
agauggaagagagugcaucagagaggcu

SEQ ID NO: 869967 - RNA, 22 nt, Human
agccccccaaggagggugggga

SEQ ID NO: 869968 - RNA, 20 nt, Human
agcuccucaccccugccccc

SEQ ID NO: 869969 - RNA, 20 nt, Human
aggaaaggggucugcuggau

SEQ ID NO: 869970 - RNA, 18 nt, Human
aggaagaugaacugucag

SEQ ID NO: 869971 - RNA, 19 nt, Human
aggaaggauguuggggcug

SEQ ID NO: 869972 - RNA, 21 nt, Human
aggacaccaugagucucacaa

SEQ ID NO: 869973 - RNA, 20 nt, Human
aggcaagugaugagaccaga

SEQ ID NO: 869974 - RNA, 21 nt, Human
aggcaagugaugagaccagag

SEQ ID NO: 869975 - RNA, 21 nt, Human
aggcagauauaucuccccagg

SEQ ID NO: 869976 - RNA, 22 nt, Human
aggcaggcaagugagcccagag

SEQ ID NO: 869977 - RNA, 23 nt, Human
aggcaggcaagugagcccagagu

SEQ ID NO: 869978 - RNA, 24 nt, Human
aggggaagaaagccagggcaggug

SEQ ID NO: 869979 - RNA, 18 nt, Human
agggguuuuuccaguggc

SEQ ID NO: 869980 - RNA, 20 nt, Human
aguggagaagccugcacgga

SEQ ID NO: 869981 - RNA, 19 nt, Human
auggaccugaauugucugu

SEQ ID NO: 869982 - RNA, 19 nt, Human
caagaaggcaagugaugag

SEQ ID NO: 869983 - RNA, 19 nt, Human
caagccauggccccucccc

SEQ ID NO: 869984 - RNA, 22 nt, Human
caaggugaaagcugaugacagu

SEQ ID NO: 869985 - RNA, 18 nt, Human
caaggugagggaccaagc

SEQ ID NO: 869986 - RNA, 21 nt, Human
cacagacccugcccugccugc

SEQ ID NO: 869987 - RNA, 23 nt, Human
cacagcagaacccugaaagaccc

SEQ ID NO: 869988 - RNA, 23 nt, Human
cacugcaucucuggauacaggag

SEQ ID NO: 869989 - RNA, 18 nt, Human
cacuuggacagaaaucac

SEQ ID NO: 869990 - RNA, 21 nt, Human
cagaaaccacuccuuuuccca

SEQ ID NO: 869991 - RNA, 20 nt, Human
cagaagacagcaaguaccau

SEQ ID NO: 869992 - RNA, 21 nt, Human
cagaagacagcaaguaccauc

SEQ ID NO: 869993 - RNA, 18 nt, Human
cagaaugcaagaaggcaa

SEQ ID NO: 869994 - RNA, 24 nt, Human
cagaaugcaagaaggcaagugaug

SEQ ID NO: 869995 - RNA, 18 nt, Human
cagcuccucaccccugcc

SEQ ID NO: 869996 - RNA, 18 nt, Human
caugccaagccauggccc

SEQ ID NO: 869997 - RNA, 24 nt, Human
ccacagcagaacccugaaagaccc

SEQ ID NO: 869998 - RNA, 20 nt, Human
ccacugcaucucuggauaca

SEQ ID NO: 869999 - RNA, 24 nt, Human
ccacugcaucucuggauacaggag

SEQ ID NO: 870000 - RNA, 26 nt, Human
ccacugcaucucuggauacaggaggc

SEQ ID NO: 870001 - RNA, 21 nt, Human
ccagagaggugagcagggaca

SEQ ID NO: 870002 - RNA, 18 nt, Human
ccagagagugacuugauc

SEQ ID NO: 870003 - RNA, 21 nt, Human
cccacagcagaacccugaaag

SEQ ID NO: 870004 - RNA, 22 nt, Human
cccauggccaccugcccagaga

SEQ ID NO: 870005 - RNA, 30 nt, Human
cccauggccaccugcccagagaacuugucu

SEQ ID NO: 870006 - RNA, 18 nt, Human
cccauggccaccugcccg

SEQ ID NO: 870007 - RNA, 21 nt, Human
ccccauggccaccugcccaga

SEQ ID NO: 870008 - RNA, 19 nt, Human
ccuaagauaguauucagcc

SEQ ID NO: 870009 - RNA, 24 nt, Human
ccuaagauaguauucagccagaaa

SEQ ID NO: 870010 - RNA, 22 nt, Human
ccugacucuccugaucuugccc

SEQ ID NO: 870011 - RNA, 19 nt, Human
ccugccugccccagcgggg

SEQ ID NO: 870012 - RNA, 22 nt, Human
ccuugggaagggcaagacccaa

SEQ ID NO: 870013 - RNA, 22 nt, Human
cgacuucugguccccaccuggc

SEQ ID NO: 870014 - RNA, 20 nt, Human
cucagggaaaggggaaagcu

SEQ ID NO: 870015 - RNA, 19 nt, Human
cuccucaccccugcccccu

SEQ ID NO: 870016 - RNA, 23 nt, Human
cucguucacacuaagaggagacc

SEQ ID NO: 870017 - RNA, 21 nt, Human
cucuuaagcuucacagacccu

SEQ ID NO: 870018 - RNA, 21 nt, Human
cucuuagagugacaaacagcu

SEQ ID NO: 870019 - RNA, 19 nt, Human
cugaucuugccccccacau

SEQ ID NO: 870020 - RNA, 21 nt, Human
cugccacccuccuuggugccc

SEQ ID NO: 870021 - RNA, 21 nt, Human
cugccacccuccuuggugccc

SEQ ID NO: 870022 - RNA, 23 nt, Human
cugcccugccugccccagcgggg

SEQ ID NO: 870023 - RNA, 19 nt, Human
cugugcaugggcaagugga

SEQ ID NO: 870024 - RNA, 25 nt, Human
cugugcccaagaccuggucugcccc

SEQ ID NO: 870025 - RNA, 18 nt, Human
cuugccccccacauccug

SEQ ID NO: 870026 - RNA, 22 nt, Human
gaaaaggagucccuggagcaga

SEQ ID NO: 870027 - RNA, 18 nt, Human
gaaaggaggaaucagagu

SEQ ID NO: 870028 - RNA, 19 nt, Human
gaagguaaaugcuaaagcc

SEQ ID NO: 870029 - RNA, 23 nt, Human
gacagaaaucaccguucaacagc

SEQ ID NO: 870030 - RNA, 19 nt, Human
gacccugcccugccugccc

SEQ ID NO: 870031 - RNA, 19 nt, Human
gaccuggucugccuucuua

SEQ ID NO: 870032 - RNA, 18 nt, Human
gagagauuggauguggug

SEQ ID NO: 870033 - RNA, 21 nt, Human
gagagccacugcaucucugga

SEQ ID NO: 870034 - RNA, 24 nt, Human
gagauggaagagagugcaucagag

SEQ ID NO: 870035 - RNA, 19 nt, Human
gagauuggauguggugggc

SEQ ID NO: 870036 - RNA, 18 nt, Human
gagcaggcucagcuccuc

SEQ ID NO: 870037 - RNA, 21 nt, Human
gagcccacagcagaacccuga

SEQ ID NO: 870038 - RNA, 20 nt, Human
gauguuggggcuggagguca

SEQ ID NO: 870039 - RNA, 22 nt, Human
gcaaacagugccaccuagaagc

SEQ ID NO: 870040 - RNA, 27 nt, Human
gcaauggagagccacugcaucucugga

SEQ ID NO: 870041 - RNA, 19 nt, Human
gccacaucaucaaggugag

SEQ ID NO: 870042 - RNA, 21 nt, Human
gcccccuucccauuaagggcc

SEQ ID NO: 870043 - RNA, 19 nt, Human
gccuuggggaaagagaugg

SEQ ID NO: 870044 - RNA, 19 nt, Human
gcugccaguauccccugcc

SEQ ID NO: 870045 - RNA, 22 nt, Human
ggaaaucugcacuuggacagaa

SEQ ID NO: 870046 - RNA, 25 nt, Human
ggagaagccugcacggaagccugaa

SEQ ID NO: 870047 - RNA, 23 nt, Human
ggagucccuggagcagaaaagug

SEQ ID NO: 870048 - RNA, 19 nt, Human
ggcagguuugcagaagaca

SEQ ID NO: 870049 - RNA, 19 nt, Human
ggccagggcuuggaugcuc

SEQ ID NO: 870050 - RNA, 22 nt, Human
ggcccaggggccugacucuccu

SEQ ID NO: 870051 - RNA, 24 nt, Human
gggaaagcugguauucuuggacgc

SEQ ID NO: 870052 - RNA, 25 nt, Human
gggaaagcugguauucuuggacguc

SEQ ID NO: 870053 - RNA, 21 nt, Human
guaggacaacuagccacagag

SEQ ID NO: 870054 - RNA, 20 nt, Human
guccccucuccuacucccag

SEQ ID NO: 870055 - RNA, 20 nt, Human
gugacaaacagcuucuccca

SEQ ID NO: 870056 - RNA, 21 nt, Human
guugagcacuugcaaggcacu

SEQ ID NO: 870057 - RNA, 20 nt, Human
uaaggcaaacagugccaccc

SEQ ID NO: 870058 - RNA, 25 nt, Human
uagccaaagcuccuuggaggaaguc

SEQ ID NO: 870059 - RNA, 20 nt, Human
uagccccacuucccacuccu

SEQ ID NO: 870060 - RNA, 24 nt, Human
uaggagaaaagggccuggcaaucu

SEQ ID NO: 870061 - RNA, 19 nt, Human
uagggccagcugucagccc

SEQ ID NO: 870062 - RNA, 20 nt, Human
ucaacucuaaauuccucacc

SEQ ID NO: 870063 - RNA, 24 nt, Human
ucacggagccuuggggaaagagau

SEQ ID NO: 870064 - RNA, 23 nt, Human
uccagaguugaggggaagaaagc

SEQ ID NO: 870065 - RNA, 25 nt, Human
ucccauuucuuuaaaaacaggcugc

SEQ ID NO: 870066 - RNA, 18 nt, Human
uccccauggccaccugcc

SEQ ID NO: 870067 - RNA, 20 nt, Human
uccucaccccugcccccuuc

SEQ ID NO: 870068 - RNA, 20 nt, Human
uccugaucuugccccccaca

SEQ ID NO: 870069 - RNA, 20 nt, Human
uccuugcccucaaggagcuu

SEQ ID NO: 870070 - RNA, 22 nt, Human
ucucugugaccaaaagaaagga

SEQ ID NO: 870071 - RNA, 19 nt, Human
ucugagccaagcugagccc

SEQ ID NO: 870072 - RNA, 20 nt, Human
ucugcacuuggacagaaauc

SEQ ID NO: 870073 - RNA, 23 nt, Human
ugaaaggaacagccagggaggua

SEQ ID NO: 870074 - RNA, 21 nt, Human
ugacagucacggagccuuggg

SEQ ID NO: 870075 - RNA, 21 nt, Human
ugacagucacggagccuuggg

SEQ ID NO: 870076 - RNA, 20 nt, Human
ugacuugaucaacuaugcaa

SEQ ID NO: 870077 - RNA, 19 nt, Human
ugagagauuggauguggug

SEQ ID NO: 870078 - RNA, 19 nt, Human
ugagccaagcugagccccc

SEQ ID NO: 870079 - RNA, 22 nt, Human
ugagggcagcagggagccaagg

SEQ ID NO: 870080 - RNA, 19 nt, Human
ugaucuugccccccacauc

SEQ ID NO: 870081 - RNA, 24 nt, Human
ugccacccuccuuggugcccucug

SEQ ID NO: 870082 - RNA, 19 nt, Human
ugccaccuagaagcgaagc

SEQ ID NO: 870083 - RNA, 19 nt, Human
ugcccagaucuaguaagac

SEQ ID NO: 870084 - RNA, 18 nt, Human
ugcccugccugccccagc

SEQ ID NO: 870085 - RNA, 23 nt, Human
ugcccugccugccccagcggggc

SEQ ID NO: 870086 - RNA, 26 nt, Human
ugccuucuuagaaggcagauauaucu

SEQ ID NO: 870087 - RNA, 23 nt, Human
uggauguggugggcagaaagaga

SEQ ID NO: 870088 - RNA, 23 nt, Human
uggcaauggagagccacugcauc

SEQ ID NO: 870089 - RNA, 19 nt, Human
uggggauggggcuccagag

SEQ ID NO: 870090 - RNA, 20 nt, Human
ugugaccaaaagaaaggagg

SEQ ID NO: 870091 - RNA, 22 nt, Human
uuggggaaagagauggaagaga

SEQ ID NO: 870092 - RNA, 25 nt, Human
uuugcagaagacagcaaguaccauc

SEQ ID NO: 870093 - RNA, 24 nt, Human
aaagugcugggauuacagguguga

SEQ ID NO: 870094 - RNA, 19 nt, Human
aaguagcugggacugcagg

SEQ ID NO: 870095 - RNA, 20 nt, Human
aaguagcugggacugcaggu

SEQ ID NO: 870096 - RNA, 18 nt, Human
aagugcugggauuacagg

SEQ ID NO: 870097 - RNA, 19 nt, Human
aagugcugggauuacaggu

SEQ ID NO: 870098 - RNA, 26 nt, Human
aagugcugggauuacaggugugagcc

SEQ ID NO: 870099 - RNA, 22 nt, Human
accuagagaggcaggcuaggga

SEQ ID NO: 870100 - RNA, 24 nt, Human
aggaaaccaaggcacagagaggug

SEQ ID NO: 870101 - RNA, 19 nt, Human
aggcaggcuagggagagcu

SEQ ID NO: 870102 - RNA, 25 nt, Human
aggcuggagugcaguggcgcuaucu

SEQ ID NO: 870103 - RNA, 20 nt, Human
agugcaguggcgcuaucucg

SEQ ID NO: 870104 - RNA, 23 nt, Human
agugcaguggcgcuaucucggcu

SEQ ID NO: 870105 - RNA, 24 nt, Human
agugcaguggcgcuaucucggcuc

SEQ ID NO: 870106 - RNA, 24 nt, Human
aucuugugauccaccugccucggc

SEQ ID NO: 870107 - RNA, 18 nt, Human
augggguuucaccauguu

SEQ ID NO: 870108 - RNA, 19 nt, Human
augggguuucaccauguua

SEQ ID NO: 870109 - RNA, 20 nt, Human
augggguuucaccauguuag

SEQ ID NO: 870110 - RNA, 24 nt, Human
augggguuucaccauguuagccag

SEQ ID NO: 870111 - RNA, 21 nt, Human
auucuccugccucagccuccc

SEQ ID NO: 870112 - RNA, 24 nt, Human
caaagugcugggauuacaggugug

SEQ ID NO: 870113 - RNA, 18 nt, Human
caccauguuagccaggau

SEQ ID NO: 870114 - RNA, 22 nt, Human
caccauguuagccaggaugguc

SEQ ID NO: 870115 - RNA, 24 nt, Human
caccauguuagccaggauggucuc

SEQ ID NO: 870116 - RNA, 23 nt, Human
caccugccucggccucccaaagu

SEQ ID NO: 870117 - RNA, 22 nt, Human
cacgccauucuccugccucagc

SEQ ID NO: 870118 - RNA, 19 nt, Human
cagcagccaagcccagcgc

SEQ ID NO: 870119 - RNA, 22 nt, Human
cagccuggcucuaggugcuggg

SEQ ID NO: 870120 - RNA, 21 nt, Human
caggggcuggacggucagcuu

SEQ ID NO: 870121 - RNA, 21 nt, Human
caggugcccaccaccacaccc

SEQ ID NO: 870122 - RNA, 21 nt, Human
caggugcccaccaccacaccc

SEQ ID NO: 870123 - RNA, 22 nt, Human
caggugcccaccaccacacccg

SEQ ID NO: 870124 - RNA, 24 nt, Human
caggugcccaccaccacacccggc

SEQ ID NO: 870125 - RNA, 21 nt, Human
ccaaagugcugggauuacagg

SEQ ID NO: 870126 - RNA, 21 nt, Human
ccaaagugcugggauuacagg

SEQ ID NO: 870127 - RNA, 24 nt, Human
ccaaagugcugggauuacaggugu

SEQ ID NO: 870128 - RNA, 19 nt, Human
ccaagcccagcgcaacuca

SEQ ID NO: 870129 - RNA, 22 nt, Human
cccaaguagcugggacugcagg

SEQ ID NO: 870130 - RNA, 23 nt, Human
cccaaguagcugggacugcaggu

SEQ ID NO: 870131 - RNA, 24 nt, Human
ccucccaguuucacgccauucucc

SEQ ID NO: 870132 - RNA, 19 nt, Human
ccugaucuugugauccacc

SEQ ID NO: 870133 - RNA, 23 nt, Human
ccugccucagccucccaaguagc

SEQ ID NO: 870134 - RNA, 24 nt, Human
ccugccucggccucccaaagugcu

SEQ ID NO: 870135 - RNA, 24 nt, Human
cgcucuguugcccaggcuggagug

SEQ ID NO: 870136 - RNA, 24 nt, Human
cggagucucgcucuguugcccagg

SEQ ID NO: 870137 - RNA, 23 nt, Human
cuaauuuuuuguauuuuuaguag

SEQ ID NO: 870138 - RNA, 24 nt, Human
cucagccucccaaguagcugggac

SEQ ID NO: 870139 - RNA, 22 nt, Human
cucccaguuucacgccauucuc

SEQ ID NO: 870140 - RNA, 24 nt, Human
cuccugaucuugugauccaccugc

SEQ ID NO: 870141 - RNA, 21 nt, Human
cucgcucuguugcccaggcug

SEQ ID NO: 870142 - RNA, 24 nt, Human
cucgcucuguugcccaggcuggag

SEQ ID NO: 870143 - RNA, 21 nt, Human
cucuaggugcugggcucuaga

SEQ ID NO: 870144 - RNA, 23 nt, Human
cugccucagccucccaaguagcu

SEQ ID NO: 870145 - RNA, 19 nt, Human
cuugugauccaccugccuc

SEQ ID NO: 870146 - RNA, 18 nt, Human
gaaaaaccuagagaggca

SEQ ID NO: 870147 - RNA, 18 nt, Human
gagaugggguuucaccau

SEQ ID NO: 870148 - RNA, 24 nt, Human
gagaugggguuucaccauguuagc

SEQ ID NO: 870149 - RNA, 22 nt, Human
gaucuugugauccaccugccuc

SEQ ID NO: 870150 - RNA, 24 nt, Human
gaucuugugauccaccugccucgg

SEQ ID NO: 870151 - RNA, 18 nt, Human
gauuacaggugugagcca

SEQ ID NO: 870152 - RNA, 19 nt, Human
gauuacaggugugagccac

SEQ ID NO: 870153 - RNA, 22 nt, Human
gauuacaggugugagccacugc

SEQ ID NO: 870154 - RNA, 18 nt, Human
gcaagcucugccucccag

SEQ ID NO: 870155 - RNA, 19 nt, Human
gcccaggcuggagugcagu

SEQ ID NO: 870156 - RNA, 23 nt, Human
gcgcaacucagagggagcuaggg

SEQ ID NO: 870157 - RNA, 25 nt, Human
gcucuguugcccaggcuggagugca

SEQ ID NO: 870158 - RNA, 21 nt, Human
gcuggagugcaguggcgcuag

SEQ ID NO: 870159 - RNA, 23 nt, Human
ggagucucgcucuguugcccagg

SEQ ID NO: 870160 - RNA, 21 nt, Human
gggcagccuggcucuaggugc

SEQ ID NO: 870161 - RNA, 22 nt, Human
gggguuucaccauguuagccag

SEQ ID NO: 870162 - RNA, 24 nt, Human
gguuucaccauguuagccaggaug

SEQ ID NO: 870163 - RNA, 23 nt, Human
guagagaugggguuucaccaugu

SEQ ID NO: 870164 - RNA, 24 nt, Human
gugauccaccugccucggccuccc

SEQ ID NO: 870165 - RNA, 21 nt, Human
gugcagcagccaagcccagcg

SEQ ID NO: 870166 - RNA, 24 nt, Human
uaauuuuuuguauuuuuaguagag

SEQ ID NO: 870167 - RNA, 25 nt, Human
uaauuuuuuguauuuuuaguagaga

SEQ ID NO: 870168 - RNA, 19 nt, Human
uacaggugugagccacugc

SEQ ID NO: 870169 - RNA, 23 nt, Human
uacaggugugagccacugcgccc

SEQ ID NO: 870170 - RNA, 22 nt, Human
uagagaugggguuucaccaugu

SEQ ID NO: 870171 - RNA, 24 nt, Human
uaguagagaugggguuucaccaug

SEQ ID NO: 870172 - RNA, 26 nt, Human
uaguagagaugggguuucaccauguu

SEQ ID NO: 870173 - RNA, 23 nt, Human
uauuuauuuuugagacggagucu

SEQ ID NO: 870174 - RNA, 24 nt, Human
ucaccauguuagccaggauggucu

SEQ ID NO: 870175 - RNA, 18 nt, Human
ucacugcaagcucugccu

SEQ ID NO: 870176 - RNA, 18 nt, Human
ucacugcaagcucugccu

SEQ ID NO: 870177 - RNA, 19 nt, Human
ucacugcaagcucugccuc

SEQ ID NO: 870178 - RNA, 23 nt, Human
ucacugcaagcucugccucccag

SEQ ID NO: 870179 - RNA, 20 nt, Human
ucagccucccaaguagcugg

SEQ ID NO: 870180 - RNA, 23 nt, Human
ucccaaagugcugggauuacagg

SEQ ID NO: 870181 - RNA, 23 nt, Human
ucccaaguagcugggacugcagg

SEQ ID NO: 870182 - RNA, 24 nt, Human
ucccaguuucacgccauucuccug

SEQ ID NO: 870183 - RNA, 24 nt, Human
ucgcucuguugcccaggcuggagu

SEQ ID NO: 870184 - RNA, 18 nt, Human
ucggccucccaaagugcu

SEQ ID NO: 870185 - RNA, 26 nt, Human
ucuccugccucagccucccaaguagc

SEQ ID NO: 870186 - RNA, 19 nt, Human
ucucgcucuguugcccagg

SEQ ID NO: 870187 - RNA, 22 nt, Human
ucucgcucuguugcccaggcug

SEQ ID NO: 870188 - RNA, 23 nt, Human
ucucgcucuguugcccaggcugg

SEQ ID NO: 870189 - RNA, 24 nt, Human
ucucgcucuguugcccaggcugga

SEQ ID NO: 870190 - RNA, 26 nt, Human
ucucgcucuguugcccaggcuggagu

SEQ ID NO: 870191 - RNA, 27 nt, Human
ucucgcucuguugcccaggcuggagug

SEQ ID NO: 870192 - RNA, 23 nt, Human
ucugggcagccuggcucuaggug

SEQ ID NO: 870193 - RNA, 18 nt, Human
ucuguugcccaggcugga

SEQ ID NO: 870194 - RNA, 24 nt, Human
ucuguugcccaggcuggagugcag

SEQ ID NO: 870195 - RNA, 22 nt, Human
ugagacggagucucgcucuguu

SEQ ID NO: 870196 - RNA, 21 nt, Human
ugagcucccugcacuaggaac

SEQ ID NO: 870197 - RNA, 22 nt, Human
ugcaguggcgcuaucucggcuc

SEQ ID NO: 870198 - RNA, 19 nt, Human
ugcccaccaccacacccgg

SEQ ID NO: 870199 - RNA, 18 nt, Human
ugcccaggcuggagugca

SEQ ID NO: 870200 - RNA, 21 nt, Human
ugcccaggcuggagugcagug

SEQ ID NO: 870201 - RNA, 22 nt, Human
ugcccaggcuggagugcagugg

SEQ ID NO: 870202 - RNA, 24 nt, Human
ugcccaggcuggagugcaguggcg

SEQ ID NO: 870203 - RNA, 24 nt, Human
ugccucagccucccaaguagcugg

SEQ ID NO: 870204 - RNA, 21 nt, Human
ugccucggccucccaaagugc

SEQ ID NO: 870205 - RNA, 24 nt, Human
ugccucggccucccaaagugcugg

SEQ ID NO: 870206 - RNA, 24 nt, Human
ugcugggauuacaggugugagcca

SEQ ID NO: 870207 - RNA, 28 nt, Human
uggagugcaguggcgcuauccuagcacg

SEQ ID NO: 870208 - RNA, 23 nt, Human
uggagugcaguggcgcuaucucg

SEQ ID NO: 870209 - RNA, 24 nt, Human
uggagugcaguggcgcuaucucgg

SEQ ID NO: 870210 - RNA, 23 nt, Human
uggcucuaggugcugggcucuag

SEQ ID NO: 870211 - RNA, 21 nt, Human
ugggacugcaggugcccacca

SEQ ID NO: 870212 - RNA, 18 nt, Human
ugggauuacaggugugag

SEQ ID NO: 870213 - RNA, 19 nt, Human
ugggauuacaggugugagc

SEQ ID NO: 870214 - RNA, 21 nt, Human
ugggauuacaggugugagcca

SEQ ID NO: 870215 - RNA, 22 nt, Human
ugggauuacaggugugagccac

SEQ ID NO: 870216 - RNA, 22 nt, Human
ugggauuacaggugugagccac

SEQ ID NO: 870217 - RNA, 24 nt, Human
ugggauuacaggugugagccacug

SEQ ID NO: 870218 - RNA, 24 nt, Human
ugggguuucaccauguuagccagg

SEQ ID NO: 870219 - RNA, 18 nt, Human
uggucaggggcuggacgg

SEQ ID NO: 870220 - RNA, 19 nt, Human
uggucaggggcuggacggu

SEQ ID NO: 870221 - RNA, 18 nt, Human
uuaguagagaugggguuu

SEQ ID NO: 870222 - RNA, 22 nt, Human
uuaguagagaugggguuucacc

SEQ ID NO: 870223 - RNA, 24 nt, Human
uuaguagagaugggguuucaccau

SEQ ID NO: 870224 - RNA, 24 nt, Human
uugcccaggcuggagugcaguggc

SEQ ID NO: 870225 - RNA, 23 nt, Human
uuguauuuuuaguagagaugggg

SEQ ID NO: 870226 - RNA, 19 nt, Human
uuucaccauguuagccagg

SEQ ID NO: 870227 - RNA, 20 nt, Human
uuucaccauguuagccagga

SEQ ID NO: 870228 - RNA, 24 nt, Human
uuuuuaguagagaugggguuucac

SEQ ID NO: 870229 - RNA, 21 nt, Human
uuuuuguauuuuuaguagaga

SEQ ID NO: 870230 - RNA, 24 nt, Human
uuuuuuguauuuuuaguagagaug

SEQ ID NO: 870231 - RNA, 23 nt, Human
aaagauggguaguaaggcuugag

SEQ ID NO: 870232 - RNA, 19 nt, Human
aacugacuuccccucuucc

SEQ ID NO: 870233 - RNA, 20 nt, Human
aagugagaacaugggauauu

SEQ ID NO: 870234 - RNA, 25 nt, Human
aauacccauucugauaauacccauu

SEQ ID NO: 870235 - RNA, 18 nt, Human
aauuucuucuugguucaa

SEQ ID NO: 870236 - RNA, 23 nt, Human
aauuuuggaacucauuauugguc

SEQ ID NO: 870237 - RNA, 22 nt, Human
acauuugcaaaauuucuuugca

SEQ ID NO: 870238 - RNA, 21 nt, Human
accaaauuuucuuuaucuggu

SEQ ID NO: 870239 - RNA, 18 nt, Human
acuucauugcuugucagu

SEQ ID NO: 870240 - RNA, 18 nt, Human
acuuccccucuuccuauu

SEQ ID NO: 870241 - RNA, 20 nt, Human
agaaaucuuucacuuaccuu

SEQ ID NO: 870242 - RNA, 20 nt, Human
agaauggcauuuccuggguu

SEQ ID NO: 870243 - RNA, 21 nt, Human
aguuugguguacaguuaauuu

SEQ ID NO: 870244 - RNA, 23 nt, Human
aucauggucaugugguuuuuguu

SEQ ID NO: 870245 - RNA, 19 nt, Human
augcaauuucuucuugguu

SEQ ID NO: 870246 - RNA, 21 nt, Human
augcuggguugaaugcuaugu

SEQ ID NO: 870247 - RNA, 21 nt, Human
auggcauuuccuggguuuuuc

SEQ ID NO: 870248 - RNA, 21 nt, Human
auggcugcauaguauuccaug

SEQ ID NO: 870249 - RNA, 18 nt, Human
cacauguauguauucuuu

SEQ ID NO: 870250 - RNA, 21 nt, Human
cagccugaaguuuucuuuuuu

SEQ ID NO: 870251 - RNA, 21 nt, Human
ccaaccuccacccauaagccc

SEQ ID NO: 870252 - RNA, 18 nt, Human
cccacuuauaagugagaa

SEQ ID NO: 870253 - RNA, 20 nt, Human
cucaaggggaaugcuuccau

SEQ ID NO: 870254 - RNA, 20 nt, Human
cucauuauuggucuguucag

SEQ ID NO: 870255 - RNA, 22 nt, Human
cugguuccaaauaaauuucaga

SEQ ID NO: 870256 - RNA, 20 nt, Human
cuugguucaaucuugggggg

SEQ ID NO: 870257 - RNA, 21 nt, Human
gaucauggucaugugguuuuu

SEQ ID NO: 870258 - RNA, 21 nt, Human
gauucuggauuagaucuuugu

SEQ ID NO: 870259 - RNA, 24 nt, Human
gcccaguuuuuaaugggguuguuu

SEQ ID NO: 870260 - RNA, 22 nt, Human
gcugcagugcuuuccacaaugg

SEQ ID NO: 870261 - RNA, 20 nt, Human
ggcuucaacuauaaaucugu

SEQ ID NO: 870262 - RNA, 19 nt, Human
gggcagagacaacagguuu

SEQ ID NO: 870263 - RNA, 18 nt, Human
guaucucauuguggcuuu

SEQ ID NO: 870264 - RNA, 20 nt, Human
guccagaguuuuguuugaua

SEQ ID NO: 870265 - RNA, 21 nt, Human
guuuuaguugcuguagccuug

SEQ ID NO: 870266 - RNA, 20 nt, Human
uagaaaucuuucacuuaccu

SEQ ID NO: 870267 - RNA, 23 nt, Human
uagcaucuauguuuugauuuuuu

SEQ ID NO: 870268 - RNA, 29 nt, Human
uaggagccuuugggcagagacaacagguu

SEQ ID NO: 870269 - RNA, 24 nt, Human
uaggauaagagccucagcuccauc

SEQ ID NO: 870270 - RNA, 22 nt, Human
uaggucccacuugucaauuuuu

SEQ ID NO: 870271 - RNA, 20 nt, Human
uaguuugugugcauacaggu

SEQ ID NO: 870272 - RNA, 24 nt, Human
uauaaguauuugcuuuucucugca

SEQ ID NO: 870273 - RNA, 21 nt, Human
uaucagaucuaggagccuuug

SEQ ID NO: 870274 - RNA, 24 nt, Human
uauugagaauagugcugcaaugaa

SEQ ID NO: 870275 - RNA, 24 nt, Human
ucaaggggaaugcuuccagcuuuu

SEQ ID NO: 870276 - RNA, 19 nt, Human
ucacuuaggauaagagccu

SEQ ID NO: 870277 - RNA, 20 nt, Human
ucagaugcaguuuguaaaca

SEQ ID NO: 870278 - RNA, 24 nt, Human
uccacaauggcugaauuaauuuac

SEQ ID NO: 870279 - RNA, 26 nt, Human
uccagaguuuuguuugauagauuuuu

SEQ ID NO: 870280 - RNA, 22 nt, Human
ucccaaccuccacccauaagcc

SEQ ID NO: 870281 - RNA, 22 nt, Human
ucucuaaugaguuauuagaaaa

SEQ ID NO: 870282 - RNA, 22 nt, Human
ucucuucugggcuuuuucauca

SEQ ID NO: 870283 - RNA, 21 nt, Human
ucugauaauacccauucagac

SEQ ID NO: 870284 - RNA, 19 nt, Human
ucuucccaaccuccacccu

SEQ ID NO: 870285 - RNA, 22 nt, Human
ucuuugcuauugagaauagugc

SEQ ID NO: 870286 - RNA, 21 nt, Human
ucuuuuuuuauaccaguacca

SEQ ID NO: 870287 - RNA, 19 nt, Human
ugacuccuuugcuuuccuc

SEQ ID NO: 870288 - RNA, 24 nt, Human
ugagaugguaucucauuguggcuu

SEQ ID NO: 870289 - RNA, 20 nt, Human
ugauuugguucauagcuugg

SEQ ID NO: 870290 - RNA, 22 nt, Human
ugcuuuccucuuccuucucuuc

SEQ ID NO: 870291 - RNA, 19 nt, Human
ugcuuuucucugcagccuc

SEQ ID NO: 870292 - RNA, 18 nt, Human
ugggucaacugcauguug

SEQ ID NO: 870293 - RNA, 23 nt, Human
uguaaacauuuucucccauucug

SEQ ID NO: 870294 - RNA, 18 nt, Human
uguaaucaauguuuagcu

SEQ ID NO: 870295 - RNA, 23 nt, Human
ugugcagauggauuugguuuacu

SEQ ID NO: 870296 - RNA, 21 nt, Human
ugugugcauacagguguuuau

SEQ ID NO: 870297 - RNA, 23 nt, Human
uguugaauuuuauuaaaaaccuu

SEQ ID NO: 870298 - RNA, 18 nt, Human
uguugaggaucacauggu

SEQ ID NO: 870299 - RNA, 24 nt, Human
uuauaagugagaacaugggauauu

SEQ ID NO: 870300 - RNA, 25 nt, Human
uucuguagucugcaaauagcuucuu

SEQ ID NO: 870301 - RNA, 23 nt, Human
uucuugguucaaucuuggggggu

SEQ ID NO: 870302 - RNA, 23 nt, Human
uugcccaguuuuuaaugggguug

SEQ ID NO: 870303 - RNA, 24 nt, Human
uugcuuuccucuuccuucucuucu

SEQ ID NO: 870304 - RNA, 23 nt, Human
uuguaguaugguuuaaaguuggg

SEQ ID NO: 870305 - RNA, 18 nt, Human
uuuaacaauacugauucu

SEQ ID NO: 870306 - RNA, 24 nt, Human
uuuccacaauggcugaauuaauuu

SEQ ID NO: 870307 - RNA, 23 nt, Human
uuugaagacuuuuccacacauuu

SEQ ID NO: 870308 - RNA, 20 nt, Human
uuugcaaaauuucuuugcag

SEQ ID NO: 870309 - RNA, 25 nt, Human
uuugcaaaauuucuuugcaguaugg

SEQ ID NO: 870310 - RNA, 20 nt, Human
uuugguauuagaaugaugcu

SEQ ID NO: 870311 - RNA, 19 nt, Human
uuuguaaacauuuucuccc

SEQ ID NO: 870312 - RNA, 18 nt, Human
uuuguugcauuuguaguu

SEQ ID NO: 870313 - RNA, 20 nt, Human
uuuugcuuuuuuucauguuu

SEQ ID NO: 870314 - RNA, 23 nt, Human
uuuuuguuuuuguugcaauugcu

SEQ ID NO: 870315 - RNA, 18 nt, Human
agaguccuuccagaaccu

SEQ ID NO: 870316 - RNA, 19 nt, Human
aggcaccacaacgccgagc

SEQ ID NO: 870317 - RNA, 21 nt, Human
agggcacacaagugucaaggg

SEQ ID NO: 870318 - RNA, 25 nt, Human
agggcugugaggaagauggccagua

SEQ ID NO: 870319 - RNA, 19 nt, Human
cagaaucaacccacacuaa

SEQ ID NO: 870320 - RNA, 21 nt, Human
cagaguccuuccagaaccucc

SEQ ID NO: 870321 - RNA, 20 nt, Human
cagcuguaaucaacucagca

SEQ ID NO: 870322 - RNA, 23 nt, Human
ccacaacgccgagccacgguaag

SEQ ID NO: 870323 - RNA, 23 nt, Human
ccagaguccuuccagaaccuccu

SEQ ID NO: 870324 - RNA, 19 nt, Human
ccuacucaggugcuuggca

SEQ ID NO: 870325 - RNA, 21 nt, Human
ccucaggcaccacaacgccga

SEQ ID NO: 870326 - RNA, 21 nt, Human
cuccgcacuuccgagguugcc

SEQ ID NO: 870327 - RNA, 20 nt, Human
cuuaaaggacagaaaauguc

SEQ ID NO: 870328 - RNA, 18 nt, Human
gaaccuccugauucgcgc

SEQ ID NO: 870329 - RNA, 21 nt, Human
uacucaggugcuuggcagagc

SEQ ID NO: 870330 - RNA, 20 nt, Human
uacuguauuggcccagcugu

SEQ ID NO: 870331 - RNA, 19 nt, Human
ucccagggcacacaagugu

SEQ ID NO: 870332 - RNA, 24 nt, Human
ucguugcuuuaaauuguugcuuug

SEQ ID NO: 870333 - RNA, 21 nt, Human
ugagggcugugaggaagaugg

SEQ ID NO: 870334 - RNA, 23 nt, Human
uggcccagcuguaaucaacucag

SEQ ID NO: 870335 - RNA, 22 nt, Human
uggccggcugucccucaggcac

SEQ ID NO: 870336 - RNA, 22 nt, Human
uggucuuauuugugcccguuga

SEQ ID NO: 870337 - RNA, 21 nt, Human
ugucaagggccuacucaggug

SEQ ID NO: 870338 - RNA, 19 nt, Human
uuccagaaucaacccacac

SEQ ID NO: 870339 - RNA, 22 nt, Human
uuccagaaucaacccacacuaa

SEQ ID NO: 870340 - RNA, 24 nt, Human
uugcuuuaaauuguugcuuuguuc

SEQ ID NO: 870341 - RNA, 20 nt, Human
uuggucuuauuugugcccgu

SEQ ID NO: 870342 - RNA, 18 nt, Human
uuuuuuuuuuuuaagggc

SEQ ID NO: 870343 - RNA, 19 nt, Human
uuuuuuuuuuuuaagggcu

SEQ ID NO: 870344 - RNA, 24 nt, Human
uuuuuuuuuuuuuuuuuuuaaggg

SEQ ID NO: 870345 - RNA, 21 nt, Human
aaaaaaaccaaagcccaagga

SEQ ID NO: 870346 - RNA, 20 nt, Human
aaagcagccaggcaggcgug

SEQ ID NO: 870347 - RNA, 25 nt, Human
aaaguaacgaagaaaaacuuaaaua

SEQ ID NO: 870348 - RNA, 22 nt, Human
aaccacauaccccaauuuaaca

SEQ ID NO: 870349 - RNA, 26 nt, Human
aaccacauaccccaauuuaacaccuu

SEQ ID NO: 870350 - RNA, 24 nt, Human
aagaaacucauuuauagcacaggc

SEQ ID NO: 870351 - RNA, 23 nt, Human
aagagaggaaggaaacagcagga

SEQ ID NO: 870352 - RNA, 19 nt, Human
aagcagcccuaggaagccc

SEQ ID NO: 870353 - RNA, 23 nt, Human
aagcagcccuaggaagcccaggu

SEQ ID NO: 870354 - RNA, 19 nt, Human
aagcaguuagugaauacua

SEQ ID NO: 870355 - RNA, 21 nt, Human
aagucggcaguuauuuaaaau

SEQ ID NO: 870356 - RNA, 19 nt, Human
aauuuauuacaaaacuuuu

SEQ ID NO: 870357 - RNA, 19 nt, Human
acaugcugccaagucuggc

SEQ ID NO: 870358 - RNA, 18 nt, Human
accuggauccuagggcuc

SEQ ID NO: 870359 - RNA, 23 nt, Human
agagaggaaggaaacagcaggag

SEQ ID NO: 870360 - RNA, 21 nt, Human
agaggaaggaaacagcaggag

SEQ ID NO: 870361 - RNA, 18 nt, Human
agaggaccuggauccuag

SEQ ID NO: 870362 - RNA, 20 nt, Human
agaggagagggagugcagag

SEQ ID NO: 870363 - RNA, 19 nt, Human
agaugauuacagaucucug

SEQ ID NO: 870364 - RNA, 22 nt, Human
agcugcugcugcccaccaaagc

SEQ ID NO: 870365 - RNA, 18 nt, Human
aggaaggaaacagcagga

SEQ ID NO: 870366 - RNA, 21 nt, Human
aggaaggaaacagcaggagaa

SEQ ID NO: 870367 - RNA, 24 nt, Human
aggaagugggcugacgacuggaga

SEQ ID NO: 870368 - RNA, 21 nt, Human
aggcgugggcauuguacaacc

SEQ ID NO: 870369 - RNA, 21 nt, Human
caaaacgguuucugaauauga

SEQ ID NO: 870370 - RNA, 21 nt, Human
caaagaaucauuuaagacauc

SEQ ID NO: 870371 - RNA, 18 nt, Human
cacaugaagcagcaaagu

SEQ ID NO: 870372 - RNA, 20 nt, Human
cagaaaagguacacaaagaa

SEQ ID NO: 870373 - RNA, 23 nt, Human
cagaucucugguuucagaaguuc

SEQ ID NO: 870374 - RNA, 19 nt, Human
cagcaaaguaacgaagaaa

SEQ ID NO: 870375 - RNA, 22 nt, Human
cagcaaaguaacgaagaaaaac

SEQ ID NO: 870376 - RNA, 26 nt, Human
cagcaaaguaacgaagaaaaacuuaa

SEQ ID NO: 870377 - RNA, 20 nt, Human
cagcacacggcaaggcugag

SEQ ID NO: 870378 - RNA, 21 nt, Human
cagccccagcuucgaaaaucc

SEQ ID NO: 870379 - RNA, 25 nt, Human
cagcggccucuugccagccccagcu

SEQ ID NO: 870380 - RNA, 18 nt, Human
cagcugccaaugggcuga

SEQ ID NO: 870381 - RNA, 22 nt, Human
cauuguacaaccagccucaggc

SEQ ID NO: 870382 - RNA, 20 nt, Human
cauuuaagacauccugguua

SEQ ID NO: 870383 - RNA, 24 nt, Human
ccaaauacuuaauugcuaaaggaa

SEQ ID NO: 870384 - RNA, 22 nt, Human
ccaagagaggaaggaaacagca

SEQ ID NO: 870385 - RNA, 22 nt, Human
ccagcggccucuugccagcccc

SEQ ID NO: 870386 - RNA, 19 nt, Human
ccagugugucugcugguga

SEQ ID NO: 870387 - RNA, 30 nt, Human
cccaggugcccacaucgaaagcacucccaa

SEQ ID NO: 870388 - RNA, 20 nt, Human
ccccagcuucgaaaauccgc

SEQ ID NO: 870389 - RNA, 24 nt, Human
cccuuauucagcuaccaaauacuu

SEQ ID NO: 870390 - RNA, 19 nt, Human
ccggcucgcugccgccgcc

SEQ ID NO: 870391 - RNA, 19 nt, Human
ccguacccacucaguccaa

SEQ ID NO: 870392 - RNA, 21 nt, Human
cuaaacccagauaagucaucu

SEQ ID NO: 870393 - RNA, 19 nt, Human
cugccgccgccucgcgcug

SEQ ID NO: 870394 - RNA, 20 nt, Human
cugccgccgccucgcgcugu

SEQ ID NO: 870395 - RNA, 19 nt, Human
cuugggcuggcuguguuuu

SEQ ID NO: 870396 - RNA, 18 nt, Human
cuuugagggguccaugcc

SEQ ID NO: 870397 - RNA, 18 nt, Human
gaaagcagccaggcaggc

SEQ ID NO: 870398 - RNA, 23 nt, Human
gaagcagcccuaggaagcccagg

SEQ ID NO: 870399 - RNA, 24 nt, Human
gagcgugucugcguugucagccaa

SEQ ID NO: 870400 - RNA, 18 nt, Human
gcaaaguaacgaagaaaa

SEQ ID NO: 870401 - RNA, 18 nt, Human
gcugccaagucuggcccc

SEQ ID NO: 870402 - RNA, 25 nt, Human
ggaaacagcaggagaagcugucagc

SEQ ID NO: 870403 - RNA, 18 nt, Human
ggaaaguacacaugaagc

SEQ ID NO: 870404 - RNA, 18 nt, Human
ggcauuguacaaccagcc

SEQ ID NO: 870405 - RNA, 23 nt, Human
ggccccugaagaggagagggagu

SEQ ID NO: 870406 - RNA, 19 nt, Human
gggcgucaccaugaaggag

SEQ ID NO: 870407 - RNA, 22 nt, Human
gguaggaaaguacacaugaagc

SEQ ID NO: 870408 - RNA, 19 nt, Human
gugcuuucuccacccucuc

SEQ ID NO: 870409 - RNA, 21 nt, Human
gugcuuucuccacccucuccu

SEQ ID NO: 870410 - RNA, 24 nt, Human
uaagugugaagcccaguauauguc

SEQ ID NO: 870411 - RNA, 26 nt, Human
uaauugcuaaaggaauuacucccagc

SEQ ID NO: 870412 - RNA, 20 nt, Human
uacaaccagccucaggccuc

SEQ ID NO: 870413 - RNA, 23 nt, Human
uacacaugaagcagcaaaguaac

SEQ ID NO: 870414 - RNA, 27 nt, Human
uacuagaaaaaaaccaaagcccaagga

SEQ ID NO: 870415 - RNA, 21 nt, Human
uacuggcaagaagagaugugg

SEQ ID NO: 870416 - RNA, 18 nt, Human
uagaaaaaaaccaaagcc

SEQ ID NO: 870417 - RNA, 20 nt, Human
uagaaaaaaaccaaagccca

SEQ ID NO: 870418 - RNA, 22 nt, Human
uagaaaaaaaccaaagcccaag

SEQ ID NO: 870419 - RNA, 22 nt, Human
uagcacaggcaccccaggccaa

SEQ ID NO: 870420 - RNA, 23 nt, Human
uaggaagacuaaagcuauggaca

SEQ ID NO: 870421 - RNA, 19 nt, Human
uaguauaaagcuuccaacc

SEQ ID NO: 870422 - RNA, 26 nt, Human
uagugaauacuauugaauccuaaacc

SEQ ID NO: 870423 - RNA, 20 nt, Human
uauagcacaggcaccccagg

SEQ ID NO: 870424 - RNA, 20 nt, Human
uauuacaaauuugguuuucc

SEQ ID NO: 870425 - RNA, 18 nt, Human
ucaaaccacauaccccaa

SEQ ID NO: 870426 - RNA, 19 nt, Human
ucacgcaggugucgggcgg

SEQ ID NO: 870427 - RNA, 21 nt, Human
ucagaaaacuuccucuugggg

SEQ ID NO: 870428 - RNA, 21 nt, Human
ucagcuugccauucaugagcu

SEQ ID NO: 870429 - RNA, 21 nt, Human
ucauuuaagacauccugguua

SEQ ID NO: 870430 - RNA, 18 nt, Human
uccaagagaggaaggaaa

SEQ ID NO: 870431 - RNA, 23 nt, Human
uccaugcccagugugucugcugg

SEQ ID NO: 870432 - RNA, 19 nt, Human
uccgaaagcauccuuuaag

SEQ ID NO: 870433 - RNA, 18 nt, Human
ucgcugccgccgccucgc

SEQ ID NO: 870434 - RNA, 20 nt, Human
ucgcugccgccgccucgcgc

SEQ ID NO: 870435 - RNA, 18 nt, Human
ucuuucguuuuaagaaca

SEQ ID NO: 870436 - RNA, 18 nt, Human
ugaaagaaccacucagaa

SEQ ID NO: 870437 - RNA, 21 nt, Human
ugaaagaaccacucagaagca

SEQ ID NO: 870438 - RNA, 25 nt, Human
ugaaagaaccacucagaagcagccc

SEQ ID NO: 870439 - RNA, 21 nt, Human
ugaagcagcaaaguaacgaag

SEQ ID NO: 870440 - RNA, 23 nt, Human
ugaagcagcaaaguaacgaagaa

SEQ ID NO: 870441 - RNA, 19 nt, Human
ugaaggagcccauuuagua

SEQ ID NO: 870442 - RNA, 18 nt, Human
ugacacaaaauacugaga

SEQ ID NO: 870443 - RNA, 18 nt, Human
ugacacaaaauacugaga

SEQ ID NO: 870444 - RNA, 18 nt, Human
ugacccaggacucagcag

SEQ ID NO: 870445 - RNA, 21 nt, Human
ugacggggcgucaccaugaag

SEQ ID NO: 870446 - RNA, 21 nt, Human
ugaugagaagcagcacacggc

SEQ ID NO: 870447 - RNA, 26 nt, Human
ugccaaugggcugaguggcuggccgu

SEQ ID NO: 870448 - RNA, 19 nt, Human
ugcuaaaggaauuacuccc

SEQ ID NO: 870449 - RNA, 24 nt, Human
ugcuuucuccacccucuccuccca

SEQ ID NO: 870450 - RNA, 22 nt, Human
ugggcuggcuguguuuuucaug

SEQ ID NO: 870451 - RNA, 23 nt, Human
ugggugugccugcuuugaggggu

SEQ ID NO: 870452 - RNA, 21 nt, Human
ugguggugguggcaaagcaug

SEQ ID NO: 870453 - RNA, 23 nt, Human
ugugaagaaacucauuuauagca

SEQ ID NO: 870454 - RNA, 21 nt, Human
ugugccugcuuugaggggucc

SEQ ID NO: 870455 - RNA, 22 nt, Human
uguuuugggugugccugcuuug

SEQ ID NO: 870456 - RNA, 23 nt, Human
uuagugaauacuauugaauccua

SEQ ID NO: 870457 - RNA, 18 nt, Human
uucaugagcugcugcugc

SEQ ID NO: 870458 - RNA, 18 nt, Human
uucucagugacacaaaau

SEQ ID NO: 870459 - RNA, 22 nt, Human
uucuugauugugguugacgggg

SEQ ID NO: 870460 - RNA, 22 nt, Human
uugguggugguggcaaagcaug

SEQ ID NO: 870461 - RNA, 24 nt, Human
uuuaucaaucaaaccacauacccc

SEQ ID NO: 870462 - RNA, 19 nt, Human
uuucuccacccucuccucc

SEQ ID NO: 870463 - RNA, 20 nt, Human
uuucuccacccucuccuccc

SEQ ID NO: 870464 - RNA, 22 nt, Human
uuuguuuuguuuuuaaaucuua

SEQ ID NO: 870465 - RNA, 20 nt, Human
cgcacgcgcacuaggguccg

SEQ ID NO: 870466 - RNA, 22 nt, Human
uaagaaugggagcuuuauuuau

SEQ ID NO: 870467 - RNA, 20 nt, Human
uccaaaggggcggagccacc

SEQ ID NO: 870468 - RNA, 20 nt, Human
uuuuguuguguucaauacag

SEQ ID NO: 870469 - RNA, 19 nt, Human
uuuuuuuuuuuuuuuuuaa

SEQ ID NO: 870470 - RNA, 26 nt, Human
aaaaugaagacaccagggaaagagga

SEQ ID NO: 870471 - RNA, 22 nt, Human
aaagacacaaaagcucuuugua

SEQ ID NO: 870472 - RNA, 18 nt, Human
aaaggaagccaacaaaga

SEQ ID NO: 870473 - RNA, 24 nt, Human
aacaaaccauugagaacuuuggga

SEQ ID NO: 870474 - RNA, 24 nt, Human
aacacaucuucgaauacaucagca

SEQ ID NO: 870475 - RNA, 26 nt, Human
aaccaaauccagcaguucugucagca

SEQ ID NO: 870476 - RNA, 25 nt, Human
aaccaccagcaccaacucucagucu

SEQ ID NO: 870477 - RNA, 22 nt, Human
aacuuugggaguuuccaaauuc

SEQ ID NO: 870478 - RNA, 19 nt, Human
aagaggucagagcagaacg

SEQ ID NO: 870479 - RNA, 23 nt, Human
aagccaaaggcccuaggucaaaa

SEQ ID NO: 870480 - RNA, 20 nt, Human
aaggagaugguaagaacagc

SEQ ID NO: 870481 - RNA, 19 nt, Human
aaguauuuugaggacaagg

SEQ ID NO: 870482 - RNA, 22 nt, Human
acggaggaaaaugaagacacca

SEQ ID NO: 870483 - RNA, 21 nt, Human
agaaaccuuucauucagagcc

SEQ ID NO: 870484 - RNA, 23 nt, Human
agaaggcaacucccaagaccagg

SEQ ID NO: 870485 - RNA, 19 nt, Human
agacaacaggaaucugggc

SEQ ID NO: 870486 - RNA, 24 nt, Human
agacauuuuggugugaauugugga

SEQ ID NO: 870487 - RNA, 20 nt, Human
agaccaggaguaaugagaga

SEQ ID NO: 870488 - RNA, 26 nt, Human
agaggacauggaacucacaacaaacc

SEQ ID NO: 870489 - RNA, 22 nt, Human
agaugucaaagacacaaaagcu

SEQ ID NO: 870490 - RNA, 20 nt, Human
agcuacauagccuccacacc

SEQ ID NO: 870491 - RNA, 23 nt, Human
aggaggaaaggaagccaacaaag

SEQ ID NO: 870492 - RNA, 23 nt, Human
aggaggaugcaggucuggagcua

SEQ ID NO: 870493 - RNA, 18 nt, Human
aggcaacucccaagacca

SEQ ID NO: 870494 - RNA, 18 nt, Human
aggcaaggacaaccuucu

SEQ ID NO: 870495 - RNA, 23 nt, Human
aggcaauauccucccccugcccu

SEQ ID NO: 870496 - RNA, 25 nt, Human
agggugcugcugcucugcagguccg

SEQ ID NO: 870497 - RNA, 19 nt, Human
augaugagcaacugcaaca

SEQ ID NO: 870498 - RNA, 19 nt, Human
auggaacuaguggcaauga

SEQ ID NO: 870499 - RNA, 20 nt, Human
auuugaagacagcuccucca

SEQ ID NO: 870500 - RNA, 21 nt, Human
caaaagcucuuuguaggugcu

SEQ ID NO: 870501 - RNA, 21 nt, Human
caaaccccacaacuggauauu

SEQ ID NO: 870502 - RNA, 25 nt, Human
caaaugguucuuuauugaacaccca

SEQ ID NO: 870503 - RNA, 21 nt, Human
caaccaccagcaccaacucuc

SEQ ID NO: 870504 - RNA, 22 nt, Human
caaccaccagcaccaacucuca

SEQ ID NO: 870505 - RNA, 21 nt, Human
caacuggauauuaagucagga

SEQ ID NO: 870506 - RNA, 18 nt, Human
caagaauaaagccaacuc

SEQ ID NO: 870507 - RNA, 22 nt, Human
caagaauaaagccaacucaaau

SEQ ID NO: 870508 - RNA, 23 nt, Human
caagaauaaagccaacucaaaug

SEQ ID NO: 870509 - RNA, 20 nt, Human
cacaacaaaccauugagaac

SEQ ID NO: 870510 - RNA, 20 nt, Human
cacaggaccaaggggcugga

SEQ ID NO: 870511 - RNA, 24 nt, Human
cacaggaccaaggggcuggagugu

SEQ ID NO: 870512 - RNA, 19 nt, Human
caccacaaccaccagcacc

SEQ ID NO: 870513 - RNA, 27 nt, Human
caccacaaccaccagcaccaacucuca

SEQ ID NO: 870514 - RNA, 21 nt, Human
caccagcaccaacucucaguc

SEQ ID NO: 870515 - RNA, 21 nt, Human
cagaaggcaacucccaagacc

SEQ ID NO: 870516 - RNA, 22 nt, Human
cagaaggcaacucccaagacca

SEQ ID NO: 870517 - RNA, 26 nt, Human
cagacuggauuaaucauguggccaaa

SEQ ID NO: 870518 - RNA, 19 nt, Human
cagagcccccaagcuagga

SEQ ID NO: 870519 - RNA, 20 nt, Human
cagaguccagcucgccuuuc

SEQ ID NO: 870520 - RNA, 20 nt, Human
cagaucagagcauuaggcaa

SEQ ID NO: 870521 - RNA, 18 nt, Human
cagcagaaaagcugggca

SEQ ID NO: 870522 - RNA, 21 nt, Human
cagcaguucugucagcaaagg

SEQ ID NO: 870523 - RNA, 18 nt, Human
caggguaggcugaauggu

SEQ ID NO: 870524 - RNA, 19 nt, Human
cauagccuccacaccggaa

SEQ ID NO: 870525 - RNA, 23 nt, Human
cauuaaauucccucugccccaag

SEQ ID NO: 870526 - RNA, 19 nt, Human
cauucagagcccccaagcu

SEQ ID NO: 870527 - RNA, 21 nt, Human
ccacaaacugauucuaagagc

SEQ ID NO: 870528 - RNA, 22 nt, Human
ccaccacaaccaccagcaccaa

SEQ ID NO: 870529 - RNA, 19 nt, Human
ccaguggaguauccucaga

SEQ ID NO: 870530 - RNA, 18 nt, Human
cccaagugaacuggaaag

SEQ ID NO: 870531 - RNA, 22 nt, Human
ccccagguucaucuuagagcuc

SEQ ID NO: 870532 - RNA, 18 nt, Human
cccccugcccucuaaucc

SEQ ID NO: 870533 - RNA, 22 nt, Human
ccugguugagucugcuuguugu

SEQ ID NO: 870534 - RNA, 18 nt, Human
cgccuccuucccucagcc

SEQ ID NO: 870535 - RNA, 19 nt, Human
cgccuccuucccucagccc

SEQ ID NO: 870536 - RNA, 20 nt, Human
cucuaaguacagacauuuug

SEQ ID NO: 870537 - RNA, 19 nt, Human
cugggaugcagccugaagc

SEQ ID NO: 870538 - RNA, 18 nt, Human
cuucccaucugguuguuc

SEQ ID NO: 870539 - RNA, 18 nt, Human
cuuccucagaguuuuggc

SEQ ID NO: 870540 - RNA, 21 nt, Human
gaaaagucacaaacaccuuuc

SEQ ID NO: 870541 - RNA, 24 nt, Human
gaaacacuauucaccccucccuuc

SEQ ID NO: 870542 - RNA, 21 nt, Human
gaacucacaacaaaccauuga

SEQ ID NO: 870543 - RNA, 21 nt, Human
gaaggagaugguaagaacagc

SEQ ID NO: 870544 - RNA, 23 nt, Human
gaggaaaggaagccaacaaagag

SEQ ID NO: 870545 - RNA, 21 nt, Human
gcauggccacagugacugauc

SEQ ID NO: 870546 - RNA, 18 nt, Human
gcaugggcagugaauggc

SEQ ID NO: 870547 - RNA, 23 nt, Human
gccaacucaaaugaaagcagagc

SEQ ID NO: 870548 - RNA, 19 nt, Human
gcuaggcaauauccucccc

SEQ ID NO: 870549 - RNA, 24 nt, Human
ggaggaaaggaagccaacaaagag

SEQ ID NO: 870550 - RNA, 21 nt, Human
ggcgcucagcaugggcaguga

SEQ ID NO: 870551 - RNA, 20 nt, Human
gggacagcagggagacggag

SEQ ID NO: 870552 - RNA, 24 nt, Human
gggcuggaguguugggaacagaug

SEQ ID NO: 870553 - RNA, 22 nt, Human
ggggugagagccaccauggaga

SEQ ID NO: 870554 - RNA, 25 nt, Human
gugaaagccaaaggcccuaggucaa

SEQ ID NO: 870555 - RNA, 21 nt, Human
uaaaaggaggagggugguaga

SEQ ID NO: 870556 - RNA, 18 nt, Human
uaaccucaaggcugaacu

SEQ ID NO: 870557 - RNA, 23 nt, Human
uacacacucacgacugucaacac

SEQ ID NO: 870558 - RNA, 18 nt, Human
uacauagccuccacaccg

SEQ ID NO: 870559 - RNA, 21 nt, Human
uacauagccuccacaccggaa

SEQ ID NO: 870560 - RNA, 21 nt, Human
uaccuugaagcaaggaguaac

SEQ ID NO: 870561 - RNA, 18 nt, Human
uacuagcagaaucuccuu

SEQ ID NO: 870562 - RNA, 22 nt, Human
uacugagguccccacuuuuagu

SEQ ID NO: 870563 - RNA, 21 nt, Human
uagcagaaucuccuuccucag

SEQ ID NO: 870564 - RNA, 22 nt, Human
uagcagaaucuccuuccucaga

SEQ ID NO: 870565 - RNA, 22 nt, Human
uagcucuaaguacagacauuuu

SEQ ID NO: 870566 - RNA, 19 nt, Human
uaggaggaugcaggucugg

SEQ ID NO: 870567 - RNA, 23 nt, Human
uaggaggaugcaggucuggagcu

SEQ ID NO: 870568 - RNA, 23 nt, Human
uaggcaauauccucccccugccc

SEQ ID NO: 870569 - RNA, 18 nt, Human
uauccuaggacagcuaag

SEQ ID NO: 870570 - RNA, 23 nt, Human
uaugggagagagaaauaaacuuc

SEQ ID NO: 870571 - RNA, 20 nt, Human
ucaaaugaaagcagagcuga

SEQ ID NO: 870572 - RNA, 20 nt, Human
ucacugcacuguuaugggag

SEQ ID NO: 870573 - RNA, 18 nt, Human
ucacuucugaaucuuccu

SEQ ID NO: 870574 - RNA, 23 nt, Human
ucagaaggcaacucccaagacca

SEQ ID NO: 870575 - RNA, 20 nt, Human
ucaggcgggauccagccauc

SEQ ID NO: 870576 - RNA, 25 nt, Human
ucaucugccaccacaaccaccagca

SEQ ID NO: 870577 - RNA, 24 nt, Human
ucaucuuagagcucaagcagauuc

SEQ ID NO: 870578 - RNA, 20 nt, Human
ucauggcuccaaaugcaagg

SEQ ID NO: 870579 - RNA, 18 nt, Human
uccaggcucagguacccc

SEQ ID NO: 870580 - RNA, 18 nt, Human
ucccucagccccggaucc

SEQ ID NO: 870581 - RNA, 22 nt, Human
uccguuucaggcgggauccagc

SEQ ID NO: 870582 - RNA, 22 nt, Human
ucucccaauggccauucuuccc

SEQ ID NO: 870583 - RNA, 19 nt, Human
ucuuaagcacuuagagccu

SEQ ID NO: 870584 - RNA, 25 nt, Human
ugaaaagucacaaacaccuuuccca

SEQ ID NO: 870585 - RNA, 20 nt, Human
ugaaagcagagcugagagcc

SEQ ID NO: 870586 - RNA, 18 nt, Human
ugaacacccacuuuggcu

SEQ ID NO: 870587 - RNA, 23 nt, Human
ugaagacaccagggaaagaggag

SEQ ID NO: 870588 - RNA, 24 nt, Human
ugaagacaccagggaaagaggaga

SEQ ID NO: 870589 - RNA, 19 nt, Human
ugaaugguucuaggccagg

SEQ ID NO: 870590 - RNA, 18 nt, Human
ugacaggcuguuccuagg

SEQ ID NO: 870591 - RNA, 24 nt, Human
ugacuugaggcuggauaccuuccu

SEQ ID NO: 870592 - RNA, 19 nt, Human
ugagagacucaaaucuaac

SEQ ID NO: 870593 - RNA, 19 nt, Human
ugaggacaaggagauuuuc

SEQ ID NO: 870594 - RNA, 22 nt, Human
ugagguccccacuuuuagugaa

SEQ ID NO: 870595 - RNA, 20 nt, Human
ugaugcuuuguccugcccag

SEQ ID NO: 870596 - RNA, 18 nt, Human
ugauucuguguuccacag

SEQ ID NO: 870597 - RNA, 19 nt, Human
ugcagcaggaggaaaggaa

SEQ ID NO: 870598 - RNA, 21 nt, Human
ugccaccacaaccaccagcac

SEQ ID NO: 870599 - RNA, 21 nt, Human
ugcccagcacccauucguccc

SEQ ID NO: 870600 - RNA, 22 nt, Human
ugccugaugacaucauggacca

SEQ ID NO: 870601 - RNA, 19 nt, Human
uggaacucacaacaaacca

SEQ ID NO: 870602 - RNA, 22 nt, Human
uggagacagaguccagcucgcc

SEQ ID NO: 870603 - RNA, 24 nt, Human
uggagcuaucagcugucauggcuc

SEQ ID NO: 870604 - RNA, 23 nt, Human
uggcaaugauuacauacagcugu

SEQ ID NO: 870605 - RNA, 24 nt, Human
ugggaagaagagagaaacacuauu

SEQ ID NO: 870606 - RNA, 19 nt, Human
uguaagcacagcauuugaa

SEQ ID NO: 870607 - RNA, 23 nt, Human
ugugaauuguggaguuuauggca

SEQ ID NO: 870608 - RNA, 21 nt, Human
uguggccaaacaugcauggcc

SEQ ID NO: 870609 - RNA, 23 nt, Human
uguguggugacaggcuguuccua

SEQ ID NO: 870610 - RNA, 18 nt, Human
uguuccuaggucccuggg

SEQ ID NO: 870611 - RNA, 20 nt, Human
uuccaaauucgaacuggaag

SEQ ID NO: 870612 - RNA, 21 nt, Human
uucuaaccucaaggcugaacu

SEQ ID NO: 870613 - RNA, 18 nt, Human
uugaacacccacuuuggc

SEQ ID NO: 870614 - RNA, 18 nt, Human
uugcaaaccccacaacug

SEQ ID NO: 870615 - RNA, 22 nt, Human
uuggugugaauuguggaguuua

SEQ ID NO: 870616 - RNA, 23 nt, Human
uugucuucccaucaccuuguuuu

SEQ ID NO: 870617 - RNA, 23 nt, Human
uuuguaggugcugacuggcucac

SEQ ID NO: 870618 - RNA, 27 nt, Human
agaacaaucagagaaaaagggaggccu

SEQ ID NO: 870619 - RNA, 20 nt, Human
agccacaggcaggcaacuaa

SEQ ID NO: 870620 - RNA, 20 nt, Human
augacuuucugugaggguuu

SEQ ID NO: 870621 - RNA, 22 nt, Human
caaaaaaauuccauucugugaa

SEQ ID NO: 870622 - RNA, 24 nt, Human
caagaaaaauaaaacuagccacau

SEQ ID NO: 870623 - RNA, 20 nt, Human
cagaacaaucagagaaaaac

SEQ ID NO: 870624 - RNA, 19 nt, Human
cagagaaaaacaugauuuc

SEQ ID NO: 870625 - RNA, 21 nt, Human
cagagaaaaacaugauuucau

SEQ ID NO: 870626 - RNA, 21 nt, Human
cagcaguggacgucaccauuu

SEQ ID NO: 870627 - RNA, 20 nt, Human
caggagccuuuuuccaaccu

SEQ ID NO: 870628 - RNA, 25 nt, Human
cagucucacugaagagaggaugaau

SEQ ID NO: 870629 - RNA, 24 nt, Human
ccuuucuuccccuuuugcaagucc

SEQ ID NO: 870630 - RNA, 24 nt, Human
cuguacaaagagcacaugugcaug

SEQ ID NO: 870631 - RNA, 18 nt, Human
gaaacaugauaugaaugg

SEQ ID NO: 870632 - RNA, 25 nt, Human
gugaauugaaauaaaaagguaucuu

SEQ ID NO: 870633 - RNA, 22 nt, Human
gugcaugaguuaaaaaacaagg

SEQ ID NO: 870634 - RNA, 19 nt, Human
uacacuuuuuaaaacugua

SEQ ID NO: 870635 - RNA, 18 nt, Human
ucagagaaaaacaugauu

SEQ ID NO: 870636 - RNA, 25 nt, Human
ugagacaugaaacaaaaaaauucca

SEQ ID NO: 870637 - RNA, 21 nt, Human
ugauaugaaugguuuaaguca

SEQ ID NO: 870638 - RNA, 22 nt, Human
ugcaaaacaagaaaaauaaaac

SEQ ID NO: 870639 - RNA, 21 nt, Human
ugcaugaguuaaaaaacaagg

SEQ ID NO: 870640 - RNA, 19 nt, Human
uggaggaggguuacaggag

SEQ ID NO: 870641 - RNA, 20 nt, Human
uguagaguguuaaaaaagaa

SEQ ID NO: 870642 - RNA, 21 nt, Human
uuacaggagccuuuuuccaac

SEQ ID NO: 870643 - RNA, 24 nt, Human
uuacaggagccuuuuuccaaccuc

SEQ ID NO: 870644 - RNA, 22 nt, Human
uucaaaauaagaguauuuagaa

SEQ ID NO: 870645 - RNA, 18 nt, Human
uucaacuuuacugucgac

SEQ ID NO: 870646 - RNA, 20 nt, Human
uucacauuuaacaaaaguag

SEQ ID NO: 870647 - RNA, 26 nt, Human
aaccgacucagaccugacagcaacau

SEQ ID NO: 870648 - RNA, 20 nt, Human
acccgucagacuccaaccga

SEQ ID NO: 870649 - RNA, 18 nt, Human
agaaaagucuggaaagua

SEQ ID NO: 870650 - RNA, 18 nt, Human
agaugcuggagcucaggc

SEQ ID NO: 870651 - RNA, 21 nt, Human
aggcugggccgcccccuuggc

SEQ ID NO: 870652 - RNA, 26 nt, Human
agguggcccgggggggauaugggggg

SEQ ID NO: 870653 - RNA, 26 nt, Human
caaagcucccugcucggcugccccuc

SEQ ID NO: 870654 - RNA, 23 nt, Human
ccaaccgacucagaccugacagc

SEQ ID NO: 870655 - RNA, 21 nt, Human
ccccuuggcucucccuccuga

SEQ ID NO: 870656 - RNA, 19 nt, Human
cccgggggggauauggggg

SEQ ID NO: 870657 - RNA, 18 nt, Human
cccuuggcucucccuccu

SEQ ID NO: 870658 - RNA, 19 nt, Human
cccuuggcucucccuccug

SEQ ID NO: 870659 - RNA, 19 nt, Human
ccuccuguuccaggggagc

SEQ ID NO: 870660 - RNA, 22 nt, Human
ccuucugcuccccuguuucuca

SEQ ID NO: 870661 - RNA, 21 nt, Human
cgacucagaccugacagcaac

SEQ ID NO: 870662 - RNA, 19 nt, Human
cggcugccccucgcccgcc

SEQ ID NO: 870663 - RNA, 18 nt, Human
cucaaggugucaaaggag

SEQ ID NO: 870664 - RNA, 19 nt, Human
cucagaccugacagcaaca

SEQ ID NO: 870665 - RNA, 21 nt, Human
cucccugcucggcugccccuc

SEQ ID NO: 870666 - RNA, 24 nt, Human
cucgccuacccgucagacuccaac

SEQ ID NO: 870667 - RNA, 24 nt, Human
cugcgccugcgcgucucgccuacc

SEQ ID NO: 870668 - RNA, 26 nt, Human
cuggagcucaggcccgccgugugugc

SEQ ID NO: 870669 - RNA, 19 nt, Human
gacucagaccugacagcaa

SEQ ID NO: 870670 - RNA, 21 nt, Human
gcacccaggcaggagcgggcg

SEQ ID NO: 870671 - RNA, 18 nt, Human
gcccgccgugugugcacc

SEQ ID NO: 870672 - RNA, 19 nt, Human
gcccgggggggauaugggg

SEQ ID NO: 870673 - RNA, 20 nt, Human
ggagcgggcgcuguccaggc

SEQ ID NO: 870674 - RNA, 22 nt, Human
ggcuggggcucucugcgccugc

SEQ ID NO: 870675 - RNA, 20 nt, Human
ggggggcaggacaggcagag

SEQ ID NO: 870676 - RNA, 24 nt, Human
gucucgccuacccgucagacucca

SEQ ID NO: 870677 - RNA, 23 nt, Human
uaagaaaagucuggaaaguagca

SEQ ID NO: 870678 - RNA, 23 nt, Human
uaagaaaagucuggaaaguagca

SEQ ID NO: 870679 - RNA, 21 nt, Human
ucauacccccaaacucagaug

SEQ ID NO: 870680 - RNA, 20 nt, Human
ucgcugaggccaccugggcc

SEQ ID NO: 870681 - RNA, 21 nt, Human
ucuggaaaguagcagaaucau

SEQ ID NO: 870682 - RNA, 20 nt, Human
uggcccgggggggauauggg

SEQ ID NO: 870683 - RNA, 24 nt, Human
ugggccgcccccuuggcucucccu

SEQ ID NO: 870684 - RNA, 22 nt, Human
ugggggccccagcccuguccca

SEQ ID NO: 870685 - RNA, 20 nt, Human
uguuugcuuuguaagaaaag

SEQ ID NO: 870686 - RNA, 24 nt, Human
uuggcucucccuccuguuccaggg

SEQ ID NO: 870687 - RNA, 24 nt, Human
uuugcagcacaggcaguuuucuuc

SEQ ID NO: 870688 - RNA, 27 nt, Human
uuuuuuuuuuuuuuuuuuuuuuugggg

SEQ ID NO: 870689 - RNA, 26 nt, Human
aagaaaccaagucugaagcaguggga

SEQ ID NO: 870690 - RNA, 21 nt, Human
aauucuccucuuacuucaagc

SEQ ID NO: 870691 - RNA, 23 nt, Human
accccaacaccuucuucuuucuu

SEQ ID NO: 870692 - RNA, 21 nt, Human
accuucuucuuucuucugcug

SEQ ID NO: 870693 - RNA, 19 nt, Human
agcaaagaaaagcauaauu

SEQ ID NO: 870694 - RNA, 21 nt, Human
agcauaauucuccucuuacuu

SEQ ID NO: 870695 - RNA, 19 nt, Human
aggcagcagccgccgugug

SEQ ID NO: 870696 - RNA, 22 nt, Human
aguagguagugaaaaacaguaa

SEQ ID NO: 870697 - RNA, 19 nt, Human
auaaaacaaauauacuggc

SEQ ID NO: 870698 - RNA, 25 nt, Human
augauccaucuucagugggggauga

SEQ ID NO: 870699 - RNA, 22 nt, Human
auggugacgacuauucaggcac

SEQ ID NO: 870700 - RNA, 21 nt, Human
caaguccacaguaaccaggag

SEQ ID NO: 870701 - RNA, 22 nt, Human
cagcagcggcggcggcgaggag

SEQ ID NO: 870702 - RNA, 19 nt, Human
cagcggcggcggcgaggag

SEQ ID NO: 870703 - RNA, 23 nt, Human
cagcggggcugcgcgggccccuc

SEQ ID NO: 870704 - RNA, 21 nt, Human
caggcacacaucucuuccuug

SEQ ID NO: 870705 - RNA, 25 nt, Human
cauaaggaagagaauggcuaauucc

SEQ ID NO: 870706 - RNA, 26 nt, Human
caucuagggguaagauaugacugcuc

SEQ ID NO: 870707 - RNA, 19 nt, Human
ccagcagcggcggcggcga

SEQ ID NO: 870708 - RNA, 19 nt, Human
cccguagucuucugguuuc

SEQ ID NO: 870709 - RNA, 24 nt, Human
cccguagucuucugguuucuagcu

SEQ ID NO: 870710 - RNA, 20 nt, Human
cccuucuacuuuauuuguaa

SEQ ID NO: 870711 - RNA, 22 nt, Human
cggggcugcgcgggccccucgu

SEQ ID NO: 870712 - RNA, 18 nt, Human
cucaauugauuguccauu

SEQ ID NO: 870713 - RNA, 22 nt, Human
cucuuuucuuacuuucccccuu

SEQ ID NO: 870714 - RNA, 19 nt, Human
cuuggauuuccuucucuuu

SEQ ID NO: 870715 - RNA, 24 nt, Human
cuuuauauuguugcauuccucaau

SEQ ID NO: 870716 - RNA, 18 nt, Human
gaaaaagcaaagaaaagc

SEQ ID NO: 870717 - RNA, 22 nt, Human
gaaaaagcaaagaaaagcauaa

SEQ ID NO: 870718 - RNA, 22 nt, Human
gagcagcggggcugcgcgggcc

SEQ ID NO: 870719 - RNA, 23 nt, Human
gagcgcggucaacgcggcgagca

SEQ ID NO: 870720 - RNA, 23 nt, Human
gauacaugaggggucagaaagaa

SEQ ID NO: 870721 - RNA, 18 nt, Human
ggcugcgcgggccccucg

SEQ ID NO: 870722 - RNA, 22 nt, Human
gguugccaggaagcuuggagau

SEQ ID NO: 870723 - RNA, 26 nt, Human
uaaaauaagacucauaguucucugcc

SEQ ID NO: 870724 - RNA, 23 nt, Human
uaauauaggcagacaguagguca

SEQ ID NO: 870725 - RNA, 20 nt, Human
uagggguaagauaugacugc

SEQ ID NO: 870726 - RNA, 21 nt, Human
ucaccuggagaugcuugauac

SEQ ID NO: 870727 - RNA, 22 nt, Human
ucccaggcucucccuagagccc

SEQ ID NO: 870728 - RNA, 18 nt, Human
uccuacagccucgcaugu

SEQ ID NO: 870729 - RNA, 21 nt, Human
uccuaccacagucaucuccuc

SEQ ID NO: 870730 - RNA, 21 nt, Human
ucuucagugggggaugaaagu

SEQ ID NO: 870731 - RNA, 19 nt, Human
ugaagcaccuugugaagau

SEQ ID NO: 870732 - RNA, 23 nt, Human
ugaggggucagaaagaagccugg

SEQ ID NO: 870733 - RNA, 18 nt, Human
ugccaaggaagagcuucc

SEQ ID NO: 870734 - RNA, 19 nt, Human
ugcugugggaugauccauc

SEQ ID NO: 870735 - RNA, 23 nt, Human
uguggacccuuaauauaggcaga

SEQ ID NO: 870736 - RNA, 18 nt, Human
uuaaaaaaaggcagcagc

SEQ ID NO: 870737 - RNA, 21 nt, Human
uuccuuggguccuaccacagu

SEQ ID NO: 870738 - RNA, 20 nt, Human
uuucccccuuaaaaaaaggc

SEQ ID NO: 870739 - RNA, 25 nt, Human
uuuuuuuuuuugaaugaaaagggcu

SEQ ID NO: 870740 - RNA, 18 nt, Human
uuuuuuuuuuuuuuuuug

SEQ ID NO: 870741 - RNA, 22 nt, Human
aagcuuuauggaagagcaauuc

SEQ ID NO: 870742 - RNA, 20 nt, Human
accaacuccugagcacgcgc

SEQ ID NO: 870743 - RNA, 22 nt, Human
acucagugagccuccacccuuc

SEQ ID NO: 870744 - RNA, 18 nt, Human
aggcaggacaccaacucc

SEQ ID NO: 870745 - RNA, 21 nt, Human
caauacagguaaugaaacucu

SEQ ID NO: 870746 - RNA, 27 nt, Human
cagcccucuacucagugagccuccacc

SEQ ID NO: 870747 - RNA, 19 nt, Human
cagcucccuggcuggcacc

SEQ ID NO: 870748 - RNA, 19 nt, Human
cagugagccuccacccuuc

SEQ ID NO: 870749 - RNA, 21 nt, Human
cauuuuccucuuaagcauagg

SEQ ID NO: 870750 - RNA, 18 nt, Human
ccaacccugcagggacau

SEQ ID NO: 870751 - RNA, 22 nt, Human
ccaaugggcagccccagccuga

SEQ ID NO: 870752 - RNA, 22 nt, Human
ccaggaacacuuucauuuuccu

SEQ ID NO: 870753 - RNA, 23 nt, Human
ccccaaugggcagccccagccuu

SEQ ID NO: 870754 - RNA, 22 nt, Human
cccucuacucagugagccucca

SEQ ID NO: 870755 - RNA, 22 nt, Human
ccugagcacgcgcuaggcgaac

SEQ ID NO: 870756 - RNA, 18 nt, Human
cucaguuuagacaacagc

SEQ ID NO: 870757 - RNA, 20 nt, Human
cuccugagcacgcgcuaggc

SEQ ID NO: 870758 - RNA, 22 nt, Human
gacaccaacuccugagcacgcg

SEQ ID NO: 870759 - RNA, 22 nt, Human
gcccccaaugggcagccccagc

SEQ ID NO: 870760 - RNA, 21 nt, Human
gcucugucccugccaacccug

SEQ ID NO: 870761 - RNA, 19 nt, Human
ucagagacagcaccccagg

SEQ ID NO: 870762 - RNA, 21 nt, Human
ucccuggcuggcaccaugguc

SEQ ID NO: 870763 - RNA, 22 nt, Human
uggggcccccaaugggcagccc

SEQ ID NO: 870764 - RNA, 20 nt, Human
aaaaagacuguucugccccu

SEQ ID NO: 870765 - RNA, 21 nt, Human
acccaaaaagacuguucugcc

SEQ ID NO: 870766 - RNA, 19 nt, Human
accccgaagucugcaaagc

SEQ ID NO: 870767 - RNA, 21 nt, Human
acgcugcaggagggcccagac

SEQ ID NO: 870768 - RNA, 22 nt, Human
agacgcgacagaggaaagaaac

SEQ ID NO: 870769 - RNA, 25 nt, Human
agagcaccccgaagucugcaaagcg

SEQ ID NO: 870770 - RNA, 23 nt, Human
agcccggcccuuacccaaaaaga

SEQ ID NO: 870771 - RNA, 18 nt, Human
auaacacaaaagacauuc

SEQ ID NO: 870772 - RNA, 22 nt, Human
cagaggaaagaaacgggaaacc

SEQ ID NO: 870773 - RNA, 19 nt, Human
caggagggcagcacagaga

SEQ ID NO: 870774 - RNA, 21 nt, Human
caggagggcccagacgcgaca

SEQ ID NO: 870775 - RNA, 23 nt, Human
caggaucaaggucccaguccgcc

SEQ ID NO: 870776 - RNA, 19 nt, Human
cccaaaaagacuguucugc

SEQ ID NO: 870777 - RNA, 21 nt, Human
cccccagcccggcccuuaccc

SEQ ID NO: 870778 - RNA, 21 nt, Human
ccccgugucccgguucuccag

SEQ ID NO: 870779 - RNA, 18 nt, Human
cccggcccuuacccaaaa

SEQ ID NO: 870780 - RNA, 21 nt, Human
cccuuacccaaaaagacuguu

SEQ ID NO: 870781 - RNA, 18 nt, Human
ccucccguccccgugucc

SEQ ID NO: 870782 - RNA, 22 nt, Human
cgaggaaggugccccggaggcg

SEQ ID NO: 870783 - RNA, 23 nt, Human
cggcuaaacgcggguguguggag

SEQ ID NO: 870784 - RNA, 18 nt, Human
cguggcgaggaaggugcc

SEQ ID NO: 870785 - RNA, 20 nt, Human
gaccggcucccggggcccgg

SEQ ID NO: 870786 - RNA, 21 nt, Human
gcccccagcccggcccuuacc

SEQ ID NO: 870787 - RNA, 23 nt, Human
gcccccagcccggcccuuaccca

SEQ ID NO: 870788 - RNA, 24 nt, Human
ggaaagcaacagccccuggccuuc

SEQ ID NO: 870789 - RNA, 25 nt, Human
ggccgggcaggcaggaucaaggucc

SEQ ID NO: 870790 - RNA, 22 nt, Human
ggcucccggggcccgguuaccu

SEQ ID NO: 870791 - RNA, 21 nt, Human
gggcccagacgcgacagagga

SEQ ID NO: 870792 - RNA, 19 nt, Human
gggccccgcggccuuucag

SEQ ID NO: 870793 - RNA, 22 nt, Human
gggcggccgggcaggcaggauc

SEQ ID NO: 870794 - RNA, 21 nt, Human
guucgggguccgcucucauuc

SEQ ID NO: 870795 - RNA, 20 nt, Human
ucccgguucuccaggagggc

SEQ ID NO: 870796 - RNA, 23 nt, Human
ugcuggcccucccguccccgugu

SEQ ID NO: 870797 - RNA, 22 nt, Human
uggcccucccguccccgugucc

SEQ ID NO: 870798 - RNA, 20 nt, Human
ugucguggcgaggaaggugc

SEQ ID NO: 870799 - RNA, 19 nt, Human
uguggcggcuaaacgcggg

SEQ ID NO: 870800 - RNA, 20 nt, Human
uuuuuuuuuuuuuuuuuaac

SEQ ID NO: 870801 - RNA, 25 nt, Human
aaauggguuuuaaaaauuaaggcuc

SEQ ID NO: 870802 - RNA, 19 nt, Human
aagaaaaaagucacuaccu

SEQ ID NO: 870803 - RNA, 25 nt, Human
agucacuaccuauucaaguucuaga

SEQ ID NO: 870804 - RNA, 21 nt, Human
caccccaccccucccacgaaa

SEQ ID NO: 870805 - RNA, 22 nt, Human
caccccaccccucccacgaaaa

SEQ ID NO: 870806 - RNA, 19 nt, Human
cacgaaaaagaaaaaaguc

SEQ ID NO: 870807 - RNA, 23 nt, Human
ccucccacgaaaaagaaaaaagu

SEQ ID NO: 870808 - RNA, 24 nt, Human
cuugggacucuauauacucccagg

SEQ ID NO: 870809 - RNA, 19 nt, Human
uaaaugcucuaagguaaau

SEQ ID NO: 870810 - RNA, 23 nt, Human
uaagauaaaaaauuggacuauaa

SEQ ID NO: 870811 - RNA, 23 nt, Human
ucaacccugcuaaacguuuuguu

SEQ ID NO: 870812 - RNA, 19 nt, Human
ugccagaacaauguaaaaa

SEQ ID NO: 870813 - RNA, 19 nt, Human
ugugcugaacacacauuga

SEQ ID NO: 870814 - RNA, 18 nt, Human
uuaagauaaaaaauugga

SEQ ID NO: 870815 - RNA, 30 nt, Human
uuuuuugcuucuuugaaaaaagauguuuaa

SEQ ID NO: 870816 - RNA, 19 nt, Human
uuuuuuuuuuuuuuugcuu

SEQ ID NO: 870817 - RNA, 24 nt, Human
uuuuuuuuuuuuuuugcuucuuug

SEQ ID NO: 870818 - RNA, 20 nt, Human
aaaaauuggcauauggacaa

SEQ ID NO: 870819 - RNA, 23 nt, Human
acaccaggauuuccgccaggcca

SEQ ID NO: 870820 - RNA, 21 nt, Human
agauguuaacuaaauuucugu

SEQ ID NO: 870821 - RNA, 18 nt, Human
agcaucaccaacgcuccc

SEQ ID NO: 870822 - RNA, 18 nt, Human
agguaagcaggcggaauc

SEQ ID NO: 870823 - RNA, 24 nt, Human
aguuuuuuacaccaacuaaauggu

SEQ ID NO: 870824 - RNA, 25 nt, Human
auacagcaucaccaacgcuccccag

SEQ ID NO: 870825 - RNA, 20 nt, Human
auggccaccgaggcguuucc

SEQ ID NO: 870826 - RNA, 24 nt, Human
auuucuagauguggggagaaacaa

SEQ ID NO: 870827 - RNA, 18 nt, Human
auuuuguuccuccaccuc

SEQ ID NO: 870828 - RNA, 22 nt, Human
caauagaaaaccagacaccacg

SEQ ID NO: 870829 - RNA, 18 nt, Human
cacaguuugcgaggguuu

SEQ ID NO: 870830 - RNA, 23 nt, Human
caccgcuaccaacggcugugggc

SEQ ID NO: 870831 - RNA, 19 nt, Human
cagcaguacugcugccacc

SEQ ID NO: 870832 - RNA, 18 nt, Human
caucaccaacgcucccca

SEQ ID NO: 870833 - RNA, 19 nt, Human
cauuuuuugguuguuguuu

SEQ ID NO: 870834 - RNA, 23 nt, Human
ccccucuaggggaggauggaggc

SEQ ID NO: 870835 - RNA, 20 nt, Human
cccgcaaggcugaggaugag

SEQ ID NO: 870836 - RNA, 21 nt, Human
cccggucacgccgccggcgcc

SEQ ID NO: 870837 - RNA, 18 nt, Human
ccgccaggccacaguuug

SEQ ID NO: 870838 - RNA, 19 nt, Human
ccggcgccgccauuuuguc

SEQ ID NO: 870839 - RNA, 18 nt, Human
ccuccaccucagccaacc

SEQ ID NO: 870840 - RNA, 22 nt, Human
ccugagaggcaaagauggaggc

SEQ ID NO: 870841 - RNA, 19 nt, Human
cggucacgccgccggcgcc

SEQ ID NO: 870842 - RNA, 23 nt, Human
cggucacgccgccggcgccgcca

SEQ ID NO: 870843 - RNA, 24 nt, Human
cuaaaaaugcucaaucauaagcau

SEQ ID NO: 870844 - RNA, 21 nt, Human
cuccaccucagccaaccacaa

SEQ ID NO: 870845 - RNA, 21 nt, Human
cugucguggcgaugucguggg

SEQ ID NO: 870846 - RNA, 24 nt, Human
cuuguaaaacauaaaagcucccau

SEQ ID NO: 870847 - RNA, 20 nt, Human
gagaaacccuaaaaaugcuc

SEQ ID NO: 870848 - RNA, 19 nt, Human
gcacagcgaguuggggcag

SEQ ID NO: 870849 - RNA, 20 nt, Human
gccaccgaggcguuucccgg

SEQ ID NO: 870850 - RNA, 22 nt, Human
ggagaaacaaaugcugcucgaa

SEQ ID NO: 870851 - RNA, 18 nt, Human
ggagaaacccuaaaaaug

SEQ ID NO: 870852 - RNA, 19 nt, Human
ggaggauggaggccuccgg

SEQ ID NO: 870853 - RNA, 21 nt, Human
gggcacagcgaguuggggcag

SEQ ID NO: 870854 - RNA, 22 nt, Human
gguaagcaggcggaaucuuucc

SEQ ID NO: 870855 - RNA, 19 nt, Human
guacauacauguucaguug

SEQ ID NO: 870856 - RNA, 18 nt, Human
gugggccagagggcccgg

SEQ ID NO: 870857 - RNA, 23 nt, Human
uaaaauaccgagaacaugauaua

SEQ ID NO: 870858 - RNA, 19 nt, Human
uacaccaacuaaaugguug

SEQ ID NO: 870859 - RNA, 19 nt, Human
uacuagaucagcuggcuua

SEQ ID NO: 870860 - RNA, 23 nt, Human
ucccagaucauauggguguuuac

SEQ ID NO: 870861 - RNA, 21 nt, Human
ucccgguguuacagggcgugg

SEQ ID NO: 870862 - RNA, 20 nt, Human
ucgguggcggucgcugccuc

SEQ ID NO: 870863 - RNA, 24 nt, Human
ucgugggcugagaaagggggcaca

SEQ ID NO: 870864 - RNA, 20 nt, Human
ucucaagguuccaggcuggg

SEQ ID NO: 870865 - RNA, 21 nt, Human
ucucgguggcggucgcugccu

SEQ ID NO: 870866 - RNA, 19 nt, Human
ucugcuucuucuguuccuc

SEQ ID NO: 870867 - RNA, 21 nt, Human
ugaaauaaaauuuacuugcaa

SEQ ID NO: 870868 - RNA, 18 nt, Human
ugagaggcaaagauggag

SEQ ID NO: 870869 - RNA, 20 nt, Human
ugaggaugagggcugcugga

SEQ ID NO: 870870 - RNA, 23 nt, Human
ugcucugcuucuucuguuccuca

SEQ ID NO: 870871 - RNA, 24 nt, Human
uggaggccuccggggcccaccggc

SEQ ID NO: 870872 - RNA, 21 nt, Human
uggcuuacagacaagaagcca

SEQ ID NO: 870873 - RNA, 18 nt, Human
ugguuguuguuguuuuua

SEQ ID NO: 870874 - RNA, 20 nt, Human
uguuacagggcguggaguca

SEQ ID NO: 870875 - RNA, 23 nt, Human
uuaacuaaauuucugugacaaau

SEQ ID NO: 870876 - RNA, 23 nt, Human
uugcagcuguggcugaauacugu

SEQ ID NO: 870877 - RNA, 21 nt, Human
uuugcaaaccccagggaugga

SEQ ID NO: 870878 - RNA, 23 nt, Human
uuuuuacaccaacuaaaugguug

SEQ ID NO: 870879 - RNA, 20 nt, Human
aaaacagccaggugucagga

SEQ ID NO: 870880 - RNA, 25 nt, Human
aaacaagcucuacuucagaugucca

SEQ ID NO: 870881 - RNA, 20 nt, Human
aaacagccaggugucaggaa

SEQ ID NO: 870882 - RNA, 21 nt, Human
aagauuuuagucuaaacagaa

SEQ ID NO: 870883 - RNA, 25 nt, Human
aagcgggaaggaggcggggggaggu

SEQ ID NO: 870884 - RNA, 20 nt, Human
aaguuaaggcacagcaguuc

SEQ ID NO: 870885 - RNA, 20 nt, Human
acaagaguaaaacuccaccu

SEQ ID NO: 870886 - RNA, 23 nt, Human
acacaguaguaaaacugcuacaa

SEQ ID NO: 870887 - RNA, 19 nt, Human
accacaauuccuccuugua

SEQ ID NO: 870888 - RNA, 24 nt, Human
accagggccuccagcuggaggcag

SEQ ID NO: 870889 - RNA, 23 nt, Human
accccaggauucaaauaggaccg

SEQ ID NO: 870890 - RNA, 27 nt, Human
acggcacuccagccuagacaacaagag

SEQ ID NO: 870891 - RNA, 24 nt, Human
acuccaaagcaaguuacuaucaac

SEQ ID NO: 870892 - RNA, 24 nt, Human
acuccacaaacaacccuucugacc

SEQ ID NO: 870893 - RNA, 21 nt, Human
acuuugucgcccaggcuguag

SEQ ID NO: 870894 - RNA, 23 nt, Human
agagcugaggggccagcuugagc

SEQ ID NO: 870895 - RNA, 18 nt, Human
agauuccccaccacccac

SEQ ID NO: 870896 - RNA, 23 nt, Human
agauuccccaccacccaccauac

SEQ ID NO: 870897 - RNA, 19 nt, Human
agccgcauagcgaagcucc

SEQ ID NO: 870898 - RNA, 22 nt, Human
agccgcucacucagcuaacccc

SEQ ID NO: 870899 - RNA, 18 nt, Human
aggaaugugccauuuacc

SEQ ID NO: 870900 - RNA, 24 nt, Human
aggcggggguugcagugagcuaag

SEQ ID NO: 870901 - RNA, 22 nt, Human
aggcuggagguggggguauggg

SEQ ID NO: 870902 - RNA, 23 nt, Human
aggcuggagguggggguaugggu

SEQ ID NO: 870903 - RNA, 19 nt, Human
aggcuguagugcaguggca

SEQ ID NO: 870904 - RNA, 28 nt, Human
aggugggggacagauucauagguuuuug

SEQ ID NO: 870905 - RNA, 22 nt, Human
agugcaguggcauucucggcuc

SEQ ID NO: 870906 - RNA, 20 nt, Human
aguuaacugcaacaagccug

SEQ ID NO: 870907 - RNA, 20 nt, Human
caaacaaaaaucacacagua

SEQ ID NO: 870908 - RNA, 24 nt, Human
caacaagccugaaaauuugguuac

SEQ ID NO: 870909 - RNA, 18 nt, Human
caacccagugcaucucca

SEQ ID NO: 870910 - RNA, 23 nt, Human
caaccuccaccucccagguucaa

SEQ ID NO: 870911 - RNA, 22 nt, Human
caagcacagcaaaaggucaccc

SEQ ID NO: 870912 - RNA, 18 nt, Human
caagcgagucuccugaac

SEQ ID NO: 870913 - RNA, 18 nt, Human
caccagcuucccguccug

SEQ ID NO: 870914 - RNA, 19 nt, Human
caccccacaggccacucca

SEQ ID NO: 870915 - RNA, 23 nt, Human
caccucauaacaaacaaucaauc

SEQ ID NO: 870916 - RNA, 24 nt, Human
cacuccagccuagacaacaagagu

SEQ ID NO: 870917 - RNA, 21 nt, Human
cacugcaaccuccaccuccca

SEQ ID NO: 870918 - RNA, 19 nt, Human
cacuggucaguaugcugcc

SEQ ID NO: 870919 - RNA, 24 nt, Human
cacuuugucgcccaggcuguagug

SEQ ID NO: 870920 - RNA, 22 nt, Human
cagaacccuaggcugcugaugc

SEQ ID NO: 870921 - RNA, 22 nt, Human
cagagcugaggggccagcuuga

SEQ ID NO: 870922 - RNA, 22 nt, Human
cagcccagacuccacaaacaag

SEQ ID NO: 870923 - RNA, 23 nt, Human
cagcuaaccccaggauucaaaua

SEQ ID NO: 870924 - RNA, 19 nt, Human
caucaagcacagcaaaagg

SEQ ID NO: 870925 - RNA, 22 nt, Human
ccaccacccaccauacagcucc

SEQ ID NO: 870926 - RNA, 18 nt, Human
ccaccccuccucaagaaa

SEQ ID NO: 870927 - RNA, 19 nt, Human
ccacggcacuccagccuag

SEQ ID NO: 870928 - RNA, 21 nt, Human
ccacggcacuccagccuagac

SEQ ID NO: 870929 - RNA, 24 nt, Human
ccacuggucaguaugcugccuucu

SEQ ID NO: 870930 - RNA, 19 nt, Human
ccagauuccccaccaccca

SEQ ID NO: 870931 - RNA, 18 nt, Human
ccagcauuacuaagguuu

SEQ ID NO: 870932 - RNA, 26 nt, Human
ccagcccagacuccacaaacaacccu

SEQ ID NO: 870933 - RNA, 20 nt, Human
ccaggugucaggaaugugcc

SEQ ID NO: 870934 - RNA, 23 nt, Human
cccagguucaagcgagucucccc

SEQ ID NO: 870935 - RNA, 23 nt, Human
cccagguucaagcgagucuccug

SEQ ID NO: 870936 - RNA, 19 nt, Human
ccccacaggccacuccaaa

SEQ ID NO: 870937 - RNA, 21 nt, Human
ccccaggauucaaauaggacc

SEQ ID NO: 870938 - RNA, 19 nt, Human
cccgggaggcggggguugc

SEQ ID NO: 870939 - RNA, 30 nt, Human
ccgagggccugaucuagcugcugccaagac

SEQ ID NO: 870940 - RNA, 23 nt, Human
ccggccucagaacucuccaaugu

SEQ ID NO: 870941 - RNA, 23 nt, Human
ccuacggcacauacuauuuuguu

SEQ ID NO: 870942 - RNA, 19 nt, Human
ccucaacccagugcaucuc

SEQ ID NO: 870943 - RNA, 21 nt, Human
ccucccagguucaagcgaguc

SEQ ID NO: 870944 - RNA, 24 nt, Human
ccucccagguucaagcgagucucc

SEQ ID NO: 870945 - RNA, 26 nt, Human
cgcaccacggcacuccagccuagaca

SEQ ID NO: 870946 - RNA, 30 nt, Human
cgcaccacggcacuccagccuagacaacaa

SEQ ID NO: 870947 - RNA, 22 nt, Human
cgggaaggaggcggggggaggu

SEQ ID NO: 870948 - RNA, 24 nt, Human
cgggaggcggggguugcagugagc

SEQ ID NO: 870949 - RNA, 21 nt, Human
cuaguuaacugcaacaagccu

SEQ ID NO: 870950 - RNA, 24 nt, Human
cucacugcaaccuccaccucccag

SEQ ID NO: 870951 - RNA, 21 nt, Human
cucagccccagucuucuuagc

SEQ ID NO: 870952 - RNA, 25 nt, Human
cucagucacaccggggaguuuugcu

SEQ ID NO: 870953 - RNA, 24 nt, Human
cucccagauuccccaccacccacc

SEQ ID NO: 870954 - RNA, 20 nt, Human
cucccuguaacucaaaaagc

SEQ ID NO: 870955 - RNA, 23 nt, Human
cucccuuugugggauugaugcaa

SEQ ID NO: 870956 - RNA, 21 nt, Human
cugaaauaagcaacaucaaaa

SEQ ID NO: 870957 - RNA, 24 nt, Human
cugaacccgggaggcggggguugc

SEQ ID NO: 870958 - RNA, 22 nt, Human
cugaccaacagccaccucucag

SEQ ID NO: 870959 - RNA, 24 nt, Human
cugagggcuuucuguuguuacuga

SEQ ID NO: 870960 - RNA, 23 nt, Human
cugcaaccuccaccucccagguu

SEQ ID NO: 870961 - RNA, 23 nt, Human
cugcccagcccagacuccacaaa

SEQ ID NO: 870962 - RNA, 22 nt, Human
cugcuucugaaauaagcaacau

SEQ ID NO: 870963 - RNA, 25 nt, Human
cuucccagcauuacuaagguuucuc

SEQ ID NO: 870964 - RNA, 25 nt, Human
cuucccguccugaccaacagccacc

SEQ ID NO: 870965 - RNA, 26 nt, Human
gaacccuggcauuccaauuagaaacg

SEQ ID NO: 870966 - RNA, 22 nt, Human
gaccacaauuccuccuuguaaa

SEQ ID NO: 870967 - RNA, 21 nt, Human
gaccuagaacaggguaccagg

SEQ ID NO: 870968 - RNA, 22 nt, Human
gcaaccuccaccucccagguuc

SEQ ID NO: 870969 - RNA, 23 nt, Human
gcacagcaaaaggucaccccuuu

SEQ ID NO: 870970 - RNA, 21 nt, Human
gccaccccuccucaagaaaca

SEQ ID NO: 870971 - RNA, 24 nt, Human
gcccaggcuguagugcaguggcau

SEQ ID NO: 870972 - RNA, 20 nt, Human
gccgagguuccugccagacg

SEQ ID NO: 870973 - RNA, 18 nt, Human
ggaaggaggcggggggag

SEQ ID NO: 870974 - RNA, 18 nt, Human
ggaaggaggcggggggag

SEQ ID NO: 870975 - RNA, 21 nt, Human
ggggauuacaagugaagccac

SEQ ID NO: 870976 - RNA, 24 nt, Human
ggggguugcagugagcuaagaucg

SEQ ID NO: 870977 - RNA, 19 nt, Human
gggguugcagugagcuaag

SEQ ID NO: 870978 - RNA, 22 nt, Human
gggguugcagugagcuaagauc

SEQ ID NO: 870979 - RNA, 23 nt, Human
gggguugcagugagcuaagaucg

SEQ ID NO: 870980 - RNA, 19 nt, Human
gggugguccccagacucug

SEQ ID NO: 870981 - RNA, 19 nt, Human
ggugacagagacagcauga

SEQ ID NO: 870982 - RNA, 21 nt, Human
gguugcagugagcuaagaucg

SEQ ID NO: 870983 - RNA, 24 nt, Human
guuacuaucaacacguuuccaacu

SEQ ID NO: 870984 - RNA, 21 nt, Human
guugcagugagcuaagaucgc

SEQ ID NO: 870985 - RNA, 21 nt, Human
uaaaaacaaaacaagcucuac

SEQ ID NO: 870986 - RNA, 22 nt, Human
uaaagcagccgcauagcgaagc

SEQ ID NO: 870987 - RNA, 22 nt, Human
uaacuacucagccccagucuuc

SEQ ID NO: 870988 - RNA, 23 nt, Human
uaacugcaacaagccugaaaauu

SEQ ID NO: 870989 - RNA, 23 nt, Human
uaccagggccuccagcuggaggc

SEQ ID NO: 870990 - RNA, 18 nt, Human
uagaaacguguuucaagg

SEQ ID NO: 870991 - RNA, 21 nt, Human
uagaaucuuaaagcagccgca

SEQ ID NO: 870992 - RNA, 21 nt, Human
uaggcagugcugcccagccca

SEQ ID NO: 870993 - RNA, 24 nt, Human
uaggcagugcugcccagcccagac

SEQ ID NO: 870994 - RNA, 18 nt, Human
uauguaggugcaaagcug

SEQ ID NO: 870995 - RNA, 23 nt, Human
uauucuuauuuaaaaacaaaaca

SEQ ID NO: 870996 - RNA, 19 nt, Human
ucaacaggcuggagguggg

SEQ ID NO: 870997 - RNA, 22 nt, Human
ucaagcacagcaaaaggucacc

SEQ ID NO: 870998 - RNA, 20 nt, Human
ucaccccuuuccggggggac

SEQ ID NO: 870999 - RNA, 21 nt, Human
ucacucagcuaaccccaggau

SEQ ID NO: 871000 - RNA, 24 nt, Human
ucacugcaaccuccaccucccagg

SEQ ID NO: 871001 - RNA, 25 nt, Human
ucacugcaaccuccaccucccaggu

SEQ ID NO: 871002 - RNA, 27 nt, Human
ucacugcaaccuccaccucccagguuc

SEQ ID NO: 871003 - RNA, 18 nt, Human
uccacaaacaacccuucu

SEQ ID NO: 871004 - RNA, 19 nt, Human
ucccacuuugucgcccagg

SEQ ID NO: 871005 - RNA, 22 nt, Human
ucccacuuugucgcccaggcug

SEQ ID NO: 871006 - RNA, 23 nt, Human
ucccacuuugucgcccaggcugu

SEQ ID NO: 871007 - RNA, 24 nt, Human
ucccacuuugucgcccaggcugua

SEQ ID NO: 871008 - RNA, 21 nt, Human
ucccagguucaagcgagucuc

SEQ ID NO: 871009 - RNA, 24 nt, Human
ucccagguucaagcgagucuccug

SEQ ID NO: 871010 - RNA, 24 nt, Human
uccccaccacccaccauacagcuc

SEQ ID NO: 871011 - RNA, 18 nt, Human
uccccagacucugcugcu

SEQ ID NO: 871012 - RNA, 21 nt, Human
uccccagacucugcugcuccu

SEQ ID NO: 871013 - RNA, 24 nt, Human
ucgcccaggcuguagugcaguggc

SEQ ID NO: 871014 - RNA, 22 nt, Human
ucuaggcagugcugcccagccc

SEQ ID NO: 871015 - RNA, 20 nt, Human
ucuccagcuccagcuccgca

SEQ ID NO: 871016 - RNA, 23 nt, Human
ucuccugaacccgggaggcgggg

SEQ ID NO: 871017 - RNA, 23 nt, Human
ucuggccaagauuuuagucuaaa

SEQ ID NO: 871018 - RNA, 26 nt, Human
ugaaauaagcaacaucaaaacagcca

SEQ ID NO: 871019 - RNA, 21 nt, Human
ugaccaacagccaccucucag

SEQ ID NO: 871020 - RNA, 22 nt, Human
ugagccagcuugcaaucccucg

SEQ ID NO: 871021 - RNA, 20 nt, Human
ugaugaccacaauuccuccu

SEQ ID NO: 871022 - RNA, 23 nt, Human
ugcagaggcaguccagagcugag

SEQ ID NO: 871023 - RNA, 20 nt, Human
ugcaguggcauucucggcuc

SEQ ID NO: 871024 - RNA, 20 nt, Human
ugccaaggucaccagcuucc

SEQ ID NO: 871025 - RNA, 23 nt, Human
ugccgagggccugaucuagcugc

SEQ ID NO: 871026 - RNA, 18 nt, Human
ugccuucuccagcuccag

SEQ ID NO: 871027 - RNA, 21 nt, Human
ugcugccaagacaugccaagg

SEQ ID NO: 871028 - RNA, 24 nt, Human
ugcugcccagcccagacuccacaa

SEQ ID NO: 871029 - RNA, 18 nt, Human
ugcugccuucuccagcuc

SEQ ID NO: 871030 - RNA, 28 nt, Human
ugcugcuccuucccagcauuacuaaggu

SEQ ID NO: 871031 - RNA, 18 nt, Human
uggaggcagagagagcca

SEQ ID NO: 871032 - RNA, 22 nt, Human
uggaggcagagagagccacccc

SEQ ID NO: 871033 - RNA, 18 nt, Human
uggagguggggguauggg

SEQ ID NO: 871034 - RNA, 20 nt, Human
uggcaaggagcucuggccaa

SEQ ID NO: 871035 - RNA, 19 nt, Human
ugggugccuucugugugcc

SEQ ID NO: 871036 - RNA, 22 nt, Human
uguagugcaguggcauucucgg

SEQ ID NO: 871037 - RNA, 21 nt, Human
uuacuaagguuucucucccag

SEQ ID NO: 871038 - RNA, 20 nt, Human
uucaagcgagucuccugaac

SEQ ID NO: 871039 - RNA, 21 nt, Human
uuccugugucucugccgaggg

SEQ ID NO: 871040 - RNA, 19 nt, Human
uugcagugagcuaagaucg

SEQ ID NO: 871041 - RNA, 22 nt, Human
uugcagugagcuaagaucgcac

SEQ ID NO: 871042 - RNA, 18 nt, Human
uuuaccggguggucccca

SEQ ID NO: 871043 - RNA, 21 nt, Human
uuucuaguuaacugcaacaag

SEQ ID NO: 871044 - RNA, 24 nt, Human
uuugucgcccaggcuguagugcag

SEQ ID NO: 871045 - RNA, 19 nt, Human
acagcagagagacucugac

SEQ ID NO: 871046 - RNA, 23 nt, Human
cacaaaaccagcccuggcuccaa

SEQ ID NO: 871047 - RNA, 19 nt, Human
cacccugccccuagcacuc

SEQ ID NO: 871048 - RNA, 21 nt, Human
cacucuggccuugccuggccc

SEQ ID NO: 871049 - RNA, 21 nt, Human
cagcagagagacucugaccag

SEQ ID NO: 871050 - RNA, 23 nt, Human
cagcagcccauaguucacuucug

SEQ ID NO: 871051 - RNA, 19 nt, Human
cagcagcuccagcaaccac

SEQ ID NO: 871052 - RNA, 23 nt, Human
cagccccagccucucgguggccu

SEQ ID NO: 871053 - RNA, 22 nt, Human
cagcccuggcuccaagaggccc

SEQ ID NO: 871054 - RNA, 22 nt, Human
ccaugggaaucaaagucacuag

SEQ ID NO: 871055 - RNA, 21 nt, Human
cccauaguucacuucugaagc

SEQ ID NO: 871056 - RNA, 25 nt, Human
ccccagccccagccucucgguggcc

SEQ ID NO: 871057 - RNA, 22 nt, Human
ccccuagcacucuggccuugcc

SEQ ID NO: 871058 - RNA, 19 nt, Human
cccuggcuccaagaggccc

SEQ ID NO: 871059 - RNA, 22 nt, Human
ccuugccuggcccugccagcag

SEQ ID NO: 871060 - RNA, 21 nt, Human
cuccaugggaaucaaagucac

SEQ ID NO: 871061 - RNA, 18 nt, Human
cucucgguggccuccagg

SEQ ID NO: 871062 - RNA, 27 nt, Human
gagagacucugaccagacagguggccc

SEQ ID NO: 871063 - RNA, 20 nt, Human
gcccugccagcagcuccagc

SEQ ID NO: 871064 - RNA, 21 nt, Human
gccuugccuggcccugccagc

SEQ ID NO: 871065 - RNA, 20 nt, Human
ggagacacagggaaauggcc

SEQ ID NO: 871066 - RNA, 22 nt, Human
ggccuugccuggcccugccagc

SEQ ID NO: 871067 - RNA, 18 nt, Human
gggcgcugccuucaucug

SEQ ID NO: 871068 - RNA, 24 nt, Human
gucacuacaacagugagcugaagc

SEQ ID NO: 871069 - RNA, 22 nt, Human
gucagccccagccccagccucu

SEQ ID NO: 871070 - RNA, 30 nt, Human
gucagccccagccccagccucucgguggcc

SEQ ID NO: 871071 - RNA, 22 nt, Human
guggccuccaggucagcauccu

SEQ ID NO: 871072 - RNA, 26 nt, Human
guggucagccccagccccagccucuc

SEQ ID NO: 871073 - RNA, 19 nt, Human
ucacuaguugcucccagca

SEQ ID NO: 871074 - RNA, 20 nt, Human
uccaagaggcccacagcaga

SEQ ID NO: 871075 - RNA, 20 nt, Human
uccaugggaaucaaagucac

SEQ ID NO: 871076 - RNA, 21 nt, Human
ucucgguggccuccaggucag

SEQ ID NO: 871077 - RNA, 25 nt, Human
ucugaagccagagcaagugaggggc

SEQ ID NO: 871078 - RNA, 21 nt, Human
ugaccagacagguggccccag

SEQ ID NO: 871079 - RNA, 24 nt, Human
ugaggggcgcugccuucaucugug

SEQ ID NO: 871080 - RNA, 19 nt, Human
ugccccuagcacucuggcc

SEQ ID NO: 871081 - RNA, 24 nt, Human
ugccuggcccugccagcagcucca

SEQ ID NO: 871082 - RNA, 26 nt, Human
ugcuucauucuugcuggcauaauuca

SEQ ID NO: 871083 - RNA, 20 nt, Human
uggcauaauucauggaugga

SEQ ID NO: 871084 - RNA, 19 nt, Human
uggcccugccagcagcucc

SEQ ID NO: 871085 - RNA, 23 nt, Human
aagggcaaggcacagaaaggcuu

SEQ ID NO: 871086 - RNA, 19 nt, Human
agagccaccaggcuuccuc

SEQ ID NO: 871087 - RNA, 19 nt, Human
agcagcaggccagaugcag

SEQ ID NO: 871088 - RNA, 22 nt, Human
agcagcaggccagaugcagggg

SEQ ID NO: 871089 - RNA, 23 nt, Human
agcuccauggccacggcagccuc

SEQ ID NO: 871090 - RNA, 21 nt, Human
agcuuccagagcuccauggcc

SEQ ID NO: 871091 - RNA, 23 nt, Human
aggggagugggcaaagggcaagg

SEQ ID NO: 871092 - RNA, 23 nt, Human
caccaggcuuccucccccagccc

SEQ ID NO: 871093 - RNA, 18 nt, Human
cagcccagggugaaagcc

SEQ ID NO: 871094 - RNA, 20 nt, Human
cagccucagagccgcagccc

SEQ ID NO: 871095 - RNA, 23 nt, Human
caggggagugggcaaagggcaag

SEQ ID NO: 871096 - RNA, 18 nt, Human
ccaccaggcuuccucccc

SEQ ID NO: 871097 - RNA, 21 nt, Human
cgagaggaaggccgaaccucg

SEQ ID NO: 871098 - RNA, 19 nt, Human
cgccugggggcuccugcag

SEQ ID NO: 871099 - RNA, 18 nt, Human
cuccauggccacggcagc

SEQ ID NO: 871100 - RNA, 19 nt, Human
cucccccagcccagcuucc

SEQ ID NO: 871101 - RNA, 18 nt, Human
cugggcccguguggaacu

SEQ ID NO: 871102 - RNA, 21 nt, Human
cugggcccguguggaacuggg

SEQ ID NO: 871103 - RNA, 24 nt, Human
gcaggggcagcacugggcccgugu

SEQ ID NO: 871104 - RNA, 24 nt, Human
gcauugagggucuuggcaguccca

SEQ ID NO: 871105 - RNA, 21 nt, Human
gcuccugcagcagcaggggcu

SEQ ID NO: 871106 - RNA, 20 nt, Human
gcuuccucccccagcccagc

SEQ ID NO: 871107 - RNA, 27 nt, Human
ggccacggcagccucagagccgcagcc

SEQ ID NO: 871108 - RNA, 24 nt, Human
gggggcuccugcagcagcaggggc

SEQ ID NO: 871109 - RNA, 21 nt, Human
gguaaggaggcagguucagga

SEQ ID NO: 871110 - RNA, 20 nt, Human
gugagcucaggugcuggugc

SEQ ID NO: 871111 - RNA, 20 nt, Human
ucagagccgcagcccagggg

SEQ ID NO: 871112 - RNA, 25 nt, Human
uccauggccacggcagccucagagc

SEQ ID NO: 871113 - RNA, 18 nt, Human
ucccccagcccagcuucc

SEQ ID NO: 871114 - RNA, 18 nt, Human
uccugcagcagcaggggc

SEQ ID NO: 871115 - RNA, 23 nt, Human
ucuuggcagucccaccaggggag

SEQ ID NO: 871116 - RNA, 18 nt, Human
ugagaggcaggcaagagu

SEQ ID NO: 871117 - RNA, 22 nt, Human
ugggggcuccugcagcagcagg

SEQ ID NO: 871118 - RNA, 19 nt, Human
uuuuuuuuuuuugagaggc

SEQ ID NO: 871119 - RNA, 20 nt, Human
uuuuuuuuuuuuugagaggc

SEQ ID NO: 871120 - RNA, 22 nt, Human
uuuuuuuuuuuuuuuugagagg

SEQ ID NO: 871121 - RNA, 21 nt, Human
agaaggagccugaagguggug

SEQ ID NO: 871122 - RNA, 20 nt, Human
agggaugcacuaaguuggaa

SEQ ID NO: 871123 - RNA, 27 nt, Human
agggaugcacuaaguuggaaggaccac

SEQ ID NO: 871124 - RNA, 18 nt, Human
aggugguggcgagaggag

SEQ ID NO: 871125 - RNA, 19 nt, Human
ccagaggauggcaucugga

SEQ ID NO: 871126 - RNA, 19 nt, Human
ccugaaggugguggcgaga

SEQ ID NO: 871127 - RNA, 24 nt, Human
cugaaggugguggcgagaggagcu

SEQ ID NO: 871128 - RNA, 19 nt, Human
gcuugggugggagguggcu

SEQ ID NO: 871129 - RNA, 21 nt, Human
ggagucuugcuaguggcuugg

SEQ ID NO: 871130 - RNA, 19 nt, Human
uaaguuggaaggaccacuu

SEQ ID NO: 871131 - RNA, 22 nt, Human
uggaaggaccacuuguagugug

SEQ ID NO: 871132 - RNA, 22 nt, Human
uggcaucuggaggugaaggguc

SEQ ID NO: 871133 - RNA, 19 nt, Human
uggcuugggugggaggugg

SEQ ID NO: 871134 - RNA, 19 nt, Human
ugugccagaggauggcauc

SEQ ID NO: 871135 - RNA, 21 nt, Human
uuggaaggaccacuuguagug

SEQ ID NO: 871136 - RNA, 20 nt, Human
aauuaccuuacuaauggcac

SEQ ID NO: 871137 - RNA, 19 nt, Human
acgaagcggguaggggguu

SEQ ID NO: 871138 - RNA, 21 nt, Human
caccgucucccuccgccucca

SEQ ID NO: 871139 - RNA, 19 nt, Human
cagcccacccagugacgcc

SEQ ID NO: 871140 - RNA, 23 nt, Human
ccauacuguucauuuuguucuca

SEQ ID NO: 871141 - RNA, 18 nt, Human
cccccugccucgcgccca

SEQ ID NO: 871142 - RNA, 19 nt, Human
ccgccgccgcccgggccgc

SEQ ID NO: 871143 - RNA, 20 nt, Human
ccgcgggcuccuccuccucc

SEQ ID NO: 871144 - RNA, 25 nt, Human
cgaggcggggcccuacggagaaccu

SEQ ID NO: 871145 - RNA, 22 nt, Human
cgggcuccuccuccucccccuc

SEQ ID NO: 871146 - RNA, 21 nt, Human
cuaaaauggucuggucucucu

SEQ ID NO: 871147 - RNA, 18 nt, Human
cuccuccucccccucccc

SEQ ID NO: 871148 - RNA, 19 nt, Human
cucuguuuuuggccugaag

SEQ ID NO: 871149 - RNA, 18 nt, Human
gacgccaccgucucccuc

SEQ ID NO: 871150 - RNA, 22 nt, Human
gagcccagggccccgcggacga

SEQ ID NO: 871151 - RNA, 21 nt, Human
gaggcggggcccuacggagaa

SEQ ID NO: 871152 - RNA, 21 nt, Human
gauaaugcugcgaccuguuug

SEQ ID NO: 871153 - RNA, 20 nt, Human
gccuccacuuccgccccagc

SEQ ID NO: 871154 - RNA, 19 nt, Human
gcuccuccuccucccccuc

SEQ ID NO: 871155 - RNA, 21 nt, Human
ggccucgccgcgagagcccag

SEQ ID NO: 871156 - RNA, 18 nt, Human
guuguuccacaguuucuu

SEQ ID NO: 871157 - RNA, 20 nt, Human
guuuagcugugcggccgugg

SEQ ID NO: 871158 - RNA, 18 nt, Human
uaaaauggucuggucucu

SEQ ID NO: 871159 - RNA, 21 nt, Human
uaagagacgcuuaagugacau

SEQ ID NO: 871160 - RNA, 24 nt, Human
uccacuuccgccccagcccaccca

SEQ ID NO: 871161 - RNA, 21 nt, Human
ucccuccgccuccacuuccgc

SEQ ID NO: 871162 - RNA, 18 nt, Human
uccucagucuccuccucc

SEQ ID NO: 871163 - RNA, 25 nt, Human
uccuccgccgccgcccgcuccgagg

SEQ ID NO: 871164 - RNA, 23 nt, Human
uccuccuccgccgccgcccgcua

SEQ ID NO: 871165 - RNA, 19 nt, Human
uggucuggucucucugcug

SEQ ID NO: 871166 - RNA, 24 nt, Human
uugcuguuuagcugugcggccgug

SEQ ID NO: 871167 - RNA, 24 nt, Human
uugugggcuuuuuccauacuguuc

SEQ ID NO: 871168 - RNA, 20 nt, Human
uuuuccauacuguucauuuu

SEQ ID NO: 871169 - RNA, 21 nt, Human
uuuuuuuuucuuugacaaguu

SEQ ID NO: 871170 - RNA, 18 nt, Human
uuuuuuuuuuuuucuuug

SEQ ID NO: 871171 - RNA, 24 nt, Human
uuuuuuuuuuuuuucuuugacaag

SEQ ID NO: 871172 - RNA, 19 nt, Human
aagggcagggcagcuucca

SEQ ID NO: 871173 - RNA, 18 nt, Human
agcagaaaggccacugca

SEQ ID NO: 871174 - RNA, 18 nt, Human
aggaaggaaagagacauu

SEQ ID NO: 871175 - RNA, 21 nt, Human
caucuaggagaggaaccgucc

SEQ ID NO: 871176 - RNA, 22 nt, Human
ccacucaggaugcaggcggcag

SEQ ID NO: 871177 - RNA, 18 nt, Human
cugagcacagccacaugu

SEQ ID NO: 871178 - RNA, 29 nt, Human
gcggagaagcagccucuuuauucccacaa

SEQ ID NO: 871179 - RNA, 18 nt, Human
ggagaggaaccguccgug

SEQ ID NO: 871180 - RNA, 21 nt, Human
gggcggggcuggcgcuauccg

SEQ ID NO: 871181 - RNA, 24 nt, Human
guggcucuagauacaucuucccac

SEQ ID NO: 871182 - RNA, 22 nt, Human
ucacugggcgugauuccaacau

SEQ ID NO: 871183 - RNA, 23 nt, Human
ucagcggaguuuugggguccucu

SEQ ID NO: 871184 - RNA, 19 nt, Human
ucaggggccuuccaagggc

SEQ ID NO: 871185 - RNA, 21 nt, Human
uccaagggcagggcagcuucc

SEQ ID NO: 871186 - RNA, 18 nt, Human
ucccacaugacaaaaaac

SEQ ID NO: 871187 - RNA, 21 nt, Human
uccuugggagacucugcgcuu

SEQ ID NO: 871188 - RNA, 21 nt, Human
ucuaggagaggaaccguccgu

SEQ ID NO: 871189 - RNA, 20 nt, Human
ugagaauggcagguuuugga

SEQ ID NO: 871190 - RNA, 18 nt, Human
uggccucugagcacagcc

SEQ ID NO: 871191 - RNA, 21 nt, Human
uggcucuagauacaucuuccc

SEQ ID NO: 871192 - RNA, 20 nt, Human
ugugaguugcagggagcugg

SEQ ID NO: 871193 - RNA, 28 nt, Human
uucccacaugacaaaaaacggucuuuau

SEQ ID NO: 871194 - RNA, 18 nt, Human
uuggccucugagcacagc

SEQ ID NO: 871195 - RNA, 21 nt, Human
uuggccucugagcacaggguc

SEQ ID NO: 871196 - RNA, 25 nt, Human
uuuuuuuuuuugcggagaagcagcc

SEQ ID NO: 871197 - RNA, 20 nt, Human
uuuuuuuuuuuuuuuugcgg

SEQ ID NO: 871198 - RNA, 26 nt, Human
aacacacacaugugcaugcacacaca

SEQ ID NO: 871199 - RNA, 29 nt, Human
aacacacacaugugcaugcacacagugug

SEQ ID NO: 871200 - RNA, 23 nt, Human
acaugugcaugcacacacaccca

SEQ ID NO: 871201 - RNA, 22 nt, Human
augcacacacacccaaaguccu

SEQ ID NO: 871202 - RNA, 18 nt, Human
cagcggccgccaccuucu

SEQ ID NO: 871203 - RNA, 23 nt, Human
caugcacacacacccaaaguccu

SEQ ID NO: 871204 - RNA, 18 nt, Human
ccacccaagccccccgcu

SEQ ID NO: 871205 - RNA, 18 nt, Human
ccagcggccgccaccuuc

SEQ ID NO: 871206 - RNA, 21 nt, Human
ccagcggccgccaccuucucc

SEQ ID NO: 871207 - RNA, 21 nt, Human
cccucagccaccucccgggcc

SEQ ID NO: 871208 - RNA, 23 nt, Human
cccucagccaccucccgggccuc

SEQ ID NO: 871209 - RNA, 21 nt, Human
ccgccaccuucuccaccagcu

SEQ ID NO: 871210 - RNA, 20 nt, Human
ccgccuggaccccucagccc

SEQ ID NO: 871211 - RNA, 26 nt, Human
ccuggaccccucagccaccucccggg

SEQ ID NO: 871212 - RNA, 22 nt, Human
ccuuugugcuuuaaacauuccu

SEQ ID NO: 871213 - RNA, 20 nt, Human
cgucccgccgccuggacccc

SEQ ID NO: 871214 - RNA, 27 nt, Human
cucauggaaaacacacacaugugcaug

SEQ ID NO: 871215 - RNA, 22 nt, Human
gaccccucagccaccucccggg

SEQ ID NO: 871216 - RNA, 25 nt, Human
guagaguuuccucccggucuucaaa

SEQ ID NO: 871217 - RNA, 26 nt, Human
guagaguuuccucccggucuucaaaa

SEQ ID NO: 871218 - RNA, 19 nt, Human
gugcaugcacacacaccca

SEQ ID NO: 871219 - RNA, 26 nt, Human
uaaaaagcagugccucauggaaaaca

SEQ ID NO: 871220 - RNA, 19 nt, Human
ucuaaagaugagagggggg

SEQ ID NO: 871221 - RNA, 19 nt, Human
ugagaggggggagggaaau

SEQ ID NO: 871222 - RNA, 21 nt, Human
ugagaggggggagggaaaugc

SEQ ID NO: 871223 - RNA, 20 nt, Human
uucaaaaggccagagucguc

SEQ ID NO: 871224 - RNA, 20 nt, Human
uucugguugccacccaagcc

SEQ ID NO: 871225 - RNA, 19 nt, Human
uuuuuuuuuuuuuuuugcu

SEQ ID NO: 871226 - RNA, 25 nt, Human
uuuuuuuuuuuuuuuugcucaccag

SEQ ID NO: 871227 - RNA, 21 nt, Human
aaaaaaugccacugaucucac

SEQ ID NO: 871228 - RNA, 18 nt, Human
aaaaugccacugaucuca

SEQ ID NO: 871229 - RNA, 21 nt, Human
acguaucagugcuguagacag

SEQ ID NO: 871230 - RNA, 24 nt, Human
cagcacagccuggaaauugcaucc

SEQ ID NO: 871231 - RNA, 19 nt, Human
ccacugaucucacaguuua

SEQ ID NO: 871232 - RNA, 23 nt, Human
cuugacagucacguaucagugcu

SEQ ID NO: 871233 - RNA, 20 nt, Human
uccacagcacagccuggaaa

SEQ ID NO: 871234 - RNA, 18 nt, Human
uucaaaccugcuggaaga

SEQ ID NO: 871235 - RNA, 24 nt, Human
cagcuuuauuaagacaggggcggu

SEQ ID NO: 871236 - RNA, 19 nt, Human
gacaggggcgguagaagaa

SEQ ID NO: 871237 - RNA, 19 nt, Human
uagaagaaggucuccaugc

SEQ ID NO: 871238 - RNA, 19 nt, Human
uuuuuuuuuuuuuugccga

SEQ ID NO: 871239 - RNA, 21 nt, Human
uuuuuuuuuuuuuuuugccga

SEQ ID NO: 871240 - RNA, 21 nt, Human
aaaauucaaaacuagguaacc

SEQ ID NO: 871241 - RNA, 25 nt, Human
aaaauucaaaacuagguaaccgccc

SEQ ID NO: 871242 - RNA, 23 nt, Human
aaagauuccagggaaacugcgca

SEQ ID NO: 871243 - RNA, 25 nt, Human
aacaagugacaaaauucaaaacuag

SEQ ID NO: 871244 - RNA, 23 nt, Human
aaggaugggguguguacgucacc

SEQ ID NO: 871245 - RNA, 20 nt, Human
acugcgcaacagccuggggc

SEQ ID NO: 871246 - RNA, 23 nt, Human
aggcgggagcgauccacagcagc

SEQ ID NO: 871247 - RNA, 19 nt, Human
auccacagcagcugaccca

SEQ ID NO: 871248 - RNA, 21 nt, Human
auuacagugcugucuuuaauu

SEQ ID NO: 871249 - RNA, 22 nt, Human
caacaagugacaaaauucaaaa

SEQ ID NO: 871250 - RNA, 22 nt, Human
ccccauccgagagggaaggggg

SEQ ID NO: 871251 - RNA, 18 nt, Human
cccccuucuccuccucuu

SEQ ID NO: 871252 - RNA, 19 nt, Human
ccuccagccaggaggcggg

SEQ ID NO: 871253 - RNA, 22 nt, Human
ccuccagccaggaggcgggagc

SEQ ID NO: 871254 - RNA, 26 nt, Human
ccuucuaucgcccccaccccuccuuu

SEQ ID NO: 871255 - RNA, 22 nt, Human
cgagaaauauuaaagaccagga

SEQ ID NO: 871256 - RNA, 21 nt, Human
cgucaacaacuauggcgggcg

SEQ ID NO: 871257 - RNA, 26 nt, Human
cgucgcacuccuuuuccccgagacuu

SEQ ID NO: 871258 - RNA, 18 nt, Human
cucauaagguacuugaaa

SEQ ID NO: 871259 - RNA, 18 nt, Human
cugcgcaacagccugggg

SEQ ID NO: 871260 - RNA, 21 nt, Human
cuucuaucgcccccaccccuc

SEQ ID NO: 871261 - RNA, 21 nt, Human
cuucuccuccucuuuggugcc

SEQ ID NO: 871262 - RNA, 20 nt, Human
gauccacagcagcugaccca

SEQ ID NO: 871263 - RNA, 21 nt, Human
gggcggcgggcagaggcggug

SEQ ID NO: 871264 - RNA, 23 nt, Human
uagcagucgaucaaaaagauucc

SEQ ID NO: 871265 - RNA, 20 nt, Human
ucaaaaagauuccagggaaa

SEQ ID NO: 871266 - RNA, 18 nt, Human
ucccccuucuccuccucu

SEQ ID NO: 871267 - RNA, 20 nt, Human
uccccgagacuugguacugg

SEQ ID NO: 871268 - RNA, 19 nt, Human
ucucuggccaucacuccug

SEQ ID NO: 871269 - RNA, 18 nt, Human
ucuucuccacccucgucg

SEQ ID NO: 871270 - RNA, 24 nt, Human
ugaaacuaaaauuuuugccacgaa

SEQ ID NO: 871271 - RNA, 27 nt, Human
ugacaaaauucaaaacuagguaaccgc

SEQ ID NO: 871272 - RNA, 27 nt, Human
ugcccugccauccuucuaucgccccca

SEQ ID NO: 871273 - RNA, 19 nt, Human
ugggaaggacauggucaac

SEQ ID NO: 871274 - RNA, 24 nt, Human
ugggaaggacauggucaacguagc

SEQ ID NO: 871275 - RNA, 25 nt, Human
ugggaaggacauggucaacguagca

SEQ ID NO: 871276 - RNA, 26 nt, Human
uguacacccucaacaagugacaaaau

SEQ ID NO: 871277 - RNA, 22 nt, Human
uucuccacccucgucgcacucc

SEQ ID NO: 871278 - RNA, 19 nt, Human
uugaaacuaaaauuuuugc

SEQ ID NO: 871279 - RNA, 21 nt, Human
aaacaaaaacagagggcuaga

SEQ ID NO: 871280 - RNA, 23 nt, Human
aaacaaaaacagagggcuagagg

SEQ ID NO: 871281 - RNA, 21 nt, Human
aaacaaaaacagagggcuagg

SEQ ID NO: 871282 - RNA, 19 nt, Human
aacagaauucaucaaacaa

SEQ ID NO: 871283 - RNA, 22 nt, Human
aaccaaaacaagcgccgcgccc

SEQ ID NO: 871284 - RNA, 18 nt, Human
aagaggauggguccugga

SEQ ID NO: 871285 - RNA, 20 nt, Human
acacccaaaacccacccaag

SEQ ID NO: 871286 - RNA, 18 nt, Human
acauugucaccccaggga

SEQ ID NO: 871287 - RNA, 20 nt, Human
accccgaagcugccgugggc

SEQ ID NO: 871288 - RNA, 19 nt, Human
agagguccuugccccuuug

SEQ ID NO: 871289 - RNA, 23 nt, Human
agccagcucuauuucagaagucc

SEQ ID NO: 871290 - RNA, 22 nt, Human
auccaggccacuggagccuggg

SEQ ID NO: 871291 - RNA, 21 nt, Human
caaaaacagagggcuagaggc

SEQ ID NO: 871292 - RNA, 18 nt, Human
caaaacaagcgccgcgcc

SEQ ID NO: 871293 - RNA, 24 nt, Human
caaacaaaaacagagggcuagagg

SEQ ID NO: 871294 - RNA, 25 nt, Human
caaacaaaaacagagggcuagaggc

SEQ ID NO: 871295 - RNA, 21 nt, Human
caacacagcacgucuaacgcc

SEQ ID NO: 871296 - RNA, 20 nt, Human
caacacccaaaacccaccca

SEQ ID NO: 871297 - RNA, 24 nt, Human
caagcgccgcgcccggagcugccc

SEQ ID NO: 871298 - RNA, 21 nt, Human
cacaacacagcacgucuaacg

SEQ ID NO: 871299 - RNA, 28 nt, Human
cacccaaaacccacccaagaggaugggg

SEQ ID NO: 871300 - RNA, 18 nt, Human
cacuguguguccaggggc

SEQ ID NO: 871301 - RNA, 28 nt, Human
cagaauucaucaaacaaaaacagagggc

SEQ ID NO: 871302 - RNA, 18 nt, Human
cagagagcccgaaaacga

SEQ ID NO: 871303 - RNA, 18 nt, Human
cagccaacacccaaaacc

SEQ ID NO: 871304 - RNA, 22 nt, Human
caggaacacagcuggcaaccau

SEQ ID NO: 871305 - RNA, 18 nt, Human
cagggugugagcaggcgc

SEQ ID NO: 871306 - RNA, 24 nt, Human
caucaaacaaaaacagagggcuag

SEQ ID NO: 871307 - RNA, 19 nt, Human
ccaacacccaaaacccacc

SEQ ID NO: 871308 - RNA, 22 nt, Human
ccaacacccaaaacccacccaa

SEQ ID NO: 871309 - RNA, 23 nt, Human
ccaacacccaaaacccacccaag

SEQ ID NO: 871310 - RNA, 22 nt, Human
ccacuggagccuggggaaagug

SEQ ID NO: 871311 - RNA, 20 nt, Human
ccaggccacuggagccuggg

SEQ ID NO: 871312 - RNA, 21 nt, Human
cccagccaacacccaaaaccc

SEQ ID NO: 871313 - RNA, 27 nt, Human
cccggcuccccuuacccagccaacacc

SEQ ID NO: 871314 - RNA, 20 nt, Human
cgcccggagcugcccacguc

SEQ ID NO: 871315 - RNA, 20 nt, Human
cgccgcgcccggagcugccc

SEQ ID NO: 871316 - RNA, 23 nt, Human
cuccccuuacccagccaacaccc

SEQ ID NO: 871317 - RNA, 24 nt, Human
gaccccauagguuauaacagaauu

SEQ ID NO: 871318 - RNA, 23 nt, Human
gccaacacccaaaacccacccaa

SEQ ID NO: 871319 - RNA, 21 nt, Human
gcgccgcgcccggagcugccc

SEQ ID NO: 871320 - RNA, 19 nt, Human
ggcaggagcccgccccagg

SEQ ID NO: 871321 - RNA, 20 nt, Human
ggcgcggcagcuggugcagg

SEQ ID NO: 871322 - RNA, 21 nt, Human
ggcuugcggaacugcgggcuc

SEQ ID NO: 871323 - RNA, 19 nt, Human
gggcucagagagcccgaaa

SEQ ID NO: 871324 - RNA, 21 nt, Human
ggucagggugugagcaggcgc

SEQ ID NO: 871325 - RNA, 23 nt, Human
guguguccaggggccaggaacac

SEQ ID NO: 871326 - RNA, 24 nt, Human
uacccagccaacacccaaaaccca

SEQ ID NO: 871327 - RNA, 22 nt, Human
uagaaggaaaccaaaacaagcg

SEQ ID NO: 871328 - RNA, 20 nt, Human
uagaggccaguguccaugag

SEQ ID NO: 871329 - RNA, 22 nt, Human
uagaggccaguguccaugagag

SEQ ID NO: 871330 - RNA, 22 nt, Human
uauacauugucaccccagggag

SEQ ID NO: 871331 - RNA, 23 nt, Human
ucaaacaaaaacagagggcuaga

SEQ ID NO: 871332 - RNA, 19 nt, Human
uccccggcuccccuuaccc

SEQ ID NO: 871333 - RNA, 27 nt, Human
ugaggaugccacacuguguguccaggg

SEQ ID NO: 871334 - RNA, 20 nt, Human
ugcaaacaugaggaugccac

SEQ ID NO: 871335 - RNA, 21 nt, Human
ugcaaacaugaggaugccaca

SEQ ID NO: 871336 - RNA, 22 nt, Human
ugccacacuguguguccagggg

SEQ ID NO: 871337 - RNA, 22 nt, Human
ugcccaggacucauauccugac

SEQ ID NO: 871338 - RNA, 23 nt, Human
uguccaugagagguccuugcccc

SEQ ID NO: 871339 - RNA, 25 nt, Human
uugcauauauacauugucaccccuc

SEQ ID NO: 871340 - RNA, 19 nt, Human
uuuaaagauuucucaauuu

SEQ ID NO: 871341 - RNA, 25 nt, Human
uuuuuuuuuuuuuaaagauuucuca

SEQ ID NO: 871342 - RNA, 18 nt, Human
aaaaaggagcacaacaaa

SEQ ID NO: 871343 - RNA, 20 nt, Human
aaaaaggagcacaacaaaca

SEQ ID NO: 871344 - RNA, 22 nt, Human
aaaggagcacaacaaacaugca

SEQ ID NO: 871345 - RNA, 19 nt, Human
aacagaaaaaaggagcaca

SEQ ID NO: 871346 - RNA, 23 nt, Human
aacucaacaccauugcucccaug

SEQ ID NO: 871347 - RNA, 23 nt, Human
accuuccuccaggucaccuacug

SEQ ID NO: 871348 - RNA, 24 nt, Human
agaaaaaaggagcacaacaaacau

SEQ ID NO: 871349 - RNA, 23 nt, Human
agaaacacaacuuguccccucau

SEQ ID NO: 871350 - RNA, 21 nt, Human
agaggucacauccccuaagcc

SEQ ID NO: 871351 - RNA, 23 nt, Human
agccagcaaguggcagcccccag

SEQ ID NO: 871352 - RNA, 18 nt, Human
agggaugcuucaggaugc

SEQ ID NO: 871353 - RNA, 20 nt, Human
agugagugagcaccagcugc

SEQ ID NO: 871354 - RNA, 22 nt, Human
caacagaaaaaaggagcacaac

SEQ ID NO: 871355 - RNA, 18 nt, Human
caacaggcucuuccuacu

SEQ ID NO: 871356 - RNA, 27 nt, Human
caacaggcucuuccuacuucucucauc

SEQ ID NO: 871357 - RNA, 23 nt, Human
caacuuguccccucaugguuucc

SEQ ID NO: 871358 - RNA, 24 nt, Human
cagccagcaaguggcagcccccag

SEQ ID NO: 871359 - RNA, 19 nt, Human
caggcucuuccuacuucuc

SEQ ID NO: 871360 - RNA, 23 nt, Human
cagucagacuguagagugucacc

SEQ ID NO: 871361 - RNA, 18 nt, Human
cauuucaccugcugucug

SEQ ID NO: 871362 - RNA, 18 nt, Human
ccaacagaaaaaaggagc

SEQ ID NO: 871363 - RNA, 19 nt, Human
ccagcugcuggggauccag

SEQ ID NO: 871364 - RNA, 18 nt, Human
cggaaaacagaaacacaa

SEQ ID NO: 871365 - RNA, 19 nt, Human
cucaaggauuauucuggga

SEQ ID NO: 871366 - RNA, 27 nt, Human
cuccaggucaccuacuguagagcucgc

SEQ ID NO: 871367 - RNA, 25 nt, Human
cucguacucccccugguauucgaca

SEQ ID NO: 871368 - RNA, 23 nt, Human
cugcggcuucauucuugaaguca

SEQ ID NO: 871369 - RNA, 24 nt, Human
gaaaaaaggagcacaacaaacaug

SEQ ID NO: 871370 - RNA, 20 nt, Human
gaagguuguauggcacagug

SEQ ID NO: 871371 - RNA, 20 nt, Human
gacuuguagacaacaggcuc

SEQ ID NO: 871372 - RNA, 19 nt, Human
gcggaaaacagaaacacaa

SEQ ID NO: 871373 - RNA, 20 nt, Human
gcuuuuggccaggguggccc

SEQ ID NO: 871374 - RNA, 21 nt, Human
ggaaaacagaaacacaacuug

SEQ ID NO: 871375 - RNA, 23 nt, Human
ggcuucaccugggcccuuccgca

SEQ ID NO: 871376 - RNA, 21 nt, Human
ggggauccagauguggcucgu

SEQ ID NO: 871377 - RNA, 18 nt, Human
gugagaucaagaacccac

SEQ ID NO: 871378 - RNA, 19 nt, Human
guggcccugacacgaaggu

SEQ ID NO: 871379 - RNA, 20 nt, Human
guggcccuuuuuauuugcuu

SEQ ID NO: 871380 - RNA, 21 nt, Human
guguagaguccuugaucauuc

SEQ ID NO: 871381 - RNA, 23 nt, Human
guguguagaguccuugaucauuc

SEQ ID NO: 871382 - RNA, 22 nt, Human
uacagaugagaaaacuuaggac

SEQ ID NO: 871383 - RNA, 24 nt, Human
uacuucucucaucccuuguccgug

SEQ ID NO: 871384 - RNA, 19 nt, Human
uaguucauggauccuccgu

SEQ ID NO: 871385 - RNA, 20 nt, Human
uauguguacguguguauaua

SEQ ID NO: 871386 - RNA, 22 nt, Human
ucacauccccuaagccucaguc

SEQ ID NO: 871387 - RNA, 25 nt, Human
ucccaggguugcucagccagccgua

SEQ ID NO: 871388 - RNA, 22 nt, Human
ucccccauuacagaugagaaaa

SEQ ID NO: 871389 - RNA, 23 nt, Human
uccccuaagccucagucaguguu

SEQ ID NO: 871390 - RNA, 21 nt, Human
uccguggcggaaaacagaaac

SEQ ID NO: 871391 - RNA, 19 nt, Human
ucgacagaauaguacacug

SEQ ID NO: 871392 - RNA, 24 nt, Human
ucgcuaagccauuccccucugcac

SEQ ID NO: 871393 - RNA, 23 nt, Human
ucuagacuuguagacaacaggcu

SEQ ID NO: 871394 - RNA, 22 nt, Human
ucucaaggauuauucugggaaa

SEQ ID NO: 871395 - RNA, 18 nt, Human
ucugaugguugcuucuag

SEQ ID NO: 871396 - RNA, 26 nt, Human
ucuguacuuuaccaacagaaaaaagg

SEQ ID NO: 871397 - RNA, 28 nt, Human
ucuguguguguguguuuagcaggugugu

SEQ ID NO: 871398 - RNA, 18 nt, Human
ugaagucacuuuucccag

SEQ ID NO: 871399 - RNA, 18 nt, Human
ugaaucagucagacugua

SEQ ID NO: 871400 - RNA, 18 nt, Human
ugagaucaagaacccacc

SEQ ID NO: 871401 - RNA, 19 nt, Human
ugagaucaagaacccacca

SEQ ID NO: 871402 - RNA, 21 nt, Human
uggccgugaugucaucaguga

SEQ ID NO: 871403 - RNA, 21 nt, Human
ugggcucuccaagccacccag

SEQ ID NO: 871404 - RNA, 23 nt, Human
ugggcucuccaagccacccagug

SEQ ID NO: 871405 - RNA, 25 nt, Human
uggguguauuuauguguacgugugu

SEQ ID NO: 871406 - RNA, 24 nt, Human
uguacuuuaccaacagaaaaaagg

SEQ ID NO: 871407 - RNA, 24 nt, Human
uguagguaauucccccauuacaga

SEQ ID NO: 871408 - RNA, 18 nt, Human
uguguacguguguauaua

SEQ ID NO: 871409 - RNA, 27 nt, Human
uguguguguguguuuagcaggugugua

SEQ ID NO: 871410 - RNA, 24 nt, Human
uguugguugagaguacagagaggu

SEQ ID NO: 871411 - RNA, 20 nt, Human
uuccuccaggucaccuacug

SEQ ID NO: 871412 - RNA, 25 nt, Human
uugaagucagugagaucaagaaccc

SEQ ID NO: 871413 - RNA, 27 nt, Human
uugaagucagugagaucaagaacccac

SEQ ID NO: 871414 - RNA, 19 nt, Human
uuguccccucaugguuucc

SEQ ID NO: 871415 - RNA, 24 nt, Human
uuuuuuuuuuugaccgcuuuuggc

SEQ ID NO: 871416 - RNA, 26 nt, Human
uuuuuuuuuuuuuugaccgcuuuugg

SEQ ID NO: 871417 - RNA, 25 nt, Human
uuuuuuuuuuuuuuugaccgcuuuu

SEQ ID NO: 871418 - RNA, 20 nt, Human
aaccuuuugcuccacccccu

SEQ ID NO: 871419 - RNA, 18 nt, Human
agaauccuccauccagca

SEQ ID NO: 871420 - RNA, 20 nt, Human
agagcacgcuucccaucuug

SEQ ID NO: 871421 - RNA, 23 nt, Human
agaggaacccagggcggcagcag

SEQ ID NO: 871422 - RNA, 19 nt, Human
agcagcagggggccccagg

SEQ ID NO: 871423 - RNA, 23 nt, Human
aggaaggaugaaggaugaguguc

SEQ ID NO: 871424 - RNA, 23 nt, Human
agguggggaccugggugggcagg

SEQ ID NO: 871425 - RNA, 23 nt, Human
aguccucucuccucccuuuguug

SEQ ID NO: 871426 - RNA, 19 nt, Human
auaccacuuagcacagagu

SEQ ID NO: 871427 - RNA, 21 nt, Human
auagaggaacccagggcggca

SEQ ID NO: 871428 - RNA, 19 nt, Human
auccugacucugucccugg

SEQ ID NO: 871429 - RNA, 19 nt, Human
cacagcagcagggggcccc

SEQ ID NO: 871430 - RNA, 24 nt, Human
caccugagccugugcacaggcccu

SEQ ID NO: 871431 - RNA, 21 nt, Human
cagaauccuccauccagcauc

SEQ ID NO: 871432 - RNA, 23 nt, Human
cagaauccuccauccagcaucuu

SEQ ID NO: 871433 - RNA, 22 nt, Human
cagauaccacuuagcacagagu

SEQ ID NO: 871434 - RNA, 24 nt, Human
cagccuaagcugggggucaaaggc

SEQ ID NO: 871435 - RNA, 18 nt, Human
caggaaggaugaaggaug

SEQ ID NO: 871436 - RNA, 23 nt, Human
caggacagagcuggugcugaagg

SEQ ID NO: 871437 - RNA, 21 nt, Human
caucuuguggacucggagggu

SEQ ID NO: 871438 - RNA, 24 nt, Human
cauugcacgcaugcggggcaugug

SEQ ID NO: 871439 - RNA, 23 nt, Human
cauuuguuaacagucuguccucc

SEQ ID NO: 871440 - RNA, 21 nt, Human
ccaaccuuuugcuccaccccc

SEQ ID NO: 871441 - RNA, 20 nt, Human
ccacaguuggggggaagggc

SEQ ID NO: 871442 - RNA, 20 nt, Human
ccaccagggggggaaccagg

SEQ ID NO: 871443 - RNA, 21 nt, Human
ccagugaguccucucuccucc

SEQ ID NO: 871444 - RNA, 24 nt, Human
ccauccagcaucuucccuggucac

SEQ ID NO: 871445 - RNA, 20 nt, Human
ccaucgacccaggacagagc

SEQ ID NO: 871446 - RNA, 22 nt, Human
ccauggggcugggcuuuccucc

SEQ ID NO: 871447 - RNA, 23 nt, Human
cccaaccuuuugcuccacccccu

SEQ ID NO: 871448 - RNA, 21 nt, Human
cccagccugccacccacccac

SEQ ID NO: 871449 - RNA, 18 nt, Human
ccccagauaccacuuagc

SEQ ID NO: 871450 - RNA, 20 nt, Human
ccccccgcaguccaugcucc

SEQ ID NO: 871451 - RNA, 23 nt, Human
ccccuggccccuucacuccccca

SEQ ID NO: 871452 - RNA, 19 nt, Human
ccccuucacucccccaggg

SEQ ID NO: 871453 - RNA, 20 nt, Human
cccuggccccuucacucccc

SEQ ID NO: 871454 - RNA, 22 nt, Human
ccgcucccuccccgccuagccc

SEQ ID NO: 871455 - RNA, 22 nt, Human
ccguccacaaaugagguucaga

SEQ ID NO: 871456 - RNA, 21 nt, Human
ccuaagcugggggucaaaggc

SEQ ID NO: 871457 - RNA, 20 nt, Human
ccuccccgccuagccccugc

SEQ ID NO: 871458 - RNA, 25 nt, Human
ccucucuccucccuuuguugacucc

SEQ ID NO: 871459 - RNA, 25 nt, Human
ccuugugucacagccgacacucuug

SEQ ID NO: 871460 - RNA, 19 nt, Human
cgacccaggacagagcugg

SEQ ID NO: 871461 - RNA, 18 nt, Human
cggcgggaugggcccggc

SEQ ID NO: 871462 - RNA, 18 nt, Human
cgggaugggcccggcccg

SEQ ID NO: 871463 - RNA, 22 nt, Human
cuaggcccagccugccacccac

SEQ ID NO: 871464 - RNA, 21 nt, Human
cuccacuagacugugaacucc

SEQ ID NO: 871465 - RNA, 18 nt, Human
cucccuccccgccuagcc

SEQ ID NO: 871466 - RNA, 26 nt, Human
cuccucccuuuguugacuccugaccg

SEQ ID NO: 871467 - RNA, 21 nt, Human
cugacucugucccuggauuuc

SEQ ID NO: 871468 - RNA, 21 nt, Human
cugccacaaccugauuuguac

SEQ ID NO: 871469 - RNA, 21 nt, Human
cugccacccacccaccacuca

SEQ ID NO: 871470 - RNA, 25 nt, Human
cugccacccacccaccacucacuug

SEQ ID NO: 871471 - RNA, 20 nt, Human
cuggcuuacugacaccugag

SEQ ID NO: 871472 - RNA, 21 nt, Human
cuuguggacuugcuucccauc

SEQ ID NO: 871473 - RNA, 19 nt, Human
gaaggccccaucagcauga

SEQ ID NO: 871474 - RNA, 19 nt, Human
gacacucuugaccagugag

SEQ ID NO: 871475 - RNA, 23 nt, Human
gcagagcucccucugggcugcag

SEQ ID NO: 871476 - RNA, 23 nt, Human
gcaguccaugcuccagccauccu

SEQ ID NO: 871477 - RNA, 24 nt, Human
gcauagccagccuaagcugggggu

SEQ ID NO: 871478 - RNA, 26 nt, Human
gccacaaccugauuuguacucugauc

SEQ ID NO: 871479 - RNA, 20 nt, Human
gcggcagcaggaaggaugaa

SEQ ID NO: 871480 - RNA, 24 nt, Human
ggaagggcaaggccauggggcugg

SEQ ID NO: 871481 - RNA, 21 nt, Human
ggacucggaggguuccgagca

SEQ ID NO: 871482 - RNA, 18 nt, Human
ggcaaggccauggggcug

SEQ ID NO: 871483 - RNA, 19 nt, Human
gggcacagcagcagggggc

SEQ ID NO: 871484 - RNA, 22 nt, Human
gggcacagcagcagggggcccc

SEQ ID NO: 871485 - RNA, 20 nt, Human
uagaggaacccagggcggca

SEQ ID NO: 871486 - RNA, 22 nt, Human
uauagaggaacccagggcggca

SEQ ID NO: 871487 - RNA, 23 nt, Human
uauuaucaucaucagcacagugc

SEQ ID NO: 871488 - RNA, 22 nt, Human
ucccaaccuuuugcuccacccc

SEQ ID NO: 871489 - RNA, 23 nt, Human
ucccacaugcagagcucccucug

SEQ ID NO: 871490 - RNA, 25 nt, Human
ucccuggucacauggucccaaccuu

SEQ ID NO: 871491 - RNA, 23 nt, Human
uccuuggggggccacaguugggg

SEQ ID NO: 871492 - RNA, 22 nt, Human
ucgacccaggacagagcuggug

SEQ ID NO: 871493 - RNA, 20 nt, Human
ucuuggggaccuccuugggg

SEQ ID NO: 871494 - RNA, 20 nt, Human
ugacugggguggagaucuug

SEQ ID NO: 871495 - RNA, 24 nt, Human
ugacugggguggagaucuugggga

SEQ ID NO: 871496 - RNA, 18 nt, Human
ugagcagcgagguuuaua

SEQ ID NO: 871497 - RNA, 20 nt, Human
ugaggccugccacaaccuga

SEQ ID NO: 871498 - RNA, 21 nt, Human
ugaguccucucuccucccuuu

SEQ ID NO: 871499 - RNA, 18 nt, Human
ugccauuuguuaacaguc

SEQ ID NO: 871500 - RNA, 22 nt, Human
ugcggggcacauggugggcauu

SEQ ID NO: 871501 - RNA, 24 nt, Human
uggauuucuggcuuacugacaccu

SEQ ID NO: 871502 - RNA, 22 nt, Human
ugggaugccccaggaagggcaa

SEQ ID NO: 871503 - RNA, 21 nt, Human
uggggaccugggugggcaggu

SEQ ID NO: 871504 - RNA, 18 nt, Human
uggggcugggcuuuccuc

SEQ ID NO: 871505 - RNA, 19 nt, Human
uggggcugggcuuuccucc

SEQ ID NO: 871506 - RNA, 24 nt, Human
ugggggcagcugagcagcgagguu

SEQ ID NO: 871507 - RNA, 20 nt, Human
uggugggcauucagggauga

SEQ ID NO: 871508 - RNA, 22 nt, Human
uguggcugugccagcagggagu

SEQ ID NO: 871509 - RNA, 20 nt, Human
ugugggacuugugggggcag

SEQ ID NO: 871510 - RNA, 23 nt, Human
uuagcacagagucgagcccauag

SEQ ID NO: 871511 - RNA, 19 nt, Human
uucucuguuccccccgcag

SEQ ID NO: 871512 - RNA, 23 nt, Human
uuucuggcuuacugacaccugag

SEQ ID NO: 871513 - RNA, 25 nt, Human
uuugcuccacccccuucucuguucc

SEQ ID NO: 871514 - RNA, 18 nt, Human
uuuugcuccacccccuuc

SEQ ID NO: 871515 - RNA, 24 nt, Human
uuuuuuuuuuuuggagagugcuca

SEQ ID NO: 871516 - RNA, 20 nt, Human
uuuuuuuuuuuuuuuuuugg

SEQ ID NO: 871517 - RNA, 20 nt, Human
aaaaaccaaaaggcaguaca

SEQ ID NO: 871518 - RNA, 24 nt, Human
aaaacaaaagcaaaaagagugcaa

SEQ ID NO: 871519 - RNA, 23 nt, Human
aaacaaacguggggaaaaagcaa

SEQ ID NO: 871520 - RNA, 22 nt, Human
aaagccccuugcccugauucua

SEQ ID NO: 871521 - RNA, 18 nt, Human
aaccucaguccugcaucc

SEQ ID NO: 871522 - RNA, 25 nt, Human
aagagauggcaggcuuaaaaaggaa

SEQ ID NO: 871523 - RNA, 24 nt, Human
aaggcacccaguccagaguagugc

SEQ ID NO: 871524 - RNA, 24 nt, Human
aaggcacucaccuaucacuaaccc

SEQ ID NO: 871525 - RNA, 18 nt, Human
aauccuucucucucugcc

SEQ ID NO: 871526 - RNA, 20 nt, Human
aaucucagucuccugaucug

SEQ ID NO: 871527 - RNA, 23 nt, Human
aaugccagaauccuggaaaugag

SEQ ID NO: 871528 - RNA, 21 nt, Human
accagccaccccccuuuguug

SEQ ID NO: 871529 - RNA, 23 nt, Human
accccagaccuccuccccuucuc

SEQ ID NO: 871530 - RNA, 24 nt, Human
accuauaccaauccaauccagggg

SEQ ID NO: 871531 - RNA, 23 nt, Human
acgcugugugcacggacagcucc

SEQ ID NO: 871532 - RNA, 22 nt, Human
acucugggagcaaccucagucc

SEQ ID NO: 871533 - RNA, 22 nt, Human
agacaggaaagaugcucccuaa

SEQ ID NO: 871534 - RNA, 18 nt, Human
agaguaacauguaaugug

SEQ ID NO: 871535 - RNA, 19 nt, Human
agcagcucccuuccgcaga

SEQ ID NO: 871536 - RNA, 18 nt, Human
agccagaagccagggccg

SEQ ID NO: 871537 - RNA, 22 nt, Human
agcccaacagaggugcaaacug

SEQ ID NO: 871538 - RNA, 22 nt, Human
agcugugcaugccuggagcccc

SEQ ID NO: 871539 - RNA, 24 nt, Human
aggaaaaguaccagacagacagaa

SEQ ID NO: 871540 - RNA, 21 nt, Human
aggagggugggaaagcguggg

SEQ ID NO: 871541 - RNA, 19 nt, Human
aggaugucuccgagcaaaa

SEQ ID NO: 871542 - RNA, 18 nt, Human
aggcagcccagaaaggag

SEQ ID NO: 871543 - RNA, 19 nt, Human
agggauggugggucugagc

SEQ ID NO: 871544 - RNA, 18 nt, Human
agggaugucauagcagcc

SEQ ID NO: 871545 - RNA, 23 nt, Human
auaggauguggccaggagaguca

SEQ ID NO: 871546 - RNA, 29 nt, Human
aucucgcacaccucugcagucccuuccaa

SEQ ID NO: 871547 - RNA, 19 nt, Human
auuuccacaaauauuucua

SEQ ID NO: 871548 - RNA, 18 nt, Human
caaaaagagugcaaaggc

SEQ ID NO: 871549 - RNA, 19 nt, Human
caaaagcaaaaagagugca

SEQ ID NO: 871550 - RNA, 22 nt, Human
caaaaugccagaucugccugcg

SEQ ID NO: 871551 - RNA, 21 nt, Human
caacacaggaguugaaagagc

SEQ ID NO: 871552 - RNA, 22 nt, Human
caacuacaaaaggggacuaaug

SEQ ID NO: 871553 - RNA, 20 nt, Human
caccagccaccccccuuugu

SEQ ID NO: 871554 - RNA, 18 nt, Human
cacgcaaacacacacaca

SEQ ID NO: 871555 - RNA, 18 nt, Human
cacgcacagccaccggcg

SEQ ID NO: 871556 - RNA, 26 nt, Human
cagaaccaagauggcuggacucaaau

SEQ ID NO: 871557 - RNA, 19 nt, Human
cagagaacgcugugugcac

SEQ ID NO: 871558 - RNA, 23 nt, Human
cagagcuguucugcaaagaaaaa

SEQ ID NO: 871559 - RNA, 20 nt, Human
cagcagguuugcacagggug

SEQ ID NO: 871560 - RNA, 19 nt, Human
cagcauuucuaggguacgu

SEQ ID NO: 871561 - RNA, 20 nt, Human
cagccaccggcgacucuagc

SEQ ID NO: 871562 - RNA, 20 nt, Human
cagcccagaaaggaggcaca

SEQ ID NO: 871563 - RNA, 18 nt, Human
caggaaccagcucaggag

SEQ ID NO: 871564 - RNA, 18 nt, Human
caggaggccaccugaucc

SEQ ID NO: 871565 - RNA, 23 nt, Human
caugacagccaggagcauccugg

SEQ ID NO: 871566 - RNA, 23 nt, Human
cauggaauuaguccacagcauuu

SEQ ID NO: 871567 - RNA, 18 nt, Human
ccagaaaggaggcacagg

SEQ ID NO: 871568 - RNA, 18 nt, Human
ccagaccuccuccccuuc

SEQ ID NO: 871569 - RNA, 22 nt, Human
ccagaccuccuccccuucucuc

SEQ ID NO: 871570 - RNA, 23 nt, Human
ccaucugacaaagacuguucuga

SEQ ID NO: 871571 - RNA, 23 nt, Human
cccacaguggcucaccagggagg

SEQ ID NO: 871572 - RNA, 19 nt, Human
cccacgcacagccaccggc

SEQ ID NO: 871573 - RNA, 20 nt, Human
cccacgcacagccaccggcg

SEQ ID NO: 871574 - RNA, 19 nt, Human
cccagaaaggaggcacagg

SEQ ID NO: 871575 - RNA, 23 nt, Human
cccagaccuccuccccuucucuc

SEQ ID NO: 871576 - RNA, 18 nt, Human
ccccacgcacagccaccg

SEQ ID NO: 871577 - RNA, 18 nt, Human
cccggaagcgagaagcag

SEQ ID NO: 871578 - RNA, 23 nt, Human
ccgccuucccagcagcucccuuc

SEQ ID NO: 871579 - RNA, 22 nt, Human
ccgcggacucuggaaaccccag

SEQ ID NO: 871580 - RNA, 20 nt, Human
ccggccaagagauggcgggg

SEQ ID NO: 871581 - RNA, 23 nt, Human
ccggcgacucuagccacccugga

SEQ ID NO: 871582 - RNA, 21 nt, Human
ccuaucacuaacccuuucgaa

SEQ ID NO: 871583 - RNA, 18 nt, Human
ccucauuccacucaucuc

SEQ ID NO: 871584 - RNA, 19 nt, Human
ccuccugucccuccagccc

SEQ ID NO: 871585 - RNA, 18 nt, Human
ccucugcagggccaggga

SEQ ID NO: 871586 - RNA, 22 nt, Human
ccucugcagggccagggaugaa

SEQ ID NO: 871587 - RNA, 21 nt, Human
ccucugggcuacccgaggcuc

SEQ ID NO: 871588 - RNA, 22 nt, Human
ccugcgcuccuuucagacuaga

SEQ ID NO: 871589 - RNA, 21 nt, Human
ccuggauaguaaaggugcccu

SEQ ID NO: 871590 - RNA, 18 nt, Human
ccuggggccucauuccac

SEQ ID NO: 871591 - RNA, 21 nt, Human
cgcacugcccaagacacuguu

SEQ ID NO: 871592 - RNA, 21 nt, Human
cgcucuggcgaccccggaagc

SEQ ID NO: 871593 - RNA, 19 nt, Human
cggcacagacaggaaagau

SEQ ID NO: 871594 - RNA, 19 nt, Human
cgggaggggcgcucuggcg

SEQ ID NO: 871595 - RNA, 21 nt, Human
cucacuuucaaagagauggca

SEQ ID NO: 871596 - RNA, 19 nt, Human
cucauuccacucaucucgc

SEQ ID NO: 871597 - RNA, 19 nt, Human
cuccccuucucucgcacga

SEQ ID NO: 871598 - RNA, 24 nt, Human
cuccuccccuucucucgcacgauc

SEQ ID NO: 871599 - RNA, 24 nt, Human
cuccugagccaacacaggaguuga

SEQ ID NO: 871600 - RNA, 22 nt, Human
cucuggcgaccccggaagcgag

SEQ ID NO: 871601 - RNA, 18 nt, Human
cugaaaggcacucaccua

SEQ ID NO: 871602 - RNA, 18 nt, Human
cugaucugaauaauggac

SEQ ID NO: 871603 - RNA, 20 nt, Human
cugaucugaauaauggacac

SEQ ID NO: 871604 - RNA, 24 nt, Human
cugcaggccccaaacucaccuucu

SEQ ID NO: 871605 - RNA, 21 nt, Human
cugggagcaaccucaguccug

SEQ ID NO: 871606 - RNA, 27 nt, Human
cuucuuagcaaaaccgcggacucuggg

SEQ ID NO: 871607 - RNA, 18 nt, Human
gagauggcaggcuuaaaa

SEQ ID NO: 871608 - RNA, 21 nt, Human
gagcugugcaugccuggagcc

SEQ ID NO: 871609 - RNA, 20 nt, Human
gagggggcuggggagcacag

SEQ ID NO: 871610 - RNA, 24 nt, Human
gccagggccgccuggcaggccuau

SEQ ID NO: 871611 - RNA, 18 nt, Human
gcccuccugucccuccag

SEQ ID NO: 871612 - RNA, 23 nt, Human
ggaauacauacacugugggguua

SEQ ID NO: 871613 - RNA, 18 nt, Human
ggagccccucacccaccu

SEQ ID NO: 871614 - RNA, 21 nt, Human
ggauaguaaaggugcccuuuc

SEQ ID NO: 871615 - RNA, 24 nt, Human
ggguggcgggaggggcgcucuggc

SEQ ID NO: 871616 - RNA, 18 nt, Human
gucccuccagcccucccu

SEQ ID NO: 871617 - RNA, 18 nt, Human
gugaaguaggaggguggg

SEQ ID NO: 871618 - RNA, 24 nt, Human
gugcacgcaaacacacacacacac

SEQ ID NO: 871619 - RNA, 23 nt, Human
gugcaugccuggagccccuggga

SEQ ID NO: 871620 - RNA, 21 nt, Human
guggcucaccagggagggcag

SEQ ID NO: 871621 - RNA, 22 nt, Human
guggucucuggcaaguucccuu

SEQ ID NO: 871622 - RNA, 19 nt, Human
guugcugagcugaucaagu

SEQ ID NO: 871623 - RNA, 23 nt, Human
uaaaacaaaagcaaaaagagugc

SEQ ID NO: 871624 - RNA, 24 nt, Human
uaaaacaaaagcaaaaagagugca

SEQ ID NO: 871625 - RNA, 18 nt, Human
uaaaaugaacagccaaua

SEQ ID NO: 871626 - RNA, 23 nt, Human
uaaaaugaacagccaauacucuc

SEQ ID NO: 871627 - RNA, 19 nt, Human
uaaugggcuuggucuguga

SEQ ID NO: 871628 - RNA, 20 nt, Human
uaaugggcuuggucugugau

SEQ ID NO: 871629 - RNA, 19 nt, Human
uacccgaggcucugcaggc

SEQ ID NO: 871630 - RNA, 23 nt, Human
uaucaaaaaauaaugcaugaggu

SEQ ID NO: 871631 - RNA, 21 nt, Human
ucaccuaucacuaacccuuuc

SEQ ID NO: 871632 - RNA, 19 nt, Human
ucacgggccugcuccauac

SEQ ID NO: 871633 - RNA, 18 nt, Human
ucacuuagauacacuggg

SEQ ID NO: 871634 - RNA, 18 nt, Human
uccaaagaauugaacucc

SEQ ID NO: 871635 - RNA, 20 nt, Human
uccacaguguugcugagcug

SEQ ID NO: 871636 - RNA, 18 nt, Human
uccgcccuccugucccuc

SEQ ID NO: 871637 - RNA, 21 nt, Human
uccugauaaaauggcagagau

SEQ ID NO: 871638 - RNA, 18 nt, Human
ucgguguuucugugucua

SEQ ID NO: 871639 - RNA, 18 nt, Human
ucucuggcaaguucccuc

SEQ ID NO: 871640 - RNA, 24 nt, Human
ucugcagcagguuugcacagggug

SEQ ID NO: 871641 - RNA, 18 nt, Human
ucugcuucgagaagaggc

SEQ ID NO: 871642 - RNA, 23 nt, Human
ucuggaaggacucagcgcuugca

SEQ ID NO: 871643 - RNA, 22 nt, Human
ugacguguuuaaaacaaaagca

SEQ ID NO: 871644 - RNA, 23 nt, Human
ugcaaagaaaaaccaaaaggcag

SEQ ID NO: 871645 - RNA, 23 nt, Human
ugcagcggagccccucacccacc

SEQ ID NO: 871646 - RNA, 18 nt, Human
ugccagaauccuggaaau

SEQ ID NO: 871647 - RNA, 18 nt, Human
ugccccauuuggcaccag

SEQ ID NO: 871648 - RNA, 18 nt, Human
ugccucguccgccuuccc

SEQ ID NO: 871649 - RNA, 21 nt, Human
ugccucguccgccuucccagc

SEQ ID NO: 871650 - RNA, 20 nt, Human
ugccuggagccccugggagc

SEQ ID NO: 871651 - RNA, 20 nt, Human
uggaaaccccagaccuccuc

SEQ ID NO: 871652 - RNA, 20 nt, Human
uggcagagaugucaugaaca

SEQ ID NO: 871653 - RNA, 22 nt, Human
uggcgaguggcccacaguggcu

SEQ ID NO: 871654 - RNA, 19 nt, Human
uggcgggguggcgggaggg

SEQ ID NO: 871655 - RNA, 22 nt, Human
ugggagcccaugacagccagga

SEQ ID NO: 871656 - RNA, 20 nt, Human
ugggagccuggcagguuggg

SEQ ID NO: 871657 - RNA, 20 nt, Human
ugggcauaaaaaucagcacc

SEQ ID NO: 871658 - RNA, 25 nt, Human
uggggagcacagggcuauuggcaag

SEQ ID NO: 871659 - RNA, 21 nt, Human
ugguaaccuguagaguaacau

SEQ ID NO: 871660 - RNA, 21 nt, Human
ugucccaucugacaaagacug

SEQ ID NO: 871661 - RNA, 21 nt, Human
ugucccuccagcccuccucug

SEQ ID NO: 871662 - RNA, 18 nt, Human
ugugcaugccuggagccc

SEQ ID NO: 871663 - RNA, 18 nt, Human
uucaaagagauggcaggc

SEQ ID NO: 871664 - RNA, 19 nt, Human
uucacagucgguguuucug

SEQ ID NO: 871665 - RNA, 18 nt, Human
uuccagagcuguucugca

SEQ ID NO: 871666 - RNA, 22 nt, Human
uuccgcagagugcuuaacagcu

SEQ ID NO: 871667 - RNA, 23 nt, Human
uucucaacaauaaucccacccau

SEQ ID NO: 871668 - RNA, 22 nt, Human
uucugcugcuugcaagccaugu

SEQ ID NO: 871669 - RNA, 22 nt, Human
uucugcuucgagaagaggcgga

SEQ ID NO: 871670 - RNA, 19 nt, Human
uucuggcaagcccaacuau

SEQ ID NO: 871671 - RNA, 24 nt, Human
uugaugacguguuuaaaacaaaag

SEQ ID NO: 871672 - RNA, 23 nt, Human
uugcaagccauguggucucuggc

SEQ ID NO: 871673 - RNA, 22 nt, Human
uugcugagcugaucaagugugu

SEQ ID NO: 871674 - RNA, 19 nt, Human
uuuuuugguuuuucauuuu

SEQ ID NO: 871675 - RNA, 21 nt, Human
aacaccaugaucgaggaccuc

SEQ ID NO: 871676 - RNA, 20 nt, Human
aacuacagacacauucacug

SEQ ID NO: 871677 - RNA, 19 nt, Human
aaguaccggagcgcgaagc

SEQ ID NO: 871678 - RNA, 20 nt, Human
aaucacggccagaaaccacc

SEQ ID NO: 871679 - RNA, 18 nt, Human
aaugccuauuccucgaac

SEQ ID NO: 871680 - RNA, 22 nt, Human
acuucacauccaaucacggcca

SEQ ID NO: 871681 - RNA, 19 nt, Human
agaaaccaccuccaaugcc

SEQ ID NO: 871682 - RNA, 21 nt, Human
cacacaaugucuguuaaauag

SEQ ID NO: 871683 - RNA, 22 nt, Human
cacggccagaaaccaccuccaa

SEQ ID NO: 871684 - RNA, 26 nt, Human
cacggccagaaaccaccuccaaugcc

SEQ ID NO: 871685 - RNA, 25 nt, Human
cagaaagagcccaucuuuuucuguu

SEQ ID NO: 871686 - RNA, 19 nt, Human
cagcccaccacacaauguc

SEQ ID NO: 871687 - RNA, 26 nt, Human
ccaaugccuauuccucgaaccaucca

SEQ ID NO: 871688 - RNA, 19 nt, Human
ccacacaaugucuguuaag

SEQ ID NO: 871689 - RNA, 27 nt, Human
ccccgcuauccaccagaccaccugguc

SEQ ID NO: 871690 - RNA, 22 nt, Human
ccgcuauccaccagaccaccug

SEQ ID NO: 871691 - RNA, 20 nt, Human
ccucgaaccauccaagcucu

SEQ ID NO: 871692 - RNA, 24 nt, Human
cggccagaaaccaccuccaaugcc

SEQ ID NO: 871693 - RNA, 21 nt, Human
cuaaguaaaaauaucucugcu

SEQ ID NO: 871694 - RNA, 19 nt, Human
gaucgaggaccucuucuac

SEQ ID NO: 871695 - RNA, 20 nt, Human
uaaaagaagagaauauucau

SEQ ID NO: 871696 - RNA, 21 nt, Human
uaacacaacuacagacacauu

SEQ ID NO: 871697 - RNA, 25 nt, Human
uaacacaacuacagacacauucacu

SEQ ID NO: 871698 - RNA, 22 nt, Human
uccaaugccuauuccucgaacc

SEQ ID NO: 871699 - RNA, 23 nt, Human
uccucgaaccauccaagcuccua

SEQ ID NO: 871700 - RNA, 21 nt, Human
ugcaaacuaacacaacuacag

SEQ ID NO: 871701 - RNA, 20 nt, Human
ugcagagggcuggcugggcc

SEQ ID NO: 871702 - RNA, 19 nt, Human
uguuuuaaaagaagagaaa

SEQ ID NO: 871703 - RNA, 20 nt, Human
uucgucucaucagagagaga

SEQ ID NO: 871704 - RNA, 23 nt, Human
acagcagcggcaacaugcgguag

SEQ ID NO: 871705 - RNA, 20 nt, Human
accuugucacuggagagggg

SEQ ID NO: 871706 - RNA, 22 nt, Human
agaggggagaaggaacuggagu

SEQ ID NO: 871707 - RNA, 21 nt, Human
caccuaggugcaggcugggcu

SEQ ID NO: 871708 - RNA, 25 nt, Human
cagcagaaacagcagcggcaacaug

SEQ ID NO: 871709 - RNA, 21 nt, Human
cagccaagcugagcaaggaca

SEQ ID NO: 871710 - RNA, 19 nt, Human
cccgcagccuagacugggg

SEQ ID NO: 871711 - RNA, 23 nt, Human
ccuaggugcaggcugggcuacag

SEQ ID NO: 871712 - RNA, 20 nt, Human
cgucccagcagaaacagcag

SEQ ID NO: 871713 - RNA, 19 nt, Human
gaggggagaaggaacugga

SEQ ID NO: 871714 - RNA, 24 nt, Human
gcagcggcaacaugcgguaggcac

SEQ ID NO: 871715 - RNA, 19 nt, Human
gcugagcaaggacaggucc

SEQ ID NO: 871716 - RNA, 31 nt, Human
ggcuacagggacagccaagcugagcaaggaa

SEQ ID NO: 871717 - RNA, 22 nt, Human
uuuuuuuuuuuuuuuugagugg

SEQ ID NO: 871718 - RNA, 20 nt, Human
uuuuuuuuuuuuuuuuuugg

SEQ ID NO: 871719 - RNA, 21 nt, Human
aacuccuugggggcuccuggu

SEQ ID NO: 871720 - RNA, 24 nt, Human
aaucgccugaacccaggaggcgga

SEQ ID NO: 871721 - RNA, 19 nt, Human
acccugaagguggggaagg

SEQ ID NO: 871722 - RNA, 19 nt, Human
accggcacuguggaggcgg

SEQ ID NO: 871723 - RNA, 23 nt, Human
acuccgagggggcaucgcaggag

SEQ ID NO: 871724 - RNA, 21 nt, Human
acuccuugggggcuccuggug

SEQ ID NO: 871725 - RNA, 23 nt, Human
agccaggugugguggcacaugcc

SEQ ID NO: 871726 - RNA, 21 nt, Human
aggagagggacggggaagagg

SEQ ID NO: 871727 - RNA, 18 nt, Human
aggcaggagaaucgccug

SEQ ID NO: 871728 - RNA, 24 nt, Human
aggcaggagaaucgccugaaccca

SEQ ID NO: 871729 - RNA, 24 nt, Human
aggcggagguuggggugagccgag

SEQ ID NO: 871730 - RNA, 20 nt, Human
aggcugaggcaggagaaucg

SEQ ID NO: 871731 - RNA, 20 nt, Human
aggcugaggcaggagaaucg

SEQ ID NO: 871732 - RNA, 22 nt, Human
aggcuggagcugagaaggggua

SEQ ID NO: 871733 - RNA, 21 nt, Human
aggugugguggcacaugccug

SEQ ID NO: 871734 - RNA, 24 nt, Human
aggugugguggcacaugccuguaa

SEQ ID NO: 871735 - RNA, 22 nt, Human
auggagcccgaagagccacacu

SEQ ID NO: 871736 - RNA, 24 nt, Human
auugcgccauugcacuccagcaug

SEQ ID NO: 871737 - RNA, 19 nt, Human
caagcaggcacuguggcca

SEQ ID NO: 871738 - RNA, 24 nt, Human
caauaaggucccauucugaggucc

SEQ ID NO: 871739 - RNA, 19 nt, Human
cacgccuguaaucccagca

SEQ ID NO: 871740 - RNA, 22 nt, Human
cagcaaggacaguccuucaagc

SEQ ID NO: 871741 - RNA, 24 nt, Human
cagguaaucaggaggcugaggcag

SEQ ID NO: 871742 - RNA, 18 nt, Human
cauugcacuccagcaugg

SEQ ID NO: 871743 - RNA, 19 nt, Human
cauugcacuccagcauggg

SEQ ID NO: 871744 - RNA, 19 nt, Human
cauugcacuccagcauggg

SEQ ID NO: 871745 - RNA, 20 nt, Human
cauugcacuccagcauggga

SEQ ID NO: 871746 - RNA, 26 nt, Human
ccacgcccaccggcacuguggaggcg

SEQ ID NO: 871747 - RNA, 19 nt, Human
ccauugcacuccagcaugg

SEQ ID NO: 871748 - RNA, 20 nt, Human
ccauugcacuccagcauggg

SEQ ID NO: 871749 - RNA, 19 nt, Human
cccauucugagguccaggg

SEQ ID NO: 871750 - RNA, 22 nt, Human
cccugaagguggggaagguggg

SEQ ID NO: 871751 - RNA, 22 nt, Human
ccuaagucacggcucuaaggag

SEQ ID NO: 871752 - RNA, 22 nt, Human
ccuguaaucccagguaaucagg

SEQ ID NO: 871753 - RNA, 24 nt, Human
cgagauugcgccauugcacuccag

SEQ ID NO: 871754 - RNA, 18 nt, Human
cgccauugcacuccagca

SEQ ID NO: 871755 - RNA, 21 nt, Human
cucacgccuguaaucccagca

SEQ ID NO: 871756 - RNA, 21 nt, Human
cucacgccuguaaucccagca

SEQ ID NO: 871757 - RNA, 21 nt, Human
cuccugguguccuuggugugg

SEQ ID NO: 871758 - RNA, 25 nt, Human
cucuuccaacuccuugggggcuccc

SEQ ID NO: 871759 - RNA, 23 nt, Human
gacccuuuuccccaauaaggucc

SEQ ID NO: 871760 - RNA, 20 nt, Human
gagguaggagagggacgggg

SEQ ID NO: 871761 - RNA, 26 nt, Human
gagguuggggugagccgagauugcgc

SEQ ID NO: 871762 - RNA, 22 nt, Human
gcaggagaaucgccugaaccca

SEQ ID NO: 871763 - RNA, 25 nt, Human
gccacacuccgagggggcaucgcag

SEQ ID NO: 871764 - RNA, 19 nt, Human
gccaccuagaaaguggacc

SEQ ID NO: 871765 - RNA, 23 nt, Human
gcuccugguguccuugguguggg

SEQ ID NO: 871766 - RNA, 20 nt, Human
gcuggagcugagaaggggua

SEQ ID NO: 871767 - RNA, 22 nt, Human
ggagguuggggugagccgagau

SEQ ID NO: 871768 - RNA, 24 nt, Human
ggagguuggggugagccgagauug

SEQ ID NO: 871769 - RNA, 21 nt, Human
ggcucacgccuguaaucccag

SEQ ID NO: 871770 - RNA, 21 nt, Human
ggcuggagcugagaaggggua

SEQ ID NO: 871771 - RNA, 20 nt, Human
gggaagaagagcgaaacucc

SEQ ID NO: 871772 - RNA, 24 nt, Human
gggcgcgguggcucacgccuguaa

SEQ ID NO: 871773 - RNA, 18 nt, Human
gggcuccugguguccuug

SEQ ID NO: 871774 - RNA, 24 nt, Human
ggguagcugcccuugggcaccacg

SEQ ID NO: 871775 - RNA, 24 nt, Human
gguggcacaugccuguaaucccag

SEQ ID NO: 871776 - RNA, 23 nt, Human
gguggcucacgccuguaauccca

SEQ ID NO: 871777 - RNA, 23 nt, Human
guggcucacgccuguaaucccag

SEQ ID NO: 871778 - RNA, 19 nt, Human
gugggcaucccuccagucu

SEQ ID NO: 871779 - RNA, 20 nt, Human
uaaaaacacaaaacuagcca

SEQ ID NO: 871780 - RNA, 21 nt, Human
uaaaaacacaaaacuagccag

SEQ ID NO: 871781 - RNA, 22 nt, Human
uaaaaacacaaaacuagccagg

SEQ ID NO: 871782 - RNA, 23 nt, Human
uaaaaacacaaaacuagccaggu

SEQ ID NO: 871783 - RNA, 26 nt, Human
uaagauggagcccgaagagccacacu

SEQ ID NO: 871784 - RNA, 18 nt, Human
uaagcugggggaggcggu

SEQ ID NO: 871785 - RNA, 23 nt, Human
uaauagacagcagucuacacugc

SEQ ID NO: 871786 - RNA, 22 nt, Human
uacuaaaaacacaaaacuagcc

SEQ ID NO: 871787 - RNA, 22 nt, Human
uagaggacacuauucaagccac

SEQ ID NO: 871788 - RNA, 23 nt, Human
uaggcugggcgcgguggcucacg

SEQ ID NO: 871789 - RNA, 19 nt, Human
uauaaagacccuuuucccc

SEQ ID NO: 871790 - RNA, 21 nt, Human
ucacgccuguaaucccagcau

SEQ ID NO: 871791 - RNA, 23 nt, Human
ucccauucugagguccagggagg

SEQ ID NO: 871792 - RNA, 20 nt, Human
ucccuccagucucugcuucc

SEQ ID NO: 871793 - RNA, 18 nt, Human
uccuugggggcuccuggu

SEQ ID NO: 871794 - RNA, 20 nt, Human
uccuugggggcuccuggugu

SEQ ID NO: 871795 - RNA, 24 nt, Human
ucgguaaauguucuaauuuuuuuu

SEQ ID NO: 871796 - RNA, 23 nt, Human
ucucugcuuccuucucuggggcc

SEQ ID NO: 871797 - RNA, 23 nt, Human
ucugcuuccuucucugugucucu

SEQ ID NO: 871798 - RNA, 22 nt, Human
ucuguguccucuccuauucugu

SEQ ID NO: 871799 - RNA, 22 nt, Human
ugagccgagauugcgccauugc

SEQ ID NO: 871800 - RNA, 20 nt, Human
ugaggcaggagaaucgccug

SEQ ID NO: 871801 - RNA, 24 nt, Human
ugaggcaggagaaucgccugaacc

SEQ ID NO: 871802 - RNA, 25 nt, Human
ugaggcaggagaaucgccugaaccc

SEQ ID NO: 871803 - RNA, 22 nt, Human
ugauggggcuguccuuucuagg

SEQ ID NO: 871804 - RNA, 24 nt, Human
ugccuguaaucccagguaaucagg

SEQ ID NO: 871805 - RNA, 19 nt, Human
ugcugaggucagugugagg

SEQ ID NO: 871806 - RNA, 19 nt, Human
ugcugaggucagugugagg

SEQ ID NO: 871807 - RNA, 22 nt, Human
ugcuuccuucucugugucucug

SEQ ID NO: 871808 - RNA, 23 nt, Human
ugcuuccuucucugugucucugu

SEQ ID NO: 871809 - RNA, 24 nt, Human
uggagcccgaagagccacacuccg

SEQ ID NO: 871810 - RNA, 22 nt, Human
uggaggcggcuuggugaauauu

SEQ ID NO: 871811 - RNA, 21 nt, Human
uggcacaugccuguaauccca

SEQ ID NO: 871812 - RNA, 22 nt, Human
uggcacaugccuguaaucccag

SEQ ID NO: 871813 - RNA, 20 nt, Human
uggcccugggugucucuccc

SEQ ID NO: 871814 - RNA, 22 nt, Human
uggcucacgccuguaaucccag

SEQ ID NO: 871815 - RNA, 24 nt, Human
uggcucacgccuguaaucccagca

SEQ ID NO: 871816 - RNA, 24 nt, Human
ugguggcacaugccuguaauccca

SEQ ID NO: 871817 - RNA, 22 nt, Human
uguauaaagacccuuuucccca

SEQ ID NO: 871818 - RNA, 20 nt, Human
ugugucucuguguccucucc

SEQ ID NO: 871819 - RNA, 25 nt, Human
uucaagcugcgucuugcauguuggu

SEQ ID NO: 871820 - RNA, 18 nt, Human
uuccgacgcugccggagc

SEQ ID NO: 871821 - RNA, 24 nt, Human
uugggggcuccugguguccuuggu

SEQ ID NO: 871822 - RNA, 18 nt, Human
uuggggugagccgagauu

SEQ ID NO: 871823 - RNA, 22 nt, Human
uuggggugagccgagauugcgc

SEQ ID NO: 871824 - RNA, 21 nt, Human
uuuuuuuuuuuuuuuucccag

SEQ ID NO: 871825 - RNA, 23 nt, Human
uuuuuuuuuuuuuuuuucccagg

SEQ ID NO: 871826 - RNA, 21 nt, Human
aagcgggacgugggcugcggg

SEQ ID NO: 871827 - RNA, 19 nt, Human
acaaugggccuggggucug

SEQ ID NO: 871828 - RNA, 19 nt, Human
cccuggaaaucuccagaua

SEQ ID NO: 871829 - RNA, 21 nt, Human
cuggaaaucuccagauaccaa

SEQ ID NO: 871830 - RNA, 18 nt, Human
gaucacccgagagucagg

SEQ ID NO: 871831 - RNA, 21 nt, Human
gcccuggaaaucuccagauac

SEQ ID NO: 871832 - RNA, 21 nt, Human
uuacaaugggccuggggucug

SEQ ID NO: 871833 - RNA, 22 nt, Human
uuuuuuuuuuuucagcaaccuc

SEQ ID NO: 871834 - RNA, 24 nt, Human
uuuuuuuuuuuuuuuuuuuuucag

SEQ ID NO: 871835 - RNA, 25 nt, Human
aaagugcuggggauuacagguguga

SEQ ID NO: 871836 - RNA, 24 nt, Human
aaguagagaugggguuucgccaug

SEQ ID NO: 871837 - RNA, 27 nt, Human
aagugcuggggauuacaggugugagcc

SEQ ID NO: 871838 - RNA, 24 nt, Human
aggugauccgcccgccuuggccuc

SEQ ID NO: 871839 - RNA, 22 nt, Human
aguagagaugggguuucgccau

SEQ ID NO: 871840 - RNA, 23 nt, Human
aguagagaugggguuucgccaug

SEQ ID NO: 871841 - RNA, 21 nt, Human
agugcuggggauuacaggugu

SEQ ID NO: 871842 - RNA, 23 nt, Human
augggguuucgccauguuggcca

SEQ ID NO: 871843 - RNA, 24 nt, Human
augggguuucgccauguuggccag

SEQ ID NO: 871844 - RNA, 21 nt, Human
auugcaauagauuauacaacc

SEQ ID NO: 871845 - RNA, 25 nt, Human
caaagugcuggggauuacaggugug

SEQ ID NO: 871846 - RNA, 21 nt, Human
cagaaaaggaugucugagaug

SEQ ID NO: 871847 - RNA, 24 nt, Human
cauguuggccaggcuggucucgaa

SEQ ID NO: 871848 - RNA, 22 nt, Human
ccaaagugcuggggauuacagg

SEQ ID NO: 871849 - RNA, 25 nt, Human
ccaaagugcuggggauuacaggugu

SEQ ID NO: 871850 - RNA, 19 nt, Human
ccauguuggccaggcuggu

SEQ ID NO: 871851 - RNA, 22 nt, Human
ccauguuggccaggcuggucuc

SEQ ID NO: 871852 - RNA, 22 nt, Human
cccgccuuggccucccaaagug

SEQ ID NO: 871853 - RNA, 18 nt, Human
ccugaccucaggugaucc

SEQ ID NO: 871854 - RNA, 22 nt, Human
ccugaccucaggugauccgccc

SEQ ID NO: 871855 - RNA, 24 nt, Human
cgccauguuggccaggcuggucuc

SEQ ID NO: 871856 - RNA, 26 nt, Human
cuccugaccucaggugauccgcccgc

SEQ ID NO: 871857 - RNA, 24 nt, Human
gaccucaggugauccgcccgccuu

SEQ ID NO: 871858 - RNA, 18 nt, Human
gagaugggguuucgccau

SEQ ID NO: 871859 - RNA, 24 nt, Human
gagaugggguuucgccauguuggc

SEQ ID NO: 871860 - RNA, 18 nt, Human
gauuacaggugugagcca

SEQ ID NO: 871861 - RNA, 18 nt, Human
gauuacaggugugagcca

SEQ ID NO: 871862 - RNA, 22 nt, Human
gauuacaggugugagccaucac

SEQ ID NO: 871863 - RNA, 24 nt, Human
gccauguuggccaggcuggucucg

SEQ ID NO: 871864 - RNA, 25 nt, Human
gccauguuggccaggcuggucucga

SEQ ID NO: 871865 - RNA, 22 nt, Human
gccuuggccucccaaagugcug

SEQ ID NO: 871866 - RNA, 23 nt, Human
gcuggucucgaacuccugaccuc

SEQ ID NO: 871867 - RNA, 23 nt, Human
ggauuacaggugugagccaucac

SEQ ID NO: 871868 - RNA, 24 nt, Human
ggcuggucucgaacuccugaccuc

SEQ ID NO: 871869 - RNA, 18 nt, Human
gggauuacaggugugagc

SEQ ID NO: 871870 - RNA, 23 nt, Human
gggauuacaggugugagccauca

SEQ ID NO: 871871 - RNA, 22 nt, Human
ggggauuacaggugugagccau

SEQ ID NO: 871872 - RNA, 23 nt, Human
ggggauuacaggugugagccauc

SEQ ID NO: 871873 - RNA, 24 nt, Human
ggggauuacaggugugagccauca

SEQ ID NO: 871874 - RNA, 22 nt, Human
gggguuucgccauguuggccag

SEQ ID NO: 871875 - RNA, 22 nt, Human
ggguuucgccauguuggccagg

SEQ ID NO: 871876 - RNA, 19 nt, Human
ggucucgaacuccugaccu

SEQ ID NO: 871877 - RNA, 23 nt, Human
guagagaugggguuucgccaugu

SEQ ID NO: 871878 - RNA, 24 nt, Human
uaaguagagaugggguuucgccau

SEQ ID NO: 871879 - RNA, 22 nt, Human
uacaggugugagccaucacacc

SEQ ID NO: 871880 - RNA, 23 nt, Human
uacaggugugagccaucacaccu

SEQ ID NO: 871881 - RNA, 22 nt, Human
uagagaugggguuucgccaugu

SEQ ID NO: 871882 - RNA, 20 nt, Human
uauacaaccccaaguuuaua

SEQ ID NO: 871883 - RNA, 24 nt, Human
ucccaaagugcuggggauuacagg

SEQ ID NO: 871884 - RNA, 22 nt, Human
ucgccauguuggccaggcuggu

SEQ ID NO: 871885 - RNA, 24 nt, Human
ucgccauguuggccaggcuggucu

SEQ ID NO: 871886 - RNA, 23 nt, Human
ucucgaacuccugaccucaggug

SEQ ID NO: 871887 - RNA, 18 nt, Human
ugaccucaggugauccgc

SEQ ID NO: 871888 - RNA, 21 nt, Human
ugaccucaggugauccgcccg

SEQ ID NO: 871889 - RNA, 24 nt, Human
ugaccucaggugauccgcccgccu

SEQ ID NO: 871890 - RNA, 21 nt, Human
ugcaauagauuauacaacccc

SEQ ID NO: 871891 - RNA, 18 nt, Human
ugccugauuuuuguugac

SEQ ID NO: 871892 - RNA, 23 nt, Human
uggcauagaguaucuaauauuuu

SEQ ID NO: 871893 - RNA, 24 nt, Human
uggccaggcuggucucgaacuccu

SEQ ID NO: 871894 - RNA, 24 nt, Human
ugggguuucgccauguuggccagg

SEQ ID NO: 871895 - RNA, 18 nt, Human
uuagaggaaaguccagga

SEQ ID NO: 871896 - RNA, 18 nt, Human
uuggccucccaaagugcu

SEQ ID NO: 871897 - RNA, 23 nt, Human
uuucgccauguuggccaggcugu

SEQ ID NO: 871898 - RNA, 24 nt, Human
uuuuaaguagagaugggguuucgc

SEQ ID NO: 871899 - RNA, 23 nt, Human
uuuuauugcaauagauuauacaa

SEQ ID NO: 871900 - RNA, 24 nt, Human
uuuuuaaguagagaugggguuucg

SEQ ID NO: 871901 - RNA, 24 nt, Human
uuuuuuuuuuuuuuuaaguagaga

SEQ ID NO: 871902 - RNA, 25 nt, Human
uuuuuuuuuuuuuuuuuuuuuaagg

SEQ ID NO: 871903 - RNA, 19 nt, Human
aaagaagacaaggaagaga

SEQ ID NO: 871904 - RNA, 20 nt, Human
aagcaaaggugguaaugaaa

SEQ ID NO: 871905 - RNA, 19 nt, Human
agacaccaggagccuccuc

SEQ ID NO: 871906 - RNA, 26 nt, Human
aggccaggccuacuagagugccuggu

SEQ ID NO: 871907 - RNA, 24 nt, Human
cacugccguuucagacaccaggag

SEQ ID NO: 871908 - RNA, 25 nt, Human
ccauucuuuuccaagcaaagguggu

SEQ ID NO: 871909 - RNA, 18 nt, Human
ccuguuucuucucucucc

SEQ ID NO: 871910 - RNA, 21 nt, Human
cggcucagagggcgugcucag

SEQ ID NO: 871911 - RNA, 20 nt, Human
gagcggcucagagggcgugc

SEQ ID NO: 871912 - RNA, 24 nt, Human
gccuguuucuucucucuccugcug

SEQ ID NO: 871913 - RNA, 18 nt, Human
uaacugccaggaccaccg

SEQ ID NO: 871914 - RNA, 23 nt, Human
uaacugccaggaccaccgaaugc

SEQ ID NO: 871915 - RNA, 24 nt, Human
uaggcuuuuagaauccauuaaucc

SEQ ID NO: 871916 - RNA, 21 nt, Human
ugguaaugaaaauggaaaaga

SEQ ID NO: 871917 - RNA, 23 nt, Human
uucucucuccugcuguuucuggg

SEQ ID NO: 871918 - RNA, 24 nt, Human
uuggcuucucacagcuggccuguu

SEQ ID NO: 871919 - RNA, 25 nt, Human
uuuuuuuuuuuuuuuaggcuuuuag

SEQ ID NO: 871920 - RNA, 24 nt, Human
uuuuuuuuuuuuuuuuaggcuuuu

SEQ ID NO: 871921 - RNA, 23 nt, Human
uuuuuuuuuuuuuuuuuuuuagg

SEQ ID NO: 871922 - RNA, 25 nt, Human
aacacaaaucugagcuugaauuaua

SEQ ID NO: 871923 - RNA, 22 nt, Human
aagcaccucucgcggagaccga

SEQ ID NO: 871924 - RNA, 24 nt, Human
agcaacagggcagccgggaagcag

SEQ ID NO: 871925 - RNA, 21 nt, Human
cagcaacagggcagccgggaa

SEQ ID NO: 871926 - RNA, 20 nt, Human
ccacggaucagugaggauag

SEQ ID NO: 871927 - RNA, 24 nt, Human
ccgacagcaacagggcagccggga

SEQ ID NO: 871928 - RNA, 20 nt, Human
ccucucgcggagaccgaaag

SEQ ID NO: 871929 - RNA, 19 nt, Human
gcggagaccgaaagauucu

SEQ ID NO: 871930 - RNA, 18 nt, Human
ugacuccgacagcaacag

SEQ ID NO: 871931 - RNA, 24 nt, Human
aaacugggcccagagggaccccga

SEQ ID NO: 871932 - RNA, 22 nt, Human
acccugcgaccccauacauuua

SEQ ID NO: 871933 - RNA, 23 nt, Human
acucaacacccugcgaccccaua

SEQ ID NO: 871934 - RNA, 21 nt, Human
acugagcaccucccauguggc

SEQ ID NO: 871935 - RNA, 20 nt, Human
agggaaacugggcccagagg

SEQ ID NO: 871936 - RNA, 24 nt, Human
cacccugcgaccccauacauuuac

SEQ ID NO: 871937 - RNA, 18 nt, Human
cagagggaccccgagguc

SEQ ID NO: 871938 - RNA, 21 nt, Human
cccaauuuacagauagggaaa

SEQ ID NO: 871939 - RNA, 23 nt, Human
cccauacauuuacuguccccaau

SEQ ID NO: 871940 - RNA, 24 nt, Human
ccccauacauuuacuguccccaau

SEQ ID NO: 871941 - RNA, 18 nt, Human
ccccaucacugggugucc

SEQ ID NO: 871942 - RNA, 18 nt, Human
cccuuagcgcacuuaacg

SEQ ID NO: 871943 - RNA, 20 nt, Human
ccuccugucacucaacaccc

SEQ ID NO: 871944 - RNA, 19 nt, Human
ccuggcucgcgccucuccc

SEQ ID NO: 871945 - RNA, 18 nt, Human
ccuuuacugagcaccucc

SEQ ID NO: 871946 - RNA, 21 nt, Human
cgaccaggccuggcucgcgcc

SEQ ID NO: 871947 - RNA, 18 nt, Human
cuaagcagccuccuguca

SEQ ID NO: 871948 - RNA, 20 nt, Human
cuagagucugugcucuugac

SEQ ID NO: 871949 - RNA, 20 nt, Human
cucccaggacccgccuggcu

SEQ ID NO: 871950 - RNA, 19 nt, Human
cugggcccagagggacccc

SEQ ID NO: 871951 - RNA, 24 nt, Human
gaccccauacauuuacugucccca

SEQ ID NO: 871952 - RNA, 18 nt, Human
gagauauguaagccgcga

SEQ ID NO: 871953 - RNA, 18 nt, Human
ggagaggagaaagcggca

SEQ ID NO: 871954 - RNA, 21 nt, Human
uaagcagccuccugucacuca

SEQ ID NO: 871955 - RNA, 20 nt, Human
uagaaaggacagaagcggug

SEQ ID NO: 871956 - RNA, 21 nt, Human
uaguucaugggcuugacugcu

SEQ ID NO: 871957 - RNA, 21 nt, Human
ucacucaacacccugcgaccc

SEQ ID NO: 871958 - RNA, 18 nt, Human
ucugacagucucuagagu

SEQ ID NO: 871959 - RNA, 22 nt, Human
ugagcaccucccauguggcuaa

SEQ ID NO: 871960 - RNA, 19 nt, Human
uggcuaagcagccuccugu

SEQ ID NO: 871961 - RNA, 18 nt, Human
ugggcccagagggacccc

SEQ ID NO: 871962 - RNA, 23 nt, Human
ugggcccagagggaccccgaggu

SEQ ID NO: 871963 - RNA, 24 nt, Human
uuacugagcaccucccauguggcu

SEQ ID NO: 871964 - RNA, 24 nt, Human
uuucuccgcgggcgccgaccaggc

SEQ ID NO: 871965 - RNA, 19 nt, Human
uuuuuuuuuuuuuuuuuaa

SEQ ID NO: 871966 - RNA, 21 nt, Human
uuuuuuuuuuguagagacugg

SEQ ID NO: 871967 - RNA, 27 nt, Human
uuuuuuuuuuuuuuguagagacuggaa

SEQ ID NO: 871968 - RNA, 18 nt, Human
uuuuuuuuuuuuuuuuug

SEQ ID NO: 871969 - RNA, 19 nt, Human
uuuuuuuuuuuuuuuuugu

SEQ ID NO: 871970 - RNA, 18 nt, Human
aaacagaaaacaaagcuc

SEQ ID NO: 871971 - RNA, 23 nt, Human
aaagcucuuccaguagcugguau

SEQ ID NO: 871972 - RNA, 24 nt, Human
aacacaaaccaaaauaaaccuaua

SEQ ID NO: 871973 - RNA, 24 nt, Human
aacagcaacacaaaccaaaauaaa

SEQ ID NO: 871974 - RNA, 21 nt, Human
aacauugaugaaaaauaucau

SEQ ID NO: 871975 - RNA, 23 nt, Human
aagaacagcaacacaaaccaaaa

SEQ ID NO: 871976 - RNA, 18 nt, Human
cacaaaccaaaauaaacc

SEQ ID NO: 871977 - RNA, 22 nt, Human
cauccuggcaauucauaucuag

SEQ ID NO: 871978 - RNA, 19 nt, Human
ccggcuucugccuccgacc

SEQ ID NO: 871979 - RNA, 19 nt, Human
cuacacaggcuuccucugg

SEQ ID NO: 871980 - RNA, 24 nt, Human
cucaaacauccuggcaauucauau

SEQ ID NO: 871981 - RNA, 23 nt, Human
gacacauauuuacucaaacaucc

SEQ ID NO: 871982 - RNA, 18 nt, Human
uaaucagucucugagaaa

SEQ ID NO: 871983 - RNA, 21 nt, Human
uaaugaaacagaaaacaaagc

SEQ ID NO: 871984 - RNA, 18 nt, Human
uacacaggcuuccucugg

SEQ ID NO: 871985 - RNA, 18 nt, Human
uaccuaucuacacaggcu

SEQ ID NO: 871986 - RNA, 19 nt, Human
ucagaagucuccuucccgg

SEQ ID NO: 871987 - RNA, 24 nt, Human
ucagaagucuccuucccggcuucu

SEQ ID NO: 871988 - RNA, 20 nt, Human
uccucaguaauagauucacu

SEQ ID NO: 871989 - RNA, 24 nt, Human
uccuucccggcuucugccuccgac

SEQ ID NO: 871990 - RNA, 18 nt, Human
ucuccuucccggcuucug

SEQ ID NO: 871991 - RNA, 21 nt, Human
ugccuccgaccuucucggucu

SEQ ID NO: 871992 - RNA, 24 nt, Human
uggaagaacagcaacacaaaccaa

SEQ ID NO: 871993 - RNA, 21 nt, Human
uuccucaguaauagauucacu

SEQ ID NO: 871994 - RNA, 20 nt, Human
uuuuuuuuuuuuuuuuuugg

SEQ ID NO: 871995 - RNA, 18 nt, Human
aaaaaaaaaauccccaaa

SEQ ID NO: 871996 - RNA, 21 nt, Human
aaaaauccccaaagacaagaa

SEQ ID NO: 871997 - RNA, 21 nt, Human
aaagacaagaaauggugaaga

SEQ ID NO: 871998 - RNA, 23 nt, Human
aagaggaaaaaaaaaauccccaa

SEQ ID NO: 871999 - RNA, 23 nt, Human
aauuguuuccauucugaggucug

SEQ ID NO: 872000 - RNA, 21 nt, Human
agccgccauucaggggccccg

SEQ ID NO: 872001 - RNA, 21 nt, Human
agggaaagacccacacuaaug

SEQ ID NO: 872002 - RNA, 24 nt, Human
agggaaggaggguguugaaaaaaa

SEQ ID NO: 872003 - RNA, 18 nt, Human
caaagacaagaaauggug

SEQ ID NO: 872004 - RNA, 18 nt, Human
caagaaauggugaagacu

SEQ ID NO: 872005 - RNA, 20 nt, Human
caagaaauggugaagacugc

SEQ ID NO: 872006 - RNA, 18 nt, Human
cagccccagugguuuacu

SEQ ID NO: 872007 - RNA, 18 nt, Human
cagccuccgggcgccgcu

SEQ ID NO: 872008 - RNA, 18 nt, Human
cauugcagcuccggcgac

SEQ ID NO: 872009 - RNA, 18 nt, Human
ccgccgccgccgccgccg

SEQ ID NO: 872010 - RNA, 21 nt, Human
ccgccgccgccgccgccucag

SEQ ID NO: 872011 - RNA, 22 nt, Human
ccgccgccgccgccgccucagc

SEQ ID NO: 872012 - RNA, 23 nt, Human
ccuucaccgccacgccacgcccc

SEQ ID NO: 872013 - RNA, 23 nt, Human
cgggcgccgcucauugcagcucc

SEQ ID NO: 872014 - RNA, 21 nt, Human
cugguuuccucauccuacagg

SEQ ID NO: 872015 - RNA, 19 nt, Human
cuguuugcuccucccucau

SEQ ID NO: 872016 - RNA, 20 nt, Human
cuucaccgccacgccacgcc

SEQ ID NO: 872017 - RNA, 23 nt, Human
gagccgccauucaggggccccgg

SEQ ID NO: 872018 - RNA, 22 nt, Human
gcagcuccggcgacggacgccc

SEQ ID NO: 872019 - RNA, 19 nt, Human
gccgccgccgccgccgccg

SEQ ID NO: 872020 - RNA, 21 nt, Human
gccgccgccgccgccgccgcc

SEQ ID NO: 872021 - RNA, 22 nt, Human
ggaaggaggguguugaaaaaaa

SEQ ID NO: 872022 - RNA, 18 nt, Human
ggacgcccgcucggcucc

SEQ ID NO: 872023 - RNA, 21 nt, Human
ggaggguguugaaaaaaauug

SEQ ID NO: 872024 - RNA, 21 nt, Human
gggaguggucccauuucacag

SEQ ID NO: 872025 - RNA, 23 nt, Human
ggggaguggucccauuucacagg

SEQ ID NO: 872026 - RNA, 22 nt, Human
ggguguugaaaaaaauuguuuc

SEQ ID NO: 872027 - RNA, 22 nt, Human
gugaagaggaaaaaaaaaaucc

SEQ ID NO: 872028 - RNA, 24 nt, Human
uagccaccugguuuccucauccua

SEQ ID NO: 872029 - RNA, 18 nt, Human
ucauugcagcuccggcga

SEQ ID NO: 872030 - RNA, 19 nt, Human
ucauugcagcuccggcgac

SEQ ID NO: 872031 - RNA, 22 nt, Human
uccagaauggcggcacuaagaa

SEQ ID NO: 872032 - RNA, 25 nt, Human
ucccucauagguaagcagcaagagu

SEQ ID NO: 872033 - RNA, 18 nt, Human
uuacuggggagugguccc

SEQ ID NO: 872034 - RNA, 25 nt, Human
uugcagcuccggcgacggacgcccg

SEQ ID NO: 872035 - RNA, 23 nt, Human
uugugaagaggaaaaaaaaaauc

SEQ ID NO: 872036 - RNA, 21 nt, Human
uuuuuuuuuuuuuuuguguga

SEQ ID NO: 872037 - RNA, 22 nt, Human
aaaaggcucaugaccguacucc

SEQ ID NO: 872038 - RNA, 21 nt, Human
acgcucagccguccgcgggac

SEQ ID NO: 872039 - RNA, 22 nt, Human
agguggccgggaaugugagagc

SEQ ID NO: 872040 - RNA, 24 nt, Human
aucgaaaggcaaauauuuauuuuu

SEQ ID NO: 872041 - RNA, 21 nt, Human
augcaguccacgaccugcaca

SEQ ID NO: 872042 - RNA, 22 nt, Human
cacacccucacauggcagccug

SEQ ID NO: 872043 - RNA, 23 nt, Human
cacucacuucuccauggccucca

SEQ ID NO: 872044 - RNA, 23 nt, Human
cagcagcucuccagauccuccuc

SEQ ID NO: 872045 - RNA, 18 nt, Human
caugaccguacucccaca

SEQ ID NO: 872046 - RNA, 27 nt, Human
ccacagaagcuccugcagccacacgcu

SEQ ID NO: 872047 - RNA, 22 nt, Human
ccagcagcucuccagauccucc

SEQ ID NO: 872048 - RNA, 26 nt, Human
ccucacauggcagccugggcaggggc

SEQ ID NO: 872049 - RNA, 19 nt, Human
cgaccugcacacccucaca

SEQ ID NO: 872050 - RNA, 21 nt, Human
cuccagggggcgccagucacc

SEQ ID NO: 872051 - RNA, 21 nt, Human
cucggugggcccccaggcgga

SEQ ID NO: 872052 - RNA, 19 nt, Human
cuugcugugaugcagucca

SEQ ID NO: 872053 - RNA, 19 nt, Human
gaagcuccugcagccacac

SEQ ID NO: 872054 - RNA, 23 nt, Human
gagcugugggggugaaggucagc

SEQ ID NO: 872055 - RNA, 22 nt, Human
gaugcggaaggugggagcccug

SEQ ID NO: 872056 - RNA, 20 nt, Human
ggaaggugggagcccugggc

SEQ ID NO: 872057 - RNA, 22 nt, Human
ggaugaggggcaugguggcugg

SEQ ID NO: 872058 - RNA, 21 nt, Human
gggcagggagggcauaguaca

SEQ ID NO: 872059 - RNA, 18 nt, Human
gggcaugguggcugggag

SEQ ID NO: 872060 - RNA, 19 nt, Human
ggggcaugguggcugggag

SEQ ID NO: 872061 - RNA, 21 nt, Human
gggugaaggucagcggggggc

SEQ ID NO: 872062 - RNA, 23 nt, Human
ucagcggggggcaggggcagggg

SEQ ID NO: 872063 - RNA, 24 nt, Human
uccauggccuccaugguguucucc

SEQ ID NO: 872064 - RNA, 18 nt, Human
ucccacagaagcuccugc

SEQ ID NO: 872065 - RNA, 18 nt, Human
ugagagcggaguucgugg

SEQ ID NO: 872066 - RNA, 20 nt, Human
ugagagcggaguucguggcg

SEQ ID NO: 872067 - RNA, 18 nt, Human
ugcaguccacgaccugca

SEQ ID NO: 872068 - RNA, 22 nt, Human
uggcagccugggcaggggcaga

SEQ ID NO: 872069 - RNA, 20 nt, Human
ugggagcccugggcgugugg

SEQ ID NO: 872070 - RNA, 21 nt, Human
ugggaugaggggcaugguggc

SEQ ID NO: 872071 - RNA, 23 nt, Human
ugggaugaggggcaugguggcug

SEQ ID NO: 872072 - RNA, 21 nt, Human
ugugcagcagaugaggccggc

SEQ ID NO: 872073 - RNA, 21 nt, Human
uucaggaagagaaacagaaga

SEQ ID NO: 872074 - RNA, 24 nt, Human
uuucaggaagagaaacagaagacc

SEQ ID NO: 872075 - RNA, 22 nt, Human
uuuuuugaucgaaaggcaaaua

SEQ ID NO: 872076 - RNA, 18 nt, Human
uuuuuuuuuuuuuuuuug

SEQ ID NO: 872077 - RNA, 21 nt, Human
aaacaaauuuucuagccccug

SEQ ID NO: 872078 - RNA, 18 nt, Human
aagaagauggggauuuug

SEQ ID NO: 872079 - RNA, 21 nt, Human
aagccaagacugggcugggga

SEQ ID NO: 872080 - RNA, 21 nt, Human
aaguaaaacaauuagggacac

SEQ ID NO: 872081 - RNA, 21 nt, Human
aaucaacaccuaaaauccaga

SEQ ID NO: 872082 - RNA, 22 nt, Human
acaacacagauauaaggugaag

SEQ ID NO: 872083 - RNA, 19 nt, Human
acaccaccuccuuucccca

SEQ ID NO: 872084 - RNA, 23 nt, Human
acaccaccuccuuuccccagccc

SEQ ID NO: 872085 - RNA, 21 nt, Human
acacugagagcagacaaaggc

SEQ ID NO: 872086 - RNA, 23 nt, Human
acacugagagcagacaaaggcca

SEQ ID NO: 872087 - RNA, 19 nt, Human
accaccuucagucccugcu

SEQ ID NO: 872088 - RNA, 20 nt, Human
accaccuucagucccugcug

SEQ ID NO: 872089 - RNA, 21 nt, Human
accagcgccagccggucgcgc

SEQ ID NO: 872090 - RNA, 20 nt, Human
accaugaaauccacugggcc

SEQ ID NO: 872091 - RNA, 22 nt, Human
agaaaucaacaccuaaaaucca

SEQ ID NO: 872092 - RNA, 19 nt, Human
agaagccaagacugggcug

SEQ ID NO: 872093 - RNA, 18 nt, Human
agaaggagauagauaagg

SEQ ID NO: 872094 - RNA, 23 nt, Human
agaaggagauagauaagggggac

SEQ ID NO: 872095 - RNA, 22 nt, Human
agccaugaaggguggggaggga

SEQ ID NO: 872096 - RNA, 25 nt, Human
aggaagugguaucccgugauccaga

SEQ ID NO: 872097 - RNA, 22 nt, Human
aggcaggaggcaagccaugaaa

SEQ ID NO: 872098 - RNA, 19 nt, Human
aggguggggagggaaggag

SEQ ID NO: 872099 - RNA, 18 nt, Human
auaggucacaucuguagg

SEQ ID NO: 872100 - RNA, 20 nt, Human
caacaccuaaaauccagagg

SEQ ID NO: 872101 - RNA, 22 nt, Human
caagacugggcuggggagccga

SEQ ID NO: 872102 - RNA, 22 nt, Human
caaguuaacaaguaaaacaauu

SEQ ID NO: 872103 - RNA, 23 nt, Human
caccagcgccagccggucgcgcc

SEQ ID NO: 872104 - RNA, 21 nt, Human
caccuaaaauccagaggcagg

SEQ ID NO: 872105 - RNA, 20 nt, Human
cacgccgcccguccgccucg

SEQ ID NO: 872106 - RNA, 19 nt, Human
cacucuuacauucagcagc

SEQ ID NO: 872107 - RNA, 22 nt, Human
cacugagagcagacaaaggcca

SEQ ID NO: 872108 - RNA, 21 nt, Human
caggaggggacaagaagccaa

SEQ ID NO: 872109 - RNA, 19 nt, Human
caugccgggccuggccaug

SEQ ID NO: 872110 - RNA, 19 nt, Human
ccacggccgcgccgaugcc

SEQ ID NO: 872111 - RNA, 23 nt, Human
cccccgaggcccccgucaccagc

SEQ ID NO: 872112 - RNA, 18 nt, Human
ccccgaggcccccgucac

SEQ ID NO: 872113 - RNA, 25 nt, Human
cccucugccaccccagcccugagcc

SEQ ID NO: 872114 - RNA, 19 nt, Human
ccgcucuccugccgccgcc

SEQ ID NO: 872115 - RNA, 23 nt, Human
ccgcucuccugccgccgccgccg

SEQ ID NO: 872116 - RNA, 19 nt, Human
ccugccgccgccgccgacc

SEQ ID NO: 872117 - RNA, 22 nt, Human
cgaggcccccgucaccagcgcc

SEQ ID NO: 872118 - RNA, 24 nt, Human
cgccgaugccccccgaggcccccg

SEQ ID NO: 872119 - RNA, 21 nt, Human
cguugaggugcaagaagaugg

SEQ ID NO: 872120 - RNA, 19 nt, Human
cuccaugccgggccuggcc

SEQ ID NO: 872121 - RNA, 22 nt, Human
cuccugccgccgccgccgaccu

SEQ ID NO: 872122 - RNA, 22 nt, Human
cucuccugccgccgccgccgac

SEQ ID NO: 872123 - RNA, 27 nt, Human
cucugccaccccagcccugagccacag

SEQ ID NO: 872124 - RNA, 19 nt, Human
gagaaggagauagauaagg

SEQ ID NO: 872125 - RNA, 18 nt, Human
gcagaggaggaagucugg

SEQ ID NO: 872126 - RNA, 21 nt, Human
gcccaccaccuucagucccug

SEQ ID NO: 872127 - RNA, 24 nt, Human
gcccccgucaccagcgccagccgg

SEQ ID NO: 872128 - RNA, 22 nt, Human
gcccuggauaacaacacagaua

SEQ ID NO: 872129 - RNA, 24 nt, Human
gcgccgaugccccccgaggccccc

SEQ ID NO: 872130 - RNA, 19 nt, Human
ggacaccaccuccuuuccc

SEQ ID NO: 872131 - RNA, 19 nt, Human
gggaaggaggagcucccac

SEQ ID NO: 872132 - RNA, 21 nt, Human
gggagggaaggaggagcuccc

SEQ ID NO: 872133 - RNA, 19 nt, Human
gggauuuuggccacaacuc

SEQ ID NO: 872134 - RNA, 22 nt, Human
ggggauuuuggccacaacuccu

SEQ ID NO: 872135 - RNA, 19 nt, Human
gucuggagcccuggauaac

SEQ ID NO: 872136 - RNA, 18 nt, Human
uaacaacacagauauaag

SEQ ID NO: 872137 - RNA, 23 nt, Human
uaacaacacagauauaaggugaa

SEQ ID NO: 872138 - RNA, 23 nt, Human
uaaggugaaggccucccucugcc

SEQ ID NO: 872139 - RNA, 22 nt, Human
uagggacaccaccuccuuuccc

SEQ ID NO: 872140 - RNA, 24 nt, Human
uagggacaccaccuccuuucccca

SEQ ID NO: 872141 - RNA, 22 nt, Human
ucacaucuguaggggaucaaag

SEQ ID NO: 872142 - RNA, 21 nt, Human
ucgcgccaccgcuccaugccg

SEQ ID NO: 872143 - RNA, 31 nt, Human
ugaaggguggggagggaaggaggagcucccc

SEQ ID NO: 872144 - RNA, 25 nt, Human
ugacaagaugauauaaaaaucucaa

SEQ ID NO: 872145 - RNA, 19 nt, Human
ugagagcagacaaaggcca

SEQ ID NO: 872146 - RNA, 20 nt, Human
ugagagcagacaaaggccaa

SEQ ID NO: 872147 - RNA, 18 nt, Human
ugccaccccagcccugag

SEQ ID NO: 872148 - RNA, 20 nt, Human
uguaggggaucaaagucccg

SEQ ID NO: 872149 - RNA, 21 nt, Human
uuacaacugaagcaauuugac

SEQ ID NO: 872150 - RNA, 18 nt, Human
uuccccagcccauuuuuc

SEQ ID NO: 872151 - RNA, 18 nt, Human
uuuuuuuuuuuuuuuuug

SEQ ID NO: 872152 - RNA, 18 nt, Human
uuuuuuuuuuuuuuuuug

SEQ ID NO: 872153 - RNA, 23 nt, Human
aaaaagcaaagugaucuaggaua

SEQ ID NO: 872154 - RNA, 21 nt, Human
aaagcaagacagcaugaccuc

SEQ ID NO: 872155 - RNA, 24 nt, Human
aagcaagacagcaugaccucccga

SEQ ID NO: 872156 - RNA, 22 nt, Human
acagcaugaccucccgaggucu

SEQ ID NO: 872157 - RNA, 19 nt, Human
acugcuccgccccggcccc

SEQ ID NO: 872158 - RNA, 22 nt, Human
agaguccugguaaguacuucuc

SEQ ID NO: 872159 - RNA, 24 nt, Human
aguggucggggaagcgcuggcgcc

SEQ ID NO: 872160 - RNA, 23 nt, Human
caacgugaaauuaaauuguaguu

SEQ ID NO: 872161 - RNA, 22 nt, Human
caagccacuuaaaagcaagaca

SEQ ID NO: 872162 - RNA, 24 nt, Human
cagcuccuuaaagaaaaagcaaag

SEQ ID NO: 872163 - RNA, 21 nt, Human
caguuuaacagaaauaaaaga

SEQ ID NO: 872164 - RNA, 20 nt, Human
ccaagccacuuaaaagcaag

SEQ ID NO: 872165 - RNA, 21 nt, Human
cccgcauagccgaacccgagu

SEQ ID NO: 872166 - RNA, 22 nt, Human
ccucccgaggucucagguccac

SEQ ID NO: 872167 - RNA, 18 nt, Human
cgacugcuccgccccggc

SEQ ID NO: 872168 - RNA, 20 nt, Human
cgcggggaacgcgacugcuc

SEQ ID NO: 872169 - RNA, 26 nt, Human
cuccgccccggccccgcgccgguucc

SEQ ID NO: 872170 - RNA, 22 nt, Human
gcaagccuccuccucacggcuc

SEQ ID NO: 872171 - RNA, 18 nt, Human
ggguuucuucacuuuccc

SEQ ID NO: 872172 - RNA, 23 nt, Human
guggucggggaagcgcuggcgcc

SEQ ID NO: 872173 - RNA, 21 nt, Human
uaaaagcaagacagcaugacu

SEQ ID NO: 872174 - RNA, 18 nt, Human
uaacaugaaaaucaugua

SEQ ID NO: 872175 - RNA, 18 nt, Human
uagccgaacccgaguggu

SEQ ID NO: 872176 - RNA, 22 nt, Human
uaggugcaacaucagcuccuua

SEQ ID NO: 872177 - RNA, 24 nt, Human
ucacuguccuaauguaucauuuug

SEQ ID NO: 872178 - RNA, 18 nt, Human
ucacuuuccccaagccac

SEQ ID NO: 872179 - RNA, 23 nt, Human
ucagcauaccuuauccaaaaauu

SEQ ID NO: 872180 - RNA, 20 nt, Human
uccuuaaagaaaaagcaaag

SEQ ID NO: 872181 - RNA, 24 nt, Human
ugccauacaauuauaaaaauuuca

SEQ ID NO: 872182 - RNA, 22 nt, Human
uuaaaagcaagacagcaugacc

SEQ ID NO: 872183 - RNA, 19 nt, Human
uugucuuuucacuguguuu

SEQ ID NO: 872184 - RNA, 20 nt, Human
uuugggguuucuucacuuuc

SEQ ID NO: 872185 - RNA, 19 nt, Human
uuuuuuuuuuuuuuuuugu

SEQ ID NO: 872186 - RNA, 27 nt, Human
uuuuuuuuuuuuuuuuuuuuuuugggg

SEQ ID NO: 872187 - RNA, 22 nt, Human
aaguaucacaggccagacagcu

SEQ ID NO: 872188 - RNA, 24 nt, Human
agaccaagaacagaugucggaaaa

SEQ ID NO: 872189 - RNA, 20 nt, Human
agggaaugaguugucuucaa

SEQ ID NO: 872190 - RNA, 28 nt, Human
aucacagcccaaguaucacaggccagac

SEQ ID NO: 872191 - RNA, 19 nt, Human
cacaaaagaccaagaacag

SEQ ID NO: 872192 - RNA, 18 nt, Human
cacaggccagacagcuca

SEQ ID NO: 872193 - RNA, 24 nt, Human
ccucagagggaaugaguugucuuc

SEQ ID NO: 872194 - RNA, 22 nt, Human
ccucuaaacaggcacgaagcuu

SEQ ID NO: 872195 - RNA, 20 nt, Human
cggaaaaguuuuuuuuucuu

SEQ ID NO: 872196 - RNA, 22 nt, Human
cugcgucacaaaagaccaagaa

SEQ ID NO: 872197 - RNA, 23 nt, Human
cuucaaccugcgucacaaaagac

SEQ ID NO: 872198 - RNA, 18 nt, Human
ggccagacagcucaugag

SEQ ID NO: 872199 - RNA, 22 nt, Human
uaaacaggcacgaagcuucugc

SEQ ID NO: 872200 - RNA, 19 nt, Human
uaacaugauagacauaaaa

SEQ ID NO: 872201 - RNA, 22 nt, Human
uagaaugaugugaguccaagcu

SEQ ID NO: 872202 - RNA, 25 nt, Human
uagacauaaaauugguuuaucuccu

SEQ ID NO: 872203 - RNA, 20 nt, Human
uauuguuuaaaaguuucaau

SEQ ID NO: 872204 - RNA, 20 nt, Human
ucuagauuuuuguauaacau

SEQ ID NO: 872205 - RNA, 19 nt, Human
ugacugaaaauucaggugu

SEQ ID NO: 872206 - RNA, 19 nt, Human
ugucuuuuucuauuccucc

SEQ ID NO: 872207 - RNA, 26 nt, Human
ugucuuuuucuauuccucccccuuca

SEQ ID NO: 872208 - RNA, 18 nt, Human
uguguucucauuuauuau

SEQ ID NO: 872209 - RNA, 19 nt, Human
uuauacuacccucuaaaca

SEQ ID NO: 872210 - RNA, 22 nt, Human
uucuauuccucccccuucaacc

SEQ ID NO: 872211 - RNA, 23 nt, Human
uuguauaacaugauagacauaaa

SEQ ID NO: 872212 - RNA, 23 nt, Human
uuuuguauaacaugauagacaua

SEQ ID NO: 872213 - RNA, 18 nt, Human
uuuuuuuuuuuuuuuuug

SEQ ID NO: 872214 - RNA, 23 nt, Human
uuuuuuuuuuuuuuuuuugguuu

SEQ ID NO: 872215 - RNA, 22 nt, Human
ccaugucugugucucgguccuu

SEQ ID NO: 872216 - RNA, 22 nt, Human
cccagccccuccccuacuuuuu

SEQ ID NO: 872217 - RNA, 24 nt, Human
ccuccccuacuuuuuggucagcua

SEQ ID NO: 872218 - RNA, 24 nt, Human
gaaguccuuccaugucugugucuc

SEQ ID NO: 872219 - RNA, 25 nt, Human
uaauuugcagacccagccccucccc

SEQ ID NO: 872220 - RNA, 19 nt, Human
ucccaggacuccuuccuug

SEQ ID NO: 872221 - RNA, 18 nt, Human
uccuguuggugggucccc

SEQ ID NO: 872222 - RNA, 19 nt, Human
uccuugguccuguuggugg

SEQ ID NO: 872223 - RNA, 18 nt, Human
ugucugugucucgguccu

SEQ ID NO: 872224 - RNA, 19 nt, Human
uuccaugucugugucucgg

SEQ ID NO: 872225 - RNA, 18 nt, Human
uuuuuuuuuugcgguccc

SEQ ID NO: 872226 - RNA, 21 nt, Human
uuuuuuuuuuuugcgguccca

SEQ ID NO: 872227 - RNA, 18 nt, Human
uuuuuuuuuuuuuugcgg

SEQ ID NO: 872228 - RNA, 18 nt, Human
uuuuuuuuuuuuuuuuug

SEQ ID NO: 872229 - RNA, 19 nt, Human
uuuuuuuuuuuuuuuuugc

SEQ ID NO: 872230 - RNA, 21 nt, Human
uuuuuuuuuuuuuuuuugcgg

SEQ ID NO: 872231 - RNA, 21 nt, Human
aaacaauacaucccaugaaca

SEQ ID NO: 872232 - RNA, 24 nt, Human
aaagugcugggauuacagguguga

SEQ ID NO: 872233 - RNA, 19 nt, Human
aagaaacuuggguccugga

SEQ ID NO: 872234 - RNA, 18 nt, Human
aagugcugggauuacagg

SEQ ID NO: 872235 - RNA, 19 nt, Human
aagugcugggauuacaggu

SEQ ID NO: 872236 - RNA, 26 nt, Human
aagugcugggauuacaggugugagcc

SEQ ID NO: 872237 - RNA, 24 nt, Human
aauacaguggugugaucucagcuc

SEQ ID NO: 872238 - RNA, 24 nt, Human
acccgggugauuuuuguauuuuua

SEQ ID NO: 872239 - RNA, 18 nt, Human
acgggguuucgccauguu

SEQ ID NO: 872240 - RNA, 19 nt, Human
acgggguuucgccauguug

SEQ ID NO: 872241 - RNA, 24 nt, Human
acgggguuucgccauguugcucag

SEQ ID NO: 872242 - RNA, 19 nt, Human
acuacaggugccugccacc

SEQ ID NO: 872243 - RNA, 18 nt, Human
acugcacccagccuggca

SEQ ID NO: 872244 - RNA, 19 nt, Human
acugcacccagccuggcag

SEQ ID NO: 872245 - RNA, 21 nt, Human
agguucaagugauucuccugc

SEQ ID NO: 872246 - RNA, 22 nt, Human
agguucaagugauucuccugcc

SEQ ID NO: 872247 - RNA, 24 nt, Human
aguggugugaucucagcucaccgc

SEQ ID NO: 872248 - RNA, 20 nt, Human
auuuuuguauuuuuaguaga

SEQ ID NO: 872249 - RNA, 22 nt, Human
auuuuuguauuuuuaguagaga

SEQ ID NO: 872250 - RNA, 24 nt, Human
auuuuuguauuuuuaguagagacg

SEQ ID NO: 872251 - RNA, 24 nt, Human
caaagugcugggauuacaggugug

SEQ ID NO: 872252 - RNA, 23 nt, Human
caaccuccaccucccagguucaa

SEQ ID NO: 872253 - RNA, 20 nt, Human
caagugauucuccugccuca

SEQ ID NO: 872254 - RNA, 22 nt, Human
caagugauucuccugccucagc

SEQ ID NO: 872255 - RNA, 21 nt, Human
caccgcaaccuccaccuccca

SEQ ID NO: 872256 - RNA, 21 nt, Human
caccgcaaccuccaccuccca

SEQ ID NO: 872257 - RNA, 23 nt, Human
caggugccugccaccacacccgg

SEQ ID NO: 872258 - RNA, 24 nt, Human
caggugccugccaccacacccggg

SEQ ID NO: 872259 - RNA, 19 nt, Human
cauguugcucaggcugguc

SEQ ID NO: 872260 - RNA, 24 nt, Human
cauguugcucaggcuggucucgaa

SEQ ID NO: 872261 - RNA, 21 nt, Human
ccaaagugcugggauuacagg

SEQ ID NO: 872262 - RNA, 21 nt, Human
ccaaagugcugggauuacagg

SEQ ID NO: 872263 - RNA, 24 nt, Human
ccaaagugcugggauuacaggugu

SEQ ID NO: 872264 - RNA, 24 nt, Human
ccaccucccagguucaagugauuc

SEQ ID NO: 872265 - RNA, 18 nt, Human
ccacugcacccagccugg

SEQ ID NO: 872266 - RNA, 18 nt, Human
ccacugcacccagccugg

SEQ ID NO: 872267 - RNA, 19 nt, Human
ccacugcacccagccuggc

SEQ ID NO: 872268 - RNA, 20 nt, Human
ccacugcacccagccuggca

SEQ ID NO: 872269 - RNA, 22 nt, Human
ccauguugcucaggcuggucuc

SEQ ID NO: 872270 - RNA, 23 nt, Human
ccauguugcucaggcuggucucg

SEQ ID NO: 872271 - RNA, 20 nt, Human
cccaggcuggaauacagugg

SEQ ID NO: 872272 - RNA, 23 nt, Human
cccagguucaagugauucuccuc

SEQ ID NO: 872273 - RNA, 23 nt, Human
cccagguucaagugauucuccug

SEQ ID NO: 872274 - RNA, 19 nt, Human
cccgaccucaagugacuug

SEQ ID NO: 872275 - RNA, 24 nt, Human
cccgaccucaagugacuugcucac

SEQ ID NO: 872276 - RNA, 23 nt, Human
cccggguagcugggacuacaggu

SEQ ID NO: 872277 - RNA, 24 nt, Human
cccggguagcugggacuacaggug

SEQ ID NO: 872278 - RNA, 23 nt, Human
ccgcaaccuccaccucccagguu

SEQ ID NO: 872279 - RNA, 24 nt, Human
ccgcaaccuccaccucccagguuc

SEQ ID NO: 872280 - RNA, 24 nt, Human
ccucccagguucaagugauucucc

SEQ ID NO: 872281 - RNA, 24 nt, Human
ccucccggguagcugggacuacag

SEQ ID NO: 872282 - RNA, 20 nt, Human
cgaccucaagugacuugcuc

SEQ ID NO: 872283 - RNA, 24 nt, Human
cgccauguugcucaggcuggucuc

SEQ ID NO: 872284 - RNA, 27 nt, Human
cgccauguugcucaggcuggucucgaa

SEQ ID NO: 872285 - RNA, 24 nt, Human
cgggguuucgccauguugcucagg

SEQ ID NO: 872286 - RNA, 24 nt, Human
cucaccgcaaccuccaccucccag

SEQ ID NO: 872287 - RNA, 24 nt, Human
cucagccucccggguagcugggac

SEQ ID NO: 872288 - RNA, 19 nt, Human
cucagucacccaggcugga

SEQ ID NO: 872289 - RNA, 19 nt, Human
cucccagguucaagugauu

SEQ ID NO: 872290 - RNA, 19 nt, Human
cucccgaccucaagugacu

SEQ ID NO: 872291 - RNA, 23 nt, Human
cugccucagccucccggguagcu

SEQ ID NO: 872292 - RNA, 24 nt, Human
cuggaauacaguggugugaucuca

SEQ ID NO: 872293 - RNA, 20 nt, Human
gaacacaggugaaugucccu

SEQ ID NO: 872294 - RNA, 23 nt, Human
gaccucaagugacuugcucaccu

SEQ ID NO: 872295 - RNA, 21 nt, Human
gacgggguuucgccauguugc

SEQ ID NO: 872296 - RNA, 23 nt, Human
gagacgggguuucgccauguugc

SEQ ID NO: 872297 - RNA, 19 nt, Human
gaguggaaacaauacaucc

SEQ ID NO: 872298 - RNA, 18 nt, Human
gauuacaggugugagcca

SEQ ID NO: 872299 - RNA, 19 nt, Human
gauuacaggugugagccac

SEQ ID NO: 872300 - RNA, 23 nt, Human
gauuacaggugugagccacugca

SEQ ID NO: 872301 - RNA, 21 nt, Human
gauucuccugccucagccucc

SEQ ID NO: 872302 - RNA, 20 nt, Human
gcucaggcuggucucgaacu

SEQ ID NO: 872303 - RNA, 23 nt, Human
gcuggucucgaacucccgaccuc

SEQ ID NO: 872304 - RNA, 22 nt, Human
ggcuggaauacaguggugugau

SEQ ID NO: 872305 - RNA, 23 nt, Human
gggguuucgccauguugcucagg

SEQ ID NO: 872306 - RNA, 23 nt, Human
guagagacgggguuucgccaugu

SEQ ID NO: 872307 - RNA, 21 nt, Human
gucucagucacccaggcugga

SEQ ID NO: 872308 - RNA, 24 nt, Human
gugauucuccugccucagccuccc

SEQ ID NO: 872309 - RNA, 23 nt, Human
gugauuuuuguauuuuuaguaga

SEQ ID NO: 872310 - RNA, 24 nt, Human
guuucgccauguugcucaggcugg

SEQ ID NO: 872311 - RNA, 19 nt, Human
uacacagcguccacaccuc

SEQ ID NO: 872312 - RNA, 23 nt, Human
uacaggugccugccaccacaccc

SEQ ID NO: 872313 - RNA, 19 nt, Human
uacaggugugagccacugc

SEQ ID NO: 872314 - RNA, 24 nt, Human
uacaggugugagccacugcaccca

SEQ ID NO: 872315 - RNA, 22 nt, Human
uagagacgggguuucgccaugu

SEQ ID NO: 872316 - RNA, 24 nt, Human
uaguagagacgggguuucgccaug

SEQ ID NO: 872317 - RNA, 19 nt, Human
ucaagugauucuccugccu

SEQ ID NO: 872318 - RNA, 19 nt, Human
ucacccaggcuggaauaca

SEQ ID NO: 872319 - RNA, 24 nt, Human
ucaccgcaaccuccaccucccagg

SEQ ID NO: 872320 - RNA, 27 nt, Human
ucaccgcaaccuccaccucccagguuc

SEQ ID NO: 872321 - RNA, 23 nt, Human
ucagccucccggguagcugggac

SEQ ID NO: 872322 - RNA, 26 nt, Human
ucagcucaccgcaaccuccaccuccc

SEQ ID NO: 872323 - RNA, 19 nt, Human
uccauacugagaguagagu

SEQ ID NO: 872324 - RNA, 23 nt, Human
ucccaaagugcugggauuacagg

SEQ ID NO: 872325 - RNA, 21 nt, Human
ucccagguucaagugauucuc

SEQ ID NO: 872326 - RNA, 24 nt, Human
ucccagguucaagugauucuccug

SEQ ID NO: 872327 - RNA, 23 nt, Human
ucccggguagcugggacuacagg

SEQ ID NO: 872328 - RNA, 24 nt, Human
ucccggguagcugggacuacaggu

SEQ ID NO: 872329 - RNA, 22 nt, Human
ucgccauguugcucaggcuggu

SEQ ID NO: 872330 - RNA, 24 nt, Human
ucuccugccucagccucccgggua

SEQ ID NO: 872331 - RNA, 24 nt, Human
ugacuugcucaccuuggccuccca

SEQ ID NO: 872332 - RNA, 20 nt, Human
ugauucuccugccucagccu

SEQ ID NO: 872333 - RNA, 24 nt, Human
ugauuuuuguauuuuuaguagaga

SEQ ID NO: 872334 - RNA, 24 nt, Human
ugccucagccucccggguagcugg

SEQ ID NO: 872335 - RNA, 24 nt, Human
ugcugggauuacaggugugagcca

SEQ ID NO: 872336 - RNA, 23 nt, Human
uggaauacaguggugugaucuca

SEQ ID NO: 872337 - RNA, 28 nt, Human
uggaauacaguggugugauggcucuagc

SEQ ID NO: 872338 - RNA, 21 nt, Human
uggcagucaauuuuaagccuc

SEQ ID NO: 872339 - RNA, 21 nt, Human
ugggacuacaggugccugcca

SEQ ID NO: 872340 - RNA, 22 nt, Human
ugggacuacaggugccugccac

SEQ ID NO: 872341 - RNA, 24 nt, Human
ugggacuacaggugccugccacca

SEQ ID NO: 872342 - RNA, 18 nt, Human
ugggauuacaggugugag

SEQ ID NO: 872343 - RNA, 19 nt, Human
ugggauuacaggugugagc

SEQ ID NO: 872344 - RNA, 21 nt, Human
ugggauuacaggugugagcca

SEQ ID NO: 872345 - RNA, 22 nt, Human
ugggauuacaggugugagccac

SEQ ID NO: 872346 - RNA, 22 nt, Human
ugggauuacaggugugagccac

SEQ ID NO: 872347 - RNA, 24 nt, Human
ugggauuacaggugugagccacug

SEQ ID NO: 872348 - RNA, 19 nt, Human
uggucucgaacucccgacc

SEQ ID NO: 872349 - RNA, 24 nt, Human
uggugugaucucagcucaccgcaa

SEQ ID NO: 872350 - RNA, 21 nt, Human
uguauuuuuaguagagacggg

SEQ ID NO: 872351 - RNA, 21 nt, Human
uuaagccuccuauuucccagg

SEQ ID NO: 872352 - RNA, 18 nt, Human
uuaguagagacgggguuu

SEQ ID NO: 872353 - RNA, 22 nt, Human
uuaguagagacgggguuucgcc

SEQ ID NO: 872354 - RNA, 24 nt, Human
uuaguagagacgggguuucgccau

SEQ ID NO: 872355 - RNA, 21 nt, Human
uucaagugauucuccugccuc

SEQ ID NO: 872356 - RNA, 23 nt, Human
uucaagugauucuccugccucag

SEQ ID NO: 872357 - RNA, 24 nt, Human
uucaagugauucuccugccucagc

SEQ ID NO: 872358 - RNA, 18 nt, Human
uuggccucccaaagugcu

SEQ ID NO: 872359 - RNA, 23 nt, Human
uuucgccauguugcucaggcugg

SEQ ID NO: 872360 - RNA, 24 nt, Human
uuucgccauguugcucaggcuggu

SEQ ID NO: 872361 - RNA, 21 nt, Human
uuuggggcuauuuugccuuag

SEQ ID NO: 872362 - RNA, 23 nt, Human
uuuuuaguagagacgggguuucg

SEQ ID NO: 872363 - RNA, 24 nt, Human
uuuuuaguagagacgggguuucgc

SEQ ID NO: 872364 - RNA, 20 nt, Human
uuuuuguauuuuuaguagag

SEQ ID NO: 872365 - RNA, 25 nt, Human
uuuuuuuuuuuuaguuagagucuca

SEQ ID NO: 872366 - RNA, 25 nt, Human
aaaaaccuguacagcauuagugcca

SEQ ID NO: 872367 - RNA, 21 nt, Human
aaacaaacagaccaaaaagca

SEQ ID NO: 872368 - RNA, 24 nt, Human
aaacaaacagaccaaaaagcauaa

SEQ ID NO: 872369 - RNA, 18 nt, Human
aaacagaccaaaaagcau

SEQ ID NO: 872370 - RNA, 26 nt, Human
aagcaaaagaucaaacaaagggaccc

SEQ ID NO: 872371 - RNA, 20 nt, Human
aagcauaaauaaacagcagc

SEQ ID NO: 872372 - RNA, 19 nt, Human
aaggugagugacagagagc

SEQ ID NO: 872373 - RNA, 22 nt, Human
aaugagcugccucuuaacugcc

SEQ ID NO: 872374 - RNA, 21 nt, Human
acacacacacucccucucaca

SEQ ID NO: 872375 - RNA, 19 nt, Human
acacacacucccucucaca

SEQ ID NO: 872376 - RNA, 25 nt, Human
acacacacucccucucacagucucc

SEQ ID NO: 872377 - RNA, 18 nt, Human
acugccugcuccaccccu

SEQ ID NO: 872378 - RNA, 22 nt, Human
agagacagcaggaagggcaaag

SEQ ID NO: 872379 - RNA, 23 nt, Human
agagacagcaggaagggcaaagc

SEQ ID NO: 872380 - RNA, 20 nt, Human
agagcagaacagggucugcu

SEQ ID NO: 872381 - RNA, 18 nt, Human
agcaggaagggcaaagcu

SEQ ID NO: 872382 - RNA, 19 nt, Human
agcccagagcagaacaggg

SEQ ID NO: 872383 - RNA, 18 nt, Human
aguggcucccugugccca

SEQ ID NO: 872384 - RNA, 23 nt, Human
auccacaugugucaacacacaca

SEQ ID NO: 872385 - RNA, 23 nt, Human
caaacagaccaaaaagcauaaau

SEQ ID NO: 872386 - RNA, 19 nt, Human
caagcgcugagcccagaaa

SEQ ID NO: 872387 - RNA, 25 nt, Human
cacacucccucucacagucuccaaa

SEQ ID NO: 872388 - RNA, 21 nt, Human
cacagcccagagcagaacagg

SEQ ID NO: 872389 - RNA, 19 nt, Human
caccaggccaaccauggag

SEQ ID NO: 872390 - RNA, 21 nt, Human
caccccuucacagcccagagc

SEQ ID NO: 872391 - RNA, 20 nt, Human
cacugccugcuccaccccuu

SEQ ID NO: 872392 - RNA, 21 nt, Human
cagaaauuuggacaaaugagc

SEQ ID NO: 872393 - RNA, 19 nt, Human
cagccccugugcccuuccu

SEQ ID NO: 872394 - RNA, 19 nt, Human
ccaucuuccuuccucuguc

SEQ ID NO: 872395 - RNA, 20 nt, Human
ccauggagcuagaaacagag

SEQ ID NO: 872396 - RNA, 21 nt, Human
cccaccaggccaaccauggag

SEQ ID NO: 872397 - RNA, 22 nt, Human
ccccuggcauacccugagaacc

SEQ ID NO: 872398 - RNA, 19 nt, Human
cccucaguggcucccugug

SEQ ID NO: 872399 - RNA, 21 nt, Human
cccugccauacucccuucuca

SEQ ID NO: 872400 - RNA, 20 nt, Human
cccuggcauacccugagaac

SEQ ID NO: 872401 - RNA, 21 nt, Human
ccgguacuguuucugccccug

SEQ ID NO: 872402 - RNA, 22 nt, Human
ccugauccacaugugucaacac

SEQ ID NO: 872403 - RNA, 18 nt, Human
cucagccccugugcccuu

SEQ ID NO: 872404 - RNA, 20 nt, Human
cucagcucuccuaacaggaa

SEQ ID NO: 872405 - RNA, 18 nt, Human
cuccaccccuucacagcc

SEQ ID NO: 872406 - RNA, 20 nt, Human
cuccuaacaggaaaaaaacc

SEQ ID NO: 872407 - RNA, 18 nt, Human
cucugucucccacucucc

SEQ ID NO: 872408 - RNA, 21 nt, Human
cugauccacaugugucaacac

SEQ ID NO: 872409 - RNA, 23 nt, Human
cugcuccaccccuucacagccca

SEQ ID NO: 872410 - RNA, 21 nt, Human
cugggccagcaaggaggaagg

SEQ ID NO: 872411 - RNA, 21 nt, Human
cuguuucugccccuggcauac

SEQ ID NO: 872412 - RNA, 18 nt, Human
gacuguguggucuggugu

SEQ ID NO: 872413 - RNA, 24 nt, Human
gcaaaaaacaauuuuaaaaaagca

SEQ ID NO: 872414 - RNA, 22 nt, Human
gcauacccugagaacccaugug

SEQ ID NO: 872415 - RNA, 22 nt, Human
gcccaucucagccucuugccau

SEQ ID NO: 872416 - RNA, 21 nt, Human
gccccugugcccuuccugggc

SEQ ID NO: 872417 - RNA, 19 nt, Human
gcuagaaacagagacagca

SEQ ID NO: 872418 - RNA, 19 nt, Human
ggaauuuuucacauuugcu

SEQ ID NO: 872419 - RNA, 22 nt, Human
uagaaacagagacagcaggaag

SEQ ID NO: 872420 - RNA, 22 nt, Human
ucaaacaaacagaccaaaaagc

SEQ ID NO: 872421 - RNA, 23 nt, Human
ucaaacaaacagaccaaaaagca

SEQ ID NO: 872422 - RNA, 25 nt, Human
ucaacacacacacucccucucacag

SEQ ID NO: 872423 - RNA, 21 nt, Human
ucaguagccgcaucccagccc

SEQ ID NO: 872424 - RNA, 21 nt, Human
ucccagcccugccauacuccc

SEQ ID NO: 872425 - RNA, 23 nt, Human
ucccucucacagucuccaaacag

SEQ ID NO: 872426 - RNA, 25 nt, Human
ucucacagucuccaaacagcacugc

SEQ ID NO: 872427 - RNA, 18 nt, Human
ucucaguagccgcauccc

SEQ ID NO: 872428 - RNA, 24 nt, Human
ucuccaaacagcacugcagagccu

SEQ ID NO: 872429 - RNA, 25 nt, Human
ucuccaucuuccuuccucugucucc

SEQ ID NO: 872430 - RNA, 19 nt, Human
ugacccucaguggcucccu

SEQ ID NO: 872431 - RNA, 24 nt, Human
ugacuucuguagugcucagccccu

SEQ ID NO: 872432 - RNA, 21 nt, Human
ugagugacagagagccgguac

SEQ ID NO: 872433 - RNA, 24 nt, Human
ugcaaaaaacaauuuuaaaaaagc

SEQ ID NO: 872434 - RNA, 18 nt, Human
ugccugcuccaccccuuc

SEQ ID NO: 872435 - RNA, 25 nt, Human
ugcuccaccccuucacagcccagag

SEQ ID NO: 872436 - RNA, 18 nt, Human
ugggcagcuggccucagc

SEQ ID NO: 872437 - RNA, 22 nt, Human
uguuucugccccuggcauaccc

SEQ ID NO: 872438 - RNA, 22 nt, Human
uuggaggacuguguggucuggu

SEQ ID NO: 872439 - RNA, 21 nt, Human
uugggagggaacuccaccccc

SEQ ID NO: 872440 - RNA, 19 nt, Human
uuuuuuuuuuuuuuugucu

SEQ ID NO: 872441 - RNA, 18 nt, Human
uuuuuuuuuuuuuuuuug

SEQ ID NO: 872442 - RNA, 19 nt, Human
uuuuuuuuuuuuuuuuugu

SEQ ID NO: 872443 - RNA, 19 nt, Human
aaacagcccaauggcccca

SEQ ID NO: 872444 - RNA, 21 nt, Human
aaacagcccaauggccccagg

SEQ ID NO: 872445 - RNA, 22 nt, Human
aagaguggcaaguugcugcugc

SEQ ID NO: 872446 - RNA, 18 nt, Human
acaaacaugaacagaaca

SEQ ID NO: 872447 - RNA, 24 nt, Human
acaccuggaggguacuuuggccac

SEQ ID NO: 872448 - RNA, 23 nt, Human
acugcacuggggaccaagggaau

SEQ ID NO: 872449 - RNA, 26 nt, Human
aggaagaguggcaaguugcugcugcc

SEQ ID NO: 872450 - RNA, 19 nt, Human
aggaggaauaaacuggaug

SEQ ID NO: 872451 - RNA, 23 nt, Human
aucaacuucccaucaguaaauuc

SEQ ID NO: 872452 - RNA, 24 nt, Human
caaacaugaacagaacacagccga

SEQ ID NO: 872453 - RNA, 24 nt, Human
cagaaccuugcagcucccggcucc

SEQ ID NO: 872454 - RNA, 22 nt, Human
cagcgcucuggauccggcuccu

SEQ ID NO: 872455 - RNA, 19 nt, Human
caggguuuuucuugugcua

SEQ ID NO: 872456 - RNA, 25 nt, Human
cauucaacaaacaugaacagaacac

SEQ ID NO: 872457 - RNA, 24 nt, Human
ccccagguggcuccgugccagccu

SEQ ID NO: 872458 - RNA, 23 nt, Human
ccgcccgcucggcucucagcugu

SEQ ID NO: 872459 - RNA, 25 nt, Human
ccguggaccugcccgcgccgcccgc

SEQ ID NO: 872460 - RNA, 19 nt, Human
ccugcuccgcccgacccuc

SEQ ID NO: 872461 - RNA, 22 nt, Human
ccugugguaaauuacuucuuuc

SEQ ID NO: 872462 - RNA, 24 nt, Human
cucagcugucaagcagccgccugc

SEQ ID NO: 872463 - RNA, 22 nt, Human
cuccucggaggaccugcaacuc

SEQ ID NO: 872464 - RNA, 22 nt, Human
cugccccacccuugacaaacag

SEQ ID NO: 872465 - RNA, 26 nt, Human
cuguggucagggcaugaccggggucc

SEQ ID NO: 872466 - RNA, 18 nt, Human
cugugucgccugugguaa

SEQ ID NO: 872467 - RNA, 21 nt, Human
gaaggcugagaaagcuuuuuc

SEQ ID NO: 872468 - RNA, 23 nt, Human
gcgauuagucaguuucuugaagu

SEQ ID NO: 872469 - RNA, 23 nt, Human
gcgccgcccgcucggcucucagc

SEQ ID NO: 872470 - RNA, 22 nt, Human
ggaccaagggaauugagggcac

SEQ ID NO: 872471 - RNA, 21 nt, Human
ggacucagaggaguggggcag

SEQ ID NO: 872472 - RNA, 20 nt, Human
ggggcagagccuccccacca

SEQ ID NO: 872473 - RNA, 21 nt, Human
guaaacggaccaaacauaaua

SEQ ID NO: 872474 - RNA, 20 nt, Human
guccaaacacugcacugggg

SEQ ID NO: 872475 - RNA, 19 nt, Human
ucccaucaguaaauuccug

SEQ ID NO: 872476 - RNA, 21 nt, Human
ucccguggaccugcccgcgcc

SEQ ID NO: 872477 - RNA, 18 nt, Human
uccgugccagccuccuga

SEQ ID NO: 872478 - RNA, 20 nt, Human
ugacaaacagcccaauggcc

SEQ ID NO: 872479 - RNA, 25 nt, Human
ugacuugaauuccaccaucagcaag

SEQ ID NO: 872480 - RNA, 24 nt, Human
ugagaaagcuuuuucuuggugcuc

SEQ ID NO: 872481 - RNA, 20 nt, Human
ugcccuacucaccuaacagu

SEQ ID NO: 872482 - RNA, 27 nt, Human
ugcccuacucaccuaacaguuuugcug

SEQ ID NO: 872483 - RNA, 18 nt, Human
ugcugaaucccagcgcuc

SEQ ID NO: 872484 - RNA, 21 nt, Human
uggcacuccugcugaauccca

SEQ ID NO: 872485 - RNA, 20 nt, Human
ugggcucauggaggaagagu

SEQ ID NO: 872486 - RNA, 22 nt, Human
uggggcagagccuccccaccag

SEQ ID NO: 872487 - RNA, 23 nt, Human
uggugguccaaacacugcacugg

SEQ ID NO: 872488 - RNA, 19 nt, Human
uuuuucuuggugcucuguu

SEQ ID NO: 872489 - RNA, 22 nt, Human
uuuuuuuuuuuuuuaccaguaa

SEQ ID NO: 872490 - RNA, 22 nt, Human
uuuuuuuuuuuuuuuuuaccag

SEQ ID NO: 872491 - RNA, 23 nt, Human
uuuuuuuuuuuuuuuuuuaccag

SEQ ID NO: 872492 - RNA, 22 nt, Human
aaaauaacauaccauacauugg

SEQ ID NO: 872493 - RNA, 18 nt, Human
aaacacucagcagaaaac

SEQ ID NO: 872494 - RNA, 22 nt, Human
aaaggaaacacucagcagaaaa

SEQ ID NO: 872495 - RNA, 20 nt, Human
aaaguuuuaagaaucucaca

SEQ ID NO: 872496 - RNA, 18 nt, Human
aacauaccauacauugga

SEQ ID NO: 872497 - RNA, 18 nt, Human
aagaacgaaaugaacaaa

SEQ ID NO: 872498 - RNA, 23 nt, Human
aagaacgaaaugaacaaaaagaa

SEQ ID NO: 872499 - RNA, 22 nt, Human
aagccaacuuuccagaccaaaa

SEQ ID NO: 872500 - RNA, 24 nt, Human
aauugggcugguccuugaaaacag

SEQ ID NO: 872501 - RNA, 21 nt, Human
acaaagcaagaggaacccaag

SEQ ID NO: 872502 - RNA, 22 nt, Human
acaaagcaagaggaacccaagc

SEQ ID NO: 872503 - RNA, 24 nt, Human
acaaaggaaacacucagcagaaaa

SEQ ID NO: 872504 - RNA, 23 nt, Human
accacgcacaccgcagguacugg

SEQ ID NO: 872505 - RNA, 19 nt, Human
agaagacaaauagggcaac

SEQ ID NO: 872506 - RNA, 21 nt, Human
agacaagccaacuuuccagac

SEQ ID NO: 872507 - RNA, 25 nt, Human
agacaagccaacuuuccagaccaaa

SEQ ID NO: 872508 - RNA, 19 nt, Human
aggcacucacagcuaggga

SEQ ID NO: 872509 - RNA, 18 nt, Human
auaauuacagagagaaug

SEQ ID NO: 872510 - RNA, 23 nt, Human
augaagcaaaaaaguuuuaagaa

SEQ ID NO: 872511 - RNA, 21 nt, Human
auggaaaacagaucuugugca

SEQ ID NO: 872512 - RNA, 20 nt, Human
auggaugauccagacuuggu

SEQ ID NO: 872513 - RNA, 19 nt, Human
caaagcaagaggaacccaa

SEQ ID NO: 872514 - RNA, 22 nt, Human
caacuacaaaccuuucauguug

SEQ ID NO: 872515 - RNA, 23 nt, Human
caagaggaacccaagcauuucca

SEQ ID NO: 872516 - RNA, 25 nt, Human
caagaggaacccaagcauuuccauu

SEQ ID NO: 872517 - RNA, 23 nt, Human
caaggacaauucauaauuacaga

SEQ ID NO: 872518 - RNA, 24 nt, Human
cagaaguuauauagccaagaggca

SEQ ID NO: 872519 - RNA, 18 nt, Human
cagcagaaaacauucccu

SEQ ID NO: 872520 - RNA, 24 nt, Human
ccaagcauuuccauugcuggacuu

SEQ ID NO: 872521 - RNA, 24 nt, Human
ccaaggacaaaggaaacacucagc

SEQ ID NO: 872522 - RNA, 21 nt, Human
ccacugagcccacuucagugu

SEQ ID NO: 872523 - RNA, 21 nt, Human
ccagaccaaaaggcacucaca

SEQ ID NO: 872524 - RNA, 20 nt, Human
cccaaggacaaaggaaacac

SEQ ID NO: 872525 - RNA, 25 nt, Human
cccaaggacaaaggaaacacucagc

SEQ ID NO: 872526 - RNA, 19 nt, Human
cccuaggcuccagaaucuc

SEQ ID NO: 872527 - RNA, 20 nt, Human
cgacuccugaguccccugac

SEQ ID NO: 872528 - RNA, 24 nt, Human
cuagcuguggguauuaugagacaa

SEQ ID NO: 872529 - RNA, 22 nt, Human
cuccaaaaaccacugagcccac

SEQ ID NO: 872530 - RNA, 23 nt, Human
cuccaaaaaccacugagcccacu

SEQ ID NO: 872531 - RNA, 22 nt, Human
cucccuaugcaaagcugccaca

SEQ ID NO: 872532 - RNA, 22 nt, Human
cugguccuugaaaacaguggga

SEQ ID NO: 872533 - RNA, 18 nt, Human
cuugugugggagcaugag

SEQ ID NO: 872534 - RNA, 20 nt, Human
gaaaugaacaaaaagaacac

SEQ ID NO: 872535 - RNA, 20 nt, Human
gaaccaagccagagaaauug

SEQ ID NO: 872536 - RNA, 19 nt, Human
gaagcaaaaaaguuuuaag

SEQ ID NO: 872537 - RNA, 22 nt, Human
gacaaagcaagaggaacccaag

SEQ ID NO: 872538 - RNA, 19 nt, Human
gagcagcccaaggacaaag

SEQ ID NO: 872539 - RNA, 21 nt, Human
gagcagcccaaggacaaagga

SEQ ID NO: 872540 - RNA, 18 nt, Human
gcuucuucacuccaaaaa

SEQ ID NO: 872541 - RNA, 20 nt, Human
gcuugcaugaccagucucac

SEQ ID NO: 872542 - RNA, 22 nt, Human
gggucucuaacaugaguuguuu

SEQ ID NO: 872543 - RNA, 21 nt, Human
ggucaagcgugcagagaaggc

SEQ ID NO: 872544 - RNA, 18 nt, Human
guaaaacaaggacaauuc

SEQ ID NO: 872545 - RNA, 26 nt, Human
gucugaagucuuugcacugaaggcca

SEQ ID NO: 872546 - RNA, 24 nt, Human
uaacauaccauacauuggagaaga

SEQ ID NO: 872547 - RNA, 26 nt, Human
uagccaagaggcaaccaaguguaaua

SEQ ID NO: 872548 - RNA, 23 nt, Human
uagcucccuaggcuccagaaucu

SEQ ID NO: 872549 - RNA, 25 nt, Human
uauuauaaacaauaaaauauaugua

SEQ ID NO: 872550 - RNA, 18 nt, Human
ucacaguggaaauaaucc

SEQ ID NO: 872551 - RNA, 24 nt, Human
ucacggggccaaaugguuucccuu

SEQ ID NO: 872552 - RNA, 21 nt, Human
ucacuccaaaaaccacugagg

SEQ ID NO: 872553 - RNA, 20 nt, Human
ucacugagcgugcucagggg

SEQ ID NO: 872554 - RNA, 21 nt, Human
ucagggaaguaagaacgaaau

SEQ ID NO: 872555 - RNA, 21 nt, Human
uccccugacaaagcaagagga

SEQ ID NO: 872556 - RNA, 23 nt, Human
ucuagugaucaaagacauucucu

SEQ ID NO: 872557 - RNA, 25 nt, Human
ucucuugcuucagggaaguaagaac

SEQ ID NO: 872558 - RNA, 26 nt, Human
ucucuuuuaauguaaaacaaggacug

SEQ ID NO: 872559 - RNA, 18 nt, Human
ucuuuuguauagaugauu

SEQ ID NO: 872560 - RNA, 23 nt, Human
ugaaacgaacuccgaaccaagcc

SEQ ID NO: 872561 - RNA, 18 nt, Human
ugacaaagcaagaggaac

SEQ ID NO: 872562 - RNA, 20 nt, Human
ugagacaagccaacuuucca

SEQ ID NO: 872563 - RNA, 22 nt, Human
ugagacaagccaacuuuccaga

SEQ ID NO: 872564 - RNA, 25 nt, Human
ugagacaagccaacuuuccagacca

SEQ ID NO: 872565 - RNA, 19 nt, Human
ugcugggccuaaccagccc

SEQ ID NO: 872566 - RNA, 18 nt, Human
uggaugauccagacuugg

SEQ ID NO: 872567 - RNA, 26 nt, Human
uggcacuguaaaugcuugcaugacca

SEQ ID NO: 872568 - RNA, 21 nt, Human
ugggcugguccuugaaaacag

SEQ ID NO: 872569 - RNA, 23 nt, Human
uuuuuuuuuuuuuuuuuauccau

SEQ ID NO: 872570 - RNA, 19 nt, Human
acaggcagcuccaugagag

SEQ ID NO: 872571 - RNA, 19 nt, Human
agagccccggccccugccc

SEQ ID NO: 872572 - RNA, 18 nt, Human
cagcuggcaggcaggagg

SEQ ID NO: 872573 - RNA, 22 nt, Human
caggagcuccaggcugaggccu

SEQ ID NO: 872574 - RNA, 23 nt, Human
cagucccuccacccacccugccc

SEQ ID NO: 872575 - RNA, 18 nt, Human
ccaugagagccccggccc

SEQ ID NO: 872576 - RNA, 20 nt, Human
cccccucuuccucaucuuga

SEQ ID NO: 872577 - RNA, 23 nt, Human
cccccucuuccucaucuugauuu

SEQ ID NO: 872578 - RNA, 20 nt, Human
cccuccacccacccugccca

SEQ ID NO: 872579 - RNA, 21 nt, Human
ccggccccugcccuggcggcu

SEQ ID NO: 872580 - RNA, 23 nt, Human
ccgugggcucuggcugugucccu

SEQ ID NO: 872581 - RNA, 18 nt, Human
cucgcaucagucccucca

SEQ ID NO: 872582 - RNA, 22 nt, Human
cugaagcccugcacggccccug

SEQ ID NO: 872583 - RNA, 19 nt, Human
cuggcggcuucugcuuugc

SEQ ID NO: 872584 - RNA, 22 nt, Human
cugggggaccucgcaucagucc

SEQ ID NO: 872585 - RNA, 19 nt, Human
gagagccccggccccugcc

SEQ ID NO: 872586 - RNA, 22 nt, Human
gguuucaccacaggcagcucca

SEQ ID NO: 872587 - RNA, 24 nt, Human
gugcugcugaagcccugcacggcc

SEQ ID NO: 872588 - RNA, 20 nt, Human
uacaagacgccagcuggcag

SEQ ID NO: 872589 - RNA, 19 nt, Human
ucagucccuccacccaccc

SEQ ID NO: 872590 - RNA, 19 nt, Human
uccaggcugaggccugggg

SEQ ID NO: 872591 - RNA, 21 nt, Human
ucucaaggcacgacaggcccc

SEQ ID NO: 872592 - RNA, 22 nt, Human
ugauucccguuccagcuuucuc

SEQ ID NO: 872593 - RNA, 18 nt, Human
ugauuuggauacaagacg

SEQ ID NO: 872594 - RNA, 20 nt, Human
ugcccuggcggcuucugcuu

SEQ ID NO: 872595 - RNA, 22 nt, Human
ugcccuggcggcuucugcuuug

SEQ ID NO: 872596 - RNA, 23 nt, Human
ugcccuggcggcuucugcuuugc

SEQ ID NO: 872597 - RNA, 23 nt, Human
ugcugcugaagcccugcacggcc

SEQ ID NO: 872598 - RNA, 18 nt, Human
uuccucaucuugauuugg

SEQ ID NO: 872599 - RNA, 27 nt, Human
uuuuuuuuuuuuuuuuuuuuuuugggg

SEQ ID NO: 872600 - RNA, 20 nt, Human
aaccgugcgcccagcaagac

SEQ ID NO: 872601 - RNA, 21 nt, Human
aagacacaagcgaugacaccg

SEQ ID NO: 872602 - RNA, 21 nt, Human
acaagcgaugacaccgauuua

SEQ ID NO: 872603 - RNA, 20 nt, Human
agacggaggagggggacagc

SEQ ID NO: 872604 - RNA, 19 nt, Human
agaguccuccgggagcucc

SEQ ID NO: 872605 - RNA, 23 nt, Human
agcaagacacaagcgaugacacc

SEQ ID NO: 872606 - RNA, 21 nt, Human
aggagcagucaggggacucag

SEQ ID NO: 872607 - RNA, 21 nt, Human
aggccucggggugggggaguc

SEQ ID NO: 872608 - RNA, 25 nt, Human
aucccagagccucccgcagaguccc

SEQ ID NO: 872609 - RNA, 19 nt, Human
caaccgugcgcccagcaag

SEQ ID NO: 872610 - RNA, 24 nt, Human
caaugggucccggccuuccacaac

SEQ ID NO: 872611 - RNA, 23 nt, Human
cacaacggcagcuccucgguccc

SEQ ID NO: 872612 - RNA, 23 nt, Human
caccccaagccuggaaacuucca

SEQ ID NO: 872613 - RNA, 23 nt, Human
caccgagcucuggagacucagga

SEQ ID NO: 872614 - RNA, 19 nt, Human
cagcacaacggcagcuccu

SEQ ID NO: 872615 - RNA, 24 nt, Human
caggccccgaggagcagucagggg

SEQ ID NO: 872616 - RNA, 18 nt, Human
caggcuaaaccuggggac

SEQ ID NO: 872617 - RNA, 18 nt, Human
cagggaccaccacccugu

SEQ ID NO: 872618 - RNA, 22 nt, Human
caucccagagccucccgcagag

SEQ ID NO: 872619 - RNA, 20 nt, Human
ccacgcuacagcccugcgcc

SEQ ID NO: 872620 - RNA, 23 nt, Human
ccagagccucccgcagaguccca

SEQ ID NO: 872621 - RNA, 21 nt, Human
cccagagccccagcucugccc

SEQ ID NO: 872622 - RNA, 22 nt, Human
cccagggaccaccacccugucc

SEQ ID NO: 872623 - RNA, 20 nt, Human
ccccgaggagcagucagggg

SEQ ID NO: 872624 - RNA, 25 nt, Human
ccccuggcuccccucgcgauccucc

SEQ ID NO: 872625 - RNA, 22 nt, Human
ccccuggcuucccucgcgaucc

SEQ ID NO: 872626 - RNA, 19 nt, Human
ccccugugcccuaccugac

SEQ ID NO: 872627 - RNA, 20 nt, Human
ccccugugcccuaccugacc

SEQ ID NO: 872628 - RNA, 22 nt, Human
ccugagccgggcaucccagagc

SEQ ID NO: 872629 - RNA, 23 nt, Human
ccuggcuccccucgcgauccucc

SEQ ID NO: 872630 - RNA, 23 nt, Human
ccuggcuucccucgcaauccucc

SEQ ID NO: 872631 - RNA, 23 nt, Human
ccuggcuucccucgcgauccucc

SEQ ID NO: 872632 - RNA, 23 nt, Human
ccuggcuucccucgcgauccucc

SEQ ID NO: 872633 - RNA, 23 nt, Human
ccuggcuucccucgcgauccucc

SEQ ID NO: 872634 - RNA, 24 nt, Human
cgcaggcgccucugccaccacccc

SEQ ID NO: 872635 - RNA, 19 nt, Human
cgccucugccaccaccccu

SEQ ID NO: 872636 - RNA, 25 nt, Human
cgccucugccaccaccccucgugcc

SEQ ID NO: 872637 - RNA, 21 nt, Human
cgcucugaggucugcuugucc

SEQ ID NO: 872638 - RNA, 20 nt, Human
cggccaguaaccgcaggcgc

SEQ ID NO: 872639 - RNA, 24 nt, Human
cuccccuggcuccccucgcgaucc

SEQ ID NO: 872640 - RNA, 24 nt, Human
cuccccuggcuucccucgcgaucc

SEQ ID NO: 872641 - RNA, 24 nt, Human
cuccccuggcuucccucgcgaucc

SEQ ID NO: 872642 - RNA, 24 nt, Human
cucccuuggcuucccucgcgaucc

SEQ ID NO: 872643 - RNA, 24 nt, Human
cucgcgauccuccccuggcucccc

SEQ ID NO: 872644 - RNA, 24 nt, Human
cucgcgauccuccccuggcuuccc

SEQ ID NO: 872645 - RNA, 24 nt, Human
cucgcgauccuccccuggcuuccc

SEQ ID NO: 872646 - RNA, 24 nt, Human
cucgcgauccuccccuggcuuccc

SEQ ID NO: 872647 - RNA, 24 nt, Human
cucgcgauccuccccuggcuuccc

SEQ ID NO: 872648 - RNA, 19 nt, Human
cucugcgggggaggagcgg

SEQ ID NO: 872649 - RNA, 25 nt, Human
cugccccuggcuucccucgcgaucc

SEQ ID NO: 872650 - RNA, 18 nt, Human
cugcuugucccucccugg

SEQ ID NO: 872651 - RNA, 20 nt, Human
cuggaaacuuccacgcuaca

SEQ ID NO: 872652 - RNA, 22 nt, Human
gacgccaaagcucugcggggga

SEQ ID NO: 872653 - RNA, 25 nt, Human
gcagagucccaccccaagccuggaa

SEQ ID NO: 872654 - RNA, 26 nt, Human
gcagagucccaccccaagccuggaaa

SEQ ID NO: 872655 - RNA, 21 nt, Human
gccccgaggagcagucagggg

SEQ ID NO: 872656 - RNA, 21 nt, Human
gcgauccucccuuggcuuccc

SEQ ID NO: 872657 - RNA, 21 nt, Human
ggagcagucaggggacucagg

SEQ ID NO: 872658 - RNA, 19 nt, Human
uaccugacccacccaggga

SEQ ID NO: 872659 - RNA, 18 nt, Human
uccccuggcuccccucgc

SEQ ID NO: 872660 - RNA, 18 nt, Human
uccccuggcuucccucgc

SEQ ID NO: 872661 - RNA, 18 nt, Human
uccccuggcuucccucgc

SEQ ID NO: 872662 - RNA, 19 nt, Human
uccccuggcuucccucgca

SEQ ID NO: 872663 - RNA, 19 nt, Human
uccccuggcuucccucgcg

SEQ ID NO: 872664 - RNA, 20 nt, Human
ucgccgccuccgggacgccu

SEQ ID NO: 872665 - RNA, 19 nt, Human
ucugcuugucccucccugg

SEQ ID NO: 872666 - RNA, 21 nt, Human
ugagccgggcaucccagagcc

SEQ ID NO: 872667 - RNA, 20 nt, Human
ugcgccaggccccgaggagc

SEQ ID NO: 872668 - RNA, 22 nt, Human
ugcgcccagcaagacacaagcg

SEQ ID NO: 872669 - RNA, 19 nt, Human
ugcgggggaggagcggccc

SEQ ID NO: 872670 - RNA, 23 nt, Human
ugcuugucccucccuggccccug

SEQ ID NO: 872671 - RNA, 19 nt, Human
uggccccugugcccuaccu

SEQ ID NO: 872672 - RNA, 21 nt, Human
uuuuuuuuuuuuuuguuuugg

SEQ ID NO: 872673 - RNA, 23 nt, Human
uuuuuuuuuuuuuuuuguuuugg

SEQ ID NO: 872674 - RNA, 18 nt, Human
uuuuuuuuuuuuuuuuug

SEQ ID NO: 872675 - RNA, 24 nt, Human
uuuuuuuuuuuuuuuuuuuguuuu

SEQ ID NO: 872676 - RNA, 20 nt, Human
acgcagucccaggggaggcc

SEQ ID NO: 872677 - RNA, 26 nt, Human
acgcagucccaggggagggggaacgc

SEQ ID NO: 872678 - RNA, 20 nt, Human
acucagaaaggcagcagagg

SEQ ID NO: 872679 - RNA, 24 nt, Human
agaagccucuggggccugcugcuc

SEQ ID NO: 872680 - RNA, 22 nt, Human
agagaaacggcuccagaccagg

SEQ ID NO: 872681 - RNA, 18 nt, Human
aggauggaauagggaaga

SEQ ID NO: 872682 - RNA, 21 nt, Human
aggccacccaucaaaggaugg

SEQ ID NO: 872683 - RNA, 24 nt, Human
agggacccuagagagaaacggcuc

SEQ ID NO: 872684 - RNA, 22 nt, Human
aguggggcuggucugcuguggg

SEQ ID NO: 872685 - RNA, 25 nt, Human
cagaggugcagagaagccucugggg

SEQ ID NO: 872686 - RNA, 21 nt, Human
cccagcagaccguuaagaaag

SEQ ID NO: 872687 - RNA, 19 nt, Human
ccuguggcagcaucagccc

SEQ ID NO: 872688 - RNA, 20 nt, Human
cggagaguccugagagacag

SEQ ID NO: 872689 - RNA, 22 nt, Human
cggcuccagaccaggcuuuccc

SEQ ID NO: 872690 - RNA, 20 nt, Human
cuccucuauggcugcccgaa

SEQ ID NO: 872691 - RNA, 18 nt, Human
cugaccuugacuuccugu

SEQ ID NO: 872692 - RNA, 23 nt, Human
cuggaguggguguggccuccucu

SEQ ID NO: 872693 - RNA, 18 nt, Human
cuggggccugcugcucug

SEQ ID NO: 872694 - RNA, 22 nt, Human
gaaaggcagcagaggugcagag

SEQ ID NO: 872695 - RNA, 21 nt, Human
gacccuagagagaaacggcuc

SEQ ID NO: 872696 - RNA, 19 nt, Human
gagagacaggaggagaggg

SEQ ID NO: 872697 - RNA, 21 nt, Human
gaggugcagagaagccucugg

SEQ ID NO: 872698 - RNA, 19 nt, Human
gcagucccaggggaggccc

SEQ ID NO: 872699 - RNA, 21 nt, Human
ggagagggguucuccauggca

SEQ ID NO: 872700 - RNA, 23 nt, Human
ggaggcauccauccuugacccuc

SEQ ID NO: 872701 - RNA, 19 nt, Human
ggcucggugcugcugacag

SEQ ID NO: 872702 - RNA, 21 nt, Human
ggggaggcccacuuggguccc

SEQ ID NO: 872703 - RNA, 22 nt, Human
gguguccuggaguggguguggc

SEQ ID NO: 872704 - RNA, 22 nt, Human
guaggaugucuagugacacccc

SEQ ID NO: 872705 - RNA, 20 nt, Human
uaacaggccacccaucaaag

SEQ ID NO: 872706 - RNA, 22 nt, Human
uccauccuugacccucggagag

SEQ ID NO: 872707 - RNA, 24 nt, Human
ucggagaguccugagagacaggag

SEQ ID NO: 872708 - RNA, 22 nt, Human
ucugcuguggggccguccugug

SEQ ID NO: 872709 - RNA, 19 nt, Human
ugacaguggggcuggucug

SEQ ID NO: 872710 - RNA, 20 nt, Human
ugagagacaggaggagaggg

SEQ ID NO: 872711 - RNA, 19 nt, Human
ugcggcggagggagagaug

SEQ ID NO: 872712 - RNA, 21 nt, Human
ugcugcucuguguccuguggc

SEQ ID NO: 872713 - RNA, 21 nt, Human
uggaauagggaagaaagugag

SEQ ID NO: 872714 - RNA, 26 nt, Human
uggcagcaucagccccugcggcggag

SEQ ID NO: 872715 - RNA, 18 nt, Human
uggcagugagggguuccc

SEQ ID NO: 872716 - RNA, 23 nt, Human
uggggcuggucugcuguggggcc

SEQ ID NO: 872717 - RNA, 19 nt, Human
uguccuggagugggugugg

SEQ ID NO: 872718 - RNA, 20 nt, Human
uucccuagcagggacccuag

SEQ ID NO: 872719 - RNA, 25 nt, Human
uuuuuuuuuuucccacuuguuuuuu

SEQ ID NO: 872720 - RNA, 18 nt, Human
agaguugucaaaaggaca

SEQ ID NO: 872721 - RNA, 19 nt, Human
agaguugucaaaaggacag

SEQ ID NO: 872722 - RNA, 18 nt, Human
cauuucuguuucagaauc

SEQ ID NO: 872723 - RNA, 24 nt, Human
uaacauaaacuauuugcugauauu

SEQ ID NO: 872724 - RNA, 23 nt, Human
uaagagaguugucaaaaggacag

SEQ ID NO: 872725 - RNA, 22 nt, Human
uaagaugcaacuucuacuguga

SEQ ID NO: 872726 - RNA, 24 nt, Human
ucagagucauuaaauaagaugcaa

SEQ ID NO: 872727 - RNA, 19 nt, Human
uucagaauccccacauucc

SEQ ID NO: 872728 - RNA, 24 nt, Human
uucauuucuguuucagaaucccca

SEQ ID NO: 872729 - RNA, 22 nt, Human
uucugugucuccuucuccuuca

SEQ ID NO: 872730 - RNA, 28 nt, Human
uuucagaauccccacauuccucauuuga

SEQ ID NO: 872731 - RNA, 20 nt, Human
aaaauuaaugaauaaggaau

SEQ ID NO: 872732 - RNA, 22 nt, Human
aaaccgccacacccacaccuca

SEQ ID NO: 872733 - RNA, 21 nt, Human
aaaguuaaagugauaucgcca

SEQ ID NO: 872734 - RNA, 22 nt, Human
aagcaguucacaaccauaagua

SEQ ID NO: 872735 - RNA, 19 nt, Human
aaggaugaggauguggaga

SEQ ID NO: 872736 - RNA, 25 nt, Human
aagugauggaggcugaauuugagcc

SEQ ID NO: 872737 - RNA, 22 nt, Human
aauggccuuuacaaacuuccac

SEQ ID NO: 872738 - RNA, 21 nt, Human
acacagaaaccgccacaccca

SEQ ID NO: 872739 - RNA, 21 nt, Human
acagaaaccgccacacccaca

SEQ ID NO: 872740 - RNA, 19 nt, Human
acucuuaccucccucccca

SEQ ID NO: 872741 - RNA, 24 nt, Human
agaaaccgccacacccacaccuca

SEQ ID NO: 872742 - RNA, 24 nt, Human
agaaggcagcuuucucucuuucug

SEQ ID NO: 872743 - RNA, 22 nt, Human
agacacagaaaucaacucagcu

SEQ ID NO: 872744 - RNA, 24 nt, Human
agacacagaaaucaacucagcuga

SEQ ID NO: 872745 - RNA, 18 nt, Human
agauucugcaugacuucu

SEQ ID NO: 872746 - RNA, 19 nt, Human
agcaguucacaaccauaag

SEQ ID NO: 872747 - RNA, 26 nt, Human
agguguggcaauucagaagagcagcu

SEQ ID NO: 872748 - RNA, 19 nt, Human
aguauuaucauuuauugag

SEQ ID NO: 872749 - RNA, 20 nt, Human
auaaguaagauuuacuuccu

SEQ ID NO: 872750 - RNA, 21 nt, Human
auaaguaagauuuacuuccua

SEQ ID NO: 872751 - RNA, 24 nt, Human
aucuuucaccuccccuuucuccau

SEQ ID NO: 872752 - RNA, 19 nt, Human
augccagggccccagguuc

SEQ ID NO: 872753 - RNA, 20 nt, Human
caaguccucacccauggcca

SEQ ID NO: 872754 - RNA, 21 nt, Human
cacacagcagcccauccccag

SEQ ID NO: 872755 - RNA, 24 nt, Human
cacacccacaccucacauaccaau

SEQ ID NO: 872756 - RNA, 25 nt, Human
cacagaauuccaaguguagcacagg

SEQ ID NO: 872757 - RNA, 21 nt, Human
cacauaccaugacagggugga

SEQ ID NO: 872758 - RNA, 22 nt, Human
cacccauggccaggaaugaggc

SEQ ID NO: 872759 - RNA, 19 nt, Human
cacgguaucuuuaaaaaac

SEQ ID NO: 872760 - RNA, 20 nt, Human
cacugacaggaggguccuuu

SEQ ID NO: 872761 - RNA, 21 nt, Human
cagaccaaguccucacccaug

SEQ ID NO: 872762 - RNA, 25 nt, Human
cagagcacagaauuccaaguguagc

SEQ ID NO: 872763 - RNA, 19 nt, Human
caucucacacacucacaga

SEQ ID NO: 872764 - RNA, 22 nt, Human
cauugacaggaaccugcucuuc

SEQ ID NO: 872765 - RNA, 21 nt, Human
ccaaguuuuacuuuauagcua

SEQ ID NO: 872766 - RNA, 21 nt, Human
ccacacccacaccucacauac

SEQ ID NO: 872767 - RNA, 20 nt, Human
ccacaccucacauaccauga

SEQ ID NO: 872768 - RNA, 19 nt, Human
ccagaacuaagcuuuacau

SEQ ID NO: 872769 - RNA, 18 nt, Human
ccaggaaugaggcacagg

SEQ ID NO: 872770 - RNA, 18 nt, Human
cccacuguggaagaaggc

SEQ ID NO: 872771 - RNA, 19 nt, Human
cccauggccaggaaugagg

SEQ ID NO: 872772 - RNA, 21 nt, Human
ccucuugcaucucuucaaaaa

SEQ ID NO: 872773 - RNA, 20 nt, Human
cgaacucagaacauugacag

SEQ ID NO: 872774 - RNA, 26 nt, Human
cgguugaccucugugugagauggcac

SEQ ID NO: 872775 - RNA, 23 nt, Human
cuccagaaggcagcuuucucucu

SEQ ID NO: 872776 - RNA, 22 nt, Human
cucuccuggggaaaagagccua

SEQ ID NO: 872777 - RNA, 29 nt, Human
cugacccuacucuuaccucccuccccauc

SEQ ID NO: 872778 - RNA, 19 nt, Human
cugggcccucuugcaucuc

SEQ ID NO: 872779 - RNA, 18 nt, Human
gaaaccgccacacccaca

SEQ ID NO: 872780 - RNA, 21 nt, Human
gaaauagacacagaaaucaac

SEQ ID NO: 872781 - RNA, 18 nt, Human
gaacgucaacauucacac

SEQ ID NO: 872782 - RNA, 18 nt, Human
gaagagcagcugucaaca

SEQ ID NO: 872783 - RNA, 24 nt, Human
gaggaugccuaguggcaggugcag

SEQ ID NO: 872784 - RNA, 18 nt, Human
gccaaguggaaguagagc

SEQ ID NO: 872785 - RNA, 18 nt, Human
gggaauauaauaggcugu

SEQ ID NO: 872786 - RNA, 21 nt, Human
ggugucaaaggauggaagggu

SEQ ID NO: 872787 - RNA, 22 nt, Human
ggugucaaaggauggaaggguu

SEQ ID NO: 872788 - RNA, 23 nt, Human
ggugucaaaggauggaaggguuc

SEQ ID NO: 872789 - RNA, 24 nt, Human
guacacagaaaccgccacacccac

SEQ ID NO: 872790 - RNA, 21 nt, Human
gucaugucuggccaugucucc

SEQ ID NO: 872791 - RNA, 21 nt, Human
guggaaguagagcugucgcuu

SEQ ID NO: 872792 - RNA, 18 nt, Human
gugucaaaggauggaagg

SEQ ID NO: 872793 - RNA, 22 nt, Human
gugucaaaggauggaaggguuc

SEQ ID NO: 872794 - RNA, 18 nt, Human
uaacuuggccgguugugg

SEQ ID NO: 872795 - RNA, 18 nt, Human
uaagaaaacuggagaaau

SEQ ID NO: 872796 - RNA, 23 nt, Human
uaagugauggaggcugaauuuga

SEQ ID NO: 872797 - RNA, 21 nt, Human
uacacagaaaccgccacaccc

SEQ ID NO: 872798 - RNA, 20 nt, Human
uacacauacaaccagguguc

SEQ ID NO: 872799 - RNA, 24 nt, Human
uacagcuuugcacacugacaggag

SEQ ID NO: 872800 - RNA, 19 nt, Human
uagcauguggaaucagucc

SEQ ID NO: 872801 - RNA, 20 nt, Human
uaucaugccaggcugggaga

SEQ ID NO: 872802 - RNA, 22 nt, Human
ucaacauucacacagcagccca

SEQ ID NO: 872803 - RNA, 21 nt, Human
ucacacagcagcccaucccca

SEQ ID NO: 872804 - RNA, 24 nt, Human
ucagaacauugacaggaaccugcu

SEQ ID NO: 872805 - RNA, 20 nt, Human
uccaugagauuacagcuuug

SEQ ID NO: 872806 - RNA, 23 nt, Human
ucccaaagaccauccuaagagcc

SEQ ID NO: 872807 - RNA, 25 nt, Human
ucccuccccaucaauucaagcugaa

SEQ ID NO: 872808 - RNA, 21 nt, Human
ucugugacuuugucgugugug

SEQ ID NO: 872809 - RNA, 25 nt, Human
ucugugacuuugucgugugugggag

SEQ ID NO: 872810 - RNA, 19 nt, Human
ugaaauagacacagaaauc

SEQ ID NO: 872811 - RNA, 18 nt, Human
ugaaucccaaagaccauc

SEQ ID NO: 872812 - RNA, 23 nt, Human
ugaauggccuuuacaaacuucca

SEQ ID NO: 872813 - RNA, 18 nt, Human
ugacaggaaccugcucuu

SEQ ID NO: 872814 - RNA, 18 nt, Human
ugaccaaguuuggauuua

SEQ ID NO: 872815 - RNA, 22 nt, Human
ugaccucagcucugucuagcac

SEQ ID NO: 872816 - RNA, 24 nt, Human
ugaccuugaccauccuaaucacac

SEQ ID NO: 872817 - RNA, 20 nt, Human
ugacuucuccuguccauccc

SEQ ID NO: 872818 - RNA, 21 nt, Human
ugagcaaacguacacagaaac

SEQ ID NO: 872819 - RNA, 20 nt, Human
ugauaucgccaggguuccug

SEQ ID NO: 872820 - RNA, 24 nt, Human
ugcguguaugagcaaacguacaca

SEQ ID NO: 872821 - RNA, 19 nt, Human
ugcuccaucaucacucucc

SEQ ID NO: 872822 - RNA, 21 nt, Human
uggaaucaguccuccagaagg

SEQ ID NO: 872823 - RNA, 19 nt, Human
uggcaggguauagcagaga

SEQ ID NO: 872824 - RNA, 22 nt, Human
uggccaggaaugaggcacaggc

SEQ ID NO: 872825 - RNA, 22 nt, Human
uggcccccucucuucuaguccc

SEQ ID NO: 872826 - RNA, 18 nt, Human
uggcuugugcccaguggc

SEQ ID NO: 872827 - RNA, 19 nt, Human
ugguaagugauggaggcug

SEQ ID NO: 872828 - RNA, 21 nt, Human
ugguauuauuuuccccgucuu

SEQ ID NO: 872829 - RNA, 22 nt, Human
uguagacuauucaaucuacacc

SEQ ID NO: 872830 - RNA, 18 nt, Human
ugucaaaggauggaaggg

SEQ ID NO: 872831 - RNA, 21 nt, Human
ugucaaaggauggaaggguuc

SEQ ID NO: 872832 - RNA, 18 nt, Human
uguggccagaacuaagcu

SEQ ID NO: 872833 - RNA, 24 nt, Human
uguguucuaucugcauuccugcuu

SEQ ID NO: 872834 - RNA, 18 nt, Human
uucacacagcagcccauc

SEQ ID NO: 872835 - RNA, 23 nt, Human
uuccacccaaguuuuacuuuaua

SEQ ID NO: 872836 - RNA, 21 nt, Human
aacagaagcuccccacccccu

SEQ ID NO: 872837 - RNA, 21 nt, Human
aaggauucaggcucggccucc

SEQ ID NO: 872838 - RNA, 19 nt, Human
acacagcaacagacaccac

SEQ ID NO: 872839 - RNA, 20 nt, Human
acacugaaaguugcauaacu

SEQ ID NO: 872840 - RNA, 19 nt, Human
acagaagcuccccaccccc

SEQ ID NO: 872841 - RNA, 20 nt, Human
acaggcccccgcugcccacc

SEQ ID NO: 872842 - RNA, 22 nt, Human
acccccagagccuucccugccc

SEQ ID NO: 872843 - RNA, 23 nt, Human
agcaggcagggggcaguuagggg

SEQ ID NO: 872844 - RNA, 19 nt, Human
agccagcgccgguguggcg

SEQ ID NO: 872845 - RNA, 21 nt, Human
agcugggccuggggcagugcc

SEQ ID NO: 872846 - RNA, 22 nt, Human
aggcaaacgcaauccggguccg

SEQ ID NO: 872847 - RNA, 21 nt, Human
aggcagggggcaguuaggggu

SEQ ID NO: 872848 - RNA, 23 nt, Human
aggcagggggcaguuaggggugc

SEQ ID NO: 872849 - RNA, 21 nt, Human
agggaccuagggccaggagcu

SEQ ID NO: 872850 - RNA, 22 nt, Human
aggggugcaagagagcccaggg

SEQ ID NO: 872851 - RNA, 20 nt, Human
aucucuucugcugucuccca

SEQ ID NO: 872852 - RNA, 23 nt, Human
caaggcaguggacgucacuuggg

SEQ ID NO: 872853 - RNA, 22 nt, Human
caaggcgaagcgcucgucuccu

SEQ ID NO: 872854 - RNA, 25 nt, Human
cacacacaggcacacgcaugucagc

SEQ ID NO: 872855 - RNA, 24 nt, Human
cacacgcaugucagcaagcacgug

SEQ ID NO: 872856 - RNA, 24 nt, Human
caccacacacaggcacacgcaugg

SEQ ID NO: 872857 - RNA, 18 nt, Human
cacccccucucccauuuc

SEQ ID NO: 872858 - RNA, 22 nt, Human
cacgacacagcaacagacacca

SEQ ID NO: 872859 - RNA, 23 nt, Human
cacucugugggggcagcccugau

SEQ ID NO: 872860 - RNA, 22 nt, Human
cagaacagaagcuccccacccc

SEQ ID NO: 872861 - RNA, 23 nt, Human
cagacaccacacacaggcacacg

SEQ ID NO: 872862 - RNA, 19 nt, Human
cagggagggccgggccggg

SEQ ID NO: 872863 - RNA, 25 nt, Human
cagggcaccaggguguuaggguccc

SEQ ID NO: 872864 - RNA, 22 nt, Human
ccagggagggccgggccgggca

SEQ ID NO: 872865 - RNA, 20 nt, Human
cccacggcaugcccggcagg

SEQ ID NO: 872866 - RNA, 18 nt, Human
cccaugcgccacccucgc

SEQ ID NO: 872867 - RNA, 24 nt, Human
ccccagagaucugggguucuccaa

SEQ ID NO: 872868 - RNA, 20 nt, Human
cccccagagccuucccugcc

SEQ ID NO: 872869 - RNA, 23 nt, Human
cccccagagccuucccugcccau

SEQ ID NO: 872870 - RNA, 18 nt, Human
cccccgcugcccaccgcc

SEQ ID NO: 872871 - RNA, 18 nt, Human
cccccucucccauuucag

SEQ ID NO: 872872 - RNA, 20 nt, Human
ccccgcugcccaccgccugg

SEQ ID NO: 872873 - RNA, 20 nt, Human
ccggccgguggccugggccu

SEQ ID NO: 872874 - RNA, 21 nt, Human
ccgguggccugggccugacca

SEQ ID NO: 872875 - RNA, 27 nt, Human
ccuagggccaggagcugggccuggggc

SEQ ID NO: 872876 - RNA, 22 nt, Human
ccucccaugcgccacccucgcc

SEQ ID NO: 872877 - RNA, 21 nt, Human
ccucccgccccacucucucca

SEQ ID NO: 872878 - RNA, 26 nt, Human
ccucccgccccacucucuccagagcc

SEQ ID NO: 872879 - RNA, 25 nt, Human
ccucgcccaccacacuggggccgga

SEQ ID NO: 872880 - RNA, 21 nt, Human
ccuggcugggccccagagauc

SEQ ID NO: 872881 - RNA, 23 nt, Human
cgcaugcaaacacacuuaaagca

SEQ ID NO: 872882 - RNA, 19 nt, Human
cgccgguguggcggccucg

SEQ ID NO: 872883 - RNA, 24 nt, Human
cgggccgggcagggagccagcgcc

SEQ ID NO: 872884 - RNA, 26 nt, Human
cggguuggggggacagggaugugugg

SEQ ID NO: 872885 - RNA, 23 nt, Human
cuaaggcaaacgcaauccggguc

SEQ ID NO: 872886 - RNA, 24 nt, Human
cuccagagccccgagacccucagg

SEQ ID NO: 872887 - RNA, 22 nt, Human
cucccauuucaguagauggaag

SEQ ID NO: 872888 - RNA, 20 nt, Human
cucgccuuggccgggcccac

SEQ ID NO: 872889 - RNA, 18 nt, Human
cugcccccacacccugcc

SEQ ID NO: 872890 - RNA, 24 nt, Human
cuggcugggccccagagaucuggg

SEQ ID NO: 872891 - RNA, 23 nt, Human
cuggugcagggcaccaggguguu

SEQ ID NO: 872892 - RNA, 22 nt, Human
gaacagaagcuccccacccccu

SEQ ID NO: 872893 - RNA, 19 nt, Human
gaagggagcggggaggggc

SEQ ID NO: 872894 - RNA, 19 nt, Human
gacccccagagccuucccu

SEQ ID NO: 872895 - RNA, 18 nt, Human
gagcaggcagggggcagu

SEQ ID NO: 872896 - RNA, 22 nt, Human
gaggagggcagggguucccggg

SEQ ID NO: 872897 - RNA, 21 nt, Human
gcacagcugcccccacacccu

SEQ ID NO: 872898 - RNA, 25 nt, Human
gccccaggggcggugcggccugcuu

SEQ ID NO: 872899 - RNA, 19 nt, Human
gcccugauucuaucucuuc

SEQ ID NO: 872900 - RNA, 21 nt, Human
gcccugauucuaucucuucug

SEQ ID NO: 872901 - RNA, 18 nt, Human
gccggagcagggcggucg

SEQ ID NO: 872902 - RNA, 19 nt, Human
gccucccaugcgccacccu

SEQ ID NO: 872903 - RNA, 18 nt, Human
gccuggcugggccccaga

SEQ ID NO: 872904 - RNA, 20 nt, Human
ggaagcuguggcagaacccg

SEQ ID NO: 872905 - RNA, 19 nt, Human
ggaaggggcuggcaggggg

SEQ ID NO: 872906 - RNA, 19 nt, Human
ggacaggcccccgcugccc

SEQ ID NO: 872907 - RNA, 19 nt, Human
ggaggaaaaggcccugggg

SEQ ID NO: 872908 - RNA, 21 nt, Human
ggcacauggggcugggaggga

SEQ ID NO: 872909 - RNA, 24 nt, Human
ggcaggcacauggggcugggaggg

SEQ ID NO: 872910 - RNA, 23 nt, Human
ggcagggggccccaggggcggug

SEQ ID NO: 872911 - RNA, 18 nt, Human
ggccuggggcagugccgg

SEQ ID NO: 872912 - RNA, 22 nt, Human
ggcugggagggaccuagggcca

SEQ ID NO: 872913 - RNA, 24 nt, Human
gggcagggguucccggguuggggg

SEQ ID NO: 872914 - RNA, 21 nt, Human
gggccgggccgggcagggagc

SEQ ID NO: 872915 - RNA, 23 nt, Human
gggcuggcagggggccccagggg

SEQ ID NO: 872916 - RNA, 22 nt, Human
ggggaaggauggcgggagaggg

SEQ ID NO: 872917 - RNA, 18 nt, Human
gggggccugcccgggucc

SEQ ID NO: 872918 - RNA, 18 nt, Human
guagcuuccaggacuccu

SEQ ID NO: 872919 - RNA, 19 nt, Human
gugcggccugcuggaggag

SEQ ID NO: 872920 - RNA, 22 nt, Human
uaacuguggccucgagggccac

SEQ ID NO: 872921 - RNA, 21 nt, Human
uagccccuugggucccacucu

SEQ ID NO: 872922 - RNA, 25 nt, Human
ucaggcucggccucccaugcgccac

SEQ ID NO: 872923 - RNA, 22 nt, Human
uccauaagaccccugaacuugc

SEQ ID NO: 872924 - RNA, 22 nt, Human
ucccaaagaaaaaaacauuuua

SEQ ID NO: 872925 - RNA, 21 nt, Human
uccccacccccucucccauuu

SEQ ID NO: 872926 - RNA, 21 nt, Human
ucccgccccacucucuccaga

SEQ ID NO: 872927 - RNA, 22 nt, Human
ucccgccccacucucuccagaa

SEQ ID NO: 872928 - RNA, 23 nt, Human
ucccuucaccagaacagaagcug

SEQ ID NO: 872929 - RNA, 20 nt, Human
ucggaggcuucucggagaau

SEQ ID NO: 872930 - RNA, 23 nt, Human
ucggugccuccuaauuucugcag

SEQ ID NO: 872931 - RNA, 22 nt, Human
ucuaucucuucugcugucuccc

SEQ ID NO: 872932 - RNA, 20 nt, Human
ucuccagagccccgagaccc

SEQ ID NO: 872933 - RNA, 24 nt, Human
ucucccagccugggaaggggcugg

SEQ ID NO: 872934 - RNA, 22 nt, Human
ucugcagauucuaaggccaaaa

SEQ ID NO: 872935 - RNA, 20 nt, Human
ucugugggggcagcccugau

SEQ ID NO: 872936 - RNA, 24 nt, Human
ucuucugcugucucccagccuggg

SEQ ID NO: 872937 - RNA, 25 nt, Human
ugagguagauuggcacagcugcccc

SEQ ID NO: 872938 - RNA, 23 nt, Human
ugcauaacuguggccucgagggc

SEQ ID NO: 872939 - RNA, 24 nt, Human
ugccagggagggccgggccgggca

SEQ ID NO: 872940 - RNA, 18 nt, Human
ugcccccacacccugccu

SEQ ID NO: 872941 - RNA, 21 nt, Human
ugcccgggucccuucaccaga

SEQ ID NO: 872942 - RNA, 19 nt, Human
ugccggagcaggcaggggg

SEQ ID NO: 872943 - RNA, 23 nt, Human
ugccggagcaggcagggggcagu

SEQ ID NO: 872944 - RNA, 19 nt, Human
uggaagacgcagaggagga

SEQ ID NO: 872945 - RNA, 19 nt, Human
uggaagggagcggggaggg

SEQ ID NO: 872946 - RNA, 20 nt, Human
uggaggagggcagggguucc

SEQ ID NO: 872947 - RNA, 23 nt, Human
uggcacagcugcccccacacccu

SEQ ID NO: 872948 - RNA, 23 nt, Human
uggcagaacccggccgguggccu

SEQ ID NO: 872949 - RNA, 24 nt, Human
uggcagggggccccaggggcggug

SEQ ID NO: 872950 - RNA, 20 nt, Human
uggcccgcgcggcacucgcc

SEQ ID NO: 872951 - RNA, 22 nt, Human
uggccugggccugaccacggcc

SEQ ID NO: 872952 - RNA, 24 nt, Human
ugggaagcuguggcagaacccggc

SEQ ID NO: 872953 - RNA, 22 nt, Human
ugggaaggggcuggcagggggc

SEQ ID NO: 872954 - RNA, 23 nt, Human
ugggaaggggcuggcagggggcc

SEQ ID NO: 872955 - RNA, 22 nt, Human
uggggaaggauggcgggagagg

SEQ ID NO: 872956 - RNA, 22 nt, Human
ugggggccugcccgggucccuu

SEQ ID NO: 872957 - RNA, 19 nt, Human
uggggugcugggggccugc

SEQ ID NO: 872958 - RNA, 18 nt, Human
uggugacaaggcagugga

SEQ ID NO: 872959 - RNA, 19 nt, Human
ugucagcaagcacguggga

SEQ ID NO: 872960 - RNA, 23 nt, Human
uguuaggguccccaugcuuccuc

SEQ ID NO: 872961 - RNA, 18 nt, Human
uucacagauauuuuuagg

SEQ ID NO: 872962 - RNA, 23 nt, Human
uucccaaagaaaaaaacauuuua

SEQ ID NO: 872963 - RNA, 20 nt, Human
uuccucagggggugggcaug

SEQ ID NO: 872964 - RNA, 21 nt, Human
uucuaaggccaaaaaauaaaa

SEQ ID NO: 872965 - RNA, 23 nt, Human
uugcuccauucacagauauuuuu

SEQ ID NO: 872966 - RNA, 21 nt, Human
uuuuuuuuuuuuuuucccaaa

SEQ ID NO: 872967 - RNA, 20 nt, Human
auuacaaaauagugaccgcg

SEQ ID NO: 872968 - RNA, 20 nt, Human
cacccaggcccccaccacuc

SEQ ID NO: 872969 - RNA, 22 nt, Human
cagcccaguacaccugcaacgg

SEQ ID NO: 872970 - RNA, 24 nt, Human
cagcuggaucagcuccagccacau

SEQ ID NO: 872971 - RNA, 21 nt, Human
ccaggcccccaccacuccacc

SEQ ID NO: 872972 - RNA, 19 nt, Human
ccccacagaguuccucucu

SEQ ID NO: 872973 - RNA, 21 nt, Human
ccccaccacuccacacgggcg

SEQ ID NO: 872974 - RNA, 19 nt, Human
cuccacacgggcggagagc

SEQ ID NO: 872975 - RNA, 22 nt, Human
gaucccugacagcccaguacac

SEQ ID NO: 872976 - RNA, 24 nt, Human
gcccccaccacuccacacgggcgg

SEQ ID NO: 872977 - RNA, 22 nt, Human
gcggagagcagaaacccgggag

SEQ ID NO: 872978 - RNA, 21 nt, Human
uacaccugcaacggcccccac

SEQ ID NO: 872979 - RNA, 24 nt, Human
ucccacccaggcccccaccacucc

SEQ ID NO: 872980 - RNA, 24 nt, Human
ugguauagaaaagaucccugacag

SEQ ID NO: 872981 - RNA, 19 nt, Human
uuuuuuuuuuuuguagguc

SEQ ID NO: 872982 - RNA, 19 nt, Human
uuuuuuuuuuuuuuuuugu

SEQ ID NO: 872983 - RNA, 23 nt, Human
uuuuuuuuuuuuuuuuuuguagg

SEQ ID NO: 872984 - RNA, 21 nt, Human
aaacccaagacugcccagcaa

SEQ ID NO: 872985 - RNA, 19 nt, Human
aaagugcugggauuacugg

SEQ ID NO: 872986 - RNA, 24 nt, Human
aaagugcugggauuacuggcauga

SEQ ID NO: 872987 - RNA, 25 nt, Human
aagcaauccucccaccucggccucc

SEQ ID NO: 872988 - RNA, 20 nt, Human
aagcauuugcuguuuccugc

SEQ ID NO: 872989 - RNA, 26 nt, Human
aagugcugggauuacuggcaugaacc

SEQ ID NO: 872990 - RNA, 18 nt, Human
acacucaggagaccaaga

SEQ ID NO: 872991 - RNA, 21 nt, Human
accagcgccacuggcaucauc

SEQ ID NO: 872992 - RNA, 21 nt, Human
acccagccauuccugggccug

SEQ ID NO: 872993 - RNA, 23 nt, Human
accuggguacacucaggagacca

SEQ ID NO: 872994 - RNA, 18 nt, Human
agacaggaucuugcugug

SEQ ID NO: 872995 - RNA, 20 nt, Human
agagcccagcccccuccugc

SEQ ID NO: 872996 - RNA, 25 nt, Human
agagcccagcccccuccugccaggu

SEQ ID NO: 872997 - RNA, 23 nt, Human
agccagacguggggcaaaggugu

SEQ ID NO: 872998 - RNA, 20 nt, Human
agcccaggccagcccugcaa

SEQ ID NO: 872999 - RNA, 18 nt, Human
aggcagugcaggguccuc

SEQ ID NO: 873000 - RNA, 22 nt, Human
aggcagugcaggguccucuggg

SEQ ID NO: 873001 - RNA, 19 nt, Human
agugugaggaacagagaga

SEQ ID NO: 873002 - RNA, 18 nt, Human
aucacggacaucauggag

SEQ ID NO: 873003 - RNA, 24 nt, Human
aucuugcuguguugcccaggcugg

SEQ ID NO: 873004 - RNA, 22 nt, Human
caaagacaggaucuugcugugu

SEQ ID NO: 873005 - RNA, 18 nt, Human
caaagccacaggugaccu

SEQ ID NO: 873006 - RNA, 18 nt, Human
cacagcccaggccagccc

SEQ ID NO: 873007 - RNA, 19 nt, Human
cacagcccaggccagcccu

SEQ ID NO: 873008 - RNA, 20 nt, Human
cacagcccgcugguucuccu

SEQ ID NO: 873009 - RNA, 18 nt, Human
cacuaaacccaagacugc

SEQ ID NO: 873010 - RNA, 25 nt, Human
cacugcacuguuccuccaggucucc

SEQ ID NO: 873011 - RNA, 19 nt, Human
cagcauugcggcacuaaac

SEQ ID NO: 873012 - RNA, 20 nt, Human
cagcgccacuggcaucaucg

SEQ ID NO: 873013 - RNA, 20 nt, Human
cagcuccuacggggugggga

SEQ ID NO: 873014 - RNA, 22 nt, Human
caggaagcagccugucagaagu

SEQ ID NO: 873015 - RNA, 24 nt, Human
caggaucuugcuguguugcccagg

SEQ ID NO: 873016 - RNA, 23 nt, Human
cagggcccaggaguccccagcuc

SEQ ID NO: 873017 - RNA, 22 nt, Human
caggugaccuggggccaaugcc

SEQ ID NO: 873018 - RNA, 19 nt, Human
caguggccgagccaucccc

SEQ ID NO: 873019 - RNA, 18 nt, Human
caucacggacaucaugga

SEQ ID NO: 873020 - RNA, 23 nt, Human
cauccccgcccacacaugcugcc

SEQ ID NO: 873021 - RNA, 19 nt, Human
ccaaagccacaggugaccu

SEQ ID NO: 873022 - RNA, 19 nt, Human
ccagcccugcaacugcucu

SEQ ID NO: 873023 - RNA, 22 nt, Human
ccauuccugggccugccgccua

SEQ ID NO: 873024 - RNA, 21 nt, Human
cccaagacugcccagcaacuc

SEQ ID NO: 873025 - RNA, 20 nt, Human
cccacacaugcugcccggca

SEQ ID NO: 873026 - RNA, 19 nt, Human
cccacagcccaggccagcc

SEQ ID NO: 873027 - RNA, 25 nt, Human
cccacagcccaggccagcccugcaa

SEQ ID NO: 873028 - RNA, 20 nt, Human
cccagcccccuccugccagg

SEQ ID NO: 873029 - RNA, 21 nt, Human
ccccggaggacugcuguggcc

SEQ ID NO: 873030 - RNA, 22 nt, Human
cccguggcaacucagggcagcc

SEQ ID NO: 873031 - RNA, 21 nt, Human
ccuacgggguggggagaaguc

SEQ ID NO: 873032 - RNA, 21 nt, Human
ccuccacgcucacaucacgga

SEQ ID NO: 873033 - RNA, 22 nt, Human
ccuccacgcucacaucacggac

SEQ ID NO: 873034 - RNA, 25 nt, Human
ccuccaggucuccccaagguuggcu

SEQ ID NO: 873035 - RNA, 19 nt, Human
ccugcaacugcucucccca

SEQ ID NO: 873036 - RNA, 24 nt, Human
ccuggccucaagcaauccucccac

SEQ ID NO: 873037 - RNA, 18 nt, Human
ccuguccugcaacgaggg

SEQ ID NO: 873038 - RNA, 19 nt, Human
cgaaagugcugggauuacu

SEQ ID NO: 873039 - RNA, 24 nt, Human
cgaaagugcugggauuacuggcau

SEQ ID NO: 873040 - RNA, 21 nt, Human
cgccuaggggcucacagggcc

SEQ ID NO: 873041 - RNA, 24 nt, Human
cucaagcaauccucccaccucggc

SEQ ID NO: 873042 - RNA, 27 nt, Human
cuccuggccucaagcaauccucccacc

SEQ ID NO: 873043 - RNA, 21 nt, Human
cucggccuccgaaagugcugg

SEQ ID NO: 873044 - RNA, 20 nt, Human
cugccugaggcugggccccg

SEQ ID NO: 873045 - RNA, 22 nt, Human
cuggccucaagcaauccuccca

SEQ ID NO: 873046 - RNA, 19 nt, Human
cugggugggaaggacgugc

SEQ ID NO: 873047 - RNA, 22 nt, Human
cuugcuguguugcccaggcugg

SEQ ID NO: 873048 - RNA, 21 nt, Human
cuuuacacugcacuguuccuc

SEQ ID NO: 873049 - RNA, 24 nt, Human
gaaaacggcacagcugccucccac

SEQ ID NO: 873050 - RNA, 24 nt, Human
gaaagugcugggauuacuggcaug

SEQ ID NO: 873051 - RNA, 23 nt, Human
gagcaggaccaccacugcgggga

SEQ ID NO: 873052 - RNA, 18 nt, Human
gagccauccccgcccaca

SEQ ID NO: 873053 - RNA, 22 nt, Human
gauuacuggcaugaaccacugc

SEQ ID NO: 873054 - RNA, 24 nt, Human
gcacuaaacccaagacugcccagc

SEQ ID NO: 873055 - RNA, 22 nt, Human
gccgagccauccccgcccacac

SEQ ID NO: 873056 - RNA, 22 nt, Human
gcggucccaauggcugucagaa

SEQ ID NO: 873057 - RNA, 20 nt, Human
gcuggaacucaauuucugca

SEQ ID NO: 873058 - RNA, 23 nt, Human
gcuggucuugaacuccuggccuc

SEQ ID NO: 873059 - RNA, 24 nt, Human
gcuguguugcccaggcuggucuug

SEQ ID NO: 873060 - RNA, 24 nt, Human
ggagaagcccgucugcaagccgga

SEQ ID NO: 873061 - RNA, 21 nt, Human
ggaggcggguccucggggagg

SEQ ID NO: 873062 - RNA, 22 nt, Human
ggaggcggguccucggggaggg

SEQ ID NO: 873063 - RNA, 19 nt, Human
ggcccuggauguucacccc

SEQ ID NO: 873064 - RNA, 24 nt, Human
ggcuggucuugaacuccuggccuc

SEQ ID NO: 873065 - RNA, 18 nt, Human
gggcaucaggccaggcgc

SEQ ID NO: 873066 - RNA, 20 nt, Human
ggggaggggcagcuuccaca

SEQ ID NO: 873067 - RNA, 23 nt, Human
ggggaggggcagcuuccacagug

SEQ ID NO: 873068 - RNA, 24 nt, Human
ggggaggggcagcuuccacagugu

SEQ ID NO: 873069 - RNA, 21 nt, Human
gggugggagaagcccgucugc

SEQ ID NO: 873070 - RNA, 24 nt, Human
guacacucaggagaccaagagcac

SEQ ID NO: 873071 - RNA, 23 nt, Human
guaccggaccuucuccuccucca

SEQ ID NO: 873072 - RNA, 19 nt, Human
gucacagccagacgugggg

SEQ ID NO: 873073 - RNA, 19 nt, Human
uaaacccaagacugcccag

SEQ ID NO: 873074 - RNA, 22 nt, Human
uacccagccauuccugggccug

SEQ ID NO: 873075 - RNA, 21 nt, Human
uacuagaagagcugaccuuuu

SEQ ID NO: 873076 - RNA, 21 nt, Human
uaugaugacccuguccugcaa

SEQ ID NO: 873077 - RNA, 22 nt, Human
uaugaugacccuguccugcaac

SEQ ID NO: 873078 - RNA, 18 nt, Human
ucacagccagguaggccc

SEQ ID NO: 873079 - RNA, 18 nt, Human
ucagcgucacagccaggu

SEQ ID NO: 873080 - RNA, 25 nt, Human
ucaggccaggcgcgcucggugcaca

SEQ ID NO: 873081 - RNA, 18 nt, Human
ucccaguuuuuccuguuu

SEQ ID NO: 873082 - RNA, 21 nt, Human
uccccgcccacacaugcugcc

SEQ ID NO: 873083 - RNA, 24 nt, Human
uccgaaagugcugggauuacuggc

SEQ ID NO: 873084 - RNA, 22 nt, Human
ucggggaggggcagcuuccaca

SEQ ID NO: 873085 - RNA, 23 nt, Human
ucggugcacaccgcaccugggag

SEQ ID NO: 873086 - RNA, 22 nt, Human
ucucccaguuuuuccuguuugg

SEQ ID NO: 873087 - RNA, 20 nt, Human
ucugcaagccggagcaccac

SEQ ID NO: 873088 - RNA, 22 nt, Human
ucuguagccgagagcccagccc

SEQ ID NO: 873089 - RNA, 19 nt, Human
ucugugacgaccgcugggg

SEQ ID NO: 873090 - RNA, 21 nt, Human
ucuugaacuccuggccucaag

SEQ ID NO: 873091 - RNA, 18 nt, Human
ucuugcuguguugcccag

SEQ ID NO: 873092 - RNA, 19 nt, Human
ucuugcuguguugcccagg

SEQ ID NO: 873093 - RNA, 23 nt, Human
ucuugcuguguugcccaggcugg

SEQ ID NO: 873094 - RNA, 24 nt, Human
ucuugcuguguugcccaggcuggu

SEQ ID NO: 873095 - RNA, 24 nt, Human
ugaacuccuggccucaagcaaucc

SEQ ID NO: 873096 - RNA, 22 nt, Human
ugacgaccgcuggggcagagug

SEQ ID NO: 873097 - RNA, 20 nt, Human
ugcaagccggagcaccacca

SEQ ID NO: 873098 - RNA, 23 nt, Human
ugcacuguuccuccaggucuccc

SEQ ID NO: 873099 - RNA, 18 nt, Human
ugcaggguccucugggug

SEQ ID NO: 873100 - RNA, 24 nt, Human
ugcccaggcuggucuugaacuccu

SEQ ID NO: 873101 - RNA, 18 nt, Human
ugcccuggccaggucccu

SEQ ID NO: 873102 - RNA, 24 nt, Human
ugcuguguugcccaggcuggucuu

SEQ ID NO: 873103 - RNA, 24 nt, Human
uggcaucaucgaaagcgacagcca

SEQ ID NO: 873104 - RNA, 20 nt, Human
uggccucaagcaauccuccc

SEQ ID NO: 873105 - RNA, 21 nt, Human
uggccucaagcaauccuccca

SEQ ID NO: 873106 - RNA, 25 nt, Human
uggccucaagcaauccucccaccuc

SEQ ID NO: 873107 - RNA, 24 nt, Human
uggcugucagaaaacggcacagcu

SEQ ID NO: 873108 - RNA, 22 nt, Human
ugggaaggacgugcccgcggug

SEQ ID NO: 873109 - RNA, 19 nt, Human
ugggagaagcccgucugca

SEQ ID NO: 873110 - RNA, 19 nt, Human
ugggauuacuggcaugaac

SEQ ID NO: 873111 - RNA, 22 nt, Human
ugggauuacuggcaugaaccac

SEQ ID NO: 873112 - RNA, 24 nt, Human
ugggauuacuggcaugaaccacug

SEQ ID NO: 873113 - RNA, 26 nt, Human
ugggauuacuggcaugaaccacugcg

SEQ ID NO: 873114 - RNA, 18 nt, Human
ugggugggaaggacgugc

SEQ ID NO: 873115 - RNA, 19 nt, Human
uguagccgagagcccagcc

SEQ ID NO: 873116 - RNA, 21 nt, Human
ugucagaaaacggcacagcug

SEQ ID NO: 873117 - RNA, 19 nt, Human
ugugacgaccgcuggggca

SEQ ID NO: 873118 - RNA, 24 nt, Human
uguguugcccaggcuggucuugaa

SEQ ID NO: 873119 - RNA, 18 nt, Human
uguugcccaggcuggucu

SEQ ID NO: 873120 - RNA, 22 nt, Human
uguugcccaggcuggucuugaa

SEQ ID NO: 873121 - RNA, 19 nt, Human
uuaagcacugcacgauacu

SEQ ID NO: 873122 - RNA, 22 nt, Human
uucccuguccuacccagccauu

SEQ ID NO: 873123 - RNA, 24 nt, Human
uuccugggccugccgccuaggggc

SEQ ID NO: 873124 - RNA, 26 nt, Human
uucugugacgaccgcuggggcagagu

SEQ ID NO: 873125 - RNA, 21 nt, Human
uuuuuuuuuuuuuuuuugaca

SEQ ID NO: 873126 - RNA, 27 nt, Human
uuuuuuuuuuuuuuuuuuuuuuugggg

SEQ ID NO: 873127 - RNA, 21 nt, Human
agaaagcaugaauccaaaagg

SEQ ID NO: 873128 - RNA, 18 nt, Human
agcccuugauggugcaac

SEQ ID NO: 873129 - RNA, 18 nt, Human
agcugagaaaauaugcac

SEQ ID NO: 873130 - RNA, 24 nt, Human
augaaccagauauuuuauggccuu

SEQ ID NO: 873131 - RNA, 21 nt, Human
caguuuuauucuucuagagca

SEQ ID NO: 873132 - RNA, 19 nt, Human
ccaaccaaauuuggaccca

SEQ ID NO: 873133 - RNA, 23 nt, Human
ccagauauuuuauggccuuuccu

SEQ ID NO: 873134 - RNA, 18 nt, Human
ccgcugcccucagggggc

SEQ ID NO: 873135 - RNA, 25 nt, Human
ccggcuccgcggcccgucgccgccc

SEQ ID NO: 873136 - RNA, 21 nt, Human
ccgggucuugucuccccgcug

SEQ ID NO: 873137 - RNA, 27 nt, Human
ccucagggggcugccggcaacgccucc

SEQ ID NO: 873138 - RNA, 23 nt, Human
ccucuaaaaagugacuuuggucc

SEQ ID NO: 873139 - RNA, 20 nt, Human
cgaaaaugccauuaaauugc

SEQ ID NO: 873140 - RNA, 21 nt, Human
cgcggcguggccgccggcgcc

SEQ ID NO: 873141 - RNA, 21 nt, Human
cggcucugcucggcccgcgcc

SEQ ID NO: 873142 - RNA, 21 nt, Human
cuccgcggcccgucgccgccc

SEQ ID NO: 873143 - RNA, 21 nt, Human
gccauuaaauugcucuuuggc

SEQ ID NO: 873144 - RNA, 19 nt, Human
gcgcguggcggcucgaggg

SEQ ID NO: 873145 - RNA, 20 nt, Human
gcggcguggccgccggcgcc

SEQ ID NO: 873146 - RNA, 20 nt, Human
gcugccggcaacgccuccau

SEQ ID NO: 873147 - RNA, 18 nt, Human
ggcucgagggaugcgcga

SEQ ID NO: 873148 - RNA, 23 nt, Human
uccaacgcccggcucugcucggc

SEQ ID NO: 873149 - RNA, 18 nt, Human
uccaugcgcgcgcgggcu

SEQ ID NO: 873150 - RNA, 21 nt, Human
ucgccgggucuugucuccccg

SEQ ID NO: 873151 - RNA, 24 nt, Human
ucuaaacaucaauggggaaaaaaa

SEQ ID NO: 873152 - RNA, 21 nt, Human
ugaaccagauauuuuauggcc

SEQ ID NO: 873153 - RNA, 20 nt, Human
uuggugcuuaacccugaauc

SEQ ID NO: 873154 - RNA, 20 nt, Human
uuggugcuuaacccugaauc

SEQ ID NO: 873155 - RNA, 24 nt, Human
aaagugcugagauuacagguguga

SEQ ID NO: 873156 - RNA, 18 nt, Human
aacagcuugauguagccc

SEQ ID NO: 873157 - RNA, 21 nt, Human
aagcagcccugucaacagcuc

SEQ ID NO: 873158 - RNA, 20 nt, Human
aaggguccucaaacauggaa

SEQ ID NO: 873159 - RNA, 24 nt, Human
aagugaucuuccugccuuggccuc

SEQ ID NO: 873160 - RNA, 26 nt, Human
aagugcugagauuacaggugugagcc

SEQ ID NO: 873161 - RNA, 19 nt, Human
acacacugcagacgcgaca

SEQ ID NO: 873162 - RNA, 18 nt, Human
accacagaauuugggcag

SEQ ID NO: 873163 - RNA, 24 nt, Human
acgaggcacaauuuagcgcuaaaa

SEQ ID NO: 873164 - RNA, 23 nt, Human
acuugccaccuggcuaaaauuau

SEQ ID NO: 873165 - RNA, 22 nt, Human
agauuacaggugugagccacug

SEQ ID NO: 873166 - RNA, 23 nt, Human
agggcaaagaaagacgcuccccu

SEQ ID NO: 873167 - RNA, 23 nt, Human
aggucaagcuaccacuggaaaug

SEQ ID NO: 873168 - RNA, 18 nt, Human
aguuauuuuccagugcug

SEQ ID NO: 873169 - RNA, 19 nt, Human
auguucucucucuucuguc

SEQ ID NO: 873170 - RNA, 24 nt, Human
caaagugcugagauuacaggugug

SEQ ID NO: 873171 - RNA, 20 nt, Human
caagucagaggcagaggcag

SEQ ID NO: 873172 - RNA, 22 nt, Human
caagugaucuuccugccuuggc

SEQ ID NO: 873173 - RNA, 27 nt, Human
caagugaucuuccugccuuggccuccc

SEQ ID NO: 873174 - RNA, 21 nt, Human
cagaaauguccuccacaacca

SEQ ID NO: 873175 - RNA, 24 nt, Human
caggugugagccacugugccuggc

SEQ ID NO: 873176 - RNA, 21 nt, Human
caucucaggucaagcuaccac

SEQ ID NO: 873177 - RNA, 24 nt, Human
cauuaaacacgucccuccaagacu

SEQ ID NO: 873178 - RNA, 21 nt, Human
ccaaagugcugagauuacagg

SEQ ID NO: 873179 - RNA, 21 nt, Human
ccaaagugcugagauuacagg

SEQ ID NO: 873180 - RNA, 24 nt, Human
ccaaagugcugagauuacaggugu

SEQ ID NO: 873181 - RNA, 24 nt, Human
ccacuggaaaugaugaucuucccc

SEQ ID NO: 873182 - RNA, 21 nt, Human
cccaagucagaggcagaggca

SEQ ID NO: 873183 - RNA, 23 nt, Human
cccagccuggaagcuccuucuuc

SEQ ID NO: 873184 - RNA, 22 nt, Human
ccccaaaccacagaauuugggc

SEQ ID NO: 873185 - RNA, 19 nt, Human
ccccacacacugcagacgc

SEQ ID NO: 873186 - RNA, 23 nt, Human
ccuccaagacucucaagacauaa

SEQ ID NO: 873187 - RNA, 23 nt, Human
ccuccacaguguuucagcccuaa

SEQ ID NO: 873188 - RNA, 23 nt, Human
cgaggcacaauuuagcgcuaaaa

SEQ ID NO: 873189 - RNA, 19 nt, Human
cgggcucaagugaucuucc

SEQ ID NO: 873190 - RNA, 24 nt, Human
cuaaagauuuucccaccuuucugg

SEQ ID NO: 873191 - RNA, 23 nt, Human
cuagcaacucuaguauguucucu

SEQ ID NO: 873192 - RNA, 24 nt, Human
cuauaaugcucacauauaacaauc

SEQ ID NO: 873193 - RNA, 20 nt, Human
cucaagugaucuuccugccu

SEQ ID NO: 873194 - RNA, 24 nt, Human
cucaagugaucuuccugccuuggc

SEQ ID NO: 873195 - RNA, 18 nt, Human
cuccaaaaagaaaagcag

SEQ ID NO: 873196 - RNA, 25 nt, Human
cuccacaguccauacacuugccacc

SEQ ID NO: 873197 - RNA, 26 nt, Human
cuccacaguccauacacuugccaccu

SEQ ID NO: 873198 - RNA, 21 nt, Human
cucccaaagugcugagauuac

SEQ ID NO: 873199 - RNA, 22 nt, Human
cucuacaguugucuauguuucu

SEQ ID NO: 873200 - RNA, 21 nt, Human
cugaaaaugucuuguuccuau

SEQ ID NO: 873201 - RNA, 23 nt, Human
cugccuuggccucccaaagugcu

SEQ ID NO: 873202 - RNA, 24 nt, Human
cugucuauucugggccuucccaga

SEQ ID NO: 873203 - RNA, 26 nt, Human
cuuaacauacuugccucauaauaaga

SEQ ID NO: 873204 - RNA, 20 nt, Human
gaaaagcagcccugucaaca

SEQ ID NO: 873205 - RNA, 25 nt, Human
gaaauguccuccacaaccacugccu

SEQ ID NO: 873206 - RNA, 24 nt, Human
gagcaucuauaaugcucacauaua

SEQ ID NO: 873207 - RNA, 22 nt, Human
gaggcacaauuuagcgcuaaaa

SEQ ID NO: 873208 - RNA, 18 nt, Human
gauuacaggugugagcca

SEQ ID NO: 873209 - RNA, 24 nt, Human
gauuacaggugugagccacugugc

SEQ ID NO: 873210 - RNA, 18 nt, Human
gcaaagaaagacgcuccc

SEQ ID NO: 873211 - RNA, 23 nt, Human
gcaaagaaagacgcuccccuaga

SEQ ID NO: 873212 - RNA, 23 nt, Human
gcccugucaacagcuugauguag

SEQ ID NO: 873213 - RNA, 22 nt, Human
gccuuggccucccaaagugcug

SEQ ID NO: 873214 - RNA, 19 nt, Human
gcuauguugcccagggugg

SEQ ID NO: 873215 - RNA, 19 nt, Human
gggcucaagugaucuuccu

SEQ ID NO: 873216 - RNA, 22 nt, Human
gggcucaagugaucuuccugcc

SEQ ID NO: 873217 - RNA, 23 nt, Human
gggcucaagugaucuuccugccu

SEQ ID NO: 873218 - RNA, 24 nt, Human
gguagucucgcuauguugcccagg

SEQ ID NO: 873219 - RNA, 20 nt, Human
gucuauucugggccuuccca

SEQ ID NO: 873220 - RNA, 18 nt, Human
uaaaagcaccaucacaau

SEQ ID NO: 873221 - RNA, 22 nt, Human
uacaggugugagccacugugcc

SEQ ID NO: 873222 - RNA, 23 nt, Human
uacaggugugagccacugugccu

SEQ ID NO: 873223 - RNA, 18 nt, Human
uaccacuggaaaugauga

SEQ ID NO: 873224 - RNA, 21 nt, Human
uacccgccgccccgcgaaccc

SEQ ID NO: 873225 - RNA, 22 nt, Human
uacccgccgccccgcgaacccc

SEQ ID NO: 873226 - RNA, 20 nt, Human
uagagguagucucgcuaugu

SEQ ID NO: 873227 - RNA, 24 nt, Human
uaguauguucucucucuucugucu

SEQ ID NO: 873228 - RNA, 22 nt, Human
uagucucgcuauguugcccagg

SEQ ID NO: 873229 - RNA, 24 nt, Human
uauguugcccaggguggucucaaa

SEQ ID NO: 873230 - RNA, 19 nt, Human
ucaagaguuuuucuuuucu

SEQ ID NO: 873231 - RNA, 26 nt, Human
ucacaaggguccucaaacauggaaga

SEQ ID NO: 873232 - RNA, 19 nt, Human
ucagaggcagaggcaggua

SEQ ID NO: 873233 - RNA, 23 nt, Human
ucauuaaacacgucccuccaaga

SEQ ID NO: 873234 - RNA, 18 nt, Human
uccacaaccacugccucc

SEQ ID NO: 873235 - RNA, 23 nt, Human
ucccaaagugcugagauuacagg

SEQ ID NO: 873236 - RNA, 18 nt, Human
ucccaccuuucugguauc

SEQ ID NO: 873237 - RNA, 18 nt, Human
uccccuagagccuccaaa

SEQ ID NO: 873238 - RNA, 21 nt, Human
uccuccacaaccacugccucc

SEQ ID NO: 873239 - RNA, 24 nt, Human
ucuaguauguucucucucuucugu

SEQ ID NO: 873240 - RNA, 18 nt, Human
ucuauucugggccuuccc

SEQ ID NO: 873241 - RNA, 19 nt, Human
ucucgcuauguugcccagg

SEQ ID NO: 873242 - RNA, 19 nt, Human
ucucgcuauguugcccagg

SEQ ID NO: 873243 - RNA, 20 nt, Human
ucucgcuauguugcccaggg

SEQ ID NO: 873244 - RNA, 21 nt, Human
ugaaaggaggccccaaaccac

SEQ ID NO: 873245 - RNA, 21 nt, Human
ugagauuacaggugugagcca

SEQ ID NO: 873246 - RNA, 22 nt, Human
ugagauuacaggugugagccac

SEQ ID NO: 873247 - RNA, 22 nt, Human
ugagauuacaggugugagccac

SEQ ID NO: 873248 - RNA, 22 nt, Human
ugagauuacaggugugagccac

SEQ ID NO: 873249 - RNA, 24 nt, Human
ugagauuacaggugugagccacug

SEQ ID NO: 873250 - RNA, 24 nt, Human
ugcugagauuacaggugugagcca

SEQ ID NO: 873251 - RNA, 19 nt, Human
uggaagagggagacagaac

SEQ ID NO: 873252 - RNA, 21 nt, Human
uggcauuuuucauguguuucc

SEQ ID NO: 873253 - RNA, 20 nt, Human
ugucuuguuccuauaggcca

SEQ ID NO: 873254 - RNA, 26 nt, Human
uucaaugguguuuaacagguuugacu

SEQ ID NO: 873255 - RNA, 21 nt, Human
uucuuuuuggacauuuaggag

SEQ ID NO: 873256 - RNA, 24 nt, Human
uugccaccuggcuaaaauuauuug

SEQ ID NO: 873257 - RNA, 18 nt, Human
uuggccucccaaagugcu

SEQ ID NO: 873258 - RNA, 20 nt, Human
uuuuaagccauuaaauuugu

SEQ ID NO: 873259 - RNA, 19 nt, Human
uuuucuauaaauucuccca

SEQ ID NO: 873260 - RNA, 24 nt, Human
uuuuuuuuuuguagagguagucuc

SEQ ID NO: 873261 - RNA, 22 nt, Human
uuuuuuuuuuuuuuuguagagg

SEQ ID NO: 873262 - RNA, 19 nt, Human
uuuuuuuuuuuuuuuuugu

SEQ ID NO: 873263 - RNA, 20 nt, Human
uuuuuuuuuuuuuuuuuugg

SEQ ID NO: 873264 - RNA, 21 nt, Human
aaacccucuuuuaggagaggc

SEQ ID NO: 873265 - RNA, 24 nt, Human
aaagaauaaacgcuggaacucaaa

SEQ ID NO: 873266 - RNA, 22 nt, Human
aaagcuucugcaggccaaggcc

SEQ ID NO: 873267 - RNA, 24 nt, Human
aacaaugaggcacaucgguccccc

SEQ ID NO: 873268 - RNA, 18 nt, Human
aacacagccaauggguug

SEQ ID NO: 873269 - RNA, 23 nt, Human
aaccaaacuuuauccagaaaagc

SEQ ID NO: 873270 - RNA, 25 nt, Human
aaccacccucacucuucccaaaccc

SEQ ID NO: 873271 - RNA, 18 nt, Human
aaccuuaaggacaaaggc

SEQ ID NO: 873272 - RNA, 23 nt, Human
aacucgucgcucauccugggacc

SEQ ID NO: 873273 - RNA, 19 nt, Human
aagaaggagaucuugagaa

SEQ ID NO: 873274 - RNA, 21 nt, Human
aaguuccagguauccagaauc

SEQ ID NO: 873275 - RNA, 19 nt, Human
aaucuucaaacagaacaca

SEQ ID NO: 873276 - RNA, 23 nt, Human
acaggcccagccagcaggucacc

SEQ ID NO: 873277 - RNA, 21 nt, Human
acaucgguccccucuccccaa

SEQ ID NO: 873278 - RNA, 18 nt, Human
acccaccggcuucuccua

SEQ ID NO: 873279 - RNA, 22 nt, Human
acccauuuggccuugaaacccu

SEQ ID NO: 873280 - RNA, 19 nt, Human
accggcugggaggagcuuc

SEQ ID NO: 873281 - RNA, 18 nt, Human
accggcuucuccuaucgg

SEQ ID NO: 873282 - RNA, 18 nt, Human
acguguggauggaugagg

SEQ ID NO: 873283 - RNA, 23 nt, Human
acucacccacccuuuuaaugcaa

SEQ ID NO: 873284 - RNA, 23 nt, Human
agaacaggaauucucuugaguua

SEQ ID NO: 873285 - RNA, 21 nt, Human
agacagcaccguugacaaacc

SEQ ID NO: 873286 - RNA, 23 nt, Human
agacagcaccguugacaaaccca

SEQ ID NO: 873287 - RNA, 23 nt, Human
agcaccguugacaaacccauuug

SEQ ID NO: 873288 - RNA, 22 nt, Human
aggaaaaaagaauaaacgcugg

SEQ ID NO: 873289 - RNA, 19 nt, Human
aggaauguucaaauucccc

SEQ ID NO: 873290 - RNA, 19 nt, Human
aggacaaaggcggaguagg

SEQ ID NO: 873291 - RNA, 23 nt, Human
agggaugcugggaaucuuaaggu

SEQ ID NO: 873292 - RNA, 19 nt, Human
aggguggagaugagggggg

SEQ ID NO: 873293 - RNA, 18 nt, Human
auaccuggcagacagagu

SEQ ID NO: 873294 - RNA, 26 nt, Human
caaccaaacuuuauccagaaaagcau

SEQ ID NO: 873295 - RNA, 21 nt, Human
caaccacccucacucuuccca

SEQ ID NO: 873296 - RNA, 25 nt, Human
caaccacccucacucuucccaaacc

SEQ ID NO: 873297 - RNA, 18 nt, Human
caagccgcuggaagccaa

SEQ ID NO: 873298 - RNA, 21 nt, Human
cacaauccccagcuaaaaccc

SEQ ID NO: 873299 - RNA, 23 nt, Human
caccccaagacaaccgagcacag

SEQ ID NO: 873300 - RNA, 20 nt, Human
cacccucacucuucccaaag

SEQ ID NO: 873301 - RNA, 18 nt, Human
cacccugucagcugcucc

SEQ ID NO: 873302 - RNA, 21 nt, Human
cagaacacagccaauggguug

SEQ ID NO: 873303 - RNA, 29 nt, Human
cagaagccugguuccaauuugggagccuc

SEQ ID NO: 873304 - RNA, 22 nt, Human
cagaagccugugaggaaggcug

SEQ ID NO: 873305 - RNA, 24 nt, Human
cagcaccaggggcuggggggcuaa

SEQ ID NO: 873306 - RNA, 19 nt, Human
cagccagcaggucacccca

SEQ ID NO: 873307 - RNA, 22 nt, Human
cagcccagggcagcgggcccug

SEQ ID NO: 873308 - RNA, 21 nt, Human
cagccccucggaucgcagccu

SEQ ID NO: 873309 - RNA, 23 nt, Human
cagcgccugcguuuuacagcacc

SEQ ID NO: 873310 - RNA, 21 nt, Human
caggaugccagcacaaucccc

SEQ ID NO: 873311 - RNA, 26 nt, Human
cauuccucuccccaucucccccuacu

SEQ ID NO: 873312 - RNA, 24 nt, Human
ccaaacccacucucucuuuuggcu

SEQ ID NO: 873313 - RNA, 23 nt, Human
ccaaccacccucacucuucccaa

SEQ ID NO: 873314 - RNA, 20 nt, Human
ccagaaaagcauauuuguaa

SEQ ID NO: 873315 - RNA, 23 nt, Human
cccaaccacccucacucuuccca

SEQ ID NO: 873316 - RNA, 24 nt, Human
cccaccccaagacaaccgagcaca

SEQ ID NO: 873317 - RNA, 25 nt, Human
ccccaaccacccucacucuucccuc

SEQ ID NO: 873318 - RNA, 19 nt, Human
ccccaagacaaccgagcac

SEQ ID NO: 873319 - RNA, 22 nt, Human
ccccaagacaaccgagcacaga

SEQ ID NO: 873320 - RNA, 19 nt, Human
ccccagacugggaugggag

SEQ ID NO: 873321 - RNA, 20 nt, Human
cccccaaaucuucaaacaga

SEQ ID NO: 873322 - RNA, 23 nt, Human
cccccggaucugcgcggccccug

SEQ ID NO: 873323 - RNA, 19 nt, Human
ccccuauggcacagggccu

SEQ ID NO: 873324 - RNA, 21 nt, Human
cccgccgcggccuccucgccu

SEQ ID NO: 873325 - RNA, 24 nt, Human
cccuucggcaugaaugagagccgg

SEQ ID NO: 873326 - RNA, 19 nt, Human
ccgccgcggccuccucgcc

SEQ ID NO: 873327 - RNA, 19 nt, Human
ccgccgcggccuccucgcc

SEQ ID NO: 873328 - RNA, 20 nt, Human
ccgccgcggccuccucgccu

SEQ ID NO: 873329 - RNA, 25 nt, Human
ccgcggccuccucgccuugcucccc

SEQ ID NO: 873330 - RNA, 20 nt, Human
ccgcugcgcccgccgcggcc

SEQ ID NO: 873331 - RNA, 21 nt, Human
ccgcugcgcccgccgcggccu

SEQ ID NO: 873332 - RNA, 21 nt, Human
ccggaucugcgcggccccugu

SEQ ID NO: 873333 - RNA, 21 nt, Human
ccucacucuucccaaacccac

SEQ ID NO: 873334 - RNA, 21 nt, Human
ccucacugggguggguccccu

SEQ ID NO: 873335 - RNA, 20 nt, Human
ccucgccuugcuccccucuu

SEQ ID NO: 873336 - RNA, 21 nt, Human
ccugagccagggguccugacu

SEQ ID NO: 873337 - RNA, 22 nt, Human
ccuugagggagggugagugugg

SEQ ID NO: 873338 - RNA, 27 nt, Human
ccuugcuccccucuuaguccucucuuc

SEQ ID NO: 873339 - RNA, 31 nt, Human
cgcggcccagcgccugcguuuuacagcaccc

SEQ ID NO: 873340 - RNA, 26 nt, Human
cgcgguggcggcggcggcggcgcccc

SEQ ID NO: 873341 - RNA, 22 nt, Human
cggcuccugagccagggguccu

SEQ ID NO: 873342 - RNA, 22 nt, Human
cgggagcugagcgucaggguuc

SEQ ID NO: 873343 - RNA, 19 nt, Human
cggggccgcggcgggcgcg

SEQ ID NO: 873344 - RNA, 23 nt, Human
cgguccccucuccccaaccaccc

SEQ ID NO: 873345 - RNA, 24 nt, Human
cucccccggaucugcgcggccccc

SEQ ID NO: 873346 - RNA, 23 nt, Human
cucccccuacugccagugaagac

SEQ ID NO: 873347 - RNA, 21 nt, Human
cuggcagacagagugagcaca

SEQ ID NO: 873348 - RNA, 19 nt, Human
cugggcugggauucugggc

SEQ ID NO: 873349 - RNA, 19 nt, Human
cugggggcaggucgggugg

SEQ ID NO: 873350 - RNA, 20 nt, Human
cuggguccccaucuguaaga

SEQ ID NO: 873351 - RNA, 23 nt, Human
cuucacccaucugggcucuucca

SEQ ID NO: 873352 - RNA, 20 nt, Human
gaacacagccaauggguugg

SEQ ID NO: 873353 - RNA, 22 nt, Human
gacagcaccguugacaaaccca

SEQ ID NO: 873354 - RNA, 22 nt, Human
gaccagcucugggaaucuccau

SEQ ID NO: 873355 - RNA, 21 nt, Human
gagaggccaggacaguuagug

SEQ ID NO: 873356 - RNA, 20 nt, Human
gagcaggcucugggucccca

SEQ ID NO: 873357 - RNA, 23 nt, Human
gagggaagggggcagccagaagc

SEQ ID NO: 873358 - RNA, 19 nt, Human
gagugguucuucucuuugg

SEQ ID NO: 873359 - RNA, 21 nt, Human
gaugaggggccagggaaggga

SEQ ID NO: 873360 - RNA, 22 nt, Human
gaugggagcugcccagaguagu

SEQ ID NO: 873361 - RNA, 24 nt, Human
gauucugggcugggauucugggcg

SEQ ID NO: 873362 - RNA, 19 nt, Human
gcacagagagaccggcugg

SEQ ID NO: 873363 - RNA, 19 nt, Human
gccgcggcgggcgcgggcg

SEQ ID NO: 873364 - RNA, 18 nt, Human
gccuugaaacccucuuuu

SEQ ID NO: 873365 - RNA, 20 nt, Human
gcgagugugugucagccccu

SEQ ID NO: 873366 - RNA, 18 nt, Human
gcgcccgccgcggccucc

SEQ ID NO: 873367 - RNA, 24 nt, Human
gcggcggcgccccgagcagcggaa

SEQ ID NO: 873368 - RNA, 27 nt, Human
gcggcggcggcggcgccccgagcagcg

SEQ ID NO: 873369 - RNA, 19 nt, Human
gcgggagggaagggggcag

SEQ ID NO: 873370 - RNA, 20 nt, Human
gcgguggcggcggcggcggc

SEQ ID NO: 873371 - RNA, 22 nt, Human
ggaagggaagaggaaccgcgag

SEQ ID NO: 873372 - RNA, 21 nt, Human
ggacagcacagggaugcuggg

SEQ ID NO: 873373 - RNA, 21 nt, Human
ggagggcagggagagggugcc

SEQ ID NO: 873374 - RNA, 23 nt, Human
ggagggcagggagagggugccag

SEQ ID NO: 873375 - RNA, 20 nt, Human
ggaggguggagaugaggggg

SEQ ID NO: 873376 - RNA, 22 nt, Human
ggaggguggagaugaggggggc

SEQ ID NO: 873377 - RNA, 26 nt, Human
ggccaaggccagaaugguguugccag

SEQ ID NO: 873378 - RNA, 22 nt, Human
ggcgacaguggaaacgcuggag

SEQ ID NO: 873379 - RNA, 21 nt, Human
ggcggcagaagccugugagga

SEQ ID NO: 873380 - RNA, 20 nt, Human
ggcggcggcggcggcgcccc

SEQ ID NO: 873381 - RNA, 18 nt, Human
ggcucuggguccccaucu

SEQ ID NO: 873382 - RNA, 21 nt, Human
gggaagaggaaccgcgagguu

SEQ ID NO: 873383 - RNA, 27 nt, Human
gggaggguggagaugaggggggcggca

SEQ ID NO: 873384 - RNA, 23 nt, Human
gggcagcgggcccugagagcggu

SEQ ID NO: 873385 - RNA, 21 nt, Human
gggcagggagagggugccagg

SEQ ID NO: 873386 - RNA, 23 nt, Human
gggcagggagagggugccagggc

SEQ ID NO: 873387 - RNA, 23 nt, Human
gggccgcggcgggcgcgggcggc

SEQ ID NO: 873388 - RNA, 23 nt, Human
gggcgcgguggcggcggcggcgg

SEQ ID NO: 873389 - RNA, 19 nt, Human
gggcggcggcggcgcugcc

SEQ ID NO: 873390 - RNA, 21 nt, Human
gggcgggagggaagggggcag

SEQ ID NO: 873391 - RNA, 24 nt, Human
ggggcgggagggaagggggcagcc

SEQ ID NO: 873392 - RNA, 22 nt, Human
ggggugggguucaccuuaacau

SEQ ID NO: 873393 - RNA, 18 nt, Human
ggguccccucccucugcu

SEQ ID NO: 873394 - RNA, 24 nt, Human
ggguccugacucacccacccuuuu

SEQ ID NO: 873395 - RNA, 26 nt, Human
gguagaggcaagaggagacuccacaa

SEQ ID NO: 873396 - RNA, 19 nt, Human
gguccccaucuguaagaag

SEQ ID NO: 873397 - RNA, 22 nt, Human
gguguugccagcccagggcagc

SEQ ID NO: 873398 - RNA, 20 nt, Human
gucggugugaccagcucugg

SEQ ID NO: 873399 - RNA, 20 nt, Human
uaaaaccaaacucgucgcuc

SEQ ID NO: 873400 - RNA, 26 nt, Human
uaaggcaaaaucaaucuucacccauc

SEQ ID NO: 873401 - RNA, 19 nt, Human
uaagggagacccacccugu

SEQ ID NO: 873402 - RNA, 26 nt, Human
uaaggugggaauacugcuccaggccc

SEQ ID NO: 873403 - RNA, 20 nt, Human
uacguguucuucucauaccu

SEQ ID NO: 873404 - RNA, 23 nt, Human
uaguccucucuuccucuccuccu

SEQ ID NO: 873405 - RNA, 23 nt, Human
uaugggggaggguggagaugagg

SEQ ID NO: 873406 - RNA, 20 nt, Human
ucaaacagaacacagccaau

SEQ ID NO: 873407 - RNA, 22 nt, Human
ucacccacccuuuuaaugcaaa

SEQ ID NO: 873408 - RNA, 24 nt, Human
ucacggagaggccaggacaguuag

SEQ ID NO: 873409 - RNA, 24 nt, Human
ucacugggguggguccccucccuc

SEQ ID NO: 873410 - RNA, 22 nt, Human
ucagugccgggaucucuugcag

SEQ ID NO: 873411 - RNA, 22 nt, Human
ucagugccgggaucucuugcag

SEQ ID NO: 873412 - RNA, 19 nt, Human
uccaacaauguaaaggaau

SEQ ID NO: 873413 - RNA, 22 nt, Human
uccaagaaagggagacagcacc

SEQ ID NO: 873414 - RNA, 19 nt, Human
uccccaguucaggucucug

SEQ ID NO: 873415 - RNA, 18 nt, Human
ucccuggggaagaaagag

SEQ ID NO: 873416 - RNA, 24 nt, Human
ucggcggaugggccccaccccaag

SEQ ID NO: 873417 - RNA, 19 nt, Human
ucucuugcaggugacuuuc

SEQ ID NO: 873418 - RNA, 19 nt, Human
ucugaaagcuucugcaggc

SEQ ID NO: 873419 - RNA, 22 nt, Human
ucugcaaauggccccagacugg

SEQ ID NO: 873420 - RNA, 24 nt, Human
ugacaaacccauuuggccuugaaa

SEQ ID NO: 873421 - RNA, 19 nt, Human
ugaccacagacagcaccag

SEQ ID NO: 873422 - RNA, 21 nt, Human
ugaucugaaaaaaggaaaaaa

SEQ ID NO: 873423 - RNA, 25 nt, Human
ugcccagagagggagaccuaugcaa

SEQ ID NO: 873424 - RNA, 19 nt, Human
ugcuagagaauucccuggg

SEQ ID NO: 873425 - RNA, 18 nt, Human
ugcuccaggcccaggagc

SEQ ID NO: 873426 - RNA, 25 nt, Human
ugcuccccucuuaguccucucuucc

SEQ ID NO: 873427 - RNA, 19 nt, Human
uggaacuccuaaugcaaac

SEQ ID NO: 873428 - RNA, 22 nt, Human
uggaugaggcuccauggcggcc

SEQ ID NO: 873429 - RNA, 23 nt, Human
uggccugcaaaaaccuuaaggac

SEQ ID NO: 873430 - RNA, 22 nt, Human
uggcggcggcggcggcgccccg

SEQ ID NO: 873431 - RNA, 18 nt, Human
ugggaccagccaaggccu

SEQ ID NO: 873432 - RNA, 18 nt, Human
ugggaugggagcugccca

SEQ ID NO: 873433 - RNA, 18 nt, Human
ugggaugggagcugccca

SEQ ID NO: 873434 - RNA, 20 nt, Human
ugggcuggacugaguccugg

SEQ ID NO: 873435 - RNA, 20 nt, Human
uggggaagaaagagaaggcg

SEQ ID NO: 873436 - RNA, 24 nt, Human
ugggguggguccccucccucugcu

SEQ ID NO: 873437 - RNA, 19 nt, Human
uggugcccagagagggaga

SEQ ID NO: 873438 - RNA, 19 nt, Human
uguaagaaggggugggguu

SEQ ID NO: 873439 - RNA, 19 nt, Human
uuuguaaucaccacuaaac

SEQ ID NO: 873440 - RNA, 25 nt, Human
uuuuuuuuuuuuuuuuuuuuuaagg

SEQ ID NO: 873441 - RNA, 19 nt, Human
aaagagagcugugggcugc

SEQ ID NO: 873442 - RNA, 19 nt, Human
accaagauggcugccguag

SEQ ID NO: 873443 - RNA, 21 nt, Human
acuucagagguccgaaagaga

SEQ ID NO: 873444 - RNA, 20 nt, Human
agcaaugucauccaggcccu

SEQ ID NO: 873445 - RNA, 24 nt, Human
auaaagcaaaacaaaaucuuuuuc

SEQ ID NO: 873446 - RNA, 21 nt, Human
auccccgcccugcuuuuccua

SEQ ID NO: 873447 - RNA, 23 nt, Human
caagaggaaauguugacuagacc

SEQ ID NO: 873448 - RNA, 22 nt, Human
caagauggcugccguagccuaa

SEQ ID NO: 873449 - RNA, 22 nt, Human
cuacuaccuccuuucaagcaga

SEQ ID NO: 873450 - RNA, 27 nt, Human
gaaauucuccacaugccuguguuacuc

SEQ ID NO: 873451 - RNA, 20 nt, Human
gaugacacucuaguucuugu

SEQ ID NO: 873452 - RNA, 21 nt, Human
gcaaaguauucuucaugccag

SEQ ID NO: 873453 - RNA, 18 nt, Human
guggaggagucuaagcug

SEQ ID NO: 873454 - RNA, 22 nt, Human
uaccuccuuucaagcagacuuc

SEQ ID NO: 873455 - RNA, 19 nt, Human
uaggauaguucuagguuaa

SEQ ID NO: 873456 - RNA, 23 nt, Human
uaucccacagaguucuggaguca

SEQ ID NO: 873457 - RNA, 24 nt, Human
ucacaugcucaugguaaaucuaaa

SEQ ID NO: 873458 - RNA, 24 nt, Human
uccacaugccuguguuacuccugc

SEQ ID NO: 873459 - RNA, 18 nt, Human
uccgaaagagagcugugg

SEQ ID NO: 873460 - RNA, 21 nt, Human
ucucaggguaccaagauggcu

SEQ ID NO: 873461 - RNA, 22 nt, Human
ucuccacaugccuguguuacuc

SEQ ID NO: 873462 - RNA, 20 nt, Human
ucuuaagugaccaauggcug

SEQ ID NO: 873463 - RNA, 18 nt, Human
ugauguugagaauucugu

SEQ ID NO: 873464 - RNA, 19 nt, Human
uguggaggagucuaagcug

SEQ ID NO: 873465 - RNA, 28 nt, Human
uucaaacagggaaaaaugauguugagaa

SEQ ID NO: 873466 - RNA, 22 nt, Human
uucaagcagacuucccucgugc

SEQ ID NO: 873467 - RNA, 19 nt, Human
uucaagcuaugaucuugua

SEQ ID NO: 873468 - RNA, 22 nt, Human
uuuccuagaaugcuggcaucuu

SEQ ID NO: 873469 - RNA, 24 nt, Human
uuuuuuuuuuucaagcuaugaucu

SEQ ID NO: 873470 - RNA, 24 nt, Human
uuuuuuuuuuuuuuuuuuuucaag

SEQ ID NO: 873471 - RNA, 18 nt, Human
aacaguaugggacagacu

SEQ ID NO: 873472 - RNA, 21 nt, Human
aagagaagccuccagccaccc

SEQ ID NO: 873473 - RNA, 24 nt, Human
aaguuucaaguaguaagucagugu

SEQ ID NO: 873474 - RNA, 24 nt, Human
acccaccauaucugcucagugggc

SEQ ID NO: 873475 - RNA, 18 nt, Human
accugcccaccacaccaa

SEQ ID NO: 873476 - RNA, 26 nt, Human
acugguggaggagaagggcuggccga

SEQ ID NO: 873477 - RNA, 18 nt, Human
agacaaguagauagacag

SEQ ID NO: 873478 - RNA, 18 nt, Human
aggcagggacugagaaag

SEQ ID NO: 873479 - RNA, 24 nt, Human
aggcccuccaccugcccaccacac

SEQ ID NO: 873480 - RNA, 20 nt, Human
aggcggccuccggggcuggu

SEQ ID NO: 873481 - RNA, 18 nt, Human
agguggaauucccagggc

SEQ ID NO: 873482 - RNA, 22 nt, Human
cagacagacaaguagauagaca

SEQ ID NO: 873483 - RNA, 18 nt, Human
cagccacccaccauaucu

SEQ ID NO: 873484 - RNA, 19 nt, Human
cagccugcugggauccuug

SEQ ID NO: 873485 - RNA, 19 nt, Human
cagcucugcucuggggaac

SEQ ID NO: 873486 - RNA, 21 nt, Human
caggagagcugcaggcuggca

SEQ ID NO: 873487 - RNA, 23 nt, Human
caggcaucagcuccagcucugcu

SEQ ID NO: 873488 - RNA, 22 nt, Human
cagggcaggcccuccaccugcc

SEQ ID NO: 873489 - RNA, 20 nt, Human
caguaugggacagacuggga

SEQ ID NO: 873490 - RNA, 18 nt, Human
caucagcuccagcucugc

SEQ ID NO: 873491 - RNA, 23 nt, Human
ccacaccaacauggugcaauaaa

SEQ ID NO: 873492 - RNA, 23 nt, Human
ccaggccaggcucagcagcugug

SEQ ID NO: 873493 - RNA, 24 nt, Human
ccuguguccagggcaggccggggc

SEQ ID NO: 873494 - RNA, 19 nt, Human
cuauggauggcugggcuga

SEQ ID NO: 873495 - RNA, 20 nt, Human
gaagccuccagccacccacc

SEQ ID NO: 873496 - RNA, 24 nt, Human
gaagccuccagccacccaccauau

SEQ ID NO: 873497 - RNA, 25 nt, Human
gacaagaaaacaaccaaguggguaa

SEQ ID NO: 873498 - RNA, 18 nt, Human
gacucccuggggaggugg

SEQ ID NO: 873499 - RNA, 18 nt, Human
gagaaagagaagccucca

SEQ ID NO: 873500 - RNA, 18 nt, Human
gcacggaaagaccgacgg

SEQ ID NO: 873501 - RNA, 20 nt, Human
gcacuggagugggugucugg

SEQ ID NO: 873502 - RNA, 22 nt, Human
gcggccuccggggcuggucucc

SEQ ID NO: 873503 - RNA, 18 nt, Human
gggagguggaggccuggg

SEQ ID NO: 873504 - RNA, 22 nt, Human
gguggaggagaagggcuggccc

SEQ ID NO: 873505 - RNA, 22 nt, Human
guggaauucccagggcuaugga

SEQ ID NO: 873506 - RNA, 19 nt, Human
gugggcacggaaagaccga

SEQ ID NO: 873507 - RNA, 19 nt, Human
uaacaguaugggacagacu

SEQ ID NO: 873508 - RNA, 19 nt, Human
uagacagacagacagaggg

SEQ ID NO: 873509 - RNA, 21 nt, Human
ucugcucuggggaacuggugg

SEQ ID NO: 873510 - RNA, 24 nt, Human
ugagcagaggaucgaggcucuugg

SEQ ID NO: 873511 - RNA, 19 nt, Human
ugccuggcacagggauagg

SEQ ID NO: 873512 - RNA, 18 nt, Human
ugcucagcagggccccug

SEQ ID NO: 873513 - RNA, 21 nt, Human
uggagacucccuggggaggug

SEQ ID NO: 873514 - RNA, 23 nt, Human
uggaggagaagggcuggccgggg

SEQ ID NO: 873515 - RNA, 23 nt, Human
uggcagguggaauucccagggcu

SEQ ID NO: 873516 - RNA, 20 nt, Human
uggcccagacagacaaguag

SEQ ID NO: 873517 - RNA, 27 nt, Human
ugggcucaagcggucgcaagucugucu

SEQ ID NO: 873518 - RNA, 19 nt, Human
uggggagguggaggccugg

SEQ ID NO: 873519 - RNA, 19 nt, Human
uggguaacaguaugggaca

SEQ ID NO: 873520 - RNA, 22 nt, Human
uggucaaguuccaggauggggc

SEQ ID NO: 873521 - RNA, 19 nt, Human
ugguggaggagaagggcug

SEQ ID NO: 873522 - RNA, 21 nt, Human
ugucuugugcacuggaguggg

SEQ ID NO: 873523 - RNA, 19 nt, Human
uuauggguaacaguauggg

SEQ ID NO: 873524 - RNA, 27 nt, Human
uuuuuuuuuuuuuaaagagauaguuuu

SEQ ID NO: 873525 - RNA, 24 nt, Human
uuuuuuuuuuuuuuuuuuuuaaag

SEQ ID NO: 873526 - RNA, 21 nt, Human
aaaagcaacugaacaugaaac

SEQ ID NO: 873527 - RNA, 21 nt, Human
aaagcaacugaacaugaaacg

SEQ ID NO: 873528 - RNA, 23 nt, Human
acacacacacacacacacacaca

SEQ ID NO: 873529 - RNA, 23 nt, Human
acacacacacacacacacacaca

SEQ ID NO: 873530 - RNA, 23 nt, Human
acacacacacacacacacacaca

SEQ ID NO: 873531 - RNA, 23 nt, Human
acacacacacacacacacacaca

SEQ ID NO: 873532 - RNA, 23 nt, Human
acacacacacacacacacacaca

SEQ ID NO: 873533 - RNA, 23 nt, Human
acacacacacacacacacacaca

SEQ ID NO: 873534 - RNA, 23 nt, Human
acacacacacacacacacacaca

SEQ ID NO: 873535 - RNA, 23 nt, Human
acacacacacacacacacacaca

SEQ ID NO: 873536 - RNA, 21 nt, Human
acacacacacacacacacggc

SEQ ID NO: 873537 - RNA, 22 nt, Human
acaccaccgcguaccugugagc

SEQ ID NO: 873538 - RNA, 31 nt, Human
acacccacuacacacacacacacacacacag

SEQ ID NO: 873539 - RNA, 18 nt, Human
acccacacccacacgcac

SEQ ID NO: 873540 - RNA, 21 nt, Human
acccacacccacacgcacacc

SEQ ID NO: 873541 - RNA, 31 nt, Human
acccacuacacacacacacacacacacacag

SEQ ID NO: 873542 - RNA, 23 nt, Human
acccuggaccccuggaaugucuc

SEQ ID NO: 873543 - RNA, 21 nt, Human
agaaccgaacagcuggaucca

SEQ ID NO: 873544 - RNA, 21 nt, Human
agcacacacucacggccaccc

SEQ ID NO: 873545 - RNA, 22 nt, Human
aggaaacagucccccaauuccg

SEQ ID NO: 873546 - RNA, 20 nt, Human
aggaacccgacaccaccgcg

SEQ ID NO: 873547 - RNA, 22 nt, Human
aggcuggggggccaggggcugc

SEQ ID NO: 873548 - RNA, 23 nt, Human
agguggagaaggagggcgggaag

SEQ ID NO: 873549 - RNA, 22 nt, Human
caaaagcaacugaacaugaaac

SEQ ID NO: 873550 - RNA, 20 nt, Human
cacacacacacacacacaca

SEQ ID NO: 873551 - RNA, 20 nt, Human
cacacacacacacacacaca

SEQ ID NO: 873552 - RNA, 20 nt, Human
cacacacacacacacacaca

SEQ ID NO: 873553 - RNA, 20 nt, Human
cacacacacacacacacaca

SEQ ID NO: 873554 - RNA, 20 nt, Human
cacacacacacacacacaca

SEQ ID NO: 873555 - RNA, 20 nt, Human
cacacacacacacacacaca

SEQ ID NO: 873556 - RNA, 20 nt, Human
cacacacacacacacacaca

SEQ ID NO: 873557 - RNA, 20 nt, Human
cacacacacacacacacaca

SEQ ID NO: 873558 - RNA, 20 nt, Human
cacacacacacacacacaca

SEQ ID NO: 873559 - RNA, 20 nt, Human
cacacacacacacacacaca

SEQ ID NO: 873560 - RNA, 20 nt, Human
cacacacacacacacacaca

SEQ ID NO: 873561 - RNA, 20 nt, Human
cacacacacacacacacaca

SEQ ID NO: 873562 - RNA, 22 nt, Human
cacacacacacacacacacaca

SEQ ID NO: 873563 - RNA, 22 nt, Human
cacacacacacacacacacaca

SEQ ID NO: 873564 - RNA, 22 nt, Human
cacacacacacacacacacaca

SEQ ID NO: 873565 - RNA, 22 nt, Human
cacacacacacacacacacaca

SEQ ID NO: 873566 - RNA, 22 nt, Human
cacacacacacacacacacaca

SEQ ID NO: 873567 - RNA, 22 nt, Human
cacacacacacacacacacaca

SEQ ID NO: 873568 - RNA, 22 nt, Human
cacacacacacacacacacaca

SEQ ID NO: 873569 - RNA, 26 nt, Human
cacacacacacacacacacacacaca

SEQ ID NO: 873570 - RNA, 26 nt, Human
cacacacacacacacacacacacaca

SEQ ID NO: 873571 - RNA, 26 nt, Human
cacacacacacacacacacacacaca

SEQ ID NO: 873572 - RNA, 26 nt, Human
cacacacacacacacacacacacaca

SEQ ID NO: 873573 - RNA, 26 nt, Human
cacacacacacacacacacacacaca

SEQ ID NO: 873574 - RNA, 26 nt, Human
cacacacacacacacacacacacacg

SEQ ID NO: 873575 - RNA, 28 nt, Human
cacacacacacacacacacacacggcug

SEQ ID NO: 873576 - RNA, 29 nt, Human
cacacacacacacacacacacggcugugg

SEQ ID NO: 873577 - RNA, 27 nt, Human
cacacacacccacacucacucacaccc

SEQ ID NO: 873578 - RNA, 19 nt, Human
cacacacucacggccaccc

SEQ ID NO: 873579 - RNA, 21 nt, Human
cacacccacuacacacacaca

SEQ ID NO: 873580 - RNA, 23 nt, Human
cacacucacucacacccacaccc

SEQ ID NO: 873581 - RNA, 23 nt, Human
cacccacacccacacgcacaccc

SEQ ID NO: 873582 - RNA, 24 nt, Human
cacccacacccacacgcacaccca

SEQ ID NO: 873583 - RNA, 21 nt, Human
cacccacacgcacacccacua

SEQ ID NO: 873584 - RNA, 20 nt, Human
cacccacacucacucacacc

SEQ ID NO: 873585 - RNA, 18 nt, Human
caccgcguaccugugagc

SEQ ID NO: 873586 - RNA, 19 nt, Human
cagagccccaaggcugggg

SEQ ID NO: 873587 - RNA, 23 nt, Human
cagagccccaaggcuggggggcc

SEQ ID NO: 873588 - RNA, 22 nt, Human
cagcaaaggcuuucggagccaa

SEQ ID NO: 873589 - RNA, 18 nt, Human
cagcccaggacccacacc

SEQ ID NO: 873590 - RNA, 19 nt, Human
caggaacccgacaccaccg

SEQ ID NO: 873591 - RNA, 18 nt, Human
cagggcccagcccaggga

SEQ ID NO: 873592 - RNA, 23 nt, Human
cagucccccaauuccgccggggg

SEQ ID NO: 873593 - RNA, 20 nt, Human
cauggggaggggggcggcuc

SEQ ID NO: 873594 - RNA, 26 nt, Human
ccacacgcacacccacuacacacaca

SEQ ID NO: 873595 - RNA, 30 nt, Human
ccacacgcacacccacuacacacacacaca

SEQ ID NO: 873596 - RNA, 21 nt, Human
ccaggaacccgacaccaccgc

SEQ ID NO: 873597 - RNA, 21 nt, Human
cccacacccacacgcacaccc

SEQ ID NO: 873598 - RNA, 22 nt, Human
cccacacccacacgcacaccca

SEQ ID NO: 873599 - RNA, 21 nt, Human
cccacacucacucacacccac

SEQ ID NO: 873600 - RNA, 21 nt, Human
cccacuacacacacacacaca

SEQ ID NO: 873601 - RNA, 18 nt, Human
ccccaaggcuggggggcc

SEQ ID NO: 873602 - RNA, 19 nt, Human
ccccaaggcuggggggcca

SEQ ID NO: 873603 - RNA, 22 nt, Human
cccuggaccccuggaaugucuc

SEQ ID NO: 873604 - RNA, 25 nt, Human
cgcacacccacuacacacacacaca

SEQ ID NO: 873605 - RNA, 20 nt, Human
cggcugugacagcccaggac

SEQ ID NO: 873606 - RNA, 19 nt, Human
cggcuuugaauccccggcc

SEQ ID NO: 873607 - RNA, 20 nt, Human
cucacucacacccacaccca

SEQ ID NO: 873608 - RNA, 20 nt, Human
cuggaccagaaccgaacagc

SEQ ID NO: 873609 - RNA, 26 nt, Human
cuggaccccuggaaugucucuggacc

SEQ ID NO: 873610 - RNA, 22 nt, Human
gaauccccggccacgggcacua

SEQ ID NO: 873611 - RNA, 20 nt, Human
gagccagagccccaaggcug

SEQ ID NO: 873612 - RNA, 31 nt, Human
gcacacccacuacacacacacacacacacag

SEQ ID NO: 873613 - RNA, 25 nt, Human
ggaccagaaccgaacagcuggaucc

SEQ ID NO: 873614 - RNA, 22 nt, Human
ggcacuagaagguggagaagga

SEQ ID NO: 873615 - RNA, 26 nt, Human
ggcgggaaguccaguugagaugggca

SEQ ID NO: 873616 - RNA, 18 nt, Human
gggaggggggcggcuccc

SEQ ID NO: 873617 - RNA, 19 nt, Human
gggccaggggcugcaggga

SEQ ID NO: 873618 - RNA, 22 nt, Human
gggggagccagagccccaaggc

SEQ ID NO: 873619 - RNA, 23 nt, Human
gugcagccacacacacccacacu

SEQ ID NO: 873620 - RNA, 20 nt, Human
uacacacacacacacacaca

SEQ ID NO: 873621 - RNA, 25 nt, Human
uacacacacacacacacacacacac

SEQ ID NO: 873622 - RNA, 18 nt, Human
uagaagguggagaaggag

SEQ ID NO: 873623 - RNA, 19 nt, Human
uagugggcuucccuugucc

SEQ ID NO: 873624 - RNA, 23 nt, Human
ucacacccacacccacacgcaca

SEQ ID NO: 873625 - RNA, 18 nt, Human
ucagggcccagcccaggg

SEQ ID NO: 873626 - RNA, 22 nt, Human
uccaggaugucaggaaacaguc

SEQ ID NO: 873627 - RNA, 20 nt, Human
ugaauccccggccacgggca

SEQ ID NO: 873628 - RNA, 20 nt, Human
ugacagcccaggacccacac

SEQ ID NO: 873629 - RNA, 22 nt, Human
ugauugacagcuguccccaucc

SEQ ID NO: 873630 - RNA, 19 nt, Human
ugcagguggaugagccccu

SEQ ID NO: 873631 - RNA, 20 nt, Human
uggaaugucucuggaccaga

SEQ ID NO: 873632 - RNA, 23 nt, Human
uggaccagaaccgaacagcugga

SEQ ID NO: 873633 - RNA, 20 nt, Human
uggggaggggggcggcuccc

SEQ ID NO: 873634 - RNA, 20 nt, Human
uuuuuuuuuuuuuuugugcg

SEQ ID NO: 873635 - RNA, 19 nt, Human
uuuuuuuuuuuuuuuuugu

SEQ ID NO: 873636 - RNA, 20 nt, Human
uuuuuuuuuuuuuuuuuugg

SEQ ID NO: 873637 - RNA, 19 nt, Human
aaagugcugggguuacagg

SEQ ID NO: 873638 - RNA, 24 nt, Human
aaagugcugggguuacaggcguga

SEQ ID NO: 873639 - RNA, 21 nt, Human
aacuuauuagaaaggggccau

SEQ ID NO: 873640 - RNA, 28 nt, Human
aacuuuuuuuuuuuuuuuuuuuuuuuuu

SEQ ID NO: 873641 - RNA, 19 nt, Human
aaguagcugggacuacagg

SEQ ID NO: 873642 - RNA, 20 nt, Human
aaguagcugggacuacaggc

SEQ ID NO: 873643 - RNA, 26 nt, Human
aaguagcugggacuacaggcgcaugc

SEQ ID NO: 873644 - RNA, 19 nt, Human
aagugcugggguuacaggc

SEQ ID NO: 873645 - RNA, 26 nt, Human
aagugcugggguuacaggcgugagcc

SEQ ID NO: 873646 - RNA, 20 nt, Human
aaugcaguggugcgaucucg

SEQ ID NO: 873647 - RNA, 24 nt, Human
aaugcaguggugcgaucucggcuc

SEQ ID NO: 873648 - RNA, 19 nt, Human
acuacaggcgcaugccacc

SEQ ID NO: 873649 - RNA, 18 nt, Human
acuggguuucaccguguu

SEQ ID NO: 873650 - RNA, 20 nt, Human
acuggguuucaccguguuag

SEQ ID NO: 873651 - RNA, 24 nt, Human
acuggguuucaccguguuagccag

SEQ ID NO: 873652 - RNA, 23 nt, Human
agacuggguuucaccguguuagc

SEQ ID NO: 873653 - RNA, 23 nt, Human
agagaacuuuuuuuuuuuuuuuu

SEQ ID NO: 873654 - RNA, 23 nt, Human
aggcgugagccaccgugcccggc

SEQ ID NO: 873655 - RNA, 23 nt, Human
aggggccaucugcagagccacca

SEQ ID NO: 873656 - RNA, 24 nt, Human
caaagugcugggguuacaggcgug

SEQ ID NO: 873657 - RNA, 21 nt, Human
cacaucacuagacaagaguuu

SEQ ID NO: 873658 - RNA, 24 nt, Human
caccacgccgggcuaauuuuugua

SEQ ID NO: 873659 - RNA, 18 nt, Human
caccguguuagccaggau

SEQ ID NO: 873660 - RNA, 24 nt, Human
caccguguuagccaggauggucuc

SEQ ID NO: 873661 - RNA, 20 nt, Human
cacucauuacugaaaacugu

SEQ ID NO: 873662 - RNA, 18 nt, Human
cacugagugacacacauu

SEQ ID NO: 873663 - RNA, 23 nt, Human
cacugcaaccuccucuuccuggg

SEQ ID NO: 873664 - RNA, 22 nt, Human
caggcaauucuccugcuucagc

SEQ ID NO: 873665 - RNA, 24 nt, Human
caugccaccacgccgggcuaauuu

SEQ ID NO: 873666 - RNA, 22 nt, Human
ccaaagugcugggguuacaggc

SEQ ID NO: 873667 - RNA, 22 nt, Human
ccaaagugcugggguuacaggc

SEQ ID NO: 873668 - RNA, 24 nt, Human
ccaaagugcugggguuacaggcgu

SEQ ID NO: 873669 - RNA, 18 nt, Human
ccagagacggagggaaga

SEQ ID NO: 873670 - RNA, 21 nt, Human
ccaucugcagagccaccacuu

SEQ ID NO: 873671 - RNA, 23 nt, Human
cccaaguagcugggacuacaggc

SEQ ID NO: 873672 - RNA, 24 nt, Human
cccaaguagcugggacuacaggcg

SEQ ID NO: 873673 - RNA, 26 nt, Human
ccgcccgccucagccucccaaagugc

SEQ ID NO: 873674 - RNA, 24 nt, Human
ccgccucagccucccaaagugcug

SEQ ID NO: 873675 - RNA, 20 nt, Human
cgccgggcuaauuuuuguau

SEQ ID NO: 873676 - RNA, 24 nt, Human
cgccucagccucccaaagugcugg

SEQ ID NO: 873677 - RNA, 24 nt, Human
cgugauccgcccgccucagccucc

SEQ ID NO: 873678 - RNA, 19 nt, Human
cucacugcaaccuccucuu

SEQ ID NO: 873679 - RNA, 23 nt, Human
cucacugcaaccuccucuuccug

SEQ ID NO: 873680 - RNA, 24 nt, Human
cucacugcaaccuccucuuccugg

SEQ ID NO: 873681 - RNA, 24 nt, Human
cuccugaccucgugauccgcccgc

SEQ ID NO: 873682 - RNA, 20 nt, Human
cucuguugcccaggcuggaa

SEQ ID NO: 873683 - RNA, 23 nt, Human
cucuguugcccaggcuggaaugc

SEQ ID NO: 873684 - RNA, 23 nt, Human
cugcaaccuccucuuccuggguu

SEQ ID NO: 873685 - RNA, 23 nt, Human
cugcuucagccucccaaguagcu

SEQ ID NO: 873686 - RNA, 24 nt, Human
cuggguuucaccguguuagccagg

SEQ ID NO: 873687 - RNA, 24 nt, Human
cuuccuggguucaggcaauucucc

SEQ ID NO: 873688 - RNA, 25 nt, Human
gaacauuuuacauauaugcgaaaua

SEQ ID NO: 873689 - RNA, 22 nt, Human
gaccucgugauccgcccgccuc

SEQ ID NO: 873690 - RNA, 24 nt, Human
gaccucgugauccgcccgccucag

SEQ ID NO: 873691 - RNA, 25 nt, Human
gagagaacuuuuuuuuuuuuuuuuu

SEQ ID NO: 873692 - RNA, 24 nt, Human
gagccaccacuuacuguccacuca

SEQ ID NO: 873693 - RNA, 22 nt, Human
gcaaccuccucuuccuggguuc

SEQ ID NO: 873694 - RNA, 20 nt, Human
gcccaggcuggaaugcagug

SEQ ID NO: 873695 - RNA, 22 nt, Human
gcucacugcaaccuccucuucc

SEQ ID NO: 873696 - RNA, 23 nt, Human
ggagucucgcucuguugcccagg

SEQ ID NO: 873697 - RNA, 22 nt, Human
ggggccaucugcagagccacca

SEQ ID NO: 873698 - RNA, 21 nt, Human
ggguuucaccguguuagccag

SEQ ID NO: 873699 - RNA, 20 nt, Human
ggucucaaucuccugaccuc

SEQ ID NO: 873700 - RNA, 18 nt, Human
gguuacaggcgugagcca

SEQ ID NO: 873701 - RNA, 24 nt, Human
gguuacaggcgugagccaccgugc

SEQ ID NO: 873702 - RNA, 24 nt, Human
gugauccgcccgccucagccuccc

SEQ ID NO: 873703 - RNA, 22 nt, Human
uaaugagucacaucacuagacc

SEQ ID NO: 873704 - RNA, 24 nt, Human
uaauuuuuguauuuuuaguagaga

SEQ ID NO: 873705 - RNA, 23 nt, Human
uacaggcgugagccaccgugccc

SEQ ID NO: 873706 - RNA, 20 nt, Human
uaccuggacggcaggugacc

SEQ ID NO: 873707 - RNA, 25 nt, Human
uaggaugauaccuggacggcaggug

SEQ ID NO: 873708 - RNA, 21 nt, Human
uaguagagacuggguuucacc

SEQ ID NO: 873709 - RNA, 24 nt, Human
uaguagagacuggguuucaccgug

SEQ ID NO: 873710 - RNA, 25 nt, Human
uaguagagacuggguuucaccgugu

SEQ ID NO: 873711 - RNA, 24 nt, Human
ucaccguguuagccaggauggucu

SEQ ID NO: 873712 - RNA, 24 nt, Human
ucacugcaaccuccucuuccuggg

SEQ ID NO: 873713 - RNA, 20 nt, Human
ucagccucccaaagugcugg

SEQ ID NO: 873714 - RNA, 18 nt, Human
ucagccucccaaguagcu

SEQ ID NO: 873715 - RNA, 20 nt, Human
ucagccucccaaguagcugg

SEQ ID NO: 873716 - RNA, 23 nt, Human
ucagccucccaaguagcugggac

SEQ ID NO: 873717 - RNA, 24 nt, Human
ucccaaagugcugggguuacaggc

SEQ ID NO: 873718 - RNA, 24 nt, Human
ucccaaguagcugggacuacaggc

SEQ ID NO: 873719 - RNA, 21 nt, Human
uccgcccgccucagccuccca

SEQ ID NO: 873720 - RNA, 20 nt, Human
uccuggguucaggcaauucu

SEQ ID NO: 873721 - RNA, 21 nt, Human
uccuggguucaggcaauucuc

SEQ ID NO: 873722 - RNA, 24 nt, Human
uccuggguucaggcaauucuccug

SEQ ID NO: 873723 - RNA, 19 nt, Human
ucucgcucuguugcccagg

SEQ ID NO: 873724 - RNA, 23 nt, Human
ucucgcucuguugcccaggcugg

SEQ ID NO: 873725 - RNA, 24 nt, Human
ucucgcucuguugcccaggcugga

SEQ ID NO: 873726 - RNA, 26 nt, Human
ucucgcucuguugcccaggcuggaau

SEQ ID NO: 873727 - RNA, 27 nt, Human
ucucgcucuguugcccaggcuggaaug

SEQ ID NO: 873728 - RNA, 18 nt, Human
ucugcagagccaccacuu

SEQ ID NO: 873729 - RNA, 18 nt, Human
ucuguugcccaggcugga

SEQ ID NO: 873730 - RNA, 24 nt, Human
ucuguugcccaggcuggaaugcag

SEQ ID NO: 873731 - RNA, 25 nt, Human
ugaaaagacuguaaaacauucacau

SEQ ID NO: 873732 - RNA, 19 nt, Human
ugaaugagagaacuuuuuu

SEQ ID NO: 873733 - RNA, 22 nt, Human
ugagauggagucucgcucuguu

SEQ ID NO: 873734 - RNA, 19 nt, Human
ugcaaccuccucuuccugg

SEQ ID NO: 873735 - RNA, 24 nt, Human
ugcagagccaccacuuacugucca

SEQ ID NO: 873736 - RNA, 22 nt, Human
ugcaguggugcgaucucggcuc

SEQ ID NO: 873737 - RNA, 21 nt, Human
ugcccaggcuggaaugcagug

SEQ ID NO: 873738 - RNA, 24 nt, Human
ugcccaggcuggaaugcaguggug

SEQ ID NO: 873739 - RNA, 24 nt, Human
ugcuucagccucccaaguagcugg

SEQ ID NO: 873740 - RNA, 24 nt, Human
uggaaugcaguggugcgaucucgg

SEQ ID NO: 873741 - RNA, 24 nt, Human
uggagucucgcucuguugcccagg

SEQ ID NO: 873742 - RNA, 21 nt, Human
ugggacuacaggcgcaugcca

SEQ ID NO: 873743 - RNA, 22 nt, Human
ugggacuacaggcgcaugccac

SEQ ID NO: 873744 - RNA, 24 nt, Human
ugggacuacaggcgcaugccacca

SEQ ID NO: 873745 - RNA, 21 nt, Human
ugggaucacguaaugagucac

SEQ ID NO: 873746 - RNA, 18 nt, Human
ugggguuacaggcgugag

SEQ ID NO: 873747 - RNA, 22 nt, Human
ugggguuacaggcgugagccac

SEQ ID NO: 873748 - RNA, 23 nt, Human
ugggguuacaggcgugagccacc

SEQ ID NO: 873749 - RNA, 23 nt, Human
ugggguuacaggcgugagccacc

SEQ ID NO: 873750 - RNA, 24 nt, Human
ugggguuacaggcgugagccaccg

SEQ ID NO: 873751 - RNA, 23 nt, Human
uggguuucaccguguuagccagg

SEQ ID NO: 873752 - RNA, 19 nt, Human
uuacaggcgugagccaccg

SEQ ID NO: 873753 - RNA, 22 nt, Human
uuaguagagacuggguuucacc

SEQ ID NO: 873754 - RNA, 24 nt, Human
uuaguagagacuggguuucaccgu

SEQ ID NO: 873755 - RNA, 25 nt, Human
uuccagucugggaucacguaaugag

SEQ ID NO: 873756 - RNA, 19 nt, Human
uuucaccguguuagccagg

SEQ ID NO: 873757 - RNA, 24 nt, Human
uuuuuaguagagacuggguuucac

SEQ ID NO: 873758 - RNA, 20 nt, Human
uuuuuguauuuuuaguagag

SEQ ID NO: 873759 - RNA, 25 nt, Human
uuuuuuuuuuuugagauggagucuc

SEQ ID NO: 873760 - RNA, 22 nt, Human
uuuuuuuuuuuuuugagaugga

SEQ ID NO: 873761 - RNA, 24 nt, Human
uuuuuuuuuuuuuuuuuuaaccag

SEQ ID NO: 873762 - RNA, 27 nt, Human
uuuuuuuuuuuuuuuuuuuuuuugggg

SEQ ID NO: 873763 - RNA, 21 nt, Human
aacaagcagccaguggcgagu

SEQ ID NO: 873764 - RNA, 18 nt, Human
aagaaugccaccauuauc

SEQ ID NO: 873765 - RNA, 23 nt, Human
aaggcagagagacucaaaauuca

SEQ ID NO: 873766 - RNA, 20 nt, Human
acaaagcaugcagaaacuua

SEQ ID NO: 873767 - RNA, 22 nt, Human
acaaagcaugcagaaacuuacu

SEQ ID NO: 873768 - RNA, 21 nt, Human
agacucaaaauucaucgacag

SEQ ID NO: 873769 - RNA, 24 nt, Human
agccuccaguguggcgccuggcuc

SEQ ID NO: 873770 - RNA, 22 nt, Human
aggggcugcaugcagugagcca

SEQ ID NO: 873771 - RNA, 20 nt, Human
augccacggugcgcgaaagg

SEQ ID NO: 873772 - RNA, 22 nt, Human
caaaucaacaucaaugcucagc

SEQ ID NO: 873773 - RNA, 24 nt, Human
cacacggccggggacgugcuguuu

SEQ ID NO: 873774 - RNA, 18 nt, Human
cacaguucgacuucuguc

SEQ ID NO: 873775 - RNA, 24 nt, Human
caccccaaaucugaccccaaccgg

SEQ ID NO: 873776 - RNA, 23 nt, Human
caccugggccuaagcugggaggc

SEQ ID NO: 873777 - RNA, 23 nt, Human
cagagccagggcggagucagggg

SEQ ID NO: 873778 - RNA, 22 nt, Human
cagcaauaccgcaacgaacagc

SEQ ID NO: 873779 - RNA, 21 nt, Human
cagcaaugcccucucucucuc

SEQ ID NO: 873780 - RNA, 22 nt, Human
cagcggcguccccaggagacca

SEQ ID NO: 873781 - RNA, 23 nt, Human
ccaggggcugcaugcagugagcc

SEQ ID NO: 873782 - RNA, 21 nt, Human
cccacggcagggguauggggc

SEQ ID NO: 873783 - RNA, 23 nt, Human
ccccaaaucugaccccaaccggu

SEQ ID NO: 873784 - RNA, 21 nt, Human
cccccgaggcccgagggggcu

SEQ ID NO: 873785 - RNA, 18 nt, Human
ccugaauuaacaagcagc

SEQ ID NO: 873786 - RNA, 25 nt, Human
ccuggcaccugggccuaagcuggga

SEQ ID NO: 873787 - RNA, 18 nt, Human
ccuggccccgauaggcag

SEQ ID NO: 873788 - RNA, 21 nt, Human
cggagccggaugucugcaucc

SEQ ID NO: 873789 - RNA, 21 nt, Human
cuaguauugcacgccaggggc

SEQ ID NO: 873790 - RNA, 18 nt, Human
cugcagcgggagucuacg

SEQ ID NO: 873791 - RNA, 18 nt, Human
cugcuuacauuguuguuu

SEQ ID NO: 873792 - RNA, 26 nt, Human
cuggcaacagcuacucaauugcacgu

SEQ ID NO: 873793 - RNA, 18 nt, Human
cugggcccucccgccugg

SEQ ID NO: 873794 - RNA, 24 nt, Human
cuucaccccaaaucugaccccaac

SEQ ID NO: 873795 - RNA, 18 nt, Human
cuuccugggcucccuaaa

SEQ ID NO: 873796 - RNA, 20 nt, Human
gacaucuuuuacgcaaaaau

SEQ ID NO: 873797 - RNA, 19 nt, Human
gcaugcagaaacuuacuca

SEQ ID NO: 873798 - RNA, 23 nt, Human
ggagcacuaguauugcacgccag

SEQ ID NO: 873799 - RNA, 21 nt, Human
ggcagggguauggggcagagc

SEQ ID NO: 873800 - RNA, 25 nt, Human
ggccugggcccucccgccugggagc

SEQ ID NO: 873801 - RNA, 18 nt, Human
ggguauggggcagagcca

SEQ ID NO: 873802 - RNA, 20 nt, Human
gguauggggcagagccaggg

SEQ ID NO: 873803 - RNA, 22 nt, Human
guuaagaaauggagacgaacuc

SEQ ID NO: 873804 - RNA, 18 nt, Human
uaacuuccugggcucccu

SEQ ID NO: 873805 - RNA, 21 nt, Human
uacaggccagcaaugcccucu

SEQ ID NO: 873806 - RNA, 21 nt, Human
uacgcugcuguugccugggcc

SEQ ID NO: 873807 - RNA, 20 nt, Human
uaucaaguaacuccaguuua

SEQ ID NO: 873808 - RNA, 27 nt, Human
ucauguguccaccccacuccagcagau

SEQ ID NO: 873809 - RNA, 20 nt, Human
uccccaggagaccacggccc

SEQ ID NO: 873810 - RNA, 19 nt, Human
ugaaaaucugcagggcugg

SEQ ID NO: 873811 - RNA, 25 nt, Human
ugcagugagccacaggccagaggcc

SEQ ID NO: 873812 - RNA, 19 nt, Human
ugccuuugguuuggggacu

SEQ ID NO: 873813 - RNA, 24 nt, Human
ugccuuugguuuggggacuagcuc

SEQ ID NO: 873814 - RNA, 22 nt, Human
ugcugcuuacauuguuguuuug

SEQ ID NO: 873815 - RNA, 18 nt, Human
uggcgccuggcucugggu

SEQ ID NO: 873816 - RNA, 24 nt, Human
ugggaggccagcggcguccccagg

SEQ ID NO: 873817 - RNA, 22 nt, Human
ugggccuaagcugggaggccag

SEQ ID NO: 873818 - RNA, 23 nt, Human
uggggcagagccagggcggaguc

SEQ ID NO: 873819 - RNA, 21 nt, Human
uuuuuuuuuuuuuuuuucauu

SEQ ID NO: 873820 - RNA, 19 nt, Human
aaaaaacacacacacacac

SEQ ID NO: 873821 - RNA, 26 nt, Human
aaacacacacacacacucacacucuc

SEQ ID NO: 873822 - RNA, 22 nt, Human
acacacacacacucacacucuc

SEQ ID NO: 873823 - RNA, 18 nt, Human
acacacacacucuacagg

SEQ ID NO: 873824 - RNA, 18 nt, Human
acacacacucucucuaua

SEQ ID NO: 873825 - RNA, 20 nt, Human
acacucacacacucucucua

SEQ ID NO: 873826 - RNA, 19 nt, Human
acacucucucuuccucuuu

SEQ ID NO: 873827 - RNA, 19 nt, Human
acacugcacccuagaggca

SEQ ID NO: 873828 - RNA, 18 nt, Human
acucagaaaauucagucc

SEQ ID NO: 873829 - RNA, 24 nt, Human
acucuacagguguucaauagaaaa

SEQ ID NO: 873830 - RNA, 21 nt, Human
acugcacccuagaggcaggag

SEQ ID NO: 873831 - RNA, 25 nt, Human
agaaaacacacacucacacacucuc

SEQ ID NO: 873832 - RNA, 18 nt, Human
agguacggacacugcacc

SEQ ID NO: 873833 - RNA, 20 nt, Human
aggucucugaauagguguuc

SEQ ID NO: 873834 - RNA, 24 nt, Human
caauagaaaacacacacacucucu

SEQ ID NO: 873835 - RNA, 19 nt, Human
cacucacacucucucuucc

SEQ ID NO: 873836 - RNA, 21 nt, Human
cacucucucuuccucuuuccc

SEQ ID NO: 873837 - RNA, 24 nt, Human
cacucucucuuccucuuucccgca

SEQ ID NO: 873838 - RNA, 20 nt, Human
cacugcacccuagaggcagg

SEQ ID NO: 873839 - RNA, 22 nt, Human
ccuagaggcaggagcaguggga

SEQ ID NO: 873840 - RNA, 20 nt, Human
cucuuccucuuucccgcaac

SEQ ID NO: 873841 - RNA, 18 nt, Human
gagcuugagguuucucuc

SEQ ID NO: 873842 - RNA, 18 nt, Human
gggaaggagggcccaggc

SEQ ID NO: 873843 - RNA, 23 nt, Human
guuucucaaugucugggcugggg

SEQ ID NO: 873844 - RNA, 20 nt, Human
uagaaaacacacacacacac

SEQ ID NO: 873845 - RNA, 19 nt, Human
uagaggcaggagcaguggg

SEQ ID NO: 873846 - RNA, 18 nt, Human
uccaggucucugaauagg

SEQ ID NO: 873847 - RNA, 23 nt, Human
ucucucuucuucccaaguuucuc

SEQ ID NO: 873848 - RNA, 19 nt, Human
ucucuuccucuuucccgca

SEQ ID NO: 873849 - RNA, 21 nt, Human
ucugggcuggggaaggagggc

SEQ ID NO: 873850 - RNA, 22 nt, Human
uggggaaggagggcccaggcuc

SEQ ID NO: 873851 - RNA, 23 nt, Human
ugucugggcuggggaaggagggc

SEQ ID NO: 873852 - RNA, 22 nt, Human
uugggagcuugagguuucucuc

SEQ ID NO: 873853 - RNA, 20 nt, Human
uuuuuuuuuuuuuaagagau

SEQ ID NO: 873854 - RNA, 19 nt, Human
uuuuuuuuuuuuuuuuuaa

SEQ ID NO: 873855 - RNA, 25 nt, Human
uuuuuuuuuuuuuuuuuuuaagaga

SEQ ID NO: 873856 - RNA, 18 nt, Human
aguagaggaccugggccg

SEQ ID NO: 873857 - RNA, 26 nt, Human
augugcaaaacugacagccguccaag

SEQ ID NO: 873858 - RNA, 25 nt, Human
ccccgcacugaggcucgugucccuc

SEQ ID NO: 873859 - RNA, 22 nt, Human
cccgcccggcccgccccgggag

SEQ ID NO: 873860 - RNA, 22 nt, Human
ccgcccggcccgccccgggagc

SEQ ID NO: 873861 - RNA, 18 nt, Human
ccucucccuggccaccac

SEQ ID NO: 873862 - RNA, 26 nt, Human
cgccagcagccgcuacaugcucgacc

SEQ ID NO: 873863 - RNA, 21 nt, Human
cgcgugcggcucccgcggccc

SEQ ID NO: 873864 - RNA, 20 nt, Human
cggccgggcccuccccgagc

SEQ ID NO: 873865 - RNA, 19 nt, Human
cggcucccgcggcccgccc

SEQ ID NO: 873866 - RNA, 22 nt, Human
cguccaagggcccagccgacag

SEQ ID NO: 873867 - RNA, 23 nt, Human
cuccccgagcggggacacacugc

SEQ ID NO: 873868 - RNA, 26 nt, Human
cucgacccgggccucgugccgguucc

SEQ ID NO: 873869 - RNA, 22 nt, Human
cuuccaccccgcacugaggcuc

SEQ ID NO: 873870 - RNA, 18 nt, Human
gacaggacuggcucuccc

SEQ ID NO: 873871 - RNA, 19 nt, Human
gacuggcucucccugcccg

SEQ ID NO: 873872 - RNA, 20 nt, Human
gcagggcuuggcugagcccu

SEQ ID NO: 873873 - RNA, 19 nt, Human
gccccgggagccccgccgc

SEQ ID NO: 873874 - RNA, 22 nt, Human
gccgacaggacuggcucucccu

SEQ ID NO: 873875 - RNA, 19 nt, Human
ucccucggcagcucccugc

SEQ ID NO: 873876 - RNA, 20 nt, Human
ucccuggccaccaccaaggg

SEQ ID NO: 873877 - RNA, 18 nt, Human
uccuucugggaaggccua

SEQ ID NO: 873878 - RNA, 20 nt, Human
ucugcaccgggcgccucucc

SEQ ID NO: 873879 - RNA, 25 nt, Human
ugcaguaaacuucuuuuuaaggucu

SEQ ID NO: 873880 - RNA, 24 nt, Human
ugggugcccccccauccacugucc

SEQ ID NO: 873881 - RNA, 18 nt, Human
ugugcaaaacugacagcc

SEQ ID NO: 873882 - RNA, 23 nt, Human
ugugggugcccccccauccacug

SEQ ID NO: 873883 - RNA, 19 nt, Human
uuccaccccgcacugaggc

SEQ ID NO: 873884 - RNA, 18 nt, Human
agcuagcuucgcgacccc

SEQ ID NO: 873885 - RNA, 21 nt, Human
agcuucgcgaccccgcuccuu

SEQ ID NO: 873886 - RNA, 23 nt, Human
cacaaccaagccgccgccgcgcc

SEQ ID NO: 873887 - RNA, 19 nt, Human
ccccgccucuucacaacca

SEQ ID NO: 873888 - RNA, 18 nt, Human
ccgccgcgccgccgggcc

SEQ ID NO: 873889 - RNA, 21 nt, Human
ccgggcccggggaccuggagg

SEQ ID NO: 873890 - RNA, 22 nt, Human
ccucucacagucucauaggggu

SEQ ID NO: 873891 - RNA, 30 nt, Human
cuucacaaccaagccgccgccgcgccgccu

SEQ ID NO: 873892 - RNA, 20 nt, Human
gaccuggaggggggccgcug

SEQ ID NO: 873893 - RNA, 19 nt, Human
gggggccgcugcuagcuag

SEQ ID NO: 873894 - RNA, 21 nt, Human
uccuuugagguaggccccggg

SEQ ID NO: 873895 - RNA, 18 nt, Human
uuccccgccucuucacaa

SEQ ID NO: 873896 - RNA, 20 nt, Human
uuuuuuuuuugcugacaccc

SEQ ID NO: 873897 - RNA, 20 nt, Human
uuuuuuuuuuuuuuuuugcu

SEQ ID NO: 873898 - RNA, 23 nt, Human
uuuuuuuuuuuuuuuuuugcuga

SEQ ID NO: 873899 - RNA, 20 nt, Human
uuuuuuuuuuuuuuuuuugg

SEQ ID NO: 873900 - RNA, 19 nt, Human
caggagccugggcgggaau

SEQ ID NO: 873901 - RNA, 22 nt, Human
cggcugggagugggcucugugg

SEQ ID NO: 873902 - RNA, 19 nt, Human
cucccugguccaucucugg

SEQ ID NO: 873903 - RNA, 20 nt, Human
cugggagugggcucuguggc

SEQ ID NO: 873904 - RNA, 25 nt, Human
gaggacggcugggagugggcucugu

SEQ ID NO: 873905 - RNA, 22 nt, Human
gcauccuguccucccuggucca

SEQ ID NO: 873906 - RNA, 18 nt, Human
uaaaaccaggccacgcaa

SEQ ID NO: 873907 - RNA, 22 nt, Human
ugaaaauaaaaccaggccacgc

SEQ ID NO: 873908 - RNA, 23 nt, Human
ugccuggcgguuacaggagccug

SEQ ID NO: 873909 - RNA, 19 nt, Human
uuuuuuuuuuuuuugagga

SEQ ID NO: 873910 - RNA, 18 nt, Human
uuuuuuuuuuuuuuuuug

SEQ ID NO: 873911 - RNA, 21 nt, Human
uuuuuuuuuuuuuuuuugagg

SEQ ID NO: 873912 - RNA, 20 nt, Human
aaaguagaucaucugaugga

SEQ ID NO: 873913 - RNA, 21 nt, Human
aagaaaguauaagccaggcgc

SEQ ID NO: 873914 - RNA, 20 nt, Human
aagaagaaagaaaguauaaa

SEQ ID NO: 873915 - RNA, 23 nt, Human
aagaaucacuugaacccaggaga

SEQ ID NO: 873916 - RNA, 23 nt, Human
aagaucgugucacugcacuccag

SEQ ID NO: 873917 - RNA, 28 nt, Human
aaguauaagccaggcgcgguggcucacg

SEQ ID NO: 873918 - RNA, 19 nt, Human
aagugcccauuuggguccc

SEQ ID NO: 873919 - RNA, 24 nt, Human
aaucacuugaacccaggagacgga

SEQ ID NO: 873920 - RNA, 24 nt, Human
acagagcgagacucgaucucaaaa

SEQ ID NO: 873921 - RNA, 24 nt, Human
acccaggagacggagguugcagug

SEQ ID NO: 873922 - RNA, 24 nt, Human
accucguuucuacuaagaauacaa

SEQ ID NO: 873923 - RNA, 23 nt, Human
acugcacuccagccuggugacag

SEQ ID NO: 873924 - RNA, 25 nt, Human
acugcacuccagccuggugacagag

SEQ ID NO: 873925 - RNA, 24 nt, Human
agacggagguugcagugagccaag

SEQ ID NO: 873926 - RNA, 21 nt, Human
agccuggugacagagcgagac

SEQ ID NO: 873927 - RNA, 23 nt, Human
agccuggugacagagcgagacuc

SEQ ID NO: 873928 - RNA, 23 nt, Human
aggagacggagguugcagugagc

SEQ ID NO: 873929 - RNA, 20 nt, Human
aggagccucggauggcaguu

SEQ ID NO: 873930 - RNA, 18 nt, Human
aggcagaagaaucacuug

SEQ ID NO: 873931 - RNA, 23 nt, Human
aggcagaagaaucacuugaaccc

SEQ ID NO: 873932 - RNA, 24 nt, Human
aggcagaagaaucacuugaaccca

SEQ ID NO: 873933 - RNA, 24 nt, Human
aggcgcgguggcucacgccuauaa

SEQ ID NO: 873934 - RNA, 24 nt, Human
aggcugaggcagaagaaucacuug

SEQ ID NO: 873935 - RNA, 20 nt, Human
aggugguuguuggguugggg

SEQ ID NO: 873936 - RNA, 20 nt, Human
aguugcuccgucuguugagu

SEQ ID NO: 873937 - RNA, 22 nt, Human
aucaugcuuucuggguagaccc

SEQ ID NO: 873938 - RNA, 21 nt, Human
auccuggccaacauguugaaa

SEQ ID NO: 873939 - RNA, 24 nt, Human
aucgugucacugcacuccagccug

SEQ ID NO: 873940 - RNA, 24 nt, Human
auuagugggcgccuguaaucccag

SEQ ID NO: 873941 - RNA, 24 nt, Human
auuuuccugacuccuguuucuggg

SEQ ID NO: 873942 - RNA, 20 nt, Human
caacagcccuuacccugggc

SEQ ID NO: 873943 - RNA, 20 nt, Human
caagaucgugucacugcacu

SEQ ID NO: 873944 - RNA, 24 nt, Human
caagucggguggaucaagagguca

SEQ ID NO: 873945 - RNA, 25 nt, Human
caccccugaaaagggaccucccaga

SEQ ID NO: 873946 - RNA, 22 nt, Human
cacuccagccuggugacagagc

SEQ ID NO: 873947 - RNA, 23 nt, Human
cacuccagccuggugacagagcg

SEQ ID NO: 873948 - RNA, 18 nt, Human
cacugcacuccagccugg

SEQ ID NO: 873949 - RNA, 18 nt, Human
cacugcacuccagccugg

SEQ ID NO: 873950 - RNA, 20 nt, Human
cacugcacuccagccuggug

SEQ ID NO: 873951 - RNA, 22 nt, Human
cacugcacuccagccuggugac

SEQ ID NO: 873952 - RNA, 23 nt, Human
cacugcacuccagccuggugaca

SEQ ID NO: 873953 - RNA, 24 nt, Human
cacugcacuccagccuggugacag

SEQ ID NO: 873954 - RNA, 21 nt, Human
cagcagacaccacugccacac

SEQ ID NO: 873955 - RNA, 25 nt, Human
cagccaaccuggaauaagccagagu

SEQ ID NO: 873956 - RNA, 22 nt, Human
cagcgccuugcccaucucccuc

SEQ ID NO: 873957 - RNA, 24 nt, Human
cagcugcucgggaggcugaggcag

SEQ ID NO: 873958 - RNA, 19 nt, Human
caguggguccuguccccug

SEQ ID NO: 873959 - RNA, 22 nt, Human
ccaacacaucagccaaccugga

SEQ ID NO: 873960 - RNA, 24 nt, Human
cccaacacaucagccaaccuggaa

SEQ ID NO: 873961 - RNA, 23 nt, Human
ccccugaaaagggaccucccaga

SEQ ID NO: 873962 - RNA, 20 nt, Human
cccugugccugggaaacuuc

SEQ ID NO: 873963 - RNA, 21 nt, Human
ccucccucccucccuaguccc

SEQ ID NO: 873964 - RNA, 21 nt, Human
ccuggccaacauguugaaacc

SEQ ID NO: 873965 - RNA, 24 nt, Human
ccuggccaacauguugaaaccucg

SEQ ID NO: 873966 - RNA, 21 nt, Human
ccuggugacagagcgagacuc

SEQ ID NO: 873967 - RNA, 19 nt, Human
ccuguaaucccagcugcuc

SEQ ID NO: 873968 - RNA, 21 nt, Human
ccuguaaucccagcugcucgg

SEQ ID NO: 873969 - RNA, 21 nt, Human
ccuguccccugggaaaaacca

SEQ ID NO: 873970 - RNA, 20 nt, Human
ccuuaagguaccucaacagc

SEQ ID NO: 873971 - RNA, 19 nt, Human
ccuucccucccucccuccc

SEQ ID NO: 873972 - RNA, 19 nt, Human
ccuugcccaucucccucuu

SEQ ID NO: 873973 - RNA, 23 nt, Human
cgccuauaaucucaucacuucgg

SEQ ID NO: 873974 - RNA, 24 nt, Human
cgccuguaaucccagcugcucggg

SEQ ID NO: 873975 - RNA, 24 nt, Human
cgggaggcugaggcagaagaauca

SEQ ID NO: 873976 - RNA, 22 nt, Human
cggguggaucaagaggucaaga

SEQ ID NO: 873977 - RNA, 23 nt, Human
cuagucccugacaucuucucaca

SEQ ID NO: 873978 - RNA, 22 nt, Human
cucacgccuauaaucucaucac

SEQ ID NO: 873979 - RNA, 24 nt, Human
cucacgccuauaaucucaucacuu

SEQ ID NO: 873980 - RNA, 24 nt, Human
cuccagccuggugacagagcgaga

SEQ ID NO: 873981 - RNA, 22 nt, Human
cuuggccaaggguacagccacc

SEQ ID NO: 873982 - RNA, 19 nt, Human
cuuuaugacucacauuugu

SEQ ID NO: 873983 - RNA, 23 nt, Human
gaggacuuucucaucuugggaga

SEQ ID NO: 873984 - RNA, 23 nt, Human
gagguugcagugagccaagaucg

SEQ ID NO: 873985 - RNA, 23 nt, Human
gcacuccagccuggugacagagc

SEQ ID NO: 873986 - RNA, 22 nt, Human
gcagaagaaucacuugaaccca

SEQ ID NO: 873987 - RNA, 22 nt, Human
gccuugcccaucucccucuuga

SEQ ID NO: 873988 - RNA, 20 nt, Human
gcuugucucccagugggucc

SEQ ID NO: 873989 - RNA, 25 nt, Human
gcuuuacccaucucccaacacauca

SEQ ID NO: 873990 - RNA, 20 nt, Human
gcuuucuggguagaccccuu

SEQ ID NO: 873991 - RNA, 22 nt, Human
gcuuugacuuuguggacacccc

SEQ ID NO: 873992 - RNA, 20 nt, Human
ggagguugcagugagccaag

SEQ ID NO: 873993 - RNA, 24 nt, Human
ggagguugcagugagccaagaucg

SEQ ID NO: 873994 - RNA, 23 nt, Human
gggaaaaaccagggaacuucuua

SEQ ID NO: 873995 - RNA, 23 nt, Human
gggaggccaagucggguggauca

SEQ ID NO: 873996 - RNA, 23 nt, Human
ggucaagugagucauauugccag

SEQ ID NO: 873997 - RNA, 19 nt, Human
gguggcucacgccuauaau

SEQ ID NO: 873998 - RNA, 23 nt, Human
gguggcucacgccuauaaucuca

SEQ ID NO: 873999 - RNA, 26 nt, Human
gucaagugagucauauugccaggugg

SEQ ID NO: 874000 - RNA, 23 nt, Human
uaagcauccucccucagcgccuu

SEQ ID NO: 874001 - RNA, 24 nt, Human
uaagccagagucucagacaagaaa

SEQ ID NO: 874002 - RNA, 19 nt, Human
uagaagaaacgcuuuaccc

SEQ ID NO: 874003 - RNA, 21 nt, Human
uagaagaaacgcuuuacccau

SEQ ID NO: 874004 - RNA, 23 nt, Human
uagcuuugacuuuguggacaccc

SEQ ID NO: 874005 - RNA, 19 nt, Human
uagggcaggaaaucaugcu

SEQ ID NO: 874006 - RNA, 21 nt, Human
uagugggcgccuguaauccca

SEQ ID NO: 874007 - RNA, 22 nt, Human
uagugggcgccuguaaucccag

SEQ ID NO: 874008 - RNA, 24 nt, Human
ucaagaggucaagagauugagacc

SEQ ID NO: 874009 - RNA, 20 nt, Human
ucacugcacuccagccuggu

SEQ ID NO: 874010 - RNA, 23 nt, Human
ucacugcacuccagccuggugac

SEQ ID NO: 874011 - RNA, 21 nt, Human
ucacuugaggacuuucucauc

SEQ ID NO: 874012 - RNA, 24 nt, Human
ucagccaaccuggaauaagccaga

SEQ ID NO: 874013 - RNA, 20 nt, Human
ucaggagccucggauggcag

SEQ ID NO: 874014 - RNA, 19 nt, Human
uccaaagccccagguccuc

SEQ ID NO: 874015 - RNA, 22 nt, Human
uccagccuggugacagagcgag

SEQ ID NO: 874016 - RNA, 21 nt, Human
ucccagaagccuacagaguac

SEQ ID NO: 874017 - RNA, 20 nt, Human
ucccuagucccugacaucuu

SEQ ID NO: 874018 - RNA, 23 nt, Human
ucccucccucccucccuaguccc

SEQ ID NO: 874019 - RNA, 23 nt, Human
ucccucuugaccuucccuuaagg

SEQ ID NO: 874020 - RNA, 25 nt, Human
ucgggaggcugaggcagaagaauca

SEQ ID NO: 874021 - RNA, 19 nt, Human
ucucaaaaaaauaaaaaag

SEQ ID NO: 874022 - RNA, 26 nt, Human
ucucaaaaaaauaaaaaagaagaaag

SEQ ID NO: 874023 - RNA, 18 nt, Human
ucugccuucccucccucc

SEQ ID NO: 874024 - RNA, 23 nt, Human
ucugccuucccucccucccuccc

SEQ ID NO: 874025 - RNA, 18 nt, Human
ucugcuuccuccuccccu

SEQ ID NO: 874026 - RNA, 23 nt, Human
ugagaccauccuggccaacaugu

SEQ ID NO: 874027 - RNA, 22 nt, Human
ugagccaagaucgugucacugc

SEQ ID NO: 874028 - RNA, 20 nt, Human
ugaggcagaagaaucacuug

SEQ ID NO: 874029 - RNA, 24 nt, Human
ugaggcagaagaaucacuugaacc

SEQ ID NO: 874030 - RNA, 25 nt, Human
ugaggcagaagaaucacuugaaccc

SEQ ID NO: 874031 - RNA, 18 nt, Human
ugcucuggaccaucaccc

SEQ ID NO: 874032 - RNA, 18 nt, Human
uggaauaagccagagucu

SEQ ID NO: 874033 - RNA, 21 nt, Human
uggcucacgccuauaaucuca

SEQ ID NO: 874034 - RNA, 22 nt, Human
ugggccagccugcuuacccugc

SEQ ID NO: 874035 - RNA, 24 nt, Human
uggguugggguguggaucaggaau

SEQ ID NO: 874036 - RNA, 22 nt, Human
uguggaucaggaaucugaugcc

SEQ ID NO: 874037 - RNA, 18 nt, Human
uguggaucaggaaucugg

SEQ ID NO: 874038 - RNA, 18 nt, Human
uuaagaaaguauaagcca

SEQ ID NO: 874039 - RNA, 19 nt, Human
uucuuucuccuuuuuauua

SEQ ID NO: 874040 - RNA, 24 nt, Human
uugagucugauugcugggggccaa

SEQ ID NO: 874041 - RNA, 22 nt, Human
uugcagugagccaagaucgugu

SEQ ID NO: 874042 - RNA, 21 nt, Human
uuucuacuaagaauacaaaaa

SEQ ID NO: 874043 - RNA, 24 nt, Human
uuuuuuuuuuuuuuuuuaacaaug

SEQ ID NO: 874044 - RNA, 22 nt, Human
aaaaaacccaaaacacacucca

SEQ ID NO: 874045 - RNA, 19 nt, Human
aaaaagagucccugucucu

SEQ ID NO: 874046 - RNA, 24 nt, Human
aaaacaaaacaaaacaacaaaaaa

SEQ ID NO: 874047 - RNA, 19 nt, Human
aaacaaaacaaaacaacaa

SEQ ID NO: 874048 - RNA, 21 nt, Human
aaacaaaacaaaacaacaaaa

SEQ ID NO: 874049 - RNA, 22 nt, Human
aaacaaaacaacaaaaaaaaca

SEQ ID NO: 874050 - RNA, 23 nt, Human
aaacaaaacaacaaaaaaaacaa

SEQ ID NO: 874051 - RNA, 27 nt, Human
aaacaaaacaacaaaaaaaacaaaaac

SEQ ID NO: 874052 - RNA, 20 nt, Human
aaacuuuacauuuauucuag

SEQ ID NO: 874053 - RNA, 18 nt, Human
aaaggacauguacaaaug

SEQ ID NO: 874054 - RNA, 22 nt, Human
aacaaaaacaguguuuucuccu

SEQ ID NO: 874055 - RNA, 31 nt, Human
aacaaaacaaaacaacaaaaaaaacaaaaaa

SEQ ID NO: 874056 - RNA, 22 nt, Human
aacacaauagaugacgaacccu

SEQ ID NO: 874057 - RNA, 25 nt, Human
aacaguuaaaaaaaacccaaaacac

SEQ ID NO: 874058 - RNA, 21 nt, Human
aacuggccaaaacaaaacaaa

SEQ ID NO: 874059 - RNA, 23 nt, Human
aagagcaaaauaaggucaggagg

SEQ ID NO: 874060 - RNA, 18 nt, Human
aagcagcuuugcccuucu

SEQ ID NO: 874061 - RNA, 19 nt, Human
aaucuggguuggacugcuc

SEQ ID NO: 874062 - RNA, 20 nt, Human
aauggcuccacaucugcagg

SEQ ID NO: 874063 - RNA, 23 nt, Human
acaaaacaacaaaaaaaacaaaa

SEQ ID NO: 874064 - RNA, 25 nt, Human
acaaaacaacaaaaaaaacaaaaaa

SEQ ID NO: 874065 - RNA, 21 nt, Human
acaacaaaaaaaacaaaaaca

SEQ ID NO: 874066 - RNA, 22 nt, Human
acacaucaccauaacauaauca

SEQ ID NO: 874067 - RNA, 22 nt, Human
acagaagaaaaauaaaaaagga

SEQ ID NO: 874068 - RNA, 21 nt, Human
acaguuaaaaaaaacccaaaa

SEQ ID NO: 874069 - RNA, 20 nt, Human
accaaguuaaaggauguucu

SEQ ID NO: 874070 - RNA, 24 nt, Human
acccaaaacacacuccauuaucau

SEQ ID NO: 874071 - RNA, 18 nt, Human
acccccagagcugagaaa

SEQ ID NO: 874072 - RNA, 22 nt, Human
acccuaagccuccgggcugcac

SEQ ID NO: 874073 - RNA, 23 nt, Human
acccugauaguggccaaguagaa

SEQ ID NO: 874074 - RNA, 25 nt, Human
accuugggaagaggauaccuucuug

SEQ ID NO: 874075 - RNA, 22 nt, Human
acuacagcuguucagaccaaug

SEQ ID NO: 874076 - RNA, 22 nt, Human
acuguguggaggaagaccaggg

SEQ ID NO: 874077 - RNA, 21 nt, Human
agacagcucgaaacccaugcc

SEQ ID NO: 874078 - RNA, 24 nt, Human
agagugcauuuuuuuuucucugua

SEQ ID NO: 874079 - RNA, 22 nt, Human
aggacauguacaaauggccuuc

SEQ ID NO: 874080 - RNA, 21 nt, Human
aggaguagaccaacuacagcu

SEQ ID NO: 874081 - RNA, 24 nt, Human
agucaacacaauagaugacgaacc

SEQ ID NO: 874082 - RNA, 22 nt, Human
agucaguacuuaagagucuaga

SEQ ID NO: 874083 - RNA, 23 nt, Human
aguuccaccugaaaccaggcagc

SEQ ID NO: 874084 - RNA, 18 nt, Human
auaacauaaucacaaaag

SEQ ID NO: 874085 - RNA, 19 nt, Human
auaaccuugaacuaaaagc

SEQ ID NO: 874086 - RNA, 23 nt, Human
caaaaagccauuaauagucaaca

SEQ ID NO: 874087 - RNA, 31 nt, Human
caaaacaaaacaaaacaacaaaaaaaacaaa

SEQ ID NO: 874088 - RNA, 24 nt, Human
caaaacaacaaaaaaaacaaaaac

SEQ ID NO: 874089 - RNA, 21 nt, Human
caaacugguaaaugaccccca

SEQ ID NO: 874090 - RNA, 18 nt, Human
caacaaaaaaaacaaaaa

SEQ ID NO: 874091 - RNA, 19 nt, Human
caacaaaaaaaacaaaaac

SEQ ID NO: 874092 - RNA, 20 nt, Human
caacagaaggagcuucuaaa

SEQ ID NO: 874093 - RNA, 23 nt, Human
caacugggcuaauggcuccacag

SEQ ID NO: 874094 - RNA, 24 nt, Human
caacugggcuaauggcuccacauu

SEQ ID NO: 874095 - RNA, 18 nt, Human
caacuuccaacagaagga

SEQ ID NO: 874096 - RNA, 23 nt, Human
caaguagcuccagugugcaccaa

SEQ ID NO: 874097 - RNA, 25 nt, Human
cacagacgcuuuauuggcuggggag

SEQ ID NO: 874098 - RNA, 21 nt, Human
caccagaaagaauuuugccaa

SEQ ID NO: 874099 - RNA, 18 nt, Human
caccgcuuugagaaagcu

SEQ ID NO: 874100 - RNA, 21 nt, Human
caccuuuguuuccccacacaa

SEQ ID NO: 874101 - RNA, 20 nt, Human
cacuccauuaucaugauccu

SEQ ID NO: 874102 - RNA, 24 nt, Human
cagcagugaaauacacacacgugg

SEQ ID NO: 874103 - RNA, 21 nt, Human
caggagccggcaagggaagag

SEQ ID NO: 874104 - RNA, 21 nt, Human
cauuucucuguagcauuuggg

SEQ ID NO: 874105 - RNA, 19 nt, Human
cauuuuagaucacagguac

SEQ ID NO: 874106 - RNA, 22 nt, Human
ccaaaacacacuccauuaucau

SEQ ID NO: 874107 - RNA, 19 nt, Human
ccacacaaucaagugcuaa

SEQ ID NO: 874108 - RNA, 22 nt, Human
ccagaaagaauuuugccaaagg

SEQ ID NO: 874109 - RNA, 25 nt, Human
ccagaaagaauuuugccaaaggaca

SEQ ID NO: 874110 - RNA, 23 nt, Human
ccaguauuccccaccccucccac

SEQ ID NO: 874111 - RNA, 19 nt, Human
cccuaagaaauggcucucu

SEQ ID NO: 874112 - RNA, 19 nt, Human
cccuaagccuccgggcugc

SEQ ID NO: 874113 - RNA, 18 nt, Human
cccuugcugagguccagc

SEQ ID NO: 874114 - RNA, 20 nt, Human
ccuagauuggagagcaaaac

SEQ ID NO: 874115 - RNA, 23 nt, Human
ccucuaccuucaucuauagcaaa

SEQ ID NO: 874116 - RNA, 22 nt, Human
ccuuaauaaaacacacaaccaa

SEQ ID NO: 874117 - RNA, 26 nt, Human
cgccacagacgcuuuauuggcugggg

SEQ ID NO: 874118 - RNA, 20 nt, Human
cgugcagcaaggcaugcugg

SEQ ID NO: 874119 - RNA, 18 nt, Human
cuagguugugaacauauu

SEQ ID NO: 874120 - RNA, 19 nt, Human
cucaagcaaaaaaaccaga

SEQ ID NO: 874121 - RNA, 23 nt, Human
cugaaaccaggcagccaucauca

SEQ ID NO: 874122 - RNA, 19 nt, Human
cugacagcccucuaccuuc

SEQ ID NO: 874123 - RNA, 21 nt, Human
cugcacccuaagccuccgggc

SEQ ID NO: 874124 - RNA, 24 nt, Human
cugcaggggucgccccgaucuccu

SEQ ID NO: 874125 - RNA, 19 nt, Human
cuggaaaugaacuuuuaac

SEQ ID NO: 874126 - RNA, 25 nt, Human
cuggccaaaacaaaacaaaacaaca

SEQ ID NO: 874127 - RNA, 21 nt, Human
cuggggagagugaagagcaaa

SEQ ID NO: 874128 - RNA, 19 nt, Human
cugguuggaaagcacauau

SEQ ID NO: 874129 - RNA, 23 nt, Human
cuuucaaauugcacaccaaguua

SEQ ID NO: 874130 - RNA, 18 nt, Human
cuuugaagggguuucagc

SEQ ID NO: 874131 - RNA, 22 nt, Human
cuuugugauguacuggacaugu

SEQ ID NO: 874132 - RNA, 18 nt, Human
gaacaacuguguggagga

SEQ ID NO: 874133 - RNA, 19 nt, Human
gaagggguuucagccuguc

SEQ ID NO: 874134 - RNA, 20 nt, Human
gagaagcagaaggaagguug

SEQ ID NO: 874135 - RNA, 26 nt, Human
gagacuaaucuacaauggggacaccu

SEQ ID NO: 874136 - RNA, 18 nt, Human
gaggaagaccagggaggc

SEQ ID NO: 874137 - RNA, 20 nt, Human
gaucacagguacucaacuuc

SEQ ID NO: 874138 - RNA, 20 nt, Human
gcaaaauccuuacccaauca

SEQ ID NO: 874139 - RNA, 23 nt, Human
gccaaaacaaaacaaaacaacaa

SEQ ID NO: 874140 - RNA, 23 nt, Human
gccuggggagaccagcugggugc

SEQ ID NO: 874141 - RNA, 24 nt, Human
gcugacagcccucuaccuucaucu

SEQ ID NO: 874142 - RNA, 18 nt, Human
ggagaauauccucaacug

SEQ ID NO: 874143 - RNA, 24 nt, Human
ggagugcacuggccaucccucaga

SEQ ID NO: 874144 - RNA, 25 nt, Human
ggcagcucacacagcugccuuccga

SEQ ID NO: 874145 - RNA, 29 nt, Human
ggccaaaacaaaacaaaacaacaaaaaaa

SEQ ID NO: 874146 - RNA, 21 nt, Human
gggaaggguuaggaggggagg

SEQ ID NO: 874147 - RNA, 22 nt, Human
gguaccaggagccggcaaggga

SEQ ID NO: 874148 - RNA, 23 nt, Human
guagaaaacauuucucuguagca

SEQ ID NO: 874149 - RNA, 24 nt, Human
guauuccccaccccucccaccuuu

SEQ ID NO: 874150 - RNA, 22 nt, Human
uaaaaaaaacccaaaacacacu

SEQ ID NO: 874151 - RNA, 24 nt, Human
uaaaaaaaacccaaaacacacucc

SEQ ID NO: 874152 - RNA, 25 nt, Human
uaaaaaaaacccaaaacacacucca

SEQ ID NO: 874153 - RNA, 20 nt, Human
uaaaaauacucauaaagcag

SEQ ID NO: 874154 - RNA, 22 nt, Human
uaaaacacacaaccaaucagga

SEQ ID NO: 874155 - RNA, 18 nt, Human
uaaacccugugugccaaa

SEQ ID NO: 874156 - RNA, 19 nt, Human
uaacauaaucacaaaaguc

SEQ ID NO: 874157 - RNA, 21 nt, Human
uaacauaaucacaaaagucaa

SEQ ID NO: 874158 - RNA, 25 nt, Human
uaacauaaucacaaaagucaaagca

SEQ ID NO: 874159 - RNA, 20 nt, Human
uaaguuccaccugaaaccag

SEQ ID NO: 874160 - RNA, 19 nt, Human
uaaucacaaaagucaaagc

SEQ ID NO: 874161 - RNA, 24 nt, Human
uacacacacgugcagcaaggcaug

SEQ ID NO: 874162 - RNA, 19 nt, Human
uacagcuguucagaccaau

SEQ ID NO: 874163 - RNA, 20 nt, Human
uagacuguacagaagaaaaa

SEQ ID NO: 874164 - RNA, 20 nt, Human
uaggagacaccagaaagaau

SEQ ID NO: 874165 - RNA, 27 nt, Human
ucaacugaaccuagauuggagagcaaa

SEQ ID NO: 874166 - RNA, 26 nt, Human
ucacaaaagucaaagcagucaguacu

SEQ ID NO: 874167 - RNA, 18 nt, Human
ucagcagugaaauacaca

SEQ ID NO: 874168 - RNA, 22 nt, Human
ucaggaggaggaagaaaaggca

SEQ ID NO: 874169 - RNA, 20 nt, Human
ucaguggguacaccuuggga

SEQ ID NO: 874170 - RNA, 19 nt, Human
ucccugucucugaaguuag

SEQ ID NO: 874171 - RNA, 26 nt, Human
uccgagugacuggguuugccugaccc

SEQ ID NO: 874172 - RNA, 21 nt, Human
uccuuggugcccagagggcua

SEQ ID NO: 874173 - RNA, 22 nt, Human
ucuagagaacaaagaggugaac

SEQ ID NO: 874174 - RNA, 23 nt, Human
ucucuggaaaugaacuuuuaacu

SEQ ID NO: 874175 - RNA, 22 nt, Human
ucuguagcauuuggguagcugg

SEQ ID NO: 874176 - RNA, 24 nt, Human
ucuuagaaacaauauuccuucaac

SEQ ID NO: 874177 - RNA, 20 nt, Human
ugaaauacacacacgugcag

SEQ ID NO: 874178 - RNA, 22 nt, Human
ugaaauacacacacgugcagca

SEQ ID NO: 874179 - RNA, 18 nt, Human
ugaaaucaugcagagaug

SEQ ID NO: 874180 - RNA, 23 nt, Human
ugaagagcaaaauaaggucagga

SEQ ID NO: 874181 - RNA, 19 nt, Human
ugaagcccacuagcuuggc

SEQ ID NO: 874182 - RNA, 24 nt, Human
ugaauauaaccuugaacuaaaagc

SEQ ID NO: 874183 - RNA, 19 nt, Human
ugacagaaaggcugguaaa

SEQ ID NO: 874184 - RNA, 26 nt, Human
ugacuacacaucaccauaacauaauc

SEQ ID NO: 874185 - RNA, 22 nt, Human
ugagaaaugugaacgauucaag

SEQ ID NO: 874186 - RNA, 21 nt, Human
ugagaagagacuaaucuacaa

SEQ ID NO: 874187 - RNA, 23 nt, Human
ugagguccagcuguuuaugcugu

SEQ ID NO: 874188 - RNA, 23 nt, Human
uggacaugucucaaaacagucuu

SEQ ID NO: 874189 - RNA, 26 nt, Human
uggccaaaacaaaacaaaacaacaag

SEQ ID NO: 874190 - RNA, 24 nt, Human
uggcuggggagagugaagagcaaa

SEQ ID NO: 874191 - RNA, 19 nt, Human
ugggaaagaaaaaaauugc

SEQ ID NO: 874192 - RNA, 20 nt, Human
ugggaagggaauuacauuga

SEQ ID NO: 874193 - RNA, 18 nt, Human
ugggagaagcagaaggaa

SEQ ID NO: 874194 - RNA, 23 nt, Human
ugggugugggagaagcagaagga

SEQ ID NO: 874195 - RNA, 19 nt, Human
uggguuggacugcucugcu

SEQ ID NO: 874196 - RNA, 21 nt, Human
ugguaaaugacccccagagcu

SEQ ID NO: 874197 - RNA, 22 nt, Human
ugguaagugggguuuaccuucu

SEQ ID NO: 874198 - RNA, 18 nt, Human
uggugaacaacugugugg

SEQ ID NO: 874199 - RNA, 19 nt, Human
ugugcugagacuuugucuc

SEQ ID NO: 874200 - RNA, 18 nt, Human
uguggaggaagaccaggg

SEQ ID NO: 874201 - RNA, 24 nt, Human
uguggcacagguacccuugcaccu

SEQ ID NO: 874202 - RNA, 24 nt, Human
ugugggagaagcagaaggaagguu

SEQ ID NO: 874203 - RNA, 22 nt, Human
uuagaaacaauauuccuucaac

SEQ ID NO: 874204 - RNA, 23 nt, Human
uuaggcuacgauguaucauuaua

SEQ ID NO: 874205 - RNA, 22 nt, Human
uucucuggaaaugaacuuuuaa

SEQ ID NO: 874206 - RNA, 19 nt, Human
uugcugagguccagcuguu

SEQ ID NO: 874207 - RNA, 22 nt, Human
uuuaaaauacgacuuaacugca

SEQ ID NO: 874208 - RNA, 21 nt, Human
uuugcccuucugcaaauacug

SEQ ID NO: 874209 - RNA, 18 nt, Human
uuuuaacuuaccugauua

SEQ ID NO: 874210 - RNA, 20 nt, Human
uuuuagaugucaucugccuc

SEQ ID NO: 874211 - RNA, 19 nt, Human
uuuuuuuuuuuuucacuuu

SEQ ID NO: 874212 - RNA, 26 nt, Human
uuuuuuuuuuuuuuuuucacuuuaau

SEQ ID NO: 874213 - RNA, 23 nt, Human
aacacaccucugugcuacuagga

SEQ ID NO: 874214 - RNA, 27 nt, Human
aagugccugccagguuccccggugucg

SEQ ID NO: 874215 - RNA, 23 nt, Human
agagccccuugcauauccccacu

SEQ ID NO: 874216 - RNA, 18 nt, Human
agccuaggggguuccaaa

SEQ ID NO: 874217 - RNA, 23 nt, Human
agggaagaaccacauacacggca

SEQ ID NO: 874218 - RNA, 19 nt, Human
auccccucuccaauaaagc

SEQ ID NO: 874219 - RNA, 22 nt, Human
augaauucaggcuguggcggcc

SEQ ID NO: 874220 - RNA, 19 nt, Human
caacugguuccagcagggu

SEQ ID NO: 874221 - RNA, 21 nt, Human
caagagauggucaucuaccac

SEQ ID NO: 874222 - RNA, 28 nt, Human
cacauacacggcaauaaucugggaaacc

SEQ ID NO: 874223 - RNA, 21 nt, Human
cagagccccuugcauaucccc

SEQ ID NO: 874224 - RNA, 20 nt, Human
cagccuccuccucaucuccg

SEQ ID NO: 874225 - RNA, 20 nt, Human
cagcgagccccgcccucccc

SEQ ID NO: 874226 - RNA, 21 nt, Human
cauccccugggauccugugga

SEQ ID NO: 874227 - RNA, 22 nt, Human
ccaagcuuaacccccauccccu

SEQ ID NO: 874228 - RNA, 24 nt, Human
ccaccacaccagaacacaccucug

SEQ ID NO: 874229 - RNA, 20 nt, Human
ccagaacacaccucugugcu

SEQ ID NO: 874230 - RNA, 23 nt, Human
ccagagccccuugcauaucccca

SEQ ID NO: 874231 - RNA, 18 nt, Human
ccccggacgcccuggccu

SEQ ID NO: 874232 - RNA, 24 nt, Human
ccccugggauccuguggagacagg

SEQ ID NO: 874233 - RNA, 19 nt, Human
ccuccccagcugagggggc

SEQ ID NO: 874234 - RNA, 23 nt, Human
ccucccggccgugucgcaccgcc

SEQ ID NO: 874235 - RNA, 21 nt, Human
ccugcccacauccccucucca

SEQ ID NO: 874236 - RNA, 18 nt, Human
ccugggccuuauagccag

SEQ ID NO: 874237 - RNA, 21 nt, Human
ccuguggagacaggcaccugg

SEQ ID NO: 874238 - RNA, 22 nt, Human
ccuugcguuguucuccuccucc

SEQ ID NO: 874239 - RNA, 19 nt, Human
cgcaccgccgggaccggca

SEQ ID NO: 874240 - RNA, 21 nt, Human
cgcagccccggacgcccuggc

SEQ ID NO: 874241 - RNA, 20 nt, Human
cgccauggaccgggcccgag

SEQ ID NO: 874242 - RNA, 19 nt, Human
cgcccuggccuccggggcu

SEQ ID NO: 874243 - RNA, 19 nt, Human
cgccgggaccggcagcgcu

SEQ ID NO: 874244 - RNA, 22 nt, Human
cgccgggaccggcagcgcucgg

SEQ ID NO: 874245 - RNA, 21 nt, Human
cggagccccuccaccucccug

SEQ ID NO: 874246 - RNA, 19 nt, Human
cuccaauaaagcaccugug

SEQ ID NO: 874247 - RNA, 21 nt, Human
cuccaauaaagcaccugugcc

SEQ ID NO: 874248 - RNA, 21 nt, Human
cuccgcgcggccugcgcccuc

SEQ ID NO: 874249 - RNA, 22 nt, Human
cugcguaggcgcagccuccucc

SEQ ID NO: 874250 - RNA, 18 nt, Human
cugugcuacuaggaggac

SEQ ID NO: 874251 - RNA, 18 nt, Human
cuuggcuccucugagggg

SEQ ID NO: 874252 - RNA, 20 nt, Human
gaagaaccacauacacggca

SEQ ID NO: 874253 - RNA, 18 nt, Human
gaagcauauggggaaauu

SEQ ID NO: 874254 - RNA, 23 nt, Human
gagccccuccaccucccuguggg

SEQ ID NO: 874255 - RNA, 21 nt, Human
gccauggaccgggcccgagcc

SEQ ID NO: 874256 - RNA, 21 nt, Human
gcccacauccccucuccaaua

SEQ ID NO: 874257 - RNA, 18 nt, Human
gcccaggagagguugugg

SEQ ID NO: 874258 - RNA, 20 nt, Human
gccccggacgcccuggccuc

SEQ ID NO: 874259 - RNA, 22 nt, Human
gccccggacgcccuggccuccg

SEQ ID NO: 874260 - RNA, 19 nt, Human
gccucauccuguauaguuu

SEQ ID NO: 874261 - RNA, 24 nt, Human
gcgcaggguccgaggggccgccau

SEQ ID NO: 874262 - RNA, 20 nt, Human
ggaaauuaauagugguggca

SEQ ID NO: 874263 - RNA, 23 nt, Human
ggaaccuuccuuauccccugccc

SEQ ID NO: 874264 - RNA, 25 nt, Human
ggagccccuccaccucccugugggg

SEQ ID NO: 874265 - RNA, 20 nt, Human
ggcauuguugugugaguuca

SEQ ID NO: 874266 - RNA, 25 nt, Human
gggaagcauaauaucuguuuucaga

SEQ ID NO: 874267 - RNA, 20 nt, Human
gggcccgagccaaaugcagc

SEQ ID NO: 874268 - RNA, 19 nt, Human
ggggcucagcgcagggucc

SEQ ID NO: 874269 - RNA, 20 nt, Human
gggugguugaagcauauggg

SEQ ID NO: 874270 - RNA, 19 nt, Human
guucaugaauucaggcugu

SEQ ID NO: 874271 - RNA, 19 nt, Human
uaacccccauccccuggga

SEQ ID NO: 874272 - RNA, 21 nt, Human
uaacccccauccccugggauc

SEQ ID NO: 874273 - RNA, 23 nt, Human
uaagggucgcagucggcagcagg

SEQ ID NO: 874274 - RNA, 18 nt, Human
uaagucccugccaccaca

SEQ ID NO: 874275 - RNA, 21 nt, Human
uaaguguggguauugguuuuu

SEQ ID NO: 874276 - RNA, 21 nt, Human
uacauagaugacaauuuugug

SEQ ID NO: 874277 - RNA, 23 nt, Human
uaggauucccuaagucccugcca

SEQ ID NO: 874278 - RNA, 24 nt, Human
uauggcaaagugccugccagguuc

SEQ ID NO: 874279 - RNA, 20 nt, Human
uccaauaaagcaccugugcc

SEQ ID NO: 874280 - RNA, 23 nt, Human
uccauucugggucugaguuagga

SEQ ID NO: 874281 - RNA, 21 nt, Human
uccccugggauccuguggaga

SEQ ID NO: 874282 - RNA, 21 nt, Human
ucccuguggggccuggccuug

SEQ ID NO: 874283 - RNA, 21 nt, Human
ucugaguuaggagcuuggggc

SEQ ID NO: 874284 - RNA, 23 nt, Human
ugccaccacaccagaacacaccu

SEQ ID NO: 874285 - RNA, 18 nt, Human
uggcaggaagggggaccg

SEQ ID NO: 874286 - RNA, 19 nt, Human
uggcaggaagggggaccgg

SEQ ID NO: 874287 - RNA, 18 nt, Human
uggcauuguugugugagu

SEQ ID NO: 874288 - RNA, 23 nt, Human
ugucaggggcagccaggacuguc

SEQ ID NO: 874289 - RNA, 24 nt, Human
ugucaggggcagccaggacuguuc

SEQ ID NO: 874290 - RNA, 22 nt, Human
ugucgcaccgccgggaccggca

SEQ ID NO: 874291 - RNA, 20 nt, Human
uguugugugaguucaggagg

SEQ ID NO: 874292 - RNA, 22 nt, Human
uugcguuguucuccuccucccg

SEQ ID NO: 874293 - RNA, 28 nt, Human
uuggacaagagauggucaucggacuucc

SEQ ID NO: 874294 - RNA, 23 nt, Human
uugugugaguucaggaggugagg

SEQ ID NO: 874295 - RNA, 21 nt, Human
uuugucccuuauguguggcuc

SEQ ID NO: 874296 - RNA, 21 nt, Human
uuugugacugacuggugucuu

SEQ ID NO: 874297 - RNA, 20 nt, Human
aaaaggcuguaucugccuuc

SEQ ID NO: 874298 - RNA, 25 nt, Human
aaacaggugagcucugucccaggac

SEQ ID NO: 874299 - RNA, 26 nt, Human
aaaccugaaauaccacaguugccaaa

SEQ ID NO: 874300 - RNA, 20 nt, Human
aaagugcugggauuauaggc

SEQ ID NO: 874301 - RNA, 24 nt, Human
aaagugcugggauuauaggcguga

SEQ ID NO: 874302 - RNA, 19 nt, Human
aagugcugggauuauaggc

SEQ ID NO: 874303 - RNA, 19 nt, Human
aagugcugggauuauaggc

SEQ ID NO: 874304 - RNA, 26 nt, Human
aagugcugggauuauaggcgugagcc

SEQ ID NO: 874305 - RNA, 18 nt, Human
aauuuuuuguauucuuuu

SEQ ID NO: 874306 - RNA, 19 nt, Human
acacacaagcgguggucgc

SEQ ID NO: 874307 - RNA, 23 nt, Human
acaggugcccgccaccacgcccg

SEQ ID NO: 874308 - RNA, 18 nt, Human
acccuggaccugaagccu

SEQ ID NO: 874309 - RNA, 19 nt, Human
agagaugggguuucaccgu

SEQ ID NO: 874310 - RNA, 18 nt, Human
agccucccgaauagcugg

SEQ ID NO: 874311 - RNA, 20 nt, Human
aggcgugagccaccgcgccc

SEQ ID NO: 874312 - RNA, 25 nt, Human
aggcuggagugcaguggcgcgaucu

SEQ ID NO: 874313 - RNA, 20 nt, Human
aggugcccgccaccacgccc

SEQ ID NO: 874314 - RNA, 20 nt, Human
aguagagaugggguuucacc

SEQ ID NO: 874315 - RNA, 20 nt, Human
agugcaguggcgcgaucucg

SEQ ID NO: 874316 - RNA, 23 nt, Human
agugcaguggcgcgaucucggcu

SEQ ID NO: 874317 - RNA, 24 nt, Human
agugcaguggcgcgaucucggcuc

SEQ ID NO: 874318 - RNA, 19 nt, Human
augggguuucaccguguua

SEQ ID NO: 874319 - RNA, 22 nt, Human
auuaguuuucucucucccacuc

SEQ ID NO: 874320 - RNA, 18 nt, Human
caaaacacugaccacagc

SEQ ID NO: 874321 - RNA, 20 nt, Human
caaacaucccuguacuuuuc

SEQ ID NO: 874322 - RNA, 21 nt, Human
caagacgcccgcaccugaggg

SEQ ID NO: 874323 - RNA, 18 nt, Human
caccaaguuggcagugac

SEQ ID NO: 874324 - RNA, 18 nt, Human
caccguguuagccacgac

SEQ ID NO: 874325 - RNA, 24 nt, Human
caccguguuagccacgacggucuc

SEQ ID NO: 874326 - RNA, 22 nt, Human
cacgccauucuccugccucagc

SEQ ID NO: 874327 - RNA, 19 nt, Human
caggugcccgccaccacgc

SEQ ID NO: 874328 - RNA, 21 nt, Human
caggugcccgccaccacgccc

SEQ ID NO: 874329 - RNA, 21 nt, Human
cagugacaguggcacacagaa

SEQ ID NO: 874330 - RNA, 22 nt, Human
cccaggcuggagugcaguggcg

SEQ ID NO: 874331 - RNA, 24 nt, Human
cccgaauagcugggacuacaggug

SEQ ID NO: 874332 - RNA, 24 nt, Human
cccgcaccugagggcaugcgucca

SEQ ID NO: 874333 - RNA, 21 nt, Human
cccguggaaacuccugccccc

SEQ ID NO: 874334 - RNA, 23 nt, Human
ccuaaagugcugggauuauaggc

SEQ ID NO: 874335 - RNA, 25 nt, Human
ccuccgcagaaugaggaggagcgaa

SEQ ID NO: 874336 - RNA, 19 nt, Human
cgccucccggguucacgcc

SEQ ID NO: 874337 - RNA, 24 nt, Human
cgccucggccuccuaaagugcugg

SEQ ID NO: 874338 - RNA, 24 nt, Human
cggagucuggcucuguugcccagg

SEQ ID NO: 874339 - RNA, 24 nt, Human
cuaaagugcugggauuauaggcgu

SEQ ID NO: 874340 - RNA, 24 nt, Human
cucccgaauagcugggacuacagg

SEQ ID NO: 874341 - RNA, 21 nt, Human
cucccggguucacgccauucu

SEQ ID NO: 874342 - RNA, 24 nt, Human
cuccugauuucgugauccgcccgc

SEQ ID NO: 874343 - RNA, 23 nt, Human
cugccucagccucccgaauagcu

SEQ ID NO: 874344 - RNA, 24 nt, Human
cugcgaggccgacucgcaagacgc

SEQ ID NO: 874345 - RNA, 19 nt, Human
cuguugcccaggcuggagu

SEQ ID NO: 874346 - RNA, 24 nt, Human
cuuuuaguagagaugggguuucac

SEQ ID NO: 874347 - RNA, 22 nt, Human
gacucgcaagacgcccgcaccu

SEQ ID NO: 874348 - RNA, 24 nt, Human
gagaugggguuucaccguguuagc

SEQ ID NO: 874349 - RNA, 20 nt, Human
gagcucugucccaggacccg

SEQ ID NO: 874350 - RNA, 22 nt, Human
gauuaguuuucucucucccacu

SEQ ID NO: 874351 - RNA, 18 nt, Human
gauuauaggcgugagcca

SEQ ID NO: 874352 - RNA, 22 nt, Human
gauuauaggcgugagccaccgc

SEQ ID NO: 874353 - RNA, 22 nt, Human
gauuauaggcgugagccaccgc

SEQ ID NO: 874354 - RNA, 24 nt, Human
gauuucgugauccgcccgccucgg

SEQ ID NO: 874355 - RNA, 24 nt, Human
gcagaaugaggaggagcgaaguac

SEQ ID NO: 874356 - RNA, 19 nt, Human
gcccaggcuggagugcagu

SEQ ID NO: 874357 - RNA, 18 nt, Human
gcgaaguaccgaccucac

SEQ ID NO: 874358 - RNA, 25 nt, Human
gcucuguugcccaggcuggagugca

SEQ ID NO: 874359 - RNA, 19 nt, Human
gcuggagugcaguggcgcg

SEQ ID NO: 874360 - RNA, 23 nt, Human
ggagucuggcucuguugcccagg

SEQ ID NO: 874361 - RNA, 24 nt, Human
ggcucuguugcccaggcuggagug

SEQ ID NO: 874362 - RNA, 18 nt, Human
gggguuucaccguguuag

SEQ ID NO: 874363 - RNA, 23 nt, Human
gugauccgcccgccucggccucc

SEQ ID NO: 874364 - RNA, 24 nt, Human
uaaagugcugggauuauaggcgug

SEQ ID NO: 874365 - RNA, 18 nt, Human
uaaguguaauucaaaaca

SEQ ID NO: 874366 - RNA, 26 nt, Human
uaauuuuuuguauucuuuuaguagag

SEQ ID NO: 874367 - RNA, 23 nt, Human
uacaggugcccgccaccacgccc

SEQ ID NO: 874368 - RNA, 21 nt, Human
uaguagagaugggguuucacc

SEQ ID NO: 874369 - RNA, 24 nt, Human
uaguagagaugggguuucaccgug

SEQ ID NO: 874370 - RNA, 26 nt, Human
uaguagagaugggguuucaccguguu

SEQ ID NO: 874371 - RNA, 24 nt, Human
ucaccguguuagccacgacggucu

SEQ ID NO: 874372 - RNA, 24 nt, Human
ucacugaaagcuccgccucccggg

SEQ ID NO: 874373 - RNA, 20 nt, Human
ucagccucccgaauagcugg

SEQ ID NO: 874374 - RNA, 21 nt, Human
ucccaggacccguggaaacuc

SEQ ID NO: 874375 - RNA, 23 nt, Human
ucccgaauagcugggacuacagg

SEQ ID NO: 874376 - RNA, 21 nt, Human
ucccggguucacgccauucuc

SEQ ID NO: 874377 - RNA, 24 nt, Human
ucccggguucacgccauucuccug

SEQ ID NO: 874378 - RNA, 24 nt, Human
uccuaaagugcugggauuauaggc

SEQ ID NO: 874379 - RNA, 19 nt, Human
uccuucaaaacacugacca

SEQ ID NO: 874380 - RNA, 18 nt, Human
ucggccuccuaaagugcu

SEQ ID NO: 874381 - RNA, 18 nt, Human
ucgugauccgcccgccuc

SEQ ID NO: 874382 - RNA, 26 nt, Human
ucuccugccucagccucccgaauagc

SEQ ID NO: 874383 - RNA, 23 nt, Human
ucuggcucuguugcccaggcugg

SEQ ID NO: 874384 - RNA, 24 nt, Human
ucuggcucuguugcccaggcugga

SEQ ID NO: 874385 - RNA, 18 nt, Human
ucuguugcccaggcugga

SEQ ID NO: 874386 - RNA, 24 nt, Human
ucuguugcccaggcuggagugcag

SEQ ID NO: 874387 - RNA, 18 nt, Human
ugaaauaccacaguugcc

SEQ ID NO: 874388 - RNA, 22 nt, Human
ugagacggagucuggcucuguu

SEQ ID NO: 874389 - RNA, 20 nt, Human
ugagcucugucccaggaccc

SEQ ID NO: 874390 - RNA, 22 nt, Human
ugcaguggcgcgaucucggcuc

SEQ ID NO: 874391 - RNA, 24 nt, Human
ugccaaacaucccuguacuuuucc

SEQ ID NO: 874392 - RNA, 18 nt, Human
ugcccaggcuggagugca

SEQ ID NO: 874393 - RNA, 21 nt, Human
ugcccaggcuggagugcagug

SEQ ID NO: 874394 - RNA, 22 nt, Human
ugcccaggcuggagugcagugg

SEQ ID NO: 874395 - RNA, 27 nt, Human
ugccucagccucccgaauagcugggac

SEQ ID NO: 874396 - RNA, 22 nt, Human
ugcggcuuccacagagcugcga

SEQ ID NO: 874397 - RNA, 23 nt, Human
uggagugcaguggcgcgaucucg

SEQ ID NO: 874398 - RNA, 24 nt, Human
uggagugcaguggcgcgaucucgg

SEQ ID NO: 874399 - RNA, 21 nt, Human
ugggacuacaggugcccgcca

SEQ ID NO: 874400 - RNA, 22 nt, Human
ugggacuacaggugcccgccac

SEQ ID NO: 874401 - RNA, 24 nt, Human
ugggacuacaggugcccgccacca

SEQ ID NO: 874402 - RNA, 18 nt, Human
ugggauuauaggcgugag

SEQ ID NO: 874403 - RNA, 19 nt, Human
ugggauuauaggcgugagc

SEQ ID NO: 874404 - RNA, 21 nt, Human
ugggauuauaggcgugagcca

SEQ ID NO: 874405 - RNA, 22 nt, Human
ugggauuauaggcgugagccac

SEQ ID NO: 874406 - RNA, 23 nt, Human
ugggauuauaggcgugagccacc

SEQ ID NO: 874407 - RNA, 24 nt, Human
ugggauuauaggcgugagccaccg

SEQ ID NO: 874408 - RNA, 19 nt, Human
ugggguuucaccguguuag

SEQ ID NO: 874409 - RNA, 21 nt, Human
uuaaguaucugcuaaggugcc

SEQ ID NO: 874410 - RNA, 18 nt, Human
uuaguagagaugggguuu

SEQ ID NO: 874411 - RNA, 22 nt, Human
uuaguagagaugggguuucacc

SEQ ID NO: 874412 - RNA, 24 nt, Human
uuaguagagaugggguuucaccgu

SEQ ID NO: 874413 - RNA, 23 nt, Human
uucaaaacaaaacaggugagcuc

SEQ ID NO: 874414 - RNA, 20 nt, Human
uuccgugcugcuuuccccuc

SEQ ID NO: 874415 - RNA, 24 nt, Human
uugcccaggcuggagugcaguggc

SEQ ID NO: 874416 - RNA, 21 nt, Human
uuucaccguguuagccacgac

SEQ ID NO: 874417 - RNA, 18 nt, Human
uuuccgcugccagucaca

SEQ ID NO: 874418 - RNA, 23 nt, Human
uuuuuguauucuuuuaguagaga

SEQ ID NO: 874419 - RNA, 26 nt, Human
uuuuuuguauucuuuuaguagagaug

SEQ ID NO: 874420 - RNA, 23 nt, Human
uuuuuuuuugagacggagucugg

SEQ ID NO: 874421 - RNA, 25 nt, Human
uuuuuuuuuuugagacggagucugg

SEQ ID NO: 874422 - RNA, 22 nt, Human
uuuuuuuuuuuuuugagacgga

SEQ ID NO: 874423 - RNA, 18 nt, Human
uuuuuuuuuuuuuuuuug

SEQ ID NO: 874424 - RNA, 20 nt, Human
aaacaugcaugaaaaacaca

SEQ ID NO: 874425 - RNA, 22 nt, Human
aaggauacuuccaaagacagac

SEQ ID NO: 874426 - RNA, 19 nt, Human
aaggcccaaagagacccaa

SEQ ID NO: 874427 - RNA, 21 nt, Human
acaagauacaguagcacacaa

SEQ ID NO: 874428 - RNA, 24 nt, Human
acagagggacgguagaaucagaaa

SEQ ID NO: 874429 - RNA, 19 nt, Human
agaaauacagauggcacca

SEQ ID NO: 874430 - RNA, 19 nt, Human
agaagagacugaaaaggca

SEQ ID NO: 874431 - RNA, 19 nt, Human
agaaucaaauuuaucagca

SEQ ID NO: 874432 - RNA, 23 nt, Human
agacaaaugggaaaccgaccaga

SEQ ID NO: 874433 - RNA, 24 nt, Human
agacagagggacgguagaaucaga

SEQ ID NO: 874434 - RNA, 18 nt, Human
agacugaaaaggcagaug

SEQ ID NO: 874435 - RNA, 22 nt, Human
aggguggauaagaaguggggcc

SEQ ID NO: 874436 - RNA, 21 nt, Human
agguacaucaaauaaucacaa

SEQ ID NO: 874437 - RNA, 23 nt, Human
aguacauggaaacugaaaaggga

SEQ ID NO: 874438 - RNA, 20 nt, Human
agugaaaggauacuuccaaa

SEQ ID NO: 874439 - RNA, 22 nt, Human
auacuguagccccacaaaacca

SEQ ID NO: 874440 - RNA, 19 nt, Human
auacuuccaaagacagaca

SEQ ID NO: 874441 - RNA, 24 nt, Human
aucacaauacaccugggccuagca

SEQ ID NO: 874442 - RNA, 24 nt, Human
auggcaccaucuucccaaagucca

SEQ ID NO: 874443 - RNA, 23 nt, Human
caaaaccaacuucaugcuuaaau

SEQ ID NO: 874444 - RNA, 19 nt, Human
caaauaaucacaauacacc

SEQ ID NO: 874445 - RNA, 24 nt, Human
caagauacaguagcacacaaaaua

SEQ ID NO: 874446 - RNA, 24 nt, Human
cacaagauacaguagcacacaaag

SEQ ID NO: 874447 - RNA, 21 nt, Human
cacaugcaaccuguccaagau

SEQ ID NO: 874448 - RNA, 22 nt, Human
cacuccccucuccaaaggccca

SEQ ID NO: 874449 - RNA, 24 nt, Human
cacuccccucuccaaaggcccaaa

SEQ ID NO: 874450 - RNA, 23 nt, Human
cagaagagacugaaaaggcagau

SEQ ID NO: 874451 - RNA, 23 nt, Human
cagcacaggacugacagcagcuc

SEQ ID NO: 874452 - RNA, 22 nt, Human
cagcacuuccaugggagggagg

SEQ ID NO: 874453 - RNA, 22 nt, Human
caugaaaaacacaggucacugc

SEQ ID NO: 874454 - RNA, 23 nt, Human
cauggaaacugaaaagggaaaga

SEQ ID NO: 874455 - RNA, 21 nt, Human
ccaaagacagacagagggacg

SEQ ID NO: 874456 - RNA, 18 nt, Human
ccaagcaaaggcccugag

SEQ ID NO: 874457 - RNA, 21 nt, Human
ccacuggcccugccgcucccc

SEQ ID NO: 874458 - RNA, 22 nt, Human
ccauacuguagccccacaaaac

SEQ ID NO: 874459 - RNA, 19 nt, Human
cccaaagagacccaaugag

SEQ ID NO: 874460 - RNA, 21 nt, Human
cccacaaaaccaacuucaugc

SEQ ID NO: 874461 - RNA, 23 nt, Human
cccagagaaguuaagaaauaaga

SEQ ID NO: 874462 - RNA, 20 nt, Human
ccccacaaaaccaacuucau

SEQ ID NO: 874463 - RNA, 23 nt, Human
ccccacaaaaccaacuucaugcu

SEQ ID NO: 874464 - RNA, 20 nt, Human
ccccucuccaaaggcccaaa

SEQ ID NO: 874465 - RNA, 21 nt, Human
ccccugaccaagcaaaggccc

SEQ ID NO: 874466 - RNA, 20 nt, Human
ccccugaccaagcaaaggcu

SEQ ID NO: 874467 - RNA, 18 nt, Human
cccugaggacagcacagg

SEQ ID NO: 874468 - RNA, 19 nt, Human
cccugcacuccccucucca

SEQ ID NO: 874469 - RNA, 22 nt, Human
ccgcuugagaccagcauggucu

SEQ ID NO: 874470 - RNA, 24 nt, Human
ccuacaugccccuguugacuugga

SEQ ID NO: 874471 - RNA, 19 nt, Human
ccugcacuccccucuccaa

SEQ ID NO: 874472 - RNA, 18 nt, Human
ccuuccacaugcaaccug

SEQ ID NO: 874473 - RNA, 23 nt, Human
cuacccgcuauuuccagccauau

SEQ ID NO: 874474 - RNA, 21 nt, Human
cuccccgggagacauggccuc

SEQ ID NO: 874475 - RNA, 21 nt, Human
cugcugcucagacacacuuug

SEQ ID NO: 874476 - RNA, 21 nt, Human
cuggcggcaaugguggugcgg

SEQ ID NO: 874477 - RNA, 22 nt, Human
cuucaugcuuaaaucugcugcu

SEQ ID NO: 874478 - RNA, 21 nt, Human
gaaaacccacuggcccugccg

SEQ ID NO: 874479 - RNA, 23 nt, Human
gacugacagcagcuccagaaaga

SEQ ID NO: 874480 - RNA, 18 nt, Human
gagcuggagacagcacuu

SEQ ID NO: 874481 - RNA, 25 nt, Human
gcaacccucaguucaccaugaaaac

SEQ ID NO: 874482 - RNA, 19 nt, Human
gcacaaauuuuucuguaaa

SEQ ID NO: 874483 - RNA, 18 nt, Human
ggaaggguggauaagaag

SEQ ID NO: 874484 - RNA, 23 nt, Human
ggaggucaaauccaagacuaccc

SEQ ID NO: 874485 - RNA, 22 nt, Human
ggcccugccgcuccccauuucc

SEQ ID NO: 874486 - RNA, 21 nt, Human
gggauggcucuacccaugacc

SEQ ID NO: 874487 - RNA, 19 nt, Human
gugucauagagcuuccugu

SEQ ID NO: 874488 - RNA, 18 nt, Human
uacauggaaacugaaaag

SEQ ID NO: 874489 - RNA, 21 nt, Human
uagccccacaaaaccaacuuc

SEQ ID NO: 874490 - RNA, 19 nt, Human
ucaguucaccaugaaaacc

SEQ ID NO: 874491 - RNA, 23 nt, Human
uccacaugcaaccuguccaagau

SEQ ID NO: 874492 - RNA, 19 nt, Human
uccagaaagacugugauuc

SEQ ID NO: 874493 - RNA, 19 nt, Human
uccauacuguagccccaca

SEQ ID NO: 874494 - RNA, 19 nt, Human
ucccaaaguccauacugua

SEQ ID NO: 874495 - RNA, 23 nt, Human
uccccgggagacauggccuccca

SEQ ID NO: 874496 - RNA, 20 nt, Human
ugaaaaggcagauguuccca

SEQ ID NO: 874497 - RNA, 22 nt, Human
ugaaaaggcagauguucccaaa

SEQ ID NO: 874498 - RNA, 18 nt, Human
ugaaaaguugauucaguu

SEQ ID NO: 874499 - RNA, 18 nt, Human
ugaaacaaaaacaugcau

SEQ ID NO: 874500 - RNA, 24 nt, Human
ugaccaagcaaaggcccugaggac

SEQ ID NO: 874501 - RNA, 18 nt, Human
ugacuuggaugaagaguc

SEQ ID NO: 874502 - RNA, 28 nt, Human
ugagagaucccuguggaauuccagccca

SEQ ID NO: 874503 - RNA, 19 nt, Human
ugaugggcccugaggcucu

SEQ ID NO: 874504 - RNA, 18 nt, Human
ugcagaaaaucauucuca

SEQ ID NO: 874505 - RNA, 23 nt, Human
ugcccugcacuccccucuccaaa

SEQ ID NO: 874506 - RNA, 21 nt, Human
uggcaagcaacaaacauugcu

SEQ ID NO: 874507 - RNA, 21 nt, Human
uggccagacaaaugggaaacc

SEQ ID NO: 874508 - RNA, 20 nt, Human
uggcggcaaugguggugcgg

SEQ ID NO: 874509 - RNA, 23 nt, Human
ugggguguccacauaaacagaau

SEQ ID NO: 874510 - RNA, 22 nt, Human
uggucagggucugacuccugau

SEQ ID NO: 874511 - RNA, 18 nt, Human
ugucauagagcuuccugu

SEQ ID NO: 874512 - RNA, 20 nt, Human
ugucauagagcuuccuguuu

SEQ ID NO: 874513 - RNA, 21 nt, Human
uguggaauuccagcccaauga

SEQ ID NO: 874514 - RNA, 19 nt, Human
ugugucauagagcuuccug

SEQ ID NO: 874515 - RNA, 19 nt, Human
uguuuggggccagccugug

SEQ ID NO: 874516 - RNA, 18 nt, Human
uucacuauggaugaagaa

SEQ ID NO: 874517 - RNA, 23 nt, Human
uuccacaugcaaccuguccaaga

SEQ ID NO: 874518 - RNA, 25 nt, Human
uuccagcccaaugagguccugagcc

SEQ ID NO: 874519 - RNA, 21 nt, Human
uuccuggucagggucugacuc

SEQ ID NO: 874520 - RNA, 21 nt, Human
uugcuggcggcaaugguggug

SEQ ID NO: 874521 - RNA, 19 nt, Human
uugggaacccugcuguccc

SEQ ID NO: 874522 - RNA, 25 nt, Human
uuugcagaaaaucauucucaguccu

SEQ ID NO: 874523 - RNA, 21 nt, Human
uuuggggagaaagcaguuuuu

SEQ ID NO: 874524 - RNA, 30 nt, Human
uuuuuuuuuuucuuuaguuuugcuuuuaaa

SEQ ID NO: 874525 - RNA, 23 nt, Human
uuuuuuuuuuuuucuuuaguuuu

SEQ ID NO: 874526 - RNA, 18 nt, Human
aaaacaaacgcacaagcc

SEQ ID NO: 874527 - RNA, 24 nt, Human
aagcagaaaaaaagcuacguuuua

SEQ ID NO: 874528 - RNA, 21 nt, Human
aaucgccgucgacaccgagcu

SEQ ID NO: 874529 - RNA, 21 nt, Human
acgcugacaaaacaaacgcac

SEQ ID NO: 874530 - RNA, 21 nt, Human
agaggcagcggcaagccccag

SEQ ID NO: 874531 - RNA, 20 nt, Human
agccagcgcugaggcagccc

SEQ ID NO: 874532 - RNA, 18 nt, Human
aggaaaaaaaagaggcac

SEQ ID NO: 874533 - RNA, 24 nt, Human
aggagcagcagggaagcgcgcggc

SEQ ID NO: 874534 - RNA, 21 nt, Human
aggcagcggcaagccccaggg

SEQ ID NO: 874535 - RNA, 19 nt, Human
caaaacaaacgcacaagcc

SEQ ID NO: 874536 - RNA, 19 nt, Human
caaaacaaacgcacaagcc

SEQ ID NO: 874537 - RNA, 23 nt, Human
caccgcgacgcggagaacagcag

SEQ ID NO: 874538 - RNA, 19 nt, Human
cacuccuccagccccacac

SEQ ID NO: 874539 - RNA, 22 nt, Human
cagccccacaccccugcgccca

SEQ ID NO: 874540 - RNA, 19 nt, Human
cagcugugacaccuaagca

SEQ ID NO: 874541 - RNA, 19 nt, Human
cagcugugacaccuaagca

SEQ ID NO: 874542 - RNA, 20 nt, Human
ccacaccccugcgcccagaa

SEQ ID NO: 874543 - RNA, 22 nt, Human
ccacaccccugcgcccagaacc

SEQ ID NO: 874544 - RNA, 18 nt, Human
ccaccgcccuccgugccc

SEQ ID NO: 874545 - RNA, 21 nt, Human
ccacuccuccagccccacacc

SEQ ID NO: 874546 - RNA, 19 nt, Human
ccagccccacaccccugcg

SEQ ID NO: 874547 - RNA, 19 nt, Human
cccaauuuuguuguaucug

SEQ ID NO: 874548 - RNA, 22 nt, Human
ccccagggauccgcggccccaa

SEQ ID NO: 874549 - RNA, 19 nt, Human
cccccgccccagcuccucg

SEQ ID NO: 874550 - RNA, 20 nt, Human
cccccgccccagcuccucgc

SEQ ID NO: 874551 - RNA, 20 nt, Human
ccggccuucagccagcgcug

SEQ ID NO: 874552 - RNA, 20 nt, Human
ccuccgugccccgcgcgccu

SEQ ID NO: 874553 - RNA, 19 nt, Human
ccugcgcccagaaccgagg

SEQ ID NO: 874554 - RNA, 23 nt, Human
cgaaccccagaggcagcggcaag

SEQ ID NO: 874555 - RNA, 21 nt, Human
cgacgcggagaacagcaggag

SEQ ID NO: 874556 - RNA, 21 nt, Human
cgcacaagcccaccgaaucgc

SEQ ID NO: 874557 - RNA, 23 nt, Human
cgcccagaaccgaggcccgcguc

SEQ ID NO: 874558 - RNA, 20 nt, Human
cgccccagcuccucgcccag

SEQ ID NO: 874559 - RNA, 24 nt, Human
cgcggagaacagcaggagcagcag

SEQ ID NO: 874560 - RNA, 19 nt, Human
cuccagaguccaccaccgc

SEQ ID NO: 874561 - RNA, 23 nt, Human
cuccagccccacaccccugcgcc

SEQ ID NO: 874562 - RNA, 24 nt, Human
gaaaauaaauccaagcagaaaaaa

SEQ ID NO: 874563 - RNA, 18 nt, Human
gagcaccuggaaggagcc

SEQ ID NO: 874564 - RNA, 20 nt, Human
gagcaccuggaaggagcccc

SEQ ID NO: 874565 - RNA, 22 nt, Human
gagggucacccagcugugacac

SEQ ID NO: 874566 - RNA, 24 nt, Human
gcgaaccccagaggcagcggcaag

SEQ ID NO: 874567 - RNA, 20 nt, Human
gcuccaccuccagaguccac

SEQ ID NO: 874568 - RNA, 25 nt, Human
ggagaacagcaggagcagcagggaa

SEQ ID NO: 874569 - RNA, 21 nt, Human
ggagaacagcaggagcagccg

SEQ ID NO: 874570 - RNA, 18 nt, Human
ggcagcugcuggagcacc

SEQ ID NO: 874571 - RNA, 19 nt, Human
uaaaagaggacacguaaua

SEQ ID NO: 874572 - RNA, 21 nt, Human
uauaccaaguccacagagaag

SEQ ID NO: 874573 - RNA, 22 nt, Human
uccaccuccagaguccaccacc

SEQ ID NO: 874574 - RNA, 18 nt, Human
uccccgggcagcugcugg

SEQ ID NO: 874575 - RNA, 20 nt, Human
uccuccucaacgucucgccg

SEQ ID NO: 874576 - RNA, 20 nt, Human
ugacaaaacaaacgcacaaa

SEQ ID NO: 874577 - RNA, 21 nt, Human
ugacaaaacaaacgcacaagc

SEQ ID NO: 874578 - RNA, 24 nt, Human
ugacaaaacaaacgcacaagccca

SEQ ID NO: 874579 - RNA, 21 nt, Human
ugacaccuaagcacgcugaca

SEQ ID NO: 874580 - RNA, 25 nt, Human
uuaagggugcuucgggccggccuuc

SEQ ID NO: 874581 - RNA, 18 nt, Human
aagcuccagcucuccggc

SEQ ID NO: 874582 - RNA, 25 nt, Human
aaggugcuggagaggaggcugggug

SEQ ID NO: 874583 - RNA, 22 nt, Human
acccuucauauuaccaaggcua

SEQ ID NO: 874584 - RNA, 24 nt, Human
agaugaaccuuauugggggacccg

SEQ ID NO: 874585 - RNA, 18 nt, Human
agggcgcugugggcagga

SEQ ID NO: 874586 - RNA, 20 nt, Human
agguugccgucucccucgug

SEQ ID NO: 874587 - RNA, 18 nt, Human
caagugaaaucaucuucu

SEQ ID NO: 874588 - RNA, 22 nt, Human
cagcacagcaaggugcuggaga

SEQ ID NO: 874589 - RNA, 19 nt, Human
cagcagcagagggcagcac

SEQ ID NO: 874590 - RNA, 21 nt, Human
cagcagcagagggcagcacag

SEQ ID NO: 874591 - RNA, 19 nt, Human
cauucaccuuccggggcca

SEQ ID NO: 874592 - RNA, 20 nt, Human
ccccucuggcuggucuuggg

SEQ ID NO: 874593 - RNA, 19 nt, Human
ccggggccacuggcugggc

SEQ ID NO: 874594 - RNA, 25 nt, Human
ccuuugaccgggguggcuucaaagc

SEQ ID NO: 874595 - RNA, 21 nt, Human
cgcaggugucacccuugaugg

SEQ ID NO: 874596 - RNA, 23 nt, Human
cggaacccagguugccgucuccc

SEQ ID NO: 874597 - RNA, 21 nt, Human
cggggccacuggcugggcuga

SEQ ID NO: 874598 - RNA, 19 nt, Human
cgggguggcuucaaagcuc

SEQ ID NO: 874599 - RNA, 18 nt, Human
cugcucuuaagagguuag

SEQ ID NO: 874600 - RNA, 26 nt, Human
cuucauauuaccaaggcuacuggcug

SEQ ID NO: 874601 - RNA, 23 nt, Human
cuuccggaacccagguugccguc

SEQ ID NO: 874602 - RNA, 21 nt, Human
gcagcacagcaaggugcugga

SEQ ID NO: 874603 - RNA, 22 nt, Human
ggcugggugggcacaccaaggg

SEQ ID NO: 874604 - RNA, 19 nt, Human
gggacccgcagaggcuggc

SEQ ID NO: 874605 - RNA, 19 nt, Human
gggcugggugggagcaggu

SEQ ID NO: 874606 - RNA, 20 nt, Human
ggggccacuggcugggcuga

SEQ ID NO: 874607 - RNA, 20 nt, Human
gucagcuuggggccuaagug

SEQ ID NO: 874608 - RNA, 19 nt, Human
uaccaaggcuacuggcugu

SEQ ID NO: 874609 - RNA, 19 nt, Human
uaccagacaugagggacuu

SEQ ID NO: 874610 - RNA, 21 nt, Human
uaccagacaugagggacuuuu

SEQ ID NO: 874611 - RNA, 20 nt, Human
uagacacaaaggggucaaga

SEQ ID NO: 874612 - RNA, 18 nt, Human
ucagaagagacugcucuu

SEQ ID NO: 874613 - RNA, 19 nt, Human
ucccccuuaauggaguugc

SEQ ID NO: 874614 - RNA, 23 nt, Human
ucuccaacaggccacagcgguua

SEQ ID NO: 874615 - RNA, 24 nt, Human
ugaaguucacaggcugauagggcc

SEQ ID NO: 874616 - RNA, 19 nt, Human
uggcuggucuuggggcugu

SEQ ID NO: 874617 - RNA, 24 nt, Human
ugggcacaccaagggcuggguggg

SEQ ID NO: 874618 - RNA, 22 nt, Human
ugucagcagcagagggcagcac

SEQ ID NO: 874619 - RNA, 22 nt, Human
uuuuuuuuuuuuuuuuaccaga

SEQ ID NO: 874620 - RNA, 22 nt, Human
uuuuuuuuuuuuuuuuuaccag

SEQ ID NO: 874621 - RNA, 18 nt, Human
aaaaaacugacaagaaca

SEQ ID NO: 874622 - RNA, 25 nt, Human
aaaaagaacucuuuaaaauaaugaa

SEQ ID NO: 874623 - RNA, 24 nt, Human
aacaacacagguuugaacugcgca

SEQ ID NO: 874624 - RNA, 28 nt, Human
aacauuuuuuuuuucucuaggggggccc

SEQ ID NO: 874625 - RNA, 18 nt, Human
aagaaauaaaaagaacuc

SEQ ID NO: 874626 - RNA, 24 nt, Human
aagaagccauaguaucucagggua

SEQ ID NO: 874627 - RNA, 19 nt, Human
aagggaagacuagaacaaa

SEQ ID NO: 874628 - RNA, 21 nt, Human
aagugucuguccagaacaccc

SEQ ID NO: 874629 - RNA, 20 nt, Human
acaaaaaacugacaagaaca

SEQ ID NO: 874630 - RNA, 21 nt, Human
acagaaagaccaacuccucuu

SEQ ID NO: 874631 - RNA, 25 nt, Human
acccaauagguagaaaacauggccu

SEQ ID NO: 874632 - RNA, 18 nt, Human
acucggccucaaccuugg

SEQ ID NO: 874633 - RNA, 21 nt, Human
acugacaagaacaaguucuag

SEQ ID NO: 874634 - RNA, 23 nt, Human
agacuacucagcgugaagaugag

SEQ ID NO: 874635 - RNA, 21 nt, Human
agauaagacaaagaaccuguu

SEQ ID NO: 874636 - RNA, 19 nt, Human
agcucucauaaggugaugg

SEQ ID NO: 874637 - RNA, 21 nt, Human
aggaugauucacuucuaccua

SEQ ID NO: 874638 - RNA, 18 nt, Human
agguagaaaacauggccu

SEQ ID NO: 874639 - RNA, 21 nt, Human
agucaucugugaggcuaaaua

SEQ ID NO: 874640 - RNA, 18 nt, Human
agugcuuguggaaaaaga

SEQ ID NO: 874641 - RNA, 21 nt, Human
aucuuuuuuuuuuuuagcuaa

SEQ ID NO: 874642 - RNA, 19 nt, Human
augaaagaaauaaaaagaa

SEQ ID NO: 874643 - RNA, 19 nt, Human
auguucagggacuaaagca

SEQ ID NO: 874644 - RNA, 20 nt, Human
caaagaaaauguucagggac

SEQ ID NO: 874645 - RNA, 23 nt, Human
caauacaguugacccaaacaaca

SEQ ID NO: 874646 - RNA, 22 nt, Human
caauagaacagacugccuuuua

SEQ ID NO: 874647 - RNA, 22 nt, Human
caauagaacagacugccuuuua

SEQ ID NO: 874648 - RNA, 21 nt, Human
cacagguuugaacugcgcagg

SEQ ID NO: 874649 - RNA, 21 nt, Human
cagaaaaagcucagauucaua

SEQ ID NO: 874650 - RNA, 19 nt, Human
cagggaacaacuugucuuu

SEQ ID NO: 874651 - RNA, 22 nt, Human
cagggacuaaagcaguccauca

SEQ ID NO: 874652 - RNA, 21 nt, Human
caguagaucaagccaagacca

SEQ ID NO: 874653 - RNA, 22 nt, Human
cauacacagaaaauuucacgua

SEQ ID NO: 874654 - RNA, 21 nt, Human
cauccccgcuaugaacucuga

SEQ ID NO: 874655 - RNA, 20 nt, Human
ccauggucccuuccaacuua

SEQ ID NO: 874656 - RNA, 23 nt, Human
cccaauagguagaaaacauggcc

SEQ ID NO: 874657 - RNA, 21 nt, Human
ccccagauaagacaaagaacc

SEQ ID NO: 874658 - RNA, 22 nt, Human
ccugcugugugugucacgggga

SEQ ID NO: 874659 - RNA, 19 nt, Human
cucuuagaaaugaacuaug

SEQ ID NO: 874660 - RNA, 19 nt, Human
gguagaaaaacccaauagg

SEQ ID NO: 874661 - RNA, 18 nt, Human
gucuguccauguacaagu

SEQ ID NO: 874662 - RNA, 21 nt, Human
uaaccaaagaaaauguucagg

SEQ ID NO: 874663 - RNA, 21 nt, Human
uacaagauucuaaagucaucu

SEQ ID NO: 874664 - RNA, 22 nt, Human
uacauacaacacaaaaaaugug

SEQ ID NO: 874665 - RNA, 20 nt, Human
uauaugaaugaccauaugua

SEQ ID NO: 874666 - RNA, 21 nt, Human
uauguuuauauauaaugcuua

SEQ ID NO: 874667 - RNA, 20 nt, Human
uccaaacaaauacacuauga

SEQ ID NO: 874668 - RNA, 19 nt, Human
uccacauaaugcugcaaaa

SEQ ID NO: 874669 - RNA, 27 nt, Human
uccauagccagagaaugaccggggucc

SEQ ID NO: 874670 - RNA, 25 nt, Human
uccccagauaagacaaagaaccugu

SEQ ID NO: 874671 - RNA, 26 nt, Human
ucuagcuccaucacggacuuacugaa

SEQ ID NO: 874672 - RNA, 23 nt, Human
ucuagugcuuguggaaaaagaaa

SEQ ID NO: 874673 - RNA, 22 nt, Human
ucucugagggauuuauugguuc

SEQ ID NO: 874674 - RNA, 22 nt, Human
ucucuuagaaaugaacuaugua

SEQ ID NO: 874675 - RNA, 22 nt, Human
ucugccacugggacagaaagac

SEQ ID NO: 874676 - RNA, 24 nt, Human
ugaagaugaggaugaagaccuuua

SEQ ID NO: 874677 - RNA, 19 nt, Human
ugagaaaaacauuaaaaug

SEQ ID NO: 874678 - RNA, 22 nt, Human
ugagcaggcagguuuauucaga

SEQ ID NO: 874679 - RNA, 19 nt, Human
ugaggagucagguuauaug

SEQ ID NO: 874680 - RNA, 28 nt, Human
uuacugaaugacccuaggcaaaucaugu

SEQ ID NO: 874681 - RNA, 21 nt, Human
uuauucuugccuccaugaaag

SEQ ID NO: 874682 - RNA, 20 nt, Human
uuccaaacaaauacacuaug

SEQ ID NO: 874683 - RNA, 21 nt, Human
uucuaaagucaucugugaggc

SEQ ID NO: 874684 - RNA, 25 nt, Human
uucuauauauugcaugaugcccacc

SEQ ID NO: 874685 - RNA, 18 nt, Human
uugacccaaacaacacag

SEQ ID NO: 874686 - RNA, 21 nt, Human
uugaggagucagguuauaugc

SEQ ID NO: 874687 - RNA, 18 nt, Human
aaaagagcaacucaaaaa

SEQ ID NO: 874688 - RNA, 20 nt, Human
aaacaaacacacauuuaccc

SEQ ID NO: 874689 - RNA, 20 nt, Human
aaacaaacacacauuuaccc

SEQ ID NO: 874690 - RNA, 22 nt, Human
aaacacacauuuacccacagaa

SEQ ID NO: 874691 - RNA, 19 nt, Human
aaacacauggccugaacaa

SEQ ID NO: 874692 - RNA, 26 nt, Human
aaagagcaacucaaaaaaauaugcac

SEQ ID NO: 874693 - RNA, 21 nt, Human
aacacacauuuacccacagaa

SEQ ID NO: 874694 - RNA, 21 nt, Human
aaccgcuucucugcccuucca

SEQ ID NO: 874695 - RNA, 22 nt, Human
aaccgcuucucugcccuuccau

SEQ ID NO: 874696 - RNA, 22 nt, Human
aagcaaacacauggccugaaca

SEQ ID NO: 874697 - RNA, 22 nt, Human
acaaaggaagacaauaccaaau

SEQ ID NO: 874698 - RNA, 23 nt, Human
acccauaguaaaagagcaacuca

SEQ ID NO: 874699 - RNA, 26 nt, Human
acuucccaauuuuuuuuuuuuuuuuu

SEQ ID NO: 874700 - RNA, 20 nt, Human
agaagcaaacacauggccug

SEQ ID NO: 874701 - RNA, 24 nt, Human
agaagcaaacacauggccugaaca

SEQ ID NO: 874702 - RNA, 30 nt, Human
agagaaacaaacacacauuuacccacagag

SEQ ID NO: 874703 - RNA, 23 nt, Human
aguaaaagagcaacucaaaaaaa

SEQ ID NO: 874704 - RNA, 24 nt, Human
caaacacacauuuacccacagaau

SEQ ID NO: 874705 - RNA, 22 nt, Human
caacccauaguaaaagagcaac

SEQ ID NO: 874706 - RNA, 23 nt, Human
caacucaaaaaaauaugcacuga

SEQ ID NO: 874707 - RNA, 25 nt, Human
cacagaauugaagcucacuucccaa

SEQ ID NO: 874708 - RNA, 19 nt, Human
cacauggccugaacaaucc

SEQ ID NO: 874709 - RNA, 22 nt, Human
cagcuccagugagaaaugcaac

SEQ ID NO: 874710 - RNA, 19 nt, Human
ccaguggcaagacauucaa

SEQ ID NO: 874711 - RNA, 21 nt, Human
ccauacccagcagcaaccgaa

SEQ ID NO: 874712 - RNA, 24 nt, Human
ccauaguaaaagagcaacucaaaa

SEQ ID NO: 874713 - RNA, 19 nt, Human
cccacagaauugaagcuca

SEQ ID NO: 874714 - RNA, 21 nt, Human
cccacagaauugaagcucacu

SEQ ID NO: 874715 - RNA, 18 nt, Human
cccuuuggcacaacuugc

SEQ ID NO: 874716 - RNA, 24 nt, Human
cgcuccacaucucccaguccuuca

SEQ ID NO: 874717 - RNA, 24 nt, Human
cggaggucgcuccacaucucccag

SEQ ID NO: 874718 - RNA, 23 nt, Human
cuacaaaggaagacaauaccaaa

SEQ ID NO: 874719 - RNA, 19 nt, Human
gcuccacaucucccagucc

SEQ ID NO: 874720 - RNA, 23 nt, Human
uacagaacacuuuuacugcaacc

SEQ ID NO: 874721 - RNA, 22 nt, Human
uacugcaaccaguggcaagaca

SEQ ID NO: 874722 - RNA, 19 nt, Human
ucaaagagaaacaaacaca

SEQ ID NO: 874723 - RNA, 23 nt, Human
uccuggauaccacugugcagccc

SEQ ID NO: 874724 - RNA, 20 nt, Human
ugcuguggagcucugugguc

SEQ ID NO: 874725 - RNA, 21 nt, Human
uggcaagacauucaaagagaa

SEQ ID NO: 874726 - RNA, 22 nt, Human
ugggcuucugugggcuccaggg

SEQ ID NO: 874727 - RNA, 19 nt, Human
uuacugcaaccaguggcaa

SEQ ID NO: 874728 - RNA, 18 nt, Human
uucaaagagaaacaaaca

SEQ ID NO: 874729 - RNA, 24 nt, Human
uuuucguuuuuuuguuuuuuuuuu

SEQ ID NO: 874730 - RNA, 23 nt, Human
uuuuuuuuuuaaauuguucccag

SEQ ID NO: 874731 - RNA, 18 nt, Human
uuuuuuuuuuagcaaccc

SEQ ID NO: 874732 - RNA, 24 nt, Human
uuuuuuuuuuuuuuuuuuuuaaug

SEQ ID NO: 874733 - RNA, 18 nt, Human
aacagucacugaacacac

SEQ ID NO: 874734 - RNA, 21 nt, Human
aaccuccgagcuccacucuuc

SEQ ID NO: 874735 - RNA, 26 nt, Human
aacucaaucacucccgcauucuuaua

SEQ ID NO: 874736 - RNA, 19 nt, Human
aagaaaaccagccuugggg

SEQ ID NO: 874737 - RNA, 26 nt, Human
aagccacagaaagucauucacagaac

SEQ ID NO: 874738 - RNA, 19 nt, Human
aagcugcccacgcccucag

SEQ ID NO: 874739 - RNA, 25 nt, Human
aagcugucgaagguuaauguaaacu

SEQ ID NO: 874740 - RNA, 22 nt, Human
aauuuucucuuccucagaaagc

SEQ ID NO: 874741 - RNA, 25 nt, Human
acacacagccaugguaaccagacgc

SEQ ID NO: 874742 - RNA, 20 nt, Human
acacaucuccuugaacccac

SEQ ID NO: 874743 - RNA, 22 nt, Human
acagaacgcagcagcuccaccg

SEQ ID NO: 874744 - RNA, 20 nt, Human
acccuggggccagggagcac

SEQ ID NO: 874745 - RNA, 28 nt, Human
acgaccuccuacggcaccaucucuccug

SEQ ID NO: 874746 - RNA, 18 nt, Human
acuccacuccgcugguga

SEQ ID NO: 874747 - RNA, 18 nt, Human
acugaacacaccgaagac

SEQ ID NO: 874748 - RNA, 20 nt, Human
agaacgcagcagcuccaccg

SEQ ID NO: 874749 - RNA, 22 nt, Human
agacuugucuguggcucugucc

SEQ ID NO: 874750 - RNA, 21 nt, Human
agcaaacagucacugaacaca

SEQ ID NO: 874751 - RNA, 24 nt, Human
agcaaacagucacugaacacaccg

SEQ ID NO: 874752 - RNA, 22 nt, Human
agcaaagaugcuacaggaggaa

SEQ ID NO: 874753 - RNA, 19 nt, Human
agcccugggcugccagccc

SEQ ID NO: 874754 - RNA, 21 nt, Human
aggaacaggaggagagggccg

SEQ ID NO: 874755 - RNA, 23 nt, Human
aggaagaaaaccagccuuggggg

SEQ ID NO: 874756 - RNA, 21 nt, Human
aggagagggcugggagggguc

SEQ ID NO: 874757 - RNA, 20 nt, Human
aggaugcuguagcgcugaau

SEQ ID NO: 874758 - RNA, 18 nt, Human
agggacggaaguaggcgg

SEQ ID NO: 874759 - RNA, 18 nt, Human
agggggugugggaggcca

SEQ ID NO: 874760 - RNA, 24 nt, Human
agggggugugggaggccaggcagg

SEQ ID NO: 874761 - RNA, 24 nt, Human
agucucaugcucaccauuucuuuc

SEQ ID NO: 874762 - RNA, 24 nt, Human
auccagcaaacagucacugaacac

SEQ ID NO: 874763 - RNA, 26 nt, Human
augcagccccagggagaggggaacgc

SEQ ID NO: 874764 - RNA, 19 nt, Human
auucaggacagcuuccagg

SEQ ID NO: 874765 - RNA, 22 nt, Human
auugguggugagggcaccuggc

SEQ ID NO: 874766 - RNA, 20 nt, Human
caaagaugcuacaggaggaa

SEQ ID NO: 874767 - RNA, 19 nt, Human
caacucgaaguucaaacgg

SEQ ID NO: 874768 - RNA, 21 nt, Human
cacacacagccaugguaacca

SEQ ID NO: 874769 - RNA, 20 nt, Human
cacacagccaugguaaccag

SEQ ID NO: 874770 - RNA, 20 nt, Human
cacaguaaucguuccagucg

SEQ ID NO: 874771 - RNA, 22 nt, Human
caccuggccggugucuauuggc

SEQ ID NO: 874772 - RNA, 19 nt, Human
cacgaugaacagugacucg

SEQ ID NO: 874773 - RNA, 22 nt, Human
cagaacgcagcagcuccaccga

SEQ ID NO: 874774 - RNA, 24 nt, Human
cagaacgcagcagcuccaccgaca

SEQ ID NO: 874775 - RNA, 23 nt, Human
cagacuugucuguggcucugucc

SEQ ID NO: 874776 - RNA, 20 nt, Human
cagcaggaagggugcugccc

SEQ ID NO: 874777 - RNA, 26 nt, Human
cagcccagccucugugcgugccucuu

SEQ ID NO: 874778 - RNA, 20 nt, Human
cagcccugggcugccagccc

SEQ ID NO: 874779 - RNA, 20 nt, Human
caggagcaggugacacugcc

SEQ ID NO: 874780 - RNA, 21 nt, Human
cagggagagacucgaacucca

SEQ ID NO: 874781 - RNA, 25 nt, Human
cagggggugugggaggccaggcagg

SEQ ID NO: 874782 - RNA, 22 nt, Human
cagggugaggccgccagggagg

SEQ ID NO: 874783 - RNA, 18 nt, Human
caggguuccccauccuuc

SEQ ID NO: 874784 - RNA, 20 nt, Human
caggucccccacgugcuucc

SEQ ID NO: 874785 - RNA, 20 nt, Human
cauggacacacacagccaug

SEQ ID NO: 874786 - RNA, 24 nt, Human
ccacgcacugcauggcggccacgc

SEQ ID NO: 874787 - RNA, 18 nt, Human
ccacucggggccgaacga

SEQ ID NO: 874788 - RNA, 22 nt, Human
ccacucuucccaccaguuccac

SEQ ID NO: 874789 - RNA, 21 nt, Human
ccaggcugcaaagggaacugg

SEQ ID NO: 874790 - RNA, 20 nt, Human
ccagggucuucacguggcug

SEQ ID NO: 874791 - RNA, 22 nt, Human
cccaugggggucuccaggaaga

SEQ ID NO: 874792 - RNA, 18 nt, Human
cccucaggcugugcccag

SEQ ID NO: 874793 - RNA, 22 nt, Human
ccgaaaaggacuggacagggga

SEQ ID NO: 874794 - RNA, 25 nt, Human
ccggcagguuauccagcaaacaguc

SEQ ID NO: 874795 - RNA, 20 nt, Human
ccucaggcugugcccagucu

SEQ ID NO: 874796 - RNA, 20 nt, Human
ccucugcuucagccugugua

SEQ ID NO: 874797 - RNA, 19 nt, Human
ccugccaaguugcccaugg

SEQ ID NO: 874798 - RNA, 20 nt, Human
ccugcuuuguugcucucggg

SEQ ID NO: 874799 - RNA, 18 nt, Human
ccuguguaugguccaggg

SEQ ID NO: 874800 - RNA, 20 nt, Human
cgacuucuacaugcagcccc

SEQ ID NO: 874801 - RNA, 18 nt, Human
cgagggaggucccucugc

SEQ ID NO: 874802 - RNA, 22 nt, Human
cgcuuccaacucaaucacuccc

SEQ ID NO: 874803 - RNA, 18 nt, Human
cggaagagaaagcgccgc

SEQ ID NO: 874804 - RNA, 20 nt, Human
cgggacacagagaaggggga

SEQ ID NO: 874805 - RNA, 19 nt, Human
cgggcagcguuuccaggag

SEQ ID NO: 874806 - RNA, 21 nt, Human
cggggccgaacgaccugccga

SEQ ID NO: 874807 - RNA, 19 nt, Human
cucugugcgugccucugcu

SEQ ID NO: 874808 - RNA, 23 nt, Human
cugaaaucuuugggauccagcga

SEQ ID NO: 874809 - RNA, 18 nt, Human
cugcagaaagagggacgg

SEQ ID NO: 874810 - RNA, 22 nt, Human
cugcuccuggugcugacgguca

SEQ ID NO: 874811 - RNA, 22 nt, Human
cuugggggauuccaaggcccag

SEQ ID NO: 874812 - RNA, 21 nt, Human
gaccuccuacggcaccaucuc

SEQ ID NO: 874813 - RNA, 19 nt, Human
gacuucuacaugcagcccc

SEQ ID NO: 874814 - RNA, 20 nt, Human
gagcagcacagcacggcugg

SEQ ID NO: 874815 - RNA, 20 nt, Human
gaggagagggcugggagggg

SEQ ID NO: 874816 - RNA, 23 nt, Human
gagggcugggaggggucuggggg

SEQ ID NO: 874817 - RNA, 20 nt, Human
gauuccaaggcccagggagg

SEQ ID NO: 874818 - RNA, 20 nt, Human
gcaccaucucuccugccaag

SEQ ID NO: 874819 - RNA, 19 nt, Human
gcacugcauggcggccacg

SEQ ID NO: 874820 - RNA, 23 nt, Human
gccacucacacugauuccaucau

SEQ ID NO: 874821 - RNA, 22 nt, Human
gcccucaggcugugcccagucu

SEQ ID NO: 874822 - RNA, 22 nt, Human
gcccuccacccaggcuccgcga

SEQ ID NO: 874823 - RNA, 20 nt, Human
gcccuggaaccuccgagcuc

SEQ ID NO: 874824 - RNA, 20 nt, Human
gccuccagaguauuugaaau

SEQ ID NO: 874825 - RNA, 21 nt, Human
gccugcaggcacagguccccc

SEQ ID NO: 874826 - RNA, 21 nt, Human
gccugcuuuguugcucucggg

SEQ ID NO: 874827 - RNA, 21 nt, Human
gcucauugcaggggguguggg

SEQ ID NO: 874828 - RNA, 20 nt, Human
gcugggaggggucuggggga

SEQ ID NO: 874829 - RNA, 19 nt, Human
gcuuggugaagggcaccgg

SEQ ID NO: 874830 - RNA, 26 nt, Human
ggaacaggaggagagggcugggaggg

SEQ ID NO: 874831 - RNA, 19 nt, Human
ggaaccuccgagcuccacu

SEQ ID NO: 874832 - RNA, 22 nt, Human
ggaaggacaggugucugacaga

SEQ ID NO: 874833 - RNA, 23 nt, Human
ggacguauaguucucuaggcuuu

SEQ ID NO: 874834 - RNA, 23 nt, Human
ggagagggcugggaggggucugg

SEQ ID NO: 874835 - RNA, 25 nt, Human
ggagcacccagaaacaggcgaaguc

SEQ ID NO: 874836 - RNA, 19 nt, Human
ggaggagagggcugggagg

SEQ ID NO: 874837 - RNA, 21 nt, Human
ggaggagauggggcugcagug

SEQ ID NO: 874838 - RNA, 23 nt, Human
ggaguccugcagcaucccugccu

SEQ ID NO: 874839 - RNA, 20 nt, Human
ggcaucaaccauccacgacc

SEQ ID NO: 874840 - RNA, 25 nt, Human
ggcuggaugggcacccgcuuuggga

SEQ ID NO: 874841 - RNA, 26 nt, Human
gggaacaguguaggaaggggcguggc

SEQ ID NO: 874842 - RNA, 21 nt, Human
gggaggaggaggagauggggc

SEQ ID NO: 874843 - RNA, 21 nt, Human
gggccccaggucacagaaaug

SEQ ID NO: 874844 - RNA, 22 nt, Human
ggggaggaggaggagauggggc

SEQ ID NO: 874845 - RNA, 24 nt, Human
ggggcguggcaugggguggggcug

SEQ ID NO: 874846 - RNA, 21 nt, Human
gggggaggaggaggagaugga

SEQ ID NO: 874847 - RNA, 21 nt, Human
gggggaggaggaggagauggg

SEQ ID NO: 874848 - RNA, 26 nt, Human
gggggaggcaggccauuuauugaaga

SEQ ID NO: 874849 - RNA, 21 nt, Human
ggggugugggaggccaggcag

SEQ ID NO: 874850 - RNA, 23 nt, Human
ggggugugggaggccaggcaggg

SEQ ID NO: 874851 - RNA, 18 nt, Human
ggguggguucacagguuu

SEQ ID NO: 874852 - RNA, 18 nt, Human
ggugcugacucgggugaa

SEQ ID NO: 874853 - RNA, 19 nt, Human
gugcugaucugcagucuug

SEQ ID NO: 874854 - RNA, 22 nt, Human
uacggcaccaucucuccugcca

SEQ ID NO: 874855 - RNA, 21 nt, Human
uagaaggaaggacaggugucu

SEQ ID NO: 874856 - RNA, 21 nt, Human
uagcaggcccuccacccaggc

SEQ ID NO: 874857 - RNA, 19 nt, Human
uauauaccaucagcugaac

SEQ ID NO: 874858 - RNA, 21 nt, Human
ucaggcugugcccagucucau

SEQ ID NO: 874859 - RNA, 21 nt, Human
ucaguguggcccgggccucca

SEQ ID NO: 874860 - RNA, 19 nt, Human
uccaagccacagaaaguca

SEQ ID NO: 874861 - RNA, 21 nt, Human
uccaagccacagaaagucauu

SEQ ID NO: 874862 - RNA, 28 nt, Human
uccaaggcccagggagggugggaaggaa

SEQ ID NO: 874863 - RNA, 27 nt, Human
uccaaugguuccauuccaauauuuucc

SEQ ID NO: 874864 - RNA, 24 nt, Human
uccacuccgcuggugagcagcccc

SEQ ID NO: 874865 - RNA, 24 nt, Human
uccccagacuugucuguggcucug

SEQ ID NO: 874866 - RNA, 19 nt, Human
uccuuccagggcagcucca

SEQ ID NO: 874867 - RNA, 20 nt, Human
ucgccugcuuuguugcucuc

SEQ ID NO: 874868 - RNA, 23 nt, Human
ucgguggaguugaagacauccag

SEQ ID NO: 874869 - RNA, 22 nt, Human
ucuagcuuccagcucaagaagu

SEQ ID NO: 874870 - RNA, 23 nt, Human
ucuccaggaagaaaaccagccuu

SEQ ID NO: 874871 - RNA, 26 nt, Human
ucuccugccaaguugcccaugggggu

SEQ ID NO: 874872 - RNA, 23 nt, Human
ucugcugaaaucuuugggaucca

SEQ ID NO: 874873 - RNA, 20 nt, Human
ucuggaccgcagcccagccu

SEQ ID NO: 874874 - RNA, 21 nt, Human
ugaaggccuugcucauugcag

SEQ ID NO: 874875 - RNA, 18 nt, Human
ugaaugugcagaucuggg

SEQ ID NO: 874876 - RNA, 20 nt, Human
ugacacguucugacccagca

SEQ ID NO: 874877 - RNA, 21 nt, Human
ugacccagcaagcuuuucauu

SEQ ID NO: 874878 - RNA, 18 nt, Human
ugacgaugggaagcuugg

SEQ ID NO: 874879 - RNA, 27 nt, Human
ugacuuccacuguggagccacugguuu

SEQ ID NO: 874880 - RNA, 23 nt, Human
ugagauccugcaggagauucucc

SEQ ID NO: 874881 - RNA, 19 nt, Human
ugaugccauugguggugag

SEQ ID NO: 874882 - RNA, 20 nt, Human
ugauugugaacguggccacc

SEQ ID NO: 874883 - RNA, 21 nt, Human
ugauugugaacguggccaccu

SEQ ID NO: 874884 - RNA, 22 nt, Human
ugauugugaacguggccaccuu

SEQ ID NO: 874885 - RNA, 22 nt, Human
ugcagaucugggcagagaggug

SEQ ID NO: 874886 - RNA, 25 nt, Human
ugcccagucucaugcucaccauuuc

SEQ ID NO: 874887 - RNA, 24 nt, Human
ugcccuggaaccuccgagcuccac

SEQ ID NO: 874888 - RNA, 26 nt, Human
ugccggguacugguugcugggagggu

SEQ ID NO: 874889 - RNA, 20 nt, Human
ugcuacaggaggaacaggag

SEQ ID NO: 874890 - RNA, 23 nt, Human
ugcugggagggugcugacucggg

SEQ ID NO: 874891 - RNA, 22 nt, Human
ugcuucagccuguguauggucc

SEQ ID NO: 874892 - RNA, 19 nt, Human
uggaaccuccgagcuccac

SEQ ID NO: 874893 - RNA, 19 nt, Human
uggacacacacagccaugg

SEQ ID NO: 874894 - RNA, 23 nt, Human
uggcaucaaccauccacgaccuc

SEQ ID NO: 874895 - RNA, 18 nt, Human
uggccggaggcuagcagg

SEQ ID NO: 874896 - RNA, 21 nt, Human
uggccggaggcuagcaggaag

SEQ ID NO: 874897 - RNA, 24 nt, Human
uggcucuguccagacgcuuggacu

SEQ ID NO: 874898 - RNA, 18 nt, Human
ugggaagcugcccacgcc

SEQ ID NO: 874899 - RNA, 19 nt, Human
ugggaggccaggcaggguc

SEQ ID NO: 874900 - RNA, 21 nt, Human
ugggaggccaggcagggucac

SEQ ID NO: 874901 - RNA, 22 nt, Human
ugggagggugcugacucgggug

SEQ ID NO: 874902 - RNA, 24 nt, Human
ugggcagagaggugcugaucugcc

SEQ ID NO: 874903 - RNA, 22 nt, Human
ugggcuggaugggcacccgcuu

SEQ ID NO: 874904 - RNA, 20 nt, Human
ugggggaggaggaggagaug

SEQ ID NO: 874905 - RNA, 18 nt, Human
ugggguggggcugccaug

SEQ ID NO: 874906 - RNA, 21 nt, Human
uggugcugacggucagcucau

SEQ ID NO: 874907 - RNA, 22 nt, Human
ugguugacacguucugacccag

SEQ ID NO: 874908 - RNA, 19 nt, Human
ugguugcugggagggugcu

SEQ ID NO: 874909 - RNA, 23 nt, Human
uguugauugugaacguggccacc

SEQ ID NO: 874910 - RNA, 23 nt, Human
uucacagaacgcagcagcuccac

SEQ ID NO: 874911 - RNA, 22 nt, Human
uuccgcaugcggccuuggcacc

SEQ ID NO: 874912 - RNA, 20 nt, Human
uucuauggccaaagggaagu

SEQ ID NO: 874913 - RNA, 24 nt, Human
uucuauggccaaagggaagucgcu

SEQ ID NO: 874914 - RNA, 21 nt, Human
uugaagaacgcagacuugcga

SEQ ID NO: 874915 - RNA, 19 nt, Human
uugaugcacgcuuccaacu

SEQ ID NO: 874916 - RNA, 21 nt, Human
uugauguugauugugaacgug

SEQ ID NO: 874917 - RNA, 19 nt, Human
uugcccuccacucggggcc

SEQ ID NO: 874918 - RNA, 19 nt, Human
uugggccacaucuuucuuu

SEQ ID NO: 874919 - RNA, 21 nt, Human
uugguggugagggcaccuggc

SEQ ID NO: 874920 - RNA, 21 nt, Human
uuugcccuccacucggggccg

SEQ ID NO: 874921 - RNA, 19 nt, Human
uuugggauuuccucugcuu

SEQ ID NO: 874922 - RNA, 18 nt, Human
uuuugggggaggcaggcc

SEQ ID NO: 874923 - RNA, 18 nt, Human
uuuuuugggggaggcagg

SEQ ID NO: 874924 - RNA, 23 nt, Human
uuuuuuuuuuuuugggggaggca

SEQ ID NO: 874925 - RNA, 20 nt, Human
uuuuuuuuuuuuuuggggga

SEQ ID NO: 874926 - RNA, 20 nt, Human
uuuuuuuuuuuuuuuggggg

SEQ ID NO: 874927 - RNA, 22 nt, Human
uuuuuuuuuuuuuuuuuggggg

SEQ ID NO: 874928 - RNA, 25 nt, Human
uuuuuuuuuuuuuuuuuuuuugggg

SEQ ID NO: 874929 - RNA, 19 nt, Human
aaauucccaucuacuccuc

SEQ ID NO: 874930 - RNA, 20 nt, Human
aacacggugaaaccccgucu

SEQ ID NO: 874931 - RNA, 21 nt, Human
aacacggugaaaccccgucuc

SEQ ID NO: 874932 - RNA, 20 nt, Human
aagcaggugcaacccguuac

SEQ ID NO: 874933 - RNA, 20 nt, Human
aaggcaggcggaucacgagg

SEQ ID NO: 874934 - RNA, 20 nt, Human
accccgucucuacuggccca

SEQ ID NO: 874935 - RNA, 22 nt, Human
agaaauguuuauuaguaacgcc

SEQ ID NO: 874936 - RNA, 21 nt, Human
agcgucuauccauucgcgcgc

SEQ ID NO: 874937 - RNA, 18 nt, Human
aggcaggcggaucacgag

SEQ ID NO: 874938 - RNA, 24 nt, Human
aggcaggcggaucacgaggucagg

SEQ ID NO: 874939 - RNA, 25 nt, Human
aggcaggcggaucacgaggucagga

SEQ ID NO: 874940 - RNA, 23 nt, Human
aggccaaggcaggcggaucacga

SEQ ID NO: 874941 - RNA, 24 nt, Human
aggcggaucacgaggucaggagau

SEQ ID NO: 874942 - RNA, 20 nt, Human
aucacgaggucaggagaucc

SEQ ID NO: 874943 - RNA, 22 nt, Human
caaggcaggcggaucacgaggu

SEQ ID NO: 874944 - RNA, 24 nt, Human
caaggcaggcggaucacgagguca

SEQ ID NO: 874945 - RNA, 24 nt, Human
cagcacuuugggaggccaaggcag

SEQ ID NO: 874946 - RNA, 25 nt, Human
cagcacuuugggaggccaaggcagg

SEQ ID NO: 874947 - RNA, 20 nt, Human
caggcggaucacgaggucau

SEQ ID NO: 874948 - RNA, 20 nt, Human
ccaagcaggugcaacccguu

SEQ ID NO: 874949 - RNA, 27 nt, Human
ccagucaaaaaagauguccucagaccc

SEQ ID NO: 874950 - RNA, 24 nt, Human
ccauuugucacacauaguucaucc

SEQ ID NO: 874951 - RNA, 23 nt, Human
cccccucuccugucucuucaccg

SEQ ID NO: 874952 - RNA, 21 nt, Human
ccccgucucuacuggcccaaa

SEQ ID NO: 874953 - RNA, 22 nt, Human
ccccgucucuacuggcccaaaa

SEQ ID NO: 874954 - RNA, 22 nt, Human
cccgucucuacuggcccaaagu

SEQ ID NO: 874955 - RNA, 21 nt, Human
cccuguaaucccagcacuuug

SEQ ID NO: 874956 - RNA, 23 nt, Human
cccuguaaucccagcacuuuggg

SEQ ID NO: 874957 - RNA, 24 nt, Human
ccgccaagccugucccuuggcugu

SEQ ID NO: 874958 - RNA, 23 nt, Human
ccuggcuaacacggugaaacccc

SEQ ID NO: 874959 - RNA, 24 nt, Human
ccuggcuaacacggugaaaccccg

SEQ ID NO: 874960 - RNA, 20 nt, Human
ccuguaaucccagcacuuug

SEQ ID NO: 874961 - RNA, 24 nt, Human
cgagaccauccuggcuaacacggu

SEQ ID NO: 874962 - RNA, 18 nt, Human
cgcccaccgaucccccuc

SEQ ID NO: 874963 - RNA, 22 nt, Human
cgcgcgcgucacuaauuacaug

SEQ ID NO: 874964 - RNA, 22 nt, Human
cuacuggcccaaaguucucuuc

SEQ ID NO: 874965 - RNA, 21 nt, Human
cuccucagcuuguugaaccuc

SEQ ID NO: 874966 - RNA, 19 nt, Human
cugaagauggaggcgggac

SEQ ID NO: 874967 - RNA, 22 nt, Human
cugaugggauggaugguucuuu

SEQ ID NO: 874968 - RNA, 18 nt, Human
cuggcuaacacggugaaa

SEQ ID NO: 874969 - RNA, 20 nt, Human
gcccuguaaucccagcacuu

SEQ ID NO: 874970 - RNA, 24 nt, Human
gcuaacacggugaaaccccgucuc

SEQ ID NO: 874971 - RNA, 18 nt, Human
ggcuguggugucgcugga

SEQ ID NO: 874972 - RNA, 22 nt, Human
uaacacggugaaaccccgucuc

SEQ ID NO: 874973 - RNA, 24 nt, Human
uaacacggugaaaccccgucucua

SEQ ID NO: 874974 - RNA, 20 nt, Human
uacauggggcauuggcucuu

SEQ ID NO: 874975 - RNA, 25 nt, Human
ucaaaaaagauguccucagacccag

SEQ ID NO: 874976 - RNA, 18 nt, Human
ucacgaggucaggagauc

SEQ ID NO: 874977 - RNA, 24 nt, Human
ucacgaggucaggagaucgagacc

SEQ ID NO: 874978 - RNA, 19 nt, Human
uccgccaagccugucccuu

SEQ ID NO: 874979 - RNA, 20 nt, Human
ucuccugucucuucaccgcc

SEQ ID NO: 874980 - RNA, 21 nt, Human
ucuccugucucuucaccgccu

SEQ ID NO: 874981 - RNA, 22 nt, Human
ucuccugucucuucaccgccuu

SEQ ID NO: 874982 - RNA, 23 nt, Human
ucuccugucucuucaccgccuuu

SEQ ID NO: 874983 - RNA, 22 nt, Human
ugaaaccccgucucuacuggcc

SEQ ID NO: 874984 - RNA, 25 nt, Human
ugaaccucaacaguaagaaggcucc

SEQ ID NO: 874985 - RNA, 24 nt, Human
ugggaggccaaggcaggcggauca

SEQ ID NO: 874986 - RNA, 18 nt, Human
uucacuuugacauucagu

SEQ ID NO: 874987 - RNA, 22 nt, Human
uuuuuuuuuuuuuuuuucacag

SEQ ID NO: 874988 - RNA, 19 nt, Human
aaaaagugacaagaauuug

SEQ ID NO: 874989 - RNA, 21 nt, Human
aagaggagaugcucugcugcu

SEQ ID NO: 874990 - RNA, 26 nt, Human
aagcagcuccaaagaaaggggaacgc

SEQ ID NO: 874991 - RNA, 22 nt, Human
aaggcagcaccagcagagaagc

SEQ ID NO: 874992 - RNA, 21 nt, Human
agaccaaaugccucugggaga

SEQ ID NO: 874993 - RNA, 23 nt, Human
agcacagcucccgggggccgccu

SEQ ID NO: 874994 - RNA, 19 nt, Human
aggagaugcucugcugcug

SEQ ID NO: 874995 - RNA, 26 nt, Human
caaaugaucuaucaucccuacagagu

SEQ ID NO: 874996 - RNA, 20 nt, Human
cacacaauucucaugaucau

SEQ ID NO: 874997 - RNA, 21 nt, Human
cacccacggccgcaauagcuc

SEQ ID NO: 874998 - RNA, 24 nt, Human
cagcaccagcagagaagcuauaaa

SEQ ID NO: 874999 - RNA, 20 nt, Human
cagcucccgggggccgccuc

SEQ ID NO: 875000 - RNA, 23 nt, Human
cauuugccagauuauccuucagu

SEQ ID NO: 875001 - RNA, 18 nt, Human
ccacacacccuacagcca

SEQ ID NO: 875002 - RNA, 20 nt, Human
cccgcgaccacccacggccg

SEQ ID NO: 875003 - RNA, 22 nt, Human
cccgcgaccacccacggccgca

SEQ ID NO: 875004 - RNA, 21 nt, Human
ccuuaaccacacacccuacag

SEQ ID NO: 875005 - RNA, 21 nt, Human
gaucauuaauacucugacuug

SEQ ID NO: 875006 - RNA, 23 nt, Human
uagaaggcagcaccagcagagaa

SEQ ID NO: 875007 - RNA, 22 nt, Human
uagagcacagcucccgggggcc

SEQ ID NO: 875008 - RNA, 19 nt, Human
ucaaaacugagcuuuaggg

SEQ ID NO: 875009 - RNA, 21 nt, Human
ucccgggggccgccucgugcc

SEQ ID NO: 875010 - RNA, 22 nt, Human
ucguuuacugguucagcacaca

SEQ ID NO: 875011 - RNA, 21 nt, Human
ugacugguucaugcuccauga

SEQ ID NO: 875012 - RNA, 21 nt, Human
ugagcaaagauacagaccaaa

SEQ ID NO: 875013 - RNA, 18 nt, Human
ugccagauuauccuucag

SEQ ID NO: 875014 - RNA, 26 nt, Human
ugucucauuugccagauuauccuuca

SEQ ID NO: 875015 - RNA, 22 nt, Human
uuguaccuuaaccacacacccu

SEQ ID NO: 875016 - RNA, 18 nt, Human
aaagugcuggaauuacaa

SEQ ID NO: 875017 - RNA, 24 nt, Human
aaagugcuggaauuacaagcguga

SEQ ID NO: 875018 - RNA, 23 nt, Human
aaggcgcucugucccccuguuua

SEQ ID NO: 875019 - RNA, 26 nt, Human
aagugcuggaauuacaagcgugagcc

SEQ ID NO: 875020 - RNA, 18 nt, Human
aauuacaagcgugagcca

SEQ ID NO: 875021 - RNA, 21 nt, Human
acaacagccugaauccagaac

SEQ ID NO: 875022 - RNA, 23 nt, Human
acacaguccacugcccgaaggcc

SEQ ID NO: 875023 - RNA, 20 nt, Human
acagcgggcgucccuucgcc

SEQ ID NO: 875024 - RNA, 23 nt, Human
accucagccucccaaagugcugg

SEQ ID NO: 875025 - RNA, 24 nt, Human
acuauguuggucaggcuggucucg

SEQ ID NO: 875026 - RNA, 26 nt, Human
acuccugaccucgugauccacucacc

SEQ ID NO: 875027 - RNA, 27 nt, Human
acucuguugcccaggcuggagugcaau

SEQ ID NO: 875028 - RNA, 21 nt, Human
aggccaccauccagacgacgg

SEQ ID NO: 875029 - RNA, 20 nt, Human
aguagagacggggguuucac

SEQ ID NO: 875030 - RNA, 18 nt, Human
aguagcugggauuacagg

SEQ ID NO: 875031 - RNA, 21 nt, Human
agugcaauggcgugaucucag

SEQ ID NO: 875032 - RNA, 24 nt, Human
agugcaauggcgugaucucagcuc

SEQ ID NO: 875033 - RNA, 24 nt, Human
auuuuuguauuuuuaguagagacg

SEQ ID NO: 875034 - RNA, 24 nt, Human
caaagugcuggaauuacaagcgug

SEQ ID NO: 875035 - RNA, 22 nt, Human
caagcgauucuccugucucagc

SEQ ID NO: 875036 - RNA, 19 nt, Human
caaggagcccuuccucugu

SEQ ID NO: 875037 - RNA, 21 nt, Human
cacagcgggcgucccuucgcc

SEQ ID NO: 875038 - RNA, 24 nt, Human
caccaggcccggcuaauuuuugua

SEQ ID NO: 875039 - RNA, 22 nt, Human
cacccaccucagccucccaaag

SEQ ID NO: 875040 - RNA, 23 nt, Human
cacccaccucagccucccaaagu

SEQ ID NO: 875041 - RNA, 19 nt, Human
cacccagacgagggggaag

SEQ ID NO: 875042 - RNA, 21 nt, Human
caccuccagccacuggggcgc

SEQ ID NO: 875043 - RNA, 22 nt, Human
caccucggcauccacccaccuc

SEQ ID NO: 875044 - RNA, 21 nt, Human
cacuauguuggucaggcuggu

SEQ ID NO: 875045 - RNA, 24 nt, Human
cacuauguuggucaggcuggucuc

SEQ ID NO: 875046 - RNA, 22 nt, Human
cacucuguugcccaggcuggag

SEQ ID NO: 875047 - RNA, 23 nt, Human
cacugcccgaaggccaccaccca

SEQ ID NO: 875048 - RNA, 23 nt, Human
cacugcccgaaggccaccaucca

SEQ ID NO: 875049 - RNA, 19 nt, Human
cagcgggcgucccuucgcc

SEQ ID NO: 875050 - RNA, 24 nt, Human
cagcuccugcaaccucugccuccc

SEQ ID NO: 875051 - RNA, 24 nt, Human
cagguggaaggcgcucuguccccc

SEQ ID NO: 875052 - RNA, 24 nt, Human
ccaaagugcuggaauuacaagcgu

SEQ ID NO: 875053 - RNA, 26 nt, Human
ccacccaccucagccucccaaagugc

SEQ ID NO: 875054 - RNA, 22 nt, Human
ccaccgcgcccggccaggcaaa

SEQ ID NO: 875055 - RNA, 22 nt, Human
ccacucaccucggcauccaccc

SEQ ID NO: 875056 - RNA, 24 nt, Human
ccacugcccgaaggccaccaccca

SEQ ID NO: 875057 - RNA, 24 nt, Human
ccacugcccgaaggccaccaucca

SEQ ID NO: 875058 - RNA, 25 nt, Human
ccagcaucugccccacguuucuuca

SEQ ID NO: 875059 - RNA, 21 nt, Human
ccauuaccuaaugaaacugag

SEQ ID NO: 875060 - RNA, 22 nt, Human
cccacaacagccugaauccaga

SEQ ID NO: 875061 - RNA, 19 nt, Human
ccccgagcgcaagcucugc

SEQ ID NO: 875062 - RNA, 23 nt, Human
cccgaguagcugggauuacaggc

SEQ ID NO: 875063 - RNA, 24 nt, Human
cccgaguagcugggauuacaggcg

SEQ ID NO: 875064 - RNA, 25 nt, Human
cccgcccugcccagcaucugcccca

SEQ ID NO: 875065 - RNA, 23 nt, Human
cccggauucaagcgauucuccug

SEQ ID NO: 875066 - RNA, 22 nt, Human
ccgaguagcugggauuacaggc

SEQ ID NO: 875067 - RNA, 22 nt, Human
ccgcgcccggccaggcaaagca

SEQ ID NO: 875068 - RNA, 23 nt, Human
ccggaaaggccaacaguccagcg

SEQ ID NO: 875069 - RNA, 24 nt, Human
ccucccggauucaagcgauucucc

SEQ ID NO: 875070 - RNA, 22 nt, Human
ccugaccucgugauccacucac

SEQ ID NO: 875071 - RNA, 22 nt, Human
ccugcaaccucugccucccgga

SEQ ID NO: 875072 - RNA, 24 nt, Human
ccugucucagccucccgaguagcu

SEQ ID NO: 875073 - RNA, 20 nt, Human
cgcuccggaaaggccaacag

SEQ ID NO: 875074 - RNA, 25 nt, Human
cgggaucccgggcuucuuccccgag

SEQ ID NO: 875075 - RNA, 24 nt, Human
cggggguuucacuauguuggucag

SEQ ID NO: 875076 - RNA, 18 nt, Human
cguccaguggagaaugcc

SEQ ID NO: 875077 - RNA, 31 nt, Human
cgugagccaccgcgcccggccaggcaaagcu

SEQ ID NO: 875078 - RNA, 21 nt, Human
cucaccucggcauccacccac

SEQ ID NO: 875079 - RNA, 24 nt, Human
cucacucuguugcccaggcuggag

SEQ ID NO: 875080 - RNA, 24 nt, Human
cucagccucccgaguagcugggau

SEQ ID NO: 875081 - RNA, 18 nt, Human
cuccugaccucgugaucc

SEQ ID NO: 875082 - RNA, 23 nt, Human
cuccugcaaccucugccucccgg

SEQ ID NO: 875083 - RNA, 19 nt, Human
cugcaaccucugccucccg

SEQ ID NO: 875084 - RNA, 20 nt, Human
cugcaaccucugccucccgg

SEQ ID NO: 875085 - RNA, 23 nt, Human
cugcaaccucugccucccggauu

SEQ ID NO: 875086 - RNA, 24 nt, Human
cugcaaccucugccucccggauuc

SEQ ID NO: 875087 - RNA, 24 nt, Human
cuggagugcaauggcgugaucuca

SEQ ID NO: 875088 - RNA, 18 nt, Human
gaaaaaacaauccucucg

SEQ ID NO: 875089 - RNA, 19 nt, Human
gaaaaaacaauccucucga

SEQ ID NO: 875090 - RNA, 20 nt, Human
gacacaaaggagggggucac

SEQ ID NO: 875091 - RNA, 22 nt, Human
gaccucgugauccacucaccuc

SEQ ID NO: 875092 - RNA, 22 nt, Human
gaccucgugauccacucaccuc

SEQ ID NO: 875093 - RNA, 24 nt, Human
gaccucgugauccacucaccucgg

SEQ ID NO: 875094 - RNA, 24 nt, Human
gaccucgugauccacucaccucgg

SEQ ID NO: 875095 - RNA, 19 nt, Human
gacgacggggaagccuuga

SEQ ID NO: 875096 - RNA, 21 nt, Human
gagaaugccaccuccagccac

SEQ ID NO: 875097 - RNA, 26 nt, Human
gaguagcugggauuacaggcgcacgc

SEQ ID NO: 875098 - RNA, 18 nt, Human
gauuacaggcgcacgcca

SEQ ID NO: 875099 - RNA, 21 nt, Human
gauucuccugucucagccucc

SEQ ID NO: 875100 - RNA, 19 nt, Human
gcaucguccgcccucgugc

SEQ ID NO: 875101 - RNA, 21 nt, Human
gccaccacccagacgaggggg

SEQ ID NO: 875102 - RNA, 24 nt, Human
gcccaggcuggagugcaauggcgu

SEQ ID NO: 875103 - RNA, 22 nt, Human
gcccggcuaauuuuuguauuuu

SEQ ID NO: 875104 - RNA, 24 nt, Human
gcgauucuccugucucagccuccc

SEQ ID NO: 875105 - RNA, 22 nt, Human
gcggcggugaagacagacuggc

SEQ ID NO: 875106 - RNA, 19 nt, Human
gcucucauugcaucugggu

SEQ ID NO: 875107 - RNA, 19 nt, Human
gcuggagugcaauggcgug

SEQ ID NO: 875108 - RNA, 23 nt, Human
gcuggucucgaacuccugaccuc

SEQ ID NO: 875109 - RNA, 25 nt, Human
ggacacaguccacugcccgaaggcc

SEQ ID NO: 875110 - RNA, 24 nt, Human
ggagggagggaacccgacaaagag

SEQ ID NO: 875111 - RNA, 23 nt, Human
ggagucucacucuguugcccagg

SEQ ID NO: 875112 - RNA, 24 nt, Human
ggccaccauccagacgacggggaa

SEQ ID NO: 875113 - RNA, 22 nt, Human
ggcuggagugcaauggcgugau

SEQ ID NO: 875114 - RNA, 24 nt, Human
ggcuggucucgaacuccugaccuc

SEQ ID NO: 875115 - RNA, 24 nt, Human
ggggcgccugggggcagggcggag

SEQ ID NO: 875116 - RNA, 20 nt, Human
ggggguuucacuauguuggu

SEQ ID NO: 875117 - RNA, 24 nt, Human
ggggguuucacuauguuggucagg

SEQ ID NO: 875118 - RNA, 18 nt, Human
gggguuucacuauguugg

SEQ ID NO: 875119 - RNA, 19 nt, Human
ggucucgaacuccugaccu

SEQ ID NO: 875120 - RNA, 23 nt, Human
ggucugcgcggcggugaagacag

SEQ ID NO: 875121 - RNA, 18 nt, Human
guagcugggauuacaggc

SEQ ID NO: 875122 - RNA, 21 nt, Human
gugaagggcggccccaggucu

SEQ ID NO: 875123 - RNA, 24 nt, Human
gugaagggcggccccaggucugcg

SEQ ID NO: 875124 - RNA, 22 nt, Human
gugacacaaaggagggggucac

SEQ ID NO: 875125 - RNA, 30 nt, Human
gugagccaccgcgcccggccaggcaaagcu

SEQ ID NO: 875126 - RNA, 23 nt, Human
gugauccacucaccucggcaucc

SEQ ID NO: 875127 - RNA, 18 nt, Human
guggaaggcgcucugucc

SEQ ID NO: 875128 - RNA, 19 nt, Human
guggaaggcgcucuguccc

SEQ ID NO: 875129 - RNA, 24 nt, Human
uaauuuuuguauuuuuaguagaga

SEQ ID NO: 875130 - RNA, 23 nt, Human
uacaagcgugagccaccgcgccc

SEQ ID NO: 875131 - RNA, 25 nt, Human
uaguagagacggggguuucacuaug

SEQ ID NO: 875132 - RNA, 24 nt, Human
uauguuggucaggcuggucucgaa

SEQ ID NO: 875133 - RNA, 22 nt, Human
ucacuauguuggucaggcuggu

SEQ ID NO: 875134 - RNA, 24 nt, Human
ucacucuguugcccaggcuggagu

SEQ ID NO: 875135 - RNA, 18 nt, Human
ucagccucccaaagugcu

SEQ ID NO: 875136 - RNA, 20 nt, Human
ucagccucccgaguagcugg

SEQ ID NO: 875137 - RNA, 18 nt, Human
ucagcuccugcaaccucu

SEQ ID NO: 875138 - RNA, 21 nt, Human
ucaucaguuccuucugggugu

SEQ ID NO: 875139 - RNA, 21 nt, Human
uccacccaccucagccuccca

SEQ ID NO: 875140 - RNA, 19 nt, Human
uccacugcccgaaggccac

SEQ ID NO: 875141 - RNA, 18 nt, Human
ucccaaagugcuggaauu

SEQ ID NO: 875142 - RNA, 24 nt, Human
ucccgaguagcugggauuacaggc

SEQ ID NO: 875143 - RNA, 21 nt, Human
ucccggauucaagcgauucuc

SEQ ID NO: 875144 - RNA, 24 nt, Human
ucccggauucaagcgauucuccug

SEQ ID NO: 875145 - RNA, 22 nt, Human
uccugcaaccucugccucccgg

SEQ ID NO: 875146 - RNA, 23 nt, Human
uccugcaaccucugccucccgga

SEQ ID NO: 875147 - RNA, 23 nt, Human
ucucacucuguugcccaggcugg

SEQ ID NO: 875148 - RNA, 24 nt, Human
ucucacucuguugcccaggcugga

SEQ ID NO: 875149 - RNA, 26 nt, Human
ucucacucuguugcccaggcuggagu

SEQ ID NO: 875150 - RNA, 27 nt, Human
ucucacucuguugcccaggcuggagug

SEQ ID NO: 875151 - RNA, 18 nt, Human
ucucauugcaucuggguu

SEQ ID NO: 875152 - RNA, 24 nt, Human
ucuccugucucagccucccgagua

SEQ ID NO: 875153 - RNA, 19 nt, Human
ucucgaacuccugaccucg

SEQ ID NO: 875154 - RNA, 18 nt, Human
ucuguugcccaggcugga

SEQ ID NO: 875155 - RNA, 24 nt, Human
ucuguugcccaggcuggagugcaa

SEQ ID NO: 875156 - RNA, 22 nt, Human
ugagauggagucucacucuguu

SEQ ID NO: 875157 - RNA, 18 nt, Human
ugcccaggcuggagugca

SEQ ID NO: 875158 - RNA, 21 nt, Human
ugcccaggcuggagugcaaug

SEQ ID NO: 875159 - RNA, 21 nt, Human
ugcccaggcuggagugcaaug

SEQ ID NO: 875160 - RNA, 24 nt, Human
ugcccaggcuggagugcaauggcg

SEQ ID NO: 875161 - RNA, 24 nt, Human
ugcuggaauuacaagcgugagcca

SEQ ID NO: 875162 - RNA, 21 nt, Human
uggaauuacaagcgugagcca

SEQ ID NO: 875163 - RNA, 22 nt, Human
uggaauuacaagcgugagccac

SEQ ID NO: 875164 - RNA, 23 nt, Human
uggaauuacaagcgugagccacc

SEQ ID NO: 875165 - RNA, 24 nt, Human
uggaauuacaagcgugagccaccg

SEQ ID NO: 875166 - RNA, 24 nt, Human
uggaauuacaagcgugagccaccg

SEQ ID NO: 875167 - RNA, 24 nt, Human
uggagucucacucuguugcccagg

SEQ ID NO: 875168 - RNA, 19 nt, Human
uggagugcaauggcgugau

SEQ ID NO: 875169 - RNA, 24 nt, Human
uggagugcaauggcgugaucucag

SEQ ID NO: 875170 - RNA, 18 nt, Human
uggcaucguccgcccucg

SEQ ID NO: 875171 - RNA, 18 nt, Human
uggcgugaucucagcucc

SEQ ID NO: 875172 - RNA, 23 nt, Human
uggcgugaucucagcuccugcaa

SEQ ID NO: 875173 - RNA, 19 nt, Human
uggcugaggucaaggagcc

SEQ ID NO: 875174 - RNA, 22 nt, Human
ugggauuacaggcgcacgccac

SEQ ID NO: 875175 - RNA, 24 nt, Human
ugggauuacaggcgcacgccacca

SEQ ID NO: 875176 - RNA, 22 nt, Human
ugggggcagggcggagacacag

SEQ ID NO: 875177 - RNA, 24 nt, Human
uggguuucguggaaaaaacaaucc

SEQ ID NO: 875178 - RNA, 24 nt, Human
uggucaggcuggucucgaacuccu

SEQ ID NO: 875179 - RNA, 21 nt, Human
uguauuuuuaguagagacggg

SEQ ID NO: 875180 - RNA, 24 nt, Human
ugucucagccucccgaguagcugg

SEQ ID NO: 875181 - RNA, 23 nt, Human
uguggaagucccccggauugagg

SEQ ID NO: 875182 - RNA, 20 nt, Human
uguugcccaggcuggagugc

SEQ ID NO: 875183 - RNA, 22 nt, Human
uuaguagagacggggguuucac

SEQ ID NO: 875184 - RNA, 25 nt, Human
uuaguagagacggggguuucacuau

SEQ ID NO: 875185 - RNA, 23 nt, Human
uucaagcgauucuccugucucag

SEQ ID NO: 875186 - RNA, 22 nt, Human
uuccucugugaagggcggcccc

SEQ ID NO: 875187 - RNA, 18 nt, Human
uugcccaggcuggagugc

SEQ ID NO: 875188 - RNA, 24 nt, Human
uuguauuuuuaguagagacggggg

SEQ ID NO: 875189 - RNA, 25 nt, Human
uuuuuaguagagacggggguuucac

SEQ ID NO: 875190 - RNA, 20 nt, Human
uuuuuguauuuuuaguagag

SEQ ID NO: 875191 - RNA, 23 nt, Human
uuuuuuuuuuugagauggagucu

SEQ ID NO: 875192 - RNA, 25 nt, Human
uuuuuuuuuuugagauggagucuca

SEQ ID NO: 875193 - RNA, 18 nt, Human
uuuuuuuuuuuuuuuuug

SEQ ID NO: 875194 - RNA, 25 nt, Human
uuuuuuuuuuuuuuuuuuguuuuuu

SEQ ID NO: 875195 - RNA, 18 nt, Human
aaacacagucaccucccc

SEQ ID NO: 875196 - RNA, 20 nt, Human
aaacccagaugaaggcagcg

SEQ ID NO: 875197 - RNA, 21 nt, Human
aaagagacagagguagauuaa

SEQ ID NO: 875198 - RNA, 20 nt, Human
aagacccuggcccucagcgc

SEQ ID NO: 875199 - RNA, 18 nt, Human
aagagggcaucccccagc

SEQ ID NO: 875200 - RNA, 19 nt, Human
aagcaggaagggugagaga

SEQ ID NO: 875201 - RNA, 20 nt, Human
aagcaggaagggugagagag

SEQ ID NO: 875202 - RNA, 20 nt, Human
aagcccaaggcaggccccag

SEQ ID NO: 875203 - RNA, 18 nt, Human
aaggccucccaucaccgg

SEQ ID NO: 875204 - RNA, 19 nt, Human
aagugcuggauggggcaug

SEQ ID NO: 875205 - RNA, 21 nt, Human
aaguggcagcagugcuggugg

SEQ ID NO: 875206 - RNA, 18 nt, Human
acagcaccucagagaagc

SEQ ID NO: 875207 - RNA, 21 nt, Human
accauccccuaaacacaagag

SEQ ID NO: 875208 - RNA, 21 nt, Human
acccuaagaucaccugcccuc

SEQ ID NO: 875209 - RNA, 22 nt, Human
accuggaggagccacauacgca

SEQ ID NO: 875210 - RNA, 20 nt, Human
acuggcaggaggggcuuccc

SEQ ID NO: 875211 - RNA, 19 nt, Human
acuggcugcgugagagguc

SEQ ID NO: 875212 - RNA, 19 nt, Human
agaaguggcagcagugcug

SEQ ID NO: 875213 - RNA, 26 nt, Human
agacagagguagauuaaaagggaccc

SEQ ID NO: 875214 - RNA, 22 nt, Human
agagaagggaacagguuaacgc

SEQ ID NO: 875215 - RNA, 19 nt, Human
agagagggacggaaagagg

SEQ ID NO: 875216 - RNA, 18 nt, Human
agagggcuggccugggcc

SEQ ID NO: 875217 - RNA, 19 nt, Human
agagggcuggccugggcca

SEQ ID NO: 875218 - RNA, 20 nt, Human
agcacaagacccuggcccuc

SEQ ID NO: 875219 - RNA, 23 nt, Human
agcaggaggaagcugagagggcu

SEQ ID NO: 875220 - RNA, 19 nt, Human
agcagggaggaggggaagc

SEQ ID NO: 875221 - RNA, 19 nt, Human
agcagugcugguggccccg

SEQ ID NO: 875222 - RNA, 18 nt, Human
agccaggcaggcaggguc

SEQ ID NO: 875223 - RNA, 23 nt, Human
agccggggcugcucggcucuccc

SEQ ID NO: 875224 - RNA, 20 nt, Human
agccuggagggacccggugg

SEQ ID NO: 875225 - RNA, 22 nt, Human
aggaggaagcugagagggcugg

SEQ ID NO: 875226 - RNA, 18 nt, Human
aggaggggcuucccugcc

SEQ ID NO: 875227 - RNA, 19 nt, Human
aggcaagagugcuggcagc

SEQ ID NO: 875228 - RNA, 19 nt, Human
aggcaggaggggccucagg

SEQ ID NO: 875229 - RNA, 21 nt, Human
aggcagggucccccaaucccu

SEQ ID NO: 875230 - RNA, 21 nt, Human
aggcuguggcaggggccuggg

SEQ ID NO: 875231 - RNA, 24 nt, Human
agggagcucacgugugggcugugg

SEQ ID NO: 875232 - RNA, 23 nt, Human
agggcaggcaagagugcuggcag

SEQ ID NO: 875233 - RNA, 18 nt, Human
agggucuuugcuuggcac

SEQ ID NO: 875234 - RNA, 22 nt, Human
agugaugaugauuuuagccaaa

SEQ ID NO: 875235 - RNA, 23 nt, Human
augaaaagcaggaagggugagag

SEQ ID NO: 875236 - RNA, 24 nt, Human
caaguccaguaagggcaaggggag

SEQ ID NO: 875237 - RNA, 20 nt, Human
caagugcuggauggggcaug

SEQ ID NO: 875238 - RNA, 23 nt, Human
caccacaucuauuaugaggcaag

SEQ ID NO: 875239 - RNA, 25 nt, Human
cacccuaagaucaccugcccucugc

SEQ ID NO: 875240 - RNA, 21 nt, Human
caccucagagaagccacugag

SEQ ID NO: 875241 - RNA, 21 nt, Human
cacuucaaaaucucggcucaa

SEQ ID NO: 875242 - RNA, 20 nt, Human
cagcaaugcuguugcucggc

SEQ ID NO: 875243 - RNA, 18 nt, Human
cagcaccuggaggagcca

SEQ ID NO: 875244 - RNA, 21 nt, Human
cagcagagagggacugguggg

SEQ ID NO: 875245 - RNA, 21 nt, Human
cagcagugcugguggccccgg

SEQ ID NO: 875246 - RNA, 22 nt, Human
cagcgcagccacccgagccgcc

SEQ ID NO: 875247 - RNA, 22 nt, Human
cagcugagacagacgcaggcuc

SEQ ID NO: 875248 - RNA, 24 nt, Human
caggcaccacacccucaggccuca

SEQ ID NO: 875249 - RNA, 18 nt, Human
caggcucccuccucccuc

SEQ ID NO: 875250 - RNA, 20 nt, Human
cagggccaaguccaguaagg

SEQ ID NO: 875251 - RNA, 19 nt, Human
caguaggcucccacaggcc

SEQ ID NO: 875252 - RNA, 24 nt, Human
ccaaagcuuggacugaggggccug

SEQ ID NO: 875253 - RNA, 19 nt, Human
ccaagugcuggauggggca

SEQ ID NO: 875254 - RNA, 21 nt, Human
ccaagugcuggauggggcaug

SEQ ID NO: 875255 - RNA, 23 nt, Human
ccacacccucaggccucaaggcc

SEQ ID NO: 875256 - RNA, 20 nt, Human
ccacagcacaagacccuggc

SEQ ID NO: 875257 - RNA, 23 nt, Human
ccaggccugcagcccaacccaug

SEQ ID NO: 875258 - RNA, 18 nt, Human
cccaacccaugggccccu

SEQ ID NO: 875259 - RNA, 21 nt, Human
cccaagugcuggauggggcau

SEQ ID NO: 875260 - RNA, 18 nt, Human
cccacuggggagcagggc

SEQ ID NO: 875261 - RNA, 27 nt, Human
cccagccccacagcacaagacccuggc

SEQ ID NO: 875262 - RNA, 22 nt, Human
cccauaguccguagcccagagc

SEQ ID NO: 875263 - RNA, 21 nt, Human
cccaugcugagcucccuggga

SEQ ID NO: 875264 - RNA, 18 nt, Human
ccccacccuaggcccaac

SEQ ID NO: 875265 - RNA, 26 nt, Human
ccccacccuaggcccaacacuuucuc

SEQ ID NO: 875266 - RNA, 25 nt, Human
cccccagccccacagcacaagaccc

SEQ ID NO: 875267 - RNA, 24 nt, Human
ccccuccagccaaccucaacuccc

SEQ ID NO: 875268 - RNA, 22 nt, Human
ccccuucgcacugggaguccac

SEQ ID NO: 875269 - RNA, 27 nt, Human
cccugacccccuccagccaaccucaac

SEQ ID NO: 875270 - RNA, 18 nt, Human
cccugcccuccagggggc

SEQ ID NO: 875271 - RNA, 22 nt, Human
cccuggcccagcuucaggcccu

SEQ ID NO: 875272 - RNA, 23 nt, Human
ccgccgccgccgccgccgccgcc

SEQ ID NO: 875273 - RNA, 24 nt, Human
ccgccgccgccgccgccgccgccu

SEQ ID NO: 875274 - RNA, 26 nt, Human
ccgccgccucccagcgcagccacccg

SEQ ID NO: 875275 - RNA, 22 nt, Human
ccggggcugcucggcucucccu

SEQ ID NO: 875276 - RNA, 21 nt, Human
ccggugggcugcugagagggg

SEQ ID NO: 875277 - RNA, 26 nt, Human
ccuaacucacuggcugcgugagaggu

SEQ ID NO: 875278 - RNA, 25 nt, Human
ccucaaggccgggggugggaguggc

SEQ ID NO: 875279 - RNA, 19 nt, Human
ccucccagcgcagccaccc

SEQ ID NO: 875280 - RNA, 19 nt, Human
ccugagucccucaccacca

SEQ ID NO: 875281 - RNA, 24 nt, Human
ccugcagcgagcugcacuuucagc

SEQ ID NO: 875282 - RNA, 22 nt, Human
ccugcagucacccuuccaggca

SEQ ID NO: 875283 - RNA, 24 nt, Human
ccugcccucugcugccuggugccc

SEQ ID NO: 875284 - RNA, 21 nt, Human
ccuggaggggacacucagccu

SEQ ID NO: 875285 - RNA, 22 nt, Human
ccuggaucagaaagagagggac

SEQ ID NO: 875286 - RNA, 23 nt, Human
ccugucccuauuguggcccggga

SEQ ID NO: 875287 - RNA, 21 nt, Human
ccugucccugcccugucccua

SEQ ID NO: 875288 - RNA, 23 nt, Human
ccuuccaggcaccacacccucag

SEQ ID NO: 875289 - RNA, 23 nt, Human
ccuugcuguccagccaggcuggg

SEQ ID NO: 875290 - RNA, 20 nt, Human
cgcccauaguccguagccca

SEQ ID NO: 875291 - RNA, 21 nt, Human
cgccgccgccgccucccucca

SEQ ID NO: 875292 - RNA, 23 nt, Human
cgcuuggguacccagcuccgggc

SEQ ID NO: 875293 - RNA, 19 nt, Human
cggcucaaaagggcagcag

SEQ ID NO: 875294 - RNA, 21 nt, Human
cgggggccaggaggcucuggg

SEQ ID NO: 875295 - RNA, 19 nt, Human
cgugccagucaccacagga

SEQ ID NO: 875296 - RNA, 24 nt, Human
cucaguaccacggggaaggauaga

SEQ ID NO: 875297 - RNA, 20 nt, Human
cuccugagucccucaccacc

SEQ ID NO: 875298 - RNA, 21 nt, Human
cucguacugggagcacuccuc

SEQ ID NO: 875299 - RNA, 23 nt, Human
cugcccucugcugccuggugccc

SEQ ID NO: 875300 - RNA, 22 nt, Human
cugcucggcucucccucccggg

SEQ ID NO: 875301 - RNA, 21 nt, Human
cuggugcccaagucucugccc

SEQ ID NO: 875302 - RNA, 22 nt, Human
cugguggccccggcugaggcug

SEQ ID NO: 875303 - RNA, 21 nt, Human
cuuuaccucagaagccuuagc

SEQ ID NO: 875304 - RNA, 25 nt, Human
gaaaugaaucaucugaaaaaugaaa

SEQ ID NO: 875305 - RNA, 21 nt, Human
gaacacaggccacgcaggccc

SEQ ID NO: 875306 - RNA, 21 nt, Human
gaagcugaagugguguccccg

SEQ ID NO: 875307 - RNA, 22 nt, Human
gaaguggcagcagugcuggugg

SEQ ID NO: 875308 - RNA, 19 nt, Human
gacaggagggcaggcaaga

SEQ ID NO: 875309 - RNA, 23 nt, Human
gacuguggggagcagcgccccag

SEQ ID NO: 875310 - RNA, 22 nt, Human
gagacgggagagaaagagccag

SEQ ID NO: 875311 - RNA, 18 nt, Human
gagcgugcaggcagcccc

SEQ ID NO: 875312 - RNA, 22 nt, Human
gaggagccacauacgcagggcc

SEQ ID NO: 875313 - RNA, 19 nt, Human
gagggugggaaggagacaa

SEQ ID NO: 875314 - RNA, 21 nt, Human
gcagcagugcugguggccccg

SEQ ID NO: 875315 - RNA, 22 nt, Human
gccaggccugcagcccaaccca

SEQ ID NO: 875316 - RNA, 25 nt, Human
gccgccgccgccgccgccgccgccu

SEQ ID NO: 875317 - RNA, 23 nt, Human
gccgccgccgccgccgccgccgg

SEQ ID NO: 875318 - RNA, 24 nt, Human
gccucaaggccgggggugggagug

SEQ ID NO: 875319 - RNA, 18 nt, Human
gcucccacaggcccacug

SEQ ID NO: 875320 - RNA, 18 nt, Human
gcucucccucccgggggg

SEQ ID NO: 875321 - RNA, 26 nt, Human
gcugacaugcaggaagaguccccagu

SEQ ID NO: 875322 - RNA, 25 nt, Human
ggaagcuggagguggguagggauug

SEQ ID NO: 875323 - RNA, 19 nt, Human
ggaagggucuuugcuuggc

SEQ ID NO: 875324 - RNA, 19 nt, Human
ggacccgggacugacgcag

SEQ ID NO: 875325 - RNA, 22 nt, Human
ggagagcagggaggaggggaaa

SEQ ID NO: 875326 - RNA, 19 nt, Human
ggagcgugcaggcagcccc

SEQ ID NO: 875327 - RNA, 18 nt, Human
ggagcuccaaggugggcc

SEQ ID NO: 875328 - RNA, 18 nt, Human
ggaggcucucccaggcac

SEQ ID NO: 875329 - RNA, 20 nt, Human
ggcaggaggggcuucccugc

SEQ ID NO: 875330 - RNA, 22 nt, Human
ggcucccuccucccucuugcuc

SEQ ID NO: 875331 - RNA, 18 nt, Human
gggaaacugaggcacaag

SEQ ID NO: 875332 - RNA, 18 nt, Human
gggaaggcccuggagugg

SEQ ID NO: 875333 - RNA, 19 nt, Human
gggaauggggaggaaagaa

SEQ ID NO: 875334 - RNA, 25 nt, Human
gggcaaggggagggggcauucuggu

SEQ ID NO: 875335 - RNA, 21 nt, Human
gggcagggaguggccauggac

SEQ ID NO: 875336 - RNA, 23 nt, Human
gggcauggggagaaaggggcgug

SEQ ID NO: 875337 - RNA, 20 nt, Human
gggcccuggcccagcuucag

SEQ ID NO: 875338 - RNA, 20 nt, Human
gggccggggccggggcugga

SEQ ID NO: 875339 - RNA, 25 nt, Human
gggccggggccggggcuggaggcgu

SEQ ID NO: 875340 - RNA, 21 nt, Human
ggggagcgugcaggcagcccc

SEQ ID NO: 875341 - RNA, 24 nt, Human
ggggagggugggaaggagacaaag

SEQ ID NO: 875342 - RNA, 22 nt, Human
gggggccaggaggcucugggag

SEQ ID NO: 875343 - RNA, 18 nt, Human
ggggggccggggccgggg

SEQ ID NO: 875344 - RNA, 20 nt, Human
ggggggccggggccggggcu

SEQ ID NO: 875345 - RNA, 22 nt, Human
gggugaggagggagcucacgug

SEQ ID NO: 875346 - RNA, 21 nt, Human
ggucuuugcuuggcaucaggc

SEQ ID NO: 875347 - RNA, 24 nt, Human
ggugaagguuuuccaaagcuugga

SEQ ID NO: 875348 - RNA, 19 nt, Human
ggugagagagaacucugag

SEQ ID NO: 875349 - RNA, 18 nt, Human
ggugggaguggcgcugag

SEQ ID NO: 875350 - RNA, 21 nt, Human
uaaagagacagagguagauua

SEQ ID NO: 875351 - RNA, 18 nt, Human
uaagaacacaggccacgc

SEQ ID NO: 875352 - RNA, 20 nt, Human
uaccucagaagccuuagcug

SEQ ID NO: 875353 - RNA, 19 nt, Human
uacugcuggcaagaggugg

SEQ ID NO: 875354 - RNA, 18 nt, Human
ucaagccaggcaggcagg

SEQ ID NO: 875355 - RNA, 22 nt, Human
ucacccuuccaggcaccacacc

SEQ ID NO: 875356 - RNA, 24 nt, Human
ucagcuuauuuggacuguggggag

SEQ ID NO: 875357 - RNA, 21 nt, Human
ucagugugugacacccaguga

SEQ ID NO: 875358 - RNA, 22 nt, Human
ucaguugguggccgcuggggaa

SEQ ID NO: 875359 - RNA, 23 nt, Human
ucaucugaaaaaugaaaagcagg

SEQ ID NO: 875360 - RNA, 24 nt, Human
ucauggauggagcucuucuccucg

SEQ ID NO: 875361 - RNA, 21 nt, Human
ucaugggcugugcgucguggc

SEQ ID NO: 875362 - RNA, 23 nt, Human
uccaauauccagggcccagcaau

SEQ ID NO: 875363 - RNA, 25 nt, Human
ucccuacaauucuccugagucccuc

SEQ ID NO: 875364 - RNA, 19 nt, Human
ucccucaccaccauggagg

SEQ ID NO: 875365 - RNA, 18 nt, Human
ucccuccucccucuugcu

SEQ ID NO: 875366 - RNA, 25 nt, Human
ucccugccugggggugaggagggag

SEQ ID NO: 875367 - RNA, 23 nt, Human
uccgcagguagcgcugcgccagg

SEQ ID NO: 875368 - RNA, 21 nt, Human
uccgcagguagcgcugcgccg

SEQ ID NO: 875369 - RNA, 21 nt, Human
uccuccgucaccuucgccuuu

SEQ ID NO: 875370 - RNA, 21 nt, Human
ucgugguaccucugcugaccc

SEQ ID NO: 875371 - RNA, 22 nt, Human
ucuaggcuucucagauuuaaaa

SEQ ID NO: 875372 - RNA, 25 nt, Human
ucuccagcuacaccaagcccaaggc

SEQ ID NO: 875373 - RNA, 22 nt, Human
ucucccaggcacggccccuccu

SEQ ID NO: 875374 - RNA, 19 nt, Human
ucucugagcccugaggcgg

SEQ ID NO: 875375 - RNA, 22 nt, Human
ucuguaacauggggcuaagaac

SEQ ID NO: 875376 - RNA, 24 nt, Human
ucuucuguaacauggggcuaagaa

SEQ ID NO: 875377 - RNA, 21 nt, Human
ugaaaagcaggaagggugaga

SEQ ID NO: 875378 - RNA, 27 nt, Human
ugaaaagcaggaagggugagagagaac

SEQ ID NO: 875379 - RNA, 23 nt, Human
ugaaggcagcgcagcagacagga

SEQ ID NO: 875380 - RNA, 23 nt, Human
ugaaucaucugaaaaaugaaaag

SEQ ID NO: 875381 - RNA, 19 nt, Human
ugacacccagugagggcug

SEQ ID NO: 875382 - RNA, 21 nt, Human
ugacccccuccagccaaccuc

SEQ ID NO: 875383 - RNA, 22 nt, Human
ugaccugggcugucccuguccc

SEQ ID NO: 875384 - RNA, 23 nt, Human
ugaccuuggaagggcccagucug

SEQ ID NO: 875385 - RNA, 18 nt, Human
ugacuugggcagcaggag

SEQ ID NO: 875386 - RNA, 23 nt, Human
ugacuugggcagcaggaggaagc

SEQ ID NO: 875387 - RNA, 18 nt, Human
ugagagggcuggccuggg

SEQ ID NO: 875388 - RNA, 21 nt, Human
ugagagggcuggccugggcca

SEQ ID NO: 875389 - RNA, 18 nt, Human
ugaggcggggaggguggg

SEQ ID NO: 875390 - RNA, 21 nt, Human
ugagggcugacccauccuccu

SEQ ID NO: 875391 - RNA, 21 nt, Human
ugagggugggucccugacccc

SEQ ID NO: 875392 - RNA, 21 nt, Human
ugaggugaagguuuuccaaag

SEQ ID NO: 875393 - RNA, 22 nt, Human
ugagucagggggcagagaaaug

SEQ ID NO: 875394 - RNA, 24 nt, Human
ugcagcccaacccaugggccccuu

SEQ ID NO: 875395 - RNA, 19 nt, Human
ugcagggaauggggaggaa

SEQ ID NO: 875396 - RNA, 18 nt, Human
ugcucggccaagcccugc

SEQ ID NO: 875397 - RNA, 21 nt, Human
ugcucggccaagcccugcccu

SEQ ID NO: 875398 - RNA, 23 nt, Human
ugcugguggccccggcugaggcu

SEQ ID NO: 875399 - RNA, 18 nt, Human
uggaagaaguggcagcag

SEQ ID NO: 875400 - RNA, 20 nt, Human
uggagguggguagggauugg

SEQ ID NO: 875401 - RNA, 18 nt, Human
uggcaagagguggcccca

SEQ ID NO: 875402 - RNA, 25 nt, Human
uggcaggaggggcuucccugccugg

SEQ ID NO: 875403 - RNA, 22 nt, Human
uggcaggggccugggagagcag

SEQ ID NO: 875404 - RNA, 20 nt, Human
uggcuggggcuggaagaagu

SEQ ID NO: 875405 - RNA, 18 nt, Human
uggggaaggcccuggagu

SEQ ID NO: 875406 - RNA, 22 nt, Human
uggggaagggucuuugcuuggc

SEQ ID NO: 875407 - RNA, 19 nt, Human
ugggucccugacccccucc

SEQ ID NO: 875408 - RNA, 21 nt, Human
ugggucccugacccccuccag

SEQ ID NO: 875409 - RNA, 20 nt, Human
ugguaccucugcugacccca

SEQ ID NO: 875410 - RNA, 19 nt, Human
uggugcccaagucucugcc

SEQ ID NO: 875411 - RNA, 20 nt, Human
ugucccugucccugcccugu

SEQ ID NO: 875412 - RNA, 18 nt, Human
uuccaauauccagggccc

SEQ ID NO: 875413 - RNA, 18 nt, Human
uuccucgggggccaggag

SEQ ID NO: 875414 - RNA, 21 nt, Human
uucgcacugggaguccacgug

SEQ ID NO: 875415 - RNA, 24 nt, Human
uucucucagugugugacacccagu

SEQ ID NO: 875416 - RNA, 19 nt, Human
uugguggccgcuggggaag

SEQ ID NO: 875417 - RNA, 22 nt, Human
uuuuuagggggaggagagcggc

SEQ ID NO: 875418 - RNA, 21 nt, Human
aaaguucuccuuccacaaauc

SEQ ID NO: 875419 - RNA, 18 nt, Human
accccggccucggccacg

SEQ ID NO: 875420 - RNA, 19 nt, Human
aggcccgguagggccuuga

SEQ ID NO: 875421 - RNA, 20 nt, Human
caaccgcaagcaggcagcgg

SEQ ID NO: 875422 - RNA, 18 nt, Human
cggcagggucaccccggc

SEQ ID NO: 875423 - RNA, 21 nt, Human
cggugcggcgaagguuuaguu

SEQ ID NO: 875424 - RNA, 27 nt, Human
cuccggcagggucaccccggccucggc

SEQ ID NO: 875425 - RNA, 19 nt, Human
cucuccccacugaccuggg

SEQ ID NO: 875426 - RNA, 18 nt, Human
gccacgcccacuauagag

SEQ ID NO: 875427 - RNA, 19 nt, Human
gccguacugcaaacucggu

SEQ ID NO: 875428 - RNA, 26 nt, Human
gcuuguuguggauaauagagggaggc

SEQ ID NO: 875429 - RNA, 21 nt, Human
ggaggcccgguagggccuuga

SEQ ID NO: 875430 - RNA, 24 nt, Human
ggcagcuaaucccaugaaaccagg

SEQ ID NO: 875431 - RNA, 19 nt, Human
gggaggcagcuaaucccau

SEQ ID NO: 875432 - RNA, 18 nt, Human
uaaucccaugaaaccagg

SEQ ID NO: 875433 - RNA, 19 nt, Human
uaaucucuccccacugacc

SEQ ID NO: 875434 - RNA, 23 nt, Human
ucacccgguucuagaagccgcgu

SEQ ID NO: 875435 - RNA, 22 nt, Human
uccucguaaaccccagucauau

SEQ ID NO: 875436 - RNA, 24 nt, Human
ucgcugagccgcagcgcgucgcgc

SEQ ID NO: 875437 - RNA, 27 nt, Human
uucuaugacuauauauccucguaaacc

SEQ ID NO: 875438 - RNA, 21 nt, Human
uugaaaguucuccuuccacaa

SEQ ID NO: 875439 - RNA, 19 nt, Human
aaaagcccaauuccaagag

SEQ ID NO: 875440 - RNA, 19 nt, Human
aaagagacugcacugaaug

SEQ ID NO: 875441 - RNA, 20 nt, Human
aacacacccaagacuaaaga

SEQ ID NO: 875442 - RNA, 23 nt, Human
aauacagaaaaagauaggucuga

SEQ ID NO: 875443 - RNA, 18 nt, Human
acacagcucccucuaagc

SEQ ID NO: 875444 - RNA, 20 nt, Human
agaaaaagauaggucugaga

SEQ ID NO: 875445 - RNA, 18 nt, Human
agaggaggugagaaggag

SEQ ID NO: 875446 - RNA, 19 nt, Human
agagucccccacauggacc

SEQ ID NO: 875447 - RNA, 23 nt, Human
agagucccccacauggaccuccc

SEQ ID NO: 875448 - RNA, 18 nt, Human
agcagaugaacacauuuc

SEQ ID NO: 875449 - RNA, 18 nt, Human
aggaauaauucuacaugg

SEQ ID NO: 875450 - RNA, 23 nt, Human
caaaagcccaauuccaagagucc

SEQ ID NO: 875451 - RNA, 21 nt, Human
caagacauaaaaccgaaccua

SEQ ID NO: 875452 - RNA, 24 nt, Human
caagacuaaagagucccuccucuc

SEQ ID NO: 875453 - RNA, 20 nt, Human
cacaaugauucuucgagaca

SEQ ID NO: 875454 - RNA, 19 nt, Human
cacagcucccucuaagccu

SEQ ID NO: 875455 - RNA, 18 nt, Human
caccaaaagcccaauucc

SEQ ID NO: 875456 - RNA, 21 nt, Human
caccaaaagcccaauuccaag

SEQ ID NO: 875457 - RNA, 18 nt, Human
caccccaugcaagaaaac

SEQ ID NO: 875458 - RNA, 22 nt, Human
ccuccucuccauauauauugcc

SEQ ID NO: 875459 - RNA, 19 nt, Human
cucaaggucaggagcucau

SEQ ID NO: 875460 - RNA, 23 nt, Human
cuuaacacacccaagacuaaaga

SEQ ID NO: 875461 - RNA, 20 nt, Human
gaaggagcaauuagggaugg

SEQ ID NO: 875462 - RNA, 22 nt, Human
guuaaguacuccucaaggucag

SEQ ID NO: 875463 - RNA, 23 nt, Human
uagcuucacaauccaggaauaau

SEQ ID NO: 875464 - RNA, 22 nt, Human
uauauugccauucugauucuuc

SEQ ID NO: 875465 - RNA, 21 nt, Human
ucagaggucaccaaaacacag

SEQ ID NO: 875466 - RNA, 18 nt, Human
uccucaaggucaggagcu

SEQ ID NO: 875467 - RNA, 19 nt, Human
uccucaaggucaggagcuc

SEQ ID NO: 875468 - RNA, 18 nt, Human
ucgcuggguucuuugaag

SEQ ID NO: 875469 - RNA, 21 nt, Human
ugacuguuggcuucauuguga

SEQ ID NO: 875470 - RNA, 25 nt, Human
ugagaaggagcaauuagggauggug

SEQ ID NO: 875471 - RNA, 18 nt, Human
ugagaggaggugagaagg

SEQ ID NO: 875472 - RNA, 21 nt, Human
ugagaggaggugagaaggagc

SEQ ID NO: 875473 - RNA, 19 nt, Human
ugauaaggcacaaggaaga

SEQ ID NO: 875474 - RNA, 22 nt, Human
uucaagacauaaaaccgaaccu

SEQ ID NO: 875475 - RNA, 29 nt, Human
uuuuuuuuuuuuuuuuuuuauacuuuuag

SEQ ID NO: 875476 - RNA, 20 nt, Human
aaaggagaugaugggaaggc

SEQ ID NO: 875477 - RNA, 22 nt, Human
aacauuuuauuuuacauuauau

SEQ ID NO: 875478 - RNA, 23 nt, Human
aacguuuaaagggggacagaggc

SEQ ID NO: 875479 - RNA, 22 nt, Human
aacugcaucuucagacagcacu

SEQ ID NO: 875480 - RNA, 24 nt, Human
aacugcaucuucagacagcacuga

SEQ ID NO: 875481 - RNA, 19 nt, Human
aagcugcagaguggagcgu

SEQ ID NO: 875482 - RNA, 25 nt, Human
aagcugcagaguggagcgugagagg

SEQ ID NO: 875483 - RNA, 23 nt, Human
acuccaggauuugguccuuggua

SEQ ID NO: 875484 - RNA, 23 nt, Human
agaaaagacccccacacagugaa

SEQ ID NO: 875485 - RNA, 18 nt, Human
agaaagagcugacauaag

SEQ ID NO: 875486 - RNA, 24 nt, Human
agagagagugaaauucagggucua

SEQ ID NO: 875487 - RNA, 18 nt, Human
agcaacugcaucuucaga

SEQ ID NO: 875488 - RNA, 22 nt, Human
agcuguacuuaaaucagaagga

SEQ ID NO: 875489 - RNA, 18 nt, Human
aggucaggggcagccuca

SEQ ID NO: 875490 - RNA, 23 nt, Human
aguccucuuuuuauuugaauucu

SEQ ID NO: 875491 - RNA, 18 nt, Human
agugaaaagcuggaagag

SEQ ID NO: 875492 - RNA, 18 nt, Human
agugaaugacugggcuac

SEQ ID NO: 875493 - RNA, 21 nt, Human
auaguuacccaggccuggaaa

SEQ ID NO: 875494 - RNA, 18 nt, Human
aucucccucuuuuccuaa

SEQ ID NO: 875495 - RNA, 19 nt, Human
cacaaccugacagcagagu

SEQ ID NO: 875496 - RNA, 21 nt, Human
caggucccccauuugacuuuc

SEQ ID NO: 875497 - RNA, 21 nt, Human
ccagcgcucgcugcagccggg

SEQ ID NO: 875498 - RNA, 23 nt, Human
cccaggccuggaaaucucccucu

SEQ ID NO: 875499 - RNA, 22 nt, Human
ccccuggcccaggaugagcccu

SEQ ID NO: 875500 - RNA, 20 nt, Human
ccgcagaagcuccggauagg

SEQ ID NO: 875501 - RNA, 22 nt, Human
ccucccgccacuaccucgugcc

SEQ ID NO: 875502 - RNA, 21 nt, Human
ccucuaaaguugggagaacuc

SEQ ID NO: 875503 - RNA, 22 nt, Human
ccuggaaaucucccucuuuucc

SEQ ID NO: 875504 - RNA, 25 nt, Human
ccuuuccauccucuaaaguugggag

SEQ ID NO: 875505 - RNA, 21 nt, Human
cucauuggcuguaauuugaca

SEQ ID NO: 875506 - RNA, 19 nt, Human
cucauuuuguucaguuucu

SEQ ID NO: 875507 - RNA, 18 nt, Human
cucccucuuuuccuaauu

SEQ ID NO: 875508 - RNA, 22 nt, Human
cucucuggccagaaggucaggg

SEQ ID NO: 875509 - RNA, 19 nt, Human
cugcaucaaauucccaaaa

SEQ ID NO: 875510 - RNA, 24 nt, Human
cuggaaaucucccucuuuuccuaa

SEQ ID NO: 875511 - RNA, 20 nt, Human
cuggcuggcagcaaugucuc

SEQ ID NO: 875512 - RNA, 22 nt, Human
cuguacuuaaaucagaaggauc

SEQ ID NO: 875513 - RNA, 18 nt, Human
cuuccuacuucacuggcc

SEQ ID NO: 875514 - RNA, 22 nt, Human
gagaaaagacccccacacagug

SEQ ID NO: 875515 - RNA, 21 nt, Human
gagcacagcggggaaggaccg

SEQ ID NO: 875516 - RNA, 19 nt, Human
gcaaacagcaacugcaucu

SEQ ID NO: 875517 - RNA, 19 nt, Human
gcaguccagcgugcuggcc

SEQ ID NO: 875518 - RNA, 22 nt, Human
gcuagauuacucugccccuuuc

SEQ ID NO: 875519 - RNA, 25 nt, Human
gcugcagccgggccgucucgcaguc

SEQ ID NO: 875520 - RNA, 19 nt, Human
ggaagagaaacaaaacuca

SEQ ID NO: 875521 - RNA, 18 nt, Human
ggagaacuccaggauuug

SEQ ID NO: 875522 - RNA, 20 nt, Human
gguccugaaaggagaugaug

SEQ ID NO: 875523 - RNA, 22 nt, Human
gguuccaacuguugagaccugu

SEQ ID NO: 875524 - RNA, 18 nt, Human
uaaaacaggguaaucuuu

SEQ ID NO: 875525 - RNA, 20 nt, Human
uaacaucauccgcuuuccuc

SEQ ID NO: 875526 - RNA, 19 nt, Human
uaacuccuagaacaaggac

SEQ ID NO: 875527 - RNA, 23 nt, Human
uaagcaggucaaccugaagcuac

SEQ ID NO: 875528 - RNA, 19 nt, Human
uaauagagcacaauggaca

SEQ ID NO: 875529 - RNA, 23 nt, Human
uaccaggcagcucuggaggcucc

SEQ ID NO: 875530 - RNA, 22 nt, Human
uacgcagaccccaccgcucagc

SEQ ID NO: 875531 - RNA, 26 nt, Human
uacucugccccuuuccauccucuaaa

SEQ ID NO: 875532 - RNA, 18 nt, Human
uacuuguuguuucuucuc

SEQ ID NO: 875533 - RNA, 19 nt, Human
uagaaagagcugacauaag

SEQ ID NO: 875534 - RNA, 27 nt, Human
uagcaaacaccuuuauauuuuugaaau

SEQ ID NO: 875535 - RNA, 18 nt, Human
ucacuggccucagucucc

SEQ ID NO: 875536 - RNA, 22 nt, Human
uccaaaagcacuaucaugaacu

SEQ ID NO: 875537 - RNA, 22 nt, Human
uccaugcugagcacagcgggga

SEQ ID NO: 875538 - RNA, 23 nt, Human
ucccuaagcagcucauccgguuc

SEQ ID NO: 875539 - RNA, 24 nt, Human
ucuucagacagcacugagcaagua

SEQ ID NO: 875540 - RNA, 21 nt, Human
ugaaaagcuggaagagaaaca

SEQ ID NO: 875541 - RNA, 19 nt, Human
ugaaaggagaugaugggaa

SEQ ID NO: 875542 - RNA, 20 nt, Human
ugaaaggcugguauacauuu

SEQ ID NO: 875543 - RNA, 23 nt, Human
ugagaggucagcugccaugugau

SEQ ID NO: 875544 - RNA, 19 nt, Human
ugauaagcaggucaaccug

SEQ ID NO: 875545 - RNA, 23 nt, Human
ugccuucuugauuuuccaaucuu

SEQ ID NO: 875546 - RNA, 24 nt, Human
ugcuggccagagaccgcagcuucc

SEQ ID NO: 875547 - RNA, 21 nt, Human
uggaagagaaacaaaacucac

SEQ ID NO: 875548 - RNA, 19 nt, Human
uggccagaaggucaggggc

SEQ ID NO: 875549 - RNA, 21 nt, Human
uggcccaggaugagcccucag

SEQ ID NO: 875550 - RNA, 21 nt, Human
ugguuccaacuguugagaccu

SEQ ID NO: 875551 - RNA, 20 nt, Human
uguuuuggugacaguuuucu

SEQ ID NO: 875552 - RNA, 23 nt, Human
uuagauaauacuuuccagcugua

SEQ ID NO: 875553 - RNA, 18 nt, Human
uucacagaaucaucacuc

SEQ ID NO: 875554 - RNA, 20 nt, Human
uucucagcaauauucacaga

SEQ ID NO: 875555 - RNA, 25 nt, Human
uugcuuuaucaagaagaauauuaac

SEQ ID NO: 875556 - RNA, 21 nt, Human
uuguucaguuucuguguugga

SEQ ID NO: 875557 - RNA, 21 nt, Human
uuuaugaaaucaaugccuucu

SEQ ID NO: 875558 - RNA, 18 nt, Human
uuucaucucauuuuguuc

SEQ ID NO: 875559 - RNA, 21 nt, Human
uuuccauccucuaaaguuggg

SEQ ID NO: 875560 - RNA, 21 nt, Human
uuucuuccuacuucacuggcc

SEQ ID NO: 875561 - RNA, 18 nt, Human
uuugcaaacagcaacugc

SEQ ID NO: 875562 - RNA, 23 nt, Human
uuuuuuuuuuuuuuuuuuuucag

SEQ ID NO: 875563 - RNA, 19 nt, Human
aaagugcuaggguuacagg

SEQ ID NO: 875564 - RNA, 20 nt, Human
aaagugcuaggguuacaggg

SEQ ID NO: 875565 - RNA, 19 nt, Human
aaagugcuggaauuacagg

SEQ ID NO: 875566 - RNA, 24 nt, Human
aaagugcuggaauuacagguguga

SEQ ID NO: 875567 - RNA, 25 nt, Human
aaaucaacaucuuauauuucuauac

SEQ ID NO: 875568 - RNA, 24 nt, Human
aagaagcugggauuacaggcacau

SEQ ID NO: 875569 - RNA, 29 nt, Human
aagcaagaaauaggagacggagggacccc

SEQ ID NO: 875570 - RNA, 18 nt, Human
aagugauccacucgccuc

SEQ ID NO: 875571 - RNA, 26 nt, Human
aagugcuaggguuacaggggugagcc

SEQ ID NO: 875572 - RNA, 26 nt, Human
aagugcuggaauuacaggugugagcc

SEQ ID NO: 875573 - RNA, 18 nt, Human
aauuacaggugugagcca

SEQ ID NO: 875574 - RNA, 18 nt, Human
aauuacaggugugagcca

SEQ ID NO: 875575 - RNA, 21 nt, Human
aauucuugugccucagcuucc

SEQ ID NO: 875576 - RNA, 22 nt, Human
acagaguuucgccguuggccag

SEQ ID NO: 875577 - RNA, 21 nt, Human
acagccaguaagcagaugagc

SEQ ID NO: 875578 - RNA, 21 nt, Human
acagguaaauccacuaaggua

SEQ ID NO: 875579 - RNA, 23 nt, Human
acucugucgcccagggugcuggg

SEQ ID NO: 875580 - RNA, 19 nt, Human
agagacagaguuucgccgu

SEQ ID NO: 875581 - RNA, 23 nt, Human
agauacaaaaaguucacacagcc

SEQ ID NO: 875582 - RNA, 18 nt, Human
agccaccaugcccagccc

SEQ ID NO: 875583 - RNA, 19 nt, Human
aggcggccugcuguggagc

SEQ ID NO: 875584 - RNA, 22 nt, Human
aguccauuacuggcuagaauaa

SEQ ID NO: 875585 - RNA, 21 nt, Human
agugcaauggcgcgaucccag

SEQ ID NO: 875586 - RNA, 23 nt, Human
agugcaguggcgugaucuuggcu

SEQ ID NO: 875587 - RNA, 24 nt, Human
agugcaguggcgugaucuuggcuc

SEQ ID NO: 875588 - RNA, 24 nt, Human
auacaaaaaguucacacagccagu

SEQ ID NO: 875589 - RNA, 24 nt, Human
augggguuuugccauguugcccag

SEQ ID NO: 875590 - RNA, 22 nt, Human
caaaaaguucacacagccagua

SEQ ID NO: 875591 - RNA, 24 nt, Human
caaagugcuggaauuacaggugug

SEQ ID NO: 875592 - RNA, 23 nt, Human
caaccuccaccuccuggguucag

SEQ ID NO: 875593 - RNA, 20 nt, Human
caaguagcuggacuacaggc

SEQ ID NO: 875594 - RNA, 24 nt, Human
caccaugcccagcuaauuuuugua

SEQ ID NO: 875595 - RNA, 20 nt, Human
cacuaaaaagacaagaauuc

SEQ ID NO: 875596 - RNA, 19 nt, Human
cacucugucgcccagggug

SEQ ID NO: 875597 - RNA, 21 nt, Human
cacugcaaccuccaccuccug

SEQ ID NO: 875598 - RNA, 23 nt, Human
cacugcaaccuccaccuccuggg

SEQ ID NO: 875599 - RNA, 22 nt, Human
cagaguuucgccguuggccagg

SEQ ID NO: 875600 - RNA, 19 nt, Human
cagauggauggcugccucc

SEQ ID NO: 875601 - RNA, 22 nt, Human
cagcuucccaagaagcugggau

SEQ ID NO: 875602 - RNA, 20 nt, Human
caggaguuaggauuccaugc

SEQ ID NO: 875603 - RNA, 28 nt, Human
caggcaauucuugugccucagcuuccca

SEQ ID NO: 875604 - RNA, 24 nt, Human
cagggucucacucugucgcccagg

SEQ ID NO: 875605 - RNA, 21 nt, Human
cagggugcuucugugaggugu

SEQ ID NO: 875606 - RNA, 19 nt, Human
caucccagauggauggcug

SEQ ID NO: 875607 - RNA, 23 nt, Human
caucucagccucaaguagcugga

SEQ ID NO: 875608 - RNA, 22 nt, Human
caucuuauauuucuauacuaaa

SEQ ID NO: 875609 - RNA, 19 nt, Human
cauguugcccaggcuggcc

SEQ ID NO: 875610 - RNA, 20 nt, Human
cauguugcccaggcuggccu

SEQ ID NO: 875611 - RNA, 22 nt, Human
cauguugcccaggcuggccuug

SEQ ID NO: 875612 - RNA, 24 nt, Human
cauguugcccaggcuggccuugaa

SEQ ID NO: 875613 - RNA, 20 nt, Human
ccaaagugcuggaauuacag

SEQ ID NO: 875614 - RNA, 21 nt, Human
ccaaagugcuggaauuacagg

SEQ ID NO: 875615 - RNA, 24 nt, Human
ccaaagugcuggaauuacaggugu

SEQ ID NO: 875616 - RNA, 20 nt, Human
ccaccaugcccagcccagac

SEQ ID NO: 875617 - RNA, 21 nt, Human
ccaccucccaggauuugauuc

SEQ ID NO: 875618 - RNA, 27 nt, Human
ccaccuccuggguucaggcaauucuuu

SEQ ID NO: 875619 - RNA, 18 nt, Human
ccagggugcuggagugca

SEQ ID NO: 875620 - RNA, 23 nt, Human
ccagggugcuggagugcaguggc

SEQ ID NO: 875621 - RNA, 25 nt, Human
ccagggugcuggagugcaguggcgu

SEQ ID NO: 875622 - RNA, 21 nt, Human
ccauguugcccaggcuggccu

SEQ ID NO: 875623 - RNA, 19 nt, Human
cccaagaagcugggauuac

SEQ ID NO: 875624 - RNA, 24 nt, Human
cccaagaagcugggauuacaggca

SEQ ID NO: 875625 - RNA, 23 nt, Human
cccaggauuugauucaggcggcc

SEQ ID NO: 875626 - RNA, 19 nt, Human
ccuaccucgaccucccaaa

SEQ ID NO: 875627 - RNA, 23 nt, Human
ccucaaguagcuggacuacaggc

SEQ ID NO: 875628 - RNA, 19 nt, Human
ccuccaccuccuggguuca

SEQ ID NO: 875629 - RNA, 30 nt, Human
ccucccaucucagccucaaguagcuggacc

SEQ ID NO: 875630 - RNA, 22 nt, Human
ccuccuggguucaggcaauucu

SEQ ID NO: 875631 - RNA, 20 nt, Human
ccugagcuuaagugauccac

SEQ ID NO: 875632 - RNA, 22 nt, Human
ccugagcuuaagugauccacuc

SEQ ID NO: 875633 - RNA, 23 nt, Human
ccuugaacuccugagcuuaagug

SEQ ID NO: 875634 - RNA, 24 nt, Human
cgcucugucagccaggcuggagug

SEQ ID NO: 875635 - RNA, 19 nt, Human
cuaaagugcuaggguuaca

SEQ ID NO: 875636 - RNA, 20 nt, Human
cucaaguagcuggacuacag

SEQ ID NO: 875637 - RNA, 24 nt, Human
cucacugcaaccuccaccuccugg

SEQ ID NO: 875638 - RNA, 27 nt, Human
cucacugcaaccuccaccuccuggguu

SEQ ID NO: 875639 - RNA, 21 nt, Human
cucacugcagccccgaccucc

SEQ ID NO: 875640 - RNA, 19 nt, Human
cucagccucaaguagcugg

SEQ ID NO: 875641 - RNA, 24 nt, Human
cucauccucccaucucagccucaa

SEQ ID NO: 875642 - RNA, 21 nt, Human
cuccuggguucaggcaauucu

SEQ ID NO: 875643 - RNA, 21 nt, Human
cucgcucugucagccaggcug

SEQ ID NO: 875644 - RNA, 24 nt, Human
cucgcucugucagccaggcuggag

SEQ ID NO: 875645 - RNA, 20 nt, Human
cugaacuugagugugcagca

SEQ ID NO: 875646 - RNA, 23 nt, Human
cugcaaccuccaccuccuggguu

SEQ ID NO: 875647 - RNA, 24 nt, Human
cugcaaccuccaccuccuggguuc

SEQ ID NO: 875648 - RNA, 20 nt, Human
cugcacucuucugagguugc

SEQ ID NO: 875649 - RNA, 23 nt, Human
cugcuggauacaagcuaucaugu

SEQ ID NO: 875650 - RNA, 23 nt, Human
cuucauagucauacauagccuga

SEQ ID NO: 875651 - RNA, 22 nt, Human
cuuggcucacugcagccccgac

SEQ ID NO: 875652 - RNA, 21 nt, Human
gaagaaaaccaagauacaaaa

SEQ ID NO: 875653 - RNA, 18 nt, Human
gaagcugggauuacaggc

SEQ ID NO: 875654 - RNA, 24 nt, Human
gaauuacaggugugagccaucacg

SEQ ID NO: 875655 - RNA, 19 nt, Human
gagcugcacucuucugagg

SEQ ID NO: 875656 - RNA, 24 nt, Human
gagcuuaagugauccacucgccuc

SEQ ID NO: 875657 - RNA, 20 nt, Human
gauuucuguccccaccuccc

SEQ ID NO: 875658 - RNA, 18 nt, Human
gcagcagaauuaccugga

SEQ ID NO: 875659 - RNA, 22 nt, Human
gcccagcuaauuuuuguauuuu

SEQ ID NO: 875660 - RNA, 24 nt, Human
gccucagcuucccaagaagcuggg

SEQ ID NO: 875661 - RNA, 21 nt, Human
gcucacugcagccccgaccuc

SEQ ID NO: 875662 - RNA, 25 nt, Human
gcuggagugcaauggcgcgauccca

SEQ ID NO: 875663 - RNA, 25 nt, Human
ggaaggcuucuuaaaacacagauuu

SEQ ID NO: 875664 - RNA, 22 nt, Human
ggacuacaggcgggugccacca

SEQ ID NO: 875665 - RNA, 22 nt, Human
gggguuuugccauguugcccag

SEQ ID NO: 875666 - RNA, 23 nt, Human
gggguuuugccauguugcccagg

SEQ ID NO: 875667 - RNA, 22 nt, Human
ggguuacaggggugagccacca

SEQ ID NO: 875668 - RNA, 24 nt, Human
ggguuacaggggugagccaccaug

SEQ ID NO: 875669 - RNA, 24 nt, Human
gguuacaggggugagccaccaugc

SEQ ID NO: 875670 - RNA, 21 nt, Human
guagaaaugggguuuugccau

SEQ ID NO: 875671 - RNA, 22 nt, Human
guagaaaugggguuuugccaug

SEQ ID NO: 875672 - RNA, 23 nt, Human
guauauuuuuuguagagacagag

SEQ ID NO: 875673 - RNA, 19 nt, Human
gucagccaggcuggagugc

SEQ ID NO: 875674 - RNA, 22 nt, Human
gugagccaccaugcccagccca

SEQ ID NO: 875675 - RNA, 24 nt, Human
gugauccacucgccucgauuuccu

SEQ ID NO: 875676 - RNA, 18 nt, Human
gugaucugccuaccucga

SEQ ID NO: 875677 - RNA, 23 nt, Human
gugccucagcuucccaagaagcu

SEQ ID NO: 875678 - RNA, 19 nt, Human
guggagccugagaauguac

SEQ ID NO: 875679 - RNA, 23 nt, Human
gugguuccugaacuugagugugc

SEQ ID NO: 875680 - RNA, 24 nt, Human
guuuugccauguugcccaggcugg

SEQ ID NO: 875681 - RNA, 23 nt, Human
uaagcagaugagccugacuucau

SEQ ID NO: 875682 - RNA, 22 nt, Human
uaauuuuuguauuuuuuguaga

SEQ ID NO: 875683 - RNA, 22 nt, Human
uacaaaaaguucacacagccag

SEQ ID NO: 875684 - RNA, 24 nt, Human
uacagaugcuucuguucuggagac

SEQ ID NO: 875685 - RNA, 22 nt, Human
uacaggcgggugccaccaugcc

SEQ ID NO: 875686 - RNA, 24 nt, Human
uacaggggugagccaccaugccca

SEQ ID NO: 875687 - RNA, 24 nt, Human
uaccagguacuacagaugguaaaa

SEQ ID NO: 875688 - RNA, 24 nt, Human
uaccucgaccucccaaagugcugg

SEQ ID NO: 875689 - RNA, 25 nt, Human
uacuacagaugcuucuguucuggag

SEQ ID NO: 875690 - RNA, 22 nt, Human
uagaaaugggguuuugccaugu

SEQ ID NO: 875691 - RNA, 20 nt, Human
uagagacagaguuucgccgu

SEQ ID NO: 875692 - RNA, 20 nt, Human
uagcuggacuacaggcgggu

SEQ ID NO: 875693 - RNA, 26 nt, Human
uaggagacggaaucaggaguuaggau

SEQ ID NO: 875694 - RNA, 22 nt, Human
uaggguuacaggggugagccac

SEQ ID NO: 875695 - RNA, 24 nt, Human
uaggguuacaggggugagccacca

SEQ ID NO: 875696 - RNA, 24 nt, Human
uaguucuaaguaauugauugguuu

SEQ ID NO: 875697 - RNA, 33 nt, Human
uauaaaacagggacaucuugcauaccccuaaag

SEQ ID NO: 875698 - RNA, 24 nt, Human
uauacuaaacacuagccacuacuu

SEQ ID NO: 875699 - RNA, 21 nt, Human
uaugcuauaucuuuccaggga

SEQ ID NO: 875700 - RNA, 20 nt, Human
uauuuuuuguagaaaugggg

SEQ ID NO: 875701 - RNA, 21 nt, Human
uauuuuuuguagaaauggggu

SEQ ID NO: 875702 - RNA, 21 nt, Human
ucaaaaagagccagacagaca

SEQ ID NO: 875703 - RNA, 23 nt, Human
ucacugcaaccuccaccuccugg

SEQ ID NO: 875704 - RNA, 24 nt, Human
ucacugcaaccuccaccuccuggg

SEQ ID NO: 875705 - RNA, 25 nt, Human
ucacugcaaccuccaccuccugggu

SEQ ID NO: 875706 - RNA, 27 nt, Human
ucacugcaaccuccaccuccuggguuc

SEQ ID NO: 875707 - RNA, 20 nt, Human
ucagccaggcuggagugcaa

SEQ ID NO: 875708 - RNA, 19 nt, Human
uccagggccagggugcuuc

SEQ ID NO: 875709 - RNA, 26 nt, Human
uccagggccagggugcuucugugagg

SEQ ID NO: 875710 - RNA, 23 nt, Human
ucccaaagugcuggaauuacagg

SEQ ID NO: 875711 - RNA, 24 nt, Human
ucccaagaagcugggauuacaggc

SEQ ID NO: 875712 - RNA, 23 nt, Human
ucccagcucacugcaaccuccac

SEQ ID NO: 875713 - RNA, 27 nt, Human
ucccucauccucccaucucagccucaa

SEQ ID NO: 875714 - RNA, 23 nt, Human
ucccucugggagcugcacucuuc

SEQ ID NO: 875715 - RNA, 25 nt, Human
uccuaaagugcuaggguuacagggg

SEQ ID NO: 875716 - RNA, 20 nt, Human
uccucccaucucagccucaa

SEQ ID NO: 875717 - RNA, 21 nt, Human
uccuggguucaggcaauucuu

SEQ ID NO: 875718 - RNA, 22 nt, Human
uccuggguucaggcaauucuug

SEQ ID NO: 875719 - RNA, 20 nt, Human
ucuaaguaauugauugguuu

SEQ ID NO: 875720 - RNA, 19 nt, Human
ucucacucugucgcccagg

SEQ ID NO: 875721 - RNA, 20 nt, Human
ucucacucugucgcccaggg

SEQ ID NO: 875722 - RNA, 27 nt, Human
ucucacucugucgcccagggugcugga

SEQ ID NO: 875723 - RNA, 23 nt, Human
ucucagccucaaguagcuggacu

SEQ ID NO: 875724 - RNA, 23 nt, Human
ucucgcucugucagccaggcugg

SEQ ID NO: 875725 - RNA, 24 nt, Human
ucucgcucugucagccaggcugga

SEQ ID NO: 875726 - RNA, 24 nt, Human
ucugagguugcaggcauccagggc

SEQ ID NO: 875727 - RNA, 19 nt, Human
ucugucagccaggcuggag

SEQ ID NO: 875728 - RNA, 24 nt, Human
ucugucagccaggcuggagugcaa

SEQ ID NO: 875729 - RNA, 24 nt, Human
ucuuuuuuuuuuagagacagucuc

SEQ ID NO: 875730 - RNA, 24 nt, Human
ugaagaaaaccaagauacaaaaag

SEQ ID NO: 875731 - RNA, 18 nt, Human
ugacuucauagucauaca

SEQ ID NO: 875732 - RNA, 25 nt, Human
ugagaauguacauuucuaacaaguu

SEQ ID NO: 875733 - RNA, 20 nt, Human
ugagacagggucucacucug

SEQ ID NO: 875734 - RNA, 22 nt, Human
ugagacagggucucacucuguc

SEQ ID NO: 875735 - RNA, 25 nt, Human
ugagcacuucauaacuuaaaauucu

SEQ ID NO: 875736 - RNA, 20 nt, Human
ugagcuuaagugauccacuc

SEQ ID NO: 875737 - RNA, 24 nt, Human
ugaucugccuaccucgaccuccca

SEQ ID NO: 875738 - RNA, 18 nt, Human
ugcacucuucugagguug

SEQ ID NO: 875739 - RNA, 22 nt, Human
ugcaguggcgugaucuuggcuc

SEQ ID NO: 875740 - RNA, 24 nt, Human
ugccauguugcccaggcuggccuu

SEQ ID NO: 875741 - RNA, 26 nt, Human
ugccauguugcccaggcuggccuuga

SEQ ID NO: 875742 - RNA, 24 nt, Human
ugcccaggcuggccuugaacuccu

SEQ ID NO: 875743 - RNA, 28 nt, Human
ugcccaggcuggccuugaacuccugagc

SEQ ID NO: 875744 - RNA, 24 nt, Human
ugccucagcuucccaagaagcugg

SEQ ID NO: 875745 - RNA, 24 nt, Human
ugcuggaauuacaggugugagcca

SEQ ID NO: 875746 - RNA, 20 nt, Human
uggaaggcuucuuaaaacac

SEQ ID NO: 875747 - RNA, 18 nt, Human
uggaauuacaggugugag

SEQ ID NO: 875748 - RNA, 19 nt, Human
uggaauuacaggugugagc

SEQ ID NO: 875749 - RNA, 21 nt, Human
uggaauuacaggugugagcca

SEQ ID NO: 875750 - RNA, 22 nt, Human
uggaauuacaggugugagccau

SEQ ID NO: 875751 - RNA, 24 nt, Human
uggaauuacaggugugagccauca

SEQ ID NO: 875752 - RNA, 26 nt, Human
uggaauuacaggugugagccaucacg

SEQ ID NO: 875753 - RNA, 19 nt, Human
uggacuacaggcgggugcc

SEQ ID NO: 875754 - RNA, 23 nt, Human
uggacuacaggcgggugccacca

SEQ ID NO: 875755 - RNA, 19 nt, Human
uggagccugagaauguaca

SEQ ID NO: 875756 - RNA, 19 nt, Human
uggagugcaauggcgcgau

SEQ ID NO: 875757 - RNA, 19 nt, Human
uggagugcaguggcgugau

SEQ ID NO: 875758 - RNA, 23 nt, Human
uggagugcaguggcgugaucuug

SEQ ID NO: 875759 - RNA, 24 nt, Human
uggagugcaguggcgugaucuugg

SEQ ID NO: 875760 - RNA, 24 nt, Human
uggccaggauugucuugaacucuu

SEQ ID NO: 875761 - RNA, 24 nt, Human
uggcgcgaucccagcucacugcaa

SEQ ID NO: 875762 - RNA, 24 nt, Human
uggcuagaauaauaacuagaaauu

SEQ ID NO: 875763 - RNA, 24 nt, Human
uggcucacugcagccccgaccucc

SEQ ID NO: 875764 - RNA, 19 nt, Human
ugggauguguaggcuucau

SEQ ID NO: 875765 - RNA, 19 nt, Human
ugggauuacaggcacauca

SEQ ID NO: 875766 - RNA, 19 nt, Human
ugggauuacaggcacaugc

SEQ ID NO: 875767 - RNA, 21 nt, Human
ugggauuacaggcacaugcua

SEQ ID NO: 875768 - RNA, 23 nt, Human
ugggauuacaggcacaugcuaac

SEQ ID NO: 875769 - RNA, 23 nt, Human
ugggggcugucaaaaagagccag

SEQ ID NO: 875770 - RNA, 24 nt, Human
ugggguuuugccauguugcccagg

SEQ ID NO: 875771 - RNA, 24 nt, Human
uguagaaaugggguuuugccaugu

SEQ ID NO: 875772 - RNA, 22 nt, Human
ugugagccaucacgcccggccc

SEQ ID NO: 875773 - RNA, 23 nt, Human
uucaggcaauucuugugccucag

SEQ ID NO: 875774 - RNA, 18 nt, Human
uucaggcggccugcugug

SEQ ID NO: 875775 - RNA, 18 nt, Human
uucaucuuugccuaguuc

SEQ ID NO: 875776 - RNA, 24 nt, Human
uuccuaaagugcuaggguuacagg

SEQ ID NO: 875777 - RNA, 22 nt, Human
uugagacagggucucacucugu

SEQ ID NO: 875778 - RNA, 21 nt, Human
uuggcuauacuuucaucuuug

SEQ ID NO: 875779 - RNA, 24 nt, Human
uuguagaaaugggguuuugccaug

SEQ ID NO: 875780 - RNA, 22 nt, Human
uuguagagacagaguuucgccg

SEQ ID NO: 875781 - RNA, 22 nt, Human
uuucuauacuaaacacuagcca

SEQ ID NO: 875782 - RNA, 25 nt, Human
uuugaacuuaaucuccacaguaaca

SEQ ID NO: 875783 - RNA, 23 nt, Human
uuuguagaaaugggguuuugcca

SEQ ID NO: 875784 - RNA, 24 nt, Human
uuuguagaaaugggguuuugccau

SEQ ID NO: 875785 - RNA, 24 nt, Human
uuuguagagacagaguuucgccgu

SEQ ID NO: 875786 - RNA, 23 nt, Human
uuuugccauguugcccaggcugg

SEQ ID NO: 875787 - RNA, 18 nt, Human
uuuuuguauuuuuuguag

SEQ ID NO: 875788 - RNA, 24 nt, Human
uuuuuuguagaaaugggguuuugc

SEQ ID NO: 875789 - RNA, 23 nt, Human
uuuuuuguagagacagaguuucg

SEQ ID NO: 875790 - RNA, 24 nt, Human
uuuuuuguagagacagaguuucgc

SEQ ID NO: 875791 - RNA, 23 nt, Human
uuuuuuuuuugagacagggucuc

SEQ ID NO: 875792 - RNA, 20 nt, Human
uuuuuuuuuuugagacaggg

SEQ ID NO: 875793 - RNA, 23 nt, Human
uuuuuuuuuuuugagacaggguc

SEQ ID NO: 875794 - RNA, 26 nt, Human
uuuuuuuuuuuugagacagggucuca

SEQ ID NO: 875795 - RNA, 24 nt, Human
uuuuuuuuuuuuuuugagacaggg

SEQ ID NO: 875796 - RNA, 21 nt, Human
aaaaaaagggaagaaaaaaua

SEQ ID NO: 875797 - RNA, 26 nt, Human
aaaaauacuggggaagaaaacacagc

SEQ ID NO: 875798 - RNA, 19 nt, Human
aaaacaaaauacaagaccu

SEQ ID NO: 875799 - RNA, 26 nt, Human
aaacaagaaauguacaaaggggaccc

SEQ ID NO: 875800 - RNA, 18 nt, Human
aaacagguuugucuccca

SEQ ID NO: 875801 - RNA, 20 nt, Human
aaagcagacccuucagcuug

SEQ ID NO: 875802 - RNA, 19 nt, Human
aaccaacaggcagccagaa

SEQ ID NO: 875803 - RNA, 19 nt, Human
aaccuccccgaaagaaguc

SEQ ID NO: 875804 - RNA, 19 nt, Human
aacguccugcgcugauguc

SEQ ID NO: 875805 - RNA, 21 nt, Human
aagaaaaaauacuggggaaga

SEQ ID NO: 875806 - RNA, 23 nt, Human
aagacaaccaacaggcagccaga

SEQ ID NO: 875807 - RNA, 20 nt, Human
aagagaggcucucuccagga

SEQ ID NO: 875808 - RNA, 21 nt, Human
aagcauauccucccaacauaa

SEQ ID NO: 875809 - RNA, 20 nt, Human
aagccaauccuccaggcugg

SEQ ID NO: 875810 - RNA, 22 nt, Human
aagggcauuuuggcccaaaggc

SEQ ID NO: 875811 - RNA, 22 nt, Human
aagugaacuuuuuugagaacac

SEQ ID NO: 875812 - RNA, 25 nt, Human
aagugacuuuacagaggggaaaaga

SEQ ID NO: 875813 - RNA, 23 nt, Human
aauaaacuuuuuuaucuggauuc

SEQ ID NO: 875814 - RNA, 19 nt, Human
aauggcccaaagacugagg

SEQ ID NO: 875815 - RNA, 21 nt, Human
acacagccuauuaaauccauu

SEQ ID NO: 875816 - RNA, 22 nt, Human
acagaacaccagacuuucagaa

SEQ ID NO: 875817 - RNA, 19 nt, Human
acagaagcaggaggggcag

SEQ ID NO: 875818 - RNA, 20 nt, Human
acagaagcaggaggggcagg

SEQ ID NO: 875819 - RNA, 24 nt, Human
acagcacuguuuggcagcuccuuu

SEQ ID NO: 875820 - RNA, 23 nt, Human
acaggaaaaaaaauagacuuuca

SEQ ID NO: 875821 - RNA, 20 nt, Human
acccauuccuuggugccucc

SEQ ID NO: 875822 - RNA, 22 nt, Human
acgcaagguuuggcaaucucaa

SEQ ID NO: 875823 - RNA, 22 nt, Human
acggggcaggaaaaaaagggaa

SEQ ID NO: 875824 - RNA, 18 nt, Human
acguaacucugauccacc

SEQ ID NO: 875825 - RNA, 18 nt, Human
acucuuggcaccucccuc

SEQ ID NO: 875826 - RNA, 22 nt, Human
acugcagauaagagauagccca

SEQ ID NO: 875827 - RNA, 19 nt, Human
acugcuggggaugcagaag

SEQ ID NO: 875828 - RNA, 20 nt, Human
agaaagcugcugcugauucg

SEQ ID NO: 875829 - RNA, 23 nt, Human
agaacaccagacuuucagaagca

SEQ ID NO: 875830 - RNA, 22 nt, Human
agaagaaagugacuuuacagag

SEQ ID NO: 875831 - RNA, 24 nt, Human
agaagaaagugacuuuacagaggg

SEQ ID NO: 875832 - RNA, 23 nt, Human
agacagugcuaacagcccuggca

SEQ ID NO: 875833 - RNA, 20 nt, Human
agacugcaaggcaaaggaac

SEQ ID NO: 875834 - RNA, 18 nt, Human
agauacagaacaccagac

SEQ ID NO: 875835 - RNA, 21 nt, Human
agcacccaggaaccuuaagag

SEQ ID NO: 875836 - RNA, 23 nt, Human
agcagcacuggugguggauggac

SEQ ID NO: 875837 - RNA, 21 nt, Human
agcaucacccauuccuuggug

SEQ ID NO: 875838 - RNA, 22 nt, Human
agccagaacuacggaaaauaaa

SEQ ID NO: 875839 - RNA, 22 nt, Human
agcccacagaugugcaagugaa

SEQ ID NO: 875840 - RNA, 21 nt, Human
agccuuggcuuccuggggcca

SEQ ID NO: 875841 - RNA, 20 nt, Human
aggaaaaaaagggaagaaaa

SEQ ID NO: 875842 - RNA, 21 nt, Human
aggaaccuuaagagcugcuga

SEQ ID NO: 875843 - RNA, 19 nt, Human
aggaagaggauacagcaca

SEQ ID NO: 875844 - RNA, 20 nt, Human
aggaagaggauacagcacaa

SEQ ID NO: 875845 - RNA, 19 nt, Human
aggaagcacaugcuugaaa

SEQ ID NO: 875846 - RNA, 23 nt, Human
aggagacugcaaggcaaaggaac

SEQ ID NO: 875847 - RNA, 22 nt, Human
aggcagccagaacuacggaaaa

SEQ ID NO: 875848 - RNA, 18 nt, Human
aggcaggacucacccagu

SEQ ID NO: 875849 - RNA, 18 nt, Human
agggcauuuuggcccaaa

SEQ ID NO: 875850 - RNA, 23 nt, Human
agguagauaggaaaacccuccuc

SEQ ID NO: 875851 - RNA, 19 nt, Human
aucagccuauuuugcccuu

SEQ ID NO: 875852 - RNA, 20 nt, Human
auccucuuucuagcaaaagc

SEQ ID NO: 875853 - RNA, 22 nt, Human
augagaaacagaaggugaggag

SEQ ID NO: 875854 - RNA, 22 nt, Human
auguauuggaaaucaaauggcc

SEQ ID NO: 875855 - RNA, 26 nt, Human
auucuuccacccuauguauuggaaau

SEQ ID NO: 875856 - RNA, 23 nt, Human
caacauaagccagauuagccccu

SEQ ID NO: 875857 - RNA, 22 nt, Human
caagacaaccaacaggcagcca

SEQ ID NO: 875858 - RNA, 20 nt, Human
caagacucuggccugggaca

SEQ ID NO: 875859 - RNA, 21 nt, Human
caagagauacuacuguuccau

SEQ ID NO: 875860 - RNA, 23 nt, Human
caagccagauugcccaccuccuc

SEQ ID NO: 875861 - RNA, 21 nt, Human
caagcuugucuguccuccaaa

SEQ ID NO: 875862 - RNA, 22 nt, Human
caaucacugccauuucacaaau

SEQ ID NO: 875863 - RNA, 23 nt, Human
cacagcacccaggaaccuuaagg

SEQ ID NO: 875864 - RNA, 18 nt, Human
cacagccccagauacaga

SEQ ID NO: 875865 - RNA, 19 nt, Human
cacagccccagauacagaa

SEQ ID NO: 875866 - RNA, 23 nt, Human
caccagacuuucagaagcagcaa

SEQ ID NO: 875867 - RNA, 18 nt, Human
cacccauuccuuggugcc

SEQ ID NO: 875868 - RNA, 19 nt, Human
caccccagccuuggcuucc

SEQ ID NO: 875869 - RNA, 20 nt, Human
caccucccucccuccccacc

SEQ ID NO: 875870 - RNA, 22 nt, Human
cacuauccgcaaauggucucca

SEQ ID NO: 875871 - RNA, 18 nt, Human
cacugccaggcugaaaac

SEQ ID NO: 875872 - RNA, 21 nt, Human
cacugggccaagguucggggc

SEQ ID NO: 875873 - RNA, 23 nt, Human
cagaacaccagacuuucagaagc

SEQ ID NO: 875874 - RNA, 18 nt, Human
cagagcgggucucguaag

SEQ ID NO: 875875 - RNA, 18 nt, Human
cagaguggaaugcuucuc

SEQ ID NO: 875876 - RNA, 20 nt, Human
cagaguggaaugcuucucaa

SEQ ID NO: 875877 - RNA, 22 nt, Human
cagauuagccccuggaagcuga

SEQ ID NO: 875878 - RNA, 18 nt, Human
cagcacaacucaagccag

SEQ ID NO: 875879 - RNA, 18 nt, Human
cagccuauuuugcccuuu

SEQ ID NO: 875880 - RNA, 20 nt, Human
cagcuccagaaccacauccc

SEQ ID NO: 875881 - RNA, 21 nt, Human
caggaaaaaaagggaagaaaa

SEQ ID NO: 875882 - RNA, 19 nt, Human
caggaacccacagccccag

SEQ ID NO: 875883 - RNA, 23 nt, Human
caggaacccacagccccagauac

SEQ ID NO: 875884 - RNA, 22 nt, Human
cagggucuccuaugcagguagu

SEQ ID NO: 875885 - RNA, 23 nt, Human
caucccuggcccccauacggccu

SEQ ID NO: 875886 - RNA, 20 nt, Human
cauccuccgaaagcugggga

SEQ ID NO: 875887 - RNA, 24 nt, Human
ccaagacacacucuacuaagcaca

SEQ ID NO: 875888 - RNA, 23 nt, Human
ccacacacugucucuuccauccc

SEQ ID NO: 875889 - RNA, 22 nt, Human
ccacauccucuuucuagcaaaa

SEQ ID NO: 875890 - RNA, 22 nt, Human
ccacuaagggucugaggacaaa

SEQ ID NO: 875891 - RNA, 21 nt, Human
ccagugguaaauccaccucca

SEQ ID NO: 875892 - RNA, 20 nt, Human
ccauuucacaaauuuccagu

SEQ ID NO: 875893 - RNA, 25 nt, Human
cccaaucacugccauuucacaaauu

SEQ ID NO: 875894 - RNA, 24 nt, Human
cccacagccccagauacagaacac

SEQ ID NO: 875895 - RNA, 23 nt, Human
cccagcucuugacaaagggcagg

SEQ ID NO: 875896 - RNA, 24 nt, Human
ccccaaaaucacauucuuccaccc

SEQ ID NO: 875897 - RNA, 20 nt, Human
ccccagauacagaacaccag

SEQ ID NO: 875898 - RNA, 18 nt, Human
cccccgggcccagccgcc

SEQ ID NO: 875899 - RNA, 24 nt, Human
ccccgaaagaagucuggaaauaaa

SEQ ID NO: 875900 - RNA, 22 nt, Human
ccccugcagcauaagggacaga

SEQ ID NO: 875901 - RNA, 19 nt, Human
ccccuggaagcugauacua

SEQ ID NO: 875902 - RNA, 18 nt, Human
cccgccuucuucuucucc

SEQ ID NO: 875903 - RNA, 18 nt, Human
cccgggcccagccgccga

SEQ ID NO: 875904 - RNA, 21 nt, Human
cccuaucuacucuugcagcac

SEQ ID NO: 875905 - RNA, 18 nt, Human
ccgccgacgccgcggccg

SEQ ID NO: 875906 - RNA, 20 nt, Human
ccgccgacgccgcggccgca

SEQ ID NO: 875907 - RNA, 22 nt, Human
ccgccucccauuguaucaccca

SEQ ID NO: 875908 - RNA, 22 nt, Human
ccucaagagauacuacuguucc

SEQ ID NO: 875909 - RNA, 24 nt, Human
ccuccacauccucuuucuagcaaa

SEQ ID NO: 875910 - RNA, 24 nt, Human
ccucccaacauaagccagauuagc

SEQ ID NO: 875911 - RNA, 19 nt, Human
ccucccucccuccccaccc

SEQ ID NO: 875912 - RNA, 18 nt, Human
ccucccuccuccucaucc

SEQ ID NO: 875913 - RNA, 20 nt, Human
ccucuccacaaagcagaccc

SEQ ID NO: 875914 - RNA, 22 nt, Human
ccucugcaaccuacggggcagg

SEQ ID NO: 875915 - RNA, 21 nt, Human
ccucuuaaaacauagaaugaa

SEQ ID NO: 875916 - RNA, 19 nt, Human
ccuggccagagccuucuca

SEQ ID NO: 875917 - RNA, 26 nt, Human
ccuucagcuuggcagcaucacccauu

SEQ ID NO: 875918 - RNA, 18 nt, Human
cgcgccuucaggcgguuc

SEQ ID NO: 875919 - RNA, 18 nt, Human
cgcggcaaagcaccuccc

SEQ ID NO: 875920 - RNA, 19 nt, Human
cgggcccagccgccgacgc

SEQ ID NO: 875921 - RNA, 23 nt, Human
cgggccggaugguguccagcgcc

SEQ ID NO: 875922 - RNA, 26 nt, Human
cgugguggggcgccugccgccgcgcc

SEQ ID NO: 875923 - RNA, 19 nt, Human
cuagacacaggaacccaca

SEQ ID NO: 875924 - RNA, 20 nt, Human
cuauuuugcccuuucugaac

SEQ ID NO: 875925 - RNA, 21 nt, Human
cucaagauuuccugagcagcu

SEQ ID NO: 875926 - RNA, 24 nt, Human
cucacagucacuuaccagauaccu

SEQ ID NO: 875927 - RNA, 21 nt, Human
cucauccuccuccuggucuga

SEQ ID NO: 875928 - RNA, 22 nt, Human
cuccaccguagccccgacuguc

SEQ ID NO: 875929 - RNA, 21 nt, Human
cucccaacauaagccagauua

SEQ ID NO: 875930 - RNA, 23 nt, Human
cucccacugugaacuccaccgua

SEQ ID NO: 875931 - RNA, 20 nt, Human
cucccuccuccucauccucc

SEQ ID NO: 875932 - RNA, 21 nt, Human
cuggcccccauacggccuuuc

SEQ ID NO: 875933 - RNA, 18 nt, Human
cugggccaagguucgggg

SEQ ID NO: 875934 - RNA, 22 nt, Human
cuguuacuuucagagaaaguau

SEQ ID NO: 875935 - RNA, 22 nt, Human
cuucccacagcacccaggaacc

SEQ ID NO: 875936 - RNA, 22 nt, Human
cuugccagccaccagccccccg

SEQ ID NO: 875937 - RNA, 21 nt, Human
gaaaacccuccuaaacaagaa

SEQ ID NO: 875938 - RNA, 20 nt, Human
gacaaacugcagcuucgauc

SEQ ID NO: 875939 - RNA, 19 nt, Human
gacacagccuauuaaaucc

SEQ ID NO: 875940 - RNA, 18 nt, Human
gagaggcucucuccagga

SEQ ID NO: 875941 - RNA, 24 nt, Human
gagcagcacuggugguggauggac

SEQ ID NO: 875942 - RNA, 21 nt, Human
gaggagccaggagauguggag

SEQ ID NO: 875943 - RNA, 24 nt, Human
gaggagccaggagauguggagcaa

SEQ ID NO: 875944 - RNA, 21 nt, Human
gaggaggaaggacagaucagg

SEQ ID NO: 875945 - RNA, 19 nt, Human
gaggaggagcuaccuggaa

SEQ ID NO: 875946 - RNA, 21 nt, Human
gcaaaggaacagaagcaggag

SEQ ID NO: 875947 - RNA, 21 nt, Human
gcacccaggaaccuuaagagc

SEQ ID NO: 875948 - RNA, 18 nt, Human
gcauuacguaacucugau

SEQ ID NO: 875949 - RNA, 19 nt, Human
gccacaaugagaaacagaa

SEQ ID NO: 875950 - RNA, 18 nt, Human
gccacaucaaucgucuca

SEQ ID NO: 875951 - RNA, 22 nt, Human
gcccaaagacugaggugucuuc

SEQ ID NO: 875952 - RNA, 18 nt, Human
gccccgacuguccggagg

SEQ ID NO: 875953 - RNA, 22 nt, Human
gccccgacuguccggaggcgga

SEQ ID NO: 875954 - RNA, 27 nt, Human
gcccuaaagcccacacagggagcagca

SEQ ID NO: 875955 - RNA, 22 nt, Human
gccuuggcuuccuggggccagg

SEQ ID NO: 875956 - RNA, 21 nt, Human
gccuuucucccaagcacauca

SEQ ID NO: 875957 - RNA, 21 nt, Human
gcggcaaagcaccuccccuau

SEQ ID NO: 875958 - RNA, 25 nt, Human
gcuagacacaggaacccacagcccc

SEQ ID NO: 875959 - RNA, 21 nt, Human
gcugagacccuggaagucaga

SEQ ID NO: 875960 - RNA, 19 nt, Human
ggaaaguuccagaaacuac

SEQ ID NO: 875961 - RNA, 19 nt, Human
ggaauggucucuccccucu

SEQ ID NO: 875962 - RNA, 20 nt, Human
ggaaugugaguaacacaaug

SEQ ID NO: 875963 - RNA, 22 nt, Human
ggacgccgccgcccgccuucuu

SEQ ID NO: 875964 - RNA, 19 nt, Human
gggaacaauggcaaugcag

SEQ ID NO: 875965 - RNA, 18 nt, Human
gggaaggaggaggaagga

SEQ ID NO: 875966 - RNA, 23 nt, Human
gggaggagccaggagauguggag

SEQ ID NO: 875967 - RNA, 18 nt, Human
gggcaggacacacuaagg

SEQ ID NO: 875968 - RNA, 19 nt, Human
ggggcaggaaaaaaaggga

SEQ ID NO: 875969 - RNA, 19 nt, Human
ggucuauucccaggagggc

SEQ ID NO: 875970 - RNA, 21 nt, Human
gguucuguuacuuucagagaa

SEQ ID NO: 875971 - RNA, 19 nt, Human
guaaaaccagugguaaauc

SEQ ID NO: 875972 - RNA, 19 nt, Human
guaccgguggggcaggaca

SEQ ID NO: 875973 - RNA, 23 nt, Human
guagauaggaaaacccuccuaaa

SEQ ID NO: 875974 - RNA, 25 nt, Human
gugguggggcgccugccgccgcgcc

SEQ ID NO: 875975 - RNA, 23 nt, Human
guuugucucccacugugaacucc

SEQ ID NO: 875976 - RNA, 19 nt, Human
uaaaaaaacaaaauacaag

SEQ ID NO: 875977 - RNA, 20 nt, Human
uaaaaaaacaaaauacaaga

SEQ ID NO: 875978 - RNA, 22 nt, Human
uaaaaaaacaaaauacaagacc

SEQ ID NO: 875979 - RNA, 25 nt, Human
uaaagcccacacagggagcagcacu

SEQ ID NO: 875980 - RNA, 26 nt, Human
uaacaaggaagaggauacagcacaac

SEQ ID NO: 875981 - RNA, 21 nt, Human
uaacagcccuggcaucuuucu

SEQ ID NO: 875982 - RNA, 23 nt, Human
uaacugcuaucaacaguucagau

SEQ ID NO: 875983 - RNA, 21 nt, Human
uaagagauagcccacuaaugu

SEQ ID NO: 875984 - RNA, 19 nt, Human
uacaagaccugcucuggcc

SEQ ID NO: 875985 - RNA, 25 nt, Human
uacagaacaccagacuuucagaagc

SEQ ID NO: 875986 - RNA, 22 nt, Human
uaccagauaccugggccuuucc

SEQ ID NO: 875987 - RNA, 21 nt, Human
uacuggggaagaaaacacagc

SEQ ID NO: 875988 - RNA, 24 nt, Human
uagaaugaaauaaacucggaucuu

SEQ ID NO: 875989 - RNA, 21 nt, Human
uagauauguucacaaguguuc

SEQ ID NO: 875990 - RNA, 21 nt, Human
uagcccaaaacuucuuucacu

SEQ ID NO: 875991 - RNA, 20 nt, Human
ucaaauggcccaaagacuga

SEQ ID NO: 875992 - RNA, 18 nt, Human
ucacaaguguuccuacug

SEQ ID NO: 875993 - RNA, 21 nt, Human
ucacugacaucauagugacac

SEQ ID NO: 875994 - RNA, 24 nt, Human
ucacuuguuauguccuuuuaccuc

SEQ ID NO: 875995 - RNA, 18 nt, Human
ucagacugcauuacguaa

SEQ ID NO: 875996 - RNA, 21 nt, Human
ucagcuucccacagcacccag

SEQ ID NO: 875997 - RNA, 20 nt, Human
uccaaaaugggaacagaagg

SEQ ID NO: 875998 - RNA, 26 nt, Human
ucccagauaauacucaaauaucaaau

SEQ ID NO: 875999 - RNA, 21 nt, Human
uccccgaaagaagucuggaaa

SEQ ID NO: 876000 - RNA, 18 nt, Human
uccccugcagcauaaggg

SEQ ID NO: 876001 - RNA, 23 nt, Human
ucccucccuccccacccuuucaa

SEQ ID NO: 876002 - RNA, 22 nt, Human
uccggaggcggagaaaugccgg

SEQ ID NO: 876003 - RNA, 20 nt, Human
uccuccaaaaugggaacaga

SEQ ID NO: 876004 - RNA, 19 nt, Human
uccuccucauccuccuccu

SEQ ID NO: 876005 - RNA, 23 nt, Human
uccuccucauccuccuccugguc

SEQ ID NO: 876006 - RNA, 24 nt, Human
ucuagcaaaagcgaacacugcaga

SEQ ID NO: 876007 - RNA, 18 nt, Human
ucuccaccucccuccucc

SEQ ID NO: 876008 - RNA, 19 nt, Human
ucuccagugagacuaaggc

SEQ ID NO: 876009 - RNA, 22 nt, Human
ucuccuccuugccagccaccag

SEQ ID NO: 876010 - RNA, 20 nt, Human
ucuccuuuagaaagcugcug

SEQ ID NO: 876011 - RNA, 25 nt, Human
ucuggccucaagagauacuacuguu

SEQ ID NO: 876012 - RNA, 21 nt, Human
ucuuccaucccuggcccccau

SEQ ID NO: 876013 - RNA, 20 nt, Human
ucuucuucuccuccuugcca

SEQ ID NO: 876014 - RNA, 19 nt, Human
ugaagcgggugaaaucaac

SEQ ID NO: 876015 - RNA, 24 nt, Human
ugagaaagcugccagcauguggca

SEQ ID NO: 876016 - RNA, 19 nt, Human
ugagacuaaggcaagcuaa

SEQ ID NO: 876017 - RNA, 24 nt, Human
ugagacucagaagggaggagccag

SEQ ID NO: 876018 - RNA, 19 nt, Human
ugagaggaggagcuaccug

SEQ ID NO: 876019 - RNA, 23 nt, Human
ugaggagacagugcuaacagccc

SEQ ID NO: 876020 - RNA, 19 nt, Human
ugaggcgcaggacgugcuc

SEQ ID NO: 876021 - RNA, 18 nt, Human
ugauaaggaacccacucc

SEQ ID NO: 876022 - RNA, 21 nt, Human
ugauaaggaacccacuccaca

SEQ ID NO: 876023 - RNA, 22 nt, Human
ugauaaggaacccacuccacag

SEQ ID NO: 876024 - RNA, 24 nt, Human
ugauauguucugugacauggaaug

SEQ ID NO: 876025 - RNA, 26 nt, Human
ugauauguucugugacauggaaugug

SEQ ID NO: 876026 - RNA, 20 nt, Human
ugauucguaagcauauccuc

SEQ ID NO: 876027 - RNA, 26 nt, Human
ugcaaaucccauuugaggagccacaa

SEQ ID NO: 876028 - RNA, 22 nt, Human
ugccaccccagccuuggcuucc

SEQ ID NO: 876029 - RNA, 23 nt, Human
ugccguucgaucauccggaaguu

SEQ ID NO: 876030 - RNA, 22 nt, Human
uggacacaaagacaauaaaaac

SEQ ID NO: 876031 - RNA, 20 nt, Human
uggcaccucccucccucccc

SEQ ID NO: 876032 - RNA, 21 nt, Human
uggcaccucccucccucccca

SEQ ID NO: 876033 - RNA, 23 nt, Human
uggcagcaucacccauuccuugg

SEQ ID NO: 876034 - RNA, 24 nt, Human
uggcagcaucacccauuccuuggu

SEQ ID NO: 876035 - RNA, 19 nt, Human
uggccagagccuucucacc

SEQ ID NO: 876036 - RNA, 23 nt, Human
uggccagagccuucucaccaggc

SEQ ID NO: 876037 - RNA, 19 nt, Human
uggcccaaaggcuguacag

SEQ ID NO: 876038 - RNA, 20 nt, Human
uggcugagacccuggaaguc

SEQ ID NO: 876039 - RNA, 21 nt, Human
ugggaacagaaggcacugcca

SEQ ID NO: 876040 - RNA, 19 nt, Human
uggggaagaaaacacagca

SEQ ID NO: 876041 - RNA, 18 nt, Human
uggggccagguuccagau

SEQ ID NO: 876042 - RNA, 20 nt, Human
ugggggaagcgggaaggagg

SEQ ID NO: 876043 - RNA, 23 nt, Human
uggucagccccaaaaucacauuc

SEQ ID NO: 876044 - RNA, 19 nt, Human
uguagcagauacagugugc

SEQ ID NO: 876045 - RNA, 24 nt, Human
ugucucuuccaucccuggccccca

SEQ ID NO: 876046 - RNA, 19 nt, Human
ugucuguccuccaaaaugg

SEQ ID NO: 876047 - RNA, 19 nt, Human
uuacuuuggacacaaagac

SEQ ID NO: 876048 - RNA, 21 nt, Human
uucccacagcacccaggaacc

SEQ ID NO: 876049 - RNA, 18 nt, Human
uuccuccacauccucuuu

SEQ ID NO: 876050 - RNA, 19 nt, Human
uucguaagcauauccuccc

SEQ ID NO: 876051 - RNA, 18 nt, Human
uucucccaagcacaucag

SEQ ID NO: 876052 - RNA, 20 nt, Human
uuggagaagcuagaagggca

SEQ ID NO: 876053 - RNA, 22 nt, Human
uuuacaggaaaaaaaauagacu

SEQ ID NO: 876054 - RNA, 24 nt, Human
uuucuguggccacacacugucucu

SEQ ID NO: 876055 - RNA, 21 nt, Human
uuuuucagcaaguguucccgg

SEQ ID NO: 876056 - RNA, 21 nt, Human
aaaaacggagaaaaagaggga

SEQ ID NO: 876057 - RNA, 20 nt, Human
aaaagaaaaaagaaaaugca

SEQ ID NO: 876058 - RNA, 18 nt, Human
aaaauuagcugggcgugg

SEQ ID NO: 876059 - RNA, 21 nt, Human
aaacuggcggaggggucagca

SEQ ID NO: 876060 - RNA, 22 nt, Human
aaagaggccaaucuucaaugag

SEQ ID NO: 876061 - RNA, 18 nt, Human
aaagcucuucaacuucuc

SEQ ID NO: 876062 - RNA, 22 nt, Human
aacaucuccuucccgugugcug

SEQ ID NO: 876063 - RNA, 22 nt, Human
aacaugccaaaggacacgaagc

SEQ ID NO: 876064 - RNA, 25 nt, Human
aagaaugagggacuuacagaaaaaa

SEQ ID NO: 876065 - RNA, 20 nt, Human
aagcaacaggcuggggagac

SEQ ID NO: 876066 - RNA, 24 nt, Human
aauuaaugaaaaaacggagaaaaa

SEQ ID NO: 876067 - RNA, 24 nt, Human
aauuacuugaaccugggaggcaga

SEQ ID NO: 876068 - RNA, 24 nt, Human
acagagugagacugugucucaaaa

SEQ ID NO: 876069 - RNA, 24 nt, Human
accccaucucugcuaaaaauacaa

SEQ ID NO: 876070 - RNA, 21 nt, Human
acccugugagacacugcuuca

SEQ ID NO: 876071 - RNA, 23 nt, Human
acucuagccuggugacagaguga

SEQ ID NO: 876072 - RNA, 23 nt, Human
acugcacucuagccuggugacag

SEQ ID NO: 876073 - RNA, 25 nt, Human
acugcacucuagccuggugacagag

SEQ ID NO: 876074 - RNA, 28 nt, Human
acugugucucaaaaaaaaaaaaaaagaa

SEQ ID NO: 876075 - RNA, 18 nt, Human
agaaaagaaaaaagaaaa

SEQ ID NO: 876076 - RNA, 21 nt, Human
agaagcuacagacgaauggaa

SEQ ID NO: 876077 - RNA, 21 nt, Human
agaccgagguggguggaucac

SEQ ID NO: 876078 - RNA, 21 nt, Human
agagaaaggaaagaggccaau

SEQ ID NO: 876079 - RNA, 22 nt, Human
agaggggugcaagcaagcaggu

SEQ ID NO: 876080 - RNA, 22 nt, Human
agagguugcagugagcugagau

SEQ ID NO: 876081 - RNA, 24 nt, Human
agagguugcagugagcugagaucg

SEQ ID NO: 876082 - RNA, 21 nt, Human
agccaagugucuucaagcucu

SEQ ID NO: 876083 - RNA, 23 nt, Human
agccuggugacagagugagacug

SEQ ID NO: 876084 - RNA, 24 nt, Human
agcgcuuugggagaccgagguggg

SEQ ID NO: 876085 - RNA, 23 nt, Human
agcugggcgugguggcacgugcc

SEQ ID NO: 876086 - RNA, 20 nt, Human
aggcagagguugcagugagc

SEQ ID NO: 876087 - RNA, 24 nt, Human
aggcagagguugcagugagcugag

SEQ ID NO: 876088 - RNA, 22 nt, Human
aggcaggagaauuacuugaacc

SEQ ID NO: 876089 - RNA, 24 nt, Human
aggcaggagaauuacuugaaccug

SEQ ID NO: 876090 - RNA, 21 nt, Human
aggcugaggcaggagaauuac

SEQ ID NO: 876091 - RNA, 24 nt, Human
aggcugaggcaggagaauuacuug

SEQ ID NO: 876092 - RNA, 20 nt, Human
aggcuggggagacggggggc

SEQ ID NO: 876093 - RNA, 23 nt, Human
aggcugggucaugccccaacucg

SEQ ID NO: 876094 - RNA, 29 nt, Human
aggggcuaaagaaaacacugggguauucc

SEQ ID NO: 876095 - RNA, 24 nt, Human
aggggucagcaagagagaggaaaa

SEQ ID NO: 876096 - RNA, 18 nt, Human
agucauugagcuugagga

SEQ ID NO: 876097 - RNA, 22 nt, Human
aguggcuaccauauuggacagc

SEQ ID NO: 876098 - RNA, 24 nt, Human
aucgugccacugcacucuagccug

SEQ ID NO: 876099 - RNA, 21 nt, Human
aucucuuuuucuccuccgccu

SEQ ID NO: 876100 - RNA, 23 nt, Human
aucucuuuuucuccuccgccuga

SEQ ID NO: 876101 - RNA, 18 nt, Human
aucugaacaauuuugggg

SEQ ID NO: 876102 - RNA, 24 nt, Human
caaaaaaaaaaaaaaagaaaagaa

SEQ ID NO: 876103 - RNA, 25 nt, Human
caaagacaccagggaauuggagacc

SEQ ID NO: 876104 - RNA, 19 nt, Human
caaagcucaggcuuuuacu

SEQ ID NO: 876105 - RNA, 24 nt, Human
caauguggugaaaccccaucucug

SEQ ID NO: 876106 - RNA, 23 nt, Human
cacaagcagcggcuauuucagcc

SEQ ID NO: 876107 - RNA, 20 nt, Human
cacaauggcacagcauccuc

SEQ ID NO: 876108 - RNA, 24 nt, Human
caccacgcccuccuggucuauguu

SEQ ID NO: 876109 - RNA, 21 nt, Human
cacgaugagacccuggcugcu

SEQ ID NO: 876110 - RNA, 24 nt, Human
cacgccuguaaucccagcgcuuug

SEQ ID NO: 876111 - RNA, 21 nt, Human
cacucuagccuggugacagag

SEQ ID NO: 876112 - RNA, 21 nt, Human
cacucuagccuggugacagag

SEQ ID NO: 876113 - RNA, 23 nt, Human
cacucuagccuggugacagagug

SEQ ID NO: 876114 - RNA, 18 nt, Human
cacugcacucuagccugg

SEQ ID NO: 876115 - RNA, 18 nt, Human
cacugcacucuagccugg

SEQ ID NO: 876116 - RNA, 22 nt, Human
cacugcacucuagccuggugac

SEQ ID NO: 876117 - RNA, 23 nt, Human
cacugcacucuagccuggugaca

SEQ ID NO: 876118 - RNA, 24 nt, Human
cacugcacucuagccuggugacag

SEQ ID NO: 876119 - RNA, 18 nt, Human
cacugcucuugcuuaagc

SEQ ID NO: 876120 - RNA, 22 nt, Human
cagaauuuccuggauauuuaac

SEQ ID NO: 876121 - RNA, 21 nt, Human
cagcaaguucuuccaaagccu

SEQ ID NO: 876122 - RNA, 20 nt, Human
cagccuggauuaccaaugag

SEQ ID NO: 876123 - RNA, 24 nt, Human
cagcgcuuugggagaccgaggugg

SEQ ID NO: 876124 - RNA, 24 nt, Human
cagcuacuugggaggcugaggcag

SEQ ID NO: 876125 - RNA, 18 nt, Human
caggagccaggucagaaa

SEQ ID NO: 876126 - RNA, 19 nt, Human
ccacugcacucuagccugg

SEQ ID NO: 876127 - RNA, 19 nt, Human
ccacugcacucuagccugg

SEQ ID NO: 876128 - RNA, 23 nt, Human
ccacugcacucuagccuggugac

SEQ ID NO: 876129 - RNA, 22 nt, Human
ccuggccaauguggugaaaccc

SEQ ID NO: 876130 - RNA, 23 nt, Human
ccuggccaauguggugaaacccc

SEQ ID NO: 876131 - RNA, 24 nt, Human
ccuggccaauguggugaaacccca

SEQ ID NO: 876132 - RNA, 25 nt, Human
ccugggaggcagagguugcagugag

SEQ ID NO: 876133 - RNA, 22 nt, Human
ccuguaaucccagcgcuuuggg

SEQ ID NO: 876134 - RNA, 18 nt, Human
ccuguagucccagcuacu

SEQ ID NO: 876135 - RNA, 21 nt, Human
ccuguagucccagcuacuugg

SEQ ID NO: 876136 - RNA, 22 nt, Human
ccuguagucccagcuacuuggg

SEQ ID NO: 876137 - RNA, 24 nt, Human
cgagaccauccuggccaauguggu

SEQ ID NO: 876138 - RNA, 20 nt, Human
cgaggaugggggccuaggac

SEQ ID NO: 876139 - RNA, 20 nt, Human
cgaggaugggggccuaggac

SEQ ID NO: 876140 - RNA, 20 nt, Human
cucacgccuguaaucccagc

SEQ ID NO: 876141 - RNA, 24 nt, Human
cucacgccuguaaucccagcgcuu

SEQ ID NO: 876142 - RNA, 23 nt, Human
cucuuuggcagcaaguucuucca

SEQ ID NO: 876143 - RNA, 18 nt, Human
cugaguucuaaagaaaaa

SEQ ID NO: 876144 - RNA, 23 nt, Human
cuuuuaguuucuuugccuuuggg

SEQ ID NO: 876145 - RNA, 22 nt, Human
gaaaggcuucuugaaccucuuu

SEQ ID NO: 876146 - RNA, 24 nt, Human
gacagagugagacugugucucaaa

SEQ ID NO: 876147 - RNA, 20 nt, Human
gacccugugagacacugcuu

SEQ ID NO: 876148 - RNA, 20 nt, Human
gagaagucuccacugcucuu

SEQ ID NO: 876149 - RNA, 23 nt, Human
gagaauuacuugaaccugggagg

SEQ ID NO: 876150 - RNA, 20 nt, Human
gagaucgugccacugcacuc

SEQ ID NO: 876151 - RNA, 18 nt, Human
gaggaugggggccuagga

SEQ ID NO: 876152 - RNA, 23 nt, Human
gagguggguggaucacgagguug

SEQ ID NO: 876153 - RNA, 22 nt, Human
gcaaguucuuccaaagccugga

SEQ ID NO: 876154 - RNA, 23 nt, Human
gcacucuagccuggugacagagu

SEQ ID NO: 876155 - RNA, 24 nt, Human
gccaauguggugaaaccccaucuc

SEQ ID NO: 876156 - RNA, 20 nt, Human
gccacugcacucuagccugg

SEQ ID NO: 876157 - RNA, 20 nt, Human
gcugagaucgugccacugca

SEQ ID NO: 876158 - RNA, 19 nt, Human
gcuuggcgcgguggcucac

SEQ ID NO: 876159 - RNA, 21 nt, Human
ggacagcacuauggguguggu

SEQ ID NO: 876160 - RNA, 21 nt, Human
ggaguauggcaaaccauaggc

SEQ ID NO: 876161 - RNA, 23 nt, Human
ggagugagcagaucuuugccuug

SEQ ID NO: 876162 - RNA, 23 nt, Human
ggccaaucuucaaugagucauuu

SEQ ID NO: 876163 - RNA, 23 nt, Human
ggcgcgguggcucacgccuguaa

SEQ ID NO: 876164 - RNA, 21 nt, Human
ggcucacgccuguaaucccag

SEQ ID NO: 876165 - RNA, 25 nt, Human
gggcaggagccaggucagaaaggga

SEQ ID NO: 876166 - RNA, 19 nt, Human
gggcuaaagaaaacacugg

SEQ ID NO: 876167 - RNA, 23 nt, Human
gguggcucacgccuguaauccca

SEQ ID NO: 876168 - RNA, 24 nt, Human
gguggcucacgccuguaaucccag

SEQ ID NO: 876169 - RNA, 20 nt, Human
guaccagaauuuccuggaua

SEQ ID NO: 876170 - RNA, 21 nt, Human
gucucaaaaaaaaaaaaaaag

SEQ ID NO: 876171 - RNA, 24 nt, Human
guugcagugagcugagaucgugcc

SEQ ID NO: 876172 - RNA, 19 nt, Human
uaaauggggcugugucucu

SEQ ID NO: 876173 - RNA, 19 nt, Human
uaagcagccaugcuugugc

SEQ ID NO: 876174 - RNA, 20 nt, Human
uacagaaaaaaacuauacua

SEQ ID NO: 876175 - RNA, 22 nt, Human
uagcugggcgugguggcacgug

SEQ ID NO: 876176 - RNA, 23 nt, Human
uaggcugggucaugccccaacuc

SEQ ID NO: 876177 - RNA, 19 nt, Human
ucaaaaaaaaaaaaaaaga

SEQ ID NO: 876178 - RNA, 23 nt, Human
ucaaagcucaggcuuuuacuuag

SEQ ID NO: 876179 - RNA, 22 nt, Human
ucaagcucuucaagaagccuca

SEQ ID NO: 876180 - RNA, 20 nt, Human
ucacacacauauauuggggu

SEQ ID NO: 876181 - RNA, 22 nt, Human
ucacgagguugagaucgagacc

SEQ ID NO: 876182 - RNA, 22 nt, Human
ucacgccuguaaucccagcgcu

SEQ ID NO: 876183 - RNA, 22 nt, Human
uccaaugucaucaggaugggcc

SEQ ID NO: 876184 - RNA, 21 nt, Human
uccccagagggcuggguccac

SEQ ID NO: 876185 - RNA, 21 nt, Human
uccuggauauuuaacuaugug

SEQ ID NO: 876186 - RNA, 19 nt, Human
ucuaaagaaaaaugcagac

SEQ ID NO: 876187 - RNA, 23 nt, Human
ucuagccuggugacagagugaga

SEQ ID NO: 876188 - RNA, 19 nt, Human
ucucaaaaaaaaaaaaaaa

SEQ ID NO: 876189 - RNA, 20 nt, Human
ucucaacacgaugagacccu

SEQ ID NO: 876190 - RNA, 21 nt, Human
ucucugcuaaaaauacaaaaa

SEQ ID NO: 876191 - RNA, 23 nt, Human
ucucuugucucuuugagucucca

SEQ ID NO: 876192 - RNA, 22 nt, Human
ucucuuuggcagcaaguucuuc

SEQ ID NO: 876193 - RNA, 25 nt, Human
ucuucaagcucuucaagaagccuca

SEQ ID NO: 876194 - RNA, 18 nt, Human
ucuugggacaccaauggg

SEQ ID NO: 876195 - RNA, 18 nt, Human
ugaaaaaacggagaaaaa

SEQ ID NO: 876196 - RNA, 19 nt, Human
ugaaaaaacggagaaaaag

SEQ ID NO: 876197 - RNA, 24 nt, Human
ugaaccugggaggcagagguugca

SEQ ID NO: 876198 - RNA, 19 nt, Human
ugacaugaaagggugaugc

SEQ ID NO: 876199 - RNA, 22 nt, Human
ugagcugagaucgugccacugc

SEQ ID NO: 876200 - RNA, 21 nt, Human
ugaggaaacugaggcucaaag

SEQ ID NO: 876201 - RNA, 24 nt, Human
ugaggaaacugaggcucaaagaca

SEQ ID NO: 876202 - RNA, 20 nt, Human
ugaggcaggagaauuacuug

SEQ ID NO: 876203 - RNA, 24 nt, Human
ugaggcaggagaauuacuugaacc

SEQ ID NO: 876204 - RNA, 25 nt, Human
ugaggcaggagaauuacuugaaccu

SEQ ID NO: 876205 - RNA, 19 nt, Human
ugagggacuuacagaaaaa

SEQ ID NO: 876206 - RNA, 20 nt, Human
ugcagugugagaaaggcuuc

SEQ ID NO: 876207 - RNA, 18 nt, Human
ugcccuggaccuuggggg

SEQ ID NO: 876208 - RNA, 19 nt, Human
ugcccuggaccuugggggc

SEQ ID NO: 876209 - RNA, 24 nt, Human
ugccuguagucccagcuacuuggg

SEQ ID NO: 876210 - RNA, 19 nt, Human
ugccuuggauccuaaccag

SEQ ID NO: 876211 - RNA, 21 nt, Human
ugccuuggauccuaaccaggu

SEQ ID NO: 876212 - RNA, 21 nt, Human
ugccuuuggggauagaagcua

SEQ ID NO: 876213 - RNA, 23 nt, Human
ugcgaggaugggggccuaggacu

SEQ ID NO: 876214 - RNA, 25 nt, Human
uggaaaugagaauuccugcucucaa

SEQ ID NO: 876215 - RNA, 24 nt, Human
uggccaauguggugaaaccccauc

SEQ ID NO: 876216 - RNA, 22 nt, Human
uggcuaccauauuggacagcac

SEQ ID NO: 876217 - RNA, 22 nt, Human
uggcucacgccuguaaucccag

SEQ ID NO: 876218 - RNA, 23 nt, Human
uggcucacgccuguaaucccagc

SEQ ID NO: 876219 - RNA, 19 nt, Human
ugggagaccgaggugggug

SEQ ID NO: 876220 - RNA, 24 nt, Human
ugggagaccgagguggguggauca

SEQ ID NO: 876221 - RNA, 24 nt, Human
ugggaggcagagguugcagugagc

SEQ ID NO: 876222 - RNA, 19 nt, Human
ugggaggcugaggcaggag

SEQ ID NO: 876223 - RNA, 22 nt, Human
ugggaggcugaggcaggagaau

SEQ ID NO: 876224 - RNA, 23 nt, Human
ugggggaagaagguccugggucg

SEQ ID NO: 876225 - RNA, 21 nt, Human
ugggggccuaggacuauuggg

SEQ ID NO: 876226 - RNA, 18 nt, Human
uggugaaaccccaucucu

SEQ ID NO: 876227 - RNA, 24 nt, Human
ugguggcacgugccuguaguccca

SEQ ID NO: 876228 - RNA, 25 nt, Human
uguaaauggggcugugucucuuuca

SEQ ID NO: 876229 - RNA, 19 nt, Human
uguuauuacauaagaauga

SEQ ID NO: 876230 - RNA, 25 nt, Human
uguucagguacuuguaggugcagcc

SEQ ID NO: 876231 - RNA, 23 nt, Human
uguuccauaucuguaccguccaa

SEQ ID NO: 876232 - RNA, 22 nt, Human
uguuuuauauuagacccuuuca

SEQ ID NO: 876233 - RNA, 21 nt, Human
uuaagcccaugacaacguugg

SEQ ID NO: 876234 - RNA, 24 nt, Human
uuacuugaaccugggaggcagagg

SEQ ID NO: 876235 - RNA, 20 nt, Human
uuagcugggcgugguggcac

SEQ ID NO: 876236 - RNA, 20 nt, Human
uuagcugggcgugguggcac

SEQ ID NO: 876237 - RNA, 24 nt, Human
uuagcugggcgugguggcacgugc

SEQ ID NO: 876238 - RNA, 19 nt, Human
uuauagaaguguuguccaa

SEQ ID NO: 876239 - RNA, 19 nt, Human
uucaauagucacacacaua

SEQ ID NO: 876240 - RNA, 21 nt, Human
uucauuuaaucucuguaauga

SEQ ID NO: 876241 - RNA, 21 nt, Human
uuccuagcuguuuuggauugg

SEQ ID NO: 876242 - RNA, 24 nt, Human
uugaaccugggaggcagagguugc

SEQ ID NO: 876243 - RNA, 18 nt, Human
uugcagugagcugagauc

SEQ ID NO: 876244 - RNA, 22 nt, Human
uugcagugagcugagaucgugc

SEQ ID NO: 876245 - RNA, 23 nt, Human
uugggaggcugaggcaggagaau

SEQ ID NO: 876246 - RNA, 19 nt, Human
uuuugggggaagaaggucc

SEQ ID NO: 876247 - RNA, 21 nt, Human
aaagaaaagucagggcccaag

SEQ ID NO: 876248 - RNA, 23 nt, Human
aagaaggcacaaagguaggagca

SEQ ID NO: 876249 - RNA, 19 nt, Human
aaucucguucucucgucac

SEQ ID NO: 876250 - RNA, 25 nt, Human
acacugaaaacagaggcagagacau

SEQ ID NO: 876251 - RNA, 22 nt, Human
agaggcagagacauguacucug

SEQ ID NO: 876252 - RNA, 19 nt, Human
agccaugagggaaggaccc

SEQ ID NO: 876253 - RNA, 23 nt, Human
agcucguuugcuuucuaggcugg

SEQ ID NO: 876254 - RNA, 19 nt, Human
aggugaaagcaagguagca

SEQ ID NO: 876255 - RNA, 24 nt, Human
caagaaggcacaaagguaggagca

SEQ ID NO: 876256 - RNA, 22 nt, Human
cagaacggcagccccaaggccc

SEQ ID NO: 876257 - RNA, 21 nt, Human
cagagccucaagagccaggag

SEQ ID NO: 876258 - RNA, 22 nt, Human
cagcaccaguggaagcucagcu

SEQ ID NO: 876259 - RNA, 21 nt, Human
cagcagcaccaguggaagcuc

SEQ ID NO: 876260 - RNA, 22 nt, Human
cagcagcaccaguggaagcuca

SEQ ID NO: 876261 - RNA, 19 nt, Human
caucauuuucccuggaacc

SEQ ID NO: 876262 - RNA, 24 nt, Human
ccaaagccacacugaaaacagagg

SEQ ID NO: 876263 - RNA, 27 nt, Human
ccacacugaaaacagaggcagagacau

SEQ ID NO: 876264 - RNA, 23 nt, Human
ccaccugggcugucagccaugag

SEQ ID NO: 876265 - RNA, 21 nt, Human
ccaucucuguaccuucucaca

SEQ ID NO: 876266 - RNA, 19 nt, Human
cccaaggcccggagugucc

SEQ ID NO: 876267 - RNA, 22 nt, Human
cccggaguguccaggggcuucu

SEQ ID NO: 876268 - RNA, 24 nt, Human
cccugccgucucgccuggcgccca

SEQ ID NO: 876269 - RNA, 21 nt, Human
ccgcacacucagaacggcagc

SEQ ID NO: 876270 - RNA, 23 nt, Human
ccuggcagugauccuuuucuuug

SEQ ID NO: 876271 - RNA, 19 nt, Human
cggcagccccaaggcccgg

SEQ ID NO: 876272 - RNA, 21 nt, Human
cuccagagccucaagagccag

SEQ ID NO: 876273 - RNA, 24 nt, Human
cuccagagccucaagagccaggag

SEQ ID NO: 876274 - RNA, 22 nt, Human
cuguggccucaaccucccagac

SEQ ID NO: 876275 - RNA, 21 nt, Human
cuuguguauuggaaaaccugu

SEQ ID NO: 876276 - RNA, 22 nt, Human
gagccccauucccacaggcggg

SEQ ID NO: 876277 - RNA, 19 nt, Human
ggaaaaccuguauggcagu

SEQ ID NO: 876278 - RNA, 20 nt, Human
ggacuaaacuguagcaauuc

SEQ ID NO: 876279 - RNA, 26 nt, Human
ggcccggaguguccaggggcuucugg

SEQ ID NO: 876280 - RNA, 20 nt, Human
ggccucaaccucccagacag

SEQ ID NO: 876281 - RNA, 23 nt, Human
gggcuucuggccugaggugaauc

SEQ ID NO: 876282 - RNA, 24 nt, Human
uacacuguggccucaaccucccag

SEQ ID NO: 876283 - RNA, 21 nt, Human
uaccagucuauacacuguggc

SEQ ID NO: 876284 - RNA, 23 nt, Human
ucaagagccaggagagggcacag

SEQ ID NO: 876285 - RNA, 21 nt, Human
ucagugucucuucugggcucc

SEQ ID NO: 876286 - RNA, 21 nt, Human
uccaaagccacacugaaaaca

SEQ ID NO: 876287 - RNA, 19 nt, Human
uccaggggcuucuggccug

SEQ ID NO: 876288 - RNA, 24 nt, Human
ucccucuugcuuuauagcuagcug

SEQ ID NO: 876289 - RNA, 24 nt, Human
ucucuuguccucagugucucuucu

SEQ ID NO: 876290 - RNA, 23 nt, Human
ucuuuguagccaccugggcuguc

SEQ ID NO: 876291 - RNA, 21 nt, Human
ugaggugaaucugccaggccc

SEQ ID NO: 876292 - RNA, 21 nt, Human
ugauagacucaugauggaaac

SEQ ID NO: 876293 - RNA, 18 nt, Human
ugccaggcccaagaaggc

SEQ ID NO: 876294 - RNA, 19 nt, Human
ugccaggcccaagaaggca

SEQ ID NO: 876295 - RNA, 21 nt, Human
uggaaccuggucacugacuaa

SEQ ID NO: 876296 - RNA, 21 nt, Human
uggcuggagaggugggagcuc

SEQ ID NO: 876297 - RNA, 22 nt, Human
uggugugaucucuuguccucag

SEQ ID NO: 876298 - RNA, 22 nt, Human
uguccaaagccacacugaaaac

SEQ ID NO: 876299 - RNA, 18 nt, Human
uguggccucaaccuccca

SEQ ID NO: 876300 - RNA, 22 nt, Human
uguguauuggaaaaccuguaug

SEQ ID NO: 876301 - RNA, 20 nt, Human
uuccuguccaaagccacacu

SEQ ID NO: 876302 - RNA, 24 nt, Human
uuggaccaccacaugacaucauuu

SEQ ID NO: 876303 - RNA, 25 nt, Human
uuggaccaccacaugacaucauuuu

SEQ ID NO: 876304 - RNA, 22 nt, Human
uuuuuuuuuucauuggggaauu

SEQ ID NO: 876305 - RNA, 23 nt, Human
uuuuuuuuuuuuuuuucauuggg

SEQ ID NO: 876306 - RNA, 24 nt, Human
aaagugcugggauuacaggcguga

SEQ ID NO: 876307 - RNA, 19 nt, Human
aagugcugggauuacaggc

SEQ ID NO: 876308 - RNA, 19 nt, Human
aagugcugggauuacaggc

SEQ ID NO: 876309 - RNA, 26 nt, Human
aagugcugggauuacaggcgugagcc

SEQ ID NO: 876310 - RNA, 20 nt, Human
acaggguuucacccugcuag

SEQ ID NO: 876311 - RNA, 19 nt, Human
acccugcuagccaggaugg

SEQ ID NO: 876312 - RNA, 26 nt, Human
agagaaaaaauuuauguauccuuaau

SEQ ID NO: 876313 - RNA, 18 nt, Human
agugcugggauuacaggc

SEQ ID NO: 876314 - RNA, 24 nt, Human
augauccacccaccucggccuccc

SEQ ID NO: 876315 - RNA, 24 nt, Human
caaagugcugggauuacaggcgug

SEQ ID NO: 876316 - RNA, 22 nt, Human
cacccaccucggccucccaaag

SEQ ID NO: 876317 - RNA, 23 nt, Human
cacccaccucggccucccaaagu

SEQ ID NO: 876318 - RNA, 24 nt, Human
cacccugcuagccaggauggucuc

SEQ ID NO: 876319 - RNA, 24 nt, Human
caccucggccucccaaagugcugg

SEQ ID NO: 876320 - RNA, 22 nt, Human
ccaaagugcugggauuacaggc

SEQ ID NO: 876321 - RNA, 22 nt, Human
ccaaagugcugggauuacaggc

SEQ ID NO: 876322 - RNA, 24 nt, Human
ccaaagugcugggauuacaggcgu

SEQ ID NO: 876323 - RNA, 22 nt, Human
ccugaccucaugauccacccac

SEQ ID NO: 876324 - RNA, 18 nt, Human
cuccugaccucaugaucc

SEQ ID NO: 876325 - RNA, 22 nt, Human
gaccucaugauccacccaccuc

SEQ ID NO: 876326 - RNA, 24 nt, Human
gaccucaugauccacccaccucgg

SEQ ID NO: 876327 - RNA, 18 nt, Human
gauuacaggcgugagcca

SEQ ID NO: 876328 - RNA, 22 nt, Human
gauuacaggcgugagccacugc

SEQ ID NO: 876329 - RNA, 23 nt, Human
gauuacaggcgugagccacugca

SEQ ID NO: 876330 - RNA, 22 nt, Human
gcacauauaccaaauaguuacc

SEQ ID NO: 876331 - RNA, 24 nt, Human
ggauggucucaaucuccugaccuc

SEQ ID NO: 876332 - RNA, 21 nt, Human
uaauauauacauacacauaua

SEQ ID NO: 876333 - RNA, 19 nt, Human
uacaggcgugagccacugc

SEQ ID NO: 876334 - RNA, 23 nt, Human
uacaggcgugagccacugcaccc

SEQ ID NO: 876335 - RNA, 22 nt, Human
uacauacacauauacauauacc

SEQ ID NO: 876336 - RNA, 19 nt, Human
uaguagggacaggguuuca

SEQ ID NO: 876337 - RNA, 23 nt, Human
uaguagggacaggguuucacccu

SEQ ID NO: 876338 - RNA, 21 nt, Human
uauacauauaccaucuugccc

SEQ ID NO: 876339 - RNA, 19 nt, Human
uauauacauacacauauac

SEQ ID NO: 876340 - RNA, 20 nt, Human
uauauacauacacauauaca

SEQ ID NO: 876341 - RNA, 20 nt, Human
uauauacauacacauauaca

SEQ ID NO: 876342 - RNA, 24 nt, Human
uauauacauacacauauacauaua

SEQ ID NO: 876343 - RNA, 23 nt, Human
uauguauccuuaauauauacaua

SEQ ID NO: 876344 - RNA, 24 nt, Human
ucacccugcuagccaggauggucu

SEQ ID NO: 876345 - RNA, 24 nt, Human
ucccaaagugcugggauuacaggc

SEQ ID NO: 876346 - RNA, 18 nt, Human
ucggccucccaaagugcu

SEQ ID NO: 876347 - RNA, 24 nt, Human
ugauccacccaccucggccuccca

SEQ ID NO: 876348 - RNA, 24 nt, Human
ugcugggauuacaggcgugagcca

SEQ ID NO: 876349 - RNA, 18 nt, Human
ugggauuacaggcgugag

SEQ ID NO: 876350 - RNA, 19 nt, Human
ugggauuacaggcgugagc

SEQ ID NO: 876351 - RNA, 21 nt, Human
ugggauuacaggcgugagcca

SEQ ID NO: 876352 - RNA, 22 nt, Human
ugggauuacaggcgugagccac

SEQ ID NO: 876353 - RNA, 22 nt, Human
ugggauuacaggcgugagccac

SEQ ID NO: 876354 - RNA, 24 nt, Human
ugggauuacaggcgugagccacug

SEQ ID NO: 876355 - RNA, 26 nt, Human
ugggauuacaggcgugagccacugca

SEQ ID NO: 876356 - RNA, 18 nt, Human
uuaguagggacaggguuu

SEQ ID NO: 876357 - RNA, 24 nt, Human
uuuuuaguagggacaggguuucac

SEQ ID NO: 876358 - RNA, 21 nt, Human
uuuuuguauuuuuaguaggga

SEQ ID NO: 876359 - RNA, 19 nt, Human
uuuuuuguauuuuuaguag

SEQ ID NO: 876360 - RNA, 24 nt, Human
uuuuuuguauuuuuaguagggaca

SEQ ID NO: 876361 - RNA, 24 nt, Human
uuuuuuuuguauuuuuaguaggga

SEQ ID NO: 876362 - RNA, 25 nt, Human
cagcacaugaucaauuguuugaugu

SEQ ID NO: 876363 - RNA, 26 nt, Human
cagucuagaacauauucugcaaagug

SEQ ID NO: 876364 - RNA, 19 nt, Human
gaauuccuuuacagcacau

SEQ ID NO: 876365 - RNA, 20 nt, Human
gugcuuauaaaacuuagcac

SEQ ID NO: 876366 - RNA, 19 nt, Human
uaauuuuaaauuuuaccac

SEQ ID NO: 876367 - RNA, 24 nt, Human
uacauaguauaaggaaaacuacag

SEQ ID NO: 876368 - RNA, 23 nt, Human
ugacacuaguauuaaauuaaaau

SEQ ID NO: 876369 - RNA, 23 nt, Human
uuaauacugaguuccauaaaaau

SEQ ID NO: 876370 - RNA, 21 nt, Human
uuuuuuuuuuuuuuuacuuaa

SEQ ID NO: 876371 - RNA, 18 nt, Human
aaaugauccaccgauaaa

SEQ ID NO: 876372 - RNA, 24 nt, Human
agccgagccuucggcagggacccg

SEQ ID NO: 876373 - RNA, 22 nt, Human
auguacuuuaaaguacagucau

SEQ ID NO: 876374 - RNA, 26 nt, Human
cccgugccccggcgcgcccaggugag

SEQ ID NO: 876375 - RNA, 21 nt, Human
cgacugcaaagguugccgccc

SEQ ID NO: 876376 - RNA, 24 nt, Human
cgagaaccgcgcugcuccucucuc

SEQ ID NO: 876377 - RNA, 20 nt, Human
cgcgcugcuccucucucuca

SEQ ID NO: 876378 - RNA, 21 nt, Human
cgugcagggcaggcgcgcggg

SEQ ID NO: 876379 - RNA, 20 nt, Human
cguucugcugucccggccga

SEQ ID NO: 876380 - RNA, 18 nt, Human
cucgaaaugauccaccga

SEQ ID NO: 876381 - RNA, 18 nt, Human
gcgcugcuccucucucuc

SEQ ID NO: 876382 - RNA, 21 nt, Human
gggcaggcgcgcgggucuccg

SEQ ID NO: 876383 - RNA, 20 nt, Human
gguggacagaagcagccgag

SEQ ID NO: 876384 - RNA, 22 nt, Human
gucuucauacugcaaacaauca

SEQ ID NO: 876385 - RNA, 19 nt, Human
uccaccgauaaaugaagaa

SEQ ID NO: 876386 - RNA, 24 nt, Human
ucuucauacugcaaacaaucacac

SEQ ID NO: 876387 - RNA, 21 nt, Human
ugaguugcuccagccacugga

SEQ ID NO: 876388 - RNA, 22 nt, Human
uggagcaucauuugggagcgaa

SEQ ID NO: 876389 - RNA, 22 nt, Human
ugucuucauacugcaaacaauc

SEQ ID NO: 876390 - RNA, 18 nt, Human
uuaaaauaaaggugguuu

SEQ ID NO: 876391 - RNA, 24 nt, Human
uucauacugcaaacaaucacacag

SEQ ID NO: 876392 - RNA, 22 nt, Human
uuuuuuuuuuuuuuuuuccuuu

SEQ ID NO: 876393 - RNA, 23 nt, Human
uuuuuuuuuuuuuuuuuuccuuu

SEQ ID NO: 876394 - RNA, 26 nt, Human
uuuuuuuuuuuuuuuuuuuccuuuaa

SEQ ID NO: 876395 - RNA, 19 nt, Human
aaaacauagcaccaaacau

SEQ ID NO: 876396 - RNA, 23 nt, Human
aaacacuagagaaacuucgagcc

SEQ ID NO: 876397 - RNA, 18 nt, Human
aacccaggccucggccca

SEQ ID NO: 876398 - RNA, 21 nt, Human
aagcccucuuugaaaugaccc

SEQ ID NO: 876399 - RNA, 18 nt, Human
acaauauaaaggcaaagc

SEQ ID NO: 876400 - RNA, 24 nt, Human
acaauauaaaggcaaagcaaauuu

SEQ ID NO: 876401 - RNA, 21 nt, Human
acccaggccucggcccaaaau

SEQ ID NO: 876402 - RNA, 19 nt, Human
acguagcagauagaaaacc

SEQ ID NO: 876403 - RNA, 24 nt, Human
agagaaacuucgagccaaaaauac

SEQ ID NO: 876404 - RNA, 22 nt, Human
aggugguggggaucuaccuggu

SEQ ID NO: 876405 - RNA, 20 nt, Human
aucaacuguucccaauaagc

SEQ ID NO: 876406 - RNA, 26 nt, Human
caaaaauacaugcugacuuucuagaa

SEQ ID NO: 876407 - RNA, 19 nt, Human
caagauaaaagccuuugac

SEQ ID NO: 876408 - RNA, 22 nt, Human
caauaccuuuaacuccagacac

SEQ ID NO: 876409 - RNA, 24 nt, Human
cacaaggguuacaauauaaaggca

SEQ ID NO: 876410 - RNA, 20 nt, Human
cacagcaaaugagaaacugc

SEQ ID NO: 876411 - RNA, 25 nt, Human
cacagccucauaagcccucuuugaa

SEQ ID NO: 876412 - RNA, 19 nt, Human
cagaaaacacuagagaaac

SEQ ID NO: 876413 - RNA, 19 nt, Human
cagauguguggaguaugcc

SEQ ID NO: 876414 - RNA, 24 nt, Human
caucuuuggucacagcguuaagag

SEQ ID NO: 876415 - RNA, 23 nt, Human
cauuagacaaaauuauuuaaagu

SEQ ID NO: 876416 - RNA, 22 nt, Human
ccaauaccuuuaacuccagaca

SEQ ID NO: 876417 - RNA, 23 nt, Human
ccccaaccgcgcacuugcugcuu

SEQ ID NO: 876418 - RNA, 23 nt, Human
ccucccgaccucagcccuccaac

SEQ ID NO: 876419 - RNA, 23 nt, Human
ccuuuaacuccagacaccauguu

SEQ ID NO: 876420 - RNA, 21 nt, Human
cgaccucagcccuccaacucc

SEQ ID NO: 876421 - RNA, 19 nt, Human
cuagagcucuguacacacc

SEQ ID NO: 876422 - RNA, 21 nt, Human
cuagagcucuguacacaccac

SEQ ID NO: 876423 - RNA, 24 nt, Human
cucacauggcaacaaucauggauu

SEQ ID NO: 876424 - RNA, 25 nt, Human
cucgcaguggccccaaccgcgcacu

SEQ ID NO: 876425 - RNA, 18 nt, Human
cucucacauggcaacaau

SEQ ID NO: 876426 - RNA, 20 nt, Human
cucuguacacaccacccucc

SEQ ID NO: 876427 - RNA, 24 nt, Human
cugauuuuaaagaaaaaucacaug

SEQ ID NO: 876428 - RNA, 24 nt, Human
gaaaacacuagagaaacuucgagc

SEQ ID NO: 876429 - RNA, 21 nt, Human
gaauuccauguugugauuucu

SEQ ID NO: 876430 - RNA, 18 nt, Human
gcaguggccccaaccgcg

SEQ ID NO: 876431 - RNA, 26 nt, Human
gccccaaccgcgcacuugcugcuugu

SEQ ID NO: 876432 - RNA, 21 nt, Human
gccgaccuccuccaaccgugc

SEQ ID NO: 876433 - RNA, 18 nt, Human
guggaguaugccaauacc

SEQ ID NO: 876434 - RNA, 23 nt, Human
guggaguaugccaauaccuuuaa

SEQ ID NO: 876435 - RNA, 25 nt, Human
uaaaacucucacauggcaacaauca

SEQ ID NO: 876436 - RNA, 22 nt, Human
uaaaagccuugguaaugaccau

SEQ ID NO: 876437 - RNA, 21 nt, Human
uaaccuuuaaaacucucacau

SEQ ID NO: 876438 - RNA, 21 nt, Human
uaagauaaaaaccauuacuug

SEQ ID NO: 876439 - RNA, 22 nt, Human
uaagcgaucacucaagaauggu

SEQ ID NO: 876440 - RNA, 22 nt, Human
uacaauauaaaggcaaagcaaa

SEQ ID NO: 876441 - RNA, 25 nt, Human
uaccuuuaacuccagacaccauguu

SEQ ID NO: 876442 - RNA, 20 nt, Human
uacuacaaacugcuugguua

SEQ ID NO: 876443 - RNA, 25 nt, Human
uaggguccuuuuuacuguagguggu

SEQ ID NO: 876444 - RNA, 19 nt, Human
uauguagcauuagacaaaa

SEQ ID NO: 876445 - RNA, 22 nt, Human
ucccgaccucagcccuccaacu

SEQ ID NO: 876446 - RNA, 24 nt, Human
uccuagagcucuguacacaccacc

SEQ ID NO: 876447 - RNA, 21 nt, Human
ucgcaguggccccaaccgcgc

SEQ ID NO: 876448 - RNA, 24 nt, Human
ucuaaaacggccucgcaguggccc

SEQ ID NO: 876449 - RNA, 18 nt, Human
ucuagaaauaguguaaag

SEQ ID NO: 876450 - RNA, 19 nt, Human
ugaaaugacccauacaaau

SEQ ID NO: 876451 - RNA, 21 nt, Human
ugaaugaguucaaaucacauu

SEQ ID NO: 876452 - RNA, 18 nt, Human
ugagucccuagaacgagc

SEQ ID NO: 876453 - RNA, 22 nt, Human
ugaguuaacucuacuacaaacu

SEQ ID NO: 876454 - RNA, 18 nt, Human
ugaguucaaaucacauuc

SEQ ID NO: 876455 - RNA, 23 nt, Human
uggagucaaaagauuuaucuuca

SEQ ID NO: 876456 - RNA, 21 nt, Human
uggggaucuaccugguucuca

SEQ ID NO: 876457 - RNA, 21 nt, Human
uguacagugagugaacaugaa

SEQ ID NO: 876458 - RNA, 24 nt, Human
uguggaguaugccaauaccuuuaa

SEQ ID NO: 876459 - RNA, 22 nt, Human
uucacauuuuauuuguauugca

SEQ ID NO: 876460 - RNA, 22 nt, Human
uuguaacccaggccucggccca

SEQ ID NO: 876461 - RNA, 27 nt, Human
uuuaggguccuuuuuacuguagguggu

SEQ ID NO: 876462 - RNA, 23 nt, Human
uuuuuuaauuguguauauguagc

SEQ ID NO: 876463 - RNA, 27 nt, Human
uuuuuuuuuuuuuuuuuuuuuuugggg

SEQ ID NO: 876464 - RNA, 18 nt, Human
aauaagccacauacuuag

SEQ ID NO: 876465 - RNA, 18 nt, Human
aaugauccccacagugau

SEQ ID NO: 876466 - RNA, 21 nt, Human
acagugaugaggggucagcac

SEQ ID NO: 876467 - RNA, 19 nt, Human
accagcagcgccgcaggcc

SEQ ID NO: 876468 - RNA, 19 nt, Human
accauaauacaauagaaca

SEQ ID NO: 876469 - RNA, 18 nt, Human
agggcccagucccaccuc

SEQ ID NO: 876470 - RNA, 22 nt, Human
caagcugcuggaacagcugggg

SEQ ID NO: 876471 - RNA, 18 nt, Human
cacacagccucaaccagc

SEQ ID NO: 876472 - RNA, 19 nt, Human
cacagcuccgccucuccuc

SEQ ID NO: 876473 - RNA, 29 nt, Human
cacagcuccgccucuccuccagccccucu

SEQ ID NO: 876474 - RNA, 18 nt, Human
cagaggggcugaggggug

SEQ ID NO: 876475 - RNA, 21 nt, Human
cagcagcgccgcaggcguggc

SEQ ID NO: 876476 - RNA, 19 nt, Human
cagugaugaggggucagca

SEQ ID NO: 876477 - RNA, 18 nt, Human
cauggaauaagccacaua

SEQ ID NO: 876478 - RNA, 21 nt, Human
ccaagacuauuuuccugcgcc

SEQ ID NO: 876479 - RNA, 21 nt, Human
cccacacagccucaaccagca

SEQ ID NO: 876480 - RNA, 27 nt, Human
cccguccccgacccacacagccucaac

SEQ ID NO: 876481 - RNA, 23 nt, Human
cgccagacaagcugcuggaacag

SEQ ID NO: 876482 - RNA, 19 nt, Human
gacaccauaauacaauaga

SEQ ID NO: 876483 - RNA, 19 nt, Human
gaggacagaggggcugagg

SEQ ID NO: 876484 - RNA, 22 nt, Human
gcuccgccucuccuccagcccc

SEQ ID NO: 876485 - RNA, 24 nt, Human
uauuacaaaaauaauuacauggaa

SEQ ID NO: 876486 - RNA, 19 nt, Human
ucccgggggaucuucacac

SEQ ID NO: 876487 - RNA, 19 nt, Human
uccugcgccucaucugccc

SEQ ID NO: 876488 - RNA, 25 nt, Human
ucggacaccauaauacaauagaacc

SEQ ID NO: 876489 - RNA, 24 nt, Human
ugaaauccaugaaaacaguuacau

SEQ ID NO: 876490 - RNA, 20 nt, Human
ugacgccagacaagcugcug

SEQ ID NO: 876491 - RNA, 23 nt, Human
uuacccaucauauuuaacauuuc

SEQ ID NO: 876492 - RNA, 23 nt, Human
uucggacaccauaauacaauaga

SEQ ID NO: 876493 - RNA, 19 nt, Human
aaaaacuaagaacaaaagc

SEQ ID NO: 876494 - RNA, 20 nt, Human
aaaaacuaagaacaaaagca

SEQ ID NO: 876495 - RNA, 20 nt, Human
aaaaacuaagaacaaaagca

SEQ ID NO: 876496 - RNA, 21 nt, Human
aaaacacagggacuggacagc

SEQ ID NO: 876497 - RNA, 19 nt, Human
aaacagaaacacauaguug

SEQ ID NO: 876498 - RNA, 24 nt, Human
aaacagaaacaguaauuucugaau

SEQ ID NO: 876499 - RNA, 20 nt, Human
aaagaacucaauacaaaguc

SEQ ID NO: 876500 - RNA, 21 nt, Human
aaauggaggcaaaggcagccc

SEQ ID NO: 876501 - RNA, 19 nt, Human
aagaggaagggggagagag

SEQ ID NO: 876502 - RNA, 21 nt, Human
aaguugcaccugccaauccca

SEQ ID NO: 876503 - RNA, 21 nt, Human
acacuugccaucucuuacccc

SEQ ID NO: 876504 - RNA, 23 nt, Human
acaugccagagcaaaugaaucca

SEQ ID NO: 876505 - RNA, 22 nt, Human
agacagaccacagaugaaucuu

SEQ ID NO: 876506 - RNA, 18 nt, Human
agagagaaaauaaauucu

SEQ ID NO: 876507 - RNA, 18 nt, Human
agcccagugcaagagguc

SEQ ID NO: 876508 - RNA, 19 nt, Human
agcccagugcaagaggucc

SEQ ID NO: 876509 - RNA, 23 nt, Human
agcuccccugcagcagggcuccg

SEQ ID NO: 876510 - RNA, 19 nt, Human
agggacuggacagcagcag

SEQ ID NO: 876511 - RNA, 25 nt, Human
aguugaauaguacaucuuggcuccc

SEQ ID NO: 876512 - RNA, 23 nt, Human
auggugaugaacagugucauuau

SEQ ID NO: 876513 - RNA, 18 nt, Human
augguuccaugguaugug

SEQ ID NO: 876514 - RNA, 19 nt, Human
augguuccaugguaugugu

SEQ ID NO: 876515 - RNA, 18 nt, Human
caaaaagaacucaauaca

SEQ ID NO: 876516 - RNA, 18 nt, Human
caaaauauuuccugagaa

SEQ ID NO: 876517 - RNA, 21 nt, Human
caaaggcagcccagugcaaga

SEQ ID NO: 876518 - RNA, 21 nt, Human
caaagucaauauaaaaaaauc

SEQ ID NO: 876519 - RNA, 26 nt, Human
caaaugaauccagcuuaaccccuucu

SEQ ID NO: 876520 - RNA, 18 nt, Human
caaccucugacacagccc

SEQ ID NO: 876521 - RNA, 22 nt, Human
caccuauggguucccccuuccu

SEQ ID NO: 876522 - RNA, 18 nt, Human
caccugccaaucccagag

SEQ ID NO: 876523 - RNA, 20 nt, Human
cacuugccaucucuuacccc

SEQ ID NO: 876524 - RNA, 21 nt, Human
cagcaagauggcugauuaccg

SEQ ID NO: 876525 - RNA, 19 nt, Human
cagcaguugccagcguggu

SEQ ID NO: 876526 - RNA, 23 nt, Human
cagcccagugcaagagguccgga

SEQ ID NO: 876527 - RNA, 19 nt, Human
cagugucugcucccccagg

SEQ ID NO: 876528 - RNA, 24 nt, Human
ccacaccuauggguucccccuucc

SEQ ID NO: 876529 - RNA, 21 nt, Human
cccagggccaggggaaagccc

SEQ ID NO: 876530 - RNA, 25 nt, Human
cccccagggccaggggaaagcccac

SEQ ID NO: 876531 - RNA, 19 nt, Human
cccccuuccuucuucucca

SEQ ID NO: 876532 - RNA, 21 nt, Human
ccccugcagcagggcuccgcc

SEQ ID NO: 876533 - RNA, 18 nt, Human
cccuacucucccuucccc

SEQ ID NO: 876534 - RNA, 24 nt, Human
cccuuccuucuucuccagcauguc

SEQ ID NO: 876535 - RNA, 26 nt, Human
cccuuccuucuucuccagcaugucuu

SEQ ID NO: 876536 - RNA, 20 nt, Human
ccuguacuacagcaagaugg

SEQ ID NO: 876537 - RNA, 19 nt, Human
cuauggguucccccuuccu

SEQ ID NO: 876538 - RNA, 19 nt, Human
cucacacuugccaucucuu

SEQ ID NO: 876539 - RNA, 20 nt, Human
cuccccugcagcagggcucc

SEQ ID NO: 876540 - RNA, 21 nt, Human
cuggaaaaagcaagagugaac

SEQ ID NO: 876541 - RNA, 22 nt, Human
cuguguuuaacagacagaccac

SEQ ID NO: 876542 - RNA, 21 nt, Human
gagcuccccugcagcagggcu

SEQ ID NO: 876543 - RNA, 25 nt, Human
gcaaaaacuaagaacaaaagcacca

SEQ ID NO: 876544 - RNA, 24 nt, Human
gcagcaguugccagcgugguuggc

SEQ ID NO: 876545 - RNA, 24 nt, Human
ggauggcuccucugcccacaaccc

SEQ ID NO: 876546 - RNA, 20 nt, Human
gggcuccugaaggagcuccc

SEQ ID NO: 876547 - RNA, 18 nt, Human
guagaguguccauuuucc

SEQ ID NO: 876548 - RNA, 20 nt, Human
gucuccuuuggcagggcagc

SEQ ID NO: 876549 - RNA, 20 nt, Human
guuuggucuccuuuggcagg

SEQ ID NO: 876550 - RNA, 20 nt, Human
guuuguugcagauacaggaa

SEQ ID NO: 876551 - RNA, 24 nt, Human
uaacggcaaaaacuaagaacaaaa

SEQ ID NO: 876552 - RNA, 21 nt, Human
ucagcaacuaagagugggagc

SEQ ID NO: 876553 - RNA, 21 nt, Human
ucagcuguguuuaacagacag

SEQ ID NO: 876554 - RNA, 18 nt, Human
uccaguuugaagggaucu

SEQ ID NO: 876555 - RNA, 22 nt, Human
uccccaaacucuguagaguguc

SEQ ID NO: 876556 - RNA, 22 nt, Human
ucccccagggccaggggaaagc

SEQ ID NO: 876557 - RNA, 19 nt, Human
ucccuacucucccuucccc

SEQ ID NO: 876558 - RNA, 21 nt, Human
ucccuacucucccuuccccaa

SEQ ID NO: 876559 - RNA, 20 nt, Human
uccgccaggauggcuccucu

SEQ ID NO: 876560 - RNA, 24 nt, Human
uccgccaggauggcuccucugccc

SEQ ID NO: 876561 - RNA, 18 nt, Human
uccugcauuuuauuuugu

SEQ ID NO: 876562 - RNA, 24 nt, Human
uccuucuucuccagcaugucuuuu

SEQ ID NO: 876563 - RNA, 20 nt, Human
ucucuuaccccauuucccaa

SEQ ID NO: 876564 - RNA, 22 nt, Human
ucucuuaccccauuucccaaaa

SEQ ID NO: 876565 - RNA, 24 nt, Human
ucugcccacaacccagucaguguc

SEQ ID NO: 876566 - RNA, 20 nt, Human
ugcacagugacgguggucag

SEQ ID NO: 876567 - RNA, 19 nt, Human
uggcagaggcgaugaguug

SEQ ID NO: 876568 - RNA, 21 nt, Human
uggcuccucugcccacaaccc

SEQ ID NO: 876569 - RNA, 18 nt, Human
ugggagaaagaggaaggg

SEQ ID NO: 876570 - RNA, 22 nt, Human
ugguauguguuuuuuauaaaca

SEQ ID NO: 876571 - RNA, 22 nt, Human
uguauccaugacguagcaaccu

SEQ ID NO: 876572 - RNA, 19 nt, Human
uugaagggaucuaacggca

SEQ ID NO: 876573 - RNA, 18 nt, Human
uuggucuccuuuggcagg

SEQ ID NO: 876574 - RNA, 22 nt, Human
uuuaucagcaacuaagaguggg

SEQ ID NO: 876575 - RNA, 23 nt, Human
uuuuuuuuuuuuuaaaggcuuua

SEQ ID NO: 876576 - RNA, 22 nt, Human
uuuuuuuuuuuuuuuuuaaagg

SEQ ID NO: 876577 - RNA, 31 nt, Human
acacagaugaaccaagcagacgaaaccagag

SEQ ID NO: 876578 - RNA, 21 nt, Human
agacgaaaccagauuaggaaa

SEQ ID NO: 876579 - RNA, 21 nt, Human
gaaccaagcagacgaaaccag

SEQ ID NO: 876580 - RNA, 19 nt, Human
uaaacacaaauucuaaaag

SEQ ID NO: 876581 - RNA, 21 nt, Human
ugaaccaagcagacgaaacca

SEQ ID NO: 876582 - RNA, 24 nt, Human
uguuuuguuuuauuuauucacuua

SEQ ID NO: 876583 - RNA, 21 nt, Human
uguuuuguuuuguuuuauuua

SEQ ID NO: 876584 - RNA, 18 nt, Human
uuuguuuuguuuuguuuu

SEQ ID NO: 876585 - RNA, 22 nt, Human
auccuccucaucuccaccccca

SEQ ID NO: 876586 - RNA, 20 nt, Human
caucuccacccccacggagg

SEQ ID NO: 876587 - RNA, 21 nt, Human
cuccucaucuccacccccacg

SEQ ID NO: 876588 - RNA, 24 nt, Human
ggaagaugcuggaggaagacaccc

SEQ ID NO: 876589 - RNA, 19 nt, Human
ucagugcuggggccucuuc

SEQ ID NO: 876590 - RNA, 19 nt, Human
aaaaugaugcauaauuucu

SEQ ID NO: 876591 - RNA, 20 nt, Human
aacuggccuuaagcaaaagu

SEQ ID NO: 876592 - RNA, 25 nt, Human
aagcaaaagucugaaaccuaggccg

SEQ ID NO: 876593 - RNA, 21 nt, Human
acuggccuuaagcaaaagucu

SEQ ID NO: 876594 - RNA, 19 nt, Human
aucaccuuucaucggagug

SEQ ID NO: 876595 - RNA, 24 nt, Human
augggucccaaagaaacuaacacu

SEQ ID NO: 876596 - RNA, 22 nt, Human
caaaagucugaaaccuaggcug

SEQ ID NO: 876597 - RNA, 23 nt, Human
cuggccuuaagcaaaagucugaa

SEQ ID NO: 876598 - RNA, 22 nt, Human
cuucacugcaucaguaguuuua

SEQ ID NO: 876599 - RNA, 20 nt, Human
uaacaaugagaugcgaucaa

SEQ ID NO: 876600 - RNA, 21 nt, Human
uaaccuuuugagaauugcacu

SEQ ID NO: 876601 - RNA, 23 nt, Human
uaagcaaaagucugaaaccuagg

SEQ ID NO: 876602 - RNA, 26 nt, Human
uauagaaaugguuauagauaaugaga

SEQ ID NO: 876603 - RNA, 22 nt, Human
ucaaacauccauauuaucugau

SEQ ID NO: 876604 - RNA, 24 nt, Human
ucagaaagaacuuaacaaucuuuc

SEQ ID NO: 876605 - RNA, 18 nt, Human
ucaggguagauggguccc

SEQ ID NO: 876606 - RNA, 23 nt, Human
uccagcugcguuccuuugccugc

SEQ ID NO: 876607 - RNA, 19 nt, Human
uccugaacuuuccguaguc

SEQ ID NO: 876608 - RNA, 20 nt, Human
uccugaacuuuccguagucc

SEQ ID NO: 876609 - RNA, 23 nt, Human
ucuuccagcugcguuccuuugcc

SEQ ID NO: 876610 - RNA, 24 nt, Human
ucuuccagcugcguuccuuugccu

SEQ ID NO: 876611 - RNA, 25 nt, Human
ucuuccagcugcguuccuuugccug

SEQ ID NO: 876612 - RNA, 20 nt, Human
ugauguggucaggguagaug

SEQ ID NO: 876613 - RNA, 24 nt, Human
uggccuuaagcaaaagucugaaac

SEQ ID NO: 876614 - RNA, 21 nt, Human
uucaaauguaaauauagaaau

SEQ ID NO: 876615 - RNA, 25 nt, Human
uucacugcaucaguaguuuuauucc

SEQ ID NO: 876616 - RNA, 20 nt, Human
uuccuuugccugcaacaggg

SEQ ID NO: 876617 - RNA, 22 nt, Human
uuccuuugccugcaacaggggu

SEQ ID NO: 876618 - RNA, 26 nt, Human
uuugauguccugaacuuuccguaguc

SEQ ID NO: 876619 - RNA, 22 nt, Human
uuuucugaauucacggguuucu

SEQ ID NO: 876620 - RNA, 20 nt, Human
uuuuuuuuuuuuuuuuccac

SEQ ID NO: 876621 - RNA, 27 nt, Human
aaaaaacaggcugagaaaaguggcuca

SEQ ID NO: 876622 - RNA, 18 nt, Human
aaacaaaaaacaggcuga

SEQ ID NO: 876623 - RNA, 24 nt, Human
aaagugcugggauuacaggcauga

SEQ ID NO: 876624 - RNA, 19 nt, Human
aacaaaaaacaggcugaga

SEQ ID NO: 876625 - RNA, 18 nt, Human
aagaaacaaaaaacaggc

SEQ ID NO: 876626 - RNA, 19 nt, Human
aagugcugggauuacaggc

SEQ ID NO: 876627 - RNA, 21 nt, Human
aagugcugggauuacaggcau

SEQ ID NO: 876628 - RNA, 26 nt, Human
aagugcugggauuacaggcaugagcc

SEQ ID NO: 876629 - RNA, 23 nt, Human
aauaagaaacaaaaaacaggcug

SEQ ID NO: 876630 - RNA, 23 nt, Human
aauaauagaaaauaagaaacaaa

SEQ ID NO: 876631 - RNA, 18 nt, Human
acaccaugaauugccuga

SEQ ID NO: 876632 - RNA, 25 nt, Human
acucugucgcccaggcuggagccca

SEQ ID NO: 876633 - RNA, 20 nt, Human
agccaccacaccuggcccca

SEQ ID NO: 876634 - RNA, 20 nt, Human
aguagagacagggauucacc

SEQ ID NO: 876635 - RNA, 18 nt, Human
aguagcugggacuacagg

SEQ ID NO: 876636 - RNA, 19 nt, Human
aguagcugggacuacaggc

SEQ ID NO: 876637 - RNA, 19 nt, Human
aguagcugggacuacaggc

SEQ ID NO: 876638 - RNA, 18 nt, Human
agugcugggauuacaggc

SEQ ID NO: 876639 - RNA, 23 nt, Human
auaauagaaaauaagaaacaaaa

SEQ ID NO: 876640 - RNA, 20 nt, Human
caaaaaacaggcugagaaaa

SEQ ID NO: 876641 - RNA, 24 nt, Human
caaagugcugggauuacaggcaug

SEQ ID NO: 876642 - RNA, 20 nt, Human
cacaccuggccccauccucu

SEQ ID NO: 876643 - RNA, 24 nt, Human
cacccuguuagccaggaaagucuc

SEQ ID NO: 876644 - RNA, 22 nt, Human
cacucugucgcccaggcuggag

SEQ ID NO: 876645 - RNA, 22 nt, Human
caugccauucuccugccucagc

SEQ ID NO: 876646 - RNA, 22 nt, Human
caugcugguuucaaacuccuga

SEQ ID NO: 876647 - RNA, 23 nt, Human
ccaaagugcugggauuacaggca

SEQ ID NO: 876648 - RNA, 24 nt, Human
ccaaagugcugggauuacaggcau

SEQ ID NO: 876649 - RNA, 25 nt, Human
ccacaccuggccccauccucuuaac

SEQ ID NO: 876650 - RNA, 20 nt, Human
ccaugcugguuucaaacucc

SEQ ID NO: 876651 - RNA, 24 nt, Human
cccaaagugcugggauuacaggca

SEQ ID NO: 876652 - RNA, 22 nt, Human
ccgacgugcugggauuacaggu

SEQ ID NO: 876653 - RNA, 24 nt, Human
ccucacagguucaugccauucucc

SEQ ID NO: 876654 - RNA, 19 nt, Human
ccugaccccgugaucugcc

SEQ ID NO: 876655 - RNA, 21 nt, Human
ccugaccucaagugaccuaug

SEQ ID NO: 876656 - RNA, 19 nt, Human
ccuggccccauccucuuaa

SEQ ID NO: 876657 - RNA, 24 nt, Human
cgacgugcugggauuacaggucgg

SEQ ID NO: 876658 - RNA, 23 nt, Human
cgcccaggcuggagcccaguggc

SEQ ID NO: 876659 - RNA, 20 nt, Human
cucaagugaccuaugugccu

SEQ ID NO: 876660 - RNA, 19 nt, Human
cucacaucuguuggccaug

SEQ ID NO: 876661 - RNA, 24 nt, Human
cucacucugucgcccaggcuggag

SEQ ID NO: 876662 - RNA, 24 nt, Human
cuccugaccccgugaucugccugc

SEQ ID NO: 876663 - RNA, 20 nt, Human
cugaagacuuugugacaauc

SEQ ID NO: 876664 - RNA, 23 nt, Human
cugccucggccucccaaagugcu

SEQ ID NO: 876665 - RNA, 23 nt, Human
cuuaacauaaacacuugaauguc

SEQ ID NO: 876666 - RNA, 22 nt, Human
gaccccgugaucugccugccuc

SEQ ID NO: 876667 - RNA, 24 nt, Human
gaccccgugaucugccugccucgg

SEQ ID NO: 876668 - RNA, 24 nt, Human
gacuacaggcgccagccaccaugc

SEQ ID NO: 876669 - RNA, 21 nt, Human
gacucccugcaagcuccgccu

SEQ ID NO: 876670 - RNA, 27 nt, Human
gaguagcugggacuacaggcgccagcc

SEQ ID NO: 876671 - RNA, 21 nt, Human
gauuacaggcaugagccuccg

SEQ ID NO: 876672 - RNA, 24 nt, Human
gauuacaggcaugagccuccgugc

SEQ ID NO: 876673 - RNA, 18 nt, Human
gauuacaggucggagcca

SEQ ID NO: 876674 - RNA, 22 nt, Human
gcaagcuccgccucacagguuc

SEQ ID NO: 876675 - RNA, 23 nt, Human
gcccagcuaauuuuuuguauuuu

SEQ ID NO: 876676 - RNA, 20 nt, Human
gcccaggcuggagcccagug

SEQ ID NO: 876677 - RNA, 23 nt, Human
gcugguuucaaacuccugaccuc

SEQ ID NO: 876678 - RNA, 23 nt, Human
ggauuacaggcaugagccuccgu

SEQ ID NO: 876679 - RNA, 20 nt, Human
uaaaaaguacuggcucaaaa

SEQ ID NO: 876680 - RNA, 21 nt, Human
uaacauaaacacuugaauguc

SEQ ID NO: 876681 - RNA, 24 nt, Human
uaauuuuuuguauuuuuaguagag

SEQ ID NO: 876682 - RNA, 22 nt, Human
uacaggcaugagccuccgugcc

SEQ ID NO: 876683 - RNA, 24 nt, Human
uacaggcgccagccaccaugccca

SEQ ID NO: 876684 - RNA, 22 nt, Human
uacaggucggagccaccacacc

SEQ ID NO: 876685 - RNA, 22 nt, Human
uagagacagggauucacccugu

SEQ ID NO: 876686 - RNA, 23 nt, Human
uaguagagacagggauucacccu

SEQ ID NO: 876687 - RNA, 21 nt, Human
ucaauaaaggcuugaacucaa

SEQ ID NO: 876688 - RNA, 21 nt, Human
ucacagguucaugccauucuc

SEQ ID NO: 876689 - RNA, 24 nt, Human
ucacagguucaugccauucuccug

SEQ ID NO: 876690 - RNA, 24 nt, Human
ucccaaagugcugggauuacaggc

SEQ ID NO: 876691 - RNA, 23 nt, Human
ucccgacgugcugggauuacagg

SEQ ID NO: 876692 - RNA, 24 nt, Human
ucccgacgugcugggauuacaggu

SEQ ID NO: 876693 - RNA, 21 nt, Human
ucccuacaccaugaauugccu

SEQ ID NO: 876694 - RNA, 20 nt, Human
ucccugcaagcuccgccucu

SEQ ID NO: 876695 - RNA, 18 nt, Human
ucggccucccaaagugcu

SEQ ID NO: 876696 - RNA, 23 nt, Human
ucucacucugucgcccaggcugg

SEQ ID NO: 876697 - RNA, 24 nt, Human
ucucacucugucgcccaggcugga

SEQ ID NO: 876698 - RNA, 26 nt, Human
ucucacucugucgcccaggcuggagc

SEQ ID NO: 876699 - RNA, 24 nt, Human
ucuggaguagcugggacuacaggc

SEQ ID NO: 876700 - RNA, 22 nt, Human
ugacugcuugccaaaggcuuug

SEQ ID NO: 876701 - RNA, 24 nt, Human
ugagacagacucucacucugucgc

SEQ ID NO: 876702 - RNA, 24 nt, Human
ugagccuccgugccuggccucaua

SEQ ID NO: 876703 - RNA, 21 nt, Human
ugccucagcaucuggaguagc

SEQ ID NO: 876704 - RNA, 24 nt, Human
ugccucagcaucuggaguagcugg

SEQ ID NO: 876705 - RNA, 21 nt, Human
ugccucggccucccaaagugc

SEQ ID NO: 876706 - RNA, 24 nt, Human
ugccucggccucccaaagugcugg

SEQ ID NO: 876707 - RNA, 22 nt, Human
ugccugauggugaauaaguguu

SEQ ID NO: 876708 - RNA, 21 nt, Human
ugccuuggccucccgacgugc

SEQ ID NO: 876709 - RNA, 22 nt, Human
ugccuuggccucccgacgugcu

SEQ ID NO: 876710 - RNA, 20 nt, Human
ugcugggauuacaggcauga

SEQ ID NO: 876711 - RNA, 24 nt, Human
uggccaugcugguuucaaacuccu

SEQ ID NO: 876712 - RNA, 22 nt, Human
ugggacuacaggcgccagccac

SEQ ID NO: 876713 - RNA, 24 nt, Human
ugggacuacaggcgccagccacca

SEQ ID NO: 876714 - RNA, 25 nt, Human
ugggacuacaggcgccagccaccau

SEQ ID NO: 876715 - RNA, 18 nt, Human
ugggauuacaggcaugag

SEQ ID NO: 876716 - RNA, 19 nt, Human
ugggauuacaggcaugagc

SEQ ID NO: 876717 - RNA, 20 nt, Human
ugggauuacaggcaugagcc

SEQ ID NO: 876718 - RNA, 20 nt, Human
ugggauuacaggcaugagcc

SEQ ID NO: 876719 - RNA, 23 nt, Human
ugggauuacaggcaugagccucc

SEQ ID NO: 876720 - RNA, 24 nt, Human
ugggauuacaggcaugagccuccg

SEQ ID NO: 876721 - RNA, 21 nt, Human
ugggauuacaggucggagcca

SEQ ID NO: 876722 - RNA, 22 nt, Human
ugggauuacaggucggagccac

SEQ ID NO: 876723 - RNA, 24 nt, Human
ugggauuacaggucggagccacca

SEQ ID NO: 876724 - RNA, 21 nt, Human
uggugaauaaguguugacugc

SEQ ID NO: 876725 - RNA, 23 nt, Human
uuaaaaaguacuggcucaaaaaa

SEQ ID NO: 876726 - RNA, 19 nt, Human
uucaugccauucuccugcc

SEQ ID NO: 876727 - RNA, 21 nt, Human
uuuuuguauuuuuaguagaga

SEQ ID NO: 876728 - RNA, 24 nt, Human
uuuuuuguauuuuuaguagagaca

SEQ ID NO: 876729 - RNA, 22 nt, Human
aaaacaucauuauaaaaccccc

SEQ ID NO: 876730 - RNA, 18 nt, Human
aaaacccgagauaaacca

SEQ ID NO: 876731 - RNA, 20 nt, Human
aaagagcagccaauggcaca

SEQ ID NO: 876732 - RNA, 19 nt, Human
aagagcagccaauggcaca

SEQ ID NO: 876733 - RNA, 21 nt, Human
aagcagccuccugagguaggu

SEQ ID NO: 876734 - RNA, 24 nt, Human
aauuuuccuuucauguuauaaggc

SEQ ID NO: 876735 - RNA, 19 nt, Human
acaucauuauaaaaccccc

SEQ ID NO: 876736 - RNA, 20 nt, Human
caagccaaugcacagaaaag

SEQ ID NO: 876737 - RNA, 20 nt, Human
cacuucuugggacggggcuu

SEQ ID NO: 876738 - RNA, 27 nt, Human
cagcaauuagauauaaaaaaaucuuaa

SEQ ID NO: 876739 - RNA, 20 nt, Human
cagcagugcucuacugcggc

SEQ ID NO: 876740 - RNA, 23 nt, Human
cagccuccugagguagguaaccu

SEQ ID NO: 876741 - RNA, 22 nt, Human
cagcucaggaaaagcauuauuu

SEQ ID NO: 876742 - RNA, 22 nt, Human
cccaacuauugcaaguucuaga

SEQ ID NO: 876743 - RNA, 18 nt, Human
ccuacuucccagguucug

SEQ ID NO: 876744 - RNA, 23 nt, Human
cggcacgacagacacccuguuaa

SEQ ID NO: 876745 - RNA, 19 nt, Human
cugcauuugcucucucaca

SEQ ID NO: 876746 - RNA, 20 nt, Human
cugcggcacgacagacaccc

SEQ ID NO: 876747 - RNA, 21 nt, Human
cuucuggcaauaaauuaaggu

SEQ ID NO: 876748 - RNA, 23 nt, Human
gaccugacuuacuuaggaacaua

SEQ ID NO: 876749 - RNA, 19 nt, Human
gagguguggcucuucaagu

SEQ ID NO: 876750 - RNA, 19 nt, Human
gcagccaauggcacaaguc

SEQ ID NO: 876751 - RNA, 20 nt, Human
ggacuagaaagagcagccaa

SEQ ID NO: 876752 - RNA, 21 nt, Human
ggcaggaaauuucuuuugguc

SEQ ID NO: 876753 - RNA, 23 nt, Human
gggaacaaggcaguguucuuuac

SEQ ID NO: 876754 - RNA, 24 nt, Human
gggaacaaggcaguguucuuuacc

SEQ ID NO: 876755 - RNA, 21 nt, Human
ggggcaggaaauuucuuuugg

SEQ ID NO: 876756 - RNA, 26 nt, Human
uaaaacaucauuauaaaacccccccu

SEQ ID NO: 876757 - RNA, 21 nt, Human
uaaaacccccaacuauugcaa

SEQ ID NO: 876758 - RNA, 25 nt, Human
uaaaacccccaacuauugcaaguuc

SEQ ID NO: 876759 - RNA, 18 nt, Human
uaaaacuagaacagaaau

SEQ ID NO: 876760 - RNA, 19 nt, Human
uaaaaguaacugcugaacc

SEQ ID NO: 876761 - RNA, 18 nt, Human
uaaaaugaaggcagcagc

SEQ ID NO: 876762 - RNA, 23 nt, Human
uaacugaagaaaaaacccgagau

SEQ ID NO: 876763 - RNA, 25 nt, Human
uaaggcaacacugggauccagcuca

SEQ ID NO: 876764 - RNA, 23 nt, Human
uacuuaggaacauaaauuuuggg

SEQ ID NO: 876765 - RNA, 21 nt, Human
uagaaagagcagccaauggca

SEQ ID NO: 876766 - RNA, 22 nt, Human
uagaaagagcagccaauggcac

SEQ ID NO: 876767 - RNA, 25 nt, Human
uagaaagagcagccaauggcacaag

SEQ ID NO: 876768 - RNA, 20 nt, Human
ucacuuggggagcuuuaaaa

SEQ ID NO: 876769 - RNA, 21 nt, Human
ucacuuggggagcuuuaaaaa

SEQ ID NO: 876770 - RNA, 20 nt, Human
ucccagguucugacugcauu

SEQ ID NO: 876771 - RNA, 19 nt, Human
uccuggaucccaugcuucu

SEQ ID NO: 876772 - RNA, 19 nt, Human
ucugggaccuacuucccag

SEQ ID NO: 876773 - RNA, 23 nt, Human
ucugggaccuacuucccagguuc

SEQ ID NO: 876774 - RNA, 20 nt, Human
ugacuuacuuaggaacauaa

SEQ ID NO: 876775 - RNA, 21 nt, Human
ugggguuggaggaagcagcag

SEQ ID NO: 876776 - RNA, 20 nt, Human
uguaaacuaguuuacaaagc

SEQ ID NO: 876777 - RNA, 19 nt, Human
ugugcagucaagcgcgagg

SEQ ID NO: 876778 - RNA, 21 nt, Human
uuggggcaggaaauuucuuuu

SEQ ID NO: 876779 - RNA, 24 nt, Human
uuuucuggacucaucagaauguua

SEQ ID NO: 876780 - RNA, 23 nt, Human
aaacaugcaugcuccgaaaagcc

SEQ ID NO: 876781 - RNA, 21 nt, Human
aagcagggcuuaugcagcagc

SEQ ID NO: 876782 - RNA, 28 nt, Human
agcccgccccuccuuccucucuuccccu

SEQ ID NO: 876783 - RNA, 18 nt, Human
aggcugcggugcugcggc

SEQ ID NO: 876784 - RNA, 24 nt, Human
caaaccuaagcccacacucugucc

SEQ ID NO: 876785 - RNA, 22 nt, Human
caaagcccccucuagucccaaa

SEQ ID NO: 876786 - RNA, 20 nt, Human
caagcagggcuuaugcagca

SEQ ID NO: 876787 - RNA, 22 nt, Human
caccauaguugccaaagccccc

SEQ ID NO: 876788 - RNA, 22 nt, Human
cacucuguccccuugcaaguga

SEQ ID NO: 876789 - RNA, 24 nt, Human
cagcccucggucuggccuggcugg

SEQ ID NO: 876790 - RNA, 19 nt, Human
ccaaaccuaagcccacacu

SEQ ID NO: 876791 - RNA, 25 nt, Human
ccauagccggcgcgaggcccaaggc

SEQ ID NO: 876792 - RNA, 19 nt, Human
ccccuccuuccucucuucc

SEQ ID NO: 876793 - RNA, 19 nt, Human
cccgccccuccuuccucuc

SEQ ID NO: 876794 - RNA, 20 nt, Human
cccuccuuccucucuucccc

SEQ ID NO: 876795 - RNA, 20 nt, Human
cccucuagucccaaaccuaa

SEQ ID NO: 876796 - RNA, 22 nt, Human
ccuugccaggagcccgccccuc

SEQ ID NO: 876797 - RNA, 21 nt, Human
cuacuggcggcgacgagcccc

SEQ ID NO: 876798 - RNA, 19 nt, Human
cucgcggaagguauuccuu

SEQ ID NO: 876799 - RNA, 19 nt, Human
gcacggccauagccggcgc

SEQ ID NO: 876800 - RNA, 18 nt, Human
gccggcgcgaggcccaag

SEQ ID NO: 876801 - RNA, 23 nt, Human
gcuauaaacaugcaugcuccgaa

SEQ ID NO: 876802 - RNA, 19 nt, Human
ggcggugcaguccccgcgg

SEQ ID NO: 876803 - RNA, 22 nt, Human
ggucacaaaaacaaccuuaaga

SEQ ID NO: 876804 - RNA, 21 nt, Human
uaagcccacacucuguccccu

SEQ ID NO: 876805 - RNA, 20 nt, Human
uagaacaaugcuccaaagaa

SEQ ID NO: 876806 - RNA, 24 nt, Human
uagccggcgcgaggcccaaggcug

SEQ ID NO: 876807 - RNA, 23 nt, Human
uaguugccaaagcccccucuagu

SEQ ID NO: 876808 - RNA, 19 nt, Human
uccccgcggcagagcagcu

SEQ ID NO: 876809 - RNA, 24 nt, Human
uccccuugcaagugaagaaaugca

SEQ ID NO: 876810 - RNA, 26 nt, Human
uccuuuaacugcagguguuuguugcc

SEQ ID NO: 876811 - RNA, 18 nt, Human
ucgucgggaaucucgguc

SEQ ID NO: 876812 - RNA, 19 nt, Human
ugccaggagcccgccccuc

SEQ ID NO: 876813 - RNA, 22 nt, Human
uuaagagggggugguuuucuuc

SEQ ID NO: 876814 - RNA, 22 nt, Human
uuagaacaaugcuccaaagaac

SEQ ID NO: 876815 - RNA, 25 nt, Human
uuggcacagcaauauguaauuuccc

SEQ ID NO: 876816 - RNA, 18 nt, Human
aagcaccccuccuucccc

SEQ ID NO: 876817 - RNA, 23 nt, Human
aaggagcugucagggauuggagg

SEQ ID NO: 876818 - RNA, 21 nt, Human
acacuaagacgggcccccggg

SEQ ID NO: 876819 - RNA, 21 nt, Human
accccgaggagcccacuccca

SEQ ID NO: 876820 - RNA, 22 nt, Human
aggcgcggaggucgcaggcacc

SEQ ID NO: 876821 - RNA, 20 nt, Human
aggcgggccugggcaggcag

SEQ ID NO: 876822 - RNA, 18 nt, Human
caccagccucccaccgac

SEQ ID NO: 876823 - RNA, 18 nt, Human
caccccuccuuccccgcc

SEQ ID NO: 876824 - RNA, 19 nt, Human
caccccuccuuccccgccg

SEQ ID NO: 876825 - RNA, 20 nt, Human
cagaacacuaagacgggccc

SEQ ID NO: 876826 - RNA, 26 nt, Human
cagcagccccgggagguggccccgag

SEQ ID NO: 876827 - RNA, 23 nt, Human
cagcucccgccgcggcgcgggga

SEQ ID NO: 876828 - RNA, 25 nt, Human
cagcucccgccgcggcgcggggagg

SEQ ID NO: 876829 - RNA, 21 nt, Human
ccagugcgggcugagggucag

SEQ ID NO: 876830 - RNA, 22 nt, Human
ccccaacucagcccaaggagcu

SEQ ID NO: 876831 - RNA, 18 nt, Human
ccccgaggagcccacucc

SEQ ID NO: 876832 - RNA, 19 nt, Human
ccccggcggucgcagggcg

SEQ ID NO: 876833 - RNA, 21 nt, Human
ccccggcggucgcagggcggg

SEQ ID NO: 876834 - RNA, 19 nt, Human
ccccggggcggcccggcuc

SEQ ID NO: 876835 - RNA, 23 nt, Human
ccccggggcggcccggcucugcc

SEQ ID NO: 876836 - RNA, 23 nt, Human
ccccuccccgcuccccuucacca

SEQ ID NO: 876837 - RNA, 18 nt, Human
cccgccgcgcuaccgagc

SEQ ID NO: 876838 - RNA, 19 nt, Human
cccgccgcgcuaccgagcg

SEQ ID NO: 876839 - RNA, 23 nt, Human
cccgccgcgcuaccgagcgcccg

SEQ ID NO: 876840 - RNA, 20 nt, Human
cccggggccgaggcagcgac

SEQ ID NO: 876841 - RNA, 21 nt, Human
ccgccgcgcuaccgagcgccc

SEQ ID NO: 876842 - RNA, 20 nt, Human
ccggggccgaggcagcgacg

SEQ ID NO: 876843 - RNA, 22 nt, Human
ccucugccccuccccgcucccc

SEQ ID NO: 876844 - RNA, 25 nt, Human
ccugaagcaccccuccuuccccgcc

SEQ ID NO: 876845 - RNA, 22 nt, Human
cgcagggcugggcuccagggcg

SEQ ID NO: 876846 - RNA, 21 nt, Human
cgcuaccgagcgcccggcucc

SEQ ID NO: 876847 - RNA, 19 nt, Human
cggcgggaagaggcaggcc

SEQ ID NO: 876848 - RNA, 24 nt, Human
cggcucugcccggggccgaggcag

SEQ ID NO: 876849 - RNA, 21 nt, Human
cgggaagaggcaggccggaga

SEQ ID NO: 876850 - RNA, 18 nt, Human
cgggaggcgcggaggucg

SEQ ID NO: 876851 - RNA, 22 nt, Human
cgggagguggccccgagccccg

SEQ ID NO: 876852 - RNA, 19 nt, Human
cgggccugggcaggcagca

SEQ ID NO: 876853 - RNA, 23 nt, Human
cucccccagcuccaucgcggccc

SEQ ID NO: 876854 - RNA, 25 nt, Human
cucccccagcuccaucgcggccccc

SEQ ID NO: 876855 - RNA, 20 nt, Human
cuccccuucaccagccuccc

SEQ ID NO: 876856 - RNA, 24 nt, Human
cuccccuucaccagccucccaccg

SEQ ID NO: 876857 - RNA, 25 nt, Human
cugcccggggccgaggcagcgacag

SEQ ID NO: 876858 - RNA, 18 nt, Human
cuucaccagccucccacc

SEQ ID NO: 876859 - RNA, 22 nt, Human
gaggagcccacucccagugcgg

SEQ ID NO: 876860 - RNA, 27 nt, Human
gccccgagccccggcggucgcagggcg

SEQ ID NO: 876861 - RNA, 22 nt, Human
ggccggagaggcgggccugggc

SEQ ID NO: 876862 - RNA, 18 nt, Human
ggcggcgggaagaggcag

SEQ ID NO: 876863 - RNA, 18 nt, Human
ggguuccggggaacuccu

SEQ ID NO: 876864 - RNA, 21 nt, Human
ucacaguuacuuuaaucugca

SEQ ID NO: 876865 - RNA, 21 nt, Human
ucagggauuggaggcggcugg

SEQ ID NO: 876866 - RNA, 19 nt, Human
uccagggcggcgggaagag

SEQ ID NO: 876867 - RNA, 21 nt, Human
ucccaccgaccuggcgucccc

SEQ ID NO: 876868 - RNA, 25 nt, Human
uccccgcuccccuucaccagccucc

SEQ ID NO: 876869 - RNA, 19 nt, Human
uccuccggcagaacacuaa

SEQ ID NO: 876870 - RNA, 22 nt, Human
ucgcggccccucgggcacuucc

SEQ ID NO: 876871 - RNA, 28 nt, Human
ucugcggcgcagggcugggcuccagggc

SEQ ID NO: 876872 - RNA, 20 nt, Human
ugccaagcgcccgcggaggc

SEQ ID NO: 876873 - RNA, 22 nt, Human
ugccccuccccgcuccccuuca

SEQ ID NO: 876874 - RNA, 18 nt, Human
ugcccgaccccgaggagc

SEQ ID NO: 876875 - RNA, 20 nt, Human
ugcccggggccgaggcagcc

SEQ ID NO: 876876 - RNA, 18 nt, Human
ugcggcgcagggcugggc

SEQ ID NO: 876877 - RNA, 19 nt, Human
uuacuuuaaucugcacggg

SEQ ID NO: 876878 - RNA, 18 nt, Human
uucacaguuacuuuaauc

SEQ ID NO: 876879 - RNA, 28 nt, Human
aaaaggaauucccuuuagccuucaugaa

SEQ ID NO: 876880 - RNA, 22 nt, Human
aaaggaauucccuuuagccuuc

SEQ ID NO: 876881 - RNA, 23 nt, Human
aaagugcugggauuaagguguga

SEQ ID NO: 876882 - RNA, 25 nt, Human
aagugcugggauuaaggugugagcc

SEQ ID NO: 876883 - RNA, 24 nt, Human
acagaguuucaccaugcuggccag

SEQ ID NO: 876884 - RNA, 24 nt, Human
accaugcuggccaggcuggucucg

SEQ ID NO: 876885 - RNA, 19 nt, Human
acccaggcuggagugcaau

SEQ ID NO: 876886 - RNA, 22 nt, Human
accccuaaguaacaaggacaaa

SEQ ID NO: 876887 - RNA, 19 nt, Human
accuucuucagugcuuauu

SEQ ID NO: 876888 - RNA, 18 nt, Human
agacuggaaaggagcaag

SEQ ID NO: 876889 - RNA, 19 nt, Human
agcaaggagguacuggacu

SEQ ID NO: 876890 - RNA, 22 nt, Human
agcuauguaggcagugaaacca

SEQ ID NO: 876891 - RNA, 21 nt, Human
aggacagaagacuggaaagga

SEQ ID NO: 876892 - RNA, 21 nt, Human
aggcagugaaaccaaaaagac

SEQ ID NO: 876893 - RNA, 20 nt, Human
aggugugagccaccgcgccc

SEQ ID NO: 876894 - RNA, 26 nt, Human
aguaacaaggacaaaaucaaaaggaa

SEQ ID NO: 876895 - RNA, 22 nt, Human
aguagagacagaguuucaccau

SEQ ID NO: 876896 - RNA, 24 nt, Human
agugcaauggcacgaucuuggcuc

SEQ ID NO: 876897 - RNA, 23 nt, Human
caaagugcugggauuaaggugug

SEQ ID NO: 876898 - RNA, 21 nt, Human
caacucuaccauccuuauccc

SEQ ID NO: 876899 - RNA, 22 nt, Human
caagccauucuccugccucagc

SEQ ID NO: 876900 - RNA, 22 nt, Human
caaggaagacccauaaaucuca

SEQ ID NO: 876901 - RNA, 21 nt, Human
caccaugcuggccaggcuggu

SEQ ID NO: 876902 - RNA, 24 nt, Human
caccaugcuggccaggcuggucuc

SEQ ID NO: 876903 - RNA, 27 nt, Human
caccaugcuggccaggcuggucucgaa

SEQ ID NO: 876904 - RNA, 24 nt, Human
cagaguuucaccaugcuggccagg

SEQ ID NO: 876905 - RNA, 20 nt, Human
cagccuccugaguagcaggg

SEQ ID NO: 876906 - RNA, 28 nt, Human
cagcuccauggaagaagggacuguagag

SEQ ID NO: 876907 - RNA, 18 nt, Human
caugcuccaacaaugcgg

SEQ ID NO: 876908 - RNA, 24 nt, Human
caugcuggccaggcuggucucgaa

SEQ ID NO: 876909 - RNA, 20 nt, Human
ccaaagugcugggauuaagg

SEQ ID NO: 876910 - RNA, 23 nt, Human
ccaaagugcugggauuaaggugu

SEQ ID NO: 876911 - RNA, 23 nt, Human
ccaggacagaagacuggaaagga

SEQ ID NO: 876912 - RNA, 20 nt, Human
ccaggagggaagaugggaaa

SEQ ID NO: 876913 - RNA, 18 nt, Human
ccucccaggacagaagac

SEQ ID NO: 876914 - RNA, 23 nt, Human
ccugaccccuaaguaacaaggac

SEQ ID NO: 876915 - RNA, 23 nt, Human
ccugccucagccuccugaguagc

SEQ ID NO: 876916 - RNA, 21 nt, Human
ccuugugauuugccuuccuca

SEQ ID NO: 876917 - RNA, 22 nt, Human
ccuugugauuugccuuccucag

SEQ ID NO: 876918 - RNA, 21 nt, Human
cgcccggccaugccauucauu

SEQ ID NO: 876919 - RNA, 24 nt, Human
cgcucugucacccaggcuggagug

SEQ ID NO: 876920 - RNA, 18 nt, Human
cuagucucuaaguuuucu

SEQ ID NO: 876921 - RNA, 23 nt, Human
cucagccucccaggacagaagac

SEQ ID NO: 876922 - RNA, 22 nt, Human
cuccugaccuugugauuugccu

SEQ ID NO: 876923 - RNA, 24 nt, Human
cucgcucugucacccaggcuggag

SEQ ID NO: 876924 - RNA, 22 nt, Human
cucuaccauccuuaucccugac

SEQ ID NO: 876925 - RNA, 25 nt, Human
cucugucacccaggcuggagugcaa

SEQ ID NO: 876926 - RNA, 20 nt, Human
cugauuccauuaacuggacu

SEQ ID NO: 876927 - RNA, 24 nt, Human
cugcaaccuccaucugcuggguuc

SEQ ID NO: 876928 - RNA, 22 nt, Human
cugccucagccuccugaguagc

SEQ ID NO: 876929 - RNA, 23 nt, Human
cuuaucccugaccccuaaguaac

SEQ ID NO: 876930 - RNA, 24 nt, Human
gaagacccauaaaucucagccucc

SEQ ID NO: 876931 - RNA, 18 nt, Human
gacaaugguccugaucua

SEQ ID NO: 876932 - RNA, 24 nt, Human
gaccuugugauuugccuuccucag

SEQ ID NO: 876933 - RNA, 20 nt, Human
gagacagaguuucaccaugc

SEQ ID NO: 876934 - RNA, 23 nt, Human
gagcagaaacaucacugcuuccu

SEQ ID NO: 876935 - RNA, 22 nt, Human
gaggagaggguuuacacuuggg

SEQ ID NO: 876936 - RNA, 20 nt, Human
gcagugaaaccaaaaagacc

SEQ ID NO: 876937 - RNA, 19 nt, Human
gcuggagugcaauggcacg

SEQ ID NO: 876938 - RNA, 23 nt, Human
ggaguuacaaggucccaaccucc

SEQ ID NO: 876939 - RNA, 23 nt, Human
ggcuggucucgaacuccugaccu

SEQ ID NO: 876940 - RNA, 20 nt, Human
ggucucgaacuccugaccuu

SEQ ID NO: 876941 - RNA, 24 nt, Human
gugauuugccuuccucagccuccc

SEQ ID NO: 876942 - RNA, 23 nt, Human
guuuagggcuaguuucuggaucc

SEQ ID NO: 876943 - RNA, 21 nt, Human
uaacaaggacaaaaucaaaag

SEQ ID NO: 876944 - RNA, 24 nt, Human
uaacaaggacaaaaucaaaaggaa

SEQ ID NO: 876945 - RNA, 23 nt, Human
uaaguuuucuaacaccucccaua

SEQ ID NO: 876946 - RNA, 23 nt, Human
uaauuuuuuuauuuuuaguagag

SEQ ID NO: 876947 - RNA, 24 nt, Human
uaauuuuuuuauuuuuaguagaga

SEQ ID NO: 876948 - RNA, 18 nt, Human
uagcagggacuacacgua

SEQ ID NO: 876949 - RNA, 24 nt, Human
uaguagagacagaguuucaccaug

SEQ ID NO: 876950 - RNA, 26 nt, Human
uaguagagacagaguuucaccaugcu

SEQ ID NO: 876951 - RNA, 25 nt, Human
ucaagccauucuccugccucagccu

SEQ ID NO: 876952 - RNA, 18 nt, Human
ucacccaggcuggagugc

SEQ ID NO: 876953 - RNA, 18 nt, Human
ucacugcaaccuccaucu

SEQ ID NO: 876954 - RNA, 19 nt, Human
ucacugcaaccuccaucug

SEQ ID NO: 876955 - RNA, 24 nt, Human
ucacugcaaccuccaucugcuggg

SEQ ID NO: 876956 - RNA, 22 nt, Human
ucccaaagugcugggauuaagg

SEQ ID NO: 876957 - RNA, 20 nt, Human
ucccauaccaaagcacugcg

SEQ ID NO: 876958 - RNA, 23 nt, Human
ucccugaccccuaaguaacaagg

SEQ ID NO: 876959 - RNA, 24 nt, Human
ucgcucugucacccaggcuggagu

SEQ ID NO: 876960 - RNA, 19 nt, Human
ucuaacaccucccauacca

SEQ ID NO: 876961 - RNA, 19 nt, Human
ucuaaguuuucuaacaccu

SEQ ID NO: 876962 - RNA, 21 nt, Human
ucuaccauccuuaucccugac

SEQ ID NO: 876963 - RNA, 24 nt, Human
ucuccugccucagccuccugagua

SEQ ID NO: 876964 - RNA, 19 nt, Human
ucucgaacuccugaccuug

SEQ ID NO: 876965 - RNA, 19 nt, Human
ucucgcucugucacccagg

SEQ ID NO: 876966 - RNA, 23 nt, Human
ucucgcucugucacccaggcugg

SEQ ID NO: 876967 - RNA, 24 nt, Human
ucucgcucugucacccaggcugga

SEQ ID NO: 876968 - RNA, 26 nt, Human
ucucgcucugucacccaggcuggagu

SEQ ID NO: 876969 - RNA, 27 nt, Human
ucucgcucugucacccaggcuggagug

SEQ ID NO: 876970 - RNA, 18 nt, Human
ucugcuggguucaagcca

SEQ ID NO: 876971 - RNA, 24 nt, Human
ucugucacccaggcuggagugcaa

SEQ ID NO: 876972 - RNA, 18 nt, Human
ugagacagagucucgcuc

SEQ ID NO: 876973 - RNA, 22 nt, Human
ugagacagagucucgcucuguc

SEQ ID NO: 876974 - RNA, 23 nt, Human
ugccucagccuccugaguagcag

SEQ ID NO: 876975 - RNA, 21 nt, Human
ugccuuccucagccucccaaa

SEQ ID NO: 876976 - RNA, 18 nt, Human
ugcuggccaggcuggucu

SEQ ID NO: 876977 - RNA, 24 nt, Human
ugcuggguucaagccauucuccug

SEQ ID NO: 876978 - RNA, 23 nt, Human
uggagugcaauggcacgaucuug

SEQ ID NO: 876979 - RNA, 24 nt, Human
uggagugcaauggcacgaucuugg

SEQ ID NO: 876980 - RNA, 24 nt, Human
uggccaggcuggucucgaacuccu

SEQ ID NO: 876981 - RNA, 19 nt, Human
uggcucacugcaaccucca

SEQ ID NO: 876982 - RNA, 18 nt, Human
ugggauuaaggugugagc

SEQ ID NO: 876983 - RNA, 21 nt, Human
ugggauuaaggugugagccac

SEQ ID NO: 876984 - RNA, 22 nt, Human
ugggauuaaggugugagccacc

SEQ ID NO: 876985 - RNA, 23 nt, Human
ugggauuaaggugugagccaccg

SEQ ID NO: 876986 - RNA, 21 nt, Human
uggggugggugcggggguucc

SEQ ID NO: 876987 - RNA, 20 nt, Human
ugucacccaggcuggagugc

SEQ ID NO: 876988 - RNA, 24 nt, Human
uuaguagagacagaguuucaccau

SEQ ID NO: 876989 - RNA, 18 nt, Human
uucaagccauucuccugc

SEQ ID NO: 876990 - RNA, 21 nt, Human
uucaagccauucuccugccuc

SEQ ID NO: 876991 - RNA, 22 nt, Human
uucauuuucccaggagggaaga

SEQ ID NO: 876992 - RNA, 23 nt, Human
uucauuuucccaggagggaagau

SEQ ID NO: 876993 - RNA, 21 nt, Human
uuccucagccucccaaagugc

SEQ ID NO: 876994 - RNA, 23 nt, Human
uuccucagccucccaaagugcug

SEQ ID NO: 876995 - RNA, 24 nt, Human
uuccucagccucccaaagugcugg

SEQ ID NO: 876996 - RNA, 21 nt, Human
uuucaccaugcuggccaggcu

SEQ ID NO: 876997 - RNA, 20 nt, Human
uuuucugacaaugguccuga

SEQ ID NO: 876998 - RNA, 24 nt, Human
uuuuuaguagagacagaguuucac

SEQ ID NO: 876999 - RNA, 22 nt, Human
uuuuuuauuuuuaguagagaca

SEQ ID NO: 877000 - RNA, 20 nt, Human
uuuuuuuuuuugagacagag

SEQ ID NO: 877001 - RNA, 25 nt, Human
uuuuuuuuuuuugagacagagucuc

SEQ ID NO: 877002 - RNA, 18 nt, Human
uuuuuuuuuuuuuuuuug

SEQ ID NO: 877003 - RNA, 22 nt, Human
aaacaaacaggagccacuuuug

SEQ ID NO: 877004 - RNA, 18 nt, Human
aaagcauuuucauagacu

SEQ ID NO: 877005 - RNA, 18 nt, Human
aaauucacuucauaacaa

SEQ ID NO: 877006 - RNA, 23 nt, Human
aaccugccaaggacaaccuccgg

SEQ ID NO: 877007 - RNA, 24 nt, Human
acagaacagagaaaccgcugguac

SEQ ID NO: 877008 - RNA, 22 nt, Human
acaucagagggaauguccugaa

SEQ ID NO: 877009 - RNA, 23 nt, Human
accgccgucaccaccgcugccgg

SEQ ID NO: 877010 - RNA, 24 nt, Human
acgguaaucaagguuccaggcauc

SEQ ID NO: 877011 - RNA, 19 nt, Human
agaacagagaaaccgcugg

SEQ ID NO: 877012 - RNA, 18 nt, Human
agaggcagaaugaagcag

SEQ ID NO: 877013 - RNA, 21 nt, Human
agauuaaccuuuaauuacacc

SEQ ID NO: 877014 - RNA, 23 nt, Human
agcuaaauuuaagaaacaacccu

SEQ ID NO: 877015 - RNA, 18 nt, Human
aggcaggaugugcuggcu

SEQ ID NO: 877016 - RNA, 20 nt, Human
agugaaaucuuuaaaaagau

SEQ ID NO: 877017 - RNA, 25 nt, Human
auaaagcauuuucauagacuuaaaa

SEQ ID NO: 877018 - RNA, 22 nt, Human
aucaccaaugaaaaaauaaagc

SEQ ID NO: 877019 - RNA, 21 nt, Human
augaagcagucuucaaacagu

SEQ ID NO: 877020 - RNA, 27 nt, Human
auuucugcccuuuuuuuuguuuuguaa

SEQ ID NO: 877021 - RNA, 18 nt, Human
auuugaggacaauguuuu

SEQ ID NO: 877022 - RNA, 22 nt, Human
caaaaauaaaaccaaucaucau

SEQ ID NO: 877023 - RNA, 22 nt, Human
cacacccccacacaggccgccc

SEQ ID NO: 877024 - RNA, 20 nt, Human
caccgcggcucacaccccca

SEQ ID NO: 877025 - RNA, 22 nt, Human
cagaaugaagcagucuucaaac

SEQ ID NO: 877026 - RNA, 20 nt, Human
cagccaggcugcaacagcag

SEQ ID NO: 877027 - RNA, 22 nt, Human
caggcugcaacagcaggcagga

SEQ ID NO: 877028 - RNA, 25 nt, Human
caucaucaaacaaacaggagccaac

SEQ ID NO: 877029 - RNA, 18 nt, Human
ccagccaggcugcaacag

SEQ ID NO: 877030 - RNA, 22 nt, Human
ccccacacaggccgcccagucc

SEQ ID NO: 877031 - RNA, 21 nt, Human
ccgccgucaccaccgcugccg

SEQ ID NO: 877032 - RNA, 23 nt, Human
cggccggccgcgcggcuuccccu

SEQ ID NO: 877033 - RNA, 24 nt, Human
cggcgcagccuugggcaccgcggc

SEQ ID NO: 877034 - RNA, 18 nt, Human
cugguacuagaggcagaa

SEQ ID NO: 877035 - RNA, 22 nt, Human
cuuuaaagaacauuauuugagg

SEQ ID NO: 877036 - RNA, 24 nt, Human
gaaaaccugccaaggacaaccucc

SEQ ID NO: 877037 - RNA, 25 nt, Human
gagcauucggggcugaagccguucg

SEQ ID NO: 877038 - RNA, 19 nt, Human
ggccgaguagcuccagccc

SEQ ID NO: 877039 - RNA, 22 nt, Human
ggugauuucugcccuuuuuuuu

SEQ ID NO: 877040 - RNA, 18 nt, Human
guccagugggagaugcga

SEQ ID NO: 877041 - RNA, 20 nt, Human
guccugaaaggaaugaguug

SEQ ID NO: 877042 - RNA, 22 nt, Human
uaaaaaagccuuacauggucag

SEQ ID NO: 877043 - RNA, 18 nt, Human
uaaaauacuucuacaaca

SEQ ID NO: 877044 - RNA, 18 nt, Human
uaaagaacauuauuugag

SEQ ID NO: 877045 - RNA, 24 nt, Human
uaaagcauuuucauagacuuaaaa

SEQ ID NO: 877046 - RNA, 18 nt, Human
uaaauuuaagaaacaacc

SEQ ID NO: 877047 - RNA, 24 nt, Human
uaacaugagcuaaauuuaagaaac

SEQ ID NO: 877048 - RNA, 19 nt, Human
uaagaaacaacccuagucu

SEQ ID NO: 877049 - RNA, 19 nt, Human
uaagaaagagguuccuuca

SEQ ID NO: 877050 - RNA, 20 nt, Human
ucacagaacagagaaaccgc

SEQ ID NO: 877051 - RNA, 23 nt, Human
ucacauugaucacagaacagaga

SEQ ID NO: 877052 - RNA, 22 nt, Human
ucagacuuucaucaccaaugaa

SEQ ID NO: 877053 - RNA, 21 nt, Human
ucagaggaagccggauucacg

SEQ ID NO: 877054 - RNA, 22 nt, Human
ucgcacggccaccgccuucguc

SEQ ID NO: 877055 - RNA, 29 nt, Human
ucucuuaugaaaaaaaggcugggagaggu

SEQ ID NO: 877056 - RNA, 18 nt, Human
ugaaaaguacaagagcug

SEQ ID NO: 877057 - RNA, 26 nt, Human
ugaaaauguaaaauacuucuacaaca

SEQ ID NO: 877058 - RNA, 18 nt, Human
uggaguggggaugacaaa

SEQ ID NO: 877059 - RNA, 25 nt, Human
uggggugauuucugcccuuuuuuuu

SEQ ID NO: 877060 - RNA, 23 nt, Human
ugugcuggcuugaugaggugcua

SEQ ID NO: 877061 - RNA, 22 nt, Human
uguuuaaauacaagaaaaguaa

SEQ ID NO: 877062 - RNA, 19 nt, Human
uuauucucauuuaaagucu

SEQ ID NO: 877063 - RNA, 20 nt, Human
uuauuugaggacaauguuuu

SEQ ID NO: 877064 - RNA, 22 nt, Human
uucaaauucacuucauaacaau

SEQ ID NO: 877065 - RNA, 18 nt, Human
uucacuucauaacaauca

SEQ ID NO: 877066 - RNA, 23 nt, Human
uucccagagcuguucaaagucua

SEQ ID NO: 877067 - RNA, 19 nt, Human
uuccuuggggugauuucug

SEQ ID NO: 877068 - RNA, 23 nt, Human
uuccuuggggugauuucugcccu

SEQ ID NO: 877069 - RNA, 19 nt, Human
uugaaaauaggacaucaga

SEQ ID NO: 877070 - RNA, 21 nt, Human
uugaggacaauguuuuuucag

SEQ ID NO: 877071 - RNA, 18 nt, Human
uuuaaagucuuaaacccu

SEQ ID NO: 877072 - RNA, 19 nt, Human
aaaaaacuuccaugcccuu

SEQ ID NO: 877073 - RNA, 19 nt, Human
aaagagcuaauacacagac

SEQ ID NO: 877074 - RNA, 24 nt, Human
aacucacaacacugcagcagccuc

SEQ ID NO: 877075 - RNA, 19 nt, Human
aagcaaaagaacgaaaugc

SEQ ID NO: 877076 - RNA, 22 nt, Human
aagcagagaagacaggaggucc

SEQ ID NO: 877077 - RNA, 19 nt, Human
acaaagcaaaagaacgaaa

SEQ ID NO: 877078 - RNA, 26 nt, Human
acaaagcaaaagaacgaaaugcgcaa

SEQ ID NO: 877079 - RNA, 27 nt, Human
acaaagcaaaagaacgaaaugcgcaag

SEQ ID NO: 877080 - RNA, 20 nt, Human
acaaagucuaccaugcaccc

SEQ ID NO: 877081 - RNA, 19 nt, Human
acucaugcugggggcaaag

SEQ ID NO: 877082 - RNA, 26 nt, Human
acuuccaugcccuuccauuccccucc

SEQ ID NO: 877083 - RNA, 22 nt, Human
agcuuccaacucacaacacugc

SEQ ID NO: 877084 - RNA, 19 nt, Human
augcacccagaagcagaga

SEQ ID NO: 877085 - RNA, 21 nt, Human
caaagcaaaagaacgaaaugc

SEQ ID NO: 877086 - RNA, 23 nt, Human
caacuccgagagaacagaccaaa

SEQ ID NO: 877087 - RNA, 22 nt, Human
cacaacacugcagcagccucca

SEQ ID NO: 877088 - RNA, 21 nt, Human
cccaccaacuccgagagaagg

SEQ ID NO: 877089 - RNA, 23 nt, Human
cccuuccauuccccucccuccaa

SEQ ID NO: 877090 - RNA, 22 nt, Human
cuuccauuccccucccuccaaa

SEQ ID NO: 877091 - RNA, 23 nt, Human
gaagcagagaagacaggaggucc

SEQ ID NO: 877092 - RNA, 21 nt, Human
gagagaacagaccaaacuaac

SEQ ID NO: 877093 - RNA, 19 nt, Human
gcaaagaauggaaagagcu

SEQ ID NO: 877094 - RNA, 19 nt, Human
gcccuuccauuccccuccc

SEQ ID NO: 877095 - RNA, 24 nt, Human
uacucgcacugcagaguccacgcg

SEQ ID NO: 877096 - RNA, 25 nt, Human
uagggugcccaccaacuccgagaga

SEQ ID NO: 877097 - RNA, 22 nt, Human
uauuaaaugcucaauucucaaa

SEQ ID NO: 877098 - RNA, 23 nt, Human
ucaaaauuauauguauauauuuu

SEQ ID NO: 877099 - RNA, 19 nt, Human
uccgagagaacagaccaaa

SEQ ID NO: 877100 - RNA, 21 nt, Human
uccgagagaacagaccaaacu

SEQ ID NO: 877101 - RNA, 23 nt, Human
ucugccggggccuccucucccua

SEQ ID NO: 877102 - RNA, 27 nt, Human
ugaccagagacguuuacaauuuauacc

SEQ ID NO: 877103 - RNA, 21 nt, Human
ugcacccagaagcagagaaga

SEQ ID NO: 877104 - RNA, 24 nt, Human
ugccacaaagucuaccaugcaccc

SEQ ID NO: 877105 - RNA, 18 nt, Human
ugcgcagccugaccagag

SEQ ID NO: 877106 - RNA, 23 nt, Human
uggaaagagcuaauacacagaca

SEQ ID NO: 877107 - RNA, 26 nt, Human
aaacaagaagggagcuggagauuugg

SEQ ID NO: 877108 - RNA, 18 nt, Human
aagcagccacagaacacu

SEQ ID NO: 877109 - RNA, 23 nt, Human
aagccaaggcagcagcagaggga

SEQ ID NO: 877110 - RNA, 19 nt, Human
aaggagcugccuguguucc

SEQ ID NO: 877111 - RNA, 22 nt, Human
aaguggccccuaaccaccaaga

SEQ ID NO: 877112 - RNA, 20 nt, Human
aaugcccagcaaggucccac

SEQ ID NO: 877113 - RNA, 21 nt, Human
acacaagguacauccuccucc

SEQ ID NO: 877114 - RNA, 22 nt, Human
acagggcaagaaaagggcaggg

SEQ ID NO: 877115 - RNA, 23 nt, Human
acagggcaagaaaagggcagggg

SEQ ID NO: 877116 - RNA, 26 nt, Human
accaagcacugauaaaaaauauauau

SEQ ID NO: 877117 - RNA, 22 nt, Human
agaagacagggccgcaaggaca

SEQ ID NO: 877118 - RNA, 19 nt, Human
agcugccuguguuccuccc

SEQ ID NO: 877119 - RNA, 19 nt, Human
aggaccaugguuugguggg

SEQ ID NO: 877120 - RNA, 20 nt, Human
aggaucaauguucugaaggu

SEQ ID NO: 877121 - RNA, 18 nt, Human
agggaaaggagcugccug

SEQ ID NO: 877122 - RNA, 21 nt, Human
agggaggccccuccaaccuuc

SEQ ID NO: 877123 - RNA, 19 nt, Human
agggggcuggcaggagggc

SEQ ID NO: 877124 - RNA, 22 nt, Human
agggggcuggcaggagggcugc

SEQ ID NO: 877125 - RNA, 19 nt, Human
agguccccuuaccccugcc

SEQ ID NO: 877126 - RNA, 21 nt, Human
caaggaggcggguccucccuc

SEQ ID NO: 877127 - RNA, 18 nt, Human
caaugaggaggacaggag

SEQ ID NO: 877128 - RNA, 21 nt, Human
cacaaagcagccacagaacac

SEQ ID NO: 877129 - RNA, 18 nt, Human
cacuugcaggcacaugcc

SEQ ID NO: 877130 - RNA, 21 nt, Human
cacuugcaggcacaugccuac

SEQ ID NO: 877131 - RNA, 22 nt, Human
cagagaaggacauccaccucca

SEQ ID NO: 877132 - RNA, 21 nt, Human
caggcugggagcagagaaagg

SEQ ID NO: 877133 - RNA, 19 nt, Human
caggggacccuguuucccc

SEQ ID NO: 877134 - RNA, 20 nt, Human
cauauaaugcccagcaaggu

SEQ ID NO: 877135 - RNA, 23 nt, Human
cauccuccuccccugcagccccc

SEQ ID NO: 877136 - RNA, 21 nt, Human
cauggccccgaagcagcucag

SEQ ID NO: 877137 - RNA, 19 nt, Human
ccccgaagcagcucagcuc

SEQ ID NO: 877138 - RNA, 27 nt, Human
ccccuaaccaccaagacaggguacccu

SEQ ID NO: 877139 - RNA, 19 nt, Human
ccccuuaccccugccccuc

SEQ ID NO: 877140 - RNA, 22 nt, Human
cccugcagcccccacaggccuc

SEQ ID NO: 877141 - RNA, 19 nt, Human
ccuacaaagcagcagccau

SEQ ID NO: 877142 - RNA, 23 nt, Human
ccuacauacaguauggcagcagg

SEQ ID NO: 877143 - RNA, 21 nt, Human
ccucccuccucuuucaggguc

SEQ ID NO: 877144 - RNA, 21 nt, Human
ccugcagcccccacaggccuc

SEQ ID NO: 877145 - RNA, 25 nt, Human
ccugcagcccccacaggccucaggg

SEQ ID NO: 877146 - RNA, 19 nt, Human
ccuuaccccugccccuccc

SEQ ID NO: 877147 - RNA, 23 nt, Human
cuagagccucaaaggaaaagugg

SEQ ID NO: 877148 - RNA, 18 nt, Human
cucaaaggaaaaguggcc

SEQ ID NO: 877149 - RNA, 25 nt, Human
cuccccugcagcccccacaggccuc

SEQ ID NO: 877150 - RNA, 18 nt, Human
cucugaaacccccacagg

SEQ ID NO: 877151 - RNA, 21 nt, Human
cugaaacgcgccaccaaaccc

SEQ ID NO: 877152 - RNA, 22 nt, Human
cugcagcugugauuccacauca

SEQ ID NO: 877153 - RNA, 21 nt, Human
cugccccucccuacugcuggg

SEQ ID NO: 877154 - RNA, 23 nt, Human
cuuuauccucagguccccuuacc

SEQ ID NO: 877155 - RNA, 24 nt, Human
gaagccaaggcagcagcaguggga

SEQ ID NO: 877156 - RNA, 18 nt, Human
gacaggcagggggaaugg

SEQ ID NO: 877157 - RNA, 21 nt, Human
gacaggcagggggaauggucu

SEQ ID NO: 877158 - RNA, 26 nt, Human
gagccaaccccagacagagaaccuca

SEQ ID NO: 877159 - RNA, 21 nt, Human
gaugaggaaaacaagaaggga

SEQ ID NO: 877160 - RNA, 20 nt, Human
gauucugagagugacugcuc

SEQ ID NO: 877161 - RNA, 22 nt, Human
gcaaggacaggcagggggaaug

SEQ ID NO: 877162 - RNA, 21 nt, Human
gcagcagcagagggaagccag

SEQ ID NO: 877163 - RNA, 22 nt, Human
gcaggcacaugccuacaaagca

SEQ ID NO: 877164 - RNA, 20 nt, Human
gcccccacaggccucagggg

SEQ ID NO: 877165 - RNA, 23 nt, Human
gccccuccaaccuucccugguga

SEQ ID NO: 877166 - RNA, 22 nt, Human
gcgacuucgcugaaacgcgcca

SEQ ID NO: 877167 - RNA, 21 nt, Human
gcgguguguggggcauccggc

SEQ ID NO: 877168 - RNA, 22 nt, Human
ggagaggggcagcuggcagcuc

SEQ ID NO: 877169 - RNA, 20 nt, Human
ggcaagaaaagggcaggggg

SEQ ID NO: 877170 - RNA, 24 nt, Human
ggcaagaaaagggcagggggcugg

SEQ ID NO: 877171 - RNA, 21 nt, Human
ggcaagcagaaggcccugcug

SEQ ID NO: 877172 - RNA, 22 nt, Human
ggcagggggcuggcaggagggc

SEQ ID NO: 877173 - RNA, 26 nt, Human
ggcagggggcuggcaggagggcugca

SEQ ID NO: 877174 - RNA, 20 nt, Human
gggagagaagugcaugcagu

SEQ ID NO: 877175 - RNA, 24 nt, Human
gguaggaggaugaggaaaacaaga

SEQ ID NO: 877176 - RNA, 22 nt, Human
guauggcagcaggcaagcagaa

SEQ ID NO: 877177 - RNA, 22 nt, Human
gugaggcaggcugggagcagag

SEQ ID NO: 877178 - RNA, 20 nt, Human
uaaaaccaaccaagcacuga

SEQ ID NO: 877179 - RNA, 23 nt, Human
uaaauacauuuuauucagaacaa

SEQ ID NO: 877180 - RNA, 19 nt, Human
uacaggguaggaggaugag

SEQ ID NO: 877181 - RNA, 21 nt, Human
uaggaggaagccaaggcagca

SEQ ID NO: 877182 - RNA, 24 nt, Human
uauucuucacaucaugugccaagc

SEQ ID NO: 877183 - RNA, 23 nt, Human
ucacugcagcugugauuccacau

SEQ ID NO: 877184 - RNA, 19 nt, Human
ucagaaggacaggagagca

SEQ ID NO: 877185 - RNA, 25 nt, Human
uccacaucaaaccugaacaguaaga

SEQ ID NO: 877186 - RNA, 21 nt, Human
uccaccuccacuagagccuca

SEQ ID NO: 877187 - RNA, 22 nt, Human
uccaccuccacuagagccucaa

SEQ ID NO: 877188 - RNA, 19 nt, Human
ucccacuugcaggcacaug

SEQ ID NO: 877189 - RNA, 21 nt, Human
ucccacuugcaggcacaugcc

SEQ ID NO: 877190 - RNA, 19 nt, Human
uccccugcagcccccacag

SEQ ID NO: 877191 - RNA, 20 nt, Human
uccccuuaccccugccccuc

SEQ ID NO: 877192 - RNA, 19 nt, Human
ucccuggugaggcaggcug

SEQ ID NO: 877193 - RNA, 24 nt, Human
uccucccuccucuuucagggucuc

SEQ ID NO: 877194 - RNA, 18 nt, Human
ucucaggccacugcuauc

SEQ ID NO: 877195 - RNA, 20 nt, Human
ucuuuugcuuuggcugaugg

SEQ ID NO: 877196 - RNA, 24 nt, Human
ugaacaguaagaauugggcauuua

SEQ ID NO: 877197 - RNA, 24 nt, Human
ugagagaccaacggcaguuggagc

SEQ ID NO: 877198 - RNA, 23 nt, Human
ugccuacaaagcagcagccaucu

SEQ ID NO: 877199 - RNA, 19 nt, Human
ugcuggcgcagaugcagaa

SEQ ID NO: 877200 - RNA, 19 nt, Human
uggcagcaggcaagcagaa

SEQ ID NO: 877201 - RNA, 25 nt, Human
uggccaaggagcaacuucagaagga

SEQ ID NO: 877202 - RNA, 23 nt, Human
uggcgguguguggggcauccggc

SEQ ID NO: 877203 - RNA, 21 nt, Human
uggcugauggggaaucaagau

SEQ ID NO: 877204 - RNA, 23 nt, Human
ugggcacuggucagcaacuccuu

SEQ ID NO: 877205 - RNA, 20 nt, Human
uggugggaguacaggguagg

SEQ ID NO: 877206 - RNA, 18 nt, Human
uuaaaaccaaccaagcac

SEQ ID NO: 877207 - RNA, 20 nt, Human
uuaaaggaccaugguuuggu

SEQ ID NO: 877208 - RNA, 22 nt, Human
uuaaaggaccaugguuuggugg

SEQ ID NO: 877209 - RNA, 21 nt, Human
uucccuggugaggcaggcugg

SEQ ID NO: 877210 - RNA, 20 nt, Human
uuucagggucucugaaaccc

SEQ ID NO: 877211 - RNA, 23 nt, Human
uuucagggucucugaaaccccca

SEQ ID NO: 877212 - RNA, 18 nt, Human
uuuuuuuuuuuuuuuuug

SEQ ID NO: 877213 - RNA, 22 nt, Human
uuuuuuuuuuuuuuuuuggagu

SEQ ID NO: 877214 - RNA, 22 nt, Human
aggagaccccagucggcuaccc

SEQ ID NO: 877215 - RNA, 23 nt, Human
uaagaaaauuccacaauaaucag

SEQ ID NO: 877216 - RNA, 25 nt, Human
ucgccaggagaccccagucggcuac

SEQ ID NO: 877217 - RNA, 19 nt, Human
uuuuuuuuuuuuuaaggga

SEQ ID NO: 877218 - RNA, 22 nt, Human
accuugaagagggccacaggga

SEQ ID NO: 877219 - RNA, 23 nt, Human
aggaagguaggaccuugaagagg

SEQ ID NO: 877220 - RNA, 24 nt, Human
aggaagguaggaccuugaagaggg

SEQ ID NO: 877221 - RNA, 18 nt, Human
aggaccuugaagagggcc

SEQ ID NO: 877222 - RNA, 23 nt, Human
aggguucacaggagaguuaggca

SEQ ID NO: 877223 - RNA, 20 nt, Human
agguaggaccuugaagaggg

SEQ ID NO: 877224 - RNA, 24 nt, Human
caaguagaugaugaccaccaacca

SEQ ID NO: 877225 - RNA, 19 nt, Human
caccauacggggcagguug

SEQ ID NO: 877226 - RNA, 18 nt, Human
ccacagccucucccgggc

SEQ ID NO: 877227 - RNA, 18 nt, Human
ccacagggacuucaagga

SEQ ID NO: 877228 - RNA, 19 nt, Human
ccaccacagccucucccgg

SEQ ID NO: 877229 - RNA, 19 nt, Human
cccucccuucuccccucca

SEQ ID NO: 877230 - RNA, 23 nt, Human
cucccgggccgcuguagacagcc

SEQ ID NO: 877231 - RNA, 24 nt, Human
cuguacagaaccacaaagaauaaa

SEQ ID NO: 877232 - RNA, 24 nt, Human
cuuuacaauuauauguaugucacu

SEQ ID NO: 877233 - RNA, 22 nt, Human
cuuugcccucccuucuccccuc

SEQ ID NO: 877234 - RNA, 23 nt, Human
gaggacaaugaccaucacgaggg

SEQ ID NO: 877235 - RNA, 18 nt, Human
gaugaccaccaaccaugg

SEQ ID NO: 877236 - RNA, 19 nt, Human
gccccgaggccggcgcuuc

SEQ ID NO: 877237 - RNA, 22 nt, Human
gccccgaggccggcgcuucucg

SEQ ID NO: 877238 - RNA, 23 nt, Human
gcccucccuucuccccuccauca

SEQ ID NO: 877239 - RNA, 24 nt, Human
ggaggacaaugaccaucacgaggg

SEQ ID NO: 877240 - RNA, 18 nt, Human
ggaggggcgggccuggcc

SEQ ID NO: 877241 - RNA, 24 nt, Human
ggccacagggacuucaaggaagga

SEQ ID NO: 877242 - RNA, 21 nt, Human
guggcauccuggggagcuucu

SEQ ID NO: 877243 - RNA, 21 nt, Human
uaaaaggaggggcacacagca

SEQ ID NO: 877244 - RNA, 20 nt, Human
uaaaauaauaugaaaagacc

SEQ ID NO: 877245 - RNA, 18 nt, Human
uaggaagguaggaccuug

SEQ ID NO: 877246 - RNA, 21 nt, Human
ucaaaacauaucugguugcaa

SEQ ID NO: 877247 - RNA, 23 nt, Human
ucccuucuccccuccaucaagga

SEQ ID NO: 877248 - RNA, 23 nt, Human
ucggggccaccacagccucuccc

SEQ ID NO: 877249 - RNA, 18 nt, Human
ucuggaggacaaugacca

SEQ ID NO: 877250 - RNA, 21 nt, Human
ugaaaagaccauaacugaaga

SEQ ID NO: 877251 - RNA, 18 nt, Human
ugagggaagcccaggguu

SEQ ID NO: 877252 - RNA, 19 nt, Human
uggcauccuggggagcuuc

SEQ ID NO: 877253 - RNA, 19 nt, Human
ugguggcauccuggggagc

SEQ ID NO: 877254 - RNA, 19 nt, Human
uucaaggaaggaggaaacc

SEQ ID NO: 877255 - RNA, 18 nt, Human
uucaauuugaugcccuga

SEQ ID NO: 877256 - RNA, 20 nt, Human
uuggaauuucugguuuuuca

SEQ ID NO: 877257 - RNA, 21 nt, Human
uuuacacagugguggcauccu

SEQ ID NO: 877258 - RNA, 21 nt, Human
uuugcccucccuucuccccuc

SEQ ID NO: 877259 - RNA, 21 nt, Human
uuuggaauuucugguuuuuca

SEQ ID NO: 877260 - RNA, 22 nt, Human
uuuuacacagugguggcauccu

SEQ ID NO: 877261 - RNA, 23 nt, Human
uuuuuuuuuuuuuuuuuuaacug

SEQ ID NO: 877262 - RNA, 21 nt, Human
aaaccaaaacaaaucaggaaa

SEQ ID NO: 877263 - RNA, 19 nt, Human
aaaguagaggggaacucac

SEQ ID NO: 877264 - RNA, 19 nt, Human
aagaaguucccaagcagcc

SEQ ID NO: 877265 - RNA, 20 nt, Human
aagcagccggaagguaggaa

SEQ ID NO: 877266 - RNA, 21 nt, Human
aagcagccggaagguaggaaa

SEQ ID NO: 877267 - RNA, 24 nt, Human
aaugcagaaacauuuauugaaaga

SEQ ID NO: 877268 - RNA, 19 nt, Human
agacuagguuucuaaaagu

SEQ ID NO: 877269 - RNA, 19 nt, Human
agaggaguaauuauucagc

SEQ ID NO: 877270 - RNA, 19 nt, Human
caagaaagaaguucccaag

SEQ ID NO: 877271 - RNA, 26 nt, Human
ccaaagcacaugucuacgccaggcag

SEQ ID NO: 877272 - RNA, 18 nt, Human
ccaguuuggguggaaggc

SEQ ID NO: 877273 - RNA, 19 nt, Human
cuacccccuccaacugucc

SEQ ID NO: 877274 - RNA, 19 nt, Human
cuacccccuccaacugucc

SEQ ID NO: 877275 - RNA, 18 nt, Human
cucggccuacccccucca

SEQ ID NO: 877276 - RNA, 21 nt, Human
gaagaaaagacuguuguucuu

SEQ ID NO: 877277 - RNA, 24 nt, Human
gagugagcauugccugugccagua

SEQ ID NO: 877278 - RNA, 18 nt, Human
guagaggggaacucacuc

SEQ ID NO: 877279 - RNA, 23 nt, Human
uaaauauaaaaagccaaacuuua

SEQ ID NO: 877280 - RNA, 18 nt, Human
uaaguaaagaaaugacau

SEQ ID NO: 877281 - RNA, 24 nt, Human
uaggaaaccugagcguuugaaagc

SEQ ID NO: 877282 - RNA, 18 nt, Human
ucauuagcuaaguuaaaa

SEQ ID NO: 877283 - RNA, 18 nt, Human
uccuuguuuacacugugu

SEQ ID NO: 877284 - RNA, 19 nt, Human
ugaaagacauuucgaagcc

SEQ ID NO: 877285 - RNA, 24 nt, Human
ugacauuuuaaauauaaaaagcca

SEQ ID NO: 877286 - RNA, 21 nt, Human
uggaaggcuaaaaguagaggg

SEQ ID NO: 877287 - RNA, 22 nt, Human
uggauuagccauuaacauuuuu

SEQ ID NO: 877288 - RNA, 19 nt, Human
uggcgggcaagaaagaagu

SEQ ID NO: 877289 - RNA, 18 nt, Human
uggcugcgggcuuggcgg

SEQ ID NO: 877290 - RNA, 21 nt, Human
uguguacauaguacaaauaua

SEQ ID NO: 877291 - RNA, 22 nt, Human
uguguacauaguacaaauauag

SEQ ID NO: 877292 - RNA, 24 nt, Human
uuaaaccuucuuuaauuauggauu

SEQ ID NO: 877293 - RNA, 19 nt, Human
uuacuugaaguuuucgagu

SEQ ID NO: 877294 - RNA, 23 nt, Human
uuagaagacuagguuucuaaaag

SEQ ID NO: 877295 - RNA, 23 nt, Human
uucaugacaauaaaacuuguaaa

SEQ ID NO: 877296 - RNA, 24 nt, Human
uuuaucaagcauuccaaaaccaac

SEQ ID NO: 877297 - RNA, 23 nt, Human
uuuuuuuuuuuuuuuuuuaaaug

SEQ ID NO: 877298 - RNA, 23 nt, Human
aaaucauuucaguacuucuuccu

SEQ ID NO: 877299 - RNA, 19 nt, Human
aaccaaaagacaaaaacaa

SEQ ID NO: 877300 - RNA, 25 nt, Human
aaccaaaagacaaaaacaagggacc

SEQ ID NO: 877301 - RNA, 21 nt, Human
aagaaaccaaaagacaaaaac

SEQ ID NO: 877302 - RNA, 23 nt, Human
aagaaaccaaaagacaaaaacaa

SEQ ID NO: 877303 - RNA, 23 nt, Human
aaugcauucaguaaggcacucaa

SEQ ID NO: 877304 - RNA, 24 nt, Human
acaaaaacaaucuuuuuaaaccuc

SEQ ID NO: 877305 - RNA, 22 nt, Human
agaaaccaaaagacaaaaacaa

SEQ ID NO: 877306 - RNA, 23 nt, Human
agcauacucugaacuuacagaau

SEQ ID NO: 877307 - RNA, 22 nt, Human
aggaagaaaccaaaagacaaaa

SEQ ID NO: 877308 - RNA, 19 nt, Human
aggagaaaggaagaaacca

SEQ ID NO: 877309 - RNA, 22 nt, Human
aggagaaaggaagaaaccaaaa

SEQ ID NO: 877310 - RNA, 21 nt, Human
aggauucaggucagaguacau

SEQ ID NO: 877311 - RNA, 21 nt, Human
aggcgggugcggccuccgggc

SEQ ID NO: 877312 - RNA, 24 nt, Human
auacuuuuuauagaaagacacgcu

SEQ ID NO: 877313 - RNA, 24 nt, Human
auaugauaaucuauuaacacucag

SEQ ID NO: 877314 - RNA, 22 nt, Human
aucucauuuccuucauuuucaa

SEQ ID NO: 877315 - RNA, 18 nt, Human
caucaugaauuuauuuuc

SEQ ID NO: 877316 - RNA, 21 nt, Human
cauuaaugacuaucauuuuac

SEQ ID NO: 877317 - RNA, 22 nt, Human
cauuuuucacugagagccccgc

SEQ ID NO: 877318 - RNA, 25 nt, Human
ccaaagcaaaagcccugucauucau

SEQ ID NO: 877319 - RNA, 23 nt, Human
cgaaagcacugcagcaguuucug

SEQ ID NO: 877320 - RNA, 24 nt, Human
cgccggaggcgggugcggccuccg

SEQ ID NO: 877321 - RNA, 18 nt, Human
cucugaacuuacagaaua

SEQ ID NO: 877322 - RNA, 21 nt, Human
cugugguuccccauacuuagu

SEQ ID NO: 877323 - RNA, 21 nt, Human
gagcuucuuccacaaucacaa

SEQ ID NO: 877324 - RNA, 19 nt, Human
gugguuccccauacuuagu

SEQ ID NO: 877325 - RNA, 20 nt, Human
uaaaaaauccaaagcaaaag

SEQ ID NO: 877326 - RNA, 22 nt, Human
uaaccacagaacgcucuucccu

SEQ ID NO: 877327 - RNA, 21 nt, Human
uacagaauaaguaccacgcca

SEQ ID NO: 877328 - RNA, 23 nt, Human
uagcagggacuaaauacaguggu

SEQ ID NO: 877329 - RNA, 20 nt, Human
uauaguuauaaucaaggaaa

SEQ ID NO: 877330 - RNA, 22 nt, Human
ucaaggaaaugauuucacauug

SEQ ID NO: 877331 - RNA, 18 nt, Human
ucaggauucaggucagag

SEQ ID NO: 877332 - RNA, 20 nt, Human
ucauuaaugacuaucauuuu

SEQ ID NO: 877333 - RNA, 22 nt, Human
ucucauuuccuucauuuucaau

SEQ ID NO: 877334 - RNA, 22 nt, Human
ucuuccacaaucacaaugagag

SEQ ID NO: 877335 - RNA, 19 nt, Human
ugccugcaauuucuuccuc

SEQ ID NO: 877336 - RNA, 21 nt, Human
ugccuggaauguagcagggac

SEQ ID NO: 877337 - RNA, 21 nt, Human
ugguagaucauuucuccagga

SEQ ID NO: 877338 - RNA, 18 nt, Human
uuccccauacuuaguaca

SEQ ID NO: 877339 - RNA, 24 nt, Human
uugucuugaacuugucuaaacaua

SEQ ID NO: 877340 - RNA, 19 nt, Human
aagaggaaacaugggaagg

SEQ ID NO: 877341 - RNA, 18 nt, Human
aaggaccuguugcaugcc

SEQ ID NO: 877342 - RNA, 25 nt, Human
acaagacaggaaaggggaagaagcc

SEQ ID NO: 877343 - RNA, 20 nt, Human
acaccagcccacaccuaugu

SEQ ID NO: 877344 - RNA, 19 nt, Human
acgccacuccaaggaccug

SEQ ID NO: 877345 - RNA, 24 nt, Human
acucaguuugaguguggcaccugg

SEQ ID NO: 877346 - RNA, 21 nt, Human
agaagcugacaugagcagguc

SEQ ID NO: 877347 - RNA, 21 nt, Human
agacaggaaaggggaagaagc

SEQ ID NO: 877348 - RNA, 24 nt, Human
agacaggaaaggggaagaagcuga

SEQ ID NO: 877349 - RNA, 18 nt, Human
agcuauugccauguagag

SEQ ID NO: 877350 - RNA, 20 nt, Human
agcuauugccauguagaggu

SEQ ID NO: 877351 - RNA, 18 nt, Human
aggaaacaugggaaggau

SEQ ID NO: 877352 - RNA, 19 nt, Human
aggcuggucuugagcuucu

SEQ ID NO: 877353 - RNA, 20 nt, Human
auuguuuuaguccauuuugu

SEQ ID NO: 877354 - RNA, 18 nt, Human
cacagcacgccacuccaa

SEQ ID NO: 877355 - RNA, 21 nt, Human
cacagcacgccacuccaagga

SEQ ID NO: 877356 - RNA, 23 nt, Human
cagaggaccuccuccugggguuu

SEQ ID NO: 877357 - RNA, 22 nt, Human
cagcuacaccagcccacaccua

SEQ ID NO: 877358 - RNA, 20 nt, Human
caggcuggucuugagcuucu

SEQ ID NO: 877359 - RNA, 21 nt, Human
ccacacagcacgccacuccaa

SEQ ID NO: 877360 - RNA, 25 nt, Human
ccaggcccagcacugagucuugugc

SEQ ID NO: 877361 - RNA, 20 nt, Human
cccucuggcaaugcuuccag

SEQ ID NO: 877362 - RNA, 25 nt, Human
ccuccugggguuucagaucagucuu

SEQ ID NO: 877363 - RNA, 20 nt, Human
ccucuucaauuacucaguuu

SEQ ID NO: 877364 - RNA, 22 nt, Human
ccuguugcaugccaggcccagc

SEQ ID NO: 877365 - RNA, 24 nt, Human
cgagugauacaggcuggucuugag

SEQ ID NO: 877366 - RNA, 22 nt, Human
cuacaccagcccacaccuaugu

SEQ ID NO: 877367 - RNA, 18 nt, Human
cucugccucagggcucag

SEQ ID NO: 877368 - RNA, 18 nt, Human
cuugagaggggcuggaga

SEQ ID NO: 877369 - RNA, 22 nt, Human
cuugagaggggcuggagagaga

SEQ ID NO: 877370 - RNA, 23 nt, Human
gaucucugccucagggcucagag

SEQ ID NO: 877371 - RNA, 23 nt, Human
gccaggaccccgagugauacagg

SEQ ID NO: 877372 - RNA, 22 nt, Human
gcccagcacugagucuugugcc

SEQ ID NO: 877373 - RNA, 20 nt, Human
gggaagaagcugacaugagc

SEQ ID NO: 877374 - RNA, 19 nt, Human
uaacccagcagaggagcga

SEQ ID NO: 877375 - RNA, 23 nt, Human
uaacuuccuggcacucuuaguuu

SEQ ID NO: 877376 - RNA, 22 nt, Human
uaaguagcuauugccauguaga

SEQ ID NO: 877377 - RNA, 21 nt, Human
ucaccacacugagcaccugga

SEQ ID NO: 877378 - RNA, 25 nt, Human
uccacacagcacgccacuccaagga

SEQ ID NO: 877379 - RNA, 21 nt, Human
uccccaauauucauuauccac

SEQ ID NO: 877380 - RNA, 21 nt, Human
uccccgggcagcacucuggga

SEQ ID NO: 877381 - RNA, 24 nt, Human
uccccgggcagcacucugggagau

SEQ ID NO: 877382 - RNA, 18 nt, Human
ucuauccccgggcagcac

SEQ ID NO: 877383 - RNA, 22 nt, Human
ugagaggggcuggagagagaug

SEQ ID NO: 877384 - RNA, 18 nt, Human
ugauacaggcuggucuug

SEQ ID NO: 877385 - RNA, 25 nt, Human
ugccaggaccccgagugauacaggc

SEQ ID NO: 877386 - RNA, 19 nt, Human
ugggcagcuacaccagccc

SEQ ID NO: 877387 - RNA, 22 nt, Human
uguaaauaacucccauauuaaa

SEQ ID NO: 877388 - RNA, 21 nt, Human
uguugcaugccaggcccagca

SEQ ID NO: 877389 - RNA, 25 nt, Human
uucauuauccacacagcacgccacu

SEQ ID NO: 877390 - RNA, 20 nt, Human
uuuuuuuuucaaugcaagua

SEQ ID NO: 877391 - RNA, 20 nt, Human
aaaaaaaaaaagccaacaca

SEQ ID NO: 877392 - RNA, 20 nt, Human
aaaaaaaaaagccaacacac

SEQ ID NO: 877393 - RNA, 21 nt, Human
aacacacuuuuuucuuucuuu

SEQ ID NO: 877394 - RNA, 25 nt, Human
aaccaauuccuccucugcuuacacc

SEQ ID NO: 877395 - RNA, 24 nt, Human
aacuuucuaaaaaaaaaaaaaagc

SEQ ID NO: 877396 - RNA, 20 nt, Human
aagaacagcugaaaagaucu

SEQ ID NO: 877397 - RNA, 21 nt, Human
aagcucccaggccuuugggaa

SEQ ID NO: 877398 - RNA, 24 nt, Human
aagcucccaggccuuugggaacag

SEQ ID NO: 877399 - RNA, 21 nt, Human
aaguggcaggaggauguuugc

SEQ ID NO: 877400 - RNA, 23 nt, Human
aauucugcaaaucuuuauugagu

SEQ ID NO: 877401 - RNA, 19 nt, Human
acacacuuuuuucuuucuu

SEQ ID NO: 877402 - RNA, 20 nt, Human
auuccuccucugcuuacacc

SEQ ID NO: 877403 - RNA, 20 nt, Human
caaaaagcucccaggccuuu

SEQ ID NO: 877404 - RNA, 22 nt, Human
caaaaagcucccaggccuuugg

SEQ ID NO: 877405 - RNA, 19 nt, Human
caagccccacauagacucu

SEQ ID NO: 877406 - RNA, 25 nt, Human
cacacuuuuuucuuucuuuucaaaa

SEQ ID NO: 877407 - RNA, 23 nt, Human
cagcugaaacaaauucauauccu

SEQ ID NO: 877408 - RNA, 19 nt, Human
ccaauccauguuccagcca

SEQ ID NO: 877409 - RNA, 20 nt, Human
cucucugcugccacuucugc

SEQ ID NO: 877410 - RNA, 18 nt, Human
gcugggcacaggcuaggc

SEQ ID NO: 877411 - RNA, 22 nt, Human
uaagugaaccaauuccuccucu

SEQ ID NO: 877412 - RNA, 18 nt, Human
uacaggcgcuguguggaa

SEQ ID NO: 877413 - RNA, 23 nt, Human
uagacucuugguaaaaacaauuc

SEQ ID NO: 877414 - RNA, 19 nt, Human
ucaagccccacauagaccg

SEQ ID NO: 877415 - RNA, 23 nt, Human
ucacaauccuagcuccacaucac

SEQ ID NO: 877416 - RNA, 23 nt, Human
uccaugguuugauaaccuagaac

SEQ ID NO: 877417 - RNA, 27 nt, Human
ucccucucugcugccacuucugcacag

SEQ ID NO: 877418 - RNA, 26 nt, Human
ucuaacuuucuaaaaaaaaaaaaaag

SEQ ID NO: 877419 - RNA, 21 nt, Human
ugaaucaaaagcaggguuuaa

SEQ ID NO: 877420 - RNA, 20 nt, Human
ugggaacauaugcugugcuc

SEQ ID NO: 877421 - RNA, 21 nt, Human
ugguaccauagggagguguuu

SEQ ID NO: 877422 - RNA, 19 nt, Human
uguggaagaaccaauagca

SEQ ID NO: 877423 - RNA, 19 nt, Human
uguguggaagaaccaauag

SEQ ID NO: 877424 - RNA, 22 nt, Human
uucaaaaagcucccaggccuuu

SEQ ID NO: 877425 - RNA, 20 nt, Human
uucuuuucaaaaagcuccca

SEQ ID NO: 877426 - RNA, 20 nt, Human
uuuucuaucaaauccccaag

SEQ ID NO: 877427 - RNA, 18 nt, Human
uuuuuuuuuuuuuuuuug

SEQ ID NO: 877428 - RNA, 23 nt, Human
aaaaaaauacagaggaaccuaaa

SEQ ID NO: 877429 - RNA, 22 nt, Human
aaaaaauacagaggaaccuaaa

SEQ ID NO: 877430 - RNA, 22 nt, Human
aaaaagcagaaggaaggcagag

SEQ ID NO: 877431 - RNA, 22 nt, Human
aaaaauacagaggaaccuaaac

SEQ ID NO: 877432 - RNA, 21 nt, Human
aaaagaaaaaaaaauacagag

SEQ ID NO: 877433 - RNA, 19 nt, Human
aaagaaaaagacugggaga

SEQ ID NO: 877434 - RNA, 21 nt, Human
aagaaaaaaaaauacagagga

SEQ ID NO: 877435 - RNA, 18 nt, Human
aagaaaccaaaguugugg

SEQ ID NO: 877436 - RNA, 21 nt, Human
aagaaaccaaaguugugggua

SEQ ID NO: 877437 - RNA, 22 nt, Human
aagaugcuucuggcuuuuauua

SEQ ID NO: 877438 - RNA, 18 nt, Human
aagcucuucuugggucag

SEQ ID NO: 877439 - RNA, 23 nt, Human
aagcucuucuugggucagaaaug

SEQ ID NO: 877440 - RNA, 24 nt, Human
aauaaagaaaaagacugggagaga

SEQ ID NO: 877441 - RNA, 20 nt, Human
acacuacagugacuacaaac

SEQ ID NO: 877442 - RNA, 20 nt, Human
acagacaccucccagcagau

SEQ ID NO: 877443 - RNA, 19 nt, Human
accacaaggaacacuacag

SEQ ID NO: 877444 - RNA, 19 nt, Human
acccuaaaucagagacaga

SEQ ID NO: 877445 - RNA, 22 nt, Human
acuacaugcagauauacaaaug

SEQ ID NO: 877446 - RNA, 23 nt, Human
acucucaaagggcaggaaaagaa

SEQ ID NO: 877447 - RNA, 26 nt, Human
agaaaugcaauucuuugauggugccc

SEQ ID NO: 877448 - RNA, 20 nt, Human
agaaggaaggcagagcuuaa

SEQ ID NO: 877449 - RNA, 18 nt, Human
agacuaaaccauggaaau

SEQ ID NO: 877450 - RNA, 21 nt, Human
aggaacacuacagugacuaca

SEQ ID NO: 877451 - RNA, 18 nt, Human
aggaauggaauguagcca

SEQ ID NO: 877452 - RNA, 20 nt, Human
aguccugagucuugccugag

SEQ ID NO: 877453 - RNA, 26 nt, Human
auacaaauggaugauaagaaaccaaa

SEQ ID NO: 877454 - RNA, 21 nt, Human
auggaaauugggaacaagcac

SEQ ID NO: 877455 - RNA, 18 nt, Human
caaagacugaaacugaag

SEQ ID NO: 877456 - RNA, 23 nt, Human
caaagggcaggaaaagaaaaaaa

SEQ ID NO: 877457 - RNA, 19 nt, Human
caaggccaaccaaaggcca

SEQ ID NO: 877458 - RNA, 23 nt, Human
cagaauaaagaaaaagacuggga

SEQ ID NO: 877459 - RNA, 24 nt, Human
cagcagaugaaugcaucaccuccu

SEQ ID NO: 877460 - RNA, 28 nt, Human
cagcuucugaauguccagagcaguccuu

SEQ ID NO: 877461 - RNA, 24 nt, Human
caggcuccaaaaagcagaaggaag

SEQ ID NO: 877462 - RNA, 19 nt, Human
cagguucuugggcuucauc

SEQ ID NO: 877463 - RNA, 21 nt, Human
caucuuaucugaccacacaga

SEQ ID NO: 877464 - RNA, 21 nt, Human
ccaaaaagcagaaggaaggca

SEQ ID NO: 877465 - RNA, 19 nt, Human
cccuucugccuucuuuucc

SEQ ID NO: 877466 - RNA, 22 nt, Human
cuaaacccuaaaucagagacag

SEQ ID NO: 877467 - RNA, 24 nt, Human
gaaaagaaaaaaaaauacagagga

SEQ ID NO: 877468 - RNA, 19 nt, Human
gaauaaagaaaaagacugg

SEQ ID NO: 877469 - RNA, 19 nt, Human
gagagagaugggagcugau

SEQ ID NO: 877470 - RNA, 19 nt, Human
gccaaccaaaggccaggcu

SEQ ID NO: 877471 - RNA, 24 nt, Human
gugaaaaaagugaauuugccuaca

SEQ ID NO: 877472 - RNA, 22 nt, Human
uaaacccuaaaucagagacaga

SEQ ID NO: 877473 - RNA, 24 nt, Human
ucacgucccucaguggcucccugg

SEQ ID NO: 877474 - RNA, 21 nt, Human
ucaguggcucccuggaggaag

SEQ ID NO: 877475 - RNA, 24 nt, Human
ucccucaguggcucccuggaggaa

SEQ ID NO: 877476 - RNA, 20 nt, Human
ucccuggaggaagaaugauu

SEQ ID NO: 877477 - RNA, 22 nt, Human
ugaacuacacagcacacuugca

SEQ ID NO: 877478 - RNA, 18 nt, Human
ugaauguccagagcaguc

SEQ ID NO: 877479 - RNA, 22 nt, Human
ugaccacacagacaccucccag

SEQ ID NO: 877480 - RNA, 18 nt, Human
ugagaaaaauacucaggu

SEQ ID NO: 877481 - RNA, 19 nt, Human
ugcuuuggacuaucacguc

SEQ ID NO: 877482 - RNA, 18 nt, Human
ugggagagagaugggagc

SEQ ID NO: 877483 - RNA, 22 nt, Human
ugggagagagaugggagcugau

SEQ ID NO: 877484 - RNA, 22 nt, Human
ugucacagaauaaagaaaaaga

SEQ ID NO: 877485 - RNA, 23 nt, Human
uuagagggugaaaaaagugaauu

SEQ ID NO: 877486 - RNA, 21 nt, Human
uucauucaaggccaaccaaag

SEQ ID NO: 877487 - RNA, 23 nt, Human
uuuggaagcaccucucccuggaa

SEQ ID NO: 877488 - RNA, 22 nt, Human
uuuggggccccacucuucauuc

SEQ ID NO: 877489 - RNA, 24 nt, Human
uuuuuuuuuuuuuuuuauuacaag

SEQ ID NO: 877490 - RNA, 18 nt, Human
aaaacccaagagagcuuc

SEQ ID NO: 877491 - RNA, 19 nt, Human
aaguuccaguucucagugg

SEQ ID NO: 877492 - RNA, 23 nt, Human
acacaaauucggucagcuuucca

SEQ ID NO: 877493 - RNA, 19 nt, Human
acagcucucugacaggugg

SEQ ID NO: 877494 - RNA, 20 nt, Human
accucuggcucuucuggaug

SEQ ID NO: 877495 - RNA, 20 nt, Human
acugaaguaguuccaauggg

SEQ ID NO: 877496 - RNA, 18 nt, Human
agcaccucuggcucuucu

SEQ ID NO: 877497 - RNA, 21 nt, Human
aggaaaaagccauauagaaag

SEQ ID NO: 877498 - RNA, 24 nt, Human
aggacagcaagcaccucuggcucu

SEQ ID NO: 877499 - RNA, 19 nt, Human
agggggucgcccaagguag

SEQ ID NO: 877500 - RNA, 22 nt, Human
aguaaguuggauuugacugccc

SEQ ID NO: 877501 - RNA, 22 nt, Human
aguaguuccaaugggccuguga

SEQ ID NO: 877502 - RNA, 22 nt, Human
aucagcaagggggucgcccaag

SEQ ID NO: 877503 - RNA, 22 nt, Human
augggccuguggucuggauacc

SEQ ID NO: 877504 - RNA, 26 nt, Human
caagucccacagccugcagauccaca

SEQ ID NO: 877505 - RNA, 24 nt, Human
cacacggaaaaaggaaaaagccuu

SEQ ID NO: 877506 - RNA, 21 nt, Human
cacaggccgaguguuuggaac

SEQ ID NO: 877507 - RNA, 21 nt, Human
caccacugggacuggggccug

SEQ ID NO: 877508 - RNA, 21 nt, Human
cacggaaaaaggaaaaagcca

SEQ ID NO: 877509 - RNA, 20 nt, Human
cagcacgggaaaacuggaug

SEQ ID NO: 877510 - RNA, 19 nt, Human
cagccugcagauccacacu

SEQ ID NO: 877511 - RNA, 22 nt, Human
caggccgaguguuuggaacacc

SEQ ID NO: 877512 - RNA, 20 nt, Human
cauagucuucaagucccaca

SEQ ID NO: 877513 - RNA, 19 nt, Human
caucagcaagggggucgcc

SEQ ID NO: 877514 - RNA, 20 nt, Human
ccaagguagaaaguucccag

SEQ ID NO: 877515 - RNA, 18 nt, Human
ccaucacauagaaggggg

SEQ ID NO: 877516 - RNA, 18 nt, Human
cccacagccugcagaucc

SEQ ID NO: 877517 - RNA, 22 nt, Human
cccgugcaccacugugguccuc

SEQ ID NO: 877518 - RNA, 18 nt, Human
ccggaacccuucuuugac

SEQ ID NO: 877519 - RNA, 19 nt, Human
ccugaaauacuccucugca

SEQ ID NO: 877520 - RNA, 23 nt, Human
ccugaacucccucucuauggcau

SEQ ID NO: 877521 - RNA, 24 nt, Human
cgugcaccacugugguccucugcu

SEQ ID NO: 877522 - RNA, 23 nt, Human
cucgauacugcuuaacccagguu

SEQ ID NO: 877523 - RNA, 23 nt, Human
cugaacucccucucuauggcaug

SEQ ID NO: 877524 - RNA, 19 nt, Human
cugaaguccccgugcacca

SEQ ID NO: 877525 - RNA, 24 nt, Human
cugcugccuguggggcaccacugg

SEQ ID NO: 877526 - RNA, 19 nt, Human
cuucaagucccacagccug

SEQ ID NO: 877527 - RNA, 21 nt, Human
gaaaguucccagucaaggaca

SEQ ID NO: 877528 - RNA, 18 nt, Human
gaagauggaggggcagcc

SEQ ID NO: 877529 - RNA, 20 nt, Human
gaucacgauuagccagccug

SEQ ID NO: 877530 - RNA, 21 nt, Human
gauggaaggagugucccuggg

SEQ ID NO: 877531 - RNA, 22 nt, Human
ggacuggggccuggcccacgug

SEQ ID NO: 877532 - RNA, 21 nt, Human
ggauggcagguaaugagccag

SEQ ID NO: 877533 - RNA, 21 nt, Human
ggcagccauucgaucagccuc

SEQ ID NO: 877534 - RNA, 27 nt, Human
gucacagucauuaauaccucucagcaa

SEQ ID NO: 877535 - RNA, 19 nt, Human
gucuuuguagaugagaccu

SEQ ID NO: 877536 - RNA, 18 nt, Human
gugucaagucacaguccc

SEQ ID NO: 877537 - RNA, 23 nt, Human
guguccccaaaaccccuuuccaa

SEQ ID NO: 877538 - RNA, 21 nt, Human
uagaagggggugccaaugaca

SEQ ID NO: 877539 - RNA, 22 nt, Human
uagaaguuccaguucucagugg

SEQ ID NO: 877540 - RNA, 18 nt, Human
ucaagaacguuagggaca

SEQ ID NO: 877541 - RNA, 22 nt, Human
ucaauguaaaacccaagagagc

SEQ ID NO: 877542 - RNA, 26 nt, Human
ucacagucauuaauaccucucagcaa

SEQ ID NO: 877543 - RNA, 21 nt, Human
uccaagccuggcagggaaggg

SEQ ID NO: 877544 - RNA, 19 nt, Human
uccccaaaaccccuuucca

SEQ ID NO: 877545 - RNA, 23 nt, Human
uccccaaaaccccuuuccaaaau

SEQ ID NO: 877546 - RNA, 19 nt, Human
ucucuauggcaugggcaga

SEQ ID NO: 877547 - RNA, 18 nt, Human
ucuggaacggagcuauaa

SEQ ID NO: 877548 - RNA, 19 nt, Human
ucuguggcugggcuccaag

SEQ ID NO: 877549 - RNA, 21 nt, Human
ucuuugagguacuucugcaag

SEQ ID NO: 877550 - RNA, 26 nt, Human
ucuuugagguacuucugcaaggaauc

SEQ ID NO: 877551 - RNA, 20 nt, Human
ugaaaacccggaacccuucu

SEQ ID NO: 877552 - RNA, 18 nt, Human
ugacagguggagagaggc

SEQ ID NO: 877553 - RNA, 23 nt, Human
ugacagguggagagaggcucucu

SEQ ID NO: 877554 - RNA, 22 nt, Human
ugagccaggcagcuguaggcca

SEQ ID NO: 877555 - RNA, 19 nt, Human
ugagguacuucugcaagga

SEQ ID NO: 877556 - RNA, 21 nt, Human
ugcagccacacggaaaaagga

SEQ ID NO: 877557 - RNA, 21 nt, Human
ugccuguggggcaccacuggg

SEQ ID NO: 877558 - RNA, 21 nt, Human
uggcguggaauauaguccccu

SEQ ID NO: 877559 - RNA, 22 nt, Human
uguccccaaaaccccuuuccaa

SEQ ID NO: 877560 - RNA, 18 nt, Human
uguggagcuugcuugccc

SEQ ID NO: 877561 - RNA, 21 nt, Human
ugugucaagucacagucauua

SEQ ID NO: 877562 - RNA, 21 nt, Human
uguguucauggcaguguauau

SEQ ID NO: 877563 - RNA, 22 nt, Human
uguguucauggcaguguauaug

SEQ ID NO: 877564 - RNA, 19 nt, Human
uuccaucgucuuuuucaca

SEQ ID NO: 877565 - RNA, 19 nt, Human
uucucagugggagggagcc

SEQ ID NO: 877566 - RNA, 21 nt, Human
uucucagugggagggagcccc

SEQ ID NO: 877567 - RNA, 20 nt, Human
uuguagaugagaccugggca

SEQ ID NO: 877568 - RNA, 21 nt, Human
uuucacaggccgaguguuugg

SEQ ID NO: 877569 - RNA, 24 nt, Human
uuuuuuuuuuuuuuuugccuccga

SEQ ID NO: 877570 - RNA, 18 nt, Human
uuuuuuuuuuuuuuuuug

SEQ ID NO: 877571 - RNA, 21 nt, Human
uuuuuuuuuuuuuuuuugccu

SEQ ID NO: 877572 - RNA, 23 nt, Human
uuuuuuuuuuuuuuuuugccucc

SEQ ID NO: 877573 - RNA, 19 nt, Human
aaacaccaggaggcuaccu

SEQ ID NO: 877574 - RNA, 19 nt, Human
aaacccacgagccacgcuc

SEQ ID NO: 877575 - RNA, 18 nt, Human
aaagacuagaaaaaggcu

SEQ ID NO: 877576 - RNA, 25 nt, Human
aagugucaaagauggcauuugaacc

SEQ ID NO: 877577 - RNA, 19 nt, Human
accaucuggacucuuacag

SEQ ID NO: 877578 - RNA, 22 nt, Human
agaaaccagaucucucugcccu

SEQ ID NO: 877579 - RNA, 18 nt, Human
agaggcugcugggccuca

SEQ ID NO: 877580 - RNA, 19 nt, Human
aggcaaaagguacaacagg

SEQ ID NO: 877581 - RNA, 22 nt, Human
aggcaaaagguacaacagggaa

SEQ ID NO: 877582 - RNA, 18 nt, Human
cagggccaggccacucuc

SEQ ID NO: 877583 - RNA, 21 nt, Human
cagggccaggccacucucugc

SEQ ID NO: 877584 - RNA, 28 nt, Human
ccucaagaaguggaggccucaggcccau

SEQ ID NO: 877585 - RNA, 19 nt, Human
ccucaggcccaugaucuau

SEQ ID NO: 877586 - RNA, 19 nt, Human
ccucccuggccauccagga

SEQ ID NO: 877587 - RNA, 20 nt, Human
ccucccuggccauccaggaa

SEQ ID NO: 877588 - RNA, 23 nt, Human
ccugcaggcaaaagguacaacag

SEQ ID NO: 877589 - RNA, 18 nt, Human
ccuggcuccaccaucugg

SEQ ID NO: 877590 - RNA, 18 nt, Human
cgcccaaaaccauuuuac

SEQ ID NO: 877591 - RNA, 18 nt, Human
cgcccaccgcugcaccgc

SEQ ID NO: 877592 - RNA, 22 nt, Human
cuccagggccaggccacucucu

SEQ ID NO: 877593 - RNA, 18 nt, Human
cuuacagccuucaaucuc

SEQ ID NO: 877594 - RNA, 21 nt, Human
cuucuagaggcugcugggccu

SEQ ID NO: 877595 - RNA, 24 nt, Human
gacuucacggaaaacccacgagcc

SEQ ID NO: 877596 - RNA, 21 nt, Human
ggggaaggaacuuacaugaca

SEQ ID NO: 877597 - RNA, 21 nt, Human
uacaacagggaaacacgagaa

SEQ ID NO: 877598 - RNA, 24 nt, Human
uaccuucuagaggcugcugggccu

SEQ ID NO: 877599 - RNA, 22 nt, Human
uagaaguuaucgcccaaaacca

SEQ ID NO: 877600 - RNA, 19 nt, Human
uagaggcugcugggccuca

SEQ ID NO: 877601 - RNA, 21 nt, Human
ucacggaaaacccacgagcca

SEQ ID NO: 877602 - RNA, 18 nt, Human
ucugaaaagacuagaaaa

SEQ ID NO: 877603 - RNA, 21 nt, Human
ucugaaaagacuagaaaaagg

SEQ ID NO: 877604 - RNA, 25 nt, Human
ucuucagacaccacccugaguugca

SEQ ID NO: 877605 - RNA, 24 nt, Human
ugcccugcaggcaaaagguacaac

SEQ ID NO: 877606 - RNA, 23 nt, Human
uggacucuuacagccuucaaucu

SEQ ID NO: 877607 - RNA, 20 nt, Human
ugucaaagauggcauuugaa

SEQ ID NO: 877608 - RNA, 21 nt, Human
uuuacugggagaacaaacacc

SEQ ID NO: 877609 - RNA, 24 nt, Human
uuuuuuuuuuuuuuuuuuuuuggg

SEQ ID NO: 877610 - RNA, 18 nt, Human
aaaaggaggcagccgaga

SEQ ID NO: 877611 - RNA, 18 nt, Human
aaagugaugccaagagaa

SEQ ID NO: 877612 - RNA, 20 nt, Human
aaccauugaagaccaggguc

SEQ ID NO: 877613 - RNA, 23 nt, Human
accguccccgcugccagccacgc

SEQ ID NO: 877614 - RNA, 22 nt, Human
accucgucuccucccuccucag

SEQ ID NO: 877615 - RNA, 22 nt, Human
agagaaccucgucuccucccuc

SEQ ID NO: 877616 - RNA, 19 nt, Human
aggcccuggggguugacau

SEQ ID NO: 877617 - RNA, 21 nt, Human
agggagaaagugaugccaaga

SEQ ID NO: 877618 - RNA, 20 nt, Human
agggugucuaguucugcagc

SEQ ID NO: 877619 - RNA, 18 nt, Human
caaauauucacuaaauau

SEQ ID NO: 877620 - RNA, 20 nt, Human
caacggaaaaggaggcagcc

SEQ ID NO: 877621 - RNA, 28 nt, Human
caagagaaccucgucuccucccuccuca

SEQ ID NO: 877622 - RNA, 22 nt, Human
cacagggaggugguuuugccag

SEQ ID NO: 877623 - RNA, 21 nt, Human
caccacuggaaucucaauagc

SEQ ID NO: 877624 - RNA, 23 nt, Human
cacccaaaacuuuccgcugggca

SEQ ID NO: 877625 - RNA, 20 nt, Human
cacccagacccccgccgacc

SEQ ID NO: 877626 - RNA, 23 nt, Human
caggaaguggacccccccacccu

SEQ ID NO: 877627 - RNA, 24 nt, Human
ccaaagguuagacuuccucccggc

SEQ ID NO: 877628 - RNA, 23 nt, Human
ccaggaugugguuuggggcgcga

SEQ ID NO: 877629 - RNA, 22 nt, Human
ccagggagaaagugaugccaag

SEQ ID NO: 877630 - RNA, 23 nt, Human
cccagacccccgccgaccucgga

SEQ ID NO: 877631 - RNA, 19 nt, Human
cccaggccaaaucuucaag

SEQ ID NO: 877632 - RNA, 22 nt, Human
ccccacccugcacaucccuucu

SEQ ID NO: 877633 - RNA, 21 nt, Human
cccggcacccaaaacuuuccg

SEQ ID NO: 877634 - RNA, 18 nt, Human
cccuaccugcccaaucag

SEQ ID NO: 877635 - RNA, 18 nt, Human
ccugcgccccggcgcacc

SEQ ID NO: 877636 - RNA, 22 nt, Human
cgcgcacgcgacucuugggccu

SEQ ID NO: 877637 - RNA, 20 nt, Human
cgcuccaggaugugguuugg

SEQ ID NO: 877638 - RNA, 23 nt, Human
cuaguucugcagccagggagaaa

SEQ ID NO: 877639 - RNA, 19 nt, Human
cuggaaucucaauagcaca

SEQ ID NO: 877640 - RNA, 22 nt, Human
cugggcagagucccuaccugcc

SEQ ID NO: 877641 - RNA, 19 nt, Human
cuugggccugcgccccggc

SEQ ID NO: 877642 - RNA, 20 nt, Human
cuuuccgcugggcagagucc

SEQ ID NO: 877643 - RNA, 22 nt, Human
gagcaggaaguggaccccccca

SEQ ID NO: 877644 - RNA, 18 nt, Human
gcagagucccuaccugcc

SEQ ID NO: 877645 - RNA, 19 nt, Human
gcccgggggugggcccggg

SEQ ID NO: 877646 - RNA, 27 nt, Human
ggagcagaugaguaggacacgcgucug

SEQ ID NO: 877647 - RNA, 21 nt, Human
gggagcagaugaguaggacac

SEQ ID NO: 877648 - RNA, 23 nt, Human
gggcgcgaagggacaacggaaaa

SEQ ID NO: 877649 - RNA, 21 nt, Human
gucucacuggcccaggccaaa

SEQ ID NO: 877650 - RNA, 23 nt, Human
uaaaucaaauauucacuaaauau

SEQ ID NO: 877651 - RNA, 30 nt, Human
ucagcgcggcccgggggugggcccgggggg

SEQ ID NO: 877652 - RNA, 19 nt, Human
ucccaaagguuagacuucc

SEQ ID NO: 877653 - RNA, 20 nt, Human
uccgcugggcagagucccua

SEQ ID NO: 877654 - RNA, 19 nt, Human
uccugcuuucuuuucuccc

SEQ ID NO: 877655 - RNA, 20 nt, Human
ucucaauagcacauuuuccu

SEQ ID NO: 877656 - RNA, 20 nt, Human
ucucacuggcccaggccaaa

SEQ ID NO: 877657 - RNA, 23 nt, Human
ugaugccaagagaaccucgucuc

SEQ ID NO: 877658 - RNA, 21 nt, Human
ugcagccagggagaaagugau

SEQ ID NO: 877659 - RNA, 24 nt, Human
ugcagccagggagaaagugaugcc

SEQ ID NO: 877660 - RNA, 19 nt, Human
uggaagguugucuucuaga

SEQ ID NO: 877661 - RNA, 22 nt, Human
ugucuuggagucucccaaaggu

SEQ ID NO: 877662 - RNA, 18 nt, Human
uguguggcacagggaggu

SEQ ID NO: 877663 - RNA, 19 nt, Human
uuugaaggggaaauaaaua

SEQ ID NO: 877664 - RNA, 18 nt, Human
aaacuggugaagcuagca

SEQ ID NO: 877665 - RNA, 22 nt, Human
aaagacagaaaagccacaagga

SEQ ID NO: 877666 - RNA, 23 nt, Human
aaauaacagggucuuaggaagga

SEQ ID NO: 877667 - RNA, 19 nt, Human
aacccuacuuccucauccc

SEQ ID NO: 877668 - RNA, 21 nt, Human
aauaacacaaauaacaggguc

SEQ ID NO: 877669 - RNA, 23 nt, Human
acaaggaacagaaacuggugaag

SEQ ID NO: 877670 - RNA, 18 nt, Human
acacacauacacacagga

SEQ ID NO: 877671 - RNA, 21 nt, Human
acagaaacuggugaagcuagc

SEQ ID NO: 877672 - RNA, 22 nt, Human
accacucacacacauacacaca

SEQ ID NO: 877673 - RNA, 19 nt, Human
acccuacuuccucauccca

SEQ ID NO: 877674 - RNA, 20 nt, Human
accugucaggagccucccuc

SEQ ID NO: 877675 - RNA, 27 nt, Human
acucucccacccuccugcccauccccu

SEQ ID NO: 877676 - RNA, 23 nt, Human
acuggccugcccaccacucacac

SEQ ID NO: 877677 - RNA, 22 nt, Human
agaaaaucugccccuguaaagg

SEQ ID NO: 877678 - RNA, 18 nt, Human
agaaacuggugaagcuag

SEQ ID NO: 877679 - RNA, 21 nt, Human
agaggacuugugggcugagau

SEQ ID NO: 877680 - RNA, 23 nt, Human
agcaaaagacagaaaagccacaa

SEQ ID NO: 877681 - RNA, 21 nt, Human
agcuagugagcaguaucccua

SEQ ID NO: 877682 - RNA, 23 nt, Human
aggaagagcaaggagguaucagc

SEQ ID NO: 877683 - RNA, 22 nt, Human
aggcaagaagggaaggggaagg

SEQ ID NO: 877684 - RNA, 24 nt, Human
aggcaagaagggaaggggaaggag

SEQ ID NO: 877685 - RNA, 25 nt, Human
aggcaggaaauaacacaaagggacc

SEQ ID NO: 877686 - RNA, 22 nt, Human
agggcagcccacugcaggacuc

SEQ ID NO: 877687 - RNA, 19 nt, Human
auccacucucccacccucc

SEQ ID NO: 877688 - RNA, 22 nt, Human
auuucauuguugaacugagcag

SEQ ID NO: 877689 - RNA, 24 nt, Human
auuucauuguugaacugagcagaa

SEQ ID NO: 877690 - RNA, 26 nt, Human
cacucucccacccuccugcccauccc

SEQ ID NO: 877691 - RNA, 23 nt, Human
cagaaaagccacaaggaauccau

SEQ ID NO: 877692 - RNA, 21 nt, Human
cauccccugcccccccucacc

SEQ ID NO: 877693 - RNA, 23 nt, Human
caucuaggaagagcaaggaggua

SEQ ID NO: 877694 - RNA, 24 nt, Human
caucuaggaagagcaaggagguau

SEQ ID NO: 877695 - RNA, 18 nt, Human
ccagagcagacccacagg

SEQ ID NO: 877696 - RNA, 22 nt, Human
ccaggcucuaaccugcagcgcc

SEQ ID NO: 877697 - RNA, 24 nt, Human
cccacacaccacaggcacacaccu

SEQ ID NO: 877698 - RNA, 21 nt, Human
cccaccacucacacacauaca

SEQ ID NO: 877699 - RNA, 19 nt, Human
cccagaaaaagcaacucaa

SEQ ID NO: 877700 - RNA, 18 nt, Human
ccccugaguaucccuaga

SEQ ID NO: 877701 - RNA, 24 nt, Human
ccccugcccccccucaccaggcug

SEQ ID NO: 877702 - RNA, 18 nt, Human
cccuaggguggagaggac

SEQ ID NO: 877703 - RNA, 22 nt, Human
cccugccacuggccugcccacc

SEQ ID NO: 877704 - RNA, 23 nt, Human
ccuaagaccgcugacagggccuc

SEQ ID NO: 877705 - RNA, 19 nt, Human
ccucccucaggaaacuggg

SEQ ID NO: 877706 - RNA, 25 nt, Human
ccucuauaccagccuguaucugcuc

SEQ ID NO: 877707 - RNA, 22 nt, Human
ccugcagggccugccuagggga

SEQ ID NO: 877708 - RNA, 19 nt, Human
ccuguaucugcuccuagag

SEQ ID NO: 877709 - RNA, 24 nt, Human
cgccgagggcuccggggacggcgg

SEQ ID NO: 877710 - RNA, 24 nt, Human
cggggacggcgggcagaauccgcu

SEQ ID NO: 877711 - RNA, 22 nt, Human
cucauccacucucccacccucc

SEQ ID NO: 877712 - RNA, 22 nt, Human
cucccgugaccccuaguuaugc

SEQ ID NO: 877713 - RNA, 22 nt, Human
cucuauaccagccuguaucugc

SEQ ID NO: 877714 - RNA, 26 nt, Human
cucuauaccagccuguaucugcuccc

SEQ ID NO: 877715 - RNA, 22 nt, Human
cugcauccucuauaccagccug

SEQ ID NO: 877716 - RNA, 24 nt, Human
cugccacuggccugcccaccacuc

SEQ ID NO: 877717 - RNA, 19 nt, Human
gagcagacccacaggcaug

SEQ ID NO: 877718 - RNA, 18 nt, Human
gagcagcaucccacaagg

SEQ ID NO: 877719 - RNA, 18 nt, Human
gaggugggcaucuaggaa

SEQ ID NO: 877720 - RNA, 21 nt, Human
gcaaaagacagaaaagccaca

SEQ ID NO: 877721 - RNA, 22 nt, Human
gcaagaagggaaggggaaggag

SEQ ID NO: 877722 - RNA, 18 nt, Human
gcaucuaggaagagcaag

SEQ ID NO: 877723 - RNA, 18 nt, Human
gcccacacaccacaggca

SEQ ID NO: 877724 - RNA, 21 nt, Human
gcccauccccugcccccccuc

SEQ ID NO: 877725 - RNA, 18 nt, Human
gccugggagaguguggga

SEQ ID NO: 877726 - RNA, 19 nt, Human
ggaaggacaaaaauggaag

SEQ ID NO: 877727 - RNA, 22 nt, Human
ggcaagaagggaaggggaagga

SEQ ID NO: 877728 - RNA, 23 nt, Human
gggaaggggaaggagagcaggag

SEQ ID NO: 877729 - RNA, 23 nt, Human
gggaauggugaggcaagaaggga

SEQ ID NO: 877730 - RNA, 19 nt, Human
gggcaugggggagcgaggg

SEQ ID NO: 877731 - RNA, 20 nt, Human
ggucugacaaagggcaccug

SEQ ID NO: 877732 - RNA, 20 nt, Human
guacagggcagcccacugca

SEQ ID NO: 877733 - RNA, 19 nt, Human
uaacacaaauaacaggguc

SEQ ID NO: 877734 - RNA, 22 nt, Human
uaacccaccgaccuucacacac

SEQ ID NO: 877735 - RNA, 21 nt, Human
uaacccuacuuccucauccca

SEQ ID NO: 877736 - RNA, 23 nt, Human
uagaagugagcuguagaaagagg

SEQ ID NO: 877737 - RNA, 20 nt, Human
uagcaaaagacagaaaagcc

SEQ ID NO: 877738 - RNA, 23 nt, Human
uagcaaaagacagaaaagccaca

SEQ ID NO: 877739 - RNA, 26 nt, Human
uagcaaaagacagaaaagccacaagg

SEQ ID NO: 877740 - RNA, 22 nt, Human
ucacacaccagagcagacccac

SEQ ID NO: 877741 - RNA, 18 nt, Human
ucauccacucucccaccc

SEQ ID NO: 877742 - RNA, 19 nt, Human
ucaugagguucaggguaca

SEQ ID NO: 877743 - RNA, 18 nt, Human
uccaugcaggggcugggg

SEQ ID NO: 877744 - RNA, 19 nt, Human
ucccacaaggaacagaaac

SEQ ID NO: 877745 - RNA, 22 nt, Human
ucccacccuccugcccaucccc

SEQ ID NO: 877746 - RNA, 23 nt, Human
uccuagagcagcccacacaccac

SEQ ID NO: 877747 - RNA, 26 nt, Human
uccugcccauccccugcccccccuca

SEQ ID NO: 877748 - RNA, 19 nt, Human
ucucccacccuccugccca

SEQ ID NO: 877749 - RNA, 21 nt, Human
ucugccccuguaaagggcaaa

SEQ ID NO: 877750 - RNA, 25 nt, Human
ucuuaggaaggacaaaaauggaagc

SEQ ID NO: 877751 - RNA, 22 nt, Human
ugaacugagcagaaaaucugcc

SEQ ID NO: 877752 - RNA, 18 nt, Human
ugagguucaggguacagg

SEQ ID NO: 877753 - RNA, 23 nt, Human
ugagguucaggguacagggcagc

SEQ ID NO: 877754 - RNA, 23 nt, Human
ugcaggggcuggggccggcccug

SEQ ID NO: 877755 - RNA, 22 nt, Human
ugccaggcucuaaccugcagcg

SEQ ID NO: 877756 - RNA, 24 nt, Human
ugccaggucucauugccacguccu

SEQ ID NO: 877757 - RNA, 18 nt, Human
ugcccuaccuuucugcau

SEQ ID NO: 877758 - RNA, 18 nt, Human
ugccgagcaagggcgagg

SEQ ID NO: 877759 - RNA, 19 nt, Human
ugccuaggggaauggugag

SEQ ID NO: 877760 - RNA, 21 nt, Human
ugcuccuagagcagcccacac

SEQ ID NO: 877761 - RNA, 19 nt, Human
uggcccaggguaaggaccc

SEQ ID NO: 877762 - RNA, 26 nt, Human
uggggccggcccugccacuggccugc

SEQ ID NO: 877763 - RNA, 21 nt, Human
ugguagggucugacaaagggc

SEQ ID NO: 877764 - RNA, 18 nt, Human
uguaaagggcaaaccucc

SEQ ID NO: 877765 - RNA, 21 nt, Human
ugucaggagccucccucagga

SEQ ID NO: 877766 - RNA, 21 nt, Human
ugugcaggagccuaagaccgc

SEQ ID NO: 877767 - RNA, 19 nt, Human
uucaguaggcacacaguua

SEQ ID NO: 877768 - RNA, 25 nt, Human
uuuuuuuuuuuuuggcuuugcaggg

SEQ ID NO: 877769 - RNA, 18 nt, Human
uuuuuuuuuuuuuuuuug

SEQ ID NO: 877770 - RNA, 24 nt, Human
uuuuuuuuuuuuuuuuuuggcuuu

SEQ ID NO: 877771 - RNA, 22 nt, Human
uuuuuuuuuuuuuuuuuuuggc

SEQ ID NO: 877772 - RNA, 23 nt, Human
aacuuuuuuuagccacagaccuu

SEQ ID NO: 877773 - RNA, 19 nt, Human
cacggcgggcugagccugg

SEQ ID NO: 877774 - RNA, 23 nt, Human
cacuggcacugcagggaaccuuc

SEQ ID NO: 877775 - RNA, 21 nt, Human
ccagccacggcgggcugagcc

SEQ ID NO: 877776 - RNA, 22 nt, Human
ccugggccugucaagcccugac

SEQ ID NO: 877777 - RNA, 22 nt, Human
cucaacagagaauguuuaugga

SEQ ID NO: 877778 - RNA, 19 nt, Human
gagugugggagugggaggg

SEQ ID NO: 877779 - RNA, 18 nt, Human
gcagcccaggggccagcc

SEQ ID NO: 877780 - RNA, 19 nt, Human
gccugggccugucaagccc

SEQ ID NO: 877781 - RNA, 18 nt, Human
gcgggcugagccugggcc

SEQ ID NO: 877782 - RNA, 18 nt, Human
gggcagcccaggggccag

SEQ ID NO: 877783 - RNA, 19 nt, Human
gggccugucaagcccugac

SEQ ID NO: 877784 - RNA, 21 nt, Human
gggcuacagucucgccagcug

SEQ ID NO: 877785 - RNA, 22 nt, Human
ucccugcugcagcacuggcacu

SEQ ID NO: 877786 - RNA, 26 nt, Human
ucccugcugcagcacuggcacugcag

SEQ ID NO: 877787 - RNA, 23 nt, Human
uccucaacagagaauguuuaugg

SEQ ID NO: 877788 - RNA, 21 nt, Human
ucgcugcuucugcccagcucu

SEQ ID NO: 877789 - RNA, 19 nt, Human
ugcaagagugaguguggga

SEQ ID NO: 877790 - RNA, 21 nt, Human
ugcuuaaagacacaggcucug

SEQ ID NO: 877791 - RNA, 18 nt, Human
ugcuucugcccagcucuc

SEQ ID NO: 877792 - RNA, 21 nt, Human
ugcuucugcccagcucucccu

SEQ ID NO: 877793 - RNA, 19 nt, Human
uuuauggagucagcacgaa

SEQ ID NO: 877794 - RNA, 25 nt, Human
uuuuuuuuuuuuuuuuuugauuuuu

SEQ ID NO: 877795 - RNA, 20 nt, Human
uuuuuuuuuuuuuuuuuugg

SEQ ID NO: 877796 - RNA, 20 nt, Human
aagacuuuuguugaaaaauu

SEQ ID NO: 877797 - RNA, 20 nt, Human
aauagaauacaaaaagcuag

SEQ ID NO: 877798 - RNA, 19 nt, Human
acuuuuuuucuaaagagaa

SEQ ID NO: 877799 - RNA, 21 nt, Human
agaaagugaugaaaaauccaa

SEQ ID NO: 877800 - RNA, 24 nt, Human
agaagguaauauucaguuaccaga

SEQ ID NO: 877801 - RNA, 25 nt, Human
agaugcuuauuuucuaccuuuuccu

SEQ ID NO: 877802 - RNA, 21 nt, Human
augaaaaauccaaaauuucug

SEQ ID NO: 877803 - RNA, 18 nt, Human
caaaaagcuacacuggac

SEQ ID NO: 877804 - RNA, 20 nt, Human
caaagcuucagagcucaaaa

SEQ ID NO: 877805 - RNA, 22 nt, Human
caaccaccuaaaacugaaauuu

SEQ ID NO: 877806 - RNA, 19 nt, Human
cagaaggccaucuccacca

SEQ ID NO: 877807 - RNA, 23 nt, Human
caucaaauaauauaauaccaaau

SEQ ID NO: 877808 - RNA, 30 nt, Human
ccucuuaugaacgaaagaaauauagagguu

SEQ ID NO: 877809 - RNA, 27 nt, Human
cuaaaacugaaauuuucuguacuuagu

SEQ ID NO: 877810 - RNA, 19 nt, Human
gaacgaaagaaauauagag

SEQ ID NO: 877811 - RNA, 22 nt, Human
gcaaacaucaaauaauauaaua

SEQ ID NO: 877812 - RNA, 24 nt, Human
gccaucuccaccacugaaugauuc

SEQ ID NO: 877813 - RNA, 21 nt, Human
uaacaccacagaacuuuugaa

SEQ ID NO: 877814 - RNA, 24 nt, Human
uaacaccacagaacuuuugaauau

SEQ ID NO: 877815 - RNA, 24 nt, Human
uaagauugaaacagacuauuacaa

SEQ ID NO: 877816 - RNA, 26 nt, Human
uacuuuuuuucuaaagagaaagugau

SEQ ID NO: 877817 - RNA, 23 nt, Human
uagggcaucacagguuuuagaaa

SEQ ID NO: 877818 - RNA, 24 nt, Human
uaguacaacaccuucauucuuaau

SEQ ID NO: 877819 - RNA, 21 nt, Human
ucaaagcuucagagcucaaaa

SEQ ID NO: 877820 - RNA, 21 nt, Human
uccaaagcuugauuuaaaugu

SEQ ID NO: 877821 - RNA, 25 nt, Human
ugaaaaauccaaaauuucugcaucc

SEQ ID NO: 877822 - RNA, 18 nt, Human
ugaaacagacuauuacaa

SEQ ID NO: 877823 - RNA, 24 nt, Human
ugaaacagacuauuacaacaauau

SEQ ID NO: 877824 - RNA, 23 nt, Human
ugaauauccccuuuucccaauug

SEQ ID NO: 877825 - RNA, 21 nt, Human
uuaguacaacaccuucauucu

SEQ ID NO: 877826 - RNA, 19 nt, Human
uucugcauccaguguuuga

SEQ ID NO: 877827 - RNA, 26 nt, Human
uuugaauauccccuuuucccaauugu

SEQ ID NO: 877828 - RNA, 21 nt, Human
aaaguagaaauaucugcuuac

SEQ ID NO: 877829 - RNA, 21 nt, Human
acggcucccuccucccgcggc

SEQ ID NO: 877830 - RNA, 18 nt, Human
agguaaauucaaacaaaa

SEQ ID NO: 877831 - RNA, 24 nt, Human
auagcauuccccucccacaccaca

SEQ ID NO: 877832 - RNA, 26 nt, Human
caaacaaaaaguaaaucauccucagu

SEQ ID NO: 877833 - RNA, 23 nt, Human
caaacacuagagcugggggccag

SEQ ID NO: 877834 - RNA, 20 nt, Human
cagcuccucggugacggcuc

SEQ ID NO: 877835 - RNA, 22 nt, Human
cagcuccucggugacggcuccc

SEQ ID NO: 877836 - RNA, 25 nt, Human
cucccacaccacaaaaguagaaaua

SEQ ID NO: 877837 - RNA, 23 nt, Human
cugcccggggcagcgagcggcag

SEQ ID NO: 877838 - RNA, 20 nt, Human
gagcugggggccagagaaag

SEQ ID NO: 877839 - RNA, 21 nt, Human
gcauuccccucccacaccaca

SEQ ID NO: 877840 - RNA, 30 nt, Human
gcggcagcuccucggugacggcucccuccu

SEQ ID NO: 877841 - RNA, 21 nt, Human
uacuaugcuaaugccauaggu

SEQ ID NO: 877842 - RNA, 28 nt, Human
uccccucccacaccacaaaaguagaaau

SEQ ID NO: 877843 - RNA, 18 nt, Human
ugccuugguugcaacugu

SEQ ID NO: 877844 - RNA, 18 nt, Human
ugguugcaacugugcccc

SEQ ID NO: 877845 - RNA, 19 nt, Human
aaaaagcucaccucacaac

SEQ ID NO: 877846 - RNA, 21 nt, Human
cgucuuugguccucuuuccaa

SEQ ID NO: 877847 - RNA, 21 nt, Human
cucuggggaugcuugcuuccc

SEQ ID NO: 877848 - RNA, 19 nt, Human
cugaaaaagcucaccucac

SEQ ID NO: 877849 - RNA, 24 nt, Human
ugaaaaagcucaccucacaacgcc

SEQ ID NO: 877850 - RNA, 24 nt, Human
ugaugauacacacaaaucugccuc

SEQ ID NO: 877851 - RNA, 24 nt, Human
ugccucaauuauucaauuaguuuu

SEQ ID NO: 877852 - RNA, 21 nt, Human
uuaguuuuguugggcccaauu

SEQ ID NO: 877853 - RNA, 22 nt, Human
aggaagaaggaaaguacacugg

SEQ ID NO: 877854 - RNA, 23 nt, Human
agggaagaagugauggagaggaa

SEQ ID NO: 877855 - RNA, 21 nt, Human
agugauggagaggaagaagga

SEQ ID NO: 877856 - RNA, 23 nt, Human
caaagaggaucccgaaagacagu

SEQ ID NO: 877857 - RNA, 20 nt, Human
cacuggccaauacucugaaa

SEQ ID NO: 877858 - RNA, 21 nt, Human
cacuggccaauacucugaaac

SEQ ID NO: 877859 - RNA, 19 nt, Human
ccuuauccuccccacuccc

SEQ ID NO: 877860 - RNA, 18 nt, Human
gacagcgccuuauccucc

SEQ ID NO: 877861 - RNA, 18 nt, Human
gccaauacucugaaacug

SEQ ID NO: 877862 - RNA, 20 nt, Human
ggaagaagugauggagagga

SEQ ID NO: 877863 - RNA, 18 nt, Human
ggagaggaagaaggaaag

SEQ ID NO: 877864 - RNA, 25 nt, Human
ggcaacagugggggcaaccgguacc

SEQ ID NO: 877865 - RNA, 21 nt, Human
gggaagaagugauggagagga

SEQ ID NO: 877866 - RNA, 18 nt, Human
gguccugugagagcuguu

SEQ ID NO: 877867 - RNA, 23 nt, Human
gucucaaugauuauucccauccc

SEQ ID NO: 877868 - RNA, 22 nt, Human
uccaagaaguuugugagucacc

SEQ ID NO: 877869 - RNA, 21 nt, Human
ugaaacugacugacuugggua

SEQ ID NO: 877870 - RNA, 19 nt, Human
ugauuauucccaucccaau

SEQ ID NO: 877871 - RNA, 22 nt, Human
uuaacuuaagggaagaagugau

SEQ ID NO: 877872 - RNA, 27 nt, Human
uuggaaaacgauccaccaaccuuuuua

SEQ ID NO: 877873 - RNA, 18 nt, Human
uuuuuuuuuuuuuuuuug

SEQ ID NO: 877874 - RNA, 19 nt, Human
accucccucccuccuuccc

SEQ ID NO: 877875 - RNA, 23 nt, Human
agaggcugggucagcuguggaug

SEQ ID NO: 877876 - RNA, 24 nt, Human
agccaggggaguggguaggccaua

SEQ ID NO: 877877 - RNA, 22 nt, Human
aggcugggucagcuguggaugg

SEQ ID NO: 877878 - RNA, 22 nt, Human
auagcagaaagggagaacugag

SEQ ID NO: 877879 - RNA, 23 nt, Human
augauucuagauccuagacagag

SEQ ID NO: 877880 - RNA, 19 nt, Human
caaagagagcacugcccuu

SEQ ID NO: 877881 - RNA, 22 nt, Human
ccagcugcagaccuccaguugc

SEQ ID NO: 877882 - RNA, 18 nt, Human
cccaaauagcuccucugc

SEQ ID NO: 877883 - RNA, 20 nt, Human
cccaaccacagcaaaggcaa

SEQ ID NO: 877884 - RNA, 18 nt, Human
ccucccucccuccuuccc

SEQ ID NO: 877885 - RNA, 18 nt, Human
ccucuuaccucccucccu

SEQ ID NO: 877886 - RNA, 19 nt, Human
ccugaagugucaccucucu

SEQ ID NO: 877887 - RNA, 24 nt, Human
cuccagagaucaccaagccccucu

SEQ ID NO: 877888 - RNA, 20 nt, Human
cucgugcugccucugguccc

SEQ ID NO: 877889 - RNA, 21 nt, Human
cugaagcugauuuguaaugau

SEQ ID NO: 877890 - RNA, 22 nt, Human
cugcugugggcugggcuuccag

SEQ ID NO: 877891 - RNA, 18 nt, Human
cugucccaaauagcuccu

SEQ ID NO: 877892 - RNA, 18 nt, Human
gaacugacuccuguccca

SEQ ID NO: 877893 - RNA, 21 nt, Human
gacaagaguugcuugggacgc

SEQ ID NO: 877894 - RNA, 21 nt, Human
gaccucuccucuggccugugg

SEQ ID NO: 877895 - RNA, 22 nt, Human
gcaaaggcaacacucuuccucc

SEQ ID NO: 877896 - RNA, 18 nt, Human
gcggcggggcgcgcgagc

SEQ ID NO: 877897 - RNA, 20 nt, Human
gcugugggcugggcuuccag

SEQ ID NO: 877898 - RNA, 20 nt, Human
ggcuggaaggagagaugcca

SEQ ID NO: 877899 - RNA, 18 nt, Human
gugcaguuugggcuggaa

SEQ ID NO: 877900 - RNA, 26 nt, Human
gugcugccucuggucccugaaggaaa

SEQ ID NO: 877901 - RNA, 22 nt, Human
guggguuaugauucuagauccu

SEQ ID NO: 877902 - RNA, 18 nt, Human
guuaaggaauggcugaug

SEQ ID NO: 877903 - RNA, 20 nt, Human
uagcagaaagggagaacuga

SEQ ID NO: 877904 - RNA, 24 nt, Human
ucacuuugcuccucuugcccucug

SEQ ID NO: 877905 - RNA, 21 nt, Human
ucaggaccucuccucuggccu

SEQ ID NO: 877906 - RNA, 20 nt, Human
ucugucuucugguccaggca

SEQ ID NO: 877907 - RNA, 25 nt, Human
ugacuccugucccaaauagcuccuc

SEQ ID NO: 877908 - RNA, 25 nt, Human
ugccucuggucccugaagugucacc

SEQ ID NO: 877909 - RNA, 23 nt, Human
uggaaggagagaugccagcccuc

SEQ ID NO: 877910 - RNA, 19 nt, Human
uggauagcagaaagggaga

SEQ ID NO: 877911 - RNA, 22 nt, Human
uggaugggguggugccuugguc

SEQ ID NO: 877912 - RNA, 20 nt, Human
uggcugaugacugcuacacc

SEQ ID NO: 877913 - RNA, 18 nt, Human
ugggaaccugguuggggc

SEQ ID NO: 877914 - RNA, 18 nt, Human
ugggcuggaaggagagau

SEQ ID NO: 877915 - RNA, 19 nt, Human
ugggcuuccagcugcagac

SEQ ID NO: 877916 - RNA, 21 nt, Human
uggggcugugcaguuugggaa

SEQ ID NO: 877917 - RNA, 21 nt, Human
uggucccugaagugucaccuc

SEQ ID NO: 877918 - RNA, 28 nt, Human
ugguuggggcugugcaguucuggaguca

SEQ ID NO: 877919 - RNA, 23 nt, Human
ugugggcugggcuuccagcugca

SEQ ID NO: 877920 - RNA, 20 nt, Human
uuaccucccucccuccuucc

SEQ ID NO: 877921 - RNA, 20 nt, Human
uuccagcugcagaccuccag

SEQ ID NO: 877922 - RNA, 19 nt, Human
aacuguggacacauucacc

SEQ ID NO: 877923 - RNA, 24 nt, Human
aagaaaccagacccagccauaagc

SEQ ID NO: 877924 - RNA, 19 nt, Human
aagcagcucgagcagggac

SEQ ID NO: 877925 - RNA, 19 nt, Human
aaggggucaggggcagagc

SEQ ID NO: 877926 - RNA, 19 nt, Human
acagccccugcagcagcaa

SEQ ID NO: 877927 - RNA, 19 nt, Human
acaggcugucaucuuccag

SEQ ID NO: 877928 - RNA, 24 nt, Human
acuugcgcacgugaggcagccgcc

SEQ ID NO: 877929 - RNA, 19 nt, Human
agagaaaaucaucucaagg

SEQ ID NO: 877930 - RNA, 26 nt, Human
agcaggggaauggagguuuuggaggg

SEQ ID NO: 877931 - RNA, 23 nt, Human
aggaaccgggagaagggccacuu

SEQ ID NO: 877932 - RNA, 19 nt, Human
aggaccaaccgcgccgcca

SEQ ID NO: 877933 - RNA, 21 nt, Human
aggagaaaaggaggauggaga

SEQ ID NO: 877934 - RNA, 20 nt, Human
aggcaaggagaaaaggagga

SEQ ID NO: 877935 - RNA, 21 nt, Human
aggcauaguguggccccugcc

SEQ ID NO: 877936 - RNA, 20 nt, Human
agggaggccagcagggcggg

SEQ ID NO: 877937 - RNA, 21 nt, Human
agguggcgccuugggcagagc

SEQ ID NO: 877938 - RNA, 18 nt, Human
auccugcuccaaccucuc

SEQ ID NO: 877939 - RNA, 21 nt, Human
aucgccccuuccuccucccca

SEQ ID NO: 877940 - RNA, 23 nt, Human
augagcagcaggagagcccggaa

SEQ ID NO: 877941 - RNA, 26 nt, Human
augcccaccagcacgcgcacacacgg

SEQ ID NO: 877942 - RNA, 18 nt, Human
auggagagagccccagcc

SEQ ID NO: 877943 - RNA, 25 nt, Human
caaaagaagcuagcgcaggccaccc

SEQ ID NO: 877944 - RNA, 20 nt, Human
caaggagaaaaggaggaugg

SEQ ID NO: 877945 - RNA, 21 nt, Human
caagugauuauugauggugac

SEQ ID NO: 877946 - RNA, 23 nt, Human
cacagguagauugaguguaggaa

SEQ ID NO: 877947 - RNA, 20 nt, Human
cacaucccuugccacccucc

SEQ ID NO: 877948 - RNA, 21 nt, Human
cacaucccuugccacccuccc

SEQ ID NO: 877949 - RNA, 18 nt, Human
caccacguugaccaggcc

SEQ ID NO: 877950 - RNA, 25 nt, Human
caccacguugaccaggccaauagcc

SEQ ID NO: 877951 - RNA, 21 nt, Human
caccagacagggaacaugcac

SEQ ID NO: 877952 - RNA, 22 nt, Human
caccggcucacggucgcccugg

SEQ ID NO: 877953 - RNA, 18 nt, Human
cacguugaccaggccaau

SEQ ID NO: 877954 - RNA, 22 nt, Human
cacuuugugaccuuccuggagg

SEQ ID NO: 877955 - RNA, 19 nt, Human
cagaaagcugaaaaagagg

SEQ ID NO: 877956 - RNA, 18 nt, Human
cagcaagaccaccaccac

SEQ ID NO: 877957 - RNA, 21 nt, Human
cagcaagaccaccaccacgca

SEQ ID NO: 877958 - RNA, 23 nt, Human
cagcagcaagaccaccaccacgc

SEQ ID NO: 877959 - RNA, 24 nt, Human
cagcugggugcugcagccccacgg

SEQ ID NO: 877960 - RNA, 22 nt, Human
ccaggacccagaagagcggugg

SEQ ID NO: 877961 - RNA, 18 nt, Human
ccaggccagccaccacac

SEQ ID NO: 877962 - RNA, 22 nt, Human
ccaggccagccaccacaccacg

SEQ ID NO: 877963 - RNA, 22 nt, Human
ccauagucgaagcggaugaggc

SEQ ID NO: 877964 - RNA, 18 nt, Human
cccuuccuccuccccaaa

SEQ ID NO: 877965 - RNA, 24 nt, Human
ccucucaacuguggacacauucac

SEQ ID NO: 877966 - RNA, 19 nt, Human
ccugcagcagcaagaccac

SEQ ID NO: 877967 - RNA, 19 nt, Human
ccugccugcccuggggcca

SEQ ID NO: 877968 - RNA, 18 nt, Human
ccuggcuguccgcccagg

SEQ ID NO: 877969 - RNA, 23 nt, Human
ccugggagccgcucgccagcgcc

SEQ ID NO: 877970 - RNA, 18 nt, Human
ccuucagcagguacaggc

SEQ ID NO: 877971 - RNA, 22 nt, Human
cgaagcggaugaggcucaggua

SEQ ID NO: 877972 - RNA, 19 nt, Human
cgccgcugguuccacaggc

SEQ ID NO: 877973 - RNA, 24 nt, Human
cgcgcacacacguuccccuaaccc

SEQ ID NO: 877974 - RNA, 19 nt, Human
cggucagcaugagcagcag

SEQ ID NO: 877975 - RNA, 26 nt, Human
cucccuccauucuauuccuguggggc

SEQ ID NO: 877976 - RNA, 24 nt, Human
cucucaacuguggacacauucacc

SEQ ID NO: 877977 - RNA, 23 nt, Human
cugaccacagcugggugcugcag

SEQ ID NO: 877978 - RNA, 23 nt, Human
cuguggacacauucaccggcagu

SEQ ID NO: 877979 - RNA, 22 nt, Human
cuuucuccccuucucccucaaa

SEQ ID NO: 877980 - RNA, 18 nt, Human
gaacaggaaccgggagaa

SEQ ID NO: 877981 - RNA, 22 nt, Human
gaagaaaccagacccagccaua

SEQ ID NO: 877982 - RNA, 23 nt, Human
gaccacagcugggugcugcagcc

SEQ ID NO: 877983 - RNA, 20 nt, Human
gagcagcaggagagcccgga

SEQ ID NO: 877984 - RNA, 19 nt, Human
gauuccuucagcagguaca

SEQ ID NO: 877985 - RNA, 18 nt, Human
gcaaggagaaaaggagga

SEQ ID NO: 877986 - RNA, 19 nt, Human
gcagcucgagcagggacag

SEQ ID NO: 877987 - RNA, 19 nt, Human
gcagucgcgguacaccggc

SEQ ID NO: 877988 - RNA, 22 nt, Human
gcauagcuccccucccucaaag

SEQ ID NO: 877989 - RNA, 18 nt, Human
gccccugccugcccuggg

SEQ ID NO: 877990 - RNA, 20 nt, Human
gcgcaggccacccgaguccc

SEQ ID NO: 877991 - RNA, 21 nt, Human
gcucccuccauucuauuccug

SEQ ID NO: 877992 - RNA, 20 nt, Human
gcucuugaaagaacaggaac

SEQ ID NO: 877993 - RNA, 21 nt, Human
gcuuucuccccuucucccuca

SEQ ID NO: 877994 - RNA, 24 nt, Human
ggaccagaaccaugcauugaggga

SEQ ID NO: 877995 - RNA, 18 nt, Human
ggacccagaagagcggug

SEQ ID NO: 877996 - RNA, 19 nt, Human
ggagaagggaggccagcag

SEQ ID NO: 877997 - RNA, 21 nt, Human
ggcagagcuggcgcuccacaa

SEQ ID NO: 877998 - RNA, 22 nt, Human
gggaauggagguuuuggagggg

SEQ ID NO: 877999 - RNA, 18 nt, Human
gggagaagggaggccagc

SEQ ID NO: 878000 - RNA, 21 nt, Human
gggagaagggaggccagcagg

SEQ ID NO: 878001 - RNA, 23 nt, Human
gggcagagcaaaaauccagucug

SEQ ID NO: 878002 - RNA, 21 nt, Human
ggggaauggagguuuuggagg

SEQ ID NO: 878003 - RNA, 19 nt, Human
ggggcuggcagcaggggaa

SEQ ID NO: 878004 - RNA, 22 nt, Human
gguacaggcugucaucuuccag

SEQ ID NO: 878005 - RNA, 23 nt, Human
gucgucccgacagguccagccug

SEQ ID NO: 878006 - RNA, 19 nt, Human
guggaaaacuguggaccag

SEQ ID NO: 878007 - RNA, 18 nt, Human
guggacagggauggugcu

SEQ ID NO: 878008 - RNA, 19 nt, Human
uacaggcugucaucuucca

SEQ ID NO: 878009 - RNA, 22 nt, Human
uagagcccaacggugacccaca

SEQ ID NO: 878010 - RNA, 22 nt, Human
uagcauagcuccccucccucaa

SEQ ID NO: 878011 - RNA, 18 nt, Human
uaggaugacaguggaggc

SEQ ID NO: 878012 - RNA, 19 nt, Human
uaggaugacaguggaggca

SEQ ID NO: 878013 - RNA, 19 nt, Human
ucauacuuacagucguccc

SEQ ID NO: 878014 - RNA, 21 nt, Human
uccacaggcaccaggccagcc

SEQ ID NO: 878015 - RNA, 21 nt, Human
ucccugagguuggaguccuag

SEQ ID NO: 878016 - RNA, 19 nt, Human
ucccugguguggaaaacug

SEQ ID NO: 878017 - RNA, 19 nt, Human
uccuucagcagguacaggc

SEQ ID NO: 878018 - RNA, 21 nt, Human
ucgccccuuccuccuccccaa

SEQ ID NO: 878019 - RNA, 25 nt, Human
ugaaagaacaggaaccgggagaagg

SEQ ID NO: 878020 - RNA, 21 nt, Human
ugacaguggaggcacagaagu

SEQ ID NO: 878021 - RNA, 22 nt, Human
ugaccacagcugggugcugcag

SEQ ID NO: 878022 - RNA, 22 nt, Human
ugagaaacgaggccacggccga

SEQ ID NO: 878023 - RNA, 20 nt, Human
ugaggcagccgccgcugguu

SEQ ID NO: 878024 - RNA, 22 nt, Human
ugaggucagugucccuggugug

SEQ ID NO: 878025 - RNA, 22 nt, Human
ugauuuauuaagcacaucccuu

SEQ ID NO: 878026 - RNA, 19 nt, Human
ugcccuggggccacccugg

SEQ ID NO: 878027 - RNA, 19 nt, Human
ugcgguagcggcagagcau

SEQ ID NO: 878028 - RNA, 20 nt, Human
ugcugcagccccacgguccu

SEQ ID NO: 878029 - RNA, 21 nt, Human
ugcugcagccccacgguccug

SEQ ID NO: 878030 - RNA, 23 nt, Human
uggaaaacuguggaccagaacca

SEQ ID NO: 878031 - RNA, 19 nt, Human
uggaguccuagcauagcuc

SEQ ID NO: 878032 - RNA, 21 nt, Human
uggcgggagcggaagugauuc

SEQ ID NO: 878033 - RNA, 21 nt, Human
ugggagccgcucgccagcgcc

SEQ ID NO: 878034 - RNA, 18 nt, Human
ugggcauccaggacccag

SEQ ID NO: 878035 - RNA, 19 nt, Human
ugggggaggaggcuggcac

SEQ ID NO: 878036 - RNA, 22 nt, Human
ugggugcugcagccccacgguc

SEQ ID NO: 878037 - RNA, 18 nt, Human
ugguacaugggggaggag

SEQ ID NO: 878038 - RNA, 21 nt, Human
ugguacaugggggaggaggcu

SEQ ID NO: 878039 - RNA, 23 nt, Human
uguggaccagaaccaugcauuga

SEQ ID NO: 878040 - RNA, 20 nt, Human
uuaaaaguuuucaguaucaa

SEQ ID NO: 878041 - RNA, 20 nt, Human
uucaagaaguugaaaagaga

SEQ ID NO: 878042 - RNA, 21 nt, Human
uugaacuuguccucugauucc

SEQ ID NO: 878043 - RNA, 22 nt, Human
uugaccaggccaauagccacgu

SEQ ID NO: 878044 - RNA, 22 nt, Human
uuuuuuuuuuuugaggcuugga

SEQ ID NO: 878045 - RNA, 18 nt, Human
uuuuuuuuuuuuuuuuug

SEQ ID NO: 878046 - RNA, 21 nt, Human
uuuuuuuuuuuuuuuuugagg

SEQ ID NO: 878047 - RNA, 33 nt, Human
uuuuuuuuuuuuuuuuugaggcuuggaauugau

SEQ ID NO: 878048 - RNA, 26 nt, Human
aaaaaaaaacaaaaacaaaaaaacaa

SEQ ID NO: 878049 - RNA, 22 nt, Human
aaaaacaacuaagaggccgggc

SEQ ID NO: 878050 - RNA, 22 nt, Human
aaaaaugcugaagauuaguaua

SEQ ID NO: 878051 - RNA, 23 nt, Human
aaacagcuauagaaacuaguuuu

SEQ ID NO: 878052 - RNA, 25 nt, Human
aagugauccucccaccucggccucc

SEQ ID NO: 878053 - RNA, 27 nt, Human
aagugauccucccaccucggccuccca

SEQ ID NO: 878054 - RNA, 18 nt, Human
aagugcugaaguuuaccu

SEQ ID NO: 878055 - RNA, 24 nt, Human
aaucgcuugaauccaggaggugga

SEQ ID NO: 878056 - RNA, 24 nt, Human
acagagcaagacuccaucucaaaa

SEQ ID NO: 878057 - RNA, 23 nt, Human
accucggccucccaaagugcuga

SEQ ID NO: 878058 - RNA, 19 nt, Human
acugagauccagaguuuag

SEQ ID NO: 878059 - RNA, 23 nt, Human
acugcacuccagucuggcgacag

SEQ ID NO: 878060 - RNA, 25 nt, Human
acugcacuccagucuggcgacagag

SEQ ID NO: 878061 - RNA, 20 nt, Human
agaaaacagcuauagaaacu

SEQ ID NO: 878062 - RNA, 22 nt, Human
agaaucgcuugaauccaggagg

SEQ ID NO: 878063 - RNA, 24 nt, Human
agaggccgggcacgguggcucaug

SEQ ID NO: 878064 - RNA, 21 nt, Human
agccagcgccgcggccggaca

SEQ ID NO: 878065 - RNA, 23 nt, Human
aggcaggagaaucgcuugaaucc

SEQ ID NO: 878066 - RNA, 24 nt, Human
aggcaggagaaucgcuugaaucca

SEQ ID NO: 878067 - RNA, 20 nt, Human
aggcugaggcaggagaaucg

SEQ ID NO: 878068 - RNA, 24 nt, Human
aggcugaggcaggagaaucgcuug

SEQ ID NO: 878069 - RNA, 21 nt, Human
agguggagguugcagugagcc

SEQ ID NO: 878070 - RNA, 24 nt, Human
agguggagguugcagugagccgag

SEQ ID NO: 878071 - RNA, 23 nt, Human
agucuggcgacagagcaagacuc

SEQ ID NO: 878072 - RNA, 25 nt, Human
agugauccucccaccucggccuccc

SEQ ID NO: 878073 - RNA, 22 nt, Human
auaaaaacaacuuuuaaacccu

SEQ ID NO: 878074 - RNA, 21 nt, Human
auauaucuauauguauaugua

SEQ ID NO: 878075 - RNA, 24 nt, Human
auugcgccacugcacuccagucug

SEQ ID NO: 878076 - RNA, 25 nt, Human
caaaaaaaaaacaaaaacaaaaaaa

SEQ ID NO: 878077 - RNA, 26 nt, Human
caaaaacaaaaaaacaauuaagaacc

SEQ ID NO: 878078 - RNA, 25 nt, Human
caaacuccugggcucaagugauccu

SEQ ID NO: 878079 - RNA, 18 nt, Human
caacuuuuaaacccuuau

SEQ ID NO: 878080 - RNA, 21 nt, Human
caagacuccaucucaaaaaaa

SEQ ID NO: 878081 - RNA, 22 nt, Human
cacuccagucuggcgacagagc

SEQ ID NO: 878082 - RNA, 18 nt, Human
cacugcacuccagucugg

SEQ ID NO: 878083 - RNA, 18 nt, Human
cacugcacuccagucugg

SEQ ID NO: 878084 - RNA, 22 nt, Human
cacugcacuccagucuggcgac

SEQ ID NO: 878085 - RNA, 23 nt, Human
cacugcacuccagucuggcgaca

SEQ ID NO: 878086 - RNA, 24 nt, Human
cacugcacuccagucuggcgacag

SEQ ID NO: 878087 - RNA, 20 nt, Human
cagaaaacagcuauagaaac

SEQ ID NO: 878088 - RNA, 24 nt, Human
cagcuacuugggaggcugaggcag

SEQ ID NO: 878089 - RNA, 29 nt, Human
caggagguggagguugcagugacaacggu

SEQ ID NO: 878090 - RNA, 22 nt, Human
caucucaaaaaaaaaacaaaaa

SEQ ID NO: 878091 - RNA, 23 nt, Human
caucucaaaaaaaaaacaaaaac

SEQ ID NO: 878092 - RNA, 24 nt, Human
ccaaagugcugaaguuuaccuaau

SEQ ID NO: 878093 - RNA, 19 nt, Human
ccacugcacuccagucugg

SEQ ID NO: 878094 - RNA, 20 nt, Human
ccacugcacuccagucuggc

SEQ ID NO: 878095 - RNA, 23 nt, Human
ccacugcacuccagucuggcgac

SEQ ID NO: 878096 - RNA, 22 nt, Human
ccaggagguggagguugcagug

SEQ ID NO: 878097 - RNA, 22 nt, Human
ccaucucaaaaaaaaaacaaaa

SEQ ID NO: 878098 - RNA, 26 nt, Human
ccucccaccucggccucccaaagugc

SEQ ID NO: 878099 - RNA, 22 nt, Human
ccugggcucaagugauccuccc

SEQ ID NO: 878100 - RNA, 18 nt, Human
ccuguagucccagcuacu

SEQ ID NO: 878101 - RNA, 21 nt, Human
ccuguagucccagcuacuugg

SEQ ID NO: 878102 - RNA, 22 nt, Human
ccuguagucccagcuacuuggg

SEQ ID NO: 878103 - RNA, 24 nt, Human
cgagauugcgccacugcacuccag

SEQ ID NO: 878104 - RNA, 25 nt, Human
cgccacugcacuccagucuggcgac

SEQ ID NO: 878105 - RNA, 18 nt, Human
cgcuugaauccaggaggu

SEQ ID NO: 878106 - RNA, 24 nt, Human
cucaagugauccucccaccucggc

SEQ ID NO: 878107 - RNA, 23 nt, Human
cucaugccuguagucccagcuac

SEQ ID NO: 878108 - RNA, 25 nt, Human
cuccaucucaaaaaaaaaacaaaaa

SEQ ID NO: 878109 - RNA, 20 nt, Human
cuggcgacagagcaagacuc

SEQ ID NO: 878110 - RNA, 24 nt, Human
cugggucuugcuauucugcccagg

SEQ ID NO: 878111 - RNA, 21 nt, Human
gagguggagguugcagugagc

SEQ ID NO: 878112 - RNA, 23 nt, Human
gagguugcagugagccgagauug

SEQ ID NO: 878113 - RNA, 23 nt, Human
gcacuccagucuggcgacagagc

SEQ ID NO: 878114 - RNA, 22 nt, Human
gccgggcacgguggcucaugcc

SEQ ID NO: 878115 - RNA, 18 nt, Human
gcucaagugauccuccca

SEQ ID NO: 878116 - RNA, 22 nt, Human
ggagguugcagugagccgagau

SEQ ID NO: 878117 - RNA, 24 nt, Human
ggagguugcagugagccgagauug

SEQ ID NO: 878118 - RNA, 22 nt, Human
ggcacgguggcucaugccugua

SEQ ID NO: 878119 - RNA, 23 nt, Human
ggccgggcacgguggcucaugcc

SEQ ID NO: 878120 - RNA, 21 nt, Human
ggcucaugccuguagucccag

SEQ ID NO: 878121 - RNA, 22 nt, Human
gggcucaagugauccucccacc

SEQ ID NO: 878122 - RNA, 23 nt, Human
gguggcucaugccuguaguccca

SEQ ID NO: 878123 - RNA, 24 nt, Human
gugauccucccaccucggccuccc

SEQ ID NO: 878124 - RNA, 23 nt, Human
guggcucaugccuguagucccag

SEQ ID NO: 878125 - RNA, 19 nt, Human
guugcagugagccgagauu

SEQ ID NO: 878126 - RNA, 21 nt, Human
guugcagugagccgagauugc

SEQ ID NO: 878127 - RNA, 24 nt, Human
uaagaggccgggcacgguggcuca

SEQ ID NO: 878128 - RNA, 18 nt, Human
uagagacugggucuugcu

SEQ ID NO: 878129 - RNA, 24 nt, Human
uauguauauguauauguuagagac

SEQ ID NO: 878130 - RNA, 24 nt, Human
uauucugcccaggcuggucgcaaa

SEQ ID NO: 878131 - RNA, 20 nt, Human
uauugcaaaauacuuaaaau

SEQ ID NO: 878132 - RNA, 21 nt, Human
uauugcaaaauacuuaaaaug

SEQ ID NO: 878133 - RNA, 23 nt, Human
uauugcaaaauacuuaaaaugua

SEQ ID NO: 878134 - RNA, 21 nt, Human
uccaggagguggagguugcag

SEQ ID NO: 878135 - RNA, 19 nt, Human
uccaucucaaaaaaaaaac

SEQ ID NO: 878136 - RNA, 22 nt, Human
ucccaaagugcugaaguuuacc

SEQ ID NO: 878137 - RNA, 21 nt, Human
uccugggcucaagugauccuc

SEQ ID NO: 878138 - RNA, 22 nt, Human
uccugggcucaagugauccucc

SEQ ID NO: 878139 - RNA, 24 nt, Human
uccugggcucaagugauccuccca

SEQ ID NO: 878140 - RNA, 20 nt, Human
uccugucuaaaaaugcugaa

SEQ ID NO: 878141 - RNA, 24 nt, Human
ucgcuugaauccaggagguggagg

SEQ ID NO: 878142 - RNA, 18 nt, Human
ucggccucccaaagugcu

SEQ ID NO: 878143 - RNA, 23 nt, Human
ucuugcuauucugcccaggcugg

SEQ ID NO: 878144 - RNA, 24 nt, Human
ucuugcuauucugcccaggcuggu

SEQ ID NO: 878145 - RNA, 18 nt, Human
ugaagugaauagacagca

SEQ ID NO: 878146 - RNA, 21 nt, Human
ugacuuggcaaagucauccaa

SEQ ID NO: 878147 - RNA, 22 nt, Human
ugagccgagauugcgccacugc

SEQ ID NO: 878148 - RNA, 20 nt, Human
ugaggcaggagaaucgcuug

SEQ ID NO: 878149 - RNA, 22 nt, Human
ugaggcaggagaaucgcuugaa

SEQ ID NO: 878150 - RNA, 25 nt, Human
ugaggcaggagaaucgcuugaaucc

SEQ ID NO: 878151 - RNA, 24 nt, Human
ugcccaggcuggucgcaaacuccu

SEQ ID NO: 878152 - RNA, 28 nt, Human
ugcccaggcuggucgcaaacuccugggc

SEQ ID NO: 878153 - RNA, 24 nt, Human
ugccuguagucccagcuacuuggg

SEQ ID NO: 878154 - RNA, 22 nt, Human
uggaaaguaauauaacacacaa

SEQ ID NO: 878155 - RNA, 19 nt, Human
ugggaggcugaggcaggag

SEQ ID NO: 878156 - RNA, 23 nt, Human
ugggaggcugaggcaggagaauc

SEQ ID NO: 878157 - RNA, 24 nt, Human
ugggcucaagugauccucccaccu

SEQ ID NO: 878158 - RNA, 23 nt, Human
ugggucuugcuauucugcccagg

SEQ ID NO: 878159 - RNA, 21 nt, Human
uuaaaguaauguaaaacauuu

SEQ ID NO: 878160 - RNA, 19 nt, Human
uuacauauauaucuauaug

SEQ ID NO: 878161 - RNA, 19 nt, Human
uucaagauuaaggggaaga

SEQ ID NO: 878162 - RNA, 19 nt, Human
uucuuauaucaaguaaaga

SEQ ID NO: 878163 - RNA, 24 nt, Human
uugaauccaggagguggagguugc

SEQ ID NO: 878164 - RNA, 18 nt, Human
uugcagugagccgagauu

SEQ ID NO: 878165 - RNA, 19 nt, Human
uugcagugagccgagauug

SEQ ID NO: 878166 - RNA, 22 nt, Human
uugcagugagccgagauugcgc

SEQ ID NO: 878167 - RNA, 23 nt, Human
uugcgccacugcacuccagucug

SEQ ID NO: 878168 - RNA, 24 nt, Human
uugggaggcugaggcaggagaauc

SEQ ID NO: 878169 - RNA, 26 nt, Human
aaaaaaagcaauaaagaaaccgugca

SEQ ID NO: 878170 - RNA, 23 nt, Human
aaaaagcaauaaagaaaccgugc

SEQ ID NO: 878171 - RNA, 18 nt, Human
aaaagaacaggcgggaaa

SEQ ID NO: 878172 - RNA, 19 nt, Human
aaaagaacaggcgggaaaa

SEQ ID NO: 878173 - RNA, 24 nt, Human
aacacuaaagauauugaguccaaa

SEQ ID NO: 878174 - RNA, 27 nt, Human
aaccacaguaaauacaguucuuggcau

SEQ ID NO: 878175 - RNA, 22 nt, Human
aagaacaggcgggaaaaaaagc

SEQ ID NO: 878176 - RNA, 24 nt, Human
aagauauugaguccaaagcucaaa

SEQ ID NO: 878177 - RNA, 18 nt, Human
acccgaauccgcacccgg

SEQ ID NO: 878178 - RNA, 18 nt, Human
accggaguggaccacugc

SEQ ID NO: 878179 - RNA, 24 nt, Human
acgcugcccaucccgaccgggugc

SEQ ID NO: 878180 - RNA, 24 nt, Human
acuacaguuauccuguaguacauc

SEQ ID NO: 878181 - RNA, 30 nt, Human
agaaaccgugcaagaaacucagugaauaaa

SEQ ID NO: 878182 - RNA, 23 nt, Human
agaagcuuaacaugaccuacaaa

SEQ ID NO: 878183 - RNA, 25 nt, Human
agacacagacuucagaauuuaaagc

SEQ ID NO: 878184 - RNA, 24 nt, Human
agcaauaaagaaaccgugcaagaa

SEQ ID NO: 878185 - RNA, 18 nt, Human
auacaguucuuggcauaa

SEQ ID NO: 878186 - RNA, 20 nt, Human
aucaaugccaaacaaaucuu

SEQ ID NO: 878187 - RNA, 18 nt, Human
augcuucacugccuuucc

SEQ ID NO: 878188 - RNA, 24 nt, Human
auuccauuaagcuucaauuugagc

SEQ ID NO: 878189 - RNA, 19 nt, Human
auugaguccaaagcucaaa

SEQ ID NO: 878190 - RNA, 19 nt, Human
cacaagccugcgacguacc

SEQ ID NO: 878191 - RNA, 23 nt, Human
cacacagccuucgguccggaacc

SEQ ID NO: 878192 - RNA, 23 nt, Human
cagaaaauaguaaauaccuuaca

SEQ ID NO: 878193 - RNA, 19 nt, Human
ccacaguaaccccggccug

SEQ ID NO: 878194 - RNA, 23 nt, Human
ccauuagauaauauccugguuau

SEQ ID NO: 878195 - RNA, 21 nt, Human
ccgcacccggcaaccggagug

SEQ ID NO: 878196 - RNA, 24 nt, Human
ccggcugcggggggagcuggggga

SEQ ID NO: 878197 - RNA, 21 nt, Human
cgacccgcacaagccugcgac

SEQ ID NO: 878198 - RNA, 18 nt, Human
cgccacaguaaccccggc

SEQ ID NO: 878199 - RNA, 20 nt, Human
cgugcaagaaacucagugaa

SEQ ID NO: 878200 - RNA, 21 nt, Human
cucacaggccuacgcugccca

SEQ ID NO: 878201 - RNA, 22 nt, Human
cuguaguacaucucaauauccu

SEQ ID NO: 878202 - RNA, 24 nt, Human
cuguaguacaucucaauauccucc

SEQ ID NO: 878203 - RNA, 26 nt, Human
gaacacacagccuucgguccggaacc

SEQ ID NO: 878204 - RNA, 23 nt, Human
gaacccgacccgcacaagccugc

SEQ ID NO: 878205 - RNA, 19 nt, Human
gaccuacaaaucugauuua

SEQ ID NO: 878206 - RNA, 21 nt, Human
gccggcugcggggggagcugg

SEQ ID NO: 878207 - RNA, 19 nt, Human
ggagcugggggacaggggc

SEQ ID NO: 878208 - RNA, 21 nt, Human
ggcugcggggggagcuggggg

SEQ ID NO: 878209 - RNA, 19 nt, Human
gggagcugggggacagggg

SEQ ID NO: 878210 - RNA, 24 nt, Human
ggggccacaaugaacggcggagaa

SEQ ID NO: 878211 - RNA, 19 nt, Human
guccucgccaccccauccc

SEQ ID NO: 878212 - RNA, 24 nt, Human
guuugaguuuugcaccucaaaguu

SEQ ID NO: 878213 - RNA, 21 nt, Human
uaaagaaaccgugcaagaaac

SEQ ID NO: 878214 - RNA, 24 nt, Human
uacaaaucugauuuagggaaacac

SEQ ID NO: 878215 - RNA, 21 nt, Human
uacaucccgaggcagcgcagg

SEQ ID NO: 878216 - RNA, 18 nt, Human
uacugauuuuauuauuau

SEQ ID NO: 878217 - RNA, 21 nt, Human
uacuuaaacugaaaaugagau

SEQ ID NO: 878218 - RNA, 20 nt, Human
uaguacaucucaauauccuc

SEQ ID NO: 878219 - RNA, 21 nt, Human
uauaauaguggauuaaucaaa

SEQ ID NO: 878220 - RNA, 22 nt, Human
uauacuuuacaucccgaggcag

SEQ ID NO: 878221 - RNA, 20 nt, Human
uaugcuucacugccuuuccu

SEQ ID NO: 878222 - RNA, 19 nt, Human
ucaaaaugaugacacauca

SEQ ID NO: 878223 - RNA, 22 nt, Human
ucagugaauaagaagaucaaaa

SEQ ID NO: 878224 - RNA, 22 nt, Human
uccacaaccacaguaaauacag

SEQ ID NO: 878225 - RNA, 19 nt, Human
uccgcacccggcaaccgga

SEQ ID NO: 878226 - RNA, 18 nt, Human
ucgccaccccaucccucg

SEQ ID NO: 878227 - RNA, 23 nt, Human
ugggggacaggggcacccgcagg

SEQ ID NO: 878228 - RNA, 18 nt, Human
ugucauaacauaauugaa

SEQ ID NO: 878229 - RNA, 23 nt, Human
uguccacaaccacaguaaauaca

SEQ ID NO: 878230 - RNA, 21 nt, Human
ugucggggccacaaugaacgg

SEQ ID NO: 878231 - RNA, 21 nt, Human
uuaaagccuccccaccugcaa

SEQ ID NO: 878232 - RNA, 21 nt, Human
uugaacacaaaagacccacau

SEQ ID NO: 878233 - RNA, 22 nt, Human
uuugagcaaaaguguaaucacu

SEQ ID NO: 878234 - RNA, 21 nt, Human
uuuuuuuuuuuuuuuuuuaag

SEQ ID NO: 878235 - RNA, 20 nt, Human
aaacaaaucgcuagaggggc

SEQ ID NO: 878236 - RNA, 21 nt, Human
aaacaaaucgcuagaggggcu

SEQ ID NO: 878237 - RNA, 19 nt, Human
agaagccaucucugcccuu

SEQ ID NO: 878238 - RNA, 21 nt, Human
agccaucucugcccuuccccu

SEQ ID NO: 878239 - RNA, 19 nt, Human
agcuccgagcccucuuccc

SEQ ID NO: 878240 - RNA, 20 nt, Human
aggacacguagccccgaagc

SEQ ID NO: 878241 - RNA, 21 nt, Human
aucugggcggccccaaggcag

SEQ ID NO: 878242 - RNA, 24 nt, Human
cacaaaugcgggugcccaaggcaa

SEQ ID NO: 878243 - RNA, 22 nt, Human
caccgaggcaccucgcagacgc

SEQ ID NO: 878244 - RNA, 23 nt, Human
cagacccugccuuucgggcuggg

SEQ ID NO: 878245 - RNA, 18 nt, Human
cagcaggaaggcagcucc

SEQ ID NO: 878246 - RNA, 23 nt, Human
caggaaggcagcuccgagcccuc

SEQ ID NO: 878247 - RNA, 19 nt, Human
caggcucuccggggcuccc

SEQ ID NO: 878248 - RNA, 20 nt, Human
caucugggcggccccaaggc

SEQ ID NO: 878249 - RNA, 20 nt, Human
ccagacccugccuuucgggc

SEQ ID NO: 878250 - RNA, 21 nt, Human
ccagacccugccuuucgggcu

SEQ ID NO: 878251 - RNA, 24 nt, Human
cccaaggcaaagucgcccccaagg

SEQ ID NO: 878252 - RNA, 18 nt, Human
cccagggcggggagcggc

SEQ ID NO: 878253 - RNA, 21 nt, Human
cccccaaggcuucucacaaac

SEQ ID NO: 878254 - RNA, 22 nt, Human
cccccaaggcuucucacaaacu

SEQ ID NO: 878255 - RNA, 23 nt, Human
ccccugccugcaucccccagacc

SEQ ID NO: 878256 - RNA, 18 nt, Human
ccgcacccagacccugcc

SEQ ID NO: 878257 - RNA, 18 nt, Human
ccgcacccagacccugcc

SEQ ID NO: 878258 - RNA, 22 nt, Human
ccggggcuccccucccucccca

SEQ ID NO: 878259 - RNA, 24 nt, Human
ccuuucgggcuggggcgcucagcc

SEQ ID NO: 878260 - RNA, 19 nt, Human
cgcacaaaugcgggugccc

SEQ ID NO: 878261 - RNA, 21 nt, Human
cgcccccaaggcuucucacaa

SEQ ID NO: 878262 - RNA, 21 nt, Human
cggagaagggaggggcccggg

SEQ ID NO: 878263 - RNA, 19 nt, Human
cggccccaaggcagcagga

SEQ ID NO: 878264 - RNA, 24 nt, Human
cgucuccgacagcacaggacacgu

SEQ ID NO: 878265 - RNA, 25 nt, Human
cuaguucaugucaucacuuuuccua

SEQ ID NO: 878266 - RNA, 27 nt, Human
gaagccaucucugcccuuccccugccu

SEQ ID NO: 878267 - RNA, 23 nt, Human
gacacguagccccgaagcuguca

SEQ ID NO: 878268 - RNA, 20 nt, Human
gagcccucuucccgcaccca

SEQ ID NO: 878269 - RNA, 22 nt, Human
gagccugcuuccagcucccacc

SEQ ID NO: 878270 - RNA, 18 nt, Human
gcaaagucgcccccaagg

SEQ ID NO: 878271 - RNA, 19 nt, Human
gcgcucagccgggagccug

SEQ ID NO: 878272 - RNA, 20 nt, Human
ggagccugcuuccagcuccc

SEQ ID NO: 878273 - RNA, 22 nt, Human
gggcggggagcggcgcugcgau

SEQ ID NO: 878274 - RNA, 24 nt, Human
uagccccgaagcugucaucggaaa

SEQ ID NO: 878275 - RNA, 23 nt, Human
ucagaaccaggcaaaucgggcug

SEQ ID NO: 878276 - RNA, 22 nt, Human
uccacaaccacgacagccugga

SEQ ID NO: 878277 - RNA, 24 nt, Human
uccacaaccacgacagccuggaga

SEQ ID NO: 878278 - RNA, 19 nt, Human
uccagcucccaccggcagg

SEQ ID NO: 878279 - RNA, 23 nt, Human
uccccugccugcaucccccagac

SEQ ID NO: 878280 - RNA, 25 nt, Human
ucgccgggugucugcaccggggaaa

SEQ ID NO: 878281 - RNA, 21 nt, Human
ucuccggggcuccccucccuc

SEQ ID NO: 878282 - RNA, 18 nt, Human
ugcccaaggcaaagucgc

SEQ ID NO: 878283 - RNA, 21 nt, Human
ugggcggccccaaggcagcag

SEQ ID NO: 878284 - RNA, 18 nt, Human
uucaugucaucacuuuuc

SEQ ID NO: 878285 - RNA, 21 nt, Human
uuccacaaccacgacagccug

SEQ ID NO: 878286 - RNA, 19 nt, Human
uuccccugccugcaucccc

SEQ ID NO: 878287 - RNA, 24 nt, Human
uuuuuugcaagccauaucugagaa

SEQ ID NO: 878288 - RNA, 23 nt, Human
uuuuuuuugcaagccauaucuga

SEQ ID NO: 878289 - RNA, 21 nt, Human
uuuuuuuuuuuuuuuuugcaa

SEQ ID NO: 878290 - RNA, 27 nt, Human
uuuuuuuuuuuuuuuuuuuuuuugggg

SEQ ID NO: 878291 - RNA, 23 nt, Human
agucccugagcuccgggacgccc

SEQ ID NO: 878292 - RNA, 20 nt, Human
cccugagcuccgggacgccc

SEQ ID NO: 878293 - RNA, 20 nt, Human
gaggggcggcggggacgacu

SEQ ID NO: 878294 - RNA, 23 nt, Human
gcagcccggguagggugcgacca

SEQ ID NO: 878295 - RNA, 22 nt, Human
gcccggggcucagucccugagc

SEQ ID NO: 878296 - RNA, 18 nt, Human
uaggacccaguuugcuac

SEQ ID NO: 878297 - RNA, 20 nt, Human
ucagucccugagcuccggga

SEQ ID NO: 878298 - RNA, 25 nt, Human
ucccugagcuccgggacgcccaacu

SEQ ID NO: 878299 - RNA, 22 nt, Human
aaaauccuccauagccaccucc

SEQ ID NO: 878300 - RNA, 19 nt, Human
aaacagggacacagggugg

SEQ ID NO: 878301 - RNA, 19 nt, Human
aaaccaaacucacaaacac

SEQ ID NO: 878302 - RNA, 21 nt, Human
aaaccaaacucacaaacaccc

SEQ ID NO: 878303 - RNA, 21 nt, Human
aaacucacaaacacccagagc

SEQ ID NO: 878304 - RNA, 24 nt, Human
aaacucacaaacacccagagcuca

SEQ ID NO: 878305 - RNA, 22 nt, Human
aaagcacccggggcggggggcg

SEQ ID NO: 878306 - RNA, 18 nt, Human
aacauuccaggaaaccag

SEQ ID NO: 878307 - RNA, 21 nt, Human
aaccaaacucacaaacaccca

SEQ ID NO: 878308 - RNA, 20 nt, Human
aagcacccggggcggggggc

SEQ ID NO: 878309 - RNA, 20 nt, Human
aagcuggaggcaggcuggcu

SEQ ID NO: 878310 - RNA, 23 nt, Human
aaggacuuagccauccgacaggc

SEQ ID NO: 878311 - RNA, 19 nt, Human
aagucacaccuggacacaa

SEQ ID NO: 878312 - RNA, 28 nt, Human
aauccugcaagccaccccacccuuacua

SEQ ID NO: 878313 - RNA, 25 nt, Human
acaggccuacgaauugcuucauacu

SEQ ID NO: 878314 - RNA, 19 nt, Human
accauaaagguaaagugga

SEQ ID NO: 878315 - RNA, 18 nt, Human
accccagaagccacgcac

SEQ ID NO: 878316 - RNA, 19 nt, Human
acgacugaccacccuccac

SEQ ID NO: 878317 - RNA, 20 nt, Human
acucuugcuaccaaaacagg

SEQ ID NO: 878318 - RNA, 20 nt, Human
agaaaccaaacucacaaaca

SEQ ID NO: 878319 - RNA, 21 nt, Human
agaaagcacccggggcggggg

SEQ ID NO: 878320 - RNA, 24 nt, Human
agagaaaccaaacucacaaacacc

SEQ ID NO: 878321 - RNA, 22 nt, Human
agagcagcacagcagcugcggg

SEQ ID NO: 878322 - RNA, 22 nt, Human
agcgcccgaaggggaggccgag

SEQ ID NO: 878323 - RNA, 20 nt, Human
agcucugcuccagcccaaac

SEQ ID NO: 878324 - RNA, 20 nt, Human
aggagccccgccgccucugc

SEQ ID NO: 878325 - RNA, 19 nt, Human
aggcaggcuggcuuuggga

SEQ ID NO: 878326 - RNA, 19 nt, Human
aggcaggcuggcuuuggga

SEQ ID NO: 878327 - RNA, 18 nt, Human
aggcccuggaaacaggcc

SEQ ID NO: 878328 - RNA, 20 nt, Human
aggcggagggccccggagga

SEQ ID NO: 878329 - RNA, 23 nt, Human
aggcugaggggucuuccaggcau

SEQ ID NO: 878330 - RNA, 20 nt, Human
aggggucuuccaggcauguc

SEQ ID NO: 878331 - RNA, 23 nt, Human
aucaguccccauuucuuccucag

SEQ ID NO: 878332 - RNA, 23 nt, Human
caaaauccuccauagccaccucc

SEQ ID NO: 878333 - RNA, 19 nt, Human
caaacacccagagcucauc

SEQ ID NO: 878334 - RNA, 24 nt, Human
caaauuuucucugccaaauuaagc

SEQ ID NO: 878335 - RNA, 27 nt, Human
caacacaggauaaaacucaucuccggu

SEQ ID NO: 878336 - RNA, 19 nt, Human
caaccuucagauagacaca

SEQ ID NO: 878337 - RNA, 25 nt, Human
caagcgaaugucucuuuccccucuc

SEQ ID NO: 878338 - RNA, 21 nt, Human
cacccagcccccuauggaauc

SEQ ID NO: 878339 - RNA, 18 nt, Human
caccccagaagccacgca

SEQ ID NO: 878340 - RNA, 19 nt, Human
cacccggggcggggggcgg

SEQ ID NO: 878341 - RNA, 24 nt, Human
caccuccuuccgcccagcuuuauc

SEQ ID NO: 878342 - RNA, 25 nt, Human
cacugaaccccagccccugucccag

SEQ ID NO: 878343 - RNA, 21 nt, Human
cacugugucuccccucucgcu

SEQ ID NO: 878344 - RNA, 18 nt, Human
cagagcccgccaggcuuc

SEQ ID NO: 878345 - RNA, 21 nt, Human
cagauagacacauggugacca

SEQ ID NO: 878346 - RNA, 22 nt, Human
cagccccugucccagagccucc

SEQ ID NO: 878347 - RNA, 20 nt, Human
caguccacugugucuccccu

SEQ ID NO: 878348 - RNA, 23 nt, Human
caugccaaaauccuccauagcca

SEQ ID NO: 878349 - RNA, 23 nt, Human
ccaauccugcaagccaccccacc

SEQ ID NO: 878350 - RNA, 22 nt, Human
ccacgcagaggcauuucugcag

SEQ ID NO: 878351 - RNA, 18 nt, Human
ccaggaaaccagcucugc

SEQ ID NO: 878352 - RNA, 21 nt, Human
cccagccccugucccagagcc

SEQ ID NO: 878353 - RNA, 19 nt, Human
ccccagaagccacgcacac

SEQ ID NO: 878354 - RNA, 26 nt, Human
ccccagaagccacgcacaccuccuuc

SEQ ID NO: 878355 - RNA, 18 nt, Human
cccccgcauccugugcuc

SEQ ID NO: 878356 - RNA, 18 nt, Human
ccccgccgccucugcagg

SEQ ID NO: 878357 - RNA, 25 nt, Human
ccccgccgccucugcagggucccgc

SEQ ID NO: 878358 - RNA, 21 nt, Human
cccgaaggccacacccagccc

SEQ ID NO: 878359 - RNA, 22 nt, Human
cccggggcggggggcgguaagg

SEQ ID NO: 878360 - RNA, 19 nt, Human
cccuauggaaucagauggg

SEQ ID NO: 878361 - RNA, 20 nt, Human
ccucagggcccuggcacuga

SEQ ID NO: 878362 - RNA, 19 nt, Human
ccucccccgccgcccccaa

SEQ ID NO: 878363 - RNA, 26 nt, Human
ccucugggucccaccccagaagccuu

SEQ ID NO: 878364 - RNA, 18 nt, Human
ccugcaagccaccccacc

SEQ ID NO: 878365 - RNA, 23 nt, Human
ccugcaagccaccccacccuuac

SEQ ID NO: 878366 - RNA, 26 nt, Human
ccugcaagccaccccacccuuacuaa

SEQ ID NO: 878367 - RNA, 18 nt, Human
ccugcagcuggacagggc

SEQ ID NO: 878368 - RNA, 22 nt, Human
ccuggcacugaaccccagcccc

SEQ ID NO: 878369 - RNA, 21 nt, Human
cgaggaggagcgggaggagga

SEQ ID NO: 878370 - RNA, 25 nt, Human
cgcacagggcuacgacugaccaccc

SEQ ID NO: 878371 - RNA, 20 nt, Human
cgccgcccccaauuacauuu

SEQ ID NO: 878372 - RNA, 20 nt, Human
cggcuuccagguucucuccc

SEQ ID NO: 878373 - RNA, 23 nt, Human
cggguccaaaugaaggggugggg

SEQ ID NO: 878374 - RNA, 25 nt, Human
cucacagacagcacauauucuacgu

SEQ ID NO: 878375 - RNA, 19 nt, Human
cucaguggacagccuauga

SEQ ID NO: 878376 - RNA, 18 nt, Human
cuccagcccaaaccaggc

SEQ ID NO: 878377 - RNA, 22 nt, Human
cuccccacgcacucucccucag

SEQ ID NO: 878378 - RNA, 18 nt, Human
cucccccgccgcccccaa

SEQ ID NO: 878379 - RNA, 19 nt, Human
cuccuugcaggggcuccaa

SEQ ID NO: 878380 - RNA, 19 nt, Human
cugacaaaguucacaaucu

SEQ ID NO: 878381 - RNA, 19 nt, Human
cugcaaacagaaggcugag

SEQ ID NO: 878382 - RNA, 21 nt, Human
cugcguuucacuaaaccaagc

SEQ ID NO: 878383 - RNA, 24 nt, Human
cuggccaaugagugugggaggccc

SEQ ID NO: 878384 - RNA, 20 nt, Human
cugucccgugagccucugac

SEQ ID NO: 878385 - RNA, 22 nt, Human
cuuggugcugaccgguucgcuc

SEQ ID NO: 878386 - RNA, 22 nt, Human
gaacagauguacagggaauucu

SEQ ID NO: 878387 - RNA, 18 nt, Human
gaagggguggggggagcc

SEQ ID NO: 878388 - RNA, 19 nt, Human
gacaggccacgcaugccaa

SEQ ID NO: 878389 - RNA, 21 nt, Human
gaccagagcccgccaggcuuc

SEQ ID NO: 878390 - RNA, 20 nt, Human
gagcagcacagcagcugcgg

SEQ ID NO: 878391 - RNA, 23 nt, Human
gagccgauggcacagagcagcac

SEQ ID NO: 878392 - RNA, 19 nt, Human
gcacgcacugggaauggcc

SEQ ID NO: 878393 - RNA, 19 nt, Human
gcagcacagcagcugcggg

SEQ ID NO: 878394 - RNA, 25 nt, Human
gcagggcagagaaaccaaacucaca

SEQ ID NO: 878395 - RNA, 24 nt, Human
gccaaaauccuccauagccaccuc

SEQ ID NO: 878396 - RNA, 22 nt, Human
gcccuggaaacaggccaauccu

SEQ ID NO: 878397 - RNA, 19 nt, Human
gcccuggcacugaacccca

SEQ ID NO: 878398 - RNA, 21 nt, Human
gcccuggcacugaaccccagc

SEQ ID NO: 878399 - RNA, 24 nt, Human
gcccuggcacugaaccccagcccc

SEQ ID NO: 878400 - RNA, 23 nt, Human
gcgguggcaccauugugcaugcc

SEQ ID NO: 878401 - RNA, 20 nt, Human
gcuggacagggcccucagau

SEQ ID NO: 878402 - RNA, 22 nt, Human
gcugucuauuggcagaaaccug

SEQ ID NO: 878403 - RNA, 23 nt, Human
gcuuggaccggcucuccggaagc

SEQ ID NO: 878404 - RNA, 20 nt, Human
ggaagacugaagugaaacca

SEQ ID NO: 878405 - RNA, 20 nt, Human
ggaggagcacaguuagcgcg

SEQ ID NO: 878406 - RNA, 18 nt, Human
ggcaggcuggcuuuggga

SEQ ID NO: 878407 - RNA, 19 nt, Human
ggcggcggcggcggcucug

SEQ ID NO: 878408 - RNA, 25 nt, Human
gggaaacucagaccaacaaggagcc

SEQ ID NO: 878409 - RNA, 19 nt, Human
gggaauggccucacaaggc

SEQ ID NO: 878410 - RNA, 20 nt, Human
gggagcaggcggagggcccc

SEQ ID NO: 878411 - RNA, 21 nt, Human
gggcacgcacugggaauggcc

SEQ ID NO: 878412 - RNA, 22 nt, Human
ggggagccgggugacaagcggu

SEQ ID NO: 878413 - RNA, 19 nt, Human
ggguccaaaugaaggggug

SEQ ID NO: 878414 - RNA, 23 nt, Human
gguggcgacaggccacgcaugcc

SEQ ID NO: 878415 - RNA, 21 nt, Human
guaagauccugccugucuggu

SEQ ID NO: 878416 - RNA, 26 nt, Human
gucccagagccuccccucuggguccc

SEQ ID NO: 878417 - RNA, 18 nt, Human
gucucuuuccccucuccu

SEQ ID NO: 878418 - RNA, 24 nt, Human
uaaaguggacaaccccugagguca

SEQ ID NO: 878419 - RNA, 23 nt, Human
uaaaucacugaaagccuccgcuu

SEQ ID NO: 878420 - RNA, 20 nt, Human
uaagauccugccugucuggu

SEQ ID NO: 878421 - RNA, 25 nt, Human
uacgacugaccacccuccaccacag

SEQ ID NO: 878422 - RNA, 20 nt, Human
uaucagggagggacaagccu

SEQ ID NO: 878423 - RNA, 23 nt, Human
ucaacccgaaggccacacccagc

SEQ ID NO: 878424 - RNA, 24 nt, Human
ucaacugcagucagugcuccuggg

SEQ ID NO: 878425 - RNA, 24 nt, Human
ucacuaggagcugccaccgguggg

SEQ ID NO: 878426 - RNA, 21 nt, Human
ucaguagacaggggcccuaga

SEQ ID NO: 878427 - RNA, 22 nt, Human
ucaguccccauuucuuccucag

SEQ ID NO: 878428 - RNA, 19 nt, Human
ucaugggguuccuguguuu

SEQ ID NO: 878429 - RNA, 21 nt, Human
ucccccuucagccacacaguc

SEQ ID NO: 878430 - RNA, 23 nt, Human
uccgacaggccucaccauaaagg

SEQ ID NO: 878431 - RNA, 18 nt, Human
uccggugcagaaaugauu

SEQ ID NO: 878432 - RNA, 25 nt, Human
uccuugaggccacugucaggggcug

SEQ ID NO: 878433 - RNA, 21 nt, Human
ucgcuugggacaggcccaugc

SEQ ID NO: 878434 - RNA, 18 nt, Human
ucuccucccccgccgccc

SEQ ID NO: 878435 - RNA, 18 nt, Human
ucucgacauacuugguau

SEQ ID NO: 878436 - RNA, 31 nt, Human
ucugacacagcaaacugacuaucaguagacu

SEQ ID NO: 878437 - RNA, 27 nt, Human
ucuggccaaugagugugggaggcccug

SEQ ID NO: 878438 - RNA, 19 nt, Human
ucugggucccaccccagaa

SEQ ID NO: 878439 - RNA, 19 nt, Human
ucugggucccaccccagaa

SEQ ID NO: 878440 - RNA, 19 nt, Human
ugaaaugaacguucugcaa

SEQ ID NO: 878441 - RNA, 22 nt, Human
ugaaccccagccccugucccag

SEQ ID NO: 878442 - RNA, 20 nt, Human
ugaccagagcccgccaggcu

SEQ ID NO: 878443 - RNA, 19 nt, Human
ugaccgguucgcuccuugc

SEQ ID NO: 878444 - RNA, 20 nt, Human
ugagacgcacagggcuacga

SEQ ID NO: 878445 - RNA, 18 nt, Human
ugagcaccucuccccaac

SEQ ID NO: 878446 - RNA, 21 nt, Human
ugagccccccaccugcagcuc

SEQ ID NO: 878447 - RNA, 21 nt, Human
ugagugccaggcucuaggcuu

SEQ ID NO: 878448 - RNA, 26 nt, Human
ugaguucaaacucuuguccccuaagc

SEQ ID NO: 878449 - RNA, 20 nt, Human
ugcaaaacgaacacgaggca

SEQ ID NO: 878450 - RNA, 21 nt, Human
ugcagauuccagugguuuccu

SEQ ID NO: 878451 - RNA, 21 nt, Human
ugcgugugcaacguggaguau

SEQ ID NO: 878452 - RNA, 21 nt, Human
ugcgugugugugguguuacuu

SEQ ID NO: 878453 - RNA, 24 nt, Human
ugcuaccaaaacagggacacaggg

SEQ ID NO: 878454 - RNA, 19 nt, Human
ugcuccagcccaaaccagg

SEQ ID NO: 878455 - RNA, 21 nt, Human
uggcacagagcagcacagcag

SEQ ID NO: 878456 - RNA, 22 nt, Human
uggcagugucgagcaaguguaa

SEQ ID NO: 878457 - RNA, 21 nt, Human
uggcgacaggccacgcaugcc

SEQ ID NO: 878458 - RNA, 19 nt, Human
ugggaaggagaagcuccug

SEQ ID NO: 878459 - RNA, 23 nt, Human
ugggaauggccucacaaggcagc

SEQ ID NO: 878460 - RNA, 25 nt, Human
ugggggcugcagauuccagugguuu

SEQ ID NO: 878461 - RNA, 19 nt, Human
ugguggcucagcagcuccc

SEQ ID NO: 878462 - RNA, 18 nt, Human
uguccagguggcgacagg

SEQ ID NO: 878463 - RNA, 19 nt, Human
ugucccagagccuccccuc

SEQ ID NO: 878464 - RNA, 23 nt, Human
ugucccagagccuccccucuggg

SEQ ID NO: 878465 - RNA, 27 nt, Human
ugugcaugccugcagcuggacagggcc

SEQ ID NO: 878466 - RNA, 20 nt, Human
ugugguguuacuuggugcug

SEQ ID NO: 878467 - RNA, 24 nt, Human
ugugguucugucccgugagccucu

SEQ ID NO: 878468 - RNA, 18 nt, Human
uuagacagaugcaugugg

SEQ ID NO: 878469 - RNA, 21 nt, Human
uucaaccaguccuuucagucc

SEQ ID NO: 878470 - RNA, 19 nt, Human
uucauacuuauccggaaga

SEQ ID NO: 878471 - RNA, 19 nt, Human
uuccuucauggcaccacgc

SEQ ID NO: 878472 - RNA, 18 nt, Human
uugugcaugccugcagcu

SEQ ID NO: 878473 - RNA, 23 nt, Human
uuucacuugggguuccucacaua

SEQ ID NO: 878474 - RNA, 22 nt, Human
uuuuuuuuuucugcucggugcc

SEQ ID NO: 878475 - RNA, 19 nt, Human
aagcagacggcccacccuc

SEQ ID NO: 878476 - RNA, 20 nt, Human
acagcaaggcucucugccag

SEQ ID NO: 878477 - RNA, 20 nt, Human
agcgggugggagggcggggg

SEQ ID NO: 878478 - RNA, 23 nt, Human
agggcgggggcgggggcgggggc

SEQ ID NO: 878479 - RNA, 19 nt, Human
aggggccgcuuccuguugg

SEQ ID NO: 878480 - RNA, 19 nt, Human
cacugugcuggggugaggu

SEQ ID NO: 878481 - RNA, 25 nt, Human
caucucauuacuucuggaucccucu

SEQ ID NO: 878482 - RNA, 19 nt, Human
ccaggcagcccagaugaac

SEQ ID NO: 878483 - RNA, 22 nt, Human
ccgccuccagcggggacagucu

SEQ ID NO: 878484 - RNA, 22 nt, Human
cgagaucgggcggggaugcugg

SEQ ID NO: 878485 - RNA, 19 nt, Human
cuggggugaggugcuuucu

SEQ ID NO: 878486 - RNA, 21 nt, Human
cuggggugaggugcuuucuuu

SEQ ID NO: 878487 - RNA, 21 nt, Human
cuucuggaucccucuaccgcc

SEQ ID NO: 878488 - RNA, 18 nt, Human
gagcgggugggagggcgg

SEQ ID NO: 878489 - RNA, 18 nt, Human
gagggcagcagcugggca

SEQ ID NO: 878490 - RNA, 22 nt, Human
gcagcagcugggcagagacgag

SEQ ID NO: 878491 - RNA, 22 nt, Human
gcccgggcuuuauucgcgacuc

SEQ ID NO: 878492 - RNA, 18 nt, Human
gccuggagucgcgcggag

SEQ ID NO: 878493 - RNA, 25 nt, Human
gcggcuccgaagccgggaggggccg

SEQ ID NO: 878494 - RNA, 18 nt, Human
gcggggcgccgcccgggc

SEQ ID NO: 878495 - RNA, 19 nt, Human
gcuuccgcgaggggcgcgg

SEQ ID NO: 878496 - RNA, 19 nt, Human
gggagggcgggggcggggg

SEQ ID NO: 878497 - RNA, 22 nt, Human
gggcgggggcgggggcgggggc

SEQ ID NO: 878498 - RNA, 18 nt, Human
ggugggagggcgggggcg

SEQ ID NO: 878499 - RNA, 18 nt, Human
gugggaacgaaagcagac

SEQ ID NO: 878500 - RNA, 23 nt, Human
uaccgccuccagcggggacaguc

SEQ ID NO: 878501 - RNA, 24 nt, Human
uaccgccuccagcggggacagucu

SEQ ID NO: 878502 - RNA, 18 nt, Human
uccgcgaggggcgcgggg

SEQ ID NO: 878503 - RNA, 19 nt, Human
ucugagcgggugggagggc

SEQ ID NO: 878504 - RNA, 18 nt, Human
uggcaaccaggucugagc

SEQ ID NO: 878505 - RNA, 20 nt, Human
ugggaugcggggcggcccgg

SEQ ID NO: 878506 - RNA, 19 nt, Human
uggggagggcagcagcugg

SEQ ID NO: 878507 - RNA, 24 nt, Human
uggggagggcagcagcugggcaga

SEQ ID NO: 878508 - RNA, 18 nt, Human
uuuuuuuuuuuggggcag

SEQ ID NO: 878509 - RNA, 19 nt, Human
aaaaaggccagacgccccu

SEQ ID NO: 878510 - RNA, 18 nt, Human
aaauggucagcaaguagc

SEQ ID NO: 878511 - RNA, 23 nt, Human
aaggacaugacaggcucuggaag

SEQ ID NO: 878512 - RNA, 21 nt, Human
aaggauccaggcugcuggguc

SEQ ID NO: 878513 - RNA, 21 nt, Human
aaggcugcgacugaacuucgg

SEQ ID NO: 878514 - RNA, 20 nt, Human
aaguagcuggaaggagaaga

SEQ ID NO: 878515 - RNA, 20 nt, Human
aauuaacacuucuagaucac

SEQ ID NO: 878516 - RNA, 23 nt, Human
acaggcugggagagguggggaca

SEQ ID NO: 878517 - RNA, 19 nt, Human
accccaucccaggccucca

SEQ ID NO: 878518 - RNA, 23 nt, Human
acccugcuaagggguacacacca

SEQ ID NO: 878519 - RNA, 24 nt, Human
agaaugcccucagagagccugccu

SEQ ID NO: 878520 - RNA, 20 nt, Human
agaccuccaaccacaccaga

SEQ ID NO: 878521 - RNA, 19 nt, Human
agagauagacagaaggaac

SEQ ID NO: 878522 - RNA, 22 nt, Human
agaggcaggugcuggugggcuc

SEQ ID NO: 878523 - RNA, 25 nt, Human
agaucagggccaggcaaaugcagga

SEQ ID NO: 878524 - RNA, 24 nt, Human
agcaacagagauagacagaaggaa

SEQ ID NO: 878525 - RNA, 24 nt, Human
agcccauacaugaggacccagagc

SEQ ID NO: 878526 - RNA, 21 nt, Human
aggcaaggggagguuccgggu

SEQ ID NO: 878527 - RNA, 18 nt, Human
aggccagaccagcagagg

SEQ ID NO: 878528 - RNA, 19 nt, Human
aggcugcagcugggcccca

SEQ ID NO: 878529 - RNA, 19 nt, Human
aggcugcgacugaacuucg

SEQ ID NO: 878530 - RNA, 25 nt, Human
agggaguaggcuagcugcagaccua

SEQ ID NO: 878531 - RNA, 21 nt, Human
aggggguacaagggagcaugg

SEQ ID NO: 878532 - RNA, 21 nt, Human
agguggggacugcuugaggcc

SEQ ID NO: 878533 - RNA, 18 nt, Human
aucucucuccugucuccc

SEQ ID NO: 878534 - RNA, 24 nt, Human
augagcaaagagcccgagagaagu

SEQ ID NO: 878535 - RNA, 23 nt, Human
caacccucacaccagcucucacc

SEQ ID NO: 878536 - RNA, 20 nt, Human
caagcagggcacacaaugcu

SEQ ID NO: 878537 - RNA, 23 nt, Human
caagguaaagucaagaucuccca

SEQ ID NO: 878538 - RNA, 23 nt, Human
caagugccaagguaaagucaaga

SEQ ID NO: 878539 - RNA, 18 nt, Human
cacacuggggcagaagau

SEQ ID NO: 878540 - RNA, 19 nt, Human
caccagaugagggcaagca

SEQ ID NO: 878541 - RNA, 19 nt, Human
cacuugauuuccagaccuu

SEQ ID NO: 878542 - RNA, 22 nt, Human
cacuuggagguggggacugcuu

SEQ ID NO: 878543 - RNA, 21 nt, Human
cagaaggaacaaaauagggcg

SEQ ID NO: 878544 - RNA, 18 nt, Human
cagaccuaccccauccca

SEQ ID NO: 878545 - RNA, 19 nt, Human
cagcaacagagauagacag

SEQ ID NO: 878546 - RNA, 21 nt, Human
cagcaacagagauagacagaa

SEQ ID NO: 878547 - RNA, 19 nt, Human
cagcaccagagggggaaau

SEQ ID NO: 878548 - RNA, 20 nt, Human
cagcaggcugcagcugggcc

SEQ ID NO: 878549 - RNA, 21 nt, Human
cagcccaucaacccccucacu

SEQ ID NO: 878550 - RNA, 18 nt, Human
cagcucugugcuuccuuc

SEQ ID NO: 878551 - RNA, 19 nt, Human
caggccagaccagcagagg

SEQ ID NO: 878552 - RNA, 20 nt, Human
caguauggagugcaaggucu

SEQ ID NO: 878553 - RNA, 23 nt, Human
caguauggagugcaaggucucuu

SEQ ID NO: 878554 - RNA, 23 nt, Human
caguggcaccagaagaggccagu

SEQ ID NO: 878555 - RNA, 23 nt, Human
caucaacccccucacugcccucu

SEQ ID NO: 878556 - RNA, 21 nt, Human
cauccaguucaagcugcuucc

SEQ ID NO: 878557 - RNA, 23 nt, Human
caugcacccagcccaucaacccc

SEQ ID NO: 878558 - RNA, 24 nt, Human
ccaucaacccccucacugcccucu

SEQ ID NO: 878559 - RNA, 23 nt, Human
cccagcccaucaacccccucacu

SEQ ID NO: 878560 - RNA, 20 nt, Human
cccagcucugugcuuccuuc

SEQ ID NO: 878561 - RNA, 24 nt, Human
cccaguaacuagcauaggguaccc

SEQ ID NO: 878562 - RNA, 21 nt, Human
ccccaggaucaagagcgaugg

SEQ ID NO: 878563 - RNA, 24 nt, Human
cccccaacacccccaguaacuagc

SEQ ID NO: 878564 - RNA, 23 nt, Human
cccuccacccaagugcauggaua

SEQ ID NO: 878565 - RNA, 21 nt, Human
cccugagccccaucugggcuc

SEQ ID NO: 878566 - RNA, 20 nt, Human
ccgagagaaguuggggaaga

SEQ ID NO: 878567 - RNA, 22 nt, Human
ccuaccccaucccaggccucca

SEQ ID NO: 878568 - RNA, 26 nt, Human
ccuaccccaucccaggccuccaggag

SEQ ID NO: 878569 - RNA, 21 nt, Human
ccuccagcaguggcaaagugu

SEQ ID NO: 878570 - RNA, 18 nt, Human
cggaaccccgugggaucu

SEQ ID NO: 878571 - RNA, 21 nt, Human
cgggagcccugggugacagug

SEQ ID NO: 878572 - RNA, 24 nt, Human
cgugggaucucucuccugucuccc

SEQ ID NO: 878573 - RNA, 21 nt, Human
cuaaagacuucugggccaaca

SEQ ID NO: 878574 - RNA, 20 nt, Human
cucagagucaacaccucucu

SEQ ID NO: 878575 - RNA, 23 nt, Human
cucagcaccagagggggaaaugg

SEQ ID NO: 878576 - RNA, 24 nt, Human
cucagcaccagagggggaaauggg

SEQ ID NO: 878577 - RNA, 20 nt, Human
cuccugucucccccaacacc

SEQ ID NO: 878578 - RNA, 23 nt, Human
cucuccugucucccccaacaccc

SEQ ID NO: 878579 - RNA, 27 nt, Human
cucugcagcuugagaagcaggaaaugg

SEQ ID NO: 878580 - RNA, 22 nt, Human
cucuggaaggauccaggcugcu

SEQ ID NO: 878581 - RNA, 30 nt, Human
cugagaggcaggugcuggugggcuccuggg

SEQ ID NO: 878582 - RNA, 20 nt, Human
cugcagcugggccccaagac

SEQ ID NO: 878583 - RNA, 20 nt, Human
cugcuggacugggcuggggc

SEQ ID NO: 878584 - RNA, 20 nt, Human
cugggcuggggcaagggcuu

SEQ ID NO: 878585 - RNA, 26 nt, Human
cuggggccccaggaucaagagcgaug

SEQ ID NO: 878586 - RNA, 21 nt, Human
cuguagccagagacacagggc

SEQ ID NO: 878587 - RNA, 18 nt, Human
cugugcuuccuuccuggg

SEQ ID NO: 878588 - RNA, 20 nt, Human
cugugcuuccuuccugggug

SEQ ID NO: 878589 - RNA, 21 nt, Human
cuuccugguuggucugcugcu

SEQ ID NO: 878590 - RNA, 19 nt, Human
cuucuagaucacuccuucg

SEQ ID NO: 878591 - RNA, 21 nt, Human
cuugaggcccgggagcccugg

SEQ ID NO: 878592 - RNA, 22 nt, Human
gaaauucacugugaccccaccu

SEQ ID NO: 878593 - RNA, 24 nt, Human
gaaggauccaggcugcuggguccc

SEQ ID NO: 878594 - RNA, 21 nt, Human
gaaugaauaaaugaaugaaca

SEQ ID NO: 878595 - RNA, 20 nt, Human
gacugggcuggggcaagggc

SEQ ID NO: 878596 - RNA, 26 nt, Human
gagacuccccuccacccaaggcacuc

SEQ ID NO: 878597 - RNA, 19 nt, Human
gagauagacagaaggaaca

SEQ ID NO: 878598 - RNA, 22 nt, Human
gagguggggacugcuugaggcc

SEQ ID NO: 878599 - RNA, 19 nt, Human
gagguuccgggugggggug

SEQ ID NO: 878600 - RNA, 20 nt, Human
gcaccaaagccaucugauga

SEQ ID NO: 878601 - RNA, 24 nt, Human
gcacugaaguggggugagaggcca

SEQ ID NO: 878602 - RNA, 19 nt, Human
gcauuccaaagggaguagg

SEQ ID NO: 878603 - RNA, 18 nt, Human
gccaaggucugcugaaug

SEQ ID NO: 878604 - RNA, 20 nt, Human
gcuggggcaagggcuugggg

SEQ ID NO: 878605 - RNA, 22 nt, Human
gcuggguggaggcccccagccu

SEQ ID NO: 878606 - RNA, 20 nt, Human
ggaaagucuccauccaguuc

SEQ ID NO: 878607 - RNA, 20 nt, Human
ggaccuagcccuccacuccu

SEQ ID NO: 878608 - RNA, 18 nt, Human
ggcaccagaagaggccag

SEQ ID NO: 878609 - RNA, 21 nt, Human
ggcagaagauguggagucacc

SEQ ID NO: 878610 - RNA, 18 nt, Human
ggccagugggcuaugugc

SEQ ID NO: 878611 - RNA, 22 nt, Human
gggcagggaguggggagcccuc

SEQ ID NO: 878612 - RNA, 21 nt, Human
ggggaaaugggcugaguccug

SEQ ID NO: 878613 - RNA, 22 nt, Human
ggggagcccucaagcaaagggc

SEQ ID NO: 878614 - RNA, 24 nt, Human
ggggagguuccggguggggguggg

SEQ ID NO: 878615 - RNA, 19 nt, Human
gggucuguuccucaccugg

SEQ ID NO: 878616 - RNA, 23 nt, Human
ggguggaggcccccagccucugc

SEQ ID NO: 878617 - RNA, 19 nt, Human
ggugcagaacucaugcaga

SEQ ID NO: 878618 - RNA, 22 nt, Human
gguggaggcccccagccucugc

SEQ ID NO: 878619 - RNA, 18 nt, Human
ggugggaaugaaaagcuu

SEQ ID NO: 878620 - RNA, 22 nt, Human
gucaagaucucccacuugauuu

SEQ ID NO: 878621 - RNA, 25 nt, Human
uaacuaaagacuucugggccaacag

SEQ ID NO: 878622 - RNA, 21 nt, Human
uaagggguacacaccagcagc

SEQ ID NO: 878623 - RNA, 21 nt, Human
uacacaccagcagcucaguug

SEQ ID NO: 878624 - RNA, 25 nt, Human
uacacaccagcagcucaguugugca

SEQ ID NO: 878625 - RNA, 20 nt, Human
uaccccaucccaggccucca

SEQ ID NO: 878626 - RNA, 21 nt, Human
uagaacacccaaguguacucc

SEQ ID NO: 878627 - RNA, 23 nt, Human
uagaacacccaaguguacucccc

SEQ ID NO: 878628 - RNA, 20 nt, Human
uaugugccaugcaccaaagc

SEQ ID NO: 878629 - RNA, 25 nt, Human
uauuggugggcagggaguggggagc

SEQ ID NO: 878630 - RNA, 19 nt, Human
ucaaggaugguuaguugca

SEQ ID NO: 878631 - RNA, 18 nt, Human
ucaccuggguauuggugg

SEQ ID NO: 878632 - RNA, 18 nt, Human
ucacugugaccccaccuc

SEQ ID NO: 878633 - RNA, 22 nt, Human
ucagggccaggcaaaugcagga

SEQ ID NO: 878634 - RNA, 20 nt, Human
ucccaggaaugaaaaaggcc

SEQ ID NO: 878635 - RNA, 18 nt, Human
ucccaggcacagagacuc

SEQ ID NO: 878636 - RNA, 25 nt, Human
ucccaggccuccaggagggaugcuc

SEQ ID NO: 878637 - RNA, 23 nt, Human
uccccaaagaggucuguauccau

SEQ ID NO: 878638 - RNA, 18 nt, Human
uccccagacacccugcua

SEQ ID NO: 878639 - RNA, 21 nt, Human
ucccccaacacccccaguaac

SEQ ID NO: 878640 - RNA, 18 nt, Human
uccccuccacccaagugc

SEQ ID NO: 878641 - RNA, 21 nt, Human
ucccuggcaugcacccagccc

SEQ ID NO: 878642 - RNA, 20 nt, Human
ucccugggaggccggaaccc

SEQ ID NO: 878643 - RNA, 21 nt, Human
ucccugggaggccggaacccc

SEQ ID NO: 878644 - RNA, 19 nt, Human
uccugggcuggucuugcug

SEQ ID NO: 878645 - RNA, 21 nt, Human
uccuggguggcuuccuuugug

SEQ ID NO: 878646 - RNA, 19 nt, Human
ucucucagagucaacaccu

SEQ ID NO: 878647 - RNA, 18 nt, Human
ucucugcagcuugagaag

SEQ ID NO: 878648 - RNA, 20 nt, Human
ucuggcaggacccagaagau

SEQ ID NO: 878649 - RNA, 22 nt, Human
ugaaggaaaaacuuauuuuaac

SEQ ID NO: 878650 - RNA, 19 nt, Human
ugaaguggggugagaggcc

SEQ ID NO: 878651 - RNA, 22 nt, Human
ugaaugaagagcaauuccaaag

SEQ ID NO: 878652 - RNA, 20 nt, Human
ugaaugagugggugaaugaa

SEQ ID NO: 878653 - RNA, 22 nt, Human
ugaccccaccuccuuucaguau

SEQ ID NO: 878654 - RNA, 18 nt, Human
ugacuccacagaccucca

SEQ ID NO: 878655 - RNA, 21 nt, Human
ugacuccacagaccuccaacc

SEQ ID NO: 878656 - RNA, 22 nt, Human
ugacuccacagaccuccaacca

SEQ ID NO: 878657 - RNA, 23 nt, Human
ugagcaaagagcccgagagaagu

SEQ ID NO: 878658 - RNA, 20 nt, Human
ugaggacccagagcuggggc

SEQ ID NO: 878659 - RNA, 18 nt, Human
ugaggcccgggagcccug

SEQ ID NO: 878660 - RNA, 19 nt, Human
ugcagagccaugaagggca

SEQ ID NO: 878661 - RNA, 25 nt, Human
ugcagaggacucaggggagccucca

SEQ ID NO: 878662 - RNA, 20 nt, Human
ugccaaggucugcugaauga

SEQ ID NO: 878663 - RNA, 25 nt, Human
ugccaaggucugcugaaugaguggg

SEQ ID NO: 878664 - RNA, 19 nt, Human
ugcugccuuuauugcauuc

SEQ ID NO: 878665 - RNA, 20 nt, Human
ugcuggguccuugggagccc

SEQ ID NO: 878666 - RNA, 21 nt, Human
ugcuggguggaggcccccagc

SEQ ID NO: 878667 - RNA, 19 nt, Human
ugcuggugggcuccugggc

SEQ ID NO: 878668 - RNA, 19 nt, Human
ugcuuccuuccuggguggc

SEQ ID NO: 878669 - RNA, 20 nt, Human
uggaaggagaagauacccug

SEQ ID NO: 878670 - RNA, 24 nt, Human
uggagguggggacugcuugaggcc

SEQ ID NO: 878671 - RNA, 21 nt, Human
uggcaaaguguaaacuucaag

SEQ ID NO: 878672 - RNA, 21 nt, Human
uggcaccagaagaggccagug

SEQ ID NO: 878673 - RNA, 23 nt, Human
uggcaccagaagaggccaguggg

SEQ ID NO: 878674 - RNA, 21 nt, Human
uggccacagaaggcugcgacu

SEQ ID NO: 878675 - RNA, 23 nt, Human
uggccacagaaggcugcgacuga

SEQ ID NO: 878676 - RNA, 18 nt, Human
ugggacuacagaaugccc

SEQ ID NO: 878677 - RNA, 20 nt, Human
ugggagagggggaccuugac

SEQ ID NO: 878678 - RNA, 18 nt, Human
ugggaggcugcuugaaag

SEQ ID NO: 878679 - RNA, 19 nt, Human
ugggcuccugggcuggucu

SEQ ID NO: 878680 - RNA, 24 nt, Human
uggggugagaggccagagggucug

SEQ ID NO: 878681 - RNA, 18 nt, Human
uggggugcagaacucaug

SEQ ID NO: 878682 - RNA, 20 nt, Human
uggggugcagaacucaugca

SEQ ID NO: 878683 - RNA, 18 nt, Human
uggguccuugggagccca

SEQ ID NO: 878684 - RNA, 23 nt, Human
uuaacacuucuagaucacuccuu

SEQ ID NO: 878685 - RNA, 18 nt, Human
uuagaugcauguugugaa

SEQ ID NO: 878686 - RNA, 22 nt, Human
uucaagcugcuuccugguuggu

SEQ ID NO: 878687 - RNA, 22 nt, Human
uucaaggagggccuagguugcc

SEQ ID NO: 878688 - RNA, 19 nt, Human
uuccucaccuggguauugg

SEQ ID NO: 878689 - RNA, 19 nt, Human
uuccuggguggcuuccuuu

SEQ ID NO: 878690 - RNA, 23 nt, Human
uuccuggguggcuuccuuugugu

SEQ ID NO: 878691 - RNA, 28 nt, Human
uuccuggguggcuuccuuuguguuccuc

SEQ ID NO: 878692 - RNA, 23 nt, Human
uuccugguuggucugcugcuggg

SEQ ID NO: 878693 - RNA, 26 nt, Human
uuccugguuggucugcugcugggugg

SEQ ID NO: 878694 - RNA, 24 nt, Human
uuccuuccuggguggcuuccuuug

SEQ ID NO: 878695 - RNA, 18 nt, Human
uucuguggccacagaagg

SEQ ID NO: 878696 - RNA, 19 nt, Human
uugagaagcaggaaauggu

SEQ ID NO: 878697 - RNA, 24 nt, Human
uuggagguggggacugcuugaggc

SEQ ID NO: 878698 - RNA, 24 nt, Human
uuuccagugggccugggacuacag

SEQ ID NO: 878699 - RNA, 23 nt, Human
uuuggaaagucuccauccaguuc

SEQ ID NO: 878700 - RNA, 25 nt, Human
aaaaagaaauaaaguggucagccug

SEQ ID NO: 878701 - RNA, 27 nt, Human
aaacauccugucauaaaaagacaagga

SEQ ID NO: 878702 - RNA, 22 nt, Human
aacauggaguagccaggaaaga

SEQ ID NO: 878703 - RNA, 18 nt, Human
aagaaacagggaaauaua

SEQ ID NO: 878704 - RNA, 22 nt, Human
aagaacaaagacaaucauagcc

SEQ ID NO: 878705 - RNA, 18 nt, Human
aaggaacuagggaguuuc

SEQ ID NO: 878706 - RNA, 23 nt, Human
aagguaagugggucacagacucu

SEQ ID NO: 878707 - RNA, 19 nt, Human
acaaagacaaucauagccu

SEQ ID NO: 878708 - RNA, 21 nt, Human
acaauacaaacucugaaacaa

SEQ ID NO: 878709 - RNA, 19 nt, Human
acaauauguagucuuuggu

SEQ ID NO: 878710 - RNA, 20 nt, Human
accaagugaaacaggaguuu

SEQ ID NO: 878711 - RNA, 22 nt, Human
accagaggcuagccaacaugga

SEQ ID NO: 878712 - RNA, 18 nt, Human
agaacaaagacaaucaua

SEQ ID NO: 878713 - RNA, 22 nt, Human
agaagaacaaagacaaucauag

SEQ ID NO: 878714 - RNA, 20 nt, Human
agacaaccucuccuacacaa

SEQ ID NO: 878715 - RNA, 26 nt, Human
agacaaccucuccuacacaauucacu

SEQ ID NO: 878716 - RNA, 20 nt, Human
agaggcuagccaacauggag

SEQ ID NO: 878717 - RNA, 18 nt, Human
agauaauaaguaagaggu

SEQ ID NO: 878718 - RNA, 21 nt, Human
agcaaaggggaacaaaaagaa

SEQ ID NO: 878719 - RNA, 27 nt, Human
agccuuuguauuauaugccauccuccu

SEQ ID NO: 878720 - RNA, 26 nt, Human
agcugagcaaacauccugucauaaaa

SEQ ID NO: 878721 - RNA, 18 nt, Human
agcuggacugagugagga

SEQ ID NO: 878722 - RNA, 21 nt, Human
aggcaggacuugaacuaagcu

SEQ ID NO: 878723 - RNA, 21 nt, Human
aggcucugaaagccacacacu

SEQ ID NO: 878724 - RNA, 20 nt, Human
aggcugcaguacguggaagc

SEQ ID NO: 878725 - RNA, 20 nt, Human
auaccauucuauuuuaacaa

SEQ ID NO: 878726 - RNA, 20 nt, Human
auggccuuaagcaugaugaa

SEQ ID NO: 878727 - RNA, 24 nt, Human
caaacugcuuggcucaccagcaug

SEQ ID NO: 878728 - RNA, 24 nt, Human
caaccucuccuacacaauucacug

SEQ ID NO: 878729 - RNA, 21 nt, Human
caaggagcugacaaucugguu

SEQ ID NO: 878730 - RNA, 18 nt, Human
caauacaaacucugaaac

SEQ ID NO: 878731 - RNA, 23 nt, Human
caaucagcaugaaucucucagac

SEQ ID NO: 878732 - RNA, 23 nt, Human
cacaauacaaacucugaaacaag

SEQ ID NO: 878733 - RNA, 22 nt, Human
cacauggcuuccaaagccagaa

SEQ ID NO: 878734 - RNA, 19 nt, Human
cacugcauugugguaggau

SEQ ID NO: 878735 - RNA, 19 nt, Human
cagcagugugagcagugau

SEQ ID NO: 878736 - RNA, 22 nt, Human
caggaaagagccagcaccugcu

SEQ ID NO: 878737 - RNA, 21 nt, Human
ccaaagccagaaaggaggcuc

SEQ ID NO: 878738 - RNA, 22 nt, Human
ccacacacuggugaucuccagu

SEQ ID NO: 878739 - RNA, 21 nt, Human
ccacagacaaccucuccuaca

SEQ ID NO: 878740 - RNA, 19 nt, Human
ccaggaaagagccagcacc

SEQ ID NO: 878741 - RNA, 20 nt, Human
ccccuggaaggagguuucca

SEQ ID NO: 878742 - RNA, 25 nt, Human
ccuuuguauuauaugccauccuccu

SEQ ID NO: 878743 - RNA, 21 nt, Human
cuaacugggcaccaaucaugc

SEQ ID NO: 878744 - RNA, 23 nt, Human
cuagccaacauggaguagccagg

SEQ ID NO: 878745 - RNA, 19 nt, Human
cuagucaaauuaauaagcc

SEQ ID NO: 878746 - RNA, 26 nt, Human
cucaaggagcugacaaucugguugga

SEQ ID NO: 878747 - RNA, 18 nt, Human
cugcaguacguggaagcc

SEQ ID NO: 878748 - RNA, 20 nt, Human
cuguaggcugauucaaauac

SEQ ID NO: 878749 - RNA, 18 nt, Human
cuuccaggcagcuguugu

SEQ ID NO: 878750 - RNA, 18 nt, Human
cuuggugagguccagcuc

SEQ ID NO: 878751 - RNA, 20 nt, Human
gagagaagaaaggcacugca

SEQ ID NO: 878752 - RNA, 23 nt, Human
gagccagcaccugcucugagaca

SEQ ID NO: 878753 - RNA, 21 nt, Human
gcaaaggggaacaaaaagaaa

SEQ ID NO: 878754 - RNA, 18 nt, Human
gcaguacguggaagccua

SEQ ID NO: 878755 - RNA, 22 nt, Human
gccaacauggaguagccaggaa

SEQ ID NO: 878756 - RNA, 20 nt, Human
ggaauuuuuguaugguuggg

SEQ ID NO: 878757 - RNA, 26 nt, Human
gguguuggggacaagaugagaaagga

SEQ ID NO: 878758 - RNA, 20 nt, Human
gguugggaaaagguugguca

SEQ ID NO: 878759 - RNA, 21 nt, Human
guguaugcauguauguauaua

SEQ ID NO: 878760 - RNA, 22 nt, Human
guugcaucaucccuggucccug

SEQ ID NO: 878761 - RNA, 24 nt, Human
uaagacguucgggugggaucucca

SEQ ID NO: 878762 - RNA, 18 nt, Human
uaagagguuaccagaggc

SEQ ID NO: 878763 - RNA, 27 nt, Human
uaagagguuaccagaggcuagccaaca

SEQ ID NO: 878764 - RNA, 21 nt, Human
uaaguaagagguuaccagagg

SEQ ID NO: 878765 - RNA, 19 nt, Human
uaccugugagaugcaaggu

SEQ ID NO: 878766 - RNA, 22 nt, Human
uagaauggaguuccaagucacu

SEQ ID NO: 878767 - RNA, 21 nt, Human
uagccaacauggaguagccag

SEQ ID NO: 878768 - RNA, 23 nt, Human
uagccaggaaagagccagcaccu

SEQ ID NO: 878769 - RNA, 25 nt, Human
uaggauaaacacccaagaauuaguu

SEQ ID NO: 878770 - RNA, 24 nt, Human
uaugauaaaugauuauaacgugug

SEQ ID NO: 878771 - RNA, 18 nt, Human
uaugcauguauguauaua

SEQ ID NO: 878772 - RNA, 21 nt, Human
uauguauauauaugauaaaug

SEQ ID NO: 878773 - RNA, 19 nt, Human
uauuucaaauuacaaggua

SEQ ID NO: 878774 - RNA, 22 nt, Human
ucaugauuagauaagacguucg

SEQ ID NO: 878775 - RNA, 21 nt, Human
uccaaagccagaaaggaggcu

SEQ ID NO: 878776 - RNA, 19 nt, Human
uccaccggacagcacucua

SEQ ID NO: 878777 - RNA, 21 nt, Human
uccaccggacagcacucuaaa

SEQ ID NO: 878778 - RNA, 20 nt, Human
ugaaagccacacacugguga

SEQ ID NO: 878779 - RNA, 22 nt, Human
ugaagcaaaggggaacaaaaag

SEQ ID NO: 878780 - RNA, 21 nt, Human
ugacaauauguagucuuuggu

SEQ ID NO: 878781 - RNA, 21 nt, Human
ugagaaaggaguugacucaga

SEQ ID NO: 878782 - RNA, 21 nt, Human
ugagcaaacauccugucauaa

SEQ ID NO: 878783 - RNA, 22 nt, Human
ugagcaaacauccugucauaaa

SEQ ID NO: 878784 - RNA, 22 nt, Human
ugaggaugaauugggagaagaa

SEQ ID NO: 878785 - RNA, 19 nt, Human
ugcauguauguauauauau

SEQ ID NO: 878786 - RNA, 21 nt, Human
ugccuaaaaugaguuucgaua

SEQ ID NO: 878787 - RNA, 24 nt, Human
ugcuaaaaucauggccuuaagcau

SEQ ID NO: 878788 - RNA, 21 nt, Human
uggaagaaacagggaaauaua

SEQ ID NO: 878789 - RNA, 20 nt, Human
uggagaagagcugacuugaa

SEQ ID NO: 878790 - RNA, 20 nt, Human
uggagagaagaaaggcacug

SEQ ID NO: 878791 - RNA, 23 nt, Human
uggaguagccaggaaagagccag

SEQ ID NO: 878792 - RNA, 19 nt, Human
ugggagaagaaagcacuuc

SEQ ID NO: 878793 - RNA, 18 nt, Human
uguaugcauguauguaua

SEQ ID NO: 878794 - RNA, 19 nt, Human
uguaugcauguauguauau

SEQ ID NO: 878795 - RNA, 24 nt, Human
uguaugcauguauguauauauaug

SEQ ID NO: 878796 - RNA, 26 nt, Human
uguccugaagauaauaaguaagaggu

SEQ ID NO: 878797 - RNA, 24 nt, Human
uguggcucuugcccucaaggagcu

SEQ ID NO: 878798 - RNA, 18 nt, Human
uguugugagugggaugug

SEQ ID NO: 878799 - RNA, 24 nt, Human
uuaauaagccuuuguauuauaugc

SEQ ID NO: 878800 - RNA, 22 nt, Human
uuauuugcuuugagaguguaug

SEQ ID NO: 878801 - RNA, 20 nt, Human
uucacugaaccuccccugga

SEQ ID NO: 878802 - RNA, 25 nt, Human
uugaaugaagcaaaggggaacaaaa

SEQ ID NO: 878803 - RNA, 22 nt, Human
uuggggacaagaugagaaagga

SEQ ID NO: 878804 - RNA, 24 nt, Human
uugugagugggaugugguugggug

SEQ ID NO: 878805 - RNA, 23 nt, Human
aaaaaaaaaaagcaaaaccacaa

SEQ ID NO: 878806 - RNA, 22 nt, Human
aaaaccacaacacacaucccca

SEQ ID NO: 878807 - RNA, 20 nt, Human
aaaaggccuaaaagccagaa

SEQ ID NO: 878808 - RNA, 22 nt, Human
aaaccacaacacacauccccaa

SEQ ID NO: 878809 - RNA, 21 nt, Human
aaagcuuccccauccuccccu

SEQ ID NO: 878810 - RNA, 20 nt, Human
aaccagcaacacaaggccag

SEQ ID NO: 878811 - RNA, 27 nt, Human
aagcaaaaccacaacacacauccccaa

SEQ ID NO: 878812 - RNA, 18 nt, Human
aagcaaacaauccccagg

SEQ ID NO: 878813 - RNA, 21 nt, Human
aagcaaacaauccccaggaaa

SEQ ID NO: 878814 - RNA, 22 nt, Human
aagcagccacagcugugagagu

SEQ ID NO: 878815 - RNA, 18 nt, Human
aagcagguacacccaugg

SEQ ID NO: 878816 - RNA, 21 nt, Human
acacauccccaaacaauaacc

SEQ ID NO: 878817 - RNA, 28 nt, Human
acacauccccaaacaauaacucucaauc

SEQ ID NO: 878818 - RNA, 18 nt, Human
accacaacacacaucccc

SEQ ID NO: 878819 - RNA, 22 nt, Human
acuguaagggaaaauuagucac

SEQ ID NO: 878820 - RNA, 21 nt, Human
acuuuaaaaucaaccaguagc

SEQ ID NO: 878821 - RNA, 21 nt, Human
agaaaucuucaaacuuacuaa

SEQ ID NO: 878822 - RNA, 27 nt, Human
agaaaucuucaaacuuacuaaacaaaa

SEQ ID NO: 878823 - RNA, 27 nt, Human
agcuuccccauccuccccuccccacca

SEQ ID NO: 878824 - RNA, 23 nt, Human
caaaaccacaacacacaucccca

SEQ ID NO: 878825 - RNA, 20 nt, Human
caaacaauaacucucaauca

SEQ ID NO: 878826 - RNA, 24 nt, Human
caaacaauccccaggaaauacuga

SEQ ID NO: 878827 - RNA, 27 nt, Human
caacacuaacaaagucaggguuucuca

SEQ ID NO: 878828 - RNA, 21 nt, Human
caagacgcaacaugaaaccug

SEQ ID NO: 878829 - RNA, 24 nt, Human
caaguaaccugcucucccucccuc

SEQ ID NO: 878830 - RNA, 21 nt, Human
cacaacacacauccccaaaca

SEQ ID NO: 878831 - RNA, 18 nt, Human
cacuaacaaagucagggu

SEQ ID NO: 878832 - RNA, 18 nt, Human
cagaaagaugcugaugug

SEQ ID NO: 878833 - RNA, 19 nt, Human
cagcauaacagcaucucac

SEQ ID NO: 878834 - RNA, 24 nt, Human
cagcauaacagcaucucacaacug

SEQ ID NO: 878835 - RNA, 21 nt, Human
cagccacagcugugagaguuu

SEQ ID NO: 878836 - RNA, 21 nt, Human
caggaaauacugaauaggaac

SEQ ID NO: 878837 - RNA, 23 nt, Human
caggaaauacugaauaggaacca

SEQ ID NO: 878838 - RNA, 18 nt, Human
caggcgccucuugcuggc

SEQ ID NO: 878839 - RNA, 19 nt, Human
caucucacaacugcucuaa

SEQ ID NO: 878840 - RNA, 19 nt, Human
ccaacacuaacaaagucag

SEQ ID NO: 878841 - RNA, 23 nt, Human
ccagaaaucuucaaacuuacuaa

SEQ ID NO: 878842 - RNA, 28 nt, Human
ccccgcggcgcccucccgcgcauguccg

SEQ ID NO: 878843 - RNA, 20 nt, Human
ccccuccccaccaucacauc

SEQ ID NO: 878844 - RNA, 26 nt, Human
cccgcacuacgaugagcuacuucagg

SEQ ID NO: 878845 - RNA, 21 nt, Human
ccuccauggaaaagauugccu

SEQ ID NO: 878846 - RNA, 22 nt, Human
ccugcaaaaauaaauggaacaa

SEQ ID NO: 878847 - RNA, 18 nt, Human
ccugcucucccucccuca

SEQ ID NO: 878848 - RNA, 21 nt, Human
cgcgcaggcgccucuugcugg

SEQ ID NO: 878849 - RNA, 22 nt, Human
cggcggcugccccgcggcgccc

SEQ ID NO: 878850 - RNA, 22 nt, Human
cuauguaaccucugcuggggcc

SEQ ID NO: 878851 - RNA, 20 nt, Human
cucugcugaaccaugacccc

SEQ ID NO: 878852 - RNA, 23 nt, Human
cuggcaccuagaauacuuuucca

SEQ ID NO: 878853 - RNA, 22 nt, Human
cuuccccauccuccccucccca

SEQ ID NO: 878854 - RNA, 23 nt, Human
cuuucauucccccggaggagcgg

SEQ ID NO: 878855 - RNA, 18 nt, Human
gaaguguuuuacuuaaaa

SEQ ID NO: 878856 - RNA, 18 nt, Human
ggcccaggcacuuuaaaa

SEQ ID NO: 878857 - RNA, 18 nt, Human
guaccccacugcuucuaa

SEQ ID NO: 878858 - RNA, 28 nt, Human
gucuaaaaaaaaaaaagcaaaaccacaa

SEQ ID NO: 878859 - RNA, 22 nt, Human
gugagcaccuucucuucugugc

SEQ ID NO: 878860 - RNA, 18 nt, Human
uaaaaagcuuccccaucc

SEQ ID NO: 878861 - RNA, 22 nt, Human
uaaaacugacauccuaacacug

SEQ ID NO: 878862 - RNA, 21 nt, Human
uaaaauauaauaagcuuuaaa

SEQ ID NO: 878863 - RNA, 20 nt, Human
uaaaaucaaccaguagcuuu

SEQ ID NO: 878864 - RNA, 22 nt, Human
uaaacagcuuguuuaacuguua

SEQ ID NO: 878865 - RNA, 22 nt, Human
uaaacuguaaacagcuuguuua

SEQ ID NO: 878866 - RNA, 25 nt, Human
uaacaaagucaggguuucucagcau

SEQ ID NO: 878867 - RNA, 25 nt, Human
uaacagcaucucacaacugcucuaa

SEQ ID NO: 878868 - RNA, 21 nt, Human
uaacguaccccacugcuucua

SEQ ID NO: 878869 - RNA, 26 nt, Human
uaacuuuauuaaaaugaaaagacaau

SEQ ID NO: 878870 - RNA, 22 nt, Human
uaagagaacauugcaguaaugu

SEQ ID NO: 878871 - RNA, 19 nt, Human
uaagggauuuuucucugca

SEQ ID NO: 878872 - RNA, 22 nt, Human
uagcucaaauaauauucagcag

SEQ ID NO: 878873 - RNA, 25 nt, Human
uagugagcaccuucucuucugugcu

SEQ ID NO: 878874 - RNA, 18 nt, Human
uauaccacaaguuuauau

SEQ ID NO: 878875 - RNA, 19 nt, Human
uauguaauguaugcauaua

SEQ ID NO: 878876 - RNA, 21 nt, Human
ucagcgccgcgggcucagggg

SEQ ID NO: 878877 - RNA, 20 nt, Human
uccacaugaagacagagagu

SEQ ID NO: 878878 - RNA, 19 nt, Human
uccccauccuccccucccc

SEQ ID NO: 878879 - RNA, 19 nt, Human
ucccgcgcauguccguccc

SEQ ID NO: 878880 - RNA, 19 nt, Human
ucccucaacaagacgcaac

SEQ ID NO: 878881 - RNA, 20 nt, Human
ucuaaaaaaaaaaaagcaaa

SEQ ID NO: 878882 - RNA, 24 nt, Human
ucuaaaaaaaaaaaagcaaaacca

SEQ ID NO: 878883 - RNA, 22 nt, Human
ucucacaacugcucuaaaccuu

SEQ ID NO: 878884 - RNA, 19 nt, Human
ucuccaaaccugugaggcc

SEQ ID NO: 878885 - RNA, 22 nt, Human
ucuccaaaccugugaggcccag

SEQ ID NO: 878886 - RNA, 20 nt, Human
ucugcugaaccaugacccca

SEQ ID NO: 878887 - RNA, 21 nt, Human
ucugcugaaccaugaccccaa

SEQ ID NO: 878888 - RNA, 23 nt, Human
ucuucaaacuuacuaaacaaaaa

SEQ ID NO: 878889 - RNA, 20 nt, Human
ugaagcagccacagcuguga

SEQ ID NO: 878890 - RNA, 19 nt, Human
ugaauaggaaccagcaaca

SEQ ID NO: 878891 - RNA, 22 nt, Human
ugccugcaaaaauaaauggaac

SEQ ID NO: 878892 - RNA, 20 nt, Human
ugcuggcucgcgcucccgcu

SEQ ID NO: 878893 - RNA, 25 nt, Human
ugcuggcucgcgcucccgcuagcac

SEQ ID NO: 878894 - RNA, 23 nt, Human
ugguaugauuuuuaaccuaagca

SEQ ID NO: 878895 - RNA, 23 nt, Human
uguaaccucugcugaaccaugac

SEQ ID NO: 878896 - RNA, 26 nt, Human
uuaguucauacuaaaauauaauaagc

SEQ ID NO: 878897 - RNA, 28 nt, Human
uuaguucauacuaaaauauaauaagcuu

SEQ ID NO: 878898 - RNA, 19 nt, Human
uucaagauaaauacaugga

SEQ ID NO: 878899 - RNA, 19 nt, Human
uuucauucccccggaggag

SEQ ID NO: 878900 - RNA, 25 nt, Human
uuuucagucuaucaggacucauuuc

SEQ ID NO: 878901 - RNA, 19 nt, Human
uuuuuuuuuuuuuuuuuaa

SEQ ID NO: 878902 - RNA, 22 nt, Human
aaaucaugaucauaaugaaguc

SEQ ID NO: 878903 - RNA, 20 nt, Human
aacagacuagaacauggcca

SEQ ID NO: 878904 - RNA, 24 nt, Human
aagcgcugccuguggccggagcgg

SEQ ID NO: 878905 - RNA, 23 nt, Human
aaugcaaagaguugcauauuuua

SEQ ID NO: 878906 - RNA, 21 nt, Human
acaaaaacaaaucaagcacga

SEQ ID NO: 878907 - RNA, 19 nt, Human
acagcgcaacagacuagaa

SEQ ID NO: 878908 - RNA, 21 nt, Human
agacagugauuaugcugguga

SEQ ID NO: 878909 - RNA, 21 nt, Human
agcgcugccuguggccggagc

SEQ ID NO: 878910 - RNA, 24 nt, Human
aguaguuuuuaaaaaacuguacaa

SEQ ID NO: 878911 - RNA, 23 nt, Human
agugaugguuuguuccugauuug

SEQ ID NO: 878912 - RNA, 21 nt, Human
auaucaaauuaaacauacauu

SEQ ID NO: 878913 - RNA, 24 nt, Human
aucauaaugaagucauucuuaauu

SEQ ID NO: 878914 - RNA, 20 nt, Human
augccugauuuauuuggggg

SEQ ID NO: 878915 - RNA, 23 nt, Human
auuaguuacacaaaaugcauacu

SEQ ID NO: 878916 - RNA, 22 nt, Human
caauacugguaauccaccucuc

SEQ ID NO: 878917 - RNA, 24 nt, Human
caaugacauuacuaaauaucaggc

SEQ ID NO: 878918 - RNA, 19 nt, Human
caccucucccucgcacccu

SEQ ID NO: 878919 - RNA, 23 nt, Human
caccucucccucgcacccuuuug

SEQ ID NO: 878920 - RNA, 19 nt, Human
cagacagugauuaugcugg

SEQ ID NO: 878921 - RNA, 18 nt, Human
caugccugauuuauuugg

SEQ ID NO: 878922 - RNA, 26 nt, Human
cauggcccuaaggaaugugugacaaa

SEQ ID NO: 878923 - RNA, 22 nt, Human
ccccgcgcuccacccucucccc

SEQ ID NO: 878924 - RNA, 20 nt, Human
ccccucgccuggcuccccgc

SEQ ID NO: 878925 - RNA, 20 nt, Human
ccgcccccucuguccgagcc

SEQ ID NO: 878926 - RNA, 21 nt, Human
ccuaaggaaugugugacaaau

SEQ ID NO: 878927 - RNA, 18 nt, Human
ccuccugcaugccugauu

SEQ ID NO: 878928 - RNA, 22 nt, Human
cgcaacagacuagaacauggcc

SEQ ID NO: 878929 - RNA, 22 nt, Human
cgcuccuagcgcuccgggcccg

SEQ ID NO: 878930 - RNA, 19 nt, Human
cggcuggcgaagcgcugcc

SEQ ID NO: 878931 - RNA, 18 nt, Human
cuccuagcgcuccgggcc

SEQ ID NO: 878932 - RNA, 19 nt, Human
cucgcggggcggcgguguc

SEQ ID NO: 878933 - RNA, 18 nt, Human
cucuccccgcccccucug

SEQ ID NO: 878934 - RNA, 21 nt, Human
cuggcuccccgcgcuccaccc

SEQ ID NO: 878935 - RNA, 21 nt, Human
gaaguaggauauuuuaaaaca

SEQ ID NO: 878936 - RNA, 19 nt, Human
gacaaaaacaaaucaagca

SEQ ID NO: 878937 - RNA, 22 nt, Human
gcgcugccuguggccggagcgg

SEQ ID NO: 878938 - RNA, 21 nt, Human
gcuacauuuaagccaucugcu

SEQ ID NO: 878939 - RNA, 18 nt, Human
ggauagcuuuaaaauaga

SEQ ID NO: 878940 - RNA, 23 nt, Human
ggccggagcggcuaauggagucc

SEQ ID NO: 878941 - RNA, 20 nt, Human
ggcggcgguguccgcguccg

SEQ ID NO: 878942 - RNA, 21 nt, Human
ggcugggcugggcgcgcuggc

SEQ ID NO: 878943 - RNA, 22 nt, Human
gggcccgggacucgcgcggcaa

SEQ ID NO: 878944 - RNA, 20 nt, Human
uaaaaacacgagacaauaua

SEQ ID NO: 878945 - RNA, 21 nt, Human
uaaaaauaaaaacacgagaca

SEQ ID NO: 878946 - RNA, 26 nt, Human
uaaaaugcauuuauacagucuuugaa

SEQ ID NO: 878947 - RNA, 23 nt, Human
uacaauaugguguaaaaauaaaa

SEQ ID NO: 878948 - RNA, 22 nt, Human
uauucaaggacaaaaacaaauc

SEQ ID NO: 878949 - RNA, 26 nt, Human
uccccgcgcuccacccucuccccgcc

SEQ ID NO: 878950 - RNA, 24 nt, Human
ucgcggccccucgccuggcucccc

SEQ ID NO: 878951 - RNA, 22 nt, Human
ucgucgcggccccucgccuggc

SEQ ID NO: 878952 - RNA, 18 nt, Human
ugccuguggccggagcga

SEQ ID NO: 878953 - RNA, 19 nt, Human
uggccaguccaggcauuag

SEQ ID NO: 878954 - RNA, 24 nt, Human
uggccguggaguuucauuaaacaa

SEQ ID NO: 878955 - RNA, 21 nt, Human
uggcugggcugggcgcgcugg

SEQ ID NO: 878956 - RNA, 18 nt, Human
ugggcugggcgcgcuggc

SEQ ID NO: 878957 - RNA, 18 nt, Human
uggucugguaaggcaaag

SEQ ID NO: 878958 - RNA, 20 nt, Human
uguccgagccuggcugggcu

SEQ ID NO: 878959 - RNA, 23 nt, Human
uucaaggucaaacacaaugacau

SEQ ID NO: 878960 - RNA, 18 nt, Human
uucauuaaacaguauucc

SEQ ID NO: 878961 - RNA, 20 nt, Human
uucauuaaacaguauuccua

SEQ ID NO: 878962 - RNA, 24 nt, Human
uuccucggcuggcgaagcgcugcc

SEQ ID NO: 878963 - RNA, 23 nt, Human
uuuauuuaaaauaaaaugcauuu

SEQ ID NO: 878964 - RNA, 23 nt, Human
uuugaaccauggauuauugaaca

SEQ ID NO: 878965 - RNA, 21 nt, Human
uuuguuccugauuugcccacu

SEQ ID NO: 878966 - RNA, 19 nt, Human
aaaagaaagcacauuuaaa

SEQ ID NO: 878967 - RNA, 21 nt, Human
aagaugaccuuuuuaaaccaa

SEQ ID NO: 878968 - RNA, 24 nt, Human
aauggucagaacagcacuagugcc

SEQ ID NO: 878969 - RNA, 25 nt, Human
accacacacaggacagccccaacac

SEQ ID NO: 878970 - RNA, 22 nt, Human
acccgguccuggagggggugcu

SEQ ID NO: 878971 - RNA, 20 nt, Human
agcaagagacccauagaacu

SEQ ID NO: 878972 - RNA, 22 nt, Human
agccaauacaacuccaaccuua

SEQ ID NO: 878973 - RNA, 19 nt, Human
agcgaaaagggcugaagag

SEQ ID NO: 878974 - RNA, 18 nt, Human
agguggagcugcaggaag

SEQ ID NO: 878975 - RNA, 27 nt, Human
agguggagcugcaggaagcuucgggga

SEQ ID NO: 878976 - RNA, 21 nt, Human
aguagcugaggagcccacagc

SEQ ID NO: 878977 - RNA, 19 nt, Human
auucuuccuaaguaaaccc

SEQ ID NO: 878978 - RNA, 23 nt, Human
auugaagaauucaggugaagaug

SEQ ID NO: 878979 - RNA, 20 nt, Human
auuuacagucagaugaaugu

SEQ ID NO: 878980 - RNA, 23 nt, Human
caagaauaaaaauccuuaccccc

SEQ ID NO: 878981 - RNA, 21 nt, Human
caagagacccauagaacucau

SEQ ID NO: 878982 - RNA, 20 nt, Human
caauacaacuccaaccuuac

SEQ ID NO: 878983 - RNA, 21 nt, Human
caccacacacaggacagcccc

SEQ ID NO: 878984 - RNA, 18 nt, Human
caccucaagcccuaacau

SEQ ID NO: 878985 - RNA, 21 nt, Human
caccucaagcccuaacaugcc

SEQ ID NO: 878986 - RNA, 22 nt, Human
caccucaagcccuaacaugccu

SEQ ID NO: 878987 - RNA, 19 nt, Human
caggauggggcggggggca

SEQ ID NO: 878988 - RNA, 25 nt, Human
cauuuucguuugucaucucugggag

SEQ ID NO: 878989 - RNA, 23 nt, Human
ccaagccacgugugcccugcaua

SEQ ID NO: 878990 - RNA, 24 nt, Human
ccaccacacacaggacagccccaa

SEQ ID NO: 878991 - RNA, 22 nt, Human
ccacucuugaacucugaaagcc

SEQ ID NO: 878992 - RNA, 25 nt, Human
ccagacagcugcuggagguucaaau

SEQ ID NO: 878993 - RNA, 21 nt, Human
ccagagcaagcccucgcccgu

SEQ ID NO: 878994 - RNA, 18 nt, Human
ccagaguguuccacaaau

SEQ ID NO: 878995 - RNA, 23 nt, Human
ccagccaauacaacuccaaccuu

SEQ ID NO: 878996 - RNA, 18 nt, Human
cccaccacacacaggaca

SEQ ID NO: 878997 - RNA, 21 nt, Human
cccaccacacacaggacagcc

SEQ ID NO: 878998 - RNA, 20 nt, Human
ccccaccucaagcccuaacc

SEQ ID NO: 878999 - RNA, 19 nt, Human
cccccuagcaagagaccca

SEQ ID NO: 879000 - RNA, 25 nt, Human
cuguguacauauuucgaagauuccc

SEQ ID NO: 879001 - RNA, 22 nt, Human
gaaaagggcugaagagaccuca

SEQ ID NO: 879002 - RNA, 18 nt, Human
gaccuuuuuaaaccaagc

SEQ ID NO: 879003 - RNA, 26 nt, Human
gagaaacccgguccuggagggggugc

SEQ ID NO: 879004 - RNA, 22 nt, Human
gagcccacagcuaaguucucuc

SEQ ID NO: 879005 - RNA, 18 nt, Human
gcagagcagccucagucu

SEQ ID NO: 879006 - RNA, 23 nt, Human
gcagagcagccucagucuuaaaa

SEQ ID NO: 879007 - RNA, 24 nt, Human
gccaauacaacuccaaccuuacau

SEQ ID NO: 879008 - RNA, 23 nt, Human
gcggggggcaaaaaaagaguggg

SEQ ID NO: 879009 - RNA, 21 nt, Human
gcugcuggagguucaaauucc

SEQ ID NO: 879010 - RNA, 25 nt, Human
ggacauuuggcaaugucuagagaca

SEQ ID NO: 879011 - RNA, 22 nt, Human
ggagcugcaggaagcuucgggg

SEQ ID NO: 879012 - RNA, 21 nt, Human
ggugaccacuagcgaaaaggg

SEQ ID NO: 879013 - RNA, 23 nt, Human
gguuuuguggugaucaggguagg

SEQ ID NO: 879014 - RNA, 18 nt, Human
guagcugaggagcccaca

SEQ ID NO: 879015 - RNA, 22 nt, Human
gucuagagacauuuucguuugu

SEQ ID NO: 879016 - RNA, 21 nt, Human
uaaaaauccuuacccccuagc

SEQ ID NO: 879017 - RNA, 21 nt, Human
uaaaccaagccacgugugccc

SEQ ID NO: 879018 - RNA, 19 nt, Human
uaaaucuaagaugaccuuu

SEQ ID NO: 879019 - RNA, 24 nt, Human
uacaacuccaaccuuacauccuuc

SEQ ID NO: 879020 - RNA, 20 nt, Human
uagcccaagguuauagacag

SEQ ID NO: 879021 - RNA, 20 nt, Human
uauuuugguuuauuacccug

SEQ ID NO: 879022 - RNA, 24 nt, Human
ucaagcuucuuuuuccuacuuuuu

SEQ ID NO: 879023 - RNA, 21 nt, Human
ucaggugaagaugccaccacu

SEQ ID NO: 879024 - RNA, 24 nt, Human
ucagugauauuuaggacacucucu

SEQ ID NO: 879025 - RNA, 18 nt, Human
uccacaaauguccagaca

SEQ ID NO: 879026 - RNA, 20 nt, Human
ucuagccagaguuacuugca

SEQ ID NO: 879027 - RNA, 22 nt, Human
ugaaugccccaccucaagcccu

SEQ ID NO: 879028 - RNA, 19 nt, Human
ugaaugugaaugccccacc

SEQ ID NO: 879029 - RNA, 20 nt, Human
ugacggucaaagccugugcu

SEQ ID NO: 879030 - RNA, 19 nt, Human
ugagaguacgggcgagcac

SEQ ID NO: 879031 - RNA, 22 nt, Human
ugagcagaaguccccaauuauc

SEQ ID NO: 879032 - RNA, 19 nt, Human
ugccaaggcugagaaaccc

SEQ ID NO: 879033 - RNA, 21 nt, Human
ugccaccacucuugaacucug

SEQ ID NO: 879034 - RNA, 19 nt, Human
ugccacuggcaucuagugg

SEQ ID NO: 879035 - RNA, 20 nt, Human
uggcauugaagaauucaggu

SEQ ID NO: 879036 - RNA, 19 nt, Human
ugggagggggugccacugg

SEQ ID NO: 879037 - RNA, 20 nt, Human
ugggagggggugccacugga

SEQ ID NO: 879038 - RNA, 21 nt, Human
ugggagggggugccacuggca

SEQ ID NO: 879039 - RNA, 18 nt, Human
ugguggugggugaccacu

SEQ ID NO: 879040 - RNA, 20 nt, Human
uguccagacagcugcuggag

SEQ ID NO: 879041 - RNA, 19 nt, Human
uguucucucuagccagagu

SEQ ID NO: 879042 - RNA, 19 nt, Human
uuagggcugggaucagcca

SEQ ID NO: 879043 - RNA, 23 nt, Human
uucaaauuccagccaauacaacu

SEQ ID NO: 879044 - RNA, 20 nt, Human
uucacaggggacauuuggca

SEQ ID NO: 879045 - RNA, 19 nt, Human
uucaugugauuuuucucug

SEQ ID NO: 879046 - RNA, 18 nt, Human
uuuuuuuuuuuuuuuuug

SEQ ID NO: 879047 - RNA, 19 nt, Human
acagugcaccggagcccac

SEQ ID NO: 879048 - RNA, 18 nt, Human
aucuggaaggagguaaga

SEQ ID NO: 879049 - RNA, 19 nt, Human
aucuuccuuuuugcuuuua

SEQ ID NO: 879050 - RNA, 18 nt, Human
ccaguauuccaucuggaa

SEQ ID NO: 879051 - RNA, 19 nt, Human
cccacagugcaccggagcc

SEQ ID NO: 879052 - RNA, 21 nt, Human
ccgccgcccgguccugccagg

SEQ ID NO: 879053 - RNA, 19 nt, Human
ccgccgccgcccgguccug

SEQ ID NO: 879054 - RNA, 20 nt, Human
ccgccgccgcccgguccugc

SEQ ID NO: 879055 - RNA, 25 nt, Human
ccgccgccggcccgcgccgccgccg

SEQ ID NO: 879056 - RNA, 25 nt, Human
ccgccggcccgcgccgccgccgccc

SEQ ID NO: 879057 - RNA, 19 nt, Human
ccgcgccccucagccggcc

SEQ ID NO: 879058 - RNA, 20 nt, Human
cggcguccgccgcccgcugg

SEQ ID NO: 879059 - RNA, 18 nt, Human
cgggucccuggccgccgc

SEQ ID NO: 879060 - RNA, 21 nt, Human
cuggccgcccgcgccccucag

SEQ ID NO: 879061 - RNA, 18 nt, Human
gaacuuaaaagaguaaug

SEQ ID NO: 879062 - RNA, 22 nt, Human
gacuuuucaucucugaaacuuu

SEQ ID NO: 879063 - RNA, 21 nt, Human
gccggcccgcgccgccgccgc

SEQ ID NO: 879064 - RNA, 23 nt, Human
gggucccuggccgccgccggccc

SEQ ID NO: 879065 - RNA, 20 nt, Human
uaaagcucugaaaauuagcu

SEQ ID NO: 879066 - RNA, 20 nt, Human
uaacauuguaaacuguucaa

SEQ ID NO: 879067 - RNA, 18 nt, Human
uaacuagccaguauucca

SEQ ID NO: 879068 - RNA, 23 nt, Human
ucccacagugcaccggagcccac

SEQ ID NO: 879069 - RNA, 19 nt, Human
ucccuggccgccgccggcc

SEQ ID NO: 879070 - RNA, 21 nt, Human
uggccgccgccggcccgcgcc

SEQ ID NO: 879071 - RNA, 26 nt, Human
uuagcaaacuggaacuuaaaagagua

SEQ ID NO: 879072 - RNA, 20 nt, Human
uuuuuuuuguuuggaagcgc

SEQ ID NO: 879073 - RNA, 21 nt, Human
uuuuuuuuuuuuuuguuugga

SEQ ID NO: 879074 - RNA, 22 nt, Human
uuuuuuuuuuuuuuuuguuugg

SEQ ID NO: 879075 - RNA, 18 nt, Human
uuuuuuuuuuuuuuuuug

SEQ ID NO: 879076 - RNA, 22 nt, Human
uuuuuuuuuuuuuuuuuuguuu

SEQ ID NO: 879077 - RNA, 19 nt, Human
acccuuguccggggccccg

SEQ ID NO: 879078 - RNA, 19 nt, Human
cauggaaacaugccaaguc

SEQ ID NO: 879079 - RNA, 26 nt, Human
cccagccccggacucggagagggcug

SEQ ID NO: 879080 - RNA, 19 nt, Human
ccgcugccgccacagccgc

SEQ ID NO: 879081 - RNA, 20 nt, Human
ccgcugccgccacagccgcc

SEQ ID NO: 879082 - RNA, 20 nt, Human
ccgcugccgccacagccgcc

SEQ ID NO: 879083 - RNA, 24 nt, Human
ccuucucuuuggugugcgcggggc

SEQ ID NO: 879084 - RNA, 19 nt, Human
ccuuguccggggccccgcg

SEQ ID NO: 879085 - RNA, 19 nt, Human
cugccgccacagccgccuu

SEQ ID NO: 879086 - RNA, 19 nt, Human
gccgcugccgccacagccg

SEQ ID NO: 879087 - RNA, 21 nt, Human
ggcccucgaaggcugcagcuc

SEQ ID NO: 879088 - RNA, 23 nt, Human
gugcgcggggcugccgccuuguc

SEQ ID NO: 879089 - RNA, 20 nt, Human
uccacaaucuaucauuuuaa

SEQ ID NO: 879090 - RNA, 20 nt, Human
ucgcguccccgccacccccc

SEQ ID NO: 879091 - RNA, 18 nt, Human
uggugggacccagccccg

SEQ ID NO: 879092 - RNA, 19 nt, Human
aaaaccaaauaaaaaucac

SEQ ID NO: 879093 - RNA, 25 nt, Human
aaaagcaaacaaguuuaucuuaaaa

SEQ ID NO: 879094 - RNA, 21 nt, Human
aaaauauaaccucaagaggac

SEQ ID NO: 879095 - RNA, 23 nt, Human
aaacagacucaggaaacuaugca

SEQ ID NO: 879096 - RNA, 18 nt, Human
aaacagagcuccagcaua

SEQ ID NO: 879097 - RNA, 22 nt, Human
aaagugccuuuauccaggggua

SEQ ID NO: 879098 - RNA, 20 nt, Human
aaauacagcagcaggugaua

SEQ ID NO: 879099 - RNA, 26 nt, Human
aacaaacucauagagcacacauaaga

SEQ ID NO: 879100 - RNA, 18 nt, Human
aaccuaguaucucaaacu

SEQ ID NO: 879101 - RNA, 28 nt, Human
aacuacuaaauauuuuauuucuaagcaa

SEQ ID NO: 879102 - RNA, 26 nt, Human
aagaagaaaauuacaacaaacucaua

SEQ ID NO: 879103 - RNA, 27 nt, Human
aagaagaaaauuacaacaaacucauag

SEQ ID NO: 879104 - RNA, 21 nt, Human
aagcacuuuacaaacagacuc

SEQ ID NO: 879105 - RNA, 21 nt, Human
aaggugccaaaaaacuaccag

SEQ ID NO: 879106 - RNA, 20 nt, Human
aaguguguaguuucauaguu

SEQ ID NO: 879107 - RNA, 19 nt, Human
aauaaaaaucacauccgaa

SEQ ID NO: 879108 - RNA, 20 nt, Human
acauagcuuaaccagacucu

SEQ ID NO: 879109 - RNA, 20 nt, Human
agagauacauauuuugauuc

SEQ ID NO: 879110 - RNA, 18 nt, Human
agagcagcggcggcaaca

SEQ ID NO: 879111 - RNA, 24 nt, Human
aggugccaaaaaacuaccagggcu

SEQ ID NO: 879112 - RNA, 24 nt, Human
auuauagaaaaauacuugaaauaa

SEQ ID NO: 879113 - RNA, 18 nt, Human
caaagauggcacucaacu

SEQ ID NO: 879114 - RNA, 18 nt, Human
cagacucugaaaaagaga

SEQ ID NO: 879115 - RNA, 24 nt, Human
cauccauagccuauuccuaauuau

SEQ ID NO: 879116 - RNA, 23 nt, Human
caugucugcaugacuuaagguuc

SEQ ID NO: 879117 - RNA, 21 nt, Human
cccggcaauauccgagaccgc

SEQ ID NO: 879118 - RNA, 20 nt, Human
cuagaagcggcgaugggucc

SEQ ID NO: 879119 - RNA, 19 nt, Human
cucauagagcacacauaag

SEQ ID NO: 879120 - RNA, 20 nt, Human
cuggauuaaaaacaaaaaag

SEQ ID NO: 879121 - RNA, 20 nt, Human
cuguuugucugagaaauuca

SEQ ID NO: 879122 - RNA, 19 nt, Human
cuuaaaaaauaccaaguau

SEQ ID NO: 879123 - RNA, 22 nt, Human
gaaugcccucuaauagugaaac

SEQ ID NO: 879124 - RNA, 22 nt, Human
gagcagcggcggcaacagcacc

SEQ ID NO: 879125 - RNA, 21 nt, Human
gcaacagcaccagccucgugc

SEQ ID NO: 879126 - RNA, 18 nt, Human
gcagcggcggcaacagca

SEQ ID NO: 879127 - RNA, 21 nt, Human
gcggcggcaacagcaccagcc

SEQ ID NO: 879128 - RNA, 18 nt, Human
gggguggggguggcuaca

SEQ ID NO: 879129 - RNA, 22 nt, Human
gggguggggguggcuacaggga

SEQ ID NO: 879130 - RNA, 20 nt, Human
gguggggguggcuacaggga

SEQ ID NO: 879131 - RNA, 22 nt, Human
uaaaaacaaaaaaguuaguuuc

SEQ ID NO: 879132 - RNA, 22 nt, Human
uaaauccuguuugucugagaaa

SEQ ID NO: 879133 - RNA, 22 nt, Human
uaaccagacucugaaaaagaga

SEQ ID NO: 879134 - RNA, 18 nt, Human
uacaaacauauguauaug

SEQ ID NO: 879135 - RNA, 20 nt, Human
uacacaaaagcaaacaaguu

SEQ ID NO: 879136 - RNA, 24 nt, Human
uacacaaaagcaaacaaguuuauc

SEQ ID NO: 879137 - RNA, 20 nt, Human
uacauacauguuggccugga

SEQ ID NO: 879138 - RNA, 20 nt, Human
uaccugucaacaaauacaga

SEQ ID NO: 879139 - RNA, 21 nt, Human
uacuugauauuuaagcaacac

SEQ ID NO: 879140 - RNA, 21 nt, Human
uagaccccuggagugugccag

SEQ ID NO: 879141 - RNA, 21 nt, Human
uagcagacuuuagugcuguau

SEQ ID NO: 879142 - RNA, 23 nt, Human
uagggucuagaagcggcgauggg

SEQ ID NO: 879143 - RNA, 21 nt, Human
uauaauacaaacauauguaua

SEQ ID NO: 879144 - RNA, 26 nt, Human
uauaugcauucaugugcauauacaug

SEQ ID NO: 879145 - RNA, 23 nt, Human
uaucucaaacugauugcuuacug

SEQ ID NO: 879146 - RNA, 21 nt, Human
ucaaaacaaaggagagaauua

SEQ ID NO: 879147 - RNA, 23 nt, Human
uccaaaauauaaccucaagagga

SEQ ID NO: 879148 - RNA, 22 nt, Human
uccuuccucgagcucuucccaa

SEQ ID NO: 879149 - RNA, 23 nt, Human
ucucaaacugauugcuuacaauu

SEQ ID NO: 879150 - RNA, 18 nt, Human
ucugacaauaauuacuga

SEQ ID NO: 879151 - RNA, 21 nt, Human
ugacuaaaaauaaaaccagga

SEQ ID NO: 879152 - RNA, 22 nt, Human
ugacuuaagguucccuaaacac

SEQ ID NO: 879153 - RNA, 25 nt, Human
ugagaaauucacaauacauuuuaga

SEQ ID NO: 879154 - RNA, 20 nt, Human
ugaugguauacauaugaugu

SEQ ID NO: 879155 - RNA, 18 nt, Human
ugauuauagaaaaauacu

SEQ ID NO: 879156 - RNA, 20 nt, Human
ugccaaaaaacuaccagggc

SEQ ID NO: 879157 - RNA, 19 nt, Human
ugggguggggguggcuaca

SEQ ID NO: 879158 - RNA, 21 nt, Human
ugugcauauacauguacuuca

SEQ ID NO: 879159 - RNA, 18 nt, Human
uucaaaacaaaggagaga

SEQ ID NO: 879160 - RNA, 24 nt, Human
uucaugugcauauacauguacuuc

SEQ ID NO: 879161 - RNA, 21 nt, Human
aaaagaaauauaauacauuga

SEQ ID NO: 879162 - RNA, 20 nt, Human
aaaauuacacacugcuuucc

SEQ ID NO: 879163 - RNA, 20 nt, Human
aaacaagauugguggucuuu

SEQ ID NO: 879164 - RNA, 23 nt, Human
aaacuuccagcuucaaccaucug

SEQ ID NO: 879165 - RNA, 21 nt, Human
aacaguguauuuuuccucuga

SEQ ID NO: 879166 - RNA, 23 nt, Human
aaccacgcggcgcucccgcaaac

SEQ ID NO: 879167 - RNA, 23 nt, Human
aaccaucugauguugaaaucuaa

SEQ ID NO: 879168 - RNA, 18 nt, Human
aacugccuucucacucua

SEQ ID NO: 879169 - RNA, 19 nt, Human
acaaaccauguagauggac

SEQ ID NO: 879170 - RNA, 22 nt, Human
acaauucuucacugaugauacu

SEQ ID NO: 879171 - RNA, 21 nt, Human
agaaaaggcugcaguuuagua

SEQ ID NO: 879172 - RNA, 21 nt, Human
agaggccaggacaaagaggca

SEQ ID NO: 879173 - RNA, 18 nt, Human
agugaaauacaaagucca

SEQ ID NO: 879174 - RNA, 23 nt, Human
caaaagaaaacuagaggccagga

SEQ ID NO: 879175 - RNA, 19 nt, Human
caaaccauguagauggaca

SEQ ID NO: 879176 - RNA, 23 nt, Human
caccccuguauuucagccaaggg

SEQ ID NO: 879177 - RNA, 23 nt, Human
cagaaaaggcugcaguuuaguac

SEQ ID NO: 879178 - RNA, 24 nt, Human
caguguauuuuuccucugaaaauc

SEQ ID NO: 879179 - RNA, 22 nt, Human
cccuguauuucagccaagggca

SEQ ID NO: 879180 - RNA, 22 nt, Human
cccuguauuucagccaagggca

SEQ ID NO: 879181 - RNA, 22 nt, Human
cucccaaguccuacucgcaaac

SEQ ID NO: 879182 - RNA, 24 nt, Human
cucccaaguccuacucgcaaacaa

SEQ ID NO: 879183 - RNA, 22 nt, Human
cuggcgacagaaaaggcugcag

SEQ ID NO: 879184 - RNA, 18 nt, Human
cuuccagcuucaaccauc

SEQ ID NO: 879185 - RNA, 23 nt, Human
gacaaaccauguagauggacaaa

SEQ ID NO: 879186 - RNA, 27 nt, Human
gggaaaauuuauuauuuuuuuuuuccu

SEQ ID NO: 879187 - RNA, 21 nt, Human
gugaaauacaaaguccacucu

SEQ ID NO: 879188 - RNA, 23 nt, Human
uacaaaguccacucucauaaaaa

SEQ ID NO: 879189 - RNA, 18 nt, Human
uagaggccaggacaaaga

SEQ ID NO: 879190 - RNA, 23 nt, Human
uagauggacaaacaagauuggug

SEQ ID NO: 879191 - RNA, 25 nt, Human
uauuauauuuuucaaaagaaauaua

SEQ ID NO: 879192 - RNA, 21 nt, Human
uccaggcagaguaaacuaagg

SEQ ID NO: 879193 - RNA, 22 nt, Human
uccaggcagaguaaacuaagga

SEQ ID NO: 879194 - RNA, 21 nt, Human
ucccaaguccuacucgcaaac

SEQ ID NO: 879195 - RNA, 24 nt, Human
ucccaaguccuacucgcaaacaaa

SEQ ID NO: 879196 - RNA, 20 nt, Human
ugaaaucuaaagcaccucca

SEQ ID NO: 879197 - RNA, 21 nt, Human
ugacucccaaguccuacucgc

SEQ ID NO: 879198 - RNA, 27 nt, Human
uggacaaacaagauugguggucuuuaa

SEQ ID NO: 879199 - RNA, 20 nt, Human
uuauuuuuuuuuuccaauga

SEQ ID NO: 879200 - RNA, 19 nt, Human
uucaaaagaaauauaauac

SEQ ID NO: 879201 - RNA, 26 nt, Human
uuuuuuuuuuuuuuguuaaugaaggg

SEQ ID NO: 879202 - RNA, 19 nt, Human
uuuuuuuuuuuuuuuuguu

SEQ ID NO: 879203 - RNA, 22 nt, Human
aaaaagccugaauggagccaca

SEQ ID NO: 879204 - RNA, 21 nt, Human
aagggagaagacgggcaaaga

SEQ ID NO: 879205 - RNA, 22 nt, Human
aagggagaagacgggcaaagag

SEQ ID NO: 879206 - RNA, 23 nt, Human
acacagcagcagacaccgaugcu

SEQ ID NO: 879207 - RNA, 20 nt, Human
acagagaagagagggaagag

SEQ ID NO: 879208 - RNA, 19 nt, Human
agaggcugcugccugcuca

SEQ ID NO: 879209 - RNA, 20 nt, Human
agagggaagaggcacguguc

SEQ ID NO: 879210 - RNA, 25 nt, Human
aggagggugacagagaagagaggga

SEQ ID NO: 879211 - RNA, 23 nt, Human
agggagaagacgggcaaagagga

SEQ ID NO: 879212 - RNA, 22 nt, Human
agguggaaggaccgccagagga

SEQ ID NO: 879213 - RNA, 20 nt, Human
caaagacaaccccuuuggaa

SEQ ID NO: 879214 - RNA, 25 nt, Human
cacucucugggaaguucaugggcuu

SEQ ID NO: 879215 - RNA, 22 nt, Human
cagaauaauagggaacugcuga

SEQ ID NO: 879216 - RNA, 18 nt, Human
cagagaagagagggaaga

SEQ ID NO: 879217 - RNA, 22 nt, Human
cagcagacuuuagccacacagg

SEQ ID NO: 879218 - RNA, 22 nt, Human
caggggacaaugccuggccagg

SEQ ID NO: 879219 - RNA, 18 nt, Human
cagucacagcaaagaaag

SEQ ID NO: 879220 - RNA, 18 nt, Human
ccagccgccacagcuaca

SEQ ID NO: 879221 - RNA, 19 nt, Human
cccacacaagaccugggga

SEQ ID NO: 879222 - RNA, 21 nt, Human
ccccagccgccacagcuacag

SEQ ID NO: 879223 - RNA, 24 nt, Human
ccuccaggacccuagggaaauggg

SEQ ID NO: 879224 - RNA, 25 nt, Human
ccugcugcaggcaauuaugcaaagu

SEQ ID NO: 879225 - RNA, 21 nt, Human
ccuucgcuggcucccgccggg

SEQ ID NO: 879226 - RNA, 22 nt, Human
ccuuuggaaaaagcuuuuuccu

SEQ ID NO: 879227 - RNA, 23 nt, Human
cguuccacucucugggaaguuca

SEQ ID NO: 879228 - RNA, 20 nt, Human
cucaaacagggaagugaggc

SEQ ID NO: 879229 - RNA, 22 nt, Human
cuccaggacccuagggaaaugg

SEQ ID NO: 879230 - RNA, 26 nt, Human
cuccuugcccuucccugaauugaggg

SEQ ID NO: 879231 - RNA, 18 nt, Human
cuggaucccagaucugca

SEQ ID NO: 879232 - RNA, 24 nt, Human
cuuugugcguagguggcaaucuuc

SEQ ID NO: 879233 - RNA, 21 nt, Human
gaacagcaugguuaaaaacac

SEQ ID NO: 879234 - RNA, 23 nt, Human
gcgggugagcagguggagcccag

SEQ ID NO: 879235 - RNA, 19 nt, Human
ggaacagcuuaaaaucaga

SEQ ID NO: 879236 - RNA, 21 nt, Human
ggacauccggaggacagagga

SEQ ID NO: 879237 - RNA, 18 nt, Human
ggccucugacauggaaac

SEQ ID NO: 879238 - RNA, 21 nt, Human
gggaagaggcacgugucggca

SEQ ID NO: 879239 - RNA, 18 nt, Human
ggggagcggucgcccucg

SEQ ID NO: 879240 - RNA, 22 nt, Human
gggguugaugggaaccucaggg

SEQ ID NO: 879241 - RNA, 20 nt, Human
ggugacagagaagagaggga

SEQ ID NO: 879242 - RNA, 23 nt, Human
uaaguucaucacaggaacagcuu

SEQ ID NO: 879243 - RNA, 21 nt, Human
uagcagcaaucacaaacaaag

SEQ ID NO: 879244 - RNA, 22 nt, Human
ucagccaagggagaagacgggc

SEQ ID NO: 879245 - RNA, 21 nt, Human
ucccugaauugaggggauggc

SEQ ID NO: 879246 - RNA, 18 nt, Human
uccgugcugcagaccgga

SEQ ID NO: 879247 - RNA, 18 nt, Human
uccgugcugcagaccgga

SEQ ID NO: 879248 - RNA, 19 nt, Human
uccugaaugaggaaggcuc

SEQ ID NO: 879249 - RNA, 22 nt, Human
ucucugggaaguucaugggcuu

SEQ ID NO: 879250 - RNA, 23 nt, Human
ucugcaggcgggugagcaggugg

SEQ ID NO: 879251 - RNA, 21 nt, Human
ucugugccacccacacaagac

SEQ ID NO: 879252 - RNA, 23 nt, Human
ugaaaaagccugaauggagccac

SEQ ID NO: 879253 - RNA, 24 nt, Human
ugaauggagccacagagcagaggc

SEQ ID NO: 879254 - RNA, 19 nt, Human
ugagagcaggcuggauccc

SEQ ID NO: 879255 - RNA, 24 nt, Human
ugcacacgggcagcaggcacugca

SEQ ID NO: 879256 - RNA, 23 nt, Human
ugcguagguggcaaucuucaguu

SEQ ID NO: 879257 - RNA, 22 nt, Human
uggaacagcaugguuaaaaaca

SEQ ID NO: 879258 - RNA, 22 nt, Human
uggcuucaccuuaggcacagag

SEQ ID NO: 879259 - RNA, 19 nt, Human
uuccgugcugcagaccgga

SEQ ID NO: 879260 - RNA, 24 nt, Human
uuccugcugcaggcaauuaugcaa

SEQ ID NO: 879261 - RNA, 20 nt, Human
uucgcuggcucccgccgggg

SEQ ID NO: 879262 - RNA, 18 nt, Human
uuggugucuuccagcuac

SEQ ID NO: 879263 - RNA, 25 nt, Human
aaaaaacuguccauuucucaaaaac

SEQ ID NO: 879264 - RNA, 20 nt, Human
aaaaggagaguuaaacccau

SEQ ID NO: 879265 - RNA, 19 nt, Human
aaaaugguaggggauuuug

SEQ ID NO: 879266 - RNA, 18 nt, Human
aaacagguaccaguuuug

SEQ ID NO: 879267 - RNA, 23 nt, Human
aaacccauuuucagcaagagccc

SEQ ID NO: 879268 - RNA, 23 nt, Human
aaagagaugacuggaauaaccau

SEQ ID NO: 879269 - RNA, 19 nt, Human
aaagggcaaaaacaucugc

SEQ ID NO: 879270 - RNA, 24 nt, Human
aaaugacagaagcucauuaaaacc

SEQ ID NO: 879271 - RNA, 22 nt, Human
aacacccgcccagccccacccc

SEQ ID NO: 879272 - RNA, 23 nt, Human
aaccaagucccccaaaccuccug

SEQ ID NO: 879273 - RNA, 20 nt, Human
aacugaucaaaacucaaugg

SEQ ID NO: 879274 - RNA, 24 nt, Human
aagcagaaagggcaaaaacaucug

SEQ ID NO: 879275 - RNA, 22 nt, Human
aagcagaaagggcaaaagggac

SEQ ID NO: 879276 - RNA, 19 nt, Human
aagcagccccucacauuug

SEQ ID NO: 879277 - RNA, 20 nt, Human
aagcagcuccagagccugcc

SEQ ID NO: 879278 - RNA, 20 nt, Human
aaguccucuuuucccaccuc

SEQ ID NO: 879279 - RNA, 20 nt, Human
acaacaaaagaugcuuugga

SEQ ID NO: 879280 - RNA, 22 nt, Human
acagagaaaaaccugagauacg

SEQ ID NO: 879281 - RNA, 20 nt, Human
acaguuccagaaggaagggg

SEQ ID NO: 879282 - RNA, 22 nt, Human
accauaggaaacaugaagucac

SEQ ID NO: 879283 - RNA, 20 nt, Human
accccaccuaaagacaucca

SEQ ID NO: 879284 - RNA, 20 nt, Human
acccgcccagccccaccccc

SEQ ID NO: 879285 - RNA, 21 nt, Human
acuaacucaaaucguugacca

SEQ ID NO: 879286 - RNA, 24 nt, Human
acuggguugauccaccuguugcuu

SEQ ID NO: 879287 - RNA, 20 nt, Human
acuggguuugcucuaaggua

SEQ ID NO: 879288 - RNA, 18 nt, Human
acuugcuuuuuuaagaac

SEQ ID NO: 879289 - RNA, 22 nt, Human
agaagcucauuaaaaccaaguc

SEQ ID NO: 879290 - RNA, 21 nt, Human
agaaggaagggggaccauggc

SEQ ID NO: 879291 - RNA, 23 nt, Human
agagcccuccaagugaaugucuc

SEQ ID NO: 879292 - RNA, 21 nt, Human
agccaccaccccaccuaaaga

SEQ ID NO: 879293 - RNA, 23 nt, Human
agcugauaaaacucaagccagga

SEQ ID NO: 879294 - RNA, 21 nt, Human
aggaaacaugaagucacaucc

SEQ ID NO: 879295 - RNA, 18 nt, Human
agggucuaccuaccugac

SEQ ID NO: 879296 - RNA, 27 nt, Human
aguggucaaagccccgacuuuccuguc

SEQ ID NO: 879297 - RNA, 21 nt, Human
auaaccaagucggucuguguu

SEQ ID NO: 879298 - RNA, 20 nt, Human
auccuggucaaaaaacuguc

SEQ ID NO: 879299 - RNA, 21 nt, Human
auccuggucaaaaaacugucc

SEQ ID NO: 879300 - RNA, 25 nt, Human
caaauaaauucacauuuggcuugaa

SEQ ID NO: 879301 - RNA, 23 nt, Human
caacagcuuuacacuggacugaa

SEQ ID NO: 879302 - RNA, 21 nt, Human
caacuggguugauccaccugu

SEQ ID NO: 879303 - RNA, 22 nt, Human
caagugaaugucucuuucucuu

SEQ ID NO: 879304 - RNA, 19 nt, Human
cacaguuccagaaggaagg

SEQ ID NO: 879305 - RNA, 25 nt, Human
caccauaggaaacaugaagucaacu

SEQ ID NO: 879306 - RNA, 19 nt, Human
cacccgcccagccccaccc

SEQ ID NO: 879307 - RNA, 23 nt, Human
cacuuuacaccccaucauagcac

SEQ ID NO: 879308 - RNA, 19 nt, Human
cagagugaugcucgugucc

SEQ ID NO: 879309 - RNA, 19 nt, Human
cagcugaauccuagacagu

SEQ ID NO: 879310 - RNA, 24 nt, Human
cagcugccaggaccgauuccauac

SEQ ID NO: 879311 - RNA, 21 nt, Human
cagcuuuacacuggacugaaa

SEQ ID NO: 879312 - RNA, 19 nt, Human
caguuccagaaggaagggg

SEQ ID NO: 879313 - RNA, 20 nt, Human
caguuccagaaggaaggggg

SEQ ID NO: 879314 - RNA, 19 nt, Human
cauagcacauuauuugugc

SEQ ID NO: 879315 - RNA, 23 nt, Human
cauuucucaaaaacagagaaaaa

SEQ ID NO: 879316 - RNA, 24 nt, Human
cauuuugauuugcuuuuuccacug

SEQ ID NO: 879317 - RNA, 24 nt, Human
ccaccaccccaccuaaagacaucc

SEQ ID NO: 879318 - RNA, 19 nt, Human
ccagccccacccccaaaaa

SEQ ID NO: 879319 - RNA, 21 nt, Human
ccauagcuccauuuuccaaaa

SEQ ID NO: 879320 - RNA, 19 nt, Human
cccaccuccuucuuuaauu

SEQ ID NO: 879321 - RNA, 22 nt, Human
cccagccccacccccaaaaagc

SEQ ID NO: 879322 - RNA, 19 nt, Human
cccccaaaccuccugaaac

SEQ ID NO: 879323 - RNA, 19 nt, Human
ccccucgggccccccucgc

SEQ ID NO: 879324 - RNA, 24 nt, Human
cccgcccagccccacccccaaaaa

SEQ ID NO: 879325 - RNA, 23 nt, Human
cccuccaagugaaugucucuuuc

SEQ ID NO: 879326 - RNA, 18 nt, Human
cccucgggccccccucgc

SEQ ID NO: 879327 - RNA, 20 nt, Human
ccgcccagccccacccccaa

SEQ ID NO: 879328 - RNA, 19 nt, Human
ccuaccugacccccaagcu

SEQ ID NO: 879329 - RNA, 20 nt, Human
ccucacuaaagccucucuca

SEQ ID NO: 879330 - RNA, 24 nt, Human
ccucagcaauuuguaccuuucuua

SEQ ID NO: 879331 - RNA, 19 nt, Human
ccuccaacaccaaagacac

SEQ ID NO: 879332 - RNA, 20 nt, Human
ccucuuuucccaccuccuuc

SEQ ID NO: 879333 - RNA, 21 nt, Human
ccucuuuucccaccuccuucu

SEQ ID NO: 879334 - RNA, 18 nt, Human
ccugaaacaucguuagca

SEQ ID NO: 879335 - RNA, 25 nt, Human
ccugacccccaagcuggcucagucu

SEQ ID NO: 879336 - RNA, 28 nt, Human
ccuuugcucccgcgcuccaacagcuuua

SEQ ID NO: 879337 - RNA, 25 nt, Human
cgccacggcagucucgauuccaaga

SEQ ID NO: 879338 - RNA, 18 nt, Human
cgcccagccccaccccca

SEQ ID NO: 879339 - RNA, 20 nt, Human
cggccagcguuuccaaaaac

SEQ ID NO: 879340 - RNA, 18 nt, Human
cggcugcgcucccgcucg

SEQ ID NO: 879341 - RNA, 21 nt, Human
cguuagccucccaaccuuagc

SEQ ID NO: 879342 - RNA, 20 nt, Human
cucaaaaacagagaaaaacc

SEQ ID NO: 879343 - RNA, 19 nt, Human
cucacuaaagccucucuca

SEQ ID NO: 879344 - RNA, 23 nt, Human
cucacuaaagccucucucagccc

SEQ ID NO: 879345 - RNA, 21 nt, Human
cucauuaaaaccaaguccccc

SEQ ID NO: 879346 - RNA, 21 nt, Human
cuccuccucuucuuuucagua

SEQ ID NO: 879347 - RNA, 22 nt, Human
cuccucuucuuuucaguauauu

SEQ ID NO: 879348 - RNA, 18 nt, Human
cucgggccccccucgccu

SEQ ID NO: 879349 - RNA, 24 nt, Human
cucgggccccccucgccucccgga

SEQ ID NO: 879350 - RNA, 21 nt, Human
cugccaggaccgauuccauac

SEQ ID NO: 879351 - RNA, 20 nt, Human
cugccuccgaggccaccccu

SEQ ID NO: 879352 - RNA, 23 nt, Human
cugguggugacuggcaaaaggag

SEQ ID NO: 879353 - RNA, 22 nt, Human
gaaaaaaaaauugucuauagaa

SEQ ID NO: 879354 - RNA, 21 nt, Human
gaauaaccauuccacaacaaa

SEQ ID NO: 879355 - RNA, 22 nt, Human
gaauaaccauuccacaacaaaa

SEQ ID NO: 879356 - RNA, 22 nt, Human
gacucguuagccucccaaccuu

SEQ ID NO: 879357 - RNA, 19 nt, Human
gcaaaggacuccguccaca

SEQ ID NO: 879358 - RNA, 18 nt, Human
gcagaaagggcaaaaaca

SEQ ID NO: 879359 - RNA, 20 nt, Human
gcagagugaugcucgugucc

SEQ ID NO: 879360 - RNA, 21 nt, Human
gccacuaaggaaacagguuuc

SEQ ID NO: 879361 - RNA, 21 nt, Human
gcucaucauccccauaaccaa

SEQ ID NO: 879362 - RNA, 18 nt, Human
gcuccaacagcuuuacac

SEQ ID NO: 879363 - RNA, 18 nt, Human
gcucucgcuccauuuuga

SEQ ID NO: 879364 - RNA, 21 nt, Human
ggcggcugcgcucccgcucgc

SEQ ID NO: 879365 - RNA, 22 nt, Human
ggcggcugcgcucccgcucgcg

SEQ ID NO: 879366 - RNA, 21 nt, Human
gggaccauggccaagagaagc

SEQ ID NO: 879367 - RNA, 23 nt, Human
gggggaccauggccaagagaagc

SEQ ID NO: 879368 - RNA, 22 nt, Human
ggucugaaaagugugacuagcu

SEQ ID NO: 879369 - RNA, 22 nt, Human
ggugaacuguuacacauuuggu

SEQ ID NO: 879370 - RNA, 20 nt, Human
ggugguucagcugaauccua

SEQ ID NO: 879371 - RNA, 18 nt, Human
guaugaggucaggcuggu

SEQ ID NO: 879372 - RNA, 20 nt, Human
guccucuuuucccaccuccu

SEQ ID NO: 879373 - RNA, 26 nt, Human
gucucgauuccaagaacugauuaucu

SEQ ID NO: 879374 - RNA, 22 nt, Human
gucucuuucucuuucccguuga

SEQ ID NO: 879375 - RNA, 20 nt, Human
gugauguugccagguuccug

SEQ ID NO: 879376 - RNA, 20 nt, Human
uaaaaccaagucccccaaac

SEQ ID NO: 879377 - RNA, 24 nt, Human
uaaaaccaagucccccaaaccucc

SEQ ID NO: 879378 - RNA, 23 nt, Human
uaaaaucaccaucuguaucaccc

SEQ ID NO: 879379 - RNA, 18 nt, Human
uaaacccauuuucagcaa

SEQ ID NO: 879380 - RNA, 22 nt, Human
uaaagacauccaagcagcucca

SEQ ID NO: 879381 - RNA, 22 nt, Human
uaaguccucuuuucccaccucc

SEQ ID NO: 879382 - RNA, 18 nt, Human
uacauauauauauuucag

SEQ ID NO: 879383 - RNA, 23 nt, Human
uacauauauauauuucagauuua

SEQ ID NO: 879384 - RNA, 19 nt, Human
uaccuaccugacccccaag

SEQ ID NO: 879385 - RNA, 20 nt, Human
uagaagucaccauaggaaac

SEQ ID NO: 879386 - RNA, 22 nt, Human
uagaagucaccauaggaaacau

SEQ ID NO: 879387 - RNA, 19 nt, Human
uagaagucuaguuuugcuc

SEQ ID NO: 879388 - RNA, 22 nt, Human
uagugaaccagcacuaaaggcc

SEQ ID NO: 879389 - RNA, 20 nt, Human
uauauguauguacauauaua

SEQ ID NO: 879390 - RNA, 22 nt, Human
uauauguauguacauauauaua

SEQ ID NO: 879391 - RNA, 23 nt, Human
uaugguaguggucaaagccccga

SEQ ID NO: 879392 - RNA, 22 nt, Human
uauguacauauauauauuucag

SEQ ID NO: 879393 - RNA, 21 nt, Human
uauuaaacauuuacagucuuu

SEQ ID NO: 879394 - RNA, 21 nt, Human
ucaaaagaacacuauauucau

SEQ ID NO: 879395 - RNA, 21 nt, Human
ucaaagccccgacuuuccugu

SEQ ID NO: 879396 - RNA, 25 nt, Human
uccacaacaaaagaugcuuuggagc

SEQ ID NO: 879397 - RNA, 23 nt, Human
ucccccaaaccuccugaaacauc

SEQ ID NO: 879398 - RNA, 20 nt, Human
ucccucagagggaaacgaaa

SEQ ID NO: 879399 - RNA, 22 nt, Human
ucccucagagggaaacgaaagu

SEQ ID NO: 879400 - RNA, 25 nt, Human
uccggacaaagacuaauauuugaga

SEQ ID NO: 879401 - RNA, 23 nt, Human
uccuagacaguuucccuucucuu

SEQ ID NO: 879402 - RNA, 21 nt, Human
ucgccacggcagucucgauuc

SEQ ID NO: 879403 - RNA, 23 nt, Human
ucuaagguagaccuuggcaaggc

SEQ ID NO: 879404 - RNA, 23 nt, Human
ucucucagcccuacuaguaaaug

SEQ ID NO: 879405 - RNA, 21 nt, Human
ucugacacuagugaaccagca

SEQ ID NO: 879406 - RNA, 18 nt, Human
ucugcuaccaacccaaau

SEQ ID NO: 879407 - RNA, 18 nt, Human
ugaaacuugagaaugucu

SEQ ID NO: 879408 - RNA, 23 nt, Human
ugaagcagaaagggcaaaaacca

SEQ ID NO: 879409 - RNA, 21 nt, Human
ugacaacacccgcccagcccc

SEQ ID NO: 879410 - RNA, 21 nt, Human
ugacagaagcucauuaaaacc

SEQ ID NO: 879411 - RNA, 24 nt, Human
ugagaaugucugauuaaagauuuc

SEQ ID NO: 879412 - RNA, 20 nt, Human
ugauucauaaagagaugacu

SEQ ID NO: 879413 - RNA, 22 nt, Human
ugcucuuuaaaaucaccaucug

SEQ ID NO: 879414 - RNA, 24 nt, Human
uggaaggguccggacaaagacuaa

SEQ ID NO: 879415 - RNA, 23 nt, Human
uggaauaaccauuccacaacaaa

SEQ ID NO: 879416 - RNA, 23 nt, Human
uggauaggaucauuucucuugga

SEQ ID NO: 879417 - RNA, 22 nt, Human
ugucacggcgucuccccucggg

SEQ ID NO: 879418 - RNA, 23 nt, Human
uguccuccaacaccaaagacacu

SEQ ID NO: 879419 - RNA, 22 nt, Human
uguuacacauuuggugugugug

SEQ ID NO: 879420 - RNA, 21 nt, Human
uuaaaggauugacaaucccau

SEQ ID NO: 879421 - RNA, 21 nt, Human
uucauacauuaacauacaugg

SEQ ID NO: 879422 - RNA, 19 nt, Human
uugaaaccaaguucaucuu

SEQ ID NO: 879423 - RNA, 18 nt, Human
uugaccagcacuuuccca

SEQ ID NO: 879424 - RNA, 21 nt, Human
uugcacucuauucacaacuga

SEQ ID NO: 879425 - RNA, 18 nt, Human
uugcgaggcgccgccgcg

SEQ ID NO: 879426 - RNA, 22 nt, Human
uuguagguugaggacugaggac

SEQ ID NO: 879427 - RNA, 22 nt, Human
uuuccuauaaaauucugccaua

SEQ ID NO: 879428 - RNA, 20 nt, Human
uuugagaucucuuaguagca

SEQ ID NO: 879429 - RNA, 18 nt, Human
aaaacaaacacaaaaacc

SEQ ID NO: 879430 - RNA, 19 nt, Human
aaaaugccucaagugagga

SEQ ID NO: 879431 - RNA, 18 nt, Human
aaacaaacacaaaaaccc

SEQ ID NO: 879432 - RNA, 19 nt, Human
aaacaaacacaaaaacccg

SEQ ID NO: 879433 - RNA, 23 nt, Human
aaacaaacacaaaaacccgacaa

SEQ ID NO: 879434 - RNA, 23 nt, Human
aaacaaacacaaaaacccgacaa

SEQ ID NO: 879435 - RNA, 24 nt, Human
aaacaagagaccaaaaccacagaa

SEQ ID NO: 879436 - RNA, 18 nt, Human
aaacacaaaaacccgaca

SEQ ID NO: 879437 - RNA, 26 nt, Human
aaacacaaaaacccgacaacaaaaug

SEQ ID NO: 879438 - RNA, 18 nt, Human
aacacaaaaacccgacaa

SEQ ID NO: 879439 - RNA, 18 nt, Human
aagagaccaaaaccacag

SEQ ID NO: 879440 - RNA, 22 nt, Human
aagagaccaaaaccacagaaca

SEQ ID NO: 879441 - RNA, 23 nt, Human
aagcaguagauggacaaaccagg

SEQ ID NO: 879442 - RNA, 23 nt, Human
aagugccuguacuggaaaggcca

SEQ ID NO: 879443 - RNA, 22 nt, Human
acaaaaacaaacacaaaaaccc

SEQ ID NO: 879444 - RNA, 24 nt, Human
acaaaaacaaacacaaaaacccga

SEQ ID NO: 879445 - RNA, 22 nt, Human
acaaaaacccgacaacaaaaug

SEQ ID NO: 879446 - RNA, 22 nt, Human
acacacccacacacucacacca

SEQ ID NO: 879447 - RNA, 23 nt, Human
acaccugauucugguuacccagu

SEQ ID NO: 879448 - RNA, 23 nt, Human
acagaugacgcaacacaccuaca

SEQ ID NO: 879449 - RNA, 24 nt, Human
acagggaaaacaacacacuccuca

SEQ ID NO: 879450 - RNA, 23 nt, Human
acccacacacucacaccauguca

SEQ ID NO: 879451 - RNA, 19 nt, Human
acccguucgguccccgccu

SEQ ID NO: 879452 - RNA, 23 nt, Human
acgcaacacaccuacacuaacug

SEQ ID NO: 879453 - RNA, 26 nt, Human
acugcaaacccauuacuccacuacaa

SEQ ID NO: 879454 - RNA, 19 nt, Human
agaacaagugcacguggua

SEQ ID NO: 879455 - RNA, 20 nt, Human
agagcaacaaaacacaaagg

SEQ ID NO: 879456 - RNA, 18 nt, Human
aggacggcgaggccaggc

SEQ ID NO: 879457 - RNA, 20 nt, Human
caaaaacaaacacaaaaacc

SEQ ID NO: 879458 - RNA, 22 nt, Human
caaaaacaaacacaaaaacccg

SEQ ID NO: 879459 - RNA, 21 nt, Human
caaaauacagagaccucugca

SEQ ID NO: 879460 - RNA, 22 nt, Human
caaaauacagagaccucugcaa

SEQ ID NO: 879461 - RNA, 21 nt, Human
caaacacaaaaacccgacaac

SEQ ID NO: 879462 - RNA, 22 nt, Human
caaagcaguagauggacaaacc

SEQ ID NO: 879463 - RNA, 21 nt, Human
caaauacccacaaaaacaaac

SEQ ID NO: 879464 - RNA, 23 nt, Human
caacagggaaaacaacacacucc

SEQ ID NO: 879465 - RNA, 23 nt, Human
caagagaccaaaaccacagaaca

SEQ ID NO: 879466 - RNA, 19 nt, Human
caaggaauucuuccaacaa

SEQ ID NO: 879467 - RNA, 21 nt, Human
cacacccacacacucacacca

SEQ ID NO: 879468 - RNA, 19 nt, Human
cacaccuacacuaacuguc

SEQ ID NO: 879469 - RNA, 22 nt, Human
cacaggcacugccacaccacca

SEQ ID NO: 879470 - RNA, 21 nt, Human
caccaugucagcccuugggag

SEQ ID NO: 879471 - RNA, 22 nt, Human
cacccaucacuccuauucuugg

SEQ ID NO: 879472 - RNA, 18 nt, Human
cacucacaccaugucagc

SEQ ID NO: 879473 - RNA, 22 nt, Human
cacugccacaccaccacagggg

SEQ ID NO: 879474 - RNA, 22 nt, Human
cagaaagugccuguacuggaaa

SEQ ID NO: 879475 - RNA, 19 nt, Human
cagagcaacaaaacacaaa

SEQ ID NO: 879476 - RNA, 23 nt, Human
cagcagaccaguucacacgccac

SEQ ID NO: 879477 - RNA, 22 nt, Human
cagcugcaaaauacagagaccu

SEQ ID NO: 879478 - RNA, 20 nt, Human
cagcuuaggucccuucaccc

SEQ ID NO: 879479 - RNA, 20 nt, Human
caggcgaggggaggggaagg

SEQ ID NO: 879480 - RNA, 19 nt, Human
cccacaaaaacaaacacaa

SEQ ID NO: 879481 - RNA, 24 nt, Human
cccacacagcaaaggccccggaac

SEQ ID NO: 879482 - RNA, 21 nt, Human
ccgacaacaaaaugccucaag

SEQ ID NO: 879483 - RNA, 20 nt, Human
ccuucacccaucacuccuau

SEQ ID NO: 879484 - RNA, 22 nt, Human
cgcaacacaccuacacuaacug

SEQ ID NO: 879485 - RNA, 19 nt, Human
cucagggaaaggugagggg

SEQ ID NO: 879486 - RNA, 19 nt, Human
cuggaaaggcuagaucgua

SEQ ID NO: 879487 - RNA, 22 nt, Human
cuuaucacugcaaacccauuac

SEQ ID NO: 879488 - RNA, 19 nt, Human
gaacagauauaaaaacaca

SEQ ID NO: 879489 - RNA, 22 nt, Human
gaacagauauaaaaacacagau

SEQ ID NO: 879490 - RNA, 19 nt, Human
gagaacacaggcacugcca

SEQ ID NO: 879491 - RNA, 27 nt, Human
gagaacacaggcacugccacaccacca

SEQ ID NO: 879492 - RNA, 19 nt, Human
gagggguugagaagacagg

SEQ ID NO: 879493 - RNA, 20 nt, Human
gagggguugagaagacaggc

SEQ ID NO: 879494 - RNA, 19 nt, Human
gccaacuuccaacucugca

SEQ ID NO: 879495 - RNA, 21 nt, Human
gccacaccaccacaggggaca

SEQ ID NO: 879496 - RNA, 22 nt, Human
gccccggaacuuccgggaucac

SEQ ID NO: 879497 - RNA, 18 nt, Human
gucagcccuugggagcca

SEQ ID NO: 879498 - RNA, 18 nt, Human
gugcaauuaaacaagaga

SEQ ID NO: 879499 - RNA, 20 nt, Human
uaaaaaaucucaacacauuc

SEQ ID NO: 879500 - RNA, 18 nt, Human
uaaaaacacagaugugca

SEQ ID NO: 879501 - RNA, 23 nt, Human
uaaauucguguuacaaaaaacua

SEQ ID NO: 879502 - RNA, 20 nt, Human
uaaccucuauggcuaacccc

SEQ ID NO: 879503 - RNA, 27 nt, Human
uaagaauacugcaucuauugucguaga

SEQ ID NO: 879504 - RNA, 19 nt, Human
uacccacaaaaacaaacac

SEQ ID NO: 879505 - RNA, 26 nt, Human
uacccacaaaaacaaacacaaaaacc

SEQ ID NO: 879506 - RNA, 21 nt, Human
uacuguuuaucccacacagca

SEQ ID NO: 879507 - RNA, 19 nt, Human
uagauggacaaaccaggag

SEQ ID NO: 879508 - RNA, 20 nt, Human
uagauggacaaaccaggagc

SEQ ID NO: 879509 - RNA, 21 nt, Human
uaggacagcaccuggaguuga

SEQ ID NO: 879510 - RNA, 18 nt, Human
uaggagagaacacaggca

SEQ ID NO: 879511 - RNA, 19 nt, Human
uaucacacacccacacacu

SEQ ID NO: 879512 - RNA, 26 nt, Human
uaucacacacccacacacucacacca

SEQ ID NO: 879513 - RNA, 22 nt, Human
uauccaagacccaguuuguguu

SEQ ID NO: 879514 - RNA, 21 nt, Human
uauucuuggaccccaaagcag

SEQ ID NO: 879515 - RNA, 24 nt, Human
ucaccagaaaccucaaggauccac

SEQ ID NO: 879516 - RNA, 27 nt, Human
ucaccagaaaccucaaggauccacauc

SEQ ID NO: 879517 - RNA, 19 nt, Human
ucagaaagugccuguacug

SEQ ID NO: 879518 - RNA, 18 nt, Human
ucagggguggaaugaggc

SEQ ID NO: 879519 - RNA, 24 nt, Human
ucucaacacauucacaccugauuc

SEQ ID NO: 879520 - RNA, 22 nt, Human
ugaaaaguccauaaaugcaauc

SEQ ID NO: 879521 - RNA, 22 nt, Human
ugaggcaaauacccacaaaaac

SEQ ID NO: 879522 - RNA, 23 nt, Human
ugcaaaacaguaaaaaaucucaa

SEQ ID NO: 879523 - RNA, 23 nt, Human
ugccacacaaggcuuaaaccacu

SEQ ID NO: 879524 - RNA, 21 nt, Human
ugcuuugcccuuuaagaucua

SEQ ID NO: 879525 - RNA, 20 nt, Human
ugggagccaacuuccaacuc

SEQ ID NO: 879526 - RNA, 22 nt, Human
ugggauaaccagguaguuuuaa

SEQ ID NO: 879527 - RNA, 20 nt, Human
ugggugggauccaaggaauc

SEQ ID NO: 879528 - RNA, 19 nt, Human
ugguugaaaacagaugacg

SEQ ID NO: 879529 - RNA, 20 nt, Human
uguguauccaagacccaguu

SEQ ID NO: 879530 - RNA, 22 nt, Human
uuaagauuuauuuuuguaacuu

SEQ ID NO: 879531 - RNA, 23 nt, Human
uucuuccaacaacuuaacuuuag

SEQ ID NO: 879532 - RNA, 23 nt, Human
uuucucaauuuuccuaucaugca

SEQ ID NO: 879533 - RNA, 23 nt, Human
uuuuuuuuuuuuuuaauuguuuu

SEQ ID NO: 879534 - RNA, 23 nt, Human
uuuuuuuuuuuuuuuuuuaauug

SEQ ID NO: 879535 - RNA, 18 nt, Human
aacaagauugcuacccug

SEQ ID NO: 879536 - RNA, 22 nt, Human
aacuugaaaaaaaugaccaccc

SEQ ID NO: 879537 - RNA, 20 nt, Human
aagaagaucuauacuuccac

SEQ ID NO: 879538 - RNA, 21 nt, Human
aagaugcagggcaaccaucua

SEQ ID NO: 879539 - RNA, 22 nt, Human
aaguuuacuauuucuggggaag

SEQ ID NO: 879540 - RNA, 23 nt, Human
aauuaaaaucaaaaugacuacaa

SEQ ID NO: 879541 - RNA, 24 nt, Human
aauuacccugaugggcaagaaccc

SEQ ID NO: 879542 - RNA, 19 nt, Human
aauuucaaaucaaagccag

SEQ ID NO: 879543 - RNA, 19 nt, Human
acaggaaaugugcccagag

SEQ ID NO: 879544 - RNA, 20 nt, Human
accgucgucgugccgccgcc

SEQ ID NO: 879545 - RNA, 22 nt, Human
accuccugcuccuucaagagcc

SEQ ID NO: 879546 - RNA, 21 nt, Human
aggaccacugcugggucagaa

SEQ ID NO: 879547 - RNA, 20 nt, Human
aggagcagaauucaagaaca

SEQ ID NO: 879548 - RNA, 20 nt, Human
auaauagaucacuugaguac

SEQ ID NO: 879549 - RNA, 19 nt, Human
caaaauacaguuaucugau

SEQ ID NO: 879550 - RNA, 20 nt, Human
caaaaugacuacaagacuug

SEQ ID NO: 879551 - RNA, 23 nt, Human
caaauccaagucacacgucaccu

SEQ ID NO: 879552 - RNA, 19 nt, Human
cacacgucaccuuggcugc

SEQ ID NO: 879553 - RNA, 18 nt, Human
cacauguggcaacaagau

SEQ ID NO: 879554 - RNA, 20 nt, Human
cagcuaauaccuuaaguaaa

SEQ ID NO: 879555 - RNA, 20 nt, Human
caggaaaugugcccagagcc

SEQ ID NO: 879556 - RNA, 21 nt, Human
ccacacauguaagugcacgua

SEQ ID NO: 879557 - RNA, 19 nt, Human
cccaacaccaaccagacga

SEQ ID NO: 879558 - RNA, 19 nt, Human
cccacaggugagagcagag

SEQ ID NO: 879559 - RNA, 22 nt, Human
ccccaacaccaaccagacgaca

SEQ ID NO: 879560 - RNA, 19 nt, Human
cccugaugggcaagaaccc

SEQ ID NO: 879561 - RNA, 26 nt, Human
ccuccugcuccuucaagagccucccu

SEQ ID NO: 879562 - RNA, 20 nt, Human
ccucucgcagccgcugccgc

SEQ ID NO: 879563 - RNA, 24 nt, Human
cucaaauccaagucacacgucacc

SEQ ID NO: 879564 - RNA, 23 nt, Human
cuggaggccccaacaccaaccag

SEQ ID NO: 879565 - RNA, 21 nt, Human
gaacaggaaaugugcccagag

SEQ ID NO: 879566 - RNA, 20 nt, Human
gagaacuugaaaaaaaugac

SEQ ID NO: 879567 - RNA, 20 nt, Human
gagcccaagaugcagggcaa

SEQ ID NO: 879568 - RNA, 23 nt, Human
gagggaccgucgucgugccgccg

SEQ ID NO: 879569 - RNA, 23 nt, Human
gccccaacaccaaccagacgaca

SEQ ID NO: 879570 - RNA, 19 nt, Human
gcccuggcuggaggcccca

SEQ ID NO: 879571 - RNA, 22 nt, Human
gcugcaguacagggaagcuccg

SEQ ID NO: 879572 - RNA, 22 nt, Human
ggaaaugugcccagagccuagg

SEQ ID NO: 879573 - RNA, 18 nt, Human
ggagcagaauucaagaac

SEQ ID NO: 879574 - RNA, 22 nt, Human
gggaaaguuucggccgauggag

SEQ ID NO: 879575 - RNA, 19 nt, Human
uaaauuccagcuuggaaca

SEQ ID NO: 879576 - RNA, 22 nt, Human
uaaggcuaagcccaacuccacu

SEQ ID NO: 879577 - RNA, 18 nt, Human
ucaggagcagaauucaag

SEQ ID NO: 879578 - RNA, 21 nt, Human
uccgcacacccuggcuuggga

SEQ ID NO: 879579 - RNA, 24 nt, Human
ucuggggaagaaaagaucaaaggu

SEQ ID NO: 879580 - RNA, 18 nt, Human
ugaaugagacuaaggcua

SEQ ID NO: 879581 - RNA, 21 nt, Human
ugagagcagaggcuugguucc

SEQ ID NO: 879582 - RNA, 18 nt, Human
ugccaugaaauuuuuaca

SEQ ID NO: 879583 - RNA, 19 nt, Human
uggagcccaagaugcaggg

SEQ ID NO: 879584 - RNA, 20 nt, Human
uggagcccaagaugcagggc

SEQ ID NO: 879585 - RNA, 20 nt, Human
ugggaaaguuucggccgaug

SEQ ID NO: 879586 - RNA, 24 nt, Human
ugggacacuugagagaacuugaaa

SEQ ID NO: 879587 - RNA, 23 nt, Human
uggggaagaaaagaucaaaggua

SEQ ID NO: 879588 - RNA, 18 nt, Human
uguuaacagcuaugcugc

SEQ ID NO: 879589 - RNA, 25 nt, Human
uuaaacacaaaaauagauuagauaa

SEQ ID NO: 879590 - RNA, 22 nt, Human
uugaaugccccauuuguucacc

SEQ ID NO: 879591 - RNA, 25 nt, Human
uuuaaacacaaaaauagauuagaua

SEQ ID NO: 879592 - RNA, 19 nt, Human
uuuguucacccucuucagg

SEQ ID NO: 879593 - RNA, 23 nt, Human
aaaaaacgaacuuuaaagccagg

SEQ ID NO: 879594 - RNA, 19 nt, Human
aaaaugccccaaaugagga

SEQ ID NO: 879595 - RNA, 21 nt, Human
aaagguuuuucaggaagugcc

SEQ ID NO: 879596 - RNA, 24 nt, Human
aaagugcugggauuacaggcguga

SEQ ID NO: 879597 - RNA, 18 nt, Human
aacaguagaaaucugaac

SEQ ID NO: 879598 - RNA, 21 nt, Human
aagacggagguugcagugagc

SEQ ID NO: 879599 - RNA, 19 nt, Human
aagugcugggauuacaggc

SEQ ID NO: 879600 - RNA, 19 nt, Human
aagugcugggauuacaggc

SEQ ID NO: 879601 - RNA, 26 nt, Human
aagugcugggauuacaggcgugagcc

SEQ ID NO: 879602 - RNA, 20 nt, Human
aauggcuugaacccggaaga

SEQ ID NO: 879603 - RNA, 26 nt, Human
acagagugggacucugucucaauaaa

SEQ ID NO: 879604 - RNA, 20 nt, Human
acaggguuucgccauucaca

SEQ ID NO: 879605 - RNA, 25 nt, Human
accaaagccaagaauacugcaucua

SEQ ID NO: 879606 - RNA, 21 nt, Human
accaauauggugaaaccccgu

SEQ ID NO: 879607 - RNA, 19 nt, Human
accacugcacuccagccug

SEQ ID NO: 879608 - RNA, 22 nt, Human
acccaacaacaaaaugccccaa

SEQ ID NO: 879609 - RNA, 18 nt, Human
accccguuucuacuaaaa

SEQ ID NO: 879610 - RNA, 24 nt, Human
accugaggucaggaguucgagacc

SEQ ID NO: 879611 - RNA, 23 nt, Human
acgcuuggcucugguuacccagu

SEQ ID NO: 879612 - RNA, 21 nt, Human
acuaacuuuaaggccaggcac

SEQ ID NO: 879613 - RNA, 24 nt, Human
acuccagccugggugacagagugg

SEQ ID NO: 879614 - RNA, 24 nt, Human
acugcacuccagccugggugacag

SEQ ID NO: 879615 - RNA, 26 nt, Human
acugcacuccagccugggugacagag

SEQ ID NO: 879616 - RNA, 26 nt, Human
agaaggcuacuggccagcuuaggucc

SEQ ID NO: 879617 - RNA, 18 nt, Human
agacaggagaauggcuug

SEQ ID NO: 879618 - RNA, 24 nt, Human
agacaggagaauggcuugaacccg

SEQ ID NO: 879619 - RNA, 25 nt, Human
agacaggcccuggguacauauucuu

SEQ ID NO: 879620 - RNA, 24 nt, Human
agacggagguugcagugagccaag

SEQ ID NO: 879621 - RNA, 18 nt, Human
agccuccagaguagcugg

SEQ ID NO: 879622 - RNA, 24 nt, Human
agccugaccaauauggugaaaccc

SEQ ID NO: 879623 - RNA, 24 nt, Human
agccugggugacagagugggacuc

SEQ ID NO: 879624 - RNA, 24 nt, Human
aggacaggcgaggggaggggaagg

SEQ ID NO: 879625 - RNA, 22 nt, Human
aggcacaguggcuuaugccugu

SEQ ID NO: 879626 - RNA, 22 nt, Human
aggccaggcacaguggcuuaug

SEQ ID NO: 879627 - RNA, 24 nt, Human
aggcgcgguggcucaugccuguua

SEQ ID NO: 879628 - RNA, 24 nt, Human
aggcugagacaggagaauggcuug

SEQ ID NO: 879629 - RNA, 18 nt, Human
agggccaaaggacccgga

SEQ ID NO: 879630 - RNA, 20 nt, Human
agggccaaaggacccggaac

SEQ ID NO: 879631 - RNA, 20 nt, Human
aggucaacuuccaacucugc

SEQ ID NO: 879632 - RNA, 21 nt, Human
agguccaaaagccccggaacu

SEQ ID NO: 879633 - RNA, 22 nt, Human
agguggaucaccugaggucagg

SEQ ID NO: 879634 - RNA, 22 nt, Human
aguagagacaggguuucgccau

SEQ ID NO: 879635 - RNA, 18 nt, Human
aguagcugggacuacagg

SEQ ID NO: 879636 - RNA, 19 nt, Human
aguagcugggacuacaggc

SEQ ID NO: 879637 - RNA, 18 nt, Human
agugcugggauuacaggc

SEQ ID NO: 879638 - RNA, 26 nt, Human
auaaaacaaaaaacaaaaaaaaccuu

SEQ ID NO: 879639 - RNA, 27 nt, Human
auaaaacaaaaaacaaaaaaaaccuuu

SEQ ID NO: 879640 - RNA, 20 nt, Human
auggugaaaccccguuucua

SEQ ID NO: 879641 - RNA, 20 nt, Human
auguauucuuucucaauuuu

SEQ ID NO: 879642 - RNA, 21 nt, Human
caaaacaguagaaaucugaac

SEQ ID NO: 879643 - RNA, 24 nt, Human
caaagugcugggauuacaggcgug

SEQ ID NO: 879644 - RNA, 23 nt, Human
caacagggaaaacaacacacucc

SEQ ID NO: 879645 - RNA, 27 nt, Human
caagaauacugcaucuauugucguaga

SEQ ID NO: 879646 - RNA, 24 nt, Human
caauauggugaaaccccguuucua

SEQ ID NO: 879647 - RNA, 23 nt, Human
cacaaucugguugaaaacagaug

SEQ ID NO: 879648 - RNA, 28 nt, Human
cacacacaccaugucacccccccugagg

SEQ ID NO: 879649 - RNA, 20 nt, Human
cacacacccacacucacaca

SEQ ID NO: 879650 - RNA, 23 nt, Human
cacacacccacacucacacaccc

SEQ ID NO: 879651 - RNA, 22 nt, Human
cacacucacacacaccauguca

SEQ ID NO: 879652 - RNA, 24 nt, Human
cacauaagacuuaaaccccuaaac

SEQ ID NO: 879653 - RNA, 20 nt, Human
caccacugcacuccagccug

SEQ ID NO: 879654 - RNA, 22 nt, Human
caccaugucaccccguggaggu

SEQ ID NO: 879655 - RNA, 21 nt, Human
cacccacacucacacacacca

SEQ ID NO: 879656 - RNA, 20 nt, Human
cacccacacucacacaccca

SEQ ID NO: 879657 - RNA, 22 nt, Human
cacccaucacuccuauuauugg

SEQ ID NO: 879658 - RNA, 23 nt, Human
caccugaggucaggaguucgaga

SEQ ID NO: 879659 - RNA, 19 nt, Human
caccuggaguugauagguc

SEQ ID NO: 879660 - RNA, 23 nt, Human
caccuguagucccagcaacuugg

SEQ ID NO: 879661 - RNA, 24 nt, Human
caccuguagucccagcaacuuggg

SEQ ID NO: 879662 - RNA, 22 nt, Human
cacuccagccugggugacagag

SEQ ID NO: 879663 - RNA, 22 nt, Human
cacuccagccugggugacagag

SEQ ID NO: 879664 - RNA, 24 nt, Human
cacuccagccugggugacagagug

SEQ ID NO: 879665 - RNA, 19 nt, Human
cacugcacuccagccuggg

SEQ ID NO: 879666 - RNA, 19 nt, Human
cacugcacuccagccuggg

SEQ ID NO: 879667 - RNA, 22 nt, Human
cacugcacuccagccuggguga

SEQ ID NO: 879668 - RNA, 23 nt, Human
cacugcacuccagccugggugac

SEQ ID NO: 879669 - RNA, 24 nt, Human
cacugcacuccagccugggugaca

SEQ ID NO: 879670 - RNA, 25 nt, Human
cacugcacuccagccugggugacag

SEQ ID NO: 879671 - RNA, 22 nt, Human
cacugccacaccaccacagggg

SEQ ID NO: 879672 - RNA, 21 nt, Human
cagcacuuuggaagguagugg

SEQ ID NO: 879673 - RNA, 24 nt, Human
cagcuuaggucccuucacccauca

SEQ ID NO: 879674 - RNA, 22 nt, Human
caggaagugccuauacuggaaa

SEQ ID NO: 879675 - RNA, 21 nt, Human
caggcgcccgccacuacgccc

SEQ ID NO: 879676 - RNA, 21 nt, Human
caggguuucgccauucacagg

SEQ ID NO: 879677 - RNA, 24 nt, Human
cagguggaucaccugaggucagga

SEQ ID NO: 879678 - RNA, 22 nt, Human
cauaggcacugccacaccacca

SEQ ID NO: 879679 - RNA, 20 nt, Human
caucacaaaacaagucccac

SEQ ID NO: 879680 - RNA, 20 nt, Human
ccaaagugcugggauuacag

SEQ ID NO: 879681 - RNA, 22 nt, Human
ccaaagugcugggauuacaggc

SEQ ID NO: 879682 - RNA, 22 nt, Human
ccaaagugcugggauuacaggc

SEQ ID NO: 879683 - RNA, 24 nt, Human
ccaaagugcugggauuacaggcgu

SEQ ID NO: 879684 - RNA, 21 nt, Human
ccacgcuccaaaggccccaga

SEQ ID NO: 879685 - RNA, 20 nt, Human
ccacugcacuccagccuggg

SEQ ID NO: 879686 - RNA, 20 nt, Human
ccacugcacuccagccuggg

SEQ ID NO: 879687 - RNA, 20 nt, Human
ccacugcacuccagccuggg

SEQ ID NO: 879688 - RNA, 20 nt, Human
ccacugcacuccagccuggg

SEQ ID NO: 879689 - RNA, 21 nt, Human
ccacugcacuccagccugggu

SEQ ID NO: 879690 - RNA, 21 nt, Human
ccacugcacuccagccugggu

SEQ ID NO: 879691 - RNA, 23 nt, Human
ccacugcacuccagccuggguga

SEQ ID NO: 879692 - RNA, 23 nt, Human
ccacugcacuccagccuggguga

SEQ ID NO: 879693 - RNA, 24 nt, Human
ccacugcacuccagccugggugac

SEQ ID NO: 879694 - RNA, 25 nt, Human
ccacugcacuccagccugggugaca

SEQ ID NO: 879695 - RNA, 22 nt, Human
ccagaacgccccggaacgcccc

SEQ ID NO: 879696 - RNA, 24 nt, Human
ccagaguagcugggacuacaggcg

SEQ ID NO: 879697 - RNA, 21 nt, Human
ccagcuuaggucccuucaccc

SEQ ID NO: 879698 - RNA, 21 nt, Human
ccaggcacaguggcuuaugcc

SEQ ID NO: 879699 - RNA, 21 nt, Human
cccagaacgccccggaacgcc

SEQ ID NO: 879700 - RNA, 20 nt, Human
cccagguucacaccauucuc

SEQ ID NO: 879701 - RNA, 21 nt, Human
ccccuaaaccaaggguuuccg

SEQ ID NO: 879702 - RNA, 19 nt, Human
cccggaacgccccggaacu

SEQ ID NO: 879703 - RNA, 21 nt, Human
cccggaagacggagguugcag

SEQ ID NO: 879704 - RNA, 23 nt, Human
cccugccggcucugccucuuuuu

SEQ ID NO: 879705 - RNA, 24 nt, Human
ccgccucagccucccaaagugcug

SEQ ID NO: 879706 - RNA, 20 nt, Human
ccgcgcccagccuuaaacca

SEQ ID NO: 879707 - RNA, 20 nt, Human
ccggaacuuccgggaucauu

SEQ ID NO: 879708 - RNA, 21 nt, Human
ccuauuauuggaccccaaagc

SEQ ID NO: 879709 - RNA, 23 nt, Human
ccugaccaauauggugaaacccc

SEQ ID NO: 879710 - RNA, 24 nt, Human
ccugaccaauauggugaaaccccg

SEQ ID NO: 879711 - RNA, 22 nt, Human
ccugaggucaggaguucgagac

SEQ ID NO: 879712 - RNA, 22 nt, Human
ccugggugacagagugggacuc

SEQ ID NO: 879713 - RNA, 20 nt, Human
ccuucacccaucacuccuau

SEQ ID NO: 879714 - RNA, 19 nt, Human
ccuuggggaaaggugaggg

SEQ ID NO: 879715 - RNA, 22 nt, Human
ccuugugauccggccgccucag

SEQ ID NO: 879716 - RNA, 24 nt, Human
cgagaccagccugaccaauauggu

SEQ ID NO: 879717 - RNA, 24 nt, Human
cgagagaccaaaacuacagaacua

SEQ ID NO: 879718 - RNA, 21 nt, Human
cgccauucacaggauggucuc

SEQ ID NO: 879719 - RNA, 18 nt, Human
cgccccggaacgccccgg

SEQ ID NO: 879720 - RNA, 27 nt, Human
cgccccggaacuuccggaaucacagag

SEQ ID NO: 879721 - RNA, 24 nt, Human
cgccucagccuccagaguagcugg

SEQ ID NO: 879722 - RNA, 24 nt, Human
cgccucagccucccaaagugcugg

SEQ ID NO: 879723 - RNA, 19 nt, Human
cgccucccagguucacacc

SEQ ID NO: 879724 - RNA, 23 nt, Human
cgcucugucacccaggcugggag

SEQ ID NO: 879725 - RNA, 20 nt, Human
cggaacuuccggaaucacag

SEQ ID NO: 879726 - RNA, 24 nt, Human
cggaagacggagguugcagugagc

SEQ ID NO: 879727 - RNA, 21 nt, Human
cuaacuuuaaggcugggcaug

SEQ ID NO: 879728 - RNA, 21 nt, Human
cucacacacaccaugucaccc

SEQ ID NO: 879729 - RNA, 22 nt, Human
cucacacacaccaugucacccc

SEQ ID NO: 879730 - RNA, 22 nt, Human
cucacacacuacgcaagguuuc

SEQ ID NO: 879731 - RNA, 24 nt, Human
cucagccuccagaguagcugggac

SEQ ID NO: 879732 - RNA, 23 nt, Human
cuccaaaggccccagaacgcccc

SEQ ID NO: 879733 - RNA, 24 nt, Human
cuccuggccuugugauccggccgc

SEQ ID NO: 879734 - RNA, 21 nt, Human
cucgcucugucacccaggcug

SEQ ID NO: 879735 - RNA, 21 nt, Human
cucggucccugccggcucugc

SEQ ID NO: 879736 - RNA, 24 nt, Human
cugacgccuguaaucccagcacuu

SEQ ID NO: 879737 - RNA, 19 nt, Human
cuggaaaggcuagaucgua

SEQ ID NO: 879738 - RNA, 26 nt, Human
cugucucaauaaaacaaaaaacaaaa

SEQ ID NO: 879739 - RNA, 19 nt, Human
cuugugugcuugcacaucu

SEQ ID NO: 879740 - RNA, 23 nt, Human
gaaacccaacaacaaaaugcccc

SEQ ID NO: 879741 - RNA, 19 nt, Human
gaacagauauaaaaacaca

SEQ ID NO: 879742 - RNA, 19 nt, Human
gaacagauauaaaaacaca

SEQ ID NO: 879743 - RNA, 22 nt, Human
gaacagauauaaaaacacagau

SEQ ID NO: 879744 - RNA, 22 nt, Human
gaacccggaagacggagguugc

SEQ ID NO: 879745 - RNA, 18 nt, Human
gaacuuuaaagccaggcg

SEQ ID NO: 879746 - RNA, 23 nt, Human
gacagagugggacucugucucaa

SEQ ID NO: 879747 - RNA, 18 nt, Human
gacaggguuucgccauuc

SEQ ID NO: 879748 - RNA, 24 nt, Human
gacgccuguaaucccagcacuuug

SEQ ID NO: 879749 - RNA, 19 nt, Human
gagaacauaggcacugcca

SEQ ID NO: 879750 - RNA, 18 nt, Human
gagagaccaaaacuacag

SEQ ID NO: 879751 - RNA, 18 nt, Human
gaggggaaggagacugag

SEQ ID NO: 879752 - RNA, 19 nt, Human
gagggguugacaagacagg

SEQ ID NO: 879753 - RNA, 21 nt, Human
gagguugcagugagccaagau

SEQ ID NO: 879754 - RNA, 23 nt, Human
gagguugcagugagccaagauug

SEQ ID NO: 879755 - RNA, 25 nt, Human
gaguagcugggacuacaggcgcccg

SEQ ID NO: 879756 - RNA, 21 nt, Human
gaucaccugaggucaggaguu

SEQ ID NO: 879757 - RNA, 24 nt, Human
gaucaccugaggucaggaguucga

SEQ ID NO: 879758 - RNA, 18 nt, Human
gauuacaggcgugagcca

SEQ ID NO: 879759 - RNA, 22 nt, Human
gauuacaggcgugagccaccgc

SEQ ID NO: 879760 - RNA, 22 nt, Human
gauuacaggcgugagccaccgc

SEQ ID NO: 879761 - RNA, 18 nt, Human
gcaaaacaguagaaaucu

SEQ ID NO: 879762 - RNA, 22 nt, Human
gcaagcuccgccucccagguuc

SEQ ID NO: 879763 - RNA, 24 nt, Human
gcacuccagccugggugacagagu

SEQ ID NO: 879764 - RNA, 21 nt, Human
gccacaccaccacaggggaca

SEQ ID NO: 879765 - RNA, 22 nt, Human
gcccagccuuaaaccaaggcuu

SEQ ID NO: 879766 - RNA, 25 nt, Human
gccccagaacgccccggaacgcccc

SEQ ID NO: 879767 - RNA, 22 nt, Human
gccccggaacuuccggaaucac

SEQ ID NO: 879768 - RNA, 23 nt, Human
gcccggcuaauuuuuuguauuuu

SEQ ID NO: 879769 - RNA, 24 nt, Human
gccgccucagccucccaaagugcu

SEQ ID NO: 879770 - RNA, 25 nt, Human
gccucccagguucacaccauucucc

SEQ ID NO: 879771 - RNA, 26 nt, Human
gcucugucacccaggcugggagucca

SEQ ID NO: 879772 - RNA, 22 nt, Human
gcuugaacccggaagacggagg

SEQ ID NO: 879773 - RNA, 22 nt, Human
ggagguugcagugagccaagau

SEQ ID NO: 879774 - RNA, 24 nt, Human
ggagguugcagugagccaagauug

SEQ ID NO: 879775 - RNA, 21 nt, Human
ggcagguggaucaccugaggu

SEQ ID NO: 879776 - RNA, 24 nt, Human
ggccuugugauccggccgccucag

SEQ ID NO: 879777 - RNA, 21 nt, Human
ggcugacgccuguaaucccag

SEQ ID NO: 879778 - RNA, 24 nt, Human
gggcaugguggcugacgccuguaa

SEQ ID NO: 879779 - RNA, 23 nt, Human
ggucucgaucuccuggccuugug

SEQ ID NO: 879780 - RNA, 24 nt, Human
gguggcugacgccuguaaucccag

SEQ ID NO: 879781 - RNA, 18 nt, Human
gguugacaagacaggccc

SEQ ID NO: 879782 - RNA, 19 nt, Human
guccaguggcacauucuca

SEQ ID NO: 879783 - RNA, 24 nt, Human
gucccugccggcucugccucuuuu

SEQ ID NO: 879784 - RNA, 24 nt, Human
gucucgcucugucacccaggcugg

SEQ ID NO: 879785 - RNA, 24 nt, Human
gugacagagugggacucugucuca

SEQ ID NO: 879786 - RNA, 24 nt, Human
gugauccggccgccucagccuccc

SEQ ID NO: 879787 - RNA, 23 nt, Human
guggcagguggaucaccugaggu

SEQ ID NO: 879788 - RNA, 23 nt, Human
guggcugacgccuguaaucccag

SEQ ID NO: 879789 - RNA, 18 nt, Human
uaaaaacacagaugugca

SEQ ID NO: 879790 - RNA, 26 nt, Human
uaaaacaaaaaacaaaaaaaaccuuu

SEQ ID NO: 879791 - RNA, 24 nt, Human
uaaagccaggcgcgguggcucaug

SEQ ID NO: 879792 - RNA, 20 nt, Human
uaaccaccacauaagacuua

SEQ ID NO: 879793 - RNA, 27 nt, Human
uaaccagaaaccucaaggauccgcguc

SEQ ID NO: 879794 - RNA, 20 nt, Human
uaagacuuaaaccccuaaac

SEQ ID NO: 879795 - RNA, 24 nt, Human
uaauuuuuuguauuuuuaguagag

SEQ ID NO: 879796 - RNA, 24 nt, Human
uacaaaaaacuaacuuuaaggcug

SEQ ID NO: 879797 - RNA, 21 nt, Human
uacagaacuagugcaugcggu

SEQ ID NO: 879798 - RNA, 24 nt, Human
uacaggcgugagccaccgcgccca

SEQ ID NO: 879799 - RNA, 21 nt, Human
uacauauucuuaaccgcagca

SEQ ID NO: 879800 - RNA, 20 nt, Human
uagagacaggguuucgccau

SEQ ID NO: 879801 - RNA, 22 nt, Human
uagcaugcaccuguagucccag

SEQ ID NO: 879802 - RNA, 24 nt, Human
uagcaugcaccuguagucccagca

SEQ ID NO: 879803 - RNA, 18 nt, Human
uaggagagaacauaggca

SEQ ID NO: 879804 - RNA, 23 nt, Human
uaggucccuucacccaucacucc

SEQ ID NO: 879805 - RNA, 19 nt, Human
uaguagagacaggguuucg

SEQ ID NO: 879806 - RNA, 26 nt, Human
uaguagagacaggguuucgccauuca

SEQ ID NO: 879807 - RNA, 19 nt, Human
uaucacacacccacacuca

SEQ ID NO: 879808 - RNA, 26 nt, Human
uaucacacacccacacucacacaccc

SEQ ID NO: 879809 - RNA, 23 nt, Human
uauccuuuguugggagacaguuc

SEQ ID NO: 879810 - RNA, 21 nt, Human
ucacaccauucucccgccuca

SEQ ID NO: 879811 - RNA, 21 nt, Human
ucacagagguccaaaagcccc

SEQ ID NO: 879812 - RNA, 20 nt, Human
ucaccugaggucaggaguuc

SEQ ID NO: 879813 - RNA, 22 nt, Human
ucacuccuauuauuggacccca

SEQ ID NO: 879814 - RNA, 25 nt, Human
ucaguucauugcaagcuccgccucc

SEQ ID NO: 879815 - RNA, 21 nt, Human
ucaugcaaaacaguagaaauc

SEQ ID NO: 879816 - RNA, 22 nt, Human
ucaugccuguuacaaaaaacua

SEQ ID NO: 879817 - RNA, 19 nt, Human
ucauugcaagcuccgccuc

SEQ ID NO: 879818 - RNA, 23 nt, Human
ucauugcaagcuccgccucccag

SEQ ID NO: 879819 - RNA, 24 nt, Human
ucauugcaagcuccgccucccagg

SEQ ID NO: 879820 - RNA, 21 nt, Human
uccaaaagccccggaacuucc

SEQ ID NO: 879821 - RNA, 24 nt, Human
uccagaguagcugggacuacaggc

SEQ ID NO: 879822 - RNA, 19 nt, Human
uccagccugggugacagag

SEQ ID NO: 879823 - RNA, 19 nt, Human
uccagccugggugacagag

SEQ ID NO: 879824 - RNA, 24 nt, Human
uccagccugggugacagaguggga

SEQ ID NO: 879825 - RNA, 24 nt, Human
ucccaaagugcugggauuacaggc

SEQ ID NO: 879826 - RNA, 19 nt, Human
ucccacgcuccaaaggccc

SEQ ID NO: 879827 - RNA, 21 nt, Human
ucccagguucacaccauucuc

SEQ ID NO: 879828 - RNA, 20 nt, Human
uccuuggggaaaggugaggg

SEQ ID NO: 879829 - RNA, 19 nt, Human
ucuaugcagguuugagaag

SEQ ID NO: 879830 - RNA, 24 nt, Human
ucucccgccucagccuccagagua

SEQ ID NO: 879831 - RNA, 19 nt, Human
ucucgcucugucacccagg

SEQ ID NO: 879832 - RNA, 23 nt, Human
ucucgcucugucacccaggcugg

SEQ ID NO: 879833 - RNA, 23 nt, Human
ucucgcucugucacccaggcugg

SEQ ID NO: 879834 - RNA, 24 nt, Human
ucucgcucugucacccaggcuggg

SEQ ID NO: 879835 - RNA, 24 nt, Human
ucucgcucugucacccaggcuggg

SEQ ID NO: 879836 - RNA, 25 nt, Human
ucucgcucugucacccaggcuggga

SEQ ID NO: 879837 - RNA, 18 nt, Human
ucugucacccaggcuggg

SEQ ID NO: 879838 - RNA, 18 nt, Human
ugaaaacagaugaugcaa

SEQ ID NO: 879839 - RNA, 19 nt, Human
ugaaaaguccauaaacaca

SEQ ID NO: 879840 - RNA, 24 nt, Human
ugaacccggaagacggagguugca

SEQ ID NO: 879841 - RNA, 23 nt, Human
ugaccaauauggugaaaccccgu

SEQ ID NO: 879842 - RNA, 18 nt, Human
ugagacagagucucgcuc

SEQ ID NO: 879843 - RNA, 22 nt, Human
ugagacagagucucgcucuguc

SEQ ID NO: 879844 - RNA, 24 nt, Human
ugagacaggagaauggcuugaacc

SEQ ID NO: 879845 - RNA, 21 nt, Human
ugcaaaacaguagaaaucuga

SEQ ID NO: 879846 - RNA, 21 nt, Human
ugcaccacugcacuccagccu

SEQ ID NO: 879847 - RNA, 21 nt, Human
ugcaccuguagucccagcaac

SEQ ID NO: 879848 - RNA, 24 nt, Human
ugcaccuguagucccagcaacuug

SEQ ID NO: 879849 - RNA, 18 nt, Human
ugccuaggagagaacaua
